United States Patent 7,655,785 (BIOINFORMATICALLY DETECTABLE GROUP OF NOVEL REGULATORY OLIGONUCLEOTIDES AND USES THEREOF) - sequence listing, part 24

SEQ ID NO: 969864 - RNA, 23 nt, Homo sapiens
acaucugccuuaaaaccaaagag

SEQ ID NO: 969865 - RNA, 22 nt, Homo sapiens
acaucuuuucuaaucacagugu

SEQ ID NO: 969866 - RNA, 19 nt, Homo sapiens
acaugaaucaagcaaucca

SEQ ID NO: 969867 - RNA, 18 nt, Homo sapiens
acaugaaucccacccaca

SEQ ID NO: 969868 - RNA, 20 nt, Homo sapiens
acaugacauucuuagcugua

SEQ ID NO: 969869 - RNA, 23 nt, Homo sapiens
acaugcugaaaaauauagccuuu

SEQ ID NO: 969870 - RNA, 14 nt, Homo sapiens
acauggccuaugca

SEQ ID NO: 969871 - RNA, 17 nt, Homo sapiens
acauggccuaugcacau

SEQ ID NO: 969872 - RNA, 19 nt, Homo sapiens
acauggccuaugcacauau

SEQ ID NO: 969873 - RNA, 15 nt, Homo sapiens
acaugugacacauau

SEQ ID NO: 969874 - RNA, 18 nt, Homo sapiens
acaugugacacauaugca

SEQ ID NO: 969875 - RNA, 20 nt, Homo sapiens
acauguguagccugugcaug

SEQ ID NO: 969876 - RNA, 22 nt, Homo sapiens
acauuauuuggcuuaaaccaga

SEQ ID NO: 969877 - RNA, 14 nt, Homo sapiens
acauucacuuccag

SEQ ID NO: 969878 - RNA, 22 nt, Homo sapiens
acauucccucuaauuugaacug

SEQ ID NO: 969879 - RNA, 21 nt, Homo sapiens
acauucccuggccgcuucucc

SEQ ID NO: 969880 - RNA, 20 nt, Homo sapiens
acauucccuugauggucuca

SEQ ID NO: 969881 - RNA, 21 nt, Homo sapiens
acauucuuagcuguaacuuaa

SEQ ID NO: 969882 - RNA, 19 nt, Homo sapiens
acauugagaucacuacuca

SEQ ID NO: 969883 - RNA, 21 nt, Homo sapiens
acauugagaucacuacucagu

SEQ ID NO: 969884 - RNA, 17 nt, Homo sapiens
acauuggaaugccuugg

SEQ ID NO: 969885 - RNA, 17 nt, Homo sapiens
acauuuccaaaugaacu

SEQ ID NO: 969886 - RNA, 16 nt, Homo sapiens
acauuucuucuaguga

SEQ ID NO: 969887 - RNA, 19 nt, Homo sapiens
acauuucuuugcauuccag

SEQ ID NO: 969888 - RNA, 17 nt, Homo sapiens
acauuuuuuugcaugca

SEQ ID NO: 969889 - RNA, 14 nt, Homo sapiens
accaaaaacauuug

SEQ ID NO: 969890 - RNA, 16 nt, Homo sapiens
accaaagcugcccacu

SEQ ID NO: 969891 - RNA, 13 nt, Homo sapiens
accaaaguaacug

SEQ ID NO: 969892 - RNA, 23 nt, Homo sapiens
accaaaucccugggguaaaagcu

SEQ ID NO: 969893 - RNA, 13 nt, Homo sapiens
accaacaaaaaga

SEQ ID NO: 969894 - RNA, 15 nt, Homo sapiens
accaaggacugagca

SEQ ID NO: 969895 - RNA, 13 nt, Homo sapiens
accaauaauguau

SEQ ID NO: 969896 - RNA, 13 nt, Homo sapiens
agauaagcaagag

SEQ ID NO: 969897 - RNA, 17 nt, Homo sapiens
agauaauuguuucauuc

SEQ ID NO: 969898 - RNA, 22 nt, Homo sapiens
agauaauuguuucauucauccu

SEQ ID NO: 969899 - RNA, 19 nt, Homo sapiens
agauaccuugcaaagcaac

SEQ ID NO: 969900 - RNA, 16 nt, Homo sapiens
agauagcuacagugua

SEQ ID NO: 969901 - RNA, 17 nt, Homo sapiens
agauaguguaacuugcu

SEQ ID NO: 969902 - RNA, 21 nt, Homo sapiens
agauauguugaauuaacauaa

SEQ ID NO: 969903 - RNA, 17 nt, Homo sapiens
agauauucagaaguaua

SEQ ID NO: 969904 - RNA, 22 nt, Homo sapiens
agauauuguugaaauaauugaa

SEQ ID NO: 969905 - RNA, 17 nt, Homo sapiens
agaucacgucacugcac

SEQ ID NO: 969906 - RNA, 13 nt, Homo sapiens
agaucacugccac

SEQ ID NO: 969907 - RNA, 22 nt, Homo sapiens
agaucacugccacacucuccau

SEQ ID NO: 969908 - RNA, 20 nt, Homo sapiens
agaucacuuucucaguuuuc

SEQ ID NO: 969909 - RNA, 17 nt, Homo sapiens
agaucagcgacugccac

SEQ ID NO: 969910 - RNA, 18 nt, Homo sapiens
agaucuggagcaacagcu

SEQ ID NO: 969911 - RNA, 20 nt, Homo sapiens
agaucuugaauagucucauc

SEQ ID NO: 969912 - RNA, 16 nt, Homo sapiens
agaucuuucucuuccc

SEQ ID NO: 969913 - RNA, 14 nt, Homo sapiens
agaugagugauccu

SEQ ID NO: 969914 - RNA, 20 nt, Homo sapiens
agauggaguucuugugccau

SEQ ID NO: 969915 - RNA, 22 nt, Homo sapiens
agauguacuuuuuaaaucaugu

SEQ ID NO: 969916 - RNA, 19 nt, Homo sapiens
agaugugagccuugugcau

SEQ ID NO: 969917 - RNA, 19 nt, Homo sapiens
agauguggcuacugacaua

SEQ ID NO: 969918 - RNA, 19 nt, Homo sapiens
agauguuuuggggacucau

SEQ ID NO: 969919 - RNA, 13 nt, Homo sapiens
agauuaaguauaa

SEQ ID NO: 969920 - RNA, 15 nt, Homo sapiens
agauuauaacaaauu

SEQ ID NO: 969921 - RNA, 17 nt, Homo sapiens
agauugggauacuguaa

SEQ ID NO: 969922 - RNA, 19 nt, Homo sapiens
agauuguguuuguucauaa

SEQ ID NO: 969923 - RNA, 18 nt, Homo sapiens
agauuugaugggccacaa

SEQ ID NO: 969924 - RNA, 23 nt, Homo sapiens
agcaaaggggagucucagcuuuc

SEQ ID NO: 969925 - RNA, 17 nt, Homo sapiens
agcaaauaaagaccuga

SEQ ID NO: 969926 - RNA, 12 nt, Homo sapiens
agcaacauuugu

SEQ ID NO: 969927 - RNA, 19 nt, Homo sapiens
agcaacccuggguuuucag

SEQ ID NO: 969928 - RNA, 23 nt, Homo sapiens
agcaacugcuggggagacaaauc

SEQ ID NO: 969929 - RNA, 16 nt, Homo sapiens
agcaacuucauuugac

SEQ ID NO: 969930 - RNA, 15 nt, Homo sapiens
agcaagccagaccua

SEQ ID NO: 969931 - RNA, 18 nt, Homo sapiens
agcaaguguucacugcuc

SEQ ID NO: 969932 - RNA, 14 nt, Homo sapiens
agcaauccagccuc

SEQ ID NO: 969933 - RNA, 22 nt, Homo sapiens
agcacaagcaggugaacuggga

SEQ ID NO: 969934 - RNA, 20 nt, Homo sapiens
agcaccgugucaagcugcuc

SEQ ID NO: 969935 - RNA, 18 nt, Homo sapiens
agcaccuccagccugaac

SEQ ID NO: 969936 - RNA, 14 nt, Homo sapiens
agcacggacuguca

SEQ ID NO: 969937 - RNA, 20 nt, Homo sapiens
agcacggacugucaguucuc

SEQ ID NO: 969938 - RNA, 12 nt, Homo sapiens
agcacuucccac

SEQ ID NO: 969939 - RNA, 21 nt, Homo sapiens
agcagaaaaaaaagugucuca

SEQ ID NO: 969940 - RNA, 16 nt, Homo sapiens
agcagauaccuugcaa

SEQ ID NO: 969941 - RNA, 14 nt, Homo sapiens
agcagcccugcucu

SEQ ID NO: 969942 - RNA, 18 nt, Homo sapiens
agcagcccugcucugggg

SEQ ID NO: 969943 - RNA, 22 nt, Homo sapiens
agcagcccugcucuggggugcu

SEQ ID NO: 969944 - RNA, 14 nt, Homo sapiens
agcagcuggugcuc

SEQ ID NO: 969945 - RNA, 15 nt, Homo sapiens
agcaggccacugggg

SEQ ID NO: 969946 - RNA, 13 nt, Homo sapiens
agcagggacaccc

SEQ ID NO: 969947 - RNA, 13 nt, Homo sapiens
agcaggugguggu

SEQ ID NO: 969948 - RNA, 14 nt, Homo sapiens
agcaguguuuuaga

SEQ ID NO: 969949 - RNA, 19 nt, Homo sapiens
agcaguuguuauuuaguga

SEQ ID NO: 969950 - RNA, 20 nt, Homo sapiens
agcauagaaaccacuagaaa

SEQ ID NO: 969951 - RNA, 20 nt, Homo sapiens
agcauauuuaaaacaaagaa

SEQ ID NO: 969952 - RNA, 22 nt, Homo sapiens
agcaugauaggauuuggggcag

SEQ ID NO: 969953 - RNA, 23 nt, Homo sapiens
agcauuccuucuuugauaauguu

SEQ ID NO: 969954 - RNA, 17 nt, Homo sapiens
agcauuucaaaauggac

SEQ ID NO: 969955 - RNA, 15 nt, Homo sapiens
agccaacaacucugc

SEQ ID NO: 969956 - RNA, 15 nt, Homo sapiens
agccaaggccgcugu

SEQ ID NO: 969957 - RNA, 17 nt, Homo sapiens
agccaaguggggugcug

SEQ ID NO: 969958 - RNA, 16 nt, Homo sapiens
agccaaugucuccucc

SEQ ID NO: 969959 - RNA, 13 nt, Homo sapiens
agccaccugcaag

SEQ ID NO: 969960 - RNA, 19 nt, Homo sapiens
agccacucaguucuuccuc

SEQ ID NO: 969961 - RNA, 19 nt, Homo sapiens
agccagagcuugaauucau

SEQ ID NO: 969962 - RNA, 22 nt, Homo sapiens
agccagcauccccaacugcgac

SEQ ID NO: 969963 - RNA, 18 nt, Homo sapiens
agccagcucccagccaca

SEQ ID NO: 969964 - RNA, 15 nt, Homo sapiens
agccaggaccacaga

SEQ ID NO: 969965 - RNA, 13 nt, Homo sapiens
agccaggaccugc

SEQ ID NO: 969966 - RNA, 23 nt, Homo sapiens
agccaggccugggggcagccucu

SEQ ID NO: 969967 - RNA, 18 nt, Homo sapiens
agccagugaggaugacag

SEQ ID NO: 969968 - RNA, 19 nt, Homo sapiens
agccaguggggaagugcgu

SEQ ID NO: 969969 - RNA, 22 nt, Homo sapiens
agccaucuaaaguaaaaaggga

SEQ ID NO: 969970 - RNA, 19 nt, Homo sapiens
agccaugaaacugacucau

SEQ ID NO: 969971 - RNA, 13 nt, Homo sapiens
agcccaaucugcc

SEQ ID NO: 969972 - RNA, 20 nt, Homo sapiens
agcccaaucugccagacuua

SEQ ID NO: 969973 - RNA, 14 nt, Homo sapiens
agccccuccaaagg

SEQ ID NO: 969974 - RNA, 12 nt, Homo sapiens
agccccugaauu

SEQ ID NO: 969975 - RNA, 23 nt, Homo sapiens
agcccuacauugugcugcaccug

SEQ ID NO: 969976 - RNA, 15 nt, Homo sapiens
agcccuucaguuugg

SEQ ID NO: 969977 - RNA, 14 nt, Homo sapiens
agcccuugcacagc

SEQ ID NO: 969978 - RNA, 20 nt, Homo sapiens
agccuaaaguauacaacugc

SEQ ID NO: 969979 - RNA, 21 nt, Homo sapiens
agccuauuuuauaugcacaaa

SEQ ID NO: 969980 - RNA, 13 nt, Homo sapiens
agccucagaaagg

SEQ ID NO: 969981 - RNA, 16 nt, Homo sapiens
agccucagaaagggau

SEQ ID NO: 969982 - RNA, 21 nt, Homo sapiens
agccucagaaagggauugcuu

SEQ ID NO: 969983 - RNA, 17 nt, Homo sapiens
agccuccgccauuccaa

SEQ ID NO: 969984 - RNA, 14 nt, Homo sapiens
agccucuccuccau

SEQ ID NO: 969985 - RNA, 15 nt, Homo sapiens
agccugaaccuuaau

SEQ ID NO: 969986 - RNA, 18 nt, Homo sapiens
agccugcuggcacccacc

SEQ ID NO: 969987 - RNA, 17 nt, Homo sapiens
agccugggccaucucuu

SEQ ID NO: 969988 - RNA, 22 nt, Homo sapiens
agccugugcauguaugucuugg

SEQ ID NO: 969989 - RNA, 23 nt, Homo sapiens
agccuuccagggauuugccucac

SEQ ID NO: 969990 - RNA, 16 nt, Homo sapiens
agccuucgaguggcca

SEQ ID NO: 969991 - RNA, 19 nt, Homo sapiens
agccuuuacuguuugauau

SEQ ID NO: 969992 - RNA, 20 nt, Homo sapiens
agcggacaagcagcuggugc

SEQ ID NO: 969993 - RNA, 13 nt, Homo sapiens
agcgucugggaac

SEQ ID NO: 969994 - RNA, 11 nt, Homo sapiens
agcuacagugu

SEQ ID NO: 969995 - RNA, 14 nt, Homo sapiens
agcuaccagguguu

SEQ ID NO: 969996 - RNA, 17 nt, Homo sapiens
agcuacucucuugccag

SEQ ID NO: 969997 - RNA, 13 nt, Homo sapiens
agcuacuguagaa

SEQ ID NO: 969998 - RNA, 16 nt, Homo sapiens
agcuauucaccucagu

SEQ ID NO: 969999 - RNA, 21 nt, Homo sapiens
agcuauuuaaguggacuguau

SEQ ID NO: 970000 - RNA, 10 nt, Homo sapiens
agcucaccag

SEQ ID NO: 970001 - RNA, 17 nt, Homo sapiens
agcucacugcagccuca

SEQ ID NO: 970002 - RNA, 16 nt, Homo sapiens
agcucauucucaccaa

SEQ ID NO: 970003 - RNA, 23 nt, Homo sapiens
agcucauuuugucugguccugau

SEQ ID NO: 970004 - RNA, 22 nt, Homo sapiens
agcuccucggacaccaagcaga

SEQ ID NO: 970005 - RNA, 17 nt, Homo sapiens
agcuccuguugucauga

SEQ ID NO: 970006 - RNA, 20 nt, Homo sapiens
agcucucccaacucuugcac

SEQ ID NO: 970007 - RNA, 14 nt, Homo sapiens
agcucucccaguga

SEQ ID NO: 970008 - RNA, 13 nt, Homo sapiens
agcugaccagaca

SEQ ID NO: 970009 - RNA, 13 nt, Homo sapiens
agcugacccaucu

SEQ ID NO: 970010 - RNA, 15 nt, Homo sapiens
agcugagugcugaaa

SEQ ID NO: 970011 - RNA, 23 nt, Homo sapiens
accacagcagagaccaccacauu

SEQ ID NO: 970012 - RNA, 21 nt, Homo sapiens
accacggccaccacugcagcc

SEQ ID NO: 970013 - RNA, 21 nt, Homo sapiens
accacugugguuuugacuuaa

SEQ ID NO: 970014 - RNA, 21 nt, Homo sapiens
accacuuucccacacugugaa

SEQ ID NO: 970015 - RNA, 15 nt, Homo sapiens
accagaaacaccccu

SEQ ID NO: 970016 - RNA, 13 nt, Homo sapiens
accagacacugcc

SEQ ID NO: 970017 - RNA, 18 nt, Homo sapiens
accagcccugaccccagu

SEQ ID NO: 970018 - RNA, 17 nt, Homo sapiens
accagccuucccaacau

SEQ ID NO: 970019 - RNA, 22 nt, Homo sapiens
accaggcaccucuuccuugaug

SEQ ID NO: 970020 - RNA, 19 nt, Homo sapiens
accauauugugcuucacag

SEQ ID NO: 970021 - RNA, 14 nt, Homo sapiens
accauuccuuucau

SEQ ID NO: 970022 - RNA, 19 nt, Homo sapiens
acccaagugccucaccucg

SEQ ID NO: 970023 - RNA, 15 nt, Homo sapiens
acccagagguggaug

SEQ ID NO: 970024 - RNA, 23 nt, Homo sapiens
acccagggugugaacauguucuc

SEQ ID NO: 970025 - RNA, 14 nt, Homo sapiens
acccagugauccca

SEQ ID NO: 970026 - RNA, 22 nt, Homo sapiens
acccaucuuuaauuuauaucag

SEQ ID NO: 970027 - RNA, 22 nt, Homo sapiens
acccauuugggugggaguguug

SEQ ID NO: 970028 - RNA, 17 nt, Homo sapiens
accccaguggauucuca

SEQ ID NO: 970029 - RNA, 17 nt, Homo sapiens
accccaucuuuacuaaa

SEQ ID NO: 970030 - RNA, 19 nt, Homo sapiens
accccaucuuuacuaaaaa

SEQ ID NO: 970031 - RNA, 14 nt, Homo sapiens
accccauuccugau

SEQ ID NO: 970032 - RNA, 15 nt, Homo sapiens
accccccgcccaugc

SEQ ID NO: 970033 - RNA, 13 nt, Homo sapiens
acccccugcccug

SEQ ID NO: 970034 - RNA, 17 nt, Homo sapiens
acccccuuccacaaugg

SEQ ID NO: 970035 - RNA, 20 nt, Homo sapiens
accccggggacccugugaca

SEQ ID NO: 970036 - RNA, 19 nt, Homo sapiens
accccuggaagagcccagu

SEQ ID NO: 970037 - RNA, 14 nt, Homo sapiens
accccugucccaac

SEQ ID NO: 970038 - RNA, 21 nt, Homo sapiens
accccugugcuccccugccac

SEQ ID NO: 970039 - RNA, 17 nt, Homo sapiens
acccguggcugauggug

SEQ ID NO: 970040 - RNA, 20 nt, Homo sapiens
acccuauucuauccaucucc

SEQ ID NO: 970041 - RNA, 15 nt, Homo sapiens
acccuccccuaguca

SEQ ID NO: 970042 - RNA, 19 nt, Homo sapiens
acccuccccuagucacuca

SEQ ID NO: 970043 - RNA, 23 nt, Homo sapiens
acccuccuccccacacagacucc

SEQ ID NO: 970044 - RNA, 22 nt, Homo sapiens
acccucuucccaucuguuucug

SEQ ID NO: 970045 - RNA, 17 nt, Homo sapiens
acccucuuccugugauc

SEQ ID NO: 970046 - RNA, 21 nt, Homo sapiens
acccugcugaacacagugucu

SEQ ID NO: 970047 - RNA, 16 nt, Homo sapiens
acccugucucuacuaa

SEQ ID NO: 970048 - RNA, 21 nt, Homo sapiens
acccuguuccugcugcugucu

SEQ ID NO: 970049 - RNA, 18 nt, Homo sapiens
acccuucaucuuccugug

SEQ ID NO: 970050 - RNA, 19 nt, Homo sapiens
accgaggugcuauccugcc

SEQ ID NO: 970051 - RNA, 13 nt, Homo sapiens
accgccacugggc

SEQ ID NO: 970052 - RNA, 11 nt, Homo sapiens
accuaauccaa

SEQ ID NO: 970053 - RNA, 23 nt, Homo sapiens
accuacgguggucggugggaccc

SEQ ID NO: 970054 - RNA, 20 nt, Homo sapiens
accuacuuuucuuuccucag

SEQ ID NO: 970055 - RNA, 16 nt, Homo sapiens
accuagaacacuaacu

SEQ ID NO: 970056 - RNA, 16 nt, Homo sapiens
accuaucccaaaugug

SEQ ID NO: 970057 - RNA, 18 nt, Homo sapiens
accucaaguguccugaaa

SEQ ID NO: 970058 - RNA, 21 nt, Homo sapiens
accucacgcucuggacaugau

SEQ ID NO: 970059 - RNA, 20 nt, Homo sapiens
accucauaaaaaucuagcac

SEQ ID NO: 970060 - RNA, 17 nt, Homo sapiens
accuccaagcauuucau

SEQ ID NO: 970061 - RNA, 22 nt, Homo sapiens
accuccaggcuccagcacaucc

SEQ ID NO: 970062 - RNA, 18 nt, Homo sapiens
accuccugaguaauaagc

SEQ ID NO: 970063 - RNA, 15 nt, Homo sapiens
accucuugccucaga

SEQ ID NO: 970064 - RNA, 20 nt, Homo sapiens
accucuugccucagagcagc

SEQ ID NO: 970065 - RNA, 13 nt, Homo sapiens
accucuuugcuca

SEQ ID NO: 970066 - RNA, 15 nt, Homo sapiens
accugauuugaugau

SEQ ID NO: 970067 - RNA, 23 nt, Homo sapiens
accugcauaaaaaggucuuuaaa

SEQ ID NO: 970068 - RNA, 19 nt, Homo sapiens
accugccaggcaggggugg

SEQ ID NO: 970069 - RNA, 22 nt, Homo sapiens
accugccccagcacucacaccc

SEQ ID NO: 970070 - RNA, 19 nt, Homo sapiens
accugcuuugugagccagc

SEQ ID NO: 970071 - RNA, 14 nt, Homo sapiens
accugggacccugc

SEQ ID NO: 970072 - RNA, 15 nt, Homo sapiens
accugggcaugacau

SEQ ID NO: 970073 - RNA, 16 nt, Homo sapiens
accugucucuaccuaa

SEQ ID NO: 970074 - RNA, 14 nt, Homo sapiens
accugugugcuugg

SEQ ID NO: 970075 - RNA, 18 nt, Homo sapiens
accuguguuaaugcuuug

SEQ ID NO: 970076 - RNA, 18 nt, Homo sapiens
accuuaagagacacucca

SEQ ID NO: 970077 - RNA, 16 nt, Homo sapiens
accuucguccuuuuaa

SEQ ID NO: 970078 - RNA, 13 nt, Homo sapiens
accuucugaugaa

SEQ ID NO: 970079 - RNA, 14 nt, Homo sapiens
accuucugaugaag

SEQ ID NO: 970080 - RNA, 19 nt, Homo sapiens
accuuguauaaauuauuca

SEQ ID NO: 970081 - RNA, 15 nt, Homo sapiens
accuugugucuguac

SEQ ID NO: 970082 - RNA, 17 nt, Homo sapiens
accuugugucuguacac

SEQ ID NO: 970083 - RNA, 13 nt, Homo sapiens
acgaugcauuuaa

SEQ ID NO: 970084 - RNA, 22 nt, Homo sapiens
acgcacgcucgcugccaucacc

SEQ ID NO: 970085 - RNA, 23 nt, Homo sapiens
acgccccacacuuuguacagacc

SEQ ID NO: 970086 - RNA, 21 nt, Homo sapiens
acggcgugccuggacacugua

SEQ ID NO: 970087 - RNA, 14 nt, Homo sapiens
acggugcugugagg

SEQ ID NO: 970088 - RNA, 13 nt, Homo sapiens
acgucagccagcu

SEQ ID NO: 970089 - RNA, 15 nt, Homo sapiens
acgugaggccugcac

SEQ ID NO: 970090 - RNA, 18 nt, Homo sapiens
acgugaggccugcacagc

SEQ ID NO: 970091 - RNA, 19 nt, Homo sapiens
acguguguccuuugguacu

SEQ ID NO: 970092 - RNA, 21 nt, Homo sapiens
acuaaaaaaccaacaauguga

SEQ ID NO: 970093 - RNA, 15 nt, Homo sapiens
acuaacagauaagca

SEQ ID NO: 970094 - RNA, 19 nt, Homo sapiens
acuacaggaggaaugcacc

SEQ ID NO: 970095 - RNA, 16 nt, Homo sapiens
acuaccucaaaggcca

SEQ ID NO: 970096 - RNA, 15 nt, Homo sapiens
acuacucagugcaua

SEQ ID NO: 970097 - RNA, 17 nt, Homo sapiens
acuacuuuuggugcuua

SEQ ID NO: 970098 - RNA, 14 nt, Homo sapiens
acuagaaggcuucu

SEQ ID NO: 970099 - RNA, 20 nt, Homo sapiens
acuagagaaaauaaauucca

SEQ ID NO: 970100 - RNA, 16 nt, Homo sapiens
acuagcaggcaugccg

SEQ ID NO: 970101 - RNA, 17 nt, Homo sapiens
acuaguccugacacuga

SEQ ID NO: 970102 - RNA, 16 nt, Homo sapiens
acuauacaagaauuaa

SEQ ID NO: 970103 - RNA, 15 nt, Homo sapiens
acuauuuuaccugaa

SEQ ID NO: 970104 - RNA, 20 nt, Homo sapiens
acucaccagccccacugcca

SEQ ID NO: 970105 - RNA, 15 nt, Homo sapiens
acucacuaugaaggu

SEQ ID NO: 970106 - RNA, 15 nt, Homo sapiens
acucauuuaucuccu

SEQ ID NO: 970107 - RNA, 22 nt, Homo sapiens
acucauuucauuccuaacacag

SEQ ID NO: 970108 - RNA, 18 nt, Homo sapiens
acuccaguuuucaaauca

SEQ ID NO: 970109 - RNA, 23 nt, Homo sapiens
acuccccauuaacagauggaaaa

SEQ ID NO: 970110 - RNA, 17 nt, Homo sapiens
acucccugcagaugcca

SEQ ID NO: 970111 - RNA, 15 nt, Homo sapiens
acuccuaugaucuga

SEQ ID NO: 970112 - RNA, 14 nt, Homo sapiens
acuccugccauagu

SEQ ID NO: 970113 - RNA, 14 nt, Homo sapiens
acuccugcuuaauc

SEQ ID NO: 970114 - RNA, 19 nt, Homo sapiens
acuccugggcucaagcaau

SEQ ID NO: 970115 - RNA, 21 nt, Homo sapiens
acuccugucccuguagcucag

SEQ ID NO: 970116 - RNA, 14 nt, Homo sapiens
acuccuuauuuggc

SEQ ID NO: 970117 - RNA, 19 nt, Homo sapiens
acuccuuuuccacuuuaaa

SEQ ID NO: 970118 - RNA, 21 nt, Homo sapiens
acucgcccucgccaguggugu

SEQ ID NO: 970119 - RNA, 18 nt, Homo sapiens
acucuaacaaacaagaga

SEQ ID NO: 970120 - RNA, 23 nt, Homo sapiens
acucuccaaacgggauacaggag

SEQ ID NO: 970121 - RNA, 18 nt, Homo sapiens
acucucccuggagcugcu

SEQ ID NO: 970122 - RNA, 23 nt, Homo sapiens
acucucuaccagauaacugagga

SEQ ID NO: 970123 - RNA, 19 nt, Homo sapiens
acucucuugccagcauuuu

SEQ ID NO: 970124 - RNA, 12 nt, Homo sapiens
acucugcacaug

SEQ ID NO: 970125 - RNA, 23 nt, Homo sapiens
agcugaucugcggaucucagcuu

SEQ ID NO: 970126 - RNA, 21 nt, Homo sapiens
agcugcagcucuccaccagcu

SEQ ID NO: 970127 - RNA, 22 nt, Homo sapiens
agcugcagcucuccaccagcug

SEQ ID NO: 970128 - RNA, 23 nt, Homo sapiens
agcugcaggcuuugccauuguga

SEQ ID NO: 970129 - RNA, 12 nt, Homo sapiens
agcugcaucauc

SEQ ID NO: 970130 - RNA, 23 nt, Homo sapiens
agcuggcucuccaccuuguuaca

SEQ ID NO: 970131 - RNA, 16 nt, Homo sapiens
agcuggcucugugagg

SEQ ID NO: 970132 - RNA, 20 nt, Homo sapiens
agcuggcuuuucccauuuca

SEQ ID NO: 970133 - RNA, 15 nt, Homo sapiens
agcuggucuagacug

SEQ ID NO: 970134 - RNA, 22 nt, Homo sapiens
agcuguagcucccgagcuacuc

SEQ ID NO: 970135 - RNA, 14 nt, Homo sapiens
agcuguggacaaaa

SEQ ID NO: 970136 - RNA, 22 nt, Homo sapiens
agcuguuguacauuuaugauuu

SEQ ID NO: 970137 - RNA, 14 nt, Homo sapiens
agcuuaaacacauu

SEQ ID NO: 970138 - RNA, 14 nt, Homo sapiens
agcuuaaccaagau

SEQ ID NO: 970139 - RNA, 16 nt, Homo sapiens
agcuuacuagcacuuu

SEQ ID NO: 970140 - RNA, 17 nt, Homo sapiens
agcuucacucucugggg

SEQ ID NO: 970141 - RNA, 19 nt, Homo sapiens
agcuuccuguuacugagau

SEQ ID NO: 970142 - RNA, 18 nt, Homo sapiens
agcuucugcccaccuacu

SEQ ID NO: 970143 - RNA, 19 nt, Homo sapiens
agcuucugcuuuucugccc

SEQ ID NO: 970144 - RNA, 20 nt, Homo sapiens
agcuugaagaggggguuaga

SEQ ID NO: 970145 - RNA, 19 nt, Homo sapiens
agcuugggcaacagagcaa

SEQ ID NO: 970146 - RNA, 16 nt, Homo sapiens
agcuuugcugccugag

SEQ ID NO: 970147 - RNA, 18 nt, Homo sapiens
agcuuuuggagggugaua

SEQ ID NO: 970148 - RNA, 19 nt, Homo sapiens
aggaaaaaauaaaagaucu

SEQ ID NO: 970149 - RNA, 14 nt, Homo sapiens
aggaaaaauugaug

SEQ ID NO: 970150 - RNA, 13 nt, Homo sapiens
aggaaaauuccau

SEQ ID NO: 970151 - RNA, 17 nt, Homo sapiens
aggaaauaucugugaag

SEQ ID NO: 970152 - RNA, 22 nt, Homo sapiens
aggaacaaaaagguaaauccca

SEQ ID NO: 970153 - RNA, 16 nt, Homo sapiens
aggaaccucucgccau

SEQ ID NO: 970154 - RNA, 20 nt, Homo sapiens
aggaauauaugugugccuau

SEQ ID NO: 970155 - RNA, 15 nt, Homo sapiens
aggaauaucacacuc

SEQ ID NO: 970156 - RNA, 21 nt, Homo sapiens
aggaauccuggcagcccagag

SEQ ID NO: 970157 - RNA, 22 nt, Homo sapiens
aggacaaaauaaaccguguauu

SEQ ID NO: 970158 - RNA, 15 nt, Homo sapiens
aggacccgugugacu

SEQ ID NO: 970159 - RNA, 14 nt, Homo sapiens
aggaccuaucccaa

SEQ ID NO: 970160 - RNA, 17 nt, Homo sapiens
aggaccugagaccugaa

SEQ ID NO: 970161 - RNA, 17 nt, Homo sapiens
aggacgcacgcucgcug

SEQ ID NO: 970162 - RNA, 13 nt, Homo sapiens
aggacucuuccac

SEQ ID NO: 970163 - RNA, 17 nt, Homo sapiens
aggagaaaggggcccca

SEQ ID NO: 970164 - RNA, 13 nt, Homo sapiens
aggagaacaugag

SEQ ID NO: 970165 - RNA, 14 nt, Homo sapiens
aggagccagugggg

SEQ ID NO: 970166 - RNA, 22 nt, Homo sapiens
aggagccaguggggaagugcgu

SEQ ID NO: 970167 - RNA, 13 nt, Homo sapiens
aggagcuuucuca

SEQ ID NO: 970168 - RNA, 15 nt, Homo sapiens
aggaggaaaauucca

SEQ ID NO: 970169 - RNA, 18 nt, Homo sapiens
aggaggcgcccuuggcuu

SEQ ID NO: 970170 - RNA, 20 nt, Homo sapiens
aggagggggacuaaacucaa

SEQ ID NO: 970171 - RNA, 15 nt, Homo sapiens
aggagugccagcuca

SEQ ID NO: 970172 - RNA, 14 nt, Homo sapiens
aggaguuacuggau

SEQ ID NO: 970173 - RNA, 17 nt, Homo sapiens
aggaucucaaacuugau

SEQ ID NO: 970174 - RNA, 23 nt, Homo sapiens
aggaugagagcccagagguaaca

SEQ ID NO: 970175 - RNA, 15 nt, Homo sapiens
aggaugaugccaguu

SEQ ID NO: 970176 - RNA, 15 nt, Homo sapiens
aggaugcagcacugc

SEQ ID NO: 970177 - RNA, 22 nt, Homo sapiens
aggauucccuucugggcuucau

SEQ ID NO: 970178 - RNA, 13 nt, Homo sapiens
aggcaagagauga

SEQ ID NO: 970179 - RNA, 13 nt, Homo sapiens
aggcaagcagcug

SEQ ID NO: 970180 - RNA, 19 nt, Homo sapiens
aggcagcagggaagcaacc

SEQ ID NO: 970181 - RNA, 15 nt, Homo sapiens
aggcagcgaccucaa

SEQ ID NO: 970182 - RNA, 17 nt, Homo sapiens
aggcaggagaauggugu

SEQ ID NO: 970183 - RNA, 17 nt, Homo sapiens
aggcagguugagacuac

SEQ ID NO: 970184 - RNA, 16 nt, Homo sapiens
aggcaguagaacucca

SEQ ID NO: 970185 - RNA, 18 nt, Homo sapiens
aggcaguauuuugugucc

SEQ ID NO: 970186 - RNA, 17 nt, Homo sapiens
aggcagugggucuuccc

SEQ ID NO: 970187 - RNA, 16 nt, Homo sapiens
aggcauagaggcuucu

SEQ ID NO: 970188 - RNA, 18 nt, Homo sapiens
aggcaugaagaagccacu

SEQ ID NO: 970189 - RNA, 21 nt, Homo sapiens
aggcauucuggaccucugggu

SEQ ID NO: 970190 - RNA, 14 nt, Homo sapiens
aggcauuugccuaa

SEQ ID NO: 970191 - RNA, 14 nt, Homo sapiens
aggccacaccacag

SEQ ID NO: 970192 - RNA, 14 nt, Homo sapiens
aggccacuggggac

SEQ ID NO: 970193 - RNA, 14 nt, Homo sapiens
aggccccagcugga

SEQ ID NO: 970194 - RNA, 15 nt, Homo sapiens
aggccgcuguggccu

SEQ ID NO: 970195 - RNA, 14 nt, Homo sapiens
aggccugcacagcu

SEQ ID NO: 970196 - RNA, 23 nt, Homo sapiens
aggcgcccuuggcuucugugaug

SEQ ID NO: 970197 - RNA, 18 nt, Homo sapiens
aggcgcugagacugugcu

SEQ ID NO: 970198 - RNA, 18 nt, Homo sapiens
aggcgggcggcacgccaa

SEQ ID NO: 970199 - RNA, 13 nt, Homo sapiens
aggcuaagcacuu

SEQ ID NO: 970200 - RNA, 14 nt, Homo sapiens
aggcuccagcacau

SEQ ID NO: 970201 - RNA, 14 nt, Homo sapiens
aggcuccagcacuu

SEQ ID NO: 970202 - RNA, 17 nt, Homo sapiens
aggcuccagcacuucag

SEQ ID NO: 970203 - RNA, 18 nt, Homo sapiens
aggcucucgcacaccucu

SEQ ID NO: 970204 - RNA, 19 nt, Homo sapiens
aggcucucgcacaccucug

SEQ ID NO: 970205 - RNA, 16 nt, Homo sapiens
aggcugccccucucac

SEQ ID NO: 970206 - RNA, 20 nt, Homo sapiens
aggcuggagugcaguggcau

SEQ ID NO: 970207 - RNA, 11 nt, Homo sapiens
aggcugucacc

SEQ ID NO: 970208 - RNA, 23 nt, Homo sapiens
aggcugucacccuccaccgagcc

SEQ ID NO: 970209 - RNA, 10 nt, Homo sapiens
aggcuuccug

SEQ ID NO: 970210 - RNA, 14 nt, Homo sapiens
aggcuucucuccac

SEQ ID NO: 970211 - RNA, 20 nt, Homo sapiens
agggaagaaaaagcaagugu

SEQ ID NO: 970212 - RNA, 23 nt, Homo sapiens
agggaagaacuauugugcucaga

SEQ ID NO: 970213 - RNA, 20 nt, Homo sapiens
agggaagaaugaacacuccc

SEQ ID NO: 970214 - RNA, 20 nt, Homo sapiens
agggauuaggagcagcucuu

SEQ ID NO: 970215 - RNA, 15 nt, Homo sapiens
agggcaagaucucag

SEQ ID NO: 970216 - RNA, 18 nt, Homo sapiens
agggcugggccagugcau

SEQ ID NO: 970217 - RNA, 18 nt, Homo sapiens
aggggcaacuguaugaaa

SEQ ID NO: 970218 - RNA, 17 nt, Homo sapiens
aggggccucccugugac

SEQ ID NO: 970219 - RNA, 16 nt, Homo sapiens
agggggucucuguuaa

SEQ ID NO: 970220 - RNA, 13 nt, Homo sapiens
agggguuccucaa

SEQ ID NO: 970221 - RNA, 15 nt, Homo sapiens
agggguuucuucaag

SEQ ID NO: 970222 - RNA, 15 nt, Homo sapiens
aggguuccaaagggc

SEQ ID NO: 970223 - RNA, 18 nt, Homo sapiens
aggguuccgccacuccag

SEQ ID NO: 970224 - RNA, 20 nt, Homo sapiens
agguaccagcugcgcuugcu

SEQ ID NO: 970225 - RNA, 21 nt, Homo sapiens
agguaccagcugcgcuugcuu

SEQ ID NO: 970226 - RNA, 21 nt, Homo sapiens
agguagcauucuuuggaguua

SEQ ID NO: 970227 - RNA, 15 nt, Homo sapiens
agguaguacugggaa

SEQ ID NO: 970228 - RNA, 12 nt, Homo sapiens
aggucacuggaa

SEQ ID NO: 970229 - RNA, 22 nt, Homo sapiens
aggucaucaugaaagguuaaaa

SEQ ID NO: 970230 - RNA, 11 nt, Homo sapiens
aggucaugccu

SEQ ID NO: 970231 - RNA, 21 nt, Homo sapiens
agguccuuaggccucugagaa

SEQ ID NO: 970232 - RNA, 20 nt, Homo sapiens
agguccuuguuguuucuugc

SEQ ID NO: 970233 - RNA, 18 nt, Homo sapiens
aggucuucaaucuuaaaa

SEQ ID NO: 970234 - RNA, 21 nt, Homo sapiens
aggugacaugugaaaccuuuu

SEQ ID NO: 970235 - RNA, 20 nt, Homo sapiens
aggugauccacccaccucag

SEQ ID NO: 970236 - RNA, 15 nt, Homo sapiens
aggugaucucuggga

SEQ ID NO: 970237 - RNA, 13 nt, Homo sapiens
aggugcacuggga

SEQ ID NO: 970238 - RNA, 19 nt, Homo sapiens
aggugggccuugcuaccuc

SEQ ID NO: 970239 - RNA, 16 nt, Homo sapiens
agguuaaauuucaagc

SEQ ID NO: 970240 - RNA, 19 nt, Homo sapiens
acucugcacaugucuugua

SEQ ID NO: 970241 - RNA, 21 nt, Homo sapiens
acucuggaguucaucagaguu

SEQ ID NO: 970242 - RNA, 17 nt, Homo sapiens
acucuuccaccucccaa

SEQ ID NO: 970243 - RNA, 16 nt, Homo sapiens
acucuucccucucuca

SEQ ID NO: 970244 - RNA, 18 nt, Homo sapiens
acucuucuuuaagccaua

SEQ ID NO: 970245 - RNA, 14 nt, Homo sapiens
acugaaaaugugcu

SEQ ID NO: 970246 - RNA, 12 nt, Homo sapiens
acugaaacugga

SEQ ID NO: 970247 - RNA, 13 nt, Homo sapiens
acugaagaccucc

SEQ ID NO: 970248 - RNA, 12 nt, Homo sapiens
acugaagccaca

SEQ ID NO: 970249 - RNA, 17 nt, Homo sapiens
acugaccauauugugcu

SEQ ID NO: 970250 - RNA, 16 nt, Homo sapiens
acugccacacucucca

SEQ ID NO: 970251 - RNA, 14 nt, Homo sapiens
acugccacaucauu

SEQ ID NO: 970252 - RNA, 13 nt, Homo sapiens
acugccagcagca

SEQ ID NO: 970253 - RNA, 20 nt, Homo sapiens
acugccaggaguagugagcu

SEQ ID NO: 970254 - RNA, 17 nt, Homo sapiens
acugccaggcuguuuca

SEQ ID NO: 970255 - RNA, 23 nt, Homo sapiens
acugccauuuuuugucugugaua

SEQ ID NO: 970256 - RNA, 14 nt, Homo sapiens
acugcgacugugac

SEQ ID NO: 970257 - RNA, 20 nt, Homo sapiens
acugcuucccuuacuuugcu

SEQ ID NO: 970258 - RNA, 13 nt, Homo sapiens
acuggacccuguu

SEQ ID NO: 970259 - RNA, 19 nt, Homo sapiens
acuggagguugaagccaag

SEQ ID NO: 970260 - RNA, 21 nt, Homo sapiens
acuggauggaaagacaaacug

SEQ ID NO: 970261 - RNA, 13 nt, Homo sapiens
acuggcagaucau

SEQ ID NO: 970262 - RNA, 20 nt, Homo sapiens
acuggccuuacgauggcaau

SEQ ID NO: 970263 - RNA, 21 nt, Homo sapiens
acuggcuggaggaaguggggu

SEQ ID NO: 970264 - RNA, 18 nt, Homo sapiens
acugggaggcagggcucu

SEQ ID NO: 970265 - RNA, 16 nt, Homo sapiens
acuggggcaagcuccu

SEQ ID NO: 970266 - RNA, 17 nt, Homo sapiens
acugggucugacaugaa

SEQ ID NO: 970267 - RNA, 22 nt, Homo sapiens
acugguauuguuuacguuugau

SEQ ID NO: 970268 - RNA, 19 nt, Homo sapiens
acuggugagguugaggaau

SEQ ID NO: 970269 - RNA, 15 nt, Homo sapiens
acugguuuucugcca

SEQ ID NO: 970270 - RNA, 23 nt, Homo sapiens
acuguagccacagcugcuguucu

SEQ ID NO: 970271 - RNA, 22 nt, Homo sapiens
acuguauuucggcuaugucuca

SEQ ID NO: 970272 - RNA, 13 nt, Homo sapiens
acugucaguucuc

SEQ ID NO: 970273 - RNA, 14 nt, Homo sapiens
acugucaguucucu

SEQ ID NO: 970274 - RNA, 16 nt, Homo sapiens
acuguccccuugauau

SEQ ID NO: 970275 - RNA, 21 nt, Homo sapiens
acugucucucuucucagagug

SEQ ID NO: 970276 - RNA, 15 nt, Homo sapiens
acugucuuccucaaa

SEQ ID NO: 970277 - RNA, 12 nt, Homo sapiens
acugucuuucag

SEQ ID NO: 970278 - RNA, 21 nt, Homo sapiens
acugugaccuagagacuucac

SEQ ID NO: 970279 - RNA, 18 nt, Homo sapiens
acugugcuguuguucucg

SEQ ID NO: 970280 - RNA, 16 nt, Homo sapiens
acuguguauuccaaga

SEQ ID NO: 970281 - RNA, 20 nt, Homo sapiens
acuguuauagaauagccuga

SEQ ID NO: 970282 - RNA, 18 nt, Homo sapiens
acuguucugauuauguaa

SEQ ID NO: 970283 - RNA, 21 nt, Homo sapiens
acuguuuuauaaacugcugua

SEQ ID NO: 970284 - RNA, 19 nt, Homo sapiens
acuuaaagcuacuguagaa

SEQ ID NO: 970285 - RNA, 18 nt, Homo sapiens
acuuaagggaacugaauc

SEQ ID NO: 970286 - RNA, 21 nt, Homo sapiens
acuuaaguuuuagaaaugaga

SEQ ID NO: 970287 - RNA, 19 nt, Homo sapiens
acuuaauugccagcaaaua

SEQ ID NO: 970288 - RNA, 19 nt, Homo sapiens
acuuaccgagucagacuuu

SEQ ID NO: 970289 - RNA, 16 nt, Homo sapiens
acuuagagaaccuaua

SEQ ID NO: 970290 - RNA, 23 nt, Homo sapiens
acuucaguacgucaccagggauc

SEQ ID NO: 970291 - RNA, 22 nt, Homo sapiens
acuucauacgauuugagccuga

SEQ ID NO: 970292 - RNA, 15 nt, Homo sapiens
acuucauuugacaca

SEQ ID NO: 970293 - RNA, 14 nt, Homo sapiens
acuucccuaaugaa

SEQ ID NO: 970294 - RNA, 15 nt, Homo sapiens
acuuccgagcuaugu

SEQ ID NO: 970295 - RNA, 18 nt, Homo sapiens
acuuccuucaaucuucau

SEQ ID NO: 970296 - RNA, 20 nt, Homo sapiens
acuucgcuaaccaacuguuc

SEQ ID NO: 970297 - RNA, 15 nt, Homo sapiens
acuucuaaaugcaua

SEQ ID NO: 970298 - RNA, 19 nt, Homo sapiens
acuucucaaguaacaugac

SEQ ID NO: 970299 - RNA, 18 nt, Homo sapiens
acuugaguuuuggcaagg

SEQ ID NO: 970300 - RNA, 19 nt, Homo sapiens
acuugcccugaacauacac

SEQ ID NO: 970301 - RNA, 19 nt, Homo sapiens
acuugcugugucugaggua

SEQ ID NO: 970302 - RNA, 22 nt, Homo sapiens
acuugcuuuaccuuuucagggc

SEQ ID NO: 970303 - RNA, 19 nt, Homo sapiens
acuuggcuggggaggacca

SEQ ID NO: 970304 - RNA, 18 nt, Homo sapiens
acuuguauagcaugaaau

SEQ ID NO: 970305 - RNA, 14 nt, Homo sapiens
acuugugauucaaa

SEQ ID NO: 970306 - RNA, 16 nt, Homo sapiens
acuuuaaaagacugaa

SEQ ID NO: 970307 - RNA, 14 nt, Homo sapiens
acuuuaaaaugcca

SEQ ID NO: 970308 - RNA, 15 nt, Homo sapiens
acuuuaauccaaaga

SEQ ID NO: 970309 - RNA, 14 nt, Homo sapiens
acuuuaguacaauu

SEQ ID NO: 970310 - RNA, 19 nt, Homo sapiens
acuuucccacacugugaac

SEQ ID NO: 970311 - RNA, 14 nt, Homo sapiens
acuuugaucucugc

SEQ ID NO: 970312 - RNA, 19 nt, Homo sapiens
acuuuguggcaaucugugg

SEQ ID NO: 970313 - RNA, 11 nt, Homo sapiens
acuuuucccac

SEQ ID NO: 970314 - RNA, 14 nt, Homo sapiens
acuuuucccacucc

SEQ ID NO: 970315 - RNA, 21 nt, Homo sapiens
acuuuucuuuccucagaucau

SEQ ID NO: 970316 - RNA, 20 nt, Homo sapiens
acuuuuuaaaucauguuccc

SEQ ID NO: 970317 - RNA, 11 nt, Homo sapiens
acuuuuugccc

SEQ ID NO: 970318 - RNA, 18 nt, Homo sapiens
agaaaaaaaagugucuca

SEQ ID NO: 970319 - RNA, 15 nt, Homo sapiens
agaaaagccucucca

SEQ ID NO: 970320 - RNA, 15 nt, Homo sapiens
agaaaauaaauucca

SEQ ID NO: 970321 - RNA, 22 nt, Homo sapiens
agaaaauuggaacucuacucaa

SEQ ID NO: 970322 - RNA, 16 nt, Homo sapiens
agaaacaaacaucuaa

SEQ ID NO: 970323 - RNA, 14 nt, Homo sapiens
agaaagaagccaua

SEQ ID NO: 970324 - RNA, 19 nt, Homo sapiens
agaaagagacuccgucuca

SEQ ID NO: 970325 - RNA, 11 nt, Homo sapiens
agaaagccaca

SEQ ID NO: 970326 - RNA, 12 nt, Homo sapiens
agaaagccacaa

SEQ ID NO: 970327 - RNA, 19 nt, Homo sapiens
agaaagccucucucucccu

SEQ ID NO: 970328 - RNA, 17 nt, Homo sapiens
agaaagcuuugaauacu

SEQ ID NO: 970329 - RNA, 19 nt, Homo sapiens
agaaauaagugcccucucc

SEQ ID NO: 970330 - RNA, 14 nt, Homo sapiens
agaaaucacaauga

SEQ ID NO: 970331 - RNA, 19 nt, Homo sapiens
agaaaucuuucucccucaa

SEQ ID NO: 970332 - RNA, 19 nt, Homo sapiens
agaaaugaauagacuaucu

SEQ ID NO: 970333 - RNA, 11 nt, Homo sapiens
agaaaugcaaa

SEQ ID NO: 970334 - RNA, 19 nt, Homo sapiens
agaaauggcaucauuauaa

SEQ ID NO: 970335 - RNA, 20 nt, Homo sapiens
agaaaugguauguagagcuu

SEQ ID NO: 970336 - RNA, 17 nt, Homo sapiens
agaaauuaaaucugaau

SEQ ID NO: 970337 - RNA, 16 nt, Homo sapiens
agaaccacacuugaaa

SEQ ID NO: 970338 - RNA, 21 nt, Homo sapiens
agaacuuagccuuuaccugug

SEQ ID NO: 970339 - RNA, 17 nt, Homo sapiens
agaagauuuuauucuua

SEQ ID NO: 970340 - RNA, 21 nt, Homo sapiens
agaagcccuguccuccacuca

SEQ ID NO: 970341 - RNA, 14 nt, Homo sapiens
agaaggaacaauaa

SEQ ID NO: 970342 - RNA, 22 nt, Homo sapiens
agaaggugccacuuuacccacc

SEQ ID NO: 970343 - RNA, 13 nt, Homo sapiens
agaaguccugcac

SEQ ID NO: 970344 - RNA, 20 nt, Homo sapiens
agaauaaaauuccuaucuca

SEQ ID NO: 970345 - RNA, 19 nt, Homo sapiens
agaauaccacaucaaauaa

SEQ ID NO: 970346 - RNA, 12 nt, Homo sapiens
agaauauuuacu

SEQ ID NO: 970347 - RNA, 20 nt, Homo sapiens
agaauauuuuagccacucaa

SEQ ID NO: 970348 - RNA, 20 nt, Homo sapiens
agaaucccuuugcaccugag

SEQ ID NO: 970349 - RNA, 16 nt, Homo sapiens
agaauccgaagggaau

SEQ ID NO: 970350 - RNA, 16 nt, Homo sapiens
agaaucgcuagacuaa

SEQ ID NO: 970351 - RNA, 12 nt, Homo sapiens
agaaugcucagg

SEQ ID NO: 970352 - RNA, 17 nt, Homo sapiens
agaauucuuuccuucau

SEQ ID NO: 970353 - RNA, 13 nt, Homo sapiens
agaauugcucaaa

SEQ ID NO: 970354 - RNA, 16 nt, Homo sapiens
agaauuuggggcuucc

SEQ ID NO: 970355 - RNA, 15 nt, Homo sapiens
agguuaauuccauuc

SEQ ID NO: 970356 - RNA, 14 nt, Homo sapiens
agguuaucgaaaua

SEQ ID NO: 970357 - RNA, 18 nt, Homo sapiens
agguuaucgaaauaacaa

SEQ ID NO: 970358 - RNA, 18 nt, Homo sapiens
agguuauugcaauaaagu

SEQ ID NO: 970359 - RNA, 17 nt, Homo sapiens
agguugagacuacuuaa

SEQ ID NO: 970360 - RNA, 18 nt, Homo sapiens
agguugcagugagccaaa

SEQ ID NO: 970361 - RNA, 19 nt, Homo sapiens
agguuggagcccagggcau

SEQ ID NO: 970362 - RNA, 20 nt, Homo sapiens
aguaaagcagaggaugcaac

SEQ ID NO: 970363 - RNA, 13 nt, Homo sapiens
aguaauaagcaug

SEQ ID NO: 970364 - RNA, 23 nt, Homo sapiens
aguaauuggucaugugaugcaag

SEQ ID NO: 970365 - RNA, 22 nt, Homo sapiens
aguacagagaaauucuguggug

SEQ ID NO: 970366 - RNA, 17 nt, Homo sapiens
aguacaucucuacuaaa

SEQ ID NO: 970367 - RNA, 18 nt, Homo sapiens
aguaccuacugugugcca

SEQ ID NO: 970368 - RNA, 16 nt, Homo sapiens
aguagaaguuacuuaa

SEQ ID NO: 970369 - RNA, 16 nt, Homo sapiens
aguagaauaagccuuc

SEQ ID NO: 970370 - RNA, 12 nt, Homo sapiens
aguagagccagc

SEQ ID NO: 970371 - RNA, 17 nt, Homo sapiens
aguaucacgauuugcag

SEQ ID NO: 970372 - RNA, 15 nt, Homo sapiens
aguaucccacaucca

SEQ ID NO: 970373 - RNA, 17 nt, Homo sapiens
aguaugguaaucuuuac

SEQ ID NO: 970374 - RNA, 15 nt, Homo sapiens
aguaugugcauuuaa

SEQ ID NO: 970375 - RNA, 19 nt, Homo sapiens
aguauguuuguacaguaug

SEQ ID NO: 970376 - RNA, 18 nt, Homo sapiens
aguauuguggggcucaua

SEQ ID NO: 970377 - RNA, 21 nt, Homo sapiens
aguauuuuguguccuccagga

SEQ ID NO: 970378 - RNA, 13 nt, Homo sapiens
agucacacugugg

SEQ ID NO: 970379 - RNA, 22 nt, Homo sapiens
agucaccugccccagcacucac

SEQ ID NO: 970380 - RNA, 23 nt, Homo sapiens
agucacuggagguugaagccaag

SEQ ID NO: 970381 - RNA, 19 nt, Homo sapiens
agucagaguccagugcucu

SEQ ID NO: 970382 - RNA, 15 nt, Homo sapiens
agucaguugcucaaa

SEQ ID NO: 970383 - RNA, 17 nt, Homo sapiens
agucauggcuaauuuaa

SEQ ID NO: 970384 - RNA, 20 nt, Homo sapiens
agucauuccaagaacuauaa

SEQ ID NO: 970385 - RNA, 22 nt, Homo sapiens
agucauugucgcucagcaauag

SEQ ID NO: 970386 - RNA, 15 nt, Homo sapiens
aguccacccugccug

SEQ ID NO: 970387 - RNA, 15 nt, Homo sapiens
agucccagcuacuug

SEQ ID NO: 970388 - RNA, 11 nt, Homo sapiens
aguccuacuca

SEQ ID NO: 970389 - RNA, 20 nt, Homo sapiens
aguccuggaagccagcuuuc

SEQ ID NO: 970390 - RNA, 15 nt, Homo sapiens
agucucauagguuaa

SEQ ID NO: 970391 - RNA, 18 nt, Homo sapiens
agucugcuuugguacuaa

SEQ ID NO: 970392 - RNA, 19 nt, Homo sapiens
agucugucugucugaugau

SEQ ID NO: 970393 - RNA, 19 nt, Homo sapiens
agucuuggaaaaaaaccac

SEQ ID NO: 970394 - RNA, 21 nt, Homo sapiens
agucuuggaaaaaaaccacag

SEQ ID NO: 970395 - RNA, 19 nt, Homo sapiens
agucuuguuuuuuauucag

SEQ ID NO: 970396 - RNA, 14 nt, Homo sapiens
agugaauacauuaa

SEQ ID NO: 970397 - RNA, 16 nt, Homo sapiens
agugacuuccugguga

SEQ ID NO: 970398 - RNA, 20 nt, Homo sapiens
agugacuuugagcugagugc

SEQ ID NO: 970399 - RNA, 12 nt, Homo sapiens
agugauccugcc

SEQ ID NO: 970400 - RNA, 13 nt, Homo sapiens
agugcaacccagu

SEQ ID NO: 970401 - RNA, 21 nt, Homo sapiens
agugcaacccagucacacugu

SEQ ID NO: 970402 - RNA, 20 nt, Homo sapiens
agugcaaccucgcugagggc

SEQ ID NO: 970403 - RNA, 9 nt, Homo sapiens
agugcccua

SEQ ID NO: 970404 - RNA, 16 nt, Homo sapiens
agugcccuuccugcug

SEQ ID NO: 970405 - RNA, 22 nt, Homo sapiens
agugcuuggaacauacuguuca

SEQ ID NO: 970406 - RNA, 19 nt, Homo sapiens
agugcuuuuacuaucugug

SEQ ID NO: 970407 - RNA, 13 nt, Homo sapiens
aguggacuguauu

SEQ ID NO: 970408 - RNA, 16 nt, Homo sapiens
aguggaguuggugaau

SEQ ID NO: 970409 - RNA, 14 nt, Homo sapiens
aguggauggaauau

SEQ ID NO: 970410 - RNA, 13 nt, Homo sapiens
aguggcaguauug

SEQ ID NO: 970411 - RNA, 12 nt, Homo sapiens
aguggccaguuc

SEQ ID NO: 970412 - RNA, 13 nt, Homo sapiens
aguggcuuuuuaa

SEQ ID NO: 970413 - RNA, 22 nt, Homo sapiens
agugggauuuccagaaccacac

SEQ ID NO: 970414 - RNA, 23 nt, Homo sapiens
aguguaaaaaaugucucauguca

SEQ ID NO: 970415 - RNA, 17 nt, Homo sapiens
aguguacccaucuuuaa

SEQ ID NO: 970416 - RNA, 16 nt, Homo sapiens
aguguagaagcauucc

SEQ ID NO: 970417 - RNA, 17 nt, Homo sapiens
aguguagcuaccuacau

SEQ ID NO: 970418 - RNA, 20 nt, Homo sapiens
aguguagcuaccuacaugcu

SEQ ID NO: 970419 - RNA, 17 nt, Homo sapiens
aguguccuucuugcucc

SEQ ID NO: 970420 - RNA, 10 nt, Homo sapiens
aguguucacu

SEQ ID NO: 970421 - RNA, 16 nt, Homo sapiens
aguguugagcaucugu

SEQ ID NO: 970422 - RNA, 20 nt, Homo sapiens
aguguugucaccagaucuga

SEQ ID NO: 970423 - RNA, 20 nt, Homo sapiens
aguguuuccuaggaggaaaa

SEQ ID NO: 970424 - RNA, 15 nt, Homo sapiens
aguuaaguaguacua

SEQ ID NO: 970425 - RNA, 16 nt, Homo sapiens
aguuacaaacagacca

SEQ ID NO: 970426 - RNA, 21 nt, Homo sapiens
aguuacacagaaaugcugcug

SEQ ID NO: 970427 - RNA, 15 nt, Homo sapiens
aguucacuguagaaa

SEQ ID NO: 970428 - RNA, 17 nt, Homo sapiens
aguucaucaccauuucc

SEQ ID NO: 970429 - RNA, 12 nt, Homo sapiens
aguucauugugg

SEQ ID NO: 970430 - RNA, 23 nt, Homo sapiens
aguuccaguugaaguuaguggaa

SEQ ID NO: 970431 - RNA, 19 nt, Homo sapiens
aguucuaaccuccuaagca

SEQ ID NO: 970432 - RNA, 20 nt, Homo sapiens
aguugaagggaauacugugc

SEQ ID NO: 970433 - RNA, 17 nt, Homo sapiens
aguugaggccacugugu

SEQ ID NO: 970434 - RNA, 19 nt, Homo sapiens
aguugcguggacucugcac

SEQ ID NO: 970435 - RNA, 23 nt, Homo sapiens
aguugcugugaacuuucauguca

SEQ ID NO: 970436 - RNA, 20 nt, Homo sapiens
aguuggaguugacugcucau

SEQ ID NO: 970437 - RNA, 15 nt, Homo sapiens
aguuucaaguuuuaa

SEQ ID NO: 970438 - RNA, 19 nt, Homo sapiens
aguuuccgugcguggcacu

SEQ ID NO: 970439 - RNA, 15 nt, Homo sapiens
aguuucuuagcuuuu

SEQ ID NO: 970440 - RNA, 14 nt, Homo sapiens
aguuucuuuucaca

SEQ ID NO: 970441 - RNA, 18 nt, Homo sapiens
aguuugugagaaacaucu

SEQ ID NO: 970442 - RNA, 19 nt, Homo sapiens
aguuugugagaaacaucuc

SEQ ID NO: 970443 - RNA, 21 nt, Homo sapiens
ccacuaaaaaaccaacaaugu

SEQ ID NO: 970444 - RNA, 17 nt, Homo sapiens
ccacuaaaaauauuguu

SEQ ID NO: 970445 - RNA, 12 nt, Homo sapiens
ccacuaaacuac

SEQ ID NO: 970446 - RNA, 15 nt, Homo sapiens
ccacuccaccuccac

SEQ ID NO: 970447 - RNA, 23 nt, Homo sapiens
ccacugcaugcagaaacuuggau

SEQ ID NO: 970448 - RNA, 18 nt, Homo sapiens
ccacuggggcaagcuccu

SEQ ID NO: 970449 - RNA, 16 nt, Homo sapiens
ccagaaggaaccagcc

SEQ ID NO: 970450 - RNA, 17 nt, Homo sapiens
ccagacauggaccucca

SEQ ID NO: 970451 - RNA, 12 nt, Homo sapiens
ccagacccagug

SEQ ID NO: 970452 - RNA, 22 nt, Homo sapiens
ccagacuaaaggauccagagag

SEQ ID NO: 970453 - RNA, 16 nt, Homo sapiens
ccagagcagaugcaga

SEQ ID NO: 970454 - RNA, 21 nt, Homo sapiens
ccagauacacuaaaguuacaa

SEQ ID NO: 970455 - RNA, 15 nt, Homo sapiens
ccagauacaugguga

SEQ ID NO: 970456 - RNA, 22 nt, Homo sapiens
ccagauacauggugaugguuag

SEQ ID NO: 970457 - RNA, 21 nt, Homo sapiens
ccagaugcuggacacccucuu

SEQ ID NO: 970458 - RNA, 14 nt, Homo sapiens
ccagauugcucugc

SEQ ID NO: 970459 - RNA, 22 nt, Homo sapiens
ccagcacucacacccuaacuca

SEQ ID NO: 970460 - RNA, 22 nt, Homo sapiens
ccagcacuucauacgauuugag

SEQ ID NO: 970461 - RNA, 13 nt, Homo sapiens
ccagcaggagcca

SEQ ID NO: 970462 - RNA, 16 nt, Homo sapiens
ccagcaucuggaagau

SEQ ID NO: 970463 - RNA, 19 nt, Homo sapiens
ccagccagacccuggagag

SEQ ID NO: 970464 - RNA, 15 nt, Homo sapiens
ccagccccacugcca

SEQ ID NO: 970465 - RNA, 15 nt, Homo sapiens
ccagccuacauucac

SEQ ID NO: 970466 - RNA, 19 nt, Homo sapiens
ccagccuggccaacauggc

SEQ ID NO: 970467 - RNA, 23 nt, Homo sapiens
ccagccuucuccaggacaaccug

SEQ ID NO: 970468 - RNA, 17 nt, Homo sapiens
ccagcuacucaggaguc

SEQ ID NO: 970469 - RNA, 14 nt, Homo sapiens
ccagcucauucuca

SEQ ID NO: 970470 - RNA, 21 nt, Homo sapiens
ccagcuggccuggacaguauc

SEQ ID NO: 970471 - RNA, 18 nt, Homo sapiens
ccaggaaagagcagucag

SEQ ID NO: 970472 - RNA, 16 nt, Homo sapiens
ccaggaauaggcauuu

SEQ ID NO: 970473 - RNA, 17 nt, Homo sapiens
ccaggaguagugagcug

SEQ ID NO: 970474 - RNA, 14 nt, Homo sapiens
ccaggauacuggca

SEQ ID NO: 970475 - RNA, 13 nt, Homo sapiens
ccaggauuugcac

SEQ ID NO: 970476 - RNA, 14 nt, Homo sapiens
ccaggcaggggugg

SEQ ID NO: 970477 - RNA, 23 nt, Homo sapiens
ccaggcaugaaauucuuccuaau

SEQ ID NO: 970478 - RNA, 21 nt, Homo sapiens
ccaggccacccaaaggagcuc

SEQ ID NO: 970479 - RNA, 17 nt, Homo sapiens
ccaggcuccagcacauc

SEQ ID NO: 970480 - RNA, 20 nt, Homo sapiens
ccaggcucucgcacaccucu

SEQ ID NO: 970481 - RNA, 17 nt, Homo sapiens
ccaggcuggagugcagu

SEQ ID NO: 970482 - RNA, 21 nt, Homo sapiens
ccaggcuucugcuggggccug

SEQ ID NO: 970483 - RNA, 16 nt, Homo sapiens
ccagggaguccagggu

SEQ ID NO: 970484 - RNA, 20 nt, Homo sapiens
ccagggcagggucugggcug

SEQ ID NO: 970485 - RNA, 23 nt, Homo sapiens
ccagguagaaaagaaaugguaug

SEQ ID NO: 970486 - RNA, 12 nt, Homo sapiens
ccagguggcaaa

SEQ ID NO: 970487 - RNA, 22 nt, Homo sapiens
ccagguguucuacacucaucuu

SEQ ID NO: 970488 - RNA, 13 nt, Homo sapiens
ccaguacauuuaa

SEQ ID NO: 970489 - RNA, 23 nt, Homo sapiens
ccagucccuguccggaaugccac

SEQ ID NO: 970490 - RNA, 21 nt, Homo sapiens
ccagucuuccugacacuuuaa

SEQ ID NO: 970491 - RNA, 12 nt, Homo sapiens
ccagugauccca

SEQ ID NO: 970492 - RNA, 14 nt, Homo sapiens
ccagugccuacauc

SEQ ID NO: 970493 - RNA, 22 nt, Homo sapiens
ccaguuccucuuuugugcugcu

SEQ ID NO: 970494 - RNA, 14 nt, Homo sapiens
ccaguucugaaggu

SEQ ID NO: 970495 - RNA, 16 nt, Homo sapiens
ccaguugaucugcucu

SEQ ID NO: 970496 - RNA, 15 nt, Homo sapiens
ccauaagaggugauc

SEQ ID NO: 970497 - RNA, 14 nt, Homo sapiens
ccauacuccuauga

SEQ ID NO: 970498 - RNA, 15 nt, Homo sapiens
ccauacuucucucag

SEQ ID NO: 970499 - RNA, 17 nt, Homo sapiens
ccauauuugauaguaua

SEQ ID NO: 970500 - RNA, 15 nt, Homo sapiens
ccaucaccgcugggu

SEQ ID NO: 970501 - RNA, 13 nt, Homo sapiens
ccaucaggguucu

SEQ ID NO: 970502 - RNA, 20 nt, Homo sapiens
ccauccagaugugugcaaug

SEQ ID NO: 970503 - RNA, 21 nt, Homo sapiens
ccauccagaugugugcaaugu

SEQ ID NO: 970504 - RNA, 16 nt, Homo sapiens
ccauccccagaccagg

SEQ ID NO: 970505 - RNA, 19 nt, Homo sapiens
ccaucggugaaacuaacag

SEQ ID NO: 970506 - RNA, 18 nt, Homo sapiens
ccaucgucucggccuuca

SEQ ID NO: 970507 - RNA, 16 nt, Homo sapiens
ccaucucaaaaaaaca

SEQ ID NO: 970508 - RNA, 19 nt, Homo sapiens
ccaucuucgggaccaggau

SEQ ID NO: 970509 - RNA, 17 nt, Homo sapiens
ccaucuugugguaacuu

SEQ ID NO: 970510 - RNA, 14 nt, Homo sapiens
ccaucuuuccaucc

SEQ ID NO: 970511 - RNA, 18 nt, Homo sapiens
ccaugaaacugacucauc

SEQ ID NO: 970512 - RNA, 18 nt, Homo sapiens
ccaugaccuaguuuucca

SEQ ID NO: 970513 - RNA, 19 nt, Homo sapiens
ccaugaguuaucaugaauu

SEQ ID NO: 970514 - RNA, 21 nt, Homo sapiens
ccaugaugugaagaguuucac

SEQ ID NO: 970515 - RNA, 19 nt, Homo sapiens
ccaugcuucucaucugcaa

SEQ ID NO: 970516 - RNA, 18 nt, Homo sapiens
ccauggaagguucucugu

SEQ ID NO: 970517 - RNA, 11 nt, Homo sapiens
ccauggcuguu

SEQ ID NO: 970518 - RNA, 19 nt, Homo sapiens
ccauggcuguuggugggac

SEQ ID NO: 970519 - RNA, 21 nt, Homo sapiens
ccauggcuguuggugggaccc

SEQ ID NO: 970520 - RNA, 16 nt, Homo sapiens
ccauggugaagugcuu

SEQ ID NO: 970521 - RNA, 23 nt, Homo sapiens
ccaugugauggacacuccaggga

SEQ ID NO: 970522 - RNA, 17 nt, Homo sapiens
ccauuagagaguggcaa

SEQ ID NO: 970523 - RNA, 19 nt, Homo sapiens
ccauucacuucauaaucca

SEQ ID NO: 970524 - RNA, 16 nt, Homo sapiens
ccauucagagcuaugg

SEQ ID NO: 970525 - RNA, 20 nt, Homo sapiens
ccauucagagcuauggugcu

SEQ ID NO: 970526 - RNA, 18 nt, Homo sapiens
ccauucccagauguacca

SEQ ID NO: 970527 - RNA, 11 nt, Homo sapiens
ccauucucuga

SEQ ID NO: 970528 - RNA, 19 nt, Homo sapiens
ccauucugccgcccccucc

SEQ ID NO: 970529 - RNA, 19 nt, Homo sapiens
ccauuguccuccuuuucac

SEQ ID NO: 970530 - RNA, 11 nt, Homo sapiens
ccauuugcaau

SEQ ID NO: 970531 - RNA, 23 nt, Homo sapiens
ccauuuuaauuuuaaagugcaaa

SEQ ID NO: 970532 - RNA, 18 nt, Homo sapiens
ccauuuuuugucugugau

SEQ ID NO: 970533 - RNA, 13 nt, Homo sapiens
cccaaagugcuga

SEQ ID NO: 970534 - RNA, 14 nt, Homo sapiens
cccaagcuucccuc

SEQ ID NO: 970535 - RNA, 19 nt, Homo sapiens
cccaagugaggagugccag

SEQ ID NO: 970536 - RNA, 13 nt, Homo sapiens
cccacccagucuc

SEQ ID NO: 970537 - RNA, 14 nt, Homo sapiens
cccacccagucuca

SEQ ID NO: 970538 - RNA, 15 nt, Homo sapiens
cccaccgguccagcu

SEQ ID NO: 970539 - RNA, 22 nt, Homo sapiens
cccacgaagacaaccaucacac

SEQ ID NO: 970540 - RNA, 21 nt, Homo sapiens
cccacgggaaaggagcugcuu

SEQ ID NO: 970541 - RNA, 17 nt, Homo sapiens
cccagagggaguagaau

SEQ ID NO: 970542 - RNA, 14 nt, Homo sapiens
cccagauaacuuuc

SEQ ID NO: 970543 - RNA, 16 nt, Homo sapiens
cccagauacaugguga

SEQ ID NO: 970544 - RNA, 20 nt, Homo sapiens
cccagcauucucaggcacca

SEQ ID NO: 970545 - RNA, 21 nt, Homo sapiens
cccagccaaguccaagagggc

SEQ ID NO: 970546 - RNA, 19 nt, Homo sapiens
cccagccccacuccucugc

SEQ ID NO: 970547 - RNA, 16 nt, Homo sapiens
cccagccuacauucac

SEQ ID NO: 970548 - RNA, 20 nt, Homo sapiens
cccagccuccccgugccaaa

SEQ ID NO: 970549 - RNA, 21 nt, Homo sapiens
cccaggccccagacagggugg

SEQ ID NO: 970550 - RNA, 17 nt, Homo sapiens
cccaggccccuccaguu

SEQ ID NO: 970551 - RNA, 21 nt, Homo sapiens
cccagggacugcaaguggcca

SEQ ID NO: 970552 - RNA, 22 nt, Homo sapiens
cccagggacugcaaguggccau

SEQ ID NO: 970553 - RNA, 18 nt, Homo sapiens
cccaggggacaagggauu

SEQ ID NO: 970554 - RNA, 15 nt, Homo sapiens
cccagggugugaaca

SEQ ID NO: 970555 - RNA, 18 nt, Homo sapiens
cccagucucccuccagga

SEQ ID NO: 970556 - RNA, 12 nt, Homo sapiens
cccauccagcua

SEQ ID NO: 970557 - RNA, 20 nt, Homo sapiens
cccaucgucucggccuucac

SEQ ID NO: 970558 - RNA, 20 nt, Homo sapiens
ccuuaaggauaucaguaaau

SEQ ID NO: 970559 - RNA, 18 nt, Homo sapiens
ccuuaauuauuaacaaag

SEQ ID NO: 970560 - RNA, 19 nt, Homo sapiens
ccuuaauuauuaacaaagu

SEQ ID NO: 970561 - RNA, 20 nt, Homo sapiens
ccuucaaaauaaaaaguaau

SEQ ID NO: 970562 - RNA, 17 nt, Homo sapiens
ccuucagcuccagggaa

SEQ ID NO: 970563 - RNA, 23 nt, Homo sapiens
ccuucccuagcuuuagacccugg

SEQ ID NO: 970564 - RNA, 21 nt, Homo sapiens
ccuucgaguggccagcuucac

SEQ ID NO: 970565 - RNA, 18 nt, Homo sapiens
ccuucuauuuggggcuug

SEQ ID NO: 970566 - RNA, 20 nt, Homo sapiens
ccuucuauuuggggcuugau

SEQ ID NO: 970567 - RNA, 21 nt, Homo sapiens
ccuucugagucuccaacaucc

SEQ ID NO: 970568 - RNA, 18 nt, Homo sapiens
ccuucuggaaacugugaa

SEQ ID NO: 970569 - RNA, 14 nt, Homo sapiens
ccuugacuaaauuc

SEQ ID NO: 970570 - RNA, 18 nt, Homo sapiens
ccuugagaagccaaccac

SEQ ID NO: 970571 - RNA, 16 nt, Homo sapiens
ccuugcuuaccucuca

SEQ ID NO: 970572 - RNA, 14 nt, Homo sapiens
ccuuguuacacauu

SEQ ID NO: 970573 - RNA, 12 nt, Homo sapiens
ccuuuaucucaa

SEQ ID NO: 970574 - RNA, 13 nt, Homo sapiens
ccuuuaugugaau

SEQ ID NO: 970575 - RNA, 11 nt, Homo sapiens
ccuuuccuguc

SEQ ID NO: 970576 - RNA, 15 nt, Homo sapiens
ccuuugcuaaugcua

SEQ ID NO: 970577 - RNA, 14 nt, Homo sapiens
ccuuuuauaccugc

SEQ ID NO: 970578 - RNA, 12 nt, Homo sapiens
ccuuuucagggc

SEQ ID NO: 970579 - RNA, 22 nt, Homo sapiens
cgaccuaauugucuuuguucug

SEQ ID NO: 970580 - RNA, 20 nt, Homo sapiens
cgagaccgggcccuggguuc

SEQ ID NO: 970581 - RNA, 20 nt, Homo sapiens
cgagcuguuaccauucacaa

SEQ ID NO: 970582 - RNA, 23 nt, Homo sapiens
cgaugauguacagauucuuucag

SEQ ID NO: 970583 - RNA, 12 nt, Homo sapiens
cgaugcauuuaa

SEQ ID NO: 970584 - RNA, 16 nt, Homo sapiens
cgcaccauaaugagau

SEQ ID NO: 970585 - RNA, 16 nt, Homo sapiens
cgcacgcucgcugcca

SEQ ID NO: 970586 - RNA, 17 nt, Homo sapiens
cgccauuccaagucaac

SEQ ID NO: 970587 - RNA, 22 nt, Homo sapiens
cgccccagggcacuacauaauu

SEQ ID NO: 970588 - RNA, 16 nt, Homo sapiens
cgcccugccuccugga

SEQ ID NO: 970589 - RNA, 23 nt, Homo sapiens
cgcccugucuaaaguguauuuuc

SEQ ID NO: 970590 - RNA, 21 nt, Homo sapiens
cgcccuuggcuucugugauga

SEQ ID NO: 970591 - RNA, 22 nt, Homo sapiens
cgccuguaaucccagcacuuug

SEQ ID NO: 970592 - RNA, 18 nt, Homo sapiens
cgccuguaauuccagcua

SEQ ID NO: 970593 - RNA, 12 nt, Homo sapiens
cgcuagcauuag

SEQ ID NO: 970594 - RNA, 18 nt, Homo sapiens
cgcuagguagaacacugc

SEQ ID NO: 970595 - RNA, 22 nt, Homo sapiens
cgcuccuuugugugugugucag

SEQ ID NO: 970596 - RNA, 14 nt, Homo sapiens
cggaacauguaaaa

SEQ ID NO: 970597 - RNA, 14 nt, Homo sapiens
cggacaagcagcug

SEQ ID NO: 970598 - RNA, 20 nt, Homo sapiens
cggacaagcagcuggugcuc

SEQ ID NO: 970599 - RNA, 18 nt, Homo sapiens
cggagagagaauguauuu

SEQ ID NO: 970600 - RNA, 14 nt, Homo sapiens
cggaggccagagag

SEQ ID NO: 970601 - RNA, 17 nt, Homo sapiens
cuauuuuccaggcuucu

SEQ ID NO: 970602 - RNA, 12 nt, Homo sapiens
cuauuuugugaa

SEQ ID NO: 970603 - RNA, 17 nt, Homo sapiens
cuauuuuguuggaugac

SEQ ID NO: 970604 - RNA, 20 nt, Homo sapiens
cuauuuuugacuguagccac

SEQ ID NO: 970605 - RNA, 20 nt, Homo sapiens
cucaaauauuugcuaugaag

SEQ ID NO: 970606 - RNA, 21 nt, Homo sapiens
cucaagucugcacagagcaag

SEQ ID NO: 970607 - RNA, 22 nt, Homo sapiens
cucaaugcaguuagcugaagaa

SEQ ID NO: 970608 - RNA, 16 nt, Homo sapiens
cucacagcaaaccucu

SEQ ID NO: 970609 - RNA, 17 nt, Homo sapiens
cucaccaugaugugaag

SEQ ID NO: 970610 - RNA, 13 nt, Homo sapiens
cucacgccuguaa

SEQ ID NO: 970611 - RNA, 17 nt, Homo sapiens
cucacucccaccugcau

SEQ ID NO: 970612 - RNA, 18 nt, Homo sapiens
cucacucucccuggagcu

SEQ ID NO: 970613 - RNA, 12 nt, Homo sapiens
cucacucuucaa

SEQ ID NO: 970614 - RNA, 23 nt, Homo sapiens
cucacuuuacuuucaaguaauau

SEQ ID NO: 970615 - RNA, 23 nt, Homo sapiens
cucacuuuucccagggcaugcug

SEQ ID NO: 970616 - RNA, 16 nt, Homo sapiens
cucagaaccugcuccu

SEQ ID NO: 970617 - RNA, 14 nt, Homo sapiens
cucagaagcacaga

SEQ ID NO: 970618 - RNA, 19 nt, Homo sapiens
cucagagcuccucacuuag

SEQ ID NO: 970619 - RNA, 17 nt, Homo sapiens
cucagagugguggggga

SEQ ID NO: 970620 - RNA, 21 nt, Homo sapiens
cucagaguguggguccuucaa

SEQ ID NO: 970621 - RNA, 22 nt, Homo sapiens
cucagccuaggcccucaugaua

SEQ ID NO: 970622 - RNA, 14 nt, Homo sapiens
cucagcuccacaac

SEQ ID NO: 970623 - RNA, 22 nt, Homo sapiens
cucaggcaaagaaaaugaaaug

SEQ ID NO: 970624 - RNA, 17 nt, Homo sapiens
cucaggguucaucugaa

SEQ ID NO: 970625 - RNA, 14 nt, Homo sapiens
cucaggugcugucc

SEQ ID NO: 970626 - RNA, 13 nt, Homo sapiens
cucagguggugcc

SEQ ID NO: 970627 - RNA, 19 nt, Homo sapiens
cucagguuccuuuuucaaa

SEQ ID NO: 970628 - RNA, 22 nt, Homo sapiens
cucaguaaacgggaacaugccc

SEQ ID NO: 970629 - RNA, 21 nt, Homo sapiens
cucagucauccugcaggcaca

SEQ ID NO: 970630 - RNA, 13 nt, Homo sapiens
cucagucuauucu

SEQ ID NO: 970631 - RNA, 19 nt, Homo sapiens
cucagugcauagcgaagac

SEQ ID NO: 970632 - RNA, 16 nt, Homo sapiens
cucaguuaaaucuccu

SEQ ID NO: 970633 - RNA, 17 nt, Homo sapiens
cucaguucuacacugau

SEQ ID NO: 970634 - RNA, 21 nt, Homo sapiens
cucauaauagucguaagugga

SEQ ID NO: 970635 - RNA, 21 nt, Homo sapiens
cucauaccagcauacgcucac

SEQ ID NO: 970636 - RNA, 20 nt, Homo sapiens
cucauccucuuuuaauggca

SEQ ID NO: 970637 - RNA, 16 nt, Homo sapiens
cucaugagaagccaag

SEQ ID NO: 970638 - RNA, 20 nt, Homo sapiens
cuccaaaggucugaugucuc

SEQ ID NO: 970639 - RNA, 13 nt, Homo sapiens
cuccacaucugcc

SEQ ID NO: 970640 - RNA, 17 nt, Homo sapiens
cuccacaucugccuuaa

SEQ ID NO: 970641 - RNA, 14 nt, Homo sapiens
cuccagauucugau

SEQ ID NO: 970642 - RNA, 22 nt, Homo sapiens
cuccagcccagacccaguggac

SEQ ID NO: 970643 - RNA, 19 nt, Homo sapiens
cuccagccccugugacauc

SEQ ID NO: 970644 - RNA, 17 nt, Homo sapiens
cuccaggaaagagcagu

SEQ ID NO: 970645 - RNA, 13 nt, Homo sapiens
cuccagggcuuug

SEQ ID NO: 970646 - RNA, 14 nt, Homo sapiens
gcagcuccuggaau

SEQ ID NO: 970647 - RNA, 13 nt, Homo sapiens
gcagcuuguagua

SEQ ID NO: 970648 - RNA, 18 nt, Homo sapiens
gcaggagaauggugugaa

SEQ ID NO: 970649 - RNA, 12 nt, Homo sapiens
gcaggagccagc

SEQ ID NO: 970650 - RNA, 22 nt, Homo sapiens
gcaggaggcccuugucguggga

SEQ ID NO: 970651 - RNA, 15 nt, Homo sapiens
gcaggccacugggga

SEQ ID NO: 970652 - RNA, 21 nt, Homo sapiens
gcaggcugggacggaccagca

SEQ ID NO: 970653 - RNA, 14 nt, Homo sapiens
gcaggcugggccau

SEQ ID NO: 970654 - RNA, 20 nt, Homo sapiens
gcaggguucaagccuuccag

SEQ ID NO: 970655 - RNA, 13 nt, Homo sapiens
gcaguccuacuca

SEQ ID NO: 970656 - RNA, 13 nt, Homo sapiens
gcagugaaguaua

SEQ ID NO: 970657 - RNA, 14 nt, Homo sapiens
gcagugccuugcau

SEQ ID NO: 970658 - RNA, 16 nt, Homo sapiens
gcauaggucucuuugc

SEQ ID NO: 970659 - RNA, 15 nt, Homo sapiens
gcauccaaguuuaug

SEQ ID NO: 970660 - RNA, 20 nt, Homo sapiens
gcauccccccugcucagcaa

SEQ ID NO: 970661 - RNA, 16 nt, Homo sapiens
gcaucuucucauuccc

SEQ ID NO: 970662 - RNA, 14 nt, Homo sapiens
gcaugaccugauca

SEQ ID NO: 970663 - RNA, 16 nt, Homo sapiens
gcaugguaaugaagga

SEQ ID NO: 970664 - RNA, 24 nt, Homo sapiens
gcauguaugucuuggacacuguac

SEQ ID NO: 970665 - RNA, 16 nt, Homo sapiens
gcauguguauuuccag

SEQ ID NO: 970666 - RNA, 14 nt, Homo sapiens
gcauucacauuuag

SEQ ID NO: 970667 - RNA, 17 nt, Homo sapiens
gcauuccagcugucacu

SEQ ID NO: 970668 - RNA, 15 nt, Homo sapiens
gcauugauccaggag

SEQ ID NO: 970669 - RNA, 15 nt, Homo sapiens
gcauuuagcacagua

SEQ ID NO: 970670 - RNA, 19 nt, Homo sapiens
gcauuuucacauuuugccu

SEQ ID NO: 970671 - RNA, 12 nt, Homo sapiens
gcauuuuccucc

SEQ ID NO: 970672 - RNA, 14 nt, Homo sapiens
gccaaagacuguaa

SEQ ID NO: 970673 - RNA, 23 nt, Homo sapiens
gccaacagccccccccuugaauc

SEQ ID NO: 970674 - RNA, 19 nt, Homo sapiens
gccacaaugcaguucugag

SEQ ID NO: 970675 - RNA, 14 nt, Homo sapiens
gccacacucuccau

SEQ ID NO: 970676 - RNA, 17 nt, Homo sapiens
gccaccaaagcugccca

SEQ ID NO: 970677 - RNA, 15 nt, Homo sapiens
gccacucaaagucaa

SEQ ID NO: 970678 - RNA, 11 nt, Homo sapiens
gccagcauuuu

SEQ ID NO: 970679 - RNA, 19 nt, Homo sapiens
gccaggcuccagcacuuca

SEQ ID NO: 970680 - RNA, 21 nt, Homo sapiens
gccaggcuguaagcauucuga

SEQ ID NO: 970681 - RNA, 18 nt, Homo sapiens
gccaguggggaagugcgu

SEQ ID NO: 970682 - RNA, 20 nt, Homo sapiens
gccaucggugaaacuaacag

SEQ ID NO: 970683 - RNA, 15 nt, Homo sapiens
gccaucucuuccuca

SEQ ID NO: 970684 - RNA, 11 nt, Homo sapiens
gccaugaaucu

SEQ ID NO: 970685 - RNA, 23 nt, Homo sapiens
gccauggaagguucucugugcuc

SEQ ID NO: 970686 - RNA, 17 nt, Homo sapiens
gccauggcaacuuagag

SEQ ID NO: 970687 - RNA, 21 nt, Homo sapiens
gccauggccugcaaacuggga

SEQ ID NO: 970688 - RNA, 19 nt, Homo sapiens
gccauggugacauugugga

SEQ ID NO: 970689 - RNA, 16 nt, Homo sapiens
gccauguccaaagagg

SEQ ID NO: 970690 - RNA, 19 nt, Homo sapiens
gccauuuuuugucugugau

SEQ ID NO: 970691 - RNA, 17 nt, Homo sapiens
gcccagccuacauucac

SEQ ID NO: 970692 - RNA, 15 nt, Homo sapiens
gcccaguacauuuaa

SEQ ID NO: 970693 - RNA, 16 nt, Homo sapiens
gccccacauggcuuag

SEQ ID NO: 970694 - RNA, 13 nt, Homo sapiens
gccccacuuugaa

SEQ ID NO: 970695 - RNA, 16 nt, Homo sapiens
gccccuacugcuguga

SEQ ID NO: 970696 - RNA, 22 nt, Homo sapiens
gccccucuuccccaaugcucca

SEQ ID NO: 970697 - RNA, 19 nt, Homo sapiens
gccccugacuuaacuuuaa

SEQ ID NO: 970698 - RNA, 15 nt, Homo sapiens
gcccuacauugugcu

SEQ ID NO: 970699 - RNA, 21 nt, Homo sapiens
gcccucaugauauguccucag

SEQ ID NO: 970700 - RNA, 23 nt, Homo sapiens
gcccucuggauccagccaugccu

SEQ ID NO: 970701 - RNA, 17 nt, Homo sapiens
gcccugaggccuagacu

SEQ ID NO: 970702 - RNA, 17 nt, Homo sapiens
gcccugcacgucauggg

SEQ ID NO: 970703 - RNA, 23 nt, Homo sapiens
gcccuguccaaaagcgcccucac

SEQ ID NO: 970704 - RNA, 20 nt, Homo sapiens
gcucugugcagucacuggag

SEQ ID NO: 970705 - RNA, 17 nt, Homo sapiens
gcucuuguucuacugag

SEQ ID NO: 970706 - RNA, 15 nt, Homo sapiens
gcucuuuaccaagga

SEQ ID NO: 970707 - RNA, 22 nt, Homo sapiens
gcugaaauuuuagaaauauuca

SEQ ID NO: 970708 - RNA, 16 nt, Homo sapiens
gcugagcaaucugacc

SEQ ID NO: 970709 - RNA, 12 nt, Homo sapiens
gcugagugcuga

SEQ ID NO: 970710 - RNA, 13 nt, Homo sapiens
gcugcaccugguc

SEQ ID NO: 970711 - RNA, 15 nt, Homo sapiens
gcugcaggauggacu

SEQ ID NO: 970712 - RNA, 12 nt, Homo sapiens
gcugccaucacc

SEQ ID NO: 970713 - RNA, 20 nt, Homo sapiens
gcugccugguauauccaaaa

SEQ ID NO: 970714 - RNA, 23 nt, Homo sapiens
gcugcuggccaugaaucucugcc

SEQ ID NO: 970715 - RNA, 19 nt, Homo sapiens
gcuggacacccucuuccca

SEQ ID NO: 970716 - RNA, 17 nt, Homo sapiens
gcuggacuucuaccugc

SEQ ID NO: 970717 - RNA, 18 nt, Homo sapiens
gcuggacuucuaccugcc

SEQ ID NO: 970718 - RNA, 16 nt, Homo sapiens
gcuggagaaauggcau

SEQ ID NO: 970719 - RNA, 13 nt, Homo sapiens
gcuggagugcagu

SEQ ID NO: 970720 - RNA, 20 nt, Homo sapiens
gcuggagugcaguggcauga

SEQ ID NO: 970721 - RNA, 19 nt, Homo sapiens
gcugggaagacuauggugc

SEQ ID NO: 970722 - RNA, 14 nt, Homo sapiens
gcuggggagacaaa

SEQ ID NO: 970723 - RNA, 22 nt, Homo sapiens
gcugggggcagcaguaccaucu

SEQ ID NO: 970724 - RNA, 16 nt, Homo sapiens
gcuguauguaaacugu

SEQ ID NO: 970725 - RNA, 16 nt, Homo sapiens
gcugugcaucaguggg

SEQ ID NO: 970726 - RNA, 22 nt, Homo sapiens
gcugugggcaagccuaagggau

SEQ ID NO: 970727 - RNA, 15 nt, Homo sapiens
gcuguuaccauucac

SEQ ID NO: 970728 - RNA, 19 nt, Homo sapiens
gcuguuuuuuuugcugcua

SEQ ID NO: 970729 - RNA, 16 nt, Homo sapiens
gcuuaaaggcaguauu

SEQ ID NO: 970730 - RNA, 22 nt, Homo sapiens
gcuuaaauuucuuaugugacau

SEQ ID NO: 970731 - RNA, 17 nt, Homo sapiens
gcuuaagugagcagaac

SEQ ID NO: 970732 - RNA, 19 nt, Homo sapiens
gcuuacagggcuaggcagu

SEQ ID NO: 970733 - RNA, 18 nt, Homo sapiens
gcuuaggugccaggcugu

SEQ ID NO: 970734 - RNA, 18 nt, Homo sapiens
gcuuaucuuagaagcacu

SEQ ID NO: 970735 - RNA, 21 nt, Homo sapiens
gcuucacaguagagccagcuu

SEQ ID NO: 970736 - RNA, 14 nt, Homo sapiens
gcuucacuguauaa

SEQ ID NO: 970737 - RNA, 13 nt, Homo sapiens
gcuuccuccugcc

SEQ ID NO: 970738 - RNA, 10 nt, Homo sapiens
gcuuccucua

SEQ ID NO: 970739 - RNA, 18 nt, Homo sapiens
gcuuccucuagaagccaa

SEQ ID NO: 970740 - RNA, 14 nt, Homo sapiens
gcuucuaccuggaa

SEQ ID NO: 970741 - RNA, 17 nt, Homo sapiens
gcuucucuccacagugu

SEQ ID NO: 970742 - RNA, 17 nt, Homo sapiens
gcuuugaaaaaucucau

SEQ ID NO: 970743 - RNA, 19 nt, Homo sapiens
gcuuugaauaaauguguug

SEQ ID NO: 970744 - RNA, 15 nt, Homo sapiens
gcuuugccauuguga

SEQ ID NO: 970745 - RNA, 16 nt, Homo sapiens
gcuuugugagccagca

SEQ ID NO: 970746 - RNA, 12 nt, Homo sapiens
gcuuugugauuc

SEQ ID NO: 970747 - RNA, 15 nt, Homo sapiens
gcuuuuacuaucugu

SEQ ID NO: 970748 - RNA, 22 nt, Homo sapiens
ggaaaaaacaccaggauuuaag

SEQ ID NO: 970749 - RNA, 14 nt, Homo sapiens
ggaaaauguauuua

SEQ ID NO: 970750 - RNA, 14 nt, Homo sapiens
ggaaaauucuuaaa

SEQ ID NO: 970751 - RNA, 15 nt, Homo sapiens
ggaaacccucuccau

SEQ ID NO: 970752 - RNA, 20 nt, Homo sapiens
ggaaacucggcagcccuucc

SEQ ID NO: 970753 - RNA, 14 nt, Homo sapiens
ggaaaggggugcuu

SEQ ID NO: 970754 - RNA, 22 nt, Homo sapiens
ggaacauguaaaacaguuacaa

SEQ ID NO: 970755 - RNA, 15 nt, Homo sapiens
ggaacgucagccagc

SEQ ID NO: 970756 - RNA, 21 nt, Homo sapiens
ggaagaaaaagcaaguguuca

SEQ ID NO: 970757 - RNA, 16 nt, Homo sapiens
ggaagacaagcauuuu

SEQ ID NO: 970758 - RNA, 19 nt, Homo sapiens
ggaagacuagaggcuugca

SEQ ID NO: 970759 - RNA, 16 nt, Homo sapiens
ggaagacuauggugcu

SEQ ID NO: 970760 - RNA, 14 nt, Homo sapiens
ggaagccccaggga

SEQ ID NO: 970761 - RNA, 19 nt, Homo sapiens
ggaaggacuugacugggga

SEQ ID NO: 970762 - RNA, 23 nt, Homo sapiens
ggaaggcuguacgacacgggugg

SEQ ID NO: 970763 - RNA, 13 nt, Homo sapiens
ggaaggucuucaa

SEQ ID NO: 970764 - RNA, 14 nt, Homo sapiens
ggaagguucucugu

SEQ ID NO: 970765 - RNA, 16 nt, Homo sapiens
ggaaguuuuccuacac

SEQ ID NO: 970766 - RNA, 12 nt, Homo sapiens
ggaauaauucaa

SEQ ID NO: 970767 - RNA, 15 nt, Homo sapiens
ggaauacugugcaua

SEQ ID NO: 970768 - RNA, 21 nt, Homo sapiens
ggaauacugugcauaagccau

SEQ ID NO: 970769 - RNA, 22 nt, Homo sapiens
ggaauauaaacaggaucucaaa

SEQ ID NO: 970770 - RNA, 16 nt, Homo sapiens
ggaauuaguugggaug

SEQ ID NO: 970771 - RNA, 21 nt, Homo sapiens
ggaauuccagugccaggccag

SEQ ID NO: 970772 - RNA, 23 nt, Homo sapiens
ggaauugacugccuaugccaagu

SEQ ID NO: 970773 - RNA, 21 nt, Homo sapiens
ggacaaaauaaaccguguauu

SEQ ID NO: 970774 - RNA, 22 nt, Homo sapiens
ggacaacugcucccaccuccug

SEQ ID NO: 970775 - RNA, 23 nt, Homo sapiens
ggacaagcagcuggugcuccaag

SEQ ID NO: 970776 - RNA, 12 nt, Homo sapiens
ggacaagggauu

SEQ ID NO: 970777 - RNA, 21 nt, Homo sapiens
ggacacuuccguagacuguuu

SEQ ID NO: 970778 - RNA, 17 nt, Homo sapiens
ggacagaguagccaggu

SEQ ID NO: 970779 - RNA, 17 nt, Homo sapiens
ggacagcagaagccucc

SEQ ID NO: 970780 - RNA, 23 nt, Homo sapiens
ggacaguaucccacauccaacuc

SEQ ID NO: 970781 - RNA, 17 nt, Homo sapiens
ggaccacagagcuccug

SEQ ID NO: 970782 - RNA, 15 nt, Homo sapiens
ggaccaggauuugca

SEQ ID NO: 970783 - RNA, 18 nt, Homo sapiens
ggaccuccaggcuccagc

SEQ ID NO: 970784 - RNA, 15 nt, Homo sapiens
ggaccugagaccuga

SEQ ID NO: 970785 - RNA, 12 nt, Homo sapiens
ggacgggaugag

SEQ ID NO: 970786 - RNA, 13 nt, Homo sapiens
ggacucuuccacc

SEQ ID NO: 970787 - RNA, 19 nt, Homo sapiens
ggacucuuccaccucccaa

SEQ ID NO: 970788 - RNA, 17 nt, Homo sapiens
ggagaagagcgcagugu

SEQ ID NO: 970789 - RNA, 16 nt, Homo sapiens
ggagauaauuguuuca

SEQ ID NO: 970790 - RNA, 13 nt, Homo sapiens
ggagauacugaac

SEQ ID NO: 970791 - RNA, 21 nt, Homo sapiens
ggagaugcuucucuccuugcc

SEQ ID NO: 970792 - RNA, 14 nt, Homo sapiens
ggaggaugaugcca

SEQ ID NO: 970793 - RNA, 18 nt, Homo sapiens
ggaggcggugguagagag

SEQ ID NO: 970794 - RNA, 23 nt, Homo sapiens
ggaggucuaccugaugaaccuga

SEQ ID NO: 970795 - RNA, 14 nt, Homo sapiens
ggagugucuggaau

SEQ ID NO: 970796 - RNA, 21 nt, Homo sapiens
ggauaaagaaaagacauuuua

SEQ ID NO: 970797 - RNA, 22 nt, Homo sapiens
ggauaaauauauaaaaaagcca

SEQ ID NO: 970798 - RNA, 15 nt, Homo sapiens
ggauacuucauuaaa

SEQ ID NO: 970799 - RNA, 22 nt, Homo sapiens
ggauauugguucuuccccucau

SEQ ID NO: 970800 - RNA, 15 nt, Homo sapiens
ggaugauaguggaau

SEQ ID NO: 970801 - RNA, 17 nt, Homo sapiens
ggaugcuccggggccau

SEQ ID NO: 970802 - RNA, 14 nt, Homo sapiens
ggaugggggggcca

SEQ ID NO: 970803 - RNA, 22 nt, Homo sapiens
ggaugguuuuaucuucccuuua

SEQ ID NO: 970804 - RNA, 22 nt, Homo sapiens
ggaugucuccaucucugucuca

SEQ ID NO: 970805 - RNA, 15 nt, Homo sapiens
ggauucaauuuuaag

SEQ ID NO: 970806 - RNA, 20 nt, Homo sapiens
ggcaaaguacuugucauaga

SEQ ID NO: 970807 - RNA, 20 nt, Homo sapiens
ggcaacagagcaagacucca

SEQ ID NO: 970808 - RNA, 17 nt, Homo sapiens
ggcaagagaauugaaau

SEQ ID NO: 970809 - RNA, 22 nt, Homo sapiens
ggcaagagaauugaaaugaggu

SEQ ID NO: 970810 - RNA, 23 nt, Homo sapiens
ggcaagaggaauuacgugcucug

SEQ ID NO: 970811 - RNA, 21 nt, Homo sapiens
ggcacacaucaggaguucaau

SEQ ID NO: 970812 - RNA, 19 nt, Homo sapiens
ggcacagaagcucaucuca

SEQ ID NO: 970813 - RNA, 15 nt, Homo sapiens
ggcagaucaugaagc

SEQ ID NO: 970814 - RNA, 14 nt, Homo sapiens
ggcagcaucuucac

SEQ ID NO: 970815 - RNA, 20 nt, Homo sapiens
ggcaggagaaucgcuugaac

SEQ ID NO: 970816 - RNA, 16 nt, Homo sapiens
ggcaggagaauggugu

SEQ ID NO: 970817 - RNA, 22 nt, Homo sapiens
ggcaggcucacugccaggccag

SEQ ID NO: 970818 - RNA, 20 nt, Homo sapiens
ggcaggcugggccaugucca

SEQ ID NO: 970819 - RNA, 23 nt, Homo sapiens
ggcagguaggucggcacuuggac

SEQ ID NO: 970820 - RNA, 19 nt, Homo sapiens
ggcaguauuuuguguccuc

SEQ ID NO: 970821 - RNA, 22 nt, Homo sapiens
ggcauaggucucuuugcuuucu

SEQ ID NO: 970822 - RNA, 16 nt, Homo sapiens
ggcaucuugcuggcua

SEQ ID NO: 970823 - RNA, 14 nt, Homo sapiens
ggcaugacacucua

SEQ ID NO: 970824 - RNA, 21 nt, Homo sapiens
ggcauuuagcacaguauuuaa

SEQ ID NO: 970825 - RNA, 11 nt, Homo sapiens
ggcauuugccu

SEQ ID NO: 970826 - RNA, 16 nt, Homo sapiens
ggccaaggcuccuaug

SEQ ID NO: 970827 - RNA, 14 nt, Homo sapiens
ggccacaccacagc

SEQ ID NO: 970828 - RNA, 15 nt, Homo sapiens
ggccacccagccagg

SEQ ID NO: 970829 - RNA, 19 nt, Homo sapiens
ggccagcaagcucuucacu

SEQ ID NO: 970830 - RNA, 20 nt, Homo sapiens
ggccaggcacccccaaauca

SEQ ID NO: 970831 - RNA, 23 nt, Homo sapiens
ggccaggugguugucuuauugca

SEQ ID NO: 970832 - RNA, 15 nt, Homo sapiens
ggccauuaccaucuc

SEQ ID NO: 970833 - RNA, 13 nt, Homo sapiens
ggccauuugcaau

SEQ ID NO: 970834 - RNA, 15 nt, Homo sapiens
ggcccauacugguug

SEQ ID NO: 970835 - RNA, 23 nt, Homo sapiens
ggcccauucagagcuauggugcu

SEQ ID NO: 970836 - RNA, 18 nt, Homo sapiens
ggcccuccucucccaucc

SEQ ID NO: 970837 - RNA, 23 nt, Homo sapiens
ggcccuccucucccauccuugau

SEQ ID NO: 970838 - RNA, 13 nt, Homo sapiens
ggcccugcugagu

SEQ ID NO: 970839 - RNA, 22 nt, Homo sapiens
ggcccugggcugggugcuggga

SEQ ID NO: 970840 - RNA, 13 nt, Homo sapiens
ggccuaugcacau

SEQ ID NO: 970841 - RNA, 20 nt, Homo sapiens
ggccucccaaagugcugaga

SEQ ID NO: 970842 - RNA, 16 nt, Homo sapiens
ggccucugagaagcuc

SEQ ID NO: 970843 - RNA, 13 nt, Homo sapiens
ggccugauggugc

SEQ ID NO: 970844 - RNA, 21 nt, Homo sapiens
ggccugggaaacccucuccau

SEQ ID NO: 970845 - RNA, 16 nt, Homo sapiens
ggccuugcuaccucaa

SEQ ID NO: 970846 - RNA, 13 nt, Homo sapiens
ggccuuguaagac

SEQ ID NO: 970847 - RNA, 22 nt, Homo sapiens
ggcgcccuuggcuucugugaug

SEQ ID NO: 970848 - RNA, 22 nt, Homo sapiens
ggcgcuugcaccacuuccgucc

SEQ ID NO: 970849 - RNA, 15 nt, Homo sapiens
ggcuacucuggaaug

SEQ ID NO: 970850 - RNA, 23 nt, Homo sapiens
ggcucccccuccagccagagaca

SEQ ID NO: 970851 - RNA, 18 nt, Homo sapiens
ggcugccccucucaccaa

SEQ ID NO: 970852 - RNA, 21 nt, Homo sapiens
ggcugcucaggguucaucuga

SEQ ID NO: 970853 - RNA, 18 nt, Homo sapiens
ggcugugggcaagccuaa

SEQ ID NO: 970854 - RNA, 22 nt, Homo sapiens
ggcuguuggugggacccguggc

SEQ ID NO: 970855 - RNA, 19 nt, Homo sapiens
ggcuuaagugagcagaaca

SEQ ID NO: 970856 - RNA, 14 nt, Homo sapiens
ggcuugaagccaaa

SEQ ID NO: 970857 - RNA, 17 nt, Homo sapiens
ggcuugaagccaaagaa

SEQ ID NO: 970858 - RNA, 16 nt, Homo sapiens
ggcuugaaggccagca

SEQ ID NO: 970859 - RNA, 19 nt, Homo sapiens
ggcuuggccugcugugauu

SEQ ID NO: 970860 - RNA, 21 nt, Homo sapiens
gggaaaccccccagagcucuu

SEQ ID NO: 970861 - RNA, 18 nt, Homo sapiens
gggaagagacagcccagg

SEQ ID NO: 970862 - RNA, 20 nt, Homo sapiens
gggaccuggccccaggcugu

SEQ ID NO: 970863 - RNA, 15 nt, Homo sapiens
gggacucguggcugu

SEQ ID NO: 970864 - RNA, 12 nt, Homo sapiens
gggacucuccaa

SEQ ID NO: 970865 - RNA, 16 nt, Homo sapiens
gggagagacaggcagc

SEQ ID NO: 970866 - RNA, 11 nt, Homo sapiens
gggagccagcc

SEQ ID NO: 970867 - RNA, 13 nt, Homo sapiens
gggagcugccaag

SEQ ID NO: 970868 - RNA, 18 nt, Homo sapiens
gggaguauugaauggugg

SEQ ID NO: 970869 - RNA, 17 nt, Homo sapiens
gggcacuacauaauugc

SEQ ID NO: 970870 - RNA, 16 nt, Homo sapiens
gggcaggcugggccau

SEQ ID NO: 970871 - RNA, 11 nt, Homo sapiens
gggcauuccug

SEQ ID NO: 970872 - RNA, 14 nt, Homo sapiens
gggccacccagcca

SEQ ID NO: 970873 - RNA, 19 nt, Homo sapiens
gggccagcaggagccagcc

SEQ ID NO: 970874 - RNA, 24 nt, Homo sapiens
gggccaugcagaccucaugcccag

SEQ ID NO: 970875 - RNA, 17 nt, Homo sapiens
gggccauguccaaagag

SEQ ID NO: 970876 - RNA, 21 nt, Homo sapiens
gggcccucggugggagccaug

SEQ ID NO: 970877 - RNA, 15 nt, Homo sapiens
gggcccuguccaggu

SEQ ID NO: 970878 - RNA, 17 nt, Homo sapiens
gggccugauggugcuca

SEQ ID NO: 970879 - RNA, 14 nt, Homo sapiens
gggccugcccucau

SEQ ID NO: 970880 - RNA, 13 nt, Homo sapiens
gggccugggacaa

SEQ ID NO: 970881 - RNA, 17 nt, Homo sapiens
gggccugggacuuccau

SEQ ID NO: 970882 - RNA, 15 nt, Homo sapiens
gggccugucacugau

SEQ ID NO: 970883 - RNA, 22 nt, Homo sapiens
gggccuuaucgggcuccagcca

SEQ ID NO: 970884 - RNA, 16 nt, Homo sapiens
gggcucccaggggucu

SEQ ID NO: 970885 - RNA, 18 nt, Homo sapiens
gggcugauuuucaucaaa

SEQ ID NO: 970886 - RNA, 12 nt, Homo sapiens
ggggagacaaau

SEQ ID NO: 970887 - RNA, 18 nt, Homo sapiens
gggggagaagaagccgag

SEQ ID NO: 970888 - RNA, 15 nt, Homo sapiens
gggguggaggggugu

SEQ ID NO: 970889 - RNA, 17 nt, Homo sapiens
gggguuucuggggucca

SEQ ID NO: 970890 - RNA, 20 nt, Homo sapiens
ggguaacugggguugagggc

SEQ ID NO: 970891 - RNA, 15 nt, Homo sapiens
ggguaccuggcuaug

SEQ ID NO: 970892 - RNA, 22 nt, Homo sapiens
ggguaccuuaagagacacucca

SEQ ID NO: 970893 - RNA, 18 nt, Homo sapiens
ggguaugggaagccauau

SEQ ID NO: 970894 - RNA, 19 nt, Homo sapiens
gggucucguuuuguugcca

SEQ ID NO: 970895 - RNA, 23 nt, Homo sapiens
gggucugggcugggcaccugacu

SEQ ID NO: 970896 - RNA, 20 nt, Homo sapiens
gggucuuguuucacauuugu

SEQ ID NO: 970897 - RNA, 15 nt, Homo sapiens
gggugcuacugggga

SEQ ID NO: 970898 - RNA, 17 nt, Homo sapiens
gggugugaacauguucu

SEQ ID NO: 970899 - RNA, 19 nt, Homo sapiens
ggguuggacuguaagggau

SEQ ID NO: 970900 - RNA, 23 nt, Homo sapiens
ggguuuuuguucuggaagccaua

SEQ ID NO: 970901 - RNA, 13 nt, Homo sapiens
gguaaaacagggc

SEQ ID NO: 970902 - RNA, 19 nt, Homo sapiens
gguagaaaagaaaugguau

SEQ ID NO: 970903 - RNA, 15 nt, Homo sapiens
gguagaacacugcua

SEQ ID NO: 970904 - RNA, 13 nt, Homo sapiens
gguagauuauuca

SEQ ID NO: 970905 - RNA, 23 nt, Homo sapiens
gguagcugucuccaaaaaugcua

SEQ ID NO: 970906 - RNA, 14 nt, Homo sapiens
gguaggucggcacu

SEQ ID NO: 970907 - RNA, 14 nt, Homo sapiens
gguaguacugggaa

SEQ ID NO: 970908 - RNA, 17 nt, Homo sapiens
gguaguauuacaccacc

SEQ ID NO: 970909 - RNA, 17 nt, Homo sapiens
gguaguccccuguugau

SEQ ID NO: 970910 - RNA, 21 nt, Homo sapiens
ggucccugaggaugggucaga

SEQ ID NO: 970911 - RNA, 14 nt, Homo sapiens
aaguucucauugaa

SEQ ID NO: 970912 - RNA, 15 nt, Homo sapiens
aaguucuucuaagcu

SEQ ID NO: 970913 - RNA, 16 nt, Homo sapiens
aaguuuagcucugaga

SEQ ID NO: 970914 - RNA, 16 nt, Homo sapiens
aaguuucugucuuccu

SEQ ID NO: 970915 - RNA, 21 nt, Homo sapiens
aaguuuuguaaaagaaaucau

SEQ ID NO: 970916 - RNA, 18 nt, Homo sapiens
aauaaaaaagcucuuuua

SEQ ID NO: 970917 - RNA, 18 nt, Homo sapiens
aauaaaauuccuaucuca

SEQ ID NO: 970918 - RNA, 16 nt, Homo sapiens
aauaaauauuuaauga

SEQ ID NO: 970919 - RNA, 15 nt, Homo sapiens
aauaaauuuuccauu

SEQ ID NO: 970920 - RNA, 17 nt, Homo sapiens
aauaagaaacaugaugu

SEQ ID NO: 970921 - RNA, 18 nt, Homo sapiens
aauaagcaaucaagguua

SEQ ID NO: 970922 - RNA, 13 nt, Homo sapiens
aauaagccuucaa

SEQ ID NO: 970923 - RNA, 21 nt, Homo sapiens
aauaaguauauaauccuguga

SEQ ID NO: 970924 - RNA, 16 nt, Homo sapiens
aauaagugcgaucaca

SEQ ID NO: 970925 - RNA, 14 nt, Homo sapiens
aauaauaaaaccaa

SEQ ID NO: 970926 - RNA, 15 nt, Homo sapiens
aauaauaaauccuca

SEQ ID NO: 970927 - RNA, 13 nt, Homo sapiens
aauaauagcagau

SEQ ID NO: 970928 - RNA, 20 nt, Homo sapiens
aauaaucacgcuuuccugaa

SEQ ID NO: 970929 - RNA, 15 nt, Homo sapiens
aauacaacacauuga

SEQ ID NO: 970930 - RNA, 23 nt, Homo sapiens
aauacagacaaagcauaaucaau

SEQ ID NO: 970931 - RNA, 23 nt, Homo sapiens
aauacagaguuuuagaaaugaga

SEQ ID NO: 970932 - RNA, 15 nt, Homo sapiens
ggauggccguggaug

SEQ ID NO: 970933 - RNA, 18 nt, Homo sapiens
ggaugguuuuaucuuccc

SEQ ID NO: 970934 - RNA, 14 nt, Homo sapiens
ggauguaagccugg

SEQ ID NO: 970935 - RNA, 18 nt, Homo sapiens
ggauguaagccuggagcu

SEQ ID NO: 970936 - RNA, 15 nt, Homo sapiens
ggaugucacugccug

SEQ ID NO: 970937 - RNA, 14 nt, Homo sapiens
ggaugugugucuca

SEQ ID NO: 970938 - RNA, 24 nt, Homo sapiens
ggcaaagaaaaugaaaugcauauu

SEQ ID NO: 970939 - RNA, 19 nt, Homo sapiens
ggcaacagagcaagacucc

SEQ ID NO: 970940 - RNA, 17 nt, Homo sapiens
ggcacaguccagaccca

SEQ ID NO: 970941 - RNA, 15 nt, Homo sapiens
ggcacccucagggag

SEQ ID NO: 970942 - RNA, 13 nt, Homo sapiens
ggcacucaggggg

SEQ ID NO: 970943 - RNA, 24 nt, Homo sapiens
ggcacuccuccuacucuguggaug

SEQ ID NO: 970944 - RNA, 17 nt, Homo sapiens
ggcagcuccagugccag

SEQ ID NO: 970945 - RNA, 19 nt, Homo sapiens
ggcagcuccagugccagca

SEQ ID NO: 970946 - RNA, 22 nt, Homo sapiens
ggcagcuguagcucccgagcua

SEQ ID NO: 970947 - RNA, 18 nt, Homo sapiens
ggcaggaacaaacagggc

SEQ ID NO: 970948 - RNA, 15 nt, Homo sapiens
ggcagggcugugcuu

SEQ ID NO: 970949 - RNA, 21 nt, Homo sapiens
ggcauguggccuuuaucucaa

SEQ ID NO: 970950 - RNA, 12 nt, Homo sapiens
ggccaagcagaa

SEQ ID NO: 970951 - RNA, 22 nt, Homo sapiens
ggccaagccuaucaaaggaaau

SEQ ID NO: 970952 - RNA, 21 nt, Homo sapiens
ggccacauagaugcugaugga

SEQ ID NO: 970953 - RNA, 16 nt, Homo sapiens
ggccagccacagagca

SEQ ID NO: 970954 - RNA, 19 nt, Homo sapiens
ggccaggccacccaaagga

SEQ ID NO: 970955 - RNA, 23 nt, Homo sapiens
ggccauaaacgguuccuggugac

SEQ ID NO: 970956 - RNA, 21 nt, Homo sapiens
ggccauggaauaaaccauuuu

SEQ ID NO: 970957 - RNA, 16 nt, Homo sapiens
ggcccaccgaggugcu

SEQ ID NO: 970958 - RNA, 17 nt, Homo sapiens
ggcccagugcauaugca

SEQ ID NO: 970959 - RNA, 18 nt, Homo sapiens
ggcccauggcuguuggug

SEQ ID NO: 970960 - RNA, 17 nt, Homo sapiens
ggccccaccggggucua

SEQ ID NO: 970961 - RNA, 20 nt, Homo sapiens
ggcccuaaaggacucuccag

SEQ ID NO: 970962 - RNA, 15 nt, Homo sapiens
ggcccugcugaguca

SEQ ID NO: 970963 - RNA, 18 nt, Homo sapiens
ggcccuguuccccaagga

SEQ ID NO: 970964 - RNA, 16 nt, Homo sapiens
ggccgaggccaugugc

SEQ ID NO: 970965 - RNA, 15 nt, Homo sapiens
ggccuagcgaucucu

SEQ ID NO: 970966 - RNA, 19 nt, Homo sapiens
ggccucugagaagcucuga

SEQ ID NO: 970967 - RNA, 15 nt, Homo sapiens
ggccugagagucagc

SEQ ID NO: 970968 - RNA, 19 nt, Homo sapiens
ggcgagccaggaccacaga

SEQ ID NO: 970969 - RNA, 17 nt, Homo sapiens
ggcgaggagagggcgcu

SEQ ID NO: 970970 - RNA, 15 nt, Homo sapiens
ggcgcugagacugug

SEQ ID NO: 970971 - RNA, 20 nt, Homo sapiens
ggcggagguugcaaugagcc

SEQ ID NO: 970972 - RNA, 16 nt, Homo sapiens
ggcggcugugcaucag

SEQ ID NO: 970973 - RNA, 14 nt, Homo sapiens
ggcuagcuucugcu

SEQ ID NO: 970974 - RNA, 16 nt, Homo sapiens
ggcucaagucugcaca

SEQ ID NO: 970975 - RNA, 17 nt, Homo sapiens
ggcugcuggccaugaau

SEQ ID NO: 970976 - RNA, 14 nt, Homo sapiens
ggcuggagugcagu

SEQ ID NO: 970977 - RNA, 13 nt, Homo sapiens
ggcugggccaugu

SEQ ID NO: 970978 - RNA, 21 nt, Homo sapiens
ggcugucaaugggaccugugg

SEQ ID NO: 970979 - RNA, 20 nt, Homo sapiens
ggcuguguugguguggccca

SEQ ID NO: 970980 - RNA, 21 nt, Homo sapiens
ggcuguguugguguggcccau

SEQ ID NO: 970981 - RNA, 22 nt, Homo sapiens
ggcuguugacgcaccugugguu

SEQ ID NO: 970982 - RNA, 15 nt, Homo sapiens
ggcuuaagcaauaag

SEQ ID NO: 970983 - RNA, 15 nt, Homo sapiens
ggcuucacuguauaa

SEQ ID NO: 970984 - RNA, 19 nt, Homo sapiens
ggcuuccccagguggccug

SEQ ID NO: 970985 - RNA, 23 nt, Homo sapiens
ggcuucucucucuagcagcaccu

SEQ ID NO: 970986 - RNA, 16 nt, Homo sapiens
gggaaacccucuccau

SEQ ID NO: 970987 - RNA, 12 nt, Homo sapiens
gggaacaugccc

SEQ ID NO: 970988 - RNA, 23 nt, Homo sapiens
gggaacuuuuuuagaaaugcaaa

SEQ ID NO: 970989 - RNA, 22 nt, Homo sapiens
gggaauccaagccuccacagcg

SEQ ID NO: 970990 - RNA, 13 nt, Homo sapiens
gggaauccugcua

SEQ ID NO: 970991 - RNA, 19 nt, Homo sapiens
gggaauucgagcugggcau

SEQ ID NO: 970992 - RNA, 14 nt, Homo sapiens
gggacaagggauuu

SEQ ID NO: 970993 - RNA, 14 nt, Homo sapiens
gggacccugcacag

SEQ ID NO: 970994 - RNA, 18 nt, Homo sapiens
gggacugcaaguggccau

SEQ ID NO: 970995 - RNA, 14 nt, Homo sapiens
gggaguggguggca

SEQ ID NO: 970996 - RNA, 14 nt, Homo sapiens
accugaucauuaca

SEQ ID NO: 970997 - RNA, 20 nt, Homo sapiens
accugcagccccucaugccu

SEQ ID NO: 970998 - RNA, 18 nt, Homo sapiens
accugcguuuucauuugu

SEQ ID NO: 970999 - RNA, 17 nt, Homo sapiens
accugggugugcccacg

SEQ ID NO: 971000 - RNA, 19 nt, Homo sapiens
accuggucugguugggcag

SEQ ID NO: 971001 - RNA, 18 nt, Homo sapiens
accuguauacagugcaga

SEQ ID NO: 971002 - RNA, 17 nt, Homo sapiens
accugucucuaccuaag

SEQ ID NO: 971003 - RNA, 19 nt, Homo sapiens
accuguugguuagauucaa

SEQ ID NO: 971004 - RNA, 22 nt, Homo sapiens
accuguugguuagauucaaggc

SEQ ID NO: 971005 - RNA, 21 nt, Homo sapiens
accuuguaaucagcacauugu

SEQ ID NO: 971006 - RNA, 17 nt, Homo sapiens
accuuuuuuaagauuuu

SEQ ID NO: 971007 - RNA, 19 nt, Homo sapiens
acgaagaguucccuugaaa

SEQ ID NO: 971008 - RNA, 11 nt, Homo sapiens
acgacucuucc

SEQ ID NO: 971009 - RNA, 22 nt, Homo sapiens
acgaguggccaguucauugugg

SEQ ID NO: 971010 - RNA, 16 nt, Homo sapiens
acggacugucaguucu

SEQ ID NO: 971011 - RNA, 15 nt, Homo sapiens
acggcagcuguagcu

SEQ ID NO: 971012 - RNA, 16 nt, Homo sapiens
acgggaaaggagcugc

SEQ ID NO: 971013 - RNA, 20 nt, Homo sapiens
acggugcuaaaaaugaaaau

SEQ ID NO: 971014 - RNA, 18 nt, Homo sapiens
acgucauguguuuugcca

SEQ ID NO: 971015 - RNA, 14 nt, Homo sapiens
acgucucagcccuu

SEQ ID NO: 971016 - RNA, 16 nt, Homo sapiens
acguuuaacauacaau

SEQ ID NO: 971017 - RNA, 23 nt, Homo sapiens
acguuuguccuuuuucacuuuga

SEQ ID NO: 971018 - RNA, 13 nt, Homo sapiens
acuaaaaauugug

SEQ ID NO: 971019 - RNA, 18 nt, Homo sapiens
acuaaaaguugcauuuua

SEQ ID NO: 971020 - RNA, 14 nt, Homo sapiens
acuaaacaguaaga

SEQ ID NO: 971021 - RNA, 12 nt, Homo sapiens
acuaaaguuaac

SEQ ID NO: 971022 - RNA, 22 nt, Homo sapiens
acuaacgcaaccaagugugcua

SEQ ID NO: 971023 - RNA, 16 nt, Homo sapiens
acuaaugacaagugac

SEQ ID NO: 971024 - RNA, 16 nt, Homo sapiens
acuaaugauguuuucc

SEQ ID NO: 971025 - RNA, 14 nt, Homo sapiens
acuacaagucagcu

SEQ ID NO: 971026 - RNA, 19 nt, Homo sapiens
acuacauuugugaacaaaa

SEQ ID NO: 971027 - RNA, 22 nt, Homo sapiens
acuacuuccggcuuauggucuc

SEQ ID NO: 971028 - RNA, 13 nt, Homo sapiens
acuagauguuaag

SEQ ID NO: 971029 - RNA, 16 nt, Homo sapiens
acuauaaggugccuca

SEQ ID NO: 971030 - RNA, 22 nt, Homo sapiens
acuauucauggcuaccucagaa

SEQ ID NO: 971031 - RNA, 15 nt, Homo sapiens
acuauuuugugcucc

SEQ ID NO: 971032 - RNA, 14 nt, Homo sapiens
acucaaacugagga

SEQ ID NO: 971033 - RNA, 16 nt, Homo sapiens
acucacauuuacaagu

SEQ ID NO: 971034 - RNA, 21 nt, Homo sapiens
acucaccagccccacugccag

SEQ ID NO: 971035 - RNA, 12 nt, Homo sapiens
acucacugugau

SEQ ID NO: 971036 - RNA, 13 nt, Homo sapiens
acucacugugauc

SEQ ID NO: 971037 - RNA, 21 nt, Homo sapiens
acucacuuuucccacuccaag

SEQ ID NO: 971038 - RNA, 16 nt, Homo sapiens
acucagacauuccaag

SEQ ID NO: 971039 - RNA, 20 nt, Homo sapiens
acucagagaugaacaucuaa

SEQ ID NO: 971040 - RNA, 16 nt, Homo sapiens
acucagaucugaucaa

SEQ ID NO: 971041 - RNA, 17 nt, Homo sapiens
acucagguggugccccu

SEQ ID NO: 971042 - RNA, 18 nt, Homo sapiens
acucaguccacuguugag

SEQ ID NO: 971043 - RNA, 15 nt, Homo sapiens
acucaguucuuccuc

SEQ ID NO: 971044 - RNA, 17 nt, Homo sapiens
acucauccauccccugg

SEQ ID NO: 971045 - RNA, 17 nt, Homo sapiens
acucaucuuagugccug

SEQ ID NO: 971046 - RNA, 21 nt, Homo sapiens
acuccagcuugggcaacagag

SEQ ID NO: 971047 - RNA, 22 nt, Homo sapiens
acuccagcuugggcaacagagc

SEQ ID NO: 971048 - RNA, 19 nt, Homo sapiens
acuccauuggaucugcaag

SEQ ID NO: 971049 - RNA, 16 nt, Homo sapiens
acucccccucuuucac

SEQ ID NO: 971050 - RNA, 18 nt, Homo sapiens
acucccugcagaugccac

SEQ ID NO: 971051 - RNA, 14 nt, Homo sapiens
acuccuagcugucc

SEQ ID NO: 971052 - RNA, 16 nt, Homo sapiens
acucuaauagugcuua

SEQ ID NO: 971053 - RNA, 17 nt, Homo sapiens
acucuacucaacccauu

SEQ ID NO: 971054 - RNA, 21 nt, Homo sapiens
acucucuuuccuugagcuguu

SEQ ID NO: 971055 - RNA, 14 nt, Homo sapiens
acucugcacaugaa

SEQ ID NO: 971056 - RNA, 20 nt, Homo sapiens
acucugcacaugucuuguac

SEQ ID NO: 971057 - RNA, 19 nt, Homo sapiens
acucugggcugccauguga

SEQ ID NO: 971058 - RNA, 15 nt, Homo sapiens
acucugucuaccugg

SEQ ID NO: 971059 - RNA, 18 nt, Homo sapiens
acucuuccaccucccaac

SEQ ID NO: 971060 - RNA, 21 nt, Homo sapiens
acucuucccucucucacuccc

SEQ ID NO: 971061 - RNA, 19 nt, Homo sapiens
acucuugaauagacuucca

SEQ ID NO: 971062 - RNA, 16 nt, Homo sapiens
acucuugucacccagg

SEQ ID NO: 971063 - RNA, 13 nt, Homo sapiens
acugaaacuggaa

SEQ ID NO: 971064 - RNA, 16 nt, Homo sapiens
acugaaaugccugcuu

SEQ ID NO: 971065 - RNA, 15 nt, Homo sapiens
acugaagcugcacag

SEQ ID NO: 971066 - RNA, 18 nt, Homo sapiens
acugaagcugcacagugu

SEQ ID NO: 971067 - RNA, 18 nt, Homo sapiens
acugacugagcaggcugu

SEQ ID NO: 971068 - RNA, 16 nt, Homo sapiens
acaagcugcacuguga

SEQ ID NO: 971069 - RNA, 22 nt, Homo sapiens
acaaggagauuucuuaguucau

SEQ ID NO: 971070 - RNA, 16 nt, Homo sapiens
acaaguaugaaucuag

SEQ ID NO: 971071 - RNA, 19 nt, Homo sapiens
acaaguuagaaaacauaau

SEQ ID NO: 971072 - RNA, 14 nt, Homo sapiens
acaauaguucugug

SEQ ID NO: 971073 - RNA, 21 nt, Homo sapiens
acaauugucgaaaagagucuu

SEQ ID NO: 971074 - RNA, 19 nt, Homo sapiens
acaauuucaacuacaguga

SEQ ID NO: 971075 - RNA, 23 nt, Homo sapiens
acacaaaggaaguccaaccugag

SEQ ID NO: 971076 - RNA, 19 nt, Homo sapiens
acacacacgaugcauuuaa

SEQ ID NO: 971077 - RNA, 15 nt, Homo sapiens
acacacgaugcauuu

SEQ ID NO: 971078 - RNA, 18 nt, Homo sapiens
acacagacuccacccucc

SEQ ID NO: 971079 - RNA, 17 nt, Homo sapiens
acacauuggaaugccuu

SEQ ID NO: 971080 - RNA, 16 nt, Homo sapiens
acacauuuacccuuug

SEQ ID NO: 971081 - RNA, 23 nt, Homo sapiens
acaccacuuucccacacugugaa

SEQ ID NO: 971082 - RNA, 19 nt, Homo sapiens
acaccagagcagaugcaga

SEQ ID NO: 971083 - RNA, 22 nt, Homo sapiens
acaccagagcagaugcagagag

SEQ ID NO: 971084 - RNA, 19 nt, Homo sapiens
acacccagagggaguagaa

SEQ ID NO: 971085 - RNA, 14 nt, Homo sapiens
acacccuucuccca

SEQ ID NO: 971086 - RNA, 19 nt, Homo sapiens
acacccuucucccacucuc

SEQ ID NO: 971087 - RNA, 16 nt, Homo sapiens
acaccuauuaucccag

SEQ ID NO: 971088 - RNA, 18 nt, Homo sapiens
acaccuguagucccagcu

SEQ ID NO: 971089 - RNA, 13 nt, Homo sapiens
acacgaugcauuu

SEQ ID NO: 971090 - RNA, 20 nt, Homo sapiens
acacgaugcauuuaauaaag

SEQ ID NO: 971091 - RNA, 12 nt, Homo sapiens
acacgcauuaau

SEQ ID NO: 971092 - RNA, 14 nt, Homo sapiens
acacucuuagcuau

SEQ ID NO: 971093 - RNA, 14 nt, Homo sapiens
acacugaacuuaau

SEQ ID NO: 971094 - RNA, 15 nt, Homo sapiens
acacugaagccacag

SEQ ID NO: 971095 - RNA, 14 nt, Homo sapiens
acacugaucuggcu

SEQ ID NO: 971096 - RNA, 15 nt, Homo sapiens
acacugauggcucaa

SEQ ID NO: 971097 - RNA, 15 nt, Homo sapiens
acacugggacacugu

SEQ ID NO: 971098 - RNA, 18 nt, Homo sapiens
acacuuaaauucucuaac

SEQ ID NO: 971099 - RNA, 23 nt, Homo sapiens
acacuuagguuaauuccauucaa

SEQ ID NO: 971100 - RNA, 16 nt, Homo sapiens
acagaaaaguccacau

SEQ ID NO: 971101 - RNA, 20 nt, Homo sapiens
acagaagcggcucaguucac

SEQ ID NO: 971102 - RNA, 16 nt, Homo sapiens
acagaagcucaucuca

SEQ ID NO: 971103 - RNA, 17 nt, Homo sapiens
acagacuccacccuccu

SEQ ID NO: 971104 - RNA, 20 nt, Homo sapiens
acagagagagauuccaucuc

SEQ ID NO: 971105 - RNA, 22 nt, Homo sapiens
acagaucaagaaaaaaagggag

SEQ ID NO: 971106 - RNA, 19 nt, Homo sapiens
acagauguucccccaucuc

SEQ ID NO: 971107 - RNA, 21 nt, Homo sapiens
acagauguucccccaucucgc

SEQ ID NO: 971108 - RNA, 14 nt, Homo sapiens
acagauucuuucag

SEQ ID NO: 971109 - RNA, 22 nt, Homo sapiens
acagauuuaagaauaccugaga

SEQ ID NO: 971110 - RNA, 23 nt, Homo sapiens
aauaacuaccuuccacucuggaa

SEQ ID NO: 971111 - RNA, 13 nt, Homo sapiens
aauaagagcaguc

SEQ ID NO: 971112 - RNA, 18 nt, Homo sapiens
aauaauacugaccuaccu

SEQ ID NO: 971113 - RNA, 18 nt, Homo sapiens
aauaauuuuauuaugcaa

SEQ ID NO: 971114 - RNA, 14 nt, Homo sapiens
aauacacauuugcu

SEQ ID NO: 971115 - RNA, 22 nt, Homo sapiens
aauacauuguuguaagagugau

SEQ ID NO: 971116 - RNA, 23 nt, Homo sapiens
aauacgcagaacuaccagguggc

SEQ ID NO: 971117 - RNA, 13 nt, Homo sapiens
aauacuacaauag

SEQ ID NO: 971118 - RNA, 23 nt, Homo sapiens
aauacuacugugugugcauugaa

SEQ ID NO: 971119 - RNA, 18 nt, Homo sapiens
aauacuauuauuugcuac

SEQ ID NO: 971120 - RNA, 20 nt, Homo sapiens
aauacugugcauaagccauu

SEQ ID NO: 971121 - RNA, 18 nt, Homo sapiens
aauagcuaauaauaccuu

SEQ ID NO: 971122 - RNA, 19 nt, Homo sapiens
aauaggcuauuaaaaaagu

SEQ ID NO: 971123 - RNA, 16 nt, Homo sapiens
aauaggucaucaugaa

SEQ ID NO: 971124 - RNA, 17 nt, Homo sapiens
aauaguuuaucauuuac

SEQ ID NO: 971125 - RNA, 22 nt, Homo sapiens
aauauacuaguccugacacuga

SEQ ID NO: 971126 - RNA, 19 nt, Homo sapiens
aauauagccuuuaaaucau

SEQ ID NO: 971127 - RNA, 17 nt, Homo sapiens
aauauauaaaaaagcca

SEQ ID NO: 971128 - RNA, 14 nt, Homo sapiens
aauaucaaagucau

SEQ ID NO: 971129 - RNA, 21 nt, Homo sapiens
aauaucuacauucuauuucau

SEQ ID NO: 971130 - RNA, 14 nt, Homo sapiens
aauaugcagugaua

SEQ ID NO: 971131 - RNA, 22 nt, Homo sapiens
aauaugcuauauauuaggcaag

SEQ ID NO: 971132 - RNA, 18 nt, Homo sapiens
aauauggguugcauuugg

SEQ ID NO: 971133 - RNA, 11 nt, Homo sapiens
aauaugugcuu

SEQ ID NO: 971134 - RNA, 16 nt, Homo sapiens
aauauucuguaacuau

SEQ ID NO: 971135 - RNA, 12 nt, Homo sapiens
aaucaacucuaa

SEQ ID NO: 971136 - RNA, 23 nt, Homo sapiens
aaucaagcuuuugcuugauccag

SEQ ID NO: 971137 - RNA, 18 nt, Homo sapiens
aaucagucauuucuucau

SEQ ID NO: 971138 - RNA, 19 nt, Homo sapiens
aaucauacaaacucucacc

SEQ ID NO: 971139 - RNA, 23 nt, Homo sapiens
aaucauugauugucagcuacuaa

SEQ ID NO: 971140 - RNA, 20 nt, Homo sapiens
aauccaguaggauccaguga

SEQ ID NO: 971141 - RNA, 19 nt, Homo sapiens
aauccauccaaaguucccu

SEQ ID NO: 971142 - RNA, 21 nt, Homo sapiens
aauccauccaaaguucccuau

SEQ ID NO: 971143 - RNA, 15 nt, Homo sapiens
aaucccacaucccag

SEQ ID NO: 971144 - RNA, 17 nt, Homo sapiens
aaucccacccacaugug

SEQ ID NO: 971145 - RNA, 18 nt, Homo sapiens
aaucccuuugucugucaa

SEQ ID NO: 971146 - RNA, 23 nt, Homo sapiens
aauccucagguaguacugggaau

SEQ ID NO: 971147 - RNA, 21 nt, Homo sapiens
aaucguaguuaacguauauug

SEQ ID NO: 971148 - RNA, 16 nt, Homo sapiens
aaucuaaaauguuuua

SEQ ID NO: 971149 - RNA, 13 nt, Homo sapiens
aaucugauugcac

SEQ ID NO: 971150 - RNA, 13 nt, Homo sapiens
aaucuugaacuuu

SEQ ID NO: 971151 - RNA, 23 nt, Homo sapiens
aaugacaccacacucugccugaa

SEQ ID NO: 971152 - RNA, 15 nt, Homo sapiens
cccacuuugaagggc

SEQ ID NO: 971153 - RNA, 24 nt, Homo sapiens
cccagacucuuuuuuugagugaca

SEQ ID NO: 971154 - RNA, 13 nt, Homo sapiens
cccagagcugccu

SEQ ID NO: 971155 - RNA, 19 nt, Homo sapiens
cccagagguaacagaacag

SEQ ID NO: 971156 - RNA, 23 nt, Homo sapiens
cccagagguaacagaacagcuuc

SEQ ID NO: 971157 - RNA, 23 nt, Homo sapiens
cccagcagaggcaggcugggacg

SEQ ID NO: 971158 - RNA, 14 nt, Homo sapiens
cccagccccuccaa

SEQ ID NO: 971159 - RNA, 19 nt, Homo sapiens
cccagccccuccaaagguc

SEQ ID NO: 971160 - RNA, 17 nt, Homo sapiens
cccagccuucuccagga

SEQ ID NO: 971161 - RNA, 13 nt, Homo sapiens
cccaggaagagcu

SEQ ID NO: 971162 - RNA, 15 nt, Homo sapiens
cccaggauacuggca

SEQ ID NO: 971163 - RNA, 19 nt, Homo sapiens
cccaggccccagacagggu

SEQ ID NO: 971164 - RNA, 21 nt, Homo sapiens
cccagggauuaggagcagcuc

SEQ ID NO: 971165 - RNA, 21 nt, Homo sapiens
cccagggccuccugggggacc

SEQ ID NO: 971166 - RNA, 22 nt, Homo sapiens
cccagggccuccugggggaccu

SEQ ID NO: 971167 - RNA, 14 nt, Homo sapiens
cccagguaccagcu

SEQ ID NO: 971168 - RNA, 14 nt, Homo sapiens
cccaguucaucacc

SEQ ID NO: 971169 - RNA, 22 nt, Homo sapiens
cccaucgucucggccuucacaa

SEQ ID NO: 971170 - RNA, 12 nt, Homo sapiens
cccaugcugucc

SEQ ID NO: 971171 - RNA, 12 nt, Homo sapiens
ccccaaguccug

SEQ ID NO: 971172 - RNA, 21 nt, Homo sapiens
ccccaaguccuggugucucca

SEQ ID NO: 971173 - RNA, 23 nt, Homo sapiens
ccccacacuggagccaucucuuc

SEQ ID NO: 971174 - RNA, 15 nt, Homo sapiens
ccccagaucugcucc

SEQ ID NO: 971175 - RNA, 14 nt, Homo sapiens
ccccagccauccag

SEQ ID NO: 971176 - RNA, 19 nt, Homo sapiens
ccccaggcuggagugcagu

SEQ ID NO: 971177 - RNA, 23 nt, Homo sapiens
ccccagggacugcaaguggccau

SEQ ID NO: 971178 - RNA, 19 nt, Homo sapiens
ccccaggggacaagggauu

SEQ ID NO: 971179 - RNA, 15 nt, Homo sapiens
ccccaucucccugcc

SEQ ID NO: 971180 - RNA, 17 nt, Homo sapiens
ccccaucuucgggacca

SEQ ID NO: 971181 - RNA, 16 nt, Homo sapiens
ccccauucucacugcu

SEQ ID NO: 971182 - RNA, 15 nt, Homo sapiens
cccccaccuuuggga

SEQ ID NO: 971183 - RNA, 12 nt, Homo sapiens
cccccacuccag

SEQ ID NO: 971184 - RNA, 14 nt, Homo sapiens
cccccagagcucuu

SEQ ID NO: 971185 - RNA, 15 nt, Homo sapiens
ccccuacugcuguga

SEQ ID NO: 971186 - RNA, 14 nt, Homo sapiens
ccccucucaccaaa

SEQ ID NO: 971187 - RNA, 15 nt, Homo sapiens
ccccuggccacagua

SEQ ID NO: 971188 - RNA, 23 nt, Homo sapiens
ccccuggcuccagagauggucac

SEQ ID NO: 971189 - RNA, 17 nt, Homo sapiens
cccgaaacuaagccagg

SEQ ID NO: 971190 - RNA, 18 nt, Homo sapiens
cccgagcuguuaccauuc

SEQ ID NO: 971191 - RNA, 23 nt, Homo sapiens
cccgaucaucuuuccuguuccag

SEQ ID NO: 971192 - RNA, 21 nt, Homo sapiens
cccgggccagggcugccccua

SEQ ID NO: 971193 - RNA, 16 nt, Homo sapiens
cccggggugaguccau

SEQ ID NO: 971194 - RNA, 13 nt, Homo sapiens
cccgugccaaaaa

SEQ ID NO: 971195 - RNA, 22 nt, Homo sapiens
cccuacucccugcagaugccac

SEQ ID NO: 971196 - RNA, 15 nt, Homo sapiens
cccuacugcugugaa

SEQ ID NO: 971197 - RNA, 14 nt, Homo sapiens
cccuauucuaucca

SEQ ID NO: 971198 - RNA, 19 nt, Homo sapiens
cccucauccuuuuacuuuu

SEQ ID NO: 971199 - RNA, 19 nt, Homo sapiens
cccucaugauauguccuca

SEQ ID NO: 971200 - RNA, 21 nt, Homo sapiens
cccuccaaaggucugaugucu

SEQ ID NO: 971201 - RNA, 21 nt, Homo sapiens
cccuccacucucuaccagaua

SEQ ID NO: 971202 - RNA, 18 nt, Homo sapiens
cccuccuggagcauccca

SEQ ID NO: 971203 - RNA, 22 nt, Homo sapiens
cccugaaauauuuucuacuuua

SEQ ID NO: 971204 - RNA, 17 nt, Homo sapiens
cccugaggguggcugcc

SEQ ID NO: 971205 - RNA, 22 nt, Homo sapiens
cccuggccccacaagccaggac

SEQ ID NO: 971206 - RNA, 17 nt, Homo sapiens
cccuuaacugcauccag

SEQ ID NO: 971207 - RNA, 23 nt, Homo sapiens
cccuucaucuuccuguguccuga

SEQ ID NO: 971208 - RNA, 21 nt, Homo sapiens
cccuuccacuuugaguaccaa

SEQ ID NO: 971209 - RNA, 11 nt, Homo sapiens
cccuuccccag

SEQ ID NO: 971210 - RNA, 16 nt, Homo sapiens
cccuucccucugggca

SEQ ID NO: 971211 - RNA, 14 nt, Homo sapiens
cccuucguguuucc

SEQ ID NO: 971212 - RNA, 21 nt, Homo sapiens
cccuucuucacacagacacua

SEQ ID NO: 971213 - RNA, 17 nt, Homo sapiens
cccuucuuuacuuccca

SEQ ID NO: 971214 - RNA, 17 nt, Homo sapiens
cccuuggcuucugugau

SEQ ID NO: 971215 - RNA, 18 nt, Homo sapiens
cccuuggcuucugugaug

SEQ ID NO: 971216 - RNA, 14 nt, Homo sapiens
cccuuuagaucucu

SEQ ID NO: 971217 - RNA, 15 nt, Homo sapiens
ccgagguaggggugg

SEQ ID NO: 971218 - RNA, 23 nt, Homo sapiens
ccgccauccaccccguugcucaa

SEQ ID NO: 971219 - RNA, 13 nt, Homo sapiens
ccgcgcuccgggc

SEQ ID NO: 971220 - RNA, 14 nt, Homo sapiens
ccgcugggugguuu

SEQ ID NO: 971221 - RNA, 19 nt, Homo sapiens
ccggaacgucagccagcuc

SEQ ID NO: 971222 - RNA, 12 nt, Homo sapiens
ccgggagacuga

SEQ ID NO: 971223 - RNA, 15 nt, Homo sapiens
ccgugccugagcugc

SEQ ID NO: 971224 - RNA, 16 nt, Homo sapiens
ccgugccugagcugca

SEQ ID NO: 971225 - RNA, 16 nt, Homo sapiens
ccguggucccugagga

SEQ ID NO: 971226 - RNA, 14 nt, Homo sapiens
ccgugucaagcugc

SEQ ID NO: 971227 - RNA, 15 nt, Homo sapiens
ccuaaaagcacuccu

SEQ ID NO: 971228 - RNA, 20 nt, Homo sapiens
ccuaaggacaagacacugag

SEQ ID NO: 971229 - RNA, 12 nt, Homo sapiens
ccuaaugaaguu

SEQ ID NO: 971230 - RNA, 20 nt, Homo sapiens
ccuacagagcagccaggugg

SEQ ID NO: 971231 - RNA, 22 nt, Homo sapiens
ccuacgguggucggugggaccc

SEQ ID NO: 971232 - RNA, 15 nt, Homo sapiens
ccuacucacacuuca

SEQ ID NO: 971233 - RNA, 20 nt, Homo sapiens
ccuacuuuucuuuccucaga

SEQ ID NO: 971234 - RNA, 20 nt, Homo sapiens
ccuagacucugucuaccugg

SEQ ID NO: 971235 - RNA, 17 nt, Homo sapiens
ccuagcaggcuguucca

SEQ ID NO: 971236 - RNA, 18 nt, Homo sapiens
ccuagccaaugucuccuc

SEQ ID NO: 971237 - RNA, 18 nt, Homo sapiens
ccuagcucucccagugaa

SEQ ID NO: 971238 - RNA, 19 nt, Homo sapiens
ccuaggaggaaaauuccau

SEQ ID NO: 971239 - RNA, 21 nt, Homo sapiens
ccuaguuguucagcauggcau

SEQ ID NO: 971240 - RNA, 21 nt, Homo sapiens
ccuauagcaucuucucauucc

SEQ ID NO: 971241 - RNA, 10 nt, Homo sapiens
ccuaucucau

SEQ ID NO: 971242 - RNA, 14 nt, Homo sapiens
ccuaucuccugaca

SEQ ID NO: 971243 - RNA, 19 nt, Homo sapiens
ccuaucuccugacagaagg

SEQ ID NO: 971244 - RNA, 14 nt, Homo sapiens
ccuaugcacauaug

SEQ ID NO: 971245 - RNA, 17 nt, Homo sapiens
ccucagacguugccuga

SEQ ID NO: 971246 - RNA, 19 nt, Homo sapiens
ccucagaguguggguccuu

SEQ ID NO: 971247 - RNA, 17 nt, Homo sapiens
ccucagccucccaaagu

SEQ ID NO: 971248 - RNA, 17 nt, Homo sapiens
ccucaucugcacggugg

SEQ ID NO: 971249 - RNA, 14 nt, Homo sapiens
ccuccacccaguga

SEQ ID NO: 971250 - RNA, 15 nt, Homo sapiens
ccuccacccauccag

SEQ ID NO: 971251 - RNA, 12 nt, Homo sapiens
ccuccacuccac

SEQ ID NO: 971252 - RNA, 20 nt, Homo sapiens
ccuccaggcuccagcacauc

SEQ ID NO: 971253 - RNA, 16 nt, Homo sapiens
ccucccagguucacac

SEQ ID NO: 971254 - RNA, 18 nt, Homo sapiens
ccuccccgugccaaaaau

SEQ ID NO: 971255 - RNA, 13 nt, Homo sapiens
ccucccuuugaug

SEQ ID NO: 971256 - RNA, 20 nt, Homo sapiens
ccuccuacccuuccagugcc

SEQ ID NO: 971257 - RNA, 21 nt, Homo sapiens
ccuccuagcucucccagugaa

SEQ ID NO: 971258 - RNA, 13 nt, Homo sapiens
ccuccucauggca

SEQ ID NO: 971259 - RNA, 15 nt, Homo sapiens
ccuccuuggugccug

SEQ ID NO: 971260 - RNA, 14 nt, Homo sapiens
ccuccuuuucccaa

SEQ ID NO: 971261 - RNA, 14 nt, Homo sapiens
ccucuagaagccaa

SEQ ID NO: 971262 - RNA, 22 nt, Homo sapiens
ccucuagguccccauacuccua

SEQ ID NO: 971263 - RNA, 15 nt, Homo sapiens
ccucucuacagucuc

SEQ ID NO: 971264 - RNA, 12 nt, Homo sapiens
ccucucucaaaa

SEQ ID NO: 971265 - RNA, 16 nt, Homo sapiens
ccucuggagcccuaac

SEQ ID NO: 971266 - RNA, 16 nt, Homo sapiens
ccucugggcagcuccu

SEQ ID NO: 971267 - RNA, 18 nt, Homo sapiens
cauaaaggaaaagacaca

SEQ ID NO: 971268 - RNA, 17 nt, Homo sapiens
cauaaauaaaaauucaa

SEQ ID NO: 971269 - RNA, 17 nt, Homo sapiens
cauaaauaaaguuucag

SEQ ID NO: 971270 - RNA, 21 nt, Homo sapiens
cauaagaauuuuuuauaagua

SEQ ID NO: 971271 - RNA, 18 nt, Homo sapiens
cauaaucaauauaaucug

SEQ ID NO: 971272 - RNA, 21 nt, Homo sapiens
cauacauucccucuaauuuga

SEQ ID NO: 971273 - RNA, 13 nt, Homo sapiens
cauacuguucacu

SEQ ID NO: 971274 - RNA, 18 nt, Homo sapiens
cauagaaaccacuagaaa

SEQ ID NO: 971275 - RNA, 15 nt, Homo sapiens
cauagacuccuuugc

SEQ ID NO: 971276 - RNA, 16 nt, Homo sapiens
cauagcgaagaccagu

SEQ ID NO: 971277 - RNA, 20 nt, Homo sapiens
cauagcucaccaggacuguu

SEQ ID NO: 971278 - RNA, 21 nt, Homo sapiens
cauaggccgagcuguggacaa

SEQ ID NO: 971279 - RNA, 11 nt, Homo sapiens
cauaguguacc

SEQ ID NO: 971280 - RNA, 11 nt, Homo sapiens
cauauagcucg

SEQ ID NO: 971281 - RNA, 17 nt, Homo sapiens
cauauauacacauauac

SEQ ID NO: 971282 - RNA, 18 nt, Homo sapiens
cauauauacacauauaca

SEQ ID NO: 971283 - RNA, 23 nt, Homo sapiens
cauauauuuauugaguaccuacu

SEQ ID NO: 971284 - RNA, 19 nt, Homo sapiens
cauauccaggcaccaggac

SEQ ID NO: 971285 - RNA, 15 nt, Homo sapiens
cauaugaacuuguca

SEQ ID NO: 971286 - RNA, 15 nt, Homo sapiens
cauauggacucugca

SEQ ID NO: 971287 - RNA, 20 nt, Homo sapiens
cauauggacucugcacauga

SEQ ID NO: 971288 - RNA, 23 nt, Homo sapiens
cauauguaguauaauuucuagaa

SEQ ID NO: 971289 - RNA, 17 nt, Homo sapiens
cauauugugauucugcc

SEQ ID NO: 971290 - RNA, 19 nt, Homo sapiens
cauauuuuuuuuacuguca

SEQ ID NO: 971291 - RNA, 14 nt, Homo sapiens
caucaaaaagaaca

SEQ ID NO: 971292 - RNA, 18 nt, Homo sapiens
caucacaggcugugccaa

SEQ ID NO: 971293 - RNA, 13 nt, Homo sapiens
caucaggacucug

SEQ ID NO: 971294 - RNA, 21 nt, Homo sapiens
caucaggugaggugugcucca

SEQ ID NO: 971295 - RNA, 21 nt, Homo sapiens
caucaugcggugggugcugcc

SEQ ID NO: 971296 - RNA, 14 nt, Homo sapiens
cauccauuaccucc

SEQ ID NO: 971297 - RNA, 19 nt, Homo sapiens
caucccuuuuucugcuaau

SEQ ID NO: 971298 - RNA, 15 nt, Homo sapiens
cauccuaugcuuaau

SEQ ID NO: 971299 - RNA, 14 nt, Homo sapiens
cauccugacugaaa

SEQ ID NO: 971300 - RNA, 23 nt, Homo sapiens
cauccuuacagcuaucuguagaa

SEQ ID NO: 971301 - RNA, 11 nt, Homo sapiens
cauccuuccaa

SEQ ID NO: 971302 - RNA, 21 nt, Homo sapiens
cauccuugaugcaagugcaac

SEQ ID NO: 971303 - RNA, 22 nt, Homo sapiens
cauccuuucuuuuaaugaugcc

SEQ ID NO: 971304 - RNA, 20 nt, Homo sapiens
cauccuuuuacuuuuugccc

SEQ ID NO: 971305 - RNA, 19 nt, Homo sapiens
caucuaauaaguauauaau

SEQ ID NO: 971306 - RNA, 11 nt, Homo sapiens
caucucugucu

SEQ ID NO: 971307 - RNA, 19 nt, Homo sapiens
caucugccuuaaaaccaaa

SEQ ID NO: 971308 - RNA, 15 nt, Homo sapiens
caucuuccauuucca

SEQ ID NO: 971309 - RNA, 13 nt, Homo sapiens
caucuucuauuca

SEQ ID NO: 971310 - RNA, 15 nt, Homo sapiens
caugaaccaagugga

SEQ ID NO: 971311 - RNA, 22 nt, Homo sapiens
caugaaggagagcccagucucc

SEQ ID NO: 971312 - RNA, 18 nt, Homo sapiens
caugaggcaguuccuucc

SEQ ID NO: 971313 - RNA, 16 nt, Homo sapiens
caugauauguccucag

SEQ ID NO: 971314 - RNA, 23 nt, Homo sapiens
caugaugugaagaguuucacaaa

SEQ ID NO: 971315 - RNA, 23 nt, Homo sapiens
caugcagaaacuuggaugucacu

SEQ ID NO: 971316 - RNA, 11 nt, Homo sapiens
caugcauuuga

SEQ ID NO: 971317 - RNA, 12 nt, Homo sapiens
caugcuggugaa

SEQ ID NO: 971318 - RNA, 19 nt, Homo sapiens
cauggacuuucuugcauga

SEQ ID NO: 971319 - RNA, 13 nt, Homo sapiens
cauggaucugauc

SEQ ID NO: 971320 - RNA, 16 nt, Homo sapiens
cauggaucugaucugu

SEQ ID NO: 971321 - RNA, 24 nt, Homo sapiens
cauggcaucuucaauaugaaucua

SEQ ID NO: 971322 - RNA, 16 nt, Homo sapiens
cauggccuaugcacau

SEQ ID NO: 971323 - RNA, 17 nt, Homo sapiens
cauggccuaugcacaua

SEQ ID NO: 971324 - RNA, 20 nt, Homo sapiens
cauggcuguuggugggaccc

SEQ ID NO: 971325 - RNA, 15 nt, Homo sapiens
caugggggcacuuga

SEQ ID NO: 971326 - RNA, 21 nt, Homo sapiens
caugguaaugaaggacaguga

SEQ ID NO: 971327 - RNA, 20 nt, Homo sapiens
cauggugaaaccccgucucu

SEQ ID NO: 971328 - RNA, 16 nt, Homo sapiens
cauggugacagucucc

SEQ ID NO: 971329 - RNA, 13 nt, Homo sapiens
cauggugacauug

SEQ ID NO: 971330 - RNA, 13 nt, Homo sapiens
cauggugcacuga

SEQ ID NO: 971331 - RNA, 13 nt, Homo sapiens
cauguaugucuug

SEQ ID NO: 971332 - RNA, 20 nt, Homo sapiens
caugucacuucccugcuuaa

SEQ ID NO: 971333 - RNA, 17 nt, Homo sapiens
caugucuccucaugucu

SEQ ID NO: 971334 - RNA, 15 nt, Homo sapiens
caugugacacauaug

SEQ ID NO: 971335 - RNA, 18 nt, Homo sapiens
caugugacacauaugcac

SEQ ID NO: 971336 - RNA, 20 nt, Homo sapiens
caugugacacauaugcaccu

SEQ ID NO: 971337 - RNA, 17 nt, Homo sapiens
caugugagcaugucacu

SEQ ID NO: 971338 - RNA, 18 nt, Homo sapiens
cauguggccuuuaucuca

SEQ ID NO: 971339 - RNA, 21 nt, Homo sapiens
cauguuaaugacaauauucca

SEQ ID NO: 971340 - RNA, 15 nt, Homo sapiens
cauguucccccuaaa

SEQ ID NO: 971341 - RNA, 22 nt, Homo sapiens
cauguugccucaccagcccuga

SEQ ID NO: 971342 - RNA, 21 nt, Homo sapiens
cauguuugaaucuacauucac

SEQ ID NO: 971343 - RNA, 23 nt, Homo sapiens
ccauacuccuaugaucugaguca

SEQ ID NO: 971344 - RNA, 22 nt, Homo sapiens
ccauauagcucgagcaaaauuc

SEQ ID NO: 971345 - RNA, 12 nt, Homo sapiens
ccauauucacac

SEQ ID NO: 971346 - RNA, 15 nt, Homo sapiens
ccauauucacaccuc

SEQ ID NO: 971347 - RNA, 21 nt, Homo sapiens
ccauccuuccaacauauauuu

SEQ ID NO: 971348 - RNA, 22 nt, Homo sapiens
ccaucucccaaggcugccagac

SEQ ID NO: 971349 - RNA, 15 nt, Homo sapiens
ccaucuucuauucaa

SEQ ID NO: 971350 - RNA, 17 nt, Homo sapiens
ccaugaaacugacucau

SEQ ID NO: 971351 - RNA, 14 nt, Homo sapiens
ccaugaaucucugc

SEQ ID NO: 971352 - RNA, 15 nt, Homo sapiens
ccaugcuaacaaaga

SEQ ID NO: 971353 - RNA, 13 nt, Homo sapiens
ccauguccaaaga

SEQ ID NO: 971354 - RNA, 14 nt, Homo sapiens
ccauguccaaagag

SEQ ID NO: 971355 - RNA, 12 nt, Homo sapiens
ccauuaccaaaa

SEQ ID NO: 971356 - RNA, 13 nt, Homo sapiens
ccauuaccuccau

SEQ ID NO: 971357 - RNA, 13 nt, Homo sapiens
ccauucacaauaa

SEQ ID NO: 971358 - RNA, 15 nt, Homo sapiens
ccauucagagcuaug

SEQ ID NO: 971359 - RNA, 22 nt, Homo sapiens
ccauuccaagucaacacucuuc

SEQ ID NO: 971360 - RNA, 14 nt, Homo sapiens
ccauucuacugugu

SEQ ID NO: 971361 - RNA, 13 nt, Homo sapiens
ccauuuccugaga

SEQ ID NO: 971362 - RNA, 19 nt, Homo sapiens
ccauuucugccucgcucac

SEQ ID NO: 971363 - RNA, 15 nt, Homo sapiens
ccauuugugccagag

SEQ ID NO: 971364 - RNA, 18 nt, Homo sapiens
cccaaacagugggcugcu

SEQ ID NO: 971365 - RNA, 15 nt, Homo sapiens
cccaaaggcauccau

SEQ ID NO: 971366 - RNA, 15 nt, Homo sapiens
cccaacccuaucucc

SEQ ID NO: 971367 - RNA, 15 nt, Homo sapiens
cccaacucuugcaca

SEQ ID NO: 971368 - RNA, 21 nt, Homo sapiens
cccaagacaugacauucuuag

SEQ ID NO: 971369 - RNA, 17 nt, Homo sapiens
cccaaggacucuuccac

SEQ ID NO: 971370 - RNA, 20 nt, Homo sapiens
cccaagugaggagugccagc

SEQ ID NO: 971371 - RNA, 13 nt, Homo sapiens
cccaagugccuca

SEQ ID NO: 971372 - RNA, 18 nt, Homo sapiens
cccaauuaagaaauucca

SEQ ID NO: 971373 - RNA, 17 nt, Homo sapiens
cccacacuggagccauc

SEQ ID NO: 971374 - RNA, 13 nt, Homo sapiens
cccacacugugaa

SEQ ID NO: 971375 - RNA, 17 nt, Homo sapiens
cccacauccaacuccag

SEQ ID NO: 971376 - RNA, 21 nt, Homo sapiens
cccaccuugccagggcagggu

SEQ ID NO: 971377 - RNA, 17 nt, Homo sapiens
cccacgggaaaggagcu

SEQ ID NO: 971378 - RNA, 23 nt, Homo sapiens
cccacuccaagcccagcccaugg

SEQ ID NO: 971379 - RNA, 17 nt, Homo sapiens
cccacugaaccuucuga

SEQ ID NO: 971380 - RNA, 19 nt, Homo sapiens
cccacuguuucucuugagc

SEQ ID NO: 971381 - RNA, 11 nt, Homo sapiens
cccacuuugaa

SEQ ID NO: 971382 - RNA, 15 nt, Homo sapiens
cagagcuauggugcu

SEQ ID NO: 971383 - RNA, 22 nt, Homo sapiens
cagaggaauaacaucaccacug

SEQ ID NO: 971384 - RNA, 23 nt, Homo sapiens
cagaggaauaacaucaccacugu

SEQ ID NO: 971385 - RNA, 23 nt, Homo sapiens
cagaggaugcaacaaauguggcc

SEQ ID NO: 971386 - RNA, 22 nt, Homo sapiens
cagaguuuuagaaaugagaucu

SEQ ID NO: 971387 - RNA, 14 nt, Homo sapiens
cagauaacugagga

SEQ ID NO: 971388 - RNA, 14 nt, Homo sapiens
cagauaauuggcaa

SEQ ID NO: 971389 - RNA, 19 nt, Homo sapiens
cagauacacuaaaguuaca

SEQ ID NO: 971390 - RNA, 14 nt, Homo sapiens
cagaucacugccac

SEQ ID NO: 971391 - RNA, 19 nt, Homo sapiens
cagauccgcaagaguaaag

SEQ ID NO: 971392 - RNA, 21 nt, Homo sapiens
cagaucugauuuguaacccac

SEQ ID NO: 971393 - RNA, 18 nt, Homo sapiens
cagaucuuggacucauga

SEQ ID NO: 971394 - RNA, 19 nt, Homo sapiens
cagauggaaaaacugaggc

SEQ ID NO: 971395 - RNA, 16 nt, Homo sapiens
cagaugggaacugaau

SEQ ID NO: 971396 - RNA, 17 nt, Homo sapiens
cagcaauucucuuucuu

SEQ ID NO: 971397 - RNA, 18 nt, Homo sapiens
cagcacgaguggccaguu

SEQ ID NO: 971398 - RNA, 19 nt, Homo sapiens
cagcacucacgcaccggag

SEQ ID NO: 971399 - RNA, 15 nt, Homo sapiens
cagcacuuacaauuu

SEQ ID NO: 971400 - RNA, 12 nt, Homo sapiens
cagcagcucaua

SEQ ID NO: 971401 - RNA, 18 nt, Homo sapiens
cagcaggagccagccaag

SEQ ID NO: 971402 - RNA, 21 nt, Homo sapiens
cagcagggucuugcuguaacu

SEQ ID NO: 971403 - RNA, 18 nt, Homo sapiens
cagcauuuagucuugcca

SEQ ID NO: 971404 - RNA, 21 nt, Homo sapiens
cagccaugaaacugacucauc

SEQ ID NO: 971405 - RNA, 12 nt, Homo sapiens
cagccaugccag

SEQ ID NO: 971406 - RNA, 19 nt, Homo sapiens
cagcccaagcuucccucca

SEQ ID NO: 971407 - RNA, 17 nt, Homo sapiens
cagcccagacccagugg

SEQ ID NO: 971408 - RNA, 19 nt, Homo sapiens
cagcccagacccaguggac

SEQ ID NO: 971409 - RNA, 17 nt, Homo sapiens
cagcccagagacuuugu

SEQ ID NO: 971410 - RNA, 23 nt, Homo sapiens
cagcccauggagauugaccugga

SEQ ID NO: 971411 - RNA, 19 nt, Homo sapiens
cagcccccuaaaagcacuc

SEQ ID NO: 971412 - RNA, 17 nt, Homo sapiens
cagccccggcaagccac

SEQ ID NO: 971413 - RNA, 12 nt, Homo sapiens
cagccccggggu

SEQ ID NO: 971414 - RNA, 13 nt, Homo sapiens
cagccccugugac

SEQ ID NO: 971415 - RNA, 18 nt, Homo sapiens
cagccuccccgugccaaa

SEQ ID NO: 971416 - RNA, 19 nt, Homo sapiens
cagccuccccgugccaaaa

SEQ ID NO: 971417 - RNA, 12 nt, Homo sapiens
cagccucuggac

SEQ ID NO: 971418 - RNA, 19 nt, Homo sapiens
cagccuggccaacauggca

SEQ ID NO: 971419 - RNA, 12 nt, Homo sapiens
cagccugucacc

SEQ ID NO: 971420 - RNA, 18 nt, Homo sapiens
cagccuucccaacaugcc

SEQ ID NO: 971421 - RNA, 17 nt, Homo sapiens
cagccuugcaucaaggg

SEQ ID NO: 971422 - RNA, 22 nt, Homo sapiens
cagcucaaugcaguuagcugaa

SEQ ID NO: 971423 - RNA, 21 nt, Homo sapiens
cagcucacuuuuucauaguca

SEQ ID NO: 971424 - RNA, 16 nt, Homo sapiens
cagcucuccaccagcu

SEQ ID NO: 971425 - RNA, 21 nt, Homo sapiens
cagcugcucccuggcauucaa

SEQ ID NO: 971426 - RNA, 18 nt, Homo sapiens
cagcuggagaaauggcau

SEQ ID NO: 971427 - RNA, 22 nt, Homo sapiens
cagcuugggaauccugcuaaag

SEQ ID NO: 971428 - RNA, 20 nt, Homo sapiens
cagcuuggggccaccaaagc

SEQ ID NO: 971429 - RNA, 19 nt, Homo sapiens
caggaaaauuuaaaauuca

SEQ ID NO: 971430 - RNA, 21 nt, Homo sapiens
caggaaacuccacaucugccu

SEQ ID NO: 971431 - RNA, 20 nt, Homo sapiens
caggaaagcuggugucugau

SEQ ID NO: 971432 - RNA, 14 nt, Homo sapiens
caggaaauagucac

SEQ ID NO: 971433 - RNA, 17 nt, Homo sapiens
caggaaauaucugugaa

SEQ ID NO: 971434 - RNA, 18 nt, Homo sapiens
caggaaauaucugugaag

SEQ ID NO: 971435 - RNA, 13 nt, Homo sapiens
caggaacaaacag

SEQ ID NO: 971436 - RNA, 15 nt, Homo sapiens
caggagccaccagca

SEQ ID NO: 971437 - RNA, 23 nt, Homo sapiens
caggagcuugggcagugccccag

SEQ ID NO: 971438 - RNA, 16 nt, Homo sapiens
caggaguagugagcug

SEQ ID NO: 971439 - RNA, 17 nt, Homo sapiens
caggaugcagcacugcg

SEQ ID NO: 971440 - RNA, 17 nt, Homo sapiens
caggaugcccacauacu

SEQ ID NO: 971441 - RNA, 19 nt, Homo sapiens
caggaugcccacauacugu

SEQ ID NO: 971442 - RNA, 16 nt, Homo sapiens
caggauuuaaguuuca

SEQ ID NO: 971443 - RNA, 16 nt, Homo sapiens
caggauuugcacagaa

SEQ ID NO: 971444 - RNA, 17 nt, Homo sapiens
caggcaagagaauugaa

SEQ ID NO: 971445 - RNA, 16 nt, Homo sapiens
caggcacccucaggga

SEQ ID NO: 971446 - RNA, 19 nt, Homo sapiens
caggcaccucuuccuugau

SEQ ID NO: 971447 - RNA, 18 nt, Homo sapiens
caggcaugaaauucuucc

SEQ ID NO: 971448 - RNA, 19 nt, Homo sapiens
caggccaaagugccgguga

SEQ ID NO: 971449 - RNA, 19 nt, Homo sapiens
caggccuuaccgcucuguu

SEQ ID NO: 971450 - RNA, 20 nt, Homo sapiens
caggcgugagccaccgcgcc

SEQ ID NO: 971451 - RNA, 18 nt, Homo sapiens
caggcugaaaacaaugga

SEQ ID NO: 971452 - RNA, 23 nt, Homo sapiens
caggcugagaacucguucaccuc

SEQ ID NO: 971453 - RNA, 16 nt, Homo sapiens
caggcuggagugcagu

SEQ ID NO: 971454 - RNA, 20 nt, Homo sapiens
caggcuggagugcaguggca

SEQ ID NO: 971455 - RNA, 21 nt, Homo sapiens
cagggaagcaacccuggguuu

SEQ ID NO: 971456 - RNA, 20 nt, Homo sapiens
cagggacugcaaguggccau

SEQ ID NO: 971457 - RNA, 20 nt, Homo sapiens
agcucugauugcagcacaga

SEQ ID NO: 971458 - RNA, 15 nt, Homo sapiens
agcucuggguugugc

SEQ ID NO: 971459 - RNA, 18 nt, Homo sapiens
agcucuggguugugcaca

SEQ ID NO: 971460 - RNA, 14 nt, Homo sapiens
agcucuuccuaucc

SEQ ID NO: 971461 - RNA, 17 nt, Homo sapiens
agcugaccagacacugc

SEQ ID NO: 971462 - RNA, 14 nt, Homo sapiens
agcugagacaggcc

SEQ ID NO: 971463 - RNA, 20 nt, Homo sapiens
agcugagaucgugcuacugc

SEQ ID NO: 971464 - RNA, 13 nt, Homo sapiens
agcugagugcuga

SEQ ID NO: 971465 - RNA, 19 nt, Homo sapiens
agcugcuauccccaucucc

SEQ ID NO: 971466 - RNA, 23 nt, Homo sapiens
agcugcucuccuaucagaagcuc

SEQ ID NO: 971467 - RNA, 17 nt, Homo sapiens
agcuggagaaauggcau

SEQ ID NO: 971468 - RNA, 16 nt, Homo sapiens
agcuggccucucuagc

SEQ ID NO: 971469 - RNA, 23 nt, Homo sapiens
agcugggcccaccgaggugcuau

SEQ ID NO: 971470 - RNA, 21 nt, Homo sapiens
agcugguaggauguaagccug

SEQ ID NO: 971471 - RNA, 19 nt, Homo sapiens
agcuggugcuccaagcaca

SEQ ID NO: 971472 - RNA, 21 nt, Homo sapiens
agcuggugcuccaagcacagg

SEQ ID NO: 971473 - RNA, 15 nt, Homo sapiens
agcuguuaccauuca

SEQ ID NO: 971474 - RNA, 18 nt, Homo sapiens
agcuuaagaaccauugau

SEQ ID NO: 971475 - RNA, 19 nt, Homo sapiens
agcuuaaugcuacauguga

SEQ ID NO: 971476 - RNA, 15 nt, Homo sapiens
agcuucccuugccuc

SEQ ID NO: 971477 - RNA, 16 nt, Homo sapiens
agcuucuaccuggaaa

SEQ ID NO: 971478 - RNA, 18 nt, Homo sapiens
agcuucuugcugaucaga

SEQ ID NO: 971479 - RNA, 21 nt, Homo sapiens
agcuugaauucauguuggucu

SEQ ID NO: 971480 - RNA, 23 nt, Homo sapiens
agcuugauuaaaucaaccaccua

SEQ ID NO: 971481 - RNA, 18 nt, Homo sapiens
agcuuggggccaccaaag

SEQ ID NO: 971482 - RNA, 13 nt, Homo sapiens
agcuugugugccc

SEQ ID NO: 971483 - RNA, 13 nt, Homo sapiens
agcuuucugccau

SEQ ID NO: 971484 - RNA, 19 nt, Homo sapiens
agcuuuggaccuaauccaa

SEQ ID NO: 971485 - RNA, 21 nt, Homo sapiens
agcuuuucuccucaugagcug

SEQ ID NO: 971486 - RNA, 20 nt, Homo sapiens
agcuuuuggcugcaaguaac

SEQ ID NO: 971487 - RNA, 19 nt, Homo sapiens
agcuuuuuuuggaaguaac

SEQ ID NO: 971488 - RNA, 13 nt, Homo sapiens
aggaaaaauugau

SEQ ID NO: 971489 - RNA, 17 nt, Homo sapiens
aggaaacucacacuccc

SEQ ID NO: 971490 - RNA, 20 nt, Homo sapiens
aggaaacuccacaucugccu

SEQ ID NO: 971491 - RNA, 21 nt, Homo sapiens
aggaaacuccacaucugccuu

SEQ ID NO: 971492 - RNA, 23 nt, Homo sapiens
aggaaccucucgccaugaucaga

SEQ ID NO: 971493 - RNA, 22 nt, Homo sapiens
aggaagaauuccugccaugccc

SEQ ID NO: 971494 - RNA, 13 nt, Homo sapiens
aggaaggacuuga

SEQ ID NO: 971495 - RNA, 14 nt, Homo sapiens
aggaagggaucuga

SEQ ID NO: 971496 - RNA, 20 nt, Homo sapiens
aggaauaacaucaccacugu

SEQ ID NO: 971497 - RNA, 23 nt, Homo sapiens
aggaauccuggcagcccagagac

SEQ ID NO: 971498 - RNA, 14 nt, Homo sapiens
aggacaaccugcug

SEQ ID NO: 971499 - RNA, 20 nt, Homo sapiens
aggacaggccacaccacagc

SEQ ID NO: 971500 - RNA, 11 nt, Homo sapiens
aggaccugcug

SEQ ID NO: 971501 - RNA, 21 nt, Homo sapiens
aggacgcacgcucgcugccau

SEQ ID NO: 971502 - RNA, 13 nt, Homo sapiens
aggacgcgcacuc

SEQ ID NO: 971503 - RNA, 22 nt, Homo sapiens
aggacuuuaucuaauaccucug

SEQ ID NO: 971504 - RNA, 14 nt, Homo sapiens
aggagacagccuca

SEQ ID NO: 971505 - RNA, 13 nt, Homo sapiens
aggagagagcagc

SEQ ID NO: 971506 - RNA, 17 nt, Homo sapiens
aggagauaauuguuuca

SEQ ID NO: 971507 - RNA, 21 nt, Homo sapiens
aggagcagcucuucagcacaa

SEQ ID NO: 971508 - RNA, 11 nt, Homo sapiens
aggagcaggca

SEQ ID NO: 971509 - RNA, 22 nt, Homo sapiens
aggagccaggccuugggcuccu

SEQ ID NO: 971510 - RNA, 14 nt, Homo sapiens
aggagcuuucucaa

SEQ ID NO: 971511 - RNA, 23 nt, Homo sapiens
aggagcuuucucaaugucuuccc

SEQ ID NO: 971512 - RNA, 23 nt, Homo sapiens
aggagguccuuaggccucugaga

SEQ ID NO: 971513 - RNA, 18 nt, Homo sapiens
aggaguagugagcuguac

SEQ ID NO: 971514 - RNA, 22 nt, Homo sapiens
aggaucuaagggaagaucacug

SEQ ID NO: 971515 - RNA, 13 nt, Homo sapiens
aggaugacaguga

SEQ ID NO: 971516 - RNA, 17 nt, Homo sapiens
aggaugcagcacugcgc

SEQ ID NO: 971517 - RNA, 22 nt, Homo sapiens
aggaugcccacauacugucuaa

SEQ ID NO: 971518 - RNA, 20 nt, Homo sapiens
aggcaagcugaaauuuuaga

SEQ ID NO: 971519 - RNA, 21 nt, Homo sapiens
aggcaggaacaaacagggcug

SEQ ID NO: 971520 - RNA, 17 nt, Homo sapiens
aggcaggagaaucucuu

SEQ ID NO: 971521 - RNA, 21 nt, Homo sapiens
aggcagggcucucccgugcau

SEQ ID NO: 971522 - RNA, 19 nt, Homo sapiens
aggcagugggucuucccuc

SEQ ID NO: 971523 - RNA, 16 nt, Homo sapiens
aggcauaggucucuuu

SEQ ID NO: 971524 - RNA, 20 nt, Homo sapiens
aggcauuucugggaagcccc

SEQ ID NO: 971525 - RNA, 19 nt, Homo sapiens
aggccaguugaucugcucu

SEQ ID NO: 971526 - RNA, 14 nt, Homo sapiens
aggcccagcugaga

SEQ ID NO: 971527 - RNA, 19 nt, Homo sapiens
aggccccagcuggagaaaa

SEQ ID NO: 971528 - RNA, 17 nt, Homo sapiens
aggcccugcacugccag

SEQ ID NO: 971529 - RNA, 15 nt, Homo sapiens
aggccuagacucugu

SEQ ID NO: 971530 - RNA, 12 nt, Homo sapiens
aggccugaauca

SEQ ID NO: 971531 - RNA, 19 nt, Homo sapiens
aggcgcugagacugugcug

SEQ ID NO: 971532 - RNA, 14 nt, Homo sapiens
aggcuaagcacuuu

SEQ ID NO: 971533 - RNA, 15 nt, Homo sapiens
aggcugccccucuca

SEQ ID NO: 971534 - RNA, 18 nt, Homo sapiens
aggcugggccauguccaa

SEQ ID NO: 971535 - RNA, 21 nt, Homo sapiens
aggcugggccauguccaaaga

SEQ ID NO: 971536 - RNA, 24 nt, Homo sapiens
aggcugugggguggagcacuggac

SEQ ID NO: 971537 - RNA, 19 nt, Homo sapiens
aggcuuguuuaccuuucuc

SEQ ID NO: 971538 - RNA, 17 nt, Homo sapiens
aggcuuuauguacaaac

SEQ ID NO: 971539 - RNA, 14 nt, Homo sapiens
aggcuuugccauug

SEQ ID NO: 971540 - RNA, 23 nt, Homo sapiens
agggaaugagaguuccuucucac

SEQ ID NO: 971541 - RNA, 15 nt, Homo sapiens
agggagaagcaugaa

SEQ ID NO: 971542 - RNA, 15 nt, Homo sapiens
agggagcgcucucuu

SEQ ID NO: 971543 - RNA, 21 nt, Homo sapiens
agggagcuucuaccuggaaaa

SEQ ID NO: 971544 - RNA, 16 nt, Homo sapiens
agggaggucacuggaa

SEQ ID NO: 971545 - RNA, 20 nt, Homo sapiens
agggauauuuuuuucuauua

SEQ ID NO: 971546 - RNA, 17 nt, Homo sapiens
agggauggcagugauuc

SEQ ID NO: 971547 - RNA, 19 nt, Homo sapiens
agggauuugaggugagggu

SEQ ID NO: 971548 - RNA, 23 nt, Homo sapiens
agggcaagaaauggcgucugcuc

SEQ ID NO: 971549 - RNA, 18 nt, Homo sapiens
agggcacuguguuugccu

SEQ ID NO: 971550 - RNA, 16 nt, Homo sapiens
agggcagccugucacc

SEQ ID NO: 971551 - RNA, 15 nt, Homo sapiens
agggcagcuccagug

SEQ ID NO: 971552 - RNA, 18 nt, Homo sapiens
agggcagcuccagugcca

SEQ ID NO: 971553 - RNA, 22 nt, Homo sapiens
agggcaguuuugaggcaugacu

SEQ ID NO: 971554 - RNA, 23 nt, Homo sapiens
agggccacauagaugcugaugga

SEQ ID NO: 971555 - RNA, 16 nt, Homo sapiens
agggcucccuaaacuu

SEQ ID NO: 971556 - RNA, 21 nt, Homo sapiens
aggggccugcccucaucauca

SEQ ID NO: 971557 - RNA, 23 nt, Homo sapiens
aggguaaauaaaccacugugcgu

SEQ ID NO: 971558 - RNA, 21 nt, Homo sapiens
aggguaaauaggaaucauuca

SEQ ID NO: 971559 - RNA, 18 nt, Homo sapiens
aggguaugggaagccaua

SEQ ID NO: 971560 - RNA, 19 nt, Homo sapiens
agggucacugaaccacugc

SEQ ID NO: 971561 - RNA, 19 nt, Homo sapiens
agggucuucuuacaugcau

SEQ ID NO: 971562 - RNA, 23 nt, Homo sapiens
aggguuaacccuucaucuuccug

SEQ ID NO: 971563 - RNA, 18 nt, Homo sapiens
agguagaagugagcaaaa

SEQ ID NO: 971564 - RNA, 14 nt, Homo sapiens
aggucaaguaagaa

SEQ ID NO: 971565 - RNA, 16 nt, Homo sapiens
aggucaggaguugaag

SEQ ID NO: 971566 - RNA, 13 nt, Homo sapiens
aggucaugggaag

SEQ ID NO: 971567 - RNA, 18 nt, Homo sapiens
agguccccauacuccuau

SEQ ID NO: 971568 - RNA, 15 nt, Homo sapiens
aggucggcacuugga

SEQ ID NO: 971569 - RNA, 19 nt, Homo sapiens
aggugaagucgggucaaaa

SEQ ID NO: 971570 - RNA, 16 nt, Homo sapiens
aggugagauaaauuaa

SEQ ID NO: 971571 - RNA, 18 nt, Homo sapiens
acuuuaucuaauaccucu

SEQ ID NO: 971572 - RNA, 22 nt, Homo sapiens
acuuuaucuauaucucauuuca

SEQ ID NO: 971573 - RNA, 12 nt, Homo sapiens
acuuucauguca

SEQ ID NO: 971574 - RNA, 17 nt, Homo sapiens
acuuucucaguuuucau

SEQ ID NO: 971575 - RNA, 15 nt, Homo sapiens
acuuucuugcaugaa

SEQ ID NO: 971576 - RNA, 16 nt, Homo sapiens
acuuucuugcaugaau

SEQ ID NO: 971577 - RNA, 15 nt, Homo sapiens
acuuugagcugagug

SEQ ID NO: 971578 - RNA, 17 nt, Homo sapiens
acuuugagcugagugcu

SEQ ID NO: 971579 - RNA, 19 nt, Homo sapiens
acuuugagcugagugcuga

SEQ ID NO: 971580 - RNA, 23 nt, Homo sapiens
acuuugagcugagugcugaaaua

SEQ ID NO: 971581 - RNA, 16 nt, Homo sapiens
acuuugaucucugcuu

SEQ ID NO: 971582 - RNA, 17 nt, Homo sapiens
acuuugggauucuuucc

SEQ ID NO: 971583 - RNA, 15 nt, Homo sapiens
acuuugggggaggag

SEQ ID NO: 971584 - RNA, 15 nt, Homo sapiens
acuuuguauuuugau

SEQ ID NO: 971585 - RNA, 22 nt, Homo sapiens
acuuuguuaaaugguuauccaa

SEQ ID NO: 971586 - RNA, 19 nt, Homo sapiens
agaaaaugaaaugcauauu

SEQ ID NO: 971587 - RNA, 17 nt, Homo sapiens
agaaaauguaguuagcu

SEQ ID NO: 971588 - RNA, 19 nt, Homo sapiens
agaaacuaucuauuugcac

SEQ ID NO: 971589 - RNA, 15 nt, Homo sapiens
agaaaggguuccaaa

SEQ ID NO: 971590 - RNA, 19 nt, Homo sapiens
agaaaucaauaguugaauu

SEQ ID NO: 971591 - RNA, 21 nt, Homo sapiens
agaaaugaauagacuaucuag

SEQ ID NO: 971592 - RNA, 13 nt, Homo sapiens
agaaaugcugcug

SEQ ID NO: 971593 - RNA, 20 nt, Homo sapiens
agaaauggacuggagcucau

SEQ ID NO: 971594 - RNA, 12 nt, Homo sapiens
agaaauggccaa

SEQ ID NO: 971595 - RNA, 22 nt, Homo sapiens
agaaauuccauacuucucucag

SEQ ID NO: 971596 - RNA, 14 nt, Homo sapiens
agaaauucuguggu

SEQ ID NO: 971597 - RNA, 13 nt, Homo sapiens
agaacaacauauc

SEQ ID NO: 971598 - RNA, 15 nt, Homo sapiens
agaacaacuaccuga

SEQ ID NO: 971599 - RNA, 23 nt, Homo sapiens
agaacaaugcuauaauauauaau

SEQ ID NO: 971600 - RNA, 14 nt, Homo sapiens
agaacacuaacuca

SEQ ID NO: 971601 - RNA, 15 nt, Homo sapiens
agaacagagugcaac

SEQ ID NO: 971602 - RNA, 20 nt, Homo sapiens
agaacagagugcaacccagu

SEQ ID NO: 971603 - RNA, 17 nt, Homo sapiens
agaacagguucuuaaaa

SEQ ID NO: 971604 - RNA, 20 nt, Homo sapiens
agaaccacacuugaaaccuu

SEQ ID NO: 971605 - RNA, 16 nt, Homo sapiens
agaaccagggcucuuc

SEQ ID NO: 971606 - RNA, 19 nt, Homo sapiens
agaaccagggcucuucuca

SEQ ID NO: 971607 - RNA, 18 nt, Homo sapiens
agaacccaccaaccagaa

SEQ ID NO: 971608 - RNA, 19 nt, Homo sapiens
agaacccaguguuuccaca

SEQ ID NO: 971609 - RNA, 21 nt, Homo sapiens
agaaccuauagcaucuucuca

SEQ ID NO: 971610 - RNA, 22 nt, Homo sapiens
agaaccuugucccagccaguga

SEQ ID NO: 971611 - RNA, 20 nt, Homo sapiens
agaacuagccaaaccaggac

SEQ ID NO: 971612 - RNA, 14 nt, Homo sapiens
agaacugugccaca

SEQ ID NO: 971613 - RNA, 18 nt, Homo sapiens
agaagacaccagagcaga

SEQ ID NO: 971614 - RNA, 13 nt, Homo sapiens
agaagcaagccag

SEQ ID NO: 971615 - RNA, 14 nt, Homo sapiens
agaagcaagccaga

SEQ ID NO: 971616 - RNA, 19 nt, Homo sapiens
agaagccuccaagcacaga

SEQ ID NO: 971617 - RNA, 13 nt, Homo sapiens
agaagcucuuacu

SEQ ID NO: 971618 - RNA, 23 nt, Homo sapiens
agaaggaaaaaauaaaagaucuu

SEQ ID NO: 971619 - RNA, 19 nt, Homo sapiens
agaaggaaccagccaugag

SEQ ID NO: 971620 - RNA, 13 nt, Homo sapiens
agaaggugccacu

SEQ ID NO: 971621 - RNA, 13 nt, Homo sapiens
agaaguuccucaa

SEQ ID NO: 971622 - RNA, 19 nt, Homo sapiens
agaauaaaaacuuccuuca

SEQ ID NO: 971623 - RNA, 13 nt, Homo sapiens
agaauaagccuuc

SEQ ID NO: 971624 - RNA, 13 nt, Homo sapiens
agaauacacagga

SEQ ID NO: 971625 - RNA, 13 nt, Homo sapiens
agaaucagaauuu

SEQ ID NO: 971626 - RNA, 23 nt, Homo sapiens
agaaucagcauuuagucuugcca

SEQ ID NO: 971627 - RNA, 15 nt, Homo sapiens
agaaucccugccugu

SEQ ID NO: 971628 - RNA, 23 nt, Homo sapiens
agaaucccuuugcaccugagacc

SEQ ID NO: 971629 - RNA, 19 nt, Homo sapiens
agaaucgcuugaacccagg

SEQ ID NO: 971630 - RNA, 22 nt, Homo sapiens
agaaucuguauucagacccugg

SEQ ID NO: 971631 - RNA, 13 nt, Homo sapiens
agacaaggugcua

SEQ ID NO: 971632 - RNA, 11 nt, Homo sapiens
agacacagacu

SEQ ID NO: 971633 - RNA, 15 nt, Homo sapiens
agacacugaucuggc

SEQ ID NO: 971634 - RNA, 13 nt, Homo sapiens
agacagugcggau

SEQ ID NO: 971635 - RNA, 22 nt, Homo sapiens
agacauaaaggaaaagacacau

SEQ ID NO: 971636 - RNA, 23 nt, Homo sapiens
agacauaaaguaaaauaguuuau

SEQ ID NO: 971637 - RNA, 13 nt, Homo sapiens
agacauucucaca

SEQ ID NO: 971638 - RNA, 22 nt, Homo sapiens
agacauuuuaaaaaauggucac

SEQ ID NO: 971639 - RNA, 22 nt, Homo sapiens
agaccaagacuuuugucugauc

SEQ ID NO: 971640 - RNA, 15 nt, Homo sapiens
agaccaccacauuga

SEQ ID NO: 971641 - RNA, 17 nt, Homo sapiens
agaccaguauggcaaaa

SEQ ID NO: 971642 - RNA, 19 nt, Homo sapiens
agacccaguggacucuucc

SEQ ID NO: 971643 - RNA, 21 nt, Homo sapiens
acccaauuugauuugaauauu

SEQ ID NO: 971644 - RNA, 20 nt, Homo sapiens
acccaccuagaacacuaacu

SEQ ID NO: 971645 - RNA, 14 nt, Homo sapiens
acccacugacccac

SEQ ID NO: 971646 - RNA, 19 nt, Homo sapiens
acccagggaacagccacuc

SEQ ID NO: 971647 - RNA, 16 nt, Homo sapiens
acccagggacucucca

SEQ ID NO: 971648 - RNA, 22 nt, Homo sapiens
acccagggugugaacauguucu

SEQ ID NO: 971649 - RNA, 15 nt, Homo sapiens
acccauggcuguguu

SEQ ID NO: 971650 - RNA, 19 nt, Homo sapiens
acccccguguccaccguga

SEQ ID NO: 971651 - RNA, 21 nt, Homo sapiens
accccugaaacuggaccugca

SEQ ID NO: 971652 - RNA, 22 nt, Homo sapiens
accccugaaacuggaccugcau

SEQ ID NO: 971653 - RNA, 23 nt, Homo sapiens
accccugcccccagccccggggu

SEQ ID NO: 971654 - RNA, 22 nt, Homo sapiens
accccugcucaguaaagcacuu

SEQ ID NO: 971655 - RNA, 21 nt, Homo sapiens
accccuuccagaucacugcca

SEQ ID NO: 971656 - RNA, 13 nt, Homo sapiens
accccuuucccac

SEQ ID NO: 971657 - RNA, 18 nt, Homo sapiens
acccgacugaaacuggaa

SEQ ID NO: 971658 - RNA, 18 nt, Homo sapiens
acccgagggccagguuag

SEQ ID NO: 971659 - RNA, 22 nt, Homo sapiens
acccguggcugaugguguggcc

SEQ ID NO: 971660 - RNA, 20 nt, Homo sapiens
acccuagccaaugucuccuc

SEQ ID NO: 971661 - RNA, 16 nt, Homo sapiens
acccuaucuccugaca

SEQ ID NO: 971662 - RNA, 22 nt, Homo sapiens
acccuccagagacaacagguaa

SEQ ID NO: 971663 - RNA, 19 nt, Homo sapiens
acccuggucucaucagucc

SEQ ID NO: 971664 - RNA, 14 nt, Homo sapiens
acccuuaccaaaaa

SEQ ID NO: 971665 - RNA, 20 nt, Homo sapiens
acccuugaucuuaacaaagc

SEQ ID NO: 971666 - RNA, 21 nt, Homo sapiens
acccuuuggccccacuuugaa

SEQ ID NO: 971667 - RNA, 20 nt, Homo sapiens
accgagccacgcagugccug

SEQ ID NO: 971668 - RNA, 17 nt, Homo sapiens
accgcccaucaggguuc

SEQ ID NO: 971669 - RNA, 22 nt, Homo sapiens
accgcccaucaggguucucuua

SEQ ID NO: 971670 - RNA, 22 nt, Homo sapiens
accgcgcccagccuacauucac

SEQ ID NO: 971671 - RNA, 14 nt, Homo sapiens
accguccuggagcu

SEQ ID NO: 971672 - RNA, 14 nt, Homo sapiens
accuaacacauuaa

SEQ ID NO: 971673 - RNA, 17 nt, Homo sapiens
accuaccaaaauggaau

SEQ ID NO: 971674 - RNA, 19 nt, Homo sapiens
accuacuuuucuuuccuca

SEQ ID NO: 971675 - RNA, 17 nt, Homo sapiens
accuagcaggcuguucc

SEQ ID NO: 971676 - RNA, 21 nt, Homo sapiens
accuauagcaucuucucauuc

SEQ ID NO: 971677 - RNA, 22 nt, Homo sapiens
accucaacugccuacuccaaaa

SEQ ID NO: 971678 - RNA, 17 nt, Homo sapiens
accucacgcucuggaca

SEQ ID NO: 971679 - RNA, 18 nt, Homo sapiens
accucagaaagauuugau

SEQ ID NO: 971680 - RNA, 18 nt, Homo sapiens
accuccaggcuccagcac

SEQ ID NO: 971681 - RNA, 16 nt, Homo sapiens
accuccgccauccacc

SEQ ID NO: 971682 - RNA, 23 nt, Homo sapiens
accuccuauccuuggagagcagc

SEQ ID NO: 971683 - RNA, 16 nt, Homo sapiens
accugaccccauuccu

SEQ ID NO: 971684 - RNA, 19 nt, Homo sapiens
accugagcgggugccgaag

SEQ ID NO: 971685 - RNA, 20 nt, Homo sapiens
gucuguagcuccucaacuca

SEQ ID NO: 971686 - RNA, 16 nt, Homo sapiens
gucugugaagucaaga

SEQ ID NO: 971687 - RNA, 21 nt, Homo sapiens
gucuucagugucuuaaugugg

SEQ ID NO: 971688 - RNA, 18 nt, Homo sapiens
gucuuccugacacuuuaa

SEQ ID NO: 971689 - RNA, 19 nt, Homo sapiens
gucuuccugacacuuuaau

SEQ ID NO: 971690 - RNA, 20 nt, Homo sapiens
gucuuuccugaaccaugugg

SEQ ID NO: 971691 - RNA, 19 nt, Homo sapiens
gucuuucugaauugcacau

SEQ ID NO: 971692 - RNA, 21 nt, Homo sapiens
gucuuucuuuuauacugacac

SEQ ID NO: 971693 - RNA, 13 nt, Homo sapiens
gucuuuggugcuu

SEQ ID NO: 971694 - RNA, 16 nt, Homo sapiens
gucuuuguucugugau

SEQ ID NO: 971695 - RNA, 17 nt, Homo sapiens
gucuuuguucugugauu

SEQ ID NO: 971696 - RNA, 12 nt, Homo sapiens
gugaaaauauga

SEQ ID NO: 971697 - RNA, 13 nt, Homo sapiens
gugaaacuaacag

SEQ ID NO: 971698 - RNA, 19 nt, Homo sapiens
gugaacauucccagcccag

SEQ ID NO: 971699 - RNA, 21 nt, Homo sapiens
gugaaccauggugaagugcuu

SEQ ID NO: 971700 - RNA, 20 nt, Homo sapiens
gugaagagggagaagcauga

SEQ ID NO: 971701 - RNA, 12 nt, Homo sapiens
gugaaguguuac

SEQ ID NO: 971702 - RNA, 23 nt, Homo sapiens
gugacaagaauaauuuuggaaua

SEQ ID NO: 971703 - RNA, 12 nt, Homo sapiens
gugacacauaug

SEQ ID NO: 971704 - RNA, 23 nt, Homo sapiens
gugacagcuuucugggaugucac

SEQ ID NO: 971705 - RNA, 22 nt, Homo sapiens
gugacuuugagcugagugcuga

SEQ ID NO: 971706 - RNA, 16 nt, Homo sapiens
gugagaaacaucucaa

SEQ ID NO: 971707 - RNA, 18 nt, Homo sapiens
gugagccaagauugcacc

SEQ ID NO: 971708 - RNA, 22 nt, Homo sapiens
gugagcuggauagacuugggau

SEQ ID NO: 971709 - RNA, 16 nt, Homo sapiens
gugauggacacuccag

SEQ ID NO: 971710 - RNA, 20 nt, Homo sapiens
gugauucaccucuucuuucc

SEQ ID NO: 971711 - RNA, 16 nt, Homo sapiens
gugcaacccagucaca

SEQ ID NO: 971712 - RNA, 17 nt, Homo sapiens
gugcagcccaaucugcc

SEQ ID NO: 971713 - RNA, 15 nt, Homo sapiens
gugcaucccugagac

SEQ ID NO: 971714 - RNA, 12 nt, Homo sapiens
gugccaaaaauc

SEQ ID NO: 971715 - RNA, 19 nt, Homo sapiens
gugccaaaaaucuuuucau

SEQ ID NO: 971716 - RNA, 20 nt, Homo sapiens
gugccaggccagugaccuca

SEQ ID NO: 971717 - RNA, 21 nt, Homo sapiens
gugccaggcuguaagcauucu

SEQ ID NO: 971718 - RNA, 15 nt, Homo sapiens
gugcccacauuugau

SEQ ID NO: 971719 - RNA, 20 nt, Homo sapiens
gugcccauccugccauccuc

SEQ ID NO: 971720 - RNA, 21 nt, Homo sapiens
gugccccagggaguccagggu

SEQ ID NO: 971721 - RNA, 17 nt, Homo sapiens
gugccugauccaucccc

SEQ ID NO: 971722 - RNA, 18 nt, Homo sapiens
gugccugccaccuucaag

SEQ ID NO: 971723 - RNA, 21 nt, Homo sapiens
gugcucuccauucugcuccuu

SEQ ID NO: 971724 - RNA, 15 nt, Homo sapiens
gugcugucauuauuu

SEQ ID NO: 971725 - RNA, 15 nt, Homo sapiens
gugcuguuguucucg

SEQ ID NO: 971726 - RNA, 18 nt, Homo sapiens
gugcuuaaaaaucauuga

SEQ ID NO: 971727 - RNA, 19 nt, Homo sapiens
gugcuuccgagcugggaug

SEQ ID NO: 971728 - RNA, 16 nt, Homo sapiens
guggauaacuuuacag

SEQ ID NO: 971729 - RNA, 20 nt, Homo sapiens
guggccgugccugagcugca

SEQ ID NO: 971730 - RNA, 23 nt, Homo sapiens
guggcugauuuacuaacaguaac

SEQ ID NO: 971731 - RNA, 13 nt, Homo sapiens
gugggacugagau

SEQ ID NO: 971732 - RNA, 21 nt, Homo sapiens
gugggauauugaauguuaaag

SEQ ID NO: 971733 - RNA, 23 nt, Homo sapiens
gugggugggagugugucugcuga

SEQ ID NO: 971734 - RNA, 22 nt, Homo sapiens
guggucuaagguucagccugaa

SEQ ID NO: 971735 - RNA, 22 nt, Homo sapiens
gugguguuuucagggcacugug

SEQ ID NO: 971736 - RNA, 17 nt, Homo sapiens
gugguuccucugcucac

SEQ ID NO: 971737 - RNA, 21 nt, Homo sapiens
ccugaacguuuucuucuuucc

SEQ ID NO: 971738 - RNA, 23 nt, Homo sapiens
ccugaauauuuguuauguagaua

SEQ ID NO: 971739 - RNA, 11 nt, Homo sapiens
ccugacacuga

SEQ ID NO: 971740 - RNA, 20 nt, Homo sapiens
ccugacccuccuccacucca

SEQ ID NO: 971741 - RNA, 23 nt, Homo sapiens
ccugacuuggcuggggaggacca

SEQ ID NO: 971742 - RNA, 15 nt, Homo sapiens
ccugagaagccagug

SEQ ID NO: 971743 - RNA, 13 nt, Homo sapiens
ccugagaccucaa

SEQ ID NO: 971744 - RNA, 17 nt, Homo sapiens
ccugaggaugggucaga

SEQ ID NO: 971745 - RNA, 12 nt, Homo sapiens
ccugauggugcu

SEQ ID NO: 971746 - RNA, 21 nt, Homo sapiens
ccugcacggggcauuccugcu

SEQ ID NO: 971747 - RNA, 13 nt, Homo sapiens
ccugcagaugcca

SEQ ID NO: 971748 - RNA, 18 nt, Homo sapiens
ccugccacagccagagga

SEQ ID NO: 971749 - RNA, 13 nt, Homo sapiens
ccugccaccuuca

SEQ ID NO: 971750 - RNA, 13 nt, Homo sapiens
ccugccaggcaca

SEQ ID NO: 971751 - RNA, 21 nt, Homo sapiens
ccugccccagauuuacuaaau

SEQ ID NO: 971752 - RNA, 14 nt, Homo sapiens
ccugccccagcacu

SEQ ID NO: 971753 - RNA, 16 nt, Homo sapiens
ccugccgucugugcuu

SEQ ID NO: 971754 - RNA, 22 nt, Homo sapiens
ccugcggcuccggggccaaggc

SEQ ID NO: 971755 - RNA, 16 nt, Homo sapiens
ccugcuaaagacagug

SEQ ID NO: 971756 - RNA, 10 nt, Homo sapiens
ccugcuggaa

SEQ ID NO: 971757 - RNA, 23 nt, Homo sapiens
ccugcuggaaaccacacuucuug

SEQ ID NO: 971758 - RNA, 19 nt, Homo sapiens
ccuggaaucuacaagccaa

SEQ ID NO: 971759 - RNA, 22 nt, Homo sapiens
ccuggacaguaucccacaucca

SEQ ID NO: 971760 - RNA, 17 nt, Homo sapiens
ccuggagacaaggugcu

SEQ ID NO: 971761 - RNA, 20 nt, Homo sapiens
ccuggauggggcaggccacc

SEQ ID NO: 971762 - RNA, 17 nt, Homo sapiens
ccuggccccacaagcca

SEQ ID NO: 971763 - RNA, 18 nt, Homo sapiens
ccuggcccccaaccucag

SEQ ID NO: 971764 - RNA, 14 nt, Homo sapiens
ccugggacuuccau

SEQ ID NO: 971765 - RNA, 19 nt, Homo sapiens
ccuggggcagaaagccaca

SEQ ID NO: 971766 - RNA, 12 nt, Homo sapiens
ccugggugugcc

SEQ ID NO: 971767 - RNA, 20 nt, Homo sapiens
ccugguagaucaagcauuac

SEQ ID NO: 971768 - RNA, 16 nt, Homo sapiens
ccugguauauccaaaa

SEQ ID NO: 971769 - RNA, 22 nt, Homo sapiens
ccuguccggaaugccacccaca

SEQ ID NO: 971770 - RNA, 15 nt, Homo sapiens
ccugugauccaccca

SEQ ID NO: 971771 - RNA, 23 nt, Homo sapiens
ccugugccguuuucuugcucaaa

SEQ ID NO: 971772 - RNA, 15 nt, Homo sapiens
ccugugucaucccau

SEQ ID NO: 971773 - RNA, 16 nt, Homo sapiens
ccuguguuaaugcuuu

SEQ ID NO: 971774 - RNA, 15 nt, Homo sapiens
ccuguuagacguccu

SEQ ID NO: 971775 - RNA, 17 nt, Homo sapiens
ccuguugguuagauuca

SEQ ID NO: 971776 - RNA, 16 nt, Homo sapiens
ccuuaaaaauguaugu

SEQ ID NO: 971777 - RNA, 16 nt, Homo sapiens
ccuuaaaaccaaagag

SEQ ID NO: 971778 - RNA, 19 nt, Homo sapiens
ccuuaagggguaucaugua

SEQ ID NO: 971779 - RNA, 14 nt, Homo sapiens
ccuuaccgcucugu

SEQ ID NO: 971780 - RNA, 13 nt, Homo sapiens
ccuucaaaccuca

SEQ ID NO: 971781 - RNA, 16 nt, Homo sapiens
ccuucagcuccaggga

SEQ ID NO: 971782 - RNA, 21 nt, Homo sapiens
ccuucaguaaaugugauucac

SEQ ID NO: 971783 - RNA, 16 nt, Homo sapiens
ccuuccacucuggaac

SEQ ID NO: 971784 - RNA, 20 nt, Homo sapiens
ccuuccagaucacugccaca

SEQ ID NO: 971785 - RNA, 21 nt, Homo sapiens
ccuucuauuuggggcuugaug

SEQ ID NO: 971786 - RNA, 19 nt, Homo sapiens
ccuucucuacacucuugua

SEQ ID NO: 971787 - RNA, 22 nt, Homo sapiens
ccuugacguuucuucuuucuag

SEQ ID NO: 971788 - RNA, 15 nt, Homo sapiens
ccuugagaagccaac

SEQ ID NO: 971789 - RNA, 22 nt, Homo sapiens
ccuugauauaaaaaaucuuuag

SEQ ID NO: 971790 - RNA, 14 nt, Homo sapiens
ccuugccagggcag

SEQ ID NO: 971791 - RNA, 14 nt, Homo sapiens
ccuugcuuccugau

SEQ ID NO: 971792 - RNA, 22 nt, Homo sapiens
ccuuggaggcccugcacugcca

SEQ ID NO: 971793 - RNA, 17 nt, Homo sapiens
ccuuggugccugaucca

SEQ ID NO: 971794 - RNA, 14 nt, Homo sapiens
ccuuguauucugag

SEQ ID NO: 971795 - RNA, 14 nt, Homo sapiens
ccuugucuaaagau

SEQ ID NO: 971796 - RNA, 23 nt, Homo sapiens
ccuuguuggggaguggguggcag

SEQ ID NO: 971797 - RNA, 16 nt, Homo sapiens
ccuuuagaaccuuaaa

SEQ ID NO: 971798 - RNA, 17 nt, Homo sapiens
ccuuucagugcaguuuc

SEQ ID NO: 971799 - RNA, 21 nt, Homo sapiens
ccuuugcuaaugcuaugcaaa

SEQ ID NO: 971800 - RNA, 13 nt, Homo sapiens
ccuuuuccacuuu

SEQ ID NO: 971801 - RNA, 12 nt, Homo sapiens
ccuuuugugcaa

SEQ ID NO: 971802 - RNA, 15 nt, Homo sapiens
ccuuuuucacuuuga

SEQ ID NO: 971803 - RNA, 16 nt, Homo sapiens
ccuuuuucacuuugaa

SEQ ID NO: 971804 - RNA, 15 nt, Homo sapiens
ccuuuuugacacuga

SEQ ID NO: 971805 - RNA, 23 nt, Homo sapiens
cgacagaggagcuuuucuggaau

SEQ ID NO: 971806 - RNA, 21 nt, Homo sapiens
cgagaucacgucacugcacuc

SEQ ID NO: 971807 - RNA, 17 nt, Homo sapiens
cgagccaggaccacaga

SEQ ID NO: 971808 - RNA, 14 nt, Homo sapiens
cgagccugcacugg

SEQ ID NO: 971809 - RNA, 18 nt, Homo sapiens
cgagcuacucucuugcca

SEQ ID NO: 971810 - RNA, 22 nt, Homo sapiens
cgaguacugggacaaccucauc

SEQ ID NO: 971811 - RNA, 15 nt, Homo sapiens
cgagucauggcuaau

SEQ ID NO: 971812 - RNA, 15 nt, Homo sapiens
cgaucucuccuggcc

SEQ ID NO: 971813 - RNA, 20 nt, Homo sapiens
cgcaccggagugucuggaau

SEQ ID NO: 971814 - RNA, 15 nt, Homo sapiens
cugaaauaauuugag

SEQ ID NO: 971815 - RNA, 19 nt, Homo sapiens
cugaacucaaacugaggaa

SEQ ID NO: 971816 - RNA, 17 nt, Homo sapiens
cugaacuccugccauag

SEQ ID NO: 971817 - RNA, 14 nt, Homo sapiens
cugaaucaugagcc

SEQ ID NO: 971818 - RNA, 23 nt, Homo sapiens
cugaauccaaacuaauccaucac

SEQ ID NO: 971819 - RNA, 21 nt, Homo sapiens
cugacauuucuucuagugaug

SEQ ID NO: 971820 - RNA, 20 nt, Homo sapiens
cugacccuccuccacuccac

SEQ ID NO: 971821 - RNA, 14 nt, Homo sapiens
cugaccuguguucc

SEQ ID NO: 971822 - RNA, 17 nt, Homo sapiens
cugagaaaagccucucc

SEQ ID NO: 971823 - RNA, 12 nt, Homo sapiens
cugagaccucaa

SEQ ID NO: 971824 - RNA, 13 nt, Homo sapiens
cugagaccucaau

SEQ ID NO: 971825 - RNA, 12 nt, Homo sapiens
cugagacugugc

SEQ ID NO: 971826 - RNA, 22 nt, Homo sapiens
cugagacuuaagggaacugaau

SEQ ID NO: 971827 - RNA, 22 nt, Homo sapiens
cugagaggcaggcauagaggcu

SEQ ID NO: 971828 - RNA, 14 nt, Homo sapiens
cugagaucgugcua

SEQ ID NO: 971829 - RNA, 18 nt, Homo sapiens
cugagauugcagauguga

SEQ ID NO: 971830 - RNA, 20 nt, Homo sapiens
cugagcccccacugcuucua

SEQ ID NO: 971831 - RNA, 23 nt, Homo sapiens
cugagcugcagcucuccaccagc

SEQ ID NO: 971832 - RNA, 20 nt, Homo sapiens
cugaggacccgugugacucg

SEQ ID NO: 971833 - RNA, 23 nt, Homo sapiens
cugaggacccgugugacucgcca

SEQ ID NO: 971834 - RNA, 18 nt, Homo sapiens
cugaggcagcgaccucaa

SEQ ID NO: 971835 - RNA, 22 nt, Homo sapiens
cugaggcccagugcauaugcaa

SEQ ID NO: 971836 - RNA, 22 nt, Homo sapiens
cugagggauuuucacagugugc

SEQ ID NO: 971837 - RNA, 18 nt, Homo sapiens
cugaguaagcccucagga

SEQ ID NO: 971838 - RNA, 19 nt, Homo sapiens
cugaguaagcccucaggag

SEQ ID NO: 971839 - RNA, 15 nt, Homo sapiens
cugagucaucuguua

SEQ ID NO: 971840 - RNA, 22 nt, Homo sapiens
cugagugcgggcugaggccaga

SEQ ID NO: 971841 - RNA, 14 nt, Homo sapiens
cugaguugcuuuua

SEQ ID NO: 971842 - RNA, 14 nt, Homo sapiens
cugaucauuacaug

SEQ ID NO: 971843 - RNA, 15 nt, Homo sapiens
cugaugcugggcaau

SEQ ID NO: 971844 - RNA, 17 nt, Homo sapiens
cugaugguggcucuggu

SEQ ID NO: 971845 - RNA, 14 nt, Homo sapiens
cugauuguuuucau

SEQ ID NO: 971846 - RNA, 22 nt, Homo sapiens
cugauuucuuaggggaaggaga

SEQ ID NO: 971847 - RNA, 17 nt, Homo sapiens
cugauuuguaacccacu

SEQ ID NO: 971848 - RNA, 19 nt, Homo sapiens
cugauuuuggccaucagga

SEQ ID NO: 971849 - RNA, 13 nt, Homo sapiens
cugcaaacuggga

SEQ ID NO: 971850 - RNA, 14 nt, Homo sapiens
cugcaaacugggaa

SEQ ID NO: 971851 - RNA, 16 nt, Homo sapiens
cugcaagcuucuugcu

SEQ ID NO: 971852 - RNA, 13 nt, Homo sapiens
cugcacacagaau

SEQ ID NO: 971853 - RNA, 16 nt, Homo sapiens
cugcaccuaaagccua

SEQ ID NO: 971854 - RNA, 19 nt, Homo sapiens
gaucuauauuucuggugaa

SEQ ID NO: 971855 - RNA, 17 nt, Homo sapiens
gaucuugaauagucuca

SEQ ID NO: 971856 - RNA, 22 nt, Homo sapiens
gaugaaaaauaugugcuugaaa

SEQ ID NO: 971857 - RNA, 15 nt, Homo sapiens
gaugaaagugcuuca

SEQ ID NO: 971858 - RNA, 14 nt, Homo sapiens
gaugaacaucuaac

SEQ ID NO: 971859 - RNA, 19 nt, Homo sapiens
gaugcaacaaauguggcca

SEQ ID NO: 971860 - RNA, 14 nt, Homo sapiens
gaugcaagugcaac

SEQ ID NO: 971861 - RNA, 12 nt, Homo sapiens
gaugcauuuaau

SEQ ID NO: 971862 - RNA, 13 nt, Homo sapiens
gauggauguuggg

SEQ ID NO: 971863 - RNA, 20 nt, Homo sapiens
gauggcauuuggucucaggc

SEQ ID NO: 971864 - RNA, 23 nt, Homo sapiens
gaugggauggcaaaugcugugaa

SEQ ID NO: 971865 - RNA, 14 nt, Homo sapiens
gaugugagccaccg

SEQ ID NO: 971866 - RNA, 20 nt, Homo sapiens
gaugugagccuugugcaugu

SEQ ID NO: 971867 - RNA, 18 nt, Homo sapiens
gauguggcccuggcugcc

SEQ ID NO: 971868 - RNA, 22 nt, Homo sapiens
gauuaagauauucagaaguaua

SEQ ID NO: 971869 - RNA, 19 nt, Homo sapiens
gauuacaggcgugagccac

SEQ ID NO: 971870 - RNA, 13 nt, Homo sapiens
gauuauaaacuga

SEQ ID NO: 971871 - RNA, 15 nt, Homo sapiens
gauucaccucuucuu

SEQ ID NO: 971872 - RNA, 15 nt, Homo sapiens
gauucuaaagcucaa

SEQ ID NO: 971873 - RNA, 15 nt, Homo sapiens
gauucugaaucucaa

SEQ ID NO: 971874 - RNA, 14 nt, Homo sapiens
gauucuuuguuaca

SEQ ID NO: 971875 - RNA, 17 nt, Homo sapiens
gauuucaguucuaggaa

SEQ ID NO: 971876 - RNA, 16 nt, Homo sapiens
gauuuccuugugcaaa

SEQ ID NO: 971877 - RNA, 22 nt, Homo sapiens
gauuugauugggaugaaugcca

SEQ ID NO: 971878 - RNA, 20 nt, Homo sapiens
gauuuggggcagagggacag

SEQ ID NO: 971879 - RNA, 18 nt, Homo sapiens
gauuuguaugcucauuga

SEQ ID NO: 971880 - RNA, 22 nt, Homo sapiens
gauuuugaacuugaguaauuca

SEQ ID NO: 971881 - RNA, 23 nt, Homo sapiens
gauuuuggccaucaggacucuga

SEQ ID NO: 971882 - RNA, 20 nt, Homo sapiens
gauuuuuuaaauugucauaa

SEQ ID NO: 971883 - RNA, 15 nt, Homo sapiens
gcaaaaugcuuacag

SEQ ID NO: 971884 - RNA, 18 nt, Homo sapiens
gcaaacugggaaccccuu

SEQ ID NO: 971885 - RNA, 15 nt, Homo sapiens
gcaaagccaaaaccu

SEQ ID NO: 971886 - RNA, 22 nt, Homo sapiens
gcaaaggaaaaauugaugaaua

SEQ ID NO: 971887 - RNA, 16 nt, Homo sapiens
gcaaaggcgucugaau

SEQ ID NO: 971888 - RNA, 22 nt, Homo sapiens
gcaaauaaaauaaaugaaaucu

SEQ ID NO: 971889 - RNA, 18 nt, Homo sapiens
gcaaauaaagaccugaga

SEQ ID NO: 971890 - RNA, 14 nt, Homo sapiens
gcaaccucuuugcu

SEQ ID NO: 971891 - RNA, 16 nt, Homo sapiens
gcaaccucuuugcuca

SEQ ID NO: 971892 - RNA, 18 nt, Homo sapiens
gcaacuucuucuccaucc

SEQ ID NO: 971893 - RNA, 22 nt, Homo sapiens
gcaagagcaccuggccaagcga

SEQ ID NO: 971894 - RNA, 18 nt, Homo sapiens
gcaaguuuuaaacccaaa

SEQ ID NO: 971895 - RNA, 17 nt, Homo sapiens
gcaauaucuacauucua

SEQ ID NO: 971896 - RNA, 20 nt, Homo sapiens
gcaauauucuguaacuauug

SEQ ID NO: 971897 - RNA, 18 nt, Homo sapiens
gcaauccaccugccuugg

SEQ ID NO: 971898 - RNA, 15 nt, Homo sapiens
gcaaucugacccuau

SEQ ID NO: 971899 - RNA, 22 nt, Homo sapiens
gcaaugaggcagauagcacugg

SEQ ID NO: 971900 - RNA, 18 nt, Homo sapiens
gcaaugcuaauucaaugc

SEQ ID NO: 971901 - RNA, 23 nt, Homo sapiens
gcacacauugaagguauaugcca

SEQ ID NO: 971902 - RNA, 23 nt, Homo sapiens
gcacagagcaguggccaggccac

SEQ ID NO: 971903 - RNA, 14 nt, Homo sapiens
gcacagaugccugg

SEQ ID NO: 971904 - RNA, 22 nt, Homo sapiens
gcacaggcagauguuugccuca

SEQ ID NO: 971905 - RNA, 11 nt, Homo sapiens
gcacaguauuu

SEQ ID NO: 971906 - RNA, 15 nt, Homo sapiens
gcacagucacugcuc

SEQ ID NO: 971907 - RNA, 16 nt, Homo sapiens
gcacaguccagaccca

SEQ ID NO: 971908 - RNA, 23 nt, Homo sapiens
gcacauugucaccccaagccaua

SEQ ID NO: 971909 - RNA, 14 nt, Homo sapiens
gcacauuucuuugc

SEQ ID NO: 971910 - RNA, 20 nt, Homo sapiens
gcaccacugcucuccagccu

SEQ ID NO: 971911 - RNA, 13 nt, Homo sapiens
gcacccucaggga

SEQ ID NO: 971912 - RNA, 14 nt, Homo sapiens
gcaccuaaagccua

SEQ ID NO: 971913 - RNA, 17 nt, Homo sapiens
gcaccuccagccugaac

SEQ ID NO: 971914 - RNA, 13 nt, Homo sapiens
gcaccucuuccuu

SEQ ID NO: 971915 - RNA, 20 nt, Homo sapiens
gcaccugagacccuacugaa

SEQ ID NO: 971916 - RNA, 21 nt, Homo sapiens
gcaccuguagucccagcuacu

SEQ ID NO: 971917 - RNA, 24 nt, Homo sapiens
gcaccuugugucuguacacguguc

SEQ ID NO: 971918 - RNA, 20 nt, Homo sapiens
gcacgcuccugccuacccag

SEQ ID NO: 971919 - RNA, 16 nt, Homo sapiens
gcacggcccguggcug

SEQ ID NO: 971920 - RNA, 21 nt, Homo sapiens
gcacugaggcagcgaccucaa

SEQ ID NO: 971921 - RNA, 14 nt, Homo sapiens
gcagaaagccacaa

SEQ ID NO: 971922 - RNA, 17 nt, Homo sapiens
gcagaaagccacaaacu

SEQ ID NO: 971923 - RNA, 17 nt, Homo sapiens
gcagagguguaggggug

SEQ ID NO: 971924 - RNA, 14 nt, Homo sapiens
gcagauuuaagaua

SEQ ID NO: 971925 - RNA, 22 nt, Homo sapiens
gcagcacuccgcaucaccucac

SEQ ID NO: 971926 - RNA, 22 nt, Homo sapiens
gcagcucauuuugucugguccu

SEQ ID NO: 971927 - RNA, 20 nt, Homo sapiens
gcagcucccuuucucaggag

SEQ ID NO: 971928 - RNA, 13 nt, Homo sapiens
gcagcucugugac

SEQ ID NO: 971929 - RNA, 21 nt, Homo sapiens
gcagcuggugcuccaagcaca

SEQ ID NO: 971930 - RNA, 24 nt, Homo sapiens
gcaggauuucuucacaccucuccu

SEQ ID NO: 971931 - RNA, 14 nt, Homo sapiens
gcaggccacugggg

SEQ ID NO: 971932 - RNA, 19 nt, Homo sapiens
gcaggcuuugccauuguga

SEQ ID NO: 971933 - RNA, 14 nt, Homo sapiens
gcagggcagccugu

SEQ ID NO: 971934 - RNA, 17 nt, Homo sapiens
gcagguaggucggcacu

SEQ ID NO: 971935 - RNA, 11 nt, Homo sapiens
gcagguugaga

SEQ ID NO: 971936 - RNA, 20 nt, Homo sapiens
gcaguaccaaaguaacugaa

SEQ ID NO: 971937 - RNA, 20 nt, Homo sapiens
gcaguaccaucuacaucucc

SEQ ID NO: 971938 - RNA, 13 nt, Homo sapiens
gcaguauugacaa

SEQ ID NO: 971939 - RNA, 12 nt, Homo sapiens
gcagugcaaugc

SEQ ID NO: 971940 - RNA, 22 nt, Homo sapiens
gcaguggaguaaguauuuagaa

SEQ ID NO: 971941 - RNA, 19 nt, Homo sapiens
gcaguuggccaagcagaaa

SEQ ID NO: 971942 - RNA, 23 nt, Homo sapiens
gcaguuucaucaaagaacaaaca

SEQ ID NO: 971943 - RNA, 23 nt, Homo sapiens
gcauaaaguaaauacaugcauau

SEQ ID NO: 971944 - RNA, 22 nt, Homo sapiens
gcauaaauccauccauccaaag

SEQ ID NO: 971945 - RNA, 20 nt, Homo sapiens
gcauaagagcuuaagaacca

SEQ ID NO: 971946 - RNA, 18 nt, Homo sapiens
gcauaauaagcuaaagag

SEQ ID NO: 971947 - RNA, 15 nt, Homo sapiens
gcauacugagaauau

SEQ ID NO: 971948 - RNA, 18 nt, Homo sapiens
gcauaugguccuagacaa

SEQ ID NO: 971949 - RNA, 16 nt, Homo sapiens
gcauauggugcuuaaa

SEQ ID NO: 971950 - RNA, 12 nt, Homo sapiens
gcaucauuucag

SEQ ID NO: 971951 - RNA, 19 nt, Homo sapiens
gcaucccugagacagggag

SEQ ID NO: 971952 - RNA, 19 nt, Homo sapiens
gcaugaaaaggaugcuccg

SEQ ID NO: 971953 - RNA, 13 nt, Homo sapiens
gcaugacacucua

SEQ ID NO: 971954 - RNA, 22 nt, Homo sapiens
gcaugcagcuuugcaaacccau

SEQ ID NO: 971955 - RNA, 13 nt, Homo sapiens
gcaugcugaaugc

SEQ ID NO: 971956 - RNA, 14 nt, Homo sapiens
gcauggacauuuag

SEQ ID NO: 971957 - RNA, 21 nt, Homo sapiens
gcaugucacuucccugcuuaa

SEQ ID NO: 971958 - RNA, 17 nt, Homo sapiens
gcauuaauagucccauu

SEQ ID NO: 971959 - RNA, 19 nt, Homo sapiens
gcauucauuuuuauagcaa

SEQ ID NO: 971960 - RNA, 16 nt, Homo sapiens
gcauuuagcacaguau

SEQ ID NO: 971961 - RNA, 23 nt, Homo sapiens
gccaaaaauacagccuauaguaa

SEQ ID NO: 971962 - RNA, 13 nt, Homo sapiens
gccaaagauuuca

SEQ ID NO: 971963 - RNA, 18 nt, Homo sapiens
gccaagagugaagggaag

SEQ ID NO: 971964 - RNA, 21 nt, Homo sapiens
gccaagauugcaccacugcuc

SEQ ID NO: 971965 - RNA, 21 nt, Homo sapiens
gccaagauuuuccucuuguga

SEQ ID NO: 971966 - RNA, 13 nt, Homo sapiens
gccaagguaggca

SEQ ID NO: 971967 - RNA, 16 nt, Homo sapiens
gccaaguggggugcug

SEQ ID NO: 971968 - RNA, 15 nt, Homo sapiens
caacucugaagcuaa

SEQ ID NO: 971969 - RNA, 17 nt, Homo sapiens
caacucugccuuuauga

SEQ ID NO: 971970 - RNA, 13 nt, Homo sapiens
caacucuugcaca

SEQ ID NO: 971971 - RNA, 12 nt, Homo sapiens
caacugauugca

SEQ ID NO: 971972 - RNA, 16 nt, Homo sapiens
caacuuagagauugca

SEQ ID NO: 971973 - RNA, 15 nt, Homo sapiens
caacuuuaagauaga

SEQ ID NO: 971974 - RNA, 22 nt, Homo sapiens
caagaaagcucacuguagcuuu

SEQ ID NO: 971975 - RNA, 17 nt, Homo sapiens
caagaaggaacaauaaa

SEQ ID NO: 971976 - RNA, 17 nt, Homo sapiens
caagacugagccagcuu

SEQ ID NO: 971977 - RNA, 18 nt, Homo sapiens
caagagauaagucuuuca

SEQ ID NO: 971978 - RNA, 19 nt, Homo sapiens
caagagauaagucuuucau

SEQ ID NO: 971979 - RNA, 12 nt, Homo sapiens
caagauugcacc

SEQ ID NO: 971980 - RNA, 17 nt, Homo sapiens
caagcaaaaugcuuaca

SEQ ID NO: 971981 - RNA, 19 nt, Homo sapiens
caagcagcuggugcuccaa

SEQ ID NO: 971982 - RNA, 12 nt, Homo sapiens
caagcauuucau

SEQ ID NO: 971983 - RNA, 21 nt, Homo sapiens
caagcauuucaugaaaaagcu

SEQ ID NO: 971984 - RNA, 17 nt, Homo sapiens
caagcgcucauguugag

SEQ ID NO: 971985 - RNA, 14 nt, Homo sapiens
caagcuuuugcuug

SEQ ID NO: 971986 - RNA, 21 nt, Homo sapiens
caaggaaccucaagucaugcu

SEQ ID NO: 971987 - RNA, 16 nt, Homo sapiens
caaggaccugagaccu

SEQ ID NO: 971988 - RNA, 22 nt, Homo sapiens
caaggacguggaugacccuccc

SEQ ID NO: 971989 - RNA, 13 nt, Homo sapiens
caaggacugagca

SEQ ID NO: 971990 - RNA, 14 nt, Homo sapiens
caaggagacugccu

SEQ ID NO: 971991 - RNA, 11 nt, Homo sapiens
caaggcauuua

SEQ ID NO: 971992 - RNA, 16 nt, Homo sapiens
caaggcugccagacau

SEQ ID NO: 971993 - RNA, 17 nt, Homo sapiens
caaggcuggcaggucaa

SEQ ID NO: 971994 - RNA, 20 nt, Homo sapiens
caagggggacugucuuucag

SEQ ID NO: 971995 - RNA, 18 nt, Homo sapiens
caaggugagaaaucacaa

SEQ ID NO: 971996 - RNA, 21 nt, Homo sapiens
caagguggccuuugugcugcg

SEQ ID NO: 971997 - RNA, 19 nt, Homo sapiens
caaggugggccuugcuacc

SEQ ID NO: 971998 - RNA, 17 nt, Homo sapiens
caaguaagaagacauga

SEQ ID NO: 971999 - RNA, 17 nt, Homo sapiens
caaguaucacacuuuaa

SEQ ID NO: 972000 - RNA, 17 nt, Homo sapiens
caagucaacacucuucu

SEQ ID NO: 972001 - RNA, 17 nt, Homo sapiens
caagucacccaucagau

SEQ ID NO: 972002 - RNA, 16 nt, Homo sapiens
caaguccucacucuuc

SEQ ID NO: 972003 - RNA, 19 nt, Homo sapiens
caaguggccauuaccaucu

SEQ ID NO: 972004 - RNA, 21 nt, Homo sapiens
caaguuagaaaacauaaucuu

SEQ ID NO: 972005 - RNA, 22 nt, Homo sapiens
caaguuagaaaacauaaucuuc

SEQ ID NO: 972006 - RNA, 17 nt, Homo sapiens
caauaaagcacugagca

SEQ ID NO: 972007 - RNA, 14 nt, Homo sapiens
caauaaagugcuuu

SEQ ID NO: 972008 - RNA, 20 nt, Homo sapiens
caauaaagugcuuuaaaaag

SEQ ID NO: 972009 - RNA, 18 nt, Homo sapiens
caaucugcaguuuaacaa

SEQ ID NO: 972010 - RNA, 13 nt, Homo sapiens
caaugaccaaaca

SEQ ID NO: 972011 - RNA, 20 nt, Homo sapiens
caauggaauacagucauucc

SEQ ID NO: 972012 - RNA, 15 nt, Homo sapiens
caauggcacgcuccu

SEQ ID NO: 972013 - RNA, 11 nt, Homo sapiens
caaugggaccu

SEQ ID NO: 972014 - RNA, 14 nt, Homo sapiens
caaugugauuuaua

SEQ ID NO: 972015 - RNA, 17 nt, Homo sapiens
caauuaaaaacaugaau

SEQ ID NO: 972016 - RNA, 14 nt, Homo sapiens
caauuaugugcaaa

SEQ ID NO: 972017 - RNA, 18 nt, Homo sapiens
caauuccugugauuuaug

SEQ ID NO: 972018 - RNA, 16 nt, Homo sapiens
caauugggagcugcca

SEQ ID NO: 972019 - RNA, 20 nt, Homo sapiens
caauuguuauguguuuagaa

SEQ ID NO: 972020 - RNA, 13 nt, Homo sapiens
caauuucauucaa

SEQ ID NO: 972021 - RNA, 18 nt, Homo sapiens
cacaaacaccuuaagcaa

SEQ ID NO: 972022 - RNA, 13 nt, Homo sapiens
cacaaacuccauc

SEQ ID NO: 972023 - RNA, 15 nt, Homo sapiens
cacaaacuccaucca

SEQ ID NO: 972024 - RNA, 15 nt, Homo sapiens
cacaaagcuauuuaa

SEQ ID NO: 972025 - RNA, 22 nt, Homo sapiens
cacaaaggaaguccaaccugag

SEQ ID NO: 972026 - RNA, 16 nt, Homo sapiens
cacaaccuuccagcuc

SEQ ID NO: 972027 - RNA, 19 nt, Homo sapiens
cacaaccuuccagcuccau

SEQ ID NO: 972028 - RNA, 22 nt, Homo sapiens
cacaagugguguuuauugcaau

SEQ ID NO: 972029 - RNA, 23 nt, Homo sapiens
cacaagugguguuuauugcaaua

SEQ ID NO: 972030 - RNA, 13 nt, Homo sapiens
cacacacgaugca

SEQ ID NO: 972031 - RNA, 17 nt, Homo sapiens
cacacacgaugcauuua

SEQ ID NO: 972032 - RNA, 14 nt, Homo sapiens
cacacauugcagcu

SEQ ID NO: 972033 - RNA, 11 nt, Homo sapiens
cacaccacagc

SEQ ID NO: 972034 - RNA, 16 nt, Homo sapiens
cacacugaagccacag

SEQ ID NO: 972035 - RNA, 18 nt, Homo sapiens
cacacuuaucaauggcac

SEQ ID NO: 972036 - RNA, 14 nt, Homo sapiens
cacagaaaugcugc

SEQ ID NO: 972037 - RNA, 13 nt, Homo sapiens
cacagaagcacau

SEQ ID NO: 972038 - RNA, 18 nt, Homo sapiens
cacagaaguggaauuuga

SEQ ID NO: 972039 - RNA, 22 nt, Homo sapiens
cacagaauauuuuuauauuucc

SEQ ID NO: 972040 - RNA, 16 nt, Homo sapiens
cacagagcaguggcca

SEQ ID NO: 972041 - RNA, 20 nt, Homo sapiens
cacagauccgcaagaguaaa

SEQ ID NO: 972042 - RNA, 22 nt, Homo sapiens
cacagaugccuggguugcugcu

SEQ ID NO: 972043 - RNA, 12 nt, Homo sapiens
cacagauuuaua

SEQ ID NO: 972044 - RNA, 15 nt, Homo sapiens
cacagcaaaccucuc

SEQ ID NO: 972045 - RNA, 14 nt, Homo sapiens
cacagccacuaaga

SEQ ID NO: 972046 - RNA, 20 nt, Homo sapiens
cacagcccugcucauuccuc

SEQ ID NO: 972047 - RNA, 23 nt, Homo sapiens
cacaggauauuuuggggggcaga

SEQ ID NO: 972048 - RNA, 22 nt, Homo sapiens
cacauaagggagauuguauaca

SEQ ID NO: 972049 - RNA, 22 nt, Homo sapiens
cacauacgggcuuuaauaguca

SEQ ID NO: 972050 - RNA, 17 nt, Homo sapiens
cacauccaucccuccau

SEQ ID NO: 972051 - RNA, 15 nt, Homo sapiens
cacaucucccagcca

SEQ ID NO: 972052 - RNA, 18 nt, Homo sapiens
cacaucuuccauuuccau

SEQ ID NO: 972053 - RNA, 18 nt, Homo sapiens
cacaugagggggugcccu

SEQ ID NO: 972054 - RNA, 19 nt, Homo sapiens
cacaugagggggugcccuc

SEQ ID NO: 972055 - RNA, 20 nt, Homo sapiens
cacaugcugggccauuguga

SEQ ID NO: 972056 - RNA, 19 nt, Homo sapiens
cacauggccuaugcacaua

SEQ ID NO: 972057 - RNA, 12 nt, Homo sapiens
cacauggcuuag

SEQ ID NO: 972058 - RNA, 16 nt, Homo sapiens
cacaugucuuguacau

SEQ ID NO: 972059 - RNA, 18 nt, Homo sapiens
cacaugugacacauaugc

SEQ ID NO: 972060 - RNA, 20 nt, Homo sapiens
cacaugugacacauaugcac

SEQ ID NO: 972061 - RNA, 21 nt, Homo sapiens
cacaugugagcaugucacuuc

SEQ ID NO: 972062 - RNA, 17 nt, Homo sapiens
cacauuaaguggcuuuu

SEQ ID NO: 972063 - RNA, 16 nt, Homo sapiens
cacauuaaucucaaag

SEQ ID NO: 972064 - RNA, 22 nt, Homo sapiens
cacauugaagguauaugccaaa

SEQ ID NO: 972065 - RNA, 20 nt, Homo sapiens
cacauuuagaaaagugaauu

SEQ ID NO: 972066 - RNA, 15 nt, Homo sapiens
cacauuuucuuuauc

SEQ ID NO: 972067 - RNA, 15 nt, Homo sapiens
caccaaaacugcucc

SEQ ID NO: 972068 - RNA, 13 nt, Homo sapiens
caccaccacuuac

SEQ ID NO: 972069 - RNA, 19 nt, Homo sapiens
caccacugcucuccagccu

SEQ ID NO: 972070 - RNA, 21 nt, Homo sapiens
caccacuuucccacacuguga

SEQ ID NO: 972071 - RNA, 14 nt, Homo sapiens
caccagccauccuc

SEQ ID NO: 972072 - RNA, 18 nt, Homo sapiens
caccagccccacugccag

SEQ ID NO: 972073 - RNA, 18 nt, Homo sapiens
caccagcccugaccccag

SEQ ID NO: 972074 - RNA, 20 nt, Homo sapiens
caccagcccugaccccagug

SEQ ID NO: 972075 - RNA, 21 nt, Homo sapiens
caccagcccugaccccagugu

SEQ ID NO: 972076 - RNA, 15 nt, Homo sapiens
caccaugaacuugau

SEQ ID NO: 972077 - RNA, 12 nt, Homo sapiens
cacccacaugug

SEQ ID NO: 972078 - RNA, 13 nt, Homo sapiens
cacccagucucau

SEQ ID NO: 972079 - RNA, 19 nt, Homo sapiens
cacccgugugaagaugaag

SEQ ID NO: 972080 - RNA, 17 nt, Homo sapiens
cacccuccaccgagcca

SEQ ID NO: 972081 - RNA, 15 nt, Homo sapiens
cacccuccuacaggu

SEQ ID NO: 972082 - RNA, 18 nt, Homo sapiens
cacccucuuccugugauc

SEQ ID NO: 972083 - RNA, 15 nt, Homo sapiens
ccucuguccaaccac

SEQ ID NO: 972084 - RNA, 22 nt, Homo sapiens
ccucugucuaggacugcagugu

SEQ ID NO: 972085 - RNA, 18 nt, Homo sapiens
ccugaccccauuccugau

SEQ ID NO: 972086 - RNA, 18 nt, Homo sapiens
ccugagaagaaguggcug

SEQ ID NO: 972087 - RNA, 21 nt, Homo sapiens
ccugagaggaaccagagcaga

SEQ ID NO: 972088 - RNA, 20 nt, Homo sapiens
ccugagcccuacucccugca

SEQ ID NO: 972089 - RNA, 20 nt, Homo sapiens
ccugauaccccugagggugg

SEQ ID NO: 972090 - RNA, 17 nt, Homo sapiens
ccugcacggggcauucc

SEQ ID NO: 972091 - RNA, 13 nt, Homo sapiens
ccugcagaccuca

SEQ ID NO: 972092 - RNA, 18 nt, Homo sapiens
ccugcagaccucaagcca

SEQ ID NO: 972093 - RNA, 19 nt, Homo sapiens
ccugccccagauuuacuaa

SEQ ID NO: 972094 - RNA, 15 nt, Homo sapiens
ccugccccagcacuc

SEQ ID NO: 972095 - RNA, 16 nt, Homo sapiens
ccugcccucaucauca

SEQ ID NO: 972096 - RNA, 17 nt, Homo sapiens
ccugcccuguccaaaag

SEQ ID NO: 972097 - RNA, 23 nt, Homo sapiens
ccugcugccggaagucaucccag

SEQ ID NO: 972098 - RNA, 12 nt, Homo sapiens
ccugcugugauu

SEQ ID NO: 972099 - RNA, 15 nt, Homo sapiens
ccugcuuugaauaaa

SEQ ID NO: 972100 - RNA, 17 nt, Homo sapiens
ccuggacuuuggcucag

SEQ ID NO: 972101 - RNA, 22 nt, Homo sapiens
ccuggagaagaauggcuuucaa

SEQ ID NO: 972102 - RNA, 12 nt, Homo sapiens
ccuggagcugcu

SEQ ID NO: 972103 - RNA, 22 nt, Homo sapiens
ccuggccaagcgagagcagcug

SEQ ID NO: 972104 - RNA, 20 nt, Homo sapiens
ccugggaggguguggugcuu

SEQ ID NO: 972105 - RNA, 16 nt, Homo sapiens
ccugggugacgguccu

SEQ ID NO: 972106 - RNA, 13 nt, Homo sapiens
ccuggugacuccu

SEQ ID NO: 972107 - RNA, 18 nt, Homo sapiens
ccugguguagcacuuaac

SEQ ID NO: 972108 - RNA, 21 nt, Homo sapiens
ccuggugugcagggugaagca

SEQ ID NO: 972109 - RNA, 15 nt, Homo sapiens
ccuguaauuccagcu

SEQ ID NO: 972110 - RNA, 16 nt, Homo sapiens
ccuguccagguagaaa

SEQ ID NO: 972111 - RNA, 17 nt, Homo sapiens
ccugucccaaccccagu

SEQ ID NO: 972112 - RNA, 21 nt, Homo sapiens
ccuguggggccugauggugcu

SEQ ID NO: 972113 - RNA, 14 nt, Homo sapiens
ccuguguacuuccc

SEQ ID NO: 972114 - RNA, 22 nt, Homo sapiens
ccuguuacugagaugucuucaa

SEQ ID NO: 972115 - RNA, 20 nt, Homo sapiens
ccuguuccccaaggacucuu

SEQ ID NO: 972116 - RNA, 14 nt, Homo sapiens
ccuuaacugcaucc

SEQ ID NO: 972117 - RNA, 21 nt, Homo sapiens
ccuuaagcaaauuuuguauua

SEQ ID NO: 972118 - RNA, 22 nt, Homo sapiens
ccuuaauuauugcacuagagaa

SEQ ID NO: 972119 - RNA, 18 nt, Homo sapiens
ccuuaauuuccuuuuuga

SEQ ID NO: 972120 - RNA, 22 nt, Homo sapiens
ccuuacuggcuuaccuccucau

SEQ ID NO: 972121 - RNA, 16 nt, Homo sapiens
ccuuagauaccuugaa

SEQ ID NO: 972122 - RNA, 20 nt, Homo sapiens
ccuuccacuuugaguaccaa

SEQ ID NO: 972123 - RNA, 18 nt, Homo sapiens
ccuuccagaucacugcca

SEQ ID NO: 972124 - RNA, 18 nt, Homo sapiens
ccuuccaggugauucugu

SEQ ID NO: 972125 - RNA, 20 nt, Homo sapiens
ccuucccuuuuuuuguuauu

SEQ ID NO: 972126 - RNA, 21 nt, Homo sapiens
ccuuccugcugcgcaguucuc

SEQ ID NO: 972127 - RNA, 14 nt, Homo sapiens
ccuucugagcuccu

SEQ ID NO: 972128 - RNA, 19 nt, Homo sapiens
ccuugauauaaaaaaucuu

SEQ ID NO: 972129 - RNA, 17 nt, Homo sapiens
ccuugaucuuaacaaag

SEQ ID NO: 972130 - RNA, 13 nt, Homo sapiens
ccuugaugacugc

SEQ ID NO: 972131 - RNA, 24 nt, Homo sapiens
ccuugaugauugacaacacccauu

SEQ ID NO: 972132 - RNA, 14 nt, Homo sapiens
ccuugcaaccucac

SEQ ID NO: 972133 - RNA, 19 nt, Homo sapiens
ccuugcacagcuggagaaa

SEQ ID NO: 972134 - RNA, 21 nt, Homo sapiens
ccuugcugcauugauccagga

SEQ ID NO: 972135 - RNA, 16 nt, Homo sapiens
ccuuggcuucgugaau

SEQ ID NO: 972136 - RNA, 17 nt, Homo sapiens
ccuuggcuucugugaug

SEQ ID NO: 972137 - RNA, 14 nt, Homo sapiens
ccuugugucuguac

SEQ ID NO: 972138 - RNA, 22 nt, Homo sapiens
ccuuucucgugguagaagccag

SEQ ID NO: 972139 - RNA, 21 nt, Homo sapiens
ccuuucucuccagccugacuu

SEQ ID NO: 972140 - RNA, 18 nt, Homo sapiens
ccuuuggccccacuuuga

SEQ ID NO: 972141 - RNA, 14 nt, Homo sapiens
ccuuuuaaaaaccu

SEQ ID NO: 972142 - RNA, 15 nt, Homo sapiens
ccuuuuaacucaccu

SEQ ID NO: 972143 - RNA, 15 nt, Homo sapiens
ccuuuuccacuuuaa

SEQ ID NO: 972144 - RNA, 13 nt, Homo sapiens
ccuuuuucacuuu

SEQ ID NO: 972145 - RNA, 20 nt, Homo sapiens
cgaaauaacaauguuaagga

SEQ ID NO: 972146 - RNA, 20 nt, Homo sapiens
cgaaugaaaagaaaugcaug

SEQ ID NO: 972147 - RNA, 16 nt, Homo sapiens
cgaauugucuuuggug

SEQ ID NO: 972148 - RNA, 16 nt, Homo sapiens
cgaccugcgccaaucc

SEQ ID NO: 972149 - RNA, 14 nt, Homo sapiens
cgagcaaaauucaa

SEQ ID NO: 972150 - RNA, 12 nt, Homo sapiens
cgaggccugaag

SEQ ID NO: 972151 - RNA, 14 nt, Homo sapiens
cgagggcagcugcu

SEQ ID NO: 972152 - RNA, 14 nt, Homo sapiens
cgaggucaggagau

SEQ ID NO: 972153 - RNA, 15 nt, Homo sapiens
cgaguacugggacaa

SEQ ID NO: 972154 - RNA, 17 nt, Homo sapiens
cgcacgcucgcugccau

SEQ ID NO: 972155 - RNA, 14 nt, Homo sapiens
cgcacguggagcug

SEQ ID NO: 972156 - RNA, 15 nt, Homo sapiens
cgcagggccaugcag

SEQ ID NO: 972157 - RNA, 20 nt, Homo sapiens
cgcccaggcuggagugcagu

SEQ ID NO: 972158 - RNA, 19 nt, Homo sapiens
cgcccuggguuucaugagc

SEQ ID NO: 972159 - RNA, 19 nt, Homo sapiens
cgcccuuggcuucugugau

SEQ ID NO: 972160 - RNA, 11 nt, Homo sapiens
cgccuguaauu

SEQ ID NO: 972161 - RNA, 12 nt, Homo sapiens
cgcugggugguu

SEQ ID NO: 972162 - RNA, 22 nt, Homo sapiens
cgcuugcaccacuuccguccca

SEQ ID NO: 972163 - RNA, 19 nt, Homo sapiens
cgcuugcuggccaguccac

SEQ ID NO: 972164 - RNA, 17 nt, Homo sapiens
cggaagggguuccucaa

SEQ ID NO: 972165 - RNA, 20 nt, Homo sapiens
cggaagucaucccagugcac

SEQ ID NO: 972166 - RNA, 15 nt, Homo sapiens
cggaaugccacccac

SEQ ID NO: 972167 - RNA, 21 nt, Homo sapiens
cggaguucugcccaugggaag

SEQ ID NO: 972168 - RNA, 22 nt, Homo sapiens
cggaugugugucucaccccuca

SEQ ID NO: 972169 - RNA, 22 nt, Homo sapiens
cggcaguauggaauuccagugc

SEQ ID NO: 972170 - RNA, 17 nt, Homo sapiens
cggcuaggaagcagcug

SEQ ID NO: 972171 - RNA, 13 nt, Homo sapiens
cggcucugcaguc

SEQ ID NO: 972172 - RNA, 11 nt, Homo sapiens
cggcugcucag

SEQ ID NO: 972173 - RNA, 21 nt, Homo sapiens
cgggagcccccaaaacagccu

SEQ ID NO: 972174 - RNA, 13 nt, Homo sapiens
cgggccucagugc

SEQ ID NO: 972175 - RNA, 17 nt, Homo sapiens
cgggucucaacuuuaag

SEQ ID NO: 972176 - RNA, 22 nt, Homo sapiens
cggugaugaggaaggacuugac

SEQ ID NO: 972177 - RNA, 13 nt, Homo sapiens
cguauagguugau

SEQ ID NO: 972178 - RNA, 16 nt, Homo sapiens
cgucagaccaguacug

SEQ ID NO: 972179 - RNA, 15 nt, Homo sapiens
cgucgucaccaaauc

SEQ ID NO: 972180 - RNA, 20 nt, Homo sapiens
cgucugccggacccggaggc

SEQ ID NO: 972181 - RNA, 19 nt, Homo sapiens
cgugaaaguugugaucugu

SEQ ID NO: 972182 - RNA, 12 nt, Homo sapiens
cguggucccuga

SEQ ID NO: 972183 - RNA, 19 nt, Homo sapiens
cgugugacucgccagcuca

SEQ ID NO: 972184 - RNA, 21 nt, Homo sapiens
cguguguauuagaaugcaugu

SEQ ID NO: 972185 - RNA, 22 nt, Homo sapiens
cguguguauuagaaugcaugua

SEQ ID NO: 972186 - RNA, 20 nt, Homo sapiens
cguucaccuccaagcauuuc

SEQ ID NO: 972187 - RNA, 17 nt, Homo sapiens
cguugguucugcacuaa

SEQ ID NO: 972188 - RNA, 21 nt, Homo sapiens
cguuuucuugcucaaagggaa

SEQ ID NO: 972189 - RNA, 18 nt, Homo sapiens
cuaaaaaugaaaauucua

SEQ ID NO: 972190 - RNA, 18 nt, Homo sapiens
cuaaaagcuuucaugucc

SEQ ID NO: 972191 - RNA, 14 nt, Homo sapiens
cuaaaauucuguca

SEQ ID NO: 972192 - RNA, 17 nt, Homo sapiens
cuaaaauucugucaggg

SEQ ID NO: 972193 - RNA, 13 nt, Homo sapiens
cuaaacaguauua

SEQ ID NO: 972194 - RNA, 23 nt, Homo sapiens
cuaaacuccuuccuggccugaga

SEQ ID NO: 972195 - RNA, 20 nt, Homo sapiens
cuaaaggaaaaaacuuugac

SEQ ID NO: 972196 - RNA, 16 nt, Homo sapiens
cuaaaguauacaacug

SEQ ID NO: 972197 - RNA, 16 nt, Homo sapiens
gaacauacuguucacu

SEQ ID NO: 972198 - RNA, 16 nt, Homo sapiens
gaacccaguguuucca

SEQ ID NO: 972199 - RNA, 21 nt, Homo sapiens
gaaccccagcuucccuccagc

SEQ ID NO: 972200 - RNA, 13 nt, Homo sapiens
gaaccgcacagcu

SEQ ID NO: 972201 - RNA, 17 nt, Homo sapiens
gaaccgcacagcucagg

SEQ ID NO: 972202 - RNA, 21 nt, Homo sapiens
gaaccugagcuauuuuccucu

SEQ ID NO: 972203 - RNA, 17 nt, Homo sapiens
gaacuacuuuuggugcu

SEQ ID NO: 972204 - RNA, 20 nt, Homo sapiens
gaacucaaauaaaaugcccc

SEQ ID NO: 972205 - RNA, 22 nt, Homo sapiens
gaacugggagcagcucugugac

SEQ ID NO: 972206 - RNA, 13 nt, Homo sapiens
gaacugucuguga

SEQ ID NO: 972207 - RNA, 21 nt, Homo sapiens
gaacuuaauaacuguguacug

SEQ ID NO: 972208 - RNA, 21 nt, Homo sapiens
gaacuuuaagaagcaguguuu

SEQ ID NO: 972209 - RNA, 14 nt, Homo sapiens
gaacuuuuguacug

SEQ ID NO: 972210 - RNA, 19 nt, Homo sapiens
gaagaaaucuuucucccuc

SEQ ID NO: 972211 - RNA, 13 nt, Homo sapiens
gaagaacauagaa

SEQ ID NO: 972212 - RNA, 20 nt, Homo sapiens
gaagacccuaucucccacaa

SEQ ID NO: 972213 - RNA, 19 nt, Homo sapiens
gaagagcguagacaggugu

SEQ ID NO: 972214 - RNA, 17 nt, Homo sapiens
gaagauagaacaaugcu

SEQ ID NO: 972215 - RNA, 21 nt, Homo sapiens
gaagaugaauggucuggcaau

SEQ ID NO: 972216 - RNA, 13 nt, Homo sapiens
gaagaugugaagg

SEQ ID NO: 972217 - RNA, 22 nt, Homo sapiens
gaagauuuuauucuuauuucau

SEQ ID NO: 972218 - RNA, 13 nt, Homo sapiens
gaagcaagccaga

SEQ ID NO: 972219 - RNA, 19 nt, Homo sapiens
gaagcacuacaccuugccu

SEQ ID NO: 972220 - RNA, 15 nt, Homo sapiens
gaagcagaaauguac

SEQ ID NO: 972221 - RNA, 19 nt, Homo sapiens
gaagcccccucuuccuccc

SEQ ID NO: 972222 - RNA, 19 nt, Homo sapiens
gaagccuucagcuccaggg

SEQ ID NO: 972223 - RNA, 15 nt, Homo sapiens
gaagcugcaggcuuu

SEQ ID NO: 972224 - RNA, 16 nt, Homo sapiens
gaagcuggucuagacu

SEQ ID NO: 972225 - RNA, 18 nt, Homo sapiens
gaaggcccugcugaguca

SEQ ID NO: 972226 - RNA, 15 nt, Homo sapiens
gaagggguuccucaa

SEQ ID NO: 972227 - RNA, 14 nt, Homo sapiens
gaagguaaagggag

SEQ ID NO: 972228 - RNA, 14 nt, Homo sapiens
gaaguaaacugcag

SEQ ID NO: 972229 - RNA, 22 nt, Homo sapiens
gaaguaggaggaaacaguucuc

SEQ ID NO: 972230 - RNA, 12 nt, Homo sapiens
gaagucauccca

SEQ ID NO: 972231 - RNA, 23 nt, Homo sapiens
gaagucuggcuuugcucuauuaa

SEQ ID NO: 972232 - RNA, 20 nt, Homo sapiens
gaaguggagcccggcacagg

SEQ ID NO: 972233 - RNA, 22 nt, Homo sapiens
gaaguuauggcuucacauucau

SEQ ID NO: 972234 - RNA, 16 nt, Homo sapiens
gaauaaaccauuuuua

SEQ ID NO: 972235 - RNA, 16 nt, Homo sapiens
gaauaauuucuauuaa

SEQ ID NO: 972236 - RNA, 20 nt, Homo sapiens
gaauacauuaacggugcuaa

SEQ ID NO: 972237 - RNA, 17 nt, Homo sapiens
gaauacuaaauuauagu

SEQ ID NO: 972238 - RNA, 14 nt, Homo sapiens
gaauagacuaucua

SEQ ID NO: 972239 - RNA, 22 nt, Homo sapiens
gaauagccuggccaccagccau

SEQ ID NO: 972240 - RNA, 17 nt, Homo sapiens
gaaucacuuaaauguca

SEQ ID NO: 972241 - RNA, 23 nt, Homo sapiens
gaaucgguuguucuuuccucaca

SEQ ID NO: 972242 - RNA, 17 nt, Homo sapiens
gaaucucuucacuaccc

SEQ ID NO: 972243 - RNA, 17 nt, Homo sapiens
gaaugaguugaggccac

SEQ ID NO: 972244 - RNA, 22 nt, Homo sapiens
gaauggucuggcaauauucugu

SEQ ID NO: 972245 - RNA, 15 nt, Homo sapiens
gaauuacgugcucug

SEQ ID NO: 972246 - RNA, 16 nt, Homo sapiens
gaauuauugacacuga

SEQ ID NO: 972247 - RNA, 15 nt, Homo sapiens
gaauuccagugccag

SEQ ID NO: 972248 - RNA, 20 nt, Homo sapiens
gaauugacugccuaugccaa

SEQ ID NO: 972249 - RNA, 11 nt, Homo sapiens
gaauugcacau

SEQ ID NO: 972250 - RNA, 19 nt, Homo sapiens
gaauugucuuuggugcuuu

SEQ ID NO: 972251 - RNA, 23 nt, Homo sapiens
gaauugucuuuggugcuuuucac

SEQ ID NO: 972252 - RNA, 16 nt, Homo sapiens
gaauuuguuuuagcca

SEQ ID NO: 972253 - RNA, 17 nt, Homo sapiens
gaauuuguuuuagccau

SEQ ID NO: 972254 - RNA, 17 nt, Homo sapiens
gacaaaaauauuuacac

SEQ ID NO: 972255 - RNA, 16 nt, Homo sapiens
gacaaaauauuuccca

SEQ ID NO: 972256 - RNA, 17 nt, Homo sapiens
gacaacugcucccaccu

SEQ ID NO: 972257 - RNA, 17 nt, Homo sapiens
gacaagcagcuggugcu

SEQ ID NO: 972258 - RNA, 21 nt, Homo sapiens
gacaagcccuugagaagccaa

SEQ ID NO: 972259 - RNA, 13 nt, Homo sapiens
gacaaggugcuaa

SEQ ID NO: 972260 - RNA, 14 nt, Homo sapiens
gacaaggugcuaac

SEQ ID NO: 972261 - RNA, 21 nt, Homo sapiens
gacaauauuccagaucuuuca

SEQ ID NO: 972262 - RNA, 18 nt, Homo sapiens
gacaaucacuacaaguca

SEQ ID NO: 972263 - RNA, 16 nt, Homo sapiens
gacacacaaaucccau

SEQ ID NO: 972264 - RNA, 21 nt, Homo sapiens
gacacagacuuggggaccugg

SEQ ID NO: 972265 - RNA, 13 nt, Homo sapiens
gacacauaugcac

SEQ ID NO: 972266 - RNA, 17 nt, Homo sapiens
gacacccuucucccacu

SEQ ID NO: 972267 - RNA, 20 nt, Homo sapiens
gacacugaggagauacugaa

SEQ ID NO: 972268 - RNA, 20 nt, Homo sapiens
gacacuuaguuauuuaccaa

SEQ ID NO: 972269 - RNA, 17 nt, Homo sapiens
gacacuuuaauuaccaa

SEQ ID NO: 972270 - RNA, 21 nt, Homo sapiens
gacaugguugucaucacuagu

SEQ ID NO: 972271 - RNA, 11 nt, Homo sapiens
gaccaccacau

SEQ ID NO: 972272 - RNA, 20 nt, Homo sapiens
gaccagaucagggacuugaa

SEQ ID NO: 972273 - RNA, 17 nt, Homo sapiens
gacccagggacucucca

SEQ ID NO: 972274 - RNA, 17 nt, Homo sapiens
gaccccagccauccagg

SEQ ID NO: 972275 - RNA, 21 nt, Homo sapiens
gaccccauuccugaucccaug

SEQ ID NO: 972276 - RNA, 18 nt, Homo sapiens
gaccccucgcaacugucc

SEQ ID NO: 972277 - RNA, 18 nt, Homo sapiens
gacccuagggauuugcac

SEQ ID NO: 972278 - RNA, 19 nt, Homo sapiens
gacccugccacagccagag

SEQ ID NO: 972279 - RNA, 14 nt, Homo sapiens
gaccuccacauuaa

SEQ ID NO: 972280 - RNA, 23 nt, Homo sapiens
gaccuccaggcuccagcacaucc

SEQ ID NO: 972281 - RNA, 17 nt, Homo sapiens
gaccugcauagcuacgu

SEQ ID NO: 972282 - RNA, 17 nt, Homo sapiens
gaccugucucuaccuaa

SEQ ID NO: 972283 - RNA, 23 nt, Homo sapiens
gacggacguugguucugcacuaa

SEQ ID NO: 972284 - RNA, 17 nt, Homo sapiens
gacgguaaguguucuca

SEQ ID NO: 972285 - RNA, 16 nt, Homo sapiens
gacuaaggaacuaaaa

SEQ ID NO: 972286 - RNA, 20 nt, Homo sapiens
gacuacccauagacaugaaa

SEQ ID NO: 972287 - RNA, 16 nt, Homo sapiens
gacuccaggaacaaaa

SEQ ID NO: 972288 - RNA, 23 nt, Homo sapiens
gacucugaccccagcauucucag

SEQ ID NO: 972289 - RNA, 14 nt, Homo sapiens
gacucugcacaugu

SEQ ID NO: 972290 - RNA, 14 nt, Homo sapiens
gacugaaacuggaa

SEQ ID NO: 972291 - RNA, 17 nt, Homo sapiens
gacugaccauauugugc

SEQ ID NO: 972292 - RNA, 16 nt, Homo sapiens
gacugcaaguggccau

SEQ ID NO: 972293 - RNA, 19 nt, Homo sapiens
gacugcucagaacuugcug

SEQ ID NO: 972294 - RNA, 13 nt, Homo sapiens
gacuggagcucau

SEQ ID NO: 972295 - RNA, 15 nt, Homo sapiens
gacuggcucaugccu

SEQ ID NO: 972296 - RNA, 21 nt, Homo sapiens
gacugucaguucucugggaag

SEQ ID NO: 972297 - RNA, 17 nt, Homo sapiens
gacuguugccacuuaac

SEQ ID NO: 972298 - RNA, 19 nt, Homo sapiens
gacuuagaauaaugaaggu

SEQ ID NO: 972299 - RNA, 12 nt, Homo sapiens
gacuugaauaac

SEQ ID NO: 972300 - RNA, 17 nt, Homo sapiens
gacuuugggaccugcuu

SEQ ID NO: 972301 - RNA, 13 nt, Homo sapiens
gacuuuguguuca

SEQ ID NO: 972302 - RNA, 18 nt, Homo sapiens
gacuuuguguucauuuca

SEQ ID NO: 972303 - RNA, 17 nt, Homo sapiens
gagaacaugcuggugaa

SEQ ID NO: 972304 - RNA, 12 nt, Homo sapiens
gagaaccuucca

SEQ ID NO: 972305 - RNA, 13 nt, Homo sapiens
gagaagcaccagc

SEQ ID NO: 972306 - RNA, 22 nt, Homo sapiens
gagaauaaaacguuaguuaauc

SEQ ID NO: 972307 - RNA, 20 nt, Homo sapiens
gagaauaaaauuccuaucuc

SEQ ID NO: 972308 - RNA, 23 nt, Homo sapiens
gagaauugaaaugaggugccacc

SEQ ID NO: 972309 - RNA, 15 nt, Homo sapiens
gagacaaggugcuaa

SEQ ID NO: 972310 - RNA, 19 nt, Homo sapiens
gagacagagacaaguaauu

SEQ ID NO: 972311 - RNA, 22 nt, Homo sapiens
aaaggcauccauagugcacuag

SEQ ID NO: 972312 - RNA, 18 nt, Homo sapiens
aaagguauuauacaugug

SEQ ID NO: 972313 - RNA, 23 nt, Homo sapiens
aaaguaaggugcuuggaguuuac

SEQ ID NO: 972314 - RNA, 19 nt, Homo sapiens
aaaguacaucucuacuaaa

SEQ ID NO: 972315 - RNA, 16 nt, Homo sapiens
aaaguaccuugaacuc

SEQ ID NO: 972316 - RNA, 18 nt, Homo sapiens
aaaguagaauaagccuuc

SEQ ID NO: 972317 - RNA, 17 nt, Homo sapiens
aaaguauauuuaacuca

SEQ ID NO: 972318 - RNA, 16 nt, Homo sapiens
aaaguggaaguaugua

SEQ ID NO: 972319 - RNA, 12 nt, Homo sapiens
aaagugucucaa

SEQ ID NO: 972320 - RNA, 14 nt, Homo sapiens
aaauaaaaauucaa

SEQ ID NO: 972321 - RNA, 22 nt, Homo sapiens
aaauaaaaauucaaccacagau

SEQ ID NO: 972322 - RNA, 23 nt, Homo sapiens
aaauaaaagaucuugaauagucu

SEQ ID NO: 972323 - RNA, 19 nt, Homo sapiens
aaauaaaauuuuuauguaa

SEQ ID NO: 972324 - RNA, 13 nt, Homo sapiens
aaauaaauuccaa

SEQ ID NO: 972325 - RNA, 12 nt, Homo sapiens
aaauacagauuu

SEQ ID NO: 972326 - RNA, 14 nt, Homo sapiens
aaauacuacaauag

SEQ ID NO: 972327 - RNA, 18 nt, Homo sapiens
aaauagaaagaagccaua

SEQ ID NO: 972328 - RNA, 21 nt, Homo sapiens
aaauaucaaagucauuaaaga

SEQ ID NO: 972329 - RNA, 13 nt, Homo sapiens
aaauaugcaguga

SEQ ID NO: 972330 - RNA, 19 nt, Homo sapiens
aaauauuuucuacuuuaaa

SEQ ID NO: 972331 - RNA, 16 nt, Homo sapiens
aaauccucaggugauu

SEQ ID NO: 972332 - RNA, 19 nt, Homo sapiens
aaaucucuacugcuuugga

SEQ ID NO: 972333 - RNA, 18 nt, Homo sapiens
aaaucugauggccuuaau

SEQ ID NO: 972334 - RNA, 18 nt, Homo sapiens
aaaucuguguaacuguaa

SEQ ID NO: 972335 - RNA, 15 nt, Homo sapiens
aaaucuuaaguacca

SEQ ID NO: 972336 - RNA, 16 nt, Homo sapiens
aaaugaaacuuggcca

SEQ ID NO: 972337 - RNA, 15 nt, Homo sapiens
aaaugagaaugacag

SEQ ID NO: 972338 - RNA, 16 nt, Homo sapiens
aaaugcuuacagggcu

SEQ ID NO: 972339 - RNA, 20 nt, Homo sapiens
aaauggaggaucucuaaaga

SEQ ID NO: 972340 - RNA, 23 nt, Homo sapiens
aaauggguauuuguucaaaauaa

SEQ ID NO: 972341 - RNA, 18 nt, Homo sapiens
aaauggugccuggagcua

SEQ ID NO: 972342 - RNA, 14 nt, Homo sapiens
aaauguauguuggu

SEQ ID NO: 972343 - RNA, 17 nt, Homo sapiens
aaaugugcuauacugca

SEQ ID NO: 972344 - RNA, 20 nt, Homo sapiens
aaauguggaauugacugccu

SEQ ID NO: 972345 - RNA, 16 nt, Homo sapiens
aaauguguaagaacaa

SEQ ID NO: 972346 - RNA, 15 nt, Homo sapiens
aaauuaaaaugauuu

SEQ ID NO: 972347 - RNA, 15 nt, Homo sapiens
aaauuaacacaaagg

SEQ ID NO: 972348 - RNA, 19 nt, Homo sapiens
aaauuacguuuauguacua

SEQ ID NO: 972349 - RNA, 14 nt, Homo sapiens
aaauuauuugucau

SEQ ID NO: 972350 - RNA, 15 nt, Homo sapiens
aaauucaaccacaga

SEQ ID NO: 972351 - RNA, 15 nt, Homo sapiens
aaauucaugcacuuu

SEQ ID NO: 972352 - RNA, 18 nt, Homo sapiens
aaauucuaguguccauaa

SEQ ID NO: 972353 - RNA, 13 nt, Homo sapiens
aaauuucauagcu

SEQ ID NO: 972354 - RNA, 11 nt, Homo sapiens
aucgugugcca

SEQ ID NO: 972355 - RNA, 19 nt, Homo sapiens
aucuaaaaugugugccaga

SEQ ID NO: 972356 - RNA, 21 nt, Homo sapiens
aucuaaaaugugugccagaug

SEQ ID NO: 972357 - RNA, 21 nt, Homo sapiens
aucuaacagcccugugcagca

SEQ ID NO: 972358 - RNA, 13 nt, Homo sapiens
aucuacacuucgc

SEQ ID NO: 972359 - RNA, 17 nt, Homo sapiens
aucuauaggcagcuucu

SEQ ID NO: 972360 - RNA, 19 nt, Homo sapiens
aucuaugggaaaaaucuaa

SEQ ID NO: 972361 - RNA, 17 nt, Homo sapiens
aucucaaugaaccauaa

SEQ ID NO: 972362 - RNA, 15 nt, Homo sapiens
aucucagcuuugaga

SEQ ID NO: 972363 - RNA, 23 nt, Homo sapiens
aucucgcacuacaucugauauca

SEQ ID NO: 972364 - RNA, 13 nt, Homo sapiens
aucucuacugcuu

SEQ ID NO: 972365 - RNA, 13 nt, Homo sapiens
aucucuuccacau

SEQ ID NO: 972366 - RNA, 20 nt, Homo sapiens
aucucuuuagagaaguccaa

SEQ ID NO: 972367 - RNA, 13 nt, Homo sapiens
aucugaacauucu

SEQ ID NO: 972368 - RNA, 17 nt, Homo sapiens
aucugccuuaaaaccaa

SEQ ID NO: 972369 - RNA, 21 nt, Homo sapiens
aucuguaagagcuugcuccag

SEQ ID NO: 972370 - RNA, 15 nt, Homo sapiens
aucuguaccaugacc

SEQ ID NO: 972371 - RNA, 20 nt, Homo sapiens
aucuguuucugugucuuaau

SEQ ID NO: 972372 - RNA, 14 nt, Homo sapiens
aucuuaaguaccaa

SEQ ID NO: 972373 - RNA, 14 nt, Homo sapiens
aucuucaaagccuu

SEQ ID NO: 972374 - RNA, 23 nt, Homo sapiens
aucuucacuucuaaaugcauauc

SEQ ID NO: 972375 - RNA, 18 nt, Homo sapiens
aucuucccuuuauuacaa

SEQ ID NO: 972376 - RNA, 14 nt, Homo sapiens
aucuugaauagucu

SEQ ID NO: 972377 - RNA, 16 nt, Homo sapiens
aucuugaauagucuca

SEQ ID NO: 972378 - RNA, 17 nt, Homo sapiens
aucuugaauagucucau

SEQ ID NO: 972379 - RNA, 18 nt, Homo sapiens
aucuugaauagucucauc

SEQ ID NO: 972380 - RNA, 13 nt, Homo sapiens
aucuugcuggcua

SEQ ID NO: 972381 - RNA, 22 nt, Homo sapiens
aucuugugguaacuugcugcuu

SEQ ID NO: 972382 - RNA, 12 nt, Homo sapiens
aucuuuaccucc

SEQ ID NO: 972383 - RNA, 22 nt, Homo sapiens
aucuuuaccuccugaguaauaa

SEQ ID NO: 972384 - RNA, 17 nt, Homo sapiens
aucuuucauccuugacu

SEQ ID NO: 972385 - RNA, 19 nt, Homo sapiens
aucuuucauccuugacuaa

SEQ ID NO: 972386 - RNA, 13 nt, Homo sapiens
aucuuuucauuaa

SEQ ID NO: 972387 - RNA, 13 nt, Homo sapiens
augaaaaaauuag

SEQ ID NO: 972388 - RNA, 17 nt, Homo sapiens
augaaaaauguguucca

SEQ ID NO: 972389 - RNA, 23 nt, Homo sapiens
augaaaaauguguuccauugcca

SEQ ID NO: 972390 - RNA, 12 nt, Homo sapiens
augaaaaauugg

SEQ ID NO: 972391 - RNA, 12 nt, Homo sapiens
augaaacuaaga

SEQ ID NO: 972392 - RNA, 14 nt, Homo sapiens
augaaaugcauauu

SEQ ID NO: 972393 - RNA, 18 nt, Homo sapiens
augaaauugauuugucaa

SEQ ID NO: 972394 - RNA, 13 nt, Homo sapiens
augaacacuuuuu

SEQ ID NO: 972395 - RNA, 16 nt, Homo sapiens
augaagacccuaucuc

SEQ ID NO: 972396 - RNA, 21 nt, Homo sapiens
augaaggagagcccagucucc

SEQ ID NO: 972397 - RNA, 21 nt, Homo sapiens
augaaucccacccacauguga

SEQ ID NO: 972398 - RNA, 24 nt, Homo sapiens
augaaugcuuuuagugugugcaua

SEQ ID NO: 972399 - RNA, 15 nt, Homo sapiens
augacaggcuguuca

SEQ ID NO: 972400 - RNA, 13 nt, Homo sapiens
augacucaguaag

SEQ ID NO: 972401 - RNA, 11 nt, Homo sapiens
augacugccuu

SEQ ID NO: 972402 - RNA, 21 nt, Homo sapiens
augacuuggagauuuaucucu

SEQ ID NO: 972403 - RNA, 13 nt, Homo sapiens
augagagcauaau

SEQ ID NO: 972404 - RNA, 16 nt, Homo sapiens
augagaucggagacaa

SEQ ID NO: 972405 - RNA, 20 nt, Homo sapiens
augaggagaaaggggcccca

SEQ ID NO: 972406 - RNA, 17 nt, Homo sapiens
augaggcagauagcacu

SEQ ID NO: 972407 - RNA, 17 nt, Homo sapiens
augaguaaaaacuagaa

SEQ ID NO: 972408 - RNA, 13 nt, Homo sapiens
augaguugguucu

SEQ ID NO: 972409 - RNA, 20 nt, Homo sapiens
augauaaauuaagcaugaaa

SEQ ID NO: 972410 - RNA, 14 nt, Homo sapiens
augauacuucccac

SEQ ID NO: 972411 - RNA, 16 nt, Homo sapiens
augauccuuguguuca

SEQ ID NO: 972412 - RNA, 15 nt, Homo sapiens
augauuucaguucua

SEQ ID NO: 972413 - RNA, 15 nt, Homo sapiens
augcaaaucaauuac

SEQ ID NO: 972414 - RNA, 20 nt, Homo sapiens
augcaagagcaccuggccaa

SEQ ID NO: 972415 - RNA, 14 nt, Homo sapiens
augcacauauggac

SEQ ID NO: 972416 - RNA, 20 nt, Homo sapiens
augcacauauggacucugca

SEQ ID NO: 972417 - RNA, 21 nt, Homo sapiens
augcacauauggacucugcac

SEQ ID NO: 972418 - RNA, 18 nt, Homo sapiens
augcaccuugugucugua

SEQ ID NO: 972419 - RNA, 21 nt, Homo sapiens
augccaauaauaaaugcccuc

SEQ ID NO: 972420 - RNA, 16 nt, Homo sapiens
augccaguuacuugcu

SEQ ID NO: 972421 - RNA, 22 nt, Homo sapiens
augcccuguugguuucacagau

SEQ ID NO: 972422 - RNA, 18 nt, Homo sapiens
augccuccugcccugcua

SEQ ID NO: 972423 - RNA, 15 nt, Homo sapiens
augccuuaagccaau

SEQ ID NO: 972424 - RNA, 15 nt, Homo sapiens
augcgcagugccuug

SEQ ID NO: 972425 - RNA, 20 nt, Homo sapiens
augcuaacaaagacaaaagu

SEQ ID NO: 972426 - RNA, 16 nt, Homo sapiens
augcucauugaacuuu

SEQ ID NO: 972427 - RNA, 21 nt, Homo sapiens
augcuccaaauauaagacauu

SEQ ID NO: 972428 - RNA, 22 nt, Homo sapiens
auugucgaaaagagucuuccaa

SEQ ID NO: 972429 - RNA, 21 nt, Homo sapiens
auugucuuuggugcuuuucac

SEQ ID NO: 972430 - RNA, 17 nt, Homo sapiens
auugugugacuauucau

SEQ ID NO: 972431 - RNA, 20 nt, Homo sapiens
auuguugaaagguaauuuga

SEQ ID NO: 972432 - RNA, 21 nt, Homo sapiens
auuguuugguaaauguuucuu

SEQ ID NO: 972433 - RNA, 15 nt, Homo sapiens
auuuaaaaacauuuu

SEQ ID NO: 972434 - RNA, 21 nt, Homo sapiens
auuuaaaacagacacuggcau

SEQ ID NO: 972435 - RNA, 22 nt, Homo sapiens
auuuaacacccuuuagaaccuu

SEQ ID NO: 972436 - RNA, 16 nt, Homo sapiens
auuuaacuaaaguuaa

SEQ ID NO: 972437 - RNA, 13 nt, Homo sapiens
auuuaacucauaa

SEQ ID NO: 972438 - RNA, 15 nt, Homo sapiens
auuuaagcacaaaaa

SEQ ID NO: 972439 - RNA, 12 nt, Homo sapiens
auuuaagugaau

SEQ ID NO: 972440 - RNA, 14 nt, Homo sapiens
auuuaaguuucaca

SEQ ID NO: 972441 - RNA, 12 nt, Homo sapiens
auuuaauaacau

SEQ ID NO: 972442 - RNA, 19 nt, Homo sapiens
auuuaauaagaaacaugau

SEQ ID NO: 972443 - RNA, 19 nt, Homo sapiens
auuuaaugaauacuugcua

SEQ ID NO: 972444 - RNA, 23 nt, Homo sapiens
auuuacuuguuauguuguaauau

SEQ ID NO: 972445 - RNA, 16 nt, Homo sapiens
auuuagcacaguauuu

SEQ ID NO: 972446 - RNA, 16 nt, Homo sapiens
auuuagucuugccagg

SEQ ID NO: 972447 - RNA, 18 nt, Homo sapiens
auuuauacaccagcaauu

SEQ ID NO: 972448 - RNA, 13 nt, Homo sapiens
auuuaucuuucaa

SEQ ID NO: 972449 - RNA, 19 nt, Homo sapiens
auuuauucagccuugguca

SEQ ID NO: 972450 - RNA, 14 nt, Homo sapiens
auuucaaagggaaa

SEQ ID NO: 972451 - RNA, 14 nt, Homo sapiens
auuucaauuccugu

SEQ ID NO: 972452 - RNA, 17 nt, Homo sapiens
auuucaccagucacugc

SEQ ID NO: 972453 - RNA, 14 nt, Homo sapiens
auuucauagcugua

SEQ ID NO: 972454 - RNA, 16 nt, Homo sapiens
auuuccaaacauccaa

SEQ ID NO: 972455 - RNA, 19 nt, Homo sapiens
auuucccauuugugccaga

SEQ ID NO: 972456 - RNA, 23 nt, Homo sapiens
auuucccauuugugccagaggaa

SEQ ID NO: 972457 - RNA, 16 nt, Homo sapiens
auuuccuaaggcaugu

SEQ ID NO: 972458 - RNA, 13 nt, Homo sapiens
auuuccucugggc

SEQ ID NO: 972459 - RNA, 19 nt, Homo sapiens
auuuccuucaaugugcaua

SEQ ID NO: 972460 - RNA, 21 nt, Homo sapiens
auuuccuuggcuucgugaaug

SEQ ID NO: 972461 - RNA, 17 nt, Homo sapiens
auuucucucagauuucc

SEQ ID NO: 972462 - RNA, 22 nt, Homo sapiens
auuucugggccgggcauggugg

SEQ ID NO: 972463 - RNA, 23 nt, Homo sapiens
auuucuggugaaaaaagccagcc

SEQ ID NO: 972464 - RNA, 22 nt, Homo sapiens
auuugauugggaugaaugccau

SEQ ID NO: 972465 - RNA, 16 nt, Homo sapiens
auuugcacuaaaucag

SEQ ID NO: 972466 - RNA, 13 nt, Homo sapiens
auuugcucauaag

SEQ ID NO: 972467 - RNA, 23 nt, Homo sapiens
auuuggguugacuccugagcaua

SEQ ID NO: 972468 - RNA, 14 nt, Homo sapiens
aaauuugauuuuga

SEQ ID NO: 972469 - RNA, 13 nt, Homo sapiens
aacaaaaagguaa

SEQ ID NO: 972470 - RNA, 13 nt, Homo sapiens
aacaaacaagaga

SEQ ID NO: 972471 - RNA, 13 nt, Homo sapiens
aacaaacagggcu

SEQ ID NO: 972472 - RNA, 13 nt, Homo sapiens
aacaaagaagcua

SEQ ID NO: 972473 - RNA, 12 nt, Homo sapiens
aacaacauuuau

SEQ ID NO: 972474 - RNA, 16 nt, Homo sapiens
aacaagaaaguggucu

SEQ ID NO: 972475 - RNA, 13 nt, Homo sapiens
aacaagucuauaa

SEQ ID NO: 972476 - RNA, 13 nt, Homo sapiens
aacaauugguaaa

SEQ ID NO: 972477 - RNA, 13 nt, Homo sapiens
aacacaagcaaaa

SEQ ID NO: 972478 - RNA, 15 nt, Homo sapiens
aacaccuauugcacu

SEQ ID NO: 972479 - RNA, 22 nt, Homo sapiens
aacagagugcaacccagucaca

SEQ ID NO: 972480 - RNA, 16 nt, Homo sapiens
aacagcaagucaccca

SEQ ID NO: 972481 - RNA, 15 nt, Homo sapiens
aacagcaguggagua

SEQ ID NO: 972482 - RNA, 23 nt, Homo sapiens
aacagccuucuagcacacuuuuu

SEQ ID NO: 972483 - RNA, 21 nt, Homo sapiens
aacagcguguaaacacauguu

SEQ ID NO: 972484 - RNA, 13 nt, Homo sapiens
aacagcuacaaac

SEQ ID NO: 972485 - RNA, 22 nt, Homo sapiens
aacagcuuccuguuacugagau

SEQ ID NO: 972486 - RNA, 21 nt, Homo sapiens
aacagggcugccuucuggccu

SEQ ID NO: 972487 - RNA, 17 nt, Homo sapiens
aacagguaaaacagggc

SEQ ID NO: 972488 - RNA, 18 nt, Homo sapiens
aacagguaaaacagggcc

SEQ ID NO: 972489 - RNA, 20 nt, Homo sapiens
aacauaaaggacaggccaca

SEQ ID NO: 972490 - RNA, 20 nt, Homo sapiens
aacauagauuuaagugaaua

SEQ ID NO: 972491 - RNA, 17 nt, Homo sapiens
aacaucccuuauaccac

SEQ ID NO: 972492 - RNA, 19 nt, Homo sapiens
aacaucuaauaaguauaua

SEQ ID NO: 972493 - RNA, 21 nt, Homo sapiens
aacaugcggugccaugaaggg

SEQ ID NO: 972494 - RNA, 19 nt, Homo sapiens
aacauggacuuucuugcau

SEQ ID NO: 972495 - RNA, 22 nt, Homo sapiens
aacauggugaaaccccgucucu

SEQ ID NO: 972496 - RNA, 19 nt, Homo sapiens
aacauguaaaacaguuaca

SEQ ID NO: 972497 - RNA, 19 nt, Homo sapiens
aacauuaccuuacugugga

SEQ ID NO: 972498 - RNA, 12 nt, Homo sapiens
aacauugcccag

SEQ ID NO: 972499 - RNA, 16 nt, Homo sapiens
aacauuugcugccauu

SEQ ID NO: 972500 - RNA, 18 nt, Homo sapiens
aacauuugcugccauuac

SEQ ID NO: 972501 - RNA, 15 nt, Homo sapiens
aacauuuuacaguaa

SEQ ID NO: 972502 - RNA, 19 nt, Homo sapiens
aaccaaagagggcuuccuc

SEQ ID NO: 972503 - RNA, 22 nt, Homo sapiens
aaccaaaucuuaaaugagacca

SEQ ID NO: 972504 - RNA, 12 nt, Homo sapiens
aaccaagcuaua

SEQ ID NO: 972505 - RNA, 16 nt, Homo sapiens
aaccaaggacugagca

SEQ ID NO: 972506 - RNA, 15 nt, Homo sapiens
aaccaaguaucacac

SEQ ID NO: 972507 - RNA, 21 nt, Homo sapiens
aaccaaguaucacacuuuaau

SEQ ID NO: 972508 - RNA, 14 nt, Homo sapiens
aaccacagauuuau

SEQ ID NO: 972509 - RNA, 14 nt, Homo sapiens
aaccaucagcauca

SEQ ID NO: 972510 - RNA, 17 nt, Homo sapiens
aaccauggugaagugcu

SEQ ID NO: 972511 - RNA, 17 nt, Homo sapiens
aacccagagguggaugu

SEQ ID NO: 972512 - RNA, 19 nt, Homo sapiens
aacccagagguggauguua

SEQ ID NO: 972513 - RNA, 17 nt, Homo sapiens
aacccagggugugaaca

SEQ ID NO: 972514 - RNA, 11 nt, Homo sapiens
aaccccagugg

SEQ ID NO: 972515 - RNA, 21 nt, Homo sapiens
aaccccuuccagaucacugcc

SEQ ID NO: 972516 - RNA, 16 nt, Homo sapiens
aacccucuccaucucc

SEQ ID NO: 972517 - RNA, 21 nt, Homo sapiens
aacccuuacauuaugcuauga

SEQ ID NO: 972518 - RNA, 23 nt, Homo sapiens
aaccuaugauauuuucugugccu

SEQ ID NO: 972519 - RNA, 20 nt, Homo sapiens
aaccuauuuuuaaugaaacu

SEQ ID NO: 972520 - RNA, 21 nt, Homo sapiens
aaccucaacugccuacuccaa

SEQ ID NO: 972521 - RNA, 14 nt, Homo sapiens
aaccuccuaagcaa

SEQ ID NO: 972522 - RNA, 19 nt, Homo sapiens
aaccugcucuccucuucua

SEQ ID NO: 972523 - RNA, 22 nt, Homo sapiens
aaccuuaauguggggccucagu

SEQ ID NO: 972524 - RNA, 22 nt, Homo sapiens
aaccuuggaccacuccuguccc

SEQ ID NO: 972525 - RNA, 19 nt, Homo sapiens
aaccuugucccagccagug

SEQ ID NO: 972526 - RNA, 20 nt, Homo sapiens
aacgaagaguucccuugaaa

SEQ ID NO: 972527 - RNA, 13 nt, Homo sapiens
aacgcauugccac

SEQ ID NO: 972528 - RNA, 15 nt, Homo sapiens
aacgucagccagcuc

SEQ ID NO: 972529 - RNA, 22 nt, Homo sapiens
aacgucauguguuuugccaaag

SEQ ID NO: 972530 - RNA, 17 nt, Homo sapiens
aacuaaacaauaagcaa

SEQ ID NO: 972531 - RNA, 20 nt, Homo sapiens
aacuaagucaggauguuaac

SEQ ID NO: 972532 - RNA, 23 nt, Homo sapiens
aacuagccagacaaaauuugaga

SEQ ID NO: 972533 - RNA, 23 nt, Homo sapiens
aacuauaaggugccucaguuuuc

SEQ ID NO: 972534 - RNA, 16 nt, Homo sapiens
aacuauugggugaaua

SEQ ID NO: 972535 - RNA, 20 nt, Homo sapiens
aacucaaauacacauuugcu

SEQ ID NO: 972536 - RNA, 18 nt, Homo sapiens
aacucauaauuuuugcag

SEQ ID NO: 972537 - RNA, 20 nt, Homo sapiens
aacucauaauuuuugcagaa

SEQ ID NO: 972538 - RNA, 12 nt, Homo sapiens
aacucauuugau

SEQ ID NO: 972539 - RNA, 20 nt, Homo sapiens
aacuccagcaacuucuucuc

SEQ ID NO: 972540 - RNA, 18 nt, Homo sapiens
aggaagaauuccugccau

SEQ ID NO: 972541 - RNA, 17 nt, Homo sapiens
aggaagggaucugagaa

SEQ ID NO: 972542 - RNA, 19 nt, Homo sapiens
aggaauaacaucaccacug

SEQ ID NO: 972543 - RNA, 23 nt, Homo sapiens
aggaaugcaccacggcagcucuc

SEQ ID NO: 972544 - RNA, 15 nt, Homo sapiens
aggacaagacacuga

SEQ ID NO: 972545 - RNA, 22 nt, Homo sapiens
aggacaccuuuuaacucaccuc

SEQ ID NO: 972546 - RNA, 11 nt, Homo sapiens
aggaccacaga

SEQ ID NO: 972547 - RNA, 17 nt, Homo sapiens
aggaccacagagcuccu

SEQ ID NO: 972548 - RNA, 21 nt, Homo sapiens
aggacuguuuuauaaacugcu

SEQ ID NO: 972549 - RNA, 14 nt, Homo sapiens
aggagaaggggaag

SEQ ID NO: 972550 - RNA, 13 nt, Homo sapiens
aggagauacugaa

SEQ ID NO: 972551 - RNA, 18 nt, Homo sapiens
aggagcuucuuguuuccu

SEQ ID NO: 972552 - RNA, 19 nt, Homo sapiens
aggaggaaugcaccacggc

SEQ ID NO: 972553 - RNA, 17 nt, Homo sapiens
aggaggagacagccuca

SEQ ID NO: 972554 - RNA, 23 nt, Homo sapiens
aggauacguacaccucuugccuc

SEQ ID NO: 972555 - RNA, 14 nt, Homo sapiens
aggauguaagccug

SEQ ID NO: 972556 - RNA, 15 nt, Homo sapiens
aggauuuaaguuuca

SEQ ID NO: 972557 - RNA, 21 nt, Homo sapiens
aggauuuggggcagagggaca

SEQ ID NO: 972558 - RNA, 21 nt, Homo sapiens
aggcacccucagggagccucc

SEQ ID NO: 972559 - RNA, 15 nt, Homo sapiens
aggcaccugcuggaa

SEQ ID NO: 972560 - RNA, 16 nt, Homo sapiens
aggcagauagcacugg

SEQ ID NO: 972561 - RNA, 16 nt, Homo sapiens
aggcagauguuugccu

SEQ ID NO: 972562 - RNA, 22 nt, Homo sapiens
aggcaggcugggacggaccagc

SEQ ID NO: 972563 - RNA, 23 nt, Homo sapiens
aggcaguauuuuguguccuccag

SEQ ID NO: 972564 - RNA, 18 nt, Homo sapiens
aggcauacacacagcagu

SEQ ID NO: 972565 - RNA, 17 nt, Homo sapiens
aggcaugaagaagccac

SEQ ID NO: 972566 - RNA, 22 nt, Homo sapiens
aggcauguggccuuuaucucaa

SEQ ID NO: 972567 - RNA, 16 nt, Homo sapiens
aggcauuuauugccau

SEQ ID NO: 972568 - RNA, 15 nt, Homo sapiens
aggccacaccacagc

SEQ ID NO: 972569 - RNA, 21 nt, Homo sapiens
aguccaaggccaguccccauu

SEQ ID NO: 972570 - RNA, 18 nt, Homo sapiens
aguccaucuaacaucaua

SEQ ID NO: 972571 - RNA, 15 nt, Homo sapiens
aguccccucucucug

SEQ ID NO: 972572 - RNA, 20 nt, Homo sapiens
agucccuguccggaaugcca

SEQ ID NO: 972573 - RNA, 23 nt, Homo sapiens
aguccuugauuucaaaguuuugu

SEQ ID NO: 972574 - RNA, 20 nt, Homo sapiens
agucuacaaacugaacacug

SEQ ID NO: 972575 - RNA, 18 nt, Homo sapiens
agucuaggcuaagcacuu

SEQ ID NO: 972576 - RNA, 12 nt, Homo sapiens
agucuauucugu

SEQ ID NO: 972577 - RNA, 13 nt, Homo sapiens
agucucaccagcc

SEQ ID NO: 972578 - RNA, 23 nt, Homo sapiens
agucugcccacgcagaggacgca

SEQ ID NO: 972579 - RNA, 20 nt, Homo sapiens
agucuuaauaaaacauugaa

SEQ ID NO: 972580 - RNA, 19 nt, Homo sapiens
agucuuccugacacuuuaa

SEQ ID NO: 972581 - RNA, 18 nt, Homo sapiens
agucuucuuugugccuga

SEQ ID NO: 972582 - RNA, 18 nt, Homo sapiens
agugaaagagaguaccau

SEQ ID NO: 972583 - RNA, 16 nt, Homo sapiens
agugaagugaaucuga

SEQ ID NO: 972584 - RNA, 19 nt, Homo sapiens
agugacagcuuucugggau

SEQ ID NO: 972585 - RNA, 14 nt, Homo sapiens
agugagaacaugca

SEQ ID NO: 972586 - RNA, 18 nt, Homo sapiens
agugaggaugacagugac

SEQ ID NO: 972587 - RNA, 22 nt, Homo sapiens
agugagggucuucuuacaugca

SEQ ID NO: 972588 - RNA, 17 nt, Homo sapiens
agugauagauguagucu

SEQ ID NO: 972589 - RNA, 17 nt, Homo sapiens
agugcaacccagucaca

SEQ ID NO: 972590 - RNA, 19 nt, Homo sapiens
agugcagccuucuccauau

SEQ ID NO: 972591 - RNA, 12 nt, Homo sapiens
agugcauaugca

SEQ ID NO: 972592 - RNA, 16 nt, Homo sapiens
agugcccacauuugau

SEQ ID NO: 972593 - RNA, 21 nt, Homo sapiens
agugccuggaguugacugacu

SEQ ID NO: 972594 - RNA, 15 nt, Homo sapiens
agugcguguguagag

SEQ ID NO: 972595 - RNA, 19 nt, Homo sapiens
aguggaacuaaaauucugu

SEQ ID NO: 972596 - RNA, 20 nt, Homo sapiens
aguggccagcuucacucucu

SEQ ID NO: 972597 - RNA, 14 nt, Homo sapiens
aguggccaggccac

SEQ ID NO: 972598 - RNA, 16 nt, Homo sapiens
agugggccuccaagga

SEQ ID NO: 972599 - RNA, 21 nt, Homo sapiens
agugggcugcuagaagcacga

SEQ ID NO: 972600 - RNA, 14 nt, Homo sapiens
auagaggcuagcuu

SEQ ID NO: 972601 - RNA, 17 nt, Homo sapiens
auagcuacaguguaaua

SEQ ID NO: 972602 - RNA, 18 nt, Homo sapiens
auaggugagauaaauuaa

SEQ ID NO: 972603 - RNA, 13 nt, Homo sapiens
auagucacacuuu

SEQ ID NO: 972604 - RNA, 17 nt, Homo sapiens
auagucuauauuuuaac

SEQ ID NO: 972605 - RNA, 15 nt, Homo sapiens
auauaaaaaaucaug

SEQ ID NO: 972606 - RNA, 17 nt, Homo sapiens
auauaaaaaaucuuuag

SEQ ID NO: 972607 - RNA, 16 nt, Homo sapiens
auauaaauuuguguuc

SEQ ID NO: 972608 - RNA, 14 nt, Homo sapiens
auauacaaauguau

SEQ ID NO: 972609 - RNA, 14 nt, Homo sapiens
auauacacauacau

SEQ ID NO: 972610 - RNA, 18 nt, Homo sapiens
auauacacauacauauau

SEQ ID NO: 972611 - RNA, 11 nt, Homo sapiens
auauaccaaau

SEQ ID NO: 972612 - RNA, 21 nt, Homo sapiens
auauacuaguccugacacuga

SEQ ID NO: 972613 - RNA, 19 nt, Homo sapiens
auauacuuaagaauacaca

SEQ ID NO: 972614 - RNA, 17 nt, Homo sapiens
auauagaaaaauaacuu

SEQ ID NO: 972615 - RNA, 14 nt, Homo sapiens
auauagcaauacuu

SEQ ID NO: 972616 - RNA, 22 nt, Homo sapiens
auauagcucgagcaaaauucaa

SEQ ID NO: 972617 - RNA, 15 nt, Homo sapiens
auauagucacacuuu

SEQ ID NO: 972618 - RNA, 13 nt, Homo sapiens
auauauacuauau

SEQ ID NO: 972619 - RNA, 17 nt, Homo sapiens
auauaugaaauaaguaa

SEQ ID NO: 972620 - RNA, 12 nt, Homo sapiens
auauaugaccag

SEQ ID NO: 972621 - RNA, 17 nt, Homo sapiens
auauauuuauaaggaaa

SEQ ID NO: 972622 - RNA, 20 nt, Homo sapiens
auauauuuucauccuauaag

SEQ ID NO: 972623 - RNA, 21 nt, Homo sapiens
auauauuuuccuaguagauau

SEQ ID NO: 972624 - RNA, 22 nt, Homo sapiens
auaucacccagacauaaaggaa

SEQ ID NO: 972625 - RNA, 14 nt, Homo sapiens
auauccaagacuua

SEQ ID NO: 972626 - RNA, 23 nt, Homo sapiens
auaucuccauggcccugucccag

SEQ ID NO: 972627 - RNA, 16 nt, Homo sapiens
auaugaucggccauca

SEQ ID NO: 972628 - RNA, 18 nt, Homo sapiens
auaugcaccuugugucug

SEQ ID NO: 972629 - RNA, 14 nt, Homo sapiens
auaugcagugauau

SEQ ID NO: 972630 - RNA, 22 nt, Homo sapiens
auaugcagugauauggcagaag

SEQ ID NO: 972631 - RNA, 17 nt, Homo sapiens
auaugcccucaucaucc

SEQ ID NO: 972632 - RNA, 22 nt, Homo sapiens
auauguaauuucaaaauacauu

SEQ ID NO: 972633 - RNA, 16 nt, Homo sapiens
auauuaaaaucugaug

SEQ ID NO: 972634 - RNA, 12 nt, Homo sapiens
cucuuucacuuc

SEQ ID NO: 972635 - RNA, 16 nt, Homo sapiens
cucuuuccuauuucag

SEQ ID NO: 972636 - RNA, 21 nt, Homo sapiens
cugaaacucauagacacugau

SEQ ID NO: 972637 - RNA, 22 nt, Homo sapiens
cugaaauaaaaugauaaacaag

SEQ ID NO: 972638 - RNA, 13 nt, Homo sapiens
cugaaaugccugc

SEQ ID NO: 972639 - RNA, 22 nt, Homo sapiens
cugaacagaagcucuuacucuu

SEQ ID NO: 972640 - RNA, 12 nt, Homo sapiens
cugaacauacac

SEQ ID NO: 972641 - RNA, 18 nt, Homo sapiens
cugaaccauguggauaac

SEQ ID NO: 972642 - RNA, 17 nt, Homo sapiens
cugaaccgcacagcuca

SEQ ID NO: 972643 - RNA, 20 nt, Homo sapiens
cugaacuccugccauagucu

SEQ ID NO: 972644 - RNA, 22 nt, Homo sapiens
cugaaggaaaaacacaagcaaa

SEQ ID NO: 972645 - RNA, 13 nt, Homo sapiens
cugaauaauauca

SEQ ID NO: 972646 - RNA, 13 nt, Homo sapiens
cugaaucacuuaa

SEQ ID NO: 972647 - RNA, 13 nt, Homo sapiens
cugaauugcacau

SEQ ID NO: 972648 - RNA, 19 nt, Homo sapiens
cugaauuggcuaugcagua

SEQ ID NO: 972649 - RNA, 18 nt, Homo sapiens
cugacacaagaauggucu

SEQ ID NO: 972650 - RNA, 20 nt, Homo sapiens
cugacccagggacucuccaa

SEQ ID NO: 972651 - RNA, 23 nt, Homo sapiens
cugaccccucuccucaagggaag

SEQ ID NO: 972652 - RNA, 15 nt, Homo sapiens
cugaccugaccccau

SEQ ID NO: 972653 - RNA, 13 nt, Homo sapiens
cugacuacaaauu

SEQ ID NO: 972654 - RNA, 16 nt, Homo sapiens
cugagaaauggccaaa

SEQ ID NO: 972655 - RNA, 16 nt, Homo sapiens
cugagacagugaauuu

SEQ ID NO: 972656 - RNA, 13 nt, Homo sapiens
cugagauccugca

SEQ ID NO: 972657 - RNA, 15 nt, Homo sapiens
cugagcaccguguca

SEQ ID NO: 972658 - RNA, 22 nt, Homo sapiens
cugagcccuacucccugcagau

SEQ ID NO: 972659 - RNA, 17 nt, Homo sapiens
cugagcuuguucauccu

SEQ ID NO: 972660 - RNA, 15 nt, Homo sapiens
cugaggccagaguca

SEQ ID NO: 972661 - RNA, 17 nt, Homo sapiens
cugaggcccagugcaua

SEQ ID NO: 972662 - RNA, 16 nt, Homo sapiens
cugagggcagacuggg

SEQ ID NO: 972663 - RNA, 23 nt, Homo sapiens
cugaggguugggguggggaagca

SEQ ID NO: 972664 - RNA, 14 nt, Homo sapiens
cugaguauuuucac

SEQ ID NO: 972665 - RNA, 17 nt, Homo sapiens
cugagucagagccaugu

SEQ ID NO: 972666 - RNA, 13 nt, Homo sapiens
cugagugagcugg

SEQ ID NO: 972667 - RNA, 14 nt, Homo sapiens
cugauuugaugaua

SEQ ID NO: 972668 - RNA, 13 nt, Homo sapiens
cugcacaaggugg

SEQ ID NO: 972669 - RNA, 15 nt, Homo sapiens
cugcacacaggacag

SEQ ID NO: 972670 - RNA, 18 nt, Homo sapiens
cugcacacccuccagaga

SEQ ID NO: 972671 - RNA, 15 nt, Homo sapiens
cuguaauuccagcua

SEQ ID NO: 972672 - RNA, 17 nt, Homo sapiens
cuguaugugagcuguaa

SEQ ID NO: 972673 - RNA, 20 nt, Homo sapiens
cuguauuuuuaaauugccaa

SEQ ID NO: 972674 - RNA, 15 nt, Homo sapiens
cugucaagcuggugc

SEQ ID NO: 972675 - RNA, 12 nt, Homo sapiens
cugucaccaccc

SEQ ID NO: 972676 - RNA, 23 nt, Homo sapiens
cugucaguucuaaccuccuaagc

SEQ ID NO: 972677 - RNA, 23 nt, Homo sapiens
cuguccacgcgugccguggcacc

SEQ ID NO: 972678 - RNA, 11 nt, Homo sapiens
cuguccagugc

SEQ ID NO: 972679 - RNA, 23 nt, Homo sapiens
cugucccagccccggcaagccac

SEQ ID NO: 972680 - RNA, 17 nt, Homo sapiens
cuguccccacacugacc

SEQ ID NO: 972681 - RNA, 17 nt, Homo sapiens
cugucccuguagcucag

SEQ ID NO: 972682 - RNA, 19 nt, Homo sapiens
cuguccuguuucugucaag

SEQ ID NO: 972683 - RNA, 14 nt, Homo sapiens
cugucggugggacc

SEQ ID NO: 972684 - RNA, 15 nt, Homo sapiens
cugucggugggacuc

SEQ ID NO: 972685 - RNA, 22 nt, Homo sapiens
cugucuauuaauauucagggua

SEQ ID NO: 972686 - RNA, 23 nt, Homo sapiens
cugucugaguaagcccucaggag

SEQ ID NO: 972687 - RNA, 17 nt, Homo sapiens
cugucuggaacauggac

SEQ ID NO: 972688 - RNA, 16 nt, Homo sapiens
cugugaaccugggcac

SEQ ID NO: 972689 - RNA, 18 nt, Homo sapiens
cugugaacuuucauguca

SEQ ID NO: 972690 - RNA, 15 nt, Homo sapiens
cugugacuaccucaa

SEQ ID NO: 972691 - RNA, 16 nt, Homo sapiens
cugugaguauugcuua

SEQ ID NO: 972692 - RNA, 22 nt, Homo sapiens
cugugauauuuucacacuggua

SEQ ID NO: 972693 - RNA, 23 nt, Homo sapiens
cugugauauuuucacacugguaa

SEQ ID NO: 972694 - RNA, 15 nt, Homo sapiens
cugugauccacccaa

SEQ ID NO: 972695 - RNA, 22 nt, Homo sapiens
cugugccaauacagacaaagca

SEQ ID NO: 972696 - RNA, 23 nt, Homo sapiens
cugugccaauacagacaaagcau

SEQ ID NO: 972697 - RNA, 17 nt, Homo sapiens
cuguggcuagugacaaa

SEQ ID NO: 972698 - RNA, 16 nt, Homo sapiens
cugugggcaagccuaa

SEQ ID NO: 972699 - RNA, 20 nt, Homo sapiens
cugugguuccucugcucacc

SEQ ID NO: 972700 - RNA, 23 nt, Homo sapiens
cuguguaacuguaaaacauugaa

SEQ ID NO: 972701 - RNA, 16 nt, Homo sapiens
cuguguacauaacuga

SEQ ID NO: 972702 - RNA, 19 nt, Homo sapiens
cugugucuaggcaggcaag

SEQ ID NO: 972703 - RNA, 16 nt, Homo sapiens
cugugugaucuucagu

SEQ ID NO: 972704 - RNA, 17 nt, Homo sapiens
cugugugugccuccagc

SEQ ID NO: 972705 - RNA, 14 nt, Homo sapiens
cuguuggugggacc

SEQ ID NO: 972706 - RNA, 12 nt, Homo sapiens
cuguuguaauau

SEQ ID NO: 972707 - RNA, 20 nt, Homo sapiens
ccuucuuugauaauguuaaa

SEQ ID NO: 972708 - RNA, 17 nt, Homo sapiens
ccuugagggcugcaguu

SEQ ID NO: 972709 - RNA, 22 nt, Homo sapiens
ccuugaucuuaacaaagccuuu

SEQ ID NO: 972710 - RNA, 20 nt, Homo sapiens
ccuugcaucaagggcuuuau

SEQ ID NO: 972711 - RNA, 21 nt, Homo sapiens
ccuuggaagggcguucuaggu

SEQ ID NO: 972712 - RNA, 16 nt, Homo sapiens
ccuuggcuucugugau

SEQ ID NO: 972713 - RNA, 18 nt, Homo sapiens
ccuugucccagccaguga

SEQ ID NO: 972714 - RNA, 18 nt, Homo sapiens
ccuuguuggggagugggu

SEQ ID NO: 972715 - RNA, 23 nt, Homo sapiens
ccuuucuacaacugauugcaaca

SEQ ID NO: 972716 - RNA, 18 nt, Homo sapiens
ccuuucugcagggaugau

SEQ ID NO: 972717 - RNA, 23 nt, Homo sapiens
ccuuucuuuuaaugaugccaugg

SEQ ID NO: 972718 - RNA, 15 nt, Homo sapiens
ccuuugagacaguuu

SEQ ID NO: 972719 - RNA, 14 nt, Homo sapiens
ccuuugagguugau

SEQ ID NO: 972720 - RNA, 12 nt, Homo sapiens
ccuuugcuaaug

SEQ ID NO: 972721 - RNA, 19 nt, Homo sapiens
ccuuuggccccacuuugaa

SEQ ID NO: 972722 - RNA, 16 nt, Homo sapiens
ccuuuggggacuuuuc

SEQ ID NO: 972723 - RNA, 16 nt, Homo sapiens
ccuuuguaagugcagg

SEQ ID NO: 972724 - RNA, 16 nt, Homo sapiens
ccuuuuaauggauggu

SEQ ID NO: 972725 - RNA, 21 nt, Homo sapiens
ccuuuuaauggaugguugaau

SEQ ID NO: 972726 - RNA, 20 nt, Homo sapiens
ccuuuuacaauuguugaaau

SEQ ID NO: 972727 - RNA, 22 nt, Homo sapiens
ccuuuuuuaagauuuuucucaa

SEQ ID NO: 972728 - RNA, 18 nt, Homo sapiens
cgaaauaacaauguuaag

SEQ ID NO: 972729 - RNA, 20 nt, Homo sapiens
cgaacaccaaaaaugaugcg

SEQ ID NO: 972730 - RNA, 17 nt, Homo sapiens
cgaagacaaccaucaca

SEQ ID NO: 972731 - RNA, 16 nt, Homo sapiens
cgacaacuuguaacuc

SEQ ID NO: 972732 - RNA, 13 nt, Homo sapiens
cgaccccaagagu

SEQ ID NO: 972733 - RNA, 14 nt, Homo sapiens
cgacugaaacugga

SEQ ID NO: 972734 - RNA, 22 nt, Homo sapiens
cgagagaggcgcgucugcccca

SEQ ID NO: 972735 - RNA, 15 nt, Homo sapiens
cgagcaaaauucaaa

SEQ ID NO: 972736 - RNA, 19 nt, Homo sapiens
cgagcaccuccagccugaa

SEQ ID NO: 972737 - RNA, 21 nt, Homo sapiens
cgagcaccuccagccugaaca

SEQ ID NO: 972738 - RNA, 20 nt, Homo sapiens
cgagggcaaagcggccucau

SEQ ID NO: 972739 - RNA, 15 nt, Homo sapiens
cgagugugauuugaa

SEQ ID NO: 972740 - RNA, 19 nt, Homo sapiens
cgcagagguguaggggugg

SEQ ID NO: 972741 - RNA, 17 nt, Homo sapiens
cgcaguguuuugcaagu

SEQ ID NO: 972742 - RNA, 21 nt, Homo sapiens
cgcauugccacggaaacauac

SEQ ID NO: 972743 - RNA, 23 nt, Homo sapiens
cgccauuccaagucaacacucuu

SEQ ID NO: 972744 - RNA, 20 nt, Homo sapiens
cgcccuuggcuucugugaug

SEQ ID NO: 972745 - RNA, 20 nt, Homo sapiens
ucaaaguuuugaaaagcuau

SEQ ID NO: 972746 - RNA, 13 nt, Homo sapiens
ucaaauaaacuca

SEQ ID NO: 972747 - RNA, 14 nt, Homo sapiens
ucaaauaaacucaa

SEQ ID NO: 972748 - RNA, 22 nt, Homo sapiens
ucaaauaggcuauuaaaaaagu

SEQ ID NO: 972749 - RNA, 19 nt, Homo sapiens
ucaaauaguugcauagcag

SEQ ID NO: 972750 - RNA, 17 nt, Homo sapiens
ucaaaugaagugaguca

SEQ ID NO: 972751 - RNA, 15 nt, Homo sapiens
ucaaauggacuuuca

SEQ ID NO: 972752 - RNA, 21 nt, Homo sapiens
ucaaauuuuggcgaaucucaa

SEQ ID NO: 972753 - RNA, 23 nt, Homo sapiens
ucaacaagauuuccuugugcaaa

SEQ ID NO: 972754 - RNA, 20 nt, Homo sapiens
ucaacagaaacuaaaugaac

SEQ ID NO: 972755 - RNA, 16 nt, Homo sapiens
ucaaccuaacacauua

SEQ ID NO: 972756 - RNA, 20 nt, Homo sapiens
ucaacucuuaaagacaucuu

SEQ ID NO: 972757 - RNA, 17 nt, Homo sapiens
ucaacugaaugagguca

SEQ ID NO: 972758 - RNA, 14 nt, Homo sapiens
ucaagaccugagua

SEQ ID NO: 972759 - RNA, 22 nt, Homo sapiens
ucaagcaaaaugcuuacagggc

SEQ ID NO: 972760 - RNA, 18 nt, Homo sapiens
ucaaggaggcccacugug

SEQ ID NO: 972761 - RNA, 14 nt, Homo sapiens
ucaaguccacaagc

SEQ ID NO: 972762 - RNA, 14 nt, Homo sapiens
ucaauaaagcacug

SEQ ID NO: 972763 - RNA, 21 nt, Homo sapiens
ucaauauuuuuauaucaugca

SEQ ID NO: 972764 - RNA, 16 nt, Homo sapiens
ucaaucacagucucag

SEQ ID NO: 972765 - RNA, 21 nt, Homo sapiens
ucaaucugcaguuuaacaaaa

SEQ ID NO: 972766 - RNA, 23 nt, Homo sapiens
ucaauggaauacagucauuccaa

SEQ ID NO: 972767 - RNA, 16 nt, Homo sapiens
ucaaugggaccugugg

SEQ ID NO: 972768 - RNA, 20 nt, Homo sapiens
ucaauguuuagcagauuuaa

SEQ ID NO: 972769 - RNA, 15 nt, Homo sapiens
ucaauuccugugauu

SEQ ID NO: 972770 - RNA, 16 nt, Homo sapiens
ucacaaauccuucaaa

SEQ ID NO: 972771 - RNA, 15 nt, Homo sapiens
ucacacacacucuga

SEQ ID NO: 972772 - RNA, 18 nt, Homo sapiens
ucacacagacacuaacga

SEQ ID NO: 972773 - RNA, 22 nt, Homo sapiens
ucacacuccccuagggggagaa

SEQ ID NO: 972774 - RNA, 16 nt, Homo sapiens
ucacagauaacauaaa

SEQ ID NO: 972775 - RNA, 23 nt, Homo sapiens
ucacaggugggaucggcacucag

SEQ ID NO: 972776 - RNA, 17 nt, Homo sapiens
ucacauggccuaugcac

SEQ ID NO: 972777 - RNA, 18 nt, Homo sapiens
ucacauuccucugcccuu

SEQ ID NO: 972778 - RNA, 22 nt, Homo sapiens
ucacauuguacuuaaaccuccu

SEQ ID NO: 972779 - RNA, 12 nt, Homo sapiens
ucaccauguugg

SEQ ID NO: 972780 - RNA, 19 nt, Homo sapiens
ucacccaggcuggaguaca

SEQ ID NO: 972781 - RNA, 16 nt, Homo sapiens
ucaccuguaaaccuga

SEQ ID NO: 972782 - RNA, 15 nt, Homo sapiens
ucaccuuggggccuu

SEQ ID NO: 972783 - RNA, 14 nt, Homo sapiens
ucacgacucuuccu

SEQ ID NO: 972784 - RNA, 16 nt, Homo sapiens
ucacuacucagugcau

SEQ ID NO: 972785 - RNA, 13 nt, Homo sapiens
ucacuagucucac

SEQ ID NO: 972786 - RNA, 21 nt, Homo sapiens
ucacuaugaagguaaagggag

SEQ ID NO: 972787 - RNA, 13 nt, Homo sapiens
ucacugcacucca

SEQ ID NO: 972788 - RNA, 20 nt, Homo sapiens
ucacugcucccccgugugua

SEQ ID NO: 972789 - RNA, 15 nt, Homo sapiens
ucacugucaccaccc

SEQ ID NO: 972790 - RNA, 19 nt, Homo sapiens
ucacuucauagcucaccag

SEQ ID NO: 972791 - RNA, 13 nt, Homo sapiens
ucagaaagggauu

SEQ ID NO: 972792 - RNA, 24 nt, Homo sapiens
ucagaaccugcuccuggaguacac

SEQ ID NO: 972793 - RNA, 16 nt, Homo sapiens
ucagaacugugccaca

SEQ ID NO: 972794 - RNA, 20 nt, Homo sapiens
ucagaauaaauuauugcugu

SEQ ID NO: 972795 - RNA, 18 nt, Homo sapiens
ucagaauugcucaaagaa

SEQ ID NO: 972796 - RNA, 17 nt, Homo sapiens
ucagaccaguacuggga

SEQ ID NO: 972797 - RNA, 21 nt, Homo sapiens
ucagacuuuguguucauuuca

SEQ ID NO: 972798 - RNA, 22 nt, Homo sapiens
ucagacuuuguguucauuucau

SEQ ID NO: 972799 - RNA, 21 nt, Homo sapiens
uccugaugaggagaaaggggc

SEQ ID NO: 972800 - RNA, 19 nt, Homo sapiens
uccugauuauaggauuuua

SEQ ID NO: 972801 - RNA, 17 nt, Homo sapiens
uccugccauagucuuaa

SEQ ID NO: 972802 - RNA, 21 nt, Homo sapiens
uccugcucuucccucauuaaa

SEQ ID NO: 972803 - RNA, 21 nt, Homo sapiens
uccuggcagcccagagacuuu

SEQ ID NO: 972804 - RNA, 19 nt, Homo sapiens
uccuggcuaacauggugaa

SEQ ID NO: 972805 - RNA, 22 nt, Homo sapiens
uccuggugccccccaccccugg

SEQ ID NO: 972806 - RNA, 13 nt, Homo sapiens
uccugugauccac

SEQ ID NO: 972807 - RNA, 18 nt, Homo sapiens
uccugugauuuaugccaa

SEQ ID NO: 972808 - RNA, 23 nt, Homo sapiens
uccuuaccgucuugaucggaaag

SEQ ID NO: 972809 - RNA, 19 nt, Homo sapiens
uccuuagcauucauaaacu

SEQ ID NO: 972810 - RNA, 17 nt, Homo sapiens
uccuucccucucugaug

SEQ ID NO: 972811 - RNA, 13 nt, Homo sapiens
uccuuccuaagaa

SEQ ID NO: 972812 - RNA, 18 nt, Homo sapiens
uccuucuauucuagccug

SEQ ID NO: 972813 - RNA, 21 nt, Homo sapiens
uccuucuuugauaauguuaaa

SEQ ID NO: 972814 - RNA, 14 nt, Homo sapiens
uccuugaugauuga

SEQ ID NO: 972815 - RNA, 15 nt, Homo sapiens
uccuugcuuccuguc

SEQ ID NO: 972816 - RNA, 18 nt, Homo sapiens
uccuugcuuccugucuua

SEQ ID NO: 972817 - RNA, 22 nt, Homo sapiens
uccuugugcaaaauauuugacu

SEQ ID NO: 972818 - RNA, 16 nt, Homo sapiens
uccuuuuaauuuuccu

SEQ ID NO: 972819 - RNA, 19 nt, Homo sapiens
uccuuuuacaauuguugaa

SEQ ID NO: 972820 - RNA, 16 nt, Homo sapiens
uccuuuucccaaagca

SEQ ID NO: 972821 - RNA, 14 nt, Homo sapiens
ucgaggccugaagc

SEQ ID NO: 972822 - RNA, 21 nt, Homo sapiens
ucgcaacuguccacgcgugcc

SEQ ID NO: 972823 - RNA, 20 nt, Homo sapiens
ucgcaucuugugucgcugaa

SEQ ID NO: 972824 - RNA, 19 nt, Homo sapiens
ucgcuagguagaacacugc

SEQ ID NO: 972825 - RNA, 19 nt, Homo sapiens
ucggaagggguuccucaaa

SEQ ID NO: 972826 - RNA, 17 nt, Homo sapiens
ucuaaaugugacaugca

SEQ ID NO: 972827 - RNA, 18 nt, Homo sapiens
ucuaaaugugacaugcaa

SEQ ID NO: 972828 - RNA, 13 nt, Homo sapiens
ucuaacaaacaag

SEQ ID NO: 972829 - RNA, 20 nt, Homo sapiens
ucuaauuaauaaauuuucca

SEQ ID NO: 972830 - RNA, 11 nt, Homo sapiens
ucuacauucac

SEQ ID NO: 972831 - RNA, 18 nt, Homo sapiens
ucuaccagauaacugagg

SEQ ID NO: 972832 - RNA, 21 nt, Homo sapiens
ucuagacuguuugcugauccc

SEQ ID NO: 972833 - RNA, 18 nt, Homo sapiens
ucuagauuauaaacugac

SEQ ID NO: 972834 - RNA, 23 nt, Homo sapiens
ucuagcacacuuuuuuaaaugaa

SEQ ID NO: 972835 - RNA, 16 nt, Homo sapiens
ucuaggagcaagguga

SEQ ID NO: 972836 - RNA, 16 nt, Homo sapiens
ucuaggcuaagcacuu

SEQ ID NO: 972837 - RNA, 20 nt, Homo sapiens
ucuauacaaaaugauuuuga

SEQ ID NO: 972838 - RNA, 19 nt, Homo sapiens
ucuauacuccuucccuuaa

SEQ ID NO: 972839 - RNA, 14 nt, Homo sapiens
ucuauaggcagcuu

SEQ ID NO: 972840 - RNA, 11 nt, Homo sapiens
ucuauaucuca

SEQ ID NO: 972841 - RNA, 20 nt, Homo sapiens
ucuauauuagaucaaauagu

SEQ ID NO: 972842 - RNA, 20 nt, Homo sapiens
ucuauuaauaucaacucuga

SEQ ID NO: 972843 - RNA, 18 nt, Homo sapiens
ucuauuuggggcuugaug

SEQ ID NO: 972844 - RNA, 20 nt, Homo sapiens
ucuauuuuaauuacugcuau

SEQ ID NO: 972845 - RNA, 21 nt, Homo sapiens
ucucaagauggggcgagccag

SEQ ID NO: 972846 - RNA, 22 nt, Homo sapiens
ucucaauguuuagcagauuuaa

SEQ ID NO: 972847 - RNA, 12 nt, Homo sapiens
ucucagaaccuu

SEQ ID NO: 972848 - RNA, 14 nt, Homo sapiens
ucucagauuuccac

SEQ ID NO: 972849 - RNA, 20 nt, Homo sapiens
ucucaggggaaggauuugca

SEQ ID NO: 972850 - RNA, 17 nt, Homo sapiens
ucucagugaaauaacua

SEQ ID NO: 972851 - RNA, 13 nt, Homo sapiens
ucucaguggagcc

SEQ ID NO: 972852 - RNA, 16 nt, Homo sapiens
ucucaguggagccuua

SEQ ID NO: 972853 - RNA, 10 nt, Homo sapiens
ucucauguca

SEQ ID NO: 972854 - RNA, 17 nt, Homo sapiens
ucucauuacuuauacug

SEQ ID NO: 972855 - RNA, 14 nt, Homo sapiens
ucuccaaccacugu

SEQ ID NO: 972856 - RNA, 18 nt, Homo sapiens
ucuccaaccacugugcca

SEQ ID NO: 972857 - RNA, 18 nt, Homo sapiens
ucuccaccuuguuacaca

SEQ ID NO: 972858 - RNA, 12 nt, Homo sapiens
ucuccacuccau

SEQ ID NO: 972859 - RNA, 13 nt, Homo sapiens
ucuccagcaugua

SEQ ID NO: 972860 - RNA, 16 nt, Homo sapiens
ucucccccuaguuugu

SEQ ID NO: 972861 - RNA, 14 nt, Homo sapiens
ucucccuggagcug

SEQ ID NO: 972862 - RNA, 22 nt, Homo sapiens
ugaucagaguuccuccuacuua

SEQ ID NO: 972863 - RNA, 22 nt, Homo sapiens
ugauccauccccagaccaggac

SEQ ID NO: 972864 - RNA, 20 nt, Homo sapiens
ugaucuccauaaacaugaaa

SEQ ID NO: 972865 - RNA, 12 nt, Homo sapiens
ugaucugggcau

SEQ ID NO: 972866 - RNA, 17 nt, Homo sapiens
ugaugaacuuauaauga

SEQ ID NO: 972867 - RNA, 18 nt, Homo sapiens
ugaugauuuucauuucau

SEQ ID NO: 972868 - RNA, 21 nt, Homo sapiens
ugauggacacuccagggacac

SEQ ID NO: 972869 - RNA, 16 nt, Homo sapiens
ugaugucuccacuuuc

SEQ ID NO: 972870 - RNA, 14 nt, Homo sapiens
ugauugaagucuuc

SEQ ID NO: 972871 - RNA, 15 nt, Homo sapiens
ugauugagacucaaa

SEQ ID NO: 972872 - RNA, 19 nt, Homo sapiens
ugauugugugacuauucau

SEQ ID NO: 972873 - RNA, 22 nt, Homo sapiens
ugauuuagggaagcagggacac

SEQ ID NO: 972874 - RNA, 19 nt, Homo sapiens
ugauuuggaagagaggcac

SEQ ID NO: 972875 - RNA, 20 nt, Homo sapiens
ugcaaaagugaaacauacaa

SEQ ID NO: 972876 - RNA, 22 nt, Homo sapiens
ugcaaguggccauuaccaucuc

SEQ ID NO: 972877 - RNA, 13 nt, Homo sapiens
ugcacacaggaca

SEQ ID NO: 972878 - RNA, 20 nt, Homo sapiens
ugcacagagcaaguccucac

SEQ ID NO: 972879 - RNA, 17 nt, Homo sapiens
ugcacagcuggagaaau

SEQ ID NO: 972880 - RNA, 23 nt, Homo sapiens
ugcacaugggauugcuaaaacag

SEQ ID NO: 972881 - RNA, 22 nt, Homo sapiens
ugcacugaggcagcgaccucaa

SEQ ID NO: 972882 - RNA, 15 nt, Homo sapiens
ugcagaaacuuggau

SEQ ID NO: 972883 - RNA, 20 nt, Homo sapiens
ugcagaaacuuggaugucac

SEQ ID NO: 972884 - RNA, 22 nt, Homo sapiens
ugcagagaaacuuaagcaaagg

SEQ ID NO: 972885 - RNA, 21 nt, Homo sapiens
ugcagaugccacccuagccaa

SEQ ID NO: 972886 - RNA, 22 nt, Homo sapiens
ugcagguuuucuucacugccag

SEQ ID NO: 972887 - RNA, 17 nt, Homo sapiens
ugcaguuucuuuucaca

SEQ ID NO: 972888 - RNA, 20 nt, Homo sapiens
ugcaguuucuuuucacauua

SEQ ID NO: 972889 - RNA, 18 nt, Homo sapiens
ugcauaaaaaggucuuua

SEQ ID NO: 972890 - RNA, 14 nt, Homo sapiens
ugcauaauaagcua

SEQ ID NO: 972891 - RNA, 13 nt, Homo sapiens
ugcaugaccugau

SEQ ID NO: 972892 - RNA, 21 nt, Homo sapiens
ugcaugaccugaucauuacau

SEQ ID NO: 972893 - RNA, 16 nt, Homo sapiens
ugcauguuuccugcuc

SEQ ID NO: 972894 - RNA, 21 nt, Homo sapiens
ugcauuuuuguaaauguguac

SEQ ID NO: 972895 - RNA, 16 nt, Homo sapiens
ugcauuuuugugaaau

SEQ ID NO: 972896 - RNA, 13 nt, Homo sapiens
ugccaacaugugg

SEQ ID NO: 972897 - RNA, 17 nt, Homo sapiens
ugccaaugaccaaacag

SEQ ID NO: 972898 - RNA, 17 nt, Homo sapiens
ugccacagccagaggag

SEQ ID NO: 972899 - RNA, 14 nt, Homo sapiens
ugccagcaaauaaa

SEQ ID NO: 972900 - RNA, 21 nt, Homo sapiens
ugccaucaccgcugggugguu

SEQ ID NO: 972901 - RNA, 22 nt, Homo sapiens
ugccaucaccgcugggugguuu

SEQ ID NO: 972902 - RNA, 15 nt, Homo sapiens
ugccaugcucagaaa

SEQ ID NO: 972903 - RNA, 18 nt, Homo sapiens
ugccaugucugcagugug

SEQ ID NO: 972904 - RNA, 15 nt, Homo sapiens
ugcccacgcagagga

SEQ ID NO: 972905 - RNA, 20 nt, Homo sapiens
ugcccacucuccauccuccc

SEQ ID NO: 972906 - RNA, 22 nt, Homo sapiens
ugccccagauuuacuaaaucaa

SEQ ID NO: 972907 - RNA, 20 nt, Homo sapiens
ugccccauucucacugcuau

SEQ ID NO: 972908 - RNA, 19 nt, Homo sapiens
ugccccuggaccugggaac

SEQ ID NO: 972909 - RNA, 22 nt, Homo sapiens
ugcccgccgccccuccacccau

SEQ ID NO: 972910 - RNA, 22 nt, Homo sapiens
ugcccugcuaaagacagugcgg

SEQ ID NO: 972911 - RNA, 20 nt, Homo sapiens
ugccggccgggugugguggc

SEQ ID NO: 972912 - RNA, 23 nt, Homo sapiens
ugccguuuucuugcucaaaggga

SEQ ID NO: 972913 - RNA, 16 nt, Homo sapiens
ugccuaauuccuggca

SEQ ID NO: 972914 - RNA, 14 nt, Homo sapiens
ugccuacuccaaaa

SEQ ID NO: 972915 - RNA, 23 nt, Homo sapiens
ugccucagagcagccucauccca

SEQ ID NO: 972916 - RNA, 13 nt, Homo sapiens
ugccuccagcauu

SEQ ID NO: 972917 - RNA, 19 nt, Homo sapiens
ugccuccucugguccccag

SEQ ID NO: 972918 - RNA, 15 nt, Homo sapiens
ugccugccaccuuca

SEQ ID NO: 972919 - RNA, 15 nt, Homo sapiens
ugccuggccuggcac

SEQ ID NO: 972920 - RNA, 16 nt, Homo sapiens
ugccuggccuggcaca

SEQ ID NO: 972921 - RNA, 21 nt, Homo sapiens
ugccuuaaacacacauugcag

SEQ ID NO: 972922 - RNA, 15 nt, Homo sapiens
ugccuucucaggaaa

SEQ ID NO: 972923 - RNA, 19 nt, Homo sapiens
ugccuucuccaucaugccc

SEQ ID NO: 972924 - RNA, 22 nt, Homo sapiens
ugccuuuuuuucucugcauuua

SEQ ID NO: 972925 - RNA, 22 nt, Homo sapiens
ugcgccaguccugcuaccuccc

SEQ ID NO: 972926 - RNA, 18 nt, Homo sapiens
ugcggaugcaagagcacc

SEQ ID NO: 972927 - RNA, 15 nt, Homo sapiens
ugcgggccagggucc

SEQ ID NO: 972928 - RNA, 22 nt, Homo sapiens
ugcgucagaccaguacugggaa

SEQ ID NO: 972929 - RNA, 14 nt, Homo sapiens
caauuucucucaga

SEQ ID NO: 972930 - RNA, 18 nt, Homo sapiens
caauuuuuuaucaugcau

SEQ ID NO: 972931 - RNA, 14 nt, Homo sapiens
cacaaaucugccaa

SEQ ID NO: 972932 - RNA, 11 nt, Homo sapiens
cacaacaaucc

SEQ ID NO: 972933 - RNA, 20 nt, Homo sapiens
cacaacugucuuagacugcu

SEQ ID NO: 972934 - RNA, 18 nt, Homo sapiens
cacaagccaggaccugcu

SEQ ID NO: 972935 - RNA, 19 nt, Homo sapiens
cacaaucugucaguucuaa

SEQ ID NO: 972936 - RNA, 18 nt, Homo sapiens
cacacacgaugcauuuaa

SEQ ID NO: 972937 - RNA, 19 nt, Homo sapiens
cacacacgaugcauuuaau

SEQ ID NO: 972938 - RNA, 19 nt, Homo sapiens
cacaccucuccuuugugac

SEQ ID NO: 972939 - RNA, 14 nt, Homo sapiens
cacacgagcaaacc

SEQ ID NO: 972940 - RNA, 13 nt, Homo sapiens
cacacgaugcauu

SEQ ID NO: 972941 - RNA, 13 nt, Homo sapiens
cacacgcauuaau

SEQ ID NO: 972942 - RNA, 21 nt, Homo sapiens
cacacucugaagaauccugua

SEQ ID NO: 972943 - RNA, 17 nt, Homo sapiens
cacagaagcacaugcac

SEQ ID NO: 972944 - RNA, 14 nt, Homo sapiens
cacagaagcucauc

SEQ ID NO: 972945 - RNA, 16 nt, Homo sapiens
cacagaggagugcagc

SEQ ID NO: 972946 - RNA, 17 nt, Homo sapiens
cacagauguucccccau

SEQ ID NO: 972947 - RNA, 13 nt, Homo sapiens
cacagcccugcuc

SEQ ID NO: 972948 - RNA, 18 nt, Homo sapiens
cacaggcagauguuugcc

SEQ ID NO: 972949 - RNA, 18 nt, Homo sapiens
cacaguaccggauucucu

SEQ ID NO: 972950 - RNA, 21 nt, Homo sapiens
cacaguagaacugucugugaa

SEQ ID NO: 972951 - RNA, 12 nt, Homo sapiens
cacagucacugc

SEQ ID NO: 972952 - RNA, 22 nt, Homo sapiens
cacaguccaaccagaaacaccc

SEQ ID NO: 972953 - RNA, 14 nt, Homo sapiens
cacagugugcucca

SEQ ID NO: 972954 - RNA, 18 nt, Homo sapiens
cacauaguucuguaauaa

SEQ ID NO: 972955 - RNA, 17 nt, Homo sapiens
cacauauggacucugca

SEQ ID NO: 972956 - RNA, 16 nt, Homo sapiens
cacauauguaguauaa

SEQ ID NO: 972957 - RNA, 16 nt, Homo sapiens
cacaucuacacguggc

SEQ ID NO: 972958 - RNA, 15 nt, Homo sapiens
cacaucuuguaacuu

SEQ ID NO: 972959 - RNA, 15 nt, Homo sapiens
cacaugaugugcaua

SEQ ID NO: 972960 - RNA, 14 nt, Homo sapiens
cacauggaacuuua

SEQ ID NO: 972961 - RNA, 15 nt, Homo sapiens
cacaugugacacaua

SEQ ID NO: 972962 - RNA, 18 nt, Homo sapiens
cacauuaaauguggaagg

SEQ ID NO: 972963 - RNA, 14 nt, Homo sapiens
cacauuguacuuaa

SEQ ID NO: 972964 - RNA, 19 nt, Homo sapiens
cacauuuacaaguagugaa

SEQ ID NO: 972965 - RNA, 19 nt, Homo sapiens
cacauuuuacuacaguaaa

SEQ ID NO: 972966 - RNA, 22 nt, Homo sapiens
caccaaaaacaaaaaccaaaug

SEQ ID NO: 972967 - RNA, 18 nt, Homo sapiens
caccaaccagaccacuca

SEQ ID NO: 972968 - RNA, 23 nt, Homo sapiens
caccaaggcugagacagugaauu

SEQ ID NO: 972969 - RNA, 23 nt, Homo sapiens
caccacagcagagaccaccacau

SEQ ID NO: 972970 - RNA, 16 nt, Homo sapiens
caccacuaaaaaacca

SEQ ID NO: 972971 - RNA, 12 nt, Homo sapiens
caccacuguaua

SEQ ID NO: 972972 - RNA, 20 nt, Homo sapiens
caccauaaugagaugugagc

SEQ ID NO: 972973 - RNA, 23 nt, Homo sapiens
caccauacuccuugcuuccugau

SEQ ID NO: 972974 - RNA, 22 nt, Homo sapiens
cacccaacccuaucuccugaca

SEQ ID NO: 972975 - RNA, 12 nt, Homo sapiens
cacccacaucuu

SEQ ID NO: 972976 - RNA, 13 nt, Homo sapiens
cacccagacauaa

SEQ ID NO: 972977 - RNA, 15 nt, Homo sapiens
cacccauaccacagc

SEQ ID NO: 972978 - RNA, 16 nt, Homo sapiens
caccccuauggugcuc

SEQ ID NO: 972979 - RNA, 15 nt, Homo sapiens
cacccgggaacuuuu

SEQ ID NO: 972980 - RNA, 13 nt, Homo sapiens
cacccgugagaaa

SEQ ID NO: 972981 - RNA, 16 nt, Homo sapiens
cacccuggacaaagaa

SEQ ID NO: 972982 - RNA, 17 nt, Homo sapiens
caccgugaaauagguga

SEQ ID NO: 972983 - RNA, 21 nt, Homo sapiens
caccgugaccccuguccccac

SEQ ID NO: 972984 - RNA, 19 nt, Homo sapiens
caccuagaacacuaacuca

SEQ ID NO: 972985 - RNA, 14 nt, Homo sapiens
caccucugcaccuu

SEQ ID NO: 972986 - RNA, 14 nt, Homo sapiens
caccucuuccuuga

SEQ ID NO: 972987 - RNA, 12 nt, Homo sapiens
caccugccuugg

SEQ ID NO: 972988 - RNA, 22 nt, Homo sapiens
caccugcuggaaaccacacuuc

SEQ ID NO: 972989 - RNA, 15 nt, Homo sapiens
caccuugugucugua

SEQ ID NO: 972990 - RNA, 13 nt, Homo sapiens
cacgaacuggccu

SEQ ID NO: 972991 - RNA, 17 nt, Homo sapiens
cacgacucuuccugcaa

SEQ ID NO: 972992 - RNA, 15 nt, Homo sapiens
cacgccuacuuaaga

SEQ ID NO: 972993 - RNA, 17 nt, Homo sapiens
cacgcucgcugccauca

SEQ ID NO: 972994 - RNA, 19 nt, Homo sapiens
cacggcagcuguagcuccc

SEQ ID NO: 972995 - RNA, 16 nt, Homo sapiens
cacgggaaaggagcug

SEQ ID NO: 972996 - RNA, 14 nt, Homo sapiens
cacguggcuuggag

SEQ ID NO: 972997 - RNA, 21 nt, Homo sapiens
cacguugccaggggcuugaga

SEQ ID NO: 972998 - RNA, 16 nt, Homo sapiens
cacuaaguuuacuucu

SEQ ID NO: 972999 - RNA, 18 nt, Homo sapiens
cacuacaccuugccuugc

SEQ ID NO: 973000 - RNA, 16 nt, Homo sapiens
cacuacucagugcaua

SEQ ID NO: 973001 - RNA, 22 nt, Homo sapiens
cacuagcauuuucuugaaccaa

SEQ ID NO: 973002 - RNA, 12 nt, Homo sapiens
cacuagucucac

SEQ ID NO: 973003 - RNA, 23 nt, Homo sapiens
cacuauucuuggaccaugccaga

SEQ ID NO: 973004 - RNA, 14 nt, Homo sapiens
cacucuuagcuaug

SEQ ID NO: 973005 - RNA, 15 nt, Homo sapiens
aaaaaaaagugucuc

SEQ ID NO: 973006 - RNA, 13 nt, Homo sapiens
aaaaaaaccacag

SEQ ID NO: 973007 - RNA, 13 nt, Homo sapiens
aaaaaacuuugac

SEQ ID NO: 973008 - RNA, 19 nt, Homo sapiens
aaaaaccaacaaugugauu

SEQ ID NO: 973009 - RNA, 17 nt, Homo sapiens
aaaaaccacagccacua

SEQ ID NO: 973010 - RNA, 23 nt, Homo sapiens
aaaaacuagacuucguacuguga

SEQ ID NO: 973011 - RNA, 15 nt, Homo sapiens
aaaaacuagagcaca

SEQ ID NO: 973012 - RNA, 17 nt, Homo sapiens
aagauuuuccucuugug

SEQ ID NO: 973013 - RNA, 15 nt, Homo sapiens
aagcaaauguuggga

SEQ ID NO: 973014 - RNA, 13 nt, Homo sapiens
aagcacagaauau

SEQ ID NO: 973015 - RNA, 19 nt, Homo sapiens
aagcacaggagaacaugcu

SEQ ID NO: 973016 - RNA, 20 nt, Homo sapiens
aagcaccuuccccuccauuc

SEQ ID NO: 973017 - RNA, 19 nt, Homo sapiens
aagcacuacaccuugccuu

SEQ ID NO: 973018 - RNA, 16 nt, Homo sapiens
aagcagaaagucuuca

SEQ ID NO: 973019 - RNA, 22 nt, Homo sapiens
aagcagaauucugcauggugac

SEQ ID NO: 973020 - RNA, 17 nt, Homo sapiens
aagcaggugaacuggga

SEQ ID NO: 973021 - RNA, 19 nt, Homo sapiens
aagcauggugucaguuuug

SEQ ID NO: 973022 - RNA, 23 nt, Homo sapiens
aagccaaagaaaaauaacccuuu

SEQ ID NO: 973023 - RNA, 18 nt, Homo sapiens
aagccaacaacucugccu

SEQ ID NO: 973024 - RNA, 13 nt, Homo sapiens
aagccccagggac

SEQ ID NO: 973025 - RNA, 17 nt, Homo sapiens
aagcccccacacagacc

SEQ ID NO: 973026 - RNA, 16 nt, Homo sapiens
aagccuaucaaaggaa

SEQ ID NO: 973027 - RNA, 16 nt, Homo sapiens
aagccucagaaaggga

SEQ ID NO: 973028 - RNA, 13 nt, Homo sapiens
aagccucucucuc

SEQ ID NO: 973029 - RNA, 15 nt, Homo sapiens
aagccuguugcugaa

SEQ ID NO: 973030 - RNA, 23 nt, Homo sapiens
aagccuuaaguggcagaauauaa

SEQ ID NO: 973031 - RNA, 13 nt, Homo sapiens
aagccuucagcuc

SEQ ID NO: 973032 - RNA, 15 nt, Homo sapiens
aagcgagagcagcug

SEQ ID NO: 973033 - RNA, 14 nt, Homo sapiens
aagcuaaugucaca

SEQ ID NO: 973034 - RNA, 21 nt, Homo sapiens
aagcugaaaauuaaauuuuag

SEQ ID NO: 973035 - RNA, 23 nt, Homo sapiens
aagcuggaagaagugagcagugu

SEQ ID NO: 973036 - RNA, 16 nt, Homo sapiens
aagcuggcuuuuccca

SEQ ID NO: 973037 - RNA, 16 nt, Homo sapiens
aagcuucauguuugau

SEQ ID NO: 973038 - RNA, 18 nt, Homo sapiens
aagcuucccuccaucccc

SEQ ID NO: 973039 - RNA, 23 nt, Homo sapiens
aagcuuuuguucacacacacucu

SEQ ID NO: 973040 - RNA, 23 nt, Homo sapiens
aaggaaaaaacuuugacuuugcc

SEQ ID NO: 973041 - RNA, 15 nt, Homo sapiens
aaggaacuaagucag

SEQ ID NO: 973042 - RNA, 21 nt, Homo sapiens
aaggacaggccacaccacagc

SEQ ID NO: 973043 - RNA, 17 nt, Homo sapiens
aaggacucuuccaccuc

SEQ ID NO: 973044 - RNA, 18 nt, Homo sapiens
aaggacucuuccaccucc

SEQ ID NO: 973045 - RNA, 15 nt, Homo sapiens
aaggagagcuuugca

SEQ ID NO: 973046 - RNA, 17 nt, Homo sapiens
aaggcauuuauugccau

SEQ ID NO: 973047 - RNA, 16 nt, Homo sapiens
aaggcucacaccucau

SEQ ID NO: 973048 - RNA, 19 nt, Homo sapiens
aaggcuguacgacacgggu

SEQ ID NO: 973049 - RNA, 15 nt, Homo sapiens
aaggcuuugccaugg

SEQ ID NO: 973050 - RNA, 20 nt, Homo sapiens
aaggcuuugguuuccaaguc

SEQ ID NO: 973051 - RNA, 19 nt, Homo sapiens
aagggauggaaaaggaaga

SEQ ID NO: 973052 - RNA, 16 nt, Homo sapiens
aaggguuucucuauua

SEQ ID NO: 973053 - RNA, 14 nt, Homo sapiens
aagguuaaauuuca

SEQ ID NO: 973054 - RNA, 14 nt, Homo sapiens
aagguucucugugc

SEQ ID NO: 973055 - RNA, 23 nt, Homo sapiens
aagguuuaaaguuugaagauuau

SEQ ID NO: 973056 - RNA, 22 nt, Homo sapiens
aaguaauuaaaaguaauauggu

SEQ ID NO: 973057 - RNA, 18 nt, Homo sapiens
aaguaccuugaacucuua

SEQ ID NO: 973058 - RNA, 20 nt, Homo sapiens
aaguagcaucccaucccaac

SEQ ID NO: 973059 - RNA, 22 nt, Homo sapiens
aaguagucucuccccuggccac

SEQ ID NO: 973060 - RNA, 12 nt, Homo sapiens
aaguagugugaa

SEQ ID NO: 973061 - RNA, 13 nt, Homo sapiens
aagucagcuccag

SEQ ID NO: 973062 - RNA, 22 nt, Homo sapiens
aagucagcuccagcuuucugcc

SEQ ID NO: 973063 - RNA, 15 nt, Homo sapiens
aagucaucccagugc

SEQ ID NO: 973064 - RNA, 23 nt, Homo sapiens
aaguccaaccugccugugcauga

SEQ ID NO: 973065 - RNA, 20 nt, Homo sapiens
aaguccuaguuguucagcau

SEQ ID NO: 973066 - RNA, 15 nt, Homo sapiens
aaguccuggcacagu

SEQ ID NO: 973067 - RNA, 14 nt, Homo sapiens
aagucuacaacaua

SEQ ID NO: 973068 - RNA, 20 nt, Homo sapiens
aagucucucaggcucucuga

SEQ ID NO: 973069 - RNA, 14 nt, Homo sapiens
aagucugucugucu

SEQ ID NO: 973070 - RNA, 15 nt, Homo sapiens
aagugacuauagaau

SEQ ID NO: 973071 - RNA, 12 nt, Homo sapiens
aagugagcagaa

SEQ ID NO: 973072 - RNA, 13 nt, Homo sapiens
aaguguccugaaa

SEQ ID NO: 973073 - RNA, 20 nt, Homo sapiens
aaguuaccuacaagaacaau

SEQ ID NO: 973074 - RNA, 20 nt, Homo sapiens
aaguucaggcagcacaucaa

SEQ ID NO: 973075 - RNA, 15 nt, Homo sapiens
aaguuuagcucugag

SEQ ID NO: 973076 - RNA, 16 nt, Homo sapiens
aauaaaaagaucacuu

SEQ ID NO: 973077 - RNA, 15 nt, Homo sapiens
aauaaaagaacaugc

SEQ ID NO: 973078 - RNA, 22 nt, Homo sapiens
aauaaaaugccccacauuuuac

SEQ ID NO: 973079 - RNA, 12 nt, Homo sapiens
aauaaaccgugu

SEQ ID NO: 973080 - RNA, 16 nt, Homo sapiens
aauaaagcacugagca

SEQ ID NO: 973081 - RNA, 13 nt, Homo sapiens
aauaaauacgugu

SEQ ID NO: 973082 - RNA, 18 nt, Homo sapiens
aauaaauauuuaaugaau

SEQ ID NO: 973083 - RNA, 15 nt, Homo sapiens
aauaaauuaugagcu

SEQ ID NO: 973084 - RNA, 11 nt, Homo sapiens
aauaaauucca

SEQ ID NO: 973085 - RNA, 22 nt, Homo sapiens
aucccagauaugguugcacaaa

SEQ ID NO: 973086 - RNA, 16 nt, Homo sapiens
aucccaggcagugggu

SEQ ID NO: 973087 - RNA, 22 nt, Homo sapiens
aucccaggcgggcggcacgcca

SEQ ID NO: 973088 - RNA, 16 nt, Homo sapiens
aucccugccuguuaag

SEQ ID NO: 973089 - RNA, 16 nt, Homo sapiens
aucccuuugucuguca

SEQ ID NO: 973090 - RNA, 17 nt, Homo sapiens
auccgcugccagccuug

SEQ ID NO: 973091 - RNA, 18 nt, Homo sapiens
auccucccuccaccucaa

SEQ ID NO: 973092 - RNA, 16 nt, Homo sapiens
auccugccauccucaa

SEQ ID NO: 973093 - RNA, 13 nt, Homo sapiens
auccuuccaacau

SEQ ID NO: 973094 - RNA, 13 nt, Homo sapiens
auccuuccaucca

SEQ ID NO: 973095 - RNA, 12 nt, Homo sapiens
uacaagaacaau

SEQ ID NO: 973096 - RNA, 22 nt, Homo sapiens
uacaagaacaaugacaccacac

SEQ ID NO: 973097 - RNA, 11 nt, Homo sapiens
uacaagggaag

SEQ ID NO: 973098 - RNA, 22 nt, Homo sapiens
uacaaguaauauuauuacuuua

SEQ ID NO: 973099 - RNA, 18 nt, Homo sapiens
uacaauuuuuuaucaugc

SEQ ID NO: 973100 - RNA, 16 nt, Homo sapiens
uacagauuuaagaaua

SEQ ID NO: 973101 - RNA, 16 nt, Homo sapiens
uacagccuauaguaaa

SEQ ID NO: 973102 - RNA, 19 nt, Homo sapiens
uacaguauguuuuacaugu

SEQ ID NO: 973103 - RNA, 20 nt, Homo sapiens
uacaguggcaguauugacaa

SEQ ID NO: 973104 - RNA, 12 nt, Homo sapiens
uacagugguuuu

SEQ ID NO: 973105 - RNA, 20 nt, Homo sapiens
uacaguucugggguacaugu

SEQ ID NO: 973106 - RNA, 19 nt, Homo sapiens
uacauaggccgagcugugg

SEQ ID NO: 973107 - RNA, 16 nt, Homo sapiens
uacauagucaagucca

SEQ ID NO: 973108 - RNA, 20 nt, Homo sapiens
uacauauauacauugcuuag

SEQ ID NO: 973109 - RNA, 22 nt, Homo sapiens
uacauauuaaaggaagcacucu

SEQ ID NO: 973110 - RNA, 17 nt, Homo sapiens
uacaugcauaaacuaaa

SEQ ID NO: 973111 - RNA, 18 nt, Homo sapiens
uacaugugagugacgaug

SEQ ID NO: 973112 - RNA, 13 nt, Homo sapiens
uacauuucauuaa

SEQ ID NO: 973113 - RNA, 18 nt, Homo sapiens
uacauuugugaacaaaaa

SEQ ID NO: 973114 - RNA, 20 nt, Homo sapiens
uaccaaaaacaagucuauaa

SEQ ID NO: 973115 - RNA, 22 nt, Homo sapiens
uaccaaguaaauccaggcuuua

SEQ ID NO: 973116 - RNA, 18 nt, Homo sapiens
uaccacaaacccugcuga

SEQ ID NO: 973117 - RNA, 15 nt, Homo sapiens
uaccaguuuuccaga

SEQ ID NO: 973118 - RNA, 18 nt, Homo sapiens
uaccaguuuuccagaaca

SEQ ID NO: 973119 - RNA, 16 nt, Homo sapiens
uacccaauagguaauu

SEQ ID NO: 973120 - RNA, 17 nt, Homo sapiens
uaccuacaagaacaaug

SEQ ID NO: 973121 - RNA, 19 nt, Homo sapiens
uaccuagcuggcucuguga

SEQ ID NO: 973122 - RNA, 18 nt, Homo sapiens
uaccucagaaagauuuga

SEQ ID NO: 973123 - RNA, 21 nt, Homo sapiens
uaccuccauccauccuuccaa

SEQ ID NO: 973124 - RNA, 16 nt, Homo sapiens
uaccugagacuuaaga

SEQ ID NO: 973125 - RNA, 20 nt, Homo sapiens
uaccuggauguucuuuuuac

SEQ ID NO: 973126 - RNA, 18 nt, Homo sapiens
uaccuuaagagacacucc

SEQ ID NO: 973127 - RNA, 15 nt, Homo sapiens
uaccuuucagugcag

SEQ ID NO: 973128 - RNA, 18 nt, Homo sapiens
uacguacaccucuugccu

SEQ ID NO: 973129 - RNA, 12 nt, Homo sapiens
uacgugucaaaa

SEQ ID NO: 973130 - RNA, 20 nt, Homo sapiens
uacuaacuaaauaccauuca

SEQ ID NO: 973131 - RNA, 19 nt, Homo sapiens
uacuaguccugacacugaa

SEQ ID NO: 973132 - RNA, 20 nt, Homo sapiens
uacucaacccauuguuguca

SEQ ID NO: 973133 - RNA, 23 nt, Homo sapiens
uacucaggcugguggagaacucu

SEQ ID NO: 973134 - RNA, 23 nt, Homo sapiens
uacucagugcauagcgaagacca

SEQ ID NO: 973135 - RNA, 16 nt, Homo sapiens
uacuccuaugaucuga

SEQ ID NO: 973136 - RNA, 18 nt, Homo sapiens
uacuccuuaaaaauguau

SEQ ID NO: 973137 - RNA, 12 nt, Homo sapiens
uacucucuugcc

SEQ ID NO: 973138 - RNA, 17 nt, Homo sapiens
uacuguaguucacugua

SEQ ID NO: 973139 - RNA, 16 nt, Homo sapiens
uacuucuugaauauaa

SEQ ID NO: 973140 - RNA, 17 nt, Homo sapiens
uacuuugguagcuggga

SEQ ID NO: 973141 - RNA, 18 nt, Homo sapiens
uacuuuuaaacuguguac

SEQ ID NO: 973142 - RNA, 22 nt, Homo sapiens
uagaaaaguguggcuugggcau

SEQ ID NO: 973143 - RNA, 12 nt, Homo sapiens
uagaaacaaaca

SEQ ID NO: 973144 - RNA, 15 nt, Homo sapiens
uagaaagaugagauc

SEQ ID NO: 973145 - RNA, 23 nt, Homo sapiens
uagaacucugggcugccauguga

SEQ ID NO: 973146 - RNA, 16 nt, Homo sapiens
uagaacugucugugaa

SEQ ID NO: 973147 - RNA, 18 nt, Homo sapiens
uagaacugucugugaaca

SEQ ID NO: 973148 - RNA, 14 nt, Homo sapiens
uagaagccaaggga

SEQ ID NO: 973149 - RNA, 18 nt, Homo sapiens
uagaagcuguaacagaau

SEQ ID NO: 973150 - RNA, 17 nt, Homo sapiens
uagaauauccaugaccu

SEQ ID NO: 973151 - RNA, 16 nt, Homo sapiens
uagaauccgaagggaa

SEQ ID NO: 973152 - RNA, 16 nt, Homo sapiens
uagacaaucacuacaa

SEQ ID NO: 973153 - RNA, 17 nt, Homo sapiens
uagacagguguuacuua

SEQ ID NO: 973154 - RNA, 18 nt, Homo sapiens
uagagaaaauaaauucca

SEQ ID NO: 973155 - RNA, 16 nt, Homo sapiens
uagagaacucuuucau

SEQ ID NO: 973156 - RNA, 20 nt, Homo sapiens
uagagauagcuacaguguaa

SEQ ID NO: 973157 - RNA, 12 nt, Homo sapiens
uagagccagcuu

SEQ ID NO: 973158 - RNA, 19 nt, Homo sapiens
uagagccauaugcccucau

SEQ ID NO: 973159 - RNA, 13 nt, Homo sapiens
uagagcugggaau

SEQ ID NO: 973160 - RNA, 18 nt, Homo sapiens
uagagcugggaaucuuuu

SEQ ID NO: 973161 - RNA, 16 nt, Homo sapiens
uagagcuuagauuucc

SEQ ID NO: 973162 - RNA, 18 nt, Homo sapiens
uagaggauagggagaaua

SEQ ID NO: 973163 - RNA, 18 nt, Homo sapiens
uagaggcugggggcucca

SEQ ID NO: 973164 - RNA, 21 nt, Homo sapiens
uagauauugugaaguacauau

SEQ ID NO: 973165 - RNA, 14 nt, Homo sapiens
uagaucuaguucuc

SEQ ID NO: 973166 - RNA, 18 nt, Homo sapiens
uagaucucugaagccaca

SEQ ID NO: 973167 - RNA, 12 nt, Homo sapiens
uagaucuuucaa

SEQ ID NO: 973168 - RNA, 21 nt, Homo sapiens
uagauguagucuugacgaaua

SEQ ID NO: 973169 - RNA, 12 nt, Homo sapiens
uagaugugcauu

SEQ ID NO: 973170 - RNA, 17 nt, Homo sapiens
uagauuucuacacugag

SEQ ID NO: 973171 - RNA, 13 nt, Homo sapiens
uagcaaaugacau

SEQ ID NO: 973172 - RNA, 22 nt, Homo sapiens
uagcaacugcuggggagacaaa

SEQ ID NO: 973173 - RNA, 23 nt, Homo sapiens
uagcaauacuucagugagauuaa

SEQ ID NO: 973174 - RNA, 19 nt, Homo sapiens
uagcagaguuaaaucucaa

SEQ ID NO: 973175 - RNA, 18 nt, Homo sapiens
uagcagauuuaagauaug

SEQ ID NO: 973176 - RNA, 19 nt, Homo sapiens
uagcaucuucucauuccca

SEQ ID NO: 973177 - RNA, 15 nt, Homo sapiens
aaucuuuaccuguau

SEQ ID NO: 973178 - RNA, 16 nt, Homo sapiens
aaucuuuguaccaaaa

SEQ ID NO: 973179 - RNA, 14 nt, Homo sapiens
aaugaaaauuguau

SEQ ID NO: 973180 - RNA, 22 nt, Homo sapiens
aaugaaagcccucaugugcagu

SEQ ID NO: 973181 - RNA, 22 nt, Homo sapiens
aaugaagacuacauuugugaac

SEQ ID NO: 973182 - RNA, 22 nt, Homo sapiens
aaugaagcagaaauguacuuag

SEQ ID NO: 973183 - RNA, 22 nt, Homo sapiens
aaugaaguagaaguuacuuaau

SEQ ID NO: 973184 - RNA, 19 nt, Homo sapiens
aaugagaguuccuucucac

SEQ ID NO: 973185 - RNA, 17 nt, Homo sapiens
aaugagccgagaucacg

SEQ ID NO: 973186 - RNA, 18 nt, Homo sapiens
aaugagcuugugugcccu

SEQ ID NO: 973187 - RNA, 14 nt, Homo sapiens
aaugauguuuuccu

SEQ ID NO: 973188 - RNA, 23 nt, Homo sapiens
aaugauuaacaguuaugugguca

SEQ ID NO: 973189 - RNA, 22 nt, Homo sapiens
aaugcaguacauuaauauucau

SEQ ID NO: 973190 - RNA, 20 nt, Homo sapiens
aaugcauauuugccacaaaa

SEQ ID NO: 973191 - RNA, 20 nt, Homo sapiens
aaugcauguuuccugcucuu

SEQ ID NO: 973192 - RNA, 23 nt, Homo sapiens
aaugccauccagaugugugcaau

SEQ ID NO: 973193 - RNA, 14 nt, Homo sapiens
aaugccaugaauua

SEQ ID NO: 973194 - RNA, 19 nt, Homo sapiens
aaugccccacauuuuacua

SEQ ID NO: 973195 - RNA, 16 nt, Homo sapiens
aaugcccuucacuguc

SEQ ID NO: 973196 - RNA, 20 nt, Homo sapiens
aaugccuuugagacaguuuc

SEQ ID NO: 973197 - RNA, 13 nt, Homo sapiens
aaugcuacaugug

SEQ ID NO: 973198 - RNA, 10 nt, Homo sapiens
aaugcuccau

SEQ ID NO: 973199 - RNA, 19 nt, Homo sapiens
aaugcuuucccacucucag

SEQ ID NO: 973200 - RNA, 19 nt, Homo sapiens
aaugcuuuguuaaugcuuu

SEQ ID NO: 973201 - RNA, 19 nt, Homo sapiens
aaugcuuuucccacucuca

SEQ ID NO: 973202 - RNA, 22 nt, Homo sapiens
aauggagaauuaaaaauaccaa

SEQ ID NO: 973203 - RNA, 19 nt, Homo sapiens
aauggcacgcuccugccua

SEQ ID NO: 973204 - RNA, 22 nt, Homo sapiens
aauggcauuuagcacaguauuu

SEQ ID NO: 973205 - RNA, 16 nt, Homo sapiens
aauggcccuguagcuc

SEQ ID NO: 973206 - RNA, 16 nt, Homo sapiens
aauggcuuguucauca

SEQ ID NO: 973207 - RNA, 20 nt, Homo sapiens
aauggcuuguucaucaucca

SEQ ID NO: 973208 - RNA, 23 nt, Homo sapiens
aauggucucagccuaggcccuca

SEQ ID NO: 973209 - RNA, 17 nt, Homo sapiens
aauguaagagaaauuaa

SEQ ID NO: 973210 - RNA, 21 nt, Homo sapiens
aaugucacaauuaugugcaaa

SEQ ID NO: 973211 - RNA, 17 nt, Homo sapiens
aaugucagaacagagug

SEQ ID NO: 973212 - RNA, 12 nt, Homo sapiens
aaugucaugauu

SEQ ID NO: 973213 - RNA, 14 nt, Homo sapiens
aaugucucauguca

SEQ ID NO: 973214 - RNA, 23 nt, Homo sapiens
aaugugauucaccucuucuuucc

SEQ ID NO: 973215 - RNA, 19 nt, Homo sapiens
aauguuaaggaaacucuua

SEQ ID NO: 973216 - RNA, 21 nt, Homo sapiens
aauguuuauuaaaugcuucau

SEQ ID NO: 973217 - RNA, 17 nt, Homo sapiens
aauguuuucaaaaccaa

SEQ ID NO: 973218 - RNA, 22 nt, Homo sapiens
aauguuuucuagucacuuccuc

SEQ ID NO: 973219 - RNA, 21 nt, Homo sapiens
aauguuuuucccuccccagaa

SEQ ID NO: 973220 - RNA, 12 nt, Homo sapiens
aauuaagcauuu

SEQ ID NO: 973221 - RNA, 21 nt, Homo sapiens
aauuacuggcaaaaacaaaac

SEQ ID NO: 973222 - RNA, 14 nt, Homo sapiens
aauuaucaagcuuu

SEQ ID NO: 973223 - RNA, 13 nt, Homo sapiens
aauuaugugcaaa

SEQ ID NO: 973224 - RNA, 18 nt, Homo sapiens
aauuauuugaagauuuaa

SEQ ID NO: 973225 - RNA, 18 nt, Homo sapiens
aauucaaaaagaacuaaa

SEQ ID NO: 973226 - RNA, 13 nt, Homo sapiens
aauucaacuuugu

SEQ ID NO: 973227 - RNA, 20 nt, Homo sapiens
aauucaagugacacauuaau

SEQ ID NO: 973228 - RNA, 16 nt, Homo sapiens
aauucaauccuacuuu

SEQ ID NO: 973229 - RNA, 18 nt, Homo sapiens
aauucaguaacaaagguu

SEQ ID NO: 973230 - RNA, 17 nt, Homo sapiens
aauucccaccacuaaaa

SEQ ID NO: 973231 - RNA, 15 nt, Homo sapiens
aauucucuagauuua

SEQ ID NO: 973232 - RNA, 19 nt, Homo sapiens
aauucuuccuaaugucaga

SEQ ID NO: 973233 - RNA, 15 nt, Homo sapiens
aauugaagcaaguga

SEQ ID NO: 973234 - RNA, 23 nt, Homo sapiens
aauugaguugcacuuauugacca

SEQ ID NO: 973235 - RNA, 14 nt, Homo sapiens
aauugcucuuucac

SEQ ID NO: 973236 - RNA, 17 nt, Homo sapiens
aauuggcaucauucucc

SEQ ID NO: 973237 - RNA, 23 nt, Homo sapiens
aauugguaaaaacagcagcucau

SEQ ID NO: 973238 - RNA, 22 nt, Homo sapiens
aauugguaaaacucacugugau

SEQ ID NO: 973239 - RNA, 16 nt, Homo sapiens
aauuguuuucaaucua

SEQ ID NO: 973240 - RNA, 13 nt, Homo sapiens
aauuuaauaccag

SEQ ID NO: 973241 - RNA, 19 nt, Homo sapiens
aauuuagacaaagccuuaa

SEQ ID NO: 973242 - RNA, 20 nt, Homo sapiens
aauuucauagcuguacuucu

SEQ ID NO: 973243 - RNA, 21 nt, Homo sapiens
aauuuccuuuuugacacugaa

SEQ ID NO: 973244 - RNA, 22 nt, Homo sapiens
aauuucuccaguggauucccag

SEQ ID NO: 973245 - RNA, 19 nt, Homo sapiens
aauuucuccucccuuccuu

SEQ ID NO: 973246 - RNA, 11 nt, Homo sapiens
aauuugaacug

SEQ ID NO: 973247 - RNA, 17 nt, Homo sapiens
aauuugaugauuuucau

SEQ ID NO: 973248 - RNA, 14 nt, Homo sapiens
aauuuguguucuca

SEQ ID NO: 973249 - RNA, 17 nt, Homo sapiens
aauuuuaaaaaagggag

SEQ ID NO: 973250 - RNA, 15 nt, Homo sapiens
aauuuugaguauucc

SEQ ID NO: 973251 - RNA, 14 nt, Homo sapiens
aauuuuuaccuguu

SEQ ID NO: 973252 - RNA, 13 nt, Homo sapiens
acaaaaauuagcu

SEQ ID NO: 973253 - RNA, 22 nt, Homo sapiens
acaaaauaacucuccaguaaca

SEQ ID NO: 973254 - RNA, 12 nt, Homo sapiens
acaaacugcaca

SEQ ID NO: 973255 - RNA, 12 nt, Homo sapiens
acaaagaagcua

SEQ ID NO: 973256 - RNA, 18 nt, Homo sapiens
acaaauaaacucauuuaa

SEQ ID NO: 973257 - RNA, 18 nt, Homo sapiens
acaaaucugccaaaauau

SEQ ID NO: 973258 - RNA, 20 nt, Homo sapiens
acaaauguauauuuuugcaa

SEQ ID NO: 973259 - RNA, 20 nt, Homo sapiens
acaaauuuuucaaaucauuc

SEQ ID NO: 973260 - RNA, 21 nt, Homo sapiens
acaaauuuuucaaaucauucc

SEQ ID NO: 973261 - RNA, 10 nt, Homo sapiens
acaacccagg

SEQ ID NO: 973262 - RNA, 12 nt, Homo sapiens
acaacuaccuga

SEQ ID NO: 973263 - RNA, 21 nt, Homo sapiens
acaagcagcuggugcuccaag

SEQ ID NO: 973264 - RNA, 11 nt, Homo sapiens
acaagcauuuu

SEQ ID NO: 973265 - RNA, 19 nt, Homo sapiens
acaagugcuguugggauau

SEQ ID NO: 973266 - RNA, 20 nt, Homo sapiens
acaagugguguuuauugcaa

SEQ ID NO: 973267 - RNA, 21 nt, Homo sapiens
acaagugguguuuauugcaau

SEQ ID NO: 973268 - RNA, 13 nt, Homo sapiens
acaauaguauaca

SEQ ID NO: 973269 - RNA, 23 nt, Homo sapiens
acaauccuucuauucuagccugc

SEQ ID NO: 973270 - RNA, 15 nt, Homo sapiens
acaauggaguauucu

SEQ ID NO: 973271 - RNA, 23 nt, Homo sapiens
acaauugguaaaacucacuguga

SEQ ID NO: 973272 - RNA, 15 nt, Homo sapiens
acaauuuaugaauug

SEQ ID NO: 973273 - RNA, 16 nt, Homo sapiens
acacacacgaugcauu

SEQ ID NO: 973274 - RNA, 14 nt, Homo sapiens
acacacacucugaa

SEQ ID NO: 973275 - RNA, 15 nt, Homo sapiens
acacacagccuagca

SEQ ID NO: 973276 - RNA, 17 nt, Homo sapiens
acacaucaggaguucaa

SEQ ID NO: 973277 - RNA, 17 nt, Homo sapiens
acacauugaaacuguau

SEQ ID NO: 973278 - RNA, 11 nt, Homo sapiens
acaccaaccag

SEQ ID NO: 973279 - RNA, 22 nt, Homo sapiens
acaccacuuucccacacuguga

SEQ ID NO: 973280 - RNA, 20 nt, Homo sapiens
acacccuucucccacucucc

SEQ ID NO: 973281 - RNA, 14 nt, Homo sapiens
acaccuauugcacu

SEQ ID NO: 973282 - RNA, 15 nt, Homo sapiens
acaccuguaguccca

SEQ ID NO: 973283 - RNA, 15 nt, Homo sapiens
acacgaugcauuuaa

SEQ ID NO: 973284 - RNA, 21 nt, Homo sapiens
acacgcugcaccuaaagccua

SEQ ID NO: 973285 - RNA, 16 nt, Homo sapiens
acacguggguauuuaa

SEQ ID NO: 973286 - RNA, 15 nt, Homo sapiens
acacguguccuguag

SEQ ID NO: 973287 - RNA, 14 nt, Homo sapiens
acacugaagccaca

SEQ ID NO: 973288 - RNA, 13 nt, Homo sapiens
acacugauacacu

SEQ ID NO: 973289 - RNA, 16 nt, Homo sapiens
acacuggagccaucuc

SEQ ID NO: 973290 - RNA, 19 nt, Homo sapiens
acacugggugcgucuccag

SEQ ID NO: 973291 - RNA, 21 nt, Homo sapiens
agaggcugccccucucaccaa

SEQ ID NO: 973292 - RNA, 15 nt, Homo sapiens
agagggaggucacug

SEQ ID NO: 973293 - RNA, 21 nt, Homo sapiens
agagggcgugggcgcuugcac

SEQ ID NO: 973294 - RNA, 21 nt, Homo sapiens
agagucagcucucugcccugu

SEQ ID NO: 973295 - RNA, 21 nt, Homo sapiens
agagucuaggcuaagcacuuu

SEQ ID NO: 973296 - RNA, 21 nt, Homo sapiens
agagucuucuuugugccugag

SEQ ID NO: 973297 - RNA, 11 nt, Homo sapiens
agagugguggg

SEQ ID NO: 973298 - RNA, 17 nt, Homo sapiens
agaguguagacuguggc

SEQ ID NO: 973299 - RNA, 15 nt, Homo sapiens
agaguuaaaucucaa

SEQ ID NO: 973300 - RNA, 14 nt, Homo sapiens
agaguuccuucuca

SEQ ID NO: 973301 - RNA, 13 nt, Homo sapiens
agauaauuggcaa

SEQ ID NO: 973302 - RNA, 21 nt, Homo sapiens
agauacaugguugugaccuga

SEQ ID NO: 973303 - RNA, 15 nt, Homo sapiens
agauacauguugccu

SEQ ID NO: 973304 - RNA, 19 nt, Homo sapiens
agauauugugaaguacaua

SEQ ID NO: 973305 - RNA, 19 nt, Homo sapiens
agaucacuacucagugcau

SEQ ID NO: 973306 - RNA, 10 nt, Homo sapiens
agaucacugc

SEQ ID NO: 973307 - RNA, 17 nt, Homo sapiens
agauccgagugugauuu

SEQ ID NO: 973308 - RNA, 20 nt, Homo sapiens
agaucgagaccauccuggcu

SEQ ID NO: 973309 - RNA, 11 nt, Homo sapiens
agaucuuucaa

SEQ ID NO: 973310 - RNA, 17 nt, Homo sapiens
agaugagugauccugcc

SEQ ID NO: 973311 - RNA, 23 nt, Homo sapiens
agaugcuggacacccucuuccca

SEQ ID NO: 973312 - RNA, 15 nt, Homo sapiens
agaugcuguugugaa

SEQ ID NO: 973313 - RNA, 22 nt, Homo sapiens
agauggacacgagccacaagcu

SEQ ID NO: 973314 - RNA, 12 nt, Homo sapiens
agauggaguucu

SEQ ID NO: 973315 - RNA, 23 nt, Homo sapiens
agaugguucccaauaucauguga

SEQ ID NO: 973316 - RNA, 18 nt, Homo sapiens
agauguggaacaacagca

SEQ ID NO: 973317 - RNA, 17 nt, Homo sapiens
agauguggcuacugaca

SEQ ID NO: 973318 - RNA, 15 nt, Homo sapiens
agauguuugccucau

SEQ ID NO: 973319 - RNA, 14 nt, Homo sapiens
agauuaauuacucu

SEQ ID NO: 973320 - RNA, 16 nt, Homo sapiens
agauuccccuguguca

SEQ ID NO: 973321 - RNA, 17 nt, Homo sapiens
agauugcaccacugcuc

SEQ ID NO: 973322 - RNA, 21 nt, Homo sapiens
agauuuaagugaauacauuaa

SEQ ID NO: 973323 - RNA, 16 nt, Homo sapiens
agauuuacuaaaucaa

SEQ ID NO: 973324 - RNA, 12 nt, Homo sapiens
agauuuauuagu

SEQ ID NO: 973325 - RNA, 17 nt, Homo sapiens
agauuucccuauuguga

SEQ ID NO: 973326 - RNA, 17 nt, Homo sapiens
agauuugaugggccaca

SEQ ID NO: 973327 - RNA, 13 nt, Homo sapiens
agauuuuccauug

SEQ ID NO: 973328 - RNA, 22 nt, Homo sapiens
agauuuugaaugcuuccugaca

SEQ ID NO: 973329 - RNA, 14 nt, Homo sapiens
agcaacucagagaa

SEQ ID NO: 973330 - RNA, 20 nt, Homo sapiens
agcaacuucuucuccauccc

SEQ ID NO: 973331 - RNA, 20 nt, Homo sapiens
agcaagggcaagaacccaag

SEQ ID NO: 973332 - RNA, 17 nt, Homo sapiens
agcaauagggugcaguu

SEQ ID NO: 973333 - RNA, 23 nt, Homo sapiens
agcaauaggguggcacagaagcu

SEQ ID NO: 973334 - RNA, 23 nt, Homo sapiens
agcaauuuagacaaagccuuaag

SEQ ID NO: 973335 - RNA, 14 nt, Homo sapiens
agcacaauuugcac

SEQ ID NO: 973336 - RNA, 11 nt, Homo sapiens
agcacacucuu

SEQ ID NO: 973337 - RNA, 13 nt, Homo sapiens
agcacacucuucu

SEQ ID NO: 973338 - RNA, 14 nt, Homo sapiens
agcacagauguucc

SEQ ID NO: 973339 - RNA, 14 nt, Homo sapiens
agcacaguauuuaa

SEQ ID NO: 973340 - RNA, 14 nt, Homo sapiens
agcacuggguguga

SEQ ID NO: 973341 - RNA, 11 nt, Homo sapiens
agcacuuuauc

SEQ ID NO: 973342 - RNA, 21 nt, Homo sapiens
agcagauuuaagauauguaac

SEQ ID NO: 973343 - RNA, 18 nt, Homo sapiens
agcagccaguucaaaaac

SEQ ID NO: 973344 - RNA, 21 nt, Homo sapiens
agcagccucaucccaggcagu

SEQ ID NO: 973345 - RNA, 21 nt, Homo sapiens
agcagcugugcauugacauca

SEQ ID NO: 973346 - RNA, 16 nt, Homo sapiens
agcaggagccagccaa

SEQ ID NO: 973347 - RNA, 14 nt, Homo sapiens
agcaggcacgggug

SEQ ID NO: 973348 - RNA, 12 nt, Homo sapiens
agcaggccacug

SEQ ID NO: 973349 - RNA, 17 nt, Homo sapiens
agcaguugggaaguuac

SEQ ID NO: 973350 - RNA, 15 nt, Homo sapiens
agcauagaaaccacu

SEQ ID NO: 973351 - RNA, 23 nt, Homo sapiens
agcauuuugaaacaaaguacucu

SEQ ID NO: 973352 - RNA, 20 nt, Homo sapiens
agccaagauugcaccacugc

SEQ ID NO: 973353 - RNA, 17 nt, Homo sapiens
agccacaagcugcacug

SEQ ID NO: 973354 - RNA, 14 nt, Homo sapiens
agccagcucccagc

SEQ ID NO: 973355 - RNA, 22 nt, Homo sapiens
agccagcuuacuagcacuuuga

SEQ ID NO: 973356 - RNA, 15 nt, Homo sapiens
agccaggaccugcug

SEQ ID NO: 973357 - RNA, 20 nt, Homo sapiens
agccaguacagagaaauucu

SEQ ID NO: 973358 - RNA, 22 nt, Homo sapiens
agccauaugcccucaucauccc

SEQ ID NO: 973359 - RNA, 11 nt, Homo sapiens
agccauccagg

SEQ ID NO: 973360 - RNA, 13 nt, Homo sapiens
agccaugccagcu

SEQ ID NO: 973361 - RNA, 11 nt, Homo sapiens
agccaugccug

SEQ ID NO: 973362 - RNA, 16 nt, Homo sapiens
agccaugccugagguc

SEQ ID NO: 973363 - RNA, 16 nt, Homo sapiens
agcccagagacuuugu

SEQ ID NO: 973364 - RNA, 19 nt, Homo sapiens
agcccaggauacuggcaca

SEQ ID NO: 973365 - RNA, 17 nt, Homo sapiens
agcccauaucacuaaga

SEQ ID NO: 973366 - RNA, 22 nt, Homo sapiens
agcccauggagauugaccugga

SEQ ID NO: 973367 - RNA, 16 nt, Homo sapiens
agccccaggggacaag

SEQ ID NO: 973368 - RNA, 16 nt, Homo sapiens
agccccauguguaccu

SEQ ID NO: 973369 - RNA, 15 nt, Homo sapiens
agcccccacuccagu

SEQ ID NO: 973370 - RNA, 14 nt, Homo sapiens
agccccucaugccu

SEQ ID NO: 973371 - RNA, 17 nt, Homo sapiens
agcccugcucauuccuc

SEQ ID NO: 973372 - RNA, 23 nt, Homo sapiens
agcccugugcagcagcuucccuu

SEQ ID NO: 973373 - RNA, 21 nt, Homo sapiens
agcccuugcacagcuggagaa

SEQ ID NO: 973374 - RNA, 16 nt, Homo sapiens
agccuauuuuuuuaga

SEQ ID NO: 973375 - RNA, 18 nt, Homo sapiens
agccucagcggacaagca

SEQ ID NO: 973376 - RNA, 22 nt, Homo sapiens
agccuccacagcgagggcagcu

SEQ ID NO: 973377 - RNA, 15 nt, Homo sapiens
agccuccccgugcca

SEQ ID NO: 973378 - RNA, 17 nt, Homo sapiens
agccuccccgugccaaa

SEQ ID NO: 973379 - RNA, 19 nt, Homo sapiens
agccuccccgugccaaaaa

SEQ ID NO: 973380 - RNA, 20 nt, Homo sapiens
agccucccugaagaccaaaa

SEQ ID NO: 973381 - RNA, 17 nt, Homo sapiens
agccugaacagaagcuc

SEQ ID NO: 973382 - RNA, 20 nt, Homo sapiens
agccugaauuggcuaugcag

SEQ ID NO: 973383 - RNA, 21 nt, Homo sapiens
agccugaauuggcuaugcagu

SEQ ID NO: 973384 - RNA, 21 nt, Homo sapiens
agccugagcaaaaagaccagc

SEQ ID NO: 973385 - RNA, 18 nt, Homo sapiens
agccugcucuaaggcagu

SEQ ID NO: 973386 - RNA, 12 nt, Homo sapiens
agccuuacaaac

SEQ ID NO: 973387 - RNA, 18 nt, Homo sapiens
agccuugcaucaagggcu

SEQ ID NO: 973388 - RNA, 13 nt, Homo sapiens
agcgaagaccagu

SEQ ID NO: 973389 - RNA, 16 nt, Homo sapiens
agcgagcugcucugcu

SEQ ID NO: 973390 - RNA, 21 nt, Homo sapiens
agcgaucucuccacugugcuu

SEQ ID NO: 973391 - RNA, 16 nt, Homo sapiens
agcggugccacugagg

SEQ ID NO: 973392 - RNA, 15 nt, Homo sapiens
agcuaaagaggcuga

SEQ ID NO: 973393 - RNA, 14 nt, Homo sapiens
agcuaagauauaau

SEQ ID NO: 973394 - RNA, 20 nt, Homo sapiens
agcuaauuguacuaaucuga

SEQ ID NO: 973395 - RNA, 13 nt, Homo sapiens
agcuaccaggugu

SEQ ID NO: 973396 - RNA, 23 nt, Homo sapiens
agcuaccagguguucuacacuca

SEQ ID NO: 973397 - RNA, 18 nt, Homo sapiens
agcuacggguaggucuau

SEQ ID NO: 973398 - RNA, 17 nt, Homo sapiens
agcuacuguagaaacaa

SEQ ID NO: 973399 - RNA, 15 nt, Homo sapiens
agcuauggugcuugc

SEQ ID NO: 973400 - RNA, 22 nt, Homo sapiens
agcuauguugacaugaggcagu

SEQ ID NO: 973401 - RNA, 15 nt, Homo sapiens
agcuauucaccucag

SEQ ID NO: 973402 - RNA, 15 nt, Homo sapiens
agcucccagccacau

SEQ ID NO: 973403 - RNA, 20 nt, Homo sapiens
agcucccagcugaccagaca

SEQ ID NO: 973404 - RNA, 12 nt, Homo sapiens
agcuccuggaau

SEQ ID NO: 973405 - RNA, 12 nt, Homo sapiens
agcucuccuuag

SEQ ID NO: 973406 - RNA, 20 nt, Homo sapiens
aucucuaccugggugugccc

SEQ ID NO: 973407 - RNA, 15 nt, Homo sapiens
aucucuacuaaaaau

SEQ ID NO: 973408 - RNA, 22 nt, Homo sapiens
aucucugggaguuauaggucau

SEQ ID NO: 973409 - RNA, 15 nt, Homo sapiens
aucucuucacuaccc

SEQ ID NO: 973410 - RNA, 15 nt, Homo sapiens
aucucuuccccagag

SEQ ID NO: 973411 - RNA, 21 nt, Homo sapiens
aucugccuuaaaaccaaagag

SEQ ID NO: 973412 - RNA, 22 nt, Homo sapiens
aucugucccccuuuagaucucu

SEQ ID NO: 973413 - RNA, 13 nt, Homo sapiens
aucuuaacaaagc

SEQ ID NO: 973414 - RNA, 19 nt, Homo sapiens
aucuuagaagcacuacacc

SEQ ID NO: 973415 - RNA, 15 nt, Homo sapiens
aucuuauuuucucaa

SEQ ID NO: 973416 - RNA, 15 nt, Homo sapiens
aucuuccccggaugu

SEQ ID NO: 973417 - RNA, 16 nt, Homo sapiens
aucuuccuccuuguga

SEQ ID NO: 973418 - RNA, 14 nt, Homo sapiens
aucuuccugugucc

SEQ ID NO: 973419 - RNA, 15 nt, Homo sapiens
aucuucucauuccca

SEQ ID NO: 973420 - RNA, 20 nt, Homo sapiens
augaaagugcuucauugacu

SEQ ID NO: 973421 - RNA, 17 nt, Homo sapiens
augaacauauuguugaa

SEQ ID NO: 973422 - RNA, 23 nt, Homo sapiens
augaaccccccgcccaugcuguc

SEQ ID NO: 973423 - RNA, 21 nt, Homo sapiens
augaagggacccuuugggggu

SEQ ID NO: 973424 - RNA, 22 nt, Homo sapiens
augaaggggcucuucaucugcc

SEQ ID NO: 973425 - RNA, 19 nt, Homo sapiens
augacccaggccuggccag

SEQ ID NO: 973426 - RNA, 22 nt, Homo sapiens
augacgguaaguguucucauga

SEQ ID NO: 973427 - RNA, 16 nt, Homo sapiens
augacugccuugccuc

SEQ ID NO: 973428 - RNA, 13 nt, Homo sapiens
augagacauuagg

SEQ ID NO: 973429 - RNA, 16 nt, Homo sapiens
augagcgccaccucuu

SEQ ID NO: 973430 - RNA, 22 nt, Homo sapiens
augagcugaucugcggaucuca

SEQ ID NO: 973431 - RNA, 18 nt, Homo sapiens
augaggaaggacuugacu

SEQ ID NO: 973432 - RNA, 19 nt, Homo sapiens
augaguaaacugagacuua

SEQ ID NO: 973433 - RNA, 21 nt, Homo sapiens
augaguagauaauuucagggu

SEQ ID NO: 973434 - RNA, 15 nt, Homo sapiens
augaucagacauaca

SEQ ID NO: 973435 - RNA, 16 nt, Homo sapiens
augauugugugacuau

SEQ ID NO: 973436 - RNA, 18 nt, Homo sapiens
augauuuagggaagcagg

SEQ ID NO: 973437 - RNA, 19 nt, Homo sapiens
augcaaaugagcucugaaa

SEQ ID NO: 973438 - RNA, 21 nt, Homo sapiens
augcaauauauguucauaucu

SEQ ID NO: 973439 - RNA, 18 nt, Homo sapiens
augcacaaaucugccaaa

SEQ ID NO: 973440 - RNA, 18 nt, Homo sapiens
augcagugauauggcaga

SEQ ID NO: 973441 - RNA, 15 nt, Homo sapiens
augcaguucugagca

SEQ ID NO: 973442 - RNA, 18 nt, Homo sapiens
augcauauccugagccau

SEQ ID NO: 973443 - RNA, 17 nt, Homo sapiens
augcauguuuccugcuc

SEQ ID NO: 973444 - RNA, 18 nt, Homo sapiens
augcauguuuccugcucu

SEQ ID NO: 973445 - RNA, 12 nt, Homo sapiens
augcauuauuaa

SEQ ID NO: 973446 - RNA, 21 nt, Homo sapiens
augccaaacaggaacaaucca

SEQ ID NO: 973447 - RNA, 17 nt, Homo sapiens
augccaagucccuggaa

SEQ ID NO: 973448 - RNA, 17 nt, Homo sapiens
augcccucaucauccca

SEQ ID NO: 973449 - RNA, 17 nt, Homo sapiens
augccucagucuauucu

SEQ ID NO: 973450 - RNA, 14 nt, Homo sapiens
augccugcuugaua

SEQ ID NO: 973451 - RNA, 18 nt, Homo sapiens
augcuauuguugcaauau

SEQ ID NO: 973452 - RNA, 20 nt, Homo sapiens
augcucaggagccaccagca

SEQ ID NO: 973453 - RNA, 19 nt, Homo sapiens
augcuggacacccucuucc

SEQ ID NO: 973454 - RNA, 15 nt, Homo sapiens
augcugggcaaugag

SEQ ID NO: 973455 - RNA, 13 nt, Homo sapiens
augcuguugugaa

SEQ ID NO: 973456 - RNA, 19 nt, Homo sapiens
augcuuagucccucaugca

SEQ ID NO: 973457 - RNA, 12 nt, Homo sapiens
augcuuucccac

SEQ ID NO: 973458 - RNA, 15 nt, Homo sapiens
auggaaaacuguguu

SEQ ID NO: 973459 - RNA, 15 nt, Homo sapiens
auggaacucagagau

SEQ ID NO: 973460 - RNA, 15 nt, Homo sapiens
auggaauaaaccauu

SEQ ID NO: 973461 - RNA, 15 nt, Homo sapiens
auggaauacagucau

SEQ ID NO: 973462 - RNA, 21 nt, Homo sapiens
auggacuggccccugacccag

SEQ ID NO: 973463 - RNA, 14 nt, Homo sapiens
auggcaauuggcau

SEQ ID NO: 973464 - RNA, 16 nt, Homo sapiens
auggcauuuggucuca

SEQ ID NO: 973465 - RNA, 19 nt, Homo sapiens
auggcauuuggucucaggc

SEQ ID NO: 973466 - RNA, 23 nt, Homo sapiens
auggcauuuggucucaggcagca

SEQ ID NO: 973467 - RNA, 13 nt, Homo sapiens
auggcgucugcuc

SEQ ID NO: 973468 - RNA, 21 nt, Homo sapiens
auggcugaguaauaguccaug

SEQ ID NO: 973469 - RNA, 16 nt, Homo sapiens
auggcuuaagcaauaa

SEQ ID NO: 973470 - RNA, 15 nt, Homo sapiens
auggcuuugugauuc

SEQ ID NO: 973471 - RNA, 16 nt, Homo sapiens
augggaaguccuggca

SEQ ID NO: 973472 - RNA, 19 nt, Homo sapiens
auggguaugcucaggucaa

SEQ ID NO: 973473 - RNA, 14 nt, Homo sapiens
augggucuaggaca

SEQ ID NO: 973474 - RNA, 14 nt, Homo sapiens
augguagaacuaaa

SEQ ID NO: 973475 - RNA, 15 nt, Homo sapiens
auggugcacugagcu

SEQ ID NO: 973476 - RNA, 15 nt, Homo sapiens
auggugccuggagcu

SEQ ID NO: 973477 - RNA, 20 nt, Homo sapiens
auggugcucacgacucuucc

SEQ ID NO: 973478 - RNA, 13 nt, Homo sapiens
auggugcuuaaaa

SEQ ID NO: 973479 - RNA, 17 nt, Homo sapiens
augguguggguguccug

SEQ ID NO: 973480 - RNA, 22 nt, Homo sapiens
augguucccaauaucaugugau

SEQ ID NO: 973481 - RNA, 21 nt, Homo sapiens
augguugcacaaaaccacuuu

SEQ ID NO: 973482 - RNA, 17 nt, Homo sapiens
auguaauuauauauacu

SEQ ID NO: 973483 - RNA, 18 nt, Homo sapiens
auguacuaaaucuaauca

SEQ ID NO: 973484 - RNA, 16 nt, Homo sapiens
auguauguaaauagcu

SEQ ID NO: 973485 - RNA, 17 nt, Homo sapiens
auguauguguaccuaag

SEQ ID NO: 973486 - RNA, 16 nt, Homo sapiens
augucagaacagagug

SEQ ID NO: 973487 - RNA, 14 nt, Homo sapiens
auguccaccaugaa

SEQ ID NO: 973488 - RNA, 21 nt, Homo sapiens
auguccaccaugaacuugaua

SEQ ID NO: 973489 - RNA, 18 nt, Homo sapiens
augucuguagcuccucaa

SEQ ID NO: 973490 - RNA, 19 nt, Homo sapiens
augucuguucuacauagau

SEQ ID NO: 973491 - RNA, 12 nt, Homo sapiens
augucuucccac

SEQ ID NO: 973492 - RNA, 18 nt, Homo sapiens
augugaauuauugacacu

SEQ ID NO: 973493 - RNA, 19 nt, Homo sapiens
augugagcucuuccuaucc

SEQ ID NO: 973494 - RNA, 17 nt, Homo sapiens
augugagcuguaaaaau

SEQ ID NO: 973495 - RNA, 21 nt, Homo sapiens
augugauggacacuccaggga

SEQ ID NO: 973496 - RNA, 16 nt, Homo sapiens
auguggaacaacagca

SEQ ID NO: 973497 - RNA, 22 nt, Homo sapiens
auguggaacaggaugcccacau

SEQ ID NO: 973498 - RNA, 16 nt, Homo sapiens
auguggccacaaucca

SEQ ID NO: 973499 - RNA, 21 nt, Homo sapiens
auguggucuaagguucagccu

SEQ ID NO: 973500 - RNA, 16 nt, Homo sapiens
auguguaccuaaggga

SEQ ID NO: 973501 - RNA, 21 nt, Homo sapiens
auguguuccauugccauagcu

SEQ ID NO: 973502 - RNA, 13 nt, Homo sapiens
auguucuccauuu

SEQ ID NO: 973503 - RNA, 17 nt, Homo sapiens
auguucugucaaaugug

SEQ ID NO: 973504 - RNA, 20 nt, Homo sapiens
auguuggucugacaucaagg

SEQ ID NO: 973505 - RNA, 14 nt, Homo sapiens
auguuuccugcucu

SEQ ID NO: 973506 - RNA, 20 nt, Homo sapiens
auguuuuaaaauacucucau

SEQ ID NO: 973507 - RNA, 18 nt, Homo sapiens
auuaaaauuccaaauuca

SEQ ID NO: 973508 - RNA, 13 nt, Homo sapiens
auuaaccuaauca

SEQ ID NO: 973509 - RNA, 16 nt, Homo sapiens
auuaauaaauuuucca

SEQ ID NO: 973510 - RNA, 18 nt, Homo sapiens
auuaaugauaaacucaga

SEQ ID NO: 973511 - RNA, 19 nt, Homo sapiens
auuaaugauaaacucagau

SEQ ID NO: 973512 - RNA, 17 nt, Homo sapiens
auuacauggcugugguu

SEQ ID NO: 973513 - RNA, 21 nt, Homo sapiens
auuaccaaccuguuaccuacu

SEQ ID NO: 973514 - RNA, 15 nt, Homo sapiens
auuacugguccaaaa

SEQ ID NO: 973515 - RNA, 15 nt, Homo sapiens
auuagagaguggcaa

SEQ ID NO: 973516 - RNA, 18 nt, Homo sapiens
auuaguugggcauggugg

SEQ ID NO: 973517 - RNA, 15 nt, Homo sapiens
auuaguuuguggcua

SEQ ID NO: 973518 - RNA, 14 nt, Homo sapiens
auuaucaagcuuuu

SEQ ID NO: 973519 - RNA, 19 nt, Homo sapiens
auuaucacauuaaucucaa

SEQ ID NO: 973520 - RNA, 21 nt, Homo sapiens
auuauggaaaacuguguugcc

SEQ ID NO: 973521 - RNA, 18 nt, Homo sapiens
cagccccggcaagccaca

SEQ ID NO: 973522 - RNA, 16 nt, Homo sapiens
cagccccuccaaaggu

SEQ ID NO: 973523 - RNA, 20 nt, Homo sapiens
cagcccugaccccaguguac

SEQ ID NO: 973524 - RNA, 14 nt, Homo sapiens
cagccuacauucac

SEQ ID NO: 973525 - RNA, 14 nt, Homo sapiens
cagccucaucccag

SEQ ID NO: 973526 - RNA, 16 nt, Homo sapiens
cagccuccccgugcca

SEQ ID NO: 973527 - RNA, 17 nt, Homo sapiens
cagccuccccgugccaa

SEQ ID NO: 973528 - RNA, 15 nt, Homo sapiens
cagccucccuuugau

SEQ ID NO: 973529 - RNA, 17 nt, Homo sapiens
cagccucccuuugauga

SEQ ID NO: 973530 - RNA, 16 nt, Homo sapiens
cagccuucuccaggac

SEQ ID NO: 973531 - RNA, 18 nt, Homo sapiens
cagcgacugccacaucau

SEQ ID NO: 973532 - RNA, 15 nt, Homo sapiens
cagcgccagccucag

SEQ ID NO: 973533 - RNA, 12 nt, Homo sapiens
cagcuccagugc

SEQ ID NO: 973534 - RNA, 16 nt, Homo sapiens
cagcucccagccacau

SEQ ID NO: 973535 - RNA, 12 nt, Homo sapiens
cagcucuucaga

SEQ ID NO: 973536 - RNA, 19 nt, Homo sapiens
cagcugaccagacacugcc

SEQ ID NO: 973537 - RNA, 22 nt, Homo sapiens
cagcuggagaaaaaacauugcc

SEQ ID NO: 973538 - RNA, 22 nt, Homo sapiens
cagcuggagaaauggcaucauu

SEQ ID NO: 973539 - RNA, 19 nt, Homo sapiens
cagcuucaacuuuucucuu

SEQ ID NO: 973540 - RNA, 23 nt, Homo sapiens
caggaaaaguugaugguauucau

SEQ ID NO: 973541 - RNA, 12 nt, Homo sapiens
caggaaauuacu

SEQ ID NO: 973542 - RNA, 18 nt, Homo sapiens
caggaagagcugacccau

SEQ ID NO: 973543 - RNA, 16 nt, Homo sapiens
caggaaggucuucaau

SEQ ID NO: 973544 - RNA, 18 nt, Homo sapiens
caggaccacagagcuccu

SEQ ID NO: 973545 - RNA, 19 nt, Homo sapiens
caggacucugacgucucuu

SEQ ID NO: 973546 - RNA, 14 nt, Homo sapiens
caggagaacaugcu

SEQ ID NO: 973547 - RNA, 20 nt, Homo sapiens
caggagaacaugcuggugaa

SEQ ID NO: 973548 - RNA, 17 nt, Homo sapiens
caggauuuaaguuucac

SEQ ID NO: 973549 - RNA, 17 nt, Homo sapiens
caggcauagaggcuucu

SEQ ID NO: 973550 - RNA, 16 nt, Homo sapiens
caggccacaccacagc

SEQ ID NO: 973551 - RNA, 18 nt, Homo sapiens
caggccacccaaaggagc

SEQ ID NO: 973552 - RNA, 14 nt, Homo sapiens
caggccacugggga

SEQ ID NO: 973553 - RNA, 17 nt, Homo sapiens
caggccacuggggacag

SEQ ID NO: 973554 - RNA, 16 nt, Homo sapiens
caggccagcaagcucu

SEQ ID NO: 973555 - RNA, 17 nt, Homo sapiens
caggccagugaccucau

SEQ ID NO: 973556 - RNA, 12 nt, Homo sapiens
caggcccauuca

SEQ ID NO: 973557 - RNA, 15 nt, Homo sapiens
caggccccuccaguu

SEQ ID NO: 973558 - RNA, 19 nt, Homo sapiens
caggccuugggcuccugau

SEQ ID NO: 973559 - RNA, 19 nt, Homo sapiens
caggcgcugcccaccugcc

SEQ ID NO: 973560 - RNA, 14 nt, Homo sapiens
caggcucucgcaca

SEQ ID NO: 973561 - RNA, 14 nt, Homo sapiens
caggcugggccaug

SEQ ID NO: 973562 - RNA, 22 nt, Homo sapiens
caggcugggccauguccaaaga

SEQ ID NO: 973563 - RNA, 23 nt, Homo sapiens
caggcugggccauguccaaagag

SEQ ID NO: 973564 - RNA, 19 nt, Homo sapiens
caggcuguaagcauucuga

SEQ ID NO: 973565 - RNA, 13 nt, Homo sapiens
caggcugugccaa

SEQ ID NO: 973566 - RNA, 23 nt, Homo sapiens
cagggagcaacucuccacuccau

SEQ ID NO: 973567 - RNA, 18 nt, Homo sapiens
cagggauuaggagcagcu

SEQ ID NO: 973568 - RNA, 19 nt, Homo sapiens
cagggauuaggagcagcuc

SEQ ID NO: 973569 - RNA, 16 nt, Homo sapiens
cagggcagccugucac

SEQ ID NO: 973570 - RNA, 17 nt, Homo sapiens
cagggcagccugucacc

SEQ ID NO: 973571 - RNA, 13 nt, Homo sapiens
cagggccaugcag

SEQ ID NO: 973572 - RNA, 23 nt, Homo sapiens
cagggguggggguggaggcuucc

SEQ ID NO: 973573 - RNA, 17 nt, Homo sapiens
cagggucuugcucuguc

SEQ ID NO: 973574 - RNA, 18 nt, Homo sapiens
cagggugaagcagcucau

SEQ ID NO: 973575 - RNA, 15 nt, Homo sapiens
cagggugcagcccaa

SEQ ID NO: 973576 - RNA, 15 nt, Homo sapiens
caggguuucucugca

SEQ ID NO: 973577 - RNA, 16 nt, Homo sapiens
cagguaaaacagggcc

SEQ ID NO: 973578 - RNA, 18 nt, Homo sapiens
caggucaucuaggagcaa

SEQ ID NO: 973579 - RNA, 17 nt, Homo sapiens
caggugaacugggagca

SEQ ID NO: 973580 - RNA, 20 nt, Homo sapiens
caggugcgcgccaccgugcc

SEQ ID NO: 973581 - RNA, 22 nt, Homo sapiens
caggugcgcgccaccgugccug

SEQ ID NO: 973582 - RNA, 16 nt, Homo sapiens
cagguguuacuuacag

SEQ ID NO: 973583 - RNA, 20 nt, Homo sapiens
cagguguuacuuacaguccc

SEQ ID NO: 973584 - RNA, 22 nt, Homo sapiens
cagguguucuacacucaucuua

SEQ ID NO: 973585 - RNA, 19 nt, Homo sapiens
caguaaacgggaacaugcc

SEQ ID NO: 973586 - RNA, 20 nt, Homo sapiens
caguaaacgggaacaugccc

SEQ ID NO: 973587 - RNA, 17 nt, Homo sapiens
caguaaauagugucaua

SEQ ID NO: 973588 - RNA, 20 nt, Homo sapiens
caguaaaugugauucaccuc

SEQ ID NO: 973589 - RNA, 12 nt, Homo sapiens
caguaacuguca

SEQ ID NO: 973590 - RNA, 19 nt, Homo sapiens
caguacauuguauucuguu

SEQ ID NO: 973591 - RNA, 21 nt, Homo sapiens
caguaccaaaguaacugaauu

SEQ ID NO: 973592 - RNA, 16 nt, Homo sapiens
caguaccaucuacauc

SEQ ID NO: 973593 - RNA, 14 nt, Homo sapiens
caguagaacuccag

SEQ ID NO: 973594 - RNA, 22 nt, Homo sapiens
caguauggaauuccagugccag

SEQ ID NO: 973595 - RNA, 22 nt, Homo sapiens
caguccaaccagaaacaccccu

SEQ ID NO: 973596 - RNA, 12 nt, Homo sapiens
caguccuacuca

SEQ ID NO: 973597 - RNA, 23 nt, Homo sapiens
cagucuacucuuucugcuuacaa

SEQ ID NO: 973598 - RNA, 12 nt, Homo sapiens
cagugaccucau

SEQ ID NO: 973599 - RNA, 17 nt, Homo sapiens
cagugagacugccccac

SEQ ID NO: 973600 - RNA, 21 nt, Homo sapiens
cagugauucuguuugccuuuu

SEQ ID NO: 973601 - RNA, 17 nt, Homo sapiens
cagugcauagcgaagac

SEQ ID NO: 973602 - RNA, 19 nt, Homo sapiens
cagugcauagcgaagacca

SEQ ID NO: 973603 - RNA, 22 nt, Homo sapiens
cagugccccauucucacugcua

SEQ ID NO: 973604 - RNA, 21 nt, Homo sapiens
cagugggaaacaaacugucua

SEQ ID NO: 973605 - RNA, 16 nt, Homo sapiens
cagugggaucccagac

SEQ ID NO: 973606 - RNA, 22 nt, Homo sapiens
cagugugcuccagauggugcua

SEQ ID NO: 973607 - RNA, 21 nt, Homo sapiens
caguuaaaucuccuguggagu

SEQ ID NO: 973608 - RNA, 17 nt, Homo sapiens
caguucuacacugauac

SEQ ID NO: 973609 - RNA, 22 nt, Homo sapiens
caguugcucaaaaagaaaucaa

SEQ ID NO: 973610 - RNA, 22 nt, Homo sapiens
caguuuuccagaacacucuuag

SEQ ID NO: 973611 - RNA, 14 nt, Homo sapiens
caguuuuguugccc

SEQ ID NO: 973612 - RNA, 20 nt, Homo sapiens
caguuuuuguaaagcccuug

SEQ ID NO: 973613 - RNA, 18 nt, Homo sapiens
cauaaaaaggucuuuaaa

SEQ ID NO: 973614 - RNA, 17 nt, Homo sapiens
cauaaaacccuauacaa

SEQ ID NO: 973615 - RNA, 12 nt, Homo sapiens
cauaaagcauuu

SEQ ID NO: 973616 - RNA, 18 nt, Homo sapiens
cauaaauaaaaauucaac

SEQ ID NO: 973617 - RNA, 20 nt, Homo sapiens
cauaacugaaaaugugcuau

SEQ ID NO: 973618 - RNA, 21 nt, Homo sapiens
cauaacugaaaaugugcuaua

SEQ ID NO: 973619 - RNA, 20 nt, Homo sapiens
cauaagagcuuaagaaccau

SEQ ID NO: 973620 - RNA, 18 nt, Homo sapiens
cauaagggagauuguaua

SEQ ID NO: 973621 - RNA, 16 nt, Homo sapiens
cauaaguauuaugucu

SEQ ID NO: 973622 - RNA, 19 nt, Homo sapiens
cauaaucaauauaaucuga

SEQ ID NO: 973623 - RNA, 22 nt, Homo sapiens
cauacauucccucuaauuugaa

SEQ ID NO: 973624 - RNA, 19 nt, Homo sapiens
cauacgauuugagccugaa

SEQ ID NO: 973625 - RNA, 20 nt, Homo sapiens
cauagagauagcuacagugu

SEQ ID NO: 973626 - RNA, 21 nt, Homo sapiens
cauagagucuuuauguccaua

SEQ ID NO: 973627 - RNA, 19 nt, Homo sapiens
cauaggaagggaucugaga

SEQ ID NO: 973628 - RNA, 13 nt, Homo sapiens
cauagugcacuag

SEQ ID NO: 973629 - RNA, 23 nt, Homo sapiens
cauauaacaauucaguaacaaag

SEQ ID NO: 973630 - RNA, 15 nt, Homo sapiens
cauauaugaccagaa

SEQ ID NO: 973631 - RNA, 15 nt, Homo sapiens
cauaucagaacugug

SEQ ID NO: 973632 - RNA, 23 nt, Homo sapiens
cauaucuaacuuuguaaccagaa

SEQ ID NO: 973633 - RNA, 22 nt, Homo sapiens
cauaucuacacuucgcaccgga

SEQ ID NO: 973634 - RNA, 15 nt, Homo sapiens
cauaucuaugggaaa

SEQ ID NO: 973635 - RNA, 15 nt, Homo sapiens
gcccuaccagcagcu

SEQ ID NO: 973636 - RNA, 17 nt, Homo sapiens
gcccuucaaugcugcag

SEQ ID NO: 973637 - RNA, 15 nt, Homo sapiens
gcccuucacugucac

SEQ ID NO: 973638 - RNA, 13 nt, Homo sapiens
gccgaagcuacug

SEQ ID NO: 973639 - RNA, 19 nt, Homo sapiens
gccgggugugguggcucac

SEQ ID NO: 973640 - RNA, 13 nt, Homo sapiens
gccgucugugcuu

SEQ ID NO: 973641 - RNA, 22 nt, Homo sapiens
gccguuuucuugcucaaaggga

SEQ ID NO: 973642 - RNA, 19 nt, Homo sapiens
gccuacaucccgggccuca

SEQ ID NO: 973643 - RNA, 14 nt, Homo sapiens
gccuacuccaaaau

SEQ ID NO: 973644 - RNA, 15 nt, Homo sapiens
gccuaucaaaggaaa

SEQ ID NO: 973645 - RNA, 16 nt, Homo sapiens
gccuaugcacauaugg

SEQ ID NO: 973646 - RNA, 19 nt, Homo sapiens
gccuaugcacauauggacu

SEQ ID NO: 973647 - RNA, 19 nt, Homo sapiens
gccucaccuuggggccuug

SEQ ID NO: 973648 - RNA, 20 nt, Homo sapiens
gccucagcggacaagcagcu

SEQ ID NO: 973649 - RNA, 21 nt, Homo sapiens
gccucauauuguccucugcaa

SEQ ID NO: 973650 - RNA, 17 nt, Homo sapiens
gccucaucccaggcagu

SEQ ID NO: 973651 - RNA, 16 nt, Homo sapiens
gccuccaagcacagag

SEQ ID NO: 973652 - RNA, 17 nt, Homo sapiens
gccugacaugguuguca

SEQ ID NO: 973653 - RNA, 17 nt, Homo sapiens
gccugauccauccccag

SEQ ID NO: 973654 - RNA, 23 nt, Homo sapiens
gccugauggugcucacgacucuu

SEQ ID NO: 973655 - RNA, 15 nt, Homo sapiens
gccugcaaacuggga

SEQ ID NO: 973656 - RNA, 15 nt, Homo sapiens
gccugcucugugagc

SEQ ID NO: 973657 - RNA, 15 nt, Homo sapiens
gccugcuuugaauaa

SEQ ID NO: 973658 - RNA, 15 nt, Homo sapiens
gccuggacaguaucc

SEQ ID NO: 973659 - RNA, 20 nt, Homo sapiens
gccuggagacaaggugcuaa

SEQ ID NO: 973660 - RNA, 18 nt, Homo sapiens
gccuggagcuaauggcga

SEQ ID NO: 973661 - RNA, 14 nt, Homo sapiens
gccuggagcuaccu

SEQ ID NO: 973662 - RNA, 17 nt, Homo sapiens
gccuggaguugacugac

SEQ ID NO: 973663 - RNA, 20 nt, Homo sapiens
gccuggccaacauggugaaa

SEQ ID NO: 973664 - RNA, 15 nt, Homo sapiens
gccuggccaccagcc

SEQ ID NO: 973665 - RNA, 18 nt, Homo sapiens
gccugggggcagccucuc

SEQ ID NO: 973666 - RNA, 18 nt, Homo sapiens
gccugggguggacauuca

SEQ ID NO: 973667 - RNA, 19 nt, Homo sapiens
gccuguaaucccagcacuu

SEQ ID NO: 973668 - RNA, 22 nt, Homo sapiens
gccuguaaucccagcacuuugg

SEQ ID NO: 973669 - RNA, 20 nt, Homo sapiens
gccugucugccccagcccag

SEQ ID NO: 973670 - RNA, 20 nt, Homo sapiens
gccuuaaaccuaccucccac

SEQ ID NO: 973671 - RNA, 16 nt, Homo sapiens
gccuugagcccuggcu

SEQ ID NO: 973672 - RNA, 18 nt, Homo sapiens
gccuuguaagacccuuau

SEQ ID NO: 973673 - RNA, 21 nt, Homo sapiens
gccuuugcuucuugcacccag

SEQ ID NO: 973674 - RNA, 20 nt, Homo sapiens
gccuuuuccacacgcauuaa

SEQ ID NO: 973675 - RNA, 15 nt, Homo sapiens
gccuuuuguuuucau

SEQ ID NO: 973676 - RNA, 21 nt, Homo sapiens
gccuuuuuuccugggccagaa

SEQ ID NO: 973677 - RNA, 17 nt, Homo sapiens
gcgagcugcucugcuau

SEQ ID NO: 973678 - RNA, 23 nt, Homo sapiens
gcgagcugcucugcuauaugccu

SEQ ID NO: 973679 - RNA, 13 nt, Homo sapiens
gcgaguacuggga

SEQ ID NO: 973680 - RNA, 17 nt, Homo sapiens
gcgaguucucuuuggaa

SEQ ID NO: 973681 - RNA, 22 nt, Homo sapiens
gcgcagcgcgugcggugcaaag

SEQ ID NO: 973682 - RNA, 20 nt, Homo sapiens
gcggacaagcagcuggugcu

SEQ ID NO: 973683 - RNA, 17 nt, Homo sapiens
gcggagguugcaaugag

SEQ ID NO: 973684 - RNA, 12 nt, Homo sapiens
gcggccacugcg

SEQ ID NO: 973685 - RNA, 19 nt, Homo sapiens
gcggccuccuucugagcuc

SEQ ID NO: 973686 - RNA, 15 nt, Homo sapiens
gcgggugauggccag

SEQ ID NO: 973687 - RNA, 16 nt, Homo sapiens
gcggugccaugaaggg

SEQ ID NO: 973688 - RNA, 15 nt, Homo sapiens
gcuaaaacagcuucc

SEQ ID NO: 973689 - RNA, 22 nt, Homo sapiens
gcuaagauacugaugacagugu

SEQ ID NO: 973690 - RNA, 14 nt, Homo sapiens
gcuaagcacuuuau

SEQ ID NO: 973691 - RNA, 13 nt, Homo sapiens
gcuaaugucacaa

SEQ ID NO: 973692 - RNA, 21 nt, Homo sapiens
gcuaccuguugguuagauuca

SEQ ID NO: 973693 - RNA, 22 nt, Homo sapiens
gcuacucucuugccagcauuuu

SEQ ID NO: 973694 - RNA, 13 nt, Homo sapiens
gcuacuugggagg

SEQ ID NO: 973695 - RNA, 21 nt, Homo sapiens
gcuagacuaccggacacucgu

SEQ ID NO: 973696 - RNA, 16 nt, Homo sapiens
gcuagcuuucuccuua

SEQ ID NO: 973697 - RNA, 18 nt, Homo sapiens
gcuauaugccuuaagcca

SEQ ID NO: 973698 - RNA, 20 nt, Homo sapiens
gcuaugaucagaagacuuua

SEQ ID NO: 973699 - RNA, 16 nt, Homo sapiens
gcuauuuaacauuuua

SEQ ID NO: 973700 - RNA, 11 nt, Homo sapiens
gcucaaaggga

SEQ ID NO: 973701 - RNA, 22 nt, Homo sapiens
gcucaacagaacauauguugca

SEQ ID NO: 973702 - RNA, 14 nt, Homo sapiens
gcucaacauugugu

SEQ ID NO: 973703 - RNA, 19 nt, Homo sapiens
gcucaauucaagugacaca

SEQ ID NO: 973704 - RNA, 15 nt, Homo sapiens
gcuccagauggugcu

SEQ ID NO: 973705 - RNA, 16 nt, Homo sapiens
gcuccagauggugcua

SEQ ID NO: 973706 - RNA, 13 nt, Homo sapiens
gcuccagugccag

SEQ ID NO: 973707 - RNA, 22 nt, Homo sapiens
gcuccaucccaaccaggcaccu

SEQ ID NO: 973708 - RNA, 14 nt, Homo sapiens
gcucccuccuccag

SEQ ID NO: 973709 - RNA, 15 nt, Homo sapiens
gcuccgggcuuucac

SEQ ID NO: 973710 - RNA, 14 nt, Homo sapiens
gcucgcugccauca

SEQ ID NO: 973711 - RNA, 21 nt, Homo sapiens
gcucgcugccaucaccgcugg

SEQ ID NO: 973712 - RNA, 22 nt, Homo sapiens
gcucggagcggcgucccuucca

SEQ ID NO: 973713 - RNA, 18 nt, Homo sapiens
gcucugcaguccuacuca

SEQ ID NO: 973714 - RNA, 13 nt, Homo sapiens
gcucuucacugaa

SEQ ID NO: 973715 - RNA, 19 nt, Homo sapiens
gcucuucagcacaaagaca

SEQ ID NO: 973716 - RNA, 20 nt, Homo sapiens
gcugaaaaauauagccuuua

SEQ ID NO: 973717 - RNA, 18 nt, Homo sapiens
gcugaccagacacugccu

SEQ ID NO: 973718 - RNA, 15 nt, Homo sapiens
gcugaccugcugacc

SEQ ID NO: 973719 - RNA, 14 nt, Homo sapiens
gcugacuguagcuu

SEQ ID NO: 973720 - RNA, 18 nt, Homo sapiens
gcugagacaggccccuga

SEQ ID NO: 973721 - RNA, 16 nt, Homo sapiens
gcugagacugugcugu

SEQ ID NO: 973722 - RNA, 21 nt, Homo sapiens
gcugaggcugaggcacuggcg

SEQ ID NO: 973723 - RNA, 13 nt, Homo sapiens
gcugauggugugg

SEQ ID NO: 973724 - RNA, 16 nt, Homo sapiens
gcugcaccuggucaua

SEQ ID NO: 973725 - RNA, 14 nt, Homo sapiens
gcugccaccagccc

SEQ ID NO: 973726 - RNA, 13 nt, Homo sapiens
gcugcucugcuau

SEQ ID NO: 973727 - RNA, 15 nt, Homo sapiens
gcugcuuaauaccaa

SEQ ID NO: 973728 - RNA, 22 nt, Homo sapiens
gcugcuucuuauuaaucauaca

SEQ ID NO: 973729 - RNA, 18 nt, Homo sapiens
gcuggaacgcaguggugu

SEQ ID NO: 973730 - RNA, 17 nt, Homo sapiens
gcuggaggaaguggggu

SEQ ID NO: 973731 - RNA, 21 nt, Homo sapiens
gcuggccaugaaucucugccu

SEQ ID NO: 973732 - RNA, 17 nt, Homo sapiens
gcuggccucucuagcac

SEQ ID NO: 973733 - RNA, 16 nt, Homo sapiens
gcugggaugagaggaa

SEQ ID NO: 973734 - RNA, 16 nt, Homo sapiens
gcugggccauguccaa

SEQ ID NO: 973735 - RNA, 18 nt, Homo sapiens
gcugggccauguccaaag

SEQ ID NO: 973736 - RNA, 15 nt, Homo sapiens
gcugggccccuucca

SEQ ID NO: 973737 - RNA, 22 nt, Homo sapiens
gcuggggccugggacaacugcu

SEQ ID NO: 973738 - RNA, 13 nt, Homo sapiens
gcuguaugugagc

SEQ ID NO: 973739 - RNA, 19 nt, Homo sapiens
gcugucacucugugccuuu

SEQ ID NO: 973740 - RNA, 20 nt, Homo sapiens
gcugugggguggagcacugg

SEQ ID NO: 973741 - RNA, 20 nt, Homo sapiens
gcugugguuccuaagccugu

SEQ ID NO: 973742 - RNA, 15 nt, Homo sapiens
gcuguguuggugugg

SEQ ID NO: 973743 - RNA, 20 nt, Homo sapiens
gcuguuaauauaguuuagga

SEQ ID NO: 973744 - RNA, 13 nt, Homo sapiens
gcuguugugaagc

SEQ ID NO: 973745 - RNA, 16 nt, Homo sapiens
gcuuaaaguugucacu

SEQ ID NO: 973746 - RNA, 13 nt, Homo sapiens
gcuuaagcaauaa

SEQ ID NO: 973747 - RNA, 17 nt, Homo sapiens
gcuuaaugcuacaugug

SEQ ID NO: 973748 - RNA, 14 nt, Homo sapiens
gcuuacuaaugugc

SEQ ID NO: 973749 - RNA, 13 nt, Homo sapiens
gcuucacauucau

SEQ ID NO: 973750 - RNA, 13 nt, Homo sapiens
uauaaaggauaaa

SEQ ID NO: 973751 - RNA, 23 nt, Homo sapiens
uauaaauuauucaguaacuguca

SEQ ID NO: 973752 - RNA, 18 nt, Homo sapiens
uauaaauuuguguucuca

SEQ ID NO: 973753 - RNA, 18 nt, Homo sapiens
uauaagugagaacaugca

SEQ ID NO: 973754 - RNA, 21 nt, Homo sapiens
uauaagugagaacaugcagua

SEQ ID NO: 973755 - RNA, 23 nt, Homo sapiens
uauaaugggcucuccggggccau

SEQ ID NO: 973756 - RNA, 17 nt, Homo sapiens
uauaauuuaaacgugau

SEQ ID NO: 973757 - RNA, 12 nt, Homo sapiens
uauacacauaca

SEQ ID NO: 973758 - RNA, 17 nt, Homo sapiens
uauacacauacauauau

SEQ ID NO: 973759 - RNA, 22 nt, Homo sapiens
uauacacauacauauauacaca

SEQ ID NO: 973760 - RNA, 13 nt, Homo sapiens
uauacacauaguu

SEQ ID NO: 973761 - RNA, 16 nt, Homo sapiens
uauacacauauacaaa

SEQ ID NO: 973762 - RNA, 16 nt, Homo sapiens
uauacuagauguuaag

SEQ ID NO: 973763 - RNA, 22 nt, Homo sapiens
uauacugaaggaaaaacacaag

SEQ ID NO: 973764 - RNA, 13 nt, Homo sapiens
uauacuugccauc

SEQ ID NO: 973765 - RNA, 12 nt, Homo sapiens
uauagccuuuaa

SEQ ID NO: 973766 - RNA, 14 nt, Homo sapiens
uauaguagcauuuc

SEQ ID NO: 973767 - RNA, 14 nt, Homo sapiens
uauauaaacugugc

SEQ ID NO: 973768 - RNA, 17 nt, Homo sapiens
uauauaauguugccagc

SEQ ID NO: 973769 - RNA, 15 nt, Homo sapiens
uauauacauacugca

SEQ ID NO: 973770 - RNA, 17 nt, Homo sapiens
uauauaguagcauuuca

SEQ ID NO: 973771 - RNA, 19 nt, Homo sapiens
uauauauaguagcauuuca

SEQ ID NO: 973772 - RNA, 19 nt, Homo sapiens
uauauaugcauaccuggau

SEQ ID NO: 973773 - RNA, 15 nt, Homo sapiens
uauaugguucuccaa

SEQ ID NO: 973774 - RNA, 14 nt, Homo sapiens
uauaugugugccua

SEQ ID NO: 973775 - RNA, 15 nt, Homo sapiens
uauaugugugccuau

SEQ ID NO: 973776 - RNA, 14 nt, Homo sapiens
uauauuuaucuuuc

SEQ ID NO: 973777 - RNA, 15 nt, Homo sapiens
uaucagcuacaauug

SEQ ID NO: 973778 - RNA, 12 nt, Homo sapiens
uaucaguaccuc

SEQ ID NO: 973779 - RNA, 15 nt, Homo sapiens
uaucaguuacccacu

SEQ ID NO: 973780 - RNA, 11 nt, Homo sapiens
uaucaugcaaa

SEQ ID NO: 973781 - RNA, 17 nt, Homo sapiens
uaucauguauggugaua

SEQ ID NO: 973782 - RNA, 19 nt, Homo sapiens
uaucauuuacugugugauc

SEQ ID NO: 973783 - RNA, 13 nt, Homo sapiens
uauccaagacuua

SEQ ID NO: 973784 - RNA, 17 nt, Homo sapiens
uauccaauugcucuuuc

SEQ ID NO: 973785 - RNA, 20 nt, Homo sapiens
uauccugagccaucggugaa

SEQ ID NO: 973786 - RNA, 23 nt, Homo sapiens
uauccugcgaccuugcaaccuca

SEQ ID NO: 973787 - RNA, 23 nt, Homo sapiens
uauccugggaggguguggugcuu

SEQ ID NO: 973788 - RNA, 12 nt, Homo sapiens
uaucuccugaca

SEQ ID NO: 973789 - RNA, 14 nt, Homo sapiens
uaucucuguuuccu

SEQ ID NO: 973790 - RNA, 17 nt, Homo sapiens
uaugcacaaaucugcca

SEQ ID NO: 973791 - RNA, 12 nt, Homo sapiens
uaugcacaacuu

SEQ ID NO: 973792 - RNA, 21 nt, Homo sapiens
uaugcaccuugugucuguaca

SEQ ID NO: 973793 - RNA, 17 nt, Homo sapiens
uaugcauucacauuuag

SEQ ID NO: 973794 - RNA, 21 nt, Homo sapiens
uaugccucagucuauucugua

SEQ ID NO: 973795 - RNA, 20 nt, Homo sapiens
uaugcucauugaacuuuaag

SEQ ID NO: 973796 - RNA, 14 nt, Homo sapiens
uaugguaaucuuua

SEQ ID NO: 973797 - RNA, 18 nt, Homo sapiens
uauggugcucagcccuga

SEQ ID NO: 973798 - RNA, 23 nt, Homo sapiens
uauguaaaguagaauaagccuuc

SEQ ID NO: 973799 - RNA, 16 nt, Homo sapiens
uauguagaugugcauu

SEQ ID NO: 973800 - RNA, 16 nt, Homo sapiens
uaugucaaagcuuuga

SEQ ID NO: 973801 - RNA, 20 nt, Homo sapiens
uaugugcaaaggugugcuuc

SEQ ID NO: 973802 - RNA, 15 nt, Homo sapiens
uaugugggauauuga

SEQ ID NO: 973803 - RNA, 15 nt, Homo sapiens
uauguucauaucuau

SEQ ID NO: 973804 - RNA, 12 nt, Homo sapiens
uauucagaugua

SEQ ID NO: 973805 - RNA, 18 nt, Homo sapiens
uauucauggauggcucaa

SEQ ID NO: 973806 - RNA, 20 nt, Homo sapiens
uauuccaaaugccauccaga

SEQ ID NO: 973807 - RNA, 16 nt, Homo sapiens
uauugaaugguggugg

SEQ ID NO: 973808 - RNA, 14 nt, Homo sapiens
uauugaauguuaaa

SEQ ID NO: 973809 - RNA, 21 nt, Homo sapiens
uauuggagccccaggggacaa

SEQ ID NO: 973810 - RNA, 20 nt, Homo sapiens
uauuguaaucgugugccaug

SEQ ID NO: 973811 - RNA, 23 nt, Homo sapiens
uauugucauaggauuaagcaguu

SEQ ID NO: 973812 - RNA, 12 nt, Homo sapiens
uauugugacaga

SEQ ID NO: 973813 - RNA, 19 nt, Homo sapiens
uauuguuaucuuuaccucc

SEQ ID NO: 973814 - RNA, 15 nt, Homo sapiens
uauuguucucacuua

SEQ ID NO: 973815 - RNA, 15 nt, Homo sapiens
uauuuaaaacaaaga

SEQ ID NO: 973816 - RNA, 16 nt, Homo sapiens
uauuuaaaacaaagaa

SEQ ID NO: 973817 - RNA, 22 nt, Homo sapiens
uauuugcuaccacagcaacuau

SEQ ID NO: 973818 - RNA, 17 nt, Homo sapiens
uauuuucacacugguaa

SEQ ID NO: 973819 - RNA, 20 nt, Homo sapiens
uauuuuccuaguagauauau

SEQ ID NO: 973820 - RNA, 21 nt, Homo sapiens
uauuuuuauacaaaccuacca

SEQ ID NO: 973821 - RNA, 14 nt, Homo sapiens
ucaaaaagaacuaa

SEQ ID NO: 973822 - RNA, 13 nt, Homo sapiens
ucaaaauaaugaa

SEQ ID NO: 973823 - RNA, 20 nt, Homo sapiens
ucaaaauagucuaaggccau

SEQ ID NO: 973824 - RNA, 22 nt, Homo sapiens
ucaaaccauuuuuaaaauguga

SEQ ID NO: 973825 - RNA, 14 nt, Homo sapiens
ucaaagaacaaaca

SEQ ID NO: 973826 - RNA, 20 nt, Homo sapiens
ucaaagcuuugacucuauaa

SEQ ID NO: 973827 - RNA, 19 nt, Homo sapiens
ucaaagucaacauuugaga

SEQ ID NO: 973828 - RNA, 16 nt, Homo sapiens
ucaaagucauuaaaga

SEQ ID NO: 973829 - RNA, 13 nt, Homo sapiens
ucaaauagcaaua

SEQ ID NO: 973830 - RNA, 18 nt, Homo sapiens
ucaaauaguugcauagca

SEQ ID NO: 973831 - RNA, 19 nt, Homo sapiens
ucaaauaucaguuacccac

SEQ ID NO: 973832 - RNA, 14 nt, Homo sapiens
ucaaaucauuccuu

SEQ ID NO: 973833 - RNA, 14 nt, Homo sapiens
ucaaaucucuucca

SEQ ID NO: 973834 - RNA, 15 nt, Homo sapiens
ucaaaucucuuccac

SEQ ID NO: 973835 - RNA, 20 nt, Homo sapiens
ucaaauggcuuaagcaauaa

SEQ ID NO: 973836 - RNA, 16 nt, Homo sapiens
ucaaaugugucucaca

SEQ ID NO: 973837 - RNA, 14 nt, Homo sapiens
ucaacaagauuucc

SEQ ID NO: 973838 - RNA, 16 nt, Homo sapiens
ucaacacucuucuuga

SEQ ID NO: 973839 - RNA, 13 nt, Homo sapiens
ucaaccacagauu

SEQ ID NO: 973840 - RNA, 22 nt, Homo sapiens
ucaacugagguucuugggauac

SEQ ID NO: 973841 - RNA, 11 nt, Homo sapiens
ucaacugccua

SEQ ID NO: 973842 - RNA, 12 nt, Homo sapiens
ucaagaagucuu

SEQ ID NO: 973843 - RNA, 14 nt, Homo sapiens
ucaagaaucacuug

SEQ ID NO: 973844 - RNA, 20 nt, Homo sapiens
ucaagauggggcgagccagg

SEQ ID NO: 973845 - RNA, 17 nt, Homo sapiens
ucaagcaaaacaguucu

SEQ ID NO: 973846 - RNA, 18 nt, Homo sapiens
ucaagcugcucugagcca

SEQ ID NO: 973847 - RNA, 22 nt, Homo sapiens
ucaaggauagaaguauaccuga

SEQ ID NO: 973848 - RNA, 20 nt, Homo sapiens
ucaaggcaguagaacuccag

SEQ ID NO: 973849 - RNA, 11 nt, Homo sapiens
ucaaguaauaa

SEQ ID NO: 973850 - RNA, 16 nt, Homo sapiens
ucaaucugcaguuuaa

SEQ ID NO: 973851 - RNA, 20 nt, Homo sapiens
ucaaugcugcaggauggacu

SEQ ID NO: 973852 - RNA, 22 nt, Homo sapiens
ucaauggaauacagucauucca

SEQ ID NO: 973853 - RNA, 22 nt, Homo sapiens
ucaauggcuuguucaucaucca

SEQ ID NO: 973854 - RNA, 17 nt, Homo sapiens
ucaaugggaccuguggc

SEQ ID NO: 973855 - RNA, 12 nt, Homo sapiens
ucaaugucuucc

SEQ ID NO: 973856 - RNA, 14 nt, Homo sapiens
ucacaacagucacc

SEQ ID NO: 973857 - RNA, 18 nt, Homo sapiens
ucacaacagucaccucac

SEQ ID NO: 973858 - RNA, 16 nt, Homo sapiens
ucacacuuuaauguac

SEQ ID NO: 973859 - RNA, 19 nt, Homo sapiens
ucacagucucaguucucuu

SEQ ID NO: 973860 - RNA, 22 nt, Homo sapiens
ucacauggccuaugcacauaug

SEQ ID NO: 973861 - RNA, 20 nt, Homo sapiens
ucaccacccugcucauccac

SEQ ID NO: 973862 - RNA, 23 nt, Homo sapiens
ucaccacugaaacccugcacuua

SEQ ID NO: 973863 - RNA, 10 nt, Homo sapiens
ucaccacugu

SEQ ID NO: 973864 - RNA, 16 nt, Homo sapiens
ucaccagagacuuuag

SEQ ID NO: 973865 - RNA, 23 nt, Homo sapiens
uccccauccccacccagucucau

SEQ ID NO: 973866 - RNA, 18 nt, Homo sapiens
ucccccaccgguccagcu

SEQ ID NO: 973867 - RNA, 20 nt, Homo sapiens
uccccguuccaccccaagag

SEQ ID NO: 973868 - RNA, 15 nt, Homo sapiens
uccccuaaaauaaca

SEQ ID NO: 973869 - RNA, 16 nt, Homo sapiens
ucccggcgcgcccucu

SEQ ID NO: 973870 - RNA, 16 nt, Homo sapiens
ucccuaggaaacucac

SEQ ID NO: 973871 - RNA, 23 nt, Homo sapiens
ucccuauugugacagagccaugg

SEQ ID NO: 973872 - RNA, 14 nt, Homo sapiens
ucccucuaaugaga

SEQ ID NO: 973873 - RNA, 17 nt, Homo sapiens
ucccugaggauggguca

SEQ ID NO: 973874 - RNA, 14 nt, Homo sapiens
ucccugcagaccuc

SEQ ID NO: 973875 - RNA, 16 nt, Homo sapiens
ucccugcagaugccac

SEQ ID NO: 973876 - RNA, 23 nt, Homo sapiens
ucccugcagaugccacccuagcc

SEQ ID NO: 973877 - RNA, 24 nt, Homo sapiens
ucccugccucucaucaacugaaug

SEQ ID NO: 973878 - RNA, 19 nt, Homo sapiens
ucccugcuuaaauuucucc

SEQ ID NO: 973879 - RNA, 17 nt, Homo sapiens
ucccuguuaucugcuag

SEQ ID NO: 973880 - RNA, 18 nt, Homo sapiens
uccgagugugauuugaau

SEQ ID NO: 973881 - RNA, 20 nt, Homo sapiens
uccgccauuccaagucaaca

SEQ ID NO: 973882 - RNA, 23 nt, Homo sapiens
uccgccuggggcagaaagccaca

SEQ ID NO: 973883 - RNA, 18 nt, Homo sapiens
uccuaagaagagugcugu

SEQ ID NO: 973884 - RNA, 18 nt, Homo sapiens
uccuaaugucagaacaga

SEQ ID NO: 973885 - RNA, 20 nt, Homo sapiens
uccuacagcuacauugagau

SEQ ID NO: 973886 - RNA, 12 nt, Homo sapiens
uccuaccuuaau

SEQ ID NO: 973887 - RNA, 20 nt, Homo sapiens
uccuaggaggaaaauuccau

SEQ ID NO: 973888 - RNA, 22 nt, Homo sapiens
uccuaguuguucagcauggcau

SEQ ID NO: 973889 - RNA, 15 nt, Homo sapiens
uccuauaagcuuaaa

SEQ ID NO: 973890 - RNA, 19 nt, Homo sapiens
uccucaagggccaggacuu

SEQ ID NO: 973891 - RNA, 19 nt, Homo sapiens
uccucagagcuaacauaaa

SEQ ID NO: 973892 - RNA, 18 nt, Homo sapiens
uccuccacuccaccucca

SEQ ID NO: 973893 - RNA, 13 nt, Homo sapiens
uccucccagugag

SEQ ID NO: 973894 - RNA, 22 nt, Homo sapiens
uccuccuuuaccuuucagugca

SEQ ID NO: 973895 - RNA, 19 nt, Homo sapiens
uccucuacccuacaagauc

SEQ ID NO: 973896 - RNA, 14 nt, Homo sapiens
uccucuaguaguau

SEQ ID NO: 973897 - RNA, 14 nt, Homo sapiens
uccucuccuacucg

SEQ ID NO: 973898 - RNA, 16 nt, Homo sapiens
uccucuggagcccuaa

SEQ ID NO: 973899 - RNA, 23 nt, Homo sapiens
uccugaccccucuccucaaggga

SEQ ID NO: 973900 - RNA, 14 nt, Homo sapiens
uccugagaccucaa

SEQ ID NO: 973901 - RNA, 20 nt, Homo sapiens
uccugcagccccagcccagc

SEQ ID NO: 973902 - RNA, 16 nt, Homo sapiens
uccugccauagucuua

SEQ ID NO: 973903 - RNA, 19 nt, Homo sapiens
uccugggcacgcacugggu

SEQ ID NO: 973904 - RNA, 19 nt, Homo sapiens
uccugucccuguagcucag

SEQ ID NO: 973905 - RNA, 15 nt, Homo sapiens
uccuuccaggugauu

SEQ ID NO: 973906 - RNA, 12 nt, Homo sapiens
uccuuccagugu

SEQ ID NO: 973907 - RNA, 15 nt, Homo sapiens
uccuuccauccaucu

SEQ ID NO: 973908 - RNA, 19 nt, Homo sapiens
uccuuccccagcuuugcug

SEQ ID NO: 973909 - RNA, 15 nt, Homo sapiens
uccuuguaaacaaua

SEQ ID NO: 973910 - RNA, 15 nt, Homo sapiens
uccuuguauucugag

SEQ ID NO: 973911 - RNA, 14 nt, Homo sapiens
uccuuuuucacuuu

SEQ ID NO: 973912 - RNA, 17 nt, Homo sapiens
uccuuuuucacuuugaa

SEQ ID NO: 973913 - RNA, 17 nt, Homo sapiens
uccuuuuugacacugaa

SEQ ID NO: 973914 - RNA, 15 nt, Homo sapiens
ucgaguggccagcuu

SEQ ID NO: 973915 - RNA, 22 nt, Homo sapiens
ucgcucagcaauagggugcagu

SEQ ID NO: 973916 - RNA, 11 nt, Homo sapiens
ucggccuucac

SEQ ID NO: 973917 - RNA, 16 nt, Homo sapiens
ucgugguagaagccag

SEQ ID NO: 973918 - RNA, 15 nt, Homo sapiens
ucuaaaauuaaggaa

SEQ ID NO: 973919 - RNA, 17 nt, Homo sapiens
ucuaaauacaugccaca

SEQ ID NO: 973920 - RNA, 12 nt, Homo sapiens
ucuaagcugugu

SEQ ID NO: 973921 - RNA, 19 nt, Homo sapiens
ucuaaguuaaacagucagu

SEQ ID NO: 973922 - RNA, 18 nt, Homo sapiens
ucuaaugagacugaccau

SEQ ID NO: 973923 - RNA, 12 nt, Homo sapiens
ucuacaacugau

SEQ ID NO: 973924 - RNA, 17 nt, Homo sapiens
ucuacacugagguuuga

SEQ ID NO: 973925 - RNA, 18 nt, Homo sapiens
ucuacucaggcuggugga

SEQ ID NO: 973926 - RNA, 12 nt, Homo sapiens
ucuagaagccaa

SEQ ID NO: 973927 - RNA, 13 nt, Homo sapiens
ucuagaagccaag

SEQ ID NO: 973928 - RNA, 17 nt, Homo sapiens
ucuagaaugagcaagac

SEQ ID NO: 973929 - RNA, 14 nt, Homo sapiens
ucuagacuagcaau

SEQ ID NO: 973930 - RNA, 17 nt, Homo sapiens
ucuagagaacacgucuu

SEQ ID NO: 973931 - RNA, 13 nt, Homo sapiens
ucuaggcuaagca

SEQ ID NO: 973932 - RNA, 14 nt, Homo sapiens
ucuaggcuaagcac

SEQ ID NO: 973933 - RNA, 21 nt, Homo sapiens
ucuagguccccauacuccuau

SEQ ID NO: 973934 - RNA, 14 nt, Homo sapiens
ucuagugacuuccu

SEQ ID NO: 973935 - RNA, 13 nt, Homo sapiens
ucuauaggcagcu

SEQ ID NO: 973936 - RNA, 11 nt, Homo sapiens
ucuauguuaau

SEQ ID NO: 973937 - RNA, 18 nt, Homo sapiens
ucuauucuagccugcauu

SEQ ID NO: 973938 - RNA, 12 nt, Homo sapiens
ucucaacugagg

SEQ ID NO: 973939 - RNA, 20 nt, Homo sapiens
ucucacauaagcccaguuca

SEQ ID NO: 973940 - RNA, 22 nt, Homo sapiens
ucucacauaagcccaguucauc

SEQ ID NO: 973941 - RNA, 14 nt, Homo sapiens
ucucaccucuaggu

SEQ ID NO: 973942 - RNA, 22 nt, Homo sapiens
ucucacucucccuggagcugcu

SEQ ID NO: 973943 - RNA, 12 nt, Homo sapiens
ucucacucugcc

SEQ ID NO: 973944 - RNA, 17 nt, Homo sapiens
ucucagaaaugucauga

SEQ ID NO: 973945 - RNA, 14 nt, Homo sapiens
ucucagcuuugaga

SEQ ID NO: 973946 - RNA, 15 nt, Homo sapiens
ucucaucccaaccuc

SEQ ID NO: 973947 - RNA, 23 nt, Homo sapiens
ucucaugauccaacuaaugccuu

SEQ ID NO: 973948 - RNA, 22 nt, Homo sapiens
ucuccagcaauaauguuuucua

SEQ ID NO: 973949 - RNA, 15 nt, Homo sapiens
ucuccaggacaaccu

SEQ ID NO: 973950 - RNA, 18 nt, Homo sapiens
ucuccaggacaaccugcu

SEQ ID NO: 973951 - RNA, 19 nt, Homo sapiens
ucuccaucccucuaaugag

SEQ ID NO: 973952 - RNA, 20 nt, Homo sapiens
ucuccaucccucuaaugaga

SEQ ID NO: 973953 - RNA, 18 nt, Homo sapiens
ucuccaucucugucucaa

SEQ ID NO: 973954 - RNA, 20 nt, Homo sapiens
ucuccauggcccugucccag

SEQ ID NO: 973955 - RNA, 20 nt, Homo sapiens
ucucccaacucuugcacagu

SEQ ID NO: 973956 - RNA, 14 nt, Homo sapiens
ucucccauccuuga

SEQ ID NO: 973957 - RNA, 20 nt, Homo sapiens
ucuccccagagcugccugcu

SEQ ID NO: 973958 - RNA, 19 nt, Homo sapiens
ucucccuugggcucugaug

SEQ ID NO: 973959 - RNA, 23 nt, Homo sapiens
ucuccuccagcccagacccagug

SEQ ID NO: 973960 - RNA, 16 nt, Homo sapiens
ucuccuguggagucaa

SEQ ID NO: 973961 - RNA, 13 nt, Homo sapiens
ucucggccuucac

SEQ ID NO: 973962 - RNA, 14 nt, Homo sapiens
ucucuacagucucg

SEQ ID NO: 973963 - RNA, 17 nt, Homo sapiens
ucucuacuaaaaguaca

SEQ ID NO: 973964 - RNA, 20 nt, Homo sapiens
ucucuccacugugcuuucag

SEQ ID NO: 973965 - RNA, 15 nt, Homo sapiens
ucucuccagccugac

SEQ ID NO: 973966 - RNA, 18 nt, Homo sapiens
ucucugacgcuugugaca

SEQ ID NO: 973967 - RNA, 15 nt, Homo sapiens
ucucugucucaaauu

SEQ ID NO: 973968 - RNA, 20 nt, Homo sapiens
ucucuuaaguggucuaguca

SEQ ID NO: 973969 - RNA, 23 nt, Homo sapiens
ucucuucauuauucucugcuaua

SEQ ID NO: 973970 - RNA, 22 nt, Homo sapiens
ucucuuccucauauuucagcag

SEQ ID NO: 973971 - RNA, 14 nt, Homo sapiens
ucucuucugagcua

SEQ ID NO: 973972 - RNA, 21 nt, Homo sapiens
ucucuugccagcauuuucaca

SEQ ID NO: 973973 - RNA, 13 nt, Homo sapiens
ucucuugccauuu

SEQ ID NO: 973974 - RNA, 12 nt, Homo sapiens
ucucuuuggucu

SEQ ID NO: 973975 - RNA, 15 nt, Homo sapiens
ucugaacauucuccu

SEQ ID NO: 973976 - RNA, 19 nt, Homo sapiens
ucugaacucaaacugagga

SEQ ID NO: 973977 - RNA, 15 nt, Homo sapiens
ucugaauuaauuaau

SEQ ID NO: 973978 - RNA, 14 nt, Homo sapiens
ucugacgucucuuu

SEQ ID NO: 973979 - RNA, 15 nt, Homo sapiens
ucugacucugagcua

SEQ ID NO: 973980 - RNA, 18 nt, Homo sapiens
uguacaaaauaacucucc

SEQ ID NO: 973981 - RNA, 23 nt, Homo sapiens
uguacagaggucagcacacauua

SEQ ID NO: 973982 - RNA, 20 nt, Homo sapiens
uguacauguguagccugugc

SEQ ID NO: 973983 - RNA, 22 nt, Homo sapiens
uguacccuccuccccacacaga

SEQ ID NO: 973984 - RNA, 13 nt, Homo sapiens
uguacuaaucuga

SEQ ID NO: 973985 - RNA, 15 nt, Homo sapiens
uguacuuaaaccucc

SEQ ID NO: 973986 - RNA, 12 nt, Homo sapiens
uguagauauugu

SEQ ID NO: 973987 - RNA, 14 nt, Homo sapiens
uguagccugugcau

SEQ ID NO: 973988 - RNA, 18 nt, Homo sapiens
uguaugaaaaauugggga

SEQ ID NO: 973989 - RNA, 21 nt, Homo sapiens
uguauguaaauagcuaagaua

SEQ ID NO: 973990 - RNA, 16 nt, Homo sapiens
uguauucagaggcagu

SEQ ID NO: 973991 - RNA, 18 nt, Homo sapiens
uguauuuuucaaggcauu

SEQ ID NO: 973992 - RNA, 17 nt, Homo sapiens
ugucaaaugugucucac

SEQ ID NO: 973993 - RNA, 14 nt, Homo sapiens
ugucaaugggaccu

SEQ ID NO: 973994 - RNA, 17 nt, Homo sapiens
ugucaaugggaccugug

SEQ ID NO: 973995 - RNA, 20 nt, Homo sapiens
ugucacagaagcagcuaaac

SEQ ID NO: 973996 - RNA, 16 nt, Homo sapiens
ugucagcuacuaauga

SEQ ID NO: 973997 - RNA, 12 nt, Homo sapiens
ugucaguucucu

SEQ ID NO: 973998 - RNA, 21 nt, Homo sapiens
ugucaguuuuguacauagcaa

SEQ ID NO: 973999 - RNA, 18 nt, Homo sapiens
ugucauagacuccuuugc

SEQ ID NO: 974000 - RNA, 20 nt, Homo sapiens
uguccggaaugccacccaca

SEQ ID NO: 974001 - RNA, 18 nt, Homo sapiens
uguccuuuuucacuuuga

SEQ ID NO: 974002 - RNA, 20 nt, Homo sapiens
uguccuuuuucacuuugaaa

SEQ ID NO: 974003 - RNA, 18 nt, Homo sapiens
ugucgccaccacuuccag

SEQ ID NO: 974004 - RNA, 11 nt, Homo sapiens
ugucuaccugg

SEQ ID NO: 974005 - RNA, 18 nt, Homo sapiens
ugucuaggacugcagugu

SEQ ID NO: 974006 - RNA, 20 nt, Homo sapiens
ugucuaggcaggcaagagaa

SEQ ID NO: 974007 - RNA, 17 nt, Homo sapiens
ugucuauguagcugaaa

SEQ ID NO: 974008 - RNA, 13 nt, Homo sapiens
ugucucacaucua

SEQ ID NO: 974009 - RNA, 16 nt, Homo sapiens
ugucucacaucuacac

SEQ ID NO: 974010 - RNA, 23 nt, Homo sapiens
ugucucaugucaaugaccauuca

SEQ ID NO: 974011 - RNA, 17 nt, Homo sapiens
ugucugauuuuggccau

SEQ ID NO: 974012 - RNA, 13 nt, Homo sapiens
ugucugccaaaca

SEQ ID NO: 974013 - RNA, 20 nt, Homo sapiens
ugucugcgucgucaccaaau

SEQ ID NO: 974014 - RNA, 21 nt, Homo sapiens
ugucugcgucgucaccaaauc

SEQ ID NO: 974015 - RNA, 17 nt, Homo sapiens
ugugaaacaguugcugu

SEQ ID NO: 974016 - RNA, 19 nt, Homo sapiens
ugugacucgccagcucauu

SEQ ID NO: 974017 - RNA, 19 nt, Homo sapiens
ugugcagggugaagcagcu

SEQ ID NO: 974018 - RNA, 21 nt, Homo sapiens
ugugcagggugaagcagcuca

SEQ ID NO: 974019 - RNA, 15 nt, Homo sapiens
ugugcaucaguggga

SEQ ID NO: 974020 - RNA, 12 nt, Homo sapiens
ugugcaugaccu

SEQ ID NO: 974021 - RNA, 17 nt, Homo sapiens
ugugccauggaucugau

SEQ ID NO: 974022 - RNA, 19 nt, Homo sapiens
ugugccugaguggccugua

SEQ ID NO: 974023 - RNA, 19 nt, Homo sapiens
ugugcuccagauggugcua

SEQ ID NO: 974024 - RNA, 16 nt, Homo sapiens
ugugcuccccugccac

SEQ ID NO: 974025 - RNA, 19 nt, Homo sapiens
ugugcugcaccuggucaua

SEQ ID NO: 974026 - RNA, 13 nt, Homo sapiens
uguggcagugguu

SEQ ID NO: 974027 - RNA, 14 nt, Homo sapiens
ugugguuccucugc

SEQ ID NO: 974028 - RNA, 21 nt, Homo sapiens
uguguaaaaaaaccaccaaaa

SEQ ID NO: 974029 - RNA, 15 nt, Homo sapiens
uguguagccugugca

SEQ ID NO: 974030 - RNA, 21 nt, Homo sapiens
uguguccccucacgcaagugc

SEQ ID NO: 974031 - RNA, 21 nt, Homo sapiens
uguguccgugaaaguugugau

SEQ ID NO: 974032 - RNA, 11 nt, Homo sapiens
ugugucugcug

SEQ ID NO: 974033 - RNA, 13 nt, Homo sapiens
ugugucuguacac

SEQ ID NO: 974034 - RNA, 18 nt, Homo sapiens
uguuaacccacugcaugc

SEQ ID NO: 974035 - RNA, 21 nt, Homo sapiens
uguuaaugcuuucccacucuc

SEQ ID NO: 974036 - RNA, 21 nt, Homo sapiens
uguuaguaaaggaaccauucc

SEQ ID NO: 974037 - RNA, 21 nt, Homo sapiens
uguuaugcaucauuucaggag

SEQ ID NO: 974038 - RNA, 15 nt, Homo sapiens
uguucacugcuccuu

SEQ ID NO: 974039 - RNA, 12 nt, Homo sapiens
uguucacuuuau

SEQ ID NO: 974040 - RNA, 22 nt, Homo sapiens
uguuccagggagcuucuaccug

SEQ ID NO: 974041 - RNA, 22 nt, Homo sapiens
uguucuaguaacaauacaugag

SEQ ID NO: 974042 - RNA, 18 nt, Homo sapiens
uguucugcagucaucucc

SEQ ID NO: 974043 - RNA, 13 nt, Homo sapiens
uguucugugccug

SEQ ID NO: 974044 - RNA, 14 nt, Homo sapiens
uguucugugccugc

SEQ ID NO: 974045 - RNA, 16 nt, Homo sapiens
uguugagcaucugucc

SEQ ID NO: 974046 - RNA, 16 nt, Homo sapiens
uguugaggugcaagga

SEQ ID NO: 974047 - RNA, 22 nt, Homo sapiens
uguugguguggcccauggcugu

SEQ ID NO: 974048 - RNA, 21 nt, Homo sapiens
uguuguacuuaaaugguaaua

SEQ ID NO: 974049 - RNA, 14 nt, Homo sapiens
uguuuauugcaaua

SEQ ID NO: 974050 - RNA, 22 nt, Homo sapiens
uguuucugucaagcuggugcua

SEQ ID NO: 974051 - RNA, 22 nt, Homo sapiens
uguuucuugccugaacuccugc

SEQ ID NO: 974052 - RNA, 22 nt, Homo sapiens
uguuugcugauccccaaccugc

SEQ ID NO: 974053 - RNA, 21 nt, Homo sapiens
uguuuguaauaauaaaaccaa

SEQ ID NO: 974054 - RNA, 22 nt, Homo sapiens
uguuuguaauaauaaaaccaaa

SEQ ID NO: 974055 - RNA, 12 nt, Homo sapiens
uguuuuagccau

SEQ ID NO: 974056 - RNA, 16 nt, Homo sapiens
uguuuucaaaaccaag

SEQ ID NO: 974057 - RNA, 18 nt, Homo sapiens
uguuuucaaaaccaagua

SEQ ID NO: 974058 - RNA, 14 nt, Homo sapiens
uguuuuuaaguccu

SEQ ID NO: 974059 - RNA, 17 nt, Homo sapiens
uuaaaaaugagauuucu

SEQ ID NO: 974060 - RNA, 14 nt, Homo sapiens
uuaaaagcccuuuu

SEQ ID NO: 974061 - RNA, 22 nt, Homo sapiens
uuaaaagguuaaauauugucau

SEQ ID NO: 974062 - RNA, 18 nt, Homo sapiens
uuaaaaugauuuacauag

SEQ ID NO: 974063 - RNA, 13 nt, Homo sapiens
uuaaaaugccaau

SEQ ID NO: 974064 - RNA, 15 nt, Homo sapiens
uuaaaauuuuguaug

SEQ ID NO: 974065 - RNA, 17 nt, Homo sapiens
uuaaacaaauaauuuag

SEQ ID NO: 974066 - RNA, 23 nt, Homo sapiens
uuaaacacacauugcagcuucaa

SEQ ID NO: 974067 - RNA, 11 nt, Homo sapiens
uuaaacacauu

SEQ ID NO: 974068 - RNA, 20 nt, Homo sapiens
uuaaaccagaacccaguguu

SEQ ID NO: 974069 - RNA, 15 nt, Homo sapiens
uuaaagaaccaucag

SEQ ID NO: 974070 - RNA, 14 nt, Homo sapiens
uuaaagcuacugua

SEQ ID NO: 974071 - RNA, 13 nt, Homo sapiens
uuaaauacuauua

SEQ ID NO: 974072 - RNA, 20 nt, Homo sapiens
uuaaauauauaauguugcca

SEQ ID NO: 974073 - RNA, 13 nt, Homo sapiens
uuaaaugguaaua

SEQ ID NO: 974074 - RNA, 20 nt, Homo sapiens
uuaaauuauggaacugcuaa

SEQ ID NO: 974075 - RNA, 17 nt, Homo sapiens
uuaaauuuuaacuaaau

SEQ ID NO: 974076 - RNA, 21 nt, Homo sapiens
uuaacacccuuuagaaccuua

SEQ ID NO: 974077 - RNA, 19 nt, Homo sapiens
uuaacccuauuuuaccuag

SEQ ID NO: 974078 - RNA, 13 nt, Homo sapiens
uuaacggugcuaa

SEQ ID NO: 974079 - RNA, 14 nt, Homo sapiens
uuaacuacugaaua

SEQ ID NO: 974080 - RNA, 19 nt, Homo sapiens
uuaacuggucuccuugcuu

SEQ ID NO: 974081 - RNA, 16 nt, Homo sapiens
uuaagaaccugaauau

SEQ ID NO: 974082 - RNA, 12 nt, Homo sapiens
uuaagacuaaaa

SEQ ID NO: 974083 - RNA, 19 nt, Homo sapiens
uuaagacuaaaaguugcau

SEQ ID NO: 974084 - RNA, 21 nt, Homo sapiens
uuaagcagaggaauaacauca

SEQ ID NO: 974085 - RNA, 14 nt, Homo sapiens
uuaaggccugaauc

SEQ ID NO: 974086 - RNA, 15 nt, Homo sapiens
uuaaggggaagaaug

SEQ ID NO: 974087 - RNA, 20 nt, Homo sapiens
uuaaguucaggcagcacauc

SEQ ID NO: 974088 - RNA, 23 nt, Homo sapiens
uuaauaaagaugaguugguucuc

SEQ ID NO: 974089 - RNA, 13 nt, Homo sapiens
uuaauauacuaga

SEQ ID NO: 974090 - RNA, 16 nt, Homo sapiens
uuaaucaucaaaaaga

SEQ ID NO: 974091 - RNA, 16 nt, Homo sapiens
uuaaucccuuugucug

SEQ ID NO: 974092 - RNA, 22 nt, Homo sapiens
uuaaugauaaacucagaucuga

SEQ ID NO: 974093 - RNA, 11 nt, Homo sapiens
uuaaugcuuuc

SEQ ID NO: 974094 - RNA, 17 nt, Homo sapiens
uuaauggguaugcucag

SEQ ID NO: 974095 - RNA, 23 nt, Homo sapiens
aagcacucuggaugauggauucc

SEQ ID NO: 974096 - RNA, 15 nt, Homo sapiens
aagcagaaauguacu

SEQ ID NO: 974097 - RNA, 14 nt, Homo sapiens
aagcagauaccuug

SEQ ID NO: 974098 - RNA, 22 nt, Homo sapiens
aagcagcagcuuguaguaugcu

SEQ ID NO: 974099 - RNA, 21 nt, Homo sapiens
aagcaggcuugcccaguacau

SEQ ID NO: 974100 - RNA, 16 nt, Homo sapiens
aagcagggaauuccug

SEQ ID NO: 974101 - RNA, 23 nt, Homo sapiens
aagcaguuguuauuuagugauau

SEQ ID NO: 974102 - RNA, 21 nt, Homo sapiens
aagcauuccuucuuugauaau

SEQ ID NO: 974103 - RNA, 11 nt, Homo sapiens
aagccaaagaa

SEQ ID NO: 974104 - RNA, 23 nt, Homo sapiens
aagccaggccuggcuggaggagc

SEQ ID NO: 974105 - RNA, 12 nt, Homo sapiens
aagcccaguuca

SEQ ID NO: 974106 - RNA, 18 nt, Homo sapiens
aagcccuugagaagccaa

SEQ ID NO: 974107 - RNA, 20 nt, Homo sapiens
aagccuaagggauccugccu

SEQ ID NO: 974108 - RNA, 15 nt, Homo sapiens
aagccuuaagcaaau

SEQ ID NO: 974109 - RNA, 16 nt, Homo sapiens
aagccuuaagcaaauu

SEQ ID NO: 974110 - RNA, 15 nt, Homo sapiens
aagcuacuguagaaa

SEQ ID NO: 974111 - RNA, 20 nt, Homo sapiens
aagcuauuagccaggaucau

SEQ ID NO: 974112 - RNA, 17 nt, Homo sapiens
aagcucaucucagucau

SEQ ID NO: 974113 - RNA, 14 nt, Homo sapiens
aagcucccagcuga

SEQ ID NO: 974114 - RNA, 15 nt, Homo sapiens
aagcucccagcugac

SEQ ID NO: 974115 - RNA, 21 nt, Homo sapiens
aagcucuucacugaaacuggu

SEQ ID NO: 974116 - RNA, 17 nt, Homo sapiens
aaggacaagacacugag

SEQ ID NO: 974117 - RNA, 14 nt, Homo sapiens
aaggacucuuccac

SEQ ID NO: 974118 - RNA, 15 nt, Homo sapiens
aaggagccagugggg

SEQ ID NO: 974119 - RNA, 21 nt, Homo sapiens
aaggaugguuuuaucuucccu

SEQ ID NO: 974120 - RNA, 19 nt, Homo sapiens
aaggauuaauauucuucaa

SEQ ID NO: 974121 - RNA, 23 nt, Homo sapiens
aaggcauguggccuuuaucucaa

SEQ ID NO: 974122 - RNA, 15 nt, Homo sapiens
aaggcuugaagcugu

SEQ ID NO: 974123 - RNA, 12 nt, Homo sapiens
aagggauugcuu

SEQ ID NO: 974124 - RNA, 23 nt, Homo sapiens
aagggauugcuuugcauuacugu

SEQ ID NO: 974125 - RNA, 16 nt, Homo sapiens
aaggggccugcccuca

SEQ ID NO: 974126 - RNA, 15 nt, Homo sapiens
aaggggcucuucauc

SEQ ID NO: 974127 - RNA, 20 nt, Homo sapiens
aaggggcucuucaucugccu

SEQ ID NO: 974128 - RNA, 18 nt, Homo sapiens
aaguaacugaauuauuuc

SEQ ID NO: 974129 - RNA, 19 nt, Homo sapiens
aaguacagaauuugaauua

SEQ ID NO: 974130 - RNA, 11 nt, Homo sapiens
aaguacaucuc

SEQ ID NO: 974131 - RNA, 13 nt, Homo sapiens
aaguacuugucau

SEQ ID NO: 974132 - RNA, 19 nt, Homo sapiens
aaguauaaucagcacuuug

SEQ ID NO: 974133 - RNA, 23 nt, Homo sapiens
aaguauacuaagaguaaagcaac

SEQ ID NO: 974134 - RNA, 19 nt, Homo sapiens
aaguauauaauccugugaa

SEQ ID NO: 974135 - RNA, 17 nt, Homo sapiens
aaguauauuuaacucau

SEQ ID NO: 974136 - RNA, 18 nt, Homo sapiens
aaguccaaccugccugug

SEQ ID NO: 974137 - RNA, 11 nt, Homo sapiens
aagucuuucau

SEQ ID NO: 974138 - RNA, 20 nt, Homo sapiens
aagugcugggauuacaggca

SEQ ID NO: 974139 - RNA, 17 nt, Homo sapiens
aaguuagaaaacauaau

SEQ ID NO: 974140 - RNA, 16 nt, Homo sapiens
aaguuauuuuuguaca

SEQ ID NO: 974141 - RNA, 15 nt, Homo sapiens
aaguucucauugaau

SEQ ID NO: 974142 - RNA, 21 nt, Homo sapiens
aaguugaggagguuucugcau

SEQ ID NO: 974143 - RNA, 17 nt, Homo sapiens
aaguugaugguauucau

SEQ ID NO: 974144 - RNA, 14 nt, Homo sapiens
aaguugcuaauaca

SEQ ID NO: 974145 - RNA, 18 nt, Homo sapiens
aaguuguuuuuaaaacac

SEQ ID NO: 974146 - RNA, 21 nt, Homo sapiens
aaguuuacuucucgaauugaa

SEQ ID NO: 974147 - RNA, 13 nt, Homo sapiens
aauaaaaccaaag

SEQ ID NO: 974148 - RNA, 14 nt, Homo sapiens
aauaaaacugagcu

SEQ ID NO: 974149 - RNA, 19 nt, Homo sapiens
aauaaaagaucuugaauag

SEQ ID NO: 974150 - RNA, 13 nt, Homo sapiens
aauaaaauaauuc

SEQ ID NO: 974151 - RNA, 21 nt, Homo sapiens
aauaaagaaugccauuucuca

SEQ ID NO: 974152 - RNA, 15 nt, Homo sapiens
aauaaagaccugaga

SEQ ID NO: 974153 - RNA, 13 nt, Homo sapiens
aauaaauuguaaa

SEQ ID NO: 974154 - RNA, 16 nt, Homo sapiens
aauaacaucaccacug

SEQ ID NO: 974155 - RNA, 13 nt, Homo sapiens
aauaagcaaucaa

SEQ ID NO: 974156 - RNA, 13 nt, Homo sapiens
aauaauaccuuau

SEQ ID NO: 974157 - RNA, 16 nt, Homo sapiens
aauaaugaacacuaca

SEQ ID NO: 974158 - RNA, 19 nt, Homo sapiens
aauaauggaaaaugccaug

SEQ ID NO: 974159 - RNA, 16 nt, Homo sapiens
aauaauggcccuuaau

SEQ ID NO: 974160 - RNA, 19 nt, Homo sapiens
aauaauguccuuucauuug

SEQ ID NO: 974161 - RNA, 18 nt, Homo sapiens
aauacagacaaagcauaa

SEQ ID NO: 974162 - RNA, 17 nt, Homo sapiens
aauaccauuuaguaaga

SEQ ID NO: 974163 - RNA, 13 nt, Homo sapiens
aauacgugucaaa

SEQ ID NO: 974164 - RNA, 19 nt, Homo sapiens
aauacuucagugagauuaa

SEQ ID NO: 974165 - RNA, 12 nt, Homo sapiens
aauagaaaaagu

SEQ ID NO: 974166 - RNA, 16 nt, Homo sapiens
aauagaaacauuugua

SEQ ID NO: 974167 - RNA, 13 nt, Homo sapiens
aauagacuaucua

SEQ ID NO: 974168 - RNA, 20 nt, Homo sapiens
aauaguuuaucauuuacugu

SEQ ID NO: 974169 - RNA, 15 nt, Homo sapiens
aauauaaaugaugau

SEQ ID NO: 974170 - RNA, 16 nt, Homo sapiens
aauauaguuuaggagu

SEQ ID NO: 974171 - RNA, 18 nt, Homo sapiens
aauauaguuuaggaguaa

SEQ ID NO: 974172 - RNA, 18 nt, Homo sapiens
aauauauaaaaaagccac

SEQ ID NO: 974173 - RNA, 17 nt, Homo sapiens
aauauauaauguugcca

SEQ ID NO: 974174 - RNA, 14 nt, Homo sapiens
aauaucacacucgu

SEQ ID NO: 974175 - RNA, 12 nt, Homo sapiens
aauauccaagac

SEQ ID NO: 974176 - RNA, 23 nt, Homo sapiens
aauaucugugaaggacuugguga

SEQ ID NO: 974177 - RNA, 18 nt, Homo sapiens
aauauuaaaaaacuucau

SEQ ID NO: 974178 - RNA, 22 nt, Homo sapiens
aauauuagguugucacgaugaa

SEQ ID NO: 974179 - RNA, 13 nt, Homo sapiens
aauauuccuguga

SEQ ID NO: 974180 - RNA, 15 nt, Homo sapiens
aauauuccuuugcau

SEQ ID NO: 974181 - RNA, 15 nt, Homo sapiens
aauauugguauguaa

SEQ ID NO: 974182 - RNA, 23 nt, Homo sapiens
aauauuuacuaacuaaauaccau

SEQ ID NO: 974183 - RNA, 20 nt, Homo sapiens
aauauuucccauuugugcca

SEQ ID NO: 974184 - RNA, 11 nt, Homo sapiens
aauauuuggaa

SEQ ID NO: 974185 - RNA, 18 nt, Homo sapiens
aauauuuuagccacucaa

SEQ ID NO: 974186 - RNA, 17 nt, Homo sapiens
aauauuuuuauauuucc

SEQ ID NO: 974187 - RNA, 22 nt, Homo sapiens
aauauuuuuauauuuccuuuau

SEQ ID NO: 974188 - RNA, 22 nt, Homo sapiens
aaucaaaucucuuccacauggg

SEQ ID NO: 974189 - RNA, 13 nt, Homo sapiens
aaucaaucugcag

SEQ ID NO: 974190 - RNA, 13 nt, Homo sapiens
aaucacaaugaga

SEQ ID NO: 974191 - RNA, 22 nt, Homo sapiens
aaucacagucucaguucucuug

SEQ ID NO: 974192 - RNA, 13 nt, Homo sapiens
aaucagagacaaa

SEQ ID NO: 974193 - RNA, 19 nt, Homo sapiens
aaucagauguguguucuca

SEQ ID NO: 974194 - RNA, 13 nt, Homo sapiens
aaucagcauuuag

SEQ ID NO: 974195 - RNA, 13 nt, Homo sapiens
aaucauguucaaa

SEQ ID NO: 974196 - RNA, 22 nt, Homo sapiens
aaucauuccuuagauaccuuga

SEQ ID NO: 974197 - RNA, 16 nt, Homo sapiens
aauccaaacuaaucca

SEQ ID NO: 974198 - RNA, 19 nt, Homo sapiens
aauccaugcuucucaucug

SEQ ID NO: 974199 - RNA, 14 nt, Homo sapiens
aaucccagcacuuu

SEQ ID NO: 974200 - RNA, 13 nt, Homo sapiens
aauccgaagggaa

SEQ ID NO: 974201 - RNA, 21 nt, Homo sapiens
aauccuugaugauugacaaca

SEQ ID NO: 974202 - RNA, 21 nt, Homo sapiens
aaucuaaaaugugugccagau

SEQ ID NO: 974203 - RNA, 13 nt, Homo sapiens
aaucuacauucac

SEQ ID NO: 974204 - RNA, 18 nt, Homo sapiens
aaucuacauucacuuuuu

SEQ ID NO: 974205 - RNA, 18 nt, Homo sapiens
aaucucguuucuccucuu

SEQ ID NO: 974206 - RNA, 17 nt, Homo sapiens
aaucuguguaacuguaa

SEQ ID NO: 974207 - RNA, 18 nt, Homo sapiens
aaucuucaaagccuucuc

SEQ ID NO: 974208 - RNA, 14 nt, Homo sapiens
aaucuuccuuuuau

SEQ ID NO: 974209 - RNA, 15 nt, Homo sapiens
aaucuugaacuuuau

SEQ ID NO: 974210 - RNA, 12 nt, Homo sapiens
acacuguacaag

SEQ ID NO: 974211 - RNA, 19 nt, Homo sapiens
acacugucacuagucucac

SEQ ID NO: 974212 - RNA, 19 nt, Homo sapiens
acagaaaguaucacaaaug

SEQ ID NO: 974213 - RNA, 18 nt, Homo sapiens
acagaacauauguugcaa

SEQ ID NO: 974214 - RNA, 23 nt, Homo sapiens
acagaagcuucugcccaccuacu

SEQ ID NO: 974215 - RNA, 14 nt, Homo sapiens
acagacaagcccuu

SEQ ID NO: 974216 - RNA, 14 nt, Homo sapiens
acagagcagccagg

SEQ ID NO: 974217 - RNA, 11 nt, Homo sapiens
acagagccaug

SEQ ID NO: 974218 - RNA, 20 nt, Homo sapiens
acagaggagcuuuucuggaa

SEQ ID NO: 974219 - RNA, 13 nt, Homo sapiens
acagagugcaacc

SEQ ID NO: 974220 - RNA, 16 nt, Homo sapiens
acagauaaaacuugag

SEQ ID NO: 974221 - RNA, 12 nt, Homo sapiens
acagcaaggugg

SEQ ID NO: 974222 - RNA, 13 nt, Homo sapiens
acagcagagacca

SEQ ID NO: 974223 - RNA, 19 nt, Homo sapiens
acagcccugcucauuccuc

SEQ ID NO: 974224 - RNA, 21 nt, Homo sapiens
acagccucagcggacaagcag

SEQ ID NO: 974225 - RNA, 21 nt, Homo sapiens
acagcugccugugugggacug

SEQ ID NO: 974226 - RNA, 22 nt, Homo sapiens
acagcugugucugccaaacaca

SEQ ID NO: 974227 - RNA, 23 nt, Homo sapiens
acagcuuccuguuacugagaugu

SEQ ID NO: 974228 - RNA, 15 nt, Homo sapiens
acaggacagcgggaa

SEQ ID NO: 974229 - RNA, 15 nt, Homo sapiens
acaggagacaaaaga

SEQ ID NO: 974230 - RNA, 24 nt, Homo sapiens
acaggccccugaguccuggcucau

SEQ ID NO: 974231 - RNA, 17 nt, Homo sapiens
acaguaaguccaguaaa

SEQ ID NO: 974232 - RNA, 14 nt, Homo sapiens
acaguaucccacau

SEQ ID NO: 974233 - RNA, 13 nt, Homo sapiens
acagucauuccaa

SEQ ID NO: 974234 - RNA, 17 nt, Homo sapiens
acagucucaguucucuu

SEQ ID NO: 974235 - RNA, 19 nt, Homo sapiens
acagugccucuuccaguga

SEQ ID NO: 974236 - RNA, 17 nt, Homo sapiens
acagugcucaaggccag

SEQ ID NO: 974237 - RNA, 15 nt, Homo sapiens
acaguuuuaagcaga

SEQ ID NO: 974238 - RNA, 15 nt, Homo sapiens
acaguuuuuggcaaa

SEQ ID NO: 974239 - RNA, 23 nt, Homo sapiens
acauaacccuagaauucuuaguc

SEQ ID NO: 974240 - RNA, 16 nt, Homo sapiens
acauaaguaacuuuua

SEQ ID NO: 974241 - RNA, 13 nt, Homo sapiens
acauacauucccu

SEQ ID NO: 974242 - RNA, 14 nt, Homo sapiens
acauacuguucacu

SEQ ID NO: 974243 - RNA, 22 nt, Homo sapiens
acauauaaaauguaauuacuua

SEQ ID NO: 974244 - RNA, 13 nt, Homo sapiens
acauauauaccac

SEQ ID NO: 974245 - RNA, 19 nt, Homo sapiens
acauaucuacacuucgcac

SEQ ID NO: 974246 - RNA, 17 nt, Homo sapiens
acauauuaggaaaauau

SEQ ID NO: 974247 - RNA, 21 nt, Homo sapiens
acaucaaguaugguaggggag

SEQ ID NO: 974248 - RNA, 15 nt, Homo sapiens
acaucaggaguucaa

SEQ ID NO: 974249 - RNA, 15 nt, Homo sapiens
acauccaucccucca

SEQ ID NO: 974250 - RNA, 22 nt, Homo sapiens
acauccuuucuuuuaaugaugc

SEQ ID NO: 974251 - RNA, 23 nt, Homo sapiens
acaucucaauaaagugcuuuaaa

SEQ ID NO: 974252 - RNA, 13 nt, Homo sapiens
acaugaaucaagc

SEQ ID NO: 974253 - RNA, 23 nt, Homo sapiens
acaugaaucccacccacauguga

SEQ ID NO: 974254 - RNA, 21 nt, Homo sapiens
acaugacauucuuagcuguaa

SEQ ID NO: 974255 - RNA, 14 nt, Homo sapiens
acauggaacuuuag

SEQ ID NO: 974256 - RNA, 15 nt, Homo sapiens
acaugggauugcuaa

SEQ ID NO: 974257 - RNA, 18 nt, Homo sapiens
acauggucaaaauuucac

SEQ ID NO: 974258 - RNA, 17 nt, Homo sapiens
acauggugaaacccugu

SEQ ID NO: 974259 - RNA, 16 nt, Homo sapiens
acauguauguaaauag

SEQ ID NO: 974260 - RNA, 22 nt, Homo sapiens
acauguguagccugugcaugua

SEQ ID NO: 974261 - RNA, 23 nt, Homo sapiens
acauguuaaugacaauauuccag

SEQ ID NO: 974262 - RNA, 21 nt, Homo sapiens
acauguuuguuucuguagaaa

SEQ ID NO: 974263 - RNA, 13 nt, Homo sapiens
acauuaaugccug

SEQ ID NO: 974264 - RNA, 18 nt, Homo sapiens
acauuaccuuacugugga

SEQ ID NO: 974265 - RNA, 21 nt, Homo sapiens
acauuauguggcccucuggau

SEQ ID NO: 974266 - RNA, 16 nt, Homo sapiens
acauuauuagcacuuc

SEQ ID NO: 974267 - RNA, 21 nt, Homo sapiens
acauucccucuaauuugaacu

SEQ ID NO: 974268 - RNA, 19 nt, Homo sapiens
acauugcagcuucaacuuu

SEQ ID NO: 974269 - RNA, 13 nt, Homo sapiens
acauuguacuuaa

SEQ ID NO: 974270 - RNA, 23 nt, Homo sapiens
acauuguguucccauuucagcug

SEQ ID NO: 974271 - RNA, 14 nt, Homo sapiens
acauuucuuugcau

SEQ ID NO: 974272 - RNA, 15 nt, Homo sapiens
acauuugcuacuguu

SEQ ID NO: 974273 - RNA, 13 nt, Homo sapiens
acauuuuacagua

SEQ ID NO: 974274 - RNA, 18 nt, Homo sapiens
acauuuuauuaagcuuuu

SEQ ID NO: 974275 - RNA, 14 nt, Homo sapiens
acauuuuccugaga

SEQ ID NO: 974276 - RNA, 19 nt, Homo sapiens
acauuuuccugagaccuca

SEQ ID NO: 974277 - RNA, 23 nt, Homo sapiens
acauuuuccugagaccucaauga

SEQ ID NO: 974278 - RNA, 22 nt, Homo sapiens
accaaaaacauuugauuaauaa

SEQ ID NO: 974279 - RNA, 13 nt, Homo sapiens
accaaacacucag

SEQ ID NO: 974280 - RNA, 18 nt, Homo sapiens
accaacaaaaagaacaaa

SEQ ID NO: 974281 - RNA, 14 nt, Homo sapiens
accaaccagaccac

SEQ ID NO: 974282 - RNA, 19 nt, Homo sapiens
accaagaaagcucacugua

SEQ ID NO: 974283 - RNA, 13 nt, Homo sapiens
accaagacugagc

SEQ ID NO: 974284 - RNA, 19 nt, Homo sapiens
accaagacugagccagcuu

SEQ ID NO: 974285 - RNA, 20 nt, Homo sapiens
accacagagggcaggggaug

SEQ ID NO: 974286 - RNA, 22 nt, Homo sapiens
accaccuggggagagccugcuu

SEQ ID NO: 974287 - RNA, 17 nt, Homo sapiens
accacgauucucccaaa

SEQ ID NO: 974288 - RNA, 20 nt, Homo sapiens
accacggaggaugaugccag

SEQ ID NO: 974289 - RNA, 20 nt, Homo sapiens
accacucuucuuuaagccau

SEQ ID NO: 974290 - RNA, 21 nt, Homo sapiens
accacucuucuuuaagccaua

SEQ ID NO: 974291 - RNA, 14 nt, Homo sapiens
accacuguguaugu

SEQ ID NO: 974292 - RNA, 22 nt, Homo sapiens
accacuuucccacacugugaac

SEQ ID NO: 974293 - RNA, 20 nt, Homo sapiens
accagaucagggacuugaau

SEQ ID NO: 974294 - RNA, 17 nt, Homo sapiens
accagccccacugccag

SEQ ID NO: 974295 - RNA, 16 nt, Homo sapiens
accaggacuagggcug

SEQ ID NO: 974296 - RNA, 16 nt, Homo sapiens
accagggcucuucuca

SEQ ID NO: 974297 - RNA, 14 nt, Homo sapiens
accaguacugggaa

SEQ ID NO: 974298 - RNA, 22 nt, Homo sapiens
accauaaugagaugugagccuu

SEQ ID NO: 974299 - RNA, 17 nt, Homo sapiens
accauauuuuuuguaaa

SEQ ID NO: 974300 - RNA, 17 nt, Homo sapiens
accaucuacaucuccuu

SEQ ID NO: 974301 - RNA, 23 nt, Homo sapiens
accauuugauagggaacugggga

SEQ ID NO: 974302 - RNA, 21 nt, Homo sapiens
accauuuuuuaauuuacuugu

SEQ ID NO: 974303 - RNA, 23 nt, Homo sapiens
acccacaugugacacauaugcac

SEQ ID NO: 974304 - RNA, 23 nt, Homo sapiens
acccacucggauggaccaaccug

SEQ ID NO: 974305 - RNA, 15 nt, Homo sapiens
acccaggcccagcug

SEQ ID NO: 974306 - RNA, 16 nt, Homo sapiens
acccaggcccagcuga

SEQ ID NO: 974307 - RNA, 16 nt, Homo sapiens
acccagggugugaaca

SEQ ID NO: 974308 - RNA, 12 nt, Homo sapiens
acccagucucau

SEQ ID NO: 974309 - RNA, 17 nt, Homo sapiens
acccaguggacucuucc

SEQ ID NO: 974310 - RNA, 19 nt, Homo sapiens
acccaguggacucuuccac

SEQ ID NO: 974311 - RNA, 14 nt, Homo sapiens
acccauaccacagc

SEQ ID NO: 974312 - RNA, 17 nt, Homo sapiens
acccaucuucauuaaag

SEQ ID NO: 974313 - RNA, 22 nt, Homo sapiens
acccauuuuuccuuuugccgac

SEQ ID NO: 974314 - RNA, 14 nt, Homo sapiens
accccaaccugcuc

SEQ ID NO: 974315 - RNA, 16 nt, Homo sapiens
accccagccauccagg

SEQ ID NO: 974316 - RNA, 18 nt, Homo sapiens
accccaguggauucucau

SEQ ID NO: 974317 - RNA, 17 nt, Homo sapiens
acccccucuucugagca

SEQ ID NO: 974318 - RNA, 21 nt, Homo sapiens
accccgacaaggagacugccu

SEQ ID NO: 974319 - RNA, 23 nt, Homo sapiens
accccugucccaaccccagugga

SEQ ID NO: 974320 - RNA, 16 nt, Homo sapiens
acccuccccuagucac

SEQ ID NO: 974321 - RNA, 20 nt, Homo sapiens
acccuccccuagucacucau

SEQ ID NO: 974322 - RNA, 16 nt, Homo sapiens
acccucuuccugugau

SEQ ID NO: 974323 - RNA, 15 nt, Homo sapiens
acccucuuugcugca

SEQ ID NO: 974324 - RNA, 22 nt, Homo sapiens
agcucugauugcagcacagagc

SEQ ID NO: 974325 - RNA, 14 nt, Homo sapiens
agcucuucagcaca

SEQ ID NO: 974326 - RNA, 23 nt, Homo sapiens
agcugaaauuuuagaaauauuca

SEQ ID NO: 974327 - RNA, 16 nt, Homo sapiens
agcugaagaauugaaa

SEQ ID NO: 974328 - RNA, 16 nt, Homo sapiens
agcugagaucgugcua

SEQ ID NO: 974329 - RNA, 14 nt, Homo sapiens
agcugagugcugaa

SEQ ID NO: 974330 - RNA, 12 nt, Homo sapiens
agcugccuaccu

SEQ ID NO: 974331 - RNA, 13 nt, Homo sapiens
agcugccugguau

SEQ ID NO: 974332 - RNA, 19 nt, Homo sapiens
agcugccuucccuagcuuu

SEQ ID NO: 974333 - RNA, 14 nt, Homo sapiens
agcuggacuacggc

SEQ ID NO: 974334 - RNA, 22 nt, Homo sapiens
agcuggagguggaaaauggugc

SEQ ID NO: 974335 - RNA, 21 nt, Homo sapiens
agcuggauagacuugggaugg

SEQ ID NO: 974336 - RNA, 14 nt, Homo sapiens
agcuggcucuguga

SEQ ID NO: 974337 - RNA, 21 nt, Homo sapiens
agcugggcccaccgaggugcu

SEQ ID NO: 974338 - RNA, 21 nt, Homo sapiens
agcugggccgggacccagggc

SEQ ID NO: 974339 - RNA, 22 nt, Homo sapiens
agcuggggcuuugauguuccuu

SEQ ID NO: 974340 - RNA, 12 nt, Homo sapiens
agcuguuuauuu

SEQ ID NO: 974341 - RNA, 14 nt, Homo sapiens
agcuuaagaaccau

SEQ ID NO: 974342 - RNA, 15 nt, Homo sapiens
agcuuaagaaccauu

SEQ ID NO: 974343 - RNA, 13 nt, Homo sapiens
agcuucaacuuuu

SEQ ID NO: 974344 - RNA, 15 nt, Homo sapiens
agcuucuaccuggaa

SEQ ID NO: 974345 - RNA, 12 nt, Homo sapiens
agcuucuuguuu

SEQ ID NO: 974346 - RNA, 21 nt, Homo sapiens
agcuuucccugccucucauca

SEQ ID NO: 974347 - RNA, 19 nt, Homo sapiens
agcuuugcagauaacaaaa

SEQ ID NO: 974348 - RNA, 19 nt, Homo sapiens
aggaaaaacacaagcaaaa

SEQ ID NO: 974349 - RNA, 17 nt, Homo sapiens
aggaaaaauugaugaau

SEQ ID NO: 974350 - RNA, 17 nt, Homo sapiens
aggaaaagguugaauaa

SEQ ID NO: 974351 - RNA, 17 nt, Homo sapiens
aggaaaauaaacugaca

SEQ ID NO: 974352 - RNA, 19 nt, Homo sapiens
aggaaauggcuuugugauu

SEQ ID NO: 974353 - RNA, 17 nt, Homo sapiens
aggaacaaauaaacuca

SEQ ID NO: 974354 - RNA, 18 nt, Homo sapiens
aggaacaaauaaacucau

SEQ ID NO: 974355 - RNA, 19 nt, Homo sapiens
aggaaccucucgccaugau

SEQ ID NO: 974356 - RNA, 12 nt, Homo sapiens
aggaagcagcug

SEQ ID NO: 974357 - RNA, 19 nt, Homo sapiens
aggaagucccagagccugu

SEQ ID NO: 974358 - RNA, 18 nt, Homo sapiens
aggaauauaugugugccu

SEQ ID NO: 974359 - RNA, 14 nt, Homo sapiens
aggaauuacgugcu

SEQ ID NO: 974360 - RNA, 22 nt, Homo sapiens
aggaauuacgugcucugugggu

SEQ ID NO: 974361 - RNA, 19 nt, Homo sapiens
aggaauuucaccuguaaac

SEQ ID NO: 974362 - RNA, 18 nt, Homo sapiens
aggacaagacacugagga

SEQ ID NO: 974363 - RNA, 16 nt, Homo sapiens
aggacaauacuggggu

SEQ ID NO: 974364 - RNA, 18 nt, Homo sapiens
aggacaccuuuuaacuca

SEQ ID NO: 974365 - RNA, 18 nt, Homo sapiens
aggacagcuugcuucuuu

SEQ ID NO: 974366 - RNA, 11 nt, Homo sapiens
aggacucuucc

SEQ ID NO: 974367 - RNA, 22 nt, Homo sapiens
aggacugagcacccucuggauu

SEQ ID NO: 974368 - RNA, 16 nt, Homo sapiens
aggacuuugcgguggg

SEQ ID NO: 974369 - RNA, 17 nt, Homo sapiens
aggagagcccagucucc

SEQ ID NO: 974370 - RNA, 21 nt, Homo sapiens
aggagauaauuguuucauuca

SEQ ID NO: 974371 - RNA, 14 nt, Homo sapiens
aggagauacugaac

SEQ ID NO: 974372 - RNA, 17 nt, Homo sapiens
aggagcaggcacgggug

SEQ ID NO: 974373 - RNA, 18 nt, Homo sapiens
aggagcuuuggaccuaau

SEQ ID NO: 974374 - RNA, 14 nt, Homo sapiens
aggaggaaaauucc

SEQ ID NO: 974375 - RNA, 17 nt, Homo sapiens
aggaggcccacuguguc

SEQ ID NO: 974376 - RNA, 23 nt, Homo sapiens
aggauauugguucuuccccucau

SEQ ID NO: 974377 - RNA, 14 nt, Homo sapiens
aggaugcagcacug

SEQ ID NO: 974378 - RNA, 15 nt, Homo sapiens
aggauguaagccugg

SEQ ID NO: 974379 - RNA, 14 nt, Homo sapiens
aggauuugcacaga

SEQ ID NO: 974380 - RNA, 18 nt, Homo sapiens
aggcaccucuuccuugau

SEQ ID NO: 974381 - RNA, 19 nt, Homo sapiens
aggcaccugcuggaaacca

SEQ ID NO: 974382 - RNA, 16 nt, Homo sapiens
aggcagggcugggaag

SEQ ID NO: 974383 - RNA, 19 nt, Homo sapiens
aggcaguauuuuguguccu

SEQ ID NO: 974384 - RNA, 15 nt, Homo sapiens
aggcaugacuaaugc

SEQ ID NO: 974385 - RNA, 16 nt, Homo sapiens
aggcaugguggcucau

SEQ ID NO: 974386 - RNA, 21 nt, Homo sapiens
aggcauguggccuuuaucuca

SEQ ID NO: 974387 - RNA, 18 nt, Homo sapiens
aggcauucuggaccucug

SEQ ID NO: 974388 - RNA, 16 nt, Homo sapiens
aggccagcaagcucuu

SEQ ID NO: 974389 - RNA, 14 nt, Homo sapiens
aggcccauucuuca

SEQ ID NO: 974390 - RNA, 20 nt, Homo sapiens
aggcccuugucgugggaugg

SEQ ID NO: 974391 - RNA, 23 nt, Homo sapiens
aggccggaaaaggcgcaucuaac

SEQ ID NO: 974392 - RNA, 14 nt, Homo sapiens
aggccgugccuugu

SEQ ID NO: 974393 - RNA, 23 nt, Homo sapiens
aggccuagacucugucuaccugg

SEQ ID NO: 974394 - RNA, 17 nt, Homo sapiens
aggccucaccauuccaa

SEQ ID NO: 974395 - RNA, 13 nt, Homo sapiens
aggccucugagaa

SEQ ID NO: 974396 - RNA, 10 nt, Homo sapiens
aggccugaag

SEQ ID NO: 974397 - RNA, 22 nt, Homo sapiens
aggccugcacagcuaagugugg

SEQ ID NO: 974398 - RNA, 15 nt, Homo sapiens
aggcgucaccaucca

SEQ ID NO: 974399 - RNA, 15 nt, Homo sapiens
aggcuccugccugag

SEQ ID NO: 974400 - RNA, 21 nt, Homo sapiens
aggcucucgcacaccucugca

SEQ ID NO: 974401 - RNA, 18 nt, Homo sapiens
aggcugagaacucguuca

SEQ ID NO: 974402 - RNA, 18 nt, Homo sapiens
aggcugcccacucuccau

SEQ ID NO: 974403 - RNA, 19 nt, Homo sapiens
aggcugccccucucaccaa

SEQ ID NO: 974404 - RNA, 20 nt, Homo sapiens
aggcuggaguacaguggcac

SEQ ID NO: 974405 - RNA, 12 nt, Homo sapiens
aggcugggccau

SEQ ID NO: 974406 - RNA, 18 nt, Homo sapiens
aggcuguacgacacgggu

SEQ ID NO: 974407 - RNA, 14 nt, Homo sapiens
aggcuuuacagugu

SEQ ID NO: 974408 - RNA, 13 nt, Homo sapiens
aggcuuugccauu

SEQ ID NO: 974409 - RNA, 13 nt, Homo sapiens
agggaagcaggga

SEQ ID NO: 974410 - RNA, 16 nt, Homo sapiens
agggaauacugugcau

SEQ ID NO: 974411 - RNA, 22 nt, Homo sapiens
agggaaugagaguuccuucuca

SEQ ID NO: 974412 - RNA, 20 nt, Homo sapiens
agggacaggcuccucugggg

SEQ ID NO: 974413 - RNA, 21 nt, Homo sapiens
agggacuugaaugcacuuuug

SEQ ID NO: 974414 - RNA, 14 nt, Homo sapiens
agggaggucacugg

SEQ ID NO: 974415 - RNA, 18 nt, Homo sapiens
agggagugcacauaucca

SEQ ID NO: 974416 - RNA, 16 nt, Homo sapiens
agggcagcuccagugc

SEQ ID NO: 974417 - RNA, 23 nt, Homo sapiens
agggccccaauguauguguggcu

SEQ ID NO: 974418 - RNA, 18 nt, Homo sapiens
aggggagggcaggcuugg

SEQ ID NO: 974419 - RNA, 15 nt, Homo sapiens
aggggaucuaaaaaa

SEQ ID NO: 974420 - RNA, 17 nt, Homo sapiens
agggggugggauuccac

SEQ ID NO: 974421 - RNA, 14 nt, Homo sapiens
agggugaaccaagc

SEQ ID NO: 974422 - RNA, 18 nt, Homo sapiens
agggugacugaugauaca

SEQ ID NO: 974423 - RNA, 22 nt, Homo sapiens
aggguggcacagaagcucaucu

SEQ ID NO: 974424 - RNA, 14 nt, Homo sapiens
aggguguggugcuu

SEQ ID NO: 974425 - RNA, 16 nt, Homo sapiens
aggguuaaggccugaa

SEQ ID NO: 974426 - RNA, 21 nt, Homo sapiens
aggguucaagccuuccaggga

SEQ ID NO: 974427 - RNA, 18 nt, Homo sapiens
aggguugacuuuacccau

SEQ ID NO: 974428 - RNA, 15 nt, Homo sapiens
agguagaacacugcu

SEQ ID NO: 974429 - RNA, 16 nt, Homo sapiens
agguagaacacugcua

SEQ ID NO: 974430 - RNA, 23 nt, Homo sapiens
agguauccaaaaauguguaagaa

SEQ ID NO: 974431 - RNA, 13 nt, Homo sapiens
aggucaggacggc

SEQ ID NO: 974432 - RNA, 20 nt, Homo sapiens
aggucaucggcguggcccaa

SEQ ID NO: 974433 - RNA, 17 nt, Homo sapiens
aggucaucuaggagcaa

SEQ ID NO: 974434 - RNA, 18 nt, Homo sapiens
aggucauuauuuuuuaca

SEQ ID NO: 974435 - RNA, 14 nt, Homo sapiens
aggucuaccccugg

SEQ ID NO: 974436 - RNA, 18 nt, Homo sapiens
aggucucagaugagcuua

SEQ ID NO: 974437 - RNA, 19 nt, Homo sapiens
aggugaguuugagcugccu

SEQ ID NO: 974438 - RNA, 15 nt, Homo sapiens
aggugcuuggaguuu

SEQ ID NO: 974439 - RNA, 18 nt, Homo sapiens
auuauguggcccucugga

SEQ ID NO: 974440 - RNA, 16 nt, Homo sapiens
auuauucauaauguga

SEQ ID NO: 974441 - RNA, 16 nt, Homo sapiens
auucaaaucacaugga

SEQ ID NO: 974442 - RNA, 13 nt, Homo sapiens
auucaacaaauau

SEQ ID NO: 974443 - RNA, 19 nt, Homo sapiens
auucaagaggaaaugucac

SEQ ID NO: 974444 - RNA, 14 nt, Homo sapiens
auucaauccuacuu

SEQ ID NO: 974445 - RNA, 21 nt, Homo sapiens
auucacaguaauaugguuccc

SEQ ID NO: 974446 - RNA, 16 nt, Homo sapiens
auucagaagacuacua

SEQ ID NO: 974447 - RNA, 18 nt, Homo sapiens
auucagagcuauggugcu

SEQ ID NO: 974448 - RNA, 15 nt, Homo sapiens
auucauaaugugaga

SEQ ID NO: 974449 - RNA, 16 nt, Homo sapiens
auucauaaugugagau

SEQ ID NO: 974450 - RNA, 18 nt, Homo sapiens
auucauaccuucugauga

SEQ ID NO: 974451 - RNA, 18 nt, Homo sapiens
auucauggcuaccucaga

SEQ ID NO: 974452 - RNA, 19 nt, Homo sapiens
auucauucguauccagcuc

SEQ ID NO: 974453 - RNA, 16 nt, Homo sapiens
auuccagaucuuucag

SEQ ID NO: 974454 - RNA, 18 nt, Homo sapiens
auuccagcaguuguucca

SEQ ID NO: 974455 - RNA, 22 nt, Homo sapiens
auuccagcaguuguuccaggga

SEQ ID NO: 974456 - RNA, 14 nt, Homo sapiens
auuccagugccagg

SEQ ID NO: 974457 - RNA, 15 nt, Homo sapiens
auucccauguggaac

SEQ ID NO: 974458 - RNA, 15 nt, Homo sapiens
auuccuagaaguuga

SEQ ID NO: 974459 - RNA, 12 nt, Homo sapiens
auuccuaucuca

SEQ ID NO: 974460 - RNA, 20 nt, Homo sapiens
auuccuauuggaaacagaga

SEQ ID NO: 974461 - RNA, 22 nt, Homo sapiens
auuccugggguaaaguaucacu

SEQ ID NO: 974462 - RNA, 22 nt, Homo sapiens
auucuaacccagguauccaaaa

SEQ ID NO: 974463 - RNA, 18 nt, Homo sapiens
auucucccaaaguaccuu

SEQ ID NO: 974464 - RNA, 22 nt, Homo sapiens
auucucuguaaguguagcucaa

SEQ ID NO: 974465 - RNA, 16 nt, Homo sapiens
auucugaaucucaaga

SEQ ID NO: 974466 - RNA, 16 nt, Homo sapiens
auucuguaaaauuuaa

SEQ ID NO: 974467 - RNA, 15 nt, Homo sapiens
auucuguuuccuuaa

SEQ ID NO: 974468 - RNA, 15 nt, Homo sapiens
auucuucacucuguu

SEQ ID NO: 974469 - RNA, 16 nt, Homo sapiens
auucuuuucucagugu

SEQ ID NO: 974470 - RNA, 18 nt, Homo sapiens
auucuuuuguuuccaugg

SEQ ID NO: 974471 - RNA, 18 nt, Homo sapiens
auugaacuuuuguacuga

SEQ ID NO: 974472 - RNA, 21 nt, Homo sapiens
auugaacuuuuguacugaauu

SEQ ID NO: 974473 - RNA, 23 nt, Homo sapiens
auugaccauuuuuuaauuuacuu

SEQ ID NO: 974474 - RNA, 16 nt, Homo sapiens
auugacuaaacaguau

SEQ ID NO: 974475 - RNA, 23 nt, Homo sapiens
auugagccuucgaguggccagcu

SEQ ID NO: 974476 - RNA, 21 nt, Homo sapiens
auugaguuccaguugaaguua

SEQ ID NO: 974477 - RNA, 20 nt, Homo sapiens
auugcaauaaccgcuugguu

SEQ ID NO: 974478 - RNA, 23 nt, Homo sapiens
auugcauuuuuauuaaagcauuu

SEQ ID NO: 974479 - RNA, 15 nt, Homo sapiens
auugggauacuguaa

SEQ ID NO: 974480 - RNA, 14 nt, Homo sapiens
auugguacacgugu

SEQ ID NO: 974481 - RNA, 22 nt, Homo sapiens
auuguaaaaacugaacuauucc

SEQ ID NO: 974482 - RNA, 13 nt, Homo sapiens
auuguaacuaaua

SEQ ID NO: 974483 - RNA, 12 nt, Homo sapiens
auuguacuuaaa

SEQ ID NO: 974484 - RNA, 19 nt, Homo sapiens
auugucaccccaagccaua

SEQ ID NO: 974485 - RNA, 17 nt, Homo sapiens
auugucgcucagcaaua

SEQ ID NO: 974486 - RNA, 16 nt, Homo sapiens
auugugcuucacagua

SEQ ID NO: 974487 - RNA, 19 nt, Homo sapiens
auuguuguaagagugauuu

SEQ ID NO: 974488 - RNA, 20 nt, Homo sapiens
auuuaaauuuuuuuccuuac

SEQ ID NO: 974489 - RNA, 15 nt, Homo sapiens
auuuaagauauguaa

SEQ ID NO: 974490 - RNA, 12 nt, Homo sapiens
auuuaaguauau

SEQ ID NO: 974491 - RNA, 20 nt, Homo sapiens
auuuaagugaauacauuaac

SEQ ID NO: 974492 - RNA, 15 nt, Homo sapiens
auuuaauaaagauga

SEQ ID NO: 974493 - RNA, 22 nt, Homo sapiens
auuuaauuacuucuuaguaugu

SEQ ID NO: 974494 - RNA, 13 nt, Homo sapiens
auuuacaagggaa

SEQ ID NO: 974495 - RNA, 14 nt, Homo sapiens
auuuaccaaagccu

SEQ ID NO: 974496 - RNA, 19 nt, Homo sapiens
auuuaccugauuuuaauca

SEQ ID NO: 974497 - RNA, 22 nt, Homo sapiens
auuuacuaaaucaaucugcagu

SEQ ID NO: 974498 - RNA, 24 nt, Homo sapiens
auuuacuguuuuuuucuguagcac

SEQ ID NO: 974499 - RNA, 13 nt, Homo sapiens
auuuauguguaua

SEQ ID NO: 974500 - RNA, 19 nt, Homo sapiens
auuuauuaguccuaauuca

SEQ ID NO: 974501 - RNA, 12 nt, Homo sapiens
auuucaaaggga

SEQ ID NO: 974502 - RNA, 20 nt, Homo sapiens
auuucaaagggaaacuuuaa

SEQ ID NO: 974503 - RNA, 17 nt, Homo sapiens
auuucaacuacagugau

SEQ ID NO: 974504 - RNA, 22 nt, Homo sapiens
auuucaugaaaaugacauuaaa

SEQ ID NO: 974505 - RNA, 22 nt, Homo sapiens
auuuccagaaccacacuugaaa

SEQ ID NO: 974506 - RNA, 14 nt, Homo sapiens
auuuccucuuauca

SEQ ID NO: 974507 - RNA, 15 nt, Homo sapiens
auuuccuuuuugaca

SEQ ID NO: 974508 - RNA, 20 nt, Homo sapiens
auuuccuuuuugacacugaa

SEQ ID NO: 974509 - RNA, 14 nt, Homo sapiens
auuucuacacugag

SEQ ID NO: 974510 - RNA, 22 nt, Homo sapiens
auuucucucagauuuccacaga

SEQ ID NO: 974511 - RNA, 17 nt, Homo sapiens
auuugagaauacauaaa

SEQ ID NO: 974512 - RNA, 20 nt, Homo sapiens
auuugaugggccacaacugu

SEQ ID NO: 974513 - RNA, 13 nt, Homo sapiens
auuugcuauuuau

SEQ ID NO: 974514 - RNA, 18 nt, Homo sapiens
auuugcuauuuauuaaau

SEQ ID NO: 974515 - RNA, 15 nt, Homo sapiens
auuuggaaugaagga

SEQ ID NO: 974516 - RNA, 17 nt, Homo sapiens
auuuggacaagugcugu

SEQ ID NO: 974517 - RNA, 20 nt, Homo sapiens
auuuguagcucuggaccugu

SEQ ID NO: 974518 - RNA, 18 nt, Homo sapiens
auuuguccuuccuaagaa

SEQ ID NO: 974519 - RNA, 14 nt, Homo sapiens
auuuuaaguacuuu

SEQ ID NO: 974520 - RNA, 16 nt, Homo sapiens
auuuuacaugacagau

SEQ ID NO: 974521 - RNA, 19 nt, Homo sapiens
auuuuagaaacuacaaaua

SEQ ID NO: 974522 - RNA, 15 nt, Homo sapiens
auuuuagaucuuuca

SEQ ID NO: 974523 - RNA, 17 nt, Homo sapiens
auuuucaucaaaaccaa

SEQ ID NO: 974524 - RNA, 23 nt, Homo sapiens
auuuucauccuauaagcuuaaau

SEQ ID NO: 974525 - RNA, 16 nt, Homo sapiens
auuuuccugaaagugu

SEQ ID NO: 974526 - RNA, 22 nt, Homo sapiens
auuuucuaauguugacuuuaau

SEQ ID NO: 974527 - RNA, 19 nt, Homo sapiens
auuuuguaagaaggcaaua

SEQ ID NO: 974528 - RNA, 24 nt, Homo sapiens
auuuugugaauuugggacauaaua

SEQ ID NO: 974529 - RNA, 23 nt, Homo sapiens
auuuuuaaaggcauuagagucaa

SEQ ID NO: 974530 - RNA, 15 nt, Homo sapiens
auuuuucaaggcauu

SEQ ID NO: 974531 - RNA, 22 nt, Homo sapiens
auuuuucaauauauugaacuuu

SEQ ID NO: 974532 - RNA, 16 nt, Homo sapiens
auuuuuuaaggcaaua

SEQ ID NO: 974533 - RNA, 16 nt, Homo sapiens
auuuuuugaaaguuaa

SEQ ID NO: 974534 - RNA, 18 nt, Homo sapiens
auuuuuuugcaugcaugc

SEQ ID NO: 974535 - RNA, 16 nt, Homo sapiens
caaaaaaacaaaaaag

SEQ ID NO: 974536 - RNA, 20 nt, Homo sapiens
caaaaacauuugauuaauaa

SEQ ID NO: 974537 - RNA, 20 nt, Homo sapiens
caaaaagaacuaaauaugca

SEQ ID NO: 974538 - RNA, 23 nt, Homo sapiens
caaaaagaacuaaauaugcaaua

SEQ ID NO: 974539 - RNA, 17 nt, Homo sapiens
caaaaauauuuacacuu

SEQ ID NO: 974540 - RNA, 20 nt, Homo sapiens
caaaaaucuguguaacugua

SEQ ID NO: 974541 - RNA, 14 nt, Homo sapiens
caaaacaaaaagau

SEQ ID NO: 974542 - RNA, 17 nt, Homo sapiens
caaaaccaaguaucaca

SEQ ID NO: 974543 - RNA, 18 nt, Homo sapiens
caaaaggccucuuguaaa

SEQ ID NO: 974544 - RNA, 14 nt, Homo sapiens
caaaauaaugaagu

SEQ ID NO: 974545 - RNA, 15 nt, Homo sapiens
caaaauaaugaaguu

SEQ ID NO: 974546 - RNA, 16 nt, Homo sapiens
caaaauauguuuaaaa

SEQ ID NO: 974547 - RNA, 19 nt, Homo sapiens
caaaauauuuggaaugaag

SEQ ID NO: 974548 - RNA, 11 nt, Homo sapiens
caaacauggcc

SEQ ID NO: 974549 - RNA, 14 nt, Homo sapiens
caaaccuaccaaaa

SEQ ID NO: 974550 - RNA, 15 nt, Homo sapiens
caaaccuaccaaaau

SEQ ID NO: 974551 - RNA, 15 nt, Homo sapiens
caaacugaacacugc

SEQ ID NO: 974552 - RNA, 20 nt, Homo sapiens
caaacugggaaccccuuucc

SEQ ID NO: 974553 - RNA, 15 nt, Homo sapiens
ccacacucuccauca

SEQ ID NO: 974554 - RNA, 18 nt, Homo sapiens
ccacagagagaggggaga

SEQ ID NO: 974555 - RNA, 22 nt, Homo sapiens
ccacagcccugcucauuccuca

SEQ ID NO: 974556 - RNA, 21 nt, Homo sapiens
ccacagcgagggcagcugcua

SEQ ID NO: 974557 - RNA, 16 nt, Homo sapiens
ccacaucccaguuucu

SEQ ID NO: 974558 - RNA, 13 nt, Homo sapiens
ccacaugggaccu

SEQ ID NO: 974559 - RNA, 12 nt, Homo sapiens
ccacauugagau

SEQ ID NO: 974560 - RNA, 20 nt, Homo sapiens
ccacauugagaucacuacuc

SEQ ID NO: 974561 - RNA, 17 nt, Homo sapiens
ccaccaaagcugcccac

SEQ ID NO: 974562 - RNA, 13 nt, Homo sapiens
ccaccacugcagc

SEQ ID NO: 974563 - RNA, 13 nt, Homo sapiens
ccacccagucuca

SEQ ID NO: 974564 - RNA, 12 nt, Homo sapiens
ccaccccaagag

SEQ ID NO: 974565 - RNA, 13 nt, Homo sapiens
ccaccccaagaga

SEQ ID NO: 974566 - RNA, 14 nt, Homo sapiens
ccacccuguuccug

SEQ ID NO: 974567 - RNA, 21 nt, Homo sapiens
ccaccgagccacgcagugccu

SEQ ID NO: 974568 - RNA, 17 nt, Homo sapiens
ccaccucuugugcaagg

SEQ ID NO: 974569 - RNA, 22 nt, Homo sapiens
ccaccuguuuucugaaacacac

SEQ ID NO: 974570 - RNA, 15 nt, Homo sapiens
ccacgcagugccugg

SEQ ID NO: 974571 - RNA, 22 nt, Homo sapiens
ccacucaguucuuccuccaccu

SEQ ID NO: 974572 - RNA, 16 nt, Homo sapiens
ccagaaccacacuuga

SEQ ID NO: 974573 - RNA, 13 nt, Homo sapiens
ccagacaaaugga

SEQ ID NO: 974574 - RNA, 13 nt, Homo sapiens
ccagacacugccu

SEQ ID NO: 974575 - RNA, 23 nt, Homo sapiens
ccagacucaccccaucugcagca

SEQ ID NO: 974576 - RNA, 19 nt, Homo sapiens
ccagagacagaggaugugg

SEQ ID NO: 974577 - RNA, 15 nt, Homo sapiens
ccagagcagaugcag

SEQ ID NO: 974578 - RNA, 17 nt, Homo sapiens
ccagagcagaugcagag

SEQ ID NO: 974579 - RNA, 17 nt, Homo sapiens
ccagaggaauccuggca

SEQ ID NO: 974580 - RNA, 14 nt, Homo sapiens
ccagaggagggcag

SEQ ID NO: 974581 - RNA, 22 nt, Homo sapiens
ccagaggugcccgcucuucccu

SEQ ID NO: 974582 - RNA, 19 nt, Homo sapiens
ccagagguggauguuauga

SEQ ID NO: 974583 - RNA, 22 nt, Homo sapiens
ccagauaacuuucggcagguuc

SEQ ID NO: 974584 - RNA, 15 nt, Homo sapiens
ccagaucacugccac

SEQ ID NO: 974585 - RNA, 22 nt, Homo sapiens
ccagaucacugccacacucucc

SEQ ID NO: 974586 - RNA, 13 nt, Homo sapiens
ccagaucuuucag

SEQ ID NO: 974587 - RNA, 21 nt, Homo sapiens
ccagaugugugcaauguggca

SEQ ID NO: 974588 - RNA, 16 nt, Homo sapiens
ccagcaagcucuucac

SEQ ID NO: 974589 - RNA, 15 nt, Homo sapiens
ccagcacuuggcuga

SEQ ID NO: 974590 - RNA, 17 nt, Homo sapiens
ccagcagcuggguuggg

SEQ ID NO: 974591 - RNA, 13 nt, Homo sapiens
ccagcauccagcu

SEQ ID NO: 974592 - RNA, 12 nt, Homo sapiens
ccagcaucugga

SEQ ID NO: 974593 - RNA, 15 nt, Homo sapiens
ccagcaucuggagac

SEQ ID NO: 974594 - RNA, 17 nt, Homo sapiens
ccagcaucuggagaccg

SEQ ID NO: 974595 - RNA, 16 nt, Homo sapiens
ccagccccacugccag

SEQ ID NO: 974596 - RNA, 17 nt, Homo sapiens
ccagccccacugccagc

SEQ ID NO: 974597 - RNA, 18 nt, Homo sapiens
ccagccccggcaagccac

SEQ ID NO: 974598 - RNA, 17 nt, Homo sapiens
ccagccucaugggaagu

SEQ ID NO: 974599 - RNA, 19 nt, Homo sapiens
ccagccuccccgugccaaa

SEQ ID NO: 974600 - RNA, 20 nt, Homo sapiens
ccagccuggggaacagagca

SEQ ID NO: 974601 - RNA, 23 nt, Homo sapiens
ccagcgaucucuccacugugcuu

SEQ ID NO: 974602 - RNA, 19 nt, Homo sapiens
ccagcucauucucaccaau

SEQ ID NO: 974603 - RNA, 12 nt, Homo sapiens
ccagcuggagaa

SEQ ID NO: 974604 - RNA, 20 nt, Homo sapiens
ccagcuuaaaggcaguauuu

SEQ ID NO: 974605 - RNA, 19 nt, Homo sapiens
ccagcuuagcaacugcugg

SEQ ID NO: 974606 - RNA, 18 nt, Homo sapiens
ccaggaguagugagcugu

SEQ ID NO: 974607 - RNA, 20 nt, Homo sapiens
ccaggaucaugguguaauaa

SEQ ID NO: 974608 - RNA, 13 nt, Homo sapiens
ccaggaugcuaaa

SEQ ID NO: 974609 - RNA, 12 nt, Homo sapiens
ccaggccaguga

SEQ ID NO: 974610 - RNA, 23 nt, Homo sapiens
ccaggcccagaaggaaccagcca

SEQ ID NO: 974611 - RNA, 12 nt, Homo sapiens
ccaggcccagau

SEQ ID NO: 974612 - RNA, 16 nt, Homo sapiens
ccaggcuccagcacau

SEQ ID NO: 974613 - RNA, 22 nt, Homo sapiens
ccagggauuaggagcagcucuu

SEQ ID NO: 974614 - RNA, 17 nt, Homo sapiens
ccagggauuugccucac

SEQ ID NO: 974615 - RNA, 17 nt, Homo sapiens
ccagggcuuugcuccag

SEQ ID NO: 974616 - RNA, 22 nt, Homo sapiens
ccagguaggauacguacaccuc

SEQ ID NO: 974617 - RNA, 15 nt, Homo sapiens
ccaggugauucuguu

SEQ ID NO: 974618 - RNA, 22 nt, Homo sapiens
ccagguucucuuagagccauau

SEQ ID NO: 974619 - RNA, 18 nt, Homo sapiens
ccagguuuuucaaaagga

SEQ ID NO: 974620 - RNA, 13 nt, Homo sapiens
ccaguacugggaa

SEQ ID NO: 974621 - RNA, 20 nt, Homo sapiens
ccagucugugaagucaagaa

SEQ ID NO: 974622 - RNA, 23 nt, Homo sapiens
ccagugaggucggggauuuugag

SEQ ID NO: 974623 - RNA, 17 nt, Homo sapiens
ccagugccaggccagug

SEQ ID NO: 974624 - RNA, 17 nt, Homo sapiens
ccauaaauccuugauga

SEQ ID NO: 974625 - RNA, 23 nt, Homo sapiens
ccauaagaggugaucucugggag

SEQ ID NO: 974626 - RNA, 20 nt, Homo sapiens
ccauaauaagagaauguucc

SEQ ID NO: 974627 - RNA, 23 nt, Homo sapiens
ccauaaugagaugugagccuugu

SEQ ID NO: 974628 - RNA, 14 nt, Homo sapiens
ccauacuucucuca

SEQ ID NO: 974629 - RNA, 15 nt, Homo sapiens
ccauauuaaaaucug

SEQ ID NO: 974630 - RNA, 22 nt, Homo sapiens
ccauauugugcuucacaguaga

SEQ ID NO: 974631 - RNA, 22 nt, Homo sapiens
ccaucaugcggugggugcugcc

SEQ ID NO: 974632 - RNA, 14 nt, Homo sapiens
ccauccaucuuucc

SEQ ID NO: 974633 - RNA, 20 nt, Homo sapiens
ccauccaucuuuccauccau

SEQ ID NO: 974634 - RNA, 17 nt, Homo sapiens
ccauccauuaccuccau

SEQ ID NO: 974635 - RNA, 16 nt, Homo sapiens
ccauccccacccaguc

SEQ ID NO: 974636 - RNA, 21 nt, Homo sapiens
ccauccuggccaacaugguga

SEQ ID NO: 974637 - RNA, 19 nt, Homo sapiens
ccaugaaacugacucauca

SEQ ID NO: 974638 - RNA, 10 nt, Homo sapiens
ccaugaauua

SEQ ID NO: 974639 - RNA, 19 nt, Homo sapiens
ccauggcuguguuggugug

SEQ ID NO: 974640 - RNA, 20 nt, Homo sapiens
ccauggcuguguuggugugg

SEQ ID NO: 974641 - RNA, 10 nt, Homo sapiens
ccauguccaa

SEQ ID NO: 974642 - RNA, 16 nt, Homo sapiens
ccauuacagagguauu

SEQ ID NO: 974643 - RNA, 16 nt, Homo sapiens
ccauuaccuccaucca

SEQ ID NO: 974644 - RNA, 22 nt, Homo sapiens
ccauuagagaguggcaauagga

SEQ ID NO: 974645 - RNA, 22 nt, Homo sapiens
ccauucacaauaaaagcuuaaa

SEQ ID NO: 974646 - RNA, 22 nt, Homo sapiens
ccauuuccuccuuuaccuuuca

SEQ ID NO: 974647 - RNA, 23 nt, Homo sapiens
ccauuucugaggugcacugggag

SEQ ID NO: 974648 - RNA, 12 nt, Homo sapiens
ccauuugcaaua

SEQ ID NO: 974649 - RNA, 14 nt, Homo sapiens
ccauuuugugaaug

SEQ ID NO: 974650 - RNA, 22 nt, Homo sapiens
ccauuuuuuuuaaguuugacua

SEQ ID NO: 974651 - RNA, 14 nt, Homo sapiens
cccaaaggcaucca

SEQ ID NO: 974652 - RNA, 16 nt, Homo sapiens
cccaacucuugcacag

SEQ ID NO: 974653 - RNA, 18 nt, Homo sapiens
cccaagugaggagugcca

SEQ ID NO: 974654 - RNA, 17 nt, Homo sapiens
cccaaucugccagacuu

SEQ ID NO: 974655 - RNA, 12 nt, Homo sapiens
cccaaugaauua

SEQ ID NO: 974656 - RNA, 17 nt, Homo sapiens
cccacaaccuuccagcu

SEQ ID NO: 974657 - RNA, 14 nt, Homo sapiens
cccacaagccagga

SEQ ID NO: 974658 - RNA, 14 nt, Homo sapiens
cccacaugggaccu

SEQ ID NO: 974659 - RNA, 23 nt, Homo sapiens
cccacaugugacacauaugcacc

SEQ ID NO: 974660 - RNA, 19 nt, Homo sapiens
cccaccacauagcaugcuu

SEQ ID NO: 974661 - RNA, 14 nt, Homo sapiens
cccacccacaugug

SEQ ID NO: 974662 - RNA, 18 nt, Homo sapiens
cccacugacccacucgga

SEQ ID NO: 974663 - RNA, 13 nt, Homo sapiens
cccacugcuucua

SEQ ID NO: 974664 - RNA, 19 nt, Homo sapiens
cccacuugucaaguucagc

SEQ ID NO: 974665 - RNA, 10 nt, Homo sapiens
cccacuuuga

SEQ ID NO: 974666 - RNA, 12 nt, Homo sapiens
cccacuuugaag

SEQ ID NO: 974667 - RNA, 21 nt, Homo sapiens
cccagagggaguagaauacgc

SEQ ID NO: 974668 - RNA, 19 nt, Homo sapiens
gggaagcccugugggccac

SEQ ID NO: 974669 - RNA, 21 nt, Homo sapiens
gggaccuggggaccucugggc

SEQ ID NO: 974670 - RNA, 18 nt, Homo sapiens
gggacucguggcugucaa

SEQ ID NO: 974671 - RNA, 21 nt, Homo sapiens
gggagauuuuuuugagucaaa

SEQ ID NO: 974672 - RNA, 18 nt, Homo sapiens
gggaugccaauuuccucu

SEQ ID NO: 974673 - RNA, 17 nt, Homo sapiens
gggauugcuuugcauua

SEQ ID NO: 974674 - RNA, 22 nt, Homo sapiens
gggauuucucccucucagugga

SEQ ID NO: 974675 - RNA, 21 nt, Homo sapiens
gggcaggcugggccaugucca

SEQ ID NO: 974676 - RNA, 18 nt, Homo sapiens
gggcagucggcuccucaa

SEQ ID NO: 974677 - RNA, 18 nt, Homo sapiens
gggcccagaccacugucu

SEQ ID NO: 974678 - RNA, 17 nt, Homo sapiens
gggccgugagggguccc

SEQ ID NO: 974679 - RNA, 11 nt, Homo sapiens
gggccucagug

SEQ ID NO: 974680 - RNA, 20 nt, Homo sapiens
gggcgagccaggaccacaga

SEQ ID NO: 974681 - RNA, 12 nt, Homo sapiens
gggcgcgguggc

SEQ ID NO: 974682 - RNA, 17 nt, Homo sapiens
gggcgugggcgcuugca

SEQ ID NO: 974683 - RNA, 18 nt, Homo sapiens
gggcucuagggacugcca

SEQ ID NO: 974684 - RNA, 15 nt, Homo sapiens
gggcugccaccagcc

SEQ ID NO: 974685 - RNA, 15 nt, Homo sapiens
gggcuugaagccaaa

SEQ ID NO: 974686 - RNA, 16 nt, Homo sapiens
ggggagagacaggcag

SEQ ID NO: 974687 - RNA, 18 nt, Homo sapiens
ggggcaggcugggccaug

SEQ ID NO: 974688 - RNA, 15 nt, Homo sapiens
gggggcuccacccca

SEQ ID NO: 974689 - RNA, 12 nt, Homo sapiens
gggguuccucaa

SEQ ID NO: 974690 - RNA, 20 nt, Homo sapiens
gggugccgaagcuacuggac

SEQ ID NO: 974691 - RNA, 14 nt, Homo sapiens
ggguggggccauaa

SEQ ID NO: 974692 - RNA, 19 nt, Homo sapiens
gggugugcccacgaagaca

SEQ ID NO: 974693 - RNA, 17 nt, Homo sapiens
ggguugugcacauuucu

SEQ ID NO: 974694 - RNA, 13 nt, Homo sapiens
gguaaauguuucu

SEQ ID NO: 974695 - RNA, 13 nt, Homo sapiens
gguacagcagggu

SEQ ID NO: 974696 - RNA, 13 nt, Homo sapiens
gguagaacacugc

SEQ ID NO: 974697 - RNA, 21 nt, Homo sapiens
gguaugucugccauguugccc

SEQ ID NO: 974698 - RNA, 12 nt, Homo sapiens
ggucacaugaug

SEQ ID NO: 974699 - RNA, 12 nt, Homo sapiens
ggucaccuggug

SEQ ID NO: 974700 - RNA, 16 nt, Homo sapiens
ggucagucuuugcuca

SEQ ID NO: 974701 - RNA, 15 nt, Homo sapiens
ggucccaauuaagaa

SEQ ID NO: 974702 - RNA, 19 nt, Homo sapiens
gguccuucaaacaauguaa

SEQ ID NO: 974703 - RNA, 23 nt, Homo sapiens
ggucucagccuaggcccucauga

SEQ ID NO: 974704 - RNA, 22 nt, Homo sapiens
ggucugggcugggcaccugacu

SEQ ID NO: 974705 - RNA, 15 nt, Homo sapiens
ggugaaggcaagaga

SEQ ID NO: 974706 - RNA, 20 nt, Homo sapiens
ggugacaguccaaaccacuc

SEQ ID NO: 974707 - RNA, 16 nt, Homo sapiens
ggugagaaaucacaau

SEQ ID NO: 974708 - RNA, 16 nt, Homo sapiens
ggugaggguuggcgcu

SEQ ID NO: 974709 - RNA, 13 nt, Homo sapiens
ggugcacugggag

SEQ ID NO: 974710 - RNA, 21 nt, Homo sapiens
ggugccaggcuguaagcauuc

SEQ ID NO: 974711 - RNA, 22 nt, Homo sapiens
ggugcuauccugcccaggccag

SEQ ID NO: 974712 - RNA, 14 nt, Homo sapiens
gguggggccauaaa

SEQ ID NO: 974713 - RNA, 13 nt, Homo sapiens
gguguagcacuua

SEQ ID NO: 974714 - RNA, 14 nt, Homo sapiens
ggugugaacauguu

SEQ ID NO: 974715 - RNA, 14 nt, Homo sapiens
gguuccuccucucc

SEQ ID NO: 974716 - RNA, 16 nt, Homo sapiens
gguuccuggugacucc

SEQ ID NO: 974717 - RNA, 18 nt, Homo sapiens
gguuccuggugacuccug

SEQ ID NO: 974718 - RNA, 20 nt, Homo sapiens
gguucuuaaaaaggaacaaa

SEQ ID NO: 974719 - RNA, 21 nt, Homo sapiens
gguuggauggauggguggaug

SEQ ID NO: 974720 - RNA, 15 nt, Homo sapiens
gguugggcagccaga

SEQ ID NO: 974721 - RNA, 19 nt, Homo sapiens
gguugucuuauugcaccau

SEQ ID NO: 974722 - RNA, 16 nt, Homo sapiens
gguugugcacuguuua

SEQ ID NO: 974723 - RNA, 18 nt, Homo sapiens
gguuuuauuucaaaggga

SEQ ID NO: 974724 - RNA, 19 nt, Homo sapiens
gguuuuuuucuucuguauu

SEQ ID NO: 974725 - RNA, 18 nt, Homo sapiens
guaaaaaaaccaccaaaa

SEQ ID NO: 974726 - RNA, 14 nt, Homo sapiens
guaaaacaguuaca

SEQ ID NO: 974727 - RNA, 17 nt, Homo sapiens
guaaacgggaacaugcc

SEQ ID NO: 974728 - RNA, 16 nt, Homo sapiens
guaaauagcuaagaua

SEQ ID NO: 974729 - RNA, 14 nt, Homo sapiens
guaaaugucuucau

SEQ ID NO: 974730 - RNA, 12 nt, Homo sapiens
guaaauguuucu

SEQ ID NO: 974731 - RNA, 23 nt, Homo sapiens
guaacuugcuuaaauuucuuaug

SEQ ID NO: 974732 - RNA, 19 nt, Homo sapiens
guaagcauuuguacaucuu

SEQ ID NO: 974733 - RNA, 22 nt, Homo sapiens
guaaguauuuagaagugugaau

SEQ ID NO: 974734 - RNA, 16 nt, Homo sapiens
guaaguuaucuuugaa

SEQ ID NO: 974735 - RNA, 17 nt, Homo sapiens
guaauaagcaaucaagg

SEQ ID NO: 974736 - RNA, 20 nt, Homo sapiens
guaauaauaaaaccaaagaa

SEQ ID NO: 974737 - RNA, 20 nt, Homo sapiens
guaauaucaguuacaguggc

SEQ ID NO: 974738 - RNA, 13 nt, Homo sapiens
guaauuauuuucc

SEQ ID NO: 974739 - RNA, 13 nt, Homo sapiens
guaauuccagcua

SEQ ID NO: 974740 - RNA, 16 nt, Homo sapiens
guaauuucaaaauaca

SEQ ID NO: 974741 - RNA, 22 nt, Homo sapiens
guacaauuucaacuacagugau

SEQ ID NO: 974742 - RNA, 19 nt, Homo sapiens
guacaccacuuucccacac

SEQ ID NO: 974743 - RNA, 17 nt, Homo sapiens
guacacguguccuguag

SEQ ID NO: 974744 - RNA, 15 nt, Homo sapiens
guacagauucuuuca

SEQ ID NO: 974745 - RNA, 19 nt, Homo sapiens
guacaucaaugauaaugcu

SEQ ID NO: 974746 - RNA, 17 nt, Homo sapiens
guacauuguauucuguu

SEQ ID NO: 974747 - RNA, 19 nt, Homo sapiens
guagaggcugggggcucca

SEQ ID NO: 974748 - RNA, 18 nt, Homo sapiens
guagauguggccuuugaa

SEQ ID NO: 974749 - RNA, 13 nt, Homo sapiens
guagcagucuuca

SEQ ID NO: 974750 - RNA, 17 nt, Homo sapiens
guagccugugcauguau

SEQ ID NO: 974751 - RNA, 15 nt, Homo sapiens
guagcguacaucaau

SEQ ID NO: 974752 - RNA, 21 nt, Homo sapiens
guagucucuccccuggccaca

SEQ ID NO: 974753 - RNA, 22 nt, Homo sapiens
guauaauagagauaaguccauu

SEQ ID NO: 974754 - RNA, 13 nt, Homo sapiens
guauauccaaaag

SEQ ID NO: 974755 - RNA, 18 nt, Homo sapiens
guaucccacauccaacuc

SEQ ID NO: 974756 - RNA, 17 nt, Homo sapiens
guaucuucauaaucuuu

SEQ ID NO: 974757 - RNA, 14 nt, Homo sapiens
guaugacuaaagag

SEQ ID NO: 974758 - RNA, 18 nt, Homo sapiens
guaugcauucacauuuag

SEQ ID NO: 974759 - RNA, 18 nt, Homo sapiens
guauguguaccuaaggga

SEQ ID NO: 974760 - RNA, 18 nt, Homo sapiens
guauuaaacucuaaugua

SEQ ID NO: 974761 - RNA, 18 nt, Homo sapiens
guauuaugucucuucuga

SEQ ID NO: 974762 - RNA, 23 nt, Homo sapiens
guauuucuaauuccacaggucau

SEQ ID NO: 974763 - RNA, 18 nt, Homo sapiens
gucaacuuauucuuugag

SEQ ID NO: 974764 - RNA, 20 nt, Homo sapiens
gucaaggcaguagaacucca

SEQ ID NO: 974765 - RNA, 18 nt, Homo sapiens
gucacaauuaugugcaaa

SEQ ID NO: 974766 - RNA, 17 nt, Homo sapiens
gucacagaagcagcuaa

SEQ ID NO: 974767 - RNA, 18 nt, Homo sapiens
gucacguuuggugcuucu

SEQ ID NO: 974768 - RNA, 14 nt, Homo sapiens
gucacuagucucac

SEQ ID NO: 974769 - RNA, 19 nt, Homo sapiens
gucacugccugacauucac

SEQ ID NO: 974770 - RNA, 15 nt, Homo sapiens
gucagaccaguacug

SEQ ID NO: 974771 - RNA, 19 nt, Homo sapiens
gucagaccaguacugggaa

SEQ ID NO: 974772 - RNA, 11 nt, Homo sapiens
gucagccagcu

SEQ ID NO: 974773 - RNA, 20 nt, Homo sapiens
gucagccuugcaucaagggc

SEQ ID NO: 974774 - RNA, 20 nt, Homo sapiens
gucagggugaacugcaaagc

SEQ ID NO: 974775 - RNA, 14 nt, Homo sapiens
gucaguacuauuca

SEQ ID NO: 974776 - RNA, 17 nt, Homo sapiens
gucaguucuaaccuccu

SEQ ID NO: 974777 - RNA, 17 nt, Homo sapiens
gucauagagcccaguga

SEQ ID NO: 974778 - RNA, 16 nt, Homo sapiens
gucaucaaagcagaag

SEQ ID NO: 974779 - RNA, 21 nt, Homo sapiens
gucaucccagugcacauggca

SEQ ID NO: 974780 - RNA, 12 nt, Homo sapiens
gucaugauugcc

SEQ ID NO: 974781 - RNA, 20 nt, Homo sapiens
gucaugcauaaauaugcagu

SEQ ID NO: 974782 - RNA, 19 nt, Homo sapiens
gucauggcuaauuuaacac

SEQ ID NO: 974783 - RNA, 22 nt, Homo sapiens
ucaccaucaauuuuaguuguca

SEQ ID NO: 974784 - RNA, 19 nt, Homo sapiens
ucacccaccucuugugcaa

SEQ ID NO: 974785 - RNA, 17 nt, Homo sapiens
ucacccaucagauaccu

SEQ ID NO: 974786 - RNA, 18 nt, Homo sapiens
ucaccgcugggugguuuu

SEQ ID NO: 974787 - RNA, 17 nt, Homo sapiens
ucaccucacaaaccuga

SEQ ID NO: 974788 - RNA, 23 nt, Homo sapiens
ucaccuuggaggcccugcacugc

SEQ ID NO: 974789 - RNA, 21 nt, Homo sapiens
ucacguuuggugcuucucaga

SEQ ID NO: 974790 - RNA, 16 nt, Homo sapiens
ucacucaccauuccca

SEQ ID NO: 974791 - RNA, 16 nt, Homo sapiens
ucacucccaccugcau

SEQ ID NO: 974792 - RNA, 19 nt, Homo sapiens
ucacuccccacaucccauc

SEQ ID NO: 974793 - RNA, 14 nt, Homo sapiens
ucacugcucuucag

SEQ ID NO: 974794 - RNA, 19 nt, Homo sapiens
ucacugcuuguuaugcauc

SEQ ID NO: 974795 - RNA, 24 nt, Homo sapiens
ucacuggccccuacuuuguggcaa

SEQ ID NO: 974796 - RNA, 21 nt, Homo sapiens
ucacuuagaauccgaagggaa

SEQ ID NO: 974797 - RNA, 15 nt, Homo sapiens
ucacuucauaaucca

SEQ ID NO: 974798 - RNA, 15 nt, Homo sapiens
ucacuucauagcuca

SEQ ID NO: 974799 - RNA, 19 nt, Homo sapiens
ucacuuucucaguuuucau

SEQ ID NO: 974800 - RNA, 14 nt, Homo sapiens
ucagaaagauuuga

SEQ ID NO: 974801 - RNA, 12 nt, Homo sapiens
ucagaaagggau

SEQ ID NO: 974802 - RNA, 16 nt, Homo sapiens
ucagaagcaagccaga

SEQ ID NO: 974803 - RNA, 15 nt, Homo sapiens
ucagaccaguacugg

SEQ ID NO: 974804 - RNA, 17 nt, Homo sapiens
ucagauguguguucuca

SEQ ID NO: 974805 - RNA, 18 nt, Homo sapiens
ucagcaaacuaaccagca

SEQ ID NO: 974806 - RNA, 21 nt, Homo sapiens
ucagcacaggaauucucaaga

SEQ ID NO: 974807 - RNA, 20 nt, Homo sapiens
ucagccaugaaacugacuca

SEQ ID NO: 974808 - RNA, 17 nt, Homo sapiens
ucagcccucaguuccuu

SEQ ID NO: 974809 - RNA, 19 nt, Homo sapiens
ucagccuccgccauuccaa

SEQ ID NO: 974810 - RNA, 15 nt, Homo sapiens
ucagccuuagcucuc

SEQ ID NO: 974811 - RNA, 13 nt, Homo sapiens
ucagcgacugcca

SEQ ID NO: 974812 - RNA, 19 nt, Homo sapiens
ucagcgacugccacaucau

SEQ ID NO: 974813 - RNA, 20 nt, Homo sapiens
ucagcugggucacauccauc

SEQ ID NO: 974814 - RNA, 17 nt, Homo sapiens
ucaggaguugaagacca

SEQ ID NO: 974815 - RNA, 20 nt, Homo sapiens
ucaguaacugucaggcugaa

SEQ ID NO: 974816 - RNA, 15 nt, Homo sapiens
ucagucuuugcucag

SEQ ID NO: 974817 - RNA, 18 nt, Homo sapiens
ucagugacuuugagcuga

SEQ ID NO: 974818 - RNA, 20 nt, Homo sapiens
ucagugcaguuucuuuucac

SEQ ID NO: 974819 - RNA, 23 nt, Homo sapiens
ucagugcauagcgaagaccagua

SEQ ID NO: 974820 - RNA, 16 nt, Homo sapiens
ucagugccccauucuc

SEQ ID NO: 974821 - RNA, 18 nt, Homo sapiens
ucagugccccauucucac

SEQ ID NO: 974822 - RNA, 20 nt, Homo sapiens
ucagugccgaccugcgccaa

SEQ ID NO: 974823 - RNA, 12 nt, Homo sapiens
ucaucaaaaaga

SEQ ID NO: 974824 - RNA, 17 nt, Homo sapiens
ucaucaaaaagaacaac

SEQ ID NO: 974825 - RNA, 14 nt, Homo sapiens
ucaucaaaaccaag

SEQ ID NO: 974826 - RNA, 23 nt, Homo sapiens
ucaucaaagcagaagucuggcuu

SEQ ID NO: 974827 - RNA, 16 nt, Homo sapiens
ucaucacuaguggcaa

SEQ ID NO: 974828 - RNA, 17 nt, Homo sapiens
ucaucagaugccugcuu

SEQ ID NO: 974829 - RNA, 14 nt, Homo sapiens
ucaucccagugcac

SEQ ID NO: 974830 - RNA, 21 nt, Homo sapiens
ucaucuuccuguguccugaaa

SEQ ID NO: 974831 - RNA, 10 nt, Homo sapiens
ucaugaaauu

SEQ ID NO: 974832 - RNA, 20 nt, Homo sapiens
ucaugaagcccaaccugcag

SEQ ID NO: 974833 - RNA, 13 nt, Homo sapiens
ucaugacauaaua

SEQ ID NO: 974834 - RNA, 17 nt, Homo sapiens
ucaugagccugcuggaa

SEQ ID NO: 974835 - RNA, 21 nt, Homo sapiens
ucaugaguagugggcuaugca

SEQ ID NO: 974836 - RNA, 19 nt, Homo sapiens
ucaugcauguccuguaaag

SEQ ID NO: 974837 - RNA, 15 nt, Homo sapiens
ucaugcuuuugcuau

SEQ ID NO: 974838 - RNA, 17 nt, Homo sapiens
ucauggcuaauuuaaca

SEQ ID NO: 974839 - RNA, 16 nt, Homo sapiens
ucauggcuaccucaga

SEQ ID NO: 974840 - RNA, 13 nt, Homo sapiens
ucaugugccaucu

SEQ ID NO: 974841 - RNA, 15 nt, Homo sapiens
ucauguucuagucug

SEQ ID NO: 974842 - RNA, 18 nt, Homo sapiens
ucauuccucacgcccuuc

SEQ ID NO: 974843 - RNA, 21 nt, Homo sapiens
ucauuccuuagauaccuugaa

SEQ ID NO: 974844 - RNA, 14 nt, Homo sapiens
ucauuucauuucag

SEQ ID NO: 974845 - RNA, 15 nt, Homo sapiens
uccaaaacaaaaaga

SEQ ID NO: 974846 - RNA, 15 nt, Homo sapiens
uccaaagaaagauua

SEQ ID NO: 974847 - RNA, 12 nt, Homo sapiens
uccaaagaggcu

SEQ ID NO: 974848 - RNA, 22 nt, Homo sapiens
uccaacucagauugagcccuac

SEQ ID NO: 974849 - RNA, 14 nt, Homo sapiens
uccaagcauuucau

SEQ ID NO: 974850 - RNA, 22 nt, Homo sapiens
uccaaggguaugggaagccaua

SEQ ID NO: 974851 - RNA, 16 nt, Homo sapiens
uccaagucaacacucu

SEQ ID NO: 974852 - RNA, 17 nt, Homo sapiens
uccaaguugcuaauaca

SEQ ID NO: 974853 - RNA, 14 nt, Homo sapiens
uccacccaccucag

SEQ ID NO: 974854 - RNA, 14 nt, Homo sapiens
uccacccauccagu

SEQ ID NO: 974855 - RNA, 16 nt, Homo sapiens
uccaccgccacugggc

SEQ ID NO: 974856 - RNA, 17 nt, Homo sapiens
uccacgcuucuccggau

SEQ ID NO: 974857 - RNA, 14 nt, Homo sapiens
uccagaacacucuu

SEQ ID NO: 974858 - RNA, 22 nt, Homo sapiens
uccagaaucgcuagacuaagaa

SEQ ID NO: 974859 - RNA, 23 nt, Homo sapiens
uccagaauugguaaaaacagcag

SEQ ID NO: 974860 - RNA, 22 nt, Homo sapiens
uccagagaggaccuaucccaaa

SEQ ID NO: 974861 - RNA, 15 nt, Homo sapiens
uccagaucacugcca

SEQ ID NO: 974862 - RNA, 19 nt, Homo sapiens
uccagauguggcuacugac

SEQ ID NO: 974863 - RNA, 17 nt, Homo sapiens
uccagccucuccuccau

SEQ ID NO: 974864 - RNA, 23 nt, Homo sapiens
uccagccuggcucuaucuuccuc

SEQ ID NO: 974865 - RNA, 15 nt, Homo sapiens
uccagcuuucugcca

SEQ ID NO: 974866 - RNA, 17 nt, Homo sapiens
uccaggcuccagcacau

SEQ ID NO: 974867 - RNA, 21 nt, Homo sapiens
uccagguucucuuagagccau

SEQ ID NO: 974868 - RNA, 19 nt, Homo sapiens
uccaguuccucuuuugugc

SEQ ID NO: 974869 - RNA, 15 nt, Homo sapiens
uccaguuuucuccuc

SEQ ID NO: 974870 - RNA, 23 nt, Homo sapiens
uccaguuuucuccucugcuucuu

SEQ ID NO: 974871 - RNA, 18 nt, Homo sapiens
uccauaaauccuugauga

SEQ ID NO: 974872 - RNA, 23 nt, Homo sapiens
uccaucacccucuuccugugauc

SEQ ID NO: 974873 - RNA, 12 nt, Homo sapiens
uccaucaugccc

SEQ ID NO: 974874 - RNA, 14 nt, Homo sapiens
uccaucucccuuag

SEQ ID NO: 974875 - RNA, 17 nt, Homo sapiens
uccaucucugucucaaa

SEQ ID NO: 974876 - RNA, 17 nt, Homo sapiens
uccaucuuuccauccau

SEQ ID NO: 974877 - RNA, 16 nt, Homo sapiens
uccauguccccuccca

SEQ ID NO: 974878 - RNA, 19 nt, Homo sapiens
uccauuagagaguggcaau

SEQ ID NO: 974879 - RNA, 18 nt, Homo sapiens
uccauuccccacuucucu

SEQ ID NO: 974880 - RNA, 15 nt, Homo sapiens
uccauucucugaguc

SEQ ID NO: 974881 - RNA, 22 nt, Homo sapiens
uccauuuccauguccccuccca

SEQ ID NO: 974882 - RNA, 13 nt, Homo sapiens
uccauuuucaagc

SEQ ID NO: 974883 - RNA, 14 nt, Homo sapiens
ucccaacacuguca

SEQ ID NO: 974884 - RNA, 16 nt, Homo sapiens
ucccaauaucauguga

SEQ ID NO: 974885 - RNA, 14 nt, Homo sapiens
ucccacacugugaa

SEQ ID NO: 974886 - RNA, 16 nt, Homo sapiens
ucccacuccaagccca

SEQ ID NO: 974887 - RNA, 12 nt, Homo sapiens
ucccacucucag

SEQ ID NO: 974888 - RNA, 18 nt, Homo sapiens
ucccacuguuuaaggagu

SEQ ID NO: 974889 - RNA, 20 nt, Homo sapiens
ucccagccccggcaagccac

SEQ ID NO: 974890 - RNA, 20 nt, Homo sapiens
ucccaggacucugaccccag

SEQ ID NO: 974891 - RNA, 13 nt, Homo sapiens
ucccagucuguga

SEQ ID NO: 974892 - RNA, 16 nt, Homo sapiens
ucccagucugugaagu

SEQ ID NO: 974893 - RNA, 18 nt, Homo sapiens
ucccagugcacauggcag

SEQ ID NO: 974894 - RNA, 17 nt, Homo sapiens
ucccauccuugaugcaa

SEQ ID NO: 974895 - RNA, 13 nt, Homo sapiens
uccccaagcaccu

SEQ ID NO: 974896 - RNA, 17 nt, Homo sapiens
uccccaagcaccuuccc

SEQ ID NO: 974897 - RNA, 14 nt, Homo sapiens
uccccaaggacucu

SEQ ID NO: 974898 - RNA, 20 nt, Homo sapiens
ugcuuccugucuuauccucc

SEQ ID NO: 974899 - RNA, 16 nt, Homo sapiens
ugcuucgucaauggcu

SEQ ID NO: 974900 - RNA, 17 nt, Homo sapiens
ugcuugagagacacugg

SEQ ID NO: 974901 - RNA, 19 nt, Homo sapiens
ugcuugggaagacuccuag

SEQ ID NO: 974902 - RNA, 14 nt, Homo sapiens
ugcuuucagcacuc

SEQ ID NO: 974903 - RNA, 18 nt, Homo sapiens
ugcuuugaauaaaugugu

SEQ ID NO: 974904 - RNA, 18 nt, Homo sapiens
ugcuuuuuggaaagucag

SEQ ID NO: 974905 - RNA, 14 nt, Homo sapiens
uggaaaaaaaccac

SEQ ID NO: 974906 - RNA, 17 nt, Homo sapiens
uggaaaaaaaccacagc

SEQ ID NO: 974907 - RNA, 18 nt, Homo sapiens
uggaaaucugaacauucu

SEQ ID NO: 974908 - RNA, 12 nt, Homo sapiens
uggaaaugucug

SEQ ID NO: 974909 - RNA, 12 nt, Homo sapiens
uggaagaaggga

SEQ ID NO: 974910 - RNA, 18 nt, Homo sapiens
uggaagaagugagcagug

SEQ ID NO: 974911 - RNA, 17 nt, Homo sapiens
uggaaguuuagcucuga

SEQ ID NO: 974912 - RNA, 17 nt, Homo sapiens
uggaauacagucauucc

SEQ ID NO: 974913 - RNA, 17 nt, Homo sapiens
uggaaucuacaagccaa

SEQ ID NO: 974914 - RNA, 19 nt, Homo sapiens
uggaaucuuuguaccaaaa

SEQ ID NO: 974915 - RNA, 21 nt, Homo sapiens
uggaauuccagugccaggcca

SEQ ID NO: 974916 - RNA, 16 nt, Homo sapiens
uggaauugacugccua

SEQ ID NO: 974917 - RNA, 15 nt, Homo sapiens
uggacacgagccaca

SEQ ID NO: 974918 - RNA, 12 nt, Homo sapiens
uggacagccagu

SEQ ID NO: 974919 - RNA, 22 nt, Homo sapiens
uggaccaauagggcugagcucu

SEQ ID NO: 974920 - RNA, 15 nt, Homo sapiens
uggaccaugccagau

SEQ ID NO: 974921 - RNA, 19 nt, Homo sapiens
uggacccagggaacagcca

SEQ ID NO: 974922 - RNA, 16 nt, Homo sapiens
uggagaaccagggcuc

SEQ ID NO: 974923 - RNA, 20 nt, Homo sapiens
uggagacaaggugcuaacau

SEQ ID NO: 974924 - RNA, 22 nt, Homo sapiens
uggagacccugccacagccaga

SEQ ID NO: 974925 - RNA, 16 nt, Homo sapiens
uggaggaagagccacc

SEQ ID NO: 974926 - RNA, 10 nt, Homo sapiens
uggaggacca

SEQ ID NO: 974927 - RNA, 12 nt, Homo sapiens
uggaggaccaga

SEQ ID NO: 974928 - RNA, 20 nt, Homo sapiens
uggaguacaccaaccagacc

SEQ ID NO: 974929 - RNA, 13 nt, Homo sapiens
uggagucaaggau

SEQ ID NO: 974930 - RNA, 14 nt, Homo sapiens
uggauaacuuuaca

SEQ ID NO: 974931 - RNA, 15 nt, Homo sapiens
uggauaacuuuacag

SEQ ID NO: 974932 - RNA, 14 nt, Homo sapiens
uggauggaauauca

SEQ ID NO: 974933 - RNA, 23 nt, Homo sapiens
uggaugucuccaucucugucuca

SEQ ID NO: 974934 - RNA, 20 nt, Homo sapiens
uggauucccagggacuucag

SEQ ID NO: 974935 - RNA, 18 nt, Homo sapiens
uggcaaacugaagcugca

SEQ ID NO: 974936 - RNA, 20 nt, Homo sapiens
uggcagagccagagcuugaa

SEQ ID NO: 974937 - RNA, 18 nt, Homo sapiens
uggcaucucuuucugcaa

SEQ ID NO: 974938 - RNA, 15 nt, Homo sapiens
uggccaagccuauca

SEQ ID NO: 974939 - RNA, 17 nt, Homo sapiens
uggccaggugguugucu

SEQ ID NO: 974940 - RNA, 19 nt, Homo sapiens
uggccaguuuguuccucua

SEQ ID NO: 974941 - RNA, 22 nt, Homo sapiens
uggccaugucgccaaaaauaca

SEQ ID NO: 974942 - RNA, 20 nt, Homo sapiens
uggcccuauuuaaggcagau

SEQ ID NO: 974943 - RNA, 13 nt, Homo sapiens
uggccuggcacac

SEQ ID NO: 974944 - RNA, 23 nt, Homo sapiens
uggccuggccauacuguguccca

SEQ ID NO: 974945 - RNA, 13 nt, Homo sapiens
uggccuguagucc

SEQ ID NO: 974946 - RNA, 19 nt, Homo sapiens
uggcgcuuagagaggacaa

SEQ ID NO: 974947 - RNA, 17 nt, Homo sapiens
uggcggcgcagagggaa

SEQ ID NO: 974948 - RNA, 22 nt, Homo sapiens
uggcucaagucugcacagagca

SEQ ID NO: 974949 - RNA, 23 nt, Homo sapiens
uggcugcuguugcuuaaaccacu

SEQ ID NO: 974950 - RNA, 21 nt, Homo sapiens
uggcugucaaugggaccugug

SEQ ID NO: 974951 - RNA, 14 nt, Homo sapiens
uggcuucugugaug

SEQ ID NO: 974952 - RNA, 14 nt, Homo sapiens
uggcuuucccagga

SEQ ID NO: 974953 - RNA, 21 nt, Homo sapiens
ugggaaagcgcggacgugcug

SEQ ID NO: 974954 - RNA, 22 nt, Homo sapiens
ugggaacaguaaagaaagcaga

SEQ ID NO: 974955 - RNA, 23 nt, Homo sapiens
ugggaacaguaaagaaagcagaa

SEQ ID NO: 974956 - RNA, 15 nt, Homo sapiens
ugggaagacuauggu

SEQ ID NO: 974957 - RNA, 12 nt, Homo sapiens
ugggacugagau

SEQ ID NO: 974958 - RNA, 13 nt, Homo sapiens
ugggacugagaug

SEQ ID NO: 974959 - RNA, 19 nt, Homo sapiens
ugggagcacggacugucag

SEQ ID NO: 974960 - RNA, 21 nt, Homo sapiens
ugggagggggcuugaagccaa

SEQ ID NO: 974961 - RNA, 19 nt, Homo sapiens
ugggagugugucugcugag

SEQ ID NO: 974962 - RNA, 17 nt, Homo sapiens
ugggauuugagauacca

SEQ ID NO: 974963 - RNA, 18 nt, Homo sapiens
ugggcaacagagcaagac

SEQ ID NO: 974964 - RNA, 15 nt, Homo sapiens
ugggcagagcugcau

SEQ ID NO: 974965 - RNA, 18 nt, Homo sapiens
ugggcagagcugcaucau

SEQ ID NO: 974966 - RNA, 16 nt, Homo sapiens
ugggcaugccauuaca

SEQ ID NO: 974967 - RNA, 14 nt, Homo sapiens
ugggccauguccaa

SEQ ID NO: 974968 - RNA, 15 nt, Homo sapiens
ugggccauguccaaa

SEQ ID NO: 974969 - RNA, 17 nt, Homo sapiens
ugggccauguccaaaga

SEQ ID NO: 974970 - RNA, 14 nt, Homo sapiens
ugggcucuccgggg

SEQ ID NO: 974971 - RNA, 14 nt, Homo sapiens
ugggcucugaugaa

SEQ ID NO: 974972 - RNA, 16 nt, Homo sapiens
ugggcugcuagaagca

SEQ ID NO: 974973 - RNA, 13 nt, Homo sapiens
uggggaagugcgu

SEQ ID NO: 974974 - RNA, 19 nt, Homo sapiens
uggggcaggcugggccaug

SEQ ID NO: 974975 - RNA, 24 nt, Homo sapiens
uggggcaggcugggccauguccaa

SEQ ID NO: 974976 - RNA, 13 nt, Homo sapiens
uggggccauaaac

SEQ ID NO: 974977 - RNA, 22 nt, Homo sapiens
uggggcgagccaggaccacaga

SEQ ID NO: 974978 - RNA, 21 nt, Homo sapiens
uggggcucauaaaacaugaau

SEQ ID NO: 974979 - RNA, 21 nt, Homo sapiens
uggggcuggaugucuccaucu

SEQ ID NO: 974980 - RNA, 22 nt, Homo sapiens
ugggggcagggcugugcuugaa

SEQ ID NO: 974981 - RNA, 15 nt, Homo sapiens
ugggggugucccugg

SEQ ID NO: 974982 - RNA, 16 nt, Homo sapiens
uggguauuuguucaaa

SEQ ID NO: 974983 - RNA, 16 nt, Homo sapiens
ugggucacauccaucc

SEQ ID NO: 974984 - RNA, 16 nt, Homo sapiens
uggguccuucaaacaa

SEQ ID NO: 974985 - RNA, 22 nt, Homo sapiens
uggguugacuccugagcauauu

SEQ ID NO: 974986 - RNA, 18 nt, Homo sapiens
ugguaaaacucacuguga

SEQ ID NO: 974987 - RNA, 16 nt, Homo sapiens
uggucggugggacccu

SEQ ID NO: 974988 - RNA, 22 nt, Homo sapiens
uggucuaagguucagccugaaa

SEQ ID NO: 974989 - RNA, 20 nt, Homo sapiens
uggucucaaacuuguggccu

SEQ ID NO: 974990 - RNA, 22 nt, Homo sapiens
uggucugucaaugagagcauaa

SEQ ID NO: 974991 - RNA, 19 nt, Homo sapiens
uggucuguggaucagcauu

SEQ ID NO: 974992 - RNA, 22 nt, Homo sapiens
uggucuuuguaagaguguagaa

SEQ ID NO: 974993 - RNA, 20 nt, Homo sapiens
uggugaaaccccgucucuac

SEQ ID NO: 974994 - RNA, 22 nt, Homo sapiens
uggugccgaauugucuuuggug

SEQ ID NO: 974995 - RNA, 15 nt, Homo sapiens
uggugccuggagcua

SEQ ID NO: 974996 - RNA, 18 nt, Homo sapiens
ugguggaaggugugcucg

SEQ ID NO: 974997 - RNA, 13 nt, Homo sapiens
ugguggagcugcu

SEQ ID NO: 974998 - RNA, 22 nt, Homo sapiens
ugguggccgugccugagcugca

SEQ ID NO: 974999 - RNA, 17 nt, Homo sapiens
uggugggaacauucgag

SEQ ID NO: 975000 - RNA, 16 nt, Homo sapiens
uggugggcgccuguaa

SEQ ID NO: 975001 - RNA, 13 nt, Homo sapiens
ugguggucccugc

SEQ ID NO: 975002 - RNA, 14 nt, Homo sapiens
ugguguagcacuua

SEQ ID NO: 975003 - RNA, 16 nt, Homo sapiens
ugguguggguguccug

SEQ ID NO: 975004 - RNA, 15 nt, Homo sapiens
ugguuccuaagccug

SEQ ID NO: 975005 - RNA, 15 nt, Homo sapiens
uguaaaauguauauu

SEQ ID NO: 975006 - RNA, 21 nt, Homo sapiens
uguaacugagagaaagauucu

SEQ ID NO: 975007 - RNA, 19 nt, Homo sapiens
uguaacuguaaaacauuga

SEQ ID NO: 975008 - RNA, 16 nt, Homo sapiens
uguaacuuuacaguua

SEQ ID NO: 975009 - RNA, 18 nt, Homo sapiens
uguaagauuuuccauugu

SEQ ID NO: 975010 - RNA, 17 nt, Homo sapiens
uguaaguuucaggugac

SEQ ID NO: 975011 - RNA, 14 nt, Homo sapiens
uguaauaugcacaa

SEQ ID NO: 975012 - RNA, 14 nt, Homo sapiens
uguaauuccagcua

SEQ ID NO: 975013 - RNA, 14 nt, Homo sapiens
uuacacacaaaaaa

SEQ ID NO: 975014 - RNA, 13 nt, Homo sapiens
uuacauagcucug

SEQ ID NO: 975015 - RNA, 22 nt, Homo sapiens
uuacauuuuccugagaccucaa

SEQ ID NO: 975016 - RNA, 14 nt, Homo sapiens
uuaccaaaaaagga

SEQ ID NO: 975017 - RNA, 20 nt, Homo sapiens
uuaccaaggaugaaagagga

SEQ ID NO: 975018 - RNA, 21 nt, Homo sapiens
uuaccagugaaaaaauguaau

SEQ ID NO: 975019 - RNA, 19 nt, Homo sapiens
uuaccaguuuuccagaaca

SEQ ID NO: 975020 - RNA, 22 nt, Homo sapiens
uuacccuuuggccccacuuuga

SEQ ID NO: 975021 - RNA, 23 nt, Homo sapiens
uuacccuuuggccccacuuugaa

SEQ ID NO: 975022 - RNA, 15 nt, Homo sapiens
uuaccuccauccauc

SEQ ID NO: 975023 - RNA, 22 nt, Homo sapiens
uuaccugauuugaugauacauu

SEQ ID NO: 975024 - RNA, 23 nt, Homo sapiens
uuaccugguagaucaagcauuac

SEQ ID NO: 975025 - RNA, 17 nt, Homo sapiens
uuacgcccaucucagga

SEQ ID NO: 975026 - RNA, 21 nt, Homo sapiens
uuacuaacuaaauaccauuca

SEQ ID NO: 975027 - RNA, 13 nt, Homo sapiens
uuagaaaugcaaa

SEQ ID NO: 975028 - RNA, 14 nt, Homo sapiens
uuagaaaugcaaaa

SEQ ID NO: 975029 - RNA, 13 nt, Homo sapiens
uuagaauaaugaa

SEQ ID NO: 975030 - RNA, 18 nt, Homo sapiens
uuagaaucagaauuugau

SEQ ID NO: 975031 - RNA, 19 nt, Homo sapiens
uuagaauccgaagggaauu

SEQ ID NO: 975032 - RNA, 21 nt, Homo sapiens
uuagacccgcccuccccuuuu

SEQ ID NO: 975033 - RNA, 18 nt, Homo sapiens
uuagacguccuccgucca

SEQ ID NO: 975034 - RNA, 19 nt, Homo sapiens
uuagaguaaugaaauggag

SEQ ID NO: 975035 - RNA, 12 nt, Homo sapiens
uuagaguuuacu

SEQ ID NO: 975036 - RNA, 23 nt, Homo sapiens
uuagcucucccaacucuugcaca

SEQ ID NO: 975037 - RNA, 13 nt, Homo sapiens
uuaggagcagcuc

SEQ ID NO: 975038 - RNA, 22 nt, Homo sapiens
uuagggaagaaaaagcaagugu

SEQ ID NO: 975039 - RNA, 21 nt, Homo sapiens
uuaggucagcagccucccuga

SEQ ID NO: 975040 - RNA, 14 nt, Homo sapiens
uuaguacaauuuca

SEQ ID NO: 975041 - RNA, 16 nt, Homo sapiens
uuaguccuaauucaau

SEQ ID NO: 975042 - RNA, 18 nt, Homo sapiens
uuagugcacaagcacuau

SEQ ID NO: 975043 - RNA, 20 nt, Homo sapiens
uuauaaaggauaaagaagga

SEQ ID NO: 975044 - RNA, 19 nt, Homo sapiens
uuauacaaaccuaccaaaa

SEQ ID NO: 975045 - RNA, 13 nt, Homo sapiens
uuauacaccagca

SEQ ID NO: 975046 - RNA, 14 nt, Homo sapiens
uuauacaugugaua

SEQ ID NO: 975047 - RNA, 23 nt, Homo sapiens
uuauaccugcucuuguucuacug

SEQ ID NO: 975048 - RNA, 22 nt, Homo sapiens
uuauauagaaaaauaacuuuag

SEQ ID NO: 975049 - RNA, 15 nt, Homo sapiens
uuaucauuuacugug

SEQ ID NO: 975050 - RNA, 14 nt, Homo sapiens
uuaucuauaucuca

SEQ ID NO: 975051 - RNA, 22 nt, Homo sapiens
uuaugaaagaccuuagacauaa

SEQ ID NO: 975052 - RNA, 11 nt, Homo sapiens
uuaugagacag

SEQ ID NO: 975053 - RNA, 12 nt, Homo sapiens
uuaugaugcuaa

SEQ ID NO: 975054 - RNA, 21 nt, Homo sapiens
uuaugcaucauuucaggaguu

SEQ ID NO: 975055 - RNA, 13 nt, Homo sapiens
uuaugcugugaca

SEQ ID NO: 975056 - RNA, 23 nt, Homo sapiens
uuauggugccgaauugucuuugg

SEQ ID NO: 975057 - RNA, 22 nt, Homo sapiens
uuauuaaagcauuuccuaccag

SEQ ID NO: 975058 - RNA, 13 nt, Homo sapiens
uuauuaacuaaga

SEQ ID NO: 975059 - RNA, 18 nt, Homo sapiens
uuauuaagcuuuuuggaa

SEQ ID NO: 975060 - RNA, 19 nt, Homo sapiens
uuauuacauugcugccuuu

SEQ ID NO: 975061 - RNA, 15 nt, Homo sapiens
uuauucagauuggga

SEQ ID NO: 975062 - RNA, 17 nt, Homo sapiens
uuauuccuccugcucau

SEQ ID NO: 975063 - RNA, 13 nt, Homo sapiens
uuauugacacuga

SEQ ID NO: 975064 - RNA, 20 nt, Homo sapiens
uuauugcaauaaaguauaau

SEQ ID NO: 975065 - RNA, 15 nt, Homo sapiens
uuauuggcugagaua

SEQ ID NO: 975066 - RNA, 19 nt, Homo sapiens
uuauuggcugagauaugaa

SEQ ID NO: 975067 - RNA, 22 nt, Homo sapiens
uuauuucaaagggaaacuuuaa

SEQ ID NO: 975068 - RNA, 21 nt, Homo sapiens
uuauuucaggaaggucuucaa

SEQ ID NO: 975069 - RNA, 22 nt, Homo sapiens
uucaaaauacagauuugaauag

SEQ ID NO: 975070 - RNA, 16 nt, Homo sapiens
uucaaaccucauagca

SEQ ID NO: 975071 - RNA, 12 nt, Homo sapiens
uucaaagugaua

SEQ ID NO: 975072 - RNA, 20 nt, Homo sapiens
uucaaaguuuuguuguacuu

SEQ ID NO: 975073 - RNA, 12 nt, Homo sapiens
uucaaaugaaac

SEQ ID NO: 975074 - RNA, 14 nt, Homo sapiens
uucaaccacagauu

SEQ ID NO: 975075 - RNA, 14 nt, Homo sapiens
uucaacuacaguga

SEQ ID NO: 975076 - RNA, 22 nt, Homo sapiens
uucaaggaggcccacugugucu

SEQ ID NO: 975077 - RNA, 20 nt, Homo sapiens
uucaauaaagcacugagcaa

SEQ ID NO: 975078 - RNA, 14 nt, Homo sapiens
uucaauccuacuuu

SEQ ID NO: 975079 - RNA, 14 nt, Homo sapiens
uucaauggaauaca

SEQ ID NO: 975080 - RNA, 21 nt, Homo sapiens
uucaaugugcauaaugauaaa

SEQ ID NO: 975081 - RNA, 19 nt, Homo sapiens
uucacaguaauaugguucc

SEQ ID NO: 975082 - RNA, 16 nt, Homo sapiens
uucacauuuguauuaa

SEQ ID NO: 975083 - RNA, 13 nt, Homo sapiens
uucacauuuugcc

SEQ ID NO: 975084 - RNA, 16 nt, Homo sapiens
uucaccucuucuuucc

SEQ ID NO: 975085 - RNA, 13 nt, Homo sapiens
uucaccuguaaac

SEQ ID NO: 975086 - RNA, 17 nt, Homo sapiens
uucaggaguuacuggau

SEQ ID NO: 975087 - RNA, 17 nt, Homo sapiens
uucaggcagcacaucaa

SEQ ID NO: 975088 - RNA, 15 nt, Homo sapiens
uucaguaagucucau

SEQ ID NO: 975089 - RNA, 14 nt, Homo sapiens
uucagugcaguuuc

SEQ ID NO: 975090 - RNA, 20 nt, Homo sapiens
uucauaaacuuuucucuuau

SEQ ID NO: 975091 - RNA, 13 nt, Homo sapiens
uucaucagaguua

SEQ ID NO: 975092 - RNA, 17 nt, Homo sapiens
uucaucugaagauucga

SEQ ID NO: 975093 - RNA, 20 nt, Homo sapiens
uucauggcuaccucagaaag

SEQ ID NO: 975094 - RNA, 21 nt, Homo sapiens
uucaugggaaaacagaccugu

SEQ ID NO: 975095 - RNA, 23 nt, Homo sapiens
uucaugggaaaacagaccugugu

SEQ ID NO: 975096 - RNA, 21 nt, Homo sapiens
uucauguuggucugacaucaa

SEQ ID NO: 975097 - RNA, 19 nt, Homo sapiens
uucauuaaaucaacuuuau

SEQ ID NO: 975098 - RNA, 18 nt, Homo sapiens
uuccaaagaaauggaaau

SEQ ID NO: 975099 - RNA, 14 nt, Homo sapiens
uuccaacaugugau

SEQ ID NO: 975100 - RNA, 23 nt, Homo sapiens
uuccaaggguaugggaagccaua

SEQ ID NO: 975101 - RNA, 17 nt, Homo sapiens
uuccaagucaacacucu

SEQ ID NO: 975102 - RNA, 23 nt, Homo sapiens
uuccacuuugaguaccaaaucca

SEQ ID NO: 975103 - RNA, 16 nt, Homo sapiens
uuccaguuauaaauau

SEQ ID NO: 975104 - RNA, 19 nt, Homo sapiens
uuccauuagagaguggcaa

SEQ ID NO: 975105 - RNA, 13 nt, Homo sapiens
uuccauugccaua

SEQ ID NO: 975106 - RNA, 16 nt, Homo sapiens
uucccauuugugccag

SEQ ID NO: 975107 - RNA, 20 nt, Homo sapiens
uuccccaaggacucuuccac

SEQ ID NO: 975108 - RNA, 16 nt, Homo sapiens
uuccccaaugcuccau

SEQ ID NO: 975109 - RNA, 18 nt, Homo sapiens
uucccuaggaaacucaca

SEQ ID NO: 975110 - RNA, 20 nt, Homo sapiens
uucccuauggguucugugac

SEQ ID NO: 975111 - RNA, 17 nt, Homo sapiens
uucccuauugugacaga

SEQ ID NO: 975112 - RNA, 22 nt, Homo sapiens
uucccuucuacaaggacuccau

SEQ ID NO: 975113 - RNA, 19 nt, Homo sapiens
uucccuuuuguauucucuu

SEQ ID NO: 975114 - RNA, 15 nt, Homo sapiens
uuccgccacuccagu

SEQ ID NO: 975115 - RNA, 12 nt, Homo sapiens
uuccguaucucc

SEQ ID NO: 975116 - RNA, 20 nt, Homo sapiens
uuccuaagccuguugcugaa

SEQ ID NO: 975117 - RNA, 11 nt, Homo sapiens
uuccuacuggu

SEQ ID NO: 975118 - RNA, 22 nt, Homo sapiens
uuccuauuguaaucgugugcca

SEQ ID NO: 975119 - RNA, 12 nt, Homo sapiens
uuccucacauuu

SEQ ID NO: 975120 - RNA, 16 nt, Homo sapiens
uuccucagaucaucca

SEQ ID NO: 975121 - RNA, 14 nt, Homo sapiens
uuccucccagugag

SEQ ID NO: 975122 - RNA, 17 nt, Homo sapiens
uuccucuagaagccaag

SEQ ID NO: 975123 - RNA, 18 nt, Homo sapiens
uuccucuuggugucauau

SEQ ID NO: 975124 - RNA, 13 nt, Homo sapiens
uuccugggaacau

SEQ ID NO: 975125 - RNA, 11 nt, Homo sapiens
uuccuggugac

SEQ ID NO: 975126 - RNA, 16 nt, Homo sapiens
uuccugucuuauccuc

SEQ ID NO: 975127 - RNA, 19 nt, Homo sapiens
uuccuucauuuccaccagg

SEQ ID NO: 975128 - RNA, 15 nt, Homo sapiens
aggccagugaccuca

SEQ ID NO: 975129 - RNA, 15 nt, Homo sapiens
aggccccagcuggag

SEQ ID NO: 975130 - RNA, 22 nt, Homo sapiens
aggcccugcacugccagcaucu

SEQ ID NO: 975131 - RNA, 16 nt, Homo sapiens
aggcccugcugaguca

SEQ ID NO: 975132 - RNA, 13 nt, Homo sapiens
aggccugaagcca

SEQ ID NO: 975133 - RNA, 21 nt, Homo sapiens
aggccugccucccacuucacu

SEQ ID NO: 975134 - RNA, 18 nt, Homo sapiens
aggcugccccucucacca

SEQ ID NO: 975135 - RNA, 19 nt, Homo sapiens
aggcuggauggcaccucag

SEQ ID NO: 975136 - RNA, 16 nt, Homo sapiens
aggcugggccaugucc

SEQ ID NO: 975137 - RNA, 17 nt, Homo sapiens
aggcugggccaugucca

SEQ ID NO: 975138 - RNA, 23 nt, Homo sapiens
aggcugggccauguccaaagagg

SEQ ID NO: 975139 - RNA, 18 nt, Homo sapiens
aggcugugggguggagca

SEQ ID NO: 975140 - RNA, 15 nt, Homo sapiens
aggcuuuacagugua

SEQ ID NO: 975141 - RNA, 16 nt, Homo sapiens
agggaaaggggugcuu

SEQ ID NO: 975142 - RNA, 18 nt, Homo sapiens
agggaacugaaucacuua

SEQ ID NO: 975143 - RNA, 20 nt, Homo sapiens
agggagaauaaaauuccuau

SEQ ID NO: 975144 - RNA, 21 nt, Homo sapiens
agggagcaacucuccacucca

SEQ ID NO: 975145 - RNA, 19 nt, Homo sapiens
agggauuuucacagugugc

SEQ ID NO: 975146 - RNA, 24 nt, Homo sapiens
agggauuuucacagugugcuccag

SEQ ID NO: 975147 - RNA, 19 nt, Homo sapiens
agggcagcuccagugccag

SEQ ID NO: 975148 - RNA, 19 nt, Homo sapiens
agggcagggccaguuccuc

SEQ ID NO: 975149 - RNA, 19 nt, Homo sapiens
agggccagguuagcacagc

SEQ ID NO: 975150 - RNA, 15 nt, Homo sapiens
aggggacaagggauu

SEQ ID NO: 975151 - RNA, 16 nt, Homo sapiens
aggggccugcccucau

SEQ ID NO: 975152 - RNA, 22 nt, Homo sapiens
agggguggggguggaggcuucc

SEQ ID NO: 975153 - RNA, 23 nt, Homo sapiens
agggucuucuuacaugcauuuga

SEQ ID NO: 975154 - RNA, 21 nt, Homo sapiens
agggugcagcccaaucugcca

SEQ ID NO: 975155 - RNA, 14 nt, Homo sapiens
aggguuccaaaggg

SEQ ID NO: 975156 - RNA, 14 nt, Homo sapiens
agguaaaacagggc

SEQ ID NO: 975157 - RNA, 19 nt, Homo sapiens
agguauaaggacucacaca

SEQ ID NO: 975158 - RNA, 17 nt, Homo sapiens
agguauacuuuaguaga

SEQ ID NO: 975159 - RNA, 19 nt, Homo sapiens
agguauaugccaaaucucu

SEQ ID NO: 975160 - RNA, 20 nt, Homo sapiens
aggucagcagccucccugaa

SEQ ID NO: 975161 - RNA, 21 nt, Homo sapiens
aggucagcccagccccuccaa

SEQ ID NO: 975162 - RNA, 21 nt, Homo sapiens
aggucaggacggcuccucaga

SEQ ID NO: 975163 - RNA, 12 nt, Homo sapiens
aggucaggagau

SEQ ID NO: 975164 - RNA, 20 nt, Homo sapiens
agguccuuaggccucugaga

SEQ ID NO: 975165 - RNA, 21 nt, Homo sapiens
agguccuuguuguuucuugcc

SEQ ID NO: 975166 - RNA, 12 nt, Homo sapiens
aggucggcacuu

SEQ ID NO: 975167 - RNA, 19 nt, Homo sapiens
aggucuucuuguguccuga

SEQ ID NO: 975168 - RNA, 13 nt, Homo sapiens
aggucuuuggucu

SEQ ID NO: 975169 - RNA, 17 nt, Homo sapiens
aggugaacugggagcag

SEQ ID NO: 975170 - RNA, 23 nt, Homo sapiens
aggugaacugggagcagcucugu

SEQ ID NO: 975171 - RNA, 19 nt, Homo sapiens
aggugauccacccaccuca

SEQ ID NO: 975172 - RNA, 20 nt, Homo sapiens
aggugcgcgccaccgugccu

SEQ ID NO: 975173 - RNA, 15 nt, Homo sapiens
aggugcuauccugcc

SEQ ID NO: 975174 - RNA, 16 nt, Homo sapiens
agguggcccuaaagga

SEQ ID NO: 975175 - RNA, 21 nt, Homo sapiens
aggugggccuugcuaccucaa

SEQ ID NO: 975176 - RNA, 20 nt, Homo sapiens
agguuaaaaaaaaaagucac

SEQ ID NO: 975177 - RNA, 17 nt, Homo sapiens
agguuaauuccauucaa

SEQ ID NO: 975178 - RNA, 16 nt, Homo sapiens
agguuacaagccugca

SEQ ID NO: 975179 - RNA, 14 nt, Homo sapiens
agguucagccugaa

SEQ ID NO: 975180 - RNA, 14 nt, Homo sapiens
agguuuuaacugaa

SEQ ID NO: 975181 - RNA, 21 nt, Homo sapiens
aguaaaauacuauugccucau

SEQ ID NO: 975182 - RNA, 19 nt, Homo sapiens
aguaaacgggaacaugccc

SEQ ID NO: 975183 - RNA, 21 nt, Homo sapiens
aguaaagguuuuuguaauaaa

SEQ ID NO: 975184 - RNA, 17 nt, Homo sapiens
aguaauaagauggcugu

SEQ ID NO: 975185 - RNA, 22 nt, Homo sapiens
aguaauauuauuacuuuaugaa

SEQ ID NO: 975186 - RNA, 21 nt, Homo sapiens
aguacaauaauaaauccucag

SEQ ID NO: 975187 - RNA, 15 nt, Homo sapiens
aguacaucucuacua

SEQ ID NO: 975188 - RNA, 18 nt, Homo sapiens
aguacaucucuacuaaaa

SEQ ID NO: 975189 - RNA, 15 nt, Homo sapiens
aguaccuacugugug

SEQ ID NO: 975190 - RNA, 21 nt, Homo sapiens
aguaccuagcuggcucuguga

SEQ ID NO: 975191 - RNA, 12 nt, Homo sapiens
aguacugggaag

SEQ ID NO: 975192 - RNA, 19 nt, Homo sapiens
aguacugggacaaccucau

SEQ ID NO: 975193 - RNA, 20 nt, Homo sapiens
aguagaauacgcagaacuac

SEQ ID NO: 975194 - RNA, 15 nt, Homo sapiens
aguagaaugguggcu

SEQ ID NO: 975195 - RNA, 15 nt, Homo sapiens
aguagauccauuucc

SEQ ID NO: 975196 - RNA, 18 nt, Homo sapiens
aguaguaauaauagcagc

SEQ ID NO: 975197 - RNA, 12 nt, Homo sapiens
aguauauguuaa

SEQ ID NO: 975198 - RNA, 16 nt, Homo sapiens
aguaucacgauuugca

SEQ ID NO: 975199 - RNA, 14 nt, Homo sapiens
aguauguaugugua

SEQ ID NO: 975200 - RNA, 20 nt, Homo sapiens
aguauguauguguaccuaag

SEQ ID NO: 975201 - RNA, 17 nt, Homo sapiens
aguauuguggggcucau

SEQ ID NO: 975202 - RNA, 18 nt, Homo sapiens
agucaaagaugccccauu

SEQ ID NO: 975203 - RNA, 20 nt, Homo sapiens
agucaauggcuuguucauca

SEQ ID NO: 975204 - RNA, 19 nt, Homo sapiens
agucacacuuuaaauuaag

SEQ ID NO: 975205 - RNA, 12 nt, Homo sapiens
agucaccaaaua

SEQ ID NO: 975206 - RNA, 11 nt, Homo sapiens
agucaccucac

SEQ ID NO: 975207 - RNA, 11 nt, Homo sapiens
agucaucuccc

SEQ ID NO: 975208 - RNA, 19 nt, Homo sapiens
agucauggcuaauuuaaca

SEQ ID NO: 975209 - RNA, 16 nt, Homo sapiens
agucauuaaagacagg

SEQ ID NO: 975210 - RNA, 22 nt, Homo sapiens
aguccaaccugccugugcauga

SEQ ID NO: 975211 - RNA, 20 nt, Homo sapiens
aguggguggcaggugggggu

SEQ ID NO: 975212 - RNA, 15 nt, Homo sapiens
aguggugacauaguc

SEQ ID NO: 975213 - RNA, 20 nt, Homo sapiens
aguguagaaaagaacuggaa

SEQ ID NO: 975214 - RNA, 13 nt, Homo sapiens
agugugaauucac

SEQ ID NO: 975215 - RNA, 19 nt, Homo sapiens
agugugaggaggagacagc

SEQ ID NO: 975216 - RNA, 15 nt, Homo sapiens
aguguggagcuggac

SEQ ID NO: 975217 - RNA, 16 nt, Homo sapiens
agugugucugcugagu

SEQ ID NO: 975218 - RNA, 22 nt, Homo sapiens
aguguugugccccuucacucau

SEQ ID NO: 975219 - RNA, 18 nt, Homo sapiens
aguuaagaagcuguugua

SEQ ID NO: 975220 - RNA, 19 nt, Homo sapiens
aguuaccugguagaucaag

SEQ ID NO: 975221 - RNA, 17 nt, Homo sapiens
aguuauggcuucacauu

SEQ ID NO: 975222 - RNA, 22 nt, Homo sapiens
aguucaaauucuucugaacuca

SEQ ID NO: 975223 - RNA, 19 nt, Homo sapiens
aguucaauaaaugucuguu

SEQ ID NO: 975224 - RNA, 22 nt, Homo sapiens
aguucagaagcggagagccugg

SEQ ID NO: 975225 - RNA, 22 nt, Homo sapiens
aguuccuuccaggugauucugu

SEQ ID NO: 975226 - RNA, 18 nt, Homo sapiens
aguucuaaauacaggaaa

SEQ ID NO: 975227 - RNA, 18 nt, Homo sapiens
aguucucuugcuuucaca

SEQ ID NO: 975228 - RNA, 19 nt, Homo sapiens
aguucuuccuccaccucca

SEQ ID NO: 975229 - RNA, 13 nt, Homo sapiens
aguugaucugcuc

SEQ ID NO: 975230 - RNA, 20 nt, Homo sapiens
aguugcguggacucugcaca

SEQ ID NO: 975231 - RNA, 23 nt, Homo sapiens
aguuggguuaauaccagcuuaaa

SEQ ID NO: 975232 - RNA, 13 nt, Homo sapiens
aguuguucagcau

SEQ ID NO: 975233 - RNA, 20 nt, Homo sapiens
aguuguucuaguaacaauac

SEQ ID NO: 975234 - RNA, 13 nt, Homo sapiens
aguuuaaugauua

SEQ ID NO: 975235 - RNA, 14 nt, Homo sapiens
aguuuagcucugag

SEQ ID NO: 975236 - RNA, 15 nt, Homo sapiens
aguuugcacaacaag

SEQ ID NO: 975237 - RNA, 17 nt, Homo sapiens
aguuuuagaaaugagau

SEQ ID NO: 975238 - RNA, 13 nt, Homo sapiens
aguuuuguugccc

SEQ ID NO: 975239 - RNA, 14 nt, Homo sapiens
auaaaaccaaagaa

SEQ ID NO: 975240 - RNA, 19 nt, Homo sapiens
auaaaagaucuugaauagu

SEQ ID NO: 975241 - RNA, 22 nt, Homo sapiens
auaaaagugaagugaaucugau

SEQ ID NO: 975242 - RNA, 12 nt, Homo sapiens
auaaaaugauaa

SEQ ID NO: 975243 - RNA, 14 nt, Homo sapiens
auaaaauguuucau

SEQ ID NO: 975244 - RNA, 17 nt, Homo sapiens
auaaaccaaaaacauuu

SEQ ID NO: 975245 - RNA, 15 nt, Homo sapiens
auaaaccacugugcg

SEQ ID NO: 975246 - RNA, 18 nt, Homo sapiens
auaaacgguuccugguga

SEQ ID NO: 975247 - RNA, 18 nt, Homo sapiens
auaaacugacuaaacuua

SEQ ID NO: 975248 - RNA, 15 nt, Homo sapiens
auaaagaccugagaa

SEQ ID NO: 975249 - RNA, 15 nt, Homo sapiens
auaaagcacugagca

SEQ ID NO: 975250 - RNA, 14 nt, Homo sapiens
auaaaggauaaaga

SEQ ID NO: 975251 - RNA, 13 nt, Homo sapiens
auaaagugcuuua

SEQ ID NO: 975252 - RNA, 16 nt, Homo sapiens
auaaaguguugaacau

SEQ ID NO: 975253 - RNA, 14 nt, Homo sapiens
auaaauauacagua

SEQ ID NO: 975254 - RNA, 13 nt, Homo sapiens
auaaauaugcagu

SEQ ID NO: 975255 - RNA, 22 nt, Homo sapiens
auaaauccauccauccaaaggc

SEQ ID NO: 975256 - RNA, 18 nt, Homo sapiens
auaaauggaaacaccacu

SEQ ID NO: 975257 - RNA, 13 nt, Homo sapiens
auaaauuacacau

SEQ ID NO: 975258 - RNA, 15 nt, Homo sapiens
auaaauuuuccauuu

SEQ ID NO: 975259 - RNA, 17 nt, Homo sapiens
auaacaaggagauuucu

SEQ ID NO: 975260 - RNA, 14 nt, Homo sapiens
auaacuaccuucca

SEQ ID NO: 975261 - RNA, 16 nt, Homo sapiens
auaacuuuacagaaau

SEQ ID NO: 975262 - RNA, 21 nt, Homo sapiens
auaagaagaaguucaugucca

SEQ ID NO: 975263 - RNA, 18 nt, Homo sapiens
auaagcaacuucacagaa

SEQ ID NO: 975264 - RNA, 17 nt, Homo sapiens
auaaguaaaugucuuca

SEQ ID NO: 975265 - RNA, 16 nt, Homo sapiens
auaaguagaaagaauu

SEQ ID NO: 975266 - RNA, 17 nt, Homo sapiens
auaagugagaacaugca

SEQ ID NO: 975267 - RNA, 16 nt, Homo sapiens
auaaucagucaugugu

SEQ ID NO: 975268 - RNA, 14 nt, Homo sapiens
auaaugugagaugg

SEQ ID NO: 975269 - RNA, 13 nt, Homo sapiens
auaauuguuucau

SEQ ID NO: 975270 - RNA, 17 nt, Homo sapiens
auacaaaaaaaauuuag

SEQ ID NO: 975271 - RNA, 12 nt, Homo sapiens
auacaaaccuac

SEQ ID NO: 975272 - RNA, 14 nt, Homo sapiens
auacaaaccuacca

SEQ ID NO: 975273 - RNA, 14 nt, Homo sapiens
auacaaucauguga

SEQ ID NO: 975274 - RNA, 13 nt, Homo sapiens
auacaaugauccu

SEQ ID NO: 975275 - RNA, 13 nt, Homo sapiens
auacacacacaca

SEQ ID NO: 975276 - RNA, 18 nt, Homo sapiens
auacacccaaacacuuac

SEQ ID NO: 975277 - RNA, 15 nt, Homo sapiens
auacagucauuccaa

SEQ ID NO: 975278 - RNA, 23 nt, Homo sapiens
auaccaaacaugcggugccauga

SEQ ID NO: 975279 - RNA, 14 nt, Homo sapiens
auaccaacuguaca

SEQ ID NO: 975280 - RNA, 18 nt, Homo sapiens
auaccagcauacgcucac

SEQ ID NO: 975281 - RNA, 16 nt, Homo sapiens
auaccuucugaugaag

SEQ ID NO: 975282 - RNA, 17 nt, Homo sapiens
auacuaaauuauagugu

SEQ ID NO: 975283 - RNA, 15 nt, Homo sapiens
auacuauuauuugcu

SEQ ID NO: 975284 - RNA, 17 nt, Homo sapiens
auacugaccuaccucaa

SEQ ID NO: 975285 - RNA, 18 nt, Homo sapiens
auacugagaauauacaau

SEQ ID NO: 975286 - RNA, 16 nt, Homo sapiens
auacuuaagaauacac

SEQ ID NO: 975287 - RNA, 18 nt, Homo sapiens
auagaaaaauaacuuuag

SEQ ID NO: 975288 - RNA, 15 nt, Homo sapiens
auagacauucucaca

SEQ ID NO: 975289 - RNA, 19 nt, Homo sapiens
auagacuggauggaaagac

SEQ ID NO: 975290 - RNA, 22 nt, Homo sapiens
auagacuguaacuuccaaauaa

SEQ ID NO: 975291 - RNA, 14 nt, Homo sapiens
auagagcccaguga

SEQ ID NO: 975292 - RNA, 16 nt, Homo sapiens
auagagcccagugagg

SEQ ID NO: 975293 - RNA, 23 nt, Homo sapiens
cgccuuaugccucagucuauucu

SEQ ID NO: 975294 - RNA, 19 nt, Homo sapiens
cgcgcuugcuggccagucc

SEQ ID NO: 975295 - RNA, 13 nt, Homo sapiens
cgcucgcugccau

SEQ ID NO: 975296 - RNA, 14 nt, Homo sapiens
cgcucgcugccauc

SEQ ID NO: 975297 - RNA, 18 nt, Homo sapiens
cgcugcaccuaaagccua

SEQ ID NO: 975298 - RNA, 21 nt, Homo sapiens
cggaagucaucccagugcaca

SEQ ID NO: 975299 - RNA, 16 nt, Homo sapiens
cggagaagagcgcagu

SEQ ID NO: 975300 - RNA, 19 nt, Homo sapiens
cggcaaugcccugugcaug

SEQ ID NO: 975301 - RNA, 14 nt, Homo sapiens
cggcuacucuggaa

SEQ ID NO: 975302 - RNA, 12 nt, Homo sapiens
cgggaaugagcu

SEQ ID NO: 975303 - RNA, 18 nt, Homo sapiens
cgggcuccagccaucuca

SEQ ID NO: 975304 - RNA, 14 nt, Homo sapiens
cggggacccuguga

SEQ ID NO: 975305 - RNA, 20 nt, Homo sapiens
cggggaggcuccugccugag

SEQ ID NO: 975306 - RNA, 17 nt, Homo sapiens
cggguggggccauaaac

SEQ ID NO: 975307 - RNA, 11 nt, Homo sapiens
cgguccagcug

SEQ ID NO: 975308 - RNA, 20 nt, Homo sapiens
cggucccaguuuuguugccc

SEQ ID NO: 975309 - RNA, 16 nt, Homo sapiens
cggucucauuucuucu

SEQ ID NO: 975310 - RNA, 20 nt, Homo sapiens
cgguguuuggcaaugcuaau

SEQ ID NO: 975311 - RNA, 15 nt, Homo sapiens
cguauauugcuguua

SEQ ID NO: 975312 - RNA, 17 nt, Homo sapiens
cgucagaccaguacugg

SEQ ID NO: 975313 - RNA, 20 nt, Homo sapiens
cgucagaccaguacugggaa

SEQ ID NO: 975314 - RNA, 13 nt, Homo sapiens
cgucagccagcuc

SEQ ID NO: 975315 - RNA, 15 nt, Homo sapiens
cgucagcugcucccu

SEQ ID NO: 975316 - RNA, 15 nt, Homo sapiens
cguccaucucccuua

SEQ ID NO: 975317 - RNA, 18 nt, Homo sapiens
cguccuccguccauauca

SEQ ID NO: 975318 - RNA, 20 nt, Homo sapiens
cgucucuacuaaaaauacaa

SEQ ID NO: 975319 - RNA, 14 nt, Homo sapiens
cgucugugcuuccu

SEQ ID NO: 975320 - RNA, 15 nt, Homo sapiens
cgugccaaaaaucuu

SEQ ID NO: 975321 - RNA, 20 nt, Homo sapiens
cgugccaaaaaucuuuucau

SEQ ID NO: 975322 - RNA, 13 nt, Homo sapiens
cguggacucugca

SEQ ID NO: 975323 - RNA, 13 nt, Homo sapiens
cguggucccugag

SEQ ID NO: 975324 - RNA, 17 nt, Homo sapiens
cguuccaccccaagaga

SEQ ID NO: 975325 - RNA, 22 nt, Homo sapiens
cguuuguccuuuuucacuuuga

SEQ ID NO: 975326 - RNA, 20 nt, Homo sapiens
cuaaaaaaccaacaauguga

SEQ ID NO: 975327 - RNA, 12 nt, Homo sapiens
cuaaaagcuuuc

SEQ ID NO: 975328 - RNA, 21 nt, Homo sapiens
cuaaaauaauuuuauuaugca

SEQ ID NO: 975329 - RNA, 17 nt, Homo sapiens
cuaaacauguauguaaa

SEQ ID NO: 975330 - RNA, 18 nt, Homo sapiens
cuaaaccaaggacugagc

SEQ ID NO: 975331 - RNA, 18 nt, Homo sapiens
cuaaaggacucuccagcc

SEQ ID NO: 975332 - RNA, 13 nt, Homo sapiens
cuaaagugcaaaa

SEQ ID NO: 975333 - RNA, 23 nt, Homo sapiens
cuaaauaaaaauauguaauuuca

SEQ ID NO: 975334 - RNA, 13 nt, Homo sapiens
cuaaaucagagac

SEQ ID NO: 975335 - RNA, 20 nt, Homo sapiens
cuaaauggguauuuguucaa

SEQ ID NO: 975336 - RNA, 19 nt, Homo sapiens
cuaacuuaauguguauuca

SEQ ID NO: 975337 - RNA, 16 nt, Homo sapiens
cuaagauacugaugac

SEQ ID NO: 975338 - RNA, 20 nt, Homo sapiens
cuaagcaacuaggccuucag

SEQ ID NO: 975339 - RNA, 23 nt, Homo sapiens
cuaagcacuuuaucuauaucuca

SEQ ID NO: 975340 - RNA, 13 nt, Homo sapiens
cuaagccuguugc

SEQ ID NO: 975341 - RNA, 16 nt, Homo sapiens
cuaagccuguugcuga

SEQ ID NO: 975342 - RNA, 19 nt, Homo sapiens
cuaaggaacuaaaacuuga

SEQ ID NO: 975343 - RNA, 21 nt, Homo sapiens
cuaaggaugguuuuaucuucc

SEQ ID NO: 975344 - RNA, 15 nt, Homo sapiens
cuaauaaguauauaa

SEQ ID NO: 975345 - RNA, 14 nt, Homo sapiens
cuaauaauaccuug

SEQ ID NO: 975346 - RNA, 12 nt, Homo sapiens
cuaauacuacug

SEQ ID NO: 975347 - RNA, 20 nt, Homo sapiens
cuaaucaccauguaagcacu

SEQ ID NO: 975348 - RNA, 13 nt, Homo sapiens
cuaaugccucuuc

SEQ ID NO: 975349 - RNA, 23 nt, Homo sapiens
cuaauguuugaacaaagcucaaa

SEQ ID NO: 975350 - RNA, 13 nt, Homo sapiens
cuacaauuguaaa

SEQ ID NO: 975351 - RNA, 19 nt, Homo sapiens
cuacaauuguaaacuaguu

SEQ ID NO: 975352 - RNA, 18 nt, Homo sapiens
cuacauucuauuucauau

SEQ ID NO: 975353 - RNA, 15 nt, Homo sapiens
cuacauugugcugca

SEQ ID NO: 975354 - RNA, 20 nt, Homo sapiens
cuaccacagcaacuauauau

SEQ ID NO: 975355 - RNA, 17 nt, Homo sapiens
cuacccuauucuaucca

SEQ ID NO: 975356 - RNA, 22 nt, Homo sapiens
cuacccuauucuauccaucucc

SEQ ID NO: 975357 - RNA, 12 nt, Homo sapiens
cuaccucaaggg

SEQ ID NO: 975358 - RNA, 16 nt, Homo sapiens
cuaccugagcuaaaua

SEQ ID NO: 975359 - RNA, 12 nt, Homo sapiens
cuacuccaaaau

SEQ ID NO: 975360 - RNA, 17 nt, Homo sapiens
cuacuggacuaugcuga

SEQ ID NO: 975361 - RNA, 16 nt, Homo sapiens
cuacuuacaacccagg

SEQ ID NO: 975362 - RNA, 19 nt, Homo sapiens
cuacuuuaaauuguggaug

SEQ ID NO: 975363 - RNA, 19 nt, Homo sapiens
cuagaaacaaacaucuaau

SEQ ID NO: 975364 - RNA, 12 nt, Homo sapiens
cuagaaugagca

SEQ ID NO: 975365 - RNA, 22 nt, Homo sapiens
cuagaaugcaaguauccugcga

SEQ ID NO: 975366 - RNA, 19 nt, Homo sapiens
cuagagaaaauaaauucca

SEQ ID NO: 975367 - RNA, 19 nt, Homo sapiens
cuagagauaaaacagaauc

SEQ ID NO: 975368 - RNA, 13 nt, Homo sapiens
cuagcacacucuu

SEQ ID NO: 975369 - RNA, 18 nt, Homo sapiens
cuaggcuaagcacuuuau

SEQ ID NO: 975370 - RNA, 14 nt, Homo sapiens
cuaggcugagcaau

SEQ ID NO: 975371 - RNA, 16 nt, Homo sapiens
agcaaaacaguucuca

SEQ ID NO: 975372 - RNA, 12 nt, Homo sapiens
agcaaaagccuc

SEQ ID NO: 975373 - RNA, 19 nt, Homo sapiens
agcaaauaaauacguguca

SEQ ID NO: 975374 - RNA, 21 nt, Homo sapiens
agcaaauguuaaaaguuuuau

SEQ ID NO: 975375 - RNA, 13 nt, Homo sapiens
agcaacccugggu

SEQ ID NO: 975376 - RNA, 13 nt, Homo sapiens
agcaacucagaga

SEQ ID NO: 975377 - RNA, 15 nt, Homo sapiens
agcaagagacaauaa

SEQ ID NO: 975378 - RNA, 18 nt, Homo sapiens
agcaagcucuucacugaa

SEQ ID NO: 975379 - RNA, 19 nt, Homo sapiens
agcaaguccucacucuuca

SEQ ID NO: 975380 - RNA, 21 nt, Homo sapiens
agcaaguccucacucuucaag

SEQ ID NO: 975381 - RNA, 15 nt, Homo sapiens
agcaaguuagaacua

SEQ ID NO: 975382 - RNA, 16 nt, Homo sapiens
agcaauccagccucau

SEQ ID NO: 975383 - RNA, 15 nt, Homo sapiens
agcaauccuccugcc

SEQ ID NO: 975384 - RNA, 20 nt, Homo sapiens
agcaaugcaagcagccuagc

SEQ ID NO: 975385 - RNA, 15 nt, Homo sapiens
agcaauucucuuucu

SEQ ID NO: 975386 - RNA, 15 nt, Homo sapiens
agcacaauuugcacu

SEQ ID NO: 975387 - RNA, 21 nt, Homo sapiens
agcacaauuugcacuaaauca

SEQ ID NO: 975388 - RNA, 13 nt, Homo sapiens
agcacaugcaccu

SEQ ID NO: 975389 - RNA, 17 nt, Homo sapiens
agcacuacaccuugccu

SEQ ID NO: 975390 - RNA, 21 nt, Homo sapiens
agcacuacaggaggaaugcac

SEQ ID NO: 975391 - RNA, 22 nt, Homo sapiens
agcacuugcaaccgucuguuau

SEQ ID NO: 975392 - RNA, 20 nt, Homo sapiens
agcacuuugggagacugaag

SEQ ID NO: 975393 - RNA, 15 nt, Homo sapiens
agcagaccgugauuu

SEQ ID NO: 975394 - RNA, 17 nt, Homo sapiens
agcagagaccaccacau

SEQ ID NO: 975395 - RNA, 20 nt, Homo sapiens
agcagaggaauaacaucacc

SEQ ID NO: 975396 - RNA, 14 nt, Homo sapiens
agcagccacucagu

SEQ ID NO: 975397 - RNA, 23 nt, Homo sapiens
agcagccucuggacagccaguga

SEQ ID NO: 975398 - RNA, 17 nt, Homo sapiens
ugaccucaggugaucca

SEQ ID NO: 975399 - RNA, 20 nt, Homo sapiens
ugaccuggcccccucagugu

SEQ ID NO: 975400 - RNA, 15 nt, Homo sapiens
ugaccuuugaccucg

SEQ ID NO: 975401 - RNA, 14 nt, Homo sapiens
ugacgcaccugugg

SEQ ID NO: 975402 - RNA, 20 nt, Homo sapiens
ugacgcuugugacagugccu

SEQ ID NO: 975403 - RNA, 20 nt, Homo sapiens
ugacugcucagaacuugcug

SEQ ID NO: 975404 - RNA, 20 nt, Homo sapiens
ugagaaccuuggaccacucc

SEQ ID NO: 975405 - RNA, 18 nt, Homo sapiens
ugagaagccuucagcucc

SEQ ID NO: 975406 - RNA, 17 nt, Homo sapiens
ugagacccauggcugug

SEQ ID NO: 975407 - RNA, 13 nt, Homo sapiens
ugagagacacugg

SEQ ID NO: 975408 - RNA, 21 nt, Homo sapiens
ugagagacacugggacacugu

SEQ ID NO: 975409 - RNA, 23 nt, Homo sapiens
ugagauaccacaaacccugcuga

SEQ ID NO: 975410 - RNA, 22 nt, Homo sapiens
ugagaugguucccaauaucaug

SEQ ID NO: 975411 - RNA, 21 nt, Homo sapiens
ugagcacagauguucccccau

SEQ ID NO: 975412 - RNA, 22 nt, Homo sapiens
ugagcaguguuggagugaggac

SEQ ID NO: 975413 - RNA, 16 nt, Homo sapiens
ugagcaguuagcagac

SEQ ID NO: 975414 - RNA, 15 nt, Homo sapiens
ugagccccagugcug

SEQ ID NO: 975415 - RNA, 19 nt, Homo sapiens
ugagcgggugccgaagcua

SEQ ID NO: 975416 - RNA, 14 nt, Homo sapiens
ugagcugagugcug

SEQ ID NO: 975417 - RNA, 15 nt, Homo sapiens
ugagcugagugcuga

SEQ ID NO: 975418 - RNA, 23 nt, Homo sapiens
ugaggaaaaauauuccugugacu

SEQ ID NO: 975419 - RNA, 17 nt, Homo sapiens
ugaggaaggacuugacu

SEQ ID NO: 975420 - RNA, 20 nt, Homo sapiens
ugaggaauaucacacucguc

SEQ ID NO: 975421 - RNA, 18 nt, Homo sapiens
ugaggcagauagcacugg

SEQ ID NO: 975422 - RNA, 15 nt, Homo sapiens
ugaggcccagugcau

SEQ ID NO: 975423 - RNA, 21 nt, Homo sapiens
ugaggcccagugcauaugcaa

SEQ ID NO: 975424 - RNA, 21 nt, Homo sapiens
ugagggcagcuccagugccag

SEQ ID NO: 975425 - RNA, 12 nt, Homo sapiens
ugaggggucccc

SEQ ID NO: 975426 - RNA, 12 nt, Homo sapiens
ugagggugcuga

SEQ ID NO: 975427 - RNA, 18 nt, Homo sapiens
ugagggugcugacuggcu

SEQ ID NO: 975428 - RNA, 22 nt, Homo sapiens
ugaggugcaaggaguguaaaau

SEQ ID NO: 975429 - RNA, 15 nt, Homo sapiens
ugagguugaggaaua

SEQ ID NO: 975430 - RNA, 16 nt, Homo sapiens
ugagguuucuucaggg

SEQ ID NO: 975431 - RNA, 20 nt, Homo sapiens
ugaguauuccaugagcugcu

SEQ ID NO: 975432 - RNA, 17 nt, Homo sapiens
ugagucagugcucucag

SEQ ID NO: 975433 - RNA, 16 nt, Homo sapiens
ugagugagcuggugac

SEQ ID NO: 975434 - RNA, 16 nt, Homo sapiens
ugaguugaaauguucu

SEQ ID NO: 975435 - RNA, 23 nt, Homo sapiens
ugaguugaggccacuguguuccu

SEQ ID NO: 975436 - RNA, 20 nt, Homo sapiens
ugaguuuuuccucccaguga

SEQ ID NO: 975437 - RNA, 14 nt, Homo sapiens
ugauaacaccagug

SEQ ID NO: 975438 - RNA, 23 nt, Homo sapiens
ugauacaacauuaaggaauuuga

SEQ ID NO: 975439 - RNA, 19 nt, Homo sapiens
ugauagauuucuacacuga

SEQ ID NO: 975440 - RNA, 20 nt, Homo sapiens
ugauagauuucuacacugag

SEQ ID NO: 975441 - RNA, 19 nt, Homo sapiens
ugauauggcagaagacacc

SEQ ID NO: 975442 - RNA, 21 nt, Homo sapiens
ugaucaauauuuuuauaucau

SEQ ID NO: 975443 - RNA, 17 nt, Homo sapiens
ugaucagaguuccuccu

SEQ ID NO: 975444 - RNA, 13 nt, Homo sapiens
aaaaagaaaugca

SEQ ID NO: 975445 - RNA, 13 nt, Homo sapiens
aaaaagcugcuuc

SEQ ID NO: 975446 - RNA, 11 nt, Homo sapiens
aaaaagggaau

SEQ ID NO: 975447 - RNA, 21 nt, Homo sapiens
aaaaagucaccaaauagugug

SEQ ID NO: 975448 - RNA, 19 nt, Homo sapiens
aaaaauaaaagaucuugaa

SEQ ID NO: 975449 - RNA, 21 nt, Homo sapiens
aaaaauauauaugcauaccug

SEQ ID NO: 975450 - RNA, 20 nt, Homo sapiens
aaaaauauuguuucugcauu

SEQ ID NO: 975451 - RNA, 20 nt, Homo sapiens
aaaaaucuuuucauuaaaga

SEQ ID NO: 975452 - RNA, 15 nt, Homo sapiens
aaaaauguguuccau

SEQ ID NO: 975453 - RNA, 21 nt, Homo sapiens
aaaaauguguuccauugccau

SEQ ID NO: 975454 - RNA, 21 nt, Homo sapiens
aaaaauuguaucucauuacuu

SEQ ID NO: 975455 - RNA, 22 nt, Homo sapiens
aaaacagcagcucauagaauuu

SEQ ID NO: 975456 - RNA, 20 nt, Homo sapiens
aaaacagcccccacuccagu

SEQ ID NO: 975457 - RNA, 12 nt, Homo sapiens
aaaaccaaagag

SEQ ID NO: 975458 - RNA, 12 nt, Homo sapiens
aaaacuuaucac

SEQ ID NO: 975459 - RNA, 20 nt, Homo sapiens
aaaagaucuugaauagucuc

SEQ ID NO: 975460 - RNA, 23 nt, Homo sapiens
aaaagcgcucccccgucgugcuu

SEQ ID NO: 975461 - RNA, 10 nt, Homo sapiens
aaaagcuuuc

SEQ ID NO: 975462 - RNA, 20 nt, Homo sapiens
aaaaggagcuucaguauugu

SEQ ID NO: 975463 - RNA, 19 nt, Homo sapiens
aaaagguuaaauauuguca

SEQ ID NO: 975464 - RNA, 16 nt, Homo sapiens
aaaagucccucccugc

SEQ ID NO: 975465 - RNA, 19 nt, Homo sapiens
aaaagucuacaacauagca

SEQ ID NO: 975466 - RNA, 15 nt, Homo sapiens
aaaauaaaagaucuu

SEQ ID NO: 975467 - RNA, 16 nt, Homo sapiens
aaaauaaaagaucuug

SEQ ID NO: 975468 - RNA, 13 nt, Homo sapiens
aaaauaaauucca

SEQ ID NO: 975469 - RNA, 12 nt, Homo sapiens
aaaauaauucua

SEQ ID NO: 975470 - RNA, 21 nt, Homo sapiens
aaaaucucuacugcuuuggau

SEQ ID NO: 975471 - RNA, 16 nt, Homo sapiens
aaaaucuguguaacug

SEQ ID NO: 975472 - RNA, 11 nt, Homo sapiens
aaaaugaaggu

SEQ ID NO: 975473 - RNA, 12 nt, Homo sapiens
aaaaugacauua

SEQ ID NO: 975474 - RNA, 15 nt, Homo sapiens
aaaaugccuuugaga

SEQ ID NO: 975475 - RNA, 22 nt, Homo sapiens
aaaauuaaauuuuagaucuuuc

SEQ ID NO: 975476 - RNA, 14 nt, Homo sapiens
aaaauuaugaccau

SEQ ID NO: 975477 - RNA, 13 nt, Homo sapiens
aaaauuauuugcu

SEQ ID NO: 975478 - RNA, 13 nt, Homo sapiens
aaaauucaaagca

SEQ ID NO: 975479 - RNA, 17 nt, Homo sapiens
aaaauuccaaauucaug

SEQ ID NO: 975480 - RNA, 15 nt, Homo sapiens
aaaauuccuaucuca

SEQ ID NO: 975481 - RNA, 17 nt, Homo sapiens
aaaauugggcaugccau

SEQ ID NO: 975482 - RNA, 18 nt, Homo sapiens
aaaauugguaacuaagaa

SEQ ID NO: 975483 - RNA, 23 nt, Homo sapiens
aaaauuuaauuuguccuuccuaa

SEQ ID NO: 975484 - RNA, 17 nt, Homo sapiens
aaaauuucauagcugua

SEQ ID NO: 975485 - RNA, 15 nt, Homo sapiens
aaaauuugucuuaaa

SEQ ID NO: 975486 - RNA, 18 nt, Homo sapiens
aaacaaaaaucuguguaa

SEQ ID NO: 975487 - RNA, 19 nt, Homo sapiens
aaacacacauugcagcuuc

SEQ ID NO: 975488 - RNA, 20 nt, Homo sapiens
aaacagcccccacuccaguc

SEQ ID NO: 975489 - RNA, 17 nt, Homo sapiens
aaacaggccaggcucca

SEQ ID NO: 975490 - RNA, 22 nt, Homo sapiens
aaacauguauguaaauagcuaa

SEQ ID NO: 975491 - RNA, 11 nt, Homo sapiens
aaacauuugcu

SEQ ID NO: 975492 - RNA, 18 nt, Homo sapiens
aaaccaaagagggcuucc

SEQ ID NO: 975493 - RNA, 20 nt, Homo sapiens
aaaccaaguaucacacuuua

SEQ ID NO: 975494 - RNA, 12 nt, Homo sapiens
aaaccacagcca

SEQ ID NO: 975495 - RNA, 20 nt, Homo sapiens
aaaccccaucuuuacuaaaa

SEQ ID NO: 975496 - RNA, 17 nt, Homo sapiens
aaacccucuccaucucc

SEQ ID NO: 975497 - RNA, 15 nt, Homo sapiens
aaacccugcugaaca

SEQ ID NO: 975498 - RNA, 21 nt, Homo sapiens
aaacccugcugaacacagugu

SEQ ID NO: 975499 - RNA, 16 nt, Homo sapiens
aaaccugaccccugcu

SEQ ID NO: 975500 - RNA, 21 nt, Homo sapiens
aaaccugaccccugcucagua

SEQ ID NO: 975501 - RNA, 19 nt, Homo sapiens
aaaccuucaguuaugauuu

SEQ ID NO: 975502 - RNA, 16 nt, Homo sapiens
aaacgggaacaugccc

SEQ ID NO: 975503 - RNA, 13 nt, Homo sapiens
aaacgguuccugg

SEQ ID NO: 975504 - RNA, 19 nt, Homo sapiens
aaacguuaguuaaucccuu

SEQ ID NO: 975505 - RNA, 18 nt, Homo sapiens
aaacuaaccagcauuccc

SEQ ID NO: 975506 - RNA, 22 nt, Homo sapiens
aaacucaaccuaacacauuaaa

SEQ ID NO: 975507 - RNA, 15 nt, Homo sapiens
aaacuccuaauucaa

SEQ ID NO: 975508 - RNA, 18 nt, Homo sapiens
aaacugacuaaacuuaca

SEQ ID NO: 975509 - RNA, 21 nt, Homo sapiens
aaacugaggaauuucaccugu

SEQ ID NO: 975510 - RNA, 17 nt, Homo sapiens
aaacuuacaaacuuugu

SEQ ID NO: 975511 - RNA, 19 nt, Homo sapiens
aaacuugaggcagagucuu

SEQ ID NO: 975512 - RNA, 23 nt, Homo sapiens
aaacuuuaggcccugccccagau

SEQ ID NO: 975513 - RNA, 16 nt, Homo sapiens
aaagaaauuccccaag

SEQ ID NO: 975514 - RNA, 17 nt, Homo sapiens
aaagaacuaaauaugca

SEQ ID NO: 975515 - RNA, 15 nt, Homo sapiens
aaagacguucccuuu

SEQ ID NO: 975516 - RNA, 16 nt, Homo sapiens
aaagacuuuguuaaau

SEQ ID NO: 975517 - RNA, 20 nt, Homo sapiens
aaagaggcugccccucucac

SEQ ID NO: 975518 - RNA, 14 nt, Homo sapiens
aaagagggcuuccu

SEQ ID NO: 975519 - RNA, 18 nt, Homo sapiens
aaagaucuugaauagucu

SEQ ID NO: 975520 - RNA, 19 nt, Homo sapiens
aaagaugucuauguagcug

SEQ ID NO: 975521 - RNA, 13 nt, Homo sapiens
aaagcacugagca

SEQ ID NO: 975522 - RNA, 16 nt, Homo sapiens
aaagccuuaagcaaau

SEQ ID NO: 975523 - RNA, 14 nt, Homo sapiens
aaaggaagacuaga

SEQ ID NO: 975524 - RNA, 21 nt, Homo sapiens
aaaggacaccuuuuaacucac

SEQ ID NO: 975525 - RNA, 15 nt, Homo sapiens
aaaggaggugggggc

SEQ ID NO: 975526 - RNA, 15 nt, Homo sapiens
aaaggccucuuguaa

SEQ ID NO: 975527 - RNA, 20 nt, Homo sapiens
aaagggagaauaaaauuccu

SEQ ID NO: 975528 - RNA, 14 nt, Homo sapiens
aaagggcaguuuug

SEQ ID NO: 975529 - RNA, 22 nt, Homo sapiens
aaagguaaaucccacaucccag

SEQ ID NO: 975530 - RNA, 20 nt, Homo sapiens
aaaguagaauaagccuucaa

SEQ ID NO: 975531 - RNA, 15 nt, Homo sapiens
aaaguuacaaacaga

SEQ ID NO: 975532 - RNA, 16 nt, Homo sapiens
aaaguucucauugaau

SEQ ID NO: 975533 - RNA, 12 nt, Homo sapiens
aaaguugugauc

SEQ ID NO: 975534 - RNA, 21 nt, Homo sapiens
ucucccuugggcucugaugaa

SEQ ID NO: 975535 - RNA, 14 nt, Homo sapiens
ucuccuccauuccc

SEQ ID NO: 975536 - RNA, 20 nt, Homo sapiens
ucuccucuucauggcaucuu

SEQ ID NO: 975537 - RNA, 21 nt, Homo sapiens
ucucuaaaugugacaugcaaa

SEQ ID NO: 975538 - RNA, 20 nt, Homo sapiens
ucucucuuauuuguauccua

SEQ ID NO: 975539 - RNA, 14 nt, Homo sapiens
ucucuuagagccau

SEQ ID NO: 975540 - RNA, 16 nt, Homo sapiens
ucucuuagcaacucag

SEQ ID NO: 975541 - RNA, 12 nt, Homo sapiens
ucucuucacuac

SEQ ID NO: 975542 - RNA, 17 nt, Homo sapiens
ucucuugccagcauuuu

SEQ ID NO: 975543 - RNA, 19 nt, Homo sapiens
ucugacgcuugugacagug

SEQ ID NO: 975544 - RNA, 22 nt, Homo sapiens
ucugaucuauauuucuggugaa

SEQ ID NO: 975545 - RNA, 13 nt, Homo sapiens
ucugcaagcauca

SEQ ID NO: 975546 - RNA, 15 nt, Homo sapiens
ucugcacaugucuug

SEQ ID NO: 975547 - RNA, 13 nt, Homo sapiens
ucugcccaccuac

SEQ ID NO: 975548 - RNA, 15 nt, Homo sapiens
ucugcccaugggaag

SEQ ID NO: 975549 - RNA, 19 nt, Homo sapiens
ucugcccuguguacuuccc

SEQ ID NO: 975550 - RNA, 20 nt, Homo sapiens
ucugccuuaaaaccaaagag

SEQ ID NO: 975551 - RNA, 21 nt, Homo sapiens
ucugccuuuggggacuuuucu

SEQ ID NO: 975552 - RNA, 18 nt, Homo sapiens
ucugcggaucucagcuuu

SEQ ID NO: 975553 - RNA, 16 nt, Homo sapiens
ucugcuauaugccuua

SEQ ID NO: 975554 - RNA, 22 nt, Homo sapiens
ucugcuccccugugaacccacu

SEQ ID NO: 975555 - RNA, 23 nt, Homo sapiens
ucuggaaaaaaacaaaaacagaa

SEQ ID NO: 975556 - RNA, 14 nt, Homo sapiens
ucuggaccccaaag

SEQ ID NO: 975557 - RNA, 22 nt, Homo sapiens
ucuggagaccguccuggagcug

SEQ ID NO: 975558 - RNA, 20 nt, Homo sapiens
ucuggcccuugcuuaccucu

SEQ ID NO: 975559 - RNA, 18 nt, Homo sapiens
ucugggcugccaugugaa

SEQ ID NO: 975560 - RNA, 22 nt, Homo sapiens
ucugggguccauucucugaguc

SEQ ID NO: 975561 - RNA, 15 nt, Homo sapiens
ucuguaaacuuccaa

SEQ ID NO: 975562 - RNA, 18 nt, Homo sapiens
ucuguaaguguagcucaa

SEQ ID NO: 975563 - RNA, 19 nt, Homo sapiens
ucuguagaauuagucaucu

SEQ ID NO: 975564 - RNA, 19 nt, Homo sapiens
ucuguauuuuauuuagaca

SEQ ID NO: 975565 - RNA, 12 nt, Homo sapiens
ucugucaggggu

SEQ ID NO: 975566 - RNA, 14 nt, Homo sapiens
ucugugccugaaua

SEQ ID NO: 975567 - RNA, 14 nt, Homo sapiens
ucuguuugacuuua

SEQ ID NO: 975568 - RNA, 24 nt, Homo sapiens
ucuguuuugcuuuuccauauagcu

SEQ ID NO: 975569 - RNA, 17 nt, Homo sapiens
ucuuaauugucuguaga

SEQ ID NO: 975570 - RNA, 14 nt, Homo sapiens
ucuuacuaaaaagu

SEQ ID NO: 975571 - RNA, 15 nt, Homo sapiens
ucuuagauucuuaau

SEQ ID NO: 975572 - RNA, 18 nt, Homo sapiens
ucuuauuaaucauacaaa

SEQ ID NO: 975573 - RNA, 19 nt, Homo sapiens
ucuucaauaugaaucuaua

SEQ ID NO: 975574 - RNA, 14 nt, Homo sapiens
ucuucacugccagg

SEQ ID NO: 975575 - RNA, 14 nt, Homo sapiens
ucuucauguugaug

SEQ ID NO: 975576 - RNA, 13 nt, Homo sapiens
ucuuccccagaga

SEQ ID NO: 975577 - RNA, 19 nt, Homo sapiens
ucuucccugggcugccacc

SEQ ID NO: 975578 - RNA, 23 nt, Homo sapiens
ucuucccugggcugccaccagcc

SEQ ID NO: 975579 - RNA, 15 nt, Homo sapiens
ucuuccuguguccug

SEQ ID NO: 975580 - RNA, 14 nt, Homo sapiens
ucuucucauuccca

SEQ ID NO: 975581 - RNA, 15 nt, Homo sapiens
ucuucucauucccau

SEQ ID NO: 975582 - RNA, 20 nt, Homo sapiens
ucuucugaacucaaacugag

SEQ ID NO: 975583 - RNA, 22 nt, Homo sapiens
gagcuucucacagcaaaccucu

SEQ ID NO: 975584 - RNA, 13 nt, Homo sapiens
gagcuugauuaaa

SEQ ID NO: 975585 - RNA, 23 nt, Homo sapiens
gagcuugcuccagauucugaugc

SEQ ID NO: 975586 - RNA, 21 nt, Homo sapiens
gaggaaagggaaggcuggcag

SEQ ID NO: 975587 - RNA, 16 nt, Homo sapiens
gaggaccuaucccaaa

SEQ ID NO: 975588 - RNA, 15 nt, Homo sapiens
gaggagugccagcuc

SEQ ID NO: 975589 - RNA, 19 nt, Homo sapiens
gaggaugaugccaguuacu

SEQ ID NO: 975590 - RNA, 17 nt, Homo sapiens
gaggcagauagcacugg

SEQ ID NO: 975591 - RNA, 21 nt, Homo sapiens
gaggcaggagaauggugugaa

SEQ ID NO: 975592 - RNA, 18 nt, Homo sapiens
gaggccgaggcgggugga

SEQ ID NO: 975593 - RNA, 18 nt, Homo sapiens
gaggcuccugcuuauuua

SEQ ID NO: 975594 - RNA, 18 nt, Homo sapiens
gaggcugccccucucacc

SEQ ID NO: 975595 - RNA, 13 nt, Homo sapiens
gagggcugcaguu

SEQ ID NO: 975596 - RNA, 14 nt, Homo sapiens
gaggguguggugcu

SEQ ID NO: 975597 - RNA, 21 nt, Homo sapiens
gaggguuccgccacuccaguu

SEQ ID NO: 975598 - RNA, 18 nt, Homo sapiens
gaggucaggaguugaaga

SEQ ID NO: 975599 - RNA, 14 nt, Homo sapiens
gagguugaagccaa

SEQ ID NO: 975600 - RNA, 15 nt, Homo sapiens
gagguugaagccaag

SEQ ID NO: 975601 - RNA, 20 nt, Homo sapiens
gaguccacgaugguggugga

SEQ ID NO: 975602 - RNA, 22 nt, Homo sapiens
gagugaaaaaucuuaaguacca

SEQ ID NO: 975603 - RNA, 22 nt, Homo sapiens
gagugcaacccagucacacugu

SEQ ID NO: 975604 - RNA, 14 nt, Homo sapiens
gagugcagggugga

SEQ ID NO: 975605 - RNA, 20 nt, Homo sapiens
gagugcaguggcaugaucau

SEQ ID NO: 975606 - RNA, 22 nt, Homo sapiens
gagugcugaaauaaaaugauaa

SEQ ID NO: 975607 - RNA, 16 nt, Homo sapiens
gaguguagacuguggc

SEQ ID NO: 975608 - RNA, 20 nt, Homo sapiens
gaguucuaaauacaggaaau

SEQ ID NO: 975609 - RNA, 9 nt, Homo sapiens
gaguucucu

SEQ ID NO: 975610 - RNA, 19 nt, Homo sapiens
gaguugaacuuuacugggg

SEQ ID NO: 975611 - RNA, 19 nt, Homo sapiens
gauaaaacacuaacuuaau

SEQ ID NO: 975612 - RNA, 12 nt, Homo sapiens
gauaaaccaaaa

SEQ ID NO: 975613 - RNA, 18 nt, Homo sapiens
gauaaacucagaucugau

SEQ ID NO: 975614 - RNA, 18 nt, Homo sapiens
gauaauuguuucauucau

SEQ ID NO: 975615 - RNA, 14 nt, Homo sapiens
gauacagaucucag

SEQ ID NO: 975616 - RNA, 14 nt, Homo sapiens
gauagcuacagugu

SEQ ID NO: 975617 - RNA, 16 nt, Homo sapiens
gauaucaggaaauauc

SEQ ID NO: 975618 - RNA, 16 nt, Homo sapiens
gauauucagaaguaua

SEQ ID NO: 975619 - RNA, 12 nt, Homo sapiens
gaucacuacuca

SEQ ID NO: 975620 - RNA, 19 nt, Homo sapiens
gaucacucaccauucccag

SEQ ID NO: 975621 - RNA, 22 nt, Homo sapiens
gaucagcauuuuagaaacuaca

SEQ ID NO: 975622 - RNA, 23 nt, Homo sapiens
gaucaucuuugccaccaccuggg

SEQ ID NO: 975623 - RNA, 17 nt, Homo sapiens
gauccuucagcacagga

SEQ ID NO: 975624 - RNA, 14 nt, Homo sapiens
gaucggacucugcc

SEQ ID NO: 975625 - RNA, 19 nt, Homo sapiens
ucagagcaugauacaaauu

SEQ ID NO: 975626 - RNA, 21 nt, Homo sapiens
ucagaguugcugcaaaccuga

SEQ ID NO: 975627 - RNA, 22 nt, Homo sapiens
ucagaguugcugcaaaccugac

SEQ ID NO: 975628 - RNA, 21 nt, Homo sapiens
ucagauacaugguugugaccu

SEQ ID NO: 975629 - RNA, 16 nt, Homo sapiens
ucagcacaaagacaca

SEQ ID NO: 975630 - RNA, 20 nt, Homo sapiens
ucagcagaugcuguugugaa

SEQ ID NO: 975631 - RNA, 22 nt, Homo sapiens
ucagcagaugcuguugugaagc

SEQ ID NO: 975632 - RNA, 22 nt, Homo sapiens
ucagcaucacccgggaacuuuu

SEQ ID NO: 975633 - RNA, 13 nt, Homo sapiens
ucagcauggcauc

SEQ ID NO: 975634 - RNA, 20 nt, Homo sapiens
ucagccagcucccagccaca

SEQ ID NO: 975635 - RNA, 20 nt, Homo sapiens
ucagcuuuucauaauaucua

SEQ ID NO: 975636 - RNA, 18 nt, Homo sapiens
ucaggaaauaucugugaa

SEQ ID NO: 975637 - RNA, 20 nt, Homo sapiens
ucaggcaugaagaagccacu

SEQ ID NO: 975638 - RNA, 19 nt, Homo sapiens
ucagggaaaaggguccagg

SEQ ID NO: 975639 - RNA, 19 nt, Homo sapiens
ucaggguucaucugaagau

SEQ ID NO: 975640 - RNA, 19 nt, Homo sapiens
ucaguaaauagugucauau

SEQ ID NO: 975641 - RNA, 14 nt, Homo sapiens
ucaguaagucucau

SEQ ID NO: 975642 - RNA, 20 nt, Homo sapiens
ucagucuuugcucagugucc

SEQ ID NO: 975643 - RNA, 13 nt, Homo sapiens
ucagugcaguuuc

SEQ ID NO: 975644 - RNA, 14 nt, Homo sapiens
ucagugcaguuucu

SEQ ID NO: 975645 - RNA, 22 nt, Homo sapiens
ucaguuaugauuuuuuuuucau

SEQ ID NO: 975646 - RNA, 16 nt, Homo sapiens
ucaguugcauucauua

SEQ ID NO: 975647 - RNA, 14 nt, Homo sapiens
ucauaaaaaucuag

SEQ ID NO: 975648 - RNA, 13 nt, Homo sapiens
ucauacacuuauu

SEQ ID NO: 975649 - RNA, 17 nt, Homo sapiens
ucauaccuucugaugaa

SEQ ID NO: 975650 - RNA, 20 nt, Homo sapiens
ucaucacauuucuaugccaa

SEQ ID NO: 975651 - RNA, 18 nt, Homo sapiens
ucaucccuuuuucugcua

SEQ ID NO: 975652 - RNA, 17 nt, Homo sapiens
ucauccuuccauccauc

SEQ ID NO: 975653 - RNA, 12 nt, Homo sapiens
ucaucugaagau

SEQ ID NO: 975654 - RNA, 14 nt, Homo sapiens
ucaugagccugcug

SEQ ID NO: 975655 - RNA, 19 nt, Homo sapiens
ucaugggagggggcuugaa

SEQ ID NO: 975656 - RNA, 20 nt, Homo sapiens
ucaugugagugggugggaug

SEQ ID NO: 975657 - RNA, 19 nt, Homo sapiens
ucauguguaauaugcacaa

SEQ ID NO: 975658 - RNA, 14 nt, Homo sapiens
ucauuauaagcuau

SEQ ID NO: 975659 - RNA, 16 nt, Homo sapiens
ucauuauuuuuuacaa

SEQ ID NO: 975660 - RNA, 15 nt, Homo sapiens
ucauuccuaacacag

SEQ ID NO: 975661 - RNA, 20 nt, Homo sapiens
ucauuccuaacacagcaugu

SEQ ID NO: 975662 - RNA, 13 nt, Homo sapiens
ucauuuagcuuuu

SEQ ID NO: 975663 - RNA, 15 nt, Homo sapiens
uccaaacucuucccu

SEQ ID NO: 975664 - RNA, 11 nt, Homo sapiens
uccaaccacug

SEQ ID NO: 975665 - RNA, 15 nt, Homo sapiens
uccaagcacagagcc

SEQ ID NO: 975666 - RNA, 16 nt, Homo sapiens
uccacacagugcucaa

SEQ ID NO: 975667 - RNA, 14 nt, Homo sapiens
uccaccaugaacuu

SEQ ID NO: 975668 - RNA, 13 nt, Homo sapiens
uccagaacacucu

SEQ ID NO: 975669 - RNA, 13 nt, Homo sapiens
uccagagccagaa

SEQ ID NO: 975670 - RNA, 16 nt, Homo sapiens
uccagaucacugccac

SEQ ID NO: 975671 - RNA, 20 nt, Homo sapiens
uccagcccagacccagugga

SEQ ID NO: 975672 - RNA, 19 nt, Homo sapiens
uccagcuugggcaacagag

SEQ ID NO: 975673 - RNA, 21 nt, Homo sapiens
uccaggguauggccauggagu

SEQ ID NO: 975674 - RNA, 16 nt, Homo sapiens
uccaggugauucuguu

SEQ ID NO: 975675 - RNA, 21 nt, Homo sapiens
uccauaaacaugaaaacacuu

SEQ ID NO: 975676 - RNA, 21 nt, Homo sapiens
uccauagugcacuagcauuuu

SEQ ID NO: 975677 - RNA, 18 nt, Homo sapiens
uccauauuuauuuaaaca

SEQ ID NO: 975678 - RNA, 17 nt, Homo sapiens
uccauccauuaccucca

SEQ ID NO: 975679 - RNA, 17 nt, Homo sapiens
uccaucccuccauucau

SEQ ID NO: 975680 - RNA, 13 nt, Homo sapiens
uccauccuuccaa

SEQ ID NO: 975681 - RNA, 15 nt, Homo sapiens
uccaucucaaaaaag

SEQ ID NO: 975682 - RNA, 21 nt, Homo sapiens
uccaucucccaaggcugccag

SEQ ID NO: 975683 - RNA, 19 nt, Homo sapiens
uccaugaccuaguuuucca

SEQ ID NO: 975684 - RNA, 18 nt, Homo sapiens
uccauuagagaguggcaa

SEQ ID NO: 975685 - RNA, 16 nt, Homo sapiens
uccauucauccuucca

SEQ ID NO: 975686 - RNA, 20 nt, Homo sapiens
augucacuucccugcuuaaa

SEQ ID NO: 975687 - RNA, 12 nt, Homo sapiens
auguccaaagag

SEQ ID NO: 975688 - RNA, 16 nt, Homo sapiens
auguccaccaugaacu

SEQ ID NO: 975689 - RNA, 16 nt, Homo sapiens
auguccuuucauuugu

SEQ ID NO: 975690 - RNA, 16 nt, Homo sapiens
augucuauucagcuuc

SEQ ID NO: 975691 - RNA, 17 nt, Homo sapiens
augucucuucugagcua

SEQ ID NO: 975692 - RNA, 15 nt, Homo sapiens
augucuucaauggaa

SEQ ID NO: 975693 - RNA, 13 nt, Homo sapiens
augugacccucca

SEQ ID NO: 975694 - RNA, 22 nt, Homo sapiens
augugacccuccaaauggagaa

SEQ ID NO: 975695 - RNA, 15 nt, Homo sapiens
augugagcaugucac

SEQ ID NO: 975696 - RNA, 21 nt, Homo sapiens
augugagcucuuccuaucccu

SEQ ID NO: 975697 - RNA, 16 nt, Homo sapiens
augugaugcaagccag

SEQ ID NO: 975698 - RNA, 16 nt, Homo sapiens
augugcauaguuucuu

SEQ ID NO: 975699 - RNA, 18 nt, Homo sapiens
augugcuauacacacaca

SEQ ID NO: 975700 - RNA, 18 nt, Homo sapiens
ucacauggccuaugcaca

SEQ ID NO: 975701 - RNA, 19 nt, Homo sapiens
ucacauuuagaaaagugaa

SEQ ID NO: 975702 - RNA, 19 nt, Homo sapiens
ucacccucuuccugugauc

SEQ ID NO: 975703 - RNA, 16 nt, Homo sapiens
ucacccuguauguuag

SEQ ID NO: 975704 - RNA, 18 nt, Homo sapiens
ucaccucuagguccccau

SEQ ID NO: 975705 - RNA, 14 nt, Homo sapiens
ucaccucucaaggu

SEQ ID NO: 975706 - RNA, 18 nt, Homo sapiens
ucaccuggcuaacugaug

SEQ ID NO: 975707 - RNA, 13 nt, Homo sapiens
ucaccuuacaggg

SEQ ID NO: 975708 - RNA, 17 nt, Homo sapiens
ucaccuuuucuguggcu

SEQ ID NO: 975709 - RNA, 13 nt, Homo sapiens
ucacgacucuucc

SEQ ID NO: 975710 - RNA, 14 nt, Homo sapiens
ucacuaguggcaaa

SEQ ID NO: 975711 - RNA, 16 nt, Homo sapiens
ucacuaugaagguaaa

SEQ ID NO: 975712 - RNA, 15 nt, Homo sapiens
ucacuggaaagggga

SEQ ID NO: 975713 - RNA, 23 nt, Homo sapiens
ucacuguggaagaaauuccuucc

SEQ ID NO: 975714 - RNA, 18 nt, Homo sapiens
ucacuuuucccacuccaa

SEQ ID NO: 975715 - RNA, 21 nt, Homo sapiens
ucagaaaguaacaaucuaugg

SEQ ID NO: 975716 - RNA, 15 nt, Homo sapiens
ucagaaaugucauga

SEQ ID NO: 975717 - RNA, 12 nt, Homo sapiens
ucagaaccagag

SEQ ID NO: 975718 - RNA, 17 nt, Homo sapiens
ucagaaccuugucccag

SEQ ID NO: 975719 - RNA, 18 nt, Homo sapiens
ucagacauacagcugccu

SEQ ID NO: 975720 - RNA, 13 nt, Homo sapiens
ucagacauuccaa

SEQ ID NO: 975721 - RNA, 16 nt, Homo sapiens
ucagaccaguacuggg

SEQ ID NO: 975722 - RNA, 14 nt, Homo sapiens
ucagagaugaacau

SEQ ID NO: 975723 - RNA, 15 nt, Homo sapiens
ucagagcuaaacucc

SEQ ID NO: 975724 - RNA, 20 nt, Homo sapiens
ucagagcuaacauaaaggac

SEQ ID NO: 975725 - RNA, 17 nt, Homo sapiens
ucagagcuccucacuua

SEQ ID NO: 975726 - RNA, 16 nt, Homo sapiens
ucagauaggagugaau

SEQ ID NO: 975727 - RNA, 15 nt, Homo sapiens
ucagauuuccacaga

SEQ ID NO: 975728 - RNA, 21 nt, Homo sapiens
ucagcaaacuaaccagcauuc

SEQ ID NO: 975729 - RNA, 16 nt, Homo sapiens
ucagcaacucgcuuua

SEQ ID NO: 975730 - RNA, 15 nt, Homo sapiens
ucagcacaaagacac

SEQ ID NO: 975731 - RNA, 15 nt, Homo sapiens
ucagcacaggaauuc

SEQ ID NO: 975732 - RNA, 21 nt, Homo sapiens
ucagcauuuagucuugccagg

SEQ ID NO: 975733 - RNA, 16 nt, Homo sapiens
ucagcccucaguuccu

SEQ ID NO: 975734 - RNA, 21 nt, Homo sapiens
ucaggaaggucuucaaucuua

SEQ ID NO: 975735 - RNA, 16 nt, Homo sapiens
ucaggagccaccagca

SEQ ID NO: 975736 - RNA, 20 nt, Homo sapiens
ucaggagcuugggcagugcc

SEQ ID NO: 975737 - RNA, 16 nt, Homo sapiens
ucaggaugcagcacug

SEQ ID NO: 975738 - RNA, 21 nt, Homo sapiens
ucaggcagcaccacacugggu

SEQ ID NO: 975739 - RNA, 14 nt, Homo sapiens
ucagguaguacugg

SEQ ID NO: 975740 - RNA, 14 nt, Homo sapiens
ucaggucaacugac

SEQ ID NO: 975741 - RNA, 18 nt, Homo sapiens
ucaggugccuuacaucuu

SEQ ID NO: 975742 - RNA, 21 nt, Homo sapiens
ucagucaucaaagcagaaguc

SEQ ID NO: 975743 - RNA, 23 nt, Homo sapiens
ucagucuacaaacugaacacugc

SEQ ID NO: 975744 - RNA, 20 nt, Homo sapiens
ucagugaaaaagauguacag

SEQ ID NO: 975745 - RNA, 23 nt, Homo sapiens
ucagugggaaacaaacugucuaa

SEQ ID NO: 975746 - RNA, 16 nt, Homo sapiens
ucaguucuacacugau

SEQ ID NO: 975747 - RNA, 16 nt, Homo sapiens
ucaguuuucacugucg

SEQ ID NO: 975748 - RNA, 23 nt, Homo sapiens
ucauaaaacaugaaucaagcaau

SEQ ID NO: 975749 - RNA, 20 nt, Homo sapiens
ucauaccagcauacgcucac

SEQ ID NO: 975750 - RNA, 20 nt, Homo sapiens
ucauaggauuaagcaguuua

SEQ ID NO: 975751 - RNA, 23 nt, Homo sapiens
ucauagggauggcagugauucug

SEQ ID NO: 975752 - RNA, 15 nt, Homo sapiens
ucauauuguucaaua

SEQ ID NO: 975753 - RNA, 12 nt, Homo sapiens
ucauccuuccau

SEQ ID NO: 975754 - RNA, 19 nt, Homo sapiens
ucaucuucuagaaucucgu

SEQ ID NO: 975755 - RNA, 19 nt, Homo sapiens
ucaucuuugccaccaccug

SEQ ID NO: 975756 - RNA, 16 nt, Homo sapiens
ucaugagccugcugga

SEQ ID NO: 975757 - RNA, 18 nt, Homo sapiens
ucaugagccugcuggaag

SEQ ID NO: 975758 - RNA, 11 nt, Homo sapiens
ucaugcacuuu

SEQ ID NO: 975759 - RNA, 20 nt, Homo sapiens
ucaugggagggggcuugaag

SEQ ID NO: 975760 - RNA, 17 nt, Homo sapiens
ucaugucccagaacuua

SEQ ID NO: 975761 - RNA, 18 nt, Homo sapiens
ucauuaaauugcuuuuaa

SEQ ID NO: 975762 - RNA, 19 nt, Homo sapiens
ucauuaauucagcucuuca

SEQ ID NO: 975763 - RNA, 14 nt, Homo sapiens
ucauuacaguucuu

SEQ ID NO: 975764 - RNA, 13 nt, Homo sapiens
ucauucauccuga

SEQ ID NO: 975765 - RNA, 18 nt, Homo sapiens
ucauucauucaaguaaua

SEQ ID NO: 975766 - RNA, 18 nt, Homo sapiens
ucauuccuuagauaccuu

SEQ ID NO: 975767 - RNA, 20 nt, Homo sapiens
ucauuccuuagauaccuuga

SEQ ID NO: 975768 - RNA, 19 nt, Homo sapiens
ucauugucgcucagcaaua

SEQ ID NO: 975769 - RNA, 13 nt, Homo sapiens
ucauuuacugugu

SEQ ID NO: 975770 - RNA, 12 nt, Homo sapiens
ucauuuagcuuu

SEQ ID NO: 975771 - RNA, 18 nt, Homo sapiens
uccaaaaauguguaagaa

SEQ ID NO: 975772 - RNA, 16 nt, Homo sapiens
uccaaagaaagauuaa

SEQ ID NO: 975773 - RNA, 20 nt, Homo sapiens
uccaaauggagaagcugcag

SEQ ID NO: 975774 - RNA, 18 nt, Homo sapiens
uccaacccgccggucuca

SEQ ID NO: 975775 - RNA, 21 nt, Homo sapiens
uccaagaacuauaaacuuaaa

SEQ ID NO: 975776 - RNA, 20 nt, Homo sapiens
uccaaggaggggcuguaaaa

SEQ ID NO: 975777 - RNA, 21 nt, Homo sapiens
uccaaguugcugcaaaauaca

SEQ ID NO: 975778 - RNA, 20 nt, Homo sapiens
uccaauucccaccacuaaaa

SEQ ID NO: 975779 - RNA, 14 nt, Homo sapiens
uccacacaucuccc

SEQ ID NO: 975780 - RNA, 14 nt, Homo sapiens
uccacacgcauuaa

SEQ ID NO: 975781 - RNA, 17 nt, Homo sapiens
uccaccccuuucuagac

SEQ ID NO: 975782 - RNA, 20 nt, Homo sapiens
uccaccucccaacacuguca

SEQ ID NO: 975783 - RNA, 15 nt, Homo sapiens
ggucuaggacacagu

SEQ ID NO: 975784 - RNA, 20 nt, Homo sapiens
ggucuuucugaauugcacau

SEQ ID NO: 975785 - RNA, 12 nt, Homo sapiens
ggucuuugcucc

SEQ ID NO: 975786 - RNA, 14 nt, Homo sapiens
ggucuuugcuccag

SEQ ID NO: 975787 - RNA, 19 nt, Homo sapiens
ggugaacguguccuucuca

SEQ ID NO: 975788 - RNA, 22 nt, Homo sapiens
ggugagacccauggcuguguug

SEQ ID NO: 975789 - RNA, 21 nt, Homo sapiens
gguggaucacgaggucaggag

SEQ ID NO: 975790 - RNA, 20 nt, Homo sapiens
gguggcaaaguacuugucau

SEQ ID NO: 975791 - RNA, 15 nt, Homo sapiens
gguggcccccucucc

SEQ ID NO: 975792 - RNA, 15 nt, Homo sapiens
ggugggauuccacuc

SEQ ID NO: 975793 - RNA, 17 nt, Homo sapiens
ggugggccucgggucca

SEQ ID NO: 975794 - RNA, 22 nt, Homo sapiens
ggugucugcgucgucaccaaau

SEQ ID NO: 975795 - RNA, 21 nt, Homo sapiens
gguuauguugauaaaccaaaa

SEQ ID NO: 975796 - RNA, 19 nt, Homo sapiens
gguuggacuguaagggauu

SEQ ID NO: 975797 - RNA, 21 nt, Homo sapiens
gguugucaucacuaguggcaa

SEQ ID NO: 975798 - RNA, 15 nt, Homo sapiens
gguuucaaagugaua

SEQ ID NO: 975799 - RNA, 23 nt, Homo sapiens
gguuuuuauguaaaacauuuuua

SEQ ID NO: 975800 - RNA, 23 nt, Homo sapiens
guaaacacauguucugugccugc

SEQ ID NO: 975801 - RNA, 18 nt, Homo sapiens
guaaagacugguuuucug

SEQ ID NO: 975802 - RNA, 14 nt, Homo sapiens
guaaagcagaggau

SEQ ID NO: 975803 - RNA, 20 nt, Homo sapiens
guaaagccuuaaguggcaga

SEQ ID NO: 975804 - RNA, 16 nt, Homo sapiens
guaaauacaugcauau

SEQ ID NO: 975805 - RNA, 18 nt, Homo sapiens
guaacaauacaugagaaa

SEQ ID NO: 975806 - RNA, 13 nt, Homo sapiens
cuucagcaaguua

SEQ ID NO: 975807 - RNA, 16 nt, Homo sapiens
cuucagcacaggaauu

SEQ ID NO: 975808 - RNA, 21 nt, Homo sapiens
cuucagcugggucacauccau

SEQ ID NO: 975809 - RNA, 18 nt, Homo sapiens
cuucagggcugaguucug

SEQ ID NO: 975810 - RNA, 21 nt, Homo sapiens
cuucaguaaaugugauucacc

SEQ ID NO: 975811 - RNA, 16 nt, Homo sapiens
cuuccaacaugugaug

SEQ ID NO: 975812 - RNA, 20 nt, Homo sapiens
cuuccaacccgccggucuca

SEQ ID NO: 975813 - RNA, 15 nt, Homo sapiens
cuuccacaauggucu

SEQ ID NO: 975814 - RNA, 13 nt, Homo sapiens
cuuccacuuugag

SEQ ID NO: 975815 - RNA, 18 nt, Homo sapiens
cuuccagaucacugccac

SEQ ID NO: 975816 - RNA, 20 nt, Homo sapiens
cuuccagugcccuaggccug

SEQ ID NO: 975817 - RNA, 17 nt, Homo sapiens
cuuccggcuuauggucu

SEQ ID NO: 975818 - RNA, 16 nt, Homo sapiens
cuuccucuagaagcca

SEQ ID NO: 975819 - RNA, 15 nt, Homo sapiens
cuuccugucugagua

SEQ ID NO: 975820 - RNA, 15 nt, Homo sapiens
cuuccuguguccuga

SEQ ID NO: 975821 - RNA, 16 nt, Homo sapiens
cuuccuguuacugaga

SEQ ID NO: 975822 - RNA, 17 nt, Homo sapiens
cuuccuguuacugagau

SEQ ID NO: 975823 - RNA, 19 nt, Homo sapiens
cuucgaggcuuuacagugu

SEQ ID NO: 975824 - RNA, 19 nt, Homo sapiens
cuucucagauuucugagga

SEQ ID NO: 975825 - RNA, 11 nt, Homo sapiens
cuucucaggaa

SEQ ID NO: 975826 - RNA, 15 nt, Homo sapiens
cuucucaucugcaaa

SEQ ID NO: 975827 - RNA, 19 nt, Homo sapiens
cuucucccacucuccuagg

SEQ ID NO: 975828 - RNA, 17 nt, Homo sapiens
cuucuccgccagccucc

SEQ ID NO: 975829 - RNA, 14 nt, Homo sapiens
cuucuccuacuuag

SEQ ID NO: 975830 - RNA, 15 nt, Homo sapiens
cuucucgaauugaag

SEQ ID NO: 975831 - RNA, 18 nt, Homo sapiens
cuucugccuucucaggaa

SEQ ID NO: 975832 - RNA, 23 nt, Homo sapiens
cuucuggggcaggcugggccaug

SEQ ID NO: 975833 - RNA, 19 nt, Homo sapiens
cuucuuacaugcauuugag

SEQ ID NO: 975834 - RNA, 21 nt, Homo sapiens
cuucuuagcacuguugagagg

SEQ ID NO: 975835 - RNA, 16 nt, Homo sapiens
cuucuuauuaaucaua

SEQ ID NO: 975836 - RNA, 18 nt, Homo sapiens
cuucuuguguccugauga

SEQ ID NO: 975837 - RNA, 22 nt, Homo sapiens
cuugaaaugaguaaaaacuaga

SEQ ID NO: 975838 - RNA, 15 nt, Homo sapiens
cuugagagacacugg

SEQ ID NO: 975839 - RNA, 18 nt, Homo sapiens
cuugagagacacugggac

SEQ ID NO: 975840 - RNA, 21 nt, Homo sapiens
cuugagcagaccgugauuugg

SEQ ID NO: 975841 - RNA, 23 nt, Homo sapiens
cuugagggcugcaguucuacuca

SEQ ID NO: 975842 - RNA, 20 nt, Homo sapiens
cuugaucuuaacaaagccuu

SEQ ID NO: 975843 - RNA, 21 nt, Homo sapiens
cuugaugacugccuugccucc

SEQ ID NO: 975844 - RNA, 13 nt, Homo sapiens
cuugauuuuugcc

SEQ ID NO: 975845 - RNA, 18 nt, Homo sapiens
cuugcacagcuggagaaa

SEQ ID NO: 975846 - RNA, 23 nt, Homo sapiens
cuugcagguuuucuucacugcca

SEQ ID NO: 975847 - RNA, 10 nt, Homo sapiens
cuugcauaau

SEQ ID NO: 975848 - RNA, 19 nt, Homo sapiens
cuugcauuuauuauucuca

SEQ ID NO: 975849 - RNA, 18 nt, Homo sapiens
cuugcccaguacauuuaa

SEQ ID NO: 975850 - RNA, 19 nt, Homo sapiens
cuuggaaaaaaaccacagc

SEQ ID NO: 975851 - RNA, 23 nt, Homo sapiens
cuuggaaauagaaagaagccaua

SEQ ID NO: 975852 - RNA, 17 nt, Homo sapiens
cuuggacagcaaggugg

SEQ ID NO: 975853 - RNA, 14 nt, Homo sapiens
cuuggagauuuauc

SEQ ID NO: 975854 - RNA, 18 nt, Homo sapiens
cuuggcuucgugaaugua

SEQ ID NO: 975855 - RNA, 16 nt, Homo sapiens
cuuggcuucugugaug

SEQ ID NO: 975856 - RNA, 17 nt, Homo sapiens
cuuggcuucugugauga

SEQ ID NO: 975857 - RNA, 18 nt, Homo sapiens
cuugggaagacuccuagc

SEQ ID NO: 975858 - RNA, 14 nt, Homo sapiens
cuugggcucugaug

SEQ ID NO: 975859 - RNA, 22 nt, Homo sapiens
cuuggggaaaauggccaugcag

SEQ ID NO: 975860 - RNA, 19 nt, Homo sapiens
cuuguaacuuaauauacua

SEQ ID NO: 975861 - RNA, 17 nt, Homo sapiens
cuuguaggggaggggcu

SEQ ID NO: 975862 - RNA, 16 nt, Homo sapiens
cuugugccauagucac

SEQ ID NO: 975863 - RNA, 15 nt, Homo sapiens
cuuguguccugauga

SEQ ID NO: 975864 - RNA, 16 nt, Homo sapiens
cuuguuaugcaucauu

SEQ ID NO: 975865 - RNA, 13 nt, Homo sapiens
cuuguucuacuga

SEQ ID NO: 975866 - RNA, 16 nt, Homo sapiens
cuuguucuacugagaa

SEQ ID NO: 975867 - RNA, 18 nt, Homo sapiens
cuuguuguuuuuaagucc

SEQ ID NO: 975868 - RNA, 21 nt, Homo sapiens
cuuuaaaauauuguugaacac

SEQ ID NO: 975869 - RNA, 22 nt, Homo sapiens
cuuuaaauacuauuauuugcua

SEQ ID NO: 975870 - RNA, 22 nt, Homo sapiens
cuuuaagaagcaguguuuuaga

SEQ ID NO: 975871 - RNA, 14 nt, Homo sapiens
gaggagacagccuc

SEQ ID NO: 975872 - RNA, 15 nt, Homo sapiens
gaggaguaaaauuca

SEQ ID NO: 975873 - RNA, 18 nt, Homo sapiens
gaggaugggucagagcua

SEQ ID NO: 975874 - RNA, 21 nt, Homo sapiens
gaggcaccugcuggaaaccac

SEQ ID NO: 975875 - RNA, 20 nt, Homo sapiens
gaggcacucagugagccucc

SEQ ID NO: 975876 - RNA, 14 nt, Homo sapiens
gaggccaugugcau

SEQ ID NO: 975877 - RNA, 22 nt, Homo sapiens
gaggcuccgccccagcccucag

SEQ ID NO: 975878 - RNA, 15 nt, Homo sapiens
gagggagaagcauga

SEQ ID NO: 975879 - RNA, 17 nt, Homo sapiens
gagggaggucacuggaa

SEQ ID NO: 975880 - RNA, 16 nt, Homo sapiens
gagggcagacuggggc

SEQ ID NO: 975881 - RNA, 13 nt, Homo sapiens
gagggcagcugcu

SEQ ID NO: 975882 - RNA, 19 nt, Homo sapiens
gagggccgugagggguccc

SEQ ID NO: 975883 - RNA, 18 nt, Homo sapiens
gagggggcuugaagccaa

SEQ ID NO: 975884 - RNA, 19 nt, Homo sapiens
gagggggcuugaagccaaa

SEQ ID NO: 975885 - RNA, 15 nt, Homo sapiens
gaggguggcugccuc

SEQ ID NO: 975886 - RNA, 15 nt, Homo sapiens
gaggguguggugcuu

SEQ ID NO: 975887 - RNA, 13 nt, Homo sapiens
gaggucacuggaa

SEQ ID NO: 975888 - RNA, 20 nt, Homo sapiens
gagguggggcuggaugucuc

SEQ ID NO: 975889 - RNA, 22 nt, Homo sapiens
gaguaauaagcauggugucagu

SEQ ID NO: 975890 - RNA, 23 nt, Homo sapiens
gaguaccaaauccacaagccauu

SEQ ID NO: 975891 - RNA, 19 nt, Homo sapiens
gaguaccuacugugugcca

SEQ ID NO: 975892 - RNA, 22 nt, Homo sapiens
gaguauuccaugagcugcucau

SEQ ID NO: 975893 - RNA, 9 nt, Homo sapiens
gagucucca

SEQ ID NO: 975894 - RNA, 13 nt, Homo sapiens
gagucuccuucau

SEQ ID NO: 975895 - RNA, 20 nt, Homo sapiens
gagucuguacuaaacaguaa

SEQ ID NO: 975896 - RNA, 13 nt, Homo sapiens
gauaagucuuuca

SEQ ID NO: 975897 - RNA, 13 nt, Homo sapiens
gauacacuugaag

SEQ ID NO: 975898 - RNA, 21 nt, Homo sapiens
gauacagauuuaagaauaccu

SEQ ID NO: 975899 - RNA, 12 nt, Homo sapiens
gauacauuucau

SEQ ID NO: 975900 - RNA, 22 nt, Homo sapiens
gauaccuguaguggaacuaaaa

SEQ ID NO: 975901 - RNA, 20 nt, Homo sapiens
gauagaacaaugcuauaaua

SEQ ID NO: 975902 - RNA, 13 nt, Homo sapiens
gauagacuuggga

SEQ ID NO: 975903 - RNA, 22 nt, Homo sapiens
gauaucaggaaauaucugugaa

SEQ ID NO: 975904 - RNA, 20 nt, Homo sapiens
gauauguugaauuaacauaa

SEQ ID NO: 975905 - RNA, 18 nt, Homo sapiens
gaucaagaaaaaaaggga

SEQ ID NO: 975906 - RNA, 21 nt, Homo sapiens
gaucaaguccuaguuguucag

SEQ ID NO: 975907 - RNA, 15 nt, Homo sapiens
gaucaucuuugccac

SEQ ID NO: 975908 - RNA, 18 nt, Homo sapiens
gauccuuagagguccucu

SEQ ID NO: 975909 - RNA, 20 nt, Homo sapiens
gaucucagcagugaaguaua

SEQ ID NO: 975910 - RNA, 23 nt, Homo sapiens
gaucucgcuagguagaacacugc

SEQ ID NO: 975911 - RNA, 18 nt, Homo sapiens
gaucucugggaguuauag

SEQ ID NO: 975912 - RNA, 16 nt, Homo sapiens
gaucuguuguaauauc

SEQ ID NO: 975913 - RNA, 14 nt, Homo sapiens
gaugacugccuugc

SEQ ID NO: 975914 - RNA, 22 nt, Homo sapiens
gaugacuuucuuuuuguagcug

SEQ ID NO: 975915 - RNA, 16 nt, Homo sapiens
gaugcaggauuucuuc

SEQ ID NO: 975916 - RNA, 15 nt, Homo sapiens
gaugcuaagcugaua

SEQ ID NO: 975917 - RNA, 12 nt, Homo sapiens
gauggaauauca

SEQ ID NO: 975918 - RNA, 21 nt, Homo sapiens
gauggacuggccccugaccca

SEQ ID NO: 975919 - RNA, 21 nt, Homo sapiens
gauggccucucucaaaagaga

SEQ ID NO: 975920 - RNA, 16 nt, Homo sapiens
gauggggcgagccagg

SEQ ID NO: 975921 - RNA, 21 nt, Homo sapiens
gauggugguggaaggugugcu

SEQ ID NO: 975922 - RNA, 17 nt, Homo sapiens
gaugguuagucaccugc

SEQ ID NO: 975923 - RNA, 19 nt, Homo sapiens
gaugguuuuaucuucccuu

SEQ ID NO: 975924 - RNA, 22 nt, Homo sapiens
gauguaccaggcucucgcacac

SEQ ID NO: 975925 - RNA, 13 nt, Homo sapiens
gauguauauccau

SEQ ID NO: 975926 - RNA, 19 nt, Homo sapiens
ugugccugcucagcagagc

SEQ ID NO: 975927 - RNA, 17 nt, Homo sapiens
ugugcuauacacacaca

SEQ ID NO: 975928 - RNA, 19 nt, Homo sapiens
ugugcuuucagaagugccc

SEQ ID NO: 975929 - RNA, 21 nt, Homo sapiens
uguggaucaaccaucgcuuua

SEQ ID NO: 975930 - RNA, 20 nt, Homo sapiens
uguggcauuuccaaacaucc

SEQ ID NO: 975931 - RNA, 11 nt, Homo sapiens
uguggccacaa

SEQ ID NO: 975932 - RNA, 22 nt, Homo sapiens
uguguaacuguaaaacauugaa

SEQ ID NO: 975933 - RNA, 24 nt, Homo sapiens
uguguauuuccagugcaauuguag

SEQ ID NO: 975934 - RNA, 14 nt, Homo sapiens
uguguucucaguga

SEQ ID NO: 975935 - RNA, 19 nt, Homo sapiens
uguuaaggagcuucaggga

SEQ ID NO: 975936 - RNA, 22 nt, Homo sapiens
uguuaaugcuuuucccacucuc

SEQ ID NO: 975937 - RNA, 15 nt, Homo sapiens
uguuacacauugagg

SEQ ID NO: 975938 - RNA, 19 nt, Homo sapiens
uguuacugagaugucuuca

SEQ ID NO: 975939 - RNA, 16 nt, Homo sapiens
uguucauggacuauuc

SEQ ID NO: 975940 - RNA, 23 nt, Homo sapiens
uguucccccuaaacauggcuguu

SEQ ID NO: 975941 - RNA, 22 nt, Homo sapiens
uguucccuccccgaucaucuuu

SEQ ID NO: 975942 - RNA, 22 nt, Homo sapiens
uguucgggccaaggaccugaga

SEQ ID NO: 975943 - RNA, 13 nt, Homo sapiens
uguucuacacuca

SEQ ID NO: 975944 - RNA, 19 nt, Homo sapiens
uguucugccuggagacaag

SEQ ID NO: 975945 - RNA, 21 nt, Homo sapiens
uguucuguggcugauuuacua

SEQ ID NO: 975946 - RNA, 15 nt, Homo sapiens
uguugauuuccucug

SEQ ID NO: 975947 - RNA, 19 nt, Homo sapiens
uguugucaccagaucugau

SEQ ID NO: 975948 - RNA, 23 nt, Homo sapiens
uguuugccaggacaugcaauaaa

SEQ ID NO: 975949 - RNA, 12 nt, Homo sapiens
uguuugccucau

SEQ ID NO: 975950 - RNA, 14 nt, Homo sapiens
uuaaaaaacuucau

SEQ ID NO: 975951 - RNA, 13 nt, Homo sapiens
uuaaaaccaaaga

SEQ ID NO: 975952 - RNA, 14 nt, Homo sapiens
uuaaaaccaaagag

SEQ ID NO: 975953 - RNA, 22 nt, Homo sapiens
uuaaaauaaugaacacuacaga

SEQ ID NO: 975954 - RNA, 12 nt, Homo sapiens
uuaaaaugugua

SEQ ID NO: 975955 - RNA, 19 nt, Homo sapiens
uuaaacacacauugcagcu

SEQ ID NO: 975956 - RNA, 20 nt, Homo sapiens
uuaaacagaugugaauauuc

SEQ ID NO: 975957 - RNA, 17 nt, Homo sapiens
uuaaauacccaucuuca

SEQ ID NO: 975958 - RNA, 17 nt, Homo sapiens
uuaaauauauaauguug

SEQ ID NO: 975959 - RNA, 23 nt, Homo sapiens
uuaaaucaacuuuaucauaugcu

SEQ ID NO: 975960 - RNA, 20 nt, Homo sapiens
uuaaaugcaauaauuuuacu

SEQ ID NO: 975961 - RNA, 13 nt, Homo sapiens
uuaaauguggaag

SEQ ID NO: 975962 - RNA, 15 nt, Homo sapiens
uuaacaaaauccuca

SEQ ID NO: 975963 - RNA, 22 nt, Homo sapiens
uuaaccaagauuaaaugggaug

SEQ ID NO: 975964 - RNA, 17 nt, Homo sapiens
uuaacguauauugcugu

SEQ ID NO: 975965 - RNA, 15 nt, Homo sapiens
uuaacugcauccagc

SEQ ID NO: 975966 - RNA, 15 nt, Homo sapiens
uuaagaagacauacu

SEQ ID NO: 975967 - RNA, 15 nt, Homo sapiens
uuaagagacacucca

SEQ ID NO: 975968 - RNA, 23 nt, Homo sapiens
uuaagggaacugaaucacuuaaa

SEQ ID NO: 975969 - RNA, 16 nt, Homo sapiens
uuaagugacuauagaa

SEQ ID NO: 975970 - RNA, 20 nt, Homo sapiens
uuaauacauugaucaggcca

SEQ ID NO: 975971 - RNA, 16 nt, Homo sapiens
uuaauaucaacucuga

SEQ ID NO: 975972 - RNA, 15 nt, Homo sapiens
uuaauauccaagacu

SEQ ID NO: 975973 - RNA, 20 nt, Homo sapiens
uuaauauuugcacaugggau

SEQ ID NO: 975974 - RNA, 16 nt, Homo sapiens
uuaaugauaaacucag

SEQ ID NO: 975975 - RNA, 12 nt, Homo sapiens
uuaauguacaaa

SEQ ID NO: 975976 - RNA, 20 nt, Homo sapiens
uuaauuacuucuuaguaugu

SEQ ID NO: 975977 - RNA, 15 nt, Homo sapiens
uuaauugccagcaaa

SEQ ID NO: 975978 - RNA, 12 nt, Homo sapiens
uuacaaacagac

SEQ ID NO: 975979 - RNA, 19 nt, Homo sapiens
uuacaaagacaaagccuua

SEQ ID NO: 975980 - RNA, 20 nt, Homo sapiens
uuacaacccagggugugaac

SEQ ID NO: 975981 - RNA, 20 nt, Homo sapiens
uuacaauaggaguggugauu

SEQ ID NO: 975982 - RNA, 14 nt, Homo sapiens
uuacaugcauuuga

SEQ ID NO: 975983 - RNA, 19 nt, Homo sapiens
uuaccaaggaugaaagagg

SEQ ID NO: 975984 - RNA, 22 nt, Homo sapiens
uuaccacuugugauucaaacaa

SEQ ID NO: 975985 - RNA, 15 nt, Homo sapiens
uuacccuugaucuua

SEQ ID NO: 975986 - RNA, 21 nt, Homo sapiens
uuaccuccauccauccuucca

SEQ ID NO: 975987 - RNA, 15 nt, Homo sapiens
uuaccuccucauggc

SEQ ID NO: 975988 - RNA, 21 nt, Homo sapiens
uuaccugauuugaugauacau

SEQ ID NO: 975989 - RNA, 15 nt, Homo sapiens
uuaccuuuucagggc

SEQ ID NO: 975990 - RNA, 20 nt, Homo sapiens
uuacuugcccugaacauaca

SEQ ID NO: 975991 - RNA, 16 nt, Homo sapiens
uuagaacuccaguuuu

SEQ ID NO: 975992 - RNA, 18 nt, Homo sapiens
uuagaauauccaugaccu

SEQ ID NO: 975993 - RNA, 17 nt, Homo sapiens
uuagaauccgaagggaa

SEQ ID NO: 975994 - RNA, 18 nt, Homo sapiens
uuagagauuauaacaaau

SEQ ID NO: 975995 - RNA, 13 nt, Homo sapiens
uuagagcugggaa

SEQ ID NO: 975996 - RNA, 16 nt, Homo sapiens
uuagaguaaugaaaug

SEQ ID NO: 975997 - RNA, 17 nt, Homo sapiens
uuagaguaaugaaaugg

SEQ ID NO: 975998 - RNA, 22 nt, Homo sapiens
uuagaguugcucuacaaugaca

SEQ ID NO: 975999 - RNA, 16 nt, Homo sapiens
uuagauccaauuccca

SEQ ID NO: 976000 - RNA, 19 nt, Homo sapiens
uuagauuucccuauuguga

SEQ ID NO: 976001 - RNA, 22 nt, Homo sapiens
uuagcgcuggcuucauucucag

SEQ ID NO: 976002 - RNA, 16 nt, Homo sapiens
uuagcuauguugacau

SEQ ID NO: 976003 - RNA, 18 nt, Homo sapiens
uuaguggauuacugccau

SEQ ID NO: 976004 - RNA, 23 nt, Homo sapiens
uuaguguucuguuugaaacuaau

SEQ ID NO: 976005 - RNA, 22 nt, Homo sapiens
uuauacaccagcaauuuagaca

SEQ ID NO: 976006 - RNA, 20 nt, Homo sapiens
uuaucaaaaaguacaauaau

SEQ ID NO: 976007 - RNA, 20 nt, Homo sapiens
uuauccuccaccgucuuucu

SEQ ID NO: 976008 - RNA, 11 nt, Homo sapiens
uuaucugcuag

SEQ ID NO: 976009 - RNA, 13 nt, Homo sapiens
uuauuaacuacug

SEQ ID NO: 976010 - RNA, 13 nt, Homo sapiens
uuauuaaguaaaa

SEQ ID NO: 976011 - RNA, 23 nt, Homo sapiens
uuauuaaucauacaaacucucac

SEQ ID NO: 976012 - RNA, 14 nt, Homo sapiens
uuauugacacugaa

SEQ ID NO: 976013 - RNA, 15 nt, Homo sapiens
uuauuuaauaacauu

SEQ ID NO: 976014 - RNA, 15 nt, Homo sapiens
uuauuucaaagggaa

SEQ ID NO: 976015 - RNA, 14 nt, Homo sapiens
uuauuuuugucaaa

SEQ ID NO: 976016 - RNA, 23 nt, Homo sapiens
uucaaacaggccaggcuccagca

SEQ ID NO: 976017 - RNA, 17 nt, Homo sapiens
uucaacaugcuccaaau

SEQ ID NO: 976018 - RNA, 18 nt, Homo sapiens
uucaaccacagauuuaua

SEQ ID NO: 976019 - RNA, 14 nt, Homo sapiens
uucaagcagcaucu

SEQ ID NO: 976020 - RNA, 21 nt, Homo sapiens
uucaaggccccgagcuguuac

SEQ ID NO: 976021 - RNA, 20 nt, Homo sapiens
uucaauauuuguuacuguua

SEQ ID NO: 976022 - RNA, 18 nt, Homo sapiens
uucaaucuguaaacugug

SEQ ID NO: 976023 - RNA, 15 nt, Homo sapiens
uucaauuaguaacau

SEQ ID NO: 976024 - RNA, 16 nt, Homo sapiens
uucaccuugauaaggu

SEQ ID NO: 976025 - RNA, 14 nt, Homo sapiens
uucacuuccagaga

SEQ ID NO: 976026 - RNA, 19 nt, Homo sapiens
uucagcuucuaugcauuaa

SEQ ID NO: 976027 - RNA, 17 nt, Homo sapiens
uucaggaaggucuucaa

SEQ ID NO: 976028 - RNA, 20 nt, Homo sapiens
uucagugcuuuuacuaucug

SEQ ID NO: 976029 - RNA, 19 nt, Homo sapiens
uucauaauaucuaugcuga

SEQ ID NO: 976030 - RNA, 15 nt, Homo sapiens
uucauaaugugagau

SEQ ID NO: 976031 - RNA, 18 nt, Homo sapiens
uucauccuuccauccauc

SEQ ID NO: 976032 - RNA, 19 nt, Homo sapiens
uucaugacauaauaaagua

SEQ ID NO: 976033 - RNA, 16 nt, Homo sapiens
uucauggcuaccucag

SEQ ID NO: 976034 - RNA, 19 nt, Homo sapiens
uucauguaauagcaaugca

SEQ ID NO: 976035 - RNA, 22 nt, Homo sapiens
uucauguuggucugacaucaag

SEQ ID NO: 976036 - RNA, 17 nt, Homo sapiens
uucauuaauuaguucca

SEQ ID NO: 976037 - RNA, 23 nt, Homo sapiens
uucauuaauuaguuccaguuucu

SEQ ID NO: 976038 - RNA, 18 nt, Homo sapiens
uucauuaucauaugaacu

SEQ ID NO: 976039 - RNA, 15 nt, Homo sapiens
uucauuucauuucag

SEQ ID NO: 976040 - RNA, 12 nt, Homo sapiens
uucauuuguaug

SEQ ID NO: 976041 - RNA, 17 nt, Homo sapiens
uuccaaacucuucccuc

SEQ ID NO: 976042 - RNA, 18 nt, Homo sapiens
uuccaaaugccauccaga

SEQ ID NO: 976043 - RNA, 18 nt, Homo sapiens
uuccaaauuaggaagugu

SEQ ID NO: 976044 - RNA, 12 nt, Homo sapiens
uuccaaauucau

SEQ ID NO: 976045 - RNA, 23 nt, Homo sapiens
uuccagauguggauuuggcaaaa

SEQ ID NO: 976046 - RNA, 19 nt, Homo sapiens
uuccagggauuugccucac

SEQ ID NO: 976047 - RNA, 22 nt, Homo sapiens
uuccaguuccucuuuugugcug

SEQ ID NO: 976048 - RNA, 16 nt, Homo sapiens
uuccauuaugauucuu

SEQ ID NO: 976049 - RNA, 17 nt, Homo sapiens
uuccauuuccauguccc

SEQ ID NO: 976050 - RNA, 15 nt, Homo sapiens
uucccacagugccua

SEQ ID NO: 976051 - RNA, 23 nt, Homo sapiens
uucccaggagauggguccagggg

SEQ ID NO: 976052 - RNA, 21 nt, Homo sapiens
uucccaggccagcaagcucuu

SEQ ID NO: 976053 - RNA, 19 nt, Homo sapiens
uucccaucuguuucugugu

SEQ ID NO: 976054 - RNA, 22 nt, Homo sapiens
uucccauuuccuugucuaaaga

SEQ ID NO: 976055 - RNA, 17 nt, Homo sapiens
uuccccaaaggcaucca

SEQ ID NO: 976056 - RNA, 18 nt, Homo sapiens
uucccccaauguuuaaaa

SEQ ID NO: 976057 - RNA, 12 nt, Homo sapiens
uucccuagcuuu

SEQ ID NO: 976058 - RNA, 20 nt, Homo sapiens
uucccugggcugccaccagc

SEQ ID NO: 976059 - RNA, 14 nt, Homo sapiens
uuccgccacuccag

SEQ ID NO: 976060 - RNA, 22 nt, Homo sapiens
uuccgcuuggagcuauuuucca

SEQ ID NO: 976061 - RNA, 11 nt, Homo sapiens
uuccuaucuca

SEQ ID NO: 976062 - RNA, 18 nt, Homo sapiens
uuccuccuuuaccuuuca

SEQ ID NO: 976063 - RNA, 20 nt, Homo sapiens
uuccucuccacacagugcuc

SEQ ID NO: 976064 - RNA, 18 nt, Homo sapiens
uuccucuccacugcugga

SEQ ID NO: 976065 - RNA, 22 nt, Homo sapiens
uuccucuugugauuucuuuaaa

SEQ ID NO: 976066 - RNA, 16 nt, Homo sapiens
uuccugagaccacaga

SEQ ID NO: 976067 - RNA, 21 nt, Homo sapiens
uuccuggccugagagucagcu

SEQ ID NO: 976068 - RNA, 16 nt, Homo sapiens
uuccuggugacuccug

SEQ ID NO: 976069 - RNA, 20 nt, Homo sapiens
uuccugucuuauccuccacc

SEQ ID NO: 976070 - RNA, 11 nt, Homo sapiens
uuccugugauc

SEQ ID NO: 976071 - RNA, 15 nt, Homo sapiens
uuccuguuacugaga

SEQ ID NO: 976072 - RNA, 15 nt, Homo sapiens
uuccuuaaguauuau

SEQ ID NO: 976073 - RNA, 13 nt, Homo sapiens
uuccuuguauucu

SEQ ID NO: 976074 - RNA, 20 nt, Homo sapiens
uuccuuuucccugcuuccag

SEQ ID NO: 976075 - RNA, 14 nt, Homo sapiens
uucgaacaccaaaa

SEQ ID NO: 976076 - RNA, 21 nt, Homo sapiens
uucuaaagacuuguauagcau

SEQ ID NO: 976077 - RNA, 22 nt, Homo sapiens
uucuaacagugaaguuuuacug

SEQ ID NO: 976078 - RNA, 17 nt, Homo sapiens
uucuacaacugauugca

SEQ ID NO: 976079 - RNA, 20 nt, Homo sapiens
uucuacaacugauugcaaca

SEQ ID NO: 976080 - RNA, 16 nt, Homo sapiens
uucuaguggucuuugu

SEQ ID NO: 976081 - RNA, 22 nt, Homo sapiens
uucuauuaauaucaacucugaa

SEQ ID NO: 976082 - RNA, 15 nt, Homo sapiens
uucucaaaguuuuga

SEQ ID NO: 976083 - RNA, 13 nt, Homo sapiens
uucucaaucuccu

SEQ ID NO: 976084 - RNA, 14 nt, Homo sapiens
uucucacagcaaac

SEQ ID NO: 976085 - RNA, 13 nt, Homo sapiens
uucucaucugcaa

SEQ ID NO: 976086 - RNA, 13 nt, Homo sapiens
uucucaugaucca

SEQ ID NO: 976087 - RNA, 17 nt, Homo sapiens
uucuccaagaaacugaa

SEQ ID NO: 976088 - RNA, 23 nt, Homo sapiens
uucugcuguuuuuuuugcugcua

SEQ ID NO: 976089 - RNA, 17 nt, Homo sapiens
uucugggcuucaucugg

SEQ ID NO: 976090 - RNA, 22 nt, Homo sapiens
uucuggucuggcggcugugcau

SEQ ID NO: 976091 - RNA, 23 nt, Homo sapiens
uucuguaucuuucauccuugacu

SEQ ID NO: 976092 - RNA, 23 nt, Homo sapiens
uucugucaagcuggugcuacugu

SEQ ID NO: 976093 - RNA, 19 nt, Homo sapiens
uucuuaacuaucauuauuu

SEQ ID NO: 976094 - RNA, 17 nt, Homo sapiens
uucuuacaugcauuuga

SEQ ID NO: 976095 - RNA, 16 nt, Homo sapiens
uucuuacuaaaaagua

SEQ ID NO: 976096 - RNA, 19 nt, Homo sapiens
uucuugaaauuuuaaccua

SEQ ID NO: 976097 - RNA, 13 nt, Homo sapiens
uucuugaaccaau

SEQ ID NO: 976098 - RNA, 20 nt, Homo sapiens
uucuugguagauuauucaua

SEQ ID NO: 976099 - RNA, 20 nt, Homo sapiens
uucuuuauggucgauauaca

SEQ ID NO: 976100 - RNA, 19 nt, Homo sapiens
uucuuucagaaagcuuuga

SEQ ID NO: 976101 - RNA, 17 nt, Homo sapiens
uucuuuuaaugaugcca

SEQ ID NO: 976102 - RNA, 18 nt, Homo sapiens
uucuuuuuugcccccaga

SEQ ID NO: 976103 - RNA, 18 nt, Homo sapiens
uugaaaguuaacauuaau

SEQ ID NO: 976104 - RNA, 20 nt, Homo sapiens
uugaaaugagaaacuuugau

SEQ ID NO: 976105 - RNA, 22 nt, Homo sapiens
uugaaaugaguaaaaacuagaa

SEQ ID NO: 976106 - RNA, 17 nt, Homo sapiens
uugaaauguucugucaa

SEQ ID NO: 976107 - RNA, 21 nt, Homo sapiens
uugaacauguuuaauggguau

SEQ ID NO: 976108 - RNA, 12 nt, Homo sapiens
uugaacuugagu

SEQ ID NO: 976109 - RNA, 18 nt, Homo sapiens
uugaagaaaauagucagu

SEQ ID NO: 976110 - RNA, 11 nt, Homo sapiens
uugaagccaaa

SEQ ID NO: 976111 - RNA, 13 nt, Homo sapiens
uugaagccaucua

SEQ ID NO: 976112 - RNA, 24 nt, Homo sapiens
uugaauacgcuaauaagugacaaa

SEQ ID NO: 976113 - RNA, 14 nt, Homo sapiens
uugaauagucucau

SEQ ID NO: 976114 - RNA, 20 nt, Homo sapiens
uugaaucuacauucacuuuu

SEQ ID NO: 976115 - RNA, 20 nt, Homo sapiens
uugaauguuuucaaaaccaa

SEQ ID NO: 976116 - RNA, 19 nt, Homo sapiens
uugacaccacuuagauuua

SEQ ID NO: 976117 - RNA, 11 nt, Homo sapiens
uugacacugaa

SEQ ID NO: 976118 - RNA, 14 nt, Homo sapiens
uugacgcaccugug

SEQ ID NO: 976119 - RNA, 16 nt, Homo sapiens
uugacgcaccuguggu

SEQ ID NO: 976120 - RNA, 19 nt, Homo sapiens
uugacguuucuucuuucua

SEQ ID NO: 976121 - RNA, 15 nt, Homo sapiens
uugacugccuaugcc

SEQ ID NO: 976122 - RNA, 24 nt, Homo sapiens
uugacuucucaaguaacaugacuu

SEQ ID NO: 976123 - RNA, 18 nt, Homo sapiens
uugagagauaaaaagcua

SEQ ID NO: 976124 - RNA, 22 nt, Homo sapiens
uugaggggcuuugucagcauca

SEQ ID NO: 976125 - RNA, 21 nt, Homo sapiens
uugagugacagcuuucuggga

SEQ ID NO: 976126 - RNA, 22 nt, Homo sapiens
uugauacaacauuaaggaauuu

SEQ ID NO: 976127 - RNA, 18 nt, Homo sapiens
uggcucaagucugcacag

SEQ ID NO: 976128 - RNA, 22 nt, Homo sapiens
uggcugggaagacuauggugcu

SEQ ID NO: 976129 - RNA, 20 nt, Homo sapiens
uggcuguugacgcaccugug

SEQ ID NO: 976130 - RNA, 19 nt, Homo sapiens
uggcuguuggugggacccg

SEQ ID NO: 976131 - RNA, 20 nt, Homo sapiens
uggcuuaagugagcagaaca

SEQ ID NO: 976132 - RNA, 19 nt, Homo sapiens
uggcuuagagaggcuugaa

SEQ ID NO: 976133 - RNA, 23 nt, Homo sapiens
ugggaagacuccuagcuguccuu

SEQ ID NO: 976134 - RNA, 20 nt, Homo sapiens
ugggaagagcguagacaggu

SEQ ID NO: 976135 - RNA, 17 nt, Homo sapiens
ugggaaguccuggcaca

SEQ ID NO: 976136 - RNA, 17 nt, Homo sapiens
ugggaggguguggugcu

SEQ ID NO: 976137 - RNA, 16 nt, Homo sapiens
ugggagguggaagaag

SEQ ID NO: 976138 - RNA, 12 nt, Homo sapiens
ugggaguaauac

SEQ ID NO: 976139 - RNA, 13 nt, Homo sapiens
ugggauacagauc

SEQ ID NO: 976140 - RNA, 13 nt, Homo sapiens
ugggauuacaggc

SEQ ID NO: 976141 - RNA, 23 nt, Homo sapiens
ugggauuucucccucucagugga

SEQ ID NO: 976142 - RNA, 19 nt, Homo sapiens
ugggcaaagggaaguaaca

SEQ ID NO: 976143 - RNA, 14 nt, Homo sapiens
ugggccgggaccca

SEQ ID NO: 976144 - RNA, 22 nt, Homo sapiens
ugggcuaggcauaggucucuuu

SEQ ID NO: 976145 - RNA, 15 nt, Homo sapiens
ugggcucgcacugcc

SEQ ID NO: 976146 - RNA, 17 nt, Homo sapiens
ugggcucgcacugccca

SEQ ID NO: 976147 - RNA, 23 nt, Homo sapiens
ugggcucugugcagucacuggag

SEQ ID NO: 976148 - RNA, 18 nt, Homo sapiens
uggggaacagagcaagac

SEQ ID NO: 976149 - RNA, 12 nt, Homo sapiens
uggggaggacca

SEQ ID NO: 976150 - RNA, 16 nt, Homo sapiens
uggggaggagggggcc

SEQ ID NO: 976151 - RNA, 14 nt, Homo sapiens
ugggggacacccgg

SEQ ID NO: 976152 - RNA, 15 nt, Homo sapiens
ugggguaauacuucc

SEQ ID NO: 976153 - RNA, 16 nt, Homo sapiens
uggguauuuaauaaga

SEQ ID NO: 976154 - RNA, 15 nt, Homo sapiens
ugggucacauccauc

SEQ ID NO: 976155 - RNA, 17 nt, Homo sapiens
ugggucuaggacacagu

SEQ ID NO: 976156 - RNA, 14 nt, Homo sapiens
ugggugcuacuggg

SEQ ID NO: 976157 - RNA, 20 nt, Homo sapiens
ugguaaaacucacugugauc

SEQ ID NO: 976158 - RNA, 21 nt, Homo sapiens
ugguagaacuaaacaauaagc

SEQ ID NO: 976159 - RNA, 22 nt, Homo sapiens
ugguagauuauucauaauguga

SEQ ID NO: 976160 - RNA, 12 nt, Homo sapiens
ugguauucauua

SEQ ID NO: 976161 - RNA, 17 nt, Homo sapiens
ugguauuucuaauucca

SEQ ID NO: 976162 - RNA, 13 nt, Homo sapiens
uggucuggcaaua

SEQ ID NO: 976163 - RNA, 20 nt, Homo sapiens
uggucuguggaucagcauuu

SEQ ID NO: 976164 - RNA, 17 nt, Homo sapiens
uggucuguuugacuuua

SEQ ID NO: 976165 - RNA, 13 nt, Homo sapiens
uggucuuugcucc

SEQ ID NO: 976166 - RNA, 16 nt, Homo sapiens
uggugaauauaaauga

SEQ ID NO: 976167 - RNA, 14 nt, Homo sapiens
uggugacagucucc

SEQ ID NO: 976168 - RNA, 13 nt, Homo sapiens
uggugcacugagc

SEQ ID NO: 976169 - RNA, 20 nt, Homo sapiens
uggugguggaaggguagaga

SEQ ID NO: 976170 - RNA, 14 nt, Homo sapiens
ugguucaucccuuu

SEQ ID NO: 976171 - RNA, 20 nt, Homo sapiens
ugguucccaauaucauguga

SEQ ID NO: 976172 - RNA, 21 nt, Homo sapiens
ugguuugccugaggcuguaac

SEQ ID NO: 976173 - RNA, 14 nt, Homo sapiens
ugguuuuauuucaa

SEQ ID NO: 976174 - RNA, 14 nt, Homo sapiens
uguaaaaaaaccac

SEQ ID NO: 976175 - RNA, 19 nt, Homo sapiens
uguaaaaaaaccaccaaaa

SEQ ID NO: 976176 - RNA, 17 nt, Homo sapiens
uguaaagcccuugcaca

SEQ ID NO: 976177 - RNA, 19 nt, Homo sapiens
uguaaagcccuugcacagc

SEQ ID NO: 976178 - RNA, 20 nt, Homo sapiens
uguaaagcccuugcacagcu

SEQ ID NO: 976179 - RNA, 21 nt, Homo sapiens
uguaaaguagaauaagccuuc

SEQ ID NO: 976180 - RNA, 16 nt, Homo sapiens
uguaaauagcuaagau

SEQ ID NO: 976181 - RNA, 23 nt, Homo sapiens
uguaaauauuuauuuauguguuc

SEQ ID NO: 976182 - RNA, 19 nt, Homo sapiens
uguaagaacaacuaccuga

SEQ ID NO: 976183 - RNA, 18 nt, Homo sapiens
uguaagagcaaaagccuc

SEQ ID NO: 976184 - RNA, 17 nt, Homo sapiens
uguaauaauaaaaccaa

SEQ ID NO: 976185 - RNA, 13 nt, Homo sapiens
uguaauuccagcu

SEQ ID NO: 976186 - RNA, 21 nt, Homo sapiens
uguacagaaaguaucacaaau

SEQ ID NO: 976187 - RNA, 14 nt, Homo sapiens
uguacuaaucugag

SEQ ID NO: 976188 - RNA, 18 nt, Homo sapiens
uguacugugucucaugga

SEQ ID NO: 976189 - RNA, 18 nt, Homo sapiens
uguagaaaagaacuggaa

SEQ ID NO: 976190 - RNA, 19 nt, Homo sapiens
uguagagcuuagauuuccc

SEQ ID NO: 976191 - RNA, 19 nt, Homo sapiens
uguagauuuucuacaggaa

SEQ ID NO: 976192 - RNA, 17 nt, Homo sapiens
uguagcuccucaacuca

SEQ ID NO: 976193 - RNA, 18 nt, Homo sapiens
uguagcucugaaugcuau

SEQ ID NO: 976194 - RNA, 21 nt, Homo sapiens
uguagucccagcuacuuggga

SEQ ID NO: 976195 - RNA, 14 nt, Homo sapiens
uguaguuuaguucu

SEQ ID NO: 976196 - RNA, 23 nt, Homo sapiens
uguauaaauuauucaguaacugu

SEQ ID NO: 976197 - RNA, 22 nt, Homo sapiens
uguauauccauauaacaauuca

SEQ ID NO: 976198 - RNA, 14 nt, Homo sapiens
uguauguguggcug

SEQ ID NO: 976199 - RNA, 17 nt, Homo sapiens
uguauguguggcugugg

SEQ ID NO: 976200 - RNA, 14 nt, Homo sapiens
uguauuaagccaau

SEQ ID NO: 976201 - RNA, 19 nt, Homo sapiens
uguauucucuucuacaaua

SEQ ID NO: 976202 - RNA, 13 nt, Homo sapiens
ugucaaagcuuug

SEQ ID NO: 976203 - RNA, 22 nt, Homo sapiens
ugucaaaugugucucacaucua

SEQ ID NO: 976204 - RNA, 22 nt, Homo sapiens
ugucaagcugcucugagccaca

SEQ ID NO: 976205 - RNA, 19 nt, Homo sapiens
ugucacccuccaccgagcc

SEQ ID NO: 976206 - RNA, 15 nt, Homo sapiens
ugucacuagucucac

SEQ ID NO: 976207 - RNA, 11 nt, Homo sapiens
ugucagcauca

SEQ ID NO: 976208 - RNA, 20 nt, Homo sapiens
ugucagggguuucuucaaga

SEQ ID NO: 976209 - RNA, 14 nt, Homo sapiens
ugucauagacuccu

SEQ ID NO: 976210 - RNA, 23 nt, Homo sapiens
ugucauaggauuaagcaguuuaa

SEQ ID NO: 976211 - RNA, 19 nt, Homo sapiens
ugucauuucucauccacau

SEQ ID NO: 976212 - RNA, 12 nt, Homo sapiens
uguccaaagagg

SEQ ID NO: 976213 - RNA, 21 nt, Homo sapiens
guaacucagacauuccaaggg

SEQ ID NO: 976214 - RNA, 16 nt, Homo sapiens
guaacucuaugaacuu

SEQ ID NO: 976215 - RNA, 14 nt, Homo sapiens
guaacuugcugcuu

SEQ ID NO: 976216 - RNA, 17 nt, Homo sapiens
guaagaaggcaauauua

SEQ ID NO: 976217 - RNA, 19 nt, Homo sapiens
guaagauuuuccauuguau

SEQ ID NO: 976218 - RNA, 14 nt, Homo sapiens
guaagcauucugag

SEQ ID NO: 976219 - RNA, 14 nt, Homo sapiens
guaaguguucucau

SEQ ID NO: 976220 - RNA, 14 nt, Homo sapiens
guaaguuucaggug

SEQ ID NO: 976221 - RNA, 15 nt, Homo sapiens
guaauaauaaaacca

SEQ ID NO: 976222 - RNA, 17 nt, Homo sapiens
guaaugaaggacaguga

SEQ ID NO: 976223 - RNA, 23 nt, Homo sapiens
guacaguucugggguacauguua

SEQ ID NO: 976224 - RNA, 21 nt, Homo sapiens
guaccaaauccacaagccauu

SEQ ID NO: 976225 - RNA, 19 nt, Homo sapiens
guaccaucuacaucuccuu

SEQ ID NO: 976226 - RNA, 12 nt, Homo sapiens
guagaagccagu

SEQ ID NO: 976227 - RNA, 12 nt, Homo sapiens
guagacuguggc

SEQ ID NO: 976228 - RNA, 13 nt, Homo sapiens
guagagccagcuu

SEQ ID NO: 976229 - RNA, 17 nt, Homo sapiens
guagauaauuucagggu

SEQ ID NO: 976230 - RNA, 16 nt, Homo sapiens
guagccugugcaugua

SEQ ID NO: 976231 - RNA, 10 nt, Homo sapiens
guagcucucc

SEQ ID NO: 976232 - RNA, 16 nt, Homo sapiens
guagcucucccuaggc

SEQ ID NO: 976233 - RNA, 17 nt, Homo sapiens
guaggucggcacuugga

SEQ ID NO: 976234 - RNA, 13 nt, Homo sapiens
guauaaacacucu

SEQ ID NO: 976235 - RNA, 16 nt, Homo sapiens
guauaaauauacagua

SEQ ID NO: 976236 - RNA, 21 nt, Homo sapiens
guauaaguuauuuuuguacau

SEQ ID NO: 976237 - RNA, 21 nt, Homo sapiens
guauaggggcaacuguaugaa

SEQ ID NO: 976238 - RNA, 20 nt, Homo sapiens
guaucagccccaagcaggug

SEQ ID NO: 976239 - RNA, 21 nt, Homo sapiens
guaucuuucauccuugacuaa

SEQ ID NO: 976240 - RNA, 11 nt, Homo sapiens
guauguuaaag

SEQ ID NO: 976241 - RNA, 14 nt, Homo sapiens
guauuauacaugug

SEQ ID NO: 976242 - RNA, 16 nt, Homo sapiens
guauucucuuccucau

SEQ ID NO: 976243 - RNA, 22 nt, Homo sapiens
guauuuaacauucuuggucaca

SEQ ID NO: 976244 - RNA, 16 nt, Homo sapiens
gucaagcugcucugag

SEQ ID NO: 976245 - RNA, 15 nt, Homo sapiens
gucaaggaaccucaa

SEQ ID NO: 976246 - RNA, 17 nt, Homo sapiens
gucaauggcuuguucau

SEQ ID NO: 976247 - RNA, 19 nt, Homo sapiens
gucaauggcuuguucauca

SEQ ID NO: 976248 - RNA, 20 nt, Homo sapiens
gucaaugggaccuguggcug

SEQ ID NO: 976249 - RNA, 18 nt, Homo sapiens
gucacagaagcagcuaaa

SEQ ID NO: 976250 - RNA, 15 nt, Homo sapiens
gucacuagucucacc

SEQ ID NO: 976251 - RNA, 22 nt, Homo sapiens
gucacugaacaccuauugcacu

SEQ ID NO: 976252 - RNA, 17 nt, Homo sapiens
gucacuuuuuggccaug

SEQ ID NO: 976253 - RNA, 23 nt, Homo sapiens
gucagaacagagugcaacccagu

SEQ ID NO: 976254 - RNA, 12 nt, Homo sapiens
gucagagcuaaa

SEQ ID NO: 976255 - RNA, 21 nt, Homo sapiens
gucagaguccagugcucugcc

SEQ ID NO: 976256 - RNA, 16 nt, Homo sapiens
gucagccuugcaucaa

SEQ ID NO: 976257 - RNA, 16 nt, Homo sapiens
gucagcucucugcccu

SEQ ID NO: 976258 - RNA, 17 nt, Homo sapiens
gucagggguuucuucaa

SEQ ID NO: 976259 - RNA, 14 nt, Homo sapiens
gucauagacuccuu

SEQ ID NO: 976260 - RNA, 21 nt, Homo sapiens
gucaugcauaaauaugcagug

SEQ ID NO: 976261 - RNA, 16 nt, Homo sapiens
gucauguguuuugcca

SEQ ID NO: 976262 - RNA, 13 nt, Homo sapiens
gucauucauucaa

SEQ ID NO: 976263 - RNA, 15 nt, Homo sapiens
guccaaccagaaaca

SEQ ID NO: 976264 - RNA, 14 nt, Homo sapiens
gucccaaccccagu

SEQ ID NO: 976265 - RNA, 14 nt, Homo sapiens
gucccagccaguga

SEQ ID NO: 976266 - RNA, 17 nt, Homo sapiens
guccccacgaacuggcc

SEQ ID NO: 976267 - RNA, 15 nt, Homo sapiens
guccccauacuccua

SEQ ID NO: 976268 - RNA, 19 nt, Homo sapiens
gucccccugcuugucuuca

SEQ ID NO: 976269 - RNA, 12 nt, Homo sapiens
gucccuaccugc

SEQ ID NO: 976270 - RNA, 16 nt, Homo sapiens
guccuguuucugucaa

SEQ ID NO: 976271 - RNA, 19 nt, Homo sapiens
guccuucaaacaauguaaa

SEQ ID NO: 976272 - RNA, 15 nt, Homo sapiens
guccuuuuucacuuu

SEQ ID NO: 976273 - RNA, 14 nt, Homo sapiens
gucgucaccaaauc

SEQ ID NO: 976274 - RNA, 12 nt, Homo sapiens
gucuaaagugua

SEQ ID NO: 976275 - RNA, 19 nt, Homo sapiens
gucuaagguucagccugaa

SEQ ID NO: 976276 - RNA, 15 nt, Homo sapiens
gucuaggacugcagu

SEQ ID NO: 976277 - RNA, 15 nt, Homo sapiens
gucuauuuucagagc

SEQ ID NO: 976278 - RNA, 20 nt, Homo sapiens
gucucaaaggagcuuucuca

SEQ ID NO: 976279 - RNA, 23 nt, Homo sapiens
gucucaccccucauccuuuuacu

SEQ ID NO: 976280 - RNA, 16 nt, Homo sapiens
gucugcuuugguacua

SEQ ID NO: 976281 - RNA, 14 nt, Homo sapiens
gucuggaauugugg

SEQ ID NO: 976282 - RNA, 15 nt, Homo sapiens
gucugggugcuacug

SEQ ID NO: 976283 - RNA, 18 nt, Homo sapiens
gucuuagacugcuagcuu

SEQ ID NO: 976284 - RNA, 16 nt, Homo sapiens
gucuucggcugcucag

SEQ ID NO: 976285 - RNA, 19 nt, Homo sapiens
gucuucucccuacaccaag

SEQ ID NO: 976286 - RNA, 21 nt, Homo sapiens
gucuuggaaaaaaaccacagc

SEQ ID NO: 976287 - RNA, 21 nt, Homo sapiens
gugaaacccugucucuacuaa

SEQ ID NO: 976288 - RNA, 22 nt, Homo sapiens
gugaauacauuaacggugcuaa

SEQ ID NO: 976289 - RNA, 19 nt, Homo sapiens
gugaauuauugacacugaa

SEQ ID NO: 976290 - RNA, 14 nt, Homo sapiens
gugacagucucccc

SEQ ID NO: 976291 - RNA, 13 nt, Homo sapiens
gugagcuggugac

SEQ ID NO: 976292 - RNA, 17 nt, Homo sapiens
gugagcuggugaccacc

SEQ ID NO: 976293 - RNA, 18 nt, Homo sapiens
gugaguauugcuuauaug

SEQ ID NO: 976294 - RNA, 14 nt, Homo sapiens
gugaguuugagcug

SEQ ID NO: 976295 - RNA, 18 nt, Homo sapiens
gugaucgucccaucccca

SEQ ID NO: 976296 - RNA, 14 nt, Homo sapiens
gugauucaccucuu

SEQ ID NO: 976297 - RNA, 14 nt, Homo sapiens
gugauuggaccagg

SEQ ID NO: 976298 - RNA, 14 nt, Homo sapiens
gugcaauacuuaga

SEQ ID NO: 976299 - RNA, 23 nt, Homo sapiens
gugcacauuucuuugcauuccag

SEQ ID NO: 976300 - RNA, 15 nt, Homo sapiens
gugcacuagcauuuu

SEQ ID NO: 976301 - RNA, 19 nt, Homo sapiens
gugcagcccaaucugccag

SEQ ID NO: 976302 - RNA, 15 nt, Homo sapiens
gugcagucacuggag

SEQ ID NO: 976303 - RNA, 11 nt, Homo sapiens
gugccaaaaau

SEQ ID NO: 976304 - RNA, 20 nt, Homo sapiens
gugccaauacagacaaagca

SEQ ID NO: 976305 - RNA, 18 nt, Homo sapiens
gugccuggccuggcacac

SEQ ID NO: 976306 - RNA, 13 nt, Homo sapiens
gugcggugcaaag

SEQ ID NO: 976307 - RNA, 20 nt, Homo sapiens
gugcuauccugcccaggcca

SEQ ID NO: 976308 - RNA, 22 nt, Homo sapiens
uaaauuuuuuugauaauagaga

SEQ ID NO: 976309 - RNA, 23 nt, Homo sapiens
uaacaagaccucagugccuuccu

SEQ ID NO: 976310 - RNA, 14 nt, Homo sapiens
uaacaauguuaagg

SEQ ID NO: 976311 - RNA, 21 nt, Homo sapiens
uaacacauuaaauguggaagg

SEQ ID NO: 976312 - RNA, 21 nt, Homo sapiens
uaacacauuuuuuugcaugca

SEQ ID NO: 976313 - RNA, 20 nt, Homo sapiens
uaacauaaauaaaaauucaa

SEQ ID NO: 976314 - RNA, 13 nt, Homo sapiens
uaacauuaccuua

SEQ ID NO: 976315 - RNA, 12 nt, Homo sapiens
uaaccauucuac

SEQ ID NO: 976316 - RNA, 18 nt, Homo sapiens
uaacccaagacaugacau

SEQ ID NO: 976317 - RNA, 17 nt, Homo sapiens
uaacuaauacuacugug

SEQ ID NO: 976318 - RNA, 16 nt, Homo sapiens
uaacuagaaagugagu

SEQ ID NO: 976319 - RNA, 16 nt, Homo sapiens
uaacuauaaggugccu

SEQ ID NO: 976320 - RNA, 18 nt, Homo sapiens
uaacucaccucucaaggu

SEQ ID NO: 976321 - RNA, 20 nt, Homo sapiens
uaacuccuuuuccacuuuaa

SEQ ID NO: 976322 - RNA, 16 nt, Homo sapiens
uaacuuuaacuuuuga

SEQ ID NO: 976323 - RNA, 12 nt, Homo sapiens
uaagaaauucca

SEQ ID NO: 976324 - RNA, 14 nt, Homo sapiens
uaagaaccugaaua

SEQ ID NO: 976325 - RNA, 15 nt, Homo sapiens
uaagaagagugcugu

SEQ ID NO: 976326 - RNA, 22 nt, Homo sapiens
uaagacaaauauuccuuugcau

SEQ ID NO: 976327 - RNA, 19 nt, Homo sapiens
uaagagcgaacuucacaua

SEQ ID NO: 976328 - RNA, 16 nt, Homo sapiens
aacuugggcuacugaa

SEQ ID NO: 976329 - RNA, 12 nt, Homo sapiens
aagaaacaugau

SEQ ID NO: 976330 - RNA, 16 nt, Homo sapiens
aagaaagcaaaacuca

SEQ ID NO: 976331 - RNA, 18 nt, Homo sapiens
aagaaagcaaaacucacu

SEQ ID NO: 976332 - RNA, 20 nt, Homo sapiens
aagaaaucuuucucccucaa

SEQ ID NO: 976333 - RNA, 11 nt, Homo sapiens
aagaaaugcaa

SEQ ID NO: 976334 - RNA, 21 nt, Homo sapiens
aagaaauuccuuccuuaccug

SEQ ID NO: 976335 - RNA, 21 nt, Homo sapiens
aagaacccaagugccucaccu

SEQ ID NO: 976336 - RNA, 22 nt, Homo sapiens
aagaacggcuuggcagccaguc

SEQ ID NO: 976337 - RNA, 14 nt, Homo sapiens
aagaacucucugga

SEQ ID NO: 976338 - RNA, 23 nt, Homo sapiens
aagaacuggaaccccagcuuccc

SEQ ID NO: 976339 - RNA, 21 nt, Homo sapiens
aagaagacuguugccacuuaa

SEQ ID NO: 976340 - RNA, 17 nt, Homo sapiens
aagacaccagagcagau

SEQ ID NO: 976341 - RNA, 15 nt, Homo sapiens
aagacauacugcuug

SEQ ID NO: 976342 - RNA, 22 nt, Homo sapiens
aagaccaagacuuuugucugau

SEQ ID NO: 976343 - RNA, 13 nt, Homo sapiens
aagacccucccau

SEQ ID NO: 976344 - RNA, 18 nt, Homo sapiens
aagacuagaggcuugcau

SEQ ID NO: 976345 - RNA, 14 nt, Homo sapiens
aagacuauggugcu

SEQ ID NO: 976346 - RNA, 19 nt, Homo sapiens
aagacuguugccacuuaac

SEQ ID NO: 976347 - RNA, 11 nt, Homo sapiens
aagacuugaga

SEQ ID NO: 976348 - RNA, 11 nt, Homo sapiens
aagagaagcuu

SEQ ID NO: 976349 - RNA, 14 nt, Homo sapiens
aagagacacuccaa

SEQ ID NO: 976350 - RNA, 16 nt, Homo sapiens
aagagacuccgucuca

SEQ ID NO: 976351 - RNA, 16 nt, Homo sapiens
aagagaugaauugcau

SEQ ID NO: 976352 - RNA, 18 nt, Homo sapiens
aagagcguagacaggugu

SEQ ID NO: 976353 - RNA, 21 nt, Homo sapiens
aagaggcugccccucucacca

SEQ ID NO: 976354 - RNA, 13 nt, Homo sapiens
aagagucuuccaa

SEQ ID NO: 976355 - RNA, 20 nt, Homo sapiens
aagaguucuaaauacaggaa

SEQ ID NO: 976356 - RNA, 19 nt, Homo sapiens
aagaguuucacaaauccuu

SEQ ID NO: 976357 - RNA, 18 nt, Homo sapiens
aagaguuugacuuagaau

SEQ ID NO: 976358 - RNA, 22 nt, Homo sapiens
aagauaaauucaugcacuuuua

SEQ ID NO: 976359 - RNA, 13 nt, Homo sapiens
aagauaguuguaa

SEQ ID NO: 976360 - RNA, 18 nt, Homo sapiens
aagaucuugaauagucuc

SEQ ID NO: 976361 - RNA, 20 nt, Homo sapiens
aagaucuugaauagucucau

SEQ ID NO: 976362 - RNA, 18 nt, Homo sapiens
aagauguacagaacacau

SEQ ID NO: 976363 - RNA, 19 nt, Homo sapiens
aagaugucuauguagcuga

SEQ ID NO: 976364 - RNA, 22 nt, Homo sapiens
aagauuauuccugguaaaggag

SEQ ID NO: 976365 - RNA, 17 nt, Homo sapiens
aagauugcacuguucug

SEQ ID NO: 976366 - RNA, 21 nt, Homo sapiens
aagauuuuauucuuauuucau

SEQ ID NO: 976367 - RNA, 18 nt, Homo sapiens
aagauuuucccagucugu

SEQ ID NO: 976368 - RNA, 16 nt, Homo sapiens
aagauuuuccucuugu

SEQ ID NO: 976369 - RNA, 19 nt, Homo sapiens
aagauuuugaaugcuuccu

SEQ ID NO: 976370 - RNA, 18 nt, Homo sapiens
aagcaaaacucacuaagu

SEQ ID NO: 976371 - RNA, 20 nt, Homo sapiens
aagcagaugggaacugaauu

SEQ ID NO: 976372 - RNA, 22 nt, Homo sapiens
aagcagcaucuucugguuuaaa

SEQ ID NO: 976373 - RNA, 20 nt, Homo sapiens
aagcagcuggugcuccaagc

SEQ ID NO: 976374 - RNA, 15 nt, Homo sapiens
aagcaugaaaaagca

SEQ ID NO: 976375 - RNA, 16 nt, Homo sapiens
aagccaggaccugcug

SEQ ID NO: 976376 - RNA, 16 nt, Homo sapiens
aagccauagucucucu

SEQ ID NO: 976377 - RNA, 14 nt, Homo sapiens
aagcccaguucauc

SEQ ID NO: 976378 - RNA, 12 nt, Homo sapiens
aagcccuguggg

SEQ ID NO: 976379 - RNA, 16 nt, Homo sapiens
aagccuacccuauucu

SEQ ID NO: 976380 - RNA, 22 nt, Homo sapiens
aagccuuccagggauuugccuc

SEQ ID NO: 976381 - RNA, 22 nt, Homo sapiens
aagcuaaugacgaggaaccgaa

SEQ ID NO: 976382 - RNA, 18 nt, Homo sapiens
aagcugcaggcuuugcca

SEQ ID NO: 976383 - RNA, 12 nt, Homo sapiens
aagcuggaagaa

SEQ ID NO: 976384 - RNA, 14 nt, Homo sapiens
aagcuggugcuacu

SEQ ID NO: 976385 - RNA, 22 nt, Homo sapiens
aagcuuuuggagggugauauaa

SEQ ID NO: 976386 - RNA, 21 nt, Homo sapiens
aagcuuuuuauuccuccugcu

SEQ ID NO: 976387 - RNA, 18 nt, Homo sapiens
aaggaaaaaauaaaagau

SEQ ID NO: 976388 - RNA, 18 nt, Homo sapiens
aaggaagcagauaccuug

SEQ ID NO: 976389 - RNA, 13 nt, Homo sapiens
aaggacaggccac

SEQ ID NO: 976390 - RNA, 14 nt, Homo sapiens
aaggacaggccaca

SEQ ID NO: 976391 - RNA, 23 nt, Homo sapiens
aaggagacugaggggcuuuguaa

SEQ ID NO: 976392 - RNA, 15 nt, Homo sapiens
aaggagcuuucucaa

SEQ ID NO: 976393 - RNA, 18 nt, Homo sapiens
aaggcauguggccuuuau

SEQ ID NO: 976394 - RNA, 18 nt, Homo sapiens
aaggcauuuauugccaua

SEQ ID NO: 976395 - RNA, 15 nt, Homo sapiens
aaggcucacaccuca

SEQ ID NO: 976396 - RNA, 21 nt, Homo sapiens
aaggcuucucuccacaguguu

SEQ ID NO: 976397 - RNA, 18 nt, Homo sapiens
aaggcuuugccaugggcc

SEQ ID NO: 976398 - RNA, 23 nt, Homo sapiens
aagggauuugaggugaggguugg

SEQ ID NO: 976399 - RNA, 17 nt, Homo sapiens
aagggcccaaugaauua

SEQ ID NO: 976400 - RNA, 13 nt, Homo sapiens
aagguaaagggag

SEQ ID NO: 976401 - RNA, 14 nt, Homo sapiens
aaggucaguuugau

SEQ ID NO: 976402 - RNA, 14 nt, Homo sapiens
aaggucugaugucu

SEQ ID NO: 976403 - RNA, 19 nt, Homo sapiens
aaggucugugggccaaaga

SEQ ID NO: 976404 - RNA, 22 nt, Homo sapiens
aaggugggccuugcuaccucaa

SEQ ID NO: 976405 - RNA, 13 nt, Homo sapiens
aaguaaaaaggga

SEQ ID NO: 976406 - RNA, 12 nt, Homo sapiens
aaguaacuuuau

SEQ ID NO: 976407 - RNA, 13 nt, Homo sapiens
aaguaaugauuaa

SEQ ID NO: 976408 - RNA, 19 nt, Homo sapiens
aaguacaucucuacuaaaa

SEQ ID NO: 976409 - RNA, 23 nt, Homo sapiens
aaguagaaguuacuuaauugcca

SEQ ID NO: 976410 - RNA, 22 nt, Homo sapiens
aaguauaaucagcacuuugcca

SEQ ID NO: 976411 - RNA, 23 nt, Homo sapiens
aagucaccaaauagugugaaaua

SEQ ID NO: 976412 - RNA, 17 nt, Homo sapiens
aagucagaauugcucaa

SEQ ID NO: 976413 - RNA, 18 nt, Homo sapiens
aaguccuggcacaguuuu

SEQ ID NO: 976414 - RNA, 23 nt, Homo sapiens
aagucucagacugauuucuugcg

SEQ ID NO: 976415 - RNA, 20 nt, Homo sapiens
aagugaggagugccagcuca

SEQ ID NO: 976416 - RNA, 21 nt, Homo sapiens
aagugaguuaaucuuguauga

SEQ ID NO: 976417 - RNA, 23 nt, Homo sapiens
aagugauagaaaaguguggcuug

SEQ ID NO: 976418 - RNA, 14 nt, Homo sapiens
aaguggacuguauu

SEQ ID NO: 976419 - RNA, 16 nt, Homo sapiens
aaguguccuucuugcu

SEQ ID NO: 976420 - RNA, 14 nt, Homo sapiens
aagugugaauucac

SEQ ID NO: 976421 - RNA, 17 nt, Homo sapiens
aaguuacuuaauugcca

SEQ ID NO: 976422 - RNA, 18 nt, Homo sapiens
cuccauaaaguacaaaug

SEQ ID NO: 976423 - RNA, 17 nt, Homo sapiens
cuccauaucuccauggc

SEQ ID NO: 976424 - RNA, 18 nt, Homo sapiens
cuccaucccaaccaggca

SEQ ID NO: 976425 - RNA, 14 nt, Homo sapiens
cuccaucucugucu

SEQ ID NO: 976426 - RNA, 22 nt, Homo sapiens
cuccauucauccuuccauccau

SEQ ID NO: 976427 - RNA, 15 nt, Homo sapiens
cucccagccaagucc

SEQ ID NO: 976428 - RNA, 19 nt, Homo sapiens
cucccagugaacuccugcc

SEQ ID NO: 976429 - RNA, 14 nt, Homo sapiens
cucccaucuucagg

SEQ ID NO: 976430 - RNA, 18 nt, Homo sapiens
cuccccagaaucaagcuu

SEQ ID NO: 976431 - RNA, 19 nt, Homo sapiens
cuccccagagcugccugcu

SEQ ID NO: 976432 - RNA, 20 nt, Homo sapiens
cucccccuccagccagagac

SEQ ID NO: 976433 - RNA, 18 nt, Homo sapiens
cuccccuccggacuggug

SEQ ID NO: 976434 - RNA, 16 nt, Homo sapiens
cuccccuuucacaggu

SEQ ID NO: 976435 - RNA, 18 nt, Homo sapiens
cucccguacaaacuugga

SEQ ID NO: 976436 - RNA, 15 nt, Homo sapiens
cucccuggagcugcu

SEQ ID NO: 976437 - RNA, 20 nt, Homo sapiens
cucccuguuaucugcuagau

SEQ ID NO: 976438 - RNA, 14 nt, Homo sapiens
cuccgcaucaccuc

SEQ ID NO: 976439 - RNA, 18 nt, Homo sapiens
cuccuaagcaacuaggcc

SEQ ID NO: 976440 - RNA, 20 nt, Homo sapiens
cuccuacacuauugaccagg

SEQ ID NO: 976441 - RNA, 20 nt, Homo sapiens
cuccuacaggugcuguucag

SEQ ID NO: 976442 - RNA, 21 nt, Homo sapiens
cuccuacccuuccagugcccu

SEQ ID NO: 976443 - RNA, 19 nt, Homo sapiens
cuccuacuuacaacccagg

SEQ ID NO: 976444 - RNA, 22 nt, Homo sapiens
cuccuccuacccuuccagugcc

SEQ ID NO: 976445 - RNA, 22 nt, Homo sapiens
cuccugagcauauuuaaaacaa

SEQ ID NO: 976446 - RNA, 18 nt, Homo sapiens
cuccuguccccugcuaca

SEQ ID NO: 976447 - RNA, 19 nt, Homo sapiens
cuccugucccuugaccuua

SEQ ID NO: 976448 - RNA, 21 nt, Homo sapiens
cuccuugcugcauugauccag

SEQ ID NO: 976449 - RNA, 15 nt, Homo sapiens
cuccuuuaccuuuca

SEQ ID NO: 976450 - RNA, 21 nt, Homo sapiens
cuccuuuaccuuucagugcag

SEQ ID NO: 976451 - RNA, 19 nt, Homo sapiens
cuccuuuguguguguguca

SEQ ID NO: 976452 - RNA, 22 nt, Homo sapiens
cuccuuugugugugugucagcu

SEQ ID NO: 976453 - RNA, 17 nt, Homo sapiens
cucgcagccucucagug

SEQ ID NO: 976454 - RNA, 14 nt, Homo sapiens
cucgggagccaugu

SEQ ID NO: 976455 - RNA, 13 nt, Homo sapiens
cucuaaagagcau

SEQ ID NO: 976456 - RNA, 17 nt, Homo sapiens
cucuaaggcaguagaau

SEQ ID NO: 976457 - RNA, 22 nt, Homo sapiens
cucuaucuuccuccuugugauc

SEQ ID NO: 976458 - RNA, 14 nt, Homo sapiens
cucucagaacauac

SEQ ID NO: 976459 - RNA, 15 nt, Homo sapiens
cucucaucaacugaa

SEQ ID NO: 976460 - RNA, 13 nt, Homo sapiens
cucuccacuccau

SEQ ID NO: 976461 - RNA, 20 nt, Homo sapiens
cucuccacugcuggacauga

SEQ ID NO: 976462 - RNA, 21 nt, Homo sapiens
cucuccggggccauuugcaau

SEQ ID NO: 976463 - RNA, 22 nt, Homo sapiens
cucucgcacaccucugcaccuu

SEQ ID NO: 976464 - RNA, 22 nt, Homo sapiens
cucucucaaaagagaaaaacaa

SEQ ID NO: 976465 - RNA, 14 nt, Homo sapiens
cucucuuuaacccu

SEQ ID NO: 976466 - RNA, 23 nt, Homo sapiens
cucugaaguuaaaaugauuuaca

SEQ ID NO: 976467 - RNA, 21 nt, Homo sapiens
cucugacgcuugugacagugc

SEQ ID NO: 976468 - RNA, 13 nt, Homo sapiens
cucugcacauguc

SEQ ID NO: 976469 - RNA, 16 nt, Homo sapiens
cucugcaccuuugcac

SEQ ID NO: 976470 - RNA, 16 nt, Homo sapiens
cucugccuacagccag

SEQ ID NO: 976471 - RNA, 18 nt, Homo sapiens
cucugccugaaggcucac

SEQ ID NO: 976472 - RNA, 21 nt, Homo sapiens
cucugccuuuaugaugcuaag

SEQ ID NO: 976473 - RNA, 22 nt, Homo sapiens
cucuggcaucucuuucugcaaa

SEQ ID NO: 976474 - RNA, 14 nt, Homo sapiens
cucuggggugcuga

SEQ ID NO: 976475 - RNA, 21 nt, Homo sapiens
cucuggggugcugagugagcu

SEQ ID NO: 976476 - RNA, 19 nt, Homo sapiens
cucuguaaguguagcucaa

SEQ ID NO: 976477 - RNA, 13 nt, Homo sapiens
cucugugacuccc

SEQ ID NO: 976478 - RNA, 23 nt, Homo sapiens
cucugugagggugcugacuggcu

SEQ ID NO: 976479 - RNA, 19 nt, Homo sapiens
cucugugcagucacuggag

SEQ ID NO: 976480 - RNA, 20 nt, Homo sapiens
cucuguuuauagugacccac

SEQ ID NO: 976481 - RNA, 22 nt, Homo sapiens
cucuuaaguggucuagucaagg

SEQ ID NO: 976482 - RNA, 22 nt, Homo sapiens
cucuuauauuaggacuaaggaa

SEQ ID NO: 976483 - RNA, 17 nt, Homo sapiens
cucuucccccaccacca

SEQ ID NO: 976484 - RNA, 23 nt, Homo sapiens
cucuucugagcacagauguuccc

SEQ ID NO: 976485 - RNA, 16 nt, Homo sapiens
cucuucugccuucuca

SEQ ID NO: 976486 - RNA, 22 nt, Homo sapiens
cucuugcacagucacugcucuu

SEQ ID NO: 976487 - RNA, 17 nt, Homo sapiens
cucuugcccauccugac

SEQ ID NO: 976488 - RNA, 14 nt, Homo sapiens
cucuuuccuccugc

SEQ ID NO: 976489 - RNA, 18 nt, Homo sapiens
cugaacaccuauugcacu

SEQ ID NO: 976490 - RNA, 21 nt, Homo sapiens
cugaacuuuaucuguucuguu

SEQ ID NO: 976491 - RNA, 19 nt, Homo sapiens
cugaauuuggggcuacuua

SEQ ID NO: 976492 - RNA, 22 nt, Homo sapiens
cugacacaagaauggucuuucu

SEQ ID NO: 976493 - RNA, 21 nt, Homo sapiens
cugacagaaggugccacuuua

SEQ ID NO: 976494 - RNA, 13 nt, Homo sapiens
cugacauucacuu

SEQ ID NO: 976495 - RNA, 19 nt, Homo sapiens
cugaccccagcauucucag

SEQ ID NO: 976496 - RNA, 17 nt, Homo sapiens
cugaccuaccucaaagg

SEQ ID NO: 976497 - RNA, 16 nt, Homo sapiens
cugaccuguguucccu

SEQ ID NO: 976498 - RNA, 15 nt, Homo sapiens
cugagaccucaauga

SEQ ID NO: 976499 - RNA, 21 nt, Homo sapiens
cugagauccugcacaaggugg

SEQ ID NO: 976500 - RNA, 12 nt, Homo sapiens
cugagcacagau

SEQ ID NO: 976501 - RNA, 13 nt, Homo sapiens
cugagcuauuuca

SEQ ID NO: 976502 - RNA, 21 nt, Homo sapiens
cugaggcccagugcauaugca

SEQ ID NO: 976503 - RNA, 19 nt, Homo sapiens
cugagggacaggaucuaua

SEQ ID NO: 976504 - RNA, 17 nt, Homo sapiens
cugaggugcacugggag

SEQ ID NO: 976505 - RNA, 21 nt, Homo sapiens
cugagguucuugggauacaga

SEQ ID NO: 976506 - RNA, 15 nt, Homo sapiens
cugagugcugaaaua

SEQ ID NO: 976507 - RNA, 15 nt, Homo sapiens
cugauccauccccag

SEQ ID NO: 976508 - RNA, 24 nt, Homo sapiens
cugaucugcggaucucagcuuuga

SEQ ID NO: 976509 - RNA, 13 nt, Homo sapiens
cugaugacagugu

SEQ ID NO: 976510 - RNA, 18 nt, Homo sapiens
cugauggccuuaauuucc

SEQ ID NO: 976511 - RNA, 23 nt, Homo sapiens
cugaugggccagcaggagccagc

SEQ ID NO: 976512 - RNA, 19 nt, Homo sapiens
cugaugucuccacuuucac

SEQ ID NO: 976513 - RNA, 21 nt, Homo sapiens
cugauucuggcuuuaagccuu

SEQ ID NO: 976514 - RNA, 22 nt, Homo sapiens
cugauugcagcacagagcagug

SEQ ID NO: 976515 - RNA, 22 nt, Homo sapiens
cugauuuucaucaaaaccaaga

SEQ ID NO: 976516 - RNA, 22 nt, Homo sapiens
cugcaaaggcgucugaaugugu

SEQ ID NO: 976517 - RNA, 15 nt, Homo sapiens
cugcaagauggacac

SEQ ID NO: 976518 - RNA, 14 nt, Homo sapiens
cugcaaguggccau

SEQ ID NO: 976519 - RNA, 14 nt, Homo sapiens
cugcacagagcaag

SEQ ID NO: 976520 - RNA, 20 nt, Homo sapiens
cugcacuccagccuggggga

SEQ ID NO: 976521 - RNA, 22 nt, Homo sapiens
cugcacugaggcagcgaccuca

SEQ ID NO: 976522 - RNA, 16 nt, Homo sapiens
cugcacuggggccacc

SEQ ID NO: 976523 - RNA, 16 nt, Homo sapiens
cugcagccucauacuc

SEQ ID NO: 976524 - RNA, 19 nt, Homo sapiens
cugcagcucuccaccagcu

SEQ ID NO: 976525 - RNA, 14 nt, Homo sapiens
cugcagucaucucc

SEQ ID NO: 976526 - RNA, 13 nt, Homo sapiens
cugcaugcagaaa

SEQ ID NO: 976527 - RNA, 14 nt, Homo sapiens
cugccaaacacauu

SEQ ID NO: 976528 - RNA, 20 nt, Homo sapiens
cugcccacuguuucucuuga

SEQ ID NO: 976529 - RNA, 16 nt, Homo sapiens
cugccccuacccugga

SEQ ID NO: 976530 - RNA, 19 nt, Homo sapiens
cugccgcccccuccugaac

SEQ ID NO: 976531 - RNA, 17 nt, Homo sapiens
cugccuacuccaaaaug

SEQ ID NO: 976532 - RNA, 17 nt, Homo sapiens
cugccucagacguugcc

SEQ ID NO: 976533 - RNA, 18 nt, Homo sapiens
cugccucuuucccuagga

SEQ ID NO: 976534 - RNA, 16 nt, Homo sapiens
cugccuuaaaaccaaa

SEQ ID NO: 976535 - RNA, 19 nt, Homo sapiens
cugccuuaaaaccaaagag

SEQ ID NO: 976536 - RNA, 14 nt, Homo sapiens
cugccuuaaacaca

SEQ ID NO: 976537 - RNA, 17 nt, Homo sapiens
gaugucuccacuuucac

SEQ ID NO: 976538 - RNA, 19 nt, Homo sapiens
gaugugaauuauugacacu

SEQ ID NO: 976539 - RNA, 20 nt, Homo sapiens
gaugugugucucaccccuca

SEQ ID NO: 976540 - RNA, 21 nt, Homo sapiens
gauuacugccauucacuucau

SEQ ID NO: 976541 - RNA, 14 nt, Homo sapiens
gauuauaaacugac

SEQ ID NO: 976542 - RNA, 23 nt, Homo sapiens
gauucaccucuucuuucccuccu

SEQ ID NO: 976543 - RNA, 19 nt, Homo sapiens
gauucucccaaaguaccuu

SEQ ID NO: 976544 - RNA, 18 nt, Homo sapiens
gauucuuuccauuaugau

SEQ ID NO: 976545 - RNA, 16 nt, Homo sapiens
gauuuaauccaguuau

SEQ ID NO: 976546 - RNA, 22 nt, Homo sapiens
gauuuacuaaaucaaucugcag

SEQ ID NO: 976547 - RNA, 16 nt, Homo sapiens
gauuucuuaguucaua

SEQ ID NO: 976548 - RNA, 17 nt, Homo sapiens
gauuugaugggccacaa

SEQ ID NO: 976549 - RNA, 21 nt, Homo sapiens
gauuuuucucaaaguuuugaa

SEQ ID NO: 976550 - RNA, 14 nt, Homo sapiens
gcaaaaaauucuuu

SEQ ID NO: 976551 - RNA, 16 nt, Homo sapiens
gcaaaaggccucuugu

SEQ ID NO: 976552 - RNA, 19 nt, Homo sapiens
gcaaaaucucuacugcuuu

SEQ ID NO: 976553 - RNA, 13 nt, Homo sapiens
gcaaacuuauuug

SEQ ID NO: 976554 - RNA, 20 nt, Homo sapiens
gcaaagcaaauguugggaaa

SEQ ID NO: 976555 - RNA, 11 nt, Homo sapiens
gcaaagccaaa

SEQ ID NO: 976556 - RNA, 17 nt, Homo sapiens
gcaaaggaaaaauugau

SEQ ID NO: 976557 - RNA, 16 nt, Homo sapiens
gcaacagacuguugag

SEQ ID NO: 976558 - RNA, 18 nt, Homo sapiens
gcaacccagucacacugu

SEQ ID NO: 976559 - RNA, 15 nt, Homo sapiens
gcaacuccauuuacc

SEQ ID NO: 976560 - RNA, 12 nt, Homo sapiens
gcaagccagcuu

SEQ ID NO: 976561 - RNA, 14 nt, Homo sapiens
gcaaguuagaacua

SEQ ID NO: 976562 - RNA, 20 nt, Homo sapiens
gcaaguuagaacuagccaaa

SEQ ID NO: 976563 - RNA, 19 nt, Homo sapiens
gcaauaggaugagguuucu

SEQ ID NO: 976564 - RNA, 15 nt, Homo sapiens
gcaauauauaauuga

SEQ ID NO: 976565 - RNA, 18 nt, Homo sapiens
gcaauaucuacauucuau

SEQ ID NO: 976566 - RNA, 19 nt, Homo sapiens
gcaauccagccucauggga

SEQ ID NO: 976567 - RNA, 16 nt, Homo sapiens
gcaaugacucaaaguc

SEQ ID NO: 976568 - RNA, 20 nt, Homo sapiens
gcaaugcauuugauggccac

SEQ ID NO: 976569 - RNA, 16 nt, Homo sapiens
gcaaugcccugugcau

SEQ ID NO: 976570 - RNA, 17 nt, Homo sapiens
gcacacucuucucuuga

SEQ ID NO: 976571 - RNA, 14 nt, Homo sapiens
gcacagauguuccc

SEQ ID NO: 976572 - RNA, 21 nt, Homo sapiens
gcacagggagugcacauaucc

SEQ ID NO: 976573 - RNA, 22 nt, Homo sapiens
gcacauauccaggcaccaggac

SEQ ID NO: 976574 - RNA, 14 nt, Homo sapiens
gcacaugcaccuac

SEQ ID NO: 976575 - RNA, 18 nt, Homo sapiens
gcacaugcaccuacccau

SEQ ID NO: 976576 - RNA, 24 nt, Homo sapiens
gcacauugucaccccaagccauag

SEQ ID NO: 976577 - RNA, 15 nt, Homo sapiens
gcacauuucuuugca

SEQ ID NO: 976578 - RNA, 18 nt, Homo sapiens
gcaccccacacuggagcc

SEQ ID NO: 976579 - RNA, 13 nt, Homo sapiens
gcaccuuugcacg

SEQ ID NO: 976580 - RNA, 13 nt, Homo sapiens
gcacgcucgcugc

SEQ ID NO: 976581 - RNA, 17 nt, Homo sapiens
gcacggaucacgaugua

SEQ ID NO: 976582 - RNA, 22 nt, Homo sapiens
gcacuacaggaggaaugcacca

SEQ ID NO: 976583 - RNA, 17 nt, Homo sapiens
gcagaaaggguuccaaa

SEQ ID NO: 976584 - RNA, 15 nt, Homo sapiens
gcagaaauguacuua

SEQ ID NO: 976585 - RNA, 16 nt, Homo sapiens
gcagaacuaccaggug

SEQ ID NO: 976586 - RNA, 14 nt, Homo sapiens
gcagaccucaugcc

SEQ ID NO: 976587 - RNA, 19 nt, Homo sapiens
gcagagaaacuuaagcaaa

SEQ ID NO: 976588 - RNA, 20 nt, Homo sapiens
gcagagccucguuucugcuu

SEQ ID NO: 976589 - RNA, 21 nt, Homo sapiens
gcagcccaaucugccagacuu

SEQ ID NO: 976590 - RNA, 13 nt, Homo sapiens
gcagcccagagac

SEQ ID NO: 976591 - RNA, 14 nt, Homo sapiens
gcagcccagagacu

SEQ ID NO: 976592 - RNA, 16 nt, Homo sapiens
gcagccccucaugccu

SEQ ID NO: 976593 - RNA, 20 nt, Homo sapiens
gcagccucaucccaggcagu

SEQ ID NO: 976594 - RNA, 13 nt, Homo sapiens
gcagccugucacc

SEQ ID NO: 976595 - RNA, 22 nt, Homo sapiens
gcagcuaccagguguucuacac

SEQ ID NO: 976596 - RNA, 12 nt, Homo sapiens
gcagcuccagug

SEQ ID NO: 976597 - RNA, 15 nt, Homo sapiens
cggauacacacucga

SEQ ID NO: 976598 - RNA, 21 nt, Homo sapiens
cggauggaccaaccugcucug

SEQ ID NO: 976599 - RNA, 23 nt, Homo sapiens
cggauggaccaaccugcucuguc

SEQ ID NO: 976600 - RNA, 13 nt, Homo sapiens
cgggcaccuguag

SEQ ID NO: 976601 - RNA, 22 nt, Homo sapiens
cgggucucaacuuuaagauaga

SEQ ID NO: 976602 - RNA, 21 nt, Homo sapiens
cggugagacccauggcugugu

SEQ ID NO: 976603 - RNA, 15 nt, Homo sapiens
cguagacagguguua

SEQ ID NO: 976604 - RNA, 11 nt, Homo sapiens
cgucaccaaau

SEQ ID NO: 976605 - RNA, 23 nt, Homo sapiens
cgucagccagcucccagccacau

SEQ ID NO: 976606 - RNA, 14 nt, Homo sapiens
cgugacaagugccu

SEQ ID NO: 976607 - RNA, 14 nt, Homo sapiens
cguggacucugcac

SEQ ID NO: 976608 - RNA, 21 nt, Homo sapiens
cguggacucugcacaugucuu

SEQ ID NO: 976609 - RNA, 15 nt, Homo sapiens
cgugguagaagccag

SEQ ID NO: 976610 - RNA, 20 nt, Homo sapiens
cgugugacucgccagcucau

SEQ ID NO: 976611 - RNA, 15 nt, Homo sapiens
cguguguagaguuaa

SEQ ID NO: 976612 - RNA, 23 nt, Homo sapiens
cguuccuguuagcauaaugugag

SEQ ID NO: 976613 - RNA, 16 nt, Homo sapiens
cguucugcaagcauca

SEQ ID NO: 976614 - RNA, 17 nt, Homo sapiens
cuaaaaaugcaucacau

SEQ ID NO: 976615 - RNA, 20 nt, Homo sapiens
cuaaaccaaggacugagcac

SEQ ID NO: 976616 - RNA, 15 nt, Homo sapiens
cuaaagagcccuugc

SEQ ID NO: 976617 - RNA, 13 nt, Homo sapiens
cuaaagcaagccu

SEQ ID NO: 976618 - RNA, 20 nt, Homo sapiens
cuaaaggauccagagagcag

SEQ ID NO: 976619 - RNA, 15 nt, Homo sapiens
cuaaaucaaucugca

SEQ ID NO: 976620 - RNA, 22 nt, Homo sapiens
cuaacccaagacaugacauucu

SEQ ID NO: 976621 - RNA, 19 nt, Homo sapiens
cuaacuuuguaaccagaau

SEQ ID NO: 976622 - RNA, 20 nt, Homo sapiens
cuaacuuuuccaagcaaaau

SEQ ID NO: 976623 - RNA, 15 nt, Homo sapiens
cuaagauaaauucau

SEQ ID NO: 976624 - RNA, 17 nt, Homo sapiens
cuaagauaauuuacuua

SEQ ID NO: 976625 - RNA, 18 nt, Homo sapiens
cuaaggacaagacacuga

SEQ ID NO: 976626 - RNA, 17 nt, Homo sapiens
cuaagguucagccugaa

SEQ ID NO: 976627 - RNA, 13 nt, Homo sapiens
cuaagugcuuauu

SEQ ID NO: 976628 - RNA, 23 nt, Homo sapiens
cuaaguuaaacagucaguaugca

SEQ ID NO: 976629 - RNA, 19 nt, Homo sapiens
cuaauacagcaacaauuua

SEQ ID NO: 976630 - RNA, 15 nt, Homo sapiens
cuaauaccucugugu

SEQ ID NO: 976631 - RNA, 19 nt, Homo sapiens
cuaaugagacugaccauau

SEQ ID NO: 976632 - RNA, 15 nt, Homo sapiens
cuaauguugacuuua

SEQ ID NO: 976633 - RNA, 23 nt, Homo sapiens
cuaauugucuuuguucugugauu

SEQ ID NO: 976634 - RNA, 17 nt, Homo sapiens
cuacaacugauugcaac

SEQ ID NO: 976635 - RNA, 16 nt, Homo sapiens
cuacacugauacacuu

SEQ ID NO: 976636 - RNA, 15 nt, Homo sapiens
cuacagagaucccac

SEQ ID NO: 976637 - RNA, 17 nt, Homo sapiens
cuacaucccgggccuca

SEQ ID NO: 976638 - RNA, 12 nt, Homo sapiens
cuacucuggaau

SEQ ID NO: 976639 - RNA, 21 nt, Homo sapiens
cuacugacauaucuacacuuc

SEQ ID NO: 976640 - RNA, 21 nt, Homo sapiens
cuacuggggaaacuggccaug

SEQ ID NO: 976641 - RNA, 18 nt, Homo sapiens
cuacuuuaaauuguggau

SEQ ID NO: 976642 - RNA, 23 nt, Homo sapiens
cuagcacaauuugcacuaaauca

SEQ ID NO: 976643 - RNA, 12 nt, Homo sapiens
cuagcacuuugg

SEQ ID NO: 976644 - RNA, 19 nt, Homo sapiens
cuagcugggacuacaggug

SEQ ID NO: 976645 - RNA, 21 nt, Homo sapiens
cuaggaaacucacacuccccu

SEQ ID NO: 976646 - RNA, 18 nt, Homo sapiens
cuaggaggaaaauuccau

SEQ ID NO: 976647 - RNA, 23 nt, Homo sapiens
cuaggcauuucugggaagcccca

SEQ ID NO: 976648 - RNA, 14 nt, Homo sapiens
cuagggcagggaau

SEQ ID NO: 976649 - RNA, 22 nt, Homo sapiens
cuaguauuuauggguggauuua

SEQ ID NO: 976650 - RNA, 15 nt, Homo sapiens
cuagucaccagagac

SEQ ID NO: 976651 - RNA, 16 nt, Homo sapiens
cuaguggucuuuguaa

SEQ ID NO: 976652 - RNA, 13 nt, Homo sapiens
cuauacacacaca

SEQ ID NO: 976653 - RNA, 15 nt, Homo sapiens
cuauccuauguuaaa

SEQ ID NO: 976654 - RNA, 13 nt, Homo sapiens
cuauccugcccag

SEQ ID NO: 976655 - RNA, 23 nt, Homo sapiens
cuaucuccugacagaaggugcca

SEQ ID NO: 976656 - RNA, 15 nt, Homo sapiens
cuaugacuugaucac

SEQ ID NO: 976657 - RNA, 16 nt, Homo sapiens
cuaugaguugaaaugu

SEQ ID NO: 976658 - RNA, 14 nt, Homo sapiens
cuaugcacauaugg

SEQ ID NO: 976659 - RNA, 15 nt, Homo sapiens
cuaugcugaguauuu

SEQ ID NO: 976660 - RNA, 22 nt, Homo sapiens
cuaugucaguacuauucaggua

SEQ ID NO: 976661 - RNA, 21 nt, Homo sapiens
cuauuaucccagcugccuaga

SEQ ID NO: 976662 - RNA, 16 nt, Homo sapiens
cuauucuauccaucuc

SEQ ID NO: 976663 - RNA, 18 nt, Homo sapiens
cuauugugacagagccau

SEQ ID NO: 976664 - RNA, 23 nt, Homo sapiens
cuauuucaucuauuuuuggcagu

SEQ ID NO: 976665 - RNA, 12 nt, Homo sapiens
cuauuugccaug

SEQ ID NO: 976666 - RNA, 21 nt, Homo sapiens
cuauuuucagagcaugauaca

SEQ ID NO: 976667 - RNA, 22 nt, Homo sapiens
cuauuuucagagcaugauacaa

SEQ ID NO: 976668 - RNA, 17 nt, Homo sapiens
gcccuugagaagccaac

SEQ ID NO: 976669 - RNA, 17 nt, Homo sapiens
gcccuugcuuaccucuc

SEQ ID NO: 976670 - RNA, 21 nt, Homo sapiens
gccgagaucacgucacugcac

SEQ ID NO: 976671 - RNA, 18 nt, Homo sapiens
gccgcggacgcaccuggg

SEQ ID NO: 976672 - RNA, 16 nt, Homo sapiens
gccggaucugagggag

SEQ ID NO: 976673 - RNA, 21 nt, Homo sapiens
gccggcccgccucuccucggu

SEQ ID NO: 976674 - RNA, 12 nt, Homo sapiens
gccgugccuugu

SEQ ID NO: 976675 - RNA, 23 nt, Homo sapiens
gccguuuucuugcucaaagggaa

SEQ ID NO: 976676 - RNA, 21 nt, Homo sapiens
gccucaagcaauccaccugcc

SEQ ID NO: 976677 - RNA, 20 nt, Homo sapiens
gccucaccuuggggccuuga

SEQ ID NO: 976678 - RNA, 19 nt, Homo sapiens
gccucagcggacaagcagc

SEQ ID NO: 976679 - RNA, 18 nt, Homo sapiens
gccuccccgugccaaaaa

SEQ ID NO: 976680 - RNA, 19 nt, Homo sapiens
gccuccccgugccaaaaau

SEQ ID NO: 976681 - RNA, 24 nt, Homo sapiens
gccucuuccagugaacauucccag

SEQ ID NO: 976682 - RNA, 21 nt, Homo sapiens
gccugcaggagagagcagcac

SEQ ID NO: 976683 - RNA, 15 nt, Homo sapiens
gccugcuuugcuuua

SEQ ID NO: 976684 - RNA, 13 nt, Homo sapiens
gccuguugcugaa

SEQ ID NO: 976685 - RNA, 20 nt, Homo sapiens
gccuuaaacacacauugcag

SEQ ID NO: 976686 - RNA, 17 nt, Homo sapiens
gccuuauuaauauccaa

SEQ ID NO: 976687 - RNA, 15 nt, Homo sapiens
gccuucuccaggaca

SEQ ID NO: 976688 - RNA, 17 nt, Homo sapiens
gccuugaugacugccuu

SEQ ID NO: 976689 - RNA, 16 nt, Homo sapiens
gccuuggaaccagccc

SEQ ID NO: 976690 - RNA, 12 nt, Homo sapiens
gccuuuaucuca

SEQ ID NO: 976691 - RNA, 19 nt, Homo sapiens
gccuuuugugcaaagccaa

SEQ ID NO: 976692 - RNA, 21 nt, Homo sapiens
gcgagccaggaccacagagcu

SEQ ID NO: 976693 - RNA, 11 nt, Homo sapiens
gcgaguucucu

SEQ ID NO: 976694 - RNA, 21 nt, Homo sapiens
gcgcccuuaacugcauccagc

SEQ ID NO: 976695 - RNA, 20 nt, Homo sapiens
gcgccugcugccugcugaga

SEQ ID NO: 976696 - RNA, 16 nt, Homo sapiens
gcgccuguaauuccag

SEQ ID NO: 976697 - RNA, 19 nt, Homo sapiens
gcgccuguaauuccagcua

SEQ ID NO: 976698 - RNA, 15 nt, Homo sapiens
gcgcucucuuugcaa

SEQ ID NO: 976699 - RNA, 15 nt, Homo sapiens
gcgcuggacacucuc

SEQ ID NO: 976700 - RNA, 13 nt, Homo sapiens
gcgggaggcggug

SEQ ID NO: 976701 - RNA, 12 nt, Homo sapiens
gcgguggcucac

SEQ ID NO: 976702 - RNA, 16 nt, Homo sapiens
gcguggacucugcaca

SEQ ID NO: 976703 - RNA, 18 nt, Homo sapiens
gcguggacucugcacaug

SEQ ID NO: 976704 - RNA, 20 nt, Homo sapiens
gcguggacucugcacauguc

SEQ ID NO: 976705 - RNA, 23 nt, Homo sapiens
gcuaaauaaauggguguauauaa

SEQ ID NO: 976706 - RNA, 20 nt, Homo sapiens
gcuaaucagucauuucuuca

SEQ ID NO: 976707 - RNA, 15 nt, Homo sapiens
gcuacucucuugcca

SEQ ID NO: 976708 - RNA, 21 nt, Homo sapiens
gcuacucucuugccagcauuu

SEQ ID NO: 976709 - RNA, 18 nt, Homo sapiens
gcuagaucuaguucucaa

SEQ ID NO: 976710 - RNA, 18 nt, Homo sapiens
gcuaugcaguacauugua

SEQ ID NO: 976711 - RNA, 12 nt, Homo sapiens
gcuaugucucau

SEQ ID NO: 976712 - RNA, 15 nt, Homo sapiens
gcuauuuaacauuuu

SEQ ID NO: 976713 - RNA, 22 nt, Homo sapiens
gcuauuucaucuauuuuuggca

SEQ ID NO: 976714 - RNA, 16 nt, Homo sapiens
gcucaggucaacugac

SEQ ID NO: 976715 - RNA, 22 nt, Homo sapiens
gcucauguucuggcagcaacuu

SEQ ID NO: 976716 - RNA, 18 nt, Homo sapiens
gcuccagugccagcaaua

SEQ ID NO: 976717 - RNA, 19 nt, Homo sapiens
gcuccaucccaaccaggca

SEQ ID NO: 976718 - RNA, 22 nt, Homo sapiens
gcucccgagcuacucucuugcc

SEQ ID NO: 976719 - RNA, 16 nt, Homo sapiens
gcucccuuucucagga

SEQ ID NO: 976720 - RNA, 17 nt, Homo sapiens
gcuccuggaauggaaga

SEQ ID NO: 976721 - RNA, 13 nt, Homo sapiens
gcucgcugccauc

SEQ ID NO: 976722 - RNA, 13 nt, Homo sapiens
gcucuaucuuccu

SEQ ID NO: 976723 - RNA, 16 nt, Homo sapiens
gcucucgcacaccucu

SEQ ID NO: 976724 - RNA, 13 nt, Homo sapiens
gcucugccucaga

SEQ ID NO: 976725 - RNA, 19 nt, Homo sapiens
aaaaaacaccaggauuuaa

SEQ ID NO: 976726 - RNA, 17 nt, Homo sapiens
aaaaaccaacaauguga

SEQ ID NO: 976727 - RNA, 18 nt, Homo sapiens
aaaaacucaggcaaagaa

SEQ ID NO: 976728 - RNA, 22 nt, Homo sapiens
aaaaacuuccuucaaucuucau

SEQ ID NO: 976729 - RNA, 12 nt, Homo sapiens
aaaaagaacaaa

SEQ ID NO: 976730 - RNA, 12 nt, Homo sapiens
aaaaagaacaac

SEQ ID NO: 976731 - RNA, 18 nt, Homo sapiens
aaaaagcaucuaucucau

SEQ ID NO: 976732 - RNA, 16 nt, Homo sapiens
aaaaauauauaugcau

SEQ ID NO: 976733 - RNA, 19 nt, Homo sapiens
aaaaauauuguuucugcau

SEQ ID NO: 976734 - RNA, 17 nt, Homo sapiens
aaaaaucuuuucauuaa

SEQ ID NO: 976735 - RNA, 17 nt, Homo sapiens
aaaaaugaugcgcauca

SEQ ID NO: 976736 - RNA, 16 nt, Homo sapiens
aaaaaugcagggugau

SEQ ID NO: 976737 - RNA, 20 nt, Homo sapiens
aaaaaugcuauuguugcaau

SEQ ID NO: 976738 - RNA, 23 nt, Homo sapiens
aaaaaugguuaaugacaauucag

SEQ ID NO: 976739 - RNA, 13 nt, Homo sapiens
aaaacaaauucau

SEQ ID NO: 976740 - RNA, 12 nt, Homo sapiens
aaaacauuugcu

SEQ ID NO: 976741 - RNA, 15 nt, Homo sapiens
cuaaaguuacaaaca

SEQ ID NO: 976742 - RNA, 17 nt, Homo sapiens
cuaaauaaaaauaugua

SEQ ID NO: 976743 - RNA, 13 nt, Homo sapiens
cuaaauaaauggg

SEQ ID NO: 976744 - RNA, 18 nt, Homo sapiens
cuaaaucagagacaaaau

SEQ ID NO: 976745 - RNA, 14 nt, Homo sapiens
cuaaccccuuccag

SEQ ID NO: 976746 - RNA, 18 nt, Homo sapiens
cuaacuaaauaccauuca

SEQ ID NO: 976747 - RNA, 19 nt, Homo sapiens
cuaagauaaauucaugcac

SEQ ID NO: 976748 - RNA, 20 nt, Homo sapiens
cuaagcugaguuaggugucu

SEQ ID NO: 976749 - RNA, 16 nt, Homo sapiens
cuaaggagccuggaaa

SEQ ID NO: 976750 - RNA, 14 nt, Homo sapiens
cuaaugacaaguga

SEQ ID NO: 976751 - RNA, 16 nt, Homo sapiens
cuaaugagacugacca

SEQ ID NO: 976752 - RNA, 17 nt, Homo sapiens
cuaaugagacugaccau

SEQ ID NO: 976753 - RNA, 14 nt, Homo sapiens
cuaaugcuaugcaa

SEQ ID NO: 976754 - RNA, 22 nt, Homo sapiens
cuaauuccuggcaugacacucu

SEQ ID NO: 976755 - RNA, 19 nt, Homo sapiens
cuacaaaauauagcuuuca

SEQ ID NO: 976756 - RNA, 21 nt, Homo sapiens
cuacaauacaacacauugaaa

SEQ ID NO: 976757 - RNA, 15 nt, Homo sapiens
cuacagagcagccag

SEQ ID NO: 976758 - RNA, 14 nt, Homo sapiens
cuacagauagaaaa

SEQ ID NO: 976759 - RNA, 21 nt, Homo sapiens
cuacagaugguagaacuaaac

SEQ ID NO: 976760 - RNA, 17 nt, Homo sapiens
cuacagcuacauugaga

SEQ ID NO: 976761 - RNA, 17 nt, Homo sapiens
cuacaggaggaaugcac

SEQ ID NO: 976762 - RNA, 14 nt, Homo sapiens
cuacaugcugaaaa

SEQ ID NO: 976763 - RNA, 22 nt, Homo sapiens
cuacaugcugaaaaauauagcc

SEQ ID NO: 976764 - RNA, 13 nt, Homo sapiens
cuaccaugucuua

SEQ ID NO: 976765 - RNA, 19 nt, Homo sapiens
cuacccuuccagugcccua

SEQ ID NO: 976766 - RNA, 23 nt, Homo sapiens
cuacccuuccagugcccuaggcc

SEQ ID NO: 976767 - RNA, 12 nt, Homo sapiens
cuacugacauau

SEQ ID NO: 976768 - RNA, 13 nt, Homo sapiens
cuacugugugcca

SEQ ID NO: 976769 - RNA, 23 nt, Homo sapiens
cuacuuacaacccagggugugaa

SEQ ID NO: 976770 - RNA, 15 nt, Homo sapiens
cuacuuuguggcaau

SEQ ID NO: 976771 - RNA, 18 nt, Homo sapiens
cuacuuuuggugcuuaaa

SEQ ID NO: 976772 - RNA, 12 nt, Homo sapiens
cuagaagccaag

SEQ ID NO: 976773 - RNA, 15 nt, Homo sapiens
cuagaagccaaggga

SEQ ID NO: 976774 - RNA, 17 nt, Homo sapiens
cuagacuguuugcugau

SEQ ID NO: 976775 - RNA, 20 nt, Homo sapiens
cuagacuguuugcugauccc

SEQ ID NO: 976776 - RNA, 22 nt, Homo sapiens
cuagaggcuugcauaauaagcu

SEQ ID NO: 976777 - RNA, 20 nt, Homo sapiens
cuagauuuauuaguccuaau

SEQ ID NO: 976778 - RNA, 15 nt, Homo sapiens
cuagcaaugccugag

SEQ ID NO: 976779 - RNA, 22 nt, Homo sapiens
cuagcaaugccugagccugaac

SEQ ID NO: 976780 - RNA, 19 nt, Homo sapiens
cuaggaaacucacacuccc

SEQ ID NO: 976781 - RNA, 19 nt, Homo sapiens
cuagggagacgccauguga

SEQ ID NO: 976782 - RNA, 22 nt, Homo sapiens
cuagucacucauccauccccug

SEQ ID NO: 976783 - RNA, 15 nt, Homo sapiens
cuagucucaccagcc

SEQ ID NO: 976784 - RNA, 16 nt, Homo sapiens
cuagucugcuuuggua

SEQ ID NO: 976785 - RNA, 20 nt, Homo sapiens
cuauaagcaaauugcuuuuu

SEQ ID NO: 976786 - RNA, 18 nt, Homo sapiens
cuauacaaaaugauuuug

SEQ ID NO: 976787 - RNA, 22 nt, Homo sapiens
cuauaucucauuucauucucac

SEQ ID NO: 976788 - RNA, 21 nt, Homo sapiens
cuaucaaaggaaaugagaaug

SEQ ID NO: 976789 - RNA, 23 nt, Homo sapiens
cuauccugggaggguguggugcu

SEQ ID NO: 976790 - RNA, 17 nt, Homo sapiens
cuaucuagaacuugaga

SEQ ID NO: 976791 - RNA, 19 nt, Homo sapiens
cuaucugggcugugggcaa

SEQ ID NO: 976792 - RNA, 23 nt, Homo sapiens
cuaugaucugagucagagccaug

SEQ ID NO: 976793 - RNA, 15 nt, Homo sapiens
cuauguagcugaaaa

SEQ ID NO: 976794 - RNA, 12 nt, Homo sapiens
cuauuggucucc

SEQ ID NO: 976795 - RNA, 16 nt, Homo sapiens
cuauuuaaguggacug

SEQ ID NO: 976796 - RNA, 22 nt, Homo sapiens
cuauuuuuaaugaaacuucaaa

SEQ ID NO: 976797 - RNA, 20 nt, Homo sapiens
cucaaauucauggugcacug

SEQ ID NO: 976798 - RNA, 23 nt, Homo sapiens
cucaacauuguguucccauuuca

SEQ ID NO: 976799 - RNA, 18 nt, Homo sapiens
cucaaccuaacacauuaa

SEQ ID NO: 976800 - RNA, 20 nt, Homo sapiens
cucaacugggugacaagggu

SEQ ID NO: 976801 - RNA, 20 nt, Homo sapiens
cucaagccggaaacucggca

SEQ ID NO: 976802 - RNA, 15 nt, Homo sapiens
cucaagucugcacag

SEQ ID NO: 976803 - RNA, 21 nt, Homo sapiens
cucaaguguccugaaagcuua

SEQ ID NO: 976804 - RNA, 18 nt, Homo sapiens
cucacaacagucaccuca

SEQ ID NO: 976805 - RNA, 19 nt, Homo sapiens
cucaccagccccacugcca

SEQ ID NO: 976806 - RNA, 21 nt, Homo sapiens
cucacgccuguaauucuagca

SEQ ID NO: 976807 - RNA, 15 nt, Homo sapiens
cucacucuucaagga

SEQ ID NO: 976808 - RNA, 21 nt, Homo sapiens
cucacuguagcuuuuaggaau

SEQ ID NO: 976809 - RNA, 17 nt, Homo sapiens
cucagaacauacugauu

SEQ ID NO: 976810 - RNA, 20 nt, Homo sapiens
cucagaacuugcugcugucu

SEQ ID NO: 976811 - RNA, 22 nt, Homo sapiens
cucagaguguggguccuucaaa

SEQ ID NO: 976812 - RNA, 23 nt, Homo sapiens
cucagauuuccacagagacuguu

SEQ ID NO: 976813 - RNA, 14 nt, Homo sapiens
cucagcccugagau

SEQ ID NO: 976814 - RNA, 15 nt, Homo sapiens
cucagcuuuccuuaa

SEQ ID NO: 976815 - RNA, 21 nt, Homo sapiens
cucagcuuuccuuaaggauau

SEQ ID NO: 976816 - RNA, 21 nt, Homo sapiens
cucagcuuuuucguauuucaa

SEQ ID NO: 976817 - RNA, 23 nt, Homo sapiens
cucaggcaaagaaaaugaaaugc

SEQ ID NO: 976818 - RNA, 14 nt, Homo sapiens
cucagguaguacug

SEQ ID NO: 976819 - RNA, 15 nt, Homo sapiens
cucagguaguacugg

SEQ ID NO: 976820 - RNA, 16 nt, Homo sapiens
cucaguucuuccucca

SEQ ID NO: 976821 - RNA, 21 nt, Homo sapiens
cucauacccaggaagagcuga

SEQ ID NO: 976822 - RNA, 17 nt, Homo sapiens
cucauaguaauaagaug

SEQ ID NO: 976823 - RNA, 13 nt, Homo sapiens
cucauauugugau

SEQ ID NO: 976824 - RNA, 12 nt, Homo sapiens
cucaugagcuga

SEQ ID NO: 976825 - RNA, 13 nt, Homo sapiens
cucaugauccaac

SEQ ID NO: 976826 - RNA, 13 nt, Homo sapiens
cucaugugcagua

SEQ ID NO: 976827 - RNA, 16 nt, Homo sapiens
cuccaaaccugaaguu

SEQ ID NO: 976828 - RNA, 14 nt, Homo sapiens
cuccaaagucguuu

SEQ ID NO: 976829 - RNA, 23 nt, Homo sapiens
cuccacacagugcucaaggccag

SEQ ID NO: 976830 - RNA, 17 nt, Homo sapiens
cuccacccagugauccc

SEQ ID NO: 976831 - RNA, 20 nt, Homo sapiens
cuccaccgucuuucuuuuau

SEQ ID NO: 976832 - RNA, 21 nt, Homo sapiens
cuccaccuuguuacacauuau

SEQ ID NO: 976833 - RNA, 15 nt, Homo sapiens
cuccagagaugguca

SEQ ID NO: 976834 - RNA, 14 nt, Homo sapiens
cuccagauggugcu

SEQ ID NO: 976835 - RNA, 20 nt, Homo sapiens
cuccagcccagacccagugg

SEQ ID NO: 976836 - RNA, 21 nt, Homo sapiens
cuccagggcuuugcuccagaa

SEQ ID NO: 976837 - RNA, 18 nt, Homo sapiens
cuccauucauccuuccau

SEQ ID NO: 976838 - RNA, 15 nt, Homo sapiens
cuccauuuaccagua

SEQ ID NO: 976839 - RNA, 14 nt, Homo sapiens
cucccaacucuugc

SEQ ID NO: 976840 - RNA, 18 nt, Homo sapiens
cucccaacucuugcacag

SEQ ID NO: 976841 - RNA, 16 nt, Homo sapiens
cucccagguaccagcu

SEQ ID NO: 976842 - RNA, 15 nt, Homo sapiens
cuccccagagcugcc

SEQ ID NO: 976843 - RNA, 20 nt, Homo sapiens
cuccccuagggggagaagaa

SEQ ID NO: 976844 - RNA, 14 nt, Homo sapiens
cuccccugccccuc

SEQ ID NO: 976845 - RNA, 22 nt, Homo sapiens
cuccccuuuuauaccugcucuu

SEQ ID NO: 976846 - RNA, 23 nt, Homo sapiens
cucccugcagaugccacccuagc

SEQ ID NO: 976847 - RNA, 20 nt, Homo sapiens
cuccggaggagacacaguua

SEQ ID NO: 976848 - RNA, 20 nt, Homo sapiens
cuccuaucagaagcucccag

SEQ ID NO: 976849 - RNA, 19 nt, Homo sapiens
cuccucagagcgccaggaa

SEQ ID NO: 976850 - RNA, 14 nt, Homo sapiens
cuccuccccuuuca

SEQ ID NO: 976851 - RNA, 14 nt, Homo sapiens
cuccugauccacuu

SEQ ID NO: 976852 - RNA, 15 nt, Homo sapiens
cuccugccauagucu

SEQ ID NO: 976853 - RNA, 12 nt, Homo sapiens
cuccugccugag

SEQ ID NO: 976854 - RNA, 19 nt, Homo sapiens
cuccugcucauauugugau

SEQ ID NO: 976855 - RNA, 23 nt, Homo sapiens
cuucuagaaucucguuucuccuc

SEQ ID NO: 976856 - RNA, 13 nt, Homo sapiens
cuucuauuaauca

SEQ ID NO: 976857 - RNA, 18 nt, Homo sapiens
cuucucagaagcacagaa

SEQ ID NO: 976858 - RNA, 19 nt, Homo sapiens
cuucucauucccaugugga

SEQ ID NO: 976859 - RNA, 20 nt, Homo sapiens
cuucuccaucccucuaauga

SEQ ID NO: 976860 - RNA, 14 nt, Homo sapiens
cuucucuccuugcc

SEQ ID NO: 976861 - RNA, 17 nt, Homo sapiens
cuucucuugagcaguua

SEQ ID NO: 976862 - RNA, 22 nt, Homo sapiens
cuucuuaaccauucuacugugu

SEQ ID NO: 976863 - RNA, 16 nt, Homo sapiens
cuucuugaaacagccu

SEQ ID NO: 976864 - RNA, 16 nt, Homo sapiens
cuucuuugugccugag

SEQ ID NO: 976865 - RNA, 14 nt, Homo sapiens
cuugagaagccaac

SEQ ID NO: 976866 - RNA, 23 nt, Homo sapiens
cuugaucggaaagcucuuccuaa

SEQ ID NO: 976867 - RNA, 14 nt, Homo sapiens
cuugcaaagcaacu

SEQ ID NO: 976868 - RNA, 20 nt, Homo sapiens
cuugcaccacuuccguccca

SEQ ID NO: 976869 - RNA, 15 nt, Homo sapiens
cuugcagaacuguag

SEQ ID NO: 976870 - RNA, 18 nt, Homo sapiens
cuugcaucaagggcuuua

SEQ ID NO: 976871 - RNA, 13 nt, Homo sapiens
cuugcaugaauca

SEQ ID NO: 976872 - RNA, 18 nt, Homo sapiens
cuugccagggcagggucu

SEQ ID NO: 976873 - RNA, 14 nt, Homo sapiens
cuugcuuccugucu

SEQ ID NO: 976874 - RNA, 21 nt, Homo sapiens
cuuggaaaaaaaccacagcca

SEQ ID NO: 976875 - RNA, 21 nt, Homo sapiens
cuuggaaauagaaagaagcca

SEQ ID NO: 976876 - RNA, 22 nt, Homo sapiens
cuuggaacauacuguucacuca

SEQ ID NO: 976877 - RNA, 15 nt, Homo sapiens
cuuggacucaugagg

SEQ ID NO: 976878 - RNA, 21 nt, Homo sapiens
cuuggaggcccugcacugcca

SEQ ID NO: 976879 - RNA, 22 nt, Homo sapiens
cuuggaggcccugcacugccag

SEQ ID NO: 976880 - RNA, 21 nt, Homo sapiens
cuuggauuuuccugaaagugu

SEQ ID NO: 976881 - RNA, 23 nt, Homo sapiens
cuuggccucccaaagugcugaga

SEQ ID NO: 976882 - RNA, 22 nt, Homo sapiens
cuuggcuucugugaugagcuga

SEQ ID NO: 976883 - RNA, 13 nt, Homo sapiens
cuugggcucugau

SEQ ID NO: 976884 - RNA, 20 nt, Homo sapiens
cuuggggagauggaguucuu

SEQ ID NO: 976885 - RNA, 13 nt, Homo sapiens
cuuguaguaugcu

SEQ ID NO: 976886 - RNA, 23 nt, Homo sapiens
cuuguauagcaugaaauaaaaua

SEQ ID NO: 976887 - RNA, 21 nt, Homo sapiens
cuugucuuuugagcuauucac

SEQ ID NO: 976888 - RNA, 11 nt, Homo sapiens
cuugugccaua

SEQ ID NO: 976889 - RNA, 18 nt, Homo sapiens
cuuguggguccaugcuaa

SEQ ID NO: 976890 - RNA, 22 nt, Homo sapiens
cuugugucugcggggaucagag

SEQ ID NO: 976891 - RNA, 15 nt, Homo sapiens
cuuuaaaauauuguu

SEQ ID NO: 976892 - RNA, 22 nt, Homo sapiens
cuuuaagccuucaaaacuauag

SEQ ID NO: 976893 - RNA, 13 nt, Homo sapiens
cuuuaauguacau

SEQ ID NO: 976894 - RNA, 16 nt, Homo sapiens
cuuuaauuaccaguuu

SEQ ID NO: 976895 - RNA, 17 nt, Homo sapiens
cuuuacccaccuagaac

SEQ ID NO: 976896 - RNA, 14 nt, Homo sapiens
cuuuaucauaugcu

SEQ ID NO: 976897 - RNA, 18 nt, Homo sapiens
cuuuaucuaauaccucug

SEQ ID NO: 976898 - RNA, 21 nt, Homo sapiens
cuuuauguacaaacauguugu

SEQ ID NO: 976899 - RNA, 19 nt, Homo sapiens
cuuuccaaagaaauggaaa

SEQ ID NO: 976900 - RNA, 21 nt, Homo sapiens
cuuucccuccuuuucccaaag

SEQ ID NO: 976901 - RNA, 13 nt, Homo sapiens
cuuucgaggccug

SEQ ID NO: 976902 - RNA, 14 nt, Homo sapiens
cuuucucucucuaa

SEQ ID NO: 976903 - RNA, 17 nt, Homo sapiens
cuuucugaauugcacau

SEQ ID NO: 976904 - RNA, 17 nt, Homo sapiens
cuuucugcuuacaaaga

SEQ ID NO: 976905 - RNA, 19 nt, Homo sapiens
cuuugaaguagguggcuug

SEQ ID NO: 976906 - RNA, 19 nt, Homo sapiens
cuuugagcugagugcugaa

SEQ ID NO: 976907 - RNA, 13 nt, Homo sapiens
cuuugaguaccaa

SEQ ID NO: 976908 - RNA, 16 nt, Homo sapiens
cuuugcccagacauuu

SEQ ID NO: 976909 - RNA, 15 nt, Homo sapiens
cuuugcggugggacc

SEQ ID NO: 976910 - RNA, 20 nt, Homo sapiens
cuuugcuccagauaacucuc

SEQ ID NO: 976911 - RNA, 19 nt, Homo sapiens
cuuugcugaaugucauuuu

SEQ ID NO: 976912 - RNA, 20 nt, Homo sapiens
cuuuggauccugggucaaaa

SEQ ID NO: 976913 - RNA, 15 nt, Homo sapiens
cuuugucagcaauaa

SEQ ID NO: 976914 - RNA, 14 nt, Homo sapiens
cuuugucagcauca

SEQ ID NO: 976915 - RNA, 16 nt, Homo sapiens
cuuugucugucaauca

SEQ ID NO: 976916 - RNA, 14 nt, Homo sapiens
cuuugugugcucuc

SEQ ID NO: 976917 - RNA, 15 nt, Homo sapiens
cuuuguguguauuca

SEQ ID NO: 976918 - RNA, 13 nt, Homo sapiens
cuuuuaaugaugc

SEQ ID NO: 976919 - RNA, 22 nt, Homo sapiens
cuuuuacuuuuugccccuucca

SEQ ID NO: 976920 - RNA, 20 nt, Homo sapiens
cuuuucagaagcaagccaga

SEQ ID NO: 976921 - RNA, 15 nt, Homo sapiens
cuuuuccacuuuaaa

SEQ ID NO: 976922 - RNA, 21 nt, Homo sapiens
cuuuucuaauuaauagccaaa

SEQ ID NO: 976923 - RNA, 13 nt, Homo sapiens
cuuuugaccaaau

SEQ ID NO: 976924 - RNA, 12 nt, Homo sapiens
cuuuuguacuga

SEQ ID NO: 976925 - RNA, 17 nt, Homo sapiens
cuuuugugcaaagccaa

SEQ ID NO: 976926 - RNA, 14 nt, Homo sapiens
cuuuuucacuuuga

SEQ ID NO: 976927 - RNA, 19 nt, Homo sapiens
cuuuuuuccugggccagaa

SEQ ID NO: 976928 - RNA, 17 nt, Homo sapiens
cuuuuuuuaaguguucu

SEQ ID NO: 976929 - RNA, 14 nt, Homo sapiens
gaaaaaauuacuca

SEQ ID NO: 976930 - RNA, 19 nt, Homo sapiens
gaaaaaauuagcugggcau

SEQ ID NO: 976931 - RNA, 17 nt, Homo sapiens
gaaaaauauagccuuua

SEQ ID NO: 976932 - RNA, 17 nt, Homo sapiens
gaaaaauaugugcuuga

SEQ ID NO: 976933 - RNA, 17 nt, Homo sapiens
gaaaaauauuccuguga

SEQ ID NO: 976934 - RNA, 23 nt, Homo sapiens
gaaaaauauugcugaacuacuuu

SEQ ID NO: 976935 - RNA, 14 nt, Homo sapiens
gaaaaaucuaaaau

SEQ ID NO: 976936 - RNA, 18 nt, Homo sapiens
gaaaacacccaauaccuu

SEQ ID NO: 976937 - RNA, 21 nt, Homo sapiens
gaaaagaaagugaaaguuuua

SEQ ID NO: 976938 - RNA, 15 nt, Homo sapiens
gaaaagagucuucca

SEQ ID NO: 976939 - RNA, 16 nt, Homo sapiens
gaaaaguccacauaac

SEQ ID NO: 976940 - RNA, 23 nt, Homo sapiens
gaaaaguguccuucuugcucccc

SEQ ID NO: 976941 - RNA, 20 nt, Homo sapiens
gaaaaguugaugguauucau

SEQ ID NO: 976942 - RNA, 10 nt, Homo sapiens
gaaaauggaa

SEQ ID NO: 976943 - RNA, 20 nt, Homo sapiens
gaaaauuggaacucuacuca

SEQ ID NO: 976944 - RNA, 21 nt, Homo sapiens
gaaacaccccucugucuagga

SEQ ID NO: 976945 - RNA, 20 nt, Homo sapiens
gaaaccccccagagcucuuu

SEQ ID NO: 976946 - RNA, 18 nt, Homo sapiens
gaaacggaggccagagag

SEQ ID NO: 976947 - RNA, 22 nt, Homo sapiens
gaaacuuggaugucacugccug

SEQ ID NO: 976948 - RNA, 18 nt, Homo sapiens
gaaacuuuaauccaaaga

SEQ ID NO: 976949 - RNA, 18 nt, Homo sapiens
gaaagagacuccgucuca

SEQ ID NO: 976950 - RNA, 22 nt, Homo sapiens
gaaagaugguguggguguccug

SEQ ID NO: 976951 - RNA, 18 nt, Homo sapiens
gaaagcauaaagcucaaa

SEQ ID NO: 976952 - RNA, 16 nt, Homo sapiens
gaaagcccucaugugc

SEQ ID NO: 976953 - RNA, 18 nt, Homo sapiens
gaaagggauugcuuugca

SEQ ID NO: 976954 - RNA, 13 nt, Homo sapiens
gaaaggggugcuu

SEQ ID NO: 976955 - RNA, 17 nt, Homo sapiens
gaaaguauaaugcagua

SEQ ID NO: 976956 - RNA, 15 nt, Homo sapiens
gaaauaacaauguua

SEQ ID NO: 976957 - RNA, 21 nt, Homo sapiens
gaaauaauugaagagagaaau

SEQ ID NO: 976958 - RNA, 13 nt, Homo sapiens
gaaauaccuauuc

SEQ ID NO: 976959 - RNA, 18 nt, Homo sapiens
gaaauagaaagaagccau

SEQ ID NO: 976960 - RNA, 12 nt, Homo sapiens
gaaaugcaaaau

SEQ ID NO: 976961 - RNA, 23 nt, Homo sapiens
gaaauggcaucauuauaagcuau

SEQ ID NO: 976962 - RNA, 14 nt, Homo sapiens
gaaauucuguggug

SEQ ID NO: 976963 - RNA, 18 nt, Homo sapiens
gaaauugcaguaacaaaa

SEQ ID NO: 976964 - RNA, 16 nt, Homo sapiens
gaaauuuaagcacaaa

SEQ ID NO: 976965 - RNA, 17 nt, Homo sapiens
gaaauuuuguaagaagg

SEQ ID NO: 976966 - RNA, 12 nt, Homo sapiens
gaacaaaucagc

SEQ ID NO: 976967 - RNA, 16 nt, Homo sapiens
gaacaccuauugcacu

SEQ ID NO: 976968 - RNA, 12 nt, Homo sapiens
gaacagagcaag

SEQ ID NO: 976969 - RNA, 19 nt, Homo sapiens
gaacagcugugucugccaa

SEQ ID NO: 976970 - RNA, 13 nt, Homo sapiens
uuuagcucugaga

SEQ ID NO: 976971 - RNA, 13 nt, Homo sapiens
uuuaucauaugcu

SEQ ID NO: 976972 - RNA, 12 nt, Homo sapiens
uuuauccacuua

SEQ ID NO: 976973 - RNA, 16 nt, Homo sapiens
uuuaucuuuauaugaa

SEQ ID NO: 976974 - RNA, 17 nt, Homo sapiens
uuuaugugaacuaugau

SEQ ID NO: 976975 - RNA, 21 nt, Homo sapiens
uuuauguuuggugaacuauau

SEQ ID NO: 976976 - RNA, 16 nt, Homo sapiens
uuuauuaacuacugaa

SEQ ID NO: 976977 - RNA, 17 nt, Homo sapiens
uuuauuacauugcugcc

SEQ ID NO: 976978 - RNA, 13 nt, Homo sapiens
uuucaaacaagua

SEQ ID NO: 976979 - RNA, 21 nt, Homo sapiens
uuucaagcaaaacaguucuca

SEQ ID NO: 976980 - RNA, 15 nt, Homo sapiens
uuucaccauguuggc

SEQ ID NO: 976981 - RNA, 18 nt, Homo sapiens
uuucagacugugcaauac

SEQ ID NO: 976982 - RNA, 13 nt, Homo sapiens
uuucagguuuugu

SEQ ID NO: 976983 - RNA, 20 nt, Homo sapiens
uuucauccuauaagcuuaaa

SEQ ID NO: 976984 - RNA, 19 nt, Homo sapiens
uuucauccugauacuguag

SEQ ID NO: 976985 - RNA, 16 nt, Homo sapiens
uuucaucucuauuuag

SEQ ID NO: 976986 - RNA, 15 nt, Homo sapiens
uuuccaaacauccaa

SEQ ID NO: 976987 - RNA, 12 nt, Homo sapiens
uuuccagaauug

SEQ ID NO: 976988 - RNA, 17 nt, Homo sapiens
uuucccacacugugaac

SEQ ID NO: 976989 - RNA, 13 nt, Homo sapiens
uuucccacucuca

SEQ ID NO: 976990 - RNA, 12 nt, Homo sapiens
uuucccauuuca

SEQ ID NO: 976991 - RNA, 21 nt, Homo sapiens
uuuccuccugcuucaugggaa

SEQ ID NO: 976992 - RNA, 16 nt, Homo sapiens
uuuccugauaacauua

SEQ ID NO: 976993 - RNA, 20 nt, Homo sapiens
uuuccuuuuacaauuguuga

SEQ ID NO: 976994 - RNA, 19 nt, Homo sapiens
uuuccuuuuugacacugaa

SEQ ID NO: 976995 - RNA, 13 nt, Homo sapiens
uuucuaagagaag

SEQ ID NO: 976996 - RNA, 21 nt, Homo sapiens
uuucuacaacugauugcaaca

SEQ ID NO: 976997 - RNA, 14 nt, Homo sapiens
uuucuacacugagg

SEQ ID NO: 976998 - RNA, 15 nt, Homo sapiens
uuucuauuauggaaa

SEQ ID NO: 976999 - RNA, 14 nt, Homo sapiens
uuucucugaucucc

SEQ ID NO: 977000 - RNA, 19 nt, Homo sapiens
uuucugcuuacaaagacaa

SEQ ID NO: 977001 - RNA, 19 nt, Homo sapiens
uuucugggguccauucucu

SEQ ID NO: 977002 - RNA, 22 nt, Homo sapiens
uuucugugggaggagaagggga

SEQ ID NO: 977003 - RNA, 13 nt, Homo sapiens
uuucuuccaacau

SEQ ID NO: 977004 - RNA, 17 nt, Homo sapiens
uuucuugaaccaauaau

SEQ ID NO: 977005 - RNA, 13 nt, Homo sapiens
uuucuuuccucag

SEQ ID NO: 977006 - RNA, 14 nt, Homo sapiens
uuugaaaguauaau

SEQ ID NO: 977007 - RNA, 17 nt, Homo sapiens
uuugaaucuacauucac

SEQ ID NO: 977008 - RNA, 16 nt, Homo sapiens
uuugagaauacauaaa

SEQ ID NO: 977009 - RNA, 13 nt, Homo sapiens
uuugauagaaaga

SEQ ID NO: 977010 - RNA, 19 nt, Homo sapiens
uuugauagggaacugggga

SEQ ID NO: 977011 - RNA, 20 nt, Homo sapiens
uuugauauaccaaauuaaaa

SEQ ID NO: 977012 - RNA, 14 nt, Homo sapiens
uuugaugauacaga

SEQ ID NO: 977013 - RNA, 15 nt, Homo sapiens
uuugcuaucugggcu

SEQ ID NO: 977014 - RNA, 15 nt, Homo sapiens
uuuggaauauuaaaa

SEQ ID NO: 977015 - RNA, 20 nt, Homo sapiens
uuuggagcacaaaauucaaa

SEQ ID NO: 977016 - RNA, 14 nt, Homo sapiens
uuuggaggugcugc

SEQ ID NO: 977017 - RNA, 16 nt, Homo sapiens
uuuggaugauugucau

SEQ ID NO: 977018 - RNA, 16 nt, Homo sapiens
uuuggcuuaaaccaga

SEQ ID NO: 977019 - RNA, 16 nt, Homo sapiens
uuuguaaaacauuagu

SEQ ID NO: 977020 - RNA, 23 nt, Homo sapiens
uuuguaauaauaaaaccaaagaa

SEQ ID NO: 977021 - RNA, 19 nt, Homo sapiens
uuugugagaaacaucucaa

SEQ ID NO: 977022 - RNA, 23 nt, Homo sapiens
uuugugccagaggaauccuggca

SEQ ID NO: 977023 - RNA, 23 nt, Homo sapiens
uuuguguaaaaaaaccaccaaaa

SEQ ID NO: 977024 - RNA, 16 nt, Homo sapiens
uuuguuuuuacaaaau

SEQ ID NO: 977025 - RNA, 22 nt, Homo sapiens
uuuuaagaagacauacugcuug

SEQ ID NO: 977026 - RNA, 18 nt, Homo sapiens
uuuuaauacauugaucag

SEQ ID NO: 977027 - RNA, 20 nt, Homo sapiens
uuuuaaugaaacuucaaaua

SEQ ID NO: 977028 - RNA, 12 nt, Homo sapiens
uuuuagcuguga

SEQ ID NO: 977029 - RNA, 14 nt, Homo sapiens
uuuuagugugugca

SEQ ID NO: 977030 - RNA, 21 nt, Homo sapiens
uuuuauaugcuuacugauaua

SEQ ID NO: 977031 - RNA, 23 nt, Homo sapiens
uuuuauggggcccuguccaggua

SEQ ID NO: 977032 - RNA, 15 nt, Homo sapiens
uuuucaagcaaaaca

SEQ ID NO: 977033 - RNA, 22 nt, Homo sapiens
uuuucaagcaaaacaguucuca

SEQ ID NO: 977034 - RNA, 16 nt, Homo sapiens
uuuucccagucuguga

SEQ ID NO: 977035 - RNA, 14 nt, Homo sapiens
uuuucccauuucaa

SEQ ID NO: 977036 - RNA, 18 nt, Homo sapiens
uuuuccccaaaccauaaa

SEQ ID NO: 977037 - RNA, 23 nt, Homo sapiens
uuuucgaacaccaaaaaugaugc

SEQ ID NO: 977038 - RNA, 16 nt, Homo sapiens
uuuucuauuauggaaa

SEQ ID NO: 977039 - RNA, 19 nt, Homo sapiens
uuuucucaguguugguaua

SEQ ID NO: 977040 - RNA, 15 nt, Homo sapiens
uuuucuccucugcuu

SEQ ID NO: 977041 - RNA, 20 nt, Homo sapiens
uuuucuguagcaccagagaa

SEQ ID NO: 977042 - RNA, 14 nt, Homo sapiens
uuuucugugccuga

SEQ ID NO: 977043 - RNA, 18 nt, Homo sapiens
uuuugcuuuugacuccag

SEQ ID NO: 977044 - RNA, 17 nt, Homo sapiens
uuuuguaagaaggcaau

SEQ ID NO: 977045 - RNA, 17 nt, Homo sapiens
uuuugugcaaagccaaa

SEQ ID NO: 977046 - RNA, 20 nt, Homo sapiens
uuuuuauaucaugcaaaaua

SEQ ID NO: 977047 - RNA, 18 nt, Homo sapiens
uuuuucuaagcauauuca

SEQ ID NO: 977048 - RNA, 14 nt, Homo sapiens
uuuuugguaucuuc

SEQ ID NO: 977049 - RNA, 13 nt, Homo sapiens
uuuuuuugcugcu

SEQ ID NO: 977050 - RNA, 14 nt, Homo sapiens
uagaagcacuacac

SEQ ID NO: 977051 - RNA, 14 nt, Homo sapiens
uagaaguuacuuaa

SEQ ID NO: 977052 - RNA, 13 nt, Homo sapiens
uagaauaagccuu

SEQ ID NO: 977053 - RNA, 18 nt, Homo sapiens
uagaauuaucaagcuuuu

SEQ ID NO: 977054 - RNA, 12 nt, Homo sapiens
uagaauucugaa

SEQ ID NO: 977055 - RNA, 17 nt, Homo sapiens
uagacaaaccaucuccu

SEQ ID NO: 977056 - RNA, 20 nt, Homo sapiens
uagacagguguuacuuacag

SEQ ID NO: 977057 - RNA, 22 nt, Homo sapiens
uagaccuccacacccgugagaa

SEQ ID NO: 977058 - RNA, 22 nt, Homo sapiens
uagacuaucuagaacuugagaa

SEQ ID NO: 977059 - RNA, 19 nt, Homo sapiens
uagagaaaauaaauuccaa

SEQ ID NO: 977060 - RNA, 19 nt, Homo sapiens
uagagaggacaauacuggg

SEQ ID NO: 977061 - RNA, 17 nt, Homo sapiens
uagagauaaaacagaau

SEQ ID NO: 977062 - RNA, 18 nt, Homo sapiens
uagagauagcuacagugu

SEQ ID NO: 977063 - RNA, 14 nt, Homo sapiens
uagagaugcaguuu

SEQ ID NO: 977064 - RNA, 17 nt, Homo sapiens
uagagcccagugagguc

SEQ ID NO: 977065 - RNA, 22 nt, Homo sapiens
uagagcuaagauacugaugaca

SEQ ID NO: 977066 - RNA, 17 nt, Homo sapiens
uagaggcuagcuucugc

SEQ ID NO: 977067 - RNA, 21 nt, Homo sapiens
uagauaauuucagggugcagc

SEQ ID NO: 977068 - RNA, 20 nt, Homo sapiens
uagauccugguuaccacucu

SEQ ID NO: 977069 - RNA, 22 nt, Homo sapiens
uagaugauuucaguucuaggaa

SEQ ID NO: 977070 - RNA, 19 nt, Homo sapiens
uagauuucccuauugugac

SEQ ID NO: 977071 - RNA, 23 nt, Homo sapiens
uagcaacugcuggggagacaaau

SEQ ID NO: 977072 - RNA, 18 nt, Homo sapiens
uagcacaauuugcacuaa

SEQ ID NO: 977073 - RNA, 20 nt, Homo sapiens
uagcaucuucucauucccau

SEQ ID NO: 977074 - RNA, 15 nt, Homo sapiens
uagccaaugucuccu

SEQ ID NO: 977075 - RNA, 15 nt, Homo sapiens
uagcucucccaguga

SEQ ID NO: 977076 - RNA, 12 nt, Homo sapiens
uagcucugagaa

SEQ ID NO: 977077 - RNA, 13 nt, Homo sapiens
uagcucugagaac

SEQ ID NO: 977078 - RNA, 17 nt, Homo sapiens
uagcucuggaccugucu

SEQ ID NO: 977079 - RNA, 17 nt, Homo sapiens
uagcuggaugugguggu

SEQ ID NO: 977080 - RNA, 18 nt, Homo sapiens
uaggaaacucacacuccc

SEQ ID NO: 977081 - RNA, 14 nt, Homo sapiens
uaggagcaagguga

SEQ ID NO: 977082 - RNA, 14 nt, Homo sapiens
uagggcugagcucu

SEQ ID NO: 977083 - RNA, 13 nt, Homo sapiens
uaguacaauagua

SEQ ID NO: 977084 - RNA, 13 nt, Homo sapiens
uaguauacuuugu

SEQ ID NO: 977085 - RNA, 16 nt, Homo sapiens
uaguaugugcauuuaa

SEQ ID NO: 977086 - RNA, 14 nt, Homo sapiens
uagucaccagagac

SEQ ID NO: 977087 - RNA, 16 nt, Homo sapiens
uagucaccugccccag

SEQ ID NO: 977088 - RNA, 21 nt, Homo sapiens
uagucaccugccccagcacuc

SEQ ID NO: 977089 - RNA, 18 nt, Homo sapiens
uagucacucauccauccc

SEQ ID NO: 977090 - RNA, 19 nt, Homo sapiens
uaguccuuguaaacaauau

SEQ ID NO: 977091 - RNA, 18 nt, Homo sapiens
uagucugcuuugguacua

SEQ ID NO: 977092 - RNA, 17 nt, Homo sapiens
uagugcacaagcacuau

SEQ ID NO: 977093 - RNA, 14 nt, Homo sapiens
uagugucacugcuu

SEQ ID NO: 977094 - RNA, 15 nt, Homo sapiens
uaguuuuacuuuuaa

SEQ ID NO: 977095 - RNA, 12 nt, Homo sapiens
uauaagcuuaaa

SEQ ID NO: 977096 - RNA, 11 nt, Homo sapiens
uauaccaaaaa

SEQ ID NO: 977097 - RNA, 20 nt, Homo sapiens
uauacuuaagaauacacagg

SEQ ID NO: 977098 - RNA, 14 nt, Homo sapiens
uauaggucauggga

SEQ ID NO: 977099 - RNA, 23 nt, Homo sapiens
uauauaaacaauaaaaacaacuu

SEQ ID NO: 977100 - RNA, 19 nt, Homo sapiens
uauauaauuuauuuccacu

SEQ ID NO: 977101 - RNA, 14 nt, Homo sapiens
uauauacacauaca

SEQ ID NO: 977102 - RNA, 15 nt, Homo sapiens
uauaucaagaagucu

SEQ ID NO: 977103 - RNA, 15 nt, Homo sapiens
uauaugcuaugcugu

SEQ ID NO: 977104 - RNA, 16 nt, Homo sapiens
uauauuuuaaauaccc

SEQ ID NO: 977105 - RNA, 13 nt, Homo sapiens
uauauuuucacau

SEQ ID NO: 977106 - RNA, 14 nt, Homo sapiens
uaucaagcuuuuaa

SEQ ID NO: 977107 - RNA, 12 nt, Homo sapiens
uaucaggagaaa

SEQ ID NO: 977108 - RNA, 23 nt, Homo sapiens
uaucaguuacaguggcaguauug

SEQ ID NO: 977109 - RNA, 18 nt, Homo sapiens
uauccaauugcucuuuca

SEQ ID NO: 977110 - RNA, 13 nt, Homo sapiens
uauccaccaagaa

SEQ ID NO: 977111 - RNA, 22 nt, Homo sapiens
uaucgggagaggggauucacaa

SEQ ID NO: 977112 - RNA, 14 nt, Homo sapiens
uaucuacauucuau

SEQ ID NO: 977113 - RNA, 22 nt, Homo sapiens
uaucuaugggaaaaaucuaaaa

SEQ ID NO: 977114 - RNA, 19 nt, Homo sapiens
uaucugugugugauuugcu

SEQ ID NO: 977115 - RNA, 20 nt, Homo sapiens
uaucugugugugauuugcua

SEQ ID NO: 977116 - RNA, 17 nt, Homo sapiens
uaucuuugugugacaug

SEQ ID NO: 977117 - RNA, 21 nt, Homo sapiens
uaugaacagcugugucugcca

SEQ ID NO: 977118 - RNA, 16 nt, Homo sapiens
uaugaccagaagccuu

SEQ ID NO: 977119 - RNA, 15 nt, Homo sapiens
uaugacuugaucacu

SEQ ID NO: 977120 - RNA, 19 nt, Homo sapiens
uaugcaaccaguuuaucca

SEQ ID NO: 977121 - RNA, 14 nt, Homo sapiens
uaugcacauaugga

SEQ ID NO: 977122 - RNA, 23 nt, Homo sapiens
uaugcauuaagaguaaaauuccu

SEQ ID NO: 977123 - RNA, 21 nt, Homo sapiens
uaugccaagucccuggaaaag

SEQ ID NO: 977124 - RNA, 18 nt, Homo sapiens
uaugcucauugaacuuua

SEQ ID NO: 977125 - RNA, 16 nt, Homo sapiens
uaugcuuacugauaua

SEQ ID NO: 977126 - RNA, 20 nt, Homo sapiens
uauggacaguaaguccagua

SEQ ID NO: 977127 - RNA, 15 nt, Homo sapiens
uauggacucugcaca

SEQ ID NO: 977128 - RNA, 17 nt, Homo sapiens
uauggcuucacauucau

SEQ ID NO: 977129 - RNA, 12 nt, Homo sapiens
uauggugcucag

SEQ ID NO: 977130 - RNA, 18 nt, Homo sapiens
uaugucuuggacacugua

SEQ ID NO: 977131 - RNA, 17 nt, Homo sapiens
uauguuaagaguacuau

SEQ ID NO: 977132 - RNA, 16 nt, Homo sapiens
uauuacauagcucuga

SEQ ID NO: 977133 - RNA, 21 nt, Homo sapiens
uauuagaucaaauaguugcau

SEQ ID NO: 977134 - RNA, 21 nt, Homo sapiens
uauuauaauuggaagugcagu

SEQ ID NO: 977135 - RNA, 17 nt, Homo sapiens
uauuauauuuauguugu

SEQ ID NO: 977136 - RNA, 16 nt, Homo sapiens
uauucauaaugugaga

SEQ ID NO: 977137 - RNA, 18 nt, Homo sapiens
uauucucuuccucaucca

SEQ ID NO: 977138 - RNA, 19 nt, Homo sapiens
uauugaaagccaacaacuc

SEQ ID NO: 977139 - RNA, 17 nt, Homo sapiens
uauugcaccauacuccu

SEQ ID NO: 977140 - RNA, 15 nt, Homo sapiens
uauugcuguuaauau

SEQ ID NO: 977141 - RNA, 19 nt, Homo sapiens
uauuguugcaauaucuaca

SEQ ID NO: 977142 - RNA, 14 nt, Homo sapiens
uauuguuucugcau

SEQ ID NO: 977143 - RNA, 13 nt, Homo sapiens
uauuuaaacaauu

SEQ ID NO: 977144 - RNA, 19 nt, Homo sapiens
uauuuaaucuuaaucuguu

SEQ ID NO: 977145 - RNA, 14 nt, Homo sapiens
uauuuacaagggaa

SEQ ID NO: 977146 - RNA, 13 nt, Homo sapiens
uauuucaaaggga

SEQ ID NO: 977147 - RNA, 14 nt, Homo sapiens
uauuucaaagggaa

SEQ ID NO: 977148 - RNA, 19 nt, Homo sapiens
uauuucccauuugugccag

SEQ ID NO: 977149 - RNA, 16 nt, Homo sapiens
uauuugcacaugggau

SEQ ID NO: 977150 - RNA, 12 nt, Homo sapiens
uauuuggcuuaa

SEQ ID NO: 977151 - RNA, 15 nt, Homo sapiens
uauuuuaaccugcau

SEQ ID NO: 977152 - RNA, 17 nt, Homo sapiens
uauuuuaauuacugcua

SEQ ID NO: 977153 - RNA, 17 nt, Homo sapiens
uauuuuauuuagacaag

SEQ ID NO: 977154 - RNA, 17 nt, Homo sapiens
uauuuucuacagugguu

SEQ ID NO: 977155 - RNA, 14 nt, Homo sapiens
uauuuuguguccuc

SEQ ID NO: 977156 - RNA, 18 nt, Homo sapiens
uauuuuuuacaauggcca

SEQ ID NO: 977157 - RNA, 23 nt, Homo sapiens
ucaaaaaagaaaaaagaaaagaa

SEQ ID NO: 977158 - RNA, 13 nt, Homo sapiens
ucaaaaccaagua

SEQ ID NO: 977159 - RNA, 17 nt, Homo sapiens
ucaaaauaaaaaguaau

SEQ ID NO: 977160 - RNA, 23 nt, Homo sapiens
ucaaaauaaaaaguaaugacuua

SEQ ID NO: 977161 - RNA, 20 nt, Homo sapiens
ucaaagaugccccauuccuu

SEQ ID NO: 977162 - RNA, 13 nt, Homo sapiens
ucaaagccuucuc

SEQ ID NO: 977163 - RNA, 10 nt, Homo sapiens
ucaaagggaa

SEQ ID NO: 977164 - RNA, 11 nt, Homo sapiens
ucaaagggaaa

SEQ ID NO: 977165 - RNA, 11 nt, Homo sapiens
ucaaagggaac

SEQ ID NO: 977166 - RNA, 20 nt, Homo sapiens
uaacaaaauuugaauagccc

SEQ ID NO: 977167 - RNA, 21 nt, Homo sapiens
uaacacccuuuagaaccuuaa

SEQ ID NO: 977168 - RNA, 19 nt, Homo sapiens
uaacagaacagcuucaggu

SEQ ID NO: 977169 - RNA, 15 nt, Homo sapiens
uaacagaauacauag

SEQ ID NO: 977170 - RNA, 18 nt, Homo sapiens
uaacaguaacugccauuu

SEQ ID NO: 977171 - RNA, 15 nt, Homo sapiens
uaacaucaccacugu

SEQ ID NO: 977172 - RNA, 22 nt, Homo sapiens
uaacauuaccuuacuguggagg

SEQ ID NO: 977173 - RNA, 21 nt, Homo sapiens
uaacccaagacaugacauucu

SEQ ID NO: 977174 - RNA, 21 nt, Homo sapiens
uaacccccaguucaagacuua

SEQ ID NO: 977175 - RNA, 20 nt, Homo sapiens
uaaccgcuugguuugcaacc

SEQ ID NO: 977176 - RNA, 20 nt, Homo sapiens
uaacucaccagccccacugc

SEQ ID NO: 977177 - RNA, 15 nt, Homo sapiens
uaacuuaacugaaau

SEQ ID NO: 977178 - RNA, 20 nt, Homo sapiens
uaacuuauuuuaaauaugcc

SEQ ID NO: 977179 - RNA, 18 nt, Homo sapiens
uaagacuaaaaguugcau

SEQ ID NO: 977180 - RNA, 14 nt, Homo sapiens
uaagagacacucca

SEQ ID NO: 977181 - RNA, 19 nt, Homo sapiens
uaagagacacuccaaaccu

SEQ ID NO: 977182 - RNA, 19 nt, Homo sapiens
uaagaggugaucucuggga

SEQ ID NO: 977183 - RNA, 20 nt, Homo sapiens
uaagauaaauucaugcacuu

SEQ ID NO: 977184 - RNA, 20 nt, Homo sapiens
uaagauguuuuaauauguau

SEQ ID NO: 977185 - RNA, 14 nt, Homo sapiens
uaagauuucucuaa

SEQ ID NO: 977186 - RNA, 14 nt, Homo sapiens
uaagauuuuccauu

SEQ ID NO: 977187 - RNA, 12 nt, Homo sapiens
uaagcuuuuugg

SEQ ID NO: 977188 - RNA, 18 nt, Homo sapiens
uaaggcauguggccuuua

SEQ ID NO: 977189 - RNA, 12 nt, Homo sapiens
uaaggccugaau

SEQ ID NO: 977190 - RNA, 18 nt, Homo sapiens
uaaggggccugcccucau

SEQ ID NO: 977191 - RNA, 18 nt, Homo sapiens
uaagggguaucauguaug

SEQ ID NO: 977192 - RNA, 14 nt, Homo sapiens
uaaguacuuugcug

SEQ ID NO: 977193 - RNA, 16 nt, Homo sapiens
uaaguauaaacaguuu

SEQ ID NO: 977194 - RNA, 16 nt, Homo sapiens
uaaguaucagcuacaa

SEQ ID NO: 977195 - RNA, 12 nt, Homo sapiens
uaagucuuucau

SEQ ID NO: 977196 - RNA, 17 nt, Homo sapiens
uaagugaauacauuaac

SEQ ID NO: 977197 - RNA, 17 nt, Homo sapiens
uaagugcuaagugcuua

SEQ ID NO: 977198 - RNA, 15 nt, Homo sapiens
uaaguggacuguauu

SEQ ID NO: 977199 - RNA, 15 nt, Homo sapiens
uaauaaaaccaaaga

SEQ ID NO: 977200 - RNA, 16 nt, Homo sapiens
uaauaaaccaguucug

SEQ ID NO: 977201 - RNA, 19 nt, Homo sapiens
uaauacauugaucaggcca

SEQ ID NO: 977202 - RNA, 19 nt, Homo sapiens
uaauagcuaauaauaccuu

SEQ ID NO: 977203 - RNA, 16 nt, Homo sapiens
uaauauaaauguugcu

SEQ ID NO: 977204 - RNA, 15 nt, Homo sapiens
uaauaucaacucuga

SEQ ID NO: 977205 - RNA, 19 nt, Homo sapiens
uaauauuuuuccacuuaaa

SEQ ID NO: 977206 - RNA, 13 nt, Homo sapiens
uaaucacaguguu

SEQ ID NO: 977207 - RNA, 17 nt, Homo sapiens
uaaucagucauuucuuc

SEQ ID NO: 977208 - RNA, 13 nt, Homo sapiens
uaaugaugccaug

SEQ ID NO: 977209 - RNA, 14 nt, Homo sapiens
uaaugccucuucau

SEQ ID NO: 977210 - RNA, 16 nt, Homo sapiens
uaauggaugguugaau

SEQ ID NO: 977211 - RNA, 12 nt, Homo sapiens
uaauguacaaaa

SEQ ID NO: 977212 - RNA, 20 nt, Homo sapiens
uaauguacacauugcauuuu

SEQ ID NO: 977213 - RNA, 23 nt, Homo sapiens
uaauguaccaaugaugaauuuau

SEQ ID NO: 977214 - RNA, 20 nt, Homo sapiens
uaaugucacaauuaugugca

SEQ ID NO: 977215 - RNA, 16 nt, Homo sapiens
uaauuaccaaccuguu

SEQ ID NO: 977216 - RNA, 20 nt, Homo sapiens
uaauuacuuauuguauuuau

SEQ ID NO: 977217 - RNA, 15 nt, Homo sapiens
uaauucuagcacuuu

SEQ ID NO: 977218 - RNA, 22 nt, Homo sapiens
uaauuuaguggauggaauauca

SEQ ID NO: 977219 - RNA, 22 nt, Homo sapiens
uaauuuccuuuuugacacugaa

SEQ ID NO: 977220 - RNA, 20 nt, Homo sapiens
uaauuugagagaaauaugaa

SEQ ID NO: 977221 - RNA, 21 nt, Homo sapiens
uacaacacauugaaacuguau

SEQ ID NO: 977222 - RNA, 18 nt, Homo sapiens
uacaacugauugcaacag

SEQ ID NO: 977223 - RNA, 21 nt, Homo sapiens
uacaagaacaaugacaccaca

SEQ ID NO: 977224 - RNA, 18 nt, Homo sapiens
uacaauacaacacauuga

SEQ ID NO: 977225 - RNA, 22 nt, Homo sapiens
uacaaugaaagcccucaugugc

SEQ ID NO: 977226 - RNA, 22 nt, Homo sapiens
uacaauuuuuuaucaugcaugu

SEQ ID NO: 977227 - RNA, 20 nt, Homo sapiens
uacacauauacaaauguaua

SEQ ID NO: 977228 - RNA, 16 nt, Homo sapiens
uacacuaaaguuacaa

SEQ ID NO: 977229 - RNA, 17 nt, Homo sapiens
uacagaggucagcacac

SEQ ID NO: 977230 - RNA, 14 nt, Homo sapiens
uacagcugcacuga

SEQ ID NO: 977231 - RNA, 13 nt, Homo sapiens
uacaggaggaaug

SEQ ID NO: 977232 - RNA, 17 nt, Homo sapiens
uacagugcagagccuuc

SEQ ID NO: 977233 - RNA, 14 nt, Homo sapiens
uacauagagaauaa

SEQ ID NO: 977234 - RNA, 12 nt, Homo sapiens
uacauaugcuga

SEQ ID NO: 977235 - RNA, 13 nt, Homo sapiens
uacaugcauuuga

SEQ ID NO: 977236 - RNA, 13 nt, Homo sapiens
uacauuguauucu

SEQ ID NO: 977237 - RNA, 18 nt, Homo sapiens
uacauuuacuggacccug

SEQ ID NO: 977238 - RNA, 19 nt, Homo sapiens
uacauuuuauuaagcuuuu

SEQ ID NO: 977239 - RNA, 20 nt, Homo sapiens
uaccaaauccacaagccauu

SEQ ID NO: 977240 - RNA, 12 nt, Homo sapiens
uaccagcagcug

SEQ ID NO: 977241 - RNA, 22 nt, Homo sapiens
uaccagcauacgcucaccuuac

SEQ ID NO: 977242 - RNA, 22 nt, Homo sapiens
uaccagguggcaaaguacuugu

SEQ ID NO: 977243 - RNA, 16 nt, Homo sapiens
uaccauccccacccau

SEQ ID NO: 977244 - RNA, 18 nt, Homo sapiens
uaccauuuaguaagaaua

SEQ ID NO: 977245 - RNA, 22 nt, Homo sapiens
uaccccuuggaaaugucugcug

SEQ ID NO: 977246 - RNA, 15 nt, Homo sapiens
uacccuaaagugcaa

SEQ ID NO: 977247 - RNA, 22 nt, Homo sapiens
uacccuuuggccccacuuugaa

SEQ ID NO: 977248 - RNA, 18 nt, Homo sapiens
uaccggacacucgucacc

SEQ ID NO: 977249 - RNA, 13 nt, Homo sapiens
uaccuacagcuaa

SEQ ID NO: 977250 - RNA, 20 nt, Homo sapiens
uaccuccauccauccuucca

SEQ ID NO: 977251 - RNA, 21 nt, Homo sapiens
uaccugguagaucaagcauua

SEQ ID NO: 977252 - RNA, 20 nt, Homo sapiens
uaccuugaacucuuagugau

SEQ ID NO: 977253 - RNA, 16 nt, Homo sapiens
uacgcacguggagcug

SEQ ID NO: 977254 - RNA, 20 nt, Homo sapiens
uacgcagaacuaccaggugg

SEQ ID NO: 977255 - RNA, 22 nt, Homo sapiens
uacgugaggccugcacagcuaa

SEQ ID NO: 977256 - RNA, 16 nt, Homo sapiens
uacguuugauacaaca

SEQ ID NO: 977257 - RNA, 15 nt, Homo sapiens
uacuaaaaauugugg

SEQ ID NO: 977258 - RNA, 19 nt, Homo sapiens
uacuaaaucuaaucaggaa

SEQ ID NO: 977259 - RNA, 13 nt, Homo sapiens
uacuaaugugccc

SEQ ID NO: 977260 - RNA, 22 nt, Homo sapiens
uacuaaugugccccauguccaa

SEQ ID NO: 977261 - RNA, 13 nt, Homo sapiens
uacuagcacuuug

SEQ ID NO: 977262 - RNA, 17 nt, Homo sapiens
uacuagucaccagagac

SEQ ID NO: 977263 - RNA, 16 nt, Homo sapiens
uacucagaaccugcuc

SEQ ID NO: 977264 - RNA, 15 nt, Homo sapiens
uacugggacaaccuc

SEQ ID NO: 977265 - RNA, 17 nt, Homo sapiens
uacuggggaaacuggcc

SEQ ID NO: 977266 - RNA, 16 nt, Homo sapiens
uacugucuaauuaaua

SEQ ID NO: 977267 - RNA, 17 nt, Homo sapiens
uacugucuguuaugauu

SEQ ID NO: 977268 - RNA, 20 nt, Homo sapiens
uacuguuugauauaccaaau

SEQ ID NO: 977269 - RNA, 14 nt, Homo sapiens
uacuuaaguuuuag

SEQ ID NO: 977270 - RNA, 11 nt, Homo sapiens
uacuucauuaa

SEQ ID NO: 977271 - RNA, 16 nt, Homo sapiens
uacuugccaucaguga

SEQ ID NO: 977272 - RNA, 23 nt, Homo sapiens
uacuugcuuuaccuuuucagggc

SEQ ID NO: 977273 - RNA, 17 nt, Homo sapiens
uacuuuaaaaugccaau

SEQ ID NO: 977274 - RNA, 17 nt, Homo sapiens
uacuuugacuuuuugca

SEQ ID NO: 977275 - RNA, 12 nt, Homo sapiens
uacuuuuugccc

SEQ ID NO: 977276 - RNA, 13 nt, Homo sapiens
uagaaacuacaaa

SEQ ID NO: 977277 - RNA, 17 nt, Homo sapiens
uagaacaaugcuauaau

SEQ ID NO: 977278 - RNA, 18 nt, Homo sapiens
uagaacuagccaaaccag

SEQ ID NO: 977279 - RNA, 17 nt, Homo sapiens
uagaacugucugugaac

SEQ ID NO: 977280 - RNA, 17 nt, Homo sapiens
uagaagacaacaggcau

SEQ ID NO: 977281 - RNA, 21 nt, Homo sapiens
gugguugucuuauugcaccau

SEQ ID NO: 977282 - RNA, 20 nt, Homo sapiens
gugguuuuauuucaaaggga

SEQ ID NO: 977283 - RNA, 21 nt, Homo sapiens
guguauauauaguagcauuuc

SEQ ID NO: 977284 - RNA, 20 nt, Homo sapiens
guguccccucacgcaagugc

SEQ ID NO: 977285 - RNA, 20 nt, Homo sapiens
gugucuguccuuuaugaucc

SEQ ID NO: 977286 - RNA, 22 nt, Homo sapiens
gugugauuugaauucugugaua

SEQ ID NO: 977287 - RNA, 22 nt, Homo sapiens
gugugggaaagcgcggacgugc

SEQ ID NO: 977288 - RNA, 19 nt, Homo sapiens
guguucuacacucaucuua

SEQ ID NO: 977289 - RNA, 21 nt, Homo sapiens
guuaaugcuuucccacucuca

SEQ ID NO: 977290 - RNA, 18 nt, Homo sapiens
guuaauuacaacugcuau

SEQ ID NO: 977291 - RNA, 17 nt, Homo sapiens
guuacaguggcaguauu

SEQ ID NO: 977292 - RNA, 12 nt, Homo sapiens
guuaccauucac

SEQ ID NO: 977293 - RNA, 16 nt, Homo sapiens
guuaccauucacaaua

SEQ ID NO: 977294 - RNA, 19 nt, Homo sapiens
guuagcauauggugcuuaa

SEQ ID NO: 977295 - RNA, 19 nt, Homo sapiens
guuaguggauuacugccau

SEQ ID NO: 977296 - RNA, 18 nt, Homo sapiens
guuauguguuuagaauca

SEQ ID NO: 977297 - RNA, 22 nt, Homo sapiens
guuauuugaaaauuugauuuug

SEQ ID NO: 977298 - RNA, 22 nt, Homo sapiens
guuauuuuuucagacugugcaa

SEQ ID NO: 977299 - RNA, 16 nt, Homo sapiens
guucaaauucuucuga

SEQ ID NO: 977300 - RNA, 18 nt, Homo sapiens
guucaagacuuagcuccu

SEQ ID NO: 977301 - RNA, 17 nt, Homo sapiens
guucacacacacucuga

SEQ ID NO: 977302 - RNA, 13 nt, Homo sapiens
guucaccuugccg

SEQ ID NO: 977303 - RNA, 18 nt, Homo sapiens
guucccaauaucauguga

SEQ ID NO: 977304 - RNA, 19 nt, Homo sapiens
guucccaauaucaugugau

SEQ ID NO: 977305 - RNA, 17 nt, Homo sapiens
guucuacacucaucuua

SEQ ID NO: 977306 - RNA, 22 nt, Homo sapiens
guucucaaauauuugcuaugaa

SEQ ID NO: 977307 - RNA, 15 nt, Homo sapiens
guucugagcaccgug

SEQ ID NO: 977308 - RNA, 22 nt, Homo sapiens
guucuguauuuuuaaauugcca

SEQ ID NO: 977309 - RNA, 12 nt, Homo sapiens
guucuugggaua

SEQ ID NO: 977310 - RNA, 20 nt, Homo sapiens
guucuuucagaaagcuuuga

SEQ ID NO: 977311 - RNA, 16 nt, Homo sapiens
guugaaaccaccguga

SEQ ID NO: 977312 - RNA, 20 nt, Homo sapiens
guugccacaguagaacuguc

SEQ ID NO: 977313 - RNA, 21 nt, Homo sapiens
guuggacuguaagggauugaa

SEQ ID NO: 977314 - RNA, 19 nt, Homo sapiens
guuguucuaguaacaauac

SEQ ID NO: 977315 - RNA, 18 nt, Homo sapiens
guuuaauauuuugaauau

SEQ ID NO: 977316 - RNA, 19 nt, Homo sapiens
guuuaauggguaugcucag

SEQ ID NO: 977317 - RNA, 21 nt, Homo sapiens
guuuagcguuguuuuguggau

SEQ ID NO: 977318 - RNA, 16 nt, Homo sapiens
guuuauuaacuacuga

SEQ ID NO: 977319 - RNA, 22 nt, Homo sapiens
guuuauuccaaaugccauccag

SEQ ID NO: 977320 - RNA, 18 nt, Homo sapiens
guuuauuuacaagggaag

SEQ ID NO: 977321 - RNA, 22 nt, Homo sapiens
guuucauucauccugaccaaga

SEQ ID NO: 977322 - RNA, 23 nt, Homo sapiens
guuuccugggcacgcacuggguu

SEQ ID NO: 977323 - RNA, 19 nt, Homo sapiens
guuucuccucuuuccuccu

SEQ ID NO: 977324 - RNA, 21 nt, Homo sapiens
guuucugucaagcuggugcua

SEQ ID NO: 977325 - RNA, 17 nt, Homo sapiens
guuucuugcauuuauua

SEQ ID NO: 977326 - RNA, 23 nt, Homo sapiens
guuucuuucuaguggucuuugua

SEQ ID NO: 977327 - RNA, 21 nt, Homo sapiens
guuugaagucuuguguauuug

SEQ ID NO: 977328 - RNA, 20 nt, Homo sapiens
guuugaguuuuuccucccag

SEQ ID NO: 977329 - RNA, 14 nt, Homo sapiens
guuuguccugagau

SEQ ID NO: 977330 - RNA, 22 nt, Homo sapiens
guuuguccuuuuucacuuugaa

SEQ ID NO: 977331 - RNA, 17 nt, Homo sapiens
guuuuccaguucaucga

SEQ ID NO: 977332 - RNA, 20 nt, Homo sapiens
guuuucuugcucaaagggaa

SEQ ID NO: 977333 - RNA, 15 nt, Homo sapiens
guuuugcaagugcug

SEQ ID NO: 977334 - RNA, 17 nt, Homo sapiens
uaaaaaaaccaccaaaa

SEQ ID NO: 977335 - RNA, 14 nt, Homo sapiens
uaaaaaagagacau

SEQ ID NO: 977336 - RNA, 15 nt, Homo sapiens
uaaaaagggaauuau

SEQ ID NO: 977337 - RNA, 12 nt, Homo sapiens
uaaaaaguaaug

SEQ ID NO: 977338 - RNA, 16 nt, Homo sapiens
uaaaaaugaaaauucu

SEQ ID NO: 977339 - RNA, 15 nt, Homo sapiens
uaaaacauguacaaa

SEQ ID NO: 977340 - RNA, 14 nt, Homo sapiens
uaaaacauuaguca

SEQ ID NO: 977341 - RNA, 22 nt, Homo sapiens
uaaaaccaacaaaaagaacaaa

SEQ ID NO: 977342 - RNA, 15 nt, Homo sapiens
uaaaagaaugacuau

SEQ ID NO: 977343 - RNA, 11 nt, Homo sapiens
uaaaagaucuu

SEQ ID NO: 977344 - RNA, 14 nt, Homo sapiens
uaaaagaucuugaa

SEQ ID NO: 977345 - RNA, 21 nt, Homo sapiens
uaaaagaucuugaauagucuc

SEQ ID NO: 977346 - RNA, 22 nt, Homo sapiens
uaaaagaucuugaauagucuca

SEQ ID NO: 977347 - RNA, 23 nt, Homo sapiens
uaaaagaucuugaauagucucau

SEQ ID NO: 977348 - RNA, 19 nt, Homo sapiens
uaaaagcaccacuguucug

SEQ ID NO: 977349 - RNA, 14 nt, Homo sapiens
uaaaaguaaauuca

SEQ ID NO: 977350 - RNA, 17 nt, Homo sapiens
uaaaauaaggauuuuuc

SEQ ID NO: 977351 - RNA, 16 nt, Homo sapiens
uaaaauaaugaacacu

SEQ ID NO: 977352 - RNA, 13 nt, Homo sapiens
uaaaauagaaaca

SEQ ID NO: 977353 - RNA, 18 nt, Homo sapiens
uaaaaucccaagucauuu

SEQ ID NO: 977354 - RNA, 18 nt, Homo sapiens
uaaaauguuuaaugguga

SEQ ID NO: 977355 - RNA, 16 nt, Homo sapiens
uaaaauuccuaucuca

SEQ ID NO: 977356 - RNA, 13 nt, Homo sapiens
uaaaauucuguca

SEQ ID NO: 977357 - RNA, 16 nt, Homo sapiens
uaaaauugaguuugua

SEQ ID NO: 977358 - RNA, 19 nt, Homo sapiens
uaaacacauguucugugcc

SEQ ID NO: 977359 - RNA, 23 nt, Homo sapiens
uaaaccuggaaucuacaagccaa

SEQ ID NO: 977360 - RNA, 17 nt, Homo sapiens
uaaacuauuuguggcaa

SEQ ID NO: 977361 - RNA, 20 nt, Homo sapiens
uaaacucauuuaacuaaagu

SEQ ID NO: 977362 - RNA, 23 nt, Homo sapiens
uaaacuccuuccuggccugagag

SEQ ID NO: 977363 - RNA, 20 nt, Homo sapiens
uaaagaaaggaacuaaguca

SEQ ID NO: 977364 - RNA, 17 nt, Homo sapiens
uaaagacccuccuauuc

SEQ ID NO: 977365 - RNA, 14 nt, Homo sapiens
uaaagaccugagaa

SEQ ID NO: 977366 - RNA, 20 nt, Homo sapiens
uaaagacugguuuucugcca

SEQ ID NO: 977367 - RNA, 22 nt, Homo sapiens
uaaagacuuguauagcaugaaa

SEQ ID NO: 977368 - RNA, 19 nt, Homo sapiens
uaaagagagaauguagaua

SEQ ID NO: 977369 - RNA, 17 nt, Homo sapiens
uaaagccuacccuauuc

SEQ ID NO: 977370 - RNA, 18 nt, Homo sapiens
uaaagccuacccuauucu

SEQ ID NO: 977371 - RNA, 14 nt, Homo sapiens
uaaaggacaggcca

SEQ ID NO: 977372 - RNA, 22 nt, Homo sapiens
uaaaggacaggccacaccacag

SEQ ID NO: 977373 - RNA, 15 nt, Homo sapiens
uaaaguacaucucua

SEQ ID NO: 977374 - RNA, 19 nt, Homo sapiens
uaaaguauauuuaacucau

SEQ ID NO: 977375 - RNA, 19 nt, Homo sapiens
uaaaguuucuugcauuuau

SEQ ID NO: 977376 - RNA, 16 nt, Homo sapiens
uaaauaaaaauaugua

SEQ ID NO: 977377 - RNA, 22 nt, Homo sapiens
uaaauaaaaauucaaccacaga

SEQ ID NO: 977378 - RNA, 15 nt, Homo sapiens
uaaauacaugcauau

SEQ ID NO: 977379 - RNA, 17 nt, Homo sapiens
uaaauaugcagugauau

SEQ ID NO: 977380 - RNA, 19 nt, Homo sapiens
uaaauaugccuaguaacac

SEQ ID NO: 977381 - RNA, 14 nt, Homo sapiens
uaaauauugucaua

SEQ ID NO: 977382 - RNA, 19 nt, Homo sapiens
uaaauauuucucaacugag

SEQ ID NO: 977383 - RNA, 13 nt, Homo sapiens
uaaaucauaaagu

SEQ ID NO: 977384 - RNA, 19 nt, Homo sapiens
uaaaucauucuuacuaaaa

SEQ ID NO: 977385 - RNA, 21 nt, Homo sapiens
uaaauccauccauccaaaggc

SEQ ID NO: 977386 - RNA, 18 nt, Homo sapiens
uaaaucccacaucccagu

SEQ ID NO: 977387 - RNA, 20 nt, Homo sapiens
uaaaugugacaugcaaagau

SEQ ID NO: 977388 - RNA, 13 nt, Homo sapiens
uaaaugugcuuug

SEQ ID NO: 977389 - RNA, 13 nt, Homo sapiens
uaaauuaagcaug

SEQ ID NO: 977390 - RNA, 12 nt, Homo sapiens
uaaauugcauca

SEQ ID NO: 977391 - RNA, 18 nt, Homo sapiens
uaaauuucuuaugugaca

SEQ ID NO: 977392 - RNA, 16 nt, Homo sapiens
uaaauuuguguucuca

SEQ ID NO: 977393 - RNA, 17 nt, Homo sapiens
uaaauuuguguucucaa

SEQ ID NO: 977394 - RNA, 15 nt, Homo sapiens
uaacaaaauccucag

SEQ ID NO: 977395 - RNA, 14 nt, Homo sapiens
gcuauucaccucag

SEQ ID NO: 977396 - RNA, 22 nt, Homo sapiens
gcuauuuaacauuuuacaguaa

SEQ ID NO: 977397 - RNA, 13 nt, Homo sapiens
gcucaaagggaac

SEQ ID NO: 977398 - RNA, 14 nt, Homo sapiens
gcucaccauggaau

SEQ ID NO: 977399 - RNA, 17 nt, Homo sapiens
gcucaccgcccaucagg

SEQ ID NO: 977400 - RNA, 16 nt, Homo sapiens
gcucagaacuugcugc

SEQ ID NO: 977401 - RNA, 18 nt, Homo sapiens
gcucaggagccaccagca

SEQ ID NO: 977402 - RNA, 15 nt, Homo sapiens
gcucaucugcaaaag

SEQ ID NO: 977403 - RNA, 23 nt, Homo sapiens
gcucaugccucagcccgccuuca

SEQ ID NO: 977404 - RNA, 15 nt, Homo sapiens
gcucauugaacuuua

SEQ ID NO: 977405 - RNA, 12 nt, Homo sapiens
gcuccaagcaca

SEQ ID NO: 977406 - RNA, 18 nt, Homo sapiens
gcucccagccacauggcg

SEQ ID NO: 977407 - RNA, 19 nt, Homo sapiens
gcucccccuccagccagag

SEQ ID NO: 977408 - RNA, 19 nt, Homo sapiens
gcuccgccccagcccucag

SEQ ID NO: 977409 - RNA, 19 nt, Homo sapiens
gcuccuguccccugcuaca

SEQ ID NO: 977410 - RNA, 16 nt, Homo sapiens
gcucucccaacucuug

SEQ ID NO: 977411 - RNA, 18 nt, Homo sapiens
gcucucccaacucuugca

SEQ ID NO: 977412 - RNA, 21 nt, Homo sapiens
gcucucccaacucuugcacag

SEQ ID NO: 977413 - RNA, 19 nt, Homo sapiens
gcucugagccacaguggga

SEQ ID NO: 977414 - RNA, 16 nt, Homo sapiens
gcucugccccaccuug

SEQ ID NO: 977415 - RNA, 14 nt, Homo sapiens
gcucuucaucugcc

SEQ ID NO: 977416 - RNA, 15 nt, Homo sapiens
gcugaaacucauuug

SEQ ID NO: 977417 - RNA, 22 nt, Homo sapiens
gcugaaauaaaaugauaaacaa

SEQ ID NO: 977418 - RNA, 13 nt, Homo sapiens
gcugaagucauug

SEQ ID NO: 977419 - RNA, 14 nt, Homo sapiens
gcugagaucgugcu

SEQ ID NO: 977420 - RNA, 13 nt, Homo sapiens
gcugagugcugaa

SEQ ID NO: 977421 - RNA, 22 nt, Homo sapiens
gcugaguuggguuggaguacac

SEQ ID NO: 977422 - RNA, 19 nt, Homo sapiens
gcugauuuacuaacaguaa

SEQ ID NO: 977423 - RNA, 19 nt, Homo sapiens
gcugcauugauccaggaga

SEQ ID NO: 977424 - RNA, 16 nt, Homo sapiens
gcugcccugucuggaa

SEQ ID NO: 977425 - RNA, 23 nt, Homo sapiens
gcugcccugucuggaacauggac

SEQ ID NO: 977426 - RNA, 23 nt, Homo sapiens
gcugccuucccuagcuuuagacc

SEQ ID NO: 977427 - RNA, 23 nt, Homo sapiens
gcugcgucagaccaguacuggga

SEQ ID NO: 977428 - RNA, 15 nt, Homo sapiens
gcuggaggaaccaga

SEQ ID NO: 977429 - RNA, 20 nt, Homo sapiens
gcuggaugucuccaucucug

SEQ ID NO: 977430 - RNA, 17 nt, Homo sapiens
gcuggccaaauagcaaa

SEQ ID NO: 977431 - RNA, 19 nt, Homo sapiens
gcuggccucucuagcacaa

SEQ ID NO: 977432 - RNA, 13 nt, Homo sapiens
gcugggccauguc

SEQ ID NO: 977433 - RNA, 17 nt, Homo sapiens
gcugggccauguccaaa

SEQ ID NO: 977434 - RNA, 19 nt, Homo sapiens
gcugggccauguccaaaga

SEQ ID NO: 977435 - RNA, 22 nt, Homo sapiens
gcuguagcucccgagcuacucu

SEQ ID NO: 977436 - RNA, 19 nt, Homo sapiens
gcuguguugguguggccca

SEQ ID NO: 977437 - RNA, 18 nt, Homo sapiens
gcuuaaauaggaaaguuu

SEQ ID NO: 977438 - RNA, 17 nt, Homo sapiens
gcuuaccuccucauggc

SEQ ID NO: 977439 - RNA, 18 nt, Homo sapiens
gcuuacuagcacuuugag

SEQ ID NO: 977440 - RNA, 15 nt, Homo sapiens
gcuuagagaggacaa

SEQ ID NO: 977441 - RNA, 16 nt, Homo sapiens
gcuuagugcacaagca

SEQ ID NO: 977442 - RNA, 19 nt, Homo sapiens
gcuuccugaugcugggcaa

SEQ ID NO: 977443 - RNA, 12 nt, Homo sapiens
gcuucucuccac

SEQ ID NO: 977444 - RNA, 20 nt, Homo sapiens
gcuucugcuggggccuggga

SEQ ID NO: 977445 - RNA, 12 nt, Homo sapiens
gcuucugugaug

SEQ ID NO: 977446 - RNA, 19 nt, Homo sapiens
gcuucuuugccucccucag

SEQ ID NO: 977447 - RNA, 16 nt, Homo sapiens
gcuugcaccacuuccg

SEQ ID NO: 977448 - RNA, 18 nt, Homo sapiens
gcuugggaagacuccuag

SEQ ID NO: 977449 - RNA, 11 nt, Homo sapiens
gcuugggcauu

SEQ ID NO: 977450 - RNA, 19 nt, Homo sapiens
gcuuggggccaccaaagcu

SEQ ID NO: 977451 - RNA, 20 nt, Homo sapiens
gcuugucuuaaaauaaugaa

SEQ ID NO: 977452 - RNA, 17 nt, Homo sapiens
gcuuguggggccuggga

SEQ ID NO: 977453 - RNA, 22 nt, Homo sapiens
gcuuuaucaaaaaguacaauaa

SEQ ID NO: 977454 - RNA, 13 nt, Homo sapiens
gcuuuaugcacau

SEQ ID NO: 977455 - RNA, 18 nt, Homo sapiens
gcuuucacauuguacuua

SEQ ID NO: 977456 - RNA, 15 nt, Homo sapiens
gcuuucagcacucac

SEQ ID NO: 977457 - RNA, 22 nt, Homo sapiens
gcuuucuuuaaaguucuucuaa

SEQ ID NO: 977458 - RNA, 15 nt, Homo sapiens
gcuuugaauacuaaa

SEQ ID NO: 977459 - RNA, 15 nt, Homo sapiens
gcuuugcucuauuaa

SEQ ID NO: 977460 - RNA, 20 nt, Homo sapiens
gcuuuggcugagaccuggga

SEQ ID NO: 977461 - RNA, 23 nt, Homo sapiens
gggaucagccuccgccauuccaa

SEQ ID NO: 977462 - RNA, 23 nt, Homo sapiens
gggauucacaaggugaagaacug

SEQ ID NO: 977463 - RNA, 12 nt, Homo sapiens
gggcaagcuccu

SEQ ID NO: 977464 - RNA, 23 nt, Homo sapiens
gggcaagggguucccuugagggc

SEQ ID NO: 977465 - RNA, 19 nt, Homo sapiens
gggcauccugugccacuaa

SEQ ID NO: 977466 - RNA, 14 nt, Homo sapiens
gggccauguccaaa

SEQ ID NO: 977467 - RNA, 15 nt, Homo sapiens
gggcccucgguggga

SEQ ID NO: 977468 - RNA, 16 nt, Homo sapiens
gggcuuucuggggccu

SEQ ID NO: 977469 - RNA, 15 nt, Homo sapiens
ggggcguucgcugcg

SEQ ID NO: 977470 - RNA, 18 nt, Homo sapiens
ggggcucuucaucugccu

SEQ ID NO: 977471 - RNA, 17 nt, Homo sapiens
ggguccacacaucuccc

SEQ ID NO: 977472 - RNA, 22 nt, Homo sapiens
ggguccacccuguccuaugacu

SEQ ID NO: 977473 - RNA, 23 nt, Homo sapiens
gggucccccugcuugucuucacc

SEQ ID NO: 977474 - RNA, 15 nt, Homo sapiens
gggucuccccaaaca

SEQ ID NO: 977475 - RNA, 12 nt, Homo sapiens
gggucuuugugg

SEQ ID NO: 977476 - RNA, 20 nt, Homo sapiens
gggugcuugagagacacugg

SEQ ID NO: 977477 - RNA, 13 nt, Homo sapiens
gggugggggugga

SEQ ID NO: 977478 - RNA, 19 nt, Homo sapiens
gguaaaaacagcagcucau

SEQ ID NO: 977479 - RNA, 15 nt, Homo sapiens
gguaaaggucugugg

SEQ ID NO: 977480 - RNA, 20 nt, Homo sapiens
gguagaggcugggggcucca

SEQ ID NO: 977481 - RNA, 22 nt, Homo sapiens
gguauuuguucaaaauaaugaa

SEQ ID NO: 977482 - RNA, 21 nt, Homo sapiens
ggucacguuuggugcuucuca

SEQ ID NO: 977483 - RNA, 16 nt, Homo sapiens
gguccagcggggguca

SEQ ID NO: 977484 - RNA, 15 nt, Homo sapiens
gguccauucucugag

SEQ ID NO: 977485 - RNA, 16 nt, Homo sapiens
ggucuaagguucagcc

SEQ ID NO: 977486 - RNA, 21 nt, Homo sapiens
ggucugacaugaacacuuuuu

SEQ ID NO: 977487 - RNA, 13 nt, Homo sapiens
ggucuucuuacau

SEQ ID NO: 977488 - RNA, 18 nt, Homo sapiens
ggugaaaccccgucucua

SEQ ID NO: 977489 - RNA, 16 nt, Homo sapiens
ggugacauuguggacu

SEQ ID NO: 977490 - RNA, 19 nt, Homo sapiens
ggugaccacccaccaccug

SEQ ID NO: 977491 - RNA, 13 nt, Homo sapiens
ggugcuccaagca

SEQ ID NO: 977492 - RNA, 19 nt, Homo sapiens
ggugcuugagagacacugg

SEQ ID NO: 977493 - RNA, 16 nt, Homo sapiens
gguggaaaauggugcc

SEQ ID NO: 977494 - RNA, 19 nt, Homo sapiens
gguggacuuugggaccugc

SEQ ID NO: 977495 - RNA, 21 nt, Homo sapiens
gguggcaccugccacucugcc

SEQ ID NO: 977496 - RNA, 18 nt, Homo sapiens
gguggggggcauugagua

SEQ ID NO: 977497 - RNA, 21 nt, Homo sapiens
gguucaauuucagaaguaaug

SEQ ID NO: 977498 - RNA, 14 nt, Homo sapiens
gguuccgccacucc

SEQ ID NO: 977499 - RNA, 16 nt, Homo sapiens
gguuccgccacuccag

SEQ ID NO: 977500 - RNA, 23 nt, Homo sapiens
gguucucuuagcaacucagagaa

SEQ ID NO: 977501 - RNA, 21 nt, Homo sapiens
gguugcacaaaaccacuuuuu

SEQ ID NO: 977502 - RNA, 16 nt, Homo sapiens
gguugugcacauuucu

SEQ ID NO: 977503 - RNA, 21 nt, Homo sapiens
gguuuccaagucccgggucuc

SEQ ID NO: 977504 - RNA, 22 nt, Homo sapiens
gguuuucuuugucagcaauaau

SEQ ID NO: 977505 - RNA, 14 nt, Homo sapiens
guaaaaacugaacu

SEQ ID NO: 977506 - RNA, 18 nt, Homo sapiens
guaaaaggauaguaagca

SEQ ID NO: 977507 - RNA, 17 nt, Homo sapiens
guaaaauggaggccauu

SEQ ID NO: 977508 - RNA, 21 nt, Homo sapiens
guaaacuuaaaauuacuauaa

SEQ ID NO: 977509 - RNA, 12 nt, Homo sapiens
guaaacuuccaa

SEQ ID NO: 977510 - RNA, 22 nt, Homo sapiens
guaaaggauagacucacauuua

SEQ ID NO: 977511 - RNA, 17 nt, Homo sapiens
aaugagaccaaagucca

SEQ ID NO: 977512 - RNA, 22 nt, Homo sapiens
aaugauaaacucagaucugauc

SEQ ID NO: 977513 - RNA, 15 nt, Homo sapiens
aaugcaaaacuuuag

SEQ ID NO: 977514 - RNA, 18 nt, Homo sapiens
aaugcaucacauauucau

SEQ ID NO: 977515 - RNA, 23 nt, Homo sapiens
aaugccagcauaaauccauccau

SEQ ID NO: 977516 - RNA, 13 nt, Homo sapiens
aaugccucuucau

SEQ ID NO: 977517 - RNA, 15 nt, Homo sapiens
aaugcuauuugugua

SEQ ID NO: 977518 - RNA, 16 nt, Homo sapiens
aauggaaacaccacug

SEQ ID NO: 977519 - RNA, 14 nt, Homo sapiens
aauggcacgcuccu

SEQ ID NO: 977520 - RNA, 22 nt, Homo sapiens
aaugggauggucggaucucaca

SEQ ID NO: 977521 - RNA, 17 nt, Homo sapiens
aaugguugaugauacuu

SEQ ID NO: 977522 - RNA, 10 nt, Homo sapiens
aauguacaaa

SEQ ID NO: 977523 - RNA, 15 nt, Homo sapiens
aauguccaccaugaa

SEQ ID NO: 977524 - RNA, 19 nt, Homo sapiens
aaugucucacuuuacuuuc

SEQ ID NO: 977525 - RNA, 23 nt, Homo sapiens
aauguggaaggaaaauauuucau

SEQ ID NO: 977526 - RNA, 17 nt, Homo sapiens
aauguggccaagccuau

SEQ ID NO: 977527 - RNA, 16 nt, Homo sapiens
aauguuaaagggauau

SEQ ID NO: 977528 - RNA, 18 nt, Homo sapiens
aauguuuagcagauuuaa

SEQ ID NO: 977529 - RNA, 19 nt, Homo sapiens
aauguuuuccccaaaccau

SEQ ID NO: 977530 - RNA, 16 nt, Homo sapiens
aauuaaacuuccaaag

SEQ ID NO: 977531 - RNA, 22 nt, Homo sapiens
aauuaaauuuuagaucuuucaa

SEQ ID NO: 977532 - RNA, 21 nt, Homo sapiens
aauuaagcagaaagucuucau

SEQ ID NO: 977533 - RNA, 14 nt, Homo sapiens
aauuaccaguuuuc

SEQ ID NO: 977534 - RNA, 17 nt, Homo sapiens
aauuacuaauuguaaaa

SEQ ID NO: 977535 - RNA, 19 nt, Homo sapiens
aauuacuuauuguauuuau

SEQ ID NO: 977536 - RNA, 18 nt, Homo sapiens
aauuagaauauccaugac

SEQ ID NO: 977537 - RNA, 16 nt, Homo sapiens
aauuauauauacuaua

SEQ ID NO: 977538 - RNA, 17 nt, Homo sapiens
aauuauauauacuauau

SEQ ID NO: 977539 - RNA, 15 nt, Homo sapiens
aauuauugacacuga

SEQ ID NO: 977540 - RNA, 16 nt, Homo sapiens
aauuauugacacugaa

SEQ ID NO: 977541 - RNA, 19 nt, Homo sapiens
aauucaaaaagaacuaaau

SEQ ID NO: 977542 - RNA, 15 nt, Homo sapiens
aauucaagugacaca

SEQ ID NO: 977543 - RNA, 16 nt, Homo sapiens
aauucaccgugaaaua

SEQ ID NO: 977544 - RNA, 12 nt, Homo sapiens
aauucagcucuu

SEQ ID NO: 977545 - RNA, 14 nt, Homo sapiens
aauuccagugccag

SEQ ID NO: 977546 - RNA, 15 nt, Homo sapiens
aauuccagugccagg

SEQ ID NO: 977547 - RNA, 15 nt, Homo sapiens
aauucccaagcuuuu

SEQ ID NO: 977548 - RNA, 14 nt, Homo sapiens
aauuccuaucucau

SEQ ID NO: 977549 - RNA, 14 nt, Homo sapiens
aauuccuggcauga

SEQ ID NO: 977550 - RNA, 19 nt, Homo sapiens
aauucgugauuuucaagca

SEQ ID NO: 977551 - RNA, 15 nt, Homo sapiens
aauucugaacuuuau

SEQ ID NO: 977552 - RNA, 13 nt, Homo sapiens
aauugacugccua

SEQ ID NO: 977553 - RNA, 16 nt, Homo sapiens
aauugcaaaacccaac

SEQ ID NO: 977554 - RNA, 15 nt, Homo sapiens
aauugcauacuuugu

SEQ ID NO: 977555 - RNA, 22 nt, Homo sapiens
aauugccaagaaaaacaacuuu

SEQ ID NO: 977556 - RNA, 16 nt, Homo sapiens
aauuggcaucauucuc

SEQ ID NO: 977557 - RNA, 14 nt, Homo sapiens
aauuggccaugucg

SEQ ID NO: 977558 - RNA, 19 nt, Homo sapiens
aauuguacaaaauuaagca

SEQ ID NO: 977559 - RNA, 20 nt, Homo sapiens
aauuguaucucauuacuuau

SEQ ID NO: 977560 - RNA, 19 nt, Homo sapiens
aauugucgaaaagagucuu

SEQ ID NO: 977561 - RNA, 19 nt, Homo sapiens
aauuuagcagucagauuag

SEQ ID NO: 977562 - RNA, 19 nt, Homo sapiens
aauuuauuuccacuaaaaa

SEQ ID NO: 977563 - RNA, 17 nt, Homo sapiens
aauuucuuaugugacau

SEQ ID NO: 977564 - RNA, 23 nt, Homo sapiens
aauuugagaaccuuggaccacuc

SEQ ID NO: 977565 - RNA, 24 nt, Homo sapiens
aauuuggguugacuccugagcaua

SEQ ID NO: 977566 - RNA, 20 nt, Homo sapiens
aauuuuauaugcuuacugau

SEQ ID NO: 977567 - RNA, 15 nt, Homo sapiens
aauuuuaucaugcca

SEQ ID NO: 977568 - RNA, 19 nt, Homo sapiens
aauuuuugcuaugcuguaa

SEQ ID NO: 977569 - RNA, 12 nt, Homo sapiens
acaaaagucugu

SEQ ID NO: 977570 - RNA, 18 nt, Homo sapiens
acaaaaugauuuugaaga

SEQ ID NO: 977571 - RNA, 13 nt, Homo sapiens
acaaaauuaagca

SEQ ID NO: 977572 - RNA, 14 nt, Homo sapiens
acaaacuccaucca

SEQ ID NO: 977573 - RNA, 20 nt, Homo sapiens
acaaacucucaccaugaugu

SEQ ID NO: 977574 - RNA, 19 nt, Homo sapiens
acaaagcucaaaguaugca

SEQ ID NO: 977575 - RNA, 14 nt, Homo sapiens
acaaaguacauucu

SEQ ID NO: 977576 - RNA, 13 nt, Homo sapiens
acaaauuccacag

SEQ ID NO: 977577 - RNA, 11 nt, Homo sapiens
acaaccugcug

SEQ ID NO: 977578 - RNA, 14 nt, Homo sapiens
acaaccuuccagcu

SEQ ID NO: 977579 - RNA, 15 nt, Homo sapiens
acaaccuuccagcuc

SEQ ID NO: 977580 - RNA, 14 nt, Homo sapiens
acaacugauugcaa

SEQ ID NO: 977581 - RNA, 13 nt, Homo sapiens
acaacugcuccca

SEQ ID NO: 977582 - RNA, 13 nt, Homo sapiens
acaacuuagcuca

SEQ ID NO: 977583 - RNA, 20 nt, Homo sapiens
acaagauuugcugcauuucc

SEQ ID NO: 977584 - RNA, 17 nt, Homo sapiens
acaagccaucaagcacu

SEQ ID NO: 977585 - RNA, 18 nt, Homo sapiens
cuccacucucuaccagau

SEQ ID NO: 977586 - RNA, 22 nt, Homo sapiens
cuccacugcuggacaugagaug

SEQ ID NO: 977587 - RNA, 19 nt, Homo sapiens
cuccacuggccuccuggca

SEQ ID NO: 977588 - RNA, 17 nt, Homo sapiens
cuccaggacaaccugcu

SEQ ID NO: 977589 - RNA, 23 nt, Homo sapiens
cuccagggaauccaagccuccac

SEQ ID NO: 977590 - RNA, 13 nt, Homo sapiens
cuccagugccagc

SEQ ID NO: 977591 - RNA, 12 nt, Homo sapiens
cuccauuuucaa

SEQ ID NO: 977592 - RNA, 15 nt, Homo sapiens
cucccaaaguaccuu

SEQ ID NO: 977593 - RNA, 23 nt, Homo sapiens
cucccacccucuuccuacugguc

SEQ ID NO: 977594 - RNA, 18 nt, Homo sapiens
cucccacuucacugcgaa

SEQ ID NO: 977595 - RNA, 21 nt, Homo sapiens
cucccauccuugaugcaagug

SEQ ID NO: 977596 - RNA, 19 nt, Homo sapiens
cuccccacacagacuccac

SEQ ID NO: 977597 - RNA, 19 nt, Homo sapiens
cucccucccaggacucuga

SEQ ID NO: 977598 - RNA, 16 nt, Homo sapiens
cucccucucaguggag

SEQ ID NO: 977599 - RNA, 19 nt, Homo sapiens
cucccucugcuguguuccc

SEQ ID NO: 977600 - RNA, 22 nt, Homo sapiens
cucccuggagaagcaccagcaa

SEQ ID NO: 977601 - RNA, 14 nt, Homo sapiens
cucccuuugaugau

SEQ ID NO: 977602 - RNA, 13 nt, Homo sapiens
cuccgccauucca

SEQ ID NO: 977603 - RNA, 22 nt, Homo sapiens
cuccuaagcaacuaggccuuca

SEQ ID NO: 977604 - RNA, 12 nt, Homo sapiens
cuccuccaggga

SEQ ID NO: 977605 - RNA, 13 nt, Homo sapiens
cuccuccagggaa

SEQ ID NO: 977606 - RNA, 15 nt, Homo sapiens
cuccuccauucccua

SEQ ID NO: 977607 - RNA, 19 nt, Homo sapiens
cuccucucccauccuugau

SEQ ID NO: 977608 - RNA, 22 nt, Homo sapiens
cuccucuggacggcaggcucac

SEQ ID NO: 977609 - RNA, 20 nt, Homo sapiens
cuccugaaccgcacagcuca

SEQ ID NO: 977610 - RNA, 17 nt, Homo sapiens
cuccuucuccuagcucu

SEQ ID NO: 977611 - RNA, 17 nt, Homo sapiens
cuccuugcuuccugucu

SEQ ID NO: 977612 - RNA, 14 nt, Homo sapiens
cuccuuggugccug

SEQ ID NO: 977613 - RNA, 16 nt, Homo sapiens
cuccuuuaauauacuc

SEQ ID NO: 977614 - RNA, 22 nt, Homo sapiens
cuccuuugcuaaugcuaugcaa

SEQ ID NO: 977615 - RNA, 16 nt, Homo sapiens
cucgcacuacaucuga

SEQ ID NO: 977616 - RNA, 16 nt, Homo sapiens
cucgcccucgccagug

SEQ ID NO: 977617 - RNA, 17 nt, Homo sapiens
cucgccggaucugaggg

SEQ ID NO: 977618 - RNA, 14 nt, Homo sapiens
cucggccuucacaa

SEQ ID NO: 977619 - RNA, 14 nt, Homo sapiens
cucgggguaaaaag

SEQ ID NO: 977620 - RNA, 18 nt, Homo sapiens
cucuaaugagacugacca

SEQ ID NO: 977621 - RNA, 13 nt, Homo sapiens
cucuagaagccaa

SEQ ID NO: 977622 - RNA, 14 nt, Homo sapiens
cucuagaagccaag

SEQ ID NO: 977623 - RNA, 21 nt, Homo sapiens
cucuagaaugagcaagacugg

SEQ ID NO: 977624 - RNA, 21 nt, Homo sapiens
cucuauuuagcaacagaauua

SEQ ID NO: 977625 - RNA, 20 nt, Homo sapiens
cucuauuuuaauuacugcua

SEQ ID NO: 977626 - RNA, 12 nt, Homo sapiens
cucucagccuua

SEQ ID NO: 977627 - RNA, 13 nt, Homo sapiens
cucucccagugaa

SEQ ID NO: 977628 - RNA, 21 nt, Homo sapiens
cucuccccagccuccccgugc

SEQ ID NO: 977629 - RNA, 22 nt, Homo sapiens
cucuccccauccccacccaguc

SEQ ID NO: 977630 - RNA, 13 nt, Homo sapiens
cucucccuaggcu

SEQ ID NO: 977631 - RNA, 21 nt, Homo sapiens
cucucuaccagauaacugagg

SEQ ID NO: 977632 - RNA, 11 nt, Homo sapiens
cucucuagcac

SEQ ID NO: 977633 - RNA, 23 nt, Homo sapiens
cucucugacgcuugugacagugc

SEQ ID NO: 977634 - RNA, 20 nt, Homo sapiens
cucucugaugucccagugcu

SEQ ID NO: 977635 - RNA, 12 nt, Homo sapiens
cucucuucucag

SEQ ID NO: 977636 - RNA, 22 nt, Homo sapiens
cucugaaguuaaaaugauuuac

SEQ ID NO: 977637 - RNA, 17 nt, Homo sapiens
cucugacgcuugugaca

SEQ ID NO: 977638 - RNA, 23 nt, Homo sapiens
cucugaugaaaaauugcugacug

SEQ ID NO: 977639 - RNA, 18 nt, Homo sapiens
cucugcacaugucuugua

SEQ ID NO: 977640 - RNA, 24 nt, Homo sapiens
cucugccuuaaacacacauugcag

SEQ ID NO: 977641 - RNA, 14 nt, Homo sapiens
cucugccuuuauga

SEQ ID NO: 977642 - RNA, 17 nt, Homo sapiens
cucugcuccccugugaa

SEQ ID NO: 977643 - RNA, 19 nt, Homo sapiens
cucugcuugauuuuugccu

SEQ ID NO: 977644 - RNA, 20 nt, Homo sapiens
cucuggaaccuuauuccagc

SEQ ID NO: 977645 - RNA, 16 nt, Homo sapiens
cucuggacaugauuua

SEQ ID NO: 977646 - RNA, 24 nt, Homo sapiens
cucugggugucucccacaugucua

SEQ ID NO: 977647 - RNA, 18 nt, Homo sapiens
cucuguaaguguagcuca

SEQ ID NO: 977648 - RNA, 21 nt, Homo sapiens
cucugucuaggacugcagugu

SEQ ID NO: 977649 - RNA, 20 nt, Homo sapiens
cucuuacguuuaacauacaa

SEQ ID NO: 977650 - RNA, 15 nt, Homo sapiens
cucuuagauucuuaa

SEQ ID NO: 977651 - RNA, 14 nt, Homo sapiens
cucuuagugauuga

SEQ ID NO: 977652 - RNA, 12 nt, Homo sapiens
cucuuaucucag

SEQ ID NO: 977653 - RNA, 11 nt, Homo sapiens
cucuuccucau

SEQ ID NO: 977654 - RNA, 16 nt, Homo sapiens
cucuuccugugaucca

SEQ ID NO: 977655 - RNA, 23 nt, Homo sapiens
cucuucuggggcaggcugggcca

SEQ ID NO: 977656 - RNA, 18 nt, Homo sapiens
cucuuuagagaaguccaa

SEQ ID NO: 977657 - RNA, 18 nt, Homo sapiens
cucuuuccuccugcuuca

SEQ ID NO: 977658 - RNA, 19 nt, Homo sapiens
cugaaaagaugguaucaua

SEQ ID NO: 977659 - RNA, 19 nt, Homo sapiens
cugaaauaaaaugauaaac

SEQ ID NO: 977660 - RNA, 16 nt, Homo sapiens
agauauauauauacac

SEQ ID NO: 977661 - RNA, 18 nt, Homo sapiens
agauauucagaaguauau

SEQ ID NO: 977662 - RNA, 12 nt, Homo sapiens
agaucacugcca

SEQ ID NO: 977663 - RNA, 17 nt, Homo sapiens
agaucagggacuugaau

SEQ ID NO: 977664 - RNA, 20 nt, Homo sapiens
agaucauccagaaguuccuc

SEQ ID NO: 977665 - RNA, 16 nt, Homo sapiens
agaucuugaauagucu

SEQ ID NO: 977666 - RNA, 18 nt, Homo sapiens
agaucuugaauagucuca

SEQ ID NO: 977667 - RNA, 21 nt, Homo sapiens
agaugaauggucuggcaauau

SEQ ID NO: 977668 - RNA, 23 nt, Homo sapiens
agaugaauggucuggcaauauuc

SEQ ID NO: 977669 - RNA, 15 nt, Homo sapiens
agauggaaaaacuga

SEQ ID NO: 977670 - RNA, 17 nt, Homo sapiens
agauggggcgagccagg

SEQ ID NO: 977671 - RNA, 15 nt, Homo sapiens
agaugguagaacuaa

SEQ ID NO: 977672 - RNA, 22 nt, Homo sapiens
agaugugaauuauugacacuga

SEQ ID NO: 977673 - RNA, 20 nt, Homo sapiens
agaugugagccaccgugccu

SEQ ID NO: 977674 - RNA, 14 nt, Homo sapiens
agaugugagccuug

SEQ ID NO: 977675 - RNA, 15 nt, Homo sapiens
agauguguguucuca

SEQ ID NO: 977676 - RNA, 16 nt, Homo sapiens
agauguguguucucag

SEQ ID NO: 977677 - RNA, 16 nt, Homo sapiens
agauuauaaacugacu

SEQ ID NO: 977678 - RNA, 14 nt, Homo sapiens
agauuauaugaagu

SEQ ID NO: 977679 - RNA, 17 nt, Homo sapiens
agauuauucauaaugug

SEQ ID NO: 977680 - RNA, 22 nt, Homo sapiens
agauucaaggccccgagcuguu

SEQ ID NO: 977681 - RNA, 19 nt, Homo sapiens
agauucagggaaaguggga

SEQ ID NO: 977682 - RNA, 18 nt, Homo sapiens
agauuccccugugucauc

SEQ ID NO: 977683 - RNA, 14 nt, Homo sapiens
agauuuaagaauac

SEQ ID NO: 977684 - RNA, 22 nt, Homo sapiens
agauuuuacagagcgcaccuca

SEQ ID NO: 977685 - RNA, 19 nt, Homo sapiens
agauuuuagaauucuuucc

SEQ ID NO: 977686 - RNA, 16 nt, Homo sapiens
agcaaauguugggaaa

SEQ ID NO: 977687 - RNA, 19 nt, Homo sapiens
agcaaggcuuugguuucca

SEQ ID NO: 977688 - RNA, 13 nt, Homo sapiens
agcaaguguucac

SEQ ID NO: 977689 - RNA, 19 nt, Homo sapiens
agcaaucaagguuauaauu

SEQ ID NO: 977690 - RNA, 14 nt, Homo sapiens
agcaaugccugagc

SEQ ID NO: 977691 - RNA, 18 nt, Homo sapiens
agcacaauuugcacuaaa

SEQ ID NO: 977692 - RNA, 12 nt, Homo sapiens
agcacacuuuuu

SEQ ID NO: 977693 - RNA, 18 nt, Homo sapiens
agcacagagcaguggcca

SEQ ID NO: 977694 - RNA, 21 nt, Homo sapiens
agcacagauguucccccaucu

SEQ ID NO: 977695 - RNA, 22 nt, Homo sapiens
agcacccucuggauucugaauc

SEQ ID NO: 977696 - RNA, 21 nt, Homo sapiens
agcacggacugucaguucucu

SEQ ID NO: 977697 - RNA, 19 nt, Homo sapiens
agcacuccgcaucaccuca

SEQ ID NO: 977698 - RNA, 17 nt, Homo sapiens
agcacuccuaccuuaau

SEQ ID NO: 977699 - RNA, 11 nt, Homo sapiens
agcacugagca

SEQ ID NO: 977700 - RNA, 15 nt, Homo sapiens
agcacuuugccaugc

SEQ ID NO: 977701 - RNA, 14 nt, Homo sapiens
agcagcagcuugua

SEQ ID NO: 977702 - RNA, 15 nt, Homo sapiens
agcagcucugugacu

SEQ ID NO: 977703 - RNA, 17 nt, Homo sapiens
agcagcucuucagcaca

SEQ ID NO: 977704 - RNA, 13 nt, Homo sapiens
agcagcuggugcu

SEQ ID NO: 977705 - RNA, 23 nt, Homo sapiens
agcaggaauauaugugugccuau

SEQ ID NO: 977706 - RNA, 18 nt, Homo sapiens
agcagguaaggaaagggc

SEQ ID NO: 977707 - RNA, 13 nt, Homo sapiens
agcaguaccaucu

SEQ ID NO: 977708 - RNA, 17 nt, Homo sapiens
agcagucagaguccagu

SEQ ID NO: 977709 - RNA, 15 nt, Homo sapiens
agcagugaaguauaa

SEQ ID NO: 977710 - RNA, 19 nt, Homo sapiens
agcaguuggccaagcagaa

SEQ ID NO: 977711 - RNA, 13 nt, Homo sapiens
agcauauggugcu

SEQ ID NO: 977712 - RNA, 15 nt, Homo sapiens
agcauguguauuucc

SEQ ID NO: 977713 - RNA, 17 nt, Homo sapiens
agcauuuagucuugcca

SEQ ID NO: 977714 - RNA, 14 nt, Homo sapiens
agcauuuucuugaa

SEQ ID NO: 977715 - RNA, 21 nt, Homo sapiens
agcauuuucuugaaccaauaa

SEQ ID NO: 977716 - RNA, 19 nt, Homo sapiens
agccaagggaaaggggugc

SEQ ID NO: 977717 - RNA, 16 nt, Homo sapiens
agccacaaacuccauc

SEQ ID NO: 977718 - RNA, 15 nt, Homo sapiens
agccacgcagugccu

SEQ ID NO: 977719 - RNA, 19 nt, Homo sapiens
agccacuccccuccacucu

SEQ ID NO: 977720 - RNA, 19 nt, Homo sapiens
agccagcucccagccacau

SEQ ID NO: 977721 - RNA, 23 nt, Homo sapiens
agccagcuuggggccaccaaagc

SEQ ID NO: 977722 - RNA, 18 nt, Homo sapiens
agccaggaccacagagcu

SEQ ID NO: 977723 - RNA, 20 nt, Homo sapiens
agccaggaccacagagcucc

SEQ ID NO: 977724 - RNA, 18 nt, Homo sapiens
agccaggaggccugcuag

SEQ ID NO: 977725 - RNA, 15 nt, Homo sapiens
agccaguacagagaa

SEQ ID NO: 977726 - RNA, 18 nt, Homo sapiens
agccauauucacaccuca

SEQ ID NO: 977727 - RNA, 12 nt, Homo sapiens
agccaucaagca

SEQ ID NO: 977728 - RNA, 14 nt, Homo sapiens
agccaugccagcug

SEQ ID NO: 977729 - RNA, 21 nt, Homo sapiens
agccaugucuucucccuggaa

SEQ ID NO: 977730 - RNA, 14 nt, Homo sapiens
agcccaaucugcca

SEQ ID NO: 977731 - RNA, 16 nt, Homo sapiens
agcccaccagacguca

SEQ ID NO: 977732 - RNA, 14 nt, Homo sapiens
acagcauguguauu

SEQ ID NO: 977733 - RNA, 13 nt, Homo sapiens
acagcuaggaaau

SEQ ID NO: 977734 - RNA, 19 nt, Homo sapiens
acagcuggagaaauggcau

SEQ ID NO: 977735 - RNA, 20 nt, Homo sapiens
acagcuugcuucuuugccca

SEQ ID NO: 977736 - RNA, 23 nt, Homo sapiens
acagcuugggaauccugcuaaag

SEQ ID NO: 977737 - RNA, 22 nt, Homo sapiens
acaggaugcccacauacugucu

SEQ ID NO: 977738 - RNA, 22 nt, Homo sapiens
acaggcagauguuugccucaua

SEQ ID NO: 977739 - RNA, 16 nt, Homo sapiens
acagguaaaacagggc

SEQ ID NO: 977740 - RNA, 18 nt, Homo sapiens
acaguaccggauucucuc

SEQ ID NO: 977741 - RNA, 20 nt, Homo sapiens
acaguagaacugucugugaa

SEQ ID NO: 977742 - RNA, 13 nt, Homo sapiens
acaguagagccag

SEQ ID NO: 977743 - RNA, 14 nt, Homo sapiens
acagucaccucaca

SEQ ID NO: 977744 - RNA, 16 nt, Homo sapiens
acagugccuauugaua

SEQ ID NO: 977745 - RNA, 23 nt, Homo sapiens
acaguuuugcuuuaguacaauag

SEQ ID NO: 977746 - RNA, 16 nt, Homo sapiens
acauaggaagggaucu

SEQ ID NO: 977747 - RNA, 16 nt, Homo sapiens
acaucuuaauccugaa

SEQ ID NO: 977748 - RNA, 16 nt, Homo sapiens
acaucuuguaacuuaa

SEQ ID NO: 977749 - RNA, 18 nt, Homo sapiens
acaucuuuucuaaucaca

SEQ ID NO: 977750 - RNA, 16 nt, Homo sapiens
acaugaaucaagcaau

SEQ ID NO: 977751 - RNA, 21 nt, Homo sapiens
acaugaaucaagcaauccagc

SEQ ID NO: 977752 - RNA, 21 nt, Homo sapiens
acaugaggcaguuccuuccag

SEQ ID NO: 977753 - RNA, 13 nt, Homo sapiens
acaugcaccuacc

SEQ ID NO: 977754 - RNA, 21 nt, Homo sapiens
acaugcugaaaaauauagccu

SEQ ID NO: 977755 - RNA, 21 nt, Homo sapiens
acaugcuggugaacguguccu

SEQ ID NO: 977756 - RNA, 21 nt, Homo sapiens
acauggccuaugcacauaugg

SEQ ID NO: 977757 - RNA, 16 nt, Homo sapiens
acauggcgcccugccu

SEQ ID NO: 977758 - RNA, 22 nt, Homo sapiens
acauggcuguuaacccacugca

SEQ ID NO: 977759 - RNA, 20 nt, Homo sapiens
acauggugaaaccccgucuc

SEQ ID NO: 977760 - RNA, 18 nt, Homo sapiens
acauggugaaacccuguc

SEQ ID NO: 977761 - RNA, 19 nt, Homo sapiens
acaugucuuguacaugugu

SEQ ID NO: 977762 - RNA, 19 nt, Homo sapiens
acauguguagccugugcau

SEQ ID NO: 977763 - RNA, 10 nt, Homo sapiens
acauguuaau

SEQ ID NO: 977764 - RNA, 17 nt, Homo sapiens
acauuaaggaauuugau

SEQ ID NO: 977765 - RNA, 15 nt, Homo sapiens
acauuauuagcacuu

SEQ ID NO: 977766 - RNA, 13 nt, Homo sapiens
acauucacuucca

SEQ ID NO: 977767 - RNA, 14 nt, Homo sapiens
acauucauguucua

SEQ ID NO: 977768 - RNA, 22 nt, Homo sapiens
acauucauguucuagucugcuu

SEQ ID NO: 977769 - RNA, 23 nt, Homo sapiens
acauucuuggucacaaagcuauu

SEQ ID NO: 977770 - RNA, 12 nt, Homo sapiens
acauugagauca

SEQ ID NO: 977771 - RNA, 24 nt, Homo sapiens
acauuuuacuacaguaaauggcag

SEQ ID NO: 977772 - RNA, 16 nt, Homo sapiens
acauuuuaucauuaaa

SEQ ID NO: 977773 - RNA, 20 nt, Homo sapiens
acauuuuccugagaccucaa

SEQ ID NO: 977774 - RNA, 21 nt, Homo sapiens
accaaaaacaaaaaccaaaug

SEQ ID NO: 977775 - RNA, 16 nt, Homo sapiens
accaaacacucagucc

SEQ ID NO: 977776 - RNA, 16 nt, Homo sapiens
accaaagagggcuucc

SEQ ID NO: 977777 - RNA, 13 nt, Homo sapiens
accaaagcugccc

SEQ ID NO: 977778 - RNA, 15 nt, Homo sapiens
accaaagcugcccac

SEQ ID NO: 977779 - RNA, 18 nt, Homo sapiens
accaaagcugcccacugu

SEQ ID NO: 977780 - RNA, 13 nt, Homo sapiens
accaacaauguga

SEQ ID NO: 977781 - RNA, 17 nt, Homo sapiens
accaagaacauaagaau

SEQ ID NO: 977782 - RNA, 18 nt, Homo sapiens
accaagaacauaagaauu

SEQ ID NO: 977783 - RNA, 16 nt, Homo sapiens
accaagacugagccag

SEQ ID NO: 977784 - RNA, 21 nt, Homo sapiens
accaaggacugagcacccucu

SEQ ID NO: 977785 - RNA, 18 nt, Homo sapiens
accaaguaucacacuuua

SEQ ID NO: 977786 - RNA, 17 nt, Homo sapiens
accaauccauuacagcu

SEQ ID NO: 977787 - RNA, 14 nt, Homo sapiens
accacacuucuuga

SEQ ID NO: 977788 - RNA, 17 nt, Homo sapiens
accacauugagaucacu

SEQ ID NO: 977789 - RNA, 22 nt, Homo sapiens
accacauugagaucacuacuca

SEQ ID NO: 977790 - RNA, 23 nt, Homo sapiens
accacuagaaagugggcuuaaug

SEQ ID NO: 977791 - RNA, 13 nt, Homo sapiens
accacugucucca

SEQ ID NO: 977792 - RNA, 14 nt, Homo sapiens
accagaacccagug

SEQ ID NO: 977793 - RNA, 16 nt, Homo sapiens
accagauaacugagga

SEQ ID NO: 977794 - RNA, 14 nt, Homo sapiens
accagauugcucug

SEQ ID NO: 977795 - RNA, 14 nt, Homo sapiens
accaggacagcagc

SEQ ID NO: 977796 - RNA, 14 nt, Homo sapiens
accaggccgugccu

SEQ ID NO: 977797 - RNA, 17 nt, Homo sapiens
accagggcccugggcag

SEQ ID NO: 977798 - RNA, 15 nt, Homo sapiens
accaguacugggaag

SEQ ID NO: 977799 - RNA, 20 nt, Homo sapiens
accaucaauuuuaguuguca

SEQ ID NO: 977800 - RNA, 21 nt, Homo sapiens
accauccaccuucccuucuac

SEQ ID NO: 977801 - RNA, 17 nt, Homo sapiens
accaucuucuauucaaa

SEQ ID NO: 977802 - RNA, 14 nt, Homo sapiens
accaugacccuaca

SEQ ID NO: 977803 - RNA, 13 nt, Homo sapiens
accauuaccaaaa

SEQ ID NO: 977804 - RNA, 16 nt, Homo sapiens
acugagacuuaaggga

SEQ ID NO: 977805 - RNA, 19 nt, Homo sapiens
acugaggcagcgaccucaa

SEQ ID NO: 977806 - RNA, 20 nt, Homo sapiens
acugccacacucuccaucac

SEQ ID NO: 977807 - RNA, 22 nt, Homo sapiens
acugcccacaugggaccuggcc

SEQ ID NO: 977808 - RNA, 21 nt, Homo sapiens
acugccccacggagacagagg

SEQ ID NO: 977809 - RNA, 15 nt, Homo sapiens
acugccuaugccaag

SEQ ID NO: 977810 - RNA, 13 nt, Homo sapiens
acugcgacuguga

SEQ ID NO: 977811 - RNA, 13 nt, Homo sapiens
acuggcagcaucu

SEQ ID NO: 977812 - RNA, 19 nt, Homo sapiens
acuggccccuacuuugugg

SEQ ID NO: 977813 - RNA, 17 nt, Homo sapiens
acuggucuccuugcuuc

SEQ ID NO: 977814 - RNA, 16 nt, Homo sapiens
acuguaaacuucugca

SEQ ID NO: 977815 - RNA, 14 nt, Homo sapiens
acuguaagggauug

SEQ ID NO: 977816 - RNA, 14 nt, Homo sapiens
acuguagcuuuuag

SEQ ID NO: 977817 - RNA, 21 nt, Homo sapiens
acugucuccacccaccuugac

SEQ ID NO: 977818 - RNA, 14 nt, Homo sapiens
acugucuuccucaa

SEQ ID NO: 977819 - RNA, 21 nt, Homo sapiens
acugucuuucagauacauggu

SEQ ID NO: 977820 - RNA, 16 nt, Homo sapiens
acugugaagaucucac

SEQ ID NO: 977821 - RNA, 17 nt, Homo sapiens
acugugaagaucucacu

SEQ ID NO: 977822 - RNA, 14 nt, Homo sapiens
acugugccacaaug

SEQ ID NO: 977823 - RNA, 21 nt, Homo sapiens
acuguggcuagugacaaauaa

SEQ ID NO: 977824 - RNA, 18 nt, Homo sapiens
acuguguacauaacugaa

SEQ ID NO: 977825 - RNA, 13 nt, Homo sapiens
acugugugccagg

SEQ ID NO: 977826 - RNA, 19 nt, Homo sapiens
acuguuugauauaccaaau

SEQ ID NO: 977827 - RNA, 16 nt, Homo sapiens
acuguuugauuuggau

SEQ ID NO: 977828 - RNA, 17 nt, Homo sapiens
acuuaaagcuacuguag

SEQ ID NO: 977829 - RNA, 20 nt, Homo sapiens
acuuaaguuuuagaaaugag

SEQ ID NO: 977830 - RNA, 18 nt, Homo sapiens
acuuaauugccagcaaau

SEQ ID NO: 977831 - RNA, 22 nt, Homo sapiens
acuuaccacucgugcaucccug

SEQ ID NO: 977832 - RNA, 22 nt, Homo sapiens
acuuagcucaggugccuuacau

SEQ ID NO: 977833 - RNA, 19 nt, Homo sapiens
acuuaucacgccuacuuaa

SEQ ID NO: 977834 - RNA, 20 nt, Homo sapiens
acuuaucacgccuacuuaag

SEQ ID NO: 977835 - RNA, 15 nt, Homo sapiens
acuuauuaacuaaga

SEQ ID NO: 977836 - RNA, 21 nt, Homo sapiens
acuuauuauuaauaaugaagu

SEQ ID NO: 977837 - RNA, 17 nt, Homo sapiens
acuuauuggaacucugc

SEQ ID NO: 977838 - RNA, 14 nt, Homo sapiens
acuucaaauagcaa

SEQ ID NO: 977839 - RNA, 19 nt, Homo sapiens
acuucaagagccucuggca

SEQ ID NO: 977840 - RNA, 21 nt, Homo sapiens
acuucccuuaggauaacagcc

SEQ ID NO: 977841 - RNA, 13 nt, Homo sapiens
acuugcuguccag

SEQ ID NO: 977842 - RNA, 21 nt, Homo sapiens
acuuggcuggggaggaccagg

SEQ ID NO: 977843 - RNA, 23 nt, Homo sapiens
acuuggggagauggaguucuugu

SEQ ID NO: 977844 - RNA, 15 nt, Homo sapiens
acuuuaaauacuauu

SEQ ID NO: 977845 - RNA, 18 nt, Homo sapiens
acuuuaguagacauuuau

SEQ ID NO: 977846 - RNA, 15 nt, Homo sapiens
acuuuaucauaugcu

SEQ ID NO: 977847 - RNA, 16 nt, Homo sapiens
cugcaccuuugcacgu

SEQ ID NO: 977848 - RNA, 18 nt, Homo sapiens
cugcacggggcauuccug

SEQ ID NO: 977849 - RNA, 22 nt, Homo sapiens
cugcacggggcauuccugcuuc

SEQ ID NO: 977850 - RNA, 16 nt, Homo sapiens
cugcacggugggagac

SEQ ID NO: 977851 - RNA, 21 nt, Homo sapiens
cugcacggugggagaccugcu

SEQ ID NO: 977852 - RNA, 20 nt, Homo sapiens
cugcagcucuccaccagcug

SEQ ID NO: 977853 - RNA, 15 nt, Homo sapiens
cugcaguccuacuca

SEQ ID NO: 977854 - RNA, 16 nt, Homo sapiens
cugcaucauccuugca

SEQ ID NO: 977855 - RNA, 18 nt, Homo sapiens
cugcauggugacagucuc

SEQ ID NO: 977856 - RNA, 15 nt, Homo sapiens
cugcauuuccucgca

SEQ ID NO: 977857 - RNA, 17 nt, Homo sapiens
cugccacacucuccauc

SEQ ID NO: 977858 - RNA, 19 nt, Homo sapiens
cugccacacugauggcuca

SEQ ID NO: 977859 - RNA, 20 nt, Homo sapiens
cugccaggcuguuucagcca

SEQ ID NO: 977860 - RNA, 21 nt, Homo sapiens
cugccaguugucuuaugugaa

SEQ ID NO: 977861 - RNA, 22 nt, Homo sapiens
cugccauucacuucauaaucca

SEQ ID NO: 977862 - RNA, 17 nt, Homo sapiens
cugcccacgcagaggac

SEQ ID NO: 977863 - RNA, 15 nt, Homo sapiens
cugccccacccucaa

SEQ ID NO: 977864 - RNA, 22 nt, Homo sapiens
cugccccacggagacagaggaa

SEQ ID NO: 977865 - RNA, 19 nt, Homo sapiens
cugccgggcugagggccug

SEQ ID NO: 977866 - RNA, 16 nt, Homo sapiens
cugccucuggucccag

SEQ ID NO: 977867 - RNA, 20 nt, Homo sapiens
cugccuggcccccaaccuca

SEQ ID NO: 977868 - RNA, 16 nt, Homo sapiens
cugccugguauaucca

SEQ ID NO: 977869 - RNA, 20 nt, Homo sapiens
cugccugugugggacugaga

SEQ ID NO: 977870 - RNA, 19 nt, Homo sapiens
cugcgcucucuuugcaacu

SEQ ID NO: 977871 - RNA, 21 nt, Homo sapiens
cugcuaaagaaaggaacuaag

SEQ ID NO: 977872 - RNA, 24 nt, Homo sapiens
cugcuauaugccuuaagccaauau

SEQ ID NO: 977873 - RNA, 17 nt, Homo sapiens
cugcucauuacaguucu

SEQ ID NO: 977874 - RNA, 13 nt, Homo sapiens
cugcucugcuaua

SEQ ID NO: 977875 - RNA, 14 nt, Homo sapiens
cugcucuuguucua

SEQ ID NO: 977876 - RNA, 21 nt, Homo sapiens
cugcugccucuuucccuagga

SEQ ID NO: 977877 - RNA, 21 nt, Homo sapiens
cugcuggggagacaaaucuca

SEQ ID NO: 977878 - RNA, 16 nt, Homo sapiens
cugcuuacuaaugugc

SEQ ID NO: 977879 - RNA, 13 nt, Homo sapiens
cugcuucccuuac

SEQ ID NO: 977880 - RNA, 14 nt, Homo sapiens
cuggaaaaggagcu

SEQ ID NO: 977881 - RNA, 22 nt, Homo sapiens
cuggaaaccacacuucuugaaa

SEQ ID NO: 977882 - RNA, 19 nt, Homo sapiens
cuggaacgcagugguguuu

SEQ ID NO: 977883 - RNA, 23 nt, Homo sapiens
cuggaacgcagugguguuuucag

SEQ ID NO: 977884 - RNA, 14 nt, Homo sapiens
cuggaagaagugag

SEQ ID NO: 977885 - RNA, 19 nt, Homo sapiens
cuggacacccucuucccau

SEQ ID NO: 977886 - RNA, 18 nt, Homo sapiens
cuggagacaaggugcuaa

SEQ ID NO: 977887 - RNA, 23 nt, Homo sapiens
cuggaggaccagauugcucugcc

SEQ ID NO: 977888 - RNA, 17 nt, Homo sapiens
cuggaggugcugcucua

SEQ ID NO: 977889 - RNA, 21 nt, Homo sapiens
cuggagguggaaaauggugcc

SEQ ID NO: 977890 - RNA, 17 nt, Homo sapiens
cuggagguugaagccaa

SEQ ID NO: 977891 - RNA, 20 nt, Homo sapiens
cuggaguacaguggcacgau

SEQ ID NO: 977892 - RNA, 20 nt, Homo sapiens
cuggagucuccugaggacac

SEQ ID NO: 977893 - RNA, 20 nt, Homo sapiens
cuggagugcaguggcgcgau

SEQ ID NO: 977894 - RNA, 21 nt, Homo sapiens
cuggauccagccaugccugag

SEQ ID NO: 977895 - RNA, 13 nt, Homo sapiens
cuggaugucucca

SEQ ID NO: 977896 - RNA, 14 nt, Homo sapiens
cuggcaacaucuuu

SEQ ID NO: 977897 - RNA, 20 nt, Homo sapiens
cuggcagcaucuucacuucu

SEQ ID NO: 977898 - RNA, 22 nt, Homo sapiens
cuggcagguaggucggcacuug

SEQ ID NO: 977899 - RNA, 20 nt, Homo sapiens
cuggccucucuagcacaauu

SEQ ID NO: 977900 - RNA, 20 nt, Homo sapiens
cuggccuuuguaagugcagg

SEQ ID NO: 977901 - RNA, 15 nt, Homo sapiens
cuggcggcugugcau

SEQ ID NO: 977902 - RNA, 16 nt, Homo sapiens
cuggcucaugccucag

SEQ ID NO: 977903 - RNA, 14 nt, Homo sapiens
cugggaggggcaau

SEQ ID NO: 977904 - RNA, 15 nt, Homo sapiens
cugggauuacaggca

SEQ ID NO: 977905 - RNA, 22 nt, Homo sapiens
cugggauuacaggcaugagcca

SEQ ID NO: 977906 - RNA, 10 nt, Homo sapiens
cugggccaug

SEQ ID NO: 977907 - RNA, 14 nt, Homo sapiens
cugggccaugucca

SEQ ID NO: 977908 - RNA, 15 nt, Homo sapiens
cugggccauguccaa

SEQ ID NO: 977909 - RNA, 18 nt, Homo sapiens
cugggccauguccaaaga

SEQ ID NO: 977910 - RNA, 19 nt, Homo sapiens
cugggcuuguuguuuuuaa

SEQ ID NO: 977911 - RNA, 17 nt, Homo sapiens
cuggggaccuggcacug

SEQ ID NO: 977912 - RNA, 19 nt, Homo sapiens
cuggggagacaaaucucag

SEQ ID NO: 977913 - RNA, 19 nt, Homo sapiens
cuggggccuagcgaucucu

SEQ ID NO: 977914 - RNA, 16 nt, Homo sapiens
cuggggucuccgaaga

SEQ ID NO: 977915 - RNA, 19 nt, Homo sapiens
cugggugcuacuggggaaa

SEQ ID NO: 977916 - RNA, 17 nt, Homo sapiens
cuggguuucaugagcuu

SEQ ID NO: 977917 - RNA, 13 nt, Homo sapiens
cuggucuccuugc

SEQ ID NO: 977918 - RNA, 17 nt, Homo sapiens
cuggugcuccaagcaca

SEQ ID NO: 977919 - RNA, 12 nt, Homo sapiens
cugguggagcug

SEQ ID NO: 977920 - RNA, 19 nt, Homo sapiens
cugguguuuuaugggccac

SEQ ID NO: 977921 - RNA, 14 nt, Homo sapiens
cccuggagugcagu

SEQ ID NO: 977922 - RNA, 17 nt, Homo sapiens
cccuggccucacgccca

SEQ ID NO: 977923 - RNA, 21 nt, Homo sapiens
ccgacugcuagggaguggucu

SEQ ID NO: 977924 - RNA, 20 nt, Homo sapiens
ccuaaguauaaaugguuguc

SEQ ID NO: 977925 - RNA, 23 nt, Homo sapiens
ccuagcaaggcaugauguuaacc

SEQ ID NO: 977926 - RNA, 20 nt, Homo sapiens
ccuauuuggggcuugcaugc

SEQ ID NO: 977927 - RNA, 22 nt, Homo sapiens
ccucagggaucuugcauuccca

SEQ ID NO: 977928 - RNA, 15 nt, Homo sapiens
ccuccuuuugcuuga

SEQ ID NO: 977929 - RNA, 13 nt, Homo sapiens
ccucuaagccacu

SEQ ID NO: 977930 - RNA, 20 nt, Homo sapiens
ccucugagaauuccaaggag

SEQ ID NO: 977931 - RNA, 14 nt, Homo sapiens
ccucugcagcacuu

SEQ ID NO: 977932 - RNA, 14 nt, Homo sapiens
ccugaaggugccac

SEQ ID NO: 977933 - RNA, 21 nt, Homo sapiens
ccugaugacagagcgagauuc

SEQ ID NO: 977934 - RNA, 12 nt, Homo sapiens
ccugcuucucag

SEQ ID NO: 977935 - RNA, 14 nt, Homo sapiens
ccuggggcauccca

SEQ ID NO: 977936 - RNA, 12 nt, Homo sapiens
ccugugugagca

SEQ ID NO: 977937 - RNA, 17 nt, Homo sapiens
ccugugugagcaucucu

SEQ ID NO: 977938 - RNA, 19 nt, Homo sapiens
ccuucuccugccuacauuc

SEQ ID NO: 977939 - RNA, 22 nt, Homo sapiens
ccuuuccucugcagcacuuuaa

SEQ ID NO: 977940 - RNA, 20 nt, Homo sapiens
cgcaaagggcugaaagccau

SEQ ID NO: 977941 - RNA, 14 nt, Homo sapiens
cgcauauuuaacuc

SEQ ID NO: 977942 - RNA, 18 nt, Homo sapiens
cgcuauagaauaaugcau

SEQ ID NO: 977943 - RNA, 20 nt, Homo sapiens
cggagcaggggucugagcca

SEQ ID NO: 977944 - RNA, 17 nt, Homo sapiens
cggucccacacugguga

SEQ ID NO: 977945 - RNA, 15 nt, Homo sapiens
cgucccaugugcaug

SEQ ID NO: 977946 - RNA, 22 nt, Homo sapiens
cguuaagggaaggaacucuggc

SEQ ID NO: 977947 - RNA, 21 nt, Homo sapiens
cuaagccacucuuccaaaggc

SEQ ID NO: 977948 - RNA, 12 nt, Homo sapiens
cuaagccuccuu

SEQ ID NO: 977949 - RNA, 14 nt, Homo sapiens
cuccaggcucuuug

SEQ ID NO: 977950 - RNA, 21 nt, Homo sapiens
cuccuuaauagccauaugcaa

SEQ ID NO: 977951 - RNA, 18 nt, Homo sapiens
cucuggaaaaugugaccc

SEQ ID NO: 977952 - RNA, 20 nt, Homo sapiens
cucuguguacccacuccuca

SEQ ID NO: 977953 - RNA, 19 nt, Homo sapiens
cugaaggugccacuccagu

SEQ ID NO: 977954 - RNA, 13 nt, Homo sapiens
cugacaagcacug

SEQ ID NO: 977955 - RNA, 13 nt, Homo sapiens
cugaccccaaaga

SEQ ID NO: 977956 - RNA, 14 nt, Homo sapiens
cugaccccaaagag

SEQ ID NO: 977957 - RNA, 16 nt, Homo sapiens
cugagaauuccaagga

SEQ ID NO: 977958 - RNA, 14 nt, Homo sapiens
cugaguggaucucc

SEQ ID NO: 977959 - RNA, 22 nt, Homo sapiens
cugcaccgagagagauggaaua

SEQ ID NO: 977960 - RNA, 24 nt, Homo sapiens
cugcaccgagagagauggaauaaa

SEQ ID NO: 977961 - RNA, 14 nt, Homo sapiens
cugcagaggauuua

SEQ ID NO: 977962 - RNA, 13 nt, Homo sapiens
cugcagcacuuua

SEQ ID NO: 977963 - RNA, 15 nt, Homo sapiens
cugcuugcacuuugu

SEQ ID NO: 977964 - RNA, 22 nt, Homo sapiens
cuggaaaacucaggauucucac

SEQ ID NO: 977965 - RNA, 14 nt, Homo sapiens
cuggaaaaugugac

SEQ ID NO: 977966 - RNA, 23 nt, Homo sapiens
cuggaaggucaauuucaguguau

SEQ ID NO: 977967 - RNA, 21 nt, Homo sapiens
cuggcaaugaaaaauucucag

SEQ ID NO: 977968 - RNA, 19 nt, Homo sapiens
cuggcugaccccaaagagc

SEQ ID NO: 977969 - RNA, 13 nt, Homo sapiens
cugggacuuucac

SEQ ID NO: 977970 - RNA, 17 nt, Homo sapiens
cugggaggcggagagua

SEQ ID NO: 977971 - RNA, 19 nt, Homo sapiens
cugggauucccaccaaggu

SEQ ID NO: 977972 - RNA, 17 nt, Homo sapiens
cuggggaacuagaggga

SEQ ID NO: 977973 - RNA, 21 nt, Homo sapiens
cuguaaucccagcacuuuggg

SEQ ID NO: 977974 - RNA, 13 nt, Homo sapiens
cuguagcucuccu

SEQ ID NO: 977975 - RNA, 21 nt, Homo sapiens
cuguggcuucuaggugcccga

SEQ ID NO: 977976 - RNA, 15 nt, Homo sapiens
cugugugagcaucuc

SEQ ID NO: 977977 - RNA, 18 nt, Homo sapiens
cuuaauagccauaugcaa

SEQ ID NO: 977978 - RNA, 17 nt, Homo sapiens
cuuccccagacucagcu

SEQ ID NO: 977979 - RNA, 14 nt, Homo sapiens
cuuccgugcugaac

SEQ ID NO: 977980 - RNA, 13 nt, Homo sapiens
cuuggacuccucc

SEQ ID NO: 977981 - RNA, 14 nt, Homo sapiens
cuuuccuacucuca

SEQ ID NO: 977982 - RNA, 15 nt, Homo sapiens
cuuucuggaaaagag

SEQ ID NO: 977983 - RNA, 16 nt, Homo sapiens
cuuucuguaaccaaaa

SEQ ID NO: 977984 - RNA, 16 nt, Homo sapiens
cuuuucuaacucuccc

SEQ ID NO: 977985 - RNA, 13 nt, Homo sapiens
gaaaaacuuccau

SEQ ID NO: 977986 - RNA, 16 nt, Homo sapiens
gaaaauagcucuuuca

SEQ ID NO: 977987 - RNA, 15 nt, Homo sapiens
gaaaaugugacccag

SEQ ID NO: 977988 - RNA, 20 nt, Homo sapiens
gaaauaugugguuuccacga

SEQ ID NO: 977989 - RNA, 16 nt, Homo sapiens
gaaauccaguuuccca

SEQ ID NO: 977990 - RNA, 12 nt, Homo sapiens
gaacaucugugu

SEQ ID NO: 977991 - RNA, 17 nt, Homo sapiens
gaagcucacccaauaaa

SEQ ID NO: 977992 - RNA, 12 nt, Homo sapiens
gaaggugccacu

SEQ ID NO: 977993 - RNA, 19 nt, Homo sapiens
gaagguuuguauauuguca

SEQ ID NO: 977994 - RNA, 15 nt, Homo sapiens
gaauaccuucuucgc

SEQ ID NO: 977995 - RNA, 17 nt, Homo sapiens
gaaucgcuuaaaccugg

SEQ ID NO: 977996 - RNA, 14 nt, Homo sapiens
gaauggaaccaaaa

SEQ ID NO: 977997 - RNA, 19 nt, Homo sapiens
gacaaggucgagacauucc

SEQ ID NO: 977998 - RNA, 19 nt, Homo sapiens
gacauggguagcaauucua

SEQ ID NO: 977999 - RNA, 21 nt, Homo sapiens
gaccccaaagagccuggagaa

SEQ ID NO: 978000 - RNA, 23 nt, Homo sapiens
gacugaauauggacccugcugaa

SEQ ID NO: 978001 - RNA, 17 nt, Homo sapiens
gagaagcucacccaaua

SEQ ID NO: 978002 - RNA, 23 nt, Homo sapiens
agaauuccuuuucuaacucuccc

SEQ ID NO: 978003 - RNA, 16 nt, Homo sapiens
agagaccccuuccuuu

SEQ ID NO: 978004 - RNA, 19 nt, Homo sapiens
agagauggaauaaagcccu

SEQ ID NO: 978005 - RNA, 18 nt, Homo sapiens
agagcccagggcauccca

SEQ ID NO: 978006 - RNA, 16 nt, Homo sapiens
agaggauuuaacugug

SEQ ID NO: 978007 - RNA, 17 nt, Homo sapiens
agauuuaacaauuccaa

SEQ ID NO: 978008 - RNA, 21 nt, Homo sapiens
agauuuuuuuuguaacuucaa

SEQ ID NO: 978009 - RNA, 14 nt, Homo sapiens
agcaaagagugggc

SEQ ID NO: 978010 - RNA, 18 nt, Homo sapiens
agcaaucucgcaguacau

SEQ ID NO: 978011 - RNA, 22 nt, Homo sapiens
agcacuuuaacccucucuuccc

SEQ ID NO: 978012 - RNA, 13 nt, Homo sapiens
agcagauuuaaca

SEQ ID NO: 978013 - RNA, 22 nt, Homo sapiens
agcauuacgugagccagguaau

SEQ ID NO: 978014 - RNA, 13 nt, Homo sapiens
agccauaugcaau

SEQ ID NO: 978015 - RNA, 14 nt, Homo sapiens
agccauaugcaaua

SEQ ID NO: 978016 - RNA, 22 nt, Homo sapiens
agccauuuguuggggcaguggu

SEQ ID NO: 978017 - RNA, 18 nt, Homo sapiens
agcccagugugggacuga

SEQ ID NO: 978018 - RNA, 16 nt, Homo sapiens
agcccuuccuagaaga

SEQ ID NO: 978019 - RNA, 18 nt, Homo sapiens
agccuugcucaggugcaa

SEQ ID NO: 978020 - RNA, 14 nt, Homo sapiens
agcgcuuucuggaa

SEQ ID NO: 978021 - RNA, 20 nt, Homo sapiens
agcugaacagccaaaugcau

SEQ ID NO: 978022 - RNA, 12 nt, Homo sapiens
agcugaacccau

SEQ ID NO: 978023 - RNA, 14 nt, Homo sapiens
agcuggaagcacau

SEQ ID NO: 978024 - RNA, 22 nt, Homo sapiens
aggcauaagacccuaagccucc

SEQ ID NO: 978025 - RNA, 14 nt, Homo sapiens
agggaaagccagaa

SEQ ID NO: 978026 - RNA, 17 nt, Homo sapiens
agggcagcuguggcuuc

SEQ ID NO: 978027 - RNA, 22 nt, Homo sapiens
aggggugggagagccagcucuc

SEQ ID NO: 978028 - RNA, 17 nt, Homo sapiens
aggucgagacauuccug

SEQ ID NO: 978029 - RNA, 18 nt, Homo sapiens
aggucgagacauuccugc

SEQ ID NO: 978030 - RNA, 21 nt, Homo sapiens
aggugucugcacccaggggug

SEQ ID NO: 978031 - RNA, 17 nt, Homo sapiens
aggugucuuaagccuuu

SEQ ID NO: 978032 - RNA, 22 nt, Homo sapiens
agucaaaacagagaugugauaa

SEQ ID NO: 978033 - RNA, 20 nt, Homo sapiens
agugaucucccugaacauuu

SEQ ID NO: 978034 - RNA, 12 nt, Homo sapiens
agugccaggacu

SEQ ID NO: 978035 - RNA, 22 nt, Homo sapiens
aguuuacagaauggaaccaaaa

SEQ ID NO: 978036 - RNA, 14 nt, Homo sapiens
auaaagcccuugaa

SEQ ID NO: 978037 - RNA, 21 nt, Homo sapiens
auaacuuaaaaaaaugacaga

SEQ ID NO: 978038 - RNA, 20 nt, Homo sapiens
auacacagaugauaauaugc

SEQ ID NO: 978039 - RNA, 19 nt, Homo sapiens
auacaucacagcagugcau

SEQ ID NO: 978040 - RNA, 16 nt, Homo sapiens
auagccauaugcaaua

SEQ ID NO: 978041 - RNA, 22 nt, Homo sapiens
auaggcuggagaagcucaccca

SEQ ID NO: 978042 - RNA, 22 nt, Homo sapiens
auauauuuauuuaagcuuaugu

SEQ ID NO: 978043 - RNA, 13 nt, Homo sapiens
auaucaagauguu

SEQ ID NO: 978044 - RNA, 15 nt, Homo sapiens
auaucaagauguuaa

SEQ ID NO: 978045 - RNA, 21 nt, Homo sapiens
aucacaguguuugcaauggug

SEQ ID NO: 978046 - RNA, 21 nt, Homo sapiens
aucaggcuauguauggaauac

SEQ ID NO: 978047 - RNA, 19 nt, Homo sapiens
aucccaugggggugcugca

SEQ ID NO: 978048 - RNA, 21 nt, Homo sapiens
auccuggccaacauggugaaa

SEQ ID NO: 978049 - RNA, 12 nt, Homo sapiens
aucuccaaggac

SEQ ID NO: 978050 - RNA, 16 nt, Homo sapiens
augcaaaagucuuccu

SEQ ID NO: 978051 - RNA, 13 nt, Homo sapiens
augccagagccug

SEQ ID NO: 978052 - RNA, 16 nt, Homo sapiens
auggaauaaagcccuu

SEQ ID NO: 978053 - RNA, 22 nt, Homo sapiens
auguccaauggaguucagagau

SEQ ID NO: 978054 - RNA, 13 nt, Homo sapiens
auguuugucagau

SEQ ID NO: 978055 - RNA, 12 nt, Homo sapiens
auuauaacuuaa

SEQ ID NO: 978056 - RNA, 16 nt, Homo sapiens
auuauagccacauccc

SEQ ID NO: 978057 - RNA, 20 nt, Homo sapiens
auuaucuuuaauaaaauguu

SEQ ID NO: 978058 - RNA, 14 nt, Homo sapiens
auucccaccaaggu

SEQ ID NO: 978059 - RNA, 18 nt, Homo sapiens
auuccugcgcauggugca

SEQ ID NO: 978060 - RNA, 19 nt, Homo sapiens
auucuuguauauuauggaa

SEQ ID NO: 978061 - RNA, 17 nt, Homo sapiens
auuuaauggcaaugcaa

SEQ ID NO: 978062 - RNA, 17 nt, Homo sapiens
caagagcuggcaaaggu

SEQ ID NO: 978063 - RNA, 20 nt, Homo sapiens
caagaucgcgccacugcacu

SEQ ID NO: 978064 - RNA, 14 nt, Homo sapiens
caagcaaggccaaa

SEQ ID NO: 978065 - RNA, 18 nt, Homo sapiens
caagguggggggaucaca

SEQ ID NO: 978066 - RNA, 20 nt, Homo sapiens
caauuccaaaggaaucucca

SEQ ID NO: 978067 - RNA, 18 nt, Homo sapiens
cacccgccgccuccugca

SEQ ID NO: 978068 - RNA, 22 nt, Homo sapiens
cacgccuguaaucccagcacuu

SEQ ID NO: 978069 - RNA, 14 nt, Homo sapiens
cacuggaggucaca

SEQ ID NO: 978070 - RNA, 17 nt, Homo sapiens
cagagaaagaagagaca

SEQ ID NO: 978071 - RNA, 18 nt, Homo sapiens
cagagguaaaagugugag

SEQ ID NO: 978072 - RNA, 19 nt, Homo sapiens
cagauccucacaaccaccu

SEQ ID NO: 978073 - RNA, 17 nt, Homo sapiens
cagauggaaagaaagca

SEQ ID NO: 978074 - RNA, 15 nt, Homo sapiens
cagccucgcaugcca

SEQ ID NO: 978075 - RNA, 19 nt, Homo sapiens
cagcuagggcuggacucug

SEQ ID NO: 978076 - RNA, 20 nt, Homo sapiens
cagcuccagaauaccuucuu

SEQ ID NO: 978077 - RNA, 16 nt, Homo sapiens
cagcuguggcuucuag

SEQ ID NO: 978078 - RNA, 22 nt, Homo sapiens
caggauccuauucucaccagga

SEQ ID NO: 978079 - RNA, 22 nt, Homo sapiens
cagggaacccugcuugcacuuu

SEQ ID NO: 978080 - RNA, 19 nt, Homo sapiens
cagggagaccgagcgcuuu

SEQ ID NO: 978081 - RNA, 12 nt, Homo sapiens
aaaaacuuccau

SEQ ID NO: 978082 - RNA, 13 nt, Homo sapiens
aaaaguuacuuau

SEQ ID NO: 978083 - RNA, 11 nt, Homo sapiens
aaaccaaagau

SEQ ID NO: 978084 - RNA, 17 nt, Homo sapiens
aaagacugauuaccucc

SEQ ID NO: 978085 - RNA, 15 nt, Homo sapiens
aaagauggaugugcu

SEQ ID NO: 978086 - RNA, 19 nt, Homo sapiens
aaagauguuugucagauau

SEQ ID NO: 978087 - RNA, 22 nt, Homo sapiens
aaagcaauuauauuguccuccc

SEQ ID NO: 978088 - RNA, 14 nt, Homo sapiens
aaagcccuugaacc

SEQ ID NO: 978089 - RNA, 14 nt, Homo sapiens
aaagccucuggaaa

SEQ ID NO: 978090 - RNA, 22 nt, Homo sapiens
aaaggcauaagacccuaagccu

SEQ ID NO: 978091 - RNA, 15 nt, Homo sapiens
aaauccaguuuccca

SEQ ID NO: 978092 - RNA, 17 nt, Homo sapiens
aaauuagcugugugaaa

SEQ ID NO: 978093 - RNA, 20 nt, Homo sapiens
aacaacaaagccaacaguca

SEQ ID NO: 978094 - RNA, 21 nt, Homo sapiens
aacgacgguuucaaaccagga

SEQ ID NO: 978095 - RNA, 17 nt, Homo sapiens
aacuaauaaaagcauaa

SEQ ID NO: 978096 - RNA, 22 nt, Homo sapiens
aacuaauaaaagcauaaaugca

SEQ ID NO: 978097 - RNA, 19 nt, Homo sapiens
aacuccuuuagcagguggu

SEQ ID NO: 978098 - RNA, 17 nt, Homo sapiens
aacuuaaaaaaaugaca

SEQ ID NO: 978099 - RNA, 21 nt, Homo sapiens
aagaaucagaaacaggugcau

SEQ ID NO: 978100 - RNA, 11 nt, Homo sapiens
aagaccaaaaa

SEQ ID NO: 978101 - RNA, 22 nt, Homo sapiens
aagaccauaacagccaacaggu

SEQ ID NO: 978102 - RNA, 21 nt, Homo sapiens
aagaguucuuaaggauuguga

SEQ ID NO: 978103 - RNA, 22 nt, Homo sapiens
aagcaucccgcuggugccuccc

SEQ ID NO: 978104 - RNA, 15 nt, Homo sapiens
aagccacucuuccaa

SEQ ID NO: 978105 - RNA, 12 nt, Homo sapiens
aagcccuugaac

SEQ ID NO: 978106 - RNA, 22 nt, Homo sapiens
aagccucuggaaaacucaggau

SEQ ID NO: 978107 - RNA, 22 nt, Homo sapiens
aaggaaacuugaaucaaagcag

SEQ ID NO: 978108 - RNA, 13 nt, Homo sapiens
aaggaccagguua

SEQ ID NO: 978109 - RNA, 14 nt, Homo sapiens
aaggauugugauau

SEQ ID NO: 978110 - RNA, 15 nt, Homo sapiens
aaggucuucagccau

SEQ ID NO: 978111 - RNA, 16 nt, Homo sapiens
aaggugaagagaccaa

SEQ ID NO: 978112 - RNA, 23 nt, Homo sapiens
aauagaucaaaguccagcaggca

SEQ ID NO: 978113 - RNA, 14 nt, Homo sapiens
aauagcucuuucag

SEQ ID NO: 978114 - RNA, 16 nt, Homo sapiens
aauauauuucuugcua

SEQ ID NO: 978115 - RNA, 18 nt, Homo sapiens
gaaagaaagcaccuguuu

SEQ ID NO: 978116 - RNA, 15 nt, Homo sapiens
gaaagccucuggaaa

SEQ ID NO: 978117 - RNA, 19 nt, Homo sapiens
gaacccugcuugcacuuug

SEQ ID NO: 978118 - RNA, 17 nt, Homo sapiens
gaacugcgugccagugu

SEQ ID NO: 978119 - RNA, 16 nt, Homo sapiens
gaagaaggaaacaccg

SEQ ID NO: 978120 - RNA, 13 nt, Homo sapiens
gaagcucacccaa

SEQ ID NO: 978121 - RNA, 20 nt, Homo sapiens
gaaggaacucuggcuuccag

SEQ ID NO: 978122 - RNA, 15 nt, Homo sapiens
gaagggaaagccaga

SEQ ID NO: 978123 - RNA, 19 nt, Homo sapiens
gaauaaagcccuugaacca

SEQ ID NO: 978124 - RNA, 21 nt, Homo sapiens
gaauaaagcccuugaaccagc

SEQ ID NO: 978125 - RNA, 20 nt, Homo sapiens
gaauauauuauaaucuucca

SEQ ID NO: 978126 - RNA, 21 nt, Homo sapiens
gaauauauuauaaucuuccau

SEQ ID NO: 978127 - RNA, 17 nt, Homo sapiens
gaaugccucaaugugac

SEQ ID NO: 978128 - RNA, 15 nt, Homo sapiens
gaaugguccaggguu

SEQ ID NO: 978129 - RNA, 13 nt, Homo sapiens
gacaaaccagagc

SEQ ID NO: 978130 - RNA, 21 nt, Homo sapiens
gacaaaccagagcagagagca

SEQ ID NO: 978131 - RNA, 19 nt, Homo sapiens
gacaaaguugaauguaaag

SEQ ID NO: 978132 - RNA, 23 nt, Homo sapiens
gacauggguagcaauucuaccca

SEQ ID NO: 978133 - RNA, 19 nt, Homo sapiens
gaccugacaagcacugcua

SEQ ID NO: 978134 - RNA, 18 nt, Homo sapiens
gaccuugaaggguaaaga

SEQ ID NO: 978135 - RNA, 21 nt, Homo sapiens
gacgguuucaaaccaggauuu

SEQ ID NO: 978136 - RNA, 17 nt, Homo sapiens
gacugauguuacaucac

SEQ ID NO: 978137 - RNA, 15 nt, Homo sapiens
gacuggaaccaggga

SEQ ID NO: 978138 - RNA, 21 nt, Homo sapiens
gagagaacaacuacugugauc

SEQ ID NO: 978139 - RNA, 17 nt, Homo sapiens
gagauggaauaaagccc

SEQ ID NO: 978140 - RNA, 18 nt, Homo sapiens
gagcacccccucauuccc

SEQ ID NO: 978141 - RNA, 14 nt, Homo sapiens
gagcaucucugugu

SEQ ID NO: 978142 - RNA, 20 nt, Homo sapiens
gaggccugcccucagggauc

SEQ ID NO: 978143 - RNA, 16 nt, Homo sapiens
gaggugucuuaagccu

SEQ ID NO: 978144 - RNA, 22 nt, Homo sapiens
gagugacggucccacacuggug

SEQ ID NO: 978145 - RNA, 18 nt, Homo sapiens
gagugacucgaggguugg

SEQ ID NO: 978146 - RNA, 21 nt, Homo sapiens
gaguguguuugugugcaugaa

SEQ ID NO: 978147 - RNA, 23 nt, Homo sapiens
gaguuccaugaagaccacaucca

SEQ ID NO: 978148 - RNA, 23 nt, Homo sapiens
gaguuugaaggaggugagggaug

SEQ ID NO: 978149 - RNA, 15 nt, Homo sapiens
gauaacugagaauuu

SEQ ID NO: 978150 - RNA, 16 nt, Homo sapiens
gauauauacacaggau

SEQ ID NO: 978151 - RNA, 16 nt, Homo sapiens
gauggaauaaagcccu

SEQ ID NO: 978152 - RNA, 17 nt, Homo sapiens
gauggaauaaagcccuu

SEQ ID NO: 978153 - RNA, 21 nt, Homo sapiens
gaugugaauugccugcagaga

SEQ ID NO: 978154 - RNA, 14 nt, Homo sapiens
gauuggcucaccca

SEQ ID NO: 978155 - RNA, 15 nt, Homo sapiens
gauuuaacugugaac

SEQ ID NO: 978156 - RNA, 21 nt, Homo sapiens
gcaaagcaccagcuucuccag

SEQ ID NO: 978157 - RNA, 19 nt, Homo sapiens
gcaauucuacccagagccu

SEQ ID NO: 978158 - RNA, 14 nt, Homo sapiens
gcagagagaagccu

SEQ ID NO: 978159 - RNA, 19 nt, Homo sapiens
gcagagguaaaagugugag

SEQ ID NO: 978160 - RNA, 20 nt, Homo sapiens
gcaggcagccccacacccgc

SEQ ID NO: 978161 - RNA, 19 nt, Homo sapiens
gcaguucucgcagauguua

SEQ ID NO: 978162 - RNA, 20 nt, Homo sapiens
gcaguucucgcagauguuac

SEQ ID NO: 978163 - RNA, 20 nt, Homo sapiens
gcauaggccauauaauguua

SEQ ID NO: 978164 - RNA, 12 nt, Homo sapiens
gcauaugcaaua

SEQ ID NO: 978165 - RNA, 14 nt, Homo sapiens
gcaugccagagccu

SEQ ID NO: 978166 - RNA, 15 nt, Homo sapiens
gcaugcucagcccuu

SEQ ID NO: 978167 - RNA, 13 nt, Homo sapiens
gcauggugcaguu

SEQ ID NO: 978168 - RNA, 14 nt, Homo sapiens
gccaccucuugggc

SEQ ID NO: 978169 - RNA, 15 nt, Homo sapiens
gcccagggcauccca

SEQ ID NO: 978170 - RNA, 20 nt, Homo sapiens
gcccaggggcccacagggaa

SEQ ID NO: 978171 - RNA, 23 nt, Homo sapiens
gcccuccuuaauagccauaugca

SEQ ID NO: 978172 - RNA, 15 nt, Homo sapiens
gcccugaaggugcca

SEQ ID NO: 978173 - RNA, 14 nt, Homo sapiens
gccucaaugugacc

SEQ ID NO: 978174 - RNA, 19 nt, Homo sapiens
gccucaaugugaccagggg

SEQ ID NO: 978175 - RNA, 15 nt, Homo sapiens
gccuccugcaccgag

SEQ ID NO: 978176 - RNA, 18 nt, Homo sapiens
gccuccuuuugcuugaaa

SEQ ID NO: 978177 - RNA, 13 nt, Homo sapiens
gccucugacucac

SEQ ID NO: 978178 - RNA, 18 nt, Homo sapiens
gccuuucuguaaccaaaa

SEQ ID NO: 978179 - RNA, 13 nt, Homo sapiens
gcgagguguaaag

SEQ ID NO: 978180 - RNA, 15 nt, Homo sapiens
gcuagggaguggucu

SEQ ID NO: 978181 - RNA, 22 nt, Homo sapiens
gcuccaguauggaagaaugggg

SEQ ID NO: 978182 - RNA, 18 nt, Homo sapiens
gcucuggaaaaugugacc

SEQ ID NO: 978183 - RNA, 12 nt, Homo sapiens
gcugaacacugg

SEQ ID NO: 978184 - RNA, 20 nt, Homo sapiens
ggaaaagaaucccugcagcc

SEQ ID NO: 978185 - RNA, 17 nt, Homo sapiens
ggaaccaaaauguauaa

SEQ ID NO: 978186 - RNA, 19 nt, Homo sapiens
ggaacucuggcuuccaggu

SEQ ID NO: 978187 - RNA, 20 nt, Homo sapiens
ggaacucuggcuuccaggua

SEQ ID NO: 978188 - RNA, 16 nt, Homo sapiens
ggaagcacauguuuau

SEQ ID NO: 978189 - RNA, 14 nt, Homo sapiens
ggaauaaagcccuu

SEQ ID NO: 978190 - RNA, 17 nt, Homo sapiens
ggacuggaaccagggag

SEQ ID NO: 978191 - RNA, 14 nt, Homo sapiens
ggagagaaguuucu

SEQ ID NO: 978192 - RNA, 19 nt, Homo sapiens
ggcaaagguggcucuccag

SEQ ID NO: 978193 - RNA, 17 nt, Homo sapiens
ggcaacgacgguuucaa

SEQ ID NO: 978194 - RNA, 14 nt, Homo sapiens
ggcaagggguuucc

SEQ ID NO: 978195 - RNA, 13 nt, Homo sapiens
ggcaaugcaaaag

SEQ ID NO: 978196 - RNA, 11 nt, Homo sapiens
ggcauaugcaa

SEQ ID NO: 978197 - RNA, 19 nt, Homo sapiens
ggcaugccuuucuguaacc

SEQ ID NO: 978198 - RNA, 20 nt, Homo sapiens
ggccaggcaggggugggaga

SEQ ID NO: 978199 - RNA, 21 nt, Homo sapiens
ggcccuucuugccuacuaugc

SEQ ID NO: 978200 - RNA, 17 nt, Homo sapiens
ggccugcccucagggau

SEQ ID NO: 978201 - RNA, 19 nt, Homo sapiens
ggcucuccuguagcucucc

SEQ ID NO: 978202 - RNA, 23 nt, Homo sapiens
ggcuggugcuguggccaggguga

SEQ ID NO: 978203 - RNA, 19 nt, Homo sapiens
ggcuuccagguaucuccag

SEQ ID NO: 978204 - RNA, 19 nt, Homo sapiens
gggauuggagggaagacag

SEQ ID NO: 978205 - RNA, 21 nt, Homo sapiens
gggcccacagggaacccugcu

SEQ ID NO: 978206 - RNA, 13 nt, Homo sapiens
ggggcaucccaga

SEQ ID NO: 978207 - RNA, 19 nt, Homo sapiens
ggguauuuaccacagcagc

SEQ ID NO: 978208 - RNA, 16 nt, Homo sapiens
gggugggccacucucc

SEQ ID NO: 978209 - RNA, 19 nt, Homo sapiens
gguagcaauucuacccaga

SEQ ID NO: 978210 - RNA, 14 nt, Homo sapiens
gguaucuccaggau

SEQ ID NO: 978211 - RNA, 19 nt, Homo sapiens
gguauuugcuuuguaacuc

SEQ ID NO: 978212 - RNA, 15 nt, Homo sapiens
ggucacauucaggaa

SEQ ID NO: 978213 - RNA, 14 nt, Homo sapiens
ggugcagugccgcu

SEQ ID NO: 978214 - RNA, 13 nt, Homo sapiens
ggugcugcagcca

SEQ ID NO: 978215 - RNA, 13 nt, Homo sapiens
guaaacauaauuc

SEQ ID NO: 978216 - RNA, 22 nt, Homo sapiens
guagaguuugaaggaggugagg

SEQ ID NO: 978217 - RNA, 18 nt, Homo sapiens
guagcaaguucuagagaa

SEQ ID NO: 978218 - RNA, 13 nt, Homo sapiens
guaguucuugucu

SEQ ID NO: 978219 - RNA, 18 nt, Homo sapiens
guauggaauacaguguua

SEQ ID NO: 978220 - RNA, 16 nt, Homo sapiens
gucaauuucaguguau

SEQ ID NO: 978221 - RNA, 13 nt, Homo sapiens
guccagggcggga

SEQ ID NO: 978222 - RNA, 17 nt, Homo sapiens
guccccucuugacccau

SEQ ID NO: 978223 - RNA, 16 nt, Homo sapiens
gucgagacauuccugc

SEQ ID NO: 978224 - RNA, 15 nt, Homo sapiens
gucugauuggcucac

SEQ ID NO: 978225 - RNA, 20 nt, Homo sapiens
gcccagggcaucccaugggg

SEQ ID NO: 978226 - RNA, 21 nt, Homo sapiens
gccccuuggcgggcagcccag

SEQ ID NO: 978227 - RNA, 16 nt, Homo sapiens
gcccuggcugacccca

SEQ ID NO: 978228 - RNA, 15 nt, Homo sapiens
gcccuucccacugga

SEQ ID NO: 978229 - RNA, 21 nt, Homo sapiens
gcccuucccacuggaggucac

SEQ ID NO: 978230 - RNA, 21 nt, Homo sapiens
gccucuggaaaacucaggauu

SEQ ID NO: 978231 - RNA, 18 nt, Homo sapiens
gccugguagaauugggaa

SEQ ID NO: 978232 - RNA, 18 nt, Homo sapiens
gccugugugagcaucucu

SEQ ID NO: 978233 - RNA, 22 nt, Homo sapiens
gccuuuugcucacaaaaccugg

SEQ ID NO: 978234 - RNA, 15 nt, Homo sapiens
gcgcauggugcagug

SEQ ID NO: 978235 - RNA, 17 nt, Homo sapiens
gcgcugcucaaccucuc

SEQ ID NO: 978236 - RNA, 15 nt, Homo sapiens
gcggagaguacagug

SEQ ID NO: 978237 - RNA, 20 nt, Homo sapiens
gcgucgcuggacaacccaga

SEQ ID NO: 978238 - RNA, 16 nt, Homo sapiens
gcuaucacacaguggg

SEQ ID NO: 978239 - RNA, 18 nt, Homo sapiens
gcuauugugauaugacaa

SEQ ID NO: 978240 - RNA, 13 nt, Homo sapiens
gcucaggugcaag

SEQ ID NO: 978241 - RNA, 22 nt, Homo sapiens
gcucugcccucccuggccucac

SEQ ID NO: 978242 - RNA, 14 nt, Homo sapiens
gcugcucuggaaaa

SEQ ID NO: 978243 - RNA, 17 nt, Homo sapiens
ggaaaaugugacccaga

SEQ ID NO: 978244 - RNA, 21 nt, Homo sapiens
ggaacuagagggauacacuga

SEQ ID NO: 978245 - RNA, 15 nt, Homo sapiens
ggaagaugaaagagg

SEQ ID NO: 978246 - RNA, 18 nt, Homo sapiens
ggaauaaagcccuugaac

SEQ ID NO: 978247 - RNA, 13 nt, Homo sapiens
ucgagacauuccu

SEQ ID NO: 978248 - RNA, 16 nt, Homo sapiens
ucgcccacaaacugau

SEQ ID NO: 978249 - RNA, 20 nt, Homo sapiens
ucuacccggcccagagaccc

SEQ ID NO: 978250 - RNA, 18 nt, Homo sapiens
ucucagcgagguguaaag

SEQ ID NO: 978251 - RNA, 17 nt, Homo sapiens
ucucgcagauguuaccu

SEQ ID NO: 978252 - RNA, 19 nt, Homo sapiens
ucuggaaaacucaggauuc

SEQ ID NO: 978253 - RNA, 20 nt, Homo sapiens
ucugggauucccaccaaggu

SEQ ID NO: 978254 - RNA, 14 nt, Homo sapiens
ucuuuguacauuuu

SEQ ID NO: 978255 - RNA, 20 nt, Homo sapiens
ugaacaaaaaaaacaaaaag

SEQ ID NO: 978256 - RNA, 15 nt, Homo sapiens
ugaagaccacaucca

SEQ ID NO: 978257 - RNA, 17 nt, Homo sapiens
ugaagacggauuacuaa

SEQ ID NO: 978258 - RNA, 18 nt, Homo sapiens
ugaagagaccaagacucu

SEQ ID NO: 978259 - RNA, 21 nt, Homo sapiens
ugaauaaaguuaguguguugu

SEQ ID NO: 978260 - RNA, 16 nt, Homo sapiens
ugacgcacugcucaag

SEQ ID NO: 978261 - RNA, 14 nt, Homo sapiens
ugagcuucaguaua

SEQ ID NO: 978262 - RNA, 21 nt, Homo sapiens
ugaucaggcuauguauggaau

SEQ ID NO: 978263 - RNA, 20 nt, Homo sapiens
ugcagcuuaaaacaagcaaa

SEQ ID NO: 978264 - RNA, 16 nt, Homo sapiens
ugcaguugacagcagg

SEQ ID NO: 978265 - RNA, 15 nt, Homo sapiens
ugcaguuuccaaucc

SEQ ID NO: 978266 - RNA, 22 nt, Homo sapiens
ugcaguuuccaaucccauagau

SEQ ID NO: 978267 - RNA, 23 nt, Homo sapiens
ugcccugaguggaucuccaagga

SEQ ID NO: 978268 - RNA, 16 nt, Homo sapiens
ucugaauaacauuugu

SEQ ID NO: 978269 - RNA, 20 nt, Homo sapiens
ucugagcaagagcuggcaaa

SEQ ID NO: 978270 - RNA, 15 nt, Homo sapiens
ucugagcacccccuc

SEQ ID NO: 978271 - RNA, 14 nt, Homo sapiens
ucugauuggcucac

SEQ ID NO: 978272 - RNA, 21 nt, Homo sapiens
ucuggauggauuugaagcaaa

SEQ ID NO: 978273 - RNA, 11 nt, Homo sapiens
ucugugcagcu

SEQ ID NO: 978274 - RNA, 16 nt, Homo sapiens
ucuugcauucccagug

SEQ ID NO: 978275 - RNA, 16 nt, Homo sapiens
ugaacagccaaaugca

SEQ ID NO: 978276 - RNA, 19 nt, Homo sapiens
ugaccggcagaauguucug

SEQ ID NO: 978277 - RNA, 19 nt, Homo sapiens
ugacuccucuaagccacuc

SEQ ID NO: 978278 - RNA, 18 nt, Homo sapiens
ugagcacccccucauucc

SEQ ID NO: 978279 - RNA, 13 nt, Homo sapiens
ugaguguguuugu

SEQ ID NO: 978280 - RNA, 18 nt, Homo sapiens
ugauauguaaacauaauu

SEQ ID NO: 978281 - RNA, 19 nt, Homo sapiens
ugcaagacaaaguugaaug

SEQ ID NO: 978282 - RNA, 16 nt, Homo sapiens
ugcaauauuuacauuu

SEQ ID NO: 978283 - RNA, 17 nt, Homo sapiens
ugcaauauuuacauuuu

SEQ ID NO: 978284 - RNA, 19 nt, Homo sapiens
ugcagagguaaaaguguga

SEQ ID NO: 978285 - RNA, 11 nt, Homo sapiens
ugcaugccaaa

SEQ ID NO: 978286 - RNA, 16 nt, Homo sapiens
ugcauucccagugguc

SEQ ID NO: 978287 - RNA, 21 nt, Homo sapiens
ugcccagccucgcaugccaga

SEQ ID NO: 978288 - RNA, 15 nt, Homo sapiens
ugccuacauucccug

SEQ ID NO: 978289 - RNA, 17 nt, Homo sapiens
ugccucaaugugaccag

SEQ ID NO: 978290 - RNA, 14 nt, Homo sapiens
ugcgaacagcaaac

SEQ ID NO: 978291 - RNA, 13 nt, Homo sapiens
ugcgcugcucaac

SEQ ID NO: 978292 - RNA, 15 nt, Homo sapiens
ugcggagacccugag

SEQ ID NO: 978293 - RNA, 13 nt, Homo sapiens
ugcuugcacuuug

SEQ ID NO: 978294 - RNA, 17 nt, Homo sapiens
uggaaaaugugacccag

SEQ ID NO: 978295 - RNA, 20 nt, Homo sapiens
uggaagaaggaaacaccgag

SEQ ID NO: 978296 - RNA, 14 nt, Homo sapiens
uggacccugcugaa

SEQ ID NO: 978297 - RNA, 19 nt, Homo sapiens
uggagggucgccacacccg

SEQ ID NO: 978298 - RNA, 20 nt, Homo sapiens
uggaggucacauucaggaag

SEQ ID NO: 978299 - RNA, 16 nt, Homo sapiens
uggaucuguccaagga

SEQ ID NO: 978300 - RNA, 17 nt, Homo sapiens
uggcaaagguggcucuc

SEQ ID NO: 978301 - RNA, 14 nt, Homo sapiens
uggcaggaccagga

SEQ ID NO: 978302 - RNA, 21 nt, Homo sapiens
uggcaguucucgcagauguua

SEQ ID NO: 978303 - RNA, 22 nt, Homo sapiens
uggcuuccagguaucuccagga

SEQ ID NO: 978304 - RNA, 14 nt, Homo sapiens
ugggcaugcucagc

SEQ ID NO: 978305 - RNA, 18 nt, Homo sapiens
uguacauuucacaaaaag

SEQ ID NO: 978306 - RNA, 13 nt, Homo sapiens
uguaccaguguga

SEQ ID NO: 978307 - RNA, 15 nt, Homo sapiens
uguacccacuccuca

SEQ ID NO: 978308 - RNA, 21 nt, Homo sapiens
ugugaccccuccccagugccu

SEQ ID NO: 978309 - RNA, 22 nt, Homo sapiens
ugugaccccuccccagugccuc

SEQ ID NO: 978310 - RNA, 19 nt, Homo sapiens
ugugauauuuuuacuugca

SEQ ID NO: 978311 - RNA, 17 nt, Homo sapiens
uguuguacauacagagg

SEQ ID NO: 978312 - RNA, 17 nt, Homo sapiens
uguuugucagauaugau

SEQ ID NO: 978313 - RNA, 21 nt, Homo sapiens
uuaagguuuuacuuuucugaa

SEQ ID NO: 978314 - RNA, 19 nt, Homo sapiens
uuacacaguugcugucaua

SEQ ID NO: 978315 - RNA, 15 nt, Homo sapiens
uuccaugaagaccac

SEQ ID NO: 978316 - RNA, 21 nt, Homo sapiens
uucuaggugcccgaguagcau

SEQ ID NO: 978317 - RNA, 19 nt, Homo sapiens
uucuggcgcaagagaacau

SEQ ID NO: 978318 - RNA, 16 nt, Homo sapiens
uucuucuguauguuag

SEQ ID NO: 978319 - RNA, 17 nt, Homo sapiens
uugaaucaaagcaguua

SEQ ID NO: 978320 - RNA, 19 nt, Homo sapiens
uugcccugaguggaucucc

SEQ ID NO: 978321 - RNA, 14 nt, Homo sapiens
uuguaccaguguga

SEQ ID NO: 978322 - RNA, 19 nt, Homo sapiens
uuguauauugucagauauu

SEQ ID NO: 978323 - RNA, 10 nt, Homo sapiens
uuguaucauu

SEQ ID NO: 978324 - RNA, 14 nt, Homo sapiens
uugucugugcagcu

SEQ ID NO: 978325 - RNA, 22 nt, Homo sapiens
uuguucgccgcguggaauguga

SEQ ID NO: 978326 - RNA, 16 nt, Homo sapiens
uuuaacccucucuucc

SEQ ID NO: 978327 - RNA, 22 nt, Homo sapiens
uuucacaaaaaggcauaugcaa

SEQ ID NO: 978328 - RNA, 12 nt, Homo sapiens
uuucccaccacc

SEQ ID NO: 978329 - RNA, 13 nt, Homo sapiens
uuugaagcaaagc

SEQ ID NO: 978330 - RNA, 17 nt, Homo sapiens
uuuggaugaccagaaca

SEQ ID NO: 978331 - RNA, 17 nt, Homo sapiens
acaagauaacugagaau

SEQ ID NO: 978332 - RNA, 20 nt, Homo sapiens
acaagguucccucugagaau

SEQ ID NO: 978333 - RNA, 16 nt, Homo sapiens
acacuuccauuaacuu

SEQ ID NO: 978334 - RNA, 22 nt, Homo sapiens
acagaauggaaccaaaauguau

SEQ ID NO: 978335 - RNA, 18 nt, Homo sapiens
acagcgagaggcagagaa

SEQ ID NO: 978336 - RNA, 19 nt, Homo sapiens
acaggauccuauucucacc

SEQ ID NO: 978337 - RNA, 13 nt, Homo sapiens
accaaggucuuca

SEQ ID NO: 978338 - RNA, 16 nt, Homo sapiens
accaggacuauagccc

SEQ ID NO: 978339 - RNA, 14 nt, Homo sapiens
acccagaacuggac

SEQ ID NO: 978340 - RNA, 20 nt, Homo sapiens
accccagcuagggcuggacu

SEQ ID NO: 978341 - RNA, 21 nt, Homo sapiens
acccuaagccuccuuuugcuu

SEQ ID NO: 978342 - RNA, 20 nt, Homo sapiens
accgagcgcuuucuggaaaa

SEQ ID NO: 978343 - RNA, 17 nt, Homo sapiens
accuccuguguggaaga

SEQ ID NO: 978344 - RNA, 18 nt, Homo sapiens
accucuugggcaugcuca

SEQ ID NO: 978345 - RNA, 18 nt, Homo sapiens
accuuggacuccucccac

SEQ ID NO: 978346 - RNA, 19 nt, Homo sapiens
acgcccagccuccucccac

SEQ ID NO: 978347 - RNA, 21 nt, Homo sapiens
acuacgggcugcucuacugcu

SEQ ID NO: 978348 - RNA, 14 nt, Homo sapiens
acuacugugaucag

SEQ ID NO: 978349 - RNA, 14 nt, Homo sapiens
acuauagcccaggu

SEQ ID NO: 978350 - RNA, 17 nt, Homo sapiens
acucgcacaaccaugac

SEQ ID NO: 978351 - RNA, 21 nt, Homo sapiens
acugauguuacaucacagugu

SEQ ID NO: 978352 - RNA, 14 nt, Homo sapiens
acugauuaccuccu

SEQ ID NO: 978353 - RNA, 14 nt, Homo sapiens
acuggaaccaggga

SEQ ID NO: 978354 - RNA, 14 nt, Homo sapiens
acuuaucuugcucu

SEQ ID NO: 978355 - RNA, 13 nt, Homo sapiens
acuuuaacccucu

SEQ ID NO: 978356 - RNA, 14 nt, Homo sapiens
agaaauuagcugug

SEQ ID NO: 978357 - RNA, 14 nt, Homo sapiens
agaagagacaggag

SEQ ID NO: 978358 - RNA, 16 nt, Homo sapiens
agaagaggcuggugcu

SEQ ID NO: 978359 - RNA, 19 nt, Homo sapiens
agaagaggcuggugcugug

SEQ ID NO: 978360 - RNA, 14 nt, Homo sapiens
agaaucgcuuaaac

SEQ ID NO: 978361 - RNA, 15 nt, Homo sapiens
gccaggccaccagga

SEQ ID NO: 978362 - RNA, 22 nt, Homo sapiens
gccaucagggugggccacucuc

SEQ ID NO: 978363 - RNA, 20 nt, Homo sapiens
gcccuggcugaccccaaaga

SEQ ID NO: 978364 - RNA, 16 nt, Homo sapiens
gccuggggcaucccag

SEQ ID NO: 978365 - RNA, 17 nt, Homo sapiens
gccugguagaauuggga

SEQ ID NO: 978366 - RNA, 14 nt, Homo sapiens
gcggggugcagaag

SEQ ID NO: 978367 - RNA, 14 nt, Homo sapiens
gcuagggagugguc

SEQ ID NO: 978368 - RNA, 21 nt, Homo sapiens
gcucacccaagcaaggccaaa

SEQ ID NO: 978369 - RNA, 21 nt, Homo sapiens
gcucagcccugacuggugcua

SEQ ID NO: 978370 - RNA, 17 nt, Homo sapiens
gcucgcccacaaacuga

SEQ ID NO: 978371 - RNA, 15 nt, Homo sapiens
gcucuuuggggucag

SEQ ID NO: 978372 - RNA, 14 nt, Homo sapiens
gcugcucuacugcu

SEQ ID NO: 978373 - RNA, 23 nt, Homo sapiens
gcuguauauaggggucaauguga

SEQ ID NO: 978374 - RNA, 22 nt, Homo sapiens
gcuucaggaaggacauggacaa

SEQ ID NO: 978375 - RNA, 14 nt, Homo sapiens
gcuucuaggugccc

SEQ ID NO: 978376 - RNA, 14 nt, Homo sapiens
gcuugcaugccaaa

SEQ ID NO: 978377 - RNA, 18 nt, Homo sapiens
gcuuugcuucaaauccau

SEQ ID NO: 978378 - RNA, 20 nt, Homo sapiens
ggaacccugcuugcacuuug

SEQ ID NO: 978379 - RNA, 14 nt, Homo sapiens
ggaaggagugagau

SEQ ID NO: 978380 - RNA, 20 nt, Homo sapiens
ggacaccccuuauccaggac

SEQ ID NO: 978381 - RNA, 22 nt, Homo sapiens
ggaccaggacuauagcccaggu

SEQ ID NO: 978382 - RNA, 18 nt, Homo sapiens
ggagaagcucacccaaua

SEQ ID NO: 978383 - RNA, 16 nt, Homo sapiens
ggagaaucgcuuaaac

SEQ ID NO: 978384 - RNA, 13 nt, Homo sapiens
ggagagaaguuuc

SEQ ID NO: 978385 - RNA, 20 nt, Homo sapiens
ggagaguacagugagccaag

SEQ ID NO: 978386 - RNA, 15 nt, Homo sapiens
ggauauuuucuucca

SEQ ID NO: 978387 - RNA, 22 nt, Homo sapiens
ggcaaggacggccuucaacuga

SEQ ID NO: 978388 - RNA, 16 nt, Homo sapiens
ggcacgucccaugugc

SEQ ID NO: 978389 - RNA, 13 nt, Homo sapiens
ggcagagccuuug

SEQ ID NO: 978390 - RNA, 23 nt, Homo sapiens
ggcaggggugggagagccagcuc

SEQ ID NO: 978391 - RNA, 19 nt, Homo sapiens
ggcgagcucuggcuuugca

SEQ ID NO: 978392 - RNA, 16 nt, Homo sapiens
ggcgggcagggguucc

SEQ ID NO: 978393 - RNA, 21 nt, Homo sapiens
ggcuaauucccagagugugaa

SEQ ID NO: 978394 - RNA, 13 nt, Homo sapiens
ggcugagcugaac

SEQ ID NO: 978395 - RNA, 16 nt, Homo sapiens
gggaucuugcauuccc

SEQ ID NO: 978396 - RNA, 17 nt, Homo sapiens
gggcaacgacgguuuca

SEQ ID NO: 978397 - RNA, 15 nt, Homo sapiens
gggcagggguuccca

SEQ ID NO: 978398 - RNA, 15 nt, Homo sapiens
ggguccuugguguga

SEQ ID NO: 978399 - RNA, 16 nt, Homo sapiens
gggugcgguggcucac

SEQ ID NO: 978400 - RNA, 18 nt, Homo sapiens
gguccacccagcaaagag

SEQ ID NO: 978401 - RNA, 21 nt, Homo sapiens
ggucucuggcccuucuugccu

SEQ ID NO: 978402 - RNA, 17 nt, Homo sapiens
gguuuggggucugccac

SEQ ID NO: 978403 - RNA, 19 nt, Homo sapiens
gguuuguguuugaguuuua

SEQ ID NO: 978404 - RNA, 14 nt, Homo sapiens
guaaaaucuuggca

SEQ ID NO: 978405 - RNA, 16 nt, Homo sapiens
guagucccagccacuc

SEQ ID NO: 978406 - RNA, 17 nt, Homo sapiens
guauuuaccacagcagc

SEQ ID NO: 978407 - RNA, 20 nt, Homo sapiens
gucaaaccgcacucacccau

SEQ ID NO: 978408 - RNA, 16 nt, Homo sapiens
gucaaccagugaggcu

SEQ ID NO: 978409 - RNA, 17 nt, Homo sapiens
guccaggguugaucaca

SEQ ID NO: 978410 - RNA, 16 nt, Homo sapiens
gucggcacgucccaug

SEQ ID NO: 978411 - RNA, 16 nt, Homo sapiens
gucugagcuucaguau

SEQ ID NO: 978412 - RNA, 20 nt, Homo sapiens
gucuuaagccuuuugcucac

SEQ ID NO: 978413 - RNA, 20 nt, Homo sapiens
gugagaaucaaaacucuccu

SEQ ID NO: 978414 - RNA, 15 nt, Homo sapiens
gugauuucagagagg

SEQ ID NO: 978415 - RNA, 12 nt, Homo sapiens
gugcagugccgc

SEQ ID NO: 978416 - RNA, 17 nt, Homo sapiens
gugcaguugacagcagg

SEQ ID NO: 978417 - RNA, 20 nt, Homo sapiens
gugcucgcccacaaacugau

SEQ ID NO: 978418 - RNA, 17 nt, Homo sapiens
guggagaugcagaggua

SEQ ID NO: 978419 - RNA, 18 nt, Homo sapiens
gugggacaaaccagagca

SEQ ID NO: 978420 - RNA, 16 nt, Homo sapiens
gugggacugacauuuc

SEQ ID NO: 978421 - RNA, 12 nt, Homo sapiens
guggguggugga

SEQ ID NO: 978422 - RNA, 19 nt, Homo sapiens
gugucccccuaugcuccag

SEQ ID NO: 978423 - RNA, 20 nt, Homo sapiens
guguguugucugugcagcug

SEQ ID NO: 978424 - RNA, 21 nt, Homo sapiens
guuacagcgagaggcagagaa

SEQ ID NO: 978425 - RNA, 16 nt, Homo sapiens
guuacaucacaguguu

SEQ ID NO: 978426 - RNA, 19 nt, Homo sapiens
guucagagaucguuccuau

SEQ ID NO: 978427 - RNA, 21 nt, Homo sapiens
guucgccgcguggaaugugag

SEQ ID NO: 978428 - RNA, 18 nt, Homo sapiens
guucucucguaacugguu

SEQ ID NO: 978429 - RNA, 13 nt, Homo sapiens
uaaaaguuacuua

SEQ ID NO: 978430 - RNA, 18 nt, Homo sapiens
uaaaauaaaguacauuau

SEQ ID NO: 978431 - RNA, 20 nt, Homo sapiens
uaaaguacauuauuuaugaa

SEQ ID NO: 978432 - RNA, 21 nt, Homo sapiens
uaaaugcugucaacuaugaua

SEQ ID NO: 978433 - RNA, 14 nt, Homo sapiens
uaaaugugcuuaug

SEQ ID NO: 978434 - RNA, 18 nt, Homo sapiens
uaagaccauaacagccaa

SEQ ID NO: 978435 - RNA, 20 nt, Homo sapiens
uaagccacucuuccaaaggc

SEQ ID NO: 978436 - RNA, 17 nt, Homo sapiens
uaagccuuuugcucaca

SEQ ID NO: 978437 - RNA, 15 nt, Homo sapiens
uaaggauugugauau

SEQ ID NO: 978438 - RNA, 19 nt, Homo sapiens
uacagaauggaaccaaaau

SEQ ID NO: 978439 - RNA, 13 nt, Homo sapiens
uacauaagaccau

SEQ ID NO: 978440 - RNA, 14 nt, Homo sapiens
uacauguuacuugu

SEQ ID NO: 978441 - RNA, 18 nt, Homo sapiens
uaccuccuguguggaaga

SEQ ID NO: 978442 - RNA, 14 nt, Homo sapiens
uacgggcugcucua

SEQ ID NO: 978443 - RNA, 22 nt, Homo sapiens
uacuuuugaaaaucaacuguau

SEQ ID NO: 978444 - RNA, 18 nt, Homo sapiens
agcaucucuguguaccca

SEQ ID NO: 978445 - RNA, 19 nt, Homo sapiens
agccacaucccuuugaaac

SEQ ID NO: 978446 - RNA, 13 nt, Homo sapiens
agccacucuucca

SEQ ID NO: 978447 - RNA, 11 nt, Homo sapiens
agccauaugca

SEQ ID NO: 978448 - RNA, 16 nt, Homo sapiens
agcuuaaaacaagcaa

SEQ ID NO: 978449 - RNA, 17 nt, Homo sapiens
aggaagggaaagccaga

SEQ ID NO: 978450 - RNA, 13 nt, Homo sapiens
aggagaaacugag

SEQ ID NO: 978451 - RNA, 17 nt, Homo sapiens
aggauauuuucuuccaa

SEQ ID NO: 978452 - RNA, 16 nt, Homo sapiens
aggauguuuuucauga

SEQ ID NO: 978453 - RNA, 22 nt, Homo sapiens
aggcugggggcgggggagccaa

SEQ ID NO: 978454 - RNA, 19 nt, Homo sapiens
aggcuuaaggagaggagaa

SEQ ID NO: 978455 - RNA, 21 nt, Homo sapiens
agggaacccugcuugcacuuu

SEQ ID NO: 978456 - RNA, 13 nt, Homo sapiens
aggguuacuaugc

SEQ ID NO: 978457 - RNA, 19 nt, Homo sapiens
aggugcccgaguagcaucc

SEQ ID NO: 978458 - RNA, 19 nt, Homo sapiens
aguagcaaguucuagagaa

SEQ ID NO: 978459 - RNA, 15 nt, Homo sapiens
aguagcauccuguga

SEQ ID NO: 978460 - RNA, 19 nt, Homo sapiens
aguucuggcugaacacugg

SEQ ID NO: 978461 - RNA, 22 nt, Homo sapiens
aguuuguuuuuaaaaaaaucua

SEQ ID NO: 978462 - RNA, 22 nt, Homo sapiens
auaaaacgcaaagggcugaaag

SEQ ID NO: 978463 - RNA, 22 nt, Homo sapiens
auaaauguuauguuugcuaaaa

SEQ ID NO: 978464 - RNA, 19 nt, Homo sapiens
auaaggaucagaacagcag

SEQ ID NO: 978465 - RNA, 22 nt, Homo sapiens
auacacugaaguuaacagagac

SEQ ID NO: 978466 - RNA, 19 nt, Homo sapiens
auacagagguaacuaucaa

SEQ ID NO: 978467 - RNA, 17 nt, Homo sapiens
auaucaagauguuaaau

SEQ ID NO: 978468 - RNA, 17 nt, Homo sapiens
aucacaguguuugcaau

SEQ ID NO: 978469 - RNA, 21 nt, Homo sapiens
auccaguuucccaccaccuug

SEQ ID NO: 978470 - RNA, 23 nt, Homo sapiens
aucccagagcccagggcauccca

SEQ ID NO: 978471 - RNA, 21 nt, Homo sapiens
aucuccaggauugaagagcau

SEQ ID NO: 978472 - RNA, 15 nt, Homo sapiens
aucugagcaaugacu

SEQ ID NO: 978473 - RNA, 21 nt, Homo sapiens
augccuuucuguaaccaaaaa

SEQ ID NO: 978474 - RNA, 22 nt, Homo sapiens
augcucagcccugacuggugcu

SEQ ID NO: 978475 - RNA, 14 nt, Homo sapiens
augcuccaguaugg

SEQ ID NO: 978476 - RNA, 23 nt, Homo sapiens
auggacaccccuuauccaggacu

SEQ ID NO: 978477 - RNA, 22 nt, Homo sapiens
augggucuggcugagcugaacc

SEQ ID NO: 978478 - RNA, 20 nt, Homo sapiens
auguaaacauaauucuugua

SEQ ID NO: 978479 - RNA, 16 nt, Homo sapiens
auuacauggcaguguu

SEQ ID NO: 978480 - RNA, 21 nt, Homo sapiens
auuacccccucauuguuuauu

SEQ ID NO: 978481 - RNA, 21 nt, Homo sapiens
auucacaauagaaacucacca

SEQ ID NO: 978482 - RNA, 13 nt, Homo sapiens
auucccaccaagg

SEQ ID NO: 978483 - RNA, 17 nt, Homo sapiens
auuccccucgugugacu

SEQ ID NO: 978484 - RNA, 13 nt, Homo sapiens
auuccgucuuaaa

SEQ ID NO: 978485 - RNA, 13 nt, Homo sapiens
auucucaccagga

SEQ ID NO: 978486 - RNA, 15 nt, Homo sapiens
auugacgcauauuua

SEQ ID NO: 978487 - RNA, 19 nt, Homo sapiens
auuuaauggcaaugcaaaa

SEQ ID NO: 978488 - RNA, 20 nt, Homo sapiens
auuuacauuuuuaauuuagu

SEQ ID NO: 978489 - RNA, 13 nt, Homo sapiens
auuuauguuuauu

SEQ ID NO: 978490 - RNA, 15 nt, Homo sapiens
auuuauuuaagcuua

SEQ ID NO: 978491 - RNA, 19 nt, Homo sapiens
auuuuuuuuguaacuucaa

SEQ ID NO: 978492 - RNA, 18 nt, Homo sapiens
caaaacagagaugugaua

SEQ ID NO: 978493 - RNA, 13 nt, Homo sapiens
caaaccagagcag

SEQ ID NO: 978494 - RNA, 19 nt, Homo sapiens
caaauuguaguucuugucu

SEQ ID NO: 978495 - RNA, 23 nt, Homo sapiens
caacacaagcuggaagcacaugu

SEQ ID NO: 978496 - RNA, 22 nt, Homo sapiens
caacagguggcaggaccaggac

SEQ ID NO: 978497 - RNA, 15 nt, Homo sapiens
caauauuuacauuuu

SEQ ID NO: 978498 - RNA, 16 nt, Homo sapiens
caaucucgcaguacau

SEQ ID NO: 978499 - RNA, 19 nt, Homo sapiens
cacaaaaaggcauaugcaa

SEQ ID NO: 978500 - RNA, 16 nt, Homo sapiens
cacaaggucacuagau

SEQ ID NO: 978501 - RNA, 17 nt, Homo sapiens
cacaaucugggacuuuc

SEQ ID NO: 978502 - RNA, 15 nt, Homo sapiens
cacacgcaggaacuc

SEQ ID NO: 978503 - RNA, 15 nt, Homo sapiens
cacacuggugacugc

SEQ ID NO: 978504 - RNA, 15 nt, Homo sapiens
cacagcagcugaaca

SEQ ID NO: 978505 - RNA, 20 nt, Homo sapiens
cacagcagcugaacagccaa

SEQ ID NO: 978506 - RNA, 18 nt, Homo sapiens
cacaggauccuauucuca

SEQ ID NO: 978507 - RNA, 21 nt, Homo sapiens
caccacccucccaccaugcgc

SEQ ID NO: 978508 - RNA, 13 nt, Homo sapiens
cacccagcaaaga

SEQ ID NO: 978509 - RNA, 16 nt, Homo sapiens
caccccuuauccagga

SEQ ID NO: 978510 - RNA, 19 nt, Homo sapiens
cacccggcucccccugcuu

SEQ ID NO: 978511 - RNA, 20 nt, Homo sapiens
caccucuugggcaugcucag

SEQ ID NO: 978512 - RNA, 18 nt, Homo sapiens
cacucuccccucccucuu

SEQ ID NO: 978513 - RNA, 23 nt, Homo sapiens
cagagagggcagagggguaggca

SEQ ID NO: 978514 - RNA, 20 nt, Homo sapiens
cagagcgagauuccgucuua

SEQ ID NO: 978515 - RNA, 11 nt, Homo sapiens
cagagugugaa

SEQ ID NO: 978516 - RNA, 14 nt, Homo sapiens
cagauaacucuccu

SEQ ID NO: 978517 - RNA, 12 nt, Homo sapiens
cagcagcugaac

SEQ ID NO: 978518 - RNA, 23 nt, Homo sapiens
cagcgagaggcagagaaagaaga

SEQ ID NO: 978519 - RNA, 14 nt, Homo sapiens
cagcugaacagcca

SEQ ID NO: 978520 - RNA, 15 nt, Homo sapiens
caggaacucccagca

SEQ ID NO: 978521 - RNA, 16 nt, Homo sapiens
caggaagaugaaagag

SEQ ID NO: 978522 - RNA, 18 nt, Homo sapiens
caggaagggaaagccaga

SEQ ID NO: 978523 - RNA, 14 nt, Homo sapiens
caggccaggccacc

SEQ ID NO: 978524 - RNA, 13 nt, Homo sapiens
cagggcaucccau

SEQ ID NO: 978525 - RNA, 23 nt, Homo sapiens
caggggucucccuggagugcagu

SEQ ID NO: 978526 - RNA, 20 nt, Homo sapiens
caggguugaucacacucugg

SEQ ID NO: 978527 - RNA, 15 nt, Homo sapiens
cagguaaugagggac

SEQ ID NO: 978528 - RNA, 16 nt, Homo sapiens
caguguuugcaauggu

SEQ ID NO: 978529 - RNA, 14 nt, Homo sapiens
caguugacagcagg

SEQ ID NO: 978530 - RNA, 10 nt, Homo sapiens
caucccaugg

SEQ ID NO: 978531 - RNA, 15 nt, Homo sapiens
cauccccuuuccucc

SEQ ID NO: 978532 - RNA, 19 nt, Homo sapiens
cauggacaccccuuaucca

SEQ ID NO: 978533 - RNA, 12 nt, Homo sapiens
cauggugcagug

SEQ ID NO: 978534 - RNA, 18 nt, Homo sapiens
ccacaaucugggacuuuc

SEQ ID NO: 978535 - RNA, 11 nt, Homo sapiens
ccacagggaac

SEQ ID NO: 978536 - RNA, 21 nt, Homo sapiens
ccagaauaaaacgcaaagggc

SEQ ID NO: 978537 - RNA, 15 nt, Homo sapiens
ccagacucagcucca

SEQ ID NO: 978538 - RNA, 13 nt, Homo sapiens
ccauagauggguc

SEQ ID NO: 978539 - RNA, 14 nt, Homo sapiens
ccaugaagaccaca

SEQ ID NO: 978540 - RNA, 21 nt, Homo sapiens
ccaugacgcacugcucaagaa

SEQ ID NO: 978541 - RNA, 16 nt, Homo sapiens
ccaugggggugcugca

SEQ ID NO: 978542 - RNA, 14 nt, Homo sapiens
cccagagaccccuu

SEQ ID NO: 978543 - RNA, 16 nt, Homo sapiens
cccagcaacacaagcu

SEQ ID NO: 978544 - RNA, 17 nt, Homo sapiens
cccagggggcggggugc

SEQ ID NO: 978545 - RNA, 20 nt, Homo sapiens
ccccucauuguuuauuaaca

SEQ ID NO: 978546 - RNA, 22 nt, Homo sapiens
cccgccgccuccugcaccgaga

SEQ ID NO: 978547 - RNA, 13 nt, Homo sapiens
cccugaacaucug

SEQ ID NO: 978548 - RNA, 20 nt, Homo sapiens
cccuggcugaccccaaagag

SEQ ID NO: 978549 - RNA, 16 nt, Homo sapiens
ccgagagagauggaau

SEQ ID NO: 978550 - RNA, 18 nt, Homo sapiens
ccucuaagccacucuucc

SEQ ID NO: 978551 - RNA, 17 nt, Homo sapiens
ccucugcagcacuuuaa

SEQ ID NO: 978552 - RNA, 24 nt, Homo sapiens
ccugcaccgagagagauggaauaa

SEQ ID NO: 978553 - RNA, 15 nt, Homo sapiens
ccugccucugacuca

SEQ ID NO: 978554 - RNA, 17 nt, Homo sapiens
aaaaagaggcauuccag

SEQ ID NO: 978555 - RNA, 13 nt, Homo sapiens
aaaaauauuauaa

SEQ ID NO: 978556 - RNA, 22 nt, Homo sapiens
aaaacucugggaaauaagagag

SEQ ID NO: 978557 - RNA, 22 nt, Homo sapiens
aaaaguuuggccgggugcggug

SEQ ID NO: 978558 - RNA, 15 nt, Homo sapiens
aaaauagcucuuuca

SEQ ID NO: 978559 - RNA, 14 nt, Homo sapiens
aaaaucaacuguau

SEQ ID NO: 978560 - RNA, 23 nt, Homo sapiens
aaacgccuuuuauucuauuuaca

SEQ ID NO: 978561 - RNA, 19 nt, Homo sapiens
aaacuuguaaaugcuguca

SEQ ID NO: 978562 - RNA, 16 nt, Homo sapiens
aaagagccuggagaag

SEQ ID NO: 978563 - RNA, 15 nt, Homo sapiens
aaagcccuugaacca

SEQ ID NO: 978564 - RNA, 22 nt, Homo sapiens
aaagccucuggaaaacucagga

SEQ ID NO: 978565 - RNA, 13 nt, Homo sapiens
aaaggcauaugca

SEQ ID NO: 978566 - RNA, 22 nt, Homo sapiens
aaagguugacaauaaaugugcu

SEQ ID NO: 978567 - RNA, 23 nt, Homo sapiens
aaauacacagaugauaauaugcu

SEQ ID NO: 978568 - RNA, 17 nt, Homo sapiens
aaaugcauggugcaguu

SEQ ID NO: 978569 - RNA, 22 nt, Homo sapiens
aaaugugacccagauccucaca

SEQ ID NO: 978570 - RNA, 16 nt, Homo sapiens
aaauguuauuauguca

SEQ ID NO: 978571 - RNA, 20 nt, Homo sapiens
aacaagguucccucugagaa

SEQ ID NO: 978572 - RNA, 15 nt, Homo sapiens
aacagccaaaugcau

SEQ ID NO: 978573 - RNA, 16 nt, Homo sapiens
aacgccuuuuauucua

SEQ ID NO: 978574 - RNA, 18 nt, Homo sapiens
aacuacgggcugcucuac

SEQ ID NO: 978575 - RNA, 13 nt, Homo sapiens
aacuacugugauc

SEQ ID NO: 978576 - RNA, 17 nt, Homo sapiens
aacucgcacaaccauga

SEQ ID NO: 978577 - RNA, 19 nt, Homo sapiens
aacucuccuacacuuccau

SEQ ID NO: 978578 - RNA, 13 nt, Homo sapiens
aacugcgugccag

SEQ ID NO: 978579 - RNA, 17 nt, Homo sapiens
aagaaugaauaauaauu

SEQ ID NO: 978580 - RNA, 21 nt, Homo sapiens
aagacaggucuagacuuucuc

SEQ ID NO: 978581 - RNA, 17 nt, Homo sapiens
aagcagauuuaacaauu

SEQ ID NO: 978582 - RNA, 16 nt, Homo sapiens
aagccuuuugcucaca

SEQ ID NO: 978583 - RNA, 18 nt, Homo sapiens
aagccuuuugcucacaaa

SEQ ID NO: 978584 - RNA, 19 nt, Homo sapiens
aaggggcacgccugcccag

SEQ ID NO: 978585 - RNA, 17 nt, Homo sapiens
aaggucgagacauuccu

SEQ ID NO: 978586 - RNA, 13 nt, Homo sapiens
aauaaaauguuau

SEQ ID NO: 978587 - RNA, 13 nt, Homo sapiens
aauaaagcccuug

SEQ ID NO: 978588 - RNA, 20 nt, Homo sapiens
aauaaagcccuugaaccagc

SEQ ID NO: 978589 - RNA, 14 nt, Homo sapiens
aauagccauaugca

SEQ ID NO: 978590 - RNA, 14 nt, Homo sapiens
aaugcauggugcag

SEQ ID NO: 978591 - RNA, 22 nt, Homo sapiens
aauggugcaaauccuacugaau

SEQ ID NO: 978592 - RNA, 21 nt, Homo sapiens
aauuagcugugugaaauacca

SEQ ID NO: 978593 - RNA, 18 nt, Homo sapiens
aauuauuauauguaacug

SEQ ID NO: 978594 - RNA, 23 nt, Homo sapiens
aauuuaaaaauaagaaaauacau

SEQ ID NO: 978595 - RNA, 20 nt, Homo sapiens
aauuuauuucaaaaagggaa

SEQ ID NO: 978596 - RNA, 22 nt, Homo sapiens
acaaacucgcacaaccaugacg

SEQ ID NO: 978597 - RNA, 17 nt, Homo sapiens
acaaauuauguuacauc

SEQ ID NO: 978598 - RNA, 18 nt, Homo sapiens
acaaucugggacuuucac

SEQ ID NO: 978599 - RNA, 19 nt, Homo sapiens
acacuauaaagguugacaa

SEQ ID NO: 978600 - RNA, 15 nt, Homo sapiens
acacugaaguuaaca

SEQ ID NO: 978601 - RNA, 19 nt, Homo sapiens
acagaggauuguauugcaa

SEQ ID NO: 978602 - RNA, 13 nt, Homo sapiens
acagcagugcaua

SEQ ID NO: 978603 - RNA, 20 nt, Homo sapiens
acauacagagguaacuauca

SEQ ID NO: 978604 - RNA, 17 nt, Homo sapiens
accaggacuauagccca

SEQ ID NO: 978605 - RNA, 13 nt, Homo sapiens
accauaacagcca

SEQ ID NO: 978606 - RNA, 16 nt, Homo sapiens
accaugcgcugcucaa

SEQ ID NO: 978607 - RNA, 14 nt, Homo sapiens
acccacuccucacu

SEQ ID NO: 978608 - RNA, 13 nt, Homo sapiens
accucuugggcau

SEQ ID NO: 978609 - RNA, 16 nt, Homo sapiens
accuggcacaauggcu

SEQ ID NO: 978610 - RNA, 15 nt, Homo sapiens
acgccuguaauccca

SEQ ID NO: 978611 - RNA, 20 nt, Homo sapiens
acuagaauagugcauuguau

SEQ ID NO: 978612 - RNA, 19 nt, Homo sapiens
acuccagugcccaccagcc

SEQ ID NO: 978613 - RNA, 15 nt, Homo sapiens
acuccaguggugaag

SEQ ID NO: 978614 - RNA, 22 nt, Homo sapiens
acucuggguuuauuacauggca

SEQ ID NO: 978615 - RNA, 21 nt, Homo sapiens
acugcgugccaguguccccac

SEQ ID NO: 978616 - RNA, 22 nt, Homo sapiens
acugcucaagaacuacgggcug

SEQ ID NO: 978617 - RNA, 17 nt, Homo sapiens
acuuaaaaaaaugacag

SEQ ID NO: 978618 - RNA, 16 nt, Homo sapiens
acuucacaauguauau

SEQ ID NO: 978619 - RNA, 16 nt, Homo sapiens
acuuccauuaacuuag

SEQ ID NO: 978620 - RNA, 21 nt, Homo sapiens
acuugaaucaaagcaguuaac

SEQ ID NO: 978621 - RNA, 18 nt, Homo sapiens
acuuuaacccucucuucc

SEQ ID NO: 978622 - RNA, 13 nt, Homo sapiens
agaaacucaccau

SEQ ID NO: 978623 - RNA, 19 nt, Homo sapiens
agacaggucuagacuuucu

SEQ ID NO: 978624 - RNA, 19 nt, Homo sapiens
agacauuccugcgcauggu

SEQ ID NO: 978625 - RNA, 14 nt, Homo sapiens
agagaacaacuacu

SEQ ID NO: 978626 - RNA, 22 nt, Homo sapiens
agagagauggaauaaagcccuu

SEQ ID NO: 978627 - RNA, 15 nt, Homo sapiens
agagccagcucucuc

SEQ ID NO: 978628 - RNA, 14 nt, Homo sapiens
agagccuggagaag

SEQ ID NO: 978629 - RNA, 13 nt, Homo sapiens
agaggagguuugg

SEQ ID NO: 978630 - RNA, 13 nt, Homo sapiens
agaggcagagaaa

SEQ ID NO: 978631 - RNA, 21 nt, Homo sapiens
agagguaaaagugugagcagu

SEQ ID NO: 978632 - RNA, 12 nt, Homo sapiens
agaguagucaug

SEQ ID NO: 978633 - RNA, 22 nt, Homo sapiens
agagucaggaagggaaagccag

SEQ ID NO: 978634 - RNA, 13 nt, Homo sapiens
agauaacucuccu

SEQ ID NO: 978635 - RNA, 13 nt, Homo sapiens
agauaacugagaa

SEQ ID NO: 978636 - RNA, 17 nt, Homo sapiens
agauggaauaaagcccu

SEQ ID NO: 978637 - RNA, 23 nt, Homo sapiens
gcuuaaggagaggagaaacugag

SEQ ID NO: 978638 - RNA, 14 nt, Homo sapiens
gcuuaggauguuuu

SEQ ID NO: 978639 - RNA, 14 nt, Homo sapiens
ggaaaacucaggau

SEQ ID NO: 978640 - RNA, 16 nt, Homo sapiens
ggaaaagaggaguuuc

SEQ ID NO: 978641 - RNA, 12 nt, Homo sapiens
ggaaaaugugac

SEQ ID NO: 978642 - RNA, 22 nt, Homo sapiens
ggaacuagagggauacacugaa

SEQ ID NO: 978643 - RNA, 21 nt, Homo sapiens
ggacuccccaggccaggccac

SEQ ID NO: 978644 - RNA, 21 nt, Homo sapiens
ggauccuauucucaccaggaa

SEQ ID NO: 978645 - RNA, 15 nt, Homo sapiens
ggcaagggguuucca

SEQ ID NO: 978646 - RNA, 23 nt, Homo sapiens
ggcuuaaggagaggagaaacuga

SEQ ID NO: 978647 - RNA, 14 nt, Homo sapiens
ggcuugcaugccaa

SEQ ID NO: 978648 - RNA, 21 nt, Homo sapiens
gggaagcugggggaagggugg

SEQ ID NO: 978649 - RNA, 16 nt, Homo sapiens
gggcagcccagccucu

SEQ ID NO: 978650 - RNA, 15 nt, Homo sapiens
gggggccgugcccag

SEQ ID NO: 978651 - RNA, 15 nt, Homo sapiens
gguaaaaguuacuua

SEQ ID NO: 978652 - RNA, 12 nt, Homo sapiens
gguaugagcuga

SEQ ID NO: 978653 - RNA, 18 nt, Homo sapiens
ggugcaaauccuacugaa

SEQ ID NO: 978654 - RNA, 18 nt, Homo sapiens
ggugcaguugacagcagg

SEQ ID NO: 978655 - RNA, 16 nt, Homo sapiens
gguggaucuguccaag

SEQ ID NO: 978656 - RNA, 16 nt, Homo sapiens
gguggcucuccaguua

SEQ ID NO: 978657 - RNA, 18 nt, Homo sapiens
gguugaucacacucuggg

SEQ ID NO: 978658 - RNA, 15 nt, Homo sapiens
guaaagaaguuugau

SEQ ID NO: 978659 - RNA, 14 nt, Homo sapiens
guacagugagccaa

SEQ ID NO: 978660 - RNA, 23 nt, Homo sapiens
guauaaauguuauguuugcuaaa

SEQ ID NO: 978661 - RNA, 14 nt, Homo sapiens
guauauugucagau

SEQ ID NO: 978662 - RNA, 21 nt, Homo sapiens
gucaggaagggaaagccagaa

SEQ ID NO: 978663 - RNA, 19 nt, Homo sapiens
gucugauuggcucacccaa

SEQ ID NO: 978664 - RNA, 21 nt, Homo sapiens
gucugauuggcucacccaagc

SEQ ID NO: 978665 - RNA, 20 nt, Homo sapiens
ccugccucugacucacacuu

SEQ ID NO: 978666 - RNA, 18 nt, Homo sapiens
ccugcgcauggugcagug

SEQ ID NO: 978667 - RNA, 19 nt, Homo sapiens
ccugcugaaagcaguguau

SEQ ID NO: 978668 - RNA, 19 nt, Homo sapiens
ccuugaaggucacucuucc

SEQ ID NO: 978669 - RNA, 23 nt, Homo sapiens
cgacgguuucaaaccaggauuuu

SEQ ID NO: 978670 - RNA, 22 nt, Homo sapiens
cgccuguaaucccagcacuuug

SEQ ID NO: 978671 - RNA, 15 nt, Homo sapiens
cgggaggcugagaca

SEQ ID NO: 978672 - RNA, 15 nt, Homo sapiens
cuaaaacugcugaac

SEQ ID NO: 978673 - RNA, 23 nt, Homo sapiens
cuaauaaaauuaaguuguaucau

SEQ ID NO: 978674 - RNA, 23 nt, Homo sapiens
cuacccggcccagagaccccuuc

SEQ ID NO: 978675 - RNA, 14 nt, Homo sapiens
cuacuaaaaacaca

SEQ ID NO: 978676 - RNA, 20 nt, Homo sapiens
cucagcuccagaauaccuuc

SEQ ID NO: 978677 - RNA, 16 nt, Homo sapiens
cucccccugcuucuca

SEQ ID NO: 978678 - RNA, 15 nt, Homo sapiens
cucccuggccucacg

SEQ ID NO: 978679 - RNA, 16 nt, Homo sapiens
cuccggccugaugaca

SEQ ID NO: 978680 - RNA, 20 nt, Homo sapiens
cuccuuaauagccauaugca

SEQ ID NO: 978681 - RNA, 19 nt, Homo sapiens
cuccuuuugcuugaaacca

SEQ ID NO: 978682 - RNA, 17 nt, Homo sapiens
cucgcaugccagagccu

SEQ ID NO: 978683 - RNA, 19 nt, Homo sapiens
cucuaagccacucuuccaa

SEQ ID NO: 978684 - RNA, 23 nt, Homo sapiens
cucuccuggcccugaaggugcca

SEQ ID NO: 978685 - RNA, 15 nt, Homo sapiens
cucugauacccagag

SEQ ID NO: 978686 - RNA, 14 nt, Homo sapiens
cucugcagcacuuu

SEQ ID NO: 978687 - RNA, 15 nt, Homo sapiens
cugaaagcaguguau

SEQ ID NO: 978688 - RNA, 15 nt, Homo sapiens
cugaaagccauuugu

SEQ ID NO: 978689 - RNA, 15 nt, Homo sapiens
cugaacccauuuuga

SEQ ID NO: 978690 - RNA, 18 nt, Homo sapiens
cugaaugccucaauguga

SEQ ID NO: 978691 - RNA, 21 nt, Homo sapiens
cugaggggggccgugcccagg

SEQ ID NO: 978692 - RNA, 16 nt, Homo sapiens
cugcagccugguagaa

SEQ ID NO: 978693 - RNA, 13 nt, Homo sapiens
cuggcugagcuga

SEQ ID NO: 978694 - RNA, 16 nt, Homo sapiens
cugucuuccacuguac

SEQ ID NO: 978695 - RNA, 12 nt, Homo sapiens
cuguguacccac

SEQ ID NO: 978696 - RNA, 21 nt, Homo sapiens
cuuaagccuuuugcucacaaa

SEQ ID NO: 978697 - RNA, 13 nt, Homo sapiens
cuucacaguguuu

SEQ ID NO: 978698 - RNA, 17 nt, Homo sapiens
cuugaaucaaagcaguu

SEQ ID NO: 978699 - RNA, 13 nt, Homo sapiens
cuuguccuaauaa

SEQ ID NO: 978700 - RNA, 12 nt, Homo sapiens
cuuuuguaccag

SEQ ID NO: 978701 - RNA, 18 nt, Homo sapiens
gaaaauacauaagaccau

SEQ ID NO: 978702 - RNA, 15 nt, Homo sapiens
gaacuacgggcugcu

SEQ ID NO: 978703 - RNA, 18 nt, Homo sapiens
gaacugcgugccaguguc

SEQ ID NO: 978704 - RNA, 14 nt, Homo sapiens
gaauaaagcccuug

SEQ ID NO: 978705 - RNA, 16 nt, Homo sapiens
gaauaaagcccuugaa

SEQ ID NO: 978706 - RNA, 17 nt, Homo sapiens
gaauaaagcccuugaac

SEQ ID NO: 978707 - RNA, 12 nt, Homo sapiens
gaaugucucagc

SEQ ID NO: 978708 - RNA, 14 nt, Homo sapiens
gacaaaccagagca

SEQ ID NO: 978709 - RNA, 12 nt, Homo sapiens
gaccccaaagag

SEQ ID NO: 978710 - RNA, 20 nt, Homo sapiens
gacccucugaaugguccagg

SEQ ID NO: 978711 - RNA, 19 nt, Homo sapiens
gacucacacuugggcgcuc

SEQ ID NO: 978712 - RNA, 16 nt, Homo sapiens
gacuccucuaagccac

SEQ ID NO: 978713 - RNA, 23 nt, Homo sapiens
gacugauguuacaucacaguguu

SEQ ID NO: 978714 - RNA, 11 nt, Homo sapiens
gacugauuacc

SEQ ID NO: 978715 - RNA, 14 nt, Homo sapiens
gagacagauaacuc

SEQ ID NO: 978716 - RNA, 14 nt, Homo sapiens
gagagcaggacagg

SEQ ID NO: 978717 - RNA, 19 nt, Homo sapiens
gagauggaauaaagcccuu

SEQ ID NO: 978718 - RNA, 15 nt, Homo sapiens
gagcauuacgugagc

SEQ ID NO: 978719 - RNA, 12 nt, Homo sapiens
gagccuggagaa

SEQ ID NO: 978720 - RNA, 17 nt, Homo sapiens
gagccuggggcauccca

SEQ ID NO: 978721 - RNA, 18 nt, Homo sapiens
gagccuggggcaucccag

SEQ ID NO: 978722 - RNA, 20 nt, Homo sapiens
gagcucuggcuuugcaaggg

SEQ ID NO: 978723 - RNA, 22 nt, Homo sapiens
gagcugaacccauuuugaguga

SEQ ID NO: 978724 - RNA, 14 nt, Homo sapiens
gaggagaaacugag

SEQ ID NO: 978725 - RNA, 19 nt, Homo sapiens
gaggcggagaguacaguga

SEQ ID NO: 978726 - RNA, 18 nt, Homo sapiens
gaggcugagacaggagaa

SEQ ID NO: 978727 - RNA, 21 nt, Homo sapiens
gagguaaaagugugagcagug

SEQ ID NO: 978728 - RNA, 16 nt, Homo sapiens
gaggucacauucagga

SEQ ID NO: 978729 - RNA, 19 nt, Homo sapiens
gagguuuggggucugccac

SEQ ID NO: 978730 - RNA, 14 nt, Homo sapiens
gagucucuguauaa

SEQ ID NO: 978731 - RNA, 19 nt, Homo sapiens
gagugcaguuuccaauccc

SEQ ID NO: 978732 - RNA, 15 nt, Homo sapiens
gauaauaugcuaaau

SEQ ID NO: 978733 - RNA, 13 nt, Homo sapiens
gauacccagagca

SEQ ID NO: 978734 - RNA, 16 nt, Homo sapiens
gauacccagagcauua

SEQ ID NO: 978735 - RNA, 13 nt, Homo sapiens
gauauuaaaggag

SEQ ID NO: 978736 - RNA, 16 nt, Homo sapiens
gaucacuggcaaugaa

SEQ ID NO: 978737 - RNA, 20 nt, Homo sapiens
gaucuugcauucccaguggu

SEQ ID NO: 978738 - RNA, 18 nt, Homo sapiens
gauggaauaaagcccuug

SEQ ID NO: 978739 - RNA, 18 nt, Homo sapiens
gaugucacaugucagaga

SEQ ID NO: 978740 - RNA, 17 nt, Homo sapiens
gauguuacaucacagug

SEQ ID NO: 978741 - RNA, 15 nt, Homo sapiens
gauucccaccaaggu

SEQ ID NO: 978742 - RNA, 19 nt, Homo sapiens
gcaaagggcugaaagccau

SEQ ID NO: 978743 - RNA, 18 nt, Homo sapiens
gcaaagguggcucuccag

SEQ ID NO: 978744 - RNA, 21 nt, Homo sapiens
gcaaggacggccuucaacuga

SEQ ID NO: 978745 - RNA, 22 nt, Homo sapiens
gcacuuuaacccucucuucccu

SEQ ID NO: 978746 - RNA, 18 nt, Homo sapiens
gcagaggugagcagagga

SEQ ID NO: 978747 - RNA, 15 nt, Homo sapiens
gcagcccagccucug

SEQ ID NO: 978748 - RNA, 17 nt, Homo sapiens
gcagccccacacccgcc

SEQ ID NO: 978749 - RNA, 22 nt, Homo sapiens
gcaggaacucccagcaacacaa

SEQ ID NO: 978750 - RNA, 14 nt, Homo sapiens
gcaggcagccccac

SEQ ID NO: 978751 - RNA, 19 nt, Homo sapiens
gcagggguccuugguguga

SEQ ID NO: 978752 - RNA, 23 nt, Homo sapiens
gcagggguccuuggugugacccu

SEQ ID NO: 978753 - RNA, 13 nt, Homo sapiens
gcaguacauguua

SEQ ID NO: 978754 - RNA, 17 nt, Homo sapiens
gcaucucuguguaccca

SEQ ID NO: 978755 - RNA, 23 nt, Homo sapiens
gcaucugggauucccaccaaggu

SEQ ID NO: 978756 - RNA, 20 nt, Homo sapiens
gcaugaaagagaaagacuga

SEQ ID NO: 978757 - RNA, 22 nt, Homo sapiens
gcauugaauauauuauaaucuu

SEQ ID NO: 978758 - RNA, 20 nt, Homo sapiens
gccaagaucgcgccacugca

SEQ ID NO: 978759 - RNA, 21 nt, Homo sapiens
gccagagccuggggcauccca

SEQ ID NO: 978760 - RNA, 22 nt, Homo sapiens
gccagagccuggggcaucccag

SEQ ID NO: 978761 - RNA, 21 nt, Homo sapiens
gcccccagcagauggaaagaa

SEQ ID NO: 978762 - RNA, 13 nt, Homo sapiens
gcccugaacaaaa

SEQ ID NO: 978763 - RNA, 19 nt, Homo sapiens
gcccugaaggugccacucc

SEQ ID NO: 978764 - RNA, 22 nt, Homo sapiens
gccgugcucgcccacaaacuga

SEQ ID NO: 978765 - RNA, 12 nt, Homo sapiens
gccucuggaaaa

SEQ ID NO: 978766 - RNA, 17 nt, Homo sapiens
gccugugugagcaucuc

SEQ ID NO: 978767 - RNA, 12 nt, Homo sapiens
gcgcauggugca

SEQ ID NO: 978768 - RNA, 23 nt, Homo sapiens
gcgggagugggggcugugccgug

SEQ ID NO: 978769 - RNA, 19 nt, Homo sapiens
gcucagcccugacuggugc

SEQ ID NO: 978770 - RNA, 17 nt, Homo sapiens
gcucccccugcuucuca

SEQ ID NO: 978771 - RNA, 16 nt, Homo sapiens
gcugagcugaacccau

SEQ ID NO: 978772 - RNA, 12 nt, Homo sapiens
gcuggaagcaca

SEQ ID NO: 978773 - RNA, 21 nt, Homo sapiens
gcuggugucugagcuucagua

SEQ ID NO: 978774 - RNA, 15 nt, Homo sapiens
gcuguggccagggug

SEQ ID NO: 978775 - RNA, 16 nt, Homo sapiens
aaaaaggcauaugcaa

SEQ ID NO: 978776 - RNA, 17 nt, Homo sapiens
aaaaaggcauaugcaau

SEQ ID NO: 978777 - RNA, 16 nt, Homo sapiens
aaaagaauacagaaag

SEQ ID NO: 978778 - RNA, 16 nt, Homo sapiens
aaaagugugagcagug

SEQ ID NO: 978779 - RNA, 15 nt, Homo sapiens
aaacagagaugugau

SEQ ID NO: 978780 - RNA, 11 nt, Homo sapiens
aaacugcugaa

SEQ ID NO: 978781 - RNA, 21 nt, Homo sapiens
aaagaagacgcucagcacugu

SEQ ID NO: 978782 - RNA, 14 nt, Homo sapiens
aaagaauacagaaa

SEQ ID NO: 978783 - RNA, 20 nt, Homo sapiens
aaagacaaaacuuccuguuu

SEQ ID NO: 978784 - RNA, 16 nt, Homo sapiens
aaagauguuugucaga

SEQ ID NO: 978785 - RNA, 10 nt, Homo sapiens
aaagcagugu

SEQ ID NO: 978786 - RNA, 15 nt, Homo sapiens
aaagccaacagucaa

SEQ ID NO: 978787 - RNA, 17 nt, Homo sapiens
aaagcccuugaaccagc

SEQ ID NO: 978788 - RNA, 13 nt, Homo sapiens
aaaggaaucucca

SEQ ID NO: 978789 - RNA, 14 nt, Homo sapiens
aaaguuucagagaa

SEQ ID NO: 978790 - RNA, 17 nt, Homo sapiens
aaaugacagauguugaa

SEQ ID NO: 978791 - RNA, 19 nt, Homo sapiens
ugcuauauaaacuuuaaca

SEQ ID NO: 978792 - RNA, 23 nt, Homo sapiens
ugcuucaggaaggacauggacaa

SEQ ID NO: 978793 - RNA, 14 nt, Homo sapiens
ugcuucaugcucag

SEQ ID NO: 978794 - RNA, 14 nt, Homo sapiens
uggaagcacauguu

SEQ ID NO: 978795 - RNA, 18 nt, Homo sapiens
uggcaacaacaaagccaa

SEQ ID NO: 978796 - RNA, 14 nt, Homo sapiens
uggcccuucuugcc

SEQ ID NO: 978797 - RNA, 19 nt, Homo sapiens
uggcgcaagagaacauuuc

SEQ ID NO: 978798 - RNA, 18 nt, Homo sapiens
ugggucuuuguacauuuu

SEQ ID NO: 978799 - RNA, 12 nt, Homo sapiens
ugguacaaggaa

SEQ ID NO: 978800 - RNA, 20 nt, Homo sapiens
uggucuuuccuaucauggag

SEQ ID NO: 978801 - RNA, 20 nt, Homo sapiens
uggugcuguggccaggguga

SEQ ID NO: 978802 - RNA, 15 nt, Homo sapiens
ugguggaucugucca

SEQ ID NO: 978803 - RNA, 18 nt, Homo sapiens
uguaaaagagucaucugg

SEQ ID NO: 978804 - RNA, 12 nt, Homo sapiens
uguaaccaaaaa

SEQ ID NO: 978805 - RNA, 10 nt, Homo sapiens
uguacauuuc

SEQ ID NO: 978806 - RNA, 12 nt, Homo sapiens
uguacauuucac

SEQ ID NO: 978807 - RNA, 18 nt, Homo sapiens
ugucccccuaugcuccag

SEQ ID NO: 978808 - RNA, 21 nt, Homo sapiens
ugucccucuuugccuguguga

SEQ ID NO: 978809 - RNA, 14 nt, Homo sapiens
ugucugcacccagg

SEQ ID NO: 978810 - RNA, 22 nt, Homo sapiens
ugucuuguccccucuugaccca

SEQ ID NO: 978811 - RNA, 12 nt, Homo sapiens
uguggcuucuag

SEQ ID NO: 978812 - RNA, 22 nt, Homo sapiens
uguguacccacuccucacugcc

SEQ ID NO: 978813 - RNA, 15 nt, Homo sapiens
uguguggcaguucuc

SEQ ID NO: 978814 - RNA, 16 nt, Homo sapiens
uguuggggcaguggua

SEQ ID NO: 978815 - RNA, 16 nt, Homo sapiens
uguuuguggaacaaaa

SEQ ID NO: 978816 - RNA, 17 nt, Homo sapiens
uuaacugugaaccugga

SEQ ID NO: 978817 - RNA, 17 nt, Homo sapiens
uuaagcuuaugucagac

SEQ ID NO: 978818 - RNA, 16 nt, Homo sapiens
uuaagggaaggaacuc

SEQ ID NO: 978819 - RNA, 22 nt, Homo sapiens
uuacguccacaccgagcccagu

SEQ ID NO: 978820 - RNA, 12 nt, Homo sapiens
uuacuccagugg

SEQ ID NO: 978821 - RNA, 14 nt, Homo sapiens
uuauguuugcuaaa

SEQ ID NO: 978822 - RNA, 13 nt, Homo sapiens
uucaaaccaggau

SEQ ID NO: 978823 - RNA, 20 nt, Homo sapiens
uucacaaaaaggcauaugca

SEQ ID NO: 978824 - RNA, 13 nt, Homo sapiens
uucagugcuucuu

SEQ ID NO: 978825 - RNA, 20 nt, Homo sapiens
uuccaaaggcauaagacccu

SEQ ID NO: 978826 - RNA, 22 nt, Homo sapiens
uucccacuggaggucacauuca

SEQ ID NO: 978827 - RNA, 22 nt, Homo sapiens
uuccucuauccuguacauuuca

SEQ ID NO: 978828 - RNA, 12 nt, Homo sapiens
uucuauuuacaa

SEQ ID NO: 978829 - RNA, 15 nt, Homo sapiens
uucucucguaacugg

SEQ ID NO: 978830 - RNA, 15 nt, Homo sapiens
uucuguaaccaaaaa

SEQ ID NO: 978831 - RNA, 20 nt, Homo sapiens
uucuuguauauuauggaaga

SEQ ID NO: 978832 - RNA, 13 nt, Homo sapiens
uugaaaccaaaga

SEQ ID NO: 978833 - RNA, 20 nt, Homo sapiens
uugaggccugcccucaggga

SEQ ID NO: 978834 - RNA, 22 nt, Homo sapiens
uugcaagacaaaguugaaugua

SEQ ID NO: 978835 - RNA, 11 nt, Homo sapiens
uugcacuuugu

SEQ ID NO: 978836 - RNA, 17 nt, Homo sapiens
uugcccuucacaguguu

SEQ ID NO: 978837 - RNA, 17 nt, Homo sapiens
uuggcgggcagcccagc

SEQ ID NO: 978838 - RNA, 17 nt, Homo sapiens
uuguaccagugugaaua

SEQ ID NO: 978839 - RNA, 16 nt, Homo sapiens
uuguauauuauggaag

SEQ ID NO: 978840 - RNA, 12 nt, Homo sapiens
uuguauugcaag

SEQ ID NO: 978841 - RNA, 16 nt, Homo sapiens
uuguugcugucaagau

SEQ ID NO: 978842 - RNA, 20 nt, Homo sapiens
uuuacagaauggaaccaaaa

SEQ ID NO: 978843 - RNA, 22 nt, Homo sapiens
uuucccaccaccuuggacuccu

SEQ ID NO: 978844 - RNA, 13 nt, Homo sapiens
uuuccuccccacc

SEQ ID NO: 978845 - RNA, 23 nt, Homo sapiens
uuucugcucccucgacacuugau

SEQ ID NO: 978846 - RNA, 21 nt, Homo sapiens
uuucuggauaucaagauguua

SEQ ID NO: 978847 - RNA, 17 nt, Homo sapiens
uuugcuaucacacagug

SEQ ID NO: 978848 - RNA, 17 nt, Homo sapiens
uuugguuaccaauuuaa

SEQ ID NO: 978849 - RNA, 15 nt, Homo sapiens
uuuguaccaguguga

SEQ ID NO: 978850 - RNA, 22 nt, Homo sapiens
aaucccuguaggcgugcuagca

SEQ ID NO: 978851 - RNA, 16 nt, Homo sapiens
aaugugaccaggggug

SEQ ID NO: 978852 - RNA, 21 nt, Homo sapiens
aauuauacaucacagcagugc

SEQ ID NO: 978853 - RNA, 17 nt, Homo sapiens
aauuauauuguccuccc

SEQ ID NO: 978854 - RNA, 15 nt, Homo sapiens
aauuuauuucaaaaa

SEQ ID NO: 978855 - RNA, 17 nt, Homo sapiens
acaaaaaggcauaugca

SEQ ID NO: 978856 - RNA, 23 nt, Homo sapiens
acaaaauuagcugaagaaguuau

SEQ ID NO: 978857 - RNA, 16 nt, Homo sapiens
acaaauuauguuacau

SEQ ID NO: 978858 - RNA, 12 nt, Homo sapiens
acaaucugggac

SEQ ID NO: 978859 - RNA, 17 nt, Homo sapiens
acacugaaguuaacaga

SEQ ID NO: 978860 - RNA, 20 nt, Homo sapiens
acagagcgagauuccgucuu

SEQ ID NO: 978861 - RNA, 19 nt, Homo sapiens
acagguggcaggaccagga

SEQ ID NO: 978862 - RNA, 19 nt, Homo sapiens
acaguccuaccucaguuca

SEQ ID NO: 978863 - RNA, 22 nt, Homo sapiens
acauaacacuauaaagguugac

SEQ ID NO: 978864 - RNA, 20 nt, Homo sapiens
acauaagaccauaacagcca

SEQ ID NO: 978865 - RNA, 21 nt, Homo sapiens
accaaaauguauaaauguuau

SEQ ID NO: 978866 - RNA, 14 nt, Homo sapiens
accauaacagccaa

SEQ ID NO: 978867 - RNA, 16 nt, Homo sapiens
accaugacgcacugcu

SEQ ID NO: 978868 - RNA, 15 nt, Homo sapiens
accaugcgcugcuca

SEQ ID NO: 978869 - RNA, 17 nt, Homo sapiens
accaugcgcugcucaac

SEQ ID NO: 978870 - RNA, 23 nt, Homo sapiens
  misc_feature (7)..(7): n is a, c, g or u
acccagnagggcgucgcuggaca

SEQ ID NO: 978871 - RNA, 12 nt, Homo sapiens
acccccagugug

SEQ ID NO: 978872 - RNA, 22 nt, Homo sapiens
acccggcucccccugcuucuca

SEQ ID NO: 978873 - RNA, 18 nt, Homo sapiens
accgagagagauggaaua

SEQ ID NO: 978874 - RNA, 19 nt, Homo sapiens
accgagagagauggaauaa

SEQ ID NO: 978875 - RNA, 20 nt, Homo sapiens
accucuugggcaugcucagc

SEQ ID NO: 978876 - RNA, 21 nt, Homo sapiens
acgccuguaaucccagcacuu

SEQ ID NO: 978877 - RNA, 14 nt, Homo sapiens
acgugagccaggua

SEQ ID NO: 978878 - RNA, 15 nt, Homo sapiens
acuagaauagugcau

SEQ ID NO: 978879 - RNA, 18 nt, Homo sapiens
acuagagggauacacuga

SEQ ID NO: 978880 - RNA, 13 nt, Homo sapiens
acuccagugguga

SEQ ID NO: 978881 - RNA, 23 nt, Homo sapiens
acugcuucaggaaggacauggac

SEQ ID NO: 978882 - RNA, 13 nt, Homo sapiens
acuggacgcccag

SEQ ID NO: 978883 - RNA, 17 nt, Homo sapiens
acuuuaacccucucuuc

SEQ ID NO: 978884 - RNA, 17 nt, Homo sapiens
acuuugggaggccaagg

SEQ ID NO: 978885 - RNA, 16 nt, Homo sapiens
agaaaauuggauguuu

SEQ ID NO: 978886 - RNA, 12 nt, Homo sapiens
agaaacugagaa

SEQ ID NO: 978887 - RNA, 15 nt, Homo sapiens
agaacaacuacugug

SEQ ID NO: 978888 - RNA, 16 nt, Homo sapiens
agaacaacuacuguga

SEQ ID NO: 978889 - RNA, 22 nt, Homo sapiens
agacauuccugcgcauggugca

SEQ ID NO: 978890 - RNA, 13 nt, Homo sapiens
agaccacauccac

SEQ ID NO: 978891 - RNA, 15 nt, Homo sapiens
agaccugacaagcac

SEQ ID NO: 978892 - RNA, 16 nt, Homo sapiens
agaccugacaagcacu

SEQ ID NO: 978893 - RNA, 18 nt, Homo sapiens
agacucagcuccagaaua

SEQ ID NO: 978894 - RNA, 19 nt, Homo sapiens
agagacagauaacucuccu

SEQ ID NO: 978895 - RNA, 13 nt, Homo sapiens
agagagauggaau

SEQ ID NO: 978896 - RNA, 14 nt, Homo sapiens
agagagauggaaua

SEQ ID NO: 978897 - RNA, 19 nt, Homo sapiens
agaggauuuaacugugaac

SEQ ID NO: 978898 - RNA, 15 nt, Homo sapiens
agagguaacuaucaa

SEQ ID NO: 978899 - RNA, 17 nt, Homo sapiens
agagugugaaacuuccu

SEQ ID NO: 978900 - RNA, 11 nt, Homo sapiens
agauaugauau

SEQ ID NO: 978901 - RNA, 17 nt, Homo sapiens
agaucauuuucuuaucu

SEQ ID NO: 978902 - RNA, 19 nt, Homo sapiens
agaucgcgccacugcacuc

SEQ ID NO: 978903 - RNA, 18 nt, Homo sapiens
agauggaauaaagcccuu

SEQ ID NO: 978904 - RNA, 16 nt, Homo sapiens
agcaauuccagggugg

SEQ ID NO: 978905 - RNA, 23 nt, Homo sapiens
agcacuuuaacccucucuucccu

SEQ ID NO: 978906 - RNA, 19 nt, Homo sapiens
agcaggugguccugagacc

SEQ ID NO: 978907 - RNA, 15 nt, Homo sapiens
agccaaaugcauggu

SEQ ID NO: 978908 - RNA, 20 nt, Homo sapiens
agccaagaucgcgccacugc

SEQ ID NO: 978909 - RNA, 13 nt, Homo sapiens
agcccugacuggu

SEQ ID NO: 978910 - RNA, 19 nt, Homo sapiens
agccuccuuuugcuugaaa

SEQ ID NO: 978911 - RNA, 13 nt, Homo sapiens
agcugcucuggaa

SEQ ID NO: 978912 - RNA, 14 nt, Homo sapiens
agcuggcaaaggug

SEQ ID NO: 978913 - RNA, 19 nt, Homo sapiens
agcuggcaaagguggcucu

SEQ ID NO: 978914 - RNA, 14 nt, Homo sapiens
agcuuaugucagac

SEQ ID NO: 978915 - RNA, 15 nt, Homo sapiens
aggaaaaaaaugacu

SEQ ID NO: 978916 - RNA, 12 nt, Homo sapiens
aggaacucuggc

SEQ ID NO: 978917 - RNA, 21 nt, Homo sapiens
aggaauagucgcgcaagcauc

SEQ ID NO: 978918 - RNA, 19 nt, Homo sapiens
aggagacaagaaauccagu

SEQ ID NO: 978919 - RNA, 22 nt, Homo sapiens
aggagguuuggggucugccacc

SEQ ID NO: 978920 - RNA, 16 nt, Homo sapiens
aggauauuuucuucca

SEQ ID NO: 978921 - RNA, 23 nt, Homo sapiens
aggcaggggugggagagccagcu

SEQ ID NO: 978922 - RNA, 15 nt, Homo sapiens
aggcuauguauggaa

SEQ ID NO: 978923 - RNA, 22 nt, Homo sapiens
agggaaggaacucuggcuucca

SEQ ID NO: 978924 - RNA, 19 nt, Homo sapiens
agggaucuugcauucccag

SEQ ID NO: 978925 - RNA, 22 nt, Homo sapiens
agggaucuugcauucccagugg

SEQ ID NO: 978926 - RNA, 23 nt, Homo sapiens
agggcagcuguggcuucuaggug

SEQ ID NO: 978927 - RNA, 15 nt, Homo sapiens
aggucgagacauucc

SEQ ID NO: 978928 - RNA, 14 nt, Homo sapiens
aggugccacuccag

SEQ ID NO: 978929 - RNA, 16 nt, Homo sapiens
aggugggaaaugguau

SEQ ID NO: 978930 - RNA, 16 nt, Homo sapiens
agucaguaauugccaa

SEQ ID NO: 978931 - RNA, 16 nt, Homo sapiens
agugaguuacagcgag

SEQ ID NO: 978932 - RNA, 21 nt, Homo sapiens
agugccucuccuggcccugaa

SEQ ID NO: 978933 - RNA, 13 nt, Homo sapiens
aguggguggugga

SEQ ID NO: 978934 - RNA, 19 nt, Homo sapiens
agugggugguggaucuguc

SEQ ID NO: 978935 - RNA, 24 nt, Homo sapiens
agugggugguggaucuguccaagg

SEQ ID NO: 978936 - RNA, 16 nt, Homo sapiens
aguguuugcaauggug

SEQ ID NO: 978937 - RNA, 19 nt, Homo sapiens
aguuccaugaagaccacau

SEQ ID NO: 978938 - RNA, 19 nt, Homo sapiens
aguuguucgccgcguggaa

SEQ ID NO: 978939 - RNA, 15 nt, Homo sapiens
auaaagcccuugaac

SEQ ID NO: 978940 - RNA, 18 nt, Homo sapiens
auaaagcccuugaaccag

SEQ ID NO: 978941 - RNA, 17 nt, Homo sapiens
auaugcaauauuuacau

SEQ ID NO: 978942 - RNA, 14 nt, Homo sapiens
aucaaaacucuccu

SEQ ID NO: 978943 - RNA, 17 nt, Homo sapiens
auccaggacucugucaa

SEQ ID NO: 978944 - RNA, 14 nt, Homo sapiens
aucuguccaaggaa

SEQ ID NO: 978945 - RNA, 23 nt, Homo sapiens
aucuuagcuucuauuauagccac

SEQ ID NO: 978946 - RNA, 16 nt, Homo sapiens
augacgcacugcucaa

SEQ ID NO: 978947 - RNA, 16 nt, Homo sapiens
augguaaaaguuacuu

SEQ ID NO: 978948 - RNA, 16 nt, Homo sapiens
augucaaccagugagg

SEQ ID NO: 978949 - RNA, 20 nt, Homo sapiens
auguuuacuuuucagggcau

SEQ ID NO: 978950 - RNA, 19 nt, Homo sapiens
auuccaaggaguuccauga

SEQ ID NO: 978951 - RNA, 22 nt, Homo sapiens
auuccccucgugugacucucuu

SEQ ID NO: 978952 - RNA, 17 nt, Homo sapiens
auucuacccagagccuu

SEQ ID NO: 978953 - RNA, 14 nt, Homo sapiens
auucucaccaggaa

SEQ ID NO: 978954 - RNA, 18 nt, Homo sapiens
auugacgcauauuuaacu

SEQ ID NO: 978955 - RNA, 18 nt, Homo sapiens
auuggagggaagacaggu

SEQ ID NO: 978956 - RNA, 20 nt, Homo sapiens
auuuguuuucuucuguaugu

SEQ ID NO: 978957 - RNA, 16 nt, Homo sapiens
caaaaaggcauaugca

SEQ ID NO: 978958 - RNA, 16 nt, Homo sapiens
caaaacagagauguga

SEQ ID NO: 978959 - RNA, 12 nt, Homo sapiens
caaaacucuccu

SEQ ID NO: 978960 - RNA, 17 nt, Homo sapiens
gugcagaagaauccgag

SEQ ID NO: 978961 - RNA, 23 nt, Homo sapiens
gugcagguaccugcgauguuuac

SEQ ID NO: 978962 - RNA, 15 nt, Homo sapiens
gugcccgaguagcau

SEQ ID NO: 978963 - RNA, 18 nt, Homo sapiens
gugcuauaggcuggagaa

SEQ ID NO: 978964 - RNA, 15 nt, Homo sapiens
gugcugcagccagga

SEQ ID NO: 978965 - RNA, 18 nt, Homo sapiens
gugcugcagccaggagga

SEQ ID NO: 978966 - RNA, 19 nt, Homo sapiens
gugugagcaucucugugua

SEQ ID NO: 978967 - RNA, 22 nt, Homo sapiens
guguuuuugcuaucacacagug

SEQ ID NO: 978968 - RNA, 21 nt, Homo sapiens
guuacaucacaguguuugcaa

SEQ ID NO: 978969 - RNA, 14 nt, Homo sapiens
guuagaugaggcac

SEQ ID NO: 978970 - RNA, 20 nt, Homo sapiens
guuaguguguugucugugca

SEQ ID NO: 978971 - RNA, 23 nt, Homo sapiens
guuuggccgggugcgguggcuca

SEQ ID NO: 978972 - RNA, 19 nt, Homo sapiens
uaaaaucuuggcacagaaa

SEQ ID NO: 978973 - RNA, 12 nt, Homo sapiens
uaaaaugaggcu

SEQ ID NO: 978974 - RNA, 16 nt, Homo sapiens
uaaaguauauauuuau

SEQ ID NO: 978975 - RNA, 13 nt, Homo sapiens
uaaauuuauuuca

SEQ ID NO: 978976 - RNA, 13 nt, Homo sapiens
uaacccucucuuc

SEQ ID NO: 978977 - RNA, 15 nt, Homo sapiens
uaacccucucuuccc

SEQ ID NO: 978978 - RNA, 13 nt, Homo sapiens
uaacuucaaauau

SEQ ID NO: 978979 - RNA, 16 nt, Homo sapiens
uaagaaaauacauaag

SEQ ID NO: 978980 - RNA, 24 nt, Homo sapiens
uaagaguagcaaguucuagagaag

SEQ ID NO: 978981 - RNA, 14 nt, Homo sapiens
uaagccacucuucc

SEQ ID NO: 978982 - RNA, 20 nt, Homo sapiens
uaaggagaggagaaacugag

SEQ ID NO: 978983 - RNA, 11 nt, Homo sapiens
uaaugagggac

SEQ ID NO: 978984 - RNA, 12 nt, Homo sapiens
uacaguguuauu

SEQ ID NO: 978985 - RNA, 12 nt, Homo sapiens
uacauucccugg

SEQ ID NO: 978986 - RNA, 17 nt, Homo sapiens
uagaauuggagaguaaa

SEQ ID NO: 978987 - RNA, 12 nt, Homo sapiens
uagaauugggaa

SEQ ID NO: 978988 - RNA, 15 nt, Homo sapiens
uagcauccugugacc

SEQ ID NO: 978989 - RNA, 22 nt, Homo sapiens
uagcucuccugggguucuggga

SEQ ID NO: 978990 - RNA, 17 nt, Homo sapiens
uagcugagcgugguggc

SEQ ID NO: 978991 - RNA, 20 nt, Homo sapiens
uagguacuucacauugcaaa

SEQ ID NO: 978992 - RNA, 14 nt, Homo sapiens
uauauguaacugaa

SEQ ID NO: 978993 - RNA, 16 nt, Homo sapiens
uauauuuaauggcaau

SEQ ID NO: 978994 - RNA, 16 nt, Homo sapiens
uauggaauacaguguu

SEQ ID NO: 978995 - RNA, 20 nt, Homo sapiens
uaugguaaaaguuacuuauu

SEQ ID NO: 978996 - RNA, 13 nt, Homo sapiens
uauguauggaaua

SEQ ID NO: 978997 - RNA, 14 nt, Homo sapiens
uauucuauuuacaa

SEQ ID NO: 978998 - RNA, 15 nt, Homo sapiens
uauuuuaagacguga

SEQ ID NO: 978999 - RNA, 13 nt, Homo sapiens
ucaacuaugauau

SEQ ID NO: 979000 - RNA, 19 nt, Homo sapiens
ucacaaaaaggcauaugca

SEQ ID NO: 979001 - RNA, 22 nt, Homo sapiens
ucacgacucuaccauguccaau

SEQ ID NO: 979002 - RNA, 14 nt, Homo sapiens
ucagcacuguuuca

SEQ ID NO: 979003 - RNA, 19 nt, Homo sapiens
ucagcuccagaauaccuuc

SEQ ID NO: 979004 - RNA, 19 nt, Homo sapiens
ucaggaucaagaaaguguu

SEQ ID NO: 979005 - RNA, 21 nt, Homo sapiens
ucauaagaaugaauaauaauu

SEQ ID NO: 979006 - RNA, 20 nt, Homo sapiens
ucauuguuuauuaacaaauu

SEQ ID NO: 979007 - RNA, 18 nt, Homo sapiens
uccaaggaguuccaugaa

SEQ ID NO: 979008 - RNA, 15 nt, Homo sapiens
uccacccagcaaaga

SEQ ID NO: 979009 - RNA, 14 nt, Homo sapiens
ucccagagcccagg

SEQ ID NO: 979010 - RNA, 14 nt, Homo sapiens
ucccucuuugccug

SEQ ID NO: 979011 - RNA, 23 nt, Homo sapiens
uccugcaccgagagagauggaau

SEQ ID NO: 979012 - RNA, 15 nt, Homo sapiens
uccugccuacauucc

SEQ ID NO: 979013 - RNA, 15 nt, Homo sapiens
uccugcgcauggugc

SEQ ID NO: 979014 - RNA, 22 nt, Homo sapiens
uccuggcccugaaggugccacu

SEQ ID NO: 979015 - RNA, 16 nt, Homo sapiens
uccuguacauuucaca

SEQ ID NO: 979016 - RNA, 19 nt, Homo sapiens
uccuguguggaagaaggaa

SEQ ID NO: 979017 - RNA, 19 nt, Homo sapiens
uccuuaauagccauaugca

SEQ ID NO: 979018 - RNA, 20 nt, Homo sapiens
ucgcccacaaacugauuucu

SEQ ID NO: 979019 - RNA, 18 nt, Homo sapiens
ucuacccggcccagagac

SEQ ID NO: 979020 - RNA, 14 nt, Homo sapiens
ucuauuauagccac

SEQ ID NO: 979021 - RNA, 21 nt, Homo sapiens
ucuauuuacauaaaaugggug

SEQ ID NO: 979022 - RNA, 20 nt, Homo sapiens
ucuccaggauugaagagcau

SEQ ID NO: 979023 - RNA, 18 nt, Homo sapiens
ucucguaacugguuucau

SEQ ID NO: 979024 - RNA, 18 nt, Homo sapiens
ucugggauucccaccaag

SEQ ID NO: 979025 - RNA, 16 nt, Homo sapiens
ucugucccucuuugcc

SEQ ID NO: 979026 - RNA, 15 nt, Homo sapiens
ucuucgcugcuagag

SEQ ID NO: 979027 - RNA, 17 nt, Homo sapiens
ucuuuggggucagccag

SEQ ID NO: 979028 - RNA, 22 nt, Homo sapiens
ugaaaaauucucagucaguaau

SEQ ID NO: 979029 - RNA, 12 nt, Homo sapiens
ugaaaccaaaga

SEQ ID NO: 979030 - RNA, 15 nt, Homo sapiens
ugaaaucucagaauu

SEQ ID NO: 979031 - RNA, 11 nt, Homo sapiens
ugaacagccaa

SEQ ID NO: 979032 - RNA, 22 nt, Homo sapiens
ugaacuuuccaaaaccuaaaga

SEQ ID NO: 979033 - RNA, 22 nt, Homo sapiens
ugaaggaggugagggaugugaa

SEQ ID NO: 979034 - RNA, 16 nt, Homo sapiens
ugaaggguaaagaagu

SEQ ID NO: 979035 - RNA, 22 nt, Homo sapiens
ugaauaacauuugugugguggg

SEQ ID NO: 979036 - RNA, 19 nt, Homo sapiens
ugaaugccucaaugugacc

SEQ ID NO: 979037 - RNA, 22 nt, Homo sapiens
ugaaugguccaggguugaucac

SEQ ID NO: 979038 - RNA, 20 nt, Homo sapiens
ugacggucccacacugguga

SEQ ID NO: 979039 - RNA, 18 nt, Homo sapiens
ugacugauguuacaucac

SEQ ID NO: 979040 - RNA, 13 nt, Homo sapiens
ugauuggcucacc

SEQ ID NO: 979041 - RNA, 14 nt, Homo sapiens
ugcauuguauuuag

SEQ ID NO: 979042 - RNA, 19 nt, Homo sapiens
ugcccagccucgcaugcca

SEQ ID NO: 979043 - RNA, 13 nt, Homo sapiens
ugccuacauuccc

SEQ ID NO: 979044 - RNA, 19 nt, Homo sapiens
ugccugugugagcaucucu

SEQ ID NO: 979045 - RNA, 16 nt, Homo sapiens
ugcgcauggugcagug

SEQ ID NO: 979046 - RNA, 20 nt, Homo sapiens
ugcucuacugcuucaggaag

SEQ ID NO: 979047 - RNA, 18 nt, Homo sapiens
ugcucuggaaaaugugac

SEQ ID NO: 979048 - RNA, 17 nt, Homo sapiens
ugcuugaaaccaaagau

SEQ ID NO: 979049 - RNA, 14 nt, Homo sapiens
uggaauaaagcccu

SEQ ID NO: 979050 - RNA, 22 nt, Homo sapiens
uggagggcagcuguggcuucua

SEQ ID NO: 979051 - RNA, 13 nt, Homo sapiens
uggaguucagaga

SEQ ID NO: 979052 - RNA, 22 nt, Homo sapiens
uggccgggugcgguggcucacg

SEQ ID NO: 979053 - RNA, 14 nt, Homo sapiens
uggcuaauucccag

SEQ ID NO: 979054 - RNA, 22 nt, Homo sapiens
uggcuaauucccagagugugaa

SEQ ID NO: 979055 - RNA, 17 nt, Homo sapiens
uggcugaccccaaagag

SEQ ID NO: 979056 - RNA, 12 nt, Homo sapiens
ugggauucccac

SEQ ID NO: 979057 - RNA, 21 nt, Homo sapiens
ugggguauuuaccacagcagc

SEQ ID NO: 979058 - RNA, 14 nt, Homo sapiens
ugguacaaggaaua

SEQ ID NO: 979059 - RNA, 14 nt, Homo sapiens
ugguccaggguuga

SEQ ID NO: 979060 - RNA, 16 nt, Homo sapiens
ugguggaucuguccaa

SEQ ID NO: 979061 - RNA, 21 nt, Homo sapiens
ugguuucauuucuacugugac

SEQ ID NO: 979062 - RNA, 16 nt, Homo sapiens
ugucuaauaguuauuc

SEQ ID NO: 979063 - RNA, 22 nt, Homo sapiens
ugucuguuuuuguaacuuaaaa

SEQ ID NO: 979064 - RNA, 15 nt, Homo sapiens
ugugaccagggguga

SEQ ID NO: 979065 - RNA, 23 nt, Homo sapiens
uuaaauauauuucuugcuauugu

SEQ ID NO: 979066 - RNA, 23 nt, Homo sapiens
uuaacaaauuauguuacaucugu

SEQ ID NO: 979067 - RNA, 13 nt, Homo sapiens
uuacgugagccag

SEQ ID NO: 979068 - RNA, 16 nt, Homo sapiens
uuacuugcauugaaua

SEQ ID NO: 979069 - RNA, 20 nt, Homo sapiens
uuagccuugcucaggugcaa

SEQ ID NO: 979070 - RNA, 16 nt, Homo sapiens
uagaauagugcauugu

SEQ ID NO: 979071 - RNA, 12 nt, Homo sapiens
uagccauaugca

SEQ ID NO: 979072 - RNA, 18 nt, Homo sapiens
uaggugcccgaguagcau

SEQ ID NO: 979073 - RNA, 22 nt, Homo sapiens
uauaaucuuccauacuucuuca

SEQ ID NO: 979074 - RNA, 13 nt, Homo sapiens
uauauuauggaag

SEQ ID NO: 979075 - RNA, 22 nt, Homo sapiens
uauccuguacauuucacaaaaa

SEQ ID NO: 979076 - RNA, 17 nt, Homo sapiens
ucaaaacagagauguga

SEQ ID NO: 979077 - RNA, 19 nt, Homo sapiens
ucaaaacagagaugugaua

SEQ ID NO: 979078 - RNA, 17 nt, Homo sapiens
ucaauuucccugacucc

SEQ ID NO: 979079 - RNA, 20 nt, Homo sapiens
ucacaaaaaggcauaugcaa

SEQ ID NO: 979080 - RNA, 18 nt, Homo sapiens
ucaguauaaaagacaaaa

SEQ ID NO: 979081 - RNA, 15 nt, Homo sapiens
ucaucccuaugggau

SEQ ID NO: 979082 - RNA, 23 nt, Homo sapiens
ucaugcucagcccugacuggugc

SEQ ID NO: 979083 - RNA, 17 nt, Homo sapiens
ucauuggccuucuuaaa

SEQ ID NO: 979084 - RNA, 15 nt, Homo sapiens
ucauuucuacuguga

SEQ ID NO: 979085 - RNA, 19 nt, Homo sapiens
uccaaaaccuaaagaggaa

SEQ ID NO: 979086 - RNA, 16 nt, Homo sapiens
uccagaauaaaacgca

SEQ ID NO: 979087 - RNA, 14 nt, Homo sapiens
ucccaguggucaaa

SEQ ID NO: 979088 - RNA, 18 nt, Homo sapiens
ucccucuuugccugugug

SEQ ID NO: 979089 - RNA, 18 nt, Homo sapiens
ucccugaacaucugugug

SEQ ID NO: 979090 - RNA, 17 nt, Homo sapiens
uccucucccugcaccug

SEQ ID NO: 979091 - RNA, 15 nt, Homo sapiens
uccugcaccgagaga

SEQ ID NO: 979092 - RNA, 17 nt, Homo sapiens
ucuauccuguacauuuc

SEQ ID NO: 979093 - RNA, 20 nt, Homo sapiens
ucucagucaguaauugccaa

SEQ ID NO: 979094 - RNA, 19 nt, Homo sapiens
ucucgcaguacauguuacu

SEQ ID NO: 979095 - RNA, 13 nt, Homo sapiens
aaaugcauggugc

SEQ ID NO: 979096 - RNA, 22 nt, Homo sapiens
aaauguccuccaacaauaaaga

SEQ ID NO: 979097 - RNA, 14 nt, Homo sapiens
aaaugugcuuaugu

SEQ ID NO: 979098 - RNA, 21 nt, Homo sapiens
aaauuaaguuguaucauuuca

SEQ ID NO: 979099 - RNA, 24 nt, Homo sapiens
aaauucucagucaguaauugccaa

SEQ ID NO: 979100 - RNA, 14 nt, Homo sapiens
aacaacuacuguga

SEQ ID NO: 979101 - RNA, 19 nt, Homo sapiens
aacaagaguugucuugucc

SEQ ID NO: 979102 - RNA, 15 nt, Homo sapiens
aacccucucuucccu

SEQ ID NO: 979103 - RNA, 22 nt, Homo sapiens
aacccugcuugcacuuuguaac

SEQ ID NO: 979104 - RNA, 22 nt, Homo sapiens
aacgcaaagggcugaaagccau

SEQ ID NO: 979105 - RNA, 17 nt, Homo sapiens
aacguuuugaacuaaua

SEQ ID NO: 979106 - RNA, 13 nt, Homo sapiens
aagaauacagaaa

SEQ ID NO: 979107 - RNA, 19 nt, Homo sapiens
aagagaacauuucuagaaa

SEQ ID NO: 979108 - RNA, 18 nt, Homo sapiens
aagagaccaagacucuga

SEQ ID NO: 979109 - RNA, 21 nt, Homo sapiens
aagagaggaaugccuguguga

SEQ ID NO: 979110 - RNA, 22 nt, Homo sapiens
aagagcuggcaaagguggcucu

SEQ ID NO: 979111 - RNA, 22 nt, Homo sapiens
aagauuuuuuuuguaacuucaa

SEQ ID NO: 979112 - RNA, 13 nt, Homo sapiens
aagcaaggccaaa

SEQ ID NO: 979113 - RNA, 12 nt, Homo sapiens
aagcuuauguca

SEQ ID NO: 979114 - RNA, 22 nt, Homo sapiens
aaggaacucuggcuuccaggua

SEQ ID NO: 979115 - RNA, 21 nt, Homo sapiens
aaggacggccuucaacugaaa

SEQ ID NO: 979116 - RNA, 22 nt, Homo sapiens
aaggcaaggucaccugccucuu

SEQ ID NO: 979117 - RNA, 13 nt, Homo sapiens
aagggaaacuauu

SEQ ID NO: 979118 - RNA, 20 nt, Homo sapiens
aaggucaauuucaguguaug

SEQ ID NO: 979119 - RNA, 14 nt, Homo sapiens
aauaaaugugcuua

SEQ ID NO: 979120 - RNA, 15 nt, Homo sapiens
aauacauaagaccau

SEQ ID NO: 979121 - RNA, 14 nt, Homo sapiens
aaucuccaguuuuc

SEQ ID NO: 979122 - RNA, 19 nt, Homo sapiens
aauuuuaaauuauaacuua

SEQ ID NO: 979123 - RNA, 17 nt, Homo sapiens
acaagcuggaagcacau

SEQ ID NO: 979124 - RNA, 18 nt, Homo sapiens
acaauggcuaauucccag

SEQ ID NO: 979125 - RNA, 21 nt, Homo sapiens
acaauggcuaauucccagagu

SEQ ID NO: 979126 - RNA, 23 nt, Homo sapiens
acacccgccgccuccugcaccga

SEQ ID NO: 979127 - RNA, 15 nt, Homo sapiens
acagagaugugauaa

SEQ ID NO: 979128 - RNA, 17 nt, Homo sapiens
acagaugauaauaugcu

SEQ ID NO: 979129 - RNA, 18 nt, Homo sapiens
acagcagcugaacagcca

SEQ ID NO: 979130 - RNA, 20 nt, Homo sapiens
acagcagcugaacagccaaa

SEQ ID NO: 979131 - RNA, 12 nt, Homo sapiens
acagcagguggg

SEQ ID NO: 979132 - RNA, 23 nt, Homo sapiens
acauucccuggccuggcucuccu

SEQ ID NO: 979133 - RNA, 15 nt, Homo sapiens
accaagacucugaaa

SEQ ID NO: 979134 - RNA, 11 nt, Homo sapiens
accacagcagc

SEQ ID NO: 979135 - RNA, 16 nt, Homo sapiens
accagccuuguccuaa

SEQ ID NO: 979136 - RNA, 21 nt, Homo sapiens
accaggggugauuucagagag

SEQ ID NO: 979137 - RNA, 20 nt, Homo sapiens
accaugacgcacugcucaag

SEQ ID NO: 979138 - RNA, 13 nt, Homo sapiens
acccacuccucac

SEQ ID NO: 979139 - RNA, 16 nt, Homo sapiens
acccagagccuucucc

SEQ ID NO: 979140 - RNA, 13 nt, Homo sapiens
acccagcaaagag

SEQ ID NO: 979141 - RNA, 14 nt, Homo sapiens
acccucucuucccu

SEQ ID NO: 979142 - RNA, 15 nt, Homo sapiens
accuuggacuccucc

SEQ ID NO: 979143 - RNA, 16 nt, Homo sapiens
acgucccaugugcaug

SEQ ID NO: 979144 - RNA, 14 nt, Homo sapiens
acuaaaaauauuau

SEQ ID NO: 979145 - RNA, 11 nt, Homo sapiens
acuaugcacaa

SEQ ID NO: 979146 - RNA, 22 nt, Homo sapiens
acucuccccucccucuuccuuc

SEQ ID NO: 979147 - RNA, 18 nt, Homo sapiens
acucugaaaucucagaau

SEQ ID NO: 979148 - RNA, 16 nt, Homo sapiens
acucuuccaaaggcau

SEQ ID NO: 979149 - RNA, 22 nt, Homo sapiens
acugauuaccuccuguguggaa

SEQ ID NO: 979150 - RNA, 18 nt, Homo sapiens
acugcgaucuucagagca

SEQ ID NO: 979151 - RNA, 20 nt, Homo sapiens
acugcuaggcgagugccagg

SEQ ID NO: 979152 - RNA, 12 nt, Homo sapiens
acugcucaagaa

SEQ ID NO: 979153 - RNA, 14 nt, Homo sapiens
acuucacaauguau

SEQ ID NO: 979154 - RNA, 14 nt, Homo sapiens
acuucacauugcaa

SEQ ID NO: 979155 - RNA, 22 nt, Homo sapiens
agaaguucuggcugaacacugg

SEQ ID NO: 979156 - RNA, 13 nt, Homo sapiens
agaauagugcauu

SEQ ID NO: 979157 - RNA, 18 nt, Homo sapiens
agaaugaauaauaauuau

SEQ ID NO: 979158 - RNA, 18 nt, Homo sapiens
agacaggucuagacuuuc

SEQ ID NO: 979159 - RNA, 19 nt, Homo sapiens
agaccugacaagcacugcu

SEQ ID NO: 979160 - RNA, 14 nt, Homo sapiens
agagaagaggcugg

SEQ ID NO: 979161 - RNA, 21 nt, Homo sapiens
agagauggaauaaagcccuug

SEQ ID NO: 979162 - RNA, 23 nt, Homo sapiens
agagauggaauaaagcccuugaa

SEQ ID NO: 979163 - RNA, 14 nt, Homo sapiens
agagccagcucucu

SEQ ID NO: 979164 - RNA, 23 nt, Homo sapiens
agaggagguuuggggucugccac

SEQ ID NO: 979165 - RNA, 16 nt, Homo sapiens
agaguaaaaacugaau

SEQ ID NO: 979166 - RNA, 17 nt, Homo sapiens
agaucgcgccacugcac

SEQ ID NO: 979167 - RNA, 21 nt, Homo sapiens
agcaaucucgcaguacauguu

SEQ ID NO: 979168 - RNA, 15 nt, Homo sapiens
agcagaggaguccag

SEQ ID NO: 979169 - RNA, 21 nt, Homo sapiens
agcauccuggccaacauggug

SEQ ID NO: 979170 - RNA, 22 nt, Homo sapiens
agccaccucuugggcaugcuca

SEQ ID NO: 979171 - RNA, 12 nt, Homo sapiens
agcccagugugg

SEQ ID NO: 979172 - RNA, 15 nt, Homo sapiens
agcccuugaaccagc

SEQ ID NO: 979173 - RNA, 18 nt, Homo sapiens
agccuggggcaucccaga

SEQ ID NO: 979174 - RNA, 12 nt, Homo sapiens
agcucucucuac

SEQ ID NO: 979175 - RNA, 17 nt, Homo sapiens
aggacuauagcccaggu

SEQ ID NO: 979176 - RNA, 19 nt, Homo sapiens
aggagguuuggggucugcc

SEQ ID NO: 979177 - RNA, 11 nt, Homo sapiens
aggcauaugca

SEQ ID NO: 979178 - RNA, 16 nt, Homo sapiens
aggcaugauguuaacc

SEQ ID NO: 979179 - RNA, 18 nt, Homo sapiens
aggcugcccugaacaaaa

SEQ ID NO: 979180 - RNA, 15 nt, Homo sapiens
agggcugaaagccau

SEQ ID NO: 979181 - RNA, 14 nt, Homo sapiens
aggggcccacaggg

SEQ ID NO: 979182 - RNA, 20 nt, Homo sapiens
agggggguugugaggccugg

SEQ ID NO: 979183 - RNA, 17 nt, Homo sapiens
aggggugauuucagaga

SEQ ID NO: 979184 - RNA, 23 nt, Homo sapiens
aggguuggguucaucugagcaag

SEQ ID NO: 979185 - RNA, 17 nt, Homo sapiens
aggugccacuccagugc

SEQ ID NO: 979186 - RNA, 19 nt, Homo sapiens
agguggcaggaccaggacu

SEQ ID NO: 979187 - RNA, 13 nt, Homo sapiens
agguggcucucca

SEQ ID NO: 979188 - RNA, 15 nt, Homo sapiens
aggugucugcaccca

SEQ ID NO: 979189 - RNA, 18 nt, Homo sapiens
aguacagugagccaagau

SEQ ID NO: 979190 - RNA, 15 nt, Homo sapiens
agucaaaacagagau

SEQ ID NO: 979191 - RNA, 15 nt, Homo sapiens
aguggaucuccaagg

SEQ ID NO: 979192 - RNA, 16 nt, Homo sapiens
agugggugguggaucu

SEQ ID NO: 979193 - RNA, 17 nt, Homo sapiens
agugugaauaaaguuag

SEQ ID NO: 979194 - RNA, 16 nt, Homo sapiens
aguuauuaaacagugu

SEQ ID NO: 979195 - RNA, 17 nt, Homo sapiens
aguuauuaaacaguguu

SEQ ID NO: 979196 - RNA, 19 nt, Homo sapiens
aguuuccaaucccauagau

SEQ ID NO: 979197 - RNA, 10 nt, Homo sapiens
aguuugauau

SEQ ID NO: 979198 - RNA, 20 nt, Homo sapiens
auaaaauaaaguacauuauu

SEQ ID NO: 979199 - RNA, 17 nt, Homo sapiens
auaaagcccuugaacca

SEQ ID NO: 979200 - RNA, 13 nt, Homo sapiens
auacauaagacca

SEQ ID NO: 979201 - RNA, 16 nt, Homo sapiens
auaugauauguaaaca

SEQ ID NO: 979202 - RNA, 22 nt, Homo sapiens
auauguaggugucugcacccag

SEQ ID NO: 979203 - RNA, 18 nt, Homo sapiens
auauuuaauggcaaugca

SEQ ID NO: 979204 - RNA, 20 nt, Homo sapiens
aucaaugggugguauuugcu

SEQ ID NO: 979205 - RNA, 16 nt, Homo sapiens
aucacagcagugcaua

SEQ ID NO: 979206 - RNA, 20 nt, Homo sapiens
aucacaguguuugcaauggu

SEQ ID NO: 979207 - RNA, 18 nt, Homo sapiens
aucaccaggaugucacau

SEQ ID NO: 979208 - RNA, 20 nt, Homo sapiens
aucccugcagccugguagaa

SEQ ID NO: 979209 - RNA, 15 nt, Homo sapiens
auccucacaaccacc

SEQ ID NO: 979210 - RNA, 20 nt, Homo sapiens
aucucgcaguacauguuacu

SEQ ID NO: 979211 - RNA, 15 nt, Homo sapiens
aucugggauucccac

SEQ ID NO: 979212 - RNA, 21 nt, Homo sapiens
augaagaugucuaauaguuau

SEQ ID NO: 979213 - RNA, 22 nt, Homo sapiens
augccuuucuguaaccaaaaau

SEQ ID NO: 979214 - RNA, 15 nt, Homo sapiens
augcuuugcuucaaa

SEQ ID NO: 979215 - RNA, 15 nt, Homo sapiens
auggaauaaagcccu

SEQ ID NO: 979216 - RNA, 17 nt, Homo sapiens
augggauucagugcuuc

SEQ ID NO: 979217 - RNA, 20 nt, Homo sapiens
auggugcaaauccuacugaa

SEQ ID NO: 979218 - RNA, 13 nt, Homo sapiens
auguauaaauguu

SEQ ID NO: 979219 - RNA, 11 nt, Homo sapiens
augugccaagg

SEQ ID NO: 979220 - RNA, 19 nt, Homo sapiens
auguuagggugcucuggaa

SEQ ID NO: 979221 - RNA, 19 nt, Homo sapiens
auuaccuccuguguggaag

SEQ ID NO: 979222 - RNA, 12 nt, Homo sapiens
auuccagugcag

SEQ ID NO: 979223 - RNA, 14 nt, Homo sapiens
auuccgucuuaaaa

SEQ ID NO: 979224 - RNA, 14 nt, Homo sapiens
auuccuacaaagau

SEQ ID NO: 979225 - RNA, 12 nt, Homo sapiens
auucucaccagg

SEQ ID NO: 979226 - RNA, 21 nt, Homo sapiens
auucugaaaauaccagugugu

SEQ ID NO: 979227 - RNA, 15 nt, Homo sapiens
auugccugcagagag

SEQ ID NO: 979228 - RNA, 19 nt, Homo sapiens
auuggagaguaaaaacuga

SEQ ID NO: 979229 - RNA, 22 nt, Homo sapiens
auugggaagcugggggaagggu

SEQ ID NO: 979230 - RNA, 18 nt, Homo sapiens
auugugauauuuuuacuu

SEQ ID NO: 979231 - RNA, 23 nt, Homo sapiens
caaaacuuccuguuuguggaaca

SEQ ID NO: 979232 - RNA, 21 nt, Homo sapiens
caaacucgcacaaccaugacg

SEQ ID NO: 979233 - RNA, 19 nt, Homo sapiens
caacaaagccaacagucaa

SEQ ID NO: 979234 - RNA, 15 nt, Homo sapiens
caacuacugugauca

SEQ ID NO: 979235 - RNA, 16 nt, Homo sapiens
caagcuggaagcacau

SEQ ID NO: 979236 - RNA, 16 nt, Homo sapiens
caaggucgagacauuc

SEQ ID NO: 979237 - RNA, 18 nt, Homo sapiens
caauucuacccagagccu

SEQ ID NO: 979238 - RNA, 21 nt, Homo sapiens
cacaaaaaggcauaugcaaua

SEQ ID NO: 979239 - RNA, 20 nt, Homo sapiens
cacacccgccgccuccugca

SEQ ID NO: 979240 - RNA, 23 nt, Homo sapiens
cacucuccccucccucuuccuuc

SEQ ID NO: 979241 - RNA, 23 nt, Homo sapiens
cacugaaugccucaaugugacca

SEQ ID NO: 979242 - RNA, 13 nt, Homo sapiens
cacugcucaagaa

SEQ ID NO: 979243 - RNA, 16 nt, Homo sapiens
cagaaaaacucuggga

SEQ ID NO: 979244 - RNA, 20 nt, Homo sapiens
cagaaaaacucugggaaaua

SEQ ID NO: 979245 - RNA, 20 nt, Homo sapiens
cagagccuggggcaucccag

SEQ ID NO: 979246 - RNA, 22 nt, Homo sapiens
cagagggguaggcagagccuuu

SEQ ID NO: 979247 - RNA, 23 nt, Homo sapiens
cagagguaaaagugugagcagug

SEQ ID NO: 979248 - RNA, 17 nt, Homo sapiens
cagcagcugaacagcca

SEQ ID NO: 979249 - RNA, 16 nt, Homo sapiens
cagcccugacuggugc

SEQ ID NO: 979250 - RNA, 17 nt, Homo sapiens
cagccucgcaugccaga

SEQ ID NO: 979251 - RNA, 16 nt, Homo sapiens
cagcugaacagccaaa

SEQ ID NO: 979252 - RNA, 13 nt, Homo sapiens
caggcagccccac

SEQ ID NO: 979253 - RNA, 14 nt, Homo sapiens
caggccaccaggau

SEQ ID NO: 979254 - RNA, 17 nt, Homo sapiens
caggucuagacuuucuc

SEQ ID NO: 979255 - RNA, 17 nt, Homo sapiens
caggugguccugagacc

SEQ ID NO: 979256 - RNA, 13 nt, Homo sapiens
caucccagagccc

SEQ ID NO: 979257 - RNA, 20 nt, Homo sapiens
cauccuggccaacaugguga

SEQ ID NO: 979258 - RNA, 13 nt, Homo sapiens
caugaagaccaca

SEQ ID NO: 979259 - RNA, 22 nt, Homo sapiens
cauuccccucgugugacucucu

SEQ ID NO: 979260 - RNA, 14 nt, Homo sapiens
cauuucuacuguga

SEQ ID NO: 979261 - RNA, 18 nt, Homo sapiens
ccaaaggcauaagacccu

SEQ ID NO: 979262 - RNA, 19 nt, Homo sapiens
ccaaaugcauggugcaguu

SEQ ID NO: 979263 - RNA, 20 nt, Homo sapiens
ccaagacucugaaaucucag

SEQ ID NO: 979264 - RNA, 16 nt, Homo sapiens
ccaaggaaacuugaau

SEQ ID NO: 979265 - RNA, 12 nt, Homo sapiens
ccagcaaagagu

SEQ ID NO: 979266 - RNA, 16 nt, Homo sapiens
ccagcaacacaagcug

SEQ ID NO: 979267 - RNA, 22 nt, Homo sapiens
ccagcugaggcugggggcgggg

SEQ ID NO: 979268 - RNA, 22 nt, Homo sapiens
ccaggguugaucacacucuggg

SEQ ID NO: 979269 - RNA, 15 nt, Homo sapiens
ccaugcgcugcucaa

SEQ ID NO: 979270 - RNA, 17 nt, Homo sapiens
ccaugggggugcugcag

SEQ ID NO: 979271 - RNA, 21 nt, Homo sapiens
ccauuuguuggggcaguggua

SEQ ID NO: 979272 - RNA, 21 nt, Homo sapiens
cccagagcccagggcauccca

SEQ ID NO: 979273 - RNA, 12 nt, Homo sapiens
cccagcaaagag

SEQ ID NO: 979274 - RNA, 16 nt, Homo sapiens
cccauccccuuuccuc

SEQ ID NO: 979275 - RNA, 17 nt, Homo sapiens
cccauuuugagugacuc

SEQ ID NO: 979276 - RNA, 14 nt, Homo sapiens
ccccuaugcuccag

SEQ ID NO: 979277 - RNA, 22 nt, Homo sapiens
ccccuuauccaggacucuguca

SEQ ID NO: 979278 - RNA, 12 nt, Homo sapiens
cccgaguagcau

SEQ ID NO: 979279 - RNA, 11 nt, Homo sapiens
cccucagggau

SEQ ID NO: 979280 - RNA, 17 nt, Homo sapiens
cccucagggaucuugca

SEQ ID NO: 979281 - RNA, 19 nt, Homo sapiens
cccugcuugcacuuuguaa

SEQ ID NO: 979282 - RNA, 22 nt, Homo sapiens
cccuuauccaggacucugucaa

SEQ ID NO: 979283 - RNA, 13 nt, Homo sapiens
cccuugaaccagc

SEQ ID NO: 979284 - RNA, 19 nt, Homo sapiens
cccuuuccuacucucagga

SEQ ID NO: 979285 - RNA, 20 nt, Homo sapiens
ccgagagagauggaauaaag

SEQ ID NO: 979286 - RNA, 12 nt, Homo sapiens
ccgcguggaaug

SEQ ID NO: 979287 - RNA, 15 nt, Homo sapiens
ccuacugaaugcucu

SEQ ID NO: 979288 - RNA, 23 nt, Homo sapiens
ccuauacauuucuguucaucuua

SEQ ID NO: 979289 - RNA, 13 nt, Homo sapiens
ccucaaugugacc

SEQ ID NO: 979290 - RNA, 17 nt, Homo sapiens
ccucacugaaugccuca

SEQ ID NO: 979291 - RNA, 15 nt, Homo sapiens
ccuccugcaccgaga

SEQ ID NO: 979292 - RNA, 12 nt, Homo sapiens
ccucucuccuuc

SEQ ID NO: 979293 - RNA, 19 nt, Homo sapiens
ccucugauacccagagcau

SEQ ID NO: 979294 - RNA, 15 nt, Homo sapiens
ccucugcagcacuuu

SEQ ID NO: 979295 - RNA, 20 nt, Homo sapiens
ccugacuccucuaagccacu

SEQ ID NO: 979296 - RNA, 23 nt, Homo sapiens
ccugcaccgagagagauggaaua

SEQ ID NO: 979297 - RNA, 21 nt, Homo sapiens
ccugcugcuguguuuuugcua

SEQ ID NO: 979298 - RNA, 16 nt, Homo sapiens
ccugcuugcacuuugu

SEQ ID NO: 979299 - RNA, 14 nt, Homo sapiens
ccuggagugcaguu

SEQ ID NO: 979300 - RNA, 20 nt, Homo sapiens
ccuguuuguggaacaaaagu

SEQ ID NO: 979301 - RNA, 11 nt, Homo sapiens
ccuugaaccag

SEQ ID NO: 979302 - RNA, 14 nt, Homo sapiens
ccuuggugugaccc

SEQ ID NO: 979303 - RNA, 16 nt, Homo sapiens
cgcaagagaacauuuc

SEQ ID NO: 979304 - RNA, 14 nt, Homo sapiens
cgcauggugcagug

SEQ ID NO: 979305 - RNA, 14 nt, Homo sapiens
cggagaguacagug

SEQ ID NO: 979306 - RNA, 14 nt, Homo sapiens
cggucccacacugg

SEQ ID NO: 979307 - RNA, 19 nt, Homo sapiens
cgugaacugcgugccagug

SEQ ID NO: 979308 - RNA, 17 nt, Homo sapiens
cuaagccacucuuccaa

SEQ ID NO: 979309 - RNA, 18 nt, Homo sapiens
cuaauucccagaguguga

SEQ ID NO: 979310 - RNA, 23 nt, Homo sapiens
cuagagaagaggcuggugcugug

SEQ ID NO: 979311 - RNA, 22 nt, Homo sapiens
cuauguauggaauacaguguua

SEQ ID NO: 979312 - RNA, 13 nt, Homo sapiens
cuauucucaccag

SEQ ID NO: 979313 - RNA, 21 nt, Homo sapiens
cuauuuggggcuugcaugcca

SEQ ID NO: 979314 - RNA, 23 nt, Homo sapiens
cuauuuggggcuugcaugccaaa

SEQ ID NO: 979315 - RNA, 23 nt, Homo sapiens
cuccuuuugcuugaaaccaaaga

SEQ ID NO: 979316 - RNA, 21 nt, Homo sapiens
cucgcaguacauguuacuugu

SEQ ID NO: 979317 - RNA, 23 nt, Homo sapiens
cucucaggaucaagaaaguguug

SEQ ID NO: 979318 - RNA, 20 nt, Homo sapiens
cucucuacccggcccagaga

SEQ ID NO: 979319 - RNA, 19 nt, Homo sapiens
cucugaaaucucagaauuc

SEQ ID NO: 979320 - RNA, 22 nt, Homo sapiens
cucuggaaaacucaggauucuc

SEQ ID NO: 979321 - RNA, 16 nt, Homo sapiens
cucuuccugcaaggac

SEQ ID NO: 979322 - RNA, 19 nt, Homo sapiens
cugaaaagacucaguguuc

SEQ ID NO: 979323 - RNA, 12 nt, Homo sapiens
cugaacagccaa

SEQ ID NO: 979324 - RNA, 20 nt, Homo sapiens
cugaaugccucaaugugacc

SEQ ID NO: 979325 - RNA, 14 nt, Homo sapiens
cugacaagcacugc

SEQ ID NO: 979326 - RNA, 19 nt, Homo sapiens
cugaguggaucuccaagga

SEQ ID NO: 979327 - RNA, 23 nt, Homo sapiens
cugaugcuuugcuucaaauccau

SEQ ID NO: 979328 - RNA, 22 nt, Homo sapiens
cugauuaccuccuguguggaag

SEQ ID NO: 979329 - RNA, 17 nt, Homo sapiens
cugcaccgagagagaug

SEQ ID NO: 979330 - RNA, 20 nt, Homo sapiens
cugcaccgagagagauggaa

SEQ ID NO: 979331 - RNA, 18 nt, Homo sapiens
cugcagagagaagccugu

SEQ ID NO: 979332 - RNA, 21 nt, Homo sapiens
cugcagcuuaaaacaagcaaa

SEQ ID NO: 979333 - RNA, 11 nt, Homo sapiens
cugcuucucag

SEQ ID NO: 979334 - RNA, 18 nt, Homo sapiens
cuggaaaacucaggauuc

SEQ ID NO: 979335 - RNA, 15 nt, Homo sapiens
cuggaaaaugugacc

SEQ ID NO: 979336 - RNA, 15 nt, Homo sapiens
cugguuugaaagccu

SEQ ID NO: 979337 - RNA, 20 nt, Homo sapiens
cuguaaucccagcacuuugg

SEQ ID NO: 979338 - RNA, 21 nt, Homo sapiens
cuguagucccagccacucggg

SEQ ID NO: 979339 - RNA, 20 nt, Homo sapiens
cuuauccaggacucugucaa

SEQ ID NO: 979340 - RNA, 14 nt, Homo sapiens
cuucacaguguuuc

SEQ ID NO: 979341 - RNA, 19 nt, Homo sapiens
cuucagccaucaacaagag

SEQ ID NO: 979342 - RNA, 19 nt, Homo sapiens
cuuccagguaucuccagga

SEQ ID NO: 979343 - RNA, 24 nt, Homo sapiens
cuuccauuaacuuagcauguguug

SEQ ID NO: 979344 - RNA, 19 nt, Homo sapiens
cuuccuuagccuugcucag

SEQ ID NO: 979345 - RNA, 13 nt, Homo sapiens
cuugaaaccaaag

SEQ ID NO: 979346 - RNA, 22 nt, Homo sapiens
cuuguuggauuccagugcaggu

SEQ ID NO: 979347 - RNA, 20 nt, Homo sapiens
cuuuccaaaaccuaaagagg

SEQ ID NO: 979348 - RNA, 18 nt, Homo sapiens
gaaacaccgagucucugu

SEQ ID NO: 979349 - RNA, 21 nt, Homo sapiens
gaacacuggcaacaacaaagc

SEQ ID NO: 979350 - RNA, 21 nt, Homo sapiens
gaacccauuuugagugacucg

SEQ ID NO: 979351 - RNA, 21 nt, Homo sapiens
gaacccugcuugcacuuugua

SEQ ID NO: 979352 - RNA, 21 nt, Homo sapiens
gaacuacgggcugcucuacug

SEQ ID NO: 979353 - RNA, 12 nt, Homo sapiens
gaagaccaaaaa

SEQ ID NO: 979354 - RNA, 14 nt, Homo sapiens
gaagagaccaagac

SEQ ID NO: 979355 - RNA, 11 nt, Homo sapiens
gaagagcauug

SEQ ID NO: 979356 - RNA, 13 nt, Homo sapiens
gaagagcauugca

SEQ ID NO: 979357 - RNA, 19 nt, Homo sapiens
gaaggaacucuggcuucca

SEQ ID NO: 979358 - RNA, 22 nt, Homo sapiens
gaaucaaagcaguuaacuuuaa

SEQ ID NO: 979359 - RNA, 21 nt, Homo sapiens
gacccucugaaugguccaggg

SEQ ID NO: 979360 - RNA, 16 nt, Homo sapiens
gacggucccacacugg

SEQ ID NO: 979361 - RNA, 21 nt, Homo sapiens
gacuagaauagugcauuguau

SEQ ID NO: 979362 - RNA, 14 nt, Homo sapiens
gagaagcucaccca

SEQ ID NO: 979363 - RNA, 15 nt, Homo sapiens
gagaagcucacccaa

SEQ ID NO: 979364 - RNA, 13 nt, Homo sapiens
gagagauggaaua

SEQ ID NO: 979365 - RNA, 20 nt, Homo sapiens
gagagauggaauaaagcccu

SEQ ID NO: 979366 - RNA, 19 nt, Homo sapiens
gagaggaaaggacaugggu

SEQ ID NO: 979367 - RNA, 23 nt, Homo sapiens
gagccagcucucucuacccggcc

SEQ ID NO: 979368 - RNA, 17 nt, Homo sapiens
gagcuggcaaagguggc

SEQ ID NO: 979369 - RNA, 13 nt, Homo sapiens
gagcuucaguaua

SEQ ID NO: 979370 - RNA, 18 nt, Homo sapiens
gagcuucaguauaaaaga

SEQ ID NO: 979371 - RNA, 17 nt, Homo sapiens
gauacccagagcauuac

SEQ ID NO: 979372 - RNA, 20 nt, Homo sapiens
gaucgcgccacugcacuccg

SEQ ID NO: 979373 - RNA, 18 nt, Homo sapiens
gaucuccaaggaccaggu

SEQ ID NO: 979374 - RNA, 12 nt, Homo sapiens
gaucuucagagc

SEQ ID NO: 979375 - RNA, 16 nt, Homo sapiens
gaucuugcauucccag

SEQ ID NO: 979376 - RNA, 18 nt, Homo sapiens
gaugaccagaacaagguu

SEQ ID NO: 979377 - RNA, 20 nt, Homo sapiens
gauggaauaaagcccuugaa

SEQ ID NO: 979378 - RNA, 17 nt, Homo sapiens
gauuggcucacccaagc

SEQ ID NO: 979379 - RNA, 13 nt, Homo sapiens
gcaauucuaccca

SEQ ID NO: 979380 - RNA, 18 nt, Homo sapiens
gcaccgagagagauggaa

SEQ ID NO: 979381 - RNA, 18 nt, Homo sapiens
gcacucacccaugugcca

SEQ ID NO: 979382 - RNA, 20 nt, Homo sapiens
gcacucacccaugugccaag

SEQ ID NO: 979383 - RNA, 21 nt, Homo sapiens
gcacugcuaggcgagugccag

SEQ ID NO: 979384 - RNA, 15 nt, Homo sapiens
gcagaaaaacucugg

SEQ ID NO: 979385 - RNA, 9 nt, Homo sapiens
gcagcacuu

SEQ ID NO: 979386 - RNA, 16 nt, Homo sapiens
gcagccccacacccgc

SEQ ID NO: 979387 - RNA, 12 nt, Homo sapiens
gcaggaccagga

SEQ ID NO: 979388 - RNA, 21 nt, Homo sapiens
gcaggcagccccacacccgcc

SEQ ID NO: 979389 - RNA, 19 nt, Homo sapiens
gcaucccaugggggugcug

SEQ ID NO: 979390 - RNA, 14 nt, Homo sapiens
gcauccuggccaac

SEQ ID NO: 979391 - RNA, 20 nt, Homo sapiens
gcauccuggccaacauggug

SEQ ID NO: 979392 - RNA, 14 nt, Homo sapiens
gcaucucuguguac

SEQ ID NO: 979393 - RNA, 21 nt, Homo sapiens
gcauggacaccccuuauccag

SEQ ID NO: 979394 - RNA, 20 nt, Homo sapiens
gcauuccagccccuauguua

SEQ ID NO: 979395 - RNA, 14 nt, Homo sapiens
gcauugcauggaca

SEQ ID NO: 979396 - RNA, 14 nt, Homo sapiens
gccaacauggugaa

SEQ ID NO: 979397 - RNA, 23 nt, Homo sapiens
gccaaggugggguauuuaccaca

SEQ ID NO: 979398 - RNA, 16 nt, Homo sapiens
gccacaucccuuugaa

SEQ ID NO: 979399 - RNA, 21 nt, Homo sapiens
gccaccucuugggcaugcuca

SEQ ID NO: 979400 - RNA, 15 nt, Homo sapiens
gccagcucucucuac

SEQ ID NO: 979401 - RNA, 16 nt, Homo sapiens
gcccagggcaucccau

SEQ ID NO: 979402 - RNA, 19 nt, Homo sapiens
ggacaccccuuauccagga

SEQ ID NO: 979403 - RNA, 16 nt, Homo sapiens
ggagaguacagugagc

SEQ ID NO: 979404 - RNA, 21 nt, Homo sapiens
ggagaguacagugagccaaga

SEQ ID NO: 979405 - RNA, 20 nt, Homo sapiens
ggagugacggucccacacug

SEQ ID NO: 979406 - RNA, 18 nt, Homo sapiens
ggagugagaucauuuucu

SEQ ID NO: 979407 - RNA, 12 nt, Homo sapiens
ggagugcaguuu

SEQ ID NO: 979408 - RNA, 16 nt, Homo sapiens
ggaucacaaggucacu

SEQ ID NO: 979409 - RNA, 20 nt, Homo sapiens
ggaucacaaggucacuagau

SEQ ID NO: 979410 - RNA, 19 nt, Homo sapiens
ggaucuccaaggaccaggu

SEQ ID NO: 979411 - RNA, 16 nt, Homo sapiens
ggaucuguccaaggaa

SEQ ID NO: 979412 - RNA, 23 nt, Homo sapiens
ggauuugaagcaaagcaccagcu

SEQ ID NO: 979413 - RNA, 16 nt, Homo sapiens
ggccugcccucaggga

SEQ ID NO: 979414 - RNA, 21 nt, Homo sapiens
gggaaaggauauuuucuucca

SEQ ID NO: 979415 - RNA, 23 nt, Homo sapiens
gggccccuuggcgggcagcccag

SEQ ID NO: 979416 - RNA, 20 nt, Homo sapiens
ggguccacccagcaaagagu

SEQ ID NO: 979417 - RNA, 16 nt, Homo sapiens
gggugauuucagagag

SEQ ID NO: 979418 - RNA, 19 nt, Homo sapiens
ggguggucugagcaccccc

SEQ ID NO: 979419 - RNA, 17 nt, Homo sapiens
gguauuuaccacagcag

SEQ ID NO: 979420 - RNA, 15 nt, Homo sapiens
ggugcagaggugagc

SEQ ID NO: 979421 - RNA, 16 nt, Homo sapiens
guaaaagugugagcag

SEQ ID NO: 979422 - RNA, 20 nt, Homo sapiens
guagguacuucacauugcaa

SEQ ID NO: 979423 - RNA, 22 nt, Homo sapiens
guagguacuucacauugcaaac

SEQ ID NO: 979424 - RNA, 15 nt, Homo sapiens
guaggugucugcacc

SEQ ID NO: 979425 - RNA, 14 nt, Homo sapiens
gucaacuaugauau

SEQ ID NO: 979426 - RNA, 23 nt, Homo sapiens
gucaauuucaguguaugauauac

SEQ ID NO: 979427 - RNA, 14 nt, Homo sapiens
gucccacacuggug

SEQ ID NO: 979428 - RNA, 15 nt, Homo sapiens
gucccccuaugcucc

SEQ ID NO: 979429 - RNA, 23 nt, Homo sapiens
gucccccuaugcuccaguaugga

SEQ ID NO: 979430 - RNA, 16 nt, Homo sapiens
guccccucuugaccca

SEQ ID NO: 979431 - RNA, 22 nt, Homo sapiens
gucggcacgucccaugugcaug

SEQ ID NO: 979432 - RNA, 13 nt, Homo sapiens
gucuagacuuucu

SEQ ID NO: 979433 - RNA, 21 nt, Homo sapiens
gucuagacuuucucaguggga

SEQ ID NO: 979434 - RNA, 22 nt, Homo sapiens
gucugagcuucaguauaaaaga

SEQ ID NO: 979435 - RNA, 14 nt, Homo sapiens
gucuuccacuguac

SEQ ID NO: 979436 - RNA, 18 nt, Homo sapiens
gugaauugccugcagaga

SEQ ID NO: 979437 - RNA, 14 nt, Homo sapiens
gugaccagggguga

SEQ ID NO: 979438 - RNA, 21 nt, Homo sapiens
gugaguuacagcgagaggcag

SEQ ID NO: 979439 - RNA, 13 nt, Homo sapiens
gugauuucagaga

SEQ ID NO: 979440 - RNA, 19 nt, Homo sapiens
gugauuucagagagggcag

SEQ ID NO: 979441 - RNA, 14 nt, Homo sapiens
gugcccaccagccu

SEQ ID NO: 979442 - RNA, 21 nt, Homo sapiens
gugcccaggggcccacaggga

SEQ ID NO: 979443 - RNA, 13 nt, Homo sapiens
guggaacaaaagu

SEQ ID NO: 979444 - RNA, 14 nt, Homo sapiens
guggaagaaggaaa

SEQ ID NO: 979445 - RNA, 11 nt, Homo sapiens
guggguggugg

SEQ ID NO: 979446 - RNA, 23 nt, Homo sapiens
gugucugcacccaggggugggga

SEQ ID NO: 979447 - RNA, 22 nt, Homo sapiens
gugugucccccuaugcuccagu

SEQ ID NO: 979448 - RNA, 19 nt, Homo sapiens
guguguuugugugcaugaa

SEQ ID NO: 979449 - RNA, 17 nt, Homo sapiens
guuccaugaagaccaca

SEQ ID NO: 979450 - RNA, 21 nt, Homo sapiens
guuccuauuuggggcuugcau

SEQ ID NO: 979451 - RNA, 14 nt, Homo sapiens
guuucaaaccagga

SEQ ID NO: 979452 - RNA, 20 nt, Homo sapiens
guuugaaggaggugagggau

SEQ ID NO: 979453 - RNA, 14 nt, Homo sapiens
uaaagcccuugaac

SEQ ID NO: 979454 - RNA, 13 nt, Homo sapiens
uaacuaucaauau

SEQ ID NO: 979455 - RNA, 17 nt, Homo sapiens
uaagaccauaacagcca

SEQ ID NO: 979456 - RNA, 19 nt, Homo sapiens
uaaucuuccauacuucuuc

SEQ ID NO: 979457 - RNA, 17 nt, Homo sapiens
uaccuccuguguggaag

SEQ ID NO: 979458 - RNA, 15 nt, Homo sapiens
uagccauaugcaaua

SEQ ID NO: 979459 - RNA, 22 nt, Homo sapiens
uaguuuacagaauggaaccaaa

SEQ ID NO: 979460 - RNA, 17 nt, Homo sapiens
uauauuauaaucuucca

SEQ ID NO: 979461 - RNA, 17 nt, Homo sapiens
uauccaggacucuguca

SEQ ID NO: 979462 - RNA, 15 nt, Homo sapiens
uaugcuccaguaugg

SEQ ID NO: 979463 - RNA, 15 nt, Homo sapiens
uauuaagauguauaa

SEQ ID NO: 979464 - RNA, 18 nt, Homo sapiens
uauugacgcauauuuaac

SEQ ID NO: 979465 - RNA, 12 nt, Homo sapiens
uauugcaagaca

SEQ ID NO: 979466 - RNA, 14 nt, Homo sapiens
ucaaaccaggauuu

SEQ ID NO: 979467 - RNA, 17 nt, Homo sapiens
ucaacaagaguugucuu

SEQ ID NO: 979468 - RNA, 17 nt, Homo sapiens
ucaacugaaaagacuca

SEQ ID NO: 979469 - RNA, 22 nt, Homo sapiens
ucaacugaaaagacucaguguu

SEQ ID NO: 979470 - RNA, 15 nt, Homo sapiens
ucaauuucaguguau

SEQ ID NO: 979471 - RNA, 14 nt, Homo sapiens
ucacauucaggaag

SEQ ID NO: 979472 - RNA, 15 nt, Homo sapiens
ucacuauuacuugaa

SEQ ID NO: 979473 - RNA, 20 nt, Homo sapiens
ucagaaacaggugcaucugg

SEQ ID NO: 979474 - RNA, 20 nt, Homo sapiens
ucagauauuuuuucagaaau

SEQ ID NO: 979475 - RNA, 17 nt, Homo sapiens
uccaaaggaaucuccag

SEQ ID NO: 979476 - RNA, 19 nt, Homo sapiens
uccaaaggcauaagacccu

SEQ ID NO: 979477 - RNA, 18 nt, Homo sapiens
uccaguuucccaccaccu

SEQ ID NO: 979478 - RNA, 17 nt, Homo sapiens
ucccacaaucugggacu

SEQ ID NO: 979479 - RNA, 13 nt, Homo sapiens
ucccagcacuuug

SEQ ID NO: 979480 - RNA, 20 nt, Homo sapiens
uccccaccuuccccagacuc

SEQ ID NO: 979481 - RNA, 21 nt, Homo sapiens
ucccccuaugcuccaguaugg

SEQ ID NO: 979482 - RNA, 21 nt, Homo sapiens
uccccucgugugacucucuug

SEQ ID NO: 979483 - RNA, 16 nt, Homo sapiens
uccgacugcuagggag

SEQ ID NO: 979484 - RNA, 13 nt, Homo sapiens
uccgaguguuugc

SEQ ID NO: 979485 - RNA, 23 nt, Homo sapiens
uccggguggaaaagaaucccugc

SEQ ID NO: 979486 - RNA, 20 nt, Homo sapiens
uccucuaagccacucuucca

SEQ ID NO: 979487 - RNA, 19 nt, Homo sapiens
uccuggccaacauggugaa

SEQ ID NO: 979488 - RNA, 19 nt, Homo sapiens
uccuggcccugaaggugcc

SEQ ID NO: 979489 - RNA, 20 nt, Homo sapiens
uccuuaauagccauaugcaa

SEQ ID NO: 979490 - RNA, 20 nt, Homo sapiens
aaaaauauauuuaauggcaa

SEQ ID NO: 979491 - RNA, 14 nt, Homo sapiens
aaaaaugacuaaaa

SEQ ID NO: 979492 - RNA, 18 nt, Homo sapiens
aaaacagagaugugauaa

SEQ ID NO: 979493 - RNA, 11 nt, Homo sapiens
aaaacucuccu

SEQ ID NO: 979494 - RNA, 18 nt, Homo sapiens
aaaacugcugaacuugac

SEQ ID NO: 979495 - RNA, 18 nt, Homo sapiens
aaaagauuuguuuuguca

SEQ ID NO: 979496 - RNA, 17 nt, Homo sapiens
aaaaggcauaugcaaua

SEQ ID NO: 979497 - RNA, 18 nt, Homo sapiens
aaaauguuauuaugucaa

SEQ ID NO: 979498 - RNA, 16 nt, Homo sapiens
aaaccgcacucaccca

SEQ ID NO: 979499 - RNA, 23 nt, Homo sapiens
aaacuacuuuuguaccaguguga

SEQ ID NO: 979500 - RNA, 20 nt, Homo sapiens
aaacuugaaucaaagcaguu

SEQ ID NO: 979501 - RNA, 16 nt, Homo sapiens
aaagaaagaaacugau

SEQ ID NO: 979502 - RNA, 19 nt, Homo sapiens
aaagaggaaaagugcaaug

SEQ ID NO: 979503 - RNA, 17 nt, Homo sapiens
aaagauuuguuuuguca

SEQ ID NO: 979504 - RNA, 17 nt, Homo sapiens
aaagggcugaaagccau

SEQ ID NO: 979505 - RNA, 23 nt, Homo sapiens
aaaguuguucgccgcguggaaug

SEQ ID NO: 979506 - RNA, 15 nt, Homo sapiens
aacaaauuauguuac

SEQ ID NO: 979507 - RNA, 22 nt, Homo sapiens
aacaauuccaaaggaaucucca

SEQ ID NO: 979508 - RNA, 17 nt, Homo sapiens
aacagccaacagguggc

SEQ ID NO: 979509 - RNA, 23 nt, Homo sapiens
aacuacuuuuguaccagugugaa

SEQ ID NO: 979510 - RNA, 13 nt, Homo sapiens
aagaaaagcaauc

SEQ ID NO: 979511 - RNA, 17 nt, Homo sapiens
aagaaaguguuggcuaa

SEQ ID NO: 979512 - RNA, 18 nt, Homo sapiens
aagaaauccaguuuccca

SEQ ID NO: 979513 - RNA, 14 nt, Homo sapiens
aagagaacauuucu

SEQ ID NO: 979514 - RNA, 21 nt, Homo sapiens
aagagagaacaacuacuguga

SEQ ID NO: 979515 - RNA, 19 nt, Homo sapiens
aagagcuggcaaagguggc

SEQ ID NO: 979516 - RNA, 15 nt, Homo sapiens
aagauaacugagaau

SEQ ID NO: 979517 - RNA, 13 nt, Homo sapiens
aagcccuugaacc

SEQ ID NO: 979518 - RNA, 14 nt, Homo sapiens
aagcuggaagcaca

SEQ ID NO: 979519 - RNA, 14 nt, Homo sapiens
aagggaaagccaga

SEQ ID NO: 979520 - RNA, 19 nt, Homo sapiens
aaggucaauuucaguguau

SEQ ID NO: 979521 - RNA, 18 nt, Homo sapiens
aagguucccucugagaau

SEQ ID NO: 979522 - RNA, 16 nt, Homo sapiens
aauaaaguuagugugu

SEQ ID NO: 979523 - RNA, 23 nt, Homo sapiens
aauacacagaugauaauaugcua

SEQ ID NO: 979524 - RNA, 22 nt, Homo sapiens
aaucaggcugaggugucuuaag

SEQ ID NO: 979525 - RNA, 15 nt, Homo sapiens
aaugaagaugucuaa

SEQ ID NO: 979526 - RNA, 16 nt, Homo sapiens
aaugccucaaugugac

SEQ ID NO: 979527 - RNA, 12 nt, Homo sapiens
aauguccuccaa

SEQ ID NO: 979528 - RNA, 21 nt, Homo sapiens
aaugucuuaaaaauauauuua

SEQ ID NO: 979529 - RNA, 16 nt, Homo sapiens
aauucaaugucuuaaa

SEQ ID NO: 979530 - RNA, 22 nt, Homo sapiens
aauucucagucaguaauugcca

SEQ ID NO: 979531 - RNA, 17 nt, Homo sapiens
aauuuaaucacuuucau

SEQ ID NO: 979532 - RNA, 18 nt, Homo sapiens
acaagagacuuaacuuau

SEQ ID NO: 979533 - RNA, 18 nt, Homo sapiens
acaagaguugucuugucc

SEQ ID NO: 979534 - RNA, 14 nt, Homo sapiens
caggguugaucaca

SEQ ID NO: 979535 - RNA, 15 nt, Homo sapiens
caggugggaaauggu

SEQ ID NO: 979536 - RNA, 23 nt, Homo sapiens
cagugcccaccagccuuguccua

SEQ ID NO: 979537 - RNA, 20 nt, Homo sapiens
caguggugaagaaaacuccu

SEQ ID NO: 979538 - RNA, 21 nt, Homo sapiens
cauacagagguaacuaucaau

SEQ ID NO: 979539 - RNA, 16 nt, Homo sapiens
cauacuucuucauuca

SEQ ID NO: 979540 - RNA, 19 nt, Homo sapiens
caugaaaauagcucuuuca

SEQ ID NO: 979541 - RNA, 19 nt, Homo sapiens
caugauguuaaccagaaua

SEQ ID NO: 979542 - RNA, 15 nt, Homo sapiens
cauucccagugguca

SEQ ID NO: 979543 - RNA, 18 nt, Homo sapiens
cauuccugcgcauggugc

SEQ ID NO: 979544 - RNA, 18 nt, Homo sapiens
cauuucuacugugacuga

SEQ ID NO: 979545 - RNA, 17 nt, Homo sapiens
ccaaaauuaccaaaaau

SEQ ID NO: 979546 - RNA, 18 nt, Homo sapiens
ccaacagucaaaacagag

SEQ ID NO: 979547 - RNA, 21 nt, Homo sapiens
ccaccucuugggcaugcucag

SEQ ID NO: 979548 - RNA, 13 nt, Homo sapiens
ccacuccagugcc

SEQ ID NO: 979549 - RNA, 12 nt, Homo sapiens
ccagcacuuugg

SEQ ID NO: 979550 - RNA, 13 nt, Homo sapiens
ccagccaccucuu

SEQ ID NO: 979551 - RNA, 11 nt, Homo sapiens
ccaggauuuug

SEQ ID NO: 979552 - RNA, 12 nt, Homo sapiens
cccaaagagccu

SEQ ID NO: 979553 - RNA, 19 nt, Homo sapiens
cccaccagccuuguccuaa

SEQ ID NO: 979554 - RNA, 19 nt, Homo sapiens
cccaccaugcgcugcucaa

SEQ ID NO: 979555 - RNA, 14 nt, Homo sapiens
cccagacucagcuc

SEQ ID NO: 979556 - RNA, 23 nt, Homo sapiens
cccagagaccccuuccuuuccuc

SEQ ID NO: 979557 - RNA, 21 nt, Homo sapiens
cccagagugugaaacuuccua

SEQ ID NO: 979558 - RNA, 18 nt, Homo sapiens
ccccaccagccaccucuu

SEQ ID NO: 979559 - RNA, 11 nt, Homo sapiens
cccccagugug

SEQ ID NO: 979560 - RNA, 14 nt, Homo sapiens
cccccuggagagaa

SEQ ID NO: 979561 - RNA, 13 nt, Homo sapiens
cccuaugcuccag

SEQ ID NO: 979562 - RNA, 16 nt, Homo sapiens
cccugcuugcacuuug

SEQ ID NO: 979563 - RNA, 22 nt, Homo sapiens
gagaccaagacucugaaaucuc

SEQ ID NO: 979564 - RNA, 20 nt, Homo sapiens
gagaccccuuccuuuccucu

SEQ ID NO: 979565 - RNA, 14 nt, Homo sapiens
gagagauggaauaa

SEQ ID NO: 979566 - RNA, 20 nt, Homo sapiens
gagaguacagugagccaaga

SEQ ID NO: 979567 - RNA, 19 nt, Homo sapiens
gagcauuacgugagccagg

SEQ ID NO: 979568 - RNA, 23 nt, Homo sapiens
gaggcauuccagccccuauguua

SEQ ID NO: 979569 - RNA, 23 nt, Homo sapiens
gaggguuggguucaucugagcaa

SEQ ID NO: 979570 - RNA, 16 nt, Homo sapiens
gaguacagugagccaa

SEQ ID NO: 979571 - RNA, 14 nt, Homo sapiens
gaguggaucuccaa

SEQ ID NO: 979572 - RNA, 18 nt, Homo sapiens
gaguucccugaacaucug

SEQ ID NO: 979573 - RNA, 14 nt, Homo sapiens
gaguuucgagguag

SEQ ID NO: 979574 - RNA, 23 nt, Homo sapiens
gauacacugaaguuaacagagac

SEQ ID NO: 979575 - RNA, 12 nt, Homo sapiens
gauagggacuga

SEQ ID NO: 979576 - RNA, 19 nt, Homo sapiens
gaucuccaaggaccagguu

SEQ ID NO: 979577 - RNA, 21 nt, Homo sapiens
gauggaauaaagcccuugaac

SEQ ID NO: 979578 - RNA, 23 nt, Homo sapiens
gauggaauaaagcccuugaacca

SEQ ID NO: 979579 - RNA, 13 nt, Homo sapiens
gauuguauugcaa

SEQ ID NO: 979580 - RNA, 17 nt, Homo sapiens
gcaaggacggccuucaa

SEQ ID NO: 979581 - RNA, 23 nt, Homo sapiens
gcacaaccaugacgcacugcuca

SEQ ID NO: 979582 - RNA, 15 nt, Homo sapiens
gcacccccuggagag

SEQ ID NO: 979583 - RNA, 19 nt, Homo sapiens
gcaccgagagagauggaau

SEQ ID NO: 979584 - RNA, 22 nt, Homo sapiens
gcaccgagagagauggaauaaa

SEQ ID NO: 979585 - RNA, 20 nt, Homo sapiens
gcagagguaaaagugugagc

SEQ ID NO: 979586 - RNA, 22 nt, Homo sapiens
gcagcacuuuaacccucucuuc

SEQ ID NO: 979587 - RNA, 12 nt, Homo sapiens
gcauccugugac

SEQ ID NO: 979588 - RNA, 14 nt, Homo sapiens
gcauggugcaguug

SEQ ID NO: 979589 - RNA, 22 nt, Homo sapiens
caaaacucuccuacacuuccau

SEQ ID NO: 979590 - RNA, 19 nt, Homo sapiens
caaacguuuugaacuaaua

SEQ ID NO: 979591 - RNA, 17 nt, Homo sapiens
caaagauauauacacag

SEQ ID NO: 979592 - RNA, 13 nt, Homo sapiens
caaagcaccagcu

SEQ ID NO: 979593 - RNA, 20 nt, Homo sapiens
caacugaaaagacucagugu

SEQ ID NO: 979594 - RNA, 19 nt, Homo sapiens
caagaaauccaguuuccca

SEQ ID NO: 979595 - RNA, 16 nt, Homo sapiens
caauucuacccagagc

SEQ ID NO: 979596 - RNA, 14 nt, Homo sapiens
caauuucaguguau

SEQ ID NO: 979597 - RNA, 18 nt, Homo sapiens
cacaaaaaggcauaugca

SEQ ID NO: 979598 - RNA, 17 nt, Homo sapiens
cacaagcuggaagcaca

SEQ ID NO: 979599 - RNA, 18 nt, Homo sapiens
cacaagcuggaagcacau

SEQ ID NO: 979600 - RNA, 18 nt, Homo sapiens
cacagaugauaauaugcu

SEQ ID NO: 979601 - RNA, 21 nt, Homo sapiens
cacaguccuaccucaguucaa

SEQ ID NO: 979602 - RNA, 15 nt, Homo sapiens
cacaucccuuugaaa

SEQ ID NO: 979603 - RNA, 16 nt, Homo sapiens
caccaugcgcugcuca

SEQ ID NO: 979604 - RNA, 14 nt, Homo sapiens
cacccaugugccaa

SEQ ID NO: 979605 - RNA, 14 nt, Homo sapiens
cacuccagugccca

SEQ ID NO: 979606 - RNA, 21 nt, Homo sapiens
cagagaaguucuggcugaaca

SEQ ID NO: 979607 - RNA, 20 nt, Homo sapiens
cagagcccagggcaucccau

SEQ ID NO: 979608 - RNA, 21 nt, Homo sapiens
cagaggauuuaacugugaacc

SEQ ID NO: 979609 - RNA, 14 nt, Homo sapiens
cagauccucacaac

SEQ ID NO: 979610 - RNA, 16 nt, Homo sapiens
cagccucgcaugccag

SEQ ID NO: 979611 - RNA, 15 nt, Homo sapiens
cagcugaacagccaa

SEQ ID NO: 979612 - RNA, 22 nt, Homo sapiens
cagcuguggcuucuaggugccc

SEQ ID NO: 979613 - RNA, 14 nt, Homo sapiens
caggucuagacuuu

SEQ ID NO: 979614 - RNA, 15 nt, Homo sapiens
caggucuagacuuuc

SEQ ID NO: 979615 - RNA, 19 nt, Homo sapiens
caguguuugcaaugguguu

SEQ ID NO: 979616 - RNA, 22 nt, Homo sapiens
caguuaacuuuaagacugagca

SEQ ID NO: 979617 - RNA, 23 nt, Homo sapiens
caucaacaagaguugucuugucc

SEQ ID NO: 979618 - RNA, 16 nt, Homo sapiens
caucacagcagugcau

SEQ ID NO: 979619 - RNA, 21 nt, Homo sapiens
caucccaugggggugcugcag

SEQ ID NO: 979620 - RNA, 14 nt, Homo sapiens
caugcgcugcucaa

SEQ ID NO: 979621 - RNA, 17 nt, Homo sapiens
cauggaaauguccucca

SEQ ID NO: 979622 - RNA, 13 nt, Homo sapiens
cauggacaagguc

SEQ ID NO: 979623 - RNA, 20 nt, Homo sapiens
ccaaaauuaccaaaaaucuu

SEQ ID NO: 979624 - RNA, 12 nt, Homo sapiens
ccacaaacugau

SEQ ID NO: 979625 - RNA, 19 nt, Homo sapiens
ccacaaucugggacuuuca

SEQ ID NO: 979626 - RNA, 20 nt, Homo sapiens
ccacagcagcugaacagcca

SEQ ID NO: 979627 - RNA, 23 nt, Homo sapiens
ccaggcaggggugggagagccag

SEQ ID NO: 979628 - RNA, 19 nt, Homo sapiens
ccaguggugaagaaaacuc

SEQ ID NO: 979629 - RNA, 12 nt, Homo sapiens
ccagugucccca

SEQ ID NO: 979630 - RNA, 12 nt, Homo sapiens
ccauaacagcca

SEQ ID NO: 979631 - RNA, 13 nt, Homo sapiens
ccauaacagccaa

SEQ ID NO: 979632 - RNA, 12 nt, Homo sapiens
cccagauccuca

SEQ ID NO: 979633 - RNA, 12 nt, Homo sapiens
cccagcacuuug

SEQ ID NO: 979634 - RNA, 15 nt, Homo sapiens
cccagccacucggga

SEQ ID NO: 979635 - RNA, 17 nt, Homo sapiens
cccagccucgcaugcca

SEQ ID NO: 979636 - RNA, 18 nt, Homo sapiens
cccaugggggugcugcag

SEQ ID NO: 979637 - RNA, 17 nt, Homo sapiens
cccccggagcagggguc

SEQ ID NO: 979638 - RNA, 23 nt, Homo sapiens
ccccuuauccaggacucugucaa

SEQ ID NO: 979639 - RNA, 22 nt, Homo sapiens
cccgcaggcagccccacacccg

SEQ ID NO: 979640 - RNA, 21 nt, Homo sapiens
cccggcucccccugcuucuca

SEQ ID NO: 979641 - RNA, 14 nt, Homo sapiens
cccuccccagugcc

SEQ ID NO: 979642 - RNA, 18 nt, Homo sapiens
cccugaguggaucuccaa

SEQ ID NO: 979643 - RNA, 21 nt, Homo sapiens
cccuggcugaccccaaagagc

SEQ ID NO: 979644 - RNA, 17 nt, Homo sapiens
ccgagagagauggaaua

SEQ ID NO: 979645 - RNA, 22 nt, Homo sapiens
ccgugcucgcccacaaacugau

SEQ ID NO: 979646 - RNA, 20 nt, Homo sapiens
ccuaaagaggaaaagugcaa

SEQ ID NO: 979647 - RNA, 20 nt, Homo sapiens
ccuaaucaggcugagguguc

SEQ ID NO: 979648 - RNA, 15 nt, Homo sapiens
ccugaaggugccacu

SEQ ID NO: 979649 - RNA, 15 nt, Homo sapiens
ccugcgcauggugca

SEQ ID NO: 979650 - RNA, 19 nt, Homo sapiens
ccugggaggcggagaguac

SEQ ID NO: 979651 - RNA, 19 nt, Homo sapiens
ccuuaauagccauaugcaa

SEQ ID NO: 979652 - RNA, 19 nt, Homo sapiens
ccuuuccuccccaccuucc

SEQ ID NO: 979653 - RNA, 14 nt, Homo sapiens
cgaguguuugccag

SEQ ID NO: 979654 - RNA, 12 nt, Homo sapiens
cgcagauguuac

SEQ ID NO: 979655 - RNA, 14 nt, Homo sapiens
cgugccaguguccc

SEQ ID NO: 979656 - RNA, 13 nt, Homo sapiens
cuaagccacucuu

SEQ ID NO: 979657 - RNA, 19 nt, Homo sapiens
cuaggugcccgaguagcau

SEQ ID NO: 979658 - RNA, 20 nt, Homo sapiens
cuauaaagguugacaauaaa

SEQ ID NO: 979659 - RNA, 15 nt, Homo sapiens
cuaucacacaguggg

SEQ ID NO: 979660 - RNA, 19 nt, Homo sapiens
cuauuuuaagacgugaaug

SEQ ID NO: 979661 - RNA, 18 nt, Homo sapiens
cucacgcccagccuccuc

SEQ ID NO: 979662 - RNA, 13 nt, Homo sapiens
cucagugggacaa

SEQ ID NO: 979663 - RNA, 21 nt, Homo sapiens
cucagugggacaaaccagagc

SEQ ID NO: 979664 - RNA, 22 nt, Homo sapiens
cucauuguuuauuaacaaauua

SEQ ID NO: 979665 - RNA, 19 nt, Homo sapiens
cuccaggauugaagagcau

SEQ ID NO: 979666 - RNA, 16 nt, Homo sapiens
cuccugccuacauucc

SEQ ID NO: 979667 - RNA, 22 nt, Homo sapiens
cucuaagccacucuuccaaagg

SEQ ID NO: 979668 - RNA, 17 nt, Homo sapiens
cucuacugcuucaggaa

SEQ ID NO: 979669 - RNA, 15 nt, Homo sapiens
cucugcagcacuuua

SEQ ID NO: 979670 - RNA, 17 nt, Homo sapiens
cucuggaaaaugugacc

SEQ ID NO: 979671 - RNA, 20 nt, Homo sapiens
cucuuccaaaggcauaagac

SEQ ID NO: 979672 - RNA, 22 nt, Homo sapiens
cugaauauggacccugcugaaa

SEQ ID NO: 979673 - RNA, 12 nt, Homo sapiens
cugagaauucca

SEQ ID NO: 979674 - RNA, 20 nt, Homo sapiens
cugagcugaacccauuuuga

SEQ ID NO: 979675 - RNA, 15 nt, Homo sapiens
cugauacccagagca

SEQ ID NO: 979676 - RNA, 13 nt, Homo sapiens
cugcaccgagaga

SEQ ID NO: 979677 - RNA, 14 nt, Homo sapiens
cugcagcacuuuaa

SEQ ID NO: 979678 - RNA, 18 nt, Homo sapiens
cugcucuggaaaauguga

SEQ ID NO: 979679 - RNA, 22 nt, Homo sapiens
cugcucuggaaaaugugaccca

SEQ ID NO: 979680 - RNA, 16 nt, Homo sapiens
cuggaaaacucaggau

SEQ ID NO: 979681 - RNA, 16 nt, Homo sapiens
cuggaggucacauuca

SEQ ID NO: 979682 - RNA, 13 nt, Homo sapiens
cuggagugcaguu

SEQ ID NO: 979683 - RNA, 18 nt, Homo sapiens
cuggcugagcugaaccca

SEQ ID NO: 979684 - RNA, 23 nt, Homo sapiens
cuggcuuccagguaucuccagga

SEQ ID NO: 979685 - RNA, 13 nt, Homo sapiens
cuggcuuugcaag

SEQ ID NO: 979686 - RNA, 22 nt, Homo sapiens
cugggaguucccugaacaucug

SEQ ID NO: 979687 - RNA, 17 nt, Homo sapiens
cuguaaucccagcacuu

SEQ ID NO: 979688 - RNA, 18 nt, Homo sapiens
cuguaaucccagcacuuu

SEQ ID NO: 979689 - RNA, 21 nt, Homo sapiens
cuguauaaucuauuuacauaa

SEQ ID NO: 979690 - RNA, 17 nt, Homo sapiens
cuguguacccacuccuc

SEQ ID NO: 979691 - RNA, 16 nt, Homo sapiens
cuuaagccuuuugcuc

SEQ ID NO: 979692 - RNA, 21 nt, Homo sapiens
cuuagcuucuauuauagccac

SEQ ID NO: 979693 - RNA, 19 nt, Homo sapiens
cuucaggaaggacauggac

SEQ ID NO: 979694 - RNA, 14 nt, Homo sapiens
cuugaaaccaaaga

SEQ ID NO: 979695 - RNA, 13 nt, Homo sapiens
cuugaaucaaagc

SEQ ID NO: 979696 - RNA, 16 nt, Homo sapiens
cuuucuggaaaagagg

SEQ ID NO: 979697 - RNA, 20 nt, Homo sapiens
cuuuugcuugaaaccaaaga

SEQ ID NO: 979698 - RNA, 15 nt, Homo sapiens
gaaaaacuuccauga

SEQ ID NO: 979699 - RNA, 20 nt, Homo sapiens
uuaguuuugggaauaggcau

SEQ ID NO: 979700 - RNA, 21 nt, Homo sapiens
uuauacaucacagcagugcau

SEQ ID NO: 979701 - RNA, 16 nt, Homo sapiens
uuauuaagauguauaa

SEQ ID NO: 979702 - RNA, 23 nt, Homo sapiens
uucacaaaaaggcauaugcaaua

SEQ ID NO: 979703 - RNA, 19 nt, Homo sapiens
uucaguugaucacuggcaa

SEQ ID NO: 979704 - RNA, 22 nt, Homo sapiens
uuccagccccuauguuauugau

SEQ ID NO: 979705 - RNA, 13 nt, Homo sapiens
uucuaggugcccg

SEQ ID NO: 979706 - RNA, 21 nt, Homo sapiens
uucugggaguucccugaacau

SEQ ID NO: 979707 - RNA, 15 nt, Homo sapiens
uucuguucaucuuaa

SEQ ID NO: 979708 - RNA, 18 nt, Homo sapiens
uugaccggcagaauguuc

SEQ ID NO: 979709 - RNA, 20 nt, Homo sapiens
uugagugacucgaggguugg

SEQ ID NO: 979710 - RNA, 16 nt, Homo sapiens
uugccugugugagcau

SEQ ID NO: 979711 - RNA, 21 nt, Homo sapiens
uugcugucauaagaaugaaua

SEQ ID NO: 979712 - RNA, 12 nt, Homo sapiens
uuggauuccagu

SEQ ID NO: 979713 - RNA, 15 nt, Homo sapiens
uugggcaugcucagc

SEQ ID NO: 979714 - RNA, 16 nt, Homo sapiens
uuguaacuucaaauau

SEQ ID NO: 979715 - RNA, 16 nt, Homo sapiens
uuguaccagugugaau

SEQ ID NO: 979716 - RNA, 20 nt, Homo sapiens
uugucuguuuuuguaacuua

SEQ ID NO: 979717 - RNA, 23 nt, Homo sapiens
uuguucgccgcguggaaugugag

SEQ ID NO: 979718 - RNA, 14 nt, Homo sapiens
uuguugcugucaag

SEQ ID NO: 979719 - RNA, 16 nt, Homo sapiens
uuuagucuguauugau

SEQ ID NO: 979720 - RNA, 21 nt, Homo sapiens
uuucacaaaaaggcauaugca

SEQ ID NO: 979721 - RNA, 23 nt, Homo sapiens
uuucaguguaugauauacuuuau

SEQ ID NO: 979722 - RNA, 16 nt, Homo sapiens
gugaacugcgugccag

SEQ ID NO: 979723 - RNA, 21 nt, Homo sapiens
gugaccccuccccagugccuc

SEQ ID NO: 979724 - RNA, 12 nt, Homo sapiens
gugacucucuug

SEQ ID NO: 979725 - RNA, 20 nt, Homo sapiens
guggggaccgggcucugaca

SEQ ID NO: 979726 - RNA, 18 nt, Homo sapiens
guggucaaaccgcacuca

SEQ ID NO: 979727 - RNA, 14 nt, Homo sapiens
guucugaguguuuu

SEQ ID NO: 979728 - RNA, 19 nt, Homo sapiens
guuguucgccgcguggaau

SEQ ID NO: 979729 - RNA, 13 nt, Homo sapiens
uaaaaagaggcau

SEQ ID NO: 979730 - RNA, 20 nt, Homo sapiens
uaaaauauuuuuugcuauau

SEQ ID NO: 979731 - RNA, 14 nt, Homo sapiens
uaaaauguuauuau

SEQ ID NO: 979732 - RNA, 23 nt, Homo sapiens
uaaaauuaaguuguaucauuuca

SEQ ID NO: 979733 - RNA, 14 nt, Homo sapiens
uaaagaaguuugau

SEQ ID NO: 979734 - RNA, 13 nt, Homo sapiens
uaaagcccuugaa

SEQ ID NO: 979735 - RNA, 16 nt, Homo sapiens
uaacagacuuguuuaa

SEQ ID NO: 979736 - RNA, 12 nt, Homo sapiens
uaagcucuggcu

SEQ ID NO: 979737 - RNA, 20 nt, Homo sapiens
uaagggaaggaacucuggcu

SEQ ID NO: 979738 - RNA, 16 nt, Homo sapiens
uaauagccauaugcaa

SEQ ID NO: 979739 - RNA, 17 nt, Homo sapiens
uaauagccauaugcaau

SEQ ID NO: 979740 - RNA, 16 nt, Homo sapiens
uacagugagccaagau

SEQ ID NO: 979741 - RNA, 15 nt, Homo sapiens
uacauacagagguaa

SEQ ID NO: 979742 - RNA, 15 nt, Homo sapiens
uacauuucuguucau

SEQ ID NO: 979743 - RNA, 22 nt, Homo sapiens
uacauuuugccugacuuaccuu

SEQ ID NO: 979744 - RNA, 16 nt, Homo sapiens
uacccggcccagagac

SEQ ID NO: 979745 - RNA, 17 nt, Homo sapiens
uaccuaaaacugcugaa

SEQ ID NO: 979746 - RNA, 17 nt, Homo sapiens
uaccugcgauguuuacg

SEQ ID NO: 979747 - RNA, 15 nt, Homo sapiens
uacgggcugcucuac

SEQ ID NO: 979748 - RNA, 17 nt, Homo sapiens
uacuuauucuagauuac

SEQ ID NO: 979749 - RNA, 17 nt, Homo sapiens
uagaggaagaccaaaaa

SEQ ID NO: 979750 - RNA, 13 nt, Homo sapiens
uagcaauuccagg

SEQ ID NO: 979751 - RNA, 12 nt, Homo sapiens
uagcucuuucag

SEQ ID NO: 979752 - RNA, 23 nt, Homo sapiens
uagcugaagaaguuauucucaag

SEQ ID NO: 979753 - RNA, 20 nt, Homo sapiens
uauaagcagauuuaacaauu

SEQ ID NO: 979754 - RNA, 19 nt, Homo sapiens
uauauuguauuaagggcau

SEQ ID NO: 979755 - RNA, 22 nt, Homo sapiens
uauccguagaguagucaugaca

SEQ ID NO: 979756 - RNA, 18 nt, Homo sapiens
uaugcuccaguauggaag

SEQ ID NO: 979757 - RNA, 17 nt, Homo sapiens
uauuuuaagacgugaau

SEQ ID NO: 979758 - RNA, 16 nt, Homo sapiens
uauuuuuguacguuau

SEQ ID NO: 979759 - RNA, 18 nt, Homo sapiens
ucacaaccaccuaaucag

SEQ ID NO: 979760 - RNA, 20 nt, Homo sapiens
ucacagcagugcauaggcca

SEQ ID NO: 979761 - RNA, 18 nt, Homo sapiens
ucacucuuccugcaagga

SEQ ID NO: 979762 - RNA, 13 nt, Homo sapiens
ucagauaugauau

SEQ ID NO: 979763 - RNA, 21 nt, Homo sapiens
ucagauauuuuuucagaaaua

SEQ ID NO: 979764 - RNA, 19 nt, Homo sapiens
ucaggaagggaaagccaga

SEQ ID NO: 979765 - RNA, 21 nt, Homo sapiens
ucaguguaugauauacuuuau

SEQ ID NO: 979766 - RNA, 16 nt, Homo sapiens
ucaugacacuauacag

SEQ ID NO: 979767 - RNA, 19 nt, Homo sapiens
uccaguuucccaccaccuu

SEQ ID NO: 979768 - RNA, 14 nt, Homo sapiens
uccaugaagaccac

SEQ ID NO: 979769 - RNA, 20 nt, Homo sapiens
ucccaccaugcgcugcucaa

SEQ ID NO: 979770 - RNA, 17 nt, Homo sapiens
ucccagccacucgggag

SEQ ID NO: 979771 - RNA, 23 nt, Homo sapiens
ucccaugugcauggaaauguccu

SEQ ID NO: 979772 - RNA, 21 nt, Homo sapiens
ucccucugagaauuccaagga

SEQ ID NO: 979773 - RNA, 19 nt, Homo sapiens
ucccucuuugccuguguga

SEQ ID NO: 979774 - RNA, 18 nt, Homo sapiens
ucccuuuccuacucucag

SEQ ID NO: 979775 - RNA, 19 nt, Homo sapiens
uccugcgcauggugcagug

SEQ ID NO: 979776 - RNA, 18 nt, Homo sapiens
uccuguacauuucacaaa

SEQ ID NO: 979777 - RNA, 13 nt, Homo sapiens
uccuguguggaag

SEQ ID NO: 979778 - RNA, 23 nt, Homo sapiens
uccuuaauagccauaugcaauaa

SEQ ID NO: 979779 - RNA, 16 nt, Homo sapiens
uccuucccccaucccc

SEQ ID NO: 979780 - RNA, 12 nt, Homo sapiens
ucuaacucuccc

SEQ ID NO: 979781 - RNA, 22 nt, Homo sapiens
ucuacugugacugauguuacau

SEQ ID NO: 979782 - RNA, 16 nt, Homo sapiens
ucucgcagauguuacc

SEQ ID NO: 979783 - RNA, 20 nt, Homo sapiens
ucucuacccggcccagagac

SEQ ID NO: 979784 - RNA, 21 nt, Homo sapiens
ucucuacuaaaaacacaaaag

SEQ ID NO: 979785 - RNA, 19 nt, Homo sapiens
ucucuuuuuaccuuuaaca

SEQ ID NO: 979786 - RNA, 17 nt, Homo sapiens
ucugagaauuccaagga

SEQ ID NO: 979787 - RNA, 20 nt, Homo sapiens
ucugauacccagagcauuac

SEQ ID NO: 979788 - RNA, 12 nt, Homo sapiens
ucugcacccagg

SEQ ID NO: 979789 - RNA, 16 nt, Homo sapiens
ucuggcccuucuugcc

SEQ ID NO: 979790 - RNA, 11 nt, Homo sapiens
ucuucagccau

SEQ ID NO: 979791 - RNA, 24 nt, Homo sapiens
ucuugggggguuuuuacuccagug

SEQ ID NO: 979792 - RNA, 17 nt, Homo sapiens
ugaaaagacucaguguu

SEQ ID NO: 979793 - RNA, 20 nt, Homo sapiens
ugaaacaagauaacugagaa

SEQ ID NO: 979794 - RNA, 15 nt, Homo sapiens
ugaagaaaacuccuu

SEQ ID NO: 979795 - RNA, 18 nt, Homo sapiens
ugaagcaaccuacuuuug

SEQ ID NO: 979796 - RNA, 17 nt, Homo sapiens
ugaaggaggugagggau

SEQ ID NO: 979797 - RNA, 23 nt, Homo sapiens
ugaaggaggugagggaugugaau

SEQ ID NO: 979798 - RNA, 16 nt, Homo sapiens
ugaaggucacucuucc

SEQ ID NO: 979799 - RNA, 22 nt, Homo sapiens
ugaaggugccacuccagugccc

SEQ ID NO: 979800 - RNA, 16 nt, Homo sapiens
ugaaguuuuuauuuag

SEQ ID NO: 979801 - RNA, 14 nt, Homo sapiens
ugacaagcacugcu

SEQ ID NO: 979802 - RNA, 17 nt, Homo sapiens
ugacagcaggugggaaa

SEQ ID NO: 979803 - RNA, 14 nt, Homo sapiens
ugaccccaaagagc

SEQ ID NO: 979804 - RNA, 17 nt, Homo sapiens
ugaccccuccccagugc

SEQ ID NO: 979805 - RNA, 19 nt, Homo sapiens
ugagagcugcucuggaaaa

SEQ ID NO: 979806 - RNA, 12 nt, Homo sapiens
ugagccagguaa

SEQ ID NO: 979807 - RNA, 20 nt, Homo sapiens
ugagggacuggaaccaggga

SEQ ID NO: 979808 - RNA, 18 nt, Homo sapiens
ugaguggaucuccaagga

SEQ ID NO: 979809 - RNA, 17 nt, Homo sapiens
ugauauuuuuacuugca

SEQ ID NO: 979810 - RNA, 15 nt, Homo sapiens
ugaucacacucuggg

SEQ ID NO: 979811 - RNA, 14 nt, Homo sapiens
ugcaauauuuacau

SEQ ID NO: 979812 - RNA, 20 nt, Homo sapiens
ugcaccgagagagauggaau

SEQ ID NO: 979813 - RNA, 15 nt, Homo sapiens
ugccugugugagcau

SEQ ID NO: 979814 - RNA, 23 nt, Homo sapiens
ugcuauaggcuggagaagcucac

SEQ ID NO: 979815 - RNA, 13 nt, Homo sapiens
ugcuccaguaugg

SEQ ID NO: 979816 - RNA, 16 nt, Homo sapiens
ugcucuacugcuucag

SEQ ID NO: 979817 - RNA, 14 nt, Homo sapiens
ugcucugucuucca

SEQ ID NO: 979818 - RNA, 21 nt, Homo sapiens
ugcuuccgugcugaacuuuag

SEQ ID NO: 979819 - RNA, 16 nt, Homo sapiens
uggaaaacucaggauu

SEQ ID NO: 979820 - RNA, 14 nt, Homo sapiens
uggaaaaugugacc

SEQ ID NO: 979821 - RNA, 17 nt, Homo sapiens
uggaauaaagcccuuga

SEQ ID NO: 979822 - RNA, 19 nt, Homo sapiens
uggaauaaagcccuugaac

SEQ ID NO: 979823 - RNA, 20 nt, Homo sapiens
uggcaaugaaaaauucucag

SEQ ID NO: 979824 - RNA, 15 nt, Homo sapiens
uggcugaccccaaag

SEQ ID NO: 979825 - RNA, 20 nt, Homo sapiens
ugguucguguucauacugca

SEQ ID NO: 979826 - RNA, 19 nt, Homo sapiens
uguaaacauaauucuugua

SEQ ID NO: 979827 - RNA, 19 nt, Homo sapiens
uguaaucccagcacuuugg

SEQ ID NO: 979828 - RNA, 21 nt, Homo sapiens
ugucugauuggcucacccaag

SEQ ID NO: 979829 - RNA, 17 nt, Homo sapiens
ugugagcagugaguuac

SEQ ID NO: 979830 - RNA, 20 nt, Homo sapiens
ugugcaugaaagagaaagac

SEQ ID NO: 979831 - RNA, 22 nt, Homo sapiens
ugugggacugacauuucucaau

SEQ ID NO: 979832 - RNA, 20 nt, Homo sapiens
uguuucagcccgaagcugcu

SEQ ID NO: 979833 - RNA, 16 nt, Homo sapiens
uuaaaaaacguauuau

SEQ ID NO: 979834 - RNA, 15 nt, Homo sapiens
uuaacaaaauuagcu

SEQ ID NO: 979835 - RNA, 21 nt, Homo sapiens
uuaaggagaggagaaacugag

SEQ ID NO: 979836 - RNA, 15 nt, Homo sapiens
uuaaggauugugaua

SEQ ID NO: 979837 - RNA, 18 nt, Homo sapiens
uuaccuaaaacugcugaa

SEQ ID NO: 979838 - RNA, 16 nt, Homo sapiens
uuagcugaagaaguua

SEQ ID NO: 979839 - RNA, 17 nt, Homo sapiens
uucaggaagaugaaaga

SEQ ID NO: 979840 - RNA, 20 nt, Homo sapiens
uucccaguggucaaaccgca

SEQ ID NO: 979841 - RNA, 20 nt, Homo sapiens
uuccuauuuggggcuugcau

SEQ ID NO: 979842 - RNA, 18 nt, Homo sapiens
uuccugcgcauggugcag

SEQ ID NO: 979843 - RNA, 23 nt, Homo sapiens
uuccugcgcauggugcagugccg

SEQ ID NO: 979844 - RNA, 15 nt, Homo sapiens
uucuacugugacuga

SEQ ID NO: 979845 - RNA, 17 nt, Homo sapiens
uucuuaaagaguucuua

SEQ ID NO: 979846 - RNA, 18 nt, Homo sapiens
uugaagagcauugcaugg

SEQ ID NO: 979847 - RNA, 14 nt, Homo sapiens
uugacauaacacua

SEQ ID NO: 979848 - RNA, 19 nt, Homo sapiens
uuguucgccgcguggaaug

SEQ ID NO: 979849 - RNA, 18 nt, Homo sapiens
uuuaacugugaaccugga

SEQ ID NO: 979850 - RNA, 14 nt, Homo sapiens
uuuaccacagcagc

SEQ ID NO: 979851 - RNA, 14 nt, Homo sapiens
uuuccucugcagca

SEQ ID NO: 979852 - RNA, 15 nt, Homo sapiens
uuucuguaaccaaaa

SEQ ID NO: 979853 - RNA, 19 nt, Homo sapiens
uuuuagaggaagaccaaaa

SEQ ID NO: 979854 - RNA, 17 nt, Homo sapiens
uuuuuacuccaguggug

SEQ ID NO: 979855 - RNA, 12 nt, Homo sapiens
uuuuugcuauau

SEQ ID NO: 979856 - RNA, 12 nt, Homo sapiens
aaaaaauuccgg

SEQ ID NO: 979857 - RNA, 12 nt, Homo sapiens
aaaaguguccau

SEQ ID NO: 979858 - RNA, 19 nt, Homo sapiens
aaaaucuggugcucaauaa

SEQ ID NO: 979859 - RNA, 12 nt, Homo sapiens
aaacaaugccau

SEQ ID NO: 979860 - RNA, 21 nt, Homo sapiens
aaaccauccucucccuucuua

SEQ ID NO: 979861 - RNA, 22 nt, Homo sapiens
aaaccuuccaugucaagauuca

SEQ ID NO: 979862 - RNA, 15 nt, Homo sapiens
aaagcaaaauccaac

SEQ ID NO: 979863 - RNA, 19 nt, Homo sapiens
aaauauggaaagcaccuca

SEQ ID NO: 979864 - RNA, 21 nt, Homo sapiens
aaauccuugagauguggguau

SEQ ID NO: 979865 - RNA, 12 nt, Homo sapiens
aaaucuggugcu

SEQ ID NO: 979866 - RNA, 16 nt, Homo sapiens
aaauguauuaucacca

SEQ ID NO: 979867 - RNA, 19 nt, Homo sapiens
aacaauaaaaguguccauu

SEQ ID NO: 979868 - RNA, 22 nt, Homo sapiens
aacagacggacagcguguggca

SEQ ID NO: 979869 - RNA, 20 nt, Homo sapiens
aacagauaacagugugcuca

SEQ ID NO: 979870 - RNA, 21 nt, Homo sapiens
aacagcuuugugaacguggca

SEQ ID NO: 979871 - RNA, 18 nt, Homo sapiens
aacaggauguggaaaaug

SEQ ID NO: 979872 - RNA, 13 nt, Homo sapiens
aacagugugcuca

SEQ ID NO: 979873 - RNA, 17 nt, Homo sapiens
aaccauugugcauucua

SEQ ID NO: 979874 - RNA, 18 nt, Homo sapiens
aacccccagccccuccau

SEQ ID NO: 979875 - RNA, 14 nt, Homo sapiens
aacguacccaaggu

SEQ ID NO: 979876 - RNA, 17 nt, Homo sapiens
aacugcauugcugauuc

SEQ ID NO: 979877 - RNA, 12 nt, Homo sapiens
aacuuuguacca

SEQ ID NO: 979878 - RNA, 14 nt, Homo sapiens
aagacaacuuccuc

SEQ ID NO: 979879 - RNA, 14 nt, Homo sapiens
aagccagggacuaa

SEQ ID NO: 979880 - RNA, 19 nt, Homo sapiens
aagcccauggcugguggca

SEQ ID NO: 979881 - RNA, 17 nt, Homo sapiens
aagucaacuuagcauuu

SEQ ID NO: 979882 - RNA, 19 nt, Homo sapiens
aagucaucaugaacuggcu

SEQ ID NO: 979883 - RNA, 19 nt, Homo sapiens
aagucccuugaccuuucca

SEQ ID NO: 979884 - RNA, 15 nt, Homo sapiens
aauaaaauacagcca

SEQ ID NO: 979885 - RNA, 12 nt, Homo sapiens
aaucacuugaau

SEQ ID NO: 979886 - RNA, 16 nt, Homo sapiens
aaucccuucuccacuu

SEQ ID NO: 979887 - RNA, 12 nt, Homo sapiens
aauccuugagau

SEQ ID NO: 979888 - RNA, 19 nt, Homo sapiens
aauccuugagaugugggua

SEQ ID NO: 979889 - RNA, 20 nt, Homo sapiens
aaucuauugaaagaagaaca

SEQ ID NO: 979890 - RNA, 12 nt, Homo sapiens
aaugaaggucau

SEQ ID NO: 979891 - RNA, 22 nt, Homo sapiens
aaugagguggcucaugccugua

SEQ ID NO: 979892 - RNA, 12 nt, Homo sapiens
aauguaugcauu

SEQ ID NO: 979893 - RNA, 22 nt, Homo sapiens
aauucugccuuaaauaaaacug

SEQ ID NO: 979894 - RNA, 22 nt, Homo sapiens
aauugaaugggggaggcccaau

SEQ ID NO: 979895 - RNA, 21 nt, Homo sapiens
aauugggggagucauggucag

SEQ ID NO: 979896 - RNA, 18 nt, Homo sapiens
acaaguagagaugaaguu

SEQ ID NO: 979897 - RNA, 17 nt, Homo sapiens
acaauaaaaguguccau

SEQ ID NO: 979898 - RNA, 13 nt, Homo sapiens
acaauacuugcau

SEQ ID NO: 979899 - RNA, 23 nt, Homo sapiens
acaauguauuuuaauaacauauc

SEQ ID NO: 979900 - RNA, 21 nt, Homo sapiens
acacuuugccaaacaggaugu

SEQ ID NO: 979901 - RNA, 14 nt, Homo sapiens
acagggcaugccug

SEQ ID NO: 979902 - RNA, 19 nt, Homo sapiens
acauagcugggauuugaac

SEQ ID NO: 979903 - RNA, 22 nt, Homo sapiens
acauaucuaaagucaucaugaa

SEQ ID NO: 979904 - RNA, 12 nt, Homo sapiens
acauuccuggcc

SEQ ID NO: 979905 - RNA, 17 nt, Homo sapiens
accacaggccugagcca

SEQ ID NO: 979906 - RNA, 16 nt, Homo sapiens
accacccagagcaccc

SEQ ID NO: 979907 - RNA, 23 nt, Homo sapiens
accaguccuagccgcgugugaca

SEQ ID NO: 979908 - RNA, 21 nt, Homo sapiens
accauccucucccuucuuaca

SEQ ID NO: 979909 - RNA, 13 nt, Homo sapiens
acccaccacaucu

SEQ ID NO: 979910 - RNA, 19 nt, Homo sapiens
acccaggcuagagugcaau

SEQ ID NO: 979911 - RNA, 12 nt, Homo sapiens
accccgugccac

SEQ ID NO: 979912 - RNA, 13 nt, Homo sapiens
acccuccuucugu

SEQ ID NO: 979913 - RNA, 18 nt, Homo sapiens
acccuuaaacaguugcac

SEQ ID NO: 979914 - RNA, 23 nt, Homo sapiens
acccuuccugccaagccagggac

SEQ ID NO: 979915 - RNA, 21 nt, Homo sapiens
accucccccuguguggcccug

SEQ ID NO: 979916 - RNA, 20 nt, Homo sapiens
accuccuccacucacuccag

SEQ ID NO: 979917 - RNA, 13 nt, Homo sapiens
accuuccauguca

SEQ ID NO: 979918 - RNA, 18 nt, Homo sapiens
acgcucaugacagcaaag

SEQ ID NO: 979919 - RNA, 18 nt, Homo sapiens
acggaucagaugucuaua

SEQ ID NO: 979920 - RNA, 21 nt, Homo sapiens
acuaaaccauugugcauucua

SEQ ID NO: 979921 - RNA, 16 nt, Homo sapiens
acuacccgagcccagc

SEQ ID NO: 979922 - RNA, 18 nt, Homo sapiens
acuaguggggcuuaauga

SEQ ID NO: 979923 - RNA, 15 nt, Homo sapiens
acuauaaugguugga

SEQ ID NO: 979924 - RNA, 14 nt, Homo sapiens
acuccauugcuuaa

SEQ ID NO: 979925 - RNA, 17 nt, Homo sapiens
acucuggagcaaccuac

SEQ ID NO: 979926 - RNA, 16 nt, Homo sapiens
acugagaaaggcucaa

SEQ ID NO: 979927 - RNA, 12 nt, Homo sapiens
acugcaaccucc

SEQ ID NO: 979928 - RNA, 16 nt, Homo sapiens
acugcuaugugucaca

SEQ ID NO: 979929 - RNA, 12 nt, Homo sapiens
acugcuuugaca

SEQ ID NO: 979930 - RNA, 14 nt, Homo sapiens
acuguggccuggca

SEQ ID NO: 979931 - RNA, 15 nt, Homo sapiens
acuguggccuggcau

SEQ ID NO: 979932 - RNA, 22 nt, Homo sapiens
acuuagcauuuucugcaucucc

SEQ ID NO: 979933 - RNA, 15 nt, Homo sapiens
acuugaauccauuga

SEQ ID NO: 979934 - RNA, 14 nt, Homo sapiens
acuugacaggguuu

SEQ ID NO: 979935 - RNA, 20 nt, Homo sapiens
agaaacacauaaacaccauu

SEQ ID NO: 979936 - RNA, 20 nt, Homo sapiens
agaaauaaacaggaguucag

SEQ ID NO: 979937 - RNA, 19 nt, Homo sapiens
agaaaucauuauugaguca

SEQ ID NO: 979938 - RNA, 17 nt, Homo sapiens
agaacagcauggcccga

SEQ ID NO: 979939 - RNA, 23 nt, Homo sapiens
agaaggcaggagugcugcccucu

SEQ ID NO: 979940 - RNA, 15 nt, Homo sapiens
agaccaugaucucaa

SEQ ID NO: 979941 - RNA, 16 nt, Homo sapiens
agacccucuucucugg

SEQ ID NO: 979942 - RNA, 19 nt, Homo sapiens
agagaaaccauccucuccc

SEQ ID NO: 979943 - RNA, 21 nt, Homo sapiens
agagaugaaguuaaagguauu

SEQ ID NO: 979944 - RNA, 20 nt, Homo sapiens
agagcaagacuccgucucaa

SEQ ID NO: 979945 - RNA, 22 nt, Homo sapiens
agauaacagugugcucauagaa

SEQ ID NO: 979946 - RNA, 14 nt, Homo sapiens
agaugaaauuccau

SEQ ID NO: 979947 - RNA, 15 nt, Homo sapiens
agaugggacaauuag

SEQ ID NO: 979948 - RNA, 16 nt, Homo sapiens
agcacucgagaccauc

SEQ ID NO: 979949 - RNA, 12 nt, Homo sapiens
agccacugugcc

SEQ ID NO: 979950 - RNA, 22 nt, Homo sapiens
agccauguaccacauaacaaca

SEQ ID NO: 979951 - RNA, 19 nt, Homo sapiens
agcccagaagcccaguaac

SEQ ID NO: 979952 - RNA, 17 nt, Homo sapiens
agcccagcuacauuccu

SEQ ID NO: 979953 - RNA, 20 nt, Homo sapiens
agcccauuccucccauucaa

SEQ ID NO: 979954 - RNA, 17 nt, Homo sapiens
agcccccacccaugcca

SEQ ID NO: 979955 - RNA, 22 nt, Homo sapiens
agccgcgugugacagucuugca

SEQ ID NO: 979956 - RNA, 15 nt, Homo sapiens
agccgugcagcuggg

SEQ ID NO: 979957 - RNA, 19 nt, Homo sapiens
agccugggugacagagcaa

SEQ ID NO: 979958 - RNA, 16 nt, Homo sapiens
agcuagcagaagacaa

SEQ ID NO: 979959 - RNA, 16 nt, Homo sapiens
aggaaccaaccaacaa

SEQ ID NO: 979960 - RNA, 13 nt, Homo sapiens
aggacaaacagac

SEQ ID NO: 979961 - RNA, 19 nt, Homo sapiens
aggaccaaagauacaugua

SEQ ID NO: 979962 - RNA, 17 nt, Homo sapiens
aggcaggagaauggcgu

SEQ ID NO: 979963 - RNA, 19 nt, Homo sapiens
aggcaggaggauccccuga

SEQ ID NO: 979964 - RNA, 19 nt, Homo sapiens
aggccugagccacugugcc

SEQ ID NO: 979965 - RNA, 18 nt, Homo sapiens
aggccuucugauuucaag

SEQ ID NO: 979966 - RNA, 22 nt, Homo sapiens
aggccuucugggccuccaaagc

SEQ ID NO: 979967 - RNA, 23 nt, Homo sapiens
aggcguggugggauuugcuccug

SEQ ID NO: 979968 - RNA, 16 nt, Homo sapiens
aggcucuguuccacau

SEQ ID NO: 979969 - RNA, 17 nt, Homo sapiens
aggcugaggcaggagaa

SEQ ID NO: 979970 - RNA, 21 nt, Homo sapiens
agggaggaacaccugaucuua

SEQ ID NO: 979971 - RNA, 19 nt, Homo sapiens
aggggagaaccugguugca

SEQ ID NO: 979972 - RNA, 16 nt, Homo sapiens
aggggcucauguucag

SEQ ID NO: 979973 - RNA, 15 nt, Homo sapiens
agguauauaccucca

SEQ ID NO: 979974 - RNA, 18 nt, Homo sapiens
aggucauggucugagugg

SEQ ID NO: 979975 - RNA, 20 nt, Homo sapiens
aggugugagccaccgugccc

SEQ ID NO: 979976 - RNA, 14 nt, Homo sapiens
agucagucauguca

SEQ ID NO: 979977 - RNA, 21 nt, Homo sapiens
agucuuacucugucacccagg

SEQ ID NO: 979978 - RNA, 21 nt, Homo sapiens
agugcuuaugucauagccuua

SEQ ID NO: 979979 - RNA, 13 nt, Homo sapiens
agugcuugugauu

SEQ ID NO: 979980 - RNA, 15 nt, Homo sapiens
aguggcauccauuuc

SEQ ID NO: 979981 - RNA, 21 nt, Homo sapiens
aguggccaagagaugcagugc

SEQ ID NO: 979982 - RNA, 13 nt, Homo sapiens
agugggacccaua

SEQ ID NO: 979983 - RNA, 22 nt, Homo sapiens
aguucaugggcaccucauggac

SEQ ID NO: 979984 - RNA, 21 nt, Homo sapiens
aguucucuuuugauguagguu

SEQ ID NO: 979985 - RNA, 17 nt, Homo sapiens
aguuggggcggcccacg

SEQ ID NO: 979986 - RNA, 20 nt, Homo sapiens
aguuggggcggcccacgcca

SEQ ID NO: 979987 - RNA, 12 nt, Homo sapiens
aguuucaccagg

SEQ ID NO: 979988 - RNA, 21 nt, Homo sapiens
aguuuuguaaauguacuggua

SEQ ID NO: 979989 - RNA, 15 nt, Homo sapiens
auaaaauacagccau

SEQ ID NO: 979990 - RNA, 18 nt, Homo sapiens
auaaacaccauuuaguca

SEQ ID NO: 979991 - RNA, 17 nt, Homo sapiens
auaauacccacauuaca

SEQ ID NO: 979992 - RNA, 15 nt, Homo sapiens
auaauuaaggccaga

SEQ ID NO: 979993 - RNA, 13 nt, Homo sapiens
auaccuccauguu

SEQ ID NO: 979994 - RNA, 19 nt, Homo sapiens
auacgacagcucucugugc

SEQ ID NO: 979995 - RNA, 15 nt, Homo sapiens
auagcucaggguaag

SEQ ID NO: 979996 - RNA, 19 nt, Homo sapiens
auagcugggauuugaacug

SEQ ID NO: 979997 - RNA, 15 nt, Homo sapiens
auauauuuccacuuc

SEQ ID NO: 979998 - RNA, 23 nt, Homo sapiens
auauauuuccacuucuucauucu

SEQ ID NO: 979999 - RNA, 17 nt, Homo sapiens
auaugaagaccaaauga

SEQ ID NO: 980000 - RNA, 23 nt, Homo sapiens
auauuauuguuuucuacugcuau

SEQ ID NO: 980001 - RNA, 13 nt, Homo sapiens
aucaugugcuuca

SEQ ID NO: 980002 - RNA, 20 nt, Homo sapiens
auccauuucuaauguaugca

SEQ ID NO: 980003 - RNA, 16 nt, Homo sapiens
aucccagucucugcca

SEQ ID NO: 980004 - RNA, 17 nt, Homo sapiens
aucccuggccaccugcc

SEQ ID NO: 980005 - RNA, 18 nt, Homo sapiens
aucccuggccaccugcca

SEQ ID NO: 980006 - RNA, 21 nt, Homo sapiens
aucccuggccaccugccaggc

SEQ ID NO: 980007 - RNA, 20 nt, Homo sapiens
aucguggugugucaaugcca

SEQ ID NO: 980008 - RNA, 20 nt, Homo sapiens
aucuccacuuggcauuagcu

SEQ ID NO: 980009 - RNA, 16 nt, Homo sapiens
aucuggugcucaauaa

SEQ ID NO: 980010 - RNA, 17 nt, Homo sapiens
aucuuggcucacugcaa

SEQ ID NO: 980011 - RNA, 17 nt, Homo sapiens
augaaacaaauaaucac

SEQ ID NO: 980012 - RNA, 21 nt, Homo sapiens
augaacccugccccacuccug

SEQ ID NO: 980013 - RNA, 22 nt, Homo sapiens
augaaguuaaagguauuuauca

SEQ ID NO: 980014 - RNA, 21 nt, Homo sapiens
augaccuaguaaacuuuguac

SEQ ID NO: 980015 - RNA, 17 nt, Homo sapiens
augagaacacacugagu

SEQ ID NO: 980016 - RNA, 16 nt, Homo sapiens
augauagaacuguacu

SEQ ID NO: 980017 - RNA, 18 nt, Homo sapiens
augcaaaagaaguggcau

SEQ ID NO: 980018 - RNA, 21 nt, Homo sapiens
augccccuggcccugccucac

SEQ ID NO: 980019 - RNA, 14 nt, Homo sapiens
augcucccucugug

SEQ ID NO: 980020 - RNA, 20 nt, Homo sapiens
augcucuucugaaggcugau

SEQ ID NO: 980021 - RNA, 16 nt, Homo sapiens
auggacagcugagcac

SEQ ID NO: 980022 - RNA, 21 nt, Homo sapiens
auggccgcgucacuucucuga

SEQ ID NO: 980023 - RNA, 14 nt, Homo sapiens
augggccagcccuu

SEQ ID NO: 980024 - RNA, 23 nt, Homo sapiens
auguagucuuacucugucaccca

SEQ ID NO: 980025 - RNA, 19 nt, Homo sapiens
auguaugcauucauccaac

SEQ ID NO: 980026 - RNA, 20 nt, Homo sapiens
auguauuuuaauaacauauc

SEQ ID NO: 980027 - RNA, 16 nt, Homo sapiens
auguccccugucccac

SEQ ID NO: 980028 - RNA, 17 nt, Homo sapiens
augugaaccacccaugu

SEQ ID NO: 980029 - RNA, 15 nt, Homo sapiens
augugucuugucucc

SEQ ID NO: 980030 - RNA, 13 nt, Homo sapiens
auguuccaugccu

SEQ ID NO: 980031 - RNA, 21 nt, Homo sapiens
auuacaggcacccaccacauc

SEQ ID NO: 980032 - RNA, 18 nt, Homo sapiens
auuagaucaaaagucuac

SEQ ID NO: 980033 - RNA, 23 nt, Homo sapiens
auuagcuaaaaccuuccauguca

SEQ ID NO: 980034 - RNA, 21 nt, Homo sapiens
auuauuguuuucuacugcuau

SEQ ID NO: 980035 - RNA, 17 nt, Homo sapiens
auucaggcuuccauuga

SEQ ID NO: 980036 - RNA, 18 nt, Homo sapiens
auuccucccauucaagau

SEQ ID NO: 980037 - RNA, 23 nt, Homo sapiens
auuccuugucaccagcaacaucu

SEQ ID NO: 980038 - RNA, 17 nt, Homo sapiens
auucuggcagaccaagg

SEQ ID NO: 980039 - RNA, 15 nt, Homo sapiens
auucuguuugucucg

SEQ ID NO: 980040 - RNA, 16 nt, Homo sapiens
auucuucaagauccca

SEQ ID NO: 980041 - RNA, 22 nt, Homo sapiens
auugacaggcacuauucuaauc

SEQ ID NO: 980042 - RNA, 13 nt, Homo sapiens
auugagaccaagg

SEQ ID NO: 980043 - RNA, 18 nt, Homo sapiens
auuggcuggagauggaaa

SEQ ID NO: 980044 - RNA, 15 nt, Homo sapiens
auuguucacuucuuu

SEQ ID NO: 980045 - RNA, 19 nt, Homo sapiens
auuucccaccgcuuuguga

SEQ ID NO: 980046 - RNA, 20 nt, Homo sapiens
auuuggauaaaaggaaccaa

SEQ ID NO: 980047 - RNA, 20 nt, Homo sapiens
auuuucugcaucuccacuug

SEQ ID NO: 980048 - RNA, 21 nt, Homo sapiens
auuuuuuuuuuuuuccuguca

SEQ ID NO: 980049 - RNA, 21 nt, Homo sapiens
caaacuccugaccucaaguga

SEQ ID NO: 980050 - RNA, 21 nt, Homo sapiens
caaauaaacaacuauggcugu

SEQ ID NO: 980051 - RNA, 14 nt, Homo sapiens
caacaauaaaauac

SEQ ID NO: 980052 - RNA, 12 nt, Homo sapiens
caaccuacuguc

SEQ ID NO: 980053 - RNA, 12 nt, Homo sapiens
caacuuccucuc

SEQ ID NO: 980054 - RNA, 18 nt, Homo sapiens
caagaugaaauuccauuu

SEQ ID NO: 980055 - RNA, 20 nt, Homo sapiens
caagauugcgccacugcacu

SEQ ID NO: 980056 - RNA, 22 nt, Homo sapiens
caaggguaaucuuggguuucua

SEQ ID NO: 980057 - RNA, 16 nt, Homo sapiens
caaggucauggucuga

SEQ ID NO: 980058 - RNA, 18 nt, Homo sapiens
caaguagagaugaaguua

SEQ ID NO: 980059 - RNA, 19 nt, Homo sapiens
caagucccuugaccuuucc

SEQ ID NO: 980060 - RNA, 18 nt, Homo sapiens
caagugcgcacuaccaca

SEQ ID NO: 980061 - RNA, 21 nt, Homo sapiens
caauacuugcauuccagaguu

SEQ ID NO: 980062 - RNA, 20 nt, Homo sapiens
caaugagccaagauugcgcc

SEQ ID NO: 980063 - RNA, 10 nt, Homo sapiens
caaugccauc

SEQ ID NO: 980064 - RNA, 22 nt, Homo sapiens
cacaggcagcaaggucaugguc

SEQ ID NO: 980065 - RNA, 12 nt, Homo sapiens
cacauagcuggg

SEQ ID NO: 980066 - RNA, 14 nt, Homo sapiens
cacauauauuucca

SEQ ID NO: 980067 - RNA, 20 nt, Homo sapiens
caccaagguggcuucuccuu

SEQ ID NO: 980068 - RNA, 19 nt, Homo sapiens
caccaggcuggagugcagu

SEQ ID NO: 980069 - RNA, 22 nt, Homo sapiens
caccaucuuggcucacugcaac

SEQ ID NO: 980070 - RNA, 13 nt, Homo sapiens
caccauguuggcu

SEQ ID NO: 980071 - RNA, 16 nt, Homo sapiens
caccccaacucugugg

SEQ ID NO: 980072 - RNA, 17 nt, Homo sapiens
cacccugcccugcugag

SEQ ID NO: 980073 - RNA, 14 nt, Homo sapiens
cacuagagucuuca

SEQ ID NO: 980074 - RNA, 18 nt, Homo sapiens
cacuugaauccauugaaa

SEQ ID NO: 980075 - RNA, 23 nt, Homo sapiens
cagacacugccgggccucccucc

SEQ ID NO: 980076 - RNA, 20 nt, Homo sapiens
cagagcaagacuccgucuca

SEQ ID NO: 980077 - RNA, 22 nt, Homo sapiens
cagagugcccuggggcauccac

SEQ ID NO: 980078 - RNA, 23 nt, Homo sapiens
cagaguuaaaauguuuacuguaa

SEQ ID NO: 980079 - RNA, 17 nt, Homo sapiens
cagauaacagugugcuc

SEQ ID NO: 980080 - RNA, 19 nt, Homo sapiens
cagauaacagugugcucau

SEQ ID NO: 980081 - RNA, 19 nt, Homo sapiens
cagcaaggucauggucuga

SEQ ID NO: 980082 - RNA, 15 nt, Homo sapiens
cagccccuaccuuga

SEQ ID NO: 980083 - RNA, 15 nt, Homo sapiens
cagccucagugccac

SEQ ID NO: 980084 - RNA, 12 nt, Homo sapiens
cagccugccucg

SEQ ID NO: 980085 - RNA, 13 nt, Homo sapiens
cagcuacauuccu

SEQ ID NO: 980086 - RNA, 16 nt, Homo sapiens
cagcucucugugcacu

SEQ ID NO: 980087 - RNA, 15 nt, Homo sapiens
caggaugagaacaca

SEQ ID NO: 980088 - RNA, 22 nt, Homo sapiens
caggcacccaccacaucuggcu

SEQ ID NO: 980089 - RNA, 22 nt, Homo sapiens
cagggcaugccuggccugagga

SEQ ID NO: 980090 - RNA, 15 nt, Homo sapiens
cagggcugugggugg

SEQ ID NO: 980091 - RNA, 19 nt, Homo sapiens
caggugugagccaccgugc

SEQ ID NO: 980092 - RNA, 17 nt, Homo sapiens
cagguuccagugccuga

SEQ ID NO: 980093 - RNA, 12 nt, Homo sapiens
caguaagggaua

SEQ ID NO: 980094 - RNA, 20 nt, Homo sapiens
caguaagggauauuagauaa

SEQ ID NO: 980095 - RNA, 18 nt, Homo sapiens
cagucccuccuguugcca

SEQ ID NO: 980096 - RNA, 18 nt, Homo sapiens
caguuacugaugcuccug

SEQ ID NO: 980097 - RNA, 22 nt, Homo sapiens
caguuggggcuguucauggcaa

SEQ ID NO: 980098 - RNA, 22 nt, Homo sapiens
caguuuuguaaauguacuggua

SEQ ID NO: 980099 - RNA, 17 nt, Homo sapiens
cauaauuuaaaaaguca

SEQ ID NO: 980100 - RNA, 17 nt, Homo sapiens
cauauguuccaugccug

SEQ ID NO: 980101 - RNA, 17 nt, Homo sapiens
caucgcucugagcauau

SEQ ID NO: 980102 - RNA, 22 nt, Homo sapiens
caucuaugaggguguuuccucu

SEQ ID NO: 980103 - RNA, 13 nt, Homo sapiens
caucucaauggca

SEQ ID NO: 980104 - RNA, 12 nt, Homo sapiens
caucuuggcuca

SEQ ID NO: 980105 - RNA, 17 nt, Homo sapiens
caugagggcuggagacc

SEQ ID NO: 980106 - RNA, 19 nt, Homo sapiens
cauggacuccaggauccuc

SEQ ID NO: 980107 - RNA, 19 nt, Homo sapiens
cauggccaccccgugccac

SEQ ID NO: 980108 - RNA, 21 nt, Homo sapiens
caugggccagcccuugcucua

SEQ ID NO: 980109 - RNA, 23 nt, Homo sapiens
cauggucaggggugagaccugaa

SEQ ID NO: 980110 - RNA, 16 nt, Homo sapiens
caugguggcaugugcc

SEQ ID NO: 980111 - RNA, 20 nt, Homo sapiens
caugguggcaugugccugua

SEQ ID NO: 980112 - RNA, 15 nt, Homo sapiens
caugucacugaaauu

SEQ ID NO: 980113 - RNA, 14 nt, Homo sapiens
caugugcuugugcc

SEQ ID NO: 980114 - RNA, 15 nt, Homo sapiens
caugugcuugugccu

SEQ ID NO: 980115 - RNA, 22 nt, Homo sapiens
cauuaggggguuuguugcacag

SEQ ID NO: 980116 - RNA, 19 nt, Homo sapiens
cauuauugacgaacuggcu

SEQ ID NO: 980117 - RNA, 23 nt, Homo sapiens
ccaaacaggauguggaaaaugaa

SEQ ID NO: 980118 - RNA, 20 nt, Homo sapiens
ccaaagugcuggaaccacag

SEQ ID NO: 980119 - RNA, 22 nt, Homo sapiens
ccaaaugauagaacuguacugu

SEQ ID NO: 980120 - RNA, 13 nt, Homo sapiens
ccaacaaacaaug

SEQ ID NO: 980121 - RNA, 16 nt, Homo sapiens
ccaacaaacaaugcca

SEQ ID NO: 980122 - RNA, 11 nt, Homo sapiens
ccacacuuuca

SEQ ID NO: 980123 - RNA, 15 nt, Homo sapiens
ccaccacaucuggcu

SEQ ID NO: 980124 - RNA, 14 nt, Homo sapiens
ccacgugcagcacc

SEQ ID NO: 980125 - RNA, 21 nt, Homo sapiens
ccacuugacauuccuugucac

SEQ ID NO: 980126 - RNA, 20 nt, Homo sapiens
ccagcccccacccaugccag

SEQ ID NO: 980127 - RNA, 15 nt, Homo sapiens
ccagccccuaccuug

SEQ ID NO: 980128 - RNA, 16 nt, Homo sapiens
ccagcgcagcgccagg

SEQ ID NO: 980129 - RNA, 19 nt, Homo sapiens
ccaggcuagagugcaaugg

SEQ ID NO: 980130 - RNA, 21 nt, Homo sapiens
ccaggcugaucucaaacuccu

SEQ ID NO: 980131 - RNA, 12 nt, Homo sapiens
ccagggacuaag

SEQ ID NO: 980132 - RNA, 13 nt, Homo sapiens
ccaucacuggaau

SEQ ID NO: 980133 - RNA, 18 nt, Homo sapiens
ccaucuucccuacccuuc

SEQ ID NO: 980134 - RNA, 15 nt, Homo sapiens
ccaugaucucaauag

SEQ ID NO: 980135 - RNA, 15 nt, Homo sapiens
ccaugcugggcucac

SEQ ID NO: 980136 - RNA, 18 nt, Homo sapiens
ccauggugcccgugccuc

SEQ ID NO: 980137 - RNA, 17 nt, Homo sapiens
ccauguaccacauaaca

SEQ ID NO: 980138 - RNA, 16 nt, Homo sapiens
ccaugucuaugcuccc

SEQ ID NO: 980139 - RNA, 12 nt, Homo sapiens
ccauugugcauu

SEQ ID NO: 980140 - RNA, 23 nt, Homo sapiens
cccaaccucaaugcccugccauu

SEQ ID NO: 980141 - RNA, 20 nt, Homo sapiens
cccagaauccccuggggaga

SEQ ID NO: 980142 - RNA, 15 nt, Homo sapiens
cccagcccauuccuc

SEQ ID NO: 980143 - RNA, 22 nt, Homo sapiens
cccaugugagggaauaaaccug

SEQ ID NO: 980144 - RNA, 14 nt, Homo sapiens
cccuagugagggca

SEQ ID NO: 980145 - RNA, 12 nt, Homo sapiens
cccuccaugucu

SEQ ID NO: 980146 - RNA, 16 nt, Homo sapiens
cccucccugugugaaa

SEQ ID NO: 980147 - RNA, 15 nt, Homo sapiens
cccugccucacugug

SEQ ID NO: 980148 - RNA, 15 nt, Homo sapiens
cccuggauuugcaua

SEQ ID NO: 980149 - RNA, 17 nt, Homo sapiens
aaaaccuuccaugucaa

SEQ ID NO: 980150 - RNA, 15 nt, Homo sapiens
aaaagggcaucucaa

SEQ ID NO: 980151 - RNA, 13 nt, Homo sapiens
aaaauccaacuaa

SEQ ID NO: 980152 - RNA, 14 nt, Homo sapiens
aaaaugaacuccau

SEQ ID NO: 980153 - RNA, 19 nt, Homo sapiens
aaacaagaugaaauuccau

SEQ ID NO: 980154 - RNA, 23 nt, Homo sapiens
aaacaggaguucagcggagcuag

SEQ ID NO: 980155 - RNA, 21 nt, Homo sapiens
aaagaugggguuucaccaugu

SEQ ID NO: 980156 - RNA, 14 nt, Homo sapiens
aaagcccauccuug

SEQ ID NO: 980157 - RNA, 15 nt, Homo sapiens
aaagucaucaugaac

SEQ ID NO: 980158 - RNA, 15 nt, Homo sapiens
aaaucuggugcucaa

SEQ ID NO: 980159 - RNA, 19 nt, Homo sapiens
aaaugaaacaaauaaucac

SEQ ID NO: 980160 - RNA, 18 nt, Homo sapiens
aaaugacaacaaggcccu

SEQ ID NO: 980161 - RNA, 21 nt, Homo sapiens
aaaugugucuugucuccauuu

SEQ ID NO: 980162 - RNA, 18 nt, Homo sapiens
aaauugaugauccauuaa

SEQ ID NO: 980163 - RNA, 18 nt, Homo sapiens
aacaaugccaucacugga

SEQ ID NO: 980164 - RNA, 12 nt, Homo sapiens
aacagacggaca

SEQ ID NO: 980165 - RNA, 23 nt, Homo sapiens
aacagcuuugugaacguggcagu

SEQ ID NO: 980166 - RNA, 18 nt, Homo sapiens
aacccuccuucuguggca

SEQ ID NO: 980167 - RNA, 13 nt, Homo sapiens
aacggagucucac

SEQ ID NO: 980168 - RNA, 19 nt, Homo sapiens
aacuaaacgucaccaaggu

SEQ ID NO: 980169 - RNA, 15 nt, Homo sapiens
aacucugcacuccau

SEQ ID NO: 980170 - RNA, 23 nt, Homo sapiens
aacuuuuauuuuuaucaguuaca

SEQ ID NO: 980171 - RNA, 12 nt, Homo sapiens
aagaaguggcau

SEQ ID NO: 980172 - RNA, 24 nt, Homo sapiens
aagacaacuuccucucacuguugc

SEQ ID NO: 980173 - RNA, 18 nt, Homo sapiens
aagcccaguaacugcccu

SEQ ID NO: 980174 - RNA, 13 nt, Homo sapiens
aaggaaccaacca

SEQ ID NO: 980175 - RNA, 17 nt, Homo sapiens
aaggucaggaugagaac

SEQ ID NO: 980176 - RNA, 17 nt, Homo sapiens
aaggucauggucugagu

SEQ ID NO: 980177 - RNA, 17 nt, Homo sapiens
aaguauuuuugauuaac

SEQ ID NO: 980178 - RNA, 15 nt, Homo sapiens
aagugagcaguguua

SEQ ID NO: 980179 - RNA, 23 nt, Homo sapiens
aagugcugggauuacagguguga

SEQ ID NO: 980180 - RNA, 20 nt, Homo sapiens
aaguguaguggcauccauuu

SEQ ID NO: 980181 - RNA, 13 nt, Homo sapiens
aaguucaugggca

SEQ ID NO: 980182 - RNA, 12 nt, Homo sapiens
aauaaucacuug

SEQ ID NO: 980183 - RNA, 14 nt, Homo sapiens
aauaucucucaccc

SEQ ID NO: 980184 - RNA, 19 nt, Homo sapiens
aaucacuugaauccauuga

SEQ ID NO: 980185 - RNA, 14 nt, Homo sapiens
aaucaugugcuuca

SEQ ID NO: 980186 - RNA, 17 nt, Homo sapiens
aaucuauuucauaccau

SEQ ID NO: 980187 - RNA, 14 nt, Homo sapiens
aaucucggcucacu

SEQ ID NO: 980188 - RNA, 15 nt, Homo sapiens
aaugagguggcucau

SEQ ID NO: 980189 - RNA, 20 nt, Homo sapiens
aaugagguggcucaugccug

SEQ ID NO: 980190 - RNA, 16 nt, Homo sapiens
aaugauagaacuguac

SEQ ID NO: 980191 - RNA, 12 nt, Homo sapiens
aaugccacaaaa

SEQ ID NO: 980192 - RNA, 15 nt, Homo sapiens
aaugccaucacugga

SEQ ID NO: 980193 - RNA, 15 nt, Homo sapiens
aauguaugcauucau

SEQ ID NO: 980194 - RNA, 12 nt, Homo sapiens
aauuaaggccag

SEQ ID NO: 980195 - RNA, 16 nt, Homo sapiens
acaaacaaugccauca

SEQ ID NO: 980196 - RNA, 21 nt, Homo sapiens
acaagaugaaauuccauuugu

SEQ ID NO: 980197 - RNA, 14 nt, Homo sapiens
acaauaaaauacag

SEQ ID NO: 980198 - RNA, 22 nt, Homo sapiens
acacguguggcgggcaguggga

SEQ ID NO: 980199 - RNA, 17 nt, Homo sapiens
acacuuucacuggggau

SEQ ID NO: 980200 - RNA, 17 nt, Homo sapiens
acagccauguaccacau

SEQ ID NO: 980201 - RNA, 19 nt, Homo sapiens
acaggcacuauucuaauca

SEQ ID NO: 980202 - RNA, 14 nt, Homo sapiens
acaguaagggauau

SEQ ID NO: 980203 - RNA, 14 nt, Homo sapiens
acagucuugcauuc

SEQ ID NO: 980204 - RNA, 17 nt, Homo sapiens
acaguugcacagcaucu

SEQ ID NO: 980205 - RNA, 22 nt, Homo sapiens
acaguuggggcuguucauggca

SEQ ID NO: 980206 - RNA, 20 nt, Homo sapiens
acauaaacaccauuuaguca

SEQ ID NO: 980207 - RNA, 13 nt, Homo sapiens
acauaacaacauc

SEQ ID NO: 980208 - RNA, 15 nt, Homo sapiens
acaucccauguagaa

SEQ ID NO: 980209 - RNA, 17 nt, Homo sapiens
acauccccaccuuccaa

SEQ ID NO: 980210 - RNA, 13 nt, Homo sapiens
acaugacugcaau

SEQ ID NO: 980211 - RNA, 23 nt, Homo sapiens
acauuaggggguuuguugcacag

SEQ ID NO: 980212 - RNA, 18 nt, Homo sapiens
accaacaaacaaugccau

SEQ ID NO: 980213 - RNA, 14 nt, Homo sapiens
accagcagacacug

SEQ ID NO: 980214 - RNA, 18 nt, Homo sapiens
accaggcuggagugcagu

SEQ ID NO: 980215 - RNA, 14 nt, Homo sapiens
accaugaucucaau

SEQ ID NO: 980216 - RNA, 17 nt, Homo sapiens
accauugaccucagcug

SEQ ID NO: 980217 - RNA, 19 nt, Homo sapiens
accauugaccucagcugca

SEQ ID NO: 980218 - RNA, 13 nt, Homo sapiens
accauugugcauu

SEQ ID NO: 980219 - RNA, 16 nt, Homo sapiens
acccacauuacaggau

SEQ ID NO: 980220 - RNA, 11 nt, Homo sapiens
acccacugugg

SEQ ID NO: 980221 - RNA, 20 nt, Homo sapiens
acccaggcuagagugcaaug

SEQ ID NO: 980222 - RNA, 21 nt, Homo sapiens
acccaugccagcgcagcgcca

SEQ ID NO: 980223 - RNA, 18 nt, Homo sapiens
acccccaucgcucugagc

SEQ ID NO: 980224 - RNA, 16 nt, Homo sapiens
accccuccucuagcuc

SEQ ID NO: 980225 - RNA, 22 nt, Homo sapiens
acccgagcccagcuacauuccu

SEQ ID NO: 980226 - RNA, 16 nt, Homo sapiens
acccggcgcugagugg

SEQ ID NO: 980227 - RNA, 22 nt, Homo sapiens
acccuccguuccuccucagccu

SEQ ID NO: 980228 - RNA, 18 nt, Homo sapiens
acccuggauuugcauaca

SEQ ID NO: 980229 - RNA, 15 nt, Homo sapiens
accgugaggccaaga

SEQ ID NO: 980230 - RNA, 19 nt, Homo sapiens
accucaaggucaggaugag

SEQ ID NO: 980231 - RNA, 16 nt, Homo sapiens
accugacaggccuucu

SEQ ID NO: 980232 - RNA, 16 nt, Homo sapiens
accugaucuggcccaa

SEQ ID NO: 980233 - RNA, 16 nt, Homo sapiens
accuguaauuaguuua

SEQ ID NO: 980234 - RNA, 14 nt, Homo sapiens
accuuccaugucaa

SEQ ID NO: 980235 - RNA, 16 nt, Homo sapiens
acgcuguccauugcca

SEQ ID NO: 980236 - RNA, 22 nt, Homo sapiens
acggacagcguguggcaguguu

SEQ ID NO: 980237 - RNA, 14 nt, Homo sapiens
acgugcagcaccug

SEQ ID NO: 980238 - RNA, 15 nt, Homo sapiens
acuaaaccauugugc

SEQ ID NO: 980239 - RNA, 16 nt, Homo sapiens
acuaaaccauugugca

SEQ ID NO: 980240 - RNA, 19 nt, Homo sapiens
acuaaaccauugugcauuc

SEQ ID NO: 980241 - RNA, 17 nt, Homo sapiens
acauuaaaucacuugaa

SEQ ID NO: 980242 - RNA, 18 nt, Homo sapiens
accaaagauacauguaaa

SEQ ID NO: 980243 - RNA, 16 nt, Homo sapiens
accaacaaacaaugcc

SEQ ID NO: 980244 - RNA, 19 nt, Homo sapiens
accaagguggcuucuccuu

SEQ ID NO: 980245 - RNA, 17 nt, Homo sapiens
accaagguucuuuuugu

SEQ ID NO: 980246 - RNA, 16 nt, Homo sapiens
accagcagacacugcc

SEQ ID NO: 980247 - RNA, 16 nt, Homo sapiens
accaucuuggcucacu

SEQ ID NO: 980248 - RNA, 14 nt, Homo sapiens
accccuccucuagc

SEQ ID NO: 980249 - RNA, 19 nt, Homo sapiens
acccucccccaccauucca

SEQ ID NO: 980250 - RNA, 23 nt, Homo sapiens
acccuccguuccuccucagccuc

SEQ ID NO: 980251 - RNA, 15 nt, Homo sapiens
acccuggauuugcau

SEQ ID NO: 980252 - RNA, 16 nt, Homo sapiens
acccuguaaugguugg

SEQ ID NO: 980253 - RNA, 22 nt, Homo sapiens
acccuguaaugguugggaccag

SEQ ID NO: 980254 - RNA, 16 nt, Homo sapiens
accucagcugcacauu

SEQ ID NO: 980255 - RNA, 11 nt, Homo sapiens
accuuccacaa

SEQ ID NO: 980256 - RNA, 21 nt, Homo sapiens
acgacagcucucugugcacug

SEQ ID NO: 980257 - RNA, 23 nt, Homo sapiens
acgacagcucucugugcacugau

SEQ ID NO: 980258 - RNA, 20 nt, Homo sapiens
acggacagcguguggcagug

SEQ ID NO: 980259 - RNA, 12 nt, Homo sapiens
acggccaugagg

SEQ ID NO: 980260 - RNA, 22 nt, Homo sapiens
acuacccgagcccagcuacauu

SEQ ID NO: 980261 - RNA, 19 nt, Homo sapiens
acucaugaggcugaggcag

SEQ ID NO: 980262 - RNA, 22 nt, Homo sapiens
acugcacccuggauuugcauac

SEQ ID NO: 980263 - RNA, 20 nt, Homo sapiens
acuggcuacaguaccaugcc

SEQ ID NO: 980264 - RNA, 18 nt, Homo sapiens
acuugacaggguuucacc

SEQ ID NO: 980265 - RNA, 13 nt, Homo sapiens
acuugacauuccu

SEQ ID NO: 980266 - RNA, 16 nt, Homo sapiens
agaaacgcucaugaca

SEQ ID NO: 980267 - RNA, 15 nt, Homo sapiens
agaaagugagcagug

SEQ ID NO: 980268 - RNA, 18 nt, Homo sapiens
agaaaugacaacaaggcc

SEQ ID NO: 980269 - RNA, 16 nt, Homo sapiens
agaacacacugaguga

SEQ ID NO: 980270 - RNA, 15 nt, Homo sapiens
agaagacaaggcaug

SEQ ID NO: 980271 - RNA, 21 nt, Homo sapiens
agaaguggggcagcagcagug

SEQ ID NO: 980272 - RNA, 19 nt, Homo sapiens
agacaaaauugaugaucca

SEQ ID NO: 980273 - RNA, 21 nt, Homo sapiens
agacaacuuccucucacuguu

SEQ ID NO: 980274 - RNA, 18 nt, Homo sapiens
agacaauuggucaaaaug

SEQ ID NO: 980275 - RNA, 21 nt, Homo sapiens
agacccucccccaccauucca

SEQ ID NO: 980276 - RNA, 19 nt, Homo sapiens
agacggacagcguguggca

SEQ ID NO: 980277 - RNA, 16 nt, Homo sapiens
agagcagccuggccaa

SEQ ID NO: 980278 - RNA, 17 nt, Homo sapiens
agaggcucugagggucu

SEQ ID NO: 980279 - RNA, 12 nt, Homo sapiens
agagugcauaua

SEQ ID NO: 980280 - RNA, 16 nt, Homo sapiens
agauaaauguccauuc

SEQ ID NO: 980281 - RNA, 21 nt, Homo sapiens
agauaacagugugcucauaga

SEQ ID NO: 980282 - RNA, 19 nt, Homo sapiens
agaugaaauuccauuugua

SEQ ID NO: 980283 - RNA, 14 nt, Homo sapiens
agaugggacaauua

SEQ ID NO: 980284 - RNA, 13 nt, Homo sapiens
agauucccacucc

SEQ ID NO: 980285 - RNA, 21 nt, Homo sapiens
agcaaaucuccugccucagcc

SEQ ID NO: 980286 - RNA, 15 nt, Homo sapiens
agcaaccuacugucu

SEQ ID NO: 980287 - RNA, 21 nt, Homo sapiens
agcaauucuccugccucagcc

SEQ ID NO: 980288 - RNA, 17 nt, Homo sapiens
agcacagacggaggaag

SEQ ID NO: 980289 - RNA, 17 nt, Homo sapiens
agcacuucucucuucaa

SEQ ID NO: 980290 - RNA, 12 nt, Homo sapiens
agcagacacugc

SEQ ID NO: 980291 - RNA, 15 nt, Homo sapiens
agcaguguuagcuua

SEQ ID NO: 980292 - RNA, 18 nt, Homo sapiens
agcauauguuccaugccu

SEQ ID NO: 980293 - RNA, 17 nt, Homo sapiens
agcauuuucugcaucuc

SEQ ID NO: 980294 - RNA, 21 nt, Homo sapiens
agccaccccuccucuagcucu

SEQ ID NO: 980295 - RNA, 13 nt, Homo sapiens
agccacugugccc

SEQ ID NO: 980296 - RNA, 15 nt, Homo sapiens
agcccuugcucuacc

SEQ ID NO: 980297 - RNA, 17 nt, Homo sapiens
agcccuugcucuaccug

SEQ ID NO: 980298 - RNA, 18 nt, Homo sapiens
agccuacugccucuccag

SEQ ID NO: 980299 - RNA, 15 nt, Homo sapiens
agccucagugccacu

SEQ ID NO: 980300 - RNA, 19 nt, Homo sapiens
agccucccuuugccagcca

SEQ ID NO: 980301 - RNA, 12 nt, Homo sapiens
agcuacauuccu

SEQ ID NO: 980302 - RNA, 18 nt, Homo sapiens
agcuacauuccucagcug

SEQ ID NO: 980303 - RNA, 23 nt, Homo sapiens
agcucuguccucugucagucaug

SEQ ID NO: 980304 - RNA, 17 nt, Homo sapiens
agcugagcacuaaagga

SEQ ID NO: 980305 - RNA, 14 nt, Homo sapiens
agcugcacauuccu

SEQ ID NO: 980306 - RNA, 14 nt, Homo sapiens
agcugccaagcacu

SEQ ID NO: 980307 - RNA, 14 nt, Homo sapiens
agcuugcaaugagc

SEQ ID NO: 980308 - RNA, 13 nt, Homo sapiens
aggagaccuucca

SEQ ID NO: 980309 - RNA, 17 nt, Homo sapiens
aggaggauccccugagg

SEQ ID NO: 980310 - RNA, 21 nt, Homo sapiens
aggcccaaugagguggcucau

SEQ ID NO: 980311 - RNA, 20 nt, Homo sapiens
aggcccauuaguugagaaag

SEQ ID NO: 980312 - RNA, 18 nt, Homo sapiens
agggcaucucaauggcau

SEQ ID NO: 980313 - RNA, 16 nt, Homo sapiens
agguauuuaucauuca

SEQ ID NO: 980314 - RNA, 13 nt, Homo sapiens
agguggacagucc

SEQ ID NO: 980315 - RNA, 15 nt, Homo sapiens
agguggcucaugccu

SEQ ID NO: 980316 - RNA, 16 nt, Homo sapiens
agguggcucaugccug

SEQ ID NO: 980317 - RNA, 16 nt, Homo sapiens
agguuauuaugauuag

SEQ ID NO: 980318 - RNA, 12 nt, Homo sapiens
aguaaacaauaa

SEQ ID NO: 980319 - RNA, 15 nt, Homo sapiens
agucagucaugucac

SEQ ID NO: 980320 - RNA, 18 nt, Homo sapiens
agucaucaugaacuggcu

SEQ ID NO: 980321 - RNA, 13 nt, Homo sapiens
agucggucaccaa

SEQ ID NO: 980322 - RNA, 17 nt, Homo sapiens
agucucacucugucacc

SEQ ID NO: 980323 - RNA, 17 nt, Homo sapiens
agucuuacucugucacc

SEQ ID NO: 980324 - RNA, 13 nt, Homo sapiens
agucuugcauucu

SEQ ID NO: 980325 - RNA, 18 nt, Homo sapiens
agugacugaaaauggcau

SEQ ID NO: 980326 - RNA, 23 nt, Homo sapiens
agugcaauggcaccaucuuggcu

SEQ ID NO: 980327 - RNA, 19 nt, Homo sapiens
agugccacuugacauuccu

SEQ ID NO: 980328 - RNA, 14 nt, Homo sapiens
agugggacccauag

SEQ ID NO: 980329 - RNA, 19 nt, Homo sapiens
aguguacauguacauagua

SEQ ID NO: 980330 - RNA, 16 nt, Homo sapiens
agugugggcauagcau

SEQ ID NO: 980331 - RNA, 18 nt, Homo sapiens
agugugggcauagcauua

SEQ ID NO: 980332 - RNA, 12 nt, Homo sapiens
aguguuagcuua

SEQ ID NO: 980333 - RNA, 16 nt, Homo sapiens
cccugccucacuguga

SEQ ID NO: 980334 - RNA, 18 nt, Homo sapiens
cccuggccaccugccagg

SEQ ID NO: 980335 - RNA, 21 nt, Homo sapiens
cccugucccaccaacucugca

SEQ ID NO: 980336 - RNA, 23 nt, Homo sapiens
ccgcaaucucggcucacugcaac

SEQ ID NO: 980337 - RNA, 19 nt, Homo sapiens
ccuaagucaacuuagcauu

SEQ ID NO: 980338 - RNA, 11 nt, Homo sapiens
ccuacugccuc

SEQ ID NO: 980339 - RNA, 18 nt, Homo sapiens
ccuacugucuaagcaguu

SEQ ID NO: 980340 - RNA, 15 nt, Homo sapiens
ccucaagugaucugc

SEQ ID NO: 980341 - RNA, 16 nt, Homo sapiens
ccucaagugaucugcc

SEQ ID NO: 980342 - RNA, 23 nt, Homo sapiens
ccucagugccacuugacauuccu

SEQ ID NO: 980343 - RNA, 14 nt, Homo sapiens
ccucauggacucca

SEQ ID NO: 980344 - RNA, 19 nt, Homo sapiens
ccuccaugucuaugcuccc

SEQ ID NO: 980345 - RNA, 20 nt, Homo sapiens
ccucccgggggcacugccug

SEQ ID NO: 980346 - RNA, 14 nt, Homo sapiens
ccuccuguugccac

SEQ ID NO: 980347 - RNA, 14 nt, Homo sapiens
ccucuagcucuggu

SEQ ID NO: 980348 - RNA, 19 nt, Homo sapiens
ccucugcaucuugcucugu

SEQ ID NO: 980349 - RNA, 14 nt, Homo sapiens
ccucuguguuagaa

SEQ ID NO: 980350 - RNA, 20 nt, Homo sapiens
ccugcucagcccauccccug

SEQ ID NO: 980351 - RNA, 14 nt, Homo sapiens
ccugcugagcacag

SEQ ID NO: 980352 - RNA, 19 nt, Homo sapiens
gccuacugccucuccagca

SEQ ID NO: 980353 - RNA, 13 nt, Homo sapiens
gccucagccucca

SEQ ID NO: 980354 - RNA, 17 nt, Homo sapiens
gccucagugccacuuga

SEQ ID NO: 980355 - RNA, 23 nt, Homo sapiens
gccucccucccgggggcacugcc

SEQ ID NO: 980356 - RNA, 17 nt, Homo sapiens
gccucuccagcacuucu

SEQ ID NO: 980357 - RNA, 21 nt, Homo sapiens
gccuguauucccagcuacuca

SEQ ID NO: 980358 - RNA, 21 nt, Homo sapiens
gccuuaaauaaaacugcauug

SEQ ID NO: 980359 - RNA, 20 nt, Homo sapiens
gcggcccacgccagcuggcc

SEQ ID NO: 980360 - RNA, 20 nt, Homo sapiens
gcuaugauuaaauuuacuua

SEQ ID NO: 980361 - RNA, 15 nt, Homo sapiens
gcucaucugcagccu

SEQ ID NO: 980362 - RNA, 13 nt, Homo sapiens
gcucccucugugu

SEQ ID NO: 980363 - RNA, 16 nt, Homo sapiens
gcugagucaccuccuc

SEQ ID NO: 980364 - RNA, 16 nt, Homo sapiens
gcugccaagcacucga

SEQ ID NO: 980365 - RNA, 20 nt, Homo sapiens
gcuggcgccagggccugccg

SEQ ID NO: 980366 - RNA, 15 nt, Homo sapiens
gcugggauuugaacu

SEQ ID NO: 980367 - RNA, 13 nt, Homo sapiens
gcuggucuccccc

SEQ ID NO: 980368 - RNA, 18 nt, Homo sapiens
gcugguuuuucauuucca

SEQ ID NO: 980369 - RNA, 16 nt, Homo sapiens
gcuuauauuguucacu

SEQ ID NO: 980370 - RNA, 21 nt, Homo sapiens
gcuuuguaaacuccacaggga

SEQ ID NO: 980371 - RNA, 22 nt, Homo sapiens
ggacaauuagauaaauguccau

SEQ ID NO: 980372 - RNA, 19 nt, Homo sapiens
ggaccauugaccucagcug

SEQ ID NO: 980373 - RNA, 15 nt, Homo sapiens
ggaggcccaaugagg

SEQ ID NO: 980374 - RNA, 17 nt, Homo sapiens
ggaguggacgcugucca

SEQ ID NO: 980375 - RNA, 20 nt, Homo sapiens
ggauccccagccuacugccu

SEQ ID NO: 980376 - RNA, 19 nt, Homo sapiens
ggaucucuuggccucauga

SEQ ID NO: 980377 - RNA, 17 nt, Homo sapiens
ggcacccaccacaucug

SEQ ID NO: 980378 - RNA, 22 nt, Homo sapiens
ggcaccucauggacuccaggau

SEQ ID NO: 980379 - RNA, 16 nt, Homo sapiens
ggcagcaaggucaugg

SEQ ID NO: 980380 - RNA, 14 nt, Homo sapiens
ggcagugggaccca

SEQ ID NO: 980381 - RNA, 13 nt, Homo sapiens
ggcauagccuuuc

SEQ ID NO: 980382 - RNA, 19 nt, Homo sapiens
ggcauuagcuaaaaccuuc

SEQ ID NO: 980383 - RNA, 13 nt, Homo sapiens
ggccaaucccuuc

SEQ ID NO: 980384 - RNA, 12 nt, Homo sapiens
ggccaccugcca

SEQ ID NO: 980385 - RNA, 23 nt, Homo sapiens
ggccuggacugcacaggcagcaa

SEQ ID NO: 980386 - RNA, 21 nt, Homo sapiens
ggcuaagaagaaaugcaaaag

SEQ ID NO: 980387 - RNA, 17 nt, Homo sapiens
ggcucacuacaugggcc

SEQ ID NO: 980388 - RNA, 19 nt, Homo sapiens
ggcugcgucccugcucagc

SEQ ID NO: 980389 - RNA, 18 nt, Homo sapiens
gggauaggacugaguggu

SEQ ID NO: 980390 - RNA, 14 nt, Homo sapiens
gggauuugcuccug

SEQ ID NO: 980391 - RNA, 16 nt, Homo sapiens
gggcaugguggcaugu

SEQ ID NO: 980392 - RNA, 18 nt, Homo sapiens
ggggagucagucauguca

SEQ ID NO: 980393 - RNA, 13 nt, Homo sapiens
gguaaacaacaga

SEQ ID NO: 980394 - RNA, 18 nt, Homo sapiens
ggucacauagcugggauu

SEQ ID NO: 980395 - RNA, 14 nt, Homo sapiens
gguggcaugugccu

SEQ ID NO: 980396 - RNA, 14 nt, Homo sapiens
ggugugucaaugcc

SEQ ID NO: 980397 - RNA, 18 nt, Homo sapiens
guaaaauagggcuuugua

SEQ ID NO: 980398 - RNA, 17 nt, Homo sapiens
guaaacaacagacugca

SEQ ID NO: 980399 - RNA, 20 nt, Homo sapiens
guaaauacugguaccuuccc

SEQ ID NO: 980400 - RNA, 18 nt, Homo sapiens
guaaaucuagaguuuaua

SEQ ID NO: 980401 - RNA, 16 nt, Homo sapiens
guaaauguacugguaa

SEQ ID NO: 980402 - RNA, 16 nt, Homo sapiens
guacauaguaaaguau

SEQ ID NO: 980403 - RNA, 18 nt, Homo sapiens
guagugaauuggcuuccu

SEQ ID NO: 980404 - RNA, 15 nt, Homo sapiens
guauuaucaccagca

SEQ ID NO: 980405 - RNA, 11 nt, Homo sapiens
gucaaugccac

SEQ ID NO: 980406 - RNA, 20 nt, Homo sapiens
gucacauagcugggauuuga

SEQ ID NO: 980407 - RNA, 16 nt, Homo sapiens
gucaccccaacucugu

SEQ ID NO: 980408 - RNA, 17 nt, Homo sapiens
gucaccccaacucugug

SEQ ID NO: 980409 - RNA, 22 nt, Homo sapiens
gucagccccucaucagccuuuu

SEQ ID NO: 980410 - RNA, 21 nt, Homo sapiens
gucaguuacugaugcuccuga

SEQ ID NO: 980411 - RNA, 14 nt, Homo sapiens
gucaucugcuccuu

SEQ ID NO: 980412 - RNA, 19 nt, Homo sapiens
gucauggucaggggugaga

SEQ ID NO: 980413 - RNA, 16 nt, Homo sapiens
gucaugucacugaaau

SEQ ID NO: 980414 - RNA, 22 nt, Homo sapiens
guccuuaacaccugaucuggcc

SEQ ID NO: 980415 - RNA, 16 nt, Homo sapiens
gucuugucuccauuug

SEQ ID NO: 980416 - RNA, 20 nt, Homo sapiens
gucuuugaacguacccaagg

SEQ ID NO: 980417 - RNA, 18 nt, Homo sapiens
gugaacguggcagugcuu

SEQ ID NO: 980418 - RNA, 15 nt, Homo sapiens
gugaauuggcuuccu

SEQ ID NO: 980419 - RNA, 14 nt, Homo sapiens
gugacagucuugca

SEQ ID NO: 980420 - RNA, 18 nt, Homo sapiens
gugccacuugacauuccu

SEQ ID NO: 980421 - RNA, 19 nt, Homo sapiens
gugcugggauuacaggugu

SEQ ID NO: 980422 - RNA, 13 nt, Homo sapiens
guggcagugcuug

SEQ ID NO: 980423 - RNA, 21 nt, Homo sapiens
guggggcugguuuuucauuuc

SEQ ID NO: 980424 - RNA, 13 nt, Homo sapiens
guggugugucaau

SEQ ID NO: 980425 - RNA, 16 nt, Homo sapiens
guguccguggaaccag

SEQ ID NO: 980426 - RNA, 16 nt, Homo sapiens
guguuuaaaugcucuu

SEQ ID NO: 980427 - RNA, 18 nt, Homo sapiens
guuacugaugcuccugaa

SEQ ID NO: 980428 - RNA, 18 nt, Homo sapiens
guuccacauauauuucca

SEQ ID NO: 980429 - RNA, 19 nt, Homo sapiens
guucccccucccuguguga

SEQ ID NO: 980430 - RNA, 17 nt, Homo sapiens
guugcacagcaucucag

SEQ ID NO: 980431 - RNA, 15 nt, Homo sapiens
guugccacacuuuca

SEQ ID NO: 980432 - RNA, 21 nt, Homo sapiens
guuggaguugauucaugugcu

SEQ ID NO: 980433 - RNA, 20 nt, Homo sapiens
guuggccaggcugaucucaa

SEQ ID NO: 980434 - RNA, 20 nt, Homo sapiens
guugucuacauuaaaucacu

SEQ ID NO: 980435 - RNA, 22 nt, Homo sapiens
guugucuacauuaaaucacuug

SEQ ID NO: 980436 - RNA, 20 nt, Homo sapiens
guuucuaaguaauaugcuua

SEQ ID NO: 980437 - RNA, 20 nt, Homo sapiens
guuuucuggaaguuuccuca

SEQ ID NO: 980438 - RNA, 18 nt, Homo sapiens
guuuuuauggaaggguaa

SEQ ID NO: 980439 - RNA, 14 nt, Homo sapiens
uggugucaucugcu

SEQ ID NO: 980440 - RNA, 15 nt, Homo sapiens
uggugucaucugcuc

SEQ ID NO: 980441 - RNA, 23 nt, Homo sapiens
ugguuacugaggaccaaagauac

SEQ ID NO: 980442 - RNA, 14 nt, Homo sapiens
uguaaauguacugg

SEQ ID NO: 980443 - RNA, 16 nt, Homo sapiens
uguaaucccagcacuu

SEQ ID NO: 980444 - RNA, 19 nt, Homo sapiens
uguacugguaauuguacaa

SEQ ID NO: 980445 - RNA, 19 nt, Homo sapiens
uguauuuuaauaacauauc

SEQ ID NO: 980446 - RNA, 14 nt, Homo sapiens
ugucaccagcaaca

SEQ ID NO: 980447 - RNA, 11 nt, Homo sapiens
ugucagucaug

SEQ ID NO: 980448 - RNA, 21 nt, Homo sapiens
ugucauuccucuccuagcccu

SEQ ID NO: 980449 - RNA, 18 nt, Homo sapiens
uguccaggagaccuucca

SEQ ID NO: 980450 - RNA, 19 nt, Homo sapiens
ugucccaccaacucugcac

SEQ ID NO: 980451 - RNA, 17 nt, Homo sapiens
uguccucugucagucau

SEQ ID NO: 980452 - RNA, 18 nt, Homo sapiens
ugugacagucuugcauuc

SEQ ID NO: 980453 - RNA, 14 nt, Homo sapiens
ugugcuucauagaa

SEQ ID NO: 980454 - RNA, 16 nt, Homo sapiens
uguggggcugagcaac

SEQ ID NO: 980455 - RNA, 15 nt, Homo sapiens
ugugucaaugccaca

SEQ ID NO: 980456 - RNA, 22 nt, Homo sapiens
ugugugaaauguauuaucacca

SEQ ID NO: 980457 - RNA, 19 nt, Homo sapiens
uguuaggaagggugagaau

SEQ ID NO: 980458 - RNA, 17 nt, Homo sapiens
uguucaaaaacaagaca

SEQ ID NO: 980459 - RNA, 14 nt, Homo sapiens
uguuccaugccugg

SEQ ID NO: 980460 - RNA, 13 nt, Homo sapiens
uguugccugcauu

SEQ ID NO: 980461 - RNA, 19 nt, Homo sapiens
uguuggauuuuaagcaaaa

SEQ ID NO: 980462 - RNA, 22 nt, Homo sapiens
uguugucuacauuaaaucacuu

SEQ ID NO: 980463 - RNA, 17 nt, Homo sapiens
uuaaaauguuuacugua

SEQ ID NO: 980464 - RNA, 17 nt, Homo sapiens
uuacugaugcuccugaa

SEQ ID NO: 980465 - RNA, 16 nt, Homo sapiens
uuauggcagacauugu

SEQ ID NO: 980466 - RNA, 23 nt, Homo sapiens
uuauuuuuaucaguuacacauga

SEQ ID NO: 980467 - RNA, 16 nt, Homo sapiens
uucagguauauaccuc

SEQ ID NO: 980468 - RNA, 14 nt, Homo sapiens
uuccucagcugcca

SEQ ID NO: 980469 - RNA, 15 nt, Homo sapiens
uucuagagugcauau

SEQ ID NO: 980470 - RNA, 14 nt, Homo sapiens
uucugggccaguga

SEQ ID NO: 980471 - RNA, 22 nt, Homo sapiens
uugaauugggggagucaugguc

SEQ ID NO: 980472 - RNA, 15 nt, Homo sapiens
uugaguuuuucaggu

SEQ ID NO: 980473 - RNA, 19 nt, Homo sapiens
uugcaauuggaauaaucac

SEQ ID NO: 980474 - RNA, 16 nt, Homo sapiens
uugcacagcaucucag

SEQ ID NO: 980475 - RNA, 21 nt, Homo sapiens
uugccaauuuucuuugaaaau

SEQ ID NO: 980476 - RNA, 24 nt, Homo sapiens
uuggcucacugcaaccucuaccuc

SEQ ID NO: 980477 - RNA, 12 nt, Homo sapiens
uugucacaauua

SEQ ID NO: 980478 - RNA, 15 nt, Homo sapiens
uugucaccagcaaca

SEQ ID NO: 980479 - RNA, 23 nt, Homo sapiens
uugucuacauuaaaucacuugaa

SEQ ID NO: 980480 - RNA, 13 nt, Homo sapiens
uugugccuaccug

SEQ ID NO: 980481 - RNA, 23 nt, Homo sapiens
uuguggcccagauaaggcuuuag

SEQ ID NO: 980482 - RNA, 19 nt, Homo sapiens
uugugggcuuggaccacga

SEQ ID NO: 980483 - RNA, 19 nt, Homo sapiens
uuguucacaucccauguag

SEQ ID NO: 980484 - RNA, 18 nt, Homo sapiens
uuuaaagacuaccuggga

SEQ ID NO: 980485 - RNA, 19 nt, Homo sapiens
uuuacauuuauuccuucca

SEQ ID NO: 980486 - RNA, 11 nt, Homo sapiens
uuuagucacug

SEQ ID NO: 980487 - RNA, 20 nt, Homo sapiens
uuuccacuucuucauucucu

SEQ ID NO: 980488 - RNA, 20 nt, Homo sapiens
uuuccugccuuuuaguuccu

SEQ ID NO: 980489 - RNA, 22 nt, Homo sapiens
uuuccuuugucauuuccuuugu

SEQ ID NO: 980490 - RNA, 14 nt, Homo sapiens
uuugcaauuggaau

SEQ ID NO: 980491 - RNA, 21 nt, Homo sapiens
uuuugcaauuggaauaaucac

SEQ ID NO: 980492 - RNA, 20 nt, Homo sapiens
uuuuguuuacauaauacuug

SEQ ID NO: 980493 - RNA, 18 nt, Homo sapiens
caaaguagcugggauuac

SEQ ID NO: 980494 - RNA, 16 nt, Homo sapiens
caaaucuccugccuca

SEQ ID NO: 980495 - RNA, 21 nt, Homo sapiens
caacaaccaccaccacaauga

SEQ ID NO: 980496 - RNA, 16 nt, Homo sapiens
caacaucucgagcccc

SEQ ID NO: 980497 - RNA, 11 nt, Homo sapiens
caacauggcaa

SEQ ID NO: 980498 - RNA, 17 nt, Homo sapiens
caacauuuuuacauuua

SEQ ID NO: 980499 - RNA, 16 nt, Homo sapiens
caacucugcacuccau

SEQ ID NO: 980500 - RNA, 19 nt, Homo sapiens
caagaagaccaugaucuca

SEQ ID NO: 980501 - RNA, 22 nt, Homo sapiens
caagagagccucuuguggaccc

SEQ ID NO: 980502 - RNA, 15 nt, Homo sapiens
caagaucccauuuga

SEQ ID NO: 980503 - RNA, 20 nt, Homo sapiens
caagcaaaucuccugccuca

SEQ ID NO: 980504 - RNA, 20 nt, Homo sapiens
caagcaauucuccugccuca

SEQ ID NO: 980505 - RNA, 23 nt, Homo sapiens
caaugagguggcucaugccugua

SEQ ID NO: 980506 - RNA, 18 nt, Homo sapiens
caauuagauaaaugucca

SEQ ID NO: 980507 - RNA, 13 nt, Homo sapiens
cacacuuugccaa

SEQ ID NO: 980508 - RNA, 15 nt, Homo sapiens
cacauccccaccuuc

SEQ ID NO: 980509 - RNA, 16 nt, Homo sapiens
caccacaucuggcuaa

SEQ ID NO: 980510 - RNA, 11 nt, Homo sapiens
cacccacguga

SEQ ID NO: 980511 - RNA, 19 nt, Homo sapiens
cacccaggcuagagugcaa

SEQ ID NO: 980512 - RNA, 22 nt, Homo sapiens
caccccagaauccccuggggag

SEQ ID NO: 980513 - RNA, 18 nt, Homo sapiens
cacgugugaaguguagug

SEQ ID NO: 980514 - RNA, 18 nt, Homo sapiens
cacugugaccugcuccug

SEQ ID NO: 980515 - RNA, 23 nt, Homo sapiens
cacugugaccugcuccugcccac

SEQ ID NO: 980516 - RNA, 14 nt, Homo sapiens
cagaaaugacaaca

SEQ ID NO: 980517 - RNA, 13 nt, Homo sapiens
cagaacagcaugg

SEQ ID NO: 980518 - RNA, 20 nt, Homo sapiens
cagaaccggucccagccugg

SEQ ID NO: 980519 - RNA, 21 nt, Homo sapiens
cagacaauuggucaaaaugaa

SEQ ID NO: 980520 - RNA, 12 nt, Homo sapiens
cagacauugugc

SEQ ID NO: 980521 - RNA, 23 nt, Homo sapiens
cagauaacagugugcucauagaa

SEQ ID NO: 980522 - RNA, 11 nt, Homo sapiens
cagcccauucc

SEQ ID NO: 980523 - RNA, 16 nt, Homo sapiens
cagccccuccaugucu

SEQ ID NO: 980524 - RNA, 13 nt, Homo sapiens
cagccuacugccu

SEQ ID NO: 980525 - RNA, 19 nt, Homo sapiens
cagccucagugccacuuga

SEQ ID NO: 980526 - RNA, 15 nt, Homo sapiens
cagccucucugcuau

SEQ ID NO: 980527 - RNA, 20 nt, Homo sapiens
cagccugggugacagagcaa

SEQ ID NO: 980528 - RNA, 15 nt, Homo sapiens
cagcuacauuccuca

SEQ ID NO: 980529 - RNA, 14 nt, Homo sapiens
caggagaccuucca

SEQ ID NO: 980530 - RNA, 22 nt, Homo sapiens
caggccugagccacugugccca

SEQ ID NO: 980531 - RNA, 17 nt, Homo sapiens
caggcuagagugcaaug

SEQ ID NO: 980532 - RNA, 20 nt, Homo sapiens
caggugugagccaccgugcc

SEQ ID NO: 980533 - RNA, 23 nt, Homo sapiens
caggugugagccaccgugcccag

SEQ ID NO: 980534 - RNA, 20 nt, Homo sapiens
caguguuagcuuaguucucu

SEQ ID NO: 980535 - RNA, 12 nt, Homo sapiens
cauacuuuguua

SEQ ID NO: 980536 - RNA, 12 nt, Homo sapiens
cauauguuccau

SEQ ID NO: 980537 - RNA, 22 nt, Homo sapiens
caucaugaacuggcuuguacau

SEQ ID NO: 980538 - RNA, 15 nt, Homo sapiens
cauccccaccuucca

SEQ ID NO: 980539 - RNA, 16 nt, Homo sapiens
caucuucccuacccuu

SEQ ID NO: 980540 - RNA, 22 nt, Homo sapiens
caugccuguaaucccagcacuu

SEQ ID NO: 980541 - RNA, 20 nt, Homo sapiens
cauggacagcugagcacuaa

SEQ ID NO: 980542 - RNA, 23 nt, Homo sapiens
caugggccagcccuugcucuacc

SEQ ID NO: 980543 - RNA, 19 nt, Homo sapiens
cauggguggguggggaguc

SEQ ID NO: 980544 - RNA, 23 nt, Homo sapiens
cauggucugaguggggcuuccug

SEQ ID NO: 980545 - RNA, 11 nt, Homo sapiens
cauguaaaaua

SEQ ID NO: 980546 - RNA, 13 nt, Homo sapiens
cauguaccacaua

SEQ ID NO: 980547 - RNA, 16 nt, Homo sapiens
cauuaaaucacuugaa

SEQ ID NO: 980548 - RNA, 14 nt, Homo sapiens
cauuaguugagaaa

SEQ ID NO: 980549 - RNA, 16 nt, Homo sapiens
cauuauugacgaacug

SEQ ID NO: 980550 - RNA, 10 nt, Homo sapiens
cauuccacau

SEQ ID NO: 980551 - RNA, 22 nt, Homo sapiens
cauuuggauaaaaggaaccaac

SEQ ID NO: 980552 - RNA, 17 nt, Homo sapiens
ccaacaaacaaugccau

SEQ ID NO: 980553 - RNA, 21 nt, Homo sapiens
ccaaccaacaaacaaugccau

SEQ ID NO: 980554 - RNA, 15 nt, Homo sapiens
ccacauauauuucca

SEQ ID NO: 980555 - RNA, 12 nt, Homo sapiens
ccacccaugcca

SEQ ID NO: 980556 - RNA, 15 nt, Homo sapiens
ccacccaugugaggg

SEQ ID NO: 980557 - RNA, 20 nt, Homo sapiens
ccacccguaggcagccucuc

SEQ ID NO: 980558 - RNA, 14 nt, Homo sapiens
ccaccugacaggcc

SEQ ID NO: 980559 - RNA, 20 nt, Homo sapiens
ccacgugagagaaucugccu

SEQ ID NO: 980560 - RNA, 18 nt, Homo sapiens
ccacugggucucacuccu

SEQ ID NO: 980561 - RNA, 21 nt, Homo sapiens
ccagcccccacccaugccagc

SEQ ID NO: 980562 - RNA, 15 nt, Homo sapiens
ccagcccuugcucua

SEQ ID NO: 980563 - RNA, 14 nt, Homo sapiens
ccagccugccaggc

SEQ ID NO: 980564 - RNA, 20 nt, Homo sapiens
ccagccugggugacagagca

SEQ ID NO: 980565 - RNA, 23 nt, Homo sapiens
ccagcuacauuccucagcugcca

SEQ ID NO: 980566 - RNA, 15 nt, Homo sapiens
ccaggagaccuucca

SEQ ID NO: 980567 - RNA, 17 nt, Homo sapiens
ccaggcuagagugcaau

SEQ ID NO: 980568 - RNA, 13 nt, Homo sapiens
ccaucgcucugag

SEQ ID NO: 980569 - RNA, 12 nt, Homo sapiens
ccauuaaguaaa

SEQ ID NO: 980570 - RNA, 20 nt, Homo sapiens
ccauugacaggcacuauucu

SEQ ID NO: 980571 - RNA, 19 nt, Homo sapiens
ccauugaccucagcugcac

SEQ ID NO: 980572 - RNA, 15 nt, Homo sapiens
ccauugugcauucua

SEQ ID NO: 980573 - RNA, 19 nt, Homo sapiens
ccauuuagucacugaacau

SEQ ID NO: 980574 - RNA, 22 nt, Homo sapiens
cccaaugagguggcucaugccu

SEQ ID NO: 980575 - RNA, 21 nt, Homo sapiens
cccaccaacucugcacuccau

SEQ ID NO: 980576 - RNA, 18 nt, Homo sapiens
cccacuguggccuggcau

SEQ ID NO: 980577 - RNA, 22 nt, Homo sapiens
cccagcacuuugggaagcugag

SEQ ID NO: 980578 - RNA, 18 nt, Homo sapiens
cccaggcuagagugcaau

SEQ ID NO: 980579 - RNA, 22 nt, Homo sapiens
cccauccaucuucccuacccuu

SEQ ID NO: 980580 - RNA, 14 nt, Homo sapiens
cccaugugagggaa

SEQ ID NO: 980581 - RNA, 13 nt, Homo sapiens
cccucaucagccu

SEQ ID NO: 980582 - RNA, 22 nt, Homo sapiens
cccucccgggggcacugccuga

SEQ ID NO: 980583 - RNA, 16 nt, Homo sapiens
cccuggggcauccacc

SEQ ID NO: 980584 - RNA, 19 nt, Homo sapiens
ccgaggggcucauguucag

SEQ ID NO: 980585 - RNA, 19 nt, Homo sapiens
ccgggaccauugaccucag

SEQ ID NO: 980586 - RNA, 11 nt, Homo sapiens
ccuaagucaac

SEQ ID NO: 980587 - RNA, 18 nt, Homo sapiens
ccuaauucugccuuaaau

SEQ ID NO: 980588 - RNA, 19 nt, Homo sapiens
ccuacccucccagcgaguu

SEQ ID NO: 980589 - RNA, 15 nt, Homo sapiens
ccuagguuguguuga

SEQ ID NO: 980590 - RNA, 16 nt, Homo sapiens
ccuagucggucaccaa

SEQ ID NO: 980591 - RNA, 21 nt, Homo sapiens
ccuccaaaguagcugggauua

SEQ ID NO: 980592 - RNA, 15 nt, Homo sapiens
ccucccaaagugcug

SEQ ID NO: 980593 - RNA, 21 nt, Homo sapiens
ccucccaaagugcugggauua

SEQ ID NO: 980594 - RNA, 19 nt, Homo sapiens
ccuccuguugccacacuuu

SEQ ID NO: 980595 - RNA, 13 nt, Homo sapiens
ccuccuucugugg

SEQ ID NO: 980596 - RNA, 12 nt, Homo sapiens
ccucuaucccug

SEQ ID NO: 980597 - RNA, 17 nt, Homo sapiens
ccucuguauuugucauu

SEQ ID NO: 980598 - RNA, 11 nt, Homo sapiens
ccugacugugg

SEQ ID NO: 980599 - RNA, 11 nt, Homo sapiens
ccugaggucag

SEQ ID NO: 980600 - RNA, 14 nt, Homo sapiens
ccuggauuugcaua

SEQ ID NO: 980601 - RNA, 19 nt, Homo sapiens
ccugggcuguugugucugg

SEQ ID NO: 980602 - RNA, 23 nt, Homo sapiens
ccuggggcauccaccuuccugcc

SEQ ID NO: 980603 - RNA, 13 nt, Homo sapiens
ccuggucccccac

SEQ ID NO: 980604 - RNA, 15 nt, Homo sapiens
ccuguggccuugccc

SEQ ID NO: 980605 - RNA, 19 nt, Homo sapiens
ccuguucaaaaacaagaca

SEQ ID NO: 980606 - RNA, 16 nt, Homo sapiens
ccuuccaagaagacca

SEQ ID NO: 980607 - RNA, 17 nt, Homo sapiens
cgagaggcucugagggu

SEQ ID NO: 980608 - RNA, 21 nt, Homo sapiens
cgagaggcucugagggucuga

SEQ ID NO: 980609 - RNA, 23 nt, Homo sapiens
cgagggaggaacaccugaucuua

SEQ ID NO: 980610 - RNA, 21 nt, Homo sapiens
aaaaagccccagcccauuccu

SEQ ID NO: 980611 - RNA, 18 nt, Homo sapiens
aaaagcagaaguucaugg

SEQ ID NO: 980612 - RNA, 22 nt, Homo sapiens
aaaauacagccauguaccacau

SEQ ID NO: 980613 - RNA, 21 nt, Homo sapiens
aaacaaauaaucacauugacu

SEQ ID NO: 980614 - RNA, 13 nt, Homo sapiens
aaacuccacaggg

SEQ ID NO: 980615 - RNA, 22 nt, Homo sapiens
aaagccccagcccauuccuccc

SEQ ID NO: 980616 - RNA, 20 nt, Homo sapiens
aaaggaaccaaccaacaaac

SEQ ID NO: 980617 - RNA, 18 nt, Homo sapiens
aaaguauuuuugauuaac

SEQ ID NO: 980618 - RNA, 22 nt, Homo sapiens
aaaguuuuuauggaaggguaaa

SEQ ID NO: 980619 - RNA, 17 nt, Homo sapiens
aaaucacccugacugug

SEQ ID NO: 980620 - RNA, 11 nt, Homo sapiens
aaaucacuuga

SEQ ID NO: 980621 - RNA, 14 nt, Homo sapiens
aaauguuuacugua

SEQ ID NO: 980622 - RNA, 18 nt, Homo sapiens
aaauuccauuuguaggua

SEQ ID NO: 980623 - RNA, 14 nt, Homo sapiens
aacaaacaaugcca

SEQ ID NO: 980624 - RNA, 21 nt, Homo sapiens
aacaaccaccaccacaaugac

SEQ ID NO: 980625 - RNA, 19 nt, Homo sapiens
aacaccugaucuggcccaa

SEQ ID NO: 980626 - RNA, 18 nt, Homo sapiens
aacagugugcucauagaa

SEQ ID NO: 980627 - RNA, 16 nt, Homo sapiens
aaccauccucucccuu

SEQ ID NO: 980628 - RNA, 12 nt, Homo sapiens
aaccuacugucu

SEQ ID NO: 980629 - RNA, 20 nt, Homo sapiens
aaccuccgccucccagguuc

SEQ ID NO: 980630 - RNA, 20 nt, Homo sapiens
aaccucuaccuccuggguuc

SEQ ID NO: 980631 - RNA, 15 nt, Homo sapiens
aacugcauugcugau

SEQ ID NO: 980632 - RNA, 17 nt, Homo sapiens
aacuuuuauuuuuauca

SEQ ID NO: 980633 - RNA, 19 nt, Homo sapiens
aagaaacacauaaacacca

SEQ ID NO: 980634 - RNA, 22 nt, Homo sapiens
aagaagaccaugaucucaauag

SEQ ID NO: 980635 - RNA, 12 nt, Homo sapiens
aagcccauggcu

SEQ ID NO: 980636 - RNA, 15 nt, Homo sapiens
aaggguaaauacugg

SEQ ID NO: 980637 - RNA, 22 nt, Homo sapiens
aaggucauaaguuucugagaug

SEQ ID NO: 980638 - RNA, 19 nt, Homo sapiens
aagugacugaaaauggcau

SEQ ID NO: 980639 - RNA, 19 nt, Homo sapiens
aauacagcugagcuaugua

SEQ ID NO: 980640 - RNA, 17 nt, Homo sapiens
aauaugaagaccaaaug

SEQ ID NO: 980641 - RNA, 22 nt, Homo sapiens
aauaugcuuauauuguucacuu

SEQ ID NO: 980642 - RNA, 19 nt, Homo sapiens
aaucaugugcuucauagaa

SEQ ID NO: 980643 - RNA, 17 nt, Homo sapiens
aaugccaucacuggaau

SEQ ID NO: 980644 - RNA, 14 nt, Homo sapiens
aauguaugcauuca

SEQ ID NO: 980645 - RNA, 13 nt, Homo sapiens
aauguccauucuu

SEQ ID NO: 980646 - RNA, 18 nt, Homo sapiens
aauguccauucuuuauca

SEQ ID NO: 980647 - RNA, 21 nt, Homo sapiens
aauuagauaaauguccauucu

SEQ ID NO: 980648 - RNA, 16 nt, Homo sapiens
aauugaugauccauua

SEQ ID NO: 980649 - RNA, 13 nt, Homo sapiens
aauuggcuuccuu

SEQ ID NO: 980650 - RNA, 11 nt, Homo sapiens
acaaacagacg

SEQ ID NO: 980651 - RNA, 17 nt, Homo sapiens
acaaauaaucacauuga

SEQ ID NO: 980652 - RNA, 18 nt, Homo sapiens
acaauaaaauacagccau

SEQ ID NO: 980653 - RNA, 17 nt, Homo sapiens
acaaugccaucacugga

SEQ ID NO: 980654 - RNA, 21 nt, Homo sapiens
acaauuagauaaauguccauu

SEQ ID NO: 980655 - RNA, 12 nt, Homo sapiens
acagagugcccu

SEQ ID NO: 980656 - RNA, 22 nt, Homo sapiens
acagggcaugccuggccugagg

SEQ ID NO: 980657 - RNA, 13 nt, Homo sapiens
acaguaagggaua

SEQ ID NO: 980658 - RNA, 12 nt, Homo sapiens
acagugugcuca

SEQ ID NO: 980659 - RNA, 19 nt, Homo sapiens
acaguugcacagcaucuca

SEQ ID NO: 980660 - RNA, 23 nt, Homo sapiens
acaguugcacagcaucucagcuc

SEQ ID NO: 980661 - RNA, 14 nt, Homo sapiens
acauaaacaccauu

SEQ ID NO: 980662 - RNA, 14 nt, Homo sapiens
acauaacaacaucu

SEQ ID NO: 980663 - RNA, 16 nt, Homo sapiens
acauccccaccuucca

SEQ ID NO: 980664 - RNA, 14 nt, Homo sapiens
acauuaaaucacuu

SEQ ID NO: 980665 - RNA, 15 nt, Homo sapiens
acauuaaaucacuug

SEQ ID NO: 980666 - RNA, 17 nt, Homo sapiens
accaacaaacaaugcca

SEQ ID NO: 980667 - RNA, 14 nt, Homo sapiens
accaaggcgaguuu

SEQ ID NO: 980668 - RNA, 17 nt, Homo sapiens
accaagguggcuucucc

SEQ ID NO: 980669 - RNA, 17 nt, Homo sapiens
accacaaugacagaaau

SEQ ID NO: 980670 - RNA, 22 nt, Homo sapiens
accacccaugugagggaauaaa

SEQ ID NO: 980671 - RNA, 15 nt, Homo sapiens
accagaacagcaugg

SEQ ID NO: 980672 - RNA, 21 nt, Homo sapiens
accagaacagcauggcccgaa

SEQ ID NO: 980673 - RNA, 19 nt, Homo sapiens
accaggcuggagugcagug

SEQ ID NO: 980674 - RNA, 20 nt, Homo sapiens
accauccucucccuucuuac

SEQ ID NO: 980675 - RNA, 21 nt, Homo sapiens
accaucuuggcucacugcaac

SEQ ID NO: 980676 - RNA, 12 nt, Homo sapiens
accauuccacau

SEQ ID NO: 980677 - RNA, 15 nt, Homo sapiens
accauugugcauucu

SEQ ID NO: 980678 - RNA, 16 nt, Homo sapiens
accauugugcauucua

SEQ ID NO: 980679 - RNA, 17 nt, Homo sapiens
accauugugcauucuag

SEQ ID NO: 980680 - RNA, 17 nt, Homo sapiens
acccagcuaauuuuugc

SEQ ID NO: 980681 - RNA, 17 nt, Homo sapiens
acccccgccacggccac

SEQ ID NO: 980682 - RNA, 21 nt, Homo sapiens
accccggcugcuuggcaguug

SEQ ID NO: 980683 - RNA, 19 nt, Homo sapiens
acccgagcccagcuacauu

SEQ ID NO: 980684 - RNA, 12 nt, Homo sapiens
acccucugugag

SEQ ID NO: 980685 - RNA, 21 nt, Homo sapiens
acccuuaaacaguugcacagc

SEQ ID NO: 980686 - RNA, 15 nt, Homo sapiens
acccuuccugccaag

SEQ ID NO: 980687 - RNA, 10 nt, Homo sapiens
accucaaggu

SEQ ID NO: 980688 - RNA, 19 nt, Homo sapiens
accucagcugcacauuccu

SEQ ID NO: 980689 - RNA, 15 nt, Homo sapiens
accucaucacugaga

SEQ ID NO: 980690 - RNA, 20 nt, Homo sapiens
accuccgccucccagguuca

SEQ ID NO: 980691 - RNA, 16 nt, Homo sapiens
accugauuuauugaaa

SEQ ID NO: 980692 - RNA, 13 nt, Homo sapiens
accugcuccugcc

SEQ ID NO: 980693 - RNA, 20 nt, Homo sapiens
accuuccaugucaagauuca

SEQ ID NO: 980694 - RNA, 18 nt, Homo sapiens
acgcgagaggcucugagg

SEQ ID NO: 980695 - RNA, 20 nt, Homo sapiens
acggagucucacucugucac

SEQ ID NO: 980696 - RNA, 22 nt, Homo sapiens
acuacucagcauggaaacaaga

SEQ ID NO: 980697 - RNA, 16 nt, Homo sapiens
acuaguggggcuuaau

SEQ ID NO: 980698 - RNA, 19 nt, Homo sapiens
acuauaaugguuggaacua

SEQ ID NO: 980699 - RNA, 11 nt, Homo sapiens
acucacuccag

SEQ ID NO: 980700 - RNA, 21 nt, Homo sapiens
acucacuccagcccaacagaa

SEQ ID NO: 980701 - RNA, 20 nt, Homo sapiens
acuccaggauccuccuggag

SEQ ID NO: 980702 - RNA, 20 nt, Homo sapiens
acuccgggaccauugaccuc

SEQ ID NO: 980703 - RNA, 14 nt, Homo sapiens
acucugcacuccau

SEQ ID NO: 980704 - RNA, 18 nt, Homo sapiens
acugaaaaucuggugcuc

SEQ ID NO: 980705 - RNA, 21 nt, Homo sapiens
acugaaaaucuggugcucaau

SEQ ID NO: 980706 - RNA, 20 nt, Homo sapiens
acugcaaucaugugcuucau

SEQ ID NO: 980707 - RNA, 20 nt, Homo sapiens
acugcacuccagccugggug

SEQ ID NO: 980708 - RNA, 20 nt, Homo sapiens
acuguugccugcauuuguac

SEQ ID NO: 980709 - RNA, 13 nt, Homo sapiens
acuugcccugcca

SEQ ID NO: 980710 - RNA, 18 nt, Homo sapiens
acuugcccugccacuuug

SEQ ID NO: 980711 - RNA, 21 nt, Homo sapiens
acuugcccugccacuuugcau

SEQ ID NO: 980712 - RNA, 15 nt, Homo sapiens
agaaacacauaaaca

SEQ ID NO: 980713 - RNA, 23 nt, Homo sapiens
agaaaucauuauugagucaccau

SEQ ID NO: 980714 - RNA, 12 nt, Homo sapiens
agaaauugauua

SEQ ID NO: 980715 - RNA, 15 nt, Homo sapiens
agaaucuugaggaac

SEQ ID NO: 980716 - RNA, 17 nt, Homo sapiens
agacaaaauugaugauc

SEQ ID NO: 980717 - RNA, 17 nt, Homo sapiens
agaccagccugccaggc

SEQ ID NO: 980718 - RNA, 18 nt, Homo sapiens
agacccucuucucugggc

SEQ ID NO: 980719 - RNA, 18 nt, Homo sapiens
agaccugaaggaccuccc

SEQ ID NO: 980720 - RNA, 11 nt, Homo sapiens
agaccuuccac

SEQ ID NO: 980721 - RNA, 11 nt, Homo sapiens
agacugcauau

SEQ ID NO: 980722 - RNA, 21 nt, Homo sapiens
agagacauccuucauuugaca

SEQ ID NO: 980723 - RNA, 19 nt, Homo sapiens
agagcaagacuccgucuca

SEQ ID NO: 980724 - RNA, 21 nt, Homo sapiens
agaguuaaaauguuuacugua

SEQ ID NO: 980725 - RNA, 14 nt, Homo sapiens
agauaaauguccau

SEQ ID NO: 980726 - RNA, 15 nt, Homo sapiens
agauaacagugugcu

SEQ ID NO: 980727 - RNA, 18 nt, Homo sapiens
agauaacagugugcucau

SEQ ID NO: 980728 - RNA, 14 nt, Homo sapiens
agauuuucugggau

SEQ ID NO: 980729 - RNA, 14 nt, Homo sapiens
agcaaaagcaucca

SEQ ID NO: 980730 - RNA, 19 nt, Homo sapiens
agcauauguuccaugccug

SEQ ID NO: 980731 - RNA, 23 nt, Homo sapiens
agccauguaccacauaacaacau

SEQ ID NO: 980732 - RNA, 15 nt, Homo sapiens
agcccagaagcccag

SEQ ID NO: 980733 - RNA, 18 nt, Homo sapiens
agcccucccucuucccag

SEQ ID NO: 980734 - RNA, 14 nt, Homo sapiens
agccuccucuguga

SEQ ID NO: 980735 - RNA, 16 nt, Homo sapiens
agcgccagggcucaga

SEQ ID NO: 980736 - RNA, 21 nt, Homo sapiens
agcuaaaaccuuccaugucaa

SEQ ID NO: 980737 - RNA, 15 nt, Homo sapiens
agcuaauuuuugcau

SEQ ID NO: 980738 - RNA, 13 nt, Homo sapiens
agcuacauuccuc

SEQ ID NO: 980739 - RNA, 21 nt, Homo sapiens
agcuagcagaagacaaggcau

SEQ ID NO: 980740 - RNA, 14 nt, Homo sapiens
agcucucugugcac

SEQ ID NO: 980741 - RNA, 23 nt, Homo sapiens
agcugcuuccuccccuccuggca

SEQ ID NO: 980742 - RNA, 11 nt, Homo sapiens
agcuggcccag

SEQ ID NO: 980743 - RNA, 23 nt, Homo sapiens
agcuggcccaguggguagugaau

SEQ ID NO: 980744 - RNA, 15 nt, Homo sapiens
agcugggauuugaac

SEQ ID NO: 980745 - RNA, 13 nt, Homo sapiens
agcuugcaaugag

SEQ ID NO: 980746 - RNA, 10 nt, Homo sapiens
agcuuuccau

SEQ ID NO: 980747 - RNA, 13 nt, Homo sapiens
aggaaaagggaua

SEQ ID NO: 980748 - RNA, 23 nt, Homo sapiens
aggaaagcaaaauccaacuaaug

SEQ ID NO: 980749 - RNA, 22 nt, Homo sapiens
aggaaccaaccaacaaacaaug

SEQ ID NO: 980750 - RNA, 14 nt, Homo sapiens
aggagaccuuccac

SEQ ID NO: 980751 - RNA, 14 nt, Homo sapiens
aggauaguuucacc

SEQ ID NO: 980752 - RNA, 21 nt, Homo sapiens
aggaugccucagugcuuaugu

SEQ ID NO: 980753 - RNA, 17 nt, Homo sapiens
aggcacccaccacaucu

SEQ ID NO: 980754 - RNA, 20 nt, Homo sapiens
aggcacccaccacaucuggc

SEQ ID NO: 980755 - RNA, 17 nt, Homo sapiens
aggcacuauucuaauca

SEQ ID NO: 980756 - RNA, 19 nt, Homo sapiens
aggcucugagggucugaaa

SEQ ID NO: 980757 - RNA, 12 nt, Homo sapiens
agggcaucucaa

SEQ ID NO: 980758 - RNA, 12 nt, Homo sapiens
agggcaugccug

SEQ ID NO: 980759 - RNA, 16 nt, Homo sapiens
agggguauccuccuaa

SEQ ID NO: 980760 - RNA, 17 nt, Homo sapiens
aggucacauagcuggga

SEQ ID NO: 980761 - RNA, 22 nt, Homo sapiens
aggucauaaguuucugagaugg

SEQ ID NO: 980762 - RNA, 11 nt, Homo sapiens
agguggagcuu

SEQ ID NO: 980763 - RNA, 20 nt, Homo sapiens
agguuauuaugauuagcuuu

SEQ ID NO: 980764 - RNA, 20 nt, Homo sapiens
aguaaagaugggguuucacc

SEQ ID NO: 980765 - RNA, 19 nt, Homo sapiens
aguaaaguauuuuugauua

SEQ ID NO: 980766 - RNA, 19 nt, Homo sapiens
agucagucaugucacugaa

SEQ ID NO: 980767 - RNA, 17 nt, Homo sapiens
agucaucaugaacuggc

SEQ ID NO: 980768 - RNA, 20 nt, Homo sapiens
agucucacucugucaccagg

SEQ ID NO: 980769 - RNA, 20 nt, Homo sapiens
agugacuaaaccauugugca

SEQ ID NO: 980770 - RNA, 18 nt, Homo sapiens
agugcaauggcaccaucu

SEQ ID NO: 980771 - RNA, 20 nt, Homo sapiens
agugccacuugacauuccuu

SEQ ID NO: 980772 - RNA, 13 nt, Homo sapiens
aguguacauguac

SEQ ID NO: 980773 - RNA, 17 nt, Homo sapiens
agugugggcauagcauu

SEQ ID NO: 980774 - RNA, 15 nt, Homo sapiens
aguugagaaagucac

SEQ ID NO: 980775 - RNA, 22 nt, Homo sapiens
aguugcacagcaucucagcuca

SEQ ID NO: 980776 - RNA, 15 nt, Homo sapiens
auaaaccuggcacua

SEQ ID NO: 980777 - RNA, 13 nt, Homo sapiens
auaacagugugcu

SEQ ID NO: 980778 - RNA, 23 nt, Homo sapiens
auaacuaauacagcugagcuaug

SEQ ID NO: 980779 - RNA, 20 nt, Homo sapiens
auaauaugaagaccaaauga

SEQ ID NO: 980780 - RNA, 11 nt, Homo sapiens
auaaugguugg

SEQ ID NO: 980781 - RNA, 14 nt, Homo sapiens
auaauuaaggccag

SEQ ID NO: 980782 - RNA, 13 nt, Homo sapiens
auacaaaaauuag

SEQ ID NO: 980783 - RNA, 14 nt, Homo sapiens
auacaguguacaug

SEQ ID NO: 980784 - RNA, 17 nt, Homo sapiens
auaccuccauguuucua

SEQ ID NO: 980785 - RNA, 14 nt, Homo sapiens
auagauuagaucaa

SEQ ID NO: 980786 - RNA, 16 nt, Homo sapiens
auagcugggauuugaa

SEQ ID NO: 980787 - RNA, 19 nt, Homo sapiens
auaugaugguggucaucca

SEQ ID NO: 980788 - RNA, 15 nt, Homo sapiens
auauguuccaugccu

SEQ ID NO: 980789 - RNA, 19 nt, Homo sapiens
auccccagccuacugccuc

SEQ ID NO: 980790 - RNA, 17 nt, Homo sapiens
auccucuguauuuguca

SEQ ID NO: 980791 - RNA, 20 nt, Homo sapiens
aucuugguaaacaacagacu

SEQ ID NO: 980792 - RNA, 18 nt, Homo sapiens
augaaacaaauaaucaca

SEQ ID NO: 980793 - RNA, 19 nt, Homo sapiens
augaaggucauaaguuucu

SEQ ID NO: 980794 - RNA, 14 nt, Homo sapiens
augaguuagcuuuc

SEQ ID NO: 980795 - RNA, 18 nt, Homo sapiens
augauccagggauugggc

SEQ ID NO: 980796 - RNA, 22 nt, Homo sapiens
augcauuauugacgaacuggcu

SEQ ID NO: 980797 - RNA, 14 nt, Homo sapiens
augcauucauccaa

SEQ ID NO: 980798 - RNA, 19 nt, Homo sapiens
augcuaugauuaaauuuac

SEQ ID NO: 980799 - RNA, 15 nt, Homo sapiens
augcucccucugugu

SEQ ID NO: 980800 - RNA, 17 nt, Homo sapiens
auggacagcugagcacu

SEQ ID NO: 980801 - RNA, 19 nt, Homo sapiens
auggcagacauugugcuag

SEQ ID NO: 980802 - RNA, 20 nt, Homo sapiens
auguaccacauaacaacauc

SEQ ID NO: 980803 - RNA, 17 nt, Homo sapiens
auguauuaucaccagca

SEQ ID NO: 980804 - RNA, 16 nt, Homo sapiens
augucaagauucagcu

SEQ ID NO: 980805 - RNA, 17 nt, Homo sapiens
augucaagauucagcua

SEQ ID NO: 980806 - RNA, 17 nt, Homo sapiens
augucacugaaauugaa

SEQ ID NO: 980807 - RNA, 18 nt, Homo sapiens
augucacugaaauugaau

SEQ ID NO: 980808 - RNA, 22 nt, Homo sapiens
augucauagccuuaugaguuag

SEQ ID NO: 980809 - RNA, 11 nt, Homo sapiens
augugccugua

SEQ ID NO: 980810 - RNA, 16 nt, Homo sapiens
auuaugauuagcuuug

SEQ ID NO: 980811 - RNA, 19 nt, Homo sapiens
auuaugauuagcuuuguca

SEQ ID NO: 980812 - RNA, 13 nt, Homo sapiens
auucauccaacag

SEQ ID NO: 980813 - RNA, 14 nt, Homo sapiens
auucauccaacaga

SEQ ID NO: 980814 - RNA, 22 nt, Homo sapiens
auuccacauccccaccuuccaa

SEQ ID NO: 980815 - RNA, 16 nt, Homo sapiens
auucccagcuacucau

SEQ ID NO: 980816 - RNA, 21 nt, Homo sapiens
auucuucaagaucccauuuga

SEQ ID NO: 980817 - RNA, 14 nt, Homo sapiens
auugaccucagcug

SEQ ID NO: 980818 - RNA, 14 nt, Homo sapiens
auugacgaacuggc

SEQ ID NO: 980819 - RNA, 13 nt, Homo sapiens
auugagucaccau

SEQ ID NO: 980820 - RNA, 13 nt, Homo sapiens
auugaugauccau

SEQ ID NO: 980821 - RNA, 21 nt, Homo sapiens
auugcuuaagaaacacauaaa

SEQ ID NO: 980822 - RNA, 23 nt, Homo sapiens
auuggccacugggucucacuccu

SEQ ID NO: 980823 - RNA, 16 nt, Homo sapiens
auuguacaauacuugc

SEQ ID NO: 980824 - RNA, 14 nt, Homo sapiens
auuuagucacugaa

SEQ ID NO: 980825 - RNA, 19 nt, Homo sapiens
auuucuccaagaaagccaa

SEQ ID NO: 980826 - RNA, 16 nt, Homo sapiens
auuuugaugaccaagu

SEQ ID NO: 980827 - RNA, 23 nt, Homo sapiens
caaaaaagccccagcccauuccu

SEQ ID NO: 980828 - RNA, 16 nt, Homo sapiens
caaaagcauccaagaa

SEQ ID NO: 980829 - RNA, 17 nt, Homo sapiens
caaacuccugaccucaa

SEQ ID NO: 980830 - RNA, 14 nt, Homo sapiens
caaagauacaugua

SEQ ID NO: 980831 - RNA, 11 nt, Homo sapiens
caaagugcugg

SEQ ID NO: 980832 - RNA, 22 nt, Homo sapiens
caaagugcuggaaccacaggcc

SEQ ID NO: 980833 - RNA, 19 nt, Homo sapiens
caaccucaaugcccugcca

SEQ ID NO: 980834 - RNA, 20 nt, Homo sapiens
caaccucaaugcccugccau

SEQ ID NO: 980835 - RNA, 14 nt, Homo sapiens
caaccucuaccucc

SEQ ID NO: 980836 - RNA, 22 nt, Homo sapiens
caagaagaccaugaucucaaua

SEQ ID NO: 980837 - RNA, 15 nt, Homo sapiens
caaggucauggucug

SEQ ID NO: 980838 - RNA, 17 nt, Homo sapiens
caaucccuucuccacuu

SEQ ID NO: 980839 - RNA, 21 nt, Homo sapiens
caauguauuuuaauaacauau

SEQ ID NO: 980840 - RNA, 19 nt, Homo sapiens
caauucuaaaacagacuca

SEQ ID NO: 980841 - RNA, 16 nt, Homo sapiens
caauucuccugccuca

SEQ ID NO: 980842 - RNA, 18 nt, Homo sapiens
caauuggaauaaucacuu

SEQ ID NO: 980843 - RNA, 23 nt, Homo sapiens
cacauagcugggauuugaacuga

SEQ ID NO: 980844 - RNA, 13 nt, Homo sapiens
caccauguuggcc

SEQ ID NO: 980845 - RNA, 18 nt, Homo sapiens
caccauguuggccaggcu

SEQ ID NO: 980846 - RNA, 15 nt, Homo sapiens
caccauuuagucacu

SEQ ID NO: 980847 - RNA, 13 nt, Homo sapiens
cacccaccuccac

SEQ ID NO: 980848 - RNA, 12 nt, Homo sapiens
caccccgugcca

SEQ ID NO: 980849 - RNA, 14 nt, Homo sapiens
cacccugacugugg

SEQ ID NO: 980850 - RNA, 17 nt, Homo sapiens
cacccuggauuugcaua

SEQ ID NO: 980851 - RNA, 15 nt, Homo sapiens
caccuccuccacuca

SEQ ID NO: 980852 - RNA, 14 nt, Homo sapiens
cacggccaugaggg

SEQ ID NO: 980853 - RNA, 15 nt, Homo sapiens
cacgugcagcaccug

SEQ ID NO: 980854 - RNA, 17 nt, Homo sapiens
cacucugucaccaggcu

SEQ ID NO: 980855 - RNA, 17 nt, Homo sapiens
cacugggucucacuccu

SEQ ID NO: 980856 - RNA, 17 nt, Homo sapiens
cacugugaccugcuccu

SEQ ID NO: 980857 - RNA, 13 nt, Homo sapiens
cacuucuuaacag

SEQ ID NO: 980858 - RNA, 14 nt, Homo sapiens
cacuugacauuccu

SEQ ID NO: 980859 - RNA, 15 nt, Homo sapiens
cacuugacauuccuu

SEQ ID NO: 980860 - RNA, 22 nt, Homo sapiens
cacuugcccugccacuuugcau

SEQ ID NO: 980861 - RNA, 16 nt, Homo sapiens
cagaauccccugggga

SEQ ID NO: 980862 - RNA, 22 nt, Homo sapiens
cagaccaaggcgaguuucccca

SEQ ID NO: 980863 - RNA, 21 nt, Homo sapiens
cagcaaagucuccaacaauaa

SEQ ID NO: 980864 - RNA, 17 nt, Homo sapiens
cagcauggaaacaagau

SEQ ID NO: 980865 - RNA, 18 nt, Homo sapiens
cagcccacccucugugag

SEQ ID NO: 980866 - RNA, 20 nt, Homo sapiens
cagcccauuccucccauuca

SEQ ID NO: 980867 - RNA, 13 nt, Homo sapiens
cagcccuugcucu

SEQ ID NO: 980868 - RNA, 14 nt, Homo sapiens
cagccuacugccuc

SEQ ID NO: 980869 - RNA, 12 nt, Homo sapiens
cagccucucugc

SEQ ID NO: 980870 - RNA, 20 nt, Homo sapiens
cagccuggccaacauggcaa

SEQ ID NO: 980871 - RNA, 22 nt, Homo sapiens
cagcuacauuccucagcugcca

SEQ ID NO: 980872 - RNA, 15 nt, Homo sapiens
cagcugggauuugaa

SEQ ID NO: 980873 - RNA, 12 nt, Homo sapiens
cagcuuuccauc

SEQ ID NO: 980874 - RNA, 14 nt, Homo sapiens
caggagguggguga

SEQ ID NO: 980875 - RNA, 20 nt, Homo sapiens
caggagugcugcccucuccc

SEQ ID NO: 980876 - RNA, 21 nt, Homo sapiens
caggcaaggaugauccaggga

SEQ ID NO: 980877 - RNA, 20 nt, Homo sapiens
caggcuagagugcaauggca

SEQ ID NO: 980878 - RNA, 17 nt, Homo sapiens
cagguauauaccuccau

SEQ ID NO: 980879 - RNA, 17 nt, Homo sapiens
cagugccugacuuggga

SEQ ID NO: 980880 - RNA, 20 nt, Homo sapiens
cauagcugggauuugaacug

SEQ ID NO: 980881 - RNA, 21 nt, Homo sapiens
caucauuugucuuugaacgua

SEQ ID NO: 980882 - RNA, 18 nt, Homo sapiens
caucgcucugagcauaug

SEQ ID NO: 980883 - RNA, 12 nt, Homo sapiens
caucugcuccuu

SEQ ID NO: 980884 - RNA, 13 nt, Homo sapiens
caucugcuccuuc

SEQ ID NO: 980885 - RNA, 22 nt, Homo sapiens
caugaacccugccccacuccug

SEQ ID NO: 980886 - RNA, 12 nt, Homo sapiens
caugacugcaau

SEQ ID NO: 980887 - RNA, 12 nt, Homo sapiens
caugaucucaau

SEQ ID NO: 980888 - RNA, 16 nt, Homo sapiens
caugcguccacuuucc

SEQ ID NO: 980889 - RNA, 21 nt, Homo sapiens
caugcugggcucacuacaugg

SEQ ID NO: 980890 - RNA, 17 nt, Homo sapiens
cauuaaguaaacaauaa

SEQ ID NO: 980891 - RNA, 13 nt, Homo sapiens
cauuauugaguca

SEQ ID NO: 980892 - RNA, 17 nt, Homo sapiens
cauucaagaaaucauua

SEQ ID NO: 980893 - RNA, 19 nt, Homo sapiens
cauucauccaacagaguua

SEQ ID NO: 980894 - RNA, 20 nt, Homo sapiens
cauuuaguagaauuccucuu

SEQ ID NO: 980895 - RNA, 18 nt, Homo sapiens
cauuucuaauguaugcau

SEQ ID NO: 980896 - RNA, 19 nt, Homo sapiens
cauuucuaauguaugcauu

SEQ ID NO: 980897 - RNA, 16 nt, Homo sapiens
cauuuucugcaucucc

SEQ ID NO: 980898 - RNA, 15 nt, Homo sapiens
cauuuuuacuugaca

SEQ ID NO: 980899 - RNA, 15 nt, Homo sapiens
ccaacucugcacucc

SEQ ID NO: 980900 - RNA, 13 nt, Homo sapiens
ccaagaagaccau

SEQ ID NO: 980901 - RNA, 21 nt, Homo sapiens
ccaagagaugcagugccagga

SEQ ID NO: 980902 - RNA, 14 nt, Homo sapiens
ccaagauugcgcca

SEQ ID NO: 980903 - RNA, 23 nt, Homo sapiens
ccaaugagguggcucaugccugu

SEQ ID NO: 980904 - RNA, 17 nt, Homo sapiens
ccacuucuucauucucu

SEQ ID NO: 980905 - RNA, 23 nt, Homo sapiens
ccagccuauacuucccuuuuuga

SEQ ID NO: 980906 - RNA, 13 nt, Homo sapiens
ccagcuacauucc

SEQ ID NO: 980907 - RNA, 14 nt, Homo sapiens
ccagcuacauuccu

SEQ ID NO: 980908 - RNA, 20 nt, Homo sapiens
ccaggcuagagugcaauggc

SEQ ID NO: 980909 - RNA, 16 nt, Homo sapiens
ccagucucugccagac

SEQ ID NO: 980910 - RNA, 15 nt, Homo sapiens
ccauccucucccuuc

SEQ ID NO: 980911 - RNA, 23 nt, Homo sapiens
ccauguuggccaggcugaucuca

SEQ ID NO: 980912 - RNA, 14 nt, Homo sapiens
ccauugugcauucu

SEQ ID NO: 980913 - RNA, 14 nt, Homo sapiens
cccaccaacucugc

SEQ ID NO: 980914 - RNA, 15 nt, Homo sapiens
cccagccuacugccu

SEQ ID NO: 980915 - RNA, 18 nt, Homo sapiens
cccagcgaguugcgcugg

SEQ ID NO: 980916 - RNA, 19 nt, Homo sapiens
cccaggcuagagugcaaug

SEQ ID NO: 980917 - RNA, 14 nt, Homo sapiens
ccccacuccuguca

SEQ ID NO: 980918 - RNA, 16 nt, Homo sapiens
ccccuaagucaacuua

SEQ ID NO: 980919 - RNA, 13 nt, Homo sapiens
cccguccugauuc

SEQ ID NO: 980920 - RNA, 19 nt, Homo sapiens
cccuaagucaacuuagcau

SEQ ID NO: 980921 - RNA, 18 nt, Homo sapiens
cccugccacuuugcaugg

SEQ ID NO: 980922 - RNA, 12 nt, Homo sapiens
ccguggaaccag

SEQ ID NO: 980923 - RNA, 21 nt, Homo sapiens
ccuacugccucuccagcacuu

SEQ ID NO: 980924 - RNA, 17 nt, Homo sapiens
ccucacccccaccucaa

SEQ ID NO: 980925 - RNA, 19 nt, Homo sapiens
ccucagccucccuuugcca

SEQ ID NO: 980926 - RNA, 18 nt, Homo sapiens
ccucagcugcacauuccu

SEQ ID NO: 980927 - RNA, 23 nt, Homo sapiens
ccuccccggagccggcacugcau

SEQ ID NO: 980928 - RNA, 20 nt, Homo sapiens
ccucccugugugaaauguau

SEQ ID NO: 980929 - RNA, 18 nt, Homo sapiens
ccucuaccuccuggguuc

SEQ ID NO: 980930 - RNA, 17 nt, Homo sapiens
ccucuaucccuggccac

SEQ ID NO: 980931 - RNA, 16 nt, Homo sapiens
ccugcugagcacagac

SEQ ID NO: 980932 - RNA, 21 nt, Homo sapiens
ccuggauuugcauacauucuu

SEQ ID NO: 980933 - RNA, 23 nt, Homo sapiens
ccuuccaagaagaccaugaucuc

SEQ ID NO: 980934 - RNA, 15 nt, Homo sapiens
ccuucccccagcuuu

SEQ ID NO: 980935 - RNA, 22 nt, Homo sapiens
ccuuccugcccaggggacgugg

SEQ ID NO: 980936 - RNA, 19 nt, Homo sapiens
ccuuuguugucuacauuaa

SEQ ID NO: 980937 - RNA, 19 nt, Homo sapiens
cgagcccagcuacauuccu

SEQ ID NO: 980938 - RNA, 16 nt, Homo sapiens
cgcaucgugguguguc

SEQ ID NO: 980939 - RNA, 14 nt, Homo sapiens
cggcucacugcaac

SEQ ID NO: 980940 - RNA, 14 nt, Homo sapiens
cgggagguggagcu

SEQ ID NO: 980941 - RNA, 18 nt, Homo sapiens
cgugagagaaucugccug

SEQ ID NO: 980942 - RNA, 22 nt, Homo sapiens
cguggggggagguggacagucc

SEQ ID NO: 980943 - RNA, 23 nt, Homo sapiens
cguguccaggagaccuuccacaa

SEQ ID NO: 980944 - RNA, 19 nt, Homo sapiens
cuaaaccauugugcauucu

SEQ ID NO: 980945 - RNA, 22 nt, Homo sapiens
cuaaagucaucaugaacuggcu

SEQ ID NO: 980946 - RNA, 21 nt, Homo sapiens
cuaaucaguaguucacuuuaa

SEQ ID NO: 980947 - RNA, 20 nt, Homo sapiens
cuaaugguauauauuguagg

SEQ ID NO: 980948 - RNA, 14 nt, Homo sapiens
cuaauguaugcauu

SEQ ID NO: 980949 - RNA, 14 nt, Homo sapiens
cuagagugcauaua

SEQ ID NO: 980950 - RNA, 20 nt, Homo sapiens
cuagccgcgugugacagucu

SEQ ID NO: 980951 - RNA, 14 nt, Homo sapiens
cuaggaaaagggau

SEQ ID NO: 980952 - RNA, 18 nt, Homo sapiens
cuauaaugguuggaacua

SEQ ID NO: 980953 - RNA, 18 nt, Homo sapiens
cucaauaaagaagcccau

SEQ ID NO: 980954 - RNA, 12 nt, Homo sapiens
cucacucuguca

SEQ ID NO: 980955 - RNA, 13 nt, Homo sapiens
cuccacuuggcau

SEQ ID NO: 980956 - RNA, 13 nt, Homo sapiens
cucccccugugug

SEQ ID NO: 980957 - RNA, 15 nt, Homo sapiens
cuccucugcaucuug

SEQ ID NO: 980958 - RNA, 16 nt, Homo sapiens
cucggcucacugcaac

SEQ ID NO: 980959 - RNA, 23 nt, Homo sapiens
cucugaauaaauacccauugaac

SEQ ID NO: 980960 - RNA, 17 nt, Homo sapiens
cucugagggucugaaaa

SEQ ID NO: 980961 - RNA, 15 nt, Homo sapiens
cucuucuguaaaaug

SEQ ID NO: 980962 - RNA, 17 nt, Homo sapiens
cugaacccuaugugucc

SEQ ID NO: 980963 - RNA, 14 nt, Homo sapiens
cugacaggccuucu

SEQ ID NO: 980964 - RNA, 23 nt, Homo sapiens
cugacccccaucgcucugagcau

SEQ ID NO: 980965 - RNA, 17 nt, Homo sapiens
cugacuuuucugaccca

SEQ ID NO: 980966 - RNA, 22 nt, Homo sapiens
cugagggucugaaaagggcauc

SEQ ID NO: 980967 - RNA, 20 nt, Homo sapiens
cugagugaggaguggacgcu

SEQ ID NO: 980968 - RNA, 13 nt, Homo sapiens
cugaguggggcca

SEQ ID NO: 980969 - RNA, 13 nt, Homo sapiens
cugauuaugugcc

SEQ ID NO: 980970 - RNA, 14 nt, Homo sapiens
cugauuuauugaaa

SEQ ID NO: 980971 - RNA, 13 nt, Homo sapiens
cugcacauuccug

SEQ ID NO: 980972 - RNA, 20 nt, Homo sapiens
cugcaucuccacuuggcauu

SEQ ID NO: 980973 - RNA, 14 nt, Homo sapiens
cugccugagcccag

SEQ ID NO: 980974 - RNA, 14 nt, Homo sapiens
cugccuuuuaguuc

SEQ ID NO: 980975 - RNA, 14 nt, Homo sapiens
cugcugagcacaga

SEQ ID NO: 980976 - RNA, 13 nt, Homo sapiens
cuggaaccacagg

SEQ ID NO: 980977 - RNA, 16 nt, Homo sapiens
cuggacaccacccaga

SEQ ID NO: 980978 - RNA, 22 nt, Homo sapiens
cuggauuugcauacauucuuca

SEQ ID NO: 980979 - RNA, 20 nt, Homo sapiens
cugggauaacaguaagggau

SEQ ID NO: 980980 - RNA, 16 nt, Homo sapiens
cugggucucacuccug

SEQ ID NO: 980981 - RNA, 22 nt, Homo sapiens
cugucagccccucaucagccuu

SEQ ID NO: 980982 - RNA, 22 nt, Homo sapiens
cugucccagagcuuauuggcca

SEQ ID NO: 980983 - RNA, 16 nt, Homo sapiens
cugugaccugcuccug

SEQ ID NO: 980984 - RNA, 23 nt, Homo sapiens
cuguugccacacuuucacugggg

SEQ ID NO: 980985 - RNA, 12 nt, Homo sapiens
cuuacucuguca

SEQ ID NO: 980986 - RNA, 15 nt, Homo sapiens
cuuauauuguucacu

SEQ ID NO: 980987 - RNA, 18 nt, Homo sapiens
cuucaagaucccauuuga

SEQ ID NO: 980988 - RNA, 19 nt, Homo sapiens
cuucaagaucccauuugaa

SEQ ID NO: 980989 - RNA, 19 nt, Homo sapiens
cuuccaugucaagauucag

SEQ ID NO: 980990 - RNA, 13 nt, Homo sapiens
cuuccccagcuca

SEQ ID NO: 980991 - RNA, 13 nt, Homo sapiens
cuucugauggugu

SEQ ID NO: 980992 - RNA, 21 nt, Homo sapiens
cuucuguggcaacuuguacug

SEQ ID NO: 980993 - RNA, 13 nt, Homo sapiens
cuugagacccucu

SEQ ID NO: 980994 - RNA, 16 nt, Homo sapiens
cuuggcucacugcaac

SEQ ID NO: 980995 - RNA, 16 nt, Homo sapiens
cuugguaaacaacaga

SEQ ID NO: 980996 - RNA, 20 nt, Homo sapiens
cuuuaucaagggccuacuuu

SEQ ID NO: 980997 - RNA, 20 nt, Homo sapiens
cuuucauuuuuugaccucau

SEQ ID NO: 980998 - RNA, 17 nt, Homo sapiens
cuuugacaugacugcaa

SEQ ID NO: 980999 - RNA, 11 nt, Homo sapiens
cuuuuccucua

SEQ ID NO: 981000 - RNA, 17 nt, Homo sapiens
gaaaagggauacuuuga

SEQ ID NO: 981001 - RNA, 16 nt, Homo sapiens
gaaaagggcaucucaa

SEQ ID NO: 981002 - RNA, 21 nt, Homo sapiens
gaaauccgaacaguuggggcu

SEQ ID NO: 981003 - RNA, 14 nt, Homo sapiens
gaaaucuauuucau

SEQ ID NO: 981004 - RNA, 19 nt, Homo sapiens
gaaaucuauuucauaccau

SEQ ID NO: 981005 - RNA, 13 nt, Homo sapiens
gaaaugacaacaa

SEQ ID NO: 981006 - RNA, 14 nt, Homo sapiens
gaagaccaaaugau

SEQ ID NO: 981007 - RNA, 22 nt, Homo sapiens
gaaggcucuguuccacauauau

SEQ ID NO: 981008 - RNA, 18 nt, Homo sapiens
gaaguuaaagguauuuau

SEQ ID NO: 981009 - RNA, 13 nt, Homo sapiens
gaaguuuccucau

SEQ ID NO: 981010 - RNA, 21 nt, Homo sapiens
gacaauuagauaaauguccau

SEQ ID NO: 981011 - RNA, 13 nt, Homo sapiens
gacagagcaagac

SEQ ID NO: 981012 - RNA, 21 nt, Homo sapiens
gacaugacugcaaucaugugc

SEQ ID NO: 981013 - RNA, 18 nt, Homo sapiens
gaccaaagauacauguaa

SEQ ID NO: 981014 - RNA, 16 nt, Homo sapiens
gaccuucuauccucug

SEQ ID NO: 981015 - RNA, 17 nt, Homo sapiens
gacgcccccaaauccuu

SEQ ID NO: 981016 - RNA, 16 nt, Homo sapiens
gacuaaaccauugugc

SEQ ID NO: 981017 - RNA, 15 nt, Homo sapiens
gacuuggggacaccc

SEQ ID NO: 981018 - RNA, 17 nt, Homo sapiens
gagaaacgcucaugaca

SEQ ID NO: 981019 - RNA, 15 nt, Homo sapiens
gagaccauccuggcc

SEQ ID NO: 981020 - RNA, 14 nt, Homo sapiens
gagaccuuccacaa

SEQ ID NO: 981021 - RNA, 13 nt, Homo sapiens
gagaggcucugag

SEQ ID NO: 981022 - RNA, 19 nt, Homo sapiens
gagaugaaguuaaagguau

SEQ ID NO: 981023 - RNA, 14 nt, Homo sapiens
gagcuugcaaugag

SEQ ID NO: 981024 - RNA, 20 nt, Homo sapiens
gaggcaggagaauggcguga

SEQ ID NO: 981025 - RNA, 22 nt, Homo sapiens
gaggcugaggcaggagaauggc

SEQ ID NO: 981026 - RNA, 23 nt, Homo sapiens
gagggucugaaaagggcaucuca

SEQ ID NO: 981027 - RNA, 20 nt, Homo sapiens
gagguggagcuugcaaugag

SEQ ID NO: 981028 - RNA, 17 nt, Homo sapiens
gagguggcucaugccug

SEQ ID NO: 981029 - RNA, 23 nt, Homo sapiens
gagucaccuccuccacucacucc

SEQ ID NO: 981030 - RNA, 15 nt, Homo sapiens
gaguggcggggcccc

SEQ ID NO: 981031 - RNA, 21 nt, Homo sapiens
gaguuauuuauuggcuggaga

SEQ ID NO: 981032 - RNA, 13 nt, Homo sapiens
gauaaauguccau

SEQ ID NO: 981033 - RNA, 13 nt, Homo sapiens
gaucuggcccaag

SEQ ID NO: 981034 - RNA, 22 nt, Homo sapiens
gaugggguuucaccauguuggc

SEQ ID NO: 981035 - RNA, 20 nt, Homo sapiens
gauugcgccacugcacucca

SEQ ID NO: 981036 - RNA, 22 nt, Homo sapiens
gcaacuuguacugaaaaucugg

SEQ ID NO: 981037 - RNA, 21 nt, Homo sapiens
gcaccucauggacuccaggau

SEQ ID NO: 981038 - RNA, 17 nt, Homo sapiens
gcacuucuuaacagaca

SEQ ID NO: 981039 - RNA, 14 nt, Homo sapiens
gcagccuggccaac

SEQ ID NO: 981040 - RNA, 21 nt, Homo sapiens
gcagcugacuuuucugaccca

SEQ ID NO: 981041 - RNA, 12 nt, Homo sapiens
gcagcugggauu

SEQ ID NO: 981042 - RNA, 17 nt, Homo sapiens
gcaggagaauggcguga

SEQ ID NO: 981043 - RNA, 18 nt, Homo sapiens
gcagguuccagugccuga

SEQ ID NO: 981044 - RNA, 12 nt, Homo sapiens
gcauacauucuu

SEQ ID NO: 981045 - RNA, 12 nt, Homo sapiens
gcauagccuuuc

SEQ ID NO: 981046 - RNA, 15 nt, Homo sapiens
gcauaugcaucccaa

SEQ ID NO: 981047 - RNA, 22 nt, Homo sapiens
gcaucguggugugucaaugcca

SEQ ID NO: 981048 - RNA, 22 nt, Homo sapiens
gcaugguuugauuuugaccugg

SEQ ID NO: 981049 - RNA, 16 nt, Homo sapiens
gcauucuagagugcau

SEQ ID NO: 981050 - RNA, 18 nt, Homo sapiens
gcauuuucugcaucucca

SEQ ID NO: 981051 - RNA, 20 nt, Homo sapiens
gccaagauugcgccacugca

SEQ ID NO: 981052 - RNA, 23 nt, Homo sapiens
gccacuugacauuccuugucacc

SEQ ID NO: 981053 - RNA, 17 nt, Homo sapiens
gccagccucagugccac

SEQ ID NO: 981054 - RNA, 14 nt, Homo sapiens
gccagggcucagau

SEQ ID NO: 981055 - RNA, 19 nt, Homo sapiens
gcccaaugagguggcucau

SEQ ID NO: 981056 - RNA, 15 nt, Homo sapiens
gcccagaagcccagu

SEQ ID NO: 981057 - RNA, 12 nt, Homo sapiens
gcccagcuacau

SEQ ID NO: 981058 - RNA, 18 nt, Homo sapiens
gccccucgcugcugcuac

SEQ ID NO: 981059 - RNA, 17 nt, Homo sapiens
gcccuugcacaugggca

SEQ ID NO: 981060 - RNA, 14 nt, Homo sapiens
gccgcgugugacag

SEQ ID NO: 981061 - RNA, 20 nt, Homo sapiens
gccgcuuccccagcucagag

SEQ ID NO: 981062 - RNA, 12 nt, Homo sapiens
gccuacugccuc

SEQ ID NO: 981063 - RNA, 14 nt, Homo sapiens
gccucagugccacu

SEQ ID NO: 981064 - RNA, 20 nt, Homo sapiens
gccucauccaaacuguaucu

SEQ ID NO: 981065 - RNA, 14 nt, Homo sapiens
gccuggcaucgcau

SEQ ID NO: 981066 - RNA, 14 nt, Homo sapiens
gcgaguugcgcugg

SEQ ID NO: 981067 - RNA, 18 nt, Homo sapiens
gcgcacuaccacacccag

SEQ ID NO: 981068 - RNA, 18 nt, Homo sapiens
gcucccucuguguuagaa

SEQ ID NO: 981069 - RNA, 18 nt, Homo sapiens
gcucugagggucugaaaa

SEQ ID NO: 981070 - RNA, 15 nt, Homo sapiens
gcugaggcaggagga

SEQ ID NO: 981071 - RNA, 13 nt, Homo sapiens
gcugcacauuccu

SEQ ID NO: 981072 - RNA, 14 nt, Homo sapiens
gcuguccauugcca

SEQ ID NO: 981073 - RNA, 15 nt, Homo sapiens
gcuuccccagcucag

SEQ ID NO: 981074 - RNA, 17 nt, Homo sapiens
gcuuuccaucugaggac

SEQ ID NO: 981075 - RNA, 21 nt, Homo sapiens
ggaaaaucacaccaccugaca

SEQ ID NO: 981076 - RNA, 23 nt, Homo sapiens
ggaaccaaccaacaaacaaugcc

SEQ ID NO: 981077 - RNA, 16 nt, Homo sapiens
ggagaaccugguugca

SEQ ID NO: 981078 - RNA, 14 nt, Homo sapiens
ggagggagggacaa

SEQ ID NO: 981079 - RNA, 21 nt, Homo sapiens
ggagucagucaugucacugaa

SEQ ID NO: 981080 - RNA, 21 nt, Homo sapiens
ggauccccagccuacugccuc

SEQ ID NO: 981081 - RNA, 23 nt, Homo sapiens
ggaugacuuggggacaccccaga

SEQ ID NO: 981082 - RNA, 23 nt, Homo sapiens
ggcauagcauuagcugcuuccuc

SEQ ID NO: 981083 - RNA, 19 nt, Homo sapiens
ggcauggccgcgucacuuc

SEQ ID NO: 981084 - RNA, 22 nt, Homo sapiens
ggccacugggucucacuccuga

SEQ ID NO: 981085 - RNA, 18 nt, Homo sapiens
ggccagcccuugcucuac

SEQ ID NO: 981086 - RNA, 15 nt, Homo sapiens
ggccuggcaucgcau

SEQ ID NO: 981087 - RNA, 20 nt, Homo sapiens
ggcgagugugggcauagcau

SEQ ID NO: 981088 - RNA, 15 nt, Homo sapiens
ggcuagagugcaaug

SEQ ID NO: 981089 - RNA, 16 nt, Homo sapiens
ggcucaauuuggugcu

SEQ ID NO: 981090 - RNA, 16 nt, Homo sapiens
ggcucugagggucuga

SEQ ID NO: 981091 - RNA, 22 nt, Homo sapiens
ggcugcgucccugcucagccca

SEQ ID NO: 981092 - RNA, 14 nt, Homo sapiens
ggcuguucauggca

SEQ ID NO: 981093 - RNA, 18 nt, Homo sapiens
ggcuuaaugaaggucaua

SEQ ID NO: 981094 - RNA, 20 nt, Homo sapiens
gggagguggagcuugcaaug

SEQ ID NO: 981095 - RNA, 20 nt, Homo sapiens
gggagucagucaugucacug

SEQ ID NO: 981096 - RNA, 15 nt, Homo sapiens
gggauuugaaccagg

SEQ ID NO: 981097 - RNA, 11 nt, Homo sapiens
gggcacugccu

SEQ ID NO: 981098 - RNA, 12 nt, Homo sapiens
gggcacugccug

SEQ ID NO: 981099 - RNA, 20 nt, Homo sapiens
gggcagaagagaaaccaucc

SEQ ID NO: 981100 - RNA, 19 nt, Homo sapiens
gggcaucucaauggcaugg

SEQ ID NO: 981101 - RNA, 22 nt, Homo sapiens
gggccccggaugacuuggggac

SEQ ID NO: 981102 - RNA, 12 nt, Homo sapiens
gguaaauacugg

SEQ ID NO: 981103 - RNA, 23 nt, Homo sapiens
ggucaggggugagaccugaagga

SEQ ID NO: 981104 - RNA, 16 nt, Homo sapiens
gguggcucaugccugu

SEQ ID NO: 981105 - RNA, 22 nt, Homo sapiens
gguggggagucagucaugucac

SEQ ID NO: 981106 - RNA, 17 nt, Homo sapiens
ggugucaucugcuccuu

SEQ ID NO: 981107 - RNA, 17 nt, Homo sapiens
guaaucuuggguuucua

SEQ ID NO: 981108 - RNA, 13 nt, Homo sapiens
guaauuaguuuaa

SEQ ID NO: 981109 - RNA, 17 nt, Homo sapiens
guauaguuuugucacaa

SEQ ID NO: 981110 - RNA, 22 nt, Homo sapiens
guauuuaucauucaagaaauca

SEQ ID NO: 981111 - RNA, 15 nt, Homo sapiens
gucacacuuugccaa

SEQ ID NO: 981112 - RNA, 22 nt, Homo sapiens
gucaccaagguggcuucuccuu

SEQ ID NO: 981113 - RNA, 22 nt, Homo sapiens
gucaucaugaacuggcuuguac

SEQ ID NO: 981114 - RNA, 13 nt, Homo sapiens
gucauggucugag

SEQ ID NO: 981115 - RNA, 12 nt, Homo sapiens
guccacuuuccc

SEQ ID NO: 981116 - RNA, 20 nt, Homo sapiens
guccauugccacggccauga

SEQ ID NO: 981117 - RNA, 14 nt, Homo sapiens
gucuucuaguuuag

SEQ ID NO: 981118 - RNA, 14 nt, Homo sapiens
gugaccacuuucaa

SEQ ID NO: 981119 - RNA, 15 nt, Homo sapiens
gugagagaaucugcc

SEQ ID NO: 981120 - RNA, 18 nt, Homo sapiens
gugagccgugucguauga

SEQ ID NO: 981121 - RNA, 21 nt, Homo sapiens
gugcugguccuguugauccca

SEQ ID NO: 981122 - RNA, 23 nt, Homo sapiens
guggaggggcauagccuuucccu

SEQ ID NO: 981123 - RNA, 19 nt, Homo sapiens
gugggaggcccggggcccu

SEQ ID NO: 981124 - RNA, 12 nt, Homo sapiens
guggggcuuccu

SEQ ID NO: 981125 - RNA, 17 nt, Homo sapiens
gugucacacuuugccaa

SEQ ID NO: 981126 - RNA, 23 nt, Homo sapiens
gugugaaguguaguggcauccau

SEQ ID NO: 981127 - RNA, 22 nt, Homo sapiens
gugugcucauagaaacugcuuu

SEQ ID NO: 981128 - RNA, 13 nt, Homo sapiens
guguggcaguguu

SEQ ID NO: 981129 - RNA, 19 nt, Homo sapiens
guguggcccuggacacagc

SEQ ID NO: 981130 - RNA, 14 nt, Homo sapiens
gugugucaaugcca

SEQ ID NO: 981131 - RNA, 19 nt, Homo sapiens
guguguccguggaaccagu

SEQ ID NO: 981132 - RNA, 17 nt, Homo sapiens
guucaugggcaccucau

SEQ ID NO: 981133 - RNA, 21 nt, Homo sapiens
guuccacauauauuuccacuu

SEQ ID NO: 981134 - RNA, 16 nt, Homo sapiens
guucuuuuuguuuaca

SEQ ID NO: 981135 - RNA, 16 nt, Homo sapiens
guugcacagcaucuca

SEQ ID NO: 981136 - RNA, 16 nt, Homo sapiens
guuugcuuuuuuaaca

SEQ ID NO: 981137 - RNA, 21 nt, Homo sapiens
guuuuguaaauguacugguaa

SEQ ID NO: 981138 - RNA, 23 nt, Homo sapiens
uaaaaagaaagugagcaguguua

SEQ ID NO: 981139 - RNA, 23 nt, Homo sapiens
uaaaaauaaaguuccugauaaua

SEQ ID NO: 981140 - RNA, 12 nt, Homo sapiens
uaaaagugucca

SEQ ID NO: 981141 - RNA, 12 nt, Homo sapiens
uaaacaacagac

SEQ ID NO: 981142 - RNA, 20 nt, Homo sapiens
uaacagacaauuggucaaaa

SEQ ID NO: 981143 - RNA, 17 nt, Homo sapiens
uaagauuuucugggaua

SEQ ID NO: 981144 - RNA, 16 nt, Homo sapiens
uaagcaaaagcaucca

SEQ ID NO: 981145 - RNA, 20 nt, Homo sapiens
uaagcagcaaauaaacaacu

SEQ ID NO: 981146 - RNA, 18 nt, Homo sapiens
uaaguuauaaaaggugaa

SEQ ID NO: 981147 - RNA, 15 nt, Homo sapiens
uaauacccacauuac

SEQ ID NO: 981148 - RNA, 15 nt, Homo sapiens
uaaucccagcacuuu

SEQ ID NO: 981149 - RNA, 14 nt, Homo sapiens
uaaugaaggucaua

SEQ ID NO: 981150 - RNA, 15 nt, Homo sapiens
uaaugguugggacca

SEQ ID NO: 981151 - RNA, 14 nt, Homo sapiens
uaauguaugcauuc

SEQ ID NO: 981152 - RNA, 15 nt, Homo sapiens
uaauguaugcauuca

SEQ ID NO: 981153 - RNA, 13 nt, Homo sapiens
uacauuaaaucac

SEQ ID NO: 981154 - RNA, 18 nt, Homo sapiens
uaccacauaacaacaucu

SEQ ID NO: 981155 - RNA, 18 nt, Homo sapiens
uaccccggcugcuuggca

SEQ ID NO: 981156 - RNA, 22 nt, Homo sapiens
uacuuuauggcagacauugugc

SEQ ID NO: 981157 - RNA, 22 nt, Homo sapiens
uagaaacugcuuugacaugacu

SEQ ID NO: 981158 - RNA, 22 nt, Homo sapiens
uagagacauccuucauuugaca

SEQ ID NO: 981159 - RNA, 18 nt, Homo sapiens
uagcaccuuaucuaugau

SEQ ID NO: 981160 - RNA, 22 nt, Homo sapiens
uagcuaaaaccuuccaugucaa

SEQ ID NO: 981161 - RNA, 14 nt, Homo sapiens
uagcugggauuuga

SEQ ID NO: 981162 - RNA, 17 nt, Homo sapiens
uaggcagccucucugcu

SEQ ID NO: 981163 - RNA, 16 nt, Homo sapiens
uagucaguuacugaug

SEQ ID NO: 981164 - RNA, 20 nt, Homo sapiens
uagugacuaaaccauugugc

SEQ ID NO: 981165 - RNA, 23 nt, Homo sapiens
uauccucuguauuugucauuccu

SEQ ID NO: 981166 - RNA, 14 nt, Homo sapiens
uauccuguuuucau

SEQ ID NO: 981167 - RNA, 13 nt, Homo sapiens
uaugauuagcuuu

SEQ ID NO: 981168 - RNA, 18 nt, Homo sapiens
uauggaaggguaaauacu

SEQ ID NO: 981169 - RNA, 19 nt, Homo sapiens
uaugugucacacuuugcca

SEQ ID NO: 981170 - RNA, 21 nt, Homo sapiens
uauucuaaucaguaguucacu

SEQ ID NO: 981171 - RNA, 17 nt, Homo sapiens
uauugcugaaugcaaga

SEQ ID NO: 981172 - RNA, 12 nt, Homo sapiens
uauuuccacuuc

SEQ ID NO: 981173 - RNA, 17 nt, Homo sapiens
ucaagauucccacuccc

SEQ ID NO: 981174 - RNA, 22 nt, Homo sapiens
ucaauagucaguuacugaugcu

SEQ ID NO: 981175 - RNA, 22 nt, Homo sapiens
ucacaauuauagauuagaucaa

SEQ ID NO: 981176 - RNA, 20 nt, Homo sapiens
ucaccaggcuggagugcagu

SEQ ID NO: 981177 - RNA, 12 nt, Homo sapiens
ucaccauguugg

SEQ ID NO: 981178 - RNA, 20 nt, Homo sapiens
ucacccggaucccuccucac

SEQ ID NO: 981179 - RNA, 16 nt, Homo sapiens
ucacccugacuguggg

SEQ ID NO: 981180 - RNA, 23 nt, Homo sapiens
ucacugcacccuggauuugcaua

SEQ ID NO: 981181 - RNA, 16 nt, Homo sapiens
ucagcucaucuucacu

SEQ ID NO: 981182 - RNA, 22 nt, Homo sapiens
ucaggaugagaacacacugagu

SEQ ID NO: 981183 - RNA, 15 nt, Homo sapiens
ucaguaguucacuuu

SEQ ID NO: 981184 - RNA, 15 nt, Homo sapiens
ucaucugcuccuucc

SEQ ID NO: 981185 - RNA, 20 nt, Homo sapiens
uccaaaguagcugggauuac

SEQ ID NO: 981186 - RNA, 18 nt, Homo sapiens
uccacauccccaccuucc

SEQ ID NO: 981187 - RNA, 22 nt, Homo sapiens
uccagacccugccugagcccag

SEQ ID NO: 981188 - RNA, 13 nt, Homo sapiens
uccagugccugac

SEQ ID NO: 981189 - RNA, 23 nt, Homo sapiens
uccauuuggauaaaaggaaccaa

SEQ ID NO: 981190 - RNA, 10 nt, Homo sapiens
ucccaaagug

SEQ ID NO: 981191 - RNA, 17 nt, Homo sapiens
uccccagccuacugccu

SEQ ID NO: 981192 - RNA, 13 nt, Homo sapiens
ucccugcucagcc

SEQ ID NO: 981193 - RNA, 15 nt, Homo sapiens
ucccuugaccuuucc

SEQ ID NO: 981194 - RNA, 21 nt, Homo sapiens
uccuccccuccuggcacccac

SEQ ID NO: 981195 - RNA, 20 nt, Homo sapiens
uccugagggguauccuccua

SEQ ID NO: 981196 - RNA, 17 nt, Homo sapiens
uccugccucagccucca

SEQ ID NO: 981197 - RNA, 21 nt, Homo sapiens
uccuggagcagcagcugaggc

SEQ ID NO: 981198 - RNA, 14 nt, Homo sapiens
ucggccucccaaag

SEQ ID NO: 981199 - RNA, 20 nt, Homo sapiens
ucuaaagucaucaugaacug

SEQ ID NO: 981200 - RNA, 23 nt, Homo sapiens
ucuaaucaguaguucacuuuaau

SEQ ID NO: 981201 - RNA, 20 nt, Homo sapiens
ucuagacgcccccaaauccu

SEQ ID NO: 981202 - RNA, 12 nt, Homo sapiens
ucuccagcacuu

SEQ ID NO: 981203 - RNA, 18 nt, Homo sapiens
ucuccuagcccuccugag

SEQ ID NO: 981204 - RNA, 20 nt, Homo sapiens
ucugagguaaagguccauga

SEQ ID NO: 981205 - RNA, 15 nt, Homo sapiens
ucugauggugucauc

SEQ ID NO: 981206 - RNA, 19 nt, Homo sapiens
ucugcuuccaguuggaguu

SEQ ID NO: 981207 - RNA, 13 nt, Homo sapiens
ucugggccaguga

SEQ ID NO: 981208 - RNA, 18 nt, Homo sapiens
ucugugcacugauugcau

SEQ ID NO: 981209 - RNA, 14 nt, Homo sapiens
ucugugcuguguau

SEQ ID NO: 981210 - RNA, 16 nt, Homo sapiens
ucuucccuacccuucc

SEQ ID NO: 981211 - RNA, 23 nt, Homo sapiens
ucuucccuacccuuccugccaag

SEQ ID NO: 981212 - RNA, 11 nt, Homo sapiens
ucuugcauucu

SEQ ID NO: 981213 - RNA, 16 nt, Homo sapiens
ucuuggcucacugcaa

SEQ ID NO: 981214 - RNA, 15 nt, Homo sapiens
ucuugucuccauuug

SEQ ID NO: 981215 - RNA, 17 nt, Homo sapiens
ugaaacaaauaaucaca

SEQ ID NO: 981216 - RNA, 14 nt, Homo sapiens
ugaacccuaugugu

SEQ ID NO: 981217 - RNA, 20 nt, Homo sapiens
ugaaguguaguggcauccau

SEQ ID NO: 981218 - RNA, 23 nt, Homo sapiens
ugacaacaaggcccuuuaacuug

SEQ ID NO: 981219 - RNA, 15 nt, Homo sapiens
ugacaugacugcaau

SEQ ID NO: 981220 - RNA, 14 nt, Homo sapiens
ugaccucagcugca

SEQ ID NO: 981221 - RNA, 13 nt, Homo sapiens
ugacgaacuggcu

SEQ ID NO: 981222 - RNA, 21 nt, Homo sapiens
ugacuuuucugacccauguuc

SEQ ID NO: 981223 - RNA, 21 nt, Homo sapiens
ugagcauauguuccaugccug

SEQ ID NO: 981224 - RNA, 18 nt, Homo sapiens
ugagguggcucaugccug

SEQ ID NO: 981225 - RNA, 13 nt, Homo sapiens
ugaugauccauua

SEQ ID NO: 981226 - RNA, 18 nt, Homo sapiens
ugauggugucaucugcuc

SEQ ID NO: 981227 - RNA, 12 nt, Homo sapiens
ugauuuauugaa

SEQ ID NO: 981228 - RNA, 13 nt, Homo sapiens
ugcaauggcacca

SEQ ID NO: 981229 - RNA, 16 nt, Homo sapiens
ugcaauggcaccaucu

SEQ ID NO: 981230 - RNA, 15 nt, Homo sapiens
ugcacacacguauac

SEQ ID NO: 981231 - RNA, 14 nt, Homo sapiens
ugcacagcaucuca

SEQ ID NO: 981232 - RNA, 15 nt, Homo sapiens
ugcacagcaucucag

SEQ ID NO: 981233 - RNA, 14 nt, Homo sapiens
ugcaucuccacuug

SEQ ID NO: 981234 - RNA, 21 nt, Homo sapiens
ugccaaacaggauguggaaaa

SEQ ID NO: 981235 - RNA, 19 nt, Homo sapiens
ugccaauuuucuuugaaaa

SEQ ID NO: 981236 - RNA, 17 nt, Homo sapiens
ugccacuugacauuccu

SEQ ID NO: 981237 - RNA, 12 nt, Homo sapiens
ugccacuuugca

SEQ ID NO: 981238 - RNA, 15 nt, Homo sapiens
ugcccugcugagcac

SEQ ID NO: 981239 - RNA, 14 nt, Homo sapiens
ugccucacugugac

SEQ ID NO: 981240 - RNA, 14 nt, Homo sapiens
ugccucagccuccc

SEQ ID NO: 981241 - RNA, 20 nt, Homo sapiens
ugccucggccucccaaagug

SEQ ID NO: 981242 - RNA, 22 nt, Homo sapiens
ugccuuaaauaaaacugcauug

SEQ ID NO: 981243 - RNA, 15 nt, Homo sapiens
ugcucccucuguguu

SEQ ID NO: 981244 - RNA, 17 nt, Homo sapiens
ugcuccgaggggcucau

SEQ ID NO: 981245 - RNA, 13 nt, Homo sapiens
ugcucugagguaa

SEQ ID NO: 981246 - RNA, 20 nt, Homo sapiens
ugcuuugacaugacugcaau

SEQ ID NO: 981247 - RNA, 17 nt, Homo sapiens
uggaaaaucacaccacc

SEQ ID NO: 981248 - RNA, 15 nt, Homo sapiens
uggacagcugagcac

SEQ ID NO: 981249 - RNA, 20 nt, Homo sapiens
uggagcuugcaaugagccaa

SEQ ID NO: 981250 - RNA, 13 nt, Homo sapiens
uggaggcugcugc

SEQ ID NO: 981251 - RNA, 23 nt, Homo sapiens
uggcacccacuguggccuggcau

SEQ ID NO: 981252 - RNA, 18 nt, Homo sapiens
uggcagugcuugugauuc

SEQ ID NO: 981253 - RNA, 17 nt, Homo sapiens
uggcccgccccucgcug

SEQ ID NO: 981254 - RNA, 16 nt, Homo sapiens
uggccuggcaucgcau

SEQ ID NO: 981255 - RNA, 19 nt, Homo sapiens
uggcgcugucgguguuugg

SEQ ID NO: 981256 - RNA, 18 nt, Homo sapiens
ugggagagcaacaaguag

SEQ ID NO: 981257 - RNA, 18 nt, Homo sapiens
ugggcuccucugcaucuu

SEQ ID NO: 981258 - RNA, 15 nt, Homo sapiens
uggggcccacauuag

SEQ ID NO: 981259 - RNA, 16 nt, Homo sapiens
ugguaaacaacagacu

SEQ ID NO: 981260 - RNA, 14 nt, Homo sapiens
uggugggauuugcu

SEQ ID NO: 981261 - RNA, 22 nt, Homo sapiens
uggugggauuugcuccuggguu

SEQ ID NO: 981262 - RNA, 17 nt, Homo sapiens
uguaaugguugggacca

SEQ ID NO: 981263 - RNA, 21 nt, Homo sapiens
uguggagucaccccaacucug

SEQ ID NO: 981264 - RNA, 23 nt, Homo sapiens
uguggcaguguuuaaaugcucuu

SEQ ID NO: 981265 - RNA, 23 nt, Homo sapiens
uguggccuugcccgccagccuca

SEQ ID NO: 981266 - RNA, 22 nt, Homo sapiens
uguggguauagcucaggguaag

SEQ ID NO: 981267 - RNA, 15 nt, Homo sapiens
ugugucacacuuugc

SEQ ID NO: 981268 - RNA, 21 nt, Homo sapiens
uguguccguggaaccaguccu

SEQ ID NO: 981269 - RNA, 13 nt, Homo sapiens
uguuuucauggac

SEQ ID NO: 981270 - RNA, 15 nt, Homo sapiens
uuaaaauguuuacug

SEQ ID NO: 981271 - RNA, 22 nt, Homo sapiens
uuaacagauaacagugugcuca

SEQ ID NO: 981272 - RNA, 21 nt, Homo sapiens
uuacaagugcgcacuaccaca

SEQ ID NO: 981273 - RNA, 22 nt, Homo sapiens
uuacaggugugagccaccgugc

SEQ ID NO: 981274 - RNA, 15 nt, Homo sapiens
uuacauaauacuuga

SEQ ID NO: 981275 - RNA, 21 nt, Homo sapiens
uuagcauuuucugcaucucca

SEQ ID NO: 981276 - RNA, 15 nt, Homo sapiens
uuagcuuaguucucu

SEQ ID NO: 981277 - RNA, 22 nt, Homo sapiens
uucaagcaauucuccugccuca

SEQ ID NO: 981278 - RNA, 20 nt, Homo sapiens
uucaccauguuggcuaggau

SEQ ID NO: 981279 - RNA, 21 nt, Homo sapiens
uucagcagguuccagugccug

SEQ ID NO: 981280 - RNA, 14 nt, Homo sapiens
uucauuuccauugg

SEQ ID NO: 981281 - RNA, 21 nt, Homo sapiens
uuccacauccccaccuuccaa

SEQ ID NO: 981282 - RNA, 13 nt, Homo sapiens
uuccauuuguagg

SEQ ID NO: 981283 - RNA, 22 nt, Homo sapiens
uuccauuuguagguagugagac

SEQ ID NO: 981284 - RNA, 23 nt, Homo sapiens
uucccugcauaugcuucugaugg

SEQ ID NO: 981285 - RNA, 21 nt, Homo sapiens
uuccucuaggaaaagggauac

SEQ ID NO: 981286 - RNA, 22 nt, Homo sapiens
uuccucucacuguugccugcau

SEQ ID NO: 981287 - RNA, 15 nt, Homo sapiens
uugaccucagcugca

SEQ ID NO: 981288 - RNA, 20 nt, Homo sapiens
uugacgaacuggcuacagua

SEQ ID NO: 981289 - RNA, 13 nt, Homo sapiens
uugcauacauucu

SEQ ID NO: 981290 - RNA, 20 nt, Homo sapiens
uugccaaacaggauguggaa

SEQ ID NO: 981291 - RNA, 17 nt, Homo sapiens
uugcccugccacuuugc

SEQ ID NO: 981292 - RNA, 16 nt, Homo sapiens
uuggaauaaucacuug

SEQ ID NO: 981293 - RNA, 17 nt, Homo sapiens
uuggaauaaucacuugg

SEQ ID NO: 981294 - RNA, 16 nt, Homo sapiens
uugggaagcugaggca

SEQ ID NO: 981295 - RNA, 16 nt, Homo sapiens
uugggauaggacugag

SEQ ID NO: 981296 - RNA, 18 nt, Homo sapiens
uuggggcuguucauggca

SEQ ID NO: 981297 - RNA, 23 nt, Homo sapiens
uuguauagguaacuagguaacuu

SEQ ID NO: 981298 - RNA, 21 nt, Homo sapiens
uuguugucuacauuaaaucac

SEQ ID NO: 981299 - RNA, 15 nt, Homo sapiens
uuuaaaaacauuuuc

SEQ ID NO: 981300 - RNA, 16 nt, Homo sapiens
uuuaauaagauuuucu

SEQ ID NO: 981301 - RNA, 20 nt, Homo sapiens
uuuauggcagacauugugcu

SEQ ID NO: 981302 - RNA, 24 nt, Homo sapiens
uuucaccaggaucucuuggccuca

SEQ ID NO: 981303 - RNA, 14 nt, Homo sapiens
uuucuuaggcacuu

SEQ ID NO: 981304 - RNA, 21 nt, Homo sapiens
uuugaauuuuuuagugacuaa

SEQ ID NO: 981305 - RNA, 15 nt, Homo sapiens
uuuucugcaucucca

SEQ ID NO: 981306 - RNA, 17 nt, Homo sapiens
uuuuguaaauguacugg

SEQ ID NO: 981307 - RNA, 21 nt, Homo sapiens
gagccucuuguggaccccgcc

SEQ ID NO: 981308 - RNA, 17 nt, Homo sapiens
gaggccaagauccccuc

SEQ ID NO: 981309 - RNA, 18 nt, Homo sapiens
gagggaggaacaccugau

SEQ ID NO: 981310 - RNA, 19 nt, Homo sapiens
gagucagucaugucacuga

SEQ ID NO: 981311 - RNA, 23 nt, Homo sapiens
gauacuuugauaauuaaggccag

SEQ ID NO: 981312 - RNA, 20 nt, Homo sapiens
gauccauuaaguaaacaaua

SEQ ID NO: 981313 - RNA, 16 nt, Homo sapiens
gaugacuuggggacac

SEQ ID NO: 981314 - RNA, 13 nt, Homo sapiens
gaugagaacacac

SEQ ID NO: 981315 - RNA, 20 nt, Homo sapiens
gauggaaaaucacaccaccu

SEQ ID NO: 981316 - RNA, 21 nt, Homo sapiens
gaugguuacugaggaccaaag

SEQ ID NO: 981317 - RNA, 16 nt, Homo sapiens
gauugcauaugcaucc

SEQ ID NO: 981318 - RNA, 21 nt, Homo sapiens
gauuuuaagcaaaagcaucca

SEQ ID NO: 981319 - RNA, 18 nt, Homo sapiens
gcaaccuccgccucccag

SEQ ID NO: 981320 - RNA, 17 nt, Homo sapiens
gcaagacuccgucucaa

SEQ ID NO: 981321 - RNA, 14 nt, Homo sapiens
gcaaucaugugcuu

SEQ ID NO: 981322 - RNA, 22 nt, Homo sapiens
gcaaucaugugcuucauagaaa

SEQ ID NO: 981323 - RNA, 20 nt, Homo sapiens
gcaaucucggcucacugcaa

SEQ ID NO: 981324 - RNA, 22 nt, Homo sapiens
gcacaugggcaugguugaaucu

SEQ ID NO: 981325 - RNA, 18 nt, Homo sapiens
gcacccuggauuugcaua

SEQ ID NO: 981326 - RNA, 16 nt, Homo sapiens
gcagaagagaaaccau

SEQ ID NO: 981327 - RNA, 13 nt, Homo sapiens
gcagacacugccg

SEQ ID NO: 981328 - RNA, 17 nt, Homo sapiens
gcagccuccucugugac

SEQ ID NO: 981329 - RNA, 17 nt, Homo sapiens
gcaucguggugugucaa

SEQ ID NO: 981330 - RNA, 17 nt, Homo sapiens
gccaagccagggacuaa

SEQ ID NO: 981331 - RNA, 13 nt, Homo sapiens
gccacugcacucc

SEQ ID NO: 981332 - RNA, 14 nt, Homo sapiens
gcccagcuacauuc

SEQ ID NO: 981333 - RNA, 12 nt, Homo sapiens
gccccaugggcc

SEQ ID NO: 981334 - RNA, 16 nt, Homo sapiens
gccccucaucagccuu

SEQ ID NO: 981335 - RNA, 21 nt, Homo sapiens
gccccucgcugcugcuacuac

SEQ ID NO: 981336 - RNA, 13 nt, Homo sapiens
gccgcgugugaca

SEQ ID NO: 981337 - RNA, 15 nt, Homo sapiens
uagcugggauuugaa

SEQ ID NO: 981338 - RNA, 21 nt, Homo sapiens
uagcugggauuugaacugagc

SEQ ID NO: 981339 - RNA, 14 nt, Homo sapiens
uaggaaaagggaua

SEQ ID NO: 981340 - RNA, 20 nt, Homo sapiens
uaggaaaagggauacuuuga

SEQ ID NO: 981341 - RNA, 13 nt, Homo sapiens
uaguagaauuccu

SEQ ID NO: 981342 - RNA, 14 nt, Homo sapiens
uagucaguuacuga

SEQ ID NO: 981343 - RNA, 17 nt, Homo sapiens
uaguuucaccaggaucu

SEQ ID NO: 981344 - RNA, 16 nt, Homo sapiens
uauacaguguacaugu

SEQ ID NO: 981345 - RNA, 14 nt, Homo sapiens
uauaguuuugucac

SEQ ID NO: 981346 - RNA, 22 nt, Homo sapiens
uauauuuccacuucuucauucu

SEQ ID NO: 981347 - RNA, 22 nt, Homo sapiens
uauauuucuccaagaaagccaa

SEQ ID NO: 981348 - RNA, 13 nt, Homo sapiens
uauauuuugccug

SEQ ID NO: 981349 - RNA, 17 nt, Homo sapiens
uauccuguuuucaugga

SEQ ID NO: 981350 - RNA, 16 nt, Homo sapiens
uauguaguaugcuaug

SEQ ID NO: 981351 - RNA, 20 nt, Homo sapiens
uaugugucacacuuugccaa

SEQ ID NO: 981352 - RNA, 14 nt, Homo sapiens
uauuaucaccagca

SEQ ID NO: 981353 - RNA, 16 nt, Homo sapiens
uauucccagcuacuca

SEQ ID NO: 981354 - RNA, 21 nt, Homo sapiens
uauucccagcuacucaugagg

SEQ ID NO: 981355 - RNA, 17 nt, Homo sapiens
ucaaacuccugaccuca

SEQ ID NO: 981356 - RNA, 17 nt, Homo sapiens
ucaagaucccauuugaa

SEQ ID NO: 981357 - RNA, 22 nt, Homo sapiens
ucaagcaauucuccugccucag

SEQ ID NO: 981358 - RNA, 14 nt, Homo sapiens
ucacaccaccugac

SEQ ID NO: 981359 - RNA, 18 nt, Homo sapiens
ucaccagcagacacugcc

SEQ ID NO: 981360 - RNA, 20 nt, Homo sapiens
ucacugagaaaggcucaauu

SEQ ID NO: 981361 - RNA, 13 nt, Homo sapiens
ucacuucucugau

SEQ ID NO: 981362 - RNA, 19 nt, Homo sapiens
ucacuugaauccauugaaa

SEQ ID NO: 981363 - RNA, 17 nt, Homo sapiens
ucagcagguuccagugc

SEQ ID NO: 981364 - RNA, 19 nt, Homo sapiens
ucagcagguuccagugccu

SEQ ID NO: 981365 - RNA, 20 nt, Homo sapiens
ucagcagguuccagugccug

SEQ ID NO: 981366 - RNA, 21 nt, Homo sapiens
ucagccagcccguguguauaa

SEQ ID NO: 981367 - RNA, 16 nt, Homo sapiens
ucaggaugagaacaca

SEQ ID NO: 981368 - RNA, 20 nt, Homo sapiens
ucaggguaagcugcucugag

SEQ ID NO: 981369 - RNA, 17 nt, Homo sapiens
ucauaaguuucugagau

SEQ ID NO: 981370 - RNA, 19 nt, Homo sapiens
ucauaauuuaaaaagucaa

SEQ ID NO: 981371 - RNA, 15 nt, Homo sapiens
ucaucuucacugcac

SEQ ID NO: 981372 - RNA, 20 nt, Homo sapiens
ucauggacuccaggauccuc

SEQ ID NO: 981373 - RNA, 18 nt, Homo sapiens
ucauuugucuuugaacgu

SEQ ID NO: 981374 - RNA, 20 nt, Homo sapiens
uccacauccccaccuuccaa

SEQ ID NO: 981375 - RNA, 14 nt, Homo sapiens
uccacccugcccug

SEQ ID NO: 981376 - RNA, 22 nt, Homo sapiens
uccagccugggugacagagcaa

SEQ ID NO: 981377 - RNA, 17 nt, Homo sapiens
uccaggagaccuuccac

SEQ ID NO: 981378 - RNA, 19 nt, Homo sapiens
uccaggagaccuuccacaa

SEQ ID NO: 981379 - RNA, 17 nt, Homo sapiens
ucccaaagugcuggaac

SEQ ID NO: 981380 - RNA, 16 nt, Homo sapiens
ucccaaagugcuggga

SEQ ID NO: 981381 - RNA, 17 nt, Homo sapiens
ucccauucaagauuccc

SEQ ID NO: 981382 - RNA, 14 nt, Homo sapiens
uccccaccuuccaa

SEQ ID NO: 981383 - RNA, 18 nt, Homo sapiens
uccccagcccccacccau

SEQ ID NO: 981384 - RNA, 16 nt, Homo sapiens
ucccccagcuuuccau

SEQ ID NO: 981385 - RNA, 21 nt, Homo sapiens
uccccggagccggcacugcau

SEQ ID NO: 981386 - RNA, 17 nt, Homo sapiens
ucccgggggcacugccu

SEQ ID NO: 981387 - RNA, 15 nt, Homo sapiens
ucccuaauucugccu

SEQ ID NO: 981388 - RNA, 15 nt, Homo sapiens
ucccuccucacuugc

SEQ ID NO: 981389 - RNA, 15 nt, Homo sapiens
uccuaaagaccucca

SEQ ID NO: 981390 - RNA, 21 nt, Homo sapiens
uccucagcugccaagcacucg

SEQ ID NO: 981391 - RNA, 16 nt, Homo sapiens
uccuccacucacucca

SEQ ID NO: 981392 - RNA, 21 nt, Homo sapiens
uccuuccaagaagaccaugau

SEQ ID NO: 981393 - RNA, 11 nt, Homo sapiens
ucgcucugagc

SEQ ID NO: 981394 - RNA, 17 nt, Homo sapiens
ucgggcuggugucuuga

SEQ ID NO: 981395 - RNA, 16 nt, Homo sapiens
ucuaauguaugcauuc

SEQ ID NO: 981396 - RNA, 21 nt, Homo sapiens
ucucagcucaucuucacugca

SEQ ID NO: 981397 - RNA, 16 nt, Homo sapiens
ucucggcucacugcaa

SEQ ID NO: 981398 - RNA, 17 nt, Homo sapiens
ucugacccauguucacg

SEQ ID NO: 981399 - RNA, 13 nt, Homo sapiens
ucugagggucuga

SEQ ID NO: 981400 - RNA, 20 nt, Homo sapiens
ucugcagccuccucugugac

SEQ ID NO: 981401 - RNA, 15 nt, Homo sapiens
ucuuggcucacugca

SEQ ID NO: 981402 - RNA, 12 nt, Homo sapiens
ucuuuugcaauu

SEQ ID NO: 981403 - RNA, 18 nt, Homo sapiens
ugaaccacccaugugagg

SEQ ID NO: 981404 - RNA, 17 nt, Homo sapiens
ugaacuccauugcuuaa

SEQ ID NO: 981405 - RNA, 18 nt, Homo sapiens
ugaacuggcuuguacauu

SEQ ID NO: 981406 - RNA, 19 nt, Homo sapiens
ugaccuaguaaacuuugua

SEQ ID NO: 981407 - RNA, 21 nt, Homo sapiens
ugaccucagcugcacauuccu

SEQ ID NO: 981408 - RNA, 17 nt, Homo sapiens
ugaccucaucacugaga

SEQ ID NO: 981409 - RNA, 20 nt, Homo sapiens
ugacgcgagaggcucugagg

SEQ ID NO: 981410 - RNA, 20 nt, Homo sapiens
ugacuaaaccauugugcauu

SEQ ID NO: 981411 - RNA, 14 nt, Homo sapiens
ugagaacacacuga

SEQ ID NO: 981412 - RNA, 15 nt, Homo sapiens
ugaggaccaaagaua

SEQ ID NO: 981413 - RNA, 21 nt, Homo sapiens
ugaggcaggagaauggcguga

SEQ ID NO: 981414 - RNA, 14 nt, Homo sapiens
ugagggguauccuc

SEQ ID NO: 981415 - RNA, 13 nt, Homo sapiens
ugaguuagcuuuc

SEQ ID NO: 981416 - RNA, 16 nt, Homo sapiens
ugauacgacagcucuc

SEQ ID NO: 981417 - RNA, 22 nt, Homo sapiens
ugaugaccaaguuuucuggaag

SEQ ID NO: 981418 - RNA, 15 nt, Homo sapiens
ugauucaggcuucca

SEQ ID NO: 981419 - RNA, 13 nt, Homo sapiens
ugcaaccucuacc

SEQ ID NO: 981420 - RNA, 15 nt, Homo sapiens
ugcacaggcagcaag

SEQ ID NO: 981421 - RNA, 17 nt, Homo sapiens
ugcaggacaaacagacg

SEQ ID NO: 981422 - RNA, 16 nt, Homo sapiens
ugcauacauucuucaa

SEQ ID NO: 981423 - RNA, 15 nt, Homo sapiens
ugcauauaugauggu

SEQ ID NO: 981424 - RNA, 18 nt, Homo sapiens
cgauggggcccacauuag

SEQ ID NO: 981425 - RNA, 23 nt, Homo sapiens
cgggauccccagccuacugccuc

SEQ ID NO: 981426 - RNA, 22 nt, Homo sapiens
cggggaggaaagcaaaauccaa

SEQ ID NO: 981427 - RNA, 15 nt, Homo sapiens
cgggggcacugccug

SEQ ID NO: 981428 - RNA, 15 nt, Homo sapiens
cuaaaacagacucaa

SEQ ID NO: 981429 - RNA, 22 nt, Homo sapiens
cuaaaggaauuucuaaggacau

SEQ ID NO: 981430 - RNA, 22 nt, Homo sapiens
cuaauguaugcauucauccaac

SEQ ID NO: 981431 - RNA, 18 nt, Homo sapiens
cuacaugggccagcccuu

SEQ ID NO: 981432 - RNA, 21 nt, Homo sapiens
cuacuuuauggcagacauugu

SEQ ID NO: 981433 - RNA, 19 nt, Homo sapiens
cuagacgcccccaaauccu

SEQ ID NO: 981434 - RNA, 22 nt, Homo sapiens
cuaggaaaagggauacuuugau

SEQ ID NO: 981435 - RNA, 14 nt, Homo sapiens
cucaagugaucugc

SEQ ID NO: 981436 - RNA, 16 nt, Homo sapiens
cucaauaaagaagccc

SEQ ID NO: 981437 - RNA, 21 nt, Homo sapiens
cucacccccaccucaagguca

SEQ ID NO: 981438 - RNA, 15 nt, Homo sapiens
cucagcccauccccu

SEQ ID NO: 981439 - RNA, 15 nt, Homo sapiens
cucagcucaucuuca

SEQ ID NO: 981440 - RNA, 23 nt, Homo sapiens
cuccauggccaccccgugccacc

SEQ ID NO: 981441 - RNA, 17 nt, Homo sapiens
cuccaugucuaugcucc

SEQ ID NO: 981442 - RNA, 19 nt, Homo sapiens
cucccgggggcacugccug

SEQ ID NO: 981443 - RNA, 23 nt, Homo sapiens
cuccucagccucccuuugccagc

SEQ ID NO: 981444 - RNA, 14 nt, Homo sapiens
cuccugaacccuau

SEQ ID NO: 981445 - RNA, 13 nt, Homo sapiens
cuccugaccucaa

SEQ ID NO: 981446 - RNA, 23 nt, Homo sapiens
cuccuguugccacacuuucacug

SEQ ID NO: 981447 - RNA, 19 nt, Homo sapiens
cucuccuagcccuccugag

SEQ ID NO: 981448 - RNA, 21 nt, Homo sapiens
cucuccuagcccuccugaggg

SEQ ID NO: 981449 - RNA, 19 nt, Homo sapiens
cugaaaaucuggugcucaa

SEQ ID NO: 981450 - RNA, 14 nt, Homo sapiens
cugacccauguuca

SEQ ID NO: 981451 - RNA, 14 nt, Homo sapiens
cugagaaaggcuca

SEQ ID NO: 981452 - RNA, 14 nt, Homo sapiens
cugauggugucauc

SEQ ID NO: 981453 - RNA, 22 nt, Homo sapiens
cugcacccuggauuugcauaca

SEQ ID NO: 981454 - RNA, 17 nt, Homo sapiens
cugcagccuccucugug

SEQ ID NO: 981455 - RNA, 18 nt, Homo sapiens
cugcauguuccuggacac

SEQ ID NO: 981456 - RNA, 16 nt, Homo sapiens
cugcccugcugagcac

SEQ ID NO: 981457 - RNA, 21 nt, Homo sapiens
cugcuuccuccccuccuggca

SEQ ID NO: 981458 - RNA, 22 nt, Homo sapiens
cuggagauggaaaaucacacca

SEQ ID NO: 981459 - RNA, 19 nt, Homo sapiens
cuggauuugcauacauucu

SEQ ID NO: 981460 - RNA, 20 nt, Homo sapiens
cuggauuugcauacauucuu

SEQ ID NO: 981461 - RNA, 12 nt, Homo sapiens
cuggcacccacu

SEQ ID NO: 981462 - RNA, 20 nt, Homo sapiens
cuggccccgggcucuggcca

SEQ ID NO: 981463 - RNA, 19 nt, Homo sapiens
cugggugacagagcaagac

SEQ ID NO: 981464 - RNA, 16 nt, Homo sapiens
cuggguucccuaggcc

SEQ ID NO: 981465 - RNA, 14 nt, Homo sapiens
cuguaauuaguuua

SEQ ID NO: 981466 - RNA, 18 nt, Homo sapiens
cugucauacuuuguuagg

SEQ ID NO: 981467 - RNA, 19 nt, Homo sapiens
cuguggggcugagcaacau

SEQ ID NO: 981468 - RNA, 11 nt, Homo sapiens
cuguugccaca

SEQ ID NO: 981469 - RNA, 20 nt, Homo sapiens
cuguuuucugggccagugag

SEQ ID NO: 981470 - RNA, 18 nt, Homo sapiens
cuuauauuguucacuucu

SEQ ID NO: 981471 - RNA, 19 nt, Homo sapiens
cuuauccuguuuucaugga

SEQ ID NO: 981472 - RNA, 13 nt, Homo sapiens
cuucauagaaacu

SEQ ID NO: 981473 - RNA, 16 nt, Homo sapiens
cuuccaaggaaaagca

SEQ ID NO: 981474 - RNA, 11 nt, Homo sapiens
cuuccauguca

SEQ ID NO: 981475 - RNA, 18 nt, Homo sapiens
cuucucugggcccagaga

SEQ ID NO: 981476 - RNA, 23 nt, Homo sapiens
cuugcccgccagccucagugcca

SEQ ID NO: 981477 - RNA, 14 nt, Homo sapiens
cuugcucuaccugg

SEQ ID NO: 981478 - RNA, 15 nt, Homo sapiens
cuugucuccauuugg

SEQ ID NO: 981479 - RNA, 12 nt, Homo sapiens
cuugucuucuag

SEQ ID NO: 981480 - RNA, 12 nt, Homo sapiens
cuuuccagccua

SEQ ID NO: 981481 - RNA, 18 nt, Homo sapiens
cuuucccugcauaugcuu

SEQ ID NO: 981482 - RNA, 13 nt, Homo sapiens
cuuugacaugacu

SEQ ID NO: 981483 - RNA, 18 nt, Homo sapiens
cuuugacaugacugcaau

SEQ ID NO: 981484 - RNA, 19 nt, Homo sapiens
cuuuucugacccauguuca

SEQ ID NO: 981485 - RNA, 19 nt, Homo sapiens
cuuuuucucugcuuccagu

SEQ ID NO: 981486 - RNA, 17 nt, Homo sapiens
gaaaccauccucucccu

SEQ ID NO: 981487 - RNA, 17 nt, Homo sapiens
gaaacccuccuucugug

SEQ ID NO: 981488 - RNA, 16 nt, Homo sapiens
gaaacugcuuugacau

SEQ ID NO: 981489 - RNA, 20 nt, Homo sapiens
gaaacugcuuugacaugacu

SEQ ID NO: 981490 - RNA, 16 nt, Homo sapiens
gaaaugugucuugucu

SEQ ID NO: 981491 - RNA, 19 nt, Homo sapiens
gaagcccaguaacugcccu

SEQ ID NO: 981492 - RNA, 19 nt, Homo sapiens
gaaguguaguggcauccau

SEQ ID NO: 981493 - RNA, 14 nt, Homo sapiens
gaauaaucacuugg

SEQ ID NO: 981494 - RNA, 13 nt, Homo sapiens
gacaacaaggccc

SEQ ID NO: 981495 - RNA, 13 nt, Homo sapiens
gacaacuuccucu

SEQ ID NO: 981496 - RNA, 16 nt, Homo sapiens
gacagcaaagucucca

SEQ ID NO: 981497 - RNA, 16 nt, Homo sapiens
gaccugaaggaccucc

SEQ ID NO: 981498 - RNA, 15 nt, Homo sapiens
gacgcuguccauugc

SEQ ID NO: 981499 - RNA, 16 nt, Homo sapiens
gacugcaaucaugugc

SEQ ID NO: 981500 - RNA, 23 nt, Homo sapiens
gacuguucuauagcagucaucau

SEQ ID NO: 981501 - RNA, 12 nt, Homo sapiens
gagaccuuccac

SEQ ID NO: 981502 - RNA, 18 nt, Homo sapiens
gaggauccccugagguca

SEQ ID NO: 981503 - RNA, 15 nt, Homo sapiens
gagguggacaguccu

SEQ ID NO: 981504 - RNA, 16 nt, Homo sapiens
gagucagucaugucac

SEQ ID NO: 981505 - RNA, 13 nt, Homo sapiens
gagucauggucag

SEQ ID NO: 981506 - RNA, 17 nt, Homo sapiens
gaguugauucaugugcu

SEQ ID NO: 981507 - RNA, 24 nt, Homo sapiens
gauaauuaaggccagaggcccauu

SEQ ID NO: 981508 - RNA, 14 nt, Homo sapiens
gaucagaugucuau

SEQ ID NO: 981509 - RNA, 20 nt, Homo sapiens
gauccccagccuacugccuc

SEQ ID NO: 981510 - RNA, 20 nt, Homo sapiens
gaugauaauacccacauuac

SEQ ID NO: 981511 - RNA, 23 nt, Homo sapiens
gauguagguuauuaugauuagcu

SEQ ID NO: 981512 - RNA, 20 nt, Homo sapiens
gauguagucuuacucuguca

SEQ ID NO: 981513 - RNA, 13 nt, Homo sapiens
gauuagcuuuguc

SEQ ID NO: 981514 - RNA, 12 nt, Homo sapiens
gcaaagucucca

SEQ ID NO: 981515 - RNA, 20 nt, Homo sapiens
gcaacaaguagagaugaagu

SEQ ID NO: 981516 - RNA, 14 nt, Homo sapiens
gcacagcaucucag

SEQ ID NO: 981517 - RNA, 16 nt, Homo sapiens
gcacuccauggccacc

SEQ ID NO: 981518 - RNA, 15 nt, Homo sapiens
gcacugcauguuccu

SEQ ID NO: 981519 - RNA, 19 nt, Homo sapiens
gcagugccaggaacccuua

SEQ ID NO: 981520 - RNA, 15 nt, Homo sapiens
gcauggccgcgucac

SEQ ID NO: 981521 - RNA, 16 nt, Homo sapiens
gcaugugccuguauuc

SEQ ID NO: 981522 - RNA, 17 nt, Homo sapiens
gcauucuagagugcaua

SEQ ID NO: 981523 - RNA, 23 nt, Homo sapiens
gcauucuagagugcauauauuua

SEQ ID NO: 981524 - RNA, 17 nt, Homo sapiens
gcauuuucugcaucucc

SEQ ID NO: 981525 - RNA, 22 nt, Homo sapiens
gccacaagaauaagcagcaaau

SEQ ID NO: 981526 - RNA, 14 nt, Homo sapiens
gccacuugacauuc

SEQ ID NO: 981527 - RNA, 16 nt, Homo sapiens
gccacuugacauuccu

SEQ ID NO: 981528 - RNA, 17 nt, Homo sapiens
gccagaaauugauuaag

SEQ ID NO: 981529 - RNA, 15 nt, Homo sapiens
gccaggcugaucuca

SEQ ID NO: 981530 - RNA, 18 nt, Homo sapiens
gccagggcucagaugggg

SEQ ID NO: 981531 - RNA, 16 nt, Homo sapiens
gcccagcuacauuccu

SEQ ID NO: 981532 - RNA, 22 nt, Homo sapiens
gcccuccugagggguauccucc

SEQ ID NO: 981533 - RNA, 18 nt, Homo sapiens
gcccugacccccaucgcu

SEQ ID NO: 981534 - RNA, 18 nt, Homo sapiens
gcccugccucacugugac

SEQ ID NO: 981535 - RNA, 12 nt, Homo sapiens
gccuggcccuug

SEQ ID NO: 981536 - RNA, 21 nt, Homo sapiens
gccuguaaucccagcacuuug

SEQ ID NO: 981537 - RNA, 21 nt, Homo sapiens
gccuucacccuguggagucac

SEQ ID NO: 981538 - RNA, 22 nt, Homo sapiens
gccuucugggccuccaaagccc

SEQ ID NO: 981539 - RNA, 14 nt, Homo sapiens
gcgucuccccaugc

SEQ ID NO: 981540 - RNA, 13 nt, Homo sapiens
gccagccucagug

SEQ ID NO: 981541 - RNA, 22 nt, Homo sapiens
gcccaagcugggcucccuuuaa

SEQ ID NO: 981542 - RNA, 20 nt, Homo sapiens
gcccauuccucccauucaag

SEQ ID NO: 981543 - RNA, 17 nt, Homo sapiens
gcccccaaauccuugag

SEQ ID NO: 981544 - RNA, 20 nt, Homo sapiens
gcccuagugagggcagaaga

SEQ ID NO: 981545 - RNA, 23 nt, Homo sapiens
gcccugacccccaucgcucugag

SEQ ID NO: 981546 - RNA, 17 nt, Homo sapiens
gccgugcagcugggauu

SEQ ID NO: 981547 - RNA, 16 nt, Homo sapiens
gccucuccagcacuuc

SEQ ID NO: 981548 - RNA, 19 nt, Homo sapiens
gccugggcuccucugcauc

SEQ ID NO: 981549 - RNA, 16 nt, Homo sapiens
gcgccuccacccugcc

SEQ ID NO: 981550 - RNA, 21 nt, Homo sapiens
gcguguccaggagaccuucca

SEQ ID NO: 981551 - RNA, 17 nt, Homo sapiens
gcuacauuccucagcug

SEQ ID NO: 981552 - RNA, 15 nt, Homo sapiens
gcucaauuuggugcu

SEQ ID NO: 981553 - RNA, 14 nt, Homo sapiens
gcucacuacauggg

SEQ ID NO: 981554 - RNA, 16 nt, Homo sapiens
gcucacuacaugggcc

SEQ ID NO: 981555 - RNA, 23 nt, Homo sapiens
gcugaaguguuuuugugcagcug

SEQ ID NO: 981556 - RNA, 17 nt, Homo sapiens
gcugguuuuucauuucc

SEQ ID NO: 981557 - RNA, 23 nt, Homo sapiens
gcuuauccuguuuucauggacag

SEQ ID NO: 981558 - RNA, 13 nt, Homo sapiens
gcuuaugucauag

SEQ ID NO: 981559 - RNA, 18 nt, Homo sapiens
gcuucuccuuggcugaga

SEQ ID NO: 981560 - RNA, 19 nt, Homo sapiens
gcuucugauggugucaucu

SEQ ID NO: 981561 - RNA, 13 nt, Homo sapiens
ggacaccacccag

SEQ ID NO: 981562 - RNA, 21 nt, Homo sapiens
ggacagagugcccuggggcau

SEQ ID NO: 981563 - RNA, 22 nt, Homo sapiens
ggacagcguguggcaguguuua

SEQ ID NO: 981564 - RNA, 22 nt, Homo sapiens
ggaccuucuauccucuguauuu

SEQ ID NO: 981565 - RNA, 16 nt, Homo sapiens
ggagcuugcaaugagc

SEQ ID NO: 981566 - RNA, 17 nt, Homo sapiens
ggaggacagagugcccu

SEQ ID NO: 981567 - RNA, 21 nt, Homo sapiens
ggaguggaggggcauagccuu

SEQ ID NO: 981568 - RNA, 11 nt, Homo sapiens
ggcacugccug

SEQ ID NO: 981569 - RNA, 12 nt, Homo sapiens
ggcacugccuga

SEQ ID NO: 981570 - RNA, 14 nt, Homo sapiens
ggcagacauugugc

SEQ ID NO: 981571 - RNA, 19 nt, Homo sapiens
ggcagcaaggucauggucu

SEQ ID NO: 981572 - RNA, 21 nt, Homo sapiens
ggcagcaaggucauggucuga

SEQ ID NO: 981573 - RNA, 19 nt, Homo sapiens
ggcaguuggggcggcccac

SEQ ID NO: 981574 - RNA, 16 nt, Homo sapiens
ggccaagagaugcagu

SEQ ID NO: 981575 - RNA, 18 nt, Homo sapiens
ggccucauccaaacugua

SEQ ID NO: 981576 - RNA, 17 nt, Homo sapiens
ggccugagccacugugc

SEQ ID NO: 981577 - RNA, 16 nt, Homo sapiens
ggccuucugauuucaa

SEQ ID NO: 981578 - RNA, 22 nt, Homo sapiens
ggcguggugggauuugcuccug

SEQ ID NO: 981579 - RNA, 15 nt, Homo sapiens
ggcucagauggggcc

SEQ ID NO: 981580 - RNA, 19 nt, Homo sapiens
ggcuccucugcaucuugcu

SEQ ID NO: 981581 - RNA, 13 nt, Homo sapiens
ggcugcuggcgcc

SEQ ID NO: 981582 - RNA, 19 nt, Homo sapiens
ggcuuaaugaaggucauaa

SEQ ID NO: 981583 - RNA, 12 nt, Homo sapiens
gggaggcccaau

SEQ ID NO: 981584 - RNA, 19 nt, Homo sapiens
gggagucagucaugucacu

SEQ ID NO: 981585 - RNA, 14 nt, Homo sapiens
gggcauagccuuuc

SEQ ID NO: 981586 - RNA, 20 nt, Homo sapiens
gggcucacuacaugggccag

SEQ ID NO: 981587 - RNA, 15 nt, Homo sapiens
gggcuggagaccaga

SEQ ID NO: 981588 - RNA, 23 nt, Homo sapiens
gguaccuucccccagcuuuccau

SEQ ID NO: 981589 - RNA, 23 nt, Homo sapiens
gguauaguuuugucacaauuaua

SEQ ID NO: 981590 - RNA, 14 nt, Homo sapiens
gguggagcuugcaa

SEQ ID NO: 981591 - RNA, 21 nt, Homo sapiens
gguggggagucagucauguca

SEQ ID NO: 981592 - RNA, 17 nt, Homo sapiens
gguugggaccaggccaa

SEQ ID NO: 981593 - RNA, 14 nt, Homo sapiens
guaagcugcucuga

SEQ ID NO: 981594 - RNA, 15 nt, Homo sapiens
guagaagcaaaggca

SEQ ID NO: 981595 - RNA, 20 nt, Homo sapiens
guagguuauuaugauuagcu

SEQ ID NO: 981596 - RNA, 17 nt, Homo sapiens
guaguggcauccauuuc

SEQ ID NO: 981597 - RNA, 22 nt, Homo sapiens
guaugaccuaguaaacuuugua

SEQ ID NO: 981598 - RNA, 16 nt, Homo sapiens
gucaaaaugaacucca

SEQ ID NO: 981599 - RNA, 13 nt, Homo sapiens
gucaggaugagaa

SEQ ID NO: 981600 - RNA, 19 nt, Homo sapiens
gucagucaugucacugaaa

SEQ ID NO: 981601 - RNA, 16 nt, Homo sapiens
gucauuccucuccuag

SEQ ID NO: 981602 - RNA, 23 nt, Homo sapiens
gucauuccucuccuagcccuccu

SEQ ID NO: 981603 - RNA, 13 nt, Homo sapiens
gucccaccaacuc

SEQ ID NO: 981604 - RNA, 14 nt, Homo sapiens
gugaggacaaggua

SEQ ID NO: 981605 - RNA, 18 nt, Homo sapiens
gugcaauggcaccaucuu

SEQ ID NO: 981606 - RNA, 14 nt, Homo sapiens
gugccuaccuggcc

SEQ ID NO: 981607 - RNA, 12 nt, Homo sapiens
gugcggggcccc

SEQ ID NO: 981608 - RNA, 11 nt, Homo sapiens
guggaaccagu

SEQ ID NO: 981609 - RNA, 20 nt, Homo sapiens
guguccaggagaccuuccac

SEQ ID NO: 981610 - RNA, 20 nt, Homo sapiens
gugugacagucuugcauucu

SEQ ID NO: 981611 - RNA, 15 nt, Homo sapiens
gugugucaaugccac

SEQ ID NO: 981612 - RNA, 22 nt, Homo sapiens
guucacguuguucacaucccau

SEQ ID NO: 981613 - RNA, 21 nt, Homo sapiens
guucccccucccugugugaaa

SEQ ID NO: 981614 - RNA, 16 nt, Homo sapiens
guucuauagcagucau

SEQ ID NO: 981615 - RNA, 18 nt, Homo sapiens
guuuacauaauacuugaa

SEQ ID NO: 981616 - RNA, 21 nt, Homo sapiens
guuuauacaguguacauguac

SEQ ID NO: 981617 - RNA, 20 nt, Homo sapiens
uaaaaucacccugacugugg

SEQ ID NO: 981618 - RNA, 20 nt, Homo sapiens
uaaacaauaaaaguguccau

SEQ ID NO: 981619 - RNA, 13 nt, Homo sapiens
uaaagguccauga

SEQ ID NO: 981620 - RNA, 15 nt, Homo sapiens
uaacagugugcucau

SEQ ID NO: 981621 - RNA, 19 nt, Homo sapiens
uaagccaagagagccucuu

SEQ ID NO: 981622 - RNA, 15 nt, Homo sapiens
uaaguaauaugcuua

SEQ ID NO: 981623 - RNA, 21 nt, Homo sapiens
uaauaugcuuauauuguucac

SEQ ID NO: 981624 - RNA, 14 nt, Homo sapiens
uaauuguacaauac

SEQ ID NO: 981625 - RNA, 20 nt, Homo sapiens
uacaggaugguuacugagga

SEQ ID NO: 981626 - RNA, 12 nt, Homo sapiens
uacaggcaccca

SEQ ID NO: 981627 - RNA, 13 nt, Homo sapiens
uacauaacuaaua

SEQ ID NO: 981628 - RNA, 15 nt, Homo sapiens
uacauuccucagcug

SEQ ID NO: 981629 - RNA, 19 nt, Homo sapiens
uacauuccucagcugccaa

SEQ ID NO: 981630 - RNA, 23 nt, Homo sapiens
uacccucccagcgaguugcgcug

SEQ ID NO: 981631 - RNA, 13 nt, Homo sapiens
uacccuuccugcc

SEQ ID NO: 981632 - RNA, 21 nt, Homo sapiens
uacgacagcucucugugcacu

SEQ ID NO: 981633 - RNA, 17 nt, Homo sapiens
uacuacccgagcccagc

SEQ ID NO: 981634 - RNA, 14 nt, Homo sapiens
uacugaaaaucugg

SEQ ID NO: 981635 - RNA, 16 nt, Homo sapiens
uacugaaaaucuggug

SEQ ID NO: 981636 - RNA, 19 nt, Homo sapiens
uagaauuccucuuuggcca

SEQ ID NO: 981637 - RNA, 12 nt, Homo sapiens
uagagacauccu

SEQ ID NO: 981638 - RNA, 15 nt, Homo sapiens
uagauaauauaccgu

SEQ ID NO: 981639 - RNA, 13 nt, Homo sapiens
uagcuuaguucuc

SEQ ID NO: 981640 - RNA, 16 nt, Homo sapiens
uguuuucuacugcuau

SEQ ID NO: 981641 - RNA, 17 nt, Homo sapiens
uuaaacaguugcacagc

SEQ ID NO: 981642 - RNA, 14 nt, Homo sapiens
uuaaagguauuuau

SEQ ID NO: 981643 - RNA, 12 nt, Homo sapiens
uuaaaucacuug

SEQ ID NO: 981644 - RNA, 20 nt, Homo sapiens
uuacauaauacuugaaaaau

SEQ ID NO: 981645 - RNA, 14 nt, Homo sapiens
uuacuugacagggu

SEQ ID NO: 981646 - RNA, 20 nt, Homo sapiens
uuagcauuuucugcaucucc

SEQ ID NO: 981647 - RNA, 18 nt, Homo sapiens
uuaguuccugugcacagc

SEQ ID NO: 981648 - RNA, 14 nt, Homo sapiens
uuaugaguuagcuu

SEQ ID NO: 981649 - RNA, 13 nt, Homo sapiens
uuauuaugauuag

SEQ ID NO: 981650 - RNA, 22 nt, Homo sapiens
uucaagcaaaucuccugccuca

SEQ ID NO: 981651 - RNA, 18 nt, Homo sapiens
uucuaauguaugcauuca

SEQ ID NO: 981652 - RNA, 22 nt, Homo sapiens
uucuguggcaacuuguacugaa

SEQ ID NO: 981653 - RNA, 17 nt, Homo sapiens
uucuuaggcacuucuua

SEQ ID NO: 981654 - RNA, 19 nt, Homo sapiens
uugagauguagucuuacuc

SEQ ID NO: 981655 - RNA, 15 nt, Homo sapiens
uugcacagcaucuca

SEQ ID NO: 981656 - RNA, 16 nt, Homo sapiens
uugcauaugcauccca

SEQ ID NO: 981657 - RNA, 14 nt, Homo sapiens
uuguaaauguacug

SEQ ID NO: 981658 - RNA, 17 nt, Homo sapiens
uuguaaauguacuggua

SEQ ID NO: 981659 - RNA, 15 nt, Homo sapiens
uuucaccauguuggc

SEQ ID NO: 981660 - RNA, 17 nt, Homo sapiens
uuucaccauguuggcua

SEQ ID NO: 981661 - RNA, 20 nt, Homo sapiens
uuugccagccaccccuccuc

SEQ ID NO: 981662 - RNA, 14 nt, Homo sapiens
uuuggguaccugua

SEQ ID NO: 981663 - RNA, 14 nt, Homo sapiens
uuuuaaauucuuac

SEQ ID NO: 981664 - RNA, 16 nt, Homo sapiens
uuuuaauaacauaucu

SEQ ID NO: 981665 - RNA, 22 nt, Homo sapiens
uuuugucacaauuauagauuag

SEQ ID NO: 981666 - RNA, 16 nt, Homo sapiens
ucacaccaccugacag

SEQ ID NO: 981667 - RNA, 20 nt, Homo sapiens
ucacccaggcuagagugcaa

SEQ ID NO: 981668 - RNA, 22 nt, Homo sapiens
ucacccggaucccuccucacuu

SEQ ID NO: 981669 - RNA, 16 nt, Homo sapiens
ucacugugaccugcuc

SEQ ID NO: 981670 - RNA, 16 nt, Homo sapiens
ucacuguugccugcau

SEQ ID NO: 981671 - RNA, 17 nt, Homo sapiens
ucacuugaauccauuga

SEQ ID NO: 981672 - RNA, 18 nt, Homo sapiens
ucaggaugagaacacacu

SEQ ID NO: 981673 - RNA, 15 nt, Homo sapiens
ucaggguaagcugcu

SEQ ID NO: 981674 - RNA, 16 nt, Homo sapiens
ucaguaguucacuuua

SEQ ID NO: 981675 - RNA, 21 nt, Homo sapiens
ucagugccacuugacauuccu

SEQ ID NO: 981676 - RNA, 16 nt, Homo sapiens
ucaguuacugaugcuc

SEQ ID NO: 981677 - RNA, 21 nt, Homo sapiens
ucaguuacugaugcuccugaa

SEQ ID NO: 981678 - RNA, 20 nt, Homo sapiens
ucauccaaacuguaucuucc

SEQ ID NO: 981679 - RNA, 13 nt, Homo sapiens
ucaugaacuggcu

SEQ ID NO: 981680 - RNA, 15 nt, Homo sapiens
ucaugacagcaaagu

SEQ ID NO: 981681 - RNA, 20 nt, Homo sapiens
ucauggucugaguggggcuu

SEQ ID NO: 981682 - RNA, 23 nt, Homo sapiens
uccaacagaguuauuuauuggcu

SEQ ID NO: 981683 - RNA, 19 nt, Homo sapiens
uccacauccccaccuucca

SEQ ID NO: 981684 - RNA, 13 nt, Homo sapiens
uccacucacucca

SEQ ID NO: 981685 - RNA, 15 nt, Homo sapiens
uccacucacuccagc

SEQ ID NO: 981686 - RNA, 17 nt, Homo sapiens
uccaucuucccuacccu

SEQ ID NO: 981687 - RNA, 18 nt, Homo sapiens
uccaucuucccuacccuu

SEQ ID NO: 981688 - RNA, 22 nt, Homo sapiens
uccauggccaccccgugccacc

SEQ ID NO: 981689 - RNA, 15 nt, Homo sapiens
ucccaaagugcugga

SEQ ID NO: 981690 - RNA, 15 nt, Homo sapiens
ucccaccgcuuugug

SEQ ID NO: 981691 - RNA, 16 nt, Homo sapiens
ucccccacgugugaag

SEQ ID NO: 981692 - RNA, 20 nt, Homo sapiens
ucccccucccugugugaaau

SEQ ID NO: 981693 - RNA, 12 nt, Homo sapiens
uccccugagguc

SEQ ID NO: 981694 - RNA, 16 nt, Homo sapiens
ucccgaguagcuggaa

SEQ ID NO: 981695 - RNA, 18 nt, Homo sapiens
ucccgggggcacugccug

SEQ ID NO: 981696 - RNA, 21 nt, Homo sapiens
ucccucgggcuggugucuuga

SEQ ID NO: 981697 - RNA, 13 nt, Homo sapiens
uccucacuugccc

SEQ ID NO: 981698 - RNA, 12 nt, Homo sapiens
uccucccauuca

SEQ ID NO: 981699 - RNA, 20 nt, Homo sapiens
uccucgcacagggcaugccu

SEQ ID NO: 981700 - RNA, 19 nt, Homo sapiens
uccucugcaucuugcucug

SEQ ID NO: 981701 - RNA, 16 nt, Homo sapiens
uccucuucuguaaaau

SEQ ID NO: 981702 - RNA, 21 nt, Homo sapiens
uccuucuguggcaacuuguac

SEQ ID NO: 981703 - RNA, 23 nt, Homo sapiens
uccuucuguggcaacuuguacug

SEQ ID NO: 981704 - RNA, 20 nt, Homo sapiens
ucgagguccuccuggccuga

SEQ ID NO: 981705 - RNA, 13 nt, Homo sapiens
ucgcucugagcau

SEQ ID NO: 981706 - RNA, 15 nt, Homo sapiens
ucggcucacugcaac

SEQ ID NO: 981707 - RNA, 19 nt, Homo sapiens
ucguggugugucaaugcca

SEQ ID NO: 981708 - RNA, 21 nt, Homo sapiens
ucuaaaacagacucaaugucc

SEQ ID NO: 981709 - RNA, 22 nt, Homo sapiens
ucuacauuaaaucacuugaauc

SEQ ID NO: 981710 - RNA, 18 nt, Homo sapiens
ucuacugcuaugugucac

SEQ ID NO: 981711 - RNA, 23 nt, Homo sapiens
ucuaggaaaagggauacuuugau

SEQ ID NO: 981712 - RNA, 20 nt, Homo sapiens
ucucaaacuccugaccucaa

SEQ ID NO: 981713 - RNA, 20 nt, Homo sapiens
ucuccccaugcugggcucac

SEQ ID NO: 981714 - RNA, 16 nt, Homo sapiens
ucucugggcccagaga

SEQ ID NO: 981715 - RNA, 20 nt, Homo sapiens
ucugaauaaauacccauuga

SEQ ID NO: 981716 - RNA, 21 nt, Homo sapiens
ucugagcauauguuccaugcc

SEQ ID NO: 981717 - RNA, 22 nt, Homo sapiens
ucugcagccuccucugugacuc

SEQ ID NO: 981718 - RNA, 22 nt, Homo sapiens
ucuggagcaaccuacugucuaa

SEQ ID NO: 981719 - RNA, 20 nt, Homo sapiens
ucuguggcaacuuguacuga

SEQ ID NO: 981720 - RNA, 20 nt, Homo sapiens
ucuguggggcugagcaacau

SEQ ID NO: 981721 - RNA, 12 nt, Homo sapiens
ucuguuccacau

SEQ ID NO: 981722 - RNA, 21 nt, Homo sapiens
ucuucaagaucccauuugaau

SEQ ID NO: 981723 - RNA, 22 nt, Homo sapiens
ucuugagaccagccugccaggc

SEQ ID NO: 981724 - RNA, 14 nt, Homo sapiens
ucuuguuuugccaa

SEQ ID NO: 981725 - RNA, 19 nt, Homo sapiens
ugaaguguaguggcaucca

SEQ ID NO: 981726 - RNA, 15 nt, Homo sapiens
ugaauugggggaguc

SEQ ID NO: 981727 - RNA, 20 nt, Homo sapiens
ugacccccaucgcucugagc

SEQ ID NO: 981728 - RNA, 20 nt, Homo sapiens
ugaccucaagugaucugccc

SEQ ID NO: 981729 - RNA, 12 nt, Homo sapiens
ugaccucagcug

SEQ ID NO: 981730 - RNA, 12 nt, Homo sapiens
ugaccuuuccag

SEQ ID NO: 981731 - RNA, 21 nt, Homo sapiens
ugacugcaaucaugugcuuca

SEQ ID NO: 981732 - RNA, 19 nt, Homo sapiens
ugagauguggguauagcuc

SEQ ID NO: 981733 - RNA, 18 nt, Homo sapiens
ugagcauauguuccaugc

SEQ ID NO: 981734 - RNA, 13 nt, Homo sapiens
ugagccacugugc

SEQ ID NO: 981735 - RNA, 20 nt, Homo sapiens
ugagcccucccucuucccag

SEQ ID NO: 981736 - RNA, 19 nt, Homo sapiens
ugagggucugaaaagggca

SEQ ID NO: 981737 - RNA, 16 nt, Homo sapiens
ugagguggcucaugcc

SEQ ID NO: 981738 - RNA, 17 nt, Homo sapiens
ugauagaacuguacugu

SEQ ID NO: 981739 - RNA, 21 nt, Homo sapiens
ugauccauuaaguaaacaaua

SEQ ID NO: 981740 - RNA, 17 nt, Homo sapiens
ugcaaccuccgccuccc

SEQ ID NO: 981741 - RNA, 21 nt, Homo sapiens
ugcaauggcaccaucuuggcu

SEQ ID NO: 981742 - RNA, 19 nt, Homo sapiens
ugcaauuggaauaaucacu

SEQ ID NO: 981743 - RNA, 10 nt, Homo sapiens
ugcacuccau

SEQ ID NO: 981744 - RNA, 19 nt, Homo sapiens
ugcagccuccucugugacu

SEQ ID NO: 981745 - RNA, 18 nt, Homo sapiens
ugcauuuuuacuugacag

SEQ ID NO: 981746 - RNA, 12 nt, Homo sapiens
ugccaagccagg

SEQ ID NO: 981747 - RNA, 20 nt, Homo sapiens
ugccagccaccccuccucua

SEQ ID NO: 981748 - RNA, 19 nt, Homo sapiens
ugcccagccuauacuuccc

SEQ ID NO: 981749 - RNA, 19 nt, Homo sapiens
ugccucagccuccaaagua

SEQ ID NO: 981750 - RNA, 21 nt, Homo sapiens
ugccuuuuaguuccugugcac

SEQ ID NO: 981751 - RNA, 20 nt, Homo sapiens
ugcggaaaugugucuugucu

SEQ ID NO: 981752 - RNA, 16 nt, Homo sapiens
ugcgucccugcucagc

SEQ ID NO: 981753 - RNA, 23 nt, Homo sapiens
ugcucccagccccuaccuugaga

SEQ ID NO: 981754 - RNA, 14 nt, Homo sapiens
ugcucccucugugu

SEQ ID NO: 981755 - RNA, 18 nt, Homo sapiens
ugcuguguaugugaacca

SEQ ID NO: 981756 - RNA, 21 nt, Homo sapiens
ugcuguugauaauaucucuca

SEQ ID NO: 981757 - RNA, 15 nt, Homo sapiens
ugcuucugauggugu

SEQ ID NO: 981758 - RNA, 21 nt, Homo sapiens
uggaaccacaggccugagcca

SEQ ID NO: 981759 - RNA, 14 nt, Homo sapiens
uggaaguuuccuca

SEQ ID NO: 981760 - RNA, 17 nt, Homo sapiens
uggagcaaccuacuguc

SEQ ID NO: 981761 - RNA, 19 nt, Homo sapiens
uggcagugcuugugauuca

SEQ ID NO: 981762 - RNA, 16 nt, Homo sapiens
uggccaccugccaggc

SEQ ID NO: 981763 - RNA, 23 nt, Homo sapiens
uggccacugggucucacuccuga

SEQ ID NO: 981764 - RNA, 18 nt, Homo sapiens
uggccccgggcucuggcc

SEQ ID NO: 981765 - RNA, 11 nt, Homo sapiens
uggccuuggcc

SEQ ID NO: 981766 - RNA, 14 nt, Homo sapiens
ugggaccaggccaa

SEQ ID NO: 981767 - RNA, 11 nt, Homo sapiens
aaaagggauac

SEQ ID NO: 981768 - RNA, 14 nt, Homo sapiens
aaaaggugaaucua

SEQ ID NO: 981769 - RNA, 11 nt, Homo sapiens
aaacaaugcca

SEQ ID NO: 981770 - RNA, 17 nt, Homo sapiens
aaacaaugccaucacug

SEQ ID NO: 981771 - RNA, 21 nt, Homo sapiens
aaacaguugcacagcaucuca

SEQ ID NO: 981772 - RNA, 19 nt, Homo sapiens
aaaccauugugcauucuag

SEQ ID NO: 981773 - RNA, 14 nt, Homo sapiens
aaaccuuccauguc

SEQ ID NO: 981774 - RNA, 17 nt, Homo sapiens
aaacuguaucuuccuuu

SEQ ID NO: 981775 - RNA, 12 nt, Homo sapiens
aaagaaauugaa

SEQ ID NO: 981776 - RNA, 14 nt, Homo sapiens
aaagccaacaacca

SEQ ID NO: 981777 - RNA, 12 nt, Homo sapiens
aaagguauuuau

SEQ ID NO: 981778 - RNA, 12 nt, Homo sapiens
aaaucuauuuca

SEQ ID NO: 981779 - RNA, 20 nt, Homo sapiens
aaaugaacuccauugcuuaa

SEQ ID NO: 981780 - RNA, 17 nt, Homo sapiens
aaaugugucuugucucc

SEQ ID NO: 981781 - RNA, 22 nt, Homo sapiens
aacaaccaccaccacaaugaca

SEQ ID NO: 981782 - RNA, 11 nt, Homo sapiens
aacaaugccau

SEQ ID NO: 981783 - RNA, 14 nt, Homo sapiens
aacacacugaguga

SEQ ID NO: 981784 - RNA, 14 nt, Homo sapiens
aacagcuuugugaa

SEQ ID NO: 981785 - RNA, 14 nt, Homo sapiens
aacaguaagggaua

SEQ ID NO: 981786 - RNA, 16 nt, Homo sapiens
aaccauugugcauucu

SEQ ID NO: 981787 - RNA, 18 nt, Homo sapiens
aacccuuaaacaguugca

SEQ ID NO: 981788 - RNA, 24 nt, Homo sapiens
aacuaguggggcuuaaugaagguc

SEQ ID NO: 981789 - RNA, 22 nt, Homo sapiens
aacugagccgugcagcugggau

SEQ ID NO: 981790 - RNA, 16 nt, Homo sapiens
aagcugcucugaggua

SEQ ID NO: 981791 - RNA, 17 nt, Homo sapiens
augaugguggucaucca

SEQ ID NO: 981792 - RNA, 13 nt, Homo sapiens
augauuagcuuug

SEQ ID NO: 981793 - RNA, 18 nt, Homo sapiens
auggucaggggugagacc

SEQ ID NO: 981794 - RNA, 17 nt, Homo sapiens
auggugcccgugccucu

SEQ ID NO: 981795 - RNA, 19 nt, Homo sapiens
auggugucaucugcuccuu

SEQ ID NO: 981796 - RNA, 16 nt, Homo sapiens
auguaccacauaacaa

SEQ ID NO: 981797 - RNA, 13 nt, Homo sapiens
auguaugcauuca

SEQ ID NO: 981798 - RNA, 13 nt, Homo sapiens
auguuuacuguaa

SEQ ID NO: 981799 - RNA, 23 nt, Homo sapiens
auguuucuaaguaauaugcuuau

SEQ ID NO: 981800 - RNA, 14 nt, Homo sapiens
auuaucaccagcag

SEQ ID NO: 981801 - RNA, 13 nt, Homo sapiens
auucaagauuccc

SEQ ID NO: 981802 - RNA, 18 nt, Homo sapiens
auucuagagugcauauau

SEQ ID NO: 981803 - RNA, 15 nt, Homo sapiens
auugacgaacuggcu

SEQ ID NO: 981804 - RNA, 15 nt, Homo sapiens
auuuauuccuuccaa

SEQ ID NO: 981805 - RNA, 14 nt, Homo sapiens
auuuccacuucuuc

SEQ ID NO: 981806 - RNA, 21 nt, Homo sapiens
auuuccacuucuucauucucu

SEQ ID NO: 981807 - RNA, 22 nt, Homo sapiens
auuuccuuuguugucuacauua

SEQ ID NO: 981808 - RNA, 20 nt, Homo sapiens
auuucuaauguaugcauuca

SEQ ID NO: 981809 - RNA, 15 nt, Homo sapiens
auuugcauacauucu

SEQ ID NO: 981810 - RNA, 16 nt, Homo sapiens
auuugcauacauucuu

SEQ ID NO: 981811 - RNA, 16 nt, Homo sapiens
auuuucugcaucucca

SEQ ID NO: 981812 - RNA, 20 nt, Homo sapiens
auuuuugauuaacaauguau

SEQ ID NO: 981813 - RNA, 14 nt, Homo sapiens
caaaaacaagacaa

SEQ ID NO: 981814 - RNA, 14 nt, Homo sapiens
caaaaugaacucca

SEQ ID NO: 981815 - RNA, 16 nt, Homo sapiens
caaaauugaugaucca

SEQ ID NO: 981816 - RNA, 18 nt, Homo sapiens
caaacaaugccaucacug

SEQ ID NO: 981817 - RNA, 17 nt, Homo sapiens
caagaagaccaugaucu

SEQ ID NO: 981818 - RNA, 13 nt, Homo sapiens
caagauucagcua

SEQ ID NO: 981819 - RNA, 13 nt, Homo sapiens
caaggaugaucca

SEQ ID NO: 981820 - RNA, 19 nt, Homo sapiens
caauaaaaguguccauuga

SEQ ID NO: 981821 - RNA, 13 nt, Homo sapiens
caaucaugugcuu

SEQ ID NO: 981822 - RNA, 15 nt, Homo sapiens
caaucaugugcuuca

SEQ ID NO: 981823 - RNA, 20 nt, Homo sapiens
caaucaugugcuucauagaa

SEQ ID NO: 981824 - RNA, 21 nt, Homo sapiens
caaugagguggcucaugccug

SEQ ID NO: 981825 - RNA, 9 nt, Homo sapiens
caaugccau

SEQ ID NO: 981826 - RNA, 17 nt, Homo sapiens
cacacuuucacugggga

SEQ ID NO: 981827 - RNA, 15 nt, Homo sapiens
cacagggcaugccug

SEQ ID NO: 981828 - RNA, 12 nt, Homo sapiens
cacauuacagga

SEQ ID NO: 981829 - RNA, 19 nt, Homo sapiens
caccaacucugcacuccau

SEQ ID NO: 981830 - RNA, 20 nt, Homo sapiens
cacccaggcuagagugcaau

SEQ ID NO: 981831 - RNA, 14 nt, Homo sapiens
cacccccaccucaa

SEQ ID NO: 981832 - RNA, 20 nt, Homo sapiens
caccucauggacuccaggau

SEQ ID NO: 981833 - RNA, 12 nt, Homo sapiens
cacucacuccag

SEQ ID NO: 981834 - RNA, 12 nt, Homo sapiens
cacugugcccag

SEQ ID NO: 981835 - RNA, 16 nt, Homo sapiens
cacuucuuaacagaca

SEQ ID NO: 981836 - RNA, 14 nt, Homo sapiens
cagcaccugucacc

SEQ ID NO: 981837 - RNA, 20 nt, Homo sapiens
cagccucccgaguagcugga

SEQ ID NO: 981838 - RNA, 19 nt, Homo sapiens
cagccuggccaacauggca

SEQ ID NO: 981839 - RNA, 19 nt, Homo sapiens
cagccugggugacagagca

SEQ ID NO: 981840 - RNA, 16 nt, Homo sapiens
cagcgccagggcucag

SEQ ID NO: 981841 - RNA, 23 nt, Homo sapiens
cagcuacauuccucagcugccaa

SEQ ID NO: 981842 - RNA, 14 nt, Homo sapiens
cagcugagcacuaa

SEQ ID NO: 981843 - RNA, 17 nt, Homo sapiens
cagcugggauuugaacc

SEQ ID NO: 981844 - RNA, 16 nt, Homo sapiens
caggagaccuuccaca

SEQ ID NO: 981845 - RNA, 16 nt, Homo sapiens
caggcuagagugcaau

SEQ ID NO: 981846 - RNA, 19 nt, Homo sapiens
caggcuagagugcaauggc

SEQ ID NO: 981847 - RNA, 14 nt, Homo sapiens
caggggugagaccu

SEQ ID NO: 981848 - RNA, 21 nt, Homo sapiens
cagucaugcguccacuuuccc

SEQ ID NO: 981849 - RNA, 11 nt, Homo sapiens
cagucauguca

SEQ ID NO: 981850 - RNA, 13 nt, Homo sapiens
caguguuagcuua

SEQ ID NO: 981851 - RNA, 16 nt, Homo sapiens
caguuacugaugcucc

SEQ ID NO: 981852 - RNA, 21 nt, Homo sapiens
caguuacugaugcuccugaac

SEQ ID NO: 981853 - RNA, 18 nt, Homo sapiens
caguugcacagcaucuca

SEQ ID NO: 981854 - RNA, 21 nt, Homo sapiens
caguuggggcuguucauggca

SEQ ID NO: 981855 - RNA, 14 nt, Homo sapiens
cauagaaacugcuu

SEQ ID NO: 981856 - RNA, 22 nt, Homo sapiens
cauagcauuagcugcuuccucc

SEQ ID NO: 981857 - RNA, 15 nt, Homo sapiens
cauagccuuucccua

SEQ ID NO: 981858 - RNA, 13 nt, Homo sapiens
cauaguaaaguau

SEQ ID NO: 981859 - RNA, 17 nt, Homo sapiens
cauauauuuccacuucu

SEQ ID NO: 981860 - RNA, 18 nt, Homo sapiens
cauauauuuccacuucuu

SEQ ID NO: 981861 - RNA, 22 nt, Homo sapiens
caucguggugugucaaugccac

SEQ ID NO: 981862 - RNA, 13 nt, Homo sapiens
caugggugggugg

SEQ ID NO: 981863 - RNA, 17 nt, Homo sapiens
caugguugaaucugaaa

SEQ ID NO: 981864 - RNA, 16 nt, Homo sapiens
cauguaccacauaaca

SEQ ID NO: 981865 - RNA, 14 nt, Homo sapiens
cauuaaaucacuug

SEQ ID NO: 981866 - RNA, 22 nt, Homo sapiens
cauuccacauccccaccuucca

SEQ ID NO: 981867 - RNA, 14 nt, Homo sapiens
cauuccuugucacc

SEQ ID NO: 981868 - RNA, 16 nt, Homo sapiens
cauucuguuugucucg

SEQ ID NO: 981869 - RNA, 15 nt, Homo sapiens
cauugaaagugcuuc

SEQ ID NO: 981870 - RNA, 19 nt, Homo sapiens
cauuugaauuuuuuaguga

SEQ ID NO: 981871 - RNA, 15 nt, Homo sapiens
ccaaauccuugagau

SEQ ID NO: 981872 - RNA, 22 nt, Homo sapiens
ccaacaaacaaugccaucacug

SEQ ID NO: 981873 - RNA, 16 nt, Homo sapiens
ccaacucugcacucca

SEQ ID NO: 981874 - RNA, 22 nt, Homo sapiens
ccacauauauuuccacuucuuc

SEQ ID NO: 981875 - RNA, 13 nt, Homo sapiens
ccacucacuccag

SEQ ID NO: 981876 - RNA, 19 nt, Homo sapiens
ccagcuggcccagugggua

SEQ ID NO: 981877 - RNA, 16 nt, Homo sapiens
ccaggcuagagugcaa

SEQ ID NO: 981878 - RNA, 18 nt, Homo sapiens
ccaggcuagagugcaaug

SEQ ID NO: 981879 - RNA, 14 nt, Homo sapiens
cccagccccuccau

SEQ ID NO: 981880 - RNA, 20 nt, Homo sapiens
cccagccugggcuccucugc

SEQ ID NO: 981881 - RNA, 20 nt, Homo sapiens
cccaggcuagagugcaaugg

SEQ ID NO: 981882 - RNA, 13 nt, Homo sapiens
ccccacgugugaa

SEQ ID NO: 981883 - RNA, 16 nt, Homo sapiens
ccccagcuuuccaucu

SEQ ID NO: 981884 - RNA, 17 nt, Homo sapiens
ccccaugcugggcucac

SEQ ID NO: 981885 - RNA, 16 nt, Homo sapiens
ccccucccugugugaa

SEQ ID NO: 981886 - RNA, 22 nt, Homo sapiens
cccguaggcagccucucugcua

SEQ ID NO: 981887 - RNA, 14 nt, Homo sapiens
ugcauuauugacga

SEQ ID NO: 981888 - RNA, 13 nt, Homo sapiens
ugccacggccaug

SEQ ID NO: 981889 - RNA, 14 nt, Homo sapiens
ugcccgugccucug

SEQ ID NO: 981890 - RNA, 19 nt, Homo sapiens
ugcccugcugagcacagac

SEQ ID NO: 981891 - RNA, 15 nt, Homo sapiens
ugcccuuucccugca

SEQ ID NO: 981892 - RNA, 14 nt, Homo sapiens
ugccucggccuccc

SEQ ID NO: 981893 - RNA, 11 nt, Homo sapiens
ugcugagcaca

SEQ ID NO: 981894 - RNA, 13 nt, Homo sapiens
ugcuucauagaaa

SEQ ID NO: 981895 - RNA, 20 nt, Homo sapiens
ugcuuccuccccuccuggca

SEQ ID NO: 981896 - RNA, 17 nt, Homo sapiens
ugcuuuuuuaacagaua

SEQ ID NO: 981897 - RNA, 17 nt, Homo sapiens
uggaaagcaccucauga

SEQ ID NO: 981898 - RNA, 18 nt, Homo sapiens
uggaagacuuagaucuga

SEQ ID NO: 981899 - RNA, 18 nt, Homo sapiens
uggacagcugagcacuaa

SEQ ID NO: 981900 - RNA, 17 nt, Homo sapiens
uggagagaugggacaau

SEQ ID NO: 981901 - RNA, 20 nt, Homo sapiens
uggauuugcauacauucuuc

SEQ ID NO: 981902 - RNA, 23 nt, Homo sapiens
uggauuuuaagcaaaagcaucca

SEQ ID NO: 981903 - RNA, 18 nt, Homo sapiens
uggcaccaucuuggcuca

SEQ ID NO: 981904 - RNA, 21 nt, Homo sapiens
uggcccaagcugggcucccuu

SEQ ID NO: 981905 - RNA, 19 nt, Homo sapiens
uggcccuugccggggccug

SEQ ID NO: 981906 - RNA, 22 nt, Homo sapiens
uggccugagcgcagcgccucca

SEQ ID NO: 981907 - RNA, 14 nt, Homo sapiens
uggcucacugcaac

SEQ ID NO: 981908 - RNA, 20 nt, Homo sapiens
ugggauaacaguaagggaua

SEQ ID NO: 981909 - RNA, 14 nt, Homo sapiens
ugggauuugaacca

SEQ ID NO: 981910 - RNA, 16 nt, Homo sapiens
uggggcuuccugggca

SEQ ID NO: 981911 - RNA, 23 nt, Homo sapiens
ugggguuucaccauguuggccag

SEQ ID NO: 981912 - RNA, 23 nt, Homo sapiens
uggguggggagucagucauguca

SEQ ID NO: 981913 - RNA, 22 nt, Homo sapiens
uggucaaaaugaacuccauugc

SEQ ID NO: 981914 - RNA, 20 nt, Homo sapiens
uggucaggggugagaccuga

SEQ ID NO: 981915 - RNA, 15 nt, Homo sapiens
uggugcccgugccuc

SEQ ID NO: 981916 - RNA, 13 nt, Homo sapiens
cguggcagugcuu

SEQ ID NO: 981917 - RNA, 13 nt, Homo sapiens
cguuccuccucag

SEQ ID NO: 981918 - RNA, 21 nt, Homo sapiens
cuaaaaccuuccaugucaaga

SEQ ID NO: 981919 - RNA, 15 nt, Homo sapiens
cuaaaccauugugca

SEQ ID NO: 981920 - RNA, 15 nt, Homo sapiens
cuaauguaugcauuc

SEQ ID NO: 981921 - RNA, 17 nt, Homo sapiens
cuaauguaugcauucau

SEQ ID NO: 981922 - RNA, 18 nt, Homo sapiens
cuaauguaugcauucauc

SEQ ID NO: 981923 - RNA, 14 nt, Homo sapiens
cuacccgagcccag

SEQ ID NO: 981924 - RNA, 17 nt, Homo sapiens
cuacuacccgagcccag

SEQ ID NO: 981925 - RNA, 20 nt, Homo sapiens
cuacucaugaggcugaggca

SEQ ID NO: 981926 - RNA, 23 nt, Homo sapiens
cuaggaaaagggauacuuugaua

SEQ ID NO: 981927 - RNA, 15 nt, Homo sapiens
cuaggauaguuucac

SEQ ID NO: 981928 - RNA, 22 nt, Homo sapiens
cuaugauguuucuuuugcaauu

SEQ ID NO: 981929 - RNA, 15 nt, Homo sapiens
cuauucuaaucagua

SEQ ID NO: 981930 - RNA, 15 nt, Homo sapiens
cucagcugcacauuc

SEQ ID NO: 981931 - RNA, 16 nt, Homo sapiens
cucagcugcacauucc

SEQ ID NO: 981932 - RNA, 17 nt, Homo sapiens
cucagcugcacauuccu

SEQ ID NO: 981933 - RNA, 22 nt, Homo sapiens
cucagugccacuugacauuccu

SEQ ID NO: 981934 - RNA, 14 nt, Homo sapiens
cuccacucacucca

SEQ ID NO: 981935 - RNA, 19 nt, Homo sapiens
cuccacuuacuauaauggu

SEQ ID NO: 981936 - RNA, 14 nt, Homo sapiens
cucccaaccucaau

SEQ ID NO: 981937 - RNA, 23 nt, Homo sapiens
cuccccagaggugaccacuuuca

SEQ ID NO: 981938 - RNA, 13 nt, Homo sapiens
cucccucuguguu

SEQ ID NO: 981939 - RNA, 22 nt, Homo sapiens
cuccuccaagccuucacccugu

SEQ ID NO: 981940 - RNA, 13 nt, Homo sapiens
cuccucuagcucu

SEQ ID NO: 981941 - RNA, 19 nt, Homo sapiens
cuccuggguucaagcaaau

SEQ ID NO: 981942 - RNA, 15 nt, Homo sapiens
cucgagaugggugcu

SEQ ID NO: 981943 - RNA, 17 nt, Homo sapiens
cucggccucccaaagug

SEQ ID NO: 981944 - RNA, 20 nt, Homo sapiens
cucggggggguuuucaucua

SEQ ID NO: 981945 - RNA, 20 nt, Homo sapiens
cucgguauaguuuugucaca

SEQ ID NO: 981946 - RNA, 22 nt, Homo sapiens
cucugagguaaagguccaugaa

SEQ ID NO: 981947 - RNA, 18 nt, Homo sapiens
cucugcacuccauggcca

SEQ ID NO: 981948 - RNA, 21 nt, Homo sapiens
cugaaaaucuggugcucaaua

SEQ ID NO: 981949 - RNA, 14 nt, Homo sapiens
cugaccucaaguga

SEQ ID NO: 981950 - RNA, 14 nt, Homo sapiens
cugaggaccagaaa

SEQ ID NO: 981951 - RNA, 12 nt, Homo sapiens
cugcacauuccu

SEQ ID NO: 981952 - RNA, 16 nt, Homo sapiens
cugcacuccagccugg

SEQ ID NO: 981953 - RNA, 16 nt, Homo sapiens
cugcacuccauggcca

SEQ ID NO: 981954 - RNA, 23 nt, Homo sapiens
cugccauuaaauccgcaaacagc

SEQ ID NO: 981955 - RNA, 23 nt, Homo sapiens
cugcccacgugcagcaccuguca

SEQ ID NO: 981956 - RNA, 14 nt, Homo sapiens
cugccucacuguga

SEQ ID NO: 981957 - RNA, 17 nt, Homo sapiens
cugccucuccagcacuu

SEQ ID NO: 981958 - RNA, 19 nt, Homo sapiens
cugccucuccagcacuucu

SEQ ID NO: 981959 - RNA, 19 nt, Homo sapiens
cugccuuaaauaaaacugc

SEQ ID NO: 981960 - RNA, 12 nt, Homo sapiens
cugcucugaggu

SEQ ID NO: 981961 - RNA, 19 nt, Homo sapiens
cuggagcaaccuacugucu

SEQ ID NO: 981962 - RNA, 18 nt, Homo sapiens
cuggauuugcauacauuc

SEQ ID NO: 981963 - RNA, 12 nt, Homo sapiens
cuggccugagga

SEQ ID NO: 981964 - RNA, 20 nt, Homo sapiens
cuggcuuuucuggcugggga

SEQ ID NO: 981965 - RNA, 21 nt, Homo sapiens
cugggauuacaggugugagcc

SEQ ID NO: 981966 - RNA, 16 nt, Homo sapiens
cugggcucacuacaug

SEQ ID NO: 981967 - RNA, 18 nt, Homo sapiens
cuguaaugguugggacca

SEQ ID NO: 981968 - RNA, 14 nt, Homo sapiens
cugucccaccaacu

SEQ ID NO: 981969 - RNA, 23 nt, Homo sapiens
cugucgguguuuggaggcugcug

SEQ ID NO: 981970 - RNA, 13 nt, Homo sapiens
cugugacuccccu

SEQ ID NO: 981971 - RNA, 11 nt, Homo sapiens
cugugacuccu

SEQ ID NO: 981972 - RNA, 16 nt, Homo sapiens
cuguugauaauaucuc

SEQ ID NO: 981973 - RNA, 20 nt, Homo sapiens
cuuaacagacaauuggucaa

SEQ ID NO: 981974 - RNA, 13 nt, Homo sapiens
cuuagaugagauc

SEQ ID NO: 981975 - RNA, 18 nt, Homo sapiens
cuuauaacaaaaaagccc

SEQ ID NO: 981976 - RNA, 21 nt, Homo sapiens
cuuauuggccacugggucuca

SEQ ID NO: 981977 - RNA, 17 nt, Homo sapiens
cuucauuugacauuuag

SEQ ID NO: 981978 - RNA, 18 nt, Homo sapiens
cuuccccugugacuccuc

SEQ ID NO: 981979 - RNA, 14 nt, Homo sapiens
cuucugggccucca

SEQ ID NO: 981980 - RNA, 12 nt, Homo sapiens
cuugacauuccu

SEQ ID NO: 981981 - RNA, 13 nt, Homo sapiens
cuugagaccagcc

SEQ ID NO: 981982 - RNA, 12 nt, Homo sapiens
cuugagacccuc

SEQ ID NO: 981983 - RNA, 13 nt, Homo sapiens
cuugcucuaccug

SEQ ID NO: 981984 - RNA, 14 nt, Homo sapiens
cuuggccucaugau

SEQ ID NO: 981985 - RNA, 22 nt, Homo sapiens
cuuuaucaagggccuacuuuau

SEQ ID NO: 981986 - RNA, 16 nt, Homo sapiens
cuuuuauucuaacuuu

SEQ ID NO: 981987 - RNA, 19 nt, Homo sapiens
cuuuuauucuaacuuuuau

SEQ ID NO: 981988 - RNA, 21 nt, Homo sapiens
gaaaugaaacaaauaaucaca

SEQ ID NO: 981989 - RNA, 18 nt, Homo sapiens
gaaauugauuaaggcuuu

SEQ ID NO: 981990 - RNA, 20 nt, Homo sapiens
gaaggcaggagugcugcccu

SEQ ID NO: 981991 - RNA, 13 nt, Homo sapiens
gaauaaucacuug

SEQ ID NO: 981992 - RNA, 23 nt, Homo sapiens
gaaucuugaggaacggaucagau

SEQ ID NO: 981993 - RNA, 21 nt, Homo sapiens
gacacagcccacccucuguga

SEQ ID NO: 981994 - RNA, 22 nt, Homo sapiens
gacaggguuucaccauguuggc

SEQ ID NO: 981995 - RNA, 12 nt, Homo sapiens
gacagucuugca

SEQ ID NO: 981996 - RNA, 13 nt, Homo sapiens
gacagucuugcau

SEQ ID NO: 981997 - RNA, 16 nt, Homo sapiens
gaccccucccaaccuc

SEQ ID NO: 981998 - RNA, 16 nt, Homo sapiens
gaccucaucacugaga

SEQ ID NO: 981999 - RNA, 17 nt, Homo sapiens
gaccucaucacugagaa

SEQ ID NO: 982000 - RNA, 15 nt, Homo sapiens
gagaugcagugccag

SEQ ID NO: 982001 - RNA, 21 nt, Homo sapiens
gagcauauguuccaugccugg

SEQ ID NO: 982002 - RNA, 17 nt, Homo sapiens
gagccgugcagcuggga

SEQ ID NO: 982003 - RNA, 19 nt, Homo sapiens
gcgugugacagucuugcau

SEQ ID NO: 982004 - RNA, 14 nt, Homo sapiens
gcuacucaugaggc

SEQ ID NO: 982005 - RNA, 14 nt, Homo sapiens
gcuagagugcaaug

SEQ ID NO: 982006 - RNA, 18 nt, Homo sapiens
gcucaauuuggugcucac

SEQ ID NO: 982007 - RNA, 18 nt, Homo sapiens
gcucacguguccuuaaca

SEQ ID NO: 982008 - RNA, 16 nt, Homo sapiens
gcuccucugcaucuug

SEQ ID NO: 982009 - RNA, 19 nt, Homo sapiens
gcuccugaacccuaugugu

SEQ ID NO: 982010 - RNA, 13 nt, Homo sapiens
gcucugagcauau

SEQ ID NO: 982011 - RNA, 14 nt, Homo sapiens
gcucuguuccacau

SEQ ID NO: 982012 - RNA, 21 nt, Homo sapiens
gcugacuuuucugacccaugu

SEQ ID NO: 982013 - RNA, 14 nt, Homo sapiens
gcugauacgacagc

SEQ ID NO: 982014 - RNA, 11 nt, Homo sapiens
gcugcugcuac

SEQ ID NO: 982015 - RNA, 13 nt, Homo sapiens
gcuggcgccuagg

SEQ ID NO: 982016 - RNA, 15 nt, Homo sapiens
gcugggauuugaacc

SEQ ID NO: 982017 - RNA, 17 nt, Homo sapiens
gcugggcucacuacaug

SEQ ID NO: 982018 - RNA, 13 nt, Homo sapiens
gcuguccauugcc

SEQ ID NO: 982019 - RNA, 13 nt, Homo sapiens
gcuuaaugaaggu

SEQ ID NO: 982020 - RNA, 12 nt, Homo sapiens
gcuuaugucaua

SEQ ID NO: 982021 - RNA, 22 nt, Homo sapiens
gcuuugacaugacugcaaucau

SEQ ID NO: 982022 - RNA, 17 nt, Homo sapiens
gcuuuggcgccccaugg

SEQ ID NO: 982023 - RNA, 21 nt, Homo sapiens
ggaaacaagaugaaauuccau

SEQ ID NO: 982024 - RNA, 19 nt, Homo sapiens
ggaaaucuuguuuugccaa

SEQ ID NO: 982025 - RNA, 21 nt, Homo sapiens
ggaaaugugucuugucuccau

SEQ ID NO: 982026 - RNA, 13 nt, Homo sapiens
ggaacuaaacguc

SEQ ID NO: 982027 - RNA, 21 nt, Homo sapiens
ggagaccuuccacaaagggua

SEQ ID NO: 982028 - RNA, 18 nt, Homo sapiens
ggaggacuccgggaccau

SEQ ID NO: 982029 - RNA, 16 nt, Homo sapiens
ggcaaggaugauccag

SEQ ID NO: 982030 - RNA, 17 nt, Homo sapiens
ggccaccccgugccacc

SEQ ID NO: 982031 - RNA, 20 nt, Homo sapiens
ggccacgggaccuucuaucc

SEQ ID NO: 982032 - RNA, 19 nt, Homo sapiens
ggccaugagggcuggagac

SEQ ID NO: 982033 - RNA, 17 nt, Homo sapiens
ggccugaggacccggcg

SEQ ID NO: 982034 - RNA, 14 nt, Homo sapiens
ggcguguccaggag

SEQ ID NO: 982035 - RNA, 15 nt, Homo sapiens
ggcucaugccuguaa

SEQ ID NO: 982036 - RNA, 21 nt, Homo sapiens
gggaaggaaggcguguccagg

SEQ ID NO: 982037 - RNA, 12 nt, Homo sapiens
gggcaugccugg

SEQ ID NO: 982038 - RNA, 22 nt, Homo sapiens
gggcucccuuuaagccaagaga

SEQ ID NO: 982039 - RNA, 23 nt, Homo sapiens
ggguucccccucccugugugaaa

SEQ ID NO: 982040 - RNA, 21 nt, Homo sapiens
guaaacaauaaaaguguccau

SEQ ID NO: 982041 - RNA, 13 nt, Homo sapiens
guaaagguccaug

SEQ ID NO: 982042 - RNA, 23 nt, Homo sapiens
guacugaaaaucuggugcucaau

SEQ ID NO: 982043 - RNA, 12 nt, Homo sapiens
guaugcauucau

SEQ ID NO: 982044 - RNA, 15 nt, Homo sapiens
guaugugaaccaccc

SEQ ID NO: 982045 - RNA, 16 nt, Homo sapiens
guauuugucauuccuc

SEQ ID NO: 982046 - RNA, 19 nt, Homo sapiens
gucaccagcaacaucucga

SEQ ID NO: 982047 - RNA, 23 nt, Homo sapiens
gucaccaggcuggagugcagugc

SEQ ID NO: 982048 - RNA, 18 nt, Homo sapiens
gucaucaugaacuggcuu

SEQ ID NO: 982049 - RNA, 21 nt, Homo sapiens
gucaucauuugucuuugaacg

SEQ ID NO: 982050 - RNA, 17 nt, Homo sapiens
gucccccacgugugaag

SEQ ID NO: 982051 - RNA, 14 nt, Homo sapiens
guccguggaaccag

SEQ ID NO: 982052 - RNA, 10 nt, Homo sapiens
gugaggccaa

SEQ ID NO: 982053 - RNA, 13 nt, Homo sapiens
gugcucauagaaa

SEQ ID NO: 982054 - RNA, 21 nt, Homo sapiens
gugcugggauuacagguguga

SEQ ID NO: 982055 - RNA, 14 nt, Homo sapiens
gugcuuaugucaua

SEQ ID NO: 982056 - RNA, 14 nt, Homo sapiens
gugcuucauagaaa

SEQ ID NO: 982057 - RNA, 14 nt, Homo sapiens
guggcucaugccug

SEQ ID NO: 982058 - RNA, 20 nt, Homo sapiens
guggguauagcucaggguaa

SEQ ID NO: 982059 - RNA, 19 nt, Homo sapiens
guguccaggagaccuucca

SEQ ID NO: 982060 - RNA, 14 nt, Homo sapiens
guguggcaguguuu

SEQ ID NO: 982061 - RNA, 19 nt, Homo sapiens
guuaaaauguuuacuguaa

SEQ ID NO: 982062 - RNA, 13 nt, Homo sapiens
guuuaaaugcucu

SEQ ID NO: 982063 - RNA, 20 nt, Homo sapiens
guuuuguaaauguacuggua

SEQ ID NO: 982064 - RNA, 13 nt, Homo sapiens
uaaaacagacuca

SEQ ID NO: 982065 - RNA, 18 nt, Homo sapiens
uaaaaccuuccaugucaa

SEQ ID NO: 982066 - RNA, 21 nt, Homo sapiens
uaaacaauaaaaguguccauu

SEQ ID NO: 982067 - RNA, 21 nt, Homo sapiens
uaaacaccauuuagucacuga

SEQ ID NO: 982068 - RNA, 16 nt, Homo sapiens
uaaaccauugugcauu

SEQ ID NO: 982069 - RNA, 19 nt, Homo sapiens
uaaaccauugugcauucua

SEQ ID NO: 982070 - RNA, 16 nt, Homo sapiens
uaaacuccacagggac

SEQ ID NO: 982071 - RNA, 18 nt, Homo sapiens
uaaaucuagaguuuauac

SEQ ID NO: 982072 - RNA, 14 nt, Homo sapiens
uaaauguccauucu

SEQ ID NO: 982073 - RNA, 18 nt, Homo sapiens
uaacagauaacagugugc

SEQ ID NO: 982074 - RNA, 14 nt, Homo sapiens
uaacagugugcuca

SEQ ID NO: 982075 - RNA, 20 nt, Homo sapiens
uaacagugugcucauagaaa

SEQ ID NO: 982076 - RNA, 20 nt, Homo sapiens
uaagauuuucugggauaaca

SEQ ID NO: 982077 - RNA, 20 nt, Homo sapiens
uaauacccacauuacaggau

SEQ ID NO: 982078 - RNA, 12 nt, Homo sapiens
uaauuuuugcau

SEQ ID NO: 982079 - RNA, 17 nt, Homo sapiens
uacaccgugaggccaag

SEQ ID NO: 982080 - RNA, 20 nt, Homo sapiens
uacaggcacccaccacaucu

SEQ ID NO: 982081 - RNA, 12 nt, Homo sapiens
uacauguaaaau

SEQ ID NO: 982082 - RNA, 19 nt, Homo sapiens
uacauuaaaucacuugaau

SEQ ID NO: 982083 - RNA, 17 nt, Homo sapiens
uaccacuagagucuuca

SEQ ID NO: 982084 - RNA, 12 nt, Homo sapiens
uacccacauuac

SEQ ID NO: 982085 - RNA, 23 nt, Homo sapiens
uaccuccauguuucuaaguaaua

SEQ ID NO: 982086 - RNA, 22 nt, Homo sapiens
uacuacccgagcccagcuacau

SEQ ID NO: 982087 - RNA, 19 nt, Homo sapiens
uacucaugaggcugaggca

SEQ ID NO: 982088 - RNA, 18 nt, Homo sapiens
uacuguuuauaucuucac

SEQ ID NO: 982089 - RNA, 19 nt, Homo sapiens
uacuguuuauaucuucacc

SEQ ID NO: 982090 - RNA, 20 nt, Homo sapiens
uacuguuuucugggccagug

SEQ ID NO: 982091 - RNA, 21 nt, Homo sapiens
uacuguuuucugggccaguga

SEQ ID NO: 982092 - RNA, 14 nt, Homo sapiens
uagaacuguacugu

SEQ ID NO: 982093 - RNA, 20 nt, Homo sapiens
uagagacauccuucauuuga

SEQ ID NO: 982094 - RNA, 21 nt, Homo sapiens
uagagugcaauggcaccaucu

SEQ ID NO: 982095 - RNA, 12 nt, Homo sapiens
uagagugcauau

SEQ ID NO: 982096 - RNA, 19 nt, Homo sapiens
uagcauuuucugcaucucc

SEQ ID NO: 982097 - RNA, 20 nt, Homo sapiens
uagcauuuucugcaucucca

SEQ ID NO: 982098 - RNA, 16 nt, Homo sapiens
uagcugggauuugaac

SEQ ID NO: 982099 - RNA, 17 nt, Homo sapiens
uagcuuugucacuguuu

SEQ ID NO: 982100 - RNA, 19 nt, Homo sapiens
uaggcacuucuuaacagac

SEQ ID NO: 982101 - RNA, 14 nt, Homo sapiens
uaguaaacuuugua

SEQ ID NO: 982102 - RNA, 15 nt, Homo sapiens
uagucuuuuccucua

SEQ ID NO: 982103 - RNA, 16 nt, Homo sapiens
uaguggcauccauuuc

SEQ ID NO: 982104 - RNA, 13 nt, Homo sapiens
uauagcagucauc

SEQ ID NO: 982105 - RNA, 21 nt, Homo sapiens
uauauuauuguuuucuacugc

SEQ ID NO: 982106 - RNA, 17 nt, Homo sapiens
uauauuuccacuucuuc

SEQ ID NO: 982107 - RNA, 14 nt, Homo sapiens
uaucaguuacacau

SEQ ID NO: 982108 - RNA, 16 nt, Homo sapiens
uaugcauucauccaac

SEQ ID NO: 982109 - RNA, 14 nt, Homo sapiens
uaugcuaugauuaa

SEQ ID NO: 982110 - RNA, 19 nt, Homo sapiens
uaugcuuauauuguucacu

SEQ ID NO: 982111 - RNA, 16 nt, Homo sapiens
uauggaaagcaccuca

SEQ ID NO: 982112 - RNA, 21 nt, Homo sapiens
uauguaugguuguuacuaugg

SEQ ID NO: 982113 - RNA, 19 nt, Homo sapiens
uauuagauaauauaccgua

SEQ ID NO: 982114 - RNA, 23 nt, Homo sapiens
uauucuaacuuuuauuuuuauca

SEQ ID NO: 982115 - RNA, 17 nt, Homo sapiens
ucaauaaagaagcccau

SEQ ID NO: 982116 - RNA, 19 nt, Homo sapiens
ucaauagucaguuacugau

SEQ ID NO: 982117 - RNA, 20 nt, Homo sapiens
ucacauagcugggauuugaa

SEQ ID NO: 982118 - RNA, 15 nt, Homo sapiens
ucaccaaacuaguaa

SEQ ID NO: 982119 - RNA, 16 nt, Homo sapiens
ucaccagcagacacug

SEQ ID NO: 982120 - RNA, 22 nt, Homo sapiens
uugucuacauuaaaucacuuga

SEQ ID NO: 982121 - RNA, 17 nt, Homo sapiens
uuguuuucuacugcuau

SEQ ID NO: 982122 - RNA, 21 nt, Homo sapiens
uuuaacagauaacagugugcu

SEQ ID NO: 982123 - RNA, 23 nt, Homo sapiens
uuuagugacuaaaccauugugca

SEQ ID NO: 982124 - RNA, 22 nt, Homo sapiens
uuuauggcagacauugugcuag

SEQ ID NO: 982125 - RNA, 17 nt, Homo sapiens
uuucaccauguuggcca

SEQ ID NO: 982126 - RNA, 21 nt, Homo sapiens
uuucccaccgcuuugugagcc

SEQ ID NO: 982127 - RNA, 15 nt, Homo sapiens
uuuccccgauuuucc

SEQ ID NO: 982128 - RNA, 19 nt, Homo sapiens
uuucuaauguaugcauuca

SEQ ID NO: 982129 - RNA, 16 nt, Homo sapiens
uuugaauaccauuugg

SEQ ID NO: 982130 - RNA, 20 nt, Homo sapiens
uuugaauuuuuuagugacua

SEQ ID NO: 982131 - RNA, 22 nt, Homo sapiens
uuugcaauuggaauaaucacuu

SEQ ID NO: 982132 - RNA, 17 nt, Homo sapiens
uuugcauacauucuuca

SEQ ID NO: 982133 - RNA, 19 nt, Homo sapiens
uuugccaauuuucuuugaa

SEQ ID NO: 982134 - RNA, 12 nt, Homo sapiens
uuugugagccgu

SEQ ID NO: 982135 - RNA, 21 nt, Homo sapiens
uuuguuaggaagggugagaau

SEQ ID NO: 982136 - RNA, 18 nt, Homo sapiens
aaggucauggucugagug

SEQ ID NO: 982137 - RNA, 20 nt, Homo sapiens
aagugagcaguguuagcuua

SEQ ID NO: 982138 - RNA, 17 nt, Homo sapiens
aaguuuccucauuuggc

SEQ ID NO: 982139 - RNA, 21 nt, Homo sapiens
aauaagcgguuuucuuaggca

SEQ ID NO: 982140 - RNA, 13 nt, Homo sapiens
aauaaucacuugg

SEQ ID NO: 982141 - RNA, 20 nt, Homo sapiens
aauagagcgugugcuguuga

SEQ ID NO: 982142 - RNA, 17 nt, Homo sapiens
aaucacccugacugugg

SEQ ID NO: 982143 - RNA, 18 nt, Homo sapiens
aaucaugugcuucauaga

SEQ ID NO: 982144 - RNA, 18 nt, Homo sapiens
aaucucggcucacugcaa

SEQ ID NO: 982145 - RNA, 16 nt, Homo sapiens
aaucuuguuuugccaa

SEQ ID NO: 982146 - RNA, 19 nt, Homo sapiens
aaugaacuccauugcuuaa

SEQ ID NO: 982147 - RNA, 15 nt, Homo sapiens
aauuauagauuagau

SEQ ID NO: 982148 - RNA, 15 nt, Homo sapiens
aauuuuucucuuuaa

SEQ ID NO: 982149 - RNA, 14 nt, Homo sapiens
acaaacaaugccau

SEQ ID NO: 982150 - RNA, 14 nt, Homo sapiens
acaacagacugcau

SEQ ID NO: 982151 - RNA, 15 nt, Homo sapiens
acaacagacugcaua

SEQ ID NO: 982152 - RNA, 13 nt, Homo sapiens
acaagacaacuuc

SEQ ID NO: 982153 - RNA, 19 nt, Homo sapiens
acaaggccuguucaaaaac

SEQ ID NO: 982154 - RNA, 16 nt, Homo sapiens
acaaugccaucacugg

SEQ ID NO: 982155 - RNA, 16 nt, Homo sapiens
acacauaaacaccauu

SEQ ID NO: 982156 - RNA, 16 nt, Homo sapiens
acaccgugaggccaag

SEQ ID NO: 982157 - RNA, 13 nt, Homo sapiens
acacuuucacugg

SEQ ID NO: 982158 - RNA, 20 nt, Homo sapiens
acagagcaagacuccgucuc

SEQ ID NO: 982159 - RNA, 17 nt, Homo sapiens
acaggcagcaaggucau

SEQ ID NO: 982160 - RNA, 18 nt, Homo sapiens
acaguugcacagcaucuc

SEQ ID NO: 982161 - RNA, 19 nt, Homo sapiens
acaucuugguaaacaacag

SEQ ID NO: 982162 - RNA, 16 nt, Homo sapiens
aguuccugugcacagc

SEQ ID NO: 982163 - RNA, 17 nt, Homo sapiens
aguugcacagcaucuca

SEQ ID NO: 982164 - RNA, 21 nt, Homo sapiens
aguuuauacaguguacaugua

SEQ ID NO: 982165 - RNA, 23 nt, Homo sapiens
aguuuuucagguauauaccucca

SEQ ID NO: 982166 - RNA, 14 nt, Homo sapiens
auaaaaguguccau

SEQ ID NO: 982167 - RNA, 14 nt, Homo sapiens
auaaucacauugac

SEQ ID NO: 982168 - RNA, 17 nt, Homo sapiens
auacaguguacauguac

SEQ ID NO: 982169 - RNA, 19 nt, Homo sapiens
auauaccguauguauuuau

SEQ ID NO: 982170 - RNA, 18 nt, Homo sapiens
auauauuuccacuucuuc

SEQ ID NO: 982171 - RNA, 16 nt, Homo sapiens
auaugcaucccaagau

SEQ ID NO: 982172 - RNA, 13 nt, Homo sapiens
auauuuccacuuc

SEQ ID NO: 982173 - RNA, 21 nt, Homo sapiens
auauuucuccaagaaagccaa

SEQ ID NO: 982174 - RNA, 19 nt, Homo sapiens
aucaccagcagacacugcc

SEQ ID NO: 982175 - RNA, 14 nt, Homo sapiens
aucagccuuuucag

SEQ ID NO: 982176 - RNA, 19 nt, Homo sapiens
aucaguuacacaugaucau

SEQ ID NO: 982177 - RNA, 18 nt, Homo sapiens
auccaucuucccuacccu

SEQ ID NO: 982178 - RNA, 20 nt, Homo sapiens
auccucuguauuugucauuc

SEQ ID NO: 982179 - RNA, 19 nt, Homo sapiens
aucuauuucauaccaugga

SEQ ID NO: 982180 - RNA, 20 nt, Homo sapiens
aucucaaacuccugaccuca

SEQ ID NO: 982181 - RNA, 17 nt, Homo sapiens
aucucggcucacugcaa

SEQ ID NO: 982182 - RNA, 18 nt, Homo sapiens
aucuuggcucacugcaac

SEQ ID NO: 982183 - RNA, 20 nt, Homo sapiens
augagaucuagacgccccca

SEQ ID NO: 982184 - RNA, 13 nt, Homo sapiens
ccuggacacagcc

SEQ ID NO: 982185 - RNA, 23 nt, Homo sapiens
ccuggauuugcauacauucuuca

SEQ ID NO: 982186 - RNA, 20 nt, Homo sapiens
ccuggccaacauggcaaaac

SEQ ID NO: 982187 - RNA, 21 nt, Homo sapiens
ccuggucccccacgugugaag

SEQ ID NO: 982188 - RNA, 17 nt, Homo sapiens
ccuguuuucauggacag

SEQ ID NO: 982189 - RNA, 17 nt, Homo sapiens
cgaggggcucauguuca

SEQ ID NO: 982190 - RNA, 21 nt, Homo sapiens
cgcaaguccccagccccucaa

SEQ ID NO: 982191 - RNA, 18 nt, Homo sapiens
cgcacagggcaugccugg

SEQ ID NO: 982192 - RNA, 13 nt, Homo sapiens
cgccagggcucag

SEQ ID NO: 982193 - RNA, 12 nt, Homo sapiens
cgcuuugugagc

SEQ ID NO: 982194 - RNA, 16 nt, Homo sapiens
cguggugggauuugcu

SEQ ID NO: 982195 - RNA, 20 nt, Homo sapiens
cguggugggauuugcuccug

SEQ ID NO: 982196 - RNA, 19 nt, Homo sapiens
cguggugugucaaugccac

SEQ ID NO: 982197 - RNA, 21 nt, Homo sapiens
cguguccaggagaccuuccac

SEQ ID NO: 982198 - RNA, 23 nt, Homo sapiens
cgugugaaguguaguggcaucca

SEQ ID NO: 982199 - RNA, 15 nt, Homo sapiens
cguguggcaguguuu

SEQ ID NO: 982200 - RNA, 18 nt, Homo sapiens
cuaaaaccuuccauguca

SEQ ID NO: 982201 - RNA, 20 nt, Homo sapiens
cuaaaccauugugcauucua

SEQ ID NO: 982202 - RNA, 11 nt, Homo sapiens
cuacauuccuc

SEQ ID NO: 982203 - RNA, 18 nt, Homo sapiens
cuacugcuaugugucaca

SEQ ID NO: 982204 - RNA, 14 nt, Homo sapiens
cuauagcagucauc

SEQ ID NO: 982205 - RNA, 16 nt, Homo sapiens
cucacugugaccugcu

SEQ ID NO: 982206 - RNA, 22 nt, Homo sapiens
cucagaaggcaggagugcugcc

SEQ ID NO: 982207 - RNA, 16 nt, Homo sapiens
cucagccuccaaagua

SEQ ID NO: 982208 - RNA, 20 nt, Homo sapiens
cucagcugccaagcacucga

SEQ ID NO: 982209 - RNA, 12 nt, Homo sapiens
cucagugccacu

SEQ ID NO: 982210 - RNA, 12 nt, Homo sapiens
cucauagaaacu

SEQ ID NO: 982211 - RNA, 14 nt, Homo sapiens
cucaucagccuuuu

SEQ ID NO: 982212 - RNA, 13 nt, Homo sapiens
cucaugacagcaa

SEQ ID NO: 982213 - RNA, 20 nt, Homo sapiens
cucaugccuguaaucccagc

SEQ ID NO: 982214 - RNA, 15 nt, Homo sapiens
cuccacucacuccag

SEQ ID NO: 982215 - RNA, 12 nt, Homo sapiens
cucccaaagugc

SEQ ID NO: 982216 - RNA, 13 nt, Homo sapiens
cuccucugugacu

SEQ ID NO: 982217 - RNA, 14 nt, Homo sapiens
cuccuguugccaca

SEQ ID NO: 982218 - RNA, 13 nt, Homo sapiens
cuccuucccgccg

SEQ ID NO: 982219 - RNA, 17 nt, Homo sapiens
cucuaggaaaagggaua

SEQ ID NO: 982220 - RNA, 15 nt, Homo sapiens
cucucccauggugcc

SEQ ID NO: 982221 - RNA, 15 nt, Homo sapiens
cucucugugcacuga

SEQ ID NO: 982222 - RNA, 21 nt, Homo sapiens
cucugaauaaauacccauuga

SEQ ID NO: 982223 - RNA, 19 nt, Homo sapiens
cucugugagccguuuccaa

SEQ ID NO: 982224 - RNA, 21 nt, Homo sapiens
cugacccccaucgcucugagc

SEQ ID NO: 982225 - RNA, 20 nt, Homo sapiens
cugaggacccggcgcugagu

SEQ ID NO: 982226 - RNA, 20 nt, Homo sapiens
cugagguaaagguccaugaa

SEQ ID NO: 982227 - RNA, 14 nt, Homo sapiens
cugagucaccuccu

SEQ ID NO: 982228 - RNA, 18 nt, Homo sapiens
cugauggugucaucugcu

SEQ ID NO: 982229 - RNA, 16 nt, Homo sapiens
cugauuuauugaaauu

SEQ ID NO: 982230 - RNA, 12 nt, Homo sapiens
cugcaucuccac

SEQ ID NO: 982231 - RNA, 12 nt, Homo sapiens
cugcauguuccu

SEQ ID NO: 982232 - RNA, 14 nt, Homo sapiens
cugccucagccucc

SEQ ID NO: 982233 - RNA, 15 nt, Homo sapiens
cugcgucccugcuca

SEQ ID NO: 982234 - RNA, 14 nt, Homo sapiens
cuggauuugcauac

SEQ ID NO: 982235 - RNA, 16 nt, Homo sapiens
cuggccaccugccagg

SEQ ID NO: 982236 - RNA, 19 nt, Homo sapiens
cugggauuacaggcaccca

SEQ ID NO: 982237 - RNA, 20 nt, Homo sapiens
cuggucccccacgugugaag

SEQ ID NO: 982238 - RNA, 12 nt, Homo sapiens
cugucagucaug

SEQ ID NO: 982239 - RNA, 15 nt, Homo sapiens
cugucauacuuuguu

SEQ ID NO: 982240 - RNA, 13 nt, Homo sapiens
cugugacuccucc

SEQ ID NO: 982241 - RNA, 21 nt, Homo sapiens
cuguuggauuuuaagcaaaag

SEQ ID NO: 982242 - RNA, 12 nt, Homo sapiens
cuguuugucucg

SEQ ID NO: 982243 - RNA, 19 nt, Homo sapiens
cuuauauuguucacuucuu

SEQ ID NO: 982244 - RNA, 17 nt, Homo sapiens
cuucacccuguaauggu

SEQ ID NO: 982245 - RNA, 12 nt, Homo sapiens
cuucccagcaca

SEQ ID NO: 982246 - RNA, 18 nt, Homo sapiens
cuucucugauuaugugcc

SEQ ID NO: 982247 - RNA, 23 nt, Homo sapiens
cuucuguggcaacuuguacugaa

SEQ ID NO: 982248 - RNA, 16 nt, Homo sapiens
cuugacaggguuucac

SEQ ID NO: 982249 - RNA, 21 nt, Homo sapiens
cuugagauguggguauagcuc

SEQ ID NO: 982250 - RNA, 21 nt, Homo sapiens
cuuggcaguugcagugcugcu

SEQ ID NO: 982251 - RNA, 14 nt, Homo sapiens
cuugucuccauuug

SEQ ID NO: 982252 - RNA, 22 nt, Homo sapiens
cuuuaacuugucuucuaguuua

SEQ ID NO: 982253 - RNA, 15 nt, Homo sapiens
cuuuccaucugagga

SEQ ID NO: 982254 - RNA, 20 nt, Homo sapiens
cuuuucugacccauguucac

SEQ ID NO: 982255 - RNA, 20 nt, Homo sapiens
gaaagugagcaguguuagcu

SEQ ID NO: 982256 - RNA, 20 nt, Homo sapiens
gaaaugacaacaaggcccuu

SEQ ID NO: 982257 - RNA, 23 nt, Homo sapiens
gaaaugugucuugucuccauuug

SEQ ID NO: 982258 - RNA, 13 nt, Homo sapiens
gaacacacugagu

SEQ ID NO: 982259 - RNA, 16 nt, Homo sapiens
gaaccugguugcagga

SEQ ID NO: 982260 - RNA, 20 nt, Homo sapiens
gaacguacccaaggucacau

SEQ ID NO: 982261 - RNA, 18 nt, Homo sapiens
gaagaccaugaucucaau

SEQ ID NO: 982262 - RNA, 19 nt, Homo sapiens
gaagagaaaccauccucuc

SEQ ID NO: 982263 - RNA, 23 nt, Homo sapiens
gaauuccucuuuggccacaagaa

SEQ ID NO: 982264 - RNA, 14 nt, Homo sapiens
gacaacuuccucuc

SEQ ID NO: 982265 - RNA, 20 nt, Homo sapiens
gacaauuagauaaaugucca

SEQ ID NO: 982266 - RNA, 20 nt, Homo sapiens
gacagcucucugugcacuga

SEQ ID NO: 982267 - RNA, 18 nt, Homo sapiens
gacauuuaguagaauucc

SEQ ID NO: 982268 - RNA, 13 nt, Homo sapiens
gaccacgagcccu

SEQ ID NO: 982269 - RNA, 18 nt, Homo sapiens
gacgcuguccauugccac

SEQ ID NO: 982270 - RNA, 17 nt, Homo sapiens
gagacauccuucauuug

SEQ ID NO: 982271 - RNA, 18 nt, Homo sapiens
gagcccagcuacauuccu

SEQ ID NO: 982272 - RNA, 15 nt, Homo sapiens
gagcuugcaaugagc

SEQ ID NO: 982273 - RNA, 21 nt, Homo sapiens
gaggaacggaucagaugucua

SEQ ID NO: 982274 - RNA, 20 nt, Homo sapiens
gaggggcauagccuuucccu

SEQ ID NO: 982275 - RNA, 14 nt, Homo sapiens
gagggguauccucc

SEQ ID NO: 982276 - RNA, 13 nt, Homo sapiens
gaguagcuggaau

SEQ ID NO: 982277 - RNA, 14 nt, Homo sapiens
gaguggggcuuccu

SEQ ID NO: 982278 - RNA, 22 nt, Homo sapiens
gagugugggcauagcauuagcu

SEQ ID NO: 982279 - RNA, 16 nt, Homo sapiens
gaguugcgcugggaga

SEQ ID NO: 982280 - RNA, 15 nt, Homo sapiens
gauaaaaggaaccaa

SEQ ID NO: 982281 - RNA, 15 nt, Homo sapiens
gauacgacagcucuc

SEQ ID NO: 982282 - RNA, 22 nt, Homo sapiens
cccuggauuugcauacauucuu

SEQ ID NO: 982283 - RNA, 23 nt, Homo sapiens
ccgagcccagcuacauuccucag

SEQ ID NO: 982284 - RNA, 16 nt, Homo sapiens
ccgcgugugacagucu

SEQ ID NO: 982285 - RNA, 18 nt, Homo sapiens
ccggcacugcauguuccu

SEQ ID NO: 982286 - RNA, 23 nt, Homo sapiens
ccuaacccccagccccuccaugu

SEQ ID NO: 982287 - RNA, 18 nt, Homo sapiens
ccuacugccucuccagca

SEQ ID NO: 982288 - RNA, 19 nt, Homo sapiens
ccuacugccucuccagcac

SEQ ID NO: 982289 - RNA, 17 nt, Homo sapiens
ccucagccuccaaagua

SEQ ID NO: 982290 - RNA, 14 nt, Homo sapiens
ccuccaaagcccau

SEQ ID NO: 982291 - RNA, 18 nt, Homo sapiens
ccucggccucccaaagug

SEQ ID NO: 982292 - RNA, 18 nt, Homo sapiens
ccucuaggaaaagggaua

SEQ ID NO: 982293 - RNA, 22 nt, Homo sapiens
ccucucccauggugcccgugcc

SEQ ID NO: 982294 - RNA, 21 nt, Homo sapiens
ccugcauaugcuucugauggu

SEQ ID NO: 982295 - RNA, 16 nt, Homo sapiens
ccugccacuuugcaug

SEQ ID NO: 982296 - RNA, 20 nt, Homo sapiens
ccugccugagcccaggagcu

SEQ ID NO: 982297 - RNA, 14 nt, Homo sapiens
ccugcuccugccca

SEQ ID NO: 982298 - RNA, 23 nt, Homo sapiens
ccugcuccugcccacgugcagca

SEQ ID NO: 982299 - RNA, 19 nt, Homo sapiens
ccuggccgguaggcugcug

SEQ ID NO: 982300 - RNA, 20 nt, Homo sapiens
ccugggugacagagcaagac

SEQ ID NO: 982301 - RNA, 13 nt, Homo sapiens
ccuucuauccucu

SEQ ID NO: 982302 - RNA, 22 nt, Homo sapiens
ccuugacgcgagaggcucugag

SEQ ID NO: 982303 - RNA, 13 nt, Homo sapiens
ccuuuguugucua

SEQ ID NO: 982304 - RNA, 15 nt, Homo sapiens
cgagaggcucugagg

SEQ ID NO: 982305 - RNA, 19 nt, Homo sapiens
cgcaucguggugugucaau

SEQ ID NO: 982306 - RNA, 19 nt, Homo sapiens
cgccccucgcugcugcuac

SEQ ID NO: 982307 - RNA, 17 nt, Homo sapiens
cgccuagguuguguuga

SEQ ID NO: 982308 - RNA, 20 nt, Homo sapiens
cgcgugugacagucuugcau

SEQ ID NO: 982309 - RNA, 18 nt, Homo sapiens
cggacagcguguggcagu

SEQ ID NO: 982310 - RNA, 22 nt, Homo sapiens
cgggcccaggcccuagacccuc

SEQ ID NO: 982311 - RNA, 22 nt, Homo sapiens
cgguguuuggaggcugcugccc

SEQ ID NO: 982312 - RNA, 22 nt, Homo sapiens
guuuuucagguauauaccucca

SEQ ID NO: 982313 - RNA, 16 nt, Homo sapiens
uaaaaguguccauuga

SEQ ID NO: 982314 - RNA, 17 nt, Homo sapiens
uaaaaguguccauugaa

SEQ ID NO: 982315 - RNA, 18 nt, Homo sapiens
uaaacaguugcacagcau

SEQ ID NO: 982316 - RNA, 22 nt, Homo sapiens
uaaacaguugcacagcaucuca

SEQ ID NO: 982317 - RNA, 23 nt, Homo sapiens
uaaacaguugcacagcaucucag

SEQ ID NO: 982318 - RNA, 15 nt, Homo sapiens
uaaaccauugugcau

SEQ ID NO: 982319 - RNA, 18 nt, Homo sapiens
uaaaccauugugcauucu

SEQ ID NO: 982320 - RNA, 14 nt, Homo sapiens
uaaagguccaugaa

SEQ ID NO: 982321 - RNA, 15 nt, Homo sapiens
uaaaugcucuucuga

SEQ ID NO: 982322 - RNA, 19 nt, Homo sapiens
uaagcgguuuucuuaggca

SEQ ID NO: 982323 - RNA, 16 nt, Homo sapiens
uaaugguuggaacuaa

SEQ ID NO: 982324 - RNA, 18 nt, Homo sapiens
uacaagugcgcacuacca

SEQ ID NO: 982325 - RNA, 13 nt, Homo sapiens
uacacaugaucau

SEQ ID NO: 982326 - RNA, 19 nt, Homo sapiens
uacagaaagaaaaaugcau

SEQ ID NO: 982327 - RNA, 14 nt, Homo sapiens
uacauaauacuuga

SEQ ID NO: 982328 - RNA, 17 nt, Homo sapiens
uacauuccucagcugcc

SEQ ID NO: 982329 - RNA, 12 nt, Homo sapiens
uacauucuucaa

SEQ ID NO: 982330 - RNA, 13 nt, Homo sapiens
uacauucuucaag

SEQ ID NO: 982331 - RNA, 21 nt, Homo sapiens
uacauuuauuccuuccaagaa

SEQ ID NO: 982332 - RNA, 16 nt, Homo sapiens
uacccuuccugccaag

SEQ ID NO: 982333 - RNA, 16 nt, Homo sapiens
uaccguauguauuuau

SEQ ID NO: 982334 - RNA, 22 nt, Homo sapiens
uacuagucuuuuccucuaggaa

SEQ ID NO: 982335 - RNA, 15 nt, Homo sapiens
uacugcuauguguca

SEQ ID NO: 982336 - RNA, 17 nt, Homo sapiens
uacugcuaugugucaca

SEQ ID NO: 982337 - RNA, 16 nt, Homo sapiens
uacugucuaagcaguu

SEQ ID NO: 982338 - RNA, 16 nt, Homo sapiens
uacuguuuauaucuuc

SEQ ID NO: 982339 - RNA, 13 nt, Homo sapiens
uagaauuccucuu

SEQ ID NO: 982340 - RNA, 16 nt, Homo sapiens
uagauaaauguccauu

SEQ ID NO: 982341 - RNA, 23 nt, Homo sapiens
uagaucugagcccucccucuucc

SEQ ID NO: 982342 - RNA, 19 nt, Homo sapiens
acucgagaccauccuggcc

SEQ ID NO: 982343 - RNA, 14 nt, Homo sapiens
acugagaaaggcuc

SEQ ID NO: 982344 - RNA, 19 nt, Homo sapiens
acugauugcauaugcaucc

SEQ ID NO: 982345 - RNA, 12 nt, Homo sapiens
acugcaaccucu

SEQ ID NO: 982346 - RNA, 19 nt, Homo sapiens
acugcacccuggauuugca

SEQ ID NO: 982347 - RNA, 16 nt, Homo sapiens
acugccucuccagcac

SEQ ID NO: 982348 - RNA, 15 nt, Homo sapiens
acugggucucacucc

SEQ ID NO: 982349 - RNA, 18 nt, Homo sapiens
acuuccucucacuguugc

SEQ ID NO: 982350 - RNA, 15 nt, Homo sapiens
acuucuucauucucu

SEQ ID NO: 982351 - RNA, 11 nt, Homo sapiens
acuugggauag

SEQ ID NO: 982352 - RNA, 16 nt, Homo sapiens
acuuggucaccuugcc

SEQ ID NO: 982353 - RNA, 17 nt, Homo sapiens
acuugucuucuaguuua

SEQ ID NO: 982354 - RNA, 12 nt, Homo sapiens
agaaaagcagac

SEQ ID NO: 982355 - RNA, 17 nt, Homo sapiens
agaaacgcucaugacag

SEQ ID NO: 982356 - RNA, 23 nt, Homo sapiens
agaaagugagcaguguuagcuua

SEQ ID NO: 982357 - RNA, 23 nt, Homo sapiens
agaauuccucuuuggccacaaga

SEQ ID NO: 982358 - RNA, 22 nt, Homo sapiens
agacauugugcuagugcuuuua

SEQ ID NO: 982359 - RNA, 12 nt, Homo sapiens
agagaugcagug

SEQ ID NO: 982360 - RNA, 20 nt, Homo sapiens
agagugcaauggcaccaucu

SEQ ID NO: 982361 - RNA, 16 nt, Homo sapiens
agauaacagugugcuc

SEQ ID NO: 982362 - RNA, 16 nt, Homo sapiens
agaugaaauuccauuu

SEQ ID NO: 982363 - RNA, 17 nt, Homo sapiens
agauggggccugggcug

SEQ ID NO: 982364 - RNA, 15 nt, Homo sapiens
agauguagucuuacu

SEQ ID NO: 982365 - RNA, 22 nt, Homo sapiens
agauguagucuuacucugucac

SEQ ID NO: 982366 - RNA, 18 nt, Homo sapiens
agauguggguauagcuca

SEQ ID NO: 982367 - RNA, 13 nt, Homo sapiens
agcaaagucucca

SEQ ID NO: 982368 - RNA, 18 nt, Homo sapiens
agcaacaaguagagauga

SEQ ID NO: 982369 - RNA, 22 nt, Homo sapiens
agcaacauuuuuacauuuauuc

SEQ ID NO: 982370 - RNA, 10 nt, Homo sapiens
agcagucauc

SEQ ID NO: 982371 - RNA, 22 nt, Homo sapiens
agcaucucagcucaucuucacu

SEQ ID NO: 982372 - RNA, 18 nt, Homo sapiens
agcauuuucugcaucucc

SEQ ID NO: 982373 - RNA, 20 nt, Homo sapiens
agccaagauugcgccacugc

SEQ ID NO: 982374 - RNA, 21 nt, Homo sapiens
agccaagauugcgccacugca

SEQ ID NO: 982375 - RNA, 15 nt, Homo sapiens
agcccuccugagggg

SEQ ID NO: 982376 - RNA, 18 nt, Homo sapiens
agccgcgugugacagucu

SEQ ID NO: 982377 - RNA, 17 nt, Homo sapiens
agccgugucguaugacc

SEQ ID NO: 982378 - RNA, 19 nt, Homo sapiens
agccgugucguaugaccua

SEQ ID NO: 982379 - RNA, 13 nt, Homo sapiens
agccuacugccuc

SEQ ID NO: 982380 - RNA, 20 nt, Homo sapiens
agccuacugccucuccagca

SEQ ID NO: 982381 - RNA, 18 nt, Homo sapiens
agccugggcuccucugca

SEQ ID NO: 982382 - RNA, 15 nt, Homo sapiens
agccuuaugaguuag

SEQ ID NO: 982383 - RNA, 19 nt, Homo sapiens
agccuuucccuaauucugc

SEQ ID NO: 982384 - RNA, 17 nt, Homo sapiens
agcgaguugcgcuggga

SEQ ID NO: 982385 - RNA, 19 nt, Homo sapiens
agcuaaaaccuuccauguc

SEQ ID NO: 982386 - RNA, 20 nt, Homo sapiens
agcuaaaaccuuccauguca

SEQ ID NO: 982387 - RNA, 15 nt, Homo sapiens
agcugcacauuccug

SEQ ID NO: 982388 - RNA, 13 nt, Homo sapiens
agcugggauuuga

SEQ ID NO: 982389 - RNA, 18 nt, Homo sapiens
aggaaaggggcgagcacc

SEQ ID NO: 982390 - RNA, 21 nt, Homo sapiens
aggaaaggggcgagcacccac

SEQ ID NO: 982391 - RNA, 21 nt, Homo sapiens
aggaacccuuaaacaguugca

SEQ ID NO: 982392 - RNA, 17 nt, Homo sapiens
aggaguggacgcugucc

SEQ ID NO: 982393 - RNA, 20 nt, Homo sapiens
aggcacuucuuaacagacaa

SEQ ID NO: 982394 - RNA, 13 nt, Homo sapiens
aggcccaaugagg

SEQ ID NO: 982395 - RNA, 13 nt, Homo sapiens
aggccccagggcu

SEQ ID NO: 982396 - RNA, 21 nt, Homo sapiens
aggcuuccauugagaccaagg

SEQ ID NO: 982397 - RNA, 17 nt, Homo sapiens
agggaauaaaccuggca

SEQ ID NO: 982398 - RNA, 20 nt, Homo sapiens
aggguaagcugcucugaggu

SEQ ID NO: 982399 - RNA, 20 nt, Homo sapiens
aggguuucaccauguuggcu

SEQ ID NO: 982400 - RNA, 21 nt, Homo sapiens
aggucauaaguuucugagaug

SEQ ID NO: 982401 - RNA, 21 nt, Homo sapiens
agguuauuaugauuagcuuug

SEQ ID NO: 982402 - RNA, 16 nt, Homo sapiens
aguaugcuaugauuaa

SEQ ID NO: 982403 - RNA, 23 nt, Homo sapiens
agucaccuccuccacucacucca

SEQ ID NO: 982404 - RNA, 14 nt, Homo sapiens
agucaugucacuga

SEQ ID NO: 982405 - RNA, 22 nt, Homo sapiens
agugagacaaaauugaugaucc

SEQ ID NO: 982406 - RNA, 20 nt, Homo sapiens
aguuaaaauguuuacuguaa

SEQ ID NO: 982407 - RNA, 11 nt, Homo sapiens
aguugcacagc

SEQ ID NO: 982408 - RNA, 20 nt, Homo sapiens
aguugcgcugggagacgcug

SEQ ID NO: 982409 - RNA, 20 nt, Homo sapiens
aguuggggcuguucauggca

SEQ ID NO: 982410 - RNA, 14 nt, Homo sapiens
aguuuugucacaau

SEQ ID NO: 982411 - RNA, 17 nt, Homo sapiens
aguuuugucacaauuau

SEQ ID NO: 982412 - RNA, 21 nt, Homo sapiens
auaaguuucugagaugggaga

SEQ ID NO: 982413 - RNA, 16 nt, Homo sapiens
auacauucuucaagau

SEQ ID NO: 982414 - RNA, 13 nt, Homo sapiens
auaggacugagug

SEQ ID NO: 982415 - RNA, 19 nt, Homo sapiens
auagucaguuacugaugcu

SEQ ID NO: 982416 - RNA, 22 nt, Homo sapiens
auauauuuccacuucuucauuc

SEQ ID NO: 982417 - RNA, 17 nt, Homo sapiens
aucaagggccuacuuua

SEQ ID NO: 982418 - RNA, 20 nt, Homo sapiens
aucaccagcagacacugccg

SEQ ID NO: 982419 - RNA, 13 nt, Homo sapiens
aucccauguagaa

SEQ ID NO: 982420 - RNA, 15 nt, Homo sapiens
auccccaccuuccaa

SEQ ID NO: 982421 - RNA, 13 nt, Homo sapiens
auccccugccucu

SEQ ID NO: 982422 - RNA, 16 nt, Homo sapiens
aucccuccucacuugc

SEQ ID NO: 982423 - RNA, 19 nt, Homo sapiens
auccucucccuucuuacac

SEQ ID NO: 982424 - RNA, 21 nt, Homo sapiens
aucguggugugucaaugccac

SEQ ID NO: 982425 - RNA, 14 nt, Homo sapiens
aucuauuucauacc

SEQ ID NO: 982426 - RNA, 17 nt, Homo sapiens
augaaauuccauuugua

SEQ ID NO: 982427 - RNA, 18 nt, Homo sapiens
augacugcaaucaugugc

SEQ ID NO: 982428 - RNA, 19 nt, Homo sapiens
augauagaacuguacuguu

SEQ ID NO: 982429 - RNA, 16 nt, Homo sapiens
augauccagggauugg

SEQ ID NO: 982430 - RNA, 20 nt, Homo sapiens
augaucucaauagucaguua

SEQ ID NO: 982431 - RNA, 16 nt, Homo sapiens
augauuagcuuuguca

SEQ ID NO: 982432 - RNA, 11 nt, Homo sapiens
augcugggcuc

SEQ ID NO: 982433 - RNA, 23 nt, Homo sapiens
augcuuauauuguucacuucuuu

SEQ ID NO: 982434 - RNA, 15 nt, Homo sapiens
auggacagcugagca

SEQ ID NO: 982435 - RNA, 16 nt, Homo sapiens
auggcaccaucuuggc

SEQ ID NO: 982436 - RNA, 21 nt, Homo sapiens
augggccagcccuugcucuac

SEQ ID NO: 982437 - RNA, 15 nt, Homo sapiens
augguuacugaggac

SEQ ID NO: 982438 - RNA, 15 nt, Homo sapiens
auguaguaugcuaug

SEQ ID NO: 982439 - RNA, 12 nt, Homo sapiens
auuaaauuuacu

SEQ ID NO: 982440 - RNA, 19 nt, Homo sapiens
auuagcuuugucacuguuu

SEQ ID NO: 982441 - RNA, 24 nt, Homo sapiens
auuagcuuugucacuguuucacua

SEQ ID NO: 982442 - RNA, 19 nt, Homo sapiens
auuaggggguuuguugcac

SEQ ID NO: 982443 - RNA, 15 nt, Homo sapiens
auuccucagcugcca

SEQ ID NO: 982444 - RNA, 15 nt, Homo sapiens
auuccucccauucaa

SEQ ID NO: 982445 - RNA, 23 nt, Homo sapiens
auucuaaaacagacucaaugucc

SEQ ID NO: 982446 - RNA, 21 nt, Homo sapiens
auugaauugggggagucaugg

SEQ ID NO: 982447 - RNA, 23 nt, Homo sapiens
auugaccucagcugcacauuccu

SEQ ID NO: 982448 - RNA, 22 nt, Homo sapiens
auugacgaacuggcuacaguac

SEQ ID NO: 982449 - RNA, 17 nt, Homo sapiens
auugagaccaaggggag

SEQ ID NO: 982450 - RNA, 16 nt, Homo sapiens
auugcugaaugcaaga

SEQ ID NO: 982451 - RNA, 15 nt, Homo sapiens
auuucauaccaugga

SEQ ID NO: 982452 - RNA, 11 nt, Homo sapiens
auuugcuccug

SEQ ID NO: 982453 - RNA, 16 nt, Homo sapiens
auuuuaauaacauauc

SEQ ID NO: 982454 - RNA, 15 nt, Homo sapiens
auuuucugcaucucc

SEQ ID NO: 982455 - RNA, 16 nt, Homo sapiens
caaaauccaacuaaug

SEQ ID NO: 982456 - RNA, 19 nt, Homo sapiens
caaaauugaugauccauua

SEQ ID NO: 982457 - RNA, 14 nt, Homo sapiens
caaacaaugccauc

SEQ ID NO: 982458 - RNA, 17 nt, Homo sapiens
uaguuccugugcacagc

SEQ ID NO: 982459 - RNA, 17 nt, Homo sapiens
uaguugagaaagucaca

SEQ ID NO: 982460 - RNA, 22 nt, Homo sapiens
uauaagaaaagcagacgcagca

SEQ ID NO: 982461 - RNA, 20 nt, Homo sapiens
uauaccacuagagucuucag

SEQ ID NO: 982462 - RNA, 23 nt, Homo sapiens
uauauguaugguuguuacuaugg

SEQ ID NO: 982463 - RNA, 14 nt, Homo sapiens
uauccucuguauuu

SEQ ID NO: 982464 - RNA, 18 nt, Homo sapiens
uaugaugguggucaucca

SEQ ID NO: 982465 - RNA, 16 nt, Homo sapiens
uaugcucccucugugu

SEQ ID NO: 982466 - RNA, 14 nt, Homo sapiens
uauggaaggguaaa

SEQ ID NO: 982467 - RNA, 22 nt, Homo sapiens
uauggaaggguaaauacuggua

SEQ ID NO: 982468 - RNA, 19 nt, Homo sapiens
uauggcagacauugugcua

SEQ ID NO: 982469 - RNA, 14 nt, Homo sapiens
uauguaguaugcua

SEQ ID NO: 982470 - RNA, 13 nt, Homo sapiens
uauuaucaccagc

SEQ ID NO: 982471 - RNA, 15 nt, Homo sapiens
uauuucauaccaugg

SEQ ID NO: 982472 - RNA, 22 nt, Homo sapiens
ucaagcaaaucuccugccucag

SEQ ID NO: 982473 - RNA, 18 nt, Homo sapiens
gauagaacuguacuguuu

SEQ ID NO: 982474 - RNA, 15 nt, Homo sapiens
gauuacaggcaccca

SEQ ID NO: 982475 - RNA, 13 nt, Homo sapiens
gcaaaagcaucca

SEQ ID NO: 982476 - RNA, 19 nt, Homo sapiens
gcacccaccacaucuggcu

SEQ ID NO: 982477 - RNA, 20 nt, Homo sapiens
gcacccuggauuugcauaca

SEQ ID NO: 982478 - RNA, 20 nt, Homo sapiens
gcacuccagccugggugaca

SEQ ID NO: 982479 - RNA, 12 nt, Homo sapiens
gcacugauugca

SEQ ID NO: 982480 - RNA, 21 nt, Homo sapiens
gcagccuccucugugacuccc

SEQ ID NO: 982481 - RNA, 17 nt, Homo sapiens
gcagcugggauuugaac

SEQ ID NO: 982482 - RNA, 18 nt, Homo sapiens
gcagggguagaagcaaag

SEQ ID NO: 982483 - RNA, 19 nt, Homo sapiens
gcagggguagaagcaaagg

SEQ ID NO: 982484 - RNA, 23 nt, Homo sapiens
gcauauaugaugguggucaucca

SEQ ID NO: 982485 - RNA, 23 nt, Homo sapiens
gcaucguggugugucaaugccac

SEQ ID NO: 982486 - RNA, 19 nt, Homo sapiens
gcaugugccuguauuccca

SEQ ID NO: 982487 - RNA, 15 nt, Homo sapiens
gcauucauccaacag

SEQ ID NO: 982488 - RNA, 15 nt, Homo sapiens
gccaaucccuucucc

SEQ ID NO: 982489 - RNA, 13 nt, Homo sapiens
gccagaaauugau

SEQ ID NO: 982490 - RNA, 16 nt, Homo sapiens
ugggccuccaaagccc

SEQ ID NO: 982491 - RNA, 19 nt, Homo sapiens
uggggagucagucauguca

SEQ ID NO: 982492 - RNA, 16 nt, Homo sapiens
uggggcuguucauggc

SEQ ID NO: 982493 - RNA, 15 nt, Homo sapiens
ugggggaggcccaau

SEQ ID NO: 982494 - RNA, 16 nt, Homo sapiens
uggugugucaaugcca

SEQ ID NO: 982495 - RNA, 19 nt, Homo sapiens
uguaguggcauccauuucu

SEQ ID NO: 982496 - RNA, 16 nt, Homo sapiens
ugucacacuuugccaa

SEQ ID NO: 982497 - RNA, 20 nt, Homo sapiens
ugucacuguuucacuacuca

SEQ ID NO: 982498 - RNA, 15 nt, Homo sapiens
ugugacagucuugca

SEQ ID NO: 982499 - RNA, 22 nt, Homo sapiens
uguggcaguguuuaaaugcucu

SEQ ID NO: 982500 - RNA, 22 nt, Homo sapiens
ugugggcauagcauuagcugcu

SEQ ID NO: 982501 - RNA, 22 nt, Homo sapiens
uguguccguggaaccaguccua

SEQ ID NO: 982502 - RNA, 12 nt, Homo sapiens
uguuuacuguaa

SEQ ID NO: 982503 - RNA, 19 nt, Homo sapiens
ucacccaggcuagagugca

SEQ ID NO: 982504 - RNA, 21 nt, Homo sapiens
ucacccaggcuagagugcaau

SEQ ID NO: 982505 - RNA, 20 nt, Homo sapiens
ucacccccaccucaagguca

SEQ ID NO: 982506 - RNA, 15 nt, Homo sapiens
ucacugagaaaggcu

SEQ ID NO: 982507 - RNA, 19 nt, Homo sapiens
ucagccucccuuugccagc

SEQ ID NO: 982508 - RNA, 16 nt, Homo sapiens
ucagcugcacauuccu

SEQ ID NO: 982509 - RNA, 21 nt, Homo sapiens
ucagucaugcguccacuuucc

SEQ ID NO: 982510 - RNA, 16 nt, Homo sapiens
ucauagaaacugcuuu

SEQ ID NO: 982511 - RNA, 13 nt, Homo sapiens
ucaucagccuuuu

SEQ ID NO: 982512 - RNA, 14 nt, Homo sapiens
uccaagaagaccau

SEQ ID NO: 982513 - RNA, 14 nt, Homo sapiens
uccacucacuccag

SEQ ID NO: 982514 - RNA, 16 nt, Homo sapiens
uccaggagaccuucca

SEQ ID NO: 982515 - RNA, 15 nt, Homo sapiens
uccaucuucccuacc

SEQ ID NO: 982516 - RNA, 20 nt, Homo sapiens
ucccaaagugcugggauuac

SEQ ID NO: 982517 - RNA, 23 nt, Homo sapiens
ucccaaccucaaugcccugccau

SEQ ID NO: 982518 - RNA, 22 nt, Homo sapiens
ucccaccaacucugcacuccau

SEQ ID NO: 982519 - RNA, 23 nt, Homo sapiens
uccccaugcugggcucacuacau

SEQ ID NO: 982520 - RNA, 15 nt, Homo sapiens
uccccugucccacca

SEQ ID NO: 982521 - RNA, 20 nt, Homo sapiens
ucccgaguagcuggaauuac

SEQ ID NO: 982522 - RNA, 16 nt, Homo sapiens
ucccuaauucugccuu

SEQ ID NO: 982523 - RNA, 14 nt, Homo sapiens
ucccuaggcccuag

SEQ ID NO: 982524 - RNA, 21 nt, Homo sapiens
ucccucccgggggcacugccu

SEQ ID NO: 982525 - RNA, 22 nt, Homo sapiens
ucccucccgggggcacugccug

SEQ ID NO: 982526 - RNA, 19 nt, Homo sapiens
ucccuccucacuugcccug

SEQ ID NO: 982527 - RNA, 23 nt, Homo sapiens
ucccucgggcuggugucuugaga

SEQ ID NO: 982528 - RNA, 16 nt, Homo sapiens
ucccugcauaugcuuc

SEQ ID NO: 982529 - RNA, 15 nt, Homo sapiens
uccguuccuccucag

SEQ ID NO: 982530 - RNA, 17 nt, Homo sapiens
uccuccccuccuggcac

SEQ ID NO: 982531 - RNA, 15 nt, Homo sapiens
uccucucacuguugc

SEQ ID NO: 982532 - RNA, 22 nt, Homo sapiens
uccucuguauuugucauuccuc

SEQ ID NO: 982533 - RNA, 15 nt, Homo sapiens
uccuucuguggcaac

SEQ ID NO: 982534 - RNA, 14 nt, Homo sapiens
ucgcacagggcaug

SEQ ID NO: 982535 - RNA, 23 nt, Homo sapiens
ucguggggggagguggacagucc

SEQ ID NO: 982536 - RNA, 16 nt, Homo sapiens
ucuacauuaaaucacu

SEQ ID NO: 982537 - RNA, 21 nt, Homo sapiens
ucuacauuaaaucacuugaau

SEQ ID NO: 982538 - RNA, 12 nt, Homo sapiens
ucuagcucuggu

SEQ ID NO: 982539 - RNA, 21 nt, Homo sapiens
ucuauauugcugaaugcaaga

SEQ ID NO: 982540 - RNA, 15 nt, Homo sapiens
ucucugugcacugau

SEQ ID NO: 982541 - RNA, 19 nt, Homo sapiens
ucugcaucuccacuuggca

SEQ ID NO: 982542 - RNA, 23 nt, Homo sapiens
ucugccuguggccuugcccgcca

SEQ ID NO: 982543 - RNA, 21 nt, Homo sapiens
ucuguggccuuggcccugacc

SEQ ID NO: 982544 - RNA, 15 nt, Homo sapiens
ucuguuccacauaua

SEQ ID NO: 982545 - RNA, 17 nt, Homo sapiens
ucuuacucugucaccca

SEQ ID NO: 982546 - RNA, 11 nt, Homo sapiens
ucuuaggcacu

SEQ ID NO: 982547 - RNA, 19 nt, Homo sapiens
ucuugguaaacaacagacu

SEQ ID NO: 982548 - RNA, 15 nt, Homo sapiens
ugaaaaucuggugcu

SEQ ID NO: 982549 - RNA, 17 nt, Homo sapiens
ugaaacccuccuucugu

SEQ ID NO: 982550 - RNA, 21 nt, Homo sapiens
ugaacccuauguguccauuuc

SEQ ID NO: 982551 - RNA, 16 nt, Homo sapiens
ugacagucuugcauuc

SEQ ID NO: 982552 - RNA, 19 nt, Homo sapiens
ugaccucaagugaucugcc

SEQ ID NO: 982553 - RNA, 19 nt, Homo sapiens
ugacuaaaccauugugcau

SEQ ID NO: 982554 - RNA, 18 nt, Homo sapiens
ugagaaacgcucaugaca

SEQ ID NO: 982555 - RNA, 15 nt, Homo sapiens
ugagcacuaaaggaa

SEQ ID NO: 982556 - RNA, 19 nt, Homo sapiens
ugagggaauaaaccuggca

SEQ ID NO: 982557 - RNA, 19 nt, Homo sapiens
ugauacgacagcucucugu

SEQ ID NO: 982558 - RNA, 23 nt, Homo sapiens
ugauacgacagcucucugugcac

SEQ ID NO: 982559 - RNA, 14 nt, Homo sapiens
ugaucuggcccaag

SEQ ID NO: 982560 - RNA, 19 nt, Homo sapiens
ugauucaggcuuccauuga

SEQ ID NO: 982561 - RNA, 18 nt, Homo sapiens
ugcaaucaugugcuucau

SEQ ID NO: 982562 - RNA, 22 nt, Homo sapiens
ugcacccuggauuugcauacau

SEQ ID NO: 982563 - RNA, 17 nt, Homo sapiens
ugcagcugggauuugaa

SEQ ID NO: 982564 - RNA, 12 nt, Homo sapiens
ugcauaugcuuc

SEQ ID NO: 982565 - RNA, 19 nt, Homo sapiens
ugcauaugcuucugauggu

SEQ ID NO: 982566 - RNA, 17 nt, Homo sapiens
ugcccagccuuguuugc

SEQ ID NO: 982567 - RNA, 19 nt, Homo sapiens
ugcccucucccauggugcc

SEQ ID NO: 982568 - RNA, 17 nt, Homo sapiens
ugccucuccagcacuuc

SEQ ID NO: 982569 - RNA, 14 nt, Homo sapiens
ugccugagcccagg

SEQ ID NO: 982570 - RNA, 18 nt, Homo sapiens
ugcggaaaugugucuugu

SEQ ID NO: 982571 - RNA, 13 nt, Homo sapiens
ugcuaugugucac

SEQ ID NO: 982572 - RNA, 21 nt, Homo sapiens
ugcuguguaugugaaccaccc

SEQ ID NO: 982573 - RNA, 16 nt, Homo sapiens
uggaaggguaaauacu

SEQ ID NO: 982574 - RNA, 19 nt, Homo sapiens
uggaggggcauagccuuuc

SEQ ID NO: 982575 - RNA, 21 nt, Homo sapiens
uggcuaggauaguuucaccag

SEQ ID NO: 982576 - RNA, 13 nt, Homo sapiens
uggcucacugcaa

SEQ ID NO: 982577 - RNA, 16 nt, Homo sapiens
uggcuucuccuuggcu

SEQ ID NO: 982578 - RNA, 19 nt, Homo sapiens
ugggaccugauuuauugaa

SEQ ID NO: 982579 - RNA, 15 nt, Homo sapiens
ugggauuugcuccug

SEQ ID NO: 982580 - RNA, 19 nt, Homo sapiens
ugggcucccuuuaagccaa

SEQ ID NO: 982581 - RNA, 22 nt, Homo sapiens
uggggagucagucaugucacug

SEQ ID NO: 982582 - RNA, 13 nt, Homo sapiens
uguaaauguacug

SEQ ID NO: 982583 - RNA, 14 nt, Homo sapiens
uguaccacauaaca

SEQ ID NO: 982584 - RNA, 16 nt, Homo sapiens
uguaugcauucaucca

SEQ ID NO: 982585 - RNA, 17 nt, Homo sapiens
uguaugugaaccaccca

SEQ ID NO: 982586 - RNA, 23 nt, Homo sapiens
ugucaagauucagcuaguggcca

SEQ ID NO: 982587 - RNA, 15 nt, Homo sapiens
ugucacuguuucacu

SEQ ID NO: 982588 - RNA, 18 nt, Homo sapiens
ugucuacauuaaaucacu

SEQ ID NO: 982589 - RNA, 21 nt, Homo sapiens
ugugaaguguaguggcaucca

SEQ ID NO: 982590 - RNA, 13 nt, Homo sapiens
ugugacagucuug

SEQ ID NO: 982591 - RNA, 13 nt, Homo sapiens
ugugcucauagaa

SEQ ID NO: 982592 - RNA, 15 nt, Homo sapiens
uguggccucauccaa

SEQ ID NO: 982593 - RNA, 14 nt, Homo sapiens
ugugucaaugccac

SEQ ID NO: 982594 - RNA, 21 nt, Homo sapiens
uguguccauuucugcacacac

SEQ ID NO: 982595 - RNA, 20 nt, Homo sapiens
uuaauaagauuuucugggau

SEQ ID NO: 982596 - RNA, 22 nt, Homo sapiens
uuaauuuuccuuugucauuucc

SEQ ID NO: 982597 - RNA, 18 nt, Homo sapiens
uuacaccgugaggccaag

SEQ ID NO: 982598 - RNA, 18 nt, Homo sapiens
uuacauaauacuugaaaa

SEQ ID NO: 982599 - RNA, 19 nt, Homo sapiens
uuauuguuuucuacugcua

SEQ ID NO: 982600 - RNA, 17 nt, Homo sapiens
uuccaugucaagauuca

SEQ ID NO: 982601 - RNA, 13 nt, Homo sapiens
uuccucccauuca

SEQ ID NO: 982602 - RNA, 13 nt, Homo sapiens
uuccuccucagcc

SEQ ID NO: 982603 - RNA, 19 nt, Homo sapiens
uuccuggacaccacccaga

SEQ ID NO: 982604 - RNA, 14 nt, Homo sapiens
uuccugugcacagc

SEQ ID NO: 982605 - RNA, 20 nt, Homo sapiens
uucgagagcagccuggccaa

SEQ ID NO: 982606 - RNA, 12 nt, Homo sapiens
uucugcacacac

SEQ ID NO: 982607 - RNA, 15 nt, Homo sapiens
uucuucaagauccca

SEQ ID NO: 982608 - RNA, 17 nt, Homo sapiens
uucuuugaaaauucugg

SEQ ID NO: 982609 - RNA, 21 nt, Homo sapiens
uugaaagugcuucaaggguaa

SEQ ID NO: 982610 - RNA, 11 nt, Homo sapiens
uugacauuccu

SEQ ID NO: 982611 - RNA, 13 nt, Homo sapiens
uugaccuuuccag

SEQ ID NO: 982612 - RNA, 15 nt, Homo sapiens
uugacgaacuggcua

SEQ ID NO: 982613 - RNA, 20 nt, Homo sapiens
uugcaauuggaauaaucacu

SEQ ID NO: 982614 - RNA, 14 nt, Homo sapiens
uuggaauaaucacu

SEQ ID NO: 982615 - RNA, 18 nt, Homo sapiens
uuggccaggcugaucuca

SEQ ID NO: 982616 - RNA, 17 nt, Homo sapiens
uugggggagucaugguc

SEQ ID NO: 982617 - RNA, 18 nt, Homo sapiens
uugggggagucaugguca

SEQ ID NO: 982618 - RNA, 15 nt, Homo sapiens
uuguacaauacuugc

SEQ ID NO: 982619 - RNA, 21 nt, Homo sapiens
aggccaagaggcuguucccac

SEQ ID NO: 982620 - RNA, 18 nt, Homo sapiens
aggccccugucucagggu

SEQ ID NO: 982621 - RNA, 14 nt, Homo sapiens
aggccugacugcca

SEQ ID NO: 982622 - RNA, 14 nt, Homo sapiens
aggccuuucccuaa

SEQ ID NO: 982623 - RNA, 14 nt, Homo sapiens
aggcucuaauguac

SEQ ID NO: 982624 - RNA, 15 nt, Homo sapiens
aggcucuaauguaca

SEQ ID NO: 982625 - RNA, 16 nt, Homo sapiens
aggcugcucagggcug

SEQ ID NO: 982626 - RNA, 15 nt, Homo sapiens
aggcuggagugcagu

SEQ ID NO: 982627 - RNA, 16 nt, Homo sapiens
aggcuggagugcagug

SEQ ID NO: 982628 - RNA, 17 nt, Homo sapiens
aggcuggagugcagugg

SEQ ID NO: 982629 - RNA, 13 nt, Homo sapiens
aggcuggucucaa

SEQ ID NO: 982630 - RNA, 16 nt, Homo sapiens
agggaaugugaaauuu

SEQ ID NO: 982631 - RNA, 17 nt, Homo sapiens
agggaccuugucuccca

SEQ ID NO: 982632 - RNA, 17 nt, Homo sapiens
agggagugggcuaagca

SEQ ID NO: 982633 - RNA, 15 nt, Homo sapiens
agggauuuucagccc

SEQ ID NO: 982634 - RNA, 16 nt, Homo sapiens
agggccuguaauccca

SEQ ID NO: 982635 - RNA, 16 nt, Homo sapiens
agggcugucuucguau

SEQ ID NO: 982636 - RNA, 21 nt, Homo sapiens
agggggaggcuaaagcccaga

SEQ ID NO: 982637 - RNA, 21 nt, Homo sapiens
agggugaggugcuugagucuc

SEQ ID NO: 982638 - RNA, 14 nt, Homo sapiens
agguaaaagcauca

SEQ ID NO: 982639 - RNA, 20 nt, Homo sapiens
agguccuuaggccucugaga

SEQ ID NO: 982640 - RNA, 17 nt, Homo sapiens
aggugcuugagucucca

SEQ ID NO: 982641 - RNA, 14 nt, Homo sapiens
agguucagccugaa

SEQ ID NO: 982642 - RNA, 14 nt, Homo sapiens
agguuggagugcag

SEQ ID NO: 982643 - RNA, 15 nt, Homo sapiens
aguaaagaacauccc

SEQ ID NO: 982644 - RNA, 23 nt, Homo sapiens
aguaaucauauuguuacugguac

SEQ ID NO: 982645 - RNA, 21 nt, Homo sapiens
aguacaccccaacagcacccu

SEQ ID NO: 982646 - RNA, 18 nt, Homo sapiens
aguacuccccuccuugaa

SEQ ID NO: 982647 - RNA, 15 nt, Homo sapiens
aguacuuugugcauu

SEQ ID NO: 982648 - RNA, 19 nt, Homo sapiens
aguagagacaggguuucac

SEQ ID NO: 982649 - RNA, 20 nt, Homo sapiens
aguauaauauuaauaauacc

SEQ ID NO: 982650 - RNA, 14 nt, Homo sapiens
aguauccaagguua

SEQ ID NO: 982651 - RNA, 20 nt, Homo sapiens
aguauuccagaccugaagaa

SEQ ID NO: 982652 - RNA, 21 nt, Homo sapiens
aguauuuaauucauguugccu

SEQ ID NO: 982653 - RNA, 16 nt, Homo sapiens
agucacagcuacacag

SEQ ID NO: 982654 - RNA, 14 nt, Homo sapiens
agucauuggcuuua

SEQ ID NO: 982655 - RNA, 20 nt, Homo sapiens
aguccccagccugcucccua

SEQ ID NO: 982656 - RNA, 17 nt, Homo sapiens
agucuuauuuccucaac

SEQ ID NO: 982657 - RNA, 13 nt, Homo sapiens
agucuugccuugc

SEQ ID NO: 982658 - RNA, 16 nt, Homo sapiens
agugaaaaacuauuaa

SEQ ID NO: 982659 - RNA, 20 nt, Homo sapiens
agugaacauucgaccuccau

SEQ ID NO: 982660 - RNA, 12 nt, Homo sapiens
agugaaggauuu

SEQ ID NO: 982661 - RNA, 20 nt, Homo sapiens
agugacagagcaagacccca

SEQ ID NO: 982662 - RNA, 22 nt, Homo sapiens
agugauaucccccagccucaag

SEQ ID NO: 982663 - RNA, 12 nt, Homo sapiens
agugauuuccac

SEQ ID NO: 982664 - RNA, 12 nt, Homo sapiens
agugcaccacuu

SEQ ID NO: 982665 - RNA, 21 nt, Homo sapiens
agugcaguggcgugaucucag

SEQ ID NO: 982666 - RNA, 19 nt, Homo sapiens
agugccgacagcucuccaa

SEQ ID NO: 982667 - RNA, 18 nt, Homo sapiens
agugccuuucuucucucc

SEQ ID NO: 982668 - RNA, 14 nt, Homo sapiens
aguggauuuuacau

SEQ ID NO: 982669 - RNA, 17 nt, Homo sapiens
aguggcaucaucucagc

SEQ ID NO: 982670 - RNA, 15 nt, Homo sapiens
aguggcgugaucuca

SEQ ID NO: 982671 - RNA, 20 nt, Homo sapiens
aguggcgugaucucagcuca

SEQ ID NO: 982672 - RNA, 17 nt, Homo sapiens
agugggagccagggcug

SEQ ID NO: 982673 - RNA, 17 nt, Homo sapiens
agugggugguagcagag

SEQ ID NO: 982674 - RNA, 15 nt, Homo sapiens
aguguaccagagaag

SEQ ID NO: 982675 - RNA, 14 nt, Homo sapiens
aguguggccugagu

SEQ ID NO: 982676 - RNA, 17 nt, Homo sapiens
aguguuugaaagcuuua

SEQ ID NO: 982677 - RNA, 17 nt, Homo sapiens
aguuagaacuagccaaa

SEQ ID NO: 982678 - RNA, 22 nt, Homo sapiens
aguucaaguccugccucuuaaa

SEQ ID NO: 982679 - RNA, 18 nt, Homo sapiens
aguugcaacuuuguauaa

SEQ ID NO: 982680 - RNA, 17 nt, Homo sapiens
aguugcauugacuguca

SEQ ID NO: 982681 - RNA, 15 nt, Homo sapiens
aguuuaauaccacag

SEQ ID NO: 982682 - RNA, 18 nt, Homo sapiens
auaaaaugaauacaauua

SEQ ID NO: 982683 - RNA, 15 nt, Homo sapiens
auaaagcaauguggu

SEQ ID NO: 982684 - RNA, 14 nt, Homo sapiens
auaaagucuugccu

SEQ ID NO: 982685 - RNA, 12 nt, Homo sapiens
auaaagugcuuu

SEQ ID NO: 982686 - RNA, 21 nt, Homo sapiens
auaaaucuaucaaaauuaccc

SEQ ID NO: 982687 - RNA, 20 nt, Homo sapiens
auaaauguaccuucacacca

SEQ ID NO: 982688 - RNA, 23 nt, Homo sapiens
auaaauguaccuucacaccaaua

SEQ ID NO: 982689 - RNA, 12 nt, Homo sapiens
auaacaaugaaa

SEQ ID NO: 982690 - RNA, 22 nt, Homo sapiens
auaacgauaaaagacagugaaa

SEQ ID NO: 982691 - RNA, 13 nt, Homo sapiens
auaauaacuggga

SEQ ID NO: 982692 - RNA, 22 nt, Homo sapiens
auaaucauucuuauuucaugaa

SEQ ID NO: 982693 - RNA, 15 nt, Homo sapiens
auaaugcucauacuu

SEQ ID NO: 982694 - RNA, 14 nt, Homo sapiens
auaauucuaugaga

SEQ ID NO: 982695 - RNA, 21 nt, Homo sapiens
auaauuuucuaccuggucucu

SEQ ID NO: 982696 - RNA, 23 nt, Homo sapiens
auaauuuucuaccuggucucucc

SEQ ID NO: 982697 - RNA, 16 nt, Homo sapiens
auaauuuuucacuuca

SEQ ID NO: 982698 - RNA, 20 nt, Homo sapiens
auacaaaacccuuucugccc

SEQ ID NO: 982699 - RNA, 14 nt, Homo sapiens
auacaauuaaagcu

SEQ ID NO: 982700 - RNA, 18 nt, Homo sapiens
auacaauuaaagcuguua

SEQ ID NO: 982701 - RNA, 14 nt, Homo sapiens
auacaccuauguca

SEQ ID NO: 982702 - RNA, 19 nt, Homo sapiens
auacaugcauacacucuca

SEQ ID NO: 982703 - RNA, 20 nt, Homo sapiens
auacaugcauacacucucaa

SEQ ID NO: 982704 - RNA, 10 nt, Homo sapiens
auagaauuau

SEQ ID NO: 982705 - RNA, 19 nt, Homo sapiens
auagauaggucagugcaaa

SEQ ID NO: 982706 - RNA, 12 nt, Homo sapiens
auagaucagcca

SEQ ID NO: 982707 - RNA, 12 nt, Homo sapiens
auagcuaaaaaa

SEQ ID NO: 982708 - RNA, 16 nt, Homo sapiens
auauaagcugccauau

SEQ ID NO: 982709 - RNA, 14 nt, Homo sapiens
auauaagugcugua

SEQ ID NO: 982710 - RNA, 23 nt, Homo sapiens
auauacauacaugcauacacucu

SEQ ID NO: 982711 - RNA, 20 nt, Homo sapiens
auauacuugguucucuccac

SEQ ID NO: 982712 - RNA, 14 nt, Homo sapiens
auauauauacauac

SEQ ID NO: 982713 - RNA, 15 nt, Homo sapiens
auauauuccaccagg

SEQ ID NO: 982714 - RNA, 17 nt, Homo sapiens
auauauuccaccaggau

SEQ ID NO: 982715 - RNA, 16 nt, Homo sapiens
auauccagauggcaug

SEQ ID NO: 982716 - RNA, 18 nt, Homo sapiens
auauccaggcaccaggac

SEQ ID NO: 982717 - RNA, 14 nt, Homo sapiens
auaucugccuuuau

SEQ ID NO: 982718 - RNA, 22 nt, Homo sapiens
auaugaggcuguugucuuuucc

SEQ ID NO: 982719 - RNA, 19 nt, Homo sapiens
auaugguguacauucuucc

SEQ ID NO: 982720 - RNA, 16 nt, Homo sapiens
auauuuaguguucaua

SEQ ID NO: 982721 - RNA, 22 nt, Homo sapiens
aucaaauugugcaguacuuugu

SEQ ID NO: 982722 - RNA, 18 nt, Homo sapiens
aucaagacugcaaacccu

SEQ ID NO: 982723 - RNA, 17 nt, Homo sapiens
aucacauuccucugccc

SEQ ID NO: 982724 - RNA, 10 nt, Homo sapiens
aucaccacug

SEQ ID NO: 982725 - RNA, 19 nt, Homo sapiens
aucauauuguuacugguac

SEQ ID NO: 982726 - RNA, 11 nt, Homo sapiens
aucaucucagc

SEQ ID NO: 982727 - RNA, 14 nt, Homo sapiens
aucaucucagcuca

SEQ ID NO: 982728 - RNA, 15 nt, Homo sapiens
aucaugugaaaucau

SEQ ID NO: 982729 - RNA, 16 nt, Homo sapiens
auccacuaaaaucaaa

SEQ ID NO: 982730 - RNA, 19 nt, Homo sapiens
aucccccagccucaagucu

SEQ ID NO: 982731 - RNA, 19 nt, Homo sapiens
auccuaucucuccaaccag

SEQ ID NO: 982732 - RNA, 21 nt, Homo sapiens
auccucuugccaaaucaaaag

SEQ ID NO: 982733 - RNA, 23 nt, Homo sapiens
aucgcagauucucccuugcucug

SEQ ID NO: 982734 - RNA, 18 nt, Homo sapiens
aucuaccacuguaugagu

SEQ ID NO: 982735 - RNA, 23 nt, Homo sapiens
aucuagaggcuuccuucauuucc

SEQ ID NO: 982736 - RNA, 17 nt, Homo sapiens
aucucagcucacugcaa

SEQ ID NO: 982737 - RNA, 12 nt, Homo sapiens
aucucugugaaa

SEQ ID NO: 982738 - RNA, 17 nt, Homo sapiens
aucucugugaaaccccu

SEQ ID NO: 982739 - RNA, 19 nt, Homo sapiens
aucucuucuuuuaaaccau

SEQ ID NO: 982740 - RNA, 19 nt, Homo sapiens
aucugagaaaagcuuugaa

SEQ ID NO: 982741 - RNA, 21 nt, Homo sapiens
aucugaggcacaugucagcaa

SEQ ID NO: 982742 - RNA, 18 nt, Homo sapiens
aucugggcugugggcaag

SEQ ID NO: 982743 - RNA, 16 nt, Homo sapiens
aucuuucacuaucugu

SEQ ID NO: 982744 - RNA, 13 nt, Homo sapiens
augaagcuuuuau

SEQ ID NO: 982745 - RNA, 23 nt, Homo sapiens
augaaggugucauacagauuugc

SEQ ID NO: 982746 - RNA, 14 nt, Homo sapiens
augaauguaaauuu

SEQ ID NO: 982747 - RNA, 21 nt, Homo sapiens
augacgucaucaucacauuca

SEQ ID NO: 982748 - RNA, 15 nt, Homo sapiens
augagcaaaaccaaa

SEQ ID NO: 982749 - RNA, 22 nt, Homo sapiens
augaggaauuucuguucuucca

SEQ ID NO: 982750 - RNA, 14 nt, Homo sapiens
cuaauaguuuuauu

SEQ ID NO: 982751 - RNA, 13 nt, Homo sapiens
cuaauguacaaua

SEQ ID NO: 982752 - RNA, 19 nt, Homo sapiens
cuaauguacaauaaagcaa

SEQ ID NO: 982753 - RNA, 21 nt, Homo sapiens
cuaauguacaauaaagcaaug

SEQ ID NO: 982754 - RNA, 21 nt, Homo sapiens
cuaauuucuauuugaucugau

SEQ ID NO: 982755 - RNA, 15 nt, Homo sapiens
cuacacauacaugua

SEQ ID NO: 982756 - RNA, 12 nt, Homo sapiens
cuacaugcacuu

SEQ ID NO: 982757 - RNA, 12 nt, Homo sapiens
cuaccacuguau

SEQ ID NO: 982758 - RNA, 14 nt, Homo sapiens
cuaccuaccaagau

SEQ ID NO: 982759 - RNA, 14 nt, Homo sapiens
cuacugcucugugu

SEQ ID NO: 982760 - RNA, 18 nt, Homo sapiens
cuacugcucuguguuuac

SEQ ID NO: 982761 - RNA, 18 nt, Homo sapiens
cuacuguaaggcaaucau

SEQ ID NO: 982762 - RNA, 16 nt, Homo sapiens
cuacuuacaugcauua

SEQ ID NO: 982763 - RNA, 12 nt, Homo sapiens
cuagagacucaa

SEQ ID NO: 982764 - RNA, 16 nt, Homo sapiens
cuagccagaggcucua

SEQ ID NO: 982765 - RNA, 17 nt, Homo sapiens
cuagccagaggcucuaa

SEQ ID NO: 982766 - RNA, 13 nt, Homo sapiens
cuagucauaaccu

SEQ ID NO: 982767 - RNA, 15 nt, Homo sapiens
cuagucauaaccuua

SEQ ID NO: 982768 - RNA, 23 nt, Homo sapiens
cuaguccccagccugcucccuag

SEQ ID NO: 982769 - RNA, 18 nt, Homo sapiens
cuauaguccagcuuuguu

SEQ ID NO: 982770 - RNA, 13 nt, Homo sapiens
cuauucuccauac

SEQ ID NO: 982771 - RNA, 16 nt, Homo sapiens
cuauucuugauguaaa

SEQ ID NO: 982772 - RNA, 22 nt, Homo sapiens
cucaaacuccugaccucaggca

SEQ ID NO: 982773 - RNA, 23 nt, Homo sapiens
cucaaacuccugaccucaggcaa

SEQ ID NO: 982774 - RNA, 23 nt, Homo sapiens
cucaaagcaaauaauuuuucacu

SEQ ID NO: 982775 - RNA, 16 nt, Homo sapiens
cucacauccauucuuc

SEQ ID NO: 982776 - RNA, 17 nt, Homo sapiens
cucacaugauuccagcc

SEQ ID NO: 982777 - RNA, 18 nt, Homo sapiens
cucacugcaaccuccacc

SEQ ID NO: 982778 - RNA, 10 nt, Homo sapiens
cucacuuuug

SEQ ID NO: 982779 - RNA, 20 nt, Homo sapiens
cucagacacaaauaaaggaa

SEQ ID NO: 982780 - RNA, 14 nt, Homo sapiens
cucagagacauaca

SEQ ID NO: 982781 - RNA, 15 nt, Homo sapiens
cucaggaugagggaa

SEQ ID NO: 982782 - RNA, 17 nt, Homo sapiens
cucaguucccucuugcu

SEQ ID NO: 982783 - RNA, 19 nt, Homo sapiens
cucauaacucugugaucuu

SEQ ID NO: 982784 - RNA, 14 nt, Homo sapiens
cucaucauuuccau

SEQ ID NO: 982785 - RNA, 15 nt, Homo sapiens
cucauccugcaggca

SEQ ID NO: 982786 - RNA, 21 nt, Homo sapiens
cucaucuccccaucauuggua

SEQ ID NO: 982787 - RNA, 13 nt, Homo sapiens
cucauuguagaaa

SEQ ID NO: 982788 - RNA, 12 nt, Homo sapiens
cuccaacaauaa

SEQ ID NO: 982789 - RNA, 19 nt, Homo sapiens
cuccagcugcucugucuuc

SEQ ID NO: 982790 - RNA, 22 nt, Homo sapiens
cuccaggcaggucugaagcuca

SEQ ID NO: 982791 - RNA, 20 nt, Homo sapiens
cucccaagcaccugggauua

SEQ ID NO: 982792 - RNA, 19 nt, Homo sapiens
cucccaccaccucaccagu

SEQ ID NO: 982793 - RNA, 16 nt, Homo sapiens
cuccccaucauuggua

SEQ ID NO: 982794 - RNA, 13 nt, Homo sapiens
cuccucauucaca

SEQ ID NO: 982795 - RNA, 16 nt, Homo sapiens
cuccucucccagugac

SEQ ID NO: 982796 - RNA, 21 nt, Homo sapiens
cuccugggaaugaagcaaugc

SEQ ID NO: 982797 - RNA, 18 nt, Homo sapiens
cuccuucccuugcuucuu

SEQ ID NO: 982798 - RNA, 15 nt, Homo sapiens
cuccuuucucaucuu

SEQ ID NO: 982799 - RNA, 17 nt, Homo sapiens
cucgcccagcggcauca

SEQ ID NO: 982800 - RNA, 20 nt, Homo sapiens
cucuaauauguaaaauuaca

SEQ ID NO: 982801 - RNA, 22 nt, Homo sapiens
cucuaauguacaauaaagcaau

SEQ ID NO: 982802 - RNA, 17 nt, Homo sapiens
cucuaugguguggcaaa

SEQ ID NO: 982803 - RNA, 17 nt, Homo sapiens
cucuccaauacucaggu

SEQ ID NO: 982804 - RNA, 13 nt, Homo sapiens
cucuccaccaggu

SEQ ID NO: 982805 - RNA, 16 nt, Homo sapiens
cucuccaccagguucu

SEQ ID NO: 982806 - RNA, 21 nt, Homo sapiens
cucucccagugacaaccaaaa

SEQ ID NO: 982807 - RNA, 14 nt, Homo sapiens
cucucucaaagugc

SEQ ID NO: 982808 - RNA, 19 nt, Homo sapiens
cucugaauuugagauacaa

SEQ ID NO: 982809 - RNA, 21 nt, Homo sapiens
cucugagcagugcuugaauga

SEQ ID NO: 982810 - RNA, 19 nt, Homo sapiens
cucugagucccagagccaa

SEQ ID NO: 982811 - RNA, 15 nt, Homo sapiens
cucuggggcauuauc

SEQ ID NO: 982812 - RNA, 18 nt, Homo sapiens
cucuguauacaaaacccu

SEQ ID NO: 982813 - RNA, 21 nt, Homo sapiens
cucuguauuccuagaaacuga

SEQ ID NO: 982814 - RNA, 15 nt, Homo sapiens
cucugucuccuaagc

SEQ ID NO: 982815 - RNA, 15 nt, Homo sapiens
cucugugucuucaaa

SEQ ID NO: 982816 - RNA, 17 nt, Homo sapiens
cucuuacuuauuaucuu

SEQ ID NO: 982817 - RNA, 13 nt, Homo sapiens
cucuugaaucucu

SEQ ID NO: 982818 - RNA, 18 nt, Homo sapiens
cucuugccucaaccuccc

SEQ ID NO: 982819 - RNA, 12 nt, Homo sapiens
cugaaaauugau

SEQ ID NO: 982820 - RNA, 16 nt, Homo sapiens
cugaaaggaagcugug

SEQ ID NO: 982821 - RNA, 16 nt, Homo sapiens
cugaacaucacagcuu

SEQ ID NO: 982822 - RNA, 21 nt, Homo sapiens
cugacauaaguauuuaauuca

SEQ ID NO: 982823 - RNA, 13 nt, Homo sapiens
cugaccugucuca

SEQ ID NO: 982824 - RNA, 9 nt, Homo sapiens
cugagacag

SEQ ID NO: 982825 - RNA, 22 nt, Homo sapiens
cugagcagugcuugaaugaagu

SEQ ID NO: 982826 - RNA, 23 nt, Homo sapiens
cugagcagugcuugaaugaaguu

SEQ ID NO: 982827 - RNA, 12 nt, Homo sapiens
cugaguagaaag

SEQ ID NO: 982828 - RNA, 19 nt, Homo sapiens
cugauaaugaaaauuauga

SEQ ID NO: 982829 - RNA, 18 nt, Homo sapiens
cugcacacccuccagaga

SEQ ID NO: 982830 - RNA, 18 nt, Homo sapiens
cugcagacucacuguggg

SEQ ID NO: 982831 - RNA, 21 nt, Homo sapiens
cugcaggcagccugccuuuaa

SEQ ID NO: 982832 - RNA, 15 nt, Homo sapiens
cugcauaaauguggu

SEQ ID NO: 982833 - RNA, 18 nt, Homo sapiens
cugcaugcacuucuuaca

SEQ ID NO: 982834 - RNA, 23 nt, Homo sapiens
cugcaugcacuucuuacaauaau

SEQ ID NO: 982835 - RNA, 16 nt, Homo sapiens
cugccagcauaauacu

SEQ ID NO: 982836 - RNA, 20 nt, Homo sapiens
cugccagcauaauacuugcu

SEQ ID NO: 982837 - RNA, 20 nt, Homo sapiens
cugccgcagggguccgggau

SEQ ID NO: 982838 - RNA, 14 nt, Homo sapiens
cugccucuuaaaua

SEQ ID NO: 982839 - RNA, 14 nt, Homo sapiens
cugccuuguguaca

SEQ ID NO: 982840 - RNA, 16 nt, Homo sapiens
cugcuauaacuaugac

SEQ ID NO: 982841 - RNA, 16 nt, Homo sapiens
cugcucacacugcuga

SEQ ID NO: 982842 - RNA, 22 nt, Homo sapiens
cugcucagcccugcaccaugcu

SEQ ID NO: 982843 - RNA, 18 nt, Homo sapiens
cugcuccagaguugguga

SEQ ID NO: 982844 - RNA, 14 nt, Homo sapiens
cugcucccuagcca

SEQ ID NO: 982845 - RNA, 14 nt, Homo sapiens
cugcucuuccucag

SEQ ID NO: 982846 - RNA, 19 nt, Homo sapiens
cugcuggggaagacagugg

SEQ ID NO: 982847 - RNA, 20 nt, Homo sapiens
cuggaaauagcccuguaaca

SEQ ID NO: 982848 - RNA, 13 nt, Homo sapiens
cuggaaauggaca

SEQ ID NO: 982849 - RNA, 14 nt, Homo sapiens
cuggauuuuuacca

SEQ ID NO: 982850 - RNA, 17 nt, Homo sapiens
cuggcauuacaggugug

SEQ ID NO: 982851 - RNA, 17 nt, Homo sapiens
cuggccuguacccagua

SEQ ID NO: 982852 - RNA, 18 nt, Homo sapiens
cugggcagaaggccaaga

SEQ ID NO: 982853 - RNA, 23 nt, Homo sapiens
cugggcccaguaccuagcuggcu

SEQ ID NO: 982854 - RNA, 15 nt, Homo sapiens
cuggggagcucagga

SEQ ID NO: 982855 - RNA, 20 nt, Homo sapiens
cugggucuaccacucagaga

SEQ ID NO: 982856 - RNA, 23 nt, Homo sapiens
cuggucagucugcccuugucacu

SEQ ID NO: 982857 - RNA, 15 nt, Homo sapiens
cugucaccaagccuu

SEQ ID NO: 982858 - RNA, 12 nt, Homo sapiens
cugucauccacu

SEQ ID NO: 982859 - RNA, 16 nt, Homo sapiens
cuguccguucacaugu

SEQ ID NO: 982860 - RNA, 22 nt, Homo sapiens
cuguccguucacauguguggua

SEQ ID NO: 982861 - RNA, 13 nt, Homo sapiens
cugucucagggug

SEQ ID NO: 982862 - RNA, 17 nt, Homo sapiens
cugucucucaugaaccu

SEQ ID NO: 982863 - RNA, 14 nt, Homo sapiens
cugugacccacuua

SEQ ID NO: 982864 - RNA, 17 nt, Homo sapiens
cuguguauucauucuca

SEQ ID NO: 982865 - RNA, 24 nt, Homo sapiens
cuguguuacccaguaacucaucug

SEQ ID NO: 982866 - RNA, 11 nt, Homo sapiens
cuguucauucc

SEQ ID NO: 982867 - RNA, 16 nt, Homo sapiens
cuguucauuccuccag

SEQ ID NO: 982868 - RNA, 22 nt, Homo sapiens
cuguuucugggcugucuauucu

SEQ ID NO: 982869 - RNA, 13 nt, Homo sapiens
cuuaaaauuguau

SEQ ID NO: 982870 - RNA, 19 nt, Homo sapiens
cuuagucacaaagcccauc

SEQ ID NO: 982871 - RNA, 17 nt, Homo sapiens
cuuaucuaaucaugaaa

SEQ ID NO: 982872 - RNA, 14 nt, Homo sapiens
cuuaugccauauaa

SEQ ID NO: 982873 - RNA, 18 nt, Homo sapiens
cuuauugccucacuucag

SEQ ID NO: 982874 - RNA, 16 nt, Homo sapiens
cuucauagagacuugg

SEQ ID NO: 982875 - RNA, 16 nt, Homo sapiens
cuuccaacguggccca

SEQ ID NO: 982876 - RNA, 21 nt, Homo sapiens
cuuccaggggagguucaguga

SEQ ID NO: 982877 - RNA, 20 nt, Homo sapiens
cuucccaaaguccugggauu

SEQ ID NO: 982878 - RNA, 13 nt, Homo sapiens
cuuccucacacca

SEQ ID NO: 982879 - RNA, 14 nt, Homo sapiens
cuuccucacaccag

SEQ ID NO: 982880 - RNA, 14 nt, Homo sapiens
cuucucuccagugc

SEQ ID NO: 982881 - RNA, 22 nt, Homo sapiens
gcaaucauggugcucagagcag

SEQ ID NO: 982882 - RNA, 22 nt, Homo sapiens
gcacacccuccagagacaacag

SEQ ID NO: 982883 - RNA, 15 nt, Homo sapiens
gcaccacuguguauu

SEQ ID NO: 982884 - RNA, 14 nt, Homo sapiens
gcaccaugcugcug

SEQ ID NO: 982885 - RNA, 12 nt, Homo sapiens
gcacccuggauu

SEQ ID NO: 982886 - RNA, 17 nt, Homo sapiens
gcacuggccacccaagg

SEQ ID NO: 982887 - RNA, 19 nt, Homo sapiens
gcagaccugacucucuuaa

SEQ ID NO: 982888 - RNA, 23 nt, Homo sapiens
gcagcaucccuagucucuaccca

SEQ ID NO: 982889 - RNA, 14 nt, Homo sapiens
gcaggaaaauggac

SEQ ID NO: 982890 - RNA, 15 nt, Homo sapiens
gcagguaaccccaga

SEQ ID NO: 982891 - RNA, 21 nt, Homo sapiens
gcaggugcuucaggauaccau

SEQ ID NO: 982892 - RNA, 19 nt, Homo sapiens
gcagugcuugaaugaaguu

SEQ ID NO: 982893 - RNA, 16 nt, Homo sapiens
gcaguggcaucaucuc

SEQ ID NO: 982894 - RNA, 17 nt, Homo sapiens
gcaguggcaucaucuca

SEQ ID NO: 982895 - RNA, 22 nt, Homo sapiens
gcaguggcgcgaucucagcuca

SEQ ID NO: 982896 - RNA, 22 nt, Homo sapiens
gcaguggcgugaucucagcuca

SEQ ID NO: 982897 - RNA, 16 nt, Homo sapiens
gcaguucuuuggcuga

SEQ ID NO: 982898 - RNA, 16 nt, Homo sapiens
gcauaucugccuuuau

SEQ ID NO: 982899 - RNA, 23 nt, Homo sapiens
gcaucucacagguagacaguaua

SEQ ID NO: 982900 - RNA, 19 nt, Homo sapiens
gcaugagucagucugauga

SEQ ID NO: 982901 - RNA, 14 nt, Homo sapiens
gcauuaaaaaugca

SEQ ID NO: 982902 - RNA, 17 nt, Homo sapiens
gcauuaaauuuuagcaa

SEQ ID NO: 982903 - RNA, 23 nt, Homo sapiens
gcauuauaaauaaauaccaaaaa

SEQ ID NO: 982904 - RNA, 14 nt, Homo sapiens
gcauuuuacuguac

SEQ ID NO: 982905 - RNA, 13 nt, Homo sapiens
gccaaaccaggac

SEQ ID NO: 982906 - RNA, 13 nt, Homo sapiens
gccaacccuuuca

SEQ ID NO: 982907 - RNA, 20 nt, Homo sapiens
gccaagagccugagugacag

SEQ ID NO: 982908 - RNA, 19 nt, Homo sapiens
gccacccucccacugccaa

SEQ ID NO: 982909 - RNA, 18 nt, Homo sapiens
gccacuggacugacgacu

SEQ ID NO: 982910 - RNA, 15 nt, Homo sapiens
gccagaggcucuaau

SEQ ID NO: 982911 - RNA, 23 nt, Homo sapiens
gccagaggcucuaauguacaaua

SEQ ID NO: 982912 - RNA, 17 nt, Homo sapiens
gccaggaggccugcuag

SEQ ID NO: 982913 - RNA, 18 nt, Homo sapiens
gccaggcuggagugcagu

SEQ ID NO: 982914 - RNA, 20 nt, Homo sapiens
gccagguucugacucuuggc

SEQ ID NO: 982915 - RNA, 21 nt, Homo sapiens
gcccaggaucguuuuuuccca

SEQ ID NO: 982916 - RNA, 13 nt, Homo sapiens
gcccccaacagca

SEQ ID NO: 982917 - RNA, 13 nt, Homo sapiens
gcccuacucaccu

SEQ ID NO: 982918 - RNA, 17 nt, Homo sapiens
gcccugaggccuagacu

SEQ ID NO: 982919 - RNA, 18 nt, Homo sapiens
gcccugcaccaugcugcu

SEQ ID NO: 982920 - RNA, 23 nt, Homo sapiens
gcccuggacugugugcucaggag

SEQ ID NO: 982921 - RNA, 18 nt, Homo sapiens
gcccuggccucugcucaa

SEQ ID NO: 982922 - RNA, 14 nt, Homo sapiens
gccuacaggccuca

SEQ ID NO: 982923 - RNA, 20 nt, Homo sapiens
gccuauuuuaauaaacacuc

SEQ ID NO: 982924 - RNA, 12 nt, Homo sapiens
gccucaaccucc

SEQ ID NO: 982925 - RNA, 17 nt, Homo sapiens
gccucccaaagugcugg

SEQ ID NO: 982926 - RNA, 15 nt, Homo sapiens
gccucccauguucaa

SEQ ID NO: 982927 - RNA, 16 nt, Homo sapiens
gccugacugccaagcc

SEQ ID NO: 982928 - RNA, 19 nt, Homo sapiens
gccugacugccaagccaug

SEQ ID NO: 982929 - RNA, 23 nt, Homo sapiens
gccugcucccuagccagaggcuc

SEQ ID NO: 982930 - RNA, 19 nt, Homo sapiens
gccuucccaggaguacacc

SEQ ID NO: 982931 - RNA, 22 nt, Homo sapiens
gccuucucuguucauuuccuca

SEQ ID NO: 982932 - RNA, 14 nt, Homo sapiens
gcgaucucagcuca

SEQ ID NO: 982933 - RNA, 23 nt, Homo sapiens
gcuaccugcucagcccugcacca

SEQ ID NO: 982934 - RNA, 15 nt, Homo sapiens
gcuacucuaguauuc

SEQ ID NO: 982935 - RNA, 14 nt, Homo sapiens
gcuagacuagucuc

SEQ ID NO: 982936 - RNA, 15 nt, Homo sapiens
gcuagagugacucac

SEQ ID NO: 982937 - RNA, 17 nt, Homo sapiens
gcuaucgcaccacugug

SEQ ID NO: 982938 - RNA, 16 nt, Homo sapiens
gcucaacuagcagaua

SEQ ID NO: 982939 - RNA, 22 nt, Homo sapiens
gcucaacucucuuauugccuca

SEQ ID NO: 982940 - RNA, 17 nt, Homo sapiens
gcucacaggagcuuaaa

SEQ ID NO: 982941 - RNA, 11 nt, Homo sapiens
gcucacuuuug

SEQ ID NO: 982942 - RNA, 16 nt, Homo sapiens
gcucagcccugcacca

SEQ ID NO: 982943 - RNA, 20 nt, Homo sapiens
gcucagcccugcaccaugcu

SEQ ID NO: 982944 - RNA, 17 nt, Homo sapiens
gcuccauucaaagugag

SEQ ID NO: 982945 - RNA, 19 nt, Homo sapiens
gcuccauuuuuagugaaau

SEQ ID NO: 982946 - RNA, 20 nt, Homo sapiens
gcuccccuccucggcuuccu

SEQ ID NO: 982947 - RNA, 14 nt, Homo sapiens
gcucuaauguacaa

SEQ ID NO: 982948 - RNA, 15 nt, Homo sapiens
gcucuaauguacaau

SEQ ID NO: 982949 - RNA, 18 nt, Homo sapiens
gcucuggagcccacugua

SEQ ID NO: 982950 - RNA, 22 nt, Homo sapiens
gcucuucuccauccuaccacaa

SEQ ID NO: 982951 - RNA, 17 nt, Homo sapiens
gcugaaaaaucauccaa

SEQ ID NO: 982952 - RNA, 19 nt, Homo sapiens
gcugaaaaaucauccaaga

SEQ ID NO: 982953 - RNA, 23 nt, Homo sapiens
gcugacaugaagcuguuguguga

SEQ ID NO: 982954 - RNA, 16 nt, Homo sapiens
gcugagugcaccacuu

SEQ ID NO: 982955 - RNA, 17 nt, Homo sapiens
gcugcuggggaagacag

SEQ ID NO: 982956 - RNA, 15 nt, Homo sapiens
gcuggaaauggacac

SEQ ID NO: 982957 - RNA, 14 nt, Homo sapiens
gcuggagugcagug

SEQ ID NO: 982958 - RNA, 14 nt, Homo sapiens
gcugggaccugggg

SEQ ID NO: 982959 - RNA, 19 nt, Homo sapiens
gcuguuauuuaauuagcca

SEQ ID NO: 982960 - RNA, 23 nt, Homo sapiens
gcuuaguucaaguccugccucuu

SEQ ID NO: 982961 - RNA, 17 nt, Homo sapiens
gcuuccuucauuuccuc

SEQ ID NO: 982962 - RNA, 18 nt, Homo sapiens
gcuuccuucauuuccucc

SEQ ID NO: 982963 - RNA, 22 nt, Homo sapiens
gcuuccuucauuuccuccguca

SEQ ID NO: 982964 - RNA, 13 nt, Homo sapiens
gcuuggaaaggac

SEQ ID NO: 982965 - RNA, 17 nt, Homo sapiens
gcuuggaaaggaccagu

SEQ ID NO: 982966 - RNA, 19 nt, Homo sapiens
gcuuugccccugagacaaa

SEQ ID NO: 982967 - RNA, 18 nt, Homo sapiens
gcuuuuuuaucaugugaa

SEQ ID NO: 982968 - RNA, 17 nt, Homo sapiens
ggaaauuaagacuuuau

SEQ ID NO: 982969 - RNA, 16 nt, Homo sapiens
ggaacaucacauuccu

SEQ ID NO: 982970 - RNA, 19 nt, Homo sapiens
ggaacugucucucaugaac

SEQ ID NO: 982971 - RNA, 20 nt, Homo sapiens
ggaagccccugggcccagua

SEQ ID NO: 982972 - RNA, 22 nt, Homo sapiens
ggaauaauccuaaacauaugaa

SEQ ID NO: 982973 - RNA, 13 nt, Homo sapiens
ggaauauuugaau

SEQ ID NO: 982974 - RNA, 11 nt, Homo sapiens
ggacacuuuua

SEQ ID NO: 982975 - RNA, 17 nt, Homo sapiens
ggacguggguugcacug

SEQ ID NO: 982976 - RNA, 17 nt, Homo sapiens
ggacugggacacuuuua

SEQ ID NO: 982977 - RNA, 11 nt, Homo sapiens
ggacuugccuc

SEQ ID NO: 982978 - RNA, 12 nt, Homo sapiens
ggagacacugau

SEQ ID NO: 982979 - RNA, 16 nt, Homo sapiens
ggagcaugagugccgu

SEQ ID NO: 982980 - RNA, 19 nt, Homo sapiens
ggagcccugucuccucucu

SEQ ID NO: 982981 - RNA, 15 nt, Homo sapiens
ggagcuuaaacagcu

SEQ ID NO: 982982 - RNA, 14 nt, Homo sapiens
ggaguacaccccaa

SEQ ID NO: 982983 - RNA, 12 nt, Homo sapiens
ggagugcagugg

SEQ ID NO: 982984 - RNA, 16 nt, Homo sapiens
ggauaaaguugguaaa

SEQ ID NO: 982985 - RNA, 13 nt, Homo sapiens
ggauacuggcaca

SEQ ID NO: 982986 - RNA, 19 nt, Homo sapiens
ggauccccccacagccccu

SEQ ID NO: 982987 - RNA, 21 nt, Homo sapiens
ggaugagggaaaagaaaaaga

SEQ ID NO: 982988 - RNA, 13 nt, Homo sapiens
ggauggcgcagga

SEQ ID NO: 982989 - RNA, 15 nt, Homo sapiens
ggcaaucauggugcu

SEQ ID NO: 982990 - RNA, 11 nt, Homo sapiens
ggcacauuccc

SEQ ID NO: 982991 - RNA, 19 nt, Homo sapiens
ggcacugugggacugggac

SEQ ID NO: 982992 - RNA, 20 nt, Homo sapiens
ggcagaccugacucucuuaa

SEQ ID NO: 982993 - RNA, 22 nt, Homo sapiens
ggcagagccaccugacucuugc

SEQ ID NO: 982994 - RNA, 19 nt, Homo sapiens
ggcagaguucuauaaugua

SEQ ID NO: 982995 - RNA, 15 nt, Homo sapiens
ggcaggaaaauggac

SEQ ID NO: 982996 - RNA, 21 nt, Homo sapiens
ggcauuuucuucucacauuua

SEQ ID NO: 982997 - RNA, 19 nt, Homo sapiens
ggccaauaaauaugauguu

SEQ ID NO: 982998 - RNA, 20 nt, Homo sapiens
ggcccucuugaaucucugaa

SEQ ID NO: 982999 - RNA, 16 nt, Homo sapiens
ggccucugagaagcuc

SEQ ID NO: 983000 - RNA, 13 nt, Homo sapiens
ggccuuguaagac

SEQ ID NO: 983001 - RNA, 21 nt, Homo sapiens
ggcucuaauguacaauaaagc

SEQ ID NO: 983002 - RNA, 19 nt, Homo sapiens
ggcucucuugugcauugua

SEQ ID NO: 983003 - RNA, 20 nt, Homo sapiens
ggcugcuuggagcagccuaa

SEQ ID NO: 983004 - RNA, 15 nt, Homo sapiens
ggcuguacacugcac

SEQ ID NO: 983005 - RNA, 17 nt, Homo sapiens
ggcuucaaauuguaagc

SEQ ID NO: 983006 - RNA, 21 nt, Homo sapiens
ggcuuuggaagccaugugauu

SEQ ID NO: 983007 - RNA, 16 nt, Homo sapiens
gggaaggggaaggaua

SEQ ID NO: 983008 - RNA, 21 nt, Homo sapiens
gggaauauuugaaucuugucu

SEQ ID NO: 983009 - RNA, 23 nt, Homo sapiens
gggaggcucuggagcccacugua

SEQ ID NO: 983010 - RNA, 20 nt, Homo sapiens
gggauuuucagcccucagaa

SEQ ID NO: 983011 - RNA, 14 nt, Homo sapiens
aaggcuaagcuuca

SEQ ID NO: 983012 - RNA, 17 nt, Homo sapiens
aagggacugagaaauuu

SEQ ID NO: 983013 - RNA, 21 nt, Homo sapiens
aagggauuuucagcccucaga

SEQ ID NO: 983014 - RNA, 19 nt, Homo sapiens
aagggcuuggacucaagca

SEQ ID NO: 983015 - RNA, 15 nt, Homo sapiens
aaggggcaggccaga

SEQ ID NO: 983016 - RNA, 19 nt, Homo sapiens
aaggguucaagauuguucc

SEQ ID NO: 983017 - RNA, 19 nt, Homo sapiens
aaggucaagaacacaguga

SEQ ID NO: 983018 - RNA, 18 nt, Homo sapiens
aagguuaggguuggagca

SEQ ID NO: 983019 - RNA, 21 nt, Homo sapiens
aaguauuuaauucauguugcc

SEQ ID NO: 983020 - RNA, 16 nt, Homo sapiens
aagucagcucuucucc

SEQ ID NO: 983021 - RNA, 11 nt, Homo sapiens
aagucuugccu

SEQ ID NO: 983022 - RNA, 12 nt, Homo sapiens
aagugauccuca

SEQ ID NO: 983023 - RNA, 16 nt, Homo sapiens
aagugauccucaggca

SEQ ID NO: 983024 - RNA, 23 nt, Homo sapiens
aagugcuggcauuacagguguga

SEQ ID NO: 983025 - RNA, 20 nt, Homo sapiens
aagugcuucuccagccucag

SEQ ID NO: 983026 - RNA, 19 nt, Homo sapiens
aagugucuugagacuuuau

SEQ ID NO: 983027 - RNA, 17 nt, Homo sapiens
aaguugcauagguuuaa

SEQ ID NO: 983028 - RNA, 22 nt, Homo sapiens
aauaaaacaccuuguacuuuau

SEQ ID NO: 983029 - RNA, 22 nt, Homo sapiens
aauaaaaugaaguggugagcuu

SEQ ID NO: 983030 - RNA, 15 nt, Homo sapiens
aauaaauaccaaaaa

SEQ ID NO: 983031 - RNA, 13 nt, Homo sapiens
aauagccauaaag

SEQ ID NO: 983032 - RNA, 15 nt, Homo sapiens
aauagcccuguaaca

SEQ ID NO: 983033 - RNA, 14 nt, Homo sapiens
aauagugauuucca

SEQ ID NO: 983034 - RNA, 18 nt, Homo sapiens
aauauaagcugccauaua

SEQ ID NO: 983035 - RNA, 16 nt, Homo sapiens
aauauccuuuaauuga

SEQ ID NO: 983036 - RNA, 19 nt, Homo sapiens
aauaugaguuuuauugucc

SEQ ID NO: 983037 - RNA, 21 nt, Homo sapiens
aauaugguguacauucuuccu

SEQ ID NO: 983038 - RNA, 16 nt, Homo sapiens
aauauguaaaauuaca

SEQ ID NO: 983039 - RNA, 14 nt, Homo sapiens
aauauguucugaca

SEQ ID NO: 983040 - RNA, 11 nt, Homo sapiens
aauauugauuu

SEQ ID NO: 983041 - RNA, 20 nt, Homo sapiens
aaucauauuguuacugguac

SEQ ID NO: 983042 - RNA, 15 nt, Homo sapiens
aaucaugcugagaga

SEQ ID NO: 983043 - RNA, 17 nt, Homo sapiens
aaucauuauuacuuuug

SEQ ID NO: 983044 - RNA, 20 nt, Homo sapiens
aaucccagcaugcugagauu

SEQ ID NO: 983045 - RNA, 20 nt, Homo sapiens
aaucccuccccgugacugca

SEQ ID NO: 983046 - RNA, 15 nt, Homo sapiens
aauccucccacuuca

SEQ ID NO: 983047 - RNA, 19 nt, Homo sapiens
aauccuucuauucuagccu

SEQ ID NO: 983048 - RNA, 21 nt, Homo sapiens
aaugcagugccuuucuucucu

SEQ ID NO: 983049 - RNA, 22 nt, Homo sapiens
aauggacacagucuaacaaauu

SEQ ID NO: 983050 - RNA, 21 nt, Homo sapiens
aauggucagaggcgcaugaau

SEQ ID NO: 983051 - RNA, 17 nt, Homo sapiens
aauggugaaaugcagag

SEQ ID NO: 983052 - RNA, 18 nt, Homo sapiens
aauguacaauaaagcaau

SEQ ID NO: 983053 - RNA, 19 nt, Homo sapiens
aauguacaauaaagcaaug

SEQ ID NO: 983054 - RNA, 15 nt, Homo sapiens
aaugugguacaagca

SEQ ID NO: 983055 - RNA, 20 nt, Homo sapiens
aauuacacuuugaacuacua

SEQ ID NO: 983056 - RNA, 21 nt, Homo sapiens
aauuagccagugaaaaacuau

SEQ ID NO: 983057 - RNA, 18 nt, Homo sapiens
aauuauuuugugaugcaa

SEQ ID NO: 983058 - RNA, 17 nt, Homo sapiens
aauuauuuuuguucaua

SEQ ID NO: 983059 - RNA, 23 nt, Homo sapiens
aauucauccucacucaguccagc

SEQ ID NO: 983060 - RNA, 15 nt, Homo sapiens
aauucuaugagauag

SEQ ID NO: 983061 - RNA, 21 nt, Homo sapiens
aauucuuauugacucauacac

SEQ ID NO: 983062 - RNA, 22 nt, Homo sapiens
aauugauuuugaaccugaugaa

SEQ ID NO: 983063 - RNA, 16 nt, Homo sapiens
aauugugcaguacuuu

SEQ ID NO: 983064 - RNA, 21 nt, Homo sapiens
aauuugggggacuuacaugau

SEQ ID NO: 983065 - RNA, 14 nt, Homo sapiens
acaaagaugacugu

SEQ ID NO: 983066 - RNA, 21 nt, Homo sapiens
acaaauuccaaauucucacag

SEQ ID NO: 983067 - RNA, 18 nt, Homo sapiens
acaacuugucuauuaccu

SEQ ID NO: 983068 - RNA, 23 nt, Homo sapiens
acaagauagccaccgagauccuu

SEQ ID NO: 983069 - RNA, 19 nt, Homo sapiens
acaauaacgauaaaagaca

SEQ ID NO: 983070 - RNA, 21 nt, Homo sapiens
acaauagaauuauaacuggaa

SEQ ID NO: 983071 - RNA, 23 nt, Homo sapiens
acacaaauaaaggaaacccagcu

SEQ ID NO: 983072 - RNA, 19 nt, Homo sapiens
acacacacguuauaaucau

SEQ ID NO: 983073 - RNA, 21 nt, Homo sapiens
acacagacauccucuaugcca

SEQ ID NO: 983074 - RNA, 15 nt, Homo sapiens
acaccuaugucauuu

SEQ ID NO: 983075 - RNA, 12 nt, Homo sapiens
acaccucuccaa

SEQ ID NO: 983076 - RNA, 15 nt, Homo sapiens
acacuaacaugauuu

SEQ ID NO: 983077 - RNA, 14 nt, Homo sapiens
acacugaucuggcu

SEQ ID NO: 983078 - RNA, 20 nt, Homo sapiens
acagaagugcuuucuucucc

SEQ ID NO: 983079 - RNA, 16 nt, Homo sapiens
acagacauacauuucu

SEQ ID NO: 983080 - RNA, 19 nt, Homo sapiens
acagagccccacccucaga

SEQ ID NO: 983081 - RNA, 22 nt, Homo sapiens
acagauguucacccaaccacau

SEQ ID NO: 983082 - RNA, 16 nt, Homo sapiens
acagcacccucuccag

SEQ ID NO: 983083 - RNA, 13 nt, Homo sapiens
acagcacuaugua

SEQ ID NO: 983084 - RNA, 15 nt, Homo sapiens
acagcagucagggac

SEQ ID NO: 983085 - RNA, 20 nt, Homo sapiens
acagcuaugaaggcuguaca

SEQ ID NO: 983086 - RNA, 20 nt, Homo sapiens
acagcuucucaauuucuaca

SEQ ID NO: 983087 - RNA, 18 nt, Homo sapiens
acaggaugaugacuaugg

SEQ ID NO: 983088 - RNA, 15 nt, Homo sapiens
acaggcgugagccac

SEQ ID NO: 983089 - RNA, 21 nt, Homo sapiens
acaggcgugagccaccaugcc

SEQ ID NO: 983090 - RNA, 15 nt, Homo sapiens
acagggagugcacau

SEQ ID NO: 983091 - RNA, 16 nt, Homo sapiens
acagguaaaacagggc

SEQ ID NO: 983092 - RNA, 14 nt, Homo sapiens
acagguccccagau

SEQ ID NO: 983093 - RNA, 18 nt, Homo sapiens
acagucuaacaaauucca

SEQ ID NO: 983094 - RNA, 20 nt, Homo sapiens
acagugccgacagcucucca

SEQ ID NO: 983095 - RNA, 19 nt, Homo sapiens
acagugccuaauaauacug

SEQ ID NO: 983096 - RNA, 21 nt, Homo sapiens
acaguuauugcaagaguuuaa

SEQ ID NO: 983097 - RNA, 20 nt, Homo sapiens
acaguucggugagcuacaaa

SEQ ID NO: 983098 - RNA, 20 nt, Homo sapiens
acauaaguauuuaauucaug

SEQ ID NO: 983099 - RNA, 21 nt, Homo sapiens
acauacaccuaugucauuuca

SEQ ID NO: 983100 - RNA, 16 nt, Homo sapiens
acaucgcagauucucc

SEQ ID NO: 983101 - RNA, 18 nt, Homo sapiens
acaucugagagaugacag

SEQ ID NO: 983102 - RNA, 20 nt, Homo sapiens
acaucugagagaugacaggg

SEQ ID NO: 983103 - RNA, 16 nt, Homo sapiens
acaugauuccagccau

SEQ ID NO: 983104 - RNA, 19 nt, Homo sapiens
acaugcacuuggcugcaua

SEQ ID NO: 983105 - RNA, 21 nt, Homo sapiens
acaugcacuuggcugcauaaa

SEQ ID NO: 983106 - RNA, 18 nt, Homo sapiens
acaugcauacacucucaa

SEQ ID NO: 983107 - RNA, 22 nt, Homo sapiens
acaugcauuacugcaugcacuu

SEQ ID NO: 983108 - RNA, 18 nt, Homo sapiens
acaugggugaacacucaa

SEQ ID NO: 983109 - RNA, 16 nt, Homo sapiens
acaugucaaucugucc

SEQ ID NO: 983110 - RNA, 14 nt, Homo sapiens
acauucagggcuau

SEQ ID NO: 983111 - RNA, 21 nt, Homo sapiens
acauucuuccugauuauuuuc

SEQ ID NO: 983112 - RNA, 15 nt, Homo sapiens
acauuuuuaguuuaa

SEQ ID NO: 983113 - RNA, 16 nt, Homo sapiens
accaaaaccacagugc

SEQ ID NO: 983114 - RNA, 17 nt, Homo sapiens
accaaccuuuucccaac

SEQ ID NO: 983115 - RNA, 20 nt, Homo sapiens
accaagauauaccugauaua

SEQ ID NO: 983116 - RNA, 22 nt, Homo sapiens
accaauagauugggcacugugg

SEQ ID NO: 983117 - RNA, 17 nt, Homo sapiens
accacaucccacucaca

SEQ ID NO: 983118 - RNA, 18 nt, Homo sapiens
accaccagaucagguaua

SEQ ID NO: 983119 - RNA, 14 nt, Homo sapiens
accacccaccaguu

SEQ ID NO: 983120 - RNA, 13 nt, Homo sapiens
accaccucaccag

SEQ ID NO: 983121 - RNA, 15 nt, Homo sapiens
accaccucaccaguu

SEQ ID NO: 983122 - RNA, 20 nt, Homo sapiens
accacuggagaucaccagug

SEQ ID NO: 983123 - RNA, 22 nt, Homo sapiens
accagagaagggcuuggacuca

SEQ ID NO: 983124 - RNA, 16 nt, Homo sapiens
accagaucauugugaa

SEQ ID NO: 983125 - RNA, 20 nt, Homo sapiens
accagaugucgcccuacuca

SEQ ID NO: 983126 - RNA, 17 nt, Homo sapiens
accagauugucagcucc

SEQ ID NO: 983127 - RNA, 16 nt, Homo sapiens
accaggacuagggcug

SEQ ID NO: 983128 - RNA, 13 nt, Homo sapiens
accauauacagcu

SEQ ID NO: 983129 - RNA, 16 nt, Homo sapiens
accauguacauagcuu

SEQ ID NO: 983130 - RNA, 16 nt, Homo sapiens
acccaagggcaggggc

SEQ ID NO: 983131 - RNA, 23 nt, Homo sapiens
acccaccaguugaauuucaucau

SEQ ID NO: 983132 - RNA, 20 nt, Homo sapiens
agccugcauugagcuugcau

SEQ ID NO: 983133 - RNA, 18 nt, Homo sapiens
agccugcugccugcuuuu

SEQ ID NO: 983134 - RNA, 15 nt, Homo sapiens
caagagccugaguga

SEQ ID NO: 983135 - RNA, 20 nt, Homo sapiens
caagauugugucccauuccc

SEQ ID NO: 983136 - RNA, 17 nt, Homo sapiens
caagcaccugggauuac

SEQ ID NO: 983137 - RNA, 18 nt, Homo sapiens
caaggcaaagacuauucc

SEQ ID NO: 983138 - RNA, 21 nt, Homo sapiens
caaggcaaagacuauucccuu

SEQ ID NO: 983139 - RNA, 13 nt, Homo sapiens
caagucagcucuu

SEQ ID NO: 983140 - RNA, 18 nt, Homo sapiens
caagugauccucaggcag

SEQ ID NO: 983141 - RNA, 17 nt, Homo sapiens
caauaaagcaauguggu

SEQ ID NO: 983142 - RNA, 18 nt, Homo sapiens
caauaaagcaauguggua

SEQ ID NO: 983143 - RNA, 19 nt, Homo sapiens
caauaauucuaugagauag

SEQ ID NO: 983144 - RNA, 20 nt, Homo sapiens
caauagauugggcacugugg

SEQ ID NO: 983145 - RNA, 17 nt, Homo sapiens
caaugcuucaucccuuu

SEQ ID NO: 983146 - RNA, 21 nt, Homo sapiens
caauuagcuccuccuuuuucc

SEQ ID NO: 983147 - RNA, 13 nt, Homo sapiens
caauucuucuucc

SEQ ID NO: 983148 - RNA, 19 nt, Homo sapiens
cacaauaauuuucuaccug

SEQ ID NO: 983149 - RNA, 12 nt, Homo sapiens
cacaauacuguu

SEQ ID NO: 983150 - RNA, 15 nt, Homo sapiens
cacaaugaugaugau

SEQ ID NO: 983151 - RNA, 15 nt, Homo sapiens
cacaaugcagugccu

SEQ ID NO: 983152 - RNA, 15 nt, Homo sapiens
cacagcuacacagau

SEQ ID NO: 983153 - RNA, 21 nt, Homo sapiens
cacagcuaugaaggcuguaca

SEQ ID NO: 983154 - RNA, 17 nt, Homo sapiens
cacagguagacaguaua

SEQ ID NO: 983155 - RNA, 19 nt, Homo sapiens
cacaugauuccagccauca

SEQ ID NO: 983156 - RNA, 13 nt, Homo sapiens
cacaugggaucaa

SEQ ID NO: 983157 - RNA, 17 nt, Homo sapiens
cacauugagucuaucaa

SEQ ID NO: 983158 - RNA, 22 nt, Homo sapiens
caccaggaauccccaacaugca

SEQ ID NO: 983159 - RNA, 19 nt, Homo sapiens
caccaguguguggcuuuca

SEQ ID NO: 983160 - RNA, 19 nt, Homo sapiens
caccauguuagccaggcug

SEQ ID NO: 983161 - RNA, 18 nt, Homo sapiens
cacccaggaguauccucu

SEQ ID NO: 983162 - RNA, 12 nt, Homo sapiens
caccccaacagc

SEQ ID NO: 983163 - RNA, 21 nt, Homo sapiens
cacccuguccaaacugccuaa

SEQ ID NO: 983164 - RNA, 16 nt, Homo sapiens
caccugggcugaggca

SEQ ID NO: 983165 - RNA, 15 nt, Homo sapiens
caccugucaucucac

SEQ ID NO: 983166 - RNA, 20 nt, Homo sapiens
cacuaauucauuaaucugcc

SEQ ID NO: 983167 - RNA, 14 nt, Homo sapiens
cacuacauuacuuc

SEQ ID NO: 983168 - RNA, 14 nt, Homo sapiens
cacuaucuguaaug

SEQ ID NO: 983169 - RNA, 20 nt, Homo sapiens
cacucucaaagcaaauaauu

SEQ ID NO: 983170 - RNA, 12 nt, Homo sapiens
cacugccaaaga

SEQ ID NO: 983171 - RNA, 12 nt, Homo sapiens
cacuguaaaaug

SEQ ID NO: 983172 - RNA, 17 nt, Homo sapiens
cacuucaaaacaguauu

SEQ ID NO: 983173 - RNA, 18 nt, Homo sapiens
cacuuuuuaaaaucucaa

SEQ ID NO: 983174 - RNA, 20 nt, Homo sapiens
cagaaaaaacugagauguag

SEQ ID NO: 983175 - RNA, 17 nt, Homo sapiens
cagaaucgcuccaccuu

SEQ ID NO: 983176 - RNA, 21 nt, Homo sapiens
cagaaucucucuucuuuucaa

SEQ ID NO: 983177 - RNA, 13 nt, Homo sapiens
cagagaagccaaa

SEQ ID NO: 983178 - RNA, 21 nt, Homo sapiens
cagagccaccugacucuugca

SEQ ID NO: 983179 - RNA, 17 nt, Homo sapiens
cagaggcucuaauguac

SEQ ID NO: 983180 - RNA, 18 nt, Homo sapiens
cagaggcucuaauguaca

SEQ ID NO: 983181 - RNA, 22 nt, Homo sapiens
cagaggcucuaauguacaauaa

SEQ ID NO: 983182 - RNA, 21 nt, Homo sapiens
cagaguucuauaauguaaaca

SEQ ID NO: 983183 - RNA, 17 nt, Homo sapiens
cagaucauugugaaauu

SEQ ID NO: 983184 - RNA, 20 nt, Homo sapiens
cagauccuccucauucacau

SEQ ID NO: 983185 - RNA, 17 nt, Homo sapiens
cagaugagaguacaccc

SEQ ID NO: 983186 - RNA, 15 nt, Homo sapiens
cagauggcagguuug

SEQ ID NO: 983187 - RNA, 20 nt, Homo sapiens
cagauggccuggcugcugcu

SEQ ID NO: 983188 - RNA, 16 nt, Homo sapiens
cagcaagucaggguug

SEQ ID NO: 983189 - RNA, 22 nt, Homo sapiens
cagcauaauacuugcuuuggaa

SEQ ID NO: 983190 - RNA, 16 nt, Homo sapiens
cagcauggagucacag

SEQ ID NO: 983191 - RNA, 16 nt, Homo sapiens
cagccaacccuuucau

SEQ ID NO: 983192 - RNA, 17 nt, Homo sapiens
cagccacggggacucag

SEQ ID NO: 983193 - RNA, 19 nt, Homo sapiens
cagccacggggacucagcc

SEQ ID NO: 983194 - RNA, 12 nt, Homo sapiens
cagccauguauu

SEQ ID NO: 983195 - RNA, 13 nt, Homo sapiens
cagccugccuuua

SEQ ID NO: 983196 - RNA, 14 nt, Homo sapiens
cagccugcucccua

SEQ ID NO: 983197 - RNA, 22 nt, Homo sapiens
cagccuggcuucaaauuguaag

SEQ ID NO: 983198 - RNA, 14 nt, Homo sapiens
cagcuccuugaggg

SEQ ID NO: 983199 - RNA, 14 nt, Homo sapiens
cagcucuccaauac

SEQ ID NO: 983200 - RNA, 18 nt, Homo sapiens
cagcucuccccuucucug

SEQ ID NO: 983201 - RNA, 23 nt, Homo sapiens
cagcugugugggucauaccgugu

SEQ ID NO: 983202 - RNA, 14 nt, Homo sapiens
caggaaaauggaca

SEQ ID NO: 983203 - RNA, 13 nt, Homo sapiens
caggaacaaacag

SEQ ID NO: 983204 - RNA, 17 nt, Homo sapiens
caggaacaaacagggcu

SEQ ID NO: 983205 - RNA, 20 nt, Homo sapiens
caggaagcugugagagcagu

SEQ ID NO: 983206 - RNA, 16 nt, Homo sapiens
caggaaggggugugcu

SEQ ID NO: 983207 - RNA, 14 nt, Homo sapiens
caggauaccauaua

SEQ ID NO: 983208 - RNA, 18 nt, Homo sapiens
caggaugaugacuaugga

SEQ ID NO: 983209 - RNA, 19 nt, Homo sapiens
caggaugaugacuauggaa

SEQ ID NO: 983210 - RNA, 16 nt, Homo sapiens
caggauggcgcaggaa

SEQ ID NO: 983211 - RNA, 19 nt, Homo sapiens
caggcaaucugcccgccug

SEQ ID NO: 983212 - RNA, 23 nt, Homo sapiens
caggcgugaccugccaggcacac

SEQ ID NO: 983213 - RNA, 17 nt, Homo sapiens
caggcuggagugcagug

SEQ ID NO: 983214 - RNA, 18 nt, Homo sapiens
caggcuggagugcagugg

SEQ ID NO: 983215 - RNA, 19 nt, Homo sapiens
cagggagguggcuggguuu

SEQ ID NO: 983216 - RNA, 18 nt, Homo sapiens
cagggagugggcuaagca

SEQ ID NO: 983217 - RNA, 20 nt, Homo sapiens
cagggcuggucuuuuaggac

SEQ ID NO: 983218 - RNA, 16 nt, Homo sapiens
cagguaaaacagggcc

SEQ ID NO: 983219 - RNA, 13 nt, Homo sapiens
caggugcuucagg

SEQ ID NO: 983220 - RNA, 19 nt, Homo sapiens
caggugguaagcaccagga

SEQ ID NO: 983221 - RNA, 16 nt, Homo sapiens
cagguuaaugcugaaa

SEQ ID NO: 983222 - RNA, 17 nt, Homo sapiens
cagguucugacucuugg

SEQ ID NO: 983223 - RNA, 16 nt, Homo sapiens
cagguuggagugcagu

SEQ ID NO: 983224 - RNA, 17 nt, Homo sapiens
caguaacucaucuguca

SEQ ID NO: 983225 - RNA, 14 nt, Homo sapiens
caguagaugccacc

SEQ ID NO: 983226 - RNA, 13 nt, Homo sapiens
caguauauaacua

SEQ ID NO: 983227 - RNA, 23 nt, Homo sapiens
cagucuuccucccuguguauuca

SEQ ID NO: 983228 - RNA, 22 nt, Homo sapiens
cagugacaaccaaaagucuuca

SEQ ID NO: 983229 - RNA, 18 nt, Homo sapiens
cagugcaaauacucuggu

SEQ ID NO: 983230 - RNA, 15 nt, Homo sapiens
cagugccuuucuucu

SEQ ID NO: 983231 - RNA, 18 nt, Homo sapiens
cagugcucgcuguugcug

SEQ ID NO: 983232 - RNA, 16 nt, Homo sapiens
cagugcuugaaugaag

SEQ ID NO: 983233 - RNA, 17 nt, Homo sapiens
caguggcgcgaucucag

SEQ ID NO: 983234 - RNA, 20 nt, Homo sapiens
caguggcgcgaucucagcuc

SEQ ID NO: 983235 - RNA, 21 nt, Homo sapiens
caguggcgcgaucucagcuca

SEQ ID NO: 983236 - RNA, 21 nt, Homo sapiens
caguggcgugaucucagcuca

SEQ ID NO: 983237 - RNA, 15 nt, Homo sapiens
caguguguggcuuuc

SEQ ID NO: 983238 - RNA, 18 nt, Homo sapiens
caguugggacuacaggcg

SEQ ID NO: 983239 - RNA, 13 nt, Homo sapiens
caguugugacaau

SEQ ID NO: 983240 - RNA, 19 nt, Homo sapiens
caguuuaccgaaaaucaua

SEQ ID NO: 983241 - RNA, 21 nt, Homo sapiens
caguuuaccgaaaaucauaua

SEQ ID NO: 983242 - RNA, 15 nt, Homo sapiens
cauaaagucuugccu

SEQ ID NO: 983243 - RNA, 20 nt, Homo sapiens
cauaaaugugguacaagcau

SEQ ID NO: 983244 - RNA, 16 nt, Homo sapiens
cauaacucugugaucu

SEQ ID NO: 983245 - RNA, 19 nt, Homo sapiens
cauacccucacuuaaacuu

SEQ ID NO: 983246 - RNA, 17 nt, Homo sapiens
cauauaaauggaauuac

SEQ ID NO: 983247 - RNA, 12 nt, Homo sapiens
cauauacuuuaa

SEQ ID NO: 983248 - RNA, 16 nt, Homo sapiens
cauauauauacauaca

SEQ ID NO: 983249 - RNA, 18 nt, Homo sapiens
cauauauauacauauaua

SEQ ID NO: 983250 - RNA, 21 nt, Homo sapiens
cauauauauauagcagcuuua

SEQ ID NO: 983251 - RNA, 19 nt, Homo sapiens
cauauccaggcaccaggac

SEQ ID NO: 983252 - RNA, 22 nt, Homo sapiens
cauaugaaaaggcuaagcuuca

SEQ ID NO: 983253 - RNA, 15 nt, Homo sapiens
caucagacagaugga

SEQ ID NO: 983254 - RNA, 13 nt, Homo sapiens
caucauuuccauu

SEQ ID NO: 983255 - RNA, 12 nt, Homo sapiens
cauccauucuuc

SEQ ID NO: 983256 - RNA, 18 nt, Homo sapiens
cauccauucuucccuuga

SEQ ID NO: 983257 - RNA, 14 nt, Homo sapiens
caucccuagucucu

SEQ ID NO: 983258 - RNA, 12 nt, Homo sapiens
uucagacuguuu

SEQ ID NO: 983259 - RNA, 17 nt, Homo sapiens
uucauguugccuugcau

SEQ ID NO: 983260 - RNA, 18 nt, Homo sapiens
uucauuuuaacaucugag

SEQ ID NO: 983261 - RNA, 16 nt, Homo sapiens
uuccaacguggcccag

SEQ ID NO: 983262 - RNA, 20 nt, Homo sapiens
uuccagaaauacuacugugu

SEQ ID NO: 983263 - RNA, 22 nt, Homo sapiens
uuccagccaucaccuuagacca

SEQ ID NO: 983264 - RNA, 16 nt, Homo sapiens
uuccauaagaagucgu

SEQ ID NO: 983265 - RNA, 21 nt, Homo sapiens
uuccaucugauugugauguga

SEQ ID NO: 983266 - RNA, 21 nt, Homo sapiens
uuccccgcccguuuuacaaag

SEQ ID NO: 983267 - RNA, 16 nt, Homo sapiens
uuccuagaaacugaca

SEQ ID NO: 983268 - RNA, 21 nt, Homo sapiens
uuccuauguuucacugugcaa

SEQ ID NO: 983269 - RNA, 20 nt, Homo sapiens
uuccuccgucaccucagaga

SEQ ID NO: 983270 - RNA, 21 nt, Homo sapiens
uuccuugauggagauauuuac

SEQ ID NO: 983271 - RNA, 17 nt, Homo sapiens
uucuaccuggucucucc

SEQ ID NO: 983272 - RNA, 18 nt, Homo sapiens
uucuauugccucugagag

SEQ ID NO: 983273 - RNA, 23 nt, Homo sapiens
uucucaagcccugcagucacagc

SEQ ID NO: 983274 - RNA, 13 nt, Homo sapiens
uucuccauacucu

SEQ ID NO: 983275 - RNA, 14 nt, Homo sapiens
uucucuccaccagg

SEQ ID NO: 983276 - RNA, 12 nt, Homo sapiens
uucugagcauuu

SEQ ID NO: 983277 - RNA, 16 nt, Homo sapiens
uucugccccugcugac

SEQ ID NO: 983278 - RNA, 13 nt, Homo sapiens
uucuuaaccagau

SEQ ID NO: 983279 - RNA, 22 nt, Homo sapiens
uucuuacaauaauucuaugaga

SEQ ID NO: 983280 - RNA, 13 nt, Homo sapiens
uucuucuuuaggc

SEQ ID NO: 983281 - RNA, 12 nt, Homo sapiens
uucuuugcccac

SEQ ID NO: 983282 - RNA, 14 nt, Homo sapiens
uugaaccuaaacau

SEQ ID NO: 983283 - RNA, 22 nt, Homo sapiens
uugaaucacugcucacacugcu

SEQ ID NO: 983284 - RNA, 17 nt, Homo sapiens
uugaccucgugauccac

SEQ ID NO: 983285 - RNA, 13 nt, Homo sapiens
uugagacagaguc

SEQ ID NO: 983286 - RNA, 19 nt, Homo sapiens
uugauuuugaaccugauga

SEQ ID NO: 983287 - RNA, 21 nt, Homo sapiens
uugcacaugucuuaaugaagu

SEQ ID NO: 983288 - RNA, 13 nt, Homo sapiens
uugcccacaaugc

SEQ ID NO: 983289 - RNA, 18 nt, Homo sapiens
uugcucucggugcuucca

SEQ ID NO: 983290 - RNA, 19 nt, Homo sapiens
uugcucucggugcuuccaa

SEQ ID NO: 983291 - RNA, 20 nt, Homo sapiens
uugcuucuucccaauugcuu

SEQ ID NO: 983292 - RNA, 21 nt, Homo sapiens
uuggacucaagcaagauuuca

SEQ ID NO: 983293 - RNA, 14 nt, Homo sapiens
uuggacuucuugaa

SEQ ID NO: 983294 - RNA, 23 nt, Homo sapiens
uuggagcaggggugcugggaccu

SEQ ID NO: 983295 - RNA, 13 nt, Homo sapiens
uuggagugcagug

SEQ ID NO: 983296 - RNA, 22 nt, Homo sapiens
uugguucucauaacucugugau

SEQ ID NO: 983297 - RNA, 14 nt, Homo sapiens
uugguucucuccac

SEQ ID NO: 983298 - RNA, 13 nt, Homo sapiens
uugucugagacag

SEQ ID NO: 983299 - RNA, 20 nt, Homo sapiens
uugugcuucuuucuuuggga

SEQ ID NO: 983300 - RNA, 12 nt, Homo sapiens
uuguucugauaa

SEQ ID NO: 983301 - RNA, 15 nt, Homo sapiens
uuuaaaauaugcucu

SEQ ID NO: 983302 - RNA, 18 nt, Homo sapiens
uuuaaauauaugcuaagu

SEQ ID NO: 983303 - RNA, 21 nt, Homo sapiens
uuuaagggaaggggaaggaua

SEQ ID NO: 983304 - RNA, 16 nt, Homo sapiens
uuuagagaaguucaau

SEQ ID NO: 983305 - RNA, 14 nt, Homo sapiens
uuuaugacaggaug

SEQ ID NO: 983306 - RNA, 14 nt, Homo sapiens
uuuauuaauauaua

SEQ ID NO: 983307 - RNA, 16 nt, Homo sapiens
uuuauuuaacuauuca

SEQ ID NO: 983308 - RNA, 14 nt, Homo sapiens
uuucacuaccuauc

SEQ ID NO: 983309 - RNA, 14 nt, Homo sapiens
uuucauagcuaaaa

SEQ ID NO: 983310 - RNA, 22 nt, Homo sapiens
uuucccuuccugggucuaccac

SEQ ID NO: 983311 - RNA, 18 nt, Homo sapiens
uuucuuguauuuuuccaa

SEQ ID NO: 983312 - RNA, 21 nt, Homo sapiens
uuucuuuguaaugaaaaccac

SEQ ID NO: 983313 - RNA, 20 nt, Homo sapiens
uuugacaaagguaaaucaga

SEQ ID NO: 983314 - RNA, 23 nt, Homo sapiens
uuugacuagaaaauuuaaaacau

SEQ ID NO: 983315 - RNA, 22 nt, Homo sapiens
uuugccuucucuaaacauuuca

SEQ ID NO: 983316 - RNA, 22 nt, Homo sapiens
uuugggggacuuacaugauuca

SEQ ID NO: 983317 - RNA, 15 nt, Homo sapiens
uuuuaacauuccuca

SEQ ID NO: 983318 - RNA, 20 nt, Homo sapiens
uuuuauaaugucccuucaca

SEQ ID NO: 983319 - RNA, 12 nt, Homo sapiens
uuuuauauccac

SEQ ID NO: 983320 - RNA, 20 nt, Homo sapiens
uuuucuauuguuguacacag

SEQ ID NO: 983321 - RNA, 21 nt, Homo sapiens
uuuucucaccugucaucucac

SEQ ID NO: 983322 - RNA, 22 nt, Homo sapiens
uuuuuaaguuauuuuuacauuc

SEQ ID NO: 983323 - RNA, 13 nt, Homo sapiens
uuuuuauacagga

SEQ ID NO: 983324 - RNA, 18 nt, Homo sapiens
uuuuuauuaugcauuaua

SEQ ID NO: 983325 - RNA, 18 nt, Homo sapiens
uuuuuccaauuagcuccu

SEQ ID NO: 983326 - RNA, 19 nt, Homo sapiens
uuuuuuaaaaaauagcagc

SEQ ID NO: 983327 - RNA, 20 nt, Homo sapiens
uuuuuuauaaucaagccuaa

SEQ ID NO: 983328 - RNA, 17 nt, Homo sapiens
gaaugagcaaaaccaaa

SEQ ID NO: 983329 - RNA, 15 nt, Homo sapiens
gaauguaaugguggc

SEQ ID NO: 983330 - RNA, 17 nt, Homo sapiens
gaauucugucauuucaa

SEQ ID NO: 983331 - RNA, 13 nt, Homo sapiens
gaauugcagagua

SEQ ID NO: 983332 - RNA, 16 nt, Homo sapiens
gaauuuucaucuagga

SEQ ID NO: 983333 - RNA, 15 nt, Homo sapiens
gacaaguauggcucc

SEQ ID NO: 983334 - RNA, 17 nt, Homo sapiens
gacacagacauccucua

SEQ ID NO: 983335 - RNA, 20 nt, Homo sapiens
gacacaugcugaacaucaca

SEQ ID NO: 983336 - RNA, 14 nt, Homo sapiens
gacagacauacauu

SEQ ID NO: 983337 - RNA, 17 nt, Homo sapiens
auaaaucucuccuauaa

SEQ ID NO: 983338 - RNA, 16 nt, Homo sapiens
auaagugcuguauaaa

SEQ ID NO: 983339 - RNA, 15 nt, Homo sapiens
auaauaaauguaccu

SEQ ID NO: 983340 - RNA, 20 nt, Homo sapiens
auaaugguuuuuaacaccuu

SEQ ID NO: 983341 - RNA, 16 nt, Homo sapiens
auaaugucccuucaca

SEQ ID NO: 983342 - RNA, 15 nt, Homo sapiens
auacaaaaauuccuu

SEQ ID NO: 983343 - RNA, 14 nt, Homo sapiens
auacaaaacccuuu

SEQ ID NO: 983344 - RNA, 14 nt, Homo sapiens
auacacucucaaag

SEQ ID NO: 983345 - RNA, 14 nt, Homo sapiens
auacauacaugcau

SEQ ID NO: 983346 - RNA, 14 nt, Homo sapiens
auaccacagcuuuu

SEQ ID NO: 983347 - RNA, 23 nt, Homo sapiens
auacccucacuuaaacuuuuauc

SEQ ID NO: 983348 - RNA, 13 nt, Homo sapiens
auacgcaucagac

SEQ ID NO: 983349 - RNA, 14 nt, Homo sapiens
auacuacuguguaa

SEQ ID NO: 983350 - RNA, 13 nt, Homo sapiens
auacucagguuaa

SEQ ID NO: 983351 - RNA, 18 nt, Homo sapiens
auagacacugaucuggcu

SEQ ID NO: 983352 - RNA, 15 nt, Homo sapiens
auagcagcuuuagcc

SEQ ID NO: 983353 - RNA, 17 nt, Homo sapiens
auagcagcuuuagccaa

SEQ ID NO: 983354 - RNA, 14 nt, Homo sapiens
auagcccuguaaca

SEQ ID NO: 983355 - RNA, 14 nt, Homo sapiens
auaggcacaggaaa

SEQ ID NO: 983356 - RNA, 21 nt, Homo sapiens
auaggucagugcaaauacucu

SEQ ID NO: 983357 - RNA, 19 nt, Homo sapiens
auauaucugcuauucucca

SEQ ID NO: 983358 - RNA, 13 nt, Homo sapiens
auauauuccacca

SEQ ID NO: 983359 - RNA, 17 nt, Homo sapiens
auauccagauggcaugu

SEQ ID NO: 983360 - RNA, 13 nt, Homo sapiens
auaucucaucucu

SEQ ID NO: 983361 - RNA, 16 nt, Homo sapiens
auaucugcuauucucc

SEQ ID NO: 983362 - RNA, 17 nt, Homo sapiens
auaucuugaaagggguu

SEQ ID NO: 983363 - RNA, 15 nt, Homo sapiens
auaugauuuguguau

SEQ ID NO: 983364 - RNA, 14 nt, Homo sapiens
auauuccaccagga

SEQ ID NO: 983365 - RNA, 17 nt, Homo sapiens
auauuccaccaggauau

SEQ ID NO: 983366 - RNA, 15 nt, Homo sapiens
aucaaaggcacacag

SEQ ID NO: 983367 - RNA, 16 nt, Homo sapiens
aucaaaggcacacagc

SEQ ID NO: 983368 - RNA, 15 nt, Homo sapiens
aucaacuaaugauuu

SEQ ID NO: 983369 - RNA, 20 nt, Homo sapiens
aucaagacugcaaacccuuu

SEQ ID NO: 983370 - RNA, 20 nt, Homo sapiens
aucaauguucaucauguauc

SEQ ID NO: 983371 - RNA, 17 nt, Homo sapiens
aucauauaaucuuacaa

SEQ ID NO: 983372 - RNA, 21 nt, Homo sapiens
aucauuuaauaauauacuugu

SEQ ID NO: 983373 - RNA, 23 nt, Homo sapiens
auccaaaaauguguaagaacaac

SEQ ID NO: 983374 - RNA, 21 nt, Homo sapiens
aucccagcaugcugagauuac

SEQ ID NO: 983375 - RNA, 21 nt, Homo sapiens
aucccuccugggaaugaagca

SEQ ID NO: 983376 - RNA, 12 nt, Homo sapiens
auccuaccacaa

SEQ ID NO: 983377 - RNA, 17 nt, Homo sapiens
auccuggggaacauaga

SEQ ID NO: 983378 - RNA, 14 nt, Homo sapiens
aucuaccacuguau

SEQ ID NO: 983379 - RNA, 18 nt, Homo sapiens
aucucugaauuugagaua

SEQ ID NO: 983380 - RNA, 18 nt, Homo sapiens
aucucuuguuuaaauuca

SEQ ID NO: 983381 - RNA, 19 nt, Homo sapiens
aucugagagaugacaggga

SEQ ID NO: 983382 - RNA, 15 nt, Homo sapiens
aucuuauuucuguca

SEQ ID NO: 983383 - RNA, 16 nt, Homo sapiens
aucuucaggacacuca

SEQ ID NO: 983384 - RNA, 18 nt, Homo sapiens
aucuucaggacacucacu

SEQ ID NO: 983385 - RNA, 14 nt, Homo sapiens
augaacuuuccaca

SEQ ID NO: 983386 - RNA, 20 nt, Homo sapiens
augaagcaaugcuucauccc

SEQ ID NO: 983387 - RNA, 14 nt, Homo sapiens
augaaggcuguaca

SEQ ID NO: 983388 - RNA, 15 nt, Homo sapiens
augaccaugcugaua

SEQ ID NO: 983389 - RNA, 15 nt, Homo sapiens
augacgucaucauca

SEQ ID NO: 983390 - RNA, 13 nt, Homo sapiens
augauaaaagcac

SEQ ID NO: 983391 - RNA, 15 nt, Homo sapiens
augauaaaagcacuu

SEQ ID NO: 983392 - RNA, 23 nt, Homo sapiens
augaucuagagccaguuacuuug

SEQ ID NO: 983393 - RNA, 23 nt, Homo sapiens
augauuccagccaucaccuuaga

SEQ ID NO: 983394 - RNA, 23 nt, Homo sapiens
augcaaacuuuauuuuguguuua

SEQ ID NO: 983395 - RNA, 19 nt, Homo sapiens
augcacuuggcugcauaaa

SEQ ID NO: 983396 - RNA, 18 nt, Homo sapiens
augcagccccaucuccuc

SEQ ID NO: 983397 - RNA, 13 nt, Homo sapiens
augcauguugccc

SEQ ID NO: 983398 - RNA, 17 nt, Homo sapiens
augcauuauaucaaauc

SEQ ID NO: 983399 - RNA, 16 nt, Homo sapiens
augcugaacaucacag

SEQ ID NO: 983400 - RNA, 23 nt, Homo sapiens
augcugcuggggaagacaguggc

SEQ ID NO: 983401 - RNA, 12 nt, Homo sapiens
augcuuugcccc

SEQ ID NO: 983402 - RNA, 21 nt, Homo sapiens
augcuuugccccugagacaaa

SEQ ID NO: 983403 - RNA, 18 nt, Homo sapiens
auggagccagcucugcau

SEQ ID NO: 983404 - RNA, 16 nt, Homo sapiens
auggagucuugcucug

SEQ ID NO: 983405 - RNA, 22 nt, Homo sapiens
auggaugccgugggaguacaaa

SEQ ID NO: 983406 - RNA, 23 nt, Homo sapiens
auggccuguggaucaaauccagc

SEQ ID NO: 983407 - RNA, 12 nt, Homo sapiens
augggauuuggu

SEQ ID NO: 983408 - RNA, 14 nt, Homo sapiens
augggucuaggaca

SEQ ID NO: 983409 - RNA, 17 nt, Homo sapiens
augggucuaggacacag

SEQ ID NO: 983410 - RNA, 21 nt, Homo sapiens
auggguuucuccagagggaau

SEQ ID NO: 983411 - RNA, 17 nt, Homo sapiens
augguggccuggggcuu

SEQ ID NO: 983412 - RNA, 17 nt, Homo sapiens
auguacaauaaagcaau

SEQ ID NO: 983413 - RNA, 18 nt, Homo sapiens
auguacaauaaagcaaug

SEQ ID NO: 983414 - RNA, 15 nt, Homo sapiens
auguacauguacuga

SEQ ID NO: 983415 - RNA, 21 nt, Homo sapiens
auguaguuuuuauauguugua

SEQ ID NO: 983416 - RNA, 15 nt, Homo sapiens
auguauucagcuuua

SEQ ID NO: 983417 - RNA, 18 nt, Homo sapiens
augucauguggcuaccug

SEQ ID NO: 983418 - RNA, 17 nt, Homo sapiens
augugaaacauguuucu

SEQ ID NO: 983419 - RNA, 16 nt, Homo sapiens
augugaaaucauucau

SEQ ID NO: 983420 - RNA, 23 nt, Homo sapiens
augugaauuguuaguuucugagu

SEQ ID NO: 983421 - RNA, 22 nt, Homo sapiens
augugaguugcacagcuaugaa

SEQ ID NO: 983422 - RNA, 12 nt, Homo sapiens
auguggcccaac

SEQ ID NO: 983423 - RNA, 14 nt, Homo sapiens
auguguaucucaca

SEQ ID NO: 983424 - RNA, 17 nt, Homo sapiens
auguguucauucuggaa

SEQ ID NO: 983425 - RNA, 12 nt, Homo sapiens
auguguuuacuu

SEQ ID NO: 983426 - RNA, 15 nt, Homo sapiens
auguuaaacuagcau

SEQ ID NO: 983427 - RNA, 18 nt, Homo sapiens
auguuacuacaugcacuu

SEQ ID NO: 983428 - RNA, 22 nt, Homo sapiens
auguucacccaaccacauccca

SEQ ID NO: 983429 - RNA, 23 nt, Homo sapiens
auguucacccaaccacaucccac

SEQ ID NO: 983430 - RNA, 16 nt, Homo sapiens
auguucacuuccaaga

SEQ ID NO: 983431 - RNA, 14 nt, Homo sapiens
auguucucuaucau

SEQ ID NO: 983432 - RNA, 14 nt, Homo sapiens
auguugaguuauua

SEQ ID NO: 983433 - RNA, 12 nt, Homo sapiens
auguuucacugu

SEQ ID NO: 983434 - RNA, 13 nt, Homo sapiens
auuaaagcuguua

SEQ ID NO: 983435 - RNA, 12 nt, Homo sapiens
auuacucugaaa

SEQ ID NO: 983436 - RNA, 18 nt, Homo sapiens
auuacugcaugcacuucu

SEQ ID NO: 983437 - RNA, 18 nt, Homo sapiens
auuagaacuucaagcucu

SEQ ID NO: 983438 - RNA, 16 nt, Homo sapiens
auuagaccaagcuugu

SEQ ID NO: 983439 - RNA, 17 nt, Homo sapiens
auuauaaauaaauacca

SEQ ID NO: 983440 - RNA, 21 nt, Homo sapiens
auuauaaauaaauaccaaaaa

SEQ ID NO: 983441 - RNA, 17 nt, Homo sapiens
auuaucaauuaccacac

SEQ ID NO: 983442 - RNA, 17 nt, Homo sapiens
auuaucuuuucauacau

SEQ ID NO: 983443 - RNA, 21 nt, Homo sapiens
auuaugugccagauuuaugca

SEQ ID NO: 983444 - RNA, 12 nt, Homo sapiens
auuauuguugca

SEQ ID NO: 983445 - RNA, 17 nt, Homo sapiens
auuauuguugcauuaaa

SEQ ID NO: 983446 - RNA, 12 nt, Homo sapiens
cagcacuuuaga

SEQ ID NO: 983447 - RNA, 22 nt, Homo sapiens
cagccaacuauggccuguggau

SEQ ID NO: 983448 - RNA, 16 nt, Homo sapiens
cagccagguucugacu

SEQ ID NO: 983449 - RNA, 15 nt, Homo sapiens
cagcccugcaccaug

SEQ ID NO: 983450 - RNA, 20 nt, Homo sapiens
cagcccugggauagugcugu

SEQ ID NO: 983451 - RNA, 20 nt, Homo sapiens
cagccuccagagaguaucug

SEQ ID NO: 983452 - RNA, 19 nt, Homo sapiens
cagccucccaaguagcuga

SEQ ID NO: 983453 - RNA, 20 nt, Homo sapiens
cagccucccaaguagcugag

SEQ ID NO: 983454 - RNA, 13 nt, Homo sapiens
caggaaaauggac

SEQ ID NO: 983455 - RNA, 18 nt, Homo sapiens
caggaaaauggacaucaa

SEQ ID NO: 983456 - RNA, 14 nt, Homo sapiens
caggaacucaauaa

SEQ ID NO: 983457 - RNA, 19 nt, Homo sapiens
caggaauccccaacaugca

SEQ ID NO: 983458 - RNA, 14 nt, Homo sapiens
caggacgcccucac

SEQ ID NO: 983459 - RNA, 17 nt, Homo sapiens
caggaggugcuaucgca

SEQ ID NO: 983460 - RNA, 21 nt, Homo sapiens
caggaggugugauuccugaag

SEQ ID NO: 983461 - RNA, 13 nt, Homo sapiens
caggaguacaccc

SEQ ID NO: 983462 - RNA, 13 nt, Homo sapiens
caggcacacugag

SEQ ID NO: 983463 - RNA, 19 nt, Homo sapiens
caggcagcuuuuucucucc

SEQ ID NO: 983464 - RNA, 19 nt, Homo sapiens
caggcaugagucagucuga

SEQ ID NO: 983465 - RNA, 17 nt, Homo sapiens
cccuagccagaggcucu

SEQ ID NO: 983466 - RNA, 18 nt, Homo sapiens
cccugcaccaugcugcug

SEQ ID NO: 983467 - RNA, 23 nt, Homo sapiens
cccugcugacacagacauccucu

SEQ ID NO: 983468 - RNA, 19 nt, Homo sapiens
cccuucuaaccugaacuga

SEQ ID NO: 983469 - RNA, 15 nt, Homo sapiens
cccuuuacaaauaga

SEQ ID NO: 983470 - RNA, 15 nt, Homo sapiens
ccgaaaaucauauaa

SEQ ID NO: 983471 - RNA, 17 nt, Homo sapiens
ccgcaaauuuucuucca

SEQ ID NO: 983472 - RNA, 21 nt, Homo sapiens
ccgccacccucccacugccaa

SEQ ID NO: 983473 - RNA, 22 nt, Homo sapiens
ccgucaccucagagacauacac

SEQ ID NO: 983474 - RNA, 17 nt, Homo sapiens
ccguuuacuuguuucag

SEQ ID NO: 983475 - RNA, 17 nt, Homo sapiens
ccuaaacauaugaauua

SEQ ID NO: 983476 - RNA, 22 nt, Homo sapiens
ccuaagcccuccgccauucuca

SEQ ID NO: 983477 - RNA, 19 nt, Homo sapiens
ccuaagcuggagugcagug

SEQ ID NO: 983478 - RNA, 20 nt, Homo sapiens
ccuacacgagauacagaauu

SEQ ID NO: 983479 - RNA, 17 nt, Homo sapiens
ccuacuuacaugcauua

SEQ ID NO: 983480 - RNA, 13 nt, Homo sapiens
ccuagaaacugac

SEQ ID NO: 983481 - RNA, 16 nt, Homo sapiens
ccuagcugugaccucu

SEQ ID NO: 983482 - RNA, 23 nt, Homo sapiens
ccuaggugagaacccuugcacua

SEQ ID NO: 983483 - RNA, 18 nt, Homo sapiens
ccuagucucuacccagua

SEQ ID NO: 983484 - RNA, 13 nt, Homo sapiens
ccucacauacccu

SEQ ID NO: 983485 - RNA, 14 nt, Homo sapiens
ccucacuucaggua

SEQ ID NO: 983486 - RNA, 21 nt, Homo sapiens
ccucacuucagguauaccuca

SEQ ID NO: 983487 - RNA, 20 nt, Homo sapiens
ccuccaccuccuggguucaa

SEQ ID NO: 983488 - RNA, 18 nt, Homo sapiens
ccucccacugccaaagaa

SEQ ID NO: 983489 - RNA, 15 nt, Homo sapiens
ccucccuggucccuu

SEQ ID NO: 983490 - RNA, 21 nt, Homo sapiens
ccucuccagaugagaguacac

SEQ ID NO: 983491 - RNA, 12 nt, Homo sapiens
ccucucucugua

SEQ ID NO: 983492 - RNA, 15 nt, Homo sapiens
ccucuggggcauuau

SEQ ID NO: 983493 - RNA, 14 nt, Homo sapiens
ccucugucuccuaa

SEQ ID NO: 983494 - RNA, 17 nt, Homo sapiens
ccugaagaucuagugaa

SEQ ID NO: 983495 - RNA, 14 nt, Homo sapiens
ccugaccugucuca

SEQ ID NO: 983496 - RNA, 16 nt, Homo sapiens
ccugacgaacuccuug

SEQ ID NO: 983497 - RNA, 16 nt, Homo sapiens
ccugcaagcagaggug

SEQ ID NO: 983498 - RNA, 14 nt, Homo sapiens
ccugcacuguaaaa

SEQ ID NO: 983499 - RNA, 15 nt, Homo sapiens
ccugcacuguaaaau

SEQ ID NO: 983500 - RNA, 18 nt, Homo sapiens
ccugccaggcacacugag

SEQ ID NO: 983501 - RNA, 21 nt, Homo sapiens
ccuggaacugucucucaugaa

SEQ ID NO: 983502 - RNA, 18 nt, Homo sapiens
ccuggcaagugggugaaa

SEQ ID NO: 983503 - RNA, 18 nt, Homo sapiens
ccugucauaugcucugau

SEQ ID NO: 983504 - RNA, 16 nt, Homo sapiens
ccugucaucucacauu

SEQ ID NO: 983505 - RNA, 13 nt, Homo sapiens
ccuucagcacuuu

SEQ ID NO: 983506 - RNA, 23 nt, Homo sapiens
ccuucauuuccuccgucaccuca

SEQ ID NO: 983507 - RNA, 18 nt, Homo sapiens
ccuugauugguguugcca

SEQ ID NO: 983508 - RNA, 23 nt, Homo sapiens
ccuugcggcuccucagggacuca

SEQ ID NO: 983509 - RNA, 16 nt, Homo sapiens
ccuuggcugacaugaa

SEQ ID NO: 983510 - RNA, 20 nt, Homo sapiens
ccuuggugauuccgcaguga

SEQ ID NO: 983511 - RNA, 21 nt, Homo sapiens
ccuuggugauuccgcagugag

SEQ ID NO: 983512 - RNA, 21 nt, Homo sapiens
ccuuguguacaguuauuuaug

SEQ ID NO: 983513 - RNA, 18 nt, Homo sapiens
ccuuguucugauaaugaa

SEQ ID NO: 983514 - RNA, 20 nt, Homo sapiens
ccuuucauaaagucuugccu

SEQ ID NO: 983515 - RNA, 12 nt, Homo sapiens
ccuuugcugacc

SEQ ID NO: 983516 - RNA, 17 nt, Homo sapiens
ccuuuggcagaguucua

SEQ ID NO: 983517 - RNA, 13 nt, Homo sapiens
cgaacuccugacc

SEQ ID NO: 983518 - RNA, 20 nt, Homo sapiens
cgaggccccugucucagggu

SEQ ID NO: 983519 - RNA, 12 nt, Homo sapiens
cgcaggaacuca

SEQ ID NO: 983520 - RNA, 20 nt, Homo sapiens
cgccacccucccacugccaa

SEQ ID NO: 983521 - RNA, 19 nt, Homo sapiens
cgcccucacugcaggcucc

SEQ ID NO: 983522 - RNA, 16 nt, Homo sapiens
cgcccuggacugugug

SEQ ID NO: 983523 - RNA, 19 nt, Homo sapiens
cggagcccugucuccucuc

SEQ ID NO: 983524 - RNA, 17 nt, Homo sapiens
cggagccuccucucuca

SEQ ID NO: 983525 - RNA, 14 nt, Homo sapiens
cggcucacugcaac

SEQ ID NO: 983526 - RNA, 19 nt, Homo sapiens
cggcucacugcaaccucca

SEQ ID NO: 983527 - RNA, 13 nt, Homo sapiens
cggcuccucaggg

SEQ ID NO: 983528 - RNA, 14 nt, Homo sapiens
cgugaucucagcuc

SEQ ID NO: 983529 - RNA, 18 nt, Homo sapiens
cguuaagaauuguuaaag

SEQ ID NO: 983530 - RNA, 12 nt, Homo sapiens
cuaaacauuuca

SEQ ID NO: 983531 - RNA, 14 nt, Homo sapiens
cuaaagccauugua

SEQ ID NO: 983532 - RNA, 19 nt, Homo sapiens
cuaaaguuagaaaguugau

SEQ ID NO: 983533 - RNA, 21 nt, Homo sapiens
cuaagaaacauuuauauugau

SEQ ID NO: 983534 - RNA, 17 nt, Homo sapiens
cuaagcacgggccauau

SEQ ID NO: 983535 - RNA, 18 nt, Homo sapiens
cuaagcccccacuacaag

SEQ ID NO: 983536 - RNA, 22 nt, Homo sapiens
cuaagucuuauauauuguagau

SEQ ID NO: 983537 - RNA, 16 nt, Homo sapiens
cuaaguguaccagaga

SEQ ID NO: 983538 - RNA, 17 nt, Homo sapiens
cuaaguguaccagagaa

SEQ ID NO: 983539 - RNA, 20 nt, Homo sapiens
cuaauagggcaauuaauucc

SEQ ID NO: 983540 - RNA, 22 nt, Homo sapiens
cuaaugauuuagugaucaaauu

SEQ ID NO: 983541 - RNA, 15 nt, Homo sapiens
cuaauguacaauaaa

SEQ ID NO: 983542 - RNA, 19 nt, Homo sapiens
cuaauucauuaaucugccu

SEQ ID NO: 983543 - RNA, 19 nt, Homo sapiens
cuaauuggcaugaaggugu

SEQ ID NO: 983544 - RNA, 14 nt, Homo sapiens
cuacacagaucaca

SEQ ID NO: 983545 - RNA, 18 nt, Homo sapiens
cuacaggauuugaaauug

SEQ ID NO: 983546 - RNA, 19 nt, Homo sapiens
cuacagggcucacagaauu

SEQ ID NO: 983547 - RNA, 16 nt, Homo sapiens
cuaccaagauauaccu

SEQ ID NO: 983548 - RNA, 12 nt, Homo sapiens
cuaccuguaacu

SEQ ID NO: 983549 - RNA, 18 nt, Homo sapiens
cuaccuuuugcuguggca

SEQ ID NO: 983550 - RNA, 22 nt, Homo sapiens
cuacuguaaggcaaucauggug

SEQ ID NO: 983551 - RNA, 19 nt, Homo sapiens
cuagagcaagcaggaauca

SEQ ID NO: 983552 - RNA, 13 nt, Homo sapiens
cuagagugacuca

SEQ ID NO: 983553 - RNA, 19 nt, Homo sapiens
cuagcauaucugccuuuau

SEQ ID NO: 983554 - RNA, 15 nt, Homo sapiens
cuagcugugaccucu

SEQ ID NO: 983555 - RNA, 19 nt, Homo sapiens
cuaggaauuguguuuauaa

SEQ ID NO: 983556 - RNA, 19 nt, Homo sapiens
cuaggguccaccaggaguu

SEQ ID NO: 983557 - RNA, 21 nt, Homo sapiens
cuaggugagaacccuugcacu

SEQ ID NO: 983558 - RNA, 22 nt, Homo sapiens
cuaguccccagccugcucccua

SEQ ID NO: 983559 - RNA, 15 nt, Homo sapiens
cuagucucuacccag

SEQ ID NO: 983560 - RNA, 17 nt, Homo sapiens
cuagucucuacccagua

SEQ ID NO: 983561 - RNA, 22 nt, Homo sapiens
cuagugaacauucgaccuccau

SEQ ID NO: 983562 - RNA, 16 nt, Homo sapiens
cuaguucuguagaaau

SEQ ID NO: 983563 - RNA, 21 nt, Homo sapiens
cuaguuuuugacuugcuccua

SEQ ID NO: 983564 - RNA, 14 nt, Homo sapiens
cuauaaaaugaaua

SEQ ID NO: 983565 - RNA, 20 nt, Homo sapiens
cuauaauuuaaauauaugcu

SEQ ID NO: 983566 - RNA, 14 nt, Homo sapiens
cuauagcuuuuccc

SEQ ID NO: 983567 - RNA, 19 nt, Homo sapiens
cuaucugggcugugggcaa

SEQ ID NO: 983568 - RNA, 17 nt, Homo sapiens
cuaucuuuugcauccua

SEQ ID NO: 983569 - RNA, 14 nt, Homo sapiens
cuauggaaagagua

SEQ ID NO: 983570 - RNA, 18 nt, Homo sapiens
cuaugucauuucauuucc

SEQ ID NO: 983571 - RNA, 18 nt, Homo sapiens
cuauguuucacugugcaa

SEQ ID NO: 983572 - RNA, 12 nt, Homo sapiens
cuauuggucucc

SEQ ID NO: 983573 - RNA, 18 nt, Homo sapiens
cucaaacuccugaccuca

SEQ ID NO: 983574 - RNA, 22 nt, Homo sapiens
cucaaagagggagugcauuuau

SEQ ID NO: 983575 - RNA, 19 nt, Homo sapiens
cucaacucucuuauugccu

SEQ ID NO: 983576 - RNA, 22 nt, Homo sapiens
cucaagcccugcagucacagcu

SEQ ID NO: 983577 - RNA, 15 nt, Homo sapiens
cucaauaaguuuauu

SEQ ID NO: 983578 - RNA, 20 nt, Homo sapiens
cucacauacccucacuuaaa

SEQ ID NO: 983579 - RNA, 19 nt, Homo sapiens
cucacauccauucuucccu

SEQ ID NO: 983580 - RNA, 19 nt, Homo sapiens
cucaccugucaucucacau

SEQ ID NO: 983581 - RNA, 14 nt, Homo sapiens
cucacuaauucauu

SEQ ID NO: 983582 - RNA, 18 nt, Homo sapiens
cucagccucccaaagugc

SEQ ID NO: 983583 - RNA, 11 nt, Homo sapiens
cucagcucacu

SEQ ID NO: 983584 - RNA, 16 nt, Homo sapiens
cucagcucacugcaac

SEQ ID NO: 983585 - RNA, 15 nt, Homo sapiens
cucagggacucaggu

SEQ ID NO: 983586 - RNA, 22 nt, Homo sapiens
cucauaacucugugaucuugcu

SEQ ID NO: 983587 - RNA, 19 nt, Homo sapiens
cucauaugauguacaugua

SEQ ID NO: 983588 - RNA, 14 nt, Homo sapiens
cucaugaaccucaa

SEQ ID NO: 983589 - RNA, 18 nt, Homo sapiens
cuccaaaggcucagauua

SEQ ID NO: 983590 - RNA, 18 nt, Homo sapiens
cuccaccaucgucuucuu

SEQ ID NO: 983591 - RNA, 16 nt, Homo sapiens
cuccauguacuggcaa

SEQ ID NO: 983592 - RNA, 20 nt, Homo sapiens
cucccaaagugcugggauua

SEQ ID NO: 983593 - RNA, 18 nt, Homo sapiens
cucccagccagguucuga

SEQ ID NO: 983594 - RNA, 14 nt, Homo sapiens
cucccagugacaac

SEQ ID NO: 983595 - RNA, 15 nt, Homo sapiens
cuccccugcacugua

SEQ ID NO: 983596 - RNA, 15 nt, Homo sapiens
cucccuccagauaua

SEQ ID NO: 983597 - RNA, 21 nt, Homo sapiens
ucuugaaaaaugcauguugcc

SEQ ID NO: 983598 - RNA, 20 nt, Homo sapiens
ucuugaaucucugaauuuga

SEQ ID NO: 983599 - RNA, 20 nt, Homo sapiens
ucuuuguaaugaaaaccaca

SEQ ID NO: 983600 - RNA, 14 nt, Homo sapiens
ucuuuuccaugaac

SEQ ID NO: 983601 - RNA, 15 nt, Homo sapiens
ugaaaaaucauccaa

SEQ ID NO: 983602 - RNA, 19 nt, Homo sapiens
ugaaaauuaacaugaauau

SEQ ID NO: 983603 - RNA, 13 nt, Homo sapiens
ugaaacacuuugc

SEQ ID NO: 983604 - RNA, 19 nt, Homo sapiens
ugaaacucauagacacuga

SEQ ID NO: 983605 - RNA, 15 nt, Homo sapiens
ugaaagaaaauaaca

SEQ ID NO: 983606 - RNA, 13 nt, Homo sapiens
ugaaauuaacuca

SEQ ID NO: 983607 - RNA, 18 nt, Homo sapiens
ugaaccuaaacauagaaa

SEQ ID NO: 983608 - RNA, 13 nt, Homo sapiens
ugaagagguguuu

SEQ ID NO: 983609 - RNA, 14 nt, Homo sapiens
ugaagcaaugcuuc

SEQ ID NO: 983610 - RNA, 19 nt, Homo sapiens
ugaagcuuuuaugugaaac

SEQ ID NO: 983611 - RNA, 13 nt, Homo sapiens
ugaaggcuguaca

SEQ ID NO: 983612 - RNA, 17 nt, Homo sapiens
ugaaguacuaagcgcua

SEQ ID NO: 983613 - RNA, 13 nt, Homo sapiens
ugacaaccaaaag

SEQ ID NO: 983614 - RNA, 19 nt, Homo sapiens
ugacaaccaaaagucuuca

SEQ ID NO: 983615 - RNA, 19 nt, Homo sapiens
ugacaauugggagcugcca

SEQ ID NO: 983616 - RNA, 14 nt, Homo sapiens
ugacacaugcugaa

SEQ ID NO: 983617 - RNA, 17 nt, Homo sapiens
ugacagggaaaacugca

SEQ ID NO: 983618 - RNA, 18 nt, Homo sapiens
ugacaucaccacaguuua

SEQ ID NO: 983619 - RNA, 20 nt, Homo sapiens
ugaccucaagugaucugccc

SEQ ID NO: 983620 - RNA, 20 nt, Homo sapiens
ugaccucaggcaaucugccc

SEQ ID NO: 983621 - RNA, 21 nt, Homo sapiens
ugaccugccaggcacacugag

SEQ ID NO: 983622 - RNA, 12 nt, Homo sapiens
ugacuauggaaa

SEQ ID NO: 983623 - RNA, 15 nt, Homo sapiens
ugacuauucuugaug

SEQ ID NO: 983624 - RNA, 17 nt, Homo sapiens
ugagacagaaucucagu

SEQ ID NO: 983625 - RNA, 11 nt, Homo sapiens
ugagaguacac

SEQ ID NO: 983626 - RNA, 14 nt, Homo sapiens
ugagcaccuacuua

SEQ ID NO: 983627 - RNA, 23 nt, Homo sapiens
ugagcccucuaugguguggcaaa

SEQ ID NO: 983628 - RNA, 21 nt, Homo sapiens
ugaggaauuucuguucuucca

SEQ ID NO: 983629 - RNA, 24 nt, Homo sapiens
ugaggaugugucccaucuagggaa

SEQ ID NO: 983630 - RNA, 20 nt, Homo sapiens
ugaggcauccuuccucacac

SEQ ID NO: 983631 - RNA, 18 nt, Homo sapiens
ugaggccuagacucuguc

SEQ ID NO: 983632 - RNA, 18 nt, Homo sapiens
ugagggugcugacuggcu

SEQ ID NO: 983633 - RNA, 16 nt, Homo sapiens
ugagucccagagccaa

SEQ ID NO: 983634 - RNA, 19 nt, Homo sapiens
ugagucccagagccaauca

SEQ ID NO: 983635 - RNA, 20 nt, Homo sapiens
ugauauauuccaccaggaua

SEQ ID NO: 983636 - RNA, 18 nt, Homo sapiens
ugaucaaaggcacacagc

SEQ ID NO: 983637 - RNA, 15 nt, Homo sapiens
ugauccccacgccac

SEQ ID NO: 983638 - RNA, 23 nt, Homo sapiens
ugauuguuauuggguaucaccac

SEQ ID NO: 983639 - RNA, 17 nt, Homo sapiens
ugcaaauauaucugcua

SEQ ID NO: 983640 - RNA, 19 nt, Homo sapiens
ugcaaauauaucugcuauu

SEQ ID NO: 983641 - RNA, 20 nt, Homo sapiens
ugcaacagccacuacauuac

SEQ ID NO: 983642 - RNA, 15 nt, Homo sapiens
ugcacaaaccaauua

SEQ ID NO: 983643 - RNA, 15 nt, Homo sapiens
ugcacagcuaugaag

SEQ ID NO: 983644 - RNA, 13 nt, Homo sapiens
ugcaccaugcugc

SEQ ID NO: 983645 - RNA, 14 nt, Homo sapiens
ugcaccaugcugcu

SEQ ID NO: 983646 - RNA, 15 nt, Homo sapiens
ugcaccaugcugcug

SEQ ID NO: 983647 - RNA, 23 nt, Homo sapiens
ugcaccaugucaaggguucaaga

SEQ ID NO: 983648 - RNA, 20 nt, Homo sapiens
ugcacuagaggaacccuaca

SEQ ID NO: 983649 - RNA, 21 nt, Homo sapiens
ugcagaggggcccaugaaaga

SEQ ID NO: 983650 - RNA, 19 nt, Homo sapiens
ugcagcucucuuuccucug

SEQ ID NO: 983651 - RNA, 20 nt, Homo sapiens
ugcaguggcaucaucucagc

SEQ ID NO: 983652 - RNA, 20 nt, Homo sapiens
ugcaguggcgcgaucucagc

SEQ ID NO: 983653 - RNA, 20 nt, Homo sapiens
ugcaguggcgugaucucagc

SEQ ID NO: 983654 - RNA, 15 nt, Homo sapiens
ugcauacacucucaa

SEQ ID NO: 983655 - RNA, 16 nt, Homo sapiens
ugcaugcacuucuuac

SEQ ID NO: 983656 - RNA, 21 nt, Homo sapiens
ugcauguugcccuguugcugc

SEQ ID NO: 983657 - RNA, 15 nt, Homo sapiens
ugcauuaaaaaugca

SEQ ID NO: 983658 - RNA, 21 nt, Homo sapiens
ugcauuaaaaaugcauauacu

SEQ ID NO: 983659 - RNA, 23 nt, Homo sapiens
ugcauuguaggauguugagcagc

SEQ ID NO: 983660 - RNA, 12 nt, Homo sapiens
ugccacccaguu

SEQ ID NO: 983661 - RNA, 20 nt, Homo sapiens
ugccacccaguugugacaau

SEQ ID NO: 983662 - RNA, 15 nt, Homo sapiens
ugccaggccuggcaa

SEQ ID NO: 983663 - RNA, 19 nt, Homo sapiens
ugccaggcuggagugcagu

SEQ ID NO: 983664 - RNA, 15 nt, Homo sapiens
ugccucaaccuccca

SEQ ID NO: 983665 - RNA, 23 nt, Homo sapiens
ugccucacuucagguauaccuca

SEQ ID NO: 983666 - RNA, 15 nt, Homo sapiens
ugccucugagagcau

SEQ ID NO: 983667 - RNA, 15 nt, Homo sapiens
ugccucuguauuuaa

SEQ ID NO: 983668 - RNA, 22 nt, Homo sapiens
ugccugcuuuuuauggccugug

SEQ ID NO: 983669 - RNA, 19 nt, Homo sapiens
ugccuucccaggaguacac

SEQ ID NO: 983670 - RNA, 17 nt, Homo sapiens
ugcggcuccucagggac

SEQ ID NO: 983671 - RNA, 16 nt, Homo sapiens
ugcuacucuaguauuc

SEQ ID NO: 983672 - RNA, 13 nt, Homo sapiens
ugcuauucuccau

SEQ ID NO: 983673 - RNA, 20 nt, Homo sapiens
ugcucagcccugcaccaugc

SEQ ID NO: 983674 - RNA, 22 nt, Homo sapiens
ugcucauaugauguacauguac

SEQ ID NO: 983675 - RNA, 21 nt, Homo sapiens
ugcucugucuucuuugcccac

SEQ ID NO: 983676 - RNA, 23 nt, Homo sapiens
ugcugagugcaccacuucaagug

SEQ ID NO: 983677 - RNA, 23 nt, Homo sapiens
ugcuggaaauggacacagucuaa

SEQ ID NO: 983678 - RNA, 19 nt, Homo sapiens
ugcuuaagguaugguacaa

SEQ ID NO: 983679 - RNA, 18 nt, Homo sapiens
ugcuucaggauaccauau

SEQ ID NO: 983680 - RNA, 18 nt, Homo sapiens
ugcuuccaacucauccac

SEQ ID NO: 983681 - RNA, 19 nt, Homo sapiens
ugcuucuuaaaauagccau

SEQ ID NO: 983682 - RNA, 13 nt, Homo sapiens
ugcuuuaaccuca

SEQ ID NO: 983683 - RNA, 17 nt, Homo sapiens
uggaaagaaguugggga

SEQ ID NO: 983684 - RNA, 18 nt, Homo sapiens
uggaaauagugauuucca

SEQ ID NO: 983685 - RNA, 11 nt, Homo sapiens
uggaaccaagg

SEQ ID NO: 983686 - RNA, 15 nt, Homo sapiens
uggaacugucucuca

SEQ ID NO: 983687 - RNA, 18 nt, Homo sapiens
uggaagaggcaccugucc

SEQ ID NO: 983688 - RNA, 18 nt, Homo sapiens
uggaauuugaaacacuuu

SEQ ID NO: 983689 - RNA, 19 nt, Homo sapiens
uggacguggguugcacugg

SEQ ID NO: 983690 - RNA, 14 nt, Homo sapiens
uggagcccacugua

SEQ ID NO: 983691 - RNA, 18 nt, Homo sapiens
uggagccccaucagcucc

SEQ ID NO: 983692 - RNA, 20 nt, Homo sapiens
uggaggcucucuugugcauu

SEQ ID NO: 983693 - RNA, 21 nt, Homo sapiens
uggagggaccuugucucccag

SEQ ID NO: 983694 - RNA, 11 nt, Homo sapiens
uggagugcagu

SEQ ID NO: 983695 - RNA, 12 nt, Homo sapiens
uggagugcagug

SEQ ID NO: 983696 - RNA, 13 nt, Homo sapiens
uggagugcagugg

SEQ ID NO: 983697 - RNA, 14 nt, Homo sapiens
uggauuuuuaccag

SEQ ID NO: 983698 - RNA, 18 nt, Homo sapiens
uggauuuuuaccagucuc

SEQ ID NO: 983699 - RNA, 23 nt, Homo sapiens
uggcaaagccuucauugccuuaa

SEQ ID NO: 983700 - RNA, 12 nt, Homo sapiens
uggcagagccag

SEQ ID NO: 983701 - RNA, 19 nt, Homo sapiens
uggcaucaucucagcucac

SEQ ID NO: 983702 - RNA, 23 nt, Homo sapiens
uggcauuacaggugugagccacg

SEQ ID NO: 983703 - RNA, 15 nt, Homo sapiens
uggcccaacacaauu

SEQ ID NO: 983704 - RNA, 14 nt, Homo sapiens
uggcccuacuggga

SEQ ID NO: 983705 - RNA, 15 nt, Homo sapiens
uggcccuacugggag

SEQ ID NO: 983706 - RNA, 18 nt, Homo sapiens
uggcccucugcccagaaa

SEQ ID NO: 983707 - RNA, 18 nt, Homo sapiens
uggcuccacccucuuuag

SEQ ID NO: 983708 - RNA, 17 nt, Homo sapiens
uggcuucaaauuguaag

SEQ ID NO: 983709 - RNA, 23 nt, Homo sapiens
ugggacuacaggcgugagccacc

SEQ ID NO: 983710 - RNA, 17 nt, Homo sapiens
ugggagacacugaugua

SEQ ID NO: 983711 - RNA, 18 nt, Homo sapiens
ugggagccagggcugucu

SEQ ID NO: 983712 - RNA, 13 nt, Homo sapiens
ugggaucaagucc

SEQ ID NO: 983713 - RNA, 15 nt, Homo sapiens
ugggcagaaggccaa

SEQ ID NO: 983714 - RNA, 19 nt, Homo sapiens
ugggcugugggcaagccua

SEQ ID NO: 983715 - RNA, 15 nt, Homo sapiens
uggggaaaaaacugu

SEQ ID NO: 983716 - RNA, 15 nt, Homo sapiens
uggggaagacagugg

SEQ ID NO: 983717 - RNA, 12 nt, Homo sapiens
ucaaaacagggu

SEQ ID NO: 983718 - RNA, 16 nt, Homo sapiens
ucaaagcaaagcucuu

SEQ ID NO: 983719 - RNA, 14 nt, Homo sapiens
ucaaccucuguauu

SEQ ID NO: 983720 - RNA, 15 nt, Homo sapiens
ucaacuuugauacuu

SEQ ID NO: 983721 - RNA, 22 nt, Homo sapiens
ucaagcccugcagucacagcua

SEQ ID NO: 983722 - RNA, 19 nt, Homo sapiens
ucaagcgauucucuugccu

SEQ ID NO: 983723 - RNA, 18 nt, Homo sapiens
ucacagguagacaguaua

SEQ ID NO: 983724 - RNA, 17 nt, Homo sapiens
ucacauaaugcucauac

SEQ ID NO: 983725 - RNA, 15 nt, Homo sapiens
ucacaugauuccagc

SEQ ID NO: 983726 - RNA, 18 nt, Homo sapiens
ucacauuccucugcccuu

SEQ ID NO: 983727 - RNA, 16 nt, Homo sapiens
ucaccaguuuccaggu

SEQ ID NO: 983728 - RNA, 14 nt, Homo sapiens
ucaccauguacaua

SEQ ID NO: 983729 - RNA, 15 nt, Homo sapiens
ucaccauguacauag

SEQ ID NO: 983730 - RNA, 14 nt, Homo sapiens
caaccucugccucc

SEQ ID NO: 983731 - RNA, 12 nt, Homo sapiens
caacuaccugag

SEQ ID NO: 983732 - RNA, 18 nt, Homo sapiens
caagaaaauaagagcuca

SEQ ID NO: 983733 - RNA, 12 nt, Homo sapiens
caagaaauuacu

SEQ ID NO: 983734 - RNA, 16 nt, Homo sapiens
cuucuuuuaaaccauu

SEQ ID NO: 983735 - RNA, 14 nt, Homo sapiens
cuugaaaaaugcau

SEQ ID NO: 983736 - RNA, 20 nt, Homo sapiens
cuugaaucucugaauuugag

SEQ ID NO: 983737 - RNA, 18 nt, Homo sapiens
cuugaccucgugauccac

SEQ ID NO: 983738 - RNA, 16 nt, Homo sapiens
cuugauaaagggccaa

SEQ ID NO: 983739 - RNA, 14 nt, Homo sapiens
cuugaucaaaggca

SEQ ID NO: 983740 - RNA, 18 nt, Homo sapiens
cuugccaaauauaaauaa

SEQ ID NO: 983741 - RNA, 17 nt, Homo sapiens
cuugccaaauuuagauu

SEQ ID NO: 983742 - RNA, 16 nt, Homo sapiens
cuugcugcugagugca

SEQ ID NO: 983743 - RNA, 14 nt, Homo sapiens
cuugucauguguau

SEQ ID NO: 983744 - RNA, 17 nt, Homo sapiens
cuugucauguguauaaa

SEQ ID NO: 983745 - RNA, 18 nt, Homo sapiens
cuuuaaaauuuuuuuaga

SEQ ID NO: 983746 - RNA, 21 nt, Homo sapiens
cuuuaaagcaggauuucucaa

SEQ ID NO: 983747 - RNA, 14 nt, Homo sapiens
cuuuaaugaauaaa

SEQ ID NO: 983748 - RNA, 22 nt, Homo sapiens
cuuuaaugaauaaacauuugua

SEQ ID NO: 983749 - RNA, 20 nt, Homo sapiens
cuuuacacaauagaauuaua

SEQ ID NO: 983750 - RNA, 11 nt, Homo sapiens
cuuuacuugac

SEQ ID NO: 983751 - RNA, 16 nt, Homo sapiens
cuuuauguuacuacau

SEQ ID NO: 983752 - RNA, 13 nt, Homo sapiens
cuuucacuaucug

SEQ ID NO: 983753 - RNA, 17 nt, Homo sapiens
cuuucauaaagucuugc

SEQ ID NO: 983754 - RNA, 22 nt, Homo sapiens
cuuucaugaauucugucauuuc

SEQ ID NO: 983755 - RNA, 13 nt, Homo sapiens
cuuuccacauuca

SEQ ID NO: 983756 - RNA, 21 nt, Homo sapiens
cuuucuucucccaauucaucc

SEQ ID NO: 983757 - RNA, 14 nt, Homo sapiens
cuuucuucucucca

SEQ ID NO: 983758 - RNA, 15 nt, Homo sapiens
cuuucuuucuuagaa

SEQ ID NO: 983759 - RNA, 22 nt, Homo sapiens
cuuucuuuuuuaaauaggguug

SEQ ID NO: 983760 - RNA, 21 nt, Homo sapiens
cuuugcccacaaugcuuugcc

SEQ ID NO: 983761 - RNA, 13 nt, Homo sapiens
cuuuguacuuuag

SEQ ID NO: 983762 - RNA, 11 nt, Homo sapiens
cuuuguuaaaa

SEQ ID NO: 983763 - RNA, 14 nt, Homo sapiens
cuuuuaaaauccac

SEQ ID NO: 983764 - RNA, 21 nt, Homo sapiens
cuuuuacccggcacauucccc

SEQ ID NO: 983765 - RNA, 13 nt, Homo sapiens
cuuuuaugauacu

SEQ ID NO: 983766 - RNA, 18 nt, Homo sapiens
cuuuuaugauacuugaaa

SEQ ID NO: 983767 - RNA, 16 nt, Homo sapiens
cuuuucugcauguucu

SEQ ID NO: 983768 - RNA, 13 nt, Homo sapiens
cuuuuuaauuucu

SEQ ID NO: 983769 - RNA, 22 nt, Homo sapiens
cuuuuuaugacaggauguuugc

SEQ ID NO: 983770 - RNA, 17 nt, Homo sapiens
cuuuuuuaaaugaagaa

SEQ ID NO: 983771 - RNA, 12 nt, Homo sapiens
gaaaaacuauua

SEQ ID NO: 983772 - RNA, 18 nt, Homo sapiens
gaaaaaucauccaagaca

SEQ ID NO: 983773 - RNA, 12 nt, Homo sapiens
gaaaacaauucu

SEQ ID NO: 983774 - RNA, 15 nt, Homo sapiens
gaaaagggcuuucuc

SEQ ID NO: 983775 - RNA, 16 nt, Homo sapiens
gaaaagggcuuucuca

SEQ ID NO: 983776 - RNA, 17 nt, Homo sapiens
gaaaaguuauguagaaa

SEQ ID NO: 983777 - RNA, 18 nt, Homo sapiens
gaaacaaaaggauaauga

SEQ ID NO: 983778 - RNA, 15 nt, Homo sapiens
gaaacugacacaugc

SEQ ID NO: 983779 - RNA, 14 nt, Homo sapiens
gaaagcauuugaau

SEQ ID NO: 983780 - RNA, 20 nt, Homo sapiens
gaaaugccuuuguacuuuag

SEQ ID NO: 983781 - RNA, 15 nt, Homo sapiens
gaaauggggaacuac

SEQ ID NO: 983782 - RNA, 17 nt, Homo sapiens
gaaauuaagacuuuaug

SEQ ID NO: 983783 - RNA, 21 nt, Homo sapiens
gaaauuacuggaaggcuucca

SEQ ID NO: 983784 - RNA, 23 nt, Homo sapiens
gaaauuuauuuccuaguucugua

SEQ ID NO: 983785 - RNA, 14 nt, Homo sapiens
gaacaucacauucc

SEQ ID NO: 983786 - RNA, 20 nt, Homo sapiens
gaacauucgaccuccauuac

SEQ ID NO: 983787 - RNA, 21 nt, Homo sapiens
gaaccacucauaauucuucac

SEQ ID NO: 983788 - RNA, 18 nt, Homo sapiens
gaacuucuccuacuguag

SEQ ID NO: 983789 - RNA, 20 nt, Homo sapiens
gaacuugcugcugagugcac

SEQ ID NO: 983790 - RNA, 17 nt, Homo sapiens
gaagaaucacaauaauu

SEQ ID NO: 983791 - RNA, 16 nt, Homo sapiens
gaaggauuuugcaguu

SEQ ID NO: 983792 - RNA, 19 nt, Homo sapiens
gaaggauuuugcaguucuu

SEQ ID NO: 983793 - RNA, 16 nt, Homo sapiens
gaaggugggaggaugu

SEQ ID NO: 983794 - RNA, 15 nt, Homo sapiens
gaagugagaccuucc

SEQ ID NO: 983795 - RNA, 17 nt, Homo sapiens
gaagugcuuucuucucc

SEQ ID NO: 983796 - RNA, 20 nt, Homo sapiens
gaagugcuuucuucucccaa

SEQ ID NO: 983797 - RNA, 22 nt, Homo sapiens
gaauaacauggugugcuucuua

SEQ ID NO: 983798 - RNA, 19 nt, Homo sapiens
gaauaugccuuguuucaua

SEQ ID NO: 983799 - RNA, 21 nt, Homo sapiens
gaauguuaaauaaauuguaua

SEQ ID NO: 983800 - RNA, 16 nt, Homo sapiens
gacacaaauaaaggaa

SEQ ID NO: 983801 - RNA, 18 nt, Homo sapiens
gacagauggaaaagggag

SEQ ID NO: 983802 - RNA, 13 nt, Homo sapiens
gacagcucuccaa

SEQ ID NO: 983803 - RNA, 22 nt, Homo sapiens
gacaguauauaacuaacaacca

SEQ ID NO: 983804 - RNA, 11 nt, Homo sapiens
gacagugaaag

SEQ ID NO: 983805 - RNA, 18 nt, Homo sapiens
gacauacaccuaugucau

SEQ ID NO: 983806 - RNA, 11 nt, Homo sapiens
gacaucaaaau

SEQ ID NO: 983807 - RNA, 17 nt, Homo sapiens
gaccaagcuuguccaac

SEQ ID NO: 983808 - RNA, 21 nt, Homo sapiens
gaccaguaugcuuggacugaa

SEQ ID NO: 983809 - RNA, 12 nt, Homo sapiens
gacccuccccaa

SEQ ID NO: 983810 - RNA, 19 nt, Homo sapiens
gaccugccaggcacacuga

SEQ ID NO: 983811 - RNA, 20 nt, Homo sapiens
gaccugccaggcacacugag

SEQ ID NO: 983812 - RNA, 16 nt, Homo sapiens
gacggguuucaccaug

SEQ ID NO: 983813 - RNA, 21 nt, Homo sapiens
gacggguuucaccauguuggc

SEQ ID NO: 983814 - RNA, 20 nt, Homo sapiens
gacgugcacgcacacugucu

SEQ ID NO: 983815 - RNA, 16 nt, Homo sapiens
gacguggguugcacug

SEQ ID NO: 983816 - RNA, 17 nt, Homo sapiens
gacguggguugcacugg

SEQ ID NO: 983817 - RNA, 18 nt, Homo sapiens
gacuacuagggaaaugcc

SEQ ID NO: 983818 - RNA, 22 nt, Homo sapiens
gacuauaggcaugcgccaccau

SEQ ID NO: 983819 - RNA, 12 nt, Homo sapiens
gacucacugugg

SEQ ID NO: 983820 - RNA, 18 nt, Homo sapiens
gacucauacaccagguca

SEQ ID NO: 983821 - RNA, 17 nt, Homo sapiens
gacucuuggcacagcau

SEQ ID NO: 983822 - RNA, 14 nt, Homo sapiens
gacugccaagccau

SEQ ID NO: 983823 - RNA, 23 nt, Homo sapiens
gacuguggacguggguugcacug

SEQ ID NO: 983824 - RNA, 15 nt, Homo sapiens
gacuucuugaaauca

SEQ ID NO: 983825 - RNA, 15 nt, Homo sapiens
gacuuuaucaugugu

SEQ ID NO: 983826 - RNA, 22 nt, Homo sapiens
gacuuuucuccucucagugggu

SEQ ID NO: 983827 - RNA, 16 nt, Homo sapiens
gagaacccuugcacua

SEQ ID NO: 983828 - RNA, 14 nt, Homo sapiens
gagaacucugagca

SEQ ID NO: 983829 - RNA, 19 nt, Homo sapiens
gagacagaaucucagucug

SEQ ID NO: 983830 - RNA, 15 nt, Homo sapiens
gagacauacaccuau

SEQ ID NO: 983831 - RNA, 21 nt, Homo sapiens
gagacauacaccuaugucauu

SEQ ID NO: 983832 - RNA, 20 nt, Homo sapiens
gagacggguuucaccauguu

SEQ ID NO: 983833 - RNA, 18 nt, Homo sapiens
gagagauucaugcugauu

SEQ ID NO: 983834 - RNA, 20 nt, Homo sapiens
gcucccuagccagaggcucu

SEQ ID NO: 983835 - RNA, 14 nt, Homo sapiens
gcuccuaagccaug

SEQ ID NO: 983836 - RNA, 18 nt, Homo sapiens
gcucuccccuucucugua

SEQ ID NO: 983837 - RNA, 20 nt, Homo sapiens
gcucugucuucuuugcccac

SEQ ID NO: 983838 - RNA, 20 nt, Homo sapiens
gcugaggcauccuuccucac

SEQ ID NO: 983839 - RNA, 19 nt, Homo sapiens
gcugagugcaccacuucaa

SEQ ID NO: 983840 - RNA, 15 nt, Homo sapiens
gcuggaggcacccau

SEQ ID NO: 983841 - RNA, 13 nt, Homo sapiens
gcuggagugcagu

SEQ ID NO: 983842 - RNA, 15 nt, Homo sapiens
gcuggagugcagugg

SEQ ID NO: 983843 - RNA, 17 nt, Homo sapiens
gcugucauccacuuuau

SEQ ID NO: 983844 - RNA, 16 nt, Homo sapiens
gcuucaggauaccaua

SEQ ID NO: 983845 - RNA, 15 nt, Homo sapiens
gcuugcaugcuugca

SEQ ID NO: 983846 - RNA, 22 nt, Homo sapiens
gcuuggaaaggaccaguaugcu

SEQ ID NO: 983847 - RNA, 16 nt, Homo sapiens
gcuuucagagccuccu

SEQ ID NO: 983848 - RNA, 21 nt, Homo sapiens
gcuuugcccugcugcccuccc

SEQ ID NO: 983849 - RNA, 18 nt, Homo sapiens
ggaaaaaauaacaaugaa

SEQ ID NO: 983850 - RNA, 18 nt, Homo sapiens
ggaaagacagcuucucau

SEQ ID NO: 983851 - RNA, 15 nt, Homo sapiens
ggaaauuaagacuuu

SEQ ID NO: 983852 - RNA, 12 nt, Homo sapiens
ggaagagguggc

SEQ ID NO: 983853 - RNA, 23 nt, Homo sapiens
ggaaggcaagauugugucccauu

SEQ ID NO: 983854 - RNA, 17 nt, Homo sapiens
ggaauaaacuccauuua

SEQ ID NO: 983855 - RNA, 11 nt, Homo sapiens
ggaauaaucuc

SEQ ID NO: 983856 - RNA, 12 nt, Homo sapiens
ggaauaaucucc

SEQ ID NO: 983857 - RNA, 15 nt, Homo sapiens
ggaauuguguuuaua

SEQ ID NO: 983858 - RNA, 19 nt, Homo sapiens
ggacuaaguguaccagaga

SEQ ID NO: 983859 - RNA, 17 nt, Homo sapiens
ggaggcacccaugccau

SEQ ID NO: 983860 - RNA, 18 nt, Homo sapiens
ggaguacaccccaacagc

SEQ ID NO: 983861 - RNA, 17 nt, Homo sapiens
ggaguauccucuugcca

SEQ ID NO: 983862 - RNA, 23 nt, Homo sapiens
ggagugcaguggcaucaucucag

SEQ ID NO: 983863 - RNA, 20 nt, Homo sapiens
ggagugcccccaacagcacc

SEQ ID NO: 983864 - RNA, 21 nt, Homo sapiens
ggagugcccccaacagcaccc

SEQ ID NO: 983865 - RNA, 18 nt, Homo sapiens
ggaguucucccaccaccu

SEQ ID NO: 983866 - RNA, 17 nt, Homo sapiens
ggaugaugacuauggaa

SEQ ID NO: 983867 - RNA, 22 nt, Homo sapiens
ggauuaaugucaauucuugcca

SEQ ID NO: 983868 - RNA, 17 nt, Homo sapiens
ggauucuuccaucugau

SEQ ID NO: 983869 - RNA, 21 nt, Homo sapiens
cguucccggguagccacugga

SEQ ID NO: 983870 - RNA, 23 nt, Homo sapiens
cuaaacauccuaagcucaucuau

SEQ ID NO: 983871 - RNA, 23 nt, Homo sapiens
cuaacacccagucuguuccccau

SEQ ID NO: 983872 - RNA, 14 nt, Homo sapiens
cuaacacggugcuc

SEQ ID NO: 983873 - RNA, 16 nt, Homo sapiens
cuaaccugaacugaug

SEQ ID NO: 983874 - RNA, 20 nt, Homo sapiens
cuaagaaacauuuauauuga

SEQ ID NO: 983875 - RNA, 21 nt, Homo sapiens
cuaagcccccacuacaaguga

SEQ ID NO: 983876 - RNA, 17 nt, Homo sapiens
cuaagcuggagugcagu

SEQ ID NO: 983877 - RNA, 16 nt, Homo sapiens
cuaagcuucacuguaa

SEQ ID NO: 983878 - RNA, 17 nt, Homo sapiens
cuaagguucagccugaa

SEQ ID NO: 983879 - RNA, 23 nt, Homo sapiens
cuaauauguaaaauuacacuuug

SEQ ID NO: 983880 - RNA, 17 nt, Homo sapiens
cuaauuggcaugaaggu

SEQ ID NO: 983881 - RNA, 17 nt, Homo sapiens
cuacacagaucacagcu

SEQ ID NO: 983882 - RNA, 18 nt, Homo sapiens
cuacacagaucacagcuu

SEQ ID NO: 983883 - RNA, 21 nt, Homo sapiens
cuacaggcgugagccaccaug

SEQ ID NO: 983884 - RNA, 17 nt, Homo sapiens
cuagaaacugacacaug

SEQ ID NO: 983885 - RNA, 21 nt, Homo sapiens
cuagaggcuuccuucauuucc

SEQ ID NO: 983886 - RNA, 22 nt, Homo sapiens
cuagaggcuuccuucauuuccu

SEQ ID NO: 983887 - RNA, 22 nt, Homo sapiens
cuaggugagaacccuugcacua

SEQ ID NO: 983888 - RNA, 14 nt, Homo sapiens
cuaucgcaccacug

SEQ ID NO: 983889 - RNA, 15 nt, Homo sapiens
cuaucgcaccacugu

SEQ ID NO: 983890 - RNA, 22 nt, Homo sapiens
cuaugaaggcuguacacugcac

SEQ ID NO: 983891 - RNA, 19 nt, Homo sapiens
cuaugucauuucauuuccu

SEQ ID NO: 983892 - RNA, 19 nt, Homo sapiens
cuauuaccuguuaguauua

SEQ ID NO: 983893 - RNA, 21 nt, Homo sapiens
cuauucccuucuaaccugaac

SEQ ID NO: 983894 - RNA, 17 nt, Homo sapiens
cuauucuugauguaaaa

SEQ ID NO: 983895 - RNA, 15 nt, Homo sapiens
cucaaaacaggguug

SEQ ID NO: 983896 - RNA, 19 nt, Homo sapiens
cucaaacuccugaccucaa

SEQ ID NO: 983897 - RNA, 18 nt, Homo sapiens
cucaacguugcuccccau

SEQ ID NO: 983898 - RNA, 16 nt, Homo sapiens
cucaagcccugcaguc

SEQ ID NO: 983899 - RNA, 19 nt, Homo sapiens
cucaagcccugcagucaca

SEQ ID NO: 983900 - RNA, 21 nt, Homo sapiens
cucacauuuggggcuagacag

SEQ ID NO: 983901 - RNA, 13 nt, Homo sapiens
cucacuucaggua

SEQ ID NO: 983902 - RNA, 19 nt, Homo sapiens
cucagaaucgcuccaccuu

SEQ ID NO: 983903 - RNA, 19 nt, Homo sapiens
cucagaugcacaugagcug

SEQ ID NO: 983904 - RNA, 16 nt, Homo sapiens
cucaggcaaucugccc

SEQ ID NO: 983905 - RNA, 16 nt, Homo sapiens
cucagggacucaggug

SEQ ID NO: 983906 - RNA, 16 nt, Homo sapiens
cucaguagucagacug

SEQ ID NO: 983907 - RNA, 20 nt, Homo sapiens
cucagugggggcagagccac

SEQ ID NO: 983908 - RNA, 14 nt, Homo sapiens
cucaguggguggua

SEQ ID NO: 983909 - RNA, 20 nt, Homo sapiens
cucauaugauguacauguac

SEQ ID NO: 983910 - RNA, 14 nt, Homo sapiens
cucauuguagaaaa

SEQ ID NO: 983911 - RNA, 22 nt, Homo sapiens
cucauuguagaaaagcuauaaa

SEQ ID NO: 983912 - RNA, 16 nt, Homo sapiens
cuccacaggcacaggu

SEQ ID NO: 983913 - RNA, 12 nt, Homo sapiens
cuccacauuucc

SEQ ID NO: 983914 - RNA, 15 nt, Homo sapiens
cuccaccuccugggu

SEQ ID NO: 983915 - RNA, 18 nt, Homo sapiens
cuccagagggaauugcag

SEQ ID NO: 983916 - RNA, 19 nt, Homo sapiens
cuccagagggaauugcaga

SEQ ID NO: 983917 - RNA, 22 nt, Homo sapiens
cuccagaugagaguacacccca

SEQ ID NO: 983918 - RNA, 17 nt, Homo sapiens
cuccauacucuguaaca

SEQ ID NO: 983919 - RNA, 19 nt, Homo sapiens
cucccaaagugcugggauu

SEQ ID NO: 983920 - RNA, 19 nt, Homo sapiens
cucccaaguagcugagacu

SEQ ID NO: 983921 - RNA, 21 nt, Homo sapiens
cucccuaccuaccaagauaua

SEQ ID NO: 983922 - RNA, 12 nt, Homo sapiens
cucccuagccag

SEQ ID NO: 983923 - RNA, 14 nt, Homo sapiens
cucccuagccagag

SEQ ID NO: 983924 - RNA, 17 nt, Homo sapiens
cucccuagccagaggcu

SEQ ID NO: 983925 - RNA, 14 nt, Homo sapiens
cucccuggauuuuu

SEQ ID NO: 983926 - RNA, 17 nt, Homo sapiens
cuccuaaaguacuggga

SEQ ID NO: 983927 - RNA, 20 nt, Homo sapiens
cuccuaagcuggagugcagu

SEQ ID NO: 983928 - RNA, 12 nt, Homo sapiens
cuccuacuguag

SEQ ID NO: 983929 - RNA, 12 nt, Homo sapiens
cuccucagggac

SEQ ID NO: 983930 - RNA, 19 nt, Homo sapiens
cuccuccuuuuuccuucca

SEQ ID NO: 983931 - RNA, 19 nt, Homo sapiens
cuccucucccagugacaac

SEQ ID NO: 983932 - RNA, 20 nt, Homo sapiens
cucgcccagcggcaucaggc

SEQ ID NO: 983933 - RNA, 13 nt, Homo sapiens
cucgcuguugcug

SEQ ID NO: 983934 - RNA, 12 nt, Homo sapiens
cucucccaguga

SEQ ID NO: 983935 - RNA, 22 nt, Homo sapiens
cucucccagugacaaccaaaag

SEQ ID NO: 983936 - RNA, 19 nt, Homo sapiens
cucucgugaguauauugau

SEQ ID NO: 983937 - RNA, 18 nt, Homo sapiens
cucuggagcccacuguac

SEQ ID NO: 983938 - RNA, 23 nt, Homo sapiens
cucugugagggugcugacuggcu

SEQ ID NO: 983939 - RNA, 14 nt, Homo sapiens
cucuuauugccuca

SEQ ID NO: 983940 - RNA, 23 nt, Homo sapiens
cucuucugagcaccuacuuacau

SEQ ID NO: 983941 - RNA, 16 nt, Homo sapiens
cucuugaaaaaugcau

SEQ ID NO: 983942 - RNA, 16 nt, Homo sapiens
cugaaauuaacucaga

SEQ ID NO: 983943 - RNA, 18 nt, Homo sapiens
cugaagaaucacaauaau

SEQ ID NO: 983944 - RNA, 15 nt, Homo sapiens
cugaagggguucuca

SEQ ID NO: 983945 - RNA, 21 nt, Homo sapiens
cugagcaccuacuuacaugca

SEQ ID NO: 983946 - RNA, 15 nt, Homo sapiens
cugcaaacccuuuca

SEQ ID NO: 983947 - RNA, 13 nt, Homo sapiens
cugcaccaugcug

SEQ ID NO: 983948 - RNA, 14 nt, Homo sapiens
cugcaccaugcugc

SEQ ID NO: 983949 - RNA, 14 nt, Homo sapiens
cugcacuguaaaau

SEQ ID NO: 983950 - RNA, 14 nt, Homo sapiens
cugcagacucacug

SEQ ID NO: 983951 - RNA, 22 nt, Homo sapiens
cugcauccauucuccugaggau

SEQ ID NO: 983952 - RNA, 11 nt, Homo sapiens
cugccaagagu

SEQ ID NO: 983953 - RNA, 16 nt, Homo sapiens
cugcccuugucacugg

SEQ ID NO: 983954 - RNA, 22 nt, Homo sapiens
cugccuauuuuaauaaacacuc

SEQ ID NO: 983955 - RNA, 13 nt, Homo sapiens
cugcgcagcaucc

SEQ ID NO: 983956 - RNA, 16 nt, Homo sapiens
cugcucauaugaugua

SEQ ID NO: 983957 - RNA, 22 nt, Homo sapiens
cugcucugucuucuuugcccac

SEQ ID NO: 983958 - RNA, 12 nt, Homo sapiens
cuggaaauggac

SEQ ID NO: 983959 - RNA, 20 nt, Homo sapiens
cuggaacugucucucaugaa

SEQ ID NO: 983960 - RNA, 16 nt, Homo sapiens
cuggaaggcuuccacu

SEQ ID NO: 983961 - RNA, 16 nt, Homo sapiens
cuggacccuguugcua

SEQ ID NO: 983962 - RNA, 15 nt, Homo sapiens
cuggagcccacugua

SEQ ID NO: 983963 - RNA, 14 nt, Homo sapiens
cuggcaacugcuaa

SEQ ID NO: 983964 - RNA, 15 nt, Homo sapiens
cuggcauuacaggug

SEQ ID NO: 983965 - RNA, 18 nt, Homo sapiens
cuggcauuacagguguga

SEQ ID NO: 983966 - RNA, 15 nt, Homo sapiens
cuggccuguacccag

SEQ ID NO: 983967 - RNA, 19 nt, Homo sapiens
cuggcugcugcugugcagu

SEQ ID NO: 983968 - RNA, 19 nt, Homo sapiens
cugggacuaaguguaccag

SEQ ID NO: 983969 - RNA, 22 nt, Homo sapiens
cugggauuacaagcaugaguca

SEQ ID NO: 983970 - RNA, 22 nt, Homo sapiens
cugggauuacaggugugagcca

SEQ ID NO: 983971 - RNA, 13 nt, Homo sapiens
cugggcugaggca

SEQ ID NO: 983972 - RNA, 14 nt, Homo sapiens
cuggggaagacagu

SEQ ID NO: 983973 - RNA, 17 nt, Homo sapiens
cuguaaucccagcaugc

SEQ ID NO: 983974 - RNA, 18 nt, Homo sapiens
cuguaauguuaauauuga

SEQ ID NO: 983975 - RNA, 23 nt, Homo sapiens
cuguagggugcugcgcagcaucc

SEQ ID NO: 983976 - RNA, 16 nt, Homo sapiens
cugucaccaagccuug

SEQ ID NO: 983977 - RNA, 14 nt, Homo sapiens
cugucauccacuuu

SEQ ID NO: 983978 - RNA, 19 nt, Homo sapiens
cugucucucaugaaccuca

SEQ ID NO: 983979 - RNA, 20 nt, Homo sapiens
cugucuguuuccucuguaua

SEQ ID NO: 983980 - RNA, 22 nt, Homo sapiens
cugucuucguauucccauuaga

SEQ ID NO: 983981 - RNA, 21 nt, Homo sapiens
cuguggacguggguugcacug

SEQ ID NO: 983982 - RNA, 12 nt, Homo sapiens
cuguuaguauua

SEQ ID NO: 983983 - RNA, 17 nt, Homo sapiens
guuauuggguaucacca

SEQ ID NO: 983984 - RNA, 19 nt, Homo sapiens
guuauuuaugccucuguau

SEQ ID NO: 983985 - RNA, 18 nt, Homo sapiens
guucccggguagccacug

SEQ ID NO: 983986 - RNA, 16 nt, Homo sapiens
guucccucuugcucag

SEQ ID NO: 983987 - RNA, 16 nt, Homo sapiens
guucucacagugggag

SEQ ID NO: 983988 - RNA, 19 nt, Homo sapiens
guucucccaccaccucacc

SEQ ID NO: 983989 - RNA, 17 nt, Homo sapiens
guucuucuuaaagucaa

SEQ ID NO: 983990 - RNA, 13 nt, Homo sapiens
guugugcgcacau

SEQ ID NO: 983991 - RNA, 23 nt, Homo sapiens
guuuaucguauuugaugcuacag

SEQ ID NO: 983992 - RNA, 13 nt, Homo sapiens
guuucacugugca

SEQ ID NO: 983993 - RNA, 23 nt, Homo sapiens
guuucagaguuuguauugugauu

SEQ ID NO: 983994 - RNA, 19 nt, Homo sapiens
guuuccuauguuucacugu

SEQ ID NO: 983995 - RNA, 13 nt, Homo sapiens
guuuccucuguau

SEQ ID NO: 983996 - RNA, 15 nt, Homo sapiens
guuugaauguuaaau

SEQ ID NO: 983997 - RNA, 15 nt, Homo sapiens
guuugguuucuagca

SEQ ID NO: 983998 - RNA, 14 nt, Homo sapiens
guuuuacaaagggg

SEQ ID NO: 983999 - RNA, 23 nt, Homo sapiens
guuuucuuucuaaugagauauua

SEQ ID NO: 984000 - RNA, 14 nt, Homo sapiens
uaaaaagcauuauu

SEQ ID NO: 984001 - RNA, 19 nt, Homo sapiens
uaaaacaagcacuaaacaa

SEQ ID NO: 984002 - RNA, 15 nt, Homo sapiens
uaaaacuccuguuuc

SEQ ID NO: 984003 - RNA, 22 nt, Homo sapiens
uaaaaguuuuuuauuaugcauu

SEQ ID NO: 984004 - RNA, 14 nt, Homo sapiens
uaaaauagccauaa

SEQ ID NO: 984005 - RNA, 14 nt, Homo sapiens
uaaaaucuugucau

SEQ ID NO: 984006 - RNA, 13 nt, Homo sapiens
uaaaauuacacuu

SEQ ID NO: 984007 - RNA, 22 nt, Homo sapiens
uaaaccuuuuuggacacacaaa

SEQ ID NO: 984008 - RNA, 13 nt, Homo sapiens
uaaagcaggauuu

SEQ ID NO: 984009 - RNA, 22 nt, Homo sapiens
uaaagcugccggcacagaacuu

SEQ ID NO: 984010 - RNA, 23 nt, Homo sapiens
uaaaucuaucaaaauuacccuaa

SEQ ID NO: 984011 - RNA, 20 nt, Homo sapiens
uaaauuugggggacuuacau

SEQ ID NO: 984012 - RNA, 23 nt, Homo sapiens
uaaauuugggggacuuacaugau

SEQ ID NO: 984013 - RNA, 21 nt, Homo sapiens
uaaauuuguacuauuuaacug

SEQ ID NO: 984014 - RNA, 14 nt, Homo sapiens
uaacacggugcuca

SEQ ID NO: 984015 - RNA, 16 nt, Homo sapiens
uaacacggugcucauu

SEQ ID NO: 984016 - RNA, 15 nt, Homo sapiens
uaacauggugugcuu

SEQ ID NO: 984017 - RNA, 18 nt, Homo sapiens
uaaccagaucauugugaa

SEQ ID NO: 984018 - RNA, 20 nt, Homo sapiens
uaaccagaucauugugaaau

SEQ ID NO: 984019 - RNA, 15 nt, Homo sapiens
uaaccucacauaccc

SEQ ID NO: 984020 - RNA, 14 nt, Homo sapiens
uaacgucaugugca

SEQ ID NO: 984021 - RNA, 20 nt, Homo sapiens
agcccugcaccaugcugcug

SEQ ID NO: 984022 - RNA, 15 nt, Homo sapiens
agcccuuuacuugac

SEQ ID NO: 984023 - RNA, 14 nt, Homo sapiens
agccucagccuccc

SEQ ID NO: 984024 - RNA, 15 nt, Homo sapiens
agccuccucucucaa

SEQ ID NO: 984025 - RNA, 13 nt, Homo sapiens
agccugccuuuaa

SEQ ID NO: 984026 - RNA, 18 nt, Homo sapiens
agccugcucccuagccag

SEQ ID NO: 984027 - RNA, 19 nt, Homo sapiens
agcgauucucuugccucaa

SEQ ID NO: 984028 - RNA, 13 nt, Homo sapiens
agcgcacagggag

SEQ ID NO: 984029 - RNA, 14 nt, Homo sapiens
agcggcaucaggcu

SEQ ID NO: 984030 - RNA, 23 nt, Homo sapiens
agcggccacggugccuccagaug

SEQ ID NO: 984031 - RNA, 19 nt, Homo sapiens
agcuacacagaucacagcu

SEQ ID NO: 984032 - RNA, 19 nt, Homo sapiens
agcuaggaauuguguuuau

SEQ ID NO: 984033 - RNA, 22 nt, Homo sapiens
agcucaacucucuuauugccuc

SEQ ID NO: 984034 - RNA, 17 nt, Homo sapiens
agcucacuacaaccucc

SEQ ID NO: 984035 - RNA, 23 nt, Homo sapiens
agcucaggaaggggugugcugag

SEQ ID NO: 984036 - RNA, 23 nt, Homo sapiens
agcucauggacuucugccagcau

SEQ ID NO: 984037 - RNA, 21 nt, Homo sapiens
agcucuucuccauccuaccac

SEQ ID NO: 984038 - RNA, 14 nt, Homo sapiens
agcuggagugcagu

SEQ ID NO: 984039 - RNA, 15 nt, Homo sapiens
agcuggagugcagug

SEQ ID NO: 984040 - RNA, 14 nt, Homo sapiens
agcuuaagaaccau

SEQ ID NO: 984041 - RNA, 16 nt, Homo sapiens
uuugugaugcaaauaa

SEQ ID NO: 984042 - RNA, 19 nt, Homo sapiens
uuuuaaaaaaauuccaagu

SEQ ID NO: 984043 - RNA, 23 nt, Homo sapiens
uuuuaaauaggguuguacuaugc

SEQ ID NO: 984044 - RNA, 17 nt, Homo sapiens
uuuuacauguggcccaa

SEQ ID NO: 984045 - RNA, 15 nt, Homo sapiens
uuuuaccagucucac

SEQ ID NO: 984046 - RNA, 12 nt, Homo sapiens
uuuuccuuccag

SEQ ID NO: 984047 - RNA, 13 nt, Homo sapiens
uuuugagacagag

SEQ ID NO: 984048 - RNA, 14 nt, Homo sapiens
uuuugagggagcaa

SEQ ID NO: 984049 - RNA, 18 nt, Homo sapiens
uuuuuagcucaucggcua

SEQ ID NO: 984050 - RNA, 19 nt, Homo sapiens
uuuuuauucagcucaugga

SEQ ID NO: 984051 - RNA, 14 nt, Homo sapiens
uuuuuguaacugga

SEQ ID NO: 984052 - RNA, 12 nt, Homo sapiens
aucaugugaaau

SEQ ID NO: 984053 - RNA, 19 nt, Homo sapiens
aucaugugaaaucauucau

SEQ ID NO: 984054 - RNA, 13 nt, Homo sapiens
aucauugugaaau

SEQ ID NO: 984055 - RNA, 19 nt, Homo sapiens
aucauugugaaauuauuca

SEQ ID NO: 984056 - RNA, 17 nt, Homo sapiens
auccaggcaccaggacu

SEQ ID NO: 984057 - RNA, 16 nt, Homo sapiens
auccuaucucuccaac

SEQ ID NO: 984058 - RNA, 23 nt, Homo sapiens
auccucaggcagguaaccccaga

SEQ ID NO: 984059 - RNA, 13 nt, Homo sapiens
auccucucucugu

SEQ ID NO: 984060 - RNA, 15 nt, Homo sapiens
aucuaauagggcaau

SEQ ID NO: 984061 - RNA, 17 nt, Homo sapiens
aucuaauagggcaauua

SEQ ID NO: 984062 - RNA, 20 nt, Homo sapiens
aucuaauguugaguuauuaa

SEQ ID NO: 984063 - RNA, 18 nt, Homo sapiens
aucuagaggcuuccuuca

SEQ ID NO: 984064 - RNA, 22 nt, Homo sapiens
aucuagccuggaaccaagguua

SEQ ID NO: 984065 - RNA, 11 nt, Homo sapiens
aucucagcuca

SEQ ID NO: 984066 - RNA, 15 nt, Homo sapiens
aucuccucagcaccc

SEQ ID NO: 984067 - RNA, 18 nt, Homo sapiens
aucugagaaaagcuuuga

SEQ ID NO: 984068 - RNA, 21 nt, Homo sapiens
aucugccuccccuucacuccc

SEQ ID NO: 984069 - RNA, 14 nt, Homo sapiens
aucuuaaaugccag

SEQ ID NO: 984070 - RNA, 13 nt, Homo sapiens
augaaaacaauuc

SEQ ID NO: 984071 - RNA, 17 nt, Homo sapiens
augaaaaggacuuuaua

SEQ ID NO: 984072 - RNA, 22 nt, Homo sapiens
augaacuuguaaaggaauuuaa

SEQ ID NO: 984073 - RNA, 12 nt, Homo sapiens
aaaaaagcuuuu

SEQ ID NO: 984074 - RNA, 18 nt, Homo sapiens
aaaaacuaacacccaguc

SEQ ID NO: 984075 - RNA, 12 nt, Homo sapiens
aaaaauauacag

SEQ ID NO: 984076 - RNA, 19 nt, Homo sapiens
aaaacaccuuguacuuuau

SEQ ID NO: 984077 - RNA, 20 nt, Homo sapiens
aaaaccacuggaaaguuuau

SEQ ID NO: 984078 - RNA, 13 nt, Homo sapiens
aaaacccuuucug

SEQ ID NO: 984079 - RNA, 13 nt, Homo sapiens
aaaagacagugaa

SEQ ID NO: 984080 - RNA, 22 nt, Homo sapiens
aaaagacuuuuuccuugggcuu

SEQ ID NO: 984081 - RNA, 13 nt, Homo sapiens
aaaagggcuuucu

SEQ ID NO: 984082 - RNA, 16 nt, Homo sapiens
aaaaguuauguagaaa

SEQ ID NO: 984083 - RNA, 20 nt, Homo sapiens
aaaauccacuuuaucuugaa

SEQ ID NO: 984084 - RNA, 21 nt, Homo sapiens
aaacagggcugccuucuggcc

SEQ ID NO: 984085 - RNA, 15 nt, Homo sapiens
aaacaguauugacuu

SEQ ID NO: 984086 - RNA, 23 nt, Homo sapiens
aaacauguuccuuauauuuacuc

SEQ ID NO: 984087 - RNA, 22 nt, Homo sapiens
aaacauguuuaucguauuugau

SEQ ID NO: 984088 - RNA, 19 nt, Homo sapiens
aaacccauucccucuccag

SEQ ID NO: 984089 - RNA, 16 nt, Homo sapiens
aaaccuauacucacuu

SEQ ID NO: 984090 - RNA, 22 nt, Homo sapiens
aaaccuauacucacuuucccaa

SEQ ID NO: 984091 - RNA, 16 nt, Homo sapiens
aaacuaacacccaguc

SEQ ID NO: 984092 - RNA, 17 nt, Homo sapiens
aaacucccuaguuccuu

SEQ ID NO: 984093 - RNA, 13 nt, Homo sapiens
aaacugauuuauc

SEQ ID NO: 984094 - RNA, 23 nt, Homo sapiens
aaacuugaaguagguagcaacgu

SEQ ID NO: 984095 - RNA, 19 nt, Homo sapiens
aaagaacacgcucucucca

SEQ ID NO: 984096 - RNA, 12 nt, Homo sapiens
aaagacagugaa

SEQ ID NO: 984097 - RNA, 14 nt, Homo sapiens
aaagacuacauauu

SEQ ID NO: 984098 - RNA, 16 nt, Homo sapiens
aaagaggacaggcuac

SEQ ID NO: 984099 - RNA, 15 nt, Homo sapiens
aaagagucacucaca

SEQ ID NO: 984100 - RNA, 16 nt, Homo sapiens
aaagcaaugugguagu

SEQ ID NO: 984101 - RNA, 14 nt, Homo sapiens
aaagcaguugagac

SEQ ID NO: 984102 - RNA, 15 nt, Homo sapiens
aaagcauuugaaugc

SEQ ID NO: 984103 - RNA, 21 nt, Homo sapiens
aaagcuccauuuuuagugaaa

SEQ ID NO: 984104 - RNA, 20 nt, Homo sapiens
aaaggaaacccagcucacag

SEQ ID NO: 984105 - RNA, 19 nt, Homo sapiens
aaaggucaagaacacagug

SEQ ID NO: 984106 - RNA, 22 nt, Homo sapiens
aaaggucaagaacacagugauu

SEQ ID NO: 984107 - RNA, 17 nt, Homo sapiens
aaaguaaaaacaaagaa

SEQ ID NO: 984108 - RNA, 14 nt, Homo sapiens
aaaguaccagguga

SEQ ID NO: 984109 - RNA, 11 nt, Homo sapiens
aaaguacuggg

SEQ ID NO: 984110 - RNA, 16 nt, Homo sapiens
aaagucaagauuucca

SEQ ID NO: 984111 - RNA, 15 nt, Homo sapiens
aaagucuugccuugc

SEQ ID NO: 984112 - RNA, 20 nt, Homo sapiens
aaaguugauaaguacaugau

SEQ ID NO: 984113 - RNA, 21 nt, Homo sapiens
aaaguuuuuuauuaugcauua

SEQ ID NO: 984114 - RNA, 15 nt, Homo sapiens
aaauaagagcucagg

SEQ ID NO: 984115 - RNA, 16 nt, Homo sapiens
aaauagaauuugagca

SEQ ID NO: 984116 - RNA, 14 nt, Homo sapiens
aaauauaucugcua

SEQ ID NO: 984117 - RNA, 13 nt, Homo sapiens
aaauaugaguuuu

SEQ ID NO: 984118 - RNA, 19 nt, Homo sapiens
aaaucaaucaagacugcaa

SEQ ID NO: 984119 - RNA, 13 nt, Homo sapiens
aaaucaguauuug

SEQ ID NO: 984120 - RNA, 21 nt, Homo sapiens
aaaucaugaagauauuuuucc

SEQ ID NO: 984121 - RNA, 21 nt, Homo sapiens
aaauccugaugagguuucuac

SEQ ID NO: 984122 - RNA, 16 nt, Homo sapiens
aaaucuaaguguuuca

SEQ ID NO: 984123 - RNA, 15 nt, Homo sapiens
aaaucuaccacugua

SEQ ID NO: 984124 - RNA, 22 nt, Homo sapiens
aaaucuauuuuguaacuuucuc

SEQ ID NO: 984125 - RNA, 16 nt, Homo sapiens
aaauguaccuucacac

SEQ ID NO: 984126 - RNA, 21 nt, Homo sapiens
aaaugucauguggcuaccugu

SEQ ID NO: 984127 - RNA, 16 nt, Homo sapiens
aaauguucccuucaag

SEQ ID NO: 984128 - RNA, 18 nt, Homo sapiens
aaauuacuggaaggcuuc

SEQ ID NO: 984129 - RNA, 21 nt, Homo sapiens
aaauuauuuuuguucauauaa

SEQ ID NO: 984130 - RNA, 17 nt, Homo sapiens
aaauuccuuuucccgaa

SEQ ID NO: 984131 - RNA, 15 nt, Homo sapiens
aaauuguauuacaaa

SEQ ID NO: 984132 - RNA, 15 nt, Homo sapiens
aaauuucagcagcug

SEQ ID NO: 984133 - RNA, 15 nt, Homo sapiens
aaauuuuuaaucuuu

SEQ ID NO: 984134 - RNA, 13 nt, Homo sapiens
aacaaacagggcu

SEQ ID NO: 984135 - RNA, 13 nt, Homo sapiens
aacagcacccucu

SEQ ID NO: 984136 - RNA, 15 nt, Homo sapiens
aacagcacccucucc

SEQ ID NO: 984137 - RNA, 17 nt, Homo sapiens
aacagcacccucuccag

SEQ ID NO: 984138 - RNA, 15 nt, Homo sapiens
aacaugaaaacaauu

SEQ ID NO: 984139 - RNA, 22 nt, Homo sapiens
aacauguuccuuauauuuacuc

SEQ ID NO: 984140 - RNA, 15 nt, Homo sapiens
aacauucgaccucca

SEQ ID NO: 984141 - RNA, 16 nt, Homo sapiens
aaccagaucauuguga

SEQ ID NO: 984142 - RNA, 19 nt, Homo sapiens
aaccauauauauacauaua

SEQ ID NO: 984143 - RNA, 17 nt, Homo sapiens
aaccccagauucaugca

SEQ ID NO: 984144 - RNA, 14 nt, Homo sapiens
aaccucugccuccc

SEQ ID NO: 984145 - RNA, 17 nt, Homo sapiens
aaccuuuucccaaccau

SEQ ID NO: 984146 - RNA, 18 nt, Homo sapiens
aacuagguuuuaauaauu

SEQ ID NO: 984147 - RNA, 13 nt, Homo sapiens
aacuccuuucuca

SEQ ID NO: 984148 - RNA, 17 nt, Homo sapiens
aacucugugaucuugcu

SEQ ID NO: 984149 - RNA, 14 nt, Homo sapiens
aacuucccugaaaa

SEQ ID NO: 984150 - RNA, 22 nt, Homo sapiens
aacuuggaaauagugauuucca

SEQ ID NO: 984151 - RNA, 18 nt, Homo sapiens
aacuuugauacuuacuca

SEQ ID NO: 984152 - RNA, 13 nt, Homo sapiens
aagaaacauuuau

SEQ ID NO: 984153 - RNA, 15 nt, Homo sapiens
aagaaccauugauuu

SEQ ID NO: 984154 - RNA, 21 nt, Homo sapiens
aagaacuucuccuacuguagc

SEQ ID NO: 984155 - RNA, 21 nt, Homo sapiens
aagaauuuuuauauccacuaa

SEQ ID NO: 984156 - RNA, 12 nt, Homo sapiens
aagacaccacca

SEQ ID NO: 984157 - RNA, 15 nt, Homo sapiens
aagaccccaucucaa

SEQ ID NO: 984158 - RNA, 18 nt, Homo sapiens
aagacuauucccuucuaa

SEQ ID NO: 984159 - RNA, 23 nt, Homo sapiens
aagacuauucccuucuaaccuga

SEQ ID NO: 984160 - RNA, 22 nt, Homo sapiens
aagacuuuuaugauacuugaaa

SEQ ID NO: 984161 - RNA, 13 nt, Homo sapiens
aagagauuccuga

SEQ ID NO: 984162 - RNA, 13 nt, Homo sapiens
aagagccacagua

SEQ ID NO: 984163 - RNA, 16 nt, Homo sapiens
aagagcuuaagaacca

SEQ ID NO: 984164 - RNA, 14 nt, Homo sapiens
aagcaaagcucuuu

SEQ ID NO: 984165 - RNA, 20 nt, Homo sapiens
aagcaauccucccacuucag

SEQ ID NO: 984166 - RNA, 12 nt, Homo sapiens
aagcaccaggac

SEQ ID NO: 984167 - RNA, 24 nt, Homo sapiens
aagcaguugggacuacaggcguga

SEQ ID NO: 984168 - RNA, 19 nt, Homo sapiens
aagcccccacuacaaguga

SEQ ID NO: 984169 - RNA, 15 nt, Homo sapiens
aagcccuuuacuuga

SEQ ID NO: 984170 - RNA, 20 nt, Homo sapiens
aagccuuggggauucuucca

SEQ ID NO: 984171 - RNA, 17 nt, Homo sapiens
aagcgauucuccugccu

SEQ ID NO: 984172 - RNA, 14 nt, Homo sapiens
aagcuggagugcag

SEQ ID NO: 984173 - RNA, 20 nt, Homo sapiens
aagcuggagugcaguggcau

SEQ ID NO: 984174 - RNA, 13 nt, Homo sapiens
aaggaaacccagc

SEQ ID NO: 984175 - RNA, 14 nt, Homo sapiens
aaggaugucugcca

SEQ ID NO: 984176 - RNA, 21 nt, Homo sapiens
aaggcuuacacccacagugga

SEQ ID NO: 984177 - RNA, 16 nt, Homo sapiens
aagggcaggugcuuca

SEQ ID NO: 984178 - RNA, 21 nt, Homo sapiens
aagggccaaaaguauccaagg

SEQ ID NO: 984179 - RNA, 13 nt, Homo sapiens
aagggguucucac

SEQ ID NO: 984180 - RNA, 20 nt, Homo sapiens
aaggguaggcucaaaacagg

SEQ ID NO: 984181 - RNA, 19 nt, Homo sapiens
aaguaauuccguagguuau

SEQ ID NO: 984182 - RNA, 15 nt, Homo sapiens
aagucugcuacccuc

SEQ ID NO: 984183 - RNA, 15 nt, Homo sapiens
aagugcuaauuuuga

SEQ ID NO: 984184 - RNA, 19 nt, Homo sapiens
aagugcuucuccagccuca

SEQ ID NO: 984185 - RNA, 19 nt, Homo sapiens
aaguguuugaaagcuuuau

SEQ ID NO: 984186 - RNA, 16 nt, Homo sapiens
augaggcuguugucuu

SEQ ID NO: 984187 - RNA, 20 nt, Homo sapiens
augauuuuagcaauacccau

SEQ ID NO: 984188 - RNA, 15 nt, Homo sapiens
augcacugauguugu

SEQ ID NO: 984189 - RNA, 20 nt, Homo sapiens
augcacuuggcugcauaaau

SEQ ID NO: 984190 - RNA, 21 nt, Homo sapiens
augcagugcucgcuguugcug

SEQ ID NO: 984191 - RNA, 15 nt, Homo sapiens
augcauacacucuca

SEQ ID NO: 984192 - RNA, 23 nt, Homo sapiens
augccacccaguugugacaauua

SEQ ID NO: 984193 - RNA, 20 nt, Homo sapiens
augcggcccaggauggcuuu

SEQ ID NO: 984194 - RNA, 23 nt, Homo sapiens
augcugagagagcuggaggcacc

SEQ ID NO: 984195 - RNA, 20 nt, Homo sapiens
augcugcuggggaagacagu

SEQ ID NO: 984196 - RNA, 22 nt, Homo sapiens
augcuguuaugaguggcuuuaa

SEQ ID NO: 984197 - RNA, 21 nt, Homo sapiens
auggaagaggcaccuguccca

SEQ ID NO: 984198 - RNA, 21 nt, Homo sapiens
auggagauauuuacaugaauu

SEQ ID NO: 984199 - RNA, 18 nt, Homo sapiens
auggaggaaagugauauc

SEQ ID NO: 984200 - RNA, 12 nt, Homo sapiens
auggcauauaau

SEQ ID NO: 984201 - RNA, 14 nt, Homo sapiens
auggugaaaugcag

SEQ ID NO: 984202 - RNA, 12 nt, Homo sapiens
auggugcucaga

SEQ ID NO: 984203 - RNA, 18 nt, Homo sapiens
augguggcaggaaaaugg

SEQ ID NO: 984204 - RNA, 20 nt, Homo sapiens
auguacugauuacugccuau

SEQ ID NO: 984205 - RNA, 20 nt, Homo sapiens
auguaguuuuuauauguugu

SEQ ID NO: 984206 - RNA, 17 nt, Homo sapiens
augucauuucauuuccu

SEQ ID NO: 984207 - RNA, 15 nt, Homo sapiens
augugaaaucauuca

SEQ ID NO: 984208 - RNA, 16 nt, Homo sapiens
auguggcccaacacaa

SEQ ID NO: 984209 - RNA, 21 nt, Homo sapiens
auguggucuaagguucagccu

SEQ ID NO: 984210 - RNA, 23 nt, Homo sapiens
auguuaaacuagcauaucugccu

SEQ ID NO: 984211 - RNA, 10 nt, Homo sapiens
auguucaagc

SEQ ID NO: 984212 - RNA, 18 nt, Homo sapiens
auuaagacuuuauguagu

SEQ ID NO: 984213 - RNA, 19 nt, Homo sapiens
auuaagacuuuauguaguu

SEQ ID NO: 984214 - RNA, 13 nt, Homo sapiens
auuaaucugccuc

SEQ ID NO: 984215 - RNA, 17 nt, Homo sapiens
auuacaaauccaaugaa

SEQ ID NO: 984216 - RNA, 18 nt, Homo sapiens
auuacaggugugagccac

SEQ ID NO: 984217 - RNA, 13 nt, Homo sapiens
auuaccaguuuuc

SEQ ID NO: 984218 - RNA, 13 nt, Homo sapiens
auuacugcaugca

SEQ ID NO: 984219 - RNA, 16 nt, Homo sapiens
auuacugcaugcacuu

SEQ ID NO: 984220 - RNA, 20 nt, Homo sapiens
auuacugcaugcacuucuua

SEQ ID NO: 984221 - RNA, 20 nt, Homo sapiens
auuacuggaaggcuuccacu

SEQ ID NO: 984222 - RNA, 14 nt, Homo sapiens
auuagaacuucaag

SEQ ID NO: 984223 - RNA, 13 nt, Homo sapiens
auuagaccaagcu

SEQ ID NO: 984224 - RNA, 18 nt, Homo sapiens
auuauccaucuuucacua

SEQ ID NO: 984225 - RNA, 15 nt, Homo sapiens
auuaucuucaggaca

SEQ ID NO: 984226 - RNA, 15 nt, Homo sapiens
auuauuuugugaugc

SEQ ID NO: 984227 - RNA, 17 nt, Homo sapiens
auucagggagugggcua

SEQ ID NO: 984228 - RNA, 13 nt, Homo sapiens
auucauguugccu

SEQ ID NO: 984229 - RNA, 18 nt, Homo sapiens
auucauguugccuugcau

SEQ ID NO: 984230 - RNA, 14 nt, Homo sapiens
auuccuagaaacug

SEQ ID NO: 984231 - RNA, 16 nt, Homo sapiens
auuccugagccagugu

SEQ ID NO: 984232 - RNA, 22 nt, Homo sapiens
auucuaacccagguauccaaaa

SEQ ID NO: 984233 - RNA, 16 nt, Homo sapiens
auucuccauacucugu

SEQ ID NO: 984234 - RNA, 15 nt, Homo sapiens
auucucccuugcucu

SEQ ID NO: 984235 - RNA, 18 nt, Homo sapiens
auucuccugccucagccu

SEQ ID NO: 984236 - RNA, 14 nt, Homo sapiens
auucugucauuuca

SEQ ID NO: 984237 - RNA, 17 nt, Homo sapiens
auucuugauguaaaauc

SEQ ID NO: 984238 - RNA, 13 nt, Homo sapiens
auugacucauaca

SEQ ID NO: 984239 - RNA, 17 nt, Homo sapiens
auugacuuguauaccuu

SEQ ID NO: 984240 - RNA, 17 nt, Homo sapiens
auugagauguguucaca

SEQ ID NO: 984241 - RNA, 19 nt, Homo sapiens
auugcuugcacaaaccaau

SEQ ID NO: 984242 - RNA, 14 nt, Homo sapiens
auugggaauccgcc

SEQ ID NO: 984243 - RNA, 20 nt, Homo sapiens
auuguaguccuguaauggaa

SEQ ID NO: 984244 - RNA, 14 nt, Homo sapiens
auugucagcuccuu

SEQ ID NO: 984245 - RNA, 17 nt, Homo sapiens
auugugcaguacuuugu

SEQ ID NO: 984246 - RNA, 22 nt, Homo sapiens
auuuagugaucaaauugugcag

SEQ ID NO: 984247 - RNA, 20 nt, Homo sapiens
auuuaugccucuguauuuaa

SEQ ID NO: 984248 - RNA, 15 nt, Homo sapiens
auuucagcagggaug

SEQ ID NO: 984249 - RNA, 16 nt, Homo sapiens
auuucucaacuuugau

SEQ ID NO: 984250 - RNA, 22 nt, Homo sapiens
auuucuuuucugcauguucuaa

SEQ ID NO: 984251 - RNA, 17 nt, Homo sapiens
auuuuaacaucugagaa

SEQ ID NO: 984252 - RNA, 12 nt, Homo sapiens
auuuuacuguac

SEQ ID NO: 984253 - RNA, 21 nt, Homo sapiens
auuuuagcaaagauaucucau

SEQ ID NO: 984254 - RNA, 15 nt, Homo sapiens
auuuuauagcuacua

SEQ ID NO: 984255 - RNA, 21 nt, Homo sapiens
auuuugaaaaacugcucauau

SEQ ID NO: 984256 - RNA, 18 nt, Homo sapiens
auuuugaaaucaugaaga

SEQ ID NO: 984257 - RNA, 23 nt, Homo sapiens
auuuuguguuuaggaacuacuga

SEQ ID NO: 984258 - RNA, 18 nt, Homo sapiens
auuuuuaccagucucaca

SEQ ID NO: 984259 - RNA, 19 nt, Homo sapiens
auuuuuaguuuaaaaaccu

SEQ ID NO: 984260 - RNA, 16 nt, Homo sapiens
auuuuugagacagagu

SEQ ID NO: 984261 - RNA, 13 nt, Homo sapiens
auuuuuggaagag

SEQ ID NO: 984262 - RNA, 22 nt, Homo sapiens
caaaaccaaauauuccagagac

SEQ ID NO: 984263 - RNA, 18 nt, Homo sapiens
caaaaggauaaugaauac

SEQ ID NO: 984264 - RNA, 13 nt, Homo sapiens
caaacccauuccc

SEQ ID NO: 984265 - RNA, 17 nt, Homo sapiens
caaacuccugaccucaa

SEQ ID NO: 984266 - RNA, 21 nt, Homo sapiens
caaacuccugaccucaaguga

SEQ ID NO: 984267 - RNA, 21 nt, Homo sapiens
caaacuccugaccucaggcaa

SEQ ID NO: 984268 - RNA, 22 nt, Homo sapiens
caaacugcugucccaaacaugc

SEQ ID NO: 984269 - RNA, 17 nt, Homo sapiens
caaagaacuucuccuac

SEQ ID NO: 984270 - RNA, 21 nt, Homo sapiens
caaagacuacauauugucacu

SEQ ID NO: 984271 - RNA, 14 nt, Homo sapiens
caaagacuauuccc

SEQ ID NO: 984272 - RNA, 14 nt, Homo sapiens
caaagagugaagga

SEQ ID NO: 984273 - RNA, 14 nt, Homo sapiens
caaagaugacugug

SEQ ID NO: 984274 - RNA, 16 nt, Homo sapiens
caaagaugacugugga

SEQ ID NO: 984275 - RNA, 22 nt, Homo sapiens
caaagcccucccuaccuaccaa

SEQ ID NO: 984276 - RNA, 20 nt, Homo sapiens
caaagccuucauugccuuaa

SEQ ID NO: 984277 - RNA, 16 nt, Homo sapiens
caaagggggaggcuaa

SEQ ID NO: 984278 - RNA, 17 nt, Homo sapiens
caaaguccugggauuac

SEQ ID NO: 984279 - RNA, 19 nt, Homo sapiens
caaauaauuuuucacuuca

SEQ ID NO: 984280 - RNA, 16 nt, Homo sapiens
caaaucuaccacugua

SEQ ID NO: 984281 - RNA, 13 nt, Homo sapiens
caaaugcaccaug

SEQ ID NO: 984282 - RNA, 22 nt, Homo sapiens
caaaugcauuucuaaagccauu

SEQ ID NO: 984283 - RNA, 20 nt, Homo sapiens
caaauuuucuuccauuucau

SEQ ID NO: 984284 - RNA, 17 nt, Homo sapiens
caacaaagucacccacu

SEQ ID NO: 984285 - RNA, 22 nt, Homo sapiens
caacaaccggccaccagauguc

SEQ ID NO: 984286 - RNA, 18 nt, Homo sapiens
caacagguaaaacagggc

SEQ ID NO: 984287 - RNA, 15 nt, Homo sapiens
caacaugcacugaug

SEQ ID NO: 984288 - RNA, 13 nt, Homo sapiens
caacccuuucauu

SEQ ID NO: 984289 - RNA, 17 nt, Homo sapiens
caaccugaaauuaacuc

SEQ ID NO: 984290 - RNA, 19 nt, Homo sapiens
caaccuuuucccaaccaua

SEQ ID NO: 984291 - RNA, 15 nt, Homo sapiens
caagacuacuaggga

SEQ ID NO: 984292 - RNA, 20 nt, Homo sapiens
caagccuaaaauuguauaga

SEQ ID NO: 984293 - RNA, 12 nt, Homo sapiens
caagcugcauuu

SEQ ID NO: 984294 - RNA, 15 nt, Homo sapiens
caaguagcacccugg

SEQ ID NO: 984295 - RNA, 17 nt, Homo sapiens
caagucagcucuucucc

SEQ ID NO: 984296 - RNA, 23 nt, Homo sapiens
caaucaguagccagcaucugccu

SEQ ID NO: 984297 - RNA, 11 nt, Homo sapiens
caaugaacuuu

SEQ ID NO: 984298 - RNA, 16 nt, Homo sapiens
caauuaauuccuucag

SEQ ID NO: 984299 - RNA, 21 nt, Homo sapiens
caauuaauuccuucagcacuu

SEQ ID NO: 984300 - RNA, 13 nt, Homo sapiens
caauuagcuccuc

SEQ ID NO: 984301 - RNA, 14 nt, Homo sapiens
caauucauccucac

SEQ ID NO: 984302 - RNA, 16 nt, Homo sapiens
caauugggagcugcca

SEQ ID NO: 984303 - RNA, 13 nt, Homo sapiens
cacaaauuaucuu

SEQ ID NO: 984304 - RNA, 20 nt, Homo sapiens
cacacacaaugugucugaga

SEQ ID NO: 984305 - RNA, 19 nt, Homo sapiens
cacagaauucauucacuca

SEQ ID NO: 984306 - RNA, 21 nt, Homo sapiens
cacagacauccucuaugccag

SEQ ID NO: 984307 - RNA, 15 nt, Homo sapiens
cacagaucacagcuu

SEQ ID NO: 984308 - RNA, 14 nt, Homo sapiens
cacagcuuuuuacc

SEQ ID NO: 984309 - RNA, 16 nt, Homo sapiens
cacagguagacaguau

SEQ ID NO: 984310 - RNA, 21 nt, Homo sapiens
cacauacauguaaaauauguc

SEQ ID NO: 984311 - RNA, 14 nt, Homo sapiens
cacauccagccuaa

SEQ ID NO: 984312 - RNA, 19 nt, Homo sapiens
cacauguaucuaugcauuu

SEQ ID NO: 984313 - RNA, 19 nt, Homo sapiens
caccaguugaauuucauca

SEQ ID NO: 984314 - RNA, 20 nt, Homo sapiens
caccaucgucuucuuggcca

SEQ ID NO: 984315 - RNA, 12 nt, Homo sapiens
caccaugcugcu

SEQ ID NO: 984316 - RNA, 21 nt, Homo sapiens
cuucucuguucauuuccucaa

SEQ ID NO: 984317 - RNA, 21 nt, Homo sapiens
cuucugagcaccuacuuacau

SEQ ID NO: 984318 - RNA, 16 nt, Homo sapiens
cuucuuacuggugcua

SEQ ID NO: 984319 - RNA, 20 nt, Homo sapiens
cuugaaaaaugcauguugcc

SEQ ID NO: 984320 - RNA, 14 nt, Homo sapiens
cuugaaucaaagaa

SEQ ID NO: 984321 - RNA, 19 nt, Homo sapiens
cuugagucuccaacggcaa

SEQ ID NO: 984322 - RNA, 18 nt, Homo sapiens
cuugaguuuaaauuguaa

SEQ ID NO: 984323 - RNA, 20 nt, Homo sapiens
cuugccuaaauacaagggcu

SEQ ID NO: 984324 - RNA, 14 nt, Homo sapiens
cuugccugcaggca

SEQ ID NO: 984325 - RNA, 18 nt, Homo sapiens
cuugccuugcugaacucc

SEQ ID NO: 984326 - RNA, 12 nt, Homo sapiens
cuugcucagugg

SEQ ID NO: 984327 - RNA, 23 nt, Homo sapiens
cuuggaauccuggggaacauaga

SEQ ID NO: 984328 - RNA, 20 nt, Homo sapiens
cuuggagacaaaaucuuaaa

SEQ ID NO: 984329 - RNA, 20 nt, Homo sapiens
cuuggugauuccgcagugag

SEQ ID NO: 984330 - RNA, 18 nt, Homo sapiens
cuugguucaguaccacau

SEQ ID NO: 984331 - RNA, 18 nt, Homo sapiens
cuuuaaccucacauaccc

SEQ ID NO: 984332 - RNA, 14 nt, Homo sapiens
cuuuaauggguaaa

SEQ ID NO: 984333 - RNA, 19 nt, Homo sapiens
cuuucauaaagucuugccu

SEQ ID NO: 984334 - RNA, 14 nt, Homo sapiens
cuuuccacauucag

SEQ ID NO: 984335 - RNA, 15 nt, Homo sapiens
cuuucccuaagccag

SEQ ID NO: 984336 - RNA, 13 nt, Homo sapiens
cuuucuucucucc

SEQ ID NO: 984337 - RNA, 18 nt, Homo sapiens
cuuugaaugcggcccaac

SEQ ID NO: 984338 - RNA, 23 nt, Homo sapiens
cuuugccccugagacaaauggag

SEQ ID NO: 984339 - RNA, 17 nt, Homo sapiens
cuuuuaugauacuugaa

SEQ ID NO: 984340 - RNA, 23 nt, Homo sapiens
cuuuuuauacuuuguaaagacaa

SEQ ID NO: 984341 - RNA, 17 nt, Homo sapiens
cuuuuuggacacacaaa

SEQ ID NO: 984342 - RNA, 22 nt, Homo sapiens
gaaaagauacccaaaggucaag

SEQ ID NO: 984343 - RNA, 16 nt, Homo sapiens
gaaaauaagagcucag

SEQ ID NO: 984344 - RNA, 16 nt, Homo sapiens
gaaacauuuucucccu

SEQ ID NO: 984345 - RNA, 13 nt, Homo sapiens
gaaagauuacuuu

SEQ ID NO: 984346 - RNA, 21 nt, Homo sapiens
gaaaggaccaguaugcuugga

SEQ ID NO: 984347 - RNA, 12 nt, Homo sapiens
gaaagugauauc

SEQ ID NO: 984348 - RNA, 21 nt, Homo sapiens
gaaaucauucauuuucugggu

SEQ ID NO: 984349 - RNA, 14 nt, Homo sapiens
gaaaugcagaguca

SEQ ID NO: 984350 - RNA, 14 nt, Homo sapiens
gaaaugucaugugg

SEQ ID NO: 984351 - RNA, 15 nt, Homo sapiens
gaaauuaagacuuua

SEQ ID NO: 984352 - RNA, 13 nt, Homo sapiens
gaacaaacagggc

SEQ ID NO: 984353 - RNA, 15 nt, Homo sapiens
gaacccuacacccca

SEQ ID NO: 984354 - RNA, 15 nt, Homo sapiens
gaacuggacccuguu

SEQ ID NO: 984355 - RNA, 20 nt, Homo sapiens
gaacuggacccuguugcuaa

SEQ ID NO: 984356 - RNA, 22 nt, Homo sapiens
gaacuucuccuacuguagcaac

SEQ ID NO: 984357 - RNA, 14 nt, Homo sapiens
gaagccaugugauu

SEQ ID NO: 984358 - RNA, 12 nt, Homo sapiens
gaaggccaagag

SEQ ID NO: 984359 - RNA, 12 nt, Homo sapiens
gaaggugucaua

SEQ ID NO: 984360 - RNA, 19 nt, Homo sapiens
gaagugcuuucuucuccca

SEQ ID NO: 984361 - RNA, 17 nt, Homo sapiens
gaauaaucuccuguuaa

SEQ ID NO: 984362 - RNA, 18 nt, Homo sapiens
gaauugugcaaccaucac

SEQ ID NO: 984363 - RNA, 17 nt, Homo sapiens
gacaagcugcauuucag

SEQ ID NO: 984364 - RNA, 22 nt, Homo sapiens
gacacagucuaacaaauuccaa

SEQ ID NO: 984365 - RNA, 24 nt, Homo sapiens
gacacaugcugaacaucacagcuu

SEQ ID NO: 984366 - RNA, 20 nt, Homo sapiens
gacacauguauuuggugauu

SEQ ID NO: 984367 - RNA, 22 nt, Homo sapiens
gacagagcaagaccccaucuca

SEQ ID NO: 984368 - RNA, 23 nt, Homo sapiens
gacagagcaagaccccaucucaa

SEQ ID NO: 984369 - RNA, 13 nt, Homo sapiens
gacagcuucucau

SEQ ID NO: 984370 - RNA, 21 nt, Homo sapiens
gacagcuugaucaaaggcaca

SEQ ID NO: 984371 - RNA, 14 nt, Homo sapiens
gacauacauuucuc

SEQ ID NO: 984372 - RNA, 15 nt, Homo sapiens
gaccauuagcauuug

SEQ ID NO: 984373 - RNA, 16 nt, Homo sapiens
gaccucaagugaucug

SEQ ID NO: 984374 - RNA, 18 nt, Homo sapiens
gaccucaggcaaucugcc

SEQ ID NO: 984375 - RNA, 19 nt, Homo sapiens
gaccucucucaaagugcug

SEQ ID NO: 984376 - RNA, 22 nt, Homo sapiens
gacuacaggcgugagccaccau

SEQ ID NO: 984377 - RNA, 20 nt, Homo sapiens
gacucaaagagggagugcau

SEQ ID NO: 984378 - RNA, 12 nt, Homo sapiens
gacucaagcaag

SEQ ID NO: 984379 - RNA, 13 nt, Homo sapiens
gacucacuguggg

SEQ ID NO: 984380 - RNA, 15 nt, Homo sapiens
gacucaucauuucca

SEQ ID NO: 984381 - RNA, 16 nt, Homo sapiens
gacucaucauuuccau

SEQ ID NO: 984382 - RNA, 17 nt, Homo sapiens
gacuuuuuccuugggcu

SEQ ID NO: 984383 - RNA, 16 nt, Homo sapiens
gagaaaauguuguaua

SEQ ID NO: 984384 - RNA, 21 nt, Homo sapiens
gagacaaaaucuuaaaugcca

SEQ ID NO: 984385 - RNA, 14 nt, Homo sapiens
gagacaacagguaa

SEQ ID NO: 984386 - RNA, 14 nt, Homo sapiens
gagacagaaucuca

SEQ ID NO: 984387 - RNA, 21 nt, Homo sapiens
gagacagagucuuacucuguu

SEQ ID NO: 984388 - RNA, 18 nt, Homo sapiens
gagacaggguuucaccau

SEQ ID NO: 984389 - RNA, 19 nt, Homo sapiens
gagacauacaccuauguca

SEQ ID NO: 984390 - RNA, 19 nt, Homo sapiens
gagaccuuccagaaauacu

SEQ ID NO: 984391 - RNA, 18 nt, Homo sapiens
gagagcacgccuguacua

SEQ ID NO: 984392 - RNA, 17 nt, Homo sapiens
gagauggaggaaaguga

SEQ ID NO: 984393 - RNA, 15 nt, Homo sapiens
gagauuccugagcca

SEQ ID NO: 984394 - RNA, 18 nt, Homo sapiens
gagcaagaccccaucuca

SEQ ID NO: 984395 - RNA, 20 nt, Homo sapiens
gagcagcccuaggcuuccac

SEQ ID NO: 984396 - RNA, 14 nt, Homo sapiens
gagcaguagcugga

SEQ ID NO: 984397 - RNA, 13 nt, Homo sapiens
gagccaccaugcc

SEQ ID NO: 984398 - RNA, 18 nt, Homo sapiens
gagccagggcugucuucg

SEQ ID NO: 984399 - RNA, 22 nt, Homo sapiens
gagcccucuaugguguggcaaa

SEQ ID NO: 984400 - RNA, 12 nt, Homo sapiens
gagccugaguga

SEQ ID NO: 984401 - RNA, 22 nt, Homo sapiens
gagcugccaagagugaagggaa

SEQ ID NO: 984402 - RNA, 14 nt, Homo sapiens
gagcuuaaacagcu

SEQ ID NO: 984403 - RNA, 19 nt, Homo sapiens
gagcuugcaugcuugcaua

SEQ ID NO: 984404 - RNA, 13 nt, Homo sapiens
gaggacuccuuaa

SEQ ID NO: 984405 - RNA, 19 nt, Homo sapiens
gaggccccugucucagggu

SEQ ID NO: 984406 - RNA, 14 nt, Homo sapiens
gaggcuacuguaag

SEQ ID NO: 984407 - RNA, 19 nt, Homo sapiens
gaguacuggcugauggagu

SEQ ID NO: 984408 - RNA, 16 nt, Homo sapiens
gaguauccucuugcca

SEQ ID NO: 984409 - RNA, 16 nt, Homo sapiens
gagucugcacgggacc

SEQ ID NO: 984410 - RNA, 20 nt, Homo sapiens
gagugcaccacuucaaguga

SEQ ID NO: 984411 - RNA, 19 nt, Homo sapiens
gagugcaguggcgugaucu

SEQ ID NO: 984412 - RNA, 14 nt, Homo sapiens
gagugcccccaaca

SEQ ID NO: 984413 - RNA, 16 nt, Homo sapiens
gauaaaagacagugaa

SEQ ID NO: 984414 - RNA, 18 nt, Homo sapiens
gauaaaagacagugaaag

SEQ ID NO: 984415 - RNA, 19 nt, Homo sapiens
gauaaaguugguaaaccuu

SEQ ID NO: 984416 - RNA, 15 nt, Homo sapiens
gauaaggaaauaaga

SEQ ID NO: 984417 - RNA, 16 nt, Homo sapiens
gauauaagugcuguau

SEQ ID NO: 984418 - RNA, 20 nt, Homo sapiens
gauauaauucuuaugccaua

SEQ ID NO: 984419 - RNA, 14 nt, Homo sapiens
gauccccacgccac

SEQ ID NO: 984420 - RNA, 20 nt, Homo sapiens
gauccccacgccacagcccu

SEQ ID NO: 984421 - RNA, 19 nt, Homo sapiens
gaugcuacucuaguauucc

SEQ ID NO: 984422 - RNA, 13 nt, Homo sapiens
gaugcugucuucg

SEQ ID NO: 984423 - RNA, 22 nt, Homo sapiens
gaugcugucuucguacugggaa

SEQ ID NO: 984424 - RNA, 19 nt, Homo sapiens
gauggagauauuuacauga

SEQ ID NO: 984425 - RNA, 20 nt, Homo sapiens
gaugggagugcccccaacag

SEQ ID NO: 984426 - RNA, 22 nt, Homo sapiens
gaugggguuucaccauguuggc

SEQ ID NO: 984427 - RNA, 18 nt, Homo sapiens
gaugucugccacaccucu

SEQ ID NO: 984428 - RNA, 21 nt, Homo sapiens
gauuaaugucaauucuugcca

SEQ ID NO: 984429 - RNA, 19 nt, Homo sapiens
gauuacaggugugagccac

SEQ ID NO: 984430 - RNA, 20 nt, Homo sapiens
gauucauuuuaacaucugag

SEQ ID NO: 984431 - RNA, 16 nt, Homo sapiens
gauucucuugccucaa

SEQ ID NO: 984432 - RNA, 21 nt, Homo sapiens
gauucucuugccucaaccucc

SEQ ID NO: 984433 - RNA, 14 nt, Homo sapiens
gauugugucccauu

SEQ ID NO: 984434 - RNA, 19 nt, Homo sapiens
gauuuagcaggaagcugug

SEQ ID NO: 984435 - RNA, 15 nt, Homo sapiens
gauuucagcagggau

SEQ ID NO: 984436 - RNA, 18 nt, Homo sapiens
gauuuguuaaagggccaa

SEQ ID NO: 984437 - RNA, 19 nt, Homo sapiens
gauuuguuaaagggccaaa

SEQ ID NO: 984438 - RNA, 21 nt, Homo sapiens
gauuuuuacacauguaucuau

SEQ ID NO: 984439 - RNA, 12 nt, Homo sapiens
gcaaaaccaaau

SEQ ID NO: 984440 - RNA, 24 nt, Homo sapiens
gcaaacuuucuuaaaacauuauga

SEQ ID NO: 984441 - RNA, 22 nt, Homo sapiens
gcaacagccacuacauuacuuc

SEQ ID NO: 984442 - RNA, 18 nt, Homo sapiens
gcaaccucugccucccag

SEQ ID NO: 984443 - RNA, 23 nt, Homo sapiens
gcaagcagagguggcgauuuguu

SEQ ID NO: 984444 - RNA, 14 nt, Homo sapiens
gcaaguuagaacua

SEQ ID NO: 984445 - RNA, 13 nt, Homo sapiens
gcaauagaacccu

SEQ ID NO: 984446 - RNA, 19 nt, Homo sapiens
uacauucuuaaagugucga

SEQ ID NO: 984447 - RNA, 18 nt, Homo sapiens
uacauucuuccugauuau

SEQ ID NO: 984448 - RNA, 19 nt, Homo sapiens
uacauuuuaaacacauuag

SEQ ID NO: 984449 - RNA, 15 nt, Homo sapiens
uaccacucagagaaa

SEQ ID NO: 984450 - RNA, 17 nt, Homo sapiens
uaccauauacagcucag

SEQ ID NO: 984451 - RNA, 21 nt, Homo sapiens
uaccauuucuugagguaaaag

SEQ ID NO: 984452 - RNA, 22 nt, Homo sapiens
uacccuaaacauccuaagcuca

SEQ ID NO: 984453 - RNA, 19 nt, Homo sapiens
uaccuaccaagauauaccu

SEQ ID NO: 984454 - RNA, 12 nt, Homo sapiens
uaccucacuuua

SEQ ID NO: 984455 - RNA, 22 nt, Homo sapiens
uaccucaguucccucuugcuca

SEQ ID NO: 984456 - RNA, 14 nt, Homo sapiens
uacgcaucagacag

SEQ ID NO: 984457 - RNA, 14 nt, Homo sapiens
uacuacaugcacuu

SEQ ID NO: 984458 - RNA, 15 nt, Homo sapiens
uacugauuacugccu

SEQ ID NO: 984459 - RNA, 14 nt, Homo sapiens
uacugcaugcacuu

SEQ ID NO: 984460 - RNA, 20 nt, Homo sapiens
uacuugaaaauuaacaugaa

SEQ ID NO: 984461 - RNA, 22 nt, Homo sapiens
uacuugcuuuggaaaacccaga

SEQ ID NO: 984462 - RNA, 14 nt, Homo sapiens
uacuuuguaaagac

SEQ ID NO: 984463 - RNA, 22 nt, Homo sapiens
uacuuuuggcauuuuacuguac

SEQ ID NO: 984464 - RNA, 19 nt, Homo sapiens
uagaaaaguuauguagaaa

SEQ ID NO: 984465 - RNA, 15 nt, Homo sapiens
uagaaagaagaugaa

SEQ ID NO: 984466 - RNA, 20 nt, Homo sapiens
uagaauuugagcaucaguga

SEQ ID NO: 984467 - RNA, 13 nt, Homo sapiens
uagacuagucuca

SEQ ID NO: 984468 - RNA, 15 nt, Homo sapiens
uagagaaauaugauu

SEQ ID NO: 984469 - RNA, 14 nt, Homo sapiens
uagagacucaaaga

SEQ ID NO: 984470 - RNA, 16 nt, Homo sapiens
uagcaaagauaucuca

SEQ ID NO: 984471 - RNA, 16 nt, Homo sapiens
uagcaaagcgacguua

SEQ ID NO: 984472 - RNA, 22 nt, Homo sapiens
uagcagauacagggaugaggca

SEQ ID NO: 984473 - RNA, 20 nt, Homo sapiens
uagccaaaccaggacccugu

SEQ ID NO: 984474 - RNA, 19 nt, Homo sapiens
uagccagaggcucuaaugu

SEQ ID NO: 984475 - RNA, 22 nt, Homo sapiens
uaggaacuacugaggaucagag

SEQ ID NO: 984476 - RNA, 20 nt, Homo sapiens
uaguccccagccugcucccu

SEQ ID NO: 984477 - RNA, 16 nt, Homo sapiens
uagucucuacccagua

SEQ ID NO: 984478 - RNA, 23 nt, Homo sapiens
uagucucuacccaguagaugcca

SEQ ID NO: 984479 - RNA, 19 nt, Homo sapiens
uagugauuuccacagugac

SEQ ID NO: 984480 - RNA, 21 nt, Homo sapiens
uaguggugacugugggcucca

SEQ ID NO: 984481 - RNA, 20 nt, Homo sapiens
uauaaaaauaaaaaacacug

SEQ ID NO: 984482 - RNA, 16 nt, Homo sapiens
uauaaauaaauaccaa

SEQ ID NO: 984483 - RNA, 19 nt, Homo sapiens
uauaaauaaauaccaaaaa

SEQ ID NO: 984484 - RNA, 15 nt, Homo sapiens
uauaagcugccauau

SEQ ID NO: 984485 - RNA, 18 nt, Homo sapiens
uauacaguuuaccgaaaa

SEQ ID NO: 984486 - RNA, 14 nt, Homo sapiens
uauauuccaccagg

SEQ ID NO: 984487 - RNA, 21 nt, Homo sapiens
uauauuccaccaggauauccu

SEQ ID NO: 984488 - RNA, 14 nt, Homo sapiens
uaucaugugucuuc

SEQ ID NO: 984489 - RNA, 13 nt, Homo sapiens
uauccucuugcca

SEQ ID NO: 984490 - RNA, 12 nt, Homo sapiens
uaucuaugcauu

SEQ ID NO: 984491 - RNA, 22 nt, Homo sapiens
uaugaaggcuguacacugcacg

SEQ ID NO: 984492 - RNA, 15 nt, Homo sapiens
uaugcauuauaucaa

SEQ ID NO: 984493 - RNA, 15 nt, Homo sapiens
uaugccucuguauuu

SEQ ID NO: 984494 - RNA, 14 nt, Homo sapiens
uaugcucuaaacau

SEQ ID NO: 984495 - RNA, 18 nt, Homo sapiens
uauguuaaacuagcauau

SEQ ID NO: 984496 - RNA, 17 nt, Homo sapiens
uauguuacuacaugcac

SEQ ID NO: 984497 - RNA, 19 nt, Homo sapiens
uauguuacuacaugcacuu

SEQ ID NO: 984498 - RNA, 18 nt, Homo sapiens
uauuacaaauccaaugaa

SEQ ID NO: 984499 - RNA, 12 nt, Homo sapiens
uauuauaauuca

SEQ ID NO: 984500 - RNA, 17 nt, Homo sapiens
uauuauuuuugagacag

SEQ ID NO: 984501 - RNA, 14 nt, Homo sapiens
uauucagcucaugg

SEQ ID NO: 984502 - RNA, 15 nt, Homo sapiens
uauucuccauacucu

SEQ ID NO: 984503 - RNA, 19 nt, Homo sapiens
uauucuccauacucuguaa

SEQ ID NO: 984504 - RNA, 21 nt, Homo sapiens
uauuggacaguaaaauccaca

SEQ ID NO: 984505 - RNA, 16 nt, Homo sapiens
uauuuagauuggcagu

SEQ ID NO: 984506 - RNA, 14 nt, Homo sapiens
uauuuaugccucug

SEQ ID NO: 984507 - RNA, 22 nt, Homo sapiens
uauuucccuguuucuuccacag

SEQ ID NO: 984508 - RNA, 14 nt, Homo sapiens
ucaaaauuguuaca

SEQ ID NO: 984509 - RNA, 15 nt, Homo sapiens
ucaaaauuguuacaa

SEQ ID NO: 984510 - RNA, 22 nt, Homo sapiens
ucaaagagggagugcauuuaug

SEQ ID NO: 984511 - RNA, 13 nt, Homo sapiens
ucaaagugagcuc

SEQ ID NO: 984512 - RNA, 16 nt, Homo sapiens
ucaacaaagucaccca

SEQ ID NO: 984513 - RNA, 18 nt, Homo sapiens
ucaaccucccaagcaguu

SEQ ID NO: 984514 - RNA, 19 nt, Homo sapiens
ucaacuagcagauacaggg

SEQ ID NO: 984515 - RNA, 18 nt, Homo sapiens
ucaacuuuuccuuugaau

SEQ ID NO: 984516 - RNA, 15 nt, Homo sapiens
ucaagaacacaguga

SEQ ID NO: 984517 - RNA, 21 nt, Homo sapiens
ucaagcaguuauuugauuugu

SEQ ID NO: 984518 - RNA, 22 nt, Homo sapiens
ucaagcaguuauuugauuugug

SEQ ID NO: 984519 - RNA, 21 nt, Homo sapiens
ucaagcccugcagucacagcu

SEQ ID NO: 984520 - RNA, 18 nt, Homo sapiens
ucaagcccuuuacuugac

SEQ ID NO: 984521 - RNA, 23 nt, Homo sapiens
ucaaucuguccguucacaugugu

SEQ ID NO: 984522 - RNA, 16 nt, Homo sapiens
ucacagcuacacagau

SEQ ID NO: 984523 - RNA, 18 nt, Homo sapiens
ucacagugggagccaggg

SEQ ID NO: 984524 - RNA, 23 nt, Homo sapiens
ucacauaaugcucauacuuaucu

SEQ ID NO: 984525 - RNA, 18 nt, Homo sapiens
ucacauccauucuucccu

SEQ ID NO: 984526 - RNA, 18 nt, Homo sapiens
ucacaugaacuuguaaag

SEQ ID NO: 984527 - RNA, 17 nt, Homo sapiens
ucaccauguacauagcu

SEQ ID NO: 984528 - RNA, 20 nt, Homo sapiens
ucaccauguacauagcuuga

SEQ ID NO: 984529 - RNA, 19 nt, Homo sapiens
ucaccuuaggaauaaucuc

SEQ ID NO: 984530 - RNA, 13 nt, Homo sapiens
ucacugacacaca

SEQ ID NO: 984531 - RNA, 19 nt, Homo sapiens
ucacugugcaaauauaucu

SEQ ID NO: 984532 - RNA, 15 nt, Homo sapiens
ucacuuaaacuuuua

SEQ ID NO: 984533 - RNA, 21 nt, Homo sapiens
ucacuugguucaguaccacau

SEQ ID NO: 984534 - RNA, 13 nt, Homo sapiens
ucacuuugcuaca

SEQ ID NO: 984535 - RNA, 18 nt, Homo sapiens
ucagaaguuucuucuuua

SEQ ID NO: 984536 - RNA, 17 nt, Homo sapiens
ucagaguaauccaagca

SEQ ID NO: 984537 - RNA, 21 nt, Homo sapiens
ucagauccuccucauucacau

SEQ ID NO: 984538 - RNA, 18 nt, Homo sapiens
ucagauuauaacuguugu

SEQ ID NO: 984539 - RNA, 17 nt, Homo sapiens
ucagcccugcaccaugc

SEQ ID NO: 984540 - RNA, 14 nt, Homo sapiens
ucagccucccaaag

SEQ ID NO: 984541 - RNA, 14 nt, Homo sapiens
ucagcucacugcaa

SEQ ID NO: 984542 - RNA, 20 nt, Homo sapiens
ucagcuuuaguagauauuac

SEQ ID NO: 984543 - RNA, 13 nt, Homo sapiens
ucaggauaccaua

SEQ ID NO: 984544 - RNA, 16 nt, Homo sapiens
ucauaacucugugauc

SEQ ID NO: 984545 - RNA, 12 nt, Homo sapiens
ucauaagauauu

SEQ ID NO: 984546 - RNA, 24 nt, Homo sapiens
ucauaccguguaccucaguucccu

SEQ ID NO: 984547 - RNA, 15 nt, Homo sapiens
ucaucacauucaggg

SEQ ID NO: 984548 - RNA, 13 nt, Homo sapiens
ucauccugcaggc

SEQ ID NO: 984549 - RNA, 17 nt, Homo sapiens
ucaucucacauuuuccc

SEQ ID NO: 984550 - RNA, 22 nt, Homo sapiens
ucaucucuucuuuuaaaccauu

SEQ ID NO: 984551 - RNA, 14 nt, Homo sapiens
ucaugaagauauuu

SEQ ID NO: 984552 - RNA, 21 nt, Homo sapiens
ucauguaucgcuucauguaac

SEQ ID NO: 984553 - RNA, 14 nt, Homo sapiens
ucaugucaugugua

SEQ ID NO: 984554 - RNA, 11 nt, Homo sapiens
ucaugugaaau

SEQ ID NO: 984555 - RNA, 10 nt, Homo sapiens
ucauguugcc

SEQ ID NO: 984556 - RNA, 18 nt, Homo sapiens
ucauguugccuugcauaa

SEQ ID NO: 984557 - RNA, 12 nt, Homo sapiens
ucauucaaguca

SEQ ID NO: 984558 - RNA, 15 nt, Homo sapiens
ucauucacucaacaa

SEQ ID NO: 984559 - RNA, 22 nt, Homo sapiens
ucauuuccuccgucaccucaga

SEQ ID NO: 984560 - RNA, 19 nt, Homo sapiens
ucauuuuaacaucugagaa

SEQ ID NO: 984561 - RNA, 18 nt, Homo sapiens
uccaaagcccucccuacc

SEQ ID NO: 984562 - RNA, 23 nt, Homo sapiens
uccaacaugaaaacaauucuuau

SEQ ID NO: 984563 - RNA, 19 nt, Homo sapiens
uccaacggcaagggaacaa

SEQ ID NO: 984564 - RNA, 16 nt, Homo sapiens
uccaacguggcccaga

SEQ ID NO: 984565 - RNA, 23 nt, Homo sapiens
uccaacguggcccagagaagcca

SEQ ID NO: 984566 - RNA, 20 nt, Homo sapiens
uccaagcaaaugugaaucau

SEQ ID NO: 984567 - RNA, 21 nt, Homo sapiens
uccacuaggguccaccaggag

SEQ ID NO: 984568 - RNA, 18 nt, Homo sapiens
uccagaaauacuacugug

SEQ ID NO: 984569 - RNA, 18 nt, Homo sapiens
uccagagacugggacuaa

SEQ ID NO: 984570 - RNA, 23 nt, Homo sapiens
uccagcugcucugucuucuuugc

SEQ ID NO: 984571 - RNA, 18 nt, Homo sapiens
uccagcuuaguucaaguc

SEQ ID NO: 984572 - RNA, 21 nt, Homo sapiens
uccaucucuuguuuaaauuca

SEQ ID NO: 984573 - RNA, 20 nt, Homo sapiens
uccaugggccauaugaaaag

SEQ ID NO: 984574 - RNA, 20 nt, Homo sapiens
ucccaaagugcugggauuaa

SEQ ID NO: 984575 - RNA, 23 nt, Homo sapiens
ucccaaauugaaucacugcucac

SEQ ID NO: 984576 - RNA, 19 nt, Homo sapiens
uuuugaaaaacugcucaua

SEQ ID NO: 984577 - RNA, 15 nt, Homo sapiens
uuuugaaaccaugaa

SEQ ID NO: 984578 - RNA, 22 nt, Homo sapiens
uuuugagauggagucuugcucu

SEQ ID NO: 984579 - RNA, 22 nt, Homo sapiens
uuuuuacuaaacucagaggcag

SEQ ID NO: 984580 - RNA, 11 nt, Homo sapiens
uuuuucaugau

SEQ ID NO: 984581 - RNA, 13 nt, Homo sapiens
uuuuuucccccac

SEQ ID NO: 984582 - RNA, 11 nt, Homo sapiens
uaacuauucau

SEQ ID NO: 984583 - RNA, 13 nt, Homo sapiens
uaacuauucauaa

SEQ ID NO: 984584 - RNA, 17 nt, Homo sapiens
uaacugccuuguguaca

SEQ ID NO: 984585 - RNA, 23 nt, Homo sapiens
uaagaaccacucauaauucuuca

SEQ ID NO: 984586 - RNA, 14 nt, Homo sapiens
uaagagcucaggau

SEQ ID NO: 984587 - RNA, 21 nt, Homo sapiens
uaagcccccacuacaagugau

SEQ ID NO: 984588 - RNA, 23 nt, Homo sapiens
uaauaaauguaccuucacaccaa

SEQ ID NO: 984589 - RNA, 17 nt, Homo sapiens
uaauaggcguaacuaau

SEQ ID NO: 984590 - RNA, 17 nt, Homo sapiens
uaauauaagcugccaua

SEQ ID NO: 984591 - RNA, 15 nt, Homo sapiens
uaauaugguguacau

SEQ ID NO: 984592 - RNA, 21 nt, Homo sapiens
uaaucccagcaugcugagauu

SEQ ID NO: 984593 - RNA, 12 nt, Homo sapiens
uaauccuaaaca

SEQ ID NO: 984594 - RNA, 23 nt, Homo sapiens
uaaugaauaaacauuuguagcau

SEQ ID NO: 984595 - RNA, 18 nt, Homo sapiens
uaaugguuuuuaacaccu

SEQ ID NO: 984596 - RNA, 21 nt, Homo sapiens
uaauguacaauaaagcaaugu

SEQ ID NO: 984597 - RNA, 15 nt, Homo sapiens
uaaugucaauucuug

SEQ ID NO: 984598 - RNA, 12 nt, Homo sapiens
uaauuagugaac

SEQ ID NO: 984599 - RNA, 13 nt, Homo sapiens
uaauucauguugc

SEQ ID NO: 984600 - RNA, 14 nt, Homo sapiens
uaauucauguugcc

SEQ ID NO: 984601 - RNA, 17 nt, Homo sapiens
uaauuccuucagcacuu

SEQ ID NO: 984602 - RNA, 12 nt, Homo sapiens
uaauucuucacc

SEQ ID NO: 984603 - RNA, 17 nt, Homo sapiens
uaauuuugaaaaacugc

SEQ ID NO: 984604 - RNA, 23 nt, Homo sapiens
uaauuuugaaaaacugcucauau

SEQ ID NO: 984605 - RNA, 12 nt, Homo sapiens
uacaaacauguu

SEQ ID NO: 984606 - RNA, 21 nt, Homo sapiens
uacaaaggcuuauuaauuuga

SEQ ID NO: 984607 - RNA, 15 nt, Homo sapiens
uacaaaugcauuucu

SEQ ID NO: 984608 - RNA, 19 nt, Homo sapiens
uacaauaauucuaugagau

SEQ ID NO: 984609 - RNA, 13 nt, Homo sapiens
uacacauacaugu

SEQ ID NO: 984610 - RNA, 18 nt, Homo sapiens
uacacauguaucuaugca

SEQ ID NO: 984611 - RNA, 19 nt, Homo sapiens
uacacauguaucuaugcau

SEQ ID NO: 984612 - RNA, 20 nt, Homo sapiens
uacacauguaucuaugcauu

SEQ ID NO: 984613 - RNA, 15 nt, Homo sapiens
uacacuggaugaaaa

SEQ ID NO: 984614 - RNA, 19 nt, Homo sapiens
uacagacagaaaaaacuga

SEQ ID NO: 984615 - RNA, 14 nt, Homo sapiens
uacauuucucauac

SEQ ID NO: 984616 - RNA, 17 nt, Homo sapiens
uacccaguagaugccac

SEQ ID NO: 984617 - RNA, 15 nt, Homo sapiens
uaccccuuuacaaau

SEQ ID NO: 984618 - RNA, 18 nt, Homo sapiens
uacccucacuuaaacuuu

SEQ ID NO: 984619 - RNA, 18 nt, Homo sapiens
uaccgaaaaucauauaau

SEQ ID NO: 984620 - RNA, 19 nt, Homo sapiens
uaccuagcuggcucuguga

SEQ ID NO: 984621 - RNA, 16 nt, Homo sapiens
uaccuguuaguauuau

SEQ ID NO: 984622 - RNA, 23 nt, Homo sapiens
uaccuguuaguauuauuguugca

SEQ ID NO: 984623 - RNA, 22 nt, Homo sapiens
uaccuuccccacaucugagaga

SEQ ID NO: 984624 - RNA, 19 nt, Homo sapiens
uaccuuguaauuugaaaua

SEQ ID NO: 984625 - RNA, 18 nt, Homo sapiens
uaccuuuugcuguggcaa

SEQ ID NO: 984626 - RNA, 17 nt, Homo sapiens
uacuagagcaagcagga

SEQ ID NO: 984627 - RNA, 15 nt, Homo sapiens
uacugcaugcacuuc

SEQ ID NO: 984628 - RNA, 22 nt, Homo sapiens
uacugcuggcaguggaacuaag

SEQ ID NO: 984629 - RNA, 12 nt, Homo sapiens
uacuguacagac

SEQ ID NO: 984630 - RNA, 13 nt, Homo sapiens
uacuuacaugcau

SEQ ID NO: 984631 - RNA, 16 nt, Homo sapiens
uacuuacaugcauuac

SEQ ID NO: 984632 - RNA, 16 nt, Homo sapiens
uacuucaaacugagau

SEQ ID NO: 984633 - RNA, 14 nt, Homo sapiens
uacuugaaggucua

SEQ ID NO: 984634 - RNA, 12 nt, Homo sapiens
uacuuugugcau

SEQ ID NO: 984635 - RNA, 15 nt, Homo sapiens
uacuuugugcauucu

SEQ ID NO: 984636 - RNA, 20 nt, Homo sapiens
uagaaaaguuauguagaaaa

SEQ ID NO: 984637 - RNA, 13 nt, Homo sapiens
uagaaagcauuug

SEQ ID NO: 984638 - RNA, 12 nt, Homo sapiens
uagaccauuaau

SEQ ID NO: 984639 - RNA, 20 nt, Homo sapiens
uagauuugugugcaucaggc

SEQ ID NO: 984640 - RNA, 21 nt, Homo sapiens
uagcaaagauaucucaucucu

SEQ ID NO: 984641 - RNA, 17 nt, Homo sapiens
uagcauuugucaacaaa

SEQ ID NO: 984642 - RNA, 18 nt, Homo sapiens
uagcauuugucaacaaag

SEQ ID NO: 984643 - RNA, 14 nt, Homo sapiens
uagccaagugcagg

SEQ ID NO: 984644 - RNA, 22 nt, Homo sapiens
uagccaauauuuuucuuacuga

SEQ ID NO: 984645 - RNA, 17 nt, Homo sapiens
uagccagaggcucuaau

SEQ ID NO: 984646 - RNA, 16 nt, Homo sapiens
uagccagugaaaaacu

SEQ ID NO: 984647 - RNA, 22 nt, Homo sapiens
uaggaagaauuuuuauauccac

SEQ ID NO: 984648 - RNA, 22 nt, Homo sapiens
uaggcauuaaauuuuagcaaag

SEQ ID NO: 984649 - RNA, 23 nt, Homo sapiens
uagugauuuccacagugacucca

SEQ ID NO: 984650 - RNA, 22 nt, Homo sapiens
uauaaaaauaaaaaacacuggg

SEQ ID NO: 984651 - RNA, 18 nt, Homo sapiens
uauaaaggauuaauguca

SEQ ID NO: 984652 - RNA, 19 nt, Homo sapiens
uauacucacuuucccaaau

SEQ ID NO: 984653 - RNA, 14 nt, Homo sapiens
uauagcuacuaauu

SEQ ID NO: 984654 - RNA, 13 nt, Homo sapiens
uauauaacuaaca

SEQ ID NO: 984655 - RNA, 21 nt, Homo sapiens
uauauaacuaacaaccaaaga

SEQ ID NO: 984656 - RNA, 20 nt, Homo sapiens
uauaucaauuuccucauauc

SEQ ID NO: 984657 - RNA, 20 nt, Homo sapiens
uauauccagauggcaugugu

SEQ ID NO: 984658 - RNA, 13 nt, Homo sapiens
uaucacuguugca

SEQ ID NO: 984659 - RNA, 20 nt, Homo sapiens
uaucacuguugcauauacca

SEQ ID NO: 984660 - RNA, 13 nt, Homo sapiens
uaucaugugaaau

SEQ ID NO: 984661 - RNA, 23 nt, Homo sapiens
uauccaucuuucacuaucuguaa

SEQ ID NO: 984662 - RNA, 15 nt, Homo sapiens
uauccuaucucucca

SEQ ID NO: 984663 - RNA, 23 nt, Homo sapiens
uaucuaaacuggauucacagcuc

SEQ ID NO: 984664 - RNA, 18 nt, Homo sapiens
uaucucacacucaugcau

SEQ ID NO: 984665 - RNA, 12 nt, Homo sapiens
uaucucaucucu

SEQ ID NO: 984666 - RNA, 17 nt, Homo sapiens
uaucuucaggacacuca

SEQ ID NO: 984667 - RNA, 17 nt, Homo sapiens
uaucuugaauaauguaa

SEQ ID NO: 984668 - RNA, 14 nt, Homo sapiens
uauggcuccuccau

SEQ ID NO: 984669 - RNA, 18 nt, Homo sapiens
uauggugucauaggcucu

SEQ ID NO: 984670 - RNA, 16 nt, Homo sapiens
uaugugugugugugua

SEQ ID NO: 984671 - RNA, 13 nt, Homo sapiens
uauguuucacugu

SEQ ID NO: 984672 - RNA, 12 nt, Homo sapiens
uauuaagauaug

SEQ ID NO: 984673 - RNA, 23 nt, Homo sapiens
uauuauuuuauguugcauagaau

SEQ ID NO: 984674 - RNA, 23 nt, Homo sapiens
ggauuuuguauaugcauagucau

SEQ ID NO: 984675 - RNA, 17 nt, Homo sapiens
ggcaaccagaccauugu

SEQ ID NO: 984676 - RNA, 17 nt, Homo sapiens
ggcacacugagccagca

SEQ ID NO: 984677 - RNA, 20 nt, Homo sapiens
ggcacagcauggagucacag

SEQ ID NO: 984678 - RNA, 18 nt, Homo sapiens
ggcacccaugccaucuca

SEQ ID NO: 984679 - RNA, 19 nt, Homo sapiens
ggccacggugccuccagau

SEQ ID NO: 984680 - RNA, 16 nt, Homo sapiens
ggccaucaaccucugu

SEQ ID NO: 984681 - RNA, 15 nt, Homo sapiens
ggccuguacccagua

SEQ ID NO: 984682 - RNA, 22 nt, Homo sapiens
ggcuaagcacgggccauaugaa

SEQ ID NO: 984683 - RNA, 21 nt, Homo sapiens
ggcuccccuccucggcuuccu

SEQ ID NO: 984684 - RNA, 19 nt, Homo sapiens
ggcucuaauguacaauaaa

SEQ ID NO: 984685 - RNA, 15 nt, Homo sapiens
ggcugaaagaugacg

SEQ ID NO: 984686 - RNA, 18 nt, Homo sapiens
ggcugacaugaagcuguu

SEQ ID NO: 984687 - RNA, 20 nt, Homo sapiens
ggcuggagugcaguggcgcg

SEQ ID NO: 984688 - RNA, 18 nt, Homo sapiens
ggcugugggcaagccuaa

SEQ ID NO: 984689 - RNA, 21 nt, Homo sapiens
ggcuucagucuuuuccaugaa

SEQ ID NO: 984690 - RNA, 22 nt, Homo sapiens
ggcuucccaaaguccugggauu

SEQ ID NO: 984691 - RNA, 17 nt, Homo sapiens
ggcuuccuucauuuccu

SEQ ID NO: 984692 - RNA, 18 nt, Homo sapiens
gggaagagacagcccagg

SEQ ID NO: 984693 - RNA, 20 nt, Homo sapiens
gggaaguacuuuuggcauuu

SEQ ID NO: 984694 - RNA, 21 nt, Homo sapiens
gggaccuugucucccagcuca

SEQ ID NO: 984695 - RNA, 20 nt, Homo sapiens
gggacuaaguguaccagaga

SEQ ID NO: 984696 - RNA, 14 nt, Homo sapiens
gggacuuacaugau

SEQ ID NO: 984697 - RNA, 13 nt, Homo sapiens
gggagaacgggaa

SEQ ID NO: 984698 - RNA, 13 nt, Homo sapiens
gggagacacugau

SEQ ID NO: 984699 - RNA, 13 nt, Homo sapiens
gggagcugccaag

SEQ ID NO: 984700 - RNA, 20 nt, Homo sapiens
gggagugcccccaacagcac

SEQ ID NO: 984701 - RNA, 22 nt, Homo sapiens
gggcaggauggcaaccagacca

SEQ ID NO: 984702 - RNA, 15 nt, Homo sapiens
gggccccuuugcuga

SEQ ID NO: 984703 - RNA, 15 nt, Homo sapiens
gggccucuucugcuu

SEQ ID NO: 984704 - RNA, 15 nt, Homo sapiens
gggccuguaauccca

SEQ ID NO: 984705 - RNA, 23 nt, Homo sapiens
ggguaccuaguccccagccugcu

SEQ ID NO: 984706 - RNA, 22 nt, Homo sapiens
ggguguuuauccuaucucucca

SEQ ID NO: 984707 - RNA, 19 nt, Homo sapiens
gguaaaagcaucacaugaa

SEQ ID NO: 984708 - RNA, 17 nt, Homo sapiens
ggucaagaacacaguga

SEQ ID NO: 984709 - RNA, 16 nt, Homo sapiens
ggucuaagguucagcc

SEQ ID NO: 984710 - RNA, 20 nt, Homo sapiens
ggugcuaucgcaccacugug

SEQ ID NO: 984711 - RNA, 19 nt, Homo sapiens
ggugugagccaccacaucc

SEQ ID NO: 984712 - RNA, 17 nt, Homo sapiens
gguguucugugauauaa

SEQ ID NO: 984713 - RNA, 17 nt, Homo sapiens
gguucucuccaccaggu

SEQ ID NO: 984714 - RNA, 14 nt, Homo sapiens
gguuggagugcagu

SEQ ID NO: 984715 - RNA, 20 nt, Homo sapiens
gguuggagugcaguggcgug

SEQ ID NO: 984716 - RNA, 17 nt, Homo sapiens
gguuguacuaugcuguu

SEQ ID NO: 984717 - RNA, 21 nt, Homo sapiens
guaagacccuuauugcugucc

SEQ ID NO: 984718 - RNA, 19 nt, Homo sapiens
guacaauaaagcaaugugg

SEQ ID NO: 984719 - RNA, 17 nt, Homo sapiens
guacaugguguuugugg

SEQ ID NO: 984720 - RNA, 24 nt, Homo sapiens
guacauguacugauuacugccuau

SEQ ID NO: 984721 - RNA, 15 nt, Homo sapiens
guagaauagauaucc

SEQ ID NO: 984722 - RNA, 14 nt, Homo sapiens
guagcuacaggaca

SEQ ID NO: 984723 - RNA, 16 nt, Homo sapiens
guagcuacaggacauu

SEQ ID NO: 984724 - RNA, 15 nt, Homo sapiens
guagucagacuggau

SEQ ID NO: 984725 - RNA, 18 nt, Homo sapiens
guauaaaagggacugaga

SEQ ID NO: 984726 - RNA, 21 nt, Homo sapiens
guauauaacuaacaaccaaag

SEQ ID NO: 984727 - RNA, 17 nt, Homo sapiens
guauaugucuuuuaccc

SEQ ID NO: 984728 - RNA, 23 nt, Homo sapiens
guauucagcuuuaguagauauua

SEQ ID NO: 984729 - RNA, 23 nt, Homo sapiens
guauuccuagaaacugacacaug

SEQ ID NO: 984730 - RNA, 15 nt, Homo sapiens
gucaacuccuuucuc

SEQ ID NO: 984731 - RNA, 13 nt, Homo sapiens
gucaccucagaga

SEQ ID NO: 984732 - RNA, 17 nt, Homo sapiens
gucaccucagagacaua

SEQ ID NO: 984733 - RNA, 14 nt, Homo sapiens
gucacucacaucca

SEQ ID NO: 984734 - RNA, 12 nt, Homo sapiens
gucagacuggau

SEQ ID NO: 984735 - RNA, 14 nt, Homo sapiens
gucaucaucacauu

SEQ ID NO: 984736 - RNA, 14 nt, Homo sapiens
gucauuucaaagac

SEQ ID NO: 984737 - RNA, 20 nt, Homo sapiens
guccccagccugcucccuag

SEQ ID NO: 984738 - RNA, 19 nt, Homo sapiens
guccuaagccuguuagcau

SEQ ID NO: 984739 - RNA, 14 nt, Homo sapiens
guccugcaagcaga

SEQ ID NO: 984740 - RNA, 18 nt, Homo sapiens
guccugggauuacaggug

SEQ ID NO: 984741 - RNA, 20 nt, Homo sapiens
gucuaaaaaaggaauccucu

SEQ ID NO: 984742 - RNA, 19 nt, Homo sapiens
gucuaagguucagccugaa

SEQ ID NO: 984743 - RNA, 21 nt, Homo sapiens
gucucacaugauuccagccau

SEQ ID NO: 984744 - RNA, 13 nt, Homo sapiens
gucucccagcuca

SEQ ID NO: 984745 - RNA, 21 nt, Homo sapiens
gucuccuaagcuggagugcag

SEQ ID NO: 984746 - RNA, 16 nt, Homo sapiens
gucuccucucucugua

SEQ ID NO: 984747 - RNA, 21 nt, Homo sapiens
gucucucaugaaccucaagcu

SEQ ID NO: 984748 - RNA, 13 nt, Homo sapiens
gucuucccuguau

SEQ ID NO: 984749 - RNA, 14 nt, Homo sapiens
gucuuuguucuucu

SEQ ID NO: 984750 - RNA, 19 nt, Homo sapiens
gugacaauuaaaagugucu

SEQ ID NO: 984751 - RNA, 18 nt, Homo sapiens
gugagaacccuugcacua

SEQ ID NO: 984752 - RNA, 13 nt, Homo sapiens
gugauauguuggu

SEQ ID NO: 984753 - RNA, 22 nt, Homo sapiens
gugaucccuagcugugaccucu

SEQ ID NO: 984754 - RNA, 22 nt, Homo sapiens
gugcaguacuuugugcauucug

SEQ ID NO: 984755 - RNA, 19 nt, Homo sapiens
gugcaguggcgcgaucuca

SEQ ID NO: 984756 - RNA, 18 nt, Homo sapiens
gugcauuuaugagcucuu

SEQ ID NO: 984757 - RNA, 12 nt, Homo sapiens
gugccuccagau

SEQ ID NO: 984758 - RNA, 20 nt, Homo sapiens
gugcuguauaaaaucagcca

SEQ ID NO: 984759 - RNA, 18 nt, Homo sapiens
gugcuucuccagccucag

SEQ ID NO: 984760 - RNA, 15 nt, Homo sapiens
gugcuugagccagga

SEQ ID NO: 984761 - RNA, 14 nt, Homo sapiens
guggcaucaucuca

SEQ ID NO: 984762 - RNA, 18 nt, Homo sapiens
guggcccaagggugguga

SEQ ID NO: 984763 - RNA, 13 nt, Homo sapiens
guggcccagagaa

SEQ ID NO: 984764 - RNA, 16 nt, Homo sapiens
guguauucauucucau

SEQ ID NO: 984765 - RNA, 14 nt, Homo sapiens
gugugcaucaggcu

SEQ ID NO: 984766 - RNA, 15 nt, Homo sapiens
guguuugacgggaaa

SEQ ID NO: 984767 - RNA, 14 nt, Homo sapiens
guuacuacaugcac

SEQ ID NO: 984768 - RNA, 16 nt, Homo sapiens
gaugaugacuauggaa

SEQ ID NO: 984769 - RNA, 14 nt, Homo sapiens
gauggggucuguaa

SEQ ID NO: 984770 - RNA, 17 nt, Homo sapiens
gauggucccuauuccuc

SEQ ID NO: 984771 - RNA, 20 nt, Homo sapiens
gaugugucccaucuagggaa

SEQ ID NO: 984772 - RNA, 19 nt, Homo sapiens
gauuacaggcgugagccac

SEQ ID NO: 984773 - RNA, 14 nt, Homo sapiens
gauucaugcacugu

SEQ ID NO: 984774 - RNA, 14 nt, Homo sapiens
gauucauuuuaaca

SEQ ID NO: 984775 - RNA, 15 nt, Homo sapiens
gauucucuugccuca

SEQ ID NO: 984776 - RNA, 18 nt, Homo sapiens
gauugagauguguucaca

SEQ ID NO: 984777 - RNA, 14 nt, Homo sapiens
gauuuccacaguga

SEQ ID NO: 984778 - RNA, 12 nt, Homo sapiens
gauuuuuacaca

SEQ ID NO: 984779 - RNA, 22 nt, Homo sapiens
gcaaaaccaaauauuccagaga

SEQ ID NO: 984780 - RNA, 23 nt, Homo sapiens
gcaaaaccaaauauuccagagac

SEQ ID NO: 984781 - RNA, 14 nt, Homo sapiens
gcaaacccuuucau

SEQ ID NO: 984782 - RNA, 15 nt, Homo sapiens
gcaaacuuuauuuug

SEQ ID NO: 984783 - RNA, 14 nt, Homo sapiens
gcaaauaaauaucc

SEQ ID NO: 984784 - RNA, 15 nt, Homo sapiens
gcaaauuuucuucca

SEQ ID NO: 984785 - RNA, 16 nt, Homo sapiens
gcaaauuuucuuccau

SEQ ID NO: 984786 - RNA, 20 nt, Homo sapiens
gcaaccuccaccuccugggu

SEQ ID NO: 984787 - RNA, 15 nt, Homo sapiens
gcaaucauggugcuc

SEQ ID NO: 984788 - RNA, 22 nt, Homo sapiens
gcaauccucccacuucagccuc

SEQ ID NO: 984789 - RNA, 15 nt, Homo sapiens
gcaaucugacccuau

SEQ ID NO: 984790 - RNA, 23 nt, Homo sapiens
gcaauuaauuccuucagcacuuu

SEQ ID NO: 984791 - RNA, 16 nt, Homo sapiens
gcacagcuaugaaggc

SEQ ID NO: 984792 - RNA, 22 nt, Homo sapiens
gcacauauccaggcaccaggac

SEQ ID NO: 984793 - RNA, 19 nt, Homo sapiens
gcaccacuguguauuuaac

SEQ ID NO: 984794 - RNA, 15 nt, Homo sapiens
gcacccucuccagau

SEQ ID NO: 984795 - RNA, 17 nt, Homo sapiens
gcaccuacuuacaugca

SEQ ID NO: 984796 - RNA, 18 nt, Homo sapiens
gcaccuacuuacaugcau

SEQ ID NO: 984797 - RNA, 20 nt, Homo sapiens
gcaccuacuuacaugcauua

SEQ ID NO: 984798 - RNA, 12 nt, Homo sapiens
gcaccugggauu

SEQ ID NO: 984799 - RNA, 16 nt, Homo sapiens
gcagacucacuguggg

SEQ ID NO: 984800 - RNA, 17 nt, Homo sapiens
gcagacucacuguggga

SEQ ID NO: 984801 - RNA, 18 nt, Homo sapiens
gcagagguggcgauuugu

SEQ ID NO: 984802 - RNA, 16 nt, Homo sapiens
gcagaguacuggcuga

SEQ ID NO: 984803 - RNA, 23 nt, Homo sapiens
gcagaguacuggcugauggagua

SEQ ID NO: 984804 - RNA, 16 nt, Homo sapiens
gcagaguucuauaaug

SEQ ID NO: 984805 - RNA, 16 nt, Homo sapiens
gcagcaucucuggccu

SEQ ID NO: 984806 - RNA, 21 nt, Homo sapiens
gcagccuaacacggugcucau

SEQ ID NO: 984807 - RNA, 16 nt, Homo sapiens
gcaggaaaauggacau

SEQ ID NO: 984808 - RNA, 22 nt, Homo sapiens
gcaggauuugggcucuuggaau

SEQ ID NO: 984809 - RNA, 19 nt, Homo sapiens
gcagguaaccccagauuca

SEQ ID NO: 984810 - RNA, 15 nt, Homo sapiens
gcaggucccuaauaa

SEQ ID NO: 984811 - RNA, 13 nt, Homo sapiens
gcagucagggaca

SEQ ID NO: 984812 - RNA, 19 nt, Homo sapiens
gcagucccuccacauuucc

SEQ ID NO: 984813 - RNA, 21 nt, Homo sapiens
gcagugcucgcuguugcugaa

SEQ ID NO: 984814 - RNA, 13 nt, Homo sapiens
gcaguggaacuaa

SEQ ID NO: 984815 - RNA, 22 nt, Homo sapiens
gcaguggcaucaucucagcuca

SEQ ID NO: 984816 - RNA, 17 nt, Homo sapiens
gcaguggcgcgaucuca

SEQ ID NO: 984817 - RNA, 20 nt, Homo sapiens
gcauaagagcuuaagaacca

SEQ ID NO: 984818 - RNA, 17 nt, Homo sapiens
gcauaauacuugcuuug

SEQ ID NO: 984819 - RNA, 21 nt, Homo sapiens
gcauaauacuugcuuuggaaa

SEQ ID NO: 984820 - RNA, 12 nt, Homo sapiens
gcauaucugccu

SEQ ID NO: 984821 - RNA, 18 nt, Homo sapiens
gcaucaucucagcucacu

SEQ ID NO: 984822 - RNA, 23 nt, Homo sapiens
gcaucccuagucucuacccagua

SEQ ID NO: 984823 - RNA, 21 nt, Homo sapiens
gcaugccggugaucccuagcu

SEQ ID NO: 984824 - RNA, 10 nt, Homo sapiens
gcauguugcc

SEQ ID NO: 984825 - RNA, 18 nt, Homo sapiens
gcauuaaaaaugcauaua

SEQ ID NO: 984826 - RNA, 15 nt, Homo sapiens
gccaacccuuucauu

SEQ ID NO: 984827 - RNA, 16 nt, Homo sapiens
gccaagccaaccgugg

SEQ ID NO: 984828 - RNA, 11 nt, Homo sapiens
gccacaguaua

SEQ ID NO: 984829 - RNA, 18 nt, Homo sapiens
gccagaggcucuaaugua

SEQ ID NO: 984830 - RNA, 14 nt, Homo sapiens
gccagcaucugccu

SEQ ID NO: 984831 - RNA, 19 nt, Homo sapiens
gccagcugcccccagagcc

SEQ ID NO: 984832 - RNA, 14 nt, Homo sapiens
gccaggauggcgca

SEQ ID NO: 984833 - RNA, 16 nt, Homo sapiens
gccaggcuggagugca

SEQ ID NO: 984834 - RNA, 19 nt, Homo sapiens
gccaggcuggagugcagug

SEQ ID NO: 984835 - RNA, 17 nt, Homo sapiens
gccaugauuuuagcaau

SEQ ID NO: 984836 - RNA, 20 nt, Homo sapiens
gccauucucaagcccugcag

SEQ ID NO: 984837 - RNA, 14 nt, Homo sapiens
gcccacacauggga

SEQ ID NO: 984838 - RNA, 21 nt, Homo sapiens
gcccaggaccccauggcagug

SEQ ID NO: 984839 - RNA, 20 nt, Homo sapiens
gcccaggauggcuuugaaug

SEQ ID NO: 984840 - RNA, 20 nt, Homo sapiens
gcccaugcuggagugcagug

SEQ ID NO: 984841 - RNA, 22 nt, Homo sapiens
gcccucagaaucgcuccaccuu

SEQ ID NO: 984842 - RNA, 16 nt, Homo sapiens
gcccugcaccaugcug

SEQ ID NO: 984843 - RNA, 17 nt, Homo sapiens
gcccugcucuuccucag

SEQ ID NO: 984844 - RNA, 15 nt, Homo sapiens
gcccuguaacaggcu

SEQ ID NO: 984845 - RNA, 14 nt, Homo sapiens
gcccuugucacugg

SEQ ID NO: 984846 - RNA, 21 nt, Homo sapiens
gccucaaccucccaagcaguu

SEQ ID NO: 984847 - RNA, 21 nt, Homo sapiens
gccucccaaagugcugggauu

SEQ ID NO: 984848 - RNA, 19 nt, Homo sapiens
gccuccccugccucaccag

SEQ ID NO: 984849 - RNA, 21 nt, Homo sapiens
gccuccucucucaaacugggg

SEQ ID NO: 984850 - RNA, 18 nt, Homo sapiens
gccugacgaacuccuuga

SEQ ID NO: 984851 - RNA, 16 nt, Homo sapiens
gccugcucccuagcca

SEQ ID NO: 984852 - RNA, 22 nt, Homo sapiens
gccuuggggauucuuccaucug

SEQ ID NO: 984853 - RNA, 18 nt, Homo sapiens
gccuuguaagacccuuau

SEQ ID NO: 984854 - RNA, 19 nt, Homo sapiens
gcgcagcaucccuagucuc

SEQ ID NO: 984855 - RNA, 17 nt, Homo sapiens
gcgcgaucucagcucac

SEQ ID NO: 984856 - RNA, 15 nt, Homo sapiens
gcuacccgcagaguu

SEQ ID NO: 984857 - RNA, 22 nt, Homo sapiens
gcuacccgcagaguucucagaa

SEQ ID NO: 984858 - RNA, 22 nt, Homo sapiens
gcuagacaguucuuuguuugga

SEQ ID NO: 984859 - RNA, 17 nt, Homo sapiens
gcucacugcaaccucug

SEQ ID NO: 984860 - RNA, 22 nt, Homo sapiens
gcucagcccugcaccaugcugc

SEQ ID NO: 984861 - RNA, 15 nt, Homo sapiens
gcucauacuuaucua

SEQ ID NO: 984862 - RNA, 22 nt, Homo sapiens
gcucauuuuuucuucuccuaaa

SEQ ID NO: 984863 - RNA, 21 nt, Homo sapiens
gcuccagcugcucugucuucu

SEQ ID NO: 984864 - RNA, 16 nt, Homo sapiens
gcuccauucaaaguga

SEQ ID NO: 984865 - RNA, 16 nt, Homo sapiens
cauguacauagcuuga

SEQ ID NO: 984866 - RNA, 11 nt, Homo sapiens
caugugaaauc

SEQ ID NO: 984867 - RNA, 19 nt, Homo sapiens
caugugaaaucauucauuu

SEQ ID NO: 984868 - RNA, 13 nt, Homo sapiens
cauuacugcaugc

SEQ ID NO: 984869 - RNA, 17 nt, Homo sapiens
cauuacugcaugcacuu

SEQ ID NO: 984870 - RNA, 22 nt, Homo sapiens
cauuauaaauaaauaccaaaaa

SEQ ID NO: 984871 - RNA, 15 nt, Homo sapiens
cauucuaucuauucc

SEQ ID NO: 984872 - RNA, 17 nt, Homo sapiens
cauugauuuaauguaau

SEQ ID NO: 984873 - RNA, 22 nt, Homo sapiens
cauuggagagaaaaaacuuaag

SEQ ID NO: 984874 - RNA, 18 nt, Homo sapiens
cauuguagaaaagcuaua

SEQ ID NO: 984875 - RNA, 15 nt, Homo sapiens
cauuguaggauguug

SEQ ID NO: 984876 - RNA, 13 nt, Homo sapiens
cauuuaucauaua

SEQ ID NO: 984877 - RNA, 20 nt, Homo sapiens
cauuuggggcuagacaguuc

SEQ ID NO: 984878 - RNA, 17 nt, Homo sapiens
cauuuuaacaucugaga

SEQ ID NO: 984879 - RNA, 18 nt, Homo sapiens
cauuuuaacaucugagaa

SEQ ID NO: 984880 - RNA, 14 nt, Homo sapiens
ccaaaagucuucau

SEQ ID NO: 984881 - RNA, 19 nt, Homo sapiens
ccaaagcccucccuaccua

SEQ ID NO: 984882 - RNA, 17 nt, Homo sapiens
ccaaauauuccagagac

SEQ ID NO: 984883 - RNA, 19 nt, Homo sapiens
ccaaaucaaaagacuuuuu

SEQ ID NO: 984884 - RNA, 15 nt, Homo sapiens
ccaacagcacccucu

SEQ ID NO: 984885 - RNA, 19 nt, Homo sapiens
ccaagagccugagugacag

SEQ ID NO: 984886 - RNA, 22 nt, Homo sapiens
ccaagagccugagugacagagc

SEQ ID NO: 984887 - RNA, 17 nt, Homo sapiens
ccaagcaguugggacua

SEQ ID NO: 984888 - RNA, 16 nt, Homo sapiens
ccaaggaugucugcca

SEQ ID NO: 984889 - RNA, 17 nt, Homo sapiens
ccacacucagauccucc

SEQ ID NO: 984890 - RNA, 22 nt, Homo sapiens
ccacagaagugcuuucuucucc

SEQ ID NO: 984891 - RNA, 20 nt, Homo sapiens
ccacagugacuccacucuga

SEQ ID NO: 984892 - RNA, 21 nt, Homo sapiens
ccacaguggaaagacagcuuc

SEQ ID NO: 984893 - RNA, 18 nt, Homo sapiens
ccacauuggagauguuua

SEQ ID NO: 984894 - RNA, 17 nt, Homo sapiens
ccaccaccucaccaguu

SEQ ID NO: 984895 - RNA, 18 nt, Homo sapiens
ccacuagacaaguccagc

SEQ ID NO: 984896 - RNA, 15 nt, Homo sapiens
ccacugccaaagaac

SEQ ID NO: 984897 - RNA, 15 nt, Homo sapiens
ccacuguguauuuaa

SEQ ID NO: 984898 - RNA, 19 nt, Homo sapiens
ccagaaauacuacugugua

SEQ ID NO: 984899 - RNA, 14 nt, Homo sapiens
ccagagacugggac

SEQ ID NO: 984900 - RNA, 22 nt, Homo sapiens
ccagaggcucuaauguacaaua

SEQ ID NO: 984901 - RNA, 18 nt, Homo sapiens
ccagaugagaagucugcu

SEQ ID NO: 984902 - RNA, 19 nt, Homo sapiens
ccagaugagaagucugcua

SEQ ID NO: 984903 - RNA, 15 nt, Homo sapiens
ccagauuuaugcaua

SEQ ID NO: 984904 - RNA, 23 nt, Homo sapiens
ccagccacggggacucagcccuu

SEQ ID NO: 984905 - RNA, 20 nt, Homo sapiens
ccagccugcucccuagccag

SEQ ID NO: 984906 - RNA, 19 nt, Homo sapiens
ccagcucagggcucuuucc

SEQ ID NO: 984907 - RNA, 18 nt, Homo sapiens
ccagcugcucugucuucu

SEQ ID NO: 984908 - RNA, 20 nt, Homo sapiens
ccaggauggcgcaggaacuc

SEQ ID NO: 984909 - RNA, 18 nt, Homo sapiens
ccaggcuggagugcagug

SEQ ID NO: 984910 - RNA, 13 nt, Homo sapiens
ccaggugaacaaa

SEQ ID NO: 984911 - RNA, 18 nt, Homo sapiens
ccagguuggagugcagug

SEQ ID NO: 984912 - RNA, 21 nt, Homo sapiens
ccauaaaggggagggacucau

SEQ ID NO: 984913 - RNA, 22 nt, Homo sapiens
ccauaggaggccaacccaaaau

SEQ ID NO: 984914 - RNA, 23 nt, Homo sapiens
ccauaugaaaaggcuaagcuuca

SEQ ID NO: 984915 - RNA, 13 nt, Homo sapiens
ccaucuuucacua

SEQ ID NO: 984916 - RNA, 21 nt, Homo sapiens
ccaugccaucucaaccucuuc

SEQ ID NO: 984917 - RNA, 13 nt, Homo sapiens
ccaugcccggcua

SEQ ID NO: 984918 - RNA, 16 nt, Homo sapiens
ccaugcugauaaacug

SEQ ID NO: 984919 - RNA, 15 nt, Homo sapiens
ccauuucauugcuca

SEQ ID NO: 984920 - RNA, 16 nt, Homo sapiens
ccauuuuuagugaaau

SEQ ID NO: 984921 - RNA, 17 nt, Homo sapiens
cccaaacaugcacuucc

SEQ ID NO: 984922 - RNA, 10 nt, Homo sapiens
cccaacagca

SEQ ID NO: 984923 - RNA, 17 nt, Homo sapiens
cccacuggggugugugg

SEQ ID NO: 984924 - RNA, 14 nt, Homo sapiens
cccacuguacuugc

SEQ ID NO: 984925 - RNA, 18 nt, Homo sapiens
cccacuuaccuugcaucu

SEQ ID NO: 984926 - RNA, 18 nt, Homo sapiens
cccagcaugcugagauua

SEQ ID NO: 984927 - RNA, 21 nt, Homo sapiens
cccaggaggugugauuccuga

SEQ ID NO: 984928 - RNA, 21 nt, Homo sapiens
cccaggcccugcucuuccuca

SEQ ID NO: 984929 - RNA, 23 nt, Homo sapiens
cccaguagaugccacuagcccuc

SEQ ID NO: 984930 - RNA, 23 nt, Homo sapiens
cccaugucuacacagauguucac

SEQ ID NO: 984931 - RNA, 16 nt, Homo sapiens
ccccaacaugcacuga

SEQ ID NO: 984932 - RNA, 12 nt, Homo sapiens
ccccagagccac

SEQ ID NO: 984933 - RNA, 11 nt, Homo sapiens
cccccaacagc

SEQ ID NO: 984934 - RNA, 16 nt, Homo sapiens
cccccaaccauuuccu

SEQ ID NO: 984935 - RNA, 15 nt, Homo sapiens
ccccgugacugcaau

SEQ ID NO: 984936 - RNA, 22 nt, Homo sapiens
cccgccacccucccacugccaa

SEQ ID NO: 984937 - RNA, 20 nt, Homo sapiens
cccuuugcuucauucaaguc

SEQ ID NO: 984938 - RNA, 19 nt, Homo sapiens
ccgcucaggcugaccacuu

SEQ ID NO: 984939 - RNA, 13 nt, Homo sapiens
ccggccaccagau

SEQ ID NO: 984940 - RNA, 19 nt, Homo sapiens
ccgucaaaagagucuuaau

SEQ ID NO: 984941 - RNA, 15 nt, Homo sapiens
ccgugggaguacaaa

SEQ ID NO: 984942 - RNA, 15 nt, Homo sapiens
ccuaaaguacuggga

SEQ ID NO: 984943 - RNA, 18 nt, Homo sapiens
ccuaaaguacugggauua

SEQ ID NO: 984944 - RNA, 19 nt, Homo sapiens
ccuaacacggugcucauuu

SEQ ID NO: 984945 - RNA, 23 nt, Homo sapiens
ccuaagccaugggagacacugau

SEQ ID NO: 984946 - RNA, 17 nt, Homo sapiens
ccuaagcuggagugcag

SEQ ID NO: 984947 - RNA, 20 nt, Homo sapiens
ccuagacucugucuaccugg

SEQ ID NO: 984948 - RNA, 19 nt, Homo sapiens
ccuagaggccugacugcca

SEQ ID NO: 984949 - RNA, 18 nt, Homo sapiens
ccuagccagaggcucuaa

SEQ ID NO: 984950 - RNA, 21 nt, Homo sapiens
ccuagcuggcucugugagggu

SEQ ID NO: 984951 - RNA, 20 nt, Homo sapiens
ccuauuagaguauuuuccac

SEQ ID NO: 984952 - RNA, 21 nt, Homo sapiens
ccuauuuuaauaaacacucuu

SEQ ID NO: 984953 - RNA, 14 nt, Homo sapiens
ccucacacagcccu

SEQ ID NO: 984954 - RNA, 14 nt, Homo sapiens
ccucacuuuacaca

SEQ ID NO: 984955 - RNA, 15 nt, Homo sapiens
ccuccgccauucuca

SEQ ID NO: 984956 - RNA, 13 nt, Homo sapiens
ccucucucuguaa

SEQ ID NO: 984957 - RNA, 16 nt, Homo sapiens
ccucuugccaaaucaa

SEQ ID NO: 984958 - RNA, 16 nt, Homo sapiens
ccugaaauuaacucag

SEQ ID NO: 984959 - RNA, 19 nt, Homo sapiens
ccugaaauuaacucagaca

SEQ ID NO: 984960 - RNA, 18 nt, Homo sapiens
ccugacucuugcaggggu

SEQ ID NO: 984961 - RNA, 15 nt, Homo sapiens
ccugacugccaagcc

SEQ ID NO: 984962 - RNA, 15 nt, Homo sapiens
ccugauuauuuucua

SEQ ID NO: 984963 - RNA, 16 nt, Homo sapiens
ccugcaccaugcugcu

SEQ ID NO: 984964 - RNA, 17 nt, Homo sapiens
ccugcaggcaggaacaa

SEQ ID NO: 984965 - RNA, 15 nt, Homo sapiens
ccugccaggcacacu

SEQ ID NO: 984966 - RNA, 20 nt, Homo sapiens
ccugcucagcccugcaccau

SEQ ID NO: 984967 - RNA, 24 nt, Homo sapiens
ccugcucagcccugcaccaugcug

SEQ ID NO: 984968 - RNA, 17 nt, Homo sapiens
ccugcucccuagccaga

SEQ ID NO: 984969 - RNA, 22 nt, Homo sapiens
ccugcucccuagccagaggcuc

SEQ ID NO: 984970 - RNA, 20 nt, Homo sapiens
ccuggauuuuuaccagucuc

SEQ ID NO: 984971 - RNA, 13 nt, Homo sapiens
ccugggaacauca

SEQ ID NO: 984972 - RNA, 18 nt, Homo sapiens
ccuggucccuuggagaca

SEQ ID NO: 984973 - RNA, 13 nt, Homo sapiens
ccugucucagggu

SEQ ID NO: 984974 - RNA, 22 nt, Homo sapiens
ccugugagcuaggaauuguguu

SEQ ID NO: 984975 - RNA, 17 nt, Homo sapiens
ccuuaaagauacuugaa

SEQ ID NO: 984976 - RNA, 16 nt, Homo sapiens
ccuuaucgaaacucau

SEQ ID NO: 984977 - RNA, 22 nt, Homo sapiens
ccuuccagaaauacuacugugu

SEQ ID NO: 984978 - RNA, 21 nt, Homo sapiens
ccuugauugguguugccaguu

SEQ ID NO: 984979 - RNA, 21 nt, Homo sapiens
ccuugcuucuuggacuucuug

SEQ ID NO: 984980 - RNA, 13 nt, Homo sapiens
ccuuucuucucuc

SEQ ID NO: 984981 - RNA, 17 nt, Homo sapiens
ccuuuuacguccaucuc

SEQ ID NO: 984982 - RNA, 17 nt, Homo sapiens
ccuuuugucucugcaaa

SEQ ID NO: 984983 - RNA, 23 nt, Homo sapiens
ccuuuuuuugaaaaaaagcuuuu

SEQ ID NO: 984984 - RNA, 20 nt, Homo sapiens
uuaucaugugaaaucauuca

SEQ ID NO: 984985 - RNA, 18 nt, Homo sapiens
uuaucugagucaacuccu

SEQ ID NO: 984986 - RNA, 16 nt, Homo sapiens
uuaucuuaaaacuccu

SEQ ID NO: 984987 - RNA, 17 nt, Homo sapiens
uuauugccucacuucag

SEQ ID NO: 984988 - RNA, 14 nt, Homo sapiens
uuauuguugcauua

SEQ ID NO: 984989 - RNA, 16 nt, Homo sapiens
uuauuguugcauuaaa

SEQ ID NO: 984990 - RNA, 17 nt, Homo sapiens
uuauuuuuguucauaua

SEQ ID NO: 984991 - RNA, 20 nt, Homo sapiens
uucaacaaccggccaccaga

SEQ ID NO: 984992 - RNA, 18 nt, Homo sapiens
uucaacaguuuuugcuaa

SEQ ID NO: 984993 - RNA, 12 nt, Homo sapiens
uucaagcucucc

SEQ ID NO: 984994 - RNA, 18 nt, Homo sapiens
uucaagugcuucuccagc

SEQ ID NO: 984995 - RNA, 23 nt, Homo sapiens
uucaagugcuucuccagccucag

SEQ ID NO: 984996 - RNA, 18 nt, Homo sapiens
uucacaucgcagauucuc

SEQ ID NO: 984997 - RNA, 14 nt, Homo sapiens
uucacuaucuguaa

SEQ ID NO: 984998 - RNA, 12 nt, Homo sapiens
uucacucccacc

SEQ ID NO: 984999 - RNA, 13 nt, Homo sapiens
uucagaaucucuc

SEQ ID NO: 985000 - RNA, 11 nt, Homo sapiens
uucaugcacug

SEQ ID NO: 985001 - RNA, 15 nt, Homo sapiens
uucauguaacuagaa

SEQ ID NO: 985002 - RNA, 19 nt, Homo sapiens
uuccaacguggcccagaga

SEQ ID NO: 985003 - RNA, 21 nt, Homo sapiens
uucccaccaggcugcucaggg

SEQ ID NO: 985004 - RNA, 15 nt, Homo sapiens
uucccaggaguacac

SEQ ID NO: 985005 - RNA, 23 nt, Homo sapiens
uuccgaggccccugucucagggu

SEQ ID NO: 985006 - RNA, 21 nt, Homo sapiens
uuccuagaaacugacacaugc

SEQ ID NO: 985007 - RNA, 12 nt, Homo sapiens
uuccucuguaua

SEQ ID NO: 985008 - RNA, 14 nt, Homo sapiens
uuccuugggcuuua

SEQ ID NO: 985009 - RNA, 17 nt, Homo sapiens
uucguauucccauuaga

SEQ ID NO: 985010 - RNA, 16 nt, Homo sapiens
uucuaauuggcaugaa

SEQ ID NO: 985011 - RNA, 20 nt, Homo sapiens
uucuaccacccaccaguuga

SEQ ID NO: 985012 - RNA, 19 nt, Homo sapiens
uucucacacacauacauac

SEQ ID NO: 985013 - RNA, 20 nt, Homo sapiens
uucucauccugcaggcagcu

SEQ ID NO: 985014 - RNA, 17 nt, Homo sapiens
uucucccaccaccucac

SEQ ID NO: 985015 - RNA, 20 nt, Homo sapiens
uucucccuggauuuuuacca

SEQ ID NO: 985016 - RNA, 14 nt, Homo sapiens
uucuccucaucucc

SEQ ID NO: 985017 - RNA, 13 nt, Homo sapiens
uucucuugccuca

SEQ ID NO: 985018 - RNA, 23 nt, Homo sapiens
uucugagcaccuacuuacaugca

SEQ ID NO: 985019 - RNA, 18 nt, Homo sapiens
uucugcauguucuaaaua

SEQ ID NO: 985020 - RNA, 22 nt, Homo sapiens
uucuuuguaaugaaaaccacau

SEQ ID NO: 985021 - RNA, 14 nt, Homo sapiens
uugaaaaaugcaug

SEQ ID NO: 985022 - RNA, 18 nt, Homo sapiens
uugaacuaggcugagcaa

SEQ ID NO: 985023 - RNA, 20 nt, Homo sapiens
uugaagggcaggugcuucag

SEQ ID NO: 985024 - RNA, 9 nt, Homo sapiens
uugagacag

SEQ ID NO: 985025 - RNA, 16 nt, Homo sapiens
uugcauugacugucac

SEQ ID NO: 985026 - RNA, 13 nt, Homo sapiens
uugcauugcagag

SEQ ID NO: 985027 - RNA, 20 nt, Homo sapiens
uugccaggcuggagugcagu

SEQ ID NO: 985028 - RNA, 15 nt, Homo sapiens
uugccccugagacaa

SEQ ID NO: 985029 - RNA, 20 nt, Homo sapiens
uugcuacagggcucacagaa

SEQ ID NO: 985030 - RNA, 23 nt, Homo sapiens
uugcucagugggggcagagccac

SEQ ID NO: 985031 - RNA, 12 nt, Homo sapiens
uuggaaagcagc

SEQ ID NO: 985032 - RNA, 19 nt, Homo sapiens
uuggaaaggaccaguaugc

SEQ ID NO: 985033 - RNA, 21 nt, Homo sapiens
uuggagcaggggugcugggac

SEQ ID NO: 985034 - RNA, 20 nt, Homo sapiens
uuggaggcucucuugugcau

SEQ ID NO: 985035 - RNA, 13 nt, Homo sapiens
uuggcaugaaggu

SEQ ID NO: 985036 - RNA, 19 nt, Homo sapiens
uuggcauuuuacuguacag

SEQ ID NO: 985037 - RNA, 22 nt, Homo sapiens
uuggcugcauaaaugugguaca

SEQ ID NO: 985038 - RNA, 14 nt, Homo sapiens
uugggagcugccaa

SEQ ID NO: 985039 - RNA, 17 nt, Homo sapiens
uugguucaguaccacau

SEQ ID NO: 985040 - RNA, 16 nt, Homo sapiens
uugucacugacacaca

SEQ ID NO: 985041 - RNA, 14 nt, Homo sapiens
uuguccguuuacuu

SEQ ID NO: 985042 - RNA, 17 nt, Homo sapiens
uugucucccagcucagg

SEQ ID NO: 985043 - RNA, 13 nt, Homo sapiens
uuguuacugguac

SEQ ID NO: 985044 - RNA, 17 nt, Homo sapiens
uuuaaaccuauacucac

SEQ ID NO: 985045 - RNA, 14 nt, Homo sapiens
uuuaacguuuucau

SEQ ID NO: 985046 - RNA, 20 nt, Homo sapiens
uuuaaucuguauuuccccaa

SEQ ID NO: 985047 - RNA, 19 nt, Homo sapiens
uuuaauguaauagggaaaa

SEQ ID NO: 985048 - RNA, 16 nt, Homo sapiens
uuuaauuauaccgcua

SEQ ID NO: 985049 - RNA, 13 nt, Homo sapiens
uuuacaaaggggg

SEQ ID NO: 985050 - RNA, 20 nt, Homo sapiens
uuuacacauguaucuaugca

SEQ ID NO: 985051 - RNA, 15 nt, Homo sapiens
uuuacauguggccca

SEQ ID NO: 985052 - RNA, 17 nt, Homo sapiens
uuuaccuuauguuuaau

SEQ ID NO: 985053 - RNA, 12 nt, Homo sapiens
uuuagggagaac

SEQ ID NO: 985054 - RNA, 14 nt, Homo sapiens
uuuaucacuguugc

SEQ ID NO: 985055 - RNA, 20 nt, Homo sapiens
uuuaucauauauauacauac

SEQ ID NO: 985056 - RNA, 12 nt, Homo sapiens
uuuaugcuccua

SEQ ID NO: 985057 - RNA, 18 nt, Homo sapiens
uuucauaaagucuugccu

SEQ ID NO: 985058 - RNA, 16 nt, Homo sapiens
uuuccaauuagcuccu

SEQ ID NO: 985059 - RNA, 17 nt, Homo sapiens
uuucccuguuucuucca

SEQ ID NO: 985060 - RNA, 22 nt, Homo sapiens
uuuccuauguuucacugugcaa

SEQ ID NO: 985061 - RNA, 21 nt, Homo sapiens
uuuccucuggggcauuaucca

SEQ ID NO: 985062 - RNA, 18 nt, Homo sapiens
uuucuaauuggcaugaag

SEQ ID NO: 985063 - RNA, 19 nt, Homo sapiens
uuucucaccugucaucuca

SEQ ID NO: 985064 - RNA, 15 nt, Homo sapiens
uuugaacuacuagaa

SEQ ID NO: 985065 - RNA, 10 nt, Homo sapiens
uuugagacag

SEQ ID NO: 985066 - RNA, 22 nt, Homo sapiens
uuugaugaacaaaauuuccuaa

SEQ ID NO: 985067 - RNA, 17 nt, Homo sapiens
uuuggcauuuuacugua

SEQ ID NO: 985068 - RNA, 13 nt, Homo sapiens
uuugucucugcaa

SEQ ID NO: 985069 - RNA, 22 nt, Homo sapiens
uuuguggccuuggcugacauga

SEQ ID NO: 985070 - RNA, 20 nt, Homo sapiens
uuuguucuucuaccacccac

SEQ ID NO: 985071 - RNA, 13 nt, Homo sapiens
uuuuaacaucuga

SEQ ID NO: 985072 - RNA, 14 nt, Homo sapiens
uuuuaacaugucaa

SEQ ID NO: 985073 - RNA, 16 nt, Homo sapiens
uuuuaccagucucaca

SEQ ID NO: 985074 - RNA, 14 nt, Homo sapiens
uuuuaccuuugaca

SEQ ID NO: 985075 - RNA, 11 nt, Homo sapiens
uuuuagcucau

SEQ ID NO: 985076 - RNA, 18 nt, Homo sapiens
uuuuagggagaacgggaa

SEQ ID NO: 985077 - RNA, 17 nt, Homo sapiens
uuuuauuagaaguuuca

SEQ ID NO: 985078 - RNA, 15 nt, Homo sapiens
uuuuauuaugcauua

SEQ ID NO: 985079 - RNA, 21 nt, Homo sapiens
uuuuuacacauguaucuaugc

SEQ ID NO: 985080 - RNA, 17 nt, Homo sapiens
aaaaaauaacaaugaaa

SEQ ID NO: 985081 - RNA, 13 nt, Homo sapiens
aaaaacugcucau

SEQ ID NO: 985082 - RNA, 13 nt, Homo sapiens
aaaaagcaucaug

SEQ ID NO: 985083 - RNA, 16 nt, Homo sapiens
aaaaaggaauccucug

SEQ ID NO: 985084 - RNA, 15 nt, Homo sapiens
aaaaauagcagcuuu

SEQ ID NO: 985085 - RNA, 16 nt, Homo sapiens
aaaaaugcauauacuu

SEQ ID NO: 985086 - RNA, 11 nt, Homo sapiens
aaaacaguauu

SEQ ID NO: 985087 - RNA, 18 nt, Homo sapiens
aaaacuggcuacugcucu

SEQ ID NO: 985088 - RNA, 20 nt, Homo sapiens
aaaaggaauccucugugucu

SEQ ID NO: 985089 - RNA, 20 nt, Homo sapiens
aaaagggagauucagacugu

SEQ ID NO: 985090 - RNA, 20 nt, Homo sapiens
aaaaucaaacaauucaggga

SEQ ID NO: 985091 - RNA, 16 nt, Homo sapiens
aaaauccuacuuucau

SEQ ID NO: 985092 - RNA, 17 nt, Homo sapiens
aaaaugaauacaauuaa

SEQ ID NO: 985093 - RNA, 15 nt, Homo sapiens
aaaaugcauguugcc

SEQ ID NO: 985094 - RNA, 21 nt, Homo sapiens
aaaauuuuuuuuguaacugga

SEQ ID NO: 985095 - RNA, 19 nt, Homo sapiens
aaacacucuugaaaaaugc

SEQ ID NO: 985096 - RNA, 22 nt, Homo sapiens
aaacagggcugccuucuggccu

SEQ ID NO: 985097 - RNA, 16 nt, Homo sapiens
aaacaugcacuuccuu

SEQ ID NO: 985098 - RNA, 14 nt, Homo sapiens
aaacauuuguucua

SEQ ID NO: 985099 - RNA, 16 nt, Homo sapiens
aaaccaaauauuccag

SEQ ID NO: 985100 - RNA, 15 nt, Homo sapiens
aaacccuuucauaaa

SEQ ID NO: 985101 - RNA, 17 nt, Homo sapiens
aaacuccuguuucacuu

SEQ ID NO: 985102 - RNA, 19 nt, Homo sapiens
aaagaaaaucucugugaaa

SEQ ID NO: 985103 - RNA, 22 nt, Homo sapiens
aaagaaguuggggacacaugua

SEQ ID NO: 985104 - RNA, 16 nt, Homo sapiens
aaagagggagugcauu

SEQ ID NO: 985105 - RNA, 18 nt, Homo sapiens
aaagagugaaggauuuau

SEQ ID NO: 985106 - RNA, 18 nt, Homo sapiens
aaagauauaagugcugua

SEQ ID NO: 985107 - RNA, 17 nt, Homo sapiens
aaaggaauccucugugu

SEQ ID NO: 985108 - RNA, 22 nt, Homo sapiens
aaaggaauccucugugucuuca

SEQ ID NO: 985109 - RNA, 15 nt, Homo sapiens
aaaggaccaguaugc

SEQ ID NO: 985110 - RNA, 20 nt, Homo sapiens
aaagguaaaucagacuauga

SEQ ID NO: 985111 - RNA, 15 nt, Homo sapiens
aaaguaccaggugaa

SEQ ID NO: 985112 - RNA, 24 nt, Homo sapiens
aaaguacugggauuacaggcguga

SEQ ID NO: 985113 - RNA, 12 nt, Homo sapiens
aaagucuugccu

SEQ ID NO: 985114 - RNA, 15 nt, Homo sapiens
aaaguuuaccagaaa

SEQ ID NO: 985115 - RNA, 17 nt, Homo sapiens
aaauaaagauauuguuc

SEQ ID NO: 985116 - RNA, 14 nt, Homo sapiens
aaauagcagcuuua

SEQ ID NO: 985117 - RNA, 14 nt, Homo sapiens
aaauaugauuugug

SEQ ID NO: 985118 - RNA, 19 nt, Homo sapiens
aaauccacuuuaucuugaa

SEQ ID NO: 985119 - RNA, 20 nt, Homo sapiens
aaauggaggccuguccugac

SEQ ID NO: 985120 - RNA, 14 nt, Homo sapiens
aaauuaagacuuua

SEQ ID NO: 985121 - RNA, 15 nt, Homo sapiens
aaauugccugacgaa

SEQ ID NO: 985122 - RNA, 14 nt, Homo sapiens
aaauuguauauuca

SEQ ID NO: 985123 - RNA, 13 nt, Homo sapiens
aacaacuaccuga

SEQ ID NO: 985124 - RNA, 21 nt, Homo sapiens
aacaauucuuauugacucaua

SEQ ID NO: 985125 - RNA, 17 nt, Homo sapiens
aacacaauucuucuucc

SEQ ID NO: 985126 - RNA, 12 nt, Homo sapiens
aacacucuugaa

SEQ ID NO: 985127 - RNA, 22 nt, Homo sapiens
aacagcacccucuccagaugag

SEQ ID NO: 985128 - RNA, 14 nt, Homo sapiens
aacaggcuugaauc

SEQ ID NO: 985129 - RNA, 17 nt, Homo sapiens
aacagguaaaacagggc

SEQ ID NO: 985130 - RNA, 18 nt, Homo sapiens
aacagguaaaacagggcc

SEQ ID NO: 985131 - RNA, 16 nt, Homo sapiens
aacaguuuuugcuaau

SEQ ID NO: 985132 - RNA, 21 nt, Homo sapiens
aacauguuuaucguauuugau

SEQ ID NO: 985133 - RNA, 17 nt, Homo sapiens
aaccaaagacuacauau

SEQ ID NO: 985134 - RNA, 19 nt, Homo sapiens
aaccaaauauuccagagac

SEQ ID NO: 985135 - RNA, 20 nt, Homo sapiens
aaccaccgcgcccagccuuu

SEQ ID NO: 985136 - RNA, 19 nt, Homo sapiens
aaccacucauaauucuuca

SEQ ID NO: 985137 - RNA, 18 nt, Homo sapiens
aaccagauugucagcucc

SEQ ID NO: 985138 - RNA, 14 nt, Homo sapiens
aaccuaaacauaga

SEQ ID NO: 985139 - RNA, 15 nt, Homo sapiens
aaccucaagcugcau

SEQ ID NO: 985140 - RNA, 17 nt, Homo sapiens
aaccucaagcugcaucu

SEQ ID NO: 985141 - RNA, 14 nt, Homo sapiens
aaccuccgccuccc

SEQ ID NO: 985142 - RNA, 15 nt, Homo sapiens
aaccuccuuccaggg

SEQ ID NO: 985143 - RNA, 17 nt, Homo sapiens
aaccucuguauuugaau

SEQ ID NO: 985144 - RNA, 13 nt, Homo sapiens
aacggcaagggaa

SEQ ID NO: 985145 - RNA, 22 nt, Homo sapiens
aacgugcauugugcuucuuucu

SEQ ID NO: 985146 - RNA, 12 nt, Homo sapiens
aacguggcccag

SEQ ID NO: 985147 - RNA, 15 nt, Homo sapiens
aacguugacaaguuu

SEQ ID NO: 985148 - RNA, 17 nt, Homo sapiens
aacuaacaaccaaagac

SEQ ID NO: 985149 - RNA, 21 nt, Homo sapiens
aacuaauucuuggguguuuau

SEQ ID NO: 985150 - RNA, 12 nt, Homo sapiens
aacuagccaaac

SEQ ID NO: 985151 - RNA, 23 nt, Homo sapiens
aacugcugagagacagagcuauu

SEQ ID NO: 985152 - RNA, 22 nt, Homo sapiens
aacugucucucaugaaccucaa

SEQ ID NO: 985153 - RNA, 23 nt, Homo sapiens
aacuuggaaauagugauuuccac

SEQ ID NO: 985154 - RNA, 18 nt, Homo sapiens
aacuuuuaucacuguugc

SEQ ID NO: 985155 - RNA, 16 nt, Homo sapiens
aacuuuuuauugauuu

SEQ ID NO: 985156 - RNA, 19 nt, Homo sapiens
aacuuuuuucuuacugucu

SEQ ID NO: 985157 - RNA, 13 nt, Homo sapiens
aagaaaacuugua

SEQ ID NO: 985158 - RNA, 21 nt, Homo sapiens
aagaaaacuuguauuaugugu

SEQ ID NO: 985159 - RNA, 21 nt, Homo sapiens
aagaaccacucauaauucuuc

SEQ ID NO: 985160 - RNA, 23 nt, Homo sapiens
aagaauuuuuauauccacuaaaa

SEQ ID NO: 985161 - RNA, 23 nt, Homo sapiens
aagagauuccugagccaguguca

SEQ ID NO: 985162 - RNA, 16 nt, Homo sapiens
aagagauuuuucauga

SEQ ID NO: 985163 - RNA, 19 nt, Homo sapiens
aagauaccaaaaccacagu

SEQ ID NO: 985164 - RNA, 22 nt, Homo sapiens
aagaugaaugagcaaaaccaaa

SEQ ID NO: 985165 - RNA, 19 nt, Homo sapiens
aagaugacggaugccuaga

SEQ ID NO: 985166 - RNA, 21 nt, Homo sapiens
aagauuucagauuugugacca

SEQ ID NO: 985167 - RNA, 22 nt, Homo sapiens
aagcaaauaauuuuucacuuca

SEQ ID NO: 985168 - RNA, 20 nt, Homo sapiens
auauggggaaaaaacugugc

SEQ ID NO: 985169 - RNA, 16 nt, Homo sapiens
auauguaaaauuacac

SEQ ID NO: 985170 - RNA, 19 nt, Homo sapiens
auauuuauuuaacuauuca

SEQ ID NO: 985171 - RNA, 20 nt, Homo sapiens
auauuuauuuaacuauucau

SEQ ID NO: 985172 - RNA, 22 nt, Homo sapiens
auauuuuaagacgaaacauuug

SEQ ID NO: 985173 - RNA, 23 nt, Homo sapiens
aucaagacugcaaacccuuucau

SEQ ID NO: 985174 - RNA, 17 nt, Homo sapiens
aucaagcccuuuacuug

SEQ ID NO: 985175 - RNA, 19 nt, Homo sapiens
aucacagcuucagccagga

SEQ ID NO: 985176 - RNA, 20 nt, Homo sapiens
aucaccaguguguggcuuuc

SEQ ID NO: 985177 - RNA, 23 nt, Homo sapiens
aucagcccugggauagugcuguc

SEQ ID NO: 985178 - RNA, 14 nt, Homo sapiens
aucaguccaguuug

SEQ ID NO: 985179 - RNA, 20 nt, Homo sapiens
aucauaauauaaaacaggau

SEQ ID NO: 985180 - RNA, 15 nt, Homo sapiens
aucauauauauacau

SEQ ID NO: 985181 - RNA, 14 nt, Homo sapiens
aucaugcugagaga

SEQ ID NO: 985182 - RNA, 21 nt, Homo sapiens
aucauugguacccacuugcuu

SEQ ID NO: 985183 - RNA, 20 nt, Homo sapiens
aucauugugaaauuauucau

SEQ ID NO: 985184 - RNA, 17 nt, Homo sapiens
auccaagcaaaugugaa

SEQ ID NO: 985185 - RNA, 11 nt, Homo sapiens
aucccacucac

SEQ ID NO: 985186 - RNA, 12 nt, Homo sapiens
aucccagcauuu

SEQ ID NO: 985187 - RNA, 15 nt, Homo sapiens
aucccccagccucaa

SEQ ID NO: 985188 - RNA, 20 nt, Homo sapiens
auccuuccuuuugagggagc

SEQ ID NO: 985189 - RNA, 14 nt, Homo sapiens
aucgacuugccaaa

SEQ ID NO: 985190 - RNA, 13 nt, Homo sapiens
aucucagcucacu

SEQ ID NO: 985191 - RNA, 13 nt, Homo sapiens
aucugaggcacau

SEQ ID NO: 985192 - RNA, 17 nt, Homo sapiens
aucugguccaacaugaa

SEQ ID NO: 985193 - RNA, 20 nt, Homo sapiens
aucuguccguucacaugugu

SEQ ID NO: 985194 - RNA, 22 nt, Homo sapiens
aucuugcucucggugcuuccaa

SEQ ID NO: 985195 - RNA, 14 nt, Homo sapiens
aucuuguccccaac

SEQ ID NO: 985196 - RNA, 19 nt, Homo sapiens
augaauauuuaguguucau

SEQ ID NO: 985197 - RNA, 19 nt, Homo sapiens
augaauucugucauuucaa

SEQ ID NO: 985198 - RNA, 19 nt, Homo sapiens
augaauugcauuuuacuuu

SEQ ID NO: 985199 - RNA, 21 nt, Homo sapiens
augagaguuuuggaugcagug

SEQ ID NO: 985200 - RNA, 16 nt, Homo sapiens
augaguggcuuuaaug

SEQ ID NO: 985201 - RNA, 12 nt, Homo sapiens
augauacuugaa

SEQ ID NO: 985202 - RNA, 19 nt, Homo sapiens
augauuuagugaucaaauu

SEQ ID NO: 985203 - RNA, 19 nt, Homo sapiens
augcacuucuuacaauaau

SEQ ID NO: 985204 - RNA, 12 nt, Homo sapiens
augcauacacuc

SEQ ID NO: 985205 - RNA, 15 nt, Homo sapiens
augcauauacuuuaa

SEQ ID NO: 985206 - RNA, 12 nt, Homo sapiens
augcauguugcc

SEQ ID NO: 985207 - RNA, 14 nt, Homo sapiens
augcauuacugcau

SEQ ID NO: 985208 - RNA, 21 nt, Homo sapiens
augccacccaguugugacaau

SEQ ID NO: 985209 - RNA, 16 nt, Homo sapiens
augcuacucuaguauu

SEQ ID NO: 985210 - RNA, 19 nt, Homo sapiens
augcucugauuuaucugag

SEQ ID NO: 985211 - RNA, 22 nt, Homo sapiens
augcugaaaaaucauccaagac

SEQ ID NO: 985212 - RNA, 17 nt, Homo sapiens
augcugauaaacugauu

SEQ ID NO: 985213 - RNA, 20 nt, Homo sapiens
augcugucuucguacuggga

SEQ ID NO: 985214 - RNA, 12 nt, Homo sapiens
auggaagcaucu

SEQ ID NO: 985215 - RNA, 16 nt, Homo sapiens
auggcgcaggaacuca

SEQ ID NO: 985216 - RNA, 16 nt, Homo sapiens
auggggaaaaaacugu

SEQ ID NO: 985217 - RNA, 19 nt, Homo sapiens
auggugcacuaauuucacu

SEQ ID NO: 985218 - RNA, 13 nt, Homo sapiens
auguaacuucccu

SEQ ID NO: 985219 - RNA, 23 nt, Homo sapiens
auguacaauaaagcaauguggua

SEQ ID NO: 985220 - RNA, 16 nt, Homo sapiens
auguacauagcuugau

SEQ ID NO: 985221 - RNA, 16 nt, Homo sapiens
auguaucuaugcauuu

SEQ ID NO: 985222 - RNA, 19 nt, Homo sapiens
augucauguggcuaccugu

SEQ ID NO: 985223 - RNA, 23 nt, Homo sapiens
augucuuaaugaaguuugaaugu

SEQ ID NO: 985224 - RNA, 18 nt, Homo sapiens
augugauuccaucuugcc

SEQ ID NO: 985225 - RNA, 22 nt, Homo sapiens
auguguaagaacaacuaccuga

SEQ ID NO: 985226 - RNA, 16 nt, Homo sapiens
auguugagcagcaucu

SEQ ID NO: 985227 - RNA, 20 nt, Homo sapiens
auguugaguuauuaauaugu

SEQ ID NO: 985228 - RNA, 14 nt, Homo sapiens
auguugccuugcau

SEQ ID NO: 985229 - RNA, 21 nt, Homo sapiens
auguuggcuagacuagucuca

SEQ ID NO: 985230 - RNA, 21 nt, Homo sapiens
auguuguguuuuuaacauguc

SEQ ID NO: 985231 - RNA, 20 nt, Homo sapiens
auguuguuaugggcaggaug

SEQ ID NO: 985232 - RNA, 16 nt, Homo sapiens
auguuucacugugcaa

SEQ ID NO: 985233 - RNA, 17 nt, Homo sapiens
auguuucacugugcaaa

SEQ ID NO: 985234 - RNA, 17 nt, Homo sapiens
auuaaaaaugcauauac

SEQ ID NO: 985235 - RNA, 18 nt, Homo sapiens
auuaauuaucuaguuuaa

SEQ ID NO: 985236 - RNA, 19 nt, Homo sapiens
auuaauuccuucagcacuu

SEQ ID NO: 985237 - RNA, 12 nt, Homo sapiens
auuaccuucuau

SEQ ID NO: 985238 - RNA, 22 nt, Homo sapiens
auuacuuuugcuguaauguuaa

SEQ ID NO: 985239 - RNA, 23 nt, Homo sapiens
auuagcagucccuccacauuucc

SEQ ID NO: 985240 - RNA, 14 nt, Homo sapiens
auuaucuucaggac

SEQ ID NO: 985241 - RNA, 20 nt, Homo sapiens
auuaugcauuauaucaaauc

SEQ ID NO: 985242 - RNA, 17 nt, Homo sapiens
auuauuuuauguugcau

SEQ ID NO: 985243 - RNA, 16 nt, Homo sapiens
auucaaaggcauuucu

SEQ ID NO: 985244 - RNA, 11 nt, Homo sapiens
auucaaaguga

SEQ ID NO: 985245 - RNA, 17 nt, Homo sapiens
auuccagaccugaagaa

SEQ ID NO: 985246 - RNA, 13 nt, Homo sapiens
auuccaucuugcc

SEQ ID NO: 985247 - RNA, 17 nt, Homo sapiens
auucucacacacauaca

SEQ ID NO: 985248 - RNA, 22 nt, Homo sapiens
auucucacacacauacauaccu

SEQ ID NO: 985249 - RNA, 21 nt, Homo sapiens
auucuccauguacuggcaaga

SEQ ID NO: 985250 - RNA, 15 nt, Homo sapiens
auucucuugccucaa

SEQ ID NO: 985251 - RNA, 19 nt, Homo sapiens
auugaucgacuugccaaau

SEQ ID NO: 985252 - RNA, 13 nt, Homo sapiens
auugccucugaga

SEQ ID NO: 985253 - RNA, 19 nt, Homo sapiens
auugcugguuuuaguugca

SEQ ID NO: 985254 - RNA, 14 nt, Homo sapiens
auuggcaugaaggu

SEQ ID NO: 985255 - RNA, 22 nt, Homo sapiens
auugguacccacuugcuuuuaa

SEQ ID NO: 985256 - RNA, 15 nt, Homo sapiens
auugguguugccagu

SEQ ID NO: 985257 - RNA, 16 nt, Homo sapiens
auugguguugccaguu

SEQ ID NO: 985258 - RNA, 13 nt, Homo sapiens
auuguaugguggg

SEQ ID NO: 985259 - RNA, 15 nt, Homo sapiens
auuguccguuuacuu

SEQ ID NO: 985260 - RNA, 17 nt, Homo sapiens
auugugcuggaaaugga

SEQ ID NO: 985261 - RNA, 21 nt, Homo sapiens
auuuaaaaaacuaacacccag

SEQ ID NO: 985262 - RNA, 14 nt, Homo sapiens
auuuaaaucacuca

SEQ ID NO: 985263 - RNA, 17 nt, Homo sapiens
auuuacaacaaacaccu

SEQ ID NO: 985264 - RNA, 21 nt, Homo sapiens
auuuacaugaauugcauuuua

SEQ ID NO: 985265 - RNA, 14 nt, Homo sapiens
auuucauugcucag

SEQ ID NO: 985266 - RNA, 22 nt, Homo sapiens
auuucauugcucagaaauguca

SEQ ID NO: 985267 - RNA, 19 nt, Homo sapiens
auuuccuccgucaccucag

SEQ ID NO: 985268 - RNA, 14 nt, Homo sapiens
auuucuguucuucc

SEQ ID NO: 985269 - RNA, 14 nt, Homo sapiens
auuucuucaaauaa

SEQ ID NO: 985270 - RNA, 15 nt, Homo sapiens
auuucuuuucugcau

SEQ ID NO: 985271 - RNA, 14 nt, Homo sapiens
auuugaaugcauuu

SEQ ID NO: 985272 - RNA, 21 nt, Homo sapiens
auuugaucugauaucagucca

SEQ ID NO: 985273 - RNA, 17 nt, Homo sapiens
auuugucaacaaaguca

SEQ ID NO: 985274 - RNA, 14 nt, Homo sapiens
auuuguguauuaua

SEQ ID NO: 985275 - RNA, 14 nt, Homo sapiens
auuuucccuucccu

SEQ ID NO: 985276 - RNA, 16 nt, Homo sapiens
auuuucccuucccuga

SEQ ID NO: 985277 - RNA, 18 nt, Homo sapiens
auuuugaaaccaugaaga

SEQ ID NO: 985278 - RNA, 23 nt, Homo sapiens
auuuugagauggagucuugcucu

SEQ ID NO: 985279 - RNA, 16 nt, Homo sapiens
auuuuuacacauguau

SEQ ID NO: 985280 - RNA, 15 nt, Homo sapiens
auuuuugaaaacugg

SEQ ID NO: 985281 - RNA, 23 nt, Homo sapiens
auuuuuggaagaggacuccuuaa

SEQ ID NO: 985282 - RNA, 19 nt, Homo sapiens
caaaaaaaaaauuugccaa

SEQ ID NO: 985283 - RNA, 20 nt, Homo sapiens
caaaaauguguaagaacaac

SEQ ID NO: 985284 - RNA, 17 nt, Homo sapiens
caaaauuagugcuuuuu

SEQ ID NO: 985285 - RNA, 20 nt, Homo sapiens
caaacauguuccugggauca

SEQ ID NO: 985286 - RNA, 16 nt, Homo sapiens
caaacuccugaccuca

SEQ ID NO: 985287 - RNA, 22 nt, Homo sapiens
caaagacuacauauugucacug

SEQ ID NO: 985288 - RNA, 15 nt, Homo sapiens
caaagcccaucauaa

SEQ ID NO: 985289 - RNA, 21 nt, Homo sapiens
caaagcccucccuaccuacca

SEQ ID NO: 985290 - RNA, 22 nt, Homo sapiens
caaagguaaaucagacuaugaa

SEQ ID NO: 985291 - RNA, 14 nt, Homo sapiens
caaauauaucugcu

SEQ ID NO: 985292 - RNA, 16 nt, Homo sapiens
caaauaucuugaaagg

SEQ ID NO: 985293 - RNA, 16 nt, Homo sapiens
caaaucaaaagacuuu

SEQ ID NO: 985294 - RNA, 18 nt, Homo sapiens
caaaucuaccacuguaug

SEQ ID NO: 985295 - RNA, 15 nt, Homo sapiens
caacaaagucaccca

SEQ ID NO: 985296 - RNA, 13 nt, Homo sapiens
ugauacuuacuca

SEQ ID NO: 985297 - RNA, 17 nt, Homo sapiens
ugauauauuccaccagg

SEQ ID NO: 985298 - RNA, 23 nt, Homo sapiens
ugaucggagccuccucucucaaa

SEQ ID NO: 985299 - RNA, 13 nt, Homo sapiens
ugaucucagcuca

SEQ ID NO: 985300 - RNA, 12 nt, Homo sapiens
ugauuacugccu

SEQ ID NO: 985301 - RNA, 15 nt, Homo sapiens
ugauuuagugaucaa

SEQ ID NO: 985302 - RNA, 16 nt, Homo sapiens
ugauuuagugaucaaa

SEQ ID NO: 985303 - RNA, 21 nt, Homo sapiens
ugauuuaucugagucaacucc

SEQ ID NO: 985304 - RNA, 18 nt, Homo sapiens
ugauuuugaaaucaugaa

SEQ ID NO: 985305 - RNA, 16 nt, Homo sapiens
ugcaaacccuuucaua

SEQ ID NO: 985306 - RNA, 12 nt, Homo sapiens
ugcaaacugccu

SEQ ID NO: 985307 - RNA, 22 nt, Homo sapiens
ugcaaauauaucugcuauucuc

SEQ ID NO: 985308 - RNA, 16 nt, Homo sapiens
ugcaaccaucaccaga

SEQ ID NO: 985309 - RNA, 13 nt, Homo sapiens
ugcaaccucugcc

SEQ ID NO: 985310 - RNA, 20 nt, Homo sapiens
ugcacuguaaaaugugggau

SEQ ID NO: 985311 - RNA, 16 nt, Homo sapiens
ugcagacucacugugg

SEQ ID NO: 985312 - RNA, 22 nt, Homo sapiens
ugcaggcaggaacaaacagggc

SEQ ID NO: 985313 - RNA, 21 nt, Homo sapiens
ugcagggccuguaaucccagc

SEQ ID NO: 985314 - RNA, 15 nt, Homo sapiens
ugcagucacagcuac

SEQ ID NO: 985315 - RNA, 19 nt, Homo sapiens
ugcaguggcgcgaucucag

SEQ ID NO: 985316 - RNA, 23 nt, Homo sapiens
ugcaguggcgcgaucucagcuca

SEQ ID NO: 985317 - RNA, 18 nt, Homo sapiens
ugcaguggcgugaucuca

SEQ ID NO: 985318 - RNA, 19 nt, Homo sapiens
ugcaguggcgugaucucag

SEQ ID NO: 985319 - RNA, 18 nt, Homo sapiens
ugcauaaaugugguacaa

SEQ ID NO: 985320 - RNA, 17 nt, Homo sapiens
ugcaucuuauuucuguc

SEQ ID NO: 985321 - RNA, 14 nt, Homo sapiens
ugcaugcuugcaua

SEQ ID NO: 985322 - RNA, 14 nt, Homo sapiens
ugccaaagaacuug

SEQ ID NO: 985323 - RNA, 19 nt, Homo sapiens
ugccgccuccuugugcaca

SEQ ID NO: 985324 - RNA, 20 nt, Homo sapiens
ugccuauuuuaauaaacacu

SEQ ID NO: 985325 - RNA, 13 nt, Homo sapiens
ugccucaaccucc

SEQ ID NO: 985326 - RNA, 18 nt, Homo sapiens
ugccucccagguucaagu

SEQ ID NO: 985327 - RNA, 14 nt, Homo sapiens
ugccuucuggccuu

SEQ ID NO: 985328 - RNA, 20 nt, Homo sapiens
ugcuauaacuaugaccaugc

SEQ ID NO: 985329 - RNA, 15 nt, Homo sapiens
ugcuaucgcaccacu

SEQ ID NO: 985330 - RNA, 21 nt, Homo sapiens
ugcucauuuuuucuucuccua

SEQ ID NO: 985331 - RNA, 21 nt, Homo sapiens
ugcucccuagccagaggcucu

SEQ ID NO: 985332 - RNA, 18 nt, Homo sapiens
ugcucucggugcuuccaa

SEQ ID NO: 985333 - RNA, 23 nt, Homo sapiens
ugcugaaaaaucauccaagacag

SEQ ID NO: 985334 - RNA, 20 nt, Homo sapiens
ugcugcuggggaagacagug

SEQ ID NO: 985335 - RNA, 13 nt, Homo sapiens
ugcugcugugcag

SEQ ID NO: 985336 - RNA, 16 nt, Homo sapiens
ugcuggaaauggacac

SEQ ID NO: 985337 - RNA, 20 nt, Homo sapiens
ugcuggcaguggaacuaaga

SEQ ID NO: 985338 - RNA, 14 nt, Homo sapiens
ugcuggggaagaca

SEQ ID NO: 985339 - RNA, 15 nt, Homo sapiens
ugcuucaggauacca

SEQ ID NO: 985340 - RNA, 14 nt, Homo sapiens
ugcuuccaacucau

SEQ ID NO: 985341 - RNA, 14 nt, Homo sapiens
ugcuugaaugaagu

SEQ ID NO: 985342 - RNA, 18 nt, Homo sapiens
ugcuuuuaaaauccacuu

SEQ ID NO: 985343 - RNA, 20 nt, Homo sapiens
ugcuuuuuauggccugugag

SEQ ID NO: 985344 - RNA, 21 nt, Homo sapiens
uggaaagacagcuucucaucc

SEQ ID NO: 985345 - RNA, 18 nt, Homo sapiens
uggaaauggacacagucu

SEQ ID NO: 985346 - RNA, 17 nt, Homo sapiens
uggaagaggcaccuguc

SEQ ID NO: 985347 - RNA, 14 nt, Homo sapiens
uggaagugcuaauu

SEQ ID NO: 985348 - RNA, 18 nt, Homo sapiens
uggaauaauccuaaacau

SEQ ID NO: 985349 - RNA, 16 nt, Homo sapiens
uggacugugugcucag

SEQ ID NO: 985350 - RNA, 21 nt, Homo sapiens
uggagagccccucacacagcc

SEQ ID NO: 985351 - RNA, 13 nt, Homo sapiens
uggagaucaccag

SEQ ID NO: 985352 - RNA, 21 nt, Homo sapiens
uggagcaggggugcugggacc

SEQ ID NO: 985353 - RNA, 18 nt, Homo sapiens
uggaggaaagugauaucc

SEQ ID NO: 985354 - RNA, 23 nt, Homo sapiens
uggaggccuguccugaccugucu

SEQ ID NO: 985355 - RNA, 23 nt, Homo sapiens
uggaggcggaauugcucucccag

SEQ ID NO: 985356 - RNA, 13 nt, Homo sapiens
uggauccugugug

SEQ ID NO: 985357 - RNA, 15 nt, Homo sapiens
uggaugaaaauguuc

SEQ ID NO: 985358 - RNA, 22 nt, Homo sapiens
uggauuuuacauguggcccaac

SEQ ID NO: 985359 - RNA, 14 nt, Homo sapiens
uggcaaagccuuca

SEQ ID NO: 985360 - RNA, 16 nt, Homo sapiens
uggcaggaaaauggac

SEQ ID NO: 985361 - RNA, 21 nt, Homo sapiens
uggcaguggaacuaagaaagc

SEQ ID NO: 985362 - RNA, 11 nt, Homo sapiens
uggcauauaau

SEQ ID NO: 985363 - RNA, 16 nt, Homo sapiens
uggcaucaucucagcu

SEQ ID NO: 985364 - RNA, 15 nt, Homo sapiens
uggcauuuuacugua

SEQ ID NO: 985365 - RNA, 23 nt, Homo sapiens
uggccuggcugcugcugugcagu

SEQ ID NO: 985366 - RNA, 16 nt, Homo sapiens
uggcuagucauaaccu

SEQ ID NO: 985367 - RNA, 17 nt, Homo sapiens
uggcugauggaguaaau

SEQ ID NO: 985368 - RNA, 21 nt, Homo sapiens
uggcuuugaaugcggcccaac

SEQ ID NO: 985369 - RNA, 20 nt, Homo sapiens
uggcuuuggaagccauguga

SEQ ID NO: 985370 - RNA, 22 nt, Homo sapiens
ugggaaguuggcuggugucccu

SEQ ID NO: 985371 - RNA, 21 nt, Homo sapiens
ugggagugcccccaacagcac

SEQ ID NO: 985372 - RNA, 11 nt, Homo sapiens
ugggaugcuac

SEQ ID NO: 985373 - RNA, 23 nt, Homo sapiens
ugggauuacaggcgugagccacc

SEQ ID NO: 985374 - RNA, 21 nt, Homo sapiens
ugggauuaugggucacaggaa

SEQ ID NO: 985375 - RNA, 17 nt, Homo sapiens
uggggcauuauccaucu

SEQ ID NO: 985376 - RNA, 15 nt, Homo sapiens
uggggggggugcugg

SEQ ID NO: 985377 - RNA, 17 nt, Homo sapiens
ugggucuaggacacagu

SEQ ID NO: 985378 - RNA, 12 nt, Homo sapiens
ugguaaccucuu

SEQ ID NO: 985379 - RNA, 20 nt, Homo sapiens
ugguccaugggccauaugaa

SEQ ID NO: 985380 - RNA, 22 nt, Homo sapiens
uggucucaaacuccugaccuca

SEQ ID NO: 985381 - RNA, 21 nt, Homo sapiens
uggugagcuuaacccuggaaa

SEQ ID NO: 985382 - RNA, 13 nt, Homo sapiens
uggugauuuagca

SEQ ID NO: 985383 - RNA, 15 nt, Homo sapiens
uggugcucagagcag

SEQ ID NO: 985384 - RNA, 17 nt, Homo sapiens
uguaauaaaacauguuc

SEQ ID NO: 985385 - RNA, 22 nt, Homo sapiens
uguaauaaacucauuucuagca

SEQ ID NO: 985386 - RNA, 19 nt, Homo sapiens
uguacaaaaguuucauccu

SEQ ID NO: 985387 - RNA, 13 nt, Homo sapiens
uguacaauaaagc

SEQ ID NO: 985388 - RNA, 20 nt, Homo sapiens
uguacacagaaauacaguua

SEQ ID NO: 985389 - RNA, 20 nt, Homo sapiens
uguacagacagaaaaaacug

SEQ ID NO: 985390 - RNA, 19 nt, Homo sapiens
uguaucuagccuggaacca

SEQ ID NO: 985391 - RNA, 15 nt, Homo sapiens
uguaucucacacuca

SEQ ID NO: 985392 - RNA, 15 nt, Homo sapiens
ugucauuucaaagac

SEQ ID NO: 985393 - RNA, 13 nt, Homo sapiens
ugucucucaugaa

SEQ ID NO: 985394 - RNA, 15 nt, Homo sapiens
ugucuucuuugccca

SEQ ID NO: 985395 - RNA, 21 nt, Homo sapiens
uguggacguggguugcacugg

SEQ ID NO: 985396 - RNA, 18 nt, Homo sapiens
uguggccaucaaccucug

SEQ ID NO: 985397 - RNA, 16 nt, Homo sapiens
ugugguacaagcauuc

SEQ ID NO: 985398 - RNA, 14 nt, Homo sapiens
ugugguuagaaaag

SEQ ID NO: 985399 - RNA, 20 nt, Homo sapiens
uguguaucucacacucaugc

SEQ ID NO: 985400 - RNA, 18 nt, Homo sapiens
uguguuuuaaacugguag

SEQ ID NO: 985401 - RNA, 20 nt, Homo sapiens
uguguuuuuaacaugucaau

SEQ ID NO: 985402 - RNA, 15 nt, Homo sapiens
uguuaauauggugua

SEQ ID NO: 985403 - RNA, 22 nt, Homo sapiens
uguuaguuucugaguuuuacca

SEQ ID NO: 985404 - RNA, 21 nt, Homo sapiens
uguuauuggguaucaccacug

SEQ ID NO: 985405 - RNA, 15 nt, Homo sapiens
uguugagcagcaucu

SEQ ID NO: 985406 - RNA, 20 nt, Homo sapiens
uguuggcuagacuagucuca

SEQ ID NO: 985407 - RNA, 15 nt, Homo sapiens
uguuugaaagcuuua

SEQ ID NO: 985408 - RNA, 17 nt, Homo sapiens
uguuugacgggaaacaa

SEQ ID NO: 985409 - RNA, 20 nt, Homo sapiens
uguuuucuuaaccagaucau

SEQ ID NO: 985410 - RNA, 20 nt, Homo sapiens
uuaaacugguaggaaacuag

SEQ ID NO: 985411 - RNA, 21 nt, Homo sapiens
uuaaagacuuuuaugauacuu

SEQ ID NO: 985412 - RNA, 13 nt, Homo sapiens
uuaaagcuguuau

SEQ ID NO: 985413 - RNA, 16 nt, Homo sapiens
uuaacucagacacaaa

SEQ ID NO: 985414 - RNA, 17 nt, Homo sapiens
uuaauaccacagcuuuu

SEQ ID NO: 985415 - RNA, 15 nt, Homo sapiens
uuaauauguuauuau

SEQ ID NO: 985416 - RNA, 14 nt, Homo sapiens
uuaauauuccucag

SEQ ID NO: 985417 - RNA, 15 nt, Homo sapiens
uuacaugauucauuu

SEQ ID NO: 985418 - RNA, 15 nt, Homo sapiens
uuacuacaugcacuu

SEQ ID NO: 985419 - RNA, 18 nt, Homo sapiens
uuagaaacagcuucucaa

SEQ ID NO: 985420 - RNA, 21 nt, Homo sapiens
uuagaaagcauuugaaugcau

SEQ ID NO: 985421 - RNA, 17 nt, Homo sapiens
uuagaguuagacuguug

SEQ ID NO: 985422 - RNA, 22 nt, Homo sapiens
uuaguagagacgagguuucacu

SEQ ID NO: 985423 - RNA, 21 nt, Homo sapiens
uuagugaucaaauugugcagu

SEQ ID NO: 985424 - RNA, 13 nt, Homo sapiens
uuauaacuguugu

SEQ ID NO: 985425 - RNA, 20 nt, Homo sapiens
uuauacaggaugaugacuau

SEQ ID NO: 985426 - RNA, 18 nt, Homo sapiens
uuauacauaacacauauc

SEQ ID NO: 985427 - RNA, 17 nt, Homo sapiens
uuauauugauaagaucu

SEQ ID NO: 985428 - RNA, 22 nt, Homo sapiens
ucauauauauacauacaugcau

SEQ ID NO: 985429 - RNA, 16 nt, Homo sapiens
ucaucucacauuuucc

SEQ ID NO: 985430 - RNA, 15 nt, Homo sapiens
ucaucucagcucacu

SEQ ID NO: 985431 - RNA, 16 nt, Homo sapiens
ucaucucagcucacug

SEQ ID NO: 985432 - RNA, 16 nt, Homo sapiens
ucaugaguaacugauu

SEQ ID NO: 985433 - RNA, 18 nt, Homo sapiens
ucauucuuauuucaugaa

SEQ ID NO: 985434 - RNA, 19 nt, Homo sapiens
ucauugguacccacuugcu

SEQ ID NO: 985435 - RNA, 20 nt, Homo sapiens
ucauugguacccacuugcuu

SEQ ID NO: 985436 - RNA, 17 nt, Homo sapiens
ucauuuuaacaucugag

SEQ ID NO: 985437 - RNA, 18 nt, Homo sapiens
uccaaaaauguguaagaa

SEQ ID NO: 985438 - RNA, 21 nt, Homo sapiens
uccaaagucucuggaauuuga

SEQ ID NO: 985439 - RNA, 19 nt, Homo sapiens
uccaaccagauugucagcu

SEQ ID NO: 985440 - RNA, 23 nt, Homo sapiens
uccaacggcaagggaacaaguac

SEQ ID NO: 985441 - RNA, 22 nt, Homo sapiens
uccacaaugaugaugauuucag

SEQ ID NO: 985442 - RNA, 15 nt, Homo sapiens
uccacguacugcagc

SEQ ID NO: 985443 - RNA, 20 nt, Homo sapiens
uccacuaggguccaccagga

SEQ ID NO: 985444 - RNA, 18 nt, Homo sapiens
uccacuuuaugugcaucu

SEQ ID NO: 985445 - RNA, 18 nt, Homo sapiens
uccagagacaacagguaa

SEQ ID NO: 985446 - RNA, 17 nt, Homo sapiens
uccagagggaauugcag

SEQ ID NO: 985447 - RNA, 17 nt, Homo sapiens
uccagaugagaguacac

SEQ ID NO: 985448 - RNA, 15 nt, Homo sapiens
uccauccuaccacaa

SEQ ID NO: 985449 - RNA, 15 nt, Homo sapiens
uccaucuuucacuau

SEQ ID NO: 985450 - RNA, 21 nt, Homo sapiens
uccaugaguuacacuggauga

SEQ ID NO: 985451 - RNA, 14 nt, Homo sapiens
uccauucuucccuu

SEQ ID NO: 985452 - RNA, 20 nt, Homo sapiens
ucccaaaaucauaagauauu

SEQ ID NO: 985453 - RNA, 13 nt, Homo sapiens
ucccaaagugcug

SEQ ID NO: 985454 - RNA, 20 nt, Homo sapiens
ucccaaguagcugagacuac

SEQ ID NO: 985455 - RNA, 19 nt, Homo sapiens
ucccagcaugcugagauua

SEQ ID NO: 985456 - RNA, 14 nt, Homo sapiens
ucccaggaguacac

SEQ ID NO: 985457 - RNA, 15 nt, Homo sapiens
uccccaacaugcacu

SEQ ID NO: 985458 - RNA, 13 nt, Homo sapiens
uccccagccugcu

SEQ ID NO: 985459 - RNA, 19 nt, Homo sapiens
uccccagccugcucccuag

SEQ ID NO: 985460 - RNA, 17 nt, Homo sapiens
ucccccagccucaaguc

SEQ ID NO: 985461 - RNA, 19 nt, Homo sapiens
uccccgcccguuuuacaaa

SEQ ID NO: 985462 - RNA, 17 nt, Homo sapiens
uccccugccucaccagc

SEQ ID NO: 985463 - RNA, 20 nt, Homo sapiens
uccccuggaacugucucuca

SEQ ID NO: 985464 - RNA, 19 nt, Homo sapiens
ucccuaauaaagcugugug

SEQ ID NO: 985465 - RNA, 20 nt, Homo sapiens
ucccuagccagaggcucuaa

SEQ ID NO: 985466 - RNA, 23 nt, Homo sapiens
ucccuccagauauacuugguucu

SEQ ID NO: 985467 - RNA, 23 nt, Homo sapiens
ucccuucccugaagaucuaguga

SEQ ID NO: 985468 - RNA, 19 nt, Homo sapiens
ucccuuccugggucuacca

SEQ ID NO: 985469 - RNA, 19 nt, Homo sapiens
uccgaggccccugucucag

SEQ ID NO: 985470 - RNA, 16 nt, Homo sapiens
uccgucaccucagaga

SEQ ID NO: 985471 - RNA, 23 nt, Homo sapiens
uccgucaccucagagacauacac

SEQ ID NO: 985472 - RNA, 20 nt, Homo sapiens
uccuaacaaguagcacccug

SEQ ID NO: 985473 - RNA, 22 nt, Homo sapiens
uccuaagccaugggagacacug

SEQ ID NO: 985474 - RNA, 23 nt, Homo sapiens
uccuaagcuggagugcaguggca

SEQ ID NO: 985475 - RNA, 17 nt, Homo sapiens
uccuagaaacugacaca

SEQ ID NO: 985476 - RNA, 21 nt, Homo sapiens
uccuauguuucacugugcaaa

SEQ ID NO: 985477 - RNA, 20 nt, Homo sapiens
uccucaguuuuugugaaaag

SEQ ID NO: 985478 - RNA, 15 nt, Homo sapiens
uccuccgucaccuca

SEQ ID NO: 985479 - RNA, 14 nt, Homo sapiens
uccucucccaguga

SEQ ID NO: 985480 - RNA, 19 nt, Homo sapiens
uccugggauuacaggugug

SEQ ID NO: 985481 - RNA, 18 nt, Homo sapiens
uccuggggaacauagaac

SEQ ID NO: 985482 - RNA, 14 nt, Homo sapiens
uccugggucuacca

SEQ ID NO: 985483 - RNA, 18 nt, Homo sapiens
uccuucuauucuagccug

SEQ ID NO: 985484 - RNA, 18 nt, Homo sapiens
uccuucugagccugccuu

SEQ ID NO: 985485 - RNA, 13 nt, Homo sapiens
ucuaaacauuuca

SEQ ID NO: 985486 - RNA, 14 nt, Homo sapiens
ucuaauguacaaua

SEQ ID NO: 985487 - RNA, 15 nt, Homo sapiens
ucuaauuggcaugaa

SEQ ID NO: 985488 - RNA, 19 nt, Homo sapiens
ucuacacauacauguaaaa

SEQ ID NO: 985489 - RNA, 16 nt, Homo sapiens
ucuaucaaaauuaccc

SEQ ID NO: 985490 - RNA, 21 nt, Homo sapiens
ucuaugagauagguacuauua

SEQ ID NO: 985491 - RNA, 22 nt, Homo sapiens
ucuaugagauagguacuauuau

SEQ ID NO: 985492 - RNA, 15 nt, Homo sapiens
ucuauuugaucugau

SEQ ID NO: 985493 - RNA, 20 nt, Homo sapiens
ucucaaacuccugaccucag

SEQ ID NO: 985494 - RNA, 22 nt, Homo sapiens
ucucacaugauuccagccauca

SEQ ID NO: 985495 - RNA, 22 nt, Homo sapiens
ucucagcucacuacaaccuccg

SEQ ID NO: 985496 - RNA, 15 nt, Homo sapiens
ucucagcucacugca

SEQ ID NO: 985497 - RNA, 21 nt, Homo sapiens
ucucagcucacugcaaccucc

SEQ ID NO: 985498 - RNA, 22 nt, Homo sapiens
ucucagcucacugcaaccucug

SEQ ID NO: 985499 - RNA, 15 nt, Homo sapiens
ucucauaacucugug

SEQ ID NO: 985500 - RNA, 12 nt, Homo sapiens
ucucauccugca

SEQ ID NO: 985501 - RNA, 14 nt, Homo sapiens
ucucaugauuauua

SEQ ID NO: 985502 - RNA, 24 nt, Homo sapiens
ucuccauacucuguaacaguugca

SEQ ID NO: 985503 - RNA, 19 nt, Homo sapiens
ucucccaauucauccucac

SEQ ID NO: 985504 - RNA, 16 nt, Homo sapiens
ucucccagcucagggc

SEQ ID NO: 985505 - RNA, 17 nt, Homo sapiens
ucuccccuucucuguau

SEQ ID NO: 985506 - RNA, 17 nt, Homo sapiens
ucuccucucucuguaau

SEQ ID NO: 985507 - RNA, 13 nt, Homo sapiens
ucucuccagugca

SEQ ID NO: 985508 - RNA, 16 nt, Homo sapiens
ucucuccagugcaccu

SEQ ID NO: 985509 - RNA, 20 nt, Homo sapiens
ucucucgugaguauauugau

SEQ ID NO: 985510 - RNA, 18 nt, Homo sapiens
ucugaauuugagauacaa

SEQ ID NO: 985511 - RNA, 10 nt, Homo sapiens
ucugagacag

SEQ ID NO: 985512 - RNA, 12 nt, Homo sapiens
ucugagcaccua

SEQ ID NO: 985513 - RNA, 24 nt, Homo sapiens
ucugagcaccuacuuacaugcauu

SEQ ID NO: 985514 - RNA, 13 nt, Homo sapiens
ucugagcauuuaa

SEQ ID NO: 985515 - RNA, 13 nt, Homo sapiens
ucugaggucauua

SEQ ID NO: 985516 - RNA, 21 nt, Homo sapiens
ucugcauuaucugaggucaca

SEQ ID NO: 985517 - RNA, 18 nt, Homo sapiens
ucuggccuguacccagua

SEQ ID NO: 985518 - RNA, 14 nt, Homo sapiens
ucuggggcauuauc

SEQ ID NO: 985519 - RNA, 19 nt, Homo sapiens
ucuguucauuuccucaaaa

SEQ ID NO: 985520 - RNA, 15 nt, Homo sapiens
ucuguucuuccauca

SEQ ID NO: 985521 - RNA, 16 nt, Homo sapiens
ucuguuuccucuguau

SEQ ID NO: 985522 - RNA, 21 nt, Homo sapiens
ucuuacaauaauucuaugaga

SEQ ID NO: 985523 - RNA, 18 nt, Homo sapiens
ucuucauguuucaggaga

SEQ ID NO: 985524 - RNA, 13 nt, Homo sapiens
ucuuccaucaccu

SEQ ID NO: 985525 - RNA, 19 nt, Homo sapiens
ucuuccaucugauugugau

SEQ ID NO: 985526 - RNA, 20 nt, Homo sapiens
ucuucuccauccuaccacaa

SEQ ID NO: 985527 - RNA, 20 nt, Homo sapiens
ucuucuccuaaaacuuuaaa

SEQ ID NO: 985528 - RNA, 14 nt, Homo sapiens
ucuugauguaaaau

SEQ ID NO: 985529 - RNA, 19 nt, Homo sapiens
ucuuggguguuuauccuau

SEQ ID NO: 985530 - RNA, 14 nt, Homo sapiens
ucuugucucaaugc

SEQ ID NO: 985531 - RNA, 21 nt, Homo sapiens
ucuuuaaagcaggauuucuca

SEQ ID NO: 985532 - RNA, 18 nt, Homo sapiens
ucuuuccuggcuacucca

SEQ ID NO: 985533 - RNA, 22 nt, Homo sapiens
ucuuuuacccggcacauucccc

SEQ ID NO: 985534 - RNA, 13 nt, Homo sapiens
ugaaaaaaagcuu

SEQ ID NO: 985535 - RNA, 12 nt, Homo sapiens
ugaaaaacugcu

SEQ ID NO: 985536 - RNA, 20 nt, Homo sapiens
ugaaagcaaccuucuugccu

SEQ ID NO: 985537 - RNA, 19 nt, Homo sapiens
ugaacauucgaccuccauu

SEQ ID NO: 985538 - RNA, 20 nt, Homo sapiens
ugaaccucaagcugcaucua

SEQ ID NO: 985539 - RNA, 17 nt, Homo sapiens
ugaacuaggcugagcaa

SEQ ID NO: 985540 - RNA, 20 nt, Homo sapiens
ugaaggcauccccaggcccu

SEQ ID NO: 985541 - RNA, 19 nt, Homo sapiens
ugaauauuuaguguucaua

SEQ ID NO: 985542 - RNA, 23 nt, Homo sapiens
ugaaucccucuaucucuaaagaa

SEQ ID NO: 985543 - RNA, 15 nt, Homo sapiens
ugaaugcggcccaac

SEQ ID NO: 985544 - RNA, 19 nt, Homo sapiens
ugaccaaccuuuucccaac

SEQ ID NO: 985545 - RNA, 17 nt, Homo sapiens
ugacuauggaaagagua

SEQ ID NO: 985546 - RNA, 14 nt, Homo sapiens
ugacucuuggcaca

SEQ ID NO: 985547 - RNA, 15 nt, Homo sapiens
ugacugccaagccau

SEQ ID NO: 985548 - RNA, 17 nt, Homo sapiens
ugagaaaagcuuugaac

SEQ ID NO: 985549 - RNA, 20 nt, Homo sapiens
ugagacagagucuuccucug

SEQ ID NO: 985550 - RNA, 15 nt, Homo sapiens
ugagauguguucaca

SEQ ID NO: 985551 - RNA, 21 nt, Homo sapiens
ugagcagugcuugaaugaagu

SEQ ID NO: 985552 - RNA, 20 nt, Homo sapiens
ugagccaccaugcccggcua

SEQ ID NO: 985553 - RNA, 17 nt, Homo sapiens
ugagcuaggaauugugu

SEQ ID NO: 985554 - RNA, 21 nt, Homo sapiens
ugagcuuggaaaggaccagua

SEQ ID NO: 985555 - RNA, 17 nt, Homo sapiens
ugaggccuagacucugu

SEQ ID NO: 985556 - RNA, 12 nt, Homo sapiens
ugagggugcuga

SEQ ID NO: 985557 - RNA, 19 nt, Homo sapiens
ugaguagaaaggccuuuaa

SEQ ID NO: 985558 - RNA, 23 nt, Homo sapiens
ugauaagaucuuuuauuuugcca

SEQ ID NO: 985559 - RNA, 15 nt, Homo sapiens
uauucuagccugcau

SEQ ID NO: 985560 - RNA, 17 nt, Homo sapiens
uauuuaugccucuguau

SEQ ID NO: 985561 - RNA, 20 nt, Homo sapiens
uauuucugucaacuuguauu

SEQ ID NO: 985562 - RNA, 23 nt, Homo sapiens
uauuucuucaaauaaaucucucc

SEQ ID NO: 985563 - RNA, 20 nt, Homo sapiens
uauuuguuuaaaaagcgcua

SEQ ID NO: 985564 - RNA, 15 nt, Homo sapiens
uauuuuaauaaacac

SEQ ID NO: 985565 - RNA, 13 nt, Homo sapiens
uauuuucuacaca

SEQ ID NO: 985566 - RNA, 23 nt, Homo sapiens
uauuuuuuuucuuguauuuuucc

SEQ ID NO: 985567 - RNA, 15 nt, Homo sapiens
ucaaaagagucuuaa

SEQ ID NO: 985568 - RNA, 17 nt, Homo sapiens
ucaacuccuuucucauc

SEQ ID NO: 985569 - RNA, 22 nt, Homo sapiens
ucaagcgauucucuugccucaa

SEQ ID NO: 985570 - RNA, 21 nt, Homo sapiens
ucaagcucuccaaaggcucag

SEQ ID NO: 985571 - RNA, 16 nt, Homo sapiens
ucaaguccugccucuu

SEQ ID NO: 985572 - RNA, 21 nt, Homo sapiens
ucaauauaagcuuuucuuuuc

SEQ ID NO: 985573 - RNA, 23 nt, Homo sapiens
ucacaccaggcuugccugcaggc

SEQ ID NO: 985574 - RNA, 14 nt, Homo sapiens
ucacagcuacacag

SEQ ID NO: 985575 - RNA, 19 nt, Homo sapiens
ucacagguagacaguauau

SEQ ID NO: 985576 - RNA, 22 nt, Homo sapiens
ucaccaauaaguauucuguguu

SEQ ID NO: 985577 - RNA, 21 nt, Homo sapiens
ucacccagguuggagugcagu

SEQ ID NO: 985578 - RNA, 19 nt, Homo sapiens
ucaccugucaucucacauu

SEQ ID NO: 985579 - RNA, 14 nt, Homo sapiens
ucacuacaaccucc

SEQ ID NO: 985580 - RNA, 13 nt, Homo sapiens
ucacuguugcaua

SEQ ID NO: 985581 - RNA, 18 nt, Homo sapiens
ucacuuccaagagccuuu

SEQ ID NO: 985582 - RNA, 18 nt, Homo sapiens
ucagaaaugcugucauaa

SEQ ID NO: 985583 - RNA, 15 nt, Homo sapiens
ucagacaagcugcau

SEQ ID NO: 985584 - RNA, 16 nt, Homo sapiens
ucagaccuggcugcuu

SEQ ID NO: 985585 - RNA, 12 nt, Homo sapiens
ucagacuaugaa

SEQ ID NO: 985586 - RNA, 23 nt, Homo sapiens
ucagagacauacaccuaugucau

SEQ ID NO: 985587 - RNA, 21 nt, Homo sapiens
ucagcaaguuagaacuagcca

SEQ ID NO: 985588 - RNA, 19 nt, Homo sapiens
ucaggagagaguugaaccu

SEQ ID NO: 985589 - RNA, 19 nt, Homo sapiens
ucaggaggaaggcuuacac

SEQ ID NO: 985590 - RNA, 15 nt, Homo sapiens
ucaggauaccauaua

SEQ ID NO: 985591 - RNA, 17 nt, Homo sapiens
ucagguggcccuacugg

SEQ ID NO: 985592 - RNA, 19 nt, Homo sapiens
ucagguggcccuacuggga

SEQ ID NO: 985593 - RNA, 17 nt, Homo sapiens
ucagucuuuuccaugaa

SEQ ID NO: 985594 - RNA, 20 nt, Homo sapiens
ucagucuuuuccaugaacuu

SEQ ID NO: 985595 - RNA, 18 nt, Homo sapiens
ucaguuauuauauuuaca

SEQ ID NO: 985596 - RNA, 18 nt, Homo sapiens
ucaguucauccauucuau

SEQ ID NO: 985597 - RNA, 16 nt, Homo sapiens
ucauaaagucuugccu

SEQ ID NO: 985598 - RNA, 17 nt, Homo sapiens
ucauauaaucuuacaau

SEQ ID NO: 985599 - RNA, 16 nt, Homo sapiens
aaauagcccuguaaca

SEQ ID NO: 985600 - RNA, 19 nt, Homo sapiens
aaauauccuuuaauugauc

SEQ ID NO: 985601 - RNA, 16 nt, Homo sapiens
aaauaucuucacuugu

SEQ ID NO: 985602 - RNA, 18 nt, Homo sapiens
aaauaucuucacuuguca

SEQ ID NO: 985603 - RNA, 15 nt, Homo sapiens
aaauauguucugaca

SEQ ID NO: 985604 - RNA, 23 nt, Homo sapiens
aaaucacucaaauuguucucuaa

SEQ ID NO: 985605 - RNA, 18 nt, Homo sapiens
aaaucagaccuggcugcu

SEQ ID NO: 985606 - RNA, 15 nt, Homo sapiens
aaaucagacuaugaa

SEQ ID NO: 985607 - RNA, 20 nt, Homo sapiens
aaaucauccaagacaguuau

SEQ ID NO: 985608 - RNA, 18 nt, Homo sapiens
aaaucuaucaaaauuacc

SEQ ID NO: 985609 - RNA, 15 nt, Homo sapiens
aaaugcaccauguca

SEQ ID NO: 985610 - RNA, 16 nt, Homo sapiens
aaauguguaagaacaa

SEQ ID NO: 985611 - RNA, 14 nt, Homo sapiens
aaauuacacuuuga

SEQ ID NO: 985612 - RNA, 14 nt, Homo sapiens
aaauugaauuucca

SEQ ID NO: 985613 - RNA, 21 nt, Homo sapiens
aaauuugggggacuuacauga

SEQ ID NO: 985614 - RNA, 22 nt, Homo sapiens
aaauuugggggacuuacaugau

SEQ ID NO: 985615 - RNA, 12 nt, Homo sapiens
aacaaacagggc

SEQ ID NO: 985616 - RNA, 21 nt, Homo sapiens
aacaacuugucuauuaccugu

SEQ ID NO: 985617 - RNA, 23 nt, Homo sapiens
aacaacuugucuauuaccuguua

SEQ ID NO: 985618 - RNA, 19 nt, Homo sapiens
aacacaauucuucuuccaa

SEQ ID NO: 985619 - RNA, 20 nt, Homo sapiens
aacagccacuacauuacuuc

SEQ ID NO: 985620 - RNA, 18 nt, Homo sapiens
aacaggcuugaaucaaag

SEQ ID NO: 985621 - RNA, 21 nt, Homo sapiens
aacagggcugccuucuggccu

SEQ ID NO: 985622 - RNA, 18 nt, Homo sapiens
aacaguauugacuuguau

SEQ ID NO: 985623 - RNA, 22 nt, Homo sapiens
aacaguugcauugacugucaca

SEQ ID NO: 985624 - RNA, 22 nt, Homo sapiens
aacauguuccugggaucacuga

SEQ ID NO: 985625 - RNA, 21 nt, Homo sapiens
aaccacacccacacucagauc

SEQ ID NO: 985626 - RNA, 18 nt, Homo sapiens
aacccagcucacaggagc

SEQ ID NO: 985627 - RNA, 17 nt, Homo sapiens
aacccauucccucucca

SEQ ID NO: 985628 - RNA, 13 nt, Homo sapiens
aacccugggacgu

SEQ ID NO: 985629 - RNA, 13 nt, Homo sapiens
aacccuugcacua

SEQ ID NO: 985630 - RNA, 23 nt, Homo sapiens
aacccuuucauaaagucuugccu

SEQ ID NO: 985631 - RNA, 13 nt, Homo sapiens
aaccuauacucac

SEQ ID NO: 985632 - RNA, 22 nt, Homo sapiens
aaccucacauacccucacuuaa

SEQ ID NO: 985633 - RNA, 20 nt, Homo sapiens
aaccuccaccucgcagguuc

SEQ ID NO: 985634 - RNA, 13 nt, Homo sapiens
aaccuuuucccaa

SEQ ID NO: 985635 - RNA, 19 nt, Homo sapiens
aacgauaaaagacagugaa

SEQ ID NO: 985636 - RNA, 15 nt, Homo sapiens
aacguauaaaagccu

SEQ ID NO: 985637 - RNA, 14 nt, Homo sapiens
aacgugcauugugc

SEQ ID NO: 985638 - RNA, 21 nt, Homo sapiens
aacuaaaguuagaaaguugau

SEQ ID NO: 985639 - RNA, 16 nt, Homo sapiens
aacuaacaaccaaaga

SEQ ID NO: 985640 - RNA, 20 nt, Homo sapiens
aacucauccacguccugucu

SEQ ID NO: 985641 - RNA, 13 nt, Homo sapiens
aacuccuguuuca

SEQ ID NO: 985642 - RNA, 18 nt, Homo sapiens
aacucugugaucuugcuc

SEQ ID NO: 985643 - RNA, 20 nt, Homo sapiens
aacugccuuuggcagaguuc

SEQ ID NO: 985644 - RNA, 13 nt, Homo sapiens
aacuguugucaua

SEQ ID NO: 985645 - RNA, 17 nt, Homo sapiens
aagaaaauaagagcuca

SEQ ID NO: 985646 - RNA, 21 nt, Homo sapiens
aagaaggaaaagauacccaaa

SEQ ID NO: 985647 - RNA, 22 nt, Homo sapiens
aagaauuauuuugugaugcaaa

SEQ ID NO: 985648 - RNA, 15 nt, Homo sapiens
aagacagcuucucau

SEQ ID NO: 985649 - RNA, 17 nt, Homo sapiens
aagacugcaaacccuuu

SEQ ID NO: 985650 - RNA, 16 nt, Homo sapiens
aagacuuuauguaguu

SEQ ID NO: 985651 - RNA, 22 nt, Homo sapiens
aagagauuuuucaugauuuuga

SEQ ID NO: 985652 - RNA, 11 nt, Homo sapiens
aagagccacag

SEQ ID NO: 985653 - RNA, 22 nt, Homo sapiens
aagagcucaggaugagggaaaa

SEQ ID NO: 985654 - RNA, 15 nt, Homo sapiens
aagaggcuacuguaa

SEQ ID NO: 985655 - RNA, 22 nt, Homo sapiens
aagagucuuaauauauauaucc

SEQ ID NO: 985656 - RNA, 18 nt, Homo sapiens
aagaucuuuuauuuugcc

SEQ ID NO: 985657 - RNA, 14 nt, Homo sapiens
aagauggggucugu

SEQ ID NO: 985658 - RNA, 12 nt, Homo sapiens
aagauuacuuuu

SEQ ID NO: 985659 - RNA, 11 nt, Homo sapiens
aagcaaugugg

SEQ ID NO: 985660 - RNA, 12 nt, Homo sapiens
aagcaauguggu

SEQ ID NO: 985661 - RNA, 12 nt, Homo sapiens
aagcaggauuuc

SEQ ID NO: 985662 - RNA, 20 nt, Homo sapiens
aagcccuccgccauucucaa

SEQ ID NO: 985663 - RNA, 17 nt, Homo sapiens
aagcuggagugcagugg

SEQ ID NO: 985664 - RNA, 20 nt, Homo sapiens
aagcuuuuuuugaaucauca

SEQ ID NO: 985665 - RNA, 19 nt, Homo sapiens
aaggagacaaaacuagaga

SEQ ID NO: 985666 - RNA, 22 nt, Homo sapiens
aaggcacacagcaagucagggu

SEQ ID NO: 985667 - RNA, 22 nt, Homo sapiens
aaggccaagaggcuguucccac

SEQ ID NO: 985668 - RNA, 23 nt, Homo sapiens
aaggcuuacacccacaguggaaa

SEQ ID NO: 985669 - RNA, 16 nt, Homo sapiens
aaggugucauacagau

SEQ ID NO: 985670 - RNA, 20 nt, Homo sapiens
aaguacaaccacacccacac

SEQ ID NO: 985671 - RNA, 23 nt, Homo sapiens
aaguacuuuuggcauuuuacugu

SEQ ID NO: 985672 - RNA, 17 nt, Homo sapiens
aaguagcacccuggauu

SEQ ID NO: 985673 - RNA, 17 nt, Homo sapiens
aagucaggguuggagca

SEQ ID NO: 985674 - RNA, 17 nt, Homo sapiens
aaguccugcaagcagag

SEQ ID NO: 985675 - RNA, 16 nt, Homo sapiens
aagucugcuacccuca

SEQ ID NO: 985676 - RNA, 17 nt, Homo sapiens
aagucuuauuuccucaa

SEQ ID NO: 985677 - RNA, 22 nt, Homo sapiens
aagucuugccuugcugaacucc

SEQ ID NO: 985678 - RNA, 20 nt, Homo sapiens
aagugagcuccuaagccaug

SEQ ID NO: 985679 - RNA, 18 nt, Homo sapiens
aagugauugcugguuuua

SEQ ID NO: 985680 - RNA, 17 nt, Homo sapiens
aagugcuucuccagccu

SEQ ID NO: 985681 - RNA, 15 nt, Homo sapiens
aaguugcuauuugaa

SEQ ID NO: 985682 - RNA, 16 nt, Homo sapiens
aauaaacacucuugaa

SEQ ID NO: 985683 - RNA, 18 nt, Homo sapiens
aauaaagcaaugugguag

SEQ ID NO: 985684 - RNA, 14 nt, Homo sapiens
aauaauaccuauau

SEQ ID NO: 985685 - RNA, 13 nt, Homo sapiens
aauaauguaagac

SEQ ID NO: 985686 - RNA, 17 nt, Homo sapiens
aauaauuuuucacuuca

SEQ ID NO: 985687 - RNA, 18 nt, Homo sapiens
aauaauuuuucacuucaa

SEQ ID NO: 985688 - RNA, 19 nt, Homo sapiens
aauacaauuaaagcuguua

SEQ ID NO: 985689 - RNA, 22 nt, Homo sapiens
aauagaauuugagcaucaguga

SEQ ID NO: 985690 - RNA, 15 nt, Homo sapiens
aauagugauuuccac

SEQ ID NO: 985691 - RNA, 19 nt, Homo sapiens
aauagugauuuccacagug

SEQ ID NO: 985692 - RNA, 14 nt, Homo sapiens
aauaguugcuguca

SEQ ID NO: 985693 - RNA, 17 nt, Homo sapiens
aauaucuucacuuguca

SEQ ID NO: 985694 - RNA, 17 nt, Homo sapiens
aauaugguguacauucu

SEQ ID NO: 985695 - RNA, 18 nt, Homo sapiens
aauauguaaaauuacacu

SEQ ID NO: 985696 - RNA, 13 nt, Homo sapiens
aauaugucuuucu

SEQ ID NO: 985697 - RNA, 15 nt, Homo sapiens
aauauguucugacau

SEQ ID NO: 985698 - RNA, 17 nt, Homo sapiens
aauauguucugacauaa

SEQ ID NO: 985699 - RNA, 15 nt, Homo sapiens
aauauuuauuuaacu

SEQ ID NO: 985700 - RNA, 23 nt, Homo sapiens
aaucacugcucacacugcugaug

SEQ ID NO: 985701 - RNA, 13 nt, Homo sapiens
aaucagacuauga

SEQ ID NO: 985702 - RNA, 18 nt, Homo sapiens
aaucauauaaucuuacaa

SEQ ID NO: 985703 - RNA, 18 nt, Homo sapiens
aauccccaacaugcacug

SEQ ID NO: 985704 - RNA, 22 nt, Homo sapiens
aaucccgauucacccuguccaa

SEQ ID NO: 985705 - RNA, 15 nt, Homo sapiens
aaucucaagcaaaca

SEQ ID NO: 985706 - RNA, 17 nt, Homo sapiens
aaucucugaauuugaga

SEQ ID NO: 985707 - RNA, 18 nt, Homo sapiens
aaucucugaauuugagau

SEQ ID NO: 985708 - RNA, 19 nt, Homo sapiens
aaugaagcaaugcuucauc

SEQ ID NO: 985709 - RNA, 16 nt, Homo sapiens
aaugcagagucaauga

SEQ ID NO: 985710 - RNA, 14 nt, Homo sapiens
aaugcauguugccc

SEQ ID NO: 985711 - RNA, 21 nt, Homo sapiens
aauggacaucaaaaucaacuu

SEQ ID NO: 985712 - RNA, 20 nt, Homo sapiens
aauggcuaagauaccaaaac

SEQ ID NO: 985713 - RNA, 14 nt, Homo sapiens
aauuaacucagaca

SEQ ID NO: 985714 - RNA, 18 nt, Homo sapiens
aauuaccacaccaucucc

SEQ ID NO: 985715 - RNA, 20 nt, Homo sapiens
aauuauuuugugaugcaaau

SEQ ID NO: 985716 - RNA, 22 nt, Homo sapiens
aauucagacaagcugcauuuca

SEQ ID NO: 985717 - RNA, 18 nt, Homo sapiens
aauucagggagugggcua

SEQ ID NO: 985718 - RNA, 23 nt, Homo sapiens
aauucuaacccagguauccaaaa

SEQ ID NO: 985719 - RNA, 20 nt, Homo sapiens
aauugcagaguacuggcuga

SEQ ID NO: 985720 - RNA, 19 nt, Homo sapiens
aauugugcuggaaauggac

SEQ ID NO: 985721 - RNA, 18 nt, Homo sapiens
aauuuaaaacauuacucu

SEQ ID NO: 985722 - RNA, 21 nt, Homo sapiens
aauuugaaacacuuugcauaa

SEQ ID NO: 985723 - RNA, 16 nt, Homo sapiens
aauuugagauacaaac

SEQ ID NO: 985724 - RNA, 16 nt, Homo sapiens
aauuuuugaaaacugg

SEQ ID NO: 985725 - RNA, 14 nt, Homo sapiens
acaaacccaagggc

SEQ ID NO: 985726 - RNA, 22 nt, Homo sapiens
acaaauauggggaaaaaacugu

SEQ ID NO: 985727 - RNA, 22 nt, Homo sapiens
acaaauccaaugaaaugaguuu

SEQ ID NO: 985728 - RNA, 12 nt, Homo sapiens
acaacuaccuga

SEQ ID NO: 985729 - RNA, 18 nt, Homo sapiens
acaaguauggcuccucca

SEQ ID NO: 985730 - RNA, 20 nt, Homo sapiens
acauguggcccaacacaauu

SEQ ID NO: 985731 - RNA, 21 nt, Homo sapiens
acauguuccuuauauuuacuc

SEQ ID NO: 985732 - RNA, 21 nt, Homo sapiens
acauuacuucaaacugagauc

SEQ ID NO: 985733 - RNA, 17 nt, Homo sapiens
acauucagagcuuacuu

SEQ ID NO: 985734 - RNA, 13 nt, Homo sapiens
acauugagguucc

SEQ ID NO: 985735 - RNA, 17 nt, Homo sapiens
acauuucccccuagccu

SEQ ID NO: 985736 - RNA, 18 nt, Homo sapiens
acauuucucauaccuucc

SEQ ID NO: 985737 - RNA, 15 nt, Homo sapiens
accaagcuuguccaa

SEQ ID NO: 985738 - RNA, 24 nt, Homo sapiens
accacacccacacucagauccucc

SEQ ID NO: 985739 - RNA, 22 nt, Homo sapiens
accacaucccacucacaacagc

SEQ ID NO: 985740 - RNA, 14 nt, Homo sapiens
accacuggagauca

SEQ ID NO: 985741 - RNA, 21 nt, Homo sapiens
accagauuuuuacacauguau

SEQ ID NO: 985742 - RNA, 20 nt, Homo sapiens
accaguugugauacaauaaa

SEQ ID NO: 985743 - RNA, 19 nt, Homo sapiens
accaucgucuucuuggcca

SEQ ID NO: 985744 - RNA, 21 nt, Homo sapiens
accaucgucuucuuggccaug

SEQ ID NO: 985745 - RNA, 22 nt, Homo sapiens
accaugcugcuggggaagacag

SEQ ID NO: 985746 - RNA, 23 nt, Homo sapiens
accaugcugcuggggaagacagu

SEQ ID NO: 985747 - RNA, 20 nt, Homo sapiens
accauucaggucuuucuuuc

SEQ ID NO: 985748 - RNA, 21 nt, Homo sapiens
acccaaggaugucugccacac

SEQ ID NO: 985749 - RNA, 15 nt, Homo sapiens
acccaccaguugaau

SEQ ID NO: 985750 - RNA, 22 nt, Homo sapiens
acccacuuaccuugcaucucac

SEQ ID NO: 985751 - RNA, 22 nt, Homo sapiens
acccaguaacucaucugucacc

SEQ ID NO: 985752 - RNA, 18 nt, Homo sapiens
accccaacagcacccucu

SEQ ID NO: 985753 - RNA, 13 nt, Homo sapiens
accccaacccugg

SEQ ID NO: 985754 - RNA, 16 nt, Homo sapiens
acccgcagaguucuca

SEQ ID NO: 985755 - RNA, 17 nt, Homo sapiens
acccucauuucucaucu

SEQ ID NO: 985756 - RNA, 12 nt, Homo sapiens
acccuguugcua

SEQ ID NO: 985757 - RNA, 19 nt, Homo sapiens
accgcaggauuugggcucu

SEQ ID NO: 985758 - RNA, 19 nt, Homo sapiens
accggagaaccccaggacg

SEQ ID NO: 985759 - RNA, 17 nt, Homo sapiens
accuacccuccacaggc

SEQ ID NO: 985760 - RNA, 18 nt, Homo sapiens
accuacuuacaugcauua

SEQ ID NO: 985761 - RNA, 15 nt, Homo sapiens
accucaagcugcauc

SEQ ID NO: 985762 - RNA, 16 nt, Homo sapiens
accucaccaguuucca

SEQ ID NO: 985763 - RNA, 17 nt, Homo sapiens
accugaaauuaacucag

SEQ ID NO: 985764 - RNA, 18 nt, Homo sapiens
accugaaauuaacucaga

SEQ ID NO: 985765 - RNA, 19 nt, Homo sapiens
accugccaggcacacugag

SEQ ID NO: 985766 - RNA, 22 nt, Homo sapiens
accugggcugaggcauccuucc

SEQ ID NO: 985767 - RNA, 16 nt, Homo sapiens
accuucacaccaauag

SEQ ID NO: 985768 - RNA, 22 nt, Homo sapiens
accuugucucccagcucagggc

SEQ ID NO: 985769 - RNA, 20 nt, Homo sapiens
accuuuucccaaccauacaa

SEQ ID NO: 985770 - RNA, 23 nt, Homo sapiens
acgcagccugcagacucacugug

SEQ ID NO: 985771 - RNA, 20 nt, Homo sapiens
acgguggcucacgccuguaa

SEQ ID NO: 985772 - RNA, 14 nt, Homo sapiens
acguccugucuguu

SEQ ID NO: 985773 - RNA, 16 nt, Homo sapiens
acguccugucuguuuc

SEQ ID NO: 985774 - RNA, 16 nt, Homo sapiens
acgucuuaucuaauca

SEQ ID NO: 985775 - RNA, 15 nt, Homo sapiens
acguggguugcacug

SEQ ID NO: 985776 - RNA, 20 nt, Homo sapiens
acuacuagggaaaugccuuu

SEQ ID NO: 985777 - RNA, 23 nt, Homo sapiens
acuaucuguaaugccuuuucuca

SEQ ID NO: 985778 - RNA, 16 nt, Homo sapiens
acuauugcuugcacaa

SEQ ID NO: 985779 - RNA, 11 nt, Homo sapiens
acucacugugg

SEQ ID NO: 985780 - RNA, 12 nt, Homo sapiens
acucacuguggg

SEQ ID NO: 985781 - RNA, 12 nt, Homo sapiens
acucauaauucu

SEQ ID NO: 985782 - RNA, 14 nt, Homo sapiens
acucaucugucacc

SEQ ID NO: 985783 - RNA, 15 nt, Homo sapiens
acucauuucuagcag

SEQ ID NO: 985784 - RNA, 17 nt, Homo sapiens
acuccugaccucaggca

SEQ ID NO: 985785 - RNA, 20 nt, Homo sapiens
acucuuagcuaaaucccucc

SEQ ID NO: 985786 - RNA, 22 nt, Homo sapiens
acucuucugagcaccuacuuac

SEQ ID NO: 985787 - RNA, 20 nt, Homo sapiens
acucuucuuacuggugcuau

SEQ ID NO: 985788 - RNA, 12 nt, Homo sapiens
acucuugcaggg

SEQ ID NO: 985789 - RNA, 17 nt, Homo sapiens
acugcaaacccuuucau

SEQ ID NO: 985790 - RNA, 12 nt, Homo sapiens
acugcaaccucu

SEQ ID NO: 985791 - RNA, 16 nt, Homo sapiens
acugcaaccucugccu

SEQ ID NO: 985792 - RNA, 15 nt, Homo sapiens
acugcaugcacuucu

SEQ ID NO: 985793 - RNA, 18 nt, Homo sapiens
acugccaaagaacuugga

SEQ ID NO: 985794 - RNA, 13 nt, Homo sapiens
acugccaagccau

SEQ ID NO: 985795 - RNA, 19 nt, Homo sapiens
acuggagccccaucagcuc

SEQ ID NO: 985796 - RNA, 15 nt, Homo sapiens
acugggacacuuuua

SEQ ID NO: 985797 - RNA, 23 nt, Homo sapiens
acuguacagacagaaaaaacuga

SEQ ID NO: 985798 - RNA, 18 nt, Homo sapiens
acugucacauaaugcuca

SEQ ID NO: 985799 - RNA, 21 nt, Homo sapiens
acugugcaaauauaucugcua

SEQ ID NO: 985800 - RNA, 12 nt, Homo sapiens
acugugugcuca

SEQ ID NO: 985801 - RNA, 12 nt, Homo sapiens
acuguguuggcc

SEQ ID NO: 985802 - RNA, 17 nt, Homo sapiens
acuguuuuucagggagg

SEQ ID NO: 985803 - RNA, 19 nt, Homo sapiens
acuuaaacuuuuaucacug

SEQ ID NO: 985804 - RNA, 16 nt, Homo sapiens
acuucaaacugagauc

SEQ ID NO: 985805 - RNA, 13 nt, Homo sapiens
acuucaagcucuc

SEQ ID NO: 985806 - RNA, 13 nt, Homo sapiens
acuucaagugacc

SEQ ID NO: 985807 - RNA, 24 nt, Homo sapiens
acuucuuacaauaauucuaugaga

SEQ ID NO: 985808 - RNA, 14 nt, Homo sapiens
acuugguucaguac

SEQ ID NO: 985809 - RNA, 20 nt, Homo sapiens
acuuuauguuacuacaugca

SEQ ID NO: 985810 - RNA, 16 nt, Homo sapiens
agaaaauaacaauaaa

SEQ ID NO: 985811 - RNA, 16 nt, Homo sapiens
agaaacugacacaugc

SEQ ID NO: 985812 - RNA, 15 nt, Homo sapiens
agaaauacuacugug

SEQ ID NO: 985813 - RNA, 15 nt, Homo sapiens
agaacaacuaccuga

SEQ ID NO: 985814 - RNA, 14 nt, Homo sapiens
agaaccacucauaa

SEQ ID NO: 985815 - RNA, 15 nt, Homo sapiens
agaacccuugcacua

SEQ ID NO: 985816 - RNA, 20 nt, Homo sapiens
agaacuagccaaaccaggac

SEQ ID NO: 985817 - RNA, 20 nt, Homo sapiens
agaacuucuccuacuguagc

SEQ ID NO: 985818 - RNA, 18 nt, Homo sapiens
agaauugugcaaccauca

SEQ ID NO: 985819 - RNA, 15 nt, Homo sapiens
agaauuuaaaccuau

SEQ ID NO: 985820 - RNA, 16 nt, Homo sapiens
agacaaguauggcucc

SEQ ID NO: 985821 - RNA, 14 nt, Homo sapiens
agacagagucuuac

SEQ ID NO: 985822 - RNA, 22 nt, Homo sapiens
agacagccaacuauggccugug

SEQ ID NO: 985823 - RNA, 14 nt, Homo sapiens
agacagcuucucau

SEQ ID NO: 985824 - RNA, 15 nt, Homo sapiens
agacagcuucucauc

SEQ ID NO: 985825 - RNA, 18 nt, Homo sapiens
agacaggguuucaccaug

SEQ ID NO: 985826 - RNA, 16 nt, Homo sapiens
agacaguauauaacua

SEQ ID NO: 985827 - RNA, 10 nt, Homo sapiens
agacagugaa

SEQ ID NO: 985828 - RNA, 13 nt, Homo sapiens
agacagugaaaga

SEQ ID NO: 985829 - RNA, 17 nt, Homo sapiens
agaccaccaagccuuga

SEQ ID NO: 985830 - RNA, 22 nt, Homo sapiens
agacuacauauugucacugaca

SEQ ID NO: 985831 - RNA, 13 nt, Homo sapiens
agacuagucucaa

SEQ ID NO: 985832 - RNA, 18 nt, Homo sapiens
agacuauucccuucuaac

SEQ ID NO: 985833 - RNA, 22 nt, Homo sapiens
agugcaguggcgcgaucucagc

SEQ ID NO: 985834 - RNA, 20 nt, Homo sapiens
agugcaguggcgugaucuca

SEQ ID NO: 985835 - RNA, 22 nt, Homo sapiens
agugcaguggcgugaucucagc

SEQ ID NO: 985836 - RNA, 16 nt, Homo sapiens
agugcccccaacagca

SEQ ID NO: 985837 - RNA, 15 nt, Homo sapiens
agugcuuucuucucc

SEQ ID NO: 985838 - RNA, 20 nt, Homo sapiens
aguggagaugggguuucacc

SEQ ID NO: 985839 - RNA, 15 nt, Homo sapiens
aguggcaucaucuca

SEQ ID NO: 985840 - RNA, 13 nt, Homo sapiens
aguuauuuuuaca

SEQ ID NO: 985841 - RNA, 22 nt, Homo sapiens
aguuccgacugccaucuuggac

SEQ ID NO: 985842 - RNA, 18 nt, Homo sapiens
aguugcugucauccacuu

SEQ ID NO: 985843 - RNA, 21 nt, Homo sapiens
aguuguuucuacuacauggaa

SEQ ID NO: 985844 - RNA, 21 nt, Homo sapiens
aguuuaauuuuugaaaacugg

SEQ ID NO: 985845 - RNA, 21 nt, Homo sapiens
aguuuuuuauuaugcauuaua

SEQ ID NO: 985846 - RNA, 13 nt, Homo sapiens
auaaaaaacacug

SEQ ID NO: 985847 - RNA, 16 nt, Homo sapiens
auaaaagcacuuacuu

SEQ ID NO: 985848 - RNA, 17 nt, Homo sapiens
auaaaagcacuuacuuc

SEQ ID NO: 985849 - RNA, 16 nt, Homo sapiens
auaaacugauuuaucu

SEQ ID NO: 985850 - RNA, 14 nt, Homo sapiens
auaaagcaaugugg

SEQ ID NO: 985851 - RNA, 17 nt, Homo sapiens
auaaagcaaugugguag

SEQ ID NO: 985852 - RNA, 19 nt, Homo sapiens
auaaaggaaacccagcuca

SEQ ID NO: 985853 - RNA, 20 nt, Homo sapiens
auaaaggggagggacucauc

SEQ ID NO: 985854 - RNA, 20 nt, Homo sapiens
auaaagguucaugcaaacuu

SEQ ID NO: 985855 - RNA, 13 nt, Homo sapiens
auaaagucuugcc

SEQ ID NO: 985856 - RNA, 15 nt, Homo sapiens
auaaaguuuguugaa

SEQ ID NO: 985857 - RNA, 14 nt, Homo sapiens
auuuaugagcucuu

SEQ ID NO: 985858 - RNA, 15 nt, Homo sapiens
auuuaugagcucuuc

SEQ ID NO: 985859 - RNA, 18 nt, Homo sapiens
auuuauuuaacuauucau

SEQ ID NO: 985860 - RNA, 21 nt, Homo sapiens
auuucuuuuuuaaaugaagaa

SEQ ID NO: 985861 - RNA, 15 nt, Homo sapiens
auuugauuugugcuc

SEQ ID NO: 985862 - RNA, 13 nt, Homo sapiens
auuugucaacaaa

SEQ ID NO: 985863 - RNA, 21 nt, Homo sapiens
auuugucaacaaagucaccca

SEQ ID NO: 985864 - RNA, 13 nt, Homo sapiens
auuugugugcauc

SEQ ID NO: 985865 - RNA, 18 nt, Homo sapiens
auuuguuaaagggccaaa

SEQ ID NO: 985866 - RNA, 21 nt, Homo sapiens
auuuuaccuuugacaaaggua

SEQ ID NO: 985867 - RNA, 21 nt, Homo sapiens
auuuuaguaagagauuccuga

SEQ ID NO: 985868 - RNA, 14 nt, Homo sapiens
auuuuauagcuacu

SEQ ID NO: 985869 - RNA, 14 nt, Homo sapiens
auuuucaguuauua

SEQ ID NO: 985870 - RNA, 19 nt, Homo sapiens
auuuucuacacauacaugu

SEQ ID NO: 985871 - RNA, 21 nt, Homo sapiens
auuuuguagaauaaggaacaa

SEQ ID NO: 985872 - RNA, 13 nt, Homo sapiens
auuuuuaccaguc

SEQ ID NO: 985873 - RNA, 23 nt, Homo sapiens
auuuuucacuucaaaacaguauu

SEQ ID NO: 985874 - RNA, 18 nt, Homo sapiens
auuuuuuccagucuuccu

SEQ ID NO: 985875 - RNA, 21 nt, Homo sapiens
caaaaaaaaaauuugccaaga

SEQ ID NO: 985876 - RNA, 13 nt, Homo sapiens
caaaaccaaauau

SEQ ID NO: 985877 - RNA, 19 nt, Homo sapiens
caaaaccaaauauuccaga

SEQ ID NO: 985878 - RNA, 20 nt, Homo sapiens
caaacguuaagaauuguuaa

SEQ ID NO: 985879 - RNA, 13 nt, Homo sapiens
caaacugagaucc

SEQ ID NO: 985880 - RNA, 12 nt, Homo sapiens
caaacugccuaa

SEQ ID NO: 985881 - RNA, 21 nt, Homo sapiens
caaacuggggccucccugguc

SEQ ID NO: 985882 - RNA, 21 nt, Homo sapiens
caaagaacuucuccuacugua

SEQ ID NO: 985883 - RNA, 22 nt, Homo sapiens
caaagaacuucuccuacuguag

SEQ ID NO: 985884 - RNA, 16 nt, Homo sapiens
caaagacuauucccuu

SEQ ID NO: 985885 - RNA, 16 nt, Homo sapiens
caaagaggcuacugua

SEQ ID NO: 985886 - RNA, 18 nt, Homo sapiens
caaagccuucauugccuu

SEQ ID NO: 985887 - RNA, 21 nt, Homo sapiens
caaaggcuuauuaauuugacu

SEQ ID NO: 985888 - RNA, 20 nt, Homo sapiens
caaaggucaagaacacagug

SEQ ID NO: 985889 - RNA, 18 nt, Homo sapiens
caaagugcuggcauuaca

SEQ ID NO: 985890 - RNA, 22 nt, Homo sapiens
caaauaaaggaaacccagcuca

SEQ ID NO: 985891 - RNA, 21 nt, Homo sapiens
caaauaauuuuucacuucaaa

SEQ ID NO: 985892 - RNA, 18 nt, Homo sapiens
caaauagaauuugagcau

SEQ ID NO: 985893 - RNA, 19 nt, Homo sapiens
caaauauaucugcuauucu

SEQ ID NO: 985894 - RNA, 21 nt, Homo sapiens
caaauauggggaaaaaacugu

SEQ ID NO: 985895 - RNA, 16 nt, Homo sapiens
caaauauuccagagac

SEQ ID NO: 985896 - RNA, 20 nt, Homo sapiens
caaaucagaccuggcugcuu

SEQ ID NO: 985897 - RNA, 17 nt, Homo sapiens
caaaugcaccaugucaa

SEQ ID NO: 985898 - RNA, 18 nt, Homo sapiens
caaauguaauugauuuau

SEQ ID NO: 985899 - RNA, 23 nt, Homo sapiens
caacaauccuucuauucuagccu

SEQ ID NO: 985900 - RNA, 16 nt, Homo sapiens
caacaugcacugaugu

SEQ ID NO: 985901 - RNA, 23 nt, Homo sapiens
caaccuuuucccaaccauacaaa

SEQ ID NO: 985902 - RNA, 11 nt, Homo sapiens
caacuaccuga

SEQ ID NO: 985903 - RNA, 19 nt, Homo sapiens
caagaaaauaagagcucag

SEQ ID NO: 985904 - RNA, 14 nt, Homo sapiens
caagaacacaguga

SEQ ID NO: 985905 - RNA, 22 nt, Homo sapiens
caagaccugauuucugagcauu

SEQ ID NO: 985906 - RNA, 17 nt, Homo sapiens
caagcccugcagucaca

SEQ ID NO: 985907 - RNA, 17 nt, Homo sapiens
caaggaugucugccaca

SEQ ID NO: 985908 - RNA, 17 nt, Homo sapiens
caaguagcugagacuac

SEQ ID NO: 985909 - RNA, 18 nt, Homo sapiens
caagucagcucuucucca

SEQ ID NO: 985910 - RNA, 17 nt, Homo sapiens
caaguuuuguggggcuu

SEQ ID NO: 985911 - RNA, 14 nt, Homo sapiens
caauaaagcaaugu

SEQ ID NO: 985912 - RNA, 15 nt, Homo sapiens
caauaaagcaaugug

SEQ ID NO: 985913 - RNA, 14 nt, Homo sapiens
caauaaagugcuuu

SEQ ID NO: 985914 - RNA, 19 nt, Homo sapiens
caauagauugggcacugug

SEQ ID NO: 985915 - RNA, 22 nt, Homo sapiens
caaugcagugccuuucuucucu

SEQ ID NO: 985916 - RNA, 21 nt, Homo sapiens
caauuaccacaccaucuccca

SEQ ID NO: 985917 - RNA, 12 nt, Homo sapiens
cacacaccacca

SEQ ID NO: 985918 - RNA, 17 nt, Homo sapiens
cacagaucacagcuuca

SEQ ID NO: 985919 - RNA, 15 nt, Homo sapiens
cacagcuaugaaggc

SEQ ID NO: 985920 - RNA, 24 nt, Homo sapiens
cacagcuaugaaggcuguacacug

SEQ ID NO: 985921 - RNA, 22 nt, Homo sapiens
cacauacccucacuuaaacuuu

SEQ ID NO: 985922 - RNA, 14 nt, Homo sapiens
cacaugggaucaag

SEQ ID NO: 985923 - RNA, 15 nt, Homo sapiens
cacauguaucuaugc

SEQ ID NO: 985924 - RNA, 20 nt, Homo sapiens
cacauuucccccuagccugc

SEQ ID NO: 985925 - RNA, 20 nt, Homo sapiens
caccauguacauagcuugau

SEQ ID NO: 985926 - RNA, 19 nt, Homo sapiens
cacccaaggaugucugcca

SEQ ID NO: 985927 - RNA, 18 nt, Homo sapiens
cacccagguuggagugca

SEQ ID NO: 985928 - RNA, 20 nt, Homo sapiens
cacccagguuggagugcagu

SEQ ID NO: 985929 - RNA, 16 nt, Homo sapiens
cacccaguugugacaa

SEQ ID NO: 985930 - RNA, 17 nt, Homo sapiens
cacccaguugugacaau

SEQ ID NO: 985931 - RNA, 17 nt, Homo sapiens
cacccucccacugccaa

SEQ ID NO: 985932 - RNA, 14 nt, Homo sapiens
cacccucuccagau

SEQ ID NO: 985933 - RNA, 17 nt, Homo sapiens
caccuacuuacaugcau

SEQ ID NO: 985934 - RNA, 18 nt, Homo sapiens
caccuacuuacaugcauu

SEQ ID NO: 985935 - RNA, 20 nt, Homo sapiens
caccucagagacauacaccu

SEQ ID NO: 985936 - RNA, 15 nt, Homo sapiens
caccugacucuugca

SEQ ID NO: 985937 - RNA, 19 nt, Homo sapiens
cacuacaagugauccucag

SEQ ID NO: 985938 - RNA, 22 nt, Homo sapiens
cacuagcccuccucucccagug

SEQ ID NO: 985939 - RNA, 14 nt, Homo sapiens
cacucacuacaggg

SEQ ID NO: 985940 - RNA, 13 nt, Homo sapiens
cacugauguauga

SEQ ID NO: 985941 - RNA, 15 nt, Homo sapiens
cacuggagaucacca

SEQ ID NO: 985942 - RNA, 19 nt, Homo sapiens
cacuggagaucaccagugu

SEQ ID NO: 985943 - RNA, 21 nt, Homo sapiens
cacuucccacuauugcuugca

SEQ ID NO: 985944 - RNA, 19 nt, Homo sapiens
cacuugggucuucccugua

SEQ ID NO: 985945 - RNA, 20 nt, Homo sapiens
cagaacuuaaggauggagcc

SEQ ID NO: 985946 - RNA, 22 nt, Homo sapiens
cagaagugcuuucuucucccaa

SEQ ID NO: 985947 - RNA, 19 nt, Homo sapiens
cagaaguuucuucuuuagg

SEQ ID NO: 985948 - RNA, 21 nt, Homo sapiens
cagaauuuaaaccuauacuca

SEQ ID NO: 985949 - RNA, 17 nt, Homo sapiens
cagacagaaaaaacuga

SEQ ID NO: 985950 - RNA, 18 nt, Homo sapiens
cagacauccucuaugcca

SEQ ID NO: 985951 - RNA, 20 nt, Homo sapiens
cagagcaagaccccaucuca

SEQ ID NO: 985952 - RNA, 19 nt, Homo sapiens
cagaggcucuaauguacaa

SEQ ID NO: 985953 - RNA, 20 nt, Homo sapiens
cagaggcucuaauguacaau

SEQ ID NO: 985954 - RNA, 15 nt, Homo sapiens
cagagggaucaagca

SEQ ID NO: 985955 - RNA, 16 nt, Homo sapiens
cagagucaaugaacuu

SEQ ID NO: 985956 - RNA, 12 nt, Homo sapiens
cagauaaagguu

SEQ ID NO: 985957 - RNA, 19 nt, Homo sapiens
cagauaaagguucaugcaa

SEQ ID NO: 985958 - RNA, 22 nt, Homo sapiens
cagauauacuugguucucucca

SEQ ID NO: 985959 - RNA, 16 nt, Homo sapiens
cagaucacagcuucag

SEQ ID NO: 985960 - RNA, 23 nt, Homo sapiens
cagaugagaguacaccccaacag

SEQ ID NO: 985961 - RNA, 12 nt, Homo sapiens
cagaugcacaug

SEQ ID NO: 985962 - RNA, 21 nt, Homo sapiens
cagauguucacccaaccacau

SEQ ID NO: 985963 - RNA, 16 nt, Homo sapiens
cagauucaugcacugu

SEQ ID NO: 985964 - RNA, 21 nt, Homo sapiens
cagauuugcaaaguuuaaugg

SEQ ID NO: 985965 - RNA, 19 nt, Homo sapiens
cagcacccucuccagauga

SEQ ID NO: 985966 - RNA, 12 nt, Homo sapiens
cucucucugugu

SEQ ID NO: 985967 - RNA, 19 nt, Homo sapiens
cucuggccuguacccagua

SEQ ID NO: 985968 - RNA, 19 nt, Homo sapiens
cucuguaacaguugcauug

SEQ ID NO: 985969 - RNA, 13 nt, Homo sapiens
cucugucuucuuu

SEQ ID NO: 985970 - RNA, 23 nt, Homo sapiens
cucuguguuacccaguaacucau

SEQ ID NO: 985971 - RNA, 15 nt, Homo sapiens
cucuguucauuuccu

SEQ ID NO: 985972 - RNA, 14 nt, Homo sapiens
cucuucuuacuggu

SEQ ID NO: 985973 - RNA, 19 nt, Homo sapiens
cucuugaaaaaugcauguu

SEQ ID NO: 985974 - RNA, 19 nt, Homo sapiens
cucuuguaauaaaaugucu

SEQ ID NO: 985975 - RNA, 21 nt, Homo sapiens
cucuuuccucuggggcauuau

SEQ ID NO: 985976 - RNA, 21 nt, Homo sapiens
cugaaacucauagacacugau

SEQ ID NO: 985977 - RNA, 21 nt, Homo sapiens
cugaaauggacuuuuguacau

SEQ ID NO: 985978 - RNA, 12 nt, Homo sapiens
cugaacugaugg

SEQ ID NO: 985979 - RNA, 22 nt, Homo sapiens
cugacuauucuugauguaaaau

SEQ ID NO: 985980 - RNA, 13 nt, Homo sapiens
cugacucuugcag

SEQ ID NO: 985981 - RNA, 13 nt, Homo sapiens
cugagauguagcc

SEQ ID NO: 985982 - RNA, 17 nt, Homo sapiens
cugagcaccuacuuaca

SEQ ID NO: 985983 - RNA, 18 nt, Homo sapiens
cugauauuggacaguaaa

SEQ ID NO: 985984 - RNA, 21 nt, Homo sapiens
cugauuauuuucuacacauac

SEQ ID NO: 985985 - RNA, 18 nt, Homo sapiens
cugcaaauguaauugauu

SEQ ID NO: 985986 - RNA, 15 nt, Homo sapiens
cugcaccaugcugcu

SEQ ID NO: 985987 - RNA, 20 nt, Homo sapiens
cugcaccaugcugcugggga

SEQ ID NO: 985988 - RNA, 19 nt, Homo sapiens
cugcagacucacuguggga

SEQ ID NO: 985989 - RNA, 16 nt, Homo sapiens
cugccccuacccugga

SEQ ID NO: 985990 - RNA, 12 nt, Homo sapiens
cugcuauaacua

SEQ ID NO: 985991 - RNA, 21 nt, Homo sapiens
cugcucugucuucuuugccca

SEQ ID NO: 985992 - RNA, 22 nt, Homo sapiens
cugcugagagacagagcuauuc

SEQ ID NO: 985993 - RNA, 19 nt, Homo sapiens
cugcugagugcaccacuuc

SEQ ID NO: 985994 - RNA, 16 nt, Homo sapiens
cuggaacugucucuca

SEQ ID NO: 985995 - RNA, 13 nt, Homo sapiens
cuggaaggcuucc

SEQ ID NO: 985996 - RNA, 14 nt, Homo sapiens
cuggagugcagugg

SEQ ID NO: 985997 - RNA, 15 nt, Homo sapiens
cuggauuuuuaccag

SEQ ID NO: 985998 - RNA, 22 nt, Homo sapiens
cuggcauuacaggugugagcca

SEQ ID NO: 985999 - RNA, 18 nt, Homo sapiens
cuggccuauguggucuaa

SEQ ID NO: 986000 - RNA, 19 nt, Homo sapiens
cuggcuacuccauguuggc

SEQ ID NO: 986001 - RNA, 15 nt, Homo sapiens
cugggauuacaggug

SEQ ID NO: 986002 - RNA, 14 nt, Homo sapiens
cugggcagaaggcc

SEQ ID NO: 986003 - RNA, 16 nt, Homo sapiens
cugggcagaaggccaa

SEQ ID NO: 986004 - RNA, 16 nt, Homo sapiens
cuggggaagacagugg

SEQ ID NO: 986005 - RNA, 19 nt, Homo sapiens
cuguaauguuaauauugau

SEQ ID NO: 986006 - RNA, 16 nt, Homo sapiens
cuguaugauuccuuga

SEQ ID NO: 986007 - RNA, 18 nt, Homo sapiens
cugucacauaaugcucau

SEQ ID NO: 986008 - RNA, 20 nt, Homo sapiens
cuguccugaccugucucacc

SEQ ID NO: 986009 - RNA, 17 nt, Homo sapiens
cugucucaccauguaca

SEQ ID NO: 986010 - RNA, 14 nt, Homo sapiens
cugucucaggguga

SEQ ID NO: 986011 - RNA, 18 nt, Homo sapiens
cugucucucaugaaccuc

SEQ ID NO: 986012 - RNA, 20 nt, Homo sapiens
cugucucucaugaaccucaa

SEQ ID NO: 986013 - RNA, 17 nt, Homo sapiens
cugucuucguacuggga

SEQ ID NO: 986014 - RNA, 17 nt, Homo sapiens
cugugaaaccccuaugu

SEQ ID NO: 986015 - RNA, 13 nt, Homo sapiens
cugugaucuugcu

SEQ ID NO: 986016 - RNA, 22 nt, Homo sapiens
cuguguaagggccagaaauauc

SEQ ID NO: 986017 - RNA, 11 nt, Homo sapiens
cuguguuaaaa

SEQ ID NO: 986018 - RNA, 18 nt, Homo sapiens
cuguuauuuaauuagcca

SEQ ID NO: 986019 - RNA, 22 nt, Homo sapiens
cuguucccaccaggcugcucag

SEQ ID NO: 986020 - RNA, 19 nt, Homo sapiens
cuuaaccagaucauuguga

SEQ ID NO: 986021 - RNA, 23 nt, Homo sapiens
cuuaaugaaguuugaauguuaaa

SEQ ID NO: 986022 - RNA, 22 nt, Homo sapiens
cuuacaauaauucuaugagaua

SEQ ID NO: 986023 - RNA, 15 nt, Homo sapiens
cuuacaugcauuacu

SEQ ID NO: 986024 - RNA, 16 nt, Homo sapiens
cuuaccuugcaucuca

SEQ ID NO: 986025 - RNA, 20 nt, Homo sapiens
cuuacuuauuaucuucagga

SEQ ID NO: 986026 - RNA, 20 nt, Homo sapiens
cuuauaauuuaaaauaugcu

SEQ ID NO: 986027 - RNA, 18 nt, Homo sapiens
cuuaucaacuaaugauuu

SEQ ID NO: 986028 - RNA, 14 nt, Homo sapiens
cuuauuaauuugac

SEQ ID NO: 986029 - RNA, 17 nt, Homo sapiens
cuucaagaaauuacugg

SEQ ID NO: 986030 - RNA, 14 nt, Homo sapiens
cuucaccuuaggaa

SEQ ID NO: 986031 - RNA, 13 nt, Homo sapiens
cuucagcaaguua

SEQ ID NO: 986032 - RNA, 12 nt, Homo sapiens
cuucagcacuuu

SEQ ID NO: 986033 - RNA, 17 nt, Homo sapiens
cuucagucuuuuccaug

SEQ ID NO: 986034 - RNA, 14 nt, Homo sapiens
cuucauugccuuaa

SEQ ID NO: 986035 - RNA, 14 nt, Homo sapiens
cuuccaucaccucc

SEQ ID NO: 986036 - RNA, 20 nt, Homo sapiens
cuucccaggaguacacccca

SEQ ID NO: 986037 - RNA, 22 nt, Homo sapiens
cuuccuuuuacuuuucuucuau

SEQ ID NO: 986038 - RNA, 18 nt, Homo sapiens
cuuccuuuugagggagca

SEQ ID NO: 986039 - RNA, 20 nt, Homo sapiens
cuucuaaccugaacugaugg

SEQ ID NO: 986040 - RNA, 19 nt, Homo sapiens
cuucuccccugcacuguaa

SEQ ID NO: 986041 - RNA, 21 nt, Homo sapiens
cuucugagccugccuuucucc

SEQ ID NO: 986042 - RNA, 23 nt, Homo sapiens
cuucugccagcauaauacuugcu

SEQ ID NO: 986043 - RNA, 23 nt, Homo sapiens
cuucugcuuucucgggaauuuuc

SEQ ID NO: 986044 - RNA, 15 nt, Homo sapiens
cuucuuacuggugcu

SEQ ID NO: 986045 - RNA, 17 nt, Homo sapiens
cuucuuuaggcauuaaa

SEQ ID NO: 986046 - RNA, 17 nt, Homo sapiens
cuucuuuuuguucuuca

SEQ ID NO: 986047 - RNA, 14 nt, Homo sapiens
cuugaagguggcua

SEQ ID NO: 986048 - RNA, 18 nt, Homo sapiens
cuugauggagauauuuac

SEQ ID NO: 986049 - RNA, 13 nt, Homo sapiens
cuugcacaaacca

SEQ ID NO: 986050 - RNA, 15 nt, Homo sapiens
cuugcauaaugguca

SEQ ID NO: 986051 - RNA, 14 nt, Homo sapiens
cuuggaaaggacca

SEQ ID NO: 986052 - RNA, 23 nt, Homo sapiens
cuuggacugaagggguucucaca

SEQ ID NO: 986053 - RNA, 20 nt, Homo sapiens
cuuuacaaauagaauuugag

SEQ ID NO: 986054 - RNA, 16 nt, Homo sapiens
cuuuagccaagugcag

SEQ ID NO: 986055 - RNA, 14 nt, Homo sapiens
cuuuaggcauuaaa

SEQ ID NO: 986056 - RNA, 22 nt, Homo sapiens
cuuuauagaucagccagugacc

SEQ ID NO: 986057 - RNA, 20 nt, Homo sapiens
cuuuauguuacuacaugcac

SEQ ID NO: 986058 - RNA, 21 nt, Homo sapiens
cuuuccgaggccccugucuca

SEQ ID NO: 986059 - RNA, 14 nt, Homo sapiens
cuuugccccugaga

SEQ ID NO: 986060 - RNA, 21 nt, Homo sapiens
cuuuuaggacccuucccuuga

SEQ ID NO: 986061 - RNA, 14 nt, Homo sapiens
cuuuucccaaccau

SEQ ID NO: 986062 - RNA, 21 nt, Homo sapiens
cuuuucucaccugucaucuca

SEQ ID NO: 986063 - RNA, 18 nt, Homo sapiens
cuuuuggcauuuuacugu

SEQ ID NO: 986064 - RNA, 17 nt, Homo sapiens
cuuuuuauuuagauugg

SEQ ID NO: 986065 - RNA, 22 nt, Homo sapiens
gaaaaaacugugccuuguuuca

SEQ ID NO: 986066 - RNA, 14 nt, Homo sapiens
gaaaacccagauaa

SEQ ID NO: 986067 - RNA, 23 nt, Homo sapiens
gaaaagcuccauuuuuagugaaa

SEQ ID NO: 986068 - RNA, 14 nt, Homo sapiens
gaaaaguugcuauu

SEQ ID NO: 986069 - RNA, 16 nt, Homo sapiens
gaaaaucucugugaaa

SEQ ID NO: 986070 - RNA, 22 nt, Homo sapiens
gaaacaauggcuaagauaccaa

SEQ ID NO: 986071 - RNA, 14 nt, Homo sapiens
gaaagauggaacuu

SEQ ID NO: 986072 - RNA, 12 nt, Homo sapiens
gaaagauuacuu

SEQ ID NO: 986073 - RNA, 15 nt, Homo sapiens
gaaauugaauuucca

SEQ ID NO: 986074 - RNA, 17 nt, Homo sapiens
gaacaucccuccuggga

SEQ ID NO: 986075 - RNA, 23 nt, Homo sapiens
gaacccugggacguggcuaguca

SEQ ID NO: 986076 - RNA, 14 nt, Homo sapiens
gaacccuugcacua

SEQ ID NO: 986077 - RNA, 22 nt, Homo sapiens
gaacuacugaggaucagaguaa

SEQ ID NO: 986078 - RNA, 12 nt, Homo sapiens
gaacucugagca

SEQ ID NO: 986079 - RNA, 18 nt, Homo sapiens
gaagagauuuuucaugau

SEQ ID NO: 986080 - RNA, 23 nt, Homo sapiens
gaagccacgguguucugugauau

SEQ ID NO: 986081 - RNA, 19 nt, Homo sapiens
gaaggaaaagauacccaaa

SEQ ID NO: 986082 - RNA, 19 nt, Homo sapiens
gaaucacugcucacacugc

SEQ ID NO: 986083 - RNA, 21 nt, Homo sapiens
gaaucagccuacaggccucac

SEQ ID NO: 986084 - RNA, 16 nt, Homo sapiens
gaauccccaacaugca

SEQ ID NO: 986085 - RNA, 18 nt, Homo sapiens
ucacccaaccacauccca

SEQ ID NO: 986086 - RNA, 18 nt, Homo sapiens
ucacccuguccaaacugc

SEQ ID NO: 986087 - RNA, 21 nt, Homo sapiens
ucaccucagagacauacaccu

SEQ ID NO: 986088 - RNA, 24 nt, Homo sapiens
ucaccuguuauaauaaauguaccu

SEQ ID NO: 986089 - RNA, 22 nt, Homo sapiens
ucacuaauucauuaaucugccu

SEQ ID NO: 986090 - RNA, 17 nt, Homo sapiens
ucacuaucuguaaugcc

SEQ ID NO: 986091 - RNA, 14 nt, Homo sapiens
ucacugcaaccucu

SEQ ID NO: 986092 - RNA, 18 nt, Homo sapiens
ucacuucaaaacaguauu

SEQ ID NO: 986093 - RNA, 11 nt, Homo sapiens
ucagacuauga

SEQ ID NO: 986094 - RNA, 17 nt, Homo sapiens
ucagacucuaagaaaga

SEQ ID NO: 986095 - RNA, 13 nt, Homo sapiens
ucagagacauaca

SEQ ID NO: 986096 - RNA, 18 nt, Homo sapiens
ucagagaccuuccagaaa

SEQ ID NO: 986097 - RNA, 14 nt, Homo sapiens
ucagauccuccuca

SEQ ID NO: 986098 - RNA, 22 nt, Homo sapiens
ucagcccugcaccaugcugcug

SEQ ID NO: 986099 - RNA, 23 nt, Homo sapiens
ucagccucccaagcaccugggau

SEQ ID NO: 986100 - RNA, 16 nt, Homo sapiens
ucagggagugggcuaa

SEQ ID NO: 986101 - RNA, 14 nt, Homo sapiens
ucagguauaccuca

SEQ ID NO: 986102 - RNA, 20 nt, Homo sapiens
ucagguauaccucacuuuac

SEQ ID NO: 986103 - RNA, 22 nt, Homo sapiens
ucagucugaugagaacucugag

SEQ ID NO: 986104 - RNA, 14 nt, Homo sapiens
ucagugaauugugu

SEQ ID NO: 986105 - RNA, 21 nt, Homo sapiens
ucauaacucugugaucuugcu

SEQ ID NO: 986106 - RNA, 13 nt, Homo sapiens
ucauaagauauuu

SEQ ID NO: 986107 - RNA, 15 nt, Homo sapiens
ucauacagauuugca

SEQ ID NO: 986108 - RNA, 13 nt, Homo sapiens
ucauacuuaucua

SEQ ID NO: 986109 - RNA, 12 nt, Homo sapiens
ucauagcuaaaa

SEQ ID NO: 986110 - RNA, 19 nt, Homo sapiens
ucauaugauguacauguac

SEQ ID NO: 986111 - RNA, 16 nt, Homo sapiens
ucauauuuucuuucaa

SEQ ID NO: 986112 - RNA, 20 nt, Homo sapiens
ucauccacguccugucuguu

SEQ ID NO: 986113 - RNA, 21 nt, Homo sapiens
ucauccucacucaguccagcu

SEQ ID NO: 986114 - RNA, 12 nt, Homo sapiens
ucaucucagcuc

SEQ ID NO: 986115 - RNA, 21 nt, Homo sapiens
ucaugauuuugaaaccaugaa

SEQ ID NO: 986116 - RNA, 20 nt, Homo sapiens
ucauuagaacuucaagcucu

SEQ ID NO: 986117 - RNA, 23 nt, Homo sapiens
ucauucaagucagcucuucucca

SEQ ID NO: 986118 - RNA, 21 nt, Homo sapiens
ucauuuccuccgucaccucag

SEQ ID NO: 986119 - RNA, 12 nt, Homo sapiens
ucauuucuagca

SEQ ID NO: 986120 - RNA, 18 nt, Homo sapiens
ucauuuuaacaucugaga

SEQ ID NO: 986121 - RNA, 19 nt, Homo sapiens
ucauuuuuuccagucuucc

SEQ ID NO: 986122 - RNA, 14 nt, Homo sapiens
uccaaacugccuaa

SEQ ID NO: 986123 - RNA, 22 nt, Homo sapiens
uccaaaggaggauggcauauaa

SEQ ID NO: 986124 - RNA, 15 nt, Homo sapiens
uccaagcaaauguga

SEQ ID NO: 986125 - RNA, 16 nt, Homo sapiens
uccacaccauucaggu

SEQ ID NO: 986126 - RNA, 15 nt, Homo sapiens
uccacagugacucca

SEQ ID NO: 986127 - RNA, 17 nt, Homo sapiens
uccacagugacuccacu

SEQ ID NO: 986128 - RNA, 13 nt, Homo sapiens
uccacagugccua

SEQ ID NO: 986129 - RNA, 19 nt, Homo sapiens
uccacuaggguccaccagg

SEQ ID NO: 986130 - RNA, 17 nt, Homo sapiens
uccacuuuaucuugaau

SEQ ID NO: 986131 - RNA, 19 nt, Homo sapiens
uccagaaauacuacugugu

SEQ ID NO: 986132 - RNA, 16 nt, Homo sapiens
uccagauggcaugugu

SEQ ID NO: 986133 - RNA, 19 nt, Homo sapiens
uccagcugcucugucuucu

SEQ ID NO: 986134 - RNA, 22 nt, Homo sapiens
uccaggcaggucugaagcucaa

SEQ ID NO: 986135 - RNA, 12 nt, Homo sapiens
uccagucuuccu

SEQ ID NO: 986136 - RNA, 14 nt, Homo sapiens
uccauacucuguaa

SEQ ID NO: 986137 - RNA, 17 nt, Homo sapiens
uccaucuuucacuaucu

SEQ ID NO: 986138 - RNA, 18 nt, Homo sapiens
uccaucuuucacuaucug

SEQ ID NO: 986139 - RNA, 17 nt, Homo sapiens
uccauuuuuagugaaau

SEQ ID NO: 986140 - RNA, 20 nt, Homo sapiens
ucccagcaugcugagauuac

SEQ ID NO: 986141 - RNA, 17 nt, Homo sapiens
ucccaggaguacacccc

SEQ ID NO: 986142 - RNA, 19 nt, Homo sapiens
ucccagugacaaccaaaag

SEQ ID NO: 986143 - RNA, 18 nt, Homo sapiens
ucccauucccccagugcg

SEQ ID NO: 986144 - RNA, 16 nt, Homo sapiens
uccccugcacuguaaa

SEQ ID NO: 986145 - RNA, 18 nt, Homo sapiens
uccccuggguucacagau

SEQ ID NO: 986146 - RNA, 15 nt, Homo sapiens
ucccuccacauuucc

SEQ ID NO: 986147 - RNA, 19 nt, Homo sapiens
ucccucucguaagauuucc

SEQ ID NO: 986148 - RNA, 16 nt, Homo sapiens
ucccuucuaaccugaa

SEQ ID NO: 986149 - RNA, 18 nt, Homo sapiens
ucccuuuuacguccaucu

SEQ ID NO: 986150 - RNA, 21 nt, Homo sapiens
uccgaggccccugucucaggg

SEQ ID NO: 986151 - RNA, 15 nt, Homo sapiens
uccgccauucucaag

SEQ ID NO: 986152 - RNA, 19 nt, Homo sapiens
uccuaagccaugggagaca

SEQ ID NO: 986153 - RNA, 19 nt, Homo sapiens
uccuaagcuggagugcagu

SEQ ID NO: 986154 - RNA, 22 nt, Homo sapiens
uccuaccacaaugcagugccuu

SEQ ID NO: 986155 - RNA, 17 nt, Homo sapiens
uccuauguuucacugug

SEQ ID NO: 986156 - RNA, 19 nt, Homo sapiens
uccucuggggcauuaucca

SEQ ID NO: 986157 - RNA, 16 nt, Homo sapiens
uccugggaaugaagca

SEQ ID NO: 986158 - RNA, 15 nt, Homo sapiens
uccugggaucacuga

SEQ ID NO: 986159 - RNA, 16 nt, Homo sapiens
uccuggggaacauaga

SEQ ID NO: 986160 - RNA, 23 nt, Homo sapiens
uccuggggaacauagaacucaug

SEQ ID NO: 986161 - RNA, 14 nt, Homo sapiens
uccuucagcacuuu

SEQ ID NO: 986162 - RNA, 11 nt, Homo sapiens
uccuuccucuc

SEQ ID NO: 986163 - RNA, 14 nt, Homo sapiens
uccuuuuuuauucc

SEQ ID NO: 986164 - RNA, 18 nt, Homo sapiens
ucgcccuacucaccugag

SEQ ID NO: 986165 - RNA, 21 nt, Homo sapiens
ucgcccuggacugugugcuca

SEQ ID NO: 986166 - RNA, 16 nt, Homo sapiens
ucgugagcucuuguga

SEQ ID NO: 986167 - RNA, 22 nt, Homo sapiens
ucuaaaaaaggaauccucugug

SEQ ID NO: 986168 - RNA, 14 nt, Homo sapiens
ucuaacaaauucca

SEQ ID NO: 986169 - RNA, 12 nt, Homo sapiens
ucuaccacccac

SEQ ID NO: 986170 - RNA, 20 nt, Homo sapiens
ucuacccaguagaugccacu

SEQ ID NO: 986171 - RNA, 15 nt, Homo sapiens
ucuaggugcuuuaac

SEQ ID NO: 986172 - RNA, 21 nt, Homo sapiens
ucuauuaccuguuaguauuau

SEQ ID NO: 986173 - RNA, 23 nt, Homo sapiens
ucucaaaaaaaaaaacaaacaaa

SEQ ID NO: 986174 - RNA, 14 nt, Homo sapiens
ucucaacuuugaua

SEQ ID NO: 986175 - RNA, 15 nt, Homo sapiens
ucucacaugauucca

SEQ ID NO: 986176 - RNA, 13 nt, Homo sapiens
ucucagcucacua

SEQ ID NO: 986177 - RNA, 20 nt, Homo sapiens
ucucagcucacugcaaccuc

SEQ ID NO: 986178 - RNA, 21 nt, Homo sapiens
ucucagcucacugcaaccucu

SEQ ID NO: 986179 - RNA, 18 nt, Homo sapiens
ucucauaacucugugauc

SEQ ID NO: 986180 - RNA, 15 nt, Homo sapiens
ucucaugaaccucaa

SEQ ID NO: 986181 - RNA, 17 nt, Homo sapiens
ucuccaacggcaaggga

SEQ ID NO: 986182 - RNA, 12 nt, Homo sapiens
ucuccagaugag

SEQ ID NO: 986183 - RNA, 14 nt, Homo sapiens
ucuccagugcaccu

SEQ ID NO: 986184 - RNA, 16 nt, Homo sapiens
ucuccauacucuguaa

SEQ ID NO: 986185 - RNA, 23 nt, Homo sapiens
ucucuaauauguaaaauuacacu

SEQ ID NO: 986186 - RNA, 17 nt, Homo sapiens
ucucugaauuugagaua

SEQ ID NO: 986187 - RNA, 18 nt, Homo sapiens
ucucuugccucaaccucc

SEQ ID NO: 986188 - RNA, 19 nt, Homo sapiens
ucugagaaaagcuuugaac

SEQ ID NO: 986189 - RNA, 18 nt, Homo sapiens
ucugagacagaaucucag

SEQ ID NO: 986190 - RNA, 13 nt, Homo sapiens
ucugagagcauca

SEQ ID NO: 986191 - RNA, 21 nt, Homo sapiens
ucugaggcuucuggggcuuca

SEQ ID NO: 986192 - RNA, 18 nt, Homo sapiens
ucugaguuccugcaugcc

SEQ ID NO: 986193 - RNA, 14 nt, Homo sapiens
ucugaguuuuacca

SEQ ID NO: 986194 - RNA, 11 nt, Homo sapiens
ucugcacggga

SEQ ID NO: 986195 - RNA, 18 nt, Homo sapiens
ucugccacaccucuccaa

SEQ ID NO: 986196 - RNA, 20 nt, Homo sapiens
ucugccuccccuucacuccc

SEQ ID NO: 986197 - RNA, 21 nt, Homo sapiens
ucugccuccccuucacuccca

SEQ ID NO: 986198 - RNA, 12 nt, Homo sapiens
ucuggagcccac

SEQ ID NO: 986199 - RNA, 21 nt, Homo sapiens
ucuggccuguacccaguagau

SEQ ID NO: 986200 - RNA, 22 nt, Homo sapiens
ucuggccuguacccaguagaug

SEQ ID NO: 986201 - RNA, 17 nt, Homo sapiens
ucuggggagcucaggaa

SEQ ID NO: 986202 - RNA, 16 nt, Homo sapiens
ucuguauuccuagaaa

SEQ ID NO: 986203 - RNA, 23 nt, Homo sapiens
ucuguauuuccccaacauguaau

SEQ ID NO: 986204 - RNA, 16 nt, Homo sapiens
ucugucaccaagccuu

SEQ ID NO: 986205 - RNA, 20 nt, Homo sapiens
acccagguuggagugcagug

SEQ ID NO: 986206 - RNA, 19 nt, Homo sapiens
acccaguagaugccacuag

SEQ ID NO: 986207 - RNA, 23 nt, Homo sapiens
acccaguguuuuaggagcaugag

SEQ ID NO: 986208 - RNA, 18 nt, Homo sapiens
acccaguugugacaauua

SEQ ID NO: 986209 - RNA, 13 nt, Homo sapiens
accccaacagcac

SEQ ID NO: 986210 - RNA, 15 nt, Homo sapiens
accccaacagcaccc

SEQ ID NO: 986211 - RNA, 19 nt, Homo sapiens
agccuuaaagauacuugaa

SEQ ID NO: 986212 - RNA, 23 nt, Homo sapiens
agccuugauugguguugccaguu

SEQ ID NO: 986213 - RNA, 19 nt, Homo sapiens
agccuuggggauucuucca

SEQ ID NO: 986214 - RNA, 15 nt, Homo sapiens
agcuacaggacauuu

SEQ ID NO: 986215 - RNA, 16 nt, Homo sapiens
agcuacaggacauuuu

SEQ ID NO: 986216 - RNA, 19 nt, Homo sapiens
agcuaccugcucagcccug

SEQ ID NO: 986217 - RNA, 22 nt, Homo sapiens
agcuauucuccauguacuggca

SEQ ID NO: 986218 - RNA, 17 nt, Homo sapiens
agcucacugcaaccucu

SEQ ID NO: 986219 - RNA, 17 nt, Homo sapiens
agcucauggacuucugc

SEQ ID NO: 986220 - RNA, 22 nt, Homo sapiens
agcucuucuccauccuaccaca

SEQ ID NO: 986221 - RNA, 19 nt, Homo sapiens
agcuggagggaccuugucu

SEQ ID NO: 986222 - RNA, 20 nt, Homo sapiens
agcuggagggaccuugucuc

SEQ ID NO: 986223 - RNA, 15 nt, Homo sapiens
agcugugcgugugug

SEQ ID NO: 986224 - RNA, 19 nt, Homo sapiens
agcuguuaauuugaguacu

SEQ ID NO: 986225 - RNA, 17 nt, Homo sapiens
agcuguugugugagguu

SEQ ID NO: 986226 - RNA, 14 nt, Homo sapiens
agcuucucaauuuc

SEQ ID NO: 986227 - RNA, 15 nt, Homo sapiens
agcuucucauccugc

SEQ ID NO: 986228 - RNA, 19 nt, Homo sapiens
agcuuggaaaggaccagua

SEQ ID NO: 986229 - RNA, 12 nt, Homo sapiens
aggaacuacuga

SEQ ID NO: 986230 - RNA, 21 nt, Homo sapiens
aggaauccucugugucuucaa

SEQ ID NO: 986231 - RNA, 14 nt, Homo sapiens
aggaauuguguuua

SEQ ID NO: 986232 - RNA, 12 nt, Homo sapiens
aggacuccuuaa

SEQ ID NO: 986233 - RNA, 19 nt, Homo sapiens
aggagggguuaaagcugcc

SEQ ID NO: 986234 - RNA, 23 nt, Homo sapiens
aggaggugcuaucgcaccacugu

SEQ ID NO: 986235 - RNA, 17 nt, Homo sapiens
aggauauccucccucca

SEQ ID NO: 986236 - RNA, 12 nt, Homo sapiens
aggauggucucc

SEQ ID NO: 986237 - RNA, 16 nt, Homo sapiens
aggcagccugccuuua

SEQ ID NO: 986238 - RNA, 21 nt, Homo sapiens
aggcagcuuuuucucucccac

SEQ ID NO: 986239 - RNA, 21 nt, Homo sapiens
aggcaggaacaaacagggcug

SEQ ID NO: 986240 - RNA, 22 nt, Homo sapiens
aggcagugacagcagucaggga

SEQ ID NO: 986241 - RNA, 20 nt, Homo sapiens
aggcauccuuccucacacca

SEQ ID NO: 986242 - RNA, 22 nt, Homo sapiens
aggcauuaaauuuuagcaaaga

SEQ ID NO: 986243 - RNA, 16 nt, Homo sapiens
aggccccugucucagg

SEQ ID NO: 986244 - RNA, 15 nt, Homo sapiens
aggccuagacucugu

SEQ ID NO: 986245 - RNA, 21 nt, Homo sapiens
aggcgaucacaacgugcauug

SEQ ID NO: 986246 - RNA, 20 nt, Homo sapiens
aggcgugagccaccaugccc

SEQ ID NO: 986247 - RNA, 19 nt, Homo sapiens
aggcucuaauguacaauaa

SEQ ID NO: 986248 - RNA, 16 nt, Homo sapiens
aggcucucuugugcau

SEQ ID NO: 986249 - RNA, 16 nt, Homo sapiens
aggcuguacacugcac

SEQ ID NO: 986250 - RNA, 15 nt, Homo sapiens
aggcuucuggggcuu

SEQ ID NO: 986251 - RNA, 18 nt, Homo sapiens
agggaacaaguacuucuu

SEQ ID NO: 986252 - RNA, 18 nt, Homo sapiens
agggagugcacauaucca

SEQ ID NO: 986253 - RNA, 19 nt, Homo sapiens
agggauuuucagcccucag

SEQ ID NO: 986254 - RNA, 13 nt, Homo sapiens
agggccagaaaua

SEQ ID NO: 986255 - RNA, 19 nt, Homo sapiens
agggcuuggacucaagcaa

SEQ ID NO: 986256 - RNA, 21 nt, Homo sapiens
aggguaggcucaaaacagggu

SEQ ID NO: 986257 - RNA, 14 nt, Homo sapiens
agguaaaacagggc

SEQ ID NO: 986258 - RNA, 22 nt, Homo sapiens
agguaaccccagauucaugcac

SEQ ID NO: 986259 - RNA, 14 nt, Homo sapiens
agguagacaguaua

SEQ ID NO: 986260 - RNA, 21 nt, Homo sapiens
agguccuuaggccucugagaa

SEQ ID NO: 986261 - RNA, 17 nt, Homo sapiens
aggucuaggugcuuuaa

SEQ ID NO: 986262 - RNA, 14 nt, Homo sapiens
aggugugggccaga

SEQ ID NO: 986263 - RNA, 15 nt, Homo sapiens
agguucagccugaaa

SEQ ID NO: 986264 - RNA, 18 nt, Homo sapiens
aguaaaaagaaauauacc

SEQ ID NO: 986265 - RNA, 16 nt, Homo sapiens
aguacaccccaacagc

SEQ ID NO: 986266 - RNA, 15 nt, Homo sapiens
aguagaaaggccuuu

SEQ ID NO: 986267 - RNA, 12 nt, Homo sapiens
aguagauaagga

SEQ ID NO: 986268 - RNA, 22 nt, Homo sapiens
agucccaaagaggcuacuguaa

SEQ ID NO: 986269 - RNA, 22 nt, Homo sapiens
agucucuacccaguagaugcca

SEQ ID NO: 986270 - RNA, 19 nt, Homo sapiens
agucugaugagaacucuga

SEQ ID NO: 986271 - RNA, 21 nt, Homo sapiens
agucugcuacccucauuucuc

SEQ ID NO: 986272 - RNA, 22 nt, Homo sapiens
agucugcuacccucauuucuca

SEQ ID NO: 986273 - RNA, 15 nt, Homo sapiens
agucuuauuuauuca

SEQ ID NO: 986274 - RNA, 16 nt, Homo sapiens
agucuugccuugcuga

SEQ ID NO: 986275 - RNA, 19 nt, Homo sapiens
agugaacauucgaccucca

SEQ ID NO: 986276 - RNA, 14 nt, Homo sapiens
agugaaggauuuau

SEQ ID NO: 986277 - RNA, 15 nt, Homo sapiens
agugacaaccaaaag

SEQ ID NO: 986278 - RNA, 18 nt, Homo sapiens
agugacagcagucaggga

SEQ ID NO: 986279 - RNA, 17 nt, Homo sapiens
agugagcuccuaagcca

SEQ ID NO: 986280 - RNA, 23 nt, Homo sapiens
agugauuuuauuagaaguuucau

SEQ ID NO: 986281 - RNA, 18 nt, Homo sapiens
agugcaguggcaucaucu

SEQ ID NO: 986282 - RNA, 20 nt, Homo sapiens
agugcaguggcaucaucuca

SEQ ID NO: 986283 - RNA, 20 nt, Homo sapiens
agugcaguggcgcgaucuca

SEQ ID NO: 986284 - RNA, 23 nt, Homo sapiens
agugcaguggcgcgaucucagcu

SEQ ID NO: 986285 - RNA, 23 nt, Homo sapiens
agugcaguggcgugaucucagcu

SEQ ID NO: 986286 - RNA, 21 nt, Homo sapiens
agugcauuuaugagcucuuca

SEQ ID NO: 986287 - RNA, 21 nt, Homo sapiens
agugcuguauaaaaucagcca

SEQ ID NO: 986288 - RNA, 21 nt, Homo sapiens
agugcugucuuuuugugggua

SEQ ID NO: 986289 - RNA, 15 nt, Homo sapiens
agugcuucuccagcc

SEQ ID NO: 986290 - RNA, 18 nt, Homo sapiens
aguggaaauuaagacuuu

SEQ ID NO: 986291 - RNA, 18 nt, Homo sapiens
aguggcaucaucucagcu

SEQ ID NO: 986292 - RNA, 20 nt, Homo sapiens
aguggcgcgaucucagcuca

SEQ ID NO: 986293 - RNA, 20 nt, Homo sapiens
aguggcgcgaucucggcuca

SEQ ID NO: 986294 - RNA, 20 nt, Homo sapiens
agugucaggaggaaggcuua

SEQ ID NO: 986295 - RNA, 14 nt, Homo sapiens
aguucccucuugcu

SEQ ID NO: 986296 - RNA, 15 nt, Homo sapiens
aguuccgacugccau

SEQ ID NO: 986297 - RNA, 17 nt, Homo sapiens
aguucggugagcuacaa

SEQ ID NO: 986298 - RNA, 19 nt, Homo sapiens
aguugcauugacugucaca

SEQ ID NO: 986299 - RNA, 15 nt, Homo sapiens
aguugggugauaugu

SEQ ID NO: 986300 - RNA, 18 nt, Homo sapiens
aguuucugaguuuuacca

SEQ ID NO: 986301 - RNA, 19 nt, Homo sapiens
aguuucuucuuuaggcauu

SEQ ID NO: 986302 - RNA, 16 nt, Homo sapiens
aguuugguuucuagca

SEQ ID NO: 986303 - RNA, 15 nt, Homo sapiens
auaaaaagcauuauu

SEQ ID NO: 986304 - RNA, 15 nt, Homo sapiens
auaaaagacagugaa

SEQ ID NO: 986305 - RNA, 15 nt, Homo sapiens
auaaacacucuugaa

SEQ ID NO: 986306 - RNA, 12 nt, Homo sapiens
auaaagguucau

SEQ ID NO: 986307 - RNA, 13 nt, Homo sapiens
auaaaguauuuaa

SEQ ID NO: 986308 - RNA, 18 nt, Homo sapiens
auaaaugugguacaagca

SEQ ID NO: 986309 - RNA, 21 nt, Homo sapiens
auaaauuauaucaauuuccuc

SEQ ID NO: 986310 - RNA, 11 nt, Homo sapiens
auaacucugug

SEQ ID NO: 986311 - RNA, 23 nt, Homo sapiens
auaaguauuuaauucauguugcc

SEQ ID NO: 986312 - RNA, 21 nt, Homo sapiens
auaaucauucuuauuucauga

SEQ ID NO: 986313 - RNA, 21 nt, Homo sapiens
auaauccuaaacauaugaauu

SEQ ID NO: 986314 - RNA, 17 nt, Homo sapiens
auaaugucccuucacaa

SEQ ID NO: 986315 - RNA, 23 nt, Homo sapiens
auacaaaaauuccuuuucccgaa

SEQ ID NO: 986316 - RNA, 13 nt, Homo sapiens
auacagaauuuua

SEQ ID NO: 986317 - RNA, 21 nt, Homo sapiens
auacaggaugaugacuaugga

SEQ ID NO: 986318 - RNA, 18 nt, Homo sapiens
auacaugcuuuuuaauga

SEQ ID NO: 986319 - RNA, 17 nt, Homo sapiens
auaccugauauauucca

SEQ ID NO: 986320 - RNA, 17 nt, Homo sapiens
auaccugggauacugug

SEQ ID NO: 986321 - RNA, 15 nt, Homo sapiens
auaccuuccccacau

SEQ ID NO: 986322 - RNA, 19 nt, Homo sapiens
auaccuuccccacaucuga

SEQ ID NO: 986323 - RNA, 22 nt, Homo sapiens
auacugugugcuaaaacaagca

SEQ ID NO: 986324 - RNA, 22 nt, Homo sapiens
auacuugguucucuccaccagg

SEQ ID NO: 986325 - RNA, 19 nt, Homo sapiens
auagaauuauaacuggaaa

SEQ ID NO: 986326 - RNA, 17 nt, Homo sapiens
auagauaggucagugca

SEQ ID NO: 986327 - RNA, 18 nt, Homo sapiens
auaggaggccaacccaaa

SEQ ID NO: 986328 - RNA, 14 nt, Homo sapiens
auaguccgucucug

SEQ ID NO: 986329 - RNA, 20 nt, Homo sapiens
auaguccgucucugcuuauc

SEQ ID NO: 986330 - RNA, 16 nt, Homo sapiens
auagugggacccuguc

SEQ ID NO: 986331 - RNA, 15 nt, Homo sapiens
auaguugcugucauc

SEQ ID NO: 986332 - RNA, 21 nt, Homo sapiens
auaguugcugucauccacuuu

SEQ ID NO: 986333 - RNA, 19 nt, Homo sapiens
auauacauacaugcauaca

SEQ ID NO: 986334 - RNA, 19 nt, Homo sapiens
auauacuugguucucucca

SEQ ID NO: 986335 - RNA, 18 nt, Homo sapiens
auaucaaaucuaccacug

SEQ ID NO: 986336 - RNA, 23 nt, Homo sapiens
auauccagauggcauguguuuac

SEQ ID NO: 986337 - RNA, 17 nt, Homo sapiens
auaugcucugauuuauc

SEQ ID NO: 986338 - RNA, 13 nt, Homo sapiens
auauggcuugagu

SEQ ID NO: 986339 - RNA, 17 nt, Homo sapiens
auauggcuugaguuuaa

SEQ ID NO: 986340 - RNA, 15 nt, Homo sapiens
aagcaguugagacaa

SEQ ID NO: 986341 - RNA, 21 nt, Homo sapiens
aagccacgguguucugugaua

SEQ ID NO: 986342 - RNA, 18 nt, Homo sapiens
aagcucaacucucuuauu

SEQ ID NO: 986343 - RNA, 14 nt, Homo sapiens
aagcugccauauau

SEQ ID NO: 986344 - RNA, 15 nt, Homo sapiens
aagcuggagugcagu

SEQ ID NO: 986345 - RNA, 16 nt, Homo sapiens
aagcuggagugcagug

SEQ ID NO: 986346 - RNA, 24 nt, Homo sapiens
aaggaaagaaaauaaaucuaucaa

SEQ ID NO: 986347 - RNA, 21 nt, Homo sapiens
aaggacuuuauagaucagcca

SEQ ID NO: 986348 - RNA, 20 nt, Homo sapiens
aaggauaaugaauacuuuau

SEQ ID NO: 986349 - RNA, 23 nt, Homo sapiens
aaggauggagccagcucugcauu

SEQ ID NO: 986350 - RNA, 14 nt, Homo sapiens
acgcuuucaugaau

SEQ ID NO: 986351 - RNA, 19 nt, Homo sapiens
acgggaauucagacaagcu

SEQ ID NO: 986352 - RNA, 20 nt, Homo sapiens
acuaaagaaggugugggcca

SEQ ID NO: 986353 - RNA, 21 nt, Homo sapiens
acuaacuccuaggaaaauacu

SEQ ID NO: 986354 - RNA, 19 nt, Homo sapiens
acuacaagugauccucagg

SEQ ID NO: 986355 - RNA, 13 nt, Homo sapiens
acuacaugcacuu

SEQ ID NO: 986356 - RNA, 21 nt, Homo sapiens
acuacaugcacuuggcugcau

SEQ ID NO: 986357 - RNA, 15 nt, Homo sapiens
acuagacaaguccag

SEQ ID NO: 986358 - RNA, 23 nt, Homo sapiens
acuauuaacaacuugucuauuac

SEQ ID NO: 986359 - RNA, 14 nt, Homo sapiens
acuauucauaagau

SEQ ID NO: 986360 - RNA, 14 nt, Homo sapiens
acucacugugggaa

SEQ ID NO: 986361 - RNA, 18 nt, Homo sapiens
acucacuuucuagauuaa

SEQ ID NO: 986362 - RNA, 17 nt, Homo sapiens
acucagagaaacaaugg

SEQ ID NO: 986363 - RNA, 18 nt, Homo sapiens
acucagaggcagugacag

SEQ ID NO: 986364 - RNA, 20 nt, Homo sapiens
acucagauccuccucauuca

SEQ ID NO: 986365 - RNA, 21 nt, Homo sapiens
acucaucugucaccaagccuu

SEQ ID NO: 986366 - RNA, 17 nt, Homo sapiens
acuccuccuaguacuaa

SEQ ID NO: 986367 - RNA, 15 nt, Homo sapiens
acucugucuaccugg

SEQ ID NO: 986368 - RNA, 17 nt, Homo sapiens
acucugugaucuugcuc

SEQ ID NO: 986369 - RNA, 17 nt, Homo sapiens
acugaagggguucucac

SEQ ID NO: 986370 - RNA, 14 nt, Homo sapiens
acugacacaugcug

SEQ ID NO: 986371 - RNA, 14 nt, Homo sapiens
acugauuuaucuau

SEQ ID NO: 986372 - RNA, 15 nt, Homo sapiens
acugcaaccucugcc

SEQ ID NO: 986373 - RNA, 17 nt, Homo sapiens
acugcagccuccagaga

SEQ ID NO: 986374 - RNA, 18 nt, Homo sapiens
acugcaugcacuucuuac

SEQ ID NO: 986375 - RNA, 19 nt, Homo sapiens
acugcucacacugcugaug

SEQ ID NO: 986376 - RNA, 15 nt, Homo sapiens
acugcuccagaguug

SEQ ID NO: 986377 - RNA, 19 nt, Homo sapiens
acugcuccagaguugguga

SEQ ID NO: 986378 - RNA, 18 nt, Homo sapiens
acugcucuguguuuacag

SEQ ID NO: 986379 - RNA, 21 nt, Homo sapiens
acuggcacagagguagucuca

SEQ ID NO: 986380 - RNA, 14 nt, Homo sapiens
acuggcugauggag

SEQ ID NO: 986381 - RNA, 19 nt, Homo sapiens
acugguaggaaacuaggug

SEQ ID NO: 986382 - RNA, 15 nt, Homo sapiens
acuguaaggcaauca

SEQ ID NO: 986383 - RNA, 21 nt, Homo sapiens
acuguagcaaccugaaauuaa

SEQ ID NO: 986384 - RNA, 19 nt, Homo sapiens
acuguguaagggccagaaa

SEQ ID NO: 986385 - RNA, 17 nt, Homo sapiens
acuuaccuugcaucuca

SEQ ID NO: 986386 - RNA, 15 nt, Homo sapiens
acuuccuugcuuaag

SEQ ID NO: 986387 - RNA, 19 nt, Homo sapiens
acuugcuuuuaaaauccac

SEQ ID NO: 986388 - RNA, 22 nt, Homo sapiens
acuuuauagaucagccagugac

SEQ ID NO: 986389 - RNA, 14 nt, Homo sapiens
acuuuaucuugaau

SEQ ID NO: 986390 - RNA, 23 nt, Homo sapiens
acuuuauguuacuacaugcacuu

SEQ ID NO: 986391 - RNA, 13 nt, Homo sapiens
acuuuuaucacug

SEQ ID NO: 986392 - RNA, 14 nt, Homo sapiens
acuuuuccuuugaa

SEQ ID NO: 986393 - RNA, 20 nt, Homo sapiens
agaaaauaacaauaaaagac

SEQ ID NO: 986394 - RNA, 20 nt, Homo sapiens
agaaaauaacgauaaaagac

SEQ ID NO: 986395 - RNA, 19 nt, Homo sapiens
agaaaauaagagcucagga

SEQ ID NO: 986396 - RNA, 12 nt, Homo sapiens
agaaacugacac

SEQ ID NO: 986397 - RNA, 14 nt, Homo sapiens
agaaaggccuuuaa

SEQ ID NO: 986398 - RNA, 13 nt, Homo sapiens
agaaaugucaugu

SEQ ID NO: 986399 - RNA, 16 nt, Homo sapiens
agaaauuuauaaacuu

SEQ ID NO: 986400 - RNA, 20 nt, Homo sapiens
agaaccccaggacgcccuca

SEQ ID NO: 986401 - RNA, 19 nt, Homo sapiens
agaagauugagauguguuc

SEQ ID NO: 986402 - RNA, 20 nt, Homo sapiens
agaauaaaauuuuuaaucuu

SEQ ID NO: 986403 - RNA, 18 nt, Homo sapiens
agaauaaggaacaacguu

SEQ ID NO: 986404 - RNA, 22 nt, Homo sapiens
agaauggaaagcuucagugcug

SEQ ID NO: 986405 - RNA, 21 nt, Homo sapiens
agaauuauuuugugaugcaaa

SEQ ID NO: 986406 - RNA, 16 nt, Homo sapiens
agacaagcugcauuuc

SEQ ID NO: 986407 - RNA, 14 nt, Homo sapiens
agacaguauauaac

SEQ ID NO: 986408 - RNA, 22 nt, Homo sapiens
agacccuuauugcuguccugga

SEQ ID NO: 986409 - RNA, 21 nt, Homo sapiens
agacgagguuucacuguguug

SEQ ID NO: 986410 - RNA, 12 nt, Homo sapiens
agacucacugug

SEQ ID NO: 986411 - RNA, 15 nt, Homo sapiens
agacucacuguggga

SEQ ID NO: 986412 - RNA, 20 nt, Homo sapiens
agacugcaaacccuuucaua

SEQ ID NO: 986413 - RNA, 19 nt, Homo sapiens
agacuuuuaugauacuuga

SEQ ID NO: 986414 - RNA, 15 nt, Homo sapiens
agagaugacagggaa

SEQ ID NO: 986415 - RNA, 19 nt, Homo sapiens
agagcaagaccccaucuca

SEQ ID NO: 986416 - RNA, 17 nt, Homo sapiens
agagcacgccuguacua

SEQ ID NO: 986417 - RNA, 22 nt, Homo sapiens
agagcaguuugguuucuagcau

SEQ ID NO: 986418 - RNA, 18 nt, Homo sapiens
agagccccacccucagau

SEQ ID NO: 986419 - RNA, 16 nt, Homo sapiens
agaggcaccuguccca

SEQ ID NO: 986420 - RNA, 14 nt, Homo sapiens
agaggcagugacag

SEQ ID NO: 986421 - RNA, 14 nt, Homo sapiens
agaggcuacuguaa

SEQ ID NO: 986422 - RNA, 19 nt, Homo sapiens
agaggcucuaauguacaau

SEQ ID NO: 986423 - RNA, 15 nt, Homo sapiens
agaggcuuccuucau

SEQ ID NO: 986424 - RNA, 20 nt, Homo sapiens
agaggcuuccuucauuuccu

SEQ ID NO: 986425 - RNA, 16 nt, Homo sapiens
agagugaaggauuuau

SEQ ID NO: 986426 - RNA, 14 nt, Homo sapiens
agaucagccaguga

SEQ ID NO: 986427 - RNA, 15 nt, Homo sapiens
agaucauugugaaau

SEQ ID NO: 986428 - RNA, 19 nt, Homo sapiens
agaucuuuuauuuugccaa

SEQ ID NO: 986429 - RNA, 15 nt, Homo sapiens
agaugacagggaaaa

SEQ ID NO: 986430 - RNA, 19 nt, Homo sapiens
agaugacagggaaaacugc

SEQ ID NO: 986431 - RNA, 15 nt, Homo sapiens
agaugagaguacacc

SEQ ID NO: 986432 - RNA, 23 nt, Homo sapiens
agaugucgcccuacucaccugag

SEQ ID NO: 986433 - RNA, 18 nt, Homo sapiens
agauguucacccaaccac

SEQ ID NO: 986434 - RNA, 14 nt, Homo sapiens
agauugucagcucc

SEQ ID NO: 986435 - RNA, 17 nt, Homo sapiens
agauugugucccauucc

SEQ ID NO: 986436 - RNA, 13 nt, Homo sapiens
agcaaaaccaaau

SEQ ID NO: 986437 - RNA, 13 nt, Homo sapiens
agcaaugugguag

SEQ ID NO: 986438 - RNA, 19 nt, Homo sapiens
agcaccuacuuacaugcau

SEQ ID NO: 986439 - RNA, 20 nt, Homo sapiens
agcagaagagaaaauguugu

SEQ ID NO: 986440 - RNA, 15 nt, Homo sapiens
agcagcugcagcuca

SEQ ID NO: 986441 - RNA, 16 nt, Homo sapiens
agcagguaggaggcaa

SEQ ID NO: 986442 - RNA, 12 nt, Homo sapiens
agcauaauacuu

SEQ ID NO: 986443 - RNA, 15 nt, Homo sapiens
agcauaauacuugcu

SEQ ID NO: 986444 - RNA, 14 nt, Homo sapiens
agcauccucuuuaa

SEQ ID NO: 986445 - RNA, 13 nt, Homo sapiens
agccaagugcagg

SEQ ID NO: 986446 - RNA, 21 nt, Homo sapiens
agccacuacauuacuucaaac

SEQ ID NO: 986447 - RNA, 18 nt, Homo sapiens
agccagaggcucuaaugu

SEQ ID NO: 986448 - RNA, 20 nt, Homo sapiens
agcccuaggcuuccacguac

SEQ ID NO: 986449 - RNA, 15 nt, Homo sapiens
agcccuccucuccca

SEQ ID NO: 986450 - RNA, 20 nt, Homo sapiens
agcccuggccucugcucaac

SEQ ID NO: 986451 - RNA, 14 nt, Homo sapiens
agcccuuuacuuga

SEQ ID NO: 986452 - RNA, 19 nt, Homo sapiens
agccucccaaguagcugag

SEQ ID NO: 986453 - RNA, 20 nt, Homo sapiens
agccucugguaaccucuuac

SEQ ID NO: 986454 - RNA, 18 nt, Homo sapiens
agccugcagacucacugu

SEQ ID NO: 986455 - RNA, 12 nt, Homo sapiens
agccugcauuga

SEQ ID NO: 986456 - RNA, 12 nt, Homo sapiens
agccugccuccc

SEQ ID NO: 986457 - RNA, 12 nt, Homo sapiens
agccugcucccu

SEQ ID NO: 986458 - RNA, 14 nt, Homo sapiens
agccugcucccuag

SEQ ID NO: 986459 - RNA, 20 nt, Homo sapiens
agccuucucuguucauuucc

SEQ ID NO: 986460 - RNA, 22 nt, Homo sapiens
agccuucucuguucauuuccuc

SEQ ID NO: 986461 - RNA, 15 nt, Homo sapiens
agcgauuaauaacag

SEQ ID NO: 986462 - RNA, 12 nt, Homo sapiens
agcuaugaaggc

SEQ ID NO: 986463 - RNA, 18 nt, Homo sapiens
agcuaugaaggcuguaca

SEQ ID NO: 986464 - RNA, 22 nt, Homo sapiens
agcuaugaaggcuguacacugc

SEQ ID NO: 986465 - RNA, 22 nt, Homo sapiens
agcugagacuacaggcacacac

SEQ ID NO: 986466 - RNA, 13 nt, Homo sapiens
agcugcauuucag

SEQ ID NO: 986467 - RNA, 17 nt, Homo sapiens
agcugcuguggccauca

SEQ ID NO: 986468 - RNA, 15 nt, Homo sapiens
agcuuaagaaccauu

SEQ ID NO: 986469 - RNA, 18 nt, Homo sapiens
agcuuaagaaccauugau

SEQ ID NO: 986470 - RNA, 15 nt, Homo sapiens
aggaaagcauguauu

SEQ ID NO: 986471 - RNA, 15 nt, Homo sapiens
aggaacaaacagggc

SEQ ID NO: 986472 - RNA, 17 nt, Homo sapiens
aggaauccccaacaugc

SEQ ID NO: 986473 - RNA, 16 nt, Homo sapiens
aggaauuguguuuaua

SEQ ID NO: 986474 - RNA, 22 nt, Homo sapiens
aggaggugcuaucgcaccacug

SEQ ID NO: 986475 - RNA, 20 nt, Homo sapiens
aggaguacaccccaacagca

SEQ ID NO: 986476 - RNA, 17 nt, Homo sapiens
aggaucauuugagccca

SEQ ID NO: 986477 - RNA, 22 nt, Homo sapiens
aggaugagggaaaagaaaaaga

SEQ ID NO: 986478 - RNA, 11 nt, Homo sapiens
aggauggcgca

SEQ ID NO: 986479 - RNA, 13 nt, Homo sapiens
aggcaaucugccc

SEQ ID NO: 986480 - RNA, 18 nt, Homo sapiens
aggcaggucugaagcuca

SEQ ID NO: 986481 - RNA, 13 nt, Homo sapiens
caccauguuggcu

SEQ ID NO: 986482 - RNA, 19 nt, Homo sapiens
cacccagguuggagugcag

SEQ ID NO: 986483 - RNA, 16 nt, Homo sapiens
caccuaugucauuuca

SEQ ID NO: 986484 - RNA, 17 nt, Homo sapiens
caccuaugucauuucau

SEQ ID NO: 986485 - RNA, 17 nt, Homo sapiens
caccuccuggguucaag

SEQ ID NO: 986486 - RNA, 13 nt, Homo sapiens
caccuuuuacucu

SEQ ID NO: 986487 - RNA, 16 nt, Homo sapiens
cacgccuguaauccca

SEQ ID NO: 986488 - RNA, 21 nt, Homo sapiens
cacuaauucauuaaucugccu

SEQ ID NO: 986489 - RNA, 20 nt, Homo sapiens
cacucaaugguuaacuaauu

SEQ ID NO: 986490 - RNA, 16 nt, Homo sapiens
cacucucaaagcaaau

SEQ ID NO: 986491 - RNA, 21 nt, Homo sapiens
cacucuugaaaaaugcauguu

SEQ ID NO: 986492 - RNA, 14 nt, Homo sapiens
cacuggaaaguuua

SEQ ID NO: 986493 - RNA, 11 nt, Homo sapiens
cacugugcaaa

SEQ ID NO: 986494 - RNA, 18 nt, Homo sapiens
cacugugggacugggaca

SEQ ID NO: 986495 - RNA, 13 nt, Homo sapiens
cacuucagccucc

SEQ ID NO: 986496 - RNA, 16 nt, Homo sapiens
cacuuccaagagccuu

SEQ ID NO: 986497 - RNA, 21 nt, Homo sapiens
cacuucuuacaauaauucuau

SEQ ID NO: 986498 - RNA, 16 nt, Homo sapiens
cacuuuaucuugaaua

SEQ ID NO: 986499 - RNA, 21 nt, Homo sapiens
cagaaauaucuucacuuguca

SEQ ID NO: 986500 - RNA, 17 nt, Homo sapiens
cagaaaugucauguggc

SEQ ID NO: 986501 - RNA, 14 nt, Homo sapiens
cagacagaaaaaac

SEQ ID NO: 986502 - RNA, 13 nt, Homo sapiens
cagacucacugug

SEQ ID NO: 986503 - RNA, 14 nt, Homo sapiens
cagacucacugugg

SEQ ID NO: 986504 - RNA, 15 nt, Homo sapiens
cagacucacuguggg

SEQ ID NO: 986505 - RNA, 20 nt, Homo sapiens
cagacuggauaguccgucuc

SEQ ID NO: 986506 - RNA, 21 nt, Homo sapiens
cagagaagggcuuggacucaa

SEQ ID NO: 986507 - RNA, 14 nt, Homo sapiens
cagagacagcuuga

SEQ ID NO: 986508 - RNA, 22 nt, Homo sapiens
cagagacauacaccuaugucau

SEQ ID NO: 986509 - RNA, 19 nt, Homo sapiens
cagagaccuuccagaaaua

SEQ ID NO: 986510 - RNA, 13 nt, Homo sapiens
cagagacugggac

SEQ ID NO: 986511 - RNA, 16 nt, Homo sapiens
cagagcgcacagggag

SEQ ID NO: 986512 - RNA, 17 nt, Homo sapiens
cagaguaauccaagcaa

SEQ ID NO: 986513 - RNA, 18 nt, Homo sapiens
cagaguacuggcugaugg

SEQ ID NO: 986514 - RNA, 19 nt, Homo sapiens
cagagucaaugaacuuucc

SEQ ID NO: 986515 - RNA, 18 nt, Homo sapiens
cagaguuccgacugccau

SEQ ID NO: 986516 - RNA, 18 nt, Homo sapiens
cagaguuuguauugugau

SEQ ID NO: 986517 - RNA, 20 nt, Homo sapiens
cagauaaagguucaugcaaa

SEQ ID NO: 986518 - RNA, 17 nt, Homo sapiens
cagauggaaaagggaga

SEQ ID NO: 986519 - RNA, 20 nt, Homo sapiens
cagauggcagguuugcaauc

SEQ ID NO: 986520 - RNA, 22 nt, Homo sapiens
cagaugggagugcccccaacag

SEQ ID NO: 986521 - RNA, 22 nt, Homo sapiens
cagauuauaacuguugucauau

SEQ ID NO: 986522 - RNA, 15 nt, Homo sapiens
cagcacccucuccag

SEQ ID NO: 986523 - RNA, 17 nt, Homo sapiens
cagcacccucuccagau

SEQ ID NO: 986524 - RNA, 15 nt, Homo sapiens
cagcauggagucaca

SEQ ID NO: 986525 - RNA, 18 nt, Homo sapiens
cagccaauuauguuaaac

SEQ ID NO: 986526 - RNA, 13 nt, Homo sapiens
cagcccugcacca

SEQ ID NO: 986527 - RNA, 19 nt, Homo sapiens
cagcccugcaccaugcugc

SEQ ID NO: 986528 - RNA, 20 nt, Homo sapiens
cagcccugcaccaugcugcu

SEQ ID NO: 986529 - RNA, 19 nt, Homo sapiens
cagcccuggcaacugcuaa

SEQ ID NO: 986530 - RNA, 17 nt, Homo sapiens
cagcccuuuugucucug

SEQ ID NO: 986531 - RNA, 17 nt, Homo sapiens
cagccugcagacucacu

SEQ ID NO: 986532 - RNA, 18 nt, Homo sapiens
cagccugcagacucacug

SEQ ID NO: 986533 - RNA, 23 nt, Homo sapiens
cagccugcucccuagccagaggc

SEQ ID NO: 986534 - RNA, 13 nt, Homo sapiens
cagcuaugaaggc

SEQ ID NO: 986535 - RNA, 20 nt, Homo sapiens
caggaaaauggacaucaaaa

SEQ ID NO: 986536 - RNA, 13 nt, Homo sapiens
caggaagcuguga

SEQ ID NO: 986537 - RNA, 18 nt, Homo sapiens
caggaauccccaacaugc

SEQ ID NO: 986538 - RNA, 18 nt, Homo sapiens
caggaggaaggcuuacac

SEQ ID NO: 986539 - RNA, 21 nt, Homo sapiens
caggagggguuaaagcugccg

SEQ ID NO: 986540 - RNA, 22 nt, Homo sapiens
caggauacuggcacagagguag

SEQ ID NO: 986541 - RNA, 19 nt, Homo sapiens
caggcacagguccccagau

SEQ ID NO: 986542 - RNA, 20 nt, Homo sapiens
caggcagcuuuuucucuccc

SEQ ID NO: 986543 - RNA, 22 nt, Homo sapiens
caggcagguaaccccagauuca

SEQ ID NO: 986544 - RNA, 23 nt, Homo sapiens
caggcccuccuugucuuuuuacu

SEQ ID NO: 986545 - RNA, 15 nt, Homo sapiens
caggcuggagugcag

SEQ ID NO: 986546 - RNA, 16 nt, Homo sapiens
caggcuggagugcagu

SEQ ID NO: 986547 - RNA, 13 nt, Homo sapiens
cagggaaaacugc

SEQ ID NO: 986548 - RNA, 18 nt, Homo sapiens
cagggccuguaaucccag

SEQ ID NO: 986549 - RNA, 22 nt, Homo sapiens
cagggccuguaaucccagcauu

SEQ ID NO: 986550 - RNA, 14 nt, Homo sapiens
cagggcugucuucg

SEQ ID NO: 986551 - RNA, 16 nt, Homo sapiens
caggggugcugggacc

SEQ ID NO: 986552 - RNA, 17 nt, Homo sapiens
cagggugaggugcuuga

SEQ ID NO: 986553 - RNA, 15 nt, Homo sapiens
cagguaaaacagggc

SEQ ID NO: 986554 - RNA, 13 nt, Homo sapiens
cagguauaccuca

SEQ ID NO: 986555 - RNA, 15 nt, Homo sapiens
caggucugaagcuca

SEQ ID NO: 986556 - RNA, 12 nt, Homo sapiens
caggugaacaaa

SEQ ID NO: 986557 - RNA, 16 nt, Homo sapiens
caguaccuagcuggcu

SEQ ID NO: 986558 - RNA, 14 nt, Homo sapiens
caguagaugccacu

SEQ ID NO: 986559 - RNA, 11 nt, Homo sapiens
caguccagcuu

SEQ ID NO: 986560 - RNA, 18 nt, Homo sapiens
cagugagguuaaacuaag

SEQ ID NO: 986561 - RNA, 21 nt, Homo sapiens
cagugccuuucuucucuccag

SEQ ID NO: 986562 - RNA, 15 nt, Homo sapiens
caguggcaucaucuc

SEQ ID NO: 986563 - RNA, 16 nt, Homo sapiens
caguggcgcgaucuca

SEQ ID NO: 986564 - RNA, 17 nt, Homo sapiens
caguggcgugaucucag

SEQ ID NO: 986565 - RNA, 20 nt, Homo sapiens
caguggcgugaucucagcuc

SEQ ID NO: 986566 - RNA, 22 nt, Homo sapiens
caguguuuuaggagcaugagug

SEQ ID NO: 986567 - RNA, 15 nt, Homo sapiens
caguucccucuugcu

SEQ ID NO: 986568 - RNA, 12 nt, Homo sapiens
caguugugauac

SEQ ID NO: 986569 - RNA, 21 nt, Homo sapiens
cauaaaugugguacaagcauu

SEQ ID NO: 986570 - RNA, 17 nt, Homo sapiens
cauaaguauuuaauuca

SEQ ID NO: 986571 - RNA, 21 nt, Homo sapiens
cauaaugcucauacuuaucua

SEQ ID NO: 986572 - RNA, 21 nt, Homo sapiens
cauacaccuaugucauuucau

SEQ ID NO: 986573 - RNA, 21 nt, Homo sapiens
cauaugauguacauguacuga

SEQ ID NO: 986574 - RNA, 16 nt, Homo sapiens
cauauuguuacuggua

SEQ ID NO: 986575 - RNA, 13 nt, Homo sapiens
caucaggcuuucu

SEQ ID NO: 986576 - RNA, 11 nt, Homo sapiens
caucaucucag

SEQ ID NO: 986577 - RNA, 18 nt, Homo sapiens
caucauggcuaucugugg

SEQ ID NO: 986578 - RNA, 19 nt, Homo sapiens
caucccacucacaacagcu

SEQ ID NO: 986579 - RNA, 22 nt, Homo sapiens
caucccuagucucuacccagua

SEQ ID NO: 986580 - RNA, 13 nt, Homo sapiens
cauccuaccacaa

SEQ ID NO: 986581 - RNA, 22 nt, Homo sapiens
caucuuguccccaacaccccac

SEQ ID NO: 986582 - RNA, 18 nt, Homo sapiens
caucuuucacuaucugua

SEQ ID NO: 986583 - RNA, 20 nt, Homo sapiens
caugaaccucaagcugcauc

SEQ ID NO: 986584 - RNA, 18 nt, Homo sapiens
caugagucagucugauga

SEQ ID NO: 986585 - RNA, 15 nt, Homo sapiens
caugagugccgugug

SEQ ID NO: 986586 - RNA, 16 nt, Homo sapiens
caugaguuacacugga

SEQ ID NO: 986587 - RNA, 13 nt, Homo sapiens
caugcacugaugu

SEQ ID NO: 986588 - RNA, 19 nt, Homo sapiens
caugcacuuggcugcauaa

SEQ ID NO: 986589 - RNA, 20 nt, Homo sapiens
caugcacuuggcugcauaaa

SEQ ID NO: 986590 - RNA, 22 nt, Homo sapiens
caugcugcuggggaagacagug

SEQ ID NO: 986591 - RNA, 23 nt, Homo sapiens
caugcuugcauaagagcuuaaga

SEQ ID NO: 986592 - RNA, 17 nt, Homo sapiens
cauggagucacagccac

SEQ ID NO: 986593 - RNA, 19 nt, Homo sapiens
caugggagacacugaugua

SEQ ID NO: 986594 - RNA, 20 nt, Homo sapiens
cauguaaaauaugucuuucu

SEQ ID NO: 986595 - RNA, 14 nt, Homo sapiens
cauguaucuaugca

SEQ ID NO: 986596 - RNA, 16 nt, Homo sapiens
caugugaaaucauuca

SEQ ID NO: 986597 - RNA, 19 nt, Homo sapiens
cauguggcuaccuguaacu

SEQ ID NO: 986598 - RNA, 16 nt, Homo sapiens
cauguguuuacuuuau

SEQ ID NO: 986599 - RNA, 24 nt, Homo sapiens
cauguuagccaggcuggucucaaa

SEQ ID NO: 986600 - RNA, 22 nt, Homo sapiens
cauguucaagcgauucuccugc

SEQ ID NO: 986601 - RNA, 16 nt, Homo sapiens
cauguugccuugcaua

SEQ ID NO: 986602 - RNA, 18 nt, Homo sapiens
cauguuggcuagccucug

SEQ ID NO: 986603 - RNA, 14 nt, Homo sapiens
cauuaaaaaugcau

SEQ ID NO: 986604 - RNA, 23 nt, Homo sapiens
cauuaaaaaugcauauacuuuaa

SEQ ID NO: 986605 - RNA, 14 nt, Homo sapiens
cauuauuauuugcu

SEQ ID NO: 986606 - RNA, 21 nt, Homo sapiens
cauucagggcuauuuuuuccc

SEQ ID NO: 986607 - RNA, 17 nt, Homo sapiens
cauugacugucacauaa

SEQ ID NO: 986608 - RNA, 19 nt, Homo sapiens
cauugcucagaaaugucau

SEQ ID NO: 986609 - RNA, 22 nt, Homo sapiens
cauugcucagaaaugucaugug

SEQ ID NO: 986610 - RNA, 14 nt, Homo sapiens
cauuuaauauggau

SEQ ID NO: 986611 - RNA, 16 nt, Homo sapiens
gggccuguaaucccag

SEQ ID NO: 986612 - RNA, 23 nt, Homo sapiens
gggcuauuuuuucccccacaaac

SEQ ID NO: 986613 - RNA, 11 nt, Homo sapiens
ggggcauuauc

SEQ ID NO: 986614 - RNA, 22 nt, Homo sapiens
ggguugcacuggccacccaagg

SEQ ID NO: 986615 - RNA, 24 nt, Homo sapiens
ggguuucaccauguuagccaggcu

SEQ ID NO: 986616 - RNA, 13 nt, Homo sapiens
gguaaaacagggc

SEQ ID NO: 986617 - RNA, 14 nt, Homo sapiens
gguagcagagggau

SEQ ID NO: 986618 - RNA, 16 nt, Homo sapiens
ggugaaagauggaacu

SEQ ID NO: 986619 - RNA, 21 nt, Homo sapiens
ggugaacaaaguuuaccagaa

SEQ ID NO: 986620 - RNA, 16 nt, Homo sapiens
ggugauuccgcaguga

SEQ ID NO: 986621 - RNA, 12 nt, Homo sapiens
ggugcuucagga

SEQ ID NO: 986622 - RNA, 22 nt, Homo sapiens
ggugucauacagauuugcaaag

SEQ ID NO: 986623 - RNA, 13 nt, Homo sapiens
gguguugccaguu

SEQ ID NO: 986624 - RNA, 22 nt, Homo sapiens
gguguuuauccuaucucuccaa

SEQ ID NO: 986625 - RNA, 16 nt, Homo sapiens
gguuggagugcagugg

SEQ ID NO: 986626 - RNA, 15 nt, Homo sapiens
guaaaaacaaagaaa

SEQ ID NO: 986627 - RNA, 17 nt, Homo sapiens
guaaaucagacuaugaa

SEQ ID NO: 986628 - RNA, 22 nt, Homo sapiens
guaacaggcuugaaucaaagaa

SEQ ID NO: 986629 - RNA, 15 nt, Homo sapiens
guaauccaagcaaau

SEQ ID NO: 986630 - RNA, 15 nt, Homo sapiens
guacaagcauucugu

SEQ ID NO: 986631 - RNA, 17 nt, Homo sapiens
guacaauaaagcaaugu

SEQ ID NO: 986632 - RNA, 12 nt, Homo sapiens
guacacaacaau

SEQ ID NO: 986633 - RNA, 18 nt, Homo sapiens
guacaccacaagggucac

SEQ ID NO: 986634 - RNA, 13 nt, Homo sapiens
guacauucuuccu

SEQ ID NO: 986635 - RNA, 20 nt, Homo sapiens
guacucuuguuuccuuauau

SEQ ID NO: 986636 - RNA, 13 nt, Homo sapiens
guagauaaggaaa

SEQ ID NO: 986637 - RNA, 19 nt, Homo sapiens
guagguaauauugcaaggc

SEQ ID NO: 986638 - RNA, 23 nt, Homo sapiens
guauauuucccuguuucuuccac

SEQ ID NO: 986639 - RNA, 17 nt, Homo sapiens
guauugugauuaucaau

SEQ ID NO: 986640 - RNA, 19 nt, Homo sapiens
guauuuaauucauguugcc

SEQ ID NO: 986641 - RNA, 19 nt, Homo sapiens
gucaaugaacuuuccacau

SEQ ID NO: 986642 - RNA, 21 nt, Homo sapiens
gucacauaaugcucauacuua

SEQ ID NO: 986643 - RNA, 21 nt, Homo sapiens
gucacccagguuggagugcag

SEQ ID NO: 986644 - RNA, 22 nt, Homo sapiens
gucacgcuuucaugaauucugu

SEQ ID NO: 986645 - RNA, 17 nt, Homo sapiens
gucaucaucacauucag

SEQ ID NO: 986646 - RNA, 16 nt, Homo sapiens
guccaaacugccuaag

SEQ ID NO: 986647 - RNA, 14 nt, Homo sapiens
guccccagccugcu

SEQ ID NO: 986648 - RNA, 22 nt, Homo sapiens
guccgacucuucugagcaccua

SEQ ID NO: 986649 - RNA, 15 nt, Homo sapiens
gucgcccuacucacc

SEQ ID NO: 986650 - RNA, 14 nt, Homo sapiens
gucucaaugcucau

SEQ ID NO: 986651 - RNA, 19 nt, Homo sapiens
gucuccuaaaguacuggga

SEQ ID NO: 986652 - RNA, 22 nt, Homo sapiens
gucuccuaagcuggagugcagu

SEQ ID NO: 986653 - RNA, 18 nt, Homo sapiens
gucugaugagaacucuga

SEQ ID NO: 986654 - RNA, 19 nt, Homo sapiens
gucugguugggcagccaga

SEQ ID NO: 986655 - RNA, 12 nt, Homo sapiens
gucuuuuacccg

SEQ ID NO: 986656 - RNA, 19 nt, Homo sapiens
gugacacagcugucccaag

SEQ ID NO: 986657 - RNA, 15 nt, Homo sapiens
gugaucucagcucac

SEQ ID NO: 986658 - RNA, 19 nt, Homo sapiens
gugcaguggcaucaucuca

SEQ ID NO: 986659 - RNA, 19 nt, Homo sapiens
gugccagauuuaugcauau

SEQ ID NO: 986660 - RNA, 19 nt, Homo sapiens
gugccuucauuugggaugc

SEQ ID NO: 986661 - RNA, 20 nt, Homo sapiens
gugcuaucgcaccacugugu

SEQ ID NO: 986662 - RNA, 17 nt, Homo sapiens
gugcuggaaauggacac

SEQ ID NO: 986663 - RNA, 19 nt, Homo sapiens
gugcuggcauuacaggugu

SEQ ID NO: 986664 - RNA, 14 nt, Homo sapiens
gugcuugagucucc

SEQ ID NO: 986665 - RNA, 21 nt, Homo sapiens
gugcuuuaaccucacauaccc

SEQ ID NO: 986666 - RNA, 14 nt, Homo sapiens
guggcccaacacaa

SEQ ID NO: 986667 - RNA, 15 nt, Homo sapiens
guggcgcuuucugca

SEQ ID NO: 986668 - RNA, 22 nt, Homo sapiens
gugggcuaagcacgggccauau

SEQ ID NO: 986669 - RNA, 16 nt, Homo sapiens
guggugcgagugcgug

SEQ ID NO: 986670 - RNA, 14 nt, Homo sapiens
guguacauucuucc

SEQ ID NO: 986671 - RNA, 13 nt, Homo sapiens
guguaccagagaa

SEQ ID NO: 986672 - RNA, 13 nt, Homo sapiens
gugugggccagac

SEQ ID NO: 986673 - RNA, 18 nt, Homo sapiens
guuaggucucaauaccug

SEQ ID NO: 986674 - RNA, 18 nt, Homo sapiens
guucauuccuccagguau

SEQ ID NO: 986675 - RNA, 14 nt, Homo sapiens
guucucauaacucu

SEQ ID NO: 986676 - RNA, 18 nt, Homo sapiens
guucucauaacucuguga

SEQ ID NO: 986677 - RNA, 19 nt, Homo sapiens
guucucauaacucugugau

SEQ ID NO: 986678 - RNA, 20 nt, Homo sapiens
guucucauaacucugugauc

SEQ ID NO: 986679 - RNA, 14 nt, Homo sapiens
guucugauaaugaa

SEQ ID NO: 986680 - RNA, 12 nt, Homo sapiens
guucuguagaaa

SEQ ID NO: 986681 - RNA, 22 nt, Homo sapiens
guugaguuauuaauauguuauu

SEQ ID NO: 986682 - RNA, 21 nt, Homo sapiens
guugcauauaccaguugugau

SEQ ID NO: 986683 - RNA, 13 nt, Homo sapiens
guuggagugcagu

SEQ ID NO: 986684 - RNA, 14 nt, Homo sapiens
guuggagugcagug

SEQ ID NO: 986685 - RNA, 20 nt, Homo sapiens
guuuaguaaucauauuguua

SEQ ID NO: 986686 - RNA, 19 nt, Homo sapiens
guuucaccauguuagccag

SEQ ID NO: 986687 - RNA, 14 nt, Homo sapiens
guuucacugugcaa

SEQ ID NO: 986688 - RNA, 21 nt, Homo sapiens
guuucuccagagggaauugca

SEQ ID NO: 986689 - RNA, 16 nt, Homo sapiens
guuucuuccacagugc

SEQ ID NO: 986690 - RNA, 14 nt, Homo sapiens
guuugaauguuaaa

SEQ ID NO: 986691 - RNA, 15 nt, Homo sapiens
guuuguauugugauu

SEQ ID NO: 986692 - RNA, 15 nt, Homo sapiens
guuuuaaaaugagaa

SEQ ID NO: 986693 - RNA, 17 nt, Homo sapiens
guuuuucuuuucauuua

SEQ ID NO: 986694 - RNA, 23 nt, Homo sapiens
guuuuugugaaaagcuccauuuu

SEQ ID NO: 986695 - RNA, 18 nt, Homo sapiens
uaaaaaaauuccaaguga

SEQ ID NO: 986696 - RNA, 22 nt, Homo sapiens
uaaaaauaaaaaacacugggag

SEQ ID NO: 986697 - RNA, 18 nt, Homo sapiens
uaaaacauuaugaguuuc

SEQ ID NO: 986698 - RNA, 14 nt, Homo sapiens
uaaaagacagugaa

SEQ ID NO: 986699 - RNA, 17 nt, Homo sapiens
uaaaagcaucacaugaa

SEQ ID NO: 986700 - RNA, 21 nt, Homo sapiens
uaaaaguuuuuuauuaugcau

SEQ ID NO: 986701 - RNA, 22 nt, Homo sapiens
uaaaaugaaguggugagcuuaa

SEQ ID NO: 986702 - RNA, 20 nt, Homo sapiens
uaaaauuacauugagguucc

SEQ ID NO: 986703 - RNA, 18 nt, Homo sapiens
uaaacaauaucagacuuu

SEQ ID NO: 986704 - RNA, 15 nt, Homo sapiens
uaaacauucuaucua

SEQ ID NO: 986705 - RNA, 14 nt, Homo sapiens
uaaagucuugccuu

SEQ ID NO: 986706 - RNA, 11 nt, Homo sapiens
uaaaugugauu

SEQ ID NO: 986707 - RNA, 19 nt, Homo sapiens
uaaaugugauuuacgcuca

SEQ ID NO: 986708 - RNA, 13 nt, Homo sapiens
uaaauuauaucaa

SEQ ID NO: 986709 - RNA, 20 nt, Homo sapiens
uaacaaccaaagacuacaua

SEQ ID NO: 986710 - RNA, 15 nt, Homo sapiens
uaacaauaaaagaca

SEQ ID NO: 986711 - RNA, 16 nt, Homo sapiens
uaacaauaaaagacaa

SEQ ID NO: 986712 - RNA, 15 nt, Homo sapiens
uaacgauaaaagaca

SEQ ID NO: 986713 - RNA, 18 nt, Homo sapiens
uaacuaugaccaugcuga

SEQ ID NO: 986714 - RNA, 15 nt, Homo sapiens
uaacucagacacaaa

SEQ ID NO: 986715 - RNA, 17 nt, Homo sapiens
uaacucagacacaaaua

SEQ ID NO: 986716 - RNA, 20 nt, Homo sapiens
uaacuggagccccaucagcu

SEQ ID NO: 986717 - RNA, 14 nt, Homo sapiens
uaacuguugucaua

SEQ ID NO: 986718 - RNA, 15 nt, Homo sapiens
uaagacggauuuauu

SEQ ID NO: 986719 - RNA, 21 nt, Homo sapiens
uaagagcucaggaugagggaa

SEQ ID NO: 986720 - RNA, 18 nt, Homo sapiens
uaagagcuuaagaaccau

SEQ ID NO: 986721 - RNA, 15 nt, Homo sapiens
uaagcuggagugcag

SEQ ID NO: 986722 - RNA, 13 nt, Homo sapiens
uaagggccagaaa

SEQ ID NO: 986723 - RNA, 23 nt, Homo sapiens
uaauauguaaaauuacacuuuga

SEQ ID NO: 986724 - RNA, 12 nt, Homo sapiens
uaauauugcaag

SEQ ID NO: 986725 - RNA, 14 nt, Homo sapiens
uaaucccagcauuu

SEQ ID NO: 986726 - RNA, 12 nt, Homo sapiens
uaaucuacuuuc

SEQ ID NO: 986727 - RNA, 22 nt, Homo sapiens
uaaugagauaaugugauauuau

SEQ ID NO: 986728 - RNA, 14 nt, Homo sapiens
uaaugagauauuaa

SEQ ID NO: 986729 - RNA, 14 nt, Homo sapiens
uaauguacaauaaa

SEQ ID NO: 986730 - RNA, 20 nt, Homo sapiens
uaauguacaauaaagcaaug

SEQ ID NO: 986731 - RNA, 15 nt, Homo sapiens
uaauucuaugagaua

SEQ ID NO: 986732 - RNA, 16 nt, Homo sapiens
uaauuggcaugaaggu

SEQ ID NO: 986733 - RNA, 21 nt, Homo sapiens
uaauuuugaaaaacugcucau

SEQ ID NO: 986734 - RNA, 14 nt, Homo sapiens
uacaagcaaugccu

SEQ ID NO: 986735 - RNA, 19 nt, Homo sapiens
uacaagcauucugucuuga

SEQ ID NO: 986736 - RNA, 16 nt, Homo sapiens
uacacagaucacagcu

SEQ ID NO: 986737 - RNA, 21 nt, Homo sapiens
uacacauguaucuaugcauuu

SEQ ID NO: 986738 - RNA, 17 nt, Homo sapiens
uacacccacaguggaaa

SEQ ID NO: 986739 - RNA, 15 nt, Homo sapiens
uacaccccaacagca

SEQ ID NO: 986740 - RNA, 18 nt, Homo sapiens
uacaugcauacacucuca

SEQ ID NO: 986741 - RNA, 14 nt, Homo sapiens
uacaugcauuacug

SEQ ID NO: 986742 - RNA, 19 nt, Homo sapiens
gacagcuugaucaaaggca

SEQ ID NO: 986743 - RNA, 23 nt, Homo sapiens
gacauacaccuaugucauuucau

SEQ ID NO: 986744 - RNA, 17 nt, Homo sapiens
gaccccaaguuauccac

SEQ ID NO: 986745 - RNA, 15 nt, Homo sapiens
gacccuucccuugag

SEQ ID NO: 986746 - RNA, 13 nt, Homo sapiens
gaccuaaaauaaa

SEQ ID NO: 986747 - RNA, 18 nt, Homo sapiens
gaccuauuagaguauuuu

SEQ ID NO: 986748 - RNA, 19 nt, Homo sapiens
gacuaaguguaccagagaa

SEQ ID NO: 986749 - RNA, 15 nt, Homo sapiens
gagaaacaauggcua

SEQ ID NO: 986750 - RNA, 13 nt, Homo sapiens
gagacaaauggag

SEQ ID NO: 986751 - RNA, 22 nt, Homo sapiens
gagacagcuugaucaaaggcac

SEQ ID NO: 986752 - RNA, 15 nt, Homo sapiens
gagaccuuccagaaa

SEQ ID NO: 986753 - RNA, 19 nt, Homo sapiens
gagaguacaccccaacagc

SEQ ID NO: 986754 - RNA, 17 nt, Homo sapiens
gagagucugugacccac

SEQ ID NO: 986755 - RNA, 13 nt, Homo sapiens
gagaucaccagug

SEQ ID NO: 986756 - RNA, 21 nt, Homo sapiens
gagaucccacccgaacgucuu

SEQ ID NO: 986757 - RNA, 14 nt, Homo sapiens
gagaugacagggaa

SEQ ID NO: 986758 - RNA, 22 nt, Homo sapiens
gagcaccuacuuacaugcauua

SEQ ID NO: 986759 - RNA, 16 nt, Homo sapiens
gagccaccacauccag

SEQ ID NO: 986760 - RNA, 19 nt, Homo sapiens
gagccaccugacucuugca

SEQ ID NO: 986761 - RNA, 17 nt, Homo sapiens
gagcccacacaugggau

SEQ ID NO: 986762 - RNA, 14 nt, Homo sapiens
gagcuggaccucac

SEQ ID NO: 986763 - RNA, 17 nt, Homo sapiens
gagcuggaccucaccaa

SEQ ID NO: 986764 - RNA, 13 nt, Homo sapiens
gaggcagugacag

SEQ ID NO: 986765 - RNA, 12 nt, Homo sapiens
gaggccuguccu

SEQ ID NO: 986766 - RNA, 16 nt, Homo sapiens
gaggccuguccugacc

SEQ ID NO: 986767 - RNA, 23 nt, Homo sapiens
gaggucauuaaaauuacauugag

SEQ ID NO: 986768 - RNA, 20 nt, Homo sapiens
gagguugucuguggccagaa

SEQ ID NO: 986769 - RNA, 18 nt, Homo sapiens
gaguacaccccaacagca

SEQ ID NO: 986770 - RNA, 19 nt, Homo sapiens
gaguacaccccaacagcac

SEQ ID NO: 986771 - RNA, 21 nt, Homo sapiens
gaguaucugaggcacauguca

SEQ ID NO: 986772 - RNA, 22 nt, Homo sapiens
gagucuccaacggcaagggaac

SEQ ID NO: 986773 - RNA, 16 nt, Homo sapiens
gagugcaguggcgcga

SEQ ID NO: 986774 - RNA, 17 nt, Homo sapiens
gagugcccccaacagca

SEQ ID NO: 986775 - RNA, 23 nt, Homo sapiens
gaguuauuaauauguuauuauua

SEQ ID NO: 986776 - RNA, 16 nt, Homo sapiens
gaguuccgacugccau

SEQ ID NO: 986777 - RNA, 17 nt, Homo sapiens
gauaaagguucaugcaa

SEQ ID NO: 986778 - RNA, 19 nt, Homo sapiens
gauauacuugguucucucc

SEQ ID NO: 986779 - RNA, 21 nt, Homo sapiens
gauauacuugguucucuccac

SEQ ID NO: 986780 - RNA, 13 nt, Homo sapiens
gauauauuccacc

SEQ ID NO: 986781 - RNA, 14 nt, Homo sapiens
gauaucucaucucu

SEQ ID NO: 986782 - RNA, 15 nt, Homo sapiens
gauauuuuucaugau

SEQ ID NO: 986783 - RNA, 13 nt, Homo sapiens
gaucccuagcugu

SEQ ID NO: 986784 - RNA, 22 nt, Homo sapiens
gaucguuuuuucccagggcaag

SEQ ID NO: 986785 - RNA, 23 nt, Homo sapiens
gaucucagcucacugcaaccucc

SEQ ID NO: 986786 - RNA, 18 nt, Homo sapiens
gaucuugcucucggugcu

SEQ ID NO: 986787 - RNA, 13 nt, Homo sapiens
gaugagaguacac

SEQ ID NO: 986788 - RNA, 18 nt, Homo sapiens
gaugagggaaaagaaaaa

SEQ ID NO: 986789 - RNA, 18 nt, Homo sapiens
gaugcacaugagcuggcg

SEQ ID NO: 986790 - RNA, 18 nt, Homo sapiens
gauggagccagcucugca

SEQ ID NO: 986791 - RNA, 22 nt, Homo sapiens
gaugucgcccuacucaccugag

SEQ ID NO: 986792 - RNA, 15 nt, Homo sapiens
gaugugaguugcaca

SEQ ID NO: 986793 - RNA, 15 nt, Homo sapiens
gauuacaggugugag

SEQ ID NO: 986794 - RNA, 18 nt, Homo sapiens
gauuaucaauuaccacac

SEQ ID NO: 986795 - RNA, 16 nt, Homo sapiens
gauucuuccaucugau

SEQ ID NO: 986796 - RNA, 21 nt, Homo sapiens
gauuuacgcucauuguagaaa

SEQ ID NO: 986797 - RNA, 18 nt, Homo sapiens
gauuugugcucacuuuug

SEQ ID NO: 986798 - RNA, 15 nt, Homo sapiens
gauuuugcaguucuu

SEQ ID NO: 986799 - RNA, 13 nt, Homo sapiens
gcaaaaccaaaua

SEQ ID NO: 986800 - RNA, 17 nt, Homo sapiens
gcaaagccuucauugcc

SEQ ID NO: 986801 - RNA, 21 nt, Homo sapiens
gcaaauauaucugcuauucuc

SEQ ID NO: 986802 - RNA, 16 nt, Homo sapiens
gcaaauguaauugauu

SEQ ID NO: 986803 - RNA, 20 nt, Homo sapiens
gcaaccagaccauugucuca

SEQ ID NO: 986804 - RNA, 17 nt, Homo sapiens
gcaagaccccaucucaa

SEQ ID NO: 986805 - RNA, 22 nt, Homo sapiens
gcacaaaccaauuaaacccagu

SEQ ID NO: 986806 - RNA, 17 nt, Homo sapiens
gcacacccuccagagac

SEQ ID NO: 986807 - RNA, 21 nt, Homo sapiens
gcacagggagugcacauaucc

SEQ ID NO: 986808 - RNA, 21 nt, Homo sapiens
gcacauauccaggcaccagga

SEQ ID NO: 986809 - RNA, 23 nt, Homo sapiens
gcacauauccaggcaccaggacu

SEQ ID NO: 986810 - RNA, 13 nt, Homo sapiens
gcacccucuccag

SEQ ID NO: 986811 - RNA, 15 nt, Homo sapiens
gcacgaauggaagag

SEQ ID NO: 986812 - RNA, 14 nt, Homo sapiens
gcagaccugacucu

SEQ ID NO: 986813 - RNA, 17 nt, Homo sapiens
gcagccugcagacucac

SEQ ID NO: 986814 - RNA, 21 nt, Homo sapiens
gcagcuuuagccaagugcagg

SEQ ID NO: 986815 - RNA, 23 nt, Homo sapiens
gcaggcaugagucagucugauga

SEQ ID NO: 986816 - RNA, 13 nt, Homo sapiens
gcagguuugcaau

SEQ ID NO: 986817 - RNA, 13 nt, Homo sapiens
gcaguacuuugug

SEQ ID NO: 986818 - RNA, 22 nt, Homo sapiens
gcagugccuuucuucucuccag

SEQ ID NO: 986819 - RNA, 16 nt, Homo sapiens
gcaguggaacuaagaa

SEQ ID NO: 986820 - RNA, 17 nt, Homo sapiens
gcaguggcgugaucuca

SEQ ID NO: 986821 - RNA, 18 nt, Homo sapiens
gcaguggcgugaucucag

SEQ ID NO: 986822 - RNA, 20 nt, Homo sapiens
gcauaaaugugguacaagca

SEQ ID NO: 986823 - RNA, 22 nt, Homo sapiens
gcauauuauuuuauguugcaua

SEQ ID NO: 986824 - RNA, 22 nt, Homo sapiens
gcaugcacuucuuacaauaauu

SEQ ID NO: 986825 - RNA, 12 nt, Homo sapiens
gcaugcggccca

SEQ ID NO: 986826 - RNA, 12 nt, Homo sapiens
gcauuacaggug

SEQ ID NO: 986827 - RNA, 16 nt, Homo sapiens
gcauuugucaacaaag

SEQ ID NO: 986828 - RNA, 22 nt, Homo sapiens
gccaaccgugggguuagcucua

SEQ ID NO: 986829 - RNA, 18 nt, Homo sapiens
gccaagaggcuguuccca

SEQ ID NO: 986830 - RNA, 18 nt, Homo sapiens
gccaagagugaagggaag

SEQ ID NO: 986831 - RNA, 18 nt, Homo sapiens
gccaaucaguagccagca

SEQ ID NO: 986832 - RNA, 15 nt, Homo sapiens
gccacaccucuccaa

SEQ ID NO: 986833 - RNA, 22 nt, Homo sapiens
gccacccaaggaugucugccac

SEQ ID NO: 986834 - RNA, 21 nt, Homo sapiens
gccacuagcccuccucuccca

SEQ ID NO: 986835 - RNA, 16 nt, Homo sapiens
gccacucuuagcuaaa

SEQ ID NO: 986836 - RNA, 13 nt, Homo sapiens
gccagaaauaucu

SEQ ID NO: 986837 - RNA, 20 nt, Homo sapiens
gccagaggcucuaauguaca

SEQ ID NO: 986838 - RNA, 21 nt, Homo sapiens
gccagaggcucuaauguacaa

SEQ ID NO: 986839 - RNA, 23 nt, Homo sapiens
gccaggcugggucgcccuggacu

SEQ ID NO: 986840 - RNA, 22 nt, Homo sapiens
gccauaaaggggagggacucau

SEQ ID NO: 986841 - RNA, 15 nt, Homo sapiens
gcccaacgcaaauuc

SEQ ID NO: 986842 - RNA, 17 nt, Homo sapiens
gcccaggauggcuuuga

SEQ ID NO: 986843 - RNA, 18 nt, Homo sapiens
gccccaucagcuccagcu

SEQ ID NO: 986844 - RNA, 13 nt, Homo sapiens
gcccuaggugaga

SEQ ID NO: 986845 - RNA, 22 nt, Homo sapiens
gcccucccuaccuaccaagaua

SEQ ID NO: 986846 - RNA, 22 nt, Homo sapiens
gcccucuaugguguggcaaagc

SEQ ID NO: 986847 - RNA, 23 nt, Homo sapiens
gcccucuaugguguggcaaagcc

SEQ ID NO: 986848 - RNA, 13 nt, Homo sapiens
gcccugcaccaug

SEQ ID NO: 986849 - RNA, 14 nt, Homo sapiens
gccucaaccuccca

SEQ ID NO: 986850 - RNA, 14 nt, Homo sapiens
gccucccaagcacc

SEQ ID NO: 986851 - RNA, 17 nt, Homo sapiens
gccucccauguucaagc

SEQ ID NO: 986852 - RNA, 18 nt, Homo sapiens
gccugacugccaagccau

SEQ ID NO: 986853 - RNA, 14 nt, Homo sapiens
gccugcagacucac

SEQ ID NO: 986854 - RNA, 19 nt, Homo sapiens
gccuggcaagugggugaaa

SEQ ID NO: 986855 - RNA, 22 nt, Homo sapiens
gccuguacuagagcaagcagga

SEQ ID NO: 986856 - RNA, 21 nt, Homo sapiens
gccuucccaaguugugcuuga

SEQ ID NO: 986857 - RNA, 18 nt, Homo sapiens
gccuucccaggaguacac

SEQ ID NO: 986858 - RNA, 19 nt, Homo sapiens
gccuucucuaaacauuuca

SEQ ID NO: 986859 - RNA, 13 nt, Homo sapiens
gcgaucucagcuc

SEQ ID NO: 986860 - RNA, 17 nt, Homo sapiens
gcgcgaucucggcucac

SEQ ID NO: 986861 - RNA, 19 nt, Homo sapiens
gcuaauuucuauuugaucu

SEQ ID NO: 986862 - RNA, 20 nt, Homo sapiens
gcuaauuuugaaaaacugcu

SEQ ID NO: 986863 - RNA, 21 nt, Homo sapiens
gcuaauuuugaaaaacugcuc

SEQ ID NO: 986864 - RNA, 16 nt, Homo sapiens
agcuugaucaaaggca

SEQ ID NO: 986865 - RNA, 20 nt, Homo sapiens
aggaaacccagcucacagga

SEQ ID NO: 986866 - RNA, 16 nt, Homo sapiens
aggaaagucauuggcu

SEQ ID NO: 986867 - RNA, 17 nt, Homo sapiens
aggaaauugaauuucca

SEQ ID NO: 986868 - RNA, 20 nt, Homo sapiens
aggaacucaauaaagugcuu

SEQ ID NO: 986869 - RNA, 19 nt, Homo sapiens
aggaagcugugagagcagu

SEQ ID NO: 986870 - RNA, 18 nt, Homo sapiens
aggaauccccaacaugca

SEQ ID NO: 986871 - RNA, 19 nt, Homo sapiens
aggacccaggaggugugau

SEQ ID NO: 986872 - RNA, 22 nt, Homo sapiens
aggagaccuacccuccacaggc

SEQ ID NO: 986873 - RNA, 21 nt, Homo sapiens
aggaguacaccccaacagcac

SEQ ID NO: 986874 - RNA, 18 nt, Homo sapiens
aggaugauaaaagcacuu

SEQ ID NO: 986875 - RNA, 21 nt, Homo sapiens
aggaugauaaaagcacuuacu

SEQ ID NO: 986876 - RNA, 20 nt, Homo sapiens
aggauugggaaaaaguaauu

SEQ ID NO: 986877 - RNA, 19 nt, Homo sapiens
aggauuugggcucuuggaa

SEQ ID NO: 986878 - RNA, 22 nt, Homo sapiens
aggcacacagcaagucaggguu

SEQ ID NO: 986879 - RNA, 17 nt, Homo sapiens
aggcagcugacacaucu

SEQ ID NO: 986880 - RNA, 23 nt, Homo sapiens
aggcagcuuuuucucucccacua

SEQ ID NO: 986881 - RNA, 16 nt, Homo sapiens
aggcauccuuccucac

SEQ ID NO: 986882 - RNA, 18 nt, Homo sapiens
aggcaugagucagucuga

SEQ ID NO: 986883 - RNA, 15 nt, Homo sapiens
aggccugacugccaa

SEQ ID NO: 986884 - RNA, 20 nt, Homo sapiens
aggccugacugccaagccau

SEQ ID NO: 986885 - RNA, 16 nt, Homo sapiens
aggcucuaauguacaa

SEQ ID NO: 986886 - RNA, 17 nt, Homo sapiens
aggcucuaauguacaau

SEQ ID NO: 986887 - RNA, 18 nt, Homo sapiens
aggcucuaauguacaaua

SEQ ID NO: 986888 - RNA, 13 nt, Homo sapiens
agggaaaacugca

SEQ ID NO: 986889 - RNA, 16 nt, Homo sapiens
agggacucaucuuucc

SEQ ID NO: 986890 - RNA, 18 nt, Homo sapiens
agggcucacagaauucau

SEQ ID NO: 986891 - RNA, 14 nt, Homo sapiens
aggggugugcugag

SEQ ID NO: 986892 - RNA, 23 nt, Homo sapiens
agguauccaaaaauguguaagaa

SEQ ID NO: 986893 - RNA, 17 nt, Homo sapiens
aggucauuaaaauuaca

SEQ ID NO: 986894 - RNA, 17 nt, Homo sapiens
aggugcuggcucuuucc

SEQ ID NO: 986895 - RNA, 20 nt, Homo sapiens
aggugguaagcaccaggacg

SEQ ID NO: 986896 - RNA, 10 nt, Homo sapiens
agguucaagc

SEQ ID NO: 986897 - RNA, 15 nt, Homo sapiens
agguuggagugcagu

SEQ ID NO: 986898 - RNA, 20 nt, Homo sapiens
agguuggagugcaguggcgu

SEQ ID NO: 986899 - RNA, 16 nt, Homo sapiens
aguaauccaagcaaau

SEQ ID NO: 986900 - RNA, 18 nt, Homo sapiens
aguacaccccaacagcac

SEQ ID NO: 986901 - RNA, 19 nt, Homo sapiens
aguagagacgagguuucac

SEQ ID NO: 986902 - RNA, 18 nt, Homo sapiens
aguagagacggguuucac

SEQ ID NO: 986903 - RNA, 11 nt, Homo sapiens
aguagaugcca

SEQ ID NO: 986904 - RNA, 22 nt, Homo sapiens
aguagcugggacuauaggcaug

SEQ ID NO: 986905 - RNA, 14 nt, Homo sapiens
aguauauugaucca

SEQ ID NO: 986906 - RNA, 15 nt, Homo sapiens
aguauccucuugcca

SEQ ID NO: 986907 - RNA, 20 nt, Homo sapiens
aguauggcuccuccauaucu

SEQ ID NO: 986908 - RNA, 15 nt, Homo sapiens
agucaagauuuccau

SEQ ID NO: 986909 - RNA, 13 nt, Homo sapiens
agucagcucuucu

SEQ ID NO: 986910 - RNA, 21 nt, Homo sapiens
aguccagccuggcaaggguuc

SEQ ID NO: 986911 - RNA, 22 nt, Homo sapiens
agucuaaaaaaggaauccucug

SEQ ID NO: 986912 - RNA, 14 nt, Homo sapiens
agugaauuguguag

SEQ ID NO: 986913 - RNA, 15 nt, Homo sapiens
agugagagaguggcu

SEQ ID NO: 986914 - RNA, 23 nt, Homo sapiens
agugagagcacgccuguacuaga

SEQ ID NO: 986915 - RNA, 22 nt, Homo sapiens
agugcuucuccagccucagccu

SEQ ID NO: 986916 - RNA, 22 nt, Homo sapiens
aguggaaagacagcuucucauc

SEQ ID NO: 986917 - RNA, 20 nt, Homo sapiens
aguggcaucaucucagcuca

SEQ ID NO: 986918 - RNA, 16 nt, Homo sapiens
aguggcgcgaucucag

SEQ ID NO: 986919 - RNA, 16 nt, Homo sapiens
aguggcgugaucucag

SEQ ID NO: 986920 - RNA, 19 nt, Homo sapiens
agugucuugagacuuuauc

SEQ ID NO: 986921 - RNA, 22 nt, Homo sapiens
aguucuccacuagcuauggugu

SEQ ID NO: 986922 - RNA, 13 nt, Homo sapiens
aguucuguagaaa

SEQ ID NO: 986923 - RNA, 15 nt, Homo sapiens
aguugcaacuuugua

SEQ ID NO: 986924 - RNA, 14 nt, Homo sapiens
aguugcugucaucc

SEQ ID NO: 986925 - RNA, 19 nt, Homo sapiens
aguuguagguaauauugca

SEQ ID NO: 986926 - RNA, 23 nt, Homo sapiens
aguuuaauuuuugaaaacuggcu

SEQ ID NO: 986927 - RNA, 23 nt, Homo sapiens
aguuuccuauguuucacugugca

SEQ ID NO: 986928 - RNA, 22 nt, Homo sapiens
aguuucuucuuuaggcauuaaa

SEQ ID NO: 986929 - RNA, 14 nt, Homo sapiens
auaaaaagcauuau

SEQ ID NO: 986930 - RNA, 13 nt, Homo sapiens
auaaaagcacuua

SEQ ID NO: 986931 - RNA, 16 nt, Homo sapiens
auaaaagggacugaga

SEQ ID NO: 986932 - RNA, 22 nt, Homo sapiens
auaaacugauuuaucuauuuaa

SEQ ID NO: 986933 - RNA, 22 nt, Homo sapiens
auaaaguguuugaaagcuuuau

SEQ ID NO: 986934 - RNA, 22 nt, Homo sapiens
auaacaauaaaagacaaggaaa

SEQ ID NO: 986935 - RNA, 21 nt, Homo sapiens
auaacauggugugcuucuuaa

SEQ ID NO: 986936 - RNA, 15 nt, Homo sapiens
auaacucugugaucu

SEQ ID NO: 986937 - RNA, 23 nt, Homo sapiens
auaagaucuuuuauuuugccaag

SEQ ID NO: 986938 - RNA, 21 nt, Homo sapiens
auaaguguguguuuuucauaa

SEQ ID NO: 986939 - RNA, 22 nt, Homo sapiens
auaaguguguguuuuucauaaa

SEQ ID NO: 986940 - RNA, 13 nt, Homo sapiens
auaaucauuuauc

SEQ ID NO: 986941 - RNA, 18 nt, Homo sapiens
auaaugaaaauuaugaua

SEQ ID NO: 986942 - RNA, 20 nt, Homo sapiens
auaauucaaaggcauuucuu

SEQ ID NO: 986943 - RNA, 21 nt, Homo sapiens
auacaaacauguuccugggau

SEQ ID NO: 986944 - RNA, 20 nt, Homo sapiens
auacacuuuuuaaaaucuca

SEQ ID NO: 986945 - RNA, 21 nt, Homo sapiens
auacacuuuuuaaaaucucaa

SEQ ID NO: 986946 - RNA, 14 nt, Homo sapiens
auacaugcauacac

SEQ ID NO: 986947 - RNA, 17 nt, Homo sapiens
auaccauauacagcuca

SEQ ID NO: 986948 - RNA, 15 nt, Homo sapiens
auaccugauauauuc

SEQ ID NO: 986949 - RNA, 16 nt, Homo sapiens
auaccugggauacugu

SEQ ID NO: 986950 - RNA, 20 nt, Homo sapiens
auacgcaucagacagaugga

SEQ ID NO: 986951 - RNA, 17 nt, Homo sapiens
auacucacuuucccaaa

SEQ ID NO: 986952 - RNA, 18 nt, Homo sapiens
auacucucaccauuugga

SEQ ID NO: 986953 - RNA, 16 nt, Homo sapiens
auacugugugcuaaaa

SEQ ID NO: 986954 - RNA, 18 nt, Homo sapiens
auacuugguucucuccac

SEQ ID NO: 986955 - RNA, 20 nt, Homo sapiens
auauaacuaacaaccaaaga

SEQ ID NO: 986956 - RNA, 18 nt, Homo sapiens
auauaauucuuaugccau

SEQ ID NO: 986957 - RNA, 22 nt, Homo sapiens
auauacagcucagaaguuucuu

SEQ ID NO: 986958 - RNA, 12 nt, Homo sapiens
auauacuaugag

SEQ ID NO: 986959 - RNA, 14 nt, Homo sapiens
auauacucacuuuc

SEQ ID NO: 986960 - RNA, 14 nt, Homo sapiens
auauccucccucca

SEQ ID NO: 986961 - RNA, 16 nt, Homo sapiens
auaugcucugauuuau

SEQ ID NO: 986962 - RNA, 18 nt, Homo sapiens
auauggggaaaaaacugu

SEQ ID NO: 986963 - RNA, 20 nt, Homo sapiens
auauguaaaauuacacuuug

SEQ ID NO: 986964 - RNA, 13 nt, Homo sapiens
auauuaugaagcu

SEQ ID NO: 986965 - RNA, 18 nt, Homo sapiens
aucaaucaagacugcaaa

SEQ ID NO: 986966 - RNA, 14 nt, Homo sapiens
aucaauuaccacac

SEQ ID NO: 986967 - RNA, 12 nt, Homo sapiens
aucagacuauga

SEQ ID NO: 986968 - RNA, 13 nt, Homo sapiens
aucagacuaugaa

SEQ ID NO: 986969 - RNA, 21 nt, Homo sapiens
aucagcuccagcugcucuguc

SEQ ID NO: 986970 - RNA, 14 nt, Homo sapiens
aucaguagccagca

SEQ ID NO: 986971 - RNA, 13 nt, Homo sapiens
aucauccaagaca

SEQ ID NO: 986972 - RNA, 14 nt, Homo sapiens
aucauccaagacag

SEQ ID NO: 986973 - RNA, 13 nt, Homo sapiens
aucaucucagcuc

SEQ ID NO: 986974 - RNA, 15 nt, Homo sapiens
aucauggcuaucugu

SEQ ID NO: 986975 - RNA, 13 nt, Homo sapiens
augaagcaaugcu

SEQ ID NO: 986976 - RNA, 20 nt, Homo sapiens
augaaggcuguacacugcac

SEQ ID NO: 986977 - RNA, 13 nt, Homo sapiens
augaauacaauua

SEQ ID NO: 986978 - RNA, 17 nt, Homo sapiens
augacuuuuuauacuuu

SEQ ID NO: 986979 - RNA, 17 nt, Homo sapiens
augauaaaagcacuuac

SEQ ID NO: 986980 - RNA, 16 nt, Homo sapiens
augauccccacgccac

SEQ ID NO: 986981 - RNA, 14 nt, Homo sapiens
augaugacuaugga

SEQ ID NO: 986982 - RNA, 22 nt, Homo sapiens
augauucauuuuaacaucugag

SEQ ID NO: 986983 - RNA, 17 nt, Homo sapiens
augauuucagcagggau

SEQ ID NO: 986984 - RNA, 14 nt, Homo sapiens
augcaccaugucaa

SEQ ID NO: 986985 - RNA, 16 nt, Homo sapiens
augcauacacucucaa

SEQ ID NO: 986986 - RNA, 22 nt, Homo sapiens
augccagcagccagccaacccu

SEQ ID NO: 986987 - RNA, 15 nt, Homo sapiens
augccggugaucccu

SEQ ID NO: 986988 - RNA, 15 nt, Homo sapiens
augccuagaguuuac

SEQ ID NO: 986989 - RNA, 15 nt, Homo sapiens
augccucgaccugcc

SEQ ID NO: 986990 - RNA, 16 nt, Homo sapiens
augccucuguauuuaa

SEQ ID NO: 986991 - RNA, 20 nt, Homo sapiens
augccuuuucucaccuguca

SEQ ID NO: 986992 - RNA, 17 nt, Homo sapiens
augcucuggacuugccu

SEQ ID NO: 986993 - RNA, 19 nt, Homo sapiens
augcugaaaaaucauccaa

SEQ ID NO: 986994 - RNA, 22 nt, Homo sapiens
augcugcuggggaagacagugg

SEQ ID NO: 986995 - RNA, 19 nt, Homo sapiens
augcuuucgauaguguuaa

SEQ ID NO: 986996 - RNA, 17 nt, Homo sapiens
auggaaaagggagauuc

SEQ ID NO: 986997 - RNA, 19 nt, Homo sapiens
auggaauaaacuccauuua

SEQ ID NO: 986998 - RNA, 19 nt, Homo sapiens
auggccccugccuucccag

SEQ ID NO: 986999 - RNA, 22 nt, Homo sapiens
auggccuggcugcugcugugca

SEQ ID NO: 987000 - RNA, 23 nt, Homo sapiens
auggccuggcugcugcugugcag

SEQ ID NO: 987001 - RNA, 17 nt, Homo sapiens
auggcuccuccauaucu

SEQ ID NO: 987002 - RNA, 15 nt, Homo sapiens
augggagacacugau

SEQ ID NO: 987003 - RNA, 22 nt, Homo sapiens
augguggcaggaaaauggacau

SEQ ID NO: 987004 - RNA, 19 nt, Homo sapiens
auguaaaauuacacuuuga

SEQ ID NO: 987005 - RNA, 20 nt, Homo sapiens
auguacaauaaagcaaugug

SEQ ID NO: 987006 - RNA, 17 nt, Homo sapiens
auguacauguacugauu

SEQ ID NO: 987007 - RNA, 22 nt, Homo sapiens
augucuuuuacccggcacauuc

SEQ ID NO: 987008 - RNA, 16 nt, Homo sapiens
auguuacuacaugcac

SEQ ID NO: 987009 - RNA, 13 nt, Homo sapiens
auguuauuauuaa

SEQ ID NO: 987010 - RNA, 21 nt, Homo sapiens
auguucuaaauaaaaagcauu

SEQ ID NO: 987011 - RNA, 22 nt, Homo sapiens
auguucuaaauaaaaagcauua

SEQ ID NO: 987012 - RNA, 21 nt, Homo sapiens
auguucugacauaaguauuua

SEQ ID NO: 987013 - RNA, 22 nt, Homo sapiens
auguuguguuuuuaacauguca

SEQ ID NO: 987014 - RNA, 14 nt, Homo sapiens
auguuuaguaauca

SEQ ID NO: 987015 - RNA, 17 nt, Homo sapiens
auguuuaguaaucauau

SEQ ID NO: 987016 - RNA, 21 nt, Homo sapiens
auguuucaggagagaguugaa

SEQ ID NO: 987017 - RNA, 13 nt, Homo sapiens
auuaaauagagaa

SEQ ID NO: 987018 - RNA, 13 nt, Homo sapiens
auuaauaauaccu

SEQ ID NO: 987019 - RNA, 13 nt, Homo sapiens
auuacagguguga

SEQ ID NO: 987020 - RNA, 16 nt, Homo sapiens
auuaccuguuaguauu

SEQ ID NO: 987021 - RNA, 15 nt, Homo sapiens
auuacugcaugcacu

SEQ ID NO: 987022 - RNA, 22 nt, Homo sapiens
auuagaacuucaagcucuccaa

SEQ ID NO: 987023 - RNA, 16 nt, Homo sapiens
auuagaguauuuucca

SEQ ID NO: 987024 - RNA, 15 nt, Homo sapiens
auuauaccgcuauca

SEQ ID NO: 987025 - RNA, 22 nt, Homo sapiens
auuauaccgcuaucauuccaaa

SEQ ID NO: 987026 - RNA, 20 nt, Homo sapiens
auuauauuuacaaaugggaa

SEQ ID NO: 987027 - RNA, 18 nt, Homo sapiens
auuauguuaaacuagcau

SEQ ID NO: 987028 - RNA, 16 nt, Homo sapiens
auuauuuuauguugca

SEQ ID NO: 987029 - RNA, 16 nt, Homo sapiens
auuauuuuugagacag

SEQ ID NO: 987030 - RNA, 17 nt, Homo sapiens
auucacaucgcagauuc

SEQ ID NO: 987031 - RNA, 18 nt, Homo sapiens
auucauuuuaacaucuga

SEQ ID NO: 987032 - RNA, 14 nt, Homo sapiens
auuccugagccagu

SEQ ID NO: 987033 - RNA, 13 nt, Homo sapiens
auucucuugccuc

SEQ ID NO: 987034 - RNA, 22 nt, Homo sapiens
auucuuauuauuuuugagacag

SEQ ID NO: 987035 - RNA, 13 nt, Homo sapiens
auucuucuuccaa

SEQ ID NO: 987036 - RNA, 18 nt, Homo sapiens
auugaucgacuugccaaa

SEQ ID NO: 987037 - RNA, 19 nt, Homo sapiens
auugcagaggggcccauga

SEQ ID NO: 987038 - RNA, 15 nt, Homo sapiens
auugcagaguacugg

SEQ ID NO: 987039 - RNA, 21 nt, Homo sapiens
auugcucucccagcccuugca

SEQ ID NO: 987040 - RNA, 21 nt, Homo sapiens
auugcuguccuggaggggcug

SEQ ID NO: 987041 - RNA, 18 nt, Homo sapiens
auuguagaaaagcuauaa

SEQ ID NO: 987042 - RNA, 13 nt, Homo sapiens
auuguuacuggua

SEQ ID NO: 987043 - RNA, 14 nt, Homo sapiens
auuguugcauuaaa

SEQ ID NO: 987044 - RNA, 17 nt, Homo sapiens
auuuaauucauguugcc

SEQ ID NO: 987045 - RNA, 19 nt, Homo sapiens
auuuauuuccuaguucugu

SEQ ID NO: 987046 - RNA, 22 nt, Homo sapiens
auuuccucauuuuuauaauguc

SEQ ID NO: 987047 - RNA, 20 nt, Homo sapiens
auuugggggacuuacaugau

SEQ ID NO: 987048 - RNA, 19 nt, Homo sapiens
auuuuaaacacauuaggaa

SEQ ID NO: 987049 - RNA, 18 nt, Homo sapiens
auuuuacauguggcccaa

SEQ ID NO: 987050 - RNA, 21 nt, Homo sapiens
auuuuuaauguuuguacacaa

SEQ ID NO: 987051 - RNA, 17 nt, Homo sapiens
auuuuuaccagucucac

SEQ ID NO: 987052 - RNA, 13 nt, Homo sapiens
auuuuuccauuua

SEQ ID NO: 987053 - RNA, 13 nt, Homo sapiens
auuuuuccauuuu

SEQ ID NO: 987054 - RNA, 14 nt, Homo sapiens
auuuuuucccccac

SEQ ID NO: 987055 - RNA, 20 nt, Homo sapiens
auuuuuuuagaaagcauuug

SEQ ID NO: 987056 - RNA, 11 nt, Homo sapiens
caaaacagggu

SEQ ID NO: 987057 - RNA, 11 nt, Homo sapiens
caaaaccaaau

SEQ ID NO: 987058 - RNA, 14 nt, Homo sapiens
caaaacccuuucug

SEQ ID NO: 987059 - RNA, 14 nt, Homo sapiens
caaacccuuucaua

SEQ ID NO: 987060 - RNA, 13 nt, Homo sapiens
caaacuccugacc

SEQ ID NO: 987061 - RNA, 22 nt, Homo sapiens
caaagaacuuggaaauagugau

SEQ ID NO: 987062 - RNA, 22 nt, Homo sapiens
caaagggggaggcuaaagccca

SEQ ID NO: 987063 - RNA, 20 nt, Homo sapiens
caaauagaauuugagcauca

SEQ ID NO: 987064 - RNA, 18 nt, Homo sapiens
caaauauaucugcuauuc

SEQ ID NO: 987065 - RNA, 23 nt, Homo sapiens
caaauauaucugcuauucuccau

SEQ ID NO: 987066 - RNA, 15 nt, Homo sapiens
caaauauuccagaga

SEQ ID NO: 987067 - RNA, 19 nt, Homo sapiens
caaaucuaccacuguauga

SEQ ID NO: 987068 - RNA, 15 nt, Homo sapiens
caaauuccaaauucu

SEQ ID NO: 987069 - RNA, 21 nt, Homo sapiens
caacacaauucuucuuccaac

SEQ ID NO: 987070 - RNA, 14 nt, Homo sapiens
caacagcacccucu

SEQ ID NO: 987071 - RNA, 16 nt, Homo sapiens
caaccaaaagucuuca

SEQ ID NO: 987072 - RNA, 20 nt, Homo sapiens
caacccuuucauuagaacuu

SEQ ID NO: 987073 - RNA, 16 nt, Homo sapiens
caacguggcccagaga

SEQ ID NO: 987074 - RNA, 18 nt, Homo sapiens
caacuuuuccuuugaauc

SEQ ID NO: 987075 - RNA, 12 nt, Homo sapiens
caagagccacag

SEQ ID NO: 987076 - RNA, 15 nt, Homo sapiens
caagagccacaguau

SEQ ID NO: 987077 - RNA, 16 nt, Homo sapiens
caagagccacaguaua

SEQ ID NO: 987078 - RNA, 23 nt, Homo sapiens
caagagccacaguauauuucccu

SEQ ID NO: 987079 - RNA, 16 nt, Homo sapiens
caagaggcuguuccca

SEQ ID NO: 987080 - RNA, 21 nt, Homo sapiens
caagauugugucccauucccc

SEQ ID NO: 987081 - RNA, 23 nt, Homo sapiens
caagccuugauugguguugccag

SEQ ID NO: 987082 - RNA, 14 nt, Homo sapiens
caaggaugucugcc

SEQ ID NO: 987083 - RNA, 16 nt, Homo sapiens
caaggaugucugccac

SEQ ID NO: 987084 - RNA, 20 nt, Homo sapiens
caagugcuucuccagccuca

SEQ ID NO: 987085 - RNA, 13 nt, Homo sapiens
caauaaagcaaug

SEQ ID NO: 987086 - RNA, 19 nt, Homo sapiens
caauaaagcaaugugguag

SEQ ID NO: 987087 - RNA, 19 nt, Homo sapiens
caaucaguagccagcaucu

SEQ ID NO: 987088 - RNA, 20 nt, Homo sapiens
caaucuguccguucacaugu

SEQ ID NO: 987089 - RNA, 14 nt, Homo sapiens
caaucuuugacaau

SEQ ID NO: 987090 - RNA, 22 nt, Homo sapiens
caauuaauuccuucagcacuuu

SEQ ID NO: 987091 - RNA, 13 nt, Homo sapiens
caauuauguuaaa

SEQ ID NO: 987092 - RNA, 13 nt, Homo sapiens
cacaaacccaagg

SEQ ID NO: 987093 - RNA, 20 nt, Homo sapiens
cacaaauaaaggaaacccag

SEQ ID NO: 987094 - RNA, 21 nt, Homo sapiens
cacaaaucagaccuggcugcu

SEQ ID NO: 987095 - RNA, 11 nt, Homo sapiens
cacaacaaucc

SEQ ID NO: 987096 - RNA, 20 nt, Homo sapiens
cacacagcaagucaggguug

SEQ ID NO: 987097 - RNA, 14 nt, Homo sapiens
cacaccauucaggu

SEQ ID NO: 987098 - RNA, 16 nt, Homo sapiens
cacagauguucaccca

SEQ ID NO: 987099 - RNA, 22 nt, Homo sapiens
cacagcuacacagaucacagcu

SEQ ID NO: 987100 - RNA, 13 nt, Homo sapiens
cacagcuaugaag

SEQ ID NO: 987101 - RNA, 14 nt, Homo sapiens
cacagcuaugaagg

SEQ ID NO: 987102 - RNA, 17 nt, Homo sapiens
cacagggagugcacaua

SEQ ID NO: 987103 - RNA, 13 nt, Homo sapiens
cacauacauguaa

SEQ ID NO: 987104 - RNA, 18 nt, Homo sapiens
cacauacccucacuuaaa

SEQ ID NO: 987105 - RNA, 17 nt, Homo sapiens
cacaugggaucaagucc

SEQ ID NO: 987106 - RNA, 22 nt, Homo sapiens
caccaagcugcuguggccauca

SEQ ID NO: 987107 - RNA, 17 nt, Homo sapiens
gagauagguacuauuau

SEQ ID NO: 987108 - RNA, 13 nt, Homo sapiens
gagauauuuacau

SEQ ID NO: 987109 - RNA, 15 nt, Homo sapiens
gagauuuuucaugau

SEQ ID NO: 987110 - RNA, 14 nt, Homo sapiens
gagcaaguccuucc

SEQ ID NO: 987111 - RNA, 20 nt, Homo sapiens
gagcagugcuugaaugaagu

SEQ ID NO: 987112 - RNA, 21 nt, Homo sapiens
gagcagugcuugaaugaaguu

SEQ ID NO: 987113 - RNA, 21 nt, Homo sapiens
gagcaguuugguuucuagcau

SEQ ID NO: 987114 - RNA, 22 nt, Homo sapiens
gagcaucaggccuagaggccug

SEQ ID NO: 987115 - RNA, 16 nt, Homo sapiens
gagccaggacccagga

SEQ ID NO: 987116 - RNA, 13 nt, Homo sapiens
gagcgcacaggga

SEQ ID NO: 987117 - RNA, 15 nt, Homo sapiens
gagcuccuaagccau

SEQ ID NO: 987118 - RNA, 13 nt, Homo sapiens
gagcuggaggcac

SEQ ID NO: 987119 - RNA, 13 nt, Homo sapiens
gagcugggcagaa

SEQ ID NO: 987120 - RNA, 21 nt, Homo sapiens
gagcugggcagaaggccaaga

SEQ ID NO: 987121 - RNA, 13 nt, Homo sapiens
gaggcuacuguaa

SEQ ID NO: 987122 - RNA, 21 nt, Homo sapiens
gaggcucuaauguacaauaaa

SEQ ID NO: 987123 - RNA, 15 nt, Homo sapiens
gaggcuguucccacc

SEQ ID NO: 987124 - RNA, 22 nt, Homo sapiens
gagucuuaauauauauauccag

SEQ ID NO: 987125 - RNA, 13 nt, Homo sapiens
gagugacucacua

SEQ ID NO: 987126 - RNA, 11 nt, Homo sapiens
gagugcagugg

SEQ ID NO: 987127 - RNA, 15 nt, Homo sapiens
gagugggcuaagcac

SEQ ID NO: 987128 - RNA, 12 nt, Homo sapiens
gauaaaagacag

SEQ ID NO: 987129 - RNA, 20 nt, Homo sapiens
gauaagacacccccucaaac

SEQ ID NO: 987130 - RNA, 19 nt, Homo sapiens
gauacccaaaggucaagaa

SEQ ID NO: 987131 - RNA, 18 nt, Homo sapiens
gauauccucccuccagau

SEQ ID NO: 987132 - RNA, 22 nt, Homo sapiens
gaucaaauugugcaguacuuug

SEQ ID NO: 987133 - RNA, 22 nt, Homo sapiens
gauccagaaagaaaacuuguau

SEQ ID NO: 987134 - RNA, 23 nt, Homo sapiens
gauccccccacagccccugguca

SEQ ID NO: 987135 - RNA, 19 nt, Homo sapiens
gaucccuagcugugaccuc

SEQ ID NO: 987136 - RNA, 20 nt, Homo sapiens
gaucggagccuccucucuca

SEQ ID NO: 987137 - RNA, 13 nt, Homo sapiens
gaucucagcucac

SEQ ID NO: 987138 - RNA, 22 nt, Homo sapiens
gaugacuuuuuauacuuuguaa

SEQ ID NO: 987139 - RNA, 21 nt, Homo sapiens
gaugagaguacaccccaacag

SEQ ID NO: 987140 - RNA, 21 nt, Homo sapiens
cgaaggaaaagggcuuucuca

SEQ ID NO: 987141 - RNA, 17 nt, Homo sapiens
cgauaaaagacagugaa

SEQ ID NO: 987142 - RNA, 18 nt, Homo sapiens
cgauuaauaacaggcaaa

SEQ ID NO: 987143 - RNA, 20 nt, Homo sapiens
cgcccuggacugugugcuca

SEQ ID NO: 987144 - RNA, 11 nt, Homo sapiens
cgcgaucucag

SEQ ID NO: 987145 - RNA, 13 nt, Homo sapiens
cgcgcccagccuu

SEQ ID NO: 987146 - RNA, 17 nt, Homo sapiens
cgcuuaucaacuaauga

SEQ ID NO: 987147 - RNA, 15 nt, Homo sapiens
cggaauugcucuccc

SEQ ID NO: 987148 - RNA, 17 nt, Homo sapiens
cggcaucaggcuuucuu

SEQ ID NO: 987149 - RNA, 14 nt, Homo sapiens
cggcuccucaggga

SEQ ID NO: 987150 - RNA, 21 nt, Homo sapiens
cggugagcuacaaaugcauuu

SEQ ID NO: 987151 - RNA, 17 nt, Homo sapiens
cgucaaagcugaaaugg

SEQ ID NO: 987152 - RNA, 14 nt, Homo sapiens
cguggguugcacug

SEQ ID NO: 987153 - RNA, 14 nt, Homo sapiens
aaaaagcauuauua

SEQ ID NO: 987154 - RNA, 17 nt, Homo sapiens
aaaaauaaaaaacacug

SEQ ID NO: 987155 - RNA, 15 nt, Homo sapiens
aaaacugugccuugu

SEQ ID NO: 987156 - RNA, 22 nt, Homo sapiens
aaaaggaaagaaaauaaaucua

SEQ ID NO: 987157 - RNA, 20 nt, Homo sapiens
aaaaggcuaagcuucacugu

SEQ ID NO: 987158 - RNA, 22 nt, Homo sapiens
aaaaggcuaagcuucacuguaa

SEQ ID NO: 987159 - RNA, 15 nt, Homo sapiens
aaaauauauaucaaa

SEQ ID NO: 987160 - RNA, 15 nt, Homo sapiens
aaaaucuuauaauuu

SEQ ID NO: 987161 - RNA, 22 nt, Homo sapiens
aaaauuuuuuuuguaacuggag

SEQ ID NO: 987162 - RNA, 19 nt, Homo sapiens
aaacaauaucagacuuuuu

SEQ ID NO: 987163 - RNA, 19 nt, Homo sapiens
aaacaauucuuauugacuc

SEQ ID NO: 987164 - RNA, 13 nt, Homo sapiens
aaacacucuugaa

SEQ ID NO: 987165 - RNA, 22 nt, Homo sapiens
aaacccaguaguggugacugug

SEQ ID NO: 987166 - RNA, 14 nt, Homo sapiens
aaaccuuuguuugc

SEQ ID NO: 987167 - RNA, 23 nt, Homo sapiens
aaacuagguaaaaucuacaguac

SEQ ID NO: 987168 - RNA, 20 nt, Homo sapiens
aaacugcaaagcucggugcu

SEQ ID NO: 987169 - RNA, 21 nt, Homo sapiens
aaacugcugucccaaacaugc

SEQ ID NO: 987170 - RNA, 22 nt, Homo sapiens
aaacugcugucccaaacaugca

SEQ ID NO: 987171 - RNA, 14 nt, Homo sapiens
aaacuggauucaca

SEQ ID NO: 987172 - RNA, 10 nt, Homo sapiens
aaacugguag

SEQ ID NO: 987173 - RNA, 22 nt, Homo sapiens
aaagaggacaggcuaccccuuu

SEQ ID NO: 987174 - RNA, 14 nt, Homo sapiens
aaagcaaagcucuu

SEQ ID NO: 987175 - RNA, 17 nt, Homo sapiens
aaagccuucauugccuu

SEQ ID NO: 987176 - RNA, 21 nt, Homo sapiens
aaaggauaaugaauacuuuau

SEQ ID NO: 987177 - RNA, 17 nt, Homo sapiens
aaaggcuaugauugucu

SEQ ID NO: 987178 - RNA, 15 nt, Homo sapiens
aaagggacugagaaa

SEQ ID NO: 987179 - RNA, 22 nt, Homo sapiens
aaagggccaauaaauaugaugu

SEQ ID NO: 987180 - RNA, 14 nt, Homo sapiens
aaagggcuuucuca

SEQ ID NO: 987181 - RNA, 21 nt, Homo sapiens
aaagguaaaucagacuaugaa

SEQ ID NO: 987182 - RNA, 20 nt, Homo sapiens
aaaguguuugaaagcuuuau

SEQ ID NO: 987183 - RNA, 16 nt, Homo sapiens
aaauaauuuuucacuu

SEQ ID NO: 987184 - RNA, 20 nt, Homo sapiens
aaauaauuuuucacuucaaa

SEQ ID NO: 987185 - RNA, 14 nt, Homo sapiens
aaauacuacugugu

SEQ ID NO: 987186 - RNA, 22 nt, Homo sapiens
aaauaguugcugucauccacuu

SEQ ID NO: 987187 - RNA, 23 nt, Homo sapiens
aaauaguugcugucauccacuuu

SEQ ID NO: 987188 - RNA, 15 nt, Homo sapiens
aaauauaucugcuau

SEQ ID NO: 987189 - RNA, 17 nt, Homo sapiens
aaauauguucugacaua

SEQ ID NO: 987190 - RNA, 12 nt, Homo sapiens
aaauauuuugcu

SEQ ID NO: 987191 - RNA, 14 nt, Homo sapiens
aaaucagacuauga

SEQ ID NO: 987192 - RNA, 22 nt, Homo sapiens
aaauccacuuuaucuugaauaa

SEQ ID NO: 987193 - RNA, 22 nt, Homo sapiens
aaaucuaaaaaacgaaaagucu

SEQ ID NO: 987194 - RNA, 16 nt, Homo sapiens
aaaucuaccacuguau

SEQ ID NO: 987195 - RNA, 20 nt, Homo sapiens
aaaucuuucuuucuuagaaa

SEQ ID NO: 987196 - RNA, 15 nt, Homo sapiens
aaauggaggccuguc

SEQ ID NO: 987197 - RNA, 15 nt, Homo sapiens
aaaugucuugcuuga

SEQ ID NO: 987198 - RNA, 15 nt, Homo sapiens
aaauuaugauaagga

SEQ ID NO: 987199 - RNA, 15 nt, Homo sapiens
aaauucgcaaacuuu

SEQ ID NO: 987200 - RNA, 17 nt, Homo sapiens
aaauucucacagaagaa

SEQ ID NO: 987201 - RNA, 16 nt, Homo sapiens
aaauugccauauugca

SEQ ID NO: 987202 - RNA, 21 nt, Homo sapiens
aaauuuauuuccuaguucugu

SEQ ID NO: 987203 - RNA, 16 nt, Homo sapiens
aacaaagucacccacu

SEQ ID NO: 987204 - RNA, 20 nt, Homo sapiens
aacaacguugacaaguuuug

SEQ ID NO: 987205 - RNA, 13 nt, Homo sapiens
aacaaguacuucu

SEQ ID NO: 987206 - RNA, 14 nt, Homo sapiens
aacacggugcucau

SEQ ID NO: 987207 - RNA, 17 nt, Homo sapiens
aacagccacuacauuac

SEQ ID NO: 987208 - RNA, 16 nt, Homo sapiens
aacaugaauauuuagu

SEQ ID NO: 987209 - RNA, 16 nt, Homo sapiens
aacauguuucuuugua

SEQ ID NO: 987210 - RNA, 14 nt, Homo sapiens
aacauuacucugaa

SEQ ID NO: 987211 - RNA, 16 nt, Homo sapiens
aaccagaccauugucu

SEQ ID NO: 987212 - RNA, 14 nt, Homo sapiens
aaccagauugucag

SEQ ID NO: 987213 - RNA, 17 nt, Homo sapiens
aaccaggacccugucca

SEQ ID NO: 987214 - RNA, 17 nt, Homo sapiens
aaccaucaccagaauua

SEQ ID NO: 987215 - RNA, 18 nt, Homo sapiens
aacccucuggggagcuca

SEQ ID NO: 987216 - RNA, 20 nt, Homo sapiens
aaccuccaccuccuggguuc

SEQ ID NO: 987217 - RNA, 16 nt, Homo sapiens
aaccugaaauuaacuc

SEQ ID NO: 987218 - RNA, 18 nt, Homo sapiens
aacuagccaaaccaggac

SEQ ID NO: 987219 - RNA, 17 nt, Homo sapiens
aacuaggugcauauuua

SEQ ID NO: 987220 - RNA, 15 nt, Homo sapiens
aacucaucugucacc

SEQ ID NO: 987221 - RNA, 16 nt, Homo sapiens
aacucauuucuagcag

SEQ ID NO: 987222 - RNA, 16 nt, Homo sapiens
aacuccugaccucagg

SEQ ID NO: 987223 - RNA, 18 nt, Homo sapiens
aacuccuguuucacuugg

SEQ ID NO: 987224 - RNA, 18 nt, Homo sapiens
aacucucuuauugccuca

SEQ ID NO: 987225 - RNA, 23 nt, Homo sapiens
aacucugagcagugcuugaauga

SEQ ID NO: 987226 - RNA, 19 nt, Homo sapiens
aacucuguuuucuuucuaa

SEQ ID NO: 987227 - RNA, 14 nt, Homo sapiens
aacugauuuaucua

SEQ ID NO: 987228 - RNA, 15 nt, Homo sapiens
aacugcucauaugau

SEQ ID NO: 987229 - RNA, 12 nt, Homo sapiens
aacugucucuca

SEQ ID NO: 987230 - RNA, 13 nt, Homo sapiens
aacugugccuugu

SEQ ID NO: 987231 - RNA, 19 nt, Homo sapiens
aacuucuccuacuguagca

SEQ ID NO: 987232 - RNA, 15 nt, Homo sapiens
aacuugcugcugagu

SEQ ID NO: 987233 - RNA, 14 nt, Homo sapiens
aagaaauuuuugcc

SEQ ID NO: 987234 - RNA, 14 nt, Homo sapiens
aagaacucucugga

SEQ ID NO: 987235 - RNA, 22 nt, Homo sapiens
aagaaguuggggacacauguau

SEQ ID NO: 987236 - RNA, 21 nt, Homo sapiens
aagacuacauauugucacuga

SEQ ID NO: 987237 - RNA, 16 nt, Homo sapiens
aagauauuuuucauga

SEQ ID NO: 987238 - RNA, 19 nt, Homo sapiens
aagaucuuuuauuuugcca

SEQ ID NO: 987239 - RNA, 11 nt, Homo sapiens
aagauuacuuu

SEQ ID NO: 987240 - RNA, 19 nt, Homo sapiens
aagauugugucccauuccc

SEQ ID NO: 987241 - RNA, 23 nt, Homo sapiens
aagcagagguggcgauuuguuaa

SEQ ID NO: 987242 - RNA, 17 nt, Homo sapiens
aagcaggaaucagagac

SEQ ID NO: 987243 - RNA, 20 nt, Homo sapiens
aagccuaagggauccugccu

SEQ ID NO: 987244 - RNA, 17 nt, Homo sapiens
aagcgauucucuugccu

SEQ ID NO: 987245 - RNA, 12 nt, Homo sapiens
aagcuuugaacc

SEQ ID NO: 987246 - RNA, 18 nt, Homo sapiens
aaggauggagccagcucu

SEQ ID NO: 987247 - RNA, 12 nt, Homo sapiens
aaggaugucugc

SEQ ID NO: 987248 - RNA, 21 nt, Homo sapiens
aaggcauuucuuuucugcaug

SEQ ID NO: 987249 - RNA, 14 nt, Homo sapiens
aagggucacaauac

SEQ ID NO: 987250 - RNA, 20 nt, Homo sapiens
aagguuggaggaucauuuga

SEQ ID NO: 987251 - RNA, 22 nt, Homo sapiens
aagugauaucccccagccucaa

SEQ ID NO: 987252 - RNA, 21 nt, Homo sapiens
aagugcuaauuuugaaaaacu

SEQ ID NO: 987253 - RNA, 16 nt, Homo sapiens
aagugcuuucuucucc

SEQ ID NO: 987254 - RNA, 21 nt, Homo sapiens
aaguugauuuuaagaauccaa

SEQ ID NO: 987255 - RNA, 12 nt, Homo sapiens
aaguuucauccg

SEQ ID NO: 987256 - RNA, 13 nt, Homo sapiens
aauaaaaaacacu

SEQ ID NO: 987257 - RNA, 14 nt, Homo sapiens
aauaaaguauuuaa

SEQ ID NO: 987258 - RNA, 15 nt, Homo sapiens
aauaaauauccuuua

SEQ ID NO: 987259 - RNA, 23 nt, Homo sapiens
aauaacgauaaaagacagugaaa

SEQ ID NO: 987260 - RNA, 23 nt, Homo sapiens
aauaagcaggcgugaccugccag

SEQ ID NO: 987261 - RNA, 21 nt, Homo sapiens
aauauuuauuuaacuauucau

SEQ ID NO: 987262 - RNA, 18 nt, Homo sapiens
aauauuugaaucuugucu

SEQ ID NO: 987263 - RNA, 17 nt, Homo sapiens
aaucaaagaacuucucc

SEQ ID NO: 987264 - RNA, 21 nt, Homo sapiens
aaucaagacugcaaacccuuu

SEQ ID NO: 987265 - RNA, 16 nt, Homo sapiens
aaucagacuaugaagu

SEQ ID NO: 987266 - RNA, 16 nt, Homo sapiens
aaucaugaaacucccu

SEQ ID NO: 987267 - RNA, 20 nt, Homo sapiens
aaucauucauuuucugggug

SEQ ID NO: 987268 - RNA, 21 nt, Homo sapiens
aauccagccugcugccugcuu

SEQ ID NO: 987269 - RNA, 22 nt, Homo sapiens
aaucccagcaugcugagauuac

SEQ ID NO: 987270 - RNA, 19 nt, Homo sapiens
aauccucccacuucagccu

SEQ ID NO: 987271 - RNA, 15 nt, Homo sapiens
aaugaaaugaguuuu

SEQ ID NO: 987272 - RNA, 15 nt, Homo sapiens
aaugaauacaauuaa

SEQ ID NO: 987273 - RNA, 23 nt, Homo sapiens
aaugagcaaaaccaaauauucca

SEQ ID NO: 987274 - RNA, 13 nt, Homo sapiens
aaugcauguugcc

SEQ ID NO: 987275 - RNA, 17 nt, Homo sapiens
aaugcauuauggguggu

SEQ ID NO: 987276 - RNA, 16 nt, Homo sapiens
aauguacaauaaagca

SEQ ID NO: 987277 - RNA, 19 nt, Homo sapiens
aaugucaauucuugccaaa

SEQ ID NO: 987278 - RNA, 14 nt, Homo sapiens
aauuaagacuuuau

SEQ ID NO: 987279 - RNA, 13 nt, Homo sapiens
aauuaucuuaaaa

SEQ ID NO: 987280 - RNA, 15 nt, Homo sapiens
aauucaaaggcauuu

SEQ ID NO: 987281 - RNA, 16 nt, Homo sapiens
aauucauccucacuca

SEQ ID NO: 987282 - RNA, 14 nt, Homo sapiens
aauucuaugagaua

SEQ ID NO: 987283 - RNA, 20 nt, Homo sapiens
aauucugucauuucaaagac

SEQ ID NO: 987284 - RNA, 20 nt, Homo sapiens
aauucuuauugacucauaca

SEQ ID NO: 987285 - RNA, 13 nt, Homo sapiens
aauucuugccaaa

SEQ ID NO: 987286 - RNA, 21 nt, Homo sapiens
aauugagcuggaccucaccaa

SEQ ID NO: 987287 - RNA, 17 nt, Homo sapiens
aauugaucgacuugcca

SEQ ID NO: 987288 - RNA, 18 nt, Homo sapiens
aauuguuaguuucugagu

SEQ ID NO: 987289 - RNA, 14 nt, Homo sapiens
aauuucuauuugau

SEQ ID NO: 987290 - RNA, 18 nt, Homo sapiens
aauuugggggacuuacau

SEQ ID NO: 987291 - RNA, 16 nt, Homo sapiens
aauuuugaaaaacugc

SEQ ID NO: 987292 - RNA, 20 nt, Homo sapiens
aauuuugaaaaacugcucau

SEQ ID NO: 987293 - RNA, 19 nt, Homo sapiens
acaaaaaaaaaauuugcca

SEQ ID NO: 987294 - RNA, 14 nt, Homo sapiens
acaaaaccacugga

SEQ ID NO: 987295 - RNA, 11 nt, Homo sapiens
acaaacagggc

SEQ ID NO: 987296 - RNA, 20 nt, Homo sapiens
acaacagguaaaacagggcc

SEQ ID NO: 987297 - RNA, 19 nt, Homo sapiens
acaacuugucuauuaccug

SEQ ID NO: 987298 - RNA, 18 nt, Homo sapiens
acaagcacuaaacaaaga

SEQ ID NO: 987299 - RNA, 22 nt, Homo sapiens
acaagcauucugucuugaaggg

SEQ ID NO: 987300 - RNA, 17 nt, Homo sapiens
acaauaaagcaaugugg

SEQ ID NO: 987301 - RNA, 18 nt, Homo sapiens
acaauaauuuucuaccug

SEQ ID NO: 987302 - RNA, 23 nt, Homo sapiens
acaauccuucuauucuagccugc

SEQ ID NO: 987303 - RNA, 15 nt, Homo sapiens
acacagaucacagcu

SEQ ID NO: 987304 - RNA, 19 nt, Homo sapiens
acaccauucaggucuuucu

SEQ ID NO: 987305 - RNA, 19 nt, Homo sapiens
acacccagucuguucccca

SEQ ID NO: 987306 - RNA, 17 nt, Homo sapiens
acacucaugcauugucc

SEQ ID NO: 987307 - RNA, 20 nt, Homo sapiens
acacugcacgaauggaagag

SEQ ID NO: 987308 - RNA, 19 nt, Homo sapiens
acagaagaaggaaauugaa

SEQ ID NO: 987309 - RNA, 13 nt, Homo sapiens
acagaaucucagu

SEQ ID NO: 987310 - RNA, 18 nt, Homo sapiens
acagacauccucuaugcc

SEQ ID NO: 987311 - RNA, 20 nt, Homo sapiens
acagagucuuccucugucuc

SEQ ID NO: 987312 - RNA, 16 nt, Homo sapiens
acagcaagucaggguu

SEQ ID NO: 987313 - RNA, 19 nt, Homo sapiens
acagcacccucuccagaug

SEQ ID NO: 987314 - RNA, 15 nt, Homo sapiens
acagcuacacagauc

SEQ ID NO: 987315 - RNA, 18 nt, Homo sapiens
acagcuacacagaucaca

SEQ ID NO: 987316 - RNA, 18 nt, Homo sapiens
acaggagcuuaaacagcu

SEQ ID NO: 987317 - RNA, 21 nt, Homo sapiens
acaggaugaugacuauggaaa

SEQ ID NO: 987318 - RNA, 20 nt, Homo sapiens
acaggauguuugcucagcuu

SEQ ID NO: 987319 - RNA, 14 nt, Homo sapiens
acaguaaaauccac

SEQ ID NO: 987320 - RNA, 19 nt, Homo sapiens
acagucuaacaaauuccaa

SEQ ID NO: 987321 - RNA, 20 nt, Homo sapiens
acagugacuccacucugagu

SEQ ID NO: 987322 - RNA, 22 nt, Homo sapiens
acauacaccuaugucauuucau

SEQ ID NO: 987323 - RNA, 17 nt, Homo sapiens
acauccauucuucccuu

SEQ ID NO: 987324 - RNA, 23 nt, Homo sapiens
acaugaauauuuaguguucauaa

SEQ ID NO: 987325 - RNA, 19 nt, Homo sapiens
acaugcauacacucucaaa

SEQ ID NO: 987326 - RNA, 17 nt, Homo sapiens
acaugcauuacugcaug

SEQ ID NO: 987327 - RNA, 14 nt, Homo sapiens
acauguggcccaac

SEQ ID NO: 987328 - RNA, 15 nt, Homo sapiens
acauucgaccuccau

SEQ ID NO: 987329 - RNA, 22 nt, Homo sapiens
acauuucucauaccuuccccac

SEQ ID NO: 987330 - RNA, 20 nt, Homo sapiens
accaaccuuuucccaaccau

SEQ ID NO: 987331 - RNA, 16 nt, Homo sapiens
accacuguguauuuaa

SEQ ID NO: 987332 - RNA, 14 nt, Homo sapiens
accaggcugcucag

SEQ ID NO: 987333 - RNA, 12 nt, Homo sapiens
accauacaaaaa

SEQ ID NO: 987334 - RNA, 17 nt, Homo sapiens
accauauacagcucaga

SEQ ID NO: 987335 - RNA, 12 nt, Homo sapiens
accaugcugcug

SEQ ID NO: 987336 - RNA, 14 nt, Homo sapiens
accauggccagcua

SEQ ID NO: 987337 - RNA, 22 nt, Homo sapiens
accauguuggcuagacuagucu

SEQ ID NO: 987338 - RNA, 18 nt, Homo sapiens
accauuagcauuugucaa

SEQ ID NO: 987339 - RNA, 22 nt, Homo sapiens
acccaggaguauccucuugcca

SEQ ID NO: 987340 - RNA, 15 nt, Homo sapiens
acccaguagaugcca

SEQ ID NO: 987341 - RNA, 16 nt, Homo sapiens
acccaguagaugccac

SEQ ID NO: 987342 - RNA, 22 nt, Homo sapiens
accccaacagcacccucuccag

SEQ ID NO: 987343 - RNA, 17 nt, Homo sapiens
accccuguuucuggcac

SEQ ID NO: 987344 - RNA, 17 nt, Homo sapiens
acccguucaacuuuucc

SEQ ID NO: 987345 - RNA, 18 nt, Homo sapiens
acccucacuuaaacuuuu

SEQ ID NO: 987346 - RNA, 16 nt, Homo sapiens
acccucagaugcacau

SEQ ID NO: 987347 - RNA, 14 nt, Homo sapiens
acccuuucauaaag

SEQ ID NO: 987348 - RNA, 18 nt, Homo sapiens
accguguaccucaguucc

SEQ ID NO: 987349 - RNA, 22 nt, Homo sapiens
accuaaacauagaaauugccug

SEQ ID NO: 987350 - RNA, 15 nt, Homo sapiens
accuacuuacaugca

SEQ ID NO: 987351 - RNA, 20 nt, Homo sapiens
gcuggagugcaguggcgcga

SEQ ID NO: 987352 - RNA, 14 nt, Homo sapiens
gcuguacacugcac

SEQ ID NO: 987353 - RNA, 22 nt, Homo sapiens
gcugugggcaagccuaagggau

SEQ ID NO: 987354 - RNA, 13 nt, Homo sapiens
gcuguugcugaau

SEQ ID NO: 987355 - RNA, 15 nt, Homo sapiens
gcuuaacccuggaaa

SEQ ID NO: 987356 - RNA, 22 nt, Homo sapiens
gcuuggacugaagggguucuca

SEQ ID NO: 987357 - RNA, 22 nt, Homo sapiens
ggaaaaaauaacaaugaaaguu

SEQ ID NO: 987358 - RNA, 14 nt, Homo sapiens
ggaaagauuacuuu

SEQ ID NO: 987359 - RNA, 23 nt, Homo sapiens
ggaaauagcccuguaacaggcuu

SEQ ID NO: 987360 - RNA, 18 nt, Homo sapiens
ggaaauagugauuuccac

SEQ ID NO: 987361 - RNA, 21 nt, Homo sapiens
ggaauccuggggaacauagaa

SEQ ID NO: 987362 - RNA, 11 nt, Homo sapiens
ggaaugaagca

SEQ ID NO: 987363 - RNA, 12 nt, Homo sapiens
ggaauguaggga

SEQ ID NO: 987364 - RNA, 19 nt, Homo sapiens
ggaauuucuguucuuccau

SEQ ID NO: 987365 - RNA, 17 nt, Homo sapiens
ggacacuuuuauguuaa

SEQ ID NO: 987366 - RNA, 20 nt, Homo sapiens
ggacuaaguguaccagagaa

SEQ ID NO: 987367 - RNA, 19 nt, Homo sapiens
ggacugaagggguucucac

SEQ ID NO: 987368 - RNA, 17 nt, Homo sapiens
ggagacaaaacuagaga

SEQ ID NO: 987369 - RNA, 24 nt, Homo sapiens
ggagaggggccucaaaugcaccau

SEQ ID NO: 987370 - RNA, 18 nt, Homo sapiens
ggagcccacacaugggau

SEQ ID NO: 987371 - RNA, 20 nt, Homo sapiens
ggagcugggcagaaggccaa

SEQ ID NO: 987372 - RNA, 22 nt, Homo sapiens
ggaggcaggaguuucguuuuca

SEQ ID NO: 987373 - RNA, 15 nt, Homo sapiens
ggagguaaugaauua

SEQ ID NO: 987374 - RNA, 19 nt, Homo sapiens
ggagguggcuggguuuaca

SEQ ID NO: 987375 - RNA, 22 nt, Homo sapiens
ggaguacaccccaacagcaccc

SEQ ID NO: 987376 - RNA, 17 nt, Homo sapiens
ggagugcccccaacagc

SEQ ID NO: 987377 - RNA, 23 nt, Homo sapiens
ggauacgcaucagacagauggaa

SEQ ID NO: 987378 - RNA, 20 nt, Homo sapiens
ggauauccucccuccagaua

SEQ ID NO: 987379 - RNA, 13 nt, Homo sapiens
ggaugucugccac

SEQ ID NO: 987380 - RNA, 23 nt, Homo sapiens
ggaugucugccacaccucuccaa

SEQ ID NO: 987381 - RNA, 18 nt, Homo sapiens
ggauuauauuaugaagcu

SEQ ID NO: 987382 - RNA, 16 nt, Homo sapiens
ggcaauuaauuccuuc

SEQ ID NO: 987383 - RNA, 23 nt, Homo sapiens
ggcaauuaauuccuucagcacuu

SEQ ID NO: 987384 - RNA, 19 nt, Homo sapiens
ggcaugaaggugucauaca

SEQ ID NO: 987385 - RNA, 15 nt, Homo sapiens
ggccaauaaauauga

SEQ ID NO: 987386 - RNA, 17 nt, Homo sapiens
ggccacauagaugcuga

SEQ ID NO: 987387 - RNA, 21 nt, Homo sapiens
ggccacauagaugcugaugga

SEQ ID NO: 987388 - RNA, 19 nt, Homo sapiens
ggccucugagaagcucuga

SEQ ID NO: 987389 - RNA, 18 nt, Homo sapiens
ggccucuucugcuuucuc

SEQ ID NO: 987390 - RNA, 17 nt, Homo sapiens
ggccuggcaagugggug

SEQ ID NO: 987391 - RNA, 19 nt, Homo sapiens
ggccuguacccaguagaug

SEQ ID NO: 987392 - RNA, 16 nt, Homo sapiens
ggccuguggaucaaau

SEQ ID NO: 987393 - RNA, 13 nt, Homo sapiens
ggcuagacaguuc

SEQ ID NO: 987394 - RNA, 15 nt, Homo sapiens
ggcucuaauguacaa

SEQ ID NO: 987395 - RNA, 17 nt, Homo sapiens
ggcucuaauguacaaua

SEQ ID NO: 987396 - RNA, 20 nt, Homo sapiens
ggcucucuugugcauuguag

SEQ ID NO: 987397 - RNA, 20 nt, Homo sapiens
ggcucuggagcccacuguac

SEQ ID NO: 987398 - RNA, 20 nt, Homo sapiens
ggcuuacacccacaguggaa

SEQ ID NO: 987399 - RNA, 15 nt, Homo sapiens
ggcuuccuucauuuc

SEQ ID NO: 987400 - RNA, 22 nt, Homo sapiens
gggaaagggauuuucagcccuc

SEQ ID NO: 987401 - RNA, 13 nt, Homo sapiens
gggaaaugccuuu

SEQ ID NO: 987402 - RNA, 11 nt, Homo sapiens
gggaagacagu

SEQ ID NO: 987403 - RNA, 18 nt, Homo sapiens
gggccaaaaguauccaag

SEQ ID NO: 987404 - RNA, 13 nt, Homo sapiens
gggguagccugag

SEQ ID NO: 987405 - RNA, 18 nt, Homo sapiens
ggguggugagaaccggag

SEQ ID NO: 987406 - RNA, 21 nt, Homo sapiens
gguaaccccagauucaugcac

SEQ ID NO: 987407 - RNA, 14 nt, Homo sapiens
gguaagcaccagga

SEQ ID NO: 987408 - RNA, 16 nt, Homo sapiens
ggugguaagcaccagg

SEQ ID NO: 987409 - RNA, 15 nt, Homo sapiens
gguuggagugcagug

SEQ ID NO: 987410 - RNA, 17 nt, Homo sapiens
gguuucuccagagggaa

SEQ ID NO: 987411 - RNA, 13 nt, Homo sapiens
guaaaaagaaaua

SEQ ID NO: 987412 - RNA, 21 nt, Homo sapiens
guaaaagcaucacaugaacuu

SEQ ID NO: 987413 - RNA, 20 nt, Homo sapiens
guaaaauuacacuuugaacu

SEQ ID NO: 987414 - RNA, 18 nt, Homo sapiens
guaaaucagacuaugaag

SEQ ID NO: 987415 - RNA, 11 nt, Homo sapiens
guaaaugugau

SEQ ID NO: 987416 - RNA, 16 nt, Homo sapiens
guaacucaucugucac

SEQ ID NO: 987417 - RNA, 21 nt, Homo sapiens
guacaauaaagcaauguggua

SEQ ID NO: 987418 - RNA, 19 nt, Homo sapiens
guacaccccaacagcaccc

SEQ ID NO: 987419 - RNA, 18 nt, Homo sapiens
guaccaggugaacaaagu

SEQ ID NO: 987420 - RNA, 20 nt, Homo sapiens
guacuauuauccccauuucu

SEQ ID NO: 987421 - RNA, 23 nt, Homo sapiens
guagaagauugagauguguucac

SEQ ID NO: 987422 - RNA, 19 nt, Homo sapiens
guagaagccacgguguucu

SEQ ID NO: 987423 - RNA, 21 nt, Homo sapiens
guagaugccacccaguuguga

SEQ ID NO: 987424 - RNA, 16 nt, Homo sapiens
guagcauccucuuuaa

SEQ ID NO: 987425 - RNA, 19 nt, Homo sapiens
guagcugagacuacaggca

SEQ ID NO: 987426 - RNA, 17 nt, Homo sapiens
guauauuucccuguuuc

SEQ ID NO: 987427 - RNA, 14 nt, Homo sapiens
guauccucuugcca

SEQ ID NO: 987428 - RNA, 15 nt, Homo sapiens
guauguguaucucac

SEQ ID NO: 987429 - RNA, 20 nt, Homo sapiens
gucaacaaagucacccacuu

SEQ ID NO: 987430 - RNA, 13 nt, Homo sapiens
gucacagccacuu

SEQ ID NO: 987431 - RNA, 18 nt, Homo sapiens
gucacagccacuugggau

SEQ ID NO: 987432 - RNA, 22 nt, Homo sapiens
gucacccagguuggagugcagu

SEQ ID NO: 987433 - RNA, 23 nt, Homo sapiens
gucacgcuuucaugaauucuguc

SEQ ID NO: 987434 - RNA, 13 nt, Homo sapiens
gucagacuggaua

SEQ ID NO: 987435 - RNA, 20 nt, Homo sapiens
gucagaguuccgacugccau

SEQ ID NO: 987436 - RNA, 20 nt, Homo sapiens
gucauaaugguuuuuaacac

SEQ ID NO: 987437 - RNA, 17 nt, Homo sapiens
gucauguggcuaccugu

SEQ ID NO: 987438 - RNA, 16 nt, Homo sapiens
gucccuccacauuucc

SEQ ID NO: 987439 - RNA, 16 nt, Homo sapiens
guccugaccugucuca

SEQ ID NO: 987440 - RNA, 18 nt, Homo sapiens
gucuccaacggcaaggga

SEQ ID NO: 987441 - RNA, 17 nt, Homo sapiens
gucucuacccaguagau

SEQ ID NO: 987442 - RNA, 18 nt, Homo sapiens
gucucuacccaguagaug

SEQ ID NO: 987443 - RNA, 22 nt, Homo sapiens
gucucuacccaguagaugccac

SEQ ID NO: 987444 - RNA, 22 nt, Homo sapiens
gucugagagauucaugcugauu

SEQ ID NO: 987445 - RNA, 16 nt, Homo sapiens
gucuucguacugggaa

SEQ ID NO: 987446 - RNA, 16 nt, Homo sapiens
gucuucguauucccau

SEQ ID NO: 987447 - RNA, 15 nt, Homo sapiens
gugaaaugcagaguc

SEQ ID NO: 987448 - RNA, 21 nt, Homo sapiens
gugaacaaaguuuaccagaaa

SEQ ID NO: 987449 - RNA, 21 nt, Homo sapiens
gugacaauuaaaagugucuug

SEQ ID NO: 987450 - RNA, 13 nt, Homo sapiens
gugaccaaccuuu

SEQ ID NO: 987451 - RNA, 22 nt, Homo sapiens
gugaccugccaggcacacugag

SEQ ID NO: 987452 - RNA, 12 nt, Homo sapiens
gugacugcaaua

SEQ ID NO: 987453 - RNA, 15 nt, Homo sapiens
gugauuuacgcucau

SEQ ID NO: 987454 - RNA, 18 nt, Homo sapiens
gugcaccacuucaaguga

SEQ ID NO: 987455 - RNA, 15 nt, Homo sapiens
gugcacgcacacugu

SEQ ID NO: 987456 - RNA, 20 nt, Homo sapiens
gugcaguuguaggcauguag

SEQ ID NO: 987457 - RNA, 16 nt, Homo sapiens
gugcauuuaugagcuc

SEQ ID NO: 987458 - RNA, 17 nt, Homo sapiens
gugcauuuaugagcucu

SEQ ID NO: 987459 - RNA, 17 nt, Homo sapiens
gugcuaucgcaccacug

SEQ ID NO: 987460 - RNA, 15 nt, Homo sapiens
gugcuggaaauggac

SEQ ID NO: 987461 - RNA, 18 nt, Homo sapiens
gugcuggcauuacaggug

SEQ ID NO: 987462 - RNA, 19 nt, Homo sapiens
gugcugggauuaacaggua

SEQ ID NO: 987463 - RNA, 22 nt, Homo sapiens
gugcuguauaaaaucagccaau

SEQ ID NO: 987464 - RNA, 18 nt, Homo sapiens
gugcuuguaaaaagucaa

SEQ ID NO: 987465 - RNA, 21 nt, Homo sapiens
guggaauuuaaaucacucaaa

SEQ ID NO: 987466 - RNA, 20 nt, Homo sapiens
guggaggcggaauugcucuc

SEQ ID NO: 987467 - RNA, 16 nt, Homo sapiens
guggauguaaagugau

SEQ ID NO: 987468 - RNA, 17 nt, Homo sapiens
guggcaggaaaauggac

SEQ ID NO: 987469 - RNA, 20 nt, Homo sapiens
guggcaucaucucagcucac

SEQ ID NO: 987470 - RNA, 16 nt, Homo sapiens
guggccaucaaccucu

SEQ ID NO: 987471 - RNA, 14 nt, Homo sapiens
guggcgcgaucuca

SEQ ID NO: 987472 - RNA, 20 nt, Homo sapiens
guguaagaacaacuaccuga

SEQ ID NO: 987473 - RNA, 16 nt, Homo sapiens
guguaagggccagaaa

SEQ ID NO: 987474 - RNA, 23 nt, Homo sapiens
guguaccucaguucccucuugcu

SEQ ID NO: 987475 - RNA, 16 nt, Homo sapiens
guguaguaaaguauca

SEQ ID NO: 987476 - RNA, 19 nt, Homo sapiens
guguuacccaguaacucau

SEQ ID NO: 987477 - RNA, 23 nt, Homo sapiens
guguuacccaguaacucaucugu

SEQ ID NO: 987478 - RNA, 19 nt, Homo sapiens
guguuuauccuaucucucc

SEQ ID NO: 987479 - RNA, 16 nt, Homo sapiens
guguuuuuaacauguc

SEQ ID NO: 987480 - RNA, 22 nt, Homo sapiens
guuaaacuaaggcccucuugaa

SEQ ID NO: 987481 - RNA, 12 nt, Homo sapiens
guuaggucucaa

SEQ ID NO: 987482 - RNA, 16 nt, Homo sapiens
ccaggaguacacccca

SEQ ID NO: 987483 - RNA, 14 nt, Homo sapiens
ccaggauacuggca

SEQ ID NO: 987484 - RNA, 16 nt, Homo sapiens
ccaggauggcgcagga

SEQ ID NO: 987485 - RNA, 21 nt, Homo sapiens
ccaggcccugcucuuccucag

SEQ ID NO: 987486 - RNA, 17 nt, Homo sapiens
ccaggcuggagugcagu

SEQ ID NO: 987487 - RNA, 16 nt, Homo sapiens
ccaggcuggucucaaa

SEQ ID NO: 987488 - RNA, 22 nt, Homo sapiens
ccaggcuuuuuuaucaugugaa

SEQ ID NO: 987489 - RNA, 14 nt, Homo sapiens
ccaguagaugccac

SEQ ID NO: 987490 - RNA, 19 nt, Homo sapiens
ccagugcaccugucauaug

SEQ ID NO: 987491 - RNA, 15 nt, Homo sapiens
ccauaugaauaacau

SEQ ID NO: 987492 - RNA, 14 nt, Homo sapiens
ccauccuaccacaa

SEQ ID NO: 987493 - RNA, 17 nt, Homo sapiens
ccaucuccucagcaccc

SEQ ID NO: 987494 - RNA, 10 nt, Homo sapiens
ccaucugauu

SEQ ID NO: 987495 - RNA, 15 nt, Homo sapiens
ccauuagaccaagcu

SEQ ID NO: 987496 - RNA, 20 nt, Homo sapiens
ccauucaggucuuucuuucc

SEQ ID NO: 987497 - RNA, 16 nt, Homo sapiens
cccaaguuauccaccu

SEQ ID NO: 987498 - RNA, 13 nt, Homo sapiens
cccacaguggaaa

SEQ ID NO: 987499 - RNA, 21 nt, Homo sapiens
cccacuuaccuugcaucucac

SEQ ID NO: 987500 - RNA, 17 nt, Homo sapiens
cccagagccacaguucc

SEQ ID NO: 987501 - RNA, 20 nt, Homo sapiens
cccagcucacaggagcuuaa

SEQ ID NO: 987502 - RNA, 17 nt, Homo sapiens
cccaggauacuggcaca

SEQ ID NO: 987503 - RNA, 19 nt, Homo sapiens
cccagguuggagugcagug

SEQ ID NO: 987504 - RNA, 16 nt, Homo sapiens
cccaucagcuccagcu

SEQ ID NO: 987505 - RNA, 24 nt, Homo sapiens
cccaucauugguacccacuugcuu

SEQ ID NO: 987506 - RNA, 13 nt, Homo sapiens
cccauggccacuu

SEQ ID NO: 987507 - RNA, 23 nt, Homo sapiens
ccccaacagcacccucuccagau

SEQ ID NO: 987508 - RNA, 15 nt, Homo sapiens
ccccacccaggagua

SEQ ID NO: 987509 - RNA, 21 nt, Homo sapiens
ccccagccugcucccuagcca

SEQ ID NO: 987510 - RNA, 22 nt, Homo sapiens
ccccagccugcucccuagccag

SEQ ID NO: 987511 - RNA, 19 nt, Homo sapiens
ccccuggaacugucucuca

SEQ ID NO: 987512 - RNA, 22 nt, Homo sapiens
cccuacugggagaggggccuca

SEQ ID NO: 987513 - RNA, 22 nt, Homo sapiens
cccucccacugccaaagaacuu

SEQ ID NO: 987514 - RNA, 17 nt, Homo sapiens
cccuccucucccaguga

SEQ ID NO: 987515 - RNA, 16 nt, Homo sapiens
cccugagacaaaugga

SEQ ID NO: 987516 - RNA, 18 nt, Homo sapiens
cccugagacaaauggagg

SEQ ID NO: 987517 - RNA, 14 nt, Homo sapiens
cccugcaccaugcu

SEQ ID NO: 987518 - RNA, 15 nt, Homo sapiens
cccugcaccaugcug

SEQ ID NO: 987519 - RNA, 16 nt, Homo sapiens
cccugcagucacagcu

SEQ ID NO: 987520 - RNA, 16 nt, Homo sapiens
cccugccucucugcag

SEQ ID NO: 987521 - RNA, 18 nt, Homo sapiens
cccuguaacaggcuugaa

SEQ ID NO: 987522 - RNA, 22 nt, Homo sapiens
cccuguccaaacugccuaagcc

SEQ ID NO: 987523 - RNA, 13 nt, Homo sapiens
cccuucucuguau

SEQ ID NO: 987524 - RNA, 14 nt, Homo sapiens
cccuucucuguauu

SEQ ID NO: 987525 - RNA, 17 nt, Homo sapiens
cccuugguucucauaac

SEQ ID NO: 987526 - RNA, 18 nt, Homo sapiens
ccgacugccaucuuggac

SEQ ID NO: 987527 - RNA, 16 nt, Homo sapiens
ccgucaaaagagucuu

SEQ ID NO: 987528 - RNA, 13 nt, Homo sapiens
ccguucaacuuuu

SEQ ID NO: 987529 - RNA, 15 nt, Homo sapiens
ccuaaacauaugaau

SEQ ID NO: 987530 - RNA, 16 nt, Homo sapiens
ccuaacacggugcuca

SEQ ID NO: 987531 - RNA, 16 nt, Homo sapiens
ccuacuuucauaauaa

SEQ ID NO: 987532 - RNA, 17 nt, Homo sapiens
ccuaucucuccaaccag

SEQ ID NO: 987533 - RNA, 20 nt, Homo sapiens
ccuaugggucuaggacacag

SEQ ID NO: 987534 - RNA, 14 nt, Homo sapiens
ccuaugucauuuca

SEQ ID NO: 987535 - RNA, 15 nt, Homo sapiens
ccuauguuucacugu

SEQ ID NO: 987536 - RNA, 15 nt, Homo sapiens
ccucaaaaagauuuc

SEQ ID NO: 987537 - RNA, 19 nt, Homo sapiens
ccucaaaugcaccauguca

SEQ ID NO: 987538 - RNA, 15 nt, Homo sapiens
ccucacuuaaacuuu

SEQ ID NO: 987539 - RNA, 16 nt, Homo sapiens
ccucagaugcacauga

SEQ ID NO: 987540 - RNA, 17 nt, Homo sapiens
ccucagggacucaggug

SEQ ID NO: 987541 - RNA, 20 nt, Homo sapiens
ccucaguucccucuugcuca

SEQ ID NO: 987542 - RNA, 13 nt, Homo sapiens
ccuccacauuucc

SEQ ID NO: 987543 - RNA, 16 nt, Homo sapiens
ccuccaccuccugggu

SEQ ID NO: 987544 - RNA, 13 nt, Homo sapiens
ccuccagauauac

SEQ ID NO: 987545 - RNA, 19 nt, Homo sapiens
ccucccuaccuaccaagau

SEQ ID NO: 987546 - RNA, 15 nt, Homo sapiens
ccucucagugggugg

SEQ ID NO: 987547 - RNA, 18 nt, Homo sapiens
ccucucguaagauuuccu

SEQ ID NO: 987548 - RNA, 13 nt, Homo sapiens
ccugaaaaaucua

SEQ ID NO: 987549 - RNA, 15 nt, Homo sapiens
ccugcaccaugcugc

SEQ ID NO: 987550 - RNA, 17 nt, Homo sapiens
ccugcagacucacugug

SEQ ID NO: 987551 - RNA, 18 nt, Homo sapiens
ccugcucagcccugcacc

SEQ ID NO: 987552 - RNA, 17 nt, Homo sapiens
ccuggaacugucucuca

SEQ ID NO: 987553 - RNA, 14 nt, Homo sapiens
ccuggaagugcuaa

SEQ ID NO: 987554 - RNA, 14 nt, Homo sapiens
ccuggggcuucuga

SEQ ID NO: 987555 - RNA, 19 nt, Homo sapiens
ccuggucccuuggagacaa

SEQ ID NO: 987556 - RNA, 22 nt, Homo sapiens
ccuguacccaguagaugccacc

SEQ ID NO: 987557 - RNA, 16 nt, Homo sapiens
ccugucuguuuccucu

SEQ ID NO: 987558 - RNA, 18 nt, Homo sapiens
ccuguguauucauucuca

SEQ ID NO: 987559 - RNA, 18 nt, Homo sapiens
ccuucuuuuuguucuuca

SEQ ID NO: 987560 - RNA, 16 nt, Homo sapiens
ccuuggggauucuucc

SEQ ID NO: 987561 - RNA, 13 nt, Homo sapiens
ccuugguucucau

SEQ ID NO: 987562 - RNA, 14 nt, Homo sapiens
ccuuguaauuugaa

SEQ ID NO: 987563 - RNA, 22 nt, Homo sapiens
ccuuucccuaagccagcugccc

SEQ ID NO: 987564 - RNA, 14 nt, Homo sapiens
ccuuucuggcuuug

SEQ ID NO: 987565 - RNA, 20 nt, Homo sapiens
ccuuucuucucuccagugca

SEQ ID NO: 987566 - RNA, 15 nt, Homo sapiens
ccuuugacaaaggua

SEQ ID NO: 987567 - RNA, 16 nt, Homo sapiens
cgauucucuugccuca

SEQ ID NO: 987568 - RNA, 23 nt, Homo sapiens
cgauucucuugccucaaccuccc

SEQ ID NO: 987569 - RNA, 16 nt, Homo sapiens
cgcaaauuuucuucca

SEQ ID NO: 987570 - RNA, 16 nt, Homo sapiens
cgcaccacuguguauu

SEQ ID NO: 987571 - RNA, 12 nt, Homo sapiens
cggcacauuccc

SEQ ID NO: 987572 - RNA, 20 nt, Homo sapiens
cggccacggugccuccagau

SEQ ID NO: 987573 - RNA, 16 nt, Homo sapiens
cggcccaacgcaaauu

SEQ ID NO: 987574 - RNA, 23 nt, Homo sapiens
cgugaccugccaggcacacugag

SEQ ID NO: 987575 - RNA, 17 nt, Homo sapiens
cgugcacgcacacuguc

SEQ ID NO: 987576 - RNA, 15 nt, Homo sapiens
cguggguugcacugg

SEQ ID NO: 987577 - RNA, 14 nt, Homo sapiens
cguguccgacucuu

SEQ ID NO: 987578 - RNA, 16 nt, Homo sapiens
cuaaacucagaggcag

SEQ ID NO: 987579 - RNA, 11 nt, Homo sapiens
cuaagcucauc

SEQ ID NO: 987580 - RNA, 17 nt, Homo sapiens
cuaagcuucacuguaaa

SEQ ID NO: 987581 - RNA, 22 nt, Homo sapiens
cuaaguguuucauaaauuugag

SEQ ID NO: 987582 - RNA, 13 nt, Homo sapiens
cuaauagggcaau

SEQ ID NO: 987583 - RNA, 20 nt, Homo sapiens
cuaauguacaauaaagcaau

SEQ ID NO: 987584 - RNA, 22 nt, Homo sapiens
cuaauguacaauaaagcaaugu

SEQ ID NO: 987585 - RNA, 17 nt, Homo sapiens
cuaauuauuaagauaug

SEQ ID NO: 987586 - RNA, 22 nt, Homo sapiens
cuaauuucuauuugaucugaua

SEQ ID NO: 987587 - RNA, 17 nt, Homo sapiens
cuacaaaaccacuggaa

SEQ ID NO: 987588 - RNA, 17 nt, Homo sapiens
cuacaagugauccucag

SEQ ID NO: 987589 - RNA, 20 nt, Homo sapiens
cuacaagugauccucaggca

SEQ ID NO: 987590 - RNA, 19 nt, Homo sapiens
cuacacgagauacagaauu

SEQ ID NO: 987591 - RNA, 13 nt, Homo sapiens
cuaccaagauaua

SEQ ID NO: 987592 - RNA, 15 nt, Homo sapiens
cuaccccuuuacaaa

SEQ ID NO: 987593 - RNA, 15 nt, Homo sapiens
cuaccuaccaagaua

SEQ ID NO: 987594 - RNA, 16 nt, Homo sapiens
cuaccugagcuaaaua

SEQ ID NO: 987595 - RNA, 19 nt, Homo sapiens
cuaccuggucucuccuugu

SEQ ID NO: 987596 - RNA, 17 nt, Homo sapiens
cuagauacaugcuuuuu

SEQ ID NO: 987597 - RNA, 19 nt, Homo sapiens
cuagccagaggcucuaaug

SEQ ID NO: 987598 - RNA, 16 nt, Homo sapiens
cuaggauuuuaaggga

SEQ ID NO: 987599 - RNA, 14 nt, Homo sapiens
cuaggcugagcaau

SEQ ID NO: 987600 - RNA, 19 nt, Homo sapiens
cuauaacuaugaccaugcu

SEQ ID NO: 987601 - RNA, 16 nt, Homo sapiens
cuauucuccauacucu

SEQ ID NO: 987602 - RNA, 17 nt, Homo sapiens
cucaauaaagugcuuug

SEQ ID NO: 987603 - RNA, 20 nt, Homo sapiens
cucacaugauuccagccauc

SEQ ID NO: 987604 - RNA, 21 nt, Homo sapiens
cucacuucagguauaccucac

SEQ ID NO: 987605 - RNA, 23 nt, Homo sapiens
cucacuuucuagauuaagauaug

SEQ ID NO: 987606 - RNA, 21 nt, Homo sapiens
cucagaaaugucauguggcua

SEQ ID NO: 987607 - RNA, 23 nt, Homo sapiens
cucagaaaugucauguggcuacc

SEQ ID NO: 987608 - RNA, 13 nt, Homo sapiens
cucagaugcacau

SEQ ID NO: 987609 - RNA, 14 nt, Homo sapiens
cucagaugcacaug

SEQ ID NO: 987610 - RNA, 21 nt, Homo sapiens
cucaggcaaucugcccgccug

SEQ ID NO: 987611 - RNA, 20 nt, Homo sapiens
cucagguggcccuacuggga

SEQ ID NO: 987612 - RNA, 15 nt, Homo sapiens
cuccagaugagagua

SEQ ID NO: 987613 - RNA, 16 nt, Homo sapiens
cuccauccuaccacaa

SEQ ID NO: 987614 - RNA, 19 nt, Homo sapiens
cucccaagcaccugggauu

SEQ ID NO: 987615 - RNA, 17 nt, Homo sapiens
cuccccuucacucccac

SEQ ID NO: 987616 - RNA, 22 nt, Homo sapiens
cucccuagccagaggcucuaau

SEQ ID NO: 987617 - RNA, 14 nt, Homo sapiens
cuccucauucacau

SEQ ID NO: 987618 - RNA, 16 nt, Homo sapiens
cuccuggaagugcuaa

SEQ ID NO: 987619 - RNA, 23 nt, Homo sapiens
cuccuggaagugcuaauuuugaa

SEQ ID NO: 987620 - RNA, 14 nt, Homo sapiens
cuccuggguucaag

SEQ ID NO: 987621 - RNA, 12 nt, Homo sapiens
cuccuguuucac

SEQ ID NO: 987622 - RNA, 15 nt, Homo sapiens
cucuaauguacaaua

SEQ ID NO: 987623 - RNA, 12 nt, Homo sapiens
cucuacccagua

SEQ ID NO: 987624 - RNA, 12 nt, Homo sapiens
cucuauggugug

SEQ ID NO: 987625 - RNA, 16 nt, Homo sapiens
cucucccagugacaac

SEQ ID NO: 987626 - RNA, 17 nt, Homo sapiens
cucuccccuucucugua

SEQ ID NO: 987627 - RNA, 16 nt, Homo sapiens
cucuccuuguucugau

SEQ ID NO: 987628 - RNA, 19 nt, Homo sapiens
cucugcaggucccuaauaa

SEQ ID NO: 987629 - RNA, 20 nt, Homo sapiens
cucugcauuaucugagguca

SEQ ID NO: 987630 - RNA, 14 nt, Homo sapiens
cucugugaucuugc

SEQ ID NO: 987631 - RNA, 14 nt, Homo sapiens
cucuguucauuucc

SEQ ID NO: 987632 - RNA, 15 nt, Homo sapiens
cucuugaaaaaugca

SEQ ID NO: 987633 - RNA, 18 nt, Homo sapiens
cucuugaaaaaugcaugu

SEQ ID NO: 987634 - RNA, 22 nt, Homo sapiens
cucuugaaaaaugcauguugcc

SEQ ID NO: 987635 - RNA, 20 nt, Homo sapiens
cucuugccaaaucaaaagac

SEQ ID NO: 987636 - RNA, 23 nt, Homo sapiens
cucuugccaaaucaaaagacuuu

SEQ ID NO: 987637 - RNA, 15 nt, Homo sapiens
cugaaauuaacucag

SEQ ID NO: 987638 - RNA, 16 nt, Homo sapiens
cugacacagacauccu

SEQ ID NO: 987639 - RNA, 19 nt, Homo sapiens
cugaccccaaguuauccac

SEQ ID NO: 987640 - RNA, 14 nt, Homo sapiens
cugaccucaaguga

SEQ ID NO: 987641 - RNA, 14 nt, Homo sapiens
cugacgaacuccuu

SEQ ID NO: 987642 - RNA, 18 nt, Homo sapiens
cugacuauucuugaugua

SEQ ID NO: 987643 - RNA, 13 nt, Homo sapiens
cugagagaugaca

SEQ ID NO: 987644 - RNA, 16 nt, Homo sapiens
cugagcaccuacuuac

SEQ ID NO: 987645 - RNA, 22 nt, Homo sapiens
cugagcaccuacuuacaugcau

SEQ ID NO: 987646 - RNA, 22 nt, Homo sapiens
cugagucaacuccuuucucauc

SEQ ID NO: 987647 - RNA, 15 nt, Homo sapiens
cugagugcaccacuu

SEQ ID NO: 987648 - RNA, 22 nt, Homo sapiens
cugagugcaccacuucaaguga

SEQ ID NO: 987649 - RNA, 16 nt, Homo sapiens
cugaguuccugcaugc

SEQ ID NO: 987650 - RNA, 15 nt, Homo sapiens
cugauuucugagcau

SEQ ID NO: 987651 - RNA, 19 nt, Homo sapiens
cugcaagcagagguggcga

SEQ ID NO: 987652 - RNA, 19 nt, Homo sapiens
cugcaggcagccugccuuu

SEQ ID NO: 987653 - RNA, 14 nt, Homo sapiens
cugccucagccucc

SEQ ID NO: 987654 - RNA, 14 nt, Homo sapiens
cugcucagggcugg

SEQ ID NO: 987655 - RNA, 15 nt, Homo sapiens
cugcucccuagccag

SEQ ID NO: 987656 - RNA, 18 nt, Homo sapiens
cugcugagugcaccacuu

SEQ ID NO: 987657 - RNA, 15 nt, Homo sapiens
cuggaaaaugaaucc

SEQ ID NO: 987658 - RNA, 22 nt, Homo sapiens
cuggaauuugaaacacuuugca

SEQ ID NO: 987659 - RNA, 12 nt, Homo sapiens
cuggagcccacu

SEQ ID NO: 987660 - RNA, 12 nt, Homo sapiens
cuggagugcagu

SEQ ID NO: 987661 - RNA, 13 nt, Homo sapiens
cuggagugcagug

SEQ ID NO: 987662 - RNA, 16 nt, Homo sapiens
cuggagugcaguggcg

SEQ ID NO: 987663 - RNA, 20 nt, Homo sapiens
cuggagugcaguggcgcgau

SEQ ID NO: 987664 - RNA, 14 nt, Homo sapiens
cuggcacagaggua

SEQ ID NO: 987665 - RNA, 19 nt, Homo sapiens
cuggcaguggaacuaagaa

SEQ ID NO: 987666 - RNA, 13 nt, Homo sapiens
cuggcugcugcug

SEQ ID NO: 987667 - RNA, 18 nt, Homo sapiens
cuggcugcugcugugcag

SEQ ID NO: 987668 - RNA, 16 nt, Homo sapiens
cuggcuucaaauugua

SEQ ID NO: 987669 - RNA, 22 nt, Homo sapiens
cugggacuauaggcaugcgcca

SEQ ID NO: 987670 - RNA, 23 nt, Homo sapiens
cugggauuaacagguaugaacca

SEQ ID NO: 987671 - RNA, 18 nt, Homo sapiens
cugggauuacagguguga

SEQ ID NO: 987672 - RNA, 23 nt, Homo sapiens
cuggggcauuauccaucuuucac

SEQ ID NO: 987673 - RNA, 23 nt, Homo sapiens
cugggggccucuucugcuuucuc

SEQ ID NO: 987674 - RNA, 23 nt, Homo sapiens
cuguaaaaucuuucuuucuuaga

SEQ ID NO: 987675 - RNA, 13 nt, Homo sapiens
cuguacacugcac

SEQ ID NO: 987676 - RNA, 12 nt, Homo sapiens
cuguauuccuag

SEQ ID NO: 987677 - RNA, 14 nt, Homo sapiens
cugucaacuuguau

SEQ ID NO: 987678 - RNA, 15 nt, Homo sapiens
cugucucucaugaac

SEQ ID NO: 987679 - RNA, 16 nt, Homo sapiens
cugugauauaagugug

SEQ ID NO: 987680 - RNA, 15 nt, Homo sapiens
cugugggacugggac

SEQ ID NO: 987681 - RNA, 16 nt, Homo sapiens
cugugggcaagccuaa

SEQ ID NO: 987682 - RNA, 21 nt, Homo sapiens
cuguguauuuaacugccuugu

SEQ ID NO: 987683 - RNA, 17 nt, Homo sapiens
cuguuucuuccacagug

SEQ ID NO: 987684 - RNA, 15 nt, Homo sapiens
cuguuuuucagggag

SEQ ID NO: 987685 - RNA, 14 nt, Homo sapiens
cuuaaaauagccau

SEQ ID NO: 987686 - RNA, 20 nt, Homo sapiens
cuuaaccagaucauugugaa

SEQ ID NO: 987687 - RNA, 17 nt, Homo sapiens
cuuaaguagauaaggaa

SEQ ID NO: 987688 - RNA, 14 nt, Homo sapiens
cuuacaugauucau

SEQ ID NO: 987689 - RNA, 13 nt, Homo sapiens
cuuacaugcauua

SEQ ID NO: 987690 - RNA, 13 nt, Homo sapiens
cuuacuggugcua

SEQ ID NO: 987691 - RNA, 19 nt, Homo sapiens
cuuauccguuagccguggu

SEQ ID NO: 987692 - RNA, 16 nt, Homo sapiens
cuuauugacucauaca

SEQ ID NO: 987693 - RNA, 17 nt, Homo sapiens
cuucaaagcaaagcucu

SEQ ID NO: 987694 - RNA, 22 nt, Homo sapiens
cuucaacaaccggccaccagau

SEQ ID NO: 987695 - RNA, 14 nt, Homo sapiens
cuucaggacacuca

SEQ ID NO: 987696 - RNA, 22 nt, Homo sapiens
cuucauguaacuucccugaaaa

SEQ ID NO: 987697 - RNA, 18 nt, Homo sapiens
cuuccaacguggcccaga

SEQ ID NO: 987698 - RNA, 20 nt, Homo sapiens
cuuccaacguggcccagaga

SEQ ID NO: 987699 - RNA, 22 nt, Homo sapiens
cuuccaggggagguucagugaa

SEQ ID NO: 987700 - RNA, 20 nt, Homo sapiens
cuucccuugcuucuuggacu

SEQ ID NO: 987701 - RNA, 19 nt, Homo sapiens
cuuccggggaaggauuuug

SEQ ID NO: 987702 - RNA, 21 nt, Homo sapiens
cuucuccccugcacuguaaaa

SEQ ID NO: 987703 - RNA, 18 nt, Homo sapiens
cuucuugaaaucaaucaa

SEQ ID NO: 987704 - RNA, 23 nt, Homo sapiens
cuucuuggccaugggaggccuuu

SEQ ID NO: 987705 - RNA, 12 nt, Homo sapiens
cuucuuugccca

SEQ ID NO: 987706 - RNA, 18 nt, Homo sapiens
cuugaaaauuaacaugaa

SEQ ID NO: 987707 - RNA, 13 nt, Homo sapiens
cuugaacuaggau

SEQ ID NO: 987708 - RNA, 18 nt, Homo sapiens
cuugauaaagggccaaua

SEQ ID NO: 987709 - RNA, 23 nt, Homo sapiens
cuugauugguguugccaguuguc

SEQ ID NO: 987710 - RNA, 14 nt, Homo sapiens
cuugauuuuagccu

SEQ ID NO: 987711 - RNA, 20 nt, Homo sapiens
cuugcaugcuugcauaagag

SEQ ID NO: 987712 - RNA, 22 nt, Homo sapiens
cuugccaaaucaaaagacuuuu

SEQ ID NO: 987713 - RNA, 14 nt, Homo sapiens
cuuggcugacauga

SEQ ID NO: 987714 - RNA, 15 nt, Homo sapiens
cuugguucucuccac

SEQ ID NO: 987715 - RNA, 22 nt, Homo sapiens
cuugugucugcggggaucagag

SEQ ID NO: 987716 - RNA, 14 nt, Homo sapiens
cuuguuuaaauuca

SEQ ID NO: 987717 - RNA, 18 nt, Homo sapiens
cuuuaauuuuacauuucc

SEQ ID NO: 987718 - RNA, 22 nt, Homo sapiens
cuuuaauuuuacauuuccuaaa

SEQ ID NO: 987719 - RNA, 19 nt, Homo sapiens
cuuuauguuacuacaugca

SEQ ID NO: 987720 - RNA, 15 nt, Homo sapiens
cuuuauuuugagaug

SEQ ID NO: 987721 - RNA, 18 nt, Homo sapiens
cuuucacuaucuguaaug

SEQ ID NO: 987722 - RNA, 19 nt, Homo sapiens
cuuucccuccuuggugauu

SEQ ID NO: 987723 - RNA, 19 nt, Homo sapiens
cuuucucaucuugucccca

SEQ ID NO: 987724 - RNA, 13 nt, Homo sapiens
cuuucuggcuuug

SEQ ID NO: 987725 - RNA, 12 nt, Homo sapiens
cuuucuucuccc

SEQ ID NO: 987726 - RNA, 15 nt, Homo sapiens
cuuucuucucuccag

SEQ ID NO: 987727 - RNA, 19 nt, Homo sapiens
cuuugcuucauucaaguca

SEQ ID NO: 987728 - RNA, 24 nt, Homo sapiens
cuuuguauaaaagggacugagaaa

SEQ ID NO: 987729 - RNA, 15 nt, Homo sapiens
cuuuguucuucuacc

SEQ ID NO: 987730 - RNA, 22 nt, Homo sapiens
cuuuuaugugaaacauguuucu

SEQ ID NO: 987731 - RNA, 19 nt, Homo sapiens
cuuuuggcauuuuacugua

SEQ ID NO: 987732 - RNA, 20 nt, Homo sapiens
cuuuuggcauuuuacuguac

SEQ ID NO: 987733 - RNA, 18 nt, Homo sapiens
cuuuuuaauuucugcaaa

SEQ ID NO: 987734 - RNA, 18 nt, Homo sapiens
gaaaaacugcucauauga

SEQ ID NO: 987735 - RNA, 19 nt, Homo sapiens
gaaaaaucuaaguguuuca

SEQ ID NO: 987736 - RNA, 17 nt, Homo sapiens
gaaaaaugcauguugcc

SEQ ID NO: 987737 - RNA, 17 nt, Homo sapiens
gaaaaucauauaaucuu

SEQ ID NO: 987738 - RNA, 15 nt, Homo sapiens
gaaaaucucugugaa

SEQ ID NO: 987739 - RNA, 22 nt, Homo sapiens
gaaaauugugcuggaaauggac

SEQ ID NO: 987740 - RNA, 23 nt, Homo sapiens
gaaaauugugcuggaaauggaca

SEQ ID NO: 987741 - RNA, 23 nt, Homo sapiens
gaaacaaaacuagguaaaaucua

SEQ ID NO: 987742 - RNA, 15 nt, Homo sapiens
gaaacaauggcuaag

SEQ ID NO: 987743 - RNA, 22 nt, Homo sapiens
gaaaguaccaggugaacaaagu

SEQ ID NO: 987744 - RNA, 22 nt, Homo sapiens
gaaauagugauuuccacaguga

SEQ ID NO: 987745 - RNA, 18 nt, Homo sapiens
gaaauuaacucagacaca

SEQ ID NO: 987746 - RNA, 20 nt, Homo sapiens
gaaauuaacucagacacaaa

SEQ ID NO: 987747 - RNA, 17 nt, Homo sapiens
gaaauuuauaaacuuuu

SEQ ID NO: 987748 - RNA, 14 nt, Homo sapiens
gaacaacuaccuga

SEQ ID NO: 987749 - RNA, 18 nt, Homo sapiens
gaacuagccaaaccagga

SEQ ID NO: 987750 - RNA, 13 nt, Homo sapiens
gaacucugagcag

SEQ ID NO: 987751 - RNA, 14 nt, Homo sapiens
gaaggaugcugucu

SEQ ID NO: 987752 - RNA, 13 nt, Homo sapiens
gaaggcuggacua

SEQ ID NO: 987753 - RNA, 23 nt, Homo sapiens
gaagggcuuggacucaagcaaga

SEQ ID NO: 987754 - RNA, 17 nt, Homo sapiens
gaagguggcuacaaaga

SEQ ID NO: 987755 - RNA, 18 nt, Homo sapiens
gaaucccucuaucucuaa

SEQ ID NO: 987756 - RNA, 17 nt, Homo sapiens
gaauccgcccaucuggg

SEQ ID NO: 987757 - RNA, 12 nt, Homo sapiens
gaaucucucuuc

SEQ ID NO: 987758 - RNA, 19 nt, Homo sapiens
gaaugagcaaaaccaaaua

SEQ ID NO: 987759 - RNA, 12 nt, Homo sapiens
gaaugcggccca

SEQ ID NO: 987760 - RNA, 17 nt, Homo sapiens
gaauuucuguucuucca

SEQ ID NO: 987761 - RNA, 16 nt, Homo sapiens
gaauuugaaacacuuu

SEQ ID NO: 987762 - RNA, 22 nt, Homo sapiens
gaauuugaaacacuuugcauaa

SEQ ID NO: 987763 - RNA, 21 nt, Homo sapiens
gaauuuuuauauccacuaaaa

SEQ ID NO: 987764 - RNA, 12 nt, Homo sapiens
gacaaccaaaag

SEQ ID NO: 987765 - RNA, 18 nt, Homo sapiens
gacaaggaaaaaauaaca

SEQ ID NO: 987766 - RNA, 18 nt, Homo sapiens
gacacacaaauuaucuua

SEQ ID NO: 987767 - RNA, 19 nt, Homo sapiens
gacacacacguuauaauca

SEQ ID NO: 987768 - RNA, 21 nt, Homo sapiens
gacagagccccacccucagau

SEQ ID NO: 987769 - RNA, 15 nt, Homo sapiens
gacaguauauaacua

SEQ ID NO: 987770 - RNA, 16 nt, Homo sapiens
gacccuccccaaaggc

SEQ ID NO: 987771 - RNA, 15 nt, Homo sapiens
gacgagguuucacug

SEQ ID NO: 987772 - RNA, 15 nt, Homo sapiens
gacguggguugcacu

SEQ ID NO: 987773 - RNA, 23 nt, Homo sapiens
gacuauucccuucuaaccugaac

SEQ ID NO: 987774 - RNA, 21 nt, Homo sapiens
gacucuaagaaagaacacgcu

SEQ ID NO: 987775 - RNA, 16 nt, Homo sapiens
gacucugucuaccugg

SEQ ID NO: 987776 - RNA, 17 nt, Homo sapiens
gacucuugcagggguag

SEQ ID NO: 987777 - RNA, 18 nt, Homo sapiens
gagaacucugagcagugc

SEQ ID NO: 987778 - RNA, 22 nt, Homo sapiens
gagaacugccuuuggcagaguu

SEQ ID NO: 987779 - RNA, 13 nt, Homo sapiens
gagaagccaaaag

SEQ ID NO: 987780 - RNA, 20 nt, Homo sapiens
gagaagcucugaagaacucu

SEQ ID NO: 987781 - RNA, 17 nt, Homo sapiens
gagagagcuggaggcac

SEQ ID NO: 987782 - RNA, 17 nt, Homo sapiens
gagagauucaugcugau

SEQ ID NO: 987783 - RNA, 23 nt, Homo sapiens
gagaguaucugaggcacauguca

SEQ ID NO: 987784 - RNA, 21 nt, Homo sapiens
gagaugggguuucaccauguu

SEQ ID NO: 987785 - RNA, 19 nt, Homo sapiens
gagauuccugagccagugu

SEQ ID NO: 987786 - RNA, 21 nt, Homo sapiens
gagcaguguuucguguguguu

SEQ ID NO: 987787 - RNA, 22 nt, Homo sapiens
gagccaccacauccagccuaac

SEQ ID NO: 987788 - RNA, 14 nt, Homo sapiens
gagccaccaugccc

SEQ ID NO: 987789 - RNA, 22 nt, Homo sapiens
gagcccugucuccucucucugu

SEQ ID NO: 987790 - RNA, 21 nt, Homo sapiens
gaggguuucauugucugugaa

SEQ ID NO: 987791 - RNA, 15 nt, Homo sapiens
gaguacaccccaaca

SEQ ID NO: 987792 - RNA, 17 nt, Homo sapiens
gaguacaccccaacagc

SEQ ID NO: 987793 - RNA, 12 nt, Homo sapiens
gaguauccucuu

SEQ ID NO: 987794 - RNA, 18 nt, Homo sapiens
gagucaacuccuuucuca

SEQ ID NO: 987795 - RNA, 16 nt, Homo sapiens
gaguccuccuguccag

SEQ ID NO: 987796 - RNA, 21 nt, Homo sapiens
gagugcaguggcaucaucuca

SEQ ID NO: 987797 - RNA, 18 nt, Homo sapiens
gagugcccccaacagcac

SEQ ID NO: 987798 - RNA, 22 nt, Homo sapiens
gaguuuaauuuuugaaaacugg

SEQ ID NO: 987799 - RNA, 23 nt, Homo sapiens
gauaaacugauuuaucuauuuaa

SEQ ID NO: 987800 - RNA, 13 nt, Homo sapiens
gauaaagggccaa

SEQ ID NO: 987801 - RNA, 15 nt, Homo sapiens
gauaaagguucaugc

SEQ ID NO: 987802 - RNA, 15 nt, Homo sapiens
gauacaaacauguuc

SEQ ID NO: 987803 - RNA, 22 nt, Homo sapiens
gauacuugaaggucuaggugcu

SEQ ID NO: 987804 - RNA, 16 nt, Homo sapiens
gauauuuuuccauuuu

SEQ ID NO: 987805 - RNA, 17 nt, Homo sapiens
gaucaaauugugcagua

SEQ ID NO: 987806 - RNA, 18 nt, Homo sapiens
gaucagagcgcacaggga

SEQ ID NO: 987807 - RNA, 14 nt, Homo sapiens
gaucucagcucacu

SEQ ID NO: 987808 - RNA, 23 nt, Homo sapiens
gaucucggcucacugcaaccucc

SEQ ID NO: 987809 - RNA, 17 nt, Homo sapiens
gaugggguuucaccaug

SEQ ID NO: 987810 - RNA, 22 nt, Homo sapiens
gaugguggcaggaaaauggaca

SEQ ID NO: 987811 - RNA, 16 nt, Homo sapiens
gauucaugcacuguag

SEQ ID NO: 987812 - RNA, 13 nt, Homo sapiens
gauuccgcaguga

SEQ ID NO: 987813 - RNA, 17 nt, Homo sapiens
gauuugggcucuuggaa

SEQ ID NO: 987814 - RNA, 20 nt, Homo sapiens
gauuuuacauguggcccaac

SEQ ID NO: 987815 - RNA, 13 nt, Homo sapiens
gauuuuuacacau

SEQ ID NO: 987816 - RNA, 13 nt, Homo sapiens
gcaaauaucuuga

SEQ ID NO: 987817 - RNA, 19 nt, Homo sapiens
gcaacagccacuacauuac

SEQ ID NO: 987818 - RNA, 15 nt, Homo sapiens
gcaagagccacagua

SEQ ID NO: 987819 - RNA, 14 nt, Homo sapiens
gcaagucagaauag

SEQ ID NO: 987820 - RNA, 20 nt, Homo sapiens
gcaaguuagaacuagccaaa

SEQ ID NO: 987821 - RNA, 14 nt, Homo sapiens
gcacacugucugcc

SEQ ID NO: 987822 - RNA, 20 nt, Homo sapiens
gcacauuccccuugccuaaa

SEQ ID NO: 987823 - RNA, 13 nt, Homo sapiens
gcaccaugcugcu

SEQ ID NO: 987824 - RNA, 14 nt, Homo sapiens
gcacccucuccaga

SEQ ID NO: 987825 - RNA, 21 nt, Homo sapiens
gcacccuggauugaucggagc

SEQ ID NO: 987826 - RNA, 19 nt, Homo sapiens
gcagagggaucaagcaguu

SEQ ID NO: 987827 - RNA, 20 nt, Homo sapiens
gcagaguacuggcugaugga

SEQ ID NO: 987828 - RNA, 22 nt, Homo sapiens
gcagcgauuaauaacaggcaaa

SEQ ID NO: 987829 - RNA, 9 nt, Homo sapiens
gcagcuuua

SEQ ID NO: 987830 - RNA, 18 nt, Homo sapiens
gcaggucugaagcucaac

SEQ ID NO: 987831 - RNA, 13 nt, Homo sapiens
gcagucacagcua

SEQ ID NO: 987832 - RNA, 21 nt, Homo sapiens
gcaguggcgugaucucagcuc

SEQ ID NO: 987833 - RNA, 14 nt, Homo sapiens
gcaguguagggagu

SEQ ID NO: 987834 - RNA, 16 nt, Homo sapiens
gcaguugagacaagaa

SEQ ID NO: 987835 - RNA, 21 nt, Homo sapiens
gcaguuuugcuaucugggcug

SEQ ID NO: 987836 - RNA, 17 nt, Homo sapiens
gcauuugaaugcauuuu

SEQ ID NO: 987837 - RNA, 19 nt, Homo sapiens
gcauuugucaacaaaguca

SEQ ID NO: 987838 - RNA, 14 nt, Homo sapiens
gccaacccuuucau

SEQ ID NO: 987839 - RNA, 18 nt, Homo sapiens
gccacccucccacugcca

SEQ ID NO: 987840 - RNA, 21 nt, Homo sapiens
gccacucuuagcuaaaucccu

SEQ ID NO: 987841 - RNA, 23 nt, Homo sapiens
gccagaccagcaggcuggccuau

SEQ ID NO: 987842 - RNA, 22 nt, Homo sapiens
gccagaggcucuaauguacaau

SEQ ID NO: 987843 - RNA, 20 nt, Homo sapiens
gccaggcuggagugcagugg

SEQ ID NO: 987844 - RNA, 22 nt, Homo sapiens
gccagugaccaaccuuuuccca

SEQ ID NO: 987845 - RNA, 13 nt, Homo sapiens
gccauaugaauaa

SEQ ID NO: 987846 - RNA, 20 nt, Homo sapiens
gcccagagaagccaaaagau

SEQ ID NO: 987847 - RNA, 18 nt, Homo sapiens
gcccccaaccauuuccuc

SEQ ID NO: 987848 - RNA, 16 nt, Homo sapiens
gccccuacccuggacu

SEQ ID NO: 987849 - RNA, 16 nt, Homo sapiens
gcccuacucaccugag

SEQ ID NO: 987850 - RNA, 14 nt, Homo sapiens
gcccuccgccauuc

SEQ ID NO: 987851 - RNA, 15 nt, Homo sapiens
gcccugcaccaugcu

SEQ ID NO: 987852 - RNA, 19 nt, Homo sapiens
gcccuguaacaggcuugaa

SEQ ID NO: 987853 - RNA, 16 nt, Homo sapiens
gccgacagcucuccaa

SEQ ID NO: 987854 - RNA, 15 nt, Homo sapiens
gccugcagacucacu

SEQ ID NO: 987855 - RNA, 19 nt, Homo sapiens
gccugcucccuagccagag

SEQ ID NO: 987856 - RNA, 12 nt, Homo sapiens
gccuguacccag

SEQ ID NO: 987857 - RNA, 22 nt, Homo sapiens
gccuguacccaguagaugccac

SEQ ID NO: 987858 - RNA, 18 nt, Homo sapiens
gccuucucuguucauuuc

SEQ ID NO: 987859 - RNA, 20 nt, Homo sapiens
gccuugauugguguugccag

SEQ ID NO: 987860 - RNA, 13 nt, Homo sapiens
gccuuguuucaua

SEQ ID NO: 987861 - RNA, 21 nt, Homo sapiens
gccuuuucucaccugucaucu

SEQ ID NO: 987862 - RNA, 20 nt, Homo sapiens
gcgauuuguuaaagggccaa

SEQ ID NO: 987863 - RNA, 17 nt, Homo sapiens
gcuaagauaccaaaacc

SEQ ID NO: 987864 - RNA, 23 nt, Homo sapiens
gcuaauuuugaaaaacugcucau

SEQ ID NO: 987865 - RNA, 19 nt, Homo sapiens
gcuacacagaucacagcuu

SEQ ID NO: 987866 - RNA, 14 nt, Homo sapiens
gcuauucuccauac

SEQ ID NO: 987867 - RNA, 15 nt, Homo sapiens
gcuauucuccaugua

SEQ ID NO: 987868 - RNA, 16 nt, Homo sapiens
gcucacugcaaccucc

SEQ ID NO: 987869 - RNA, 17 nt, Homo sapiens
gcucacugcaaccucca

SEQ ID NO: 987870 - RNA, 16 nt, Homo sapiens
gcucacugcaaccucu

SEQ ID NO: 987871 - RNA, 23 nt, Homo sapiens
gcucagcccugcaccaugcugcu

SEQ ID NO: 987872 - RNA, 21 nt, Homo sapiens
gcucaggaaggggugugcuga

SEQ ID NO: 987873 - RNA, 16 nt, Homo sapiens
gcucaggaugagggaa

SEQ ID NO: 987874 - RNA, 21 nt, Homo sapiens
gcucaguagucagacuggaua

SEQ ID NO: 987875 - RNA, 13 nt, Homo sapiens
gcucccuagccag

SEQ ID NO: 987876 - RNA, 16 nt, Homo sapiens
gcucugucuucuuugc

SEQ ID NO: 987877 - RNA, 16 nt, Homo sapiens
gcugagcaaucugacc

SEQ ID NO: 987878 - RNA, 20 nt, Homo sapiens
gcugagcaaucugacccuau

SEQ ID NO: 987879 - RNA, 22 nt, Homo sapiens
guuagugcuaguggauuuuaca

SEQ ID NO: 987880 - RNA, 18 nt, Homo sapiens
guuaugccgcuagauaca

SEQ ID NO: 987881 - RNA, 14 nt, Homo sapiens
guucaguaccacau

SEQ ID NO: 987882 - RNA, 12 nt, Homo sapiens
guucaugcaaac

SEQ ID NO: 987883 - RNA, 18 nt, Homo sapiens
guugaugguuguacauau

SEQ ID NO: 987884 - RNA, 13 nt, Homo sapiens
guugcacuggcca

SEQ ID NO: 987885 - RNA, 20 nt, Homo sapiens
guugccaggcuggagugcag

SEQ ID NO: 987886 - RNA, 21 nt, Homo sapiens
guugccaggcuggagugcagu

SEQ ID NO: 987887 - RNA, 21 nt, Homo sapiens
guuuaccgaaaaucauauaau

SEQ ID NO: 987888 - RNA, 19 nt, Homo sapiens
guuuaggaacuacugagga

SEQ ID NO: 987889 - RNA, 18 nt, Homo sapiens
guuuauccuaucucucca

SEQ ID NO: 987890 - RNA, 17 nt, Homo sapiens
guuucuccagagggaau

SEQ ID NO: 987891 - RNA, 18 nt, Homo sapiens
guuucugaguuuuaccaa

SEQ ID NO: 987892 - RNA, 19 nt, Homo sapiens
guuuuuuauuaugcauuau

SEQ ID NO: 987893 - RNA, 13 nt, Homo sapiens
uaaaaaacacugg

SEQ ID NO: 987894 - RNA, 13 nt, Homo sapiens
uaaaaagcauuau

SEQ ID NO: 987895 - RNA, 12 nt, Homo sapiens
uaaaaaugcaua

SEQ ID NO: 987896 - RNA, 13 nt, Homo sapiens
uaaaacauuauga

SEQ ID NO: 987897 - RNA, 18 nt, Homo sapiens
uaaaacuccuguuucacu

SEQ ID NO: 987898 - RNA, 13 nt, Homo sapiens
uaaaagacaagga

SEQ ID NO: 987899 - RNA, 13 nt, Homo sapiens
uaaaagacaguga

SEQ ID NO: 987900 - RNA, 16 nt, Homo sapiens
uaaaagcaucacauga

SEQ ID NO: 987901 - RNA, 23 nt, Homo sapiens
uaaaaguuuuuuauuaugcauua

SEQ ID NO: 987902 - RNA, 21 nt, Homo sapiens
uaaaauccacuuuaucuugaa

SEQ ID NO: 987903 - RNA, 12 nt, Homo sapiens
uaaaaucucaaa

SEQ ID NO: 987904 - RNA, 20 nt, Homo sapiens
uaaaaucuugucauguguau

SEQ ID NO: 987905 - RNA, 20 nt, Homo sapiens
uaaaauugccauauugcaca

SEQ ID NO: 987906 - RNA, 22 nt, Homo sapiens
uaaaauuuuuuuagaaagcauu

SEQ ID NO: 987907 - RNA, 14 nt, Homo sapiens
uaaacugauuuauc

SEQ ID NO: 987908 - RNA, 20 nt, Homo sapiens
uaaagaaaaucucugugaaa

SEQ ID NO: 987909 - RNA, 15 nt, Homo sapiens
uaaagcaauguggua

SEQ ID NO: 987910 - RNA, 17 nt, Homo sapiens
uaaagcaaugugguagu

SEQ ID NO: 987911 - RNA, 18 nt, Homo sapiens
uaaaguguuugaaagcuu

SEQ ID NO: 987912 - RNA, 15 nt, Homo sapiens
uaaauaacaaaucuc

SEQ ID NO: 987913 - RNA, 15 nt, Homo sapiens
uaaaucagacuauga

SEQ ID NO: 987914 - RNA, 14 nt, Homo sapiens
uaaaucgcuaccuu

SEQ ID NO: 987915 - RNA, 17 nt, Homo sapiens
uaaaugugguacaagca

SEQ ID NO: 987916 - RNA, 22 nt, Homo sapiens
uaaauuauuuuuguucauauaa

SEQ ID NO: 987917 - RNA, 20 nt, Homo sapiens
uaacaguugcauugacuguc

SEQ ID NO: 987918 - RNA, 23 nt, Homo sapiens
uaaccccagauucaugcacugua

SEQ ID NO: 987919 - RNA, 20 nt, Homo sapiens
uaacgauaaaagacagugaa

SEQ ID NO: 987920 - RNA, 12 nt, Homo sapiens
uaacuuacauuc

SEQ ID NO: 987921 - RNA, 19 nt, Homo sapiens
uaacuugcugcaguaugaa

SEQ ID NO: 987922 - RNA, 14 nt, Homo sapiens
uaagaaacauuuau

SEQ ID NO: 987923 - RNA, 22 nt, Homo sapiens
uaagaaccacucauaauucuuc

SEQ ID NO: 987924 - RNA, 16 nt, Homo sapiens
uaagcuggagugcagu

SEQ ID NO: 987925 - RNA, 13 nt, Homo sapiens
uaaggaacaacgu

SEQ ID NO: 987926 - RNA, 15 nt, Homo sapiens
uaauaaauuucacca

SEQ ID NO: 987927 - RNA, 16 nt, Homo sapiens
uaauauauauuaucuu

SEQ ID NO: 987928 - RNA, 20 nt, Homo sapiens
uaauaugguguacauucuuc

SEQ ID NO: 987929 - RNA, 17 nt, Homo sapiens
uaauauguaaaauuaca

SEQ ID NO: 987930 - RNA, 14 nt, Homo sapiens
uaauauugauuuau

SEQ ID NO: 987931 - RNA, 18 nt, Homo sapiens
uaauccuaaacauaugaa

SEQ ID NO: 987932 - RNA, 23 nt, Homo sapiens
uaaugccuuuucucaccugucau

SEQ ID NO: 987933 - RNA, 19 nt, Homo sapiens
uaauggaagcaucuagcau

SEQ ID NO: 987934 - RNA, 20 nt, Homo sapiens
uaauuccuucagcacuuuag

SEQ ID NO: 987935 - RNA, 15 nt, Homo sapiens
uaauuggcaugaagg

SEQ ID NO: 987936 - RNA, 23 nt, Homo sapiens
uacaaaaauuccuuuucccgaag

SEQ ID NO: 987937 - RNA, 18 nt, Homo sapiens
uacaauaaagcaaugugg

SEQ ID NO: 987938 - RNA, 21 nt, Homo sapiens
uacaauaaagcaaugugguag

SEQ ID NO: 987939 - RNA, 15 nt, Homo sapiens
uacacagaucacagc

SEQ ID NO: 987940 - RNA, 14 nt, Homo sapiens
uacacauguaucua

SEQ ID NO: 987941 - RNA, 19 nt, Homo sapiens
uacaccccaacagcacccu

SEQ ID NO: 987942 - RNA, 18 nt, Homo sapiens
uacaccuaugucauuuca

SEQ ID NO: 987943 - RNA, 21 nt, Homo sapiens
uacacucucaaagcaaauaau

SEQ ID NO: 987944 - RNA, 15 nt, Homo sapiens
uacauaacacauauc

SEQ ID NO: 987945 - RNA, 21 nt, Homo sapiens
uacauauaagugauugcuggu

SEQ ID NO: 987946 - RNA, 17 nt, Homo sapiens
uacaugcauuacugcau

SEQ ID NO: 987947 - RNA, 20 nt, Homo sapiens
uacaugcauuacugcaugca

SEQ ID NO: 987948 - RNA, 23 nt, Homo sapiens
uacaugcauuacugcaugcacuu

SEQ ID NO: 987949 - RNA, 15 nt, Homo sapiens
uacauguggcccaac

SEQ ID NO: 987950 - RNA, 21 nt, Homo sapiens
uaccacaugggugaacacuca

SEQ ID NO: 987951 - RNA, 15 nt, Homo sapiens
uaccagaaagcaguu

SEQ ID NO: 987952 - RNA, 17 nt, Homo sapiens
uacccacuugcuuuuaa

SEQ ID NO: 987953 - RNA, 20 nt, Homo sapiens
uacuacuguguaagggccag

SEQ ID NO: 987954 - RNA, 16 nt, Homo sapiens
uacucacuuucccaaa

SEQ ID NO: 987955 - RNA, 21 nt, Homo sapiens
uacucagguuaaugcugaaaa

SEQ ID NO: 987956 - RNA, 12 nt, Homo sapiens
uacucugaaauu

SEQ ID NO: 987957 - RNA, 19 nt, Homo sapiens
uacucuucuuacuggugcu

SEQ ID NO: 987958 - RNA, 17 nt, Homo sapiens
uacugauuacugccuau

SEQ ID NO: 987959 - RNA, 23 nt, Homo sapiens
uacugggagaggggccucaaaug

SEQ ID NO: 987960 - RNA, 15 nt, Homo sapiens
uacugguaccaagac

SEQ ID NO: 987961 - RNA, 23 nt, Homo sapiens
uacuugaaggucuaggugcuuua

SEQ ID NO: 987962 - RNA, 19 nt, Homo sapiens
uagaaaauugugcuggaaa

SEQ ID NO: 987963 - RNA, 20 nt, Homo sapiens
uagaaagcauuugaaugcau

SEQ ID NO: 987964 - RNA, 18 nt, Homo sapiens
uagaacuagccaaaccag

SEQ ID NO: 987965 - RNA, 16 nt, Homo sapiens
uagaauagauauccac

SEQ ID NO: 987966 - RNA, 14 nt, Homo sapiens
uagaauaugccuug

SEQ ID NO: 987967 - RNA, 15 nt, Homo sapiens
uagcagagggaucaa

SEQ ID NO: 987968 - RNA, 18 nt, Homo sapiens
uagcagagggaucaagca

SEQ ID NO: 987969 - RNA, 14 nt, Homo sapiens
uagcagcuuuagcc

SEQ ID NO: 987970 - RNA, 23 nt, Homo sapiens
uagccaagugcagggccuguaau

SEQ ID NO: 987971 - RNA, 21 nt, Homo sapiens
uagcccuccucucccagugac

SEQ ID NO: 987972 - RNA, 21 nt, Homo sapiens
uagccuucucuguucauuucc

SEQ ID NO: 987973 - RNA, 23 nt, Homo sapiens
uaggaaagaccauuuuuccucca

SEQ ID NO: 987974 - RNA, 18 nt, Homo sapiens
uaggagcaugagugccgu

SEQ ID NO: 987975 - RNA, 21 nt, Homo sapiens
uaggcauguagcuacaggaca

SEQ ID NO: 987976 - RNA, 20 nt, Homo sapiens
uagggugcugcgcagcaucc

SEQ ID NO: 987977 - RNA, 20 nt, Homo sapiens
uaguaaucauauuguuacug

SEQ ID NO: 987978 - RNA, 22 nt, Homo sapiens
uaguagagacaggguuucacca

SEQ ID NO: 987979 - RNA, 21 nt, Homo sapiens
uagugaacauucgaccuccau

SEQ ID NO: 987980 - RNA, 14 nt, Homo sapiens
uaguggugacugug

SEQ ID NO: 987981 - RNA, 17 nt, Homo sapiens
uaguugcugucauccac

SEQ ID NO: 987982 - RNA, 21 nt, Homo sapiens
uauaaaaauaaaaaacacugg

SEQ ID NO: 987983 - RNA, 19 nt, Homo sapiens
uauaaauggaauuacacaa

SEQ ID NO: 987984 - RNA, 16 nt, Homo sapiens
guucacccaaccacau

SEQ ID NO: 987985 - RNA, 14 nt, Homo sapiens
guuccgacugccau

SEQ ID NO: 987986 - RNA, 13 nt, Homo sapiens
guucgcuuaucaa

SEQ ID NO: 987987 - RNA, 22 nt, Homo sapiens
guucuaaauaaaaagcauuauu

SEQ ID NO: 987988 - RNA, 21 nt, Homo sapiens
guucucacagugggagccagg

SEQ ID NO: 987989 - RNA, 22 nt, Homo sapiens
guucugauauuggacaguaaaa

SEQ ID NO: 987990 - RNA, 13 nt, Homo sapiens
guucuucuaccac

SEQ ID NO: 987991 - RNA, 20 nt, Homo sapiens
guugcauuaaaaaugcauau

SEQ ID NO: 987992 - RNA, 19 nt, Homo sapiens
guuggcuagacuagucuca

SEQ ID NO: 987993 - RNA, 20 nt, Homo sapiens
guuggcuagacuagucucaa

SEQ ID NO: 987994 - RNA, 23 nt, Homo sapiens
guuuccuauguuucacugugcaa

SEQ ID NO: 987995 - RNA, 14 nt, Homo sapiens
guuuccucuguaua

SEQ ID NO: 987996 - RNA, 18 nt, Homo sapiens
guuugcucagcuucucca

SEQ ID NO: 987997 - RNA, 16 nt, Homo sapiens
guuuuggaugcagugc

SEQ ID NO: 987998 - RNA, 15 nt, Homo sapiens
guuuuuaacauguca

SEQ ID NO: 987999 - RNA, 16 nt, Homo sapiens
guuuuuuauuaugcau

SEQ ID NO: 988000 - RNA, 18 nt, Homo sapiens
uaaaaaauagcagcuuua

SEQ ID NO: 988001 - RNA, 22 nt, Homo sapiens
uaaaaagcauuauuauuugcug

SEQ ID NO: 988002 - RNA, 15 nt, Homo sapiens
uaaaagacagugaaa

SEQ ID NO: 988003 - RNA, 22 nt, Homo sapiens
uaaaauuguauagaccuaaaau

SEQ ID NO: 988004 - RNA, 17 nt, Homo sapiens
uaaacucaauaaguuua

SEQ ID NO: 988005 - RNA, 14 nt, Homo sapiens
uaaagguucaugca

SEQ ID NO: 988006 - RNA, 14 nt, Homo sapiens
uaaaguacugggau

SEQ ID NO: 988007 - RNA, 13 nt, Homo sapiens
uaaagucuugccu

SEQ ID NO: 988008 - RNA, 14 nt, Homo sapiens
uaaauaaauaccaa

SEQ ID NO: 988009 - RNA, 13 nt, Homo sapiens
uaaauaccaaaaa

SEQ ID NO: 988010 - RNA, 22 nt, Homo sapiens
uaaauauuuauuuaacuauuca

SEQ ID NO: 988011 - RNA, 19 nt, Homo sapiens
uaaaugccaggccuggcaa

SEQ ID NO: 988012 - RNA, 22 nt, Homo sapiens
uaaaugugguacaagcauucug

SEQ ID NO: 988013 - RNA, 22 nt, Homo sapiens
uaaauuugggggacuuacauga

SEQ ID NO: 988014 - RNA, 14 nt, Homo sapiens
uaaauuuguacuau

SEQ ID NO: 988015 - RNA, 19 nt, Homo sapiens
uaacaaauuccaaauucuc

SEQ ID NO: 988016 - RNA, 22 nt, Homo sapiens
uaacaaccaaagacuacauauu

SEQ ID NO: 988017 - RNA, 20 nt, Homo sapiens
uaacaaguagcacccuggau

SEQ ID NO: 988018 - RNA, 15 nt, Homo sapiens
uaacacggugcucau

SEQ ID NO: 988019 - RNA, 16 nt, Homo sapiens
uaacgagaaauagaaa

SEQ ID NO: 988020 - RNA, 22 nt, Homo sapiens
uaacuaacaaccaaagacuaca

SEQ ID NO: 988021 - RNA, 16 nt, Homo sapiens
uaacucaucugucacc

SEQ ID NO: 988022 - RNA, 16 nt, Homo sapiens
uaacuuucucuaugaa

SEQ ID NO: 988023 - RNA, 17 nt, Homo sapiens
uaagaaaggauaaaguu

SEQ ID NO: 988024 - RNA, 14 nt, Homo sapiens
uaagauaugcauua

SEQ ID NO: 988025 - RNA, 20 nt, Homo sapiens
uaagcaccaggacgcccucg

SEQ ID NO: 988026 - RNA, 21 nt, Homo sapiens
uaagcacgggccauaugaaua

SEQ ID NO: 988027 - RNA, 17 nt, Homo sapiens
uaagcccccacuacaag

SEQ ID NO: 988028 - RNA, 18 nt, Homo sapiens
uaagcuggagugcagugg

SEQ ID NO: 988029 - RNA, 19 nt, Homo sapiens
uaaggcccucuugaaucuc

SEQ ID NO: 988030 - RNA, 13 nt, Homo sapiens
uaaguaaggaauu

SEQ ID NO: 988031 - RNA, 18 nt, Homo sapiens
uaauaugguguacauucu

SEQ ID NO: 988032 - RNA, 23 nt, Homo sapiens
uaaucccgauucacccuguccaa

SEQ ID NO: 988033 - RNA, 19 nt, Homo sapiens
uaaugaaaaccacauugga

SEQ ID NO: 988034 - RNA, 21 nt, Homo sapiens
uaaugaaguuugaauguuaaa

SEQ ID NO: 988035 - RNA, 20 nt, Homo sapiens
uaaugccuuuucucaccugu

SEQ ID NO: 988036 - RNA, 23 nt, Homo sapiens
uaauguacaauaaagcaaugugg

SEQ ID NO: 988037 - RNA, 23 nt, Homo sapiens
uaauuggcaugaaggugucauac

SEQ ID NO: 988038 - RNA, 17 nt, Homo sapiens
uaauuuuugaaaacugg

SEQ ID NO: 988039 - RNA, 20 nt, Homo sapiens
uacaaaaccacuggaaaguu

SEQ ID NO: 988040 - RNA, 16 nt, Homo sapiens
uacaaauagaauuuga

SEQ ID NO: 988041 - RNA, 17 nt, Homo sapiens
uacaaccuccgccuccc

SEQ ID NO: 988042 - RNA, 15 nt, Homo sapiens
uacaauaaagcaaug

SEQ ID NO: 988043 - RNA, 16 nt, Homo sapiens
uacaauaaagcaaugu

SEQ ID NO: 988044 - RNA, 20 nt, Homo sapiens
uacaauaauucuaugagaua

SEQ ID NO: 988045 - RNA, 17 nt, Homo sapiens
uacacagaucacagcuu

SEQ ID NO: 988046 - RNA, 15 nt, Homo sapiens
uacacauacauguaa

SEQ ID NO: 988047 - RNA, 23 nt, Homo sapiens
uacacauacauguaaaauauguc

SEQ ID NO: 988048 - RNA, 15 nt, Homo sapiens
uacaccuaugucauu

SEQ ID NO: 988049 - RNA, 16 nt, Homo sapiens
uacaccuaugucauuu

SEQ ID NO: 988050 - RNA, 22 nt, Homo sapiens
uacacuuugaacuacuagaaaa

SEQ ID NO: 988051 - RNA, 20 nt, Homo sapiens
uacaggaugaugacuaugga

SEQ ID NO: 988052 - RNA, 13 nt, Homo sapiens
uacaggugugagc

SEQ ID NO: 988053 - RNA, 18 nt, Homo sapiens
uacauauugucacugaca

SEQ ID NO: 988054 - RNA, 15 nt, Homo sapiens
uacaugaauugcauu

SEQ ID NO: 988055 - RNA, 23 nt, Homo sapiens
uaccugcucagcccugcaccaug

SEQ ID NO: 988056 - RNA, 21 nt, Homo sapiens
uacgcucauuguagaaaagcu

SEQ ID NO: 988057 - RNA, 14 nt, Homo sapiens
uacuggaaggcuuc

SEQ ID NO: 988058 - RNA, 20 nt, Homo sapiens
uacuucuugauaccugggau

SEQ ID NO: 988059 - RNA, 21 nt, Homo sapiens
uacuuuauguuacuacaugca

SEQ ID NO: 988060 - RNA, 13 nt, Homo sapiens
uagaaaggccuuu

SEQ ID NO: 988061 - RNA, 13 nt, Homo sapiens
uagaccuaaaaua

SEQ ID NO: 988062 - RNA, 17 nt, Homo sapiens
uagauugggcacugugg

SEQ ID NO: 988063 - RNA, 23 nt, Homo sapiens
uagcagcuuuagccaagugcagg

SEQ ID NO: 988064 - RNA, 18 nt, Homo sapiens
uagcaggaagcugugaga

SEQ ID NO: 988065 - RNA, 23 nt, Homo sapiens
uagcaggaagcugugagagcagu

SEQ ID NO: 988066 - RNA, 17 nt, Homo sapiens
uagcauaucugccuuua

SEQ ID NO: 988067 - RNA, 23 nt, Homo sapiens
uagccagaggcucuaauguacaa

SEQ ID NO: 988068 - RNA, 17 nt, Homo sapiens
uaggcauguagcuacag

SEQ ID NO: 988069 - RNA, 15 nt, Homo sapiens
uaggguccaccagga

SEQ ID NO: 988070 - RNA, 16 nt, Homo sapiens
uaguaagagauuccug

SEQ ID NO: 988071 - RNA, 20 nt, Homo sapiens
uaguauuccagaccugaaga

SEQ ID NO: 988072 - RNA, 16 nt, Homo sapiens
uagucaugcuaauuau

SEQ ID NO: 988073 - RNA, 22 nt, Homo sapiens
uagucccaaagaggcuacugua

SEQ ID NO: 988074 - RNA, 23 nt, Homo sapiens
uagucccaaagaggcuacuguaa

SEQ ID NO: 988075 - RNA, 20 nt, Homo sapiens
uagucucuacccaguagaug

SEQ ID NO: 988076 - RNA, 16 nt, Homo sapiens
uagugcuaguggauuu

SEQ ID NO: 988077 - RNA, 14 nt, Homo sapiens
uauaacgucaugug

SEQ ID NO: 988078 - RNA, 15 nt, Homo sapiens
uauaguccagcuuug

SEQ ID NO: 988079 - RNA, 15 nt, Homo sapiens
uaucaaaauuacccu

SEQ ID NO: 988080 - RNA, 12 nt, Homo sapiens
uaucacuguugc

SEQ ID NO: 988081 - RNA, 23 nt, Homo sapiens
uaucuagccuggaaccaagguua

SEQ ID NO: 988082 - RNA, 16 nt, Homo sapiens
uaucucuccaaccaga

SEQ ID NO: 988083 - RNA, 17 nt, Homo sapiens
uaucuuaaaacuccugu

SEQ ID NO: 988084 - RNA, 19 nt, Homo sapiens
uaugaaggcuguacacugc

SEQ ID NO: 988085 - RNA, 22 nt, Homo sapiens
uaugcauuauaaauaaauacca

SEQ ID NO: 988086 - RNA, 16 nt, Homo sapiens
uauggcuccuccauau

SEQ ID NO: 988087 - RNA, 20 nt, Homo sapiens
uaugguacaagcaaugccug

SEQ ID NO: 988088 - RNA, 14 nt, Homo sapiens
uauguguaucucac

SEQ ID NO: 988089 - RNA, 18 nt, Homo sapiens
uauguuacuacaugcacu

SEQ ID NO: 988090 - RNA, 14 nt, Homo sapiens
uauguuucacugug

SEQ ID NO: 988091 - RNA, 21 nt, Homo sapiens
uauuaucuucaggacacucac

SEQ ID NO: 988092 - RNA, 16 nt, Homo sapiens
uauucagaguugaugg

SEQ ID NO: 988093 - RNA, 12 nt, Homo sapiens
uauucagcuuua

SEQ ID NO: 988094 - RNA, 13 nt, Homo sapiens
uauucccauuaga

SEQ ID NO: 988095 - RNA, 18 nt, Homo sapiens
uauucccauuagaccaag

SEQ ID NO: 988096 - RNA, 16 nt, Homo sapiens
uauugcaagaguuuaa

SEQ ID NO: 988097 - RNA, 14 nt, Homo sapiens
uauuuaauuagcca

SEQ ID NO: 988098 - RNA, 18 nt, Homo sapiens
uauuuaauucauguugcc

SEQ ID NO: 988099 - RNA, 23 nt, Homo sapiens
uauuucuuuuuaauuucugcaaa

SEQ ID NO: 988100 - RNA, 24 nt, Homo sapiens
uauuuuaggucuuaauacacacag

SEQ ID NO: 988101 - RNA, 17 nt, Homo sapiens
uauuuugccaagggcau

SEQ ID NO: 988102 - RNA, 20 nt, Homo sapiens
uggggggaguaaagaauuau

SEQ ID NO: 988103 - RNA, 23 nt, Homo sapiens
ugggucagaguuccgacugccau

SEQ ID NO: 988104 - RNA, 19 nt, Homo sapiens
ugggucuaccacucagaga

SEQ ID NO: 988105 - RNA, 15 nt, Homo sapiens
ugggucuucccugua

SEQ ID NO: 988106 - RNA, 15 nt, Homo sapiens
ugggugaacacucaa

SEQ ID NO: 988107 - RNA, 20 nt, Homo sapiens
uggucuaagguucagccuga

SEQ ID NO: 988108 - RNA, 17 nt, Homo sapiens
uggugaaaugcagaguc

SEQ ID NO: 988109 - RNA, 16 nt, Homo sapiens
uguaaauuuguacuau

SEQ ID NO: 988110 - RNA, 23 nt, Homo sapiens
uguaacaguugcauugacuguca

SEQ ID NO: 988111 - RNA, 22 nt, Homo sapiens
uguaagacaaauauguucugac

SEQ ID NO: 988112 - RNA, 13 nt, Homo sapiens
uguaaucccagca

SEQ ID NO: 988113 - RNA, 24 nt, Homo sapiens
uguaaugccuuuucucaccuguca

SEQ ID NO: 988114 - RNA, 14 nt, Homo sapiens
uguacaauaaagca

SEQ ID NO: 988115 - RNA, 15 nt, Homo sapiens
uguacacaacaaucc

SEQ ID NO: 988116 - RNA, 12 nt, Homo sapiens
uguaccagagaa

SEQ ID NO: 988117 - RNA, 13 nt, Homo sapiens
uguacuauuuaac

SEQ ID NO: 988118 - RNA, 15 nt, Homo sapiens
uguauagaccuaaaa

SEQ ID NO: 988119 - RNA, 19 nt, Homo sapiens
uguauucagaguugauggu

SEQ ID NO: 988120 - RNA, 18 nt, Homo sapiens
ugucaauucuugccaaau

SEQ ID NO: 988121 - RNA, 22 nt, Homo sapiens
ugucacauaaugcucauacuua

SEQ ID NO: 988122 - RNA, 23 nt, Homo sapiens
ugucacccagguuggagugcagu

SEQ ID NO: 988123 - RNA, 12 nt, Homo sapiens
ugucauguguau

SEQ ID NO: 988124 - RNA, 19 nt, Homo sapiens
ugucauuguuauauaauca

SEQ ID NO: 988125 - RNA, 16 nt, Homo sapiens
ugucccagaaaaagca

SEQ ID NO: 988126 - RNA, 23 nt, Homo sapiens
uguccgguggagaucccacccga

SEQ ID NO: 988127 - RNA, 18 nt, Homo sapiens
ugucucccagcucagggc

SEQ ID NO: 988128 - RNA, 19 nt, Homo sapiens
ugucucccagcucagggcu

SEQ ID NO: 988129 - RNA, 19 nt, Homo sapiens
ugucuguuuccucuguaua

SEQ ID NO: 988130 - RNA, 14 nt, Homo sapiens
ugucuuugccaagu

SEQ ID NO: 988131 - RNA, 18 nt, Homo sapiens
ugucuuuuuucuaaagua

SEQ ID NO: 988132 - RNA, 19 nt, Homo sapiens
ugugagguucgcuuaucaa

SEQ ID NO: 988133 - RNA, 20 nt, Homo sapiens
uguggacguggguugcacug

SEQ ID NO: 988134 - RNA, 18 nt, Homo sapiens
uguguuuuuaacauguca

SEQ ID NO: 988135 - RNA, 21 nt, Homo sapiens
uguuaauaugguguacauucu

SEQ ID NO: 988136 - RNA, 14 nt, Homo sapiens
uguugcauauacca

SEQ ID NO: 988137 - RNA, 23 nt, Homo sapiens
uguugccuugcauaauggucaga

SEQ ID NO: 988138 - RNA, 16 nt, Homo sapiens
uguuggcuagccucug

SEQ ID NO: 988139 - RNA, 21 nt, Homo sapiens
uguuguguuuuuaacauguca

SEQ ID NO: 988140 - RNA, 14 nt, Homo sapiens
uguuuacuuuaugu

SEQ ID NO: 988141 - RNA, 14 nt, Homo sapiens
uuaaaccauguaaa

SEQ ID NO: 988142 - RNA, 20 nt, Homo sapiens
uuaaauagagaaauaugauu

SEQ ID NO: 988143 - RNA, 19 nt, Homo sapiens
uuaaauuauuuuuguucau

SEQ ID NO: 988144 - RNA, 18 nt, Homo sapiens
uuaacagguaugaaccac

SEQ ID NO: 988145 - RNA, 14 nt, Homo sapiens
uuaacauuccucau

SEQ ID NO: 988146 - RNA, 21 nt, Homo sapiens
uuaaggaggcugagagcccaa

SEQ ID NO: 988147 - RNA, 19 nt, Homo sapiens
uuaagguaugguacaagca

SEQ ID NO: 988148 - RNA, 17 nt, Homo sapiens
uuaauauauacuaugag

SEQ ID NO: 988149 - RNA, 12 nt, Homo sapiens
uuaauggugccu

SEQ ID NO: 988150 - RNA, 18 nt, Homo sapiens
uuacaaagggggaggcua

SEQ ID NO: 988151 - RNA, 12 nt, Homo sapiens
uuacacauguau

SEQ ID NO: 988152 - RNA, 16 nt, Homo sapiens
uuaccuugcaucucac

SEQ ID NO: 988153 - RNA, 22 nt, Homo sapiens
uuagcagucccuccacauuucc

SEQ ID NO: 988154 - RNA, 21 nt, Homo sapiens
uuaguagagacggguuucacc

SEQ ID NO: 988155 - RNA, 20 nt, Homo sapiens
uuaguauuauuguugcauua

SEQ ID NO: 988156 - RNA, 22 nt, Homo sapiens
uuaguauuauuguugcauuaaa

SEQ ID NO: 988157 - RNA, 13 nt, Homo sapiens
uuaguuucugagu

SEQ ID NO: 988158 - RNA, 20 nt, Homo sapiens
uuauaccgcuaucauuccaa

SEQ ID NO: 988159 - RNA, 20 nt, Homo sapiens
uuauccaucuuucacuaucu

SEQ ID NO: 988160 - RNA, 22 nt, Homo sapiens
uuaucuaaucaugaaacucccu

SEQ ID NO: 988161 - RNA, 22 nt, Homo sapiens
uuaugagcucuucauguuucag

SEQ ID NO: 988162 - RNA, 19 nt, Homo sapiens
uuauuaauaaacauucuau

SEQ ID NO: 988163 - RNA, 19 nt, Homo sapiens
uuauuaauauauauuaucu

SEQ ID NO: 988164 - RNA, 15 nt, Homo sapiens
uuauuuaacuauuca

SEQ ID NO: 988165 - RNA, 17 nt, Homo sapiens
uucaaagcaaagcucuu

SEQ ID NO: 988166 - RNA, 19 nt, Homo sapiens
uucaacaguuuuugcuaau

SEQ ID NO: 988167 - RNA, 17 nt, Homo sapiens
uucaagugcuucuccag

SEQ ID NO: 988168 - RNA, 20 nt, Homo sapiens
uucacugugcaaauauaucu

SEQ ID NO: 988169 - RNA, 21 nt, Homo sapiens
uucacuugguucaguaccaca

SEQ ID NO: 988170 - RNA, 20 nt, Homo sapiens
uucagguauaccucacuuua

SEQ ID NO: 988171 - RNA, 23 nt, Homo sapiens
uucaguaccacaugggugaacac

SEQ ID NO: 988172 - RNA, 17 nt, Homo sapiens
uucauaaagucuugccu

SEQ ID NO: 988173 - RNA, 13 nt, Homo sapiens
uucauauaacguc

SEQ ID NO: 988174 - RNA, 12 nt, Homo sapiens
uucaugcacugu

SEQ ID NO: 988175 - RNA, 13 nt, Homo sapiens
uucauguugccuu

SEQ ID NO: 988176 - RNA, 17 nt, Homo sapiens
uuccccaaguacaacca

SEQ ID NO: 988177 - RNA, 21 nt, Homo sapiens
uucccggguagccacuggacu

SEQ ID NO: 988178 - RNA, 15 nt, Homo sapiens
uucccucuugcucag

SEQ ID NO: 988179 - RNA, 19 nt, Homo sapiens
uucccucuugcucaguggg

SEQ ID NO: 988180 - RNA, 19 nt, Homo sapiens
uucccugaagaucuaguga

SEQ ID NO: 988181 - RNA, 21 nt, Homo sapiens
uuccgaggccccugucucagg

SEQ ID NO: 988182 - RNA, 16 nt, Homo sapiens
uuccuggcuacuccau

SEQ ID NO: 988183 - RNA, 17 nt, Homo sapiens
uuccuucagcacuuuag

SEQ ID NO: 988184 - RNA, 19 nt, Homo sapiens
uucuaaauaaaaagcauua

SEQ ID NO: 988185 - RNA, 14 nt, Homo sapiens
uucuacaaaauccu

SEQ ID NO: 988186 - RNA, 18 nt, Homo sapiens
uucucauaacucugugau

SEQ ID NO: 988187 - RNA, 18 nt, Homo sapiens
uucucauaccuuccccac

SEQ ID NO: 988188 - RNA, 16 nt, Homo sapiens
uucucuaaacauuuca

SEQ ID NO: 988189 - RNA, 15 nt, Homo sapiens
uucugagccugccuu

SEQ ID NO: 988190 - RNA, 20 nt, Homo sapiens
uucuggacccguucaacuuu

SEQ ID NO: 988191 - RNA, 14 nt, Homo sapiens
uucuggggcuucag

SEQ ID NO: 988192 - RNA, 22 nt, Homo sapiens
uucuuccacagugccuaauaau

SEQ ID NO: 988193 - RNA, 13 nt, Homo sapiens
uucuuccaucuga

SEQ ID NO: 988194 - RNA, 16 nt, Homo sapiens
uucuuuuaaaccauuu

SEQ ID NO: 988195 - RNA, 13 nt, Homo sapiens
uucuuuucugacu

SEQ ID NO: 988196 - RNA, 18 nt, Homo sapiens
uugaagguggcuacaaag

SEQ ID NO: 988197 - RNA, 17 nt, Homo sapiens
uugaauuuuuuuuaaca

SEQ ID NO: 988198 - RNA, 17 nt, Homo sapiens
uugacuuguauaccuug

SEQ ID NO: 988199 - RNA, 13 nt, Homo sapiens
uugagcagcaucu

SEQ ID NO: 988200 - RNA, 19 nt, Homo sapiens
uugagcaucagugagguua

SEQ ID NO: 988201 - RNA, 21 nt, Homo sapiens
uugcaaggcaaagacuauucc

SEQ ID NO: 988202 - RNA, 21 nt, Homo sapiens
uugcauauaccaguugugaua

SEQ ID NO: 988203 - RNA, 11 nt, Homo sapiens
uugcaucucac

SEQ ID NO: 988204 - RNA, 14 nt, Homo sapiens
uugcaugcuugcau

SEQ ID NO: 988205 - RNA, 18 nt, Homo sapiens
uugcauuaaaaaugcaua

SEQ ID NO: 988206 - RNA, 15 nt, Homo sapiens
uugccaaguucucca

SEQ ID NO: 988207 - RNA, 19 nt, Homo sapiens
uugccaggcuggagugcag

SEQ ID NO: 988208 - RNA, 20 nt, Homo sapiens
uuggaagaggacuccuuaaa

SEQ ID NO: 988209 - RNA, 12 nt, Homo sapiens
uuggagugcagu

SEQ ID NO: 988210 - RNA, 22 nt, Homo sapiens
uuggaugcagugcucgcuguug

SEQ ID NO: 988211 - RNA, 14 nt, Homo sapiens
uuggcuucccaaag

SEQ ID NO: 988212 - RNA, 15 nt, Homo sapiens
uuguacuaugcuguu

SEQ ID NO: 988213 - RNA, 23 nt, Homo sapiens
uugugaagguggaaauaaacuau

SEQ ID NO: 988214 - RNA, 23 nt, Homo sapiens
uuguuuaaaaagcgcuaauuucu

SEQ ID NO: 988215 - RNA, 18 nt, Homo sapiens
uuuaaaaauaguugcugu

SEQ ID NO: 988216 - RNA, 18 nt, Homo sapiens
uuuaacuauucauaagau

SEQ ID NO: 988217 - RNA, 20 nt, Homo sapiens
uuuaagaguaaaaagaaaua

SEQ ID NO: 988218 - RNA, 17 nt, Homo sapiens
uuuaauuuuacauuucc

SEQ ID NO: 988219 - RNA, 23 nt, Homo sapiens
uuuaguaagagauuccugagcca

SEQ ID NO: 988220 - RNA, 15 nt, Homo sapiens
uuuaugauacuugaa

SEQ ID NO: 988221 - RNA, 23 nt, Homo sapiens
uuuauguguuugacgggaaacaa

SEQ ID NO: 988222 - RNA, 15 nt, Homo sapiens
uuuauuuaacuauuc

SEQ ID NO: 988223 - RNA, 15 nt, Homo sapiens
uuucaccauguuggc

SEQ ID NO: 988224 - RNA, 21 nt, Homo sapiens
uuucauugcucagaaauguca

SEQ ID NO: 988225 - RNA, 13 nt, Homo sapiens
uuucucaauaagc

SEQ ID NO: 988226 - RNA, 13 nt, Homo sapiens
uuucuucucucca

SEQ ID NO: 988227 - RNA, 23 nt, Homo sapiens
uuugaaauugagcuggaccucac

SEQ ID NO: 988228 - RNA, 16 nt, Homo sapiens
uuugaaugcggcccaa

SEQ ID NO: 988229 - RNA, 13 nt, Homo sapiens
uuugagacagagu

SEQ ID NO: 988230 - RNA, 19 nt, Homo sapiens
uuuggaagaggacuccuua

SEQ ID NO: 988231 - RNA, 18 nt, Homo sapiens
uuuggggggaguaaagaa

SEQ ID NO: 988232 - RNA, 20 nt, Homo sapiens
uuuuaaucuuuaauuuuaca

SEQ ID NO: 988233 - RNA, 22 nt, Homo sapiens
uuuuaucaugugaaaucauuca

SEQ ID NO: 988234 - RNA, 22 nt, Homo sapiens
uuuucacuucaaaacaguauug

SEQ ID NO: 988235 - RNA, 14 nt, Homo sapiens
gcuacaaaugcauu

SEQ ID NO: 988236 - RNA, 14 nt, Homo sapiens
gcuagagugacuca

SEQ ID NO: 988237 - RNA, 15 nt, Homo sapiens
gcuauucuccauacu

SEQ ID NO: 988238 - RNA, 16 nt, Homo sapiens
gcucacuacaaccucc

SEQ ID NO: 988239 - RNA, 21 nt, Homo sapiens
gcucagcccugcaccaugcug

SEQ ID NO: 988240 - RNA, 15 nt, Homo sapiens
gcucagcuucuccaa

SEQ ID NO: 988241 - RNA, 17 nt, Homo sapiens
gcucuaauguacaauaa

SEQ ID NO: 988242 - RNA, 23 nt, Homo sapiens
gcucuaauguacaauaaagcaau

SEQ ID NO: 988243 - RNA, 19 nt, Homo sapiens
gcucugucuucuuugccca

SEQ ID NO: 988244 - RNA, 20 nt, Homo sapiens
gcucuuuccuggcuacucca

SEQ ID NO: 988245 - RNA, 19 nt, Homo sapiens
gcugacacagacauccucu

SEQ ID NO: 988246 - RNA, 13 nt, Homo sapiens
gcugaccacuuua

SEQ ID NO: 988247 - RNA, 20 nt, Homo sapiens
gcugcuagagugacucacua

SEQ ID NO: 988248 - RNA, 15 nt, Homo sapiens
gcugcugcugugcag

SEQ ID NO: 988249 - RNA, 13 nt, Homo sapiens
gcugcuggggaag

SEQ ID NO: 988250 - RNA, 12 nt, Homo sapiens
gcugcugugcag

SEQ ID NO: 988251 - RNA, 18 nt, Homo sapiens
gcugggcagaaggccaag

SEQ ID NO: 988252 - RNA, 13 nt, Homo sapiens
gcuggguuuacac

SEQ ID NO: 988253 - RNA, 17 nt, Homo sapiens
gcuguggccaucaaccu

SEQ ID NO: 988254 - RNA, 22 nt, Homo sapiens
gcuguggccaucaaccucugua

SEQ ID NO: 988255 - RNA, 21 nt, Homo sapiens
gcuucauucaagucagcucuu

SEQ ID NO: 988256 - RNA, 19 nt, Homo sapiens
gcuucuuaaaauagccaua

SEQ ID NO: 988257 - RNA, 20 nt, Homo sapiens
gcuugaucaaaggcacacag

SEQ ID NO: 988258 - RNA, 19 nt, Homo sapiens
gcuuugaaugcggcccaac

SEQ ID NO: 988259 - RNA, 16 nt, Homo sapiens
ggaaaagauacccaaa

SEQ ID NO: 988260 - RNA, 16 nt, Homo sapiens
ggaaacccagcucaca

SEQ ID NO: 988261 - RNA, 17 nt, Homo sapiens
ggaaaggggcaggccag

SEQ ID NO: 988262 - RNA, 18 nt, Homo sapiens
ggaacuaagaaagcccuu

SEQ ID NO: 988263 - RNA, 18 nt, Homo sapiens
ggaagcugugagagcagu

SEQ ID NO: 988264 - RNA, 15 nt, Homo sapiens
ggaauccucuguguc

SEQ ID NO: 988265 - RNA, 14 nt, Homo sapiens
ggacccuguccaau

SEQ ID NO: 988266 - RNA, 18 nt, Homo sapiens
ggacucaagcaagauuuc

SEQ ID NO: 988267 - RNA, 16 nt, Homo sapiens
ggagcuuaaacagcug

SEQ ID NO: 988268 - RNA, 14 nt, Homo sapiens
ggagucuugcucug

SEQ ID NO: 988269 - RNA, 18 nt, Homo sapiens
ggauaguccgucucugcu

SEQ ID NO: 988270 - RNA, 19 nt, Homo sapiens
ggauauccucccuccagau

SEQ ID NO: 988271 - RNA, 21 nt, Homo sapiens
ggauccuguguggagagggaa

SEQ ID NO: 988272 - RNA, 23 nt, Homo sapiens
ggauguuugcucagcuucuccaa

SEQ ID NO: 988273 - RNA, 19 nt, Homo sapiens
ggauuaugggucacaggaa

SEQ ID NO: 988274 - RNA, 19 nt, Homo sapiens
ggauuuauuuuuccauuua

SEQ ID NO: 988275 - RNA, 17 nt, Homo sapiens
ggcaaagccuucauugc

SEQ ID NO: 988276 - RNA, 18 nt, Homo sapiens
ggcaagagccacaguaua

SEQ ID NO: 988277 - RNA, 17 nt, Homo sapiens
ggcacauuccccuugcc

SEQ ID NO: 988278 - RNA, 18 nt, Homo sapiens
ggcaggaacaaacagggc

SEQ ID NO: 988279 - RNA, 16 nt, Homo sapiens
ggcaugaaggugucau

SEQ ID NO: 988280 - RNA, 19 nt, Homo sapiens
ggcauuucuuuucugcaug

SEQ ID NO: 988281 - RNA, 19 nt, Homo sapiens
ggcauuuuacuguacagac

SEQ ID NO: 988282 - RNA, 20 nt, Homo sapiens
ggccaauaaauaugauguua

SEQ ID NO: 988283 - RNA, 23 nt, Homo sapiens
ggccacccaaggaugucugccac

SEQ ID NO: 988284 - RNA, 17 nt, Homo sapiens
ggccuugcggcuccuca

SEQ ID NO: 988285 - RNA, 22 nt, Homo sapiens
ggcgcgaucucggcucacugca

SEQ ID NO: 988286 - RNA, 11 nt, Homo sapiens
ggcgcuuucug

SEQ ID NO: 988287 - RNA, 12 nt, Homo sapiens
ggcuagucauaa

SEQ ID NO: 988288 - RNA, 16 nt, Homo sapiens
ggcuaucguuagugcu

SEQ ID NO: 988289 - RNA, 17 nt, Homo sapiens
ggcucucccagccaggu

SEQ ID NO: 988290 - RNA, 16 nt, Homo sapiens
ggcugcugcugugcag

SEQ ID NO: 988291 - RNA, 14 nt, Homo sapiens
ggcuggagugcagu

SEQ ID NO: 988292 - RNA, 15 nt, Homo sapiens
ggcuggagugcagug

SEQ ID NO: 988293 - RNA, 16 nt, Homo sapiens
ggcuggagugcagugg

SEQ ID NO: 988294 - RNA, 23 nt, Homo sapiens
gggaaaagaaaaagauugagaga

SEQ ID NO: 988295 - RNA, 14 nt, Homo sapiens
gggaagacaguggc

SEQ ID NO: 988296 - RNA, 15 nt, Homo sapiens
gggaauugcagagua

SEQ ID NO: 988297 - RNA, 22 nt, Homo sapiens
gggccucaaaugcaccauguca

SEQ ID NO: 988298 - RNA, 15 nt, Homo sapiens
ggggagguucaguga

SEQ ID NO: 988299 - RNA, 12 nt, Homo sapiens
ggguccaccagg

SEQ ID NO: 988300 - RNA, 14 nt, Homo sapiens
ggguucucacagug

SEQ ID NO: 988301 - RNA, 11 nt, Homo sapiens
gguagccacug

SEQ ID NO: 988302 - RNA, 18 nt, Homo sapiens
gguaggaaacuaggugca

SEQ ID NO: 988303 - RNA, 14 nt, Homo sapiens
gguaucaccacugg

SEQ ID NO: 988304 - RNA, 21 nt, Homo sapiens
ggucagaguuccgacugccau

SEQ ID NO: 988305 - RNA, 15 nt, Homo sapiens
ggucuaggacacagu

SEQ ID NO: 988306 - RNA, 18 nt, Homo sapiens
ggugaacaaaguuuacca

SEQ ID NO: 988307 - RNA, 13 nt, Homo sapiens
ggugugggccaga

SEQ ID NO: 988308 - RNA, 13 nt, Homo sapiens
gguucaagugcuu

SEQ ID NO: 988309 - RNA, 21 nt, Homo sapiens
gguucucauaacucugugauc

SEQ ID NO: 988310 - RNA, 12 nt, Homo sapiens
gguucucuccac

SEQ ID NO: 988311 - RNA, 19 nt, Homo sapiens
gguugcacuggccacccaa

SEQ ID NO: 988312 - RNA, 15 nt, Homo sapiens
gguugggcagccaga

SEQ ID NO: 988313 - RNA, 12 nt, Homo sapiens
guaaaacagggc

SEQ ID NO: 988314 - RNA, 13 nt, Homo sapiens
guaaagaauuauu

SEQ ID NO: 988315 - RNA, 19 nt, Homo sapiens
guaaggcaaucauggugcu

SEQ ID NO: 988316 - RNA, 22 nt, Homo sapiens
guaauaaacucauuucuagcag

SEQ ID NO: 988317 - RNA, 22 nt, Homo sapiens
guaaucauauuguuacugguac

SEQ ID NO: 988318 - RNA, 15 nt, Homo sapiens
guaaugccuuuucuc

SEQ ID NO: 988319 - RNA, 16 nt, Homo sapiens
guacaauaaagcaaug

SEQ ID NO: 988320 - RNA, 18 nt, Homo sapiens
guacaauaaagcaaugug

SEQ ID NO: 988321 - RNA, 17 nt, Homo sapiens
guacaccacaaggguca

SEQ ID NO: 988322 - RNA, 17 nt, Homo sapiens
guacugauuacugccua

SEQ ID NO: 988323 - RNA, 12 nt, Homo sapiens
guauaccucacu

SEQ ID NO: 988324 - RNA, 14 nt, Homo sapiens
guaucuaugcauuu

SEQ ID NO: 988325 - RNA, 21 nt, Homo sapiens
guaucuuuuuauucagcucau

SEQ ID NO: 988326 - RNA, 23 nt, Homo sapiens
guauuuauucaauaaaguauuua

SEQ ID NO: 988327 - RNA, 12 nt, Homo sapiens
gucaaugaacuu

SEQ ID NO: 988328 - RNA, 22 nt, Homo sapiens
gucagucugaugagaacucuga

SEQ ID NO: 988329 - RNA, 19 nt, Homo sapiens
gucauuucaaagacucuca

SEQ ID NO: 988330 - RNA, 14 nt, Homo sapiens
gucauuucauuucc

SEQ ID NO: 988331 - RNA, 23 nt, Homo sapiens
guccaggcuuuuuuaucauguga

SEQ ID NO: 988332 - RNA, 22 nt, Homo sapiens
guccccagccugcucccuagcc

SEQ ID NO: 988333 - RNA, 13 nt, Homo sapiens
gucccuuggagac

SEQ ID NO: 988334 - RNA, 19 nt, Homo sapiens
guccugggauuacaggugu

SEQ ID NO: 988335 - RNA, 17 nt, Homo sapiens
gucucccagcucagggc

SEQ ID NO: 988336 - RNA, 19 nt, Homo sapiens
gucuccucucucuguaaua

SEQ ID NO: 988337 - RNA, 14 nt, Homo sapiens
gucucuacccagua

SEQ ID NO: 988338 - RNA, 19 nt, Homo sapiens
gucugccacaccucuccaa

SEQ ID NO: 988339 - RNA, 14 nt, Homo sapiens
gucugcccuuguca

SEQ ID NO: 988340 - RNA, 12 nt, Homo sapiens
gucuguaaaauc

SEQ ID NO: 988341 - RNA, 22 nt, Homo sapiens
gucuuaauauauauauccagau

SEQ ID NO: 988342 - RNA, 23 nt, Homo sapiens
gucuugccuugcugaacucccuc

SEQ ID NO: 988343 - RNA, 15 nt, Homo sapiens
gugagggugcugacu

SEQ ID NO: 988344 - RNA, 18 nt, Homo sapiens
gugaggugcuugagucuc

SEQ ID NO: 988345 - RNA, 17 nt, Homo sapiens
gugaguugcacagcuau

SEQ ID NO: 988346 - RNA, 18 nt, Homo sapiens
gugcaaauauaucugcua

SEQ ID NO: 988347 - RNA, 16 nt, Homo sapiens
gugcaaccaucaccag

SEQ ID NO: 988348 - RNA, 20 nt, Homo sapiens
gugcaguggcaucaucucag

SEQ ID NO: 988349 - RNA, 19 nt, Homo sapiens
gugcaguggcgugaucuca

SEQ ID NO: 988350 - RNA, 21 nt, Homo sapiens
gugcuggcauuacagguguga

SEQ ID NO: 988351 - RNA, 11 nt, Homo sapiens
gugcugggauu

SEQ ID NO: 988352 - RNA, 22 nt, Homo sapiens
gugcuucuuaaaauagccauaa

SEQ ID NO: 988353 - RNA, 20 nt, Homo sapiens
guggacguggguugcacugg

SEQ ID NO: 988354 - RNA, 19 nt, Homo sapiens
guggcaggaaaauggacau

SEQ ID NO: 988355 - RNA, 19 nt, Homo sapiens
aaaaacuauuaacaacuug

SEQ ID NO: 988356 - RNA, 14 nt, Homo sapiens
aaaaacugcucaua

SEQ ID NO: 988357 - RNA, 16 nt, Homo sapiens
aaaaaguaaaugugau

SEQ ID NO: 988358 - RNA, 16 nt, Homo sapiens
aaaaauccuacuuuca

SEQ ID NO: 988359 - RNA, 21 nt, Homo sapiens
aaaagauacccaaaggucaag

SEQ ID NO: 988360 - RNA, 18 nt, Homo sapiens
aaaagauauaagugcugu

SEQ ID NO: 988361 - RNA, 21 nt, Homo sapiens
aaaagauggggucuguaaaau

SEQ ID NO: 988362 - RNA, 19 nt, Homo sapiens
aaaagcaucacaugaacuu

SEQ ID NO: 988363 - RNA, 15 nt, Homo sapiens
aaaagggacugagaa

SEQ ID NO: 988364 - RNA, 14 nt, Homo sapiens
aaaagggagauuca

SEQ ID NO: 988365 - RNA, 17 nt, Homo sapiens
aaaaguauccaagguua

SEQ ID NO: 988366 - RNA, 21 nt, Homo sapiens
aaaaucuauuuuguaacuuuc

SEQ ID NO: 988367 - RNA, 18 nt, Homo sapiens
aaaaugcauauacuuuaa

SEQ ID NO: 988368 - RNA, 21 nt, Homo sapiens
aaaauugugcuggaaauggac

SEQ ID NO: 988369 - RNA, 13 nt, Homo sapiens
aaaauuguuacaa

SEQ ID NO: 988370 - RNA, 23 nt, Homo sapiens
aaaauuuuuuuagaaagcauuug

SEQ ID NO: 988371 - RNA, 18 nt, Homo sapiens
aaacaccuuguacuuuau

SEQ ID NO: 988372 - RNA, 21 nt, Homo sapiens
aaacuagcauaucugccuuua

SEQ ID NO: 988373 - RNA, 16 nt, Homo sapiens
aaacuccugaccucaa

SEQ ID NO: 988374 - RNA, 20 nt, Homo sapiens
aaacugauuuaucuauuuaa

SEQ ID NO: 988375 - RNA, 14 nt, Homo sapiens
aaagaacuuggaaa

SEQ ID NO: 988376 - RNA, 15 nt, Homo sapiens
aaagaccauuuuucc

SEQ ID NO: 988377 - RNA, 19 nt, Homo sapiens
aaagacuacauauugucac

SEQ ID NO: 988378 - RNA, 16 nt, Homo sapiens
aaagauggggucugua

SEQ ID NO: 988379 - RNA, 12 nt, Homo sapiens
aaagcauuauua

SEQ ID NO: 988380 - RNA, 11 nt, Homo sapiens
aaagcccuccc

SEQ ID NO: 988381 - RNA, 18 nt, Homo sapiens
aaagcccucccuaccuac

SEQ ID NO: 988382 - RNA, 23 nt, Homo sapiens
aaagcccucccuaccuaccaaga

SEQ ID NO: 988383 - RNA, 14 nt, Homo sapiens
aaagcuuugaaccc

SEQ ID NO: 988384 - RNA, 18 nt, Homo sapiens
aaaggaaacccagcucac

SEQ ID NO: 988385 - RNA, 16 nt, Homo sapiens
aaaggaauccucugug

SEQ ID NO: 988386 - RNA, 22 nt, Homo sapiens
aaaggcuaagcuucacuguaaa

SEQ ID NO: 988387 - RNA, 22 nt, Homo sapiens
aaaggcuuugcccugcugcccu

SEQ ID NO: 988388 - RNA, 16 nt, Homo sapiens
aaagggauuuucagcc

SEQ ID NO: 988389 - RNA, 20 nt, Homo sapiens
aaaguaaaaacaaagaaauu

SEQ ID NO: 988390 - RNA, 17 nt, Homo sapiens
aaauaaaaagcauuauu

SEQ ID NO: 988391 - RNA, 16 nt, Homo sapiens
aaauaaaucuaucaaa

SEQ ID NO: 988392 - RNA, 23 nt, Homo sapiens
aaauaagacggauuuauuuuucc

SEQ ID NO: 988393 - RNA, 19 nt, Homo sapiens
caucucuuguuuaaauuca

SEQ ID NO: 988394 - RNA, 16 nt, Homo sapiens
caucuuucacuaucug

SEQ ID NO: 988395 - RNA, 21 nt, Homo sapiens
caugaaggugucauacagauu

SEQ ID NO: 988396 - RNA, 23 nt, Homo sapiens
caugaauauuuaguguucauaaa

SEQ ID NO: 988397 - RNA, 11 nt, Homo sapiens
caugauuuggg

SEQ ID NO: 988398 - RNA, 16 nt, Homo sapiens
caugcauuacugcaug

SEQ ID NO: 988399 - RNA, 21 nt, Homo sapiens
caugcauuacugcaugcacuu

SEQ ID NO: 988400 - RNA, 15 nt, Homo sapiens
caugggaucaagucc

SEQ ID NO: 988401 - RNA, 15 nt, Homo sapiens
cuguugcauauacca

SEQ ID NO: 988402 - RNA, 16 nt, Homo sapiens
cuuaaaauagccauaa

SEQ ID NO: 988403 - RNA, 15 nt, Homo sapiens
cuuaucaacuaauga

SEQ ID NO: 988404 - RNA, 19 nt, Homo sapiens
cuuauuaauuugacuagaa

SEQ ID NO: 988405 - RNA, 20 nt, Homo sapiens
cuuauuaauuugacuagaaa

SEQ ID NO: 988406 - RNA, 13 nt, Homo sapiens
cuuauuuccucau

SEQ ID NO: 988407 - RNA, 13 nt, Homo sapiens
cuucaaauuguaa

SEQ ID NO: 988408 - RNA, 13 nt, Homo sapiens
cuucagcacuuua

SEQ ID NO: 988409 - RNA, 21 nt, Homo sapiens
cuucauguaacuucccugaaa

SEQ ID NO: 988410 - RNA, 13 nt, Homo sapiens
cuucauugccuua

SEQ ID NO: 988411 - RNA, 18 nt, Homo sapiens
cuuccaucugauugugau

SEQ ID NO: 988412 - RNA, 21 nt, Homo sapiens
cuucccaaaguccugggauua

SEQ ID NO: 988413 - RNA, 15 nt, Homo sapiens
cuuccucucugcaau

SEQ ID NO: 988414 - RNA, 18 nt, Homo sapiens
cuuccuuccucucugcaa

SEQ ID NO: 988415 - RNA, 18 nt, Homo sapiens
cuucugcuuucucgggaa

SEQ ID NO: 988416 - RNA, 21 nt, Homo sapiens
cuucuuacaauaauucuauga

SEQ ID NO: 988417 - RNA, 22 nt, Homo sapiens
cuucuuggacuucuugaaauca

SEQ ID NO: 988418 - RNA, 13 nt, Homo sapiens
cuucuuugcccac

SEQ ID NO: 988419 - RNA, 16 nt, Homo sapiens
caccacgccuggcuaa

SEQ ID NO: 988420 - RNA, 23 nt, Homo sapiens
caccaggaauccccaacaugcac

SEQ ID NO: 988421 - RNA, 15 nt, Homo sapiens
caccaugcccggcua

SEQ ID NO: 988422 - RNA, 18 nt, Homo sapiens
caccaugcugcuggggaa

SEQ ID NO: 988423 - RNA, 20 nt, Homo sapiens
caccaugucaaggguucaag

SEQ ID NO: 988424 - RNA, 13 nt, Homo sapiens
caccauguuggcc

SEQ ID NO: 988425 - RNA, 16 nt, Homo sapiens
caccauucaggucuuu

SEQ ID NO: 988426 - RNA, 20 nt, Homo sapiens
cacgguguucugugauauaa

SEQ ID NO: 988427 - RNA, 22 nt, Homo sapiens
cacuacaaccuccgccucccau

SEQ ID NO: 988428 - RNA, 18 nt, Homo sapiens
cacuaggguccaccagga

SEQ ID NO: 988429 - RNA, 23 nt, Homo sapiens
cacucuugaaaaaugcauguugc

SEQ ID NO: 988430 - RNA, 14 nt, Homo sapiens
cacucuuguaauaa

SEQ ID NO: 988431 - RNA, 21 nt, Homo sapiens
cacugccaaagaacuuggaaa

SEQ ID NO: 988432 - RNA, 20 nt, Homo sapiens
cacuggacugacgacuugag

SEQ ID NO: 988433 - RNA, 23 nt, Homo sapiens
cacugugcaaauauaucugcuau

SEQ ID NO: 988434 - RNA, 16 nt, Homo sapiens
cacuucaaaacaguau

SEQ ID NO: 988435 - RNA, 20 nt, Homo sapiens
cacuucuuacaauaauucua

SEQ ID NO: 988436 - RNA, 19 nt, Homo sapiens
cagaaauacuacuguguaa

SEQ ID NO: 988437 - RNA, 15 nt, Homo sapiens
cagaaggccaagagg

SEQ ID NO: 988438 - RNA, 15 nt, Homo sapiens
cagaauagaaauuag

SEQ ID NO: 988439 - RNA, 20 nt, Homo sapiens
cagaauuuuaugcggcauuu

SEQ ID NO: 988440 - RNA, 20 nt, Homo sapiens
cagacauacauuucucauac

SEQ ID NO: 988441 - RNA, 16 nt, Homo sapiens
cagacucacuguggga

SEQ ID NO: 988442 - RNA, 20 nt, Homo sapiens
cagagacauacaccuauguc

SEQ ID NO: 988443 - RNA, 14 nt, Homo sapiens
cagaggcucuaaug

SEQ ID NO: 988444 - RNA, 19 nt, Homo sapiens
cagagucuuccucugucuc

SEQ ID NO: 988445 - RNA, 14 nt, Homo sapiens
cagaguuuguauug

SEQ ID NO: 988446 - RNA, 13 nt, Homo sapiens
cagauccuccuca

SEQ ID NO: 988447 - RNA, 14 nt, Homo sapiens
cagaugagaguaca

SEQ ID NO: 988448 - RNA, 20 nt, Homo sapiens
cagaugagaguacaccccaa

SEQ ID NO: 988449 - RNA, 18 nt, Homo sapiens
cagauucucccuugcucu

SEQ ID NO: 988450 - RNA, 19 nt, Homo sapiens
cagauucucccuugcucug

SEQ ID NO: 988451 - RNA, 19 nt, Homo sapiens
cagauuuuuacacauguau

SEQ ID NO: 988452 - RNA, 17 nt, Homo sapiens
cagcaugcugagauuac

SEQ ID NO: 988453 - RNA, 14 nt, Homo sapiens
cagccaacuauggc

SEQ ID NO: 988454 - RNA, 16 nt, Homo sapiens
cagcccugcaccaugc

SEQ ID NO: 988455 - RNA, 21 nt, Homo sapiens
cagcccugcaccaugcugcug

SEQ ID NO: 988456 - RNA, 13 nt, Homo sapiens
cagccucaagucu

SEQ ID NO: 988457 - RNA, 22 nt, Homo sapiens
cagccuccagagaguaucugag

SEQ ID NO: 988458 - RNA, 21 nt, Homo sapiens
cagccugcagacucacugugg

SEQ ID NO: 988459 - RNA, 14 nt, Homo sapiens
cagccuggcaaggg

SEQ ID NO: 988460 - RNA, 21 nt, Homo sapiens
cagccuggccaacauaguggg

SEQ ID NO: 988461 - RNA, 11 nt, Homo sapiens
cagcucagggc

SEQ ID NO: 988462 - RNA, 21 nt, Homo sapiens
cagcucugcauuaucugaggu

SEQ ID NO: 988463 - RNA, 12 nt, Homo sapiens
cagcucuucucc

SEQ ID NO: 988464 - RNA, 14 nt, Homo sapiens
cagcugacacaucu

SEQ ID NO: 988465 - RNA, 17 nt, Homo sapiens
caggagcuuaaacagcu

SEQ ID NO: 988466 - RNA, 19 nt, Homo sapiens
caggaguacaccccaacag

SEQ ID NO: 988467 - RNA, 18 nt, Homo sapiens
caggaguauccucuugcc

SEQ ID NO: 988468 - RNA, 19 nt, Homo sapiens
caggaguauccucuugcca

SEQ ID NO: 988469 - RNA, 23 nt, Homo sapiens
caggaguucucccaccaccucac

SEQ ID NO: 988470 - RNA, 19 nt, Homo sapiens
caggauaccauauacagcu

SEQ ID NO: 988471 - RNA, 19 nt, Homo sapiens
caggauguuugcucagcuu

SEQ ID NO: 988472 - RNA, 18 nt, Homo sapiens
caggcagccugccuuuaa

SEQ ID NO: 988473 - RNA, 17 nt, Homo sapiens
caggccucacacacaau

SEQ ID NO: 988474 - RNA, 12 nt, Homo sapiens
caggcuugaauc

SEQ ID NO: 988475 - RNA, 19 nt, Homo sapiens
cagggagugcacauaucca

SEQ ID NO: 988476 - RNA, 15 nt, Homo sapiens
cagggccacauagau

SEQ ID NO: 988477 - RNA, 14 nt, Homo sapiens
cagggcuggucuuu

SEQ ID NO: 988478 - RNA, 17 nt, Homo sapiens
caggggugcugggaccu

SEQ ID NO: 988479 - RNA, 15 nt, Homo sapiens
cagguuaaugcugaa

SEQ ID NO: 988480 - RNA, 18 nt, Homo sapiens
cagguuggagugcagugg

SEQ ID NO: 988481 - RNA, 16 nt, Homo sapiens
caguagucagacugga

SEQ ID NO: 988482 - RNA, 17 nt, Homo sapiens
caguaguggugacugug

SEQ ID NO: 988483 - RNA, 19 nt, Homo sapiens
caguaguggugacuguggg

SEQ ID NO: 988484 - RNA, 20 nt, Homo sapiens
caguauauaacuaacaacca

SEQ ID NO: 988485 - RNA, 16 nt, Homo sapiens
caguggcgugaucuca

SEQ ID NO: 988486 - RNA, 17 nt, Homo sapiens
cagugggggcagagcca

SEQ ID NO: 988487 - RNA, 13 nt, Homo sapiens
caguuagccucug

SEQ ID NO: 988488 - RNA, 16 nt, Homo sapiens
caguuauuugauuugu

SEQ ID NO: 988489 - RNA, 17 nt, Homo sapiens
caguugggacuacaggc

SEQ ID NO: 988490 - RNA, 17 nt, Homo sapiens
caguuugguuucuagca

SEQ ID NO: 988491 - RNA, 14 nt, Homo sapiens
cauaacucugugau

SEQ ID NO: 988492 - RNA, 20 nt, Homo sapiens
cauaacucugugaucuugcu

SEQ ID NO: 988493 - RNA, 20 nt, Homo sapiens
cauaagagcuuaagaaccau

SEQ ID NO: 988494 - RNA, 15 nt, Homo sapiens
cauacagauuugcaa

SEQ ID NO: 988495 - RNA, 17 nt, Homo sapiens
cauagagacuugggaau

SEQ ID NO: 988496 - RNA, 18 nt, Homo sapiens
cauagcuugauaaagggc

SEQ ID NO: 988497 - RNA, 18 nt, Homo sapiens
cauauaacgucaugugca

SEQ ID NO: 988498 - RNA, 18 nt, Homo sapiens
cauauaccaguugugaua

SEQ ID NO: 988499 - RNA, 14 nt, Homo sapiens
cauaugaauaacau

SEQ ID NO: 988500 - RNA, 16 nt, Homo sapiens
cauauugucacugaca

SEQ ID NO: 988501 - RNA, 20 nt, Homo sapiens
caucaaccucuguauuugaa

SEQ ID NO: 988502 - RNA, 14 nt, Homo sapiens
caucagcuccagcu

SEQ ID NO: 988503 - RNA, 13 nt, Homo sapiens
cauccacuuuaug

SEQ ID NO: 988504 - RNA, 19 nt, Homo sapiens
cauccacuuuaugugcauc

SEQ ID NO: 988505 - RNA, 18 nt, Homo sapiens
cauccugcaggcagcuuu

SEQ ID NO: 988506 - RNA, 22 nt, Homo sapiens
caucucuggccuguacccagua

SEQ ID NO: 988507 - RNA, 13 nt, Homo sapiens
caucugauuguga

SEQ ID NO: 988508 - RNA, 22 nt, Homo sapiens
caucugccuccccuucacuccc

SEQ ID NO: 988509 - RNA, 14 nt, Homo sapiens
caucuuguccccaa

SEQ ID NO: 988510 - RNA, 22 nt, Homo sapiens
caugaaccucaagcugcaucua

SEQ ID NO: 988511 - RNA, 15 nt, Homo sapiens
caugagucagucuga

SEQ ID NO: 988512 - RNA, 14 nt, Homo sapiens
caugaguuacacug

SEQ ID NO: 988513 - RNA, 18 nt, Homo sapiens
caugcauuacugcaugca

SEQ ID NO: 988514 - RNA, 17 nt, Homo sapiens
caugcugauuguuauug

SEQ ID NO: 988515 - RNA, 20 nt, Homo sapiens
caugcugcuggggaagacag

SEQ ID NO: 988516 - RNA, 21 nt, Homo sapiens
caugcugcuggggaagacagu

SEQ ID NO: 988517 - RNA, 13 nt, Homo sapiens
cauggaaggcaag

SEQ ID NO: 988518 - RNA, 15 nt, Homo sapiens
cauguaucuaugcau

SEQ ID NO: 988519 - RNA, 17 nt, Homo sapiens
cauguaucuaugcauuu

SEQ ID NO: 988520 - RNA, 17 nt, Homo sapiens
caugucagcaaguccua

SEQ ID NO: 988521 - RNA, 17 nt, Homo sapiens
caugugaaaucauucau

SEQ ID NO: 988522 - RNA, 22 nt, Homo sapiens
cauguucuaaauaaaaagcauu

SEQ ID NO: 988523 - RNA, 21 nt, Homo sapiens
cauuacugcaugcacuucuua

SEQ ID NO: 988524 - RNA, 18 nt, Homo sapiens
cauuagaccaagcuuguc

SEQ ID NO: 988525 - RNA, 17 nt, Homo sapiens
cauuccucaugaaugua

SEQ ID NO: 988526 - RNA, 19 nt, Homo sapiens
cauuccucaugaauguaaa

SEQ ID NO: 988527 - RNA, 16 nt, Homo sapiens
cauucugucuugaagg

SEQ ID NO: 988528 - RNA, 17 nt, Homo sapiens
cauucuucccuugaugg

SEQ ID NO: 988529 - RNA, 23 nt, Homo sapiens
cauuuccuccgucaccucagaga

SEQ ID NO: 988530 - RNA, 19 nt, Homo sapiens
cauuucucauaccuucccc

SEQ ID NO: 988531 - RNA, 14 nt, Homo sapiens
cauuugucaacaaa

SEQ ID NO: 988532 - RNA, 21 nt, Homo sapiens
ccaacaugaaaacaauucuua

SEQ ID NO: 988533 - RNA, 15 nt, Homo sapiens
ccaacaugcacugau

SEQ ID NO: 988534 - RNA, 14 nt, Homo sapiens
ccaacucauccacg

SEQ ID NO: 988535 - RNA, 15 nt, Homo sapiens
ccaagagugaaggga

SEQ ID NO: 988536 - RNA, 20 nt, Homo sapiens
ccaagccuuggggauucuuc

SEQ ID NO: 988537 - RNA, 12 nt, Homo sapiens
ccaaugaaauga

SEQ ID NO: 988538 - RNA, 12 nt, Homo sapiens
ccacauccagcc

SEQ ID NO: 988539 - RNA, 16 nt, Homo sapiens
ccaccaccucaccagu

SEQ ID NO: 988540 - RNA, 16 nt, Homo sapiens
ccaccaggcugcucag

SEQ ID NO: 988541 - RNA, 19 nt, Homo sapiens
ccacggugccuccagaugg

SEQ ID NO: 988542 - RNA, 22 nt, Homo sapiens
ccacuaggguccaccaggaguu

SEQ ID NO: 988543 - RNA, 21 nt, Homo sapiens
ccacugccaaagaacuuggaa

SEQ ID NO: 988544 - RNA, 14 nt, Homo sapiens
ccacuguaugagug

SEQ ID NO: 988545 - RNA, 23 nt, Homo sapiens
ccagaggcucuaauguacaauaa

SEQ ID NO: 988546 - RNA, 16 nt, Homo sapiens
ccagagggaauugcag

SEQ ID NO: 988547 - RNA, 14 nt, Homo sapiens
ccagaucagguaua

SEQ ID NO: 988548 - RNA, 14 nt, Homo sapiens
ccagauucaugcac

SEQ ID NO: 988549 - RNA, 13 nt, Homo sapiens
ccagcucacagga

SEQ ID NO: 988550 - RNA, 23 nt, Homo sapiens
ccaggagcugggcagaaggccaa

SEQ ID NO: 988551 - RNA, 14 nt, Homo sapiens
accucacauacccu

SEQ ID NO: 988552 - RNA, 17 nt, Homo sapiens
accucaggcaaucugcc

SEQ ID NO: 988553 - RNA, 15 nt, Homo sapiens
accugacucuugcag

SEQ ID NO: 988554 - RNA, 20 nt, Homo sapiens
accuggucccugcucucagu

SEQ ID NO: 988555 - RNA, 14 nt, Homo sapiens
accugucaucucac

SEQ ID NO: 988556 - RNA, 13 nt, Homo sapiens
accuuuucccaac

SEQ ID NO: 988557 - RNA, 17 nt, Homo sapiens
acgcacacugucugccc

SEQ ID NO: 988558 - RNA, 18 nt, Homo sapiens
acgcagccugcagacuca

SEQ ID NO: 988559 - RNA, 20 nt, Homo sapiens
acgcagccugcagacucacu

SEQ ID NO: 988560 - RNA, 18 nt, Homo sapiens
acgcaucagacagaugga

SEQ ID NO: 988561 - RNA, 17 nt, Homo sapiens
acgugcacgcacacugu

SEQ ID NO: 988562 - RNA, 16 nt, Homo sapiens
acgugugcaguuguag

SEQ ID NO: 988563 - RNA, 18 nt, Homo sapiens
acuacaagugauccucag

SEQ ID NO: 988564 - RNA, 19 nt, Homo sapiens
acuacagggaccagggaug

SEQ ID NO: 988565 - RNA, 11 nt, Homo sapiens
acuacaugcac

SEQ ID NO: 988566 - RNA, 14 nt, Homo sapiens
acuagaaaauugug

SEQ ID NO: 988567 - RNA, 19 nt, Homo sapiens
acucacauccauucuuccc

SEQ ID NO: 988568 - RNA, 17 nt, Homo sapiens
acucacuaauucauuaa

SEQ ID NO: 988569 - RNA, 15 nt, Homo sapiens
acucaucauuuccau

SEQ ID NO: 988570 - RNA, 12 nt, Homo sapiens
acucaucuuucc

SEQ ID NO: 988571 - RNA, 20 nt, Homo sapiens
acuccuuucucaucuugucc

SEQ ID NO: 988572 - RNA, 14 nt, Homo sapiens
acucuaguauucca

SEQ ID NO: 988573 - RNA, 17 nt, Homo sapiens
acucucaccauuuggau

SEQ ID NO: 988574 - RNA, 18 nt, Homo sapiens
acucuugaaaaaugcaug

SEQ ID NO: 988575 - RNA, 12 nt, Homo sapiens
acugagccagca

SEQ ID NO: 988576 - RNA, 20 nt, Homo sapiens
acugcaaagcucggugcucc

SEQ ID NO: 988577 - RNA, 12 nt, Homo sapiens
acugcaaccucc

SEQ ID NO: 988578 - RNA, 13 nt, Homo sapiens
acugcaaccucca

SEQ ID NO: 988579 - RNA, 17 nt, Homo sapiens
acugcaugcacuucuua

SEQ ID NO: 988580 - RNA, 14 nt, Homo sapiens
acugccuaagcccu

SEQ ID NO: 988581 - RNA, 17 nt, Homo sapiens
acuggacccuguugcua

SEQ ID NO: 988582 - RNA, 23 nt, Homo sapiens
acugggacuaaguguaccagaga

SEQ ID NO: 988583 - RNA, 17 nt, Homo sapiens
acuguaaaaugugggau

SEQ ID NO: 988584 - RNA, 15 nt, Homo sapiens
acugucucucaugaa

SEQ ID NO: 988585 - RNA, 22 nt, Homo sapiens
acugugcaaauauaucugcuau

SEQ ID NO: 988586 - RNA, 23 nt, Homo sapiens
acugugccuuguuucaacaguuu

SEQ ID NO: 988587 - RNA, 12 nt, Homo sapiens
acugugggcucc

SEQ ID NO: 988588 - RNA, 11 nt, Homo sapiens
acuuacaugau

SEQ ID NO: 988589 - RNA, 19 nt, Homo sapiens
acuucguguccgacucuuc

SEQ ID NO: 988590 - RNA, 19 nt, Homo sapiens
acuugaaaauuaacaugaa

SEQ ID NO: 988591 - RNA, 14 nt, Homo sapiens
acuugccucugcac

SEQ ID NO: 988592 - RNA, 17 nt, Homo sapiens
acuugcugcaguaugaa

SEQ ID NO: 988593 - RNA, 21 nt, Homo sapiens
acuuuauagaucagccaguga

SEQ ID NO: 988594 - RNA, 18 nt, Homo sapiens
acuuuauguuacuacaug

SEQ ID NO: 988595 - RNA, 13 nt, Homo sapiens
acuuugugcauuc

SEQ ID NO: 988596 - RNA, 18 nt, Homo sapiens
acuuuuauguuaaugcuc

SEQ ID NO: 988597 - RNA, 17 nt, Homo sapiens
acuuuugauauggccaa

SEQ ID NO: 988598 - RNA, 17 nt, Homo sapiens
agaaaauaagagcucag

SEQ ID NO: 988599 - RNA, 23 nt, Homo sapiens
agaaacagcuucucaauuucuac

SEQ ID NO: 988600 - RNA, 18 nt, Homo sapiens
agaaaccuuuguuugcau

SEQ ID NO: 988601 - RNA, 17 nt, Homo sapiens
agaaauacuacugugua

SEQ ID NO: 988602 - RNA, 23 nt, Homo sapiens
agaaaugucauguggcuaccugu

SEQ ID NO: 988603 - RNA, 18 nt, Homo sapiens
agaagaaggaaauugaau

SEQ ID NO: 988604 - RNA, 16 nt, Homo sapiens
agaagacaccaccauu

SEQ ID NO: 988605 - RNA, 21 nt, Homo sapiens
agaaggugggaggaugugaau

SEQ ID NO: 988606 - RNA, 13 nt, Homo sapiens
agaaucucagucu

SEQ ID NO: 988607 - RNA, 22 nt, Homo sapiens
agaaucucagucugucacccag

SEQ ID NO: 988608 - RNA, 12 nt, Homo sapiens
agaauuugugcc

SEQ ID NO: 988609 - RNA, 19 nt, Homo sapiens
agacaaaaucuuaaaugcc

SEQ ID NO: 988610 - RNA, 21 nt, Homo sapiens
agacaaguauggcuccuccau

SEQ ID NO: 988611 - RNA, 15 nt, Homo sapiens
agacacugaucuggc

SEQ ID NO: 988612 - RNA, 20 nt, Homo sapiens
agacagaaaaaacugagaug

SEQ ID NO: 988613 - RNA, 15 nt, Homo sapiens
agacagaaucucagu

SEQ ID NO: 988614 - RNA, 22 nt, Homo sapiens
agacaggguuucaccauguuag

SEQ ID NO: 988615 - RNA, 13 nt, Homo sapiens
agacauacauuuc

SEQ ID NO: 988616 - RNA, 13 nt, Homo sapiens
agaccuacccucc

SEQ ID NO: 988617 - RNA, 22 nt, Homo sapiens
agaccuuccagaaauacuacug

SEQ ID NO: 988618 - RNA, 19 nt, Homo sapiens
agacuauucccuucuaacc

SEQ ID NO: 988619 - RNA, 23 nt, Homo sapiens
agacucaaagagggagugcauuu

SEQ ID NO: 988620 - RNA, 22 nt, Homo sapiens
agagauuccugagccaguguca

SEQ ID NO: 988621 - RNA, 17 nt, Homo sapiens
agagcaagaccccaucu

SEQ ID NO: 988622 - RNA, 20 nt, Homo sapiens
agagcaagaccccaucucaa

SEQ ID NO: 988623 - RNA, 22 nt, Homo sapiens
agagcagauggccuggcugcug

SEQ ID NO: 988624 - RNA, 19 nt, Homo sapiens
agagccacaguuccccuau

SEQ ID NO: 988625 - RNA, 18 nt, Homo sapiens
agaggcucuaauguacaa

SEQ ID NO: 988626 - RNA, 19 nt, Homo sapiens
agaggcuuccuucauuucc

SEQ ID NO: 988627 - RNA, 16 nt, Homo sapiens
agagguggcgauuugu

SEQ ID NO: 988628 - RNA, 21 nt, Homo sapiens
agaguacaccccaacagcacc

SEQ ID NO: 988629 - RNA, 22 nt, Homo sapiens
agaguaucugaggcacauguca

SEQ ID NO: 988630 - RNA, 14 nt, Homo sapiens
agagugacucacua

SEQ ID NO: 988631 - RNA, 12 nt, Homo sapiens
agaguugaaccu

SEQ ID NO: 988632 - RNA, 15 nt, Homo sapiens
agauacaaacauguu

SEQ ID NO: 988633 - RNA, 18 nt, Homo sapiens
agaucagccagugaccaa

SEQ ID NO: 988634 - RNA, 17 nt, Homo sapiens
agauccuccucauucac

SEQ ID NO: 988635 - RNA, 15 nt, Homo sapiens
agaucuagugaacau

SEQ ID NO: 988636 - RNA, 22 nt, Homo sapiens
agaugacagggaaaacugcaaa

SEQ ID NO: 988637 - RNA, 18 nt, Homo sapiens
agaugacggaugccuaga

SEQ ID NO: 988638 - RNA, 16 nt, Homo sapiens
agaugagaguacaccc

SEQ ID NO: 988639 - RNA, 16 nt, Homo sapiens
agaugcagccccaucu

SEQ ID NO: 988640 - RNA, 20 nt, Homo sapiens
agaugccacccaguugugac

SEQ ID NO: 988641 - RNA, 19 nt, Homo sapiens
agauuacuuuuucuuuaug

SEQ ID NO: 988642 - RNA, 20 nt, Homo sapiens
agauuuuuacacauguaucu

SEQ ID NO: 988643 - RNA, 19 nt, Homo sapiens
agcacccucuccagaugag

SEQ ID NO: 988644 - RNA, 20 nt, Homo sapiens
agcacccucuccagaugcag

SEQ ID NO: 988645 - RNA, 17 nt, Homo sapiens
agcaccuacuuacaugc

SEQ ID NO: 988646 - RNA, 23 nt, Homo sapiens
agcagccagccaacccuuucauu

SEQ ID NO: 988647 - RNA, 22 nt, Homo sapiens
agcaggaagcugugagagcagu

SEQ ID NO: 988648 - RNA, 23 nt, Homo sapiens
agcaguuugguuucuagcaugaa

SEQ ID NO: 988649 - RNA, 22 nt, Homo sapiens
agcauaucugccuuuauugugu

SEQ ID NO: 988650 - RNA, 16 nt, Homo sapiens
agcaugucgucaaagc

SEQ ID NO: 988651 - RNA, 23 nt, Homo sapiens
agccacaguuccccuauguggaa

SEQ ID NO: 988652 - RNA, 18 nt, Homo sapiens
agccacuggacugacgac

SEQ ID NO: 988653 - RNA, 15 nt, Homo sapiens
agccagaggcucuaa

SEQ ID NO: 988654 - RNA, 19 nt, Homo sapiens
agccagaggcucuaaugua

SEQ ID NO: 988655 - RNA, 19 nt, Homo sapiens
agccagccaacccuuucau

SEQ ID NO: 988656 - RNA, 16 nt, Homo sapiens
agccagcucugcauua

SEQ ID NO: 988657 - RNA, 15 nt, Homo sapiens
agcccacacauggga

SEQ ID NO: 988658 - RNA, 13 nt, Homo sapiens
agccccaucagcu

SEQ ID NO: 988659 - RNA, 19 nt, Homo sapiens
agcccuccgccauucucaa

SEQ ID NO: 988660 - RNA, 20 nt, Homo sapiens
agcccuccgccauucucaag

SEQ ID NO: 988661 - RNA, 20 nt, Homo sapiens
agcccuccucucccagugac

SEQ ID NO: 988662 - RNA, 20 nt, Homo sapiens
ugcauuacugcaugcacuuc

SEQ ID NO: 988663 - RNA, 16 nt, Homo sapiens
ugcauuauaucaaauc

SEQ ID NO: 988664 - RNA, 19 nt, Homo sapiens
ugccacccaguugugacaa

SEQ ID NO: 988665 - RNA, 16 nt, Homo sapiens
ugccaggcacacugag

SEQ ID NO: 988666 - RNA, 20 nt, Homo sapiens
ugccaggcuggagugcagug

SEQ ID NO: 988667 - RNA, 14 nt, Homo sapiens
ugcccccaacagca

SEQ ID NO: 988668 - RNA, 12 nt, Homo sapiens
ugccccugagac

SEQ ID NO: 988669 - RNA, 20 nt, Homo sapiens
ugccccugagacaaauggag

SEQ ID NO: 988670 - RNA, 21 nt, Homo sapiens
ugcccgccucgaccucucuca

SEQ ID NO: 988671 - RNA, 20 nt, Homo sapiens
ugccgccuccuugugcacaa

SEQ ID NO: 988672 - RNA, 12 nt, Homo sapiens
ugccucucugca

SEQ ID NO: 988673 - RNA, 22 nt, Homo sapiens
ugccucugagagcaucaggccu

SEQ ID NO: 988674 - RNA, 20 nt, Homo sapiens
ugccuggaagagcagcccua

SEQ ID NO: 988675 - RNA, 13 nt, Homo sapiens
ugccuuuguacuu

SEQ ID NO: 988676 - RNA, 22 nt, Homo sapiens
ugcuaagccccagcaagcaauc

SEQ ID NO: 988677 - RNA, 20 nt, Homo sapiens
ugcuaauuuugaaaaacugc

SEQ ID NO: 988678 - RNA, 12 nt, Homo sapiens
ugcuaucugggc

SEQ ID NO: 988679 - RNA, 21 nt, Homo sapiens
ugcucagcccugcaccaugcu

SEQ ID NO: 988680 - RNA, 15 nt, Homo sapiens
ugcucccuagccaga

SEQ ID NO: 988681 - RNA, 20 nt, Homo sapiens
ugcucccuagccagaggcuc

SEQ ID NO: 988682 - RNA, 18 nt, Homo sapiens
ugcugaacaucacagcuu

SEQ ID NO: 988683 - RNA, 22 nt, Homo sapiens
ugcugucccaaacaugcacuuc

SEQ ID NO: 988684 - RNA, 19 nt, Homo sapiens
ugcuucaggauaccauaua

SEQ ID NO: 988685 - RNA, 22 nt, Homo sapiens
ugcuucuccagccucagccucc

SEQ ID NO: 988686 - RNA, 21 nt, Homo sapiens
uggaaagaaguuggggacaca

SEQ ID NO: 988687 - RNA, 19 nt, Homo sapiens
uggaaauagugauuuccac

SEQ ID NO: 988688 - RNA, 16 nt, Homo sapiens
uggaaggcuuccacua

SEQ ID NO: 988689 - RNA, 19 nt, Homo sapiens
uggaauuuaaaucacucaa

SEQ ID NO: 988690 - RNA, 18 nt, Homo sapiens
uggacguggguugcacug

SEQ ID NO: 988691 - RNA, 19 nt, Homo sapiens
uggagcccacuguacuugc

SEQ ID NO: 988692 - RNA, 20 nt, Homo sapiens
uggaggaucauuugagccca

SEQ ID NO: 988693 - RNA, 13 nt, Homo sapiens
uggauuuuuacca

SEQ ID NO: 988694 - RNA, 15 nt, Homo sapiens
uggcaucaucucagc

SEQ ID NO: 988695 - RNA, 18 nt, Homo sapiens
uggcaucaucucagcuca

SEQ ID NO: 988696 - RNA, 16 nt, Homo sapiens
uggcauuuuacuguac

SEQ ID NO: 988697 - RNA, 19 nt, Homo sapiens
uggcccaacacaauucuuc

SEQ ID NO: 988698 - RNA, 17 nt, Homo sapiens
uggcccagagaagccaa

SEQ ID NO: 988699 - RNA, 16 nt, Homo sapiens
uggccuggggcuucug

SEQ ID NO: 988700 - RNA, 15 nt, Homo sapiens
uggcgcgaucucagc

SEQ ID NO: 988701 - RNA, 18 nt, Homo sapiens
uggcgcgaucucagcuca

SEQ ID NO: 988702 - RNA, 19 nt, Homo sapiens
uggcgcgaucucagcucac

SEQ ID NO: 988703 - RNA, 15 nt, Homo sapiens
uggcuaagauaccaa

SEQ ID NO: 988704 - RNA, 13 nt, Homo sapiens
uggcuaccuguaa

SEQ ID NO: 988705 - RNA, 14 nt, Homo sapiens
uggcugauggagua

SEQ ID NO: 988706 - RNA, 21 nt, Homo sapiens
uggcuucaaauuguaagcaug

SEQ ID NO: 988707 - RNA, 22 nt, Homo sapiens
ugggaauauuugaaucuugucu

SEQ ID NO: 988708 - RNA, 14 nt, Homo sapiens
ugggagacacugau

SEQ ID NO: 988709 - RNA, 14 nt, Homo sapiens
ugggagcugccaag

SEQ ID NO: 988710 - RNA, 17 nt, Homo sapiens
uggggaaaaaacugugc

SEQ ID NO: 988711 - RNA, 13 nt, Homo sapiens
uggggaagacagu

SEQ ID NO: 988712 - RNA, 21 nt, Homo sapiens
ugggucuucccuguaugauuc

SEQ ID NO: 988713 - RNA, 23 nt, Homo sapiens
uggguguuuucuuaaccagauca

SEQ ID NO: 988714 - RNA, 15 nt, Homo sapiens
uggguuuuuuaguug

SEQ ID NO: 988715 - RNA, 14 nt, Homo sapiens
ugguaagcaccagg

SEQ ID NO: 988716 - RNA, 22 nt, Homo sapiens
uggucuaagguucagccugaaa

SEQ ID NO: 988717 - RNA, 18 nt, Homo sapiens
uggugauuccgcagugag

SEQ ID NO: 988718 - RNA, 20 nt, Homo sapiens
uggugcccaguuagccucug

SEQ ID NO: 988719 - RNA, 17 nt, Homo sapiens
ugguguugccaguuguc

SEQ ID NO: 988720 - RNA, 16 nt, Homo sapiens
ugguucaguaccacau

SEQ ID NO: 988721 - RNA, 18 nt, Homo sapiens
ugguuucuagcaugaaga

SEQ ID NO: 988722 - RNA, 18 nt, Homo sapiens
uguaaagugauauuuccc

SEQ ID NO: 988723 - RNA, 12 nt, Homo sapiens
uguaagaacaac

SEQ ID NO: 988724 - RNA, 18 nt, Homo sapiens
uguacaauaaagcaaugu

SEQ ID NO: 988725 - RNA, 23 nt, Homo sapiens
uguacaauaaagcaaugugguag

SEQ ID NO: 988726 - RNA, 13 nt, Homo sapiens
uguaucuaugcau

SEQ ID NO: 988727 - RNA, 15 nt, Homo sapiens
uguaucuaugcauuu

SEQ ID NO: 988728 - RNA, 15 nt, Homo sapiens
uguauuuaacugccu

SEQ ID NO: 988729 - RNA, 14 nt, Homo sapiens
ugucacauaaugcu

SEQ ID NO: 988730 - RNA, 16 nt, Homo sapiens
ugucauccacuuuaug

SEQ ID NO: 988731 - RNA, 22 nt, Homo sapiens
ugucauguggcuaccuguaacu

SEQ ID NO: 988732 - RNA, 18 nt, Homo sapiens
ugucccaaacaugcacuu

SEQ ID NO: 988733 - RNA, 20 nt, Homo sapiens
uguccccaacaccccacaga

SEQ ID NO: 988734 - RNA, 19 nt, Homo sapiens
uguccgacucuucugagca

SEQ ID NO: 988735 - RNA, 11 nt, Homo sapiens
ugucuaccugg

SEQ ID NO: 988736 - RNA, 12 nt, Homo sapiens
ugucucagggug

SEQ ID NO: 988737 - RNA, 22 nt, Homo sapiens
ugucucuggauuauauuaugaa

SEQ ID NO: 988738 - RNA, 19 nt, Homo sapiens
ugucugagacagaaucuca

SEQ ID NO: 988739 - RNA, 20 nt, Homo sapiens
ugucuucaaagcaaagcucu

SEQ ID NO: 988740 - RNA, 16 nt, Homo sapiens
ugugaaauuuacauca

SEQ ID NO: 988741 - RNA, 22 nt, Homo sapiens
ugugagcuaggaauuguguuua

SEQ ID NO: 988742 - RNA, 21 nt, Homo sapiens
ugugaguugcacagcuaugaa

SEQ ID NO: 988743 - RNA, 21 nt, Homo sapiens
ugugauuaucaauuaccacac

SEQ ID NO: 988744 - RNA, 18 nt, Homo sapiens
ugugcaaauauaucugcu

SEQ ID NO: 988745 - RNA, 18 nt, Homo sapiens
uguggaauuuaaaucacu

SEQ ID NO: 988746 - RNA, 20 nt, Homo sapiens
uguggcaaagccuucauugc

SEQ ID NO: 988747 - RNA, 13 nt, Homo sapiens
uguggcagagcca

SEQ ID NO: 988748 - RNA, 15 nt, Homo sapiens
ugugggcuccauuca

SEQ ID NO: 988749 - RNA, 13 nt, Homo sapiens
ugugguacaagca

SEQ ID NO: 988750 - RNA, 17 nt, Homo sapiens
uguguauuuaacugccu

SEQ ID NO: 988751 - RNA, 21 nt, Homo sapiens
ugugucaaacaguacacuauc

SEQ ID NO: 988752 - RNA, 16 nt, Homo sapiens
uguguuuuaaacuggu

SEQ ID NO: 988753 - RNA, 17 nt, Homo sapiens
uguguuuuaaacuggua

SEQ ID NO: 988754 - RNA, 19 nt, Homo sapiens
uguucacaauggauaggca

SEQ ID NO: 988755 - RNA, 12 nt, Homo sapiens
uguucauuuccu

SEQ ID NO: 988756 - RNA, 18 nt, Homo sapiens
uguuccuuauauuuacuc

SEQ ID NO: 988757 - RNA, 22 nt, Homo sapiens
uguucuucuaccacccaccagu

SEQ ID NO: 988758 - RNA, 18 nt, Homo sapiens
uguuuacagacgugugca

SEQ ID NO: 988759 - RNA, 17 nt, Homo sapiens
uguuucuuuguaaugaa

SEQ ID NO: 988760 - RNA, 16 nt, Homo sapiens
uuaaaauagccauaaa

SEQ ID NO: 988761 - RNA, 20 nt, Homo sapiens
uuaaaauaugcucuaaacau

SEQ ID NO: 988762 - RNA, 14 nt, Homo sapiens
uuaaaaucaguauu

SEQ ID NO: 988763 - RNA, 22 nt, Homo sapiens
uuaaacuagcauaucugccuuu

SEQ ID NO: 988764 - RNA, 18 nt, Homo sapiens
uuaaagaagagaacugcc

SEQ ID NO: 988765 - RNA, 19 nt, Homo sapiens
uuaaauucaaguccaggcu

SEQ ID NO: 988766 - RNA, 20 nt, Homo sapiens
uuaaauuugggggacuuaca

SEQ ID NO: 988767 - RNA, 17 nt, Homo sapiens
uuaacauuccucaugaa

SEQ ID NO: 988768 - RNA, 15 nt, Homo sapiens
uuaauggugccuuca

SEQ ID NO: 988769 - RNA, 15 nt, Homo sapiens
uuaauucauguugcc

SEQ ID NO: 988770 - RNA, 21 nt, Homo sapiens
uuaauucauguugccuugcau

SEQ ID NO: 988771 - RNA, 19 nt, Homo sapiens
uuaauuccuucagcacuuu

SEQ ID NO: 988772 - RNA, 20 nt, Homo sapiens
uuaauugaucgacuugccaa

SEQ ID NO: 988773 - RNA, 20 nt, Homo sapiens
uuacaauaauucuaugagau

SEQ ID NO: 988774 - RNA, 13 nt, Homo sapiens
uuacaugauucau

SEQ ID NO: 988775 - RNA, 12 nt, Homo sapiens
uuacaugcauua

SEQ ID NO: 988776 - RNA, 13 nt, Homo sapiens
uuacaugcauuac

SEQ ID NO: 988777 - RNA, 16 nt, Homo sapiens
uuacuuuauguuacua

SEQ ID NO: 988778 - RNA, 20 nt, Homo sapiens
uuagaccaagcuuguccaac

SEQ ID NO: 988779 - RNA, 11 nt, Homo sapiens
uuagacuguug

SEQ ID NO: 988780 - RNA, 20 nt, Homo sapiens
uuagucgugagcucuuguga

SEQ ID NO: 988781 - RNA, 19 nt, Homo sapiens
uuauauuauggaggcagga

SEQ ID NO: 988782 - RNA, 17 nt, Homo sapiens
uuauccuaucucuccaa

SEQ ID NO: 988783 - RNA, 16 nt, Homo sapiens
uuaugaguggcuuuaa

SEQ ID NO: 988784 - RNA, 13 nt, Homo sapiens
uuaugcggcauuu

SEQ ID NO: 988785 - RNA, 16 nt, Homo sapiens
uuauugacucauacac

SEQ ID NO: 988786 - RNA, 12 nt, Homo sapiens
uuauugccucac

SEQ ID NO: 988787 - RNA, 20 nt, Homo sapiens
uucaagcgauucucuugccu

SEQ ID NO: 988788 - RNA, 13 nt, Homo sapiens
uucaccaauaagu

SEQ ID NO: 988789 - RNA, 15 nt, Homo sapiens
uucacccuguccaaa

SEQ ID NO: 988790 - RNA, 12 nt, Homo sapiens
uucacugugcaa

SEQ ID NO: 988791 - RNA, 15 nt, Homo sapiens
uucagacaagcugca

SEQ ID NO: 988792 - RNA, 17 nt, Homo sapiens
agacucacugugggaag

SEQ ID NO: 988793 - RNA, 18 nt, Homo sapiens
agacucugucuaccuggu

SEQ ID NO: 988794 - RNA, 16 nt, Homo sapiens
agacuuuaucaugugu

SEQ ID NO: 988795 - RNA, 21 nt, Homo sapiens
agagacagcuugaucaaaggc

SEQ ID NO: 988796 - RNA, 20 nt, Homo sapiens
agagaguaucugaggcacau

SEQ ID NO: 988797 - RNA, 19 nt, Homo sapiens
agagcuacccgcagaguuc

SEQ ID NO: 988798 - RNA, 13 nt, Homo sapiens
agagcuggaggca

SEQ ID NO: 988799 - RNA, 14 nt, Homo sapiens
agaggacuccuuaa

SEQ ID NO: 988800 - RNA, 20 nt, Homo sapiens
agaggcucuaauguacaaua

SEQ ID NO: 988801 - RNA, 15 nt, Homo sapiens
agaggcuguucccac

SEQ ID NO: 988802 - RNA, 21 nt, Homo sapiens
agagguagucucacugcuuga

SEQ ID NO: 988803 - RNA, 20 nt, Homo sapiens
agaguaauccaagcaaaugu

SEQ ID NO: 988804 - RNA, 13 nt, Homo sapiens
agaguacacccca

SEQ ID NO: 988805 - RNA, 19 nt, Homo sapiens
agaguacaccccaacagca

SEQ ID NO: 988806 - RNA, 20 nt, Homo sapiens
agaguacaccccaacagcac

SEQ ID NO: 988807 - RNA, 18 nt, Homo sapiens
agauacagggaugaggca

SEQ ID NO: 988808 - RNA, 21 nt, Homo sapiens
agauauacuugguucucucca

SEQ ID NO: 988809 - RNA, 15 nt, Homo sapiens
agauaucucaucucu

SEQ ID NO: 988810 - RNA, 19 nt, Homo sapiens
agaucuaacaagauagcca

SEQ ID NO: 988811 - RNA, 20 nt, Homo sapiens
agaucuuuuauuuugccaag

SEQ ID NO: 988812 - RNA, 19 nt, Homo sapiens
agaugccacuagcccuccu

SEQ ID NO: 988813 - RNA, 21 nt, Homo sapiens
agauggaaaagggagauucag

SEQ ID NO: 988814 - RNA, 20 nt, Homo sapiens
agauggccuggcugcugcug

SEQ ID NO: 988815 - RNA, 22 nt, Homo sapiens
agauguagccccucuccuggaa

SEQ ID NO: 988816 - RNA, 20 nt, Homo sapiens
agauguucacccaaccacau

SEQ ID NO: 988817 - RNA, 18 nt, Homo sapiens
agauguuuaguaaucaua

SEQ ID NO: 988818 - RNA, 15 nt, Homo sapiens
agauucaugcacugu

SEQ ID NO: 988819 - RNA, 22 nt, Homo sapiens
agauucuaauggcuuuauugca

SEQ ID NO: 988820 - RNA, 23 nt, Homo sapiens
agauuguuccugcuuuuccccaa

SEQ ID NO: 988821 - RNA, 22 nt, Homo sapiens
agcaaaaccaaauauuccagag

SEQ ID NO: 988822 - RNA, 18 nt, Homo sapiens
agcaagaccccaucucaa

SEQ ID NO: 988823 - RNA, 15 nt, Homo sapiens
agcaaguuagaacua

SEQ ID NO: 988824 - RNA, 14 nt, Homo sapiens
agcacccucuccag

SEQ ID NO: 988825 - RNA, 18 nt, Homo sapiens
agcaccuacuuacaugca

SEQ ID NO: 988826 - RNA, 21 nt, Homo sapiens
agcaccuacuuacaugcauua

SEQ ID NO: 988827 - RNA, 22 nt, Homo sapiens
agcagcuuuagccaagugcagg

SEQ ID NO: 988828 - RNA, 14 nt, Homo sapiens
agcaggauuucuca

SEQ ID NO: 988829 - RNA, 19 nt, Homo sapiens
agcaggggugcugggaccu

SEQ ID NO: 988830 - RNA, 12 nt, Homo sapiens
agccacaguaua

SEQ ID NO: 988831 - RNA, 17 nt, Homo sapiens
agccaccacauccagcc

SEQ ID NO: 988832 - RNA, 18 nt, Homo sapiens
agccagggcugucuucgu

SEQ ID NO: 988833 - RNA, 15 nt, Homo sapiens
agccagguucugacu

SEQ ID NO: 988834 - RNA, 19 nt, Homo sapiens
agccaugggagacacugau

SEQ ID NO: 988835 - RNA, 19 nt, Homo sapiens
agcccaggauacuggcaca

SEQ ID NO: 988836 - RNA, 22 nt, Homo sapiens
agccccugggcccaguaccuag

SEQ ID NO: 988837 - RNA, 15 nt, Homo sapiens
agcccucccuaccua

SEQ ID NO: 988838 - RNA, 18 nt, Homo sapiens
agcccucccuaccuacca

SEQ ID NO: 988839 - RNA, 23 nt, Homo sapiens
agcccuccucucccagugacaac

SEQ ID NO: 988840 - RNA, 16 nt, Homo sapiens
agcccugcaccaugcu

SEQ ID NO: 988841 - RNA, 18 nt, Homo sapiens
agcccuuaggaagaauuu

SEQ ID NO: 988842 - RNA, 23 nt, Homo sapiens
agccucaagucuuauuuccucaa

SEQ ID NO: 988843 - RNA, 19 nt, Homo sapiens
agccuccuuucuggcuuug

SEQ ID NO: 988844 - RNA, 23 nt, Homo sapiens
agccugaaacucauagacacuga

SEQ ID NO: 988845 - RNA, 12 nt, Homo sapiens
agccugccuuuc

SEQ ID NO: 988846 - RNA, 17 nt, Homo sapiens
agccugcucccuagcca

SEQ ID NO: 988847 - RNA, 20 nt, Homo sapiens
agccugcucccuagccagag

SEQ ID NO: 988848 - RNA, 19 nt, Homo sapiens
agccuggcuucaaauugua

SEQ ID NO: 988849 - RNA, 15 nt, Homo sapiens
agccuggguguaaaa

SEQ ID NO: 988850 - RNA, 14 nt, Homo sapiens
agccuucauugccu

SEQ ID NO: 988851 - RNA, 13 nt, Homo sapiens
agcuacaggacau

SEQ ID NO: 988852 - RNA, 22 nt, Homo sapiens
agcuaccugcucagcccugcac

SEQ ID NO: 988853 - RNA, 17 nt, Homo sapiens
agcucacugcaaccucc

SEQ ID NO: 988854 - RNA, 23 nt, Homo sapiens
agcucuucuccauccuaccacaa

SEQ ID NO: 988855 - RNA, 16 nt, Homo sapiens
agcugaaggugaaaca

SEQ ID NO: 988856 - RNA, 13 nt, Homo sapiens
agcuggagggacc

SEQ ID NO: 988857 - RNA, 14 nt, Homo sapiens
agcuggcucuguga

SEQ ID NO: 988858 - RNA, 16 nt, Homo sapiens
agcuggcucugugagg

SEQ ID NO: 988859 - RNA, 22 nt, Homo sapiens
agcuuaaacagcuggucagccc

SEQ ID NO: 988860 - RNA, 19 nt, Homo sapiens
aggaauccucugugucuuc

SEQ ID NO: 988861 - RNA, 14 nt, Homo sapiens
aggacccuucccuu

SEQ ID NO: 988862 - RNA, 13 nt, Homo sapiens
aggacuccuuaaa

SEQ ID NO: 988863 - RNA, 16 nt, Homo sapiens
aggacuuuauagauca

SEQ ID NO: 988864 - RNA, 17 nt, Homo sapiens
aggagcaugagugccgu

SEQ ID NO: 988865 - RNA, 23 nt, Homo sapiens
aggagguccuuaggccucugaga

SEQ ID NO: 988866 - RNA, 22 nt, Homo sapiens
aggaguacaccccaacagcacc

SEQ ID NO: 988867 - RNA, 21 nt, Homo sapiens
aggauauccucccuccagaua

SEQ ID NO: 988868 - RNA, 23 nt, Homo sapiens
aggaugguggcaggaaaauggac

SEQ ID NO: 988869 - RNA, 22 nt, Homo sapiens
aggauuucucaacuuugauacu

SEQ ID NO: 988870 - RNA, 16 nt, Homo sapiens
aggcaaauaucuugaa

SEQ ID NO: 988871 - RNA, 20 nt, Homo sapiens
aggcaaucauggugcucaga

SEQ ID NO: 988872 - RNA, 20 nt, Homo sapiens
aggcagcuuuuucucuccca

SEQ ID NO: 988873 - RNA, 21 nt, Homo sapiens
aggcauguagcuacaggacau

SEQ ID NO: 988874 - RNA, 20 nt, Homo sapiens
aggccgggcacgguggcuca

SEQ ID NO: 988875 - RNA, 23 nt, Homo sapiens
aggccuagacucugucuaccugg

SEQ ID NO: 988876 - RNA, 13 nt, Homo sapiens
aggccucugagaa

SEQ ID NO: 988877 - RNA, 15 nt, Homo sapiens
aggcuacuguaaggc

SEQ ID NO: 988878 - RNA, 12 nt, Homo sapiens
aggcucuaaugu

SEQ ID NO: 988879 - RNA, 22 nt, Homo sapiens
aggcucuaauguacaauaaagc

SEQ ID NO: 988880 - RNA, 14 nt, Homo sapiens
aggcuggagugcag

SEQ ID NO: 988881 - RNA, 13 nt, Homo sapiens
aggcuuccuucau

SEQ ID NO: 988882 - RNA, 17 nt, Homo sapiens
aggcuuccuucauuucc

SEQ ID NO: 988883 - RNA, 13 nt, Homo sapiens
aggcuuugcccug

SEQ ID NO: 988884 - RNA, 12 nt, Homo sapiens
agggaaaacugc

SEQ ID NO: 988885 - RNA, 14 nt, Homo sapiens
agggaccuugucuc

SEQ ID NO: 988886 - RNA, 14 nt, Homo sapiens
agggagaacgggaa

SEQ ID NO: 988887 - RNA, 14 nt, Homo sapiens
agggagauucagac

SEQ ID NO: 988888 - RNA, 18 nt, Homo sapiens
agggcaagagccacagua

SEQ ID NO: 988889 - RNA, 17 nt, Homo sapiens
agggcaauuaauuccuu

SEQ ID NO: 988890 - RNA, 23 nt, Homo sapiens
agggccacauagaugcugaugga

SEQ ID NO: 988891 - RNA, 22 nt, Homo sapiens
agggcucuuuccuccacaccau

SEQ ID NO: 988892 - RNA, 15 nt, Homo sapiens
aggguuucauugucu

SEQ ID NO: 988893 - RNA, 19 nt, Homo sapiens
agguaaaagcaucacauga

SEQ ID NO: 988894 - RNA, 23 nt, Homo sapiens
agguauaauucacauuguauuca

SEQ ID NO: 988895 - RNA, 18 nt, Homo sapiens
aggucaagaacacaguga

SEQ ID NO: 988896 - RNA, 19 nt, Homo sapiens
aggugcuaucgcaccacug

SEQ ID NO: 988897 - RNA, 17 nt, Homo sapiens
aguaacucaucugucac

SEQ ID NO: 988898 - RNA, 18 nt, Homo sapiens
aguaacucaucugucacc

SEQ ID NO: 988899 - RNA, 17 nt, Homo sapiens
aguacaccccaacagca

SEQ ID NO: 988900 - RNA, 23 nt, Homo sapiens
aguacaccccaacagcacccucu

SEQ ID NO: 988901 - RNA, 21 nt, Homo sapiens
aguaccuagcuggcucuguga

SEQ ID NO: 988902 - RNA, 17 nt, Homo sapiens
aguagaaaggccuuuaa

SEQ ID NO: 988903 - RNA, 19 nt, Homo sapiens
aguagagacggguuucacc

SEQ ID NO: 988904 - RNA, 16 nt, Homo sapiens
aguauauaacuaacaa

SEQ ID NO: 988905 - RNA, 16 nt, Homo sapiens
aguaucugaggcacau

SEQ ID NO: 988906 - RNA, 18 nt, Homo sapiens
aguauggcuccuccauau

SEQ ID NO: 988907 - RNA, 20 nt, Homo sapiens
aguauuauuguugcauuaaa

SEQ ID NO: 988908 - RNA, 20 nt, Homo sapiens
aguauugacuuguauaccuu

SEQ ID NO: 988909 - RNA, 17 nt, Homo sapiens
agucccuccacauuucc

SEQ ID NO: 988910 - RNA, 12 nt, Homo sapiens
aguccugggauu

SEQ ID NO: 988911 - RNA, 15 nt, Homo sapiens
aguccuucccuuuca

SEQ ID NO: 988912 - RNA, 17 nt, Homo sapiens
aguccuucccuuucauu

SEQ ID NO: 988913 - RNA, 18 nt, Homo sapiens
agucugugacccacuuac

SEQ ID NO: 988914 - RNA, 14 nt, Homo sapiens
agucuuaauauaua

SEQ ID NO: 988915 - RNA, 19 nt, Homo sapiens
agucuuccucccuguguau

SEQ ID NO: 988916 - RNA, 11 nt, Homo sapiens
agucuugccuu

SEQ ID NO: 988917 - RNA, 21 nt, Homo sapiens
agugacucacuaauucauuaa

SEQ ID NO: 988918 - RNA, 21 nt, Homo sapiens
agugauaucccccagccucaa

SEQ ID NO: 988919 - RNA, 12 nt, Homo sapiens
agugauccucag

SEQ ID NO: 988920 - RNA, 21 nt, Homo sapiens
agugcaguggcaucaucucag

SEQ ID NO: 988921 - RNA, 22 nt, Homo sapiens
agugcaguggcaucaucucagc

SEQ ID NO: 988922 - RNA, 21 nt, Homo sapiens
agugcaguggcgcgaucucag

SEQ ID NO: 988923 - RNA, 20 nt, Homo sapiens
auuauuuuugagacagaguc

SEQ ID NO: 988924 - RNA, 15 nt, Homo sapiens
auucaagucagcucu

SEQ ID NO: 988925 - RNA, 15 nt, Homo sapiens
auucacccuguccaa

SEQ ID NO: 988926 - RNA, 22 nt, Homo sapiens
auucagacuguuuuucagggag

SEQ ID NO: 988927 - RNA, 13 nt, Homo sapiens
auucaugcacugu

SEQ ID NO: 988928 - RNA, 13 nt, Homo sapiens
auucaugcugauu

SEQ ID NO: 988929 - RNA, 21 nt, Homo sapiens
auucauuuuaacaucugagaa

SEQ ID NO: 988930 - RNA, 13 nt, Homo sapiens
auucccccagugc

SEQ ID NO: 988931 - RNA, 14 nt, Homo sapiens
auucuccauacucu

SEQ ID NO: 988932 - RNA, 11 nt, Homo sapiens
auucuccucau

SEQ ID NO: 988933 - RNA, 21 nt, Homo sapiens
auucuuggguguuuauccuau

SEQ ID NO: 988934 - RNA, 16 nt, Homo sapiens
auugaaggaugcuguc

SEQ ID NO: 988935 - RNA, 22 nt, Homo sapiens
auugagauguguucacaaugga

SEQ ID NO: 988936 - RNA, 16 nt, Homo sapiens
auugcaagaguuuaau

SEQ ID NO: 988937 - RNA, 20 nt, Homo sapiens
auugcagcgauuaauaacag

SEQ ID NO: 988938 - RNA, 19 nt, Homo sapiens
auugcucucccagcccuug

SEQ ID NO: 988939 - RNA, 12 nt, Homo sapiens
auugcuugcaca

SEQ ID NO: 988940 - RNA, 14 nt, Homo sapiens
auuguaagcaugca

SEQ ID NO: 988941 - RNA, 15 nt, Homo sapiens
auugugcaguacuuu

SEQ ID NO: 988942 - RNA, 14 nt, Homo sapiens
auuuaacuauucau

SEQ ID NO: 988943 - RNA, 16 nt, Homo sapiens
auuuagauuggcagug

SEQ ID NO: 988944 - RNA, 21 nt, Homo sapiens
auuuauaaaaauaaaaaacac

SEQ ID NO: 988945 - RNA, 15 nt, Homo sapiens
caggcgugaccugcc

SEQ ID NO: 988946 - RNA, 20 nt, Homo sapiens
caggcgugagccaccaugcc

SEQ ID NO: 988947 - RNA, 20 nt, Homo sapiens
caggcuugaaucaaagaacu

SEQ ID NO: 988948 - RNA, 16 nt, Homo sapiens
cagggaaaacugcaaa

SEQ ID NO: 988949 - RNA, 23 nt, Homo sapiens
cagggcugucuucguauucccau

SEQ ID NO: 988950 - RNA, 14 nt, Homo sapiens
caggugaacaaagu

SEQ ID NO: 988951 - RNA, 20 nt, Homo sapiens
caggugugagccacccugcc

SEQ ID NO: 988952 - RNA, 20 nt, Homo sapiens
caggugugagccacggugcc

SEQ ID NO: 988953 - RNA, 22 nt, Homo sapiens
cagguucaagugcuucuccagc

SEQ ID NO: 988954 - RNA, 21 nt, Homo sapiens
cagguucugacucuuggcaca

SEQ ID NO: 988955 - RNA, 17 nt, Homo sapiens
cagguuggagugcagug

SEQ ID NO: 988956 - RNA, 12 nt, Homo sapiens
caguaugcuugg

SEQ ID NO: 988957 - RNA, 23 nt, Homo sapiens
cagucuaaaaaaggaauccucug

SEQ ID NO: 988958 - RNA, 19 nt, Homo sapiens
cagucucacaugauuccag

SEQ ID NO: 988959 - RNA, 15 nt, Homo sapiens
cagugacaaccaaaa

SEQ ID NO: 988960 - RNA, 18 nt, Homo sapiens
cagugacuccacucugag

SEQ ID NO: 988961 - RNA, 19 nt, Homo sapiens
cagugagcuuggaaaggac

SEQ ID NO: 988962 - RNA, 14 nt, Homo sapiens
caguggaacuaaga

SEQ ID NO: 988963 - RNA, 16 nt, Homo sapiens
caguggcaucaucuca

SEQ ID NO: 988964 - RNA, 17 nt, Homo sapiens
caguggcaucaucucag

SEQ ID NO: 988965 - RNA, 19 nt, Homo sapiens
caguuccccuauguggaag

SEQ ID NO: 988966 - RNA, 17 nt, Homo sapiens
cauaauauaaaacagga

SEQ ID NO: 988967 - RNA, 20 nt, Homo sapiens
cauacaccuaugucauuuca

SEQ ID NO: 988968 - RNA, 20 nt, Homo sapiens
cauacaugcauacacucuca

SEQ ID NO: 988969 - RNA, 17 nt, Homo sapiens
cauaccguguaccucag

SEQ ID NO: 988970 - RNA, 21 nt, Homo sapiens
cauagagacuugggaaugagc

SEQ ID NO: 988971 - RNA, 16 nt, Homo sapiens
cauagguuuaauaauu

SEQ ID NO: 988972 - RNA, 15 nt, Homo sapiens
cauauaaucuuacaa

SEQ ID NO: 988973 - RNA, 21 nt, Homo sapiens
caucaagucuuucacauuuaa

SEQ ID NO: 988974 - RNA, 14 nt, Homo sapiens
caucaggcuuucuu

SEQ ID NO: 988975 - RNA, 23 nt, Homo sapiens
caucauaauauaaaacaggaugg

SEQ ID NO: 988976 - RNA, 21 nt, Homo sapiens
caucccacucacaacagcugc

SEQ ID NO: 988977 - RNA, 19 nt, Homo sapiens
caucccuagucucuaccca

SEQ ID NO: 988978 - RNA, 20 nt, Homo sapiens
cauccgcaaauuuucuucca

SEQ ID NO: 988979 - RNA, 19 nt, Homo sapiens
caucuagaggcuuccuuca

SEQ ID NO: 988980 - RNA, 20 nt, Homo sapiens
caucuagaggcuuccuucau

SEQ ID NO: 988981 - RNA, 14 nt, Homo sapiens
caucugauugugau

SEQ ID NO: 988982 - RNA, 20 nt, Homo sapiens
caucuuauuucugucaacuu

SEQ ID NO: 988983 - RNA, 13 nt, Homo sapiens
caucuuucacuau

SEQ ID NO: 988984 - RNA, 21 nt, Homo sapiens
caugaacuuguaaaggaauuu

SEQ ID NO: 988985 - RNA, 17 nt, Homo sapiens
caugaauauuuaguguu

SEQ ID NO: 988986 - RNA, 14 nt, Homo sapiens
caugaauucuguca

SEQ ID NO: 988987 - RNA, 14 nt, Homo sapiens
caugaauuugugaa

SEQ ID NO: 988988 - RNA, 20 nt, Homo sapiens
caugagcuggcgggauugaa

SEQ ID NO: 988989 - RNA, 13 nt, Homo sapiens
caugcacuucuua

SEQ ID NO: 988990 - RNA, 20 nt, Homo sapiens
caugcugaacaucacagcuu

SEQ ID NO: 988991 - RNA, 15 nt, Homo sapiens
caugcugcuggggaa

SEQ ID NO: 988992 - RNA, 17 nt, Homo sapiens
caugucaaggguucaag

SEQ ID NO: 988993 - RNA, 17 nt, Homo sapiens
cauuaaaaaugcauaua

SEQ ID NO: 988994 - RNA, 15 nt, Homo sapiens
cauuacaggugugag

SEQ ID NO: 988995 - RNA, 13 nt, Homo sapiens
cauuacucugaaa

SEQ ID NO: 988996 - RNA, 19 nt, Homo sapiens
cauuacucugaaauuguaa

SEQ ID NO: 988997 - RNA, 15 nt, Homo sapiens
cauuacugcaugcac

SEQ ID NO: 988998 - RNA, 12 nt, Homo sapiens
cauuagaccaag

SEQ ID NO: 988999 - RNA, 19 nt, Homo sapiens
cauuagaccaagcuugucc

SEQ ID NO: 989000 - RNA, 16 nt, Homo sapiens
cauuauccaucuuuca

SEQ ID NO: 989001 - RNA, 19 nt, Homo sapiens
cauuauccaucuuucacua

SEQ ID NO: 989002 - RNA, 15 nt, Homo sapiens
cauucaggucuuucu

SEQ ID NO: 989003 - RNA, 18 nt, Homo sapiens
cauuccucaugaauguaa

SEQ ID NO: 989004 - RNA, 14 nt, Homo sapiens
cauucucaagcccu

SEQ ID NO: 989005 - RNA, 13 nt, Homo sapiens
cauugacugucac

SEQ ID NO: 989006 - RNA, 14 nt, Homo sapiens
cauugacugucaca

SEQ ID NO: 989007 - RNA, 19 nt, Homo sapiens
cauugucugugaagugaga

SEQ ID NO: 989008 - RNA, 15 nt, Homo sapiens
cauuugaaugcauuu

SEQ ID NO: 989009 - RNA, 22 nt, Homo sapiens
cauuugucaacaaagucaccca

SEQ ID NO: 989010 - RNA, 13 nt, Homo sapiens
ccaaacaugcacu

SEQ ID NO: 989011 - RNA, 19 nt, Homo sapiens
ccaaaggucaagaacacag

SEQ ID NO: 989012 - RNA, 10 nt, Homo sapiens
ccaacagcac

SEQ ID NO: 989013 - RNA, 21 nt, Homo sapiens
ccaacagcacccucuccagau

SEQ ID NO: 989014 - RNA, 17 nt, Homo sapiens
ccaacguggcccagaga

SEQ ID NO: 989015 - RNA, 14 nt, Homo sapiens
ccaauuauguuaaa

SEQ ID NO: 989016 - RNA, 14 nt, Homo sapiens
ccacaggcacaggu

SEQ ID NO: 989017 - RNA, 20 nt, Homo sapiens
ccacaguggaaagacagcuu

SEQ ID NO: 989018 - RNA, 23 nt, Homo sapiens
ccacccgaacgucuuaucuaauc

SEQ ID NO: 989019 - RNA, 18 nt, Homo sapiens
ccacccucccacugccaa

SEQ ID NO: 989020 - RNA, 16 nt, Homo sapiens
ccaccugacucuugca

SEQ ID NO: 989021 - RNA, 17 nt, Homo sapiens
ccacggugccuccagau

SEQ ID NO: 989022 - RNA, 14 nt, Homo sapiens
ccacugccaaagaa

SEQ ID NO: 989023 - RNA, 21 nt, Homo sapiens
ccacuugcuuuuaaaauccac

SEQ ID NO: 989024 - RNA, 15 nt, Homo sapiens
ccacuuuaucuugaa

SEQ ID NO: 989025 - RNA, 13 nt, Homo sapiens
ccagaaagcaguu

SEQ ID NO: 989026 - RNA, 15 nt, Homo sapiens
ccagaccauugucuc

SEQ ID NO: 989027 - RNA, 13 nt, Homo sapiens
ccagagaagccaa

SEQ ID NO: 989028 - RNA, 18 nt, Homo sapiens
ccagaggcucuaauguac

SEQ ID NO: 989029 - RNA, 21 nt, Homo sapiens
ccagaggcucuaauguacaau

SEQ ID NO: 989030 - RNA, 21 nt, Homo sapiens
ccagauggcagguuugcaauc

SEQ ID NO: 989031 - RNA, 18 nt, Homo sapiens
ccagcaugcugagauuac

SEQ ID NO: 989032 - RNA, 15 nt, Homo sapiens
ccagccugcucccua

SEQ ID NO: 989033 - RNA, 22 nt, Homo sapiens
ccaggauauccucccuccagau

SEQ ID NO: 989034 - RNA, 17 nt, Homo sapiens
ccaggauggcgcaggaa

SEQ ID NO: 989035 - RNA, 16 nt, Homo sapiens
ccagguuggagugcag

SEQ ID NO: 989036 - RNA, 19 nt, Homo sapiens
ccagguuggagugcagugg

SEQ ID NO: 989037 - RNA, 11 nt, Homo sapiens
ccagucuuccu

SEQ ID NO: 989038 - RNA, 17 nt, Homo sapiens
ccagugacaaccaaaag

SEQ ID NO: 989039 - RNA, 22 nt, Homo sapiens
ccaucauaauauaaaacaggau

SEQ ID NO: 989040 - RNA, 15 nt, Homo sapiens
ccaucucuuguuuaa

SEQ ID NO: 989041 - RNA, 22 nt, Homo sapiens
ccaugcugcuggggaagacagu

SEQ ID NO: 989042 - RNA, 23 nt, Homo sapiens
ccauguuggcuagacuagucuca

SEQ ID NO: 989043 - RNA, 21 nt, Homo sapiens
ccauuagcauuugucaacaaa

SEQ ID NO: 989044 - RNA, 22 nt, Homo sapiens
ccauuagcauuugucaacaaag

SEQ ID NO: 989045 - RNA, 21 nt, Homo sapiens
ccauucaggucuuucuuuccg

SEQ ID NO: 989046 - RNA, 14 nt, Homo sapiens
cccagagaagccaa

SEQ ID NO: 989047 - RNA, 13 nt, Homo sapiens
cccagcggcauca

SEQ ID NO: 989048 - RNA, 18 nt, Homo sapiens
cccaggaccccauggcag

SEQ ID NO: 989049 - RNA, 12 nt, Homo sapiens
cccaggaguaca

SEQ ID NO: 989050 - RNA, 16 nt, Homo sapiens
cccaggaguauccucu

SEQ ID NO: 989051 - RNA, 19 nt, Homo sapiens
cccaguaacucaucuguca

SEQ ID NO: 989052 - RNA, 17 nt, Homo sapiens
cccaucagcuccagcug

SEQ ID NO: 989053 - RNA, 23 nt, Homo sapiens
ccccagccugcucccuagccaga

SEQ ID NO: 989054 - RNA, 16 nt, Homo sapiens
cccccacuacaaguga

SEQ ID NO: 989055 - RNA, 23 nt, Homo sapiens
ccccuucuccccugcacuguaaa

SEQ ID NO: 989056 - RNA, 20 nt, Homo sapiens
cccuacaaaaccacuggaaa

SEQ ID NO: 989057 - RNA, 11 nt, Homo sapiens
cccuacuggga

SEQ ID NO: 989058 - RNA, 18 nt, Homo sapiens
guggcccagagaagccaa

SEQ ID NO: 989059 - RNA, 14 nt, Homo sapiens
guggcgugaucuca

SEQ ID NO: 989060 - RNA, 15 nt, Homo sapiens
gugggaggaugugaa

SEQ ID NO: 989061 - RNA, 14 nt, Homo sapiens
guggguugcacugg

SEQ ID NO: 989062 - RNA, 22 nt, Homo sapiens
guggucuaagguucagccugaa

SEQ ID NO: 989063 - RNA, 16 nt, Homo sapiens
guguguaguaaaguau

SEQ ID NO: 989064 - RNA, 14 nt, Homo sapiens
guguucugugauau

SEQ ID NO: 989065 - RNA, 15 nt, Homo sapiens
guguucugugauaua

SEQ ID NO: 989066 - RNA, 17 nt, Homo sapiens
guguuuuuaacauguca

SEQ ID NO: 989067 - RNA, 16 nt, Homo sapiens
guuaaacuagcauauc

SEQ ID NO: 989068 - RNA, 14 nt, Homo sapiens
guuaauauggugua

SEQ ID NO: 989069 - RNA, 16 nt, Homo sapiens
guuagaacuagccaaa

SEQ ID NO: 989070 - RNA, 19 nt, Homo sapiens
guucaacuuuuccuuugaa

SEQ ID NO: 989071 - RNA, 18 nt, Homo sapiens
cucccuccagauauacuu

SEQ ID NO: 989072 - RNA, 14 nt, Homo sapiens
cuccgucaccucag

SEQ ID NO: 989073 - RNA, 19 nt, Homo sapiens
cuccuaagcuggagugcag

SEQ ID NO: 989074 - RNA, 18 nt, Homo sapiens
cuccucagggacucaggu

SEQ ID NO: 989075 - RNA, 16 nt, Homo sapiens
cuccuuuuuccuucca

SEQ ID NO: 989076 - RNA, 23 nt, Homo sapiens
cucgaggagguaaugaauuaaag

SEQ ID NO: 989077 - RNA, 20 nt, Homo sapiens
cucggcucaccgugagaaag

SEQ ID NO: 989078 - RNA, 14 nt, Homo sapiens
cucuaaacauuuca

SEQ ID NO: 989079 - RNA, 15 nt, Homo sapiens
cucuaaacauuucau

SEQ ID NO: 989080 - RNA, 16 nt, Homo sapiens
cucuaauguacaauaa

SEQ ID NO: 989081 - RNA, 23 nt, Homo sapiens
cucuaauguacaauaaagcaaug

SEQ ID NO: 989082 - RNA, 21 nt, Homo sapiens
cucuaugguguggcaaagccu

SEQ ID NO: 989083 - RNA, 15 nt, Homo sapiens
cucucggugcuucca

SEQ ID NO: 989084 - RNA, 19 nt, Homo sapiens
ucugucacuuaauugcuac

SEQ ID NO: 989085 - RNA, 21 nt, Homo sapiens
ucuguuuauaaacauuguaua

SEQ ID NO: 989086 - RNA, 17 nt, Homo sapiens
ucuuaaaauagccauaa

SEQ ID NO: 989087 - RNA, 15 nt, Homo sapiens
ucuuacuggugcuau

SEQ ID NO: 989088 - RNA, 19 nt, Homo sapiens
ucuuaugccauauaauuca

SEQ ID NO: 989089 - RNA, 19 nt, Homo sapiens
ucuucaaagcaaagcucuu

SEQ ID NO: 989090 - RNA, 22 nt, Homo sapiens
ucuucaccuuaggaauaaucuc

SEQ ID NO: 989091 - RNA, 15 nt, Homo sapiens
ucuuccacagugccu

SEQ ID NO: 989092 - RNA, 13 nt, Homo sapiens
ucuuccaucugau

SEQ ID NO: 989093 - RNA, 23 nt, Homo sapiens
ucuucccuguaugauuccuugau

SEQ ID NO: 989094 - RNA, 15 nt, Homo sapiens
ucuucucccaauuca

SEQ ID NO: 989095 - RNA, 24 nt, Homo sapiens
ucuucuuugcccacaaugcuuugc

SEQ ID NO: 989096 - RNA, 11 nt, Homo sapiens
acaaguccagc

SEQ ID NO: 989097 - RNA, 13 nt, Homo sapiens
acaauaaaagaca

SEQ ID NO: 989098 - RNA, 13 nt, Homo sapiens
acaauaaagcaau

SEQ ID NO: 989099 - RNA, 18 nt, Homo sapiens
acaauaacgauaaaagac

SEQ ID NO: 989100 - RNA, 14 nt, Homo sapiens
acaaugcagugccu

SEQ ID NO: 989101 - RNA, 15 nt, Homo sapiens
acaaugcuuugcccc

SEQ ID NO: 989102 - RNA, 17 nt, Homo sapiens
acacaauucuucuucca

SEQ ID NO: 989103 - RNA, 16 nt, Homo sapiens
acacauguaucuaugc

SEQ ID NO: 989104 - RNA, 20 nt, Homo sapiens
acacauguaucuaugcauuu

SEQ ID NO: 989105 - RNA, 13 nt, Homo sapiens
acacccacagugg

SEQ ID NO: 989106 - RNA, 18 nt, Homo sapiens
acaccuaugucauuucau

SEQ ID NO: 989107 - RNA, 22 nt, Homo sapiens
acagaauuuuaugcggcauuuu

SEQ ID NO: 989108 - RNA, 12 nt, Homo sapiens
acagacgugugc

SEQ ID NO: 989109 - RNA, 21 nt, Homo sapiens
acagagcaagaccccaucuca

SEQ ID NO: 989110 - RNA, 22 nt, Homo sapiens
acagaucacagcuucagccagg

SEQ ID NO: 989111 - RNA, 22 nt, Homo sapiens
acagcauggagucacagccacu

SEQ ID NO: 989112 - RNA, 19 nt, Homo sapiens
acagcuacacagaucacag

SEQ ID NO: 989113 - RNA, 14 nt, Homo sapiens
acagcuaugaaggc

SEQ ID NO: 989114 - RNA, 19 nt, Homo sapiens
acaggaugaugacuaugga

SEQ ID NO: 989115 - RNA, 20 nt, Homo sapiens
acagggaaaacugcaaagcu

SEQ ID NO: 989116 - RNA, 15 nt, Homo sapiens
acaggugugagccac

SEQ ID NO: 989117 - RNA, 20 nt, Homo sapiens
acaguauugacuuguauacc

SEQ ID NO: 989118 - RNA, 18 nt, Homo sapiens
acagugccgacagcucuc

SEQ ID NO: 989119 - RNA, 19 nt, Homo sapiens
acagugccgacagcucucc

SEQ ID NO: 989120 - RNA, 19 nt, Homo sapiens
acaguuccccuauguggaa

SEQ ID NO: 989121 - RNA, 15 nt, Homo sapiens
acaucacagcuuauu

SEQ ID NO: 989122 - RNA, 23 nt, Homo sapiens
acaucccuccugggaaugaagca

SEQ ID NO: 989123 - RNA, 22 nt, Homo sapiens
acaugaagcuguugugugaggu

SEQ ID NO: 989124 - RNA, 21 nt, Homo sapiens
acauguauuuggugauuacau

SEQ ID NO: 989125 - RNA, 22 nt, Homo sapiens
accccagauucaugcacuguag

SEQ ID NO: 989126 - RNA, 19 nt, Homo sapiens
acccucagaugcacaugag

SEQ ID NO: 989127 - RNA, 18 nt, Homo sapiens
acccuucccuugagcccu

SEQ ID NO: 989128 - RNA, 17 nt, Homo sapiens
acccuucuuuucugacu

SEQ ID NO: 989129 - RNA, 23 nt, Homo sapiens
acccuuucauaaagucuugccuu

SEQ ID NO: 989130 - RNA, 19 nt, Homo sapiens
acccuuucauuagaacuuc

SEQ ID NO: 989131 - RNA, 17 nt, Homo sapiens
accuaacgagaaauaga

SEQ ID NO: 989132 - RNA, 14 nt, Homo sapiens
accuacuuacaugc

SEQ ID NO: 989133 - RNA, 19 nt, Homo sapiens
accuaguccccagccugcu

SEQ ID NO: 989134 - RNA, 21 nt, Homo sapiens
accucuccccuggaacugucu

SEQ ID NO: 989135 - RNA, 13 nt, Homo sapiens
accugacucuugc

SEQ ID NO: 989136 - RNA, 19 nt, Homo sapiens
accuggucugguugggcag

SEQ ID NO: 989137 - RNA, 15 nt, Homo sapiens
accuuaccagauuuu

SEQ ID NO: 989138 - RNA, 19 nt, Homo sapiens
accuuuuuggacacacaaa

SEQ ID NO: 989139 - RNA, 17 nt, Homo sapiens
acgauaaaagacaguga

SEQ ID NO: 989140 - RNA, 22 nt, Homo sapiens
acgcagccugcagacucacugu

SEQ ID NO: 989141 - RNA, 12 nt, Homo sapiens
acguccaucucu

SEQ ID NO: 989142 - RNA, 22 nt, Homo sapiens
acguggcccagagaagccaaaa

SEQ ID NO: 989143 - RNA, 12 nt, Homo sapiens
acuacaaccucc

SEQ ID NO: 989144 - RNA, 18 nt, Homo sapiens
acuagccaaaccaggacc

SEQ ID NO: 989145 - RNA, 21 nt, Homo sapiens
acucaaagagggagugcauuu

SEQ ID NO: 989146 - RNA, 21 nt, Homo sapiens
acucacuuucccaaauugaau

SEQ ID NO: 989147 - RNA, 16 nt, Homo sapiens
acucagacacaaauaa

SEQ ID NO: 989148 - RNA, 21 nt, Homo sapiens
acucagauccuccucauucac

SEQ ID NO: 989149 - RNA, 21 nt, Homo sapiens
acucagguggcccuacuggga

SEQ ID NO: 989150 - RNA, 21 nt, Homo sapiens
acucuucugagcaccuacuua

SEQ ID NO: 989151 - RNA, 19 nt, Homo sapiens
acugcaaagcucggugcuc

SEQ ID NO: 989152 - RNA, 12 nt, Homo sapiens
acugccaaagaa

SEQ ID NO: 989153 - RNA, 14 nt, Homo sapiens
acugccaagccaug

SEQ ID NO: 989154 - RNA, 21 nt, Homo sapiens
acugccaucuuggacuuguca

SEQ ID NO: 989155 - RNA, 16 nt, Homo sapiens
acugcucauaugaugu

SEQ ID NO: 989156 - RNA, 15 nt, Homo sapiens
acuggccacccaagg

SEQ ID NO: 989157 - RNA, 22 nt, Homo sapiens
acuguaaggcaaucauggugcu

SEQ ID NO: 989158 - RNA, 12 nt, Homo sapiens
acugucacauaa

SEQ ID NO: 989159 - RNA, 19 nt, Homo sapiens
acugucacauaaugcucau

SEQ ID NO: 989160 - RNA, 22 nt, Homo sapiens
acugucacauaaugcucauacu

SEQ ID NO: 989161 - RNA, 14 nt, Homo sapiens
acugucucucauga

SEQ ID NO: 989162 - RNA, 22 nt, Homo sapiens
acuguggaauuuaaaucacuca

SEQ ID NO: 989163 - RNA, 19 nt, Homo sapiens
acuuaaggauggagccagc

SEQ ID NO: 989164 - RNA, 14 nt, Homo sapiens
acuuacaugauuca

SEQ ID NO: 989165 - RNA, 14 nt, Homo sapiens
acuuacaugcauua

SEQ ID NO: 989166 - RNA, 21 nt, Homo sapiens
acuugaaaauuaacaugaaua

SEQ ID NO: 989167 - RNA, 20 nt, Homo sapiens
acuugagacagcacuaugua

SEQ ID NO: 989168 - RNA, 16 nt, Homo sapiens
acuugccucugcacac

SEQ ID NO: 989169 - RNA, 14 nt, Homo sapiens
acuugcucuugaug

SEQ ID NO: 989170 - RNA, 23 nt, Homo sapiens
acuugcugcugagugcaccacuu

SEQ ID NO: 989171 - RNA, 19 nt, Homo sapiens
acuugguucaguaccacau

SEQ ID NO: 989172 - RNA, 22 nt, Homo sapiens
acuuuauguaguuuuuauaugu

SEQ ID NO: 989173 - RNA, 18 nt, Homo sapiens
acuuuaugugcaucuuau

SEQ ID NO: 989174 - RNA, 18 nt, Homo sapiens
acuuuugauauggccaau

SEQ ID NO: 989175 - RNA, 21 nt, Homo sapiens
acuuuuggcauuuuacuguac

SEQ ID NO: 989176 - RNA, 21 nt, Homo sapiens
agaaaauaacgauaaaagaca

SEQ ID NO: 989177 - RNA, 13 nt, Homo sapiens
agaaagcauuuga

SEQ ID NO: 989178 - RNA, 17 nt, Homo sapiens
agaaauaucuucacuug

SEQ ID NO: 989179 - RNA, 18 nt, Homo sapiens
agaaaugguuguauuaga

SEQ ID NO: 989180 - RNA, 15 nt, Homo sapiens
agaaaugucaugugg

SEQ ID NO: 989181 - RNA, 14 nt, Homo sapiens
agaaauuaugugcc

SEQ ID NO: 989182 - RNA, 19 nt, Homo sapiens
agaacacagugauuuuauu

SEQ ID NO: 989183 - RNA, 17 nt, Homo sapiens
agaaccacucauaauuc

SEQ ID NO: 989184 - RNA, 18 nt, Homo sapiens
agaaccacucauaauucu

SEQ ID NO: 989185 - RNA, 16 nt, Homo sapiens
agaacucugagcagug

SEQ ID NO: 989186 - RNA, 16 nt, Homo sapiens
agaacuucaagcucuc

SEQ ID NO: 989187 - RNA, 11 nt, Homo sapiens
agaagaugaau

SEQ ID NO: 989188 - RNA, 13 nt, Homo sapiens
agaagaugaauga

SEQ ID NO: 989189 - RNA, 13 nt, Homo sapiens
agaagugcuuucu

SEQ ID NO: 989190 - RNA, 23 nt, Homo sapiens
agaauucauucacucaacaaaca

SEQ ID NO: 989191 - RNA, 20 nt, Homo sapiens
agaauuuaaaccuauacuca

SEQ ID NO: 989192 - RNA, 15 nt, Homo sapiens
agacaaaacuagaga

SEQ ID NO: 989193 - RNA, 17 nt, Homo sapiens
agacagaaaaaacugag

SEQ ID NO: 989194 - RNA, 14 nt, Homo sapiens
agacagaaucucag

SEQ ID NO: 989195 - RNA, 16 nt, Homo sapiens
agacaguuauugcaag

SEQ ID NO: 989196 - RNA, 15 nt, Homo sapiens
agacauacauuucuc

SEQ ID NO: 989197 - RNA, 16 nt, Homo sapiens
agacauacauuucuca

SEQ ID NO: 989198 - RNA, 12 nt, Homo sapiens
agaccuacccuc

SEQ ID NO: 989199 - RNA, 15 nt, Homo sapiens
agacgagguuucacu

SEQ ID NO: 989200 - RNA, 13 nt, Homo sapiens
agacucacugugg

SEQ ID NO: 989201 - RNA, 17 nt, Homo sapiens
agacucugucuaccugg

SEQ ID NO: 989202 - RNA, 18 nt, Homo sapiens
agagacaggguuucacca

SEQ ID NO: 989203 - RNA, 20 nt, Homo sapiens
agagacggguuucaccaugu

SEQ ID NO: 989204 - RNA, 16 nt, Homo sapiens
agagauuccugagcca

SEQ ID NO: 989205 - RNA, 16 nt, Homo sapiens
agagccccacccucag

SEQ ID NO: 989206 - RNA, 17 nt, Homo sapiens
agaggacaggcuacccc

SEQ ID NO: 989207 - RNA, 14 nt, Homo sapiens
agaggagugugaag

SEQ ID NO: 989208 - RNA, 20 nt, Homo sapiens
agaggcgcaugaauuuguga

SEQ ID NO: 989209 - RNA, 13 nt, Homo sapiens
agagggagugcau

SEQ ID NO: 989210 - RNA, 20 nt, Homo sapiens
agagucaaugaacuuuccac

SEQ ID NO: 989211 - RNA, 16 nt, Homo sapiens
agagucuuaauauaua

SEQ ID NO: 989212 - RNA, 16 nt, Homo sapiens
agaguugaugguugua

SEQ ID NO: 989213 - RNA, 20 nt, Homo sapiens
agauagauaggucagugcaa

SEQ ID NO: 989214 - RNA, 18 nt, Homo sapiens
agauagguacuauuaucc

SEQ ID NO: 989215 - RNA, 21 nt, Homo sapiens
agauauuuuucaugauuuuga

SEQ ID NO: 989216 - RNA, 22 nt, Homo sapiens
agaucaccaguguguggcuuuc

SEQ ID NO: 989217 - RNA, 19 nt, Homo sapiens
agauggcagguuugcaauc

SEQ ID NO: 989218 - RNA, 16 nt, Homo sapiens
agauggcauguguuua

SEQ ID NO: 989219 - RNA, 14 nt, Homo sapiens
agauguguucacaa

SEQ ID NO: 989220 - RNA, 16 nt, Homo sapiens
agauguucucuaucau

SEQ ID NO: 989221 - RNA, 17 nt, Homo sapiens
agauuucagauuuguga

SEQ ID NO: 989222 - RNA, 16 nt, Homo sapiens
agcaaccuucuugccu

SEQ ID NO: 989223 - RNA, 20 nt, Homo sapiens
agcaauacccaugucuacac

SEQ ID NO: 989224 - RNA, 20 nt, Homo sapiens
agcaccuacuuacaugcauu

SEQ ID NO: 989225 - RNA, 18 nt, Homo sapiens
agcagccuaacacggugc

SEQ ID NO: 989226 - RNA, 16 nt, Homo sapiens
agcauaucugccuuua

SEQ ID NO: 989227 - RNA, 21 nt, Homo sapiens
agcaucccuagucucuaccca

SEQ ID NO: 989228 - RNA, 21 nt, Homo sapiens
agcaucucuggccuguaccca

SEQ ID NO: 989229 - RNA, 14 nt, Homo sapiens
agcaugagugccgu

SEQ ID NO: 989230 - RNA, 21 nt, Homo sapiens
agcaugucgucaaagcugaaa

SEQ ID NO: 989231 - RNA, 16 nt, Homo sapiens
agcauucugucuugaa

SEQ ID NO: 989232 - RNA, 20 nt, Homo sapiens
agccacgguguucugugaua

SEQ ID NO: 989233 - RNA, 16 nt, Homo sapiens
agccagaggcucuaau

SEQ ID NO: 989234 - RNA, 23 nt, Homo sapiens
agccagaggcucuaauguacaau

SEQ ID NO: 989235 - RNA, 18 nt, Homo sapiens
agccaggaggccugcuag

SEQ ID NO: 989236 - RNA, 18 nt, Homo sapiens
agccaggccccaagccca

SEQ ID NO: 989237 - RNA, 15 nt, Homo sapiens
agccccaucagcucc

SEQ ID NO: 989238 - RNA, 15 nt, Homo sapiens
agccccucacacagc

SEQ ID NO: 989239 - RNA, 16 nt, Homo sapiens
agcccucccuaccuac

SEQ ID NO: 989240 - RNA, 19 nt, Homo sapiens
agcccuccucucccaguga

SEQ ID NO: 989241 - RNA, 17 nt, Homo sapiens
agcccugcaccaugcug

SEQ ID NO: 989242 - RNA, 19 nt, Homo sapiens
agcccugcaccaugcugcu

SEQ ID NO: 989243 - RNA, 18 nt, Homo sapiens
agcccugcagucacagcu

SEQ ID NO: 989244 - RNA, 19 nt, Homo sapiens
agcccugcagucacagcua

SEQ ID NO: 989245 - RNA, 12 nt, Homo sapiens
agcccuguaaca

SEQ ID NO: 989246 - RNA, 12 nt, Homo sapiens
agccuaacacgg

SEQ ID NO: 989247 - RNA, 12 nt, Homo sapiens
agccucaagucu

SEQ ID NO: 989248 - RNA, 22 nt, Homo sapiens
agccugaguagaaaggccuuua

SEQ ID NO: 989249 - RNA, 16 nt, Homo sapiens
agccugcagacucacu

SEQ ID NO: 989250 - RNA, 20 nt, Homo sapiens
agccugcagacucacugugg

SEQ ID NO: 989251 - RNA, 15 nt, Homo sapiens
uauaacuggaaagaa

SEQ ID NO: 989252 - RNA, 13 nt, Homo sapiens
uauaacuguuguc

SEQ ID NO: 989253 - RNA, 14 nt, Homo sapiens
uauaaucauuauua

SEQ ID NO: 989254 - RNA, 21 nt, Homo sapiens
uauaauuuaaaauaugcucua

SEQ ID NO: 989255 - RNA, 18 nt, Homo sapiens
uauacaggaugaugacua

SEQ ID NO: 989256 - RNA, 21 nt, Homo sapiens
uauaccgcuaucauuccaaag

SEQ ID NO: 989257 - RNA, 16 nt, Homo sapiens
uauagaucagccagug

SEQ ID NO: 989258 - RNA, 17 nt, Homo sapiens
uauagcuacuaauuuua

SEQ ID NO: 989259 - RNA, 15 nt, Homo sapiens
uauauagcagcuuua

SEQ ID NO: 989260 - RNA, 16 nt, Homo sapiens
uauaugcuaagucuua

SEQ ID NO: 989261 - RNA, 14 nt, Homo sapiens
uaucaauuaccaca

SEQ ID NO: 989262 - RNA, 15 nt, Homo sapiens
uaucaauuaccacac

SEQ ID NO: 989263 - RNA, 15 nt, Homo sapiens
uaucaauuuccucau

SEQ ID NO: 989264 - RNA, 14 nt, Homo sapiens
uaucaggauacuau

SEQ ID NO: 989265 - RNA, 14 nt, Homo sapiens
uauccaucuuucac

SEQ ID NO: 989266 - RNA, 14 nt, Homo sapiens
uauccucuugccaa

SEQ ID NO: 989267 - RNA, 13 nt, Homo sapiens
uaucuaugcauuu

SEQ ID NO: 989268 - RNA, 14 nt, Homo sapiens
uaucugaggucaca

SEQ ID NO: 989269 - RNA, 18 nt, Homo sapiens
uaucugagucaacuccuu

SEQ ID NO: 989270 - RNA, 15 nt, Homo sapiens
uaugaggcuguuguc

SEQ ID NO: 989271 - RNA, 17 nt, Homo sapiens
uaugaguuucuuuuugc

SEQ ID NO: 989272 - RNA, 20 nt, Homo sapiens
uaugauggguguuuuuagca

SEQ ID NO: 989273 - RNA, 18 nt, Homo sapiens
uaugguguacauucuucc

SEQ ID NO: 989274 - RNA, 15 nt, Homo sapiens
uauguguaucucaca

SEQ ID NO: 989275 - RNA, 18 nt, Homo sapiens
uauuauuguugcauuaaa

SEQ ID NO: 989276 - RNA, 12 nt, Homo sapiens
uauuccagagac

SEQ ID NO: 989277 - RNA, 19 nt, Homo sapiens
uauucccuucuaaccugaa

SEQ ID NO: 989278 - RNA, 14 nt, Homo sapiens
uauuguuacuggua

SEQ ID NO: 989279 - RNA, 14 nt, Homo sapiens
uauuugaugcuaca

SEQ ID NO: 989280 - RNA, 20 nt, Homo sapiens
uauuuggcccucugcccaga

SEQ ID NO: 989281 - RNA, 21 nt, Homo sapiens
uauuuggugauuacauuuuaa

SEQ ID NO: 989282 - RNA, 16 nt, Homo sapiens
uauuuuauagcuacua

SEQ ID NO: 989283 - RNA, 13 nt, Homo sapiens
uauuuuucaugau

SEQ ID NO: 989284 - RNA, 21 nt, Homo sapiens
ucaaaauuguuacaaauugua

SEQ ID NO: 989285 - RNA, 15 nt, Homo sapiens
ucaaacccauucccu

SEQ ID NO: 989286 - RNA, 17 nt, Homo sapiens
ucaaacuccugaccuca

SEQ ID NO: 989287 - RNA, 19 nt, Homo sapiens
ucaaagagggagugcauuu

SEQ ID NO: 989288 - RNA, 21 nt, Homo sapiens
ucaaagagggagugcauuuau

SEQ ID NO: 989289 - RNA, 16 nt, Homo sapiens
ucaaaggcacacagca

SEQ ID NO: 989290 - RNA, 22 nt, Homo sapiens
ucaaagugagcuccuaagccau

SEQ ID NO: 989291 - RNA, 12 nt, Homo sapiens
ucaaagugcugg

SEQ ID NO: 989292 - RNA, 14 nt, Homo sapiens
ucaacaaagucacc

SEQ ID NO: 989293 - RNA, 15 nt, Homo sapiens
ucaacacuaacauga

SEQ ID NO: 989294 - RNA, 15 nt, Homo sapiens
ucaauaaaguauuua

SEQ ID NO: 989295 - RNA, 17 nt, Homo sapiens
ucaauaagccucagcuu

SEQ ID NO: 989296 - RNA, 13 nt, Homo sapiens
ucaauuucuacaa

SEQ ID NO: 989297 - RNA, 13 nt, Homo sapiens
ucacaauacuguu

SEQ ID NO: 989298 - RNA, 12 nt, Homo sapiens
ucacacugcuga

SEQ ID NO: 989299 - RNA, 18 nt, Homo sapiens
ucacagccacuugggaua

SEQ ID NO: 989300 - RNA, 18 nt, Homo sapiens
ucacagcuucagccagga

SEQ ID NO: 989301 - RNA, 20 nt, Homo sapiens
ucacaggagcuuaaacagcu

SEQ ID NO: 989302 - RNA, 19 nt, Homo sapiens
ucacauccauucuucccuu

SEQ ID NO: 989303 - RNA, 18 nt, Homo sapiens
ucacaugauuccagccau

SEQ ID NO: 989304 - RNA, 12 nt, Homo sapiens
ucaccagugugu

SEQ ID NO: 989305 - RNA, 19 nt, Homo sapiens
ucacccagguuggagugca

SEQ ID NO: 989306 - RNA, 20 nt, Homo sapiens
ucacccagguuggagugcag

SEQ ID NO: 989307 - RNA, 18 nt, Homo sapiens
ucaccccugcuauaacua

SEQ ID NO: 989308 - RNA, 14 nt, Homo sapiens
ucacccuguccaaa

SEQ ID NO: 989309 - RNA, 18 nt, Homo sapiens
ucaccugggcugaggcau

SEQ ID NO: 989310 - RNA, 19 nt, Homo sapiens
ucacuaauucauuaaucug

SEQ ID NO: 989311 - RNA, 15 nt, Homo sapiens
ucacucaguccagcu

SEQ ID NO: 989312 - RNA, 14 nt, Homo sapiens
ucacugcaaccucc

SEQ ID NO: 989313 - RNA, 16 nt, Homo sapiens
ucacugcaaccuccac

SEQ ID NO: 989314 - RNA, 12 nt, Homo sapiens
ucacuguaaaau

SEQ ID NO: 989315 - RNA, 19 nt, Homo sapiens
ucacuucaaaacaguauug

SEQ ID NO: 989316 - RNA, 14 nt, Homo sapiens
ucagagaccuucca

SEQ ID NO: 989317 - RNA, 18 nt, Homo sapiens
ucagaguaauccaagcaa

SEQ ID NO: 989318 - RNA, 19 nt, Homo sapiens
ucagaguuccgacugccau

SEQ ID NO: 989319 - RNA, 18 nt, Homo sapiens
ucagccaauuauguuaaa

SEQ ID NO: 989320 - RNA, 18 nt, Homo sapiens
ucagcccugcaccaugcu

SEQ ID NO: 989321 - RNA, 20 nt, Homo sapiens
ucagcccugcaccaugcugc

SEQ ID NO: 989322 - RNA, 18 nt, Homo sapiens
ucaggaaggggugugcug

SEQ ID NO: 989323 - RNA, 15 nt, Homo sapiens
ucagguauaccucac

SEQ ID NO: 989324 - RNA, 20 nt, Homo sapiens
ucagguggcccuacugggag

SEQ ID NO: 989325 - RNA, 16 nt, Homo sapiens
ucauaaccuuaccaga

SEQ ID NO: 989326 - RNA, 13 nt, Homo sapiens
ucauagagacuug

SEQ ID NO: 989327 - RNA, 17 nt, Homo sapiens
ucauauauauacauaca

SEQ ID NO: 989328 - RNA, 12 nt, Homo sapiens
ucaucauguauc

SEQ ID NO: 989329 - RNA, 13 nt, Homo sapiens
ucaucauuuccau

SEQ ID NO: 989330 - RNA, 21 nt, Homo sapiens
ucauccgcaaauuuucuucca

SEQ ID NO: 989331 - RNA, 20 nt, Homo sapiens
ucaucuccccaucauuggua

SEQ ID NO: 989332 - RNA, 13 nt, Homo sapiens
ucaugaaccucaa

SEQ ID NO: 989333 - RNA, 13 nt, Homo sapiens
ucaugaagauauu

SEQ ID NO: 989334 - RNA, 11 nt, Homo sapiens
ucaugcacugu

SEQ ID NO: 989335 - RNA, 15 nt, Homo sapiens
ucaugcauuguccuc

SEQ ID NO: 989336 - RNA, 14 nt, Homo sapiens
ucauguaacuagaa

SEQ ID NO: 989337 - RNA, 17 nt, Homo sapiens
ucaugugaaaucauuca

SEQ ID NO: 989338 - RNA, 16 nt, Homo sapiens
ucauguggcuaccugu

SEQ ID NO: 989339 - RNA, 15 nt, Homo sapiens
ucauucaagucagcu

SEQ ID NO: 989340 - RNA, 23 nt, Homo sapiens
ucauuuucuggguguuuucuuaa

SEQ ID NO: 989341 - RNA, 21 nt, Homo sapiens
uccaaacguuaagaauuguua

SEQ ID NO: 989342 - RNA, 12 nt, Homo sapiens
uccaauacucag

SEQ ID NO: 989343 - RNA, 13 nt, Homo sapiens
uccacagugacuc

SEQ ID NO: 989344 - RNA, 20 nt, Homo sapiens
uccaccuccuggguucaagc

SEQ ID NO: 989345 - RNA, 20 nt, Homo sapiens
uccaccucgcagguucaagc

SEQ ID NO: 989346 - RNA, 13 nt, Homo sapiens
uccagauauacuu

SEQ ID NO: 989347 - RNA, 20 nt, Homo sapiens
uccagaugagaguacacccc

SEQ ID NO: 989348 - RNA, 21 nt, Homo sapiens
uccaggugguaagcaccagga

SEQ ID NO: 989349 - RNA, 16 nt, Homo sapiens
uccaucuuucacuauc

SEQ ID NO: 989350 - RNA, 14 nt, Homo sapiens
uccauucuccugag

SEQ ID NO: 989351 - RNA, 19 nt, Homo sapiens
uccauuuacccuucuuuuc

SEQ ID NO: 989352 - RNA, 20 nt, Homo sapiens
ucccaaagaggcuacuguaa

SEQ ID NO: 989353 - RNA, 17 nt, Homo sapiens
ucccaaaguccugggau

SEQ ID NO: 989354 - RNA, 16 nt, Homo sapiens
ucccaaauugaaucac

SEQ ID NO: 989355 - RNA, 20 nt, Homo sapiens
ucccaagcaccugggauuac

SEQ ID NO: 989356 - RNA, 12 nt, Homo sapiens
ucccaauucauc

SEQ ID NO: 989357 - RNA, 17 nt, Homo sapiens
ucccaauucauccucac

SEQ ID NO: 989358 - RNA, 20 nt, Homo sapiens
ucccagcccuugcauugcag

SEQ ID NO: 989359 - RNA, 18 nt, Homo sapiens
ucccagguucaagugcuu

SEQ ID NO: 989360 - RNA, 13 nt, Homo sapiens
ucccagugacaac

SEQ ID NO: 989361 - RNA, 19 nt, Homo sapiens
uccccuugccuaaauacaa

SEQ ID NO: 989362 - RNA, 21 nt, Homo sapiens
ucccgauucacccuguccaaa

SEQ ID NO: 989363 - RNA, 13 nt, Homo sapiens
ucccuaccuacca

SEQ ID NO: 989364 - RNA, 23 nt, Homo sapiens
ucccuagccagaggcucuaaugu

SEQ ID NO: 989365 - RNA, 14 nt, Homo sapiens
ucccuccacauuuc

SEQ ID NO: 989366 - RNA, 18 nt, Homo sapiens
ucccucucguaagauuuc

SEQ ID NO: 989367 - RNA, 22 nt, Homo sapiens
ucccuucuuuuuguucuucauc

SEQ ID NO: 989368 - RNA, 22 nt, Homo sapiens
uccgaggccccugucucagggu

SEQ ID NO: 989369 - RNA, 20 nt, Homo sapiens
uccguucacaugugugguac

SEQ ID NO: 989370 - RNA, 20 nt, Homo sapiens
uccuaagcuggagugcagug

SEQ ID NO: 989371 - RNA, 15 nt, Homo sapiens
uccuacauuaauuau

SEQ ID NO: 989372 - RNA, 15 nt, Homo sapiens
uccuaccacaaugca

SEQ ID NO: 989373 - RNA, 15 nt, Homo sapiens
uccucucccagugac

SEQ ID NO: 989374 - RNA, 15 nt, Homo sapiens
uccuggcuacuccau

SEQ ID NO: 989375 - RNA, 17 nt, Homo sapiens
uccuuaggccucugaga

SEQ ID NO: 989376 - RNA, 18 nt, Homo sapiens
uccuugggcuuuagccuu

SEQ ID NO: 989377 - RNA, 22 nt, Homo sapiens
uccuuggugauuccgcagugag

SEQ ID NO: 989378 - RNA, 14 nt, Homo sapiens
ucgcagguucaagc

SEQ ID NO: 989379 - RNA, 22 nt, Homo sapiens
ucguguguguuuuaaacuggua

SEQ ID NO: 989380 - RNA, 21 nt, Homo sapiens
ucuaauguacaauaaagcaau

SEQ ID NO: 989381 - RNA, 13 nt, Homo sapiens
ucuacacauacau

SEQ ID NO: 989382 - RNA, 16 nt, Homo sapiens
ucuagauuaagauaug

SEQ ID NO: 989383 - RNA, 12 nt, Homo sapiens
ucuauucuagcc

SEQ ID NO: 989384 - RNA, 22 nt, Homo sapiens
ucucaaacuccugaccucaggc

SEQ ID NO: 989385 - RNA, 22 nt, Homo sapiens
ucucaacuuugauacuuacuca

SEQ ID NO: 989386 - RNA, 18 nt, Homo sapiens
ucucacacucaugcauug

SEQ ID NO: 989387 - RNA, 13 nt, Homo sapiens
ucucacaugauuc

SEQ ID NO: 989388 - RNA, 12 nt, Homo sapiens
ucucagcucacu

SEQ ID NO: 989389 - RNA, 20 nt, Homo sapiens
ucucauccugcaggcagcuu

SEQ ID NO: 989390 - RNA, 22 nt, Homo sapiens
ucuccaaagcccucccuaccua

SEQ ID NO: 989391 - RNA, 21 nt, Homo sapiens
ucuccaaccagauugucagcu

SEQ ID NO: 989392 - RNA, 13 nt, Homo sapiens
ucuccaauacuca

SEQ ID NO: 989393 - RNA, 19 nt, Homo sapiens
ucuccagaugagaguacac

SEQ ID NO: 989394 - RNA, 23 nt, Homo sapiens
ucuccagaugagaguacacccca

SEQ ID NO: 989395 - RNA, 16 nt, Homo sapiens
ucucccaccaccucac

SEQ ID NO: 989396 - RNA, 21 nt, Homo sapiens
ucucccagccagguucugacu

SEQ ID NO: 989397 - RNA, 17 nt, Homo sapiens
ucuccccugcacuguaa

SEQ ID NO: 989398 - RNA, 22 nt, Homo sapiens
ucuccuaaaacuuuaaaacuug

SEQ ID NO: 989399 - RNA, 19 nt, Homo sapiens
ucuccuaaaguacugggau

SEQ ID NO: 989400 - RNA, 20 nt, Homo sapiens
ucuccuaagcuggagugcag

SEQ ID NO: 989401 - RNA, 21 nt, Homo sapiens
ucuccuacuguagcaaccuga

SEQ ID NO: 989402 - RNA, 23 nt, Homo sapiens
ucuccucucucuguaauaaacuc

SEQ ID NO: 989403 - RNA, 20 nt, Homo sapiens
ucucgaacuccugaccccaa

SEQ ID NO: 989404 - RNA, 16 nt, Homo sapiens
ucucuacccaguagau

SEQ ID NO: 989405 - RNA, 14 nt, Homo sapiens
ucucucaugaaccu

SEQ ID NO: 989406 - RNA, 17 nt, Homo sapiens
ucucuccaccagguucu

SEQ ID NO: 989407 - RNA, 20 nt, Homo sapiens
ucucuggccuguacccagua

SEQ ID NO: 989408 - RNA, 23 nt, Homo sapiens
ucucuggccuguacccaguagau

SEQ ID NO: 989409 - RNA, 17 nt, Homo sapiens
ucucuguauuccuagaa

SEQ ID NO: 989410 - RNA, 19 nt, Homo sapiens
ucucuguguuacccaguaa

SEQ ID NO: 989411 - RNA, 17 nt, Homo sapiens
ucucuugccucaaccuc

SEQ ID NO: 989412 - RNA, 20 nt, Homo sapiens
ucugacucuuggcacagcau

SEQ ID NO: 989413 - RNA, 17 nt, Homo sapiens
ucugagacagaaucuca

SEQ ID NO: 989414 - RNA, 19 nt, Homo sapiens
ucugagagaugacagggaa

SEQ ID NO: 989415 - RNA, 23 nt, Homo sapiens
ucugagcagugcuugaaugaagu

SEQ ID NO: 989416 - RNA, 15 nt, Homo sapiens
ucugaguuuuaccaa

SEQ ID NO: 989417 - RNA, 20 nt, Homo sapiens
ucugauaaugaaaauuauga

SEQ ID NO: 989418 - RNA, 20 nt, Homo sapiens
ucugccacaccucuccaaag

SEQ ID NO: 989419 - RNA, 14 nt, Homo sapiens
ucuggaaauagccc

SEQ ID NO: 989420 - RNA, 22 nt, Homo sapiens
ucuguauuuccccaacauguaa

SEQ ID NO: 989421 - RNA, 16 nt, Homo sapiens
ucugucacccagguug

SEQ ID NO: 989422 - RNA, 13 nt, Homo sapiens
ucugucuaccugg

SEQ ID NO: 989423 - RNA, 15 nt, Homo sapiens
ucugucuucuuugcc

SEQ ID NO: 989424 - RNA, 13 nt, Homo sapiens
ucuguguuuacag

SEQ ID NO: 989425 - RNA, 17 nt, Homo sapiens
ucuguuccccauggcca

SEQ ID NO: 989426 - RNA, 12 nt, Homo sapiens
ucuuauugccuc

SEQ ID NO: 989427 - RNA, 14 nt, Homo sapiens
ucuuauuuccucaa

SEQ ID NO: 989428 - RNA, 18 nt, Homo sapiens
ucuucaaagcaaagcucu

SEQ ID NO: 989429 - RNA, 21 nt, Homo sapiens
ucuuccaacguggcccagaga

SEQ ID NO: 989430 - RNA, 14 nt, Homo sapiens
ucuuccacagugcc

SEQ ID NO: 989431 - RNA, 19 nt, Homo sapiens
ucuucguauucccauuaga

SEQ ID NO: 989432 - RNA, 19 nt, Homo sapiens
ucuucuccauccuaccaca

SEQ ID NO: 989433 - RNA, 14 nt, Homo sapiens
ucuugaaaguacca

SEQ ID NO: 989434 - RNA, 14 nt, Homo sapiens
ucuugaaucucuga

SEQ ID NO: 989435 - RNA, 16 nt, Homo sapiens
ucuugccucaaccucc

SEQ ID NO: 989436 - RNA, 12 nt, Homo sapiens
ucuuuacuuucc

SEQ ID NO: 989437 - RNA, 20 nt, Homo sapiens
ucuuucccuccuuggugauu

SEQ ID NO: 989438 - RNA, 17 nt, Homo sapiens
ucuuugcccacaaugcu

SEQ ID NO: 989439 - RNA, 14 nt, Homo sapiens
ucuuuuaaaccauu

SEQ ID NO: 989440 - RNA, 11 nt, Homo sapiens
ugaaaaacugc

SEQ ID NO: 989441 - RNA, 21 nt, Homo sapiens
ugaaacucauagacacugauc

SEQ ID NO: 989442 - RNA, 20 nt, Homo sapiens
ugaaaguaccaggugaacaa

SEQ ID NO: 989443 - RNA, 21 nt, Homo sapiens
ugaaaugcagagucaaugaac

SEQ ID NO: 989444 - RNA, 19 nt, Homo sapiens
ugaaauggugaaaugcaga

SEQ ID NO: 989445 - RNA, 19 nt, Homo sapiens
ugaaauuaacucagacaca

SEQ ID NO: 989446 - RNA, 16 nt, Homo sapiens
ugaacaaaguuuacca

SEQ ID NO: 989447 - RNA, 22 nt, Homo sapiens
ugaacuuuuuuuuuuuaagagu

SEQ ID NO: 989448 - RNA, 13 nt, Homo sapiens
ugaaguuugaaug

SEQ ID NO: 989449 - RNA, 20 nt, Homo sapiens
ugaaucauuuuaccuuugac

SEQ ID NO: 989450 - RNA, 22 nt, Homo sapiens
ugaaucccucuaucucuaaaga

SEQ ID NO: 989451 - RNA, 21 nt, Homo sapiens
ugaauccucucucuguguuac

SEQ ID NO: 989452 - RNA, 17 nt, Homo sapiens
ugaaucucugaauuuga

SEQ ID NO: 989453 - RNA, 18 nt, Homo sapiens
ugaauucugucauuucaa

SEQ ID NO: 989454 - RNA, 23 nt, Homo sapiens
ugaauuugagauacaaacauguu

SEQ ID NO: 989455 - RNA, 16 nt, Homo sapiens
ugacagggaaaacugc

SEQ ID NO: 989456 - RNA, 13 nt, Homo sapiens
ugaccacuuuauu

SEQ ID NO: 989457 - RNA, 23 nt, Homo sapiens
ugacccacuuaccuugcaucuca

SEQ ID NO: 989458 - RNA, 21 nt, Homo sapiens
ugacccuaugggucuaggaca

SEQ ID NO: 989459 - RNA, 14 nt, Homo sapiens
ugacccuccccaaa

SEQ ID NO: 989460 - RNA, 21 nt, Homo sapiens
ugacuauucuugauguaaaau

SEQ ID NO: 989461 - RNA, 16 nt, Homo sapiens
ugagaaaagcuuugaa

SEQ ID NO: 989462 - RNA, 19 nt, Homo sapiens
ugagaaaagcuuugaaccc

SEQ ID NO: 989463 - RNA, 17 nt, Homo sapiens
ugagaacccuugcacua

SEQ ID NO: 989464 - RNA, 16 nt, Homo sapiens
ugagaguacaccccaa

SEQ ID NO: 989465 - RNA, 19 nt, Homo sapiens
ugagaguuuuggaugcagu

SEQ ID NO: 989466 - RNA, 13 nt, Homo sapiens
ugagauguguuca

SEQ ID NO: 989467 - RNA, 13 nt, Homo sapiens
ugagauuacaggu

SEQ ID NO: 989468 - RNA, 23 nt, Homo sapiens
ugagcaccuacuuacaugcauua

SEQ ID NO: 989469 - RNA, 21 nt, Homo sapiens
ugagcucuucauguuucagga

SEQ ID NO: 989470 - RNA, 21 nt, Homo sapiens
ugagcuggcgggauugaagga

SEQ ID NO: 989471 - RNA, 14 nt, Homo sapiens
ugauaucaguccag

SEQ ID NO: 989472 - RNA, 18 nt, Homo sapiens
ugauaucccccagccuca

SEQ ID NO: 989473 - RNA, 20 nt, Homo sapiens
ugauccagaaagaaaacuug

SEQ ID NO: 989474 - RNA, 17 nt, Homo sapiens
ugaucccuagcugugac

SEQ ID NO: 989475 - RNA, 12 nt, Homo sapiens
ugaucucagcuc

SEQ ID NO: 989476 - RNA, 14 nt, Homo sapiens
ugaugacuauggaa

SEQ ID NO: 989477 - RNA, 16 nt, Homo sapiens
ugauguacauguacug

SEQ ID NO: 989478 - RNA, 15 nt, Homo sapiens
ugaugugaguugcac

SEQ ID NO: 989479 - RNA, 17 nt, Homo sapiens
ugauugguguugccagu

SEQ ID NO: 989480 - RNA, 15 nt, Homo sapiens
ugauuuugaaaucau

SEQ ID NO: 989481 - RNA, 16 nt, Homo sapiens
ugcaacuuuguauaaa

SEQ ID NO: 989482 - RNA, 17 nt, Homo sapiens
ugcaccacuucaaguga

SEQ ID NO: 989483 - RNA, 14 nt, Homo sapiens
ugcacgcacacugu

SEQ ID NO: 989484 - RNA, 13 nt, Homo sapiens
ugcacuguagggu

SEQ ID NO: 989485 - RNA, 17 nt, Homo sapiens
ugcagacucacuguggg

SEQ ID NO: 989486 - RNA, 19 nt, Homo sapiens
ugcaguggcaucaucucag

SEQ ID NO: 989487 - RNA, 22 nt, Homo sapiens
ugcaguggcgcgaucucagcuc

SEQ ID NO: 989488 - RNA, 21 nt, Homo sapiens
ugcauaaaugugguacaagca

SEQ ID NO: 989489 - RNA, 17 nt, Homo sapiens
ugcaugcacuucuuaca

SEQ ID NO: 989490 - RNA, 14 nt, Homo sapiens
ugcauuauaucaaa

SEQ ID NO: 989491 - RNA, 18 nt, Homo sapiens
ugccaggcuggagugcag

SEQ ID NO: 989492 - RNA, 16 nt, Homo sapiens
ugccauauugcacaug

SEQ ID NO: 989493 - RNA, 22 nt, Homo sapiens
ugccauauugcacaugucuuaa

SEQ ID NO: 989494 - RNA, 19 nt, Homo sapiens
ugccaucuuggacuuguca

SEQ ID NO: 989495 - RNA, 13 nt, Homo sapiens
ugcccccaacagc

SEQ ID NO: 989496 - RNA, 20 nt, Homo sapiens
ugcccccaaccauuuccuca

SEQ ID NO: 989497 - RNA, 15 nt, Homo sapiens
ugcccccagagccac

SEQ ID NO: 989498 - RNA, 16 nt, Homo sapiens
ugcccuaggugagaac

SEQ ID NO: 989499 - RNA, 14 nt, Homo sapiens
ugccucagccuccc

SEQ ID NO: 989500 - RNA, 18 nt, Homo sapiens
ugccugcaggcaugaguc

SEQ ID NO: 989501 - RNA, 19 nt, Homo sapiens
ugccugcaggcaugaguca

SEQ ID NO: 989502 - RNA, 14 nt, Homo sapiens
ugccuuaacuggag

SEQ ID NO: 989503 - RNA, 20 nt, Homo sapiens
ugccuucucuaaacauuuca

SEQ ID NO: 989504 - RNA, 21 nt, Homo sapiens
ugcuaagccccagcaagcaau

SEQ ID NO: 989505 - RNA, 24 nt, Homo sapiens
ugcuaauuuugaaaaacugcucau

SEQ ID NO: 989506 - RNA, 21 nt, Homo sapiens
ugcuacagggcucacagaauu

SEQ ID NO: 989507 - RNA, 19 nt, Homo sapiens
ugcuauucuccauacucug

SEQ ID NO: 989508 - RNA, 22 nt, Homo sapiens
ugcucagcccugcaccaugcug

SEQ ID NO: 989509 - RNA, 21 nt, Homo sapiens
ugcucaguagucagacuggau

SEQ ID NO: 989510 - RNA, 22 nt, Homo sapiens
ugcucagugggggcagagccac

SEQ ID NO: 989511 - RNA, 20 nt, Homo sapiens
ugcucauacuuaucuaaugu

SEQ ID NO: 989512 - RNA, 15 nt, Homo sapiens
ugcucauaugaugua

SEQ ID NO: 989513 - RNA, 16 nt, Homo sapiens
ugcucccuagccagag

SEQ ID NO: 989514 - RNA, 17 nt, Homo sapiens
ugcugaaaaaucaucca

SEQ ID NO: 989515 - RNA, 14 nt, Homo sapiens
ugcugaacaucaca

SEQ ID NO: 989516 - RNA, 19 nt, Homo sapiens
ugcugcugagugcaccacu

SEQ ID NO: 989517 - RNA, 23 nt, Homo sapiens
ugcugcugagugcaccacuucaa

SEQ ID NO: 989518 - RNA, 14 nt, Homo sapiens
ugcuggaaauggac

SEQ ID NO: 989519 - RNA, 18 nt, Homo sapiens
ugcuggggaagacagugg

SEQ ID NO: 989520 - RNA, 18 nt, Homo sapiens
ugcugucccaaacaugca

SEQ ID NO: 989521 - RNA, 22 nt, Homo sapiens
ugcuuaagguaugguacaagca

SEQ ID NO: 989522 - RNA, 17 nt, Homo sapiens
ugcuucaggauaccaua

SEQ ID NO: 989523 - RNA, 15 nt, Homo sapiens
ugcuugaacuaggcu

SEQ ID NO: 989524 - RNA, 17 nt, Homo sapiens
ugcuugcacaaaccaau

SEQ ID NO: 989525 - RNA, 17 nt, Homo sapiens
ugcuuuuaaaauccacu

SEQ ID NO: 989526 - RNA, 18 nt, Homo sapiens
uggaacugucucucauga

SEQ ID NO: 989527 - RNA, 20 nt, Homo sapiens
uggaagaggcaccuguccca

SEQ ID NO: 989528 - RNA, 23 nt, Homo sapiens
uggaauaauccuaaacauaugaa

SEQ ID NO: 989529 - RNA, 20 nt, Homo sapiens
uggacucaagcaagauuuca

SEQ ID NO: 989530 - RNA, 19 nt, Homo sapiens
uggagagggaaugugaaau

SEQ ID NO: 989531 - RNA, 21 nt, Homo sapiens
uggagauguuuaguaaucaua

SEQ ID NO: 989532 - RNA, 19 nt, Homo sapiens
uggaggcacccaugccauc

SEQ ID NO: 989533 - RNA, 12 nt, Homo sapiens
uggaugaucccc

SEQ ID NO: 989534 - RNA, 21 nt, Homo sapiens
uggauuuuacauguggcccaa

SEQ ID NO: 989535 - RNA, 14 nt, Homo sapiens
uggccuuguaagac

SEQ ID NO: 989536 - RNA, 15 nt, Homo sapiens
uggcgcaggaacuca

SEQ ID NO: 989537 - RNA, 16 nt, Homo sapiens
uggcgcgaucucagcu

SEQ ID NO: 989538 - RNA, 15 nt, Homo sapiens
uggcgugaucucagc

SEQ ID NO: 989539 - RNA, 18 nt, Homo sapiens
uggcgugaucucagcuca

SEQ ID NO: 989540 - RNA, 19 nt, Homo sapiens
uggcgugaucucagcucac

SEQ ID NO: 989541 - RNA, 12 nt, Homo sapiens
uggcuagucaua

SEQ ID NO: 989542 - RNA, 14 nt, Homo sapiens
uggcugcugcugug

SEQ ID NO: 989543 - RNA, 16 nt, Homo sapiens
ugggaaagauuacuuu

SEQ ID NO: 989544 - RNA, 15 nt, Homo sapiens
ugggacugggacacu

SEQ ID NO: 989545 - RNA, 23 nt, Homo sapiens
ugggauuacaggugugagccacc

SEQ ID NO: 989546 - RNA, 12 nt, Homo sapiens
uggggaagacag

SEQ ID NO: 989547 - RNA, 13 nt, Homo sapiens
uggggcauuaucc

SEQ ID NO: 989548 - RNA, 20 nt, Homo sapiens
uggguucacagaucuuucug

SEQ ID NO: 989549 - RNA, 14 nt, Homo sapiens
uggugaaaugcaga

SEQ ID NO: 989550 - RNA, 21 nt, Homo sapiens
uguaacuauaguccagcuuug

SEQ ID NO: 989551 - RNA, 23 nt, Homo sapiens
uguaacuugaagguggcuacaaa

SEQ ID NO: 989552 - RNA, 19 nt, Homo sapiens
uguaagaacaacuaccuga

SEQ ID NO: 989553 - RNA, 19 nt, Homo sapiens
uguaauauuucuucaaaua

SEQ ID NO: 989554 - RNA, 22 nt, Homo sapiens
uguaaucccagcaugcugagau

SEQ ID NO: 989555 - RNA, 20 nt, Homo sapiens
uguacaauaaagcaaugugg

SEQ ID NO: 989556 - RNA, 22 nt, Homo sapiens
uguacagacagaaaaaacugag

SEQ ID NO: 989557 - RNA, 17 nt, Homo sapiens
uguacauauaagugauu

SEQ ID NO: 989558 - RNA, 18 nt, Homo sapiens
uguauacugugugcuaaa

SEQ ID NO: 989559 - RNA, 21 nt, Homo sapiens
uguaucuagccuggaaccaag

SEQ ID NO: 989560 - RNA, 16 nt, Homo sapiens
ugucacuuugcuacag

SEQ ID NO: 989561 - RNA, 15 nt, Homo sapiens
ugucagcaaguccua

SEQ ID NO: 989562 - RNA, 17 nt, Homo sapiens
ugucccaaacaugcacu

SEQ ID NO: 989563 - RNA, 15 nt, Homo sapiens
ugucucuacaaaaaa

SEQ ID NO: 989564 - RNA, 12 nt, Homo sapiens
ugucugagacag

SEQ ID NO: 989565 - RNA, 19 nt, Homo sapiens
ugucuuuguucuucuacca

SEQ ID NO: 989566 - RNA, 14 nt, Homo sapiens
ugugaaauuuacau

SEQ ID NO: 989567 - RNA, 16 nt, Homo sapiens
ugugaagcaaggagcu

SEQ ID NO: 989568 - RNA, 21 nt, Homo sapiens
ugugaccauuagcauuuguca

SEQ ID NO: 989569 - RNA, 18 nt, Homo sapiens
ugugacccacuuaccuug

SEQ ID NO: 989570 - RNA, 15 nt, Homo sapiens
ugugcaccuuuacac

SEQ ID NO: 989571 - RNA, 21 nt, Homo sapiens
ugugcccccaaccauuuccuc

SEQ ID NO: 989572 - RNA, 21 nt, Homo sapiens
ugugcuucuuaaaauagccau

SEQ ID NO: 989573 - RNA, 23 nt, Homo sapiens
uguguauuauaauucaaaggcau

SEQ ID NO: 989574 - RNA, 16 nt, Homo sapiens
uguguggcagagccag

SEQ ID NO: 989575 - RNA, 18 nt, Homo sapiens
uguguuuaggaacuacug

SEQ ID NO: 989576 - RNA, 19 nt, Homo sapiens
uguguuucagccauguauu

SEQ ID NO: 989577 - RNA, 14 nt, Homo sapiens
uguuacuacaugca

SEQ ID NO: 989578 - RNA, 15 nt, Homo sapiens
uguucacuuccaaga

SEQ ID NO: 989579 - RNA, 19 nt, Homo sapiens
uguucuaaauaaaaagcau

SEQ ID NO: 989580 - RNA, 18 nt, Homo sapiens
uguucucuaauauguaaa

SEQ ID NO: 989581 - RNA, 15 nt, Homo sapiens
uguuggccaggcuug

SEQ ID NO: 989582 - RNA, 19 nt, Homo sapiens
uguuuccuuauauuaugga

SEQ ID NO: 989583 - RNA, 16 nt, Homo sapiens
uguuuuaaacugguag

SEQ ID NO: 989584 - RNA, 23 nt, Homo sapiens
uguuuuuuuuuuuuuugagacag

SEQ ID NO: 989585 - RNA, 17 nt, Homo sapiens
uuaaaacuugaaguagg

SEQ ID NO: 989586 - RNA, 22 nt, Homo sapiens
uuaaauaaaccuuuuuggacac

SEQ ID NO: 989587 - RNA, 14 nt, Homo sapiens
uuaauaaauguaua

SEQ ID NO: 989588 - RNA, 16 nt, Homo sapiens
uuaauacacacaguua

SEQ ID NO: 989589 - RNA, 18 nt, Homo sapiens
uuaauggugccuucauuu

SEQ ID NO: 989590 - RNA, 18 nt, Homo sapiens
uuaauuauuguacauuua

SEQ ID NO: 989591 - RNA, 21 nt, Homo sapiens
uuaauuccuucagcacuuuag

SEQ ID NO: 989592 - RNA, 22 nt, Homo sapiens
uuacacauguaucuaugcauuu

SEQ ID NO: 989593 - RNA, 12 nt, Homo sapiens
uuacaugauuca

SEQ ID NO: 989594 - RNA, 14 nt, Homo sapiens
uuacaugauucauu

SEQ ID NO: 989595 - RNA, 22 nt, Homo sapiens
uuacaugcauuacugcaugcac

SEQ ID NO: 989596 - RNA, 19 nt, Homo sapiens
uuacauuuuaaacacauua

SEQ ID NO: 989597 - RNA, 20 nt, Homo sapiens
uuacauuuuaaacacauuag

SEQ ID NO: 989598 - RNA, 12 nt, Homo sapiens
uuacuacaugca

SEQ ID NO: 989599 - RNA, 19 nt, Homo sapiens
uuagauuugugugcaucag

SEQ ID NO: 989600 - RNA, 9 nt, Homo sapiens
uuagcucau

SEQ ID NO: 989601 - RNA, 21 nt, Homo sapiens
uuaggaauaaucuccuguuaa

SEQ ID NO: 989602 - RNA, 12 nt, Homo sapiens
uuaggcauuaaa

SEQ ID NO: 989603 - RNA, 22 nt, Homo sapiens
uuaguggagaugggguuucacc

SEQ ID NO: 989604 - RNA, 17 nt, Homo sapiens
uuaguugcaacuuugua

SEQ ID NO: 989605 - RNA, 20 nt, Homo sapiens
uuaucauauauauacauaca

SEQ ID NO: 989606 - RNA, 19 nt, Homo sapiens
uuaucaugugaaaucauuc

SEQ ID NO: 989607 - RNA, 15 nt, Homo sapiens
uucaaaggcauuucu

SEQ ID NO: 989608 - RNA, 21 nt, Homo sapiens
uucaccugggcugaggcaucc

SEQ ID NO: 989609 - RNA, 16 nt, Homo sapiens
uucacucaacaaacau

SEQ ID NO: 989610 - RNA, 22 nt, Homo sapiens
uucacuugguucaguaccacau

SEQ ID NO: 989611 - RNA, 14 nt, Homo sapiens
uucagcccucagaa

SEQ ID NO: 989612 - RNA, 15 nt, Homo sapiens
uucagcccucagaau

SEQ ID NO: 989613 - RNA, 14 nt, Homo sapiens
uucagguauaccuc

SEQ ID NO: 989614 - RNA, 19 nt, Homo sapiens
uucauucacucaacaaaca

SEQ ID NO: 989615 - RNA, 20 nt, Homo sapiens
uucauuuuaacaucugagaa

SEQ ID NO: 989616 - RNA, 16 nt, Homo sapiens
uuccaugaguuacacu

SEQ ID NO: 989617 - RNA, 15 nt, Homo sapiens
uuccccuugccuaaa

SEQ ID NO: 989618 - RNA, 20 nt, Homo sapiens
uucccuguaugauuccuuga

SEQ ID NO: 989619 - RNA, 16 nt, Homo sapiens
uuccuaguucuguaga

SEQ ID NO: 989620 - RNA, 16 nt, Homo sapiens
uuccucagcugugugg

SEQ ID NO: 989621 - RNA, 16 nt, Homo sapiens
uuccucaugaauguaa

SEQ ID NO: 989622 - RNA, 13 nt, Homo sapiens
uuccugggaacau

SEQ ID NO: 989623 - RNA, 16 nt, Homo sapiens
uucuacacauacaugu

SEQ ID NO: 989624 - RNA, 18 nt, Homo sapiens
uucuaccacccaccaguu

SEQ ID NO: 989625 - RNA, 18 nt, Homo sapiens
uucuauucuagccugcau

SEQ ID NO: 989626 - RNA, 21 nt, Homo sapiens
uucucacagugggagccaggg

SEQ ID NO: 989627 - RNA, 18 nt, Homo sapiens
uucucaccugucaucuca

SEQ ID NO: 989628 - RNA, 19 nt, Homo sapiens
uucucauaacucugugauc

SEQ ID NO: 989629 - RNA, 19 nt, Homo sapiens
uucucaucuuuuuacuaaa

SEQ ID NO: 989630 - RNA, 16 nt, Homo sapiens
uucuccaacaauaaga

SEQ ID NO: 989631 - RNA, 22 nt, Homo sapiens
uucucccaccaccucaccaguu

SEQ ID NO: 989632 - RNA, 17 nt, Homo sapiens
uucugucaacuuguauu

SEQ ID NO: 989633 - RNA, 23 nt, Homo sapiens
uucuuauuauuuuugagacagag

SEQ ID NO: 989634 - RNA, 14 nt, Homo sapiens
uucuuccaucugau

SEQ ID NO: 989635 - RNA, 15 nt, Homo sapiens
uucuuuuaaaccauu

SEQ ID NO: 989636 - RNA, 22 nt, Homo sapiens
uugaaacccguggcgcuuucug

SEQ ID NO: 989637 - RNA, 23 nt, Homo sapiens
uugaaucuugucucaaugcucau

SEQ ID NO: 989638 - RNA, 18 nt, Homo sapiens
uugacaauugggagcugc

SEQ ID NO: 989639 - RNA, 11 nt, Homo sapiens
uugagacagag

SEQ ID NO: 989640 - RNA, 16 nt, Homo sapiens
uugaugcuacaggauu

SEQ ID NO: 989641 - RNA, 22 nt, Homo sapiens
uugcauuaaaaaugcauauacu

SEQ ID NO: 989642 - RNA, 15 nt, Homo sapiens
uugcauugacuguca

SEQ ID NO: 989643 - RNA, 22 nt, Homo sapiens
uugccaagagccugagugacag

SEQ ID NO: 989644 - RNA, 20 nt, Homo sapiens
uugccccugagacaaaugga

SEQ ID NO: 989645 - RNA, 15 nt, Homo sapiens
uugccucaaccuccc

SEQ ID NO: 989646 - RNA, 17 nt, Homo sapiens
uugcucagcuucuccaa

SEQ ID NO: 989647 - RNA, 19 nt, Homo sapiens
uugcuugcacaaaccaauu

SEQ ID NO: 989648 - RNA, 18 nt, Homo sapiens
uuggcaugaaggugucau

SEQ ID NO: 989649 - RNA, 17 nt, Homo sapiens
uuggcauuuuacuguac

SEQ ID NO: 989650 - RNA, 21 nt, Homo sapiens
uugguguugccaguuguccuc

SEQ ID NO: 989651 - RNA, 21 nt, Homo sapiens
uuguacauagugaggagcuuu

SEQ ID NO: 989652 - RNA, 20 nt, Homo sapiens
uuguauuuuuuuucuuguau

SEQ ID NO: 989653 - RNA, 13 nt, Homo sapiens
uugucaacaaagu

SEQ ID NO: 989654 - RNA, 22 nt, Homo sapiens
uugucaacaaagucacccacuu

SEQ ID NO: 989655 - RNA, 15 nt, Homo sapiens
uugucugagacagaa

SEQ ID NO: 989656 - RNA, 17 nt, Homo sapiens
uuguuacaaauuguaga

SEQ ID NO: 989657 - RNA, 13 nt, Homo sapiens
uuuaaacugguag

SEQ ID NO: 989658 - RNA, 15 nt, Homo sapiens
uuuaacaucugagaa

SEQ ID NO: 989659 - RNA, 13 nt, Homo sapiens
uuuaggcauuaaa

SEQ ID NO: 989660 - RNA, 14 nt, Homo sapiens
uuuaugagcucuuc

SEQ ID NO: 989661 - RNA, 16 nt, Homo sapiens
uuucacugugcaaaua

SEQ ID NO: 989662 - RNA, 22 nt, Homo sapiens
uuuccccaaguacaaccacacc

SEQ ID NO: 989663 - RNA, 18 nt, Homo sapiens
uuucccuguuucuuccac

SEQ ID NO: 989664 - RNA, 20 nt, Homo sapiens
uuuccgaggccccugucuca

SEQ ID NO: 989665 - RNA, 23 nt, Homo sapiens
uuuccuugggcuuuagccuuaaa

SEQ ID NO: 989666 - RNA, 18 nt, Homo sapiens
uuucuuaaaacauuauga

SEQ ID NO: 989667 - RNA, 13 nt, Homo sapiens
uuucuucucccaa

SEQ ID NO: 989668 - RNA, 19 nt, Homo sapiens
uuucuucucuccagugcac

SEQ ID NO: 989669 - RNA, 15 nt, Homo sapiens
uuugcuaucugggcu

SEQ ID NO: 989670 - RNA, 14 nt, Homo sapiens
uuugucaacaaagu

SEQ ID NO: 989671 - RNA, 23 nt, Homo sapiens
uuugucugagacagaaucucagu

SEQ ID NO: 989672 - RNA, 13 nt, Homo sapiens
aaguugugcuuga

SEQ ID NO: 989673 - RNA, 14 nt, Homo sapiens
aaguuuaugguugu

SEQ ID NO: 989674 - RNA, 23 nt, Homo sapiens
aaguuucuucuuuaggcauuaaa

SEQ ID NO: 989675 - RNA, 20 nt, Homo sapiens
aaguuuuuuauuaugcauua

SEQ ID NO: 989676 - RNA, 18 nt, Homo sapiens
aauaaacauuuguagcau

SEQ ID NO: 989677 - RNA, 15 nt, Homo sapiens
aauaaagcaaugugg

SEQ ID NO: 989678 - RNA, 16 nt, Homo sapiens
aauaacaauaaaagac

SEQ ID NO: 989679 - RNA, 16 nt, Homo sapiens
aauaacgauaaaagac

SEQ ID NO: 989680 - RNA, 16 nt, Homo sapiens
aauaagagcucaggau

SEQ ID NO: 989681 - RNA, 18 nt, Homo sapiens
aauaaucauucuuauuuc

SEQ ID NO: 989682 - RNA, 23 nt, Homo sapiens
aauaauccucaguuuuugugaaa

SEQ ID NO: 989683 - RNA, 15 nt, Homo sapiens
aauaauucuaugaga

SEQ ID NO: 989684 - RNA, 19 nt, Homo sapiens
aauagaauuauaacuggaa

SEQ ID NO: 989685 - RNA, 14 nt, Homo sapiens
aauauaaaacagga

SEQ ID NO: 989686 - RNA, 21 nt, Homo sapiens
aauauauaucaaauauauuca

SEQ ID NO: 989687 - RNA, 22 nt, Homo sapiens
aauauauucagccuggcuucaa

SEQ ID NO: 989688 - RNA, 22 nt, Homo sapiens
aauauuccagagacugggacua

SEQ ID NO: 989689 - RNA, 20 nt, Homo sapiens
aaucagagaccuuccagaaa

SEQ ID NO: 989690 - RNA, 18 nt, Homo sapiens
aaucauccaagacaguua

SEQ ID NO: 989691 - RNA, 18 nt, Homo sapiens
aaucgcuccaccuugcag

SEQ ID NO: 989692 - RNA, 21 nt, Homo sapiens
aaucgcuccaccuugcagcuc

SEQ ID NO: 989693 - RNA, 15 nt, Homo sapiens
aaucuaccacuguau

SEQ ID NO: 989694 - RNA, 16 nt, Homo sapiens
aaucucugaauuugag

SEQ ID NO: 989695 - RNA, 20 nt, Homo sapiens
aaucuguccguucacaugug

SEQ ID NO: 989696 - RNA, 21 nt, Homo sapiens
aaucuguccguucacaugugu

SEQ ID NO: 989697 - RNA, 17 nt, Homo sapiens
aaugaaaaggacuuuau

SEQ ID NO: 989698 - RNA, 14 nt, Homo sapiens
aaugaauacaauua

SEQ ID NO: 989699 - RNA, 14 nt, Homo sapiens
aaugaauacuuuau

SEQ ID NO: 989700 - RNA, 18 nt, Homo sapiens
aaugacuucuaguguaga

SEQ ID NO: 989701 - RNA, 16 nt, Homo sapiens
aaugcauauacuuuaa

SEQ ID NO: 989702 - RNA, 19 nt, Homo sapiens
aaugcauuucuaaagccau

SEQ ID NO: 989703 - RNA, 13 nt, Homo sapiens
aaugcggcccaac

SEQ ID NO: 989704 - RNA, 15 nt, Homo sapiens
aauguaaacaauauc

SEQ ID NO: 989705 - RNA, 17 nt, Homo sapiens
aauguacaauaaagcaa

SEQ ID NO: 989706 - RNA, 20 nt, Homo sapiens
aauguacaauaaagcaaugu

SEQ ID NO: 989707 - RNA, 15 nt, Homo sapiens
aauuaaagcuguuau

SEQ ID NO: 989708 - RNA, 14 nt, Homo sapiens
aauuacacuuugaa

SEQ ID NO: 989709 - RNA, 16 nt, Homo sapiens
aauuaugugccagauu

SEQ ID NO: 989710 - RNA, 10 nt, Homo sapiens
aauucaccuu

SEQ ID NO: 989711 - RNA, 17 nt, Homo sapiens
aauucagacaagcugca

SEQ ID NO: 989712 - RNA, 13 nt, Homo sapiens
aauucauguugcc

SEQ ID NO: 989713 - RNA, 14 nt, Homo sapiens
aauucauguugccu

SEQ ID NO: 989714 - RNA, 18 nt, Homo sapiens
aauugaaucacugcucac

SEQ ID NO: 989715 - RNA, 16 nt, Homo sapiens
aauugaucgacuugcc

SEQ ID NO: 989716 - RNA, 13 nt, Homo sapiens
aauuguaagcaug

SEQ ID NO: 989717 - RNA, 19 nt, Homo sapiens
aauuguauuacaaauccaa

SEQ ID NO: 989718 - RNA, 14 nt, Homo sapiens
aauuuaaaaauccu

SEQ ID NO: 989719 - RNA, 17 nt, Homo sapiens
aauuuaaaauaugcucu

SEQ ID NO: 989720 - RNA, 22 nt, Homo sapiens
aauuuccaugaguuacacugga

SEQ ID NO: 989721 - RNA, 15 nt, Homo sapiens
aauuugaaacacuuu

SEQ ID NO: 989722 - RNA, 18 nt, Homo sapiens
aauuuucuuccauuucau

SEQ ID NO: 989723 - RNA, 22 nt, Homo sapiens
aauuuuuuuagaaagcauuuga

SEQ ID NO: 989724 - RNA, 14 nt, Homo sapiens
acaaaacccuuucu

SEQ ID NO: 989725 - RNA, 13 nt, Homo sapiens
acaaauauguucu

SEQ ID NO: 989726 - RNA, 16 nt, Homo sapiens
acaacaauccuucuau

SEQ ID NO: 989727 - RNA, 20 nt, Homo sapiens
acaaccaaaagucuucauca

SEQ ID NO: 989728 - RNA, 15 nt, Homo sapiens
acaagcugcauuuca

SEQ ID NO: 989729 - RNA, 19 nt, Homo sapiens
acaagggucacaauacugu

SEQ ID NO: 989730 - RNA, 14 nt, Homo sapiens
acaauaaagcaaug

SEQ ID NO: 989731 - RNA, 16 nt, Homo sapiens
acaauaaagcaaugug

SEQ ID NO: 989732 - RNA, 16 nt, Homo sapiens
acaauaauucuaugag

SEQ ID NO: 989733 - RNA, 18 nt, Homo sapiens
acaaugcagugccuuucu

SEQ ID NO: 989734 - RNA, 23 nt, Homo sapiens
acaauuaaaagugucuugagacu

SEQ ID NO: 989735 - RNA, 22 nt, Homo sapiens
acacagauguucacccaaccac

SEQ ID NO: 989736 - RNA, 22 nt, Homo sapiens
acacagcccuggccucugcuca

SEQ ID NO: 989737 - RNA, 20 nt, Homo sapiens
acacaugcugaacaucacag

SEQ ID NO: 989738 - RNA, 17 nt, Homo sapiens
acaccaucucccaugaa

SEQ ID NO: 989739 - RNA, 17 nt, Homo sapiens
acaccuaugucauuuca

SEQ ID NO: 989740 - RNA, 21 nt, Homo sapiens
acacucuugaaaaaugcaugu

SEQ ID NO: 989741 - RNA, 14 nt, Homo sapiens
acagaaaaaacuga

SEQ ID NO: 989742 - RNA, 16 nt, Homo sapiens
acagaaucucagucug

SEQ ID NO: 989743 - RNA, 19 nt, Homo sapiens
acagacagaaaaaacugag

SEQ ID NO: 989744 - RNA, 18 nt, Homo sapiens
acagcacccucuccagau

SEQ ID NO: 989745 - RNA, 14 nt, Homo sapiens
acagccacuuggga

SEQ ID NO: 989746 - RNA, 21 nt, Homo sapiens
acagcccaggauacuggcaca

SEQ ID NO: 989747 - RNA, 21 nt, Homo sapiens
acagcuucacaaauucucaca

SEQ ID NO: 989748 - RNA, 13 nt, Homo sapiens
acagcuucagcca

SEQ ID NO: 989749 - RNA, 15 nt, Homo sapiens
acaggaugaugacua

SEQ ID NO: 989750 - RNA, 19 nt, Homo sapiens
acaggguuucaccauguua

SEQ ID NO: 989751 - RNA, 20 nt, Homo sapiens
acagguagacaguauauaac

SEQ ID NO: 989752 - RNA, 17 nt, Homo sapiens
acagugccgacagcucu

SEQ ID NO: 989753 - RNA, 15 nt, Homo sapiens
acagugccuaauaau

SEQ ID NO: 989754 - RNA, 15 nt, Homo sapiens
acagugggagccagg

SEQ ID NO: 989755 - RNA, 22 nt, Homo sapiens
acaguugcauugacugucacau

SEQ ID NO: 989756 - RNA, 21 nt, Homo sapiens
acauacaugcauacacucuca

SEQ ID NO: 989757 - RNA, 16 nt, Homo sapiens
acauacauuucucaua

SEQ ID NO: 989758 - RNA, 17 nt, Homo sapiens
acauacccucacuuaaa

SEQ ID NO: 989759 - RNA, 23 nt, Homo sapiens
acaugaauugcauuuuacuuuaa

SEQ ID NO: 989760 - RNA, 18 nt, Homo sapiens
acaugcugaacaucacag

SEQ ID NO: 989761 - RNA, 21 nt, Homo sapiens
acauguaaaauaugucuuucu

SEQ ID NO: 989762 - RNA, 13 nt, Homo sapiens
accaaaaccacag

SEQ ID NO: 989763 - RNA, 16 nt, Homo sapiens
accaaauaaaguagaa

SEQ ID NO: 989764 - RNA, 13 nt, Homo sapiens
accaccaagccuu

SEQ ID NO: 989765 - RNA, 15 nt, Homo sapiens
accagaaagcaguug

SEQ ID NO: 989766 - RNA, 23 nt, Homo sapiens
accagagaagggcuuggacucaa

SEQ ID NO: 989767 - RNA, 19 nt, Homo sapiens
accaggcugcucagggcug

SEQ ID NO: 989768 - RNA, 21 nt, Homo sapiens
accaugcugcuggggaagaca

SEQ ID NO: 989769 - RNA, 15 nt, Homo sapiens
accauguacauagcu

SEQ ID NO: 989770 - RNA, 13 nt, Homo sapiens
accauuuccucag

SEQ ID NO: 989771 - RNA, 21 nt, Homo sapiens
acccaaccacaucccacucac

SEQ ID NO: 989772 - RNA, 16 nt, Homo sapiens
acccacacucagaucc

SEQ ID NO: 989773 - RNA, 20 nt, Homo sapiens
acccacaguggaaagacagc

SEQ ID NO: 989774 - RNA, 14 nt, Homo sapiens
acccagcucacagg

SEQ ID NO: 989775 - RNA, 19 nt, Homo sapiens
acccagguuggagugcagu

SEQ ID NO: 989776 - RNA, 19 nt, Homo sapiens
acccaguaacucaucuguc

SEQ ID NO: 989777 - RNA, 19 nt, Homo sapiens
acccaguugugacaauuaa

SEQ ID NO: 989778 - RNA, 14 nt, Homo sapiens
acccaugucuacac

SEQ ID NO: 989779 - RNA, 12 nt, Homo sapiens
accccaacagca

SEQ ID NO: 989780 - RNA, 12 nt, Homo sapiens
accccagauuca

SEQ ID NO: 989781 - RNA, 22 nt, Homo sapiens
accccaggacgcccucacugca

SEQ ID NO: 989782 - RNA, 22 nt, Homo sapiens
acccuccagagacaacagguaa

SEQ ID NO: 989783 - RNA, 11 nt, Homo sapiens
acccucccacu

SEQ ID NO: 989784 - RNA, 16 nt, Homo sapiens
acccucccacugccaa

SEQ ID NO: 989785 - RNA, 13 nt, Homo sapiens
acccuguccaaac

SEQ ID NO: 989786 - RNA, 22 nt, Homo sapiens
acccuuucauaaagucuugccu

SEQ ID NO: 989787 - RNA, 21 nt, Homo sapiens
accuacccuccacaggcacag

SEQ ID NO: 989788 - RNA, 11 nt, Homo sapiens
accucaccaag

SEQ ID NO: 989789 - RNA, 19 nt, Homo sapiens
accucaccaagcugcugug

SEQ ID NO: 989790 - RNA, 20 nt, Homo sapiens
accucaguucccucuugcuc

SEQ ID NO: 989791 - RNA, 21 nt, Homo sapiens
accucaguucccucuugcuca

SEQ ID NO: 989792 - RNA, 14 nt, Homo sapiens
accugaacugaugg

SEQ ID NO: 989793 - RNA, 16 nt, Homo sapiens
accugaacugaugggu

SEQ ID NO: 989794 - RNA, 14 nt, Homo sapiens
accugacucuugca

SEQ ID NO: 989795 - RNA, 15 nt, Homo sapiens
accugauauauucca

SEQ ID NO: 989796 - RNA, 14 nt, Homo sapiens
accuugcaucucac

SEQ ID NO: 989797 - RNA, 14 nt, Homo sapiens
accuuuuacucuuc

SEQ ID NO: 989798 - RNA, 15 nt, Homo sapiens
accuuuuuggacaca

SEQ ID NO: 989799 - RNA, 17 nt, Homo sapiens
accuuuuuggacacaca

SEQ ID NO: 989800 - RNA, 17 nt, Homo sapiens
acgagauacagaauuuu

SEQ ID NO: 989801 - RNA, 14 nt, Homo sapiens
acgcacacugucug

SEQ ID NO: 989802 - RNA, 16 nt, Homo sapiens
acgcucauuguagaaa

SEQ ID NO: 989803 - RNA, 17 nt, Homo sapiens
cauuucagaaaugcugu

SEQ ID NO: 989804 - RNA, 12 nt, Homo sapiens
cauuucauauaa

SEQ ID NO: 989805 - RNA, 19 nt, Homo sapiens
cauuuccucagacucuaag

SEQ ID NO: 989806 - RNA, 23 nt, Homo sapiens
cauuucucauaccuuccccacau

SEQ ID NO: 989807 - RNA, 17 nt, Homo sapiens
cauuucuuuucugcaug

SEQ ID NO: 989808 - RNA, 12 nt, Homo sapiens
cauuuuacugua

SEQ ID NO: 989809 - RNA, 13 nt, Homo sapiens
cauuuuacuguac

SEQ ID NO: 989810 - RNA, 17 nt, Homo sapiens
cauuuucugccacccaa

SEQ ID NO: 989811 - RNA, 22 nt, Homo sapiens
ccaaagacuacauauugucacu

SEQ ID NO: 989812 - RNA, 12 nt, Homo sapiens
ccaacagcaccc

SEQ ID NO: 989813 - RNA, 14 nt, Homo sapiens
ccaacagcacccuc

SEQ ID NO: 989814 - RNA, 16 nt, Homo sapiens
ccaacagcacccucuc

SEQ ID NO: 989815 - RNA, 15 nt, Homo sapiens
ccaaccauuuccuca

SEQ ID NO: 989816 - RNA, 11 nt, Homo sapiens
ccaagccaugg

SEQ ID NO: 989817 - RNA, 23 nt, Homo sapiens
ccaagccuugauugguguugcca

SEQ ID NO: 989818 - RNA, 11 nt, Homo sapiens
ccacaguauau

SEQ ID NO: 989819 - RNA, 19 nt, Homo sapiens
ccaccaccucaccaguuuc

SEQ ID NO: 989820 - RNA, 13 nt, Homo sapiens
ccaccaggauauc

SEQ ID NO: 989821 - RNA, 19 nt, Homo sapiens
ccaccaguugaauuucauc

SEQ ID NO: 989822 - RNA, 21 nt, Homo sapiens
ccaccaucgucuucuuggcca

SEQ ID NO: 989823 - RNA, 14 nt, Homo sapiens
ccacggugccucca

SEQ ID NO: 989824 - RNA, 20 nt, Homo sapiens
ccacuaggguccaccaggag

SEQ ID NO: 989825 - RNA, 19 nt, Homo sapiens
ccacuauugcuugcacaaa

SEQ ID NO: 989826 - RNA, 14 nt, Homo sapiens
ccagaggcucuaau

SEQ ID NO: 989827 - RNA, 18 nt, Homo sapiens
ccagaguuggugacacag

SEQ ID NO: 989828 - RNA, 21 nt, Homo sapiens
ccagauaaagguucaugcaaa

SEQ ID NO: 989829 - RNA, 19 nt, Homo sapiens
ccagaugucgcccuacuca

SEQ ID NO: 989830 - RNA, 19 nt, Homo sapiens
ccagauucaugcacuguag

SEQ ID NO: 989831 - RNA, 17 nt, Homo sapiens
ccagcucagggcucuuu

SEQ ID NO: 989832 - RNA, 19 nt, Homo sapiens
ccaggacgcccucacugca

SEQ ID NO: 989833 - RNA, 23 nt, Homo sapiens
ccaggaguacaccccaacagcac

SEQ ID NO: 989834 - RNA, 16 nt, Homo sapiens
ccaggcugcucagggc

SEQ ID NO: 989835 - RNA, 15 nt, Homo sapiens
ccaggcuggagugca

SEQ ID NO: 989836 - RNA, 16 nt, Homo sapiens
ccaggcuggagugcag

SEQ ID NO: 989837 - RNA, 17 nt, Homo sapiens
ccagguuggagugcagu

SEQ ID NO: 989838 - RNA, 23 nt, Homo sapiens
ccaguaguggugacugugggcuc

SEQ ID NO: 989839 - RNA, 18 nt, Homo sapiens
ccagugaaaaacuauuaa

SEQ ID NO: 989840 - RNA, 19 nt, Homo sapiens
ccaguugugauacaauaaa

SEQ ID NO: 989841 - RNA, 20 nt, Homo sapiens
ccauugauuuaauguaauag

SEQ ID NO: 989842 - RNA, 19 nt, Homo sapiens
cccaaagaggcuacuguaa

SEQ ID NO: 989843 - RNA, 16 nt, Homo sapiens
cccaaaggcuuugccc

SEQ ID NO: 989844 - RNA, 22 nt, Homo sapiens
cccaacagcacccucuccagau

SEQ ID NO: 989845 - RNA, 14 nt, Homo sapiens
cccaacaugcacug

SEQ ID NO: 989846 - RNA, 12 nt, Homo sapiens
cccaagcaguug

SEQ ID NO: 989847 - RNA, 21 nt, Homo sapiens
cccacugccaaagaacuugga

SEQ ID NO: 989848 - RNA, 18 nt, Homo sapiens
cccagauucaugcacugu

SEQ ID NO: 989849 - RNA, 22 nt, Homo sapiens
cccagccugcucccuagccaga

SEQ ID NO: 989850 - RNA, 13 nt, Homo sapiens
cccaggaguacac

SEQ ID NO: 989851 - RNA, 21 nt, Homo sapiens
cccaggaguauccucuugcca

SEQ ID NO: 989852 - RNA, 15 nt, Homo sapiens
cccaggauacuggca

SEQ ID NO: 989853 - RNA, 18 nt, Homo sapiens
cccagguuggagugcagu

SEQ ID NO: 989854 - RNA, 12 nt, Homo sapiens
cccaguaaaauu

SEQ ID NO: 989855 - RNA, 16 nt, Homo sapiens
cccagugacaaccaaa

SEQ ID NO: 989856 - RNA, 17 nt, Homo sapiens
cccaguugugacaauua

SEQ ID NO: 989857 - RNA, 13 nt, Homo sapiens
cccaucucaaaaa

SEQ ID NO: 989858 - RNA, 11 nt, Homo sapiens
ccccaacagca

SEQ ID NO: 989859 - RNA, 17 nt, Homo sapiens
ccccaacaugcacugau

SEQ ID NO: 989860 - RNA, 19 nt, Homo sapiens
ccccagauucaugcacugu

SEQ ID NO: 989861 - RNA, 14 nt, Homo sapiens
ccccagccugcucc

SEQ ID NO: 989862 - RNA, 14 nt, Homo sapiens
ccccugucucaggg

SEQ ID NO: 989863 - RNA, 17 nt, Homo sapiens
ccccugucucaggguga

SEQ ID NO: 989864 - RNA, 11 nt, Homo sapiens
cccgugacugc

SEQ ID NO: 989865 - RNA, 15 nt, Homo sapiens
cccuacucaccugag

SEQ ID NO: 989866 - RNA, 14 nt, Homo sapiens
cccuccacauuucc

SEQ ID NO: 989867 - RNA, 13 nt, Homo sapiens
cccuccucuccca

SEQ ID NO: 989868 - RNA, 17 nt, Homo sapiens
cccuccuugaacuagga

SEQ ID NO: 989869 - RNA, 19 nt, Homo sapiens
cccucuugaaucucugaau

SEQ ID NO: 989870 - RNA, 14 nt, Homo sapiens
cccugccucucugc

SEQ ID NO: 989871 - RNA, 16 nt, Homo sapiens
cccuggauuuuuacca

SEQ ID NO: 989872 - RNA, 21 nt, Homo sapiens
cccugggacguggcuagucau

SEQ ID NO: 989873 - RNA, 14 nt, Homo sapiens
cccuguaugauucc

SEQ ID NO: 989874 - RNA, 17 nt, Homo sapiens
cccugucucuacaaaaa

SEQ ID NO: 989875 - RNA, 12 nt, Homo sapiens
cccuucucugua

SEQ ID NO: 989876 - RNA, 16 nt, Homo sapiens
cccuucuuuucugacu

SEQ ID NO: 989877 - RNA, 22 nt, Homo sapiens
cccuuucauaaagucuugccuu

SEQ ID NO: 989878 - RNA, 19 nt, Homo sapiens
ccgaaaaucauauaaucuu

SEQ ID NO: 989879 - RNA, 13 nt, Homo sapiens
ccgugacugcaau

SEQ ID NO: 989880 - RNA, 18 nt, Homo sapiens
ccuaagcuggagugcagu

SEQ ID NO: 989881 - RNA, 15 nt, Homo sapiens
ccuaccaagauauac

SEQ ID NO: 989882 - RNA, 21 nt, Homo sapiens
ccuaccaagauauaccugaua

SEQ ID NO: 989883 - RNA, 16 nt, Homo sapiens
ccuaccuaccaagaua

SEQ ID NO: 989884 - RNA, 19 nt, Homo sapiens
ccuacuguagcaaccugaa

SEQ ID NO: 989885 - RNA, 16 nt, Homo sapiens
ccuagccagaggcucu

SEQ ID NO: 989886 - RNA, 22 nt, Homo sapiens
ccuagguauaauucacauugua

SEQ ID NO: 989887 - RNA, 22 nt, Homo sapiens
ccuaguccccagccugcucccu

SEQ ID NO: 989888 - RNA, 19 nt, Homo sapiens
ccuauguuucacugugcaa

SEQ ID NO: 989889 - RNA, 17 nt, Homo sapiens
ccuauucuccucaucuc

SEQ ID NO: 989890 - RNA, 16 nt, Homo sapiens
ccuauuuuuggaagag

SEQ ID NO: 989891 - RNA, 14 nt, Homo sapiens
ccucacucagucca

SEQ ID NO: 989892 - RNA, 22 nt, Homo sapiens
ccucaggcagguaaccccagau

SEQ ID NO: 989893 - RNA, 13 nt, Homo sapiens
ccucccuccagau

SEQ ID NO: 989894 - RNA, 21 nt, Homo sapiens
ccucuguauacaaaacccuuu

SEQ ID NO: 989895 - RNA, 18 nt, Homo sapiens
ccugacgaacuccuugau

SEQ ID NO: 989896 - RNA, 13 nt, Homo sapiens
ccugacugccaag

SEQ ID NO: 989897 - RNA, 15 nt, Homo sapiens
ccugagacaaaugga

SEQ ID NO: 989898 - RNA, 13 nt, Homo sapiens
ccugagcuaaaua

SEQ ID NO: 989899 - RNA, 14 nt, Homo sapiens
ccugcaccaugcug

SEQ ID NO: 989900 - RNA, 14 nt, Homo sapiens
ccugcaggcagcuu

SEQ ID NO: 989901 - RNA, 16 nt, Homo sapiens
ccugcucccuagccag

SEQ ID NO: 989902 - RNA, 14 nt, Homo sapiens
ccugcuuuucccca

SEQ ID NO: 989903 - RNA, 12 nt, Homo sapiens
ccuggacugugu

SEQ ID NO: 989904 - RNA, 11 nt, Homo sapiens
ccuggucaguc

SEQ ID NO: 989905 - RNA, 19 nt, Homo sapiens
ccuuagaccaccaagccuu

SEQ ID NO: 989906 - RNA, 20 nt, Homo sapiens
ccuucuccccugcacuguaa

SEQ ID NO: 989907 - RNA, 19 nt, Homo sapiens
ccuucucuacacucuugua

SEQ ID NO: 989908 - RNA, 22 nt, Homo sapiens
ccuugauggagauauuuacaug

SEQ ID NO: 989909 - RNA, 11 nt, Homo sapiens
ccuugucuccc

SEQ ID NO: 989910 - RNA, 14 nt, Homo sapiens
ccuuugcuucauuc

SEQ ID NO: 989911 - RNA, 16 nt, Homo sapiens
ccuuugcuucauucaa

SEQ ID NO: 989912 - RNA, 23 nt, Homo sapiens
ccuuuugucucugcaaacugccu

SEQ ID NO: 989913 - RNA, 17 nt, Homo sapiens
ccuuuuuuauuccauaa

SEQ ID NO: 989914 - RNA, 22 nt, Homo sapiens
cgaauggaagaggcaccugucc

SEQ ID NO: 989915 - RNA, 12 nt, Homo sapiens
cgaucucagcuc

SEQ ID NO: 989916 - RNA, 13 nt, Homo sapiens
cgaucucagcuca

SEQ ID NO: 989917 - RNA, 14 nt, Homo sapiens
cgcaaauucgcaaa

SEQ ID NO: 989918 - RNA, 17 nt, Homo sapiens
cgcaaauuuucuuccau

SEQ ID NO: 989919 - RNA, 22 nt, Homo sapiens
cggagaguuuccuauguuucac

SEQ ID NO: 989920 - RNA, 23 nt, Homo sapiens
cggggaaggauuuugcaguucuu

SEQ ID NO: 989921 - RNA, 17 nt, Homo sapiens
cgucaucaucacauuca

SEQ ID NO: 989922 - RNA, 18 nt, Homo sapiens
cgugaccugccaggcaca

SEQ ID NO: 989923 - RNA, 13 nt, Homo sapiens
cguggaaaggggc

SEQ ID NO: 989924 - RNA, 22 nt, Homo sapiens
cguugacaaguuuuguggggcu

SEQ ID NO: 989925 - RNA, 21 nt, Homo sapiens
cuaaaauuguauagaccuaaa

SEQ ID NO: 989926 - RNA, 14 nt, Homo sapiens
cuaaaguacuggga

SEQ ID NO: 989927 - RNA, 15 nt, Homo sapiens
cuaaaguacugggau

SEQ ID NO: 989928 - RNA, 13 nt, Homo sapiens
cuaacaaauucca

SEQ ID NO: 989929 - RNA, 22 nt, Homo sapiens
cuaacaaguagcacccuggauu

SEQ ID NO: 989930 - RNA, 20 nt, Homo sapiens
cuaagcacgggccauaugaa

SEQ ID NO: 989931 - RNA, 17 nt, Homo sapiens
cuaagcccccacuacaa

SEQ ID NO: 989932 - RNA, 16 nt, Homo sapiens
cuaagcuggagugcag

SEQ ID NO: 989933 - RNA, 18 nt, Homo sapiens
cuaagcuggagugcagug

SEQ ID NO: 989934 - RNA, 12 nt, Homo sapiens
ucccacugccaa

SEQ ID NO: 989935 - RNA, 18 nt, Homo sapiens
ucccagcaugcugagauu

SEQ ID NO: 989936 - RNA, 13 nt, Homo sapiens
ucccagcucaggg

SEQ ID NO: 989937 - RNA, 23 nt, Homo sapiens
ucccaggaguacaccccaacagc

SEQ ID NO: 989938 - RNA, 18 nt, Homo sapiens
uccccagccugcucccua

SEQ ID NO: 989939 - RNA, 18 nt, Homo sapiens
uccccugcacuguaaaau

SEQ ID NO: 989940 - RNA, 14 nt, Homo sapiens
uccccuucacuccc

SEQ ID NO: 989941 - RNA, 13 nt, Homo sapiens
ucccuagccagag

SEQ ID NO: 989942 - RNA, 23 nt, Homo sapiens
ucccugaagaucuagugaacauu

SEQ ID NO: 989943 - RNA, 23 nt, Homo sapiens
ucccuuuggagauuuuuuaaucc

SEQ ID NO: 989944 - RNA, 20 nt, Homo sapiens
uccgccucccauguucaagc

SEQ ID NO: 989945 - RNA, 14 nt, Homo sapiens
uccgucaccucaga

SEQ ID NO: 989946 - RNA, 16 nt, Homo sapiens
uccuaaaguacuggga

SEQ ID NO: 989947 - RNA, 16 nt, Homo sapiens
uccuaagcucaucuau

SEQ ID NO: 989948 - RNA, 18 nt, Homo sapiens
uccuaagcuggagugcag

SEQ ID NO: 989949 - RNA, 20 nt, Homo sapiens
uccuagaaacugacacaugc

SEQ ID NO: 989950 - RNA, 15 nt, Homo sapiens
uccuauguuucacug

SEQ ID NO: 989951 - RNA, 15 nt, Homo sapiens
uccucaguucaucca

SEQ ID NO: 989952 - RNA, 16 nt, Homo sapiens
uccucaugaauguaaa

SEQ ID NO: 989953 - RNA, 15 nt, Homo sapiens
uccucccuccagaua

SEQ ID NO: 989954 - RNA, 19 nt, Homo sapiens
uccuccgucaccucagaga

SEQ ID NO: 989955 - RNA, 18 nt, Homo sapiens
uccucucccagugacaac

SEQ ID NO: 989956 - RNA, 18 nt, Homo sapiens
uccugggucuaccacuca

SEQ ID NO: 989957 - RNA, 17 nt, Homo sapiens
uccugucggagcccugu

SEQ ID NO: 989958 - RNA, 22 nt, Homo sapiens
uccugucuguuuccucuguaua

SEQ ID NO: 989959 - RNA, 14 nt, Homo sapiens
uccuuaggccucug

SEQ ID NO: 989960 - RNA, 16 nt, Homo sapiens
uccuuaucgaaacuca

SEQ ID NO: 989961 - RNA, 12 nt, Homo sapiens
uccuucauuucc

SEQ ID NO: 989962 - RNA, 23 nt, Homo sapiens
ucgcuaccuuuugcuguggcaaa

SEQ ID NO: 989963 - RNA, 19 nt, Homo sapiens
ucuaaauaaaaagcauuau

SEQ ID NO: 989964 - RNA, 12 nt, Homo sapiens
ucuaagaaagaa

SEQ ID NO: 989965 - RNA, 20 nt, Homo sapiens
ucuaagccuucugguuuuau

SEQ ID NO: 989966 - RNA, 14 nt, Homo sapiens
ucuaaguguuucau

SEQ ID NO: 989967 - RNA, 14 nt, Homo sapiens
ucuaauggcuuuau

SEQ ID NO: 989968 - RNA, 13 nt, Homo sapiens
ucuaauguacaau

SEQ ID NO: 989969 - RNA, 16 nt, Homo sapiens
ucuaccuggucucucc

SEQ ID NO: 989970 - RNA, 12 nt, Homo sapiens
ucuaggauuuua

SEQ ID NO: 989971 - RNA, 14 nt, Homo sapiens
ucuaggugcuuuaa

SEQ ID NO: 989972 - RNA, 20 nt, Homo sapiens
ucuaguauuccagaccugaa

SEQ ID NO: 989973 - RNA, 11 nt, Homo sapiens
ucuaucaaaau

SEQ ID NO: 989974 - RNA, 18 nt, Homo sapiens
ucuauucuagccugcauu

SEQ ID NO: 989975 - RNA, 20 nt, Homo sapiens
ucucaaacuccugaccucaa

SEQ ID NO: 989976 - RNA, 23 nt, Homo sapiens
ucucaccccugcuauaacuauga

SEQ ID NO: 989977 - RNA, 17 nt, Homo sapiens
ucucaccugucaucuca

SEQ ID NO: 989978 - RNA, 20 nt, Homo sapiens
ucucagcucacuacaaccuc

SEQ ID NO: 989979 - RNA, 13 nt, Homo sapiens
ucucagcucacug

SEQ ID NO: 989980 - RNA, 21 nt, Homo sapiens
ucucauaccuuccccacaucu

SEQ ID NO: 989981 - RNA, 20 nt, Homo sapiens
ucuccagagggaauugcaga

SEQ ID NO: 989982 - RNA, 23 nt, Homo sapiens
ucuccagagggaauugcagagua

SEQ ID NO: 989983 - RNA, 12 nt, Homo sapiens
ucuccagugcac

SEQ ID NO: 989984 - RNA, 16 nt, Homo sapiens
ucuccagugcaccugu

SEQ ID NO: 989985 - RNA, 21 nt, Homo sapiens
ucuccauccuaccacaaugca

SEQ ID NO: 989986 - RNA, 23 nt, Homo sapiens
ucuccaucucuugaccucgugau

SEQ ID NO: 989987 - RNA, 19 nt, Homo sapiens
ucucccuggauuuuuacca

SEQ ID NO: 989988 - RNA, 21 nt, Homo sapiens
ucuccuaagcuggagugcagu

SEQ ID NO: 989989 - RNA, 20 nt, Homo sapiens
ucucggcucacugcaaccuc

SEQ ID NO: 989990 - RNA, 18 nt, Homo sapiens
ucucuaaagaaaaucucu

SEQ ID NO: 989991 - RNA, 13 nt, Homo sapiens
ucucuacccagua

SEQ ID NO: 989992 - RNA, 18 nt, Homo sapiens
ucucuccuuguucugaua

SEQ ID NO: 989993 - RNA, 14 nt, Homo sapiens
ucucucuucuuuuc

SEQ ID NO: 989994 - RNA, 12 nt, Homo sapiens
ucucuugugcau

SEQ ID NO: 989995 - RNA, 12 nt, Homo sapiens
ucugagacagaa

SEQ ID NO: 989996 - RNA, 16 nt, Homo sapiens
ucugagagcaucaggc

SEQ ID NO: 989997 - RNA, 19 nt, Homo sapiens
ucugagcaccuacuuacau

SEQ ID NO: 989998 - RNA, 18 nt, Homo sapiens
ucugccagcauaauacuu

SEQ ID NO: 989999 - RNA, 20 nt, Homo sapiens
ucugccucccagguucaagu

SEQ ID NO: 990000 - RNA, 21 nt, Homo sapiens
ucuggauuauauuaugaagcu

SEQ ID NO: 990001 - RNA, 22 nt, Homo sapiens
ucuguauuccuagaaacugaca

SEQ ID NO: 990002 - RNA, 20 nt, Homo sapiens
ucuguuuauaaacauuguau

SEQ ID NO: 990003 - RNA, 22 nt, Homo sapiens
ucuuaauuauuguacauuuaua

SEQ ID NO: 990004 - RNA, 19 nt, Homo sapiens
ucuuacaauaauucuauga

SEQ ID NO: 990005 - RNA, 22 nt, Homo sapiens
ucuuacaauaauucuaugagau

SEQ ID NO: 990006 - RNA, 13 nt, Homo sapiens
ucuuacaaugaaa

SEQ ID NO: 990007 - RNA, 16 nt, Homo sapiens
ucuuauugacucauac

SEQ ID NO: 990008 - RNA, 14 nt, Homo sapiens
ucuuauugccucac

SEQ ID NO: 990009 - RNA, 16 nt, Homo sapiens
ucuucucccaauucau

SEQ ID NO: 990010 - RNA, 15 nt, Homo sapiens
ucuucugagcaccua

SEQ ID NO: 990011 - RNA, 16 nt, Homo sapiens
ucuucugagcaccuac

SEQ ID NO: 990012 - RNA, 17 nt, Homo sapiens
ucuucuuacuggugcua

SEQ ID NO: 990013 - RNA, 16 nt, Homo sapiens
ucuucuuuuaaaccau

SEQ ID NO: 990014 - RNA, 21 nt, Homo sapiens
ucuugaagggcaggugcuuca

SEQ ID NO: 990015 - RNA, 17 nt, Homo sapiens
ucuugauaccugggaua

SEQ ID NO: 990016 - RNA, 22 nt, Homo sapiens
ucuuguuuccuuauauuaugga

SEQ ID NO: 990017 - RNA, 19 nt, Homo sapiens
ucuuuaacuuaauugcuau

SEQ ID NO: 990018 - RNA, 12 nt, Homo sapiens
ucuuucuuuauu

SEQ ID NO: 990019 - RNA, 12 nt, Homo sapiens
ucuuugccaagu

SEQ ID NO: 990020 - RNA, 12 nt, Homo sapiens
ucuuuucugcau

SEQ ID NO: 990021 - RNA, 21 nt, Homo sapiens
ugaaaaacuauuaacaacuug

SEQ ID NO: 990022 - RNA, 24 nt, Homo sapiens
ugaaaacaauucuuauugacucau

SEQ ID NO: 990023 - RNA, 15 nt, Homo sapiens
ugaaagaaaauaacg

SEQ ID NO: 990024 - RNA, 16 nt, Homo sapiens
ugaaagggguugugaa

SEQ ID NO: 990025 - RNA, 12 nt, Homo sapiens
ugaagcuuuuau

SEQ ID NO: 990026 - RNA, 15 nt, Homo sapiens
ugaagggguucucac

SEQ ID NO: 990027 - RNA, 17 nt, Homo sapiens
ugaaguggugagcuuaa

SEQ ID NO: 990028 - RNA, 18 nt, Homo sapiens
ugaauccucucucugugu

SEQ ID NO: 990029 - RNA, 15 nt, Homo sapiens
ugaaucucuaaucaa

SEQ ID NO: 990030 - RNA, 23 nt, Homo sapiens
ugacacagacauccucuaugcca

SEQ ID NO: 990031 - RNA, 16 nt, Homo sapiens
ugacauaaguauuuaa

SEQ ID NO: 990032 - RNA, 16 nt, Homo sapiens
ugaccugccaggcaca

SEQ ID NO: 990033 - RNA, 20 nt, Homo sapiens
ugacgucaucaucacauuca

SEQ ID NO: 990034 - RNA, 18 nt, Homo sapiens
ugacugucacauaaugcu

SEQ ID NO: 990035 - RNA, 20 nt, Homo sapiens
ugagacagagucuuacucug

SEQ ID NO: 990036 - RNA, 14 nt, Homo sapiens
ugagcaaaaccaaa

SEQ ID NO: 990037 - RNA, 21 nt, Homo sapiens
ugagcaaaaccaaauauucca

SEQ ID NO: 990038 - RNA, 13 nt, Homo sapiens
ugagccaguguca

SEQ ID NO: 990039 - RNA, 17 nt, Homo sapiens
ugaggaaagcauguauu

SEQ ID NO: 990040 - RNA, 19 nt, Homo sapiens
ugaguggcuuuaaugaaua

SEQ ID NO: 990041 - RNA, 17 nt, Homo sapiens
ugaguucuauaauauaa

SEQ ID NO: 990042 - RNA, 19 nt, Homo sapiens
ugaguugcacagcuaugaa

SEQ ID NO: 990043 - RNA, 22 nt, Homo sapiens
ugaguugcacagcuaugaaggc

SEQ ID NO: 990044 - RNA, 15 nt, Homo sapiens
ugauaaaagcacuua

SEQ ID NO: 990045 - RNA, 15 nt, Homo sapiens
ugauaaggaugauaa

SEQ ID NO: 990046 - RNA, 23 nt, Homo sapiens
ugauauggccaauaaaaccauac

SEQ ID NO: 990047 - RNA, 20 nt, Homo sapiens
ugauauguugguagauucua

SEQ ID NO: 990048 - RNA, 11 nt, Homo sapiens
ugaucucagcu

SEQ ID NO: 990049 - RNA, 12 nt, Homo sapiens
ugaugacuaugg

SEQ ID NO: 990050 - RNA, 21 nt, Homo sapiens
ugauggagauauuuacaugaa

SEQ ID NO: 990051 - RNA, 17 nt, Homo sapiens
ugauuuugaaaccauga

SEQ ID NO: 990052 - RNA, 14 nt, Homo sapiens
ugcaaauauaucug

SEQ ID NO: 990053 - RNA, 17 nt, Homo sapiens
ugcaaccucugccuccc

SEQ ID NO: 990054 - RNA, 23 nt, Homo sapiens
ugcaccugucauaugcucugauu

SEQ ID NO: 990055 - RNA, 15 nt, Homo sapiens
ugcagacucacugug

SEQ ID NO: 990056 - RNA, 13 nt, Homo sapiens
ugcagaguacugg

SEQ ID NO: 990057 - RNA, 12 nt, Homo sapiens
ugcagagucaau

SEQ ID NO: 990058 - RNA, 20 nt, Homo sapiens
ugcagucacagcuacacaga

SEQ ID NO: 990059 - RNA, 18 nt, Homo sapiens
ugcaguggcaucaucuca

SEQ ID NO: 990060 - RNA, 21 nt, Homo sapiens
ugcaguuguaggcauguagcu

SEQ ID NO: 990061 - RNA, 15 nt, Homo sapiens
ugcauaacguauaaa

SEQ ID NO: 990062 - RNA, 16 nt, Homo sapiens
ugcauagucauguaag

SEQ ID NO: 990063 - RNA, 17 nt, Homo sapiens
ugcauuacugcaugcac

SEQ ID NO: 990064 - RNA, 23 nt, Homo sapiens
aggagcugauacuuugacagugu

SEQ ID NO: 990065 - RNA, 16 nt, Homo sapiens
aggagcuuugacucag

SEQ ID NO: 990066 - RNA, 15 nt, Homo sapiens
aggagggcucaggga

SEQ ID NO: 990067 - RNA, 20 nt, Homo sapiens
aggaggugaccaaaucagug

SEQ ID NO: 990068 - RNA, 23 nt, Homo sapiens
aggaggugaccaaaucaguguga

SEQ ID NO: 990069 - RNA, 16 nt, Homo sapiens
aggagucaaaacuaca

SEQ ID NO: 990070 - RNA, 19 nt, Homo sapiens
aggaguguccucuucccuc

SEQ ID NO: 990071 - RNA, 22 nt, Homo sapiens
aggauagggccgacgcugugcc

SEQ ID NO: 990072 - RNA, 22 nt, Homo sapiens
aggaugagggaaaagaaaaaga

SEQ ID NO: 990073 - RNA, 13 nt, Homo sapiens
aggaugugauaua

SEQ ID NO: 990074 - RNA, 12 nt, Homo sapiens
aggcaagcacuu

SEQ ID NO: 990075 - RNA, 19 nt, Homo sapiens
aggcaaggaugucugagac

SEQ ID NO: 990076 - RNA, 21 nt, Homo sapiens
aggcaauuccugauggaaaau

SEQ ID NO: 990077 - RNA, 19 nt, Homo sapiens
aggcacgcaccaccaugcc

SEQ ID NO: 990078 - RNA, 20 nt, Homo sapiens
aggcacuguaguucuaagac

SEQ ID NO: 990079 - RNA, 18 nt, Homo sapiens
aggcagucucuaauccac

SEQ ID NO: 990080 - RNA, 18 nt, Homo sapiens
aggcagugcugagaggga

SEQ ID NO: 990081 - RNA, 17 nt, Homo sapiens
aggcccccacuugccuc

SEQ ID NO: 990082 - RNA, 17 nt, Homo sapiens
aggcccgagcagcugag

SEQ ID NO: 990083 - RNA, 12 nt, Homo sapiens
aggcccucgcug

SEQ ID NO: 990084 - RNA, 12 nt, Homo sapiens
aggcccugagaa

SEQ ID NO: 990085 - RNA, 21 nt, Homo sapiens
aggccucuuguugagugccag

SEQ ID NO: 990086 - RNA, 22 nt, Homo sapiens
aggccucuuguugagugccagc

SEQ ID NO: 990087 - RNA, 15 nt, Homo sapiens
aggcgauccaccugu

SEQ ID NO: 990088 - RNA, 19 nt, Homo sapiens
aggcgauccaccugucuca

SEQ ID NO: 990089 - RNA, 22 nt, Homo sapiens
aggcgauccaccugucucagcc

SEQ ID NO: 990090 - RNA, 16 nt, Homo sapiens
aggcggggcuugccuu

SEQ ID NO: 990091 - RNA, 14 nt, Homo sapiens
aggcggugcuugau

SEQ ID NO: 990092 - RNA, 19 nt, Homo sapiens
aggcucucgcacaccucug

SEQ ID NO: 990093 - RNA, 13 nt, Homo sapiens
aggcucuuagcag

SEQ ID NO: 990094 - RNA, 20 nt, Homo sapiens
aggcucuuagcagcuuccag

SEQ ID NO: 990095 - RNA, 17 nt, Homo sapiens
aggcugaccacagcaca

SEQ ID NO: 990096 - RNA, 19 nt, Homo sapiens
aggcugaccacagcacagc

SEQ ID NO: 990097 - RNA, 23 nt, Homo sapiens
aggcugaggcuggcacaggacau

SEQ ID NO: 990098 - RNA, 20 nt, Homo sapiens
aggcugcgagagaaagggag

SEQ ID NO: 990099 - RNA, 14 nt, Homo sapiens
aggcugcugugaac

SEQ ID NO: 990100 - RNA, 18 nt, Homo sapiens
aggcuggcuccagaugca

SEQ ID NO: 990101 - RNA, 17 nt, Homo sapiens
aggcugggccaugucca

SEQ ID NO: 990102 - RNA, 21 nt, Homo sapiens
aggcugggccauguccaaaga

SEQ ID NO: 990103 - RNA, 23 nt, Homo sapiens
aggcugggccauguccaaagagg

SEQ ID NO: 990104 - RNA, 11 nt, Homo sapiens
aggcuguaacu

SEQ ID NO: 990105 - RNA, 13 nt, Homo sapiens
aggcuguggugag

SEQ ID NO: 990106 - RNA, 22 nt, Homo sapiens
aggcuucagccauccacuucac

SEQ ID NO: 990107 - RNA, 15 nt, Homo sapiens
aggcuugggauuugc

SEQ ID NO: 990108 - RNA, 18 nt, Homo sapiens
agggaagcugucccucac

SEQ ID NO: 990109 - RNA, 16 nt, Homo sapiens
agggacagaugaaugc

SEQ ID NO: 990110 - RNA, 14 nt, Homo sapiens
agggaccauggcuu

SEQ ID NO: 990111 - RNA, 13 nt, Homo sapiens
agggacugaccag

SEQ ID NO: 990112 - RNA, 20 nt, Homo sapiens
agggagaagugacauugcau

SEQ ID NO: 990113 - RNA, 14 nt, Homo sapiens
agggagcuggaaaa

SEQ ID NO: 990114 - RNA, 16 nt, Homo sapiens
agggagggcugucauc

SEQ ID NO: 990115 - RNA, 19 nt, Homo sapiens
agggagggguuauagcuuc

SEQ ID NO: 990116 - RNA, 14 nt, Homo sapiens
agggcaacagauca

SEQ ID NO: 990117 - RNA, 18 nt, Homo sapiens
agggcagccagggagagc

SEQ ID NO: 990118 - RNA, 14 nt, Homo sapiens
agggcaugcuuuau

SEQ ID NO: 990119 - RNA, 16 nt, Homo sapiens
agggccacaugggagg

SEQ ID NO: 990120 - RNA, 18 nt, Homo sapiens
agggcccagcccaaguga

SEQ ID NO: 990121 - RNA, 20 nt, Homo sapiens
agggcccccaucucaugccc

SEQ ID NO: 990122 - RNA, 18 nt, Homo sapiens
agggcgggcagagggcug

SEQ ID NO: 990123 - RNA, 13 nt, Homo sapiens
agggcucacucag

SEQ ID NO: 990124 - RNA, 21 nt, Homo sapiens
aggggagggagaaguuucugu

SEQ ID NO: 990125 - RNA, 15 nt, Homo sapiens
aggggagggaucucc

SEQ ID NO: 990126 - RNA, 13 nt, Homo sapiens
aggggcuguguuu

SEQ ID NO: 990127 - RNA, 22 nt, Homo sapiens
agggggagccccuucugcucag

SEQ ID NO: 990128 - RNA, 20 nt, Homo sapiens
agggggccaggcgguggcuu

SEQ ID NO: 990129 - RNA, 19 nt, Homo sapiens
agggguggaaacauaggga

SEQ ID NO: 990130 - RNA, 14 nt, Homo sapiens
aggggugugcugag

SEQ ID NO: 990131 - RNA, 18 nt, Homo sapiens
agggguuauagcuucagg

SEQ ID NO: 990132 - RNA, 16 nt, Homo sapiens
agggucccucugugua

SEQ ID NO: 990133 - RNA, 16 nt, Homo sapiens
agggucuaagcaccuu

SEQ ID NO: 990134 - RNA, 23 nt, Homo sapiens
agggucugcucuuucucugccag

SEQ ID NO: 990135 - RNA, 19 nt, Homo sapiens
agggucuggaacaccaggc

SEQ ID NO: 990136 - RNA, 13 nt, Homo sapiens
aggguugagcugg

SEQ ID NO: 990137 - RNA, 16 nt, Homo sapiens
aggguuugcagaaagc

SEQ ID NO: 990138 - RNA, 18 nt, Homo sapiens
agguaacuaacugcauac

SEQ ID NO: 990139 - RNA, 17 nt, Homo sapiens
agguagggguugggaau

SEQ ID NO: 990140 - RNA, 15 nt, Homo sapiens
agguccagcucugga

SEQ ID NO: 990141 - RNA, 18 nt, Homo sapiens
agguccccauacuccuau

SEQ ID NO: 990142 - RNA, 19 nt, Homo sapiens
agguccucugucagucaca

SEQ ID NO: 990143 - RNA, 14 nt, Homo sapiens
aggucuacucccuc

SEQ ID NO: 990144 - RNA, 23 nt, Homo sapiens
aggucuacucccuccucacccca

SEQ ID NO: 990145 - RNA, 13 nt, Homo sapiens
aggugaauagcca

SEQ ID NO: 990146 - RNA, 14 nt, Homo sapiens
aggugaauagccau

SEQ ID NO: 990147 - RNA, 16 nt, Homo sapiens
aggugaggucagcaca

SEQ ID NO: 990148 - RNA, 19 nt, Homo sapiens
aggugcauagcaagugaaa

SEQ ID NO: 990149 - RNA, 20 nt, Homo sapiens
aggugcugacuucaucuccc

SEQ ID NO: 990150 - RNA, 17 nt, Homo sapiens
agguuauuuugauguaa

SEQ ID NO: 990151 - RNA, 18 nt, Homo sapiens
agguuccacagaggacac

SEQ ID NO: 990152 - RNA, 20 nt, Homo sapiens
agguucuaaaguucuaagau

SEQ ID NO: 990153 - RNA, 18 nt, Homo sapiens
agguuucuaagcauaaaa

SEQ ID NO: 990154 - RNA, 15 nt, Homo sapiens
agguuugccugugua

SEQ ID NO: 990155 - RNA, 18 nt, Homo sapiens
agguuugccuguguacag

SEQ ID NO: 990156 - RNA, 13 nt, Homo sapiens
aguaacaggcuca

SEQ ID NO: 990157 - RNA, 17 nt, Homo sapiens
aguaauacaucaaagag

SEQ ID NO: 990158 - RNA, 13 nt, Homo sapiens
aguaccaaaauaa

SEQ ID NO: 990159 - RNA, 16 nt, Homo sapiens
aguaccccugggaggu

SEQ ID NO: 990160 - RNA, 18 nt, Homo sapiens
aguacuaugucaaagcaa

SEQ ID NO: 990161 - RNA, 16 nt, Homo sapiens
aguauaaagcuaugua

SEQ ID NO: 990162 - RNA, 17 nt, Homo sapiens
aguauauugauaaccuu

SEQ ID NO: 990163 - RNA, 21 nt, Homo sapiens
aguaucaugcccugugcaacc

SEQ ID NO: 990164 - RNA, 18 nt, Homo sapiens
aguauggcuccuccauau

SEQ ID NO: 990165 - RNA, 19 nt, Homo sapiens
aguauuaaaauguaugcau

SEQ ID NO: 990166 - RNA, 15 nt, Homo sapiens
aguauugcaugcuca

SEQ ID NO: 990167 - RNA, 20 nt, Homo sapiens
aguauugucgguuaccucug

SEQ ID NO: 990168 - RNA, 21 nt, Homo sapiens
auuaagcccaauuaauuccug

SEQ ID NO: 990169 - RNA, 15 nt, Homo sapiens
auuaauaucauuuau

SEQ ID NO: 990170 - RNA, 19 nt, Homo sapiens
auuaaucuuaguguaugau

SEQ ID NO: 990171 - RNA, 16 nt, Homo sapiens
auuaccuccugagaaa

SEQ ID NO: 990172 - RNA, 14 nt, Homo sapiens
auuacugcauaaaa

SEQ ID NO: 990173 - RNA, 16 nt, Homo sapiens
auuagaguauuuucca

SEQ ID NO: 990174 - RNA, 13 nt, Homo sapiens
auuagaugaacuc

SEQ ID NO: 990175 - RNA, 14 nt, Homo sapiens
auuauaacuguaaa

SEQ ID NO: 990176 - RNA, 24 nt, Homo sapiens
auuauacgcuggcaacacagaggc

SEQ ID NO: 990177 - RNA, 13 nt, Homo sapiens
auuaucaacagca

SEQ ID NO: 990178 - RNA, 21 nt, Homo sapiens
auuaucauaugaacuugucag

SEQ ID NO: 990179 - RNA, 15 nt, Homo sapiens
auucaacaauuucaa

SEQ ID NO: 990180 - RNA, 19 nt, Homo sapiens
auucaagggacccaugagu

SEQ ID NO: 990181 - RNA, 17 nt, Homo sapiens
auucacaugaugcacuu

SEQ ID NO: 990182 - RNA, 18 nt, Homo sapiens
auucacccagagggaaau

SEQ ID NO: 990183 - RNA, 15 nt, Homo sapiens
auucagguaauacaa

SEQ ID NO: 990184 - RNA, 15 nt, Homo sapiens
auucaugacuaugga

SEQ ID NO: 990185 - RNA, 17 nt, Homo sapiens
auucauuguggucauag

SEQ ID NO: 990186 - RNA, 17 nt, Homo sapiens
auuccagaaugcuguac

SEQ ID NO: 990187 - RNA, 16 nt, Homo sapiens
auuccauccucaacac

SEQ ID NO: 990188 - RNA, 23 nt, Homo sapiens
auucccagguaggccaagguguc

SEQ ID NO: 990189 - RNA, 23 nt, Homo sapiens
auuccccuguagcagucacugac

SEQ ID NO: 990190 - RNA, 20 nt, Homo sapiens
auuccggauccuaagcaucu

SEQ ID NO: 990191 - RNA, 20 nt, Homo sapiens
auuccgucaccacgacuggc

SEQ ID NO: 990192 - RNA, 20 nt, Homo sapiens
auuccuguuugucuacauau

SEQ ID NO: 990193 - RNA, 23 nt, Homo sapiens
auuccuuuaacaacauguuucca

SEQ ID NO: 990194 - RNA, 19 nt, Homo sapiens
auucuauuuauauguacau

SEQ ID NO: 990195 - RNA, 21 nt, Homo sapiens
auucuauuuauauguacauga

SEQ ID NO: 990196 - RNA, 13 nt, Homo sapiens
auucucauucuca

SEQ ID NO: 990197 - RNA, 12 nt, Homo sapiens
auucuccacagc

SEQ ID NO: 990198 - RNA, 15 nt, Homo sapiens
auucucccuugcucu

SEQ ID NO: 990199 - RNA, 16 nt, Homo sapiens
auucuggaccucuggg

SEQ ID NO: 990200 - RNA, 18 nt, Homo sapiens
auucuggaccucuggguu

SEQ ID NO: 990201 - RNA, 18 nt, Homo sapiens
auucuucugagcacuguu

SEQ ID NO: 990202 - RNA, 21 nt, Homo sapiens
auucuucugagcacuguuuau

SEQ ID NO: 990203 - RNA, 20 nt, Homo sapiens
auucuuucccaauucacauc

SEQ ID NO: 990204 - RNA, 15 nt, Homo sapiens
auugaacacaaacug

SEQ ID NO: 990205 - RNA, 22 nt, Homo sapiens
auugaaccuuugugcccuauca

SEQ ID NO: 990206 - RNA, 12 nt, Homo sapiens
auugaauacuuu

SEQ ID NO: 990207 - RNA, 22 nt, Homo sapiens
auugauuguauuguugaaaaag

SEQ ID NO: 990208 - RNA, 16 nt, Homo sapiens
auugcaagaguuuaau

SEQ ID NO: 990209 - RNA, 16 nt, Homo sapiens
auugcacaccuuggaa

SEQ ID NO: 990210 - RNA, 16 nt, Homo sapiens
auugcaccacugcacu

SEQ ID NO: 990211 - RNA, 18 nt, Homo sapiens
auugccuugagguacuuu

SEQ ID NO: 990212 - RNA, 22 nt, Homo sapiens
auugcugccccaucagugcucc

SEQ ID NO: 990213 - RNA, 22 nt, Homo sapiens
auuggaacuggaggcagggaac

SEQ ID NO: 990214 - RNA, 15 nt, Homo sapiens
auuggauuuccuaau

SEQ ID NO: 990215 - RNA, 23 nt, Homo sapiens
auugggaaaugaaaaaaaaaugg

SEQ ID NO: 990216 - RNA, 15 nt, Homo sapiens
auuguacuaaagcca

SEQ ID NO: 990217 - RNA, 19 nt, Homo sapiens
auuguauauuguaauuuaa

SEQ ID NO: 990218 - RNA, 19 nt, Homo sapiens
auuguaucaaaugugacau

SEQ ID NO: 990219 - RNA, 17 nt, Homo sapiens
auugucgguuaccucug

SEQ ID NO: 990220 - RNA, 18 nt, Homo sapiens
auugugaucagaccauaa

SEQ ID NO: 990221 - RNA, 15 nt, Homo sapiens
auugugauuagacag

SEQ ID NO: 990222 - RNA, 17 nt, Homo sapiens
auugugcaguacuuugu

SEQ ID NO: 990223 - RNA, 14 nt, Homo sapiens
auuuaaaaauaagu

SEQ ID NO: 990224 - RNA, 20 nt, Homo sapiens
auuuaacauuaucuaguuca

SEQ ID NO: 990225 - RNA, 15 nt, Homo sapiens
auuuacaaacugaag

SEQ ID NO: 990226 - RNA, 18 nt, Homo sapiens
auuuagacccugcauuua

SEQ ID NO: 990227 - RNA, 22 nt, Homo sapiens
auuuagugaucaaauugugcag

SEQ ID NO: 990228 - RNA, 12 nt, Homo sapiens
auuuauauaugu

SEQ ID NO: 990229 - RNA, 14 nt, Homo sapiens
auuuaucacacaaa

SEQ ID NO: 990230 - RNA, 17 nt, Homo sapiens
auuuaucacacaaagca

SEQ ID NO: 990231 - RNA, 15 nt, Homo sapiens
auuucauacuguaac

SEQ ID NO: 990232 - RNA, 12 nt, Homo sapiens
auuucaucucuu

SEQ ID NO: 990233 - RNA, 22 nt, Homo sapiens
auuucauguuuuugaucaaaaa

SEQ ID NO: 990234 - RNA, 17 nt, Homo sapiens
auuucccaacacaaaga

SEQ ID NO: 990235 - RNA, 17 nt, Homo sapiens
auuuccuaauacuguca

SEQ ID NO: 990236 - RNA, 22 nt, Homo sapiens
auuucuaauuauguagcucuuu

SEQ ID NO: 990237 - RNA, 21 nt, Homo sapiens
auuucuauuuuauuaugaaga

SEQ ID NO: 990238 - RNA, 19 nt, Homo sapiens
auuucucaucaguaguuca

SEQ ID NO: 990239 - RNA, 14 nt, Homo sapiens
auuucuccaaagcc

SEQ ID NO: 990240 - RNA, 22 nt, Homo sapiens
auuucuccaggauuuccugcuu

SEQ ID NO: 990241 - RNA, 19 nt, Homo sapiens
auuucuccuccaugggaga

SEQ ID NO: 990242 - RNA, 13 nt, Homo sapiens
auuucuguguugc

SEQ ID NO: 990243 - RNA, 23 nt, Homo sapiens
auuugaaaccccuguaggccuca

SEQ ID NO: 990244 - RNA, 17 nt, Homo sapiens
auuugaagaacauguga

SEQ ID NO: 990245 - RNA, 19 nt, Homo sapiens
auuugcauaacaauuccuc

SEQ ID NO: 990246 - RNA, 16 nt, Homo sapiens
auuuggcaaugccauc

SEQ ID NO: 990247 - RNA, 15 nt, Homo sapiens
auuuguaaaucugcc

SEQ ID NO: 990248 - RNA, 22 nt, Homo sapiens
auuuguaaaucugccacaaaaa

SEQ ID NO: 990249 - RNA, 22 nt, Homo sapiens
auuuguaaugucuugagcucua

SEQ ID NO: 990250 - RNA, 16 nt, Homo sapiens
auuuguuuuguuuaca

SEQ ID NO: 990251 - RNA, 19 nt, Homo sapiens
auuuuaaaaucagcuauuu

SEQ ID NO: 990252 - RNA, 14 nt, Homo sapiens
auuuuaaguacuuu

SEQ ID NO: 990253 - RNA, 21 nt, Homo sapiens
auuuuaaugaagaaaguggaa

SEQ ID NO: 990254 - RNA, 17 nt, Homo sapiens
auuuuccuguccucuuu

SEQ ID NO: 990255 - RNA, 22 nt, Homo sapiens
auuuuccuguccucuuucagcu

SEQ ID NO: 990256 - RNA, 22 nt, Homo sapiens
auuuucucccucuuucuuccca

SEQ ID NO: 990257 - RNA, 16 nt, Homo sapiens
auuuucucucagguga

SEQ ID NO: 990258 - RNA, 16 nt, Homo sapiens
auuuugcaaagauuua

SEQ ID NO: 990259 - RNA, 20 nt, Homo sapiens
auuuuggagaguuuccugaa

SEQ ID NO: 990260 - RNA, 17 nt, Homo sapiens
auuuugguuuguguauc

SEQ ID NO: 990261 - RNA, 20 nt, Homo sapiens
auuuuguaauguaucaaaua

SEQ ID NO: 990262 - RNA, 13 nt, Homo sapiens
auuuuuacaaugu

SEQ ID NO: 990263 - RNA, 19 nt, Homo sapiens
auuuuuaucuauccuaugu

SEQ ID NO: 990264 - RNA, 17 nt, Homo sapiens
auuuuucaagagcuccu

SEQ ID NO: 990265 - RNA, 15 nt, Homo sapiens
auuuuuccaacuacu

SEQ ID NO: 990266 - RNA, 13 nt, Homo sapiens
auuuuugugcaca

SEQ ID NO: 990267 - RNA, 14 nt, Homo sapiens
caaaaagaaccacu

SEQ ID NO: 990268 - RNA, 20 nt, Homo sapiens
caaaacagagggcugcauuc

SEQ ID NO: 990269 - RNA, 17 nt, Homo sapiens
caaaaccagguccaaug

SEQ ID NO: 990270 - RNA, 18 nt, Homo sapiens
caaaaccccccagauauc

SEQ ID NO: 990271 - RNA, 21 nt, Homo sapiens
caaaaccccccagauaucauc

SEQ ID NO: 990272 - RNA, 18 nt, Homo sapiens
cagagaagccagcuuguu

SEQ ID NO: 990273 - RNA, 18 nt, Homo sapiens
cagagaaggaacauaccc

SEQ ID NO: 990274 - RNA, 20 nt, Homo sapiens
cagagagagagaaggcagca

SEQ ID NO: 990275 - RNA, 20 nt, Homo sapiens
cagagcagagguggaaaaac

SEQ ID NO: 990276 - RNA, 22 nt, Homo sapiens
cagagcauucagaaugucaaug

SEQ ID NO: 990277 - RNA, 15 nt, Homo sapiens
cagagcccaagggaa

SEQ ID NO: 990278 - RNA, 16 nt, Homo sapiens
cagagcccagcuccaa

SEQ ID NO: 990279 - RNA, 22 nt, Homo sapiens
cagagccucggcccuagcauug

SEQ ID NO: 990280 - RNA, 17 nt, Homo sapiens
cagaggggcucagguca

SEQ ID NO: 990281 - RNA, 14 nt, Homo sapiens
cagagugacaucca

SEQ ID NO: 990282 - RNA, 17 nt, Homo sapiens
cagaucuagucaaucaa

SEQ ID NO: 990283 - RNA, 15 nt, Homo sapiens
cagaugcuccaagau

SEQ ID NO: 990284 - RNA, 21 nt, Homo sapiens
cagaugcugaaaauguccuug

SEQ ID NO: 990285 - RNA, 16 nt, Homo sapiens
cagauggcacuuugaa

SEQ ID NO: 990286 - RNA, 17 nt, Homo sapiens
cagauggcacuuugaag

SEQ ID NO: 990287 - RNA, 17 nt, Homo sapiens
cagaugugaaccauuaa

SEQ ID NO: 990288 - RNA, 19 nt, Homo sapiens
cagauucucccuugcucug

SEQ ID NO: 990289 - RNA, 14 nt, Homo sapiens
cagcaaagugguuc

SEQ ID NO: 990290 - RNA, 16 nt, Homo sapiens
cagcacacagggcagu

SEQ ID NO: 990291 - RNA, 18 nt, Homo sapiens
cagcacuagccaaaccuc

SEQ ID NO: 990292 - RNA, 15 nt, Homo sapiens
cagcagagcauucag

SEQ ID NO: 990293 - RNA, 14 nt, Homo sapiens
cagcaggggcugcc

SEQ ID NO: 990294 - RNA, 14 nt, Homo sapiens
cagcagugccuugu

SEQ ID NO: 990295 - RNA, 13 nt, Homo sapiens
cagccacauucua

SEQ ID NO: 990296 - RNA, 13 nt, Homo sapiens
cagccacccugag

SEQ ID NO: 990297 - RNA, 15 nt, Homo sapiens
cagccacccugaguu

SEQ ID NO: 990298 - RNA, 20 nt, Homo sapiens
cagccacuguuuguuuacaa

SEQ ID NO: 990299 - RNA, 19 nt, Homo sapiens
cagccagaucgggagcaaa

SEQ ID NO: 990300 - RNA, 15 nt, Homo sapiens
cagccccuuucccuu

SEQ ID NO: 990301 - RNA, 19 nt, Homo sapiens
cagcccugcaccaugcugc

SEQ ID NO: 990302 - RNA, 18 nt, Homo sapiens
cagccgaggucccugcug

SEQ ID NO: 990303 - RNA, 21 nt, Homo sapiens
cagccgcgcaucagacuguga

SEQ ID NO: 990304 - RNA, 15 nt, Homo sapiens
cagccucccauccag

SEQ ID NO: 990305 - RNA, 15 nt, Homo sapiens
cagccuuagcucucc

SEQ ID NO: 990306 - RNA, 19 nt, Homo sapiens
cagcgaccuuccucaucca

SEQ ID NO: 990307 - RNA, 22 nt, Homo sapiens
cagcggcccugucauccagcuc

SEQ ID NO: 990308 - RNA, 14 nt, Homo sapiens
cagcggugggaccu

SEQ ID NO: 990309 - RNA, 21 nt, Homo sapiens
cagcuagugacccacaugcca

SEQ ID NO: 990310 - RNA, 20 nt, Homo sapiens
cagcuauuuugugaagccau

SEQ ID NO: 990311 - RNA, 18 nt, Homo sapiens
cagcuccaaccugcaaag

SEQ ID NO: 990312 - RNA, 13 nt, Homo sapiens
cagcucccugugc

SEQ ID NO: 990313 - RNA, 17 nt, Homo sapiens
cagcuccuaggaaaaug

SEQ ID NO: 990314 - RNA, 21 nt, Homo sapiens
cagcuccuguaacauacuggc

SEQ ID NO: 990315 - RNA, 19 nt, Homo sapiens
cagcucgggcccucuguga

SEQ ID NO: 990316 - RNA, 21 nt, Homo sapiens
cagcuggaagggucaacaucu

SEQ ID NO: 990317 - RNA, 21 nt, Homo sapiens
cagcugguguagcuacagaga

SEQ ID NO: 990318 - RNA, 23 nt, Homo sapiens
cagcuguccccccacucccucac

SEQ ID NO: 990319 - RNA, 18 nt, Homo sapiens
cagcuguuuuguugacau

SEQ ID NO: 990320 - RNA, 16 nt, Homo sapiens
cagcuucaggugaccc

SEQ ID NO: 990321 - RNA, 22 nt, Homo sapiens
caggaaacaguugcauguagua

SEQ ID NO: 990322 - RNA, 19 nt, Homo sapiens
caggaaacgagacuuucca

SEQ ID NO: 990323 - RNA, 23 nt, Homo sapiens
caggaauuucccaggacccugaa

SEQ ID NO: 990324 - RNA, 14 nt, Homo sapiens
caggacacaggccu

SEQ ID NO: 990325 - RNA, 19 nt, Homo sapiens
caggacuucucuuuaguca

SEQ ID NO: 990326 - RNA, 18 nt, Homo sapiens
caggagaaucacuugaac

SEQ ID NO: 990327 - RNA, 16 nt, Homo sapiens
caggaggaauacugaa

SEQ ID NO: 990328 - RNA, 18 nt, Homo sapiens
caggaggaauacugaaca

SEQ ID NO: 990329 - RNA, 21 nt, Homo sapiens
caggaggugugauuccugaag

SEQ ID NO: 990330 - RNA, 16 nt, Homo sapiens
caggauccccaaggca

SEQ ID NO: 990331 - RNA, 19 nt, Homo sapiens
caggcaaucugcccgccug

SEQ ID NO: 990332 - RNA, 19 nt, Homo sapiens
caggcacagguccccagau

SEQ ID NO: 990333 - RNA, 12 nt, Homo sapiens
caggcaccugcc

SEQ ID NO: 990334 - RNA, 15 nt, Homo sapiens
caggcagggugcagu

SEQ ID NO: 990335 - RNA, 13 nt, Homo sapiens
caggcauugccaa

SEQ ID NO: 990336 - RNA, 14 nt, Homo sapiens
caggccaaugucag

SEQ ID NO: 990337 - RNA, 22 nt, Homo sapiens
caggccuguguagcugugaccu

SEQ ID NO: 990338 - RNA, 12 nt, Homo sapiens
caggcugggaac

SEQ ID NO: 990339 - RNA, 22 nt, Homo sapiens
caggcugggccauguccaaaga

SEQ ID NO: 990340 - RNA, 19 nt, Homo sapiens
cagggaaaauuauuugcau

SEQ ID NO: 990341 - RNA, 14 nt, Homo sapiens
cagggaacccacag

SEQ ID NO: 990342 - RNA, 17 nt, Homo sapiens
cagggaggcugguccua

SEQ ID NO: 990343 - RNA, 18 nt, Homo sapiens
cagggcagcgccaggcug

SEQ ID NO: 990344 - RNA, 16 nt, Homo sapiens
cagggcaugcuuuauu

SEQ ID NO: 990345 - RNA, 16 nt, Homo sapiens
cagggcuccugcacuu

SEQ ID NO: 990346 - RNA, 22 nt, Homo sapiens
caggggaguggagagagcuccu

SEQ ID NO: 990347 - RNA, 20 nt, Homo sapiens
cagggucugcucuuucucug

SEQ ID NO: 990348 - RNA, 23 nt, Homo sapiens
cagggucugcucuuucucugcca

SEQ ID NO: 990349 - RNA, 20 nt, Homo sapiens
cagggugacccugaagugag

SEQ ID NO: 990350 - RNA, 21 nt, Homo sapiens
cagggugggcuuguggggccu

SEQ ID NO: 990351 - RNA, 21 nt, Homo sapiens
caggguuucaccauguugccc

SEQ ID NO: 990352 - RNA, 16 nt, Homo sapiens
cagguaauacaaacua

SEQ ID NO: 990353 - RNA, 13 nt, Homo sapiens
cagguauaccuca

SEQ ID NO: 990354 - RNA, 22 nt, Homo sapiens
caggugcugacuucaucuccca

SEQ ID NO: 990355 - RNA, 19 nt, Homo sapiens
cagguguaagccaccgugc

SEQ ID NO: 990356 - RNA, 20 nt, Homo sapiens
cagguguaagccaccgugcc

SEQ ID NO: 990357 - RNA, 19 nt, Homo sapiens
caggugugugccaccacac

SEQ ID NO: 990358 - RNA, 17 nt, Homo sapiens
cagguuaccacucuggc

SEQ ID NO: 990359 - RNA, 23 nt, Homo sapiens
caguacccacucuggagcauuuc

SEQ ID NO: 990360 - RNA, 23 nt, Homo sapiens
caguagucccugcacagugacuu

SEQ ID NO: 990361 - RNA, 16 nt, Homo sapiens
cagucacugacaguua

SEQ ID NO: 990362 - RNA, 13 nt, Homo sapiens
caguccauugcuc

SEQ ID NO: 990363 - RNA, 13 nt, Homo sapiens
cagucucacuuug

SEQ ID NO: 990364 - RNA, 23 nt, Homo sapiens
cagucucuaauccaccccaaucc

SEQ ID NO: 990365 - RNA, 13 nt, Homo sapiens
cagugaacacuca

SEQ ID NO: 990366 - RNA, 17 nt, Homo sapiens
cagugaagacuaugaaa

SEQ ID NO: 990367 - RNA, 21 nt, Homo sapiens
cagugaaugauucaguguuaa

SEQ ID NO: 990368 - RNA, 12 nt, Homo sapiens
cagugcucccuc

SEQ ID NO: 990369 - RNA, 17 nt, Homo sapiens
cagugggggcagagcca

SEQ ID NO: 990370 - RNA, 15 nt, Homo sapiens
cagugucauuucuca

SEQ ID NO: 990371 - RNA, 19 nt, Homo sapiens
caguguggcugaggccacc

SEQ ID NO: 990372 - RNA, 11 nt, Homo sapiens
caguguugccc

SEQ ID NO: 990373 - RNA, 20 nt, Homo sapiens
caguguuuauccuuucauau

SEQ ID NO: 990374 - RNA, 20 nt, Homo sapiens
caguuaauaaaccuuugcaa

SEQ ID NO: 990375 - RNA, 20 nt, Homo sapiens
ccguggagagggacuggcag

SEQ ID NO: 990376 - RNA, 21 nt, Homo sapiens
ccguguaaauauguacauuuc

SEQ ID NO: 990377 - RNA, 17 nt, Homo sapiens
ccuaaacaucauucauu

SEQ ID NO: 990378 - RNA, 20 nt, Homo sapiens
ccuaagagagcaccugguga

SEQ ID NO: 990379 - RNA, 16 nt, Homo sapiens
ccuaauguguuuagau

SEQ ID NO: 990380 - RNA, 20 nt, Homo sapiens
ccuacaaaauuucaccugca

SEQ ID NO: 990381 - RNA, 21 nt, Homo sapiens
ccuacaccucuugcauuccau

SEQ ID NO: 990382 - RNA, 12 nt, Homo sapiens
ccuacauguauu

SEQ ID NO: 990383 - RNA, 21 nt, Homo sapiens
ccuaccucacagagugcauug

SEQ ID NO: 990384 - RNA, 23 nt, Homo sapiens
ccuagaccagcagacagagccag

SEQ ID NO: 990385 - RNA, 15 nt, Homo sapiens
ccuagcauugcacuu

SEQ ID NO: 990386 - RNA, 20 nt, Homo sapiens
ccuaggauuucaugauuuca

SEQ ID NO: 990387 - RNA, 15 nt, Homo sapiens
ccuaggcgcuguucu

SEQ ID NO: 990388 - RNA, 21 nt, Homo sapiens
ccuaguuguucagcauggcau

SEQ ID NO: 990389 - RNA, 21 nt, Homo sapiens
ccuaucuguguggugaugaau

SEQ ID NO: 990390 - RNA, 11 nt, Homo sapiens
ccuaugcaugg

SEQ ID NO: 990391 - RNA, 17 nt, Homo sapiens
ccucaaaugcggggugg

SEQ ID NO: 990392 - RNA, 16 nt, Homo sapiens
ccucaacccaagggga

SEQ ID NO: 990393 - RNA, 23 nt, Homo sapiens
ccucacagagugcauugugaggg

SEQ ID NO: 990394 - RNA, 14 nt, Homo sapiens
ccucacuucaggua

SEQ ID NO: 990395 - RNA, 17 nt, Homo sapiens
ccucagggacucaggug

SEQ ID NO: 990396 - RNA, 20 nt, Homo sapiens
ccucaguucccucuugcuca

SEQ ID NO: 990397 - RNA, 20 nt, Homo sapiens
ccuccaccuccuaggcucaa

SEQ ID NO: 990398 - RNA, 11 nt, Homo sapiens
ccuccaucuca

SEQ ID NO: 990399 - RNA, 18 nt, Homo sapiens
ccucccaaaugagccaug

SEQ ID NO: 990400 - RNA, 22 nt, Homo sapiens
ccucccuauuaaccuagagauu

SEQ ID NO: 990401 - RNA, 20 nt, Homo sapiens
ccuccuaguucuucauccca

SEQ ID NO: 990402 - RNA, 18 nt, Homo sapiens
ccuccuauggguugucac

SEQ ID NO: 990403 - RNA, 22 nt, Homo sapiens
ccuccuauggguugucaccaag

SEQ ID NO: 990404 - RNA, 20 nt, Homo sapiens
ccuccucaggcacacagcua

SEQ ID NO: 990405 - RNA, 15 nt, Homo sapiens
ccuccugaaagccug

SEQ ID NO: 990406 - RNA, 14 nt, Homo sapiens
ccuccuuuucccaa

SEQ ID NO: 990407 - RNA, 14 nt, Homo sapiens
ccucgcugccagcu

SEQ ID NO: 990408 - RNA, 15 nt, Homo sapiens
ccucgcuggacucuc

SEQ ID NO: 990409 - RNA, 15 nt, Homo sapiens
ccucuaacagcacca

SEQ ID NO: 990410 - RNA, 13 nt, Homo sapiens
ccucuacugccuu

SEQ ID NO: 990411 - RNA, 21 nt, Homo sapiens
ccucuagguccccauacuccu

SEQ ID NO: 990412 - RNA, 22 nt, Homo sapiens
ccucuagguccccauacuccua

SEQ ID NO: 990413 - RNA, 19 nt, Homo sapiens
ccucucccuccuccaggaa

SEQ ID NO: 990414 - RNA, 20 nt, Homo sapiens
ccucucccuugggcucugau

SEQ ID NO: 990415 - RNA, 14 nt, Homo sapiens
ccucucgcggcccu

SEQ ID NO: 990416 - RNA, 19 nt, Homo sapiens
ccucucucccggagguugg

SEQ ID NO: 990417 - RNA, 17 nt, Homo sapiens
ccucugaccugcacugg

SEQ ID NO: 990418 - RNA, 22 nt, Homo sapiens
ccucugcauggaacagcauuac

SEQ ID NO: 990419 - RNA, 11 nt, Homo sapiens
ccucugcauuu

SEQ ID NO: 990420 - RNA, 23 nt, Homo sapiens
ccucugccaaaggaugugauaua

SEQ ID NO: 990421 - RNA, 17 nt, Homo sapiens
ccucugggggguggcca

SEQ ID NO: 990422 - RNA, 21 nt, Homo sapiens
ccucuggucgcuccugcccac

SEQ ID NO: 990423 - RNA, 12 nt, Homo sapiens
ccucuuccccag

SEQ ID NO: 990424 - RNA, 22 nt, Homo sapiens
ccucuuggccugaucagaccac

SEQ ID NO: 990425 - RNA, 17 nt, Homo sapiens
ccucuuuuccuucccaa

SEQ ID NO: 990426 - RNA, 12 nt, Homo sapiens
ccugaagaacca

SEQ ID NO: 990427 - RNA, 15 nt, Homo sapiens
ccugaagaaccaguc

SEQ ID NO: 990428 - RNA, 22 nt, Homo sapiens
ccugaaggguugacuuuaccca

SEQ ID NO: 990429 - RNA, 21 nt, Homo sapiens
ccugaauucuuuuucauuuga

SEQ ID NO: 990430 - RNA, 22 nt, Homo sapiens
ccugaauucuuuuucauuugag

SEQ ID NO: 990431 - RNA, 17 nt, Homo sapiens
ccugacacggacugugc

SEQ ID NO: 990432 - RNA, 18 nt, Homo sapiens
ccugacacggacugugca

SEQ ID NO: 990433 - RNA, 21 nt, Homo sapiens
ccugacacugcaauuggcacc

SEQ ID NO: 990434 - RNA, 18 nt, Homo sapiens
ccugacuccuccaaggaa

SEQ ID NO: 990435 - RNA, 20 nt, Homo sapiens
ccugagguuugccagcauuu

SEQ ID NO: 990436 - RNA, 22 nt, Homo sapiens
ccugagguuugccagcauuuag

SEQ ID NO: 990437 - RNA, 17 nt, Homo sapiens
ccugaguggugccaaac

SEQ ID NO: 990438 - RNA, 17 nt, Homo sapiens
ccugaucccagagagcc

SEQ ID NO: 990439 - RNA, 19 nt, Homo sapiens
ccugcacagugacuucuga

SEQ ID NO: 990440 - RNA, 23 nt, Homo sapiens
ccugcacuggggagcccgucuca

SEQ ID NO: 990441 - RNA, 14 nt, Homo sapiens
ccugcacuguaaaa

SEQ ID NO: 990442 - RNA, 15 nt, Homo sapiens
ccugcacuguaaaau

SEQ ID NO: 990443 - RNA, 17 nt, Homo sapiens
ccugcagcccaugguga

SEQ ID NO: 990444 - RNA, 16 nt, Homo sapiens
ccugcauuggaacugg

SEQ ID NO: 990445 - RNA, 20 nt, Homo sapiens
ccugccagccccugccauug

SEQ ID NO: 990446 - RNA, 19 nt, Homo sapiens
ccugccuguggcgccgucu

SEQ ID NO: 990447 - RNA, 15 nt, Homo sapiens
ccugcugagcucuga

SEQ ID NO: 990448 - RNA, 16 nt, Homo sapiens
ccuggacacucagacc

SEQ ID NO: 990449 - RNA, 15 nt, Homo sapiens
ccuggaggcacugaa

SEQ ID NO: 990450 - RNA, 19 nt, Homo sapiens
ccuggagggggaauggcag

SEQ ID NO: 990451 - RNA, 23 nt, Homo sapiens
ccuggaguguaugacugcacaug

SEQ ID NO: 990452 - RNA, 18 nt, Homo sapiens
ccuggcacuaacguugag

SEQ ID NO: 990453 - RNA, 15 nt, Homo sapiens
ccugggauucaggaa

SEQ ID NO: 990454 - RNA, 19 nt, Homo sapiens
ccugggcaacacagugaga

SEQ ID NO: 990455 - RNA, 20 nt, Homo sapiens
ccuggggcuagggggagccc

SEQ ID NO: 990456 - RNA, 22 nt, Homo sapiens
ccugggugacauuugggagaca

SEQ ID NO: 990457 - RNA, 22 nt, Homo sapiens
ccuggucagugguggucuucaa

SEQ ID NO: 990458 - RNA, 13 nt, Homo sapiens
ccugguggccaug

SEQ ID NO: 990459 - RNA, 15 nt, Homo sapiens
ccugguucccggaga

SEQ ID NO: 990460 - RNA, 22 nt, Homo sapiens
ccugguugagcuucugcuaaaa

SEQ ID NO: 990461 - RNA, 22 nt, Homo sapiens
ccugucagauccaggagcucca

SEQ ID NO: 990462 - RNA, 16 nt, Homo sapiens
ccugucagcaugaauu

SEQ ID NO: 990463 - RNA, 17 nt, Homo sapiens
ccugucagcaugaauuu

SEQ ID NO: 990464 - RNA, 21 nt, Homo sapiens
ccugucuuaauuuucuuucac

SEQ ID NO: 990465 - RNA, 14 nt, Homo sapiens
ccugugaaugccac

SEQ ID NO: 990466 - RNA, 11 nt, Homo sapiens
ccugugacacu

SEQ ID NO: 990467 - RNA, 18 nt, Homo sapiens
ccugugucugcuguagaa

SEQ ID NO: 990468 - RNA, 17 nt, Homo sapiens
ccuguguuucuugccuc

SEQ ID NO: 990469 - RNA, 16 nt, Homo sapiens
ccuguuagcauugcca

SEQ ID NO: 990470 - RNA, 18 nt, Homo sapiens
ccuguugagcaucacaga

SEQ ID NO: 990471 - RNA, 16 nt, Homo sapiens
ccuguuucccacccag

SEQ ID NO: 990472 - RNA, 14 nt, Homo sapiens
ccuuacaaaugaaa

SEQ ID NO: 990473 - RNA, 18 nt, Homo sapiens
ccuuauccucccuguaac

SEQ ID NO: 990474 - RNA, 19 nt, Homo sapiens
ccuucaagcucugagggaa

SEQ ID NO: 990475 - RNA, 12 nt, Homo sapiens
ccuucaccuuca

SEQ ID NO: 990476 - RNA, 15 nt, Homo sapiens
ccuucagagagcagu

SEQ ID NO: 990477 - RNA, 15 nt, Homo sapiens
ccuucagcaccugac

SEQ ID NO: 990478 - RNA, 17 nt, Homo sapiens
gcuguggccaggaggug

SEQ ID NO: 990479 - RNA, 15 nt, Homo sapiens
gcuguggugagggaa

SEQ ID NO: 990480 - RNA, 14 nt, Homo sapiens
gcuuagaaauucag

SEQ ID NO: 990481 - RNA, 20 nt, Homo sapiens
gcuuagaaauucagcauuug

SEQ ID NO: 990482 - RNA, 21 nt, Homo sapiens
gcuuagacuaaggccauuauu

SEQ ID NO: 990483 - RNA, 21 nt, Homo sapiens
gcuuauuuaagaucacaguga

SEQ ID NO: 990484 - RNA, 14 nt, Homo sapiens
gcuuccuucagaga

SEQ ID NO: 990485 - RNA, 16 nt, Homo sapiens
gcuucuggccaggaag

SEQ ID NO: 990486 - RNA, 18 nt, Homo sapiens
gcuugauagaaaugccaa

SEQ ID NO: 990487 - RNA, 17 nt, Homo sapiens
gcuugugggacuagccu

SEQ ID NO: 990488 - RNA, 14 nt, Homo sapiens
gcuuguugcaauug

SEQ ID NO: 990489 - RNA, 17 nt, Homo sapiens
gcuuuagaaacagugca

SEQ ID NO: 990490 - RNA, 15 nt, Homo sapiens
gcuuuuugcuucuug

SEQ ID NO: 990491 - RNA, 22 nt, Homo sapiens
ggaaaaauaaucaaaagcuauu

SEQ ID NO: 990492 - RNA, 18 nt, Homo sapiens
ggaaaaucacuugccaaa

SEQ ID NO: 990493 - RNA, 22 nt, Homo sapiens
ggaaccucagccuggccagaca

SEQ ID NO: 990494 - RNA, 13 nt, Homo sapiens
ggaacugcugcca

SEQ ID NO: 990495 - RNA, 14 nt, Homo sapiens
ggaacuucaucaua

SEQ ID NO: 990496 - RNA, 19 nt, Homo sapiens
ggaacuuuuauuacugggg

SEQ ID NO: 990497 - RNA, 17 nt, Homo sapiens
ggaagacgugaugccag

SEQ ID NO: 990498 - RNA, 14 nt, Homo sapiens
ggaagauggcauaa

SEQ ID NO: 990499 - RNA, 17 nt, Homo sapiens
ggaagggagccaaggga

SEQ ID NO: 990500 - RNA, 22 nt, Homo sapiens
ggaagucguccuuacuccugug

SEQ ID NO: 990501 - RNA, 20 nt, Homo sapiens
ggaaguuuagcucugagaac

SEQ ID NO: 990502 - RNA, 13 nt, Homo sapiens
ggaaucagugaag

SEQ ID NO: 990503 - RNA, 23 nt, Homo sapiens
ggaaugaguugaggccacugugu

SEQ ID NO: 990504 - RNA, 14 nt, Homo sapiens
ggacaagaccccca

SEQ ID NO: 990505 - RNA, 22 nt, Homo sapiens
ggacaggauguguuugcuuucu

SEQ ID NO: 990506 - RNA, 15 nt, Homo sapiens
ggaccagcucaggac

SEQ ID NO: 990507 - RNA, 13 nt, Homo sapiens
ggaccauggagug

SEQ ID NO: 990508 - RNA, 13 nt, Homo sapiens
ggacccugaccag

SEQ ID NO: 990509 - RNA, 15 nt, Homo sapiens
ggaccgcuacaccac

SEQ ID NO: 990510 - RNA, 21 nt, Homo sapiens
ggaccucugacagcagcaucu

SEQ ID NO: 990511 - RNA, 16 nt, Homo sapiens
ggacugaccagcagcu

SEQ ID NO: 990512 - RNA, 16 nt, Homo sapiens
ggacuuuccugcaacu

SEQ ID NO: 990513 - RNA, 23 nt, Homo sapiens
ggagaagucucagcuaagcucac

SEQ ID NO: 990514 - RNA, 15 nt, Homo sapiens
ggagaaucacuugaa

SEQ ID NO: 990515 - RNA, 16 nt, Homo sapiens
ggagacaugugacauu

SEQ ID NO: 990516 - RNA, 14 nt, Homo sapiens
ggagaccucagaag

SEQ ID NO: 990517 - RNA, 24 nt, Homo sapiens
ggagaggggccucaaaugcaccau

SEQ ID NO: 990518 - RNA, 23 nt, Homo sapiens
ggagcaaaccaaagaccaucuga

SEQ ID NO: 990519 - RNA, 19 nt, Homo sapiens
ggagcagaguguucccuga

SEQ ID NO: 990520 - RNA, 17 nt, Homo sapiens
ggagcuccaguguccug

SEQ ID NO: 990521 - RNA, 15 nt, Homo sapiens
ggagcugaggccaca

SEQ ID NO: 990522 - RNA, 19 nt, Homo sapiens
ggaggagggcucagggagc

SEQ ID NO: 990523 - RNA, 22 nt, Homo sapiens
ggaggccgaagcuaacagggaa

SEQ ID NO: 990524 - RNA, 14 nt, Homo sapiens
ggagggagcucuga

SEQ ID NO: 990525 - RNA, 16 nt, Homo sapiens
ggaguaggacauacca

SEQ ID NO: 990526 - RNA, 16 nt, Homo sapiens
ggagucagacauuuua

SEQ ID NO: 990527 - RNA, 14 nt, Homo sapiens
ggagucuugcucug

SEQ ID NO: 990528 - RNA, 15 nt, Homo sapiens
ggagugcagugccac

SEQ ID NO: 990529 - RNA, 20 nt, Homo sapiens
ggaguguccucuucccucuc

SEQ ID NO: 990530 - RNA, 16 nt, Homo sapiens
ggaucacaagauggaa

SEQ ID NO: 990531 - RNA, 22 nt, Homo sapiens
ggaucacucaccauucccagau

SEQ ID NO: 990532 - RNA, 19 nt, Homo sapiens
ggaucccacucuucuugca

SEQ ID NO: 990533 - RNA, 22 nt, Homo sapiens
ggaucucaccaggcagccucug

SEQ ID NO: 990534 - RNA, 21 nt, Homo sapiens
ggaucucuccugaacucccac

SEQ ID NO: 990535 - RNA, 18 nt, Homo sapiens
ggauggacaucuugucau

SEQ ID NO: 990536 - RNA, 15 nt, Homo sapiens
ggaugggcauggugu

SEQ ID NO: 990537 - RNA, 16 nt, Homo sapiens
ggauuacaggcuugag

SEQ ID NO: 990538 - RNA, 20 nt, Homo sapiens
ggauuacagguguaagccac

SEQ ID NO: 990539 - RNA, 23 nt, Homo sapiens
ggauuagaaauaaagcaucucau

SEQ ID NO: 990540 - RNA, 19 nt, Homo sapiens
ggauuaugggucacaggaa

SEQ ID NO: 990541 - RNA, 20 nt, Homo sapiens
ggauuauucugggggcugca

SEQ ID NO: 990542 - RNA, 14 nt, Homo sapiens
ggauucaggaaaag

SEQ ID NO: 990543 - RNA, 19 nt, Homo sapiens
ggauucuguacaugcauug

SEQ ID NO: 990544 - RNA, 15 nt, Homo sapiens
ggcaaagccuaguga

SEQ ID NO: 990545 - RNA, 12 nt, Homo sapiens
ggcaacaaaaga

SEQ ID NO: 990546 - RNA, 20 nt, Homo sapiens
ggcaacacagugagacuuca

SEQ ID NO: 990547 - RNA, 11 nt, Homo sapiens
ggcacauuccc

SEQ ID NO: 990548 - RNA, 17 nt, Homo sapiens
ggcacauuccccuugcc

SEQ ID NO: 990549 - RNA, 17 nt, Homo sapiens
ggcagcagagcauucag

SEQ ID NO: 990550 - RNA, 15 nt, Homo sapiens
ggcaggcugggccau

SEQ ID NO: 990551 - RNA, 21 nt, Homo sapiens
ggcaggggcccgcgaugugga

SEQ ID NO: 990552 - RNA, 17 nt, Homo sapiens
ggcauagcucuggggug

SEQ ID NO: 990553 - RNA, 15 nt, Homo sapiens
ggcaucugacaugca

SEQ ID NO: 990554 - RNA, 12 nt, Homo sapiens
ggccaacaaaga

SEQ ID NO: 990555 - RNA, 12 nt, Homo sapiens
ggccaaugucag

SEQ ID NO: 990556 - RNA, 16 nt, Homo sapiens
ggccagagccaagggg

SEQ ID NO: 990557 - RNA, 15 nt, Homo sapiens
ggccagcacuuccau

SEQ ID NO: 990558 - RNA, 23 nt, Homo sapiens
ggccagccuccggcggggaccca

SEQ ID NO: 990559 - RNA, 23 nt, Homo sapiens
ggccaggaggugccacuggagug

SEQ ID NO: 990560 - RNA, 23 nt, Homo sapiens
ggccaugauggcaacagaucugg

SEQ ID NO: 990561 - RNA, 18 nt, Homo sapiens
ggcccaggucagccacug

SEQ ID NO: 990562 - RNA, 18 nt, Homo sapiens
ggcccaguucacccugau

SEQ ID NO: 990563 - RNA, 19 nt, Homo sapiens
ggcccaugaacacagagag

SEQ ID NO: 990564 - RNA, 15 nt, Homo sapiens
ggcccauggcauuuu

SEQ ID NO: 990565 - RNA, 21 nt, Homo sapiens
ggccccgugaggcaaugggag

SEQ ID NO: 990566 - RNA, 18 nt, Homo sapiens
ggccccucuccccaggga

SEQ ID NO: 990567 - RNA, 21 nt, Homo sapiens
ggcccuuggcgggcacgggug

SEQ ID NO: 990568 - RNA, 20 nt, Homo sapiens
ggcccuuucggauccaggga

SEQ ID NO: 990569 - RNA, 20 nt, Homo sapiens
ggccuaagggccacauccca

SEQ ID NO: 990570 - RNA, 11 nt, Homo sapiens
ggccucaggug

SEQ ID NO: 990571 - RNA, 14 nt, Homo sapiens
ggccugcuccagac

SEQ ID NO: 990572 - RNA, 17 nt, Homo sapiens
ggccugcugcugagaac

SEQ ID NO: 990573 - RNA, 19 nt, Homo sapiens
ggccuuacuuaaacccagc

SEQ ID NO: 990574 - RNA, 21 nt, Homo sapiens
ggcgaccuccuuucaucacac

SEQ ID NO: 990575 - RNA, 12 nt, Homo sapiens
ggcgugaucuug

SEQ ID NO: 990576 - RNA, 13 nt, Homo sapiens
ggcguuacugcuu

SEQ ID NO: 990577 - RNA, 17 nt, Homo sapiens
ggcucacucagcacuug

SEQ ID NO: 990578 - RNA, 20 nt, Homo sapiens
ggcucagucgcuagcauuuc

SEQ ID NO: 990579 - RNA, 21 nt, Homo sapiens
ggcucccagggacaccuggga

SEQ ID NO: 990580 - RNA, 19 nt, Homo sapiens
ggcuccggaggacucacca

SEQ ID NO: 990581 - RNA, 18 nt, Homo sapiens
ggcuccucugcuucucac

SEQ ID NO: 990582 - RNA, 19 nt, Homo sapiens
uacuaacauuuucauugau

SEQ ID NO: 990583 - RNA, 17 nt, Homo sapiens
uacuagagcaagcagga

SEQ ID NO: 990584 - RNA, 23 nt, Homo sapiens
uacucagauaagguaaaaugcca

SEQ ID NO: 990585 - RNA, 21 nt, Homo sapiens
uacucagguuaaugcugaaaa

SEQ ID NO: 990586 - RNA, 16 nt, Homo sapiens
uacuccuaugaucuga

SEQ ID NO: 990587 - RNA, 13 nt, Homo sapiens
uacugcaaaucag

SEQ ID NO: 990588 - RNA, 21 nt, Homo sapiens
uacugcaagguucaacuuauu

SEQ ID NO: 990589 - RNA, 16 nt, Homo sapiens
uacugcaauguaaaua

SEQ ID NO: 990590 - RNA, 18 nt, Homo sapiens
uacugcuugaccaaagag

SEQ ID NO: 990591 - RNA, 15 nt, Homo sapiens
uacuguaugccuuca

SEQ ID NO: 990592 - RNA, 18 nt, Homo sapiens
uacuguugcacguguguu

SEQ ID NO: 990593 - RNA, 13 nt, Homo sapiens
uacuuaaacccag

SEQ ID NO: 990594 - RNA, 17 nt, Homo sapiens
uacuucggggcugggaa

SEQ ID NO: 990595 - RNA, 18 nt, Homo sapiens
uacuucggggcugggaag

SEQ ID NO: 990596 - RNA, 21 nt, Homo sapiens
uacuuuacuaauaaacugugu

SEQ ID NO: 990597 - RNA, 20 nt, Homo sapiens
uacuuugugaauagaacucu

SEQ ID NO: 990598 - RNA, 15 nt, Homo sapiens
uacuuugugcauucu

SEQ ID NO: 990599 - RNA, 15 nt, Homo sapiens
uacuuuuacucugcc

SEQ ID NO: 990600 - RNA, 19 nt, Homo sapiens
uagaaaaaaaaauucacau

SEQ ID NO: 990601 - RNA, 21 nt, Homo sapiens
uagaaaaaaaaauucacauga

SEQ ID NO: 990602 - RNA, 18 nt, Homo sapiens
uagaaaaguauguucuaa

SEQ ID NO: 990603 - RNA, 24 nt, Homo sapiens
uagaaacaacacuguaguaaauaa

SEQ ID NO: 990604 - RNA, 18 nt, Homo sapiens
uagaauuauaacuguaaa

SEQ ID NO: 990605 - RNA, 12 nt, Homo sapiens
uagaauugcauu

SEQ ID NO: 990606 - RNA, 18 nt, Homo sapiens
uagacaaauagaaaaugg

SEQ ID NO: 990607 - RNA, 12 nt, Homo sapiens
uagacacaugaa

SEQ ID NO: 990608 - RNA, 13 nt, Homo sapiens
uagaccacugcca

SEQ ID NO: 990609 - RNA, 14 nt, Homo sapiens
uagaccacugccau

SEQ ID NO: 990610 - RNA, 20 nt, Homo sapiens
uagacuuuaaagaauaaagu

SEQ ID NO: 990611 - RNA, 18 nt, Homo sapiens
uagagauuaccuccugag

SEQ ID NO: 990612 - RNA, 19 nt, Homo sapiens
uagagcucuacugccucaa

SEQ ID NO: 990613 - RNA, 21 nt, Homo sapiens
uagaguuuacuauuuuagcag

SEQ ID NO: 990614 - RNA, 21 nt, Homo sapiens
uagaucucccauguguaggua

SEQ ID NO: 990615 - RNA, 23 nt, Homo sapiens
uagaugauaaagagacagugaua

SEQ ID NO: 990616 - RNA, 22 nt, Homo sapiens
uagaugauuucaguucuaggaa

SEQ ID NO: 990617 - RNA, 19 nt, Homo sapiens
uagauucagguaauacaaa

SEQ ID NO: 990618 - RNA, 20 nt, Homo sapiens
uagauuguccuuuugcaaag

SEQ ID NO: 990619 - RNA, 20 nt, Homo sapiens
uagauuugugugcaucaggc

SEQ ID NO: 990620 - RNA, 13 nt, Homo sapiens
uagcaaaagaaga

SEQ ID NO: 990621 - RNA, 22 nt, Homo sapiens
uagcagcaccguucugugcaca

SEQ ID NO: 990622 - RNA, 13 nt, Homo sapiens
uagcagucacuga

SEQ ID NO: 990623 - RNA, 23 nt, Homo sapiens
uagcccaucaagcuccugcccug

SEQ ID NO: 990624 - RNA, 21 nt, Homo sapiens
uagccucaggggucugagcuc

SEQ ID NO: 990625 - RNA, 22 nt, Homo sapiens
uagcgcuaucucccugccuccu

SEQ ID NO: 990626 - RNA, 19 nt, Homo sapiens
uagcuaaacggauuccaaa

SEQ ID NO: 990627 - RNA, 14 nt, Homo sapiens
uagcuaauaacaug

SEQ ID NO: 990628 - RNA, 13 nt, Homo sapiens
uagcuacagagaa

SEQ ID NO: 990629 - RNA, 12 nt, Homo sapiens
uagcugagcuca

SEQ ID NO: 990630 - RNA, 14 nt, Homo sapiens
uagcugagcucaca

SEQ ID NO: 990631 - RNA, 16 nt, Homo sapiens
uagcugggacuacagg

SEQ ID NO: 990632 - RNA, 21 nt, Homo sapiens
uagcuuagcuaugucagccaa

SEQ ID NO: 990633 - RNA, 21 nt, Homo sapiens
uagcuugauguuggaucucaa

SEQ ID NO: 990634 - RNA, 19 nt, Homo sapiens
uagcuuuagaaacagugca

SEQ ID NO: 990635 - RNA, 19 nt, Homo sapiens
uaggaaaucuagaaguagu

SEQ ID NO: 990636 - RNA, 18 nt, Homo sapiens
uaggagaagggucucaug

SEQ ID NO: 990637 - RNA, 15 nt, Homo sapiens
uaggagcaaagccug

SEQ ID NO: 990638 - RNA, 21 nt, Homo sapiens
uaggcaugguggacucgccug

SEQ ID NO: 990639 - RNA, 21 nt, Homo sapiens
uaggcauguagcuacaggaca

SEQ ID NO: 990640 - RNA, 17 nt, Homo sapiens
uaggcgcuguucuugcu

SEQ ID NO: 990641 - RNA, 19 nt, Homo sapiens
uaggcuacagagaagccuu

SEQ ID NO: 990642 - RNA, 23 nt, Homo sapiens
uagggggagcaaaucgugccuug

SEQ ID NO: 990643 - RNA, 16 nt, Homo sapiens
uaggugcuauuuguca

SEQ ID NO: 990644 - RNA, 19 nt, Homo sapiens
uagucuuaacuggucuccu

SEQ ID NO: 990645 - RNA, 15 nt, Homo sapiens
uagugaaaugccaca

SEQ ID NO: 990646 - RNA, 17 nt, Homo sapiens
uagugaauacugcuaca

SEQ ID NO: 990647 - RNA, 14 nt, Homo sapiens
uagugauggagcuu

SEQ ID NO: 990648 - RNA, 20 nt, Homo sapiens
uagugcauuaguggggagga

SEQ ID NO: 990649 - RNA, 14 nt, Homo sapiens
uagugucauccuca

SEQ ID NO: 990650 - RNA, 20 nt, Homo sapiens
uagugucauccucacaguga

SEQ ID NO: 990651 - RNA, 18 nt, Homo sapiens
uaguuaccuuauaguuac

SEQ ID NO: 990652 - RNA, 17 nt, Homo sapiens
uaguuauauauggggau

SEQ ID NO: 990653 - RNA, 18 nt, Homo sapiens
uaguucacauacaaauca

SEQ ID NO: 990654 - RNA, 13 nt, Homo sapiens
uaguucuaccuca

SEQ ID NO: 990655 - RNA, 23 nt, Homo sapiens
uaguucuagaaaaacaggcacuu

SEQ ID NO: 990656 - RNA, 15 nt, Homo sapiens
uaguucuucauccca

SEQ ID NO: 990657 - RNA, 13 nt, Homo sapiens
uaguuugugcugu

SEQ ID NO: 990658 - RNA, 12 nt, Homo sapiens
uauaaagcagua

SEQ ID NO: 990659 - RNA, 23 nt, Homo sapiens
uauaaagcaguauuuuucuugac

SEQ ID NO: 990660 - RNA, 15 nt, Homo sapiens
uauaaauacugcaaa

SEQ ID NO: 990661 - RNA, 12 nt, Homo sapiens
uauaacaguguu

SEQ ID NO: 990662 - RNA, 13 nt, Homo sapiens
uauaacaguguuu

SEQ ID NO: 990663 - RNA, 14 nt, Homo sapiens
uauaacuaacaugu

SEQ ID NO: 990664 - RNA, 16 nt, Homo sapiens
uauaagcaucugccau

SEQ ID NO: 990665 - RNA, 13 nt, Homo sapiens
uauaaucauauca

SEQ ID NO: 990666 - RNA, 19 nt, Homo sapiens
uauaauuuagacuuggauu

SEQ ID NO: 990667 - RNA, 16 nt, Homo sapiens
uauacaauacagauca

SEQ ID NO: 990668 - RNA, 13 nt, Homo sapiens
uauacagcuguau

SEQ ID NO: 990669 - RNA, 16 nt, Homo sapiens
uauacugcuuggagcu

SEQ ID NO: 990670 - RNA, 20 nt, Homo sapiens
uauacuucucuauuaucuca

SEQ ID NO: 990671 - RNA, 13 nt, Homo sapiens
uauagccucuguc

SEQ ID NO: 990672 - RNA, 20 nt, Homo sapiens
uauagcuaauaacaugugaa

SEQ ID NO: 990673 - RNA, 19 nt, Homo sapiens
uauaggucucaucucuuca

SEQ ID NO: 990674 - RNA, 16 nt, Homo sapiens
uauaguuucugaggcu

SEQ ID NO: 990675 - RNA, 17 nt, Homo sapiens
uauauaaagccucacau

SEQ ID NO: 990676 - RNA, 14 nt, Homo sapiens
uauaucgaucucuu

SEQ ID NO: 990677 - RNA, 14 nt, Homo sapiens
uauaucuaccccag

SEQ ID NO: 990678 - RNA, 11 nt, Homo sapiens
uauaugcacuu

SEQ ID NO: 990679 - RNA, 20 nt, Homo sapiens
uauaugugauuuacauuuca

SEQ ID NO: 990680 - RNA, 18 nt, Homo sapiens
uauauuugggccugcucc

SEQ ID NO: 990681 - RNA, 21 nt, Homo sapiens
uaucaaacccuagccuugcuu

SEQ ID NO: 990682 - RNA, 12 nt, Homo sapiens
uaucacaaucuc

SEQ ID NO: 990683 - RNA, 14 nt, Homo sapiens
uaucacacaaagca

SEQ ID NO: 990684 - RNA, 14 nt, Homo sapiens
uaucagucauaacu

SEQ ID NO: 990685 - RNA, 12 nt, Homo sapiens
uaucuacuacaa

SEQ ID NO: 990686 - RNA, 19 nt, Homo sapiens
ucggcaggacacccugaua

SEQ ID NO: 990687 - RNA, 16 nt, Homo sapiens
ucggccccagcacaug

SEQ ID NO: 990688 - RNA, 20 nt, Homo sapiens
ucggcuccccauguguccug

SEQ ID NO: 990689 - RNA, 18 nt, Homo sapiens
ucguaguguuaaguuaua

SEQ ID NO: 990690 - RNA, 13 nt, Homo sapiens
ucguucccagugu

SEQ ID NO: 990691 - RNA, 18 nt, Homo sapiens
ucguuuuuuucauuccau

SEQ ID NO: 990692 - RNA, 20 nt, Homo sapiens
ucuaaaaggugugaagguga

SEQ ID NO: 990693 - RNA, 15 nt, Homo sapiens
ucuaaaggaaaucaa

SEQ ID NO: 990694 - RNA, 20 nt, Homo sapiens
ucuaagaucuuagauucucu

SEQ ID NO: 990695 - RNA, 14 nt, Homo sapiens
ucuaagauucuaau

SEQ ID NO: 990696 - RNA, 14 nt, Homo sapiens
ucuaagauucugau

SEQ ID NO: 990697 - RNA, 21 nt, Homo sapiens
ucuaaggccuaggauucuaaa

SEQ ID NO: 990698 - RNA, 14 nt, Homo sapiens
ucuaaguaaauaca

SEQ ID NO: 990699 - RNA, 14 nt, Homo sapiens
ucuaagucuuucca

SEQ ID NO: 990700 - RNA, 13 nt, Homo sapiens
ucuaauacauucc

SEQ ID NO: 990701 - RNA, 16 nt, Homo sapiens
ucuaauuauguagcuc

SEQ ID NO: 990702 - RNA, 20 nt, Homo sapiens
ucuacacagauggaaucucu

SEQ ID NO: 990703 - RNA, 21 nt, Homo sapiens
ucuacacagauggaaucucuu

SEQ ID NO: 990704 - RNA, 19 nt, Homo sapiens
ucuacagagcuucccugac

SEQ ID NO: 990705 - RNA, 13 nt, Homo sapiens
ucuacagccucag

SEQ ID NO: 990706 - RNA, 21 nt, Homo sapiens
ucuacagccucagaaaccaga

SEQ ID NO: 990707 - RNA, 10 nt, Homo sapiens
ucuaccccag

SEQ ID NO: 990708 - RNA, 16 nt, Homo sapiens
ucuagagcacugccac

SEQ ID NO: 990709 - RNA, 16 nt, Homo sapiens
ucuagagcagggauua

SEQ ID NO: 990710 - RNA, 12 nt, Homo sapiens
ucuagauucaaa

SEQ ID NO: 990711 - RNA, 12 nt, Homo sapiens
ucuauuacauuu

SEQ ID NO: 990712 - RNA, 21 nt, Homo sapiens
ucuauuucacuggagcacaau

SEQ ID NO: 990713 - RNA, 19 nt, Homo sapiens
ucuauuucuccuccauggg

SEQ ID NO: 990714 - RNA, 22 nt, Homo sapiens
ucuauuuggggcuugaugacuu

SEQ ID NO: 990715 - RNA, 23 nt, Homo sapiens
ucucaaaacagagggcugcauuc

SEQ ID NO: 990716 - RNA, 20 nt, Homo sapiens
ucucaaacuccugaccucag

SEQ ID NO: 990717 - RNA, 19 nt, Homo sapiens
ucucaagcucuuccuuacu

SEQ ID NO: 990718 - RNA, 14 nt, Homo sapiens
ucucaccucuaggu

SEQ ID NO: 990719 - RNA, 14 nt, Homo sapiens
ucucacuugucuca

SEQ ID NO: 990720 - RNA, 18 nt, Homo sapiens
ucucacuugugcaguguu

SEQ ID NO: 990721 - RNA, 17 nt, Homo sapiens
ucucagcuccaauuuca

SEQ ID NO: 990722 - RNA, 20 nt, Homo sapiens
ucucaggaccaaagcuuuca

SEQ ID NO: 990723 - RNA, 18 nt, Homo sapiens
ucucagguguugccaaau

SEQ ID NO: 990724 - RNA, 20 nt, Homo sapiens
ucucaguaccccauggagcu

SEQ ID NO: 990725 - RNA, 19 nt, Homo sapiens
ucucauggguggcacucag

SEQ ID NO: 990726 - RNA, 10 nt, Homo sapiens
ucucauuucu

SEQ ID NO: 990727 - RNA, 19 nt, Homo sapiens
ucuccagcggcccugucau

SEQ ID NO: 990728 - RNA, 13 nt, Homo sapiens
ucuccaguggauu

SEQ ID NO: 990729 - RNA, 18 nt, Homo sapiens
ucucccauuuuggaauuu

SEQ ID NO: 990730 - RNA, 17 nt, Homo sapiens
ucuccccugcacuguaa

SEQ ID NO: 990731 - RNA, 19 nt, Homo sapiens
ucucccuggaucagaacag

SEQ ID NO: 990732 - RNA, 22 nt, Homo sapiens
ucucccuggugcuuaugcucuu

SEQ ID NO: 990733 - RNA, 22 nt, Homo sapiens
ucucccuguacaguguuaccau

SEQ ID NO: 990734 - RNA, 19 nt, Homo sapiens
ucucccuugggcucugaug

SEQ ID NO: 990735 - RNA, 14 nt, Homo sapiens
ucuccuaagcaccu

SEQ ID NO: 990736 - RNA, 15 nt, Homo sapiens
ucuccugaacuccca

SEQ ID NO: 990737 - RNA, 12 nt, Homo sapiens
ucucgcuuuguu

SEQ ID NO: 990738 - RNA, 20 nt, Homo sapiens
ucucucggcuccccaugugu

SEQ ID NO: 990739 - RNA, 13 nt, Homo sapiens
ucucucuuuauac

SEQ ID NO: 990740 - RNA, 15 nt, Homo sapiens
ucucugccagugaca

SEQ ID NO: 990741 - RNA, 20 nt, Homo sapiens
ucucuggcuguaaggcucua

SEQ ID NO: 990742 - RNA, 22 nt, Homo sapiens
ucucugggaaucaacagcauau

SEQ ID NO: 990743 - RNA, 13 nt, Homo sapiens
ucucugguaauau

SEQ ID NO: 990744 - RNA, 22 nt, Homo sapiens
ucucuuacaaucuguuuuagac

SEQ ID NO: 990745 - RNA, 14 nt, Homo sapiens
ucucuuugccucaa

SEQ ID NO: 990746 - RNA, 16 nt, Homo sapiens
ucucuuugcuucacag

SEQ ID NO: 990747 - RNA, 21 nt, Homo sapiens
ucugaaggagccccauuccug

SEQ ID NO: 990748 - RNA, 14 nt, Homo sapiens
ucugaauugcacau

SEQ ID NO: 990749 - RNA, 17 nt, Homo sapiens
ucugacucagggcuccu

SEQ ID NO: 990750 - RNA, 18 nt, Homo sapiens
ucugagggcccguguaaa

SEQ ID NO: 990751 - RNA, 18 nt, Homo sapiens
ucugauaaaagauggcca

SEQ ID NO: 990752 - RNA, 22 nt, Homo sapiens
ucugauaagagaaucaacauuu

SEQ ID NO: 990753 - RNA, 22 nt, Homo sapiens
ucugauuuguaacccacugaga

SEQ ID NO: 990754 - RNA, 21 nt, Homo sapiens
ucugcaagcacaucugcauuu

SEQ ID NO: 990755 - RNA, 23 nt, Homo sapiens
ucugcacuuauaagaaagaucaa

SEQ ID NO: 990756 - RNA, 17 nt, Homo sapiens
ucugcagaaacuacuga

SEQ ID NO: 990757 - RNA, 18 nt, Homo sapiens
ucugcaggcuucagccau

SEQ ID NO: 990758 - RNA, 19 nt, Homo sapiens
ucugcauggaacagcauua

SEQ ID NO: 990759 - RNA, 20 nt, Homo sapiens
ucugccaaaggaugugauau

SEQ ID NO: 990760 - RNA, 20 nt, Homo sapiens
ucugcuccccuaaagccuca

SEQ ID NO: 990761 - RNA, 18 nt, Homo sapiens
ucugcuguuccaguggua

SEQ ID NO: 990762 - RNA, 18 nt, Homo sapiens
ucuggaacccagacucag

SEQ ID NO: 990763 - RNA, 13 nt, Homo sapiens
ucuggaaccucag

SEQ ID NO: 990764 - RNA, 13 nt, Homo sapiens
ucuggaaguccaa

SEQ ID NO: 990765 - RNA, 14 nt, Homo sapiens
ucuggauaacaaga

SEQ ID NO: 990766 - RNA, 20 nt, Homo sapiens
ucuggauaccauuauauguu

SEQ ID NO: 990767 - RNA, 20 nt, Homo sapiens
ucuggcagccucccauccag

SEQ ID NO: 990768 - RNA, 20 nt, Homo sapiens
ucuggccuugaaaccaccuu

SEQ ID NO: 990769 - RNA, 18 nt, Homo sapiens
ucuggcucuaauucacag

SEQ ID NO: 990770 - RNA, 23 nt, Homo sapiens
ucuggcugcaacuuaaugcucug

SEQ ID NO: 990771 - RNA, 15 nt, Homo sapiens
ucugggagucacaca

SEQ ID NO: 990772 - RNA, 14 nt, Homo sapiens
ucugggcucugagu

SEQ ID NO: 990773 - RNA, 15 nt, Homo sapiens
ucugggcucugagua

SEQ ID NO: 990774 - RNA, 17 nt, Homo sapiens
ucuggggagcucaggaa

SEQ ID NO: 990775 - RNA, 23 nt, Homo sapiens
ucuggguggcucacucagcacuu

SEQ ID NO: 990776 - RNA, 16 nt, Homo sapiens
ucuggucgcuccugcc

SEQ ID NO: 990777 - RNA, 16 nt, Homo sapiens
ucuguaaaucuacaca

SEQ ID NO: 990778 - RNA, 20 nt, Homo sapiens
ucuguccugcccccaaggag

SEQ ID NO: 990779 - RNA, 18 nt, Homo sapiens
ucuguccuuuaugauccc

SEQ ID NO: 990780 - RNA, 21 nt, Homo sapiens
ucuguggaucagagaugcacc

SEQ ID NO: 990781 - RNA, 13 nt, Homo sapiens
ucuguguuuacag

SEQ ID NO: 990782 - RNA, 20 nt, Homo sapiens
ucuuacuacagcuucaguga

SEQ ID NO: 990783 - RNA, 14 nt, Homo sapiens
ucuuagugugccaa

SEQ ID NO: 990784 - RNA, 19 nt, Homo sapiens
ucuuaugcuguacccaguu

SEQ ID NO: 990785 - RNA, 18 nt, Homo sapiens
ucuucaagacgacagcuc

SEQ ID NO: 990786 - RNA, 15 nt, Homo sapiens
ucuucacaccuaccc

SEQ ID NO: 990787 - RNA, 24 nt, Homo sapiens
ucuucaccauuuggcaaugccauc

SEQ ID NO: 990788 - RNA, 19 nt, Homo sapiens
ucuucagguucucaugaua

SEQ ID NO: 990789 - RNA, 16 nt, Homo sapiens
ucuucccccucuccca

SEQ ID NO: 990790 - RNA, 21 nt, Homo sapiens
ugaggccacccagaggcagca

SEQ ID NO: 990791 - RNA, 16 nt, Homo sapiens
ugagggaagacgccuu

SEQ ID NO: 990792 - RNA, 15 nt, Homo sapiens
ugaggguuaaugaaa

SEQ ID NO: 990793 - RNA, 19 nt, Homo sapiens
ugaguaaugguguagaaca

SEQ ID NO: 990794 - RNA, 17 nt, Homo sapiens
ugagucccuguccccac

SEQ ID NO: 990795 - RNA, 14 nt, Homo sapiens
ugagucugugccac

SEQ ID NO: 990796 - RNA, 22 nt, Homo sapiens
ugaguggaguugaggugucaga

SEQ ID NO: 990797 - RNA, 19 nt, Homo sapiens
ugaguugcuuuucagcuga

SEQ ID NO: 990798 - RNA, 17 nt, Homo sapiens
ugauacuucgacacugu

SEQ ID NO: 990799 - RNA, 18 nt, Homo sapiens
ugauacuuugacaguguu

SEQ ID NO: 990800 - RNA, 20 nt, Homo sapiens
ugauagaaccauugcaauau

SEQ ID NO: 990801 - RNA, 16 nt, Homo sapiens
ugauagaguguuauca

SEQ ID NO: 990802 - RNA, 19 nt, Homo sapiens
ugauauaucaugagugaau

SEQ ID NO: 990803 - RNA, 12 nt, Homo sapiens
ugauaugcauau

SEQ ID NO: 990804 - RNA, 15 nt, Homo sapiens
ugauauugcagcuua

SEQ ID NO: 990805 - RNA, 20 nt, Homo sapiens
ugauccuggaggcccaguuc

SEQ ID NO: 990806 - RNA, 17 nt, Homo sapiens
ugaucugucuguggcaa

SEQ ID NO: 990807 - RNA, 19 nt, Homo sapiens
ugaugcuuagauguuccag

SEQ ID NO: 990808 - RNA, 19 nt, Homo sapiens
ugaugucuccuaagcaccu

SEQ ID NO: 990809 - RNA, 20 nt, Homo sapiens
ugaugugagcuuggacuugc

SEQ ID NO: 990810 - RNA, 14 nt, Homo sapiens
ugauguucuaaggc

SEQ ID NO: 990811 - RNA, 24 nt, Homo sapiens
ugauuagaaauuaccuguggauau

SEQ ID NO: 990812 - RNA, 20 nt, Homo sapiens
ugauuagacagaacaccuau

SEQ ID NO: 990813 - RNA, 17 nt, Homo sapiens
ugauuguggaauggaga

SEQ ID NO: 990814 - RNA, 18 nt, Homo sapiens
ugauuuuuuuuauugccu

SEQ ID NO: 990815 - RNA, 18 nt, Homo sapiens
ugcaaaccauagcacagg

SEQ ID NO: 990816 - RNA, 21 nt, Homo sapiens
ugcaacacuggucugcuguuc

SEQ ID NO: 990817 - RNA, 21 nt, Homo sapiens
ugcaacucaaggacuuugcag

SEQ ID NO: 990818 - RNA, 20 nt, Homo sapiens
ugcaagguucaacuuauuaa

SEQ ID NO: 990819 - RNA, 12 nt, Homo sapiens
ugcaauguauua

SEQ ID NO: 990820 - RNA, 23 nt, Homo sapiens
ugcacaagaauggaucacaagau

SEQ ID NO: 990821 - RNA, 14 nt, Homo sapiens
ugcacaagcacuau

SEQ ID NO: 990822 - RNA, 13 nt, Homo sapiens
ugcacacauauac

SEQ ID NO: 990823 - RNA, 13 nt, Homo sapiens
ugcacacuuugcc

SEQ ID NO: 990824 - RNA, 20 nt, Homo sapiens
ugcacacuuugguaccagau

SEQ ID NO: 990825 - RNA, 20 nt, Homo sapiens
ugcacagucacugcucuuca

SEQ ID NO: 990826 - RNA, 17 nt, Homo sapiens
ugcaccaccaagccaag

SEQ ID NO: 990827 - RNA, 12 nt, Homo sapiens
ugcaccacugca

SEQ ID NO: 990828 - RNA, 15 nt, Homo sapiens
ugcaccaugcugcug

SEQ ID NO: 990829 - RNA, 14 nt, Homo sapiens
ugcacuaacagagu

SEQ ID NO: 990830 - RNA, 20 nt, Homo sapiens
ugcacuguaaaaugugggau

SEQ ID NO: 990831 - RNA, 15 nt, Homo sapiens
ugcagaaacagugca

SEQ ID NO: 990832 - RNA, 14 nt, Homo sapiens
ugcagaaacuacug

SEQ ID NO: 990833 - RNA, 15 nt, Homo sapiens
ugcagaauguugauu

SEQ ID NO: 990834 - RNA, 21 nt, Homo sapiens
ugcagagccacagcugugcau

SEQ ID NO: 990835 - RNA, 19 nt, Homo sapiens
ugcagcaagcaauaaacac

SEQ ID NO: 990836 - RNA, 17 nt, Homo sapiens
ugcagccuuugccuccc

SEQ ID NO: 990837 - RNA, 21 nt, Homo sapiens
ugcauaaaauagagugcauuu

SEQ ID NO: 990838 - RNA, 21 nt, Homo sapiens
ugcauacuuucccucauccau

SEQ ID NO: 990839 - RNA, 16 nt, Homo sapiens
ugcaugauaucuucaa

SEQ ID NO: 990840 - RNA, 17 nt, Homo sapiens
ugcauucuucugagcac

SEQ ID NO: 990841 - RNA, 13 nt, Homo sapiens
ugcauugagcucu

SEQ ID NO: 990842 - RNA, 15 nt, Homo sapiens
ugcauugagcucucu

SEQ ID NO: 990843 - RNA, 13 nt, Homo sapiens
ugcauuuauagca

SEQ ID NO: 990844 - RNA, 20 nt, Homo sapiens
ugccaaaauccaaggcaauu

SEQ ID NO: 990845 - RNA, 20 nt, Homo sapiens
ugccaauagugucauccuca

SEQ ID NO: 990846 - RNA, 14 nt, Homo sapiens
ugccaccuggaccc

SEQ ID NO: 990847 - RNA, 14 nt, Homo sapiens
ugccagaagcuacu

SEQ ID NO: 990848 - RNA, 19 nt, Homo sapiens
ugccagaagcuacugcgau

SEQ ID NO: 990849 - RNA, 22 nt, Homo sapiens
ugccaggaccagucccagagca

SEQ ID NO: 990850 - RNA, 19 nt, Homo sapiens
ugccagggccccucucccc

SEQ ID NO: 990851 - RNA, 21 nt, Homo sapiens
ugccaguuuccucuacugcaa

SEQ ID NO: 990852 - RNA, 20 nt, Homo sapiens
ugcccacagugucaggcacu

SEQ ID NO: 990853 - RNA, 23 nt, Homo sapiens
ugcccagaauaaguuauugcagu

SEQ ID NO: 990854 - RNA, 17 nt, Homo sapiens
ugcccaggguuuugccc

SEQ ID NO: 990855 - RNA, 18 nt, Homo sapiens
ugccccaaguccucauuu

SEQ ID NO: 990856 - RNA, 14 nt, Homo sapiens
ugccccucucacca

SEQ ID NO: 990857 - RNA, 20 nt, Homo sapiens
ugccccuuccgccacugggg

SEQ ID NO: 990858 - RNA, 15 nt, Homo sapiens
ugcccugaucccaga

SEQ ID NO: 990859 - RNA, 19 nt, Homo sapiens
ugcccuguaccugugcacg

SEQ ID NO: 990860 - RNA, 19 nt, Homo sapiens
ugccgccuccuugugcaca

SEQ ID NO: 990861 - RNA, 16 nt, Homo sapiens
ugccucagaagugcau

SEQ ID NO: 990862 - RNA, 12 nt, Homo sapiens
ugccucaugccu

SEQ ID NO: 990863 - RNA, 13 nt, Homo sapiens
ugccucaugccug

SEQ ID NO: 990864 - RNA, 15 nt, Homo sapiens
ugccucccugagcua

SEQ ID NO: 990865 - RNA, 20 nt, Homo sapiens
ugccucgcuccccacucugc

SEQ ID NO: 990866 - RNA, 14 nt, Homo sapiens
ugccugacuaggga

SEQ ID NO: 990867 - RNA, 14 nt, Homo sapiens
ugccugguacagua

SEQ ID NO: 990868 - RNA, 13 nt, Homo sapiens
ugccugugcuaca

SEQ ID NO: 990869 - RNA, 14 nt, Homo sapiens
ugccuuaucuugca

SEQ ID NO: 990870 - RNA, 16 nt, Homo sapiens
ugccuucaacacagcu

SEQ ID NO: 990871 - RNA, 13 nt, Homo sapiens
ugccuuugccagg

SEQ ID NO: 990872 - RNA, 16 nt, Homo sapiens
ugccuuugccagguga

SEQ ID NO: 990873 - RNA, 16 nt, Homo sapiens
ugccuuuugcaaccag

SEQ ID NO: 990874 - RNA, 17 nt, Homo sapiens
ugcgugcgagcacacac

SEQ ID NO: 990875 - RNA, 23 nt, Homo sapiens
ugcgugggugugugcguguuugg

SEQ ID NO: 990876 - RNA, 21 nt, Homo sapiens
ugcguguguguucacguguuc

SEQ ID NO: 990877 - RNA, 22 nt, Homo sapiens
ugcuaaaggaaaaaaccaucca

SEQ ID NO: 990878 - RNA, 21 nt, Homo sapiens
ugcuaaucagggaggucauuu

SEQ ID NO: 990879 - RNA, 14 nt, Homo sapiens
ugcuacaauucauu

SEQ ID NO: 990880 - RNA, 22 nt, Homo sapiens
ugcucaagccggaaacucggca

SEQ ID NO: 990881 - RNA, 18 nt, Homo sapiens
ugcucaaucccugaggac

SEQ ID NO: 990882 - RNA, 23 nt, Homo sapiens
ugcucagguacuuguaaauuauu

SEQ ID NO: 990883 - RNA, 20 nt, Homo sapiens
ugcucaggugcuggggccug

SEQ ID NO: 990884 - RNA, 17 nt, Homo sapiens
ugcucccugacagcacc

SEQ ID NO: 990885 - RNA, 19 nt, Homo sapiens
ugcuccuccuccuguauuc

SEQ ID NO: 990886 - RNA, 20 nt, Homo sapiens
ugcucuccauucugcuccuu

SEQ ID NO: 990887 - RNA, 21 nt, Homo sapiens
ugcucuuaauugccaccucua

SEQ ID NO: 990888 - RNA, 15 nt, Homo sapiens
ugcucuuguguuucc

SEQ ID NO: 990889 - RNA, 23 nt, Homo sapiens
ugcugaaaaaucauccaagacag

SEQ ID NO: 990890 - RNA, 20 nt, Homo sapiens
ugcugaaaaaugggcacuua

SEQ ID NO: 990891 - RNA, 22 nt, Homo sapiens
ugcugaguaacaggugccuucc

SEQ ID NO: 990892 - RNA, 17 nt, Homo sapiens
ugcugcaaauacuguau

SEQ ID NO: 990893 - RNA, 12 nt, Homo sapiens
ugcugccagcuu

SEQ ID NO: 990894 - RNA, 14 nt, Homo sapiens
uuucuaagauucua

SEQ ID NO: 990895 - RNA, 15 nt, Homo sapiens
uuucuagagcacugc

SEQ ID NO: 990896 - RNA, 17 nt, Homo sapiens
uuucuccuuuaauugua

SEQ ID NO: 990897 - RNA, 16 nt, Homo sapiens
uuucucugccagugac

SEQ ID NO: 990898 - RNA, 14 nt, Homo sapiens
uuucucuuacaauc

SEQ ID NO: 990899 - RNA, 20 nt, Homo sapiens
uuucugaggugcacugggag

SEQ ID NO: 990900 - RNA, 21 nt, Homo sapiens
uuucugauaaaagauggccau

SEQ ID NO: 990901 - RNA, 15 nt, Homo sapiens
uuucuucagagacag

SEQ ID NO: 990902 - RNA, 13 nt, Homo sapiens
uuucuugccucau

SEQ ID NO: 990903 - RNA, 17 nt, Homo sapiens
uuucuuucucacuaaau

SEQ ID NO: 990904 - RNA, 17 nt, Homo sapiens
uuugaauaaaugucacu

SEQ ID NO: 990905 - RNA, 15 nt, Homo sapiens
uuugaaucacaugaa

SEQ ID NO: 990906 - RNA, 12 nt, Homo sapiens
uuugagcccagg

SEQ ID NO: 990907 - RNA, 18 nt, Homo sapiens
uuugauccugggggacca

SEQ ID NO: 990908 - RNA, 15 nt, Homo sapiens
uuugauuauucagug

SEQ ID NO: 990909 - RNA, 13 nt, Homo sapiens
uuugcaaacguuc

SEQ ID NO: 990910 - RNA, 19 nt, Homo sapiens
uuugcauuaaauucacaaa

SEQ ID NO: 990911 - RNA, 23 nt, Homo sapiens
uuugccauauuuucaccauuuga

SEQ ID NO: 990912 - RNA, 23 nt, Homo sapiens
uuugcccccauucacuuugucag

SEQ ID NO: 990913 - RNA, 17 nt, Homo sapiens
uuugcuaaagacaugaa

SEQ ID NO: 990914 - RNA, 15 nt, Homo sapiens
uuugcucuuacuaca

SEQ ID NO: 990915 - RNA, 14 nt, Homo sapiens
uuugcuuagcucaa

SEQ ID NO: 990916 - RNA, 13 nt, Homo sapiens
uuuggaagcacug

SEQ ID NO: 990917 - RNA, 17 nt, Homo sapiens
uuuggaauauuguccau

SEQ ID NO: 990918 - RNA, 16 nt, Homo sapiens
uuuggacccaguucag

SEQ ID NO: 990919 - RNA, 19 nt, Homo sapiens
uuuggagaaaugcuuagaa

SEQ ID NO: 990920 - RNA, 19 nt, Homo sapiens
uuuggaguccccucaccuc

SEQ ID NO: 990921 - RNA, 15 nt, Homo sapiens
uuuggccuccuccag

SEQ ID NO: 990922 - RNA, 17 nt, Homo sapiens
uuuggguuuugggucuu

SEQ ID NO: 990923 - RNA, 15 nt, Homo sapiens
uuuggucacauauca

SEQ ID NO: 990924 - RNA, 18 nt, Homo sapiens
uuuggucgaggaguaaca

SEQ ID NO: 990925 - RNA, 11 nt, Homo sapiens
uuugguuuugc

SEQ ID NO: 990926 - RNA, 17 nt, Homo sapiens
uuuguaacccacugaga

SEQ ID NO: 990927 - RNA, 19 nt, Homo sapiens
uuuguaauaauaaagaaua

SEQ ID NO: 990928 - RNA, 19 nt, Homo sapiens
uuuguauaaaauagacaaa

SEQ ID NO: 990929 - RNA, 22 nt, Homo sapiens
uuuguccaucuugagaugguga

SEQ ID NO: 990930 - RNA, 22 nt, Homo sapiens
uuuuaaacugguuuuuugcaua

SEQ ID NO: 990931 - RNA, 21 nt, Homo sapiens
uuuuaauaacuuaucuauaaa

SEQ ID NO: 990932 - RNA, 20 nt, Homo sapiens
uuuuauaggcauaccuccua

SEQ ID NO: 990933 - RNA, 14 nt, Homo sapiens
uuuuauucuauauu

SEQ ID NO: 990934 - RNA, 18 nt, Homo sapiens
uuuucaaagguacuugga

SEQ ID NO: 990935 - RNA, 15 nt, Homo sapiens
uuuucaagagcuccu

SEQ ID NO: 990936 - RNA, 17 nt, Homo sapiens
uuuuccaacuuggcugc

SEQ ID NO: 990937 - RNA, 23 nt, Homo sapiens
uuuucggccccauguaucucagu

SEQ ID NO: 990938 - RNA, 13 nt, Homo sapiens
uuuucuucauuca

SEQ ID NO: 990939 - RNA, 12 nt, Homo sapiens
uuuugaaggcaa

SEQ ID NO: 990940 - RNA, 17 nt, Homo sapiens
uuuuguuggcauagcuc

SEQ ID NO: 990941 - RNA, 22 nt, Homo sapiens
uuuuuacuaaacucagaggcag

SEQ ID NO: 990942 - RNA, 17 nt, Homo sapiens
uuuuuauucuccuccuc

SEQ ID NO: 990943 - RNA, 14 nt, Homo sapiens
uuuuucaagagcuc

SEQ ID NO: 990944 - RNA, 20 nt, Homo sapiens
uuuuucaugcgaugacacuu

SEQ ID NO: 990945 - RNA, 18 nt, Homo sapiens
uuuuucuauuucacugga

SEQ ID NO: 990946 - RNA, 13 nt, Homo sapiens
uuuuucuccagcu

SEQ ID NO: 990947 - RNA, 21 nt, Homo sapiens
uuuuuuaggaagcaagcuuaa

SEQ ID NO: 990948 - RNA, 22 nt, Homo sapiens
acacuagacaagccagaacuug

SEQ ID NO: 990949 - RNA, 16 nt, Homo sapiens
acacugcacaauaacu

SEQ ID NO: 990950 - RNA, 21 nt, Homo sapiens
acacuggcguuacugcuugac

SEQ ID NO: 990951 - RNA, 12 nt, Homo sapiens
acagaaacugca

SEQ ID NO: 990952 - RNA, 15 nt, Homo sapiens
acagaaauuguauau

SEQ ID NO: 990953 - RNA, 16 nt, Homo sapiens
acagaacaccuaugca

SEQ ID NO: 990954 - RNA, 17 nt, Homo sapiens
acagaacaccuaugcaa

SEQ ID NO: 990955 - RNA, 12 nt, Homo sapiens
acagaaugagac

SEQ ID NO: 990956 - RNA, 16 nt, Homo sapiens
acagacauacauuucu

SEQ ID NO: 990957 - RNA, 14 nt, Homo sapiens
acagaccuccguuc

SEQ ID NO: 990958 - RNA, 12 nt, Homo sapiens
acagacgugugc

SEQ ID NO: 990959 - RNA, 16 nt, Homo sapiens
acagacuugaaugcua

SEQ ID NO: 990960 - RNA, 21 nt, Homo sapiens
acagagaagccaucaccucag

SEQ ID NO: 990961 - RNA, 16 nt, Homo sapiens
acagagcuucccugac

SEQ ID NO: 990962 - RNA, 18 nt, Homo sapiens
acagagggcucaccucuu

SEQ ID NO: 990963 - RNA, 17 nt, Homo sapiens
acagagugcauugugag

SEQ ID NO: 990964 - RNA, 17 nt, Homo sapiens
acagaucaucuuggaac

SEQ ID NO: 990965 - RNA, 18 nt, Homo sapiens
acagaucaucuuggaacu

SEQ ID NO: 990966 - RNA, 16 nt, Homo sapiens
acagaucuaucuccuc

SEQ ID NO: 990967 - RNA, 18 nt, Homo sapiens
acagaucuggaaccucag

SEQ ID NO: 990968 - RNA, 22 nt, Homo sapiens
acagauuuuuuuaacgagaaaa

SEQ ID NO: 990969 - RNA, 14 nt, Homo sapiens
acagcacagccaac

SEQ ID NO: 990970 - RNA, 21 nt, Homo sapiens
acagcacccuguggucuuccu

SEQ ID NO: 990971 - RNA, 22 nt, Homo sapiens
acagcagagcuagguggaaaag

SEQ ID NO: 990972 - RNA, 15 nt, Homo sapiens
acagccaagcaccuc

SEQ ID NO: 990973 - RNA, 18 nt, Homo sapiens
acagcccuuaugcgguua

SEQ ID NO: 990974 - RNA, 17 nt, Homo sapiens
acagcuacucuccccac

SEQ ID NO: 990975 - RNA, 23 nt, Homo sapiens
acagcuuuugcaacuuaauacuc

SEQ ID NO: 990976 - RNA, 22 nt, Homo sapiens
acaggaagccugcaguccugga

SEQ ID NO: 990977 - RNA, 13 nt, Homo sapiens
acaggcaccugcc

SEQ ID NO: 990978 - RNA, 23 nt, Homo sapiens
acaggcacuuggcagccuuguga

SEQ ID NO: 990979 - RNA, 21 nt, Homo sapiens
acaggcucuuagcagcuucca

SEQ ID NO: 990980 - RNA, 24 nt, Homo sapiens
acagggucugcucuuucucugcca

SEQ ID NO: 990981 - RNA, 16 nt, Homo sapiens
acaguagauuuuccaa

SEQ ID NO: 990982 - RNA, 14 nt, Homo sapiens
acaguauguucaaa

SEQ ID NO: 990983 - RNA, 22 nt, Homo sapiens
acagucaaaaccaagucacuua

SEQ ID NO: 990984 - RNA, 15 nt, Homo sapiens
acagucccuauggaa

SEQ ID NO: 990985 - RNA, 14 nt, Homo sapiens
acagugaacacuca

SEQ ID NO: 990986 - RNA, 17 nt, Homo sapiens
acagugcagugcgcugu

SEQ ID NO: 990987 - RNA, 17 nt, Homo sapiens
acagugccgacagcucu

SEQ ID NO: 990988 - RNA, 18 nt, Homo sapiens
acaguguucugugacaaa

SEQ ID NO: 990989 - RNA, 14 nt, Homo sapiens
acaguguugcccag

SEQ ID NO: 990990 - RNA, 18 nt, Homo sapiens
acaguguuggguguacca

SEQ ID NO: 990991 - RNA, 21 nt, Homo sapiens
acaguuauugcaagaguuuaa

SEQ ID NO: 990992 - RNA, 14 nt, Homo sapiens
acaguucugugguu

SEQ ID NO: 990993 - RNA, 17 nt, Homo sapiens
acaguucuuugggccag

SEQ ID NO: 990994 - RNA, 21 nt, Homo sapiens
acaguucuuugggccagacau

SEQ ID NO: 990995 - RNA, 14 nt, Homo sapiens
acaguuuuaacugu

SEQ ID NO: 990996 - RNA, 14 nt, Homo sapiens
acauacgugcacag

SEQ ID NO: 990997 - RNA, 13 nt, Homo sapiens
acaucucugggaa

SEQ ID NO: 990998 - RNA, 15 nt, Homo sapiens
acaucugcauuuuca

SEQ ID NO: 990999 - RNA, 22 nt, Homo sapiens
acaucuggccuugaaaccaccu

SEQ ID NO: 991000 - RNA, 15 nt, Homo sapiens
acaucuguauacccu

SEQ ID NO: 991001 - RNA, 23 nt, Homo sapiens
acaucuucugccuuagucucagu

SEQ ID NO: 991002 - RNA, 13 nt, Homo sapiens
acaucuuuuacau

SEQ ID NO: 991003 - RNA, 19 nt, Homo sapiens
acaugaaaggacccuguga

SEQ ID NO: 991004 - RNA, 17 nt, Homo sapiens
acaugaugcacuucaaa

SEQ ID NO: 991005 - RNA, 16 nt, Homo sapiens
acaugcauugagcucu

SEQ ID NO: 991006 - RNA, 17 nt, Homo sapiens
acaugcauugagcucuc

SEQ ID NO: 991007 - RNA, 19 nt, Homo sapiens
acaugccucugccaaagga

SEQ ID NO: 991008 - RNA, 16 nt, Homo sapiens
acaugcuucagugcug

SEQ ID NO: 991009 - RNA, 15 nt, Homo sapiens
acauguauugcacau

SEQ ID NO: 991010 - RNA, 16 nt, Homo sapiens
acaugucaaucugucc

SEQ ID NO: 991011 - RNA, 18 nt, Homo sapiens
acauuagaagacaauuga

SEQ ID NO: 991012 - RNA, 13 nt, Homo sapiens
acauuaugugguu

SEQ ID NO: 991013 - RNA, 23 nt, Homo sapiens
acauucugcaagcacaucugcau

SEQ ID NO: 991014 - RNA, 16 nt, Homo sapiens
acauugguucuuucau

SEQ ID NO: 991015 - RNA, 13 nt, Homo sapiens
acauuuccaugca

SEQ ID NO: 991016 - RNA, 16 nt, Homo sapiens
acauuucucaggcuag

SEQ ID NO: 991017 - RNA, 22 nt, Homo sapiens
acauuucucauaccuuccccac

SEQ ID NO: 991018 - RNA, 13 nt, Homo sapiens
accaaaaccacag

SEQ ID NO: 991019 - RNA, 19 nt, Homo sapiens
accaaagagaagcaaaauc

SEQ ID NO: 991020 - RNA, 18 nt, Homo sapiens
accaaagggagucugcca

SEQ ID NO: 991021 - RNA, 14 nt, Homo sapiens
accaaauaagacuu

SEQ ID NO: 991022 - RNA, 17 nt, Homo sapiens
accaagagauaacugua

SEQ ID NO: 991023 - RNA, 16 nt, Homo sapiens
accaagauuggccuga

SEQ ID NO: 991024 - RNA, 18 nt, Homo sapiens
accaagcacccuuccacu

SEQ ID NO: 991025 - RNA, 17 nt, Homo sapiens
accaaguaccaguauaa

SEQ ID NO: 991026 - RNA, 19 nt, Homo sapiens
accaauguacccaccgggc

SEQ ID NO: 991027 - RNA, 15 nt, Homo sapiens
accaauuuuuuacag

SEQ ID NO: 991028 - RNA, 16 nt, Homo sapiens
accacagcacagccaa

SEQ ID NO: 991029 - RNA, 14 nt, Homo sapiens
accaccaagccaag

SEQ ID NO: 991030 - RNA, 14 nt, Homo sapiens
accaccuaauccuu

SEQ ID NO: 991031 - RNA, 13 nt, Homo sapiens
accaccuuuuuga

SEQ ID NO: 991032 - RNA, 22 nt, Homo sapiens
accacgccucuugaccaggcug

SEQ ID NO: 991033 - RNA, 13 nt, Homo sapiens
accagacugcaau

SEQ ID NO: 991034 - RNA, 15 nt, Homo sapiens
accagcaguacucag

SEQ ID NO: 991035 - RNA, 19 nt, Homo sapiens
accaggauagagacuggaa

SEQ ID NO: 991036 - RNA, 16 nt, Homo sapiens
accaggccaccucccc

SEQ ID NO: 991037 - RNA, 13 nt, Homo sapiens
accaggcuacaag

SEQ ID NO: 991038 - RNA, 22 nt, Homo sapiens
accaggguccuuuugacacugc

SEQ ID NO: 991039 - RNA, 20 nt, Homo sapiens
accaggguugaccccagagg

SEQ ID NO: 991040 - RNA, 17 nt, Homo sapiens
accagguccaaugagcu

SEQ ID NO: 991041 - RNA, 23 nt, Homo sapiens
accagguccaaugagcuuucuga

SEQ ID NO: 991042 - RNA, 22 nt, Homo sapiens
accaguaucgcucauagaucag

SEQ ID NO: 991043 - RNA, 13 nt, Homo sapiens
accauaauguuac

SEQ ID NO: 991044 - RNA, 14 nt, Homo sapiens
accauaauguuaca

SEQ ID NO: 991045 - RNA, 14 nt, Homo sapiens
accaucauagcuca

SEQ ID NO: 991046 - RNA, 15 nt, Homo sapiens
accaucauagcucac

SEQ ID NO: 991047 - RNA, 14 nt, Homo sapiens
accaugcuucacaa

SEQ ID NO: 991048 - RNA, 21 nt, Homo sapiens
accauggaguggcagcccagc

SEQ ID NO: 991049 - RNA, 20 nt, Homo sapiens
accauuaaccagaucuaguc

SEQ ID NO: 991050 - RNA, 13 nt, Homo sapiens
accauuauaauga

SEQ ID NO: 991051 - RNA, 21 nt, Homo sapiens
accauuuuguuauugacuaac

SEQ ID NO: 991052 - RNA, 19 nt, Homo sapiens
acccaggauccccaaggca

SEQ ID NO: 991053 - RNA, 23 nt, Homo sapiens
acccagguuggcgacugcaacag

SEQ ID NO: 991054 - RNA, 22 nt, Homo sapiens
acccauuugggugggaguguug

SEQ ID NO: 991055 - RNA, 23 nt, Homo sapiens
accccaacuacuguguuaugcaa

SEQ ID NO: 991056 - RNA, 21 nt, Homo sapiens
accccacccacuucugcacuu

SEQ ID NO: 991057 - RNA, 19 nt, Homo sapiens
accccagguacauccauga

SEQ ID NO: 991058 - RNA, 20 nt, Homo sapiens
acccccacccccagcucaau

SEQ ID NO: 991059 - RNA, 14 nt, Homo sapiens
acccccagcucaau

SEQ ID NO: 991060 - RNA, 21 nt, Homo sapiens
accccggggugcccacaggcc

SEQ ID NO: 991061 - RNA, 14 nt, Homo sapiens
accccugcacaguu

SEQ ID NO: 991062 - RNA, 12 nt, Homo sapiens
accccugcauug

SEQ ID NO: 991063 - RNA, 13 nt, Homo sapiens
accccuuucccac

SEQ ID NO: 991064 - RNA, 21 nt, Homo sapiens
acccgagaaaacaaacccagg

SEQ ID NO: 991065 - RNA, 15 nt, Homo sapiens
acccgaggcugagaa

SEQ ID NO: 991066 - RNA, 13 nt, Homo sapiens
acccgauuccacc

SEQ ID NO: 991067 - RNA, 15 nt, Homo sapiens
acccuaaacauccau

SEQ ID NO: 991068 - RNA, 16 nt, Homo sapiens
acccuaaaucuugacu

SEQ ID NO: 991069 - RNA, 20 nt, Homo sapiens
acccuaguucuaccucaggc

SEQ ID NO: 991070 - RNA, 15 nt, Homo sapiens
acccucacaucagag

SEQ ID NO: 991071 - RNA, 19 nt, Homo sapiens
acccucauucuacugaaaa

SEQ ID NO: 991072 - RNA, 20 nt, Homo sapiens
acccuccuugggacugaagg

SEQ ID NO: 991073 - RNA, 13 nt, Homo sapiens
acccucucagcuc

SEQ ID NO: 991074 - RNA, 16 nt, Homo sapiens
acccugcccacuccca

SEQ ID NO: 991075 - RNA, 19 nt, Homo sapiens
acccugccuuaucuugcac

SEQ ID NO: 991076 - RNA, 18 nt, Homo sapiens
acccuggccuagaccagc

SEQ ID NO: 991077 - RNA, 21 nt, Homo sapiens
acccuggugggccaacaaaga

SEQ ID NO: 991078 - RNA, 21 nt, Homo sapiens
acccuguccucccgagcuccu

SEQ ID NO: 991079 - RNA, 21 nt, Homo sapiens
acccuguuccugcugcugucu

SEQ ID NO: 991080 - RNA, 18 nt, Homo sapiens
acccuucucccacucucc

SEQ ID NO: 991081 - RNA, 19 nt, Homo sapiens
acccuuguuuacacauacc

SEQ ID NO: 991082 - RNA, 15 nt, Homo sapiens
acccuuugcugugag

SEQ ID NO: 991083 - RNA, 13 nt, Homo sapiens
accgaagcccaga

SEQ ID NO: 991084 - RNA, 23 nt, Homo sapiens
accggaguuaugacaagcuuucc

SEQ ID NO: 991085 - RNA, 16 nt, Homo sapiens
accgugaccagugcug

SEQ ID NO: 991086 - RNA, 17 nt, Homo sapiens
accgugggcucccugac

SEQ ID NO: 991087 - RNA, 15 nt, Homo sapiens
accguucugugcaca

SEQ ID NO: 991088 - RNA, 14 nt, Homo sapiens
accuagacuguaaa

SEQ ID NO: 991089 - RNA, 15 nt, Homo sapiens
accucaccaacuccu

SEQ ID NO: 991090 - RNA, 16 nt, Homo sapiens
accucagccuggccag

SEQ ID NO: 991091 - RNA, 19 nt, Homo sapiens
accucagccuggccagaca

SEQ ID NO: 991092 - RNA, 22 nt, Homo sapiens
accucaguuuuaucauuuucaa

SEQ ID NO: 991093 - RNA, 14 nt, Homo sapiens
accucuacugccuu

SEQ ID NO: 991094 - RNA, 21 nt, Homo sapiens
accucuagguccccauacucc

SEQ ID NO: 991095 - RNA, 17 nt, Homo sapiens
accucuucuuucccucc

SEQ ID NO: 991096 - RNA, 22 nt, Homo sapiens
accugaaauaaaauucauuagu

SEQ ID NO: 991097 - RNA, 14 nt, Homo sapiens
accugaaauuccaa

SEQ ID NO: 991098 - RNA, 18 nt, Homo sapiens
accugcguuuucauuugu

SEQ ID NO: 991099 - RNA, 14 nt, Homo sapiens
accugcugugauac

SEQ ID NO: 991100 - RNA, 22 nt, Homo sapiens
accuggccccgccccuccuaca

SEQ ID NO: 991101 - RNA, 15 nt, Homo sapiens
accugugagcccagc

SEQ ID NO: 991102 - RNA, 20 nt, Homo sapiens
accuguguggacaggacuaa

SEQ ID NO: 991103 - RNA, 19 nt, Homo sapiens
accuguguuucuugccuca

SEQ ID NO: 991104 - RNA, 16 nt, Homo sapiens
accuguuagcagacag

SEQ ID NO: 991105 - RNA, 17 nt, Homo sapiens
accuuaaaccugcaaaa

SEQ ID NO: 991106 - RNA, 12 nt, Homo sapiens
accuuccucauc

SEQ ID NO: 991107 - RNA, 16 nt, Homo sapiens
accuuggcaccagaca

SEQ ID NO: 991108 - RNA, 17 nt, Homo sapiens
accuuggcaccagacac

SEQ ID NO: 991109 - RNA, 14 nt, Homo sapiens
accuugugccuugg

SEQ ID NO: 991110 - RNA, 22 nt, Homo sapiens
accuuuugaggagccccagcua

SEQ ID NO: 991111 - RNA, 17 nt, Homo sapiens
acgacugucuccauggc

SEQ ID NO: 991112 - RNA, 13 nt, Homo sapiens
acgauaaagggau

SEQ ID NO: 991113 - RNA, 14 nt, Homo sapiens
acgaugacaguguu

SEQ ID NO: 991114 - RNA, 23 nt, Homo sapiens
acgcaaguucccaguuggagcuc

SEQ ID NO: 991115 - RNA, 14 nt, Homo sapiens
acgcaccugccuca

SEQ ID NO: 991116 - RNA, 13 nt, Homo sapiens
acgcaugcagugu

SEQ ID NO: 991117 - RNA, 16 nt, Homo sapiens
acggaccaaagcaaga

SEQ ID NO: 991118 - RNA, 19 nt, Homo sapiens
acggcugcgcacugugucc

SEQ ID NO: 991119 - RNA, 13 nt, Homo sapiens
acggucaguccau

SEQ ID NO: 991120 - RNA, 18 nt, Homo sapiens
acggucaguccaugucuc

SEQ ID NO: 991121 - RNA, 19 nt, Homo sapiens
acguacccaggucugggug

SEQ ID NO: 991122 - RNA, 23 nt, Homo sapiens
acguauuugaauggccuucauau

SEQ ID NO: 991123 - RNA, 17 nt, Homo sapiens
acguggccucuugagca

SEQ ID NO: 991124 - RNA, 20 nt, Homo sapiens
acguggccucuugagcagug

SEQ ID NO: 991125 - RNA, 22 nt, Homo sapiens
acuaauagaauaaaggcaguuu

SEQ ID NO: 991126 - RNA, 21 nt, Homo sapiens
acuacaaccaauggaauguga

SEQ ID NO: 991127 - RNA, 15 nt, Homo sapiens
acuacuggcaauuug

SEQ ID NO: 991128 - RNA, 14 nt, Homo sapiens
acuacuguguuaug

SEQ ID NO: 991129 - RNA, 23 nt, Homo sapiens
acuagagucugaacagcuguaau

SEQ ID NO: 991130 - RNA, 21 nt, Homo sapiens
acuaggaucagaauaucacag

SEQ ID NO: 991131 - RNA, 15 nt, Homo sapiens
acuagggagccaugu

SEQ ID NO: 991132 - RNA, 18 nt, Homo sapiens
acuagggagccauuugag

SEQ ID NO: 991133 - RNA, 16 nt, Homo sapiens
acuauaucacaaucuc

SEQ ID NO: 991134 - RNA, 22 nt, Homo sapiens
acuauuaaaaagguuuacagaa

SEQ ID NO: 991135 - RNA, 22 nt, Homo sapiens
acuauucuaaugaaaacauuaa

SEQ ID NO: 991136 - RNA, 16 nt, Homo sapiens
acucaaaagaacaaga

SEQ ID NO: 991137 - RNA, 17 nt, Homo sapiens
acucaaccucuacaggg

SEQ ID NO: 991138 - RNA, 19 nt, Homo sapiens
acucaaccucuacaggguu

SEQ ID NO: 991139 - RNA, 17 nt, Homo sapiens
acucaaggcuugaguca

SEQ ID NO: 991140 - RNA, 18 nt, Homo sapiens
acucaaggcuugagucac

SEQ ID NO: 991141 - RNA, 15 nt, Homo sapiens
acucaccugcacuaa

SEQ ID NO: 991142 - RNA, 17 nt, Homo sapiens
acucaccugcacuaaca

SEQ ID NO: 991143 - RNA, 21 nt, Homo sapiens
acucacuuuucccacuccaag

SEQ ID NO: 991144 - RNA, 23 nt, Homo sapiens
acucauagcgggggccuaaaaaa

SEQ ID NO: 991145 - RNA, 18 nt, Homo sapiens
acucaugaagcauacccc

SEQ ID NO: 991146 - RNA, 22 nt, Homo sapiens
acuccaaacagaccccuguuca

SEQ ID NO: 991147 - RNA, 12 nt, Homo sapiens
acucccaggacc

SEQ ID NO: 991148 - RNA, 14 nt, Homo sapiens
acuccugccauagu

SEQ ID NO: 991149 - RNA, 21 nt, Homo sapiens
acucguauagcaugcaucugu

SEQ ID NO: 991150 - RNA, 22 nt, Homo sapiens
acucguucuucugggaacccug

SEQ ID NO: 991151 - RNA, 13 nt, Homo sapiens
acucuagauucca

SEQ ID NO: 991152 - RNA, 15 nt, Homo sapiens
acucuagucaaugac

SEQ ID NO: 991153 - RNA, 17 nt, Homo sapiens
acucucaccauuuggau

SEQ ID NO: 991154 - RNA, 15 nt, Homo sapiens
acucuccuaggcauu

SEQ ID NO: 991155 - RNA, 16 nt, Homo sapiens
agaucggccacagggc

SEQ ID NO: 991156 - RNA, 15 nt, Homo sapiens
agaucgggagcaaac

SEQ ID NO: 991157 - RNA, 16 nt, Homo sapiens
agaucucugaagccac

SEQ ID NO: 991158 - RNA, 21 nt, Homo sapiens
agaugaacccgaggcugagaa

SEQ ID NO: 991159 - RNA, 15 nt, Homo sapiens
agaugacagggaaaa

SEQ ID NO: 991160 - RNA, 22 nt, Homo sapiens
agaugacagggaaaacugcaaa

SEQ ID NO: 991161 - RNA, 17 nt, Homo sapiens
agaugaccucguacuca

SEQ ID NO: 991162 - RNA, 18 nt, Homo sapiens
agaugaggcuuuccaugg

SEQ ID NO: 991163 - RNA, 22 nt, Homo sapiens
agaugauacauccaaagcagac

SEQ ID NO: 991164 - RNA, 19 nt, Homo sapiens
agaugauggaugccaauau

SEQ ID NO: 991165 - RNA, 14 nt, Homo sapiens
agaugcagggcagu

SEQ ID NO: 991166 - RNA, 18 nt, Homo sapiens
agaugcagggcagucauu

SEQ ID NO: 991167 - RNA, 18 nt, Homo sapiens
agaugccucccugagcua

SEQ ID NO: 991168 - RNA, 19 nt, Homo sapiens
agauggaccugccugcaua

SEQ ID NO: 991169 - RNA, 14 nt, Homo sapiens
agaugggacauucc

SEQ ID NO: 991170 - RNA, 22 nt, Homo sapiens
agaugggcaaauuaaggcauaa

SEQ ID NO: 991171 - RNA, 21 nt, Homo sapiens
agauggggucucacaguguug

SEQ ID NO: 991172 - RNA, 22 nt, Homo sapiens
agauguaagaaauguucuugca

SEQ ID NO: 991173 - RNA, 17 nt, Homo sapiens
agauguguguugauacu

SEQ ID NO: 991174 - RNA, 19 nt, Homo sapiens
agauguucuaagucuuucc

SEQ ID NO: 991175 - RNA, 14 nt, Homo sapiens
agauguuuauuuca

SEQ ID NO: 991176 - RNA, 16 nt, Homo sapiens
agauuauagauucuaa

SEQ ID NO: 991177 - RNA, 15 nt, Homo sapiens
agauuccggauccua

SEQ ID NO: 991178 - RNA, 15 nt, Homo sapiens
agauucuaaagauuc

SEQ ID NO: 991179 - RNA, 21 nt, Homo sapiens
agauucucuuguauaagaucc

SEQ ID NO: 991180 - RNA, 15 nt, Homo sapiens
agauucugaacuaaa

SEQ ID NO: 991181 - RNA, 15 nt, Homo sapiens
agauucugaccuuaa

SEQ ID NO: 991182 - RNA, 20 nt, Homo sapiens
agauucugccuuugccaggu

SEQ ID NO: 991183 - RNA, 18 nt, Homo sapiens
agauugaaccugaauauu

SEQ ID NO: 991184 - RNA, 16 nt, Homo sapiens
agauugagcucucugc

SEQ ID NO: 991185 - RNA, 23 nt, Homo sapiens
agauuguuccugcuuuuccccaa

SEQ ID NO: 991186 - RNA, 15 nt, Homo sapiens
agauuuaacauuauc

SEQ ID NO: 991187 - RNA, 15 nt, Homo sapiens
agauuuggaugcacu

SEQ ID NO: 991188 - RNA, 22 nt, Homo sapiens
agauuuggaugcacucauuuaa

SEQ ID NO: 991189 - RNA, 22 nt, Homo sapiens
agauuuuuuccucugcauuuac

SEQ ID NO: 991190 - RNA, 22 nt, Homo sapiens
agcaaacugaauggcaaugaaa

SEQ ID NO: 991191 - RNA, 17 nt, Homo sapiens
agcaaaucgugccuugu

SEQ ID NO: 991192 - RNA, 14 nt, Homo sapiens
agcaaaugucaugc

SEQ ID NO: 991193 - RNA, 18 nt, Homo sapiens
agcaacaggcucacuggu

SEQ ID NO: 991194 - RNA, 20 nt, Homo sapiens
agcaacauucauagucuuug

SEQ ID NO: 991195 - RNA, 22 nt, Homo sapiens
agcaacuaucagacuaagccag

SEQ ID NO: 991196 - RNA, 20 nt, Homo sapiens
agcaagacccuaaacaucca

SEQ ID NO: 991197 - RNA, 19 nt, Homo sapiens
agcaagacuucucuuugcc

SEQ ID NO: 991198 - RNA, 23 nt, Homo sapiens
agcaagacuucucuuugccucaa

SEQ ID NO: 991199 - RNA, 12 nt, Homo sapiens
agcaagcaauaa

SEQ ID NO: 991200 - RNA, 15 nt, Homo sapiens
agcaagcugauuaaa

SEQ ID NO: 991201 - RNA, 15 nt, Homo sapiens
agcaaguguucacaa

SEQ ID NO: 991202 - RNA, 22 nt, Homo sapiens
agcaaguguucacaacagugaa

SEQ ID NO: 991203 - RNA, 15 nt, Homo sapiens
agcaauaaaaugcua

SEQ ID NO: 991204 - RNA, 16 nt, Homo sapiens
agcaauaugcauuuaa

SEQ ID NO: 991205 - RNA, 14 nt, Homo sapiens
agcaauuucuaauu

SEQ ID NO: 991206 - RNA, 20 nt, Homo sapiens
agcacaaggccaucugggcu

SEQ ID NO: 991207 - RNA, 15 nt, Homo sapiens
agcacacagggcagu

SEQ ID NO: 991208 - RNA, 11 nt, Homo sapiens
agcacagccaa

SEQ ID NO: 991209 - RNA, 19 nt, Homo sapiens
agcacagcuugaccugagg

SEQ ID NO: 991210 - RNA, 21 nt, Homo sapiens
agcacaucucaacaggccuca

SEQ ID NO: 991211 - RNA, 13 nt, Homo sapiens
agcaccaaaggga

SEQ ID NO: 991212 - RNA, 14 nt, Homo sapiens
agcaccaaagggaa

SEQ ID NO: 991213 - RNA, 14 nt, Homo sapiens
agcaccauuaacuc

SEQ ID NO: 991214 - RNA, 19 nt, Homo sapiens
agcacccuuccacuuccau

SEQ ID NO: 991215 - RNA, 18 nt, Homo sapiens
agcaccguucugugcaca

SEQ ID NO: 991216 - RNA, 21 nt, Homo sapiens
agcaccguucugugcacaaaa

SEQ ID NO: 991217 - RNA, 18 nt, Homo sapiens
agcacuagccaaaccuca

SEQ ID NO: 991218 - RNA, 22 nt, Homo sapiens
agcacuguuuauacacugugua

SEQ ID NO: 991219 - RNA, 20 nt, Homo sapiens
agcagaagagaaaauguugu

SEQ ID NO: 991220 - RNA, 14 nt, Homo sapiens
agcagacuacagcu

SEQ ID NO: 991221 - RNA, 21 nt, Homo sapiens
agcagcaccguucugugcaca

SEQ ID NO: 991222 - RNA, 19 nt, Homo sapiens
agcagcaccugcccuaccu

SEQ ID NO: 991223 - RNA, 16 nt, Homo sapiens
agcagccccacaccag

SEQ ID NO: 991224 - RNA, 16 nt, Homo sapiens
agcagcccccagcucc

SEQ ID NO: 991225 - RNA, 13 nt, Homo sapiens
agcagccucgccc

SEQ ID NO: 991226 - RNA, 23 nt, Homo sapiens
agcagccuuucucucuuuauaca

SEQ ID NO: 991227 - RNA, 21 nt, Homo sapiens
agcagcgccccucccaagagg

SEQ ID NO: 991228 - RNA, 12 nt, Homo sapiens
agcagcugagca

SEQ ID NO: 991229 - RNA, 20 nt, Homo sapiens
agcagcuuagaguuggccau

SEQ ID NO: 991230 - RNA, 17 nt, Homo sapiens
agcaggacugaugucuc

SEQ ID NO: 991231 - RNA, 18 nt, Homo sapiens
agcagguuaccacucugg

SEQ ID NO: 991232 - RNA, 20 nt, Homo sapiens
agcagguuaccacucuggca

SEQ ID NO: 991233 - RNA, 12 nt, Homo sapiens
agcagugccuug

SEQ ID NO: 991234 - RNA, 21 nt, Homo sapiens
agcaguugaaacaagaagcca

SEQ ID NO: 991235 - RNA, 20 nt, Homo sapiens
agcauaggugauccauguaa

SEQ ID NO: 991236 - RNA, 14 nt, Homo sapiens
agcaugaaagugga

SEQ ID NO: 991237 - RNA, 17 nt, Homo sapiens
agcaugggauuauuaga

SEQ ID NO: 991238 - RNA, 16 nt, Homo sapiens
agcauguuacugacag

SEQ ID NO: 991239 - RNA, 12 nt, Homo sapiens
agcauugcacuu

SEQ ID NO: 991240 - RNA, 16 nt, Homo sapiens
agcauuguagugcuuu

SEQ ID NO: 991241 - RNA, 20 nt, Homo sapiens
agccaaauuuaaaacuguug

SEQ ID NO: 991242 - RNA, 13 nt, Homo sapiens
agccaagggaugg

SEQ ID NO: 991243 - RNA, 15 nt, Homo sapiens
agccacaccaggaua

SEQ ID NO: 991244 - RNA, 15 nt, Homo sapiens
agccacagcugugca

SEQ ID NO: 991245 - RNA, 22 nt, Homo sapiens
agccacagcugugcaugcucag

SEQ ID NO: 991246 - RNA, 23 nt, Homo sapiens
agccacagcugugcaugcucagc

SEQ ID NO: 991247 - RNA, 15 nt, Homo sapiens
agccaccaagaggga

SEQ ID NO: 991248 - RNA, 14 nt, Homo sapiens
agccaccaguucuc

SEQ ID NO: 991249 - RNA, 17 nt, Homo sapiens
agccacccugaggaguc

SEQ ID NO: 991250 - RNA, 21 nt, Homo sapiens
agccacuguuuguuuacaaaa

SEQ ID NO: 991251 - RNA, 22 nt, Homo sapiens
agccacuugccugugcuacaau

SEQ ID NO: 991252 - RNA, 20 nt, Homo sapiens
agccaggcccagccgacccc

SEQ ID NO: 991253 - RNA, 20 nt, Homo sapiens
agccauaguggaucacucac

SEQ ID NO: 991254 - RNA, 21 nt, Homo sapiens
agccaucaauauucagcaaaa

SEQ ID NO: 991255 - RNA, 14 nt, Homo sapiens
agcccaagccuugu

SEQ ID NO: 991256 - RNA, 19 nt, Homo sapiens
agcccagcugggucaggca

SEQ ID NO: 991257 - RNA, 21 nt, Homo sapiens
agcccaggagcuccccucccc

SEQ ID NO: 991258 - RNA, 13 nt, Homo sapiens
agccccacccugg

SEQ ID NO: 991259 - RNA, 18 nt, Homo sapiens
agcccccagccugucaga

SEQ ID NO: 991260 - RNA, 20 nt, Homo sapiens
agccccuccuaguucuucau

SEQ ID NO: 991261 - RNA, 17 nt, Homo sapiens
agccccuucugcucagc

SEQ ID NO: 991262 - RNA, 22 nt, Homo sapiens
agcccgaggaggugucucaggc

SEQ ID NO: 991263 - RNA, 17 nt, Homo sapiens
agcccugcaccaugcug

SEQ ID NO: 991264 - RNA, 16 nt, Homo sapiens
agcccugggaccgcua

SEQ ID NO: 991265 - RNA, 21 nt, Homo sapiens
agccggggugggguggcugca

SEQ ID NO: 991266 - RNA, 23 nt, Homo sapiens
agccuauguaugccauggaggca

SEQ ID NO: 991267 - RNA, 16 nt, Homo sapiens
agccucuggcauuaga

SEQ ID NO: 991268 - RNA, 18 nt, Homo sapiens
agccugagucaccugcag

SEQ ID NO: 991269 - RNA, 20 nt, Homo sapiens
agccugaugcugacauucac

SEQ ID NO: 991270 - RNA, 14 nt, Homo sapiens
agccuggccagaca

SEQ ID NO: 991271 - RNA, 20 nt, Homo sapiens
agccuggccagacacaggcc

SEQ ID NO: 991272 - RNA, 17 nt, Homo sapiens
agccuggccuccugccu

SEQ ID NO: 991273 - RNA, 18 nt, Homo sapiens
agccugggcaacacagug

SEQ ID NO: 991274 - RNA, 16 nt, Homo sapiens
agccugggccuaugga

SEQ ID NO: 991275 - RNA, 15 nt, Homo sapiens
agccuuaauuugcac

SEQ ID NO: 991276 - RNA, 23 nt, Homo sapiens
agccuugugaugucauacagaga

SEQ ID NO: 991277 - RNA, 21 nt, Homo sapiens
agccuugugugaacucaccaa

SEQ ID NO: 991278 - RNA, 14 nt, Homo sapiens
agccuuugccuccc

SEQ ID NO: 991279 - RNA, 15 nt, Homo sapiens
agcgaaacacacaaa

SEQ ID NO: 991280 - RNA, 19 nt, Homo sapiens
agcgaggaggcuccagagg

SEQ ID NO: 991281 - RNA, 17 nt, Homo sapiens
agcgaguggagucugcc

SEQ ID NO: 991282 - RNA, 11 nt, Homo sapiens
agcggacacac

SEQ ID NO: 991283 - RNA, 23 nt, Homo sapiens
agcuaacccucacaagcaugaag

SEQ ID NO: 991284 - RNA, 14 nt, Homo sapiens
agcuacucucccca

SEQ ID NO: 991285 - RNA, 17 nt, Homo sapiens
agcuagaauaccaccua

SEQ ID NO: 991286 - RNA, 11 nt, Homo sapiens
agcucacucau

SEQ ID NO: 991287 - RNA, 21 nt, Homo sapiens
agcucagaaaauaucccuccu

SEQ ID NO: 991288 - RNA, 21 nt, Homo sapiens
agcucccaggaccacaggcuc

SEQ ID NO: 991289 - RNA, 15 nt, Homo sapiens
agcuccggccugucc

SEQ ID NO: 991290 - RNA, 17 nt, Homo sapiens
agcucuauuaugaaugu

SEQ ID NO: 991291 - RNA, 20 nt, Homo sapiens
agcucucccaacucuugcac

SEQ ID NO: 991292 - RNA, 20 nt, Homo sapiens
agcucugaaaccaguguuag

SEQ ID NO: 991293 - RNA, 16 nt, Homo sapiens
agcucuuugucaggga

SEQ ID NO: 991294 - RNA, 22 nt, Homo sapiens
agcugacuuggcugguguggua

SEQ ID NO: 991295 - RNA, 23 nt, Homo sapiens
agcugagauugcaccacugcacu

SEQ ID NO: 991296 - RNA, 14 nt, Homo sapiens
agcugaguaaaaug

SEQ ID NO: 991297 - RNA, 23 nt, Homo sapiens
agcugaguuuccuaugggaacaa

SEQ ID NO: 991298 - RNA, 19 nt, Homo sapiens
agcugcacugaugcugccc

SEQ ID NO: 991299 - RNA, 18 nt, Homo sapiens
agcuggaaaaaguguccu

SEQ ID NO: 991300 - RNA, 22 nt, Homo sapiens
agcuggaagggucaacaucuuu

SEQ ID NO: 991301 - RNA, 22 nt, Homo sapiens
agcuggggcuuugauguuccuu

SEQ ID NO: 991302 - RNA, 16 nt, Homo sapiens
agcugucccacaucac

SEQ ID NO: 991303 - RNA, 20 nt, Homo sapiens
aggcccaguucacccugauu

SEQ ID NO: 991304 - RNA, 19 nt, Homo sapiens
aggccccagccucccugaa

SEQ ID NO: 991305 - RNA, 16 nt, Homo sapiens
aggccuaggauucuaa

SEQ ID NO: 991306 - RNA, 22 nt, Homo sapiens
aggccuccugugacuggcagca

SEQ ID NO: 991307 - RNA, 18 nt, Homo sapiens
aggccugggaauccgcug

SEQ ID NO: 991308 - RNA, 12 nt, Homo sapiens
aggccuguccaa

SEQ ID NO: 991309 - RNA, 17 nt, Homo sapiens
aggccuuacuuaaaccc

SEQ ID NO: 991310 - RNA, 20 nt, Homo sapiens
aggccuuacuuaaacccagc

SEQ ID NO: 991311 - RNA, 17 nt, Homo sapiens
aggcucguugacuggcu

SEQ ID NO: 991312 - RNA, 18 nt, Homo sapiens
aggcucucgcacaccucu

SEQ ID NO: 991313 - RNA, 18 nt, Homo sapiens
aggcugaccacagcacag

SEQ ID NO: 991314 - RNA, 16 nt, Homo sapiens
aggcugccccucucac

SEQ ID NO: 991315 - RNA, 19 nt, Homo sapiens
aggcugccccucucaccaa

SEQ ID NO: 991316 - RNA, 20 nt, Homo sapiens
aggcuggagugcaguggugu

SEQ ID NO: 991317 - RNA, 18 nt, Homo sapiens
aggcugggccauguccaa

SEQ ID NO: 991318 - RNA, 16 nt, Homo sapiens
aggcuguccuguacau

SEQ ID NO: 991319 - RNA, 16 nt, Homo sapiens
aggcuugagucaccau

SEQ ID NO: 991320 - RNA, 15 nt, Homo sapiens
aggcuuuaugauaau

SEQ ID NO: 991321 - RNA, 18 nt, Homo sapiens
agggaaaauuauuugcau

SEQ ID NO: 991322 - RNA, 15 nt, Homo sapiens
agggaaccugugucc

SEQ ID NO: 991323 - RNA, 21 nt, Homo sapiens
agggaagcugucccucacugu

SEQ ID NO: 991324 - RNA, 16 nt, Homo sapiens
agggaaugugaaauuu

SEQ ID NO: 991325 - RNA, 14 nt, Homo sapiens
agggacccaugagu

SEQ ID NO: 991326 - RNA, 18 nt, Homo sapiens
agggacugucgcugcuuc

SEQ ID NO: 991327 - RNA, 14 nt, Homo sapiens
agggagaacgggaa

SEQ ID NO: 991328 - RNA, 15 nt, Homo sapiens
agggagggcucugag

SEQ ID NO: 991329 - RNA, 16 nt, Homo sapiens
agggagggcucugagg

SEQ ID NO: 991330 - RNA, 12 nt, Homo sapiens
agggagugcaug

SEQ ID NO: 991331 - RNA, 19 nt, Homo sapiens
agggcagaccacauugcuu

SEQ ID NO: 991332 - RNA, 17 nt, Homo sapiens
agggcaguucugagugu

SEQ ID NO: 991333 - RNA, 20 nt, Homo sapiens
agggcaguucugaguguuua

SEQ ID NO: 991334 - RNA, 13 nt, Homo sapiens
agggccagaaaua

SEQ ID NO: 991335 - RNA, 15 nt, Homo sapiens
agggcuagugacuug

SEQ ID NO: 991336 - RNA, 16 nt, Homo sapiens
agggcucacucagcca

SEQ ID NO: 991337 - RNA, 19 nt, Homo sapiens
agggcuccugcacuuacuu

SEQ ID NO: 991338 - RNA, 13 nt, Homo sapiens
agggcugcuuccc

SEQ ID NO: 991339 - RNA, 18 nt, Homo sapiens
aggggaagaggccuguuu

SEQ ID NO: 991340 - RNA, 23 nt, Homo sapiens
aggggcuucagguccaggcugug

SEQ ID NO: 991341 - RNA, 17 nt, Homo sapiens
agggggaagaagaagag

SEQ ID NO: 991342 - RNA, 15 nt, Homo sapiens
agggggcugcugcug

SEQ ID NO: 991343 - RNA, 20 nt, Homo sapiens
aggggucugagcuccagcuc

SEQ ID NO: 991344 - RNA, 14 nt, Homo sapiens
aggguccucugaga

SEQ ID NO: 991345 - RNA, 18 nt, Homo sapiens
aggguugacuuuacccau

SEQ ID NO: 991346 - RNA, 20 nt, Homo sapiens
aggguuucaccauguugccc

SEQ ID NO: 991347 - RNA, 22 nt, Homo sapiens
aggguuuuaguuuuuaauuuau

SEQ ID NO: 991348 - RNA, 14 nt, Homo sapiens
agguacauccauga

SEQ ID NO: 991349 - RNA, 15 nt, Homo sapiens
aggucccugcugcca

SEQ ID NO: 991350 - RNA, 21 nt, Homo sapiens
aggucguuuuuuucauuccau

SEQ ID NO: 991351 - RNA, 19 nt, Homo sapiens
aggucuuggaacuugccug

SEQ ID NO: 991352 - RNA, 15 nt, Homo sapiens
aggugaccaguggga

SEQ ID NO: 991353 - RNA, 19 nt, Homo sapiens
aguucgcagccacccugag

SEQ ID NO: 991354 - RNA, 15 nt, Homo sapiens
aguucuaagauucua

SEQ ID NO: 991355 - RNA, 22 nt, Homo sapiens
aguucuaggcacuguaguucua

SEQ ID NO: 991356 - RNA, 23 nt, Homo sapiens
aguucuuuaaaauguaaagccau

SEQ ID NO: 991357 - RNA, 18 nt, Homo sapiens
aguucuuugggccagaca

SEQ ID NO: 991358 - RNA, 18 nt, Homo sapiens
aguugaagggaggggcug

SEQ ID NO: 991359 - RNA, 14 nt, Homo sapiens
aguugaggacuucu

SEQ ID NO: 991360 - RNA, 17 nt, Homo sapiens
aguugcugaugaacucu

SEQ ID NO: 991361 - RNA, 17 nt, Homo sapiens
aguugcugcuucuccca

SEQ ID NO: 991362 - RNA, 13 nt, Homo sapiens
aguuguucagcau

SEQ ID NO: 991363 - RNA, 23 nt, Homo sapiens
aguuuaauuuuugaaaacuggcu

SEQ ID NO: 991364 - RNA, 24 nt, Homo sapiens
aguuuacagacgcugcugucacaa

SEQ ID NO: 991365 - RNA, 18 nt, Homo sapiens
aguuuccucaccagaaaa

SEQ ID NO: 991366 - RNA, 18 nt, Homo sapiens
aguuugauuauucagugu

SEQ ID NO: 991367 - RNA, 15 nt, Homo sapiens
aguuuggaagcacug

SEQ ID NO: 991368 - RNA, 13 nt, Homo sapiens
aguuuuuauacau

SEQ ID NO: 991369 - RNA, 15 nt, Homo sapiens
aguuuuuguuucaca

SEQ ID NO: 991370 - RNA, 21 nt, Homo sapiens
aguuuuuuauuaugcauuaua

SEQ ID NO: 991371 - RNA, 15 nt, Homo sapiens
auaaaaaugagugcu

SEQ ID NO: 991372 - RNA, 16 nt, Homo sapiens
auaaaauucauuaguu

SEQ ID NO: 991373 - RNA, 22 nt, Homo sapiens
auaaaccccaccuuuauuccuu

SEQ ID NO: 991374 - RNA, 17 nt, Homo sapiens
auaaacguccuacugua

SEQ ID NO: 991375 - RNA, 18 nt, Homo sapiens
auaaaguaguccugugaa

SEQ ID NO: 991376 - RNA, 19 nt, Homo sapiens
auaaauauaucuaccccag

SEQ ID NO: 991377 - RNA, 20 nt, Homo sapiens
auaacagaaagccuggguga

SEQ ID NO: 991378 - RNA, 11 nt, Homo sapiens
auaacaguguu

SEQ ID NO: 991379 - RNA, 17 nt, Homo sapiens
auaaccacugcuuccau

SEQ ID NO: 991380 - RNA, 20 nt, Homo sapiens
auaacccaagguaccauccu

SEQ ID NO: 991381 - RNA, 17 nt, Homo sapiens
auaaccucucugugcca

SEQ ID NO: 991382 - RNA, 22 nt, Homo sapiens
auaacuguauuugaaauaagaa

SEQ ID NO: 991383 - RNA, 18 nt, Homo sapiens
auaacuuccacagggucc

SEQ ID NO: 991384 - RNA, 18 nt, Homo sapiens
auaagaaagaucaaagac

SEQ ID NO: 991385 - RNA, 23 nt, Homo sapiens
auaagaucuuuuauuuugccaag

SEQ ID NO: 991386 - RNA, 15 nt, Homo sapiens
auaaggcauggcuca

SEQ ID NO: 991387 - RNA, 20 nt, Homo sapiens
auaagggucccccacucuaa

SEQ ID NO: 991388 - RNA, 17 nt, Homo sapiens
auaagugcccucuccca

SEQ ID NO: 991389 - RNA, 16 nt, Homo sapiens
auaauacauugcagca

SEQ ID NO: 991390 - RNA, 15 nt, Homo sapiens
auaaucaucaaguaa

SEQ ID NO: 991391 - RNA, 20 nt, Homo sapiens
auaauguguaguucauguaa

SEQ ID NO: 991392 - RNA, 23 nt, Homo sapiens
auacaaaucauccauccuugcca

SEQ ID NO: 991393 - RNA, 14 nt, Homo sapiens
auacaauacagauc

SEQ ID NO: 991394 - RNA, 20 nt, Homo sapiens
auacaauuuuuuuuauuagu

SEQ ID NO: 991395 - RNA, 17 nt, Homo sapiens
auacagaauuacuguaa

SEQ ID NO: 991396 - RNA, 15 nt, Homo sapiens
auacagaucaucuug

SEQ ID NO: 991397 - RNA, 12 nt, Homo sapiens
auacaucaaaga

SEQ ID NO: 991398 - RNA, 15 nt, Homo sapiens
auaccauuauauguu

SEQ ID NO: 991399 - RNA, 15 nt, Homo sapiens
auacccauauguccu

SEQ ID NO: 991400 - RNA, 19 nt, Homo sapiens
auaccuuccccacaucuga

SEQ ID NO: 991401 - RNA, 13 nt, Homo sapiens
auacggugggggu

SEQ ID NO: 991402 - RNA, 14 nt, Homo sapiens
caccucuccagagg

SEQ ID NO: 991403 - RNA, 14 nt, Homo sapiens
caccucugcaccuu

SEQ ID NO: 991404 - RNA, 15 nt, Homo sapiens
caccugacucuugca

SEQ ID NO: 991405 - RNA, 15 nt, Homo sapiens
caccugcaaaccuua

SEQ ID NO: 991406 - RNA, 20 nt, Homo sapiens
caccugguggccaugcuccu

SEQ ID NO: 991407 - RNA, 13 nt, Homo sapiens
caccuucaccuuc

SEQ ID NO: 991408 - RNA, 17 nt, Homo sapiens
caccuugcuccuccuuc

SEQ ID NO: 991409 - RNA, 16 nt, Homo sapiens
caccuuggaauucgcu

SEQ ID NO: 991410 - RNA, 14 nt, Homo sapiens
cacgacaguggaug

SEQ ID NO: 991411 - RNA, 21 nt, Homo sapiens
cacgucugcagaaacagugca

SEQ ID NO: 991412 - RNA, 22 nt, Homo sapiens
cacgucugcagaaacagugcaa

SEQ ID NO: 991413 - RNA, 13 nt, Homo sapiens
cacguguguauug

SEQ ID NO: 991414 - RNA, 15 nt, Homo sapiens
cacguucugcucauc

SEQ ID NO: 991415 - RNA, 19 nt, Homo sapiens
cacuaauuuauaacuauua

SEQ ID NO: 991416 - RNA, 15 nt, Homo sapiens
cacuacauucauuua

SEQ ID NO: 991417 - RNA, 16 nt, Homo sapiens
cacuagacaagccaga

SEQ ID NO: 991418 - RNA, 13 nt, Homo sapiens
cacuauaucacaa

SEQ ID NO: 991419 - RNA, 22 nt, Homo sapiens
cacucaaaauagggacuaucua

SEQ ID NO: 991420 - RNA, 22 nt, Homo sapiens
cacucaguggcccauggcauuu

SEQ ID NO: 991421 - RNA, 20 nt, Homo sapiens
cacucuacuaaugccucuuc

SEQ ID NO: 991422 - RNA, 17 nt, Homo sapiens
cacucuagucaaugaca

SEQ ID NO: 991423 - RNA, 14 nt, Homo sapiens
cacucuggagcauu

SEQ ID NO: 991424 - RNA, 18 nt, Homo sapiens
cacucuucaaaugccuga

SEQ ID NO: 991425 - RNA, 13 nt, Homo sapiens
cacugacugggac

SEQ ID NO: 991426 - RNA, 18 nt, Homo sapiens
cacugaggggggauccag

SEQ ID NO: 991427 - RNA, 15 nt, Homo sapiens
cacugauaaaaccau

SEQ ID NO: 991428 - RNA, 21 nt, Homo sapiens
cacugcacucaaccuuaagac

SEQ ID NO: 991429 - RNA, 21 nt, Homo sapiens
cacugcccccugcugccaugu

SEQ ID NO: 991430 - RNA, 15 nt, Homo sapiens
cacugccuucaccuu

SEQ ID NO: 991431 - RNA, 17 nt, Homo sapiens
cacugggacccucagcc

SEQ ID NO: 991432 - RNA, 12 nt, Homo sapiens
cacuguaaaaug

SEQ ID NO: 991433 - RNA, 22 nt, Homo sapiens
cacuguacuaucagguucacaa

SEQ ID NO: 991434 - RNA, 14 nt, Homo sapiens
cacuguaguucuaa

SEQ ID NO: 991435 - RNA, 22 nt, Homo sapiens
cacugucaccacccugcucauc

SEQ ID NO: 991436 - RNA, 18 nt, Homo sapiens
cacugucccuugccucaa

SEQ ID NO: 991437 - RNA, 21 nt, Homo sapiens
cacuguccugggccugcagaa

SEQ ID NO: 991438 - RNA, 16 nt, Homo sapiens
cacugugucauucugu

SEQ ID NO: 991439 - RNA, 14 nt, Homo sapiens
cacuuaaagcuuuc

SEQ ID NO: 991440 - RNA, 21 nt, Homo sapiens
cagcauuuagacccugcauuu

SEQ ID NO: 991441 - RNA, 15 nt, Homo sapiens
cagccaacuuuugca

SEQ ID NO: 991442 - RNA, 12 nt, Homo sapiens
cagccagcacuu

SEQ ID NO: 991443 - RNA, 21 nt, Homo sapiens
cagccaucccgucuucuccaa

SEQ ID NO: 991444 - RNA, 19 nt, Homo sapiens
cagcccaggaagucucauc

SEQ ID NO: 991445 - RNA, 16 nt, Homo sapiens
cagccccacaccaggg

SEQ ID NO: 991446 - RNA, 20 nt, Homo sapiens
cagcccugcaccaugcugcu

SEQ ID NO: 991447 - RNA, 20 nt, Homo sapiens
cagccgaggucccugcugcc

SEQ ID NO: 991448 - RNA, 19 nt, Homo sapiens
cagccgccggcugugcagu

SEQ ID NO: 991449 - RNA, 20 nt, Homo sapiens
cagccucagaaaccagacuc

SEQ ID NO: 991450 - RNA, 20 nt, Homo sapiens
cagccucugggggguggcca

SEQ ID NO: 991451 - RNA, 14 nt, Homo sapiens
cagccuugccagag

SEQ ID NO: 991452 - RNA, 23 nt, Homo sapiens
cagccuugccagagauccaaaag

SEQ ID NO: 991453 - RNA, 13 nt, Homo sapiens
cagcgacuggcau

SEQ ID NO: 991454 - RNA, 14 nt, Homo sapiens
cagcucagcacugc

SEQ ID NO: 991455 - RNA, 19 nt, Homo sapiens
cagcucccaggaccacagg

SEQ ID NO: 991456 - RNA, 20 nt, Homo sapiens
cagcucccaggaccacaggc

SEQ ID NO: 991457 - RNA, 17 nt, Homo sapiens
cagcuccugacacugcu

SEQ ID NO: 991458 - RNA, 17 nt, Homo sapiens
cagcucuaauacauucc

SEQ ID NO: 991459 - RNA, 20 nt, Homo sapiens
cagcugcuggagauauguaa

SEQ ID NO: 991460 - RNA, 18 nt, Homo sapiens
cagcuggacccugaccag

SEQ ID NO: 991461 - RNA, 18 nt, Homo sapiens
cagcuggagguugagcuc

SEQ ID NO: 991462 - RNA, 15 nt, Homo sapiens
cagcugguguagcua

SEQ ID NO: 991463 - RNA, 17 nt, Homo sapiens
cagcuuauauucaucca

SEQ ID NO: 991464 - RNA, 21 nt, Homo sapiens
cagcuucugauaaacacaauc

SEQ ID NO: 991465 - RNA, 20 nt, Homo sapiens
caggacuuccauuugcuuug

SEQ ID NO: 991466 - RNA, 15 nt, Homo sapiens
caggagaagcucagc

SEQ ID NO: 991467 - RNA, 21 nt, Homo sapiens
caggagcuaccuguguggaca

SEQ ID NO: 991468 - RNA, 18 nt, Homo sapiens
caggaguagcugagcuca

SEQ ID NO: 991469 - RNA, 24 nt, Homo sapiens
caggauagagacuggaacacuaga

SEQ ID NO: 991470 - RNA, 12 nt, Homo sapiens
caggauugaaaa

SEQ ID NO: 991471 - RNA, 13 nt, Homo sapiens
caggcaccugcca

SEQ ID NO: 991472 - RNA, 12 nt, Homo sapiens
caggcacugaga

SEQ ID NO: 991473 - RNA, 13 nt, Homo sapiens
caggccccaugac

SEQ ID NO: 991474 - RNA, 16 nt, Homo sapiens
caggccuuugagcuca

SEQ ID NO: 991475 - RNA, 13 nt, Homo sapiens
cauaacaauuccu

SEQ ID NO: 991476 - RNA, 18 nt, Homo sapiens
cauaaccacugcuuccau

SEQ ID NO: 991477 - RNA, 20 nt, Homo sapiens
cauaaccucucugugccauc

SEQ ID NO: 991478 - RNA, 16 nt, Homo sapiens
cauaagaaaacuaaga

SEQ ID NO: 991479 - RNA, 20 nt, Homo sapiens
cauaaguuuaggauaaaaua

SEQ ID NO: 991480 - RNA, 22 nt, Homo sapiens
cauaauugugauuagacagaac

SEQ ID NO: 991481 - RNA, 15 nt, Homo sapiens
cauacaaaucaucca

SEQ ID NO: 991482 - RNA, 17 nt, Homo sapiens
cauaccguguaccucag

SEQ ID NO: 991483 - RNA, 14 nt, Homo sapiens
cauacgucagcauu

SEQ ID NO: 991484 - RNA, 17 nt, Homo sapiens
cauagcaccuaacaaca

SEQ ID NO: 991485 - RNA, 16 nt, Homo sapiens
cauaguggaucacuca

SEQ ID NO: 991486 - RNA, 19 nt, Homo sapiens
cauauaauguuguuauuua

SEQ ID NO: 991487 - RNA, 18 nt, Homo sapiens
cauaugaucugucugugg

SEQ ID NO: 991488 - RNA, 16 nt, Homo sapiens
cauaugcuaccaccag

SEQ ID NO: 991489 - RNA, 14 nt, Homo sapiens
cauauuuaccucag

SEQ ID NO: 991490 - RNA, 17 nt, Homo sapiens
caucaacagcagggugg

SEQ ID NO: 991491 - RNA, 11 nt, Homo sapiens
caucaagagaa

SEQ ID NO: 991492 - RNA, 12 nt, Homo sapiens
caucacacuggg

SEQ ID NO: 991493 - RNA, 21 nt, Homo sapiens
caucacuggggcugggagcag

SEQ ID NO: 991494 - RNA, 12 nt, Homo sapiens
caucacuuugac

SEQ ID NO: 991495 - RNA, 23 nt, Homo sapiens
caucagaaccagaggcuuggucc

SEQ ID NO: 991496 - RNA, 14 nt, Homo sapiens
caucaguaguucac

SEQ ID NO: 991497 - RNA, 15 nt, Homo sapiens
caucaguccauugcu

SEQ ID NO: 991498 - RNA, 17 nt, Homo sapiens
caucauaagaauagcug

SEQ ID NO: 991499 - RNA, 12 nt, Homo sapiens
cauccaaagcag

SEQ ID NO: 991500 - RNA, 17 nt, Homo sapiens
cauccaagcaaacugaa

SEQ ID NO: 991501 - RNA, 17 nt, Homo sapiens
cauccuccacaauagca

SEQ ID NO: 991502 - RNA, 18 nt, Homo sapiens
cauccuccagauagugua

SEQ ID NO: 991503 - RNA, 14 nt, Homo sapiens
cauccugaccagcu

SEQ ID NO: 991504 - RNA, 17 nt, Homo sapiens
caucucaaagaaggcau

SEQ ID NO: 991505 - RNA, 15 nt, Homo sapiens
caucucaacaggccu

SEQ ID NO: 991506 - RNA, 20 nt, Homo sapiens
caucucaacaggccucaggg

SEQ ID NO: 991507 - RNA, 16 nt, Homo sapiens
caucucagugaagaau

SEQ ID NO: 991508 - RNA, 21 nt, Homo sapiens
caucucccagauaaugugaaa

SEQ ID NO: 991509 - RNA, 24 nt, Homo sapiens
ccaauuaauuccuguuugucuaca

SEQ ID NO: 991510 - RNA, 20 nt, Homo sapiens
ccaauuuuuuaagugaaaau

SEQ ID NO: 991511 - RNA, 14 nt, Homo sapiens
ccacaaacuguaau

SEQ ID NO: 991512 - RNA, 22 nt, Homo sapiens
ccacaaacuguaauacaaugau

SEQ ID NO: 991513 - RNA, 17 nt, Homo sapiens
ccacacaugaaucugca

SEQ ID NO: 991514 - RNA, 22 nt, Homo sapiens
ccacacccuggaggauuucauc

SEQ ID NO: 991515 - RNA, 20 nt, Homo sapiens
ccacagaccuaggauuucau

SEQ ID NO: 991516 - RNA, 19 nt, Homo sapiens
ccacagcaaccccaggcug

SEQ ID NO: 991517 - RNA, 21 nt, Homo sapiens
ccacagcaaccccaggcugaa

SEQ ID NO: 991518 - RNA, 14 nt, Homo sapiens
ccacagcacagcca

SEQ ID NO: 991519 - RNA, 14 nt, Homo sapiens
ccacaggacauuuc

SEQ ID NO: 991520 - RNA, 21 nt, Homo sapiens
ccacauccuccacguucugcu

SEQ ID NO: 991521 - RNA, 16 nt, Homo sapiens
ccaccaaaacugcucc

SEQ ID NO: 991522 - RNA, 14 nt, Homo sapiens
ccaccagaugcuga

SEQ ID NO: 991523 - RNA, 13 nt, Homo sapiens
ccaccaguucuca

SEQ ID NO: 991524 - RNA, 22 nt, Homo sapiens
ccacccucauucuacugaaaag

SEQ ID NO: 991525 - RNA, 22 nt, Homo sapiens
ccacccucggggauguguccug

SEQ ID NO: 991526 - RNA, 13 nt, Homo sapiens
ccacccugcucau

SEQ ID NO: 991527 - RNA, 20 nt, Homo sapiens
ccaccuggaccccugcauug

SEQ ID NO: 991528 - RNA, 15 nt, Homo sapiens
ccaccuggcucucac

SEQ ID NO: 991529 - RNA, 22 nt, Homo sapiens
ccacgagcuguuuacuagggau

SEQ ID NO: 991530 - RNA, 20 nt, Homo sapiens
ccacuagaagcaacuaggaa

SEQ ID NO: 991531 - RNA, 23 nt, Homo sapiens
ccacucccuccuaaccuagagau

SEQ ID NO: 991532 - RNA, 14 nt, Homo sapiens
ccacucugcucuga

SEQ ID NO: 991533 - RNA, 14 nt, Homo sapiens
ccacuggggcucag

SEQ ID NO: 991534 - RNA, 14 nt, Homo sapiens
ccacuggucaugcc

SEQ ID NO: 991535 - RNA, 14 nt, Homo sapiens
ccacuguaugagug

SEQ ID NO: 991536 - RNA, 18 nt, Homo sapiens
ccacuuaucugaucagaa

SEQ ID NO: 991537 - RNA, 19 nt, Homo sapiens
ccagaaauacuacugugua

SEQ ID NO: 991538 - RNA, 22 nt, Homo sapiens
ccagacacuggcguuacugcuu

SEQ ID NO: 991539 - RNA, 14 nt, Homo sapiens
ccagacucuugccu

SEQ ID NO: 991540 - RNA, 16 nt, Homo sapiens
ccagagcuacugacua

SEQ ID NO: 991541 - RNA, 24 nt, Homo sapiens
ccagagggaccggaguuaugacaa

SEQ ID NO: 991542 - RNA, 22 nt, Homo sapiens
ccagaucgggagcaaaccaaag

SEQ ID NO: 991543 - RNA, 18 nt, Homo sapiens
ccagaugagaagucugcu

SEQ ID NO: 991544 - RNA, 16 nt, Homo sapiens
ccagaugcagggcagu

SEQ ID NO: 991545 - RNA, 23 nt, Homo sapiens
ccagauugacgacaagugcugaa

SEQ ID NO: 991546 - RNA, 19 nt, Homo sapiens
ccagcagccccacaccagg

SEQ ID NO: 991547 - RNA, 17 nt, Homo sapiens
ccagcccaagugaggca

SEQ ID NO: 991548 - RNA, 15 nt, Homo sapiens
ccagccccacuccuc

SEQ ID NO: 991549 - RNA, 18 nt, Homo sapiens
ccagcuaagaaccuggaa

SEQ ID NO: 991550 - RNA, 15 nt, Homo sapiens
ccagcuaaggggugg

SEQ ID NO: 991551 - RNA, 21 nt, Homo sapiens
ccagcuccaaccugcaaagau

SEQ ID NO: 991552 - RNA, 13 nt, Homo sapiens
ccagcugcacuga

SEQ ID NO: 991553 - RNA, 23 nt, Homo sapiens
ccagcugugguuuucuuuugcca

SEQ ID NO: 991554 - RNA, 14 nt, Homo sapiens
ccagcuuauaguca

SEQ ID NO: 991555 - RNA, 12 nt, Homo sapiens
ccaggaccaguc

SEQ ID NO: 991556 - RNA, 23 nt, Homo sapiens
ccaggagaagaaagaggugaccc

SEQ ID NO: 991557 - RNA, 20 nt, Homo sapiens
ccaggaggaauaagcuccca

SEQ ID NO: 991558 - RNA, 13 nt, Homo sapiens
ccaggcagaucca

SEQ ID NO: 991559 - RNA, 16 nt, Homo sapiens
ccaggcauguggcagg

SEQ ID NO: 991560 - RNA, 15 nt, Homo sapiens
ccaggccaaugucag

SEQ ID NO: 991561 - RNA, 19 nt, Homo sapiens
ccaggcugaccacagcaca

SEQ ID NO: 991562 - RNA, 23 nt, Homo sapiens
ccaggcugaccacagcacagcca

SEQ ID NO: 991563 - RNA, 13 nt, Homo sapiens
ccaggcugccguc

SEQ ID NO: 991564 - RNA, 23 nt, Homo sapiens
ccaggcuggagugcaguggugca

SEQ ID NO: 991565 - RNA, 16 nt, Homo sapiens
ccaggcuggucucaaa

SEQ ID NO: 991566 - RNA, 12 nt, Homo sapiens
ccaggcuguagg

SEQ ID NO: 991567 - RNA, 21 nt, Homo sapiens
ccaggcuucugcuggggccug

SEQ ID NO: 991568 - RNA, 15 nt, Homo sapiens
ccagggagagcccag

SEQ ID NO: 991569 - RNA, 18 nt, Homo sapiens
ccagggcuguaacugcca

SEQ ID NO: 991570 - RNA, 19 nt, Homo sapiens
ccagggggagcugggccug

SEQ ID NO: 991571 - RNA, 13 nt, Homo sapiens
ccaggugaacaaa

SEQ ID NO: 991572 - RNA, 20 nt, Homo sapiens
ccagguuggcucugccaguc

SEQ ID NO: 991573 - RNA, 18 nt, Homo sapiens
ccaguauaagacuacuga

SEQ ID NO: 991574 - RNA, 14 nt, Homo sapiens
ccaguccuguccua

SEQ ID NO: 991575 - RNA, 11 nt, Homo sapiens
ccagugacacc

SEQ ID NO: 991576 - RNA, 18 nt, Homo sapiens
ccagugcccugagccagg

SEQ ID NO: 991577 - RNA, 23 nt, Homo sapiens
ccagugucauuucucauccacau

SEQ ID NO: 991578 - RNA, 14 nt, Homo sapiens
ccauaacugaacau

SEQ ID NO: 991579 - RNA, 19 nt, Homo sapiens
ccauaugcuaccaccagcu

SEQ ID NO: 991580 - RNA, 18 nt, Homo sapiens
ggcugggaacagugugca

SEQ ID NO: 991581 - RNA, 17 nt, Homo sapiens
ggcugggacguggcuca

SEQ ID NO: 991582 - RNA, 22 nt, Homo sapiens
ggcugguccagggcuagugacu

SEQ ID NO: 991583 - RNA, 17 nt, Homo sapiens
ggcugucaucugugcac

SEQ ID NO: 991584 - RNA, 19 nt, Homo sapiens
ggcuguguuuccaucucaa

SEQ ID NO: 991585 - RNA, 15 nt, Homo sapiens
ggcuucagccaucca

SEQ ID NO: 991586 - RNA, 21 nt, Homo sapiens
ggcuugggccuaggcugcauu

SEQ ID NO: 991587 - RNA, 16 nt, Homo sapiens
gggaacggacugguau

SEQ ID NO: 991588 - RNA, 21 nt, Homo sapiens
gggaacuggccaagcugaggu

SEQ ID NO: 991589 - RNA, 11 nt, Homo sapiens
gggaagacagu

SEQ ID NO: 991590 - RNA, 20 nt, Homo sapiens
gggacaaaggagccugugaa

SEQ ID NO: 991591 - RNA, 13 nt, Homo sapiens
gggagaacgggaa

SEQ ID NO: 991592 - RNA, 20 nt, Homo sapiens
gggagacacuggccccucaa

SEQ ID NO: 991593 - RNA, 19 nt, Homo sapiens
gggagacugggcugaggga

SEQ ID NO: 991594 - RNA, 21 nt, Homo sapiens
gggagauucaagggacccaug

SEQ ID NO: 991595 - RNA, 15 nt, Homo sapiens
gggagccauguuuca

SEQ ID NO: 991596 - RNA, 20 nt, Homo sapiens
gggauaccgucuccuugaag

SEQ ID NO: 991597 - RNA, 22 nt, Homo sapiens
gggauguucagcacugucccuu

SEQ ID NO: 991598 - RNA, 14 nt, Homo sapiens
gggcaacacaguga

SEQ ID NO: 991599 - RNA, 12 nt, Homo sapiens
gggcagagguaa

SEQ ID NO: 991600 - RNA, 22 nt, Homo sapiens
gggcaguucgcagccacccuga

SEQ ID NO: 991601 - RNA, 14 nt, Homo sapiens
gggccauguccaaa

SEQ ID NO: 991602 - RNA, 14 nt, Homo sapiens
gggcccagagccca

SEQ ID NO: 991603 - RNA, 15 nt, Homo sapiens
gggcccagcgcagug

SEQ ID NO: 991604 - RNA, 15 nt, Homo sapiens
gggcccccaucucau

SEQ ID NO: 991605 - RNA, 14 nt, Homo sapiens
gggccuaggcugca

SEQ ID NO: 991606 - RNA, 16 nt, Homo sapiens
gggccugaccaaacag

SEQ ID NO: 991607 - RNA, 14 nt, Homo sapiens
gggccugcugcuga

SEQ ID NO: 991608 - RNA, 15 nt, Homo sapiens
gggccugcugcugag

SEQ ID NO: 991609 - RNA, 23 nt, Homo sapiens
gggcucaggaggggaaguccagc

SEQ ID NO: 991610 - RNA, 15 nt, Homo sapiens
gggcuccauguagaa

SEQ ID NO: 991611 - RNA, 18 nt, Homo sapiens
gggcuccgugugggagac

SEQ ID NO: 991612 - RNA, 17 nt, Homo sapiens
gggcuccuccagggugu

SEQ ID NO: 991613 - RNA, 22 nt, Homo sapiens
gggcugacuccugcucucugga

SEQ ID NO: 991614 - RNA, 18 nt, Homo sapiens
ggggcaggcugggccaug

SEQ ID NO: 991615 - RNA, 15 nt, Homo sapiens
ggggccagauccagc

SEQ ID NO: 991616 - RNA, 21 nt, Homo sapiens
ggguacauggugcugggagag

SEQ ID NO: 991617 - RNA, 13 nt, Homo sapiens
gggucaacaucuu

SEQ ID NO: 991618 - RNA, 19 nt, Homo sapiens
gggucucgcuuuguugccc

SEQ ID NO: 991619 - RNA, 14 nt, Homo sapiens
gggugcagggaugu

SEQ ID NO: 991620 - RNA, 15 nt, Homo sapiens
gggugcuacugggga

SEQ ID NO: 991621 - RNA, 16 nt, Homo sapiens
gggugggguggcugca

SEQ ID NO: 991622 - RNA, 21 nt, Homo sapiens
ggguuaguuuacaaucagcca

SEQ ID NO: 991623 - RNA, 18 nt, Homo sapiens
gguaauuaguaacaugug

SEQ ID NO: 991624 - RNA, 16 nt, Homo sapiens
gguacgaugacagugu

SEQ ID NO: 991625 - RNA, 24 nt, Homo sapiens
gguagaauucuggcugguagagca

SEQ ID NO: 991626 - RNA, 22 nt, Homo sapiens
gguagccagcacacagggcagu

SEQ ID NO: 991627 - RNA, 20 nt, Homo sapiens
gguagggugggagugguuua

SEQ ID NO: 991628 - RNA, 18 nt, Homo sapiens
ggucacccuucaacgcuc

SEQ ID NO: 991629 - RNA, 15 nt, Homo sapiens
ggucacggcaaagga

SEQ ID NO: 991630 - RNA, 13 nt, Homo sapiens
ggucagcauguac

SEQ ID NO: 991631 - RNA, 18 nt, Homo sapiens
gguccccuccuucccaag

SEQ ID NO: 991632 - RNA, 15 nt, Homo sapiens
gguccugagcacugc

SEQ ID NO: 991633 - RNA, 21 nt, Homo sapiens
ggucuagucacgcaugcagug

SEQ ID NO: 991634 - RNA, 15 nt, Homo sapiens
ggucuguagggauuu

SEQ ID NO: 991635 - RNA, 20 nt, Homo sapiens
ggucuucaagacgacagcuc

SEQ ID NO: 991636 - RNA, 23 nt, Homo sapiens
ggugaaaguuaauccacugugac

SEQ ID NO: 991637 - RNA, 15 nt, Homo sapiens
ggugaggucuguucc

SEQ ID NO: 991638 - RNA, 14 nt, Homo sapiens
ggugaucugggauu

SEQ ID NO: 991639 - RNA, 18 nt, Homo sapiens
gguggaaacuuuucuuaa

SEQ ID NO: 991640 - RNA, 21 nt, Homo sapiens
ggugggcacuggauuaguuaa

SEQ ID NO: 991641 - RNA, 17 nt, Homo sapiens
gguuauagcuucaggag

SEQ ID NO: 991642 - RNA, 19 nt, Homo sapiens
gguucucagguguugccaa

SEQ ID NO: 991643 - RNA, 21 nt, Homo sapiens
gguugaacucugguggcacag

SEQ ID NO: 991644 - RNA, 17 nt, Homo sapiens
gguugagcucuucuuaa

SEQ ID NO: 991645 - RNA, 19 nt, Homo sapiens
gguuucauguuaguuaccu

SEQ ID NO: 991646 - RNA, 14 nt, Homo sapiens
guaaaagcaaaaaa

SEQ ID NO: 991647 - RNA, 19 nt, Homo sapiens
guaaaauacuuuuacucug

SEQ ID NO: 991648 - RNA, 15 nt, Homo sapiens
guaaaaugaaggaaa

SEQ ID NO: 991649 - RNA, 14 nt, Homo sapiens
guaaaauuauuuca

SEQ ID NO: 991650 - RNA, 20 nt, Homo sapiens
guaaagaacguggucagagu

SEQ ID NO: 991651 - RNA, 17 nt, Homo sapiens
guaacaauacaaaugga

SEQ ID NO: 991652 - RNA, 23 nt, Homo sapiens
guaacauacuggccuggacuguu

SEQ ID NO: 991653 - RNA, 16 nt, Homo sapiens
guaacucuaugaacuu

SEQ ID NO: 991654 - RNA, 22 nt, Homo sapiens
guaacugccuagaaacaacacu

SEQ ID NO: 991655 - RNA, 15 nt, Homo sapiens
guaagaaguuuuaaa

SEQ ID NO: 991656 - RNA, 14 nt, Homo sapiens
guaagagguguuau

SEQ ID NO: 991657 - RNA, 13 nt, Homo sapiens
guaauacaaacua

SEQ ID NO: 991658 - RNA, 16 nt, Homo sapiens
guaauacaucaaagag

SEQ ID NO: 991659 - RNA, 17 nt, Homo sapiens
guaauagauguuugaua

SEQ ID NO: 991660 - RNA, 13 nt, Homo sapiens
guaauagcuguaa

SEQ ID NO: 991661 - RNA, 23 nt, Homo sapiens
guaauucuaaaugaauguuuaca

SEQ ID NO: 991662 - RNA, 22 nt, Homo sapiens
guaauuuuguaucuugaugucu

SEQ ID NO: 991663 - RNA, 18 nt, Homo sapiens
guacaguagauuuuccaa

SEQ ID NO: 991664 - RNA, 18 nt, Homo sapiens
guaccaggugaacaaagu

SEQ ID NO: 991665 - RNA, 12 nt, Homo sapiens
guaccauuuaau

SEQ ID NO: 991666 - RNA, 14 nt, Homo sapiens
guacccucucagcu

SEQ ID NO: 991667 - RNA, 18 nt, Homo sapiens
guaccugcccccaaucca

SEQ ID NO: 991668 - RNA, 13 nt, Homo sapiens
guaccugugcacg

SEQ ID NO: 991669 - RNA, 12 nt, Homo sapiens
guacuaaagcca

SEQ ID NO: 991670 - RNA, 21 nt, Homo sapiens
guacugguuuauguggacaag

SEQ ID NO: 991671 - RNA, 16 nt, Homo sapiens
guacuguaugccuuca

SEQ ID NO: 991672 - RNA, 23 nt, Homo sapiens
guacuuugcugaaugucauuuua

SEQ ID NO: 991673 - RNA, 15 nt, Homo sapiens
guagaccacugccau

SEQ ID NO: 991674 - RNA, 23 nt, Homo sapiens
guagauauuggacaaagaaccuu

SEQ ID NO: 991675 - RNA, 23 nt, Homo sapiens
guagcagguuaccacucuggcag

SEQ ID NO: 991676 - RNA, 14 nt, Homo sapiens
guagcuacaggaca

SEQ ID NO: 991677 - RNA, 16 nt, Homo sapiens
guagcuacaggacauu

SEQ ID NO: 991678 - RNA, 14 nt, Homo sapiens
guaggaauugagga

SEQ ID NO: 991679 - RNA, 20 nt, Homo sapiens
guaguauggccugugucacu

SEQ ID NO: 991680 - RNA, 15 nt, Homo sapiens
guagugccacuguug

SEQ ID NO: 991681 - RNA, 11 nt, Homo sapiens
guaguuugugc

SEQ ID NO: 991682 - RNA, 19 nt, Homo sapiens
acuuucuguucuccagugu

SEQ ID NO: 991683 - RNA, 17 nt, Homo sapiens
acuuucuuuuuugauau

SEQ ID NO: 991684 - RNA, 14 nt, Homo sapiens
acuuugacaguguu

SEQ ID NO: 991685 - RNA, 13 nt, Homo sapiens
acuuugcugcuaa

SEQ ID NO: 991686 - RNA, 22 nt, Homo sapiens
acuuugguggccacauaagcca

SEQ ID NO: 991687 - RNA, 16 nt, Homo sapiens
acuuuuacucugccua

SEQ ID NO: 991688 - RNA, 18 nt, Homo sapiens
agaaaauggguuuauuca

SEQ ID NO: 991689 - RNA, 22 nt, Homo sapiens
agaaaauguucuguuugcugug

SEQ ID NO: 991690 - RNA, 19 nt, Homo sapiens
agaaaccagcuuccuucag

SEQ ID NO: 991691 - RNA, 18 nt, Homo sapiens
agaaacccuugcugcuuu

SEQ ID NO: 991692 - RNA, 23 nt, Homo sapiens
agaaacccuugcugcuuuagucc

SEQ ID NO: 991693 - RNA, 11 nt, Homo sapiens
agaaacuacug

SEQ ID NO: 991694 - RNA, 19 nt, Homo sapiens
agaaacucugccaacacug

SEQ ID NO: 991695 - RNA, 15 nt, Homo sapiens
agaaagaccaggcca

SEQ ID NO: 991696 - RNA, 15 nt, Homo sapiens
agaaagaucaaagac

SEQ ID NO: 991697 - RNA, 21 nt, Homo sapiens
agaaagccugaguacuccaca

SEQ ID NO: 991698 - RNA, 20 nt, Homo sapiens
agaaagcugcacuggugcua

SEQ ID NO: 991699 - RNA, 20 nt, Homo sapiens
agaaagggagggcucugagg

SEQ ID NO: 991700 - RNA, 23 nt, Homo sapiens
agaaagggguggaaacauaggga

SEQ ID NO: 991701 - RNA, 17 nt, Homo sapiens
agaaagguuuuauucua

SEQ ID NO: 991702 - RNA, 14 nt, Homo sapiens
agaaauagaauuau

SEQ ID NO: 991703 - RNA, 18 nt, Homo sapiens
agaaauauggacacuuaa

SEQ ID NO: 991704 - RNA, 19 nt, Homo sapiens
agaaauccaagcaccacca

SEQ ID NO: 991705 - RNA, 23 nt, Homo sapiens
agaaaucuggcuucuggccagga

SEQ ID NO: 991706 - RNA, 19 nt, Homo sapiens
agaaaucugugccugagaa

SEQ ID NO: 991707 - RNA, 18 nt, Homo sapiens
agaacauggccuaagggc

SEQ ID NO: 991708 - RNA, 19 nt, Homo sapiens
agaacaugguuaccauguc

SEQ ID NO: 991709 - RNA, 13 nt, Homo sapiens
agaaccacagggc

SEQ ID NO: 991710 - RNA, 19 nt, Homo sapiens
agaaccccugaaguauuuu

SEQ ID NO: 991711 - RNA, 15 nt, Homo sapiens
agaacguggugaccu

SEQ ID NO: 991712 - RNA, 20 nt, Homo sapiens
agaacuuccccucccuuccc

SEQ ID NO: 991713 - RNA, 17 nt, Homo sapiens
agaagccaucaccucag

SEQ ID NO: 991714 - RNA, 21 nt, Homo sapiens
agaagcccuguccuccacuca

SEQ ID NO: 991715 - RNA, 20 nt, Homo sapiens
agaagccugaugcugacauu

SEQ ID NO: 991716 - RNA, 18 nt, Homo sapiens
agaagccuuaauuugcac

SEQ ID NO: 991717 - RNA, 14 nt, Homo sapiens
agaaggcaaaaaug

SEQ ID NO: 991718 - RNA, 19 nt, Homo sapiens
agaauaccaccuaauccuu

SEQ ID NO: 991719 - RNA, 19 nt, Homo sapiens
agaauaucuguaaugguac

SEQ ID NO: 991720 - RNA, 17 nt, Homo sapiens
agaaucuugguuugccu

SEQ ID NO: 991721 - RNA, 22 nt, Homo sapiens
agaaugcacaagaauggaucac

SEQ ID NO: 991722 - RNA, 19 nt, Homo sapiens
agaauggcuuuggucucuu

SEQ ID NO: 991723 - RNA, 22 nt, Homo sapiens
agaauggcuuuggucucuugcu

SEQ ID NO: 991724 - RNA, 21 nt, Homo sapiens
agacaccuuggacauccuccu

SEQ ID NO: 991725 - RNA, 15 nt, Homo sapiens
ccucagccuugccag

SEQ ID NO: 991726 - RNA, 18 nt, Homo sapiens
ccucagccuugccagaga

SEQ ID NO: 991727 - RNA, 19 nt, Homo sapiens
ccucagccuugccagagau

SEQ ID NO: 991728 - RNA, 19 nt, Homo sapiens
ccucauccaugcugugcug

SEQ ID NO: 991729 - RNA, 18 nt, Homo sapiens
ccucaucucucugcccaa

SEQ ID NO: 991730 - RNA, 22 nt, Homo sapiens
ccucaugccuguaaucccagca

SEQ ID NO: 991731 - RNA, 15 nt, Homo sapiens
ccucauucuacugaa

SEQ ID NO: 991732 - RNA, 14 nt, Homo sapiens
ccuccaacaccaag

SEQ ID NO: 991733 - RNA, 15 nt, Homo sapiens
ccuccacccacugug

SEQ ID NO: 991734 - RNA, 16 nt, Homo sapiens
ccuccagaauggagcu

SEQ ID NO: 991735 - RNA, 16 nt, Homo sapiens
ccuccagcucccugug

SEQ ID NO: 991736 - RNA, 20 nt, Homo sapiens
ccucccaaagugcugagauu

SEQ ID NO: 991737 - RNA, 17 nt, Homo sapiens
ccucccagaaagcaaac

SEQ ID NO: 991738 - RNA, 16 nt, Homo sapiens
ccucccccccaugcac

SEQ ID NO: 991739 - RNA, 16 nt, Homo sapiens
ccucccuggaugacau

SEQ ID NO: 991740 - RNA, 20 nt, Homo sapiens
ccucccuggaugacauuaaa

SEQ ID NO: 991741 - RNA, 20 nt, Homo sapiens
ccucccuuccccuuuuccca

SEQ ID NO: 991742 - RNA, 18 nt, Homo sapiens
ccucccuuguggcagcaa

SEQ ID NO: 991743 - RNA, 14 nt, Homo sapiens
ccuccgcucuguag

SEQ ID NO: 991744 - RNA, 18 nt, Homo sapiens
ccuccuaaccuagagauu

SEQ ID NO: 991745 - RNA, 16 nt, Homo sapiens
ccuccucaggcacaca

SEQ ID NO: 991746 - RNA, 21 nt, Homo sapiens
ccucgugguggaaacuuuucu

SEQ ID NO: 991747 - RNA, 13 nt, Homo sapiens
ccucuacugggaa

SEQ ID NO: 991748 - RNA, 17 nt, Homo sapiens
ccucucaacacccaguu

SEQ ID NO: 991749 - RNA, 21 nt, Homo sapiens
ccucucaacacccaguuuccu

SEQ ID NO: 991750 - RNA, 15 nt, Homo sapiens
ccucucuacagucuc

SEQ ID NO: 991751 - RNA, 16 nt, Homo sapiens
ccucucucagugucaa

SEQ ID NO: 991752 - RNA, 12 nt, Homo sapiens
ccucugacucag

SEQ ID NO: 991753 - RNA, 13 nt, Homo sapiens
ccucugcuucuca

SEQ ID NO: 991754 - RNA, 21 nt, Homo sapiens
ccucuggcuuggccacagcca

SEQ ID NO: 991755 - RNA, 20 nt, Homo sapiens
ccucugucagucacagccac

SEQ ID NO: 991756 - RNA, 13 nt, Homo sapiens
ccucuucuacuca

SEQ ID NO: 991757 - RNA, 14 nt, Homo sapiens
ccugaagaaccagu

SEQ ID NO: 991758 - RNA, 19 nt, Homo sapiens
ccugagauucagaugucau

SEQ ID NO: 991759 - RNA, 21 nt, Homo sapiens
ccugagcccaaggcacugaga

SEQ ID NO: 991760 - RNA, 15 nt, Homo sapiens
ccugaggaagaugac

SEQ ID NO: 991761 - RNA, 23 nt, Homo sapiens
ccugaguggugccaaacaaaaag

SEQ ID NO: 991762 - RNA, 17 nt, Homo sapiens
ccugaguuggagcucau

SEQ ID NO: 991763 - RNA, 21 nt, Homo sapiens
ccugaucagagccgugguccu

SEQ ID NO: 991764 - RNA, 17 nt, Homo sapiens
ccugcaaaaggacucuc

SEQ ID NO: 991765 - RNA, 14 nt, Homo sapiens
ccugcaaaccuuaa

SEQ ID NO: 991766 - RNA, 15 nt, Homo sapiens
ccugcacagugacuu

SEQ ID NO: 991767 - RNA, 20 nt, Homo sapiens
ccugcaggcugagugcauuu

SEQ ID NO: 991768 - RNA, 15 nt, Homo sapiens
ccugcccccaaggag

SEQ ID NO: 991769 - RNA, 22 nt, Homo sapiens
ccugcccccuccagucccccac

SEQ ID NO: 991770 - RNA, 20 nt, Homo sapiens
ccugcgccaccgcccagaga

SEQ ID NO: 991771 - RNA, 23 nt, Homo sapiens
ccugcgggugaacaaagcagcca

SEQ ID NO: 991772 - RNA, 15 nt, Homo sapiens
ccugcuacaccuauu

SEQ ID NO: 991773 - RNA, 18 nt, Homo sapiens
ccugcucagcccugcacc

SEQ ID NO: 991774 - RNA, 20 nt, Homo sapiens
ccugcucagcccugcaccau

SEQ ID NO: 991775 - RNA, 24 nt, Homo sapiens
ccugcucagcccugcaccaugcug

SEQ ID NO: 991776 - RNA, 16 nt, Homo sapiens
ccugcuuugggaagcc

SEQ ID NO: 991777 - RNA, 12 nt, Homo sapiens
ccuggaugacau

SEQ ID NO: 991778 - RNA, 11 nt, Homo sapiens
ccuggccagug

SEQ ID NO: 991779 - RNA, 15 nt, Homo sapiens
ccuggccgaguccaa

SEQ ID NO: 991780 - RNA, 19 nt, Homo sapiens
ccuggcuaagaucaugucu

SEQ ID NO: 991781 - RNA, 19 nt, Homo sapiens
ccuggcuggcugagggcag

SEQ ID NO: 991782 - RNA, 14 nt, Homo sapiens
ccugggcaaagccu

SEQ ID NO: 991783 - RNA, 17 nt, Homo sapiens
ccugggcaacacaguga

SEQ ID NO: 991784 - RNA, 19 nt, Homo sapiens
ccugggguucuuuuugcca

SEQ ID NO: 991785 - RNA, 16 nt, Homo sapiens
ccuggguggcuacucu

SEQ ID NO: 991786 - RNA, 19 nt, Homo sapiens
ccugguagaccacugccau

SEQ ID NO: 991787 - RNA, 20 nt, Homo sapiens
ccugguccccuccuucccaa

SEQ ID NO: 991788 - RNA, 16 nt, Homo sapiens
ccuggugccaccucag

SEQ ID NO: 991789 - RNA, 21 nt, Homo sapiens
ccuguaaacuuuaucacuuaa

SEQ ID NO: 991790 - RNA, 15 nt, Homo sapiens
ccuguccagcuccaa

SEQ ID NO: 991791 - RNA, 23 nt, Homo sapiens
ccuguccuccaacaccaagcaca

SEQ ID NO: 991792 - RNA, 13 nt, Homo sapiens
ccugugaaugcca

SEQ ID NO: 991793 - RNA, 13 nt, Homo sapiens
ccugugacuggca

SEQ ID NO: 991794 - RNA, 14 nt, Homo sapiens
ccugugcauuuucu

SEQ ID NO: 991795 - RNA, 16 nt, Homo sapiens
ccugugcccaccaguu

SEQ ID NO: 991796 - RNA, 17 nt, Homo sapiens
ccugugcuacaauucau

SEQ ID NO: 991797 - RNA, 22 nt, Homo sapiens
ccuguggccaugacccugccuc

SEQ ID NO: 991798 - RNA, 21 nt, Homo sapiens
ccuguguguccaaaacugccu

SEQ ID NO: 991799 - RNA, 23 nt, Homo sapiens
ccuguuccccagagaaaggggag

SEQ ID NO: 991800 - RNA, 16 nt, Homo sapiens
ccuguucuaugccuuu

SEQ ID NO: 991801 - RNA, 12 nt, Homo sapiens
uauauauugaau

SEQ ID NO: 991802 - RNA, 20 nt, Homo sapiens
uauauauuuuugugcacauu

SEQ ID NO: 991803 - RNA, 21 nt, Homo sapiens
uauauauuuuugugcacauuu

SEQ ID NO: 991804 - RNA, 17 nt, Homo sapiens
uauaucacaaucucugu

SEQ ID NO: 991805 - RNA, 21 nt, Homo sapiens
uauauugcuuaccugaucuca

SEQ ID NO: 991806 - RNA, 19 nt, Homo sapiens
uauauuugaaguggagcca

SEQ ID NO: 991807 - RNA, 17 nt, Homo sapiens
uaucacagaaaagcaug

SEQ ID NO: 991808 - RNA, 23 nt, Homo sapiens
uaucagccgauaucaacacuugu

SEQ ID NO: 991809 - RNA, 19 nt, Homo sapiens
uaucauuuauccuuacauu

SEQ ID NO: 991810 - RNA, 14 nt, Homo sapiens
uauccagccuccca

SEQ ID NO: 991811 - RNA, 14 nt, Homo sapiens
uaucccuacaugua

SEQ ID NO: 991812 - RNA, 23 nt, Homo sapiens
uauccuguuugaggaaagcaaga

SEQ ID NO: 991813 - RNA, 16 nt, Homo sapiens
uaucucaaacuacugg

SEQ ID NO: 991814 - RNA, 17 nt, Homo sapiens
uaucugacagagcauca

SEQ ID NO: 991815 - RNA, 11 nt, Homo sapiens
uaucugugaaa

SEQ ID NO: 991816 - RNA, 13 nt, Homo sapiens
uaucuguguauau

SEQ ID NO: 991817 - RNA, 19 nt, Homo sapiens
uaucugugugugauuugcu

SEQ ID NO: 991818 - RNA, 17 nt, Homo sapiens
uaucuucucaaguucua

SEQ ID NO: 991819 - RNA, 16 nt, Homo sapiens
uaucuugcaccccaaa

SEQ ID NO: 991820 - RNA, 20 nt, Homo sapiens
uaugaaugugaagccuuccc

SEQ ID NO: 991821 - RNA, 16 nt, Homo sapiens
uaugacaagcuuucca

SEQ ID NO: 991822 - RNA, 16 nt, Homo sapiens
uaugcaaaagcaagcu

SEQ ID NO: 991823 - RNA, 20 nt, Homo sapiens
uaugcaaagaugaacccgag

SEQ ID NO: 991824 - RNA, 22 nt, Homo sapiens
uaugcagggagcugggcuucca

SEQ ID NO: 991825 - RNA, 17 nt, Homo sapiens
uaugcucuuaauugcca

SEQ ID NO: 991826 - RNA, 15 nt, Homo sapiens
uaugguuuuguggau

SEQ ID NO: 991827 - RNA, 18 nt, Homo sapiens
uauguacauuucucaggc

SEQ ID NO: 991828 - RNA, 16 nt, Homo sapiens
uauguaccaagaaucu

SEQ ID NO: 991829 - RNA, 16 nt, Homo sapiens
uccagucccucccuca

SEQ ID NO: 991830 - RNA, 20 nt, Homo sapiens
uccaucuuuacaaaacuaca

SEQ ID NO: 991831 - RNA, 11 nt, Homo sapiens
uccaugcugug

SEQ ID NO: 991832 - RNA, 20 nt, Homo sapiens
uccauggcaggaaggcuugu

SEQ ID NO: 991833 - RNA, 19 nt, Homo sapiens
uccauggccagcagcaccu

SEQ ID NO: 991834 - RNA, 18 nt, Homo sapiens
uccaugggaccacaacua

SEQ ID NO: 991835 - RNA, 16 nt, Homo sapiens
uccauguaacugccua

SEQ ID NO: 991836 - RNA, 11 nt, Homo sapiens
uccaugucucg

SEQ ID NO: 991837 - RNA, 22 nt, Homo sapiens
uccauguuugcaccugugcauu

SEQ ID NO: 991838 - RNA, 14 nt, Homo sapiens
uccauucuccugag

SEQ ID NO: 991839 - RNA, 16 nt, Homo sapiens
uccauugcucuugagu

SEQ ID NO: 991840 - RNA, 20 nt, Homo sapiens
uccauuuccccuccuuccca

SEQ ID NO: 991841 - RNA, 20 nt, Homo sapiens
ucccaaagugcugagauuac

SEQ ID NO: 991842 - RNA, 21 nt, Homo sapiens
ucccaacucuugcacagucac

SEQ ID NO: 991843 - RNA, 16 nt, Homo sapiens
ucccacuccaagccca

SEQ ID NO: 991844 - RNA, 17 nt, Homo sapiens
ucccacucuucuugcag

SEQ ID NO: 991845 - RNA, 20 nt, Homo sapiens
ucccagaggggccugccacc

SEQ ID NO: 991846 - RNA, 18 nt, Homo sapiens
ucccagcccccugaccac

SEQ ID NO: 991847 - RNA, 14 nt, Homo sapiens
ucccaggaccaaga

SEQ ID NO: 991848 - RNA, 22 nt, Homo sapiens
ucccauuuuugcuuagcucaau

SEQ ID NO: 991849 - RNA, 21 nt, Homo sapiens
uccccagcccagagacauacu

SEQ ID NO: 991850 - RNA, 12 nt, Homo sapiens
uccccaucucag

SEQ ID NO: 991851 - RNA, 22 nt, Homo sapiens
ucccccuauuuauugacuuuga

SEQ ID NO: 991852 - RNA, 14 nt, Homo sapiens
uccccucaccuccu

SEQ ID NO: 991853 - RNA, 14 nt, Homo sapiens
uccccuccagcucc

SEQ ID NO: 991854 - RNA, 16 nt, Homo sapiens
uccccuccuucccaag

SEQ ID NO: 991855 - RNA, 16 nt, Homo sapiens
uccccugaccugugag

SEQ ID NO: 991856 - RNA, 20 nt, Homo sapiens
uccccugccugcccugguga

SEQ ID NO: 991857 - RNA, 17 nt, Homo sapiens
uccccugcuacaccuau

SEQ ID NO: 991858 - RNA, 21 nt, Homo sapiens
uccccuggggagucugggcac

SEQ ID NO: 991859 - RNA, 19 nt, Homo sapiens
uccccuucuucuccaucuc

SEQ ID NO: 991860 - RNA, 12 nt, Homo sapiens
uccccuugccug

SEQ ID NO: 991861 - RNA, 20 nt, Homo sapiens
ucccgccaacgcaucacugg

SEQ ID NO: 991862 - RNA, 21 nt, Homo sapiens
uguugcccaggcuggucucaa

SEQ ID NO: 991863 - RNA, 12 nt, Homo sapiens
uguuggcugugg

SEQ ID NO: 991864 - RNA, 19 nt, Homo sapiens
uguugucaccagaucugau

SEQ ID NO: 991865 - RNA, 18 nt, Homo sapiens
uguuuacagacgugugca

SEQ ID NO: 991866 - RNA, 17 nt, Homo sapiens
uguuuauacacugugua

SEQ ID NO: 991867 - RNA, 19 nt, Homo sapiens
uguuucacaguuugaaaua

SEQ ID NO: 991868 - RNA, 21 nt, Homo sapiens
uguuucuuucucugaggacaa

SEQ ID NO: 991869 - RNA, 18 nt, Homo sapiens
uguuugauuucaacauga

SEQ ID NO: 991870 - RNA, 15 nt, Homo sapiens
uguuuggccucucua

SEQ ID NO: 991871 - RNA, 22 nt, Homo sapiens
uguuuucgaaaaucaaauggua

SEQ ID NO: 991872 - RNA, 20 nt, Homo sapiens
uguuuuuucagucugugaaa

SEQ ID NO: 991873 - RNA, 16 nt, Homo sapiens
uuaaaaagcacagggg

SEQ ID NO: 991874 - RNA, 20 nt, Homo sapiens
uuaaaaagguuuacagaauu

SEQ ID NO: 991875 - RNA, 16 nt, Homo sapiens
uuaaaaauagacacuc

SEQ ID NO: 991876 - RNA, 17 nt, Homo sapiens
uuaaaagacacacuugu

SEQ ID NO: 991877 - RNA, 18 nt, Homo sapiens
uuaaaccuuaagauacua

SEQ ID NO: 991878 - RNA, 18 nt, Homo sapiens
uuaaacuugcaucacuua

SEQ ID NO: 991879 - RNA, 16 nt, Homo sapiens
uuaaagaaagaagugu

SEQ ID NO: 991880 - RNA, 13 nt, Homo sapiens
uuaaagaaagugu

SEQ ID NO: 991881 - RNA, 13 nt, Homo sapiens
uuaaagagucuag

SEQ ID NO: 991882 - RNA, 20 nt, Homo sapiens
uuaaagcaucuauaaggugc

SEQ ID NO: 991883 - RNA, 13 nt, Homo sapiens
uuaaagccuccuc

SEQ ID NO: 991884 - RNA, 15 nt, Homo sapiens
uuaaauaagauucua

SEQ ID NO: 991885 - RNA, 21 nt, Homo sapiens
uuaaauaggcggggcuugccu

SEQ ID NO: 991886 - RNA, 21 nt, Homo sapiens
uuaaaucaacgaguacuucaa

SEQ ID NO: 991887 - RNA, 19 nt, Homo sapiens
uuaacaguuguauuuaaca

SEQ ID NO: 991888 - RNA, 23 nt, Homo sapiens
uuaacauuaucuaguucauugaa

SEQ ID NO: 991889 - RNA, 17 nt, Homo sapiens
uuaacauuccucaugaa

SEQ ID NO: 991890 - RNA, 19 nt, Homo sapiens
uuaacuggucuccuugcuu

SEQ ID NO: 991891 - RNA, 21 nt, Homo sapiens
uuaacuuuucuaacagaaagc

SEQ ID NO: 991892 - RNA, 18 nt, Homo sapiens
uuaagaccuggcagcucu

SEQ ID NO: 991893 - RNA, 14 nt, Homo sapiens
uuaagaguccaaga

SEQ ID NO: 991894 - RNA, 16 nt, Homo sapiens
uuaauaaaccuuugca

SEQ ID NO: 991895 - RNA, 20 nt, Homo sapiens
uuaauacagggcauuuuggu

SEQ ID NO: 991896 - RNA, 13 nt, Homo sapiens
uuaauauacuaga

SEQ ID NO: 991897 - RNA, 18 nt, Homo sapiens
uuaauuuuuauuucuucc

SEQ ID NO: 991898 - RNA, 23 nt, Homo sapiens
uuacaaaacaaacucauucauua

SEQ ID NO: 991899 - RNA, 20 nt, Homo sapiens
uuacaaucagccacauucua

SEQ ID NO: 991900 - RNA, 20 nt, Homo sapiens
uuacaaucuguuuuagacau

SEQ ID NO: 991901 - RNA, 17 nt, Homo sapiens
uuacacugugucauucu

SEQ ID NO: 991902 - RNA, 19 nt, Homo sapiens
uuacauuuacaaacugaag

SEQ ID NO: 991903 - RNA, 19 nt, Homo sapiens
uuacauuuuaaacacauua

SEQ ID NO: 991904 - RNA, 20 nt, Homo sapiens
uuaccaggcaccaaaagaag

SEQ ID NO: 991905 - RNA, 15 nt, Homo sapiens
uuaccugagagauuu

SEQ ID NO: 991906 - RNA, 18 nt, Homo sapiens
uuacuauuucacaacagc

SEQ ID NO: 991907 - RNA, 14 nt, Homo sapiens
uuacucagguuuga

SEQ ID NO: 991908 - RNA, 15 nt, Homo sapiens
uuacugcucugagaa

SEQ ID NO: 991909 - RNA, 10 nt, Homo sapiens
uuacuguaac

SEQ ID NO: 991910 - RNA, 19 nt, Homo sapiens
uuacuucauauuguugcau

SEQ ID NO: 991911 - RNA, 16 nt, Homo sapiens
uuagaaacagugcaac

SEQ ID NO: 991912 - RNA, 19 nt, Homo sapiens
uuagaaauaaagcaucuca

SEQ ID NO: 991913 - RNA, 18 nt, Homo sapiens
uuagaagccaacuaugau

SEQ ID NO: 991914 - RNA, 15 nt, Homo sapiens
uuagacccugcauuu

SEQ ID NO: 991915 - RNA, 17 nt, Homo sapiens
uuagagugucuuuccac

SEQ ID NO: 991916 - RNA, 23 nt, Homo sapiens
uuccaacucgaaucugugugaaa

SEQ ID NO: 991917 - RNA, 14 nt, Homo sapiens
uuccaagagucuaa

SEQ ID NO: 991918 - RNA, 14 nt, Homo sapiens
uuccaaucaugaaa

SEQ ID NO: 991919 - RNA, 15 nt, Homo sapiens
uuccacagaggacac

SEQ ID NO: 991920 - RNA, 19 nt, Homo sapiens
uuccaccaaaugugcuuug

SEQ ID NO: 991921 - RNA, 13 nt, Homo sapiens
uuccacucaaaau

SEQ ID NO: 991922 - RNA, 17 nt, Homo sapiens
uuccagcuagugaccca

SEQ ID NO: 991923 - RNA, 21 nt, Homo sapiens
uuccagguagcugaaagggga

SEQ ID NO: 991924 - RNA, 16 nt, Homo sapiens
uuccaugggaccacaa

SEQ ID NO: 991925 - RNA, 16 nt, Homo sapiens
uuccauugguccaaga

SEQ ID NO: 991926 - RNA, 17 nt, Homo sapiens
uucccacaggacauuuc

SEQ ID NO: 991927 - RNA, 16 nt, Homo sapiens
uucccauuuuugcuua

SEQ ID NO: 991928 - RNA, 12 nt, Homo sapiens
uucccccaguca

SEQ ID NO: 991929 - RNA, 19 nt, Homo sapiens
uuccccuuuucccaaccug

SEQ ID NO: 991930 - RNA, 23 nt, Homo sapiens
uucccuacugaagcccuugugaa

SEQ ID NO: 991931 - RNA, 15 nt, Homo sapiens
uucccuaucacugaa

SEQ ID NO: 991932 - RNA, 15 nt, Homo sapiens
uucccucuugcucag

SEQ ID NO: 991933 - RNA, 22 nt, Homo sapiens
uuccuagaggugugcuauacca

SEQ ID NO: 991934 - RNA, 16 nt, Homo sapiens
uuccucagcugugugg

SEQ ID NO: 991935 - RNA, 16 nt, Homo sapiens
uuccucaugaauguaa

SEQ ID NO: 991936 - RNA, 23 nt, Homo sapiens
uuccucccagcauaggauucauu

SEQ ID NO: 991937 - RNA, 21 nt, Homo sapiens
uuccugcaacucaaggacuuu

SEQ ID NO: 991938 - RNA, 21 nt, Homo sapiens
uuccugguagaccacugccau

SEQ ID NO: 991939 - RNA, 13 nt, Homo sapiens
uuccuggugcugg

SEQ ID NO: 991940 - RNA, 13 nt, Homo sapiens
uuccuguugucaa

SEQ ID NO: 991941 - RNA, 21 nt, Homo sapiens
uuccuucaugaucaucacaau

SEQ ID NO: 991942 - RNA, 20 nt, Homo sapiens
uuccuuuuuaauaugcuuaa

SEQ ID NO: 991943 - RNA, 14 nt, Homo sapiens
uucggauccaggga

SEQ ID NO: 991944 - RNA, 21 nt, Homo sapiens
uucguuuuuuuaaaucacaag

SEQ ID NO: 991945 - RNA, 22 nt, Homo sapiens
uucuaaagauucuauaguucua

SEQ ID NO: 991946 - RNA, 14 nt, Homo sapiens
uucuaaaguucuaa

SEQ ID NO: 991947 - RNA, 14 nt, Homo sapiens
uucuaagauucuaa

SEQ ID NO: 991948 - RNA, 22 nt, Homo sapiens
uucuaaggaccugaaauuccaa

SEQ ID NO: 991949 - RNA, 21 nt, Homo sapiens
uucuaaggcucugagagucua

SEQ ID NO: 991950 - RNA, 20 nt, Homo sapiens
uucuauaauuuugccuuuaa

SEQ ID NO: 991951 - RNA, 21 nt, Homo sapiens
uucuauuuauauguacaugag

SEQ ID NO: 991952 - RNA, 15 nt, Homo sapiens
uucucaaguucuaag

SEQ ID NO: 991953 - RNA, 21 nt, Homo sapiens
uucucaaguucuaagauucua

SEQ ID NO: 991954 - RNA, 17 nt, Homo sapiens
uucucaauuccaacagu

SEQ ID NO: 991955 - RNA, 21 nt, Homo sapiens
uucucagguguugccaaauau

SEQ ID NO: 991956 - RNA, 18 nt, Homo sapiens
uucucauaccuuccccac

SEQ ID NO: 991957 - RNA, 16 nt, Homo sapiens
uucucgcauuguagaa

SEQ ID NO: 991958 - RNA, 15 nt, Homo sapiens
uucucugccagugac

SEQ ID NO: 991959 - RNA, 14 nt, Homo sapiens
uucucugguaauau

SEQ ID NO: 991960 - RNA, 18 nt, Homo sapiens
uucucugugcaguagcau

SEQ ID NO: 991961 - RNA, 15 nt, Homo sapiens
uucucuuacaaucug

SEQ ID NO: 991962 - RNA, 14 nt, Homo sapiens
uucucuuugccuca

SEQ ID NO: 991963 - RNA, 18 nt, Homo sapiens
uucugaggugcacuggga

SEQ ID NO: 991964 - RNA, 19 nt, Homo sapiens
uucugccuuugccagguga

SEQ ID NO: 991965 - RNA, 13 nt, Homo sapiens
uucuggacaggau

SEQ ID NO: 991966 - RNA, 18 nt, Homo sapiens
uucugguuguuaugugau

SEQ ID NO: 991967 - RNA, 17 nt, Homo sapiens
uucuuaagggcacacac

SEQ ID NO: 991968 - RNA, 15 nt, Homo sapiens
uuguaagcacugacu

SEQ ID NO: 991969 - RNA, 17 nt, Homo sapiens
uuguauuaucaacagca

SEQ ID NO: 991970 - RNA, 22 nt, Homo sapiens
uugucagggaguguucccuauc

SEQ ID NO: 991971 - RNA, 19 nt, Homo sapiens
uugucauugaaauuuggca

SEQ ID NO: 991972 - RNA, 18 nt, Homo sapiens
uuguccccacuuacagau

SEQ ID NO: 991973 - RNA, 20 nt, Homo sapiens
uugucucuagagcagggauu

SEQ ID NO: 991974 - RNA, 17 nt, Homo sapiens
uugucucugaugcagcu

SEQ ID NO: 991975 - RNA, 22 nt, Homo sapiens
uugucugaacuugcauugugau

SEQ ID NO: 991976 - RNA, 21 nt, Homo sapiens
uugucuggcaaggacuuugua

SEQ ID NO: 991977 - RNA, 20 nt, Homo sapiens
uugugaguuuaccuuguaua

SEQ ID NO: 991978 - RNA, 16 nt, Homo sapiens
uugugauaugcacaau

SEQ ID NO: 991979 - RNA, 19 nt, Homo sapiens
uugugauuagacagaacac

SEQ ID NO: 991980 - RNA, 21 nt, Homo sapiens
uugugccaaauuauucuccua

SEQ ID NO: 991981 - RNA, 16 nt, Homo sapiens
uuguguauccaugcac

SEQ ID NO: 991982 - RNA, 21 nt, Homo sapiens
uugugugugaugugaagccaa

SEQ ID NO: 991983 - RNA, 17 nt, Homo sapiens
uuguguuaccuguagau

SEQ ID NO: 991984 - RNA, 15 nt, Homo sapiens
uuguuauccuguaua

SEQ ID NO: 991985 - RNA, 16 nt, Homo sapiens
uuguuccccacuggag

SEQ ID NO: 991986 - RNA, 12 nt, Homo sapiens
uuguucucagaa

SEQ ID NO: 991987 - RNA, 16 nt, Homo sapiens
uuguuguccuuuucau

SEQ ID NO: 991988 - RNA, 22 nt, Homo sapiens
uuguuuaauuuuuauuucuucc

SEQ ID NO: 991989 - RNA, 12 nt, Homo sapiens
uuguuugcuuac

SEQ ID NO: 991990 - RNA, 14 nt, Homo sapiens
uuguuuggugaauu

SEQ ID NO: 991991 - RNA, 21 nt, Homo sapiens
uuguuuuaugcucagggucaa

SEQ ID NO: 991992 - RNA, 23 nt, Homo sapiens
uuuaaaaaaccacauggcacaga

SEQ ID NO: 991993 - RNA, 13 nt, Homo sapiens
uuuaaaaagcaaa

SEQ ID NO: 991994 - RNA, 16 nt, Homo sapiens
uuuaaacuauaagcaa

SEQ ID NO: 991995 - RNA, 17 nt, Homo sapiens
uuuaacagaaacuuuca

SEQ ID NO: 991996 - RNA, 16 nt, Homo sapiens
uuuaacauacaaucau

SEQ ID NO: 991997 - RNA, 21 nt, Homo sapiens
uuuaagggaaggggaaggaua

SEQ ID NO: 991998 - RNA, 12 nt, Homo sapiens
uuuaauagcaaa

SEQ ID NO: 991999 - RNA, 14 nt, Homo sapiens
uuuaauagcaaaga

SEQ ID NO: 992000 - RNA, 15 nt, Homo sapiens
uuuaauccuaccuca

SEQ ID NO: 992001 - RNA, 16 nt, Homo sapiens
uuuaauccuaccucaa

SEQ ID NO: 992002 - RNA, 20 nt, Homo sapiens
uuuacaaaacuacaugagaa

SEQ ID NO: 992003 - RNA, 23 nt, Homo sapiens
uuuacagaaucaaaugcaauuuu

SEQ ID NO: 992004 - RNA, 12 nt, Homo sapiens
uuuacagaauuu

SEQ ID NO: 992005 - RNA, 14 nt, Homo sapiens
uuuacagaauuuua

SEQ ID NO: 992006 - RNA, 17 nt, Homo sapiens
uuuaccaguugccuuuu

SEQ ID NO: 992007 - RNA, 21 nt, Homo sapiens
uuuaccugaaauaaaauucau

SEQ ID NO: 992008 - RNA, 17 nt, Homo sapiens
uuuaccuuauguuuaau

SEQ ID NO: 992009 - RNA, 14 nt, Homo sapiens
uuuagaacagggaa

SEQ ID NO: 992010 - RNA, 18 nt, Homo sapiens
uuuagacccugcauuuau

SEQ ID NO: 992011 - RNA, 21 nt, Homo sapiens
uuuagaccuguguuacuaaaa

SEQ ID NO: 992012 - RNA, 18 nt, Homo sapiens
uuuagauuuucuuuugcc

SEQ ID NO: 992013 - RNA, 12 nt, Homo sapiens
uuuagcucugag

SEQ ID NO: 992014 - RNA, 12 nt, Homo sapiens
uuuagggagaac

SEQ ID NO: 992015 - RNA, 17 nt, Homo sapiens
uuuauaggcauaccucc

SEQ ID NO: 992016 - RNA, 17 nt, Homo sapiens
uuuauauguacaugaga

SEQ ID NO: 992017 - RNA, 20 nt, Homo sapiens
uuuaucauucaaguguaaaa

SEQ ID NO: 992018 - RNA, 17 nt, Homo sapiens
uuuaugagaaacuuaaa

SEQ ID NO: 992019 - RNA, 14 nt, Homo sapiens
uuuauuaauauaua

SEQ ID NO: 992020 - RNA, 15 nt, Homo sapiens
uuucaaucaacuuua

SEQ ID NO: 992021 - RNA, 13 nt, Homo sapiens
uuucaccauuuga

SEQ ID NO: 992022 - RNA, 16 nt, Homo sapiens
uuucacuggagcacaa

SEQ ID NO: 992023 - RNA, 18 nt, Homo sapiens
uuucagguuccaaucaga

SEQ ID NO: 992024 - RNA, 18 nt, Homo sapiens
uuucauugaugagcaaga

SEQ ID NO: 992025 - RNA, 17 nt, Homo sapiens
uuucauuuaucuauaau

SEQ ID NO: 992026 - RNA, 14 nt, Homo sapiens
uuucccaacacaaa

SEQ ID NO: 992027 - RNA, 17 nt, Homo sapiens
uuucccacgaggaaucu

SEQ ID NO: 992028 - RNA, 15 nt, Homo sapiens
uuucccauuuaucua

SEQ ID NO: 992029 - RNA, 15 nt, Homo sapiens
uuuccccagugacac

SEQ ID NO: 992030 - RNA, 19 nt, Homo sapiens
uuuccccagugacaccuca

SEQ ID NO: 992031 - RNA, 21 nt, Homo sapiens
uuuccccgacuggggcagggu

SEQ ID NO: 992032 - RNA, 15 nt, Homo sapiens
uuuccgaaaucagaa

SEQ ID NO: 992033 - RNA, 20 nt, Homo sapiens
uuuccuggucagcauguacu

SEQ ID NO: 992034 - RNA, 13 nt, Homo sapiens
uuuccuugcaaau

SEQ ID NO: 992035 - RNA, 22 nt, Homo sapiens
uuucuacuuugaagucauacca

SEQ ID NO: 992036 - RNA, 18 nt, Homo sapiens
uuucuauuaaaaguggga

SEQ ID NO: 992037 - RNA, 18 nt, Homo sapiens
uuucuauuuuauuaugaa

SEQ ID NO: 992038 - RNA, 12 nt, Homo sapiens
uuucuggcucuu

SEQ ID NO: 992039 - RNA, 16 nt, Homo sapiens
uuucuuagugugccaa

SEQ ID NO: 992040 - RNA, 14 nt, Homo sapiens
uuucuucaccaaau

SEQ ID NO: 992041 - RNA, 19 nt, Homo sapiens
uuugaacccuugcuugcaa

SEQ ID NO: 992042 - RNA, 18 nt, Homo sapiens
uuugacccuugcugugaa

SEQ ID NO: 992043 - RNA, 23 nt, Homo sapiens
uuugagauauuaaugcccagaca

SEQ ID NO: 992044 - RNA, 17 nt, Homo sapiens
uuugauuaaagacucca

SEQ ID NO: 992045 - RNA, 14 nt, Homo sapiens
uuugauugauuuga

SEQ ID NO: 992046 - RNA, 13 nt, Homo sapiens
uuugcaacuuaau

SEQ ID NO: 992047 - RNA, 18 nt, Homo sapiens
uuugcaucucaguaugaa

SEQ ID NO: 992048 - RNA, 15 nt, Homo sapiens
uuugcauguuuugua

SEQ ID NO: 992049 - RNA, 13 nt, Homo sapiens
uuugccaggugac

SEQ ID NO: 992050 - RNA, 16 nt, Homo sapiens
uuuggaaagacuggac

SEQ ID NO: 992051 - RNA, 15 nt, Homo sapiens
uuuggagagugcuau

SEQ ID NO: 992052 - RNA, 14 nt, Homo sapiens
uuugggccagacau

SEQ ID NO: 992053 - RNA, 13 nt, Homo sapiens
uuugguuugaccc

SEQ ID NO: 992054 - RNA, 22 nt, Homo sapiens
uuugucccggggcuccacugaa

SEQ ID NO: 992055 - RNA, 16 nt, Homo sapiens
uuugugaugcaaauaa

SEQ ID NO: 992056 - RNA, 22 nt, Homo sapiens
uuuguggccuuggcugacauga

SEQ ID NO: 992057 - RNA, 17 nt, Homo sapiens
uuuguugacauuagucu

SEQ ID NO: 992058 - RNA, 14 nt, Homo sapiens
uuuuaacaugucaa

SEQ ID NO: 992059 - RNA, 15 nt, Homo sapiens
uuuuaauccuaccuc

SEQ ID NO: 992060 - RNA, 23 nt, Homo sapiens
uuuuacaauaaaacuuugcugcc

SEQ ID NO: 992061 - RNA, 15 nt, Homo sapiens
uuuuauuaugcauua

SEQ ID NO: 992062 - RNA, 22 nt, Homo sapiens
uuuuauugcuucuuuuuggaga

SEQ ID NO: 992063 - RNA, 23 nt, Homo sapiens
uuuucaauguuagccacagugua

SEQ ID NO: 992064 - RNA, 13 nt, Homo sapiens
uuuucaccccacc

SEQ ID NO: 992065 - RNA, 14 nt, Homo sapiens
uuuucagaugugaa

SEQ ID NO: 992066 - RNA, 14 nt, Homo sapiens
uuuuccccagacuu

SEQ ID NO: 992067 - RNA, 17 nt, Homo sapiens
uuuucccuuugccuuca

SEQ ID NO: 992068 - RNA, 21 nt, Homo sapiens
uuuucuaagaaagaaauugua

SEQ ID NO: 992069 - RNA, 20 nt, Homo sapiens
uuuucuauuaaaagacucau

SEQ ID NO: 992070 - RNA, 19 nt, Homo sapiens
uuuucuugccuugguuguc

SEQ ID NO: 992071 - RNA, 16 nt, Homo sapiens
uuuugaaaaugggcuc

SEQ ID NO: 992072 - RNA, 21 nt, Homo sapiens
aaauucauuaguuguuaguga

SEQ ID NO: 992073 - RNA, 15 nt, Homo sapiens
aaauuguauuaucaa

SEQ ID NO: 992074 - RNA, 19 nt, Homo sapiens
aaauuuaacaguuaccuga

SEQ ID NO: 992075 - RNA, 20 nt, Homo sapiens
aacaaaaauuaaaauccuca

SEQ ID NO: 992076 - RNA, 14 nt, Homo sapiens
aacaaacaaugaaa

SEQ ID NO: 992077 - RNA, 13 nt, Homo sapiens
aacaaagaacuga

SEQ ID NO: 992078 - RNA, 20 nt, Homo sapiens
aacaaagaugccacauucaa

SEQ ID NO: 992079 - RNA, 16 nt, Homo sapiens
aacaaagcagccacga

SEQ ID NO: 992080 - RNA, 15 nt, Homo sapiens
aacaaauguauuuca

SEQ ID NO: 992081 - RNA, 16 nt, Homo sapiens
aacaaauguauuucaa

SEQ ID NO: 992082 - RNA, 23 nt, Homo sapiens
aacaaauguuuauuaagcaucag

SEQ ID NO: 992083 - RNA, 24 nt, Homo sapiens
aacaaauguuuauuaagcaucaga

SEQ ID NO: 992084 - RNA, 20 nt, Homo sapiens
aacaacguugacaaguuuug

SEQ ID NO: 992085 - RNA, 23 nt, Homo sapiens
aacaagguccucugucagucaca

SEQ ID NO: 992086 - RNA, 21 nt, Homo sapiens
aacacacaggugcaacagacu

SEQ ID NO: 992087 - RNA, 14 nt, Homo sapiens
aacaccaagcacag

SEQ ID NO: 992088 - RNA, 16 nt, Homo sapiens
aacaccaccucuccag

SEQ ID NO: 992089 - RNA, 14 nt, Homo sapiens
aacacggugcucau

SEQ ID NO: 992090 - RNA, 24 nt, Homo sapiens
aacacucaguggcccauggcauuu

SEQ ID NO: 992091 - RNA, 15 nt, Homo sapiens
aacacucaugaagca

SEQ ID NO: 992092 - RNA, 18 nt, Homo sapiens
aacacuuauguuauacaa

SEQ ID NO: 992093 - RNA, 22 nt, Homo sapiens
aacacuuauguuauacaauaca

SEQ ID NO: 992094 - RNA, 16 nt, Homo sapiens
aacagaaaaauaugua

SEQ ID NO: 992095 - RNA, 18 nt, Homo sapiens
aacagaaauuguauauug

SEQ ID NO: 992096 - RNA, 17 nt, Homo sapiens
aacagaauuaaguggau

SEQ ID NO: 992097 - RNA, 20 nt, Homo sapiens
aacagauuuuguuggcauag

SEQ ID NO: 992098 - RNA, 15 nt, Homo sapiens
aacagccaacuagcc

SEQ ID NO: 992099 - RNA, 19 nt, Homo sapiens
aacagcuccuaggaaaaug

SEQ ID NO: 992100 - RNA, 20 nt, Homo sapiens
aacagcuguaaucuaugaau

SEQ ID NO: 992101 - RNA, 15 nt, Homo sapiens
aacaggccucagggc

SEQ ID NO: 992102 - RNA, 17 nt, Homo sapiens
aacaggcucacugguca

SEQ ID NO: 992103 - RNA, 18 nt, Homo sapiens
aacagguauauacuuuga

SEQ ID NO: 992104 - RNA, 18 nt, Homo sapiens
aacagguuauaacagugu

SEQ ID NO: 992105 - RNA, 18 nt, Homo sapiens
aacaguuaccugagagau

SEQ ID NO: 992106 - RNA, 22 nt, Homo sapiens
aacaguuuuuuaugcuaaucag

SEQ ID NO: 992107 - RNA, 17 nt, Homo sapiens
aacauaccccuuacaaa

SEQ ID NO: 992108 - RNA, 23 nt, Homo sapiens
aacauaguauucaugacuaugga

SEQ ID NO: 992109 - RNA, 18 nt, Homo sapiens
aacauauauauacuauua

SEQ ID NO: 992110 - RNA, 14 nt, Homo sapiens
aacaucucugggaa

SEQ ID NO: 992111 - RNA, 13 nt, Homo sapiens
aacaugguacaaa

SEQ ID NO: 992112 - RNA, 12 nt, Homo sapiens
aacaugugaaaa

SEQ ID NO: 992113 - RNA, 17 nt, Homo sapiens
aacauuaucuaguucau

SEQ ID NO: 992114 - RNA, 20 nt, Homo sapiens
aacauuucuauagccaaaaa

SEQ ID NO: 992115 - RNA, 17 nt, Homo sapiens
aaccaaagaccaucuga

SEQ ID NO: 992116 - RNA, 21 nt, Homo sapiens
aaccaagagauaacuguaaau

SEQ ID NO: 992117 - RNA, 14 nt, Homo sapiens
aaccaauugcugcu

SEQ ID NO: 992118 - RNA, 14 nt, Homo sapiens
aaccauagcacagg

SEQ ID NO: 992119 - RNA, 17 nt, Homo sapiens
aacccauucccucucca

SEQ ID NO: 992120 - RNA, 16 nt, Homo sapiens
aacccgaggcugagaa

SEQ ID NO: 992121 - RNA, 14 nt, Homo sapiens
aacccggagagugc

SEQ ID NO: 992122 - RNA, 19 nt, Homo sapiens
aacccgugccaaguccagg

SEQ ID NO: 992123 - RNA, 18 nt, Homo sapiens
aacccucuggggagcuca

SEQ ID NO: 992124 - RNA, 14 nt, Homo sapiens
aacccuugcuugca

SEQ ID NO: 992125 - RNA, 19 nt, Homo sapiens
aacccuuugugugcucucc

SEQ ID NO: 992126 - RNA, 20 nt, Homo sapiens
aaccucagccuggccagaca

SEQ ID NO: 992127 - RNA, 20 nt, Homo sapiens
aaccuccaccuccuggguuc

SEQ ID NO: 992128 - RNA, 14 nt, Homo sapiens
aaccucuacagggu

SEQ ID NO: 992129 - RNA, 16 nt, Homo sapiens
aaccucucugugccau

SEQ ID NO: 992130 - RNA, 22 nt, Homo sapiens
aaccuugaaaaaaaacagugga

SEQ ID NO: 992131 - RNA, 15 nt, Homo sapiens
aaccuuugugcccua

SEQ ID NO: 992132 - RNA, 16 nt, Homo sapiens
aacgcuauuccagcug

SEQ ID NO: 992133 - RNA, 19 nt, Homo sapiens
aacgucuaggaaaucuaga

SEQ ID NO: 992134 - RNA, 20 nt, Homo sapiens
aacuaaaaggaagucaucca

SEQ ID NO: 992135 - RNA, 14 nt, Homo sapiens
aacuaaacacguga

SEQ ID NO: 992136 - RNA, 19 nt, Homo sapiens
aacuacccccagcugugcu

SEQ ID NO: 992137 - RNA, 18 nt, Homo sapiens
aacucaaauggggccaga

SEQ ID NO: 992138 - RNA, 13 nt, Homo sapiens
aacucagauccag

SEQ ID NO: 992139 - RNA, 18 nt, Homo sapiens
aacucucuuauugccuca

SEQ ID NO: 992140 - RNA, 13 nt, Homo sapiens
aacucuucacucu

SEQ ID NO: 992141 - RNA, 23 nt, Homo sapiens
aacucuucacucuucaaaugccu

SEQ ID NO: 992142 - RNA, 14 nt, Homo sapiens
aacugaacauccaa

SEQ ID NO: 992143 - RNA, 17 nt, Homo sapiens
aacugaaugagaaccaa

SEQ ID NO: 992144 - RNA, 18 nt, Homo sapiens
aacuggccaagcugaggu

SEQ ID NO: 992145 - RNA, 21 nt, Homo sapiens
aacuguaaaugugacauugau

SEQ ID NO: 992146 - RNA, 22 nt, Homo sapiens
aacuguguaacugcccaaagca

SEQ ID NO: 992147 - RNA, 21 nt, Homo sapiens
aacuguuggcaaggugacauu

SEQ ID NO: 992148 - RNA, 22 nt, Homo sapiens
aacuuaccaggcaccaaaagaa

SEQ ID NO: 992149 - RNA, 18 nt, Homo sapiens
aacuuauggaaagcccau

SEQ ID NO: 992150 - RNA, 13 nt, Homo sapiens
aacuucaaagagg

SEQ ID NO: 992151 - RNA, 17 nt, Homo sapiens
aacuugagcauguuacu

SEQ ID NO: 992152 - RNA, 16 nt, Homo sapiens
aacuugcauugugauu

SEQ ID NO: 992153 - RNA, 24 nt, Homo sapiens
aacuugugcccucccuguccuuag

SEQ ID NO: 992154 - RNA, 14 nt, Homo sapiens
aacuuuaucacuua

SEQ ID NO: 992155 - RNA, 20 nt, Homo sapiens
aacuuuggaguccccucacc

SEQ ID NO: 992156 - RNA, 13 nt, Homo sapiens
aacuuuucuauua

SEQ ID NO: 992157 - RNA, 23 nt, Homo sapiens
aagaaaaccuuucuucaccaaau

SEQ ID NO: 992158 - RNA, 15 nt, Homo sapiens
aagaaaauaaauguc

SEQ ID NO: 992159 - RNA, 14 nt, Homo sapiens
aagaaaaugauaca

SEQ ID NO: 992160 - RNA, 18 nt, Homo sapiens
aagaaagaagacaaacuu

SEQ ID NO: 992161 - RNA, 16 nt, Homo sapiens
aagaaagaucaaagac

SEQ ID NO: 992162 - RNA, 12 nt, Homo sapiens
aagaaccuggaa

SEQ ID NO: 992163 - RNA, 20 nt, Homo sapiens
aagaccuggcagcucuggac

SEQ ID NO: 992164 - RNA, 22 nt, Homo sapiens
aagacucuacccauauuacaga

SEQ ID NO: 992165 - RNA, 21 nt, Homo sapiens
aagacuggaagcuaauuugca

SEQ ID NO: 992166 - RNA, 19 nt, Homo sapiens
aagacuuuguccccacuua

SEQ ID NO: 992167 - RNA, 21 nt, Homo sapiens
aagagaaucaacauuucucaa

SEQ ID NO: 992168 - RNA, 20 nt, Homo sapiens
aagagaauuuggggcuucca

SEQ ID NO: 992169 - RNA, 22 nt, Homo sapiens
aagagcccucaagcggcccuua

SEQ ID NO: 992170 - RNA, 21 nt, Homo sapiens
aagaggaaggccucuguggca

SEQ ID NO: 992171 - RNA, 11 nt, Homo sapiens
aagaguuuaaa

SEQ ID NO: 992172 - RNA, 18 nt, Homo sapiens
aagaucacagugaacuua

SEQ ID NO: 992173 - RNA, 15 nt, Homo sapiens
aagaucuuugcccuc

SEQ ID NO: 992174 - RNA, 22 nt, Homo sapiens
aagauggcccauccugugguca

SEQ ID NO: 992175 - RNA, 16 nt, Homo sapiens
aaucucaucucaguga

SEQ ID NO: 992176 - RNA, 20 nt, Homo sapiens
aaucuguccguucacaugug

SEQ ID NO: 992177 - RNA, 13 nt, Homo sapiens
aaugaacacuuaa

SEQ ID NO: 992178 - RNA, 21 nt, Homo sapiens
aaugaaggaaaagcauguuau

SEQ ID NO: 992179 - RNA, 14 nt, Homo sapiens
aaugacaugaauuu

SEQ ID NO: 992180 - RNA, 14 nt, Homo sapiens
aaugagccaugaga

SEQ ID NO: 992181 - RNA, 10 nt, Homo sapiens
aaugagucag

SEQ ID NO: 992182 - RNA, 19 nt, Homo sapiens
aaugagucccuguccccac

SEQ ID NO: 992183 - RNA, 18 nt, Homo sapiens
aaugauuuuucuuuacaa

SEQ ID NO: 992184 - RNA, 13 nt, Homo sapiens
aaugcaaccauuu

SEQ ID NO: 992185 - RNA, 15 nt, Homo sapiens
aaugccuacugagua

SEQ ID NO: 992186 - RNA, 16 nt, Homo sapiens
aaugcuuagaaauuca

SEQ ID NO: 992187 - RNA, 22 nt, Homo sapiens
aauggaggaacuuuccaaacac

SEQ ID NO: 992188 - RNA, 13 nt, Homo sapiens
aauggggccagau

SEQ ID NO: 992189 - RNA, 15 nt, Homo sapiens
aauguaaagccaugc

SEQ ID NO: 992190 - RNA, 17 nt, Homo sapiens
aauguaucaaauacauu

SEQ ID NO: 992191 - RNA, 20 nt, Homo sapiens
aaugucaaugaguaauucau

SEQ ID NO: 992192 - RNA, 21 nt, Homo sapiens
aaugucaccagguacuugaga

SEQ ID NO: 992193 - RNA, 20 nt, Homo sapiens
aauguccuugugaugugcac

SEQ ID NO: 992194 - RNA, 17 nt, Homo sapiens
aauguccuuucauuugu

SEQ ID NO: 992195 - RNA, 19 nt, Homo sapiens
aaugucuugaugcaugcac

SEQ ID NO: 992196 - RNA, 21 nt, Homo sapiens
aauguuaacacucaugaagca

SEQ ID NO: 992197 - RNA, 15 nt, Homo sapiens
aauguucauggacua

SEQ ID NO: 992198 - RNA, 14 nt, Homo sapiens
aauguuuacacucu

SEQ ID NO: 992199 - RNA, 13 nt, Homo sapiens
aauuaaauuggaa

SEQ ID NO: 992200 - RNA, 21 nt, Homo sapiens
aauuaauaucccuacauguau

SEQ ID NO: 992201 - RNA, 11 nt, Homo sapiens
aauuaccaugc

SEQ ID NO: 992202 - RNA, 18 nt, Homo sapiens
aauuaccaugcuucacaa

SEQ ID NO: 992203 - RNA, 15 nt, Homo sapiens
aauuaguaacaugug

SEQ ID NO: 992204 - RNA, 19 nt, Homo sapiens
aauuauaagaggauaugaa

SEQ ID NO: 992205 - RNA, 11 nt, Homo sapiens
aauuaugccuu

SEQ ID NO: 992206 - RNA, 19 nt, Homo sapiens
aauucaaaaguuccaagag

SEQ ID NO: 992207 - RNA, 20 nt, Homo sapiens
aauucacagugcucuuuucu

SEQ ID NO: 992208 - RNA, 21 nt, Homo sapiens
aauucacucugaguguuuuau

SEQ ID NO: 992209 - RNA, 17 nt, Homo sapiens
aauucagacaagcugca

SEQ ID NO: 992210 - RNA, 22 nt, Homo sapiens
aauucagacaagcugcauuuca

SEQ ID NO: 992211 - RNA, 13 nt, Homo sapiens
aauucagcauuug

SEQ ID NO: 992212 - RNA, 14 nt, Homo sapiens
aauuccacaaugaa

SEQ ID NO: 992213 - RNA, 22 nt, Homo sapiens
aauuccacaccuuuuauugaca

SEQ ID NO: 992214 - RNA, 15 nt, Homo sapiens
aauucggugugcacc

SEQ ID NO: 992215 - RNA, 19 nt, Homo sapiens
aauucuaugccugucuuaa

SEQ ID NO: 992216 - RNA, 22 nt, Homo sapiens
aauugcguucuaagaggugaag

SEQ ID NO: 992217 - RNA, 13 nt, Homo sapiens
aauuuucuuucac

SEQ ID NO: 992218 - RNA, 17 nt, Homo sapiens
aauuuugaguugccaca

SEQ ID NO: 992219 - RNA, 14 nt, Homo sapiens
aauuuugccuuuaa

SEQ ID NO: 992220 - RNA, 19 nt, Homo sapiens
aauuuuuuaaaaagcaaaa

SEQ ID NO: 992221 - RNA, 13 nt, Homo sapiens
acaaaagcgaaac

SEQ ID NO: 992222 - RNA, 23 nt, Homo sapiens
acaaaaguguguauaaaauguac

SEQ ID NO: 992223 - RNA, 14 nt, Homo sapiens
acaaaccacaccac

SEQ ID NO: 992224 - RNA, 14 nt, Homo sapiens
acaaaccauuuugu

SEQ ID NO: 992225 - RNA, 19 nt, Homo sapiens
acaaacucauucauuaguc

SEQ ID NO: 992226 - RNA, 14 nt, Homo sapiens
acaaacugucuaaa

SEQ ID NO: 992227 - RNA, 14 nt, Homo sapiens
acaaagcagauuca

SEQ ID NO: 992228 - RNA, 23 nt, Homo sapiens
acaaauagucggauuagaaauaa

SEQ ID NO: 992229 - RNA, 22 nt, Homo sapiens
acaaauauggggaaaaaacugu

SEQ ID NO: 992230 - RNA, 14 nt, Homo sapiens
acaacacaguucuc

SEQ ID NO: 992231 - RNA, 17 nt, Homo sapiens
acaacauguuuccagca

SEQ ID NO: 992232 - RNA, 15 nt, Homo sapiens
acaacggaugaaugu

SEQ ID NO: 992233 - RNA, 13 nt, Homo sapiens
acaacugcuccca

SEQ ID NO: 992234 - RNA, 18 nt, Homo sapiens
acaagacccccagcacuu

SEQ ID NO: 992235 - RNA, 19 nt, Homo sapiens
acaagacugccauauuaaa

SEQ ID NO: 992236 - RNA, 14 nt, Homo sapiens
acaagcuucugucc

SEQ ID NO: 992237 - RNA, 18 nt, Homo sapiens
acaaguauggcuccucca

SEQ ID NO: 992238 - RNA, 15 nt, Homo sapiens
acaagugcugaacag

SEQ ID NO: 992239 - RNA, 15 nt, Homo sapiens
acaauaaaacauuaa

SEQ ID NO: 992240 - RNA, 16 nt, Homo sapiens
acaauaaaacauuaau

SEQ ID NO: 992241 - RNA, 21 nt, Homo sapiens
acaauaaacgguacuugucau

SEQ ID NO: 992242 - RNA, 19 nt, Homo sapiens
acaaucucuguuuguaugu

SEQ ID NO: 992243 - RNA, 19 nt, Homo sapiens
acaaugacauuuauaucac

SEQ ID NO: 992244 - RNA, 14 nt, Homo sapiens
acaauucauugugu

SEQ ID NO: 992245 - RNA, 16 nt, Homo sapiens
acaauuugacauacaa

SEQ ID NO: 992246 - RNA, 17 nt, Homo sapiens
acaauuuuuuccacuua

SEQ ID NO: 992247 - RNA, 23 nt, Homo sapiens
acaauuuuuuuuauuaguauugu

SEQ ID NO: 992248 - RNA, 17 nt, Homo sapiens
acacaaaccagccucaa

SEQ ID NO: 992249 - RNA, 21 nt, Homo sapiens
acacaacuaggaaguggcuga

SEQ ID NO: 992250 - RNA, 20 nt, Homo sapiens
acacaaggauagaugcuggc

SEQ ID NO: 992251 - RNA, 20 nt, Homo sapiens
acacacgcacacaaaccaca

SEQ ID NO: 992252 - RNA, 23 nt, Homo sapiens
acacacggugccuuuauuuccac

SEQ ID NO: 992253 - RNA, 14 nt, Homo sapiens
acacagcauuguau

SEQ ID NO: 992254 - RNA, 12 nt, Homo sapiens
acacaguauuuu

SEQ ID NO: 992255 - RNA, 16 nt, Homo sapiens
acacagugagacuuca

SEQ ID NO: 992256 - RNA, 19 nt, Homo sapiens
acaccaaguaccaguauaa

SEQ ID NO: 992257 - RNA, 22 nt, Homo sapiens
acacccuucucccacucuccua

SEQ ID NO: 992258 - RNA, 16 nt, Homo sapiens
acaccuauuaucccag

SEQ ID NO: 992259 - RNA, 16 nt, Homo sapiens
acaccugacagaauga

SEQ ID NO: 992260 - RNA, 21 nt, Homo sapiens
acaccugcggcccaauccaag

SEQ ID NO: 992261 - RNA, 14 nt, Homo sapiens
acaccugcugagaa

SEQ ID NO: 992262 - RNA, 15 nt, Homo sapiens
acacgauaaagggau

SEQ ID NO: 992263 - RNA, 16 nt, Homo sapiens
acacguaaguauaaau

SEQ ID NO: 992264 - RNA, 20 nt, Homo sapiens
acacgugcgugcgagcacac

SEQ ID NO: 992265 - RNA, 16 nt, Homo sapiens
acacuaaaaaaaugca

SEQ ID NO: 992266 - RNA, 23 nt, Homo sapiens
acacucaccugcacuaacagagu

SEQ ID NO: 992267 - RNA, 22 nt, Homo sapiens
acacucuggcugcucccugaca

SEQ ID NO: 992268 - RNA, 18 nt, Homo sapiens
acacuggggacuuggccu

SEQ ID NO: 992269 - RNA, 18 nt, Homo sapiens
acacuucucaggacacag

SEQ ID NO: 992270 - RNA, 17 nt, Homo sapiens
acacuugcaaccuaccu

SEQ ID NO: 992271 - RNA, 21 nt, Homo sapiens
acagaaaaggcugcugugaac

SEQ ID NO: 992272 - RNA, 13 nt, Homo sapiens
acagaaauuguau

SEQ ID NO: 992273 - RNA, 13 nt, Homo sapiens
acagaacuucaga

SEQ ID NO: 992274 - RNA, 22 nt, Homo sapiens
accaugagaccacuguuaucaa

SEQ ID NO: 992275 - RNA, 12 nt, Homo sapiens
accaugcugcug

SEQ ID NO: 992276 - RNA, 20 nt, Homo sapiens
accauguacaugaagaagcu

SEQ ID NO: 992277 - RNA, 17 nt, Homo sapiens
acccagaggcagcagag

SEQ ID NO: 992278 - RNA, 22 nt, Homo sapiens
acccagguuggcgacugcaaca

SEQ ID NO: 992279 - RNA, 15 nt, Homo sapiens
acccaguucagugag

SEQ ID NO: 992280 - RNA, 22 nt, Homo sapiens
acccauuucucuuugcuucaca

SEQ ID NO: 992281 - RNA, 22 nt, Homo sapiens
acccauuuuuccuuuugccgac

SEQ ID NO: 992282 - RNA, 15 nt, Homo sapiens
accccaaagcuuucc

SEQ ID NO: 992283 - RNA, 22 nt, Homo sapiens
accccaagaguuuugggaguug

SEQ ID NO: 992284 - RNA, 13 nt, Homo sapiens
acccccagcucaa

SEQ ID NO: 992285 - RNA, 15 nt, Homo sapiens
acccccagcucaaug

SEQ ID NO: 992286 - RNA, 23 nt, Homo sapiens
accccgauauauuuuagcauuuu

SEQ ID NO: 992287 - RNA, 17 nt, Homo sapiens
accccuguuucuggcac

SEQ ID NO: 992288 - RNA, 20 nt, Homo sapiens
acccuagccuugcuuguuaa

SEQ ID NO: 992289 - RNA, 16 nt, Homo sapiens
acccuagggauuugca

SEQ ID NO: 992290 - RNA, 19 nt, Homo sapiens
acccucacaagcaugaagu

SEQ ID NO: 992291 - RNA, 16 nt, Homo sapiens
acccucaucacuagga

SEQ ID NO: 992292 - RNA, 17 nt, Homo sapiens
acccugaaggggccaug

SEQ ID NO: 992293 - RNA, 13 nt, Homo sapiens
acccuucaacgcu

SEQ ID NO: 992294 - RNA, 17 nt, Homo sapiens
acccuugacaccugcug

SEQ ID NO: 992295 - RNA, 15 nt, Homo sapiens
accgaaaucccucag

SEQ ID NO: 992296 - RNA, 18 nt, Homo sapiens
accggcucucaccuggcc

SEQ ID NO: 992297 - RNA, 23 nt, Homo sapiens
accggggccuacuagagucugaa

SEQ ID NO: 992298 - RNA, 19 nt, Homo sapiens
accguauccauaaagaccc

SEQ ID NO: 992299 - RNA, 21 nt, Homo sapiens
accguuuugaagcuacugugu

SEQ ID NO: 992300 - RNA, 20 nt, Homo sapiens
accuaaauggccucaugugg

SEQ ID NO: 992301 - RNA, 18 nt, Homo sapiens
accuaauccaggcagauc

SEQ ID NO: 992302 - RNA, 21 nt, Homo sapiens
accuacccuccacaggcacag

SEQ ID NO: 992303 - RNA, 16 nt, Homo sapiens
accuacucacacaggc

SEQ ID NO: 992304 - RNA, 16 nt, Homo sapiens
accuaugcaaagauga

SEQ ID NO: 992305 - RNA, 20 nt, Homo sapiens
accuauuaucccagcugccu

SEQ ID NO: 992306 - RNA, 20 nt, Homo sapiens
accucacaggccccaggaaa

SEQ ID NO: 992307 - RNA, 17 nt, Homo sapiens
accucagauggcagcuu

SEQ ID NO: 992308 - RNA, 19 nt, Homo sapiens
accucagccucccaaagug

SEQ ID NO: 992309 - RNA, 20 nt, Homo sapiens
accucagccuggccagacac

SEQ ID NO: 992310 - RNA, 17 nt, Homo sapiens
accucaggcaaucugcc

SEQ ID NO: 992311 - RNA, 16 nt, Homo sapiens
accucaggcagcucaa

SEQ ID NO: 992312 - RNA, 21 nt, Homo sapiens
accucaggugauccaccugcc

SEQ ID NO: 992313 - RNA, 12 nt, Homo sapiens
accuccaccucc

SEQ ID NO: 992314 - RNA, 20 nt, Homo sapiens
accuccuauggguugucacc

SEQ ID NO: 992315 - RNA, 11 nt, Homo sapiens
accuccucaug

SEQ ID NO: 992316 - RNA, 17 nt, Homo sapiens
accucgcuggacucuca

SEQ ID NO: 992317 - RNA, 14 nt, Homo sapiens
accucuacaggguu

SEQ ID NO: 992318 - RNA, 15 nt, Homo sapiens
accucugacagcagc

SEQ ID NO: 992319 - RNA, 10 nt, Homo sapiens
accucugcau

SEQ ID NO: 992320 - RNA, 18 nt, Homo sapiens
accugaaaacacugugca

SEQ ID NO: 992321 - RNA, 19 nt, Homo sapiens
accugacguacucugguua

SEQ ID NO: 992322 - RNA, 22 nt, Homo sapiens
accugcaaagaucuguccucag

SEQ ID NO: 992323 - RNA, 21 nt, Homo sapiens
accugcagcccauggugagcu

SEQ ID NO: 992324 - RNA, 15 nt, Homo sapiens
accugcuaggccaga

SEQ ID NO: 992325 - RNA, 18 nt, Homo sapiens
accugcuaggccagagcc

SEQ ID NO: 992326 - RNA, 17 nt, Homo sapiens
accuggaaucagugaag

SEQ ID NO: 992327 - RNA, 21 nt, Homo sapiens
accuggaccccugcauuggaa

SEQ ID NO: 992328 - RNA, 16 nt, Homo sapiens
accuggccuucagugu

SEQ ID NO: 992329 - RNA, 16 nt, Homo sapiens
accuguaaucauauaa

SEQ ID NO: 992330 - RNA, 14 nt, Homo sapiens
accuguagauucag

SEQ ID NO: 992331 - RNA, 21 nt, Homo sapiens
accuguagauucagguaauac

SEQ ID NO: 992332 - RNA, 17 nt, Homo sapiens
accuucaccuucaucca

SEQ ID NO: 992333 - RNA, 12 nt, Homo sapiens
accuugugagag

SEQ ID NO: 992334 - RNA, 21 nt, Homo sapiens
accuuucacgaacaugggcau

SEQ ID NO: 992335 - RNA, 14 nt, Homo sapiens
accuuuuacucuuc

SEQ ID NO: 992336 - RNA, 16 nt, Homo sapiens
acgaagcuuaguauaa

SEQ ID NO: 992337 - RNA, 18 nt, Homo sapiens
acgaagcuuaguauaaac

SEQ ID NO: 992338 - RNA, 23 nt, Homo sapiens
acgaccgccccaguuccuguggc

SEQ ID NO: 992339 - RNA, 18 nt, Homo sapiens
acgacuggccagggccac

SEQ ID NO: 992340 - RNA, 16 nt, Homo sapiens
acgaucuucuccacau

SEQ ID NO: 992341 - RNA, 15 nt, Homo sapiens
acgcaucacuggggc

SEQ ID NO: 992342 - RNA, 21 nt, Homo sapiens
acgcugcugucacaaccaaga

SEQ ID NO: 992343 - RNA, 17 nt, Homo sapiens
acggacucaugauuucu

SEQ ID NO: 992344 - RNA, 23 nt, Homo sapiens
acggaguccuguguuugugaguc

SEQ ID NO: 992345 - RNA, 18 nt, Homo sapiens
acggccagggagaagcuc

SEQ ID NO: 992346 - RNA, 16 nt, Homo sapiens
acggcugcgcacugug

SEQ ID NO: 992347 - RNA, 17 nt, Homo sapiens
acggucaggaaaacugu

SEQ ID NO: 992348 - RNA, 22 nt, Homo sapiens
acgucugcagaaacagugcaag

SEQ ID NO: 992349 - RNA, 21 nt, Homo sapiens
acgugacacaaacacacacaa

SEQ ID NO: 992350 - RNA, 14 nt, Homo sapiens
acgugcagccacac

SEQ ID NO: 992351 - RNA, 19 nt, Homo sapiens
acgugcagccacacacaga

SEQ ID NO: 992352 - RNA, 18 nt, Homo sapiens
acgugcgugcgagcacac

SEQ ID NO: 992353 - RNA, 16 nt, Homo sapiens
acgugugcaguuguag

SEQ ID NO: 992354 - RNA, 16 nt, Homo sapiens
acuaaaaaaaagauga

SEQ ID NO: 992355 - RNA, 17 nt, Homo sapiens
acuaaaaaguauugcau

SEQ ID NO: 992356 - RNA, 17 nt, Homo sapiens
acuaaaacacacaggug

SEQ ID NO: 992357 - RNA, 22 nt, Homo sapiens
acuaaaauuguaucaaauguga

SEQ ID NO: 992358 - RNA, 11 nt, Homo sapiens
acuaaagccaa

SEQ ID NO: 992359 - RNA, 16 nt, Homo sapiens
acuaacaggccaaaga

SEQ ID NO: 992360 - RNA, 15 nt, Homo sapiens
acuaagaaauaugca

SEQ ID NO: 992361 - RNA, 23 nt, Homo sapiens
acuaaggaaccaacaaucuuccu

SEQ ID NO: 992362 - RNA, 19 nt, Homo sapiens
acuaauaaacuguguaguu

SEQ ID NO: 992363 - RNA, 23 nt, Homo sapiens
acuaauagaauaaaggcaguuuu

SEQ ID NO: 992364 - RNA, 20 nt, Homo sapiens
acuaauuuaguaauagccug

SEQ ID NO: 992365 - RNA, 21 nt, Homo sapiens
acuacacacuguguacugcag

SEQ ID NO: 992366 - RNA, 18 nt, Homo sapiens
acuacagcuggggugcag

SEQ ID NO: 992367 - RNA, 23 nt, Homo sapiens
acuacagcuggggugcagggaug

SEQ ID NO: 992368 - RNA, 19 nt, Homo sapiens
acuacgguugaucuugcaa

SEQ ID NO: 992369 - RNA, 21 nt, Homo sapiens
acuacugacauguggggccag

SEQ ID NO: 992370 - RNA, 14 nt, Homo sapiens
acuagccaaaccuc

SEQ ID NO: 992371 - RNA, 16 nt, Homo sapiens
acuagccaaaccucac

SEQ ID NO: 992372 - RNA, 19 nt, Homo sapiens
acuagccaaaccucaccaa

SEQ ID NO: 992373 - RNA, 14 nt, Homo sapiens
acuaggaucagaau

SEQ ID NO: 992374 - RNA, 19 nt, Homo sapiens
acuaggaucagaauaucac

SEQ ID NO: 992375 - RNA, 16 nt, Homo sapiens
auaauuuaccuaagau

SEQ ID NO: 992376 - RNA, 20 nt, Homo sapiens
auacacuuuuuaaaaucuca

SEQ ID NO: 992377 - RNA, 21 nt, Homo sapiens
auacacuuuuuaaaaucucaa

SEQ ID NO: 992378 - RNA, 16 nt, Homo sapiens
auacagaauuacugua

SEQ ID NO: 992379 - RNA, 19 nt, Homo sapiens
auacagcuguauugucuga

SEQ ID NO: 992380 - RNA, 17 nt, Homo sapiens
auacauaaguuuaggau

SEQ ID NO: 992381 - RNA, 19 nt, Homo sapiens
auaccaaaauguugcugaa

SEQ ID NO: 992382 - RNA, 19 nt, Homo sapiens
auaccaccagacugcaaug

SEQ ID NO: 992383 - RNA, 21 nt, Homo sapiens
auaccagguuuuacacuugca

SEQ ID NO: 992384 - RNA, 19 nt, Homo sapiens
auacuaacauuuucauuga

SEQ ID NO: 992385 - RNA, 16 nt, Homo sapiens
auacuagggagccauu

SEQ ID NO: 992386 - RNA, 13 nt, Homo sapiens
auacucagguuaa

SEQ ID NO: 992387 - RNA, 16 nt, Homo sapiens
caauuucaagguucua

SEQ ID NO: 992388 - RNA, 17 nt, Homo sapiens
caauuuuaaaucugaga

SEQ ID NO: 992389 - RNA, 13 nt, Homo sapiens
cacaaacccaagg

SEQ ID NO: 992390 - RNA, 18 nt, Homo sapiens
cacaaauuagcuaggcau

SEQ ID NO: 992391 - RNA, 14 nt, Homo sapiens
cacaacacaguucu

SEQ ID NO: 992392 - RNA, 14 nt, Homo sapiens
cacaacagugaaaa

SEQ ID NO: 992393 - RNA, 20 nt, Homo sapiens
cacaauagcaguugaaacaa

SEQ ID NO: 992394 - RNA, 19 nt, Homo sapiens
cacaaucugucaguucuaa

SEQ ID NO: 992395 - RNA, 14 nt, Homo sapiens
cacaaugaaagaau

SEQ ID NO: 992396 - RNA, 17 nt, Homo sapiens
cacacaaaagggaaccc

SEQ ID NO: 992397 - RNA, 22 nt, Homo sapiens
cacacaacuaggaaguggcuga

SEQ ID NO: 992398 - RNA, 20 nt, Homo sapiens
cacacaccaaguaccaguau

SEQ ID NO: 992399 - RNA, 18 nt, Homo sapiens
cacacaccuguagcacuu

SEQ ID NO: 992400 - RNA, 11 nt, Homo sapiens
cacacaguguu

SEQ ID NO: 992401 - RNA, 15 nt, Homo sapiens
cacaccagaaagcua

SEQ ID NO: 992402 - RNA, 13 nt, Homo sapiens
cacaccuacccuc

SEQ ID NO: 992403 - RNA, 14 nt, Homo sapiens
cacacuucucagga

SEQ ID NO: 992404 - RNA, 12 nt, Homo sapiens
cacacuuugcca

SEQ ID NO: 992405 - RNA, 17 nt, Homo sapiens
cacagaagguccuggug

SEQ ID NO: 992406 - RNA, 12 nt, Homo sapiens
cacagaauguga

SEQ ID NO: 992407 - RNA, 14 nt, Homo sapiens
cacagaaugugaua

SEQ ID NO: 992408 - RNA, 15 nt, Homo sapiens
cacagcaguucugca

SEQ ID NO: 992409 - RNA, 14 nt, Homo sapiens
cacagccaacacgc

SEQ ID NO: 992410 - RNA, 15 nt, Homo sapiens
cacagccaggggagc

SEQ ID NO: 992411 - RNA, 20 nt, Homo sapiens
cacagcccccacggacaaaa

SEQ ID NO: 992412 - RNA, 22 nt, Homo sapiens
cacagcuguauagcugcuucca

SEQ ID NO: 992413 - RNA, 13 nt, Homo sapiens
cacaggcagccag

SEQ ID NO: 992414 - RNA, 16 nt, Homo sapiens
cacagguucaugccac

SEQ ID NO: 992415 - RNA, 19 nt, Homo sapiens
cacagucccaucugcuuca

SEQ ID NO: 992416 - RNA, 19 nt, Homo sapiens
cacagugugugacuuacag

SEQ ID NO: 992417 - RNA, 22 nt, Homo sapiens
cacauaagggagauuguauaca

SEQ ID NO: 992418 - RNA, 14 nt, Homo sapiens
cacauacgugcaca

SEQ ID NO: 992419 - RNA, 13 nt, Homo sapiens
cacaucacacaaa

SEQ ID NO: 992420 - RNA, 17 nt, Homo sapiens
cacaugaacuuagauuu

SEQ ID NO: 992421 - RNA, 21 nt, Homo sapiens
cacaugaagguaaauaaaaag

SEQ ID NO: 992422 - RNA, 17 nt, Homo sapiens
cacaugcccaugaugag

SEQ ID NO: 992423 - RNA, 21 nt, Homo sapiens
cacaugugagcaugucacuuc

SEQ ID NO: 992424 - RNA, 20 nt, Homo sapiens
cacauugcugugaacaggaa

SEQ ID NO: 992425 - RNA, 22 nt, Homo sapiens
caccaaagggaaggcuuccuau

SEQ ID NO: 992426 - RNA, 14 nt, Homo sapiens
caccaaaugugcuu

SEQ ID NO: 992427 - RNA, 17 nt, Homo sapiens
caccaagcuaggugcua

SEQ ID NO: 992428 - RNA, 15 nt, Homo sapiens
caccaaguaccagua

SEQ ID NO: 992429 - RNA, 14 nt, Homo sapiens
caccacacacacac

SEQ ID NO: 992430 - RNA, 17 nt, Homo sapiens
caccacagccagcaccu

SEQ ID NO: 992431 - RNA, 14 nt, Homo sapiens
caccacuagccuca

SEQ ID NO: 992432 - RNA, 12 nt, Homo sapiens
caccaugcugcu

SEQ ID NO: 992433 - RNA, 19 nt, Homo sapiens
caccauguuagccaggcug

SEQ ID NO: 992434 - RNA, 16 nt, Homo sapiens
caccauuauaaugaau

SEQ ID NO: 992435 - RNA, 18 nt, Homo sapiens
caccauuauaaugaauuu

SEQ ID NO: 992436 - RNA, 13 nt, Homo sapiens
cacccagacauaa

SEQ ID NO: 992437 - RNA, 16 nt, Homo sapiens
caccccugcacaguug

SEQ ID NO: 992438 - RNA, 20 nt, Homo sapiens
cacccugaggagucugaggu

SEQ ID NO: 992439 - RNA, 16 nt, Homo sapiens
cacccuggaggauuuc

SEQ ID NO: 992440 - RNA, 21 nt, Homo sapiens
cacccuuccccuccuucuccc

SEQ ID NO: 992441 - RNA, 12 nt, Homo sapiens
cacccuucuccc

SEQ ID NO: 992442 - RNA, 15 nt, Homo sapiens
caccggcucucaccu

SEQ ID NO: 992443 - RNA, 12 nt, Homo sapiens
caccgucuuucu

SEQ ID NO: 992444 - RNA, 16 nt, Homo sapiens
caccuaccgaguucaa

SEQ ID NO: 992445 - RNA, 16 nt, Homo sapiens
caccuagacuguaaac

SEQ ID NO: 992446 - RNA, 20 nt, Homo sapiens
caccucacaggccccaggaa

SEQ ID NO: 992447 - RNA, 16 nt, Homo sapiens
caccuccucauguaca

SEQ ID NO: 992448 - RNA, 20 nt, Homo sapiens
caccuccucauguacauacc

SEQ ID NO: 992449 - RNA, 17 nt, Homo sapiens
caccuccuggguucaag

SEQ ID NO: 992450 - RNA, 19 nt, Homo sapiens
caccugggagaaaucuggc

SEQ ID NO: 992451 - RNA, 20 nt, Homo sapiens
caccuuggaauucgcuuucu

SEQ ID NO: 992452 - RNA, 15 nt, Homo sapiens
caccuuuagguucuu

SEQ ID NO: 992453 - RNA, 19 nt, Homo sapiens
caccuuuuuucaacaguga

SEQ ID NO: 992454 - RNA, 19 nt, Homo sapiens
cacgaagcacgaucagucc

SEQ ID NO: 992455 - RNA, 18 nt, Homo sapiens
cacgcuuuuugaaaaagc

SEQ ID NO: 992456 - RNA, 19 nt, Homo sapiens
cacgggugucacggccagg

SEQ ID NO: 992457 - RNA, 15 nt, Homo sapiens
cacguauuugaaugg

SEQ ID NO: 992458 - RNA, 22 nt, Homo sapiens
cacguuacuagcagucacuuga

SEQ ID NO: 992459 - RNA, 20 nt, Homo sapiens
cacuaauucauuaaucugcc

SEQ ID NO: 992460 - RNA, 21 nt, Homo sapiens
cacuagcaauaaaaugcuaau

SEQ ID NO: 992461 - RNA, 13 nt, Homo sapiens
cacuaucacuuua

SEQ ID NO: 992462 - RNA, 14 nt, Homo sapiens
cacuauuacuggga

SEQ ID NO: 992463 - RNA, 16 nt, Homo sapiens
cacucaugaagcauac

SEQ ID NO: 992464 - RNA, 22 nt, Homo sapiens
cacucaugucccauuuuagcca

SEQ ID NO: 992465 - RNA, 16 nt, Homo sapiens
cacucuggagcauuuc

SEQ ID NO: 992466 - RNA, 13 nt, Homo sapiens
cacucuucuugca

SEQ ID NO: 992467 - RNA, 22 nt, Homo sapiens
cacugaaaaaucuaagugauau

SEQ ID NO: 992468 - RNA, 23 nt, Homo sapiens
cacugaaaaaucuaagugauaua

SEQ ID NO: 992469 - RNA, 13 nt, Homo sapiens
cacugaagcacca

SEQ ID NO: 992470 - RNA, 14 nt, Homo sapiens
cacugcaccugccu

SEQ ID NO: 992471 - RNA, 18 nt, Homo sapiens
cacugcccccugcugcca

SEQ ID NO: 992472 - RNA, 17 nt, Homo sapiens
cacugccccucucucag

SEQ ID NO: 992473 - RNA, 21 nt, Homo sapiens
cacuggagcacaauaaauggc

SEQ ID NO: 992474 - RNA, 16 nt, Homo sapiens
caggcagccagcaucu

SEQ ID NO: 992475 - RNA, 13 nt, Homo sapiens
caggcagcucaag

SEQ ID NO: 992476 - RNA, 12 nt, Homo sapiens
caggccagcugu

SEQ ID NO: 992477 - RNA, 17 nt, Homo sapiens
caggccccgugaggcaa

SEQ ID NO: 992478 - RNA, 17 nt, Homo sapiens
caggccuuugagcucag

SEQ ID NO: 992479 - RNA, 19 nt, Homo sapiens
caggcucccagggacaccu

SEQ ID NO: 992480 - RNA, 14 nt, Homo sapiens
caggcucucgcaca

SEQ ID NO: 992481 - RNA, 20 nt, Homo sapiens
caggcuggaagauagcugug

SEQ ID NO: 992482 - RNA, 14 nt, Homo sapiens
caggcugggccaug

SEQ ID NO: 992483 - RNA, 19 nt, Homo sapiens
caggcugggccauguccaa

SEQ ID NO: 992484 - RNA, 23 nt, Homo sapiens
caggcugggccauguccaaagag

SEQ ID NO: 992485 - RNA, 19 nt, Homo sapiens
cagggaagcugucccucac

SEQ ID NO: 992486 - RNA, 21 nt, Homo sapiens
cagggauuaaccucugcacua

SEQ ID NO: 992487 - RNA, 18 nt, Homo sapiens
cagggcauuuugguccaa

SEQ ID NO: 992488 - RNA, 16 nt, Homo sapiens
cagggcccccaucuca

SEQ ID NO: 992489 - RNA, 14 nt, Homo sapiens
cagggccucuguca

SEQ ID NO: 992490 - RNA, 14 nt, Homo sapiens
cagggccugucuca

SEQ ID NO: 992491 - RNA, 14 nt, Homo sapiens
cagggcucaaucuc

SEQ ID NO: 992492 - RNA, 20 nt, Homo sapiens
cagggcuggagucaaaacac

SEQ ID NO: 992493 - RNA, 15 nt, Homo sapiens
cccuccccuccaucc

SEQ ID NO: 992494 - RNA, 23 nt, Homo sapiens
cccucccuggaugacauuaaaga

SEQ ID NO: 992495 - RNA, 18 nt, Homo sapiens
cccucugggcucugagua

SEQ ID NO: 992496 - RNA, 14 nt, Homo sapiens
cccugcaccaugcu

SEQ ID NO: 992497 - RNA, 21 nt, Homo sapiens
cccugcgggugaacaaagcag

SEQ ID NO: 992498 - RNA, 14 nt, Homo sapiens
cccugggguggcca

SEQ ID NO: 992499 - RNA, 13 nt, Homo sapiens
cccugucauccag

SEQ ID NO: 992500 - RNA, 12 nt, Homo sapiens
cccugugcaacc

SEQ ID NO: 992501 - RNA, 14 nt, Homo sapiens
cccuguucaugccg

SEQ ID NO: 992502 - RNA, 16 nt, Homo sapiens
cccuuauccuucuccc

SEQ ID NO: 992503 - RNA, 11 nt, Homo sapiens
cccuucacugu

SEQ ID NO: 992504 - RNA, 17 nt, Homo sapiens
cccuugccugugccagg

SEQ ID NO: 992505 - RNA, 14 nt, Homo sapiens
cccuuugccuucau

SEQ ID NO: 992506 - RNA, 12 nt, Homo sapiens
cccuuuucauga

SEQ ID NO: 992507 - RNA, 15 nt, Homo sapiens
ccgaggucccugcug

SEQ ID NO: 992508 - RNA, 12 nt, Homo sapiens
ccgauaccaugc

SEQ ID NO: 992509 - RNA, 23 nt, Homo sapiens
ccgccauccaccccguugcucaa

SEQ ID NO: 992510 - RNA, 19 nt, Homo sapiens
ccggcaacaucucugggaa

SEQ ID NO: 992511 - RNA, 16 nt, Homo sapiens
ccggcauggacaaugg

SEQ ID NO: 992512 - RNA, 15 nt, Homo sapiens
ccgggccacuccuuc

SEQ ID NO: 992513 - RNA, 15 nt, Homo sapiens
ccggggaaaggcaag

SEQ ID NO: 992514 - RNA, 15 nt, Homo sapiens
ccggggaacuggcca

SEQ ID NO: 992515 - RNA, 16 nt, Homo sapiens
ccggggcuccacugaa

SEQ ID NO: 992516 - RNA, 13 nt, Homo sapiens
ccgugacugcaau

SEQ ID NO: 992517 - RNA, 15 nt, Homo sapiens
ccgugugggagaccg

SEQ ID NO: 992518 - RNA, 18 nt, Homo sapiens
ccguucugugcacaaaac

SEQ ID NO: 992519 - RNA, 14 nt, Homo sapiens
ccuaaccuagagau

SEQ ID NO: 992520 - RNA, 18 nt, Homo sapiens
ccuaagcagaccacugau

SEQ ID NO: 992521 - RNA, 18 nt, Homo sapiens
ccuaagggccacauccca

SEQ ID NO: 992522 - RNA, 22 nt, Homo sapiens
ccuaaucuauggucgggagaca

SEQ ID NO: 992523 - RNA, 19 nt, Homo sapiens
ccuacagaacuucagaaag

SEQ ID NO: 992524 - RNA, 21 nt, Homo sapiens
ccuacauguauugcacauugu

SEQ ID NO: 992525 - RNA, 21 nt, Homo sapiens
ccuaccuuagaaaacaaguau

SEQ ID NO: 992526 - RNA, 15 nt, Homo sapiens
ccuaggaaaauguag

SEQ ID NO: 992527 - RNA, 14 nt, Homo sapiens
ccuaggcugcauug

SEQ ID NO: 992528 - RNA, 18 nt, Homo sapiens
ccuagguguuuuguucac

SEQ ID NO: 992529 - RNA, 22 nt, Homo sapiens
ccuaugcaugguuucagcacua

SEQ ID NO: 992530 - RNA, 23 nt, Homo sapiens
ccuauguuuuuguucaaagccag

SEQ ID NO: 992531 - RNA, 16 nt, Homo sapiens
ccuauuaaccuagaga

SEQ ID NO: 992532 - RNA, 20 nt, Homo sapiens
ccuauuuccauucaacaaga

SEQ ID NO: 992533 - RNA, 14 nt, Homo sapiens
ccuauuucuuaaac

SEQ ID NO: 992534 - RNA, 21 nt, Homo sapiens
ccucacuucagguauaccuca

SEQ ID NO: 992535 - RNA, 13 nt, Homo sapiens
ccucagccagccu

SEQ ID NO: 992536 - RNA, 15 nt, Homo sapiens
ccucagcucccacaa

SEQ ID NO: 992537 - RNA, 12 nt, Homo sapiens
ccucagcuuucc

SEQ ID NO: 992538 - RNA, 17 nt, Homo sapiens
ccucaguagucccugca

SEQ ID NO: 992539 - RNA, 17 nt, Homo sapiens
ccucaguuuuaucauuu

SEQ ID NO: 992540 - RNA, 20 nt, Homo sapiens
ccucaguuuuaucauuuuca

SEQ ID NO: 992541 - RNA, 18 nt, Homo sapiens
ccucaucccgagcaccuc

SEQ ID NO: 992542 - RNA, 14 nt, Homo sapiens
ccuccacagcagug

SEQ ID NO: 992543 - RNA, 17 nt, Homo sapiens
ccuccaccuccuaggcu

SEQ ID NO: 992544 - RNA, 16 nt, Homo sapiens
ccuccagccccuguag

SEQ ID NO: 992545 - RNA, 10 nt, Homo sapiens
ccuccaggga

SEQ ID NO: 992546 - RNA, 22 nt, Homo sapiens
ccucccagaaagcaaaccugua

SEQ ID NO: 992547 - RNA, 16 nt, Homo sapiens
ccucccccagaccucc

SEQ ID NO: 992548 - RNA, 17 nt, Homo sapiens
ccucccccagaccucca

SEQ ID NO: 992549 - RNA, 24 nt, Homo sapiens
ccuccccuucuucuccaucuccau

SEQ ID NO: 992550 - RNA, 14 nt, Homo sapiens
ccucccgggcucaa

SEQ ID NO: 992551 - RNA, 16 nt, Homo sapiens
ccucccucccagagca

SEQ ID NO: 992552 - RNA, 18 nt, Homo sapiens
ccucccuugggcacgugu

SEQ ID NO: 992553 - RNA, 15 nt, Homo sapiens
ccuccgcccugccac

SEQ ID NO: 992554 - RNA, 16 nt, Homo sapiens
ccuccuaaccuagaga

SEQ ID NO: 992555 - RNA, 13 nt, Homo sapiens
ccuccuccaggaa

SEQ ID NO: 992556 - RNA, 18 nt, Homo sapiens
ccuccugaagccacagca

SEQ ID NO: 992557 - RNA, 18 nt, Homo sapiens
ccucuaacagcaccaaau

SEQ ID NO: 992558 - RNA, 22 nt, Homo sapiens
ccucucagauucuuaucuggca

SEQ ID NO: 992559 - RNA, 18 nt, Homo sapiens
ccucuccacacagugcuc

SEQ ID NO: 992560 - RNA, 12 nt, Homo sapiens
ccucucccaguu

SEQ ID NO: 992561 - RNA, 20 nt, Homo sapiens
ccucucgcuccucaaccccu

SEQ ID NO: 992562 - RNA, 18 nt, Homo sapiens
ccucucguaagauuuccu

SEQ ID NO: 992563 - RNA, 23 nt, Homo sapiens
ccucucugcagacuucccagcua

SEQ ID NO: 992564 - RNA, 17 nt, Homo sapiens
ccucugcacuacugaca

SEQ ID NO: 992565 - RNA, 14 nt, Homo sapiens
ccucugcauuuaca

SEQ ID NO: 992566 - RNA, 18 nt, Homo sapiens
ccucuguccaggcacuga

SEQ ID NO: 992567 - RNA, 22 nt, Homo sapiens
ccucuuggagaagucucagcua

SEQ ID NO: 992568 - RNA, 22 nt, Homo sapiens
ccugaaauaauacauugcagca

SEQ ID NO: 992569 - RNA, 12 nt, Homo sapiens
ccugaaguauuu

SEQ ID NO: 992570 - RNA, 14 nt, Homo sapiens
ccugacaaccacug

SEQ ID NO: 992571 - RNA, 18 nt, Homo sapiens
ccugacgugcagccacac

SEQ ID NO: 992572 - RNA, 22 nt, Homo sapiens
cggccugcccccaccccauucc

SEQ ID NO: 992573 - RNA, 11 nt, Homo sapiens
cggcugaccau

SEQ ID NO: 992574 - RNA, 20 nt, Homo sapiens
cgggagcugcggaagcccag

SEQ ID NO: 992575 - RNA, 15 nt, Homo sapiens
cggggccagcacuuc

SEQ ID NO: 992576 - RNA, 15 nt, Homo sapiens
cggggcuccacugaa

SEQ ID NO: 992577 - RNA, 11 nt, Homo sapiens
cgguguucuaa

SEQ ID NO: 992578 - RNA, 13 nt, Homo sapiens
cguaaagauuugg

SEQ ID NO: 992579 - RNA, 19 nt, Homo sapiens
cguaaguacagagaagcca

SEQ ID NO: 992580 - RNA, 21 nt, Homo sapiens
cguagcuauccggacagagca

SEQ ID NO: 992581 - RNA, 15 nt, Homo sapiens
cguaggcuacagaga

SEQ ID NO: 992582 - RNA, 22 nt, Homo sapiens
cgucaagagugaauucccucac

SEQ ID NO: 992583 - RNA, 18 nt, Homo sapiens
cgucagugcugugcugug

SEQ ID NO: 992584 - RNA, 20 nt, Homo sapiens
cguccagcuggaagggucaa

SEQ ID NO: 992585 - RNA, 22 nt, Homo sapiens
cgucuguugugcgaaugacuga

SEQ ID NO: 992586 - RNA, 16 nt, Homo sapiens
cgugaccagugcugcu

SEQ ID NO: 992587 - RNA, 15 nt, Homo sapiens
cgugcgagcacacac

SEQ ID NO: 992588 - RNA, 19 nt, Homo sapiens
cguggagagggacuggcag

SEQ ID NO: 992589 - RNA, 22 nt, Homo sapiens
cgugugggagaccggccugcca

SEQ ID NO: 992590 - RNA, 18 nt, Homo sapiens
cguguguguucacguguu

SEQ ID NO: 992591 - RNA, 19 nt, Homo sapiens
cguguguuuuucuauuaaa

SEQ ID NO: 992592 - RNA, 18 nt, Homo sapiens
cguuaccauuuacauguu

SEQ ID NO: 992593 - RNA, 21 nt, Homo sapiens
cguucccaguguggcugaggc

SEQ ID NO: 992594 - RNA, 22 nt, Homo sapiens
cguugacaaguuuuguggggcu

SEQ ID NO: 992595 - RNA, 18 nt, Homo sapiens
cguuuucuaauugcuuau

SEQ ID NO: 992596 - RNA, 20 nt, Homo sapiens
cuaaaaucuuauaguucuag

SEQ ID NO: 992597 - RNA, 15 nt, Homo sapiens
cuaaaauuagaugaa

SEQ ID NO: 992598 - RNA, 14 nt, Homo sapiens
auuaacaaaaugua

SEQ ID NO: 992599 - RNA, 22 nt, Homo sapiens
auuaaccucugcacuacugaca

SEQ ID NO: 992600 - RNA, 23 nt, Homo sapiens
auuaacuuuaauguuuuuugcca

SEQ ID NO: 992601 - RNA, 18 nt, Homo sapiens
auuaagacuuuauguagu

SEQ ID NO: 992602 - RNA, 23 nt, Homo sapiens
auuaauaacgucuuuuuauaucu

SEQ ID NO: 992603 - RNA, 20 nt, Homo sapiens
auuaauucuauaaggccaua

SEQ ID NO: 992604 - RNA, 15 nt, Homo sapiens
auuacaggcaccugc

SEQ ID NO: 992605 - RNA, 22 nt, Homo sapiens
auuacuuuugcuguaauguuaa

SEQ ID NO: 992606 - RNA, 13 nt, Homo sapiens
auuagagccugua

SEQ ID NO: 992607 - RNA, 20 nt, Homo sapiens
auuagucucagugaagacua

SEQ ID NO: 992608 - RNA, 17 nt, Homo sapiens
auuauaauauacuauau

SEQ ID NO: 992609 - RNA, 17 nt, Homo sapiens
auuauagaaguuuagau

SEQ ID NO: 992610 - RNA, 17 nt, Homo sapiens
auuauaugcacuagcaa

SEQ ID NO: 992611 - RNA, 15 nt, Homo sapiens
auuauuuugugaugc

SEQ ID NO: 992612 - RNA, 14 nt, Homo sapiens
auucaaaguguuau

SEQ ID NO: 992613 - RNA, 15 nt, Homo sapiens
auucaauuuauuuga

SEQ ID NO: 992614 - RNA, 14 nt, Homo sapiens
auucacagugcucu

SEQ ID NO: 992615 - RNA, 17 nt, Homo sapiens
auucagcaaagaacaag

SEQ ID NO: 992616 - RNA, 14 nt, Homo sapiens
auucagguaauaca

SEQ ID NO: 992617 - RNA, 23 nt, Homo sapiens
auucagguaauacaaacuauaua

SEQ ID NO: 992618 - RNA, 17 nt, Homo sapiens
auucauagucuuuggag

SEQ ID NO: 992619 - RNA, 20 nt, Homo sapiens
auucaucgguauucauccaa

SEQ ID NO: 992620 - RNA, 19 nt, Homo sapiens
auucauuguguuaccugua

SEQ ID NO: 992621 - RNA, 15 nt, Homo sapiens
auuccaaagucucua

SEQ ID NO: 992622 - RNA, 15 nt, Homo sapiens
auuccaccaaaugug

SEQ ID NO: 992623 - RNA, 17 nt, Homo sapiens
auuccaccugcaaucaa

SEQ ID NO: 992624 - RNA, 19 nt, Homo sapiens
auuccagaaugcuguacau

SEQ ID NO: 992625 - RNA, 15 nt, Homo sapiens
auuccccaucucagg

SEQ ID NO: 992626 - RNA, 17 nt, Homo sapiens
auuccuguuugucuaca

SEQ ID NO: 992627 - RNA, 19 nt, Homo sapiens
auuccuuagacucuuuucc

SEQ ID NO: 992628 - RNA, 20 nt, Homo sapiens
auucuaaaugaauguuuaca

SEQ ID NO: 992629 - RNA, 21 nt, Homo sapiens
auucuauuacauuuucaguga

SEQ ID NO: 992630 - RNA, 18 nt, Homo sapiens
auucucaucaguccauug

SEQ ID NO: 992631 - RNA, 24 nt, Homo sapiens
auucucauuaaaagaauaucuggc

SEQ ID NO: 992632 - RNA, 18 nt, Homo sapiens
auucucugagcugugcag

SEQ ID NO: 992633 - RNA, 21 nt, Homo sapiens
auucucuggcuguaaggcucu

SEQ ID NO: 992634 - RNA, 17 nt, Homo sapiens
auucucugucucaucca

SEQ ID NO: 992635 - RNA, 13 nt, Homo sapiens
auucucuugccuc

SEQ ID NO: 992636 - RNA, 15 nt, Homo sapiens
auucucuugccucaa

SEQ ID NO: 992637 - RNA, 12 nt, Homo sapiens
auucuucuaauu

SEQ ID NO: 992638 - RNA, 17 nt, Homo sapiens
auucuucuaauuaacag

SEQ ID NO: 992639 - RNA, 19 nt, Homo sapiens
auugaaaagagcugaaggu

SEQ ID NO: 992640 - RNA, 22 nt, Homo sapiens
auugaaagugggcaaaagcuua

SEQ ID NO: 992641 - RNA, 18 nt, Homo sapiens
auugaauacuuugaaugu

SEQ ID NO: 992642 - RNA, 24 nt, Homo sapiens
auugacaugugccagggcaaugau

SEQ ID NO: 992643 - RNA, 22 nt, Homo sapiens
auugaccgcgacuaauuucaaa

SEQ ID NO: 992644 - RNA, 15 nt, Homo sapiens
auugacuuuccccac

SEQ ID NO: 992645 - RNA, 18 nt, Homo sapiens
auugacuuugacaauuac

SEQ ID NO: 992646 - RNA, 19 nt, Homo sapiens
auugaucgacuugccaaau

SEQ ID NO: 992647 - RNA, 17 nt, Homo sapiens
auugauuuuaaccaaug

SEQ ID NO: 992648 - RNA, 20 nt, Homo sapiens
auugcacguguguauugcaa

SEQ ID NO: 992649 - RNA, 17 nt, Homo sapiens
auugcagcaagcaauaa

SEQ ID NO: 992650 - RNA, 17 nt, Homo sapiens
auugcaucccaaaccac

SEQ ID NO: 992651 - RNA, 16 nt, Homo sapiens
auugcucuugagucuu

SEQ ID NO: 992652 - RNA, 14 nt, Homo sapiens
auugggaauccgcc

SEQ ID NO: 992653 - RNA, 13 nt, Homo sapiens
auugguccaagau

SEQ ID NO: 992654 - RNA, 22 nt, Homo sapiens
auuguaacucaaaggguggaau

SEQ ID NO: 992655 - RNA, 14 nt, Homo sapiens
auuguagccucaau

SEQ ID NO: 992656 - RNA, 16 nt, Homo sapiens
auuuaaacaccuccuc

SEQ ID NO: 992657 - RNA, 17 nt, Homo sapiens
auuuacaggaacuucau

SEQ ID NO: 992658 - RNA, 23 nt, Homo sapiens
auuuaggauaaccuugugccuug

SEQ ID NO: 992659 - RNA, 22 nt, Homo sapiens
auuuaguuugauuauucagugu

SEQ ID NO: 992660 - RNA, 16 nt, Homo sapiens
auuuauguccaggugu

SEQ ID NO: 992661 - RNA, 20 nt, Homo sapiens
auuucagaaguuaguuugua

SEQ ID NO: 992662 - RNA, 12 nt, Homo sapiens
auuucagacucc

SEQ ID NO: 992663 - RNA, 15 nt, Homo sapiens
auuucagcagggaug

SEQ ID NO: 992664 - RNA, 19 nt, Homo sapiens
auuucccaggacccugaag

SEQ ID NO: 992665 - RNA, 21 nt, Homo sapiens
auuucuaauuauguagcucuu

SEQ ID NO: 992666 - RNA, 16 nt, Homo sapiens
auuucuauagccaaaa

SEQ ID NO: 992667 - RNA, 16 nt, Homo sapiens
auuucuccaaagccuu

SEQ ID NO: 992668 - RNA, 20 nt, Homo sapiens
auuucuuaaacacuugcaac

SEQ ID NO: 992669 - RNA, 17 nt, Homo sapiens
auuucuucuacaacuca

SEQ ID NO: 992670 - RNA, 16 nt, Homo sapiens
auuucuucuacugcua

SEQ ID NO: 992671 - RNA, 17 nt, Homo sapiens
auuucuucuacugcuau

SEQ ID NO: 992672 - RNA, 16 nt, Homo sapiens
auuugaaauauggucu

SEQ ID NO: 992673 - RNA, 13 nt, Homo sapiens
auuugagugcucu

SEQ ID NO: 992674 - RNA, 15 nt, Homo sapiens
auuugccauagccuu

SEQ ID NO: 992675 - RNA, 13 nt, Homo sapiens
auuugcuauuuau

SEQ ID NO: 992676 - RNA, 18 nt, Homo sapiens
auuugcuauuuauuaaau

SEQ ID NO: 992677 - RNA, 19 nt, Homo sapiens
auuugcugagcauguacug

SEQ ID NO: 992678 - RNA, 17 nt, Homo sapiens
auuugcuguuuuaaaca

SEQ ID NO: 992679 - RNA, 20 nt, Homo sapiens
auuugcuuuggaaguuuuaa

SEQ ID NO: 992680 - RNA, 17 nt, Homo sapiens
auuugggccugcuccag

SEQ ID NO: 992681 - RNA, 20 nt, Homo sapiens
auuugggccugcuccagacc

SEQ ID NO: 992682 - RNA, 15 nt, Homo sapiens
auuugggugaacaaa

SEQ ID NO: 992683 - RNA, 17 nt, Homo sapiens
auuuguaaaucugccac

SEQ ID NO: 992684 - RNA, 15 nt, Homo sapiens
auuuguagcaauuua

SEQ ID NO: 992685 - RNA, 16 nt, Homo sapiens
auuuguagcaauuuaa

SEQ ID NO: 992686 - RNA, 18 nt, Homo sapiens
uuuugcacacuuugccau

SEQ ID NO: 992687 - RNA, 20 nt, Homo sapiens
uuuugcaguucccacauuaa

SEQ ID NO: 992688 - RNA, 18 nt, Homo sapiens
uuuuuacugcucugagaa

SEQ ID NO: 992689 - RNA, 22 nt, Homo sapiens
uuuuuauaaaaaugagugcuua

SEQ ID NO: 992690 - RNA, 14 nt, Homo sapiens
uuuuuccucugcau

SEQ ID NO: 992691 - RNA, 22 nt, Homo sapiens
uuuuucuuugagacugggucuc

SEQ ID NO: 992692 - RNA, 18 nt, Homo sapiens
uuuuuuaaaaaagcuuaa

SEQ ID NO: 992693 - RNA, 14 nt, Homo sapiens
uuuuuucaguauua

SEQ ID NO: 992694 - RNA, 20 nt, Homo sapiens
cucaucaauggggccaguca

SEQ ID NO: 992695 - RNA, 17 nt, Homo sapiens
cucaucccuccaucuca

SEQ ID NO: 992696 - RNA, 14 nt, Homo sapiens
cucauccuccuucu

SEQ ID NO: 992697 - RNA, 14 nt, Homo sapiens
cucaugaagcauac

SEQ ID NO: 992698 - RNA, 21 nt, Homo sapiens
cucaugauaccaccuuuacug

SEQ ID NO: 992699 - RNA, 20 nt, Homo sapiens
cucaugccuguaaucccagc

SEQ ID NO: 992700 - RNA, 20 nt, Homo sapiens
cucauguugaagccacugcc

SEQ ID NO: 992701 - RNA, 19 nt, Homo sapiens
cucauuuaauccucccuuc

SEQ ID NO: 992702 - RNA, 22 nt, Homo sapiens
cuccaacaccaagcacagcagc

SEQ ID NO: 992703 - RNA, 18 nt, Homo sapiens
cuccaacaucacagccca

SEQ ID NO: 992704 - RNA, 13 nt, Homo sapiens
cuccaaguggucc

SEQ ID NO: 992705 - RNA, 23 nt, Homo sapiens
cuccacaauagcagacaguguuu

SEQ ID NO: 992706 - RNA, 15 nt, Homo sapiens
cuccacccacugugg

SEQ ID NO: 992707 - RNA, 16 nt, Homo sapiens
cuccaccuagacugua

SEQ ID NO: 992708 - RNA, 19 nt, Homo sapiens
cuccagauuagagccugua

SEQ ID NO: 992709 - RNA, 21 nt, Homo sapiens
cuccagggacagcaacuauca

SEQ ID NO: 992710 - RNA, 12 nt, Homo sapiens
cuccaguguccu

SEQ ID NO: 992711 - RNA, 13 nt, Homo sapiens
cuccaguguccug

SEQ ID NO: 992712 - RNA, 22 nt, Homo sapiens
cuccaguuuacccuucagguug

SEQ ID NO: 992713 - RNA, 14 nt, Homo sapiens
cucccaacucuugc

SEQ ID NO: 992714 - RNA, 18 nt, Homo sapiens
cucccagagcaccugcug

SEQ ID NO: 992715 - RNA, 20 nt, Homo sapiens
cucccaggcaaggcugugga

SEQ ID NO: 992716 - RNA, 16 nt, Homo sapiens
cuccccagcccagaga

SEQ ID NO: 992717 - RNA, 23 nt, Homo sapiens
cuccccaguucauugcacuuuga

SEQ ID NO: 992718 - RNA, 15 nt, Homo sapiens
cucccccagaccucc

SEQ ID NO: 992719 - RNA, 17 nt, Homo sapiens
cucccccagaccuccac

SEQ ID NO: 992720 - RNA, 23 nt, Homo sapiens
cuccccuccaucccuggcccccu

SEQ ID NO: 992721 - RNA, 23 nt, Homo sapiens
cuccccugccugcccuggugaca

SEQ ID NO: 992722 - RNA, 16 nt, Homo sapiens
cucccucuuucuuccc

SEQ ID NO: 992723 - RNA, 16 nt, Homo sapiens
cucccugaagccuuug

SEQ ID NO: 992724 - RNA, 12 nt, Homo sapiens
cucccuguaacu

SEQ ID NO: 992725 - RNA, 17 nt, Homo sapiens
cucccuguuccccagag

SEQ ID NO: 992726 - RNA, 15 nt, Homo sapiens
cucccuuccucccua

SEQ ID NO: 992727 - RNA, 24 nt, Homo sapiens
cuccgcucuguagugcuacagggu

SEQ ID NO: 992728 - RNA, 22 nt, Homo sapiens
cuccuaagcaacuaggccuuca

SEQ ID NO: 992729 - RNA, 17 nt, Homo sapiens
cuccugccggcuccuug

SEQ ID NO: 992730 - RNA, 23 nt, Homo sapiens
cuccugcgcccuucauugccaca

SEQ ID NO: 992731 - RNA, 17 nt, Homo sapiens
cucgcuuuguugcccag

SEQ ID NO: 992732 - RNA, 14 nt, Homo sapiens
cucggccuucacaa

SEQ ID NO: 992733 - RNA, 16 nt, Homo sapiens
cucuaacaaugacauu

SEQ ID NO: 992734 - RNA, 15 nt, Homo sapiens
cucuaagaucuuaga

SEQ ID NO: 992735 - RNA, 15 nt, Homo sapiens
cucuaauacauucca

SEQ ID NO: 992736 - RNA, 16 nt, Homo sapiens
cucuaauacauuccaa

SEQ ID NO: 992737 - RNA, 19 nt, Homo sapiens
cucuacaucuucugccuua

SEQ ID NO: 992738 - RNA, 16 nt, Homo sapiens
cucuacugaaugucau

SEQ ID NO: 992739 - RNA, 14 nt, Homo sapiens
cucuacugccucaa

SEQ ID NO: 992740 - RNA, 14 nt, Homo sapiens
cucuacugccuugg

SEQ ID NO: 992741 - RNA, 21 nt, Homo sapiens
cucuauuuagcaacagaauua

SEQ ID NO: 992742 - RNA, 16 nt, Homo sapiens
cucucaacacccaguu

SEQ ID NO: 992743 - RNA, 13 nt, Homo sapiens
cucucacccucau

SEQ ID NO: 992744 - RNA, 12 nt, Homo sapiens
cucucagccuua

SEQ ID NO: 992745 - RNA, 17 nt, Homo sapiens
cucuccaauacucaggu

SEQ ID NO: 992746 - RNA, 17 nt, Homo sapiens
cucuccauucugcuccu

SEQ ID NO: 992747 - RNA, 17 nt, Homo sapiens
cucugaccugcacuggg

SEQ ID NO: 992748 - RNA, 14 nt, Homo sapiens
cucugaugcagcuu

SEQ ID NO: 992749 - RNA, 15 nt, Homo sapiens
cucugcaccuuugca

SEQ ID NO: 992750 - RNA, 18 nt, Homo sapiens
cucugcauggaacagcau

SEQ ID NO: 992751 - RNA, 13 nt, Homo sapiens
cucugccagugac

SEQ ID NO: 992752 - RNA, 16 nt, Homo sapiens
cucuggcuuggccaca

SEQ ID NO: 992753 - RNA, 15 nt, Homo sapiens
cucugguaauauuga

SEQ ID NO: 992754 - RNA, 13 nt, Homo sapiens
cucugguggcaca

SEQ ID NO: 992755 - RNA, 18 nt, Homo sapiens
cucuguagugcuacaggg

SEQ ID NO: 992756 - RNA, 18 nt, Homo sapiens
cucugugggcuccaugua

SEQ ID NO: 992757 - RNA, 21 nt, Homo sapiens
cucuguuuuacaaguuggagu

SEQ ID NO: 992758 - RNA, 14 nt, Homo sapiens
cucuuauugccuca

SEQ ID NO: 992759 - RNA, 20 nt, Homo sapiens
cucuucagccauaguggauc

SEQ ID NO: 992760 - RNA, 15 nt, Homo sapiens
cucuuccaccacaga

SEQ ID NO: 992761 - RNA, 17 nt, Homo sapiens
cucuucccccaccacca

SEQ ID NO: 992762 - RNA, 18 nt, Homo sapiens
cucuucccccucucccag

SEQ ID NO: 992763 - RNA, 23 nt, Homo sapiens
cucuucuggggcaggcugggcca

SEQ ID NO: 992764 - RNA, 18 nt, Homo sapiens
cucuugccucaaccuccc

SEQ ID NO: 992765 - RNA, 18 nt, Homo sapiens
cucuuguauaugaugauc

SEQ ID NO: 992766 - RNA, 17 nt, Homo sapiens
cucuuguugagugccag

SEQ ID NO: 992767 - RNA, 17 nt, Homo sapiens
cucuuucucugccagug

SEQ ID NO: 992768 - RNA, 22 nt, Homo sapiens
cucuuuggcuccccuguaccuu

SEQ ID NO: 992769 - RNA, 13 nt, Homo sapiens
cucuuuggggcua

SEQ ID NO: 992770 - RNA, 22 nt, Homo sapiens
uauuuguuaauaguuccugcua

SEQ ID NO: 992771 - RNA, 16 nt, Homo sapiens
uauuuucaaagacuua

SEQ ID NO: 992772 - RNA, 18 nt, Homo sapiens
uauuuugcauaguaccaa

SEQ ID NO: 992773 - RNA, 22 nt, Homo sapiens
uauuuugcauaguaccaaucau

SEQ ID NO: 992774 - RNA, 16 nt, Homo sapiens
uauuuugucuuuuugc

SEQ ID NO: 992775 - RNA, 16 nt, Homo sapiens
uauuuuuucaguauua

SEQ ID NO: 992776 - RNA, 13 nt, Homo sapiens
ucaaaaccagguc

SEQ ID NO: 992777 - RNA, 19 nt, Homo sapiens
ucaaaagucuggccuuuca

SEQ ID NO: 992778 - RNA, 19 nt, Homo sapiens
ucaaaaguuuguuugcuua

SEQ ID NO: 992779 - RNA, 14 nt, Homo sapiens
ucaaaaugcuuuuu

SEQ ID NO: 992780 - RNA, 19 nt, Homo sapiens
ucaaagcaucuugcauuau

SEQ ID NO: 992781 - RNA, 15 nt, Homo sapiens
ucaaagguucuaggu

SEQ ID NO: 992782 - RNA, 21 nt, Homo sapiens
ucaaauacauuuaaaacauua

SEQ ID NO: 992783 - RNA, 19 nt, Homo sapiens
ucaaauuacuuugugaaua

SEQ ID NO: 992784 - RNA, 16 nt, Homo sapiens
ucaaauuggagcuuca

SEQ ID NO: 992785 - RNA, 14 nt, Homo sapiens
ucaacaauuucaau

SEQ ID NO: 992786 - RNA, 22 nt, Homo sapiens
ucaacagaagggauaccgucuc

SEQ ID NO: 992787 - RNA, 22 nt, Homo sapiens
ucaacagcauuuucaagcaguu

SEQ ID NO: 992788 - RNA, 20 nt, Homo sapiens
ucaacaucuuuuacauucug

SEQ ID NO: 992789 - RNA, 17 nt, Homo sapiens
ucaacauuucucaauaa

SEQ ID NO: 992790 - RNA, 20 nt, Homo sapiens
ucaaccccuccccuccaucc

SEQ ID NO: 992791 - RNA, 21 nt, Homo sapiens
ucaaccccuccccuccauccc

SEQ ID NO: 992792 - RNA, 22 nt, Homo sapiens
ucaaccccuccccuccaucccu

SEQ ID NO: 992793 - RNA, 18 nt, Homo sapiens
ucaaccucccaagcaguu

SEQ ID NO: 992794 - RNA, 15 nt, Homo sapiens
ucaaccucuacaggg

SEQ ID NO: 992795 - RNA, 16 nt, Homo sapiens
ucaacuugcuuaucaa

SEQ ID NO: 992796 - RNA, 23 nt, Homo sapiens
ucaagaaauaaaaggaagccaaa

SEQ ID NO: 992797 - RNA, 16 nt, Homo sapiens
ucaagcagucgugccu

SEQ ID NO: 992798 - RNA, 19 nt, Homo sapiens
ucaagcgauucucuugccu

SEQ ID NO: 992799 - RNA, 22 nt, Homo sapiens
ucaagcgauucucuugccucaa

SEQ ID NO: 992800 - RNA, 19 nt, Homo sapiens
ucaagguuuuagguucuaa

SEQ ID NO: 992801 - RNA, 19 nt, Homo sapiens
ucaaguccuacaagcuaaa

SEQ ID NO: 992802 - RNA, 16 nt, Homo sapiens
ucaagucucucacccu

SEQ ID NO: 992803 - RNA, 23 nt, Homo sapiens
ucaauaaaaaaaauaauaaucau

SEQ ID NO: 992804 - RNA, 15 nt, Homo sapiens
ucaauauucagcaaa

SEQ ID NO: 992805 - RNA, 12 nt, Homo sapiens
ucaauccagcua

SEQ ID NO: 992806 - RNA, 12 nt, Homo sapiens
ucaaucucuggg

SEQ ID NO: 992807 - RNA, 15 nt, Homo sapiens
ucaaugcaguugucu

SEQ ID NO: 992808 - RNA, 10 nt, Homo sapiens
ucacaaagug

SEQ ID NO: 992809 - RNA, 20 nt, Homo sapiens
ucacaaccaagaauguuaug

SEQ ID NO: 992810 - RNA, 23 nt, Homo sapiens
ucacaaucucuguuuguaugugg

SEQ ID NO: 992811 - RNA, 21 nt, Homo sapiens
ucacaccacuagccucagggg

SEQ ID NO: 992812 - RNA, 18 nt, Homo sapiens
ucacagagugcauuguga

SEQ ID NO: 992813 - RNA, 17 nt, Homo sapiens
ucacaggccccaggaaa

SEQ ID NO: 992814 - RNA, 16 nt, Homo sapiens
ucacaguguugcccag

SEQ ID NO: 992815 - RNA, 21 nt, Homo sapiens
ucacaguuugaaauaagcuau

SEQ ID NO: 992816 - RNA, 13 nt, Homo sapiens
ucacauacaaauc

SEQ ID NO: 992817 - RNA, 20 nt, Homo sapiens
ucacauacaaaucauccauc

SEQ ID NO: 992818 - RNA, 16 nt, Homo sapiens
ucacaugaugcacuuc

SEQ ID NO: 992819 - RNA, 19 nt, Homo sapiens
ucaccaagcuaggugcuau

SEQ ID NO: 992820 - RNA, 20 nt, Homo sapiens
ucaccaagcuaggugcuauu

SEQ ID NO: 992821 - RNA, 13 nt, Homo sapiens
ucaccagaucuga

SEQ ID NO: 992822 - RNA, 19 nt, Homo sapiens
ucaccauuuggcaaugcca

SEQ ID NO: 992823 - RNA, 20 nt, Homo sapiens
ucaccauuuggcaaugccau

SEQ ID NO: 992824 - RNA, 13 nt, Homo sapiens
ucacccugccuua

SEQ ID NO: 992825 - RNA, 19 nt, Homo sapiens
ucaccucagauggcagcuu

SEQ ID NO: 992826 - RNA, 16 nt, Homo sapiens
ucaccucuugccuucu

SEQ ID NO: 992827 - RNA, 22 nt, Homo sapiens
ucaccuuggcaccagacaccca

SEQ ID NO: 992828 - RNA, 20 nt, Homo sapiens
ucugaaaaauuuguaguuua

SEQ ID NO: 992829 - RNA, 19 nt, Homo sapiens
ucugaaaauauaaccagcc

SEQ ID NO: 992830 - RNA, 19 nt, Homo sapiens
ucugaacuugcauugugau

SEQ ID NO: 992831 - RNA, 20 nt, Homo sapiens
ucugaauaaaguguaacaau

SEQ ID NO: 992832 - RNA, 21 nt, Homo sapiens
ucugaauugcacaugugagca

SEQ ID NO: 992833 - RNA, 22 nt, Homo sapiens
ucugacccagugcccccacuga

SEQ ID NO: 992834 - RNA, 15 nt, Homo sapiens
ucugagacauuccac

SEQ ID NO: 992835 - RNA, 13 nt, Homo sapiens
ucugagcugugca

SEQ ID NO: 992836 - RNA, 21 nt, Homo sapiens
ucugauaaaagauggccauau

SEQ ID NO: 992837 - RNA, 18 nt, Homo sapiens
ucugauuaaaaugcuucc

SEQ ID NO: 992838 - RNA, 11 nt, Homo sapiens
ucugcacggga

SEQ ID NO: 992839 - RNA, 19 nt, Homo sapiens
ucugccaaaggaugugaua

SEQ ID NO: 992840 - RNA, 16 nt, Homo sapiens
ucugcccccugcagaa

SEQ ID NO: 992841 - RNA, 13 nt, Homo sapiens
ucugccuuugcca

SEQ ID NO: 992842 - RNA, 20 nt, Homo sapiens
ucugcgugucaccugugcuu

SEQ ID NO: 992843 - RNA, 15 nt, Homo sapiens
ucugcuccuguucac

SEQ ID NO: 992844 - RNA, 20 nt, Homo sapiens
ucugcuuuucccauugccau

SEQ ID NO: 992845 - RNA, 18 nt, Homo sapiens
ucuggaagauggggacca

SEQ ID NO: 992846 - RNA, 22 nt, Homo sapiens
ucuggagaaggugggcacugga

SEQ ID NO: 992847 - RNA, 12 nt, Homo sapiens
ucuggagcauuu

SEQ ID NO: 992848 - RNA, 23 nt, Homo sapiens
ucuggagggguguggcuccuucc

SEQ ID NO: 992849 - RNA, 16 nt, Homo sapiens
ucuggaguauucuaua

SEQ ID NO: 992850 - RNA, 22 nt, Homo sapiens
ucuggcagccacacuucucagg

SEQ ID NO: 992851 - RNA, 16 nt, Homo sapiens
ucuggcccuugcuuac

SEQ ID NO: 992852 - RNA, 20 nt, Homo sapiens
ucuggcccuugcuuaccucu

SEQ ID NO: 992853 - RNA, 17 nt, Homo sapiens
ucugggagucacacagu

SEQ ID NO: 992854 - RNA, 18 nt, Homo sapiens
ucuggguacuucuugaag

SEQ ID NO: 992855 - RNA, 16 nt, Homo sapiens
ucugguaauauugacu

SEQ ID NO: 992856 - RNA, 22 nt, Homo sapiens
ucugguaauauugacuuguaua

SEQ ID NO: 992857 - RNA, 22 nt, Homo sapiens
ucuguaagaaaccuacugccca

SEQ ID NO: 992858 - RNA, 21 nt, Homo sapiens
ucuguagguugcacacuuugg

SEQ ID NO: 992859 - RNA, 18 nt, Homo sapiens
ucuguagugcuacagggu

SEQ ID NO: 992860 - RNA, 11 nt, Homo sapiens
ucuguaucugc

SEQ ID NO: 992861 - RNA, 15 nt, Homo sapiens
ucuguaucugccaug

SEQ ID NO: 992862 - RNA, 17 nt, Homo sapiens
ucugucagucacagcca

SEQ ID NO: 992863 - RNA, 14 nt, Homo sapiens
ucugucccuaggug

SEQ ID NO: 992864 - RNA, 14 nt, Homo sapiens
ucugucuguggcaa

SEQ ID NO: 992865 - RNA, 19 nt, Homo sapiens
ucugugggcuccauguaga

SEQ ID NO: 992866 - RNA, 14 nt, Homo sapiens
ucuguguuaggggu

SEQ ID NO: 992867 - RNA, 15 nt, Homo sapiens
ucuguugauugauga

SEQ ID NO: 992868 - RNA, 21 nt, Homo sapiens
ucuuaaacuaaaugugcaaua

SEQ ID NO: 992869 - RNA, 21 nt, Homo sapiens
ucuuaacuggucuccuugcuu

SEQ ID NO: 992870 - RNA, 15 nt, Homo sapiens
ucuuacuggugcuau

SEQ ID NO: 992871 - RNA, 15 nt, Homo sapiens
ucuuagcucaaugag

SEQ ID NO: 992872 - RNA, 23 nt, Homo sapiens
ucuuauucuggcggcagcgccuu

SEQ ID NO: 992873 - RNA, 12 nt, Homo sapiens
ucuuauugccuc

SEQ ID NO: 992874 - RNA, 14 nt, Homo sapiens
ucuuauugccucac

SEQ ID NO: 992875 - RNA, 22 nt, Homo sapiens
ucuucaaaugccugacuaggga

SEQ ID NO: 992876 - RNA, 22 nt, Homo sapiens
ucuucaagacgacagcucugua

SEQ ID NO: 992877 - RNA, 17 nt, Homo sapiens
ucuuccauuugcaaggg

SEQ ID NO: 992878 - RNA, 22 nt, Homo sapiens
ucuucccucucugcagacuucc

SEQ ID NO: 992879 - RNA, 20 nt, Homo sapiens
ucuuccugaguggugccaaa

SEQ ID NO: 992880 - RNA, 15 nt, Homo sapiens
ucuucuaaauggcaa

SEQ ID NO: 992881 - RNA, 21 nt, Homo sapiens
ucuucuacagaugagucacac

SEQ ID NO: 992882 - RNA, 19 nt, Homo sapiens
ucuucuggacugguuuuca

SEQ ID NO: 992883 - RNA, 17 nt, Homo sapiens
uuagucaggaauggcug

SEQ ID NO: 992884 - RNA, 13 nt, Homo sapiens
uuagucaugugac

SEQ ID NO: 992885 - RNA, 21 nt, Homo sapiens
uuagugaucaaauugugcagu

SEQ ID NO: 992886 - RNA, 15 nt, Homo sapiens
uuagugauggagcuu

SEQ ID NO: 992887 - RNA, 18 nt, Homo sapiens
uuagugcacaagcacuau

SEQ ID NO: 992888 - RNA, 20 nt, Homo sapiens
uuaguuuacaaucagccaca

SEQ ID NO: 992889 - RNA, 17 nt, Homo sapiens
uuauaaaaaaugguuca

SEQ ID NO: 992890 - RNA, 20 nt, Homo sapiens
uuauaagaaagaucaaagac

SEQ ID NO: 992891 - RNA, 20 nt, Homo sapiens
uuauaauuguucucagaauc

SEQ ID NO: 992892 - RNA, 19 nt, Homo sapiens
uuauacauguguaaacaau

SEQ ID NO: 992893 - RNA, 15 nt, Homo sapiens
uuauaguuacugugu

SEQ ID NO: 992894 - RNA, 21 nt, Homo sapiens
uuauauauggggaugguaguu

SEQ ID NO: 992895 - RNA, 13 nt, Homo sapiens
uuauauucaucca

SEQ ID NO: 992896 - RNA, 20 nt, Homo sapiens
uuaucuugcaccccaaagcu

SEQ ID NO: 992897 - RNA, 15 nt, Homo sapiens
uuaugaaaaagaaga

SEQ ID NO: 992898 - RNA, 19 nt, Homo sapiens
uuaugaagaaggugaauag

SEQ ID NO: 992899 - RNA, 13 nt, Homo sapiens
uuaugcagagcca

SEQ ID NO: 992900 - RNA, 20 nt, Homo sapiens
uuaugucccugacuguaaau

SEQ ID NO: 992901 - RNA, 21 nt, Homo sapiens
uuaugucuggggcagaaacac

SEQ ID NO: 992902 - RNA, 24 nt, Homo sapiens
uuaugucuggggcagaaacacuca

SEQ ID NO: 992903 - RNA, 16 nt, Homo sapiens
uuaugugcaaguuuau

SEQ ID NO: 992904 - RNA, 23 nt, Homo sapiens
uuauguuaaaucaauaaagacca

SEQ ID NO: 992905 - RNA, 21 nt, Homo sapiens
uuauuaaaguacaaccauaga

SEQ ID NO: 992906 - RNA, 17 nt, Homo sapiens
uuauuaauuucuucaca

SEQ ID NO: 992907 - RNA, 15 nt, Homo sapiens
uuauuacucuauaca

SEQ ID NO: 992908 - RNA, 13 nt, Homo sapiens
uuauugacuaaca

SEQ ID NO: 992909 - RNA, 17 nt, Homo sapiens
uuauugccucacuucag

SEQ ID NO: 992910 - RNA, 22 nt, Homo sapiens
uuauugguguaagguacuuuca

SEQ ID NO: 992911 - RNA, 23 nt, Homo sapiens
uuauuugcuaccacagcaacuau

SEQ ID NO: 992912 - RNA, 16 nt, Homo sapiens
uucaaagguacuugga

SEQ ID NO: 992913 - RNA, 19 nt, Homo sapiens
uucaacaaagaaacaaaga

SEQ ID NO: 992914 - RNA, 13 nt, Homo sapiens
uucaacaauuuca

SEQ ID NO: 992915 - RNA, 15 nt, Homo sapiens
uucaacagagacuga

SEQ ID NO: 992916 - RNA, 18 nt, Homo sapiens
uucaacaguuuuugcuaa

SEQ ID NO: 992917 - RNA, 15 nt, Homo sapiens
uucaagccugugcaa

SEQ ID NO: 992918 - RNA, 21 nt, Homo sapiens
uucacaaggucuuuaaaguga

SEQ ID NO: 992919 - RNA, 17 nt, Homo sapiens
uucacauuagaagacaa

SEQ ID NO: 992920 - RNA, 22 nt, Homo sapiens
uucaccaaaucuugguugaugc

SEQ ID NO: 992921 - RNA, 16 nt, Homo sapiens
uucaccucuucuuucc

SEQ ID NO: 992922 - RNA, 15 nt, Homo sapiens
uucacugucaccacc

SEQ ID NO: 992923 - RNA, 19 nt, Homo sapiens
uucacuuaaguuaguucca

SEQ ID NO: 992924 - RNA, 15 nt, Homo sapiens
uucagacaagcugca

SEQ ID NO: 992925 - RNA, 18 nt, Homo sapiens
uucagacuccaaacagac

SEQ ID NO: 992926 - RNA, 19 nt, Homo sapiens
uucagagagcagugcuuuu

SEQ ID NO: 992927 - RNA, 23 nt, Homo sapiens
uucagcuccugaccaguugcagu

SEQ ID NO: 992928 - RNA, 12 nt, Homo sapiens
uucauacuguaa

SEQ ID NO: 992929 - RNA, 16 nt, Homo sapiens
uucauauuguugcauu

SEQ ID NO: 992930 - RNA, 11 nt, Homo sapiens
uucaucucuug

SEQ ID NO: 992931 - RNA, 19 nt, Homo sapiens
uucauuccuucagauuugg

SEQ ID NO: 992932 - RNA, 13 nt, Homo sapiens
uucauucugcaag

SEQ ID NO: 992933 - RNA, 16 nt, Homo sapiens
uucauucugcaaguau

SEQ ID NO: 992934 - RNA, 16 nt, Homo sapiens
uucauugcacuuugau

SEQ ID NO: 992935 - RNA, 17 nt, Homo sapiens
uuccaaagaacagccug

SEQ ID NO: 992936 - RNA, 23 nt, Homo sapiens
uuccaagacucuagaguccaagg

SEQ ID NO: 992937 - RNA, 15 nt, Homo sapiens
ucaguuuccucacca

SEQ ID NO: 992938 - RNA, 17 nt, Homo sapiens
ucaguuucuaggcaccu

SEQ ID NO: 992939 - RNA, 20 nt, Homo sapiens
ucauaucauccacacaugaa

SEQ ID NO: 992940 - RNA, 19 nt, Homo sapiens
ucaucaacuaccauucuau

SEQ ID NO: 992941 - RNA, 20 nt, Homo sapiens
ucaucaauggggccagucag

SEQ ID NO: 992942 - RNA, 15 nt, Homo sapiens
ucaucacauucaggg

SEQ ID NO: 992943 - RNA, 14 nt, Homo sapiens
ucaucaggugcaua

SEQ ID NO: 992944 - RNA, 22 nt, Homo sapiens
ucaucaguaguucacauacaaa

SEQ ID NO: 992945 - RNA, 14 nt, Homo sapiens
ucaucauggccagc

SEQ ID NO: 992946 - RNA, 16 nt, Homo sapiens
ucaucaugugugucca

SEQ ID NO: 992947 - RNA, 18 nt, Homo sapiens
ucaucauucucugucuca

SEQ ID NO: 992948 - RNA, 22 nt, Homo sapiens
ucaucauuucacuugucaggag

SEQ ID NO: 992949 - RNA, 14 nt, Homo sapiens
ucauccauguccaa

SEQ ID NO: 992950 - RNA, 15 nt, Homo sapiens
ucaucuugcuaccag

SEQ ID NO: 992951 - RNA, 20 nt, Homo sapiens
ucaucuuggaacugcauucu

SEQ ID NO: 992952 - RNA, 23 nt, Homo sapiens
ucaugcccccaccccugcucucc

SEQ ID NO: 992953 - RNA, 20 nt, Homo sapiens
ucaugccccuggcugggacg

SEQ ID NO: 992954 - RNA, 13 nt, Homo sapiens
ucaugccucugag

SEQ ID NO: 992955 - RNA, 18 nt, Homo sapiens
ucauggauaaauugcaca

SEQ ID NO: 992956 - RNA, 17 nt, Homo sapiens
ucauguaaacugugcac

SEQ ID NO: 992957 - RNA, 18 nt, Homo sapiens
ucauguaaauaauacauu

SEQ ID NO: 992958 - RNA, 18 nt, Homo sapiens
ucaugugaccacucuguc

SEQ ID NO: 992959 - RNA, 23 nt, Homo sapiens
ucauguguguccacgacugucuc

SEQ ID NO: 992960 - RNA, 16 nt, Homo sapiens
ucauuauuuaugucca

SEQ ID NO: 992961 - RNA, 18 nt, Homo sapiens
ucauucuguuagauacua

SEQ ID NO: 992962 - RNA, 23 nt, Homo sapiens
ucauugaugagcaagacauacuu

SEQ ID NO: 992963 - RNA, 15 nt, Homo sapiens
ucauugccacacuug

SEQ ID NO: 992964 - RNA, 14 nt, Homo sapiens
ucauuguaaucacu

SEQ ID NO: 992965 - RNA, 16 nt, Homo sapiens
ucauuucaucuaccau

SEQ ID NO: 992966 - RNA, 19 nt, Homo sapiens
uccaaacagaccccuguuc

SEQ ID NO: 992967 - RNA, 21 nt, Homo sapiens
uccaacaccaagcacagcagc

SEQ ID NO: 992968 - RNA, 16 nt, Homo sapiens
uccaaugagcuuucug

SEQ ID NO: 992969 - RNA, 17 nt, Homo sapiens
uccacaccuuuuauuga

SEQ ID NO: 992970 - RNA, 10 nt, Homo sapiens
uccacagcaa

SEQ ID NO: 992971 - RNA, 17 nt, Homo sapiens
uccaccaaaugugcuuu

SEQ ID NO: 992972 - RNA, 17 nt, Homo sapiens
uccaccccuuucuagac

SEQ ID NO: 992973 - RNA, 15 nt, Homo sapiens
uccaccuagacugua

SEQ ID NO: 992974 - RNA, 20 nt, Homo sapiens
uccaccuccuggguucaagc

SEQ ID NO: 992975 - RNA, 14 nt, Homo sapiens
uccaccugaggaac

SEQ ID NO: 992976 - RNA, 15 nt, Homo sapiens
uccacugucaggguu

SEQ ID NO: 992977 - RNA, 15 nt, Homo sapiens
uccacuucaccaucc

SEQ ID NO: 992978 - RNA, 21 nt, Homo sapiens
uccagacuugaaauucucauc

SEQ ID NO: 992979 - RNA, 21 nt, Homo sapiens
uccagccgccggcugugcagu

SEQ ID NO: 992980 - RNA, 23 nt, Homo sapiens
uccagcuggaagggucaacaucu

SEQ ID NO: 992981 - RNA, 22 nt, Homo sapiens
uccaggcaggucugaagcucaa

SEQ ID NO: 992982 - RNA, 17 nt, Homo sapiens
uccagguguuacuguaa

SEQ ID NO: 992983 - RNA, 18 nt, Homo sapiens
uccauaaauccuugauga

SEQ ID NO: 992984 - RNA, 18 nt, Homo sapiens
uccauaacugaacaucca

SEQ ID NO: 992985 - RNA, 18 nt, Homo sapiens
uccaucacguuagcuguc

SEQ ID NO: 992986 - RNA, 16 nt, Homo sapiens
uccauccauggccagc

SEQ ID NO: 992987 - RNA, 14 nt, Homo sapiens
uccaucuccaucca

SEQ ID NO: 992988 - RNA, 20 nt, Homo sapiens
uccaugcaccuaccuuagaa

SEQ ID NO: 992989 - RNA, 20 nt, Homo sapiens
uccaugccucagaagugcau

SEQ ID NO: 992990 - RNA, 14 nt, Homo sapiens
uccaugcugugcgc

SEQ ID NO: 992991 - RNA, 15 nt, Homo sapiens
uccauguuugcaccu

SEQ ID NO: 992992 - RNA, 16 nt, Homo sapiens
uccauuaaguacaugu

SEQ ID NO: 992993 - RNA, 23 nt, Homo sapiens
ucccaaaggacagccgccuggag

SEQ ID NO: 992994 - RNA, 20 nt, Homo sapiens
uuggggcuaauuuaacaaga

SEQ ID NO: 992995 - RNA, 11 nt, Homo sapiens
uuggggguccu

SEQ ID NO: 992996 - RNA, 23 nt, Homo sapiens
uuggggguccuccuccagggaca

SEQ ID NO: 992997 - RNA, 13 nt, Homo sapiens
uugggucuuugaa

SEQ ID NO: 992998 - RNA, 13 nt, Homo sapiens
uugguaccagaua

SEQ ID NO: 992999 - RNA, 16 nt, Homo sapiens
uugguccaagauuccg

SEQ ID NO: 993000 - RNA, 17 nt, Homo sapiens
uuguaaaauuauuucau

SEQ ID NO: 993001 - RNA, 18 nt, Homo sapiens
uuguaaccugcugugaua

SEQ ID NO: 993002 - RNA, 17 nt, Homo sapiens
uuguaaguugaagcaaa

SEQ ID NO: 993003 - RNA, 17 nt, Homo sapiens
uuguaauguaucaaaua

SEQ ID NO: 993004 - RNA, 14 nt, Homo sapiens
uuguacugacccca

SEQ ID NO: 993005 - RNA, 22 nt, Homo sapiens
uuguagagauggggucucacag

SEQ ID NO: 993006 - RNA, 14 nt, Homo sapiens
uuguaggguuucua

SEQ ID NO: 993007 - RNA, 15 nt, Homo sapiens
uugucagaacuagaa

SEQ ID NO: 993008 - RNA, 15 nt, Homo sapiens
uuguccaucuugaga

SEQ ID NO: 993009 - RNA, 16 nt, Homo sapiens
uugucgguuaccucug

SEQ ID NO: 993010 - RNA, 20 nt, Homo sapiens
uugucucuugccugccacug

SEQ ID NO: 993011 - RNA, 19 nt, Homo sapiens
uugugaauagaacucugaa

SEQ ID NO: 993012 - RNA, 18 nt, Homo sapiens
uugugaauuaggcuguaa

SEQ ID NO: 993013 - RNA, 15 nt, Homo sapiens
uugugagccaccacg

SEQ ID NO: 993014 - RNA, 12 nt, Homo sapiens
uugugauugccu

SEQ ID NO: 993015 - RNA, 23 nt, Homo sapiens
uugugugcucuccauucugcucc

SEQ ID NO: 993016 - RNA, 14 nt, Homo sapiens
uuguguuaccugua

SEQ ID NO: 993017 - RNA, 18 nt, Homo sapiens
uuguuacauuauguggaa

SEQ ID NO: 993018 - RNA, 17 nt, Homo sapiens
uuguuacuucugaggua

SEQ ID NO: 993019 - RNA, 16 nt, Homo sapiens
uuguuaucagucaaua

SEQ ID NO: 993020 - RNA, 16 nt, Homo sapiens
uuguuccccacugaca

SEQ ID NO: 993021 - RNA, 20 nt, Homo sapiens
uuguuguaaccugcugugau

SEQ ID NO: 993022 - RNA, 15 nt, Homo sapiens
uuguuuagaaagaau

SEQ ID NO: 993023 - RNA, 22 nt, Homo sapiens
uuuaaaucaacgaguacuucaa

SEQ ID NO: 993024 - RNA, 20 nt, Homo sapiens
uuuaacucaguuucuaggca

SEQ ID NO: 993025 - RNA, 13 nt, Homo sapiens
uuuaaguacuuug

SEQ ID NO: 993026 - RNA, 19 nt, Homo sapiens
uuuaauguuuuuugccaca

SEQ ID NO: 993027 - RNA, 15 nt, Homo sapiens
uuuaauuaugccuuu

SEQ ID NO: 993028 - RNA, 10 nt, Homo sapiens
uuuaccucag

SEQ ID NO: 993029 - RNA, 13 nt, Homo sapiens
uuuacuauuuuag

SEQ ID NO: 993030 - RNA, 14 nt, Homo sapiens
uuuagagaaguaua

SEQ ID NO: 993031 - RNA, 13 nt, Homo sapiens
uuuaggaagcaag

SEQ ID NO: 993032 - RNA, 19 nt, Homo sapiens
uuuaggaagcaagcuuaau

SEQ ID NO: 993033 - RNA, 12 nt, Homo sapiens
uuuauuacaacu

SEQ ID NO: 993034 - RNA, 16 nt, Homo sapiens
uuucaaaaccuuuuga

SEQ ID NO: 993035 - RNA, 18 nt, Homo sapiens
uuucaaauuggagcuuca

SEQ ID NO: 993036 - RNA, 20 nt, Homo sapiens
uuucaagagugagcuaucaa

SEQ ID NO: 993037 - RNA, 22 nt, Homo sapiens
uuucaaggcacucuagauucca

SEQ ID NO: 993038 - RNA, 12 nt, Homo sapiens
uuucaagucucu

SEQ ID NO: 993039 - RNA, 12 nt, Homo sapiens
uuucaauugcau

SEQ ID NO: 993040 - RNA, 19 nt, Homo sapiens
uuucagaugugaaccauua

SEQ ID NO: 993041 - RNA, 14 nt, Homo sapiens
acacuaacuaugca

SEQ ID NO: 993042 - RNA, 13 nt, Homo sapiens
acacucaugaagc

SEQ ID NO: 993043 - RNA, 14 nt, Homo sapiens
acacucaugaagca

SEQ ID NO: 993044 - RNA, 21 nt, Homo sapiens
acacugaaaaaucuaagugau

SEQ ID NO: 993045 - RNA, 13 nt, Homo sapiens
acacugugucauu

SEQ ID NO: 993046 - RNA, 18 nt, Homo sapiens
acacuuauguuauacaau

SEQ ID NO: 993047 - RNA, 14 nt, Homo sapiens
acagaaacugcaug

SEQ ID NO: 993048 - RNA, 20 nt, Homo sapiens
acagaaagccugggugacau

SEQ ID NO: 993049 - RNA, 18 nt, Homo sapiens
acagaacaccuaugcaaa

SEQ ID NO: 993050 - RNA, 13 nt, Homo sapiens
acagaacacuuau

SEQ ID NO: 993051 - RNA, 22 nt, Homo sapiens
acagaacacuuauguuauacaa

SEQ ID NO: 993052 - RNA, 15 nt, Homo sapiens
acagaaccacagggc

SEQ ID NO: 993053 - RNA, 16 nt, Homo sapiens
acagaaccacagggcu

SEQ ID NO: 993054 - RNA, 21 nt, Homo sapiens
acagaagccugaugcugacau

SEQ ID NO: 993055 - RNA, 24 nt, Homo sapiens
acagaauugcuuguuugcuucaac

SEQ ID NO: 993056 - RNA, 20 nt, Homo sapiens
acagaccuaggauuucauga

SEQ ID NO: 993057 - RNA, 22 nt, Homo sapiens
acagacgcugcugucacaacca

SEQ ID NO: 993058 - RNA, 17 nt, Homo sapiens
acagacggaaggguaaa

SEQ ID NO: 993059 - RNA, 18 nt, Homo sapiens
acagagcuucccugacuc

SEQ ID NO: 993060 - RNA, 19 nt, Homo sapiens
acagagcuucccugacuca

SEQ ID NO: 993061 - RNA, 15 nt, Homo sapiens
acagagggcugcauu

SEQ ID NO: 993062 - RNA, 16 nt, Homo sapiens
acagaugccuccuucc

SEQ ID NO: 993063 - RNA, 12 nt, Homo sapiens
acagcagcaucu

SEQ ID NO: 993064 - RNA, 15 nt, Homo sapiens
acagcagucagggac

SEQ ID NO: 993065 - RNA, 22 nt, Homo sapiens
acagccaccguuucuuccugcc

SEQ ID NO: 993066 - RNA, 13 nt, Homo sapiens
acagccaggggag

SEQ ID NO: 993067 - RNA, 22 nt, Homo sapiens
acagcccugucagcaugaauuu

SEQ ID NO: 993068 - RNA, 21 nt, Homo sapiens
acagccuauaaccagacacau

SEQ ID NO: 993069 - RNA, 23 nt, Homo sapiens
acagccucccacccccaucucuc

SEQ ID NO: 993070 - RNA, 17 nt, Homo sapiens
acagccugagccaaggc

SEQ ID NO: 993071 - RNA, 18 nt, Homo sapiens
acagcugugcaugcucag

SEQ ID NO: 993072 - RNA, 18 nt, Homo sapiens
acagcuuuugcaacuuaa

SEQ ID NO: 993073 - RNA, 21 nt, Homo sapiens
acaggaggaagacaggcaaau

SEQ ID NO: 993074 - RNA, 13 nt, Homo sapiens
acaggaguguccu

SEQ ID NO: 993075 - RNA, 15 nt, Homo sapiens
acaggcaaauguacu

SEQ ID NO: 993076 - RNA, 14 nt, Homo sapiens
acaggcaccugcca

SEQ ID NO: 993077 - RNA, 21 nt, Homo sapiens
acaggcgugagccaccaugcc

SEQ ID NO: 993078 - RNA, 13 nt, Homo sapiens
acagggcgggggu

SEQ ID NO: 993079 - RNA, 19 nt, Homo sapiens
acaggguuucaccauguua

SEQ ID NO: 993080 - RNA, 17 nt, Homo sapiens
acaggugccuucccaga

SEQ ID NO: 993081 - RNA, 18 nt, Homo sapiens
acagguuauaacaguguu

SEQ ID NO: 993082 - RNA, 14 nt, Homo sapiens
acagucaaaaccaa

SEQ ID NO: 993083 - RNA, 18 nt, Homo sapiens
acagugccgacagcucuc

SEQ ID NO: 993084 - RNA, 13 nt, Homo sapiens
acaguggacaaag

SEQ ID NO: 993085 - RNA, 22 nt, Homo sapiens
acaguggacaaaguuaccagug

SEQ ID NO: 993086 - RNA, 20 nt, Homo sapiens
acaguggcaggggcuggaga

SEQ ID NO: 993087 - RNA, 20 nt, Homo sapiens
acaguggcucacgccuguaa

SEQ ID NO: 993088 - RNA, 15 nt, Homo sapiens
acauagacagaagaa

SEQ ID NO: 993089 - RNA, 12 nt, Homo sapiens
acauaugugcug

SEQ ID NO: 993090 - RNA, 21 nt, Homo sapiens
acaucagagugacauccagga

SEQ ID NO: 993091 - RNA, 14 nt, Homo sapiens
acaucccacugcca

SEQ ID NO: 993092 - RNA, 20 nt, Homo sapiens
acauccuccagauaguguag

SEQ ID NO: 993093 - RNA, 22 nt, Homo sapiens
acaucuauuuuggauuguauau

SEQ ID NO: 993094 - RNA, 23 nt, Homo sapiens
acaucucccuuuuccaugacugu

SEQ ID NO: 993095 - RNA, 18 nt, Homo sapiens
acaucugagagaugacag

SEQ ID NO: 993096 - RNA, 16 nt, Homo sapiens
acaucuuguaacuuaa

SEQ ID NO: 993097 - RNA, 14 nt, Homo sapiens
acaugaaguauuuu

SEQ ID NO: 993098 - RNA, 19 nt, Homo sapiens
acaugagaaggaacuucca

SEQ ID NO: 993099 - RNA, 14 nt, Homo sapiens
acaugccacaagga

SEQ ID NO: 993100 - RNA, 15 nt, Homo sapiens
acaugcuuauuccau

SEQ ID NO: 993101 - RNA, 19 nt, Homo sapiens
acaugcuucagugcugcuc

SEQ ID NO: 993102 - RNA, 18 nt, Homo sapiens
acauguauugcacauugu

SEQ ID NO: 993103 - RNA, 21 nt, Homo sapiens
acauguauuuggugauuacau

SEQ ID NO: 993104 - RNA, 17 nt, Homo sapiens
acauguggggccagguc

SEQ ID NO: 993105 - RNA, 20 nt, Homo sapiens
acauucugcaagcacaucug

SEQ ID NO: 993106 - RNA, 18 nt, Homo sapiens
acauugcagcaagcaaua

SEQ ID NO: 993107 - RNA, 16 nt, Homo sapiens
acauuugcuguuuuaa

SEQ ID NO: 993108 - RNA, 13 nt, Homo sapiens
acauuugggagac

SEQ ID NO: 993109 - RNA, 20 nt, Homo sapiens
acauuuuauucuucuaauua

SEQ ID NO: 993110 - RNA, 18 nt, Homo sapiens
acauuuuguaacaaagaa

SEQ ID NO: 993111 - RNA, 23 nt, Homo sapiens
acauuuuuauaaaaaugagugcu

SEQ ID NO: 993112 - RNA, 11 nt, Homo sapiens
accaaagggaa

SEQ ID NO: 993113 - RNA, 23 nt, Homo sapiens
accaacuacuaccuguaaugaca

SEQ ID NO: 993114 - RNA, 14 nt, Homo sapiens
accaauccuaugca

SEQ ID NO: 993115 - RNA, 18 nt, Homo sapiens
accacgacuggccagggc

SEQ ID NO: 993116 - RNA, 12 nt, Homo sapiens
accacucugucu

SEQ ID NO: 993117 - RNA, 15 nt, Homo sapiens
accagaaagcaguug

SEQ ID NO: 993118 - RNA, 15 nt, Homo sapiens
accagacacccagga

SEQ ID NO: 993119 - RNA, 21 nt, Homo sapiens
accagauacggacagagacca

SEQ ID NO: 993120 - RNA, 19 nt, Homo sapiens
accagcccagcccgucucc

SEQ ID NO: 993121 - RNA, 14 nt, Homo sapiens
accagccucacccc

SEQ ID NO: 993122 - RNA, 20 nt, Homo sapiens
accaggauagagacuggaac

SEQ ID NO: 993123 - RNA, 21 nt, Homo sapiens
accaggcaccaggcagggucu

SEQ ID NO: 993124 - RNA, 16 nt, Homo sapiens
accaggccaaugucag

SEQ ID NO: 993125 - RNA, 18 nt, Homo sapiens
accaguuaauuuuuccaa

SEQ ID NO: 993126 - RNA, 18 nt, Homo sapiens
accaucucccuggugcuu

SEQ ID NO: 993127 - RNA, 16 nt, Homo sapiens
accaucugaggaauga

SEQ ID NO: 993128 - RNA, 19 nt, Homo sapiens
accaugagaccacuguuau

SEQ ID NO: 993129 - RNA, 15 nt, Homo sapiens
accaugccaggcuaa

SEQ ID NO: 993130 - RNA, 21 nt, Homo sapiens
accaugcugcuggggaagaca

SEQ ID NO: 993131 - RNA, 21 nt, Homo sapiens
accauguaauggcaguuauau

SEQ ID NO: 993132 - RNA, 13 nt, Homo sapiens
accauuuccucag

SEQ ID NO: 993133 - RNA, 16 nt, Homo sapiens
acccaagggcaggggc

SEQ ID NO: 993134 - RNA, 16 nt, Homo sapiens
acccacacucagaucc

SEQ ID NO: 993135 - RNA, 16 nt, Homo sapiens
acccaccccugcacag

SEQ ID NO: 993136 - RNA, 22 nt, Homo sapiens
acccacuguggacuccaugccu

SEQ ID NO: 993137 - RNA, 14 nt, Homo sapiens
acccaguucaguga

SEQ ID NO: 993138 - RNA, 14 nt, Homo sapiens
acccauauuacaga

SEQ ID NO: 993139 - RNA, 17 nt, Homo sapiens
acccaucccuguggucu

SEQ ID NO: 993140 - RNA, 15 nt, Homo sapiens
accccaaaccuggca

SEQ ID NO: 993141 - RNA, 13 nt, Homo sapiens
acccccagcacuu

SEQ ID NO: 993142 - RNA, 14 nt, Homo sapiens
acccccagccuggg

SEQ ID NO: 993143 - RNA, 22 nt, Homo sapiens
acccgccgcugccaccaucucc

SEQ ID NO: 993144 - RNA, 16 nt, Homo sapiens
acccgcuccuacagcu

SEQ ID NO: 993145 - RNA, 17 nt, Homo sapiens
cuccccuccaucccugg

SEQ ID NO: 993146 - RNA, 15 nt, Homo sapiens
cuccccuguaccuuu

SEQ ID NO: 993147 - RNA, 18 nt, Homo sapiens
cuccccuuaaaggggaga

SEQ ID NO: 993148 - RNA, 13 nt, Homo sapiens
cuccccuugccug

SEQ ID NO: 993149 - RNA, 22 nt, Homo sapiens
cuccccuugggcccacaccucc

SEQ ID NO: 993150 - RNA, 14 nt, Homo sapiens
cucccucaccagcc

SEQ ID NO: 993151 - RNA, 21 nt, Homo sapiens
cucccugaagccuuugcauuu

SEQ ID NO: 993152 - RNA, 21 nt, Homo sapiens
cucccugcauggcauccucca

SEQ ID NO: 993153 - RNA, 21 nt, Homo sapiens
cucccugcgaggaggggagaa

SEQ ID NO: 993154 - RNA, 16 nt, Homo sapiens
cucccuggaucagaac

SEQ ID NO: 993155 - RNA, 17 nt, Homo sapiens
cucccuggaugacauua

SEQ ID NO: 993156 - RNA, 18 nt, Homo sapiens
cucccuggaugacauuaa

SEQ ID NO: 993157 - RNA, 17 nt, Homo sapiens
cucccuggggggaggca

SEQ ID NO: 993158 - RNA, 23 nt, Homo sapiens
cucccuuucuaucguucucucuu

SEQ ID NO: 993159 - RNA, 18 nt, Homo sapiens
cuccuaagcaacuaggcc

SEQ ID NO: 993160 - RNA, 16 nt, Homo sapiens
cuccucaggcacacag

SEQ ID NO: 993161 - RNA, 12 nt, Homo sapiens
cuccucagggac

SEQ ID NO: 993162 - RNA, 18 nt, Homo sapiens
cuccucagggacucaggu

SEQ ID NO: 993163 - RNA, 14 nt, Homo sapiens
cuccuccagccaug

SEQ ID NO: 993164 - RNA, 22 nt, Homo sapiens
cuccucuuucaaccucagugau

SEQ ID NO: 993165 - RNA, 23 nt, Homo sapiens
cuccugaaaaaaaaccugagauu

SEQ ID NO: 993166 - RNA, 18 nt, Homo sapiens
cuccugaccaguugcagu

SEQ ID NO: 993167 - RNA, 23 nt, Homo sapiens
cuccugaggcuuuggauuugaca

SEQ ID NO: 993168 - RNA, 12 nt, Homo sapiens
cuccugccccug

SEQ ID NO: 993169 - RNA, 13 nt, Homo sapiens
cuccugggcucag

SEQ ID NO: 993170 - RNA, 18 nt, Homo sapiens
cuccuguccccugcuaca

SEQ ID NO: 993171 - RNA, 17 nt, Homo sapiens
cuccuugcuuccugucu

SEQ ID NO: 993172 - RNA, 18 nt, Homo sapiens
cuccuuuucccaaagcau

SEQ ID NO: 993173 - RNA, 20 nt, Homo sapiens
cuccuuuuuugcaugugcaa

SEQ ID NO: 993174 - RNA, 17 nt, Homo sapiens
cucgaaucucugugccu

SEQ ID NO: 993175 - RNA, 16 nt, Homo sapiens
cucgagcaguccugcc

SEQ ID NO: 993176 - RNA, 20 nt, Homo sapiens
cucgcccagcggcaucaggc

SEQ ID NO: 993177 - RNA, 15 nt, Homo sapiens
cucggauacuugcca

SEQ ID NO: 993178 - RNA, 23 nt, Homo sapiens
cucgugguggaaacuuuucuuaa

SEQ ID NO: 993179 - RNA, 18 nt, Homo sapiens
cucuaacaaugacauuua

SEQ ID NO: 993180 - RNA, 18 nt, Homo sapiens
cucuaacgccugagccca

SEQ ID NO: 993181 - RNA, 12 nt, Homo sapiens
cucuaacuucaa

SEQ ID NO: 993182 - RNA, 19 nt, Homo sapiens
cucuaauucggauuugcca

SEQ ID NO: 993183 - RNA, 12 nt, Homo sapiens
cucuacugcaaa

SEQ ID NO: 993184 - RNA, 15 nt, Homo sapiens
cucuacuuaauccaa

SEQ ID NO: 993185 - RNA, 22 nt, Homo sapiens
cucuauauuguucagcaugcaa

SEQ ID NO: 993186 - RNA, 15 nt, Homo sapiens
cucucaguucucgau

SEQ ID NO: 993187 - RNA, 18 nt, Homo sapiens
cucucccaacucuugcac

SEQ ID NO: 993188 - RNA, 20 nt, Homo sapiens
cucucccaacucuugcacag

SEQ ID NO: 993189 - RNA, 18 nt, Homo sapiens
cucuccccagcccagaga

SEQ ID NO: 993190 - RNA, 20 nt, Homo sapiens
cucucucccuuuucagggac

SEQ ID NO: 993191 - RNA, 15 nt, Homo sapiens
cucugaaaccagugu

SEQ ID NO: 993192 - RNA, 15 nt, Homo sapiens
cucugaggauguaua

SEQ ID NO: 993193 - RNA, 23 nt, Homo sapiens
cucugaugaaaaauugcugacug

SEQ ID NO: 993194 - RNA, 16 nt, Homo sapiens
cucugcacuacugaca

SEQ ID NO: 993195 - RNA, 17 nt, Homo sapiens
cucugcacuacugacau

SEQ ID NO: 993196 - RNA, 16 nt, Homo sapiens
cucugcagacuuccca

SEQ ID NO: 993197 - RNA, 20 nt, Homo sapiens
cucugcagacuucccagcua

SEQ ID NO: 993198 - RNA, 14 nt, Homo sapiens
cucugcagucccag

SEQ ID NO: 993199 - RNA, 16 nt, Homo sapiens
cucugcauccucugga

SEQ ID NO: 993200 - RNA, 20 nt, Homo sapiens
cucugccaaaggaugugaua

SEQ ID NO: 993201 - RNA, 11 nt, Homo sapiens
cucugccagug

SEQ ID NO: 993202 - RNA, 20 nt, Homo sapiens
cucugccuacagaacuucag

SEQ ID NO: 993203 - RNA, 16 nt, Homo sapiens
cucugggcucugagua

SEQ ID NO: 993204 - RNA, 20 nt, Homo sapiens
cucuguagugcuacaggguc

SEQ ID NO: 993205 - RNA, 12 nt, Homo sapiens
cucugucaguca

SEQ ID NO: 993206 - RNA, 10 nt, Homo sapiens
cucuguccag

SEQ ID NO: 993207 - RNA, 14 nt, Homo sapiens
cucugugaccaaug

SEQ ID NO: 993208 - RNA, 19 nt, Homo sapiens
cucuuaauugccaccucua

SEQ ID NO: 993209 - RNA, 20 nt, Homo sapiens
cucuuacguuuaacauacaa

SEQ ID NO: 993210 - RNA, 14 nt, Homo sapiens
cucuucaaaugccu

SEQ ID NO: 993211 - RNA, 14 nt, Homo sapiens
cucuucuuacuggu

SEQ ID NO: 993212 - RNA, 15 nt, Homo sapiens
cucuuggagcuguga

SEQ ID NO: 993213 - RNA, 15 nt, Homo sapiens
cucuuggccugauca

SEQ ID NO: 993214 - RNA, 21 nt, Homo sapiens
cucuuguauaugaugaucugg

SEQ ID NO: 993215 - RNA, 18 nt, Homo sapiens
cucuuguugagugccagc

SEQ ID NO: 993216 - RNA, 18 nt, Homo sapiens
cucuuucuguauauacuu

SEQ ID NO: 993217 - RNA, 16 nt, Homo sapiens
cugaaaauauaaccag

SEQ ID NO: 993218 - RNA, 16 nt, Homo sapiens
cugaaacaacuuggaa

SEQ ID NO: 993219 - RNA, 17 nt, Homo sapiens
cugaaauaaaauucauu

SEQ ID NO: 993220 - RNA, 21 nt, Homo sapiens
cugaagcccucccagguguua

SEQ ID NO: 993221 - RNA, 12 nt, Homo sapiens
cugaagguugug

SEQ ID NO: 993222 - RNA, 13 nt, Homo sapiens
cugaagugcuuag

SEQ ID NO: 993223 - RNA, 15 nt, Homo sapiens
cugaauugucuuccg

SEQ ID NO: 993224 - RNA, 19 nt, Homo sapiens
cugacacaccaggcgcuaa

SEQ ID NO: 993225 - RNA, 11 nt, Homo sapiens
cugacacugcu

SEQ ID NO: 993226 - RNA, 15 nt, Homo sapiens
cugacagcagcaucu

SEQ ID NO: 993227 - RNA, 20 nt, Homo sapiens
cugacaucaaaaaaggcagu

SEQ ID NO: 993228 - RNA, 21 nt, Homo sapiens
cugacauuaugugguuuuaga

SEQ ID NO: 993229 - RNA, 13 nt, Homo sapiens
cugaccaaagaga

SEQ ID NO: 993230 - RNA, 18 nt, Homo sapiens
cugaccaaagagaagcaa

SEQ ID NO: 993231 - RNA, 23 nt, Homo sapiens
cugaccaguugcagucacucuag

SEQ ID NO: 993232 - RNA, 11 nt, Homo sapiens
cugagaacaaa

SEQ ID NO: 993233 - RNA, 14 nt, Homo sapiens
cugagaacuggaca

SEQ ID NO: 993234 - RNA, 22 nt, Homo sapiens
cugagaacuggacaguggcagg

SEQ ID NO: 993235 - RNA, 14 nt, Homo sapiens
cugagauaccagcg

SEQ ID NO: 993236 - RNA, 17 nt, Homo sapiens
cugagcaacucuugauu

SEQ ID NO: 993237 - RNA, 22 nt, Homo sapiens
cugagcagugaaugauucagug

SEQ ID NO: 993238 - RNA, 14 nt, Homo sapiens
cugagccagggucu

SEQ ID NO: 993239 - RNA, 15 nt, Homo sapiens
cugagccccagggag

SEQ ID NO: 993240 - RNA, 17 nt, Homo sapiens
cugagccugccgagcaa

SEQ ID NO: 993241 - RNA, 22 nt, Homo sapiens
cugagcuuggcguuuggaccca

SEQ ID NO: 993242 - RNA, 23 nt, Homo sapiens
cugaggacaagagaaaaaagcca

SEQ ID NO: 993243 - RNA, 17 nt, Homo sapiens
cugaggugcacugggag

SEQ ID NO: 993244 - RNA, 19 nt, Homo sapiens
cugaguacuccacacugca

SEQ ID NO: 993245 - RNA, 16 nt, Homo sapiens
cugaguagggggagca

SEQ ID NO: 993246 - RNA, 21 nt, Homo sapiens
cugaguaucacaucacacaaa

SEQ ID NO: 993247 - RNA, 22 nt, Homo sapiens
cugaguaucacaucacacaaaa

SEQ ID NO: 993248 - RNA, 21 nt, Homo sapiens
cugagucaggacuugaaccca

SEQ ID NO: 993249 - RNA, 22 nt, Homo sapiens
cuuggcugcaggaaucuuuaaa

SEQ ID NO: 993250 - RNA, 14 nt, Homo sapiens
cuugggaccguguu

SEQ ID NO: 993251 - RNA, 18 nt, Homo sapiens
cuugggagaccuguaauc

SEQ ID NO: 993252 - RNA, 20 nt, Homo sapiens
cuuggggcggaacucacugc

SEQ ID NO: 993253 - RNA, 15 nt, Homo sapiens
cuuggggucacuccu

SEQ ID NO: 993254 - RNA, 16 nt, Homo sapiens
cuuggguuagaccuac

SEQ ID NO: 993255 - RNA, 20 nt, Homo sapiens
cuugguugucuggcaaggac

SEQ ID NO: 993256 - RNA, 17 nt, Homo sapiens
cuugucauguguauaaa

SEQ ID NO: 993257 - RNA, 16 nt, Homo sapiens
cuugucucacuugugc

SEQ ID NO: 993258 - RNA, 16 nt, Homo sapiens
cuuguguguaugcaca

SEQ ID NO: 993259 - RNA, 16 nt, Homo sapiens
cuuguuccccacugac

SEQ ID NO: 993260 - RNA, 13 nt, Homo sapiens
cuuguuugcuuca

SEQ ID NO: 993261 - RNA, 16 nt, Homo sapiens
cuuguuuuaugcucag

SEQ ID NO: 993262 - RNA, 16 nt, Homo sapiens
cuuguuuuugcacaug

SEQ ID NO: 993263 - RNA, 15 nt, Homo sapiens
cuuuaaagugacuaa

SEQ ID NO: 993264 - RNA, 13 nt, Homo sapiens
cuuuaauucugua

SEQ ID NO: 993265 - RNA, 19 nt, Homo sapiens
cuuuaauucuguaucugua

SEQ ID NO: 993266 - RNA, 18 nt, Homo sapiens
cuuuacaaaaguauuauc

SEQ ID NO: 993267 - RNA, 14 nt, Homo sapiens
cuuuacugugcuua

SEQ ID NO: 993268 - RNA, 19 nt, Homo sapiens
cuuuacuguuagucauuug

SEQ ID NO: 993269 - RNA, 21 nt, Homo sapiens
cuuuagucaggaauggcugca

SEQ ID NO: 993270 - RNA, 21 nt, Homo sapiens
cuuuauaaaacauguacaaaa

SEQ ID NO: 993271 - RNA, 21 nt, Homo sapiens
cuuuauaaauguaccagagag

SEQ ID NO: 993272 - RNA, 21 nt, Homo sapiens
cuuucacccgcuccuacagcu

SEQ ID NO: 993273 - RNA, 21 nt, Homo sapiens
cuuucacugagccuccacagc

SEQ ID NO: 993274 - RNA, 21 nt, Homo sapiens
cuuucauuccuucagauuugg

SEQ ID NO: 993275 - RNA, 19 nt, Homo sapiens
cuuuccaugggaccacaac

SEQ ID NO: 993276 - RNA, 20 nt, Homo sapiens
cuuuccccaccagaugcuga

SEQ ID NO: 993277 - RNA, 14 nt, Homo sapiens
cuuucccucaucca

SEQ ID NO: 993278 - RNA, 21 nt, Homo sapiens
cuuucccuccuuuucccaaag

SEQ ID NO: 993279 - RNA, 19 nt, Homo sapiens
cuuucccuucaguacccuc

SEQ ID NO: 993280 - RNA, 15 nt, Homo sapiens
cuuuccugcaacuca

SEQ ID NO: 993281 - RNA, 18 nt, Homo sapiens
cuuucuaaaggaaaucaa

SEQ ID NO: 993282 - RNA, 23 nt, Homo sapiens
cuuucuaggagggagacacuggc

SEQ ID NO: 993283 - RNA, 22 nt, Homo sapiens
cuuugacuuggggagaccucua

SEQ ID NO: 993284 - RNA, 15 nt, Homo sapiens
cuuugcaucucagua

SEQ ID NO: 993285 - RNA, 14 nt, Homo sapiens
cuuugcugcauggc

SEQ ID NO: 993286 - RNA, 20 nt, Homo sapiens
cuuuggagaaaugcuuagaa

SEQ ID NO: 993287 - RNA, 20 nt, Homo sapiens
cuuugggccagacaugccac

SEQ ID NO: 993288 - RNA, 22 nt, Homo sapiens
cuuugucagggaguguucccua

SEQ ID NO: 993289 - RNA, 11 nt, Homo sapiens
cuuuguugccc

SEQ ID NO: 993290 - RNA, 13 nt, Homo sapiens
cuuuuaaguugcu

SEQ ID NO: 993291 - RNA, 23 nt, Homo sapiens
cuuuuaaguugcugaugaacucu

SEQ ID NO: 993292 - RNA, 21 nt, Homo sapiens
cuuuuauguaguaauugacau

SEQ ID NO: 993293 - RNA, 18 nt, Homo sapiens
cuuuuauugacacagaaa

SEQ ID NO: 993294 - RNA, 15 nt, Homo sapiens
cuuuucaugauuuua

SEQ ID NO: 993295 - RNA, 22 nt, Homo sapiens
cuuuucggccccauguaucuca

SEQ ID NO: 993296 - RNA, 22 nt, Homo sapiens
cuuuucuccucacuguauccag

SEQ ID NO: 993297 - RNA, 20 nt, Homo sapiens
cuuuugacacugcucuaaca

SEQ ID NO: 993298 - RNA, 21 nt, Homo sapiens
cuuuugauccugggggaccaa

SEQ ID NO: 993299 - RNA, 16 nt, Homo sapiens
cuuuuuacaauuaaaa

SEQ ID NO: 993300 - RNA, 16 nt, Homo sapiens
cuuuuucaaugaauuu

SEQ ID NO: 993301 - RNA, 20 nt, Homo sapiens
cuuuuucucuuuccaugaca

SEQ ID NO: 993302 - RNA, 17 nt, Homo sapiens
cuuuuugugauaugcac

SEQ ID NO: 993303 - RNA, 17 nt, Homo sapiens
cuuuuuuuguauaguua

SEQ ID NO: 993304 - RNA, 22 nt, Homo sapiens
gaaaaaacugugccuuguuuca

SEQ ID NO: 993305 - RNA, 16 nt, Homo sapiens
gaaaaacagcauguac

SEQ ID NO: 993306 - RNA, 18 nt, Homo sapiens
gaaaaaucaugggccaga

SEQ ID NO: 993307 - RNA, 20 nt, Homo sapiens
gaaaaaugggaacaaggcaa

SEQ ID NO: 993308 - RNA, 16 nt, Homo sapiens
gaaaacacugugcaca

SEQ ID NO: 993309 - RNA, 19 nt, Homo sapiens
gaaaacacugugcacaucu

SEQ ID NO: 993310 - RNA, 15 nt, Homo sapiens
gaaaagcaacauuca

SEQ ID NO: 993311 - RNA, 13 nt, Homo sapiens
gaaaagcauguua

SEQ ID NO: 993312 - RNA, 14 nt, Homo sapiens
gaaaaugaacacag

SEQ ID NO: 993313 - RNA, 13 nt, Homo sapiens
gaaaaugcaaaag

SEQ ID NO: 993314 - RNA, 21 nt, Homo sapiens
gaaaauguugagaaucccaaa

SEQ ID NO: 993315 - RNA, 12 nt, Homo sapiens
gaaacaacuugg

SEQ ID NO: 993316 - RNA, 15 nt, Homo sapiens
gaaacaagguuuuca

SEQ ID NO: 993317 - RNA, 19 nt, Homo sapiens
gaaacaguugguaacuuuu

SEQ ID NO: 993318 - RNA, 13 nt, Homo sapiens
gaaacccaaccuu

SEQ ID NO: 993319 - RNA, 16 nt, Homo sapiens
gaaacucagugcaaaa

SEQ ID NO: 993320 - RNA, 17 nt, Homo sapiens
gaaagacuggacucuaa

SEQ ID NO: 993321 - RNA, 18 nt, Homo sapiens
gaaagaggcaccaggaag

SEQ ID NO: 993322 - RNA, 13 nt, Homo sapiens
gaaagaucaaaga

SEQ ID NO: 993323 - RNA, 18 nt, Homo sapiens
gaaagcaaguguucacaa

SEQ ID NO: 993324 - RNA, 21 nt, Homo sapiens
gaaagcaaguguucacaacag

SEQ ID NO: 993325 - RNA, 17 nt, Homo sapiens
gaaaggacccugugagc

SEQ ID NO: 993326 - RNA, 22 nt, Homo sapiens
gaaaguagaaauuuaccaaggu

SEQ ID NO: 993327 - RNA, 17 nt, Homo sapiens
gaaauaaacagguaaua

SEQ ID NO: 993328 - RNA, 19 nt, Homo sapiens
gaaauaaaggaugugauug

SEQ ID NO: 993329 - RNA, 15 nt, Homo sapiens
gaaaucucacugggg

SEQ ID NO: 993330 - RNA, 14 nt, Homo sapiens
gaaaugcuuagaaa

SEQ ID NO: 993331 - RNA, 16 nt, Homo sapiens
gaaauuccaaagucuc

SEQ ID NO: 993332 - RNA, 23 nt, Homo sapiens
gaaauuuagcauuguagugcuuu

SEQ ID NO: 993333 - RNA, 14 nt, Homo sapiens
gaacaaacaaugaa

SEQ ID NO: 993334 - RNA, 24 nt, Homo sapiens
gaacacagcaguucugcagaggac

SEQ ID NO: 993335 - RNA, 18 nt, Homo sapiens
gaacacucuuuugcuuua

SEQ ID NO: 993336 - RNA, 18 nt, Homo sapiens
gaacauugguucuuucau

SEQ ID NO: 993337 - RNA, 21 nt, Homo sapiens
gaaccagcuucugauaaacac

SEQ ID NO: 993338 - RNA, 19 nt, Homo sapiens
gaaccucagccuggccaga

SEQ ID NO: 993339 - RNA, 20 nt, Homo sapiens
gaacuauuuucaaagacuua

SEQ ID NO: 993340 - RNA, 19 nt, Homo sapiens
gaacucaaauggggccaga

SEQ ID NO: 993341 - RNA, 20 nt, Homo sapiens
gaacucaaccucuacagggu

SEQ ID NO: 993342 - RNA, 22 nt, Homo sapiens
gaacugcauucuucugagcacu

SEQ ID NO: 993343 - RNA, 19 nt, Homo sapiens
gaacuggaggcagggaaca

SEQ ID NO: 993344 - RNA, 17 nt, Homo sapiens
gaacuuaaccuugcaaa

SEQ ID NO: 993345 - RNA, 17 nt, Homo sapiens
gaagaaaccguauccau

SEQ ID NO: 993346 - RNA, 23 nt, Homo sapiens
gaagaagguaggagaaagggcgg

SEQ ID NO: 993347 - RNA, 19 nt, Homo sapiens
gaagacagaaccacagggc

SEQ ID NO: 993348 - RNA, 18 nt, Homo sapiens
gaagacccauuccuuccc

SEQ ID NO: 993349 - RNA, 17 nt, Homo sapiens
gaagagggacagaugaa

SEQ ID NO: 993350 - RNA, 23 nt, Homo sapiens
gaagaugacgaguaacuccccuc

SEQ ID NO: 993351 - RNA, 21 nt, Homo sapiens
gaagcuuuggugagaaccugg

SEQ ID NO: 993352 - RNA, 18 nt, Homo sapiens
uucauuaauacagggcau

SEQ ID NO: 993353 - RNA, 20 nt, Homo sapiens
uucauuguguuaccuguaga

SEQ ID NO: 993354 - RNA, 12 nt, Homo sapiens
uuccaaacacca

SEQ ID NO: 993355 - RNA, 20 nt, Homo sapiens
uuccagaaauacuacugugu

SEQ ID NO: 993356 - RNA, 18 nt, Homo sapiens
uuccagugucauuucuca

SEQ ID NO: 993357 - RNA, 16 nt, Homo sapiens
uuccauaagaagucgu

SEQ ID NO: 993358 - RNA, 21 nt, Homo sapiens
uuccaucuccauccaagcaaa

SEQ ID NO: 993359 - RNA, 14 nt, Homo sapiens
uuccaugacaucaa

SEQ ID NO: 993360 - RNA, 14 nt, Homo sapiens
uuccaugauucuau

SEQ ID NO: 993361 - RNA, 21 nt, Homo sapiens
uuccauuaaguacaugugcca

SEQ ID NO: 993362 - RNA, 16 nt, Homo sapiens
uuccauuugcaaggga

SEQ ID NO: 993363 - RNA, 16 nt, Homo sapiens
uucccacaggacauuu

SEQ ID NO: 993364 - RNA, 14 nt, Homo sapiens
uucccagcuaggaa

SEQ ID NO: 993365 - RNA, 19 nt, Homo sapiens
uucccaucgcugucacagg

SEQ ID NO: 993366 - RNA, 17 nt, Homo sapiens
uuccccaaguacaacca

SEQ ID NO: 993367 - RNA, 16 nt, Homo sapiens
uuccccaucuucuaaa

SEQ ID NO: 993368 - RNA, 15 nt, Homo sapiens
uuccccuugccuaaa

SEQ ID NO: 993369 - RNA, 22 nt, Homo sapiens
uucccucucccggcaacaucuc

SEQ ID NO: 993370 - RNA, 19 nt, Homo sapiens
uucccucuugcucaguggg

SEQ ID NO: 993371 - RNA, 17 nt, Homo sapiens
uucccuuucacuggcau

SEQ ID NO: 993372 - RNA, 12 nt, Homo sapiens
uuccuagcugug

SEQ ID NO: 993373 - RNA, 20 nt, Homo sapiens
uuccuccucaggcacacagc

SEQ ID NO: 993374 - RNA, 14 nt, Homo sapiens
uuccucgccugaca

SEQ ID NO: 993375 - RNA, 20 nt, Homo sapiens
uuccucuccacacagugcuc

SEQ ID NO: 993376 - RNA, 11 nt, Homo sapiens
uuccucugcau

SEQ ID NO: 993377 - RNA, 15 nt, Homo sapiens
uuccuguccagcucc

SEQ ID NO: 993378 - RNA, 23 nt, Homo sapiens
uuccuuacucccaggcacugucu

SEQ ID NO: 993379 - RNA, 21 nt, Homo sapiens
uuccuugccuaaggugucuga

SEQ ID NO: 993380 - RNA, 14 nt, Homo sapiens
uucggauuugccau

SEQ ID NO: 993381 - RNA, 21 nt, Homo sapiens
uucguagauauuggacaaaga

SEQ ID NO: 993382 - RNA, 17 nt, Homo sapiens
uucuaaagcucugacau

SEQ ID NO: 993383 - RNA, 21 nt, Homo sapiens
uucuaaaggaaaucaaaugaa

SEQ ID NO: 993384 - RNA, 23 nt, Homo sapiens
uucuaaaugaauguuuacacucu

SEQ ID NO: 993385 - RNA, 13 nt, Homo sapiens
uucuaacccugac

SEQ ID NO: 993386 - RNA, 17 nt, Homo sapiens
uucuaaccuccuaagca

SEQ ID NO: 993387 - RNA, 13 nt, Homo sapiens
uucuaauugcuua

SEQ ID NO: 993388 - RNA, 14 nt, Homo sapiens
uucuaauugcuuau

SEQ ID NO: 993389 - RNA, 12 nt, Homo sapiens
uucuacagccuc

SEQ ID NO: 993390 - RNA, 21 nt, Homo sapiens
uucuaggcacuguaguucuaa

SEQ ID NO: 993391 - RNA, 15 nt, Homo sapiens
uucuauaaggccaua

SEQ ID NO: 993392 - RNA, 14 nt, Homo sapiens
uucuauaguucuag

SEQ ID NO: 993393 - RNA, 14 nt, Homo sapiens
uucuaugccuuuag

SEQ ID NO: 993394 - RNA, 18 nt, Homo sapiens
uucucaggacacaggccu

SEQ ID NO: 993395 - RNA, 21 nt, Homo sapiens
uucucaucaguaguucacaua

SEQ ID NO: 993396 - RNA, 23 nt, Homo sapiens
uucucaucaguaguucacauaca

SEQ ID NO: 993397 - RNA, 23 nt, Homo sapiens
uucucauguugaagccacugccu

SEQ ID NO: 993398 - RNA, 20 nt, Homo sapiens
uucucauuucuguagccuga

SEQ ID NO: 993399 - RNA, 12 nt, Homo sapiens
uucuccaucucc

SEQ ID NO: 993400 - RNA, 16 nt, Homo sapiens
uucucuauacucaggu

SEQ ID NO: 993401 - RNA, 13 nt, Homo sapiens
uucugaacagcug

SEQ ID NO: 993402 - RNA, 14 nt, Homo sapiens
uucugagcacuguu

SEQ ID NO: 993403 - RNA, 16 nt, Homo sapiens
uucugagcuccugucc

SEQ ID NO: 993404 - RNA, 16 nt, Homo sapiens
uucugauaaacacaau

SEQ ID NO: 993405 - RNA, 20 nt, Homo sapiens
uucugccuuugccaggugac

SEQ ID NO: 993406 - RNA, 19 nt, Homo sapiens
uucuggauuccccaucuca

SEQ ID NO: 993407 - RNA, 20 nt, Homo sapiens
uucuggauuucauacuguaa

SEQ ID NO: 993408 - RNA, 16 nt, Homo sapiens
uucuguaaaacagguu

SEQ ID NO: 993409 - RNA, 14 nt, Homo sapiens
uucuguacaugcau

SEQ ID NO: 993410 - RNA, 19 nt, Homo sapiens
uucugugguuucauguuag

SEQ ID NO: 993411 - RNA, 15 nt, Homo sapiens
uucuguguugccaag

SEQ ID NO: 993412 - RNA, 15 nt, Homo sapiens
uucuguuaacugaau

SEQ ID NO: 993413 - RNA, 15 nt, Homo sapiens
uucuuaaauaagaaa

SEQ ID NO: 993414 - RNA, 18 nt, Homo sapiens
uucuuacacugugucauu

SEQ ID NO: 993415 - RNA, 16 nt, Homo sapiens
uucuuagcucaaugag

SEQ ID NO: 993416 - RNA, 14 nt, Homo sapiens
uucuucuacugcua

SEQ ID NO: 993417 - RNA, 23 nt, Homo sapiens
uucuugaguugucuuuugccauu

SEQ ID NO: 993418 - RNA, 21 nt, Homo sapiens
uucuugccugaacuccugcca

SEQ ID NO: 993419 - RNA, 12 nt, Homo sapiens
uucuugcuccaa

SEQ ID NO: 993420 - RNA, 19 nt, Homo sapiens
uucuugcuggucuagucac

SEQ ID NO: 993421 - RNA, 22 nt, Homo sapiens
uucuuuaaaaaacaacuaugga

SEQ ID NO: 993422 - RNA, 21 nt, Homo sapiens
uucuuuaaaauguaaagccau

SEQ ID NO: 993423 - RNA, 22 nt, Homo sapiens
uucuuuaaaauguaaagccaug

SEQ ID NO: 993424 - RNA, 19 nt, Homo sapiens
uucuuuuauacugacacaa

SEQ ID NO: 993425 - RNA, 13 nt, Homo sapiens
uucuuuuugccaa

SEQ ID NO: 993426 - RNA, 16 nt, Homo sapiens
uugaaaaagacauuca

SEQ ID NO: 993427 - RNA, 15 nt, Homo sapiens
uugaaagaaauggug

SEQ ID NO: 993428 - RNA, 21 nt, Homo sapiens
uugaaaggagaugucuuggaa

SEQ ID NO: 993429 - RNA, 18 nt, Homo sapiens
uugaacuuuauaaaacau

SEQ ID NO: 993430 - RNA, 16 nt, Homo sapiens
uugaagcugacucaaa

SEQ ID NO: 993431 - RNA, 13 nt, Homo sapiens
uugaagggccaga

SEQ ID NO: 993432 - RNA, 17 nt, Homo sapiens
uugaauuuuuuuuaaca

SEQ ID NO: 993433 - RNA, 17 nt, Homo sapiens
uugacaaccaugagacc

SEQ ID NO: 993434 - RNA, 13 nt, Homo sapiens
uugacaacuggca

SEQ ID NO: 993435 - RNA, 20 nt, Homo sapiens
uugacauuagucucagugaa

SEQ ID NO: 993436 - RNA, 19 nt, Homo sapiens
uugacccuugcugugaauu

SEQ ID NO: 993437 - RNA, 16 nt, Homo sapiens
uugacugcuuggaacu

SEQ ID NO: 993438 - RNA, 19 nt, Homo sapiens
uugacuuuccccaccagau

SEQ ID NO: 993439 - RNA, 19 nt, Homo sapiens
uugagugacuugagcccaa

SEQ ID NO: 993440 - RNA, 21 nt, Homo sapiens
uugaguuugucgcucaugugu

SEQ ID NO: 993441 - RNA, 19 nt, Homo sapiens
uugauacuguugcacgugu

SEQ ID NO: 993442 - RNA, 21 nt, Homo sapiens
uugaucaggcacaguggcuca

SEQ ID NO: 993443 - RNA, 17 nt, Homo sapiens
uugaugacccuuuucau

SEQ ID NO: 993444 - RNA, 16 nt, Homo sapiens
uugcaaaucuugaaau

SEQ ID NO: 993445 - RNA, 22 nt, Homo sapiens
uugcaaccucgcuggacucuca

SEQ ID NO: 993446 - RNA, 21 nt, Homo sapiens
uugcacacuuugguaccagau

SEQ ID NO: 993447 - RNA, 22 nt, Homo sapiens
uugcacacuuugguaccagaua

SEQ ID NO: 993448 - RNA, 14 nt, Homo sapiens
uugcacagccaaau

SEQ ID NO: 993449 - RNA, 19 nt, Homo sapiens
uugcacagugugugacuua

SEQ ID NO: 993450 - RNA, 22 nt, Homo sapiens
uugcaccccaaagcuuuccugc

SEQ ID NO: 993451 - RNA, 18 nt, Homo sapiens
uugcacuaucuuucagcu

SEQ ID NO: 993452 - RNA, 13 nt, Homo sapiens
uugcagacaggaa

SEQ ID NO: 993453 - RNA, 20 nt, Homo sapiens
uugcagagaaccucagauca

SEQ ID NO: 993454 - RNA, 16 nt, Homo sapiens
uugcagcaagcaauaa

SEQ ID NO: 993455 - RNA, 20 nt, Homo sapiens
uugcagcuguuuuguugaca

SEQ ID NO: 993456 - RNA, 18 nt, Homo sapiens
ugcccuccugugcucagc

SEQ ID NO: 993457 - RNA, 18 nt, Homo sapiens
ugcccuucuuucuacccu

SEQ ID NO: 993458 - RNA, 20 nt, Homo sapiens
ugccgccuccuugugcacaa

SEQ ID NO: 993459 - RNA, 21 nt, Homo sapiens
ugccguccccuagagucccag

SEQ ID NO: 993460 - RNA, 13 nt, Homo sapiens
ugccucaaccucc

SEQ ID NO: 993461 - RNA, 15 nt, Homo sapiens
ugccucaaugccagu

SEQ ID NO: 993462 - RNA, 15 nt, Homo sapiens
ugccugagaacacca

SEQ ID NO: 993463 - RNA, 14 nt, Homo sapiens
ugccugccacugug

SEQ ID NO: 993464 - RNA, 16 nt, Homo sapiens
ugccuuaaacucuguu

SEQ ID NO: 993465 - RNA, 15 nt, Homo sapiens
ugccuuagucucagu

SEQ ID NO: 993466 - RNA, 12 nt, Homo sapiens
ugccuucaccuu

SEQ ID NO: 993467 - RNA, 13 nt, Homo sapiens
ugccuucuccuau

SEQ ID NO: 993468 - RNA, 19 nt, Homo sapiens
ugccuuuauuuccacugug

SEQ ID NO: 993469 - RNA, 22 nt, Homo sapiens
ugcgagagaaagggagugcaug

SEQ ID NO: 993470 - RNA, 19 nt, Homo sapiens
ugcgagagauguguguuga

SEQ ID NO: 993471 - RNA, 12 nt, Homo sapiens
ugcgcacugugu

SEQ ID NO: 993472 - RNA, 16 nt, Homo sapiens
aagaccugagaaugua

SEQ ID NO: 993473 - RNA, 22 nt, Homo sapiens
aagacuggaagcuaauuugcau

SEQ ID NO: 993474 - RNA, 23 nt, Homo sapiens
aagacuuaagcccagugcacuga

SEQ ID NO: 993475 - RNA, 16 nt, Homo sapiens
aagacuuccacucgau

SEQ ID NO: 993476 - RNA, 16 nt, Homo sapiens
aagacuuuauguaguu

SEQ ID NO: 993477 - RNA, 22 nt, Homo sapiens
aagagcucaggaugagggaaaa

SEQ ID NO: 993478 - RNA, 20 nt, Homo sapiens
aagagggugauugcuggggc

SEQ ID NO: 993479 - RNA, 14 nt, Homo sapiens
aagaggugacccca

SEQ ID NO: 993480 - RNA, 18 nt, Homo sapiens
aagagugaauucccucac

SEQ ID NO: 993481 - RNA, 12 nt, Homo sapiens
aagaucaaagac

SEQ ID NO: 993482 - RNA, 18 nt, Homo sapiens
aagaucuguccucagccu

SEQ ID NO: 993483 - RNA, 15 nt, Homo sapiens
aagaucuguuuugaa

SEQ ID NO: 993484 - RNA, 20 nt, Homo sapiens
aagaucuguuuugaaggcaa

SEQ ID NO: 993485 - RNA, 19 nt, Homo sapiens
aagaucuuuuauuuugcca

SEQ ID NO: 993486 - RNA, 12 nt, Homo sapiens
aagauggcauaa

SEQ ID NO: 993487 - RNA, 20 nt, Homo sapiens
aagaugugauauucuaagac

SEQ ID NO: 993488 - RNA, 20 nt, Homo sapiens
aagauucuauaguucuagac

SEQ ID NO: 993489 - RNA, 14 nt, Homo sapiens
aagcacagcccuua

SEQ ID NO: 993490 - RNA, 16 nt, Homo sapiens
aagcacugacugggac

SEQ ID NO: 993491 - RNA, 22 nt, Homo sapiens
aagcagcgaccgcccccuccuc

SEQ ID NO: 993492 - RNA, 20 nt, Homo sapiens
aagcagucgugccugugucc

SEQ ID NO: 993493 - RNA, 24 nt, Homo sapiens
aagcaguugggacuacaggcguga

SEQ ID NO: 993494 - RNA, 23 nt, Homo sapiens
aagcauuuaaccccccuguacac

SEQ ID NO: 993495 - RNA, 15 nt, Homo sapiens
aagcauuuguagcaa

SEQ ID NO: 993496 - RNA, 11 nt, Homo sapiens
aagccacugcc

SEQ ID NO: 993497 - RNA, 13 nt, Homo sapiens
aagccacugccuu

SEQ ID NO: 993498 - RNA, 20 nt, Homo sapiens
aagccugaugcugacauuca

SEQ ID NO: 993499 - RNA, 17 nt, Homo sapiens
aagccuuaauuugcaca

SEQ ID NO: 993500 - RNA, 17 nt, Homo sapiens
aagcgauucuccugccu

SEQ ID NO: 993501 - RNA, 17 nt, Homo sapiens
aagcgauucucuugccu

SEQ ID NO: 993502 - RNA, 16 nt, Homo sapiens
aagcuaacagggaagg

SEQ ID NO: 993503 - RNA, 22 nt, Homo sapiens
aagcuauuugauguaauacuuc

SEQ ID NO: 993504 - RNA, 15 nt, Homo sapiens
aagcugaguauuaaa

SEQ ID NO: 993505 - RNA, 17 nt, Homo sapiens
aagcuuauuuaagauca

SEQ ID NO: 993506 - RNA, 23 nt, Homo sapiens
aaggaaaaugugcacacauauac

SEQ ID NO: 993507 - RNA, 12 nt, Homo sapiens
aaggaaagcuca

SEQ ID NO: 993508 - RNA, 20 nt, Homo sapiens
aaggaacauaccccuuacaa

SEQ ID NO: 993509 - RNA, 23 nt, Homo sapiens
aaggaagucauccagucuauuca

SEQ ID NO: 993510 - RNA, 12 nt, Homo sapiens
aaggacacucac

SEQ ID NO: 993511 - RNA, 12 nt, Homo sapiens
aaggaccugaga

SEQ ID NO: 993512 - RNA, 16 nt, Homo sapiens
aaggacuaugaaaagc

SEQ ID NO: 993513 - RNA, 15 nt, Homo sapiens
aaggagcugccugga

SEQ ID NO: 993514 - RNA, 15 nt, Homo sapiens
aaggaguaugcaggg

SEQ ID NO: 993515 - RNA, 21 nt, Homo sapiens
aaggaucuaggagaagggucu

SEQ ID NO: 993516 - RNA, 12 nt, Homo sapiens
aaggaugugauu

SEQ ID NO: 993517 - RNA, 16 nt, Homo sapiens
aaggcaggcagggcuc

SEQ ID NO: 993518 - RNA, 15 nt, Homo sapiens
aaggcaucgucaugc

SEQ ID NO: 993519 - RNA, 17 nt, Homo sapiens
aaggcaucugacaugca

SEQ ID NO: 993520 - RNA, 15 nt, Homo sapiens
aaggccuccugugac

SEQ ID NO: 993521 - RNA, 13 nt, Homo sapiens
aaggcugcuguga

SEQ ID NO: 993522 - RNA, 15 nt, Homo sapiens
aaggcugcugugaac

SEQ ID NO: 993523 - RNA, 17 nt, Homo sapiens
aagggagggcucugagg

SEQ ID NO: 993524 - RNA, 21 nt, Homo sapiens
aagggaggggcuguguuucca

SEQ ID NO: 993525 - RNA, 18 nt, Homo sapiens
aaggggaaucagaacuca

SEQ ID NO: 993526 - RNA, 23 nt, Homo sapiens
aaggggccucaccgagugggggc

SEQ ID NO: 993527 - RNA, 18 nt, Homo sapiens
aagguuuucuucauucau

SEQ ID NO: 993528 - RNA, 17 nt, Homo sapiens
aagguuuuuacugugag

SEQ ID NO: 993529 - RNA, 15 nt, Homo sapiens
aaguagauugccagc

SEQ ID NO: 993530 - RNA, 16 nt, Homo sapiens
aagucauaccaaugaa

SEQ ID NO: 993531 - RNA, 15 nt, Homo sapiens
aagucaucuugcuac

SEQ ID NO: 993532 - RNA, 14 nt, Homo sapiens
aagugacauugcau

SEQ ID NO: 993533 - RNA, 21 nt, Homo sapiens
aagugagcugagauugcacca

SEQ ID NO: 993534 - RNA, 19 nt, Homo sapiens
aagugaucugcccaccuca

SEQ ID NO: 993535 - RNA, 20 nt, Homo sapiens
aagugcugagauuacaggca

SEQ ID NO: 993536 - RNA, 22 nt, Homo sapiens
aagugcugggauuacaggugua

SEQ ID NO: 993537 - RNA, 14 nt, Homo sapiens
aaguguacauaugu

SEQ ID NO: 993538 - RNA, 21 nt, Homo sapiens
aagugugacuaccuccacuca

SEQ ID NO: 993539 - RNA, 20 nt, Homo sapiens
aaguuauaaccaacuuuucu

SEQ ID NO: 993540 - RNA, 11 nt, Homo sapiens
ugcgcccuuca

SEQ ID NO: 993541 - RNA, 16 nt, Homo sapiens
ugcgcuguaguaggca

SEQ ID NO: 993542 - RNA, 17 nt, Homo sapiens
ugcuaccaaaacaguua

SEQ ID NO: 993543 - RNA, 14 nt, Homo sapiens
ugcuagugugaauu

SEQ ID NO: 993544 - RNA, 15 nt, Homo sapiens
ugcuauuugucaucu

SEQ ID NO: 993545 - RNA, 23 nt, Homo sapiens
ugcucaaggccagcuuauaguca

SEQ ID NO: 993546 - RNA, 21 nt, Homo sapiens
ugcucagcccugcaccaugcu

SEQ ID NO: 993547 - RNA, 22 nt, Homo sapiens
ugcucagugggggcagagccac

SEQ ID NO: 993548 - RNA, 17 nt, Homo sapiens
ugcuccagacagggaau

SEQ ID NO: 993549 - RNA, 20 nt, Homo sapiens
ugcuccccuaaagccucaaa

SEQ ID NO: 993550 - RNA, 20 nt, Homo sapiens
ugcuccuggaucucccugag

SEQ ID NO: 993551 - RNA, 18 nt, Homo sapiens
ugcucuugagucuuugca

SEQ ID NO: 993552 - RNA, 14 nt, Homo sapiens
ugcucuugccauag

SEQ ID NO: 993553 - RNA, 17 nt, Homo sapiens
ugcugaaaaaucaucca

SEQ ID NO: 993554 - RNA, 21 nt, Homo sapiens
ugcugagauacauacagaauu

SEQ ID NO: 993555 - RNA, 14 nt, Homo sapiens
ugcugccacugagg

SEQ ID NO: 993556 - RNA, 13 nt, Homo sapiens
ugcugccaugugg

SEQ ID NO: 993557 - RNA, 14 nt, Homo sapiens
ugcugcucccucag

SEQ ID NO: 993558 - RNA, 20 nt, Homo sapiens
ugcugcuggggaagacagug

SEQ ID NO: 993559 - RNA, 14 nt, Homo sapiens
ugcugggauuucca

SEQ ID NO: 993560 - RNA, 15 nt, Homo sapiens
ugcugucaccuugcu

SEQ ID NO: 993561 - RNA, 13 nt, Homo sapiens
ugcugucugggug

SEQ ID NO: 993562 - RNA, 19 nt, Homo sapiens
ugcuguuuuguuauauaau

SEQ ID NO: 993563 - RNA, 14 nt, Homo sapiens
ugcuuaaucuugcu

SEQ ID NO: 993564 - RNA, 19 nt, Homo sapiens
ugcuuaccuacauacgugu

SEQ ID NO: 993565 - RNA, 14 nt, Homo sapiens
ugcuuagaaauuca

SEQ ID NO: 993566 - RNA, 15 nt, Homo sapiens
ugcuucagugcugcu

SEQ ID NO: 993567 - RNA, 22 nt, Homo sapiens
ugcuucccgagugagcauggaa

SEQ ID NO: 993568 - RNA, 16 nt, Homo sapiens
ugcuuccguucaugga

SEQ ID NO: 993569 - RNA, 20 nt, Homo sapiens
ugcuuccugucuuauccucc

SEQ ID NO: 993570 - RNA, 19 nt, Homo sapiens
ugcuucuaaguaaauacaa

SEQ ID NO: 993571 - RNA, 19 nt, Homo sapiens
ugcuugggaagacuccuag

SEQ ID NO: 993572 - RNA, 12 nt, Homo sapiens
ugcuuguucccu

SEQ ID NO: 993573 - RNA, 20 nt, Homo sapiens
ugcuuuuugugauaugcaca

SEQ ID NO: 993574 - RNA, 18 nt, Homo sapiens
uggaaaaugcaaaagcac

SEQ ID NO: 993575 - RNA, 17 nt, Homo sapiens
uggaaauuuagcauugu

SEQ ID NO: 993576 - RNA, 19 nt, Homo sapiens
uggaacacggccacaucaa

SEQ ID NO: 993577 - RNA, 20 nt, Homo sapiens
uggaacacuucgaguuccca

SEQ ID NO: 993578 - RNA, 19 nt, Homo sapiens
uggaaccuuguuuuggaca

SEQ ID NO: 993579 - RNA, 13 nt, Homo sapiens
uggaacuugccug

SEQ ID NO: 993580 - RNA, 15 nt, Homo sapiens
uggaagauagcugug

SEQ ID NO: 993581 - RNA, 12 nt, Homo sapiens
uggaagauggca

SEQ ID NO: 993582 - RNA, 16 nt, Homo sapiens
uggaagauggggacca

SEQ ID NO: 993583 - RNA, 18 nt, Homo sapiens
uggaauaguuuuguaucg

SEQ ID NO: 993584 - RNA, 13 nt, Homo sapiens
uggaaucagugaa

SEQ ID NO: 993585 - RNA, 14 nt, Homo sapiens
uggaaugcccuuca

SEQ ID NO: 993586 - RNA, 20 nt, Homo sapiens
uggaaugcccuucacuguca

SEQ ID NO: 993587 - RNA, 15 nt, Homo sapiens
uggaauggagauuca

SEQ ID NO: 993588 - RNA, 20 nt, Homo sapiens
uggaauucuaacaagucaua

SEQ ID NO: 993589 - RNA, 21 nt, Homo sapiens
uggaauuuugcaaagauuuaa

SEQ ID NO: 993590 - RNA, 12 nt, Homo sapiens
uggacaaaucac

SEQ ID NO: 993591 - RNA, 17 nt, Homo sapiens
uggagaccgugaccagu

SEQ ID NO: 993592 - RNA, 16 nt, Homo sapiens
uggagagggacuggca

SEQ ID NO: 993593 - RNA, 18 nt, Homo sapiens
uggagagggacuggcaga

SEQ ID NO: 993594 - RNA, 21 nt, Homo sapiens
uggagauucaguuuucauuug

SEQ ID NO: 993595 - RNA, 20 nt, Homo sapiens
uggagcagaagcagcaacuu

SEQ ID NO: 993596 - RNA, 17 nt, Homo sapiens
uggagcauuucucauca

SEQ ID NO: 993597 - RNA, 21 nt, Homo sapiens
uggagggcccagcccaaguga

SEQ ID NO: 993598 - RNA, 20 nt, Homo sapiens
uggagggguguggcuccuuc

SEQ ID NO: 993599 - RNA, 15 nt, Homo sapiens
uggagggucucuagu

SEQ ID NO: 993600 - RNA, 18 nt, Homo sapiens
uggagguucuaaggccua

SEQ ID NO: 993601 - RNA, 18 nt, Homo sapiens
uggagucauuuuuacaau

SEQ ID NO: 993602 - RNA, 22 nt, Homo sapiens
uggaguccccucaccuccucua

SEQ ID NO: 993603 - RNA, 24 nt, Homo sapiens
uggaguuucauguacaagaugaag

SEQ ID NO: 993604 - RNA, 12 nt, Homo sapiens
uggaucagaaua

SEQ ID NO: 993605 - RNA, 13 nt, Homo sapiens
uggaugacauuaa

SEQ ID NO: 993606 - RNA, 13 nt, Homo sapiens
uggaugcagcucu

SEQ ID NO: 993607 - RNA, 20 nt, Homo sapiens
uggauucccagggacuucag

SEQ ID NO: 993608 - RNA, 15 nt, Homo sapiens
uggauugcacguggc

SEQ ID NO: 993609 - RNA, 15 nt, Homo sapiens
uggauuuaguuucag

SEQ ID NO: 993610 - RNA, 17 nt, Homo sapiens
uggauuucauacuguaa

SEQ ID NO: 993611 - RNA, 20 nt, Homo sapiens
uggauuucauuaucauauga

SEQ ID NO: 993612 - RNA, 22 nt, Homo sapiens
uggauuuugggagugacucaag

SEQ ID NO: 993613 - RNA, 22 nt, Homo sapiens
uggcaaggacuuuguacauuug

SEQ ID NO: 993614 - RNA, 15 nt, Homo sapiens
uggcaaggugacauu

SEQ ID NO: 993615 - RNA, 11 nt, Homo sapiens
uggcacuuuga

SEQ ID NO: 993616 - RNA, 19 nt, Homo sapiens
uggcacuuugaaggggccu

SEQ ID NO: 993617 - RNA, 12 nt, Homo sapiens
uggcagagccag

SEQ ID NO: 993618 - RNA, 19 nt, Homo sapiens
uggcagggggcugcugcug

SEQ ID NO: 993619 - RNA, 17 nt, Homo sapiens
uggcagucugcccugca

SEQ ID NO: 993620 - RNA, 17 nt, Homo sapiens
uggcauaaccugucuca

SEQ ID NO: 993621 - RNA, 21 nt, Homo sapiens
uggcauccaagacucuuuaug

SEQ ID NO: 993622 - RNA, 12 nt, Homo sapiens
uggccagcagca

SEQ ID NO: 993623 - RNA, 23 nt, Homo sapiens
uggccaggcuggucuaaaacucc

SEQ ID NO: 993624 - RNA, 13 nt, Homo sapiens
uggccucccccac

SEQ ID NO: 993625 - RNA, 17 nt, Homo sapiens
uggccuccccugccacc

SEQ ID NO: 993626 - RNA, 18 nt, Homo sapiens
uggccugcaaacugggaa

SEQ ID NO: 993627 - RNA, 20 nt, Homo sapiens
ucgaagaaacccuugcugcu

SEQ ID NO: 993628 - RNA, 14 nt, Homo sapiens
ucgauguggucaca

SEQ ID NO: 993629 - RNA, 16 nt, Homo sapiens
ucgcuuuguugcccag

SEQ ID NO: 993630 - RNA, 20 nt, Homo sapiens
ucggauuugccauagccuug

SEQ ID NO: 993631 - RNA, 12 nt, Homo sapiens
ucggugugcacc

SEQ ID NO: 993632 - RNA, 18 nt, Homo sapiens
ucguaggaauugaggagu

SEQ ID NO: 993633 - RNA, 16 nt, Homo sapiens
ucguuaaaaacagauu

SEQ ID NO: 993634 - RNA, 21 nt, Homo sapiens
ucuaaacuuccccaucuucua

SEQ ID NO: 993635 - RNA, 23 nt, Homo sapiens
ucuaaagauggaguuucuaaggu

SEQ ID NO: 993636 - RNA, 14 nt, Homo sapiens
ucuaacaagucaua

SEQ ID NO: 993637 - RNA, 17 nt, Homo sapiens
ucuaacagcaccaaauc

SEQ ID NO: 993638 - RNA, 21 nt, Homo sapiens
ucuaagacucaaauguucuaa

SEQ ID NO: 993639 - RNA, 14 nt, Homo sapiens
ucuaagauucuaaa

SEQ ID NO: 993640 - RNA, 16 nt, Homo sapiens
ucuaauuuuuaagaau

SEQ ID NO: 993641 - RNA, 14 nt, Homo sapiens
ucuacauaugaucu

SEQ ID NO: 993642 - RNA, 20 nt, Homo sapiens
gcugacaccuaacucuucuu

SEQ ID NO: 993643 - RNA, 13 nt, Homo sapiens
gcugacuuuggga

SEQ ID NO: 993644 - RNA, 21 nt, Homo sapiens
gcugagauugcaccacugcac

SEQ ID NO: 993645 - RNA, 20 nt, Homo sapiens
gcugagguccugaucagcuu

SEQ ID NO: 993646 - RNA, 17 nt, Homo sapiens
gcugaggugcccaggag

SEQ ID NO: 993647 - RNA, 23 nt, Homo sapiens
gcugccuggacccguucaugggg

SEQ ID NO: 993648 - RNA, 13 nt, Homo sapiens
gcugcgcacugug

SEQ ID NO: 993649 - RNA, 16 nt, Homo sapiens
gcugcgcacugugucc

SEQ ID NO: 993650 - RNA, 18 nt, Homo sapiens
gcugcugggcucagugaa

SEQ ID NO: 993651 - RNA, 21 nt, Homo sapiens
gcuggagguugagcucuucuu

SEQ ID NO: 993652 - RNA, 20 nt, Homo sapiens
gcuggagugcaguggcgcga

SEQ ID NO: 993653 - RNA, 18 nt, Homo sapiens
gcuggagugcaguggugu

SEQ ID NO: 993654 - RNA, 22 nt, Homo sapiens
gcuggccucacccaccccugca

SEQ ID NO: 993655 - RNA, 16 nt, Homo sapiens
gcugggacguggcuca

SEQ ID NO: 993656 - RNA, 23 nt, Homo sapiens
gcugggacguggcucagccagca

SEQ ID NO: 993657 - RNA, 13 nt, Homo sapiens
gcugggccauguc

SEQ ID NO: 993658 - RNA, 18 nt, Homo sapiens
gcugggccauguccaaag

SEQ ID NO: 993659 - RNA, 12 nt, Homo sapiens
gcugggcucagu

SEQ ID NO: 993660 - RNA, 22 nt, Homo sapiens
gcuggggccugggacaacugcu

SEQ ID NO: 993661 - RNA, 14 nt, Homo sapiens
gcugggugugacca

SEQ ID NO: 993662 - RNA, 22 nt, Homo sapiens
gcacccaggacuuccauuugcu

SEQ ID NO: 993663 - RNA, 16 nt, Homo sapiens
gcaccguucugugcac

SEQ ID NO: 993664 - RNA, 18 nt, Homo sapiens
gcaccguucugugcacaa

SEQ ID NO: 993665 - RNA, 21 nt, Homo sapiens
gcaccuaauccaggcagaucc

SEQ ID NO: 993666 - RNA, 13 nt, Homo sapiens
gcaccuuugcacg

SEQ ID NO: 993667 - RNA, 23 nt, Homo sapiens
gcacggagccgcgggacagccaa

SEQ ID NO: 993668 - RNA, 17 nt, Homo sapiens
gcacuagccaaaccuca

SEQ ID NO: 993669 - RNA, 17 nt, Homo sapiens
gcacugacugggaccag

SEQ ID NO: 993670 - RNA, 17 nt, Homo sapiens
gcacugcccauggacag

SEQ ID NO: 993671 - RNA, 15 nt, Homo sapiens
gcacuucaaauucaa

SEQ ID NO: 993672 - RNA, 19 nt, Homo sapiens
gcacuuggggcaccuugcu

SEQ ID NO: 993673 - RNA, 21 nt, Homo sapiens
gcacuuugaaggggccucacc

SEQ ID NO: 993674 - RNA, 16 nt, Homo sapiens
gcagaccccaggcaag

SEQ ID NO: 993675 - RNA, 16 nt, Homo sapiens
gcagacccccaugaga

SEQ ID NO: 993676 - RNA, 16 nt, Homo sapiens
gcagagagguuugcag

SEQ ID NO: 993677 - RNA, 15 nt, Homo sapiens
gcagagcauucagac

SEQ ID NO: 993678 - RNA, 14 nt, Homo sapiens
gcagaggucuccca

SEQ ID NO: 993679 - RNA, 17 nt, Homo sapiens
gcagaguuacaguucug

SEQ ID NO: 993680 - RNA, 23 nt, Homo sapiens
gcagcaaggaggaagaggacuca

SEQ ID NO: 993681 - RNA, 16 nt, Homo sapiens
gcagcagcccccagcu

SEQ ID NO: 993682 - RNA, 17 nt, Homo sapiens
gcagcgccaggcugacc

SEQ ID NO: 993683 - RNA, 15 nt, Homo sapiens
gcagcuaaaaaugca

SEQ ID NO: 993684 - RNA, 13 nt, Homo sapiens
gcagcucuuggga

SEQ ID NO: 993685 - RNA, 15 nt, Homo sapiens
gcagggccucuguca

SEQ ID NO: 993686 - RNA, 15 nt, Homo sapiens
gcaggggcuggagau

SEQ ID NO: 993687 - RNA, 21 nt, Homo sapiens
gcagggugcaguaucaugccc

SEQ ID NO: 993688 - RNA, 22 nt, Homo sapiens
gcaggugcugacuucaucuccc

SEQ ID NO: 993689 - RNA, 20 nt, Homo sapiens
gcagguggggagacugggcu

SEQ ID NO: 993690 - RNA, 13 nt, Homo sapiens
gcaguacuuugug

SEQ ID NO: 993691 - RNA, 21 nt, Homo sapiens
gcaguaucaugcccugugcaa

SEQ ID NO: 993692 - RNA, 21 nt, Homo sapiens
gcaguccuggguccuccuuuc

SEQ ID NO: 993693 - RNA, 20 nt, Homo sapiens
gcaguuaccauuaaaccauc

SEQ ID NO: 993694 - RNA, 18 nt, Homo sapiens
gcaguuugggaggcugag

SEQ ID NO: 993695 - RNA, 14 nt, Homo sapiens
gcaucacagaaugu

SEQ ID NO: 993696 - RNA, 18 nt, Homo sapiens
gcaucacagaaugugaua

SEQ ID NO: 993697 - RNA, 12 nt, Homo sapiens
gcaucacugggg

SEQ ID NO: 993698 - RNA, 15 nt, Homo sapiens
gcaucaucaaaaacu

SEQ ID NO: 993699 - RNA, 15 nt, Homo sapiens
gcaucauuauuuaug

SEQ ID NO: 993700 - RNA, 18 nt, Homo sapiens
gcaucggacaagaccccc

SEQ ID NO: 993701 - RNA, 21 nt, Homo sapiens
gcaucuaaguuauaagacucu

SEQ ID NO: 993702 - RNA, 21 nt, Homo sapiens
gcaucugacaugcaucaucuc

SEQ ID NO: 993703 - RNA, 18 nt, Homo sapiens
gcaucuugcauuaugcaa

SEQ ID NO: 993704 - RNA, 18 nt, Homo sapiens
gcauuuccuggucagugg

SEQ ID NO: 993705 - RNA, 17 nt, Homo sapiens
gcauuuucaagcaguua

SEQ ID NO: 993706 - RNA, 19 nt, Homo sapiens
gcauuuucuucucugcacu

SEQ ID NO: 993707 - RNA, 18 nt, Homo sapiens
gccaaaggaugugauaua

SEQ ID NO: 993708 - RNA, 19 nt, Homo sapiens
gccaagacugcuguggcca

SEQ ID NO: 993709 - RNA, 21 nt, Homo sapiens
gccaagcuuauuuaagaucac

SEQ ID NO: 993710 - RNA, 18 nt, Homo sapiens
gccacauuuggaauacuu

SEQ ID NO: 993711 - RNA, 22 nt, Homo sapiens
gccaccuggcucucaccucuag

SEQ ID NO: 993712 - RNA, 16 nt, Homo sapiens
gccacucuuagcuaaa

SEQ ID NO: 993713 - RNA, 19 nt, Homo sapiens
gccagacaugccacaagga

SEQ ID NO: 993714 - RNA, 16 nt, Homo sapiens
gccagagaacccagcc

SEQ ID NO: 993715 - RNA, 18 nt, Homo sapiens
gccagaucgggagcaaac

SEQ ID NO: 993716 - RNA, 18 nt, Homo sapiens
gccagcacacagggcagu

SEQ ID NO: 993717 - RNA, 20 nt, Homo sapiens
gccagcacucgcuagcagug

SEQ ID NO: 993718 - RNA, 11 nt, Homo sapiens
gccagcacuuc

SEQ ID NO: 993719 - RNA, 12 nt, Homo sapiens
gccagccucuag

SEQ ID NO: 993720 - RNA, 23 nt, Homo sapiens
gccagcgucggucugugccccuu

SEQ ID NO: 993721 - RNA, 15 nt, Homo sapiens
gccagcugcacugau

SEQ ID NO: 993722 - RNA, 22 nt, Homo sapiens
gccagggaacccacagagucac

SEQ ID NO: 993723 - RNA, 23 nt, Homo sapiens
gccaggucacccuuugcugugag

SEQ ID NO: 993724 - RNA, 16 nt, Homo sapiens
gccaguccuguccuuu

SEQ ID NO: 993725 - RNA, 11 nt, Homo sapiens
gccagugacag

SEQ ID NO: 993726 - RNA, 14 nt, Homo sapiens
gccauauuaccccu

SEQ ID NO: 993727 - RNA, 20 nt, Homo sapiens
gccaucaauauucagcaaaa

SEQ ID NO: 993728 - RNA, 21 nt, Homo sapiens
gccauggccugcaaacuggga

SEQ ID NO: 993729 - RNA, 15 nt, Homo sapiens
gccauguccaaagag

SEQ ID NO: 993730 - RNA, 16 nt, Homo sapiens
gccauguccaaagagg

SEQ ID NO: 993731 - RNA, 23 nt, Homo sapiens
gcccacguacccaggucugggug

SEQ ID NO: 993732 - RNA, 18 nt, Homo sapiens
gcccacucccaggaccaa

SEQ ID NO: 993733 - RNA, 14 nt, Homo sapiens
gcccagccagcguc

SEQ ID NO: 993734 - RNA, 17 nt, Homo sapiens
gcccagcccauggagau

SEQ ID NO: 993735 - RNA, 19 nt, Homo sapiens
gcccagcuccugacacugc

SEQ ID NO: 993736 - RNA, 16 nt, Homo sapiens
gcccaggguuuugccc

SEQ ID NO: 993737 - RNA, 17 nt, Homo sapiens
gcccagugcacugaaag

SEQ ID NO: 993738 - RNA, 21 nt, Homo sapiens
gcccauccccaggcaccucac

SEQ ID NO: 993739 - RNA, 20 nt, Homo sapiens
gcccauggagauugaccugg

SEQ ID NO: 993740 - RNA, 21 nt, Homo sapiens
gcccauggugagcucugggaa

SEQ ID NO: 993741 - RNA, 16 nt, Homo sapiens
gccccagcacauggaa

SEQ ID NO: 993742 - RNA, 21 nt, Homo sapiens
gccccaugaccuccagcuuuc

SEQ ID NO: 993743 - RNA, 13 nt, Homo sapiens
gcccccacugacc

SEQ ID NO: 993744 - RNA, 17 nt, Homo sapiens
gcccccggguguaaaua

SEQ ID NO: 993745 - RNA, 21 nt, Homo sapiens
gcccccuucaagccugugcaa

SEQ ID NO: 993746 - RNA, 23 nt, Homo sapiens
gccccucccucccagagcaccug

SEQ ID NO: 993747 - RNA, 15 nt, Homo sapiens
gccccucuuggagaa

SEQ ID NO: 993748 - RNA, 18 nt, Homo sapiens
gcccuccucugcacuccc

SEQ ID NO: 993749 - RNA, 19 nt, Homo sapiens
gcccucugcauccucugga

SEQ ID NO: 993750 - RNA, 23 nt, Homo sapiens
gcccugagcgaguggagucugcc

SEQ ID NO: 993751 - RNA, 13 nt, Homo sapiens
gcccugcaccaug

SEQ ID NO: 993752 - RNA, 15 nt, Homo sapiens
gcccugcaccaugcu

SEQ ID NO: 993753 - RNA, 18 nt, Homo sapiens
gcccugcaccaugcugcu

SEQ ID NO: 993754 - RNA, 22 nt, Homo sapiens
gcccugucauccagcucacuca

SEQ ID NO: 993755 - RNA, 13 nt, Homo sapiens
gcccugugcaacc

SEQ ID NO: 993756 - RNA, 16 nt, Homo sapiens
gcccuucauugccaca

SEQ ID NO: 993757 - RNA, 17 nt, Homo sapiens
gcccuucuuucuacccu

SEQ ID NO: 993758 - RNA, 12 nt, Homo sapiens
gcccuuuccucc

SEQ ID NO: 993759 - RNA, 14 nt, Homo sapiens
gccgcgcaucagac

SEQ ID NO: 993760 - RNA, 20 nt, Homo sapiens
gccggggugggguggcugca

SEQ ID NO: 993761 - RNA, 20 nt, Homo sapiens
gccuaaaagugggcuugauu

SEQ ID NO: 993762 - RNA, 21 nt, Homo sapiens
gccuaaaagugggcuugauuc

SEQ ID NO: 993763 - RNA, 17 nt, Homo sapiens
gccuaaaugcacaguca

SEQ ID NO: 993764 - RNA, 19 nt, Homo sapiens
gccuagaaacaacacugua

SEQ ID NO: 993765 - RNA, 22 nt, Homo sapiens
gaggucccugcugccagcuuca

SEQ ID NO: 993766 - RNA, 14 nt, Homo sapiens
gagguccugaucag

SEQ ID NO: 993767 - RNA, 16 nt, Homo sapiens
gaggugcaacaagguc

SEQ ID NO: 993768 - RNA, 15 nt, Homo sapiens
gaggugccacuggag

SEQ ID NO: 993769 - RNA, 19 nt, Homo sapiens
gaggugucucaggcugccu

SEQ ID NO: 993770 - RNA, 16 nt, Homo sapiens
gagguuugcacuuccu

SEQ ID NO: 993771 - RNA, 17 nt, Homo sapiens
gaguaacaggugccuuc

SEQ ID NO: 993772 - RNA, 17 nt, Homo sapiens
gaguagaauugcauuga

SEQ ID NO: 993773 - RNA, 18 nt, Homo sapiens
gagucaaaacacuuguaa

SEQ ID NO: 993774 - RNA, 14 nt, Homo sapiens
gagucacacagugu

SEQ ID NO: 993775 - RNA, 19 nt, Homo sapiens
gagucacucuuaugcugua

SEQ ID NO: 993776 - RNA, 21 nt, Homo sapiens
gagucaggacuugaacccagg

SEQ ID NO: 993777 - RNA, 15 nt, Homo sapiens
gaguccaagaaucca

SEQ ID NO: 993778 - RNA, 14 nt, Homo sapiens
gaguccacuuuguu

SEQ ID NO: 993779 - RNA, 13 nt, Homo sapiens
gagucuagauuca

SEQ ID NO: 993780 - RNA, 13 nt, Homo sapiens
gagucuagauucu

SEQ ID NO: 993781 - RNA, 16 nt, Homo sapiens
gagucugcacgggacc

SEQ ID NO: 993782 - RNA, 15 nt, Homo sapiens
gagugaauucccuca

SEQ ID NO: 993783 - RNA, 19 nt, Homo sapiens
gagugcaguggugugaucu

SEQ ID NO: 993784 - RNA, 19 nt, Homo sapiens
gagugcauugugaggguua

SEQ ID NO: 993785 - RNA, 23 nt, Homo sapiens
gagugccuucaacacagcuuguc

SEQ ID NO: 993786 - RNA, 20 nt, Homo sapiens
gagugggggugggggguccc

SEQ ID NO: 993787 - RNA, 13 nt, Homo sapiens
gaguggucuucaa

SEQ ID NO: 993788 - RNA, 16 nt, Homo sapiens
gaguguccucuucccu

SEQ ID NO: 993789 - RNA, 21 nt, Homo sapiens
gaguguuccccuuccacugag

SEQ ID NO: 993790 - RNA, 22 nt, Homo sapiens
gaguuugccuguucuaugccuu

SEQ ID NO: 993791 - RNA, 17 nt, Homo sapiens
gauaaagagacagugau

SEQ ID NO: 993792 - RNA, 16 nt, Homo sapiens
gauaacuuccacaggg

SEQ ID NO: 993793 - RNA, 13 nt, Homo sapiens
gauaauagauucu

SEQ ID NO: 993794 - RNA, 16 nt, Homo sapiens
gauaauagauucucuu

SEQ ID NO: 993795 - RNA, 17 nt, Homo sapiens
gauacugcgacuuucug

SEQ ID NO: 993796 - RNA, 19 nt, Homo sapiens
gauacuguugcacgugugu

SEQ ID NO: 993797 - RNA, 17 nt, Homo sapiens
gauacuugccaaaauga

SEQ ID NO: 993798 - RNA, 19 nt, Homo sapiens
gauacuugccaaaaugaga

SEQ ID NO: 993799 - RNA, 21 nt, Homo sapiens
gauacuuggaugcagcucuug

SEQ ID NO: 993800 - RNA, 11 nt, Homo sapiens
gauacuuugac

SEQ ID NO: 993801 - RNA, 13 nt, Homo sapiens
gauagaaaugcca

SEQ ID NO: 993802 - RNA, 17 nt, Homo sapiens
gauagcaaauggccuca

SEQ ID NO: 993803 - RNA, 19 nt, Homo sapiens
gauaugcacaauguagaua

SEQ ID NO: 993804 - RNA, 15 nt, Homo sapiens
gauauuaaugcccag

SEQ ID NO: 993805 - RNA, 17 nt, Homo sapiens
gauauuuuuuacuuuag

SEQ ID NO: 993806 - RNA, 21 nt, Homo sapiens
gaucaaguccuaguuguucag

SEQ ID NO: 993807 - RNA, 22 nt, Homo sapiens
gauccaaaagaagcccccagcu

SEQ ID NO: 993808 - RNA, 21 nt, Homo sapiens
gauccaccugucucagccucc

SEQ ID NO: 993809 - RNA, 15 nt, Homo sapiens
gauccugggggacca

SEQ ID NO: 993810 - RNA, 22 nt, Homo sapiens
gaucguuuuuucccagggcaag

SEQ ID NO: 993811 - RNA, 19 nt, Homo sapiens
gaucuguuuugaaggcaaa

SEQ ID NO: 993812 - RNA, 21 nt, Homo sapiens
gaugaaguuuuacauuguuga

SEQ ID NO: 993813 - RNA, 14 nt, Homo sapiens
gaugacuggucucu

SEQ ID NO: 993814 - RNA, 14 nt, Homo sapiens
gaugaggaccuccu

SEQ ID NO: 993815 - RNA, 17 nt, Homo sapiens
gaugcacuucaaauuca

SEQ ID NO: 993816 - RNA, 20 nt, Homo sapiens
gaugcugccccucaucucuc

SEQ ID NO: 993817 - RNA, 20 nt, Homo sapiens
gauggaacacggccacauca

SEQ ID NO: 993818 - RNA, 20 nt, Homo sapiens
gauggacaucuugucauuuu

SEQ ID NO: 993819 - RNA, 9 nt, Homo sapiens
gauggagcu

SEQ ID NO: 993820 - RNA, 21 nt, Homo sapiens
gauggauaucccuaccuugaa

SEQ ID NO: 993821 - RNA, 13 nt, Homo sapiens
gauggauuaacau

SEQ ID NO: 993822 - RNA, 19 nt, Homo sapiens
gauguaccaggcucucgca

SEQ ID NO: 993823 - RNA, 18 nt, Homo sapiens
gaugucuccuaagcaccu

SEQ ID NO: 993824 - RNA, 20 nt, Homo sapiens
gauguguccugacacugcaa

SEQ ID NO: 993825 - RNA, 14 nt, Homo sapiens
gauuaaccucugca

SEQ ID NO: 993826 - RNA, 21 nt, Homo sapiens
gauuacaaaucagaagucauc

SEQ ID NO: 993827 - RNA, 16 nt, Homo sapiens
gauuacaggcaccugc

SEQ ID NO: 993828 - RNA, 13 nt, Homo sapiens
gauuauagauucu

SEQ ID NO: 993829 - RNA, 12 nt, Homo sapiens
gauuauguugcu

SEQ ID NO: 993830 - RNA, 13 nt, Homo sapiens
gauuauucagugu

SEQ ID NO: 993831 - RNA, 20 nt, Homo sapiens
gauucagaaaauguucuguu

SEQ ID NO: 993832 - RNA, 17 nt, Homo sapiens
gauucagaugucauuua

SEQ ID NO: 993833 - RNA, 23 nt, Homo sapiens
gauucccccagucauucugggaa

SEQ ID NO: 993834 - RNA, 21 nt, Homo sapiens
gauucucuugccucaaccucc

SEQ ID NO: 993835 - RNA, 23 nt, Homo sapiens
gauucucuuguauaagauccuag

SEQ ID NO: 993836 - RNA, 19 nt, Homo sapiens
gauucugcaguaaaucuuu

SEQ ID NO: 993837 - RNA, 14 nt, Homo sapiens
gauugagcucucug

SEQ ID NO: 993838 - RNA, 16 nt, Homo sapiens
gauuguuuacagucau

SEQ ID NO: 993839 - RNA, 17 nt, Homo sapiens
gauuucaguucuaggaa

SEQ ID NO: 993840 - RNA, 23 nt, Homo sapiens
gauuuccuugaauguggcuugag

SEQ ID NO: 993841 - RNA, 14 nt, Homo sapiens
gauuucuccaggau

SEQ ID NO: 993842 - RNA, 17 nt, Homo sapiens
gauuucugguuguuaug

SEQ ID NO: 993843 - RNA, 19 nt, Homo sapiens
gauuugaagaacaugugag

SEQ ID NO: 993844 - RNA, 11 nt, Homo sapiens
gauuugcucag

SEQ ID NO: 993845 - RNA, 16 nt, Homo sapiens
gauuugggugaacaaa

SEQ ID NO: 993846 - RNA, 14 nt, Homo sapiens
gauuuuucucuuca

SEQ ID NO: 993847 - RNA, 18 nt, Homo sapiens
gauuuuuuccucugcauu

SEQ ID NO: 993848 - RNA, 22 nt, Homo sapiens
gauuuuuuuuaauuaccaugcu

SEQ ID NO: 993849 - RNA, 18 nt, Homo sapiens
gcaaaauacaugacauuu

SEQ ID NO: 993850 - RNA, 17 nt, Homo sapiens
gcaaagaucuguccuca

SEQ ID NO: 993851 - RNA, 12 nt, Homo sapiens
gcaaccaggaac

SEQ ID NO: 993852 - RNA, 20 nt, Homo sapiens
gcaaccuccaccuccugggu

SEQ ID NO: 993853 - RNA, 11 nt, Homo sapiens
gcaaccuguag

SEQ ID NO: 993854 - RNA, 15 nt, Homo sapiens
gcaacuaggccuuca

SEQ ID NO: 993855 - RNA, 18 nt, Homo sapiens
gcaagacuucucuuugcc

SEQ ID NO: 993856 - RNA, 12 nt, Homo sapiens
gcaagcaauaaa

SEQ ID NO: 993857 - RNA, 18 nt, Homo sapiens
gcaagcggggaugucccu

SEQ ID NO: 993858 - RNA, 20 nt, Homo sapiens
gcaaggcccgagcagcugag

SEQ ID NO: 993859 - RNA, 13 nt, Homo sapiens
gcaaggugacauu

SEQ ID NO: 993860 - RNA, 19 nt, Homo sapiens
gcaauaaaucugacccagu

SEQ ID NO: 993861 - RNA, 18 nt, Homo sapiens
gcaaugccacagcccugu

SEQ ID NO: 993862 - RNA, 12 nt, Homo sapiens
gcacaagacuga

SEQ ID NO: 993863 - RNA, 21 nt, Homo sapiens
gcacaccucugcaccuuugca

SEQ ID NO: 993864 - RNA, 22 nt, Homo sapiens
gcacaggguccccgagugccua

SEQ ID NO: 993865 - RNA, 22 nt, Homo sapiens
gcacauauggaauuuugcaaag

SEQ ID NO: 993866 - RNA, 12 nt, Homo sapiens
gcaccaaaggga

SEQ ID NO: 993867 - RNA, 17 nt, Homo sapiens
gcaccagacacccagga

SEQ ID NO: 993868 - RNA, 22 nt, Homo sapiens
gagcucuuaacuacaguggcug

SEQ ID NO: 993869 - RNA, 11 nt, Homo sapiens
gagcugugcag

SEQ ID NO: 993870 - RNA, 21 nt, Homo sapiens
gagcuucccugacucauucug

SEQ ID NO: 993871 - RNA, 18 nt, Homo sapiens
gagcuuucugaacagcug

SEQ ID NO: 993872 - RNA, 15 nt, Homo sapiens
gagcuuugacucagg

SEQ ID NO: 993873 - RNA, 17 nt, Homo sapiens
gaggaauaagcucccag

SEQ ID NO: 993874 - RNA, 15 nt, Homo sapiens
gaggacccagggcuc

SEQ ID NO: 993875 - RNA, 18 nt, Homo sapiens
gaggacucuauucuuuaa

SEQ ID NO: 993876 - RNA, 16 nt, Homo sapiens
gaggauuucaucucuu

SEQ ID NO: 993877 - RNA, 16 nt, Homo sapiens
gaggccacacucagca

SEQ ID NO: 993878 - RNA, 14 nt, Homo sapiens
gaggccauccugcc

SEQ ID NO: 993879 - RNA, 21 nt, Homo sapiens
gaggccuuacuuaaacccagc

SEQ ID NO: 993880 - RNA, 17 nt, Homo sapiens
gaggcugcccuccugug

SEQ ID NO: 993881 - RNA, 19 nt, Homo sapiens
gaggcuggguucauuugug

SEQ ID NO: 993882 - RNA, 19 nt, Homo sapiens
gagggacaaaggagccugu

SEQ ID NO: 993883 - RNA, 17 nt, Homo sapiens
gagggaggccaggcggg

SEQ ID NO: 993884 - RNA, 13 nt, Homo sapiens
gagggaggcgcug

SEQ ID NO: 993885 - RNA, 21 nt, Homo sapiens
gagggaggcgcugcugguguu

SEQ ID NO: 993886 - RNA, 17 nt, Homo sapiens
gagggaggcucaggucc

SEQ ID NO: 993887 - RNA, 16 nt, Homo sapiens
gagggcagucgauaga

SEQ ID NO: 993888 - RNA, 10 nt, Homo sapiens
gagggccagg

SEQ ID NO: 993889 - RNA, 20 nt, Homo sapiens
gagggcuggcuggccucacc

SEQ ID NO: 993890 - RNA, 21 nt, Homo sapiens
gaggggaaguccagccuacca

SEQ ID NO: 993891 - RNA, 17 nt, Homo sapiens
gaggucaucacuuugac

SEQ ID NO: 993892 - RNA, 19 nt, Homo sapiens
cauuuccucagacucuaag

SEQ ID NO: 993893 - RNA, 16 nt, Homo sapiens
cauuuccuggucagug

SEQ ID NO: 993894 - RNA, 19 nt, Homo sapiens
cauuugacccuugcuguga

SEQ ID NO: 993895 - RNA, 17 nt, Homo sapiens
cauuugauugucauuuu

SEQ ID NO: 993896 - RNA, 14 nt, Homo sapiens
cauuugcuuugucc

SEQ ID NO: 993897 - RNA, 22 nt, Homo sapiens
cauuugcuuuuugugauaugca

SEQ ID NO: 993898 - RNA, 21 nt, Homo sapiens
cauuuguacugaccccaucac

SEQ ID NO: 993899 - RNA, 19 nt, Homo sapiens
cauuuuagugguagcauau

SEQ ID NO: 993900 - RNA, 14 nt, Homo sapiens
cauuuucaccccac

SEQ ID NO: 993901 - RNA, 14 nt, Homo sapiens
cauuuuguaauaau

SEQ ID NO: 993902 - RNA, 16 nt, Homo sapiens
ccaaaaauuacuuugg

SEQ ID NO: 993903 - RNA, 19 nt, Homo sapiens
ccaaaauaguuaagacaug

SEQ ID NO: 993904 - RNA, 19 nt, Homo sapiens
ccaaacugauccaguauaa

SEQ ID NO: 993905 - RNA, 21 nt, Homo sapiens
ccaaagaacagccugagccaa

SEQ ID NO: 993906 - RNA, 22 nt, Homo sapiens
ccaaagaguagaauugcauuga

SEQ ID NO: 993907 - RNA, 14 nt, Homo sapiens
ccaaagcagcacuu

SEQ ID NO: 993908 - RNA, 21 nt, Homo sapiens
ccaacauagagccgggugucc

SEQ ID NO: 993909 - RNA, 21 nt, Homo sapiens
ccaaccuggccccgccccucc

SEQ ID NO: 993910 - RNA, 13 nt, Homo sapiens
ccaacuuuugcau

SEQ ID NO: 993911 - RNA, 16 nt, Homo sapiens
ccaagacucuuuauga

SEQ ID NO: 993912 - RNA, 22 nt, Homo sapiens
ccaagcacccuuccacuuccau

SEQ ID NO: 993913 - RNA, 22 nt, Homo sapiens
ccaagcaggaaaugaaaauguc

SEQ ID NO: 993914 - RNA, 15 nt, Homo sapiens
ccaagcucugcaguc

SEQ ID NO: 993915 - RNA, 20 nt, Homo sapiens
ccaaggggaaucagaacuca

SEQ ID NO: 993916 - RNA, 20 nt, Homo sapiens
ccaagguuuaaagagucuag

SEQ ID NO: 993917 - RNA, 16 nt, Homo sapiens
ccaaguccagguccug

SEQ ID NO: 993918 - RNA, 14 nt, Homo sapiens
ccaaucauuuuaau

SEQ ID NO: 993919 - RNA, 23 nt, Homo sapiens
ccaauccuaugcaugguuucagc

SEQ ID NO: 993920 - RNA, 17 nt, Homo sapiens
ccacacucagauccucc

SEQ ID NO: 993921 - RNA, 13 nt, Homo sapiens
cagcccugcacca

SEQ ID NO: 993922 - RNA, 21 nt, Homo sapiens
cagcccugcaccaugcugcug

SEQ ID NO: 993923 - RNA, 13 nt, Homo sapiens
cagccgccggcug

SEQ ID NO: 993924 - RNA, 22 nt, Homo sapiens
cagccgccuggagaugacuuga

SEQ ID NO: 993925 - RNA, 19 nt, Homo sapiens
cagccucaccccuguggug

SEQ ID NO: 993926 - RNA, 15 nt, Homo sapiens
cagccuccaccuccu

SEQ ID NO: 993927 - RNA, 14 nt, Homo sapiens
cagccucccugaag

SEQ ID NO: 993928 - RNA, 18 nt, Homo sapiens
cagccucccugaagccuu

SEQ ID NO: 993929 - RNA, 14 nt, Homo sapiens
cagccuggccagac

SEQ ID NO: 993930 - RNA, 21 nt, Homo sapiens
cagcgccaggcugaccacagc

SEQ ID NO: 993931 - RNA, 17 nt, Homo sapiens
cagcgccuuuccugcca

SEQ ID NO: 993932 - RNA, 11 nt, Homo sapiens
cagcucacuca

SEQ ID NO: 993933 - RNA, 16 nt, Homo sapiens
cagcucccacaagccu

SEQ ID NO: 993934 - RNA, 14 nt, Homo sapiens
cagcucuccaauac

SEQ ID NO: 993935 - RNA, 21 nt, Homo sapiens
cagcucuguaucugccaugug

SEQ ID NO: 993936 - RNA, 17 nt, Homo sapiens
cagcugccaguguccug

SEQ ID NO: 993937 - RNA, 19 nt, Homo sapiens
cagcuggaagggucaacau

SEQ ID NO: 993938 - RNA, 18 nt, Homo sapiens
cagcugggcucugcaauu

SEQ ID NO: 993939 - RNA, 21 nt, Homo sapiens
cagcuguauugucugaacuug

SEQ ID NO: 993940 - RNA, 20 nt, Homo sapiens
cagcuguggcagaguuacag

SEQ ID NO: 993941 - RNA, 17 nt, Homo sapiens
cagcuuagauuucauag

SEQ ID NO: 993942 - RNA, 22 nt, Homo sapiens
cagcuuguuuacaugcuuauuc

SEQ ID NO: 993943 - RNA, 18 nt, Homo sapiens
cagcuuugggguuccuuu

SEQ ID NO: 993944 - RNA, 11 nt, Homo sapiens
cagcuuuucaa

SEQ ID NO: 993945 - RNA, 14 nt, Homo sapiens
cagcuuuugcaacu

SEQ ID NO: 993946 - RNA, 22 nt, Homo sapiens
caggaaaccuuggccucugcua

SEQ ID NO: 993947 - RNA, 18 nt, Homo sapiens
caggaaacuccugugacc

SEQ ID NO: 993948 - RNA, 21 nt, Homo sapiens
caggaacccaccaaaccaacc

SEQ ID NO: 993949 - RNA, 16 nt, Homo sapiens
caggaaggacuaugaa

SEQ ID NO: 993950 - RNA, 16 nt, Homo sapiens
caggaaggggugugcu

SEQ ID NO: 993951 - RNA, 19 nt, Homo sapiens
agaguguuaucagucauaa

SEQ ID NO: 993952 - RNA, 15 nt, Homo sapiens
agaguguucccugac

SEQ ID NO: 993953 - RNA, 21 nt, Homo sapiens
agaguuggcuggucaacuuga

SEQ ID NO: 993954 - RNA, 21 nt, Homo sapiens
agauacccuacgcuguccaga

SEQ ID NO: 993955 - RNA, 23 nt, Homo sapiens
agauagauauuccuauugugcaa

SEQ ID NO: 993956 - RNA, 17 nt, Homo sapiens
agauauuggacaaagaa

SEQ ID NO: 993957 - RNA, 14 nt, Homo sapiens
agaucuggcugugg

SEQ ID NO: 993958 - RNA, 17 nt, Homo sapiens
agaucuguccucagccu

SEQ ID NO: 993959 - RNA, 19 nt, Homo sapiens
agaucuuuuauuuugccaa

SEQ ID NO: 993960 - RNA, 14 nt, Homo sapiens
agaugagggggcca

SEQ ID NO: 993961 - RNA, 17 nt, Homo sapiens
agaugauggaugccaau

SEQ ID NO: 993962 - RNA, 15 nt, Homo sapiens
agaugccacauucaa

SEQ ID NO: 993963 - RNA, 12 nt, Homo sapiens
agauggccauau

SEQ ID NO: 993964 - RNA, 18 nt, Homo sapiens
agaugucuuggaacauug

SEQ ID NO: 993965 - RNA, 16 nt, Homo sapiens
agauuaaaaagcacag

SEQ ID NO: 993966 - RNA, 19 nt, Homo sapiens
agauucagguaauacaaac

SEQ ID NO: 993967 - RNA, 14 nt, Homo sapiens
agauucuagaugau

SEQ ID NO: 993968 - RNA, 17 nt, Homo sapiens
agauucuauaguucuag

SEQ ID NO: 993969 - RNA, 17 nt, Homo sapiens
agauucucugugucuaa

SEQ ID NO: 993970 - RNA, 22 nt, Homo sapiens
agauucugaccuuaaaugcaac

SEQ ID NO: 993971 - RNA, 23 nt, Homo sapiens
agauucugccuuugccaggugac

SEQ ID NO: 993972 - RNA, 17 nt, Homo sapiens
agauugcaccacugcac

SEQ ID NO: 993973 - RNA, 23 nt, Homo sapiens
agauuucggaggccauccugcca

SEQ ID NO: 993974 - RNA, 17 nt, Homo sapiens
agauuuggcuugacaaa

SEQ ID NO: 993975 - RNA, 23 nt, Homo sapiens
agauuugggguauaggucucauc

SEQ ID NO: 993976 - RNA, 18 nt, Homo sapiens
agauuuucuuuugccuuu

SEQ ID NO: 993977 - RNA, 21 nt, Homo sapiens
agcaaaccaaagaccaucuga

SEQ ID NO: 993978 - RNA, 19 nt, Homo sapiens
agcaaaccgcccugcagca

SEQ ID NO: 993979 - RNA, 16 nt, Homo sapiens
agcaaaucgugccuug

SEQ ID NO: 993980 - RNA, 19 nt, Homo sapiens
agcaaauggccucauguca

SEQ ID NO: 993981 - RNA, 16 nt, Homo sapiens
agcaacuaggaaaauc

SEQ ID NO: 993982 - RNA, 18 nt, Homo sapiens
agcaagacuucucuuugc

SEQ ID NO: 993983 - RNA, 21 nt, Homo sapiens
aaagaggcugaggcuggcaca

SEQ ID NO: 993984 - RNA, 15 nt, Homo sapiens
aaagaggcugccccu

SEQ ID NO: 993985 - RNA, 18 nt, Homo sapiens
aaagauaauucacuguac

SEQ ID NO: 993986 - RNA, 16 nt, Homo sapiens
aaagaugaaaaguaua

SEQ ID NO: 993987 - RNA, 23 nt, Homo sapiens
aaagauggccauauuaccccuuu

SEQ ID NO: 993988 - RNA, 13 nt, Homo sapiens
aaagcaaaccugu

SEQ ID NO: 993989 - RNA, 14 nt, Homo sapiens
aaagcaagacccua

SEQ ID NO: 993990 - RNA, 20 nt, Homo sapiens
aaagcaagcauucagaagaa

SEQ ID NO: 993991 - RNA, 17 nt, Homo sapiens
aaagcaagcugauuaaa

SEQ ID NO: 993992 - RNA, 14 nt, Homo sapiens
aaagcaaguguuca

SEQ ID NO: 993993 - RNA, 22 nt, Homo sapiens
aaagcagacagcuccacccugg

SEQ ID NO: 993994 - RNA, 23 nt, Homo sapiens
aaagcaggcuuuucuagacuuua

SEQ ID NO: 993995 - RNA, 15 nt, Homo sapiens
aaaggacccugugag

SEQ ID NO: 993996 - RNA, 22 nt, Homo sapiens
aaaggagccugugaacccagga

SEQ ID NO: 993997 - RNA, 23 nt, Homo sapiens
aaaggauuuuucuguaacuguca

SEQ ID NO: 993998 - RNA, 13 nt, Homo sapiens
aaaggcaguuuuc

SEQ ID NO: 993999 - RNA, 15 nt, Homo sapiens
aaagggaaggcuucc

SEQ ID NO: 994000 - RNA, 18 nt, Homo sapiens
aaaggugguguuucugua

SEQ ID NO: 994001 - RNA, 14 nt, Homo sapiens
aaaguacaaccaua

SEQ ID NO: 994002 - RNA, 14 nt, Homo sapiens
aaaguaccagguga

SEQ ID NO: 994003 - RNA, 13 nt, Homo sapiens
aaaguacuuuaau

SEQ ID NO: 994004 - RNA, 15 nt, Homo sapiens
aaaguaguccuguga

SEQ ID NO: 994005 - RNA, 22 nt, Homo sapiens
aaagucacggcugcgcacugug

SEQ ID NO: 994006 - RNA, 16 nt, Homo sapiens
aaaguguucauuguuu

SEQ ID NO: 994007 - RNA, 15 nt, Homo sapiens
aaaguuuaccagaaa

SEQ ID NO: 994008 - RNA, 19 nt, Homo sapiens
aaaguuuggaagcacugau

SEQ ID NO: 994009 - RNA, 19 nt, Homo sapiens
aaauaagcuauuugaugua

SEQ ID NO: 994010 - RNA, 20 nt, Homo sapiens
aaauaauuauauaacuguau

SEQ ID NO: 994011 - RNA, 15 nt, Homo sapiens
aaauacuuuuacucu

SEQ ID NO: 994012 - RNA, 19 nt, Homo sapiens
aaauacuuuuacucugccu

SEQ ID NO: 994013 - RNA, 17 nt, Homo sapiens
aaauagagccugaggga

SEQ ID NO: 994014 - RNA, 15 nt, Homo sapiens
aaucagccacauucu

SEQ ID NO: 994015 - RNA, 16 nt, Homo sapiens
aaucagccacauucua

SEQ ID NO: 994016 - RNA, 12 nt, Homo sapiens
aaucaguuuaaa

SEQ ID NO: 994017 - RNA, 13 nt, Homo sapiens
aaucaucaaguaa

SEQ ID NO: 994018 - RNA, 20 nt, Homo sapiens
aaucauuguauguggucaug

SEQ ID NO: 994019 - RNA, 17 nt, Homo sapiens
aaucauuuuaauuauua

SEQ ID NO: 994020 - RNA, 14 nt, Homo sapiens
aauccacugugacu

SEQ ID NO: 994021 - RNA, 20 nt, Homo sapiens
aauccaggcagauccaggac

SEQ ID NO: 994022 - RNA, 16 nt, Homo sapiens
aauccauuaucgagca

SEQ ID NO: 994023 - RNA, 22 nt, Homo sapiens
aauccauuaucgagcagcauuu

SEQ ID NO: 994024 - RNA, 15 nt, Homo sapiens
aauccuaacauucag

SEQ ID NO: 994025 - RNA, 21 nt, Homo sapiens
aauccuugaugauugacaaca

SEQ ID NO: 994026 - RNA, 15 nt, Homo sapiens
aauccuuuacuguua

SEQ ID NO: 994027 - RNA, 18 nt, Homo sapiens
aaucgcauuuccugagaa

SEQ ID NO: 994028 - RNA, 21 nt, Homo sapiens
aaucuguccguucacaugugu

SEQ ID NO: 994029 - RNA, 14 nt, Homo sapiens
aaucuuuaaaccaa

SEQ ID NO: 994030 - RNA, 20 nt, Homo sapiens
aaugaaaaauuccacucaaa

SEQ ID NO: 994031 - RNA, 14 nt, Homo sapiens
aaugaauguuuaca

SEQ ID NO: 994032 - RNA, 12 nt, Homo sapiens
aaugagugcuua

SEQ ID NO: 994033 - RNA, 19 nt, Homo sapiens
aaugcaaaacacauuuuau

SEQ ID NO: 994034 - RNA, 19 nt, Homo sapiens
aaugcccagacaaaaagcu

SEQ ID NO: 994035 - RNA, 16 nt, Homo sapiens
aaugcccuucacuguc

SEQ ID NO: 994036 - RNA, 14 nt, Homo sapiens
aaugccuacugagu

SEQ ID NO: 994037 - RNA, 13 nt, Homo sapiens
aaugccucuucau

SEQ ID NO: 994038 - RNA, 23 nt, Homo sapiens
aaugccugacuagggagccaugu

SEQ ID NO: 994039 - RNA, 20 nt, Homo sapiens
aauggacguuauccucucag

SEQ ID NO: 994040 - RNA, 23 nt, Homo sapiens
aaugggaagauuaaaaagcacag

SEQ ID NO: 994041 - RNA, 16 nt, Homo sapiens
aaugggcucaaacuuc

SEQ ID NO: 994042 - RNA, 23 nt, Homo sapiens
aauguccuugugaugugcacgua

SEQ ID NO: 994043 - RNA, 17 nt, Homo sapiens
aaugucuugagcucuau

SEQ ID NO: 994044 - RNA, 18 nt, Homo sapiens
aaugucuugagcucuauu

SEQ ID NO: 994045 - RNA, 19 nt, Homo sapiens
aaugucuugagcucuauua

SEQ ID NO: 994046 - RNA, 15 nt, Homo sapiens
aaugucuuuaaugca

SEQ ID NO: 994047 - RNA, 16 nt, Homo sapiens
aaugucuuuaaugcaa

SEQ ID NO: 994048 - RNA, 20 nt, Homo sapiens
aaugugacauuauaugcacu

SEQ ID NO: 994049 - RNA, 21 nt, Homo sapiens
aauguggcugcugaaacucau

SEQ ID NO: 994050 - RNA, 21 nt, Homo sapiens
aauguguguauauggacaaaa

SEQ ID NO: 994051 - RNA, 15 nt, Homo sapiens
aauguucacuuuuga

SEQ ID NO: 994052 - RNA, 21 nt, Homo sapiens
aauguuggacaccuuuagguu

SEQ ID NO: 994053 - RNA, 16 nt, Homo sapiens
aauguugggacugcua

SEQ ID NO: 994054 - RNA, 19 nt, Homo sapiens
aauuaaaauccucaaucca

SEQ ID NO: 994055 - RNA, 21 nt, Homo sapiens
aauuacuggcaaaaacaaaac

SEQ ID NO: 994056 - RNA, 13 nt, Homo sapiens
aauuagaugaacu

SEQ ID NO: 994057 - RNA, 19 nt, Homo sapiens
aauuaguguggcuaaccaa

SEQ ID NO: 994058 - RNA, 19 nt, Homo sapiens
aauuauauguuguaagcaa

SEQ ID NO: 994059 - RNA, 21 nt, Homo sapiens
aauuauauguuguaagcaaca

SEQ ID NO: 994060 - RNA, 15 nt, Homo sapiens
aauuauguagcucuu

SEQ ID NO: 994061 - RNA, 21 nt, Homo sapiens
aauuauuauuuauauauguau

SEQ ID NO: 994062 - RNA, 15 nt, Homo sapiens
aauucaaaaguucca

SEQ ID NO: 994063 - RNA, 20 nt, Homo sapiens
aauucacaugaugcacuuca

SEQ ID NO: 994064 - RNA, 22 nt, Homo sapiens
aauucacaugaugcacuucaaa

SEQ ID NO: 994065 - RNA, 15 nt, Homo sapiens
aauucacuuaggguc

SEQ ID NO: 994066 - RNA, 14 nt, Homo sapiens
aauucagcaaagaa

SEQ ID NO: 994067 - RNA, 14 nt, Homo sapiens
aauucagcauuuga

SEQ ID NO: 994068 - RNA, 16 nt, Homo sapiens
aauucauaaucacucu

SEQ ID NO: 994069 - RNA, 22 nt, Homo sapiens
aauucauuguguuaccuguaga

SEQ ID NO: 994070 - RNA, 16 nt, Homo sapiens
aauucuaacaagucau

SEQ ID NO: 994071 - RNA, 13 nt, Homo sapiens
aauugaauacuuu

SEQ ID NO: 994072 - RNA, 13 nt, Homo sapiens
aauugauuugcau

SEQ ID NO: 994073 - RNA, 16 nt, Homo sapiens
aauugauuugcauuga

SEQ ID NO: 994074 - RNA, 19 nt, Homo sapiens
aauugauuuuucucuucau

SEQ ID NO: 994075 - RNA, 16 nt, Homo sapiens
aauuguacuaaagcca

SEQ ID NO: 994076 - RNA, 17 nt, Homo sapiens
aauuguacuaaagccaa

SEQ ID NO: 994077 - RNA, 14 nt, Homo sapiens
aauugugauuagac

SEQ ID NO: 994078 - RNA, 12 nt, Homo sapiens
aauuuaacaaga

SEQ ID NO: 994079 - RNA, 19 nt, Homo sapiens
aauuuccucaucccuccau

SEQ ID NO: 994080 - RNA, 14 nt, Homo sapiens
aucagagaaggaac

SEQ ID NO: 994081 - RNA, 19 nt, Homo sapiens
aucagaggaaauucuuucc

SEQ ID NO: 994082 - RNA, 18 nt, Homo sapiens
aucagcgccgcaccagcc

SEQ ID NO: 994083 - RNA, 17 nt, Homo sapiens
aucagggaggucauuuu

SEQ ID NO: 994084 - RNA, 21 nt, Homo sapiens
aucaggugcauagcaagugaa

SEQ ID NO: 994085 - RNA, 16 nt, Homo sapiens
aucagucauaacuaaa

SEQ ID NO: 994086 - RNA, 22 nt, Homo sapiens
aucaguccaucccagagggacc

SEQ ID NO: 994087 - RNA, 19 nt, Homo sapiens
aucagugaauaaaccauca

SEQ ID NO: 994088 - RNA, 16 nt, Homo sapiens
aucaguguaccauuug

SEQ ID NO: 994089 - RNA, 15 nt, Homo sapiens
aucaucaaguaauac

SEQ ID NO: 994090 - RNA, 16 nt, Homo sapiens
aucaucaucauucuca

SEQ ID NO: 994091 - RNA, 18 nt, Homo sapiens
aucaugggccagagccuc

SEQ ID NO: 994092 - RNA, 15 nt, Homo sapiens
aucauguguguccac

SEQ ID NO: 994093 - RNA, 15 nt, Homo sapiens
aucauucccauuuug

SEQ ID NO: 994094 - RNA, 17 nt, Homo sapiens
aucauucucugucucau

SEQ ID NO: 994095 - RNA, 22 nt, Homo sapiens
aucauuucuauuucuccuccau

SEQ ID NO: 994096 - RNA, 14 nt, Homo sapiens
auccaaaaucuuga

SEQ ID NO: 994097 - RNA, 12 nt, Homo sapiens
auccacauggga

SEQ ID NO: 994098 - RNA, 18 nt, Homo sapiens
auccaccccguugcucaa

SEQ ID NO: 994099 - RNA, 21 nt, Homo sapiens
auccaccccguugcucaagcc

SEQ ID NO: 994100 - RNA, 12 nt, Homo sapiens
auccaccugccu

SEQ ID NO: 994101 - RNA, 19 nt, Homo sapiens
auccagccucccacaagaa

SEQ ID NO: 994102 - RNA, 20 nt, Homo sapiens
auccagggcccccaucucau

SEQ ID NO: 994103 - RNA, 15 nt, Homo sapiens
auccauaaugcauuc

SEQ ID NO: 994104 - RNA, 17 nt, Homo sapiens
auccauauugagucaaa

SEQ ID NO: 994105 - RNA, 17 nt, Homo sapiens
auccaugcaccuaccuu

SEQ ID NO: 994106 - RNA, 19 nt, Homo sapiens
auccaugcaccuaccuuag

SEQ ID NO: 994107 - RNA, 20 nt, Homo sapiens
auccaugcaccuaccuuaga

SEQ ID NO: 994108 - RNA, 15 nt, Homo sapiens
auccaugcugugcug

SEQ ID NO: 994109 - RNA, 15 nt, Homo sapiens
auccauucacaguuc

SEQ ID NO: 994110 - RNA, 20 nt, Homo sapiens
auccccggggcggcaggaag

SEQ ID NO: 994111 - RNA, 13 nt, Homo sapiens
aucccuacaugua

SEQ ID NO: 994112 - RNA, 14 nt, Homo sapiens
aucccucaccugua

SEQ ID NO: 994113 - RNA, 15 nt, Homo sapiens
aucccucaccuguag

SEQ ID NO: 994114 - RNA, 21 nt, Homo sapiens
aucccugaaggccuucaaccc

SEQ ID NO: 994115 - RNA, 20 nt, Homo sapiens
aucccuuuuucaaugaauuu

SEQ ID NO: 994116 - RNA, 19 nt, Homo sapiens
auccgauuccccuguagca

SEQ ID NO: 994117 - RNA, 13 nt, Homo sapiens
auccuauggcaga

SEQ ID NO: 994118 - RNA, 22 nt, Homo sapiens
aucguccagcgaccuuccucau

SEQ ID NO: 994119 - RNA, 14 nt, Homo sapiens
aucuaccacuguau

SEQ ID NO: 994120 - RNA, 21 nt, Homo sapiens
aucucaaacuacuggcaauuu

SEQ ID NO: 994121 - RNA, 15 nt, Homo sapiens
aucucaaagaaggca

SEQ ID NO: 994122 - RNA, 17 nt, Homo sapiens
aucucaaagaaggcauu

SEQ ID NO: 994123 - RNA, 16 nt, Homo sapiens
aucucaagagcccugu

SEQ ID NO: 994124 - RNA, 13 nt, Homo sapiens
aucucaguaugaa

SEQ ID NO: 994125 - RNA, 22 nt, Homo sapiens
aucucauugcuuacaagccuaa

SEQ ID NO: 994126 - RNA, 15 nt, Homo sapiens
aucucccauguguag

SEQ ID NO: 994127 - RNA, 17 nt, Homo sapiens
aucuccugcgcccuuca

SEQ ID NO: 994128 - RNA, 23 nt, Homo sapiens
ucuuccuuacuuuuuauauauau

SEQ ID NO: 994129 - RNA, 19 nt, Homo sapiens
ucuuccuuccuaauaggca

SEQ ID NO: 994130 - RNA, 15 nt, Homo sapiens
ucuucuaaacuuccc

SEQ ID NO: 994131 - RNA, 18 nt, Homo sapiens
ucuucuccaacaccaccu

SEQ ID NO: 994132 - RNA, 15 nt, Homo sapiens
ucuucucugcacuua

SEQ ID NO: 994133 - RNA, 17 nt, Homo sapiens
ucuucuuacuggugcua

SEQ ID NO: 994134 - RNA, 20 nt, Homo sapiens
ucuugaaauuaagaaggcaa

SEQ ID NO: 994135 - RNA, 14 nt, Homo sapiens
ucuugaaggugcug

SEQ ID NO: 994136 - RNA, 16 nt, Homo sapiens
ucuugagcaguggcug

SEQ ID NO: 994137 - RNA, 16 nt, Homo sapiens
ucuugaggcauuucca

SEQ ID NO: 994138 - RNA, 15 nt, Homo sapiens
ucuugcaacucugua

SEQ ID NO: 994139 - RNA, 17 nt, Homo sapiens
ucuugcaacucuguaaa

SEQ ID NO: 994140 - RNA, 13 nt, Homo sapiens
ucuugcaccccaa

SEQ ID NO: 994141 - RNA, 10 nt, Homo sapiens
ucuugccuug

SEQ ID NO: 994142 - RNA, 22 nt, Homo sapiens
ucuugguugaggaaacaaacau

SEQ ID NO: 994143 - RNA, 13 nt, Homo sapiens
ucuugucuuuauu

SEQ ID NO: 994144 - RNA, 17 nt, Homo sapiens
ucuuguugagugccagc

SEQ ID NO: 994145 - RNA, 12 nt, Homo sapiens
ucuuuaaugcaa

SEQ ID NO: 994146 - RNA, 20 nt, Homo sapiens
ucuuuacaaaacuacaugag

SEQ ID NO: 994147 - RNA, 13 nt, Homo sapiens
ucuuuauacagcu

SEQ ID NO: 994148 - RNA, 17 nt, Homo sapiens
ucuuucaauacagauau

SEQ ID NO: 994149 - RNA, 15 nt, Homo sapiens
ucuuucucugaggac

SEQ ID NO: 994150 - RNA, 12 nt, Homo sapiens
ucuuucuuuauu

SEQ ID NO: 994151 - RNA, 12 nt, Homo sapiens
ucuuugccucaa

SEQ ID NO: 994152 - RNA, 19 nt, Homo sapiens
ucuuuggaaaguacacucu

SEQ ID NO: 994153 - RNA, 15 nt, Homo sapiens
ucuuuggcgaccucc

SEQ ID NO: 994154 - RNA, 22 nt, Homo sapiens
ucuuugggccagacaugccaca

SEQ ID NO: 994155 - RNA, 16 nt, Homo sapiens
ucuuugguucuaagga

SEQ ID NO: 994156 - RNA, 14 nt, Homo sapiens
ucuuuuaacagccu

SEQ ID NO: 994157 - RNA, 13 nt, Homo sapiens
ucuuuugccauga

SEQ ID NO: 994158 - RNA, 23 nt, Homo sapiens
ucuuuugccaugacaacuucuaa

SEQ ID NO: 994159 - RNA, 14 nt, Homo sapiens
ugaaaaaaaaaugg

SEQ ID NO: 994160 - RNA, 19 nt, Homo sapiens
ugaaaaaauauauguauau

SEQ ID NO: 994161 - RNA, 18 nt, Homo sapiens
ugaaaaaucuaagugaua

SEQ ID NO: 994162 - RNA, 17 nt, Homo sapiens
ugaaaacacugugcaca

SEQ ID NO: 994163 - RNA, 16 nt, Homo sapiens
ugaaaacucuuugcug

SEQ ID NO: 994164 - RNA, 22 nt, Homo sapiens
ugaaaacugugcaauguauuaa

SEQ ID NO: 994165 - RNA, 22 nt, Homo sapiens
ugaaaagaauuguuggggguuu

SEQ ID NO: 994166 - RNA, 22 nt, Homo sapiens
ugauuucuuauuauuauauguu

SEQ ID NO: 994167 - RNA, 19 nt, Homo sapiens
ugcaagcacaucugcauuu

SEQ ID NO: 994168 - RNA, 14 nt, Homo sapiens
ugcaaguugaggac

SEQ ID NO: 994169 - RNA, 19 nt, Homo sapiens
ugcaauaucugaagcccuc

SEQ ID NO: 994170 - RNA, 15 nt, Homo sapiens
ugcaauuuuucaaga

SEQ ID NO: 994171 - RNA, 18 nt, Homo sapiens
ugcaauuuuucaagagcu

SEQ ID NO: 994172 - RNA, 17 nt, Homo sapiens
ugcacacauauacaugu

SEQ ID NO: 994173 - RNA, 20 nt, Homo sapiens
ugcacagugacuucugagau

SEQ ID NO: 994174 - RNA, 18 nt, Homo sapiens
ugcacagugugugacuua

SEQ ID NO: 994175 - RNA, 21 nt, Homo sapiens
ugcacaucuguaaaucuacac

SEQ ID NO: 994176 - RNA, 23 nt, Homo sapiens
ugcacauuaaggagaaaucuaua

SEQ ID NO: 994177 - RNA, 13 nt, Homo sapiens
ugcaccaugcugc

SEQ ID NO: 994178 - RNA, 17 nt, Homo sapiens
ugcacguggccucuuga

SEQ ID NO: 994179 - RNA, 12 nt, Homo sapiens
ugcacgugugua

SEQ ID NO: 994180 - RNA, 13 nt, Homo sapiens
ugcacuacugaca

SEQ ID NO: 994181 - RNA, 15 nt, Homo sapiens
ugcacucccaccuga

SEQ ID NO: 994182 - RNA, 22 nt, Homo sapiens
ugcacuggggagcccgucucag

SEQ ID NO: 994183 - RNA, 22 nt, Homo sapiens
ugcacuuauaagaaagaucaaa

SEQ ID NO: 994184 - RNA, 16 nt, Homo sapiens
ugcagaaacuacugac

SEQ ID NO: 994185 - RNA, 12 nt, Homo sapiens
ugcagacuuccc

SEQ ID NO: 994186 - RNA, 20 nt, Homo sapiens
ugcagcucuugggaccgugu

SEQ ID NO: 994187 - RNA, 15 nt, Homo sapiens
ugcagcuuauauuca

SEQ ID NO: 994188 - RNA, 19 nt, Homo sapiens
ugcagcuuauauucaucca

SEQ ID NO: 994189 - RNA, 19 nt, Homo sapiens
ugcaggaucucaccaggca

SEQ ID NO: 994190 - RNA, 17 nt, Homo sapiens
ugcagucacucuaguca

SEQ ID NO: 994191 - RNA, 21 nt, Homo sapiens
ugcaucacauauucauauugu

SEQ ID NO: 994192 - RNA, 23 nt, Homo sapiens
ugcauggcagggggcugcugcug

SEQ ID NO: 994193 - RNA, 13 nt, Homo sapiens
ugcauguguauau

SEQ ID NO: 994194 - RNA, 13 nt, Homo sapiens
ugcauuaugcaau

SEQ ID NO: 994195 - RNA, 15 nt, Homo sapiens
ugcauucuucucugu

SEQ ID NO: 994196 - RNA, 16 nt, Homo sapiens
ugcauugaaaagagcu

SEQ ID NO: 994197 - RNA, 17 nt, Homo sapiens
ugcauugagcucucuca

SEQ ID NO: 994198 - RNA, 18 nt, Homo sapiens
ugccaaaggaugugauau

SEQ ID NO: 994199 - RNA, 23 nt, Homo sapiens
ugccacagcuuuugcaacuuaau

SEQ ID NO: 994200 - RNA, 21 nt, Homo sapiens
ugccacaggaggggaaguagg

SEQ ID NO: 994201 - RNA, 21 nt, Homo sapiens
ugccaccucuaacagcaccaa

SEQ ID NO: 994202 - RNA, 22 nt, Homo sapiens
ugccacugaggggggauccagu

SEQ ID NO: 994203 - RNA, 14 nt, Homo sapiens
ugccacugccuucg

SEQ ID NO: 994204 - RNA, 16 nt, Homo sapiens
ugccagcuucagguga

SEQ ID NO: 994205 - RNA, 15 nt, Homo sapiens
ugccagugacagaca

SEQ ID NO: 994206 - RNA, 18 nt, Homo sapiens
ugccaugacaacuucuaa

SEQ ID NO: 994207 - RNA, 22 nt, Homo sapiens
ugccauuaaagaauaugaaaca

SEQ ID NO: 994208 - RNA, 17 nt, Homo sapiens
ugccauuccucuacugc

SEQ ID NO: 994209 - RNA, 18 nt, Homo sapiens
ugcccagacaaaaagcua

SEQ ID NO: 994210 - RNA, 20 nt, Homo sapiens
ugcccaggcuggaguggagu

SEQ ID NO: 994211 - RNA, 17 nt, Homo sapiens
ugcccaggcuggucuca

SEQ ID NO: 994212 - RNA, 22 nt, Homo sapiens
ugccccaucccaugcuguccau

SEQ ID NO: 994213 - RNA, 20 nt, Homo sapiens
ugcccccaaccauuuccuca

SEQ ID NO: 994214 - RNA, 20 nt, Homo sapiens
ugcccccugcugccaugugg

SEQ ID NO: 994215 - RNA, 15 nt, Homo sapiens
ugcccuaucacccaa

SEQ ID NO: 994216 - RNA, 15 nt, Homo sapiens
ugcccuucacuguca

SEQ ID NO: 994217 - RNA, 20 nt, Homo sapiens
ugccggucgcccuuugcugc

SEQ ID NO: 994218 - RNA, 22 nt, Homo sapiens
ugccuaaggugucugaguuucu

SEQ ID NO: 994219 - RNA, 13 nt, Homo sapiens
ugccugacauuug

SEQ ID NO: 994220 - RNA, 18 nt, Homo sapiens
ugccuucuaggucacuuc

SEQ ID NO: 994221 - RNA, 21 nt, Homo sapiens
ugccuucuccuauuucuccaa

SEQ ID NO: 994222 - RNA, 22 nt, Homo sapiens
ugcgagugguuucuugugcacu

SEQ ID NO: 994223 - RNA, 15 nt, Homo sapiens
ugcgauagagucuca

SEQ ID NO: 994224 - RNA, 16 nt, Homo sapiens
ugcgaugggggucacc

SEQ ID NO: 994225 - RNA, 20 nt, Homo sapiens
ugcgcccuucauugccacac

SEQ ID NO: 994226 - RNA, 20 nt, Homo sapiens
agcaggacugaugucuccua

SEQ ID NO: 994227 - RNA, 19 nt, Homo sapiens
agcagggauuaaccucugc

SEQ ID NO: 994228 - RNA, 23 nt, Homo sapiens
agcaguaguuuguuguagguuuc

SEQ ID NO: 994229 - RNA, 11 nt, Homo sapiens
agcaucagaaa

SEQ ID NO: 994230 - RNA, 13 nt, Homo sapiens
agcaucaugccuc

SEQ ID NO: 994231 - RNA, 21 nt, Homo sapiens
agcaucuaaguuauaagacuc

SEQ ID NO: 994232 - RNA, 19 nt, Homo sapiens
agcaucugggccuuggccu

SEQ ID NO: 994233 - RNA, 14 nt, Homo sapiens
agcauguaccccag

SEQ ID NO: 994234 - RNA, 16 nt, Homo sapiens
agcauguuuagacuuu

SEQ ID NO: 994235 - RNA, 15 nt, Homo sapiens
agcauuacccuccuc

SEQ ID NO: 994236 - RNA, 21 nt, Homo sapiens
agcauugacucuguggcuuug

SEQ ID NO: 994237 - RNA, 13 nt, Homo sapiens
agcauugcacuug

SEQ ID NO: 994238 - RNA, 15 nt, Homo sapiens
agcauugccauuccu

SEQ ID NO: 994239 - RNA, 12 nt, Homo sapiens
agccaaagggac

SEQ ID NO: 994240 - RNA, 14 nt, Homo sapiens
agccaacuuuugca

SEQ ID NO: 994241 - RNA, 23 nt, Homo sapiens
agccaacuuuugcauguuuugua

SEQ ID NO: 994242 - RNA, 14 nt, Homo sapiens
agccaagcaaaaug

SEQ ID NO: 994243 - RNA, 17 nt, Homo sapiens
agccacacuucucagga

SEQ ID NO: 994244 - RNA, 17 nt, Homo sapiens
agccauaugaaugucag

SEQ ID NO: 994245 - RNA, 23 nt, Homo sapiens
agccaucaauauucagcaaaaug

SEQ ID NO: 994246 - RNA, 17 nt, Homo sapiens
agcccaauuaauuccug

SEQ ID NO: 994247 - RNA, 20 nt, Homo sapiens
agcccagagacauacuugaa

SEQ ID NO: 994248 - RNA, 14 nt, Homo sapiens
agcccaggagcucc

SEQ ID NO: 994249 - RNA, 22 nt, Homo sapiens
agcccaggaguugaagaccagc

SEQ ID NO: 994250 - RNA, 21 nt, Homo sapiens
agcccaggcucggccugcccc

SEQ ID NO: 994251 - RNA, 16 nt, Homo sapiens
agcccagugcacugaa

SEQ ID NO: 994252 - RNA, 22 nt, Homo sapiens
agcccauggagauugaccugga

SEQ ID NO: 994253 - RNA, 22 nt, Homo sapiens
agcccauggugagcucugggaa

SEQ ID NO: 994254 - RNA, 22 nt, Homo sapiens
agcccauuuguguacacaguca

SEQ ID NO: 994255 - RNA, 21 nt, Homo sapiens
agcccgaggaggugucucagg

SEQ ID NO: 994256 - RNA, 13 nt, Homo sapiens
agcccucaucccg

SEQ ID NO: 994257 - RNA, 20 nt, Homo sapiens
agcccugcaccaugcugcug

SEQ ID NO: 994258 - RNA, 15 nt, Homo sapiens
agcccugugaggcug

SEQ ID NO: 994259 - RNA, 16 nt, Homo sapiens
agccgaggccuacccc

SEQ ID NO: 994260 - RNA, 16 nt, Homo sapiens
agccgccggcugugca

SEQ ID NO: 994261 - RNA, 12 nt, Homo sapiens
agccuaacacgg

SEQ ID NO: 994262 - RNA, 16 nt, Homo sapiens
agccuaacuccauccc

SEQ ID NO: 994263 - RNA, 20 nt, Homo sapiens
agccucaggggucugagcuc

SEQ ID NO: 994264 - RNA, 18 nt, Homo sapiens
agccuccggcggggaccc

SEQ ID NO: 994265 - RNA, 21 nt, Homo sapiens
agccucugcccaggcacugcu

SEQ ID NO: 994266 - RNA, 22 nt, Homo sapiens
agccucugcccaggcacugcua

SEQ ID NO: 994267 - RNA, 22 nt, Homo sapiens
agccugaguacuccacacugca

SEQ ID NO: 994268 - RNA, 22 nt, Homo sapiens
agccugggcguacagagcacau

SEQ ID NO: 994269 - RNA, 17 nt, Homo sapiens
agccuguccugccugug

SEQ ID NO: 994270 - RNA, 23 nt, Homo sapiens
agccuguucauggcagauguagg

SEQ ID NO: 994271 - RNA, 12 nt, Homo sapiens
agccuugcuugu

SEQ ID NO: 994272 - RNA, 16 nt, Homo sapiens
agccuugugaugucau

SEQ ID NO: 994273 - RNA, 16 nt, Homo sapiens
agcgaaacacacaaac

SEQ ID NO: 994274 - RNA, 18 nt, Homo sapiens
agcgaaacacacaaacca

SEQ ID NO: 994275 - RNA, 20 nt, Homo sapiens
agcgcagugccucaugccug

SEQ ID NO: 994276 - RNA, 18 nt, Homo sapiens
agcgccaggcugaccaca

SEQ ID NO: 994277 - RNA, 19 nt, Homo sapiens
agcgccuuuccugccaugu

SEQ ID NO: 994278 - RNA, 22 nt, Homo sapiens
agcggcccugucauccagcuca

SEQ ID NO: 994279 - RNA, 19 nt, Homo sapiens
agcguuccuagagaagaca

SEQ ID NO: 994280 - RNA, 20 nt, Homo sapiens
agcguuuuggaagaggaaaa

SEQ ID NO: 994281 - RNA, 21 nt, Homo sapiens
agcuaacagucccuauggaaa

SEQ ID NO: 994282 - RNA, 20 nt, Homo sapiens
agcuaacccucacaagcaug

SEQ ID NO: 994283 - RNA, 19 nt, Homo sapiens
agcuaauaacaugugaaaa

SEQ ID NO: 994284 - RNA, 19 nt, Homo sapiens
agcuacagagaaaccagcu

SEQ ID NO: 994285 - RNA, 19 nt, Homo sapiens
agcuaccugcucagcccug

SEQ ID NO: 994286 - RNA, 23 nt, Homo sapiens
agcuacguauuuaauagcaaaga

SEQ ID NO: 994287 - RNA, 21 nt, Homo sapiens
agcuacucuccccacgagggc

SEQ ID NO: 994288 - RNA, 23 nt, Homo sapiens
agcucaggaaggggugugcugag

SEQ ID NO: 994289 - RNA, 15 nt, Homo sapiens
agcuccagccugaca

SEQ ID NO: 994290 - RNA, 17 nt, Homo sapiens
agcuccccucacucugu

SEQ ID NO: 994291 - RNA, 13 nt, Homo sapiens
agcuccugauguc

SEQ ID NO: 994292 - RNA, 18 nt, Homo sapiens
agcuccuguccccugcua

SEQ ID NO: 994293 - RNA, 20 nt, Homo sapiens
agcucuggggugggcaguuu

SEQ ID NO: 994294 - RNA, 23 nt, Homo sapiens
agcugcuccgaggacccaggaaa

SEQ ID NO: 994295 - RNA, 16 nt, Homo sapiens
agcugggccuggucuc

SEQ ID NO: 994296 - RNA, 17 nt, Homo sapiens
agcugggcucugcaauu

SEQ ID NO: 994297 - RNA, 22 nt, Homo sapiens
agcuggggaccugguacccucc

SEQ ID NO: 994298 - RNA, 21 nt, Homo sapiens
agcugguguagcuacagagaa

SEQ ID NO: 994299 - RNA, 15 nt, Homo sapiens
agcugugacuucuau

SEQ ID NO: 994300 - RNA, 22 nt, Homo sapiens
agcuucaggagggaaccagcuu

SEQ ID NO: 994301 - RNA, 20 nt, Homo sapiens
agcuucuagaaggugcuuag

SEQ ID NO: 994302 - RNA, 17 nt, Homo sapiens
agcuugucucuugccug

SEQ ID NO: 994303 - RNA, 22 nt, Homo sapiens
agcuuucauguaaacugugcac

SEQ ID NO: 994304 - RNA, 17 nt, Homo sapiens
aggaaaaaaaaacagcc

SEQ ID NO: 994305 - RNA, 13 nt, Homo sapiens
aggaaaaaaccau

SEQ ID NO: 994306 - RNA, 17 nt, Homo sapiens
aggaaaggcacauguca

SEQ ID NO: 994307 - RNA, 23 nt, Homo sapiens
aggaaauccauucacaguucuuu

SEQ ID NO: 994308 - RNA, 11 nt, Homo sapiens
aggaagcaagc

SEQ ID NO: 994309 - RNA, 21 nt, Homo sapiens
aggaagccuuccccuaccccu

SEQ ID NO: 994310 - RNA, 15 nt, Homo sapiens
aggaauacugaacau

SEQ ID NO: 994311 - RNA, 14 nt, Homo sapiens
aggaauugguuuca

SEQ ID NO: 994312 - RNA, 18 nt, Homo sapiens
aggacagccgccuggaga

SEQ ID NO: 994313 - RNA, 23 nt, Homo sapiens
aggacaugcgguagccagcacac

SEQ ID NO: 994314 - RNA, 12 nt, Homo sapiens
aggaccacaggc

SEQ ID NO: 994315 - RNA, 15 nt, Homo sapiens
aggaccacaggcuca

SEQ ID NO: 994316 - RNA, 13 nt, Homo sapiens
aggaccagagcua

SEQ ID NO: 994317 - RNA, 14 nt, Homo sapiens
aggacccugugagc

SEQ ID NO: 994318 - RNA, 15 nt, Homo sapiens
aggaccugagccugc

SEQ ID NO: 994319 - RNA, 16 nt, Homo sapiens
aggaccuggcugccau

SEQ ID NO: 994320 - RNA, 13 nt, Homo sapiens
aggacucaaaagu

SEQ ID NO: 994321 - RNA, 15 nt, Homo sapiens
aggacucaccacugc

SEQ ID NO: 994322 - RNA, 18 nt, Homo sapiens
aggagaauuuaaacaaug

SEQ ID NO: 994323 - RNA, 18 nt, Homo sapiens
aggagccaccaguucuca

SEQ ID NO: 994324 - RNA, 15 nt, Homo sapiens
aggagccuguccugc

SEQ ID NO: 994325 - RNA, 23 nt, Homo sapiens
aggaggggucuggguacuucuug

SEQ ID NO: 994326 - RNA, 18 nt, Homo sapiens
aggaggugccacuggagu

SEQ ID NO: 994327 - RNA, 21 nt, Homo sapiens
aggaguguccucuucccucuc

SEQ ID NO: 994328 - RNA, 20 nt, Homo sapiens
cuuucucugccagugacaga

SEQ ID NO: 994329 - RNA, 22 nt, Homo sapiens
cuuucucugccagugacagaca

SEQ ID NO: 994330 - RNA, 17 nt, Homo sapiens
cuuucugaauugcacau

SEQ ID NO: 994331 - RNA, 13 nt, Homo sapiens
cuuucuguucucc

SEQ ID NO: 994332 - RNA, 16 nt, Homo sapiens
cuuucuucaccaaauc

SEQ ID NO: 994333 - RNA, 22 nt, Homo sapiens
cuuugacaauuacucagguuug

SEQ ID NO: 994334 - RNA, 13 nt, Homo sapiens
cuuugacaguguu

SEQ ID NO: 994335 - RNA, 14 nt, Homo sapiens
cuuugacaguguuu

SEQ ID NO: 994336 - RNA, 14 nt, Homo sapiens
cuuugauguuccuu

SEQ ID NO: 994337 - RNA, 11 nt, Homo sapiens
cuuugcacuga

SEQ ID NO: 994338 - RNA, 15 nt, Homo sapiens
cuuuggcgaccuccu

SEQ ID NO: 994339 - RNA, 21 nt, Homo sapiens
cuuugggccagacaugccaca

SEQ ID NO: 994340 - RNA, 21 nt, Homo sapiens
cuuugucagggaguguucccu

SEQ ID NO: 994341 - RNA, 23 nt, Homo sapiens
cuuugucccggggcuccacugaa

SEQ ID NO: 994342 - RNA, 21 nt, Homo sapiens
cuuuuacccggcacauucccc

SEQ ID NO: 994343 - RNA, 15 nt, Homo sapiens
cauguauugcacauu

SEQ ID NO: 994344 - RNA, 14 nt, Homo sapiens
caugugaagagaau

SEQ ID NO: 994345 - RNA, 17 nt, Homo sapiens
caugugagcaugucacu

SEQ ID NO: 994346 - RNA, 22 nt, Homo sapiens
caugugcaaaugugcuggucac

SEQ ID NO: 994347 - RNA, 22 nt, Homo sapiens
caugugcgcgcgugcaugugug

SEQ ID NO: 994348 - RNA, 19 nt, Homo sapiens
cauguugaagccacugccu

SEQ ID NO: 994349 - RNA, 19 nt, Homo sapiens
cauguuguaagcacugacu

SEQ ID NO: 994350 - RNA, 19 nt, Homo sapiens
cauguuucccuacaccucu

SEQ ID NO: 994351 - RNA, 15 nt, Homo sapiens
cauguuugcaccugu

SEQ ID NO: 994352 - RNA, 12 nt, Homo sapiens
cauuacugcaua

SEQ ID NO: 994353 - RNA, 17 nt, Homo sapiens
cauuacugcauaaaaua

SEQ ID NO: 994354 - RNA, 23 nt, Homo sapiens
cauuaguuguuagugauggagcu

SEQ ID NO: 994355 - RNA, 13 nt, Homo sapiens
cauucacaguucu

SEQ ID NO: 994356 - RNA, 23 nt, Homo sapiens
cauucagaagaaaaagaagcaac

SEQ ID NO: 994357 - RNA, 21 nt, Homo sapiens
cauucagggcuauuuuuuccc

SEQ ID NO: 994358 - RNA, 19 nt, Homo sapiens
cauuccugaagaaccaguc

SEQ ID NO: 994359 - RNA, 23 nt, Homo sapiens
cauucgugaaaacacauuugcuu

SEQ ID NO: 994360 - RNA, 12 nt, Homo sapiens
cauucucugucu

SEQ ID NO: 994361 - RNA, 23 nt, Homo sapiens
cauugaugagcaagacauacuua

SEQ ID NO: 994362 - RNA, 18 nt, Homo sapiens
cauugcagcaagcaauaa

SEQ ID NO: 994363 - RNA, 16 nt, Homo sapiens
cauugggagucuguag

SEQ ID NO: 994364 - RNA, 23 nt, Homo sapiens
cauugguucuuucauuugcuuug

SEQ ID NO: 994365 - RNA, 20 nt, Homo sapiens
cauuguaaaagcauuuugua

SEQ ID NO: 994366 - RNA, 12 nt, Homo sapiens
cauuuccaugca

SEQ ID NO: 994367 - RNA, 15 nt, Homo sapiens
cauuuccaugcauaa

SEQ ID NO: 994368 - RNA, 20 nt, Homo sapiens
cauuucucuuugcuucacag

SEQ ID NO: 994369 - RNA, 18 nt, Homo sapiens
cauuucugaggugcacug

SEQ ID NO: 994370 - RNA, 22 nt, Homo sapiens
cauuucugaggugcacugggag

SEQ ID NO: 994371 - RNA, 13 nt, Homo sapiens
cauuugcaccuac

SEQ ID NO: 994372 - RNA, 24 nt, Homo sapiens
cauuugcuuuuugugauaugcaca

SEQ ID NO: 994373 - RNA, 19 nt, Homo sapiens
cauuugggagacaugugac

SEQ ID NO: 994374 - RNA, 15 nt, Homo sapiens
cauuuguacugaccc

SEQ ID NO: 994375 - RNA, 21 nt, Homo sapiens
cauuugucaguauuuuugccg

SEQ ID NO: 994376 - RNA, 17 nt, Homo sapiens
cauuuguuuuguuuaca

SEQ ID NO: 994377 - RNA, 21 nt, Homo sapiens
cauuuuguaaguugaagcaaa

SEQ ID NO: 994378 - RNA, 20 nt, Homo sapiens
ccaaacucuucccucucuca

SEQ ID NO: 994379 - RNA, 19 nt, Homo sapiens
ccaaagcagacagcuccac

SEQ ID NO: 994380 - RNA, 10 nt, Homo sapiens
ccaaagggac

SEQ ID NO: 994381 - RNA, 18 nt, Homo sapiens
ccaaagucucuaauucua

SEQ ID NO: 994382 - RNA, 12 nt, Homo sapiens
ccaaaguucuaa

SEQ ID NO: 994383 - RNA, 22 nt, Homo sapiens
ccaacagcuggacccugaccag

SEQ ID NO: 994384 - RNA, 15 nt, Homo sapiens
ccaacaugcacugau

SEQ ID NO: 994385 - RNA, 22 nt, Homo sapiens
ccaacccgucuggcccaccagg

SEQ ID NO: 994386 - RNA, 21 nt, Homo sapiens
ccaaccuucuugucauugaaa

SEQ ID NO: 994387 - RNA, 18 nt, Homo sapiens
ccaacgcuccaaagucau

SEQ ID NO: 994388 - RNA, 19 nt, Homo sapiens
ccaacuugguuuugcuaca

SEQ ID NO: 994389 - RNA, 13 nt, Homo sapiens
ccaagaauguuau

SEQ ID NO: 994390 - RNA, 23 nt, Homo sapiens
ccaagacucuuuaugaucuggcc

SEQ ID NO: 994391 - RNA, 10 nt, Homo sapiens
ccaagagcua

SEQ ID NO: 994392 - RNA, 11 nt, Homo sapiens
ccaagcaccuc

SEQ ID NO: 994393 - RNA, 13 nt, Homo sapiens
ccaagcucugcag

SEQ ID NO: 994394 - RNA, 18 nt, Homo sapiens
ccaaggucuacucccucc

SEQ ID NO: 994395 - RNA, 15 nt, Homo sapiens
ccaagguuuaaagag

SEQ ID NO: 994396 - RNA, 17 nt, Homo sapiens
ccaagucuccaccccuu

SEQ ID NO: 994397 - RNA, 22 nt, Homo sapiens
ccaagugcggguccggcagcuu

SEQ ID NO: 994398 - RNA, 23 nt, Homo sapiens
ccaaucaaucuugcauguaacgc

SEQ ID NO: 994399 - RNA, 15 nt, Homo sapiens
ccaauuucagacucc

SEQ ID NO: 994400 - RNA, 17 nt, Homo sapiens
ccaauuucagacuccca

SEQ ID NO: 994401 - RNA, 18 nt, Homo sapiens
ccaauuuuuuaagugaaa

SEQ ID NO: 994402 - RNA, 14 nt, Homo sapiens
ccacacucagcaca

SEQ ID NO: 994403 - RNA, 19 nt, Homo sapiens
ccacagccugcaagucagu

SEQ ID NO: 994404 - RNA, 14 nt, Homo sapiens
ccacaggcacaggu

SEQ ID NO: 994405 - RNA, 23 nt, Homo sapiens
ccacaggccgcccugcgggugaa

SEQ ID NO: 994406 - RNA, 12 nt, Homo sapiens
ccacagucccau

SEQ ID NO: 994407 - RNA, 16 nt, Homo sapiens
ccaccaaaugugcuuu

SEQ ID NO: 994408 - RNA, 20 nt, Homo sapiens
ccaccaccaaaacugcuccu

SEQ ID NO: 994409 - RNA, 22 nt, Homo sapiens
ccacccaggauccccaaggcac

SEQ ID NO: 994410 - RNA, 16 nt, Homo sapiens
ccacccccagcucaau

SEQ ID NO: 994411 - RNA, 21 nt, Homo sapiens
ccacccucggggauguguccu

SEQ ID NO: 994412 - RNA, 21 nt, Homo sapiens
ccacccugaggagucugaggu

SEQ ID NO: 994413 - RNA, 13 nt, Homo sapiens
ccaccuagacugu

SEQ ID NO: 994414 - RNA, 21 nt, Homo sapiens
ccaccucuaacagcaccaaau

SEQ ID NO: 994415 - RNA, 18 nt, Homo sapiens
ccacgccucuugaccagg

SEQ ID NO: 994416 - RNA, 18 nt, Homo sapiens
ccacugaagcaccacagg

SEQ ID NO: 994417 - RNA, 12 nt, Homo sapiens
ccacugaccaga

SEQ ID NO: 994418 - RNA, 22 nt, Homo sapiens
ccacuggucuguagggauuuuu

SEQ ID NO: 994419 - RNA, 18 nt, Homo sapiens
ccacugugacuuugccca

SEQ ID NO: 994420 - RNA, 14 nt, Homo sapiens
ccacuguguuccuu

SEQ ID NO: 994421 - RNA, 22 nt, Homo sapiens
ccacuuacagaucuaucuccuc

SEQ ID NO: 994422 - RNA, 22 nt, Homo sapiens
ccacuugccugugcuacaauuc

SEQ ID NO: 994423 - RNA, 16 nt, Homo sapiens
cugguauuguucucac

SEQ ID NO: 994424 - RNA, 18 nt, Homo sapiens
cuggucauuaaugugucc

SEQ ID NO: 994425 - RNA, 16 nt, Homo sapiens
cuggugccaccucaga

SEQ ID NO: 994426 - RNA, 18 nt, Homo sapiens
cugguuguuaugugauca

SEQ ID NO: 994427 - RNA, 21 nt, Homo sapiens
cuguaaagauguuuauuucag

SEQ ID NO: 994428 - RNA, 19 nt, Homo sapiens
cuguaaauaaugugcacug

SEQ ID NO: 994429 - RNA, 12 nt, Homo sapiens
cuguaaauaugu

SEQ ID NO: 994430 - RNA, 21 nt, Homo sapiens
cuguaacugucaccugaaaua

SEQ ID NO: 994431 - RNA, 11 nt, Homo sapiens
cuguacagugu

SEQ ID NO: 994432 - RNA, 12 nt, Homo sapiens
cuguaccaguua

SEQ ID NO: 994433 - RNA, 16 nt, Homo sapiens
cuguaccugugcacgu

SEQ ID NO: 994434 - RNA, 18 nt, Homo sapiens
cuguaccugugcacguug

SEQ ID NO: 994435 - RNA, 13 nt, Homo sapiens
cuguagaguugcu

SEQ ID NO: 994436 - RNA, 15 nt, Homo sapiens
cuguauagcugcuuc

SEQ ID NO: 994437 - RNA, 20 nt, Homo sapiens
cuguaugccuucagcauugc

SEQ ID NO: 994438 - RNA, 22 nt, Homo sapiens
cuguauugucugaacuugcauu

SEQ ID NO: 994439 - RNA, 15 nt, Homo sapiens
cugucacaaccaaga

SEQ ID NO: 994440 - RNA, 13 nt, Homo sapiens
cugucagauccag

SEQ ID NO: 994441 - RNA, 15 nt, Homo sapiens
cugucagucacagcc

SEQ ID NO: 994442 - RNA, 19 nt, Homo sapiens
cuguccucagccuugccag

SEQ ID NO: 994443 - RNA, 22 nt, Homo sapiens
cugucgcugcuucgugggauac

SEQ ID NO: 994444 - RNA, 15 nt, Homo sapiens
cugucucaagcucuu

SEQ ID NO: 994445 - RNA, 14 nt, Homo sapiens
cugucucagccucc

SEQ ID NO: 994446 - RNA, 13 nt, Homo sapiens
cugucuccauggc

SEQ ID NO: 994447 - RNA, 14 nt, Homo sapiens
cugucucucagggc

SEQ ID NO: 994448 - RNA, 14 nt, Homo sapiens
cugucugacaaccu

SEQ ID NO: 994449 - RNA, 21 nt, Homo sapiens
cugugaaaaauaaagucauca

SEQ ID NO: 994450 - RNA, 22 nt, Homo sapiens
cugugaccugcugagcucugag

SEQ ID NO: 994451 - RNA, 24 nt, Homo sapiens
cugugacuggcagcauugacucug

SEQ ID NO: 994452 - RNA, 13 nt, Homo sapiens
gaaaggacccugu

SEQ ID NO: 994453 - RNA, 23 nt, Homo sapiens
gaaagguuuuauucuauauugcu

SEQ ID NO: 994454 - RNA, 19 nt, Homo sapiens
gaaaguacacucugcuguu

SEQ ID NO: 994455 - RNA, 17 nt, Homo sapiens
gaaauuaagaaggcaaa

SEQ ID NO: 994456 - RNA, 19 nt, Homo sapiens
gaaauucucaucaguccau

SEQ ID NO: 994457 - RNA, 14 nt, Homo sapiens
gaaauucuuuccca

SEQ ID NO: 994458 - RNA, 15 nt, Homo sapiens
gaacaauugaaguaa

SEQ ID NO: 994459 - RNA, 23 nt, Homo sapiens
gaacacuucgaguucccaggguu

SEQ ID NO: 994460 - RNA, 21 nt, Homo sapiens
gaacagcauuacccuccucuc

SEQ ID NO: 994461 - RNA, 17 nt, Homo sapiens
gaacagcuguaaucuau

SEQ ID NO: 994462 - RNA, 20 nt, Homo sapiens
gaaccaaaucuggaagccaa

SEQ ID NO: 994463 - RNA, 15 nt, Homo sapiens
gaacccagacucaga

SEQ ID NO: 994464 - RNA, 16 nt, Homo sapiens
gaaccccuuucccacc

SEQ ID NO: 994465 - RNA, 19 nt, Homo sapiens
gaacucaaccucuacaggg

SEQ ID NO: 994466 - RNA, 11 nt, Homo sapiens
gaacuugccug

SEQ ID NO: 994467 - RNA, 14 nt, Homo sapiens
gaacuuugagcuac

SEQ ID NO: 994468 - RNA, 12 nt, Homo sapiens
gaagaagcuaaa

SEQ ID NO: 994469 - RNA, 18 nt, Homo sapiens
gaagaugggcuucaucca

SEQ ID NO: 994470 - RNA, 13 nt, Homo sapiens
gaagccacugccu

SEQ ID NO: 994471 - RNA, 17 nt, Homo sapiens
gaagccuauguaugcca

SEQ ID NO: 994472 - RNA, 20 nt, Homo sapiens
gaagcuuuggugagaaccug

SEQ ID NO: 994473 - RNA, 12 nt, Homo sapiens
gaaggacacuca

SEQ ID NO: 994474 - RNA, 14 nt, Homo sapiens
gaaggccuucagga

SEQ ID NO: 994475 - RNA, 20 nt, Homo sapiens
gaagggggcggccuaugacu

SEQ ID NO: 994476 - RNA, 14 nt, Homo sapiens
gaagguuaucagug

SEQ ID NO: 994477 - RNA, 18 nt, Homo sapiens
gaaguaaacagauggcac

SEQ ID NO: 994478 - RNA, 14 nt, Homo sapiens
gaaguagcucuuuu

SEQ ID NO: 994479 - RNA, 17 nt, Homo sapiens
gaauaaaggcaguuuuc

SEQ ID NO: 994480 - RNA, 16 nt, Homo sapiens
gaauaccacucuguaa

SEQ ID NO: 994481 - RNA, 23 nt, Homo sapiens
gaauagaaauaaaggaugugauu

SEQ ID NO: 994482 - RNA, 13 nt, Homo sapiens
gaauagcuuuaau

SEQ ID NO: 994483 - RNA, 16 nt, Homo sapiens
gggccuggcuggcuga

SEQ ID NO: 994484 - RNA, 12 nt, Homo sapiens
gggcggucacag

SEQ ID NO: 994485 - RNA, 16 nt, Homo sapiens
gggcuagugacuugug

SEQ ID NO: 994486 - RNA, 21 nt, Homo sapiens
gggcucaaacuucuaaggggu

SEQ ID NO: 994487 - RNA, 23 nt, Homo sapiens
gggcuggaggcccaggcugggaa

SEQ ID NO: 994488 - RNA, 21 nt, Homo sapiens
gggcuucagcugccagugucc

SEQ ID NO: 994489 - RNA, 17 nt, Homo sapiens
gggcuuuuuaagaggau

SEQ ID NO: 994490 - RNA, 12 nt, Homo sapiens
ggggcagggugu

SEQ ID NO: 994491 - RNA, 16 nt, Homo sapiens
gggggcggccuaugac

SEQ ID NO: 994492 - RNA, 17 nt, Homo sapiens
ggguacagcgcggagga

SEQ ID NO: 994493 - RNA, 19 nt, Homo sapiens
ggguccuuuugacacugcu

SEQ ID NO: 994494 - RNA, 20 nt, Homo sapiens
gggucucacaguguugccca

SEQ ID NO: 994495 - RNA, 18 nt, Homo sapiens
gggugacccugaagugag

SEQ ID NO: 994496 - RNA, 18 nt, Homo sapiens
ggguggcacucagucucu

SEQ ID NO: 994497 - RNA, 14 nt, Homo sapiens
ggguguaccaccca

SEQ ID NO: 994498 - RNA, 24 nt, Homo sapiens
ggguuucaccauguuagccaggcu

SEQ ID NO: 994499 - RNA, 21 nt, Homo sapiens
gguaaaaugccaugaugccuc

SEQ ID NO: 994500 - RNA, 16 nt, Homo sapiens
gguaauacaaacuaua

SEQ ID NO: 994501 - RNA, 21 nt, Homo sapiens
gguaauauugacuuguauauu

SEQ ID NO: 994502 - RNA, 13 nt, Homo sapiens
gguacauggugcu

SEQ ID NO: 994503 - RNA, 11 nt, Homo sapiens
gguagccagca

SEQ ID NO: 994504 - RNA, 13 nt, Homo sapiens
gguaggggguccc

SEQ ID NO: 994505 - RNA, 16 nt, Homo sapiens
gguauauacuuugaaa

SEQ ID NO: 994506 - RNA, 15 nt, Homo sapiens
ggucaggcagggugc

SEQ ID NO: 994507 - RNA, 21 nt, Homo sapiens
ggucagugguggucuucaaga

SEQ ID NO: 994508 - RNA, 14 nt, Homo sapiens
ggucaucacuuuga

SEQ ID NO: 994509 - RNA, 15 nt, Homo sapiens
gguccacaagcuucu

SEQ ID NO: 994510 - RNA, 17 nt, Homo sapiens
gguccccuccuucccaa

SEQ ID NO: 994511 - RNA, 17 nt, Homo sapiens
ggucccuuggucaggag

SEQ ID NO: 994512 - RNA, 22 nt, Homo sapiens
ggucuaagcaccuuggugcuua

SEQ ID NO: 994513 - RNA, 20 nt, Homo sapiens
ggucucacaguguugcccag

SEQ ID NO: 994514 - RNA, 14 nt, Homo sapiens
ggucucccaaacgc

SEQ ID NO: 994515 - RNA, 20 nt, Homo sapiens
ggucucgcuuuguugcccag

SEQ ID NO: 994516 - RNA, 23 nt, Homo sapiens
ggucugcucuuucucugccagug

SEQ ID NO: 994517 - RNA, 21 nt, Homo sapiens
ggugaacaaaguuuaccagaa

SEQ ID NO: 994518 - RNA, 23 nt, Homo sapiens
ggugaacguguucaaagccaagc

SEQ ID NO: 994519 - RNA, 17 nt, Homo sapiens
ggugcaguaucaugccc

SEQ ID NO: 994520 - RNA, 19 nt, Homo sapiens
ggugcauagcaagugaaag

SEQ ID NO: 994521 - RNA, 23 nt, Homo sapiens
ggugcuacacccuuuuccagcug

SEQ ID NO: 994522 - RNA, 19 nt, Homo sapiens
gguggccgcugaguggcag

SEQ ID NO: 994523 - RNA, 19 nt, Homo sapiens
gguggcugcagccucagga

SEQ ID NO: 994524 - RNA, 13 nt, Homo sapiens
ggugggggguccc

SEQ ID NO: 994525 - RNA, 21 nt, Homo sapiens
gguguccuacagaaaaaccuu

SEQ ID NO: 994526 - RNA, 17 nt, Homo sapiens
gguuauaacaguguuua

SEQ ID NO: 994527 - RNA, 22 nt, Homo sapiens
gguuccagggucccucugugua

SEQ ID NO: 994528 - RNA, 16 nt, Homo sapiens
gguucuuugcugcauu

SEQ ID NO: 994529 - RNA, 20 nt, Homo sapiens
gguugaacucugguggcaca

SEQ ID NO: 994530 - RNA, 12 nt, Homo sapiens
gguuucagcacu

SEQ ID NO: 994531 - RNA, 22 nt, Homo sapiens
gguuucccuacugaagcccuug

SEQ ID NO: 994532 - RNA, 19 nt, Homo sapiens
gguuugcagcgacuggcau

SEQ ID NO: 994533 - RNA, 21 nt, Homo sapiens
gguuuuauaaggcugauguca

SEQ ID NO: 994534 - RNA, 13 nt, Homo sapiens
guaaaaagaaaua

SEQ ID NO: 994535 - RNA, 18 nt, Homo sapiens
guaaaaugacaaucaugu

SEQ ID NO: 994536 - RNA, 20 nt, Homo sapiens
guaaacagauggcacuuuga

SEQ ID NO: 994537 - RNA, 14 nt, Homo sapiens
guaaacugugcacc

SEQ ID NO: 994538 - RNA, 21 nt, Homo sapiens
guaaagaaauauauaugauau

SEQ ID NO: 994539 - RNA, 16 nt, Homo sapiens
guaaauaaugcuuuga

SEQ ID NO: 994540 - RNA, 16 nt, Homo sapiens
guaacucaaagggugg

SEQ ID NO: 994541 - RNA, 19 nt, Homo sapiens
guaacuccccucagggaua

SEQ ID NO: 994542 - RNA, 13 nt, Homo sapiens
guaacugccuaga

SEQ ID NO: 994543 - RNA, 17 nt, Homo sapiens
guaaguauaaaugaauu

SEQ ID NO: 994544 - RNA, 17 nt, Homo sapiens
guaauacaaacuauaua

SEQ ID NO: 994545 - RNA, 21 nt, Homo sapiens
guaauagcuguaaacuuccaa

SEQ ID NO: 994546 - RNA, 13 nt, Homo sapiens
guaaucacuguug

SEQ ID NO: 994547 - RNA, 20 nt, Homo sapiens
uaaauauauuguacucuuua

SEQ ID NO: 994548 - RNA, 13 nt, Homo sapiens
uaaaugaacaaga

SEQ ID NO: 994549 - RNA, 18 nt, Homo sapiens
uaaaugucuuuaaugcaa

SEQ ID NO: 994550 - RNA, 22 nt, Homo sapiens
uaaauuaucaggcaaauuugca

SEQ ID NO: 994551 - RNA, 12 nt, Homo sapiens
uaaauugcacac

SEQ ID NO: 994552 - RNA, 20 nt, Homo sapiens
uaacaaugacauuuauauca

SEQ ID NO: 994553 - RNA, 13 nt, Homo sapiens
uaacaauugugua

SEQ ID NO: 994554 - RNA, 15 nt, Homo sapiens
uaacacggugcucau

SEQ ID NO: 994555 - RNA, 16 nt, Homo sapiens
uaacaggugccuuccc

SEQ ID NO: 994556 - RNA, 15 nt, Homo sapiens
uaacaugugaaaaga

SEQ ID NO: 994557 - RNA, 20 nt, Homo sapiens
uaaccaagagauaacuguaa

SEQ ID NO: 994558 - RNA, 18 nt, Homo sapiens
uaaccucugcacuacuga

SEQ ID NO: 994559 - RNA, 22 nt, Homo sapiens
uaaccuugaaaaaaaacagugg

SEQ ID NO: 994560 - RNA, 13 nt, Homo sapiens
uaacggugcucag

SEQ ID NO: 994561 - RNA, 15 nt, Homo sapiens
uaacuaacugcauac

SEQ ID NO: 994562 - RNA, 18 nt, Homo sapiens
uaacuagaggagaauuua

SEQ ID NO: 994563 - RNA, 19 nt, Homo sapiens
uaacucaaaggguggaaua

SEQ ID NO: 994564 - RNA, 21 nt, Homo sapiens
uaacugcuuucuguuccaaau

SEQ ID NO: 994565 - RNA, 18 nt, Homo sapiens
uaacugucaccugaaaua

SEQ ID NO: 994566 - RNA, 19 nt, Homo sapiens
uaacuugauccauuucuaa

SEQ ID NO: 994567 - RNA, 23 nt, Homo sapiens
uaagaacuuugagcuacugccgu

SEQ ID NO: 994568 - RNA, 20 nt, Homo sapiens
uaagaagaaugcuuaaucag

SEQ ID NO: 994569 - RNA, 22 nt, Homo sapiens
uaagaagccuuaauuugcacag

SEQ ID NO: 994570 - RNA, 19 nt, Homo sapiens
uaagagccuaacuccaucc

SEQ ID NO: 994571 - RNA, 17 nt, Homo sapiens
uaagaggcuuucuccag

SEQ ID NO: 994572 - RNA, 15 nt, Homo sapiens
uaagaucacagugaa

SEQ ID NO: 994573 - RNA, 19 nt, Homo sapiens
uaagaucuuagauucucug

SEQ ID NO: 994574 - RNA, 11 nt, Homo sapiens
uaagcaccugu

SEQ ID NO: 994575 - RNA, 19 nt, Homo sapiens
uaagcucccagggccuguc

SEQ ID NO: 994576 - RNA, 23 nt, Homo sapiens
uaagggccacaucccacugccac

SEQ ID NO: 994577 - RNA, 15 nt, Homo sapiens
uaagguaaaaugcca

SEQ ID NO: 994578 - RNA, 18 nt, Homo sapiens
uaaguaaguuugauuuca

SEQ ID NO: 994579 - RNA, 13 nt, Homo sapiens
uaaguacagagaa

SEQ ID NO: 994580 - RNA, 15 nt, Homo sapiens
uaaguacaugugcca

SEQ ID NO: 994581 - RNA, 14 nt, Homo sapiens
uaaguacuuugcug

SEQ ID NO: 994582 - RNA, 17 nt, Homo sapiens
uaagucaaccugccuga

SEQ ID NO: 994583 - RNA, 22 nt, Homo sapiens
uaaguuuuauguuaaaucaaua

SEQ ID NO: 994584 - RNA, 15 nt, Homo sapiens
uaauaaauuucacca

SEQ ID NO: 994585 - RNA, 23 nt, Homo sapiens
uaauagccuggguuaaguauuau

SEQ ID NO: 994586 - RNA, 18 nt, Homo sapiens
uaaucaucaaguaauaca

SEQ ID NO: 994587 - RNA, 18 nt, Homo sapiens
uaauccaggcagauccag

SEQ ID NO: 994588 - RNA, 14 nt, Homo sapiens
uaauccuaccucaa

SEQ ID NO: 994589 - RNA, 15 nt, Homo sapiens
uaauccuucuggcaa

SEQ ID NO: 994590 - RNA, 15 nt, Homo sapiens
uaaucucacuacaca

SEQ ID NO: 994591 - RNA, 14 nt, Homo sapiens
uaaugagagcacuu

SEQ ID NO: 994592 - RNA, 21 nt, Homo sapiens
uaauguugacuuuaauacucu

SEQ ID NO: 994593 - RNA, 18 nt, Homo sapiens
uaauuaaaagcaaaucau

SEQ ID NO: 994594 - RNA, 20 nt, Homo sapiens
uaauugcacguguguauugc

SEQ ID NO: 994595 - RNA, 18 nt, Homo sapiens
uaauuguacuaaagccaa

SEQ ID NO: 994596 - RNA, 14 nt, Homo sapiens
uaauuuaugcagaa

SEQ ID NO: 994597 - RNA, 13 nt, Homo sapiens
uaauuucuucaca

SEQ ID NO: 994598 - RNA, 17 nt, Homo sapiens
uaauuuuugaaaacugg

SEQ ID NO: 994599 - RNA, 22 nt, Homo sapiens
uacaaaacaaacucauucauua

SEQ ID NO: 994600 - RNA, 13 nt, Homo sapiens
uacaaaucaucca

SEQ ID NO: 994601 - RNA, 18 nt, Homo sapiens
uacaacugccucgaaaca

SEQ ID NO: 994602 - RNA, 17 nt, Homo sapiens
uacaauuaaaaugacaa

SEQ ID NO: 994603 - RNA, 20 nt, Homo sapiens
uacacaggaggcugaggcag

SEQ ID NO: 994604 - RNA, 21 nt, Homo sapiens
uacacuguguaaauacccaua

SEQ ID NO: 994605 - RNA, 15 nt, Homo sapiens
uacagaacuucagaa

SEQ ID NO: 994606 - RNA, 20 nt, Homo sapiens
uacagaaucaaaugcaauuu

SEQ ID NO: 994607 - RNA, 17 nt, Homo sapiens
uacagagaaaccagcuu

SEQ ID NO: 994608 - RNA, 15 nt, Homo sapiens
uacagagaagccauc

SEQ ID NO: 994609 - RNA, 17 nt, Homo sapiens
uacagagaagccaucac

SEQ ID NO: 994610 - RNA, 19 nt, Homo sapiens
uacagagcacauuugucag

SEQ ID NO: 994611 - RNA, 13 nt, Homo sapiens
uacagcaggcagu

SEQ ID NO: 994612 - RNA, 16 nt, Homo sapiens
uacagcaggugcucaa

SEQ ID NO: 994613 - RNA, 20 nt, Homo sapiens
uacagggacacuaucacuca

SEQ ID NO: 994614 - RNA, 13 nt, Homo sapiens
uacaucaaagagu

SEQ ID NO: 994615 - RNA, 11 nt, Homo sapiens
uacaucuggcc

SEQ ID NO: 994616 - RNA, 14 nt, Homo sapiens
uacauguauugcac

SEQ ID NO: 994617 - RNA, 15 nt, Homo sapiens
uacauucaacagaga

SEQ ID NO: 994618 - RNA, 20 nt, Homo sapiens
uacauucugcaagcacaucu

SEQ ID NO: 994619 - RNA, 19 nt, Homo sapiens
uacauugcagcaagcaaua

SEQ ID NO: 994620 - RNA, 19 nt, Homo sapiens
uacauuuuaaacacauuag

SEQ ID NO: 994621 - RNA, 21 nt, Homo sapiens
uaccaccagacugcaaugcca

SEQ ID NO: 994622 - RNA, 13 nt, Homo sapiens
uaccaguugccuu

SEQ ID NO: 994623 - RNA, 22 nt, Homo sapiens
uaccauuuaauggggaggacaa

SEQ ID NO: 994624 - RNA, 18 nt, Homo sapiens
uacccuuuuucuccagcu

SEQ ID NO: 994625 - RNA, 23 nt, Homo sapiens
uaccucacagagugcauugugag

SEQ ID NO: 994626 - RNA, 16 nt, Homo sapiens
uaccucucagccuuag

SEQ ID NO: 994627 - RNA, 16 nt, Homo sapiens
uaccucuuucaggguu

SEQ ID NO: 994628 - RNA, 21 nt, Homo sapiens
uaccugaaaacacugugcaca

SEQ ID NO: 994629 - RNA, 21 nt, Homo sapiens
uaccugcccccaauccaugaa

SEQ ID NO: 994630 - RNA, 21 nt, Homo sapiens
uaccugggcauucuuguuuca

SEQ ID NO: 994631 - RNA, 18 nt, Homo sapiens
uacgcucagcucauccau

SEQ ID NO: 994632 - RNA, 18 nt, Homo sapiens
uacuaaugccucuucauu

SEQ ID NO: 994633 - RNA, 21 nt, Homo sapiens
uacuaauuccacaccuuuuau

SEQ ID NO: 994634 - RNA, 19 nt, Homo sapiens
uacuacaaacuucaaagag

SEQ ID NO: 994635 - RNA, 16 nt, Homo sapiens
uacuaccuguaaugac

SEQ ID NO: 994636 - RNA, 21 nt, Homo sapiens
uacucugugccagagccuggg

SEQ ID NO: 994637 - RNA, 20 nt, Homo sapiens
uacugaaucugcuaccaaaa

SEQ ID NO: 994638 - RNA, 19 nt, Homo sapiens
uacugauccucgcaugaug

SEQ ID NO: 994639 - RNA, 19 nt, Homo sapiens
uacugcuaucuacuacaaa

SEQ ID NO: 994640 - RNA, 14 nt, Homo sapiens
uacugcucugagaa

SEQ ID NO: 994641 - RNA, 14 nt, Homo sapiens
uacuggcaauuugu

SEQ ID NO: 994642 - RNA, 21 nt, Homo sapiens
uacuguaggcacacuuugcac

SEQ ID NO: 994643 - RNA, 23 nt, Homo sapiens
uacuguaggcacacuuugcacug

SEQ ID NO: 994644 - RNA, 17 nt, Homo sapiens
uacuguaguucacugua

SEQ ID NO: 994645 - RNA, 17 nt, Homo sapiens
gucaggcagggugcagu

SEQ ID NO: 994646 - RNA, 15 nt, Homo sapiens
gucagucacagccac

SEQ ID NO: 994647 - RNA, 18 nt, Homo sapiens
gucagugguggucuucaa

SEQ ID NO: 994648 - RNA, 20 nt, Homo sapiens
gucauaaugguuuuuaacac

SEQ ID NO: 994649 - RNA, 13 nt, Homo sapiens
gucauaauugcau

SEQ ID NO: 994650 - RNA, 19 nt, Homo sapiens
gucauacagagaagucaca

SEQ ID NO: 994651 - RNA, 14 nt, Homo sapiens
gucaucacuuugac

SEQ ID NO: 994652 - RNA, 14 nt, Homo sapiens
gucaucaucacauu

SEQ ID NO: 994653 - RNA, 17 nt, Homo sapiens
gucauccagcucacuca

SEQ ID NO: 994654 - RNA, 12 nt, Homo sapiens
gucauucuggga

SEQ ID NO: 994655 - RNA, 19 nt, Homo sapiens
gucauuggccgacaucaca

SEQ ID NO: 994656 - RNA, 20 nt, Homo sapiens
guccaaaacugccucaggag

SEQ ID NO: 994657 - RNA, 17 nt, Homo sapiens
guccaaugcucaggugc

SEQ ID NO: 994658 - RNA, 15 nt, Homo sapiens
guccacaagcuucug

SEQ ID NO: 994659 - RNA, 13 nt, Homo sapiens
guccacaggucua

SEQ ID NO: 994660 - RNA, 20 nt, Homo sapiens
guccacccccauacauuuau

SEQ ID NO: 994661 - RNA, 24 nt, Homo sapiens
guccacgagcuguuuacuagggau

SEQ ID NO: 994662 - RNA, 14 nt, Homo sapiens
guccacugucaggg

SEQ ID NO: 994663 - RNA, 16 nt, Homo sapiens
guccaggcacugagau

SEQ ID NO: 994664 - RNA, 18 nt, Homo sapiens
guccagggcuagugacuu

SEQ ID NO: 994665 - RNA, 16 nt, Homo sapiens
guccauccauucucac

SEQ ID NO: 994666 - RNA, 21 nt, Homo sapiens
gucccagagcaggaaugggaa

SEQ ID NO: 994667 - RNA, 23 nt, Homo sapiens
gucccagcggugggaccuaggga

SEQ ID NO: 994668 - RNA, 15 nt, Homo sapiens
gucccaggacccugg

SEQ ID NO: 994669 - RNA, 15 nt, Homo sapiens
guccccauacuccua

SEQ ID NO: 994670 - RNA, 17 nt, Homo sapiens
guccccucaccuccucu

SEQ ID NO: 994671 - RNA, 22 nt, Homo sapiens
gucccucccucaccagccucac

SEQ ID NO: 994672 - RNA, 22 nt, Homo sapiens
gucccuguuuucccacgaggaa

SEQ ID NO: 994673 - RNA, 19 nt, Homo sapiens
guccucagccuugccagag

SEQ ID NO: 994674 - RNA, 17 nt, Homo sapiens
guccuccuccagggaca

SEQ ID NO: 994675 - RNA, 15 nt, Homo sapiens
guccucuucugggcc

SEQ ID NO: 994676 - RNA, 20 nt, Homo sapiens
guccugagaaagcucaaagg

SEQ ID NO: 994677 - RNA, 17 nt, Homo sapiens
guccuguccuuuaccaa

SEQ ID NO: 994678 - RNA, 21 nt, Homo sapiens
guccuugugaugugcacguaa

SEQ ID NO: 994679 - RNA, 16 nt, Homo sapiens
gucgaacaauucauau

SEQ ID NO: 994680 - RNA, 14 nt, Homo sapiens
gucggugccuucaa

SEQ ID NO: 994681 - RNA, 18 nt, Homo sapiens
gucuacucccuccucacc

SEQ ID NO: 994682 - RNA, 20 nt, Homo sapiens
gucucaugcggacccucaca

SEQ ID NO: 994683 - RNA, 16 nt, Homo sapiens
gucuccuaagcaccug

SEQ ID NO: 994684 - RNA, 13 nt, Homo sapiens
gucucgcuuuguu

SEQ ID NO: 994685 - RNA, 16 nt, Homo sapiens
gucucugaugcagcuu

SEQ ID NO: 994686 - RNA, 15 nt, Homo sapiens
gucucuguuuuacaa

SEQ ID NO: 994687 - RNA, 17 nt, Homo sapiens
gucucuuccaguuugcu

SEQ ID NO: 994688 - RNA, 23 nt, Homo sapiens
gucucuucuuuagaacagggaaa

SEQ ID NO: 994689 - RNA, 14 nt, Homo sapiens
gucugagaccacuu

SEQ ID NO: 994690 - RNA, 21 nt, Homo sapiens
gucugagguccugagcacugc

SEQ ID NO: 994691 - RNA, 17 nt, Homo sapiens
gucugcuguuccagugg

SEQ ID NO: 994692 - RNA, 15 nt, Homo sapiens
gucuggcccaccagg

SEQ ID NO: 994693 - RNA, 18 nt, Homo sapiens
gucuggcugguguuaaca

SEQ ID NO: 994694 - RNA, 18 nt, Homo sapiens
gucugggagucacacagu

SEQ ID NO: 994695 - RNA, 19 nt, Homo sapiens
gucugggugcuacugggga

SEQ ID NO: 994696 - RNA, 17 nt, Homo sapiens
gucuguccuugaaggac

SEQ ID NO: 994697 - RNA, 11 nt, Homo sapiens
gucuguuggca

SEQ ID NO: 994698 - RNA, 13 nt, Homo sapiens
gucuguuugcauu

SEQ ID NO: 994699 - RNA, 14 nt, Homo sapiens
gucuuauccuccac

SEQ ID NO: 994700 - RNA, 22 nt, Homo sapiens
gucuuccugaguggugccaaac

SEQ ID NO: 994701 - RNA, 17 nt, Homo sapiens
gucuuggaacuugccug

SEQ ID NO: 994702 - RNA, 15 nt, Homo sapiens
gucuugugaaggcag

SEQ ID NO: 994703 - RNA, 14 nt, Homo sapiens
gucuuucucucuca

SEQ ID NO: 994704 - RNA, 19 nt, Homo sapiens
gucuuucugaauugcacau

SEQ ID NO: 994705 - RNA, 21 nt, Homo sapiens
gucuuucuuuuauacugacac

SEQ ID NO: 994706 - RNA, 17 nt, Homo sapiens
gugaaaguuaauccacu

SEQ ID NO: 994707 - RNA, 19 nt, Homo sapiens
gugaaaugcuggcauuugc

SEQ ID NO: 994708 - RNA, 16 nt, Homo sapiens
gcucccacaagccuga

SEQ ID NO: 994709 - RNA, 21 nt, Homo sapiens
gcucccacagucccaucugcu

SEQ ID NO: 994710 - RNA, 16 nt, Homo sapiens
gcuccccucacucugu

SEQ ID NO: 994711 - RNA, 15 nt, Homo sapiens
gcuccuccagggugu

SEQ ID NO: 994712 - RNA, 15 nt, Homo sapiens
gcuccugacacugcu

SEQ ID NO: 994713 - RNA, 16 nt, Homo sapiens
gcuccugacacugcug

SEQ ID NO: 994714 - RNA, 11 nt, Homo sapiens
gcuccugguca

SEQ ID NO: 994715 - RNA, 14 nt, Homo sapiens
gcuccuguucacac

SEQ ID NO: 994716 - RNA, 17 nt, Homo sapiens
gcucuauguuuguauau

SEQ ID NO: 994717 - RNA, 16 nt, Homo sapiens
gcucucccaacucuug

SEQ ID NO: 994718 - RNA, 16 nt, Homo sapiens
gcucucgcacaccucu

SEQ ID NO: 994719 - RNA, 21 nt, Homo sapiens
gcucugcaauuccccucugcu

SEQ ID NO: 994720 - RNA, 23 nt, Homo sapiens
gcucuggauaacaagacuuugac

SEQ ID NO: 994721 - RNA, 19 nt, Homo sapiens
gcucuguagugcuacaggg

SEQ ID NO: 994722 - RNA, 13 nt, Homo sapiens
gcucuuauuauau

SEQ ID NO: 994723 - RNA, 18 nt, Homo sapiens
gcucuugaggcauuucca

SEQ ID NO: 994724 - RNA, 20 nt, Homo sapiens
gcucuuggcuggacccagcc

SEQ ID NO: 994725 - RNA, 15 nt, Homo sapiens
gcucuuucucugcca

SEQ ID NO: 994726 - RNA, 16 nt, Homo sapiens
gcucuuucucugccag

SEQ ID NO: 994727 - RNA, 18 nt, Homo sapiens
gcucuuucucugccagug

SEQ ID NO: 994728 - RNA, 14 nt, Homo sapiens
gcugaccacagcac

SEQ ID NO: 994729 - RNA, 15 nt, Homo sapiens
gcugaccugcugacc

SEQ ID NO: 994730 - RNA, 14 nt, Homo sapiens
gcugacuguagcuu

SEQ ID NO: 994731 - RNA, 18 nt, Homo sapiens
gcugccagcucuguauca

SEQ ID NO: 994732 - RNA, 19 nt, Homo sapiens
gcugccucuaccugacacu

SEQ ID NO: 994733 - RNA, 20 nt, Homo sapiens
gcugcuagagugacucacua

SEQ ID NO: 994734 - RNA, 13 nt, Homo sapiens
gcugcucccucag

SEQ ID NO: 994735 - RNA, 19 nt, Homo sapiens
gcugcugcccauguuucaa

SEQ ID NO: 994736 - RNA, 12 nt, Homo sapiens
gcuggaauucua

SEQ ID NO: 994737 - RNA, 21 nt, Homo sapiens
gcuggagucaaaacacuugua

SEQ ID NO: 994738 - RNA, 20 nt, Homo sapiens
gcuggagugcaguggugcaa

SEQ ID NO: 994739 - RNA, 22 nt, Homo sapiens
gcuggagugcaguggugcaauc

SEQ ID NO: 994740 - RNA, 15 nt, Homo sapiens
gcuggcccagccaaa

SEQ ID NO: 994741 - RNA, 16 nt, Homo sapiens
gcugggccauguccaa

SEQ ID NO: 994742 - RNA, 17 nt, Homo sapiens
gcugggccauguccaaa

SEQ ID NO: 994743 - RNA, 13 nt, Homo sapiens
gcugguguuaaca

SEQ ID NO: 994744 - RNA, 14 nt, Homo sapiens
gcuguaacuacuuu

SEQ ID NO: 994745 - RNA, 21 nt, Homo sapiens
gcugucaucugugcacugccc

SEQ ID NO: 994746 - RNA, 17 nt, Homo sapiens
gcuguggaccauggagu

SEQ ID NO: 994747 - RNA, 15 nt, Homo sapiens
gcuguuucagcuuua

SEQ ID NO: 994748 - RNA, 18 nt, Homo sapiens
gcuuacaaauacuaaaaa

SEQ ID NO: 994749 - RNA, 13 nt, Homo sapiens
gcuuagauuucau

SEQ ID NO: 994750 - RNA, 12 nt, Homo sapiens
gcuuauauucau

SEQ ID NO: 994751 - RNA, 13 nt, Homo sapiens
gcuucacaguacc

SEQ ID NO: 994752 - RNA, 15 nt, Homo sapiens
gcuucccuaaucuau

SEQ ID NO: 994753 - RNA, 19 nt, Homo sapiens
gcuucccuaaucuaugguc

SEQ ID NO: 994754 - RNA, 13 nt, Homo sapiens
gcuuccuaucugu

SEQ ID NO: 994755 - RNA, 20 nt, Homo sapiens
gcuucugcuggggccuggga

SEQ ID NO: 994756 - RNA, 13 nt, Homo sapiens
gcuugagucacca

SEQ ID NO: 994757 - RNA, 21 nt, Homo sapiens
gcuugcuauucugucccuagg

SEQ ID NO: 994758 - RNA, 16 nt, Homo sapiens
gcuuggaguucucuau

SEQ ID NO: 994759 - RNA, 18 nt, Homo sapiens
gcuugggaagacuccuag

SEQ ID NO: 994760 - RNA, 21 nt, Homo sapiens
gcuugggggcuccacuggcuc

SEQ ID NO: 994761 - RNA, 16 nt, Homo sapiens
gcuuguugugcuuuua

SEQ ID NO: 994762 - RNA, 22 nt, Homo sapiens
gcuuucuuuaaaguucuucuaa

SEQ ID NO: 994763 - RNA, 16 nt, Homo sapiens
gcuuuggauuugacau

SEQ ID NO: 994764 - RNA, 15 nt, Homo sapiens
gcuuugucuacuuca

SEQ ID NO: 994765 - RNA, 20 nt, Homo sapiens
gcuuuucaugcaaacucuuu

SEQ ID NO: 994766 - RNA, 15 nt, Homo sapiens
ggaaaacaagcauuc

SEQ ID NO: 994767 - RNA, 17 nt, Homo sapiens
ggaaaaggccuggggug

SEQ ID NO: 994768 - RNA, 19 nt, Homo sapiens
ggaaacaaccaugucauuu

SEQ ID NO: 994769 - RNA, 17 nt, Homo sapiens
ggaaauuaagacuuuau

SEQ ID NO: 994770 - RNA, 13 nt, Homo sapiens
ggaacaccaggcu

SEQ ID NO: 994771 - RNA, 23 nt, Homo sapiens
ggaacacggccacaucaaagagg

SEQ ID NO: 994772 - RNA, 21 nt, Homo sapiens
ggaacacuagacaagccagaa

SEQ ID NO: 994773 - RNA, 16 nt, Homo sapiens
ggaacucagauccagg

SEQ ID NO: 994774 - RNA, 14 nt, Homo sapiens
ggaacugcugccac

SEQ ID NO: 994775 - RNA, 16 nt, Homo sapiens
ggaacuugccugccuu

SEQ ID NO: 994776 - RNA, 15 nt, Homo sapiens
ggaagauggggacca

SEQ ID NO: 994777 - RNA, 14 nt, Homo sapiens
ggaagccaaagagu

SEQ ID NO: 994778 - RNA, 14 nt, Homo sapiens
ggaaggagcugccu

SEQ ID NO: 994779 - RNA, 14 nt, Homo sapiens
ggaagggagguggc

SEQ ID NO: 994780 - RNA, 18 nt, Homo sapiens
ggaagugaaaacuuugua

SEQ ID NO: 994781 - RNA, 23 nt, Homo sapiens
ggaaucagugaagccaaagggac

SEQ ID NO: 994782 - RNA, 21 nt, Homo sapiens
ggaauggcugcaccuuuuugc

SEQ ID NO: 994783 - RNA, 18 nt, Homo sapiens
ggaauuucuuaacuucuu

SEQ ID NO: 994784 - RNA, 10 nt, Homo sapiens
ggacaaaaca

SEQ ID NO: 994785 - RNA, 20 nt, Homo sapiens
ggacaaaggagccugugaac

SEQ ID NO: 994786 - RNA, 22 nt, Homo sapiens
ggacaacugcucccaccuccug

SEQ ID NO: 994787 - RNA, 22 nt, Homo sapiens
ggacaaggagugugaccacuga

SEQ ID NO: 994788 - RNA, 16 nt, Homo sapiens
ggacacuaucacucau

SEQ ID NO: 994789 - RNA, 17 nt, Homo sapiens
ggacagaugaaugccgu

SEQ ID NO: 994790 - RNA, 20 nt, Homo sapiens
ggacagaugaaugccgugga

SEQ ID NO: 994791 - RNA, 17 nt, Homo sapiens
ggacaggauguguuugc

SEQ ID NO: 994792 - RNA, 17 nt, Homo sapiens
ggacaugaagauucuuu

SEQ ID NO: 994793 - RNA, 19 nt, Homo sapiens
ggacaugcuucagugcugc

SEQ ID NO: 994794 - RNA, 17 nt, Homo sapiens
ggaccaaugaggugagg

SEQ ID NO: 994795 - RNA, 23 nt, Homo sapiens
ggaccgcccccugucucucaggg

SEQ ID NO: 994796 - RNA, 18 nt, Homo sapiens
ggaccggagagugggggu

SEQ ID NO: 994797 - RNA, 19 nt, Homo sapiens
ggacuauauuugggccugc

SEQ ID NO: 994798 - RNA, 20 nt, Homo sapiens
ggacucgccuguaaucucac

SEQ ID NO: 994799 - RNA, 20 nt, Homo sapiens
ggacuggaaggggaagggac

SEQ ID NO: 994800 - RNA, 15 nt, Homo sapiens
ggacuugaacccagg

SEQ ID NO: 994801 - RNA, 17 nt, Homo sapiens
ggagaaacgggugagcu

SEQ ID NO: 994802 - RNA, 19 nt, Homo sapiens
ggagacacuggccccucaa

SEQ ID NO: 994803 - RNA, 18 nt, Homo sapiens
ggagaccucuacugccuu

SEQ ID NO: 994804 - RNA, 14 nt, Homo sapiens
ggagagacacuggu

SEQ ID NO: 994805 - RNA, 16 nt, Homo sapiens
ggagagggacuggcag

SEQ ID NO: 994806 - RNA, 15 nt, Homo sapiens
ggagcaaaccaaaga

SEQ ID NO: 994807 - RNA, 22 nt, Homo sapiens
ggagccccuucugcucagcucu

SEQ ID NO: 994808 - RNA, 23 nt, Homo sapiens
ggaggacccagggcucuguaagu

SEQ ID NO: 994809 - RNA, 12 nt, Homo sapiens
ggaggcaccugg

SEQ ID NO: 994810 - RNA, 21 nt, Homo sapiens
ggaggcugcucggggugcaca

SEQ ID NO: 994811 - RNA, 18 nt, Homo sapiens
uuuaucacacaaagcaga

SEQ ID NO: 994812 - RNA, 21 nt, Homo sapiens
uuuauugcaggauggugucuc

SEQ ID NO: 994813 - RNA, 20 nt, Homo sapiens
uuucacgccugaggcaauua

SEQ ID NO: 994814 - RNA, 23 nt, Homo sapiens
uuucagagugacuacacacagua

SEQ ID NO: 994815 - RNA, 21 nt, Homo sapiens
uuucaggaggaauacugaaca

SEQ ID NO: 994816 - RNA, 15 nt, Homo sapiens
uuucaucacacuggg

SEQ ID NO: 994817 - RNA, 21 nt, Homo sapiens
uuucaucacacuggguggugg

SEQ ID NO: 994818 - RNA, 19 nt, Homo sapiens
uuucauccugauacuguag

SEQ ID NO: 994819 - RNA, 19 nt, Homo sapiens
uuucauggucugcugagua

SEQ ID NO: 994820 - RNA, 13 nt, Homo sapiens
uuucauguaaucc

SEQ ID NO: 994821 - RNA, 19 nt, Homo sapiens
uuucauguuuuugaucaaa

SEQ ID NO: 994822 - RNA, 20 nt, Homo sapiens
uuucauuaaauaaauuugac

SEQ ID NO: 994823 - RNA, 20 nt, Homo sapiens
uuuccaaauauuuugcuuua

SEQ ID NO: 994824 - RNA, 23 nt, Homo sapiens
uuuccauuaaguacaugugccag

SEQ ID NO: 994825 - RNA, 22 nt, Homo sapiens
uuucccacgaggaaucuguggg

SEQ ID NO: 994826 - RNA, 22 nt, Homo sapiens
uuuccccaaguacaaccacacc

SEQ ID NO: 994827 - RNA, 21 nt, Homo sapiens
uuucccucugggauuugccca

SEQ ID NO: 994828 - RNA, 12 nt, Homo sapiens
uuuccuccugag

SEQ ID NO: 994829 - RNA, 13 nt, Homo sapiens
uuucgcucuuuga

SEQ ID NO: 994830 - RNA, 15 nt, Homo sapiens
auuuuugaaaacugg

SEQ ID NO: 994831 - RNA, 15 nt, Homo sapiens
auuuuugcuuagcuc

SEQ ID NO: 994832 - RNA, 18 nt, Homo sapiens
auuuuuuaauccuaccuc

SEQ ID NO: 994833 - RNA, 12 nt, Homo sapiens
caaaaacuuugg

SEQ ID NO: 994834 - RNA, 17 nt, Homo sapiens
caaaaauugucccuuaa

SEQ ID NO: 994835 - RNA, 22 nt, Homo sapiens
caaaaccagguccaaugagcuu

SEQ ID NO: 994836 - RNA, 14 nt, Homo sapiens
caaaaccgccagcu

SEQ ID NO: 994837 - RNA, 13 nt, Homo sapiens
caaaacugccuca

SEQ ID NO: 994838 - RNA, 19 nt, Homo sapiens
caaaagaagcccggcuccu

SEQ ID NO: 994839 - RNA, 15 nt, Homo sapiens
caaaagcgaaacaca

SEQ ID NO: 994840 - RNA, 15 nt, Homo sapiens
caaaagcuauuuaaa

SEQ ID NO: 994841 - RNA, 17 nt, Homo sapiens
caaaaguuuguuugcuu

SEQ ID NO: 994842 - RNA, 23 nt, Homo sapiens
caaaauagggacuaucuaucuua

SEQ ID NO: 994843 - RNA, 24 nt, Homo sapiens
caaaaucuaccaggucaaaauagu

SEQ ID NO: 994844 - RNA, 13 nt, Homo sapiens
caaaaugcuuuuu

SEQ ID NO: 994845 - RNA, 23 nt, Homo sapiens
caaacaccacuuuacuuguguua

SEQ ID NO: 994846 - RNA, 13 nt, Homo sapiens
caaacaccuucca

SEQ ID NO: 994847 - RNA, 22 nt, Homo sapiens
caaacagaccccuguucaugcc

SEQ ID NO: 994848 - RNA, 20 nt, Homo sapiens
caaacccuagccuugcuugu

SEQ ID NO: 994849 - RNA, 17 nt, Homo sapiens
caaacgcccuuuccucc

SEQ ID NO: 994850 - RNA, 15 nt, Homo sapiens
caaacuucaaagagg

SEQ ID NO: 994851 - RNA, 22 nt, Homo sapiens
caaacuuugcaucucaguauga

SEQ ID NO: 994852 - RNA, 13 nt, Homo sapiens
caaagaggcugcc

SEQ ID NO: 994853 - RNA, 22 nt, Homo sapiens
caaagcaacaguccacacuuug

SEQ ID NO: 994854 - RNA, 14 nt, Homo sapiens
caaagcagauucag

SEQ ID NO: 994855 - RNA, 14 nt, Homo sapiens
caaagcaucccucu

SEQ ID NO: 994856 - RNA, 22 nt, Homo sapiens
caaagcaucuugcauuaugcaa

SEQ ID NO: 994857 - RNA, 20 nt, Homo sapiens
caaagccaagggcaacagau

SEQ ID NO: 994858 - RNA, 17 nt, Homo sapiens
caaagugcugagauuac

SEQ ID NO: 994859 - RNA, 20 nt, Homo sapiens
caaagugguucccucucuua

SEQ ID NO: 994860 - RNA, 21 nt, Homo sapiens
caaauacuuagagcagugaag

SEQ ID NO: 994861 - RNA, 20 nt, Homo sapiens
caaaucagaccuggcugcuu

SEQ ID NO: 994862 - RNA, 20 nt, Homo sapiens
caaaucauccauccuugcca

SEQ ID NO: 994863 - RNA, 18 nt, Homo sapiens
caaaucuaccacuguaug

SEQ ID NO: 994864 - RNA, 16 nt, Homo sapiens
caaaucuugaaauuaa

SEQ ID NO: 994865 - RNA, 23 nt, Homo sapiens
caaaugaauggaggaacuuucca

SEQ ID NO: 994866 - RNA, 16 nt, Homo sapiens
caaaugagccaugaga

SEQ ID NO: 994867 - RNA, 13 nt, Homo sapiens
caaaugcaccaug

SEQ ID NO: 994868 - RNA, 20 nt, Homo sapiens
caaaugguaggcauuuccua

SEQ ID NO: 994869 - RNA, 11 nt, Homo sapiens
caaaugugcug

SEQ ID NO: 994870 - RNA, 23 nt, Homo sapiens
caaaugugcuggucacccuucaa

SEQ ID NO: 994871 - RNA, 15 nt, Homo sapiens
caaauuugcauuaaa

SEQ ID NO: 994872 - RNA, 15 nt, Homo sapiens
caacacccaacuguc

SEQ ID NO: 994873 - RNA, 13 nt, Homo sapiens
caacagacuugaa

SEQ ID NO: 994874 - RNA, 11 nt, Homo sapiens
caacagcauuu

SEQ ID NO: 994875 - RNA, 20 nt, Homo sapiens
caacagccugacaacauuuc

SEQ ID NO: 994876 - RNA, 16 nt, Homo sapiens
caacagcgcccaaagg

SEQ ID NO: 994877 - RNA, 21 nt, Homo sapiens
caacagcuggacccugaccag

SEQ ID NO: 994878 - RNA, 14 nt, Homo sapiens
caacauccaaaaua

SEQ ID NO: 994879 - RNA, 15 nt, Homo sapiens
caacauguuauuugu

SEQ ID NO: 994880 - RNA, 15 nt, Homo sapiens
caaccaaacaaagaa

SEQ ID NO: 994881 - RNA, 12 nt, Homo sapiens
caaccaagaaug

SEQ ID NO: 994882 - RNA, 17 nt, Homo sapiens
caaccaauggaauguga

SEQ ID NO: 994883 - RNA, 14 nt, Homo sapiens
caacccaaccucau

SEQ ID NO: 994884 - RNA, 18 nt, Homo sapiens
caacccccgacuucaucc

SEQ ID NO: 994885 - RNA, 20 nt, Homo sapiens
caaccccuccccuccauccc

SEQ ID NO: 994886 - RNA, 23 nt, Homo sapiens
caacccgagaaaacaaacccagg

SEQ ID NO: 994887 - RNA, 14 nt, Homo sapiens
caacccgagucauu

SEQ ID NO: 994888 - RNA, 21 nt, Homo sapiens
caacccgugccaaguccaggu

SEQ ID NO: 994889 - RNA, 20 nt, Homo sapiens
caaccucgcuggacucucag

SEQ ID NO: 994890 - RNA, 14 nt, Homo sapiens
caacgcucccagac

SEQ ID NO: 994891 - RNA, 19 nt, Homo sapiens
caacuacuguguuaugcaa

SEQ ID NO: 994892 - RNA, 21 nt, Homo sapiens
caacucuccccugaccuguga

SEQ ID NO: 994893 - RNA, 17 nt, Homo sapiens
caacugucuccuaccuc

SEQ ID NO: 994894 - RNA, 23 nt, Homo sapiens
caacuuguaacucuaugaacuua

SEQ ID NO: 994895 - RNA, 19 nt, Homo sapiens
caagaaaauaagagcucag

SEQ ID NO: 994896 - RNA, 23 nt, Homo sapiens
caagaaaucugugccugagaaca

SEQ ID NO: 994897 - RNA, 17 nt, Homo sapiens
caagacugacgccaggg

SEQ ID NO: 994898 - RNA, 23 nt, Homo sapiens
caagcaguuaguuccuucaugau

SEQ ID NO: 994899 - RNA, 18 nt, Homo sapiens
caagccugucuucagaga

SEQ ID NO: 994900 - RNA, 12 nt, Homo sapiens
caagcugcauuu

SEQ ID NO: 994901 - RNA, 23 nt, Homo sapiens
caaggaaguagaaacaaaauaca

SEQ ID NO: 994902 - RNA, 14 nt, Homo sapiens
caaggacuuugcag

SEQ ID NO: 994903 - RNA, 19 nt, Homo sapiens
caaggaugucugagaccac

SEQ ID NO: 994904 - RNA, 21 nt, Homo sapiens
caagggaauucggugugcacc

SEQ ID NO: 994905 - RNA, 15 nt, Homo sapiens
caagggacccaugag

SEQ ID NO: 994906 - RNA, 19 nt, Homo sapiens
caaggucuacucccuccuc

SEQ ID NO: 994907 - RNA, 20 nt, Homo sapiens
caaggucuacucccuccuca

SEQ ID NO: 994908 - RNA, 23 nt, Homo sapiens
caagguguccuacagaaaaaccu

SEQ ID NO: 994909 - RNA, 21 nt, Homo sapiens
caaguauacuagggagccauu

SEQ ID NO: 994910 - RNA, 17 nt, Homo sapiens
caagucuguuuacugca

SEQ ID NO: 994911 - RNA, 22 nt, Homo sapiens
caaguguaaaauauuuugaauc

SEQ ID NO: 994912 - RNA, 21 nt, Homo sapiens
caaguucaugcagcuguggca

SEQ ID NO: 994913 - RNA, 19 nt, Homo sapiens
caaguuggagucacucuua

SEQ ID NO: 994914 - RNA, 19 nt, Homo sapiens
caauaaagaccacuuuaca

SEQ ID NO: 994915 - RNA, 21 nt, Homo sapiens
caauaaaguuccccugugaca

SEQ ID NO: 994916 - RNA, 13 nt, Homo sapiens
cagaauaugucag

SEQ ID NO: 994917 - RNA, 14 nt, Homo sapiens
cagaauuaagugga

SEQ ID NO: 994918 - RNA, 16 nt, Homo sapiens
cagacacaacacaguu

SEQ ID NO: 994919 - RNA, 21 nt, Homo sapiens
cagacacuggcguuacugcuu

SEQ ID NO: 994920 - RNA, 13 nt, Homo sapiens
cagacaugccaca

SEQ ID NO: 994921 - RNA, 19 nt, Homo sapiens
cagaccacaugccccaucc

SEQ ID NO: 994922 - RNA, 16 nt, Homo sapiens
cagaccacggcucgau

SEQ ID NO: 994923 - RNA, 10 nt, Homo sapiens
cagaccucca

SEQ ID NO: 994924 - RNA, 15 nt, Homo sapiens
cagagaaaccagcuu

SEQ ID NO: 994925 - RNA, 23 nt, Homo sapiens
cagagaaaggggagcccacuguc

SEQ ID NO: 994926 - RNA, 13 nt, Homo sapiens
cagagacauacuu

SEQ ID NO: 994927 - RNA, 18 nt, Homo sapiens
cagagacccaagcugccu

SEQ ID NO: 994928 - RNA, 16 nt, Homo sapiens
cagagagcagugcuuu

SEQ ID NO: 994929 - RNA, 23 nt, Homo sapiens
cagagaugcaccaccaagccaag

SEQ ID NO: 994930 - RNA, 17 nt, Homo sapiens
cagagcacauuugucag

SEQ ID NO: 994931 - RNA, 17 nt, Homo sapiens
cagagcaggaaugggaa

SEQ ID NO: 994932 - RNA, 23 nt, Homo sapiens
cagagccaugucuucucccugga

SEQ ID NO: 994933 - RNA, 15 nt, Homo sapiens
cagagcuucccugac

SEQ ID NO: 994934 - RNA, 16 nt, Homo sapiens
cagaggaaauucuuuc

SEQ ID NO: 994935 - RNA, 19 nt, Homo sapiens
cagaggagccaccaguucu

SEQ ID NO: 994936 - RNA, 20 nt, Homo sapiens
cagaggauaucggcauuugu

SEQ ID NO: 994937 - RNA, 22 nt, Homo sapiens
cagagugagacccagcccucau

SEQ ID NO: 994938 - RNA, 19 nt, Homo sapiens
cagaucgggagcaaaccaa

SEQ ID NO: 994939 - RNA, 18 nt, Homo sapiens
cagauucucccuugcucu

SEQ ID NO: 994940 - RNA, 18 nt, Homo sapiens
cagauuuuuuccucugca

SEQ ID NO: 994941 - RNA, 16 nt, Homo sapiens
cagcaaagcccccaga

SEQ ID NO: 994942 - RNA, 13 nt, Homo sapiens
cagcaagcaauaa

SEQ ID NO: 994943 - RNA, 17 nt, Homo sapiens
cagcaaggaaagcucac

SEQ ID NO: 994944 - RNA, 12 nt, Homo sapiens
cagcacagccaa

SEQ ID NO: 994945 - RNA, 21 nt, Homo sapiens
cagcacugccugcucccaucc

SEQ ID NO: 994946 - RNA, 12 nt, Homo sapiens
cagcacuuccau

SEQ ID NO: 994947 - RNA, 16 nt, Homo sapiens
cagcagcccccagcuc

SEQ ID NO: 994948 - RNA, 15 nt, Homo sapiens
cagcaggugcucaau

SEQ ID NO: 994949 - RNA, 15 nt, Homo sapiens
cagcagugccuugug

SEQ ID NO: 994950 - RNA, 20 nt, Homo sapiens
cagcagugccuugugcaaug

SEQ ID NO: 994951 - RNA, 14 nt, Homo sapiens
cagcaucggaaaga

SEQ ID NO: 994952 - RNA, 18 nt, Homo sapiens
cagcauguacggauuuuc

SEQ ID NO: 994953 - RNA, 14 nt, Homo sapiens
cagcauugccuagg

SEQ ID NO: 994954 - RNA, 17 nt, Homo sapiens
cagccaaaaaggacuuu

SEQ ID NO: 994955 - RNA, 15 nt, Homo sapiens
cagccaagcucugca

SEQ ID NO: 994956 - RNA, 14 nt, Homo sapiens
cagccacacuucuc

SEQ ID NO: 994957 - RNA, 16 nt, Homo sapiens
cagccaccccugagau

SEQ ID NO: 994958 - RNA, 22 nt, Homo sapiens
cagccaccguuucuuccugcca

SEQ ID NO: 994959 - RNA, 22 nt, Homo sapiens
cagccagaucgggagcaaacca

SEQ ID NO: 994960 - RNA, 23 nt, Homo sapiens
cagccaucccgucuucuccaaca

SEQ ID NO: 994961 - RNA, 13 nt, Homo sapiens
cagccccuguaga

SEQ ID NO: 994962 - RNA, 14 nt, Homo sapiens
cagccccuguagaa

SEQ ID NO: 994963 - RNA, 12 nt, Homo sapiens
cagcccgucucc

SEQ ID NO: 994964 - RNA, 15 nt, Homo sapiens
cagcccugcaccaug

SEQ ID NO: 994965 - RNA, 16 nt, Homo sapiens
cagcccugcaccaugc

SEQ ID NO: 994966 - RNA, 18 nt, Homo sapiens
cagccucccauccagggc

SEQ ID NO: 994967 - RNA, 17 nt, Homo sapiens
cagccugucagauccag

SEQ ID NO: 994968 - RNA, 16 nt, Homo sapiens
cagccuugccagagau

SEQ ID NO: 994969 - RNA, 18 nt, Homo sapiens
cagcggcccugucaucca

SEQ ID NO: 994970 - RNA, 13 nt, Homo sapiens
cagcuaaagcaau

SEQ ID NO: 994971 - RNA, 17 nt, Homo sapiens
cagcucacucaucaaug

SEQ ID NO: 994972 - RNA, 14 nt, Homo sapiens
cagcuccuguaaca

SEQ ID NO: 994973 - RNA, 14 nt, Homo sapiens
cagcucugggccau

SEQ ID NO: 994974 - RNA, 18 nt, Homo sapiens
cagcucuguaucugccau

SEQ ID NO: 994975 - RNA, 13 nt, Homo sapiens
cagcugacuaaac

SEQ ID NO: 994976 - RNA, 18 nt, Homo sapiens
cagcuguccccccacucc

SEQ ID NO: 994977 - RNA, 22 nt, Homo sapiens
cagcugugguuuucuuuugcca

SEQ ID NO: 994978 - RNA, 23 nt, Homo sapiens
cagcugugugggucauaccgugu

SEQ ID NO: 994979 - RNA, 15 nt, Homo sapiens
cagcuuagauuucau

SEQ ID NO: 994980 - RNA, 13 nt, Homo sapiens
cagcuuauauuca

SEQ ID NO: 994981 - RNA, 16 nt, Homo sapiens
cagcuuuugcaacuua

SEQ ID NO: 994982 - RNA, 20 nt, Homo sapiens
caggaacagcaaaugcaaaa

SEQ ID NO: 994983 - RNA, 19 nt, Homo sapiens
caggaacccaccaaaccaa

SEQ ID NO: 994984 - RNA, 21 nt, Homo sapiens
caggaagggggccgacuccac

SEQ ID NO: 994985 - RNA, 18 nt, Homo sapiens
caggaauccccaacaugc

SEQ ID NO: 994986 - RNA, 19 nt, Homo sapiens
caggaauccccaacaugca

SEQ ID NO: 994987 - RNA, 20 nt, Homo sapiens
caggacacaggccuguguag

SEQ ID NO: 994988 - RNA, 20 nt, Homo sapiens
caggaccacaggcucaggca

SEQ ID NO: 994989 - RNA, 17 nt, Homo sapiens
caggaccagcucaggac

SEQ ID NO: 994990 - RNA, 19 nt, Homo sapiens
caggacuauauuugggccu

SEQ ID NO: 994991 - RNA, 17 nt, Homo sapiens
caggacuugaacccagg

SEQ ID NO: 994992 - RNA, 18 nt, Homo sapiens
caggagcuccaguguccu

SEQ ID NO: 994993 - RNA, 14 nt, Homo sapiens
caggaggccuagga

SEQ ID NO: 994994 - RNA, 23 nt, Homo sapiens
caggagggcagaccacauugcuu

SEQ ID NO: 994995 - RNA, 19 nt, Homo sapiens
caggaguagcugagcucac

SEQ ID NO: 994996 - RNA, 17 nt, Homo sapiens
caggcaaggaugucuga

SEQ ID NO: 994997 - RNA, 12 nt, Homo sapiens
caggcaccucac

SEQ ID NO: 994998 - RNA, 14 nt, Homo sapiens
caggcacgucugca

SEQ ID NO: 994999 - RNA, 15 nt, Homo sapiens
caggcacugggcaug

SEQ ID NO: 995000 - RNA, 15 nt, Homo sapiens
caggcagauccagga

SEQ ID NO: 995001 - RNA, 18 nt, Homo sapiens
ccugacucuugcaggggu

SEQ ID NO: 995002 - RNA, 23 nt, Homo sapiens
ccugagagauuuaacauuaucua

SEQ ID NO: 995003 - RNA, 21 nt, Homo sapiens
ccugagauccggcaacaucaa

SEQ ID NO: 995004 - RNA, 20 nt, Homo sapiens
ccugagccaaggccuagugg

SEQ ID NO: 995005 - RNA, 18 nt, Homo sapiens
ccugaggacugauuucag

SEQ ID NO: 995006 - RNA, 15 nt, Homo sapiens
ccugagguuugccag

SEQ ID NO: 995007 - RNA, 19 nt, Homo sapiens
ccugauuuaggagaagcca

SEQ ID NO: 995008 - RNA, 15 nt, Homo sapiens
ccugcaagucagucc

SEQ ID NO: 995009 - RNA, 13 nt, Homo sapiens
ccugcacagugac

SEQ ID NO: 995010 - RNA, 16 nt, Homo sapiens
ccugcaccaugcugcu

SEQ ID NO: 995011 - RNA, 23 nt, Homo sapiens
ccugccuugaaaaagacauucag

SEQ ID NO: 995012 - RNA, 22 nt, Homo sapiens
ccugccuuuccauccauggcca

SEQ ID NO: 995013 - RNA, 14 nt, Homo sapiens
ccugcucuccgcac

SEQ ID NO: 995014 - RNA, 13 nt, Homo sapiens
ccugcugagcucu

SEQ ID NO: 995015 - RNA, 18 nt, Homo sapiens
ccugcuuccugcuugcca

SEQ ID NO: 995016 - RNA, 16 nt, Homo sapiens
ccuggacagcugugcc

SEQ ID NO: 995017 - RNA, 14 nt, Homo sapiens
ccuggagauccucc

SEQ ID NO: 995018 - RNA, 16 nt, Homo sapiens
ccuggaugacauuaaa

SEQ ID NO: 995019 - RNA, 20 nt, Homo sapiens
ccuggcccccggguguaaau

SEQ ID NO: 995020 - RNA, 22 nt, Homo sapiens
ccuggcccccggguguaaauag

SEQ ID NO: 995021 - RNA, 16 nt, Homo sapiens
ccuggcuggcugaggg

SEQ ID NO: 995022 - RNA, 14 nt, Homo sapiens
ccugggccuaugga

SEQ ID NO: 995023 - RNA, 16 nt, Homo sapiens
ccugggggugccagga

SEQ ID NO: 995024 - RNA, 13 nt, Homo sapiens
ccuggggugaccc

SEQ ID NO: 995025 - RNA, 21 nt, Homo sapiens
ccuggugagauuauacaggag

SEQ ID NO: 995026 - RNA, 19 nt, Homo sapiens
cuaaaauuagaugaacuca

SEQ ID NO: 995027 - RNA, 16 nt, Homo sapiens
cuaaacccaauccaaa

SEQ ID NO: 995028 - RNA, 17 nt, Homo sapiens
cuaaaggaugaacaugu

SEQ ID NO: 995029 - RNA, 14 nt, Homo sapiens
cuaaaguacuggga

SEQ ID NO: 995030 - RNA, 15 nt, Homo sapiens
cuaaaguacugggau

SEQ ID NO: 995031 - RNA, 14 nt, Homo sapiens
cuaaaguucuaaga

SEQ ID NO: 995032 - RNA, 22 nt, Homo sapiens
cuaaauauggacugcucaggaa

SEQ ID NO: 995033 - RNA, 23 nt, Homo sapiens
cuaaauuuuccuguccucuuuca

SEQ ID NO: 995034 - RNA, 15 nt, Homo sapiens
cuaacaacauuguag

SEQ ID NO: 995035 - RNA, 22 nt, Homo sapiens
cuaacagcccuccucugcacuc

SEQ ID NO: 995036 - RNA, 16 nt, Homo sapiens
cuaacaucuaaaaaua

SEQ ID NO: 995037 - RNA, 22 nt, Homo sapiens
cuaaccacuggucaugccccca

SEQ ID NO: 995038 - RNA, 20 nt, Homo sapiens
cuaagaaacauuuauauuga

SEQ ID NO: 995039 - RNA, 20 nt, Homo sapiens
cuaagcaacuaggccuucag

SEQ ID NO: 995040 - RNA, 12 nt, Homo sapiens
cuaagcaccugu

SEQ ID NO: 995041 - RNA, 17 nt, Homo sapiens
cuaagcagaccacugau

SEQ ID NO: 995042 - RNA, 20 nt, Homo sapiens
cuaagcugaguuaggugucu

SEQ ID NO: 995043 - RNA, 21 nt, Homo sapiens
cuaaggagcugauacuuugac

SEQ ID NO: 995044 - RNA, 17 nt, Homo sapiens
cuaagggccacauccca

SEQ ID NO: 995045 - RNA, 18 nt, Homo sapiens
cuaagggccacaucccac

SEQ ID NO: 995046 - RNA, 16 nt, Homo sapiens
cuaagggguacuccuc

SEQ ID NO: 995047 - RNA, 22 nt, Homo sapiens
cuaagggucgaaagcucuagaa

SEQ ID NO: 995048 - RNA, 13 nt, Homo sapiens
cuaaguauauuaa

SEQ ID NO: 995049 - RNA, 19 nt, Homo sapiens
cuaaguuucuaagauucua

SEQ ID NO: 995050 - RNA, 22 nt, Homo sapiens
cuaauagaauaaaggcaguuuu

SEQ ID NO: 995051 - RNA, 14 nt, Homo sapiens
cuaauagagauuaa

SEQ ID NO: 995052 - RNA, 22 nt, Homo sapiens
cuaauguugacuuuaauacucu

SEQ ID NO: 995053 - RNA, 17 nt, Homo sapiens
cuaauucacagugcucu

SEQ ID NO: 995054 - RNA, 17 nt, Homo sapiens
cuaauucggauuugcca

SEQ ID NO: 995055 - RNA, 18 nt, Homo sapiens
cuaauuuauaacuauuau

SEQ ID NO: 995056 - RNA, 21 nt, Homo sapiens
cuaauuugcauuaaauucaca

SEQ ID NO: 995057 - RNA, 20 nt, Homo sapiens
cuacaaaauuucaccugcaa

SEQ ID NO: 995058 - RNA, 14 nt, Homo sapiens
cuacacacaaacca

SEQ ID NO: 995059 - RNA, 22 nt, Homo sapiens
cuacagagcuucccugacucau

SEQ ID NO: 995060 - RNA, 17 nt, Homo sapiens
cuaccaccagcuguguc

SEQ ID NO: 995061 - RNA, 19 nt, Homo sapiens
cuacccgugucuagaggca

SEQ ID NO: 995062 - RNA, 23 nt, Homo sapiens
cuacccugcuggggaaaguacaa

SEQ ID NO: 995063 - RNA, 22 nt, Homo sapiens
cuaccuguaggaucagggucua

SEQ ID NO: 995064 - RNA, 20 nt, Homo sapiens
cuaccuuagaaaacaaguau

SEQ ID NO: 995065 - RNA, 20 nt, Homo sapiens
cuacuacaaacuucaaagag

SEQ ID NO: 995066 - RNA, 22 nt, Homo sapiens
cuacuagagucugaacagcugu

SEQ ID NO: 995067 - RNA, 21 nt, Homo sapiens
cuacucacacaggcauuuccu

SEQ ID NO: 995068 - RNA, 19 nt, Homo sapiens
cuacugaguagggggagca

SEQ ID NO: 995069 - RNA, 18 nt, Homo sapiens
cuacugcucuguguuuac

SEQ ID NO: 995070 - RNA, 19 nt, Homo sapiens
cuacuuauauaauugccaa

SEQ ID NO: 995071 - RNA, 16 nt, Homo sapiens
cuagaaaaacaggcac

SEQ ID NO: 995072 - RNA, 21 nt, Homo sapiens
cuagaaaauuagacugugauu

SEQ ID NO: 995073 - RNA, 18 nt, Homo sapiens
cuagaaacaacacuguag

SEQ ID NO: 995074 - RNA, 14 nt, Homo sapiens
cuagagcacugcca

SEQ ID NO: 995075 - RNA, 15 nt, Homo sapiens
cuagauucaaagguu

SEQ ID NO: 995076 - RNA, 12 nt, Homo sapiens
cuagcauuguaa

SEQ ID NO: 995077 - RNA, 13 nt, Homo sapiens
cuagccucagggg

SEQ ID NO: 995078 - RNA, 21 nt, Homo sapiens
cuaggaaaaucacuugccaaa

SEQ ID NO: 995079 - RNA, 17 nt, Homo sapiens
cuaggaucagaauauca

SEQ ID NO: 995080 - RNA, 16 nt, Homo sapiens
cuagggccaagcccag

SEQ ID NO: 995081 - RNA, 15 nt, Homo sapiens
cuagguaggggccca

SEQ ID NO: 995082 - RNA, 14 nt, Homo sapiens
cuagucaaugacau

SEQ ID NO: 995083 - RNA, 20 nt, Homo sapiens
cuagucaaugacaugaauuu

SEQ ID NO: 995084 - RNA, 19 nt, Homo sapiens
cuaguuuuuauacaugugu

SEQ ID NO: 995085 - RNA, 14 nt, Homo sapiens
cuauaauuuugccu

SEQ ID NO: 995086 - RNA, 17 nt, Homo sapiens
cuaucccuaggcacuua

SEQ ID NO: 995087 - RNA, 15 nt, Homo sapiens
cuauccuauguuaaa

SEQ ID NO: 995088 - RNA, 20 nt, Homo sapiens
cuaucucuacugaaugucau

SEQ ID NO: 995089 - RNA, 23 nt, Homo sapiens
cuaugaucugagucagagccaug

SEQ ID NO: 995090 - RNA, 23 nt, Homo sapiens
cuaugcaauuuuucaagagcucc

SEQ ID NO: 995091 - RNA, 11 nt, Homo sapiens
cuaugccuuua

SEQ ID NO: 995092 - RNA, 20 nt, Homo sapiens
cuauggagagcccugggacc

SEQ ID NO: 995093 - RNA, 14 nt, Homo sapiens
cuauggugcucugu

SEQ ID NO: 995094 - RNA, 18 nt, Homo sapiens
cuauguuuggcugcuaga

SEQ ID NO: 995095 - RNA, 15 nt, Homo sapiens
cuauuaaccuagaga

SEQ ID NO: 995096 - RNA, 21 nt, Homo sapiens
cuauuaucccagcugccuaga

SEQ ID NO: 995097 - RNA, 21 nt, Homo sapiens
cuauuguuacauuauguggaa

SEQ ID NO: 995098 - RNA, 13 nt, Homo sapiens
cuauuuaaagcau

SEQ ID NO: 995099 - RNA, 19 nt, Homo sapiens
cuauuuauauguacaugag

SEQ ID NO: 995100 - RNA, 18 nt, Homo sapiens
cuauuucuucuacugcua

SEQ ID NO: 995101 - RNA, 17 nt, Homo sapiens
cuauuuugugaagccau

SEQ ID NO: 995102 - RNA, 22 nt, Homo sapiens
cucaaaacagagggcugcauuc

SEQ ID NO: 995103 - RNA, 20 nt, Homo sapiens
cucaaaauagggacuaucua

SEQ ID NO: 995104 - RNA, 17 nt, Homo sapiens
cucaacacccaacuguc

SEQ ID NO: 995105 - RNA, 19 nt, Homo sapiens
cucaaucgagugagacaga

SEQ ID NO: 995106 - RNA, 20 nt, Homo sapiens
cucaauugaaagugggcaaa

SEQ ID NO: 995107 - RNA, 15 nt, Homo sapiens
cucacaagcaugaag

SEQ ID NO: 995108 - RNA, 20 nt, Homo sapiens
cucacaaguggguaccccca

SEQ ID NO: 995109 - RNA, 23 nt, Homo sapiens
cucacaaugucccuucagcaccu

SEQ ID NO: 995110 - RNA, 18 nt, Homo sapiens
cucacaggccccaggaaa

SEQ ID NO: 995111 - RNA, 14 nt, Homo sapiens
cucaccagccucac

SEQ ID NO: 995112 - RNA, 19 nt, Homo sapiens
cucacccaccccugcacag

SEQ ID NO: 995113 - RNA, 20 nt, Homo sapiens
cucacccagucuucuacaca

SEQ ID NO: 995114 - RNA, 14 nt, Homo sapiens
cucacuaauucauu

SEQ ID NO: 995115 - RNA, 15 nt, Homo sapiens
cucacucuguuuccu

SEQ ID NO: 995116 - RNA, 13 nt, Homo sapiens
cucacuucaggua

SEQ ID NO: 995117 - RNA, 15 nt, Homo sapiens
cucagagacaucagc

SEQ ID NO: 995118 - RNA, 18 nt, Homo sapiens
cucagaucaguguaccau

SEQ ID NO: 995119 - RNA, 16 nt, Homo sapiens
cucagauggcagcuuu

SEQ ID NO: 995120 - RNA, 19 nt, Homo sapiens
cucaggagccugugacaua

SEQ ID NO: 995121 - RNA, 15 nt, Homo sapiens
cucaggaugagggaa

SEQ ID NO: 995122 - RNA, 14 nt, Homo sapiens
cucaggcacacagc

SEQ ID NO: 995123 - RNA, 19 nt, Homo sapiens
cucaggcacacagcuacuc

SEQ ID NO: 995124 - RNA, 16 nt, Homo sapiens
cucagguguugccaaa

SEQ ID NO: 995125 - RNA, 13 nt, Homo sapiens
cucaguaccccau

SEQ ID NO: 995126 - RNA, 20 nt, Homo sapiens
cucagugggggcagagccac

SEQ ID NO: 995127 - RNA, 23 nt, Homo sapiens
cucaguguugucaccagaucuga

SEQ ID NO: 995128 - RNA, 13 nt, Homo sapiens
gauuuuacaugaa

SEQ ID NO: 995129 - RNA, 21 nt, Homo sapiens
gcaaaacucuacuuaauccaa

SEQ ID NO: 995130 - RNA, 19 nt, Homo sapiens
gcaaaauacaugacauuua

SEQ ID NO: 995131 - RNA, 12 nt, Homo sapiens
gcaaaauugcaa

SEQ ID NO: 995132 - RNA, 18 nt, Homo sapiens
gcaaacugggaaccccuu

SEQ ID NO: 995133 - RNA, 23 nt, Homo sapiens
gcaaagaugaacccgaggcugag

SEQ ID NO: 995134 - RNA, 16 nt, Homo sapiens
gcaaaucgugccuugu

SEQ ID NO: 995135 - RNA, 15 nt, Homo sapiens
gcaaauguacuucuc

SEQ ID NO: 995136 - RNA, 18 nt, Homo sapiens
gcaacuaggccuucagua

SEQ ID NO: 995137 - RNA, 15 nt, Homo sapiens
gcaagugaaagcaag

SEQ ID NO: 995138 - RNA, 21 nt, Homo sapiens
gcaaguucccaguuggagcuc

SEQ ID NO: 995139 - RNA, 20 nt, Homo sapiens
gcaaguugaggacuucuugc

SEQ ID NO: 995140 - RNA, 22 nt, Homo sapiens
gcaauaacguuuaagccaaaac

SEQ ID NO: 995141 - RNA, 13 nt, Homo sapiens
gcaauagaacccu

SEQ ID NO: 995142 - RNA, 19 nt, Homo sapiens
gcaauucagcaaagaacaa

SEQ ID NO: 995143 - RNA, 21 nt, Homo sapiens
gcaauuuuucaagagcuccuu

SEQ ID NO: 995144 - RNA, 18 nt, Homo sapiens
gcacaaggccaucugggc

SEQ ID NO: 995145 - RNA, 14 nt, Homo sapiens
gcacagauggccag

SEQ ID NO: 995146 - RNA, 15 nt, Homo sapiens
gcacagauggccagc

SEQ ID NO: 995147 - RNA, 15 nt, Homo sapiens
gcacagcuaauucua

SEQ ID NO: 995148 - RNA, 22 nt, Homo sapiens
gcacaggaguguccucuucccu

SEQ ID NO: 995149 - RNA, 15 nt, Homo sapiens
gcacagucacugcuc

SEQ ID NO: 995150 - RNA, 22 nt, Homo sapiens
gcacaucugcauuuucacccca

SEQ ID NO: 995151 - RNA, 22 nt, Homo sapiens
gcacauuugucaguauuuuugc

SEQ ID NO: 995152 - RNA, 15 nt, Homo sapiens
gcaccaaaucaaaau

SEQ ID NO: 995153 - RNA, 19 nt, Homo sapiens
gcaccaaaucaaaaucucu

SEQ ID NO: 995154 - RNA, 13 nt, Homo sapiens
gcacccuacaggg

SEQ ID NO: 995155 - RNA, 15 nt, Homo sapiens
gcaccguccaaccug

SEQ ID NO: 995156 - RNA, 15 nt, Homo sapiens
gcaccuaauccaggc

SEQ ID NO: 995157 - RNA, 16 nt, Homo sapiens
gcaccugcccuaccug

SEQ ID NO: 995158 - RNA, 15 nt, Homo sapiens
gcaccuggugaucac

SEQ ID NO: 995159 - RNA, 14 nt, Homo sapiens
gcaccuuugcacgu

SEQ ID NO: 995160 - RNA, 13 nt, Homo sapiens
gcaccuuuuugca

SEQ ID NO: 995161 - RNA, 18 nt, Homo sapiens
gcacguaaaguacuugua

SEQ ID NO: 995162 - RNA, 14 nt, Homo sapiens
gcacugagaccucc

SEQ ID NO: 995163 - RNA, 16 nt, Homo sapiens
gcacuuggcagccuug

SEQ ID NO: 995164 - RNA, 13 nt, Homo sapiens
gcacuuucuuccg

SEQ ID NO: 995165 - RNA, 15 nt, Homo sapiens
gcacuuuggcuuaua

SEQ ID NO: 995166 - RNA, 14 nt, Homo sapiens
gcagaagaaggcau

SEQ ID NO: 995167 - RNA, 21 nt, Homo sapiens
gcagacagcuccacccuggcc

SEQ ID NO: 995168 - RNA, 23 nt, Homo sapiens
gcagaugaccucguacucaggag

SEQ ID NO: 995169 - RNA, 21 nt, Homo sapiens
gcagcagcaaggaaagcucac

SEQ ID NO: 995170 - RNA, 17 nt, Homo sapiens
gcagccagcaucugggc

SEQ ID NO: 995171 - RNA, 21 nt, Homo sapiens
gcagccccacaccagggccag

SEQ ID NO: 995172 - RNA, 18 nt, Homo sapiens
gcagcccccagcucccac

SEQ ID NO: 995173 - RNA, 13 nt, Homo sapiens
gcagcuuguagcc

SEQ ID NO: 995174 - RNA, 18 nt, Homo sapiens
gcaggagaaucacuugaa

SEQ ID NO: 995175 - RNA, 20 nt, Homo sapiens
gcaggaguagcugagcucac

SEQ ID NO: 995176 - RNA, 20 nt, Homo sapiens
gcaggcccguggcaggagga

SEQ ID NO: 995177 - RNA, 18 nt, Homo sapiens
gcaggucugaagcucaac

SEQ ID NO: 995178 - RNA, 16 nt, Homo sapiens
gcagguucccaagcuc

SEQ ID NO: 995179 - RNA, 19 nt, Homo sapiens
gcaguaucaugcccugugc

SEQ ID NO: 995180 - RNA, 13 nt, Homo sapiens
gcagucacuugau

SEQ ID NO: 995181 - RNA, 13 nt, Homo sapiens
gcagucagggaca

SEQ ID NO: 995182 - RNA, 19 nt, Homo sapiens
gcaguccugccucagccuc

SEQ ID NO: 995183 - RNA, 13 nt, Homo sapiens
gcaguccuggguc

SEQ ID NO: 995184 - RNA, 21 nt, Homo sapiens
gcagugccuugugcaauguga

SEQ ID NO: 995185 - RNA, 16 nt, Homo sapiens
gcaguugagacaagaa

SEQ ID NO: 995186 - RNA, 21 nt, Homo sapiens
gcauaauguuucuggauuuca

SEQ ID NO: 995187 - RNA, 23 nt, Homo sapiens
gcauacgguaugauauugcagcu

SEQ ID NO: 995188 - RNA, 20 nt, Homo sapiens
gcauacuuucccucauccau

SEQ ID NO: 995189 - RNA, 15 nt, Homo sapiens
gcauauguugaauac

SEQ ID NO: 995190 - RNA, 19 nt, Homo sapiens
gcaucaucaaaaacuuugg

SEQ ID NO: 995191 - RNA, 22 nt, Homo sapiens
gcaucaugccucugaggccagc

SEQ ID NO: 995192 - RNA, 22 nt, Homo sapiens
gcaucccaaaccacgccucuug

SEQ ID NO: 995193 - RNA, 23 nt, Homo sapiens
gcauccuccagccccuguagaac

SEQ ID NO: 995194 - RNA, 15 nt, Homo sapiens
gcaucugacaugcau

SEQ ID NO: 995195 - RNA, 17 nt, Homo sapiens
gcauggaacagcauuac

SEQ ID NO: 995196 - RNA, 22 nt, Homo sapiens
gcauguaccccagguacaucca

SEQ ID NO: 995197 - RNA, 21 nt, Homo sapiens
gcauguugucuaagaaauuga

SEQ ID NO: 995198 - RNA, 18 nt, Homo sapiens
gcauuguaaaagcauuuu

SEQ ID NO: 995199 - RNA, 15 nt, Homo sapiens
gcauuuccagacuug

SEQ ID NO: 995200 - RNA, 13 nt, Homo sapiens
gccaaaaagugaa

SEQ ID NO: 995201 - RNA, 19 nt, Homo sapiens
gccaagaaacgucuucuaa

SEQ ID NO: 995202 - RNA, 22 nt, Homo sapiens
gccacacucagcacaaggccau

SEQ ID NO: 995203 - RNA, 13 nt, Homo sapiens
gccaccaguucuc

SEQ ID NO: 995204 - RNA, 17 nt, Homo sapiens
gccaccaucauagcuca

SEQ ID NO: 995205 - RNA, 13 nt, Homo sapiens
gccagaaauaucu

SEQ ID NO: 995206 - RNA, 17 nt, Homo sapiens
gccagagauccaaaaga

SEQ ID NO: 995207 - RNA, 13 nt, Homo sapiens
gccagcagcaccu

SEQ ID NO: 995208 - RNA, 17 nt, Homo sapiens
gccagcagcaccugccc

SEQ ID NO: 995209 - RNA, 23 nt, Homo sapiens
gccagcccugccuggaggaccug

SEQ ID NO: 995210 - RNA, 21 nt, Homo sapiens
gccagccuccggcggggaccc

SEQ ID NO: 995211 - RNA, 21 nt, Homo sapiens
gccagccuggagaaggugaca

SEQ ID NO: 995212 - RNA, 15 nt, Homo sapiens
gccagcuuauaguca

SEQ ID NO: 995213 - RNA, 16 nt, Homo sapiens
gccaggagaagcucag

SEQ ID NO: 995214 - RNA, 20 nt, Homo sapiens
gccaggcccagccgaccccc

SEQ ID NO: 995215 - RNA, 21 nt, Homo sapiens
gccaggccgggaaaaagccca

SEQ ID NO: 995216 - RNA, 18 nt, Homo sapiens
gccagggcaaugaugaau

SEQ ID NO: 995217 - RNA, 20 nt, Homo sapiens
gccagucaggcccaggcacu

SEQ ID NO: 995218 - RNA, 19 nt, Homo sapiens
gccauagucuuaacugguc

SEQ ID NO: 995219 - RNA, 20 nt, Homo sapiens
gccauaguggaucacucacc

SEQ ID NO: 995220 - RNA, 22 nt, Homo sapiens
gccauaugaaugucaguaguuu

SEQ ID NO: 995221 - RNA, 16 nt, Homo sapiens
gccaucccgucuucuc

SEQ ID NO: 995222 - RNA, 16 nt, Homo sapiens
gccaugagaugauaca

SEQ ID NO: 995223 - RNA, 22 nt, Homo sapiens
gccaugagaugauacauccaaa

SEQ ID NO: 995224 - RNA, 22 nt, Homo sapiens
gccaugaguuccagaaaguaaa

SEQ ID NO: 995225 - RNA, 13 nt, Homo sapiens
gccauguccaaag

SEQ ID NO: 995226 - RNA, 17 nt, Homo sapiens
gccauuaaagaauauga

SEQ ID NO: 995227 - RNA, 16 nt, Homo sapiens
gcccaaggcacugaga

SEQ ID NO: 995228 - RNA, 14 nt, Homo sapiens
gcccacagugucag

SEQ ID NO: 995229 - RNA, 16 nt, Homo sapiens
gcccagagacccagcg

SEQ ID NO: 995230 - RNA, 22 nt, Homo sapiens
gcccagagggucugggggcaca

SEQ ID NO: 995231 - RNA, 23 nt, Homo sapiens
gcccagcuccaaggggaaucaga

SEQ ID NO: 995232 - RNA, 21 nt, Homo sapiens
gcccaggaucguuuuuuccca

SEQ ID NO: 995233 - RNA, 14 nt, Homo sapiens
gcccaggcacuggg

SEQ ID NO: 995234 - RNA, 20 nt, Homo sapiens
gcccaggcccggaugcagag

SEQ ID NO: 995235 - RNA, 20 nt, Homo sapiens
gcccaggcuggaguggagug

SEQ ID NO: 995236 - RNA, 20 nt, Homo sapiens
gcccaggcugggaacucauc

SEQ ID NO: 995237 - RNA, 19 nt, Homo sapiens
gcccaggucagccacuguu

SEQ ID NO: 995238 - RNA, 16 nt, Homo sapiens
gcccaguguccccuuu

SEQ ID NO: 995239 - RNA, 19 nt, Homo sapiens
gcccauaugcuaccaccag

SEQ ID NO: 995240 - RNA, 19 nt, Homo sapiens
gcccaugaugagaagcaga

SEQ ID NO: 995241 - RNA, 15 nt, Homo sapiens
gccccaggaccagcu

SEQ ID NO: 995242 - RNA, 16 nt, Homo sapiens
gccccaggcauugcca

SEQ ID NO: 995243 - RNA, 21 nt, Homo sapiens
gccccaggcucguggacugag

SEQ ID NO: 995244 - RNA, 13 nt, Homo sapiens
gccccauguaucu

SEQ ID NO: 995245 - RNA, 18 nt, Homo sapiens
gcccccaaccauuuccuc

SEQ ID NO: 995246 - RNA, 18 nt, Homo sapiens
gcccccaggguccuggga

SEQ ID NO: 995247 - RNA, 19 nt, Homo sapiens
gccccucugaccugcacug

SEQ ID NO: 995248 - RNA, 14 nt, Homo sapiens
gcccuccugugcuc

SEQ ID NO: 995249 - RNA, 18 nt, Homo sapiens
gcccugccuggaggaccu

SEQ ID NO: 995250 - RNA, 16 nt, Homo sapiens
gcccugcgggugaaca

SEQ ID NO: 995251 - RNA, 20 nt, Homo sapiens
gcccugcucugaacacgaag

SEQ ID NO: 995252 - RNA, 17 nt, Homo sapiens
gcccuggcaugucaaca

SEQ ID NO: 995253 - RNA, 16 nt, Homo sapiens
gcccuggggccuguac

SEQ ID NO: 995254 - RNA, 13 nt, Homo sapiens
gcccugucaucca

SEQ ID NO: 995255 - RNA, 21 nt, Homo sapiens
gcccuucccacaggacauuuc

SEQ ID NO: 995256 - RNA, 15 nt, Homo sapiens
gcccuuggggguccu

SEQ ID NO: 995257 - RNA, 20 nt, Homo sapiens
gcccuuucauggucugcuga

SEQ ID NO: 995258 - RNA, 16 nt, Homo sapiens
gccgacagcucuccaa

SEQ ID NO: 995259 - RNA, 15 nt, Homo sapiens
gccgaguccaagcug

SEQ ID NO: 995260 - RNA, 21 nt, Homo sapiens
gccgccuggagaugacuugag

SEQ ID NO: 995261 - RNA, 21 nt, Homo sapiens
gccgcgcaucagacugugaac

SEQ ID NO: 995262 - RNA, 11 nt, Homo sapiens
gccgcugugcc

SEQ ID NO: 995263 - RNA, 21 nt, Homo sapiens
gccguccuggcgccuggcagu

SEQ ID NO: 995264 - RNA, 20 nt, Homo sapiens
gccuaagggccacaucccac

SEQ ID NO: 995265 - RNA, 22 nt, Homo sapiens
gccuauuaucugucagcugcaa

SEQ ID NO: 995266 - RNA, 17 nt, Homo sapiens
gccuauugcuagagcuc

SEQ ID NO: 995267 - RNA, 14 nt, Homo sapiens
gccucaaagcaagc

SEQ ID NO: 995268 - RNA, 19 nt, Homo sapiens
gccucaagaugaaggcaaa

SEQ ID NO: 995269 - RNA, 15 nt, Homo sapiens
gccucaaugccagua

SEQ ID NO: 995270 - RNA, 16 nt, Homo sapiens
gccucagagacaucag

SEQ ID NO: 995271 - RNA, 16 nt, Homo sapiens
gccucagcucccacaa

SEQ ID NO: 995272 - RNA, 16 nt, Homo sapiens
gccucaggacugggag

SEQ ID NO: 995273 - RNA, 20 nt, Homo sapiens
gccucauuuuuuuccuugca

SEQ ID NO: 995274 - RNA, 13 nt, Homo sapiens
gccucccacaaga

SEQ ID NO: 995275 - RNA, 14 nt, Homo sapiens
gccucugaagccua

SEQ ID NO: 995276 - RNA, 21 nt, Homo sapiens
gccucugcccaggcacugcua

SEQ ID NO: 995277 - RNA, 16 nt, Homo sapiens
gccugaacaugccccu

SEQ ID NO: 995278 - RNA, 21 nt, Homo sapiens
gccugaggucaggaguucaag

SEQ ID NO: 995279 - RNA, 23 nt, Homo sapiens
gccugagucgugaccugcuaggc

SEQ ID NO: 995280 - RNA, 18 nt, Homo sapiens
gccugaugcugacauuca

SEQ ID NO: 995281 - RNA, 16 nt, Homo sapiens
gccuggacuuuccugc

SEQ ID NO: 995282 - RNA, 20 nt, Homo sapiens
gccuggaguguaugacugca

SEQ ID NO: 995283 - RNA, 20 nt, Homo sapiens
gccuggccuccugccucuac

SEQ ID NO: 995284 - RNA, 19 nt, Homo sapiens
gccuguaaucucacuacac

SEQ ID NO: 995285 - RNA, 16 nt, Homo sapiens
gccugugccaggugag

SEQ ID NO: 995286 - RNA, 18 nt, Homo sapiens
gccuguguacagaccucc

SEQ ID NO: 995287 - RNA, 19 nt, Homo sapiens
gccuguguacagaccuccg

SEQ ID NO: 995288 - RNA, 13 nt, Homo sapiens
gccuguguagcug

SEQ ID NO: 995289 - RNA, 18 nt, Homo sapiens
gccuuacuuaaacccagc

SEQ ID NO: 995290 - RNA, 15 nt, Homo sapiens
gccuucaguguaccg

SEQ ID NO: 995291 - RNA, 14 nt, Homo sapiens
gccuucauucugca

SEQ ID NO: 995292 - RNA, 18 nt, Homo sapiens
gccuugccagagauccaa

SEQ ID NO: 995293 - RNA, 20 nt, Homo sapiens
gccuuggccuggagcacaaa

SEQ ID NO: 995294 - RNA, 23 nt, Homo sapiens
gccuugugaugucauacagagaa

SEQ ID NO: 995295 - RNA, 15 nt, Homo sapiens
gccuuugccagguga

SEQ ID NO: 995296 - RNA, 20 nt, Homo sapiens
gccuuuuuguauaaaauaga

SEQ ID NO: 995297 - RNA, 19 nt, Homo sapiens
gcgcccugcagacccugcc

SEQ ID NO: 995298 - RNA, 14 nt, Homo sapiens
gcgcucagggccau

SEQ ID NO: 995299 - RNA, 16 nt, Homo sapiens
gcgcugcugguguucu

SEQ ID NO: 995300 - RNA, 17 nt, Homo sapiens
gcgcuguucuugcucca

SEQ ID NO: 995301 - RNA, 21 nt, Homo sapiens
gcggaaggagggagcucugau

SEQ ID NO: 995302 - RNA, 19 nt, Homo sapiens
gcggcaggaagggggccga

SEQ ID NO: 995303 - RNA, 21 nt, Homo sapiens
gcgguagccagcacacagggc

SEQ ID NO: 995304 - RNA, 16 nt, Homo sapiens
gcguaaguacagagaa

SEQ ID NO: 995305 - RNA, 21 nt, Homo sapiens
gcguaaguacagagaagccau

SEQ ID NO: 995306 - RNA, 17 nt, Homo sapiens
gcguaggcuacagagaa

SEQ ID NO: 995307 - RNA, 19 nt, Homo sapiens
gcgugaccagcaguacuca

SEQ ID NO: 995308 - RNA, 19 nt, Homo sapiens
gcguuacugcuugaccaaa

SEQ ID NO: 995309 - RNA, 18 nt, Homo sapiens
gcuaaaccaccauuuuau

SEQ ID NO: 995310 - RNA, 13 nt, Homo sapiens
gcuaagaaccugg

SEQ ID NO: 995311 - RNA, 20 nt, Homo sapiens
gcuaauugcacguguguauu

SEQ ID NO: 995312 - RNA, 15 nt, Homo sapiens
gcuacaccacucugg

SEQ ID NO: 995313 - RNA, 20 nt, Homo sapiens
gcuacaccacucuggcagcc

SEQ ID NO: 995314 - RNA, 23 nt, Homo sapiens
gcuaccugcucagcccugcacca

SEQ ID NO: 995315 - RNA, 22 nt, Homo sapiens
gcuacucugugccagagccugg

SEQ ID NO: 995316 - RNA, 14 nt, Homo sapiens
gcuagcaguggcag

SEQ ID NO: 995317 - RNA, 15 nt, Homo sapiens
gcuaggaacuuggga

SEQ ID NO: 995318 - RNA, 18 nt, Homo sapiens
gcuaggagcaaagccugu

SEQ ID NO: 995319 - RNA, 20 nt, Homo sapiens
gcuagugacuugugucccau

SEQ ID NO: 995320 - RNA, 23 nt, Homo sapiens
gcuaugguuuucuccaagagcua

SEQ ID NO: 995321 - RNA, 18 nt, Homo sapiens
gcuauuuugugaagccau

SEQ ID NO: 995322 - RNA, 21 nt, Homo sapiens
gcucagaggcgcacugugacc

SEQ ID NO: 995323 - RNA, 20 nt, Homo sapiens
gcucagcccugcaccaugcu

SEQ ID NO: 995324 - RNA, 21 nt, Homo sapiens
gcucagcccugcaccaugcug

SEQ ID NO: 995325 - RNA, 22 nt, Homo sapiens
gcucagcccugcaccaugcugc

SEQ ID NO: 995326 - RNA, 17 nt, Homo sapiens
gcucauagaucagcaaa

SEQ ID NO: 995327 - RNA, 13 nt, Homo sapiens
gcucaucauucuc

SEQ ID NO: 995328 - RNA, 22 nt, Homo sapiens
gcuccaaccugcaaagaucugu

SEQ ID NO: 995329 - RNA, 20 nt, Homo sapiens
gcuccacccuggccgagucc

SEQ ID NO: 995330 - RNA, 16 nt, Homo sapiens
gcuccagaugcagggc

SEQ ID NO: 995331 - RNA, 19 nt, Homo sapiens
gcuccagaugcagggcagu

SEQ ID NO: 995332 - RNA, 15 nt, Homo sapiens
gcuccaguguccuga

SEQ ID NO: 995333 - RNA, 17 nt, Homo sapiens
auguggucacagcugua

SEQ ID NO: 995334 - RNA, 12 nt, Homo sapiens
auguguccugac

SEQ ID NO: 995335 - RNA, 23 nt, Homo sapiens
auguguggaaguuauuaacuuua

SEQ ID NO: 995336 - RNA, 22 nt, Homo sapiens
auguuaacacucaugaagcaua

SEQ ID NO: 995337 - RNA, 22 nt, Homo sapiens
auguucacuuuugacaaaggca

SEQ ID NO: 995338 - RNA, 13 nt, Homo sapiens
auguucuuuggaa

SEQ ID NO: 995339 - RNA, 21 nt, Homo sapiens
auguuguguuuuuaacauguc

SEQ ID NO: 995340 - RNA, 22 nt, Homo sapiens
auguuguguuuuuaacauguca

SEQ ID NO: 995341 - RNA, 15 nt, Homo sapiens
auguuuccagcauuc

SEQ ID NO: 995342 - RNA, 21 nt, Homo sapiens
auguuuuuugccacagcuuuu

SEQ ID NO: 995343 - RNA, 19 nt, Homo sapiens
auuaaaagaauaucuggca

SEQ ID NO: 995344 - RNA, 15 nt, Homo sapiens
auuaaaagacucauc

SEQ ID NO: 995345 - RNA, 16 nt, Homo sapiens
auuaaagaagaccuga

SEQ ID NO: 995346 - RNA, 14 nt, Homo sapiens
auuaaauucacaaa

SEQ ID NO: 995347 - RNA, 14 nt, Homo sapiens
ugaauacugcuaca

SEQ ID NO: 995348 - RNA, 13 nt, Homo sapiens
ugaauucccucac

SEQ ID NO: 995349 - RNA, 16 nt, Homo sapiens
ugaauuuuagcuuuug

SEQ ID NO: 995350 - RNA, 19 nt, Homo sapiens
ugacaacauuucuauagcc

SEQ ID NO: 995351 - RNA, 12 nt, Homo sapiens
ugacaaccucuu

SEQ ID NO: 995352 - RNA, 13 nt, Homo sapiens
ugacaagcacuau

SEQ ID NO: 995353 - RNA, 14 nt, Homo sapiens
ugacaauuacucag

SEQ ID NO: 995354 - RNA, 15 nt, Homo sapiens
ugacaccugcugaga

SEQ ID NO: 995355 - RNA, 15 nt, Homo sapiens
ugacacugcucuaac

SEQ ID NO: 995356 - RNA, 12 nt, Homo sapiens
ugacagccuccc

SEQ ID NO: 995357 - RNA, 12 nt, Homo sapiens
ugacaguuuaca

SEQ ID NO: 995358 - RNA, 19 nt, Homo sapiens
ugacauacccccuccccca

SEQ ID NO: 995359 - RNA, 15 nt, Homo sapiens
ugacauguggggcca

SEQ ID NO: 995360 - RNA, 15 nt, Homo sapiens
ugacauuauaugcac

SEQ ID NO: 995361 - RNA, 23 nt, Homo sapiens
ugacauugcguuugaccuuuuau

SEQ ID NO: 995362 - RNA, 17 nt, Homo sapiens
ugaccaaagagcccuca

SEQ ID NO: 995363 - RNA, 18 nt, Homo sapiens
ugacccuugcugugaauu

SEQ ID NO: 995364 - RNA, 13 nt, Homo sapiens
ugacccuuuucau

SEQ ID NO: 995365 - RNA, 17 nt, Homo sapiens
ugaccuccgccauccac

SEQ ID NO: 995366 - RNA, 20 nt, Homo sapiens
ugaccugcugagcucugaga

SEQ ID NO: 995367 - RNA, 16 nt, Homo sapiens
ugacuaccuccacuca

SEQ ID NO: 995368 - RNA, 15 nt, Homo sapiens
ugacuauucuugaug

SEQ ID NO: 995369 - RNA, 16 nt, Homo sapiens
ugacuccugcucucug

SEQ ID NO: 995370 - RNA, 15 nt, Homo sapiens
ugacuuggcuggugu

SEQ ID NO: 995371 - RNA, 20 nt, Homo sapiens
ugacuuugcuugcuuugaag

SEQ ID NO: 995372 - RNA, 20 nt, Homo sapiens
ugagaacaccagagaccuca

SEQ ID NO: 995373 - RNA, 23 nt, Homo sapiens
ugagaggcugucuguuguauuca

SEQ ID NO: 995374 - RNA, 22 nt, Homo sapiens
ugagagucuagauucucuggcu

SEQ ID NO: 995375 - RNA, 15 nt, Homo sapiens
ugagagugagacuca

SEQ ID NO: 995376 - RNA, 21 nt, Homo sapiens
ugagauaguuuucauccauaa

SEQ ID NO: 995377 - RNA, 19 nt, Homo sapiens
ugagauugaauuucacugu

SEQ ID NO: 995378 - RNA, 12 nt, Homo sapiens
ugagcaacucuu

SEQ ID NO: 995379 - RNA, 22 nt, Homo sapiens
ugagcacugccaggagggacaa

SEQ ID NO: 995380 - RNA, 22 nt, Homo sapiens
ugagcacuguuuauacacugug

SEQ ID NO: 995381 - RNA, 17 nt, Homo sapiens
ugagcccaaggcacuga

SEQ ID NO: 995382 - RNA, 18 nt, Homo sapiens
ugagcccaaggcacugag

SEQ ID NO: 995383 - RNA, 17 nt, Homo sapiens
ugagccccugagcccaa

SEQ ID NO: 995384 - RNA, 21 nt, Homo sapiens
ugagccccuggaggcacugaa

SEQ ID NO: 995385 - RNA, 12 nt, Homo sapiens
ugagcucucuca

SEQ ID NO: 995386 - RNA, 19 nt, Homo sapiens
ugagcuuucugaacagcug

SEQ ID NO: 995387 - RNA, 12 nt, Homo sapiens
ugaggaacuguc

SEQ ID NO: 995388 - RNA, 14 nt, Homo sapiens
ugaggaacugucuc

SEQ ID NO: 995389 - RNA, 24 nt, Homo sapiens
ugaggaugugucccaucuagggaa

SEQ ID NO: 995390 - RNA, 19 nt, Homo sapiens
ugaggcccuccacaccugc

SEQ ID NO: 995391 - RNA, 18 nt, Homo sapiens
ugaggccuggacuuuccu

SEQ ID NO: 995392 - RNA, 22 nt, Homo sapiens
ugaggcugcgagagaaagggag

SEQ ID NO: 995393 - RNA, 18 nt, Homo sapiens
ugaggcuggcacaggaca

SEQ ID NO: 995394 - RNA, 13 nt, Homo sapiens
ugaggcugucagu

SEQ ID NO: 995395 - RNA, 22 nt, Homo sapiens
ugagggcaguucugaguguuua

SEQ ID NO: 995396 - RNA, 17 nt, Homo sapiens
ugaggugcccaggagaa

SEQ ID NO: 995397 - RNA, 18 nt, Homo sapiens
ugaguaacaggugccuuc

SEQ ID NO: 995398 - RNA, 18 nt, Homo sapiens
ugaguccgacccagacau

SEQ ID NO: 995399 - RNA, 17 nt, Homo sapiens
ugaguucuauaauauaa

SEQ ID NO: 995400 - RNA, 23 nt, Homo sapiens
ugaguugaggccacuguguuccu

SEQ ID NO: 995401 - RNA, 14 nt, Homo sapiens
ucuaauauggccac

SEQ ID NO: 995402 - RNA, 20 nt, Homo sapiens
ucuaauuaauuguaaucuga

SEQ ID NO: 995403 - RNA, 21 nt, Homo sapiens
ucuaauuauguagcucuuugu

SEQ ID NO: 995404 - RNA, 22 nt, Homo sapiens
ucuaauucuauuaaagugcuaa

SEQ ID NO: 995405 - RNA, 13 nt, Homo sapiens
ucuaccucaggca

SEQ ID NO: 995406 - RNA, 15 nt, Homo sapiens
ucuacuaacaaucag

SEQ ID NO: 995407 - RNA, 12 nt, Homo sapiens
ucuacuaauucc

SEQ ID NO: 995408 - RNA, 15 nt, Homo sapiens
ucuacuaauuccaca

SEQ ID NO: 995409 - RNA, 11 nt, Homo sapiens
ucuacugccuu

SEQ ID NO: 995410 - RNA, 23 nt, Homo sapiens
ucuagacauggagguucuaaggc

SEQ ID NO: 995411 - RNA, 15 nt, Homo sapiens
ucuagagcacugcca

SEQ ID NO: 995412 - RNA, 16 nt, Homo sapiens
ucuaggcaacauagua

SEQ ID NO: 995413 - RNA, 22 nt, Homo sapiens
ucuagguaggggcccacuucac

SEQ ID NO: 995414 - RNA, 19 nt, Homo sapiens
ucuauaauuuugccuuuaa

SEQ ID NO: 995415 - RNA, 16 nt, Homo sapiens
ucuauccucuguaaac

SEQ ID NO: 995416 - RNA, 13 nt, Homo sapiens
ucuauuaucucaa

SEQ ID NO: 995417 - RNA, 22 nt, Homo sapiens
ucucaaacuccugaccucaggc

SEQ ID NO: 995418 - RNA, 16 nt, Homo sapiens
ucucaaagaaggcauu

SEQ ID NO: 995419 - RNA, 17 nt, Homo sapiens
ucucaaagaaggcauuu

SEQ ID NO: 995420 - RNA, 15 nt, Homo sapiens
ucucaacacccaguu

SEQ ID NO: 995421 - RNA, 19 nt, Homo sapiens
ucucaggaccaaagcuuuc

SEQ ID NO: 995422 - RNA, 23 nt, Homo sapiens
ucucaguugauuuucuggauucc

SEQ ID NO: 995423 - RNA, 16 nt, Homo sapiens
ucucaucaguaguuca

SEQ ID NO: 995424 - RNA, 22 nt, Homo sapiens
ucucaucucuucagguucucau

SEQ ID NO: 995425 - RNA, 17 nt, Homo sapiens
ucucaugauaccaccuu

SEQ ID NO: 995426 - RNA, 22 nt, Homo sapiens
ucucauguugaagccacugccu

SEQ ID NO: 995427 - RNA, 13 nt, Homo sapiens
ucuccaauacuca

SEQ ID NO: 995428 - RNA, 19 nt, Homo sapiens
ucuccacuucuuguucccc

SEQ ID NO: 995429 - RNA, 20 nt, Homo sapiens
ucucccaacucuugcacagu

SEQ ID NO: 995430 - RNA, 21 nt, Homo sapiens
ucucccaccuuucgggccaug

SEQ ID NO: 995431 - RNA, 23 nt, Homo sapiens
ucucccuguuggucgguggguug

SEQ ID NO: 995432 - RNA, 19 nt, Homo sapiens
ucuccuaaaguacugggau

SEQ ID NO: 995433 - RNA, 15 nt, Homo sapiens
ucuccucuccuagcc

SEQ ID NO: 995434 - RNA, 18 nt, Homo sapiens
ucucgcuccucaaccccu

SEQ ID NO: 995435 - RNA, 17 nt, Homo sapiens
ucucuaacaguggacaa

SEQ ID NO: 995436 - RNA, 16 nt, Homo sapiens
ucucuacugaauguca

SEQ ID NO: 995437 - RNA, 17 nt, Homo sapiens
ucucuccagcugacuaa

SEQ ID NO: 995438 - RNA, 19 nt, Homo sapiens
ucucuccccagaugugacu

SEQ ID NO: 995439 - RNA, 19 nt, Homo sapiens
ucucugagcagugaaugau

SEQ ID NO: 995440 - RNA, 17 nt, Homo sapiens
ucucugaggacaagaga

SEQ ID NO: 995441 - RNA, 20 nt, Homo sapiens
ucucugcagaaacuacugac

SEQ ID NO: 995442 - RNA, 17 nt, Homo sapiens
ucucugcagacuuccca

SEQ ID NO: 995443 - RNA, 13 nt, Homo sapiens
ucucuggaguauu

SEQ ID NO: 995444 - RNA, 15 nt, Homo sapiens
ucucuggaguauucu

SEQ ID NO: 995445 - RNA, 14 nt, Homo sapiens
ucucuuacaaucug

SEQ ID NO: 995446 - RNA, 17 nt, Homo sapiens
ucucuuagggacaguca

SEQ ID NO: 995447 - RNA, 17 nt, Homo sapiens
ucucuugcuugugggac

SEQ ID NO: 995448 - RNA, 15 nt, Homo sapiens
cugcuccagaccuga

SEQ ID NO: 995449 - RNA, 22 nt, Homo sapiens
cugcucccugacagcaccugaa

SEQ ID NO: 995450 - RNA, 14 nt, Homo sapiens
cugcucgcucccug

SEQ ID NO: 995451 - RNA, 19 nt, Homo sapiens
cugcucggggugcacagga

SEQ ID NO: 995452 - RNA, 18 nt, Homo sapiens
cugcucguccccaaguga

SEQ ID NO: 995453 - RNA, 19 nt, Homo sapiens
cugcucugaugcaucagaa

SEQ ID NO: 995454 - RNA, 13 nt, Homo sapiens
cugcugcugagaa

SEQ ID NO: 995455 - RNA, 16 nt, Homo sapiens
cugcugcugggcucag

SEQ ID NO: 995456 - RNA, 14 nt, Homo sapiens
cugcugggugugac

SEQ ID NO: 995457 - RNA, 22 nt, Homo sapiens
cugcuguagaaaaaaaaauuca

SEQ ID NO: 995458 - RNA, 19 nt, Homo sapiens
cugcugucaccuugcucag

SEQ ID NO: 995459 - RNA, 15 nt, Homo sapiens
cugcuugaccaaaga

SEQ ID NO: 995460 - RNA, 16 nt, Homo sapiens
cuggaaaacagaacac

SEQ ID NO: 995461 - RNA, 20 nt, Homo sapiens
cuggaacacuagacaagcca

SEQ ID NO: 995462 - RNA, 15 nt, Homo sapiens
cuggaauucuaacaa

SEQ ID NO: 995463 - RNA, 12 nt, Homo sapiens
cuggacuuuccu

SEQ ID NO: 995464 - RNA, 12 nt, Homo sapiens
cuggagauccuc

SEQ ID NO: 995465 - RNA, 20 nt, Homo sapiens
cuggagucaaaacacuugua

SEQ ID NO: 995466 - RNA, 17 nt, Homo sapiens
cuggagugcagugccac

SEQ ID NO: 995467 - RNA, 20 nt, Homo sapiens
cuggagugcaguggugcaau

SEQ ID NO: 995468 - RNA, 20 nt, Homo sapiens
cuggagugcaguggugugau

SEQ ID NO: 995469 - RNA, 21 nt, Homo sapiens
cuggaguuagggacugaccag

SEQ ID NO: 995470 - RNA, 17 nt, Homo sapiens
cuggaucagcguggccu

SEQ ID NO: 995471 - RNA, 16 nt, Homo sapiens
cuggaucucccugaga

SEQ ID NO: 995472 - RNA, 12 nt, Homo sapiens
cuggaugacauu

SEQ ID NO: 995473 - RNA, 17 nt, Homo sapiens
cuggcaagucaccugca

SEQ ID NO: 995474 - RNA, 16 nt, Homo sapiens
uggggugggcacauug

SEQ ID NO: 995475 - RNA, 19 nt, Homo sapiens
ugggucuaccacucagaga

SEQ ID NO: 995476 - RNA, 22 nt, Homo sapiens
ugggugagagugagacucaguc

SEQ ID NO: 995477 - RNA, 14 nt, Homo sapiens
ugggugcuacuggg

SEQ ID NO: 995478 - RNA, 14 nt, Homo sapiens
uggguugucaccaa

SEQ ID NO: 995479 - RNA, 13 nt, Homo sapiens
uggguuuggugua

SEQ ID NO: 995480 - RNA, 14 nt, Homo sapiens
ugguaaaauacuuc

SEQ ID NO: 995481 - RNA, 22 nt, Homo sapiens
ugguaacugcuuucuguuccaa

SEQ ID NO: 995482 - RNA, 18 nt, Homo sapiens
ugguaauauugacuugua

SEQ ID NO: 995483 - RNA, 15 nt, Homo sapiens
ugguaucucagaaag

SEQ ID NO: 995484 - RNA, 15 nt, Homo sapiens
ugguccccuccuucc

SEQ ID NO: 995485 - RNA, 15 nt, Homo sapiens
uggucgggaagggag

SEQ ID NO: 995486 - RNA, 22 nt, Homo sapiens
uggucucaaacuccugaccuca

SEQ ID NO: 995487 - RNA, 17 nt, Homo sapiens
uggugccaaacaaaaag

SEQ ID NO: 995488 - RNA, 19 nt, Homo sapiens
uggugccccaggaccagcu

SEQ ID NO: 995489 - RNA, 22 nt, Homo sapiens
uggugccccaggaccagcucag

SEQ ID NO: 995490 - RNA, 15 nt, Homo sapiens
ugguggagcagagug

SEQ ID NO: 995491 - RNA, 24 nt, Homo sapiens
ugguggcacaggaguguccucuuc

SEQ ID NO: 995492 - RNA, 17 nt, Homo sapiens
ugguggcauuguuuaca

SEQ ID NO: 995493 - RNA, 23 nt, Homo sapiens
ugguuacgucagccgguccaugg

SEQ ID NO: 995494 - RNA, 17 nt, Homo sapiens
ugguucauuaauucuau

SEQ ID NO: 995495 - RNA, 20 nt, Homo sapiens
ugguugaaaccccaucucua

SEQ ID NO: 995496 - RNA, 22 nt, Homo sapiens
ugguuuauguggacaagccauu

SEQ ID NO: 995497 - RNA, 17 nt, Homo sapiens
ugguuuucuuuugccau

SEQ ID NO: 995498 - RNA, 15 nt, Homo sapiens
uguaaacugugcacc

SEQ ID NO: 995499 - RNA, 13 nt, Homo sapiens
uguaaagcuuuaa

SEQ ID NO: 995500 - RNA, 17 nt, Homo sapiens
uguaaauaauacauuau

SEQ ID NO: 995501 - RNA, 15 nt, Homo sapiens
uguaaauaguauaaa

SEQ ID NO: 995502 - RNA, 13 nt, Homo sapiens
uguaaaugugaca

SEQ ID NO: 995503 - RNA, 16 nt, Homo sapiens
uguaaccugcugugau

SEQ ID NO: 995504 - RNA, 19 nt, Homo sapiens
uguaauauuucuucaaaua

SEQ ID NO: 995505 - RNA, 17 nt, Homo sapiens
uguaaucucacuacaca

SEQ ID NO: 995506 - RNA, 16 nt, Homo sapiens
uguaaugagagcacuu

SEQ ID NO: 995507 - RNA, 21 nt, Homo sapiens
uguacaguagauuuuccaaau

SEQ ID NO: 995508 - RNA, 19 nt, Homo sapiens
uguacauauuagaaaggga

SEQ ID NO: 995509 - RNA, 15 nt, Homo sapiens
uguacauugugggau

SEQ ID NO: 995510 - RNA, 20 nt, Homo sapiens
uguaccaccaacuacuaccu

SEQ ID NO: 995511 - RNA, 15 nt, Homo sapiens
uguacuugccuuauu

SEQ ID NO: 995512 - RNA, 17 nt, Homo sapiens
uguagaacacuaauuca

SEQ ID NO: 995513 - RNA, 17 nt, Homo sapiens
uguagaagccacuauua

SEQ ID NO: 995514 - RNA, 21 nt, Homo sapiens
uguagauucagguaauacaaa

SEQ ID NO: 995515 - RNA, 14 nt, Homo sapiens
uguagcuacagaga

SEQ ID NO: 995516 - RNA, 18 nt, Homo sapiens
uguagcuccuccccugga

SEQ ID NO: 995517 - RNA, 14 nt, Homo sapiens
uguaguaauugaca

SEQ ID NO: 995518 - RNA, 22 nt, Homo sapiens
uguauauauuauuauaaucuua

SEQ ID NO: 995519 - RNA, 11 nt, Homo sapiens
uguauauccaa

SEQ ID NO: 995520 - RNA, 18 nt, Homo sapiens
uguaucaaaugugacauu

SEQ ID NO: 995521 - RNA, 18 nt, Homo sapiens
uguaugcacaugaacuua

SEQ ID NO: 995522 - RNA, 13 nt, Homo sapiens
ugucauacagaga

SEQ ID NO: 995523 - RNA, 21 nt, Homo sapiens
ugucaucugcuccuguucaca

SEQ ID NO: 995524 - RNA, 12 nt, Homo sapiens
ugucauguguau

SEQ ID NO: 995525 - RNA, 21 nt, Homo sapiens
ugucauucuguuagauacuaa

SEQ ID NO: 995526 - RNA, 19 nt, Homo sapiens
ugucauuguuauauaauca

SEQ ID NO: 995527 - RNA, 14 nt, Homo sapiens
uguccaaaacugcc

SEQ ID NO: 995528 - RNA, 17 nt, Homo sapiens
uguccaaagaggcugcc

SEQ ID NO: 995529 - RNA, 19 nt, Homo sapiens
uguccccacuuacagaucu

SEQ ID NO: 995530 - RNA, 12 nt, Homo sapiens
uuagaucuggca

SEQ ID NO: 995531 - RNA, 20 nt, Homo sapiens
uuagauguaauuuuguguaa

SEQ ID NO: 995532 - RNA, 23 nt, Homo sapiens
uuagcucucccaacucuugcaca

SEQ ID NO: 995533 - RNA, 12 nt, Homo sapiens
uuagcucugaga

SEQ ID NO: 995534 - RNA, 15 nt, Homo sapiens
uuaguauuguugucc

SEQ ID NO: 995535 - RNA, 19 nt, Homo sapiens
uuagugaaugacuuuucuc

SEQ ID NO: 995536 - RNA, 16 nt, Homo sapiens
uuaguuccacugagac

SEQ ID NO: 995537 - RNA, 13 nt, Homo sapiens
uuauaaaaaaugg

SEQ ID NO: 995538 - RNA, 17 nt, Homo sapiens
uuauaaccaacuuuucu

SEQ ID NO: 995539 - RNA, 13 nt, Homo sapiens
uuauaacuguaaa

SEQ ID NO: 995540 - RNA, 14 nt, Homo sapiens
uuauaauauacuau

SEQ ID NO: 995541 - RNA, 14 nt, Homo sapiens
uuauacaauacaga

SEQ ID NO: 995542 - RNA, 13 nt, Homo sapiens
uuauagauucuaa

SEQ ID NO: 995543 - RNA, 15 nt, Homo sapiens
uuauaggcauaccuc

SEQ ID NO: 995544 - RNA, 18 nt, Homo sapiens
uuauauauuauauggaaa

SEQ ID NO: 995545 - RNA, 21 nt, Homo sapiens
uuaucaacuuccuaaauauua

SEQ ID NO: 995546 - RNA, 14 nt, Homo sapiens
uuaucagucauaac

SEQ ID NO: 995547 - RNA, 14 nt, Homo sapiens
uuaugaaaaagaag

SEQ ID NO: 995548 - RNA, 15 nt, Homo sapiens
uuaugauauucuauc

SEQ ID NO: 995549 - RNA, 16 nt, Homo sapiens
uuaugcuguacccagu

SEQ ID NO: 995550 - RNA, 18 nt, Homo sapiens
uuauguaguaauugacau

SEQ ID NO: 995551 - RNA, 17 nt, Homo sapiens
uuauguggacaagccau

SEQ ID NO: 995552 - RNA, 14 nt, Homo sapiens
uuauuaacuuuaau

SEQ ID NO: 995553 - RNA, 17 nt, Homo sapiens
uuauuacauggggucua

SEQ ID NO: 995554 - RNA, 19 nt, Homo sapiens
uuauuagagugucuuucca

SEQ ID NO: 995555 - RNA, 20 nt, Homo sapiens
uuauucugggggcugcaguu

SEQ ID NO: 995556 - RNA, 13 nt, Homo sapiens
uucaaaaguucca

SEQ ID NO: 995557 - RNA, 15 nt, Homo sapiens
uucaaacaaccugcc

SEQ ID NO: 995558 - RNA, 18 nt, Homo sapiens
uucaagggacccaugagu

SEQ ID NO: 995559 - RNA, 10 nt, Homo sapiens
uucaaugagg

SEQ ID NO: 995560 - RNA, 16 nt, Homo sapiens
uucacacugaccaaga

SEQ ID NO: 995561 - RNA, 21 nt, Homo sapiens
uucacaguucuuugggccaga

SEQ ID NO: 995562 - RNA, 18 nt, Homo sapiens
uucacaucgcagauucuc

SEQ ID NO: 995563 - RNA, 19 nt, Homo sapiens
uucacaugaugcacuucaa

SEQ ID NO: 995564 - RNA, 18 nt, Homo sapiens
uucaccuaccgaguucaa

SEQ ID NO: 995565 - RNA, 23 nt, Homo sapiens
uucagacucccauuccugaagaa

SEQ ID NO: 995566 - RNA, 17 nt, Homo sapiens
uucagagugacuacaca

SEQ ID NO: 995567 - RNA, 12 nt, Homo sapiens
uucagaugugaa

SEQ ID NO: 995568 - RNA, 21 nt, Homo sapiens
uucagcauccgcaggugcugg

SEQ ID NO: 995569 - RNA, 21 nt, Homo sapiens
uucaggcccccgccuuggccu

SEQ ID NO: 995570 - RNA, 20 nt, Homo sapiens
uucagguauaccucacuuua

SEQ ID NO: 995571 - RNA, 14 nt, Homo sapiens
uucaguuucacaga

SEQ ID NO: 995572 - RNA, 14 nt, Homo sapiens
uucauacuugaacg

SEQ ID NO: 995573 - RNA, 20 nt, Homo sapiens
uucauauguaccauguacau

SEQ ID NO: 995574 - RNA, 22 nt, Homo sapiens
uucauuaacaaaauguaugucu

SEQ ID NO: 995575 - RNA, 18 nt, Homo sapiens
uucauuaucauaugaacu

SEQ ID NO: 995576 - RNA, 13 nt, Homo sapiens
uucauugcacuuu

SEQ ID NO: 995577 - RNA, 18 nt, Homo sapiens
uucauuuagucaugugac

SEQ ID NO: 995578 - RNA, 14 nt, Homo sapiens
uucauuuaucuaua

SEQ ID NO: 995579 - RNA, 19 nt, Homo sapiens
uuccaacaccugacagaau

SEQ ID NO: 995580 - RNA, 20 nt, Homo sapiens
uuauguaugaaaauuauucu

SEQ ID NO: 995581 - RNA, 19 nt, Homo sapiens
uuauuacauggggucuaga

SEQ ID NO: 995582 - RNA, 15 nt, Homo sapiens
uuauucuugguuuuc

SEQ ID NO: 995583 - RNA, 13 nt, Homo sapiens
uuauugcaguuua

SEQ ID NO: 995584 - RNA, 23 nt, Homo sapiens
uucaagcagucgugccugugucc

SEQ ID NO: 995585 - RNA, 20 nt, Homo sapiens
uucaagcgauucucuugccu

SEQ ID NO: 995586 - RNA, 17 nt, Homo sapiens
uucaauugcaucuccca

SEQ ID NO: 995587 - RNA, 13 nt, Homo sapiens
uucacaccuaccc

SEQ ID NO: 995588 - RNA, 21 nt, Homo sapiens
uucacauacaaaucauccauc

SEQ ID NO: 995589 - RNA, 16 nt, Homo sapiens
uucacaucuaaccuca

SEQ ID NO: 995590 - RNA, 12 nt, Homo sapiens
uucaccauccac

SEQ ID NO: 995591 - RNA, 13 nt, Homo sapiens
uucaccugcaaac

SEQ ID NO: 995592 - RNA, 17 nt, Homo sapiens
uucacgaacaugggcau

SEQ ID NO: 995593 - RNA, 18 nt, Homo sapiens
uucagguccaggcugugu

SEQ ID NO: 995594 - RNA, 14 nt, Homo sapiens
uucagucugugaaa

SEQ ID NO: 995595 - RNA, 16 nt, Homo sapiens
uucauaaguauuucaa

SEQ ID NO: 995596 - RNA, 17 nt, Homo sapiens
uucauccauaacugaac

SEQ ID NO: 995597 - RNA, 15 nt, Homo sapiens
uucaugaucaucaca

SEQ ID NO: 995598 - RNA, 20 nt, Homo sapiens
uucaugcgaugacacuugua

SEQ ID NO: 995599 - RNA, 22 nt, Homo sapiens
uucauucucccuuucacuaaaa

SEQ ID NO: 995600 - RNA, 18 nt, Homo sapiens
uucauuguguuaccugua

SEQ ID NO: 995601 - RNA, 19 nt, Homo sapiens
uucauuuucucucagguga

SEQ ID NO: 995602 - RNA, 17 nt, Homo sapiens
uuccaaacucuucccuc

SEQ ID NO: 995603 - RNA, 21 nt, Homo sapiens
uuccaacucgaaucuguguga

SEQ ID NO: 995604 - RNA, 18 nt, Homo sapiens
uuccacuaucauucccau

SEQ ID NO: 995605 - RNA, 20 nt, Homo sapiens
uuccagaaaacaaaacugca

SEQ ID NO: 995606 - RNA, 20 nt, Homo sapiens
uuccagcuagugacccacau

SEQ ID NO: 995607 - RNA, 14 nt, Homo sapiens
uuccagguguuacu

SEQ ID NO: 995608 - RNA, 18 nt, Homo sapiens
uuccagguguuacuguaa

SEQ ID NO: 995609 - RNA, 14 nt, Homo sapiens
uuccaugacugcuu

SEQ ID NO: 995610 - RNA, 13 nt, Homo sapiens
uucccacgaggaa

SEQ ID NO: 995611 - RNA, 11 nt, Homo sapiens
uuccccaguga

SEQ ID NO: 995612 - RNA, 13 nt, Homo sapiens
uucccccacugau

SEQ ID NO: 995613 - RNA, 12 nt, Homo sapiens
uucccuaucacu

SEQ ID NO: 995614 - RNA, 12 nt, Homo sapiens
uucccucuggga

SEQ ID NO: 995615 - RNA, 15 nt, Homo sapiens
uuccuaauacuguca

SEQ ID NO: 995616 - RNA, 19 nt, Homo sapiens
uuccucccuauuaaccuag

SEQ ID NO: 995617 - RNA, 18 nt, Homo sapiens
uuccucgccugacaacca

SEQ ID NO: 995618 - RNA, 22 nt, Homo sapiens
uuccugaccuccgccauccacc

SEQ ID NO: 995619 - RNA, 14 nt, Homo sapiens
uuccugcacauuaa

SEQ ID NO: 995620 - RNA, 17 nt, Homo sapiens
uuccuguccucuuucag

SEQ ID NO: 995621 - RNA, 16 nt, Homo sapiens
uuccugucuuauccuc

SEQ ID NO: 995622 - RNA, 21 nt, Homo sapiens
uuccuguuuaaaaaaccacau

SEQ ID NO: 995623 - RNA, 14 nt, Homo sapiens
uuccuguuugucua

SEQ ID NO: 995624 - RNA, 21 nt, Homo sapiens
uuccuuccaaugucuggagac

SEQ ID NO: 995625 - RNA, 12 nt, Homo sapiens
uuccuucccaaa

SEQ ID NO: 995626 - RNA, 21 nt, Homo sapiens
uuccuugaauguggcuugaga

SEQ ID NO: 995627 - RNA, 23 nt, Homo sapiens
uuccuuuaacaacauguuuccag

SEQ ID NO: 995628 - RNA, 21 nt, Homo sapiens
uucgcugagccccugagccca

SEQ ID NO: 995629 - RNA, 21 nt, Homo sapiens
uucuaaaaucuuauaguucua

SEQ ID NO: 995630 - RNA, 17 nt, Homo sapiens
uucuaaaguucuaagau

SEQ ID NO: 995631 - RNA, 23 nt, Homo sapiens
uucuaagacucaaauguucuaag

SEQ ID NO: 995632 - RNA, 21 nt, Homo sapiens
uucuaagaugugauauucuaa

SEQ ID NO: 995633 - RNA, 13 nt, Homo sapiens
uucuaagauucug

SEQ ID NO: 995634 - RNA, 21 nt, Homo sapiens
uucuaaggccuaggauucuaa

SEQ ID NO: 995635 - RNA, 23 nt, Homo sapiens
uucuaagguccgguguucuaaga

SEQ ID NO: 995636 - RNA, 18 nt, Homo sapiens
uucuacagccucagaaac

SEQ ID NO: 995637 - RNA, 17 nt, Homo sapiens
uucucagguguugccaa

SEQ ID NO: 995638 - RNA, 23 nt, Homo sapiens
uucucccuguacaguguuaccau

SEQ ID NO: 995639 - RNA, 15 nt, Homo sapiens
uucuccucacuguau

SEQ ID NO: 995640 - RNA, 16 nt, Homo sapiens
uucucugugucuaaga

SEQ ID NO: 995641 - RNA, 13 nt, Homo sapiens
uucucuugccuca

SEQ ID NO: 995642 - RNA, 13 nt, Homo sapiens
uucugcacuugcg

SEQ ID NO: 995643 - RNA, 22 nt, Homo sapiens
uucugcaggcuucagccaucca

SEQ ID NO: 995644 - RNA, 14 nt, Homo sapiens
uucuggaauguaau

SEQ ID NO: 995645 - RNA, 13 nt, Homo sapiens
uucuguaccaguu

SEQ ID NO: 995646 - RNA, 12 nt, Homo sapiens
uucuuacacugu

SEQ ID NO: 995647 - RNA, 14 nt, Homo sapiens
uucuucaucccacu

SEQ ID NO: 995648 - RNA, 19 nt, Homo sapiens
uucuucuaauuaacagcuc

SEQ ID NO: 995649 - RNA, 12 nt, Homo sapiens
uucuugccucau

SEQ ID NO: 995650 - RNA, 21 nt, Homo sapiens
uucuugugcacuggcaccaag

SEQ ID NO: 995651 - RNA, 17 nt, Homo sapiens
uucuuugggccagacau

SEQ ID NO: 995652 - RNA, 12 nt, Homo sapiens
uugaaaaacuaa

SEQ ID NO: 995653 - RNA, 17 nt, Homo sapiens
uugaaaaagacauucag

SEQ ID NO: 995654 - RNA, 23 nt, Homo sapiens
uugaaaaaguuuggaagcacuga

SEQ ID NO: 995655 - RNA, 13 nt, Homo sapiens
uugaaaaugggcu

SEQ ID NO: 995656 - RNA, 14 nt, Homo sapiens
uugaaauaaacagg

SEQ ID NO: 995657 - RNA, 20 nt, Homo sapiens
uugaaauuaagaaggcaaaa

SEQ ID NO: 995658 - RNA, 16 nt, Homo sapiens
uugaagccacugccuu

SEQ ID NO: 995659 - RNA, 14 nt, Homo sapiens
uugaagugagcuga

SEQ ID NO: 995660 - RNA, 22 nt, Homo sapiens
uugaauuaauaucccuacaugu

SEQ ID NO: 995661 - RNA, 13 nt, Homo sapiens
uugacaacaguua

SEQ ID NO: 995662 - RNA, 11 nt, Homo sapiens
uugaccaaaga

SEQ ID NO: 995663 - RNA, 12 nt, Homo sapiens
uugagauccaaa

SEQ ID NO: 995664 - RNA, 20 nt, Homo sapiens
uugagcaguggcugguccag

SEQ ID NO: 995665 - RNA, 10 nt, Homo sapiens
uugagcccag

SEQ ID NO: 995666 - RNA, 14 nt, Homo sapiens
uugagcucuauuau

SEQ ID NO: 995667 - RNA, 22 nt, Homo sapiens
uugagcucuauuaugaauguga

SEQ ID NO: 995668 - RNA, 17 nt, Homo sapiens
uugagcucuucuuaaag

SEQ ID NO: 995669 - RNA, 16 nt, Homo sapiens
uugagucaccaugcca

SEQ ID NO: 995670 - RNA, 23 nt, Homo sapiens
uugauagaaaugccaagcacuuc

SEQ ID NO: 995671 - RNA, 22 nt, Homo sapiens
uugaucuggaacccagacucag

SEQ ID NO: 995672 - RNA, 15 nt, Homo sapiens
uugauuucauuaaua

SEQ ID NO: 995673 - RNA, 13 nt, Homo sapiens
uugauuugcucuu

SEQ ID NO: 995674 - RNA, 24 nt, Homo sapiens
uugcaaccuaccuguugagcauca

SEQ ID NO: 995675 - RNA, 16 nt, Homo sapiens
uugcaacucuguaaau

SEQ ID NO: 995676 - RNA, 20 nt, Homo sapiens
uugcacacuuugguaccaga

SEQ ID NO: 995677 - RNA, 21 nt, Homo sapiens
uugcaccacugcacuccaguc

SEQ ID NO: 995678 - RNA, 18 nt, Homo sapiens
uugcagacaggaaucuua

SEQ ID NO: 995679 - RNA, 22 nt, Homo sapiens
uugcagcaagcaauaaacacaa

SEQ ID NO: 995680 - RNA, 20 nt, Homo sapiens
uugcaggauggugucucuuc

SEQ ID NO: 995681 - RNA, 16 nt, Homo sapiens
uugcaggguccucuuc

SEQ ID NO: 995682 - RNA, 21 nt, Homo sapiens
uugcaguucccacauuaaaga

SEQ ID NO: 995683 - RNA, 21 nt, Homo sapiens
uguggugagggaagacgccuu

SEQ ID NO: 995684 - RNA, 21 nt, Homo sapiens
uguguaacugcccaaagcagc

SEQ ID NO: 995685 - RNA, 15 nt, Homo sapiens
uguguacagaccucc

SEQ ID NO: 995686 - RNA, 16 nt, Homo sapiens
uguguaugcacaugaa

SEQ ID NO: 995687 - RNA, 21 nt, Homo sapiens
uguguccucuuccaccacaga

SEQ ID NO: 995688 - RNA, 15 nt, Homo sapiens
ugugugaguauguau

SEQ ID NO: 995689 - RNA, 16 nt, Homo sapiens
uguguggcagagccag

SEQ ID NO: 995690 - RNA, 15 nt, Homo sapiens
uguguguugauacug

SEQ ID NO: 995691 - RNA, 17 nt, Homo sapiens
uguguuggcuguggcag

SEQ ID NO: 995692 - RNA, 18 nt, Homo sapiens
uguguuuuuaacauguca

SEQ ID NO: 995693 - RNA, 15 nt, Homo sapiens
uguuaaauacaggaa

SEQ ID NO: 995694 - RNA, 12 nt, Homo sapiens
uguuaacacuca

SEQ ID NO: 995695 - RNA, 13 nt, Homo sapiens
uguuaacacucau

SEQ ID NO: 995696 - RNA, 14 nt, Homo sapiens
uguuaccuguagau

SEQ ID NO: 995697 - RNA, 12 nt, Homo sapiens
uguuaugugauc

SEQ ID NO: 995698 - RNA, 17 nt, Homo sapiens
uguuaugugcaaguuua

SEQ ID NO: 995699 - RNA, 19 nt, Homo sapiens
uguucaacuaggaucagaa

SEQ ID NO: 995700 - RNA, 16 nt, Homo sapiens
uguucauggacuauuc

SEQ ID NO: 995701 - RNA, 13 nt, Homo sapiens
uguuccccagaga

SEQ ID NO: 995702 - RNA, 16 nt, Homo sapiens
uguucccccugugcag

SEQ ID NO: 995703 - RNA, 14 nt, Homo sapiens
uguucccugacucc

SEQ ID NO: 995704 - RNA, 22 nt, Homo sapiens
uguucgggccaaggaccugaga

SEQ ID NO: 995705 - RNA, 15 nt, Homo sapiens
uguucugucaccaau

SEQ ID NO: 995706 - RNA, 16 nt, Homo sapiens
uguucugucccuugcc

SEQ ID NO: 995707 - RNA, 19 nt, Homo sapiens
uguucuguuugcuguggaa

SEQ ID NO: 995708 - RNA, 13 nt, Homo sapiens
uguucuuccucag

SEQ ID NO: 995709 - RNA, 17 nt, Homo sapiens
uguugagcaucacagaa

SEQ ID NO: 995710 - RNA, 14 nt, Homo sapiens
uguugcacgugugu

SEQ ID NO: 995711 - RNA, 17 nt, Homo sapiens
uguugcuuccguucaug

SEQ ID NO: 995712 - RNA, 19 nt, Homo sapiens
uguuggagguuaaggcaua

SEQ ID NO: 995713 - RNA, 16 nt, Homo sapiens
uguuggcauagcucug

SEQ ID NO: 995714 - RNA, 18 nt, Homo sapiens
uguuggcguaggcuacag

SEQ ID NO: 995715 - RNA, 15 nt, Homo sapiens
uguuggggggaugag

SEQ ID NO: 995716 - RNA, 16 nt, Homo sapiens
uguuuauucuauaguu

SEQ ID NO: 995717 - RNA, 18 nt, Homo sapiens
uguuuauuuaaugcugug

SEQ ID NO: 995718 - RNA, 14 nt, Homo sapiens
uguuucacaguuug

SEQ ID NO: 995719 - RNA, 14 nt, Homo sapiens
uguuucuguuccaa

SEQ ID NO: 995720 - RNA, 21 nt, Homo sapiens
uguuucuuaagggcacacaca

SEQ ID NO: 995721 - RNA, 20 nt, Homo sapiens
uguuucuugccugaacuccu

SEQ ID NO: 995722 - RNA, 22 nt, Homo sapiens
uguuucuugccugaacuccugc

SEQ ID NO: 995723 - RNA, 21 nt, Homo sapiens
uguuugcuucaugugucccag

SEQ ID NO: 995724 - RNA, 20 nt, Homo sapiens
uguuuucucuggaguauucu

SEQ ID NO: 995725 - RNA, 15 nt, Homo sapiens
uguuuugcuaaagga

SEQ ID NO: 995726 - RNA, 11 nt, Homo sapiens
uguuuuuaccu

SEQ ID NO: 995727 - RNA, 23 nt, Homo sapiens
uguuuuuugccacagcuuuugca

SEQ ID NO: 995728 - RNA, 17 nt, Homo sapiens
uuaaaaaaauaagaaga

SEQ ID NO: 995729 - RNA, 21 nt, Homo sapiens
uuaaaaaagauaaacacaaga

SEQ ID NO: 995730 - RNA, 21 nt, Homo sapiens
uuaaaaauuguuaauuuuucc

SEQ ID NO: 995731 - RNA, 17 nt, Homo sapiens
uuaaaacuugaaguagg

SEQ ID NO: 995732 - RNA, 14 nt, Homo sapiens
uuaaaauagcaaaa

SEQ ID NO: 995733 - RNA, 14 nt, Homo sapiens
uuaaaaucaguauu

SEQ ID NO: 995734 - RNA, 18 nt, Homo sapiens
uuaaaaucugucacguag

SEQ ID NO: 995735 - RNA, 18 nt, Homo sapiens
uuaaacuauaagcaagaa

SEQ ID NO: 995736 - RNA, 15 nt, Homo sapiens
uuaaagagucuagau

SEQ ID NO: 995737 - RNA, 15 nt, Homo sapiens
uuaaaugacacucau

SEQ ID NO: 995738 - RNA, 19 nt, Homo sapiens
uuaaauuuugaaaacugug

SEQ ID NO: 995739 - RNA, 21 nt, Homo sapiens
uuaacaacauguuuccagcau

SEQ ID NO: 995740 - RNA, 16 nt, Homo sapiens
uuaacauaagcuauuu

SEQ ID NO: 995741 - RNA, 19 nt, Homo sapiens
uuaacuccuccugagcucu

SEQ ID NO: 995742 - RNA, 23 nt, Homo sapiens
uuaacugaauaccacucuguaau

SEQ ID NO: 995743 - RNA, 15 nt, Homo sapiens
uuaagaaaaaagugu

SEQ ID NO: 995744 - RNA, 16 nt, Homo sapiens
uuaagaggauuuuaac

SEQ ID NO: 995745 - RNA, 14 nt, Homo sapiens
uuaagcaucagaaa

SEQ ID NO: 995746 - RNA, 17 nt, Homo sapiens
uuaagcucugcuauuag

SEQ ID NO: 995747 - RNA, 18 nt, Homo sapiens
uuaauauacuugaaugaa

SEQ ID NO: 995748 - RNA, 17 nt, Homo sapiens
uuaaugcacuuucuauc

SEQ ID NO: 995749 - RNA, 17 nt, Homo sapiens
uuaauggggaggacaaa

SEQ ID NO: 995750 - RNA, 20 nt, Homo sapiens
uuaauugaucgacuugccaa

SEQ ID NO: 995751 - RNA, 19 nt, Homo sapiens
uuaauuuaguaaaccaauc

SEQ ID NO: 995752 - RNA, 19 nt, Homo sapiens
uuaauuuuugauacuaagc

SEQ ID NO: 995753 - RNA, 22 nt, Homo sapiens
uuacaaaaucagguaacuaacu

SEQ ID NO: 995754 - RNA, 23 nt, Homo sapiens
uuacaacuugaaauugcuuugcu

SEQ ID NO: 995755 - RNA, 20 nt, Homo sapiens
uuacacuuuuuggaagugaa

SEQ ID NO: 995756 - RNA, 11 nt, Homo sapiens
uuacagaauuu

SEQ ID NO: 995757 - RNA, 23 nt, Homo sapiens
uuaccaaagaugaaugaagcaaa

SEQ ID NO: 995758 - RNA, 20 nt, Homo sapiens
uuaccaucacugaguuuucc

SEQ ID NO: 995759 - RNA, 14 nt, Homo sapiens
uuaccuuguauacu

SEQ ID NO: 995760 - RNA, 12 nt, Homo sapiens
uuaccuuucaua

SEQ ID NO: 995761 - RNA, 21 nt, Homo sapiens
uuacuauaagaacuuugagcu

SEQ ID NO: 995762 - RNA, 23 nt, Homo sapiens
uuacucuaagaucuuagauucuc

SEQ ID NO: 995763 - RNA, 23 nt, Homo sapiens
uuacucuauacauucaacagaga

SEQ ID NO: 995764 - RNA, 12 nt, Homo sapiens
uuacugcuugac

SEQ ID NO: 995765 - RNA, 18 nt, Homo sapiens
uuacugcuugaccaaaga

SEQ ID NO: 995766 - RNA, 13 nt, Homo sapiens
uuagaaaggggug

SEQ ID NO: 995767 - RNA, 23 nt, Homo sapiens
uuagauguucuaagucuuuccau

SEQ ID NO: 995768 - RNA, 12 nt, Homo sapiens
uuagcagacagg

SEQ ID NO: 995769 - RNA, 16 nt, Homo sapiens
uuagcauguuguugaa

SEQ ID NO: 995770 - RNA, 20 nt, Homo sapiens
uuagcuuuagaaacagugca

SEQ ID NO: 995771 - RNA, 22 nt, Homo sapiens
uuagucccgauaggguauuuga

SEQ ID NO: 995772 - RNA, 18 nt, Homo sapiens
uuaguguggcuaaccaag

SEQ ID NO: 995773 - RNA, 20 nt, Homo sapiens
uuauaaaaaugagugcuuaa

SEQ ID NO: 995774 - RNA, 16 nt, Homo sapiens
uuauacgcuggcaaca

SEQ ID NO: 995775 - RNA, 22 nt, Homo sapiens
uuauacucaccugcguuuucau

SEQ ID NO: 995776 - RNA, 21 nt, Homo sapiens
uuauacuucucuauuaucuca

SEQ ID NO: 995777 - RNA, 13 nt, Homo sapiens
uuauauaaucaau

SEQ ID NO: 995778 - RNA, 14 nt, Homo sapiens
uuauauuuugcagu

SEQ ID NO: 995779 - RNA, 18 nt, Homo sapiens
uuaucaccgugggcuccc

SEQ ID NO: 995780 - RNA, 22 nt, Homo sapiens
uuaucaccgugggcucccugac

SEQ ID NO: 995781 - RNA, 16 nt, Homo sapiens
uuaucacuuaaacuug

SEQ ID NO: 995782 - RNA, 20 nt, Homo sapiens
uuaugaaaccuguacauaug

SEQ ID NO: 995783 - RNA, 23 nt, Homo sapiens
uuaugaagaaggugaauagccau

SEQ ID NO: 995784 - RNA, 20 nt, Homo sapiens
uuaugaucuggcccuugcuu

SEQ ID NO: 995785 - RNA, 20 nt, Homo sapiens
uuaugguaccagaugcagcu

SEQ ID NO: 995786 - RNA, 19 nt, Homo sapiens
ugggcaaaagcuuacaaau

SEQ ID NO: 995787 - RNA, 13 nt, Homo sapiens
ugggcagagccca

SEQ ID NO: 995788 - RNA, 18 nt, Homo sapiens
ugggcaugagggguuccu

SEQ ID NO: 995789 - RNA, 15 nt, Homo sapiens
ugggccauguccaaa

SEQ ID NO: 995790 - RNA, 14 nt, Homo sapiens
ugggccugcuccag

SEQ ID NO: 995791 - RNA, 16 nt, Homo sapiens
ugggccuugggcuccg

SEQ ID NO: 995792 - RNA, 15 nt, Homo sapiens
ugggcgcugguccuu

SEQ ID NO: 995793 - RNA, 15 nt, Homo sapiens
uggggaaaaaacugu

SEQ ID NO: 995794 - RNA, 19 nt, Homo sapiens
uggggaguaggacauacca

SEQ ID NO: 995795 - RNA, 24 nt, Homo sapiens
uggggcaggcugggccauguccaa

SEQ ID NO: 995796 - RNA, 15 nt, Homo sapiens
uggggccagauccag

SEQ ID NO: 995797 - RNA, 16 nt, Homo sapiens
uggguauguguuuauu

SEQ ID NO: 995798 - RNA, 14 nt, Homo sapiens
uggguuaaguauua

SEQ ID NO: 995799 - RNA, 15 nt, Homo sapiens
uggguuaaguauuau

SEQ ID NO: 995800 - RNA, 20 nt, Homo sapiens
uggguuuugggucuuugaac

SEQ ID NO: 995801 - RNA, 17 nt, Homo sapiens
uggguuuugugccuuug

SEQ ID NO: 995802 - RNA, 13 nt, Homo sapiens
ugguaagcauugu

SEQ ID NO: 995803 - RNA, 16 nt, Homo sapiens
ugguaauauguuacaa

SEQ ID NO: 995804 - RNA, 20 nt, Homo sapiens
ugguaauauugacuuguaua

SEQ ID NO: 995805 - RNA, 13 nt, Homo sapiens
ugguaccagauaa

SEQ ID NO: 995806 - RNA, 21 nt, Homo sapiens
ugguacugacuuugcuugcuu

SEQ ID NO: 995807 - RNA, 15 nt, Homo sapiens
ugguaggcauuuccu

SEQ ID NO: 995808 - RNA, 15 nt, Homo sapiens
uggucacacacugau

SEQ ID NO: 995809 - RNA, 20 nt, Homo sapiens
uggucacccuucaacgcucc

SEQ ID NO: 995810 - RNA, 15 nt, Homo sapiens
uggucaggagccucu

SEQ ID NO: 995811 - RNA, 20 nt, Homo sapiens
uggucagugguggucuucaa

SEQ ID NO: 995812 - RNA, 18 nt, Homo sapiens
ugguccccuccuucccaa

SEQ ID NO: 995813 - RNA, 19 nt, Homo sapiens
ugguccccuccuucccaag

SEQ ID NO: 995814 - RNA, 17 nt, Homo sapiens
uggucuacccgugucua

SEQ ID NO: 995815 - RNA, 14 nt, Homo sapiens
uggugcaaguugag

SEQ ID NO: 995816 - RNA, 14 nt, Homo sapiens
uggugccaaacaaa

SEQ ID NO: 995817 - RNA, 16 nt, Homo sapiens
uggugccaccucagac

SEQ ID NO: 995818 - RNA, 18 nt, Homo sapiens
ugguggcauuguuuacag

SEQ ID NO: 995819 - RNA, 16 nt, Homo sapiens
ugguguauaagccauc

SEQ ID NO: 995820 - RNA, 23 nt, Homo sapiens
ugguuacucaaaagaacaagagu

SEQ ID NO: 995821 - RNA, 16 nt, Homo sapiens
ugguugaugccaaaaa

SEQ ID NO: 995822 - RNA, 18 nt, Homo sapiens
ugguuucccaagagcuac

SEQ ID NO: 995823 - RNA, 11 nt, Homo sapiens
ugguuuugcuc

SEQ ID NO: 995824 - RNA, 20 nt, Homo sapiens
uguaaacuuuuugugcugaa

SEQ ID NO: 995825 - RNA, 19 nt, Homo sapiens
uguaaagauguuuauuuca

SEQ ID NO: 995826 - RNA, 20 nt, Homo sapiens
uguaaaguaaaagcuauaaa

SEQ ID NO: 995827 - RNA, 17 nt, Homo sapiens
uguaaauagaaccagcc

SEQ ID NO: 995828 - RNA, 15 nt, Homo sapiens
uguaaaucugccaca

SEQ ID NO: 995829 - RNA, 16 nt, Homo sapiens
uguaaauuuguacuau

SEQ ID NO: 995830 - RNA, 21 nt, Homo sapiens
uguaacaauuguguagccuuu

SEQ ID NO: 995831 - RNA, 11 nt, Homo sapiens
uguaacugccc

SEQ ID NO: 995832 - RNA, 16 nt, Homo sapiens
uguaacuuuacaguua

SEQ ID NO: 995833 - RNA, 22 nt, Homo sapiens
uguaagaaauacagacuggaug

SEQ ID NO: 995834 - RNA, 14 nt, Homo sapiens
uguaagcacugacu

SEQ ID NO: 995835 - RNA, 17 nt, Homo sapiens
uguaagguacuuucaua

SEQ ID NO: 995836 - RNA, 14 nt, Homo sapiens
uguaaugucuugag

SEQ ID NO: 995837 - RNA, 20 nt, Homo sapiens
uguaauuaaaagcaaaucau

SEQ ID NO: 995838 - RNA, 20 nt, Homo sapiens
uguacaguagauuuuccaaa

SEQ ID NO: 995839 - RNA, 22 nt, Homo sapiens
uguacauaugugugugugggua

SEQ ID NO: 995840 - RNA, 23 nt, Homo sapiens
uguacaucuauuuuggauuguau

SEQ ID NO: 995841 - RNA, 14 nt, Homo sapiens
uguacuaaagccaa

SEQ ID NO: 995842 - RNA, 18 nt, Homo sapiens
uguacucuuuagaucucc

SEQ ID NO: 995843 - RNA, 19 nt, Homo sapiens
uguagaaaaaaaaauucac

SEQ ID NO: 995844 - RNA, 23 nt, Homo sapiens
uguagaaaaaaaaauucacauga

SEQ ID NO: 995845 - RNA, 20 nt, Homo sapiens
uguagagauggggucucaca

SEQ ID NO: 995846 - RNA, 15 nt, Homo sapiens
uguagcagucacuga

SEQ ID NO: 995847 - RNA, 18 nt, Homo sapiens
uguaguaaauaaugcuuu

SEQ ID NO: 995848 - RNA, 16 nt, Homo sapiens
uguagugcuacagggu

SEQ ID NO: 995849 - RNA, 14 nt, Homo sapiens
uguaguuccacuua

SEQ ID NO: 995850 - RNA, 16 nt, Homo sapiens
uguauaaaauagacaa

SEQ ID NO: 995851 - RNA, 15 nt, Homo sapiens
uguaucaaaugugac

SEQ ID NO: 995852 - RNA, 21 nt, Homo sapiens
uguauucucugagcugugcag

SEQ ID NO: 995853 - RNA, 20 nt, Homo sapiens
ugucaagaauagcauuguaa

SEQ ID NO: 995854 - RNA, 16 nt, Homo sapiens
ugucaagcugaguauu

SEQ ID NO: 995855 - RNA, 22 nt, Homo sapiens
ugucaccaagcuaggugcuauu

SEQ ID NO: 995856 - RNA, 15 nt, Homo sapiens
ugucacuaaagcagg

SEQ ID NO: 995857 - RNA, 18 nt, Homo sapiens
ugucagggaguguucccu

SEQ ID NO: 995858 - RNA, 18 nt, Homo sapiens
ugucaguucuaaccuccu

SEQ ID NO: 995859 - RNA, 21 nt, Homo sapiens
ugucauacagagaagucacag

SEQ ID NO: 995860 - RNA, 15 nt, Homo sapiens
ugucaucugugcacu

SEQ ID NO: 995861 - RNA, 18 nt, Homo sapiens
uguccaaaacugccucag

SEQ ID NO: 995862 - RNA, 12 nt, Homo sapiens
uguccaaagagg

SEQ ID NO: 995863 - RNA, 20 nt, Homo sapiens
ugucccggggcuccacugaa

SEQ ID NO: 995864 - RNA, 19 nt, Homo sapiens
uguccucagccuugccaga

SEQ ID NO: 995865 - RNA, 22 nt, Homo sapiens
uguccucagccuugccagagau

SEQ ID NO: 995866 - RNA, 21 nt, Homo sapiens
uguccugccuguggccaugac

SEQ ID NO: 995867 - RNA, 12 nt, Homo sapiens
uguccuuuauga

SEQ ID NO: 995868 - RNA, 22 nt, Homo sapiens
uguccuuucuagagcacugcca

SEQ ID NO: 995869 - RNA, 18 nt, Homo sapiens
ugucgguuaccucugcau

SEQ ID NO: 995870 - RNA, 23 nt, Homo sapiens
ugucuacacacccugcauaucau

SEQ ID NO: 995871 - RNA, 16 nt, Homo sapiens
ugucucuguuuuacaa

SEQ ID NO: 995872 - RNA, 19 nt, Homo sapiens
ugucuguggcaaaaguuua

SEQ ID NO: 995873 - RNA, 15 nt, Homo sapiens
ugugaaacuuucauu

SEQ ID NO: 995874 - RNA, 16 nt, Homo sapiens
ugugaaauuuacauca

SEQ ID NO: 995875 - RNA, 19 nt, Homo sapiens
ugugaggagguagauuugg

SEQ ID NO: 995876 - RNA, 20 nt, Homo sapiens
ugugauauauaaguguacau

SEQ ID NO: 995877 - RNA, 17 nt, Homo sapiens
ugugauuagacagaaca

SEQ ID NO: 995878 - RNA, 15 nt, Homo sapiens
ugugcaaaugugcug

SEQ ID NO: 995879 - RNA, 23 nt, Homo sapiens
ugugcaauguguauaaacaagaa

SEQ ID NO: 995880 - RNA, 15 nt, Homo sapiens
ugugcacacauauac

SEQ ID NO: 995881 - RNA, 18 nt, Homo sapiens
ugugcaguccuggguccu

SEQ ID NO: 995882 - RNA, 12 nt, Homo sapiens
ugugccagguga

SEQ ID NO: 995883 - RNA, 17 nt, Homo sapiens
ugugcccccaggguccu

SEQ ID NO: 995884 - RNA, 21 nt, Homo sapiens
ugugccccuuccgccacuggg

SEQ ID NO: 995885 - RNA, 21 nt, Homo sapiens
ugugccccuugacaacuggca

SEQ ID NO: 995886 - RNA, 21 nt, Homo sapiens
ugugcuggaaagcguugaugg

SEQ ID NO: 995887 - RNA, 17 nt, Homo sapiens
uguggacuccaugccuc

SEQ ID NO: 995888 - RNA, 16 nt, Homo sapiens
uguggucacagcugua

SEQ ID NO: 995889 - RNA, 22 nt, Homo sapiens
agacacugaaaaaucuaaguga

SEQ ID NO: 995890 - RNA, 22 nt, Homo sapiens
agacagagcccugugaggcugg

SEQ ID NO: 995891 - RNA, 18 nt, Homo sapiens
agacaggguuucaccaug

SEQ ID NO: 995892 - RNA, 22 nt, Homo sapiens
agacaggguuucaccauguuag

SEQ ID NO: 995893 - RNA, 13 nt, Homo sapiens
agacauacuugaa

SEQ ID NO: 995894 - RNA, 16 nt, Homo sapiens
agacaucagcccuugg

SEQ ID NO: 995895 - RNA, 21 nt, Homo sapiens
agacauuggcaccuaauccag

SEQ ID NO: 995896 - RNA, 14 nt, Homo sapiens
agaccauaauguua

SEQ ID NO: 995897 - RNA, 15 nt, Homo sapiens
agaccauaauguuac

SEQ ID NO: 995898 - RNA, 23 nt, Homo sapiens
agacccccuccccuccugugucc

SEQ ID NO: 995899 - RNA, 17 nt, Homo sapiens
agacccgauuccaccaa

SEQ ID NO: 995900 - RNA, 23 nt, Homo sapiens
agacccuugacaccugcugagaa

SEQ ID NO: 995901 - RNA, 14 nt, Homo sapiens
agaccuccagcugu

SEQ ID NO: 995902 - RNA, 19 nt, Homo sapiens
agaccuguaaucauauaau

SEQ ID NO: 995903 - RNA, 18 nt, Homo sapiens
agaccuguguuacuaaaa

SEQ ID NO: 995904 - RNA, 19 nt, Homo sapiens
agacgccuuucuccuccaa

SEQ ID NO: 995905 - RNA, 15 nt, Homo sapiens
agacgcugcugucac

SEQ ID NO: 995906 - RNA, 23 nt, Homo sapiens
agacgcugcugucacaaccaaga

SEQ ID NO: 995907 - RNA, 15 nt, Homo sapiens
agacuagagggcaga

SEQ ID NO: 995908 - RNA, 22 nt, Homo sapiens
agacuagauggaccugccugca

SEQ ID NO: 995909 - RNA, 19 nt, Homo sapiens
agacuagauguaguauuuu

SEQ ID NO: 995910 - RNA, 21 nt, Homo sapiens
agacuaucuuacuauuucaca

SEQ ID NO: 995911 - RNA, 19 nt, Homo sapiens
agacuauuaggugcaauuu

SEQ ID NO: 995912 - RNA, 19 nt, Homo sapiens
agacucagacauuggcacc

SEQ ID NO: 995913 - RNA, 14 nt, Homo sapiens
agacuggcuuuuau

SEQ ID NO: 995914 - RNA, 11 nt, Homo sapiens
agacuucccag

SEQ ID NO: 995915 - RNA, 19 nt, Homo sapiens
agacuucucuuugccucaa

SEQ ID NO: 995916 - RNA, 21 nt, Homo sapiens
agacuuugcuaaagacaugaa

SEQ ID NO: 995917 - RNA, 22 nt, Homo sapiens
agagaacaaugugcuaugugaa

SEQ ID NO: 995918 - RNA, 16 nt, Homo sapiens
agagaaccucagauca

SEQ ID NO: 995919 - RNA, 22 nt, Homo sapiens
agagaaccucagaucaggugca

SEQ ID NO: 995920 - RNA, 15 nt, Homo sapiens
agagaagcauucuca

SEQ ID NO: 995921 - RNA, 17 nt, Homo sapiens
agagaaggaggggagca

SEQ ID NO: 995922 - RNA, 17 nt, Homo sapiens
agagaagucacagggca

SEQ ID NO: 995923 - RNA, 17 nt, Homo sapiens
agagaaucaacauuucu

SEQ ID NO: 995924 - RNA, 12 nt, Homo sapiens
agagacacuggu

SEQ ID NO: 995925 - RNA, 19 nt, Homo sapiens
agagaccucaaauuacuuu

SEQ ID NO: 995926 - RNA, 20 nt, Homo sapiens
agagagcaccuggugaucac

SEQ ID NO: 995927 - RNA, 21 nt, Homo sapiens
agagagucuggauaacuucca

SEQ ID NO: 995928 - RNA, 20 nt, Homo sapiens
agagaugccucccugagcua

SEQ ID NO: 995929 - RNA, 12 nt, Homo sapiens
agagccacugcc

SEQ ID NO: 995930 - RNA, 14 nt, Homo sapiens
agagccacugccau

SEQ ID NO: 995931 - RNA, 15 nt, Homo sapiens
agagcccaggagcuc

SEQ ID NO: 995932 - RNA, 18 nt, Homo sapiens
agagccuguaaacuuuau

SEQ ID NO: 995933 - RNA, 22 nt, Homo sapiens
agagcggaaggagggagcucug

SEQ ID NO: 995934 - RNA, 20 nt, Homo sapiens
agaggagccaccaguucuca

SEQ ID NO: 995935 - RNA, 19 nt, Homo sapiens
agaggcugaggcuggcaca

SEQ ID NO: 995936 - RNA, 20 nt, Homo sapiens
agaggcugaggcuggcacag

SEQ ID NO: 995937 - RNA, 22 nt, Homo sapiens
agagggacagaugaaugccgug

SEQ ID NO: 995938 - RNA, 16 nt, Homo sapiens
agaguaaugaggcuug

SEQ ID NO: 995939 - RNA, 13 nt, Homo sapiens
agagucuaaagau

SEQ ID NO: 995940 - RNA, 15 nt, Homo sapiens
agagucuccaguuua

SEQ ID NO: 995941 - RNA, 22 nt, Homo sapiens
agagugacauccaggaggaaua

SEQ ID NO: 995942 - RNA, 18 nt, Homo sapiens
agaguuugccuguucuau

SEQ ID NO: 995943 - RNA, 13 nt, Homo sapiens
agauaacuaggaa

SEQ ID NO: 995944 - RNA, 17 nt, Homo sapiens
agauaauuauaauauac

SEQ ID NO: 995945 - RNA, 17 nt, Homo sapiens
agauacauacagaauua

SEQ ID NO: 995946 - RNA, 16 nt, Homo sapiens
acucuggagcauuucu

SEQ ID NO: 995947 - RNA, 19 nt, Homo sapiens
acucuggcugcucccugac

SEQ ID NO: 995948 - RNA, 20 nt, Homo sapiens
acucuuagcuaaaucccucc

SEQ ID NO: 995949 - RNA, 12 nt, Homo sapiens
acucuucuugca

SEQ ID NO: 995950 - RNA, 21 nt, Homo sapiens
acucuuuuuuaugccuauucu

SEQ ID NO: 995951 - RNA, 19 nt, Homo sapiens
acugaaucugcuaccaaaa

SEQ ID NO: 995952 - RNA, 23 nt, Homo sapiens
acugaaugagaaccaacaaguaa

SEQ ID NO: 995953 - RNA, 22 nt, Homo sapiens
acugaccccaucaccuacucac

SEQ ID NO: 995954 - RNA, 20 nt, Homo sapiens
acugagccuccacagcagug

SEQ ID NO: 995955 - RNA, 17 nt, Homo sapiens
acugcaaacaguguucu

SEQ ID NO: 995956 - RNA, 19 nt, Homo sapiens
acugcaaugccaguuuccu

SEQ ID NO: 995957 - RNA, 14 nt, Homo sapiens
acugcauaaauaac

SEQ ID NO: 995958 - RNA, 19 nt, Homo sapiens
acugccaggagggacaaag

SEQ ID NO: 995959 - RNA, 22 nt, Homo sapiens
acugccaggcucucuuugccca

SEQ ID NO: 995960 - RNA, 22 nt, Homo sapiens
acugcuacagcaauuucuaauu

SEQ ID NO: 995961 - RNA, 13 nt, Homo sapiens
acugcucugagaa

SEQ ID NO: 995962 - RNA, 14 nt, Homo sapiens
acugcucugagaau

SEQ ID NO: 995963 - RNA, 19 nt, Homo sapiens
acugcugcaaauacuguau

SEQ ID NO: 995964 - RNA, 18 nt, Homo sapiens
acugcuuggaacuggaau

SEQ ID NO: 995965 - RNA, 18 nt, Homo sapiens
acugcuuucuguuccaaa

SEQ ID NO: 995966 - RNA, 21 nt, Homo sapiens
acuggaaaacagaacacuuau

SEQ ID NO: 995967 - RNA, 13 nt, Homo sapiens
acuggauguacca

SEQ ID NO: 995968 - RNA, 14 nt, Homo sapiens
acuggcagcauuga

SEQ ID NO: 995969 - RNA, 19 nt, Homo sapiens
acuguaguaaauaaugcuu

SEQ ID NO: 995970 - RNA, 18 nt, Homo sapiens
acuguaguucacuguaga

SEQ ID NO: 995971 - RNA, 18 nt, Homo sapiens
acuguauuugaaauaaga

SEQ ID NO: 995972 - RNA, 14 nt, Homo sapiens
acugucccuugccu

SEQ ID NO: 995973 - RNA, 16 nt, Homo sapiens
acugucucgaacuauu

SEQ ID NO: 995974 - RNA, 23 nt, Homo sapiens
acugugccuuguuucaacaguuu

SEQ ID NO: 995975 - RNA, 18 nt, Homo sapiens
acuguucccccugugcag

SEQ ID NO: 995976 - RNA, 13 nt, Homo sapiens
acuguucuaaagc

SEQ ID NO: 995977 - RNA, 18 nt, Homo sapiens
acuguuuauacacugugu

SEQ ID NO: 995978 - RNA, 14 nt, Homo sapiens
acuuaaccuugcaa

SEQ ID NO: 995979 - RNA, 19 nt, Homo sapiens
acuuaagcccagugcacug

SEQ ID NO: 995980 - RNA, 22 nt, Homo sapiens
acuuaagcccagugcacugaaa

SEQ ID NO: 995981 - RNA, 15 nt, Homo sapiens
acuuacagaucuauc

SEQ ID NO: 995982 - RNA, 19 nt, Homo sapiens
acuuacagaucuaucuccu

SEQ ID NO: 995983 - RNA, 21 nt, Homo sapiens
acuuauaagaaagaucaaaga

SEQ ID NO: 995984 - RNA, 20 nt, Homo sapiens
acuucaaagaggaaccagga

SEQ ID NO: 995985 - RNA, 21 nt, Homo sapiens
acuucuccccuccucuugccu

SEQ ID NO: 995986 - RNA, 17 nt, Homo sapiens
acuucucuauuaucuca

SEQ ID NO: 995987 - RNA, 18 nt, Homo sapiens
acuucucuauuaucucaa

SEQ ID NO: 995988 - RNA, 16 nt, Homo sapiens
acuucucuuugccuca

SEQ ID NO: 995989 - RNA, 17 nt, Homo sapiens
acuucugcuuugcucuu

SEQ ID NO: 995990 - RNA, 19 nt, Homo sapiens
acuucuuguguguaugcac

SEQ ID NO: 995991 - RNA, 17 nt, Homo sapiens
acuugaaauucucauca

SEQ ID NO: 995992 - RNA, 13 nt, Homo sapiens
acuugaacccagg

SEQ ID NO: 995993 - RNA, 19 nt, Homo sapiens
acuugaaugcuaguuauac

SEQ ID NO: 995994 - RNA, 14 nt, Homo sapiens
acuugcaucacuua

SEQ ID NO: 995995 - RNA, 21 nt, Homo sapiens
acuugccuguucagagcacuc

SEQ ID NO: 995996 - RNA, 19 nt, Homo sapiens
acuugcucagguacuugua

SEQ ID NO: 995997 - RNA, 17 nt, Homo sapiens
acuuguaguuccacuua

SEQ ID NO: 995998 - RNA, 22 nt, Homo sapiens
acuuguuggcguaggcuacaga

SEQ ID NO: 995999 - RNA, 19 nt, Homo sapiens
acuuguuuuaaacuugccu

SEQ ID NO: 996000 - RNA, 19 nt, Homo sapiens
acuuuaaagcguuugcaca

SEQ ID NO: 996001 - RNA, 17 nt, Homo sapiens
acuuuacaaaaguauua

SEQ ID NO: 996002 - RNA, 15 nt, Homo sapiens
acuuuccaaacacca

SEQ ID NO: 996003 - RNA, 22 nt, Homo sapiens
acuuucccucugggauuugccc

SEQ ID NO: 996004 - RNA, 17 nt, Homo sapiens
acuuuccucgccugaca

SEQ ID NO: 996005 - RNA, 19 nt, Homo sapiens
agcugucccucacuguuga

SEQ ID NO: 996006 - RNA, 17 nt, Homo sapiens
agcugugaccugcugag

SEQ ID NO: 996007 - RNA, 17 nt, Homo sapiens
agcugugcaugcucagc

SEQ ID NO: 996008 - RNA, 14 nt, Homo sapiens
agcuucacaguacc

SEQ ID NO: 996009 - RNA, 23 nt, Homo sapiens
agcuucagugauugggggaggaa

SEQ ID NO: 996010 - RNA, 20 nt, Homo sapiens
agcuuggggaagacccauuc

SEQ ID NO: 996011 - RNA, 15 nt, Homo sapiens
agcuuuaaugauaug

SEQ ID NO: 996012 - RNA, 16 nt, Homo sapiens
agcuuugacucaggag

SEQ ID NO: 996013 - RNA, 21 nt, Homo sapiens
agcuuuggaaguuuagcucug

SEQ ID NO: 996014 - RNA, 17 nt, Homo sapiens
aggaaaagcauguuaug

SEQ ID NO: 996015 - RNA, 17 nt, Homo sapiens
aggaaaaggccuggggu

SEQ ID NO: 996016 - RNA, 23 nt, Homo sapiens
aggaaaaugugcacacauauaca

SEQ ID NO: 996017 - RNA, 13 nt, Homo sapiens
aggaaacaaccau

SEQ ID NO: 996018 - RNA, 17 nt, Homo sapiens
aggaaccaggaggacaa

SEQ ID NO: 996019 - RNA, 21 nt, Homo sapiens
aggaagaaagaagacaaacuu

SEQ ID NO: 996020 - RNA, 16 nt, Homo sapiens
aggaagagcaggacuc

SEQ ID NO: 996021 - RNA, 16 nt, Homo sapiens
aggaagagccuuccac

SEQ ID NO: 996022 - RNA, 14 nt, Homo sapiens
aggaaggagcugcc

SEQ ID NO: 996023 - RNA, 12 nt, Homo sapiens
aggaaguggcug

SEQ ID NO: 996024 - RNA, 17 nt, Homo sapiens
aggaauccccaacaugc

SEQ ID NO: 996025 - RNA, 18 nt, Homo sapiens
aggaauccccaacaugca

SEQ ID NO: 996026 - RNA, 19 nt, Homo sapiens
aggaauuucuuaacuucuu

SEQ ID NO: 996027 - RNA, 18 nt, Homo sapiens
aggacaagaggagcauga

SEQ ID NO: 996028 - RNA, 21 nt, Homo sapiens
aggacccugaaggggccauga

SEQ ID NO: 996029 - RNA, 17 nt, Homo sapiens
aggacgccgcuggugcu

SEQ ID NO: 996030 - RNA, 22 nt, Homo sapiens
aggacuaacacucagaagccug

SEQ ID NO: 996031 - RNA, 15 nt, Homo sapiens
aggagaagggucuca

SEQ ID NO: 996032 - RNA, 13 nt, Homo sapiens
aggagaaucacuu

SEQ ID NO: 996033 - RNA, 17 nt, Homo sapiens
aggagauuccggugccu

SEQ ID NO: 996034 - RNA, 17 nt, Homo sapiens
aggagcugccuggaccc

SEQ ID NO: 996035 - RNA, 19 nt, Homo sapiens
aggagggucggugccuuca

SEQ ID NO: 996036 - RNA, 13 nt, Homo sapiens
aggaggugucuca

SEQ ID NO: 996037 - RNA, 21 nt, Homo sapiens
aggaggugucucaggcugccu

SEQ ID NO: 996038 - RNA, 17 nt, Homo sapiens
aggauccaagcuaagca

SEQ ID NO: 996039 - RNA, 15 nt, Homo sapiens
aggcaacauccaaaa

SEQ ID NO: 996040 - RNA, 15 nt, Homo sapiens
aggcaaggaugucug

SEQ ID NO: 996041 - RNA, 13 nt, Homo sapiens
aggcaaucugccc

SEQ ID NO: 996042 - RNA, 18 nt, Homo sapiens
aggcacacagcuacucuc

SEQ ID NO: 996043 - RNA, 13 nt, Homo sapiens
aggcaccaggaag

SEQ ID NO: 996044 - RNA, 12 nt, Homo sapiens
aggcagcucaag

SEQ ID NO: 996045 - RNA, 23 nt, Homo sapiens
aggcagggugcaguaucaugccc

SEQ ID NO: 996046 - RNA, 23 nt, Homo sapiens
aggcagguagggggucccuccaa

SEQ ID NO: 996047 - RNA, 15 nt, Homo sapiens
aggcaguaaugccuu

SEQ ID NO: 996048 - RNA, 21 nt, Homo sapiens
aggcauggucugcccucugca

SEQ ID NO: 996049 - RNA, 21 nt, Homo sapiens
aggcauguagcuacaggacau

SEQ ID NO: 996050 - RNA, 18 nt, Homo sapiens
aggcauucuggaccucug

SEQ ID NO: 996051 - RNA, 18 nt, Homo sapiens
aggcauuugcaggguccu

SEQ ID NO: 996052 - RNA, 19 nt, Homo sapiens
aggccacacucagcacaag

SEQ ID NO: 996053 - RNA, 22 nt, Homo sapiens
aggccacacuucaaacuacuuu

SEQ ID NO: 996054 - RNA, 17 nt, Homo sapiens
aggccacggaccaaugg

SEQ ID NO: 996055 - RNA, 14 nt, Homo sapiens
aggccagagccaag

SEQ ID NO: 996056 - RNA, 22 nt, Homo sapiens
aggccagcacucgcuagcagug

SEQ ID NO: 996057 - RNA, 11 nt, Homo sapiens
aggccaggacu

SEQ ID NO: 996058 - RNA, 15 nt, Homo sapiens
aggugaccccagggc

SEQ ID NO: 996059 - RNA, 21 nt, Homo sapiens
aggugagaugggacauuccaa

SEQ ID NO: 996060 - RNA, 22 nt, Homo sapiens
aggugaggucagcacaucucaa

SEQ ID NO: 996061 - RNA, 13 nt, Homo sapiens
aggugcacuggga

SEQ ID NO: 996062 - RNA, 18 nt, Homo sapiens
aggugcauagcaagugaa

SEQ ID NO: 996063 - RNA, 15 nt, Homo sapiens
aggugccacuggagu

SEQ ID NO: 996064 - RNA, 21 nt, Homo sapiens
agguggaaaaacagcauguac

SEQ ID NO: 996065 - RNA, 20 nt, Homo sapiens
agguggaaaagcaacauuca

SEQ ID NO: 996066 - RNA, 20 nt, Homo sapiens
aggugggccagucuguggau

SEQ ID NO: 996067 - RNA, 19 nt, Homo sapiens
agguguuggcugcacgugc

SEQ ID NO: 996068 - RNA, 13 nt, Homo sapiens
agguuaaggcaua

SEQ ID NO: 996069 - RNA, 16 nt, Homo sapiens
agguucuaaaguucua

SEQ ID NO: 996070 - RNA, 20 nt, Homo sapiens
agguucuagguuucaaagau

SEQ ID NO: 996071 - RNA, 19 nt, Homo sapiens
agguuguuaauguacaaaa

SEQ ID NO: 996072 - RNA, 18 nt, Homo sapiens
aguaaaaagaaauauacc

SEQ ID NO: 996073 - RNA, 20 nt, Homo sapiens
aguaacaauacaaauggauu

SEQ ID NO: 996074 - RNA, 11 nt, Homo sapiens
aguaacaugug

SEQ ID NO: 996075 - RNA, 15 nt, Homo sapiens
aguaacauguguuaa

SEQ ID NO: 996076 - RNA, 23 nt, Homo sapiens
aguaagaauguuaaaaagugaaa

SEQ ID NO: 996077 - RNA, 19 nt, Homo sapiens
aguaaucuaauauggccac

SEQ ID NO: 996078 - RNA, 15 nt, Homo sapiens
aguacuuugugcauu

SEQ ID NO: 996079 - RNA, 19 nt, Homo sapiens
aguagagacaggguuucac

SEQ ID NO: 996080 - RNA, 20 nt, Homo sapiens
aguagaggacuaaccaugug

SEQ ID NO: 996081 - RNA, 16 nt, Homo sapiens
aguagcaucaccaucu

SEQ ID NO: 996082 - RNA, 14 nt, Homo sapiens
aguagcugagcuca

SEQ ID NO: 996083 - RNA, 13 nt, Homo sapiens
aguagggggagca

SEQ ID NO: 996084 - RNA, 14 nt, Homo sapiens
aguagggggagcaa

SEQ ID NO: 996085 - RNA, 15 nt, Homo sapiens
aguagucuugaugac

SEQ ID NO: 996086 - RNA, 22 nt, Homo sapiens
aguauguauuauuuacauuuaa

SEQ ID NO: 996087 - RNA, 18 nt, Homo sapiens
aguauuuaggauaaccuu

SEQ ID NO: 996088 - RNA, 22 nt, Homo sapiens
aguauuuauugcaggauggugu

SEQ ID NO: 996089 - RNA, 23 nt, Homo sapiens
aguauuugggaagugaagacugg

SEQ ID NO: 996090 - RNA, 15 nt, Homo sapiens
agucaaaacacuugu

SEQ ID NO: 996091 - RNA, 21 nt, Homo sapiens
agucaaccugccugacauuug

SEQ ID NO: 996092 - RNA, 19 nt, Homo sapiens
agucacggcugcgcacugu

SEQ ID NO: 996093 - RNA, 23 nt, Homo sapiens
agucacucuagucaaugacauga

SEQ ID NO: 996094 - RNA, 24 nt, Homo sapiens
agucacucuagucaaugacaugaa

SEQ ID NO: 996095 - RNA, 17 nt, Homo sapiens
agucacugacaguuaau

SEQ ID NO: 996096 - RNA, 14 nt, Homo sapiens
agucaguccaggau

SEQ ID NO: 996097 - RNA, 15 nt, Homo sapiens
agucauucugggaac

SEQ ID NO: 996098 - RNA, 18 nt, Homo sapiens
agucauuggaauaaggca

SEQ ID NO: 996099 - RNA, 15 nt, Homo sapiens
agucccagcgguggg

SEQ ID NO: 996100 - RNA, 19 nt, Homo sapiens
aguccgacccagacaucca

SEQ ID NO: 996101 - RNA, 17 nt, Homo sapiens
aguccuacaagcuaaaa

SEQ ID NO: 996102 - RNA, 14 nt, Homo sapiens
aguccuaucugggc

SEQ ID NO: 996103 - RNA, 15 nt, Homo sapiens
agucgugaccugcua

SEQ ID NO: 996104 - RNA, 17 nt, Homo sapiens
agucguucccagugugg

SEQ ID NO: 996105 - RNA, 18 nt, Homo sapiens
agucugagguccugagca

SEQ ID NO: 996106 - RNA, 21 nt, Homo sapiens
agucugcuacccucauuucuc

SEQ ID NO: 996107 - RNA, 22 nt, Homo sapiens
agucugcuacccucauuucuca

SEQ ID NO: 996108 - RNA, 14 nt, Homo sapiens
agucuguugauuaa

SEQ ID NO: 996109 - RNA, 22 nt, Homo sapiens
agucuuaaaaaaauaugccuuu

SEQ ID NO: 996110 - RNA, 22 nt, Homo sapiens
agucuuuuguucgcauggucac

SEQ ID NO: 996111 - RNA, 15 nt, Homo sapiens
agugaaaacuuugua

SEQ ID NO: 996112 - RNA, 14 nt, Homo sapiens
agugaacacucagu

SEQ ID NO: 996113 - RNA, 17 nt, Homo sapiens
agugaacacucaguggc

SEQ ID NO: 996114 - RNA, 21 nt, Homo sapiens
agugaacuugaaauauccugc

SEQ ID NO: 996115 - RNA, 14 nt, Homo sapiens
agugaagacuggaa

SEQ ID NO: 996116 - RNA, 17 nt, Homo sapiens
agugaagccaaagggac

SEQ ID NO: 996117 - RNA, 19 nt, Homo sapiens
agugaauaaaccaucaucu

SEQ ID NO: 996118 - RNA, 15 nt, Homo sapiens
agugacauccaggag

SEQ ID NO: 996119 - RNA, 23 nt, Homo sapiens
agugacauugcaucaaagcaucu

SEQ ID NO: 996120 - RNA, 16 nt, Homo sapiens
agugacccacaugcca

SEQ ID NO: 996121 - RNA, 21 nt, Homo sapiens
agugaccuggaaucagugaag

SEQ ID NO: 996122 - RNA, 21 nt, Homo sapiens
agugacucacuaauucauuaa

SEQ ID NO: 996123 - RNA, 22 nt, Homo sapiens
agugauugauagaguguuauca

SEQ ID NO: 996124 - RNA, 16 nt, Homo sapiens
agugauuggcucugug

SEQ ID NO: 996125 - RNA, 18 nt, Homo sapiens
agugcaauaaaucugacc

SEQ ID NO: 996126 - RNA, 21 nt, Homo sapiens
agugccacuuaauguauguua

SEQ ID NO: 996127 - RNA, 14 nt, Homo sapiens
agugcccugagcca

SEQ ID NO: 996128 - RNA, 21 nt, Homo sapiens
agugcccugagccagggucuc

SEQ ID NO: 996129 - RNA, 19 nt, Homo sapiens
agugccgacagcucuccaa

SEQ ID NO: 996130 - RNA, 15 nt, Homo sapiens
agugccucaugccug

SEQ ID NO: 996131 - RNA, 19 nt, Homo sapiens
agugccuucaacacagcuu

SEQ ID NO: 996132 - RNA, 19 nt, Homo sapiens
agugcugugcugugcuaug

SEQ ID NO: 996133 - RNA, 13 nt, Homo sapiens
aguggauucccag

SEQ ID NO: 996134 - RNA, 19 nt, Homo sapiens
aguggcauuuccuggucag

SEQ ID NO: 996135 - RNA, 11 nt, Homo sapiens
agugggagcaa

SEQ ID NO: 996136 - RNA, 16 nt, Homo sapiens
agugguggucuucaag

SEQ ID NO: 996137 - RNA, 20 nt, Homo sapiens
aguguacauaugugcuggaa

SEQ ID NO: 996138 - RNA, 15 nt, Homo sapiens
aguguaccauuugcc

SEQ ID NO: 996139 - RNA, 13 nt, Homo sapiens
aguguaugauuac

SEQ ID NO: 996140 - RNA, 16 nt, Homo sapiens
agugucaggcacuggg

SEQ ID NO: 996141 - RNA, 17 nt, Homo sapiens
agugucaggcacugggc

SEQ ID NO: 996142 - RNA, 14 nt, Homo sapiens
agugugaccacuga

SEQ ID NO: 996143 - RNA, 13 nt, Homo sapiens
agugugagugugc

SEQ ID NO: 996144 - RNA, 15 nt, Homo sapiens
aguguggcuaaccaa

SEQ ID NO: 996145 - RNA, 16 nt, Homo sapiens
aguguuccccuuccac

SEQ ID NO: 996146 - RNA, 13 nt, Homo sapiens
aguguucccugac

SEQ ID NO: 996147 - RNA, 17 nt, Homo sapiens
aguguucugugacaaaa

SEQ ID NO: 996148 - RNA, 12 nt, Homo sapiens
aguguugcccag

SEQ ID NO: 996149 - RNA, 12 nt, Homo sapiens
aguguuuaucuu

SEQ ID NO: 996150 - RNA, 12 nt, Homo sapiens
aguuaagacaug

SEQ ID NO: 996151 - RNA, 12 nt, Homo sapiens
aguuaaggguua

SEQ ID NO: 996152 - RNA, 13 nt, Homo sapiens
aguuaaucuugcu

SEQ ID NO: 996153 - RNA, 18 nt, Homo sapiens
aguuacaguucugugguu

SEQ ID NO: 996154 - RNA, 17 nt, Homo sapiens
aguuaccagugccuuaa

SEQ ID NO: 996155 - RNA, 19 nt, Homo sapiens
aguuaccauuaaaccaucu

SEQ ID NO: 996156 - RNA, 23 nt, Homo sapiens
aguuaccuuauaguuacugugua

SEQ ID NO: 996157 - RNA, 12 nt, Homo sapiens
aguuauaaccaa

SEQ ID NO: 996158 - RNA, 21 nt, Homo sapiens
aguucacauacaaaucaucca

SEQ ID NO: 996159 - RNA, 16 nt, Homo sapiens
aguucauauguaccau

SEQ ID NO: 996160 - RNA, 17 nt, Homo sapiens
aguucauauguaccaug

SEQ ID NO: 996161 - RNA, 18 nt, Homo sapiens
auacuaaggaaccaacaa

SEQ ID NO: 996162 - RNA, 18 nt, Homo sapiens
auacuguauauucaggac

SEQ ID NO: 996163 - RNA, 19 nt, Homo sapiens
auacuucucuauuaucuca

SEQ ID NO: 996164 - RNA, 17 nt, Homo sapiens
auagaaaaguauguucu

SEQ ID NO: 996165 - RNA, 12 nt, Homo sapiens
auagaaaugcca

SEQ ID NO: 996166 - RNA, 19 nt, Homo sapiens
auagacucugguguucuau

SEQ ID NO: 996167 - RNA, 23 nt, Homo sapiens
auagauauuccuauugugcaaug

SEQ ID NO: 996168 - RNA, 19 nt, Homo sapiens
auagauuguccuuuugcaa

SEQ ID NO: 996169 - RNA, 21 nt, Homo sapiens
auagauuuucugcuacuuugc

SEQ ID NO: 996170 - RNA, 15 nt, Homo sapiens
auagcaagugaaagc

SEQ ID NO: 996171 - RNA, 19 nt, Homo sapiens
auagccacuaaccuugccu

SEQ ID NO: 996172 - RNA, 17 nt, Homo sapiens
auagcugcuuccagugu

SEQ ID NO: 996173 - RNA, 13 nt, Homo sapiens
auagcugcuuccg

SEQ ID NO: 996174 - RNA, 18 nt, Homo sapiens
auagcuguaaacuuccaa

SEQ ID NO: 996175 - RNA, 12 nt, Homo sapiens
auagcuucagga

SEQ ID NO: 996176 - RNA, 18 nt, Homo sapiens
auaggcggggcuugccuu

SEQ ID NO: 996177 - RNA, 20 nt, Homo sapiens
auaguauucaugacuaugga

SEQ ID NO: 996178 - RNA, 23 nt, Homo sapiens
auagugauugauagaguguuauc

SEQ ID NO: 996179 - RNA, 17 nt, Homo sapiens
auaguucaugucugcua

SEQ ID NO: 996180 - RNA, 13 nt, Homo sapiens
auauaacuaucuc

SEQ ID NO: 996181 - RNA, 16 nt, Homo sapiens
auauaagcugccauau

SEQ ID NO: 996182 - RNA, 19 nt, Homo sapiens
auauacagcaggugcucaa

SEQ ID NO: 996183 - RNA, 13 nt, Homo sapiens
auauagccaauau

SEQ ID NO: 996184 - RNA, 17 nt, Homo sapiens
auauauuauauggaaau

SEQ ID NO: 996185 - RNA, 20 nt, Homo sapiens
auauauuuuugugcacauuu

SEQ ID NO: 996186 - RNA, 16 nt, Homo sapiens
auaucccuacauguau

SEQ ID NO: 996187 - RNA, 13 nt, Homo sapiens
auaucuaccccag

SEQ ID NO: 996188 - RNA, 20 nt, Homo sapiens
auaucuuggacaaaucacau

SEQ ID NO: 996189 - RNA, 13 nt, Homo sapiens
auaugaagacaua

SEQ ID NO: 996190 - RNA, 18 nt, Homo sapiens
auaugaguaauacaucaa

SEQ ID NO: 996191 - RNA, 22 nt, Homo sapiens
auaugccuaaaugcacagucau

SEQ ID NO: 996192 - RNA, 18 nt, Homo sapiens
auaugccuuuuugaagca

SEQ ID NO: 996193 - RNA, 18 nt, Homo sapiens
auaugcuuguaacuaaaa

SEQ ID NO: 996194 - RNA, 19 nt, Homo sapiens
auaugugauuuacauuuca

SEQ ID NO: 996195 - RNA, 18 nt, Homo sapiens
auauuauuguaaccaaua

SEQ ID NO: 996196 - RNA, 16 nt, Homo sapiens
auauucaggacuugaa

SEQ ID NO: 996197 - RNA, 19 nt, Homo sapiens
auauuuuaaaaucugucac

SEQ ID NO: 996198 - RNA, 18 nt, Homo sapiens
auauuuuuagauaguuag

SEQ ID NO: 996199 - RNA, 17 nt, Homo sapiens
auauuuuugugcacauu

SEQ ID NO: 996200 - RNA, 22 nt, Homo sapiens
aucaaauugugcaguacuuugu

SEQ ID NO: 996201 - RNA, 13 nt, Homo sapiens
aucaacauuucuc

SEQ ID NO: 996202 - RNA, 16 nt, Homo sapiens
aucaaccaaacaaaga

SEQ ID NO: 996203 - RNA, 23 nt, Homo sapiens
aucaacuugcuuaucaacuuccu

SEQ ID NO: 996204 - RNA, 22 nt, Homo sapiens
aucaaguccuaguuguucagca

SEQ ID NO: 996205 - RNA, 12 nt, Homo sapiens
aucacagaaaag

SEQ ID NO: 996206 - RNA, 19 nt, Homo sapiens
aucacauguuuucucugga

SEQ ID NO: 996207 - RNA, 17 nt, Homo sapiens
aucacucuaauucggau

SEQ ID NO: 996208 - RNA, 17 nt, Homo sapiens
aucacuuaaacuugcau

SEQ ID NO: 996209 - RNA, 20 nt, Homo sapiens
aucacuuaaacuugcaucac

SEQ ID NO: 996210 - RNA, 16 nt, Homo sapiens
aucagaacuguuggca

SEQ ID NO: 996211 - RNA, 19 nt, Homo sapiens
aucagaauagccacauuug

SEQ ID NO: 996212 - RNA, 16 nt, Homo sapiens
aucagaccauaauguu

SEQ ID NO: 996213 - RNA, 13 nt, Homo sapiens
aucagacugacag

SEQ ID NO: 996214 - RNA, 18 nt, Homo sapiens
aucagacugacaguuuac

SEQ ID NO: 996215 - RNA, 19 nt, Homo sapiens
cacuuacauuuacaaacug

SEQ ID NO: 996216 - RNA, 17 nt, Homo sapiens
cacuuagguaguaccaa

SEQ ID NO: 996217 - RNA, 12 nt, Homo sapiens
cacuucucagga

SEQ ID NO: 996218 - RNA, 21 nt, Homo sapiens
cacuucuuguuccccacugac

SEQ ID NO: 996219 - RNA, 17 nt, Homo sapiens
cacuugccugugcuaca

SEQ ID NO: 996220 - RNA, 15 nt, Homo sapiens
cacuugguaauugua

SEQ ID NO: 996221 - RNA, 14 nt, Homo sapiens
cacuuguacaauua

SEQ ID NO: 996222 - RNA, 20 nt, Homo sapiens
cacuuugaaggggccucacc

SEQ ID NO: 996223 - RNA, 15 nt, Homo sapiens
cacuuuucccacucc

SEQ ID NO: 996224 - RNA, 23 nt, Homo sapiens
cagaaaauguugagaaucccaaa

SEQ ID NO: 996225 - RNA, 19 nt, Homo sapiens
cagaaauacuacuguguaa

SEQ ID NO: 996226 - RNA, 14 nt, Homo sapiens
cagaaauuguauau

SEQ ID NO: 996227 - RNA, 21 nt, Homo sapiens
cagaagcagcaacuuguccua

SEQ ID NO: 996228 - RNA, 14 nt, Homo sapiens
cagaagccugaugc

SEQ ID NO: 996229 - RNA, 12 nt, Homo sapiens
cagaagugugac

SEQ ID NO: 996230 - RNA, 16 nt, Homo sapiens
cagaauaucacagaaa

SEQ ID NO: 996231 - RNA, 17 nt, Homo sapiens
cagaaucaaaugcaauu

SEQ ID NO: 996232 - RNA, 15 nt, Homo sapiens
cagaaucccuuaaca

SEQ ID NO: 996233 - RNA, 22 nt, Homo sapiens
cagaaugagaccaaacgcagcc

SEQ ID NO: 996234 - RNA, 12 nt, Homo sapiens
cagaauggagcu

SEQ ID NO: 996235 - RNA, 19 nt, Homo sapiens
cagaauugcuuguuugcuu

SEQ ID NO: 996236 - RNA, 17 nt, Homo sapiens
cagacaugccacaagga

SEQ ID NO: 996237 - RNA, 20 nt, Homo sapiens
cagaccacugauaaaaccau

SEQ ID NO: 996238 - RNA, 17 nt, Homo sapiens
cagaccauccaccaggc

SEQ ID NO: 996239 - RNA, 23 nt, Homo sapiens
cagaccuccaccuccuccagacc

SEQ ID NO: 996240 - RNA, 22 nt, Homo sapiens
cagacggaaggguaaacaauau

SEQ ID NO: 996241 - RNA, 21 nt, Homo sapiens
cagacuagaaguuccuaguga

SEQ ID NO: 996242 - RNA, 14 nt, Homo sapiens
cagacucccauucc

SEQ ID NO: 996243 - RNA, 18 nt, Homo sapiens
cagacucguucuucuggg

SEQ ID NO: 996244 - RNA, 19 nt, Homo sapiens
cagacugacaguuuacaga

SEQ ID NO: 996245 - RNA, 21 nt, Homo sapiens
cagacuugaaugcuaguuaua

SEQ ID NO: 996246 - RNA, 17 nt, Homo sapiens
cagagacauacuugaag

SEQ ID NO: 996247 - RNA, 16 nt, Homo sapiens
cagagacugaauagau

SEQ ID NO: 996248 - RNA, 21 nt, Homo sapiens
cagagagcugcccuucagcga

SEQ ID NO: 996249 - RNA, 15 nt, Homo sapiens
cagagauccaaaaga

SEQ ID NO: 996250 - RNA, 12 nt, Homo sapiens
cagagcaccugc

SEQ ID NO: 996251 - RNA, 23 nt, Homo sapiens
cagagcggaaggagggagcucug

SEQ ID NO: 996252 - RNA, 22 nt, Homo sapiens
cagagcuagguggaaaagccug

SEQ ID NO: 996253 - RNA, 21 nt, Homo sapiens
cagaggagccaccaguucuca

SEQ ID NO: 996254 - RNA, 22 nt, Homo sapiens
cagaggcagcccgcacaccugc

SEQ ID NO: 996255 - RNA, 17 nt, Homo sapiens
cagaggcccaggcugcc

SEQ ID NO: 996256 - RNA, 14 nt, Homo sapiens
cagaggcugauguc

SEQ ID NO: 996257 - RNA, 15 nt, Homo sapiens
cagaggucucccaaa

SEQ ID NO: 996258 - RNA, 16 nt, Homo sapiens
cagaguguucccugac

SEQ ID NO: 996259 - RNA, 13 nt, Homo sapiens
cagauaaugugaa

SEQ ID NO: 996260 - RNA, 21 nt, Homo sapiens
cagaucaucuuggaacugcau

SEQ ID NO: 996261 - RNA, 13 nt, Homo sapiens
cagauccuccuca

SEQ ID NO: 996262 - RNA, 14 nt, Homo sapiens
cagaucugauuugu

SEQ ID NO: 996263 - RNA, 17 nt, Homo sapiens
cagaugcuccaagauuc

SEQ ID NO: 996264 - RNA, 19 nt, Homo sapiens
cagaugcugaaaauguccu

SEQ ID NO: 996265 - RNA, 19 nt, Homo sapiens
cagaugcuuuccugcacau

SEQ ID NO: 996266 - RNA, 22 nt, Homo sapiens
cagaugcuuuccugcacauuaa

SEQ ID NO: 996267 - RNA, 14 nt, Homo sapiens
cagauggcacuuug

SEQ ID NO: 996268 - RNA, 18 nt, Homo sapiens
cagauucuucucucucaa

SEQ ID NO: 996269 - RNA, 18 nt, Homo sapiens
cagauuuggaugcacuca

SEQ ID NO: 996270 - RNA, 19 nt, Homo sapiens
cagcaaaacaacggaugaa

SEQ ID NO: 996271 - RNA, 17 nt, Homo sapiens
cagcaaagcccccagag

SEQ ID NO: 996272 - RNA, 21 nt, Homo sapiens
cagcaagacuucucuuugccu

SEQ ID NO: 996273 - RNA, 14 nt, Homo sapiens
cagcacaaggccau

SEQ ID NO: 996274 - RNA, 13 nt, Homo sapiens
cagcaggugcuga

SEQ ID NO: 996275 - RNA, 13 nt, Homo sapiens
cagcagugccuug

SEQ ID NO: 996276 - RNA, 18 nt, Homo sapiens
cagcagugccuugugcaa

SEQ ID NO: 996277 - RNA, 13 nt, Homo sapiens
cagcauacgucag

SEQ ID NO: 996278 - RNA, 16 nt, Homo sapiens
cagcaucucuaccuuc

SEQ ID NO: 996279 - RNA, 16 nt, Homo sapiens
cagcauugacucugug

SEQ ID NO: 996280 - RNA, 13 nt, Homo sapiens
cauuugauuguca

SEQ ID NO: 996281 - RNA, 15 nt, Homo sapiens
cauuugcaccuaccu

SEQ ID NO: 996282 - RNA, 20 nt, Homo sapiens
cauuugggagacaugugaca

SEQ ID NO: 996283 - RNA, 12 nt, Homo sapiens
cauuuguagcaa

SEQ ID NO: 996284 - RNA, 17 nt, Homo sapiens
cauuuguagcaauuuaa

SEQ ID NO: 996285 - RNA, 15 nt, Homo sapiens
cauuuguguacacag

SEQ ID NO: 996286 - RNA, 23 nt, Homo sapiens
ccaaaaaaaaauacaugcuaaga

SEQ ID NO: 996287 - RNA, 15 nt, Homo sapiens
ccaaaaauuacugau

SEQ ID NO: 996288 - RNA, 14 nt, Homo sapiens
ccaaaacaguuaau

SEQ ID NO: 996289 - RNA, 21 nt, Homo sapiens
ccaaagagaagggcacuguaa

SEQ ID NO: 996290 - RNA, 18 nt, Homo sapiens
ccaaagcagcacuuauaa

SEQ ID NO: 996291 - RNA, 17 nt, Homo sapiens
ccaaagcuuucauguaa

SEQ ID NO: 996292 - RNA, 18 nt, Homo sapiens
ccaaaggacgcacugagc

SEQ ID NO: 996293 - RNA, 20 nt, Homo sapiens
ccaaagggagucugccaggg

SEQ ID NO: 996294 - RNA, 19 nt, Homo sapiens
ccaaagggcuccguggaga

SEQ ID NO: 996295 - RNA, 14 nt, Homo sapiens
ccaacaccaccucu

SEQ ID NO: 996296 - RNA, 16 nt, Homo sapiens
ccaacagcgcccaaag

SEQ ID NO: 996297 - RNA, 15 nt, Homo sapiens
ccaaccauuuccuca

SEQ ID NO: 996298 - RNA, 15 nt, Homo sapiens
ccaacccaaccucau

SEQ ID NO: 996299 - RNA, 18 nt, Homo sapiens
ccaacccccgacuucauc

SEQ ID NO: 996300 - RNA, 22 nt, Homo sapiens
ccaagacaaaaagccacaauga

SEQ ID NO: 996301 - RNA, 16 nt, Homo sapiens
ccaagagucuaaagau

SEQ ID NO: 996302 - RNA, 22 nt, Homo sapiens
ccaagcaccuccaaccaaauaa

SEQ ID NO: 996303 - RNA, 17 nt, Homo sapiens
ccaagcaguugggacua

SEQ ID NO: 996304 - RNA, 19 nt, Homo sapiens
ccaagcucugcagucccag

SEQ ID NO: 996305 - RNA, 21 nt, Homo sapiens
ccaaggcacugagaccuccac

SEQ ID NO: 996306 - RNA, 15 nt, Homo sapiens
ccaaggggaaucaga

SEQ ID NO: 996307 - RNA, 14 nt, Homo sapiens
ccaaguaccaguau

SEQ ID NO: 996308 - RNA, 14 nt, Homo sapiens
ccaaguccucauuu

SEQ ID NO: 996309 - RNA, 21 nt, Homo sapiens
ccaaguuguucgggccaagga

SEQ ID NO: 996310 - RNA, 14 nt, Homo sapiens
ccaaucaaccaaac

SEQ ID NO: 996311 - RNA, 17 nt, Homo sapiens
ccaauccuggacaugaa

SEQ ID NO: 996312 - RNA, 15 nt, Homo sapiens
uagaaaaccagcuca

SEQ ID NO: 996313 - RNA, 15 nt, Homo sapiens
uagaaaaugguccaa

SEQ ID NO: 996314 - RNA, 18 nt, Homo sapiens
uagaaaauuagacuguga

SEQ ID NO: 996315 - RNA, 17 nt, Homo sapiens
uagaaagagaaacaguu

SEQ ID NO: 996316 - RNA, 22 nt, Homo sapiens
uagaagcaacuaggaaaaucac

SEQ ID NO: 996317 - RNA, 21 nt, Homo sapiens
uagaagccacuauuacuggga

SEQ ID NO: 996318 - RNA, 21 nt, Homo sapiens
uagacauggagguucuaaggc

SEQ ID NO: 996319 - RNA, 21 nt, Homo sapiens
uagacccugcauuuauagcau

SEQ ID NO: 996320 - RNA, 14 nt, Homo sapiens
uagagcacugccac

SEQ ID NO: 996321 - RNA, 18 nt, Homo sapiens
uagagucugaacagcugu

SEQ ID NO: 996322 - RNA, 18 nt, Homo sapiens
uagaucucugaagccaca

SEQ ID NO: 996323 - RNA, 13 nt, Homo sapiens
uagaucuuucuag

SEQ ID NO: 996324 - RNA, 15 nt, Homo sapiens
uagauggaccugccu

SEQ ID NO: 996325 - RNA, 14 nt, Homo sapiens
uagaugucuuuucc

SEQ ID NO: 996326 - RNA, 21 nt, Homo sapiens
uagauguuuauucuucuagag

SEQ ID NO: 996327 - RNA, 17 nt, Homo sapiens
uagauuaagaaauagac

SEQ ID NO: 996328 - RNA, 21 nt, Homo sapiens
uagauucucugugucuaagau

SEQ ID NO: 996329 - RNA, 23 nt, Homo sapiens
uagauugcagaaaauucugugcc

SEQ ID NO: 996330 - RNA, 20 nt, Homo sapiens
uagcaaaauacaugacauuu

SEQ ID NO: 996331 - RNA, 13 nt, Homo sapiens
uagcaacuacagu

SEQ ID NO: 996332 - RNA, 14 nt, Homo sapiens
uagcagacaggccc

SEQ ID NO: 996333 - RNA, 12 nt, Homo sapiens
uagcaguggcag

SEQ ID NO: 996334 - RNA, 17 nt, Homo sapiens
uagcauauagauugucc

SEQ ID NO: 996335 - RNA, 20 nt, Homo sapiens
uagcaugcuuguugcaauug

SEQ ID NO: 996336 - RNA, 12 nt, Homo sapiens
uagcauugcacu

SEQ ID NO: 996337 - RNA, 13 nt, Homo sapiens
uagcauugcacuu

SEQ ID NO: 996338 - RNA, 19 nt, Homo sapiens
uagcauuucccaacacaaa

SEQ ID NO: 996339 - RNA, 22 nt, Homo sapiens
uagccaaaccucaccaacuccu

SEQ ID NO: 996340 - RNA, 18 nt, Homo sapiens
uagccagcacacagggca

SEQ ID NO: 996341 - RNA, 22 nt, Homo sapiens
uagccucugucuggcaaugcca

SEQ ID NO: 996342 - RNA, 12 nt, Homo sapiens
uagccuggaccu

SEQ ID NO: 996343 - RNA, 15 nt, Homo sapiens
uagccuggugugauu

SEQ ID NO: 996344 - RNA, 22 nt, Homo sapiens
uagccuuuuuuccccagacuug

SEQ ID NO: 996345 - RNA, 20 nt, Homo sapiens
uagcuaauaacaugugaaaa

SEQ ID NO: 996346 - RNA, 19 nt, Homo sapiens
uagcucaauuaguguggcu

SEQ ID NO: 996347 - RNA, 23 nt, Homo sapiens
uagcuguccuuuuuccucuccac

SEQ ID NO: 996348 - RNA, 15 nt, Homo sapiens
uaggaaaaucacuug

SEQ ID NO: 996349 - RNA, 15 nt, Homo sapiens
uaggaagccucagau

SEQ ID NO: 996350 - RNA, 13 nt, Homo sapiens
uaggaaguaggaa

SEQ ID NO: 996351 - RNA, 17 nt, Homo sapiens
uaggagggagacacugg

SEQ ID NO: 996352 - RNA, 14 nt, Homo sapiens
uaggauaagcacua

SEQ ID NO: 996353 - RNA, 21 nt, Homo sapiens
uaggcacuguaguucuaagac

SEQ ID NO: 996354 - RNA, 16 nt, Homo sapiens
uaggcaugguggacuc

SEQ ID NO: 996355 - RNA, 17 nt, Homo sapiens
uaggcauguagcuacag

SEQ ID NO: 996356 - RNA, 16 nt, Homo sapiens
uaggcauucuggaccu

SEQ ID NO: 996357 - RNA, 16 nt, Homo sapiens
uaggcggggcuugccu

SEQ ID NO: 996358 - RNA, 14 nt, Homo sapiens
uagggacuuggggc

SEQ ID NO: 996359 - RNA, 20 nt, Homo sapiens
uagguaggggcccacuucac

SEQ ID NO: 996360 - RNA, 23 nt, Homo sapiens
uagguccuuguuguuucuugccu

SEQ ID NO: 996361 - RNA, 22 nt, Homo sapiens
uaggugaaaguuaauccacugu

SEQ ID NO: 996362 - RNA, 22 nt, Homo sapiens
uaggugaacguguucaaagcca

SEQ ID NO: 996363 - RNA, 21 nt, Homo sapiens
uagguucuaaaguucuaagau

SEQ ID NO: 996364 - RNA, 12 nt, Homo sapiens
uaguaacaugug

SEQ ID NO: 996365 - RNA, 22 nt, Homo sapiens
uaguagagacaggguuucacca

SEQ ID NO: 996366 - RNA, 12 nt, Homo sapiens
uaguauucauga

SEQ ID NO: 996367 - RNA, 22 nt, Homo sapiens
uagucccugcacagugacuucu

SEQ ID NO: 996368 - RNA, 17 nt, Homo sapiens
uagugcacaagcacuau

SEQ ID NO: 996369 - RNA, 14 nt, Homo sapiens
uaguuccacugaga

SEQ ID NO: 996370 - RNA, 19 nt, Homo sapiens
uauaaaaaugagugcuuaa

SEQ ID NO: 996371 - RNA, 20 nt, Homo sapiens
uauaaagaaaaugauacagc

SEQ ID NO: 996372 - RNA, 17 nt, Homo sapiens
uauaaauguaccagaga

SEQ ID NO: 996373 - RNA, 13 nt, Homo sapiens
uauaaaugugauu

SEQ ID NO: 996374 - RNA, 12 nt, Homo sapiens
uauaacuguaaa

SEQ ID NO: 996375 - RNA, 16 nt, Homo sapiens
uauaacuguauuugaa

SEQ ID NO: 996376 - RNA, 16 nt, Homo sapiens
uauaagaaagaucaaa

SEQ ID NO: 996377 - RNA, 14 nt, Homo sapiens
uauaaucauuauua

SEQ ID NO: 996378 - RNA, 12 nt, Homo sapiens
uauaaugaauuu

SEQ ID NO: 996379 - RNA, 22 nt, Homo sapiens
uauaauucuuucaauacagaua

SEQ ID NO: 996380 - RNA, 19 nt, Homo sapiens
uauacgcuggcaacacaga

SEQ ID NO: 996381 - RNA, 18 nt, Homo sapiens
uauacucagguaccucuu

SEQ ID NO: 996382 - RNA, 14 nt, Homo sapiens
uauagccucugucu

SEQ ID NO: 996383 - RNA, 21 nt, Homo sapiens
uauauaaaugugauugcagcu

SEQ ID NO: 996384 - RNA, 15 nt, Homo sapiens
uauauaaguguacau

SEQ ID NO: 996385 - RNA, 14 nt, Homo sapiens
uauauaaucaauca

SEQ ID NO: 996386 - RNA, 12 nt, Homo sapiens
uauauagccaau

SEQ ID NO: 996387 - RNA, 22 nt, Homo sapiens
ucacuaggcccccacuugccuc

SEQ ID NO: 996388 - RNA, 23 nt, Homo sapiens
ucacucaucaauggggccaguca

SEQ ID NO: 996389 - RNA, 18 nt, Homo sapiens
ucacuccccacaucccau

SEQ ID NO: 996390 - RNA, 14 nt, Homo sapiens
ucacucuagucaau

SEQ ID NO: 996391 - RNA, 18 nt, Homo sapiens
ucacucuucaaaugccug

SEQ ID NO: 996392 - RNA, 14 nt, Homo sapiens
ucacugacaguuaa

SEQ ID NO: 996393 - RNA, 17 nt, Homo sapiens
ucacugccccucucuca

SEQ ID NO: 996394 - RNA, 18 nt, Homo sapiens
ucacugccccucucucag

SEQ ID NO: 996395 - RNA, 18 nt, Homo sapiens
ucacuggcaugggagacc

SEQ ID NO: 996396 - RNA, 22 nt, Homo sapiens
ucacuuaaacuugcaucacuua

SEQ ID NO: 996397 - RNA, 18 nt, Homo sapiens
ucacuuuucccacuccaa

SEQ ID NO: 996398 - RNA, 19 nt, Homo sapiens
ucagaaguuaguuuguaua

SEQ ID NO: 996399 - RNA, 15 nt, Homo sapiens
ucagaauaucacaga

SEQ ID NO: 996400 - RNA, 19 nt, Homo sapiens
ucagaauaugucagugcug

SEQ ID NO: 996401 - RNA, 19 nt, Homo sapiens
ucagaaucccuuaacaguu

SEQ ID NO: 996402 - RNA, 15 nt, Homo sapiens
ucagaaugucaauga

SEQ ID NO: 996403 - RNA, 22 nt, Homo sapiens
ucagaauuuaguguauccauaa

SEQ ID NO: 996404 - RNA, 18 nt, Homo sapiens
ucagagaccuuccagaaa

SEQ ID NO: 996405 - RNA, 21 nt, Homo sapiens
ucagauaagguaaaaugccau

SEQ ID NO: 996406 - RNA, 15 nt, Homo sapiens
ucagauccagggaca

SEQ ID NO: 996407 - RNA, 14 nt, Homo sapiens
ucagauccuccuca

SEQ ID NO: 996408 - RNA, 20 nt, Homo sapiens
ucagauuccuucccauggag

SEQ ID NO: 996409 - RNA, 17 nt, Homo sapiens
ucagcaccugacccugu

SEQ ID NO: 996410 - RNA, 19 nt, Homo sapiens
ucagcacugucccuugccu

SEQ ID NO: 996411 - RNA, 16 nt, Homo sapiens
ucagccagccucgccc

SEQ ID NO: 996412 - RNA, 13 nt, Homo sapiens
ucagccagguuug

SEQ ID NO: 996413 - RNA, 22 nt, Homo sapiens
ucagccaucccgucuucuccaa

SEQ ID NO: 996414 - RNA, 22 nt, Homo sapiens
ucagccuggccagacacaggcc

SEQ ID NO: 996415 - RNA, 14 nt, Homo sapiens
ucagccuuaggaag

SEQ ID NO: 996416 - RNA, 18 nt, Homo sapiens
ucagccuugccagagauc

SEQ ID NO: 996417 - RNA, 20 nt, Homo sapiens
guauaagccaucaauauuca

SEQ ID NO: 996418 - RNA, 14 nt, Homo sapiens
guauauggacaaaa

SEQ ID NO: 996419 - RNA, 23 nt, Homo sapiens
guauccaugcaccuaccuuagaa

SEQ ID NO: 996420 - RNA, 22 nt, Homo sapiens
guauguauggaugcguggauau

SEQ ID NO: 996421 - RNA, 19 nt, Homo sapiens
guauguucuaaccuuuaca

SEQ ID NO: 996422 - RNA, 19 nt, Homo sapiens
guauucaugacuauggaua

SEQ ID NO: 996423 - RNA, 21 nt, Homo sapiens
guauugucgguuaccucugca

SEQ ID NO: 996424 - RNA, 16 nt, Homo sapiens
guauuugaaauaagaa

SEQ ID NO: 996425 - RNA, 23 nt, Homo sapiens
guauuuucuuacacugugucauu

SEQ ID NO: 996426 - RNA, 17 nt, Homo sapiens
gucaaaaagaaccacuu

SEQ ID NO: 996427 - RNA, 21 nt, Homo sapiens
gucaacaucuuuuacauucug

SEQ ID NO: 996428 - RNA, 21 nt, Homo sapiens
gucaagagugaauucccucac

SEQ ID NO: 996429 - RNA, 14 nt, Homo sapiens
gucaaggcucaguc

SEQ ID NO: 996430 - RNA, 18 nt, Homo sapiens
gucacacgauaaagggau

SEQ ID NO: 996431 - RNA, 13 nt, Homo sapiens
gucacagccaccc

SEQ ID NO: 996432 - RNA, 17 nt, Homo sapiens
gucaccaauguacccac

SEQ ID NO: 996433 - RNA, 14 nt, Homo sapiens
gucaccagaucuga

SEQ ID NO: 996434 - RNA, 20 nt, Homo sapiens
gucacggcugcgcacugugu

SEQ ID NO: 996435 - RNA, 15 nt, Homo sapiens
gucacuucucacaau

SEQ ID NO: 996436 - RNA, 14 nt, Homo sapiens
gucagccacuguuu

SEQ ID NO: 996437 - RNA, 16 nt, Homo sapiens
gucaguauuuuugccg

SEQ ID NO: 996438 - RNA, 17 nt, Homo sapiens
gucaucaucacauucag

SEQ ID NO: 996439 - RNA, 14 nt, Homo sapiens
gucaucugugcacu

SEQ ID NO: 996440 - RNA, 11 nt, Homo sapiens
gucaugcugcc

SEQ ID NO: 996441 - RNA, 23 nt, Homo sapiens
gucauucgcuacuaugauuuaau

SEQ ID NO: 996442 - RNA, 13 nt, Homo sapiens
guccaaaacugcc

SEQ ID NO: 996443 - RNA, 13 nt, Homo sapiens
guccaaugagcuu

SEQ ID NO: 996444 - RNA, 21 nt, Homo sapiens
guccauugauuuuaaccaaug

SEQ ID NO: 996445 - RNA, 18 nt, Homo sapiens
gucccaagcggugucucu

SEQ ID NO: 996446 - RNA, 19 nt, Homo sapiens
gucccaggccaggcuuugu

SEQ ID NO: 996447 - RNA, 17 nt, Homo sapiens
guccccaccuccagucc

SEQ ID NO: 996448 - RNA, 23 nt, Homo sapiens
guccccauacuccuaugaucuga

SEQ ID NO: 996449 - RNA, 17 nt, Homo sapiens
gucccuguccccaccuc

SEQ ID NO: 996450 - RNA, 15 nt, Homo sapiens
guccgaucuuugacu

SEQ ID NO: 996451 - RNA, 14 nt, Homo sapiens
guccuagcacagau

SEQ ID NO: 996452 - RNA, 22 nt, Homo sapiens
guccucugucagucacagccac

SEQ ID NO: 996453 - RNA, 18 nt, Homo sapiens
guccucuuccaccacaga

SEQ ID NO: 996454 - RNA, 17 nt, Homo sapiens
guccugagccccaggga

SEQ ID NO: 996455 - RNA, 17 nt, Homo sapiens
guccugccucagccucc

SEQ ID NO: 996456 - RNA, 23 nt, Homo sapiens
guccugggguauaaaacuuuccu

SEQ ID NO: 996457 - RNA, 22 nt, Homo sapiens
guccugguggggcagcuccucu

SEQ ID NO: 996458 - RNA, 16 nt, Homo sapiens
gucgaaagcucuagaa

SEQ ID NO: 996459 - RNA, 21 nt, Homo sapiens
gucgcccaggcuggagugcag

SEQ ID NO: 996460 - RNA, 18 nt, Homo sapiens
gucguuuuuuucauucca

SEQ ID NO: 996461 - RNA, 19 nt, Homo sapiens
gucuacccgugucuagagg

SEQ ID NO: 996462 - RNA, 20 nt, Homo sapiens
gucuacucccuccucacccc

SEQ ID NO: 996463 - RNA, 16 nt, Homo sapiens
gucuagaggcagguag

SEQ ID NO: 996464 - RNA, 14 nt, Homo sapiens
gucucaucucuuca

SEQ ID NO: 996465 - RNA, 21 nt, Homo sapiens
gucuuccugaguggugccaaa

SEQ ID NO: 996466 - RNA, 14 nt, Homo sapiens
gucuuugcagagaa

SEQ ID NO: 996467 - RNA, 19 nt, Homo sapiens
gucuuuguuaagacugcug

SEQ ID NO: 996468 - RNA, 20 nt, Homo sapiens
gucuuuguuaagacugcuga

SEQ ID NO: 996469 - RNA, 12 nt, Homo sapiens
gucuuuuacccg

SEQ ID NO: 996470 - RNA, 19 nt, Homo sapiens
gugaaagggagaagugaca

SEQ ID NO: 996471 - RNA, 20 nt, Homo sapiens
gugaaaugcuggcauuugca

SEQ ID NO: 996472 - RNA, 14 nt, Homo sapiens
gugaacaaagcagc

SEQ ID NO: 996473 - RNA, 21 nt, Homo sapiens
gugaacaaaguuuaccagaaa

SEQ ID NO: 996474 - RNA, 17 nt, Homo sapiens
gugaaccuuaguaccua

SEQ ID NO: 996475 - RNA, 23 nt, Homo sapiens
gugaauaaaccaucaucuugcca

SEQ ID NO: 996476 - RNA, 22 nt, Homo sapiens
gugaauacugcuacagcaauuu

SEQ ID NO: 996477 - RNA, 14 nt, Homo sapiens
gugaauuaggcugu

SEQ ID NO: 996478 - RNA, 16 nt, Homo sapiens
gugaauuaggcuguaa

SEQ ID NO: 996479 - RNA, 19 nt, Homo sapiens
gugacauuuccaugcauaa

SEQ ID NO: 996480 - RNA, 16 nt, Homo sapiens
gugacauuugggagac

SEQ ID NO: 996481 - RNA, 21 nt, Homo sapiens
gugacauuugggagacaugug

SEQ ID NO: 996482 - RNA, 23 nt, Homo sapiens
gugacauuugggagacaugugac

SEQ ID NO: 996483 - RNA, 15 nt, Homo sapiens
gugaccaaaucagug

SEQ ID NO: 996484 - RNA, 16 nt, Homo sapiens
gugaccacugaagcac

SEQ ID NO: 996485 - RNA, 19 nt, Homo sapiens
gugaccuggaaucagugaa

SEQ ID NO: 996486 - RNA, 19 nt, Homo sapiens
gugacuaauggcaugagaa

SEQ ID NO: 996487 - RNA, 12 nt, Homo sapiens
gugacugcaaua

SEQ ID NO: 996488 - RNA, 21 nt, Homo sapiens
gugacuggcagcauugacucu

SEQ ID NO: 996489 - RNA, 13 nt, Homo sapiens
gugagcucuggga

SEQ ID NO: 996490 - RNA, 19 nt, Homo sapiens
gugaggcuguccuguacau

SEQ ID NO: 996491 - RNA, 20 nt, Homo sapiens
gugaggucagcacaucucaa

SEQ ID NO: 996492 - RNA, 20 nt, Homo sapiens
gugaggugugucacaaugag

SEQ ID NO: 996493 - RNA, 15 nt, Homo sapiens
gugagguucuugggu

SEQ ID NO: 996494 - RNA, 22 nt, Homo sapiens
gugaguuuaccuuguauacugu

SEQ ID NO: 996495 - RNA, 12 nt, Homo sapiens
gugauguucuaa

SEQ ID NO: 996496 - RNA, 14 nt, Homo sapiens
gugauuuacauuuc

SEQ ID NO: 996497 - RNA, 23 nt, Homo sapiens
gugcaguaucaugcccugugcaa

SEQ ID NO: 996498 - RNA, 15 nt, Homo sapiens
gugcccacaguguca

SEQ ID NO: 996499 - RNA, 19 nt, Homo sapiens
gugccccagcagugccuug

SEQ ID NO: 996500 - RNA, 18 nt, Homo sapiens
gugccuugugcaauguga

SEQ ID NO: 996501 - RNA, 13 nt, Homo sapiens
gugcuacaauuca

SEQ ID NO: 996502 - RNA, 15 nt, Homo sapiens
gugcucaaggccagc

SEQ ID NO: 996503 - RNA, 22 nt, Homo sapiens
gugcucuuuguuuugugucucu

SEQ ID NO: 996504 - RNA, 20 nt, Homo sapiens
gugcugggauuacaggugua

SEQ ID NO: 996505 - RNA, 15 nt, Homo sapiens
guggccaugcuccuc

SEQ ID NO: 996506 - RNA, 20 nt, Homo sapiens
guggcccuuaugacugccaa

SEQ ID NO: 996507 - RNA, 22 nt, Homo sapiens
guggcccuuaugacugccaaga

SEQ ID NO: 996508 - RNA, 22 nt, Homo sapiens
guggcccuuucggauccaggga

SEQ ID NO: 996509 - RNA, 15 nt, Homo sapiens
guggcucagccagca

SEQ ID NO: 996510 - RNA, 12 nt, Homo sapiens
guggcugcugug

SEQ ID NO: 996511 - RNA, 20 nt, Homo sapiens
gugggcucccugacugggag

SEQ ID NO: 996512 - RNA, 13 nt, Homo sapiens
gugguacagagaa

SEQ ID NO: 996513 - RNA, 23 nt, Homo sapiens
guggucacagcuguauagcugcu

SEQ ID NO: 996514 - RNA, 17 nt, Homo sapiens
gugguccuuugggguga

SEQ ID NO: 996515 - RNA, 14 nt, Homo sapiens
gugguggucuucaa

SEQ ID NO: 996516 - RNA, 16 nt, Homo sapiens
guguaagggccagaaa

SEQ ID NO: 996517 - RNA, 21 nt, Homo sapiens
guguagcugugaccugcugag

SEQ ID NO: 996518 - RNA, 14 nt, Homo sapiens
guguauuugcuaau

SEQ ID NO: 996519 - RNA, 19 nt, Homo sapiens
gugucacggccaggcagau

SEQ ID NO: 996520 - RNA, 19 nt, Homo sapiens
ucccggaggcggugggccu

SEQ ID NO: 996521 - RNA, 18 nt, Homo sapiens
ucccggggccagcacuuc

SEQ ID NO: 996522 - RNA, 18 nt, Homo sapiens
ucccgucuucuccaacac

SEQ ID NO: 996523 - RNA, 20 nt, Homo sapiens
ucccuccccaguucauugca

SEQ ID NO: 996524 - RNA, 16 nt, Homo sapiens
ucccugcacagugacu

SEQ ID NO: 996525 - RNA, 17 nt, Homo sapiens
ucccugcacagugacuu

SEQ ID NO: 996526 - RNA, 19 nt, Homo sapiens
ucccugcuuaaauuucucc

SEQ ID NO: 996527 - RNA, 12 nt, Homo sapiens
ucccuggaugac

SEQ ID NO: 996528 - RNA, 14 nt, Homo sapiens
ucccuggaugacau

SEQ ID NO: 996529 - RNA, 19 nt, Homo sapiens
ucccuggcccccgggugua

SEQ ID NO: 996530 - RNA, 20 nt, Homo sapiens
ucccugggccugcugcugag

SEQ ID NO: 996531 - RNA, 22 nt, Homo sapiens
ucccuguacaguagauuuucca

SEQ ID NO: 996532 - RNA, 19 nt, Homo sapiens
ucccuugccucaaugccag

SEQ ID NO: 996533 - RNA, 21 nt, Homo sapiens
ucccuugggaagggcagggaa

SEQ ID NO: 996534 - RNA, 14 nt, Homo sapiens
ucccuuguaaauag

SEQ ID NO: 996535 - RNA, 15 nt, Homo sapiens
ucccuuucacuaaaa

SEQ ID NO: 996536 - RNA, 23 nt, Homo sapiens
ucccuuuggagauuuuuuaaucc

SEQ ID NO: 996537 - RNA, 19 nt, Homo sapiens
ucccuuuuucaaugaauuu

SEQ ID NO: 996538 - RNA, 18 nt, Homo sapiens
uccgccacuggggcucag

SEQ ID NO: 996539 - RNA, 14 nt, Homo sapiens
uccgcccugccacu

SEQ ID NO: 996540 - RNA, 22 nt, Homo sapiens
uccgggaagugagggcucacuc

SEQ ID NO: 996541 - RNA, 13 nt, Homo sapiens
uccgugugggaga

SEQ ID NO: 996542 - RNA, 13 nt, Homo sapiens
uccuaaccuagag

SEQ ID NO: 996543 - RNA, 17 nt, Homo sapiens
uccuaagcaacuaggcc

SEQ ID NO: 996544 - RNA, 13 nt, Homo sapiens
uccuaauacuguc

SEQ ID NO: 996545 - RNA, 14 nt, Homo sapiens
uccuaauacuguca

SEQ ID NO: 996546 - RNA, 18 nt, Homo sapiens
uccuacuggucucucuau

SEQ ID NO: 996547 - RNA, 18 nt, Homo sapiens
uccuacuguaugugggaa

SEQ ID NO: 996548 - RNA, 22 nt, Homo sapiens
uccuaucuccagcggcccuguc

SEQ ID NO: 996549 - RNA, 19 nt, Homo sapiens
uccuaugcuuugaaacaga

SEQ ID NO: 996550 - RNA, 19 nt, Homo sapiens
uccuauggcagagcauuca

SEQ ID NO: 996551 - RNA, 16 nt, Homo sapiens
uccuaugggaacaauu

SEQ ID NO: 996552 - RNA, 20 nt, Homo sapiens
uccuauggguugucaccaag

SEQ ID NO: 996553 - RNA, 14 nt, Homo sapiens
uccucaauccagcu

SEQ ID NO: 996554 - RNA, 19 nt, Homo sapiens
uccucagccuugccagaga

SEQ ID NO: 996555 - RNA, 22 nt, Homo sapiens
uccucaggcacacagcuacucu

SEQ ID NO: 996556 - RNA, 20 nt, Homo sapiens
uccuccagggugugugcucg

SEQ ID NO: 996557 - RNA, 20 nt, Homo sapiens
uccucccuccccgcccucac

SEQ ID NO: 996558 - RNA, 13 nt, Homo sapiens
uccucugacucag

SEQ ID NO: 996559 - RNA, 16 nt, Homo sapiens
uccucuguaaacuuuu

SEQ ID NO: 996560 - RNA, 20 nt, Homo sapiens
uccugaaaaaaaaccugaga

SEQ ID NO: 996561 - RNA, 13 nt, Homo sapiens
uccugagcacugc

SEQ ID NO: 996562 - RNA, 17 nt, Homo sapiens
uccugccauagucuuaa

SEQ ID NO: 996563 - RNA, 17 nt, Homo sapiens
uccugccgcaacaguuu

SEQ ID NO: 996564 - RNA, 23 nt, Homo sapiens
uccugcucucuggaggacgguca

SEQ ID NO: 996565 - RNA, 18 nt, Homo sapiens
uccugcugcucccucaga

SEQ ID NO: 996566 - RNA, 15 nt, Homo sapiens
uccuggacagcugug

SEQ ID NO: 996567 - RNA, 10 nt, Homo sapiens
uccuggaccc

SEQ ID NO: 996568 - RNA, 18 nt, Homo sapiens
uccuggaucucccugaga

SEQ ID NO: 996569 - RNA, 19 nt, Homo sapiens
uccuggcacuaacguugag

SEQ ID NO: 996570 - RNA, 12 nt, Homo sapiens
uccuggugcugg

SEQ ID NO: 996571 - RNA, 14 nt, Homo sapiens
uccuguccagcucc

SEQ ID NO: 996572 - RNA, 23 nt, Homo sapiens
uccuguccagcuccaaccugcaa

SEQ ID NO: 996573 - RNA, 20 nt, Homo sapiens
uccugugaaugccacugccu

SEQ ID NO: 996574 - RNA, 17 nt, Homo sapiens
uccugugaccacaacau

SEQ ID NO: 996575 - RNA, 23 nt, Homo sapiens
uccuguucacaccagagaaccag

SEQ ID NO: 996576 - RNA, 19 nt, Homo sapiens
uccuguuuaaaaaaccaca

SEQ ID NO: 996577 - RNA, 16 nt, Homo sapiens
uccuuagacucuuuuc

SEQ ID NO: 996578 - RNA, 10 nt, Homo sapiens
uccuucccaa

SEQ ID NO: 996579 - RNA, 11 nt, Homo sapiens
uccuucccaau

SEQ ID NO: 996580 - RNA, 20 nt, Homo sapiens
uccuugacccugcuuuuugc

SEQ ID NO: 996581 - RNA, 14 nt, Homo sapiens
uccuugaugauuga

SEQ ID NO: 996582 - RNA, 15 nt, Homo sapiens
uccuugcuuccuguc

SEQ ID NO: 996583 - RNA, 13 nt, Homo sapiens
uccuuuaugaucc

SEQ ID NO: 996584 - RNA, 14 nt, Homo sapiens
uccuuuuuuauucc

SEQ ID NO: 996585 - RNA, 16 nt, Homo sapiens
ucgcagccacccugag

SEQ ID NO: 996586 - RNA, 17 nt, Homo sapiens
ucgcauuuccugagaac

SEQ ID NO: 996587 - RNA, 17 nt, Homo sapiens
ucgcccuuugcugcaug

SEQ ID NO: 996588 - RNA, 22 nt, Homo sapiens
caucugacaugcaucaucucau

SEQ ID NO: 996589 - RNA, 16 nt, Homo sapiens
caucugaggaaugaga

SEQ ID NO: 996590 - RNA, 15 nt, Homo sapiens
caucugcgugacaau

SEQ ID NO: 996591 - RNA, 16 nt, Homo sapiens
caucuugcauuaugca

SEQ ID NO: 996592 - RNA, 22 nt, Homo sapiens
caucuuuacaaaacuacaugag

SEQ ID NO: 996593 - RNA, 19 nt, Homo sapiens
caugaaaguggacaaggag

SEQ ID NO: 996594 - RNA, 10 nt, Homo sapiens
caugaaggug

SEQ ID NO: 996595 - RNA, 18 nt, Homo sapiens
caugagaccacuguuauc

SEQ ID NO: 996596 - RNA, 22 nt, Homo sapiens
caugauuucauuucaacuguuu

SEQ ID NO: 996597 - RNA, 17 nt, Homo sapiens
caugauuuccuugaaug

SEQ ID NO: 996598 - RNA, 15 nt, Homo sapiens
caugcccugugcaac

SEQ ID NO: 996599 - RNA, 16 nt, Homo sapiens
caugcccugugcaacc

SEQ ID NO: 996600 - RNA, 22 nt, Homo sapiens
caugccucugaggccagccugg

SEQ ID NO: 996601 - RNA, 22 nt, Homo sapiens
caugcgaugacacuuguacaau

SEQ ID NO: 996602 - RNA, 18 nt, Homo sapiens
caugcgguagccagcaca

SEQ ID NO: 996603 - RNA, 22 nt, Homo sapiens
caugcuccagauuagagccugu

SEQ ID NO: 996604 - RNA, 17 nt, Homo sapiens
caugcugggauuuccaa

SEQ ID NO: 996605 - RNA, 14 nt, Homo sapiens
caugcugugcugug

SEQ ID NO: 996606 - RNA, 21 nt, Homo sapiens
caugcuuagcaguccccuucc

SEQ ID NO: 996607 - RNA, 14 nt, Homo sapiens
cauggaagcgcaca

SEQ ID NO: 996608 - RNA, 17 nt, Homo sapiens
cauggagaccgugacca

SEQ ID NO: 996609 - RNA, 17 nt, Homo sapiens
cauggccagcagcaccu

SEQ ID NO: 996610 - RNA, 14 nt, Homo sapiens
cauggccuaagggc

SEQ ID NO: 996611 - RNA, 23 nt, Homo sapiens
cauggccuaagggccacauccca

SEQ ID NO: 996612 - RNA, 20 nt, Homo sapiens
cauggcuuguagcccuuucc

SEQ ID NO: 996613 - RNA, 12 nt, Homo sapiens
caugguacaaac

SEQ ID NO: 996614 - RNA, 19 nt, Homo sapiens
cauggucccacaucccugg

SEQ ID NO: 996615 - RNA, 15 nt, Homo sapiens
caugguguccagaca

SEQ ID NO: 996616 - RNA, 18 nt, Homo sapiens
caugguugaaaccccauc

SEQ ID NO: 996617 - RNA, 17 nt, Homo sapiens
cauguacauacccuggc

SEQ ID NO: 996618 - RNA, 16 nt, Homo sapiens
cauguaggaguguuua

SEQ ID NO: 996619 - RNA, 21 nt, Homo sapiens
cauguaggaguguuuaucuuu

SEQ ID NO: 996620 - RNA, 19 nt, Homo sapiens
caugucauuucagaaguua

SEQ ID NO: 996621 - RNA, 18 nt, Homo sapiens
caugucccauuuuagcca

SEQ ID NO: 996622 - RNA, 18 nt, Homo sapiens
caugucugcuggguguga

SEQ ID NO: 996623 - RNA, 17 nt, Homo sapiens
caugugcaaaugugcug

SEQ ID NO: 996624 - RNA, 17 nt, Homo sapiens
caugugccagggcaaug

SEQ ID NO: 996625 - RNA, 18 nt, Homo sapiens
caugugcgcgcgugcaug

SEQ ID NO: 996626 - RNA, 24 nt, Homo sapiens
cauguuagccaggcuggucucaaa

SEQ ID NO: 996627 - RNA, 14 nt, Homo sapiens
cauguuaguuaccu

SEQ ID NO: 996628 - RNA, 15 nt, Homo sapiens
cauuaaacuuaccug

SEQ ID NO: 996629 - RNA, 18 nt, Homo sapiens
cauuaaagaaggguugag

SEQ ID NO: 996630 - RNA, 14 nt, Homo sapiens
cauuaaucaguuca

SEQ ID NO: 996631 - RNA, 19 nt, Homo sapiens
cauuaucgagcagcauuuu

SEQ ID NO: 996632 - RNA, 19 nt, Homo sapiens
cauuaucuaguucauugaa

SEQ ID NO: 996633 - RNA, 18 nt, Homo sapiens
cauuccaaagaacagccu

SEQ ID NO: 996634 - RNA, 17 nt, Homo sapiens
cauuccgagauuuuaaa

SEQ ID NO: 996635 - RNA, 19 nt, Homo sapiens
cauuccucaugaauguaaa

SEQ ID NO: 996636 - RNA, 13 nt, Homo sapiens
cauuccugaagaa

SEQ ID NO: 996637 - RNA, 16 nt, Homo sapiens
cauucugcaaguauac

SEQ ID NO: 996638 - RNA, 13 nt, Homo sapiens
cauucugcuccuu

SEQ ID NO: 996639 - RNA, 17 nt, Homo sapiens
cauucuguuagauacua

SEQ ID NO: 996640 - RNA, 18 nt, Homo sapiens
cauucuucugagcacugu

SEQ ID NO: 996641 - RNA, 19 nt, Homo sapiens
cauucuucugagcacuguu

SEQ ID NO: 996642 - RNA, 18 nt, Homo sapiens
cauugauuugcucuuacu

SEQ ID NO: 996643 - RNA, 14 nt, Homo sapiens
cauugcacuuugau

SEQ ID NO: 996644 - RNA, 17 nt, Homo sapiens
cauugcagcaagcaaua

SEQ ID NO: 996645 - RNA, 16 nt, Homo sapiens
cauuggcuaauugcac

SEQ ID NO: 996646 - RNA, 16 nt, Homo sapiens
cauugguccaagauuc

SEQ ID NO: 996647 - RNA, 16 nt, Homo sapiens
cauuguagccucaauc

SEQ ID NO: 996648 - RNA, 22 nt, Homo sapiens
cauuguagccucaaucgaguga

SEQ ID NO: 996649 - RNA, 19 nt, Homo sapiens
cauuguauguggucaugga

SEQ ID NO: 996650 - RNA, 15 nt, Homo sapiens
cauugugaggguuaa

SEQ ID NO: 996651 - RNA, 18 nt, Homo sapiens
cauuguggucauagcacc

SEQ ID NO: 996652 - RNA, 22 nt, Homo sapiens
cauuguuuagaaagaauauuca

SEQ ID NO: 996653 - RNA, 22 nt, Homo sapiens
cauuuaguuugauuauucagug

SEQ ID NO: 996654 - RNA, 16 nt, Homo sapiens
cauuucuauagccaaa

SEQ ID NO: 996655 - RNA, 23 nt, Homo sapiens
cauuucucauaccuuccccacau

SEQ ID NO: 996656 - RNA, 22 nt, Homo sapiens
cauuucucaucaguaguucaca

SEQ ID NO: 996657 - RNA, 20 nt, Homo sapiens
caggcgugagccaccaugcc

SEQ ID NO: 996658 - RNA, 18 nt, Homo sapiens
caggcucucgcacaccuc

SEQ ID NO: 996659 - RNA, 14 nt, Homo sapiens
caggcuggccaguc

SEQ ID NO: 996660 - RNA, 17 nt, Homo sapiens
caggcugggccaugucc

SEQ ID NO: 996661 - RNA, 20 nt, Homo sapiens
caggcugggccauguccaaa

SEQ ID NO: 996662 - RNA, 13 nt, Homo sapiens
caggcuggucuca

SEQ ID NO: 996663 - RNA, 16 nt, Homo sapiens
cagggaaaacugcaaa

SEQ ID NO: 996664 - RNA, 18 nt, Homo sapiens
cagggauuaaccucugca

SEQ ID NO: 996665 - RNA, 15 nt, Homo sapiens
cagggcagccaggga

SEQ ID NO: 996666 - RNA, 19 nt, Homo sapiens
cagggcccagagcccagcu

SEQ ID NO: 996667 - RNA, 17 nt, Homo sapiens
cagggcccccaucucau

SEQ ID NO: 996668 - RNA, 22 nt, Homo sapiens
caggggcccgcgauguggaacu

SEQ ID NO: 996669 - RNA, 14 nt, Homo sapiens
cagggggaaggugg

SEQ ID NO: 996670 - RNA, 21 nt, Homo sapiens
cagggggcugcugcugggcuc

SEQ ID NO: 996671 - RNA, 18 nt, Homo sapiens
cagggucccucuguguau

SEQ ID NO: 996672 - RNA, 20 nt, Homo sapiens
caggguccucuucugggccu

SEQ ID NO: 996673 - RNA, 15 nt, Homo sapiens
caggguuaucugcaa

SEQ ID NO: 996674 - RNA, 17 nt, Homo sapiens
cagguaccucuuucagg

SEQ ID NO: 996675 - RNA, 13 nt, Homo sapiens
cagguacuuguaa

SEQ ID NO: 996676 - RNA, 19 nt, Homo sapiens
caggucacccuuugcugug

SEQ ID NO: 996677 - RNA, 18 nt, Homo sapiens
caggucucccuggaucag

SEQ ID NO: 996678 - RNA, 12 nt, Homo sapiens
caggugaacaaa

SEQ ID NO: 996679 - RNA, 22 nt, Homo sapiens
caggugaggucagcacaucuca

SEQ ID NO: 996680 - RNA, 17 nt, Homo sapiens
caggugauccaccugcc

SEQ ID NO: 996681 - RNA, 17 nt, Homo sapiens
caggugccuucccagac

SEQ ID NO: 996682 - RNA, 14 nt, Homo sapiens
cagguguugccaaa

SEQ ID NO: 996683 - RNA, 16 nt, Homo sapiens
cagguuaaugcugaaa

SEQ ID NO: 996684 - RNA, 17 nt, Homo sapiens
cagguuauaacaguguu

SEQ ID NO: 996685 - RNA, 22 nt, Homo sapiens
cagguucaugccaccauggcca

SEQ ID NO: 996686 - RNA, 22 nt, Homo sapiens
cagguucccacuuaaaaauuaa

SEQ ID NO: 996687 - RNA, 17 nt, Homo sapiens
caguaaauaacuggaaa

SEQ ID NO: 996688 - RNA, 17 nt, Homo sapiens
caguaacgcgucuuccu

SEQ ID NO: 996689 - RNA, 22 nt, Homo sapiens
caguaagagguguuauuuggaa

SEQ ID NO: 996690 - RNA, 16 nt, Homo sapiens
caguacccucucagcu

SEQ ID NO: 996691 - RNA, 18 nt, Homo sapiens
caguacccucucagcucc

SEQ ID NO: 996692 - RNA, 15 nt, Homo sapiens
caguagagcucuacu

SEQ ID NO: 996693 - RNA, 14 nt, Homo sapiens
caguagauuuucca

SEQ ID NO: 996694 - RNA, 16 nt, Homo sapiens
caguagucccugcaca

SEQ ID NO: 996695 - RNA, 14 nt, Homo sapiens
caguaugacaguau

SEQ ID NO: 996696 - RNA, 12 nt, Homo sapiens
cagucacagcca

SEQ ID NO: 996697 - RNA, 13 nt, Homo sapiens
cagucacagccac

SEQ ID NO: 996698 - RNA, 22 nt, Homo sapiens
cagucacucuagucaaugacau

SEQ ID NO: 996699 - RNA, 18 nt, Homo sapiens
cagucaggcccaggcacu

SEQ ID NO: 996700 - RNA, 21 nt, Homo sapiens
cagucauaacuaaauaaagcu

SEQ ID NO: 996701 - RNA, 19 nt, Homo sapiens
caguccugccucagccucc

SEQ ID NO: 996702 - RNA, 11 nt, Homo sapiens
cagucugugaa

SEQ ID NO: 996703 - RNA, 19 nt, Homo sapiens
cagugaagagccacugcca

SEQ ID NO: 996704 - RNA, 17 nt, Homo sapiens
cagugaaguugcugcuu

SEQ ID NO: 996705 - RNA, 15 nt, Homo sapiens
cagugacccuggcuc

SEQ ID NO: 996706 - RNA, 15 nt, Homo sapiens
cagugccaccaucau

SEQ ID NO: 996707 - RNA, 16 nt, Homo sapiens
cagugcccccacugac

SEQ ID NO: 996708 - RNA, 19 nt, Homo sapiens
cagugccuuaaacucuguu

SEQ ID NO: 996709 - RNA, 11 nt, Homo sapiens
cagugcuuccc

SEQ ID NO: 996710 - RNA, 18 nt, Homo sapiens
caguggcccauggcauuu

SEQ ID NO: 996711 - RNA, 19 nt, Homo sapiens
cagugguggucuucaagac

SEQ ID NO: 996712 - RNA, 18 nt, Homo sapiens
cagugucaggcacugggc

SEQ ID NO: 996713 - RNA, 17 nt, Homo sapiens
caguguccugagcucag

SEQ ID NO: 996714 - RNA, 18 nt, Homo sapiens
caguguccugagcucagc

SEQ ID NO: 996715 - RNA, 20 nt, Homo sapiens
caguguuggggaugccuugg

SEQ ID NO: 996716 - RNA, 18 nt, Homo sapiens
caguguuuauccuuucau

SEQ ID NO: 996717 - RNA, 12 nt, Homo sapiens
caguucagugag

SEQ ID NO: 996718 - RNA, 15 nt, Homo sapiens
caguucgacucugug

SEQ ID NO: 996719 - RNA, 19 nt, Homo sapiens
caguucgcagccacccuga

SEQ ID NO: 996720 - RNA, 18 nt, Homo sapiens
caguucuuugggccagac

SEQ ID NO: 996721 - RNA, 18 nt, Homo sapiens
caguugggacuacaggcg

SEQ ID NO: 996722 - RNA, 22 nt, Homo sapiens
caguuuugucaaugcaguuguc

SEQ ID NO: 996723 - RNA, 17 nt, Homo sapiens
cauaaaauagagugcau

SEQ ID NO: 996724 - RNA, 16 nt, Homo sapiens
cauaaauccuugauga

SEQ ID NO: 996725 - RNA, 20 nt, Homo sapiens
ccggcagcagcccccagcuc

SEQ ID NO: 996726 - RNA, 15 nt, Homo sapiens
ccggcuccugugcug

SEQ ID NO: 996727 - RNA, 15 nt, Homo sapiens
ccggggccagcacuu

SEQ ID NO: 996728 - RNA, 18 nt, Homo sapiens
ccgugaggcaaugggagc

SEQ ID NO: 996729 - RNA, 18 nt, Homo sapiens
ccuaaaaggaaaucucac

SEQ ID NO: 996730 - RNA, 19 nt, Homo sapiens
ccuaaaagugggcuugauu

SEQ ID NO: 996731 - RNA, 20 nt, Homo sapiens
ccuaaagccucaaaacaaag

SEQ ID NO: 996732 - RNA, 15 nt, Homo sapiens
ccuaaaguacuggga

SEQ ID NO: 996733 - RNA, 18 nt, Homo sapiens
ccuaaaguacugggauua

SEQ ID NO: 996734 - RNA, 17 nt, Homo sapiens
ccuaaaugcacagucau

SEQ ID NO: 996735 - RNA, 16 nt, Homo sapiens
ccuaacacggugcuca

SEQ ID NO: 996736 - RNA, 17 nt, Homo sapiens
ccuaagagagcaccugg

SEQ ID NO: 996737 - RNA, 20 nt, Homo sapiens
ccuaauacugucauccucaa

SEQ ID NO: 996738 - RNA, 20 nt, Homo sapiens
ccuaauccaggcagauccag

SEQ ID NO: 996739 - RNA, 20 nt, Homo sapiens
ccuaccaggcacgucugcag

SEQ ID NO: 996740 - RNA, 17 nt, Homo sapiens
ccuagacuagagggcag

SEQ ID NO: 996741 - RNA, 15 nt, Homo sapiens
ccuaguucuucaucc

SEQ ID NO: 996742 - RNA, 18 nt, Homo sapiens
ccuauauugcauuaauuu

SEQ ID NO: 996743 - RNA, 21 nt, Homo sapiens
ccuauggagagcccugggacc

SEQ ID NO: 996744 - RNA, 17 nt, Homo sapiens
ccucaaaacaaaggccu

SEQ ID NO: 996745 - RNA, 19 nt, Homo sapiens
ccucaaaugcaccauguca

SEQ ID NO: 996746 - RNA, 19 nt, Homo sapiens
ccucaaaugcggggugggg

SEQ ID NO: 996747 - RNA, 20 nt, Homo sapiens
ccucaaccccuccccuccau

SEQ ID NO: 996748 - RNA, 18 nt, Homo sapiens
ccucacaggccccaggaa

SEQ ID NO: 996749 - RNA, 21 nt, Homo sapiens
ccucaccuuggcaccagacac

SEQ ID NO: 996750 - RNA, 22 nt, Homo sapiens
ccucacucuguuuccuggucag

SEQ ID NO: 996751 - RNA, 14 nt, Homo sapiens
ccucacuuuacaca

SEQ ID NO: 996752 - RNA, 20 nt, Homo sapiens
gaggccaauccuauggcaga

SEQ ID NO: 996753 - RNA, 14 nt, Homo sapiens
gaggccacccagag

SEQ ID NO: 996754 - RNA, 13 nt, Homo sapiens
gaggccacuguuu

SEQ ID NO: 996755 - RNA, 20 nt, Homo sapiens
gaggccuuacuuaaacccag

SEQ ID NO: 996756 - RNA, 21 nt, Homo sapiens
gaggcgcugcugguguucuua

SEQ ID NO: 996757 - RNA, 16 nt, Homo sapiens
gaggcugccccucuca

SEQ ID NO: 996758 - RNA, 20 nt, Homo sapiens
gaggcugguccuauggccuc

SEQ ID NO: 996759 - RNA, 16 nt, Homo sapiens
gagggcgcaggccgug

SEQ ID NO: 996760 - RNA, 21 nt, Homo sapiens
gagggcucaccucuugccuuc

SEQ ID NO: 996761 - RNA, 14 nt, Homo sapiens
gaggggaccaggag

SEQ ID NO: 996762 - RNA, 14 nt, Homo sapiens
gaggguuugcagaa

SEQ ID NO: 996763 - RNA, 16 nt, Homo sapiens
gagguccugagcacug

SEQ ID NO: 996764 - RNA, 22 nt, Homo sapiens
gaggugagggggguucuccuuu

SEQ ID NO: 996765 - RNA, 14 nt, Homo sapiens
gagguuaaggcaua

SEQ ID NO: 996766 - RNA, 17 nt, Homo sapiens
gagguuugccagcauuu

SEQ ID NO: 996767 - RNA, 13 nt, Homo sapiens
gaguaacaauaca

SEQ ID NO: 996768 - RNA, 18 nt, Homo sapiens
gaguaguauuaaaagcua

SEQ ID NO: 996769 - RNA, 15 nt, Homo sapiens
gagucugaacagcug

SEQ ID NO: 996770 - RNA, 15 nt, Homo sapiens
gagucuuugcagaga

SEQ ID NO: 996771 - RNA, 11 nt, Homo sapiens
gagugcagugc

SEQ ID NO: 996772 - RNA, 16 nt, Homo sapiens
gagugcaguggcgcga

SEQ ID NO: 996773 - RNA, 11 nt, Homo sapiens
gaguggugcca

SEQ ID NO: 996774 - RNA, 22 nt, Homo sapiens
gaguguuccccuuccacugagg

SEQ ID NO: 996775 - RNA, 14 nt, Homo sapiens
gaguuacaguucug

SEQ ID NO: 996776 - RNA, 17 nt, Homo sapiens
gaguugucaagucucug

SEQ ID NO: 996777 - RNA, 23 nt, Homo sapiens
gaguuucuggcucuugaggcauu

SEQ ID NO: 996778 - RNA, 13 nt, Homo sapiens
gaguuuucagugg

SEQ ID NO: 996779 - RNA, 17 nt, Homo sapiens
gauaaccuugugccuug

SEQ ID NO: 996780 - RNA, 24 nt, Homo sapiens
gauaauauccagccucccacaaga

SEQ ID NO: 996781 - RNA, 13 nt, Homo sapiens
gauacauacagaa

SEQ ID NO: 996782 - RNA, 20 nt, Homo sapiens
gauacuaacauuuucauuga

SEQ ID NO: 996783 - RNA, 17 nt, Homo sapiens
gauacuguugcacgugu

SEQ ID NO: 996784 - RNA, 23 nt, Homo sapiens
gauauagaaguauaaagaauugu

SEQ ID NO: 996785 - RNA, 10 nt, Homo sapiens
gauaugcaca

SEQ ID NO: 996786 - RNA, 19 nt, Homo sapiens
gaucagcaaaccggggccu

SEQ ID NO: 996787 - RNA, 15 nt, Homo sapiens
gaucagcgacccuga

SEQ ID NO: 996788 - RNA, 21 nt, Homo sapiens
gauccccggggcggcaggaag

SEQ ID NO: 996789 - RNA, 19 nt, Homo sapiens
gauccuaagcaucuaaguu

SEQ ID NO: 996790 - RNA, 23 nt, Homo sapiens
gaucugauaaggaucuaggagaa

SEQ ID NO: 996791 - RNA, 23 nt, Homo sapiens
gaucuggaacccagacucagaca

SEQ ID NO: 996792 - RNA, 19 nt, Homo sapiens
gaucuggcccuugcuuacc

SEQ ID NO: 996793 - RNA, 13 nt, Homo sapiens
gaucuuagauucu

SEQ ID NO: 996794 - RNA, 18 nt, Homo sapiens
gaugaaaguacauuggga

SEQ ID NO: 996795 - RNA, 20 nt, Homo sapiens
gaugaacccgaggcugagaa

SEQ ID NO: 996796 - RNA, 22 nt, Homo sapiens
gaugaaucgcauuuccugagaa

SEQ ID NO: 996797 - RNA, 12 nt, Homo sapiens
gaugacaaagaa

SEQ ID NO: 996798 - RNA, 18 nt, Homo sapiens
gaugacccuuuucaugau

SEQ ID NO: 996799 - RNA, 21 nt, Homo sapiens
gaugagcuuugucuacuucaa

SEQ ID NO: 996800 - RNA, 15 nt, Homo sapiens
gaugaggcuuuccau

SEQ ID NO: 996801 - RNA, 18 nt, Homo sapiens
gaugagggaaaagaaaaa

SEQ ID NO: 996802 - RNA, 13 nt, Homo sapiens
gaugauacaucca

SEQ ID NO: 996803 - RNA, 19 nt, Homo sapiens
gaugcuggguccauaucac

SEQ ID NO: 996804 - RNA, 23 nt, Homo sapiens
gauguagcaugcuuguugcaauu

SEQ ID NO: 996805 - RNA, 15 nt, Homo sapiens
gaugucauacagaga

SEQ ID NO: 996806 - RNA, 20 nt, Homo sapiens
gaugucuccuaagcaccugu

SEQ ID NO: 996807 - RNA, 13 nt, Homo sapiens
gaugugaagccaa

SEQ ID NO: 996808 - RNA, 16 nt, Homo sapiens
gauguugaacugguca

SEQ ID NO: 996809 - RNA, 13 nt, Homo sapiens
gauuaacauauag

SEQ ID NO: 996810 - RNA, 23 nt, Homo sapiens
gauuaaccucugcacuacugaca

SEQ ID NO: 996811 - RNA, 19 nt, Homo sapiens
gauuauuagaaucaaacau

SEQ ID NO: 996812 - RNA, 22 nt, Homo sapiens
gauuauucugggggcugcaguu

SEQ ID NO: 996813 - RNA, 23 nt, Homo sapiens
gauucaccucuucuuucccuccu

SEQ ID NO: 996814 - RNA, 21 nt, Homo sapiens
gauucugccuuugccagguga

SEQ ID NO: 996815 - RNA, 17 nt, Homo sapiens
gauucugguuccagggu

SEQ ID NO: 996816 - RNA, 20 nt, Homo sapiens
gauugcacguggccucuuga

SEQ ID NO: 996817 - RNA, 16 nt, Homo sapiens
gauuuaaucugccaag

SEQ ID NO: 996818 - RNA, 15 nt, Homo sapiens
gauuuaucacacaaa

SEQ ID NO: 996819 - RNA, 15 nt, Homo sapiens
gauuucagcagggau

SEQ ID NO: 996820 - RNA, 21 nt, Homo sapiens
gauuucauaguucagaauuua

SEQ ID NO: 996821 - RNA, 17 nt, Homo sapiens
gauuuuuuccucugcau

SEQ ID NO: 996822 - RNA, 17 nt, Homo sapiens
gcaaaaucuaccagguc

SEQ ID NO: 996823 - RNA, 13 nt, Homo sapiens
gcaaagcacagag

SEQ ID NO: 996824 - RNA, 11 nt, Homo sapiens
gcaaagccugu

SEQ ID NO: 996825 - RNA, 18 nt, Homo sapiens
gcaaaggaagacgugaug

SEQ ID NO: 996826 - RNA, 14 nt, Homo sapiens
gcaaauaaauaucc

SEQ ID NO: 996827 - RNA, 13 nt, Homo sapiens
gcaaauacuguau

SEQ ID NO: 996828 - RNA, 21 nt, Homo sapiens
gcaaauguaguauggccugug

SEQ ID NO: 996829 - RNA, 23 nt, Homo sapiens
gcaaauguaguauggccuguguc

SEQ ID NO: 996830 - RNA, 14 nt, Homo sapiens
gcaacagacuugaa

SEQ ID NO: 996831 - RNA, 18 nt, Homo sapiens
gcaacagcaaacaggugc

SEQ ID NO: 996832 - RNA, 17 nt, Homo sapiens
gcaacaggaacuuggag

SEQ ID NO: 996833 - RNA, 19 nt, Homo sapiens
gcaacaggcucacugguca

SEQ ID NO: 996834 - RNA, 12 nt, Homo sapiens
gcaacaguuuuu

SEQ ID NO: 996835 - RNA, 11 nt, Homo sapiens
gcaacaucucu

SEQ ID NO: 996836 - RNA, 16 nt, Homo sapiens
gcaacaucucugggaa

SEQ ID NO: 996837 - RNA, 22 nt, Homo sapiens
gcaacaugaugagguaguaccu

SEQ ID NO: 996838 - RNA, 16 nt, Homo sapiens
gcaacuaggccuucag

SEQ ID NO: 996839 - RNA, 14 nt, Homo sapiens
gcaacucuguaaau

SEQ ID NO: 996840 - RNA, 15 nt, Homo sapiens
gcaagcacaucugca

SEQ ID NO: 996841 - RNA, 16 nt, Homo sapiens
gcaagccugucuucag

SEQ ID NO: 996842 - RNA, 11 nt, Homo sapiens
gcaaggugcau

SEQ ID NO: 996843 - RNA, 23 nt, Homo sapiens
gcaaucaaguccuacaagcuaaa

SEQ ID NO: 996844 - RNA, 14 nt, Homo sapiens
gcaauguguguaua

SEQ ID NO: 996845 - RNA, 16 nt, Homo sapiens
gccgggaccacccuga

SEQ ID NO: 996846 - RNA, 13 nt, Homo sapiens
gccguggcccuug

SEQ ID NO: 996847 - RNA, 16 nt, Homo sapiens
gccuaaggugucugag

SEQ ID NO: 996848 - RNA, 18 nt, Homo sapiens
gccuaggccugggcagug

SEQ ID NO: 996849 - RNA, 14 nt, Homo sapiens
gccucagaagugca

SEQ ID NO: 996850 - RNA, 17 nt, Homo sapiens
gccucagagacaucagc

SEQ ID NO: 996851 - RNA, 23 nt, Homo sapiens
gccucagcucccacaagccucug

SEQ ID NO: 996852 - RNA, 14 nt, Homo sapiens
gccucuacugggaa

SEQ ID NO: 996853 - RNA, 18 nt, Homo sapiens
gccucuccuacuaugcaa

SEQ ID NO: 996854 - RNA, 14 nt, Homo sapiens
gccucuguggcacu

SEQ ID NO: 996855 - RNA, 13 nt, Homo sapiens
gccugacaaccac

SEQ ID NO: 996856 - RNA, 23 nt, Homo sapiens
gccugagaacaccagagaccuca

SEQ ID NO: 996857 - RNA, 16 nt, Homo sapiens
gccugagcccagggag

SEQ ID NO: 996858 - RNA, 13 nt, Homo sapiens
gccugaggcaauu

SEQ ID NO: 996859 - RNA, 13 nt, Homo sapiens
gccugagucaccu

SEQ ID NO: 996860 - RNA, 13 nt, Homo sapiens
gccugcaaacugg

SEQ ID NO: 996861 - RNA, 15 nt, Homo sapiens
gccugcaaacuggga

SEQ ID NO: 996862 - RNA, 15 nt, Homo sapiens
gccugcaggaucuca

SEQ ID NO: 996863 - RNA, 16 nt, Homo sapiens
gccugccacuguguga

SEQ ID NO: 996864 - RNA, 22 nt, Homo sapiens
gccuggacuguuuucucucggc

SEQ ID NO: 996865 - RNA, 15 nt, Homo sapiens
gccuggggucuggag

SEQ ID NO: 996866 - RNA, 16 nt, Homo sapiens
gccugggugacauuug

SEQ ID NO: 996867 - RNA, 22 nt, Homo sapiens
gccuguacuagagcaagcagga

SEQ ID NO: 996868 - RNA, 16 nt, Homo sapiens
gccugucuagcucaua

SEQ ID NO: 996869 - RNA, 12 nt, Homo sapiens
gccugugcaaug

SEQ ID NO: 996870 - RNA, 23 nt, Homo sapiens
gccuguggcgccgucuccagggg

SEQ ID NO: 996871 - RNA, 15 nt, Homo sapiens
gccuuaaccaugagg

SEQ ID NO: 996872 - RNA, 14 nt, Homo sapiens
gccuuaucuugcac

SEQ ID NO: 996873 - RNA, 22 nt, Homo sapiens
gccuucaccuucaccuucaucc

SEQ ID NO: 996874 - RNA, 14 nt, Homo sapiens
gccuugcuuguuaa

SEQ ID NO: 996875 - RNA, 12 nt, Homo sapiens
gccuuggcagcc

SEQ ID NO: 996876 - RNA, 15 nt, Homo sapiens
gccuugucauuuuau

SEQ ID NO: 996877 - RNA, 18 nt, Homo sapiens
gccuuuauuuccacugug

SEQ ID NO: 996878 - RNA, 14 nt, Homo sapiens
gccuuucuccucca

SEQ ID NO: 996879 - RNA, 22 nt, Homo sapiens
gcgauccaccugucucagccuc

SEQ ID NO: 996880 - RNA, 20 nt, Homo sapiens
gcgccaccgagugccuucaa

SEQ ID NO: 996881 - RNA, 22 nt, Homo sapiens
gcgcccagcuccugacacugcu

SEQ ID NO: 996882 - RNA, 15 nt, Homo sapiens
gcgggcgcgugagug

SEQ ID NO: 996883 - RNA, 21 nt, Homo sapiens
gcguaggcuacagagaagccu

SEQ ID NO: 996884 - RNA, 12 nt, Homo sapiens
gcguccugguca

SEQ ID NO: 996885 - RNA, 12 nt, Homo sapiens
gcguuacugcuu

SEQ ID NO: 996886 - RNA, 23 nt, Homo sapiens
gcguuuggacccaguucagugag

SEQ ID NO: 996887 - RNA, 20 nt, Homo sapiens
gcuaaaauuagaugaacuca

SEQ ID NO: 996888 - RNA, 22 nt, Homo sapiens
gcuaaggucuuggaacuugccu

SEQ ID NO: 996889 - RNA, 17 nt, Homo sapiens
gcuacagagaaaccagc

SEQ ID NO: 996890 - RNA, 19 nt, Homo sapiens
gcuacagagaaaccagcuu

SEQ ID NO: 996891 - RNA, 14 nt, Homo sapiens
gcuagagugacuca

SEQ ID NO: 996892 - RNA, 17 nt, Homo sapiens
gcuagguggaaaagccu

SEQ ID NO: 996893 - RNA, 14 nt, Homo sapiens
gcuauuugucaucu

SEQ ID NO: 996894 - RNA, 19 nt, Homo sapiens
gcuauuuugugaagccaug

SEQ ID NO: 996895 - RNA, 22 nt, Homo sapiens
gcucagaaaauaucccuccugu

SEQ ID NO: 996896 - RNA, 18 nt, Homo sapiens
gcucagauuguaauaugu

SEQ ID NO: 996897 - RNA, 23 nt, Homo sapiens
gcucagccccaccccagggcagc

SEQ ID NO: 996898 - RNA, 23 nt, Homo sapiens
gcucagcccugcaccaugcugcu

SEQ ID NO: 996899 - RNA, 21 nt, Homo sapiens
gcucaggaaggggugugcuga

SEQ ID NO: 996900 - RNA, 15 nt, Homo sapiens
gcucaucauucucug

SEQ ID NO: 996901 - RNA, 17 nt, Homo sapiens
gcuccaaugccuacuga

SEQ ID NO: 996902 - RNA, 19 nt, Homo sapiens
gcucccagacggucaggaa

SEQ ID NO: 996903 - RNA, 20 nt, Homo sapiens
gcucccuccgcccccaggua

SEQ ID NO: 996904 - RNA, 17 nt, Homo sapiens
gcuccgaggacccagga

SEQ ID NO: 996905 - RNA, 14 nt, Homo sapiens
gcuccggccugucc

SEQ ID NO: 996906 - RNA, 13 nt, Homo sapiens
gcuccuccagggu

SEQ ID NO: 996907 - RNA, 20 nt, Homo sapiens
gcuccucuccccagcccaga

SEQ ID NO: 996908 - RNA, 15 nt, Homo sapiens
gcucgagcaguccug

SEQ ID NO: 996909 - RNA, 22 nt, Homo sapiens
gcucuaacaaugacauuuauau

SEQ ID NO: 996910 - RNA, 14 nt, Homo sapiens
gcucuacaucuucu

SEQ ID NO: 996911 - RNA, 18 nt, Homo sapiens
gcucucccaacucuugca

SEQ ID NO: 996912 - RNA, 19 nt, Homo sapiens
gcucucccaacucuugcac

SEQ ID NO: 996913 - RNA, 21 nt, Homo sapiens
gcucucccaacucuugcacag

SEQ ID NO: 996914 - RNA, 20 nt, Homo sapiens
gcucugagaggcccuggauc

SEQ ID NO: 996915 - RNA, 23 nt, Homo sapiens
gcucugaggauguauaccccugg

SEQ ID NO: 996916 - RNA, 21 nt, Homo sapiens
gcucuuagcagcuuccagauu

SEQ ID NO: 996917 - RNA, 18 nt, Homo sapiens
gcucuuccuuacucccag

SEQ ID NO: 996918 - RNA, 20 nt, Homo sapiens
gcucuuuguuuugugucucu

SEQ ID NO: 996919 - RNA, 19 nt, Homo sapiens
gcugaaaaaucauccaaga

SEQ ID NO: 996920 - RNA, 15 nt, Homo sapiens
gcugaaacucauuug

SEQ ID NO: 996921 - RNA, 19 nt, Homo sapiens
gcugaagguuguggccuuu

SEQ ID NO: 996922 - RNA, 18 nt, Homo sapiens
gcugaauagcuucuccaa

SEQ ID NO: 996923 - RNA, 20 nt, Homo sapiens
gcugaccacagcacagccaa

SEQ ID NO: 996924 - RNA, 16 nt, Homo sapiens
gcugaggccacacuca

SEQ ID NO: 996925 - RNA, 15 nt, Homo sapiens
gcugaggcuggcaca

SEQ ID NO: 996926 - RNA, 17 nt, Homo sapiens
gcugcacugaugcugcc

SEQ ID NO: 996927 - RNA, 20 nt, Homo sapiens
gcugcauugaaaagagcuga

SEQ ID NO: 996928 - RNA, 17 nt, Homo sapiens
gcugccaguguccugag

SEQ ID NO: 996929 - RNA, 16 nt, Homo sapiens
gcugcuccugagagag

SEQ ID NO: 996930 - RNA, 12 nt, Homo sapiens
gcugcugugaac

SEQ ID NO: 996931 - RNA, 19 nt, Homo sapiens
gcuggaauucuaacaaguc

SEQ ID NO: 996932 - RNA, 19 nt, Homo sapiens
gcuggagugcaguggugca

SEQ ID NO: 996933 - RNA, 20 nt, Homo sapiens
gcuggagugcagugguguga

SEQ ID NO: 996934 - RNA, 21 nt, Homo sapiens
gcuggaguuagggacugacca

SEQ ID NO: 996935 - RNA, 17 nt, Homo sapiens
gcugggaacagugugca

SEQ ID NO: 996936 - RNA, 19 nt, Homo sapiens
gcugggccauguccaaaga

SEQ ID NO: 996937 - RNA, 20 nt, Homo sapiens
gcuguggggcgggcaugggg

SEQ ID NO: 996938 - RNA, 20 nt, Homo sapiens
gcugugugugugugaguaug

SEQ ID NO: 996939 - RNA, 16 nt, Homo sapiens
gcuguguuuccaucuc

SEQ ID NO: 996940 - RNA, 18 nt, Homo sapiens
gcuguguuuccaucucaa

SEQ ID NO: 996941 - RNA, 12 nt, Homo sapiens
gcuguucuugcu

SEQ ID NO: 996942 - RNA, 22 nt, Homo sapiens
gcuucaaggaguaugcagggag

SEQ ID NO: 996943 - RNA, 18 nt, Homo sapiens
gcuucagguccaggcugu

SEQ ID NO: 996944 - RNA, 13 nt, Homo sapiens
gcuucagugcugc

SEQ ID NO: 996945 - RNA, 15 nt, Homo sapiens
gcuucccugacucau

SEQ ID NO: 996946 - RNA, 23 nt, Homo sapiens
gcuuccgcccccggauuugcuca

SEQ ID NO: 996947 - RNA, 18 nt, Homo sapiens
gcuucucugacuucugcc

SEQ ID NO: 996948 - RNA, 14 nt, Homo sapiens
gcuucuugccucug

SEQ ID NO: 996949 - RNA, 20 nt, Homo sapiens
gcuucuugccucugugcugu

SEQ ID NO: 996950 - RNA, 13 nt, Homo sapiens
gcuugaccaaaga

SEQ ID NO: 996951 - RNA, 23 nt, Homo sapiens
gcuugcaaaaacuacaaccaaug

SEQ ID NO: 996952 - RNA, 17 nt, Homo sapiens
gcuugggaaagguggug

SEQ ID NO: 996953 - RNA, 18 nt, Homo sapiens
gcuugugggacuagccug

SEQ ID NO: 996954 - RNA, 17 nt, Homo sapiens
gcuuguggggccuggga

SEQ ID NO: 996955 - RNA, 21 nt, Homo sapiens
gcuuucauguaaacugugcac

SEQ ID NO: 996956 - RNA, 23 nt, Homo sapiens
gcuuucauuuucucucaggugaa

SEQ ID NO: 996957 - RNA, 22 nt, Homo sapiens
gcuuugauguuccuuccagugu

SEQ ID NO: 996958 - RNA, 14 nt, Homo sapiens
gcuuuucacaucca

SEQ ID NO: 996959 - RNA, 17 nt, Homo sapiens
gcuuuuugugauaugca

SEQ ID NO: 996960 - RNA, 20 nt, Homo sapiens
ggaaaaugugcacacauaua

SEQ ID NO: 996961 - RNA, 20 nt, Homo sapiens
ggaaacucggcagcccuucc

SEQ ID NO: 996962 - RNA, 19 nt, Homo sapiens
ggaaaguagaaauuuacca

SEQ ID NO: 996963 - RNA, 14 nt, Homo sapiens
ggaacacggccaca

SEQ ID NO: 996964 - RNA, 14 nt, Homo sapiens
ggaacccagacuca

SEQ ID NO: 996965 - RNA, 21 nt, Homo sapiens
ggaaccucagccuggccagac

SEQ ID NO: 996966 - RNA, 14 nt, Homo sapiens
ggaacucagaucca

SEQ ID NO: 996967 - RNA, 21 nt, Homo sapiens
ggaacugcugccacugagggg

SEQ ID NO: 996968 - RNA, 16 nt, Homo sapiens
ggaagacuccuagcug

SEQ ID NO: 996969 - RNA, 17 nt, Homo sapiens
ggaagcagcagccucgc

SEQ ID NO: 996970 - RNA, 21 nt, Homo sapiens
ggaagcccauccugaccagcu

SEQ ID NO: 996971 - RNA, 15 nt, Homo sapiens
ggaagcuaauuugca

SEQ ID NO: 996972 - RNA, 16 nt, Homo sapiens
ggaagcugucccucac

SEQ ID NO: 996973 - RNA, 11 nt, Homo sapiens
ggaagggucaa

SEQ ID NO: 996974 - RNA, 14 nt, Homo sapiens
ggaaggucagccag

SEQ ID NO: 996975 - RNA, 16 nt, Homo sapiens
ggaaguuuuaaucucu

SEQ ID NO: 996976 - RNA, 23 nt, Homo sapiens
ggaaucagaacucaaauggggcc

SEQ ID NO: 996977 - RNA, 15 nt, Homo sapiens
ggaauugauuugcau

SEQ ID NO: 996978 - RNA, 23 nt, Homo sapiens
ggacacuuaauacuaccuugaaa

SEQ ID NO: 996979 - RNA, 22 nt, Homo sapiens
ggacagagcacguuugcagaag

SEQ ID NO: 996980 - RNA, 18 nt, Homo sapiens
ggacagccccacccuggu

SEQ ID NO: 996981 - RNA, 22 nt, Homo sapiens
ggacagggcuggagucaaaaca

SEQ ID NO: 996982 - RNA, 16 nt, Homo sapiens
ggaccugagaccugaa

SEQ ID NO: 996983 - RNA, 22 nt, Homo sapiens
ggacguggcucagccagcacuu

SEQ ID NO: 996984 - RNA, 16 nt, Homo sapiens
ggacuaugaaaagcua

SEQ ID NO: 996985 - RNA, 18 nt, Homo sapiens
ggacuuccuguccagcuc

SEQ ID NO: 996986 - RNA, 17 nt, Homo sapiens
ggagaccggccugccag

SEQ ID NO: 996987 - RNA, 13 nt, Homo sapiens
ggagaccucagaa

SEQ ID NO: 996988 - RNA, 18 nt, Homo sapiens
ggagcaaaucgugccuug

SEQ ID NO: 996989 - RNA, 19 nt, Homo sapiens
ggagccccuucugcucagc

SEQ ID NO: 996990 - RNA, 16 nt, Homo sapiens
ggagcuggcccucucc

SEQ ID NO: 996991 - RNA, 15 nt, Homo sapiens
ggaggaccagagcua

SEQ ID NO: 996992 - RNA, 15 nt, Homo sapiens
ggaggugucucaggc

SEQ ID NO: 996993 - RNA, 19 nt, Homo sapiens
ggaguuagggacugaccag

SEQ ID NO: 996994 - RNA, 23 nt, Homo sapiens
ggauacagucuucuuacuuggaa

SEQ ID NO: 996995 - RNA, 21 nt, Homo sapiens
ggaucugauaaggaucuagga

SEQ ID NO: 996996 - RNA, 21 nt, Homo sapiens
ggaugauacuuggaugcagcu

SEQ ID NO: 996997 - RNA, 17 nt, Homo sapiens
ggaugguggagggccac

SEQ ID NO: 996998 - RNA, 22 nt, Homo sapiens
ggauuauucugggggcugcagu

SEQ ID NO: 996999 - RNA, 13 nt, Homo sapiens
ggauuugcucagg

SEQ ID NO: 997000 - RNA, 21 nt, Homo sapiens
ggcaagccugucuucagagaa

SEQ ID NO: 997001 - RNA, 19 nt, Homo sapiens
ggcacagggucugcucuuu

SEQ ID NO: 997002 - RNA, 18 nt, Homo sapiens
ggcaccagacacccagga

SEQ ID NO: 997003 - RNA, 14 nt, Homo sapiens
ggcacucagucucu

SEQ ID NO: 997004 - RNA, 21 nt, Homo sapiens
ggcacuguaguucuaagacuc

SEQ ID NO: 997005 - RNA, 11 nt, Homo sapiens
ggcacuuugaa

SEQ ID NO: 997006 - RNA, 13 nt, Homo sapiens
ggcagagcauuca

SEQ ID NO: 997007 - RNA, 18 nt, Homo sapiens
ggcagcauccccuugaac

SEQ ID NO: 997008 - RNA, 14 nt, Homo sapiens
ggcagcuucugccc

SEQ ID NO: 997009 - RNA, 20 nt, Homo sapiens
ggcaggagaaucacuugaac

SEQ ID NO: 997010 - RNA, 21 nt, Homo sapiens
ggcaggaguagcugagcucac

SEQ ID NO: 997011 - RNA, 18 nt, Homo sapiens
ggcaggcugggccauguc

SEQ ID NO: 997012 - RNA, 21 nt, Homo sapiens
ggcaggcuuagagucaggcau

SEQ ID NO: 997013 - RNA, 20 nt, Homo sapiens
ggcaggggcuuccuggugcu

SEQ ID NO: 997014 - RNA, 22 nt, Homo sapiens
ggcaggguuuauaugcacuuuc

SEQ ID NO: 997015 - RNA, 10 nt, Homo sapiens
ggcaguuuuu

SEQ ID NO: 997016 - RNA, 22 nt, Homo sapiens
ggcaucugacaugcaucaucuc

SEQ ID NO: 997017 - RNA, 12 nt, Homo sapiens
ggcaugggagac

SEQ ID NO: 997018 - RNA, 20 nt, Homo sapiens
ggcauuugcaccuaccucac

SEQ ID NO: 997019 - RNA, 13 nt, Homo sapiens
ggccagauccagc

SEQ ID NO: 997020 - RNA, 13 nt, Homo sapiens
ggccauauuaccc

SEQ ID NO: 997021 - RNA, 16 nt, Homo sapiens
ggcccauaucugugaa

SEQ ID NO: 997022 - RNA, 23 nt, Homo sapiens
ggcccuucccacaggacauuucu

SEQ ID NO: 997023 - RNA, 17 nt, Homo sapiens
ggccgcccugcggguga

SEQ ID NO: 997024 - RNA, 14 nt, Homo sapiens
ggccgcugugccag

SEQ ID NO: 997025 - RNA, 22 nt, Homo sapiens
ggccucacccaccccugcacag

SEQ ID NO: 997026 - RNA, 14 nt, Homo sapiens
ggccuccugccucu

SEQ ID NO: 997027 - RNA, 12 nt, Homo sapiens
ggccucugucaa

SEQ ID NO: 997028 - RNA, 17 nt, Homo sapiens
ggccugcccccacccca

SEQ ID NO: 997029 - RNA, 17 nt, Homo sapiens
ggccuggagcacaaaga

SEQ ID NO: 997030 - RNA, 14 nt, Homo sapiens
ggccuuaaccauga

SEQ ID NO: 997031 - RNA, 18 nt, Homo sapiens
ggccuucuuuuggacaaa

SEQ ID NO: 997032 - RNA, 17 nt, Homo sapiens
ggccuugcggcuccuca

SEQ ID NO: 997033 - RNA, 16 nt, Homo sapiens
ggccuuguucugucac

SEQ ID NO: 997034 - RNA, 14 nt, Homo sapiens
ggcgggcauggcgu

SEQ ID NO: 997035 - RNA, 19 nt, Homo sapiens
ggcucagauuguaauaugu

SEQ ID NO: 997036 - RNA, 19 nt, Homo sapiens
ggcucuaauucacagugcu

SEQ ID NO: 997037 - RNA, 23 nt, Homo sapiens
ggcugaauagcuucuccaaaggc

SEQ ID NO: 997038 - RNA, 17 nt, Homo sapiens
ggcugagaacuggacag

SEQ ID NO: 997039 - RNA, 18 nt, Homo sapiens
ggcugccccucucaccaa

SEQ ID NO: 997040 - RNA, 18 nt, Homo sapiens
ggcugcgagagaaaggga

SEQ ID NO: 997041 - RNA, 20 nt, Homo sapiens
ggcuggagugcaguggugca

SEQ ID NO: 997042 - RNA, 20 nt, Homo sapiens
uugcaucucuaauagagauu

SEQ ID NO: 997043 - RNA, 22 nt, Homo sapiens
uugccaauagugucauccucac

SEQ ID NO: 997044 - RNA, 16 nt, Homo sapiens
uugccacuacccccuc

SEQ ID NO: 997045 - RNA, 23 nt, Homo sapiens
uugccucccgggcucaagcgauu

SEQ ID NO: 997046 - RNA, 21 nt, Homo sapiens
uugccucugaagccuauguau

SEQ ID NO: 997047 - RNA, 16 nt, Homo sapiens
uugccuucuaggucac

SEQ ID NO: 997048 - RNA, 15 nt, Homo sapiens
uugcgauagagucuc

SEQ ID NO: 997049 - RNA, 22 nt, Homo sapiens
uugcuaaagacaugaagccacg

SEQ ID NO: 997050 - RNA, 20 nt, Homo sapiens
uugcuaaaggaaaaaaccau

SEQ ID NO: 997051 - RNA, 23 nt, Homo sapiens
uugcucagugggggcagagccac

SEQ ID NO: 997052 - RNA, 16 nt, Homo sapiens
uugcuccgccuggccu

SEQ ID NO: 997053 - RNA, 13 nt, Homo sapiens
uugcuguguaaaa

SEQ ID NO: 997054 - RNA, 20 nt, Homo sapiens
uuggaacuggaggcagggaa

SEQ ID NO: 997055 - RNA, 12 nt, Homo sapiens
uuggaagcacug

SEQ ID NO: 997056 - RNA, 19 nt, Homo sapiens
uuggacaaaccuugaaaau

SEQ ID NO: 997057 - RNA, 21 nt, Homo sapiens
uuggagaguuugccuguucua

SEQ ID NO: 997058 - RNA, 22 nt, Homo sapiens
uuggagggcccagcccaaguga

SEQ ID NO: 997059 - RNA, 12 nt, Homo sapiens
uuggauuugaca

SEQ ID NO: 997060 - RNA, 14 nt, Homo sapiens
uuggcaccagacac

SEQ ID NO: 997061 - RNA, 22 nt, Homo sapiens
uuggcaccagacacccaggacu

SEQ ID NO: 997062 - RNA, 14 nt, Homo sapiens
uuggccugaggcug

SEQ ID NO: 997063 - RNA, 19 nt, Homo sapiens
uuggcguaggcuacagaga

SEQ ID NO: 997064 - RNA, 22 nt, Homo sapiens
uuggcuacacacaaaccaguau

SEQ ID NO: 997065 - RNA, 12 nt, Homo sapiens
uuggcuggaccc

SEQ ID NO: 997066 - RNA, 22 nt, Homo sapiens
uuggcuggcuuguuugauuuca

SEQ ID NO: 997067 - RNA, 18 nt, Homo sapiens
uuggcuuguuuggagcau

SEQ ID NO: 997068 - RNA, 22 nt, Homo sapiens
uugggacucaaggcuugaguca

SEQ ID NO: 997069 - RNA, 20 nt, Homo sapiens
uugggauugagucugugcca

SEQ ID NO: 997070 - RNA, 17 nt, Homo sapiens
uugggccagcuuuucaa

SEQ ID NO: 997071 - RNA, 20 nt, Homo sapiens
uugggccuaggcugcauuga

SEQ ID NO: 997072 - RNA, 22 nt, Homo sapiens
uuggggguccuccuccagggac

SEQ ID NO: 997073 - RNA, 19 nt, Homo sapiens
uugggguauaggucucauc

SEQ ID NO: 997074 - RNA, 19 nt, Homo sapiens
uuggucacauauaugccua

SEQ ID NO: 997075 - RNA, 15 nt, Homo sapiens
uugguuguacuuugg

SEQ ID NO: 997076 - RNA, 14 nt, Homo sapiens
uugguuuaaaagac

SEQ ID NO: 997077 - RNA, 18 nt, Homo sapiens
uugguuuaaagaaagugu

SEQ ID NO: 997078 - RNA, 14 nt, Homo sapiens
uugguuugacccag

SEQ ID NO: 997079 - RNA, 20 nt, Homo sapiens
uuguaagaguggaaccaaca

SEQ ID NO: 997080 - RNA, 17 nt, Homo sapiens
uuguaaugagagcacuu

SEQ ID NO: 997081 - RNA, 14 nt, Homo sapiens
uuguaauuauggag

SEQ ID NO: 997082 - RNA, 14 nt, Homo sapiens
uuguagugcuuuga

SEQ ID NO: 997083 - RNA, 20 nt, Homo sapiens
uuguaucaaaugugacauua

SEQ ID NO: 997084 - RNA, 22 nt, Homo sapiens
uuguauguggguuuuacacuaa

SEQ ID NO: 997085 - RNA, 15 nt, Homo sapiens
uugucacacgauaaa

SEQ ID NO: 997086 - RNA, 18 nt, Homo sapiens
uugucaguauuuuugccg

SEQ ID NO: 997087 - RNA, 17 nt, Homo sapiens
uugugaguuuaccuugu

SEQ ID NO: 997088 - RNA, 15 nt, Homo sapiens
uugugauaugcacaa

SEQ ID NO: 997089 - RNA, 23 nt, Homo sapiens
uugugcaauguguauaaacaaga

SEQ ID NO: 997090 - RNA, 19 nt, Homo sapiens
uuguguaagaaauacagac

SEQ ID NO: 997091 - RNA, 17 nt, Homo sapiens
uugugucuggcaguuua

SEQ ID NO: 997092 - RNA, 17 nt, Homo sapiens
uuguuauuugaaaacau

SEQ ID NO: 997093 - RNA, 23 nt, Homo sapiens
uuguuggagucaaaaagaaccac

SEQ ID NO: 997094 - RNA, 22 nt, Homo sapiens
uuguuggcguaggcuacagaga

SEQ ID NO: 997095 - RNA, 13 nt, Homo sapiens
uuguugugcuauu

SEQ ID NO: 997096 - RNA, 15 nt, Homo sapiens
uuguuguuucuugcc

SEQ ID NO: 997097 - RNA, 18 nt, Homo sapiens
uuguuuacagucauugga

SEQ ID NO: 997098 - RNA, 15 nt, Homo sapiens
uuuaaaaaacuaaaa

SEQ ID NO: 997099 - RNA, 16 nt, Homo sapiens
uuuaaaaaagcuuaaa

SEQ ID NO: 997100 - RNA, 20 nt, Homo sapiens
uuuaaaagcacgacagugga

SEQ ID NO: 997101 - RNA, 14 nt, Homo sapiens
uuuaaaauagcaaa

SEQ ID NO: 997102 - RNA, 14 nt, Homo sapiens
uuuaaaaucuguca

SEQ ID NO: 997103 - RNA, 15 nt, Homo sapiens
uuuaaaccgcuaaaa

SEQ ID NO: 997104 - RNA, 23 nt, Homo sapiens
uuuaaauacagucuuccauuugc

SEQ ID NO: 997105 - RNA, 12 nt, Homo sapiens
uuuaaauucucu

SEQ ID NO: 997106 - RNA, 14 nt, Homo sapiens
uuuaacguuuucau

SEQ ID NO: 997107 - RNA, 18 nt, Homo sapiens
uuuaagaauaucuguaau

SEQ ID NO: 997108 - RNA, 17 nt, Homo sapiens
uuuaagcucugagcugu

SEQ ID NO: 997109 - RNA, 14 nt, Homo sapiens
uuuaaucucuaaca

SEQ ID NO: 997110 - RNA, 19 nt, Homo sapiens
uuuaaucucuaacagugga

SEQ ID NO: 997111 - RNA, 12 nt, Homo sapiens
uuuaaugaguca

SEQ ID NO: 997112 - RNA, 14 nt, Homo sapiens
uuuaauggggugca

SEQ ID NO: 997113 - RNA, 20 nt, Homo sapiens
uuuacaauuugacauacaaa

SEQ ID NO: 997114 - RNA, 18 nt, Homo sapiens
uuuacacgcuuuugugau

SEQ ID NO: 997115 - RNA, 23 nt, Homo sapiens
uuuacugcucugagaauuguuga

SEQ ID NO: 997116 - RNA, 18 nt, Homo sapiens
uuuagaaagaauauucau

SEQ ID NO: 997117 - RNA, 14 nt, Homo sapiens
uuuagaucucugaa

SEQ ID NO: 997118 - RNA, 15 nt, Homo sapiens
uuuagaucucugaag

SEQ ID NO: 997119 - RNA, 17 nt, Homo sapiens
uuuagauuuuaaucaaa

SEQ ID NO: 997120 - RNA, 13 nt, Homo sapiens
uuuagcucugaga

SEQ ID NO: 997121 - RNA, 15 nt, Homo sapiens
uuuagucaugugacc

SEQ ID NO: 997122 - RNA, 22 nt, Homo sapiens
uuuauaaaaaugagugcuuaaa

SEQ ID NO: 997123 - RNA, 16 nt, Homo sapiens
uuuauaaaaguguuca

SEQ ID NO: 997124 - RNA, 18 nt, Homo sapiens
uuuauaaggcugauguca

SEQ ID NO: 997125 - RNA, 13 nt, Homo sapiens
ucccaagcucaga

SEQ ID NO: 997126 - RNA, 17 nt, Homo sapiens
ucccaauccaguggacu

SEQ ID NO: 997127 - RNA, 15 nt, Homo sapiens
ucccacccagcuaaa

SEQ ID NO: 997128 - RNA, 17 nt, Homo sapiens
ucccacccccaucucuc

SEQ ID NO: 997129 - RNA, 16 nt, Homo sapiens
ucccacucuucuugca

SEQ ID NO: 997130 - RNA, 14 nt, Homo sapiens
ucccagagcaccug

SEQ ID NO: 997131 - RNA, 20 nt, Homo sapiens
ucccagaggagccaccaguu

SEQ ID NO: 997132 - RNA, 13 nt, Homo sapiens
ucccaggacccug

SEQ ID NO: 997133 - RNA, 19 nt, Homo sapiens
ucccaguccaccugaggaa

SEQ ID NO: 997134 - RNA, 23 nt, Homo sapiens
ucccagugaagagccacugccau

SEQ ID NO: 997135 - RNA, 16 nt, Homo sapiens
ucccaucgcugucaca

SEQ ID NO: 997136 - RNA, 23 nt, Homo sapiens
ucccaugacauggagaccgugac

SEQ ID NO: 997137 - RNA, 16 nt, Homo sapiens
ucccauuccugaagaa

SEQ ID NO: 997138 - RNA, 18 nt, Homo sapiens
uccccaagugaccuauac

SEQ ID NO: 997139 - RNA, 22 nt, Homo sapiens
uccccaagugaccuauaccugu

SEQ ID NO: 997140 - RNA, 12 nt, Homo sapiens
uccccaccagau

SEQ ID NO: 997141 - RNA, 12 nt, Homo sapiens
uccccagacuug

SEQ ID NO: 997142 - RNA, 16 nt, Homo sapiens
uccccaggcaccucac

SEQ ID NO: 997143 - RNA, 12 nt, Homo sapiens
ucccccacugau

SEQ ID NO: 997144 - RNA, 20 nt, Homo sapiens
ucccccagucauucugggaa

SEQ ID NO: 997145 - RNA, 21 nt, Homo sapiens
uccccgacuggggcagggugu

SEQ ID NO: 997146 - RNA, 19 nt, Homo sapiens
uccccucccccagaccucc

SEQ ID NO: 997147 - RNA, 15 nt, Homo sapiens
uccccuccuucccaa

SEQ ID NO: 997148 - RNA, 15 nt, Homo sapiens
uccccugaccuguga

SEQ ID NO: 997149 - RNA, 20 nt, Homo sapiens
uccccugcccccugcaggaa

SEQ ID NO: 997150 - RNA, 21 nt, Homo sapiens
uccccuguagcagucacugac

SEQ ID NO: 997151 - RNA, 16 nt, Homo sapiens
uccccuucaguaccac

SEQ ID NO: 997152 - RNA, 19 nt, Homo sapiens
uccccuugccuaaauacaa

SEQ ID NO: 997153 - RNA, 17 nt, Homo sapiens
ucccuauuaaccuagag

SEQ ID NO: 997154 - RNA, 13 nt, Homo sapiens
ucccuccaagugg

SEQ ID NO: 997155 - RNA, 18 nt, Homo sapiens
ucccucccccccaugcac

SEQ ID NO: 997156 - RNA, 20 nt, Homo sapiens
ucccucucccggcaacaucu

SEQ ID NO: 997157 - RNA, 17 nt, Homo sapiens
ucccugaaggccuucaa

SEQ ID NO: 997158 - RNA, 12 nt, Homo sapiens
ucccugacagca

SEQ ID NO: 997159 - RNA, 14 nt, Homo sapiens
ucccugacuccucc

SEQ ID NO: 997160 - RNA, 15 nt, Homo sapiens
ucccugcacagugac

SEQ ID NO: 997161 - RNA, 22 nt, Homo sapiens
ucccugcacagugacuucugag

SEQ ID NO: 997162 - RNA, 15 nt, Homo sapiens
ucccuggaugacauu

SEQ ID NO: 997163 - RNA, 16 nt, Homo sapiens
ucccuggaugacauua

SEQ ID NO: 997164 - RNA, 17 nt, Homo sapiens
ucccuggaugacauuaa

SEQ ID NO: 997165 - RNA, 18 nt, Homo sapiens
ucccuggaugacauuaaa

SEQ ID NO: 997166 - RNA, 24 nt, Homo sapiens
ucccuggcccccggguguaaauag

SEQ ID NO: 997167 - RNA, 14 nt, Homo sapiens
ucccuguaaccucu

SEQ ID NO: 997168 - RNA, 19 nt, Homo sapiens
ucccuuccugggucuacca

SEQ ID NO: 997169 - RNA, 18 nt, Homo sapiens
ucccuugggaagggcagg

SEQ ID NO: 997170 - RNA, 15 nt, Homo sapiens
ucccuuuucuguucu

SEQ ID NO: 997171 - RNA, 17 nt, Homo sapiens
ucccuuuuuauauccca

SEQ ID NO: 997172 - RNA, 23 nt, Homo sapiens
ucccuuuuuauaucccauuuuua

SEQ ID NO: 997173 - RNA, 21 nt, Homo sapiens
uccgccacuggggcucagagc

SEQ ID NO: 997174 - RNA, 20 nt, Homo sapiens
uccguucacaugugugguac

SEQ ID NO: 997175 - RNA, 21 nt, Homo sapiens
uccuaagggucgaaagcucua

SEQ ID NO: 997176 - RNA, 14 nt, Homo sapiens
uccuacaagcuaaa

SEQ ID NO: 997177 - RNA, 20 nt, Homo sapiens
uccuacuggucucucuaugc

SEQ ID NO: 997178 - RNA, 18 nt, Homo sapiens
uccuagcugugugaauac

SEQ ID NO: 997179 - RNA, 18 nt, Homo sapiens
uccuaucaccuauuucca

SEQ ID NO: 997180 - RNA, 20 nt, Homo sapiens
uccuauuucuccaaagccuu

SEQ ID NO: 997181 - RNA, 16 nt, Homo sapiens
uccucacuguauccag

SEQ ID NO: 997182 - RNA, 22 nt, Homo sapiens
uccuccaacaccaagcacagca

SEQ ID NO: 997183 - RNA, 10 nt, Homo sapiens
uccuccucag

SEQ ID NO: 997184 - RNA, 21 nt, Homo sapiens
uccucugucagucacagccac

SEQ ID NO: 997185 - RNA, 17 nt, Homo sapiens
uccucuuccaugcugug

SEQ ID NO: 997186 - RNA, 16 nt, Homo sapiens
uccugaaacaacuugg

SEQ ID NO: 997187 - RNA, 16 nt, Homo sapiens
uccugccauagucuua

SEQ ID NO: 997188 - RNA, 14 nt, Homo sapiens
uccugccauguuua

SEQ ID NO: 997189 - RNA, 16 nt, Homo sapiens
uccugccuugaaaaag

SEQ ID NO: 997190 - RNA, 13 nt, Homo sapiens
uccugggcccucu

SEQ ID NO: 997191 - RNA, 18 nt, Homo sapiens
uccugggucuaccacuca

SEQ ID NO: 997192 - RNA, 17 nt, Homo sapiens
uccuggugccaccucag

SEQ ID NO: 997193 - RNA, 19 nt, Homo sapiens
uccuguacauugugggaug

SEQ ID NO: 997194 - RNA, 22 nt, Homo sapiens
uccuguccucugcccccaaggu

SEQ ID NO: 997195 - RNA, 13 nt, Homo sapiens
uccugugaccaca

SEQ ID NO: 997196 - RNA, 17 nt, Homo sapiens
uccuguucacaccagag

SEQ ID NO: 997197 - RNA, 18 nt, Homo sapiens
uccuucaugaucaucaca

SEQ ID NO: 997198 - RNA, 16 nt, Homo sapiens
uccuuccagcuaguga

SEQ ID NO: 997199 - RNA, 22 nt, Homo sapiens
uccuucccacccccaguccugu

SEQ ID NO: 997200 - RNA, 23 nt, Homo sapiens
uccuugagaagugggagcacccu

SEQ ID NO: 997201 - RNA, 22 nt, Homo sapiens
uccuugauuuaucacacaaagc

SEQ ID NO: 997202 - RNA, 18 nt, Homo sapiens
uccuuucacccgcuccua

SEQ ID NO: 997203 - RNA, 23 nt, Homo sapiens
uccuuucacccgcuccuacagcu

SEQ ID NO: 997204 - RNA, 17 nt, Homo sapiens
uccuuucagcaagacuu

SEQ ID NO: 997205 - RNA, 12 nt, Homo sapiens
uccuuucuuuuc

SEQ ID NO: 997206 - RNA, 13 nt, Homo sapiens
uccuuugugcuua

SEQ ID NO: 997207 - RNA, 16 nt, Homo sapiens
uccuuuucccaaagca

SEQ ID NO: 997208 - RNA, 22 nt, Homo sapiens
uccuuuucccaaagcaucccuc

SEQ ID NO: 997209 - RNA, 15 nt, Homo sapiens
uccuuuugguuuugg

SEQ ID NO: 997210 - RNA, 17 nt, Homo sapiens
uccuuuuuugcaugugc

SEQ ID NO: 997211 - RNA, 15 nt, Homo sapiens
ucgaaagcucuagaa

SEQ ID NO: 997212 - RNA, 15 nt, Homo sapiens
ucgaacaauucauau

SEQ ID NO: 997213 - RNA, 18 nt, Homo sapiens
uggccuugaaaccaccuu

SEQ ID NO: 997214 - RNA, 15 nt, Homo sapiens
uggcguuacugcuug

SEQ ID NO: 997215 - RNA, 17 nt, Homo sapiens
uggcuacacacaaacca

SEQ ID NO: 997216 - RNA, 21 nt, Homo sapiens
uggcuacacacaaaccaguau

SEQ ID NO: 997217 - RNA, 20 nt, Homo sapiens
uggcucuugaggcauuucca

SEQ ID NO: 997218 - RNA, 20 nt, Homo sapiens
uggcugcaccuuuuugcaug

SEQ ID NO: 997219 - RNA, 21 nt, Homo sapiens
uggcuggugugguacagagaa

SEQ ID NO: 997220 - RNA, 18 nt, Homo sapiens
ugggaaggaaacaaccau

SEQ ID NO: 997221 - RNA, 23 nt, Homo sapiens
ugggaaugucucuuuggcgaccu

SEQ ID NO: 997222 - RNA, 14 nt, Homo sapiens
ugggacugcuaaau

SEQ ID NO: 997223 - RNA, 15 nt, Homo sapiens
ugggagacaugugac

SEQ ID NO: 997224 - RNA, 18 nt, Homo sapiens
ugggagacaugugacauu

SEQ ID NO: 997225 - RNA, 15 nt, Homo sapiens
ugggagagggagacc

SEQ ID NO: 997226 - RNA, 17 nt, Homo sapiens
ugggagucacacagugu

SEQ ID NO: 997227 - RNA, 15 nt, Homo sapiens
ugggauguucagcac

SEQ ID NO: 997228 - RNA, 21 nt, Homo sapiens
ugggauuaugggucacaggaa

SEQ ID NO: 997229 - RNA, 15 nt, Homo sapiens
ucaccacccugcuca

SEQ ID NO: 997230 - RNA, 20 nt, Homo sapiens
ucaccacccugcucauccac

SEQ ID NO: 997231 - RNA, 19 nt, Homo sapiens
ucaccauuauaaugaauuu

SEQ ID NO: 997232 - RNA, 16 nt, Homo sapiens
ucaccuucaccuucau

SEQ ID NO: 997233 - RNA, 18 nt, Homo sapiens
ucaccuuggcaccagaca

SEQ ID NO: 997234 - RNA, 16 nt, Homo sapiens
ucacucaccauuccca

SEQ ID NO: 997235 - RNA, 13 nt, Homo sapiens
ucacucagcacuu

SEQ ID NO: 997236 - RNA, 19 nt, Homo sapiens
ucacuccccacaucccauc

SEQ ID NO: 997237 - RNA, 17 nt, Homo sapiens
ucacucugaguguuuua

SEQ ID NO: 997238 - RNA, 19 nt, Homo sapiens
ucacucuucaaaugccuga

SEQ ID NO: 997239 - RNA, 18 nt, Homo sapiens
ucacuucucacaaugucc

SEQ ID NO: 997240 - RNA, 20 nt, Homo sapiens
ucacuugugcaguguugaca

SEQ ID NO: 997241 - RNA, 21 nt, Homo sapiens
ucagaaagggagggcucugag

SEQ ID NO: 997242 - RNA, 15 nt, Homo sapiens
ucagaauagccacau

SEQ ID NO: 997243 - RNA, 17 nt, Homo sapiens
ucagaauaucacagaaa

SEQ ID NO: 997244 - RNA, 15 nt, Homo sapiens
ucagacaagcugcau

SEQ ID NO: 997245 - RNA, 16 nt, Homo sapiens
ucagacauuggcaccu

SEQ ID NO: 997246 - RNA, 20 nt, Homo sapiens
ucagagacuauguagcaaua

SEQ ID NO: 997247 - RNA, 12 nt, Homo sapiens
ucagauaaggua

SEQ ID NO: 997248 - RNA, 20 nt, Homo sapiens
ucagaugcuccaagauucua

SEQ ID NO: 997249 - RNA, 21 nt, Homo sapiens
ucagauuuuuuccucugcauu

SEQ ID NO: 997250 - RNA, 15 nt, Homo sapiens
ucagcaaagaacaag

SEQ ID NO: 997251 - RNA, 15 nt, Homo sapiens
ucagcaugaauuugu

SEQ ID NO: 997252 - RNA, 19 nt, Homo sapiens
ucagccacuugccugugcu

SEQ ID NO: 997253 - RNA, 17 nt, Homo sapiens
ucagcccugcaccaugc

SEQ ID NO: 997254 - RNA, 18 nt, Homo sapiens
ucagcccugcaccaugcu

SEQ ID NO: 997255 - RNA, 18 nt, Homo sapiens
ucagcccuuggggguccu

SEQ ID NO: 997256 - RNA, 18 nt, Homo sapiens
ucagcuccugaccaguug

SEQ ID NO: 997257 - RNA, 16 nt, Homo sapiens
ucagcugccagugucc

SEQ ID NO: 997258 - RNA, 17 nt, Homo sapiens
ucagcuucaaggaguau

SEQ ID NO: 997259 - RNA, 21 nt, Homo sapiens
ucaggaaacgagacuuuccau

SEQ ID NO: 997260 - RNA, 16 nt, Homo sapiens
ucaggacagaugccac

SEQ ID NO: 997261 - RNA, 17 nt, Homo sapiens
ucaggacagaugccaca

SEQ ID NO: 997262 - RNA, 14 nt, Homo sapiens
ucaggcacacagcu

SEQ ID NO: 997263 - RNA, 13 nt, Homo sapiens
ucaggcagcucaa

SEQ ID NO: 997264 - RNA, 13 nt, Homo sapiens
ucaggcagggugc

SEQ ID NO: 997265 - RNA, 21 nt, Homo sapiens
ucagggaaggaggagccuguc

SEQ ID NO: 997266 - RNA, 17 nt, Homo sapiens
ucagggcaugcuuuauu

SEQ ID NO: 997267 - RNA, 19 nt, Homo sapiens
ucagggucuaagcaccuug

SEQ ID NO: 997268 - RNA, 14 nt, Homo sapiens
ucagguauaccuca

SEQ ID NO: 997269 - RNA, 15 nt, Homo sapiens
ucagguauaccucac

SEQ ID NO: 997270 - RNA, 16 nt, Homo sapiens
ucaggugcuggggccu

SEQ ID NO: 997271 - RNA, 22 nt, Homo sapiens
ucaguacccacucuggagcauu

SEQ ID NO: 997272 - RNA, 14 nt, Homo sapiens
ucagucacagccac

SEQ ID NO: 997273 - RNA, 15 nt, Homo sapiens
ucagucacagccacc

SEQ ID NO: 997274 - RNA, 19 nt, Homo sapiens
ucagucucugagcagugaa

SEQ ID NO: 997275 - RNA, 17 nt, Homo sapiens
ucagugaaguugcugcu

SEQ ID NO: 997276 - RNA, 18 nt, Homo sapiens
ucagugaauaaaccauca

SEQ ID NO: 997277 - RNA, 21 nt, Homo sapiens
ucagugcuucccgagugagca

SEQ ID NO: 997278 - RNA, 12 nt, Homo sapiens
ucaguggugguc

SEQ ID NO: 997279 - RNA, 22 nt, Homo sapiens
ucaguugucucugaugcagcuu

SEQ ID NO: 997280 - RNA, 21 nt, Homo sapiens
ucauaaucacucuaauuaauu

SEQ ID NO: 997281 - RNA, 17 nt, Homo sapiens
ucauauuguugcauugc

SEQ ID NO: 997282 - RNA, 13 nt, Homo sapiens
ucaucacuuugac

SEQ ID NO: 997283 - RNA, 23 nt, Homo sapiens
ucaucaggugcauagcaagugaa

SEQ ID NO: 997284 - RNA, 15 nt, Homo sapiens
ucaucccuccaucuc

SEQ ID NO: 997285 - RNA, 15 nt, Homo sapiens
ucauccugauacugu

SEQ ID NO: 997286 - RNA, 16 nt, Homo sapiens
ucaucucucugcccaa

SEQ ID NO: 997287 - RNA, 14 nt, Homo sapiens
ucaugagugaauaa

SEQ ID NO: 997288 - RNA, 20 nt, Homo sapiens
ucauuauuuauguccaggug

SEQ ID NO: 997289 - RNA, 19 nt, Homo sapiens
ucauuccaugugcccaguu

SEQ ID NO: 997290 - RNA, 23 nt, Homo sapiens
ucauucccauuuuguuacauuuc

SEQ ID NO: 997291 - RNA, 15 nt, Homo sapiens
ucauucucauucuca

SEQ ID NO: 997292 - RNA, 16 nt, Homo sapiens
ucauuguaugugguca

SEQ ID NO: 997293 - RNA, 13 nt, Homo sapiens
ucauuucuucuac

SEQ ID NO: 997294 - RNA, 20 nt, Homo sapiens
ucauuucuucuacaacucau

SEQ ID NO: 997295 - RNA, 21 nt, Homo sapiens
uccaaacagaccccuguucau

SEQ ID NO: 997296 - RNA, 16 nt, Homo sapiens
uccaaagaacagccug

SEQ ID NO: 997297 - RNA, 21 nt, Homo sapiens
uccaaagagaagggcacugua

SEQ ID NO: 997298 - RNA, 13 nt, Homo sapiens
uccaacaguuuaa

SEQ ID NO: 997299 - RNA, 16 nt, Homo sapiens
uccaacccaaccucau

SEQ ID NO: 997300 - RNA, 20 nt, Homo sapiens
uccaagacucuagaguccaa

SEQ ID NO: 997301 - RNA, 14 nt, Homo sapiens
uccaagugguccac

SEQ ID NO: 997302 - RNA, 15 nt, Homo sapiens
uccaaucaugaaaag

SEQ ID NO: 997303 - RNA, 20 nt, Homo sapiens
uccaauuuuuuaagugaaaa

SEQ ID NO: 997304 - RNA, 19 nt, Homo sapiens
uccacaaauuauuaaugaa

SEQ ID NO: 997305 - RNA, 12 nt, Homo sapiens
uccacaaugaaa

SEQ ID NO: 997306 - RNA, 22 nt, Homo sapiens
uccacaaugaugaugauuucag

SEQ ID NO: 997307 - RNA, 22 nt, Homo sapiens
uccacaccugcggcccaaucca

SEQ ID NO: 997308 - RNA, 14 nt, Homo sapiens
uccacacugcacaa

SEQ ID NO: 997309 - RNA, 19 nt, Homo sapiens
uccacagacggaaggguaa

SEQ ID NO: 997310 - RNA, 18 nt, Homo sapiens
uccacauauuucagugag

SEQ ID NO: 997311 - RNA, 16 nt, Homo sapiens
uccaccuagacuguaa

SEQ ID NO: 997312 - RNA, 17 nt, Homo sapiens
uccaccugaggaacugu

SEQ ID NO: 997313 - RNA, 19 nt, Homo sapiens
uccaccugaggaacugucu

SEQ ID NO: 997314 - RNA, 13 nt, Homo sapiens
uccaccugucuca

SEQ ID NO: 997315 - RNA, 19 nt, Homo sapiens
uccacguucugcucaucau

SEQ ID NO: 997316 - RNA, 18 nt, Homo sapiens
uccagaaaguaaagguga

SEQ ID NO: 997317 - RNA, 18 nt, Homo sapiens
uccagaaauacuacugug

SEQ ID NO: 997318 - RNA, 19 nt, Homo sapiens
uccagacagagcccuguga

SEQ ID NO: 997319 - RNA, 17 nt, Homo sapiens
uccagaugcagggcagu

SEQ ID NO: 997320 - RNA, 18 nt, Homo sapiens
uccagcuccaaccugcaa

SEQ ID NO: 997321 - RNA, 14 nt, Homo sapiens
uccagcuccuguaa

SEQ ID NO: 997322 - RNA, 13 nt, Homo sapiens
uccaggaagccuu

SEQ ID NO: 997323 - RNA, 15 nt, Homo sapiens
uccaggcagauccag

SEQ ID NO: 997324 - RNA, 22 nt, Homo sapiens
uccagucccucccucaccagcc

SEQ ID NO: 997325 - RNA, 12 nt, Homo sapiens
uccaguguccug

SEQ ID NO: 997326 - RNA, 14 nt, Homo sapiens
uccaguguccugag

SEQ ID NO: 997327 - RNA, 17 nt, Homo sapiens
uccauaaauccuugaug

SEQ ID NO: 997328 - RNA, 21 nt, Homo sapiens
uccaucugggagccccaagag

SEQ ID NO: 997329 - RNA, 16 nt, Homo sapiens
uccauggccagcagca

SEQ ID NO: 997330 - RNA, 16 nt, Homo sapiens
uccaugugcccaguua

SEQ ID NO: 997331 - RNA, 17 nt, Homo sapiens
uccauguuugcaccugu

SEQ ID NO: 997332 - RNA, 15 nt, Homo sapiens
uauaaaugaauuugc

SEQ ID NO: 997333 - RNA, 21 nt, Homo sapiens
uauaaaugugauugcagcuuu

SEQ ID NO: 997334 - RNA, 15 nt, Homo sapiens
uauaacuggaaagaa

SEQ ID NO: 997335 - RNA, 21 nt, Homo sapiens
uauaacuuaggccuagccucu

SEQ ID NO: 997336 - RNA, 22 nt, Homo sapiens
uauaacuuaggccuagccucuu

SEQ ID NO: 997337 - RNA, 15 nt, Homo sapiens
uauaagaaagccuga

SEQ ID NO: 997338 - RNA, 22 nt, Homo sapiens
uauaaucaucaaguaauacaaa

SEQ ID NO: 997339 - RNA, 18 nt, Homo sapiens
uauaauucuuucaauaca

SEQ ID NO: 997340 - RNA, 16 nt, Homo sapiens
uauaauugaguuuuca

SEQ ID NO: 997341 - RNA, 15 nt, Homo sapiens
uauacaauacagauc

SEQ ID NO: 997342 - RNA, 20 nt, Homo sapiens
uauacauguaggaguguuua

SEQ ID NO: 997343 - RNA, 16 nt, Homo sapiens
uauacuagauguuaag

SEQ ID NO: 997344 - RNA, 20 nt, Homo sapiens
uauacuuguaauuauggagu

SEQ ID NO: 997345 - RNA, 12 nt, Homo sapiens
uauagauucuaa

SEQ ID NO: 997346 - RNA, 14 nt, Homo sapiens
uauagauuguccuu

SEQ ID NO: 997347 - RNA, 22 nt, Homo sapiens
uauagauuguccuuuugcaaag

SEQ ID NO: 997348 - RNA, 17 nt, Homo sapiens
uauaguauaagcagugu

SEQ ID NO: 997349 - RNA, 22 nt, Homo sapiens
uauagucgaacaauucauauau

SEQ ID NO: 997350 - RNA, 14 nt, Homo sapiens
uauaguucuaggca

SEQ ID NO: 997351 - RNA, 18 nt, Homo sapiens
uauauauuuuugugcaca

SEQ ID NO: 997352 - RNA, 15 nt, Homo sapiens
uauaucuaccccaga

SEQ ID NO: 997353 - RNA, 15 nt, Homo sapiens
uauauggacaaaaca

SEQ ID NO: 997354 - RNA, 16 nt, Homo sapiens
uauauucauccaugcc

SEQ ID NO: 997355 - RNA, 15 nt, Homo sapiens
uaucaaauacauuua

SEQ ID NO: 997356 - RNA, 16 nt, Homo sapiens
uaucaaauacauuuaa

SEQ ID NO: 997357 - RNA, 12 nt, Homo sapiens
uaucaacugcca

SEQ ID NO: 997358 - RNA, 19 nt, Homo sapiens
uaucacuuaaacuugcauc

SEQ ID NO: 997359 - RNA, 19 nt, Homo sapiens
uaucaugcccugugcaacc

SEQ ID NO: 997360 - RNA, 21 nt, Homo sapiens
uaucccuacauguauugcaca

SEQ ID NO: 997361 - RNA, 13 nt, Homo sapiens
uaucgaucucuua

SEQ ID NO: 997362 - RNA, 14 nt, Homo sapiens
uaucugccauguga

SEQ ID NO: 997363 - RNA, 17 nt, Homo sapiens
uaugaaugugaagccuu

SEQ ID NO: 997364 - RNA, 19 nt, Homo sapiens
uaugcauggugccccagga

SEQ ID NO: 997365 - RNA, 15 nt, Homo sapiens
uaugcauuauaucaa

SEQ ID NO: 997366 - RNA, 21 nt, Homo sapiens
uaugccauggaggcacuaaca

SEQ ID NO: 997367 - RNA, 21 nt, Homo sapiens
uaugccauugggguaguugug

SEQ ID NO: 997368 - RNA, 19 nt, Homo sapiens
uaugccucucuacagucuc

SEQ ID NO: 997369 - RNA, 17 nt, Homo sapiens
uaugccuuuuuugauca

SEQ ID NO: 997370 - RNA, 18 nt, Homo sapiens
uaugcuguacccaguuuc

SEQ ID NO: 997371 - RNA, 19 nt, Homo sapiens
uauggaauugauuugcauu

SEQ ID NO: 997372 - RNA, 14 nt, Homo sapiens
uauggaauuuugca

SEQ ID NO: 997373 - RNA, 16 nt, Homo sapiens
uauggacugcucagga

SEQ ID NO: 997374 - RNA, 18 nt, Homo sapiens
uauggaggggagggaucu

SEQ ID NO: 997375 - RNA, 19 nt, Homo sapiens
uauggcuuuuagcauuuau

SEQ ID NO: 997376 - RNA, 16 nt, Homo sapiens
uaugguuuuugagaua

SEQ ID NO: 997377 - RNA, 13 nt, Homo sapiens
uauuaaaagacuc

SEQ ID NO: 997378 - RNA, 15 nt, Homo sapiens
uauuaagccacuuaa

SEQ ID NO: 997379 - RNA, 23 nt, Homo sapiens
uauuacaguguuuauccuuucau

SEQ ID NO: 997380 - RNA, 17 nt, Homo sapiens
uauuacauuuucaguga

SEQ ID NO: 997381 - RNA, 20 nt, Homo sapiens
uauuacugggacugugcuca

SEQ ID NO: 997382 - RNA, 19 nt, Homo sapiens
uauuaucugucagcugcaa

SEQ ID NO: 997383 - RNA, 18 nt, Homo sapiens
uauucuuugcucuugcca

SEQ ID NO: 997384 - RNA, 16 nt, Homo sapiens
uauugcaagaguuuaa

SEQ ID NO: 997385 - RNA, 16 nt, Homo sapiens
uauuguauaaagcauu

SEQ ID NO: 997386 - RNA, 22 nt, Homo sapiens
uauuuaaagccuccucaucccg

SEQ ID NO: 997387 - RNA, 16 nt, Homo sapiens
uauuuaagaucacagu

SEQ ID NO: 997388 - RNA, 12 nt, Homo sapiens
uauuuacauuua

SEQ ID NO: 997389 - RNA, 21 nt, Homo sapiens
uauuuauagucgaacaauuca

SEQ ID NO: 997390 - RNA, 17 nt, Homo sapiens
uauuuauucuuuaacug

SEQ ID NO: 997391 - RNA, 18 nt, Homo sapiens
uauuucaagucucucacc

SEQ ID NO: 997392 - RNA, 18 nt, Homo sapiens
uauuucacuggagcacaa

SEQ ID NO: 997393 - RNA, 19 nt, Homo sapiens
uauuucacuggagcacaau

SEQ ID NO: 997394 - RNA, 14 nt, Homo sapiens
uauuugcauaacaa

SEQ ID NO: 997395 - RNA, 22 nt, Homo sapiens
uauuugggauauguauggguag

SEQ ID NO: 997396 - RNA, 12 nt, Homo sapiens
uauuuuccaaag

SEQ ID NO: 997397 - RNA, 17 nt, Homo sapiens
uauuuugccaagggcau

SEQ ID NO: 997398 - RNA, 14 nt, Homo sapiens
uauuuuugugcaca

SEQ ID NO: 997399 - RNA, 18 nt, Homo sapiens
ucaaaaaagauagaucua

SEQ ID NO: 997400 - RNA, 19 nt, Homo sapiens
ucaaaaauccuaacauuca

SEQ ID NO: 997401 - RNA, 13 nt, Homo sapiens
ucaaaacacuugu

SEQ ID NO: 997402 - RNA, 12 nt, Homo sapiens
ucaaaaccaagu

SEQ ID NO: 997403 - RNA, 16 nt, Homo sapiens
ucaaaauuuaacaguu

SEQ ID NO: 997404 - RNA, 22 nt, Homo sapiens
ucaaacaaagaugccacauuca

SEQ ID NO: 997405 - RNA, 14 nt, Homo sapiens
ucaaacuacuggca

SEQ ID NO: 997406 - RNA, 23 nt, Homo sapiens
ucaaacuacuuugcugcuaauau

SEQ ID NO: 997407 - RNA, 13 nt, Homo sapiens
ucaaauaaaaagu

SEQ ID NO: 997408 - RNA, 20 nt, Homo sapiens
ucaaauggggccagauccag

SEQ ID NO: 997409 - RNA, 18 nt, Homo sapiens
ucaaaugugacauuauau

SEQ ID NO: 997410 - RNA, 19 nt, Homo sapiens
ucaaauucaaauaaaaauc

SEQ ID NO: 997411 - RNA, 17 nt, Homo sapiens
ucaacagugaagacaga

SEQ ID NO: 997412 - RNA, 13 nt, Homo sapiens
ucaacauuucuca

SEQ ID NO: 997413 - RNA, 11 nt, Homo sapiens
ucaaccaaaca

SEQ ID NO: 997414 - RNA, 22 nt, Homo sapiens
ucaacuaggaucagaauaucac

SEQ ID NO: 997415 - RNA, 18 nt, Homo sapiens
ucaacugucuccuaccuc

SEQ ID NO: 997416 - RNA, 12 nt, Homo sapiens
ucaacuuugaca

SEQ ID NO: 997417 - RNA, 14 nt, Homo sapiens
ucaagagugagcua

SEQ ID NO: 997418 - RNA, 16 nt, Homo sapiens
ucaagccugugcaaug

SEQ ID NO: 997419 - RNA, 15 nt, Homo sapiens
ucaagcuccccucac

SEQ ID NO: 997420 - RNA, 16 nt, Homo sapiens
ucaaggcggugcuuga

SEQ ID NO: 997421 - RNA, 20 nt, Homo sapiens
ucaagggucaggccuuugag

SEQ ID NO: 997422 - RNA, 17 nt, Homo sapiens
ucaaguaauacaaacua

SEQ ID NO: 997423 - RNA, 13 nt, Homo sapiens
ucaagucucucac

SEQ ID NO: 997424 - RNA, 23 nt, Homo sapiens
ucaauaaaguuccccugugacac

SEQ ID NO: 997425 - RNA, 21 nt, Homo sapiens
ucaauauaagcuuuucuuuuc

SEQ ID NO: 997426 - RNA, 23 nt, Homo sapiens
ucaaucuguccguucacaugugu

SEQ ID NO: 997427 - RNA, 13 nt, Homo sapiens
ucacaaacuucau

SEQ ID NO: 997428 - RNA, 15 nt, Homo sapiens
ucacaacagugaaaa

SEQ ID NO: 997429 - RNA, 15 nt, Homo sapiens
ucacaagauggaauu

SEQ ID NO: 997430 - RNA, 24 nt, Homo sapiens
ucacaaugucccuucagcaccuga

SEQ ID NO: 997431 - RNA, 15 nt, Homo sapiens
ucacagagugcauug

SEQ ID NO: 997432 - RNA, 22 nt, Homo sapiens
ucacaggucccaaauggcccug

SEQ ID NO: 997433 - RNA, 18 nt, Homo sapiens
ucacauacaaaucaucca

SEQ ID NO: 997434 - RNA, 19 nt, Homo sapiens
ucacaugaauuauuacagu

SEQ ID NO: 997435 - RNA, 19 nt, Homo sapiens
uacauuuaauagacuuaca

SEQ ID NO: 997436 - RNA, 15 nt, Homo sapiens
uacauuucucaggcu

SEQ ID NO: 997437 - RNA, 14 nt, Homo sapiens
uacauuucucauac

SEQ ID NO: 997438 - RNA, 16 nt, Homo sapiens
uaccaaaauguugcug

SEQ ID NO: 997439 - RNA, 14 nt, Homo sapiens
uaccaaucauuuua

SEQ ID NO: 997440 - RNA, 20 nt, Homo sapiens
uaccaccagcuguguccaaa

SEQ ID NO: 997441 - RNA, 13 nt, Homo sapiens
uaccacucuggca

SEQ ID NO: 997442 - RNA, 19 nt, Homo sapiens
uaccacucuguaauugcaa

SEQ ID NO: 997443 - RNA, 22 nt, Homo sapiens
uaccaguauaagcaucugccau

SEQ ID NO: 997444 - RNA, 21 nt, Homo sapiens
uaccaguauaauugaguuuuc

SEQ ID NO: 997445 - RNA, 23 nt, Homo sapiens
uaccaguuuguccaucuugagau

SEQ ID NO: 997446 - RNA, 20 nt, Homo sapiens
uaccccagacuagauguagu

SEQ ID NO: 997447 - RNA, 21 nt, Homo sapiens
uaccgaguucaagugauuuuc

SEQ ID NO: 997448 - RNA, 18 nt, Homo sapiens
uaccgcgucuacccuggg

SEQ ID NO: 997449 - RNA, 22 nt, Homo sapiens
uaccucaguucccucuugcuca

SEQ ID NO: 997450 - RNA, 20 nt, Homo sapiens
uaccugaaauaaaauucauu

SEQ ID NO: 997451 - RNA, 14 nt, Homo sapiens
uaccugacacuccc

SEQ ID NO: 997452 - RNA, 14 nt, Homo sapiens
uaccugagagauuu

SEQ ID NO: 997453 - RNA, 21 nt, Homo sapiens
uaccuugguucccccacugau

SEQ ID NO: 997454 - RNA, 15 nt, Homo sapiens
uacgaugacaguguu

SEQ ID NO: 997455 - RNA, 23 nt, Homo sapiens
uacgcgccauuagggcuuuuugc

SEQ ID NO: 997456 - RNA, 19 nt, Homo sapiens
uacguaugucugguucuca

SEQ ID NO: 997457 - RNA, 18 nt, Homo sapiens
uacuaacauuuucauuga

SEQ ID NO: 997458 - RNA, 13 nt, Homo sapiens
uacuaccuugaaa

SEQ ID NO: 997459 - RNA, 20 nt, Homo sapiens
uacuacuguguaagggccag

SEQ ID NO: 997460 - RNA, 13 nt, Homo sapiens
uacucccaggcac

SEQ ID NO: 997461 - RNA, 17 nt, Homo sapiens
uacuccuaugaucugag

SEQ ID NO: 997462 - RNA, 19 nt, Homo sapiens
uacucuucuuacuggugcu

SEQ ID NO: 997463 - RNA, 21 nt, Homo sapiens
uacugaaaaggaggggucugg

SEQ ID NO: 997464 - RNA, 13 nt, Homo sapiens
uacugaagcccuu

SEQ ID NO: 997465 - RNA, 16 nt, Homo sapiens
uacugaaugucauuga

SEQ ID NO: 997466 - RNA, 15 nt, Homo sapiens
uacugcaaacagugu

SEQ ID NO: 997467 - RNA, 22 nt, Homo sapiens
uacugcaagguucaacuuauua

SEQ ID NO: 997468 - RNA, 19 nt, Homo sapiens
uacugcugagauacauaca

SEQ ID NO: 997469 - RNA, 17 nt, Homo sapiens
uacugcuugaccaaaga

SEQ ID NO: 997470 - RNA, 15 nt, Homo sapiens
uacuggaaagcuuuu

SEQ ID NO: 997471 - RNA, 17 nt, Homo sapiens
uacugggacugugcuca

SEQ ID NO: 997472 - RNA, 21 nt, Homo sapiens
uacugggacugugcucagaga

SEQ ID NO: 997473 - RNA, 23 nt, Homo sapiens
uacugggagaggggccucaaaug

SEQ ID NO: 997474 - RNA, 21 nt, Homo sapiens
uacugggguuuuucuaagaaa

SEQ ID NO: 997475 - RNA, 14 nt, Homo sapiens
uacuuaagugcugc

SEQ ID NO: 997476 - RNA, 14 nt, Homo sapiens
uacuuugacagugu

SEQ ID NO: 997477 - RNA, 12 nt, Homo sapiens
uacuuugugcau

SEQ ID NO: 997478 - RNA, 11 nt, Homo sapiens
uagaaaugcca

SEQ ID NO: 997479 - RNA, 18 nt, Homo sapiens
uagaaauucagcauuuga

SEQ ID NO: 997480 - RNA, 15 nt, Homo sapiens
uagaacacaguuugu

SEQ ID NO: 997481 - RNA, 21 nt, Homo sapiens
uagaacucaaccucuacaggg

SEQ ID NO: 997482 - RNA, 19 nt, Homo sapiens
uagaacucugaaaugaaga

SEQ ID NO: 997483 - RNA, 22 nt, Homo sapiens
uagaagccacuauuacugggac

SEQ ID NO: 997484 - RNA, 15 nt, Homo sapiens
uagaagucucuucca

SEQ ID NO: 997485 - RNA, 18 nt, Homo sapiens
uagaaguuccuagugaug

SEQ ID NO: 997486 - RNA, 11 nt, Homo sapiens
uagaauaccac

SEQ ID NO: 997487 - RNA, 14 nt, Homo sapiens
uagacaagccagaa

SEQ ID NO: 997488 - RNA, 16 nt, Homo sapiens
uagaccuccagcuguu

SEQ ID NO: 997489 - RNA, 21 nt, Homo sapiens
uagacuuuaacauaagcuauu

SEQ ID NO: 997490 - RNA, 15 nt, Homo sapiens
uagacuuuugcuuua

SEQ ID NO: 997491 - RNA, 13 nt, Homo sapiens
uagaguguuauca

SEQ ID NO: 997492 - RNA, 11 nt, Homo sapiens
uagaucuggca

SEQ ID NO: 997493 - RNA, 22 nt, Homo sapiens
uagaugauuaaauaagauucua

SEQ ID NO: 997494 - RNA, 13 nt, Homo sapiens
uagauucagggaa

SEQ ID NO: 997495 - RNA, 18 nt, Homo sapiens
uagauucucugugucuaa

SEQ ID NO: 997496 - RNA, 19 nt, Homo sapiens
uagcaagaauugaggaaga

SEQ ID NO: 997497 - RNA, 14 nt, Homo sapiens
uagcaauauaucag

SEQ ID NO: 997498 - RNA, 13 nt, Homo sapiens
uagcauacgguau

SEQ ID NO: 997499 - RNA, 18 nt, Homo sapiens
uagcauacgguaugauau

SEQ ID NO: 997500 - RNA, 20 nt, Homo sapiens
uagcauuguaaaagcauuuu

SEQ ID NO: 997501 - RNA, 20 nt, Homo sapiens
uagccaaaccucaccaacuc

SEQ ID NO: 997502 - RNA, 20 nt, Homo sapiens
uagccagcacacagggcagu

SEQ ID NO: 997503 - RNA, 23 nt, Homo sapiens
uagccauauuuguaaaaugacaa

SEQ ID NO: 997504 - RNA, 16 nt, Homo sapiens
uagccuuuuuguauaa

SEQ ID NO: 997505 - RNA, 21 nt, Homo sapiens
uagccuuuuuuccccagacuu

SEQ ID NO: 997506 - RNA, 21 nt, Homo sapiens
uagcuacagagaaaccagcuu

SEQ ID NO: 997507 - RNA, 20 nt, Homo sapiens
uagcucucccaacucuugca

SEQ ID NO: 997508 - RNA, 13 nt, Homo sapiens
uagcucugagaac

SEQ ID NO: 997509 - RNA, 18 nt, Homo sapiens
uagcugguucacacugac

SEQ ID NO: 997510 - RNA, 16 nt, Homo sapiens
uagcugugaccugcug

SEQ ID NO: 997511 - RNA, 21 nt, Homo sapiens
uaggagcuaaggcucuaugag

SEQ ID NO: 997512 - RNA, 15 nt, Homo sapiens
uaggaugcuugggaa

SEQ ID NO: 997513 - RNA, 16 nt, Homo sapiens
uaggcaggaagcccaa

SEQ ID NO: 997514 - RNA, 14 nt, Homo sapiens
uaggcauaccuccu

SEQ ID NO: 997515 - RNA, 14 nt, Homo sapiens
uaggcuacagagaa

SEQ ID NO: 997516 - RNA, 20 nt, Homo sapiens
uagggacagucaaaaccaag

SEQ ID NO: 997517 - RNA, 14 nt, Homo sapiens
uagggaucccucau

SEQ ID NO: 997518 - RNA, 20 nt, Homo sapiens
uaggggcugggaacagugug

SEQ ID NO: 997519 - RNA, 22 nt, Homo sapiens
uagggggagcaaaucgugccuu

SEQ ID NO: 997520 - RNA, 18 nt, Homo sapiens
uaggucucaucucuucag

SEQ ID NO: 997521 - RNA, 15 nt, Homo sapiens
uaggugaaaguuaau

SEQ ID NO: 997522 - RNA, 14 nt, Homo sapiens
uagguugcacacuu

SEQ ID NO: 997523 - RNA, 16 nt, Homo sapiens
uagguugcacacuuug

SEQ ID NO: 997524 - RNA, 23 nt, Homo sapiens
uaguacuugggagaccuguaauc

SEQ ID NO: 997525 - RNA, 20 nt, Homo sapiens
uagucaagugcguccacgag

SEQ ID NO: 997526 - RNA, 13 nt, Homo sapiens
uagucaugugacc

SEQ ID NO: 997527 - RNA, 21 nt, Homo sapiens
uagucccgauaggguauuuga

SEQ ID NO: 997528 - RNA, 17 nt, Homo sapiens
uagucgaacaauucaua

SEQ ID NO: 997529 - RNA, 13 nt, Homo sapiens
uagugaacuugaa

SEQ ID NO: 997530 - RNA, 21 nt, Homo sapiens
uagugacuugugucccaugau

SEQ ID NO: 997531 - RNA, 14 nt, Homo sapiens
uagugcuacagggu

SEQ ID NO: 997532 - RNA, 12 nt, Homo sapiens
uagugugaauua

SEQ ID NO: 997533 - RNA, 15 nt, Homo sapiens
uaguugucuuuccug

SEQ ID NO: 997534 - RNA, 18 nt, Homo sapiens
uauaaaaaugagugcuua

SEQ ID NO: 997535 - RNA, 14 nt, Homo sapiens
uauaaagauuuucu

SEQ ID NO: 997536 - RNA, 14 nt, Homo sapiens
uauaaaguauucaa

SEQ ID NO: 997537 - RNA, 15 nt, Homo sapiens
uauaaaucagccuaa

SEQ ID NO: 997538 - RNA, 14 nt, Homo sapiens
uaaaauucacuuag

SEQ ID NO: 997539 - RNA, 21 nt, Homo sapiens
uaaaauugauuuuucucuuca

SEQ ID NO: 997540 - RNA, 22 nt, Homo sapiens
uaaacaaacuguguaacugccc

SEQ ID NO: 997541 - RNA, 17 nt, Homo sapiens
uaaaccaucaucuugcc

SEQ ID NO: 997542 - RNA, 18 nt, Homo sapiens
uaaacccaguugccaucu

SEQ ID NO: 997543 - RNA, 13 nt, Homo sapiens
uaaacugugcacc

SEQ ID NO: 997544 - RNA, 21 nt, Homo sapiens
uaaacuuaccugggcauucuu

SEQ ID NO: 997545 - RNA, 21 nt, Homo sapiens
uaaacuuccaauuucuagcca

SEQ ID NO: 997546 - RNA, 16 nt, Homo sapiens
uaaacuugccuguuca

SEQ ID NO: 997547 - RNA, 23 nt, Homo sapiens
uaaacuuuuuuucuguaccaguu

SEQ ID NO: 997548 - RNA, 20 nt, Homo sapiens
uaaagaaauauauaugauau

SEQ ID NO: 997549 - RNA, 15 nt, Homo sapiens
uaaagaauagcuuua

SEQ ID NO: 997550 - RNA, 17 nt, Homo sapiens
uaaagauguuuauuuca

SEQ ID NO: 997551 - RNA, 15 nt, Homo sapiens
uaaagccucaagguu

SEQ ID NO: 997552 - RNA, 14 nt, Homo sapiens
uaaagccuccucau

SEQ ID NO: 997553 - RNA, 15 nt, Homo sapiens
uaaaggcaguuuucu

SEQ ID NO: 997554 - RNA, 14 nt, Homo sapiens
uaaaguacugggau

SEQ ID NO: 997555 - RNA, 22 nt, Homo sapiens
uaaaguauucaacaauuucaau

SEQ ID NO: 997556 - RNA, 22 nt, Homo sapiens
uaaagugcuaagguucuaaggc

SEQ ID NO: 997557 - RNA, 22 nt, Homo sapiens
uaaauaauauagccugguguga

SEQ ID NO: 997558 - RNA, 18 nt, Homo sapiens
uaaauauaucuaccccag

SEQ ID NO: 997559 - RNA, 20 nt, Homo sapiens
uaaauauggacugcucagga

SEQ ID NO: 997560 - RNA, 17 nt, Homo sapiens
uaaaugcacagucaugu

SEQ ID NO: 997561 - RNA, 11 nt, Homo sapiens
uaaaugcccug

SEQ ID NO: 997562 - RNA, 20 nt, Homo sapiens
uaaaugugacauugauuugc

SEQ ID NO: 997563 - RNA, 16 nt, Homo sapiens
uaaaugugauucaccu

SEQ ID NO: 997564 - RNA, 14 nt, Homo sapiens
uaaauuuguacuau

SEQ ID NO: 997565 - RNA, 21 nt, Homo sapiens
uaaauuuguacuauuuaacug

SEQ ID NO: 997566 - RNA, 21 nt, Homo sapiens
uaaauuuugaaaacugugcaa

SEQ ID NO: 997567 - RNA, 20 nt, Homo sapiens
uaaauuuuuuauaaaagugu

SEQ ID NO: 997568 - RNA, 18 nt, Homo sapiens
uaacaaaauguaugucug

SEQ ID NO: 997569 - RNA, 14 nt, Homo sapiens
uaacacggugcuca

SEQ ID NO: 997570 - RNA, 16 nt, Homo sapiens
uaacacggugcucauu

SEQ ID NO: 997571 - RNA, 17 nt, Homo sapiens
uaacacucagaagccug

SEQ ID NO: 997572 - RNA, 16 nt, Homo sapiens
uaacagaaacuuucaa

SEQ ID NO: 997573 - RNA, 18 nt, Homo sapiens
uaacauuaucuaguucau

SEQ ID NO: 997574 - RNA, 16 nt, Homo sapiens
uaaccucucugugcca

SEQ ID NO: 997575 - RNA, 17 nt, Homo sapiens
uaaccucucugugccau

SEQ ID NO: 997576 - RNA, 22 nt, Homo sapiens
uaacgagaaaaacacacagaag

SEQ ID NO: 997577 - RNA, 22 nt, Homo sapiens
uaacuagacaccaaaguucuaa

SEQ ID NO: 997578 - RNA, 20 nt, Homo sapiens
uaacugacaagccaucuuga

SEQ ID NO: 997579 - RNA, 21 nt, Homo sapiens
uaacuuccacagggucccaca

SEQ ID NO: 997580 - RNA, 17 nt, Homo sapiens
uaagaaauagacagcau

SEQ ID NO: 997581 - RNA, 16 nt, Homo sapiens
uaagaauuauuuugau

SEQ ID NO: 997582 - RNA, 15 nt, Homo sapiens
uaagagaacaaugug

SEQ ID NO: 997583 - RNA, 20 nt, Homo sapiens
uaagagaaucaacauuucuc

SEQ ID NO: 997584 - RNA, 19 nt, Homo sapiens
uaagaucacagugaacuua

SEQ ID NO: 997585 - RNA, 16 nt, Homo sapiens
uaagaugagggggcca

SEQ ID NO: 997586 - RNA, 20 nt, Homo sapiens
uaagauguuuuaauauguau

SEQ ID NO: 997587 - RNA, 23 nt, Homo sapiens
uaagauuauagauucuaaagauu

SEQ ID NO: 997588 - RNA, 16 nt, Homo sapiens
uaagcagaccacugau

SEQ ID NO: 997589 - RNA, 20 nt, Homo sapiens
uaagcucacguccugagaaa

SEQ ID NO: 997590 - RNA, 23 nt, Homo sapiens
uaagcucacguccugagaaagcu

SEQ ID NO: 997591 - RNA, 14 nt, Homo sapiens
uaagggguacuccu

SEQ ID NO: 997592 - RNA, 18 nt, Homo sapiens
uaagggucgaaagcucua

SEQ ID NO: 997593 - RNA, 18 nt, Homo sapiens
uaagguccgguguucuaa

SEQ ID NO: 997594 - RNA, 20 nt, Homo sapiens
uaaggucuuggaacuugccu

SEQ ID NO: 997595 - RNA, 16 nt, Homo sapiens
uaagguguagccacac

SEQ ID NO: 997596 - RNA, 18 nt, Homo sapiens
uaagguuugccuguguac

SEQ ID NO: 997597 - RNA, 22 nt, Homo sapiens
uaaguacagagaagccaucacc

SEQ ID NO: 997598 - RNA, 20 nt, Homo sapiens
uaagugauauaaaucagauu

SEQ ID NO: 997599 - RNA, 19 nt, Homo sapiens
uaauaagguuuuaauuuag

SEQ ID NO: 997600 - RNA, 15 nt, Homo sapiens
uaauacagggcauuu

SEQ ID NO: 997601 - RNA, 16 nt, Homo sapiens
uaauaggcaucuccag

SEQ ID NO: 997602 - RNA, 22 nt, Homo sapiens
uaauauaaaaagcuuccaugau

SEQ ID NO: 997603 - RNA, 23 nt, Homo sapiens
uaauaugaguaauacaucaaaga

SEQ ID NO: 997604 - RNA, 16 nt, Homo sapiens
uaauauugacuuguau

SEQ ID NO: 997605 - RNA, 14 nt, Homo sapiens
uaauauugauuuau

SEQ ID NO: 997606 - RNA, 12 nt, Homo sapiens
uaaucacucuaa

SEQ ID NO: 997607 - RNA, 17 nt, Homo sapiens
uaaucaucaaguaauac

SEQ ID NO: 997608 - RNA, 20 nt, Homo sapiens
uaaucaucaaguaauacaaa

SEQ ID NO: 997609 - RNA, 22 nt, Homo sapiens
uaauccacugugacuuugccca

SEQ ID NO: 997610 - RNA, 18 nt, Homo sapiens
uaaugaacagaacauaga

SEQ ID NO: 997611 - RNA, 19 nt, Homo sapiens
uaaugaauuuagugagcau

SEQ ID NO: 997612 - RNA, 21 nt, Homo sapiens
uaaugcccagacaaaaagcua

SEQ ID NO: 997613 - RNA, 15 nt, Homo sapiens
uaaugcucugauaug

SEQ ID NO: 997614 - RNA, 20 nt, Homo sapiens
uaauggagaggaaaccagau

SEQ ID NO: 997615 - RNA, 21 nt, Homo sapiens
uaaugguguagaacacuaauu

SEQ ID NO: 997616 - RNA, 18 nt, Homo sapiens
uaaugguuuuuaacaccu

SEQ ID NO: 997617 - RNA, 13 nt, Homo sapiens
uaauguuacauua

SEQ ID NO: 997618 - RNA, 12 nt, Homo sapiens
uaauuaccaugc

SEQ ID NO: 997619 - RNA, 16 nt, Homo sapiens
uaauugcacgugugua

SEQ ID NO: 997620 - RNA, 12 nt, Homo sapiens
uaauugccaugu

SEQ ID NO: 997621 - RNA, 17 nt, Homo sapiens
uaauuuaaacaccuccu

SEQ ID NO: 997622 - RNA, 15 nt, Homo sapiens
uaauuuaguuucaua

SEQ ID NO: 997623 - RNA, 14 nt, Homo sapiens
uaauuuucuuucac

SEQ ID NO: 997624 - RNA, 22 nt, Homo sapiens
uaauuuuuccuauauugcauua

SEQ ID NO: 997625 - RNA, 16 nt, Homo sapiens
uacaaacuucaaagag

SEQ ID NO: 997626 - RNA, 20 nt, Homo sapiens
uacaaucagccacauucuag

SEQ ID NO: 997627 - RNA, 22 nt, Homo sapiens
uacagagaagucacagggcagu

SEQ ID NO: 997628 - RNA, 16 nt, Homo sapiens
uacagcuaacccucac

SEQ ID NO: 997629 - RNA, 14 nt, Homo sapiens
uacagcuucaguga

SEQ ID NO: 997630 - RNA, 18 nt, Homo sapiens
uacaggugugugccacca

SEQ ID NO: 997631 - RNA, 22 nt, Homo sapiens
uacaguaggagcccagcucuga

SEQ ID NO: 997632 - RNA, 18 nt, Homo sapiens
uacagucuuccauuugca

SEQ ID NO: 997633 - RNA, 17 nt, Homo sapiens
uacaguucugugguuuc

SEQ ID NO: 997634 - RNA, 16 nt, Homo sapiens
uacauacagaauuacu

SEQ ID NO: 997635 - RNA, 22 nt, Homo sapiens
uacauccaaagcagacagcucc

SEQ ID NO: 997636 - RNA, 21 nt, Homo sapiens
uacaugagaaggaacuuccag

SEQ ID NO: 997637 - RNA, 12 nt, Homo sapiens
uacaugcuuauu

SEQ ID NO: 997638 - RNA, 16 nt, Homo sapiens
uacauguauugcacau

SEQ ID NO: 997639 - RNA, 15 nt, Homo sapiens
uacauuaauuaccuu

SEQ ID NO: 997640 - RNA, 15 nt, Homo sapiens
gugcaccugggagaa

SEQ ID NO: 997641 - RNA, 18 nt, Homo sapiens
gugcacuggcaccaagug

SEQ ID NO: 997642 - RNA, 13 nt, Homo sapiens
gugcagccacaca

SEQ ID NO: 997643 - RNA, 17 nt, Homo sapiens
gugcagccacacacaga

SEQ ID NO: 997644 - RNA, 22 nt, Homo sapiens
gugcaguacuuugugcauucug

SEQ ID NO: 997645 - RNA, 19 nt, Homo sapiens
gugcaguggugugaucuca

SEQ ID NO: 997646 - RNA, 23 nt, Homo sapiens
gugcauuuuuacuauuguuacau

SEQ ID NO: 997647 - RNA, 12 nt, Homo sapiens
gugccaccauca

SEQ ID NO: 997648 - RNA, 22 nt, Homo sapiens
gugccacuuuaauccuuccacu

SEQ ID NO: 997649 - RNA, 18 nt, Homo sapiens
gugcccaggguuuugccc

SEQ ID NO: 997650 - RNA, 19 nt, Homo sapiens
gugcccugcaucccucucc

SEQ ID NO: 997651 - RNA, 15 nt, Homo sapiens
gugcgcgcgugcaug

SEQ ID NO: 997652 - RNA, 21 nt, Homo sapiens
gugcuaauuuguuuuggauau

SEQ ID NO: 997653 - RNA, 16 nt, Homo sapiens
gugcuauggugcucug

SEQ ID NO: 997654 - RNA, 21 nt, Homo sapiens
gugcucuccauucugcuccuu

SEQ ID NO: 997655 - RNA, 18 nt, Homo sapiens
gugcucugucuacuugcu

SEQ ID NO: 997656 - RNA, 21 nt, Homo sapiens
gugcuugcuuuucaugcaaac

SEQ ID NO: 997657 - RNA, 13 nt, Homo sapiens
guggaacugcugc

SEQ ID NO: 997658 - RNA, 11 nt, Homo sapiens
guggacaugcg

SEQ ID NO: 997659 - RNA, 17 nt, Homo sapiens
guggacaugcgugacca

SEQ ID NO: 997660 - RNA, 19 nt, Homo sapiens
guggaccauggaguggcag

SEQ ID NO: 997661 - RNA, 16 nt, Homo sapiens
guggauaucuguguau

SEQ ID NO: 997662 - RNA, 17 nt, Homo sapiens
guggauaucuguguaua

SEQ ID NO: 997663 - RNA, 13 nt, Homo sapiens
guggcacaggagu

SEQ ID NO: 997664 - RNA, 14 nt, Homo sapiens
gugggguggcugca

SEQ ID NO: 997665 - RNA, 22 nt, Homo sapiens
gugucacucaaggcggugcuug

SEQ ID NO: 997666 - RNA, 15 nt, Homo sapiens
gugucaggcacuggg

SEQ ID NO: 997667 - RNA, 14 nt, Homo sapiens
gugucuagaggcag

SEQ ID NO: 997668 - RNA, 17 nt, Homo sapiens
gugucucaggcugccug

SEQ ID NO: 997669 - RNA, 14 nt, Homo sapiens
gugugcaucaggcu

SEQ ID NO: 997670 - RNA, 14 nt, Homo sapiens
guguggugaugaau

SEQ ID NO: 997671 - RNA, 21 nt, Homo sapiens
guguuaucagucauaacuaaa

SEQ ID NO: 997672 - RNA, 12 nt, Homo sapiens
guguugauacug

SEQ ID NO: 997673 - RNA, 20 nt, Homo sapiens
guguugauacuguugcacgu

SEQ ID NO: 997674 - RNA, 22 nt, Homo sapiens
guguugauacuguugcacgugu

SEQ ID NO: 997675 - RNA, 23 nt, Homo sapiens
guguugauacuguugcacgugug

SEQ ID NO: 997676 - RNA, 17 nt, Homo sapiens
guuaacacucaugaagc

SEQ ID NO: 997677 - RNA, 19 nt, Homo sapiens
guuaauuuugaagugcugu

SEQ ID NO: 997678 - RNA, 10 nt, Homo sapiens
guuacauuuc

SEQ ID NO: 997679 - RNA, 17 nt, Homo sapiens
guuaccaugucuuucuc

SEQ ID NO: 997680 - RNA, 14 nt, Homo sapiens
guuaccucugcaug

SEQ ID NO: 997681 - RNA, 17 nt, Homo sapiens
guuaccucugcauggaa

SEQ ID NO: 997682 - RNA, 19 nt, Homo sapiens
guuacugcuugaccaaaga

SEQ ID NO: 997683 - RNA, 20 nt, Homo sapiens
guuauagacagucguuccca

SEQ ID NO: 997684 - RNA, 15 nt, Homo sapiens
guucacaacagugaa

SEQ ID NO: 997685 - RNA, 20 nt, Homo sapiens
guucaccauuauaaugaauu

SEQ ID NO: 997686 - RNA, 21 nt, Homo sapiens
guuccccaguagagcucuacu

SEQ ID NO: 997687 - RNA, 18 nt, Homo sapiens
guuccccgauaccaugcu

SEQ ID NO: 997688 - RNA, 20 nt, Homo sapiens
guuccccuaguucuacauga

SEQ ID NO: 997689 - RNA, 20 nt, Homo sapiens
guucgcauggucacacacug

SEQ ID NO: 997690 - RNA, 19 nt, Homo sapiens
guucucagguguugccaaa

SEQ ID NO: 997691 - RNA, 20 nt, Homo sapiens
guucucauggguggcacuca

SEQ ID NO: 997692 - RNA, 13 nt, Homo sapiens
guucucuauacuc

SEQ ID NO: 997693 - RNA, 21 nt, Homo sapiens
guucuggauaccauuauaugu

SEQ ID NO: 997694 - RNA, 14 nt, Homo sapiens
guucuuacugcuug

SEQ ID NO: 997695 - RNA, 19 nt, Homo sapiens
guucuuuuugaaguauuua

SEQ ID NO: 997696 - RNA, 16 nt, Homo sapiens
guugagcuauugcugu

SEQ ID NO: 997697 - RNA, 19 nt, Homo sapiens
guugaucuggaacccagac

SEQ ID NO: 997698 - RNA, 17 nt, Homo sapiens
guugauuacagugcagu

SEQ ID NO: 997699 - RNA, 21 nt, Homo sapiens
guugcacguguguuuuucuau

SEQ ID NO: 997700 - RNA, 12 nt, Homo sapiens
guugcauugcuu

SEQ ID NO: 997701 - RNA, 23 nt, Homo sapiens
guuggagucacucuuaugcugua

SEQ ID NO: 997702 - RNA, 14 nt, Homo sapiens
guuggcucugccag

SEQ ID NO: 997703 - RNA, 17 nt, Homo sapiens
guuguaagcacugacug

SEQ ID NO: 997704 - RNA, 21 nt, Homo sapiens
guuguauucauuguggucaua

SEQ ID NO: 997705 - RNA, 14 nt, Homo sapiens
guugucaccaagcu

SEQ ID NO: 997706 - RNA, 19 nt, Homo sapiens
guugucucuagagcaggga

SEQ ID NO: 997707 - RNA, 19 nt, Homo sapiens
guugucucugaugcagcuu

SEQ ID NO: 997708 - RNA, 16 nt, Homo sapiens
guuguuaaaaauguca

SEQ ID NO: 997709 - RNA, 17 nt, Homo sapiens
guuguuaauguacaaaa

SEQ ID NO: 997710 - RNA, 16 nt, Homo sapiens
guuuaacauacaauca

SEQ ID NO: 997711 - RNA, 18 nt, Homo sapiens
guuuaccaguugccuuuu

SEQ ID NO: 997712 - RNA, 19 nt, Homo sapiens
guuuaccuuguauacugua

SEQ ID NO: 997713 - RNA, 17 nt, Homo sapiens
guuuauacacuguguaa

SEQ ID NO: 997714 - RNA, 22 nt, Homo sapiens
guuuauauauuuaaaaguguca

SEQ ID NO: 997715 - RNA, 22 nt, Homo sapiens
guuuauuucaggcauuggauau

SEQ ID NO: 997716 - RNA, 21 nt, Homo sapiens
guuucauuuagucaugugacc

SEQ ID NO: 997717 - RNA, 12 nt, Homo sapiens
guuuccugguca

SEQ ID NO: 997718 - RNA, 21 nt, Homo sapiens
guuuccuugggaguugucauu

SEQ ID NO: 997719 - RNA, 23 nt, Homo sapiens
guuucuggauuucauacuguaac

SEQ ID NO: 997720 - RNA, 21 nt, Homo sapiens
guuugacuuauugcuguuuca

SEQ ID NO: 997721 - RNA, 13 nt, Homo sapiens
guuugcacuuccu

SEQ ID NO: 997722 - RNA, 14 nt, Homo sapiens
guuuggcugggaua

SEQ ID NO: 997723 - RNA, 23 nt, Homo sapiens
guuuugaaggcaaaauugcaaau

SEQ ID NO: 997724 - RNA, 15 nt, Homo sapiens
guuuuguuuccucug

SEQ ID NO: 997725 - RNA, 20 nt, Homo sapiens
guuuuuaauuuaucagagac

SEQ ID NO: 997726 - RNA, 13 nt, Homo sapiens
uaaaaaguuauaa

SEQ ID NO: 997727 - RNA, 16 nt, Homo sapiens
uaaaaaugagugcuua

SEQ ID NO: 997728 - RNA, 18 nt, Homo sapiens
uaaaaaugagugcuuaaa

SEQ ID NO: 997729 - RNA, 15 nt, Homo sapiens
uaaaaauugugauca

SEQ ID NO: 997730 - RNA, 12 nt, Homo sapiens
uaaaacuuuccu

SEQ ID NO: 997731 - RNA, 18 nt, Homo sapiens
uaaaagaaaauccauuau

SEQ ID NO: 997732 - RNA, 11 nt, Homo sapiens
uaaaagacuca

SEQ ID NO: 997733 - RNA, 13 nt, Homo sapiens
uaaaagcauuuug

SEQ ID NO: 997734 - RNA, 20 nt, Homo sapiens
uaaaagcuauaaagcaguau

SEQ ID NO: 997735 - RNA, 18 nt, Homo sapiens
uaaaauacaagacugcca

SEQ ID NO: 997736 - RNA, 19 nt, Homo sapiens
uaaaauauaaucucuauaa

SEQ ID NO: 997737 - RNA, 14 nt, Homo sapiens
uaaaaucuugucau

SEQ ID NO: 997738 - RNA, 20 nt, Homo sapiens
uaaaaucuugucauguguau

SEQ ID NO: 997739 - RNA, 21 nt, Homo sapiens
uaaaaugaaggaaaagcaugu

SEQ ID NO: 997740 - RNA, 18 nt, Homo sapiens
uaaaaugacaagcacuau

SEQ ID NO: 997741 - RNA, 16 nt, Homo sapiens
uaaaauguaaagccau

SEQ ID NO: 997742 - RNA, 18 nt, Homo sapiens
uaaaauuagaugaacuca

SEQ ID NO: 997743 - RNA, 20 nt, Homo sapiens
guaauaaaagugguuugugg

SEQ ID NO: 997744 - RNA, 15 nt, Homo sapiens
guaauacaucaaaga

SEQ ID NO: 997745 - RNA, 14 nt, Homo sapiens
guaauauguuacaa

SEQ ID NO: 997746 - RNA, 14 nt, Homo sapiens
guaaugaaacaaag

SEQ ID NO: 997747 - RNA, 12 nt, Homo sapiens
guacagaccucc

SEQ ID NO: 997748 - RNA, 13 nt, Homo sapiens
guacagaccuccg

SEQ ID NO: 997749 - RNA, 13 nt, Homo sapiens
guacagugucuuu

SEQ ID NO: 997750 - RNA, 17 nt, Homo sapiens
guacauugggagucugu

SEQ ID NO: 997751 - RNA, 15 nt, Homo sapiens
guacauuucucaggc

SEQ ID NO: 997752 - RNA, 21 nt, Homo sapiens
guacccacucuggagcauuuc

SEQ ID NO: 997753 - RNA, 15 nt, Homo sapiens
guaccccauggagcu

SEQ ID NO: 997754 - RNA, 18 nt, Homo sapiens
guacccccaggaccagaa

SEQ ID NO: 997755 - RNA, 21 nt, Homo sapiens
guaccuucaaacuagggccaa

SEQ ID NO: 997756 - RNA, 13 nt, Homo sapiens
guacuaaagccaa

SEQ ID NO: 997757 - RNA, 15 nt, Homo sapiens
guacuucucacccag

SEQ ID NO: 997758 - RNA, 18 nt, Homo sapiens
guagagcucuacugccuc

SEQ ID NO: 997759 - RNA, 22 nt, Homo sapiens
guagcuacagagaaaccagcuu

SEQ ID NO: 997760 - RNA, 16 nt, Homo sapiens
guagcugaaaggggaa

SEQ ID NO: 997761 - RNA, 18 nt, Homo sapiens
guaggcuggaguuaggga

SEQ ID NO: 997762 - RNA, 16 nt, Homo sapiens
guaggcuuaguuugug

SEQ ID NO: 997763 - RNA, 17 nt, Homo sapiens
guaggggcccacuucac

SEQ ID NO: 997764 - RNA, 14 nt, Homo sapiens
guagugucacucaa

SEQ ID NO: 997765 - RNA, 23 nt, Homo sapiens
guagugucacucaaggcggugcu

SEQ ID NO: 997766 - RNA, 20 nt, Homo sapiens
guauacauaaguuuaggaua

SEQ ID NO: 997767 - RNA, 12 nt, Homo sapiens
guauaccucacu

SEQ ID NO: 997768 - RNA, 16 nt, Homo sapiens
guauagcugcuuccag

SEQ ID NO: 997769 - RNA, 17 nt, Homo sapiens
guauaugucuuuuaccc

SEQ ID NO: 997770 - RNA, 14 nt, Homo sapiens
guaucaaaugugac

SEQ ID NO: 997771 - RNA, 21 nt, Homo sapiens
guaucaaaugugacauuauau

SEQ ID NO: 997772 - RNA, 20 nt, Homo sapiens
guaucaugcccugugcaacc

SEQ ID NO: 997773 - RNA, 16 nt, Homo sapiens
guaugaagaguguuau

SEQ ID NO: 997774 - RNA, 15 nt, Homo sapiens
guaugaauuauucaa

SEQ ID NO: 997775 - RNA, 15 nt, Homo sapiens
guaugacugcacaug

SEQ ID NO: 997776 - RNA, 22 nt, Homo sapiens
guaugucuacacguaaguauaa

SEQ ID NO: 997777 - RNA, 15 nt, Homo sapiens
guauuguugaaaaag

SEQ ID NO: 997778 - RNA, 17 nt, Homo sapiens
guauuucaagucucuca

SEQ ID NO: 997779 - RNA, 12 nt, Homo sapiens
guauuuuugccg

SEQ ID NO: 997780 - RNA, 20 nt, Homo sapiens
guauuuuugccggcugguga

SEQ ID NO: 997781 - RNA, 17 nt, Homo sapiens
gucaagcugaguauuaa

SEQ ID NO: 997782 - RNA, 15 nt, Homo sapiens
gucacgcaugcagug

SEQ ID NO: 997783 - RNA, 15 nt, Homo sapiens
gucacggccaggcag

SEQ ID NO: 997784 - RNA, 14 nt, Homo sapiens
gucacucuagucaa

SEQ ID NO: 997785 - RNA, 20 nt, Homo sapiens
gucacucuagucaaugacau

SEQ ID NO: 997786 - RNA, 13 nt, Homo sapiens
gucagaacuagaa

SEQ ID NO: 997787 - RNA, 13 nt, Homo sapiens
gucagcaugaauu

SEQ ID NO: 997788 - RNA, 12 nt, Homo sapiens
gucagcauguac

SEQ ID NO: 997789 - RNA, 19 nt, Homo sapiens
gucaggacuugaacccagg

SEQ ID NO: 997790 - RNA, 17 nt, Homo sapiens
gucaggcacugggcaug

SEQ ID NO: 997791 - RNA, 18 nt, Homo sapiens
gucaggccuuugagcuca

SEQ ID NO: 997792 - RNA, 20 nt, Homo sapiens
gucaguccaggaugcuaaca

SEQ ID NO: 997793 - RNA, 14 nt, Homo sapiens
gucauaauugcauu

SEQ ID NO: 997794 - RNA, 16 nt, Homo sapiens
gucauaauugcauuga

SEQ ID NO: 997795 - RNA, 17 nt, Homo sapiens
gucaucaggugcauagc

SEQ ID NO: 997796 - RNA, 15 nt, Homo sapiens
gucauccagcucacu

SEQ ID NO: 997797 - RNA, 23 nt, Homo sapiens
gucauccagucuauucacagaag

SEQ ID NO: 997798 - RNA, 16 nt, Homo sapiens
gucauuguaaucacug

SEQ ID NO: 997799 - RNA, 21 nt, Homo sapiens
guccagacagagcccugugag

SEQ ID NO: 997800 - RNA, 17 nt, Homo sapiens
guccagggcuagugacu

SEQ ID NO: 997801 - RNA, 21 nt, Homo sapiens
guccauaucacacacauugcu

SEQ ID NO: 997802 - RNA, 13 nt, Homo sapiens
gucccacaggcca

SEQ ID NO: 997803 - RNA, 18 nt, Homo sapiens
guccccccacucccucac

SEQ ID NO: 997804 - RNA, 16 nt, Homo sapiens
guccccugcccaugcu

SEQ ID NO: 997805 - RNA, 19 nt, Homo sapiens
gucccggggccagcacuuc

SEQ ID NO: 997806 - RNA, 21 nt, Homo sapiens
gucccuucagcaccugacccu

SEQ ID NO: 997807 - RNA, 20 nt, Homo sapiens
gucccuuuaugcagagccac

SEQ ID NO: 997808 - RNA, 18 nt, Homo sapiens
guccuacagaaaaaccuu

SEQ ID NO: 997809 - RNA, 20 nt, Homo sapiens
guccuccaacaccaagcaca

SEQ ID NO: 997810 - RNA, 20 nt, Homo sapiens
guccucccaauuucagacuc

SEQ ID NO: 997811 - RNA, 14 nt, Homo sapiens
guccugagcacugc

SEQ ID NO: 997812 - RNA, 20 nt, Homo sapiens
guccugagcacugccaggag

SEQ ID NO: 997813 - RNA, 18 nt, Homo sapiens
guccugagccccagggag

SEQ ID NO: 997814 - RNA, 12 nt, Homo sapiens
guccuggucaag

SEQ ID NO: 997815 - RNA, 14 nt, Homo sapiens
guccuuuaccaaag

SEQ ID NO: 997816 - RNA, 14 nt, Homo sapiens
guccuuucauuugu

SEQ ID NO: 997817 - RNA, 14 nt, Homo sapiens
guccuuuugacacu

SEQ ID NO: 997818 - RNA, 22 nt, Homo sapiens
gucuagacuauuaggugcaauu

SEQ ID NO: 997819 - RNA, 18 nt, Homo sapiens
gucuagucacgcaugcag

SEQ ID NO: 997820 - RNA, 17 nt, Homo sapiens
gucucagcuaagcucac

SEQ ID NO: 997821 - RNA, 19 nt, Homo sapiens
gucuccuaaaguacuggga

SEQ ID NO: 997822 - RNA, 17 nt, Homo sapiens
gucucgcuuuguugccc

SEQ ID NO: 997823 - RNA, 18 nt, Homo sapiens
gucucugcuaaaccacca

SEQ ID NO: 997824 - RNA, 22 nt, Homo sapiens
gucucuuguaauccgaaucucu

SEQ ID NO: 997825 - RNA, 16 nt, Homo sapiens
gucugggcacagucag

SEQ ID NO: 997826 - RNA, 15 nt, Homo sapiens
gucugggugcuacug

SEQ ID NO: 997827 - RNA, 20 nt, Homo sapiens
gucuguguagaguguuauac

SEQ ID NO: 997828 - RNA, 13 nt, Homo sapiens
gucuucuaaacuu

SEQ ID NO: 997829 - RNA, 17 nt, Homo sapiens
gucuugagcucuauuau

SEQ ID NO: 997830 - RNA, 15 nt, Homo sapiens
gucuuuaaugcaaua

SEQ ID NO: 997831 - RNA, 20 nt, Homo sapiens
gucuuucacagcuccuccca

SEQ ID NO: 997832 - RNA, 14 nt, Homo sapiens
gucuuugaacccuu

SEQ ID NO: 997833 - RNA, 14 nt, Homo sapiens
gugaaaugcuggca

SEQ ID NO: 997834 - RNA, 21 nt, Homo sapiens
gugaacauugguucuuucauu

SEQ ID NO: 997835 - RNA, 20 nt, Homo sapiens
gugaagaaaccguauccaua

SEQ ID NO: 997836 - RNA, 18 nt, Homo sapiens
gugaagagccacugccau

SEQ ID NO: 997837 - RNA, 23 nt, Homo sapiens
gugaauuaagcccaauuaauucc

SEQ ID NO: 997838 - RNA, 19 nt, Homo sapiens
gugacaguggcguuuguaa

SEQ ID NO: 997839 - RNA, 15 nt, Homo sapiens
gugacauuugggaga

SEQ ID NO: 997840 - RNA, 12 nt, Homo sapiens
gugagacccagc

SEQ ID NO: 997841 - RNA, 18 nt, Homo sapiens
gugagaugggacauucca

SEQ ID NO: 997842 - RNA, 17 nt, Homo sapiens
gugagcugagauugcac

SEQ ID NO: 997843 - RNA, 14 nt, Homo sapiens
gugauucaccucuu

SEQ ID NO: 997844 - RNA, 14 nt, Homo sapiens
gugcacacauauac

SEQ ID NO: 997845 - RNA, 18 nt, Homo sapiens
gugcacaggcgcauccca

SEQ ID NO: 997846 - RNA, 16 nt, Homo sapiens
gugcacaucugugucu

SEQ ID NO: 997847 - RNA, 18 nt, Homo sapiens
ggccugcuccagaccuga

SEQ ID NO: 997848 - RNA, 14 nt, Homo sapiens
ggccuguccuccaa

SEQ ID NO: 997849 - RNA, 18 nt, Homo sapiens
ggccuguguagcugugac

SEQ ID NO: 997850 - RNA, 13 nt, Homo sapiens
ggcgaguggcacg

SEQ ID NO: 997851 - RNA, 23 nt, Homo sapiens
ggcguaggcuacagagaagccuu

SEQ ID NO: 997852 - RNA, 18 nt, Homo sapiens
ggcguggaggaggaggga

SEQ ID NO: 997853 - RNA, 22 nt, Homo sapiens
ggcguuacugcuugaccaaaga

SEQ ID NO: 997854 - RNA, 23 nt, Homo sapiens
ggcguuuggacccaguucaguga

SEQ ID NO: 997855 - RNA, 21 nt, Homo sapiens
ggcuaaagcucgaugugguca

SEQ ID NO: 997856 - RNA, 17 nt, Homo sapiens
ggcuacacacaaaccag

SEQ ID NO: 997857 - RNA, 13 nt, Homo sapiens
ggcuacucugugc

SEQ ID NO: 997858 - RNA, 18 nt, Homo sapiens
ggcuccagaugcagggca

SEQ ID NO: 997859 - RNA, 15 nt, Homo sapiens
ggcucuaacgccuga

SEQ ID NO: 997860 - RNA, 21 nt, Homo sapiens
ggcucuaauucacagugcucu

SEQ ID NO: 997861 - RNA, 19 nt, Homo sapiens
ggcucuuagcagcuuccag

SEQ ID NO: 997862 - RNA, 19 nt, Homo sapiens
ggcugaauagcuucuccaa

SEQ ID NO: 997863 - RNA, 17 nt, Homo sapiens
ggcugccccucucacca

SEQ ID NO: 997864 - RNA, 20 nt, Homo sapiens
ggcugcugaaacucauuuga

SEQ ID NO: 997865 - RNA, 13 nt, Homo sapiens
ggcugggccaugu

SEQ ID NO: 997866 - RNA, 18 nt, Homo sapiens
ggcugguagagcagguga

SEQ ID NO: 997867 - RNA, 16 nt, Homo sapiens
ggcuguguuuccaucu

SEQ ID NO: 997868 - RNA, 21 nt, Homo sapiens
ggcuucagcugccaguguccu

SEQ ID NO: 997869 - RNA, 21 nt, Homo sapiens
ggcuuuguugcuuccguucau

SEQ ID NO: 997870 - RNA, 15 nt, Homo sapiens
gggaacacuggggac

SEQ ID NO: 997871 - RNA, 15 nt, Homo sapiens
gggaaggauucugcu

SEQ ID NO: 997872 - RNA, 16 nt, Homo sapiens
gggaaggggaaggaua

SEQ ID NO: 997873 - RNA, 23 nt, Homo sapiens
gggaccagcagccccacaccagg

SEQ ID NO: 997874 - RNA, 20 nt, Homo sapiens
gggagccaagggauggacau

SEQ ID NO: 997875 - RNA, 23 nt, Homo sapiens
gggaggccgaagcuaacagggaa

SEQ ID NO: 997876 - RNA, 19 nt, Homo sapiens
gggagggaagggagccaag

SEQ ID NO: 997877 - RNA, 14 nt, Homo sapiens
gggauguugaacug

SEQ ID NO: 997878 - RNA, 16 nt, Homo sapiens
gggcaggcugggccau

SEQ ID NO: 997879 - RNA, 14 nt, Homo sapiens
gggcaugcuuuauu

SEQ ID NO: 997880 - RNA, 20 nt, Homo sapiens
gggccccucucagcccucac

SEQ ID NO: 997881 - RNA, 16 nt, Homo sapiens
gggccuaggcugcauu

SEQ ID NO: 997882 - RNA, 19 nt, Homo sapiens
gggccuauggagagcccug

SEQ ID NO: 997883 - RNA, 22 nt, Homo sapiens
gggccucaaaugcaccauguca

SEQ ID NO: 997884 - RNA, 15 nt, Homo sapiens
gggccucuucugcuu

SEQ ID NO: 997885 - RNA, 20 nt, Homo sapiens
gggccuggcuggcugagggc

SEQ ID NO: 997886 - RNA, 22 nt, Homo sapiens
gggccuuaggaagagccuucca

SEQ ID NO: 997887 - RNA, 20 nt, Homo sapiens
gggcgguaccuugugcccag

SEQ ID NO: 997888 - RNA, 19 nt, Homo sapiens
gggcucagggaccauggcu

SEQ ID NO: 997889 - RNA, 20 nt, Homo sapiens
gggcugcccacaaggcuugu

SEQ ID NO: 997890 - RNA, 11 nt, Homo sapiens
gggcuugccuu

SEQ ID NO: 997891 - RNA, 20 nt, Homo sapiens
ggggaaacagcaucuccaag

SEQ ID NO: 997892 - RNA, 14 nt, Homo sapiens
ggggaucccucccc

SEQ ID NO: 997893 - RNA, 17 nt, Homo sapiens
ggggaugccuugguuuu

SEQ ID NO: 997894 - RNA, 23 nt, Homo sapiens
ggggccaggucacccuuugcugu

SEQ ID NO: 997895 - RNA, 20 nt, Homo sapiens
gggggaaagcaaagcacaga

SEQ ID NO: 997896 - RNA, 12 nt, Homo sapiens
gggggaaggugg

SEQ ID NO: 997897 - RNA, 20 nt, Homo sapiens
gggggccaggcgguggcuuc

SEQ ID NO: 997898 - RNA, 15 nt, Homo sapiens
ggggugcagggaugu

SEQ ID NO: 997899 - RNA, 16 nt, Homo sapiens
ggguaggggcugggaa

SEQ ID NO: 997900 - RNA, 20 nt, Homo sapiens
ggguauaguucaugucugcu

SEQ ID NO: 997901 - RNA, 19 nt, Homo sapiens
ggguccuccuccagggaca

SEQ ID NO: 997902 - RNA, 19 nt, Homo sapiens
gggucucacaguguugccc

SEQ ID NO: 997903 - RNA, 16 nt, Homo sapiens
gggucuuugaacccuu

SEQ ID NO: 997904 - RNA, 14 nt, Homo sapiens
gggugguacccucu

SEQ ID NO: 997905 - RNA, 19 nt, Homo sapiens
gguaacugcuuucuguucc

SEQ ID NO: 997906 - RNA, 14 nt, Homo sapiens
gguaagaaguuuua

SEQ ID NO: 997907 - RNA, 18 nt, Homo sapiens
gguacuuguaaauuauua

SEQ ID NO: 997908 - RNA, 11 nt, Homo sapiens
gguacuuucau

SEQ ID NO: 997909 - RNA, 20 nt, Homo sapiens
gguagccagcacacagggca

SEQ ID NO: 997910 - RNA, 18 nt, Homo sapiens
gguauaguucaugucugc

SEQ ID NO: 997911 - RNA, 18 nt, Homo sapiens
gguauggcguaaguacag

SEQ ID NO: 997912 - RNA, 22 nt, Homo sapiens
gguaugucauucgcuacuauga

SEQ ID NO: 997913 - RNA, 18 nt, Homo sapiens
ggucaaaauagugccacu

SEQ ID NO: 997914 - RNA, 14 nt, Homo sapiens
ggucagccacuguu

SEQ ID NO: 997915 - RNA, 18 nt, Homo sapiens
ggucaggcagggugcagu

SEQ ID NO: 997916 - RNA, 12 nt, Homo sapiens
ggucaguccaug

SEQ ID NO: 997917 - RNA, 13 nt, Homo sapiens
ggucccggggcca

SEQ ID NO: 997918 - RNA, 20 nt, Homo sapiens
ggucccggggccagcacuuc

SEQ ID NO: 997919 - RNA, 19 nt, Homo sapiens
gguccucugucagucacag

SEQ ID NO: 997920 - RNA, 23 nt, Homo sapiens
ggucuagacuauuaggugcaauu

SEQ ID NO: 997921 - RNA, 18 nt, Homo sapiens
ggugaacaaaguuuacca

SEQ ID NO: 997922 - RNA, 19 nt, Homo sapiens
ggugacccccccccauccc

SEQ ID NO: 997923 - RNA, 17 nt, Homo sapiens
ggugauccauguaacug

SEQ ID NO: 997924 - RNA, 19 nt, Homo sapiens
ggugcaguaucaugcccug

SEQ ID NO: 997925 - RNA, 21 nt, Homo sapiens
ggugccuuuauuuccacugug

SEQ ID NO: 997926 - RNA, 13 nt, Homo sapiens
gguggagggccac

SEQ ID NO: 997927 - RNA, 21 nt, Homo sapiens
ggugggcuggccgcugugcca

SEQ ID NO: 997928 - RNA, 13 nt, Homo sapiens
ggugggguggcug

SEQ ID NO: 997929 - RNA, 14 nt, Homo sapiens
gguggucccugggu

SEQ ID NO: 997930 - RNA, 14 nt, Homo sapiens
gguucaacuuauua

SEQ ID NO: 997931 - RNA, 11 nt, Homo sapiens
gguucacacag

SEQ ID NO: 997932 - RNA, 16 nt, Homo sapiens
gguuccggcauggaca

SEQ ID NO: 997933 - RNA, 21 nt, Homo sapiens
gguuccggcauggacaaugga

SEQ ID NO: 997934 - RNA, 14 nt, Homo sapiens
gguuggcucugcca

SEQ ID NO: 997935 - RNA, 22 nt, Homo sapiens
gguuggggaaacagcaucucca

SEQ ID NO: 997936 - RNA, 16 nt, Homo sapiens
gguugucaccaagcua

SEQ ID NO: 997937 - RNA, 21 nt, Homo sapiens
guaaacagauggcacuuugaa

SEQ ID NO: 997938 - RNA, 13 nt, Homo sapiens
guaaacugugcac

SEQ ID NO: 997939 - RNA, 22 nt, Homo sapiens
guaaagaaaaaagcaccaaagg

SEQ ID NO: 997940 - RNA, 12 nt, Homo sapiens
guaaagccaugc

SEQ ID NO: 997941 - RNA, 12 nt, Homo sapiens
guaaaggcagua

SEQ ID NO: 997942 - RNA, 14 nt, Homo sapiens
guaaauaauacauu

SEQ ID NO: 997943 - RNA, 15 nt, Homo sapiens
guaaauauguacauu

SEQ ID NO: 997944 - RNA, 14 nt, Homo sapiens
guaaaugcuccauu

SEQ ID NO: 997945 - RNA, 23 nt, Homo sapiens
guaaaugugacauugauuugcuc

SEQ ID NO: 997946 - RNA, 16 nt, Homo sapiens
guaacauuugcuguuu

SEQ ID NO: 997947 - RNA, 17 nt, Homo sapiens
guaacuccccucaggga

SEQ ID NO: 997948 - RNA, 20 nt, Homo sapiens
guaagaaaccuacugcccag

SEQ ID NO: 997949 - RNA, 11 nt, Homo sapiens
guaaguauuuu

SEQ ID NO: 997950 - RNA, 16 nt, Homo sapiens
gaccauguuuccucuc

SEQ ID NO: 997951 - RNA, 13 nt, Homo sapiens
gacccaagcugcc

SEQ ID NO: 997952 - RNA, 20 nt, Homo sapiens
gacccacaugcuccagauua

SEQ ID NO: 997953 - RNA, 23 nt, Homo sapiens
gacccagccagaacuugugcccu

SEQ ID NO: 997954 - RNA, 11 nt, Homo sapiens
gacccauuccu

SEQ ID NO: 997955 - RNA, 19 nt, Homo sapiens
gaccccagaggauugcugc

SEQ ID NO: 997956 - RNA, 24 nt, Homo sapiens
gaccccagggcacaggagcuaccu

SEQ ID NO: 997957 - RNA, 16 nt, Homo sapiens
gacccugccucuccca

SEQ ID NO: 997958 - RNA, 17 nt, Homo sapiens
gaccggaguuaugacaa

SEQ ID NO: 997959 - RNA, 19 nt, Homo sapiens
gaccgugaccagugcugcu

SEQ ID NO: 997960 - RNA, 18 nt, Homo sapiens
gaccucaggcaaucugcc

SEQ ID NO: 997961 - RNA, 15 nt, Homo sapiens
gaccuccagcuuucc

SEQ ID NO: 997962 - RNA, 14 nt, Homo sapiens
gaccucuacugccu

SEQ ID NO: 997963 - RNA, 17 nt, Homo sapiens
gaccucugacagcagca

SEQ ID NO: 997964 - RNA, 14 nt, Homo sapiens
gaccuuaaaugcaa

SEQ ID NO: 997965 - RNA, 21 nt, Homo sapiens
gaccuuuuuuaggaagcaagc

SEQ ID NO: 997966 - RNA, 19 nt, Homo sapiens
gacgaggggugucuugggc

SEQ ID NO: 997967 - RNA, 14 nt, Homo sapiens
gacgccuggcugcu

SEQ ID NO: 997968 - RNA, 22 nt, Homo sapiens
gacgcugcugucacaaccaaga

SEQ ID NO: 997969 - RNA, 19 nt, Homo sapiens
gacggagcccuggcauguc

SEQ ID NO: 997970 - RNA, 17 nt, Homo sapiens
gacggaguccuguguuu

SEQ ID NO: 997971 - RNA, 16 nt, Homo sapiens
gacgggaggcuggaag

SEQ ID NO: 997972 - RNA, 13 nt, Homo sapiens
gacggucagucca

SEQ ID NO: 997973 - RNA, 18 nt, Homo sapiens
gacggugcccaagccaga

SEQ ID NO: 997974 - RNA, 15 nt, Homo sapiens
gacgugcagccacac

SEQ ID NO: 997975 - RNA, 22 nt, Homo sapiens
gacuaauuucaaaaugcuuuuu

SEQ ID NO: 997976 - RNA, 18 nt, Homo sapiens
gacuaccuccacucaugu

SEQ ID NO: 997977 - RNA, 20 nt, Homo sapiens
gacuaucuuacuauuucaca

SEQ ID NO: 997978 - RNA, 17 nt, Homo sapiens
gacuauuaggugcaauu

SEQ ID NO: 997979 - RNA, 12 nt, Homo sapiens
gacuauuuccac

SEQ ID NO: 997980 - RNA, 22 nt, Homo sapiens
gacucaagaagugaagaaugca

SEQ ID NO: 997981 - RNA, 17 nt, Homo sapiens
gacucguucuucuggga

SEQ ID NO: 997982 - RNA, 21 nt, Homo sapiens
gacucuaagaaagaacacgcu

SEQ ID NO: 997983 - RNA, 22 nt, Homo sapiens
gacucuauucuuuaacucccau

SEQ ID NO: 997984 - RNA, 14 nt, Homo sapiens
gacucugguguucu

SEQ ID NO: 997985 - RNA, 18 nt, Homo sapiens
gacucuuuaugcuugcaa

SEQ ID NO: 997986 - RNA, 13 nt, Homo sapiens
gacugacaguuua

SEQ ID NO: 997987 - RNA, 15 nt, Homo sapiens
gacugacgccagggu

SEQ ID NO: 997988 - RNA, 21 nt, Homo sapiens
gacugcaacaggaacuuggag

SEQ ID NO: 997989 - RNA, 18 nt, Homo sapiens
gacugcuugcccuaagca

SEQ ID NO: 997990 - RNA, 16 nt, Homo sapiens
gacuucucuuugccuc

SEQ ID NO: 997991 - RNA, 17 nt, Homo sapiens
gacuucugccuggagac

SEQ ID NO: 997992 - RNA, 12 nt, Homo sapiens
gacuuugcuugc

SEQ ID NO: 997993 - RNA, 16 nt, Homo sapiens
gagaaaauguuguaua

SEQ ID NO: 997994 - RNA, 15 nt, Homo sapiens
gagaaacaauggcua

SEQ ID NO: 997995 - RNA, 23 nt, Homo sapiens
gagaaaggauugauuugaacuua

SEQ ID NO: 997996 - RNA, 17 nt, Homo sapiens
gagaaagggagugcaug

SEQ ID NO: 997997 - RNA, 21 nt, Homo sapiens
gagaaagggagugcaugugcg

SEQ ID NO: 997998 - RNA, 16 nt, Homo sapiens
gagaaaucuggcuucu

SEQ ID NO: 997999 - RNA, 21 nt, Homo sapiens
gagaaccuggccuucagugua

SEQ ID NO: 998000 - RNA, 17 nt, Homo sapiens
gagaagaaagaggugac

SEQ ID NO: 998001 - RNA, 20 nt, Homo sapiens
gagacacagcccccacggac

SEQ ID NO: 998002 - RNA, 23 nt, Homo sapiens
gagacacagcccccacggacaaa

SEQ ID NO: 998003 - RNA, 16 nt, Homo sapiens
gagacaugugacauuu

SEQ ID NO: 998004 - RNA, 22 nt, Homo sapiens
gagagcucgcuuugagugacug

SEQ ID NO: 998005 - RNA, 14 nt, Homo sapiens
gagagugagacuca

SEQ ID NO: 998006 - RNA, 19 nt, Homo sapiens
gagaguuugccuguucuau

SEQ ID NO: 998007 - RNA, 18 nt, Homo sapiens
gagauaagaucuauagcc

SEQ ID NO: 998008 - RNA, 19 nt, Homo sapiens
gagauauuaaugcccagac

SEQ ID NO: 998009 - RNA, 21 nt, Homo sapiens
gagaugaccacuuuuuagaaa

SEQ ID NO: 998010 - RNA, 21 nt, Homo sapiens
gagauucaagggacccaugag

SEQ ID NO: 998011 - RNA, 10 nt, Homo sapiens
gagauuuauu

SEQ ID NO: 998012 - RNA, 21 nt, Homo sapiens
gagcacguuugcagaaggggg

SEQ ID NO: 998013 - RNA, 17 nt, Homo sapiens
gagcauguuacugacag

SEQ ID NO: 998014 - RNA, 18 nt, Homo sapiens
gagcauucagaaugucaa

SEQ ID NO: 998015 - RNA, 21 nt, Homo sapiens
gagcauucagaaugucaauga

SEQ ID NO: 998016 - RNA, 23 nt, Homo sapiens
gagccacagcugugcaugcucag

SEQ ID NO: 998017 - RNA, 20 nt, Homo sapiens
gagccaccacguccagcugg

SEQ ID NO: 998018 - RNA, 19 nt, Homo sapiens
gagccaccugacucuugca

SEQ ID NO: 998019 - RNA, 16 nt, Homo sapiens
gagccaggacccagga

SEQ ID NO: 998020 - RNA, 22 nt, Homo sapiens
gagccccaagaggggcugggaa

SEQ ID NO: 998021 - RNA, 16 nt, Homo sapiens
gagccccagcuacccu

SEQ ID NO: 998022 - RNA, 19 nt, Homo sapiens
gagcccggcaacucuagua

SEQ ID NO: 998023 - RNA, 16 nt, Homo sapiens
gagcccugucaguaga

SEQ ID NO: 998024 - RNA, 21 nt, Homo sapiens
gagccgugggcaauugucuga

SEQ ID NO: 998025 - RNA, 23 nt, Homo sapiens
gagccuguccugccuguggccau

SEQ ID NO: 998026 - RNA, 19 nt, Homo sapiens
gagcuaggagcaaagccug

SEQ ID NO: 998027 - RNA, 14 nt, Homo sapiens
gagcuccagcuccu

SEQ ID NO: 998028 - RNA, 20 nt, Homo sapiens
gagcuccccuccccaacuga

SEQ ID NO: 998029 - RNA, 13 nt, Homo sapiens
ggcagggugcagu

SEQ ID NO: 998030 - RNA, 14 nt, Homo sapiens
ggcagggugcagua

SEQ ID NO: 998031 - RNA, 23 nt, Homo sapiens
ggcaguuaccauuaaaccaucuc

SEQ ID NO: 998032 - RNA, 22 nt, Homo sapiens
ggcaucaaaaaagauagaucua

SEQ ID NO: 998033 - RNA, 15 nt, Homo sapiens
ggcauuuccugggug

SEQ ID NO: 998034 - RNA, 16 nt, Homo sapiens
ggccacagccagggga

SEQ ID NO: 998035 - RNA, 15 nt, Homo sapiens
ggccauguccaaaga

SEQ ID NO: 998036 - RNA, 20 nt, Homo sapiens
ggcccacugugccucagaga

SEQ ID NO: 998037 - RNA, 17 nt, Homo sapiens
ggcccacuucaccguac

SEQ ID NO: 998038 - RNA, 19 nt, Homo sapiens
ggcccagagcccagcucca

SEQ ID NO: 998039 - RNA, 15 nt, Homo sapiens
ggcccagcgcagugc

SEQ ID NO: 998040 - RNA, 23 nt, Homo sapiens
ggccccaccaagcacccuuccac

SEQ ID NO: 998041 - RNA, 12 nt, Homo sapiens
ggccgacuccac

SEQ ID NO: 998042 - RNA, 23 nt, Homo sapiens
ggccuacaugguugaaaccccau

SEQ ID NO: 998043 - RNA, 20 nt, Homo sapiens
ggccucccaaaugagccaug

SEQ ID NO: 998044 - RNA, 13 nt, Homo sapiens
ggccucugucaau

SEQ ID NO: 998045 - RNA, 15 nt, Homo sapiens
ggccugaccaaacag

SEQ ID NO: 998046 - RNA, 15 nt, Homo sapiens
ggccugcacuggugu

SEQ ID NO: 998047 - RNA, 13 nt, Homo sapiens
ggccugcuccaga

SEQ ID NO: 998048 - RNA, 15 nt, Homo sapiens
gaaaacugugcaaug

SEQ ID NO: 998049 - RNA, 19 nt, Homo sapiens
gaaaacuuaugcugauuua

SEQ ID NO: 998050 - RNA, 21 nt, Homo sapiens
gaaaaggacuauaagaauaau

SEQ ID NO: 998051 - RNA, 18 nt, Homo sapiens
gaaaaggcugcugugaac

SEQ ID NO: 998052 - RNA, 16 nt, Homo sapiens
gaaaauaagagcucag

SEQ ID NO: 998053 - RNA, 18 nt, Homo sapiens
gaaaaucacuugccaaaa

SEQ ID NO: 998054 - RNA, 18 nt, Homo sapiens
gaaaaugaauuuuuucca

SEQ ID NO: 998055 - RNA, 17 nt, Homo sapiens
gaaaauguccaggaaag

SEQ ID NO: 998056 - RNA, 20 nt, Homo sapiens
gaaaauuagacugugauuca

SEQ ID NO: 998057 - RNA, 14 nt, Homo sapiens
gaaaauuauuugca

SEQ ID NO: 998058 - RNA, 15 nt, Homo sapiens
gaaacaauggcuaag

SEQ ID NO: 998059 - RNA, 21 nt, Homo sapiens
gaaacgucuucuaaacuuccc

SEQ ID NO: 998060 - RNA, 16 nt, Homo sapiens
gaaacucugucacucc

SEQ ID NO: 998061 - RNA, 23 nt, Homo sapiens
gaaagaaguguggggauuuucac

SEQ ID NO: 998062 - RNA, 16 nt, Homo sapiens
gaaagccccugccccu

SEQ ID NO: 998063 - RNA, 20 nt, Homo sapiens
gaaagccugggugacauuug

SEQ ID NO: 998064 - RNA, 15 nt, Homo sapiens
gaaaggcacauguca

SEQ ID NO: 998065 - RNA, 22 nt, Homo sapiens
gaaaguaccaggugaacaaagu

SEQ ID NO: 998066 - RNA, 22 nt, Homo sapiens
gaaagucacggcugcgcacugu

SEQ ID NO: 998067 - RNA, 19 nt, Homo sapiens
gaaaguuaauccacuguga

SEQ ID NO: 998068 - RNA, 18 nt, Homo sapiens
gaaauaaaaggaagccaa

SEQ ID NO: 998069 - RNA, 22 nt, Homo sapiens
gaaauaagugcccucucccacc

SEQ ID NO: 998070 - RNA, 19 nt, Homo sapiens
gaaauaaguuuuuguuuca

SEQ ID NO: 998071 - RNA, 14 nt, Homo sapiens
gaaauaauguguag

SEQ ID NO: 998072 - RNA, 21 nt, Homo sapiens
gaaauaauuguuguucuguua

SEQ ID NO: 998073 - RNA, 20 nt, Homo sapiens
gaaauacauagggauaugcg

SEQ ID NO: 998074 - RNA, 19 nt, Homo sapiens
gaaauagucggugaagaaa

SEQ ID NO: 998075 - RNA, 20 nt, Homo sapiens
gaaaucaacuugcuuaucaa

SEQ ID NO: 998076 - RNA, 19 nt, Homo sapiens
gaaaucuauagaacugaau

SEQ ID NO: 998077 - RNA, 20 nt, Homo sapiens
gaaaucucgucggaaggaca

SEQ ID NO: 998078 - RNA, 19 nt, Homo sapiens
gaaaucuggcuucuggcca

SEQ ID NO: 998079 - RNA, 16 nt, Homo sapiens
gaaauuaagaaggcaa

SEQ ID NO: 998080 - RNA, 13 nt, Homo sapiens
gaaauuuggcaaa

SEQ ID NO: 998081 - RNA, 17 nt, Homo sapiens
gaacaaagcagccacga

SEQ ID NO: 998082 - RNA, 23 nt, Homo sapiens
gaacacuaacuaugcauggugcc

SEQ ID NO: 998083 - RNA, 20 nt, Homo sapiens
gaacacucuuuugcuuuauu

SEQ ID NO: 998084 - RNA, 23 nt, Homo sapiens
gaacacuggggacuuggccucuc

SEQ ID NO: 998085 - RNA, 24 nt, Homo sapiens
gaacacuuauguuauacaauacag

SEQ ID NO: 998086 - RNA, 21 nt, Homo sapiens
gaaccaaaucuggaagccaaa

SEQ ID NO: 998087 - RNA, 13 nt, Homo sapiens
gaaccguuuugaa

SEQ ID NO: 998088 - RNA, 22 nt, Homo sapiens
gaacguuuucuaauugcuuauu

SEQ ID NO: 998089 - RNA, 21 nt, Homo sapiens
gaacuaaagugcugcacucaa

SEQ ID NO: 998090 - RNA, 22 nt, Homo sapiens
gaacucacugcgauggggguca

SEQ ID NO: 998091 - RNA, 19 nt, Homo sapiens
gaacucugguggcacagga

SEQ ID NO: 998092 - RNA, 13 nt, Homo sapiens
gaacugcugccac

SEQ ID NO: 998093 - RNA, 11 nt, Homo sapiens
gaagacauaaa

SEQ ID NO: 998094 - RNA, 15 nt, Homo sapiens
gaagagccacugcca

SEQ ID NO: 998095 - RNA, 14 nt, Homo sapiens
gaagauggggacca

SEQ ID NO: 998096 - RNA, 21 nt, Homo sapiens
gaagauugaacccuggcugaa

SEQ ID NO: 998097 - RNA, 18 nt, Homo sapiens
gaagccaggaauuuccca

SEQ ID NO: 998098 - RNA, 14 nt, Homo sapiens
gaaggaacuuccag

SEQ ID NO: 998099 - RNA, 12 nt, Homo sapiens
gaaggcaaaauu

SEQ ID NO: 998100 - RNA, 15 nt, Homo sapiens
gaaggguaaacaaua

SEQ ID NO: 998101 - RNA, 16 nt, Homo sapiens
gaagucucuuccaguu

SEQ ID NO: 998102 - RNA, 17 nt, Homo sapiens
gaagugaaaacuuugua

SEQ ID NO: 998103 - RNA, 16 nt, Homo sapiens
gaagugagggcucacu

SEQ ID NO: 998104 - RNA, 14 nt, Homo sapiens
gaauaauaccuaag

SEQ ID NO: 998105 - RNA, 18 nt, Homo sapiens
gaauacccuuuucugacc

SEQ ID NO: 998106 - RNA, 20 nt, Homo sapiens
gaauacccuuuucugaccaa

SEQ ID NO: 998107 - RNA, 12 nt, Homo sapiens
gaauagaacucu

SEQ ID NO: 998108 - RNA, 21 nt, Homo sapiens
gaauaugucagugcugaugua

SEQ ID NO: 998109 - RNA, 17 nt, Homo sapiens
gaaucaacauuucucaa

SEQ ID NO: 998110 - RNA, 22 nt, Homo sapiens
gaaucagugaagccaaagggac

SEQ ID NO: 998111 - RNA, 20 nt, Homo sapiens
gaaucucuuuuugcuuucga

SEQ ID NO: 998112 - RNA, 18 nt, Homo sapiens
gaaugagagguuccuaag

SEQ ID NO: 998113 - RNA, 14 nt, Homo sapiens
gaaugauucagugu

SEQ ID NO: 998114 - RNA, 18 nt, Homo sapiens
gaaugauuuuucuuuaca

SEQ ID NO: 998115 - RNA, 15 nt, Homo sapiens
gaaugccacugccuu

SEQ ID NO: 998116 - RNA, 17 nt, Homo sapiens
gaauggagcuggcccuc

SEQ ID NO: 998117 - RNA, 21 nt, Homo sapiens
gaauggcugcaccuuuuugca

SEQ ID NO: 998118 - RNA, 17 nt, Homo sapiens
gaauguuuacacucuuu

SEQ ID NO: 998119 - RNA, 21 nt, Homo sapiens
gaauuaacaauaaaaguguga

SEQ ID NO: 998120 - RNA, 13 nt, Homo sapiens
gaauuacuguaac

SEQ ID NO: 998121 - RNA, 21 nt, Homo sapiens
gaauuaggcuguaacuacuuu

SEQ ID NO: 998122 - RNA, 15 nt, Homo sapiens
gaauuaucuauuuca

SEQ ID NO: 998123 - RNA, 20 nt, Homo sapiens
gaauuauuuaaacaaaaacu

SEQ ID NO: 998124 - RNA, 12 nt, Homo sapiens
gaauucaaacaa

SEQ ID NO: 998125 - RNA, 20 nt, Homo sapiens
gaauuuucucuaacuucaag

SEQ ID NO: 998126 - RNA, 15 nt, Homo sapiens
gacaaaggagccugu

SEQ ID NO: 998127 - RNA, 15 nt, Homo sapiens
gacaagcaugguccc

SEQ ID NO: 998128 - RNA, 17 nt, Homo sapiens
gacaagcugcauuucag

SEQ ID NO: 998129 - RNA, 23 nt, Homo sapiens
gacacacgcgguuugguuugcag

SEQ ID NO: 998130 - RNA, 20 nt, Homo sapiens
gacacaugaagguaaauaaa

SEQ ID NO: 998131 - RNA, 17 nt, Homo sapiens
gacacccuucucccacu

SEQ ID NO: 998132 - RNA, 24 nt, Homo sapiens
gacacccuucucccacucuccuag

SEQ ID NO: 998133 - RNA, 14 nt, Homo sapiens
gacacuuaauacua

SEQ ID NO: 998134 - RNA, 20 nt, Homo sapiens
gacacuuaauacuaccuuga

SEQ ID NO: 998135 - RNA, 14 nt, Homo sapiens
gacagacauacauu

SEQ ID NO: 998136 - RNA, 19 nt, Homo sapiens
gacagaugccacacaagga

SEQ ID NO: 998137 - RNA, 11 nt, Homo sapiens
gacagccucag

SEQ ID NO: 998138 - RNA, 17 nt, Homo sapiens
gacaggccagaugaacu

SEQ ID NO: 998139 - RNA, 17 nt, Homo sapiens
gacagucguucccagug

SEQ ID NO: 998140 - RNA, 21 nt, Homo sapiens
gacaguggcaggggcuggaga

SEQ ID NO: 998141 - RNA, 18 nt, Homo sapiens
gacaugauuuccuugaau

SEQ ID NO: 998142 - RNA, 18 nt, Homo sapiens
gacaugcuucagugcugc

SEQ ID NO: 998143 - RNA, 13 nt, Homo sapiens
gacauuccaccau

SEQ ID NO: 998144 - RNA, 22 nt, Homo sapiens
gacauuugggagacaugugaca

SEQ ID NO: 998145 - RNA, 22 nt, Homo sapiens
gaccacaacuauuuucagaugu

SEQ ID NO: 998146 - RNA, 17 nt, Homo sapiens
gaccacagcacagccaa

SEQ ID NO: 998147 - RNA, 16 nt, Homo sapiens
gaccacaggcucaggc

SEQ ID NO: 998148 - RNA, 16 nt, Homo sapiens
gaccaggcuacuucuc

SEQ ID NO: 998149 - RNA, 16 nt, Homo sapiens
gaccauaguauaauca

SEQ ID NO: 998150 - RNA, 20 nt, Homo sapiens
cuucagguucucaugauacc

SEQ ID NO: 998151 - RNA, 13 nt, Homo sapiens
cuucagugcugcu

SEQ ID NO: 998152 - RNA, 14 nt, Homo sapiens
cuuccaaacucuuc

SEQ ID NO: 998153 - RNA, 13 nt, Homo sapiens
cuuccaccacaga

SEQ ID NO: 998154 - RNA, 17 nt, Homo sapiens
cuuccagaaaacaaaac

SEQ ID NO: 998155 - RNA, 15 nt, Homo sapiens
cuuccagcuagugac

SEQ ID NO: 998156 - RNA, 11 nt, Homo sapiens
cuuccauuugc

SEQ ID NO: 998157 - RNA, 19 nt, Homo sapiens
cuucccaugggcagaggac

SEQ ID NO: 998158 - RNA, 15 nt, Homo sapiens
cuucccccaccacca

SEQ ID NO: 998159 - RNA, 21 nt, Homo sapiens
cuucccucucugcagacuucc

SEQ ID NO: 998160 - RNA, 18 nt, Homo sapiens
cuuccgcuuggagcuauu

SEQ ID NO: 998161 - RNA, 23 nt, Homo sapiens
cuuccugguugagcuucugcuaa

SEQ ID NO: 998162 - RNA, 15 nt, Homo sapiens
cuuccuguccagcuc

SEQ ID NO: 998163 - RNA, 19 nt, Homo sapiens
cuuccuugaagaacugcag

SEQ ID NO: 998164 - RNA, 11 nt, Homo sapiens
cuucuacagcc

SEQ ID NO: 998165 - RNA, 12 nt, Homo sapiens
cuucuacugcua

SEQ ID NO: 998166 - RNA, 22 nt, Homo sapiens
cuucuaggucacuucucacaau

SEQ ID NO: 998167 - RNA, 21 nt, Homo sapiens
cuucuccaacaccaccucucc

SEQ ID NO: 998168 - RNA, 14 nt, Homo sapiens
cuucucuccagcug

SEQ ID NO: 998169 - RNA, 14 nt, Homo sapiens
cuucucuuugccuc

SEQ ID NO: 998170 - RNA, 15 nt, Homo sapiens
cuucugagcacuguu

SEQ ID NO: 998171 - RNA, 15 nt, Homo sapiens
cuucugcucagcucu

SEQ ID NO: 998172 - RNA, 16 nt, Homo sapiens
cuucuucaccauuugg

SEQ ID NO: 998173 - RNA, 17 nt, Homo sapiens
cuucuugcagcuguuga

SEQ ID NO: 998174 - RNA, 18 nt, Homo sapiens
cuucuuuagaacagggaa

SEQ ID NO: 998175 - RNA, 20 nt, Homo sapiens
cuugaaauuaagaaggcaaa

SEQ ID NO: 998176 - RNA, 17 nt, Homo sapiens
cuugaaggacuaauaga

SEQ ID NO: 998177 - RNA, 19 nt, Homo sapiens
cuugacccugagcugacca

SEQ ID NO: 998178 - RNA, 15 nt, Homo sapiens
cuugagccaguaauu

SEQ ID NO: 998179 - RNA, 14 nt, Homo sapiens
cuugaggggaccag

SEQ ID NO: 998180 - RNA, 20 nt, Homo sapiens
cuugagggugcuuguucccu

SEQ ID NO: 998181 - RNA, 19 nt, Homo sapiens
cuugcaaccuaccuguuga

SEQ ID NO: 998182 - RNA, 17 nt, Homo sapiens
cuugcaguuaaggguua

SEQ ID NO: 998183 - RNA, 18 nt, Homo sapiens
cuugcaguuaaggguuag

SEQ ID NO: 998184 - RNA, 14 nt, Homo sapiens
cuugcaucacuuaa

SEQ ID NO: 998185 - RNA, 21 nt, Homo sapiens
cuugccugugcuacaauucau

SEQ ID NO: 998186 - RNA, 12 nt, Homo sapiens
cuugcucagugg

SEQ ID NO: 998187 - RNA, 16 nt, Homo sapiens
cuugcuggucuaguca

SEQ ID NO: 998188 - RNA, 16 nt, Homo sapiens
cuuggaaccuaagguu

SEQ ID NO: 998189 - RNA, 23 nt, Homo sapiens
cuuggagggcccagcccaaguga

SEQ ID NO: 998190 - RNA, 21 nt, Homo sapiens
cuugggccuaggcugcauuga

SEQ ID NO: 998191 - RNA, 13 nt, Homo sapiens
cuugggcucccug

SEQ ID NO: 998192 - RNA, 13 nt, Homo sapiens
cuugggcucugau

SEQ ID NO: 998193 - RNA, 17 nt, Homo sapiens
cuugguuuucccuuugc

SEQ ID NO: 998194 - RNA, 15 nt, Homo sapiens
cuuguaacuaaaaua

SEQ ID NO: 998195 - RNA, 19 nt, Homo sapiens
cuuguaacuuaauauacua

SEQ ID NO: 998196 - RNA, 17 nt, Homo sapiens
cuuguagccagccgggg

SEQ ID NO: 998197 - RNA, 14 nt, Homo sapiens
cuugucagauguau

SEQ ID NO: 998198 - RNA, 20 nt, Homo sapiens
cuuguccacauagguuuaga

SEQ ID NO: 998199 - RNA, 16 nt, Homo sapiens
cuuguccuagcacaga

SEQ ID NO: 998200 - RNA, 11 nt, Homo sapiens
cuugugcacug

SEQ ID NO: 998201 - RNA, 11 nt, Homo sapiens
cuugugccuug

SEQ ID NO: 998202 - RNA, 13 nt, Homo sapiens
cuuguggcugaga

SEQ ID NO: 998203 - RNA, 15 nt, Homo sapiens
cuugugucccaugau

SEQ ID NO: 998204 - RNA, 18 nt, Homo sapiens
cuuguguuggcuguggca

SEQ ID NO: 998205 - RNA, 15 nt, Homo sapiens
cuuguugagugccag

SEQ ID NO: 998206 - RNA, 12 nt, Homo sapiens
cuuguugcaauu

SEQ ID NO: 998207 - RNA, 18 nt, Homo sapiens
cuuguuguuucuugccug

SEQ ID NO: 998208 - RNA, 19 nt, Homo sapiens
cuuuaaaauguaaagccau

SEQ ID NO: 998209 - RNA, 22 nt, Homo sapiens
cuuuaaauacuauuauuugcua

SEQ ID NO: 998210 - RNA, 15 nt, Homo sapiens
cuuuacaaaaguauu

SEQ ID NO: 998211 - RNA, 20 nt, Homo sapiens
cuuuacuccguaacagauuu

SEQ ID NO: 998212 - RNA, 18 nt, Homo sapiens
cuuuacuguuagucauuu

SEQ ID NO: 998213 - RNA, 19 nt, Homo sapiens
cuuuagagaaguauacaua

SEQ ID NO: 998214 - RNA, 18 nt, Homo sapiens
cuuuaugcagagccacag

SEQ ID NO: 998215 - RNA, 17 nt, Homo sapiens
cuuuauuccuucauuuc

SEQ ID NO: 998216 - RNA, 19 nt, Homo sapiens
cuuuauuccuucauuucau

SEQ ID NO: 998217 - RNA, 16 nt, Homo sapiens
cuuuauuuccacugug

SEQ ID NO: 998218 - RNA, 15 nt, Homo sapiens
cuuucaaaagggaag

SEQ ID NO: 998219 - RNA, 18 nt, Homo sapiens
cuuucagcuccugaccag

SEQ ID NO: 998220 - RNA, 19 nt, Homo sapiens
cuuucaggguuuucuaacc

SEQ ID NO: 998221 - RNA, 14 nt, Homo sapiens
cuuucccugguccc

SEQ ID NO: 998222 - RNA, 13 nt, Homo sapiens
cuuuccuccugag

SEQ ID NO: 998223 - RNA, 20 nt, Homo sapiens
cuuuccucgccugacaacca

SEQ ID NO: 998224 - RNA, 10 nt, Homo sapiens
cuuuccugcc

SEQ ID NO: 998225 - RNA, 14 nt, Homo sapiens
cuuucuucccauga

SEQ ID NO: 998226 - RNA, 16 nt, Homo sapiens
cuuugaaauuauguaa

SEQ ID NO: 998227 - RNA, 18 nt, Homo sapiens
cuuugaaauugaaccuuu

SEQ ID NO: 998228 - RNA, 15 nt, Homo sapiens
cuuugacaguguuuu

SEQ ID NO: 998229 - RNA, 23 nt, Homo sapiens
cuuugagaaggauaggccuucau

SEQ ID NO: 998230 - RNA, 17 nt, Homo sapiens
cuuugagacugggucuc

SEQ ID NO: 998231 - RNA, 21 nt, Homo sapiens
cuuugccagaggcugauguca

SEQ ID NO: 998232 - RNA, 17 nt, Homo sapiens
cuuugccuucauucugc

SEQ ID NO: 998233 - RNA, 20 nt, Homo sapiens
cuuugcugaaugucauuuua

SEQ ID NO: 998234 - RNA, 23 nt, Homo sapiens
cuuugcugugaggcuguccugua

SEQ ID NO: 998235 - RNA, 15 nt, Homo sapiens
cuuugguaccagaua

SEQ ID NO: 998236 - RNA, 21 nt, Homo sapiens
cuuuguccacugucaggguug

SEQ ID NO: 998237 - RNA, 17 nt, Homo sapiens
cuuuuaaaagcacguau

SEQ ID NO: 998238 - RNA, 12 nt, Homo sapiens
cuuuuauuacau

SEQ ID NO: 998239 - RNA, 15 nt, Homo sapiens
cuuuuauuacugggg

SEQ ID NO: 998240 - RNA, 19 nt, Homo sapiens
cuuuucaauguuagccaca

SEQ ID NO: 998241 - RNA, 21 nt, Homo sapiens
cuuuucuccucacuguaucca

SEQ ID NO: 998242 - RNA, 22 nt, Homo sapiens
cuuuucucugagacauuccacc

SEQ ID NO: 998243 - RNA, 19 nt, Homo sapiens
cuuuucuggaauguaauca

SEQ ID NO: 998244 - RNA, 20 nt, Homo sapiens
cuuuugcccauuuugaauca

SEQ ID NO: 998245 - RNA, 15 nt, Homo sapiens
cuuuuggacaaaccu

SEQ ID NO: 998246 - RNA, 13 nt, Homo sapiens
cuuuuucuuugag

SEQ ID NO: 998247 - RNA, 17 nt, Homo sapiens
gaaaaaaaaacagccac

SEQ ID NO: 998248 - RNA, 14 nt, Homo sapiens
gaaaaaaaaauuca

SEQ ID NO: 998249 - RNA, 20 nt, Homo sapiens
gaaaaaaugcagggugauuu

SEQ ID NO: 998250 - RNA, 14 nt, Homo sapiens
gaaaacaaacccag

SEQ ID NO: 998251 - RNA, 15 nt, Homo sapiens
gaaaacacugugcac

SEQ ID NO: 998252 - RNA, 20 nt, Homo sapiens
gaaaaccagcucagcacugc

SEQ ID NO: 998253 - RNA, 18 nt, Homo sapiens
gaaaacccccaaaccaga

SEQ ID NO: 998254 - RNA, 18 nt, Homo sapiens
cuggccauggagaaagcu

SEQ ID NO: 998255 - RNA, 14 nt, Homo sapiens
cuggcccagccaaa

SEQ ID NO: 998256 - RNA, 15 nt, Homo sapiens
cuggcccaucagggu

SEQ ID NO: 998257 - RNA, 21 nt, Homo sapiens
cuggcccuugcuuaccucuca

SEQ ID NO: 998258 - RNA, 14 nt, Homo sapiens
cuggcuucuggcca

SEQ ID NO: 998259 - RNA, 19 nt, Homo sapiens
cugggaaaugagaugacca

SEQ ID NO: 998260 - RNA, 19 nt, Homo sapiens
cugggacugugcucagaga

SEQ ID NO: 998261 - RNA, 14 nt, Homo sapiens
cugggaggggcaau

SEQ ID NO: 998262 - RNA, 16 nt, Homo sapiens
cugggagucacacagu

SEQ ID NO: 998263 - RNA, 18 nt, Homo sapiens
cugggauuugcccacgua

SEQ ID NO: 998264 - RNA, 17 nt, Homo sapiens
cugggcaacacagugag

SEQ ID NO: 998265 - RNA, 17 nt, Homo sapiens
cugggccauguccaaag

SEQ ID NO: 998266 - RNA, 15 nt, Homo sapiens
cugggccugaccaaa

SEQ ID NO: 998267 - RNA, 13 nt, Homo sapiens
cugggcucaguga

SEQ ID NO: 998268 - RNA, 17 nt, Homo sapiens
cugggcuggaugagcuc

SEQ ID NO: 998269 - RNA, 17 nt, Homo sapiens
cugggcugggaaaaacu

SEQ ID NO: 998270 - RNA, 14 nt, Homo sapiens
cuggggaagacagu

SEQ ID NO: 998271 - RNA, 20 nt, Homo sapiens
cuggggaagagaaaagccca

SEQ ID NO: 998272 - RNA, 22 nt, Homo sapiens
cuggggaagagaaaagcccaag

SEQ ID NO: 998273 - RNA, 16 nt, Homo sapiens
cuggggccugggacaa

SEQ ID NO: 998274 - RNA, 20 nt, Homo sapiens
cugggucuaccacucagaga

SEQ ID NO: 998275 - RNA, 21 nt, Homo sapiens
cugggucucgcuuuguugccc

SEQ ID NO: 998276 - RNA, 14 nt, Homo sapiens
cugguaauauugac

SEQ ID NO: 998277 - RNA, 14 nt, Homo sapiens
cugguagaccacug

SEQ ID NO: 998278 - RNA, 18 nt, Homo sapiens
cugguagaccacugccau

SEQ ID NO: 998279 - RNA, 15 nt, Homo sapiens
cugguaggaauagca

SEQ ID NO: 998280 - RNA, 19 nt, Homo sapiens
cuggucaacuugagcaugu

SEQ ID NO: 998281 - RNA, 16 nt, Homo sapiens
cuggucagcauguacu

SEQ ID NO: 998282 - RNA, 21 nt, Homo sapiens
cuggucagcauguacuccccu

SEQ ID NO: 998283 - RNA, 16 nt, Homo sapiens
cugguccccuccuucc

SEQ ID NO: 998284 - RNA, 23 nt, Homo sapiens
cuggucuagucacgcaugcagug

SEQ ID NO: 998285 - RNA, 13 nt, Homo sapiens
cuggucuccuugc

SEQ ID NO: 998286 - RNA, 15 nt, Homo sapiens
cuggugcaaguugag

SEQ ID NO: 998287 - RNA, 14 nt, Homo sapiens
cuggugggugccua

SEQ ID NO: 998288 - RNA, 17 nt, Homo sapiens
cugguguagcuacagag

SEQ ID NO: 998289 - RNA, 23 nt, Homo sapiens
cugguugaacucugguggcacag

SEQ ID NO: 998290 - RNA, 12 nt, Homo sapiens
cuguaacuacuu

SEQ ID NO: 998291 - RNA, 16 nt, Homo sapiens
cuguaacuugauccau

SEQ ID NO: 998292 - RNA, 16 nt, Homo sapiens
cuguaaggcucuagau

SEQ ID NO: 998293 - RNA, 16 nt, Homo sapiens
cuguaaucucacuaca

SEQ ID NO: 998294 - RNA, 15 nt, Homo sapiens
cuguaccaguuaauu

SEQ ID NO: 998295 - RNA, 14 nt, Homo sapiens
cuguacccaguuuc

SEQ ID NO: 998296 - RNA, 14 nt, Homo sapiens
cuguagguugcaca

SEQ ID NO: 998297 - RNA, 15 nt, Homo sapiens
cuguagguugcacac

SEQ ID NO: 998298 - RNA, 16 nt, Homo sapiens
cuguauuaagccacuu

SEQ ID NO: 998299 - RNA, 21 nt, Homo sapiens
cuguauuugaaauaagaauuc

SEQ ID NO: 998300 - RNA, 23 nt, Homo sapiens
cugucaccacccugcucauccac

SEQ ID NO: 998301 - RNA, 13 nt, Homo sapiens
cugucagcugcaa

SEQ ID NO: 998302 - RNA, 23 nt, Homo sapiens
cugucaguucuaaccuccuaagc

SEQ ID NO: 998303 - RNA, 18 nt, Homo sapiens
cugucaucaucauggcca

SEQ ID NO: 998304 - RNA, 19 nt, Homo sapiens
cugucaugguguccagaca

SEQ ID NO: 998305 - RNA, 12 nt, Homo sapiens
cuguccauccau

SEQ ID NO: 998306 - RNA, 18 nt, Homo sapiens
cuguccucccgagcuccu

SEQ ID NO: 998307 - RNA, 17 nt, Homo sapiens
cuguccucuuucagcuc

SEQ ID NO: 998308 - RNA, 21 nt, Homo sapiens
cuguccuuucuagagcacugc

SEQ ID NO: 998309 - RNA, 23 nt, Homo sapiens
cugugaccugcugagcucugaga

SEQ ID NO: 998310 - RNA, 19 nt, Homo sapiens
cugugagcccagcuggguc

SEQ ID NO: 998311 - RNA, 22 nt, Homo sapiens
cugugcagguggggagacuggg

SEQ ID NO: 998312 - RNA, 16 nt, Homo sapiens
cugugcaguagcauca

SEQ ID NO: 998313 - RNA, 16 nt, Homo sapiens
cuguggaagaggccaa

SEQ ID NO: 998314 - RNA, 18 nt, Homo sapiens
cuguggacuccaugccuc

SEQ ID NO: 998315 - RNA, 15 nt, Homo sapiens
cuguggcagaguuac

SEQ ID NO: 998316 - RNA, 21 nt, Homo sapiens
cugugggucugggagucacac

SEQ ID NO: 998317 - RNA, 22 nt, Homo sapiens
cuguguaagggccagaaauauc

SEQ ID NO: 998318 - RNA, 15 nt, Homo sapiens
cugugucuaagauuc

SEQ ID NO: 998319 - RNA, 14 nt, Homo sapiens
cuguguguccaaaa

SEQ ID NO: 998320 - RNA, 17 nt, Homo sapiens
cugugugugauuugcua

SEQ ID NO: 998321 - RNA, 14 nt, Homo sapiens
cugugugugcccuc

SEQ ID NO: 998322 - RNA, 16 nt, Homo sapiens
cuguguuaugcaaaag

SEQ ID NO: 998323 - RNA, 21 nt, Homo sapiens
cuguguucucaccgugaucaa

SEQ ID NO: 998324 - RNA, 21 nt, Homo sapiens
cuguguugccaagcuccaagc

SEQ ID NO: 998325 - RNA, 18 nt, Homo sapiens
cuguuacacuuuuuggaa

SEQ ID NO: 998326 - RNA, 14 nt, Homo sapiens
cuguuccccagaga

SEQ ID NO: 998327 - RNA, 20 nt, Homo sapiens
cuguucucuugggaacugaa

SEQ ID NO: 998328 - RNA, 11 nt, Homo sapiens
cuguucuugcu

SEQ ID NO: 998329 - RNA, 20 nt, Homo sapiens
cuguuucccuuucacuggca

SEQ ID NO: 998330 - RNA, 21 nt, Homo sapiens
cuguuugcugugcguggaaug

SEQ ID NO: 998331 - RNA, 15 nt, Homo sapiens
cuguuugcuguggaa

SEQ ID NO: 998332 - RNA, 14 nt, Homo sapiens
cuguuuguuuacaa

SEQ ID NO: 998333 - RNA, 18 nt, Homo sapiens
cuuaaaauacaagacugc

SEQ ID NO: 998334 - RNA, 15 nt, Homo sapiens
cuuaaacacuugcaa

SEQ ID NO: 998335 - RNA, 14 nt, Homo sapiens
cuuaacaguuguau

SEQ ID NO: 998336 - RNA, 18 nt, Homo sapiens
cuuaacuacaguggcuga

SEQ ID NO: 998337 - RNA, 21 nt, Homo sapiens
cuuaacuggucuccuugcuuc

SEQ ID NO: 998338 - RNA, 18 nt, Homo sapiens
cuuaauacuaccuugaaa

SEQ ID NO: 998339 - RNA, 14 nt, Homo sapiens
cuuaauuugcacag

SEQ ID NO: 998340 - RNA, 16 nt, Homo sapiens
cuuacaaauacuaaaa

SEQ ID NO: 998341 - RNA, 14 nt, Homo sapiens
cuuacuuaaaccca

SEQ ID NO: 998342 - RNA, 15 nt, Homo sapiens
cuuagggacagucaa

SEQ ID NO: 998343 - RNA, 17 nt, Homo sapiens
cuuagggacagucaaaa

SEQ ID NO: 998344 - RNA, 18 nt, Homo sapiens
cuuauaauuguucucaga

SEQ ID NO: 998345 - RNA, 14 nt, Homo sapiens
cuuauauucaucca

SEQ ID NO: 998346 - RNA, 16 nt, Homo sapiens
cuuaugccagcgugac

SEQ ID NO: 998347 - RNA, 23 nt, Homo sapiens
cuuauggaauugauuugcauuga

SEQ ID NO: 998348 - RNA, 20 nt, Homo sapiens
cuuaugguaccagaugcagc

SEQ ID NO: 998349 - RNA, 14 nt, Homo sapiens
cuuauguuauacaa

SEQ ID NO: 998350 - RNA, 16 nt, Homo sapiens
cuuauuccaugacugc

SEQ ID NO: 998351 - RNA, 24 nt, Homo sapiens
cuuauugcaucccaaaccacgccu

SEQ ID NO: 998352 - RNA, 14 nt, Homo sapiens
cuuauugcuguuuc

SEQ ID NO: 998353 - RNA, 23 nt, Homo sapiens
cuuauuuaaugccgauauacucu

SEQ ID NO: 998354 - RNA, 20 nt, Homo sapiens
cuucaacacagcuugucucu

SEQ ID NO: 998355 - RNA, 22 nt, Homo sapiens
cuucaaggcccauaucugugaa

SEQ ID NO: 998356 - RNA, 17 nt, Homo sapiens
cuucaauuguauuauau

SEQ ID NO: 998357 - RNA, 19 nt, Homo sapiens
cucaacucucuuauugccu

SEQ ID NO: 998358 - RNA, 23 nt, Homo sapiens
cucaagaaauaaaaggaagccaa

SEQ ID NO: 998359 - RNA, 16 nt, Homo sapiens
cucaagaagugaagaa

SEQ ID NO: 998360 - RNA, 20 nt, Homo sapiens
cucaagccggaaacucggca

SEQ ID NO: 998361 - RNA, 14 nt, Homo sapiens
cucaaugagcaugu

SEQ ID NO: 998362 - RNA, 16 nt, Homo sapiens
cucacaagcaugaagu

SEQ ID NO: 998363 - RNA, 20 nt, Homo sapiens
cucacagagugcauugugag

SEQ ID NO: 998364 - RNA, 14 nt, Homo sapiens
cucacaguguugcc

SEQ ID NO: 998365 - RNA, 11 nt, Homo sapiens
cucaccagccu

SEQ ID NO: 998366 - RNA, 15 nt, Homo sapiens
cucaccucuugccuu

SEQ ID NO: 998367 - RNA, 17 nt, Homo sapiens
cucacgggacuauuucc

SEQ ID NO: 998368 - RNA, 16 nt, Homo sapiens
cucacuccccaacccc

SEQ ID NO: 998369 - RNA, 16 nt, Homo sapiens
cucacugcagugcuga

SEQ ID NO: 998370 - RNA, 22 nt, Homo sapiens
cucacugcugcaaauacuguau

SEQ ID NO: 998371 - RNA, 14 nt, Homo sapiens
cucacuguauccag

SEQ ID NO: 998372 - RNA, 17 nt, Homo sapiens
cucagaccaaucaucaa

SEQ ID NO: 998373 - RNA, 22 nt, Homo sapiens
cucagaggcgcacugugacccc

SEQ ID NO: 998374 - RNA, 23 nt, Homo sapiens
cucagauaagguaaaaugccaug

SEQ ID NO: 998375 - RNA, 15 nt, Homo sapiens
cucagccacuugccu

SEQ ID NO: 998376 - RNA, 14 nt, Homo sapiens
cucagccagcacuu

SEQ ID NO: 998377 - RNA, 19 nt, Homo sapiens
cucagccuggccagacaca

SEQ ID NO: 998378 - RNA, 21 nt, Homo sapiens
cucaggcaaucugcccgccug

SEQ ID NO: 998379 - RNA, 15 nt, Homo sapiens
cucagggacucaggu

SEQ ID NO: 998380 - RNA, 16 nt, Homo sapiens
cucagggacucaggug

SEQ ID NO: 998381 - RNA, 20 nt, Homo sapiens
cucagguggcccuacuggga

SEQ ID NO: 998382 - RNA, 18 nt, Homo sapiens
cucagucucugagcagug

SEQ ID NO: 998383 - RNA, 22 nt, Homo sapiens
cucaguucuugagggccucccc

SEQ ID NO: 998384 - RNA, 16 nt, Homo sapiens
cucaguuucuaggcac

SEQ ID NO: 998385 - RNA, 21 nt, Homo sapiens
cucaucaauggggccagucag

SEQ ID NO: 998386 - RNA, 13 nt, Homo sapiens
cucauccuccuuc

SEQ ID NO: 998387 - RNA, 22 nt, Homo sapiens
cucauuggaaauuuagcauugu

SEQ ID NO: 998388 - RNA, 13 nt, Homo sapiens
cuccaaacugaag

SEQ ID NO: 998389 - RNA, 19 nt, Homo sapiens
cuccaaagucauaauugca

SEQ ID NO: 998390 - RNA, 18 nt, Homo sapiens
cuccaauuucaagaguga

SEQ ID NO: 998391 - RNA, 20 nt, Homo sapiens
cuccaccccacaacccaaaa

SEQ ID NO: 998392 - RNA, 18 nt, Homo sapiens
cuccaccuagacuguaaa

SEQ ID NO: 998393 - RNA, 17 nt, Homo sapiens
cuccagaccugauccug

SEQ ID NO: 998394 - RNA, 13 nt, Homo sapiens
cuccagaggccaa

SEQ ID NO: 998395 - RNA, 16 nt, Homo sapiens
cuccagaggccaagga

SEQ ID NO: 998396 - RNA, 18 nt, Homo sapiens
cuccagaugcagggcagu

SEQ ID NO: 998397 - RNA, 19 nt, Homo sapiens
cuccagaugccacaaugga

SEQ ID NO: 998398 - RNA, 20 nt, Homo sapiens
cuccagcugggcucugcaau

SEQ ID NO: 998399 - RNA, 16 nt, Homo sapiens
cuccagggacagcaac

SEQ ID NO: 998400 - RNA, 16 nt, Homo sapiens
cuccaguguccugagc

SEQ ID NO: 998401 - RNA, 19 nt, Homo sapiens
cucccaaagugcugggauu

SEQ ID NO: 998402 - RNA, 20 nt, Homo sapiens
cucccaaaugagccaugaga

SEQ ID NO: 998403 - RNA, 19 nt, Homo sapiens
cucccaaguagcugggauu

SEQ ID NO: 998404 - RNA, 17 nt, Homo sapiens
cucccacaaugcugaau

SEQ ID NO: 998405 - RNA, 15 nt, Homo sapiens
cucccacagucccau

SEQ ID NO: 998406 - RNA, 23 nt, Homo sapiens
cucccacccucuuccuacugguc

SEQ ID NO: 998407 - RNA, 20 nt, Homo sapiens
cucccagagcaccugcuguc

SEQ ID NO: 998408 - RNA, 17 nt, Homo sapiens
cucccagauaaugugaa

SEQ ID NO: 998409 - RNA, 12 nt, Homo sapiens
cucccagcauag

SEQ ID NO: 998410 - RNA, 13 nt, Homo sapiens
cucccaggaccaa

SEQ ID NO: 998411 - RNA, 15 nt, Homo sapiens
cucccaggaccaaga

SEQ ID NO: 998412 - RNA, 17 nt, Homo sapiens
cuccccagcccagagac

SEQ ID NO: 998413 - RNA, 21 nt, Homo sapiens
cuccccaguucauugcacuuu

SEQ ID NO: 998414 - RNA, 14 nt, Homo sapiens
cucccccaacagcu

SEQ ID NO: 998415 - RNA, 14 nt, Homo sapiens
cuccccccacaagu

SEQ ID NO: 998416 - RNA, 14 nt, Homo sapiens
cuccccuccugucc

SEQ ID NO: 998417 - RNA, 21 nt, Homo sapiens
cuccccuucuucuccaucucc

SEQ ID NO: 998418 - RNA, 22 nt, Homo sapiens
cucccuauuaaccuagagauug

SEQ ID NO: 998419 - RNA, 20 nt, Homo sapiens
cucccucccagagcaccugc

SEQ ID NO: 998420 - RNA, 17 nt, Homo sapiens
cucccuccccuugccug

SEQ ID NO: 998421 - RNA, 15 nt, Homo sapiens
cucccucccuuucua

SEQ ID NO: 998422 - RNA, 18 nt, Homo sapiens
cucccucggaaugcuaag

SEQ ID NO: 998423 - RNA, 14 nt, Homo sapiens
cucccuggaugaca

SEQ ID NO: 998424 - RNA, 23 nt, Homo sapiens
cucccuugggaagggcagggaau

SEQ ID NO: 998425 - RNA, 12 nt, Homo sapiens
cuccuaaccuag

SEQ ID NO: 998426 - RNA, 13 nt, Homo sapiens
cuccuaaccuaga

SEQ ID NO: 998427 - RNA, 16 nt, Homo sapiens
cuccuaccucugcucu

SEQ ID NO: 998428 - RNA, 15 nt, Homo sapiens
cuccuacuaugcaau

SEQ ID NO: 998429 - RNA, 22 nt, Homo sapiens
cuccucaaccccuccccuccau

SEQ ID NO: 998430 - RNA, 20 nt, Homo sapiens
cuccucacuguauccagguu

SEQ ID NO: 998431 - RNA, 21 nt, Homo sapiens
cuccucauagcaauacuugga

SEQ ID NO: 998432 - RNA, 12 nt, Homo sapiens
cuccucugcacu

SEQ ID NO: 998433 - RNA, 14 nt, Homo sapiens
cuccugaagccaca

SEQ ID NO: 998434 - RNA, 15 nt, Homo sapiens
cuccugaagccacag

SEQ ID NO: 998435 - RNA, 15 nt, Homo sapiens
cuccugccauagucu

SEQ ID NO: 998436 - RNA, 14 nt, Homo sapiens
cuccuggguucaag

SEQ ID NO: 998437 - RNA, 15 nt, Homo sapiens
cuccuggugagauua

SEQ ID NO: 998438 - RNA, 20 nt, Homo sapiens
cuccuguucacaccagagaa

SEQ ID NO: 998439 - RNA, 16 nt, Homo sapiens
cuccuguuuugcacag

SEQ ID NO: 998440 - RNA, 22 nt, Homo sapiens
cucgaacuauuuucaaagacuu

SEQ ID NO: 998441 - RNA, 17 nt, Homo sapiens
cucgcccagcggcauca

SEQ ID NO: 998442 - RNA, 16 nt, Homo sapiens
cucgcuccucaacccc

SEQ ID NO: 998443 - RNA, 15 nt, Homo sapiens
cucggggugcacagg

SEQ ID NO: 998444 - RNA, 19 nt, Homo sapiens
cucgucggaaggacacuca

SEQ ID NO: 998445 - RNA, 12 nt, Homo sapiens
cucuaacagcac

SEQ ID NO: 998446 - RNA, 16 nt, Homo sapiens
cucuaacagcaccaaa

SEQ ID NO: 998447 - RNA, 17 nt, Homo sapiens
cucuaacagcaccaaau

SEQ ID NO: 998448 - RNA, 17 nt, Homo sapiens
cucuaacgccugagccc

SEQ ID NO: 998449 - RNA, 18 nt, Homo sapiens
cucuaauaaauuugacug

SEQ ID NO: 998450 - RNA, 18 nt, Homo sapiens
cucuaauucacagugcuc

SEQ ID NO: 998451 - RNA, 21 nt, Homo sapiens
cucuagguacgaugacagugu

SEQ ID NO: 998452 - RNA, 22 nt, Homo sapiens
cucuagguacgaugacaguguu

SEQ ID NO: 998453 - RNA, 19 nt, Homo sapiens
cucuagguccccauacucc

SEQ ID NO: 998454 - RNA, 12 nt, Homo sapiens
cucuaguauuua

SEQ ID NO: 998455 - RNA, 15 nt, Homo sapiens
cucuauuaugaaugu

SEQ ID NO: 998456 - RNA, 16 nt, Homo sapiens
cucucaacaccaugau

SEQ ID NO: 998457 - RNA, 23 nt, Homo sapiens
cucucaauaaaguuccccuguga

SEQ ID NO: 998458 - RNA, 21 nt, Homo sapiens
cucucagucucugagcaguga

SEQ ID NO: 998459 - RNA, 16 nt, Homo sapiens
cucuccagcugacuaa

SEQ ID NO: 998460 - RNA, 18 nt, Homo sapiens
cgaccgcccccuccucua

SEQ ID NO: 998461 - RNA, 17 nt, Homo sapiens
cgacuaauuucaaaaug

SEQ ID NO: 998462 - RNA, 19 nt, Homo sapiens
cgacuuguuuuugcacaug

SEQ ID NO: 998463 - RNA, 23 nt, Homo sapiens
cgagagaaagggagugcaugugc

SEQ ID NO: 998464 - RNA, 18 nt, Homo sapiens
cgaggaguaacaauacaa

SEQ ID NO: 998465 - RNA, 22 nt, Homo sapiens
cgauauucuuugcucuugccau

SEQ ID NO: 998466 - RNA, 16 nt, Homo sapiens
cgauucucuugccuca

SEQ ID NO: 998467 - RNA, 20 nt, Homo sapiens
cgcaccuaaccacuggucau

SEQ ID NO: 998468 - RNA, 15 nt, Homo sapiens
cgccugacaaccacu

SEQ ID NO: 998469 - RNA, 19 nt, Homo sapiens
cgcggccuuucgcugagcc

SEQ ID NO: 998470 - RNA, 13 nt, Homo sapiens
cgcuguucuugcu

SEQ ID NO: 998471 - RNA, 12 nt, Homo sapiens
cgcuucuugccu

SEQ ID NO: 998472 - RNA, 23 nt, Homo sapiens
cggacaugaaaggacccugugag

SEQ ID NO: 998473 - RNA, 20 nt, Homo sapiens
cggacuuagaaaaccagcuc

SEQ ID NO: 998474 - RNA, 15 nt, Homo sapiens
cggccacagggcggu

SEQ ID NO: 998475 - RNA, 13 nt, Homo sapiens
cggcuccucaggg

SEQ ID NO: 998476 - RNA, 19 nt, Homo sapiens
cggucgcccuuugcugcau

SEQ ID NO: 998477 - RNA, 14 nt, Homo sapiens
cggugaacucuggc

SEQ ID NO: 998478 - RNA, 15 nt, Homo sapiens
cgguuaccucugcau

SEQ ID NO: 998479 - RNA, 17 nt, Homo sapiens
cgguuaccucugcaugg

SEQ ID NO: 998480 - RNA, 14 nt, Homo sapiens
cguaaguacagaga

SEQ ID NO: 998481 - RNA, 13 nt, Homo sapiens
cguaauaagguuu

SEQ ID NO: 998482 - RNA, 14 nt, Homo sapiens
cgucucugcuaaac

SEQ ID NO: 998483 - RNA, 16 nt, Homo sapiens
cgugacacaaacacac

SEQ ID NO: 998484 - RNA, 12 nt, Homo sapiens
cgugaguggucu

SEQ ID NO: 998485 - RNA, 13 nt, Homo sapiens
cgugggcucccug

SEQ ID NO: 998486 - RNA, 17 nt, Homo sapiens
cguuuuuuucauuccau

SEQ ID NO: 998487 - RNA, 21 nt, Homo sapiens
cuaaacacgugacacaaacac

SEQ ID NO: 998488 - RNA, 12 nt, Homo sapiens
cuaaagacauga

SEQ ID NO: 998489 - RNA, 14 nt, Homo sapiens
cuaaagacaugaag

SEQ ID NO: 998490 - RNA, 19 nt, Homo sapiens
cuaaagguccacaggucua

SEQ ID NO: 998491 - RNA, 19 nt, Homo sapiens
cuaaagugcugcacucaaa

SEQ ID NO: 998492 - RNA, 23 nt, Homo sapiens
cuaaauuauuuacugcaaaaaga

SEQ ID NO: 998493 - RNA, 14 nt, Homo sapiens
cuaacacggugcuc

SEQ ID NO: 998494 - RNA, 14 nt, Homo sapiens
cuaaccauguguua

SEQ ID NO: 998495 - RNA, 19 nt, Homo sapiens
cuaagaaauaugcacaaua

SEQ ID NO: 998496 - RNA, 19 nt, Homo sapiens
cuaagaaauugaauacuuu

SEQ ID NO: 998497 - RNA, 18 nt, Homo sapiens
cuaagaugugauauucua

SEQ ID NO: 998498 - RNA, 16 nt, Homo sapiens
cuaagauucuaaaggu

SEQ ID NO: 998499 - RNA, 15 nt, Homo sapiens
cuaagggguggggcu

SEQ ID NO: 998500 - RNA, 22 nt, Homo sapiens
cuaaggucuuggaacuugccug

SEQ ID NO: 998501 - RNA, 18 nt, Homo sapiens
cuaauaaacuguguaguu

SEQ ID NO: 998502 - RNA, 13 nt, Homo sapiens
cuaaugccucuuc

SEQ ID NO: 998503 - RNA, 19 nt, Homo sapiens
cuaauucauuaaucugccu

SEQ ID NO: 998504 - RNA, 23 nt, Homo sapiens
cuaauucggauuugccauagccu

SEQ ID NO: 998505 - RNA, 17 nt, Homo sapiens
cuaauuuuuuguuguuu

SEQ ID NO: 998506 - RNA, 13 nt, Homo sapiens
cuacaauucauug

SEQ ID NO: 998507 - RNA, 12 nt, Homo sapiens
cuacacacaaac

SEQ ID NO: 998508 - RNA, 22 nt, Homo sapiens
cuacaccacucuggcagccaca

SEQ ID NO: 998509 - RNA, 19 nt, Homo sapiens
cuacagcuaacccucacaa

SEQ ID NO: 998510 - RNA, 11 nt, Homo sapiens
cuacagggucc

SEQ ID NO: 998511 - RNA, 23 nt, Homo sapiens
cuacaucuucugccuuagucuca

SEQ ID NO: 998512 - RNA, 14 nt, Homo sapiens
cuacauguauugca

SEQ ID NO: 998513 - RNA, 18 nt, Homo sapiens
cuacauguauugcacauu

SEQ ID NO: 998514 - RNA, 14 nt, Homo sapiens
cuaccaaaacaguu

SEQ ID NO: 998515 - RNA, 20 nt, Homo sapiens
cuaccacagcaacuauauau

SEQ ID NO: 998516 - RNA, 12 nt, Homo sapiens
cuaccacuguau

SEQ ID NO: 998517 - RNA, 19 nt, Homo sapiens
cuaccaggcacgucugcag

SEQ ID NO: 998518 - RNA, 20 nt, Homo sapiens
cuaccuagcgggauggggcu

SEQ ID NO: 998519 - RNA, 19 nt, Homo sapiens
cuacuacaaacuucaaaga

SEQ ID NO: 998520 - RNA, 15 nt, Homo sapiens
cuacugaagcccuug

SEQ ID NO: 998521 - RNA, 14 nt, Homo sapiens
cuacugaaugucau

SEQ ID NO: 998522 - RNA, 19 nt, Homo sapiens
cuacugagggcaguucuga

SEQ ID NO: 998523 - RNA, 14 nt, Homo sapiens
cuacugcucugugu

SEQ ID NO: 998524 - RNA, 13 nt, Homo sapiens
cuagaaacaacac

SEQ ID NO: 998525 - RNA, 17 nt, Homo sapiens
cuagaaacaacacugua

SEQ ID NO: 998526 - RNA, 14 nt, Homo sapiens
cuagaaggugcuua

SEQ ID NO: 998527 - RNA, 20 nt, Homo sapiens
cuagacuauuaggugcaauu

SEQ ID NO: 998528 - RNA, 13 nt, Homo sapiens
cuagcagcaccgu

SEQ ID NO: 998529 - RNA, 13 nt, Homo sapiens
cuagcaguggcag

SEQ ID NO: 998530 - RNA, 22 nt, Homo sapiens
cuagcauuucccaacacaaaga

SEQ ID NO: 998531 - RNA, 14 nt, Homo sapiens
cuaggccuaguccu

SEQ ID NO: 998532 - RNA, 13 nt, Homo sapiens
cuagggagccauu

SEQ ID NO: 998533 - RNA, 17 nt, Homo sapiens
cuaggugcuauuuguca

SEQ ID NO: 998534 - RNA, 16 nt, Homo sapiens
cuaguaugggguggga

SEQ ID NO: 998535 - RNA, 17 nt, Homo sapiens
cuaguucuucaucccac

SEQ ID NO: 998536 - RNA, 17 nt, Homo sapiens
cuauaauuuugccuuua

SEQ ID NO: 998537 - RNA, 23 nt, Homo sapiens
cuauaguuauuaaguucuuuaaa

SEQ ID NO: 998538 - RNA, 18 nt, Homo sapiens
cuauauaauucucugucu

SEQ ID NO: 998539 - RNA, 23 nt, Homo sapiens
cuauauauaaucaucaaguaaua

SEQ ID NO: 998540 - RNA, 22 nt, Homo sapiens
cuaucacuuuaaauacuauuau

SEQ ID NO: 998541 - RNA, 15 nt, Homo sapiens
cuaucagguucacaa

SEQ ID NO: 998542 - RNA, 23 nt, Homo sapiens
cuaucuacuacaaacuucaaaga

SEQ ID NO: 998543 - RNA, 21 nt, Homo sapiens
cuaucuccagcggcccuguca

SEQ ID NO: 998544 - RNA, 21 nt, Homo sapiens
cuaugggaacaauugaaguaa

SEQ ID NO: 998545 - RNA, 13 nt, Homo sapiens
cuauguauauaaa

SEQ ID NO: 998546 - RNA, 22 nt, Homo sapiens
cuauuaaagugcuaagguucua

SEQ ID NO: 998547 - RNA, 19 nt, Homo sapiens
cuauuaaaugagcacguuu

SEQ ID NO: 998548 - RNA, 15 nt, Homo sapiens
cuauuccauauuaaa

SEQ ID NO: 998549 - RNA, 20 nt, Homo sapiens
cuauucugucccuagguguu

SEQ ID NO: 998550 - RNA, 16 nt, Homo sapiens
cuauucuugauguaaa

SEQ ID NO: 998551 - RNA, 15 nt, Homo sapiens
cuauuguuacauuau

SEQ ID NO: 998552 - RNA, 18 nt, Homo sapiens
cuauuuauugacuuugac

SEQ ID NO: 998553 - RNA, 11 nt, Homo sapiens
cuauuuccauu

SEQ ID NO: 998554 - RNA, 19 nt, Homo sapiens
cuauuuggggcuugaugac

SEQ ID NO: 998555 - RNA, 17 nt, Homo sapiens
cuauuuuccaggcuucu

SEQ ID NO: 998556 - RNA, 12 nt, Homo sapiens
cucaaaagaaca

SEQ ID NO: 998557 - RNA, 18 nt, Homo sapiens
cucaaacuccugaccuca

SEQ ID NO: 998558 - RNA, 14 nt, Homo sapiens
cucaaagaaagugu

SEQ ID NO: 998559 - RNA, 21 nt, Homo sapiens
cucaaauguucuaaguuucua

SEQ ID NO: 998560 - RNA, 15 nt, Homo sapiens
cucaacaccaugauu

SEQ ID NO: 998561 - RNA, 23 nt, Homo sapiens
cucaaccccuccccuccaucccu

SEQ ID NO: 998562 - RNA, 16 nt, Homo sapiens
cucaaccucuacaggg

SEQ ID NO: 998563 - RNA, 18 nt, Homo sapiens
cucaaccucuacaggguu

SEQ ID NO: 998564 - RNA, 14 nt, Homo sapiens
ccuccccuccugug

SEQ ID NO: 998565 - RNA, 19 nt, Homo sapiens
ccucccuggaugacauuaa

SEQ ID NO: 998566 - RNA, 14 nt, Homo sapiens
ccucccuguaacuu

SEQ ID NO: 998567 - RNA, 19 nt, Homo sapiens
ccucccuguuccccagaga

SEQ ID NO: 998568 - RNA, 20 nt, Homo sapiens
ccucccuguuccccagagaa

SEQ ID NO: 998569 - RNA, 19 nt, Homo sapiens
ccuccuaaccuagagauug

SEQ ID NO: 998570 - RNA, 14 nt, Homo sapiens
ccuccucuagcugu

SEQ ID NO: 998571 - RNA, 15 nt, Homo sapiens
ccuccugagcucuga

SEQ ID NO: 998572 - RNA, 16 nt, Homo sapiens
ccuccugggcccucuc

SEQ ID NO: 998573 - RNA, 16 nt, Homo sapiens
ccuccuguauuccuga

SEQ ID NO: 998574 - RNA, 12 nt, Homo sapiens
ccuccuucccaa

SEQ ID NO: 998575 - RNA, 13 nt, Homo sapiens
ccucuaagguugg

SEQ ID NO: 998576 - RNA, 12 nt, Homo sapiens
ccucucaccaaa

SEQ ID NO: 998577 - RNA, 18 nt, Homo sapiens
ccucucccggcaacaucu

SEQ ID NO: 998578 - RNA, 12 nt, Homo sapiens
ccucucugcucu

SEQ ID NO: 998579 - RNA, 18 nt, Homo sapiens
ccucugcuaagguguauu

SEQ ID NO: 998580 - RNA, 19 nt, Homo sapiens
ccucugucagucacagcca

SEQ ID NO: 998581 - RNA, 19 nt, Homo sapiens
ccucuguuccuucccugug

SEQ ID NO: 998582 - RNA, 16 nt, Homo sapiens
ccucuuccaccacaga

SEQ ID NO: 998583 - RNA, 17 nt, Homo sapiens
ccucuuucuucccauga

SEQ ID NO: 998584 - RNA, 21 nt, Homo sapiens
ccugaaacaacuuggaaagau

SEQ ID NO: 998585 - RNA, 19 nt, Homo sapiens
ccugaauuaucuauuucau

SEQ ID NO: 998586 - RNA, 19 nt, Homo sapiens
ccugacacugcaauuggca

SEQ ID NO: 998587 - RNA, 21 nt, Homo sapiens
ccugacaucaaaaaaggcagu

SEQ ID NO: 998588 - RNA, 16 nt, Homo sapiens
ccugaccaguugcagu

SEQ ID NO: 998589 - RNA, 17 nt, Homo sapiens
ccugacuguaaaugcuc

SEQ ID NO: 998590 - RNA, 16 nt, Homo sapiens
ccugagagauuuaaca

SEQ ID NO: 998591 - RNA, 21 nt, Homo sapiens
ccugagauucagaugucauuu

SEQ ID NO: 998592 - RNA, 11 nt, Homo sapiens
ccugaggucag

SEQ ID NO: 998593 - RNA, 15 nt, Homo sapiens
ccugcaaacugggaa

SEQ ID NO: 998594 - RNA, 14 nt, Homo sapiens
ccugcaccaugcug

SEQ ID NO: 998595 - RNA, 15 nt, Homo sapiens
ccugcaccaugcugc

SEQ ID NO: 998596 - RNA, 22 nt, Homo sapiens
ccugcagcccauggugagcucu

SEQ ID NO: 998597 - RNA, 11 nt, Homo sapiens
ccugcauguac

SEQ ID NO: 998598 - RNA, 17 nt, Homo sapiens
ccugccacccauuccau

SEQ ID NO: 998599 - RNA, 14 nt, Homo sapiens
ccugccauagucuu

SEQ ID NO: 998600 - RNA, 23 nt, Homo sapiens
ccugcccccugcaggaaggagcu

SEQ ID NO: 998601 - RNA, 17 nt, Homo sapiens
ccugcuaacggugcuca

SEQ ID NO: 998602 - RNA, 16 nt, Homo sapiens
ccugcugagcucugag

SEQ ID NO: 998603 - RNA, 16 nt, Homo sapiens
ccugcugcucccucag

SEQ ID NO: 998604 - RNA, 14 nt, Homo sapiens
ccugcuuuucccca

SEQ ID NO: 998605 - RNA, 19 nt, Homo sapiens
ccuggaccccugcauugga

SEQ ID NO: 998606 - RNA, 13 nt, Homo sapiens
ccuggacuuuccu

SEQ ID NO: 998607 - RNA, 15 nt, Homo sapiens
ccuggacuuuccugc

SEQ ID NO: 998608 - RNA, 15 nt, Homo sapiens
ccuggagcagaagca

SEQ ID NO: 998609 - RNA, 13 nt, Homo sapiens
ccuggagggccag

SEQ ID NO: 998610 - RNA, 22 nt, Homo sapiens
ccuggaguguaugacugcacau

SEQ ID NO: 998611 - RNA, 18 nt, Homo sapiens
ccuggaugacauuaaaga

SEQ ID NO: 998612 - RNA, 20 nt, Homo sapiens
ccuggauggggcaggccacc

SEQ ID NO: 998613 - RNA, 15 nt, Homo sapiens
ccuggcagcucugga

SEQ ID NO: 998614 - RNA, 13 nt, Homo sapiens
ccuggccagacac

SEQ ID NO: 998615 - RNA, 20 nt, Homo sapiens
ccugggaggagagacacugg

SEQ ID NO: 998616 - RNA, 19 nt, Homo sapiens
ccuggggagucugggcaca

SEQ ID NO: 998617 - RNA, 12 nt, Homo sapiens
ccugggggacca

SEQ ID NO: 998618 - RNA, 16 nt, Homo sapiens
ccugguaauagcugua

SEQ ID NO: 998619 - RNA, 17 nt, Homo sapiens
ccuguagcagccagucc

SEQ ID NO: 998620 - RNA, 17 nt, Homo sapiens
ccuguagcagucacuga

SEQ ID NO: 998621 - RNA, 16 nt, Homo sapiens
ccuguccccaccucca

SEQ ID NO: 998622 - RNA, 17 nt, Homo sapiens
ccuguccuccaacacca

SEQ ID NO: 998623 - RNA, 18 nt, Homo sapiens
ccuguguacagaccuccg

SEQ ID NO: 998624 - RNA, 21 nt, Homo sapiens
ccuguguugucucuagagcag

SEQ ID NO: 998625 - RNA, 17 nt, Homo sapiens
ccuguuugucuacauau

SEQ ID NO: 998626 - RNA, 13 nt, Homo sapiens
ccuuaaaccugca

SEQ ID NO: 998627 - RNA, 14 nt, Homo sapiens
ccuuaaaccugcaa

SEQ ID NO: 998628 - RNA, 21 nt, Homo sapiens
ccuuaaaggggagaccucaga

SEQ ID NO: 998629 - RNA, 14 nt, Homo sapiens
ccuuacaguaggag

SEQ ID NO: 998630 - RNA, 22 nt, Homo sapiens
ccuuagauguucuaagucuuuc

SEQ ID NO: 998631 - RNA, 16 nt, Homo sapiens
ccuucacaaucuguca

SEQ ID NO: 998632 - RNA, 16 nt, Homo sapiens
ccuucagcgauuauuu

SEQ ID NO: 998633 - RNA, 17 nt, Homo sapiens
ccuucaugaucaucaca

SEQ ID NO: 998634 - RNA, 20 nt, Homo sapiens
ccuucauuaacaaaauguau

SEQ ID NO: 998635 - RNA, 14 nt, Homo sapiens
ccuucauugccaca

SEQ ID NO: 998636 - RNA, 13 nt, Homo sapiens
ccuuccacccagg

SEQ ID NO: 998637 - RNA, 22 nt, Homo sapiens
ccuuccagaaauacuacugugu

SEQ ID NO: 998638 - RNA, 20 nt, Homo sapiens
ccuuccagcuagugacccac

SEQ ID NO: 998639 - RNA, 15 nt, Homo sapiens
ccuuccuggacagcu

SEQ ID NO: 998640 - RNA, 21 nt, Homo sapiens
ccuucgggcugugcccgggga

SEQ ID NO: 998641 - RNA, 21 nt, Homo sapiens
ccuucuauuuggggcuugaug

SEQ ID NO: 998642 - RNA, 20 nt, Homo sapiens
ccuucuccccugcacuguaa

SEQ ID NO: 998643 - RNA, 17 nt, Homo sapiens
ccuucucugugcaguag

SEQ ID NO: 998644 - RNA, 16 nt, Homo sapiens
ccuucuugucauugaa

SEQ ID NO: 998645 - RNA, 16 nt, Homo sapiens
ccuugagaagugggag

SEQ ID NO: 998646 - RNA, 22 nt, Homo sapiens
ccuugauuuaucacacaaagca

SEQ ID NO: 998647 - RNA, 16 nt, Homo sapiens
ccuugcuuaccucuca

SEQ ID NO: 998648 - RNA, 19 nt, Homo sapiens
ccuuggacaacuuuucuca

SEQ ID NO: 998649 - RNA, 17 nt, Homo sapiens
ccuuggggucacuccuu

SEQ ID NO: 998650 - RNA, 21 nt, Homo sapiens
ccuugguucuugaggggacca

SEQ ID NO: 998651 - RNA, 13 nt, Homo sapiens
ccuugugccuugg

SEQ ID NO: 998652 - RNA, 13 nt, Homo sapiens
ccuugugggccug

SEQ ID NO: 998653 - RNA, 15 nt, Homo sapiens
ccuuguuuguacugu

SEQ ID NO: 998654 - RNA, 19 nt, Homo sapiens
ccuuuaacugacaagccau

SEQ ID NO: 998655 - RNA, 15 nt, Homo sapiens
ccuuuccauccaugg

SEQ ID NO: 998656 - RNA, 18 nt, Homo sapiens
ccuuucuucagacacuga

SEQ ID NO: 998657 - RNA, 16 nt, Homo sapiens
ccuuugugcacauuua

SEQ ID NO: 998658 - RNA, 14 nt, Homo sapiens
ccuuuucaugauuu

SEQ ID NO: 998659 - RNA, 17 nt, Homo sapiens
ccuuuugcaaccaggaa

SEQ ID NO: 998660 - RNA, 18 nt, Homo sapiens
cgaaaacccccaaaccag

SEQ ID NO: 998661 - RNA, 21 nt, Homo sapiens
cgaaaccgguggggcugguuc

SEQ ID NO: 998662 - RNA, 17 nt, Homo sapiens
cgaaccuacaguuuuaa

SEQ ID NO: 998663 - RNA, 16 nt, Homo sapiens
cgacaacuuguaacuc

SEQ ID NO: 998664 - RNA, 13 nt, Homo sapiens
cgaccccaagagu

SEQ ID NO: 998665 - RNA, 19 nt, Homo sapiens
cgacccccucucccugcau

SEQ ID NO: 998666 - RNA, 20 nt, Homo sapiens
cgacccccucucccugcaug

SEQ ID NO: 998667 - RNA, 16 nt, Homo sapiens
cgaccgccccaguucc

SEQ ID NO: 998668 - RNA, 14 nt, Homo sapiens
cacugcaauuggca

SEQ ID NO: 998669 - RNA, 23 nt, Homo sapiens
cacugcuugaggaaaacaagcau

SEQ ID NO: 998670 - RNA, 22 nt, Homo sapiens
cacuggggaagagaaaagccca

SEQ ID NO: 998671 - RNA, 14 nt, Homo sapiens
cacuguaucuaggc

SEQ ID NO: 998672 - RNA, 18 nt, Homo sapiens
cacuuauguuauacaaua

SEQ ID NO: 998673 - RNA, 22 nt, Homo sapiens
cacuuauguuauacaauacaga

SEQ ID NO: 998674 - RNA, 14 nt, Homo sapiens
cacuucaaauucaa

SEQ ID NO: 998675 - RNA, 21 nt, Homo sapiens
cacuugugcaguguugacagu

SEQ ID NO: 998676 - RNA, 22 nt, Homo sapiens
cacuuugcacugauauaucaug

SEQ ID NO: 998677 - RNA, 18 nt, Homo sapiens
cagaaaagcccaaguuca

SEQ ID NO: 998678 - RNA, 19 nt, Homo sapiens
cagaaaaggcugcugugaa

SEQ ID NO: 998679 - RNA, 13 nt, Homo sapiens
cagaaacuacuga

SEQ ID NO: 998680 - RNA, 14 nt, Homo sapiens
cagaaacuacugac

SEQ ID NO: 998681 - RNA, 14 nt, Homo sapiens
cagaaacucugcca

SEQ ID NO: 998682 - RNA, 15 nt, Homo sapiens
cagaaagcaaaccug

SEQ ID NO: 998683 - RNA, 14 nt, Homo sapiens
cagaacaccuaugc

SEQ ID NO: 998684 - RNA, 20 nt, Homo sapiens
cagaacacuuauguuauaca

SEQ ID NO: 998685 - RNA, 12 nt, Homo sapiens
cagaaccacagg

SEQ ID NO: 998686 - RNA, 20 nt, Homo sapiens
cagaacguggugaccuuuca

SEQ ID NO: 998687 - RNA, 14 nt, Homo sapiens
cagaacucuuucaa

SEQ ID NO: 998688 - RNA, 16 nt, Homo sapiens
cagaaguuaguuugua

SEQ ID NO: 998689 - RNA, 19 nt, Homo sapiens
cagaaguuaguuuguauau

SEQ ID NO: 998690 - RNA, 13 nt, Homo sapiens
cagaauacauaca

SEQ ID NO: 998691 - RNA, 21 nt, Homo sapiens
cagaaucccuuaacaguugua

SEQ ID NO: 998692 - RNA, 19 nt, Homo sapiens
cagaaugagaccaaacgca

SEQ ID NO: 998693 - RNA, 16 nt, Homo sapiens
cagaccauccaccagg

SEQ ID NO: 998694 - RNA, 14 nt, Homo sapiens
cagaccuccguuca

SEQ ID NO: 998695 - RNA, 15 nt, Homo sapiens
cagacucguucuucu

SEQ ID NO: 998696 - RNA, 14 nt, Homo sapiens
cagagaaaccagcu

SEQ ID NO: 998697 - RNA, 14 nt, Homo sapiens
cagagaaaggauug

SEQ ID NO: 998698 - RNA, 13 nt, Homo sapiens
cagagaagccagc

SEQ ID NO: 998699 - RNA, 22 nt, Homo sapiens
cagagacacagcccccacggac

SEQ ID NO: 998700 - RNA, 20 nt, Homo sapiens
cagagaccaagauggcccau

SEQ ID NO: 998701 - RNA, 19 nt, Homo sapiens
cagagaccuuccagaaaua

SEQ ID NO: 998702 - RNA, 13 nt, Homo sapiens
cagagacuaugua

SEQ ID NO: 998703 - RNA, 15 nt, Homo sapiens
cagagagaggcauuu

SEQ ID NO: 998704 - RNA, 21 nt, Homo sapiens
cagagccaccugacucuugca

SEQ ID NO: 998705 - RNA, 14 nt, Homo sapiens
cagaggacacagag

SEQ ID NO: 998706 - RNA, 14 nt, Homo sapiens
cagaggccaagagu

SEQ ID NO: 998707 - RNA, 13 nt, Homo sapiens
cagaggucuccca

SEQ ID NO: 998708 - RNA, 17 nt, Homo sapiens
cagagugacauccagga

SEQ ID NO: 998709 - RNA, 23 nt, Homo sapiens
cagagugagacccagcccucauc

SEQ ID NO: 998710 - RNA, 15 nt, Homo sapiens
cagaguguucccuga

SEQ ID NO: 998711 - RNA, 22 nt, Homo sapiens
cagauaagguaaaaugccauga

SEQ ID NO: 998712 - RNA, 23 nt, Homo sapiens
cagauaucuuggacaaaucacau

SEQ ID NO: 998713 - RNA, 12 nt, Homo sapiens
cagauccaggga

SEQ ID NO: 998714 - RNA, 20 nt, Homo sapiens
cagauccuccucauucacau

SEQ ID NO: 998715 - RNA, 22 nt, Homo sapiens
cagaucgggagcaaaccaaaga

SEQ ID NO: 998716 - RNA, 21 nt, Homo sapiens
cagaucugauuuguaacccac

SEQ ID NO: 998717 - RNA, 15 nt, Homo sapiens
cagaugcagggcagu

SEQ ID NO: 998718 - RNA, 17 nt, Homo sapiens
cagaugccacacaagga

SEQ ID NO: 998719 - RNA, 23 nt, Homo sapiens
cagauguauuaaaaaaagauuug

SEQ ID NO: 998720 - RNA, 17 nt, Homo sapiens
cagauuagagccuguaa

SEQ ID NO: 998721 - RNA, 19 nt, Homo sapiens
cagauuuuuuccucugcau

SEQ ID NO: 998722 - RNA, 22 nt, Homo sapiens
cagcaaacaggugcuaauuugu

SEQ ID NO: 998723 - RNA, 20 nt, Homo sapiens
cagcaagacuucucuuugcc

SEQ ID NO: 998724 - RNA, 23 nt, Homo sapiens
cagcaagacuucucuuugccuca

SEQ ID NO: 998725 - RNA, 12 nt, Homo sapiens
cagcacaucuca

SEQ ID NO: 998726 - RNA, 15 nt, Homo sapiens
cagcacaugugcugc

SEQ ID NO: 998727 - RNA, 17 nt, Homo sapiens
cagcagcaccugcccua

SEQ ID NO: 998728 - RNA, 19 nt, Homo sapiens
cagcauugacucuguggcu

SEQ ID NO: 998729 - RNA, 12 nt, Homo sapiens
cagcauuugacc

SEQ ID NO: 998730 - RNA, 18 nt, Homo sapiens
cagccaaacccugucuga

SEQ ID NO: 998731 - RNA, 16 nt, Homo sapiens
cagccacgaggugcaa

SEQ ID NO: 998732 - RNA, 17 nt, Homo sapiens
cagccacgaggugcaac

SEQ ID NO: 998733 - RNA, 19 nt, Homo sapiens
cagccacuugccugugcua

SEQ ID NO: 998734 - RNA, 12 nt, Homo sapiens
cagccagcaucu

SEQ ID NO: 998735 - RNA, 15 nt, Homo sapiens
cagccagggcucaau

SEQ ID NO: 998736 - RNA, 21 nt, Homo sapiens
cagccagguuugccagaacca

SEQ ID NO: 998737 - RNA, 17 nt, Homo sapiens
cagcccagcccgucucc

SEQ ID NO: 998738 - RNA, 23 nt, Homo sapiens
cagcccauggagauugaccugga

SEQ ID NO: 998739 - RNA, 23 nt, Homo sapiens
cagcccauggugagcucugggaa

SEQ ID NO: 998740 - RNA, 14 nt, Homo sapiens
cagcccccucacag

SEQ ID NO: 998741 - RNA, 23 nt, Homo sapiens
ccguggcuuugguuuaaaagaca

SEQ ID NO: 998742 - RNA, 23 nt, Homo sapiens
ccguuucauuuagucaugugacc

SEQ ID NO: 998743 - RNA, 19 nt, Homo sapiens
ccuaacacggugcucauuu

SEQ ID NO: 998744 - RNA, 14 nt, Homo sapiens
ccuaaggugucuga

SEQ ID NO: 998745 - RNA, 19 nt, Homo sapiens
ccuaauccaggcagaucca

SEQ ID NO: 998746 - RNA, 14 nt, Homo sapiens
ccuacaaaauuuca

SEQ ID NO: 998747 - RNA, 21 nt, Homo sapiens
ccuacaaaauuucaccugcaa

SEQ ID NO: 998748 - RNA, 21 nt, Homo sapiens
ccuacagggacacuaucacuc

SEQ ID NO: 998749 - RNA, 23 nt, Homo sapiens
ccuagcagcaccguucugugcac

SEQ ID NO: 998750 - RNA, 21 nt, Homo sapiens
ccuauaccuguguuucuugcc

SEQ ID NO: 998751 - RNA, 21 nt, Homo sapiens
ccuaugcaugguuucagcacu

SEQ ID NO: 998752 - RNA, 14 nt, Homo sapiens
ccuauguaugccau

SEQ ID NO: 998753 - RNA, 20 nt, Homo sapiens
ccuauuagaguauuuuccac

SEQ ID NO: 998754 - RNA, 23 nt, Homo sapiens
ccucaagaaauaaaaggaagcca

SEQ ID NO: 998755 - RNA, 14 nt, Homo sapiens
ccucacaagcauga

SEQ ID NO: 998756 - RNA, 20 nt, Homo sapiens
ccucacagagugcauuguga

SEQ ID NO: 998757 - RNA, 19 nt, Homo sapiens
ccucagaagugcaucugga

SEQ ID NO: 998758 - RNA, 19 nt, Homo sapiens
ccucagccuggccagacac

SEQ ID NO: 998759 - RNA, 14 nt, Homo sapiens
ccucaggcagcuca

SEQ ID NO: 998760 - RNA, 16 nt, Homo sapiens
ccucagggcaaagcca

SEQ ID NO: 998761 - RNA, 20 nt, Homo sapiens
ccucaggugaaacuccagau

SEQ ID NO: 998762 - RNA, 18 nt, Homo sapiens
ccucaucccuccaucuca

SEQ ID NO: 998763 - RNA, 17 nt, Homo sapiens
ccuccaaaaugugccua

SEQ ID NO: 998764 - RNA, 16 nt, Homo sapiens
ccuccaccuccugggu

SEQ ID NO: 998765 - RNA, 20 nt, Homo sapiens
ccuccaccuccuggguucaa

SEQ ID NO: 998766 - RNA, 14 nt, Homo sapiens
ccuccagcuuuccu

SEQ ID NO: 998767 - RNA, 13 nt, Homo sapiens
ccuccccaguuca

SEQ ID NO: 998768 - RNA, 17 nt, Homo sapiens
cucuccucuucuacuca

SEQ ID NO: 998769 - RNA, 16 nt, Homo sapiens
cucucucccuuuucag

SEQ ID NO: 998770 - RNA, 17 nt, Homo sapiens
cucugaaaccaguguua

SEQ ID NO: 998771 - RNA, 15 nt, Homo sapiens
cucugaccugcacug

SEQ ID NO: 998772 - RNA, 21 nt, Homo sapiens
cucugagguuuccgaaaucag

SEQ ID NO: 998773 - RNA, 13 nt, Homo sapiens
cucugauauggcu

SEQ ID NO: 998774 - RNA, 13 nt, Homo sapiens
cucugaucccucu

SEQ ID NO: 998775 - RNA, 16 nt, Homo sapiens
cucugcaccuuugcac

SEQ ID NO: 998776 - RNA, 21 nt, Homo sapiens
cucugcgccggacuuggugcg

SEQ ID NO: 998777 - RNA, 21 nt, Homo sapiens
cucugucaauuguacgcgcca

SEQ ID NO: 998778 - RNA, 17 nt, Homo sapiens
cucugucgccaggcuag

SEQ ID NO: 998779 - RNA, 17 nt, Homo sapiens
cucuuaaucaaauagca

SEQ ID NO: 998780 - RNA, 17 nt, Homo sapiens
cucuuccuuacucccag

SEQ ID NO: 998781 - RNA, 17 nt, Homo sapiens
cucuuguauaugaugau

SEQ ID NO: 998782 - RNA, 18 nt, Homo sapiens
cugaaaaaaaaccugaga

SEQ ID NO: 998783 - RNA, 22 nt, Homo sapiens
cugaaaagugaagacagaacca

SEQ ID NO: 998784 - RNA, 18 nt, Homo sapiens
cugaaaauguccuuguga

SEQ ID NO: 998785 - RNA, 22 nt, Homo sapiens
cugaaauugcguucuaagaggu

SEQ ID NO: 998786 - RNA, 23 nt, Homo sapiens
cugaaauuuaucuuuucuucuau

SEQ ID NO: 998787 - RNA, 22 nt, Homo sapiens
cugaacacgaagcuuaguauaa

SEQ ID NO: 998788 - RNA, 12 nt, Homo sapiens
cugaacagugga

SEQ ID NO: 998789 - RNA, 21 nt, Homo sapiens
cugaauagcuucuccaaaggc

SEQ ID NO: 998790 - RNA, 16 nt, Homo sapiens
cugaaucugcuaccaa

SEQ ID NO: 998791 - RNA, 14 nt, Homo sapiens
cugacagaaugaga

SEQ ID NO: 998792 - RNA, 23 nt, Homo sapiens
cugacaguuaauaaaccuuugca

SEQ ID NO: 998793 - RNA, 17 nt, Homo sapiens
cugaccacagcacagcc

SEQ ID NO: 998794 - RNA, 20 nt, Homo sapiens
cugaccagccgugagcaugu

SEQ ID NO: 998795 - RNA, 19 nt, Homo sapiens
cugaccucaggugauccac

SEQ ID NO: 998796 - RNA, 17 nt, Homo sapiens
cugaccucgugauccac

SEQ ID NO: 998797 - RNA, 17 nt, Homo sapiens
cugaccuuaaaugcaac

SEQ ID NO: 998798 - RNA, 17 nt, Homo sapiens
cugacgugcagccacac

SEQ ID NO: 998799 - RNA, 14 nt, Homo sapiens
cugacuuugcuugc

SEQ ID NO: 998800 - RNA, 21 nt, Homo sapiens
cugagaacuggacaguggcag

SEQ ID NO: 998801 - RNA, 12 nt, Homo sapiens
cugagagucuag

SEQ ID NO: 998802 - RNA, 19 nt, Homo sapiens
cugagauacauacagaauu

SEQ ID NO: 998803 - RNA, 19 nt, Homo sapiens
cugagcccaaggcacugag

SEQ ID NO: 998804 - RNA, 14 nt, Homo sapiens
cugagcuccagcuc

SEQ ID NO: 998805 - RNA, 13 nt, Homo sapiens
cugagcucugaga

SEQ ID NO: 998806 - RNA, 13 nt, Homo sapiens
cugagcugugcag

SEQ ID NO: 998807 - RNA, 19 nt, Homo sapiens
cugaggccuggacuuuccu

SEQ ID NO: 998808 - RNA, 15 nt, Homo sapiens
cugagggcaguucug

SEQ ID NO: 998809 - RNA, 17 nt, Homo sapiens
cugaguaucacaucaca

SEQ ID NO: 998810 - RNA, 17 nt, Homo sapiens
cugagucagagccaugu

SEQ ID NO: 998811 - RNA, 14 nt, Homo sapiens
cugaguggugccaa

SEQ ID NO: 998812 - RNA, 15 nt, Homo sapiens
cugaguggugccaaa

SEQ ID NO: 998813 - RNA, 16 nt, Homo sapiens
cugaguggugccaaac

SEQ ID NO: 998814 - RNA, 19 nt, Homo sapiens
cugaguuucuggcucuuga

SEQ ID NO: 998815 - RNA, 22 nt, Homo sapiens
cugauaagagaaucaacauuuc

SEQ ID NO: 998816 - RNA, 18 nt, Homo sapiens
cugauaaggaucuaggag

SEQ ID NO: 998817 - RNA, 21 nt, Homo sapiens
cugaucaccuguuagcauugc

SEQ ID NO: 998818 - RNA, 17 nt, Homo sapiens
cugauggaaaaugcaaa

SEQ ID NO: 998819 - RNA, 13 nt, Homo sapiens
cugcaaacuggga

SEQ ID NO: 998820 - RNA, 15 nt, Homo sapiens
cugcaaauacuguau

SEQ ID NO: 998821 - RNA, 16 nt, Homo sapiens
cugcaagcacaucugc

SEQ ID NO: 998822 - RNA, 21 nt, Homo sapiens
cugcaauguaaauaguauaaa

SEQ ID NO: 998823 - RNA, 18 nt, Homo sapiens
cugcacagugacuucuga

SEQ ID NO: 998824 - RNA, 19 nt, Homo sapiens
cugcaccuuuuugcaugau

SEQ ID NO: 998825 - RNA, 18 nt, Homo sapiens
cugcacuaaaauucacuu

SEQ ID NO: 998826 - RNA, 18 nt, Homo sapiens
cugcacucccaccugaca

SEQ ID NO: 998827 - RNA, 22 nt, Homo sapiens
cugcacugaugcugccccucau

SEQ ID NO: 998828 - RNA, 20 nt, Homo sapiens
cugcauaucauaaugggggu

SEQ ID NO: 998829 - RNA, 22 nt, Homo sapiens
cugcauccauucuccugaggau

SEQ ID NO: 998830 - RNA, 16 nt, Homo sapiens
cugcaugcccagagac

SEQ ID NO: 998831 - RNA, 16 nt, Homo sapiens
cugcauguacuguaua

SEQ ID NO: 998832 - RNA, 16 nt, Homo sapiens
cugcauuuacacacac

SEQ ID NO: 998833 - RNA, 18 nt, Homo sapiens
cugccaaaggaugugaua

SEQ ID NO: 998834 - RNA, 11 nt, Homo sapiens
cugccacugug

SEQ ID NO: 998835 - RNA, 16 nt, Homo sapiens
cugccagcuucaggug

SEQ ID NO: 998836 - RNA, 12 nt, Homo sapiens
cugcccaaagca

SEQ ID NO: 998837 - RNA, 18 nt, Homo sapiens
cugcccaaagcagcacuu

SEQ ID NO: 998838 - RNA, 20 nt, Homo sapiens
cugcccacucccaggaccaa

SEQ ID NO: 998839 - RNA, 17 nt, Homo sapiens
cugccccucucaccaaa

SEQ ID NO: 998840 - RNA, 17 nt, Homo sapiens
cugccuauuaucuguca

SEQ ID NO: 998841 - RNA, 16 nt, Homo sapiens
cugccucucccaggca

SEQ ID NO: 998842 - RNA, 21 nt, Homo sapiens
cugccuucaccuccucuuuca

SEQ ID NO: 998843 - RNA, 17 nt, Homo sapiens
cugccuuugccagguga

SEQ ID NO: 998844 - RNA, 12 nt, Homo sapiens
cugcguuuucau

SEQ ID NO: 998845 - RNA, 22 nt, Homo sapiens
caaugacaugaauuuuagcuuu

SEQ ID NO: 998846 - RNA, 19 nt, Homo sapiens
caaugagggagcauguacc

SEQ ID NO: 998847 - RNA, 19 nt, Homo sapiens
caaugggcucaaacuucua

SEQ ID NO: 998848 - RNA, 15 nt, Homo sapiens
caauggggccaguca

SEQ ID NO: 998849 - RNA, 21 nt, Homo sapiens
caauuaaaaugacaagcacua

SEQ ID NO: 998850 - RNA, 23 nt, Homo sapiens
caauuaauuccuguuugucuaca

SEQ ID NO: 998851 - RNA, 16 nt, Homo sapiens
caauucagacaggcaa

SEQ ID NO: 998852 - RNA, 15 nt, Homo sapiens
caauuucagacuccc

SEQ ID NO: 998853 - RNA, 22 nt, Homo sapiens
caauuuuucaagagcuccuuga

SEQ ID NO: 998854 - RNA, 13 nt, Homo sapiens
cacaaaccaguau

SEQ ID NO: 998855 - RNA, 14 nt, Homo sapiens
cacaacccaaaagg

SEQ ID NO: 998856 - RNA, 16 nt, Homo sapiens
cacaaggacuuccugu

SEQ ID NO: 998857 - RNA, 14 nt, Homo sapiens
cacaaguggguacc

SEQ ID NO: 998858 - RNA, 15 nt, Homo sapiens
cacaaugaugaugau

SEQ ID NO: 998859 - RNA, 18 nt, Homo sapiens
cacaauguuaaguuauau

SEQ ID NO: 998860 - RNA, 16 nt, Homo sapiens
cacacauugcugugaa

SEQ ID NO: 998861 - RNA, 18 nt, Homo sapiens
cacacauugcugugaaca

SEQ ID NO: 998862 - RNA, 23 nt, Homo sapiens
cacacauugcugugaacaggaaa

SEQ ID NO: 998863 - RNA, 20 nt, Homo sapiens
cacacccuggaggauuucau

SEQ ID NO: 998864 - RNA, 19 nt, Homo sapiens
cacaccugcggcccaaucc

SEQ ID NO: 998865 - RNA, 17 nt, Homo sapiens
cacaccuuuuauugaca

SEQ ID NO: 998866 - RNA, 16 nt, Homo sapiens
cacacgauaaagggau

SEQ ID NO: 998867 - RNA, 14 nt, Homo sapiens
cacacucagcacaa

SEQ ID NO: 998868 - RNA, 14 nt, Homo sapiens
cacacuuguccaca

SEQ ID NO: 998869 - RNA, 15 nt, Homo sapiens
cacacuuugcacuga

SEQ ID NO: 998870 - RNA, 18 nt, Homo sapiens
cacacuuugguaccagau

SEQ ID NO: 998871 - RNA, 17 nt, Homo sapiens
cacagagauucugaacu

SEQ ID NO: 998872 - RNA, 22 nt, Homo sapiens
cacagagauucugaacuaaagu

SEQ ID NO: 998873 - RNA, 14 nt, Homo sapiens
cacagaggacacag

SEQ ID NO: 998874 - RNA, 23 nt, Homo sapiens
cacagagugcauugugaggguua

SEQ ID NO: 998875 - RNA, 14 nt, Homo sapiens
cacaggaguguccu

SEQ ID NO: 998876 - RNA, 19 nt, Homo sapiens
cacaggcagccagugcccu

SEQ ID NO: 998877 - RNA, 19 nt, Homo sapiens
cacaggccacggaccaaug

SEQ ID NO: 998878 - RNA, 20 nt, Homo sapiens
cacagggucccacagccacg

SEQ ID NO: 998879 - RNA, 21 nt, Homo sapiens
cacaguauugcucacccagug

SEQ ID NO: 998880 - RNA, 19 nt, Homo sapiens
cacagugacuucugagauc

SEQ ID NO: 998881 - RNA, 16 nt, Homo sapiens
cacagugucaggcacu

SEQ ID NO: 998882 - RNA, 13 nt, Homo sapiens
cacauacaaauca

SEQ ID NO: 998883 - RNA, 15 nt, Homo sapiens
cacauacgugcacag

SEQ ID NO: 998884 - RNA, 18 nt, Homo sapiens
cacauauggaauuuugca

SEQ ID NO: 998885 - RNA, 15 nt, Homo sapiens
cacaucccacugcca

SEQ ID NO: 998886 - RNA, 16 nt, Homo sapiens
cacaucuaaccucauc

SEQ ID NO: 998887 - RNA, 13 nt, Homo sapiens
cacaucugcauuu

SEQ ID NO: 998888 - RNA, 15 nt, Homo sapiens
cacaucuuguaacuu

SEQ ID NO: 998889 - RNA, 16 nt, Homo sapiens
cacaucuuguaacuua

SEQ ID NO: 998890 - RNA, 13 nt, Homo sapiens
cacaugcccauga

SEQ ID NO: 998891 - RNA, 15 nt, Homo sapiens
caccaaaacugcucc

SEQ ID NO: 998892 - RNA, 19 nt, Homo sapiens
caccaaagggaaggcuucc

SEQ ID NO: 998893 - RNA, 15 nt, Homo sapiens
caccacgacuggcca

SEQ ID NO: 998894 - RNA, 21 nt, Homo sapiens
caccacuuuacuuguguuaua

SEQ ID NO: 998895 - RNA, 15 nt, Homo sapiens
caccagacacccagg

SEQ ID NO: 998896 - RNA, 12 nt, Homo sapiens
caccagcaaaac

SEQ ID NO: 998897 - RNA, 22 nt, Homo sapiens
caccaggaauccccaacaugca

SEQ ID NO: 998898 - RNA, 21 nt, Homo sapiens
caccaggauagagacuggaac

SEQ ID NO: 998899 - RNA, 11 nt, Homo sapiens
caccaguucuc

SEQ ID NO: 998900 - RNA, 15 nt, Homo sapiens
caccaugcccggcua

SEQ ID NO: 998901 - RNA, 18 nt, Homo sapiens
caccaugcugcuggggaa

SEQ ID NO: 998902 - RNA, 20 nt, Homo sapiens
caccaugucaaggguucaag

SEQ ID NO: 998903 - RNA, 15 nt, Homo sapiens
caccauuaacuccuc

SEQ ID NO: 998904 - RNA, 22 nt, Homo sapiens
cacccagccccagccagggcuc

SEQ ID NO: 998905 - RNA, 14 nt, Homo sapiens
cacccccagcucaa

SEQ ID NO: 998906 - RNA, 15 nt, Homo sapiens
cacccgcuuccuccc

SEQ ID NO: 998907 - RNA, 20 nt, Homo sapiens
cacccucauucuacugaaaa

SEQ ID NO: 998908 - RNA, 21 nt, Homo sapiens
caccgcuccaaugccuacuga

SEQ ID NO: 998909 - RNA, 12 nt, Homo sapiens
caccguucugug

SEQ ID NO: 998910 - RNA, 22 nt, Homo sapiens
caccuaauccaggcagauccag

SEQ ID NO: 998911 - RNA, 20 nt, Homo sapiens
caccuacaaaauuucaccug

SEQ ID NO: 998912 - RNA, 22 nt, Homo sapiens
caccuacaaaauuucaccugca

SEQ ID NO: 998913 - RNA, 23 nt, Homo sapiens
caccuaccuuagaaaacaaguau

SEQ ID NO: 998914 - RNA, 18 nt, Homo sapiens
caccuacucacacaggca

SEQ ID NO: 998915 - RNA, 15 nt, Homo sapiens
caccuagacuguaaa

SEQ ID NO: 998916 - RNA, 15 nt, Homo sapiens
caccuauuaucccag

SEQ ID NO: 998917 - RNA, 21 nt, Homo sapiens
caccucacucuccugccuuga

SEQ ID NO: 998918 - RNA, 18 nt, Homo sapiens
caccugacacaccaggcg

SEQ ID NO: 998919 - RNA, 15 nt, Homo sapiens
caccugacagaauga

SEQ ID NO: 998920 - RNA, 17 nt, Homo sapiens
caccuucaccuucaucc

SEQ ID NO: 998921 - RNA, 18 nt, Homo sapiens
caccuucaccuucaucca

SEQ ID NO: 998922 - RNA, 22 nt, Homo sapiens
caccuuggcaccagacacccag

SEQ ID NO: 998923 - RNA, 13 nt, Homo sapiens
caccuuugcacgu

SEQ ID NO: 998924 - RNA, 13 nt, Homo sapiens
caccuuuuacucu

SEQ ID NO: 998925 - RNA, 17 nt, Homo sapiens
caccuuuuauugacaca

SEQ ID NO: 998926 - RNA, 17 nt, Homo sapiens
cacgaagcuuaguauaa

SEQ ID NO: 998927 - RNA, 20 nt, Homo sapiens
cacggccacaucaaagaggc

SEQ ID NO: 998928 - RNA, 18 nt, Homo sapiens
cacggcugcgcacugugu

SEQ ID NO: 998929 - RNA, 16 nt, Homo sapiens
cacuaaaauucacuua

SEQ ID NO: 998930 - RNA, 21 nt, Homo sapiens
cacuaauucauuaaucugccu

SEQ ID NO: 998931 - RNA, 19 nt, Homo sapiens
cacuaccgaaugugucuuu

SEQ ID NO: 998932 - RNA, 16 nt, Homo sapiens
cacuagccaaaccuca

SEQ ID NO: 998933 - RNA, 19 nt, Homo sapiens
cacucaaggcggugcuuga

SEQ ID NO: 998934 - RNA, 23 nt, Homo sapiens
cacucccaccugacacaccaggc

SEQ ID NO: 998935 - RNA, 18 nt, Homo sapiens
cacucccuccuaaccuag

SEQ ID NO: 998936 - RNA, 15 nt, Homo sapiens
cacuccuuuuuugca

SEQ ID NO: 998937 - RNA, 19 nt, Homo sapiens
cacuccuuuuuugcaugug

SEQ ID NO: 998938 - RNA, 18 nt, Homo sapiens
cacucuagucaaugacau

SEQ ID NO: 998939 - RNA, 23 nt, Homo sapiens
cacucuagucaaugacaugaauu

SEQ ID NO: 998940 - RNA, 14 nt, Homo sapiens
cacucugcucugau

SEQ ID NO: 998941 - RNA, 17 nt, Homo sapiens
cacucuggagcauuucu

SEQ ID NO: 998942 - RNA, 20 nt, Homo sapiens
cacucuuuugcuuuauucca

SEQ ID NO: 998943 - RNA, 17 nt, Homo sapiens
cacugaagcaccacagg

SEQ ID NO: 998944 - RNA, 15 nt, Homo sapiens
cacugacaguuaaua

SEQ ID NO: 998945 - RNA, 19 nt, Homo sapiens
cacugacuggaaggcaguc

SEQ ID NO: 998946 - RNA, 21 nt, Homo sapiens
cacugaggauguaaagaucaa

SEQ ID NO: 998947 - RNA, 22 nt, Homo sapiens
cacugaugcuuagauguuccag

SEQ ID NO: 998948 - RNA, 14 nt, Homo sapiens
auuuggguccagga

SEQ ID NO: 998949 - RNA, 17 nt, Homo sapiens
auuuguaaaaugacaau

SEQ ID NO: 998950 - RNA, 20 nt, Homo sapiens
auuuguaauuaaaagcaaau

SEQ ID NO: 998951 - RNA, 13 nt, Homo sapiens
auuugugugcauc

SEQ ID NO: 998952 - RNA, 19 nt, Homo sapiens
auuuuaaacacauuaggaa

SEQ ID NO: 998953 - RNA, 13 nt, Homo sapiens
auuuuaaagacaa

SEQ ID NO: 998954 - RNA, 20 nt, Homo sapiens
auuuuaggagcuaaggcucu

SEQ ID NO: 998955 - RNA, 18 nt, Homo sapiens
auuuuauaggcauaccuc

SEQ ID NO: 998956 - RNA, 21 nt, Homo sapiens
auuuuauaggcauaccuccua

SEQ ID NO: 998957 - RNA, 16 nt, Homo sapiens
auuuucaaaaccaggu

SEQ ID NO: 998958 - RNA, 19 nt, Homo sapiens
auuuucuaauguugacuuu

SEQ ID NO: 998959 - RNA, 22 nt, Homo sapiens
auuuucuaauguugacuuuaau

SEQ ID NO: 998960 - RNA, 17 nt, Homo sapiens
auuuucucucaggugaa

SEQ ID NO: 998961 - RNA, 16 nt, Homo sapiens
auuuucuuucacuuaa

SEQ ID NO: 998962 - RNA, 15 nt, Homo sapiens
auuuugaagugcugu

SEQ ID NO: 998963 - RNA, 23 nt, Homo sapiens
auuuugagauggagucuugcucu

SEQ ID NO: 998964 - RNA, 21 nt, Homo sapiens
auuuugauugcuuaccuacau

SEQ ID NO: 998965 - RNA, 18 nt, Homo sapiens
auuuuguuuucuguggag

SEQ ID NO: 998966 - RNA, 22 nt, Homo sapiens
auuuuuaugucuggggcagaaa

SEQ ID NO: 998967 - RNA, 14 nt, Homo sapiens
auuuuuauuacaac

SEQ ID NO: 998968 - RNA, 20 nt, Homo sapiens
auuuuuuaauccuaccucaa

SEQ ID NO: 998969 - RNA, 19 nt, Homo sapiens
caaaaccccccagauauca

SEQ ID NO: 998970 - RNA, 16 nt, Homo sapiens
caaaagucuggccuuu

SEQ ID NO: 998971 - RNA, 23 nt, Homo sapiens
caaaauacaauuuuuuugguaaa

SEQ ID NO: 998972 - RNA, 19 nt, Homo sapiens
caaaauugcaaaucuugaa

SEQ ID NO: 998973 - RNA, 20 nt, Homo sapiens
caaacauuuugaaagucugu

SEQ ID NO: 998974 - RNA, 14 nt, Homo sapiens
caaaccaaagacca

SEQ ID NO: 998975 - RNA, 19 nt, Homo sapiens
caaaccaaagaccaucuga

SEQ ID NO: 998976 - RNA, 19 nt, Homo sapiens
caaacugcaugcccagaga

SEQ ID NO: 998977 - RNA, 19 nt, Homo sapiens
caaacuguguaacugccca

SEQ ID NO: 998978 - RNA, 14 nt, Homo sapiens
caaacuucauuuca

SEQ ID NO: 998979 - RNA, 16 nt, Homo sapiens
caaacuuugcaucuca

SEQ ID NO: 998980 - RNA, 23 nt, Homo sapiens
caaagaaccuucucuauggggca

SEQ ID NO: 998981 - RNA, 22 nt, Homo sapiens
caaagacuuaagcccagugcac

SEQ ID NO: 998982 - RNA, 22 nt, Homo sapiens
caaagaucuguccucagccuug

SEQ ID NO: 998983 - RNA, 18 nt, Homo sapiens
caaagaugccacauucaa

SEQ ID NO: 998984 - RNA, 15 nt, Homo sapiens
caaagcaagcauuca

SEQ ID NO: 998985 - RNA, 22 nt, Homo sapiens
caaagcaucccucuuagucuag

SEQ ID NO: 998986 - RNA, 15 nt, Homo sapiens
caaagcuuuccugcc

SEQ ID NO: 998987 - RNA, 13 nt, Homo sapiens
caaaggcucccug

SEQ ID NO: 998988 - RNA, 20 nt, Homo sapiens
caaaguccuuuuuuuccauc

SEQ ID NO: 998989 - RNA, 19 nt, Homo sapiens
caaagugcugagauuacag

SEQ ID NO: 998990 - RNA, 21 nt, Homo sapiens
caaauacuguauauucaggac

SEQ ID NO: 998991 - RNA, 14 nt, Homo sapiens
caaauaggaugcuu

SEQ ID NO: 998992 - RNA, 21 nt, Homo sapiens
caaauauggggaaaaaacugu

SEQ ID NO: 998993 - RNA, 18 nt, Homo sapiens
caaaucacauauuuuaaa

SEQ ID NO: 998994 - RNA, 21 nt, Homo sapiens
caaaucagugugaggagguag

SEQ ID NO: 998995 - RNA, 22 nt, Homo sapiens
caaauccuuagaucuggcaugu

SEQ ID NO: 998996 - RNA, 22 nt, Homo sapiens
caaaucguccagcgaccuuccu

SEQ ID NO: 998997 - RNA, 14 nt, Homo sapiens
caaaucgugccuug

SEQ ID NO: 998998 - RNA, 19 nt, Homo sapiens
caaaucuaccacuguauga

SEQ ID NO: 998999 - RNA, 17 nt, Homo sapiens
caaaugcaccaugucaa

SEQ ID NO: 999000 - RNA, 20 nt, Homo sapiens
caaaugcauacaaguuucau

SEQ ID NO: 999001 - RNA, 17 nt, Homo sapiens
caaauucaguuucauaa

SEQ ID NO: 999002 - RNA, 21 nt, Homo sapiens
caaauuugauugauuugaaga

SEQ ID NO: 999003 - RNA, 15 nt, Homo sapiens
caacaccaagcacag

SEQ ID NO: 999004 - RNA, 13 nt, Homo sapiens
caacaccaccucu

SEQ ID NO: 999005 - RNA, 13 nt, Homo sapiens
caacaccaugauu

SEQ ID NO: 999006 - RNA, 14 nt, Homo sapiens
caacacccaguuuc

SEQ ID NO: 999007 - RNA, 15 nt, Homo sapiens
caacagcauuuucaa

SEQ ID NO: 999008 - RNA, 18 nt, Homo sapiens
caacagcgcccaaaggac

SEQ ID NO: 999009 - RNA, 18 nt, Homo sapiens
caacaguuuuuuaugcua

SEQ ID NO: 999010 - RNA, 16 nt, Homo sapiens
caacauaguauucaug

SEQ ID NO: 999011 - RNA, 16 nt, Homo sapiens
caacaugcacugaugu

SEQ ID NO: 999012 - RNA, 17 nt, Homo sapiens
caacauguuuccagcau

SEQ ID NO: 999013 - RNA, 16 nt, Homo sapiens
caacauuguagccuca

SEQ ID NO: 999014 - RNA, 18 nt, Homo sapiens
caaccauuugaaaccccu

SEQ ID NO: 999015 - RNA, 14 nt, Homo sapiens
caacccuucccuca

SEQ ID NO: 999016 - RNA, 12 nt, Homo sapiens
caaccucaguga

SEQ ID NO: 999017 - RNA, 15 nt, Homo sapiens
caaccucuacagggu

SEQ ID NO: 999018 - RNA, 16 nt, Homo sapiens
caacucauuugcucua

SEQ ID NO: 999019 - RNA, 16 nt, Homo sapiens
caacucguauagcaug

SEQ ID NO: 999020 - RNA, 22 nt, Homo sapiens
caacucuccccugaccugugag

SEQ ID NO: 999021 - RNA, 20 nt, Homo sapiens
caacuuauuaacaauuaggc

SEQ ID NO: 999022 - RNA, 19 nt, Homo sapiens
caacuugagcauguuacug

SEQ ID NO: 999023 - RNA, 23 nt, Homo sapiens
caacuuuucucauguugaagcca

SEQ ID NO: 999024 - RNA, 18 nt, Homo sapiens
caagaaaauaagagcuca

SEQ ID NO: 999025 - RNA, 13 nt, Homo sapiens
caagaauagcauu

SEQ ID NO: 999026 - RNA, 13 nt, Homo sapiens
caagacaaaaagc

SEQ ID NO: 999027 - RNA, 15 nt, Homo sapiens
caagacuuugcuaaa

SEQ ID NO: 999028 - RNA, 21 nt, Homo sapiens
caagagaauuuggggcuucca

SEQ ID NO: 999029 - RNA, 21 nt, Homo sapiens
caagcauggucccacaucccu

SEQ ID NO: 999030 - RNA, 16 nt, Homo sapiens
caagcugaggugccca

SEQ ID NO: 999031 - RNA, 16 nt, Homo sapiens
caagcugaguauuaaa

SEQ ID NO: 999032 - RNA, 22 nt, Homo sapiens
caagcugauuaaaugacacuca

SEQ ID NO: 999033 - RNA, 13 nt, Homo sapiens
caaggaagucaaa

SEQ ID NO: 999034 - RNA, 16 nt, Homo sapiens
caaggaccugagaccu

SEQ ID NO: 999035 - RNA, 14 nt, Homo sapiens
caaggcacugagac

SEQ ID NO: 999036 - RNA, 22 nt, Homo sapiens
caaggcccauaucugugaaaug

SEQ ID NO: 999037 - RNA, 17 nt, Homo sapiens
caagguuuuagguucua

SEQ ID NO: 999038 - RNA, 21 nt, Homo sapiens
caaguauugucgguuaccucu

SEQ ID NO: 999039 - RNA, 20 nt, Homo sapiens
caagucuuuacagaaucaaa

SEQ ID NO: 999040 - RNA, 18 nt, Homo sapiens
caagugguccacaagcuu

SEQ ID NO: 999041 - RNA, 21 nt, Homo sapiens
caaguucgucuguugugcgaa

SEQ ID NO: 999042 - RNA, 17 nt, Homo sapiens
caaguuuuguggggcuu

SEQ ID NO: 999043 - RNA, 14 nt, Homo sapiens
caauaaaaguguga

SEQ ID NO: 999044 - RNA, 20 nt, Homo sapiens
caauacagaucaucuuggaa

SEQ ID NO: 999045 - RNA, 13 nt, Homo sapiens
caauauagucuuu

SEQ ID NO: 999046 - RNA, 16 nt, Homo sapiens
caauccagcuauguua

SEQ ID NO: 999047 - RNA, 13 nt, Homo sapiens
caauccuauguuu

SEQ ID NO: 999048 - RNA, 20 nt, Homo sapiens
caaucucugggggcugagga

SEQ ID NO: 999049 - RNA, 14 nt, Homo sapiens
caaugaacacuuaa

SEQ ID NO: 999050 - RNA, 16 nt, Homo sapiens
caaugaacaucccuuu

SEQ ID NO: 999051 - RNA, 15 nt, Homo sapiens
auguaggaguguuua

SEQ ID NO: 999052 - RNA, 14 nt, Homo sapiens
auguauaugcacuu

SEQ ID NO: 999053 - RNA, 15 nt, Homo sapiens
auguauggugcaaug

SEQ ID NO: 999054 - RNA, 20 nt, Homo sapiens
augucacuucccugcuuaaa

SEQ ID NO: 999055 - RNA, 12 nt, Homo sapiens
augucauuuagu

SEQ ID NO: 999056 - RNA, 11 nt, Homo sapiens
auguccaaaga

SEQ ID NO: 999057 - RNA, 13 nt, Homo sapiens
auguccaggaaag

SEQ ID NO: 999058 - RNA, 23 nt, Homo sapiens
augucccaggaaucaguuuaaaa

SEQ ID NO: 999059 - RNA, 21 nt, Homo sapiens
augucucuuuggcgaccuccu

SEQ ID NO: 999060 - RNA, 15 nt, Homo sapiens
augucuugagcucua

SEQ ID NO: 999061 - RNA, 22 nt, Homo sapiens
augucuuuuacccggcacauuc

SEQ ID NO: 999062 - RNA, 15 nt, Homo sapiens
augugaagccuuccc

SEQ ID NO: 999063 - RNA, 13 nt, Homo sapiens
augugacuacuga

SEQ ID NO: 999064 - RNA, 11 nt, Homo sapiens
augugaugaau

SEQ ID NO: 999065 - RNA, 14 nt, Homo sapiens
augugauugcagcu

SEQ ID NO: 999066 - RNA, 17 nt, Homo sapiens
augugauuuacauuuca

SEQ ID NO: 999067 - RNA, 14 nt, Homo sapiens
augugcaaguuuau

SEQ ID NO: 999068 - RNA, 20 nt, Homo sapiens
auguggcuggaagauccugc

SEQ ID NO: 999069 - RNA, 16 nt, Homo sapiens
auguguguugauacug

SEQ ID NO: 999070 - RNA, 20 nt, Homo sapiens
auguguuuuuaaggaaaaug

SEQ ID NO: 999071 - RNA, 16 nt, Homo sapiens
auguuaaaaagugaaa

SEQ ID NO: 999072 - RNA, 18 nt, Homo sapiens
auguuagccacaguguau

SEQ ID NO: 999073 - RNA, 13 nt, Homo sapiens
auguuaugugcaa

SEQ ID NO: 999074 - RNA, 21 nt, Homo sapiens
auguugaagugagcugagauu

SEQ ID NO: 999075 - RNA, 15 nt, Homo sapiens
auguuucaaauacuu

SEQ ID NO: 999076 - RNA, 20 nt, Homo sapiens
auuaaaaugacaagcacuau

SEQ ID NO: 999077 - RNA, 18 nt, Homo sapiens
auuaaaauguaugcaugu

SEQ ID NO: 999078 - RNA, 12 nt, Homo sapiens
auuaacauauag

SEQ ID NO: 999079 - RNA, 19 nt, Homo sapiens
auuaagcccaauuaauucc

SEQ ID NO: 999080 - RNA, 13 nt, Homo sapiens
auuaaucugccuc

SEQ ID NO: 999081 - RNA, 14 nt, Homo sapiens
auuacaauugugag

SEQ ID NO: 999082 - RNA, 18 nt, Homo sapiens
auuacauggggucuagaa

SEQ ID NO: 999083 - RNA, 22 nt, Homo sapiens
auuacguaugucugguucucaa

SEQ ID NO: 999084 - RNA, 20 nt, Homo sapiens
auuagaaauaaagcaucuca

SEQ ID NO: 999085 - RNA, 22 nt, Homo sapiens
auuagacagaacaccuaugcaa

SEQ ID NO: 999086 - RNA, 18 nt, Homo sapiens
auuaggcagacucuuuau

SEQ ID NO: 999087 - RNA, 21 nt, Homo sapiens
auuauaccaccagacugcaau

SEQ ID NO: 999088 - RNA, 16 nt, Homo sapiens
auuauaugcacuagca

SEQ ID NO: 999089 - RNA, 17 nt, Homo sapiens
auuauauguuguaagca

SEQ ID NO: 999090 - RNA, 15 nt, Homo sapiens
auuaucagaugcuuu

SEQ ID NO: 999091 - RNA, 17 nt, Homo sapiens
auuaucuuuucauacau

SEQ ID NO: 999092 - RNA, 20 nt, Homo sapiens
auuaugcauuauaucaaauc

SEQ ID NO: 999093 - RNA, 21 nt, Homo sapiens
auuauucugggggcugcaguu

SEQ ID NO: 999094 - RNA, 22 nt, Homo sapiens
auucaacaagagcacuacauuc

SEQ ID NO: 999095 - RNA, 14 nt, Homo sapiens
auucaacaauuuca

SEQ ID NO: 999096 - RNA, 20 nt, Homo sapiens
auucaacagagacugaauag

SEQ ID NO: 999097 - RNA, 17 nt, Homo sapiens
auucacaucgcagauuc

SEQ ID NO: 999098 - RNA, 12 nt, Homo sapiens
auucaguguuaa

SEQ ID NO: 999099 - RNA, 17 nt, Homo sapiens
auucaguuuucauuugg

SEQ ID NO: 999100 - RNA, 16 nt, Homo sapiens
auucauuguguuaccu

SEQ ID NO: 999101 - RNA, 21 nt, Homo sapiens
auucauuguguuaccuguaga

SEQ ID NO: 999102 - RNA, 20 nt, Homo sapiens
auuccaagacucuagagucc

SEQ ID NO: 999103 - RNA, 21 nt, Homo sapiens
auuccccuguagcagucacug

SEQ ID NO: 999104 - RNA, 18 nt, Homo sapiens
auuccggugccuccugaa

SEQ ID NO: 999105 - RNA, 22 nt, Homo sapiens
auuccugaccuccgccauccac

SEQ ID NO: 999106 - RNA, 21 nt, Homo sapiens
auucgaccuauaagaagccuu

SEQ ID NO: 999107 - RNA, 19 nt, Homo sapiens
auucgcuacuaugauuuaa

SEQ ID NO: 999108 - RNA, 16 nt, Homo sapiens
auucuaacaagucaua

SEQ ID NO: 999109 - RNA, 13 nt, Homo sapiens
auucuaagugaaa

SEQ ID NO: 999110 - RNA, 13 nt, Homo sapiens
auucuaguacuug

SEQ ID NO: 999111 - RNA, 17 nt, Homo sapiens
auucuauuuauauguac

SEQ ID NO: 999112 - RNA, 16 nt, Homo sapiens
auucucaucaguccau

SEQ ID NO: 999113 - RNA, 19 nt, Homo sapiens
auucucaucaguccauugc

SEQ ID NO: 999114 - RNA, 17 nt, Homo sapiens
auucucccuuucacuaa

SEQ ID NO: 999115 - RNA, 14 nt, Homo sapiens
auucuucucucuca

SEQ ID NO: 999116 - RNA, 17 nt, Homo sapiens
auucuugauguaaaauc

SEQ ID NO: 999117 - RNA, 21 nt, Homo sapiens
auugaaccuuugugcccuauc

SEQ ID NO: 999118 - RNA, 15 nt, Homo sapiens
auugaauuucacugu

SEQ ID NO: 999119 - RNA, 18 nt, Homo sapiens
auugacgacaagugcuga

SEQ ID NO: 999120 - RNA, 18 nt, Homo sapiens
auugaucgacuugccaaa

SEQ ID NO: 999121 - RNA, 16 nt, Homo sapiens
auugcagcaagcaaua

SEQ ID NO: 999122 - RNA, 23 nt, Homo sapiens
auugcgagagauguguguugaua

SEQ ID NO: 999123 - RNA, 21 nt, Homo sapiens
auugcucuugagucuuugcag

SEQ ID NO: 999124 - RNA, 18 nt, Homo sapiens
auugcuuaccugaucuca

SEQ ID NO: 999125 - RNA, 12 nt, Homo sapiens
auuggaacugga

SEQ ID NO: 999126 - RNA, 21 nt, Homo sapiens
auugguccgaucuuugacucu

SEQ ID NO: 999127 - RNA, 15 nt, Homo sapiens
auugguuuugcagaa

SEQ ID NO: 999128 - RNA, 12 nt, Homo sapiens
auuguagccuca

SEQ ID NO: 999129 - RNA, 13 nt, Homo sapiens
auuguagccucaa

SEQ ID NO: 999130 - RNA, 15 nt, Homo sapiens
auugugcaguacuuu

SEQ ID NO: 999131 - RNA, 19 nt, Homo sapiens
auuguuguaagagugauuu

SEQ ID NO: 999132 - RNA, 18 nt, Homo sapiens
auuuaaacaccuccucau

SEQ ID NO: 999133 - RNA, 19 nt, Homo sapiens
auuuaaauguaaagacaaa

SEQ ID NO: 999134 - RNA, 15 nt, Homo sapiens
auuuacaauuugaca

SEQ ID NO: 999135 - RNA, 14 nt, Homo sapiens
auuuacgcuuugau

SEQ ID NO: 999136 - RNA, 19 nt, Homo sapiens
auuuagaagccaacuauga

SEQ ID NO: 999137 - RNA, 19 nt, Homo sapiens
auuuaggagaagccaggaa

SEQ ID NO: 999138 - RNA, 12 nt, Homo sapiens
auuuaguaauag

SEQ ID NO: 999139 - RNA, 13 nt, Homo sapiens
auuuaguuucaua

SEQ ID NO: 999140 - RNA, 22 nt, Homo sapiens
auuuaucuauaauuuaccuaag

SEQ ID NO: 999141 - RNA, 15 nt, Homo sapiens
auuucaagucucuca

SEQ ID NO: 999142 - RNA, 20 nt, Homo sapiens
auuucaugauuucauuucaa

SEQ ID NO: 999143 - RNA, 13 nt, Homo sapiens
auuucauuaucau

SEQ ID NO: 999144 - RNA, 22 nt, Homo sapiens
auuucauuaucauaugaacuug

SEQ ID NO: 999145 - RNA, 15 nt, Homo sapiens
auuuccacugugcag

SEQ ID NO: 999146 - RNA, 16 nt, Homo sapiens
auuucuccuccauggg

SEQ ID NO: 999147 - RNA, 19 nt, Homo sapiens
auuucuuauuauuauaugu

SEQ ID NO: 999148 - RNA, 15 nt, Homo sapiens
auuucuucuacugcu

SEQ ID NO: 999149 - RNA, 21 nt, Homo sapiens
auuugcaagggaaaagucucu

SEQ ID NO: 999150 - RNA, 11 nt, Homo sapiens
auuugcucagg

SEQ ID NO: 999151 - RNA, 18 nt, Homo sapiens
auuugcuuuuugugauau

SEQ ID NO: 999152 - RNA, 23 nt, Homo sapiens
auuugcuuuuugugauaugcaca

SEQ ID NO: 999153 - RNA, 17 nt, Homo sapiens
auuugggagacauguga

SEQ ID NO: 999154 - RNA, 18 nt, Homo sapiens
auuugggagacaugugac

SEQ ID NO: 999155 - RNA, 23 nt, Homo sapiens
aucgcagauucucccuugcucug

SEQ ID NO: 999156 - RNA, 14 nt, Homo sapiens
aucgccuuccccac

SEQ ID NO: 999157 - RNA, 18 nt, Homo sapiens
aucgcucauagaucagca

SEQ ID NO: 999158 - RNA, 18 nt, Homo sapiens
aucuaaauguauucugca

SEQ ID NO: 999159 - RNA, 22 nt, Homo sapiens
aucuaauauggccacaguaguc

SEQ ID NO: 999160 - RNA, 14 nt, Homo sapiens
aucuacuaauucca

SEQ ID NO: 999161 - RNA, 14 nt, Homo sapiens
aucuaguucauuga

SEQ ID NO: 999162 - RNA, 22 nt, Homo sapiens
aucuaucuuaauacuaaggaac

SEQ ID NO: 999163 - RNA, 16 nt, Homo sapiens
aucucaaagaaggcau

SEQ ID NO: 999164 - RNA, 15 nt, Homo sapiens
aucucaguaccccau

SEQ ID NO: 999165 - RNA, 22 nt, Homo sapiens
aucucaugccccuggcugggac

SEQ ID NO: 999166 - RNA, 15 nt, Homo sapiens
aucucauugcuuaca

SEQ ID NO: 999167 - RNA, 20 nt, Homo sapiens
aucucauuggacccuuccau

SEQ ID NO: 999168 - RNA, 19 nt, Homo sapiens
aucugaauaaaguguaaca

SEQ ID NO: 999169 - RNA, 14 nt, Homo sapiens
aucugcaauucaaa

SEQ ID NO: 999170 - RNA, 15 nt, Homo sapiens
aucugccacaaaaac

SEQ ID NO: 999171 - RNA, 14 nt, Homo sapiens
aucugcgugacaau

SEQ ID NO: 999172 - RNA, 23 nt, Homo sapiens
aucuggcccuugcuuaccucuca

SEQ ID NO: 999173 - RNA, 20 nt, Homo sapiens
aucugggccuuggccuggag

SEQ ID NO: 999174 - RNA, 16 nt, Homo sapiens
aucuguaaaucuacac

SEQ ID NO: 999175 - RNA, 20 nt, Homo sapiens
aucuguccguucacaugugu

SEQ ID NO: 999176 - RNA, 21 nt, Homo sapiens
aucugugggucugggagucac

SEQ ID NO: 999177 - RNA, 13 nt, Homo sapiens
aucuguguauaug

SEQ ID NO: 999178 - RNA, 18 nt, Homo sapiens
aucuugcaacucuguaaa

SEQ ID NO: 999179 - RNA, 14 nt, Homo sapiens
aucuugcaccccaa

SEQ ID NO: 999180 - RNA, 18 nt, Homo sapiens
aucuugcauuaugcaauu

SEQ ID NO: 999181 - RNA, 15 nt, Homo sapiens
aucuuggaacugcau

SEQ ID NO: 999182 - RNA, 19 nt, Homo sapiens
aucuuuuuaccuuucauac

SEQ ID NO: 999183 - RNA, 13 nt, Homo sapiens
augaauuauuaca

SEQ ID NO: 999184 - RNA, 13 nt, Homo sapiens
augacaaagcaga

SEQ ID NO: 999185 - RNA, 13 nt, Homo sapiens
augacaagcacua

SEQ ID NO: 999186 - RNA, 21 nt, Homo sapiens
augacaguauuauacgcuggc

SEQ ID NO: 999187 - RNA, 14 nt, Homo sapiens
augacccuuuucau

SEQ ID NO: 999188 - RNA, 18 nt, Homo sapiens
augaccucguacucagga

SEQ ID NO: 999189 - RNA, 20 nt, Homo sapiens
augacugcuugcccuaagca

SEQ ID NO: 999190 - RNA, 22 nt, Homo sapiens
augagaauuugagugcucugau

SEQ ID NO: 999191 - RNA, 13 nt, Homo sapiens
augagccaugaga

SEQ ID NO: 999192 - RNA, 20 nt, Homo sapiens
augaggcuuggggcuggaga

SEQ ID NO: 999193 - RNA, 21 nt, Homo sapiens
augaguaacauuugcuguuuu

SEQ ID NO: 999194 - RNA, 18 nt, Homo sapiens
augagucccuguccccac

SEQ ID NO: 999195 - RNA, 13 nt, Homo sapiens
augauaccaccuu

SEQ ID NO: 999196 - RNA, 12 nt, Homo sapiens
augaugaucugg

SEQ ID NO: 999197 - RNA, 20 nt, Homo sapiens
augauggcagccauagugca

SEQ ID NO: 999198 - RNA, 15 nt, Homo sapiens
augauuucaguucua

SEQ ID NO: 999199 - RNA, 15 nt, Homo sapiens
augcacugauguugu

SEQ ID NO: 999200 - RNA, 17 nt, Homo sapiens
augcagagccacagcug

SEQ ID NO: 999201 - RNA, 22 nt, Homo sapiens
augcagcucaagagaucccaag

SEQ ID NO: 999202 - RNA, 14 nt, Homo sapiens
augcauaaaugcga

SEQ ID NO: 999203 - RNA, 21 nt, Homo sapiens
augcauggugccccaggacca

SEQ ID NO: 999204 - RNA, 19 nt, Homo sapiens
augcaugguuucagcacua

SEQ ID NO: 999205 - RNA, 22 nt, Homo sapiens
augcaugguuucagcacuagcc

SEQ ID NO: 999206 - RNA, 16 nt, Homo sapiens
augccacagcccuguc

SEQ ID NO: 999207 - RNA, 17 nt, Homo sapiens
augccacagcccuguca

SEQ ID NO: 999208 - RNA, 20 nt, Homo sapiens
augccagccaagcucugcag

SEQ ID NO: 999209 - RNA, 22 nt, Homo sapiens
augccaguaacgcgucuuccug

SEQ ID NO: 999210 - RNA, 15 nt, Homo sapiens
augccccaucccaug

SEQ ID NO: 999211 - RNA, 19 nt, Homo sapiens
augcccuguaccugugcac

SEQ ID NO: 999212 - RNA, 17 nt, Homo sapiens
augcccuucacugucac

SEQ ID NO: 999213 - RNA, 22 nt, Homo sapiens
augccgauauacucuagaugaa

SEQ ID NO: 999214 - RNA, 13 nt, Homo sapiens
augccguggauug

SEQ ID NO: 999215 - RNA, 18 nt, Homo sapiens
augccuacugaguagggg

SEQ ID NO: 999216 - RNA, 17 nt, Homo sapiens
augccucucuacagucu

SEQ ID NO: 999217 - RNA, 12 nt, Homo sapiens
augccucugagg

SEQ ID NO: 999218 - RNA, 20 nt, Homo sapiens
augcgguagccagcacacag

SEQ ID NO: 999219 - RNA, 19 nt, Homo sapiens
augcugaaaaaucauccaa

SEQ ID NO: 999220 - RNA, 20 nt, Homo sapiens
augcugcuggggaagacagu

SEQ ID NO: 999221 - RNA, 22 nt, Homo sapiens
augcugcuggggaagacagugg

SEQ ID NO: 999222 - RNA, 23 nt, Homo sapiens
augcugcuggggaagacaguggc

SEQ ID NO: 999223 - RNA, 14 nt, Homo sapiens
augcuuauuccaug

SEQ ID NO: 999224 - RNA, 22 nt, Homo sapiens
augcuucuauaauuuugccuuu

SEQ ID NO: 999225 - RNA, 14 nt, Homo sapiens
auggaacacggcca

SEQ ID NO: 999226 - RNA, 15 nt, Homo sapiens
auggaauaguuuugu

SEQ ID NO: 999227 - RNA, 13 nt, Homo sapiens
auggacaauggac

SEQ ID NO: 999228 - RNA, 15 nt, Homo sapiens
auggacaucuuguca

SEQ ID NO: 999229 - RNA, 16 nt, Homo sapiens
auggacaucuugucau

SEQ ID NO: 999230 - RNA, 18 nt, Homo sapiens
auggacaucuugucauuu

SEQ ID NO: 999231 - RNA, 15 nt, Homo sapiens
auggagaccgugacc

SEQ ID NO: 999232 - RNA, 15 nt, Homo sapiens
auggaggaacuuucc

SEQ ID NO: 999233 - RNA, 11 nt, Homo sapiens
auggaucacaa

SEQ ID NO: 999234 - RNA, 21 nt, Homo sapiens
auggaugggggaacucagauc

SEQ ID NO: 999235 - RNA, 16 nt, Homo sapiens
auggauuucuuugaaa

SEQ ID NO: 999236 - RNA, 22 nt, Homo sapiens
auggauuuugggagugacucaa

SEQ ID NO: 999237 - RNA, 14 nt, Homo sapiens
auggcauccaagac

SEQ ID NO: 999238 - RNA, 18 nt, Homo sapiens
auggcaugagaaauacaa

SEQ ID NO: 999239 - RNA, 17 nt, Homo sapiens
auggcccugcaaaagga

SEQ ID NO: 999240 - RNA, 17 nt, Homo sapiens
auggccugcaaacuggg

SEQ ID NO: 999241 - RNA, 19 nt, Homo sapiens
auggcguaaguacagagaa

SEQ ID NO: 999242 - RNA, 20 nt, Homo sapiens
auggcucuaacaaugacauu

SEQ ID NO: 999243 - RNA, 17 nt, Homo sapiens
augggaaccccuucauc

SEQ ID NO: 999244 - RNA, 13 nt, Homo sapiens
augggacauucca

SEQ ID NO: 999245 - RNA, 16 nt, Homo sapiens
auggggaaaaaacugu

SEQ ID NO: 999246 - RNA, 22 nt, Homo sapiens
auggggaagguuaucagugcuu

SEQ ID NO: 999247 - RNA, 18 nt, Homo sapiens
auggggccagucaggccc

SEQ ID NO: 999248 - RNA, 21 nt, Homo sapiens
auggggugcaccuguccaaua

SEQ ID NO: 999249 - RNA, 20 nt, Homo sapiens
auggucugcccucugcaucc

SEQ ID NO: 999250 - RNA, 21 nt, Homo sapiens
auggugagagauaagaucuau

SEQ ID NO: 999251 - RNA, 22 nt, Homo sapiens
auggugccccaggaccagcuca

SEQ ID NO: 999252 - RNA, 23 nt, Homo sapiens
auguaaagaaaaaagcaccaaag

SEQ ID NO: 999253 - RNA, 22 nt, Homo sapiens
auguaaauuaucaggcaaauuu

SEQ ID NO: 999254 - RNA, 11 nt, Homo sapiens
auguacaugag

SEQ ID NO: 999255 - RNA, 18 nt, Homo sapiens
auguagacuuuugcuuua

SEQ ID NO: 999256 - RNA, 16 nt, Homo sapiens
auguagcucuuuguca

SEQ ID NO: 999257 - RNA, 20 nt, Homo sapiens
auguagcucuuugucaggga

SEQ ID NO: 999258 - RNA, 17 nt, Homo sapiens
auaagaaagaucaaaga

SEQ ID NO: 999259 - RNA, 14 nt, Homo sapiens
auaagaaagccuga

SEQ ID NO: 999260 - RNA, 14 nt, Homo sapiens
auaagacuacugaa

SEQ ID NO: 999261 - RNA, 15 nt, Homo sapiens
auaagaggauaugaa

SEQ ID NO: 999262 - RNA, 17 nt, Homo sapiens
auaagcucccagggccu

SEQ ID NO: 999263 - RNA, 19 nt, Homo sapiens
auaagguaaaaugccauga

SEQ ID NO: 999264 - RNA, 24 nt, Homo sapiens
auaauauccagccucccacaagaa

SEQ ID NO: 999265 - RNA, 15 nt, Homo sapiens
auaaucacucuaauu

SEQ ID NO: 999266 - RNA, 16 nt, Homo sapiens
auaauguuacauuauu

SEQ ID NO: 999267 - RNA, 17 nt, Homo sapiens
auaauguuacauuauua

SEQ ID NO: 999268 - RNA, 21 nt, Homo sapiens
auaauguuacauuauuaucaa

SEQ ID NO: 999269 - RNA, 14 nt, Homo sapiens
auaauucacuguac

SEQ ID NO: 999270 - RNA, 14 nt, Homo sapiens
auaauucucugucu

SEQ ID NO: 999271 - RNA, 17 nt, Homo sapiens
auacaaaaauacucaga

SEQ ID NO: 999272 - RNA, 13 nt, Homo sapiens
auacaaauggauu

SEQ ID NO: 999273 - RNA, 14 nt, Homo sapiens
auacaaucauguga

SEQ ID NO: 999274 - RNA, 11 nt, Homo sapiens
auacacugugu

SEQ ID NO: 999275 - RNA, 13 nt, Homo sapiens
auaccaccuuuac

SEQ ID NO: 999276 - RNA, 16 nt, Homo sapiens
auaccaccuuuacugu

SEQ ID NO: 999277 - RNA, 19 nt, Homo sapiens
auaccuguguuucuugccu

SEQ ID NO: 999278 - RNA, 22 nt, Homo sapiens
auaccuguguuucuugccucau

SEQ ID NO: 999279 - RNA, 15 nt, Homo sapiens
auacgugcacagggu

SEQ ID NO: 999280 - RNA, 15 nt, Homo sapiens
auacuagauguuaag

SEQ ID NO: 999281 - RNA, 22 nt, Homo sapiens
auacuauuuaaagccuccucau

SEQ ID NO: 999282 - RNA, 23 nt, Homo sapiens
auacucagguaccucuuucaggg

SEQ ID NO: 999283 - RNA, 23 nt, Homo sapiens
auacucuagaugaaguuuuacau

SEQ ID NO: 999284 - RNA, 22 nt, Homo sapiens
auacuguaggcacacuuugcac

SEQ ID NO: 999285 - RNA, 12 nt, Homo sapiens
auacuguugcac

SEQ ID NO: 999286 - RNA, 20 nt, Homo sapiens
auacuucuuguguguaugca

SEQ ID NO: 999287 - RNA, 17 nt, Homo sapiens
auacuugaagggccaga

SEQ ID NO: 999288 - RNA, 17 nt, Homo sapiens
auacuuggagggcccag

SEQ ID NO: 999289 - RNA, 19 nt, Homo sapiens
auacuuggaugcagcucuu

SEQ ID NO: 999290 - RNA, 18 nt, Homo sapiens
auacuuucuguucuccag

SEQ ID NO: 999291 - RNA, 15 nt, Homo sapiens
auagaaaaguauguu

SEQ ID NO: 999292 - RNA, 19 nt, Homo sapiens
auagaauuauaacuggaaa

SEQ ID NO: 999293 - RNA, 12 nt, Homo sapiens
auagacaaauag

SEQ ID NO: 999294 - RNA, 18 nt, Homo sapiens
auagaggauggucuuaca

SEQ ID NO: 999295 - RNA, 23 nt, Homo sapiens
auagaucagcaaaccggggccua

SEQ ID NO: 999296 - RNA, 22 nt, Homo sapiens
auagaugcuggcccagggccca

SEQ ID NO: 999297 - RNA, 16 nt, Homo sapiens
auagcaaauggccuca

SEQ ID NO: 999298 - RNA, 22 nt, Homo sapiens
auagcagccuuucucucuuuau

SEQ ID NO: 999299 - RNA, 18 nt, Homo sapiens
auagcccaucaagcuccu

SEQ ID NO: 999300 - RNA, 12 nt, Homo sapiens
auagcugugacu

SEQ ID NO: 999301 - RNA, 15 nt, Homo sapiens
auaguggaucacuca

SEQ ID NO: 999302 - RNA, 22 nt, Homo sapiens
auagugucauccucacagugaa

SEQ ID NO: 999303 - RNA, 15 nt, Homo sapiens
auaguuacuguguaa

SEQ ID NO: 999304 - RNA, 21 nt, Homo sapiens
auaguucuaggcacuguaguu

SEQ ID NO: 999305 - RNA, 12 nt, Homo sapiens
auauacuuugaa

SEQ ID NO: 999306 - RNA, 13 nt, Homo sapiens
auauauaaucauc

SEQ ID NO: 999307 - RNA, 14 nt, Homo sapiens
auauauacuauuaa

SEQ ID NO: 999308 - RNA, 23 nt, Homo sapiens
auauaugauauauaaaugugauu

SEQ ID NO: 999309 - RNA, 18 nt, Homo sapiens
auaucaaaucuaccacug

SEQ ID NO: 999310 - RNA, 13 nt, Homo sapiens
auaucaacacuug

SEQ ID NO: 999311 - RNA, 22 nt, Homo sapiens
auaucacccagacauaaaggaa

SEQ ID NO: 999312 - RNA, 14 nt, Homo sapiens
auaucccuaccuug

SEQ ID NO: 999313 - RNA, 13 nt, Homo sapiens
auaucgaucucuu

SEQ ID NO: 999314 - RNA, 17 nt, Homo sapiens
auaugaaugucaguagu

SEQ ID NO: 999315 - RNA, 20 nt, Homo sapiens
auauggggaaaaaacugugc

SEQ ID NO: 999316 - RNA, 14 nt, Homo sapiens
auauguaccaugua

SEQ ID NO: 999317 - RNA, 12 nt, Homo sapiens
auauguaugggu

SEQ ID NO: 999318 - RNA, 15 nt, Homo sapiens
auauuagaaagggaa

SEQ ID NO: 999319 - RNA, 13 nt, Homo sapiens
auauuauacuugu

SEQ ID NO: 999320 - RNA, 13 nt, Homo sapiens
auauuaugagaug

SEQ ID NO: 999321 - RNA, 14 nt, Homo sapiens
auauugacuuguau

SEQ ID NO: 999322 - RNA, 19 nt, Homo sapiens
auauuugggccugcuccag

SEQ ID NO: 999323 - RNA, 17 nt, Homo sapiens
auauuuuagcauuuuaa

SEQ ID NO: 999324 - RNA, 15 nt, Homo sapiens
auauuuucaccauuu

SEQ ID NO: 999325 - RNA, 22 nt, Homo sapiens
aucaaaugugacauuauaugca

SEQ ID NO: 999326 - RNA, 15 nt, Homo sapiens
aucaacauuucucaa

SEQ ID NO: 999327 - RNA, 18 nt, Homo sapiens
aucaaccaaacaaagaaa

SEQ ID NO: 999328 - RNA, 15 nt, Homo sapiens
aucaacuaaugauuu

SEQ ID NO: 999329 - RNA, 11 nt, Homo sapiens
aucaaguaaua

SEQ ID NO: 999330 - RNA, 12 nt, Homo sapiens
aucaauguuucu

SEQ ID NO: 999331 - RNA, 19 nt, Homo sapiens
aucacacugggugguggcc

SEQ ID NO: 999332 - RNA, 16 nt, Homo sapiens
aucacaucacacaaaa

SEQ ID NO: 999333 - RNA, 22 nt, Homo sapiens
aucacuuaaacuugcaucacuu

SEQ ID NO: 999334 - RNA, 23 nt, Homo sapiens
aucagcuauuuugugaagccaug

SEQ ID NO: 999335 - RNA, 19 nt, Homo sapiens
aucagcucuugaugccuuu

SEQ ID NO: 999336 - RNA, 15 nt, Homo sapiens
aucaggacccagagg

SEQ ID NO: 999337 - RNA, 21 nt, Homo sapiens
aucagugaagccaaagggacu

SEQ ID NO: 999338 - RNA, 16 nt, Homo sapiens
aucauaagaauagcug

SEQ ID NO: 999339 - RNA, 23 nt, Homo sapiens
aucauauaauaaauguacauuaa

SEQ ID NO: 999340 - RNA, 23 nt, Homo sapiens
aucaucaacuaccauucuauucc

SEQ ID NO: 999341 - RNA, 14 nt, Homo sapiens
aucauccaagacag

SEQ ID NO: 999342 - RNA, 18 nt, Homo sapiens
aucaucuccugccuuccu

SEQ ID NO: 999343 - RNA, 14 nt, Homo sapiens
aucauguguguuaa

SEQ ID NO: 999344 - RNA, 17 nt, Homo sapiens
aucauucaaguguaaaa

SEQ ID NO: 999345 - RNA, 16 nt, Homo sapiens
aucauucucauucuca

SEQ ID NO: 999346 - RNA, 18 nt, Homo sapiens
auccaauggguuuuuccc

SEQ ID NO: 999347 - RNA, 20 nt, Homo sapiens
auccacacaugaaucugcac

SEQ ID NO: 999348 - RNA, 15 nt, Homo sapiens
auccaggcagaucca

SEQ ID NO: 999349 - RNA, 22 nt, Homo sapiens
auccaguuuugucaaugcaguu

SEQ ID NO: 999350 - RNA, 18 nt, Homo sapiens
auccaugcaccuaccuua

SEQ ID NO: 999351 - RNA, 22 nt, Homo sapiens
auccccuaagcagaccacugau

SEQ ID NO: 999352 - RNA, 19 nt, Homo sapiens
aucccgucuucuccaacac

SEQ ID NO: 999353 - RNA, 14 nt, Homo sapiens
aucccuacauguau

SEQ ID NO: 999354 - RNA, 14 nt, Homo sapiens
aucccuccaucuca

SEQ ID NO: 999355 - RNA, 15 nt, Homo sapiens
aucccuccaucucaa

SEQ ID NO: 999356 - RNA, 15 nt, Homo sapiens
aucccuucauacuug

SEQ ID NO: 999357 - RNA, 23 nt, Homo sapiens
auccuaggcugacaccuaacucu

SEQ ID NO: 999358 - RNA, 20 nt, Homo sapiens
auccucacagugaacacuca

SEQ ID NO: 999359 - RNA, 21 nt, Homo sapiens
auccuuccacuaucauuccca

SEQ ID NO: 999360 - RNA, 13 nt, Homo sapiens
auccuuuacuguu

SEQ ID NO: 999361 - RNA, 15 nt, Homo sapiens
auccuuuacuguuag

SEQ ID NO: 999362 - RNA, 15 nt, Homo sapiens
aguacuuguaguucc

SEQ ID NO: 999363 - RNA, 10 nt, Homo sapiens
aguagcugag

SEQ ID NO: 999364 - RNA, 19 nt, Homo sapiens
aguauaaaugaauuugcau

SEQ ID NO: 999365 - RNA, 18 nt, Homo sapiens
aguauaagcaucugccau

SEQ ID NO: 999366 - RNA, 20 nt, Homo sapiens
aguauggcuccuccauaucu

SEQ ID NO: 999367 - RNA, 18 nt, Homo sapiens
aguauuaaaauguaugca

SEQ ID NO: 999368 - RNA, 14 nt, Homo sapiens
aguauuaucagaug

SEQ ID NO: 999369 - RNA, 16 nt, Homo sapiens
aguauucaugacuaug

SEQ ID NO: 999370 - RNA, 17 nt, Homo sapiens
aguauugucgguuaccu

SEQ ID NO: 999371 - RNA, 21 nt, Homo sapiens
aguauuuuagugaacuugaaa

SEQ ID NO: 999372 - RNA, 22 nt, Homo sapiens
aguauuuuuuaauccuaccuca

SEQ ID NO: 999373 - RNA, 17 nt, Homo sapiens
agucaaaacuacaaauc

SEQ ID NO: 999374 - RNA, 12 nt, Homo sapiens
agucacacagug

SEQ ID NO: 999375 - RNA, 16 nt, Homo sapiens
agucacgcaugcagug

SEQ ID NO: 999376 - RNA, 20 nt, Homo sapiens
agucacggcugcgcacugug

SEQ ID NO: 999377 - RNA, 21 nt, Homo sapiens
agucacggcugcgcacugugu

SEQ ID NO: 999378 - RNA, 17 nt, Homo sapiens
agucacucuagucaaug

SEQ ID NO: 999379 - RNA, 19 nt, Homo sapiens
agucacucuuaugcuguac

SEQ ID NO: 999380 - RNA, 21 nt, Homo sapiens
agucaggaauggcugcaccuu

SEQ ID NO: 999381 - RNA, 19 nt, Homo sapiens
agucagggcaugcuuuauu

SEQ ID NO: 999382 - RNA, 18 nt, Homo sapiens
agucauauauaucaccca

SEQ ID NO: 999383 - RNA, 19 nt, Homo sapiens
agucauuugcugagcaugu

SEQ ID NO: 999384 - RNA, 15 nt, Homo sapiens
aguccaccugaggaa

SEQ ID NO: 999385 - RNA, 16 nt, Homo sapiens
aguccaccugaggaac

SEQ ID NO: 999386 - RNA, 21 nt, Homo sapiens
aguccaccugaggaacugucu

SEQ ID NO: 999387 - RNA, 13 nt, Homo sapiens
agucccucccuca

SEQ ID NO: 999388 - RNA, 14 nt, Homo sapiens
agucccucccucac

SEQ ID NO: 999389 - RNA, 20 nt, Homo sapiens
agucccuguccccaccucca

SEQ ID NO: 999390 - RNA, 23 nt, Homo sapiens
agucccuuuaugcagagccacag

SEQ ID NO: 999391 - RNA, 19 nt, Homo sapiens
aguccggccccaguacaca

SEQ ID NO: 999392 - RNA, 20 nt, Homo sapiens
aguccugcgaaaacccccaa

SEQ ID NO: 999393 - RNA, 15 nt, Homo sapiens
agucguucccagugu

SEQ ID NO: 999394 - RNA, 21 nt, Homo sapiens
agucuaaagauggaguuucua

SEQ ID NO: 999395 - RNA, 16 nt, Homo sapiens
agucucucacccucau

SEQ ID NO: 999396 - RNA, 14 nt, Homo sapiens
agucugaaccuauu

SEQ ID NO: 999397 - RNA, 20 nt, Homo sapiens
agucugucgauuuaugccuc

SEQ ID NO: 999398 - RNA, 11 nt, Homo sapiens
agucugugaaa

SEQ ID NO: 999399 - RNA, 13 nt, Homo sapiens
agugaacuugaaa

SEQ ID NO: 999400 - RNA, 16 nt, Homo sapiens
agugaaguugcugcuu

SEQ ID NO: 999401 - RNA, 18 nt, Homo sapiens
agugacagcagucaggga

SEQ ID NO: 999402 - RNA, 19 nt, Homo sapiens
agugacccacaugccauuu

SEQ ID NO: 999403 - RNA, 15 nt, Homo sapiens
agugacuucugagau

SEQ ID NO: 999404 - RNA, 17 nt, Homo sapiens
agugagggcucacucag

SEQ ID NO: 999405 - RNA, 20 nt, Homo sapiens
agugagggcucacucagcca

SEQ ID NO: 999406 - RNA, 12 nt, Homo sapiens
agugauguaauc

SEQ ID NO: 999407 - RNA, 13 nt, Homo sapiens
agugcagugccac

SEQ ID NO: 999408 - RNA, 15 nt, Homo sapiens
agugcccugauccca

SEQ ID NO: 999409 - RNA, 20 nt, Homo sapiens
aguggcgcgaucucggcuca

SEQ ID NO: 999410 - RNA, 19 nt, Homo sapiens
agugggggugggggguccc

SEQ ID NO: 999411 - RNA, 20 nt, Homo sapiens
agugguccacaagcuucugu

SEQ ID NO: 999412 - RNA, 12 nt, Homo sapiens
aguggugcaauc

SEQ ID NO: 999413 - RNA, 19 nt, Homo sapiens
agugguuucuugugcacug

SEQ ID NO: 999414 - RNA, 13 nt, Homo sapiens
agugucaacucuu

SEQ ID NO: 999415 - RNA, 21 nt, Homo sapiens
aguguggcugaggccacccag

SEQ ID NO: 999416 - RNA, 22 nt, Homo sapiens
aguguugcccaggcuggucuca

SEQ ID NO: 999417 - RNA, 23 nt, Homo sapiens
aguguugcccaggcuggucucaa

SEQ ID NO: 999418 - RNA, 20 nt, Homo sapiens
aguguugucaccagaucuga

SEQ ID NO: 999419 - RNA, 13 nt, Homo sapiens
aguuaauccacug

SEQ ID NO: 999420 - RNA, 12 nt, Homo sapiens
aguuaccauuaa

SEQ ID NO: 999421 - RNA, 15 nt, Homo sapiens
aguucacauacaaau

SEQ ID NO: 999422 - RNA, 15 nt, Homo sapiens
aguucacuguagaaa

SEQ ID NO: 999423 - RNA, 19 nt, Homo sapiens
aguucaugcagcuguggca

SEQ ID NO: 999424 - RNA, 20 nt, Homo sapiens
aguuccaagagucuaaagau

SEQ ID NO: 999425 - RNA, 19 nt, Homo sapiens
aguucuaaccuccuaagca

SEQ ID NO: 999426 - RNA, 16 nt, Homo sapiens
aguucuaagauucuga

SEQ ID NO: 999427 - RNA, 21 nt, Homo sapiens
aguucucauggguggcacuca

SEQ ID NO: 999428 - RNA, 23 nt, Homo sapiens
aguucucccuguacaguguuacc

SEQ ID NO: 999429 - RNA, 17 nt, Homo sapiens
aguucugggcccagcgc

SEQ ID NO: 999430 - RNA, 20 nt, Homo sapiens
aguugaagcugacucaaaaa

SEQ ID NO: 999431 - RNA, 21 nt, Homo sapiens
aguugaucuggaacccagacu

SEQ ID NO: 999432 - RNA, 13 nt, Homo sapiens
aguugcagucacu

SEQ ID NO: 999433 - RNA, 16 nt, Homo sapiens
aguugcugaugaacuc

SEQ ID NO: 999434 - RNA, 13 nt, Homo sapiens
aguugcuuuucag

SEQ ID NO: 999435 - RNA, 16 nt, Homo sapiens
aguugcuuuucagcug

SEQ ID NO: 999436 - RNA, 15 nt, Homo sapiens
aguuggagucacucu

SEQ ID NO: 999437 - RNA, 23 nt, Homo sapiens
aguugucccgauuguaacucaaa

SEQ ID NO: 999438 - RNA, 19 nt, Homo sapiens
aguuuagauuuuaaucaaa

SEQ ID NO: 999439 - RNA, 15 nt, Homo sapiens
aguuuauacuucucu

SEQ ID NO: 999440 - RNA, 21 nt, Homo sapiens
aguuucauguacaagaugaag

SEQ ID NO: 999441 - RNA, 18 nt, Homo sapiens
aguuuccuaugggaacaa

SEQ ID NO: 999442 - RNA, 21 nt, Homo sapiens
aguuuccuaugggaacaauug

SEQ ID NO: 999443 - RNA, 23 nt, Homo sapiens
aguuuccuugggaguugucauua

SEQ ID NO: 999444 - RNA, 16 nt, Homo sapiens
aguuucuaagauucua

SEQ ID NO: 999445 - RNA, 17 nt, Homo sapiens
aguuucuggcucuugag

SEQ ID NO: 999446 - RNA, 14 nt, Homo sapiens
aguuugagggagaa

SEQ ID NO: 999447 - RNA, 15 nt, Homo sapiens
aguuugggaggcuga

SEQ ID NO: 999448 - RNA, 21 nt, Homo sapiens
aguuuuuaauuuaucagagac

SEQ ID NO: 999449 - RNA, 14 nt, Homo sapiens
auaaaaaugagugc

SEQ ID NO: 999450 - RNA, 20 nt, Homo sapiens
auaaaacaucuuugaaauua

SEQ ID NO: 999451 - RNA, 16 nt, Homo sapiens
auaaaagacuauucua

SEQ ID NO: 999452 - RNA, 17 nt, Homo sapiens
auaaacccaguugccau

SEQ ID NO: 999453 - RNA, 18 nt, Homo sapiens
auaaagcuauguauauaa

SEQ ID NO: 999454 - RNA, 18 nt, Homo sapiens
auaaauacugcaaaucag

SEQ ID NO: 999455 - RNA, 16 nt, Homo sapiens
auaaauauauauucua

SEQ ID NO: 999456 - RNA, 14 nt, Homo sapiens
auaaaucuuccuaa

SEQ ID NO: 999457 - RNA, 16 nt, Homo sapiens
auaaauguaccagaga

SEQ ID NO: 999458 - RNA, 12 nt, Homo sapiens
auaaauguaucu

SEQ ID NO: 999459 - RNA, 22 nt, Homo sapiens
auaaaugucuuuaaugcaauau

SEQ ID NO: 999460 - RNA, 20 nt, Homo sapiens
auaacccacuuuaaaauauc

SEQ ID NO: 999461 - RNA, 22 nt, Homo sapiens
auaacuaggaaauccauucaca

SEQ ID NO: 999462 - RNA, 16 nt, Homo sapiens
auaacugaacauccaa

SEQ ID NO: 999463 - RNA, 19 nt, Homo sapiens
auaacuggaaaacagaaca

SEQ ID NO: 999464 - RNA, 23 nt, Homo sapiens
auaacuggaaaacagaacacuua

SEQ ID NO: 999465 - RNA, 22 nt, Homo sapiens
aggaagucauccagucuauuca

SEQ ID NO: 999466 - RNA, 19 nt, Homo sapiens
aggacccaggaggugugau

SEQ ID NO: 999467 - RNA, 22 nt, Homo sapiens
aggacccugaaggggccaugau

SEQ ID NO: 999468 - RNA, 16 nt, Homo sapiens
aggaccuccuaccccc

SEQ ID NO: 999469 - RNA, 17 nt, Homo sapiens
aggaccugagaccugaa

SEQ ID NO: 999470 - RNA, 15 nt, Homo sapiens
aggaccuuuccacca

SEQ ID NO: 999471 - RNA, 15 nt, Homo sapiens
aggacuaacacucag

SEQ ID NO: 999472 - RNA, 13 nt, Homo sapiens
aggacuugaaccc

SEQ ID NO: 999473 - RNA, 15 nt, Homo sapiens
aggacuugaacccag

SEQ ID NO: 999474 - RNA, 22 nt, Homo sapiens
aggagaaaacaauuccuuagaa

SEQ ID NO: 999475 - RNA, 15 nt, Homo sapiens
aggagauuccuuucc

SEQ ID NO: 999476 - RNA, 19 nt, Homo sapiens
aggagccaccaguucucau

SEQ ID NO: 999477 - RNA, 18 nt, Homo sapiens
aggagcccacgacacugc

SEQ ID NO: 999478 - RNA, 18 nt, Homo sapiens
aggaggagggaggccagg

SEQ ID NO: 999479 - RNA, 22 nt, Homo sapiens
aggagggggucguggagagcua

SEQ ID NO: 999480 - RNA, 22 nt, Homo sapiens
aggauugaaaauguccaggaaa

SEQ ID NO: 999481 - RNA, 14 nt, Homo sapiens
aggcaacauccaaa

SEQ ID NO: 999482 - RNA, 12 nt, Homo sapiens
aggcacaguggc

SEQ ID NO: 999483 - RNA, 16 nt, Homo sapiens
aggcacgucugcagaa

SEQ ID NO: 999484 - RNA, 22 nt, Homo sapiens
aggcacuguaguucuaagacuc

SEQ ID NO: 999485 - RNA, 15 nt, Homo sapiens
aggcagacucuuuau

SEQ ID NO: 999486 - RNA, 22 nt, Homo sapiens
aggcagaggcccaggcugccgu

SEQ ID NO: 999487 - RNA, 21 nt, Homo sapiens
aggcagccuggaccacuccuc

SEQ ID NO: 999488 - RNA, 21 nt, Homo sapiens
aggcaggggcuuccuggugcu

SEQ ID NO: 999489 - RNA, 18 nt, Homo sapiens
aggcaggucugaagcuca

SEQ ID NO: 999490 - RNA, 22 nt, Homo sapiens
aggcagugacagcagucaggga

SEQ ID NO: 999491 - RNA, 19 nt, Homo sapiens
aggcauaagaaaacuaaga

SEQ ID NO: 999492 - RNA, 19 nt, Homo sapiens
aggcaugagccacugcacu

SEQ ID NO: 999493 - RNA, 22 nt, Homo sapiens
aggcauggucugcccucugcau

SEQ ID NO: 999494 - RNA, 21 nt, Homo sapiens
aggcauucuggaccucugggu

SEQ ID NO: 999495 - RNA, 20 nt, Homo sapiens
aggccaaaggggaccuggaa

SEQ ID NO: 999496 - RNA, 14 nt, Homo sapiens
aggccccaugaccu

SEQ ID NO: 999497 - RNA, 16 nt, Homo sapiens
aggccccaugaccucc

SEQ ID NO: 999498 - RNA, 16 nt, Homo sapiens
aggcccccacuugccu

SEQ ID NO: 999499 - RNA, 15 nt, Homo sapiens
aggcccgcucuacau

SEQ ID NO: 999500 - RNA, 17 nt, Homo sapiens
aggccucaccauuccaa

SEQ ID NO: 999501 - RNA, 15 nt, Homo sapiens
aggccucuguggcac

SEQ ID NO: 999502 - RNA, 15 nt, Homo sapiens
aggccuggauaauau

SEQ ID NO: 999503 - RNA, 21 nt, Homo sapiens
aggccugggccgcugccacgu

SEQ ID NO: 999504 - RNA, 15 nt, Homo sapiens
aggccuguacagaug

SEQ ID NO: 999505 - RNA, 15 nt, Homo sapiens
aggccuguguagcug

SEQ ID NO: 999506 - RNA, 17 nt, Homo sapiens
aggccuguguagcugug

SEQ ID NO: 999507 - RNA, 16 nt, Homo sapiens
aggcgcuguucuugcu

SEQ ID NO: 999508 - RNA, 20 nt, Homo sapiens
aggcgugagccaccaugccc

SEQ ID NO: 999509 - RNA, 12 nt, Homo sapiens
aggcuacagaga

SEQ ID NO: 999510 - RNA, 13 nt, Homo sapiens
aggcuacagagaa

SEQ ID NO: 999511 - RNA, 21 nt, Homo sapiens
aggcuacagagaagccuucaa

SEQ ID NO: 999512 - RNA, 19 nt, Homo sapiens
aggcucaggucccuggggc

SEQ ID NO: 999513 - RNA, 21 nt, Homo sapiens
aggcucucgcacaccucugca

SEQ ID NO: 999514 - RNA, 15 nt, Homo sapiens
aggcugccccucuca

SEQ ID NO: 999515 - RNA, 20 nt, Homo sapiens
aggcuggaagauagcuguga

SEQ ID NO: 999516 - RNA, 17 nt, Homo sapiens
aggcuggagugcagugc

SEQ ID NO: 999517 - RNA, 20 nt, Homo sapiens
aggcuggagugcagugccac

SEQ ID NO: 999518 - RNA, 17 nt, Homo sapiens
aggcuggcacaggacau

SEQ ID NO: 999519 - RNA, 15 nt, Homo sapiens
aggcuggccagucca

SEQ ID NO: 999520 - RNA, 20 nt, Homo sapiens
aggcuggcuccagaugcagg

SEQ ID NO: 999521 - RNA, 22 nt, Homo sapiens
aggcugggaacucaucugguug

SEQ ID NO: 999522 - RNA, 17 nt, Homo sapiens
aggcuuguugugcuuuu

SEQ ID NO: 999523 - RNA, 12 nt, Homo sapiens
agggaaaacugc

SEQ ID NO: 999524 - RNA, 13 nt, Homo sapiens
agggaaaacugca

SEQ ID NO: 999525 - RNA, 22 nt, Homo sapiens
agggaagcugucccucacuguu

SEQ ID NO: 999526 - RNA, 21 nt, Homo sapiens
agggaccacacccuguacugu

SEQ ID NO: 999527 - RNA, 16 nt, Homo sapiens
agggacgccugggggu

SEQ ID NO: 999528 - RNA, 19 nt, Homo sapiens
agggacugaccagcagcuu

SEQ ID NO: 999529 - RNA, 16 nt, Homo sapiens
agggaggccgaagcua

SEQ ID NO: 999530 - RNA, 14 nt, Homo sapiens
agggcaaagccagg

SEQ ID NO: 999531 - RNA, 15 nt, Homo sapiens
agggcacaggagcua

SEQ ID NO: 999532 - RNA, 14 nt, Homo sapiens
agggcccguguaaa

SEQ ID NO: 999533 - RNA, 19 nt, Homo sapiens
agggcggugaacucuggcu

SEQ ID NO: 999534 - RNA, 16 nt, Homo sapiens
aggggaaccccggggu

SEQ ID NO: 999535 - RNA, 20 nt, Homo sapiens
aggggcuguguuuccaucuc

SEQ ID NO: 999536 - RNA, 20 nt, Homo sapiens
agggggagcaaaucgugccu

SEQ ID NO: 999537 - RNA, 19 nt, Homo sapiens
agggggucccuccaagugg

SEQ ID NO: 999538 - RNA, 13 nt, Homo sapiens
agggggucuggcu

SEQ ID NO: 999539 - RNA, 22 nt, Homo sapiens
agggguuccuccccuccagcuc

SEQ ID NO: 999540 - RNA, 18 nt, Homo sapiens
agggguuggauugcaaua

SEQ ID NO: 999541 - RNA, 15 nt, Homo sapiens
agggucccucugugu

SEQ ID NO: 999542 - RNA, 23 nt, Homo sapiens
agggugacccugaagugagcaca

SEQ ID NO: 999543 - RNA, 19 nt, Homo sapiens
agggugcaguaucaugccc

SEQ ID NO: 999544 - RNA, 15 nt, Homo sapiens
aggguuuuaacuuug

SEQ ID NO: 999545 - RNA, 13 nt, Homo sapiens
aggguuuugcccc

SEQ ID NO: 999546 - RNA, 16 nt, Homo sapiens
agguaaaaugccauga

SEQ ID NO: 999547 - RNA, 20 nt, Homo sapiens
aggucccggcuccugugcug

SEQ ID NO: 999548 - RNA, 16 nt, Homo sapiens
agguccgguguucuaa

SEQ ID NO: 999549 - RNA, 21 nt, Homo sapiens
agguccuuguuguuucuugcc

SEQ ID NO: 999550 - RNA, 18 nt, Homo sapiens
aggucucagaugagcuua

SEQ ID NO: 999551 - RNA, 16 nt, Homo sapiens
aggugaaagaaaccac

SEQ ID NO: 999552 - RNA, 17 nt, Homo sapiens
aggugauccaccugccu

SEQ ID NO: 999553 - RNA, 16 nt, Homo sapiens
agguguugccaaauau

SEQ ID NO: 999554 - RNA, 22 nt, Homo sapiens
agguguuuuguucaccauuaua

SEQ ID NO: 999555 - RNA, 16 nt, Homo sapiens
agguucccacuuaaaa

SEQ ID NO: 999556 - RNA, 19 nt, Homo sapiens
agguucucagguguugcca

SEQ ID NO: 999557 - RNA, 20 nt, Homo sapiens
agguucucagguguugccaa

SEQ ID NO: 999558 - RNA, 18 nt, Homo sapiens
agguugcacacuuuggua

SEQ ID NO: 999559 - RNA, 14 nt, Homo sapiens
agguuugcacuucc

SEQ ID NO: 999560 - RNA, 15 nt, Homo sapiens
agguuugccagcauu

SEQ ID NO: 999561 - RNA, 15 nt, Homo sapiens
agguuuuuacuguga

SEQ ID NO: 999562 - RNA, 15 nt, Homo sapiens
aguaaauaacuggaa

SEQ ID NO: 999563 - RNA, 17 nt, Homo sapiens
aguaacgcgucuuccug

SEQ ID NO: 999564 - RNA, 12 nt, Homo sapiens
aguacaaccuga

SEQ ID NO: 999565 - RNA, 24 nt, Homo sapiens
aguaccaguauaagcaucugccau

SEQ ID NO: 999566 - RNA, 17 nt, Homo sapiens
aguacgaaccuacaguu

SEQ ID NO: 999567 - RNA, 15 nt, Homo sapiens
aguacuccacacugc

SEQ ID NO: 999568 - RNA, 13 nt, Homo sapiens
acacaggccugug

SEQ ID NO: 999569 - RNA, 18 nt, Homo sapiens
acacauauacauguagga

SEQ ID NO: 999570 - RNA, 23 nt, Homo sapiens
acacaucucccuuuuccaugacu

SEQ ID NO: 999571 - RNA, 13 nt, Homo sapiens
acacccuguacug

SEQ ID NO: 999572 - RNA, 20 nt, Homo sapiens
acacccuucucccacucucc

SEQ ID NO: 999573 - RNA, 18 nt, Homo sapiens
acaccuuuuauugacaca

SEQ ID NO: 999574 - RNA, 20 nt, Homo sapiens
acaccuuuuuucaacaguga

SEQ ID NO: 999575 - RNA, 19 nt, Homo sapiens
acacgcaccugccucagga

SEQ ID NO: 999576 - RNA, 15 nt, Homo sapiens
acacuaacauauaau

SEQ ID NO: 999577 - RNA, 17 nt, Homo sapiens
acacucagaagccuggg

SEQ ID NO: 999578 - RNA, 16 nt, Homo sapiens
acacugaugcuuagau

SEQ ID NO: 999579 - RNA, 18 nt, Homo sapiens
acacuggcguuacugcuu

SEQ ID NO: 999580 - RNA, 23 nt, Homo sapiens
acacuggucugcuguuccagugg

SEQ ID NO: 999581 - RNA, 20 nt, Homo sapiens
acacuguguaaauacccaua

SEQ ID NO: 999582 - RNA, 15 nt, Homo sapiens
acacuugcaaccuac

SEQ ID NO: 999583 - RNA, 20 nt, Homo sapiens
acacuuuuuggaagugaaaa

SEQ ID NO: 999584 - RNA, 21 nt, Homo sapiens
acagaaagccugggugacauu

SEQ ID NO: 999585 - RNA, 21 nt, Homo sapiens
acagaacuucagaaagacuug

SEQ ID NO: 999586 - RNA, 21 nt, Homo sapiens
acagaagggauaccgucuccu

SEQ ID NO: 999587 - RNA, 12 nt, Homo sapiens
acagaagguccu

SEQ ID NO: 999588 - RNA, 16 nt, Homo sapiens
acagagcccugugagg

SEQ ID NO: 999589 - RNA, 16 nt, Homo sapiens
acagaucaucuuggaa

SEQ ID NO: 999590 - RNA, 18 nt, Homo sapiens
acagaugccacacaagga

SEQ ID NO: 999591 - RNA, 18 nt, Homo sapiens
acagcaaccccaggcuga

SEQ ID NO: 999592 - RNA, 13 nt, Homo sapiens
acagcaaccugua

SEQ ID NO: 999593 - RNA, 13 nt, Homo sapiens
acagcacagccaa

SEQ ID NO: 999594 - RNA, 13 nt, Homo sapiens
acagcacccugug

SEQ ID NO: 999595 - RNA, 19 nt, Homo sapiens
acagcaucuccaagcagcu

SEQ ID NO: 999596 - RNA, 13 nt, Homo sapiens
acagcccugucag

SEQ ID NO: 999597 - RNA, 12 nt, Homo sapiens
acagcuacucuc

SEQ ID NO: 999598 - RNA, 18 nt, Homo sapiens
acagcuccuaggaaaaug

SEQ ID NO: 999599 - RNA, 20 nt, Homo sapiens
acagcucgggcccucuguga

SEQ ID NO: 999600 - RNA, 23 nt, Homo sapiens
acagcucgggcccucugugagau

SEQ ID NO: 999601 - RNA, 19 nt, Homo sapiens
acaggaaacuccugugacc

SEQ ID NO: 999602 - RNA, 18 nt, Homo sapiens
acaggacuaacacucaga

SEQ ID NO: 999603 - RNA, 13 nt, Homo sapiens
acaggagcucuua

SEQ ID NO: 999604 - RNA, 23 nt, Homo sapiens
acaggaguguccucuucccucuc

SEQ ID NO: 999605 - RNA, 22 nt, Homo sapiens
acaggcaaauguacuucucacc

SEQ ID NO: 999606 - RNA, 13 nt, Homo sapiens
acaggcacuuggc

SEQ ID NO: 999607 - RNA, 21 nt, Homo sapiens
acaggcccccuugaguggggu

SEQ ID NO: 999608 - RNA, 15 nt, Homo sapiens
acaggcgugagccac

SEQ ID NO: 999609 - RNA, 16 nt, Homo sapiens
acaggcucacugguca

SEQ ID NO: 999610 - RNA, 16 nt, Homo sapiens
acagucguucccagug

SEQ ID NO: 999611 - RNA, 21 nt, Homo sapiens
acagucguucccaguguggcu

SEQ ID NO: 999612 - RNA, 14 nt, Homo sapiens
acagucucacuuug

SEQ ID NO: 999613 - RNA, 17 nt, Homo sapiens
acagugacuucugagau

SEQ ID NO: 999614 - RNA, 18 nt, Homo sapiens
acagugacuucugagauc

SEQ ID NO: 999615 - RNA, 15 nt, Homo sapiens
acagugagacuucau

SEQ ID NO: 999616 - RNA, 14 nt, Homo sapiens
acagugcaacacug

SEQ ID NO: 999617 - RNA, 20 nt, Homo sapiens
acagugccgacagcucucca

SEQ ID NO: 999618 - RNA, 21 nt, Homo sapiens
acagugcucuuuucuccucac

SEQ ID NO: 999619 - RNA, 21 nt, Homo sapiens
acaguggaggaagagggacag

SEQ ID NO: 999620 - RNA, 13 nt, Homo sapiens
acauaaacccagu

SEQ ID NO: 999621 - RNA, 14 nt, Homo sapiens
acauaauucacucu

SEQ ID NO: 999622 - RNA, 12 nt, Homo sapiens
acauacaaauca

SEQ ID NO: 999623 - RNA, 17 nt, Homo sapiens
acauacgugcacagggu

SEQ ID NO: 999624 - RNA, 18 nt, Homo sapiens
acauacuggccuggacug

SEQ ID NO: 999625 - RNA, 17 nt, Homo sapiens
acauaugaucugucugu

SEQ ID NO: 999626 - RNA, 14 nt, Homo sapiens
acauaugugugugu

SEQ ID NO: 999627 - RNA, 15 nt, Homo sapiens
acaucagagugacau

SEQ ID NO: 999628 - RNA, 20 nt, Homo sapiens
acauccaaagcagacagcuc

SEQ ID NO: 999629 - RNA, 22 nt, Homo sapiens
acaucccaguccaccugaggaa

SEQ ID NO: 999630 - RNA, 16 nt, Homo sapiens
acaucgcagauucucc

SEQ ID NO: 999631 - RNA, 15 nt, Homo sapiens
acaucugugucuugu

SEQ ID NO: 999632 - RNA, 19 nt, Homo sapiens
acaucuuuuacauucugca

SEQ ID NO: 999633 - RNA, 22 nt, Homo sapiens
acaugaaaggacccugugagcc

SEQ ID NO: 999634 - RNA, 14 nt, Homo sapiens
acaugaagaagcua

SEQ ID NO: 999635 - RNA, 16 nt, Homo sapiens
acaugaauuuuagcuu

SEQ ID NO: 999636 - RNA, 19 nt, Homo sapiens
acaugcuuauuccaugacu

SEQ ID NO: 999637 - RNA, 12 nt, Homo sapiens
agcggugucucu

SEQ ID NO: 999638 - RNA, 14 nt, Homo sapiens
agcuaagaaccugg

SEQ ID NO: 999639 - RNA, 15 nt, Homo sapiens
agcuacaggacauuu

SEQ ID NO: 999640 - RNA, 23 nt, Homo sapiens
agcuacugugugugugaaugaac

SEQ ID NO: 999641 - RNA, 20 nt, Homo sapiens
agcuaggaagagcaggacuc

SEQ ID NO: 999642 - RNA, 21 nt, Homo sapiens
agcuauuugauguaauacuuc

SEQ ID NO: 999643 - RNA, 20 nt, Homo sapiens
agcuauuuugugaagccaug

SEQ ID NO: 999644 - RNA, 22 nt, Homo sapiens
agcucaacucucuuauugccuc

SEQ ID NO: 999645 - RNA, 19 nt, Homo sapiens
agcucauccaugccucaga

SEQ ID NO: 999646 - RNA, 15 nt, Homo sapiens
agcuccaaccugcaa

SEQ ID NO: 999647 - RNA, 15 nt, Homo sapiens
agcuccaauuucaag

SEQ ID NO: 999648 - RNA, 21 nt, Homo sapiens
agcuccaguguccugagcuca

SEQ ID NO: 999649 - RNA, 18 nt, Homo sapiens
agcucuauuaugaaugug

SEQ ID NO: 999650 - RNA, 23 nt, Homo sapiens
agcucuggacagccccacccugg

SEQ ID NO: 999651 - RNA, 17 nt, Homo sapiens
agcucuguaucugccau

SEQ ID NO: 999652 - RNA, 16 nt, Homo sapiens
agcugaccagccguga

SEQ ID NO: 999653 - RNA, 19 nt, Homo sapiens
agcugagguuugcacuucc

SEQ ID NO: 999654 - RNA, 14 nt, Homo sapiens
agcugauacuuuga

SEQ ID NO: 999655 - RNA, 13 nt, Homo sapiens
agcugcauuucag

SEQ ID NO: 999656 - RNA, 15 nt, Homo sapiens
agcugcuuccagugu

SEQ ID NO: 999657 - RNA, 23 nt, Homo sapiens
agcuggaagggucaacaucuuuu

SEQ ID NO: 999658 - RNA, 18 nt, Homo sapiens
agcuggggugcagggaug

SEQ ID NO: 999659 - RNA, 20 nt, Homo sapiens
agcugugaccugcugagcuc

SEQ ID NO: 999660 - RNA, 23 nt, Homo sapiens
agcugugguuuucuuuugccaug

SEQ ID NO: 999661 - RNA, 17 nt, Homo sapiens
agcuguugugugagguu

SEQ ID NO: 999662 - RNA, 21 nt, Homo sapiens
agcuucaggagggaaccagcu

SEQ ID NO: 999663 - RNA, 22 nt, Homo sapiens
agcuuggaguucucuauacuca

SEQ ID NO: 999664 - RNA, 14 nt, Homo sapiens
aggaaaagucccaa

SEQ ID NO: 999665 - RNA, 19 nt, Homo sapiens
aggaaacucugucacuccu

SEQ ID NO: 999666 - RNA, 21 nt, Homo sapiens
aggaacagcaaaugcaaaaac

SEQ ID NO: 999667 - RNA, 12 nt, Homo sapiens
aggaaggagcug

SEQ ID NO: 999668 - RNA, 19 nt, Homo sapiens
aggaaggcuuguugugcuu

SEQ ID NO: 999669 - RNA, 15 nt, Homo sapiens
aauaaaugucuugcc

SEQ ID NO: 999670 - RNA, 16 nt, Homo sapiens
aauaaaugucuugccu

SEQ ID NO: 999671 - RNA, 16 nt, Homo sapiens
aauaagagcucaggau

SEQ ID NO: 999672 - RNA, 15 nt, Homo sapiens
aauaagguacaagaa

SEQ ID NO: 999673 - RNA, 21 nt, Homo sapiens
aauaauaaagaauagcuuuaa

SEQ ID NO: 999674 - RNA, 13 nt, Homo sapiens
aauaauaccuuau

SEQ ID NO: 999675 - RNA, 21 nt, Homo sapiens
aauaaugcuuugaaauugaac

SEQ ID NO: 999676 - RNA, 14 nt, Homo sapiens
aauaauguacaucu

SEQ ID NO: 999677 - RNA, 16 nt, Homo sapiens
aauaauguacaucugg

SEQ ID NO: 999678 - RNA, 14 nt, Homo sapiens
aauacccauauguc

SEQ ID NO: 999679 - RNA, 21 nt, Homo sapiens
aauacuaaggaaccaacaauc

SEQ ID NO: 999680 - RNA, 12 nt, Homo sapiens
aauagauaugaa

SEQ ID NO: 999681 - RNA, 20 nt, Homo sapiens
aauagcauuguaaaagcauu

SEQ ID NO: 999682 - RNA, 16 nt, Homo sapiens
aauagccacauuugga

SEQ ID NO: 999683 - RNA, 14 nt, Homo sapiens
aauaggcaucucca

SEQ ID NO: 999684 - RNA, 19 nt, Homo sapiens
aauaggcggggcuugccuu

SEQ ID NO: 999685 - RNA, 14 nt, Homo sapiens
aauagugucauccu

SEQ ID NO: 999686 - RNA, 16 nt, Homo sapiens
aauagugucauccuca

SEQ ID NO: 999687 - RNA, 18 nt, Homo sapiens
aauauaagcugccauaua

SEQ ID NO: 999688 - RNA, 16 nt, Homo sapiens
aauauaucuaccccag

SEQ ID NO: 999689 - RNA, 22 nt, Homo sapiens
aauauccagccucccacaagaa

SEQ ID NO: 999690 - RNA, 19 nt, Homo sapiens
aauaucccuccuguuggga

SEQ ID NO: 999691 - RNA, 17 nt, Homo sapiens
aauauccuaaacaucau

SEQ ID NO: 999692 - RNA, 15 nt, Homo sapiens
aauauccugcuugau

SEQ ID NO: 999693 - RNA, 21 nt, Homo sapiens
aauaugucagugcugauguag

SEQ ID NO: 999694 - RNA, 12 nt, Homo sapiens
aauauguuacaa

SEQ ID NO: 999695 - RNA, 12 nt, Homo sapiens
aauauuaaggag

SEQ ID NO: 999696 - RNA, 23 nt, Homo sapiens
aauauuguccauuguccaauccu

SEQ ID NO: 999697 - RNA, 20 nt, Homo sapiens
aauauuuaagacacugaaaa

SEQ ID NO: 999698 - RNA, 19 nt, Homo sapiens
aauauuuuuggucauugua

SEQ ID NO: 999699 - RNA, 14 nt, Homo sapiens
aaucaaaagcuauu

SEQ ID NO: 999700 - RNA, 12 nt, Homo sapiens
aaucaacauuuc

SEQ ID NO: 999701 - RNA, 23 nt, Homo sapiens
aaucaccacaaacuguaauacaa

SEQ ID NO: 999702 - RNA, 20 nt, Homo sapiens
aaucagacugacaguuuaca

SEQ ID NO: 999703 - RNA, 20 nt, Homo sapiens
aaucagauucuucucucuca

SEQ ID NO: 999704 - RNA, 20 nt, Homo sapiens
aaucagugaagccaaaggga

SEQ ID NO: 999705 - RNA, 19 nt, Homo sapiens
aaucauauaauaaauguac

SEQ ID NO: 999706 - RNA, 20 nt, Homo sapiens
aauccaugaaccaagaccau

SEQ ID NO: 999707 - RNA, 15 nt, Homo sapiens
aauccgccaauauua

SEQ ID NO: 999708 - RNA, 19 nt, Homo sapiens
aauccuuuacuguuaguca

SEQ ID NO: 999709 - RNA, 22 nt, Homo sapiens
aauccuuucacccgcuccuaca

SEQ ID NO: 999710 - RNA, 13 nt, Homo sapiens
aaucgcauuuccu

SEQ ID NO: 999711 - RNA, 21 nt, Homo sapiens
aaucguccagcgaccuuccuc

SEQ ID NO: 999712 - RNA, 15 nt, Homo sapiens
aaucuaccacuguau

SEQ ID NO: 999713 - RNA, 17 nt, Homo sapiens
aaucuaccucugaaaaa

SEQ ID NO: 999714 - RNA, 14 nt, Homo sapiens
aaucucacuacaca

SEQ ID NO: 999715 - RNA, 13 nt, Homo sapiens
aaucuugaacuuu

SEQ ID NO: 999716 - RNA, 15 nt, Homo sapiens
aaucuugaacuuuau

SEQ ID NO: 999717 - RNA, 18 nt, Homo sapiens
aaucuuuuacaacugccu

SEQ ID NO: 999718 - RNA, 22 nt, Homo sapiens
aaugaacacucuuuugcuuuau

SEQ ID NO: 999719 - RNA, 22 nt, Homo sapiens
aaugaagcaaaugucaugcugc

SEQ ID NO: 999720 - RNA, 14 nt, Homo sapiens
aaugacaagcacua

SEQ ID NO: 999721 - RNA, 23 nt, Homo sapiens
aaugaggugagggggguucuccu

SEQ ID NO: 999722 - RNA, 17 nt, Homo sapiens
aaugaguugaggccacu

SEQ ID NO: 999723 - RNA, 13 nt, Homo sapiens
aaugauccuguau

SEQ ID NO: 999724 - RNA, 15 nt, Homo sapiens
aaugcuagguucuac

SEQ ID NO: 999725 - RNA, 16 nt, Homo sapiens
aaugcuggcauuugca

SEQ ID NO: 999726 - RNA, 18 nt, Homo sapiens
aaugcugggacucagccu

SEQ ID NO: 999727 - RNA, 12 nt, Homo sapiens
aauggaucacaa

SEQ ID NO: 999728 - RNA, 20 nt, Homo sapiens
aauggccuucauaucaucca

SEQ ID NO: 999729 - RNA, 20 nt, Homo sapiens
aauggcuaagauaccaaaac

SEQ ID NO: 999730 - RNA, 21 nt, Homo sapiens
aaugguucagaauuaaacuuu

SEQ ID NO: 999731 - RNA, 14 nt, Homo sapiens
aauguaaagacaaa

SEQ ID NO: 999732 - RNA, 13 nt, Homo sapiens
aauguaaagccau

SEQ ID NO: 999733 - RNA, 20 nt, Homo sapiens
aauguagacuuuugcuuuau

SEQ ID NO: 999734 - RNA, 22 nt, Homo sapiens
aauguagaguuuuuaaacauca

SEQ ID NO: 999735 - RNA, 21 nt, Homo sapiens
aauguaucugugugugauuug

SEQ ID NO: 999736 - RNA, 14 nt, Homo sapiens
aaugucuugagcuc

SEQ ID NO: 999737 - RNA, 13 nt, Homo sapiens
aaugugaagccuu

SEQ ID NO: 999738 - RNA, 16 nt, Homo sapiens
aauguuacauuauuau

SEQ ID NO: 999739 - RNA, 18 nt, Homo sapiens
aauguuacauuauuauca

SEQ ID NO: 999740 - RNA, 21 nt, Homo sapiens
aauguuauuuuuuaauuauua

SEQ ID NO: 999741 - RNA, 22 nt, Homo sapiens
aauguucuguuugcuguggaac

SEQ ID NO: 999742 - RNA, 14 nt, Homo sapiens
aauuaaaguacuuu

SEQ ID NO: 999743 - RNA, 14 nt, Homo sapiens
aauuaagacuuuau

SEQ ID NO: 999744 - RNA, 13 nt, Homo sapiens
aauuacuuuguga

SEQ ID NO: 999745 - RNA, 20 nt, Homo sapiens
aauucacccccuuuccugga

SEQ ID NO: 999746 - RNA, 23 nt, Homo sapiens
aauucucucccccuauuuauuga

SEQ ID NO: 999747 - RNA, 17 nt, Homo sapiens
aauucuuagucacaaaa

SEQ ID NO: 999748 - RNA, 21 nt, Homo sapiens
aauucuuucccagucugucga

SEQ ID NO: 999749 - RNA, 16 nt, Homo sapiens
aauugcaaaucuugaa

SEQ ID NO: 999750 - RNA, 18 nt, Homo sapiens
aauuguaucaaaugugac

SEQ ID NO: 999751 - RNA, 17 nt, Homo sapiens
aauugugaucagaccau

SEQ ID NO: 999752 - RNA, 19 nt, Homo sapiens
aauugugaucagaccauaa

SEQ ID NO: 999753 - RNA, 19 nt, Homo sapiens
aauuuaccuaagauuacaa

SEQ ID NO: 999754 - RNA, 20 nt, Homo sapiens
aauuuaucaaacccuagccu

SEQ ID NO: 999755 - RNA, 18 nt, Homo sapiens
aauuuguaaugucuugag

SEQ ID NO: 999756 - RNA, 13 nt, Homo sapiens
acaaaacaaacuc

SEQ ID NO: 999757 - RNA, 13 nt, Homo sapiens
acaaacugaagag

SEQ ID NO: 999758 - RNA, 15 nt, Homo sapiens
acaaagaaacaaaga

SEQ ID NO: 999759 - RNA, 17 nt, Homo sapiens
acaaauuagcuaggcau

SEQ ID NO: 999760 - RNA, 21 nt, Homo sapiens
acaaccaugagaccacuguua

SEQ ID NO: 999761 - RNA, 20 nt, Homo sapiens
acaacuauuuucagauguga

SEQ ID NO: 999762 - RNA, 17 nt, Homo sapiens
acaacuucuaauugcca

SEQ ID NO: 999763 - RNA, 23 nt, Homo sapiens
acaacuuucuccuacucuuccuu

SEQ ID NO: 999764 - RNA, 17 nt, Homo sapiens
acaagccagaacuugac

SEQ ID NO: 999765 - RNA, 18 nt, Homo sapiens
acaaggauagaugcuggc

SEQ ID NO: 999766 - RNA, 14 nt, Homo sapiens
acaaucagcuccuu

SEQ ID NO: 999767 - RNA, 19 nt, Homo sapiens
acaaucaucaucauucuca

SEQ ID NO: 999768 - RNA, 17 nt, Homo sapiens
acacaaaccacaccaca

SEQ ID NO: 999769 - RNA, 13 nt, Homo sapiens
acacacacaccaa

SEQ ID NO: 999770 - RNA, 12 nt, Homo sapiens
acacacaguacg

SEQ ID NO: 999771 - RNA, 20 nt, Homo sapiens
acacacuaccgaaugugucu

SEQ ID NO: 999772 - RNA, 20 nt, Homo sapiens
aagacaugauuuccuugaau

SEQ ID NO: 999773 - RNA, 16 nt, Homo sapiens
aagacccccagcacuu

SEQ ID NO: 999774 - RNA, 19 nt, Homo sapiens
aagaccugagaauguaucc

SEQ ID NO: 999775 - RNA, 21 nt, Homo sapiens
aagacuuaagcccagugcacu

SEQ ID NO: 999776 - RNA, 16 nt, Homo sapiens
aagacuuuguccccac

SEQ ID NO: 999777 - RNA, 21 nt, Homo sapiens
aagagaaaaagcagaggccaa

SEQ ID NO: 999778 - RNA, 15 nt, Homo sapiens
aagagaaaagcccaa

SEQ ID NO: 999779 - RNA, 14 nt, Homo sapiens
aagagaaguuguaa

SEQ ID NO: 999780 - RNA, 13 nt, Homo sapiens
aagagcacuggag

SEQ ID NO: 999781 - RNA, 21 nt, Homo sapiens
aagagcaucaugccucugagg

SEQ ID NO: 999782 - RNA, 18 nt, Homo sapiens
aagaggcugccccucuca

SEQ ID NO: 999783 - RNA, 14 nt, Homo sapiens
aagauaacuaggaa

SEQ ID NO: 999784 - RNA, 18 nt, Homo sapiens
aagaucuuuuauuuugcc

SEQ ID NO: 999785 - RNA, 14 nt, Homo sapiens
aagaugacaaagaa

SEQ ID NO: 999786 - RNA, 21 nt, Homo sapiens
aagauggcauaaccugucuca

SEQ ID NO: 999787 - RNA, 12 nt, Homo sapiens
aagcaacauuca

SEQ ID NO: 999788 - RNA, 21 nt, Homo sapiens
aagcaagacccuaaacaucca

SEQ ID NO: 999789 - RNA, 12 nt, Homo sapiens
aagcacuugugg

SEQ ID NO: 999790 - RNA, 17 nt, Homo sapiens
aagcagcaacuuguccu

SEQ ID NO: 999791 - RNA, 15 nt, Homo sapiens
aagcaggccuuuuga

SEQ ID NO: 999792 - RNA, 21 nt, Homo sapiens
aagcagguucccaagcucaga

SEQ ID NO: 999793 - RNA, 14 nt, Homo sapiens
aagcagucgugccu

SEQ ID NO: 999794 - RNA, 18 nt, Homo sapiens
aagcauaggaaggcucua

SEQ ID NO: 999795 - RNA, 12 nt, Homo sapiens
aagcaucugcca

SEQ ID NO: 999796 - RNA, 21 nt, Homo sapiens
aagcccagcgguucacacagg

SEQ ID NO: 999797 - RNA, 15 nt, Homo sapiens
aagccuaagaaucuu

SEQ ID NO: 999798 - RNA, 12 nt, Homo sapiens
aagccuccucau

SEQ ID NO: 999799 - RNA, 14 nt, Homo sapiens
aagccugugcaaug

SEQ ID NO: 999800 - RNA, 15 nt, Homo sapiens
aagccugugcaaugc

SEQ ID NO: 999801 - RNA, 20 nt, Homo sapiens
aagcuaaaauuagaugaacu

SEQ ID NO: 999802 - RNA, 18 nt, Homo sapiens
aagcucaacucucuuauu

SEQ ID NO: 999803 - RNA, 14 nt, Homo sapiens
aagcucuagaaucu

SEQ ID NO: 999804 - RNA, 21 nt, Homo sapiens
aagcucuagaaucugcaauuc

SEQ ID NO: 999805 - RNA, 21 nt, Homo sapiens
aagcugaggugcccaggagaa

SEQ ID NO: 999806 - RNA, 18 nt, Homo sapiens
aagcugauuaaaugacac

SEQ ID NO: 999807 - RNA, 20 nt, Homo sapiens
aagcuucuagaaggugcuua

SEQ ID NO: 999808 - RNA, 18 nt, Homo sapiens
aagcuuuuuagugcauua

SEQ ID NO: 999809 - RNA, 15 nt, Homo sapiens
aaggaaaucucaccc

SEQ ID NO: 999810 - RNA, 14 nt, Homo sapiens
aaggacccugugag

SEQ ID NO: 999811 - RNA, 21 nt, Homo sapiens
aaggaccugaaauuccaaagu

SEQ ID NO: 999812 - RNA, 20 nt, Homo sapiens
aaggacuuccuguccagcuc

SEQ ID NO: 999813 - RNA, 19 nt, Homo sapiens
aaggagccugugaacccag

SEQ ID NO: 999814 - RNA, 22 nt, Homo sapiens
aaggagggagcucugaugagca

SEQ ID NO: 999815 - RNA, 11 nt, Homo sapiens
aaggagucaaa

SEQ ID NO: 999816 - RNA, 19 nt, Homo sapiens
aaggauaagugaacaccca

SEQ ID NO: 999817 - RNA, 22 nt, Homo sapiens
aaggauuuuucuguaacuguca

SEQ ID NO: 999818 - RNA, 23 nt, Homo sapiens
aaggauuuuucuguaacugucac

SEQ ID NO: 999819 - RNA, 22 nt, Homo sapiens
aaggccucuuguugagugccag

SEQ ID NO: 999820 - RNA, 17 nt, Homo sapiens
aaggccuggggugaccc

SEQ ID NO: 999821 - RNA, 14 nt, Homo sapiens
aaggccuucaaccc

SEQ ID NO: 999822 - RNA, 21 nt, Homo sapiens
aaggcucagucgcuagcauuu

SEQ ID NO: 999823 - RNA, 23 nt, Homo sapiens
aaggcucccggaauuccgucacc

SEQ ID NO: 999824 - RNA, 14 nt, Homo sapiens
aaggcucccugugu

SEQ ID NO: 999825 - RNA, 13 nt, Homo sapiens
aagggagugcaug

SEQ ID NO: 999826 - RNA, 19 nt, Homo sapiens
aagggcaacagaucaguaa

SEQ ID NO: 999827 - RNA, 15 nt, Homo sapiens
aagggccacugggac

SEQ ID NO: 999828 - RNA, 16 nt, Homo sapiens
aaggggagaccucaga

SEQ ID NO: 999829 - RNA, 14 nt, Homo sapiens
aagggggaaaaagu

SEQ ID NO: 999830 - RNA, 13 nt, Homo sapiens
aaggguugagcug

SEQ ID NO: 999831 - RNA, 14 nt, Homo sapiens
aagguaaaaugcca

SEQ ID NO: 999832 - RNA, 13 nt, Homo sapiens
aagguacacuggu

SEQ ID NO: 999833 - RNA, 19 nt, Homo sapiens
aagguccacaggucuagac

SEQ ID NO: 999834 - RNA, 22 nt, Homo sapiens
aaggucguuuuuuucauuccau

SEQ ID NO: 999835 - RNA, 20 nt, Homo sapiens
aaggugggaggaucguuuga

SEQ ID NO: 999836 - RNA, 15 nt, Homo sapiens
aaggugggcacugga

SEQ ID NO: 999837 - RNA, 22 nt, Homo sapiens
aagguucucagguguugccaaa

SEQ ID NO: 999838 - RNA, 17 nt, Homo sapiens
aagguucuuacugcuug

SEQ ID NO: 999839 - RNA, 23 nt, Homo sapiens
aagguuuuauaaggcugauguca

SEQ ID NO: 999840 - RNA, 15 nt, Homo sapiens
aaguaauacaaacua

SEQ ID NO: 999841 - RNA, 20 nt, Homo sapiens
aaguacaaccacacccacac

SEQ ID NO: 999842 - RNA, 22 nt, Homo sapiens
aaguauuuuuuaauccuaccuc

SEQ ID NO: 999843 - RNA, 14 nt, Homo sapiens
aagucaacaguaaa

SEQ ID NO: 999844 - RNA, 14 nt, Homo sapiens
aagucaaccugccu

SEQ ID NO: 999845 - RNA, 13 nt, Homo sapiens
aagucaaggagaa

SEQ ID NO: 999846 - RNA, 21 nt, Homo sapiens
aagucacggcugcgcacugug

SEQ ID NO: 999847 - RNA, 22 nt, Homo sapiens
aagucacggcugcgcacugugu

SEQ ID NO: 999848 - RNA, 18 nt, Homo sapiens
aagucccuuuaugcagag

SEQ ID NO: 999849 - RNA, 19 nt, Homo sapiens
aaguccuacaagcuaaaau

SEQ ID NO: 999850 - RNA, 18 nt, Homo sapiens
aagucucucguaguguua

SEQ ID NO: 999851 - RNA, 19 nt, Homo sapiens
aagugaccuauaccugugu

SEQ ID NO: 999852 - RNA, 23 nt, Homo sapiens
aagugaggugugucacaaugaga

SEQ ID NO: 999853 - RNA, 18 nt, Homo sapiens
aagugccugacacacuaa

SEQ ID NO: 999854 - RNA, 22 nt, Homo sapiens
aagugccuuucaggaucuauuu

SEQ ID NO: 999855 - RNA, 16 nt, Homo sapiens
aagugcugcacucaaa

SEQ ID NO: 999856 - RNA, 13 nt, Homo sapiens
aagugcuguggcu

SEQ ID NO: 999857 - RNA, 11 nt, Homo sapiens
aagugcuguuu

SEQ ID NO: 999858 - RNA, 14 nt, Homo sapiens
aaguggacucaggg

SEQ ID NO: 999859 - RNA, 19 nt, Homo sapiens
aaguggccaagaagcagug

SEQ ID NO: 999860 - RNA, 19 nt, Homo sapiens
aagugguccacaagcuucu

SEQ ID NO: 999861 - RNA, 16 nt, Homo sapiens
aagugucuugggcuca

SEQ ID NO: 999862 - RNA, 20 nt, Homo sapiens
aaguguucacaacagugaaa

SEQ ID NO: 999863 - RNA, 17 nt, Homo sapiens
aaguuaauccacuguga

SEQ ID NO: 999864 - RNA, 18 nt, Homo sapiens
aaguuaguuccacugaga

SEQ ID NO: 999865 - RNA, 17 nt, Homo sapiens
aaguuauuaacuuuaau

SEQ ID NO: 999866 - RNA, 21 nt, Homo sapiens
aaguuccaagagucuaaagau

SEQ ID NO: 999867 - RNA, 15 nt, Homo sapiens
aaguucuucuaagcu

SEQ ID NO: 999868 - RNA, 23 nt, Homo sapiens
aaguugcagcuguuuuguugaca

SEQ ID NO: 999869 - RNA, 20 nt, Homo sapiens
aaguugcugaugaacucuua

SEQ ID NO: 999870 - RNA, 16 nt, Homo sapiens
aaguuuggaagcacug

SEQ ID NO: 999871 - RNA, 16 nt, Homo sapiens
aauaaaaacucaagga

SEQ ID NO: 999872 - RNA, 19 nt, Homo sapiens
aauaaaucugacccagugc

SEQ ID NO: 999873 - RNA, 12 nt, Homo sapiens
aauaaaucuucc

SEQ ID NO: 999874 - RNA, 13 nt, Homo sapiens
aauaaaucuuccu

SEQ ID NO: 999875 - RNA, 22 nt, Homo sapiens
aaauguuaacacucaugaagca

SEQ ID NO: 999876 - RNA, 19 nt, Homo sapiens
aaauguucuaaguuucuaa

SEQ ID NO: 999877 - RNA, 13 nt, Homo sapiens
aaauuccacucaa

SEQ ID NO: 999878 - RNA, 17 nt, Homo sapiens
aaauucgacaacuugua

SEQ ID NO: 999879 - RNA, 18 nt, Homo sapiens
aaauucucucucuugcag

SEQ ID NO: 999880 - RNA, 20 nt, Homo sapiens
aaauuguaucaaaugugaca

SEQ ID NO: 999881 - RNA, 22 nt, Homo sapiens
aaauuguauuaucaacagcauu

SEQ ID NO: 999882 - RNA, 18 nt, Homo sapiens
aaauuugauugauuugaa

SEQ ID NO: 999883 - RNA, 14 nt, Homo sapiens
aaauuugcauuaaa

SEQ ID NO: 999884 - RNA, 17 nt, Homo sapiens
aaauuuuuuaaaaagca

SEQ ID NO: 999885 - RNA, 20 nt, Homo sapiens
aaauuuuuuaaaaagcaaaa

SEQ ID NO: 999886 - RNA, 22 nt, Homo sapiens
aaauuuuuuguugacauuaguc

SEQ ID NO: 999887 - RNA, 22 nt, Homo sapiens
aacaaacucauucauuagucau

SEQ ID NO: 999888 - RNA, 12 nt, Homo sapiens
aacaaacuggag

SEQ ID NO: 999889 - RNA, 23 nt, Homo sapiens
aacaacauguuuccagcauuccc

SEQ ID NO: 999890 - RNA, 21 nt, Homo sapiens
aacaaguauuuguuaauuuag

SEQ ID NO: 999891 - RNA, 13 nt, Homo sapiens
aacacagaggcag

SEQ ID NO: 999892 - RNA, 13 nt, Homo sapiens
aacaccuaugcaa

SEQ ID NO: 999893 - RNA, 14 nt, Homo sapiens
aacaccuaugcaaa

SEQ ID NO: 999894 - RNA, 23 nt, Homo sapiens
aacaccugacagaaugagaccaa

SEQ ID NO: 999895 - RNA, 19 nt, Homo sapiens
aacacuggggacuuggccu

SEQ ID NO: 999896 - RNA, 14 nt, Homo sapiens
aacagaaauuguau

SEQ ID NO: 999897 - RNA, 21 nt, Homo sapiens
aacagaaauuguauauuguaa

SEQ ID NO: 999898 - RNA, 23 nt, Homo sapiens
aacagaagccugaugcugacauu

SEQ ID NO: 999899 - RNA, 13 nt, Homo sapiens
aacagacuugaau

SEQ ID NO: 999900 - RNA, 17 nt, Homo sapiens
aacagauggcacuuuga

SEQ ID NO: 999901 - RNA, 21 nt, Homo sapiens
aacagauuuggaaagacugga

SEQ ID NO: 999902 - RNA, 12 nt, Homo sapiens
aacagcauguac

SEQ ID NO: 999903 - RNA, 22 nt, Homo sapiens
aacagcauuacccuccucucuc

SEQ ID NO: 999904 - RNA, 18 nt, Homo sapiens
aacagcccuccucugcac

SEQ ID NO: 999905 - RNA, 13 nt, Homo sapiens
aacagcuggaccc

SEQ ID NO: 999906 - RNA, 17 nt, Homo sapiens
aacaguuaccugagaga

SEQ ID NO: 999907 - RNA, 12 nt, Homo sapiens
aacauagacaga

SEQ ID NO: 999908 - RNA, 16 nt, Homo sapiens
aacauagacagaagaa

SEQ ID NO: 999909 - RNA, 16 nt, Homo sapiens
aacaucuuuagugucu

SEQ ID NO: 999910 - RNA, 13 nt, Homo sapiens
aacauguacaaaa

SEQ ID NO: 999911 - RNA, 23 nt, Homo sapiens
aacaugugagagguuugacuaga

SEQ ID NO: 999912 - RNA, 17 nt, Homo sapiens
aacauugguucuuucau

SEQ ID NO: 999913 - RNA, 14 nt, Homo sapiens
aaccaacacuaaca

SEQ ID NO: 999914 - RNA, 20 nt, Homo sapiens
aaccaagacaaaaagccaca

SEQ ID NO: 999915 - RNA, 16 nt, Homo sapiens
aaccaauggaauguga

SEQ ID NO: 999916 - RNA, 23 nt, Homo sapiens
aaccacgccucuugaccaggcug

SEQ ID NO: 999917 - RNA, 17 nt, Homo sapiens
aaccacuggucaugccc

SEQ ID NO: 999918 - RNA, 19 nt, Homo sapiens
aaccagacucuugccuguu

SEQ ID NO: 999919 - RNA, 20 nt, Homo sapiens
aaccagacucuugccuguuu

SEQ ID NO: 999920 - RNA, 20 nt, Homo sapiens
aaccagaucuagucaaucaa

SEQ ID NO: 999921 - RNA, 18 nt, Homo sapiens
aaccagguccaaugagcu

SEQ ID NO: 999922 - RNA, 18 nt, Homo sapiens
aaccauagaggauggucu

SEQ ID NO: 999923 - RNA, 16 nt, Homo sapiens
aaccaucaucuugcca

SEQ ID NO: 999924 - RNA, 20 nt, Homo sapiens
aaccaucucccuggugcuua

SEQ ID NO: 999925 - RNA, 22 nt, Homo sapiens
aaccaugagaccacuguuauca

SEQ ID NO: 999926 - RNA, 23 nt, Homo sapiens
aacccacuuuaaaauaucuacau

SEQ ID NO: 999927 - RNA, 20 nt, Homo sapiens
aacccagcucccuucuuccc

SEQ ID NO: 999928 - RNA, 13 nt, Homo sapiens
aacccaggacaag

SEQ ID NO: 999929 - RNA, 22 nt, Homo sapiens
aacccgagaaaacaaacccagg

SEQ ID NO: 999930 - RNA, 18 nt, Homo sapiens
aacccucacaagcaugaa

SEQ ID NO: 999931 - RNA, 12 nt, Homo sapiens
aacccucagggc

SEQ ID NO: 999932 - RNA, 20 nt, Homo sapiens
aacccucagggcaaagccag

SEQ ID NO: 999933 - RNA, 17 nt, Homo sapiens
aaccggagagccagcua

SEQ ID NO: 999934 - RNA, 23 nt, Homo sapiens
aaccuacaguuuuaacuguggau

SEQ ID NO: 999935 - RNA, 12 nt, Homo sapiens
aaccugucucac

SEQ ID NO: 999936 - RNA, 14 nt, Homo sapiens
aaccuugugccuug

SEQ ID NO: 999937 - RNA, 18 nt, Homo sapiens
aacgauucccccagucau

SEQ ID NO: 999938 - RNA, 20 nt, Homo sapiens
aacgccugagcccagggagg

SEQ ID NO: 999939 - RNA, 17 nt, Homo sapiens
aacgcuccaaagucaua

SEQ ID NO: 999940 - RNA, 16 nt, Homo sapiens
aacgucuuuuuauauc

SEQ ID NO: 999941 - RNA, 22 nt, Homo sapiens
aacuacugacggaguccugugu

SEQ ID NO: 999942 - RNA, 22 nt, Homo sapiens
aacuaggagcuuugacucagga

SEQ ID NO: 999943 - RNA, 23 nt, Homo sapiens
aacuaggaucagaauaucacaga

SEQ ID NO: 999944 - RNA, 19 nt, Homo sapiens
aacuaucagacuaagccag

SEQ ID NO: 999945 - RNA, 16 nt, Homo sapiens
aacuauuuucaaagac

SEQ ID NO: 999946 - RNA, 16 nt, Homo sapiens
aacucaacuuugacaa

SEQ ID NO: 999947 - RNA, 23 nt, Homo sapiens
aacucagauccagggacagaggc

SEQ ID NO: 999948 - RNA, 18 nt, Homo sapiens
aacuccaccuucccacuu

SEQ ID NO: 999949 - RNA, 16 nt, Homo sapiens
aacuccugaccucagg

SEQ ID NO: 999950 - RNA, 15 nt, Homo sapiens
aacucugucacuccu

SEQ ID NO: 999951 - RNA, 12 nt, Homo sapiens
aacucuguuaca

SEQ ID NO: 999952 - RNA, 22 nt, Homo sapiens
aacugcaggcccuggccucccc

SEQ ID NO: 999953 - RNA, 19 nt, Homo sapiens
aacugccucgaaacacaga

SEQ ID NO: 999954 - RNA, 21 nt, Homo sapiens
aacuggaaaacagaacacuua

SEQ ID NO: 999955 - RNA, 22 nt, Homo sapiens
aacuggaaaacagaacacuuau

SEQ ID NO: 999956 - RNA, 13 nt, Homo sapiens
aacugugccuugu

SEQ ID NO: 999957 - RNA, 17 nt, Homo sapiens
aacuuauaacccacuuu

SEQ ID NO: 999958 - RNA, 12 nt, Homo sapiens
aacuucaaagag

SEQ ID NO: 999959 - RNA, 15 nt, Homo sapiens
aacuucaaagaggaa

SEQ ID NO: 999960 - RNA, 18 nt, Homo sapiens
aacuucuugcuucuuucu

SEQ ID NO: 999961 - RNA, 16 nt, Homo sapiens
aacuugaaauauccug

SEQ ID NO: 999962 - RNA, 16 nt, Homo sapiens
aacuugccugccuuuc

SEQ ID NO: 999963 - RNA, 15 nt, Homo sapiens
aacuuuaucacuuaa

SEQ ID NO: 999964 - RNA, 19 nt, Homo sapiens
aacuuuccucgccugacaa

SEQ ID NO: 999965 - RNA, 23 nt, Homo sapiens
aacuuugacaaccaugagaccac

SEQ ID NO: 999966 - RNA, 16 nt, Homo sapiens
aacuuuuuauugauuu

SEQ ID NO: 999967 - RNA, 19 nt, Homo sapiens
aacuuuuugcaaggcauuu

SEQ ID NO: 999968 - RNA, 14 nt, Homo sapiens
aagaaaauccauua

SEQ ID NO: 999969 - RNA, 22 nt, Homo sapiens
aagaaaccaccgaaaucccuca

SEQ ID NO: 999970 - RNA, 22 nt, Homo sapiens
aagaagagcgagagaucaaaga

SEQ ID NO: 999971 - RNA, 13 nt, Homo sapiens
aagaaggcauuug

SEQ ID NO: 999972 - RNA, 13 nt, Homo sapiens
aagaauacacaau

SEQ ID NO: 999973 - RNA, 15 nt, Homo sapiens
aagaauacuucucau

SEQ ID NO: 999974 - RNA, 16 nt, Homo sapiens
aagaauagcauuguaa

SEQ ID NO: 999975 - RNA, 17 nt, Homo sapiens
aagacagaaccacaggg

SEQ ID NO: 999976 - RNA, 22 nt, Homo sapiens
aagacaggcaaauguacuucuc

SEQ ID NO: 999977 - RNA, 21 nt, Homo sapiens
aagacauaaacccaguugcca

SEQ ID NO: 999978 - RNA, 15 nt, Homo sapiens
aaagcaaguugccug

SEQ ID NO: 999979 - RNA, 12 nt, Homo sapiens
aaagcagccacg

SEQ ID NO: 999980 - RNA, 16 nt, Homo sapiens
aaagcagccacgaggu

SEQ ID NO: 999981 - RNA, 13 nt, Homo sapiens
aaagcaguagcau

SEQ ID NO: 999982 - RNA, 13 nt, Homo sapiens
aaagcagugcucu

SEQ ID NO: 999983 - RNA, 23 nt, Homo sapiens
aaagcauuuuguaauaauaaaga

SEQ ID NO: 999984 - RNA, 21 nt, Homo sapiens
aaagccugaguacuccacacu

SEQ ID NO: 999985 - RNA, 22 nt, Homo sapiens
aaagccuugugugaacucacca

SEQ ID NO: 999986 - RNA, 13 nt, Homo sapiens
aaagcugccuguc

SEQ ID NO: 999987 - RNA, 23 nt, Homo sapiens
aaagcuuucauguaaacugugca

SEQ ID NO: 999988 - RNA, 15 nt, Homo sapiens
aaaggagccugugaa

SEQ ID NO: 999989 - RNA, 16 nt, Homo sapiens
aaaggagccugugaac

SEQ ID NO: 999990 - RNA, 15 nt, Homo sapiens
aaaggaugugauaua

SEQ ID NO: 999991 - RNA, 14 nt, Homo sapiens
aaaggcugcuguga

SEQ ID NO: 999992 - RNA, 16 nt, Homo sapiens
aaaggcugcugugaac

SEQ ID NO: 999993 - RNA, 17 nt, Homo sapiens
aaagggaagccauuccg

SEQ ID NO: 999994 - RNA, 19 nt, Homo sapiens
aaaggugguguuucuguaa

SEQ ID NO: 999995 - RNA, 18 nt, Homo sapiens
aaagguuuaugaaaaaga

SEQ ID NO: 999996 - RNA, 11 nt, Homo sapiens
aaaguacuggg

SEQ ID NO: 999997 - RNA, 18 nt, Homo sapiens
aaaguauuaucagaugcu

SEQ ID NO: 999998 - RNA, 21 nt, Homo sapiens
aaagucacggcugcgcacugu

SEQ ID NO: 999999 - RNA, 16 nt, Homo sapiens
aaagucauaauugcau

SEQ ID NO: 1000000 - RNA, 17 nt, Homo sapiens
aaagucccaacccaaug

SEQ ID NO: 1000001 - RNA, 19 nt, Homo sapiens
aaagucuguugauuaaaga

SEQ ID NO: 1000002 - RNA, 14 nt, Homo sapiens
aaagugccuuucag

SEQ ID NO: 1000003 - RNA, 11 nt, Homo sapiens
aaaguguuauu

SEQ ID NO: 1000004 - RNA, 17 nt, Homo sapiens
aaauaaagucaucagca

SEQ ID NO: 1000005 - RNA, 13 nt, Homo sapiens
aaauaacuggaaa

SEQ ID NO: 1000006 - RNA, 20 nt, Homo sapiens
aaauaacuggaaaacagaac

SEQ ID NO: 1000007 - RNA, 16 nt, Homo sapiens
aaauacaagacugcca

SEQ ID NO: 1000008 - RNA, 18 nt, Homo sapiens
aaauagagugcauuugaa

SEQ ID NO: 1000009 - RNA, 15 nt, Homo sapiens
aaauauauaugauau

SEQ ID NO: 1000010 - RNA, 13 nt, Homo sapiens
aaauauauuguac

SEQ ID NO: 1000011 - RNA, 19 nt, Homo sapiens
aaauauggacugcucagga

SEQ ID NO: 1000012 - RNA, 14 nt, Homo sapiens
aaauauguccuggg

SEQ ID NO: 1000013 - RNA, 22 nt, Homo sapiens
aaauauuguauaaagcauuugu

SEQ ID NO: 1000014 - RNA, 13 nt, Homo sapiens
aaauauuuugcuu

SEQ ID NO: 1000015 - RNA, 16 nt, Homo sapiens
aaaucaacuugcuuau

SEQ ID NO: 1000016 - RNA, 12 nt, Homo sapiens
aaaucagccuaa

SEQ ID NO: 1000017 - RNA, 13 nt, Homo sapiens
aaaucaguauuug

SEQ ID NO: 1000018 - RNA, 16 nt, Homo sapiens
aaaucauucagaucau

SEQ ID NO: 1000019 - RNA, 13 nt, Homo sapiens
aaaucgugccuug

SEQ ID NO: 1000020 - RNA, 15 nt, Homo sapiens
aaaucuaccacugua

SEQ ID NO: 1000021 - RNA, 16 nt, Homo sapiens
aaaucuaccacuguau

SEQ ID NO: 1000022 - RNA, 21 nt, Homo sapiens
aaaucucuccacuuucagcug

SEQ ID NO: 1000023 - RNA, 15 nt, Homo sapiens
aaaucugacccagug

SEQ ID NO: 1000024 - RNA, 15 nt, Homo sapiens
aaaucuugacuacag

SEQ ID NO: 1000025 - RNA, 17 nt, Homo sapiens
aaaugaaaaugucuugu

SEQ ID NO: 1000026 - RNA, 20 nt, Homo sapiens
aaaugagucccuguccccac

SEQ ID NO: 1000027 - RNA, 23 nt, Homo sapiens
aaaugagucccuguccccaccuc

SEQ ID NO: 1000028 - RNA, 15 nt, Homo sapiens
aaaugcaccauguca

SEQ ID NO: 1000029 - RNA, 14 nt, Homo sapiens
aaaugggcacuuaa

SEQ ID NO: 1000030 - RNA, 22 nt, Homo sapiens
aaaugguccaggagaaggccaa

SEQ ID NO: 1000031 - RNA, 15 nt, Homo sapiens
aaauguaaagacaaa

SEQ ID NO: 1000032 - RNA, 16 nt, Homo sapiens
aaauguacauuaauua

SEQ ID NO: 1000033 - RNA, 21 nt, Homo sapiens
aaauguagacuuuugcuuuau

SEQ ID NO: 1000034 - RNA, 11 nt, Homo sapiens
aaaugucacuu

SEQ ID NO: 1000035 - RNA, 15 nt, Homo sapiens
aaauguuaacacuca

SEQ ID NO: 1000036 - RNA, 15 nt, Homo sapiens
aaauuaaaaugauuu

SEQ ID NO: 1000037 - RNA, 14 nt, Homo sapiens
aaauuaagacuuua

SEQ ID NO: 1000038 - RNA, 22 nt, Homo sapiens
aaauuauuguuaaagaauacac

SEQ ID NO: 1000039 - RNA, 19 nt, Homo sapiens
aaauucaaauaaaaauccu

SEQ ID NO: 1000040 - RNA, 16 nt, Homo sapiens
aaauucacaaacuuuu

SEQ ID NO: 1000041 - RNA, 18 nt, Homo sapiens
aaauuuaaaacuguugga

SEQ ID NO: 1000042 - RNA, 21 nt, Homo sapiens
aaauuucuguaaaacagguua

SEQ ID NO: 1000043 - RNA, 14 nt, Homo sapiens
aaauuugagacaaa

SEQ ID NO: 1000044 - RNA, 14 nt, Homo sapiens
aacaaagaacugaa

SEQ ID NO: 1000045 - RNA, 17 nt, Homo sapiens
aacaaagaacugaagcu

SEQ ID NO: 1000046 - RNA, 14 nt, Homo sapiens
aacaagaacuuuaa

SEQ ID NO: 1000047 - RNA, 12 nt, Homo sapiens
aacaaggcaaug

SEQ ID NO: 1000048 - RNA, 15 nt, Homo sapiens
aacaaugacauuuau

SEQ ID NO: 1000049 - RNA, 18 nt, Homo sapiens
aacaauugaaguaaacuu

SEQ ID NO: 1000050 - RNA, 23 nt, Homo sapiens
aacaauuuuaggaggaccagagc

SEQ ID NO: 1000051 - RNA, 14 nt, Homo sapiens
aacacacagaagaa

SEQ ID NO: 1000052 - RNA, 23 nt, Homo sapiens
aacacacuaccgaaugugucuuu

SEQ ID NO: 1000053 - RNA, 20 nt, Homo sapiens
aacacagcuugucucuugcc

SEQ ID NO: 1000054 - RNA, 18 nt, Homo sapiens
aacaccaacauguuggga

SEQ ID NO: 1000055 - RNA, 15 nt, Homo sapiens
aacaccaagcacagc

SEQ ID NO: 1000056 - RNA, 13 nt, Homo sapiens
aacaccuccucau

SEQ ID NO: 1000057 - RNA, 19 nt, Homo sapiens
aacacgugacacaaacaca

SEQ ID NO: 1000058 - RNA, 16 nt, Homo sapiens
aacacuagacaagcca

SEQ ID NO: 1000059 - RNA, 17 nt, Homo sapiens
aacacucagaagccugg

SEQ ID NO: 1000060 - RNA, 16 nt, Homo sapiens
aacacuguaguaaaua

SEQ ID NO: 1000061 - RNA, 17 nt, Homo sapiens
aacacuuauguuauaca

SEQ ID NO: 1000062 - RNA, 20 nt, Homo sapiens
aacacuuauguuauacaaua

SEQ ID NO: 1000063 - RNA, 12 nt, Homo sapiens
aacagaaagcau

SEQ ID NO: 1000064 - RNA, 12 nt, Homo sapiens
aacagacuugaa

SEQ ID NO: 1000065 - RNA, 14 nt, Homo sapiens
aacagagacugaau

SEQ ID NO: 1000066 - RNA, 13 nt, Homo sapiens
aacagaucuggaa

SEQ ID NO: 1000067 - RNA, 19 nt, Homo sapiens
aacagccaaaaaggacuuu

SEQ ID NO: 1000068 - RNA, 16 nt, Homo sapiens
aacagcgcccaaagga

SEQ ID NO: 1000069 - RNA, 22 nt, Homo sapiens
aacaggagcucuuaacuacagu

SEQ ID NO: 1000070 - RNA, 14 nt, Homo sapiens
aacaguggacaaag

SEQ ID NO: 1000071 - RNA, 16 nt, Homo sapiens
aacaguuuuugcuaau

SEQ ID NO: 1000072 - RNA, 20 nt, Homo sapiens
aacauacuggccuggacugu

SEQ ID NO: 1000073 - RNA, 17 nt, Homo sapiens
aacaucuuuuacauucu

SEQ ID NO: 1000074 - RNA, 18 nt, Homo sapiens
aacaucuuuuacauucug

SEQ ID NO: 1000075 - RNA, 12 nt, Homo sapiens
aacauguacaaa

SEQ ID NO: 1000076 - RNA, 22 nt, Homo sapiens
aacauuaucuaguucauugaau

SEQ ID NO: 1000077 - RNA, 12 nt, Homo sapiens
aacauucaggaa

SEQ ID NO: 1000078 - RNA, 15 nt, Homo sapiens
aacauucauagucuu

SEQ ID NO: 1000079 - RNA, 13 nt, Homo sapiens
aacauuccaagac

SEQ ID NO: 1000080 - RNA, 22 nt, Homo sapiens
aaccaaagaccaucugaggaau

SEQ ID NO: 1000081 - RNA, 20 nt, Homo sapiens
aaccaauagugaaaugccac

SEQ ID NO: 1000082 - RNA, 14 nt, Homo sapiens
aaccaauguagcac

SEQ ID NO: 1000083 - RNA, 21 nt, Homo sapiens
aaccacacccacacucagauc

SEQ ID NO: 1000084 - RNA, 23 nt, Homo sapiens
aaccagcuucugauaaacacaau

SEQ ID NO: 1000085 - RNA, 17 nt, Homo sapiens
aaccccaacuacugugu

SEQ ID NO: 1000086 - RNA, 16 nt, Homo sapiens
aaccccuccccuccau

SEQ ID NO: 1000087 - RNA, 20 nt, Homo sapiens
aacccucacaagcaugaagu

SEQ ID NO: 1000088 - RNA, 17 nt, Homo sapiens
aaccggggccuacuaga

SEQ ID NO: 1000089 - RNA, 13 nt, Homo sapiens
aaccuacaguuuu

SEQ ID NO: 1000090 - RNA, 18 nt, Homo sapiens
aaccuagcacgugccagu

SEQ ID NO: 1000091 - RNA, 23 nt, Homo sapiens
aaccucagugauuggcucugugg

SEQ ID NO: 1000092 - RNA, 15 nt, Homo sapiens
aaccucugcacuacu

SEQ ID NO: 1000093 - RNA, 21 nt, Homo sapiens
aaccugaauuaucuauuucau

SEQ ID NO: 1000094 - RNA, 20 nt, Homo sapiens
aaccugcaaagaucuguccu

SEQ ID NO: 1000095 - RNA, 19 nt, Homo sapiens
aaccugcucuccucuucua

SEQ ID NO: 1000096 - RNA, 23 nt, Homo sapiens
aaccugcucuccucuucuacuca

SEQ ID NO: 1000097 - RNA, 14 nt, Homo sapiens
aaccugcugugaua

SEQ ID NO: 1000098 - RNA, 15 nt, Homo sapiens
aaccuuaaaccugca

SEQ ID NO: 1000099 - RNA, 13 nt, Homo sapiens
aaccuuaauugac

SEQ ID NO: 1000100 - RNA, 11 nt, Homo sapiens
aaccuuugugc

SEQ ID NO: 1000101 - RNA, 15 nt, Homo sapiens
aacgcaucacugggg

SEQ ID NO: 1000102 - RNA, 19 nt, Homo sapiens
aacgcccuuuccuccucag

SEQ ID NO: 1000103 - RNA, 21 nt, Homo sapiens
aacuaaagugcugcacucaaa

SEQ ID NO: 1000104 - RNA, 14 nt, Homo sapiens
aacuaaauaaagcu

SEQ ID NO: 1000105 - RNA, 19 nt, Homo sapiens
aacuaacugcauacacuuu

SEQ ID NO: 1000106 - RNA, 19 nt, Homo sapiens
aacuaagaaauaugcacaa

SEQ ID NO: 1000107 - RNA, 15 nt, Homo sapiens
aacuacuggcaauuu

SEQ ID NO: 1000108 - RNA, 18 nt, Homo sapiens
aacuacuguguuaugcaa

SEQ ID NO: 1000109 - RNA, 19 nt, Homo sapiens
aacuacuguguuaugcaaa

SEQ ID NO: 1000110 - RNA, 13 nt, Homo sapiens
aacuauaagcaag

SEQ ID NO: 1000111 - RNA, 14 nt, Homo sapiens
aacuauaagcaaga

SEQ ID NO: 1000112 - RNA, 17 nt, Homo sapiens
aacuaucucuacugaau

SEQ ID NO: 1000113 - RNA, 22 nt, Homo sapiens
aacuaucucuacugaaugucau

SEQ ID NO: 1000114 - RNA, 18 nt, Homo sapiens
aacucaaggacuuugcag

SEQ ID NO: 1000115 - RNA, 12 nt, Homo sapiens
aacucauuugau

SEQ ID NO: 1000116 - RNA, 22 nt, Homo sapiens
aacuccccucagggauacgaca

SEQ ID NO: 1000117 - RNA, 13 nt, Homo sapiens
aacucuugcacag

SEQ ID NO: 1000118 - RNA, 14 nt, Homo sapiens
aacugaacucacuu

SEQ ID NO: 1000119 - RNA, 15 nt, Homo sapiens
aacugacaagccauc

SEQ ID NO: 1000120 - RNA, 21 nt, Homo sapiens
aacugcucccaccuccugaca

SEQ ID NO: 1000121 - RNA, 17 nt, Homo sapiens
aacuggaaaacagaaca

SEQ ID NO: 1000122 - RNA, 17 nt, Homo sapiens
aacuggaauccuuucag

SEQ ID NO: 1000123 - RNA, 20 nt, Homo sapiens
aacuggaauccuuucagcaa

SEQ ID NO: 1000124 - RNA, 16 nt, Homo sapiens
aacuguaaaugugaca

SEQ ID NO: 1000125 - RNA, 13 nt, Homo sapiens
aacuguacagugu

SEQ ID NO: 1000126 - RNA, 19 nt, Homo sapiens
aacuuauaacccacuuuaa

SEQ ID NO: 1000127 - RNA, 17 nt, Homo sapiens
aacuuauggaaagccca

SEQ ID NO: 1000128 - RNA, 21 nt, Homo sapiens
aacuugauccauuucuaauua

SEQ ID NO: 1000129 - RNA, 19 nt, Homo sapiens
aacuuggauguaccugccc

SEQ ID NO: 1000130 - RNA, 16 nt, Homo sapiens
aacuuuccaaacacca

SEQ ID NO: 1000131 - RNA, 22 nt, Homo sapiens
aacuuuccucgccugacaacca

SEQ ID NO: 1000132 - RNA, 15 nt, Homo sapiens
aacuuugcaucucag

SEQ ID NO: 1000133 - RNA, 16 nt, Homo sapiens
aacuuuuauuacuggg

SEQ ID NO: 1000134 - RNA, 18 nt, Homo sapiens
aacuuuucuaacagaaag

SEQ ID NO: 1000135 - RNA, 17 nt, Homo sapiens
aagaaaauaagagcuca

SEQ ID NO: 1000136 - RNA, 15 nt, Homo sapiens
aagaaacgucuucua

SEQ ID NO: 1000137 - RNA, 15 nt, Homo sapiens
aagaaagaucaaaga

SEQ ID NO: 1000138 - RNA, 14 nt, Homo sapiens
aagaagaaucucau

SEQ ID NO: 1000139 - RNA, 23 nt, Homo sapiens
aagaagcaaccucaguaauuuag

SEQ ID NO: 1000140 - RNA, 15 nt, Homo sapiens
aagaagccacagacc

SEQ ID NO: 1000141 - RNA, 15 nt, Homo sapiens
aagaagcuaccucag

SEQ ID NO: 1000142 - RNA, 23 nt, Homo sapiens
aagaagcugguggagcagagugu

SEQ ID NO: 1000143 - RNA, 11 nt, Homo sapiens
aagaaggcauu

SEQ ID NO: 1000144 - RNA, 22 nt, Homo sapiens
aagaaguuggggacacauguau

SEQ ID NO: 1000145 - RNA, 17 nt, Homo sapiens
aagaauguuaugugcaa

SEQ ID NO: 1000146 - RNA, 22 nt, Homo sapiens
aagaauuauuuugugaugcaaa

SEQ ID NO: 1000147 - RNA, 17 nt, Homo sapiens
aagacagaaguuugcac

SEQ ID NO: 1000148 - RNA, 22 nt, Homo sapiens
aagaccaggccaaugucagggu

SEQ ID NO: 1000149 - RNA, 19 nt, Homo sapiens
aagacccccagcacuuggg

SEQ ID NO: 1000150 - RNA, 13 nt, Homo sapiens
aagacuacugaau

SEQ ID NO: 1000151 - RNA, 14 nt, Homo sapiens
aagacucuuuauga

SEQ ID NO: 1000152 - RNA, 16 nt, Homo sapiens
aagagaagcauucuca

SEQ ID NO: 1000153 - RNA, 16 nt, Homo sapiens
aagagauaacuguaaa

SEQ ID NO: 1000154 - RNA, 22 nt, Homo sapiens
aagagaucccaaguagaaucuc

SEQ ID NO: 1000155 - RNA, 22 nt, Homo sapiens
aagagcaggacuccaggcccaa

SEQ ID NO: 1000156 - RNA, 14 nt, Homo sapiens
aagagccacugcca

SEQ ID NO: 1000157 - RNA, 15 nt, Homo sapiens
aagagccacugccau

SEQ ID NO: 1000158 - RNA, 14 nt, Homo sapiens
aagagcccugucag

SEQ ID NO: 1000159 - RNA, 13 nt, Homo sapiens
aagaggccuguuu

SEQ ID NO: 1000160 - RNA, 21 nt, Homo sapiens
aagaggcugccccucucacca

SEQ ID NO: 1000161 - RNA, 12 nt, Homo sapiens
aagaggugaccc

SEQ ID NO: 1000162 - RNA, 13 nt, Homo sapiens
aagaguccaagaa

SEQ ID NO: 1000163 - RNA, 14 nt, Homo sapiens
aagaguggaaccaa

SEQ ID NO: 1000164 - RNA, 16 nt, Homo sapiens
aagauaauucacugua

SEQ ID NO: 1000165 - RNA, 17 nt, Homo sapiens
aagauacagaacucuuu

SEQ ID NO: 1000166 - RNA, 19 nt, Homo sapiens
aagauaccaaaaccacagu

SEQ ID NO: 1000167 - RNA, 22 nt, Homo sapiens
aagauccuagauccuaaggguc

SEQ ID NO: 1000168 - RNA, 13 nt, Homo sapiens
aagaucuuugccc

SEQ ID NO: 1000169 - RNA, 21 nt, Homo sapiens
aagaugacgaguaacuccccu

SEQ ID NO: 1000170 - RNA, 19 nt, Homo sapiens
aagaugacggaugccuaga

SEQ ID NO: 1000171 - RNA, 20 nt, Homo sapiens
aagaugagcuuugucuacuu

SEQ ID NO: 1000172 - RNA, 14 nt, Homo sapiens
aagauggggaccag

SEQ ID NO: 1000173 - RNA, 21 nt, Homo sapiens
aagcaaaccuguaagugucuu

SEQ ID NO: 1000174 - RNA, 14 nt, Homo sapiens
aagcaaagcacaga

SEQ ID NO: 1000175 - RNA, 22 nt, Homo sapiens
aagcaacauggcuuugaugaua

SEQ ID NO: 1000176 - RNA, 15 nt, Homo sapiens
aagcaagcugauuaa

SEQ ID NO: 1000177 - RNA, 19 nt, Homo sapiens
aagcaaguguucacaacag

SEQ ID NO: 1000178 - RNA, 17 nt, Homo sapiens
aagcagaaagugccuuu

SEQ ID NO: 1000179 - RNA, 15 nt, Homo sapiens
aagcagaccacugau

SEQ ID NO: 1000180 - RNA, 16 nt, Homo sapiens
aagcagcuuagaguug

SEQ ID NO: 1000181 - RNA, 17 nt, Homo sapiens
aagcaggaaucagagac

SEQ ID NO: 1000182 - RNA, 15 nt, Homo sapiens
aagcaguuaguuccu

SEQ ID NO: 1000183 - RNA, 21 nt, Homo sapiens
aagcaucucauuuugaguaga

SEQ ID NO: 1000184 - RNA, 19 nt, Homo sapiens
aagccaauucagacaggca

SEQ ID NO: 1000185 - RNA, 21 nt, Homo sapiens
aagccaauucagacaggcaaa

SEQ ID NO: 1000186 - RNA, 16 nt, Homo sapiens
aagccauuauucacua

SEQ ID NO: 1000187 - RNA, 16 nt, Homo sapiens
aaucuacuaauuccac

SEQ ID NO: 1000188 - RNA, 20 nt, Homo sapiens
aaugaauuuuauaaucugca

SEQ ID NO: 1000189 - RNA, 16 nt, Homo sapiens
aaugacaaucaugugu

SEQ ID NO: 1000190 - RNA, 14 nt, Homo sapiens
aaugagugcuuaaa

SEQ ID NO: 1000191 - RNA, 21 nt, Homo sapiens
aaugaguugaggccacugugu

SEQ ID NO: 1000192 - RNA, 20 nt, Homo sapiens
aaugcaaacucaccgcucca

SEQ ID NO: 1000193 - RNA, 13 nt, Homo sapiens
aaugcacuuucua

SEQ ID NO: 1000194 - RNA, 18 nt, Homo sapiens
aaugcaucacauauucau

SEQ ID NO: 1000195 - RNA, 17 nt, Homo sapiens
aaugcuggcauuugcac

SEQ ID NO: 1000196 - RNA, 13 nt, Homo sapiens
aauggacugcaua

SEQ ID NO: 1000197 - RNA, 20 nt, Homo sapiens
aauggagggaauaauaccua

SEQ ID NO: 1000198 - RNA, 16 nt, Homo sapiens
aauggggaggacaaaa

SEQ ID NO: 1000199 - RNA, 12 nt, Homo sapiens
aauggggccaga

SEQ ID NO: 1000200 - RNA, 13 nt, Homo sapiens
aauguaaagacaa

SEQ ID NO: 1000201 - RNA, 22 nt, Homo sapiens
aauguaaagacaaaaaacuaua

SEQ ID NO: 1000202 - RNA, 10 nt, Homo sapiens
aauguacaaa

SEQ ID NO: 1000203 - RNA, 22 nt, Homo sapiens
aaugugaaaaugguccaggaga

SEQ ID NO: 1000204 - RNA, 14 nt, Homo sapiens
aaugugacauugau

SEQ ID NO: 1000205 - RNA, 23 nt, Homo sapiens
aaugugauucaccucuucuuucc

SEQ ID NO: 1000206 - RNA, 12 nt, Homo sapiens
aaugugauugca

SEQ ID NO: 1000207 - RNA, 15 nt, Homo sapiens
aaugugauugcagcu

SEQ ID NO: 1000208 - RNA, 21 nt, Homo sapiens
aauguguuguuccaaauacua

SEQ ID NO: 1000209 - RNA, 15 nt, Homo sapiens
aauguuacauuauua

SEQ ID NO: 1000210 - RNA, 22 nt, Homo sapiens
aauguuauuuuuuaauuauuau

SEQ ID NO: 1000211 - RNA, 13 nt, Homo sapiens
aauguuuaaucuc

SEQ ID NO: 1000212 - RNA, 14 nt, Homo sapiens
aauuaaaaugacaa

SEQ ID NO: 1000213 - RNA, 23 nt, Homo sapiens
aauuaauugggccagcuuuucaa

SEQ ID NO: 1000214 - RNA, 14 nt, Homo sapiens
aauuaccuguggau

SEQ ID NO: 1000215 - RNA, 18 nt, Homo sapiens
aauuacuguaacugauua

SEQ ID NO: 1000216 - RNA, 22 nt, Homo sapiens
aauuacuuugugaauagaacuc

SEQ ID NO: 1000217 - RNA, 23 nt, Homo sapiens
aauuacuuugugaauagaacucu

SEQ ID NO: 1000218 - RNA, 14 nt, Homo sapiens
aauuagaugaacuc

SEQ ID NO: 1000219 - RNA, 15 nt, Homo sapiens
aauuaggcuguaacu

SEQ ID NO: 1000220 - RNA, 21 nt, Homo sapiens
aauuauauaacuguauuugaa

SEQ ID NO: 1000221 - RNA, 21 nt, Homo sapiens
aauuaucaggcaaauuugcau

SEQ ID NO: 1000222 - RNA, 13 nt, Homo sapiens
aauuauguagcuc

SEQ ID NO: 1000223 - RNA, 23 nt, Homo sapiens
aauuauguagcucuuugucaggg

SEQ ID NO: 1000224 - RNA, 14 nt, Homo sapiens
aauuauuacagugu

SEQ ID NO: 1000225 - RNA, 22 nt, Homo sapiens
aauuauuugcauaacaauuccu

SEQ ID NO: 1000226 - RNA, 18 nt, Homo sapiens
aauuauuuugugaugcaa

SEQ ID NO: 1000227 - RNA, 20 nt, Homo sapiens
aauuauuuugugaugcaaau

SEQ ID NO: 1000228 - RNA, 16 nt, Homo sapiens
aauucagcaaaguggu

SEQ ID NO: 1000229 - RNA, 23 nt, Homo sapiens
aauucauuguguuaccuguagau

SEQ ID NO: 1000230 - RNA, 19 nt, Homo sapiens
aauucauuuuuuaaauucc

SEQ ID NO: 1000231 - RNA, 13 nt, Homo sapiens
aauuccacucaaa

SEQ ID NO: 1000232 - RNA, 20 nt, Homo sapiens
aauuccugauggaaaaugca

SEQ ID NO: 1000233 - RNA, 17 nt, Homo sapiens
aauucucucucuugcag

SEQ ID NO: 1000234 - RNA, 17 nt, Homo sapiens
aauucuguaucuguaga

SEQ ID NO: 1000235 - RNA, 13 nt, Homo sapiens
aauugacaugugc

SEQ ID NO: 1000236 - RNA, 13 nt, Homo sapiens
aauugacuaaaaa

SEQ ID NO: 1000237 - RNA, 15 nt, Homo sapiens
aauugacuaaaaagu

SEQ ID NO: 1000238 - RNA, 16 nt, Homo sapiens
aauugaucgacuugcc

SEQ ID NO: 1000239 - RNA, 17 nt, Homo sapiens
aauugaucgacuugcca

SEQ ID NO: 1000240 - RNA, 16 nt, Homo sapiens
aauugcaaaacccaac

SEQ ID NO: 1000241 - RNA, 16 nt, Homo sapiens
aauugugcaguacuuu

SEQ ID NO: 1000242 - RNA, 23 nt, Homo sapiens
aauugugugugaugugaagccaa

SEQ ID NO: 1000243 - RNA, 13 nt, Homo sapiens
aauuguugagaua

SEQ ID NO: 1000244 - RNA, 17 nt, Homo sapiens
aauuguuguucuguuaa

SEQ ID NO: 1000245 - RNA, 16 nt, Homo sapiens
aauuuaaaauaauuau

SEQ ID NO: 1000246 - RNA, 14 nt, Homo sapiens
aauuucuacuuuga

SEQ ID NO: 1000247 - RNA, 13 nt, Homo sapiens
aauuugacauaca

SEQ ID NO: 1000248 - RNA, 16 nt, Homo sapiens
aauuuggguucugccu

SEQ ID NO: 1000249 - RNA, 16 nt, Homo sapiens
aauuuguaggaaaaag

SEQ ID NO: 1000250 - RNA, 16 nt, Homo sapiens
aauuugugccacuuua

SEQ ID NO: 1000251 - RNA, 18 nt, Homo sapiens
aauuugugccacuuuaau

SEQ ID NO: 1000252 - RNA, 18 nt, Homo sapiens
aauuuuaaguacuuugcu

SEQ ID NO: 1000253 - RNA, 22 nt, Homo sapiens
aauuuuauugacacaguaccau

SEQ ID NO: 1000254 - RNA, 17 nt, Homo sapiens
aauuuuguaauguauca

SEQ ID NO: 1000255 - RNA, 16 nt, Homo sapiens
aauuuuugaaaacugg

SEQ ID NO: 1000256 - RNA, 22 nt, Homo sapiens
acaaaaacagguauauacuuug

SEQ ID NO: 1000257 - RNA, 11 nt, Homo sapiens
acaaaacuaca

SEQ ID NO: 1000258 - RNA, 20 nt, Homo sapiens
acaaaauaaccaauccugga

SEQ ID NO: 1000259 - RNA, 16 nt, Homo sapiens
acaaaauaauaccuua

SEQ ID NO: 1000260 - RNA, 16 nt, Homo sapiens
acaaaaucagguaacu

SEQ ID NO: 1000261 - RNA, 15 nt, Homo sapiens
acaaacuucaaagag

SEQ ID NO: 1000262 - RNA, 18 nt, Homo sapiens
acaaacuucaaagaggaa

SEQ ID NO: 1000263 - RNA, 17 nt, Homo sapiens
acaaagaaaaacagaga

SEQ ID NO: 1000264 - RNA, 19 nt, Homo sapiens
acaaagaugccacauucaa

SEQ ID NO: 1000265 - RNA, 15 nt, Homo sapiens
acaaaggagccugug

SEQ ID NO: 1000266 - RNA, 17 nt, Homo sapiens
acaacauuguagccuca

SEQ ID NO: 1000267 - RNA, 17 nt, Homo sapiens
acaagaaaaucaaauau

SEQ ID NO: 1000268 - RNA, 12 nt, Homo sapiens
acaagaagccac

SEQ ID NO: 1000269 - RNA, 16 nt, Homo sapiens
acaagaauggucuuuc

SEQ ID NO: 1000270 - RNA, 13 nt, Homo sapiens
acaagcuuuccaa

SEQ ID NO: 1000271 - RNA, 20 nt, Homo sapiens
acaagguccucugucaguca

SEQ ID NO: 1000272 - RNA, 13 nt, Homo sapiens
acaaugucccuuc

SEQ ID NO: 1000273 - RNA, 14 nt, Homo sapiens
acaauuucaauaaa

SEQ ID NO: 1000274 - RNA, 23 nt, Homo sapiens
acacaaaaggaacaaaagcgaaa

SEQ ID NO: 1000275 - RNA, 18 nt, Homo sapiens
acacaaggauagaugcug

SEQ ID NO: 1000276 - RNA, 21 nt, Homo sapiens
acacagcccccacggacaaaa

SEQ ID NO: 1000277 - RNA, 20 nt, Homo sapiens
acacagcuugucucuugccu

SEQ ID NO: 1000278 - RNA, 19 nt, Homo sapiens
acacaggaggcugaggcag

SEQ ID NO: 1000279 - RNA, 23 nt, Homo sapiens
acacaguguuggagguuaaggca

SEQ ID NO: 1000280 - RNA, 22 nt, Homo sapiens
acacauauacauguaggagugu

SEQ ID NO: 1000281 - RNA, 16 nt, Homo sapiens
acacaugcccaugaug

SEQ ID NO: 1000282 - RNA, 22 nt, Homo sapiens
acacauuugcuuuuugugauau

SEQ ID NO: 1000283 - RNA, 21 nt, Homo sapiens
acacauuuuuauaaaaaugag

SEQ ID NO: 1000284 - RNA, 23 nt, Homo sapiens
acaccagggccagccucuagagc

SEQ ID NO: 1000285 - RNA, 23 nt, Homo sapiens
acacccuauauuuugcauaguac

SEQ ID NO: 1000286 - RNA, 14 nt, Homo sapiens
acacccuucuccca

SEQ ID NO: 1000287 - RNA, 19 nt, Homo sapiens
acacccuucucccacucuc

SEQ ID NO: 1000288 - RNA, 12 nt, Homo sapiens
acaccuccuucc

SEQ ID NO: 1000289 - RNA, 15 nt, Homo sapiens
acacggacugugcau

SEQ ID NO: 1000290 - RNA, 15 nt, Homo sapiens
acacguuacuagcag

SEQ ID NO: 1000291 - RNA, 21 nt, Homo sapiens
acccuagggauuugcacuaaa

SEQ ID NO: 1000292 - RNA, 20 nt, Homo sapiens
acccuauacuguaguauucu

SEQ ID NO: 1000293 - RNA, 13 nt, Homo sapiens
acccucacauggg

SEQ ID NO: 1000294 - RNA, 11 nt, Homo sapiens
acccucagggc

SEQ ID NO: 1000295 - RNA, 21 nt, Homo sapiens
acccucggggauguguccuga

SEQ ID NO: 1000296 - RNA, 21 nt, Homo sapiens
acccugacacggacugugcau

SEQ ID NO: 1000297 - RNA, 18 nt, Homo sapiens
acccugaguugcuuuuca

SEQ ID NO: 1000298 - RNA, 18 nt, Homo sapiens
acccugccuuaucuugca

SEQ ID NO: 1000299 - RNA, 21 nt, Homo sapiens
acccugcucauccacucuacu

SEQ ID NO: 1000300 - RNA, 18 nt, Homo sapiens
acccugcuuuuugcuucu

SEQ ID NO: 1000301 - RNA, 13 nt, Homo sapiens
acccuucccucac

SEQ ID NO: 1000302 - RNA, 21 nt, Homo sapiens
acccuugacaccugcugagaa

SEQ ID NO: 1000303 - RNA, 15 nt, Homo sapiens
acccuugcugugaau

SEQ ID NO: 1000304 - RNA, 21 nt, Homo sapiens
accgggccacuccuuccugcc

SEQ ID NO: 1000305 - RNA, 21 nt, Homo sapiens
accgguggggcugguucugua

SEQ ID NO: 1000306 - RNA, 11 nt, Homo sapiens
accgucuuucu

SEQ ID NO: 1000307 - RNA, 18 nt, Homo sapiens
accguguaccucaguucc

SEQ ID NO: 1000308 - RNA, 14 nt, Homo sapiens
accguucugugcac

SEQ ID NO: 1000309 - RNA, 23 nt, Homo sapiens
accuaaaaggaaaucucacccca

SEQ ID NO: 1000310 - RNA, 14 nt, Homo sapiens
accuaauccaggca

SEQ ID NO: 1000311 - RNA, 15 nt, Homo sapiens
accuaauccaggcag

SEQ ID NO: 1000312 - RNA, 16 nt, Homo sapiens
accuauaagaagccuu

SEQ ID NO: 1000313 - RNA, 23 nt, Homo sapiens
accuauaccuguguuucuugccu

SEQ ID NO: 1000314 - RNA, 18 nt, Homo sapiens
accucagcaccuugcucu

SEQ ID NO: 1000315 - RNA, 21 nt, Homo sapiens
accucaguucccucuugcuca

SEQ ID NO: 1000316 - RNA, 17 nt, Homo sapiens
accuccaccuccuccag

SEQ ID NO: 1000317 - RNA, 18 nt, Homo sapiens
accuccagcuuuccugua

SEQ ID NO: 1000318 - RNA, 17 nt, Homo sapiens
accucccuauacugcuu

SEQ ID NO: 1000319 - RNA, 16 nt, Homo sapiens
accuccgccauccacc

SEQ ID NO: 1000320 - RNA, 18 nt, Homo sapiens
accucguacucaggagcc

SEQ ID NO: 1000321 - RNA, 15 nt, Homo sapiens
accucuuucaggguu

SEQ ID NO: 1000322 - RNA, 19 nt, Homo sapiens
accugaaaacacugugcac

SEQ ID NO: 1000323 - RNA, 20 nt, Homo sapiens
accugaaaacacugugcaca

SEQ ID NO: 1000324 - RNA, 22 nt, Homo sapiens
accugaaauuccaaagucucua

SEQ ID NO: 1000325 - RNA, 13 nt, Homo sapiens
accugacucuugc

SEQ ID NO: 1000326 - RNA, 15 nt, Homo sapiens
accugacucuugcag

SEQ ID NO: 1000327 - RNA, 13 nt, Homo sapiens
accugagccugcc

SEQ ID NO: 1000328 - RNA, 13 nt, Homo sapiens
accugauccugga

SEQ ID NO: 1000329 - RNA, 18 nt, Homo sapiens
accugcugagcucugaga

SEQ ID NO: 1000330 - RNA, 19 nt, Homo sapiens
accugguacccuccuggcu

SEQ ID NO: 1000331 - RNA, 22 nt, Homo sapiens
accugugagcccagcuggguca

SEQ ID NO: 1000332 - RNA, 18 nt, Homo sapiens
accuuauaguuacugugu

SEQ ID NO: 1000333 - RNA, 19 nt, Homo sapiens
accuuccagcuccuguaac

SEQ ID NO: 1000334 - RNA, 16 nt, Homo sapiens
accuuggacauccucc

SEQ ID NO: 1000335 - RNA, 22 nt, Homo sapiens
accuuggcaccagacacccagg

SEQ ID NO: 1000336 - RNA, 23 nt, Homo sapiens
accuuggcaccagacacccagga

SEQ ID NO: 1000337 - RNA, 15 nt, Homo sapiens
acgagggucccgauc

SEQ ID NO: 1000338 - RNA, 15 nt, Homo sapiens
acgcaugcaguguug

SEQ ID NO: 1000339 - RNA, 12 nt, Homo sapiens
acggaccaaagc

SEQ ID NO: 1000340 - RNA, 20 nt, Homo sapiens
acggacugugcauacuuucc

SEQ ID NO: 1000341 - RNA, 21 nt, Homo sapiens
acggagccgcgggacagccaa

SEQ ID NO: 1000342 - RNA, 22 nt, Homo sapiens
acggaguccuguguuugugagu

SEQ ID NO: 1000343 - RNA, 14 nt, Homo sapiens
acggccacaucaaa

SEQ ID NO: 1000344 - RNA, 20 nt, Homo sapiens
acggcugcgcacuguguccu

SEQ ID NO: 1000345 - RNA, 23 nt, Homo sapiens
acggggcugacuccugcucucug

SEQ ID NO: 1000346 - RNA, 17 nt, Homo sapiens
acguggcucagccagca

SEQ ID NO: 1000347 - RNA, 13 nt, Homo sapiens
acguuuaagccaa

SEQ ID NO: 1000348 - RNA, 18 nt, Homo sapiens
acuaaacacgugacacaa

SEQ ID NO: 1000349 - RNA, 16 nt, Homo sapiens
acuaaugccucuucau

SEQ ID NO: 1000350 - RNA, 18 nt, Homo sapiens
acuaccauucuauuccau

SEQ ID NO: 1000351 - RNA, 15 nt, Homo sapiens
acuacugacaugugg

SEQ ID NO: 1000352 - RNA, 17 nt, Homo sapiens
acuacuguguuaugcaa

SEQ ID NO: 1000353 - RNA, 20 nt, Homo sapiens
acuagaaaauuagacuguga

SEQ ID NO: 1000354 - RNA, 16 nt, Homo sapiens
acuagagucugaacag

SEQ ID NO: 1000355 - RNA, 13 nt, Homo sapiens
acuagauguuaag

SEQ ID NO: 1000356 - RNA, 16 nt, Homo sapiens
acuagggagccauuug

SEQ ID NO: 1000357 - RNA, 23 nt, Homo sapiens
acuaugauuuaauuugaaauaug

SEQ ID NO: 1000358 - RNA, 15 nt, Homo sapiens
acuauguaacaugua

SEQ ID NO: 1000359 - RNA, 12 nt, Homo sapiens
acuauuacuggg

SEQ ID NO: 1000360 - RNA, 21 nt, Homo sapiens
acuauuguuacauuaugugga

SEQ ID NO: 1000361 - RNA, 18 nt, Homo sapiens
acuauuuaaagccuccuc

SEQ ID NO: 1000362 - RNA, 18 nt, Homo sapiens
acuauuuucaaagacuua

SEQ ID NO: 1000363 - RNA, 21 nt, Homo sapiens
acucaaauggggccagaucca

SEQ ID NO: 1000364 - RNA, 18 nt, Homo sapiens
acucagagacaugcagag

SEQ ID NO: 1000365 - RNA, 20 nt, Homo sapiens
acucagauccuccucauuca

SEQ ID NO: 1000366 - RNA, 21 nt, Homo sapiens
acucagauccuccucauucac

SEQ ID NO: 1000367 - RNA, 16 nt, Homo sapiens
acucagcacuuggccc

SEQ ID NO: 1000368 - RNA, 22 nt, Homo sapiens
acucagguaccucuuucagggu

SEQ ID NO: 1000369 - RNA, 18 nt, Homo sapiens
acucagucucucuucucu

SEQ ID NO: 1000370 - RNA, 19 nt, Homo sapiens
acucaugauuucuucuuac

SEQ ID NO: 1000371 - RNA, 18 nt, Homo sapiens
acuccaggcccaaggcuc

SEQ ID NO: 1000372 - RNA, 12 nt, Homo sapiens
acucccuccuca

SEQ ID NO: 1000373 - RNA, 17 nt, Homo sapiens
acuccuccugagcucug

SEQ ID NO: 1000374 - RNA, 19 nt, Homo sapiens
acuccuuuuuugcaugugc

SEQ ID NO: 1000375 - RNA, 14 nt, Homo sapiens
acucuacuaaugcc

SEQ ID NO: 1000376 - RNA, 16 nt, Homo sapiens
acucuagucaaugaca

SEQ ID NO: 1000377 - RNA, 13 nt, Homo sapiens
acucugcucugau

SEQ ID NO: 1000378 - RNA, 12 nt, Homo sapiens
acucugucuugu

SEQ ID NO: 1000379 - RNA, 21 nt, Homo sapiens
acucuucccccucucccaguu

SEQ ID NO: 1000380 - RNA, 17 nt, Homo sapiens
acucuucccucucucac

SEQ ID NO: 1000381 - RNA, 21 nt, Homo sapiens
acucuuccuuccuaauaggca

SEQ ID NO: 1000382 - RNA, 12 nt, Homo sapiens
acucuugcaggg

SEQ ID NO: 1000383 - RNA, 14 nt, Homo sapiens
acucuugccuguuu

SEQ ID NO: 1000384 - RNA, 20 nt, Homo sapiens
acugaaaaaucuaagugaua

SEQ ID NO: 1000385 - RNA, 13 nt, Homo sapiens
acugaacauccaa

SEQ ID NO: 1000386 - RNA, 15 nt, Homo sapiens
acugaacucacuuuc

SEQ ID NO: 1000387 - RNA, 12 nt, Homo sapiens
acugaaugucau

SEQ ID NO: 1000388 - RNA, 13 nt, Homo sapiens
acugacaguuuac

SEQ ID NO: 1000389 - RNA, 11 nt, Homo sapiens
acugaccagca

SEQ ID NO: 1000390 - RNA, 13 nt, Homo sapiens
acugaugucuccu

SEQ ID NO: 1000391 - RNA, 14 nt, Homo sapiens
acugcaaaccgcca

SEQ ID NO: 1000392 - RNA, 20 nt, Homo sapiens
acugcaaagcucggugcucc

SEQ ID NO: 1000393 - RNA, 12 nt, Homo sapiens
acugcaaccucc

SEQ ID NO: 1000394 - RNA, 13 nt, Homo sapiens
acugcaaccucca

SEQ ID NO: 1000395 - RNA, 20 nt, Homo sapiens
cugaguuuuccauggcagga

SEQ ID NO: 1000396 - RNA, 18 nt, Homo sapiens
cugauaagagaaucaaca

SEQ ID NO: 1000397 - RNA, 18 nt, Homo sapiens
cugauacuuugacagugu

SEQ ID NO: 1000398 - RNA, 14 nt, Homo sapiens
cugauauggcuuuu

SEQ ID NO: 1000399 - RNA, 12 nt, Homo sapiens
cugaugcugaca

SEQ ID NO: 1000400 - RNA, 15 nt, Homo sapiens
cugaugcugccccuc

SEQ ID NO: 1000401 - RNA, 21 nt, Homo sapiens
cugauggauaucccuaccuug

SEQ ID NO: 1000402 - RNA, 14 nt, Homo sapiens
cugauuguuuucau

SEQ ID NO: 1000403 - RNA, 17 nt, Homo sapiens
cugauuuguaacccacu

SEQ ID NO: 1000404 - RNA, 13 nt, Homo sapiens
cugcaaacagugu

SEQ ID NO: 1000405 - RNA, 14 nt, Homo sapiens
cugcaaacugggaa

SEQ ID NO: 1000406 - RNA, 14 nt, Homo sapiens
cugcaacucaagga

SEQ ID NO: 1000407 - RNA, 13 nt, Homo sapiens
cugcaccaugcug

SEQ ID NO: 1000408 - RNA, 14 nt, Homo sapiens
cugcaccaugcugc

SEQ ID NO: 1000409 - RNA, 20 nt, Homo sapiens
cugcaccaugcugcugggga

SEQ ID NO: 1000410 - RNA, 14 nt, Homo sapiens
cugcaccuuugcac

SEQ ID NO: 1000411 - RNA, 14 nt, Homo sapiens
cugcacuacugaca

SEQ ID NO: 1000412 - RNA, 15 nt, Homo sapiens
cugcagaaacagugc

SEQ ID NO: 1000413 - RNA, 17 nt, Homo sapiens
cugcagaaacuacugac

SEQ ID NO: 1000414 - RNA, 20 nt, Homo sapiens
cugcagccucaggacuggga

SEQ ID NO: 1000415 - RNA, 24 nt, Homo sapiens
cugcagccuccaccuccuaggcuc

SEQ ID NO: 1000416 - RNA, 20 nt, Homo sapiens
cugcaguaugggaucugaua

SEQ ID NO: 1000417 - RNA, 15 nt, Homo sapiens
cugcaugcccagaga

SEQ ID NO: 1000418 - RNA, 17 nt, Homo sapiens
cugcauucuucugagca

SEQ ID NO: 1000419 - RNA, 21 nt, Homo sapiens
cugccaggcucucuuugccca

SEQ ID NO: 1000420 - RNA, 21 nt, Homo sapiens
cugcccaaagcagcacuuaua

SEQ ID NO: 1000421 - RNA, 18 nt, Homo sapiens
cugcccaggcacugcaaa

SEQ ID NO: 1000422 - RNA, 22 nt, Homo sapiens
cugcccauggacaggcuggcuc

SEQ ID NO: 1000423 - RNA, 19 nt, Homo sapiens
cugccccaggccugaaaga

SEQ ID NO: 1000424 - RNA, 13 nt, Homo sapiens
cugcccucugcau

SEQ ID NO: 1000425 - RNA, 19 nt, Homo sapiens
cugcccuggcugggccccu

SEQ ID NO: 1000426 - RNA, 13 nt, Homo sapiens
cugccuagauuca

SEQ ID NO: 1000427 - RNA, 17 nt, Homo sapiens
cugcgagagaaagggag

SEQ ID NO: 1000428 - RNA, 20 nt, Homo sapiens
cugcuacaccuauuauccca

SEQ ID NO: 1000429 - RNA, 22 nt, Homo sapiens
cugcuacuuauauaauugccaa

SEQ ID NO: 1000430 - RNA, 12 nt, Homo sapiens
cugcucccucag

SEQ ID NO: 1000431 - RNA, 22 nt, Homo sapiens
cugcuccuguucacaccagaga

SEQ ID NO: 1000432 - RNA, 18 nt, Homo sapiens
cugcucugaacacgaagc

SEQ ID NO: 1000433 - RNA, 21 nt, Homo sapiens
cugcucuggauaacaagacuu

SEQ ID NO: 1000434 - RNA, 14 nt, Homo sapiens
cugcucuuccucag

SEQ ID NO: 1000435 - RNA, 15 nt, Homo sapiens
cugcucuuucucugc

SEQ ID NO: 1000436 - RNA, 22 nt, Homo sapiens
cugcucuuucucugccagugac

SEQ ID NO: 1000437 - RNA, 23 nt, Homo sapiens
cugcucuuucucugccagugaca

SEQ ID NO: 1000438 - RNA, 18 nt, Homo sapiens
cugcugucacaaccaaga

SEQ ID NO: 1000439 - RNA, 20 nt, Homo sapiens
cugcuuaaauuucuccagug

SEQ ID NO: 1000440 - RNA, 11 nt, Homo sapiens
cugcuucucac

SEQ ID NO: 1000441 - RNA, 16 nt, Homo sapiens
cugcuucucccaggca

SEQ ID NO: 1000442 - RNA, 14 nt, Homo sapiens
cugcuugaccaaag

SEQ ID NO: 1000443 - RNA, 17 nt, Homo sapiens
cugcuuuucccauugcc

SEQ ID NO: 1000444 - RNA, 18 nt, Homo sapiens
cuggaaaacagaacacuu

SEQ ID NO: 1000445 - RNA, 13 nt, Homo sapiens
cuggaacaccagg

SEQ ID NO: 1000446 - RNA, 12 nt, Homo sapiens
cuggaagccaaa

SEQ ID NO: 1000447 - RNA, 17 nt, Homo sapiens
cuggaagcuaauuugca

SEQ ID NO: 1000448 - RNA, 13 nt, Homo sapiens
cuggacucucagu

SEQ ID NO: 1000449 - RNA, 20 nt, Homo sapiens
cuggagaaagggcccugggc

SEQ ID NO: 1000450 - RNA, 17 nt, Homo sapiens
cuggaggacggucaguc

SEQ ID NO: 1000451 - RNA, 14 nt, Homo sapiens
cuggaggagcccag

SEQ ID NO: 1000452 - RNA, 14 nt, Homo sapiens
cuggaggcaccugg

SEQ ID NO: 1000453 - RNA, 15 nt, Homo sapiens
cuggaggcagggaac

SEQ ID NO: 1000454 - RNA, 22 nt, Homo sapiens
cuggaggcccaguucacccuga

SEQ ID NO: 1000455 - RNA, 21 nt, Homo sapiens
cuggagugcaguggugcaauc

SEQ ID NO: 1000456 - RNA, 20 nt, Homo sapiens
cuggaguggaguggcgugau

SEQ ID NO: 1000457 - RNA, 20 nt, Homo sapiens
cuggaguuagggacugacca

SEQ ID NO: 1000458 - RNA, 15 nt, Homo sapiens
cuggauucuaaggaa

SEQ ID NO: 1000459 - RNA, 17 nt, Homo sapiens
cuggauuucauacugua

SEQ ID NO: 1000460 - RNA, 18 nt, Homo sapiens
cuggauuucauacuguaa

SEQ ID NO: 1000461 - RNA, 14 nt, Homo sapiens
cuggcaacacagag

SEQ ID NO: 1000462 - RNA, 19 nt, Homo sapiens
cuggcauuugcaccuaccu

SEQ ID NO: 1000463 - RNA, 15 nt, Homo sapiens
cuggcccagccuuug

SEQ ID NO: 1000464 - RNA, 16 nt, Homo sapiens
cuggcccccucagugu

SEQ ID NO: 1000465 - RNA, 22 nt, Homo sapiens
cugggagcccggcaacucuagu

SEQ ID NO: 1000466 - RNA, 22 nt, Homo sapiens
cugggauuacaauugugagcca

SEQ ID NO: 1000467 - RNA, 14 nt, Homo sapiens
cugggccaugucca

SEQ ID NO: 1000468 - RNA, 22 nt, Homo sapiens
cugggccauucuccacagcaac

SEQ ID NO: 1000469 - RNA, 22 nt, Homo sapiens
cugggcccucucugcucugcgu

SEQ ID NO: 1000470 - RNA, 22 nt, Homo sapiens
cugggcuaaguaaauaggaauu

SEQ ID NO: 1000471 - RNA, 17 nt, Homo sapiens
cugggcuccuccagggu

SEQ ID NO: 1000472 - RNA, 22 nt, Homo sapiens
cuggggagcgggucugcuccca

SEQ ID NO: 1000473 - RNA, 23 nt, Homo sapiens
cuggggaucccacucuucuugca

SEQ ID NO: 1000474 - RNA, 14 nt, Homo sapiens
cuggggccugggac

SEQ ID NO: 1000475 - RNA, 17 nt, Homo sapiens
cuggggccugggacaac

SEQ ID NO: 1000476 - RNA, 18 nt, Homo sapiens
cuggggcucuaacgccug

SEQ ID NO: 1000477 - RNA, 19 nt, Homo sapiens
cugggugcuacuggggaaa

SEQ ID NO: 1000478 - RNA, 23 nt, Homo sapiens
cuggguggcuacucugugccaga

SEQ ID NO: 1000479 - RNA, 22 nt, Homo sapiens
cuggguuuuguauucucugagc

SEQ ID NO: 1000480 - RNA, 17 nt, Homo sapiens
cugguaauagcuguaaa

SEQ ID NO: 1000481 - RNA, 22 nt, Homo sapiens
cugguaauauugacuuguauau

SEQ ID NO: 1000482 - RNA, 21 nt, Homo sapiens
cugguagaagggaaagcccau

SEQ ID NO: 1000483 - RNA, 13 nt, Homo sapiens
cugguagaccacu

SEQ ID NO: 1000484 - RNA, 17 nt, Homo sapiens
cugguagaccacugcca

SEQ ID NO: 1000485 - RNA, 21 nt, Homo sapiens
cuggucccggggccagcacuu

SEQ ID NO: 1000486 - RNA, 22 nt, Homo sapiens
cuggucccggggccagcacuuc

SEQ ID NO: 1000487 - RNA, 23 nt, Homo sapiens
cuggucucaaacuccugggcuca

SEQ ID NO: 1000488 - RNA, 16 nt, Homo sapiens
cuggugagucaccacu

SEQ ID NO: 1000489 - RNA, 22 nt, Homo sapiens
cugguggcacaggaguguccuc

SEQ ID NO: 1000490 - RNA, 18 nt, Homo sapiens
cugguggggcagcuccuc

SEQ ID NO: 1000491 - RNA, 17 nt, Homo sapiens
cuggugugguacagaga

SEQ ID NO: 1000492 - RNA, 17 nt, Homo sapiens
cugguuagguagaggga

SEQ ID NO: 1000493 - RNA, 13 nt, Homo sapiens
cugguuuucacau

SEQ ID NO: 1000494 - RNA, 14 nt, Homo sapiens
cuguaaccucuuca

SEQ ID NO: 1000495 - RNA, 21 nt, Homo sapiens
cuguaagaaaccuacugccca

SEQ ID NO: 1000496 - RNA, 14 nt, Homo sapiens
cuguaagugucuug

SEQ ID NO: 1000497 - RNA, 18 nt, Homo sapiens
cuguaauguuaauauuga

SEQ ID NO: 1000498 - RNA, 19 nt, Homo sapiens
cuguaauguuaauauugau

SEQ ID NO: 1000499 - RNA, 13 nt, Homo sapiens
gaaggcuggacua

SEQ ID NO: 1000500 - RNA, 13 nt, Homo sapiens
gaaggcuguggug

SEQ ID NO: 1000501 - RNA, 16 nt, Homo sapiens
gaaggcuuguugugcu

SEQ ID NO: 1000502 - RNA, 19 nt, Homo sapiens
gaagggacacacaagaaga

SEQ ID NO: 1000503 - RNA, 13 nt, Homo sapiens
gaagguugcaccu

SEQ ID NO: 1000504 - RNA, 14 nt, Homo sapiens
gaaguaaaagcaaa

SEQ ID NO: 1000505 - RNA, 17 nt, Homo sapiens
gaagucucaucugggga

SEQ ID NO: 1000506 - RNA, 21 nt, Homo sapiens
gaagugaccuggaaucaguga

SEQ ID NO: 1000507 - RNA, 22 nt, Homo sapiens
gaagugagggcucacucagcca

SEQ ID NO: 1000508 - RNA, 21 nt, Homo sapiens
gaauaaaccaucaucuugcca

SEQ ID NO: 1000509 - RNA, 16 nt, Homo sapiens
gaauagcaugucacua

SEQ ID NO: 1000510 - RNA, 19 nt, Homo sapiens
gaauaucuguaaugguacu

SEQ ID NO: 1000511 - RNA, 21 nt, Homo sapiens
gaaucagugaagccaaaggga

SEQ ID NO: 1000512 - RNA, 23 nt, Homo sapiens
gaaucccagcccccugaccacuc

SEQ ID NO: 1000513 - RNA, 22 nt, Homo sapiens
gaaucggcgacggagcacugca

SEQ ID NO: 1000514 - RNA, 17 nt, Homo sapiens
gaaucuacuaauuccac

SEQ ID NO: 1000515 - RNA, 15 nt, Homo sapiens
gaaucucugugccuu

SEQ ID NO: 1000516 - RNA, 19 nt, Homo sapiens
gaaucugugggucugggag

SEQ ID NO: 1000517 - RNA, 17 nt, Homo sapiens
gaaugaguugaggccac

SEQ ID NO: 1000518 - RNA, 18 nt, Homo sapiens
gaaugcacaagaauggau

SEQ ID NO: 1000519 - RNA, 19 nt, Homo sapiens
gaauggaaaggauggagca

SEQ ID NO: 1000520 - RNA, 19 nt, Homo sapiens
gaauucuuuuucauuugag

SEQ ID NO: 1000521 - RNA, 11 nt, Homo sapiens
gaauugcacau

SEQ ID NO: 1000522 - RNA, 17 nt, Homo sapiens
gaauugucuuccgcuag

SEQ ID NO: 1000523 - RNA, 23 nt, Homo sapiens
gaauuuuauacuuucccuacccu

SEQ ID NO: 1000524 - RNA, 17 nt, Homo sapiens
gacaacugcucccaccu

SEQ ID NO: 1000525 - RNA, 18 nt, Homo sapiens
gacaaucauguguguuaa

SEQ ID NO: 1000526 - RNA, 14 nt, Homo sapiens
gacacaaacacaca

SEQ ID NO: 1000527 - RNA, 12 nt, Homo sapiens
gacacacuuguc

SEQ ID NO: 1000528 - RNA, 13 nt, Homo sapiens
gacacagaaaaug

SEQ ID NO: 1000529 - RNA, 22 nt, Homo sapiens
gacacagcccccacggacaaaa

SEQ ID NO: 1000530 - RNA, 19 nt, Homo sapiens
gacacaggcccucccuguu

SEQ ID NO: 1000531 - RNA, 16 nt, Homo sapiens
gacaccuuuagguucu

SEQ ID NO: 1000532 - RNA, 16 nt, Homo sapiens
gacacugaaaaaucua

SEQ ID NO: 1000533 - RNA, 12 nt, Homo sapiens
gacacugcagcc

SEQ ID NO: 1000534 - RNA, 19 nt, Homo sapiens
gacacuggcguuacugcuu

SEQ ID NO: 1000535 - RNA, 14 nt, Homo sapiens
gacagaaccacagg

SEQ ID NO: 1000536 - RNA, 22 nt, Homo sapiens
gacagagccaggagaagcucag

SEQ ID NO: 1000537 - RNA, 16 nt, Homo sapiens
gacagagggcucaccu

SEQ ID NO: 1000538 - RNA, 17 nt, Homo sapiens
gacagaugaaugccgug

SEQ ID NO: 1000539 - RNA, 15 nt, Homo sapiens
gacagccaagcaccu

SEQ ID NO: 1000540 - RNA, 13 nt, Homo sapiens
gacagcucuccaa

SEQ ID NO: 1000541 - RNA, 18 nt, Homo sapiens
gacagcucuguaucugcc

SEQ ID NO: 1000542 - RNA, 18 nt, Homo sapiens
gacaggacuaacacucag

SEQ ID NO: 1000543 - RNA, 13 nt, Homo sapiens
gacaggcucuuag

SEQ ID NO: 1000544 - RNA, 12 nt, Homo sapiens
gacaggguguug

SEQ ID NO: 1000545 - RNA, 18 nt, Homo sapiens
gacagucguucccagugu

SEQ ID NO: 1000546 - RNA, 17 nt, Homo sapiens
gacaguguuuucuggga

SEQ ID NO: 1000547 - RNA, 20 nt, Homo sapiens
gacauaaaggaaaagacaca

SEQ ID NO: 1000548 - RNA, 17 nt, Homo sapiens
gacauacuuaaugcaua

SEQ ID NO: 1000549 - RNA, 22 nt, Homo sapiens
gacaucagcccuuggggguccu

SEQ ID NO: 1000550 - RNA, 19 nt, Homo sapiens
gacauggagaccgugacca

SEQ ID NO: 1000551 - RNA, 14 nt, Homo sapiens
gacauggagguucu

SEQ ID NO: 1000552 - RNA, 13 nt, Homo sapiens
gacaugugacauu

SEQ ID NO: 1000553 - RNA, 15 nt, Homo sapiens
gacaugugacauuua

SEQ ID NO: 1000554 - RNA, 17 nt, Homo sapiens
gaccaaagagcccucaa

SEQ ID NO: 1000555 - RNA, 20 nt, Homo sapiens
gaccaaucaucaacuaccau

SEQ ID NO: 1000556 - RNA, 19 nt, Homo sapiens
gaccacagcacagccaaca

SEQ ID NO: 1000557 - RNA, 18 nt, Homo sapiens
gaccaccuuuuugaguga

SEQ ID NO: 1000558 - RNA, 22 nt, Homo sapiens
gaccacucugucuuguguuucc

SEQ ID NO: 1000559 - RNA, 23 nt, Homo sapiens
gacccaggaaaggcaggauugaa

SEQ ID NO: 1000560 - RNA, 23 nt, Homo sapiens
gacccaggggucagccuuaggaa

SEQ ID NO: 1000561 - RNA, 14 nt, Homo sapiens
gacccccagcacuu

SEQ ID NO: 1000562 - RNA, 18 nt, Homo sapiens
gacccuagggauuugcac

SEQ ID NO: 1000563 - RNA, 15 nt, Homo sapiens
gacccuugcugugaa

SEQ ID NO: 1000564 - RNA, 12 nt, Homo sapiens
gacccuuuucau

SEQ ID NO: 1000565 - RNA, 22 nt, Homo sapiens
gaccuaaauuauuuacugcaaa

SEQ ID NO: 1000566 - RNA, 18 nt, Homo sapiens
gaccuauuagaguauuuu

SEQ ID NO: 1000567 - RNA, 15 nt, Homo sapiens
gaccucaagugaucu

SEQ ID NO: 1000568 - RNA, 18 nt, Homo sapiens
gaccuccacccacugugg

SEQ ID NO: 1000569 - RNA, 15 nt, Homo sapiens
gaccuccguucaaua

SEQ ID NO: 1000570 - RNA, 14 nt, Homo sapiens
gaccugauccugga

SEQ ID NO: 1000571 - RNA, 15 nt, Homo sapiens
gaccugauccuggag

SEQ ID NO: 1000572 - RNA, 17 nt, Homo sapiens
gaccuggugcugccucu

SEQ ID NO: 1000573 - RNA, 17 nt, Homo sapiens
gaccuguaaucauauaa

SEQ ID NO: 1000574 - RNA, 13 nt, Homo sapiens
gaccuuaaaugca

SEQ ID NO: 1000575 - RNA, 16 nt, Homo sapiens
gacgaguaacuccccu

SEQ ID NO: 1000576 - RNA, 17 nt, Homo sapiens
gacgcccugcucuggau

SEQ ID NO: 1000577 - RNA, 15 nt, Homo sapiens
gacggaguccugugu

SEQ ID NO: 1000578 - RNA, 14 nt, Homo sapiens
gacggucaguccau

SEQ ID NO: 1000579 - RNA, 18 nt, Homo sapiens
gacuagauguaguauuuu

SEQ ID NO: 1000580 - RNA, 14 nt, Homo sapiens
gacuaugaaaagcu

SEQ ID NO: 1000581 - RNA, 15 nt, Homo sapiens
gacuauguagcaaua

SEQ ID NO: 1000582 - RNA, 16 nt, Homo sapiens
gacucaaauguucuaa

SEQ ID NO: 1000583 - RNA, 21 nt, Homo sapiens
gacucacaccacuagccucag

SEQ ID NO: 1000584 - RNA, 22 nt, Homo sapiens
gacuccacgcuguccuuuggga

SEQ ID NO: 1000585 - RNA, 20 nt, Homo sapiens
gacucuaaagucuguugauu

SEQ ID NO: 1000586 - RNA, 12 nt, Homo sapiens
gacugauuucag

SEQ ID NO: 1000587 - RNA, 16 nt, Homo sapiens
gacuggcuuuuauuaa

SEQ ID NO: 1000588 - RNA, 13 nt, Homo sapiens
gacuucaucccaa

SEQ ID NO: 1000589 - RNA, 17 nt, Homo sapiens
gacuucucuuugccuca

SEQ ID NO: 1000590 - RNA, 16 nt, Homo sapiens
gacuugaaauucucau

SEQ ID NO: 1000591 - RNA, 21 nt, Homo sapiens
gacuuggccucucucuagggu

SEQ ID NO: 1000592 - RNA, 19 nt, Homo sapiens
gacuuuguccccacuuaca

SEQ ID NO: 1000593 - RNA, 15 nt, Homo sapiens
gacuuuugcuuuaug

SEQ ID NO: 1000594 - RNA, 15 nt, Homo sapiens
gagaaaaacacacag

SEQ ID NO: 1000595 - RNA, 20 nt, Homo sapiens
gagaaagggcggugaacucu

SEQ ID NO: 1000596 - RNA, 15 nt, Homo sapiens
gagaaccucagauca

SEQ ID NO: 1000597 - RNA, 19 nt, Homo sapiens
gagaacuggacaguggcag

SEQ ID NO: 1000598 - RNA, 15 nt, Homo sapiens
gagaagcaaggguug

SEQ ID NO: 1000599 - RNA, 20 nt, Homo sapiens
gagaagccaggaauuuccca

SEQ ID NO: 1000600 - RNA, 15 nt, Homo sapiens
gagaaggaggggagc

SEQ ID NO: 1000601 - RNA, 16 nt, Homo sapiens
gagaagucacagggca

SEQ ID NO: 1000602 - RNA, 13 nt, Homo sapiens
gagaaucacuuga

SEQ ID NO: 1000603 - RNA, 12 nt, Homo sapiens
gagaauuguuga

SEQ ID NO: 1000604 - RNA, 18 nt, Homo sapiens
gagacaggguuucaccau

SEQ ID NO: 1000605 - RNA, 16 nt, Homo sapiens
gagaccaccagggcau

SEQ ID NO: 1000606 - RNA, 19 nt, Homo sapiens
gagaccuuccagaaauacu

SEQ ID NO: 1000607 - RNA, 13 nt, Homo sapiens
gagacugggucuc

SEQ ID NO: 1000608 - RNA, 17 nt, Homo sapiens
gagacugugugugcccu

SEQ ID NO: 1000609 - RNA, 13 nt, Homo sapiens
gagagaaagggag

SEQ ID NO: 1000610 - RNA, 20 nt, Homo sapiens
gagagauuuaacauuaucua

SEQ ID NO: 1000611 - RNA, 18 nt, Homo sapiens
gagagcacgccuguacua

SEQ ID NO: 1000612 - RNA, 15 nt, Homo sapiens
gagagcagaggucuc

SEQ ID NO: 1000613 - RNA, 16 nt, Homo sapiens
gagagccaccaagagg

SEQ ID NO: 1000614 - RNA, 19 nt, Homo sapiens
gagaggggccgaugcccag

SEQ ID NO: 1000615 - RNA, 15 nt, Homo sapiens
gagagugagacucag

SEQ ID NO: 1000616 - RNA, 13 nt, Homo sapiens
gagaguuugccug

SEQ ID NO: 1000617 - RNA, 11 nt, Homo sapiens
gagauccuccu

SEQ ID NO: 1000618 - RNA, 16 nt, Homo sapiens
gagaucuguugauuga

SEQ ID NO: 1000619 - RNA, 13 nt, Homo sapiens
gagauucugccuu

SEQ ID NO: 1000620 - RNA, 20 nt, Homo sapiens
gagauugcaccacugcacuc

SEQ ID NO: 1000621 - RNA, 14 nt, Homo sapiens
gagcaaacugcaug

SEQ ID NO: 1000622 - RNA, 23 nt, Homo sapiens
gagcacugccaggagggacaaag

SEQ ID NO: 1000623 - RNA, 19 nt, Homo sapiens
gagcaguccuuggccugcu

SEQ ID NO: 1000624 - RNA, 15 nt, Homo sapiens
gagcauggaacacuu

SEQ ID NO: 1000625 - RNA, 15 nt, Homo sapiens
gagccaccaguucuc

SEQ ID NO: 1000626 - RNA, 17 nt, Homo sapiens
gagccgggucugccucu

SEQ ID NO: 1000627 - RNA, 15 nt, Homo sapiens
gagccugaacaugcc

SEQ ID NO: 1000628 - RNA, 16 nt, Homo sapiens
gagccuuccacccagg

SEQ ID NO: 1000629 - RNA, 15 nt, Homo sapiens
gagcuccaguguccu

SEQ ID NO: 1000630 - RNA, 16 nt, Homo sapiens
gagcugauacuuugac

SEQ ID NO: 1000631 - RNA, 21 nt, Homo sapiens
gagcugauacuuugacagugu

SEQ ID NO: 1000632 - RNA, 15 nt, Homo sapiens
gagcuuaaucuuuga

SEQ ID NO: 1000633 - RNA, 15 nt, Homo sapiens
gaggaaacucuguca

SEQ ID NO: 1000634 - RNA, 14 nt, Homo sapiens
gaggaccuccuacc

SEQ ID NO: 1000635 - RNA, 19 nt, Homo sapiens
gaggagggucggugccuuc

SEQ ID NO: 1000636 - RNA, 22 nt, Homo sapiens
gaggagucugagguccugagca

SEQ ID NO: 1000637 - RNA, 21 nt, Homo sapiens
gaggcaacccgugcucagcug

SEQ ID NO: 1000638 - RNA, 19 nt, Homo sapiens
gaggcagaccauccaccag

SEQ ID NO: 1000639 - RNA, 12 nt, Homo sapiens
gaggcagggaac

SEQ ID NO: 1000640 - RNA, 17 nt, Homo sapiens
gaggccauggacucugu

SEQ ID NO: 1000641 - RNA, 22 nt, Homo sapiens
gaggccauggacucuguccuga

SEQ ID NO: 1000642 - RNA, 17 nt, Homo sapiens
gaggcccaggcugggaa

SEQ ID NO: 1000643 - RNA, 18 nt, Homo sapiens
gaggcugccccucucacc

SEQ ID NO: 1000644 - RNA, 21 nt, Homo sapiens
gaggcuugguuccuucccaau

SEQ ID NO: 1000645 - RNA, 16 nt, Homo sapiens
gagggcagcagccagc

SEQ ID NO: 1000646 - RNA, 21 nt, Homo sapiens
gagggccuaaccgagaucagu

SEQ ID NO: 1000647 - RNA, 17 nt, Homo sapiens
gagggggccaggcggug

SEQ ID NO: 1000648 - RNA, 21 nt, Homo sapiens
gagggugggaaggaaacaacc

SEQ ID NO: 1000649 - RNA, 17 nt, Homo sapiens
gagguccugagcacugc

SEQ ID NO: 1000650 - RNA, 13 nt, Homo sapiens
gaggugucucagg

SEQ ID NO: 1000651 - RNA, 18 nt, Homo sapiens
gaguaauacaucaaagag

SEQ ID NO: 1000652 - RNA, 17 nt, Homo sapiens
gaguagaagucucuucc

SEQ ID NO: 1000653 - RNA, 14 nt, Homo sapiens
gaguagggggagca

SEQ ID NO: 1000654 - RNA, 16 nt, Homo sapiens
gaguaucacaucacac

SEQ ID NO: 1000655 - RNA, 13 nt, Homo sapiens
gagucacaccaga

SEQ ID NO: 1000656 - RNA, 14 nt, Homo sapiens
gagucacaccagaa

SEQ ID NO: 1000657 - RNA, 18 nt, Homo sapiens
gagucugaacagcuguaa

SEQ ID NO: 1000658 - RNA, 19 nt, Homo sapiens
gagucuuugguucuaagga

SEQ ID NO: 1000659 - RNA, 14 nt, Homo sapiens
gaguggcacguuua

SEQ ID NO: 1000660 - RNA, 23 nt, Homo sapiens
gagugucuuuccacggagccacu

SEQ ID NO: 1000661 - RNA, 16 nt, Homo sapiens
gaguguucccuaucca

SEQ ID NO: 1000662 - RNA, 18 nt, Homo sapiens
gaguguuuaaaguucaac

SEQ ID NO: 1000663 - RNA, 13 nt, Homo sapiens
gaguugaucugga

SEQ ID NO: 1000664 - RNA, 22 nt, Homo sapiens
gaguuuaauuuuugaaaacugg

SEQ ID NO: 1000665 - RNA, 22 nt, Homo sapiens
gauaaagggaaccacuuucuua

SEQ ID NO: 1000666 - RNA, 18 nt, Homo sapiens
gauaaccuugugccuugg

SEQ ID NO: 1000667 - RNA, 18 nt, Homo sapiens
gauaacuaggaaauccau

SEQ ID NO: 1000668 - RNA, 20 nt, Homo sapiens
gauaagacacccccucaaac

SEQ ID NO: 1000669 - RNA, 16 nt, Homo sapiens
gauacuuugacagugu

SEQ ID NO: 1000670 - RNA, 14 nt, Homo sapiens
gauagaugcuggcc

SEQ ID NO: 1000671 - RNA, 18 nt, Homo sapiens
gauagcaaauggccucau

SEQ ID NO: 1000672 - RNA, 15 nt, Homo sapiens
gauaugcguauuaua

SEQ ID NO: 1000673 - RNA, 13 nt, Homo sapiens
gauauugcagcuu

SEQ ID NO: 1000674 - RNA, 17 nt, Homo sapiens
gaucaaauugugcagua

SEQ ID NO: 1000675 - RNA, 22 nt, Homo sapiens
gaucaaauugugcaguacuuug

SEQ ID NO: 1000676 - RNA, 23 nt, Homo sapiens
gaucacagugaacuuaguccugu

SEQ ID NO: 1000677 - RNA, 19 nt, Homo sapiens
gaucacucaccauucccag

SEQ ID NO: 1000678 - RNA, 15 nt, Homo sapiens
gaucaggcacagugg

SEQ ID NO: 1000679 - RNA, 23 nt, Homo sapiens
gauccaaaagaagcccccagcua

SEQ ID NO: 1000680 - RNA, 18 nt, Homo sapiens
gaucccacucuucuugca

SEQ ID NO: 1000681 - RNA, 23 nt, Homo sapiens
gaucucggcucacugcaaccucc

SEQ ID NO: 1000682 - RNA, 22 nt, Homo sapiens
gaucugagucagagccaugucu

SEQ ID NO: 1000683 - RNA, 19 nt, Homo sapiens
gaucuggaacccagacuca

SEQ ID NO: 1000684 - RNA, 18 nt, Homo sapiens
gaucuggaaccucagccu

SEQ ID NO: 1000685 - RNA, 18 nt, Homo sapiens
gaucuguuuugaaggcaa

SEQ ID NO: 1000686 - RNA, 17 nt, Homo sapiens
gaugaaucgcauuuccu

SEQ ID NO: 1000687 - RNA, 21 nt, Homo sapiens
gaugacauuaaagaaggguug

SEQ ID NO: 1000688 - RNA, 17 nt, Homo sapiens
gaugagcaagacauacu

SEQ ID NO: 1000689 - RNA, 13 nt, Homo sapiens
gaugagggggcca

SEQ ID NO: 1000690 - RNA, 23 nt, Homo sapiens
gaugauacuuggaugcagcucuu

SEQ ID NO: 1000691 - RNA, 21 nt, Homo sapiens
gaugaucuggauccaccaaga

SEQ ID NO: 1000692 - RNA, 16 nt, Homo sapiens
gaugauggaugccaau

SEQ ID NO: 1000693 - RNA, 13 nt, Homo sapiens
gauguaauacuuc

SEQ ID NO: 1000694 - RNA, 22 nt, Homo sapiens
gauguaccaggcucucgcacac

SEQ ID NO: 1000695 - RNA, 18 nt, Homo sapiens
gauguggccugcauguac

SEQ ID NO: 1000696 - RNA, 13 nt, Homo sapiens
gauguggguucca

SEQ ID NO: 1000697 - RNA, 20 nt, Homo sapiens
gaugugucccaucuagggaa

SEQ ID NO: 1000698 - RNA, 14 nt, Homo sapiens
gauguguguugaua

SEQ ID NO: 1000699 - RNA, 18 nt, Homo sapiens
gauguuccuuccaguguc

SEQ ID NO: 1000700 - RNA, 15 nt, Homo sapiens
gauucaccucuucuu

SEQ ID NO: 1000701 - RNA, 21 nt, Homo sapiens
gauuccccaucucaggccaga

SEQ ID NO: 1000702 - RNA, 19 nt, Homo sapiens
gauucccccagucauucug

SEQ ID NO: 1000703 - RNA, 19 nt, Homo sapiens
gauugauagaguguuauca

SEQ ID NO: 1000704 - RNA, 21 nt, Homo sapiens
gauuuaucacacaaagcagaa

SEQ ID NO: 1000705 - RNA, 15 nt, Homo sapiens
gauuucggaggccau

SEQ ID NO: 1000706 - RNA, 12 nt, Homo sapiens
gauuugcucagg

SEQ ID NO: 1000707 - RNA, 21 nt, Homo sapiens
uugcagcuuauauucauccau

SEQ ID NO: 1000708 - RNA, 17 nt, Homo sapiens
uugcagucacucuaguc

SEQ ID NO: 1000709 - RNA, 20 nt, Homo sapiens
uugcauaguaccaaucauuu

SEQ ID NO: 1000710 - RNA, 22 nt, Homo sapiens
uugcaugauaucuucaagccug

SEQ ID NO: 1000711 - RNA, 18 nt, Homo sapiens
uugccaccucuaacagca

SEQ ID NO: 1000712 - RNA, 21 nt, Homo sapiens
uugccauuccucuacugcaau

SEQ ID NO: 1000713 - RNA, 15 nt, Homo sapiens
uugccucugugcugu

SEQ ID NO: 1000714 - RNA, 18 nt, Homo sapiens
uugccugccacuguguga

SEQ ID NO: 1000715 - RNA, 13 nt, Homo sapiens
uugcuaccaguau

SEQ ID NO: 1000716 - RNA, 15 nt, Homo sapiens
uugcuggaguacuua

SEQ ID NO: 1000717 - RNA, 15 nt, Homo sapiens
uugcuuuauuccaga

SEQ ID NO: 1000718 - RNA, 18 nt, Homo sapiens
uugcuuuucacauccauu

SEQ ID NO: 1000719 - RNA, 19 nt, Homo sapiens
uuggaaagcagguuucaag

SEQ ID NO: 1000720 - RNA, 20 nt, Homo sapiens
uuggaagugaaaacuuugua

SEQ ID NO: 1000721 - RNA, 16 nt, Homo sapiens
uuggacuugcauuccc

SEQ ID NO: 1000722 - RNA, 16 nt, Homo sapiens
uuggagaguuugccug

SEQ ID NO: 1000723 - RNA, 13 nt, Homo sapiens
uuggcaccagaca

SEQ ID NO: 1000724 - RNA, 16 nt, Homo sapiens
uuggccacagccaggg

SEQ ID NO: 1000725 - RNA, 17 nt, Homo sapiens
uuggccucugcuaaggu

SEQ ID NO: 1000726 - RNA, 15 nt, Homo sapiens
uuggcuacacacaaa

SEQ ID NO: 1000727 - RNA, 18 nt, Homo sapiens
uuggcugcaggaaucuuu

SEQ ID NO: 1000728 - RNA, 15 nt, Homo sapiens
uuggcuggacccagc

SEQ ID NO: 1000729 - RNA, 17 nt, Homo sapiens
uugggaagggcagggaa

SEQ ID NO: 1000730 - RNA, 23 nt, Homo sapiens
uugggagggugguucaacaaaga

SEQ ID NO: 1000731 - RNA, 13 nt, Homo sapiens
uugggauuuuucu

SEQ ID NO: 1000732 - RNA, 16 nt, Homo sapiens
uuggggcagaccccag

SEQ ID NO: 1000733 - RNA, 12 nt, Homo sapiens
uugggggcucca

SEQ ID NO: 1000734 - RNA, 14 nt, Homo sapiens
uuguaaaagcauuu

SEQ ID NO: 1000735 - RNA, 18 nt, Homo sapiens
uuguaaaauaauucugag

SEQ ID NO: 1000736 - RNA, 13 nt, Homo sapiens
uuguaagcacuga

SEQ ID NO: 1000737 - RNA, 22 nt, Homo sapiens
uuguaagcacugacugggacca

SEQ ID NO: 1000738 - RNA, 15 nt, Homo sapiens
uuguaauaauaaaga

SEQ ID NO: 1000739 - RNA, 19 nt, Homo sapiens
uuguagagauggggucuca

SEQ ID NO: 1000740 - RNA, 21 nt, Homo sapiens
uuguagagauggggucucaca

SEQ ID NO: 1000741 - RNA, 24 nt, Homo sapiens
uuguauaaagcauuuguagcaauu

SEQ ID NO: 1000742 - RNA, 17 nt, Homo sapiens
uugucaaugcaguuguc

SEQ ID NO: 1000743 - RNA, 17 nt, Homo sapiens
uugucgcucaugugugc

SEQ ID NO: 1000744 - RNA, 20 nt, Homo sapiens
uugucuuuccuggcacuaac

SEQ ID NO: 1000745 - RNA, 15 nt, Homo sapiens
uuguuaucagucaau

SEQ ID NO: 1000746 - RNA, 15 nt, Homo sapiens
uuguugagugccagc

SEQ ID NO: 1000747 - RNA, 20 nt, Homo sapiens
uuguuggcguaggcuacaga

SEQ ID NO: 1000748 - RNA, 14 nt, Homo sapiens
uuguuucuugccug

SEQ ID NO: 1000749 - RNA, 18 nt, Homo sapiens
uuuaaacuauaagcaaga

SEQ ID NO: 1000750 - RNA, 13 nt, Homo sapiens
uuuaaacuguaca

SEQ ID NO: 1000751 - RNA, 14 nt, Homo sapiens
uuuaaagccuccuc

SEQ ID NO: 1000752 - RNA, 12 nt, Homo sapiens
uuuaaaucugag

SEQ ID NO: 1000753 - RNA, 13 nt, Homo sapiens
uuuaacagccucu

SEQ ID NO: 1000754 - RNA, 17 nt, Homo sapiens
uuuaaccccccuguaca

SEQ ID NO: 1000755 - RNA, 20 nt, Homo sapiens
uuuaagaguaaaaagaaaua

SEQ ID NO: 1000756 - RNA, 19 nt, Homo sapiens
uuuaagcucugagcuguca

SEQ ID NO: 1000757 - RNA, 19 nt, Homo sapiens
uuuaagguuuuuacuguga

SEQ ID NO: 1000758 - RNA, 15 nt, Homo sapiens
uuuaauaugcuuaaa

SEQ ID NO: 1000759 - RNA, 17 nt, Homo sapiens
uuuaaugagucagucaa

SEQ ID NO: 1000760 - RNA, 19 nt, Homo sapiens
uuuaaugccgauauacucu

SEQ ID NO: 1000761 - RNA, 23 nt, Homo sapiens
uuuaauguuuucagcccaucucc

SEQ ID NO: 1000762 - RNA, 14 nt, Homo sapiens
uuuaauuaugccuu

SEQ ID NO: 1000763 - RNA, 23 nt, Homo sapiens
uuuacaauaaaacuuugcugcca

SEQ ID NO: 1000764 - RNA, 14 nt, Homo sapiens
uuuacauucugcaa

SEQ ID NO: 1000765 - RNA, 16 nt, Homo sapiens
uuuagagaaguucaau

SEQ ID NO: 1000766 - RNA, 23 nt, Homo sapiens
uuuaggauaaccuugugccuugg

SEQ ID NO: 1000767 - RNA, 14 nt, Homo sapiens
uuuaguaguuuaau

SEQ ID NO: 1000768 - RNA, 23 nt, Homo sapiens
uuuagugagcauaggugauccau

SEQ ID NO: 1000769 - RNA, 21 nt, Homo sapiens
uuuauaacuauuauauuauca

SEQ ID NO: 1000770 - RNA, 19 nt, Homo sapiens
uuuauaggcauaccuccua

SEQ ID NO: 1000771 - RNA, 20 nt, Homo sapiens
uuuauagucgaacaauucau

SEQ ID NO: 1000772 - RNA, 15 nt, Homo sapiens
uuuauuaaucuuagu

SEQ ID NO: 1000773 - RNA, 21 nt, Homo sapiens
uuucaaaaccagguccaauga

SEQ ID NO: 1000774 - RNA, 13 nt, Homo sapiens
uuucaaagacuua

SEQ ID NO: 1000775 - RNA, 19 nt, Homo sapiens
uuucaagagugagcuauca

SEQ ID NO: 1000776 - RNA, 15 nt, Homo sapiens
uuucaauagcacaua

SEQ ID NO: 1000777 - RNA, 20 nt, Homo sapiens
uuucaccugcaaaccuuaaa

SEQ ID NO: 1000778 - RNA, 12 nt, Homo sapiens
uuucaggaucua

SEQ ID NO: 1000779 - RNA, 19 nt, Homo sapiens
uuucagguuccaaucagaa

SEQ ID NO: 1000780 - RNA, 21 nt, Homo sapiens
uuucauuugguucauuaauuc

SEQ ID NO: 1000781 - RNA, 20 nt, Homo sapiens
uuucauuuucucucagguga

SEQ ID NO: 1000782 - RNA, 16 nt, Homo sapiens
uuuccacuuaucugau

SEQ ID NO: 1000783 - RNA, 23 nt, Homo sapiens
uuuccaugggaccacaacuauuu

SEQ ID NO: 1000784 - RNA, 16 nt, Homo sapiens
uuuccccaccagaugc

SEQ ID NO: 1000785 - RNA, 22 nt, Homo sapiens
uuucccuuugccuucauucugc

SEQ ID NO: 1000786 - RNA, 15 nt, Homo sapiens
uuuccuccucaggca

SEQ ID NO: 1000787 - RNA, 14 nt, Homo sapiens
uuucuaaacuggag

SEQ ID NO: 1000788 - RNA, 12 nt, Homo sapiens
uuucuaagcaua

SEQ ID NO: 1000789 - RNA, 15 nt, Homo sapiens
uuucuaagcauaaaa

SEQ ID NO: 1000790 - RNA, 15 nt, Homo sapiens
uuucucugccaguga

SEQ ID NO: 1000791 - RNA, 17 nt, Homo sapiens
uuucugaacagcuggug

SEQ ID NO: 1000792 - RNA, 17 nt, Homo sapiens
uuucugcaaacaccaac

SEQ ID NO: 1000793 - RNA, 23 nt, Homo sapiens
uuucuucuacugcuaucuacuac

SEQ ID NO: 1000794 - RNA, 20 nt, Homo sapiens
uuucuugucuauaaagcauu

SEQ ID NO: 1000795 - RNA, 18 nt, Homo sapiens
uuugaaauuaaccucuca

SEQ ID NO: 1000796 - RNA, 18 nt, Homo sapiens
uuugaagaacaugugaga

SEQ ID NO: 1000797 - RNA, 12 nt, Homo sapiens
uuugaaggcaaa

SEQ ID NO: 1000798 - RNA, 14 nt, Homo sapiens
uuugacacugcucu

SEQ ID NO: 1000799 - RNA, 16 nt, Homo sapiens
uuugaggaaagcaaga

SEQ ID NO: 1000800 - RNA, 20 nt, Homo sapiens
uuugcaagggaaaagucucu

SEQ ID NO: 1000801 - RNA, 14 nt, Homo sapiens
uuugcagaaagcca

SEQ ID NO: 1000802 - RNA, 21 nt, Homo sapiens
uuugcaggguccucuucuggg

SEQ ID NO: 1000803 - RNA, 13 nt, Homo sapiens
uuugccucaaaua

SEQ ID NO: 1000804 - RNA, 22 nt, Homo sapiens
uuugcucggauacuugccaaaa

SEQ ID NO: 1000805 - RNA, 21 nt, Homo sapiens
uuuggaaguuuagcucugaga

SEQ ID NO: 1000806 - RNA, 23 nt, Homo sapiens
uuuggcgaccuccuuucaucaca

SEQ ID NO: 1000807 - RNA, 11 nt, Homo sapiens
uuugggagaca

SEQ ID NO: 1000808 - RNA, 15 nt, Homo sapiens
uuuguaaaaugacaa

SEQ ID NO: 1000809 - RNA, 17 nt, Homo sapiens
uuuguaaaucugccaca

SEQ ID NO: 1000810 - RNA, 18 nt, Homo sapiens
uuuguaaaucugccacaa

SEQ ID NO: 1000811 - RNA, 19 nt, Homo sapiens
acucaaauggggccagauc

SEQ ID NO: 1000812 - RNA, 18 nt, Homo sapiens
acucaaccucuacagggu

SEQ ID NO: 1000813 - RNA, 17 nt, Homo sapiens
acucacuaauucauuaa

SEQ ID NO: 1000814 - RNA, 17 nt, Homo sapiens
acucagagaaacaaugg

SEQ ID NO: 1000815 - RNA, 12 nt, Homo sapiens
acucagcacaag

SEQ ID NO: 1000816 - RNA, 13 nt, Homo sapiens
acucagggcuccu

SEQ ID NO: 1000817 - RNA, 19 nt, Homo sapiens
acucaucaauggggccagu

SEQ ID NO: 1000818 - RNA, 21 nt, Homo sapiens
acucaucaauggggccaguca

SEQ ID NO: 1000819 - RNA, 20 nt, Homo sapiens
acucaucaccccucuucccc

SEQ ID NO: 1000820 - RNA, 14 nt, Homo sapiens
acuccagaugccac

SEQ ID NO: 1000821 - RNA, 14 nt, Homo sapiens
acuccuagcugucc

SEQ ID NO: 1000822 - RNA, 15 nt, Homo sapiens
acuccuaugaucuga

SEQ ID NO: 1000823 - RNA, 14 nt, Homo sapiens
acuccuuccagcua

SEQ ID NO: 1000824 - RNA, 23 nt, Homo sapiens
acuccuuccagcuagugacccac

SEQ ID NO: 1000825 - RNA, 21 nt, Homo sapiens
acucuaaagucuguugauuaa

SEQ ID NO: 1000826 - RNA, 19 nt, Homo sapiens
acucugccuacagaacuuc

SEQ ID NO: 1000827 - RNA, 22 nt, Homo sapiens
acucugugccagagccuggggc

SEQ ID NO: 1000828 - RNA, 18 nt, Homo sapiens
acucuguuuccuggucag

SEQ ID NO: 1000829 - RNA, 16 nt, Homo sapiens
acucuucccucucuca

SEQ ID NO: 1000830 - RNA, 21 nt, Homo sapiens
acucuucccucucucacuccc

SEQ ID NO: 1000831 - RNA, 20 nt, Homo sapiens
acucuucuuacuggugcuau

SEQ ID NO: 1000832 - RNA, 20 nt, Homo sapiens
acugacacaagaauggucuu

SEQ ID NO: 1000833 - RNA, 18 nt, Homo sapiens
acugacggaguccugugu

SEQ ID NO: 1000834 - RNA, 20 nt, Homo sapiens
acugaggauguaaagaucaa

SEQ ID NO: 1000835 - RNA, 20 nt, Homo sapiens
acugauccaguauaagacua

SEQ ID NO: 1000836 - RNA, 12 nt, Homo sapiens
acugaugcugcc

SEQ ID NO: 1000837 - RNA, 22 nt, Homo sapiens
acugcagggaaaauuauuugca

SEQ ID NO: 1000838 - RNA, 22 nt, Homo sapiens
acugcauucuucugagcacugu

SEQ ID NO: 1000839 - RNA, 23 nt, Homo sapiens
acugcauucuucugagcacuguu

SEQ ID NO: 1000840 - RNA, 14 nt, Homo sapiens
acugccacccuuga

SEQ ID NO: 1000841 - RNA, 14 nt, Homo sapiens
acugccugcuccca

SEQ ID NO: 1000842 - RNA, 20 nt, Homo sapiens
acugccuucgcuucuugccu

SEQ ID NO: 1000843 - RNA, 14 nt, Homo sapiens
acuggaaaacagaa

SEQ ID NO: 1000844 - RNA, 20 nt, Homo sapiens
acuggagugugcgugguggu

SEQ ID NO: 1000845 - RNA, 15 nt, Homo sapiens
acuggauuaguuaac

SEQ ID NO: 1000846 - RNA, 19 nt, Homo sapiens
acuggcaccaagugcgggu

SEQ ID NO: 1000847 - RNA, 14 nt, Homo sapiens
acugggaccaggca

SEQ ID NO: 1000848 - RNA, 20 nt, Homo sapiens
acugggcuccggaggacuca

SEQ ID NO: 1000849 - RNA, 17 nt, Homo sapiens
acuggggcugggagcag

SEQ ID NO: 1000850 - RNA, 20 nt, Homo sapiens
acuggucccaagguguaaag

SEQ ID NO: 1000851 - RNA, 14 nt, Homo sapiens
acuggucucuggcu

SEQ ID NO: 1000852 - RNA, 17 nt, Homo sapiens
acuguaaaaugugggau

SEQ ID NO: 1000853 - RNA, 20 nt, Homo sapiens
acuguacuaucagguucaca

SEQ ID NO: 1000854 - RNA, 17 nt, Homo sapiens
acugucauccucaaaga

SEQ ID NO: 1000855 - RNA, 16 nt, Homo sapiens
acugucccuugccuca

SEQ ID NO: 1000856 - RNA, 21 nt, Homo sapiens
acuguguaauuagugccacuu

SEQ ID NO: 1000857 - RNA, 22 nt, Homo sapiens
acugugugugcccucugggcuc

SEQ ID NO: 1000858 - RNA, 10 nt, Homo sapiens
acuguugcac

SEQ ID NO: 1000859 - RNA, 20 nt, Homo sapiens
acuguuuauuaaaguacaac

SEQ ID NO: 1000860 - RNA, 13 nt, Homo sapiens
acuuaaacccagc

SEQ ID NO: 1000861 - RNA, 14 nt, Homo sapiens
acuuaaacuugcau

SEQ ID NO: 1000862 - RNA, 20 nt, Homo sapiens
acuuaagcccagugcacuga

SEQ ID NO: 1000863 - RNA, 23 nt, Homo sapiens
acuuaauacucaaaugaguaaca

SEQ ID NO: 1000864 - RNA, 18 nt, Homo sapiens
acuuacauuuacaaacug

SEQ ID NO: 1000865 - RNA, 17 nt, Homo sapiens
acuuaucugaucagaac

SEQ ID NO: 1000866 - RNA, 16 nt, Homo sapiens
acuuauuaacaauuag

SEQ ID NO: 1000867 - RNA, 13 nt, Homo sapiens
acuucaaauucaa

SEQ ID NO: 1000868 - RNA, 14 nt, Homo sapiens
acuucaaauucaaa

SEQ ID NO: 1000869 - RNA, 22 nt, Homo sapiens
acuucauauuguugcauugcuu

SEQ ID NO: 1000870 - RNA, 13 nt, Homo sapiens
acuuccacagggu

SEQ ID NO: 1000871 - RNA, 13 nt, Homo sapiens
acuuccauuugcu

SEQ ID NO: 1000872 - RNA, 19 nt, Homo sapiens
acuuccccauggcccugag

SEQ ID NO: 1000873 - RNA, 23 nt, Homo sapiens
acuuccugguugagcuucugcua

SEQ ID NO: 1000874 - RNA, 18 nt, Homo sapiens
acuucuauuuuaaagaca

SEQ ID NO: 1000875 - RNA, 18 nt, Homo sapiens
acuucucaggacacaggc

SEQ ID NO: 1000876 - RNA, 23 nt, Homo sapiens
acuucucauuuuuuaaaaaagcu

SEQ ID NO: 1000877 - RNA, 23 nt, Homo sapiens
acuucuuauggaauugauuugca

SEQ ID NO: 1000878 - RNA, 20 nt, Homo sapiens
acuugaaauucucaucaguc

SEQ ID NO: 1000879 - RNA, 16 nt, Homo sapiens
acuugaacccaggucu

SEQ ID NO: 1000880 - RNA, 18 nt, Homo sapiens
acuugaagggccagagcc

SEQ ID NO: 1000881 - RNA, 20 nt, Homo sapiens
acuugauccauuucuaauua

SEQ ID NO: 1000882 - RNA, 23 nt, Homo sapiens
acuuggggaguuaagaccuggca

SEQ ID NO: 1000883 - RNA, 20 nt, Homo sapiens
acuuggugggaccaugaaca

SEQ ID NO: 1000884 - RNA, 17 nt, Homo sapiens
acuuguuuuugcacaug

SEQ ID NO: 1000885 - RNA, 21 nt, Homo sapiens
acuuuaaaauaucuacauuaa

SEQ ID NO: 1000886 - RNA, 17 nt, Homo sapiens
acuuuacuguaauauaa

SEQ ID NO: 1000887 - RNA, 19 nt, Homo sapiens
acuuuacuuguguuauaua

SEQ ID NO: 1000888 - RNA, 19 nt, Homo sapiens
acuuugaauguguuucaca

SEQ ID NO: 1000889 - RNA, 16 nt, Homo sapiens
acuuugagcuacugcc

SEQ ID NO: 1000890 - RNA, 14 nt, Homo sapiens
acuuugcacugaua

SEQ ID NO: 1000891 - RNA, 14 nt, Homo sapiens
acuuugcaucucag

SEQ ID NO: 1000892 - RNA, 22 nt, Homo sapiens
acuuuggaaccagacucuugcc

SEQ ID NO: 1000893 - RNA, 17 nt, Homo sapiens
acuuuuaaguugcugau

SEQ ID NO: 1000894 - RNA, 12 nt, Homo sapiens
agaaaacauguu

SEQ ID NO: 1000895 - RNA, 19 nt, Homo sapiens
agaaaagaugcacuuugcu

SEQ ID NO: 1000896 - RNA, 19 nt, Homo sapiens
agaaaauaagagcucagga

SEQ ID NO: 1000897 - RNA, 19 nt, Homo sapiens
agaaaaucaaauauauaac

SEQ ID NO: 1000898 - RNA, 22 nt, Homo sapiens
agaaaauguugagaaucccaaa

SEQ ID NO: 1000899 - RNA, 13 nt, Homo sapiens
agaaacagugcaa

SEQ ID NO: 1000900 - RNA, 14 nt, Homo sapiens
agaaacgucuucua

SEQ ID NO: 1000901 - RNA, 19 nt, Homo sapiens
agaaagauaauucacugua

SEQ ID NO: 1000902 - RNA, 13 nt, Homo sapiens
agaaagugccuga

SEQ ID NO: 1000903 - RNA, 19 nt, Homo sapiens
agaaauaagugcccucucc

SEQ ID NO: 1000904 - RNA, 15 nt, Homo sapiens
agaaauacuacugug

SEQ ID NO: 1000905 - RNA, 16 nt, Homo sapiens
agaaauucagcauuug

SEQ ID NO: 1000906 - RNA, 15 nt, Homo sapiens
agaaccucagaucag

SEQ ID NO: 1000907 - RNA, 20 nt, Homo sapiens
agaacguggugaccuuucac

SEQ ID NO: 1000908 - RNA, 23 nt, Homo sapiens
agaacguggugaccuuucacgaa

SEQ ID NO: 1000909 - RNA, 19 nt, Homo sapiens
agaacucaaauggggccag

SEQ ID NO: 1000910 - RNA, 15 nt, Homo sapiens
agaacuucagaaaga

SEQ ID NO: 1000911 - RNA, 19 nt, Homo sapiens
agaacuucagaaagacuug

SEQ ID NO: 1000912 - RNA, 22 nt, Homo sapiens
agaagacaaacuuugcaucuca

SEQ ID NO: 1000913 - RNA, 22 nt, Homo sapiens
ccacacuucucaggacacaggc

SEQ ID NO: 1000914 - RNA, 15 nt, Homo sapiens
ccacacuugguggga

SEQ ID NO: 1000915 - RNA, 18 nt, Homo sapiens
ccacagacggaaggguaa

SEQ ID NO: 1000916 - RNA, 16 nt, Homo sapiens
ccacagcaaccccagg

SEQ ID NO: 1000917 - RNA, 13 nt, Homo sapiens
ccacagcugugca

SEQ ID NO: 1000918 - RNA, 20 nt, Homo sapiens
ccacagucccaucugcuuca

SEQ ID NO: 1000919 - RNA, 21 nt, Homo sapiens
ccacauaaccucucugugcca

SEQ ID NO: 1000920 - RNA, 23 nt, Homo sapiens
ccacauccuccacguucugcuca

SEQ ID NO: 1000921 - RNA, 18 nt, Homo sapiens
ccacauucaaaauagggu

SEQ ID NO: 1000922 - RNA, 15 nt, Homo sapiens
ccaccaaaacugcuc

SEQ ID NO: 1000923 - RNA, 16 nt, Homo sapiens
ccaccagcugugucca

SEQ ID NO: 1000924 - RNA, 16 nt, Homo sapiens
ccaccaucauagcuca

SEQ ID NO: 1000925 - RNA, 14 nt, Homo sapiens
ccacccuguuccug

SEQ ID NO: 1000926 - RNA, 16 nt, Homo sapiens
ccaccugacacaccag

SEQ ID NO: 1000927 - RNA, 16 nt, Homo sapiens
ccaccugacucuugca

SEQ ID NO: 1000928 - RNA, 22 nt, Homo sapiens
ccacguccagcuggaaggguca

SEQ ID NO: 1000929 - RNA, 12 nt, Homo sapiens
ccacucccucac

SEQ ID NO: 1000930 - RNA, 16 nt, Homo sapiens
ccacuccucugacuca

SEQ ID NO: 1000931 - RNA, 15 nt, Homo sapiens
ccacucugcucugau

SEQ ID NO: 1000932 - RNA, 22 nt, Homo sapiens
ccacucuggagcauuucucauc

SEQ ID NO: 1000933 - RNA, 14 nt, Homo sapiens
ccacucuucuugca

SEQ ID NO: 1000934 - RNA, 19 nt, Homo sapiens
ccacugcccccugcugcca

SEQ ID NO: 1000935 - RNA, 22 nt, Homo sapiens
ccacugccuucgcuucuugccu

SEQ ID NO: 1000936 - RNA, 22 nt, Homo sapiens
ccacugugccucagagaccagg

SEQ ID NO: 1000937 - RNA, 16 nt, Homo sapiens
ccagaaccaauuauuu

SEQ ID NO: 1000938 - RNA, 14 nt, Homo sapiens
ccagacggucagga

SEQ ID NO: 1000939 - RNA, 20 nt, Homo sapiens
ccagacucguucuucuggga

SEQ ID NO: 1000940 - RNA, 21 nt, Homo sapiens
ccagacucguucuucugggaa

SEQ ID NO: 1000941 - RNA, 20 nt, Homo sapiens
ccagagacauacuugaaggg

SEQ ID NO: 1000942 - RNA, 22 nt, Homo sapiens
ccagagcggaaggagggagcuc

SEQ ID NO: 1000943 - RNA, 20 nt, Homo sapiens
ccagaggauugcugccccau

SEQ ID NO: 1000944 - RNA, 12 nt, Homo sapiens
ccagauccagcc

SEQ ID NO: 1000945 - RNA, 21 nt, Homo sapiens
ccagauuagagccuguaaacu

SEQ ID NO: 1000946 - RNA, 22 nt, Homo sapiens
ccagauugacgacaagugcuga

SEQ ID NO: 1000947 - RNA, 14 nt, Homo sapiens
ccagcacacagggc

SEQ ID NO: 1000948 - RNA, 21 nt, Homo sapiens
ccagcacagcuuagauuucau

SEQ ID NO: 1000949 - RNA, 14 nt, Homo sapiens
ccagcagugccuug

SEQ ID NO: 1000950 - RNA, 19 nt, Homo sapiens
ccagcagugccuugugcaa

SEQ ID NO: 1000951 - RNA, 20 nt, Homo sapiens
ccagccagggcucaaucucu

SEQ ID NO: 1000952 - RNA, 13 nt, Homo sapiens
ccagcccagagac

SEQ ID NO: 1000953 - RNA, 16 nt, Homo sapiens
ccagcccccugaccac

SEQ ID NO: 1000954 - RNA, 24 nt, Homo sapiens
ccagcggcccugucauccagcuca

SEQ ID NO: 1000955 - RNA, 15 nt, Homo sapiens
ccagcucagcacugc

SEQ ID NO: 1000956 - RNA, 23 nt, Homo sapiens
ccagcucaggacagaugccacac

SEQ ID NO: 1000957 - RNA, 18 nt, Homo sapiens
ccagcugcacugaugcug

SEQ ID NO: 1000958 - RNA, 17 nt, Homo sapiens
ccagcuuauagucauau

SEQ ID NO: 1000959 - RNA, 21 nt, Homo sapiens
ccaggacuauauuugggccug

SEQ ID NO: 1000960 - RNA, 14 nt, Homo sapiens
ccaggccaggacuc

SEQ ID NO: 1000961 - RNA, 21 nt, Homo sapiens
ccaggcccugcucuuccucag

SEQ ID NO: 1000962 - RNA, 18 nt, Homo sapiens
ccaggcugaccacagcac

SEQ ID NO: 1000963 - RNA, 17 nt, Homo sapiens
ccagggagaagcuccuc

SEQ ID NO: 1000964 - RNA, 16 nt, Homo sapiens
ccagggagugguuugg

SEQ ID NO: 1000965 - RNA, 14 nt, Homo sapiens
ccaggguuuugccc

SEQ ID NO: 1000966 - RNA, 13 nt, Homo sapiens
ccagguacaucca

SEQ ID NO: 1000967 - RNA, 12 nt, Homo sapiens
ccagguaggggc

SEQ ID NO: 1000968 - RNA, 15 nt, Homo sapiens
ccaguaugacaguau

SEQ ID NO: 1000969 - RNA, 15 nt, Homo sapiens
ccagugcacugaaag

SEQ ID NO: 1000970 - RNA, 20 nt, Homo sapiens
ccaguucauugcacuuugau

SEQ ID NO: 1000971 - RNA, 14 nt, Homo sapiens
ccaguugccuuuua

SEQ ID NO: 1000972 - RNA, 23 nt, Homo sapiens
ccaguuuggguaaaauacuuuua

SEQ ID NO: 1000973 - RNA, 20 nt, Homo sapiens
ccaguuuugucaaugcaguu

SEQ ID NO: 1000974 - RNA, 17 nt, Homo sapiens
ccauaaauccuugauga

SEQ ID NO: 1000975 - RNA, 13 nt, Homo sapiens
ccauaauguuaca

SEQ ID NO: 1000976 - RNA, 14 nt, Homo sapiens
ccauacuccuauga

SEQ ID NO: 1000977 - RNA, 23 nt, Homo sapiens
ccauacuccuaugaucugaguca

SEQ ID NO: 1000978 - RNA, 15 nt, Homo sapiens
ccauauugagucaaa

SEQ ID NO: 1000979 - RNA, 20 nt, Homo sapiens
ccauauuuucaccauuugau

SEQ ID NO: 1000980 - RNA, 23 nt, Homo sapiens
ccaucaauauucagcaaaaugau

SEQ ID NO: 1000981 - RNA, 14 nt, Homo sapiens
ccaucagugcuccc

SEQ ID NO: 1000982 - RNA, 23 nt, Homo sapiens
ccaucagugcucccucacauguc

SEQ ID NO: 1000983 - RNA, 20 nt, Homo sapiens
ccauccaccaggccuuugag

SEQ ID NO: 1000984 - RNA, 10 nt, Homo sapiens
ccaucucagg

SEQ ID NO: 1000985 - RNA, 21 nt, Homo sapiens
ccaucugccaaaaauuacuga

SEQ ID NO: 1000986 - RNA, 22 nt, Homo sapiens
ccaucuucuaaacccaauccaa

SEQ ID NO: 1000987 - RNA, 16 nt, Homo sapiens
cauccccagcgauucc

SEQ ID NO: 1000988 - RNA, 15 nt, Homo sapiens
caucccuccaucuca

SEQ ID NO: 1000989 - RNA, 13 nt, Homo sapiens
caucccugugguc

SEQ ID NO: 1000990 - RNA, 22 nt, Homo sapiens
caucgaaucuacuaauuccaca

SEQ ID NO: 1000991 - RNA, 22 nt, Homo sapiens
caucuaaccucaucuucuucac

SEQ ID NO: 1000992 - RNA, 21 nt, Homo sapiens
caucuauuuuggauuguauau

SEQ ID NO: 1000993 - RNA, 21 nt, Homo sapiens
caucucaaagaaggcauuugc

SEQ ID NO: 1000994 - RNA, 23 nt, Homo sapiens
caucucucccuccccugccauuu

SEQ ID NO: 1000995 - RNA, 21 nt, Homo sapiens
caucugacaugcaucaucuca

SEQ ID NO: 1000996 - RNA, 22 nt, Homo sapiens
caucugcuuuucccauugccau

SEQ ID NO: 1000997 - RNA, 10 nt, Homo sapiens
caucuuguca

SEQ ID NO: 1000998 - RNA, 21 nt, Homo sapiens
caugacucggggguggggaaa

SEQ ID NO: 1000999 - RNA, 11 nt, Homo sapiens
caugacugugg

SEQ ID NO: 1001000 - RNA, 21 nt, Homo sapiens
caugagagaaggaggggagca

SEQ ID NO: 1001001 - RNA, 19 nt, Homo sapiens
caugagaugauacauccaa

SEQ ID NO: 1001002 - RNA, 19 nt, Homo sapiens
caugaggacucuauucuuu

SEQ ID NO: 1001003 - RNA, 14 nt, Homo sapiens
caugaucaucacaa

SEQ ID NO: 1001004 - RNA, 17 nt, Homo sapiens
caugaucaucacaauca

SEQ ID NO: 1001005 - RNA, 18 nt, Homo sapiens
caugauggcaacagaucu

SEQ ID NO: 1001006 - RNA, 13 nt, Homo sapiens
caugcacugaugu

SEQ ID NO: 1001007 - RNA, 19 nt, Homo sapiens
caugcauugagcucucuca

SEQ ID NO: 1001008 - RNA, 17 nt, Homo sapiens
caugccaguaacaggcu

SEQ ID NO: 1001009 - RNA, 14 nt, Homo sapiens
caugccccuggcug

SEQ ID NO: 1001010 - RNA, 17 nt, Homo sapiens
caugcccuguaccugug

SEQ ID NO: 1001011 - RNA, 18 nt, Homo sapiens
caugccgacgcuugcacg

SEQ ID NO: 1001012 - RNA, 14 nt, Homo sapiens
caugccucugaggc

SEQ ID NO: 1001013 - RNA, 15 nt, Homo sapiens
caugcugcuggggaa

SEQ ID NO: 1001014 - RNA, 20 nt, Homo sapiens
caugcugcuggggaagacag

SEQ ID NO: 1001015 - RNA, 21 nt, Homo sapiens
caugcugcuggggaagacagu

SEQ ID NO: 1001016 - RNA, 22 nt, Homo sapiens
caugcugcuggggaagacagug

SEQ ID NO: 1001017 - RNA, 17 nt, Homo sapiens
caugcuucagugcugcu

SEQ ID NO: 1001018 - RNA, 12 nt, Homo sapiens
caugcuuuauua

SEQ ID NO: 1001019 - RNA, 19 nt, Homo sapiens
cauggaaaacccccuuccu

SEQ ID NO: 1001020 - RNA, 14 nt, Homo sapiens
cauggaauaguuuu

SEQ ID NO: 1001021 - RNA, 21 nt, Homo sapiens
cauggacaugcuucagugcug

SEQ ID NO: 1001022 - RNA, 19 nt, Homo sapiens
cauggccagcagcaccugc

SEQ ID NO: 1001023 - RNA, 19 nt, Homo sapiens
cauggguggcacucagucu

SEQ ID NO: 1001024 - RNA, 13 nt, Homo sapiens
cauggugagcucu

SEQ ID NO: 1001025 - RNA, 16 nt, Homo sapiens
cauggugccccaggac

SEQ ID NO: 1001026 - RNA, 20 nt, Homo sapiens
caugucacuucccugcuuaa

SEQ ID NO: 1001027 - RNA, 13 nt, Homo sapiens
caugugacauuua

SEQ ID NO: 1001028 - RNA, 15 nt, Homo sapiens
caugugcaaaugugc

SEQ ID NO: 1001029 - RNA, 12 nt, Homo sapiens
cauguguggaag

SEQ ID NO: 1001030 - RNA, 20 nt, Homo sapiens
cauguugaagccacugccuu

SEQ ID NO: 1001031 - RNA, 19 nt, Homo sapiens
cauguuugcaccugugcau

SEQ ID NO: 1001032 - RNA, 14 nt, Homo sapiens
cauuaaaccaucuc

SEQ ID NO: 1001033 - RNA, 18 nt, Homo sapiens
cauuaaauucacaaacuu

SEQ ID NO: 1001034 - RNA, 18 nt, Homo sapiens
cauuaauagcagccuuuc

SEQ ID NO: 1001035 - RNA, 20 nt, Homo sapiens
cauuauaugcacuagcaaua

SEQ ID NO: 1001036 - RNA, 18 nt, Homo sapiens
cauucaacagagacugaa

SEQ ID NO: 1001037 - RNA, 22 nt, Homo sapiens
cauucacaguucuuugggccag

SEQ ID NO: 1001038 - RNA, 9 nt, Homo sapiens
cauucaguc

SEQ ID NO: 1001039 - RNA, 15 nt, Homo sapiens
cauuccaacucguau

SEQ ID NO: 1001040 - RNA, 18 nt, Homo sapiens
cauuccaagacucuagag

SEQ ID NO: 1001041 - RNA, 17 nt, Homo sapiens
cauuccucaugaaugua

SEQ ID NO: 1001042 - RNA, 16 nt, Homo sapiens
cauucgcuacuaugau

SEQ ID NO: 1001043 - RNA, 14 nt, Homo sapiens
cauucuacugaaaa

SEQ ID NO: 1001044 - RNA, 13 nt, Homo sapiens
cauucuagguagg

SEQ ID NO: 1001045 - RNA, 17 nt, Homo sapiens
cauucuaguacuuggga

SEQ ID NO: 1001046 - RNA, 23 nt, Homo sapiens
cauugaccgcgacuaauuucaaa

SEQ ID NO: 1001047 - RNA, 19 nt, Homo sapiens
cauugacucuguggcuuug

SEQ ID NO: 1001048 - RNA, 14 nt, Homo sapiens
cauugaucugggau

SEQ ID NO: 1001049 - RNA, 19 nt, Homo sapiens
cauugauuugcucuuacua

SEQ ID NO: 1001050 - RNA, 17 nt, Homo sapiens
cauugcucuugagucuu

SEQ ID NO: 1001051 - RNA, 23 nt, Homo sapiens
cauuggcuauuuaaaacuuguaa

SEQ ID NO: 1001052 - RNA, 14 nt, Homo sapiens
cauugguccaagau

SEQ ID NO: 1001053 - RNA, 14 nt, Homo sapiens
cauuguaaaagcau

SEQ ID NO: 1001054 - RNA, 14 nt, Homo sapiens
cauuguaaucacug

SEQ ID NO: 1001055 - RNA, 19 nt, Homo sapiens
cauuguuucguaacacagc

SEQ ID NO: 1001056 - RNA, 12 nt, Homo sapiens
cauuuaaaacau

SEQ ID NO: 1001057 - RNA, 15 nt, Homo sapiens
cauuuagucauguga

SEQ ID NO: 1001058 - RNA, 17 nt, Homo sapiens
cauuuagucaugugacc

SEQ ID NO: 1001059 - RNA, 18 nt, Homo sapiens
cauuuaucuaaauaugga

SEQ ID NO: 1001060 - RNA, 17 nt, Homo sapiens
cauuuccaugcauaaau

SEQ ID NO: 1001061 - RNA, 15 nt, Homo sapiens
caggaauauuuucca

SEQ ID NO: 1001062 - RNA, 16 nt, Homo sapiens
caggacagaugccaca

SEQ ID NO: 1001063 - RNA, 19 nt, Homo sapiens
caggacagaugccacacaa

SEQ ID NO: 1001064 - RNA, 19 nt, Homo sapiens
caggagcuccaguguccug

SEQ ID NO: 1001065 - RNA, 22 nt, Homo sapiens
caggaggggggagggaagggag

SEQ ID NO: 1001066 - RNA, 18 nt, Homo sapiens
caggcacacagcuacucu

SEQ ID NO: 1001067 - RNA, 13 nt, Homo sapiens
caggcacugggca

SEQ ID NO: 1001068 - RNA, 16 nt, Homo sapiens
caggcagauccaggac

SEQ ID NO: 1001069 - RNA, 19 nt, Homo sapiens
caggcagccucuggggggu

SEQ ID NO: 1001070 - RNA, 13 nt, Homo sapiens
caggccaauguca

SEQ ID NO: 1001071 - RNA, 17 nt, Homo sapiens
caggccaggacucugca

SEQ ID NO: 1001072 - RNA, 22 nt, Homo sapiens
caggcccuggccuccccugcca

SEQ ID NO: 1001073 - RNA, 22 nt, Homo sapiens
caggccgcccugcgggugaaca

SEQ ID NO: 1001074 - RNA, 16 nt, Homo sapiens
caggccucaccauucc

SEQ ID NO: 1001075 - RNA, 20 nt, Homo sapiens
caggcgauccaccugucuca

SEQ ID NO: 1001076 - RNA, 16 nt, Homo sapiens
caggcugccugagucg

SEQ ID NO: 1001077 - RNA, 17 nt, Homo sapiens
caggcuggagugcagug

SEQ ID NO: 1001078 - RNA, 18 nt, Homo sapiens
caggcuggagugcagugc

SEQ ID NO: 1001079 - RNA, 15 nt, Homo sapiens
caggcuggccagucc

SEQ ID NO: 1001080 - RNA, 18 nt, Homo sapiens
caggcugggccaugucca

SEQ ID NO: 1001081 - RNA, 13 nt, Homo sapiens
cagggaaaacugc

SEQ ID NO: 1001082 - RNA, 19 nt, Homo sapiens
cagggacacuaucacucau

SEQ ID NO: 1001083 - RNA, 17 nt, Homo sapiens
cagggaugacagauuug

SEQ ID NO: 1001084 - RNA, 22 nt, Homo sapiens
cagggcagucauuggcugucuc

SEQ ID NO: 1001085 - RNA, 15 nt, Homo sapiens
cagggccucugucaa

SEQ ID NO: 1001086 - RNA, 16 nt, Homo sapiens
cagggccucugucaau

SEQ ID NO: 1001087 - RNA, 18 nt, Homo sapiens
cagggccucugucaauug

SEQ ID NO: 1001088 - RNA, 13 nt, Homo sapiens
cagggcuagugac

SEQ ID NO: 1001089 - RNA, 20 nt, Homo sapiens
cagggcuuuacuccguaaca

SEQ ID NO: 1001090 - RNA, 23 nt, Homo sapiens
caggggcugucccggaggcggug

SEQ ID NO: 1001091 - RNA, 16 nt, Homo sapiens
cagggggcugcugcug

SEQ ID NO: 1001092 - RNA, 12 nt, Homo sapiens
cagggucugcuc

SEQ ID NO: 1001093 - RNA, 16 nt, Homo sapiens
cagggucugcucuuuc

SEQ ID NO: 1001094 - RNA, 15 nt, Homo sapiens
cagggugcaguauca

SEQ ID NO: 1001095 - RNA, 20 nt, Homo sapiens
caggguuucaccauguugcc

SEQ ID NO: 1001096 - RNA, 12 nt, Homo sapiens
cagguaauacaa

SEQ ID NO: 1001097 - RNA, 22 nt, Homo sapiens
cagguaggccaagguguccuac

SEQ ID NO: 1001098 - RNA, 19 nt, Homo sapiens
caggugcaacagacuugaa

SEQ ID NO: 1001099 - RNA, 21 nt, Homo sapiens
cagguguuaacauuccaagac

SEQ ID NO: 1001100 - RNA, 20 nt, Homo sapiens
cagguguuacuguaauuccu

SEQ ID NO: 1001101 - RNA, 16 nt, Homo sapiens
cagguuccaaucagaa

SEQ ID NO: 1001102 - RNA, 20 nt, Homo sapiens
caguaaaugugauucaccuc

SEQ ID NO: 1001103 - RNA, 19 nt, Homo sapiens
caguacacaggggcuugac

SEQ ID NO: 1001104 - RNA, 20 nt, Homo sapiens
caguacacaggggcuugacu

SEQ ID NO: 1001105 - RNA, 22 nt, Homo sapiens
caguagagcucuacugccucaa

SEQ ID NO: 1001106 - RNA, 22 nt, Homo sapiens
caguagucccugcacagugacu

SEQ ID NO: 1001107 - RNA, 21 nt, Homo sapiens
caguaguucacauacaaauca

SEQ ID NO: 1001108 - RNA, 17 nt, Homo sapiens
caguaugggaucugaua

SEQ ID NO: 1001109 - RNA, 13 nt, Homo sapiens
cagucaaccuggg

SEQ ID NO: 1001110 - RNA, 19 nt, Homo sapiens
cagucacugacaguuaaua

SEQ ID NO: 1001111 - RNA, 17 nt, Homo sapiens
cagucccccaacuaccc

SEQ ID NO: 1001112 - RNA, 21 nt, Homo sapiens
caguccuguccuuuaccaaag

SEQ ID NO: 1001113 - RNA, 14 nt, Homo sapiens
cagucuauucacag

SEQ ID NO: 1001114 - RNA, 14 nt, Homo sapiens
cagucuuccauuug

SEQ ID NO: 1001115 - RNA, 17 nt, Homo sapiens
cagucuuccauuugcaa

SEQ ID NO: 1001116 - RNA, 13 nt, Homo sapiens
cagugaagacaga

SEQ ID NO: 1001117 - RNA, 10 nt, Homo sapiens
cagugacacc

SEQ ID NO: 1001118 - RNA, 19 nt, Homo sapiens
cagugagguucuuggguuu

SEQ ID NO: 1001119 - RNA, 12 nt, Homo sapiens
cagugcacugaa

SEQ ID NO: 1001120 - RNA, 17 nt, Homo sapiens
cagugcacugaaaguca

SEQ ID NO: 1001121 - RNA, 20 nt, Homo sapiens
cagugccaccaucauagcuc

SEQ ID NO: 1001122 - RNA, 16 nt, Homo sapiens
cagugccucaugccug

SEQ ID NO: 1001123 - RNA, 23 nt, Homo sapiens
caguggcugaauagcuucuccaa

SEQ ID NO: 1001124 - RNA, 16 nt, Homo sapiens
cagugucaggcacugg

SEQ ID NO: 1001125 - RNA, 18 nt, Homo sapiens
caguucauugcacuuuga

SEQ ID NO: 1001126 - RNA, 16 nt, Homo sapiens
caguucccacauuaaa

SEQ ID NO: 1001127 - RNA, 14 nt, Homo sapiens
caguuccuguggcu

SEQ ID NO: 1001128 - RNA, 13 nt, Homo sapiens
caguucuaaccuc

SEQ ID NO: 1001129 - RNA, 15 nt, Homo sapiens
caguucuaaccuccu

SEQ ID NO: 1001130 - RNA, 13 nt, Homo sapiens
caguucugugguu

SEQ ID NO: 1001131 - RNA, 19 nt, Homo sapiens
caguucuuugguaagcauu

SEQ ID NO: 1001132 - RNA, 17 nt, Homo sapiens
caguugggacuacaggc

SEQ ID NO: 1001133 - RNA, 19 nt, Homo sapiens
caguuucuaggcaccucag

SEQ ID NO: 1001134 - RNA, 16 nt, Homo sapiens
caguuugcuuugcccu

SEQ ID NO: 1001135 - RNA, 14 nt, Homo sapiens
acaugcuucagugc

SEQ ID NO: 1001136 - RNA, 10 nt, Homo sapiens
acaugggagc

SEQ ID NO: 1001137 - RNA, 12 nt, Homo sapiens
acaugugacauu

SEQ ID NO: 1001138 - RNA, 12 nt, Homo sapiens
acauguguaaac

SEQ ID NO: 1001139 - RNA, 20 nt, Homo sapiens
acauuaaagaaggguugagc

SEQ ID NO: 1001140 - RNA, 16 nt, Homo sapiens
acauuagucucaguga

SEQ ID NO: 1001141 - RNA, 17 nt, Homo sapiens
acauuggcaccuaaucc

SEQ ID NO: 1001142 - RNA, 22 nt, Homo sapiens
acauuggcaccuaauccaggca

SEQ ID NO: 1001143 - RNA, 18 nt, Homo sapiens
acauuucuauagccaaaa

SEQ ID NO: 1001144 - RNA, 19 nt, Homo sapiens
acauuugggagacauguga

SEQ ID NO: 1001145 - RNA, 16 nt, Homo sapiens
acauuuucauugauga

SEQ ID NO: 1001146 - RNA, 19 nt, Homo sapiens
acauuuuuauaaaaaugag

SEQ ID NO: 1001147 - RNA, 16 nt, Homo sapiens
acauuuuuguacuaac

SEQ ID NO: 1001148 - RNA, 16 nt, Homo sapiens
accaaaaccacagugc

SEQ ID NO: 1001149 - RNA, 14 nt, Homo sapiens
accaaaauguugcu

SEQ ID NO: 1001150 - RNA, 23 nt, Homo sapiens
accaaaucuugguugaugccaaa

SEQ ID NO: 1001151 - RNA, 13 nt, Homo sapiens
accaaaugugcuu

SEQ ID NO: 1001152 - RNA, 17 nt, Homo sapiens
accaagucaaacuugga

SEQ ID NO: 1001153 - RNA, 23 nt, Homo sapiens
accaagugcggguccggcagcuu

SEQ ID NO: 1001154 - RNA, 13 nt, Homo sapiens
accacaacuauuu

SEQ ID NO: 1001155 - RNA, 17 nt, Homo sapiens
accacagguucaugcca

SEQ ID NO: 1001156 - RNA, 18 nt, Homo sapiens
accacaugccccauccca

SEQ ID NO: 1001157 - RNA, 13 nt, Homo sapiens
accaccagggcau

SEQ ID NO: 1001158 - RNA, 17 nt, Homo sapiens
accacugauaaaaccau

SEQ ID NO: 1001159 - RNA, 22 nt, Homo sapiens
accacugcccccugcugccaug

SEQ ID NO: 1001160 - RNA, 11 nt, Homo sapiens
accacuuucuu

SEQ ID NO: 1001161 - RNA, 23 nt, Homo sapiens
accagacucguucuucugggaac

SEQ ID NO: 1001162 - RNA, 20 nt, Homo sapiens
accaggaguggguggggagu

SEQ ID NO: 1001163 - RNA, 21 nt, Homo sapiens
accaggcagccucuggggggu

SEQ ID NO: 1001164 - RNA, 15 nt, Homo sapiens
accaguauaagcauc

SEQ ID NO: 1001165 - RNA, 13 nt, Homo sapiens
accagugcugcug

SEQ ID NO: 1001166 - RNA, 17 nt, Homo sapiens
accauagcacaggcuaa

SEQ ID NO: 1001167 - RNA, 12 nt, Homo sapiens
accaucauagcu

SEQ ID NO: 1001168 - RNA, 21 nt, Homo sapiens
accaugagaccacuguuauca

SEQ ID NO: 1001169 - RNA, 22 nt, Homo sapiens
accaugcugcuggggaagacag

SEQ ID NO: 1001170 - RNA, 15 nt, Homo sapiens
ugaggacugauuuca

SEQ ID NO: 1001171 - RNA, 19 nt, Homo sapiens
ugaggauguaaagaucaau

SEQ ID NO: 1001172 - RNA, 18 nt, Homo sapiens
ugaggcaggagaaucacu

SEQ ID NO: 1001173 - RNA, 16 nt, Homo sapiens
ugaggccuuacuuaaa

SEQ ID NO: 1001174 - RNA, 19 nt, Homo sapiens
ugagggagccuggccccau

SEQ ID NO: 1001175 - RNA, 18 nt, Homo sapiens
ugagggcucacucagcca

SEQ ID NO: 1001176 - RNA, 12 nt, Homo sapiens
ugaggucucagc

SEQ ID NO: 1001177 - RNA, 14 nt, Homo sapiens
ugaggucucagccc

SEQ ID NO: 1001178 - RNA, 16 nt, Homo sapiens
ugaggugccuguccca

SEQ ID NO: 1001179 - RNA, 17 nt, Homo sapiens
ugaguaauacaucaaag

SEQ ID NO: 1001180 - RNA, 16 nt, Homo sapiens
ugaguaccccugcuuu

SEQ ID NO: 1001181 - RNA, 19 nt, Homo sapiens
ugaguagagagcaagggaa

SEQ ID NO: 1001182 - RNA, 21 nt, Homo sapiens
ugagucagagccaugucuucu

SEQ ID NO: 1001183 - RNA, 21 nt, Homo sapiens
ugaguccgacccagacaucca

SEQ ID NO: 1001184 - RNA, 14 nt, Homo sapiens
ugaguggucuucaa

SEQ ID NO: 1001185 - RNA, 18 nt, Homo sapiens
ugaguugcuuuucagcug

SEQ ID NO: 1001186 - RNA, 22 nt, Homo sapiens
ugaguuucuggcucuugaggca

SEQ ID NO: 1001187 - RNA, 16 nt, Homo sapiens
ugaguuuuguguuugu

SEQ ID NO: 1001188 - RNA, 16 nt, Homo sapiens
ugauaaaagauggcca

SEQ ID NO: 1001189 - RNA, 16 nt, Homo sapiens
ugauaauagauucucu

SEQ ID NO: 1001190 - RNA, 12 nt, Homo sapiens
ugauacauccaa

SEQ ID NO: 1001191 - RNA, 17 nt, Homo sapiens
ugauauauaaaugugau

SEQ ID NO: 1001192 - RNA, 11 nt, Homo sapiens
ugauaugcaca

SEQ ID NO: 1001193 - RNA, 16 nt, Homo sapiens
ugauauucuaucugua

SEQ ID NO: 1001194 - RNA, 12 nt, Homo sapiens
ugauauugcagc

SEQ ID NO: 1001195 - RNA, 21 nt, Homo sapiens
ugaucaguuaagaaauuucac

SEQ ID NO: 1001196 - RNA, 12 nt, Homo sapiens
ugaugaaugaga

SEQ ID NO: 1001197 - RNA, 11 nt, Homo sapiens
ugaugcagcuu

SEQ ID NO: 1001198 - RNA, 13 nt, Homo sapiens
ugaugugcacgua

SEQ ID NO: 1001199 - RNA, 14 nt, Homo sapiens
ugauuagacagaac

SEQ ID NO: 1001200 - RNA, 19 nt, Homo sapiens
ugauucauaguaacuucuu

SEQ ID NO: 1001201 - RNA, 15 nt, Homo sapiens
ugauuuagugaucaa

SEQ ID NO: 1001202 - RNA, 16 nt, Homo sapiens
ugauuuagugaucaaa

SEQ ID NO: 1001203 - RNA, 14 nt, Homo sapiens
ugauuucauuucaa

SEQ ID NO: 1001204 - RNA, 22 nt, Homo sapiens
ugcaaaaggacucucaggacca

SEQ ID NO: 1001205 - RNA, 22 nt, Homo sapiens
ugcaaccuaccuguugagcauc

SEQ ID NO: 1001206 - RNA, 21 nt, Homo sapiens
ugcaagaccgagauugaggga

SEQ ID NO: 1001207 - RNA, 16 nt, Homo sapiens
ugcaaguauacuaggg

SEQ ID NO: 1001208 - RNA, 22 nt, Homo sapiens
ugcaauaaaucugacccagugc

SEQ ID NO: 1001209 - RNA, 14 nt, Homo sapiens
ugcacaccuuggaa

SEQ ID NO: 1001210 - RNA, 21 nt, Homo sapiens
ugcacaccuuggaauucgcuu

SEQ ID NO: 1001211 - RNA, 14 nt, Homo sapiens
ugcacacuuugcca

SEQ ID NO: 1001212 - RNA, 17 nt, Homo sapiens
ugcacagugugugacuu

SEQ ID NO: 1001213 - RNA, 11 nt, Homo sapiens
ugcacauugua

SEQ ID NO: 1001214 - RNA, 14 nt, Homo sapiens
ugcaccaccaagcc

SEQ ID NO: 1001215 - RNA, 14 nt, Homo sapiens
ugcaccaugcugcu

SEQ ID NO: 1001216 - RNA, 20 nt, Homo sapiens
ugcaccccaaagcuuuccug

SEQ ID NO: 1001217 - RNA, 12 nt, Homo sapiens
ugcaccuaccuu

SEQ ID NO: 1001218 - RNA, 13 nt, Homo sapiens
ugcaccuuugcac

SEQ ID NO: 1001219 - RNA, 15 nt, Homo sapiens
ugcacugugaaggac

SEQ ID NO: 1001220 - RNA, 21 nt, Homo sapiens
ugcacuguucccccugugcag

SEQ ID NO: 1001221 - RNA, 14 nt, Homo sapiens
ugcacuuacuugcu

SEQ ID NO: 1001222 - RNA, 12 nt, Homo sapiens
ugcacuuucuau

SEQ ID NO: 1001223 - RNA, 21 nt, Homo sapiens
ugcagaaaauucugugccuug

SEQ ID NO: 1001224 - RNA, 15 nt, Homo sapiens
ugcagaaacuacuga

SEQ ID NO: 1001225 - RNA, 14 nt, Homo sapiens
ugcagcaagcaaua

SEQ ID NO: 1001226 - RNA, 11 nt, Homo sapiens
ugcagccacac

SEQ ID NO: 1001227 - RNA, 19 nt, Homo sapiens
ugcagggauguggguucca

SEQ ID NO: 1001228 - RNA, 18 nt, Homo sapiens
ugcagggccucugucaau

SEQ ID NO: 1001229 - RNA, 17 nt, Homo sapiens
ugcaguaugggaucuga

SEQ ID NO: 1001230 - RNA, 14 nt, Homo sapiens
ugcaguugucucug

SEQ ID NO: 1001231 - RNA, 20 nt, Homo sapiens
ugcauacuuucccucaucca

SEQ ID NO: 1001232 - RNA, 22 nt, Homo sapiens
ugcaucacuuaacggaccaaag

SEQ ID NO: 1001233 - RNA, 18 nt, Homo sapiens
ugcaucuggagagaacag

SEQ ID NO: 1001234 - RNA, 19 nt, Homo sapiens
ugcaugguuucagcacuag

SEQ ID NO: 1001235 - RNA, 14 nt, Homo sapiens
ugcauguacuguau

SEQ ID NO: 1001236 - RNA, 16 nt, Homo sapiens
ugcauuauaucaaauc

SEQ ID NO: 1001237 - RNA, 16 nt, Homo sapiens
ugcauugugaggguua

SEQ ID NO: 1001238 - RNA, 16 nt, Homo sapiens
ugccaaauauguccug

SEQ ID NO: 1001239 - RNA, 23 nt, Homo sapiens
ugccacagccuccccugccaggg

SEQ ID NO: 1001240 - RNA, 18 nt, Homo sapiens
ugccaccaucauagcuca

SEQ ID NO: 1001241 - RNA, 18 nt, Homo sapiens
ugccacccauuccaucuc

SEQ ID NO: 1001242 - RNA, 12 nt, Homo sapiens
ugccaccucaga

SEQ ID NO: 1001243 - RNA, 19 nt, Homo sapiens
ugccaccucuaacagcacc

SEQ ID NO: 1001244 - RNA, 15 nt, Homo sapiens
ugccacugugugaau

SEQ ID NO: 1001245 - RNA, 18 nt, Homo sapiens
ugccacuuaauguauguu

SEQ ID NO: 1001246 - RNA, 18 nt, Homo sapiens
ugccaucguuuccaugac

SEQ ID NO: 1001247 - RNA, 12 nt, Homo sapiens
ugccaugugaag

SEQ ID NO: 1001248 - RNA, 18 nt, Homo sapiens
ugcccagaauaaguuauu

SEQ ID NO: 1001249 - RNA, 19 nt, Homo sapiens
ugccccaacuccuuccagc

SEQ ID NO: 1001250 - RNA, 21 nt, Homo sapiens
ugccccaucccaugcugucca

SEQ ID NO: 1001251 - RNA, 17 nt, Homo sapiens
ugcccccaauccaugaa

SEQ ID NO: 1001252 - RNA, 19 nt, Homo sapiens
ugccccccagccucuggca

SEQ ID NO: 1001253 - RNA, 13 nt, Homo sapiens
ugcccccuccagu

SEQ ID NO: 1001254 - RNA, 21 nt, Homo sapiens
ugccccucggccccagcacau

SEQ ID NO: 1001255 - RNA, 19 nt, Homo sapiens
ugccccuugacaacuggca

SEQ ID NO: 1001256 - RNA, 19 nt, Homo sapiens
ugccccuuuauaaauccaa

SEQ ID NO: 1001257 - RNA, 18 nt, Homo sapiens
ugcccuaucacccaacgc

SEQ ID NO: 1001258 - RNA, 19 nt, Homo sapiens
ugagauccggcaacaucaa

SEQ ID NO: 1001259 - RNA, 17 nt, Homo sapiens
ugagaugauacauccaa

SEQ ID NO: 1001260 - RNA, 23 nt, Homo sapiens
ugagauugcaccacugcacucca

SEQ ID NO: 1001261 - RNA, 16 nt, Homo sapiens
ugagcaacucuugauu

SEQ ID NO: 1001262 - RNA, 18 nt, Homo sapiens
ugagcaagacauacuuaa

SEQ ID NO: 1001263 - RNA, 14 nt, Homo sapiens
ugagcacugccagg

SEQ ID NO: 1001264 - RNA, 23 nt, Homo sapiens
ugagcacuguuuauacacugugu

SEQ ID NO: 1001265 - RNA, 15 nt, Homo sapiens
ugagccggguggauc

SEQ ID NO: 1001266 - RNA, 21 nt, Homo sapiens
ugagcuauugcuguucucuug

SEQ ID NO: 1001267 - RNA, 14 nt, Homo sapiens
ugagcuccagcucc

SEQ ID NO: 1001268 - RNA, 21 nt, Homo sapiens
ugagcucuauuaugaauguga

SEQ ID NO: 1001269 - RNA, 22 nt, Homo sapiens
ugagcucuauuaugaaugugaa

SEQ ID NO: 1001270 - RNA, 16 nt, Homo sapiens
ugagcuuggacuugca

SEQ ID NO: 1001271 - RNA, 21 nt, Homo sapiens
ugaggaaagcaagaaucagag

SEQ ID NO: 1001272 - RNA, 21 nt, Homo sapiens
ugaggacagaugccuccuucc

SEQ ID NO: 1001273 - RNA, 13 nt, Homo sapiens
cccagccucuggc

SEQ ID NO: 1001274 - RNA, 17 nt, Homo sapiens
cccagcgguucacacag

SEQ ID NO: 1001275 - RNA, 16 nt, Homo sapiens
cccaggcaaggcugug

SEQ ID NO: 1001276 - RNA, 14 nt, Homo sapiens
cccaggcccggaug

SEQ ID NO: 1001277 - RNA, 21 nt, Homo sapiens
cccaggccuguacagauguau

SEQ ID NO: 1001278 - RNA, 17 nt, Homo sapiens
cccaggcugggaacuca

SEQ ID NO: 1001279 - RNA, 15 nt, Homo sapiens
cccagguacauccau

SEQ ID NO: 1001280 - RNA, 15 nt, Homo sapiens
cccauaucugugaaa

SEQ ID NO: 1001281 - RNA, 19 nt, Homo sapiens
cccaucgucucggccuuca

SEQ ID NO: 1001282 - RNA, 23 nt, Homo sapiens
cccaugaccccaaagccaagggc

SEQ ID NO: 1001283 - RNA, 13 nt, Homo sapiens
cccauguguaggu

SEQ ID NO: 1001284 - RNA, 23 nt, Homo sapiens
ccccaacagcuggacccugacca

SEQ ID NO: 1001285 - RNA, 13 nt, Homo sapiens
ccccaaggcacuu

SEQ ID NO: 1001286 - RNA, 14 nt, Homo sapiens
ccccaauccaugaa

SEQ ID NO: 1001287 - RNA, 18 nt, Homo sapiens
ccccaauuucggauuuuu

SEQ ID NO: 1001288 - RNA, 11 nt, Homo sapiens
ccccaccagau

SEQ ID NO: 1001289 - RNA, 22 nt, Homo sapiens
ccccagccagggcucaaucucu

SEQ ID NO: 1001290 - RNA, 18 nt, Homo sapiens
ccccaugaccuccagcuu

SEQ ID NO: 1001291 - RNA, 12 nt, Homo sapiens
cccccugaccac

SEQ ID NO: 1001292 - RNA, 16 nt, Homo sapiens
cccccugcagcuugua

SEQ ID NO: 1001293 - RNA, 18 nt, Homo sapiens
ccccucaguguugucacc

SEQ ID NO: 1001294 - RNA, 23 nt, Homo sapiens
ccccucauccgauuccccuguag

SEQ ID NO: 1001295 - RNA, 14 nt, Homo sapiens
ccccucccuggaug

SEQ ID NO: 1001296 - RNA, 14 nt, Homo sapiens
ccccucucaccaaa

SEQ ID NO: 1001297 - RNA, 17 nt, Homo sapiens
ccccucugucuugugaa

SEQ ID NO: 1001298 - RNA, 14 nt, Homo sapiens
ccccuguaccuuuu

SEQ ID NO: 1001299 - RNA, 16 nt, Homo sapiens
ccccuguagcagucac

SEQ ID NO: 1001300 - RNA, 17 nt, Homo sapiens
ccccuuauccuucuccc

SEQ ID NO: 1001301 - RNA, 14 nt, Homo sapiens
ccccuuggcccccu

SEQ ID NO: 1001302 - RNA, 17 nt, Homo sapiens
cccggggcuccacugaa

SEQ ID NO: 1001303 - RNA, 11 nt, Homo sapiens
cccgugacugc

SEQ ID NO: 1001304 - RNA, 17 nt, Homo sapiens
cccgugccaaguccagg

SEQ ID NO: 1001305 - RNA, 16 nt, Homo sapiens
cccgugucuagaggca

SEQ ID NO: 1001306 - RNA, 20 nt, Homo sapiens
cccuaagagagcaccuggug

SEQ ID NO: 1001307 - RNA, 13 nt, Homo sapiens
cccuaccuugaaa

SEQ ID NO: 1001308 - RNA, 22 nt, Homo sapiens
cccuacugggagaggggccuca

SEQ ID NO: 1001309 - RNA, 13 nt, Homo sapiens
cccuauuaaccua

SEQ ID NO: 1001310 - RNA, 17 nt, Homo sapiens
cccuauuuauugacuuu

SEQ ID NO: 1001311 - RNA, 23 nt, Homo sapiens
cccucauuauuuauguccaggug

SEQ ID NO: 1001312 - RNA, 17 nt, Homo sapiens
cccucauucuacugaaa

SEQ ID NO: 1001313 - RNA, 15 nt, Homo sapiens
cccucccuggaugac

SEQ ID NO: 1001314 - RNA, 16 nt, Homo sapiens
cccucgacauuuucuc

SEQ ID NO: 1001315 - RNA, 20 nt, Homo sapiens
cccucggggauguguccuga

SEQ ID NO: 1001316 - RNA, 19 nt, Homo sapiens
cccucucccugcauggcau

SEQ ID NO: 1001317 - RNA, 16 nt, Homo sapiens
cccucucucaguguca

SEQ ID NO: 1001318 - RNA, 23 nt, Homo sapiens
cccucuuccuacuggucucucua

SEQ ID NO: 1001319 - RNA, 15 nt, Homo sapiens
cccugacgugcagcc

SEQ ID NO: 1001320 - RNA, 19 nt, Homo sapiens
cccugagauucagauguca

SEQ ID NO: 1001321 - RNA, 22 nt, Homo sapiens
cccugagcccaaggcacugaga

SEQ ID NO: 1001322 - RNA, 14 nt, Homo sapiens
cccugcacagugac

SEQ ID NO: 1001323 - RNA, 15 nt, Homo sapiens
cccugcaccaugcug

SEQ ID NO: 1001324 - RNA, 12 nt, Homo sapiens
cccugcauuuau

SEQ ID NO: 1001325 - RNA, 22 nt, Homo sapiens
cccugcuuuuugcuucuugagu

SEQ ID NO: 1001326 - RNA, 15 nt, Homo sapiens
cccuggaugacauua

SEQ ID NO: 1001327 - RNA, 21 nt, Homo sapiens
cccuggaugacauuaaagaag

SEQ ID NO: 1001328 - RNA, 16 nt, Homo sapiens
cccuggccgaguccaa

SEQ ID NO: 1001329 - RNA, 18 nt, Homo sapiens
cccugucagcaugaauuu

SEQ ID NO: 1001330 - RNA, 17 nt, Homo sapiens
cccugucauccagcuca

SEQ ID NO: 1001331 - RNA, 22 nt, Homo sapiens
cccugucaugguguccagacag

SEQ ID NO: 1001332 - RNA, 16 nt, Homo sapiens
cccuucacugucacca

SEQ ID NO: 1001333 - RNA, 12 nt, Homo sapiens
cccuucauacuu

SEQ ID NO: 1001334 - RNA, 13 nt, Homo sapiens
cccuugcugcuuu

SEQ ID NO: 1001335 - RNA, 21 nt, Homo sapiens
cccuuguaaauagaaccagcc

SEQ ID NO: 1001336 - RNA, 14 nt, Homo sapiens
cccuuuuucaauga

SEQ ID NO: 1001337 - RNA, 20 nt, Homo sapiens
ccgaagucuuuuguucgcau

SEQ ID NO: 1001338 - RNA, 12 nt, Homo sapiens
ccgacaucacag

SEQ ID NO: 1001339 - RNA, 15 nt, Homo sapiens
ccgauuccaccaaau

SEQ ID NO: 1001340 - RNA, 23 nt, Homo sapiens
ccgcaacaguuuuuuaugcuaau

SEQ ID NO: 1001341 - RNA, 16 nt, Homo sapiens
ccgccacuggggcuca

SEQ ID NO: 1001342 - RNA, 12 nt, Homo sapiens
ccgccauccacc

SEQ ID NO: 1001343 - RNA, 12 nt, Homo sapiens
ccgccuggagau

SEQ ID NO: 1001344 - RNA, 15 nt, Homo sapiens
ccgcuccaaugccua

SEQ ID NO: 1001345 - RNA, 16 nt, Homo sapiens
ccggacagagcacguu

SEQ ID NO: 1001346 - RNA, 16 nt, Homo sapiens
ccggggccagcacuuc

SEQ ID NO: 1001347 - RNA, 20 nt, Homo sapiens
ccggucguggggaaaucuca

SEQ ID NO: 1001348 - RNA, 23 nt, Homo sapiens
ccgucaagagugaauucccucac

SEQ ID NO: 1001349 - RNA, 17 nt, Homo sapiens
ucuuacuacagcuucag

SEQ ID NO: 1001350 - RNA, 21 nt, Homo sapiens
ucuuacugcuugguccuugau

SEQ ID NO: 1001351 - RNA, 21 nt, Homo sapiens
ucuuagauggugaucugggau

SEQ ID NO: 1001352 - RNA, 13 nt, Homo sapiens
ucuuagauucucu

SEQ ID NO: 1001353 - RNA, 15 nt, Homo sapiens
ucuuaguguaugauu

SEQ ID NO: 1001354 - RNA, 22 nt, Homo sapiens
ucuuaguguaugauuacuggcc

SEQ ID NO: 1001355 - RNA, 17 nt, Homo sapiens
ucuuaugcuguacccag

SEQ ID NO: 1001356 - RNA, 22 nt, Homo sapiens
ucuuaugcuguacccaguuucu

SEQ ID NO: 1001357 - RNA, 13 nt, Homo sapiens
ucuucagccauag

SEQ ID NO: 1001358 - RNA, 19 nt, Homo sapiens
ucuucaguugucucugaug

SEQ ID NO: 1001359 - RNA, 17 nt, Homo sapiens
ucuucaucccacuccaa

SEQ ID NO: 1001360 - RNA, 15 nt, Homo sapiens
ucuucccccaccacc

SEQ ID NO: 1001361 - RNA, 22 nt, Homo sapiens
ucuuccuacuggucucucuaug

SEQ ID NO: 1001362 - RNA, 14 nt, Homo sapiens
ucuucuaaacuucc

SEQ ID NO: 1001363 - RNA, 14 nt, Homo sapiens
ucuucuacugcuau

SEQ ID NO: 1001364 - RNA, 14 nt, Homo sapiens
aaauagcaaaagaa

SEQ ID NO: 1001365 - RNA, 15 nt, Homo sapiens
aaauaucuacauuaa

SEQ ID NO: 1001366 - RNA, 16 nt, Homo sapiens
aaauaucuucacuugu

SEQ ID NO: 1001367 - RNA, 16 nt, Homo sapiens
aaauauggacugcuca

SEQ ID NO: 1001368 - RNA, 17 nt, Homo sapiens
aaaucaaaaucucucca

SEQ ID NO: 1001369 - RNA, 13 nt, Homo sapiens
aaaucacuugcca

SEQ ID NO: 1001370 - RNA, 17 nt, Homo sapiens
aaaucuauagaacugaa

SEQ ID NO: 1001371 - RNA, 22 nt, Homo sapiens
aaaucugccacaaaaacaggua

SEQ ID NO: 1001372 - RNA, 13 nt, Homo sapiens
aaaucugugccug

SEQ ID NO: 1001373 - RNA, 16 nt, Homo sapiens
aaaucuuauaguucua

SEQ ID NO: 1001374 - RNA, 22 nt, Homo sapiens
aaaugacaauuuuuuccacuua

SEQ ID NO: 1001375 - RNA, 14 nt, Homo sapiens
aaauggcuguaaaa

SEQ ID NO: 1001376 - RNA, 15 nt, Homo sapiens
aaauggcuguaaaau

SEQ ID NO: 1001377 - RNA, 18 nt, Homo sapiens
aaaugguaggcauuuccu

SEQ ID NO: 1001378 - RNA, 13 nt, Homo sapiens
aaaugguauguca

SEQ ID NO: 1001379 - RNA, 22 nt, Homo sapiens
aaauguaugucugguuccccag

SEQ ID NO: 1001380 - RNA, 18 nt, Homo sapiens
aaaugucaugcugccuua

SEQ ID NO: 1001381 - RNA, 11 nt, Homo sapiens
aaaugucuugc

SEQ ID NO: 1001382 - RNA, 22 nt, Homo sapiens
aaauguuauuuuuuaauuauua

SEQ ID NO: 1001383 - RNA, 18 nt, Homo sapiens
aaauuaaacuuauuuaca

SEQ ID NO: 1001384 - RNA, 12 nt, Homo sapiens
aaauuaagaagg

SEQ ID NO: 1001385 - RNA, 14 nt, Homo sapiens
aaauuaccugugga

SEQ ID NO: 1001386 - RNA, 18 nt, Homo sapiens
aaauuacugauccucgca

SEQ ID NO: 1001387 - RNA, 19 nt, Homo sapiens
aaauuauaucaaggucuca

SEQ ID NO: 1001388 - RNA, 21 nt, Homo sapiens
aaauucacaugaugcacuuca

SEQ ID NO: 1001389 - RNA, 14 nt, Homo sapiens
aaauucacuuaggg

SEQ ID NO: 1001390 - RNA, 18 nt, Homo sapiens
aaauucagcaaagugguu

SEQ ID NO: 1001391 - RNA, 11 nt, Homo sapiens
aaauugcugac

SEQ ID NO: 1001392 - RNA, 22 nt, Homo sapiens
aaauuguacaagauaaguucca

SEQ ID NO: 1001393 - RNA, 22 nt, Homo sapiens
aaauuguaucaaaugugacauu

SEQ ID NO: 1001394 - RNA, 14 nt, Homo sapiens
aaauuguauuauca

SEQ ID NO: 1001395 - RNA, 12 nt, Homo sapiens
aaauuucaccug

SEQ ID NO: 1001396 - RNA, 16 nt, Homo sapiens
aaauuuugaaaacugu

SEQ ID NO: 1001397 - RNA, 13 nt, Homo sapiens
aacaaacaaugaa

SEQ ID NO: 1001398 - RNA, 13 nt, Homo sapiens
aacaaacccaggu

SEQ ID NO: 1001399 - RNA, 13 nt, Homo sapiens
aacaaacugugua

SEQ ID NO: 1001400 - RNA, 18 nt, Homo sapiens
aacaaccaugucauuuca

SEQ ID NO: 1001401 - RNA, 17 nt, Homo sapiens
aacaagucccuuuaugc

SEQ ID NO: 1001402 - RNA, 13 nt, Homo sapiens
aacaaugcauuuu

SEQ ID NO: 1001403 - RNA, 14 nt, Homo sapiens
aacaauuucaauaa

SEQ ID NO: 1001404 - RNA, 12 nt, Homo sapiens
aacacucaugaa

SEQ ID NO: 1001405 - RNA, 22 nt, Homo sapiens
aacagaaagccugggugacauu

SEQ ID NO: 1001406 - RNA, 20 nt, Homo sapiens
aacagaacauagacagaaga

SEQ ID NO: 1001407 - RNA, 13 nt, Homo sapiens
aacagaagccuga

SEQ ID NO: 1001408 - RNA, 13 nt, Homo sapiens
aacagaagggaua

SEQ ID NO: 1001409 - RNA, 16 nt, Homo sapiens
aacagccugacaacau

SEQ ID NO: 1001410 - RNA, 15 nt, Homo sapiens
aacagguauauacuu

SEQ ID NO: 1001411 - RNA, 19 nt, Homo sapiens
aacagguauauacuuugaa

SEQ ID NO: 1001412 - RNA, 18 nt, Homo sapiens
aacagguuucuaagcaua

SEQ ID NO: 1001413 - RNA, 19 nt, Homo sapiens
aacagugcaacacuggucu

SEQ ID NO: 1001414 - RNA, 16 nt, Homo sapiens
aacaucauucuugaga

SEQ ID NO: 1001415 - RNA, 13 nt, Homo sapiens
aaccaaagaccau

SEQ ID NO: 1001416 - RNA, 20 nt, Homo sapiens
aaccaaaucuggaagccaaa

SEQ ID NO: 1001417 - RNA, 21 nt, Homo sapiens
aaccaaucaaccaaacaaaga

SEQ ID NO: 1001418 - RNA, 23 nt, Homo sapiens
aaccagauacggacagagaccaa

SEQ ID NO: 1001419 - RNA, 16 nt, Homo sapiens
aaccagcuuccuucag

SEQ ID NO: 1001420 - RNA, 20 nt, Homo sapiens
aaccaguccccccacccuca

SEQ ID NO: 1001421 - RNA, 13 nt, Homo sapiens
aacccaaccucau

SEQ ID NO: 1001422 - RNA, 22 nt, Homo sapiens
aacccacuagaagcaacuagga

SEQ ID NO: 1001423 - RNA, 12 nt, Homo sapiens
aacccagacuca

SEQ ID NO: 1001424 - RNA, 22 nt, Homo sapiens
aacccagcucuaauacauucca

SEQ ID NO: 1001425 - RNA, 18 nt, Homo sapiens
aacccccgacuucauccc

SEQ ID NO: 1001426 - RNA, 17 nt, Homo sapiens
aaccccuccccuccauc

SEQ ID NO: 1001427 - RNA, 14 nt, Homo sapiens
aaccccugaaguau

SEQ ID NO: 1001428 - RNA, 23 nt, Homo sapiens
aacccgagaaaacaaacccaggu

SEQ ID NO: 1001429 - RNA, 12 nt, Homo sapiens
aacccugucuga

SEQ ID NO: 1001430 - RNA, 14 nt, Homo sapiens
aacccuuauacuca

SEQ ID NO: 1001431 - RNA, 23 nt, Homo sapiens
aacccuucccucaccuuggcacc

SEQ ID NO: 1001432 - RNA, 20 nt, Homo sapiens
aacccuuugugugcucucca

SEQ ID NO: 1001433 - RNA, 13 nt, Homo sapiens
aaccuacuaccca

SEQ ID NO: 1001434 - RNA, 21 nt, Homo sapiens
aaccucagccuggccagacac

SEQ ID NO: 1001435 - RNA, 20 nt, Homo sapiens
aaguucaugcagcuguggca

SEQ ID NO: 1001436 - RNA, 12 nt, Homo sapiens
aaguuccaagag

SEQ ID NO: 1001437 - RNA, 12 nt, Homo sapiens
aaguugcagcug

SEQ ID NO: 1001438 - RNA, 17 nt, Homo sapiens
aaguugcugaugaacuc

SEQ ID NO: 1001439 - RNA, 14 nt, Homo sapiens
aaguugugccaaau

SEQ ID NO: 1001440 - RNA, 16 nt, Homo sapiens
aaguuuaaucagagga

SEQ ID NO: 1001441 - RNA, 14 nt, Homo sapiens
aaguuuuacauugu

SEQ ID NO: 1001442 - RNA, 14 nt, Homo sapiens
aauaaagcaucuca

SEQ ID NO: 1001443 - RNA, 20 nt, Homo sapiens
aauaaaguauucgcauuaua

SEQ ID NO: 1001444 - RNA, 17 nt, Homo sapiens
aauaaaugucaccaggu

SEQ ID NO: 1001445 - RNA, 18 nt, Homo sapiens
aauaacaaaugccaaauu

SEQ ID NO: 1001446 - RNA, 20 nt, Homo sapiens
aauaacgucuuuuuauaucu

SEQ ID NO: 1001447 - RNA, 22 nt, Homo sapiens
aauaauauaucaaauaacucaa

SEQ ID NO: 1001448 - RNA, 22 nt, Homo sapiens
aauaauuuagacuucaagcaug

SEQ ID NO: 1001449 - RNA, 15 nt, Homo sapiens
aauaauuuccuccac

SEQ ID NO: 1001450 - RNA, 12 nt, Homo sapiens
aauacaaacuau

SEQ ID NO: 1001451 - RNA, 11 nt, Homo sapiens
aauacacaauu

SEQ ID NO: 1001452 - RNA, 20 nt, Homo sapiens
aauacagaucaucuuggaac

SEQ ID NO: 1001453 - RNA, 14 nt, Homo sapiens
aauacauugcagca

SEQ ID NO: 1001454 - RNA, 12 nt, Homo sapiens
aauacuaaugaa

SEQ ID NO: 1001455 - RNA, 17 nt, Homo sapiens
aauacugcuacagcaau

SEQ ID NO: 1001456 - RNA, 13 nt, Homo sapiens
aauagaacacagu

SEQ ID NO: 1001457 - RNA, 19 nt, Homo sapiens
aauagaauuauaacuggaa

SEQ ID NO: 1001458 - RNA, 22 nt, Homo sapiens
aauagacuuaaaucucauugcu

SEQ ID NO: 1001459 - RNA, 14 nt, Homo sapiens
aauagcaugucacu

SEQ ID NO: 1001460 - RNA, 15 nt, Homo sapiens
aauagugaaaugcca

SEQ ID NO: 1001461 - RNA, 16 nt, Homo sapiens
aauaucccuacaugua

SEQ ID NO: 1001462 - RNA, 17 nt, Homo sapiens
aauaucuucacuuguca

SEQ ID NO: 1001463 - RNA, 21 nt, Homo sapiens
aauaugaguaauacaucaaag

SEQ ID NO: 1001464 - RNA, 22 nt, Homo sapiens
aauaugaguaauacaucaaaga

SEQ ID NO: 1001465 - RNA, 19 nt, Homo sapiens
aauaugccuuuuugaagca

SEQ ID NO: 1001466 - RNA, 14 nt, Homo sapiens
aaucaaaugcaauu

SEQ ID NO: 1001467 - RNA, 15 nt, Homo sapiens
aaucaacuuuacugu

SEQ ID NO: 1001468 - RNA, 15 nt, Homo sapiens
aaucaaucuacucaa

SEQ ID NO: 1001469 - RNA, 19 nt, Homo sapiens
aaucacuugccaaaaucca

SEQ ID NO: 1001470 - RNA, 20 nt, Homo sapiens
aaucagagaccuuccagaaa

SEQ ID NO: 1001471 - RNA, 18 nt, Homo sapiens
cuuauaagaaagaucaaa

SEQ ID NO: 1001472 - RNA, 19 nt, Homo sapiens
cuuauaagaaagaucaaag

SEQ ID NO: 1001473 - RNA, 20 nt, Homo sapiens
cuuauaagaaagaucaaaga

SEQ ID NO: 1001474 - RNA, 18 nt, Homo sapiens
cuuauauucauccaugcc

SEQ ID NO: 1001475 - RNA, 12 nt, Homo sapiens
cuuaucuugcac

SEQ ID NO: 1001476 - RNA, 12 nt, Homo sapiens
cuuaugcuguac

SEQ ID NO: 1001477 - RNA, 12 nt, Homo sapiens
cuuauguuauac

SEQ ID NO: 1001478 - RNA, 21 nt, Homo sapiens
cuuauuaacaauuaggcagac

SEQ ID NO: 1001479 - RNA, 13 nt, Homo sapiens
cuuauuccaugac

SEQ ID NO: 1001480 - RNA, 18 nt, Homo sapiens
cuuauugccucacuucag

SEQ ID NO: 1001481 - RNA, 19 nt, Homo sapiens
cuucaaagaggaaccagga

SEQ ID NO: 1001482 - RNA, 18 nt, Homo sapiens
cuucaaaugccugacuag

SEQ ID NO: 1001483 - RNA, 17 nt, Homo sapiens
cuucaacguagucaucc

SEQ ID NO: 1001484 - RNA, 21 nt, Homo sapiens
cuucaacugucuccuaccucu

SEQ ID NO: 1001485 - RNA, 18 nt, Homo sapiens
cuucaagccugugcaaug

SEQ ID NO: 1001486 - RNA, 15 nt, Homo sapiens
cuucacaaucuguca

SEQ ID NO: 1001487 - RNA, 12 nt, Homo sapiens
cuucacaguacc

SEQ ID NO: 1001488 - RNA, 17 nt, Homo sapiens
cuuuuacucugccuaca

SEQ ID NO: 1001489 - RNA, 19 nt, Homo sapiens
cuuuuaguaaagucaagga

SEQ ID NO: 1001490 - RNA, 21 nt, Homo sapiens
cuuuuaguauuuuagugaacu

SEQ ID NO: 1001491 - RNA, 15 nt, Homo sapiens
cuuuucagcugaggu

SEQ ID NO: 1001492 - RNA, 17 nt, Homo sapiens
cuuuucccacuccaagc

SEQ ID NO: 1001493 - RNA, 17 nt, Homo sapiens
cuuuucccauugccaug

SEQ ID NO: 1001494 - RNA, 18 nt, Homo sapiens
cuuuucccauugccaugc

SEQ ID NO: 1001495 - RNA, 17 nt, Homo sapiens
cuuuugacaaaggcaag

SEQ ID NO: 1001496 - RNA, 13 nt, Homo sapiens
cuuuugccuuuug

SEQ ID NO: 1001497 - RNA, 21 nt, Homo sapiens
cuuuuggaggaagauacauuu

SEQ ID NO: 1001498 - RNA, 21 nt, Homo sapiens
cuuuugguuaugaauacuuug

SEQ ID NO: 1001499 - RNA, 16 nt, Homo sapiens
cuuuuuuucuguacca

SEQ ID NO: 1001500 - RNA, 17 nt, Homo sapiens
cuuuuuuucuguaccag

SEQ ID NO: 1001501 - RNA, 19 nt, Homo sapiens
gaaaaaucuaagugauaua

SEQ ID NO: 1001502 - RNA, 22 nt, Homo sapiens
gaaaaaugggaacaaggcaaug

SEQ ID NO: 1001503 - RNA, 17 nt, Homo sapiens
gaaaaaugguggucauu

SEQ ID NO: 1001504 - RNA, 14 nt, Homo sapiens
gaaaacacugugca

SEQ ID NO: 1001505 - RNA, 17 nt, Homo sapiens
gaaaacaggcacugccc

SEQ ID NO: 1001506 - RNA, 14 nt, Homo sapiens
gaaacaaacuggag

SEQ ID NO: 1001507 - RNA, 13 nt, Homo sapiens
gaaacaacucuuu

SEQ ID NO: 1001508 - RNA, 17 nt, Homo sapiens
gaaaccuguacauaugu

SEQ ID NO: 1001509 - RNA, 17 nt, Homo sapiens
gaaacgagacuuuccau

SEQ ID NO: 1001510 - RNA, 15 nt, Homo sapiens
gaaacuaaacucuua

SEQ ID NO: 1001511 - RNA, 20 nt, Homo sapiens
gaaagaauagaacacaguuu

SEQ ID NO: 1001512 - RNA, 13 nt, Homo sapiens
gaaagaccaggcc

SEQ ID NO: 1001513 - RNA, 20 nt, Homo sapiens
gaaagaccaggccaauguca

SEQ ID NO: 1001514 - RNA, 18 nt, Homo sapiens
gaaagccugggugacauu

SEQ ID NO: 1001515 - RNA, 13 nt, Homo sapiens
gaaaggaagcauu

SEQ ID NO: 1001516 - RNA, 20 nt, Homo sapiens
gaaaggauugauuugaacuu

SEQ ID NO: 1001517 - RNA, 23 nt, Homo sapiens
gaaaggcuguuaaauacaggaaa

SEQ ID NO: 1001518 - RNA, 12 nt, Homo sapiens
gaaagguggugu

SEQ ID NO: 1001519 - RNA, 18 nt, Homo sapiens
gaaaguuaauccacugug

SEQ ID NO: 1001520 - RNA, 23 nt, Homo sapiens
gaaauaagaauucagacaucuga

SEQ ID NO: 1001521 - RNA, 20 nt, Homo sapiens
gaaaucccuucauacuugaa

SEQ ID NO: 1001522 - RNA, 22 nt, Homo sapiens
gaaaucuaccaagcuugcaaga

SEQ ID NO: 1001523 - RNA, 16 nt, Homo sapiens
gaaaucuuaaaccuua

SEQ ID NO: 1001524 - RNA, 15 nt, Homo sapiens
gaaauuaagacuuua

SEQ ID NO: 1001525 - RNA, 17 nt, Homo sapiens
gaaauuaagacuuuaug

SEQ ID NO: 1001526 - RNA, 22 nt, Homo sapiens
gaaauuuaaacuauaagcaaga

SEQ ID NO: 1001527 - RNA, 15 nt, Homo sapiens
gaaccaggaggacaa

SEQ ID NO: 1001528 - RNA, 16 nt, Homo sapiens
gaacccaccaaaccaa

SEQ ID NO: 1001529 - RNA, 13 nt, Homo sapiens
gaacccagcccac

SEQ ID NO: 1001530 - RNA, 12 nt, Homo sapiens
gaacccaggaca

SEQ ID NO: 1001531 - RNA, 18 nt, Homo sapiens
gaacccgaggcugagaau

SEQ ID NO: 1001532 - RNA, 20 nt, Homo sapiens
gaaccggagagccagcuaag

SEQ ID NO: 1001533 - RNA, 15 nt, Homo sapiens
gaaccuggaacuugg

SEQ ID NO: 1001534 - RNA, 18 nt, Homo sapiens
gaaccuggguugcagaca

SEQ ID NO: 1001535 - RNA, 19 nt, Homo sapiens
gaaccuuugugcccuauca

SEQ ID NO: 1001536 - RNA, 23 nt, Homo sapiens
gaacucaaauggggccagaucca

SEQ ID NO: 1001537 - RNA, 13 nt, Homo sapiens
gaacucacugcga

SEQ ID NO: 1001538 - RNA, 13 nt, Homo sapiens
gaacucagaucca

SEQ ID NO: 1001539 - RNA, 14 nt, Homo sapiens
gaacucugguggca

SEQ ID NO: 1001540 - RNA, 19 nt, Homo sapiens
gaacucuucacucuucaaa

SEQ ID NO: 1001541 - RNA, 22 nt, Homo sapiens
gaagaaugcacaagaauggauc

SEQ ID NO: 1001542 - RNA, 21 nt, Homo sapiens
gaagacgccuuucuccuccaa

SEQ ID NO: 1001543 - RNA, 16 nt, Homo sapiens
gaagagccacugccau

SEQ ID NO: 1001544 - RNA, 13 nt, Homo sapiens
gaagaguguuauu

SEQ ID NO: 1001545 - RNA, 17 nt, Homo sapiens
gaagcaacuaggaaaau

SEQ ID NO: 1001546 - RNA, 20 nt, Homo sapiens
gaagccacuauuacugggac

SEQ ID NO: 1001547 - RNA, 14 nt, Homo sapiens
gaagccacugccuu

SEQ ID NO: 1001548 - RNA, 17 nt, Homo sapiens
gaagccugaugcugaca

SEQ ID NO: 1001549 - RNA, 15 nt, Homo sapiens
gaaggaaaagcaugu

SEQ ID NO: 1001550 - RNA, 21 nt, Homo sapiens
gaaggacuaugaaaagcuaga

SEQ ID NO: 1001551 - RNA, 14 nt, Homo sapiens
gaaggcaaacccau

SEQ ID NO: 1001552 - RNA, 23 nt, Homo sapiens
gaaggccucuuguugagugccag

SEQ ID NO: 1001553 - RNA, 17 nt, Homo sapiens
gaaggcuuccuaucugu

SEQ ID NO: 1001554 - RNA, 19 nt, Homo sapiens
gaagggagccaagggaugg

SEQ ID NO: 1001555 - RNA, 12 nt, Homo sapiens
gaagggccagag

SEQ ID NO: 1001556 - RNA, 21 nt, Homo sapiens
gaagucauccagucuauucac

SEQ ID NO: 1001557 - RNA, 13 nt, Homo sapiens
gaagucucuucca

SEQ ID NO: 1001558 - RNA, 11 nt, Homo sapiens
gaagugaaaac

SEQ ID NO: 1001559 - RNA, 13 nt, Homo sapiens
gaagugagcugag

SEQ ID NO: 1001560 - RNA, 18 nt, Homo sapiens
gaagugagggcucacuca

SEQ ID NO: 1001561 - RNA, 13 nt, Homo sapiens
gaaguugcugcuu

SEQ ID NO: 1001562 - RNA, 21 nt, Homo sapiens
gaaguuuagauuuuaaucaaa

SEQ ID NO: 1001563 - RNA, 11 nt, Homo sapiens
gaaguuucauc

SEQ ID NO: 1001564 - RNA, 18 nt, Homo sapiens
gaauaaaugucacuuuuu

SEQ ID NO: 1001565 - RNA, 15 nt, Homo sapiens
gaauaaaugucuugc

SEQ ID NO: 1001566 - RNA, 14 nt, Homo sapiens
gaauaccaccuaau

SEQ ID NO: 1001567 - RNA, 18 nt, Homo sapiens
gaauacugcuacagcaau

SEQ ID NO: 1001568 - RNA, 20 nt, Homo sapiens
gaauagccauauuuguaaaa

SEQ ID NO: 1001569 - RNA, 16 nt, Homo sapiens
gaaucaaaugcaauuu

SEQ ID NO: 1001570 - RNA, 14 nt, Homo sapiens
gaaucaacauuucu

SEQ ID NO: 1001571 - RNA, 21 nt, Homo sapiens
gaaucccagcccccugaccac

SEQ ID NO: 1001572 - RNA, 17 nt, Homo sapiens
gaauccgcccaucuggg

SEQ ID NO: 1001573 - RNA, 21 nt, Homo sapiens
gaaucugugugaaacuuucau

SEQ ID NO: 1001574 - RNA, 23 nt, Homo sapiens
gaaucuuuaaaagaugcuuuuaa

SEQ ID NO: 1001575 - RNA, 22 nt, Homo sapiens
gaauggcugcaccuuuuugcau

SEQ ID NO: 1001576 - RNA, 18 nt, Homo sapiens
caaccugccugacauuug

SEQ ID NO: 1001577 - RNA, 17 nt, Homo sapiens
caacgcuccaaagucau

SEQ ID NO: 1001578 - RNA, 13 nt, Homo sapiens
caacuacuaauag

SEQ ID NO: 1001579 - RNA, 12 nt, Homo sapiens
caacucuugauu

SEQ ID NO: 1001580 - RNA, 13 nt, Homo sapiens
caacucuugcaca

SEQ ID NO: 1001581 - RNA, 14 nt, Homo sapiens
caacucuugcacag

SEQ ID NO: 1001582 - RNA, 15 nt, Homo sapiens
caacucuuugagaaa

SEQ ID NO: 1001583 - RNA, 17 nt, Homo sapiens
caacuuauuaacaauua

SEQ ID NO: 1001584 - RNA, 12 nt, Homo sapiens
caacuuugacaa

SEQ ID NO: 1001585 - RNA, 16 nt, Homo sapiens
caagaaacgucuucua

SEQ ID NO: 1001586 - RNA, 18 nt, Homo sapiens
caagacccccagcacuug

SEQ ID NO: 1001587 - RNA, 13 nt, Homo sapiens
caagacucuagag

SEQ ID NO: 1001588 - RNA, 12 nt, Homo sapiens
caagacuuugac

SEQ ID NO: 1001589 - RNA, 17 nt, Homo sapiens
caagagaagcauucuca

SEQ ID NO: 1001590 - RNA, 13 nt, Homo sapiens
caagagcccuguc

SEQ ID NO: 1001591 - RNA, 23 nt, Homo sapiens
caagauuggccugaggcugcacu

SEQ ID NO: 1001592 - RNA, 16 nt, Homo sapiens
caagccugucuucaga

SEQ ID NO: 1001593 - RNA, 17 nt, Homo sapiens
caagccugucuucagag

SEQ ID NO: 1001594 - RNA, 15 nt, Homo sapiens
caagccugugcaaug

SEQ ID NO: 1001595 - RNA, 14 nt, Homo sapiens
caagcucugcaguc

SEQ ID NO: 1001596 - RNA, 13 nt, Homo sapiens
caagcugauuaaa

SEQ ID NO: 1001597 - RNA, 20 nt, Homo sapiens
caagcuuauuuaagaucaca

SEQ ID NO: 1001598 - RNA, 21 nt, Homo sapiens
caagcuuauuuaagaucacag

SEQ ID NO: 1001599 - RNA, 19 nt, Homo sapiens
caaggaaaggcacauguca

SEQ ID NO: 1001600 - RNA, 19 nt, Homo sapiens
caaggcccauaucugugaa

SEQ ID NO: 1001601 - RNA, 21 nt, Homo sapiens
caagggauggacaucuuguca

SEQ ID NO: 1001602 - RNA, 18 nt, Homo sapiens
caagguccucugucaguc

SEQ ID NO: 1001603 - RNA, 17 nt, Homo sapiens
caaggugacauuuccau

SEQ ID NO: 1001604 - RNA, 16 nt, Homo sapiens
caaguaauacaaacua

SEQ ID NO: 1001605 - RNA, 19 nt, Homo sapiens
caaguagcugggauuacag

SEQ ID NO: 1001606 - RNA, 21 nt, Homo sapiens
caagugaucugcccaccucag

SEQ ID NO: 1001607 - RNA, 21 nt, Homo sapiens
caaguuauuaauuucuucaca

SEQ ID NO: 1001608 - RNA, 20 nt, Homo sapiens
caaguuguucgggccaagga

SEQ ID NO: 1001609 - RNA, 13 nt, Homo sapiens
caauaaagaccac

SEQ ID NO: 1001610 - RNA, 18 nt, Homo sapiens
caauaaagaccacuuuac

SEQ ID NO: 1001611 - RNA, 14 nt, Homo sapiens
caauacaaauggau

SEQ ID NO: 1001612 - RNA, 17 nt, Homo sapiens
caauagugaaaugccac

SEQ ID NO: 1001613 - RNA, 15 nt, Homo sapiens
caauagugucauccu

SEQ ID NO: 1001614 - RNA, 20 nt, Homo sapiens
caauauacuggaaagcuuuu

SEQ ID NO: 1001615 - RNA, 21 nt, Homo sapiens
caaugagcauguuuagacuuu

SEQ ID NO: 1001616 - RNA, 18 nt, Homo sapiens
caaugagcuuucugaaca

SEQ ID NO: 1001617 - RNA, 21 nt, Homo sapiens
caaugagcuuucugaacagcu

SEQ ID NO: 1001618 - RNA, 19 nt, Homo sapiens
caaugggagcugaggccac

SEQ ID NO: 1001619 - RNA, 20 nt, Homo sapiens
caaugucuggagaccaccag

SEQ ID NO: 1001620 - RNA, 22 nt, Homo sapiens
caauguguguauauggacaaaa

SEQ ID NO: 1001621 - RNA, 14 nt, Homo sapiens
caauguuagccaca

SEQ ID NO: 1001622 - RNA, 18 nt, Homo sapiens
caauuaaaaugacaagca

SEQ ID NO: 1001623 - RNA, 14 nt, Homo sapiens
caauugacaacagu

SEQ ID NO: 1001624 - RNA, 14 nt, Homo sapiens
caauuucagacucc

SEQ ID NO: 1001625 - RNA, 20 nt, Homo sapiens
caauuuuucaagagcuccuu

SEQ ID NO: 1001626 - RNA, 13 nt, Homo sapiens
cacaaaacccaga

SEQ ID NO: 1001627 - RNA, 18 nt, Homo sapiens
cacaaaauaaccaauccu

SEQ ID NO: 1001628 - RNA, 21 nt, Homo sapiens
cacaaaucagaccuggcugcu

SEQ ID NO: 1001629 - RNA, 20 nt, Homo sapiens
cacaagaagcugguggagca

SEQ ID NO: 1001630 - RNA, 19 nt, Homo sapiens
cacaaggucuuuaaaguga

SEQ ID NO: 1001631 - RNA, 18 nt, Homo sapiens
cacaaguggguaccccca

SEQ ID NO: 1001632 - RNA, 15 nt, Homo sapiens
cacaauaacuccucc

SEQ ID NO: 1001633 - RNA, 13 nt, Homo sapiens
cacacaaaccagu

SEQ ID NO: 1001634 - RNA, 21 nt, Homo sapiens
cacacagaaaaggcugcugug

SEQ ID NO: 1001635 - RNA, 11 nt, Homo sapiens
cacacauauac

SEQ ID NO: 1001636 - RNA, 16 nt, Homo sapiens
cacacauauacaugua

SEQ ID NO: 1001637 - RNA, 22 nt, Homo sapiens
cacagaaaaggcugcugugaac

SEQ ID NO: 1001638 - RNA, 16 nt, Homo sapiens
cacagaaaauaaggca

SEQ ID NO: 1001639 - RNA, 14 nt, Homo sapiens
cacagagugcauug

SEQ ID NO: 1001640 - RNA, 15 nt, Homo sapiens
cacagcaacuauaua

SEQ ID NO: 1001641 - RNA, 19 nt, Homo sapiens
cacagccaccccugagauc

SEQ ID NO: 1001642 - RNA, 22 nt, Homo sapiens
cacagcccugucagcaugaauu

SEQ ID NO: 1001643 - RNA, 18 nt, Homo sapiens
cacagcuuagauuucaua

SEQ ID NO: 1001644 - RNA, 18 nt, Homo sapiens
cacagcuugucucuugcc

SEQ ID NO: 1001645 - RNA, 23 nt, Homo sapiens
cacagcuugucucuugccugcca

SEQ ID NO: 1001646 - RNA, 19 nt, Homo sapiens
cacaggaagccugcagucc

SEQ ID NO: 1001647 - RNA, 23 nt, Homo sapiens
cacaggccuguguagcugugacc

SEQ ID NO: 1001648 - RNA, 15 nt, Homo sapiens
cacagggucugcucu

SEQ ID NO: 1001649 - RNA, 16 nt, Homo sapiens
cacaguagucuugaug

SEQ ID NO: 1001650 - RNA, 12 nt, Homo sapiens
cacagucacugc

SEQ ID NO: 1001651 - RNA, 14 nt, Homo sapiens
cacagucaugugcc

SEQ ID NO: 1001652 - RNA, 16 nt, Homo sapiens
cacaugcccaugauga

SEQ ID NO: 1001653 - RNA, 19 nt, Homo sapiens
cacaugccccaucccaugc

SEQ ID NO: 1001654 - RNA, 22 nt, Homo sapiens
cacaugggcagaaaaauggugg

SEQ ID NO: 1001655 - RNA, 17 nt, Homo sapiens
cacaugucaguaccuuc

SEQ ID NO: 1001656 - RNA, 21 nt, Homo sapiens
cacauuugcuuuuugugauau

SEQ ID NO: 1001657 - RNA, 23 nt, Homo sapiens
cacauuugucaguauuuuugccg

SEQ ID NO: 1001658 - RNA, 23 nt, Homo sapiens
cacauuuuuauaaaaaugagugc

SEQ ID NO: 1001659 - RNA, 12 nt, Homo sapiens
caccaaagggaa

SEQ ID NO: 1001660 - RNA, 24 nt, Homo sapiens
caccaacccuucauuuaacaagua

SEQ ID NO: 1001661 - RNA, 22 nt, Homo sapiens
caccaaguaccaguauaagcau

SEQ ID NO: 1001662 - RNA, 23 nt, Homo sapiens
caccaggaauccccaacaugcac

SEQ ID NO: 1001663 - RNA, 15 nt, Homo sapiens
caccaggccuuugag

SEQ ID NO: 1001664 - RNA, 22 nt, Homo sapiens
cacccaacugucucgaugcaau

SEQ ID NO: 1001665 - RNA, 22 nt, Homo sapiens
cacccaggauccccaaggcacu

SEQ ID NO: 1001666 - RNA, 17 nt, Homo sapiens
cacccaggccaggcaug

SEQ ID NO: 1001667 - RNA, 18 nt, Homo sapiens
cacccaggcuggagugca

SEQ ID NO: 1001668 - RNA, 18 nt, Homo sapiens
caccccgccugcccucau

SEQ ID NO: 1001669 - RNA, 14 nt, Homo sapiens
cacccucuggagaa

SEQ ID NO: 1001670 - RNA, 24 nt, Homo sapiens
cacccugaguugcuuuucagcuga

SEQ ID NO: 1001671 - RNA, 21 nt, Homo sapiens
cacccuggaggauuucaucuc

SEQ ID NO: 1001672 - RNA, 19 nt, Homo sapiens
cacccuguuccugcugcug

SEQ ID NO: 1001673 - RNA, 24 nt, Homo sapiens
caccgagugccuucaacacagcuu

SEQ ID NO: 1001674 - RNA, 12 nt, Homo sapiens
caccgugaucaa

SEQ ID NO: 1001675 - RNA, 12 nt, Homo sapiens
caccuaauccag

SEQ ID NO: 1001676 - RNA, 12 nt, Homo sapiens
caccuauuucca

SEQ ID NO: 1001677 - RNA, 11 nt, Homo sapiens
caccuccaguc

SEQ ID NO: 1001678 - RNA, 11 nt, Homo sapiens
caccuccucau

SEQ ID NO: 1001679 - RNA, 20 nt, Homo sapiens
aauuucggauuuuuuccaaa

SEQ ID NO: 1001680 - RNA, 22 nt, Homo sapiens
aauuucuccaguggauucccag

SEQ ID NO: 1001681 - RNA, 13 nt, Homo sapiens
aauuugagacaaa

SEQ ID NO: 1001682 - RNA, 14 nt, Homo sapiens
aauuuguaaugucu

SEQ ID NO: 1001683 - RNA, 15 nt, Homo sapiens
aauuuguaaugucuu

SEQ ID NO: 1001684 - RNA, 19 nt, Homo sapiens
aauuuuguuuucuguggag

SEQ ID NO: 1001685 - RNA, 20 nt, Homo sapiens
acaaaaacagguauauacuu

SEQ ID NO: 1001686 - RNA, 16 nt, Homo sapiens
acaaaacuacaugaga

SEQ ID NO: 1001687 - RNA, 16 nt, Homo sapiens
acaaaauauauuuugu

SEQ ID NO: 1001688 - RNA, 14 nt, Homo sapiens
acaaacccaagggc

SEQ ID NO: 1001689 - RNA, 18 nt, Homo sapiens
acaaacuauauauaauca

SEQ ID NO: 1001690 - RNA, 14 nt, Homo sapiens
acaaacuucaaaga

SEQ ID NO: 1001691 - RNA, 13 nt, Homo sapiens
acaacagugaaaa

SEQ ID NO: 1001692 - RNA, 19 nt, Homo sapiens
acaacuucuaauugccaug

SEQ ID NO: 1001693 - RNA, 20 nt, Homo sapiens
acaagaacuuuaaauugugu

SEQ ID NO: 1001694 - RNA, 22 nt, Homo sapiens
acaagaagccacagaccuagga

SEQ ID NO: 1001695 - RNA, 11 nt, Homo sapiens
acaagaagcug

SEQ ID NO: 1001696 - RNA, 19 nt, Homo sapiens
acaagacccccagcacuug

SEQ ID NO: 1001697 - RNA, 14 nt, Homo sapiens
acaagccugaggga

SEQ ID NO: 1001698 - RNA, 15 nt, Homo sapiens
acaagcugcauuuca

SEQ ID NO: 1001699 - RNA, 12 nt, Homo sapiens
acaaggccaucu

SEQ ID NO: 1001700 - RNA, 21 nt, Homo sapiens
acaauagaauuauaacuggaa

SEQ ID NO: 1001701 - RNA, 18 nt, Homo sapiens
acaauagugauugauaga

SEQ ID NO: 1001702 - RNA, 11 nt, Homo sapiens
acaaugcauuu

SEQ ID NO: 1001703 - RNA, 23 nt, Homo sapiens
acaauggaccggagagugggggu

SEQ ID NO: 1001704 - RNA, 15 nt, Homo sapiens
acaauguaagagccu

SEQ ID NO: 1001705 - RNA, 19 nt, Homo sapiens
acaauuaaaaugacaagca

SEQ ID NO: 1001706 - RNA, 22 nt, Homo sapiens
acaauuaaaaugacaagcacua

SEQ ID NO: 1001707 - RNA, 16 nt, Homo sapiens
acaauugacaacaguu

SEQ ID NO: 1001708 - RNA, 22 nt, Homo sapiens
acaauugacaacaguuacauaa

SEQ ID NO: 1001709 - RNA, 13 nt, Homo sapiens
acacaacuaggaa

SEQ ID NO: 1001710 - RNA, 17 nt, Homo sapiens
acacacccugucugccc

SEQ ID NO: 1001711 - RNA, 19 nt, Homo sapiens
acaccaccucuccagaggc

SEQ ID NO: 1001712 - RNA, 23 nt, Homo sapiens
acaccacuuuacuuguguuauau

SEQ ID NO: 1001713 - RNA, 13 nt, Homo sapiens
acaccagggccag

SEQ ID NO: 1001714 - RNA, 14 nt, Homo sapiens
acacuaacauauaa

SEQ ID NO: 1001715 - RNA, 18 nt, Homo sapiens
acacuaacauauaauguu

SEQ ID NO: 1001716 - RNA, 22 nt, Homo sapiens
aucucucccuccccugccauuu

SEQ ID NO: 1001717 - RNA, 11 nt, Homo sapiens
aucucugggcu

SEQ ID NO: 1001718 - RNA, 12 nt, Homo sapiens
aucucugggcug

SEQ ID NO: 1001719 - RNA, 16 nt, Homo sapiens
aucucuuauuuuacaa

SEQ ID NO: 1001720 - RNA, 17 nt, Homo sapiens
aucucuuauuuuacaau

SEQ ID NO: 1001721 - RNA, 18 nt, Homo sapiens
aucucuucagguucucau

SEQ ID NO: 1001722 - RNA, 13 nt, Homo sapiens
aucugacccagug

SEQ ID NO: 1001723 - RNA, 23 nt, Homo sapiens
aucugauuuguaacccacugaga

SEQ ID NO: 1001724 - RNA, 22 nt, Homo sapiens
aucugccaagggccgacuaaga

SEQ ID NO: 1001725 - RNA, 15 nt, Homo sapiens
aucugcgugacaaua

SEQ ID NO: 1001726 - RNA, 14 nt, Homo sapiens
aucuggaacccaga

SEQ ID NO: 1001727 - RNA, 18 nt, Homo sapiens
aucuggaacccagacuca

SEQ ID NO: 1001728 - RNA, 16 nt, Homo sapiens
aucugggccuuggccu

SEQ ID NO: 1001729 - RNA, 10 nt, Homo sapiens
aucugugcac

SEQ ID NO: 1001730 - RNA, 15 nt, Homo sapiens
aucugugccugagaa

SEQ ID NO: 1001731 - RNA, 17 nt, Homo sapiens
aucuguguggugaugaa

SEQ ID NO: 1001732 - RNA, 20 nt, Homo sapiens
aucuucuaaacccaauccaa

SEQ ID NO: 1001733 - RNA, 16 nt, Homo sapiens
aucuucucaaguucua

SEQ ID NO: 1001734 - RNA, 15 nt, Homo sapiens
aucuucugccuuagu

SEQ ID NO: 1001735 - RNA, 22 nt, Homo sapiens
aucuugaaauuaagaaggcaaa

SEQ ID NO: 1001736 - RNA, 13 nt, Homo sapiens
aucuugcauguaa

SEQ ID NO: 1001737 - RNA, 14 nt, Homo sapiens
aucuugcauguaac

SEQ ID NO: 1001738 - RNA, 20 nt, Homo sapiens
aucuugcuucugcuucucau

SEQ ID NO: 1001739 - RNA, 21 nt, Homo sapiens
aucuuuacaaaacuacaugag

SEQ ID NO: 1001740 - RNA, 17 nt, Homo sapiens
aucuuuagagaaguaua

SEQ ID NO: 1001741 - RNA, 19 nt, Homo sapiens
aucuuucucuuacaaucug

SEQ ID NO: 1001742 - RNA, 18 nt, Homo sapiens
augaaaaaaaaaugggaa

SEQ ID NO: 1001743 - RNA, 21 nt, Homo sapiens
augaacaucuuuagugucuga

SEQ ID NO: 1001744 - RNA, 19 nt, Homo sapiens
augaaccuacuacccaggu

SEQ ID NO: 1001745 - RNA, 15 nt, Homo sapiens
augaacucuuaauca

SEQ ID NO: 1001746 - RNA, 20 nt, Homo sapiens
augaaucugcacaucuguaa

SEQ ID NO: 1001747 - RNA, 14 nt, Homo sapiens
augaauguaaauuu

SEQ ID NO: 1001748 - RNA, 17 nt, Homo sapiens
augaauuauuacagugu

SEQ ID NO: 1001749 - RNA, 13 nt, Homo sapiens
augaauuauucaa

SEQ ID NO: 1001750 - RNA, 20 nt, Homo sapiens
augacaacuucuaauugcca

SEQ ID NO: 1001751 - RNA, 15 nt, Homo sapiens
augacgucaucauca

SEQ ID NO: 1001752 - RNA, 21 nt, Homo sapiens
augacgucaucaucacauuca

SEQ ID NO: 1001753 - RNA, 22 nt, Homo sapiens
augacugcuugcccuaagcaga

SEQ ID NO: 1001754 - RNA, 17 nt, Homo sapiens
augacuggucucuggcu

SEQ ID NO: 1001755 - RNA, 17 nt, Homo sapiens
augagaccacuguuauc

SEQ ID NO: 1001756 - RNA, 17 nt, Homo sapiens
augagcucccacaagcc

SEQ ID NO: 1001757 - RNA, 16 nt, Homo sapiens
augaguaacauuugcu

SEQ ID NO: 1001758 - RNA, 13 nt, Homo sapiens
augagucagucaa

SEQ ID NO: 1001759 - RNA, 13 nt, Homo sapiens
augagugcuuaaa

SEQ ID NO: 1001760 - RNA, 14 nt, Homo sapiens
augagugcuuaaac

SEQ ID NO: 1001761 - RNA, 16 nt, Homo sapiens
augaguugaggccacu

SEQ ID NO: 1001762 - RNA, 13 nt, Homo sapiens
augauacauccaa

SEQ ID NO: 1001763 - RNA, 17 nt, Homo sapiens
augauaucuucaagccu

SEQ ID NO: 1001764 - RNA, 18 nt, Homo sapiens
augaugagguaguaccuu

SEQ ID NO: 1001765 - RNA, 14 nt, Homo sapiens
augauggaugccaa

SEQ ID NO: 1001766 - RNA, 16 nt, Homo sapiens
augauggcaacagauc

SEQ ID NO: 1001767 - RNA, 19 nt, Homo sapiens
augauuuagugaucaaauu

SEQ ID NO: 1001768 - RNA, 17 nt, Homo sapiens
augauuucagcagggau

SEQ ID NO: 1001769 - RNA, 14 nt, Homo sapiens
augcaaaagcacau

SEQ ID NO: 1001770 - RNA, 14 nt, Homo sapiens
augcaaagaugaac

SEQ ID NO: 1001771 - RNA, 17 nt, Homo sapiens
augcauacaaguuucau

SEQ ID NO: 1001772 - RNA, 22 nt, Homo sapiens
augcauggugccccaggaccag

SEQ ID NO: 1001773 - RNA, 23 nt, Homo sapiens
augcauggugccccaggaccagc

SEQ ID NO: 1001774 - RNA, 14 nt, Homo sapiens
augccagcuacuuc

SEQ ID NO: 1001775 - RNA, 21 nt, Homo sapiens
augccugacuagggagccaug

SEQ ID NO: 1001776 - RNA, 17 nt, Homo sapiens
augcucuuaauugccac

SEQ ID NO: 1001777 - RNA, 22 nt, Homo sapiens
augcuggaaaauaauacugcug

SEQ ID NO: 1001778 - RNA, 19 nt, Homo sapiens
augcuuguugcaauugccu

SEQ ID NO: 1001779 - RNA, 16 nt, Homo sapiens
auggaacacggccaca

SEQ ID NO: 1001780 - RNA, 18 nt, Homo sapiens
auggaauuuugcaaagau

SEQ ID NO: 1001781 - RNA, 22 nt, Homo sapiens
auggacguuauccucucagauu

SEQ ID NO: 1001782 - RNA, 17 nt, Homo sapiens
auggaugggggaacuca

SEQ ID NO: 1001783 - RNA, 18 nt, Homo sapiens
auggaugggggaacucag

SEQ ID NO: 1001784 - RNA, 19 nt, Homo sapiens
auggaugggggaacucaga

SEQ ID NO: 1001785 - RNA, 18 nt, Homo sapiens
auggcauaaccugucuca

SEQ ID NO: 1001786 - RNA, 17 nt, Homo sapiens
auggcccugggucccag

SEQ ID NO: 1001787 - RNA, 16 nt, Homo sapiens
auggccuucauaucau

SEQ ID NO: 1001788 - RNA, 18 nt, Homo sapiens
auggcguaaguacagaga

SEQ ID NO: 1001789 - RNA, 20 nt, Homo sapiens
augggcaaauuaaggcauaa

SEQ ID NO: 1001790 - RNA, 16 nt, Homo sapiens
augggccccaggggaa

SEQ ID NO: 1001791 - RNA, 19 nt, Homo sapiens
auggggaagguuaucagug

SEQ ID NO: 1001792 - RNA, 15 nt, Homo sapiens
auggggugcaccugu

SEQ ID NO: 1001793 - RNA, 16 nt, Homo sapiens
augguuucagcacuag

SEQ ID NO: 1001794 - RNA, 14 nt, Homo sapiens
auguaaacugugca

SEQ ID NO: 1001795 - RNA, 15 nt, Homo sapiens
auguaaacugugcac

SEQ ID NO: 1001796 - RNA, 16 nt, Homo sapiens
auguaaacugugcacc

SEQ ID NO: 1001797 - RNA, 18 nt, Homo sapiens
auguacaugaagaagcua

SEQ ID NO: 1001798 - RNA, 20 nt, Homo sapiens
auguagacuuuugcuuuaug

SEQ ID NO: 1001799 - RNA, 21 nt, Homo sapiens
auguaguuuuuauauguugua

SEQ ID NO: 1001800 - RNA, 16 nt, Homo sapiens
augucaacagaaggga

SEQ ID NO: 1001801 - RNA, 19 nt, Homo sapiens
augucaacagaagggauac

SEQ ID NO: 1001802 - RNA, 19 nt, Homo sapiens
augucuccuaagcaccugu

SEQ ID NO: 1001803 - RNA, 14 nt, Homo sapiens
augugaaaagaaua

SEQ ID NO: 1001804 - RNA, 21 nt, Homo sapiens
augugaagccaauucagacag

SEQ ID NO: 1001805 - RNA, 13 nt, Homo sapiens
augugacaguggc

SEQ ID NO: 1001806 - RNA, 22 nt, Homo sapiens
augugauucaccucuucuuucc

SEQ ID NO: 1001807 - RNA, 22 nt, Homo sapiens
augugcgcgcgugcaugugugc

SEQ ID NO: 1001808 - RNA, 13 nt, Homo sapiens
augugcuggucac

SEQ ID NO: 1001809 - RNA, 15 nt, Homo sapiens
auguggaacugcugc

SEQ ID NO: 1001810 - RNA, 17 nt, Homo sapiens
auguggccugcauguac

SEQ ID NO: 1001811 - RNA, 13 nt, Homo sapiens
auguggucaugga

SEQ ID NO: 1001812 - RNA, 13 nt, Homo sapiens
auguguuguucca

SEQ ID NO: 1001813 - RNA, 13 nt, Homo sapiens
auguguuuauuuc

SEQ ID NO: 1001814 - RNA, 23 nt, Homo sapiens
auguuaaaucaauaaagaccacu

SEQ ID NO: 1001815 - RNA, 13 nt, Homo sapiens
auguuaacacuca

SEQ ID NO: 1001816 - RNA, 21 nt, Homo sapiens
auguuacaauuaaaaugacaa

SEQ ID NO: 1001817 - RNA, 17 nt, Homo sapiens
auguucccccuguuuca

SEQ ID NO: 1001818 - RNA, 15 nt, Homo sapiens
auguucuaaggcucu

SEQ ID NO: 1001819 - RNA, 16 nt, Homo sapiens
auguucuaaguuucua

SEQ ID NO: 1001820 - RNA, 15 nt, Homo sapiens
auguucucagauuuc

SEQ ID NO: 1001821 - RNA, 18 nt, Homo sapiens
auguuuuuugccacagcu

SEQ ID NO: 1001822 - RNA, 21 nt, Homo sapiens
auuaaccagauauauauucau

SEQ ID NO: 1001823 - RNA, 15 nt, Homo sapiens
auuaagcaucagaaa

SEQ ID NO: 1001824 - RNA, 17 nt, Homo sapiens
auuaaguacaugugcca

SEQ ID NO: 1001825 - RNA, 15 nt, Homo sapiens
auuaaugcacuuucu

SEQ ID NO: 1001826 - RNA, 17 nt, Homo sapiens
auuacuauaagaacuuu

SEQ ID NO: 1001827 - RNA, 21 nt, Homo sapiens
auuacuggccuuuuucauuua

SEQ ID NO: 1001828 - RNA, 23 nt, Homo sapiens
auuacuuuugauccugggggacc

SEQ ID NO: 1001829 - RNA, 17 nt, Homo sapiens
auuagacagaacaccua

SEQ ID NO: 1001830 - RNA, 16 nt, Homo sapiens
auuagaugaacucaac

SEQ ID NO: 1001831 - RNA, 18 nt, Homo sapiens
auuaggcuguaacuacuu

SEQ ID NO: 1001832 - RNA, 13 nt, Homo sapiens
auuaggugcaauu

SEQ ID NO: 1001833 - RNA, 19 nt, Homo sapiens
auuauaaaugacaaccuga

SEQ ID NO: 1001834 - RNA, 23 nt, Homo sapiens
auuauacgcuggcaacacagagg

SEQ ID NO: 1001835 - RNA, 15 nt, Homo sapiens
auuauauaacuguau

SEQ ID NO: 1001836 - RNA, 16 nt, Homo sapiens
auuaucaacagcauuu

SEQ ID NO: 1001837 - RNA, 19 nt, Homo sapiens
auuauggggacuuugguuu

SEQ ID NO: 1001838 - RNA, 20 nt, Homo sapiens
auuauuaaugaaaauaagaa

SEQ ID NO: 1001839 - RNA, 18 nt, Homo sapiens
auuauuauucuucauaac

SEQ ID NO: 1001840 - RNA, 15 nt, Homo sapiens
auucacccagaggga

SEQ ID NO: 1001841 - RNA, 14 nt, Homo sapiens
auucaggacuugaa

SEQ ID NO: 1001842 - RNA, 15 nt, Homo sapiens
auucauuguggucau

SEQ ID NO: 1001843 - RNA, 13 nt, Homo sapiens
auuccaaagucuc

SEQ ID NO: 1001844 - RNA, 21 nt, Homo sapiens
auuccugauggaaaaugcaaa

SEQ ID NO: 1001845 - RNA, 18 nt, Homo sapiens
auuccuguuugucuacau

SEQ ID NO: 1001846 - RNA, 15 nt, Homo sapiens
auuccuugguaauau

SEQ ID NO: 1001847 - RNA, 15 nt, Homo sapiens
auucggauuugccau

SEQ ID NO: 1001848 - RNA, 19 nt, Homo sapiens
auucuacuaugcauuaaau

SEQ ID NO: 1001849 - RNA, 19 nt, Homo sapiens
auucucugucucauccauc

SEQ ID NO: 1001850 - RNA, 23 nt, Homo sapiens
auucugcaguaaaucuuuuacaa

SEQ ID NO: 1001851 - RNA, 20 nt, Homo sapiens
auucugccuuugccagguga

SEQ ID NO: 1001852 - RNA, 21 nt, Homo sapiens
auucugccuuugccaggugac

SEQ ID NO: 1001853 - RNA, 17 nt, Homo sapiens
auucuggaccucugggu

SEQ ID NO: 1001854 - RNA, 15 nt, Homo sapiens
auucuuagugacuuu

SEQ ID NO: 1001855 - RNA, 22 nt, Homo sapiens
auugacacagaaaauguugaga

SEQ ID NO: 1001856 - RNA, 19 nt, Homo sapiens
auugacgacaagugcugaa

SEQ ID NO: 1001857 - RNA, 20 nt, Homo sapiens
auugacuaacaggccaaaga

SEQ ID NO: 1001858 - RNA, 18 nt, Homo sapiens
auugacucuguggcuuug

SEQ ID NO: 1001859 - RNA, 15 nt, Homo sapiens
auugagcucucucau

SEQ ID NO: 1001860 - RNA, 16 nt, Homo sapiens
auugaguuuucagugg

SEQ ID NO: 1001861 - RNA, 18 nt, Homo sapiens
auugauagaguguuauca

SEQ ID NO: 1001862 - RNA, 15 nt, Homo sapiens
auugaugagcaagac

SEQ ID NO: 1001863 - RNA, 20 nt, Homo sapiens
auugcacuuggccucaugcu

SEQ ID NO: 1001864 - RNA, 13 nt, Homo sapiens
auugcuguuucag

SEQ ID NO: 1001865 - RNA, 20 nt, Homo sapiens
auugcuuacaagccuaagaa

SEQ ID NO: 1001866 - RNA, 22 nt, Homo sapiens
auuggauuuccuaauacuguca

SEQ ID NO: 1001867 - RNA, 20 nt, Homo sapiens
auuggcaccuaauccaggca

SEQ ID NO: 1001868 - RNA, 21 nt, Homo sapiens
auuggcaccuaauccaggcag

SEQ ID NO: 1001869 - RNA, 16 nt, Homo sapiens
auuguacuaaagccaa

SEQ ID NO: 1001870 - RNA, 20 nt, Homo sapiens
auuguaucaaaugugacauu

SEQ ID NO: 1001871 - RNA, 20 nt, Homo sapiens
auugucgguuaccucugcau

SEQ ID NO: 1001872 - RNA, 15 nt, Homo sapiens
auugugagccaccac

SEQ ID NO: 1001873 - RNA, 20 nt, Homo sapiens
auugugauuagacagaacac

SEQ ID NO: 1001874 - RNA, 20 nt, Homo sapiens
auuguuacauuauguggaaa

SEQ ID NO: 1001875 - RNA, 22 nt, Homo sapiens
auuguucagcaugcaauacaua

SEQ ID NO: 1001876 - RNA, 22 nt, Homo sapiens
auuguuguucuguuaacugaau

SEQ ID NO: 1001877 - RNA, 19 nt, Homo sapiens
auuuaaaacguuuugguca

SEQ ID NO: 1001878 - RNA, 15 nt, Homo sapiens
auuuaaagccuccuc

SEQ ID NO: 1001879 - RNA, 15 nt, Homo sapiens
auuuaacauuaucua

SEQ ID NO: 1001880 - RNA, 14 nt, Homo sapiens
auuuaagaucacag

SEQ ID NO: 1001881 - RNA, 22 nt, Homo sapiens
auuuacaggaacuucaucauaa

SEQ ID NO: 1001882 - RNA, 23 nt, Homo sapiens
auuuagaagccaacuaugauuau

SEQ ID NO: 1001883 - RNA, 21 nt, Homo sapiens
auuuagcuaaacggauuccaa

SEQ ID NO: 1001884 - RNA, 15 nt, Homo sapiens
auuuagucaugugac

SEQ ID NO: 1001885 - RNA, 23 nt, Homo sapiens
auuuauauaaaauguuuaaucuc

SEQ ID NO: 1001886 - RNA, 15 nt, Homo sapiens
auuuaugucccugac

SEQ ID NO: 1001887 - RNA, 21 nt, Homo sapiens
auuuaugucccugacuguaaa

SEQ ID NO: 1001888 - RNA, 22 nt, Homo sapiens
auuuauugguuuugcagaagaa

SEQ ID NO: 1001889 - RNA, 14 nt, Homo sapiens
auuucacuggagca

SEQ ID NO: 1001890 - RNA, 16 nt, Homo sapiens
auuucacuggagcaca

SEQ ID NO: 1001891 - RNA, 19 nt, Homo sapiens
auuucaggaggaauacuga

SEQ ID NO: 1001892 - RNA, 13 nt, Homo sapiens
auuucauacugua

SEQ ID NO: 1001893 - RNA, 14 nt, Homo sapiens
auuucauacuguaa

SEQ ID NO: 1001894 - RNA, 12 nt, Homo sapiens
auuucccaggac

SEQ ID NO: 1001895 - RNA, 17 nt, Homo sapiens
auuucucuuugucagaa

SEQ ID NO: 1001896 - RNA, 20 nt, Homo sapiens
auuucugaggugcacuggga

SEQ ID NO: 1001897 - RNA, 23 nt, Homo sapiens
auuucugguuguuaugugaucau

SEQ ID NO: 1001898 - RNA, 22 nt, Homo sapiens
auuucuguuauggggacuuuau

SEQ ID NO: 1001899 - RNA, 15 nt, Homo sapiens
auuucuuaacuucuu

SEQ ID NO: 1001900 - RNA, 14 nt, Homo sapiens
auuucuucaaauaa

SEQ ID NO: 1001901 - RNA, 18 nt, Homo sapiens
auuugacauacaaaaagg

SEQ ID NO: 1001902 - RNA, 21 nt, Homo sapiens
auuugauacauuuuuguacua

SEQ ID NO: 1001903 - RNA, 16 nt, Homo sapiens
auuugcauuaaauuca

SEQ ID NO: 1001904 - RNA, 20 nt, Homo sapiens
auuuggguucugccugccag

SEQ ID NO: 1001905 - RNA, 16 nt, Homo sapiens
auuuguaaaucugcca

SEQ ID NO: 1001906 - RNA, 15 nt, Homo sapiens
auuugugccacuuua

SEQ ID NO: 1001907 - RNA, 18 nt, Homo sapiens
auuuuagugaacuugaaa

SEQ ID NO: 1001908 - RNA, 23 nt, Homo sapiens
auuuucaaaaccagguccaauga

SEQ ID NO: 1001909 - RNA, 13 nt, Homo sapiens
auuuuccuguccu

SEQ ID NO: 1001910 - RNA, 21 nt, Homo sapiens
auuuuccuguugucaagaaua

SEQ ID NO: 1001911 - RNA, 21 nt, Homo sapiens
auuuucuuacacugugucauu

SEQ ID NO: 1001912 - RNA, 16 nt, Homo sapiens
auuuucuucucugcac

SEQ ID NO: 1001913 - RNA, 20 nt, Homo sapiens
auuuucuucucugcacuuau

SEQ ID NO: 1001914 - RNA, 21 nt, Homo sapiens
auuuugggagugacucaagaa

SEQ ID NO: 1001915 - RNA, 16 nt, Homo sapiens
auuuuguaaaaguggc

SEQ ID NO: 1001916 - RNA, 21 nt, Homo sapiens
auuuuguagaauaaggaacaa

SEQ ID NO: 1001917 - RNA, 21 nt, Homo sapiens
auuuuuauaaaaaugagugcu

SEQ ID NO: 1001918 - RNA, 22 nt, Homo sapiens
auuuuuauaaaaaugagugcuu

SEQ ID NO: 1001919 - RNA, 13 nt, Homo sapiens
auuuuucuaacua

SEQ ID NO: 1001920 - RNA, 20 nt, Homo sapiens
auuuuucuguaacugucacc

SEQ ID NO: 1001921 - RNA, 20 nt, Homo sapiens
auuuuucuuagugugccaag

SEQ ID NO: 1001922 - RNA, 14 nt, Homo sapiens
auuuuugugcacau

SEQ ID NO: 1001923 - RNA, 14 nt, Homo sapiens
auuuuuucccccac

SEQ ID NO: 1001924 - RNA, 13 nt, Homo sapiens
caaaaacuuugga

SEQ ID NO: 1001925 - RNA, 18 nt, Homo sapiens
caaaaagccacaaugaac

SEQ ID NO: 1001926 - RNA, 17 nt, Homo sapiens
caaaaccaagucacuua

SEQ ID NO: 1001927 - RNA, 15 nt, Homo sapiens
caaaacugcauuuca

SEQ ID NO: 1001928 - RNA, 12 nt, Homo sapiens
caaaacugccuc

SEQ ID NO: 1001929 - RNA, 15 nt, Homo sapiens
caaaagcacauauau

SEQ ID NO: 1001930 - RNA, 20 nt, Homo sapiens
caaaagcgaaacacacaaac

SEQ ID NO: 1001931 - RNA, 15 nt, Homo sapiens
caaaaggacucucag

SEQ ID NO: 1001932 - RNA, 21 nt, Homo sapiens
caaaauauauuuuguuuacaa

SEQ ID NO: 1001933 - RNA, 21 nt, Homo sapiens
caaaaucucuccacuuucagc

SEQ ID NO: 1001934 - RNA, 22 nt, Homo sapiens
caaacaaagaugccacauucaa

SEQ ID NO: 1001935 - RNA, 14 nt, Homo sapiens
caaacaaccugccc

SEQ ID NO: 1001936 - RNA, 18 nt, Homo sapiens
caaacagaccccuguuca

SEQ ID NO: 1001937 - RNA, 13 nt, Homo sapiens
caaacccauuccc

SEQ ID NO: 1001938 - RNA, 18 nt, Homo sapiens
caaacucuaaaauuauaa

SEQ ID NO: 1001939 - RNA, 19 nt, Homo sapiens
caaacucuucccucucuca

SEQ ID NO: 1001940 - RNA, 11 nt, Homo sapiens
caaacugaaga

SEQ ID NO: 1001941 - RNA, 20 nt, Homo sapiens
caaacugaauggcaaugaaa

SEQ ID NO: 1001942 - RNA, 23 nt, Homo sapiens
caaacugcuuuuuccaacucaga

SEQ ID NO: 1001943 - RNA, 22 nt, Homo sapiens
caaacuuggauacuuggauuua

SEQ ID NO: 1001944 - RNA, 16 nt, Homo sapiens
caaacuuuuauacucu

SEQ ID NO: 1001945 - RNA, 14 nt, Homo sapiens
caaagaacaagauc

SEQ ID NO: 1001946 - RNA, 23 nt, Homo sapiens
caaagauguuaugguguuuagau

SEQ ID NO: 1001947 - RNA, 23 nt, Homo sapiens
caaagcagccacgaggugcaaca

SEQ ID NO: 1001948 - RNA, 20 nt, Homo sapiens
caaagcauaggaaggcucua

SEQ ID NO: 1001949 - RNA, 12 nt, Homo sapiens
caaagccaagca

SEQ ID NO: 1001950 - RNA, 16 nt, Homo sapiens
caaagccaagcaaaau

SEQ ID NO: 1001951 - RNA, 22 nt, Homo sapiens
caaagcuuucauguaaacugug

SEQ ID NO: 1001952 - RNA, 14 nt, Homo sapiens
caaaggaugugaua

SEQ ID NO: 1001953 - RNA, 21 nt, Homo sapiens
caaaggaugugauauauaagu

SEQ ID NO: 1001954 - RNA, 20 nt, Homo sapiens
caaaggcaagcguauaucaa

SEQ ID NO: 1001955 - RNA, 23 nt, Homo sapiens
caaaggccuaauucuaugccugu

SEQ ID NO: 1001956 - RNA, 19 nt, Homo sapiens
caaagucauaauugcauug

SEQ ID NO: 1001957 - RNA, 18 nt, Homo sapiens
caaaguccuuuuuuucca

SEQ ID NO: 1001958 - RNA, 14 nt, Homo sapiens
caaauaaaaauccu

SEQ ID NO: 1001959 - RNA, 17 nt, Homo sapiens
caaaucauuuguuuaaa

SEQ ID NO: 1001960 - RNA, 15 nt, Homo sapiens
caaaucgugccuugu

SEQ ID NO: 1001961 - RNA, 21 nt, Homo sapiens
caaaucuugguugaugccaaa

SEQ ID NO: 1001962 - RNA, 16 nt, Homo sapiens
caaaugaaaaauucca

SEQ ID NO: 1001963 - RNA, 13 nt, Homo sapiens
caaaugcaauuuu

SEQ ID NO: 1001964 - RNA, 14 nt, Homo sapiens
caaauggccucaug

SEQ ID NO: 1001965 - RNA, 13 nt, Homo sapiens
caaauggggccag

SEQ ID NO: 1001966 - RNA, 17 nt, Homo sapiens
caaauggggccagaucc

SEQ ID NO: 1001967 - RNA, 13 nt, Homo sapiens
caaauguauuuca

SEQ ID NO: 1001968 - RNA, 15 nt, Homo sapiens
caaaugucaugcugc

SEQ ID NO: 1001969 - RNA, 12 nt, Homo sapiens
caacaaucuucc

SEQ ID NO: 1001970 - RNA, 18 nt, Homo sapiens
caacaguuacauaauuca

SEQ ID NO: 1001971 - RNA, 15 nt, Homo sapiens
caacaugcacugaug

SEQ ID NO: 1001972 - RNA, 15 nt, Homo sapiens
caacauucauagucu

SEQ ID NO: 1001973 - RNA, 18 nt, Homo sapiens
caaccaauggaaugugau

SEQ ID NO: 1001974 - RNA, 19 nt, Homo sapiens
caaccaauggaaugugaug

SEQ ID NO: 1001975 - RNA, 15 nt, Homo sapiens
caaccaugucauuuc

SEQ ID NO: 1001976 - RNA, 13 nt, Homo sapiens
caaccccaggcug

SEQ ID NO: 1001977 - RNA, 23 nt, Homo sapiens
caacccgagucauucguucugug

SEQ ID NO: 1001978 - RNA, 20 nt, Homo sapiens
cugugcauacuuucccucau

SEQ ID NO: 1001979 - RNA, 22 nt, Homo sapiens
cugugccccagcagugccuugu

SEQ ID NO: 1001980 - RNA, 22 nt, Homo sapiens
cugugccccuugacaacuggca

SEQ ID NO: 1001981 - RNA, 23 nt, Homo sapiens
cugugccucgcuccccacucugc

SEQ ID NO: 1001982 - RNA, 15 nt, Homo sapiens
cuguggccaugaccc

SEQ ID NO: 1001983 - RNA, 17 nt, Homo sapiens
cuguggucuacccgugu

SEQ ID NO: 1001984 - RNA, 15 nt, Homo sapiens
cuguguagcugugac

SEQ ID NO: 1001985 - RNA, 22 nt, Homo sapiens
cugugucauucuguuagauacu

SEQ ID NO: 1001986 - RNA, 22 nt, Homo sapiens
cuguguccucuuccaccacaga

SEQ ID NO: 1001987 - RNA, 22 nt, Homo sapiens
cuguguguuaagcucugcuauu

SEQ ID NO: 1001988 - RNA, 14 nt, Homo sapiens
cuguguuaugcaaa

SEQ ID NO: 1001989 - RNA, 15 nt, Homo sapiens
cuguguuuccaucuc

SEQ ID NO: 1001990 - RNA, 13 nt, Homo sapiens
cuguuaacugaau

SEQ ID NO: 1001991 - RNA, 16 nt, Homo sapiens
cuguuagucauuugcu

SEQ ID NO: 1001992 - RNA, 14 nt, Homo sapiens
cuguucuccagugu

SEQ ID NO: 1001993 - RNA, 13 nt, Homo sapiens
cuguucuuagcuc

SEQ ID NO: 1001994 - RNA, 23 nt, Homo sapiens
cuguuggcguggggccuuuguca

SEQ ID NO: 1001995 - RNA, 16 nt, Homo sapiens
cuguuuaaaaaaccac

SEQ ID NO: 1001996 - RNA, 19 nt, Homo sapiens
cuguuuuccccccaaggga

SEQ ID NO: 1001997 - RNA, 21 nt, Homo sapiens
cuguuuuuucagucugugaaa

SEQ ID NO: 1001998 - RNA, 18 nt, Homo sapiens
cuuaaaaaaauaugccuu

SEQ ID NO: 1001999 - RNA, 16 nt, Homo sapiens
cuuaaaaaguuauaac

SEQ ID NO: 1002000 - RNA, 20 nt, Homo sapiens
cuuaaaaauuaaauuggaaa

SEQ ID NO: 1002001 - RNA, 20 nt, Homo sapiens
cuuaaaccuuaagauacuaa

SEQ ID NO: 1002002 - RNA, 16 nt, Homo sapiens
cuuaagcccagugcac

SEQ ID NO: 1002003 - RNA, 19 nt, Homo sapiens
cuuaagcccagugcacuga

SEQ ID NO: 1002004 - RNA, 14 nt, Homo sapiens
cuuaauacuaagga

SEQ ID NO: 1002005 - RNA, 14 nt, Homo sapiens
cuuaaugcucugau

SEQ ID NO: 1002006 - RNA, 17 nt, Homo sapiens
cuuaccaggcaccaaaa

SEQ ID NO: 1002007 - RNA, 20 nt, Homo sapiens
cuuacugcuugguccuugau

SEQ ID NO: 1002008 - RNA, 16 nt, Homo sapiens
cuuacuuaaacccagc

SEQ ID NO: 1002009 - RNA, 19 nt, Homo sapiens
cuuagauguuccaguaauc

SEQ ID NO: 1002010 - RNA, 17 nt, Homo sapiens
cuuagcagcuuccagau

SEQ ID NO: 1002011 - RNA, 21 nt, Homo sapiens
cuuagcuaguuuuauucuugg

SEQ ID NO: 1002012 - RNA, 14 nt, Homo sapiens
cuuaguuuccacag

SEQ ID NO: 1002013 - RNA, 18 nt, Homo sapiens
cuuaucaacuaaugauuu

SEQ ID NO: 1002014 - RNA, 22 nt, Homo sapiens
cuuaugauagcaaauggccuca

SEQ ID NO: 1002015 - RNA, 20 nt, Homo sapiens
cuuaugcucuuaauugccac

SEQ ID NO: 1002016 - RNA, 18 nt, Homo sapiens
cuuauggaauugauuugc

SEQ ID NO: 1002017 - RNA, 23 nt, Homo sapiens
cuuauggauguccccagcagaga

SEQ ID NO: 1002018 - RNA, 14 nt, Homo sapiens
cuuauuccaugacu

SEQ ID NO: 1002019 - RNA, 23 nt, Homo sapiens
cuuauuuaagaucacagugaacu

SEQ ID NO: 1002020 - RNA, 21 nt, Homo sapiens
cuucaagacgacagcucugua

SEQ ID NO: 1002021 - RNA, 14 nt, Homo sapiens
cuucagagagcagu

SEQ ID NO: 1002022 - RNA, 13 nt, Homo sapiens
cuucagccauagu

SEQ ID NO: 1002023 - RNA, 21 nt, Homo sapiens
cuucaggaucaaguccuaguu

SEQ ID NO: 1002024 - RNA, 17 nt, Homo sapiens
cuucaguuucacagaaa

SEQ ID NO: 1002025 - RNA, 14 nt, Homo sapiens
cuucauccaugucc

SEQ ID NO: 1002026 - RNA, 15 nt, Homo sapiens
cuucaucccaaagga

SEQ ID NO: 1002027 - RNA, 17 nt, Homo sapiens
cuucauuuaacaaguaa

SEQ ID NO: 1002028 - RNA, 11 nt, Homo sapiens
cuucauuucau

SEQ ID NO: 1002029 - RNA, 19 nt, Homo sapiens
cuucauuucaucuaccauu

SEQ ID NO: 1002030 - RNA, 18 nt, Homo sapiens
cuuccacucgaugaugcu

SEQ ID NO: 1002031 - RNA, 18 nt, Homo sapiens
cuuccagauugacgacaa

SEQ ID NO: 1002032 - RNA, 16 nt, Homo sapiens
cuuccaguuugcuuug

SEQ ID NO: 1002033 - RNA, 16 nt, Homo sapiens
cuucccaauccagugg

SEQ ID NO: 1002034 - RNA, 16 nt, Homo sapiens
cuuccccaucuucuaa

SEQ ID NO: 1002035 - RNA, 22 nt, Homo sapiens
cuucccucucugcagacuuccc

SEQ ID NO: 1002036 - RNA, 15 nt, Homo sapiens
cuucccugugccucc

SEQ ID NO: 1002037 - RNA, 20 nt, Homo sapiens
cuuccucccuauuaaccuag

SEQ ID NO: 1002038 - RNA, 19 nt, Homo sapiens
cuuccugaguggugccaaa

SEQ ID NO: 1002039 - RNA, 18 nt, Homo sapiens
cuuccuggacagcugugc

SEQ ID NO: 1002040 - RNA, 18 nt, Homo sapiens
cuucuaggucacuucuca

SEQ ID NO: 1002041 - RNA, 19 nt, Homo sapiens
cuucucaaauuagcugcaa

SEQ ID NO: 1002042 - RNA, 17 nt, Homo sapiens
cuucucaaguucuaaga

SEQ ID NO: 1002043 - RNA, 18 nt, Homo sapiens
cuucuccauccacauggg

SEQ ID NO: 1002044 - RNA, 12 nt, Homo sapiens
cuucuccaucuc

SEQ ID NO: 1002045 - RNA, 17 nt, Homo sapiens
cuucucccacucuccua

SEQ ID NO: 1002046 - RNA, 17 nt, Homo sapiens
cuucuccccagcuccca

SEQ ID NO: 1002047 - RNA, 21 nt, Homo sapiens
cuucuccccugcacuguaaaa

SEQ ID NO: 1002048 - RNA, 13 nt, Homo sapiens
cuucugcuucuca

SEQ ID NO: 1002049 - RNA, 18 nt, Homo sapiens
cuucugcuuucucgggaa

SEQ ID NO: 1002050 - RNA, 19 nt, Homo sapiens
gacucuuuaugcuugcaaa

SEQ ID NO: 1002051 - RNA, 22 nt, Homo sapiens
gacugaugucuccuaagcaccu

SEQ ID NO: 1002052 - RNA, 23 nt, Homo sapiens
gacugaugucuccuaagcaccug

SEQ ID NO: 1002053 - RNA, 17 nt, Homo sapiens
gacuggauguaccacca

SEQ ID NO: 1002054 - RNA, 19 nt, Homo sapiens
gacuggccucaaagcaagc

SEQ ID NO: 1002055 - RNA, 16 nt, Homo sapiens
gacuguaaaugcucca

SEQ ID NO: 1002056 - RNA, 22 nt, Homo sapiens
gacuguaaguugggcuugcuau

SEQ ID NO: 1002057 - RNA, 17 nt, Homo sapiens
gacugugguagccagca

SEQ ID NO: 1002058 - RNA, 18 nt, Homo sapiens
gacuuauuuaaacucugu

SEQ ID NO: 1002059 - RNA, 11 nt, Homo sapiens
gacuucauccc

SEQ ID NO: 1002060 - RNA, 19 nt, Homo sapiens
gacuuccauuugcuuuguc

SEQ ID NO: 1002061 - RNA, 21 nt, Homo sapiens
gacuucuugcuggucuaguca

SEQ ID NO: 1002062 - RNA, 18 nt, Homo sapiens
gacuuggauucuuuccau

SEQ ID NO: 1002063 - RNA, 17 nt, Homo sapiens
gacuuuauguugaaaua

SEQ ID NO: 1002064 - RNA, 18 nt, Homo sapiens
gacuuuccccaccagaug

SEQ ID NO: 1002065 - RNA, 17 nt, Homo sapiens
gacuuugguuugaccca

SEQ ID NO: 1002066 - RNA, 15 nt, Homo sapiens
gagaaaacaauuccu

SEQ ID NO: 1002067 - RNA, 12 nt, Homo sapiens
gagaaaacaugc

SEQ ID NO: 1002068 - RNA, 13 nt, Homo sapiens
gagaaaucuggcu

SEQ ID NO: 1002069 - RNA, 16 nt, Homo sapiens
gagaacaaugugcuau

SEQ ID NO: 1002070 - RNA, 19 nt, Homo sapiens
gagaacaccagagaccuca

SEQ ID NO: 1002071 - RNA, 16 nt, Homo sapiens
gagaaccaacaaguaa

SEQ ID NO: 1002072 - RNA, 12 nt, Homo sapiens
gagaaccaggcu

SEQ ID NO: 1002073 - RNA, 18 nt, Homo sapiens
gagaagcuccucucccca

SEQ ID NO: 1002074 - RNA, 13 nt, Homo sapiens
gagaagggcugcu

SEQ ID NO: 1002075 - RNA, 19 nt, Homo sapiens
gagaaucaacauuucucaa

SEQ ID NO: 1002076 - RNA, 19 nt, Homo sapiens
gagaauggcuuuggucucu

SEQ ID NO: 1002077 - RNA, 12 nt, Homo sapiens
gagacacagccc

SEQ ID NO: 1002078 - RNA, 14 nt, Homo sapiens
gagacauacuugaa

SEQ ID NO: 1002079 - RNA, 13 nt, Homo sapiens
gagacaugugaca

SEQ ID NO: 1002080 - RNA, 17 nt, Homo sapiens
gagaccucuacugccuu

SEQ ID NO: 1002081 - RNA, 19 nt, Homo sapiens
gagacugugugugcccucu

SEQ ID NO: 1002082 - RNA, 17 nt, Homo sapiens
aggagugugaccacuga

SEQ ID NO: 1002083 - RNA, 18 nt, Homo sapiens
aggagugugaccacugaa

SEQ ID NO: 1002084 - RNA, 18 nt, Homo sapiens
aggauaaccuugugccuu

SEQ ID NO: 1002085 - RNA, 20 nt, Homo sapiens
aggauaaccuugugccuugg

SEQ ID NO: 1002086 - RNA, 14 nt, Homo sapiens
aggauagaugcugg

SEQ ID NO: 1002087 - RNA, 20 nt, Homo sapiens
aggaugucugagaccacuug

SEQ ID NO: 1002088 - RNA, 11 nt, Homo sapiens
aggaugugaua

SEQ ID NO: 1002089 - RNA, 12 nt, Homo sapiens
aggaugugauau

SEQ ID NO: 1002090 - RNA, 19 nt, Homo sapiens
aggaugugauuguggaaug

SEQ ID NO: 1002091 - RNA, 15 nt, Homo sapiens
aggauuucaugauuu

SEQ ID NO: 1002092 - RNA, 14 nt, Homo sapiens
aggcaaaauugcaa

SEQ ID NO: 1002093 - RNA, 13 nt, Homo sapiens
aggcaaugggagc

SEQ ID NO: 1002094 - RNA, 15 nt, Homo sapiens
aggcacacuuugcac

SEQ ID NO: 1002095 - RNA, 16 nt, Homo sapiens
aggcaccagcaaaaca

SEQ ID NO: 1002096 - RNA, 19 nt, Homo sapiens
aggcaccugccaccaugcc

SEQ ID NO: 1002097 - RNA, 16 nt, Homo sapiens
aggcacuguaguucua

SEQ ID NO: 1002098 - RNA, 19 nt, Homo sapiens
aggcacuguaguucuaaga

SEQ ID NO: 1002099 - RNA, 15 nt, Homo sapiens
aggcagaccauccac

SEQ ID NO: 1002100 - RNA, 15 nt, Homo sapiens
aggcagcagagcauu

SEQ ID NO: 1002101 - RNA, 15 nt, Homo sapiens
aggcagcagugugag

SEQ ID NO: 1002102 - RNA, 20 nt, Homo sapiens
aggcagcccaggaagucuca

SEQ ID NO: 1002103 - RNA, 16 nt, Homo sapiens
aggcaggagaaucacu

SEQ ID NO: 1002104 - RNA, 19 nt, Homo sapiens
aggcaggagaaucacuuga

SEQ ID NO: 1002105 - RNA, 15 nt, Homo sapiens
aggcaggagguacaa

SEQ ID NO: 1002106 - RNA, 14 nt, Homo sapiens
aggcauuuccagac

SEQ ID NO: 1002107 - RNA, 22 nt, Homo sapiens
aggccacccgcacaaaauucac

SEQ ID NO: 1002108 - RNA, 20 nt, Homo sapiens
aggccuccugugacuggcag

SEQ ID NO: 1002109 - RNA, 14 nt, Homo sapiens
aggccuggacuuuc

SEQ ID NO: 1002110 - RNA, 20 nt, Homo sapiens
aggccuggacuuuccugcaa

SEQ ID NO: 1002111 - RNA, 18 nt, Homo sapiens
aggccugggccgcugcca

SEQ ID NO: 1002112 - RNA, 15 nt, Homo sapiens
aggcucagauuguaa

SEQ ID NO: 1002113 - RNA, 22 nt, Homo sapiens
aggcuccagagggcacucugcu

SEQ ID NO: 1002114 - RNA, 16 nt, Homo sapiens
aggcucuagaucauaa

SEQ ID NO: 1002115 - RNA, 20 nt, Homo sapiens
aggcugagaaucagacugac

SEQ ID NO: 1002116 - RNA, 22 nt, Homo sapiens
aggcugaggccuggacuuuccu

SEQ ID NO: 1002117 - RNA, 18 nt, Homo sapiens
aggcugccccucucacca

SEQ ID NO: 1002118 - RNA, 12 nt, Homo sapiens
aggcugggccau

SEQ ID NO: 1002119 - RNA, 16 nt, Homo sapiens
aggcugggccaugucc

SEQ ID NO: 1002120 - RNA, 13 nt, Homo sapiens
aggcuggucucaa

SEQ ID NO: 1002121 - RNA, 13 nt, Homo sapiens
aggcuguggacca

SEQ ID NO: 1002122 - RNA, 15 nt, Homo sapiens
aggcuuccuaucugu

SEQ ID NO: 1002123 - RNA, 19 nt, Homo sapiens
aggcuugguuccuucccaa

SEQ ID NO: 1002124 - RNA, 23 nt, Homo sapiens
agggaccgcccccugucucucag

SEQ ID NO: 1002125 - RNA, 18 nt, Homo sapiens
agggagcucugaugagca

SEQ ID NO: 1002126 - RNA, 12 nt, Homo sapiens
agggaggcucag

SEQ ID NO: 1002127 - RNA, 15 nt, Homo sapiens
agggagggcugucau

SEQ ID NO: 1002128 - RNA, 21 nt, Homo sapiens
agggauuuuuuuuuucagggc

SEQ ID NO: 1002129 - RNA, 22 nt, Homo sapiens
agggcacccuaguucuaccuca

SEQ ID NO: 1002130 - RNA, 14 nt, Homo sapiens
agggccacauggga

SEQ ID NO: 1002131 - RNA, 21 nt, Homo sapiens
agggccaggccucucccuccu

SEQ ID NO: 1002132 - RNA, 16 nt, Homo sapiens
agggcccccaucucau

SEQ ID NO: 1002133 - RNA, 17 nt, Homo sapiens
agggcucacucagccac

SEQ ID NO: 1002134 - RNA, 12 nt, Homo sapiens
agggcucugagg

SEQ ID NO: 1002135 - RNA, 19 nt, Homo sapiens
agggcugucaucugugcac

SEQ ID NO: 1002136 - RNA, 15 nt, Homo sapiens
aggggucugagcucc

SEQ ID NO: 1002137 - RNA, 19 nt, Homo sapiens
agggucugagacucccuuu

SEQ ID NO: 1002138 - RNA, 14 nt, Homo sapiens
aggguggaauauca

SEQ ID NO: 1002139 - RNA, 23 nt, Homo sapiens
aggguuuugccccaaguccucau

SEQ ID NO: 1002140 - RNA, 17 nt, Homo sapiens
agguacgaugacagugu

SEQ ID NO: 1002141 - RNA, 19 nt, Homo sapiens
agguaggggcccacuucac

SEQ ID NO: 1002142 - RNA, 21 nt, Homo sapiens
aggucagagcagagguggaaa

SEQ ID NO: 1002143 - RNA, 11 nt, Homo sapiens
aggucagccag

SEQ ID NO: 1002144 - RNA, 21 nt, Homo sapiens
aggucccugcugccagcuuca

SEQ ID NO: 1002145 - RNA, 18 nt, Homo sapiens
agguccgguguucuaaga

SEQ ID NO: 1002146 - RNA, 18 nt, Homo sapiens
agguccugagcacugcca

SEQ ID NO: 1002147 - RNA, 16 nt, Homo sapiens
agguccuggugguauu

SEQ ID NO: 1002148 - RNA, 20 nt, Homo sapiens
agguccuuguuguuucuugc

SEQ ID NO: 1002149 - RNA, 19 nt, Homo sapiens
aggucuggguggggcccag

SEQ ID NO: 1002150 - RNA, 14 nt, Homo sapiens
aggugauccaugua

SEQ ID NO: 1002151 - RNA, 15 nt, Homo sapiens
aggugcccaggagaa

SEQ ID NO: 1002152 - RNA, 19 nt, Homo sapiens
aggugcugacuucaucucc

SEQ ID NO: 1002153 - RNA, 10 nt, Homo sapiens
aggugucuga

SEQ ID NO: 1002154 - RNA, 12 nt, Homo sapiens
agguuaucagug

SEQ ID NO: 1002155 - RNA, 19 nt, Homo sapiens
agguucuaaaguucuaaga

SEQ ID NO: 1002156 - RNA, 18 nt, Homo sapiens
agguugagcucuucuuaa

SEQ ID NO: 1002157 - RNA, 13 nt, Homo sapiens
agguuuccugccu

SEQ ID NO: 1002158 - RNA, 16 nt, Homo sapiens
agguuugccagcauuu

SEQ ID NO: 1002159 - RNA, 17 nt, Homo sapiens
agguuuuacacuugcau

SEQ ID NO: 1002160 - RNA, 20 nt, Homo sapiens
aguaaaggcaguaaugccuu

SEQ ID NO: 1002161 - RNA, 16 nt, Homo sapiens
aguaaauaacuggaaa

SEQ ID NO: 1002162 - RNA, 20 nt, Homo sapiens
aguaaaucuuuuacaacugc

SEQ ID NO: 1002163 - RNA, 21 nt, Homo sapiens
aguaacauuugcuguuuuaaa

SEQ ID NO: 1002164 - RNA, 15 nt, Homo sapiens
aguaacuccccucag

SEQ ID NO: 1002165 - RNA, 22 nt, Homo sapiens
aguaaguuugauuucauuaaua

SEQ ID NO: 1002166 - RNA, 14 nt, Homo sapiens
aguaauacaaacua

SEQ ID NO: 1002167 - RNA, 19 nt, Homo sapiens
aguaaucaaucuacucaaa

SEQ ID NO: 1002168 - RNA, 13 nt, Homo sapiens
aguacaaccugaa

SEQ ID NO: 1002169 - RNA, 22 nt, Homo sapiens
aguaccaccccucucuccccac

SEQ ID NO: 1002170 - RNA, 21 nt, Homo sapiens
aguacccacucuggagcauuu

SEQ ID NO: 1002171 - RNA, 10 nt, Homo sapiens
aguaccccau

SEQ ID NO: 1002172 - RNA, 14 nt, Homo sapiens
aguagaaucucagu

SEQ ID NO: 1002173 - RNA, 16 nt, Homo sapiens
aguagaggcuauggac

SEQ ID NO: 1002174 - RNA, 20 nt, Homo sapiens
aguagaugcauuugggucca

SEQ ID NO: 1002175 - RNA, 13 nt, Homo sapiens
ggcucugaugaaa

SEQ ID NO: 1002176 - RNA, 15 nt, Homo sapiens
ggcugaaagaugacg

SEQ ID NO: 1002177 - RNA, 16 nt, Homo sapiens
ggcugaggcuggcaca

SEQ ID NO: 1002178 - RNA, 23 nt, Homo sapiens
ggcugcagccucaggacugggag

SEQ ID NO: 1002179 - RNA, 16 nt, Homo sapiens
ggcugcgcacuguguc

SEQ ID NO: 1002180 - RNA, 12 nt, Homo sapiens
ggcugcugugaa

SEQ ID NO: 1002181 - RNA, 13 nt, Homo sapiens
ggcugcugugaac

SEQ ID NO: 1002182 - RNA, 20 nt, Homo sapiens
ggcugcuuggagcagccuaa

SEQ ID NO: 1002183 - RNA, 19 nt, Homo sapiens
ggcuggaagauagcuguga

SEQ ID NO: 1002184 - RNA, 15 nt, Homo sapiens
ggcuggagugcagug

SEQ ID NO: 1002185 - RNA, 14 nt, Homo sapiens
ggcuggaugagcuc

SEQ ID NO: 1002186 - RNA, 14 nt, Homo sapiens
ggcuggccucccaa

SEQ ID NO: 1002187 - RNA, 23 nt, Homo sapiens
ggcuguggaccauggaguggcag

SEQ ID NO: 1002188 - RNA, 17 nt, Homo sapiens
ggcuuggggcuggagag

SEQ ID NO: 1002189 - RNA, 23 nt, Homo sapiens
gggaaaagaaaaagauugagaga

SEQ ID NO: 1002190 - RNA, 21 nt, Homo sapiens
gggaacccugcccacucccag

SEQ ID NO: 1002191 - RNA, 14 nt, Homo sapiens
gggaagacaguggc

SEQ ID NO: 1002192 - RNA, 21 nt, Homo sapiens
gggaagggagccaagggaugg

SEQ ID NO: 1002193 - RNA, 12 nt, Homo sapiens
gggaauggggac

SEQ ID NO: 1002194 - RNA, 15 nt, Homo sapiens
gggacauuccaaaga

SEQ ID NO: 1002195 - RNA, 19 nt, Homo sapiens
gggagaagcuccucucccc

SEQ ID NO: 1002196 - RNA, 15 nt, Homo sapiens
gggagacaugugaca

SEQ ID NO: 1002197 - RNA, 22 nt, Homo sapiens
gggagcccacuguccugggccu

SEQ ID NO: 1002198 - RNA, 22 nt, Homo sapiens
gggaggaucguuugagcccagg

SEQ ID NO: 1002199 - RNA, 20 nt, Homo sapiens
gggaguaggacauaccagcu

SEQ ID NO: 1002200 - RNA, 14 nt, Homo sapiens
gggaucuacuuucc

SEQ ID NO: 1002201 - RNA, 23 nt, Homo sapiens
gggauuuuuggcuacacacaaac

SEQ ID NO: 1002202 - RNA, 11 nt, Homo sapiens
gggcacgugug

SEQ ID NO: 1002203 - RNA, 18 nt, Homo sapiens
gggcaggaguagcugagc

SEQ ID NO: 1002204 - RNA, 19 nt, Homo sapiens
gggccacaucccacugcca

SEQ ID NO: 1002205 - RNA, 12 nt, Homo sapiens
gggccagcacuu

SEQ ID NO: 1002206 - RNA, 21 nt, Homo sapiens
gggccagcacuuccaugggaa

SEQ ID NO: 1002207 - RNA, 16 nt, Homo sapiens
gggccauguccaaaga

SEQ ID NO: 1002208 - RNA, 18 nt, Homo sapiens
gggccauucuccacagca

SEQ ID NO: 1002209 - RNA, 21 nt, Homo sapiens
gggcccaggucagccacuguu

SEQ ID NO: 1002210 - RNA, 12 nt, Homo sapiens
gggccccucucc

SEQ ID NO: 1002211 - RNA, 15 nt, Homo sapiens
gggcccuccuuccua

SEQ ID NO: 1002212 - RNA, 16 nt, Homo sapiens
gggccugcuccagacc

SEQ ID NO: 1002213 - RNA, 17 nt, Homo sapiens
uggaagacuaucuuacu

SEQ ID NO: 1002214 - RNA, 20 nt, Homo sapiens
uggaaguuauuaacuuuaau

SEQ ID NO: 1002215 - RNA, 20 nt, Homo sapiens
uggaaguuuagcucugagaa

SEQ ID NO: 1002216 - RNA, 12 nt, Homo sapiens
uggaauaaggca

SEQ ID NO: 1002217 - RNA, 13 nt, Homo sapiens
uggaauguaauca

SEQ ID NO: 1002218 - RNA, 15 nt, Homo sapiens
uggaauuuugcaaag

SEQ ID NO: 1002219 - RNA, 17 nt, Homo sapiens
uggacaaggagugugac

SEQ ID NO: 1002220 - RNA, 22 nt, Homo sapiens
uggacaugcuucagugcugcuc

SEQ ID NO: 1002221 - RNA, 15 nt, Homo sapiens
uggacugcucaggaa

SEQ ID NO: 1002222 - RNA, 23 nt, Homo sapiens
uggagauucaguuuucauuuggu

SEQ ID NO: 1002223 - RNA, 19 nt, Homo sapiens
uggaggggagggaucuccu

SEQ ID NO: 1002224 - RNA, 22 nt, Homo sapiens
uggagucacucuuaugcuguac

SEQ ID NO: 1002225 - RNA, 15 nt, Homo sapiens
uggagugcagugcca

SEQ ID NO: 1002226 - RNA, 19 nt, Homo sapiens
uggaguuuuguuuccucug

SEQ ID NO: 1002227 - RNA, 13 nt, Homo sapiens
uggauaaauugca

SEQ ID NO: 1002228 - RNA, 18 nt, Homo sapiens
uggauauuuuuuacuuua

SEQ ID NO: 1002229 - RNA, 17 nt, Homo sapiens
uggaucacucaccauuc

SEQ ID NO: 1002230 - RNA, 21 nt, Homo sapiens
uggaugcuggguccauaucac

SEQ ID NO: 1002231 - RNA, 17 nt, Homo sapiens
uggauuaguuaacagac

SEQ ID NO: 1002232 - RNA, 10 nt, Homo sapiens
uggcacuuug

SEQ ID NO: 1002233 - RNA, 20 nt, Homo sapiens
uggcaggccccagcccugca

SEQ ID NO: 1002234 - RNA, 17 nt, Homo sapiens
uggcauuuccuggucag

SEQ ID NO: 1002235 - RNA, 12 nt, Homo sapiens
uggccaagcuga

SEQ ID NO: 1002236 - RNA, 13 nt, Homo sapiens
uggcccagccaaa

SEQ ID NO: 1002237 - RNA, 14 nt, Homo sapiens
uggcccagccuuug

SEQ ID NO: 1002238 - RNA, 21 nt, Homo sapiens
uggcccccucccuggaugaca

SEQ ID NO: 1002239 - RNA, 15 nt, Homo sapiens
uggcccuacugggag

SEQ ID NO: 1002240 - RNA, 23 nt, Homo sapiens
uggccucacccaccccugcacag

SEQ ID NO: 1002241 - RNA, 14 nt, Homo sapiens
uggccugcacuggu

SEQ ID NO: 1002242 - RNA, 15 nt, Homo sapiens
uggccuucaguguac

SEQ ID NO: 1002243 - RNA, 19 nt, Homo sapiens
uggccuucauaucauccac

SEQ ID NO: 1002244 - RNA, 19 nt, Homo sapiens
uggcguaggcuacagagaa

SEQ ID NO: 1002245 - RNA, 14 nt, Homo sapiens
uggcguuacugcuu

SEQ ID NO: 1002246 - RNA, 17 nt, Homo sapiens
uggcucagccagcacuu

SEQ ID NO: 1002247 - RNA, 22 nt, Homo sapiens
uggcucuugaggcauuuccaga

SEQ ID NO: 1002248 - RNA, 23 nt, Homo sapiens
uggcuggcuuguuugauuucaac

SEQ ID NO: 1002249 - RNA, 19 nt, Homo sapiens
uggcuuguuugauuucaac

SEQ ID NO: 1002250 - RNA, 15 nt, Homo sapiens
ugggaacagugugca

SEQ ID NO: 1002251 - RNA, 16 nt, Homo sapiens
ugggaacagugugcaa

SEQ ID NO: 1002252 - RNA, 17 nt, Homo sapiens
ugggaacagugugcaag

SEQ ID NO: 1002253 - RNA, 22 nt, Homo sapiens
ugggaaggcuugggauuugcug

SEQ ID NO: 1002254 - RNA, 17 nt, Homo sapiens
ugggaaggggggccaua

SEQ ID NO: 1002255 - RNA, 22 nt, Homo sapiens
ugggaagucguccuuacuccug

SEQ ID NO: 1002256 - RNA, 19 nt, Homo sapiens
ugggaaucaacagcauauu

SEQ ID NO: 1002257 - RNA, 23 nt, Homo sapiens
ugggaccucaguuuuaucauuuu

SEQ ID NO: 1002258 - RNA, 15 nt, Homo sapiens
ugggacguggcucag

SEQ ID NO: 1002259 - RNA, 16 nt, Homo sapiens
ugggagaaaucuggcu

SEQ ID NO: 1002260 - RNA, 19 nt, Homo sapiens
ugggagaccggccugccag

SEQ ID NO: 1002261 - RNA, 20 nt, Homo sapiens
ugggagauucaagggaccca

SEQ ID NO: 1002262 - RNA, 11 nt, Homo sapiens
ugggagcaaac

SEQ ID NO: 1002263 - RNA, 22 nt, Homo sapiens
ugggaggccgcggccaccgcca

SEQ ID NO: 1002264 - RNA, 11 nt, Homo sapiens
ugugacauuua

SEQ ID NO: 1002265 - RNA, 20 nt, Homo sapiens
ugugaccaaugucuugaugc

SEQ ID NO: 1002266 - RNA, 23 nt, Homo sapiens
ugugaccacugaagcaccacagg

SEQ ID NO: 1002267 - RNA, 23 nt, Homo sapiens
ugugacuucuauuuuaaagacaa

SEQ ID NO: 1002268 - RNA, 16 nt, Homo sapiens
ugugagccaccacguc

SEQ ID NO: 1002269 - RNA, 13 nt, Homo sapiens
ugugauaugcaca

SEQ ID NO: 1002270 - RNA, 13 nt, Homo sapiens
ugugauguucuaa

SEQ ID NO: 1002271 - RNA, 23 nt, Homo sapiens
ugugcacacauauacauguagga

SEQ ID NO: 1002272 - RNA, 11 nt, Homo sapiens
ugugcacauuu

SEQ ID NO: 1002273 - RNA, 13 nt, Homo sapiens
ugugcaguagcau

SEQ ID NO: 1002274 - RNA, 22 nt, Homo sapiens
ugugcauacuuucccucaucca

SEQ ID NO: 1002275 - RNA, 21 nt, Homo sapiens
ugugcccccaaccauuuccuc

SEQ ID NO: 1002276 - RNA, 15 nt, Homo sapiens
ugugcccucugggcu

SEQ ID NO: 1002277 - RNA, 24 nt, Homo sapiens
uguggacaggacuaacacucagaa

SEQ ID NO: 1002278 - RNA, 10 nt, Homo sapiens
ugugggaccg

SEQ ID NO: 1002279 - RNA, 15 nt, Homo sapiens
ugugggcuccaugua

SEQ ID NO: 1002280 - RNA, 13 nt, Homo sapiens
uguggggauuuuc

SEQ ID NO: 1002281 - RNA, 15 nt, Homo sapiens
uguggguauguguuu

SEQ ID NO: 1002282 - RNA, 13 nt, Homo sapiens
uguguagcuguga

SEQ ID NO: 1002283 - RNA, 19 nt, Homo sapiens
ugugucccccucuguccag

SEQ ID NO: 1002284 - RNA, 17 nt, Homo sapiens
uguguggggugggcaca

SEQ ID NO: 1002285 - RNA, 19 nt, Homo sapiens
uguguuauuuaaugaguca

SEQ ID NO: 1002286 - RNA, 17 nt, Homo sapiens
uguguuucacaguuuga

SEQ ID NO: 1002287 - RNA, 17 nt, Homo sapiens
uguguuuggaagacuau

SEQ ID NO: 1002288 - RNA, 18 nt, Homo sapiens
uguguuuugcuaaaggaa

SEQ ID NO: 1002289 - RNA, 20 nt, Homo sapiens
uguguuuuuaacaugucaau

SEQ ID NO: 1002290 - RNA, 21 nt, Homo sapiens
uguuaacacucaugaagcaua

SEQ ID NO: 1002291 - RNA, 19 nt, Homo sapiens
uguuaacauuccaagacuc

SEQ ID NO: 1002292 - RNA, 17 nt, Homo sapiens
uguuacagaagcugaaa

SEQ ID NO: 1002293 - RNA, 20 nt, Homo sapiens
uguuaccugaaaacacugug

SEQ ID NO: 1002294 - RNA, 22 nt, Homo sapiens
uguuaccuguagauucagguaa

SEQ ID NO: 1002295 - RNA, 14 nt, Homo sapiens
uguuacuguaauuc

SEQ ID NO: 1002296 - RNA, 19 nt, Homo sapiens
uguuauauagccaauauaa

SEQ ID NO: 1002297 - RNA, 15 nt, Homo sapiens
uguuaucagucaaua

SEQ ID NO: 1002298 - RNA, 19 nt, Homo sapiens
uguuaugcaaaagcaagcu

SEQ ID NO: 1002299 - RNA, 22 nt, Homo sapiens
uguucaaagucaaauaacuccu

SEQ ID NO: 1002300 - RNA, 14 nt, Homo sapiens
uguucaaggcagug

SEQ ID NO: 1002301 - RNA, 15 nt, Homo sapiens
uguucagcaugcaau

SEQ ID NO: 1002302 - RNA, 11 nt, Homo sapiens
uguucaugccg

SEQ ID NO: 1002303 - RNA, 17 nt, Homo sapiens
uguucauggacuauucc

SEQ ID NO: 1002304 - RNA, 15 nt, Homo sapiens
uguuccccacuggag

SEQ ID NO: 1002305 - RNA, 22 nt, Homo sapiens
uguuccccacuguaucuaggca

SEQ ID NO: 1002306 - RNA, 14 nt, Homo sapiens
uguuccccuaguuc

SEQ ID NO: 1002307 - RNA, 22 nt, Homo sapiens
uguucuccugcugcucccucag

SEQ ID NO: 1002308 - RNA, 12 nt, Homo sapiens
uguucuuuggaa

SEQ ID NO: 1002309 - RNA, 16 nt, Homo sapiens
uguugaagugagcuga

SEQ ID NO: 1002310 - RNA, 21 nt, Homo sapiens
uguugacauuagucucaguga

SEQ ID NO: 1002311 - RNA, 19 nt, Homo sapiens
uguugcuuccguucaugga

SEQ ID NO: 1002312 - RNA, 21 nt, Homo sapiens
uguuguaaccugcugugauac

SEQ ID NO: 1002313 - RNA, 18 nt, Homo sapiens
uguugucaccagaucuga

SEQ ID NO: 1002314 - RNA, 21 nt, Homo sapiens
uguuguguuuuuaacauguca

SEQ ID NO: 1002315 - RNA, 21 nt, Homo sapiens
uguuuaaaaaaccacauggca

SEQ ID NO: 1002316 - RNA, 17 nt, Homo sapiens
uguuuagaaagaauauu

SEQ ID NO: 1002317 - RNA, 23 nt, Homo sapiens
acucacugcugcaaauacuguau

SEQ ID NO: 1002318 - RNA, 20 nt, Homo sapiens
acucacuuuucccacuccaa

SEQ ID NO: 1002319 - RNA, 18 nt, Homo sapiens
acucagaggcagugacag

SEQ ID NO: 1002320 - RNA, 18 nt, Homo sapiens
acucagccacccugaguu

SEQ ID NO: 1002321 - RNA, 21 nt, Homo sapiens
acucagguggcccuacuggga

SEQ ID NO: 1002322 - RNA, 16 nt, Homo sapiens
acucaguuucuaggca

SEQ ID NO: 1002323 - RNA, 15 nt, Homo sapiens
acucaugaagcauac

SEQ ID NO: 1002324 - RNA, 21 nt, Homo sapiens
acucaugcugguggcauuguu

SEQ ID NO: 1002325 - RNA, 15 nt, Homo sapiens
acucccauuccugaa

SEQ ID NO: 1002326 - RNA, 20 nt, Homo sapiens
acuccgagagcaugcuuaau

SEQ ID NO: 1002327 - RNA, 19 nt, Homo sapiens
acuccuccaaggaaaggga

SEQ ID NO: 1002328 - RNA, 17 nt, Homo sapiens
acuccugaccucaggca

SEQ ID NO: 1002329 - RNA, 17 nt, Homo sapiens
acucguucuucugggaa

SEQ ID NO: 1002330 - RNA, 21 nt, Homo sapiens
acucuagaugaaguuuuacau

SEQ ID NO: 1002331 - RNA, 20 nt, Homo sapiens
acucuagucaaugacaugaa

SEQ ID NO: 1002332 - RNA, 14 nt, Homo sapiens
acucugguggcaca

SEQ ID NO: 1002333 - RNA, 21 nt, Homo sapiens
acucuuaugcuguacccaguu

SEQ ID NO: 1002334 - RNA, 20 nt, Homo sapiens
acucuucuugcagcuguuga

SEQ ID NO: 1002335 - RNA, 17 nt, Homo sapiens
acugaaacgucuaggaa

SEQ ID NO: 1002336 - RNA, 14 nt, Homo sapiens
acugaacauccaaa

SEQ ID NO: 1002337 - RNA, 14 nt, Homo sapiens
acugaagcucuuau

SEQ ID NO: 1002338 - RNA, 22 nt, Homo sapiens
acugaauagauaugaaagcuga

SEQ ID NO: 1002339 - RNA, 21 nt, Homo sapiens
acugacacaagaauggucuuu

SEQ ID NO: 1002340 - RNA, 19 nt, Homo sapiens
acugaggauguaaagauca

SEQ ID NO: 1002341 - RNA, 18 nt, Homo sapiens
acugaucaccuguuagca

SEQ ID NO: 1002342 - RNA, 23 nt, Homo sapiens
acugcaaacaguguucugugaca

SEQ ID NO: 1002343 - RNA, 19 nt, Homo sapiens
acugcaaagcucggugcuc

SEQ ID NO: 1002344 - RNA, 20 nt, Homo sapiens
acugcacuccagucugggug

SEQ ID NO: 1002345 - RNA, 18 nt, Homo sapiens
acugcauucuucugagca

SEQ ID NO: 1002346 - RNA, 17 nt, Homo sapiens
acugccuucaccuucac

SEQ ID NO: 1002347 - RNA, 18 nt, Homo sapiens
acugcucuguguuuacag

SEQ ID NO: 1002348 - RNA, 16 nt, Homo sapiens
acugcuugaccaaaga

SEQ ID NO: 1002349 - RNA, 14 nt, Homo sapiens
acugcuugaggaaa

SEQ ID NO: 1002350 - RNA, 17 nt, Homo sapiens
acuggaaaacagaacac

SEQ ID NO: 1002351 - RNA, 15 nt, Homo sapiens
acuggcaugggagac

SEQ ID NO: 1002352 - RNA, 17 nt, Homo sapiens
acuggggacuuggccuc

SEQ ID NO: 1002353 - RNA, 13 nt, Homo sapiens
acuggggcucaga

SEQ ID NO: 1002354 - RNA, 16 nt, Homo sapiens
acuguacagugucuuu

SEQ ID NO: 1002355 - RNA, 22 nt, Homo sapiens
acuguauauucaggacuugaaa

SEQ ID NO: 1002356 - RNA, 18 nt, Homo sapiens
acuguaugugggaauuua

SEQ ID NO: 1002357 - RNA, 13 nt, Homo sapiens
acugucuccaugg

SEQ ID NO: 1002358 - RNA, 19 nt, Homo sapiens
acuguggacuccaugccuc

SEQ ID NO: 1002359 - RNA, 13 nt, Homo sapiens
acugugguagcca

SEQ ID NO: 1002360 - RNA, 13 nt, Homo sapiens
acuuaaagcuuuc

SEQ ID NO: 1002361 - RNA, 17 nt, Homo sapiens
acuuaacggaccaaagc

SEQ ID NO: 1002362 - RNA, 21 nt, Homo sapiens
acuuaagcaucuggcucuaau

SEQ ID NO: 1002363 - RNA, 19 nt, Homo sapiens
acuuacauuuacaaacuga

SEQ ID NO: 1002364 - RNA, 19 nt, Homo sapiens
acuucaagaucugaauuug

SEQ ID NO: 1002365 - RNA, 16 nt, Homo sapiens
acuuccacucgaugau

SEQ ID NO: 1002366 - RNA, 21 nt, Homo sapiens
acuucugacagccucagugac

SEQ ID NO: 1002367 - RNA, 20 nt, Homo sapiens
acuucugagaucuguugauu

SEQ ID NO: 1002368 - RNA, 20 nt, Homo sapiens
acuucuugcuggucuaguca

SEQ ID NO: 1002369 - RNA, 19 nt, Homo sapiens
acuucuugcuucuuucuag

SEQ ID NO: 1002370 - RNA, 15 nt, Homo sapiens
acuugcaucacuuaa

SEQ ID NO: 1002371 - RNA, 15 nt, Homo sapiens
acuugcauugugauu

SEQ ID NO: 1002372 - RNA, 21 nt, Homo sapiens
acuugccugugcuacaauuca

SEQ ID NO: 1002373 - RNA, 23 nt, Homo sapiens
acuuggcuggugugguacagaga

SEQ ID NO: 1002374 - RNA, 19 nt, Homo sapiens
acuuggggcaccuugcucc

SEQ ID NO: 1002375 - RNA, 17 nt, Homo sapiens
acuugucaggagugugu

SEQ ID NO: 1002376 - RNA, 15 nt, Homo sapiens
acuuguccuagcaca

SEQ ID NO: 1002377 - RNA, 16 nt, Homo sapiens
acuugugucccaugau

SEQ ID NO: 1002378 - RNA, 19 nt, Homo sapiens
acuuguguuauauagccaa

SEQ ID NO: 1002379 - RNA, 15 nt, Homo sapiens
acuuguuuuaugcuc

SEQ ID NO: 1002380 - RNA, 22 nt, Homo sapiens
acuuuaaaauaucuacauuaau

SEQ ID NO: 1002381 - RNA, 22 nt, Homo sapiens
acuuuaauccuuccacuaucau

SEQ ID NO: 1002382 - RNA, 22 nt, Homo sapiens
acuuucuuccgaucuguaccug

SEQ ID NO: 1002383 - RNA, 19 nt, Homo sapiens
acuuugcuaaagacaugaa

SEQ ID NO: 1002384 - RNA, 17 nt, Homo sapiens
acuuugcuugcuuugaa

SEQ ID NO: 1002385 - RNA, 22 nt, Homo sapiens
acuuugguaccagauaacuuuu

SEQ ID NO: 1002386 - RNA, 13 nt, Homo sapiens
acuuugugcauuc

SEQ ID NO: 1002387 - RNA, 22 nt, Homo sapiens
acuuuuaaguugcugaugaacu

SEQ ID NO: 1002388 - RNA, 23 nt, Homo sapiens
acuuuuaaguugcugaugaacuc

SEQ ID NO: 1002389 - RNA, 11 nt, Homo sapiens
acuuuucccac

SEQ ID NO: 1002390 - RNA, 14 nt, Homo sapiens
acuuuucccacucc

SEQ ID NO: 1002391 - RNA, 21 nt, Homo sapiens
acuuuucuuaaaaaguuauaa

SEQ ID NO: 1002392 - RNA, 21 nt, Homo sapiens
agaaaaaauuccacaaugaaa

SEQ ID NO: 1002393 - RNA, 20 nt, Homo sapiens
agaaaacccuugggccagaa

SEQ ID NO: 1002394 - RNA, 19 nt, Homo sapiens
agaaaagcccaaguucaug

SEQ ID NO: 1002395 - RNA, 16 nt, Homo sapiens
agaaaauuagacugug

SEQ ID NO: 1002396 - RNA, 17 nt, Homo sapiens
agaaacaaagauguuau

SEQ ID NO: 1002397 - RNA, 16 nt, Homo sapiens
agaaacaacacuguag

SEQ ID NO: 1002398 - RNA, 18 nt, Homo sapiens
agaaacaacacuguagua

SEQ ID NO: 1002399 - RNA, 19 nt, Homo sapiens
agaaacaguugguaacuuu

SEQ ID NO: 1002400 - RNA, 19 nt, Homo sapiens
agaaagaccaggccaaugu

SEQ ID NO: 1002401 - RNA, 22 nt, Homo sapiens
agaaagacuugguugguagggu

SEQ ID NO: 1002402 - RNA, 14 nt, Homo sapiens
agaaagaucaaaga

SEQ ID NO: 1002403 - RNA, 14 nt, Homo sapiens
agaaaguguauuug

SEQ ID NO: 1002404 - RNA, 17 nt, Homo sapiens
agaaauacuacugugua

SEQ ID NO: 1002405 - RNA, 17 nt, Homo sapiens
agaaauaucuucacuug

SEQ ID NO: 1002406 - RNA, 14 nt, Homo sapiens
agaaauauggacac

SEQ ID NO: 1002407 - RNA, 16 nt, Homo sapiens
agaaaucugugccuga

SEQ ID NO: 1002408 - RNA, 17 nt, Homo sapiens
agaaauuaccuguggau

SEQ ID NO: 1002409 - RNA, 18 nt, Homo sapiens
agaacaccagagaccuca

SEQ ID NO: 1002410 - RNA, 11 nt, Homo sapiens
agaacagggaa

SEQ ID NO: 1002411 - RNA, 21 nt, Homo sapiens
agaacaugguuaccaugucuu

SEQ ID NO: 1002412 - RNA, 21 nt, Homo sapiens
agaacucaaauggggccagau

SEQ ID NO: 1002413 - RNA, 18 nt, Homo sapiens
agaagcaaaaucuaccag

SEQ ID NO: 1002414 - RNA, 20 nt, Homo sapiens
agaagcacccaggacuucca

SEQ ID NO: 1002415 - RNA, 18 nt, Homo sapiens
agaagccugggggccugg

SEQ ID NO: 1002416 - RNA, 21 nt, Homo sapiens
agaaucagagaaggaacauac

SEQ ID NO: 1002417 - RNA, 12 nt, Homo sapiens
agaauggaucac

SEQ ID NO: 1002418 - RNA, 18 nt, Homo sapiens
agaauggcuuuggucucu

SEQ ID NO: 1002419 - RNA, 19 nt, Homo sapiens
agaauguuaaaaagugaaa

SEQ ID NO: 1002420 - RNA, 23 nt, Homo sapiens
agacacagcccccacggacaaaa

SEQ ID NO: 1002421 - RNA, 19 nt, Homo sapiens
agacacuggcguuacugcu

SEQ ID NO: 1002422 - RNA, 20 nt, Homo sapiens
agacacuggcguuacugcuu

SEQ ID NO: 1002423 - RNA, 12 nt, Homo sapiens
agacacuggugg

SEQ ID NO: 1002424 - RNA, 15 nt, Homo sapiens
agacagagcccugug

SEQ ID NO: 1002425 - RNA, 19 nt, Homo sapiens
agacaguguuuucugggau

SEQ ID NO: 1002426 - RNA, 18 nt, Homo sapiens
agacauaaccacugcuuc

SEQ ID NO: 1002427 - RNA, 21 nt, Homo sapiens
agacauaaccacugcuuccau

SEQ ID NO: 1002428 - RNA, 20 nt, Homo sapiens
agacaucuuugcuuaugaaa

SEQ ID NO: 1002429 - RNA, 21 nt, Homo sapiens
agaccacgcccguccugccug

SEQ ID NO: 1002430 - RNA, 22 nt, Homo sapiens
agaccacgcccguccugccugu

SEQ ID NO: 1002431 - RNA, 14 nt, Homo sapiens
agaccacugauaaa

SEQ ID NO: 1002432 - RNA, 16 nt, Homo sapiens
agaccauaauguuaca

SEQ ID NO: 1002433 - RNA, 15 nt, Homo sapiens
agaccaucugaggaa

SEQ ID NO: 1002434 - RNA, 21 nt, Homo sapiens
agaccaucugaggaaugagaa

SEQ ID NO: 1002435 - RNA, 15 nt, Homo sapiens
agacccccagcacuu

SEQ ID NO: 1002436 - RNA, 14 nt, Homo sapiens
agaccccuguucau

SEQ ID NO: 1002437 - RNA, 13 nt, Homo sapiens
agaccuacccucc

SEQ ID NO: 1002438 - RNA, 12 nt, Homo sapiens
agaccuagagau

SEQ ID NO: 1002439 - RNA, 18 nt, Homo sapiens
agaccuccaccuccucca

SEQ ID NO: 1002440 - RNA, 14 nt, Homo sapiens
agaccugauccugg

SEQ ID NO: 1002441 - RNA, 22 nt, Homo sapiens
agacggagcccuggcaugucaa

SEQ ID NO: 1002442 - RNA, 16 nt, Homo sapiens
agacuauucuaaugaa

SEQ ID NO: 1002443 - RNA, 19 nt, Homo sapiens
agacucguucuucugggaa

SEQ ID NO: 1002444 - RNA, 15 nt, Homo sapiens
agacucugguguucu

SEQ ID NO: 1002445 - RNA, 21 nt, Homo sapiens
agacugcccagcuaaagcaau

SEQ ID NO: 1002446 - RNA, 18 nt, Homo sapiens
agacuggcggggggccca

SEQ ID NO: 1002447 - RNA, 20 nt, Homo sapiens
agacugggucucgcuuuguu

SEQ ID NO: 1002448 - RNA, 21 nt, Homo sapiens
agacugggucucgcuuuguug

SEQ ID NO: 1002449 - RNA, 16 nt, Homo sapiens
agacuuuccauuacaa

SEQ ID NO: 1002450 - RNA, 20 nt, Homo sapiens
agacuuuugcuuuaugauau

SEQ ID NO: 1002451 - RNA, 21 nt, Homo sapiens
agagaagccagcuuguuuaca

SEQ ID NO: 1002452 - RNA, 21 nt, Homo sapiens
agagaauauuggagauguccu

SEQ ID NO: 1002453 - RNA, 18 nt, Homo sapiens
agagacaggguuucacca

SEQ ID NO: 1002454 - RNA, 16 nt, Homo sapiens
agagacccaagcugcc

SEQ ID NO: 1002455 - RNA, 21 nt, Homo sapiens
agagagagggccugcuggaga

SEQ ID NO: 1002456 - RNA, 19 nt, Homo sapiens
agagagcaccuggugauca

SEQ ID NO: 1002457 - RNA, 20 nt, Homo sapiens
agagagccugcaggaucuca

SEQ ID NO: 1002458 - RNA, 12 nt, Homo sapiens
agagagcuccug

SEQ ID NO: 1002459 - RNA, 15 nt, Homo sapiens
agagagggccugcug

SEQ ID NO: 1002460 - RNA, 19 nt, Homo sapiens
agagagggccugcuggaga

SEQ ID NO: 1002461 - RNA, 18 nt, Homo sapiens
agagagguuugcaguccc

SEQ ID NO: 1002462 - RNA, 16 nt, Homo sapiens
agagcacucauuccuu

SEQ ID NO: 1002463 - RNA, 15 nt, Homo sapiens
agagcagagguggaa

SEQ ID NO: 1002464 - RNA, 19 nt, Homo sapiens
agagcagcaccuccucagc

SEQ ID NO: 1002465 - RNA, 13 nt, Homo sapiens
agagcccagcucc

SEQ ID NO: 1002466 - RNA, 17 nt, Homo sapiens
agagcugaagguugugg

SEQ ID NO: 1002467 - RNA, 17 nt, Homo sapiens
agaggacgggaggcugg

SEQ ID NO: 1002468 - RNA, 12 nt, Homo sapiens
agaggagcauga

SEQ ID NO: 1002469 - RNA, 17 nt, Homo sapiens
agaggagccaccaguuc

SEQ ID NO: 1002470 - RNA, 20 nt, Homo sapiens
agaggccaaggaggccuugg

SEQ ID NO: 1002471 - RNA, 18 nt, Homo sapiens
agaggcugccccucucac

SEQ ID NO: 1002472 - RNA, 23 nt, Homo sapiens
agagggucugggggcacaagacu

SEQ ID NO: 1002473 - RNA, 18 nt, Homo sapiens
agagugcuauaaaagacu

SEQ ID NO: 1002474 - RNA, 22 nt, Homo sapiens
agaguucuuuuugaaguauuua

SEQ ID NO: 1002475 - RNA, 13 nt, Homo sapiens
agaguuuccugaa

SEQ ID NO: 1002476 - RNA, 24 nt, Homo sapiens
agaguuuccugaaacaacuuggaa

SEQ ID NO: 1002477 - RNA, 22 nt, Homo sapiens
agauaaauauugagcagaucua

SEQ ID NO: 1002478 - RNA, 18 nt, Homo sapiens
agauaauuaccuacucug

SEQ ID NO: 1002479 - RNA, 19 nt, Homo sapiens
agaucagaugcuccaagau

SEQ ID NO: 1002480 - RNA, 19 nt, Homo sapiens
agaucagcgacccugagga

SEQ ID NO: 1002481 - RNA, 19 nt, Homo sapiens
agaucaucuuggaacugca

SEQ ID NO: 1002482 - RNA, 16 nt, Homo sapiens
agaucucccaugugua

SEQ ID NO: 1002483 - RNA, 19 nt, Homo sapiens
agaucuggaaccucagccu

SEQ ID NO: 1002484 - RNA, 20 nt, Homo sapiens
agaucuuuuauuuugccaag

SEQ ID NO: 1002485 - RNA, 17 nt, Homo sapiens
agaugacgaguaacucc

SEQ ID NO: 1002486 - RNA, 19 nt, Homo sapiens
agaugauacauccaaagca

SEQ ID NO: 1002487 - RNA, 16 nt, Homo sapiens
agaugcuccaagauuc

SEQ ID NO: 1002488 - RNA, 17 nt, Homo sapiens
agaugcuuuccugcaca

SEQ ID NO: 1002489 - RNA, 14 nt, Homo sapiens
agauggcacuuuga

SEQ ID NO: 1002490 - RNA, 14 nt, Homo sapiens
agauggcagcuuuu

SEQ ID NO: 1002491 - RNA, 16 nt, Homo sapiens
agauggggaccagcag

SEQ ID NO: 1002492 - RNA, 13 nt, Homo sapiens
agauucuaaagau

SEQ ID NO: 1002493 - RNA, 17 nt, Homo sapiens
agauucuaaagauucua

SEQ ID NO: 1002494 - RNA, 19 nt, Homo sapiens
agauucuaaugaugaucaa

SEQ ID NO: 1002495 - RNA, 18 nt, Homo sapiens
agauuuggcuugacaaag

SEQ ID NO: 1002496 - RNA, 17 nt, Homo sapiens
agauuugggugaacaaa

SEQ ID NO: 1002497 - RNA, 23 nt, Homo sapiens
agauuuguuuuuaaacuguacag

SEQ ID NO: 1002498 - RNA, 15 nt, Homo sapiens
agauuuucuuuugcc

SEQ ID NO: 1002499 - RNA, 20 nt, Homo sapiens
agcaaaauacaugacauuua

SEQ ID NO: 1002500 - RNA, 15 nt, Homo sapiens
agcaaaccaaagacc

SEQ ID NO: 1002501 - RNA, 15 nt, Homo sapiens
agcaaagcacagaga

SEQ ID NO: 1002502 - RNA, 22 nt, Homo sapiens
agcaaccguggcccuuccugga

SEQ ID NO: 1002503 - RNA, 16 nt, Homo sapiens
agcaacucuugauuau

SEQ ID NO: 1002504 - RNA, 20 nt, Homo sapiens
agcaagacauacuuaaugca

SEQ ID NO: 1002505 - RNA, 21 nt, Homo sapiens
agcaaggguugggcccagugu

SEQ ID NO: 1002506 - RNA, 13 nt, Homo sapiens
agcaauacuugga

SEQ ID NO: 1002507 - RNA, 16 nt, Homo sapiens
agcacagcuugaccug

SEQ ID NO: 1002508 - RNA, 17 nt, Homo sapiens
agcaccguucugugcac

SEQ ID NO: 1002509 - RNA, 21 nt, Homo sapiens
agcacucgcuagcaguggcag

SEQ ID NO: 1002510 - RNA, 15 nt, Homo sapiens
agcacugacugggac

SEQ ID NO: 1002511 - RNA, 21 nt, Homo sapiens
agcacugacugggaccaggca

SEQ ID NO: 1002512 - RNA, 18 nt, Homo sapiens
agcacugucccuugccuc

SEQ ID NO: 1002513 - RNA, 15 nt, Homo sapiens
agcacuguuuauaca

SEQ ID NO: 1002514 - RNA, 21 nt, Homo sapiens
agcacuguuuauacacugugu

SEQ ID NO: 1002515 - RNA, 21 nt, Homo sapiens
agcacuuggcccuucuaccua

SEQ ID NO: 1002516 - RNA, 23 nt, Homo sapiens
agcagaccaccccgccugcccuc

SEQ ID NO: 1002517 - RNA, 20 nt, Homo sapiens
agcagagacgggguuucacc

SEQ ID NO: 1002518 - RNA, 12 nt, Homo sapiens
agcagcacuuau

SEQ ID NO: 1002519 - RNA, 16 nt, Homo sapiens
agcagcaucucuaccu

SEQ ID NO: 1002520 - RNA, 18 nt, Homo sapiens
agcagccuaacacggugc

SEQ ID NO: 1002521 - RNA, 13 nt, Homo sapiens
agcaggacuccag

SEQ ID NO: 1002522 - RNA, 14 nt, Homo sapiens
agacaugugacauu

SEQ ID NO: 1002523 - RNA, 18 nt, Homo sapiens
agacauuggcaccuaauc

SEQ ID NO: 1002524 - RNA, 14 nt, Homo sapiens
agaccaccagggca

SEQ ID NO: 1002525 - RNA, 13 nt, Homo sapiens
agaccacugccau

SEQ ID NO: 1002526 - RNA, 20 nt, Homo sapiens
agaccagggcuccagccccu

SEQ ID NO: 1002527 - RNA, 20 nt, Homo sapiens
agaccgugaccagugcugcu

SEQ ID NO: 1002528 - RNA, 12 nt, Homo sapiens
agaccuacccuc

SEQ ID NO: 1002529 - RNA, 16 nt, Homo sapiens
agaccuaggauuucau

SEQ ID NO: 1002530 - RNA, 21 nt, Homo sapiens
agaccugagaauguaucccca

SEQ ID NO: 1002531 - RNA, 23 nt, Homo sapiens
agacuagaaaauuagacugugau

SEQ ID NO: 1002532 - RNA, 22 nt, Homo sapiens
agacuauguagcaauauaucag

SEQ ID NO: 1002533 - RNA, 16 nt, Homo sapiens
agacucuuuaugaucu

SEQ ID NO: 1002534 - RNA, 22 nt, Homo sapiens
agacugggcccaugaacacaga

SEQ ID NO: 1002535 - RNA, 18 nt, Homo sapiens
agacugugugugcccucu

SEQ ID NO: 1002536 - RNA, 16 nt, Homo sapiens
agacuuacucuaagau

SEQ ID NO: 1002537 - RNA, 19 nt, Homo sapiens
agacuuacucuaagaucuu

SEQ ID NO: 1002538 - RNA, 16 nt, Homo sapiens
agagaagccaucaccu

SEQ ID NO: 1002539 - RNA, 15 nt, Homo sapiens
agagaagucacaggg

SEQ ID NO: 1002540 - RNA, 21 nt, Homo sapiens
agagaaguuguaaaguaugua

SEQ ID NO: 1002541 - RNA, 13 nt, Homo sapiens
agagacacuggug

SEQ ID NO: 1002542 - RNA, 16 nt, Homo sapiens
agagacuauguagcaa

SEQ ID NO: 1002543 - RNA, 16 nt, Homo sapiens
agagagaggcauuuag

SEQ ID NO: 1002544 - RNA, 22 nt, Homo sapiens
agagagggccugcuggagagca

SEQ ID NO: 1002545 - RNA, 20 nt, Homo sapiens
agagaucagcgacccugagg

SEQ ID NO: 1002546 - RNA, 17 nt, Homo sapiens
agagaucccaaguagaa

SEQ ID NO: 1002547 - RNA, 15 nt, Homo sapiens
agagaugacagggaa

SEQ ID NO: 1002548 - RNA, 20 nt, Homo sapiens
agagauguguguugauacug

SEQ ID NO: 1002549 - RNA, 17 nt, Homo sapiens
agagauuguuacagaag

SEQ ID NO: 1002550 - RNA, 17 nt, Homo sapiens
agagcacgccuguacua

SEQ ID NO: 1002551 - RNA, 16 nt, Homo sapiens
agagcagacuacagcu

SEQ ID NO: 1002552 - RNA, 14 nt, Homo sapiens
agagcaggacucca

SEQ ID NO: 1002553 - RNA, 13 nt, Homo sapiens
agagcagggauua

SEQ ID NO: 1002554 - RNA, 14 nt, Homo sapiens
agagcaucaugccu

SEQ ID NO: 1002555 - RNA, 17 nt, Homo sapiens
agagccacagcugugca

SEQ ID NO: 1002556 - RNA, 23 nt, Homo sapiens
agagccaggggggugaggagcug

SEQ ID NO: 1002557 - RNA, 21 nt, Homo sapiens
agagccucggcccuagcauug

SEQ ID NO: 1002558 - RNA, 13 nt, Homo sapiens
agagccuguaaac

SEQ ID NO: 1002559 - RNA, 20 nt, Homo sapiens
agagcuagguggaaaagccu

SEQ ID NO: 1002560 - RNA, 14 nt, Homo sapiens
agagcuucccugac

SEQ ID NO: 1002561 - RNA, 18 nt, Homo sapiens
agaggaaacucugucacu

SEQ ID NO: 1002562 - RNA, 11 nt, Homo sapiens
agaggacaaga

SEQ ID NO: 1002563 - RNA, 19 nt, Homo sapiens
agaggagccaccaguucuc

SEQ ID NO: 1002564 - RNA, 14 nt, Homo sapiens
agaggagugugaag

SEQ ID NO: 1002565 - RNA, 14 nt, Homo sapiens
agaggcaccaggaa

SEQ ID NO: 1002566 - RNA, 23 nt, Homo sapiens
agaggcugcccuccugugcucag

SEQ ID NO: 1002567 - RNA, 17 nt, Homo sapiens
agagggccuaaccgaga

SEQ ID NO: 1002568 - RNA, 14 nt, Homo sapiens
agagggcugcauuc

SEQ ID NO: 1002569 - RNA, 22 nt, Homo sapiens
agaguggaaccaacacuaacau

SEQ ID NO: 1002570 - RNA, 15 nt, Homo sapiens
agaguuacaguucug

SEQ ID NO: 1002571 - RNA, 20 nt, Homo sapiens
agauaacuguaaaugugaca

SEQ ID NO: 1002572 - RNA, 14 nt, Homo sapiens
agauacauacagaa

SEQ ID NO: 1002573 - RNA, 13 nt, Homo sapiens
agauagcugugac

SEQ ID NO: 1002574 - RNA, 14 nt, Homo sapiens
agauagcugugacu

SEQ ID NO: 1002575 - RNA, 16 nt, Homo sapiens
agauaucaucuaccua

SEQ ID NO: 1002576 - RNA, 22 nt, Homo sapiens
agauauuaaugcccagacaaaa

SEQ ID NO: 1002577 - RNA, 17 nt, Homo sapiens
agauccuccucauucac

SEQ ID NO: 1002578 - RNA, 20 nt, Homo sapiens
agaugaaggagaggcaacau

SEQ ID NO: 1002579 - RNA, 11 nt, Homo sapiens
agaugacaaag

SEQ ID NO: 1002580 - RNA, 19 nt, Homo sapiens
agaugacagggaaaacugc

SEQ ID NO: 1002581 - RNA, 18 nt, Homo sapiens
agaugacggaugccuaga

SEQ ID NO: 1002582 - RNA, 15 nt, Homo sapiens
agaugauacauccaa

SEQ ID NO: 1002583 - RNA, 18 nt, Homo sapiens
agaugcugaaaauguccu

SEQ ID NO: 1002584 - RNA, 14 nt, Homo sapiens
agaugcuggcccag

SEQ ID NO: 1002585 - RNA, 21 nt, Homo sapiens
agaugcuuuccugcacauuaa

SEQ ID NO: 1002586 - RNA, 20 nt, Homo sapiens
agauggcauaaccugucuca

SEQ ID NO: 1002587 - RNA, 16 nt, Homo sapiens
agauggccagccccuu

SEQ ID NO: 1002588 - RNA, 12 nt, Homo sapiens
agauggggacca

SEQ ID NO: 1002589 - RNA, 19 nt, Homo sapiens
agauguauaacuaggagcu

SEQ ID NO: 1002590 - RNA, 22 nt, Homo sapiens
agaugucauuuaguucagcauc

SEQ ID NO: 1002591 - RNA, 19 nt, Homo sapiens
agaugugauauucuaagac

SEQ ID NO: 1002592 - RNA, 21 nt, Homo sapiens
agauguguguugauacuguug

SEQ ID NO: 1002593 - RNA, 19 nt, Homo sapiens
agauguucuggauaccauu

SEQ ID NO: 1002594 - RNA, 12 nt, Homo sapiens
agauguuuauuu

SEQ ID NO: 1002595 - RNA, 17 nt, Homo sapiens
agauuagagccuguaaa

SEQ ID NO: 1002596 - RNA, 20 nt, Homo sapiens
agauucagaaaugaggccau

SEQ ID NO: 1002597 - RNA, 19 nt, Homo sapiens
agauucagggaaaguggga

SEQ ID NO: 1002598 - RNA, 17 nt, Homo sapiens
agauucagguaauacaa

SEQ ID NO: 1002599 - RNA, 13 nt, Homo sapiens
agauucuaaugau

SEQ ID NO: 1002600 - RNA, 16 nt, Homo sapiens
agauucuaaugaugau

SEQ ID NO: 1002601 - RNA, 17 nt, Homo sapiens
agauucuagaugauuaa

SEQ ID NO: 1002602 - RNA, 16 nt, Homo sapiens
agauucuauaguucua

SEQ ID NO: 1002603 - RNA, 24 nt, Homo sapiens
agauugcaccacugcacuccaguc

SEQ ID NO: 1002604 - RNA, 18 nt, Homo sapiens
agauuuggaugcacucau

SEQ ID NO: 1002605 - RNA, 16 nt, Homo sapiens
agauuuucuuuugccu

SEQ ID NO: 1002606 - RNA, 15 nt, Homo sapiens
agauuuuuuccucug

SEQ ID NO: 1002607 - RNA, 20 nt, Homo sapiens
agauuuuuuuaacgagaaaa

SEQ ID NO: 1002608 - RNA, 18 nt, Homo sapiens
agcaaaacaacggaugaa

SEQ ID NO: 1002609 - RNA, 14 nt, Homo sapiens
agcaaauggccuca

SEQ ID NO: 1002610 - RNA, 21 nt, Homo sapiens
agcaaauggccucaugucaaa

SEQ ID NO: 1002611 - RNA, 17 nt, Homo sapiens
agcaaaugucaugcugc

SEQ ID NO: 1002612 - RNA, 12 nt, Homo sapiens
agcaacagucca

SEQ ID NO: 1002613 - RNA, 19 nt, Homo sapiens
agcaacauucauagucuuu

SEQ ID NO: 1002614 - RNA, 15 nt, Homo sapiens
agcaacgcuauucca

SEQ ID NO: 1002615 - RNA, 21 nt, Homo sapiens
agcaacuuguccuagcacaga

SEQ ID NO: 1002616 - RNA, 17 nt, Homo sapiens
agcaagacauacuuaau

SEQ ID NO: 1002617 - RNA, 15 nt, Homo sapiens
agcacagauggccag

SEQ ID NO: 1002618 - RNA, 21 nt, Homo sapiens
agcacagauggccagccccuu

SEQ ID NO: 1002619 - RNA, 13 nt, Homo sapiens
agcacaugugcug

SEQ ID NO: 1002620 - RNA, 15 nt, Homo sapiens
agcacaugugcugcc

SEQ ID NO: 1002621 - RNA, 11 nt, Homo sapiens
agcaccaaauc

SEQ ID NO: 1002622 - RNA, 15 nt, Homo sapiens
agcacccuacaggga

SEQ ID NO: 1002623 - RNA, 21 nt, Homo sapiens
agcaccugaagugaccuggaa

SEQ ID NO: 1002624 - RNA, 14 nt, Homo sapiens
agcacgacagugga

SEQ ID NO: 1002625 - RNA, 21 nt, Homo sapiens
agcacuagccaaaccucacca

SEQ ID NO: 1002626 - RNA, 22 nt, Homo sapiens
auagcucuggggugggcaguuu

SEQ ID NO: 1002627 - RNA, 23 nt, Homo sapiens
auagcucuggggugggcaguuuu

SEQ ID NO: 1002628 - RNA, 17 nt, Homo sapiens
auagcuucuccaaaggc

SEQ ID NO: 1002629 - RNA, 22 nt, Homo sapiens
auaggaugcuugggaagacucc

SEQ ID NO: 1002630 - RNA, 17 nt, Homo sapiens
auaggccuucauuaaca

SEQ ID NO: 1002631 - RNA, 17 nt, Homo sapiens
auaguguagcugaggag

SEQ ID NO: 1002632 - RNA, 14 nt, Homo sapiens
auaguuaagacaug

SEQ ID NO: 1002633 - RNA, 13 nt, Homo sapiens
auaguuacugugu

SEQ ID NO: 1002634 - RNA, 21 nt, Homo sapiens
auaguucuagacauggagguu

SEQ ID NO: 1002635 - RNA, 20 nt, Homo sapiens
auauaaaauguuuaaucucu

SEQ ID NO: 1002636 - RNA, 19 nt, Homo sapiens
auauaaaguaguccuguga

SEQ ID NO: 1002637 - RNA, 13 nt, Homo sapiens
auauaaucaauca

SEQ ID NO: 1002638 - RNA, 15 nt, Homo sapiens
auauagaaguauaaa

SEQ ID NO: 1002639 - RNA, 21 nt, Homo sapiens
auauagauuguccuuuugcaa

SEQ ID NO: 1002640 - RNA, 16 nt, Homo sapiens
auauauaaguguacau

SEQ ID NO: 1002641 - RNA, 19 nt, Homo sapiens
auauauauuuuugugcaca

SEQ ID NO: 1002642 - RNA, 16 nt, Homo sapiens
auauauuuuagcauuu

SEQ ID NO: 1002643 - RNA, 18 nt, Homo sapiens
auaucauccacacaugaa

SEQ ID NO: 1002644 - RNA, 13 nt, Homo sapiens
auaucaugaguga

SEQ ID NO: 1002645 - RNA, 19 nt, Homo sapiens
auaucauuuauccuuacau

SEQ ID NO: 1002646 - RNA, 14 nt, Homo sapiens
auaucgaucucuua

SEQ ID NO: 1002647 - RNA, 14 nt, Homo sapiens
auaugaagacauaa

SEQ ID NO: 1002648 - RNA, 21 nt, Homo sapiens
auaugaguaauacaucaaaga

SEQ ID NO: 1002649 - RNA, 17 nt, Homo sapiens
auaugcuaccaccagcu

SEQ ID NO: 1002650 - RNA, 19 nt, Homo sapiens
auauugcagcuuauauuca

SEQ ID NO: 1002651 - RNA, 21 nt, Homo sapiens
auauuuaaauguaaagacaaa

SEQ ID NO: 1002652 - RNA, 21 nt, Homo sapiens
auauuucugggagacagaaaa

SEQ ID NO: 1002653 - RNA, 16 nt, Homo sapiens
auauuuugcauaguac

SEQ ID NO: 1002654 - RNA, 19 nt, Homo sapiens
aucaaacauuuucuggcca

SEQ ID NO: 1002655 - RNA, 13 nt, Homo sapiens
aucaacagcauuu

SEQ ID NO: 1002656 - RNA, 19 nt, Homo sapiens
aucaacuuccuaaauauua

SEQ ID NO: 1002657 - RNA, 13 nt, Homo sapiens
aucaaguaauaca

SEQ ID NO: 1002658 - RNA, 14 nt, Homo sapiens
aucaaguccuacaa

SEQ ID NO: 1002659 - RNA, 15 nt, Homo sapiens
aucaagucuguuuac

SEQ ID NO: 1002660 - RNA, 16 nt, Homo sapiens
aucacaagauggaauu

SEQ ID NO: 1002661 - RNA, 20 nt, Homo sapiens
aucaccgugggcucccugac

SEQ ID NO: 1002662 - RNA, 15 nt, Homo sapiens
aucaccuacucacac

SEQ ID NO: 1002663 - RNA, 23 nt, Homo sapiens
aucaccuacucacacaggcauuu

SEQ ID NO: 1002664 - RNA, 15 nt, Homo sapiens
aucaccuguuagcau

SEQ ID NO: 1002665 - RNA, 21 nt, Homo sapiens
aucaccuguuagcauugccau

SEQ ID NO: 1002666 - RNA, 22 nt, Homo sapiens
aucacucuaauuaauuguaauc

SEQ ID NO: 1002667 - RNA, 23 nt, Homo sapiens
aucacuuaaacuugcaucacuua

SEQ ID NO: 1002668 - RNA, 11 nt, Homo sapiens
aucacuuugac

SEQ ID NO: 1002669 - RNA, 13 nt, Homo sapiens
aucagaauaucac

SEQ ID NO: 1002670 - RNA, 22 nt, Homo sapiens
aucagaccauaauguuacauua

SEQ ID NO: 1002671 - RNA, 20 nt, Homo sapiens
aucagagaaggaacauaccc

SEQ ID NO: 1002672 - RNA, 24 nt, Homo sapiens
aucagagagcugcccuucagcgau

SEQ ID NO: 1002673 - RNA, 17 nt, Homo sapiens
aucagaugcuccaagau

SEQ ID NO: 1002674 - RNA, 21 nt, Homo sapiens
aucagcuucaaggaguaugca

SEQ ID NO: 1002675 - RNA, 18 nt, Homo sapiens
aucaggaauauuuuccaa

SEQ ID NO: 1002676 - RNA, 19 nt, Homo sapiens
aucaggaauauuuuccaaa

SEQ ID NO: 1002677 - RNA, 18 nt, Homo sapiens
aucagggucuaagcaccu

SEQ ID NO: 1002678 - RNA, 20 nt, Homo sapiens
aucaguccaucccagaggga

SEQ ID NO: 1002679 - RNA, 18 nt, Homo sapiens
aucaguccauugcucuug

SEQ ID NO: 1002680 - RNA, 14 nt, Homo sapiens
aucaucauucucau

SEQ ID NO: 1002681 - RNA, 18 nt, Homo sapiens
aucaugcccugugcaacc

SEQ ID NO: 1002682 - RNA, 14 nt, Homo sapiens
auccacaugggagc

SEQ ID NO: 1002683 - RNA, 19 nt, Homo sapiens
auccagguaauccaagaua

SEQ ID NO: 1002684 - RNA, 15 nt, Homo sapiens
auccagucuauucac

SEQ ID NO: 1002685 - RNA, 14 nt, Homo sapiens
auccauaacugaac

SEQ ID NO: 1002686 - RNA, 24 nt, Homo sapiens
auccauccuugccaauagugucau

SEQ ID NO: 1002687 - RNA, 17 nt, Homo sapiens
auccaugaaccaagacc

SEQ ID NO: 1002688 - RNA, 15 nt, Homo sapiens
aucccaaaggacagc

SEQ ID NO: 1002689 - RNA, 15 nt, Homo sapiens
aucccaagucauuuc

SEQ ID NO: 1002690 - RNA, 23 nt, Homo sapiens
aucccacucuucuugcagcuguu

SEQ ID NO: 1002691 - RNA, 19 nt, Homo sapiens
auccccuugaggucucagc

SEQ ID NO: 1002692 - RNA, 18 nt, Homo sapiens
aucccuuaacaguuguau

SEQ ID NO: 1002693 - RNA, 13 nt, Homo sapiens
auccuaacauuca

SEQ ID NO: 1002694 - RNA, 20 nt, Homo sapiens
auccuauggcagagcauuca

SEQ ID NO: 1002695 - RNA, 20 nt, Homo sapiens
auccucccuguaacuugauc

SEQ ID NO: 1002696 - RNA, 22 nt, Homo sapiens
auccucugagugugaccaggca

SEQ ID NO: 1002697 - RNA, 13 nt, Homo sapiens
auccugaccagcu

SEQ ID NO: 1002698 - RNA, 20 nt, Homo sapiens
auccugggggaccaaugagg

SEQ ID NO: 1002699 - RNA, 22 nt, Homo sapiens
auccuugccaauagugucaucc

SEQ ID NO: 1002700 - RNA, 20 nt, Homo sapiens
auccuuuagguaagaaguuu

SEQ ID NO: 1002701 - RNA, 16 nt, Homo sapiens
aucgaaucuacuaauu

SEQ ID NO: 1002702 - RNA, 14 nt, Homo sapiens
aucgacuugccaaa

SEQ ID NO: 1002703 - RNA, 21 nt, Homo sapiens
aucgacuuguuuuugcacaug

SEQ ID NO: 1002704 - RNA, 20 nt, Homo sapiens
aucguugcccccauuucuga

SEQ ID NO: 1002705 - RNA, 14 nt, Homo sapiens
aucuaagugauaua

SEQ ID NO: 1002706 - RNA, 16 nt, Homo sapiens
aucuacuaauuccaca

SEQ ID NO: 1002707 - RNA, 21 nt, Homo sapiens
aucuacuacaaacuucaaaga

SEQ ID NO: 1002708 - RNA, 20 nt, Homo sapiens
aucuaggagaagggucucau

SEQ ID NO: 1002709 - RNA, 22 nt, Homo sapiens
aucucaaacuacuggcaauuug

SEQ ID NO: 1002710 - RNA, 20 nt, Homo sapiens
aucucaacaggccucagggc

SEQ ID NO: 1002711 - RNA, 22 nt, Homo sapiens
aucucauuggacccuuccaugg

SEQ ID NO: 1002712 - RNA, 23 nt, Homo sapiens
aucucauuggacccuuccauggu

SEQ ID NO: 1002713 - RNA, 18 nt, Homo sapiens
aucucccuuuuccaugac

SEQ ID NO: 1002714 - RNA, 21 nt, Homo sapiens
aucucugggggcugaggagca

SEQ ID NO: 1002715 - RNA, 23 nt, Homo sapiens
aucucuuguauaugaugaucugg

SEQ ID NO: 1002716 - RNA, 16 nt, Homo sapiens
aucugaggaaugagaa

SEQ ID NO: 1002717 - RNA, 16 nt, Homo sapiens
aucugaucagaacaaa

SEQ ID NO: 1002718 - RNA, 18 nt, Homo sapiens
aucugcauuuucacccca

SEQ ID NO: 1002719 - RNA, 14 nt, Homo sapiens
aucugccaugugaa

SEQ ID NO: 1002720 - RNA, 23 nt, Homo sapiens
aucugugcacugcccauggacag

SEQ ID NO: 1002721 - RNA, 20 nt, Homo sapiens
aucuguuuugaaggcaaaau

SEQ ID NO: 1002722 - RNA, 16 nt, Homo sapiens
aucuuccuguuuaaaa

SEQ ID NO: 1002723 - RNA, 16 nt, Homo sapiens
aucuucuucaccauuu

SEQ ID NO: 1002724 - RNA, 20 nt, Homo sapiens
aucuuuacaaaacuacauga

SEQ ID NO: 1002725 - RNA, 13 nt, Homo sapiens
aucuuucuaggag

SEQ ID NO: 1002726 - RNA, 16 nt, Homo sapiens
augaaagggcaaagac

SEQ ID NO: 1002727 - RNA, 16 nt, Homo sapiens
augaacucuuaaucaa

SEQ ID NO: 1002728 - RNA, 22 nt, Homo sapiens
augaagguggagggucucuagu

SEQ ID NO: 1002729 - RNA, 19 nt, Homo sapiens
caaugaauuuuauaaucug

SEQ ID NO: 1002730 - RNA, 13 nt, Homo sapiens
caaugacauuuau

SEQ ID NO: 1002731 - RNA, 21 nt, Homo sapiens
caaugacauuuauaucacaug

SEQ ID NO: 1002732 - RNA, 20 nt, Homo sapiens
caaugcaccuaaagaaaaac

SEQ ID NO: 1002733 - RNA, 13 nt, Homo sapiens
caauggaauguga

SEQ ID NO: 1002734 - RNA, 13 nt, Homo sapiens
caaugggagcuga

SEQ ID NO: 1002735 - RNA, 21 nt, Homo sapiens
caauggggccagucaggccca

SEQ ID NO: 1002736 - RNA, 23 nt, Homo sapiens
caauguaagagccuaacuccauc

SEQ ID NO: 1002737 - RNA, 21 nt, Homo sapiens
caaugucuggagaccaccagg

SEQ ID NO: 1002738 - RNA, 18 nt, Homo sapiens
caauuacucagguuugag

SEQ ID NO: 1002739 - RNA, 14 nt, Homo sapiens
caauugaaaguggg

SEQ ID NO: 1002740 - RNA, 11 nt, Homo sapiens
caauuguguag

SEQ ID NO: 1002741 - RNA, 15 nt, Homo sapiens
cacaacacaguucuc

SEQ ID NO: 1002742 - RNA, 13 nt, Homo sapiens
cacaacagugaaa

SEQ ID NO: 1002743 - RNA, 15 nt, Homo sapiens
cacaagcaugaagug

SEQ ID NO: 1002744 - RNA, 19 nt, Homo sapiens
cacaagcuucuguccugcc

SEQ ID NO: 1002745 - RNA, 19 nt, Homo sapiens
cacaauaaauggcuguaaa

SEQ ID NO: 1002746 - RNA, 14 nt, Homo sapiens
cacaaugcugaaua

SEQ ID NO: 1002747 - RNA, 20 nt, Homo sapiens
cacacacgugcgugcgagca

SEQ ID NO: 1002748 - RNA, 22 nt, Homo sapiens
cacacagcuacucuccccacga

SEQ ID NO: 1002749 - RNA, 22 nt, Homo sapiens
cacacaugaaucugcacaucug

SEQ ID NO: 1002750 - RNA, 18 nt, Homo sapiens
cacaccaaguaccaguau

SEQ ID NO: 1002751 - RNA, 17 nt, Homo sapiens
cacaccugcggcccaau

SEQ ID NO: 1002752 - RNA, 23 nt, Homo sapiens
cacaccuuuguccacugucaggg

SEQ ID NO: 1002753 - RNA, 13 nt, Homo sapiens
cacacuuugcacu

SEQ ID NO: 1002754 - RNA, 16 nt, Homo sapiens
cacacuuuguccaaug

SEQ ID NO: 1002755 - RNA, 20 nt, Homo sapiens
cacagacuauuuuuagauuu

SEQ ID NO: 1002756 - RNA, 13 nt, Homo sapiens
cacagcacagcca

SEQ ID NO: 1002757 - RNA, 13 nt, Homo sapiens
cacagcauuguau

SEQ ID NO: 1002758 - RNA, 17 nt, Homo sapiens
cacagccuccccugcca

SEQ ID NO: 1002759 - RNA, 13 nt, Homo sapiens
cacagggcaguac

SEQ ID NO: 1002760 - RNA, 15 nt, Homo sapiens
cacagugcucaaggc

SEQ ID NO: 1002761 - RNA, 23 nt, Homo sapiens
cacaguucuuugggccagacaug

SEQ ID NO: 1002762 - RNA, 22 nt, Homo sapiens
cacauaaccucucugugccauc

SEQ ID NO: 1002763 - RNA, 20 nt, Homo sapiens
cacaucagagugacauccag

SEQ ID NO: 1002764 - RNA, 17 nt, Homo sapiens
cacaucccaucgucucg

SEQ ID NO: 1002765 - RNA, 13 nt, Homo sapiens
caccaaaguucua

SEQ ID NO: 1002766 - RNA, 21 nt, Homo sapiens
caccaauguacccaccgggcc

SEQ ID NO: 1002767 - RNA, 13 nt, Homo sapiens
caccacaaacugu

SEQ ID NO: 1002768 - RNA, 18 nt, Homo sapiens
caccagggccagccucua

SEQ ID NO: 1002769 - RNA, 15 nt, Homo sapiens
caccaguuauuccuu

SEQ ID NO: 1002770 - RNA, 20 nt, Homo sapiens
cacccaggcuggagugcagu

SEQ ID NO: 1002771 - RNA, 19 nt, Homo sapiens
cacccaugaaccuacuacc

SEQ ID NO: 1002772 - RNA, 18 nt, Homo sapiens
cacccuggaggcaccugg

SEQ ID NO: 1002773 - RNA, 13 nt, Homo sapiens
cacccuguggucu

SEQ ID NO: 1002774 - RNA, 23 nt, Homo sapiens
caccgagugccuucaacacagcu

SEQ ID NO: 1002775 - RNA, 17 nt, Homo sapiens
caccguucugugcacaa

SEQ ID NO: 1002776 - RNA, 20 nt, Homo sapiens
caccuaauccaggcagaucc

SEQ ID NO: 1002777 - RNA, 13 nt, Homo sapiens
caccuagacugua

SEQ ID NO: 1002778 - RNA, 15 nt, Homo sapiens
caccuccucuaaggu

SEQ ID NO: 1002779 - RNA, 20 nt, Homo sapiens
caccugcagcccauggugag

SEQ ID NO: 1002780 - RNA, 19 nt, Homo sapiens
caccuggcucucaccucua

SEQ ID NO: 1002781 - RNA, 21 nt, Homo sapiens
caccuuccagcuccuguaaca

SEQ ID NO: 1002782 - RNA, 21 nt, Homo sapiens
caccuugcuccuccuucugcu

SEQ ID NO: 1002783 - RNA, 16 nt, Homo sapiens
caccuuggcaccagac

SEQ ID NO: 1002784 - RNA, 11 nt, Homo sapiens
cacgacacugc

SEQ ID NO: 1002785 - RNA, 14 nt, Homo sapiens
cacguuaccauuua

SEQ ID NO: 1002786 - RNA, 16 nt, Homo sapiens
cacuaacaaacucuga

SEQ ID NO: 1002787 - RNA, 23 nt, Homo sapiens
cacuacacaggaggcugaggcag

SEQ ID NO: 1002788 - RNA, 13 nt, Homo sapiens
cacuagacaagcc

SEQ ID NO: 1002789 - RNA, 12 nt, Homo sapiens
cacucagucucu

SEQ ID NO: 1002790 - RNA, 23 nt, Homo sapiens
cacuccgagaggugggccagucu

SEQ ID NO: 1002791 - RNA, 15 nt, Homo sapiens
cacucuggagcauuu

SEQ ID NO: 1002792 - RNA, 16 nt, Homo sapiens
cacucuuuugcuuuau

SEQ ID NO: 1002793 - RNA, 14 nt, Homo sapiens
cacugcagugcuga

SEQ ID NO: 1002794 - RNA, 15 nt, Homo sapiens
cacugccugcuccca

SEQ ID NO: 1002795 - RNA, 12 nt, Homo sapiens
cacugccuucac

SEQ ID NO: 1002796 - RNA, 15 nt, Homo sapiens
cacugcuugaggaaa

SEQ ID NO: 1002797 - RNA, 15 nt, Homo sapiens
cacuggcaccaagug

SEQ ID NO: 1002798 - RNA, 22 nt, Homo sapiens
cacuggccccucaaaucgucca

SEQ ID NO: 1002799 - RNA, 17 nt, Homo sapiens
cacuggcguuacugcuu

SEQ ID NO: 1002800 - RNA, 22 nt, Homo sapiens
cacugggugguggccugguccc

SEQ ID NO: 1002801 - RNA, 13 nt, Homo sapiens
cacuggucuguag

SEQ ID NO: 1002802 - RNA, 21 nt, Homo sapiens
cacuguacuaucagguucaca

SEQ ID NO: 1002803 - RNA, 12 nt, Homo sapiens
cacugugugaau

SEQ ID NO: 1002804 - RNA, 19 nt, Homo sapiens
cacuguuuauacacugugu

SEQ ID NO: 1002805 - RNA, 22 nt, Homo sapiens
cacuuaaacuugcaucacuuaa

SEQ ID NO: 1002806 - RNA, 15 nt, Homo sapiens
cacuuacauuuacaa

SEQ ID NO: 1002807 - RNA, 23 nt, Homo sapiens
cacuuauaagaaagaucaaagac

SEQ ID NO: 1002808 - RNA, 18 nt, Homo sapiens
cacuuauagccucugucu

SEQ ID NO: 1002809 - RNA, 23 nt, Homo sapiens
cacuucaaacuacuuugcugcua

SEQ ID NO: 1002810 - RNA, 20 nt, Homo sapiens
cacuucucaggacacaggcc

SEQ ID NO: 1002811 - RNA, 21 nt, Homo sapiens
cacuucugacagccucaguga

SEQ ID NO: 1002812 - RNA, 18 nt, Homo sapiens
cacuuuacaaaaguauua

SEQ ID NO: 1002813 - RNA, 18 nt, Homo sapiens
cagaaaaaugguggucau

SEQ ID NO: 1002814 - RNA, 19 nt, Homo sapiens
cagaaacagugcaaggaag

SEQ ID NO: 1002815 - RNA, 20 nt, Homo sapiens
cagaaagccugggugacauu

SEQ ID NO: 1002816 - RNA, 22 nt, Homo sapiens
cagaacaccuaugcaaagauga

SEQ ID NO: 1002817 - RNA, 17 nt, Homo sapiens
cagaacacuuauguuau

SEQ ID NO: 1002818 - RNA, 19 nt, Homo sapiens
cagaacacuuauguuauac

SEQ ID NO: 1002819 - RNA, 20 nt, Homo sapiens
cagaaccggagagccagcua

SEQ ID NO: 1002820 - RNA, 15 nt, Homo sapiens
cagaacuugugcccu

SEQ ID NO: 1002821 - RNA, 16 nt, Homo sapiens
cagaaggcaaacccau

SEQ ID NO: 1002822 - RNA, 16 nt, Homo sapiens
cagaagggggucucuu

SEQ ID NO: 1002823 - RNA, 13 nt, Homo sapiens
cagaagugugacu

SEQ ID NO: 1002824 - RNA, 14 nt, Homo sapiens
cagaaugagaccaa

SEQ ID NO: 1002825 - RNA, 13 nt, Homo sapiens
cagaauuacugua

SEQ ID NO: 1002826 - RNA, 14 nt, Homo sapiens
cagacacccaggac

SEQ ID NO: 1002827 - RNA, 22 nt, Homo sapiens
cagacauaaaggaaaagacaca

SEQ ID NO: 1002828 - RNA, 20 nt, Homo sapiens
cagacauacauuucucauac

SEQ ID NO: 1002829 - RNA, 12 nt, Homo sapiens
cagaccacugau

SEQ ID NO: 1002830 - RNA, 21 nt, Homo sapiens
cagaccuccaccuccuccaga

SEQ ID NO: 1002831 - RNA, 12 nt, Homo sapiens
cagagaagccag

SEQ ID NO: 1002832 - RNA, 15 nt, Homo sapiens
cagagaagccagcuu

SEQ ID NO: 1002833 - RNA, 16 nt, Homo sapiens
cauuuggcaaugccau

SEQ ID NO: 1002834 - RNA, 15 nt, Homo sapiens
cauuuguuuaaaaag

SEQ ID NO: 1002835 - RNA, 18 nt, Homo sapiens
cauuuguuuuguuuacag

SEQ ID NO: 1002836 - RNA, 15 nt, Homo sapiens
cauuuucauugauga

SEQ ID NO: 1002837 - RNA, 16 nt, Homo sapiens
cauuuucucucaggug

SEQ ID NO: 1002838 - RNA, 21 nt, Homo sapiens
cauuuuuauaaaaaugagugc

SEQ ID NO: 1002839 - RNA, 18 nt, Homo sapiens
cauuuuuuuuucaaucaa

SEQ ID NO: 1002840 - RNA, 19 nt, Homo sapiens
cauuuuuuuuucaaucaac

SEQ ID NO: 1002841 - RNA, 15 nt, Homo sapiens
ccaaaaauuacuuug

SEQ ID NO: 1002842 - RNA, 13 nt, Homo sapiens
ccaaaagaagccc

SEQ ID NO: 1002843 - RNA, 16 nt, Homo sapiens
ccaaacccaccugcua

SEQ ID NO: 1002844 - RNA, 14 nt, Homo sapiens
ccaaagaccaucug

SEQ ID NO: 1002845 - RNA, 10 nt, Homo sapiens
ccaaagggaa

SEQ ID NO: 1002846 - RNA, 20 nt, Homo sapiens
ccaaaguccuuuuuuuccau

SEQ ID NO: 1002847 - RNA, 11 nt, Homo sapiens
ccaacacaaag

SEQ ID NO: 1002848 - RNA, 15 nt, Homo sapiens
ccaaccuggacuugu

SEQ ID NO: 1002849 - RNA, 14 nt, Homo sapiens
ccaacucuugcaca

SEQ ID NO: 1002850 - RNA, 12 nt, Homo sapiens
ccaacugaccac

SEQ ID NO: 1002851 - RNA, 20 nt, Homo sapiens
ccaacuuuccccacguuaaa

SEQ ID NO: 1002852 - RNA, 19 nt, Homo sapiens
ccaagaauccacauuucua

SEQ ID NO: 1002853 - RNA, 20 nt, Homo sapiens
ccaagaauguuaugugcaag

SEQ ID NO: 1002854 - RNA, 22 nt, Homo sapiens
ccaagcaccaccaaacacagug

SEQ ID NO: 1002855 - RNA, 18 nt, Homo sapiens
ccaaggccuccugugacu

SEQ ID NO: 1002856 - RNA, 19 nt, Homo sapiens
ccaagggauggacaucuug

SEQ ID NO: 1002857 - RNA, 22 nt, Homo sapiens
ccaagggauggacaucuuguca

SEQ ID NO: 1002858 - RNA, 18 nt, Homo sapiens
ccaauagugucauccuca

SEQ ID NO: 1002859 - RNA, 16 nt, Homo sapiens
ccaauauaacuaucuc

SEQ ID NO: 1002860 - RNA, 16 nt, Homo sapiens
ccaauggaaugugaug

SEQ ID NO: 1002861 - RNA, 19 nt, Homo sapiens
ccaauugcuggaguacuua

SEQ ID NO: 1002862 - RNA, 21 nt, Homo sapiens
ccacaauagcagacaguguuu

SEQ ID NO: 1002863 - RNA, 15 nt, Homo sapiens
ccacacagugcucaa

SEQ ID NO: 1002864 - RNA, 21 nt, Homo sapiens
ccacaccugcggcccaaucca

SEQ ID NO: 1002865 - RNA, 23 nt, Homo sapiens
ccacaccugcggcccaauccaag

SEQ ID NO: 1002866 - RNA, 12 nt, Homo sapiens
ccacacucagca

SEQ ID NO: 1002867 - RNA, 15 nt, Homo sapiens
ccacagcugugcaug

SEQ ID NO: 1002868 - RNA, 19 nt, Homo sapiens
ccacagcugugcaugcuca

SEQ ID NO: 1002869 - RNA, 22 nt, Homo sapiens
ccacaggcaccagcaaaacaac

SEQ ID NO: 1002870 - RNA, 22 nt, Homo sapiens
ccacauugcuuuucacauccau

SEQ ID NO: 1002871 - RNA, 19 nt, Homo sapiens
ccaccaaaugugcuuugag

SEQ ID NO: 1002872 - RNA, 23 nt, Homo sapiens
ccaccagaugcugaaaauguccu

SEQ ID NO: 1002873 - RNA, 18 nt, Homo sapiens
ccaccaguaugacaguau

SEQ ID NO: 1002874 - RNA, 14 nt, Homo sapiens
ccacccccagcuca

SEQ ID NO: 1002875 - RNA, 21 nt, Homo sapiens
ccacccuggugggccaacaaa

SEQ ID NO: 1002876 - RNA, 14 nt, Homo sapiens
ccaccgcccagaga

SEQ ID NO: 1002877 - RNA, 20 nt, Homo sapiens
ccaccuaauccuucuggcaa

SEQ ID NO: 1002878 - RNA, 18 nt, Homo sapiens
ccaccuggggcuggggau

SEQ ID NO: 1002879 - RNA, 13 nt, Homo sapiens
ccaccugucucag

SEQ ID NO: 1002880 - RNA, 15 nt, Homo sapiens
ccacgaggugcaaca

SEQ ID NO: 1002881 - RNA, 13 nt, Homo sapiens
ccacucaaaauag

SEQ ID NO: 1002882 - RNA, 21 nt, Homo sapiens
ccacugcccccugcugccaug

SEQ ID NO: 1002883 - RNA, 13 nt, Homo sapiens
ccacuggucugua

SEQ ID NO: 1002884 - RNA, 15 nt, Homo sapiens
ccacuuaucugauca

SEQ ID NO: 1002885 - RNA, 15 nt, Homo sapiens
ccacuucaccaucca

SEQ ID NO: 1002886 - RNA, 18 nt, Homo sapiens
ccacuugccugugcuaca

SEQ ID NO: 1002887 - RNA, 20 nt, Homo sapiens
ccacuugccugugcuacaau

SEQ ID NO: 1002888 - RNA, 24 nt, Homo sapiens
ccacuugccugugcuacaauucau

SEQ ID NO: 1002889 - RNA, 13 nt, Homo sapiens
ccagaaagcaguu

SEQ ID NO: 1002890 - RNA, 19 nt, Homo sapiens
ccagaaagcuaggucgugg

SEQ ID NO: 1002891 - RNA, 11 nt, Homo sapiens
ccagaccucca

SEQ ID NO: 1002892 - RNA, 15 nt, Homo sapiens
ccagacucagacauu

SEQ ID NO: 1002893 - RNA, 22 nt, Homo sapiens
ccagagccaggggggugaggag

SEQ ID NO: 1002894 - RNA, 20 nt, Homo sapiens
ccagagccuggggcucuaac

SEQ ID NO: 1002895 - RNA, 17 nt, Homo sapiens
ccagaggggccugccac

SEQ ID NO: 1002896 - RNA, 22 nt, Homo sapiens
ccagaggggccugccaccugga

SEQ ID NO: 1002897 - RNA, 10 nt, Homo sapiens
ccagcacuuc

SEQ ID NO: 1002898 - RNA, 14 nt, Homo sapiens
ccagcaguacucag

SEQ ID NO: 1002899 - RNA, 17 nt, Homo sapiens
ccagccagggcucaauc

SEQ ID NO: 1002900 - RNA, 14 nt, Homo sapiens
ccagccucccacaa

SEQ ID NO: 1002901 - RNA, 15 nt, Homo sapiens
ccagccuggcccacc

SEQ ID NO: 1002902 - RNA, 23 nt, Homo sapiens
ccagccugggcaacacagugaga

SEQ ID NO: 1002903 - RNA, 18 nt, Homo sapiens
ccagcgagggcgugucua

SEQ ID NO: 1002904 - RNA, 20 nt, Homo sapiens
ccagcuaauaacugaucucg

SEQ ID NO: 1002905 - RNA, 20 nt, Homo sapiens
ccagcuccaaccugcaaaga

SEQ ID NO: 1002906 - RNA, 16 nt, Homo sapiens
ccagcuccaaggggaa

SEQ ID NO: 1002907 - RNA, 23 nt, Homo sapiens
ccagcugggucaggcagggugca

SEQ ID NO: 1002908 - RNA, 21 nt, Homo sapiens
ccaggaacagcaaaugcaaaa

SEQ ID NO: 1002909 - RNA, 22 nt, Homo sapiens
ccaggacccugaaggggccaug

SEQ ID NO: 1002910 - RNA, 18 nt, Homo sapiens
ccaggagaagcucagcug

SEQ ID NO: 1002911 - RNA, 19 nt, Homo sapiens
ccaggcuuuguugcuuccg

SEQ ID NO: 1002912 - RNA, 21 nt, Homo sapiens
ccagggagagcccaggagcuc

SEQ ID NO: 1002913 - RNA, 17 nt, Homo sapiens
ccagggaggcugguccu

SEQ ID NO: 1002914 - RNA, 20 nt, Homo sapiens
ccaggucacggggcaccaaa

SEQ ID NO: 1002915 - RNA, 15 nt, Homo sapiens
ccaggucagccacug

SEQ ID NO: 1002916 - RNA, 16 nt, Homo sapiens
ccaguaauugguccga

SEQ ID NO: 1002917 - RNA, 13 nt, Homo sapiens
ccaguaucgcuca

SEQ ID NO: 1002918 - RNA, 15 nt, Homo sapiens
ccagucauucuggga

SEQ ID NO: 1002919 - RNA, 15 nt, Homo sapiens
ccaguucacccugau

SEQ ID NO: 1002920 - RNA, 19 nt, Homo sapiens
ccaguucauugcacuuuga

SEQ ID NO: 1002921 - RNA, 14 nt, Homo sapiens
ccauaauguuacau

SEQ ID NO: 1002922 - RNA, 14 nt, Homo sapiens
ccauaguauaauca

SEQ ID NO: 1002923 - RNA, 12 nt, Homo sapiens
ccauauuuucac

SEQ ID NO: 1002924 - RNA, 15 nt, Homo sapiens
ccaucaccuacucac

SEQ ID NO: 1002925 - RNA, 19 nt, Homo sapiens
ccauccaccccguugcuca

SEQ ID NO: 1002926 - RNA, 16 nt, Homo sapiens
ccauccccaggcaccu

SEQ ID NO: 1002927 - RNA, 16 nt, Homo sapiens
ccauccugaccagcug

SEQ ID NO: 1002928 - RNA, 22 nt, Homo sapiens
ccauccuugccaauagugucau

SEQ ID NO: 1002929 - RNA, 13 nt, Homo sapiens
ccaucugcuccug

SEQ ID NO: 1002930 - RNA, 23 nt, Homo sapiens
ccaucugggcuccuccagggugu

SEQ ID NO: 1002931 - RNA, 22 nt, Homo sapiens
ccaugagagaaggaggggagca

SEQ ID NO: 1002932 - RNA, 23 nt, Homo sapiens
ccaugagagaaggaggggagcag

SEQ ID NO: 1002933 - RNA, 22 nt, Homo sapiens
ccaugauggcaacagaucugga

SEQ ID NO: 1002934 - RNA, 13 nt, Homo sapiens
ccaugcccggcua

SEQ ID NO: 1002935 - RNA, 13 nt, Homo sapiens
ccaugcugugcug

SEQ ID NO: 1002936 - RNA, 14 nt, Homo sapiens
ccauggacaggcug

SEQ ID NO: 1002937 - RNA, 19 nt, Homo sapiens
gcccccugaccacucagag

SEQ ID NO: 1002938 - RNA, 17 nt, Homo sapiens
gccccuccccuccaaaa

SEQ ID NO: 1002939 - RNA, 14 nt, Homo sapiens
gccccucucaccaa

SEQ ID NO: 1002940 - RNA, 14 nt, Homo sapiens
gccccucugaccug

SEQ ID NO: 1002941 - RNA, 13 nt, Homo sapiens
gcccuaucaccca

SEQ ID NO: 1002942 - RNA, 23 nt, Homo sapiens
gcccucgugguggaaacuuuucu

SEQ ID NO: 1002943 - RNA, 16 nt, Homo sapiens
gcccugcaccaugcug

SEQ ID NO: 1002944 - RNA, 18 nt, Homo sapiens
gcccugcagggaguaccg

SEQ ID NO: 1002945 - RNA, 17 nt, Homo sapiens
gcccugcucuuccucag

SEQ ID NO: 1002946 - RNA, 18 nt, Homo sapiens
gcccuggggccuguacug

SEQ ID NO: 1002947 - RNA, 16 nt, Homo sapiens
gcccugucagcaugaa

SEQ ID NO: 1002948 - RNA, 18 nt, Homo sapiens
gcccugucauccagcuca

SEQ ID NO: 1002949 - RNA, 17 nt, Homo sapiens
gcccuuccaaacucuuc

SEQ ID NO: 1002950 - RNA, 17 nt, Homo sapiens
gcccuugcuuaccucuc

SEQ ID NO: 1002951 - RNA, 15 nt, Homo sapiens
gcccuuuccaagcuu

SEQ ID NO: 1002952 - RNA, 19 nt, Homo sapiens
gccggaucucgaggcuugc

SEQ ID NO: 1002953 - RNA, 17 nt, Homo sapiens
gccgugagcauguuugg

SEQ ID NO: 1002954 - RNA, 22 nt, Homo sapiens
gccguggcugcugugggaaaug

SEQ ID NO: 1002955 - RNA, 22 nt, Homo sapiens
gccguggggccgccgccucuuu

SEQ ID NO: 1002956 - RNA, 16 nt, Homo sapiens
gccuauggagagcccu

SEQ ID NO: 1002957 - RNA, 14 nt, Homo sapiens
gccucaaccuccca

SEQ ID NO: 1002958 - RNA, 21 nt, Homo sapiens
gccucaaccucccaagcaguu

SEQ ID NO: 1002959 - RNA, 16 nt, Homo sapiens
gccucaccacggacca

SEQ ID NO: 1002960 - RNA, 21 nt, Homo sapiens
gccuccccucuccuuccugug

SEQ ID NO: 1002961 - RNA, 18 nt, Homo sapiens
gccucccugaagccuuug

SEQ ID NO: 1002962 - RNA, 16 nt, Homo sapiens
gccucgaaacacagaa

SEQ ID NO: 1002963 - RNA, 22 nt, Homo sapiens
gccugaggcaauuagacacuuu

SEQ ID NO: 1002964 - RNA, 21 nt, Homo sapiens
gccugagguuugccagcauuu

SEQ ID NO: 1002965 - RNA, 18 nt, Homo sapiens
gccugagucgugaccugc

SEQ ID NO: 1002966 - RNA, 18 nt, Homo sapiens
gccugcugcugagaaccu

SEQ ID NO: 1002967 - RNA, 13 nt, Homo sapiens
gccugcuggagag

SEQ ID NO: 1002968 - RNA, 16 nt, Homo sapiens
gccuggccuccugccu

SEQ ID NO: 1002969 - RNA, 21 nt, Homo sapiens
gccugggaggggcaauccuca

SEQ ID NO: 1002970 - RNA, 13 nt, Homo sapiens
gccuggugugauu

SEQ ID NO: 1002971 - RNA, 15 nt, Homo sapiens
gccugucuagcucau

SEQ ID NO: 1002972 - RNA, 17 nt, Homo sapiens
gccuguguagcugugac

SEQ ID NO: 1002973 - RNA, 15 nt, Homo sapiens
gccuguguucuuccu

SEQ ID NO: 1002974 - RNA, 16 nt, Homo sapiens
gccuugaaaccaccuu

SEQ ID NO: 1002975 - RNA, 20 nt, Homo sapiens
gccuugugugaacucaccaa

SEQ ID NO: 1002976 - RNA, 13 nt, Homo sapiens
gccuuugagcuca

SEQ ID NO: 1002977 - RNA, 19 nt, Homo sapiens
gccuuugucagaacuagaa

SEQ ID NO: 1002978 - RNA, 16 nt, Homo sapiens
gcgagagaaagggagu

SEQ ID NO: 1002979 - RNA, 19 nt, Homo sapiens
gcgagcgcccagcuccuga

SEQ ID NO: 1002980 - RNA, 21 nt, Homo sapiens
gcgccaggauggaacacggcc

SEQ ID NO: 1002981 - RNA, 20 nt, Homo sapiens
gcgccaggcugaccacagca

SEQ ID NO: 1002982 - RNA, 17 nt, Homo sapiens
gcgcgaucucggcucac

SEQ ID NO: 1002983 - RNA, 20 nt, Homo sapiens
gcgcuguuuucucagcucca

SEQ ID NO: 1002984 - RNA, 16 nt, Homo sapiens
gcgggcauggcgugga

SEQ ID NO: 1002985 - RNA, 12 nt, Homo sapiens
gcgugacaauaa

SEQ ID NO: 1002986 - RNA, 16 nt, Homo sapiens
gcgugcgagcacacac

SEQ ID NO: 1002987 - RNA, 14 nt, Homo sapiens
gcguuuucauuugu

SEQ ID NO: 1002988 - RNA, 17 nt, Homo sapiens
gcuaagauaccaaaacc

SEQ ID NO: 1002989 - RNA, 23 nt, Homo sapiens
gcuaauucuacucacagugcuuu

SEQ ID NO: 1002990 - RNA, 22 nt, Homo sapiens
gcuacuacgguugaucuugcaa

SEQ ID NO: 1002991 - RNA, 23 nt, Homo sapiens
gcuacugccgucagugcugugcu

SEQ ID NO: 1002992 - RNA, 17 nt, Homo sapiens
gcuacuggggaaacugg

SEQ ID NO: 1002993 - RNA, 14 nt, Homo sapiens
gcuauaaagcagua

SEQ ID NO: 1002994 - RNA, 22 nt, Homo sapiens
gcuaugugaagaguaagucaac

SEQ ID NO: 1002995 - RNA, 22 nt, Homo sapiens
gcucagccagcacuuguccagc

SEQ ID NO: 1002996 - RNA, 16 nt, Homo sapiens
gcucagcccugcacca

SEQ ID NO: 1002997 - RNA, 15 nt, Homo sapiens
gcucagggaccaugg

SEQ ID NO: 1002998 - RNA, 19 nt, Homo sapiens
gcucagucgcuagcauuuc

SEQ ID NO: 1002999 - RNA, 16 nt, Homo sapiens
gcucauagaucagcaa

SEQ ID NO: 1003000 - RNA, 13 nt, Homo sapiens
gcuccacugaaca

SEQ ID NO: 1003001 - RNA, 13 nt, Homo sapiens
gcuccauguagaa

SEQ ID NO: 1003002 - RNA, 20 nt, Homo sapiens
gcuccauguagaagccacua

SEQ ID NO: 1003003 - RNA, 22 nt, Homo sapiens
gcucccacaggcaccagcaaaa

SEQ ID NO: 1003004 - RNA, 14 nt, Homo sapiens
gcuccccacucugc

SEQ ID NO: 1003005 - RNA, 21 nt, Homo sapiens
gcuccccuccccaacugacca

SEQ ID NO: 1003006 - RNA, 18 nt, Homo sapiens
gcucccugacagcaccug

SEQ ID NO: 1003007 - RNA, 18 nt, Homo sapiens
gcuccggaggacucacca

SEQ ID NO: 1003008 - RNA, 16 nt, Homo sapiens
gcucgcuuugagugac

SEQ ID NO: 1003009 - RNA, 15 nt, Homo sapiens
gcucucuuugcccag

SEQ ID NO: 1003010 - RNA, 14 nt, Homo sapiens
gcucugaacacgaa

SEQ ID NO: 1003011 - RNA, 14 nt, Homo sapiens
gcucugagcuguca

SEQ ID NO: 1003012 - RNA, 16 nt, Homo sapiens
gcucuuagcagcuucc

SEQ ID NO: 1003013 - RNA, 22 nt, Homo sapiens
gcucuuucucugccagugacag

SEQ ID NO: 1003014 - RNA, 20 nt, Homo sapiens
gcugaaaggggaagaccuga

SEQ ID NO: 1003015 - RNA, 23 nt, Homo sapiens
gcugacaugaagcuguuguguga

SEQ ID NO: 1003016 - RNA, 20 nt, Homo sapiens
gcugagauugcaccacugca

SEQ ID NO: 1003017 - RNA, 14 nt, Homo sapiens
gcugagcgccagga

SEQ ID NO: 1003018 - RNA, 13 nt, Homo sapiens
gcugagcucugag

SEQ ID NO: 1003019 - RNA, 21 nt, Homo sapiens
gcugaggcuggcacaggacau

SEQ ID NO: 1003020 - RNA, 19 nt, Homo sapiens
gcugagguuugcacuuccu

SEQ ID NO: 1003021 - RNA, 21 nt, Homo sapiens
gcugaugaacucuuaaucaaa

SEQ ID NO: 1003022 - RNA, 16 nt, Homo sapiens
gcugcaagguacucug

SEQ ID NO: 1003023 - RNA, 16 nt, Homo sapiens
gcugccucuaccugac

SEQ ID NO: 1003024 - RNA, 17 nt, Homo sapiens
gcugccugagucgugac

SEQ ID NO: 1003025 - RNA, 18 nt, Homo sapiens
gcugcgagagaaagggag

SEQ ID NO: 1003026 - RNA, 15 nt, Homo sapiens
gcugcugagaaccug

SEQ ID NO: 1003027 - RNA, 13 nt, Homo sapiens
gcugcuggggaag

SEQ ID NO: 1003028 - RNA, 17 nt, Homo sapiens
gcugcuggggaagacag

SEQ ID NO: 1003029 - RNA, 21 nt, Homo sapiens
gcugcugugggaaaugguacu

SEQ ID NO: 1003030 - RNA, 14 nt, Homo sapiens
gcugcuuccagugu

SEQ ID NO: 1003031 - RNA, 19 nt, Homo sapiens
gcugcuuccuccuggaaau

SEQ ID NO: 1003032 - RNA, 22 nt, Homo sapiens
gcuggagauauguaaagaaaaa

SEQ ID NO: 1003033 - RNA, 17 nt, Homo sapiens
gcuggccgcugugccag

SEQ ID NO: 1003034 - RNA, 22 nt, Homo sapiens
gcugggaaaugagaugaccacu

SEQ ID NO: 1003035 - RNA, 14 nt, Homo sapiens
gcugggccuggucu

SEQ ID NO: 1003036 - RNA, 17 nt, Homo sapiens
gcugggcucagugaagu

SEQ ID NO: 1003037 - RNA, 11 nt, Homo sapiens
gcuggggcuuu

SEQ ID NO: 1003038 - RNA, 23 nt, Homo sapiens
gcugggucaggcagggugcagua

SEQ ID NO: 1003039 - RNA, 17 nt, Homo sapiens
gcugguguagcuacaga

SEQ ID NO: 1003040 - RNA, 18 nt, Homo sapiens
gcugucaucugugcacug

SEQ ID NO: 1003041 - RNA, 14 nt, Homo sapiens
uaacgcgucuuccu

SEQ ID NO: 1003042 - RNA, 14 nt, Homo sapiens
uaacggaccaaagc

SEQ ID NO: 1003043 - RNA, 17 nt, Homo sapiens
uaacuggaaaacagaac

SEQ ID NO: 1003044 - RNA, 19 nt, Homo sapiens
uaacuuuguuuuauuuuca

SEQ ID NO: 1003045 - RNA, 14 nt, Homo sapiens
uaagaaacauuuau

SEQ ID NO: 1003046 - RNA, 21 nt, Homo sapiens
uaagaagccuuaauuugcaca

SEQ ID NO: 1003047 - RNA, 14 nt, Homo sapiens
uaagaauagaaaua

SEQ ID NO: 1003048 - RNA, 22 nt, Homo sapiens
uaagaaucuuuagagaaguaua

SEQ ID NO: 1003049 - RNA, 18 nt, Homo sapiens
uaagacaugauuuccuug

SEQ ID NO: 1003050 - RNA, 21 nt, Homo sapiens
uaagacaugauuuccuugaau

SEQ ID NO: 1003051 - RNA, 13 nt, Homo sapiens
uaagaccuggcag

SEQ ID NO: 1003052 - RNA, 14 nt, Homo sapiens
uaagagcucaggau

SEQ ID NO: 1003053 - RNA, 21 nt, Homo sapiens
uaagagcucaggaugagggaa

SEQ ID NO: 1003054 - RNA, 24 nt, Homo sapiens
uaagaguggaaccaacacuaacau

SEQ ID NO: 1003055 - RNA, 17 nt, Homo sapiens
uaagauuauagauucua

SEQ ID NO: 1003056 - RNA, 11 nt, Homo sapiens
uaagauucuaa

SEQ ID NO: 1003057 - RNA, 13 nt, Homo sapiens
uaagauucuagau

SEQ ID NO: 1003058 - RNA, 20 nt, Homo sapiens
uaagcagaaagugccuuuca

SEQ ID NO: 1003059 - RNA, 14 nt, Homo sapiens
uaagcaucugccau

SEQ ID NO: 1003060 - RNA, 21 nt, Homo sapiens
uaagcaucugccaucugcuuu

SEQ ID NO: 1003061 - RNA, 17 nt, Homo sapiens
uaagcccagugcacuga

SEQ ID NO: 1003062 - RNA, 13 nt, Homo sapiens
uaaggaacaacgu

SEQ ID NO: 1003063 - RNA, 20 nt, Homo sapiens
uaaggguuaguuuacaauca

SEQ ID NO: 1003064 - RNA, 17 nt, Homo sapiens
uaagguucuaaggccua

SEQ ID NO: 1003065 - RNA, 20 nt, Homo sapiens
uaaguauuuuccuguuguca

SEQ ID NO: 1003066 - RNA, 22 nt, Homo sapiens
uaagucaaccugccugacauuu

SEQ ID NO: 1003067 - RNA, 11 nt, Homo sapiens
uaagugauaua

SEQ ID NO: 1003068 - RNA, 13 nt, Homo sapiens
uaauaaacugugu

SEQ ID NO: 1003069 - RNA, 12 nt, Homo sapiens
uaauaacuuauc

SEQ ID NO: 1003070 - RNA, 14 nt, Homo sapiens
uaauaacuuaucua

SEQ ID NO: 1003071 - RNA, 15 nt, Homo sapiens
uaauacaucaaagag

SEQ ID NO: 1003072 - RNA, 18 nt, Homo sapiens
uaauacauuauauuucua

SEQ ID NO: 1003073 - RNA, 19 nt, Homo sapiens
uaauacuucuuguguguau

SEQ ID NO: 1003074 - RNA, 23 nt, Homo sapiens
uaauagagauuaaaaacaacaaa

SEQ ID NO: 1003075 - RNA, 17 nt, Homo sapiens
uaauauaagcugccaua

SEQ ID NO: 1003076 - RNA, 21 nt, Homo sapiens
uaauauccuaaacaucauuca

SEQ ID NO: 1003077 - RNA, 20 nt, Homo sapiens
uaauaugaguaauacaucaa

SEQ ID NO: 1003078 - RNA, 16 nt, Homo sapiens
uaaucacucuaauuaa

SEQ ID NO: 1003079 - RNA, 22 nt, Homo sapiens
uaaucacucuaauuaauuguaa

SEQ ID NO: 1003080 - RNA, 22 nt, Homo sapiens
uaaucagggaggucauuuuggu

SEQ ID NO: 1003081 - RNA, 23 nt, Homo sapiens
uaaucaucaaguaauacaaacua

SEQ ID NO: 1003082 - RNA, 14 nt, Homo sapiens
uaaucuaugaauuc

SEQ ID NO: 1003083 - RNA, 14 nt, Homo sapiens
uaaugaaacaaaga

SEQ ID NO: 1003084 - RNA, 22 nt, Homo sapiens
uaaugaaauaauguacaucugg

SEQ ID NO: 1003085 - RNA, 10 nt, Homo sapiens
uaaugcugug

SEQ ID NO: 1003086 - RNA, 22 nt, Homo sapiens
uaaugcuuugaaauugaaccuu

SEQ ID NO: 1003087 - RNA, 19 nt, Homo sapiens
uaaugguguagaacacuaa

SEQ ID NO: 1003088 - RNA, 12 nt, Homo sapiens
uaauguacaaaa

SEQ ID NO: 1003089 - RNA, 14 nt, Homo sapiens
uaauguacaucugg

SEQ ID NO: 1003090 - RNA, 23 nt, Homo sapiens
uaauguuuuuugccacagcuuuu

SEQ ID NO: 1003091 - RNA, 14 nt, Homo sapiens
uaauuauguagcuc

SEQ ID NO: 1003092 - RNA, 19 nt, Homo sapiens
uaauucauaaucacucuaa

SEQ ID NO: 1003093 - RNA, 16 nt, Homo sapiens
uaauucggauuugcca

SEQ ID NO: 1003094 - RNA, 12 nt, Homo sapiens
uaauugcuuauu

SEQ ID NO: 1003095 - RNA, 15 nt, Homo sapiens
uaauuguaaucugaa

SEQ ID NO: 1003096 - RNA, 15 nt, Homo sapiens
uaauuuagacuugga

SEQ ID NO: 1003097 - RNA, 18 nt, Homo sapiens
uaauuuuguaauguauca

SEQ ID NO: 1003098 - RNA, 18 nt, Homo sapiens
uacaaaacuacaugagaa

SEQ ID NO: 1003099 - RNA, 23 nt, Homo sapiens
uacaaaccauuuuguuauugacu

SEQ ID NO: 1003100 - RNA, 14 nt, Homo sapiens
uacaaauacuaaaa

SEQ ID NO: 1003101 - RNA, 17 nt, Homo sapiens
uacaaccugaauacccu

SEQ ID NO: 1003102 - RNA, 19 nt, Homo sapiens
uacaaucagccacauucua

SEQ ID NO: 1003103 - RNA, 13 nt, Homo sapiens
uacaauucauugu

SEQ ID NO: 1003104 - RNA, 12 nt, Homo sapiens
uacaauugugag

SEQ ID NO: 1003105 - RNA, 19 nt, Homo sapiens
uacacacacacgcacacaa

SEQ ID NO: 1003106 - RNA, 21 nt, Homo sapiens
uacacacccugcauaucauaa

SEQ ID NO: 1003107 - RNA, 20 nt, Homo sapiens
uacacuguguaaauacccau

SEQ ID NO: 1003108 - RNA, 19 nt, Homo sapiens
uacacuuuuucucuuucca

SEQ ID NO: 1003109 - RNA, 20 nt, Homo sapiens
uacacuuuuuggaagugaaa

SEQ ID NO: 1003110 - RNA, 14 nt, Homo sapiens
uacagaacucuuuc

SEQ ID NO: 1003111 - RNA, 19 nt, Homo sapiens
uacagaaucaaaugcaauu

SEQ ID NO: 1003112 - RNA, 13 nt, Homo sapiens
uacagagaagcca

SEQ ID NO: 1003113 - RNA, 18 nt, Homo sapiens
uacagagaagccaucacc

SEQ ID NO: 1003114 - RNA, 22 nt, Homo sapiens
uacagagaagccaucaccucag

SEQ ID NO: 1003115 - RNA, 13 nt, Homo sapiens
uacagagaaguca

SEQ ID NO: 1003116 - RNA, 20 nt, Homo sapiens
uacagcuaacccucacaagc

SEQ ID NO: 1003117 - RNA, 12 nt, Homo sapiens
uacagcuguaac

SEQ ID NO: 1003118 - RNA, 15 nt, Homo sapiens
uacaguguuuauccu

SEQ ID NO: 1003119 - RNA, 16 nt, Homo sapiens
uacauccaaagcagac

SEQ ID NO: 1003120 - RNA, 13 nt, Homo sapiens
uacaugaaguauu

SEQ ID NO: 1003121 - RNA, 13 nt, Homo sapiens
uacaugacauuua

SEQ ID NO: 1003122 - RNA, 18 nt, Homo sapiens
uacaugguugaaacccca

SEQ ID NO: 1003123 - RNA, 22 nt, Homo sapiens
uacauucugcaagcacaucugc

SEQ ID NO: 1003124 - RNA, 18 nt, Homo sapiens
uacauuuccucaccauaa

SEQ ID NO: 1003125 - RNA, 13 nt, Homo sapiens
uaccaacuuuuag

SEQ ID NO: 1003126 - RNA, 13 nt, Homo sapiens
uaccaaucauuuu

SEQ ID NO: 1003127 - RNA, 15 nt, Homo sapiens
uaccacucagagaaa

SEQ ID NO: 1003128 - RNA, 15 nt, Homo sapiens
uaccagaaagcaguu

SEQ ID NO: 1003129 - RNA, 20 nt, Homo sapiens
uaccaggcacgucugcagaa

SEQ ID NO: 1003130 - RNA, 22 nt, Homo sapiens
uaccauccccgaccaucugauu

SEQ ID NO: 1003131 - RNA, 14 nt, Homo sapiens
uaccccagguacau

SEQ ID NO: 1003132 - RNA, 14 nt, Homo sapiens
uaccccuuacaaau

SEQ ID NO: 1003133 - RNA, 19 nt, Homo sapiens
uaccucacagagugcauug

SEQ ID NO: 1003134 - RNA, 12 nt, Homo sapiens
uaccucacuuua

SEQ ID NO: 1003135 - RNA, 15 nt, Homo sapiens
uaccuccacucaugu

SEQ ID NO: 1003136 - RNA, 14 nt, Homo sapiens
uaccuccugagaaa

SEQ ID NO: 1003137 - RNA, 19 nt, Homo sapiens
uaccugccccacuuguccu

SEQ ID NO: 1003138 - RNA, 23 nt, Homo sapiens
uaccugcucagcccugcaccaug

SEQ ID NO: 1003139 - RNA, 16 nt, Homo sapiens
uaccuggcccaucagg

SEQ ID NO: 1003140 - RNA, 13 nt, Homo sapiens
uaccugggcauuc

SEQ ID NO: 1003141 - RNA, 18 nt, Homo sapiens
uaccuguguuucuugccu

SEQ ID NO: 1003142 - RNA, 22 nt, Homo sapiens
uaccuuccccacaucugagaga

SEQ ID NO: 1003143 - RNA, 17 nt, Homo sapiens
uacgcucagcucaucca

SEQ ID NO: 1003144 - RNA, 12 nt, Homo sapiens
uacuaaagccaa

SEQ ID NO: 1003145 - RNA, 13 nt, Homo sapiens
uacuaaagccaaa

SEQ ID NO: 1003146 - RNA, 16 nt, Homo sapiens
uaucucaguaccccau

SEQ ID NO: 1003147 - RNA, 21 nt, Homo sapiens
uaucuccagcggcccugucau

SEQ ID NO: 1003148 - RNA, 22 nt, Homo sapiens
uaucugugaaaugcuggcauuu

SEQ ID NO: 1003149 - RNA, 21 nt, Homo sapiens
uaugaaaaagaagaaucucau

SEQ ID NO: 1003150 - RNA, 23 nt, Homo sapiens
uaugaauggguggaaagguguga

SEQ ID NO: 1003151 - RNA, 15 nt, Homo sapiens
uaugauauugcagcu

SEQ ID NO: 1003152 - RNA, 21 nt, Homo sapiens
uaugauuauuaacgaugucca

SEQ ID NO: 1003153 - RNA, 20 nt, Homo sapiens
uaugcagagccacagcugug

SEQ ID NO: 1003154 - RNA, 18 nt, Homo sapiens
uaugcucagggucaauuu

SEQ ID NO: 1003155 - RNA, 15 nt, Homo sapiens
uauggagagcccugg

SEQ ID NO: 1003156 - RNA, 14 nt, Homo sapiens
uauggcuccuccau

SEQ ID NO: 1003157 - RNA, 13 nt, Homo sapiens
uaugggaacaauu

SEQ ID NO: 1003158 - RNA, 16 nt, Homo sapiens
uaugggaucugauaag

SEQ ID NO: 1003159 - RNA, 13 nt, Homo sapiens
uauguaacaugua

SEQ ID NO: 1003160 - RNA, 14 nt, Homo sapiens
uauguacaugagaa

SEQ ID NO: 1003161 - RNA, 15 nt, Homo sapiens
uauguacauuucuca

SEQ ID NO: 1003162 - RNA, 22 nt, Homo sapiens
uauguagcaaaauacaugacau

SEQ ID NO: 1003163 - RNA, 16 nt, Homo sapiens
uauguagcucuuuguc

SEQ ID NO: 1003164 - RNA, 21 nt, Homo sapiens
uauguagcucuuugucaggga

SEQ ID NO: 1003165 - RNA, 21 nt, Homo sapiens
uauguauggaugcguggauau

SEQ ID NO: 1003166 - RNA, 15 nt, Homo sapiens
uaugugcgugcaugu

SEQ ID NO: 1003167 - RNA, 14 nt, Homo sapiens
uauguuacaauuaa

SEQ ID NO: 1003168 - RNA, 17 nt, Homo sapiens
uauuaaaauguaugcau

SEQ ID NO: 1003169 - RNA, 23 nt, Homo sapiens
uauuaaagugcuaagguucuaag

SEQ ID NO: 1003170 - RNA, 19 nt, Homo sapiens
uauucgccacacaguauuu

SEQ ID NO: 1003171 - RNA, 22 nt, Homo sapiens
uauucuccuauguuuggcugcu

SEQ ID NO: 1003172 - RNA, 15 nt, Homo sapiens
uauucuucauaacaa

SEQ ID NO: 1003173 - RNA, 15 nt, Homo sapiens
uauugcaguuuauca

SEQ ID NO: 1003174 - RNA, 19 nt, Homo sapiens
uauugcaugcucaacuuag

SEQ ID NO: 1003175 - RNA, 14 nt, Homo sapiens
uauugcuguuucag

SEQ ID NO: 1003176 - RNA, 19 nt, Homo sapiens
uauugcuuaccugaucuca

SEQ ID NO: 1003177 - RNA, 18 nt, Homo sapiens
uauuguuguccuuuucau

SEQ ID NO: 1003178 - RNA, 12 nt, Homo sapiens
uauuuaccugaa

SEQ ID NO: 1003179 - RNA, 22 nt, Homo sapiens
uauuuagaagccaacuaugauu

SEQ ID NO: 1003180 - RNA, 12 nt, Homo sapiens
uauuuauagucg

SEQ ID NO: 1003181 - RNA, 21 nt, Homo sapiens
uauuuccauagcuuuuggcug

SEQ ID NO: 1003182 - RNA, 12 nt, Homo sapiens
uauuugaaugau

SEQ ID NO: 1003183 - RNA, 19 nt, Homo sapiens
uauuuggaaauaaagucag

SEQ ID NO: 1003184 - RNA, 14 nt, Homo sapiens
uauuuggaaccuug

SEQ ID NO: 1003185 - RNA, 21 nt, Homo sapiens
uauuuucagaugugaaccauu

SEQ ID NO: 1003186 - RNA, 17 nt, Homo sapiens
ucaaaacucaaauguga

SEQ ID NO: 1003187 - RNA, 15 nt, Homo sapiens
ucaaacccauucccu

SEQ ID NO: 1003188 - RNA, 18 nt, Homo sapiens
ucaaacuacuuugcugcu

SEQ ID NO: 1003189 - RNA, 17 nt, Homo sapiens
ucaaacuccugaccuca

SEQ ID NO: 1003190 - RNA, 17 nt, Homo sapiens
ucaaagaggaaccagga

SEQ ID NO: 1003191 - RNA, 15 nt, Homo sapiens
ucaaagguacuugga

SEQ ID NO: 1003192 - RNA, 21 nt, Homo sapiens
ucaaauacuuagagcagugaa

SEQ ID NO: 1003193 - RNA, 13 nt, Homo sapiens
ucaaauagcauaa

SEQ ID NO: 1003194 - RNA, 21 nt, Homo sapiens
ucaaaugaguaacauuugcug

SEQ ID NO: 1003195 - RNA, 16 nt, Homo sapiens
ucaacacccaacuguc

SEQ ID NO: 1003196 - RNA, 19 nt, Homo sapiens
ucaacaucuuuuacauucu

SEQ ID NO: 1003197 - RNA, 20 nt, Homo sapiens
ucaacgcucccagacgguca

SEQ ID NO: 1003198 - RNA, 17 nt, Homo sapiens
ucaagaauagcauugua

SEQ ID NO: 1003199 - RNA, 16 nt, Homo sapiens
ucaagagcuccuugac

SEQ ID NO: 1003200 - RNA, 16 nt, Homo sapiens
ucaaguugugccaaau

SEQ ID NO: 1003201 - RNA, 18 nt, Homo sapiens
ucaauaauauauuuucug

SEQ ID NO: 1003202 - RNA, 14 nt, Homo sapiens
ucaauacagauaua

SEQ ID NO: 1003203 - RNA, 20 nt, Homo sapiens
ucaaugaauuuuauaaucug

SEQ ID NO: 1003204 - RNA, 15 nt, Homo sapiens
ucaauggacuggaag

SEQ ID NO: 1003205 - RNA, 22 nt, Homo sapiens
ucaauuuuaucccucaccugua

SEQ ID NO: 1003206 - RNA, 19 nt, Homo sapiens
ucacaaacuuuuauacucu

SEQ ID NO: 1003207 - RNA, 13 nt, Homo sapiens
ucacaacagugaa

SEQ ID NO: 1003208 - RNA, 13 nt, Homo sapiens
ucacaagcaugaa

SEQ ID NO: 1003209 - RNA, 19 nt, Homo sapiens
ucacaagcaugaagugcug

SEQ ID NO: 1003210 - RNA, 20 nt, Homo sapiens
ucacaagcaugaagugcugu

SEQ ID NO: 1003211 - RNA, 22 nt, Homo sapiens
ucacaaguggguacccccagga

SEQ ID NO: 1003212 - RNA, 22 nt, Homo sapiens
ucacaaucaucaucauucucau

SEQ ID NO: 1003213 - RNA, 11 nt, Homo sapiens
ucacacacuga

SEQ ID NO: 1003214 - RNA, 22 nt, Homo sapiens
ucacaccacuagccucaggggu

SEQ ID NO: 1003215 - RNA, 13 nt, Homo sapiens
ucacagaauguga

SEQ ID NO: 1003216 - RNA, 16 nt, Homo sapiens
ucacagagugcauugu

SEQ ID NO: 1003217 - RNA, 20 nt, Homo sapiens
ucacagccaccccugagauc

SEQ ID NO: 1003218 - RNA, 22 nt, Homo sapiens
ucacaggcagccagugcccuga

SEQ ID NO: 1003219 - RNA, 23 nt, Homo sapiens
ucacaguucuuugggccagacau

SEQ ID NO: 1003220 - RNA, 22 nt, Homo sapiens
ucacauauucauauuguucaau

SEQ ID NO: 1003221 - RNA, 16 nt, Homo sapiens
ucacaucacacaaaag

SEQ ID NO: 1003222 - RNA, 17 nt, Homo sapiens
ucaccaaacacaagaaa

SEQ ID NO: 1003223 - RNA, 21 nt, Homo sapiens
ucaccaagcuaggugcuauuu

SEQ ID NO: 1003224 - RNA, 15 nt, Homo sapiens
ucaccacaaacugua

SEQ ID NO: 1003225 - RNA, 17 nt, Homo sapiens
ucaccacaaacuguaau

SEQ ID NO: 1003226 - RNA, 13 nt, Homo sapiens
ucaccauguugcc

SEQ ID NO: 1003227 - RNA, 23 nt, Homo sapiens
ucaccauuuggcaaugccaucau

SEQ ID NO: 1003228 - RNA, 22 nt, Homo sapiens
ucacccaccccugcacaguuga

SEQ ID NO: 1003229 - RNA, 20 nt, Homo sapiens
ucacccugccuuaucuugca

SEQ ID NO: 1003230 - RNA, 19 nt, Homo sapiens
ucaccuaggaagccucaga

SEQ ID NO: 1003231 - RNA, 18 nt, Homo sapiens
ucaccucuagguccccau

SEQ ID NO: 1003232 - RNA, 22 nt, Homo sapiens
ucaccugaaauaauacauugca

SEQ ID NO: 1003233 - RNA, 23 nt, Homo sapiens
ucaccugaaauaauacauugcag

SEQ ID NO: 1003234 - RNA, 18 nt, Homo sapiens
ucacggcugcgcacugug

SEQ ID NO: 1003235 - RNA, 23 nt, Homo sapiens
ucacuccuuuuuugcaugugcaa

SEQ ID NO: 1003236 - RNA, 16 nt, Homo sapiens
ucacucuuaugcugua

SEQ ID NO: 1003237 - RNA, 17 nt, Homo sapiens
ucacucuucaaaugccu

SEQ ID NO: 1003238 - RNA, 16 nt, Homo sapiens
ucacugcaaccuccac

SEQ ID NO: 1003239 - RNA, 20 nt, Homo sapiens
ucacugcugcaaauacugua

SEQ ID NO: 1003240 - RNA, 15 nt, Homo sapiens
ucacuggagcacaau

SEQ ID NO: 1003241 - RNA, 15 nt, Homo sapiens
ucacugucaccaccc

SEQ ID NO: 1003242 - RNA, 15 nt, Homo sapiens
ucacuugaucuccgu

SEQ ID NO: 1003243 - RNA, 23 nt, Homo sapiens
ucacuugccaaaauccaaggcaa

SEQ ID NO: 1003244 - RNA, 22 nt, Homo sapiens
ucagaaaauguucuguuugcug

SEQ ID NO: 1003245 - RNA, 22 nt, Homo sapiens
ucagaaacucugccaacacuga

SEQ ID NO: 1003246 - RNA, 23 nt, Homo sapiens
ucagaaagggagggcucugaggc

SEQ ID NO: 1003247 - RNA, 18 nt, Homo sapiens
ucagaacuagaauuugau

SEQ ID NO: 1003248 - RNA, 22 nt, Homo sapiens
ucagaaguaaaggaauuugaug

SEQ ID NO: 1003249 - RNA, 15 nt, Homo sapiens
ucuucccucucugca

SEQ ID NO: 1003250 - RNA, 14 nt, Homo sapiens
ucuucccuucccug

SEQ ID NO: 1003251 - RNA, 19 nt, Homo sapiens
ucuuccugaguggugccaa

SEQ ID NO: 1003252 - RNA, 14 nt, Homo sapiens
ucuuccuuuuauca

SEQ ID NO: 1003253 - RNA, 19 nt, Homo sapiens
ucuucuccaacaccaccuc

SEQ ID NO: 1003254 - RNA, 14 nt, Homo sapiens
ucuucuccaucucc

SEQ ID NO: 1003255 - RNA, 18 nt, Homo sapiens
ucuugaggggaccaggag

SEQ ID NO: 1003256 - RNA, 14 nt, Homo sapiens
ucuugauguaaaau

SEQ ID NO: 1003257 - RNA, 18 nt, Homo sapiens
ucuugcaacucuguaaau

SEQ ID NO: 1003258 - RNA, 24 nt, Homo sapiens
ucuugcacagucacugcucuucag

SEQ ID NO: 1003259 - RNA, 18 nt, Homo sapiens
ucuugcuggucuagucac

SEQ ID NO: 1003260 - RNA, 16 nt, Homo sapiens
ucuugguuugccuucc

SEQ ID NO: 1003261 - RNA, 21 nt, Homo sapiens
ucuuguguguaugcacaugaa

SEQ ID NO: 1003262 - RNA, 16 nt, Homo sapiens
ucuuguugagugccag

SEQ ID NO: 1003263 - RNA, 23 nt, Homo sapiens
ucuuuaagaguuuaaaaucauca

SEQ ID NO: 1003264 - RNA, 15 nt, Homo sapiens
ucuuuaaugcaauau

SEQ ID NO: 1003265 - RNA, 21 nt, Homo sapiens
ucuuuacaaaacuacaugaga

SEQ ID NO: 1003266 - RNA, 15 nt, Homo sapiens
ucuuuagaacaggga

SEQ ID NO: 1003267 - RNA, 22 nt, Homo sapiens
ucuuucagcuccugaccaguug

SEQ ID NO: 1003268 - RNA, 17 nt, Homo sapiens
ucuuucccaauucacau

SEQ ID NO: 1003269 - RNA, 17 nt, Homo sapiens
ucuuucucugccaguga

SEQ ID NO: 1003270 - RNA, 14 nt, Homo sapiens
ucuuucucuuacaa

SEQ ID NO: 1003271 - RNA, 19 nt, Homo sapiens
ucuuucugaauugcacaug

SEQ ID NO: 1003272 - RNA, 21 nt, Homo sapiens
ucuuuucaaagguacuuggau

SEQ ID NO: 1003273 - RNA, 13 nt, Homo sapiens
ucuuuugccauua

SEQ ID NO: 1003274 - RNA, 12 nt, Homo sapiens
ucuuuugccuuu

SEQ ID NO: 1003275 - RNA, 21 nt, Homo sapiens
ucuuuugggggucaacaguuu

SEQ ID NO: 1003276 - RNA, 16 nt, Homo sapiens
ugaaaaaaaacagugg

SEQ ID NO: 1003277 - RNA, 13 nt, Homo sapiens
ugaaaaauuccac

SEQ ID NO: 1003278 - RNA, 16 nt, Homo sapiens
ugaaaacacugugcac

SEQ ID NO: 1003279 - RNA, 13 nt, Homo sapiens
ugaaaacuuugua

SEQ ID NO: 1003280 - RNA, 18 nt, Homo sapiens
ugaaaagaauagaagcua

SEQ ID NO: 1003281 - RNA, 20 nt, Homo sapiens
ugaaaauguccauuuacacg

SEQ ID NO: 1003282 - RNA, 17 nt, Homo sapiens
ugaaacuccagaugcca

SEQ ID NO: 1003283 - RNA, 18 nt, Homo sapiens
ugaaacuccagaugccac

SEQ ID NO: 1003284 - RNA, 13 nt, Homo sapiens
ugaaagaaaccac

SEQ ID NO: 1003285 - RNA, 15 nt, Homo sapiens
ugaaagcaguagcau

SEQ ID NO: 1003286 - RNA, 14 nt, Homo sapiens
ugaaaguuaaucca

SEQ ID NO: 1003287 - RNA, 16 nt, Homo sapiens
ugaaaguuaauccacu

SEQ ID NO: 1003288 - RNA, 20 nt, Homo sapiens
ugaaaguuaauccacuguga

SEQ ID NO: 1003289 - RNA, 17 nt, Homo sapiens
ugaaauaauacauugca

SEQ ID NO: 1003290 - RNA, 23 nt, Homo sapiens
ugaaauacuauuuaaagccuccu

SEQ ID NO: 1003291 - RNA, 16 nt, Homo sapiens
ugaaaugcuggcauuu

SEQ ID NO: 1003292 - RNA, 21 nt, Homo sapiens
ugaaauucacccccuuuccug

SEQ ID NO: 1003293 - RNA, 16 nt, Homo sapiens
ugaaauugaaccuuug

SEQ ID NO: 1003294 - RNA, 15 nt, Homo sapiens
ugaacaaacaaugaa

SEQ ID NO: 1003295 - RNA, 23 nt, Homo sapiens
ugaacacucaguggcccauggca

SEQ ID NO: 1003296 - RNA, 22 nt, Homo sapiens
ugaacaucccuuuuucaaugaa

SEQ ID NO: 1003297 - RNA, 18 nt, Homo sapiens
ugaacccgaggcugagaa

SEQ ID NO: 1003298 - RNA, 17 nt, Homo sapiens
ugaacuugcauugugau

SEQ ID NO: 1003299 - RNA, 18 nt, Homo sapiens
ugaagacagaaccacagg

SEQ ID NO: 1003300 - RNA, 18 nt, Homo sapiens
ugaagagcgauugugagg

SEQ ID NO: 1003301 - RNA, 23 nt, Homo sapiens
ugaagcauaccccggccucucag

SEQ ID NO: 1003302 - RNA, 23 nt, Homo sapiens
ugaagccuuccccuuauccuccc

SEQ ID NO: 1003303 - RNA, 20 nt, Homo sapiens
ugaaggcauccccaggcccu

SEQ ID NO: 1003304 - RNA, 20 nt, Homo sapiens
ugaagggccacugggacccu

SEQ ID NO: 1003305 - RNA, 16 nt, Homo sapiens
ugaagguuguggccuu

SEQ ID NO: 1003306 - RNA, 22 nt, Homo sapiens
ugaauaaaccaucaucuugcca

SEQ ID NO: 1003307 - RNA, 14 nt, Homo sapiens
ugaauaaaugucac

SEQ ID NO: 1003308 - RNA, 15 nt, Homo sapiens
ugaauaaaugucacu

SEQ ID NO: 1003309 - RNA, 15 nt, Homo sapiens
ugaauagaacucuga

SEQ ID NO: 1003310 - RNA, 21 nt, Homo sapiens
ugaaucaagggucaggccuuu

SEQ ID NO: 1003311 - RNA, 20 nt, Homo sapiens
ugaaugaacacucuuuugcu

SEQ ID NO: 1003312 - RNA, 20 nt, Homo sapiens
ugaaugccguggauugcacg

SEQ ID NO: 1003313 - RNA, 19 nt, Homo sapiens
ugaauggccuucauaucau

SEQ ID NO: 1003314 - RNA, 22 nt, Homo sapiens
ugaaugggugcccacaguguca

SEQ ID NO: 1003315 - RNA, 16 nt, Homo sapiens
ugacagggaaaacugc

SEQ ID NO: 1003316 - RNA, 17 nt, Homo sapiens
ugacagggaaaacugca

SEQ ID NO: 1003317 - RNA, 22 nt, Homo sapiens
ugacaguuaauaaaccuuugca

SEQ ID NO: 1003318 - RNA, 19 nt, Homo sapiens
ugacauugauuugcucuua

SEQ ID NO: 1003319 - RNA, 18 nt, Homo sapiens
ugacauuuauauauugaa

SEQ ID NO: 1003320 - RNA, 20 nt, Homo sapiens
ugacauuuauauauugaauu

SEQ ID NO: 1003321 - RNA, 22 nt, Homo sapiens
ugacauuugggagacaugugac

SEQ ID NO: 1003322 - RNA, 12 nt, Homo sapiens
ugaccacagcac

SEQ ID NO: 1003323 - RNA, 22 nt, Homo sapiens
ugaccaggcauccuccacaaua

SEQ ID NO: 1003324 - RNA, 14 nt, Homo sapiens
ugaccagugcugcu

SEQ ID NO: 1003325 - RNA, 14 nt, Homo sapiens
ugacccccagcucc

SEQ ID NO: 1003326 - RNA, 22 nt, Homo sapiens
ugacccuuuucaugauuuuaag

SEQ ID NO: 1003327 - RNA, 20 nt, Homo sapiens
ugaccucaggcaaucugccc

SEQ ID NO: 1003328 - RNA, 17 nt, Homo sapiens
ugaccucguacucagga

SEQ ID NO: 1003329 - RNA, 22 nt, Homo sapiens
ugaccuggaaucagugaagcca

SEQ ID NO: 1003330 - RNA, 15 nt, Homo sapiens
ugacgacaagugcug

SEQ ID NO: 1003331 - RNA, 13 nt, Homo sapiens
ugacgccagggua

SEQ ID NO: 1003332 - RNA, 14 nt, Homo sapiens
ugacgccaggguau

SEQ ID NO: 1003333 - RNA, 19 nt, Homo sapiens
ugacuauggcuaccaaaaa

SEQ ID NO: 1003334 - RNA, 16 nt, Homo sapiens
ugacuccuccaaggaa

SEQ ID NO: 1003335 - RNA, 21 nt, Homo sapiens
ugacuccuccaaggaaaggga

SEQ ID NO: 1003336 - RNA, 12 nt, Homo sapiens
ugacugugguag

SEQ ID NO: 1003337 - RNA, 16 nt, Homo sapiens
ugacuugugucccaug

SEQ ID NO: 1003338 - RNA, 20 nt, Homo sapiens
ugagaaauauggacacuuaa

SEQ ID NO: 1003339 - RNA, 14 nt, Homo sapiens
ugagaacaccagag

SEQ ID NO: 1003340 - RNA, 16 nt, Homo sapiens
ugagaaggaacuucca

SEQ ID NO: 1003341 - RNA, 16 nt, Homo sapiens
ugagaaucagacugac

SEQ ID NO: 1003342 - RNA, 20 nt, Homo sapiens
ugagaccuccacccacugug

SEQ ID NO: 1003343 - RNA, 17 nt, Homo sapiens
ugagaguaaugaggcuu

SEQ ID NO: 1003344 - RNA, 22 nt, Homo sapiens
ugagaugauacauccaaagcag

SEQ ID NO: 1003345 - RNA, 17 nt, Homo sapiens
ugagaugggacauucca

SEQ ID NO: 1003346 - RNA, 16 nt, Homo sapiens
ugagcaagacauacuu

SEQ ID NO: 1003347 - RNA, 14 nt, Homo sapiens
ugagccaugagaug

SEQ ID NO: 1003348 - RNA, 19 nt, Homo sapiens
ugagcucccacaagccuga

SEQ ID NO: 1003349 - RNA, 13 nt, Homo sapiens
ugagcucugggaa

SEQ ID NO: 1003350 - RNA, 12 nt, Homo sapiens
ugagcugugcag

SEQ ID NO: 1003351 - RNA, 16 nt, Homo sapiens
ugaggcauuuccagac

SEQ ID NO: 1003352 - RNA, 19 nt, Homo sapiens
ugaggcauuuccagacuug

SEQ ID NO: 1003353 - RNA, 18 nt, Homo sapiens
uuaaaaaaauaugccuuu

SEQ ID NO: 1003354 - RNA, 13 nt, Homo sapiens
uuaaaacagaagc

SEQ ID NO: 1003355 - RNA, 22 nt, Homo sapiens
uuaaaacuucaguuucacagaa

SEQ ID NO: 1003356 - RNA, 19 nt, Homo sapiens
uuaaaauagcaaaagaaga

SEQ ID NO: 1003357 - RNA, 18 nt, Homo sapiens
uuaaaaugacaagcacua

SEQ ID NO: 1003358 - RNA, 15 nt, Homo sapiens
uuaaacaaaaacuag

SEQ ID NO: 1003359 - RNA, 15 nt, Homo sapiens
uuaaacaccuccuca

SEQ ID NO: 1003360 - RNA, 22 nt, Homo sapiens
uuaaacauuaauagcagccuuu

SEQ ID NO: 1003361 - RNA, 11 nt, Homo sapiens
uuaaacucugu

SEQ ID NO: 1003362 - RNA, 18 nt, Homo sapiens
uuaaacuuaccugggcau

SEQ ID NO: 1003363 - RNA, 15 nt, Homo sapiens
uuaaagaaggguuga

SEQ ID NO: 1003364 - RNA, 14 nt, Homo sapiens
uuaaagccuccuca

SEQ ID NO: 1003365 - RNA, 13 nt, Homo sapiens
uuaaauacuauua

SEQ ID NO: 1003366 - RNA, 14 nt, Homo sapiens
uuaaaugaacaaga

SEQ ID NO: 1003367 - RNA, 17 nt, Homo sapiens
uuaaauuuuuuguugac

SEQ ID NO: 1003368 - RNA, 20 nt, Homo sapiens
uuaacaacauguuuccagca

SEQ ID NO: 1003369 - RNA, 18 nt, Homo sapiens
uuaacauuaucuaguuca

SEQ ID NO: 1003370 - RNA, 14 nt, Homo sapiens
uuaacauuccucau

SEQ ID NO: 1003371 - RNA, 20 nt, Homo sapiens
uuaagcucugagcugucaac

SEQ ID NO: 1003372 - RNA, 21 nt, Homo sapiens
uuaaucucugcugaaacucag

SEQ ID NO: 1003373 - RNA, 16 nt, Homo sapiens
uuaaucuugcuuucuu

SEQ ID NO: 1003374 - RNA, 16 nt, Homo sapiens
uuaauggggaggacaa

SEQ ID NO: 1003375 - RNA, 12 nt, Homo sapiens
uuaauguacaaa

SEQ ID NO: 1003376 - RNA, 13 nt, Homo sapiens
uuacaauugugag

SEQ ID NO: 1003377 - RNA, 12 nt, Homo sapiens
uuacacauaccc

SEQ ID NO: 1003378 - RNA, 18 nt, Homo sapiens
uuacacuaaaaaaaugca

SEQ ID NO: 1003379 - RNA, 19 nt, Homo sapiens
uuacacugugucauucugu

SEQ ID NO: 1003380 - RNA, 18 nt, Homo sapiens
uuacacuugguuacucaa

SEQ ID NO: 1003381 - RNA, 14 nt, Homo sapiens
uuacagaaacugca

SEQ ID NO: 1003382 - RNA, 16 nt, Homo sapiens
uuacaggaacuucauc

SEQ ID NO: 1003383 - RNA, 23 nt, Homo sapiens
uuacaguaggagcccagcucuga

SEQ ID NO: 1003384 - RNA, 11 nt, Homo sapiens
uuacaguucug

SEQ ID NO: 1003385 - RNA, 14 nt, Homo sapiens
uuacauuguugagc

SEQ ID NO: 1003386 - RNA, 12 nt, Homo sapiens
uuacauuuacaa

SEQ ID NO: 1003387 - RNA, 20 nt, Homo sapiens
uuacauuuuaaacacauuag

SEQ ID NO: 1003388 - RNA, 21 nt, Homo sapiens
uuaccaggcaccaaaagaagu

SEQ ID NO: 1003389 - RNA, 22 nt, Homo sapiens
uuaccccuuuucggccccaugu

SEQ ID NO: 1003390 - RNA, 22 nt, Homo sapiens
uuaccugaaauaaaauucauua

SEQ ID NO: 1003391 - RNA, 22 nt, Homo sapiens
uuaccugggcauucuuguuuca

SEQ ID NO: 1003392 - RNA, 19 nt, Homo sapiens
uuacuagcagucacuugau

SEQ ID NO: 1003393 - RNA, 16 nt, Homo sapiens
uuacugcuugaccaaa

SEQ ID NO: 1003394 - RNA, 24 nt, Homo sapiens
uuacuucucacuaauuuguaggaa

SEQ ID NO: 1003395 - RNA, 17 nt, Homo sapiens
uuagaaacagugcaaca

SEQ ID NO: 1003396 - RNA, 17 nt, Homo sapiens
uuagaaauucagcauuu

SEQ ID NO: 1003397 - RNA, 12 nt, Homo sapiens
uuagaacaggga

SEQ ID NO: 1003398 - RNA, 22 nt, Homo sapiens
uuagauucucugugucuaagau

SEQ ID NO: 1003399 - RNA, 20 nt, Homo sapiens
uuaggauaaccuugugccuu

SEQ ID NO: 1003400 - RNA, 21 nt, Homo sapiens
uuaggauaaccuugugccuug

SEQ ID NO: 1003401 - RNA, 20 nt, Homo sapiens
uuaggccuccggaugacugc

SEQ ID NO: 1003402 - RNA, 22 nt, Homo sapiens
uuagggacagucaaaaccaagu

SEQ ID NO: 1003403 - RNA, 15 nt, Homo sapiens
uuagggacugaccag

SEQ ID NO: 1003404 - RNA, 15 nt, Homo sapiens
uuaggugucuguccu

SEQ ID NO: 1003405 - RNA, 21 nt, Homo sapiens
uuaggugucuguccuuuauga

SEQ ID NO: 1003406 - RNA, 16 nt, Homo sapiens
uuaguauuguuguccu

SEQ ID NO: 1003407 - RNA, 13 nt, Homo sapiens
uuauaaaaaugag

SEQ ID NO: 1003408 - RNA, 13 nt, Homo sapiens
uuauaacaguguu

SEQ ID NO: 1003409 - RNA, 17 nt, Homo sapiens
uuauaacguguucaaua

SEQ ID NO: 1003410 - RNA, 19 nt, Homo sapiens
uuauaacguguucaauauu

SEQ ID NO: 1003411 - RNA, 13 nt, Homo sapiens
uuauacacugugu

SEQ ID NO: 1003412 - RNA, 19 nt, Homo sapiens
uuauagacagucguuccca

SEQ ID NO: 1003413 - RNA, 12 nt, Homo sapiens
uuauagauucua

SEQ ID NO: 1003414 - RNA, 20 nt, Homo sapiens
uuauagugaauacugcuaca

SEQ ID NO: 1003415 - RNA, 16 nt, Homo sapiens
uuauauuacacuacac

SEQ ID NO: 1003416 - RNA, 17 nt, Homo sapiens
uuauauugauaagaucu

SEQ ID NO: 1003417 - RNA, 18 nt, Homo sapiens
uuaucacuuaaacuugca

SEQ ID NO: 1003418 - RNA, 20 nt, Homo sapiens
uuauccuccaccgucuuucu

SEQ ID NO: 1003419 - RNA, 20 nt, Homo sapiens
uuauccucccuguaacuuga

SEQ ID NO: 1003420 - RNA, 19 nt, Homo sapiens
uuaugaaugugaagccuuc

SEQ ID NO: 1003421 - RNA, 22 nt, Homo sapiens
uuauggagucauuuuuacaaug

SEQ ID NO: 1003422 - RNA, 14 nt, Homo sapiens
uuauggugcauuac

SEQ ID NO: 1003423 - RNA, 10 nt, Homo sapiens
uuauguguuu

SEQ ID NO: 1003424 - RNA, 19 nt, Homo sapiens
uuauuaaaguacaaccaua

SEQ ID NO: 1003425 - RNA, 19 nt, Homo sapiens
uuauuaauauauauuaucu

SEQ ID NO: 1003426 - RNA, 12 nt, Homo sapiens
uuauugccucac

SEQ ID NO: 1003427 - RNA, 23 nt, Homo sapiens
uuauuuaccugaaauaaaauuca

SEQ ID NO: 1003428 - RNA, 14 nt, Homo sapiens
uuauuuuucuuguc

SEQ ID NO: 1003429 - RNA, 15 nt, Homo sapiens
uucaaacuacuuugc

SEQ ID NO: 1003430 - RNA, 16 nt, Homo sapiens
uucaaagccaagcaaa

SEQ ID NO: 1003431 - RNA, 12 nt, Homo sapiens
uucaacacagcu

SEQ ID NO: 1003432 - RNA, 19 nt, Homo sapiens
uucaacaguuuuugcuaau

SEQ ID NO: 1003433 - RNA, 15 nt, Homo sapiens
uucaagagugagcua

SEQ ID NO: 1003434 - RNA, 12 nt, Homo sapiens
uucaaguguaaa

SEQ ID NO: 1003435 - RNA, 21 nt, Homo sapiens
uucaauuuauuugaaugauuu

SEQ ID NO: 1003436 - RNA, 15 nt, Homo sapiens
uucacuuuugacaaa

SEQ ID NO: 1003437 - RNA, 18 nt, Homo sapiens
uucagaagaaaaagaagc

SEQ ID NO: 1003438 - RNA, 15 nt, Homo sapiens
uucagagaacccacu

SEQ ID NO: 1003439 - RNA, 13 nt, Homo sapiens
uucagagagcagu

SEQ ID NO: 1003440 - RNA, 13 nt, Homo sapiens
uucagagcacuca

SEQ ID NO: 1003441 - RNA, 20 nt, Homo sapiens
uucagaggcucagauuguaa

SEQ ID NO: 1003442 - RNA, 22 nt, Homo sapiens
uucagcacugucccuugccuca

SEQ ID NO: 1003443 - RNA, 14 nt, Homo sapiens
uucagcauugccua

SEQ ID NO: 1003444 - RNA, 23 nt, Homo sapiens
uucagcgcugucaggauugcgag

SEQ ID NO: 1003445 - RNA, 17 nt, Homo sapiens
uucagcugccagugucc

SEQ ID NO: 1003446 - RNA, 19 nt, Homo sapiens
uucaggaggaauacugaac

SEQ ID NO: 1003447 - RNA, 19 nt, Homo sapiens
uucaggagggaaccagcuu

SEQ ID NO: 1003448 - RNA, 18 nt, Homo sapiens
uucagguaauacaaacua

SEQ ID NO: 1003449 - RNA, 14 nt, Homo sapiens
uucagguauaccuc

SEQ ID NO: 1003450 - RNA, 17 nt, Homo sapiens
uucauauuuuaaacaga

SEQ ID NO: 1003451 - RNA, 18 nt, Homo sapiens
uucauauuuuaaacagag

SEQ ID NO: 1003452 - RNA, 13 nt, Homo sapiens
uucaucacacugg

SEQ ID NO: 1003453 - RNA, 15 nt, Homo sapiens
uucaucccacuccaa

SEQ ID NO: 1003454 - RNA, 15 nt, Homo sapiens
uucaucgguauucau

SEQ ID NO: 1003455 - RNA, 12 nt, Homo sapiens
uucaugccagcu

SEQ ID NO: 1003456 - RNA, 16 nt, Homo sapiens
uucauggucugcugag

SEQ ID NO: 1003457 - RNA, 19 nt, Homo sapiens
uucauguuaguuaccuuau

SEQ ID NO: 1003458 - RNA, 17 nt, Homo sapiens
aaaaugcaaaagcacau

SEQ ID NO: 1003459 - RNA, 17 nt, Homo sapiens
aaaaugugauguucuaa

SEQ ID NO: 1003460 - RNA, 22 nt, Homo sapiens
aaaauguucuguuugcugugga

SEQ ID NO: 1003461 - RNA, 19 nt, Homo sapiens
aaaauguugagaaucccaa

SEQ ID NO: 1003462 - RNA, 13 nt, Homo sapiens
aaaauucacauga

SEQ ID NO: 1003463 - RNA, 21 nt, Homo sapiens
aaaauuuacaauuugacauac

SEQ ID NO: 1003464 - RNA, 22 nt, Homo sapiens
aaaauuuuuuuuguaacuggag

SEQ ID NO: 1003465 - RNA, 13 nt, Homo sapiens
aaacaaacaugac

SEQ ID NO: 1003466 - RNA, 17 nt, Homo sapiens
aaacaaauguauuucaa

SEQ ID NO: 1003467 - RNA, 14 nt, Homo sapiens
aaacaaguauuugu

SEQ ID NO: 1003468 - RNA, 17 nt, Homo sapiens
aaacaucauuacuauaa

SEQ ID NO: 1003469 - RNA, 22 nt, Homo sapiens
aaacaucuuugaaauuauguaa

SEQ ID NO: 1003470 - RNA, 22 nt, Homo sapiens
aaacauuaaaauauaaucucua

SEQ ID NO: 1003471 - RNA, 16 nt, Homo sapiens
aaaccaauccuaugca

SEQ ID NO: 1003472 - RNA, 22 nt, Homo sapiens
aaaccauuuuguuauugacuaa

SEQ ID NO: 1003473 - RNA, 21 nt, Homo sapiens
aaacccagcucccuucuuccc

SEQ ID NO: 1003474 - RNA, 22 nt, Homo sapiens
aaaccuggcaagucaccugcag

SEQ ID NO: 1003475 - RNA, 16 nt, Homo sapiens
aaaccuguacauaugu

SEQ ID NO: 1003476 - RNA, 16 nt, Homo sapiens
aaacggauuccaaaga

SEQ ID NO: 1003477 - RNA, 22 nt, Homo sapiens
aaacuaauuuaguaauagccug

SEQ ID NO: 1003478 - RNA, 18 nt, Homo sapiens
aaacuccugggcucaggc

SEQ ID NO: 1003479 - RNA, 19 nt, Homo sapiens
aaacugauggauaucccua

SEQ ID NO: 1003480 - RNA, 20 nt, Homo sapiens
aaacugcaaagcucggugcu

SEQ ID NO: 1003481 - RNA, 20 nt, Homo sapiens
aaacuguuccaaucaugaaa

SEQ ID NO: 1003482 - RNA, 21 nt, Homo sapiens
aaacuucaguuucacagaaaa

SEQ ID NO: 1003483 - RNA, 23 nt, Homo sapiens
aaacuugaaguagguagcaacgu

SEQ ID NO: 1003484 - RNA, 16 nt, Homo sapiens
aaacuugcaucacuua

SEQ ID NO: 1003485 - RNA, 18 nt, Homo sapiens
aaacuuggauacuuggau

SEQ ID NO: 1003486 - RNA, 17 nt, Homo sapiens
aaacuuuaucacuuaaa

SEQ ID NO: 1003487 - RNA, 16 nt, Homo sapiens
aaacuuugcaucucag

SEQ ID NO: 1003488 - RNA, 18 nt, Homo sapiens
aaacuuugcaucucagua

SEQ ID NO: 1003489 - RNA, 16 nt, Homo sapiens
aaagaaaaaagcacca

SEQ ID NO: 1003490 - RNA, 17 nt, Homo sapiens
aaagaacgcugauuuaa

SEQ ID NO: 1003491 - RNA, 18 nt, Homo sapiens
aaagaacguggucagagu

SEQ ID NO: 1003492 - RNA, 22 nt, Homo sapiens
aaagaacguggucagaguagaa

SEQ ID NO: 1003493 - RNA, 22 nt, Homo sapiens
aaagaaguuggggacacaugua

SEQ ID NO: 1003494 - RNA, 21 nt, Homo sapiens
aaagaauauucauaguuuaau

SEQ ID NO: 1003495 - RNA, 14 nt, Homo sapiens
aaagaccaggccaa

SEQ ID NO: 1003496 - RNA, 22 nt, Homo sapiens
aaagaggcugccccucucacca

SEQ ID NO: 1003497 - RNA, 16 nt, Homo sapiens
aaagauggaguuucua

SEQ ID NO: 1003498 - RNA, 22 nt, Homo sapiens
aaagcagccacgaggugcaaca

SEQ ID NO: 1003499 - RNA, 21 nt, Homo sapiens
aaagccaagggcaacagauca

SEQ ID NO: 1003500 - RNA, 19 nt, Homo sapiens
aaagcccuuuuauaccucc

SEQ ID NO: 1003501 - RNA, 13 nt, Homo sapiens
aaagccuccucau

SEQ ID NO: 1003502 - RNA, 17 nt, Homo sapiens
aaagccuccucaucccg

SEQ ID NO: 1003503 - RNA, 14 nt, Homo sapiens
aaagcugacuuggc

SEQ ID NO: 1003504 - RNA, 21 nt, Homo sapiens
aaagcuguguguuuggaagac

SEQ ID NO: 1003505 - RNA, 12 nt, Homo sapiens
aaagcuucacag

SEQ ID NO: 1003506 - RNA, 13 nt, Homo sapiens
aaaggacccugug

SEQ ID NO: 1003507 - RNA, 14 nt, Homo sapiens
aaaggacccuguga

SEQ ID NO: 1003508 - RNA, 14 nt, Homo sapiens
aaaggacuauaaga

SEQ ID NO: 1003509 - RNA, 12 nt, Homo sapiens
aaaggagccugu

SEQ ID NO: 1003510 - RNA, 14 nt, Homo sapiens
aaagguucuagguu

SEQ ID NO: 1003511 - RNA, 15 nt, Homo sapiens
aaagguucucaggug

SEQ ID NO: 1003512 - RNA, 16 nt, Homo sapiens
aaaguacaaccugaau

SEQ ID NO: 1003513 - RNA, 16 nt, Homo sapiens
aaaguaguccugugaa

SEQ ID NO: 1003514 - RNA, 19 nt, Homo sapiens
aaaguauucuucucuuccu

SEQ ID NO: 1003515 - RNA, 21 nt, Homo sapiens
aaagugacuaauggcaugaga

SEQ ID NO: 1003516 - RNA, 18 nt, Homo sapiens
aaaguggacaaggagugu

SEQ ID NO: 1003517 - RNA, 22 nt, Homo sapiens
aaagugggcaaaagcuuacaaa

SEQ ID NO: 1003518 - RNA, 14 nt, Homo sapiens
aaaguguaacaauu

SEQ ID NO: 1003519 - RNA, 19 nt, Homo sapiens
aaaguguaacaauugugua

SEQ ID NO: 1003520 - RNA, 23 nt, Homo sapiens
aaaguguaacaauuguguagccu

SEQ ID NO: 1003521 - RNA, 17 nt, Homo sapiens
aaaguuccccugugaca

SEQ ID NO: 1003522 - RNA, 16 nt, Homo sapiens
aaaguugagcgucauu

SEQ ID NO: 1003523 - RNA, 17 nt, Homo sapiens
aaaguuuggaagcacug

SEQ ID NO: 1003524 - RNA, 22 nt, Homo sapiens
aagcaaaccuguaagugucuug

SEQ ID NO: 1003525 - RNA, 15 nt, Homo sapiens
aagcaaaugucaugc

SEQ ID NO: 1003526 - RNA, 17 nt, Homo sapiens
aagcaaguucgucuguu

SEQ ID NO: 1003527 - RNA, 13 nt, Homo sapiens
aagcacaucugca

SEQ ID NO: 1003528 - RNA, 15 nt, Homo sapiens
aagcaccaaagggaa

SEQ ID NO: 1003529 - RNA, 19 nt, Homo sapiens
aagcaccaccaaacacagu

SEQ ID NO: 1003530 - RNA, 21 nt, Homo sapiens
aagcagccacgaggugcaaca

SEQ ID NO: 1003531 - RNA, 20 nt, Homo sapiens
aagcaggaaaugaaaauguc

SEQ ID NO: 1003532 - RNA, 20 nt, Homo sapiens
aagcaguggccuuauugcau

SEQ ID NO: 1003533 - RNA, 15 nt, Homo sapiens
aagcaguugagacaa

SEQ ID NO: 1003534 - RNA, 15 nt, Homo sapiens
aagcaucuggcucua

SEQ ID NO: 1003535 - RNA, 21 nt, Homo sapiens
aagcaucuugcauuaugcaau

SEQ ID NO: 1003536 - RNA, 23 nt, Homo sapiens
aagcaucuugcauuaugcaauuu

SEQ ID NO: 1003537 - RNA, 19 nt, Homo sapiens
aagcauucacaacuuguuu

SEQ ID NO: 1003538 - RNA, 21 nt, Homo sapiens
aagccacaaauaggaugcuug

SEQ ID NO: 1003539 - RNA, 19 nt, Homo sapiens
aagccagcaccggaccagc

SEQ ID NO: 1003540 - RNA, 14 nt, Homo sapiens
aagccaugaguucc

SEQ ID NO: 1003541 - RNA, 17 nt, Homo sapiens
aagcccagcgguucaca

SEQ ID NO: 1003542 - RNA, 17 nt, Homo sapiens
aagcccagugcacugaa

SEQ ID NO: 1003543 - RNA, 17 nt, Homo sapiens
aagccugaguacuccac

SEQ ID NO: 1003544 - RNA, 21 nt, Homo sapiens
aagccuuaauuugcacagugu

SEQ ID NO: 1003545 - RNA, 15 nt, Homo sapiens
aagcguuugcacaga

SEQ ID NO: 1003546 - RNA, 22 nt, Homo sapiens
aagcuaaaauuagaugaacuca

SEQ ID NO: 1003547 - RNA, 22 nt, Homo sapiens
aagcuaaauccuuuacuguuag

SEQ ID NO: 1003548 - RNA, 21 nt, Homo sapiens
aagcugucccucacuguugaa

SEQ ID NO: 1003549 - RNA, 15 nt, Homo sapiens
aagcuucuguccugc

SEQ ID NO: 1003550 - RNA, 18 nt, Homo sapiens
aaggaaaggcacauguca

SEQ ID NO: 1003551 - RNA, 12 nt, Homo sapiens
aaggaaaucaaa

SEQ ID NO: 1003552 - RNA, 15 nt, Homo sapiens
aaggacuuugcagcc

SEQ ID NO: 1003553 - RNA, 19 nt, Homo sapiens
aaggcacccaucugucugc

SEQ ID NO: 1003554 - RNA, 16 nt, Homo sapiens
aaggccuccugugacu

SEQ ID NO: 1003555 - RNA, 22 nt, Homo sapiens
aagggauggacaucuugucauu

SEQ ID NO: 1003556 - RNA, 14 nt, Homo sapiens
aagggccacuggga

SEQ ID NO: 1003557 - RNA, 23 nt, Homo sapiens
aaggggauuuuuaugucuggggc

SEQ ID NO: 1003558 - RNA, 18 nt, Homo sapiens
aagguccucugucaguca

SEQ ID NO: 1003559 - RNA, 20 nt, Homo sapiens
aaggucuuggaacuugccug

SEQ ID NO: 1003560 - RNA, 19 nt, Homo sapiens
aaggugugagacugggaag

SEQ ID NO: 1003561 - RNA, 20 nt, Homo sapiens
aagguucucagguguugcca

SEQ ID NO: 1003562 - RNA, 16 nt, Homo sapiens
aagguuugccugugua

SEQ ID NO: 1003563 - RNA, 17 nt, Homo sapiens
aaguaaguuugauuuca

SEQ ID NO: 1003564 - RNA, 22 nt, Homo sapiens
aaguacaaccugaauacccuuu

SEQ ID NO: 1003565 - RNA, 21 nt, Homo sapiens
aaguacuuguaguuccacuua

SEQ ID NO: 1003566 - RNA, 23 nt, Homo sapiens
aaguauuuuuuaauccuaccuca

SEQ ID NO: 1003567 - RNA, 15 nt, Homo sapiens
aagucauaauugcau

SEQ ID NO: 1003568 - RNA, 13 nt, Homo sapiens
aagucaucuugcu

SEQ ID NO: 1003569 - RNA, 13 nt, Homo sapiens
aagucucucaccc

SEQ ID NO: 1003570 - RNA, 16 nt, Homo sapiens
aagucugcuacccuca

SEQ ID NO: 1003571 - RNA, 13 nt, Homo sapiens
aagugaaagcaag

SEQ ID NO: 1003572 - RNA, 11 nt, Homo sapiens
aagugaccuau

SEQ ID NO: 1003573 - RNA, 17 nt, Homo sapiens
aagugagggcucacuca

SEQ ID NO: 1003574 - RNA, 20 nt, Homo sapiens
aagugcggguccggcagcuu

SEQ ID NO: 1003575 - RNA, 12 nt, Homo sapiens
aaguguaacaau

SEQ ID NO: 1003576 - RNA, 16 nt, Homo sapiens
aaguuccccugugaca

SEQ ID NO: 1003577 - RNA, 12 nt, Homo sapiens
aaguugcugcuu

SEQ ID NO: 1003578 - RNA, 21 nt, Homo sapiens
aaguuguaaaguauguauuau

SEQ ID NO: 1003579 - RNA, 15 nt, Homo sapiens
aaguuuagcucugag

SEQ ID NO: 1003580 - RNA, 17 nt, Homo sapiens
aaguuuagcucugagaa

SEQ ID NO: 1003581 - RNA, 20 nt, Homo sapiens
aauaaaccaucaucuugcca

SEQ ID NO: 1003582 - RNA, 15 nt, Homo sapiens
aauaaagcaucucau

SEQ ID NO: 1003583 - RNA, 14 nt, Homo sapiens
aauaaagcuugcaa

SEQ ID NO: 1003584 - RNA, 16 nt, Homo sapiens
aauaaaguguaacaau

SEQ ID NO: 1003585 - RNA, 16 nt, Homo sapiens
aauaaauguacauuaa

SEQ ID NO: 1003586 - RNA, 21 nt, Homo sapiens
aauaagaauucagacaucuga

SEQ ID NO: 1003587 - RNA, 14 nt, Homo sapiens
aauaauaccuaagc

SEQ ID NO: 1003588 - RNA, 15 nt, Homo sapiens
aauacagaucaucuu

SEQ ID NO: 1003589 - RNA, 19 nt, Homo sapiens
aauacagaucaucuuggaa

SEQ ID NO: 1003590 - RNA, 13 nt, Homo sapiens
aauacaguucugc

SEQ ID NO: 1003591 - RNA, 22 nt, Homo sapiens
aauacauuguuguaagagugau

SEQ ID NO: 1003592 - RNA, 19 nt, Homo sapiens
aauacauuuaaaacauuaa

SEQ ID NO: 1003593 - RNA, 17 nt, Homo sapiens
aauaccccucaacucau

SEQ ID NO: 1003594 - RNA, 20 nt, Homo sapiens
aauacgguggggguaggggg

SEQ ID NO: 1003595 - RNA, 13 nt, Homo sapiens
aauacuaaugaaa

SEQ ID NO: 1003596 - RNA, 18 nt, Homo sapiens
aauacuauuauuugcuac

SEQ ID NO: 1003597 - RNA, 23 nt, Homo sapiens
aauacuucuuguguguaugcaca

SEQ ID NO: 1003598 - RNA, 23 nt, Homo sapiens
aauacuuugcagcacagcugaga

SEQ ID NO: 1003599 - RNA, 14 nt, Homo sapiens
aauagcacauaugg

SEQ ID NO: 1003600 - RNA, 15 nt, Homo sapiens
aauagccacauuugg

SEQ ID NO: 1003601 - RNA, 17 nt, Homo sapiens
aauagccacauuuggaa

SEQ ID NO: 1003602 - RNA, 17 nt, Homo sapiens
aauagcuguaaacuucc

SEQ ID NO: 1003603 - RNA, 15 nt, Homo sapiens
aauauacuugaauga

SEQ ID NO: 1003604 - RNA, 17 nt, Homo sapiens
aauaucccuacauguau

SEQ ID NO: 1003605 - RNA, 22 nt, Homo sapiens
aauaucccuacauguauugcac

SEQ ID NO: 1003606 - RNA, 11 nt, Homo sapiens
aauauugauuu

SEQ ID NO: 1003607 - RNA, 13 nt, Homo sapiens
aaucaaauagcau

SEQ ID NO: 1003608 - RNA, 18 nt, Homo sapiens
aaucaacuugcuuaucaa

SEQ ID NO: 1003609 - RNA, 19 nt, Homo sapiens
aaucaaucauuucuauuaa

SEQ ID NO: 1003610 - RNA, 14 nt, Homo sapiens
aaucaaucuugcau

SEQ ID NO: 1003611 - RNA, 17 nt, Homo sapiens
aaucaaucuugcaugua

SEQ ID NO: 1003612 - RNA, 18 nt, Homo sapiens
aaucaggaauauuuucca

SEQ ID NO: 1003613 - RNA, 18 nt, Homo sapiens
aaucaguaagagguguua

SEQ ID NO: 1003614 - RNA, 21 nt, Homo sapiens
aaucagugaagccaaagggac

SEQ ID NO: 1003615 - RNA, 14 nt, Homo sapiens
aaucaucaagagaa

SEQ ID NO: 1003616 - RNA, 18 nt, Homo sapiens
aaucauccaagacaguua

SEQ ID NO: 1003617 - RNA, 22 nt, Homo sapiens
aaucauccauccuugccaauag

SEQ ID NO: 1003618 - RNA, 15 nt, Homo sapiens
aaucaugaaaagggg

SEQ ID NO: 1003619 - RNA, 15 nt, Homo sapiens
aaucauuucuauuaa

SEQ ID NO: 1003620 - RNA, 16 nt, Homo sapiens
aauccaggcagaucca

SEQ ID NO: 1003621 - RNA, 18 nt, Homo sapiens
aauccccaacaugcacug

SEQ ID NO: 1003622 - RNA, 18 nt, Homo sapiens
aauccuuuacuguuaguc

SEQ ID NO: 1003623 - RNA, 15 nt, Homo sapiens
acagaaugagaccaa

SEQ ID NO: 1003624 - RNA, 18 nt, Homo sapiens
acagaauuuuauggugca

SEQ ID NO: 1003625 - RNA, 14 nt, Homo sapiens
acagacaggcucuu

SEQ ID NO: 1003626 - RNA, 15 nt, Homo sapiens
acagagaaaccagcu

SEQ ID NO: 1003627 - RNA, 20 nt, Homo sapiens
acagagaagccuucaagcuc

SEQ ID NO: 1003628 - RNA, 14 nt, Homo sapiens
acagagcacauuug

SEQ ID NO: 1003629 - RNA, 16 nt, Homo sapiens
acagagggcugcauuc

SEQ ID NO: 1003630 - RNA, 13 nt, Homo sapiens
acagagugcauug

SEQ ID NO: 1003631 - RNA, 15 nt, Homo sapiens
acagauuuggaaaga

SEQ ID NO: 1003632 - RNA, 14 nt, Homo sapiens
acagcaaacaggug

SEQ ID NO: 1003633 - RNA, 15 nt, Homo sapiens
acagcagccuggggc

SEQ ID NO: 1003634 - RNA, 18 nt, Homo sapiens
acagccaccguuucuucc

SEQ ID NO: 1003635 - RNA, 23 nt, Homo sapiens
acagccccacccuggugggccaa

SEQ ID NO: 1003636 - RNA, 21 nt, Homo sapiens
acagccucccacccccaucuc

SEQ ID NO: 1003637 - RNA, 20 nt, Homo sapiens
acagccugagucaccugcag

SEQ ID NO: 1003638 - RNA, 21 nt, Homo sapiens
acagcuacucuccccacgagg

SEQ ID NO: 1003639 - RNA, 22 nt, Homo sapiens
acagcuagaaagcugcacuggu

SEQ ID NO: 1003640 - RNA, 22 nt, Homo sapiens
acagcugguguagcuacagaga

SEQ ID NO: 1003641 - RNA, 20 nt, Homo sapiens
acagcuguucugaauugucu

SEQ ID NO: 1003642 - RNA, 16 nt, Homo sapiens
acagcuugucucuugc

SEQ ID NO: 1003643 - RNA, 17 nt, Homo sapiens
acaggaacccaccaaac

SEQ ID NO: 1003644 - RNA, 23 nt, Homo sapiens
acaggcaaauguacuucucaccc

SEQ ID NO: 1003645 - RNA, 20 nt, Homo sapiens
acagggaaaacugcaaagcu

SEQ ID NO: 1003646 - RNA, 22 nt, Homo sapiens
acagggcgguaccuugugccca

SEQ ID NO: 1003647 - RNA, 19 nt, Homo sapiens
acagggucugcucuuucuc

SEQ ID NO: 1003648 - RNA, 20 nt, Homo sapiens
acagggugucguucugucgc

SEQ ID NO: 1003649 - RNA, 23 nt, Homo sapiens
acagguaauauaaaaagcuucca

SEQ ID NO: 1003650 - RNA, 14 nt, Homo sapiens
acagguccccagau

SEQ ID NO: 1003651 - RNA, 20 nt, Homo sapiens
acaggugcaacagacuugaa

SEQ ID NO: 1003652 - RNA, 18 nt, Homo sapiens
acaguacccaaacugcuu

SEQ ID NO: 1003653 - RNA, 22 nt, Homo sapiens
acagucacugcucuucagccau

SEQ ID NO: 1003654 - RNA, 18 nt, Homo sapiens
acagucuuccauuugcaa

SEQ ID NO: 1003655 - RNA, 19 nt, Homo sapiens
acagugccgacagcucucc

SEQ ID NO: 1003656 - RNA, 17 nt, Homo sapiens
acagugcucaaggccag

SEQ ID NO: 1003657 - RNA, 22 nt, Homo sapiens
acaguggaggaagagggacaga

SEQ ID NO: 1003658 - RNA, 23 nt, Homo sapiens
acaguguuggagguuaaggcaua

SEQ ID NO: 1003659 - RNA, 24 nt, Homo sapiens
acaguuuacagacgcugcugucac

SEQ ID NO: 1003660 - RNA, 17 nt, Homo sapiens
acaguuuuaacugugga

SEQ ID NO: 1003661 - RNA, 18 nt, Homo sapiens
acaguuuuaacuguggau

SEQ ID NO: 1003662 - RNA, 16 nt, Homo sapiens
acauacauuucucaua

SEQ ID NO: 1003663 - RNA, 15 nt, Homo sapiens
acauacuuaaugcau

SEQ ID NO: 1003664 - RNA, 19 nt, Homo sapiens
acauacuugaagggccaga

SEQ ID NO: 1003665 - RNA, 18 nt, Homo sapiens
acauauauauacuauuaa

SEQ ID NO: 1003666 - RNA, 15 nt, Homo sapiens
acauaugugcuggaa

SEQ ID NO: 1003667 - RNA, 19 nt, Homo sapiens
acaucaaaaaaggcaguua

SEQ ID NO: 1003668 - RNA, 20 nt, Homo sapiens
acaucagagugacauccagg

SEQ ID NO: 1003669 - RNA, 15 nt, Homo sapiens
acaucauuacuauaa

SEQ ID NO: 1003670 - RNA, 17 nt, Homo sapiens
acauccaaaauaguuaa

SEQ ID NO: 1003671 - RNA, 19 nt, Homo sapiens
acauccaaagcagacagcu

SEQ ID NO: 1003672 - RNA, 15 nt, Homo sapiens
acaucucaacaggcc

SEQ ID NO: 1003673 - RNA, 22 nt, Homo sapiens
acaucucaacaggccucagggc

SEQ ID NO: 1003674 - RNA, 20 nt, Homo sapiens
acaucugagagaugacaggg

SEQ ID NO: 1003675 - RNA, 14 nt, Homo sapiens
acaucuugucauuu

SEQ ID NO: 1003676 - RNA, 20 nt, Homo sapiens
acaucuuuagugucugagcu

SEQ ID NO: 1003677 - RNA, 17 nt, Homo sapiens
acaucuuuuacauucug

SEQ ID NO: 1003678 - RNA, 22 nt, Homo sapiens
acaugaagcuguugugugaggu

SEQ ID NO: 1003679 - RNA, 19 nt, Homo sapiens
acaugagaacaaacagauc

SEQ ID NO: 1003680 - RNA, 17 nt, Homo sapiens
acaugaggccacuggag

SEQ ID NO: 1003681 - RNA, 20 nt, Homo sapiens
acaugccucugccaaaggau

SEQ ID NO: 1003682 - RNA, 17 nt, Homo sapiens
acaugcgguagccagca

SEQ ID NO: 1003683 - RNA, 19 nt, Homo sapiens
acaugcgugaccagcagua

SEQ ID NO: 1003684 - RNA, 22 nt, Homo sapiens
acauggacaugcuucagugcug

SEQ ID NO: 1003685 - RNA, 12 nt, Homo sapiens
acauguauugca

SEQ ID NO: 1003686 - RNA, 17 nt, Homo sapiens
acauguauugcacauug

SEQ ID NO: 1003687 - RNA, 19 nt, Homo sapiens
acauguauugcacauugua

SEQ ID NO: 1003688 - RNA, 12 nt, Homo sapiens
acauuaugugga

SEQ ID NO: 1003689 - RNA, 14 nt, Homo sapiens
acauucagggcuau

SEQ ID NO: 1003690 - RNA, 22 nt, Homo sapiens
acauucauagucuuuggagaaa

SEQ ID NO: 1003691 - RNA, 22 nt, Homo sapiens
acauugauuugcucuuacuaca

SEQ ID NO: 1003692 - RNA, 16 nt, Homo sapiens
acauugggagucugua

SEQ ID NO: 1003693 - RNA, 12 nt, Homo sapiens
acauuguagccu

SEQ ID NO: 1003694 - RNA, 20 nt, Homo sapiens
acauugugggauguucagca

SEQ ID NO: 1003695 - RNA, 17 nt, Homo sapiens
acauuuacaaacugaag

SEQ ID NO: 1003696 - RNA, 18 nt, Homo sapiens
acauuucucauaccuucc

SEQ ID NO: 1003697 - RNA, 20 nt, Homo sapiens
acauuugggagacaugugac

SEQ ID NO: 1003698 - RNA, 14 nt, Homo sapiens
acauuuucauugau

SEQ ID NO: 1003699 - RNA, 18 nt, Homo sapiens
accaaagggaaggcuucc

SEQ ID NO: 1003700 - RNA, 20 nt, Homo sapiens
accaaaucaaaaucucucca

SEQ ID NO: 1003701 - RNA, 19 nt, Homo sapiens
accaaaucuggaagccaaa

SEQ ID NO: 1003702 - RNA, 15 nt, Homo sapiens
accaacccucagggc

SEQ ID NO: 1003703 - RNA, 17 nt, Homo sapiens
accaacuacuaccugua

SEQ ID NO: 1003704 - RNA, 21 nt, Homo sapiens
accaagaauguuaugugcaag

SEQ ID NO: 1003705 - RNA, 14 nt, Homo sapiens
accaagcacagcag

SEQ ID NO: 1003706 - RNA, 13 nt, Homo sapiens
accaaugucuuga

SEQ ID NO: 1003707 - RNA, 24 nt, Homo sapiens
accacacccacacucagauccucc

SEQ ID NO: 1003708 - RNA, 21 nt, Homo sapiens
accacagagggcgugugcucg

SEQ ID NO: 1003709 - RNA, 16 nt, Homo sapiens
accaccagacugcaau

SEQ ID NO: 1003710 - RNA, 20 nt, Homo sapiens
accaccagcuguguccaaaa

SEQ ID NO: 1003711 - RNA, 13 nt, Homo sapiens
accacgacuggcc

SEQ ID NO: 1003712 - RNA, 17 nt, Homo sapiens
accacugaaaaaauaua

SEQ ID NO: 1003713 - RNA, 19 nt, Homo sapiens
accacugcuuccauuuaau

SEQ ID NO: 1003714 - RNA, 21 nt, Homo sapiens
accagaaaaaugggaacaagg

SEQ ID NO: 1003715 - RNA, 15 nt, Homo sapiens
accagacucuugccu

SEQ ID NO: 1003716 - RNA, 21 nt, Homo sapiens
accagaugcugaaaauguccu

SEQ ID NO: 1003717 - RNA, 18 nt, Homo sapiens
accagcccagcccgucuc

SEQ ID NO: 1003718 - RNA, 18 nt, Homo sapiens
accagccuggcccacccc

SEQ ID NO: 1003719 - RNA, 21 nt, Homo sapiens
accagcuucugauaaacacaa

SEQ ID NO: 1003720 - RNA, 15 nt, Homo sapiens
accaggaggacaaga

SEQ ID NO: 1003721 - RNA, 15 nt, Homo sapiens
accaggucaaaauag

SEQ ID NO: 1003722 - RNA, 13 nt, Homo sapiens
accaguaugacag

SEQ ID NO: 1003723 - RNA, 19 nt, Homo sapiens
accaucaaguugugccaaa

SEQ ID NO: 1003724 - RNA, 16 nt, Homo sapiens
accauccaccaggccu

SEQ ID NO: 1003725 - RNA, 20 nt, Homo sapiens
acuaggcccccacuugccuc

SEQ ID NO: 1003726 - RNA, 13 nt, Homo sapiens
acuaggccuucag

SEQ ID NO: 1003727 - RNA, 20 nt, Homo sapiens
acuaucuuucagcuccaguu

SEQ ID NO: 1003728 - RNA, 17 nt, Homo sapiens
acucaaauggggccaga

SEQ ID NO: 1003729 - RNA, 16 nt, Homo sapiens
acucaaggcuugaguc

SEQ ID NO: 1003730 - RNA, 15 nt, Homo sapiens
acucaccaaacacaa

SEQ ID NO: 1003731 - RNA, 16 nt, Homo sapiens
acucaccugcacuaac

SEQ ID NO: 1003732 - RNA, 17 nt, Homo sapiens
cacuguaguucuaagac

SEQ ID NO: 1003733 - RNA, 18 nt, Homo sapiens
cacugucuuuaauucugu

SEQ ID NO: 1003734 - RNA, 20 nt, Homo sapiens
cacuuaaaaauuaaauugga

SEQ ID NO: 1003735 - RNA, 22 nt, Homo sapiens
cacuuauaagaaagaucaaaga

SEQ ID NO: 1003736 - RNA, 16 nt, Homo sapiens
cacuuauguuauacaa

SEQ ID NO: 1003737 - RNA, 13 nt, Homo sapiens
cacuucaaauuca

SEQ ID NO: 1003738 - RNA, 22 nt, Homo sapiens
cacuugccugugcuacaauuca

SEQ ID NO: 1003739 - RNA, 18 nt, Homo sapiens
cacuuuuuaaaaucucaa

SEQ ID NO: 1003740 - RNA, 20 nt, Homo sapiens
cagaaaaaugggaacaaggc

SEQ ID NO: 1003741 - RNA, 18 nt, Homo sapiens
cagaaaacaaaacugcau

SEQ ID NO: 1003742 - RNA, 13 nt, Homo sapiens
cagaaaacauguu

SEQ ID NO: 1003743 - RNA, 16 nt, Homo sapiens
cagaaaauguucuguu

SEQ ID NO: 1003744 - RNA, 13 nt, Homo sapiens
cagaaaauucugu

SEQ ID NO: 1003745 - RNA, 18 nt, Homo sapiens
cagaaacacucaaguuga

SEQ ID NO: 1003746 - RNA, 21 nt, Homo sapiens
cagaaauaucuucacuuguca

SEQ ID NO: 1003747 - RNA, 14 nt, Homo sapiens
cagaaccacagggc

SEQ ID NO: 1003748 - RNA, 18 nt, Homo sapiens
cagaagccugaugcugac

SEQ ID NO: 1003749 - RNA, 19 nt, Homo sapiens
caggguuuauaugcacuuu

SEQ ID NO: 1003750 - RNA, 19 nt, Homo sapiens
cagguaccucuuucagggu

SEQ ID NO: 1003751 - RNA, 14 nt, Homo sapiens
caggucucccugga

SEQ ID NO: 1003752 - RNA, 15 nt, Homo sapiens
caggucugaagcuca

SEQ ID NO: 1003753 - RNA, 14 nt, Homo sapiens
caggugaacaaagu

SEQ ID NO: 1003754 - RNA, 20 nt, Homo sapiens
caggugaggucagcacaucu

SEQ ID NO: 1003755 - RNA, 14 nt, Homo sapiens
caggugcauagcaa

SEQ ID NO: 1003756 - RNA, 16 nt, Homo sapiens
caggugccuucccaga

SEQ ID NO: 1003757 - RNA, 15 nt, Homo sapiens
cagguuaaugcugaa

SEQ ID NO: 1003758 - RNA, 16 nt, Homo sapiens
caguaaauaacuggaa

SEQ ID NO: 1003759 - RNA, 18 nt, Homo sapiens
caguaaauaacuggaaaa

SEQ ID NO: 1003760 - RNA, 22 nt, Homo sapiens
caguaaauaacuggaaaacaga

SEQ ID NO: 1003761 - RNA, 22 nt, Homo sapiens
caguacccacucuggagcauuu

SEQ ID NO: 1003762 - RNA, 16 nt, Homo sapiens
caguagagcucuacug

SEQ ID NO: 1003763 - RNA, 13 nt, Homo sapiens
caguagaguagaa

SEQ ID NO: 1003764 - RNA, 23 nt, Homo sapiens
caguagauugcagaaaauucugu

SEQ ID NO: 1003765 - RNA, 22 nt, Homo sapiens
caguauaagcaucugccaucug

SEQ ID NO: 1003766 - RNA, 23 nt, Homo sapiens
caguauuuagaagccaacuauga

SEQ ID NO: 1003767 - RNA, 16 nt, Homo sapiens
cagucacuugaucucc

SEQ ID NO: 1003768 - RNA, 17 nt, Homo sapiens
caguccacacuuugucc

SEQ ID NO: 1003769 - RNA, 16 nt, Homo sapiens
caguccaccugaggaa

SEQ ID NO: 1003770 - RNA, 22 nt, Homo sapiens
caguccacuucugacagccuca

SEQ ID NO: 1003771 - RNA, 22 nt, Homo sapiens
caguccaggaugcuaacaucua

SEQ ID NO: 1003772 - RNA, 21 nt, Homo sapiens
caguccaucccagagggaccg

SEQ ID NO: 1003773 - RNA, 13 nt, Homo sapiens
caguccaugucuc

SEQ ID NO: 1003774 - RNA, 20 nt, Homo sapiens
cagucucuaauccaccccaa

SEQ ID NO: 1003775 - RNA, 22 nt, Homo sapiens
cagucuuccauuugcaagggaa

SEQ ID NO: 1003776 - RNA, 19 nt, Homo sapiens
cagugcccugagccagggu

SEQ ID NO: 1003777 - RNA, 18 nt, Homo sapiens
cagugccucaugccugua

SEQ ID NO: 1003778 - RNA, 15 nt, Homo sapiens
cagugcgcuguagua

SEQ ID NO: 1003779 - RNA, 21 nt, Homo sapiens
cagugcuucccgagugagcau

SEQ ID NO: 1003780 - RNA, 21 nt, Homo sapiens
cagugggaaacaaacugucua

SEQ ID NO: 1003781 - RNA, 14 nt, Homo sapiens
cagugugcaaggca

SEQ ID NO: 1003782 - RNA, 20 nt, Homo sapiens
caguguuaaaugugaugaau

SEQ ID NO: 1003783 - RNA, 15 nt, Homo sapiens
caguucccucuugcu

SEQ ID NO: 1003784 - RNA, 17 nt, Homo sapiens
caguugaagcugacuca

SEQ ID NO: 1003785 - RNA, 18 nt, Homo sapiens
caguuggagcuccagccu

SEQ ID NO: 1003786 - RNA, 24 nt, Homo sapiens
caguugucccgauuguaacucaaa

SEQ ID NO: 1003787 - RNA, 23 nt, Homo sapiens
caguuuaaaagcacgacagugga

SEQ ID NO: 1003788 - RNA, 19 nt, Homo sapiens
caguuuugucaaugcaguu

SEQ ID NO: 1003789 - RNA, 18 nt, Homo sapiens
cauaaaggaaaagacaca

SEQ ID NO: 1003790 - RNA, 14 nt, Homo sapiens
cauaaccugucuca

SEQ ID NO: 1003791 - RNA, 17 nt, Homo sapiens
cauaacugaacauccaa

SEQ ID NO: 1003792 - RNA, 22 nt, Homo sapiens
cauaaggccggacgcaucucaa

SEQ ID NO: 1003793 - RNA, 17 nt, Homo sapiens
cauacacccauuucucu

SEQ ID NO: 1003794 - RNA, 22 nt, Homo sapiens
cauaccaaugaaaaaauguaua

SEQ ID NO: 1003795 - RNA, 15 nt, Homo sapiens
cauaccccuuacaaa

SEQ ID NO: 1003796 - RNA, 18 nt, Homo sapiens
cauacuggccuggacugu

SEQ ID NO: 1003797 - RNA, 13 nt, Homo sapiens
cauaggucugaaa

SEQ ID NO: 1003798 - RNA, 14 nt, Homo sapiens
cauaggugauccau

SEQ ID NO: 1003799 - RNA, 18 nt, Homo sapiens
cauaguggaucacucacc

SEQ ID NO: 1003800 - RNA, 13 nt, Homo sapiens
cauauaauguugu

SEQ ID NO: 1003801 - RNA, 15 nt, Homo sapiens
cauaugaacuuguca

SEQ ID NO: 1003802 - RNA, 20 nt, Homo sapiens
cauaugaguaagggcacuga

SEQ ID NO: 1003803 - RNA, 18 nt, Homo sapiens
cauauuguugcauugcuu

SEQ ID NO: 1003804 - RNA, 23 nt, Homo sapiens
cauauuuugguuuguguauccau

SEQ ID NO: 1003805 - RNA, 16 nt, Homo sapiens
caucaaaaaaggcagu

SEQ ID NO: 1003806 - RNA, 19 nt, Homo sapiens
caucaaaaaaggcaguuac

SEQ ID NO: 1003807 - RNA, 15 nt, Homo sapiens
caucaaguugugcca

SEQ ID NO: 1003808 - RNA, 17 nt, Homo sapiens
caucagaaacucugcca

SEQ ID NO: 1003809 - RNA, 13 nt, Homo sapiens
caucaggcuuucu

SEQ ID NO: 1003810 - RNA, 17 nt, Homo sapiens
caucagugcucccucac

SEQ ID NO: 1003811 - RNA, 17 nt, Homo sapiens
caucauucucugucuca

SEQ ID NO: 1003812 - RNA, 17 nt, Homo sapiens
caucauuucacuuguca

SEQ ID NO: 1003813 - RNA, 15 nt, Homo sapiens
cauccauaauuguga

SEQ ID NO: 1003814 - RNA, 23 nt, Homo sapiens
cauccaugcugugcuguguuauu

SEQ ID NO: 1003815 - RNA, 13 nt, Homo sapiens
cauccauggccag

SEQ ID NO: 1003816 - RNA, 14 nt, Homo sapiens
cauccuccuucuuc

SEQ ID NO: 1003817 - RNA, 17 nt, Homo sapiens
cauccuccuucuucagg

SEQ ID NO: 1003818 - RNA, 22 nt, Homo sapiens
cauccuugucuuauucccuucc

SEQ ID NO: 1003819 - RNA, 12 nt, Homo sapiens
caucucaugccc

SEQ ID NO: 1003820 - RNA, 14 nt, Homo sapiens
caucugaggaauga

SEQ ID NO: 1003821 - RNA, 18 nt, Homo sapiens
caucuguaaaucuacaca

SEQ ID NO: 1003822 - RNA, 21 nt, Homo sapiens
caucugugcacugcccaugga

SEQ ID NO: 1003823 - RNA, 22 nt, Homo sapiens
caucugugcacugcccauggac

SEQ ID NO: 1003824 - RNA, 16 nt, Homo sapiens
caucuugcuaccagua

SEQ ID NO: 1003825 - RNA, 18 nt, Homo sapiens
caucuuuuacauucugca

SEQ ID NO: 1003826 - RNA, 18 nt, Homo sapiens
caugaaaguggacaagga

SEQ ID NO: 1003827 - RNA, 22 nt, Homo sapiens
caugaacaucuuuagugucuga

SEQ ID NO: 1003828 - RNA, 22 nt, Homo sapiens
caugaacugcggcagcaguuug

SEQ ID NO: 1003829 - RNA, 16 nt, Homo sapiens
caugaagauucuuucc

SEQ ID NO: 1003830 - RNA, 18 nt, Homo sapiens
caugaauuauuacagugu

SEQ ID NO: 1003831 - RNA, 19 nt, Homo sapiens
caugagaccacuguuauca

SEQ ID NO: 1003832 - RNA, 18 nt, Homo sapiens
caugagugaauaaauguc

SEQ ID NO: 1003833 - RNA, 21 nt, Homo sapiens
caugauaccaccuuuacugug

SEQ ID NO: 1003834 - RNA, 16 nt, Homo sapiens
caugauuuccuugaau

SEQ ID NO: 1003835 - RNA, 21 nt, Homo sapiens
caugcagcuguggcagaguua

SEQ ID NO: 1003836 - RNA, 16 nt, Homo sapiens
caugccacaaggacuu

SEQ ID NO: 1003837 - RNA, 17 nt, Homo sapiens
caugccauuuguacuga

SEQ ID NO: 1003838 - RNA, 14 nt, Homo sapiens
caugcccaugauga

SEQ ID NO: 1003839 - RNA, 15 nt, Homo sapiens
caugccccaucccau

SEQ ID NO: 1003840 - RNA, 14 nt, Homo sapiens
caugcccugugcaa

SEQ ID NO: 1003841 - RNA, 13 nt, Homo sapiens
caugccucugagg

SEQ ID NO: 1003842 - RNA, 16 nt, Homo sapiens
caugcgaugacacuug

SEQ ID NO: 1003843 - RNA, 20 nt, Homo sapiens
caugcgguagccagcacaca

SEQ ID NO: 1003844 - RNA, 16 nt, Homo sapiens
caugcguccuggucaa

SEQ ID NO: 1003845 - RNA, 23 nt, Homo sapiens
cauggacaugcuucagugcugcu

SEQ ID NO: 1003846 - RNA, 17 nt, Homo sapiens
cauggauaaauugcaca

SEQ ID NO: 1003847 - RNA, 12 nt, Homo sapiens
caugggagaccc

SEQ ID NO: 1003848 - RNA, 21 nt, Homo sapiens
cauggugccccaggaccagcu

SEQ ID NO: 1003849 - RNA, 11 nt, Homo sapiens
cauguacaaaa

SEQ ID NO: 1003850 - RNA, 15 nt, Homo sapiens
cauguaucucaguac

SEQ ID NO: 1003851 - RNA, 20 nt, Homo sapiens
cauguaucucaguaccccau

SEQ ID NO: 1003852 - RNA, 19 nt, Homo sapiens
aucgaaucuacuaauucca

SEQ ID NO: 1003853 - RNA, 18 nt, Homo sapiens
aucgugccuugucauuuu

SEQ ID NO: 1003854 - RNA, 14 nt, Homo sapiens
aucguucucucuuu

SEQ ID NO: 1003855 - RNA, 18 nt, Homo sapiens
aucuaccacuguaugagu

SEQ ID NO: 1003856 - RNA, 19 nt, Homo sapiens
aucuauaauuuaccuaaga

SEQ ID NO: 1003857 - RNA, 22 nt, Homo sapiens
aucuauuuuuggagguuuauua

SEQ ID NO: 1003858 - RNA, 15 nt, Homo sapiens
aucucaaacuacugg

SEQ ID NO: 1003859 - RNA, 16 nt, Homo sapiens
aucucaccccauccca

SEQ ID NO: 1003860 - RNA, 23 nt, Homo sapiens
aucucccuggugcuuaugcucuu

SEQ ID NO: 1003861 - RNA, 19 nt, Homo sapiens
aucugagagaugacaggga

SEQ ID NO: 1003862 - RNA, 15 nt, Homo sapiens
aucugccaucugcuu

SEQ ID NO: 1003863 - RNA, 19 nt, Homo sapiens
aucuggaacccagacucag

SEQ ID NO: 1003864 - RNA, 15 nt, Homo sapiens
aucuggaaccucagc

SEQ ID NO: 1003865 - RNA, 17 nt, Homo sapiens
ccuguaaucucacuaca

SEQ ID NO: 1003866 - RNA, 16 nt, Homo sapiens
ccuguaccugugcacg

SEQ ID NO: 1003867 - RNA, 19 nt, Homo sapiens
ccugucaucaucauggcca

SEQ ID NO: 1003868 - RNA, 15 nt, Homo sapiens
ccuguccccaccucc

SEQ ID NO: 1003869 - RNA, 15 nt, Homo sapiens
ccuguccuaucacuc

SEQ ID NO: 1003870 - RNA, 19 nt, Homo sapiens
ccuguccucccgagcuccu

SEQ ID NO: 1003871 - RNA, 18 nt, Homo sapiens
ccugugacuggcagcauu

SEQ ID NO: 1003872 - RNA, 13 nt, Homo sapiens
ccugugguucuga

SEQ ID NO: 1003873 - RNA, 17 nt, Homo sapiens
ccugugucacucagcag

SEQ ID NO: 1003874 - RNA, 18 nt, Homo sapiens
ccugugucccuuguaaau

SEQ ID NO: 1003875 - RNA, 20 nt, Homo sapiens
ccuguguguccaaaacugcc

SEQ ID NO: 1003876 - RNA, 19 nt, Homo sapiens
ccuguucagagcacucauu

SEQ ID NO: 1003877 - RNA, 13 nt, Homo sapiens
ccuguugggagag

SEQ ID NO: 1003878 - RNA, 22 nt, Homo sapiens
ccuguugucaagaauagcauug

SEQ ID NO: 1003879 - RNA, 16 nt, Homo sapiens
ccuuaaaccugcaaaa

SEQ ID NO: 1003880 - RNA, 17 nt, Homo sapiens
ccuuauccuaaugaugc

SEQ ID NO: 1003881 - RNA, 20 nt, Homo sapiens
ccuuauuagagugucuuucc

SEQ ID NO: 1003882 - RNA, 14 nt, Homo sapiens
ccuucaacccgaga

SEQ ID NO: 1003883 - RNA, 20 nt, Homo sapiens
ccuucagcauugccuaggaa

SEQ ID NO: 1003884 - RNA, 23 nt, Homo sapiens
ccuucauaucauccacacaugaa

SEQ ID NO: 1003885 - RNA, 21 nt, Homo sapiens
ccuucauugccacacuuggug

SEQ ID NO: 1003886 - RNA, 15 nt, Homo sapiens
ccuucauuucaucua

SEQ ID NO: 1003887 - RNA, 15 nt, Homo sapiens
ccuucccaauccagu

SEQ ID NO: 1003888 - RNA, 21 nt, Homo sapiens
ccuuccucuuuuccuucccaa

SEQ ID NO: 1003889 - RNA, 13 nt, Homo sapiens
ccuuccuugccua

SEQ ID NO: 1003890 - RNA, 14 nt, Homo sapiens
ccuucugagcuccu

SEQ ID NO: 1003891 - RNA, 14 nt, Homo sapiens
ccuugaggucucag

SEQ ID NO: 1003892 - RNA, 19 nt, Homo sapiens
ccuugccucaaugccagua

SEQ ID NO: 1003893 - RNA, 17 nt, Homo sapiens
ccuuggcgggcacgggu

SEQ ID NO: 1003894 - RNA, 16 nt, Homo sapiens
ccuuggcugacaugaa

SEQ ID NO: 1003895 - RNA, 20 nt, Homo sapiens
ccuugugaugucauacagag

SEQ ID NO: 1003896 - RNA, 21 nt, Homo sapiens
ccuugugaugucauacagaga

SEQ ID NO: 1003897 - RNA, 21 nt, Homo sapiens
ccuugugccagagaacccagc

SEQ ID NO: 1003898 - RNA, 21 nt, Homo sapiens
ccuuguuuggggcaggaguag

SEQ ID NO: 1003899 - RNA, 18 nt, Homo sapiens
ccuuguuuguacuguaug

SEQ ID NO: 1003900 - RNA, 19 nt, Homo sapiens
ccuuuauuccuucauuuca

SEQ ID NO: 1003901 - RNA, 14 nt, Homo sapiens
ccuuucugagggcc

SEQ ID NO: 1003902 - RNA, 14 nt, Homo sapiens
ccuuugugcccuau

SEQ ID NO: 1003903 - RNA, 11 nt, Homo sapiens
ccuuuucauag

SEQ ID NO: 1003904 - RNA, 13 nt, Homo sapiens
ccuuuucaugauu

SEQ ID NO: 1003905 - RNA, 18 nt, Homo sapiens
ccuuuuccaugacugugg

SEQ ID NO: 1003906 - RNA, 18 nt, Homo sapiens
ccuuuuggcauguuccca

SEQ ID NO: 1003907 - RNA, 14 nt, Homo sapiens
cgaacaauucauau

SEQ ID NO: 1003908 - RNA, 17 nt, Homo sapiens
cgaaucuacuaauucca

SEQ ID NO: 1003909 - RNA, 23 nt, Homo sapiens
cgacacggucggggcaucuggcc

SEQ ID NO: 1003910 - RNA, 22 nt, Homo sapiens
cgacuaauuucaaaaugcuuuu

SEQ ID NO: 1003911 - RNA, 19 nt, Homo sapiens
cgacuucaucccaaaggac

SEQ ID NO: 1003912 - RNA, 17 nt, Homo sapiens
cgagaaaacaaacccag

SEQ ID NO: 1003913 - RNA, 18 nt, Homo sapiens
cgagaaaacaaacccagg

SEQ ID NO: 1003914 - RNA, 15 nt, Homo sapiens
cgagcagcugagcag

SEQ ID NO: 1003915 - RNA, 14 nt, Homo sapiens
cgaguaacuccccu

SEQ ID NO: 1003916 - RNA, 19 nt, Homo sapiens
cgaguaacuccccucaggg

SEQ ID NO: 1003917 - RNA, 18 nt, Homo sapiens
cgauaaagggaaccacuu

SEQ ID NO: 1003918 - RNA, 14 nt, Homo sapiens
cgaugacaguguuc

SEQ ID NO: 1003919 - RNA, 20 nt, Homo sapiens
cgauuuaugccucagccacu

SEQ ID NO: 1003920 - RNA, 13 nt, Homo sapiens
cgcaacaguuuuu

SEQ ID NO: 1003921 - RNA, 16 nt, Homo sapiens
cgccaggcugaccaca

SEQ ID NO: 1003922 - RNA, 17 nt, Homo sapiens
cgccaggcugaccacag

SEQ ID NO: 1003923 - RNA, 16 nt, Homo sapiens
cgcccaggcuggagug

SEQ ID NO: 1003924 - RNA, 23 nt, Homo sapiens
cgccccagcaggugcugacuuca

SEQ ID NO: 1003925 - RNA, 19 nt, Homo sapiens
cgcccccuccgcccugcca

SEQ ID NO: 1003926 - RNA, 16 nt, Homo sapiens
cgccugacaaccacug

SEQ ID NO: 1003927 - RNA, 17 nt, Homo sapiens
cgcuaauucaaggaauu

SEQ ID NO: 1003928 - RNA, 16 nt, Homo sapiens
cgcuacaccacucugg

SEQ ID NO: 1003929 - RNA, 20 nt, Homo sapiens
cgcugagccccugagcccaa

SEQ ID NO: 1003930 - RNA, 17 nt, Homo sapiens
cgcuuaucaacuaauga

SEQ ID NO: 1003931 - RNA, 15 nt, Homo sapiens
cgcuuuguugcccag

SEQ ID NO: 1003932 - RNA, 22 nt, Homo sapiens
cggacaagacccccagcacuug

SEQ ID NO: 1003933 - RNA, 14 nt, Homo sapiens
cggacagagcacgu

SEQ ID NO: 1003934 - RNA, 15 nt, Homo sapiens
cggaccaaagcaaga

SEQ ID NO: 1003935 - RNA, 15 nt, Homo sapiens
cggaccccagagccc

SEQ ID NO: 1003936 - RNA, 12 nt, Homo sapiens
cggagcacugca

SEQ ID NO: 1003937 - RNA, 13 nt, Homo sapiens
cggcaacaucucu

SEQ ID NO: 1003938 - RNA, 14 nt, Homo sapiens
cggcaacaucucug

SEQ ID NO: 1003939 - RNA, 12 nt, Homo sapiens
cggcacauuccc

SEQ ID NO: 1003940 - RNA, 17 nt, Homo sapiens
cggcaucaggcuuucuu

SEQ ID NO: 1003941 - RNA, 16 nt, Homo sapiens
cggcccaauccaaggu

SEQ ID NO: 1003942 - RNA, 18 nt, Homo sapiens
uuccacucgaugaugcuu

SEQ ID NO: 1003943 - RNA, 10 nt, Homo sapiens
uuccacugag

SEQ ID NO: 1003944 - RNA, 16 nt, Homo sapiens
uuccagcuccuguaac

SEQ ID NO: 1003945 - RNA, 15 nt, Homo sapiens
uuccaugacaacaga

SEQ ID NO: 1003946 - RNA, 16 nt, Homo sapiens
uucccaagagcaucau

SEQ ID NO: 1003947 - RNA, 16 nt, Homo sapiens
uucccaggcccacugu

SEQ ID NO: 1003948 - RNA, 21 nt, Homo sapiens
uucccaggguuauagacaguc

SEQ ID NO: 1003949 - RNA, 12 nt, Homo sapiens
uucccagugugg

SEQ ID NO: 1003950 - RNA, 17 nt, Homo sapiens
uucccauuuuugcuuag

SEQ ID NO: 1003951 - RNA, 12 nt, Homo sapiens
uuccccacugac

SEQ ID NO: 1003952 - RNA, 12 nt, Homo sapiens
uuccccagagaa

SEQ ID NO: 1003953 - RNA, 12 nt, Homo sapiens
uuccccucugcu

SEQ ID NO: 1003954 - RNA, 16 nt, Homo sapiens
uuccccuuccacugag

SEQ ID NO: 1003955 - RNA, 18 nt, Homo sapiens
uucccuguuuucccccca

SEQ ID NO: 1003956 - RNA, 22 nt, Homo sapiens
uuccgcuuggagcuauuuucca

SEQ ID NO: 1003957 - RNA, 21 nt, Homo sapiens
uuccgucaccacgacuggcca

SEQ ID NO: 1003958 - RNA, 11 nt, Homo sapiens
uuccuacuggu

SEQ ID NO: 1003959 - RNA, 21 nt, Homo sapiens
uuccuaugcuuugaaacagaa

SEQ ID NO: 1003960 - RNA, 19 nt, Homo sapiens
uuccucaucccuccaucuc

SEQ ID NO: 1003961 - RNA, 18 nt, Homo sapiens
uuccucccuauuaaccua

SEQ ID NO: 1003962 - RNA, 23 nt, Homo sapiens
uuccucucugaguggacuggccu

SEQ ID NO: 1003963 - RNA, 19 nt, Homo sapiens
uuccugaguggugccaaac

SEQ ID NO: 1003964 - RNA, 20 nt, Homo sapiens
uuccugucuuauccuccacc

SEQ ID NO: 1003965 - RNA, 21 nt, Homo sapiens
uuccuuccagugucauuucuc

SEQ ID NO: 1003966 - RNA, 13 nt, Homo sapiens
uucgcaccgucca

SEQ ID NO: 1003967 - RNA, 17 nt, Homo sapiens
uucgucuguugugcgaa

SEQ ID NO: 1003968 - RNA, 15 nt, Homo sapiens
uucuaaaguucuaag

SEQ ID NO: 1003969 - RNA, 21 nt, Homo sapiens
uucuaagacuuacucuaagau

SEQ ID NO: 1003970 - RNA, 13 nt, Homo sapiens
uucuaagauucua

SEQ ID NO: 1003971 - RNA, 17 nt, Homo sapiens
uucuaaggcucugagag

SEQ ID NO: 1003972 - RNA, 22 nt, Homo sapiens
uucuaagguccgguguucuaag

SEQ ID NO: 1003973 - RNA, 16 nt, Homo sapiens
uucuaaguuucuaaga

SEQ ID NO: 1003974 - RNA, 17 nt, Homo sapiens
uucuaaguuucuaagau

SEQ ID NO: 1003975 - RNA, 17 nt, Homo sapiens
uucuagguaggggccca

SEQ ID NO: 1003976 - RNA, 15 nt, Homo sapiens
uucuauugcugagaa

SEQ ID NO: 1003977 - RNA, 14 nt, Homo sapiens
uucucaauuccaac

SEQ ID NO: 1003978 - RNA, 19 nt, Homo sapiens
uucucacaaugucccuuca

SEQ ID NO: 1003979 - RNA, 19 nt, Homo sapiens
uucucagguguugccaaau

SEQ ID NO: 1003980 - RNA, 19 nt, Homo sapiens
uucucaucuuuuuacuaaa

SEQ ID NO: 1003981 - RNA, 21 nt, Homo sapiens
uucuccaccuagacuguaaac

SEQ ID NO: 1003982 - RNA, 16 nt, Homo sapiens
uucucccucgacauuu

SEQ ID NO: 1003983 - RNA, 13 nt, Homo sapiens
uucuccuccaugg

SEQ ID NO: 1003984 - RNA, 17 nt, Homo sapiens
uucucucucccuuuuca

SEQ ID NO: 1003985 - RNA, 19 nt, Homo sapiens
uucucugguaauauugacu

SEQ ID NO: 1003986 - RNA, 21 nt, Homo sapiens
uucucugugucuaagauucua

SEQ ID NO: 1003987 - RNA, 15 nt, Homo sapiens
uucucuuugccucaa

SEQ ID NO: 1003988 - RNA, 17 nt, Homo sapiens
uucugagaucuguugau

SEQ ID NO: 1003989 - RNA, 20 nt, Homo sapiens
uucugauaaaagauggccau

SEQ ID NO: 1003990 - RNA, 16 nt, Homo sapiens
aaaaaugcagggugau

SEQ ID NO: 1003991 - RNA, 20 nt, Homo sapiens
aaaaauguauaugcacuuau

SEQ ID NO: 1003992 - RNA, 19 nt, Homo sapiens
aaaacaaaacaaaccuuaa

SEQ ID NO: 1003993 - RNA, 14 nt, Homo sapiens
aaaacaaacccagg

SEQ ID NO: 1003994 - RNA, 11 nt, Homo sapiens
aaaacaaacuc

SEQ ID NO: 1003995 - RNA, 19 nt, Homo sapiens
aaaacagagggcugcauuc

SEQ ID NO: 1003996 - RNA, 16 nt, Homo sapiens
aaaacaggcacuuggc

SEQ ID NO: 1003997 - RNA, 16 nt, Homo sapiens
aaaacccuugggccag

SEQ ID NO: 1003998 - RNA, 14 nt, Homo sapiens
aaaacuacaaauca

SEQ ID NO: 1003999 - RNA, 19 nt, Homo sapiens
aaaacuacaaccaauggaa

SEQ ID NO: 1004000 - RNA, 17 nt, Homo sapiens
aaaagcacgacagugga

SEQ ID NO: 1004001 - RNA, 15 nt, Homo sapiens
aaaagguuuacagaa

SEQ ID NO: 1004002 - RNA, 19 nt, Homo sapiens
aaaagguuuucuucauuca

SEQ ID NO: 1004003 - RNA, 23 nt, Homo sapiens
aaaagucccaacccaaugggcuc

SEQ ID NO: 1004004 - RNA, 15 nt, Homo sapiens
aaaagugaagacaga

SEQ ID NO: 1004005 - RNA, 14 nt, Homo sapiens
aaaauaauaaucau

SEQ ID NO: 1004006 - RNA, 18 nt, Homo sapiens
aaaauacaugacauuuau

SEQ ID NO: 1004007 - RNA, 20 nt, Homo sapiens
aaaauagcuaaauaccucaa

SEQ ID NO: 1004008 - RNA, 18 nt, Homo sapiens
aaaauaguuaagacauga

SEQ ID NO: 1004009 - RNA, 15 nt, Homo sapiens
aaaauaucuacauua

SEQ ID NO: 1004010 - RNA, 22 nt, Homo sapiens
aaaaucucuccacuuucagcug

SEQ ID NO: 1004011 - RNA, 22 nt, Homo sapiens
aaaauguaugcauguugucuaa

SEQ ID NO: 1004012 - RNA, 14 nt, Homo sapiens
aaaauguaugucug

SEQ ID NO: 1004013 - RNA, 23 nt, Homo sapiens
aaaauguucuguuugcuguggaa

SEQ ID NO: 1004014 - RNA, 16 nt, Homo sapiens
aaaauuagacugugau

SEQ ID NO: 1004015 - RNA, 14 nt, Homo sapiens
aaaauuccacucaa

SEQ ID NO: 1004016 - RNA, 21 nt, Homo sapiens
aaacaaagaugccacauucaa

SEQ ID NO: 1004017 - RNA, 23 nt, Homo sapiens
aaacaacuuucuccuacucuucc

SEQ ID NO: 1004018 - RNA, 18 nt, Homo sapiens
aaacaggugcuaauuugu

SEQ ID NO: 1004019 - RNA, 20 nt, Homo sapiens
aaacaugguggguccauggg

SEQ ID NO: 1004020 - RNA, 21 nt, Homo sapiens
aaacauuaaaauauaaucucu

SEQ ID NO: 1004021 - RNA, 22 nt, Homo sapiens
aaaccaucaaguugugccaaau

SEQ ID NO: 1004022 - RNA, 18 nt, Homo sapiens
aaacccagagcggaagga

SEQ ID NO: 1004023 - RNA, 15 nt, Homo sapiens
aaacccagcucccuu

SEQ ID NO: 1004024 - RNA, 19 nt, Homo sapiens
aaacgucuucuaaacuucc

SEQ ID NO: 1004025 - RNA, 13 nt, Homo sapiens
aaacuacuuugcu

SEQ ID NO: 1004026 - RNA, 17 nt, Homo sapiens
aaacuauguaacaugua

SEQ ID NO: 1004027 - RNA, 18 nt, Homo sapiens
aaacucuacuuaauccaa

SEQ ID NO: 1004028 - RNA, 20 nt, Homo sapiens
aaacucuguuacacuuuuug

SEQ ID NO: 1004029 - RNA, 23 nt, Homo sapiens
aaacuuuucuuaaaaaguuauaa

SEQ ID NO: 1004030 - RNA, 19 nt, Homo sapiens
aaacuuuuuuucuguacca

SEQ ID NO: 1004031 - RNA, 21 nt, Homo sapiens
aaagaaaaaagcaccaaaggg

SEQ ID NO: 1004032 - RNA, 18 nt, Homo sapiens
aaagaaauuguauuauca

SEQ ID NO: 1004033 - RNA, 19 nt, Homo sapiens
aaagaacacgcucucucca

SEQ ID NO: 1004034 - RNA, 16 nt, Homo sapiens
aaagaagaccugagaa

SEQ ID NO: 1004035 - RNA, 16 nt, Homo sapiens
aaagacuggcuuuuau

SEQ ID NO: 1004036 - RNA, 15 nt, Homo sapiens
aaagacuuaagccca

SEQ ID NO: 1004037 - RNA, 20 nt, Homo sapiens
aaagaggcugccccucucac

SEQ ID NO: 1004038 - RNA, 17 nt, Homo sapiens
aaagaugccacauucaa

SEQ ID NO: 1004039 - RNA, 18 nt, Homo sapiens
aaagauucuauaguucua

SEQ ID NO: 1004040 - RNA, 14 nt, Homo sapiens
aaagcaguugagac

SEQ ID NO: 1004041 - RNA, 22 nt, Homo sapiens
aaagccagguuccacagaggac

SEQ ID NO: 1004042 - RNA, 18 nt, Homo sapiens
aaagcccaccauuuggca

SEQ ID NO: 1004043 - RNA, 16 nt, Homo sapiens
aaagcuaauuaaucau

SEQ ID NO: 1004044 - RNA, 16 nt, Homo sapiens
aaagcuucacaguacc

SEQ ID NO: 1004045 - RNA, 14 nt, Homo sapiens
aaagggagucugcc

SEQ ID NO: 1004046 - RNA, 16 nt, Homo sapiens
aaagggagugcaugug

SEQ ID NO: 1004047 - RNA, 17 nt, Homo sapiens
aaagguuuacagaauuu

SEQ ID NO: 1004048 - RNA, 19 nt, Homo sapiens
aaagguuuucuucauucau

SEQ ID NO: 1004049 - RNA, 15 nt, Homo sapiens
aaaguaaucuaccuc

SEQ ID NO: 1004050 - RNA, 15 nt, Homo sapiens
aaaguaccaggugaa

SEQ ID NO: 1004051 - RNA, 24 nt, Homo sapiens
aaaguacugggauuacaggcguga

SEQ ID NO: 1004052 - RNA, 18 nt, Homo sapiens
aaagugcuaagguucuaa

SEQ ID NO: 1004053 - RNA, 16 nt, Homo sapiens
aaagugcugcacucaa

SEQ ID NO: 1004054 - RNA, 16 nt, Homo sapiens
aaaguggacaaggagu

SEQ ID NO: 1004055 - RNA, 21 nt, Homo sapiens
aaagugggcaaaagcuuacaa

SEQ ID NO: 1004056 - RNA, 14 nt, Homo sapiens
aaagugggcuugau

SEQ ID NO: 1004057 - RNA, 23 nt, Homo sapiens
aaaguuguuguaaccugcuguga

SEQ ID NO: 1004058 - RNA, 21 nt, Homo sapiens
aaaguuuuuuauuaugcauua

SEQ ID NO: 1004059 - RNA, 23 nt, Homo sapiens
aaauaacagaaagccugggugac

SEQ ID NO: 1004060 - RNA, 12 nt, Homo sapiens
aaauaacuggaa

SEQ ID NO: 1004061 - RNA, 22 nt, Homo sapiens
aaauaauguguaguucauguaa

SEQ ID NO: 1004062 - RNA, 15 nt, Homo sapiens
aaauacagucuucca

SEQ ID NO: 1004063 - RNA, 21 nt, Homo sapiens
aaauacagucuuccauuugca

SEQ ID NO: 1004064 - RNA, 15 nt, Homo sapiens
aaauacuucuugaag

SEQ ID NO: 1004065 - RNA, 22 nt, Homo sapiens
aaauauagcuaauaacauguga

SEQ ID NO: 1004066 - RNA, 18 nt, Homo sapiens
aaauaucuucacuuguca

SEQ ID NO: 1004067 - RNA, 17 nt, Homo sapiens
aaauauuuuaaaaucag

SEQ ID NO: 1004068 - RNA, 18 nt, Homo sapiens
aaaucagaccuggcugcu

SEQ ID NO: 1004069 - RNA, 20 nt, Homo sapiens
aaaucauccaagacaguuau

SEQ ID NO: 1004070 - RNA, 17 nt, Homo sapiens
aaaucugugccugagaa

SEQ ID NO: 1004071 - RNA, 22 nt, Homo sapiens
aaaucuugguugaugccaaaaa

SEQ ID NO: 1004072 - RNA, 20 nt, Homo sapiens
aaaugaaaaauuccacucaa

SEQ ID NO: 1004073 - RNA, 15 nt, Homo sapiens
aaaugagccaugaga

SEQ ID NO: 1004074 - RNA, 15 nt, Homo sapiens
aaaugaggccaugga

SEQ ID NO: 1004075 - RNA, 14 nt, Homo sapiens
aaaugagugcuuaa

SEQ ID NO: 1004076 - RNA, 15 nt, Homo sapiens
aaaugagugcuuaaa

SEQ ID NO: 1004077 - RNA, 21 nt, Homo sapiens
aaauggggccagauccagccu

SEQ ID NO: 1004078 - RNA, 11 nt, Homo sapiens
aaauggugguc

SEQ ID NO: 1004079 - RNA, 14 nt, Homo sapiens
aaauguaaagccau

SEQ ID NO: 1004080 - RNA, 13 nt, Homo sapiens
aaaugugaugaau

SEQ ID NO: 1004081 - RNA, 15 nt, Homo sapiens
aaaugugcuggucac

SEQ ID NO: 1004082 - RNA, 21 nt, Homo sapiens
aaauguucauggacuauucca

SEQ ID NO: 1004083 - RNA, 18 nt, Homo sapiens
aaauguugagaaucccaa

SEQ ID NO: 1004084 - RNA, 17 nt, Homo sapiens
aaauuaagaaaucauuc

SEQ ID NO: 1004085 - RNA, 15 nt, Homo sapiens
aaauuaagaaggcaa

SEQ ID NO: 1004086 - RNA, 15 nt, Homo sapiens
aaauucagcauuuga

SEQ ID NO: 1004087 - RNA, 17 nt, Homo sapiens
aaauucagcauuugacc

SEQ ID NO: 1004088 - RNA, 18 nt, Homo sapiens
gugaacccaggacaagca

SEQ ID NO: 1004089 - RNA, 14 nt, Homo sapiens
gugaacguguucaa

SEQ ID NO: 1004090 - RNA, 21 nt, Homo sapiens
gugaagacagaaccacagggc

SEQ ID NO: 1004091 - RNA, 17 nt, Homo sapiens
gugaagccaaagggacu

SEQ ID NO: 1004092 - RNA, 16 nt, Homo sapiens
gugaauaaaccaucau

SEQ ID NO: 1004093 - RNA, 14 nt, Homo sapiens
gugaauagaacucu

SEQ ID NO: 1004094 - RNA, 16 nt, Homo sapiens
gugaaugaacacucuu

SEQ ID NO: 1004095 - RNA, 16 nt, Homo sapiens
gugaaugauucagugu

SEQ ID NO: 1004096 - RNA, 17 nt, Homo sapiens
gugaauuaaaguacuuu

SEQ ID NO: 1004097 - RNA, 21 nt, Homo sapiens
gugacagacaggcucuuagca

SEQ ID NO: 1004098 - RNA, 18 nt, Homo sapiens
gugacauuuauauauuga

SEQ ID NO: 1004099 - RNA, 14 nt, Homo sapiens
gugaccagugcugc

SEQ ID NO: 1004100 - RNA, 21 nt, Homo sapiens
gugaccauguuuccucucaau

SEQ ID NO: 1004101 - RNA, 16 nt, Homo sapiens
gugacuaauggcauga

SEQ ID NO: 1004102 - RNA, 22 nt, Homo sapiens
gugagcauaggugauccaugua

SEQ ID NO: 1004103 - RNA, 18 nt, Homo sapiens
gugagggcucacucagcc

SEQ ID NO: 1004104 - RNA, 15 nt, Homo sapiens
gugagucaccacuuc

SEQ ID NO: 1004105 - RNA, 19 nt, Homo sapiens
gugaguuuaccuuguauac

SEQ ID NO: 1004106 - RNA, 15 nt, Homo sapiens
gugauaugcacaaug

SEQ ID NO: 1004107 - RNA, 16 nt, Homo sapiens
gugauauucuaagacu

SEQ ID NO: 1004108 - RNA, 22 nt, Homo sapiens
gugaucagaccauaauguuaca

SEQ ID NO: 1004109 - RNA, 21 nt, Homo sapiens
gugauguaccaguuuguccau

SEQ ID NO: 1004110 - RNA, 18 nt, Homo sapiens
gugcaaaugugcugguca

SEQ ID NO: 1004111 - RNA, 22 nt, Homo sapiens
gugcaagaccgagauugaggga

SEQ ID NO: 1004112 - RNA, 19 nt, Homo sapiens
gugcagugccaccaucaua

SEQ ID NO: 1004113 - RNA, 18 nt, Homo sapiens
gugcaugugcgcgcgugc

SEQ ID NO: 1004114 - RNA, 12 nt, Homo sapiens
gugcauguguau

SEQ ID NO: 1004115 - RNA, 20 nt, Homo sapiens
gugccaaauuauucuccuau

SEQ ID NO: 1004116 - RNA, 12 nt, Homo sapiens
gugccaggugag

SEQ ID NO: 1004117 - RNA, 17 nt, Homo sapiens
gugcgugcauguguaua

SEQ ID NO: 1004118 - RNA, 12 nt, Homo sapiens
gugcuacagggu

SEQ ID NO: 1004119 - RNA, 21 nt, Homo sapiens
gugcucagcccugaggacaga

SEQ ID NO: 1004120 - RNA, 23 nt, Homo sapiens
gugcucugaguaucacaucacac

SEQ ID NO: 1004121 - RNA, 16 nt, Homo sapiens
gugcugugcugugcua

SEQ ID NO: 1004122 - RNA, 18 nt, Homo sapiens
guggaaccaacacuaaca

SEQ ID NO: 1004123 - RNA, 16 nt, Homo sapiens
guggacaggacuaaca

SEQ ID NO: 1004124 - RNA, 16 nt, Homo sapiens
guggcacucagucucu

SEQ ID NO: 1004125 - RNA, 22 nt, Homo sapiens
guggccaccaguaugacaguau

SEQ ID NO: 1004126 - RNA, 17 nt, Homo sapiens
guggcugcagccucagg

SEQ ID NO: 1004127 - RNA, 22 nt, Homo sapiens
guggcugcugaaacucauuuga

SEQ ID NO: 1004128 - RNA, 14 nt, Homo sapiens
uaaaacagaagccu

SEQ ID NO: 1004129 - RNA, 21 nt, Homo sapiens
uaaaacagguuauaacagugu

SEQ ID NO: 1004130 - RNA, 19 nt, Homo sapiens
uaaaagaugaaagagcagu

SEQ ID NO: 1004131 - RNA, 19 nt, Homo sapiens
uaaaagcauuuuguaauaa

SEQ ID NO: 1004132 - RNA, 19 nt, Homo sapiens
uaaaagugggaauuaggag

SEQ ID NO: 1004133 - RNA, 23 nt, Homo sapiens
uaaaaguuuuuuauuaugcauua

SEQ ID NO: 1004134 - RNA, 22 nt, Homo sapiens
uaaaauaauuauauaacuguau

SEQ ID NO: 1004135 - RNA, 20 nt, Homo sapiens
uaaaauacuuuuacucugcc

SEQ ID NO: 1004136 - RNA, 18 nt, Homo sapiens
uaaaauagagugcauuug

SEQ ID NO: 1004137 - RNA, 18 nt, Homo sapiens
uaaaaucccaagucauuu

SEQ ID NO: 1004138 - RNA, 17 nt, Homo sapiens
uaaaauguaaagccaug

SEQ ID NO: 1004139 - RNA, 22 nt, Homo sapiens
uaaaaugugauguucuaaggcu

SEQ ID NO: 1004140 - RNA, 18 nt, Homo sapiens
uaaacagauggcacuuug

SEQ ID NO: 1004141 - RNA, 19 nt, Homo sapiens
uaaacagauggcacuuuga

SEQ ID NO: 1004142 - RNA, 13 nt, Homo sapiens
uaaaccaucuccc

SEQ ID NO: 1004143 - RNA, 19 nt, Homo sapiens
uaaacuggaauccuuucac

SEQ ID NO: 1004144 - RNA, 16 nt, Homo sapiens
uaaacuuuaucacuua

SEQ ID NO: 1004145 - RNA, 19 nt, Homo sapiens
uaaagaaaaaaauguauuu

SEQ ID NO: 1004146 - RNA, 20 nt, Homo sapiens
uaaagaaaaaagcaccaaag

SEQ ID NO: 1004147 - RNA, 22 nt, Homo sapiens
uaaagaaaaaagcaccaaaggg

SEQ ID NO: 1004148 - RNA, 14 nt, Homo sapiens
uaaagaccacuuua

SEQ ID NO: 1004149 - RNA, 22 nt, Homo sapiens
uaaagauuuuuuaauaauuuag

SEQ ID NO: 1004150 - RNA, 18 nt, Homo sapiens
uaaaggggagaccucaga

SEQ ID NO: 1004151 - RNA, 19 nt, Homo sapiens
uaaaggggagaccucagaa

SEQ ID NO: 1004152 - RNA, 17 nt, Homo sapiens
uaaagucuguugauuaa

SEQ ID NO: 1004153 - RNA, 14 nt, Homo sapiens
uaaagugccaguau

SEQ ID NO: 1004154 - RNA, 19 nt, Homo sapiens
uaaauaacuggaaaacaga

SEQ ID NO: 1004155 - RNA, 13 nt, Homo sapiens
uaaauacccauau

SEQ ID NO: 1004156 - RNA, 15 nt, Homo sapiens
uaaauauauauucua

SEQ ID NO: 1004157 - RNA, 16 nt, Homo sapiens
uaaauccuugaugauu

SEQ ID NO: 1004158 - RNA, 13 nt, Homo sapiens
uaaaucugccaca

SEQ ID NO: 1004159 - RNA, 15 nt, Homo sapiens
uaaaugaacaagaga

SEQ ID NO: 1004160 - RNA, 14 nt, Homo sapiens
uaaauguacauuaa

SEQ ID NO: 1004161 - RNA, 14 nt, Homo sapiens
uaacaaacucugag

SEQ ID NO: 1004162 - RNA, 16 nt, Homo sapiens
uaacaacauguuucca

SEQ ID NO: 1004163 - RNA, 22 nt, Homo sapiens
uaacagaaagccugggugacau

SEQ ID NO: 1004164 - RNA, 16 nt, Homo sapiens
uaacagaaauuguaua

SEQ ID NO: 1004165 - RNA, 22 nt, Homo sapiens
uaacaucuaaaaauagacuuaa

SEQ ID NO: 1004166 - RNA, 13 nt, Homo sapiens
uaacaugugaaaa

SEQ ID NO: 1004167 - RNA, 22 nt, Homo sapiens
uaacauuaucuaguucauugaa

SEQ ID NO: 1004168 - RNA, 18 nt, Homo sapiens
uaaccacuggucaugccc

SEQ ID NO: 1004169 - RNA, 17 nt, Homo sapiens
uaccaguauaagcaucu

SEQ ID NO: 1004170 - RNA, 19 nt, Homo sapiens
uacccacucuggagcauuu

SEQ ID NO: 1004171 - RNA, 19 nt, Homo sapiens
uacccauuugggugggagu

SEQ ID NO: 1004172 - RNA, 11 nt, Homo sapiens
uacccucucag

SEQ ID NO: 1004173 - RNA, 20 nt, Homo sapiens
uaccuacauacguguuccua

SEQ ID NO: 1004174 - RNA, 18 nt, Homo sapiens
uaccuggggccaaaccca

SEQ ID NO: 1004175 - RNA, 20 nt, Homo sapiens
uaccuguguuucuugccuca

SEQ ID NO: 1004176 - RNA, 13 nt, Homo sapiens
uaccuucucccca

SEQ ID NO: 1004177 - RNA, 17 nt, Homo sapiens
uaccuugagccaguaau

SEQ ID NO: 1004178 - RNA, 24 nt, Homo sapiens
uacuaacauuuucauugaugagca

SEQ ID NO: 1004179 - RNA, 17 nt, Homo sapiens
uacuacagcuucaguga

SEQ ID NO: 1004180 - RNA, 17 nt, Homo sapiens
uacuagcagucacuuga

SEQ ID NO: 1004181 - RNA, 16 nt, Homo sapiens
uacuagggagccauuu

SEQ ID NO: 1004182 - RNA, 16 nt, Homo sapiens
uacuccucucaucccc

SEQ ID NO: 1004183 - RNA, 19 nt, Homo sapiens
uacugacggaguccugugu

SEQ ID NO: 1004184 - RNA, 18 nt, Homo sapiens
uacugaguagggggagca

SEQ ID NO: 1004185 - RNA, 17 nt, Homo sapiens
uacugcugagauacaua

SEQ ID NO: 1004186 - RNA, 17 nt, Homo sapiens
uacuggggaaacuggcc

SEQ ID NO: 1004187 - RNA, 13 nt, Homo sapiens
uacuguaauuccu

SEQ ID NO: 1004188 - RNA, 18 nt, Homo sapiens
uacuguucuaaagcucug

SEQ ID NO: 1004189 - RNA, 17 nt, Homo sapiens
uacuuagagcagugaag

SEQ ID NO: 1004190 - RNA, 20 nt, Homo sapiens
uacuucuuguguguaugcac

SEQ ID NO: 1004191 - RNA, 21 nt, Homo sapiens
uacuucuuguguguaugcaca

SEQ ID NO: 1004192 - RNA, 19 nt, Homo sapiens
uacuugggagaccuguaau

SEQ ID NO: 1004193 - RNA, 16 nt, Homo sapiens
uacuuucccucaucca

SEQ ID NO: 1004194 - RNA, 21 nt, Homo sapiens
uacuuugaagucauaccaaug

SEQ ID NO: 1004195 - RNA, 21 nt, Homo sapiens
uacuuuugcccuuugauuaaa

SEQ ID NO: 1004196 - RNA, 14 nt, Homo sapiens
uagaaaaacaggca

SEQ ID NO: 1004197 - RNA, 19 nt, Homo sapiens
uagaaaauuagacugugau

SEQ ID NO: 1004198 - RNA, 16 nt, Homo sapiens
uagaaacaacacugua

SEQ ID NO: 1004199 - RNA, 22 nt, Homo sapiens
uagaacucaaccucuacagggu

SEQ ID NO: 1004200 - RNA, 12 nt, Homo sapiens
uagaaggcugug

SEQ ID NO: 1004201 - RNA, 14 nt, Homo sapiens
uagacuaaggccau

SEQ ID NO: 1004202 - RNA, 15 nt, Homo sapiens
uagacuuaaaucuca

SEQ ID NO: 1004203 - RNA, 16 nt, Homo sapiens
uagacuuuugcuuuau

SEQ ID NO: 1004204 - RNA, 17 nt, Homo sapiens
uagacuuuugcuuuaug

SEQ ID NO: 1004205 - RNA, 22 nt, Homo sapiens
uagagauggggucucacagugu

SEQ ID NO: 1004206 - RNA, 12 nt, Homo sapiens
uagagcacugcc

SEQ ID NO: 1004207 - RNA, 16 nt, Homo sapiens
uagagcagacuacagc

SEQ ID NO: 1004208 - RNA, 18 nt, Homo sapiens
uagaguguuaucagucau

SEQ ID NO: 1004209 - RNA, 18 nt, Homo sapiens
uagaugcauuugggucca

SEQ ID NO: 1004210 - RNA, 21 nt, Homo sapiens
uagauggggagccucgggaaa

SEQ ID NO: 1004211 - RNA, 19 nt, Homo sapiens
uagauuuucuuuugccuuu

SEQ ID NO: 1004212 - RNA, 14 nt, Homo sapiens
uauccuauguuaaa

SEQ ID NO: 1004213 - RNA, 12 nt, Homo sapiens
uaucuaccccag

SEQ ID NO: 1004214 - RNA, 15 nt, Homo sapiens
uaucuaguucauuga

SEQ ID NO: 1004215 - RNA, 23 nt, Homo sapiens
uaucucaaacuacuggcaauuug

SEQ ID NO: 1004216 - RNA, 13 nt, Homo sapiens
uaucugaucagaa

SEQ ID NO: 1004217 - RNA, 15 nt, Homo sapiens
uaucuguguggugau

SEQ ID NO: 1004218 - RNA, 20 nt, Homo sapiens
uaucugugugugauuugcua

SEQ ID NO: 1004219 - RNA, 19 nt, Homo sapiens
uaucuugcaccccaaagcu

SEQ ID NO: 1004220 - RNA, 17 nt, Homo sapiens
uaucuuggacaaaucac

SEQ ID NO: 1004221 - RNA, 18 nt, Homo sapiens
uaugaguaauacaucaaa

SEQ ID NO: 1004222 - RNA, 20 nt, Homo sapiens
uaugaguaauacaucaaaga

SEQ ID NO: 1004223 - RNA, 19 nt, Homo sapiens
uaugaucuggcccuugcuu

SEQ ID NO: 1004224 - RNA, 14 nt, Homo sapiens
uaugcagaauguug

SEQ ID NO: 1004225 - RNA, 22 nt, Homo sapiens
uaugcucagggucaauuucuuu

SEQ ID NO: 1004226 - RNA, 19 nt, Homo sapiens
uauggaauuuugcaaagau

SEQ ID NO: 1004227 - RNA, 19 nt, Homo sapiens
uauggcguaaguacagaga

SEQ ID NO: 1004228 - RNA, 16 nt, Homo sapiens
uauggcuccuccauau

SEQ ID NO: 1004229 - RNA, 18 nt, Homo sapiens
uauguaccaagaaucuug

SEQ ID NO: 1004230 - RNA, 19 nt, Homo sapiens
uauguaccauguacaugaa

SEQ ID NO: 1004231 - RNA, 23 nt, Homo sapiens
uauguaguaauugacaugugcca

SEQ ID NO: 1004232 - RNA, 15 nt, Homo sapiens
uaugucaaagcaaca

SEQ ID NO: 1004233 - RNA, 20 nt, Homo sapiens
uaugucaaagcaacagucca

SEQ ID NO: 1004234 - RNA, 20 nt, Homo sapiens
uaugugaucauguguggaag

SEQ ID NO: 1004235 - RNA, 17 nt, Homo sapiens
uauguguguuuugcuaa

SEQ ID NO: 1004236 - RNA, 21 nt, Homo sapiens
uauguucaacuaggaucagaa

SEQ ID NO: 1004237 - RNA, 19 nt, Homo sapiens
uauguucccccuguuucag

SEQ ID NO: 1004238 - RNA, 16 nt, Homo sapiens
uauuaagcaucagaaa

SEQ ID NO: 1004239 - RNA, 22 nt, Homo sapiens
uauuaagcaucagaaacucugc

SEQ ID NO: 1004240 - RNA, 17 nt, Homo sapiens
uauuauacgcuggcaac

SEQ ID NO: 1004241 - RNA, 23 nt, Homo sapiens
uauuaucagagacuauguagcaa

SEQ ID NO: 1004242 - RNA, 13 nt, Homo sapiens
uauucuucuagag

SEQ ID NO: 1004243 - RNA, 15 nt, Homo sapiens
uauugcagcuuauau

SEQ ID NO: 1004244 - RNA, 19 nt, Homo sapiens
uauugcagcuuauauucau

SEQ ID NO: 1004245 - RNA, 21 nt, Homo sapiens
uauugcucacccagugcccuc

SEQ ID NO: 1004246 - RNA, 16 nt, Homo sapiens
uauuguuucaauugca

SEQ ID NO: 1004247 - RNA, 20 nt, Homo sapiens
uauuuaaauguaaagacaaa

SEQ ID NO: 1004248 - RNA, 13 nt, Homo sapiens
uauuuaagaucac

SEQ ID NO: 1004249 - RNA, 12 nt, Homo sapiens
uauuuaccucag

SEQ ID NO: 1004250 - RNA, 19 nt, Homo sapiens
uauuuccauucaacaagag

SEQ ID NO: 1004251 - RNA, 23 nt, Homo sapiens
uauuucuucaaauaaaucucucc

SEQ ID NO: 1004252 - RNA, 22 nt, Homo sapiens
uauuucuucuacugcuaucuac

SEQ ID NO: 1004253 - RNA, 22 nt, Homo sapiens
uauuugcuaccacagcaacuau

SEQ ID NO: 1004254 - RNA, 21 nt, Homo sapiens
uauuuggugauuacauuuuaa

SEQ ID NO: 1004255 - RNA, 18 nt, Homo sapiens
uauuuguaaaucugccac

SEQ ID NO: 1004256 - RNA, 13 nt, Homo sapiens
ucccuucauacuu

SEQ ID NO: 1004257 - RNA, 15 nt, Homo sapiens
ucccuucuacagccu

SEQ ID NO: 1004258 - RNA, 17 nt, Homo sapiens
ucccuucuucccuagcc

SEQ ID NO: 1004259 - RNA, 15 nt, Homo sapiens
uccgcccccagguag

SEQ ID NO: 1004260 - RNA, 20 nt, Homo sapiens
uccgcccccggauuugcuca

SEQ ID NO: 1004261 - RNA, 23 nt, Homo sapiens
uccgcucuguagugcuacagggu

SEQ ID NO: 1004262 - RNA, 11 nt, Homo sapiens
uccggcagcuu

SEQ ID NO: 1004263 - RNA, 16 nt, Homo sapiens
uccggcgggauguuga

SEQ ID NO: 1004264 - RNA, 16 nt, Homo sapiens
uccuaaaguacuggga

SEQ ID NO: 1004265 - RNA, 18 nt, Homo sapiens
uccuaaguauauuaauau

SEQ ID NO: 1004266 - RNA, 19 nt, Homo sapiens
uccuacagcuaacccucac

SEQ ID NO: 1004267 - RNA, 23 nt, Homo sapiens
uccuagcguuuuggaagaggaaa

SEQ ID NO: 1004268 - RNA, 17 nt, Homo sapiens
uccuagcugugugaaua

SEQ ID NO: 1004269 - RNA, 16 nt, Homo sapiens
uccucaugaauguaaa

SEQ ID NO: 1004270 - RNA, 13 nt, Homo sapiens
uccucauguacau

SEQ ID NO: 1004271 - RNA, 17 nt, Homo sapiens
uccucauuguaaacaaa

SEQ ID NO: 1004272 - RNA, 17 nt, Homo sapiens
uccuccacaauagcaga

SEQ ID NO: 1004273 - RNA, 17 nt, Homo sapiens
uccuccagggacagcaa

SEQ ID NO: 1004274 - RNA, 22 nt, Homo sapiens
uccucccuguaacuugauccau

SEQ ID NO: 1004275 - RNA, 10 nt, Homo sapiens
uccucugcau

SEQ ID NO: 1004276 - RNA, 19 nt, Homo sapiens
uccucugugaccaaugucu

SEQ ID NO: 1004277 - RNA, 19 nt, Homo sapiens
uccucuuuuccuucccaaa

SEQ ID NO: 1004278 - RNA, 23 nt, Homo sapiens
uccugagcucagcguggaggggu

SEQ ID NO: 1004279 - RNA, 17 nt, Homo sapiens
uccugagugcuugcuuu

SEQ ID NO: 1004280 - RNA, 20 nt, Homo sapiens
uccugcagccccagcccagc

SEQ ID NO: 1004281 - RNA, 18 nt, Homo sapiens
uccugccucuacugggaa

SEQ ID NO: 1004282 - RNA, 19 nt, Homo sapiens
uccugccucuacugggaag

SEQ ID NO: 1004283 - RNA, 16 nt, Homo sapiens
uccuggaucucccuga

SEQ ID NO: 1004284 - RNA, 13 nt, Homo sapiens
uccuggcacuaac

SEQ ID NO: 1004285 - RNA, 18 nt, Homo sapiens
uccuguauaccuccucca

SEQ ID NO: 1004286 - RNA, 16 nt, Homo sapiens
uccuguauuccugacc

SEQ ID NO: 1004287 - RNA, 13 nt, Homo sapiens
uccugugcuggaa

SEQ ID NO: 1004288 - RNA, 19 nt, Homo sapiens
uccuguucacaccagagaa

SEQ ID NO: 1004289 - RNA, 13 nt, Homo sapiens
uccuguugggaga

SEQ ID NO: 1004290 - RNA, 15 nt, Homo sapiens
uccuguuugucuaca

SEQ ID NO: 1004291 - RNA, 17 nt, Homo sapiens
uccuuacucccaggcac

SEQ ID NO: 1004292 - RNA, 20 nt, Homo sapiens
uccuuacucccaggcacugu

SEQ ID NO: 1004293 - RNA, 18 nt, Homo sapiens
uccuugcuuccugucuua

SEQ ID NO: 1004294 - RNA, 19 nt, Homo sapiens
ucgcaaugagggagcaugu

SEQ ID NO: 1004295 - RNA, 21 nt, Homo sapiens
ucgcccaggcuggagugcagu

SEQ ID NO: 1004296 - RNA, 21 nt, Homo sapiens
ucgcccugcgguagaugggag

SEQ ID NO: 1004297 - RNA, 21 nt, Homo sapiens
ucgcuuucuaaaggaaaucaa

SEQ ID NO: 1004298 - RNA, 15 nt, Homo sapiens
ucggauacuugccaa

SEQ ID NO: 1004299 - RNA, 20 nt, Homo sapiens
ucggauuagaaauaaagcau

SEQ ID NO: 1004300 - RNA, 14 nt, Homo sapiens
ucggccccagcaca

SEQ ID NO: 1004301 - RNA, 11 nt, Homo sapiens
ucggccuucac

SEQ ID NO: 1004302 - RNA, 15 nt, Homo sapiens
ucggcugaccaugcu

SEQ ID NO: 1004303 - RNA, 13 nt, Homo sapiens
ucguacucaggag

SEQ ID NO: 1004304 - RNA, 14 nt, Homo sapiens
ucgugaaaacacau

SEQ ID NO: 1004305 - RNA, 19 nt, Homo sapiens
ucgugggucagcucugagg

SEQ ID NO: 1004306 - RNA, 14 nt, Homo sapiens
ucuaaagauucuau

SEQ ID NO: 1004307 - RNA, 20 nt, Homo sapiens
ucuaaaggaaaucaaaugaa

SEQ ID NO: 1004308 - RNA, 13 nt, Homo sapiens
ucuaaaguucuaa

SEQ ID NO: 1004309 - RNA, 21 nt, Homo sapiens
ucuaaauguaguucugcucca

SEQ ID NO: 1004310 - RNA, 18 nt, Homo sapiens
ucuaacagcccuccucug

SEQ ID NO: 1004311 - RNA, 13 nt, Homo sapiens
ucuaagugauaua

SEQ ID NO: 1004312 - RNA, 14 nt, Homo sapiens
ucuugaaaguacca

SEQ ID NO: 1004313 - RNA, 19 nt, Homo sapiens
ucuugacuacagucaggaa

SEQ ID NO: 1004314 - RNA, 16 nt, Homo sapiens
ucuugcauuaugcaau

SEQ ID NO: 1004315 - RNA, 16 nt, Homo sapiens
ucuugccucaaccucc

SEQ ID NO: 1004316 - RNA, 16 nt, Homo sapiens
ucuuggaacuugccug

SEQ ID NO: 1004317 - RNA, 23 nt, Homo sapiens
ucuuggggggguggccgcugagu

SEQ ID NO: 1004318 - RNA, 20 nt, Homo sapiens
ucuuguauaagauccuagau

SEQ ID NO: 1004319 - RNA, 16 nt, Homo sapiens
ucuuguguuaccugaa

SEQ ID NO: 1004320 - RNA, 22 nt, Homo sapiens
ucuuguuucaauuccaccugca

SEQ ID NO: 1004321 - RNA, 14 nt, Homo sapiens
ucuuuaaugcaaua

SEQ ID NO: 1004322 - RNA, 16 nt, Homo sapiens
ucuuuauacagcugua

SEQ ID NO: 1004323 - RNA, 15 nt, Homo sapiens
ucuuucagcuccuga

SEQ ID NO: 1004324 - RNA, 14 nt, Homo sapiens
ucuuucccaauuca

SEQ ID NO: 1004325 - RNA, 22 nt, Homo sapiens
ucuuucucugccagugacagac

SEQ ID NO: 1004326 - RNA, 19 nt, Homo sapiens
ucuuucuuuuuuggccauc

SEQ ID NO: 1004327 - RNA, 19 nt, Homo sapiens
ucuuugcuucacagguuuu

SEQ ID NO: 1004328 - RNA, 22 nt, Homo sapiens
ucuuuuacccggcacauucccc

SEQ ID NO: 1004329 - RNA, 18 nt, Homo sapiens
ucuuuuuuuucuauuuca

SEQ ID NO: 1004330 - RNA, 20 nt, Homo sapiens
ugaaaaaaaauaaauugcuc

SEQ ID NO: 1004331 - RNA, 22 nt, Homo sapiens
ugaaaaaguuuggaagcacuga

SEQ ID NO: 1004332 - RNA, 14 nt, Homo sapiens
ugaaaaaucuaagu

SEQ ID NO: 1004333 - RNA, 18 nt, Homo sapiens
ugaaaaauuccacucaaa

SEQ ID NO: 1004334 - RNA, 14 nt, Homo sapiens
ugaaaacaauguaa

SEQ ID NO: 1004335 - RNA, 19 nt, Homo sapiens
ugaaaaugguccaggagaa

SEQ ID NO: 1004336 - RNA, 17 nt, Homo sapiens
ugaaaggacccugugag

SEQ ID NO: 1004337 - RNA, 16 nt, Homo sapiens
ugaaaguggacaagga

SEQ ID NO: 1004338 - RNA, 17 nt, Homo sapiens
ugaaaguggacaaggag

SEQ ID NO: 1004339 - RNA, 15 nt, Homo sapiens
ugaaaugcuggcauu

SEQ ID NO: 1004340 - RNA, 18 nt, Homo sapiens
ugaaaugcuggcauuugc

SEQ ID NO: 1004341 - RNA, 17 nt, Homo sapiens
ugaaauuaagaaggcaa

SEQ ID NO: 1004342 - RNA, 12 nt, Homo sapiens
ugaacaaacaau

SEQ ID NO: 1004343 - RNA, 11 nt, Homo sapiens
ugaacaaagca

SEQ ID NO: 1004344 - RNA, 17 nt, Homo sapiens
ugaacaaagcagccacg

SEQ ID NO: 1004345 - RNA, 16 nt, Homo sapiens
ugaacaaaguuuacca

SEQ ID NO: 1004346 - RNA, 22 nt, Homo sapiens
ugaaccaagaccauugaauucu

SEQ ID NO: 1004347 - RNA, 19 nt, Homo sapiens
ugaacccaggacaagcaug

SEQ ID NO: 1004348 - RNA, 18 nt, Homo sapiens
ugaaccugaauauugcca

SEQ ID NO: 1004349 - RNA, 21 nt, Homo sapiens
ugaaccuuugugcccuaucac

SEQ ID NO: 1004350 - RNA, 15 nt, Homo sapiens
ugaagacuagaaaau

SEQ ID NO: 1004351 - RNA, 21 nt, Homo sapiens
ugaagauauucuacuaugcau

SEQ ID NO: 1004352 - RNA, 23 nt, Homo sapiens
ugaagcaaaugucaugcugccuu

SEQ ID NO: 1004353 - RNA, 14 nt, Homo sapiens
ugaagccaauucag

SEQ ID NO: 1004354 - RNA, 21 nt, Homo sapiens
ugaagccaauucagacaggca

SEQ ID NO: 1004355 - RNA, 19 nt, Homo sapiens
ugaagggccacugggaccc

SEQ ID NO: 1004356 - RNA, 13 nt, Homo sapiens
ugaaggggccaug

SEQ ID NO: 1004357 - RNA, 18 nt, Homo sapiens
ugaagggggcggccuaug

SEQ ID NO: 1004358 - RNA, 14 nt, Homo sapiens
ugaaguugcugcuu

SEQ ID NO: 1004359 - RNA, 15 nt, Homo sapiens
ugaaguugcugcuuc

SEQ ID NO: 1004360 - RNA, 13 nt, Homo sapiens
aaaaaaccaucca

SEQ ID NO: 1004361 - RNA, 19 nt, Homo sapiens
aaaaaauucacaugaugca

SEQ ID NO: 1004362 - RNA, 15 nt, Homo sapiens
aaaaacaggucuuca

SEQ ID NO: 1004363 - RNA, 21 nt, Homo sapiens
aaaaaccaucaaguugugcca

SEQ ID NO: 1004364 - RNA, 14 nt, Homo sapiens
aaaaacuauaugua

SEQ ID NO: 1004365 - RNA, 12 nt, Homo sapiens
aaaaagcuucca

SEQ ID NO: 1004366 - RNA, 22 nt, Homo sapiens
aaaaauauguaccaagaaucuu

SEQ ID NO: 1004367 - RNA, 15 nt, Homo sapiens
aaaaaugggaacaag

SEQ ID NO: 1004368 - RNA, 21 nt, Homo sapiens
aaaaauguaucugugugugau

SEQ ID NO: 1004369 - RNA, 20 nt, Homo sapiens
aaaacaauguaagagccuaa

SEQ ID NO: 1004370 - RNA, 11 nt, Homo sapiens
aaaacacugug

SEQ ID NO: 1004371 - RNA, 16 nt, Homo sapiens
aaaacagaacacuuau

SEQ ID NO: 1004372 - RNA, 16 nt, Homo sapiens
aaaagaagcaaccuca

SEQ ID NO: 1004373 - RNA, 17 nt, Homo sapiens
aaaagcauaaggccgga

SEQ ID NO: 1004374 - RNA, 17 nt, Homo sapiens
aaaagcauguuaugugu

SEQ ID NO: 1004375 - RNA, 15 nt, Homo sapiens
aaaagccacaaugaa

SEQ ID NO: 1004376 - RNA, 22 nt, Homo sapiens
aaaagcgaaacacacaaaccag

SEQ ID NO: 1004377 - RNA, 23 nt, Homo sapiens
aaaaggacuauaagaauaauuuc

SEQ ID NO: 1004378 - RNA, 16 nt, Homo sapiens
aaaaggauaagugaac

SEQ ID NO: 1004379 - RNA, 22 nt, Homo sapiens
aaaaguggcauuuccuggucag

SEQ ID NO: 1004380 - RNA, 16 nt, Homo sapiens
aaaaucaugggccaga

SEQ ID NO: 1004381 - RNA, 13 nt, Homo sapiens
aaaauccaaggca

SEQ ID NO: 1004382 - RNA, 20 nt, Homo sapiens
aaaauccaaggcaauuccug

SEQ ID NO: 1004383 - RNA, 18 nt, Homo sapiens
aaaaucccaagucauuuc

SEQ ID NO: 1004384 - RNA, 23 nt, Homo sapiens
aaaauccuuuuggcauguuccca

SEQ ID NO: 1004385 - RNA, 19 nt, Homo sapiens
aaaaucucuccacuuucag

SEQ ID NO: 1004386 - RNA, 23 nt, Homo sapiens
aaaaugaaggaaaagcauguuau

SEQ ID NO: 1004387 - RNA, 16 nt, Homo sapiens
aaaaugagugcuuaaa

SEQ ID NO: 1004388 - RNA, 14 nt, Homo sapiens
aaaaugcaaaagca

SEQ ID NO: 1004389 - RNA, 12 nt, Homo sapiens
ccaugacaugga

SEQ ID NO: 1004390 - RNA, 20 nt, Homo sapiens
ccaugagaugauacauccaa

SEQ ID NO: 1004391 - RNA, 17 nt, Homo sapiens
ccaugcguccuggucaa

SEQ ID NO: 1004392 - RNA, 22 nt, Homo sapiens
ccaugcugcuggggaagacagu

SEQ ID NO: 1004393 - RNA, 16 nt, Homo sapiens
ccaugcugugcugugu

SEQ ID NO: 1004394 - RNA, 19 nt, Homo sapiens
ccauguacaguauguucaa

SEQ ID NO: 1004395 - RNA, 21 nt, Homo sapiens
ccauguccaaagaggcugccc

SEQ ID NO: 1004396 - RNA, 21 nt, Homo sapiens
ccauguuuagugaaugacuuu

SEQ ID NO: 1004397 - RNA, 16 nt, Homo sapiens
ccauuacugcauaaaa

SEQ ID NO: 1004398 - RNA, 15 nt, Homo sapiens
ccauugguccaagau

SEQ ID NO: 1004399 - RNA, 21 nt, Homo sapiens
ccauuuauuauuuuguaacuu

SEQ ID NO: 1004400 - RNA, 16 nt, Homo sapiens
ccauuucuaauuaugu

SEQ ID NO: 1004401 - RNA, 17 nt, Homo sapiens
cccaaaaauuacuuugg

SEQ ID NO: 1004402 - RNA, 15 nt, Homo sapiens
cccaaguccucauuu

SEQ ID NO: 1004403 - RNA, 17 nt, Homo sapiens
cccaaguucaugcagcu

SEQ ID NO: 1004404 - RNA, 21 nt, Homo sapiens
cccaaugggcucaaacuucua

SEQ ID NO: 1004405 - RNA, 22 nt, Homo sapiens
cccaauuucggauuuuuuccaa

SEQ ID NO: 1004406 - RNA, 18 nt, Homo sapiens
cccacaagccugagggaa

SEQ ID NO: 1004407 - RNA, 22 nt, Homo sapiens
cccacacccuggaggauuucau

SEQ ID NO: 1004408 - RNA, 21 nt, Homo sapiens
cccacaggccacggaccaaug

SEQ ID NO: 1004409 - RNA, 13 nt, Homo sapiens
cccacagucccau

SEQ ID NO: 1004410 - RNA, 15 nt, Homo sapiens
cccacggacaaaacc

SEQ ID NO: 1004411 - RNA, 23 nt, Homo sapiens
cccacuccaagcccagcccaugg

SEQ ID NO: 1004412 - RNA, 18 nt, Homo sapiens
cccacuguaucuaggcaa

SEQ ID NO: 1004413 - RNA, 12 nt, Homo sapiens
cccagacaaaaa

SEQ ID NO: 1004414 - RNA, 17 nt, Homo sapiens
cccagacuagauguagu

SEQ ID NO: 1004415 - RNA, 18 nt, Homo sapiens
cccagagacauacuugaa

SEQ ID NO: 1004416 - RNA, 19 nt, Homo sapiens
cccagagacauacuugaag

SEQ ID NO: 1004417 - RNA, 22 nt, Homo sapiens
cccagaggcagcagagcauuca

SEQ ID NO: 1004418 - RNA, 16 nt, Homo sapiens
cccagcagugccuugu

SEQ ID NO: 1004419 - RNA, 15 nt, Homo sapiens
gacaagccagaacuu

SEQ ID NO: 1004420 - RNA, 11 nt, Homo sapiens
gacaagccauc

SEQ ID NO: 1004421 - RNA, 21 nt, Homo sapiens
gacaagccauuauaccaccag

SEQ ID NO: 1004422 - RNA, 20 nt, Homo sapiens
gacaccugggagaaaucugg

SEQ ID NO: 1004423 - RNA, 15 nt, Homo sapiens
gacacuaucacucau

SEQ ID NO: 1004424 - RNA, 22 nt, Homo sapiens
gacacuuaauacuaccuugaaa

SEQ ID NO: 1004425 - RNA, 14 nt, Homo sapiens
gacacuuguacaau

SEQ ID NO: 1004426 - RNA, 18 nt, Homo sapiens
gacagaacaccuaugcaa

SEQ ID NO: 1004427 - RNA, 18 nt, Homo sapiens
gacagaaugagaccaaac

SEQ ID NO: 1004428 - RNA, 22 nt, Homo sapiens
gacagagggcucaccucuugcc

SEQ ID NO: 1004429 - RNA, 23 nt, Homo sapiens
gacagaugaggcuuuccauggga

SEQ ID NO: 1004430 - RNA, 20 nt, Homo sapiens
gacagauuuggaugcacuca

SEQ ID NO: 1004431 - RNA, 12 nt, Homo sapiens
gacagggcgggg

SEQ ID NO: 1004432 - RNA, 22 nt, Homo sapiens
gacauccaggaggaauaagcuc

SEQ ID NO: 1004433 - RNA, 18 nt, Homo sapiens
gacaugaaaggacccugu

SEQ ID NO: 1004434 - RNA, 16 nt, Homo sapiens
gacaugauuuccuuga

SEQ ID NO: 1004435 - RNA, 16 nt, Homo sapiens
gacauguggggccagg

SEQ ID NO: 1004436 - RNA, 14 nt, Homo sapiens
gacauuccaaagaa

SEQ ID NO: 1004437 - RNA, 20 nt, Homo sapiens
gacauuccaaagaacagccu

SEQ ID NO: 1004438 - RNA, 19 nt, Homo sapiens
gacauuggcaccuaaucca

SEQ ID NO: 1004439 - RNA, 13 nt, Homo sapiens
gaccaaagcaaga

SEQ ID NO: 1004440 - RNA, 22 nt, Homo sapiens
gaccacugaagcaccacaggga

SEQ ID NO: 1004441 - RNA, 15 nt, Homo sapiens
gaccagccuggccca

SEQ ID NO: 1004442 - RNA, 21 nt, Homo sapiens
gaccaggcaccaggcaggguc

SEQ ID NO: 1004443 - RNA, 20 nt, Homo sapiens
gaccaguugaagcugacuca

SEQ ID NO: 1004444 - RNA, 15 nt, Homo sapiens
gacccccagcacuug

SEQ ID NO: 1004445 - RNA, 19 nt, Homo sapiens
gaccccccuuucacaggca

SEQ ID NO: 1004446 - RNA, 16 nt, Homo sapiens
gaccucguacucagga

SEQ ID NO: 1004447 - RNA, 15 nt, Homo sapiens
gaccucuacugccuu

SEQ ID NO: 1004448 - RNA, 21 nt, Homo sapiens
gaccuggauggggcaggccac

SEQ ID NO: 1004449 - RNA, 15 nt, Homo sapiens
gaccuuccucaucca

SEQ ID NO: 1004450 - RNA, 14 nt, Homo sapiens
gacggagcacugca

SEQ ID NO: 1004451 - RNA, 22 nt, Homo sapiens
gacggucaguccaugucucgga

SEQ ID NO: 1004452 - RNA, 14 nt, Homo sapiens
gacuaauuucaaaa

SEQ ID NO: 1004453 - RNA, 16 nt, Homo sapiens
gacuagaugauggaug

SEQ ID NO: 1004454 - RNA, 20 nt, Homo sapiens
gacuauggauaaacuaaaca

SEQ ID NO: 1004455 - RNA, 19 nt, Homo sapiens
gacucaaauguucuaaguu

SEQ ID NO: 1004456 - RNA, 20 nt, Homo sapiens
gacuccaaacagaccccugu

SEQ ID NO: 1004457 - RNA, 13 nt, Homo sapiens
gacuccaguuaaa

SEQ ID NO: 1004458 - RNA, 16 nt, Homo sapiens
gacucgguuucuccaa

SEQ ID NO: 1004459 - RNA, 18 nt, Homo sapiens
gacucguucuucugggaa

SEQ ID NO: 1004460 - RNA, 17 nt, Homo sapiens
gacucuugcagggguag

SEQ ID NO: 1004461 - RNA, 22 nt, Homo sapiens
gacuggcagcauugacucugug

SEQ ID NO: 1004462 - RNA, 20 nt, Homo sapiens
gacuggguuuugugauugcc

SEQ ID NO: 1004463 - RNA, 22 nt, Homo sapiens
gacugugcauacuuucccucau

SEQ ID NO: 1004464 - RNA, 22 nt, Homo sapiens
gacuuaagcccagugcacugaa

SEQ ID NO: 1004465 - RNA, 17 nt, Homo sapiens
gacuucaucccaaagga

SEQ ID NO: 1004466 - RNA, 23 nt, Homo sapiens
gacuugaaauucucaucagucca

SEQ ID NO: 1004467 - RNA, 20 nt, Homo sapiens
gacuuguuuuaaacuugccu

SEQ ID NO: 1004468 - RNA, 20 nt, Homo sapiens
gacuuguuuuaugcucaggg

SEQ ID NO: 1004469 - RNA, 19 nt, Homo sapiens
gagaaaucuauagaacuga

SEQ ID NO: 1004470 - RNA, 20 nt, Homo sapiens
gagaaaugcuuagaaauuca

SEQ ID NO: 1004471 - RNA, 21 nt, Homo sapiens
gagaaauuuaaacuauaagca

SEQ ID NO: 1004472 - RNA, 21 nt, Homo sapiens
gagaagcaaaaucuaccaggu

SEQ ID NO: 1004473 - RNA, 16 nt, Homo sapiens
gagaaggaggggagca

SEQ ID NO: 1004474 - RNA, 13 nt, Homo sapiens
gagaaguauacau

SEQ ID NO: 1004475 - RNA, 21 nt, Homo sapiens
gagaaucccaaauuugauuga

SEQ ID NO: 1004476 - RNA, 16 nt, Homo sapiens
gagaauuuaaacaaug

SEQ ID NO: 1004477 - RNA, 22 nt, Homo sapiens
gagacauacuugaagggccaga

SEQ ID NO: 1004478 - RNA, 23 nt, Homo sapiens
gagacauacuugaagggccagag

SEQ ID NO: 1004479 - RNA, 11 nt, Homo sapiens
gagacauguga

SEQ ID NO: 1004480 - RNA, 15 nt, Homo sapiens
gagacaugugacauu

SEQ ID NO: 1004481 - RNA, 20 nt, Homo sapiens
gagaccaccuuuuugaguga

SEQ ID NO: 1004482 - RNA, 17 nt, Homo sapiens
gagacccaagcugccuc

SEQ ID NO: 1004483 - RNA, 19 nt, Homo sapiens
gagaccuagagaucuggcu

SEQ ID NO: 1004484 - RNA, 15 nt, Homo sapiens
gagaccuuccagaaa

SEQ ID NO: 1004485 - RNA, 14 nt, Homo sapiens
gagagagaaggcag

SEQ ID NO: 1004486 - RNA, 13 nt, Homo sapiens
gagagagcuccug

SEQ ID NO: 1004487 - RNA, 15 nt, Homo sapiens
gagagcagacuggcg

SEQ ID NO: 1004488 - RNA, 23 nt, Homo sapiens
gagagcccgaggaggugucucag

SEQ ID NO: 1004489 - RNA, 17 nt, Homo sapiens
gagagcuaggagcaaag

SEQ ID NO: 1004490 - RNA, 15 nt, Homo sapiens
gagagggacuggcag

SEQ ID NO: 1004491 - RNA, 14 nt, Homo sapiens
gagaugacagggaa

SEQ ID NO: 1004492 - RNA, 16 nt, Homo sapiens
gagaugauacauccaa

SEQ ID NO: 1004493 - RNA, 22 nt, Homo sapiens
gagauugcaccacugcacucca

SEQ ID NO: 1004494 - RNA, 16 nt, Homo sapiens
gagcacccuacaggga

SEQ ID NO: 1004495 - RNA, 18 nt, Homo sapiens
gagcacucauuccuuccc

SEQ ID NO: 1004496 - RNA, 21 nt, Homo sapiens
gagcacuguuuauacacugug

SEQ ID NO: 1004497 - RNA, 21 nt, Homo sapiens
gagcagugaaugauucagugu

SEQ ID NO: 1004498 - RNA, 17 nt, Homo sapiens
gagcaguggcuggucca

SEQ ID NO: 1004499 - RNA, 19 nt, Homo sapiens
gagcaguggcugguccagg

SEQ ID NO: 1004500 - RNA, 19 nt, Homo sapiens
gagcaucacagaaugugau

SEQ ID NO: 1004501 - RNA, 21 nt, Homo sapiens
gagcauucagacuccaaacag

SEQ ID NO: 1004502 - RNA, 12 nt, Homo sapiens
gagccaagggau

SEQ ID NO: 1004503 - RNA, 14 nt, Homo sapiens
gagccaccaugccc

SEQ ID NO: 1004504 - RNA, 13 nt, Homo sapiens
gagccauaugaau

SEQ ID NO: 1004505 - RNA, 17 nt, Homo sapiens
gagcccacgacacugca

SEQ ID NO: 1004506 - RNA, 13 nt, Homo sapiens
gagcccaggagcu

SEQ ID NO: 1004507 - RNA, 19 nt, Homo sapiens
gagccucgcaacccgugcc

SEQ ID NO: 1004508 - RNA, 23 nt, Homo sapiens
gagccuguaaacuuuaucacuua

SEQ ID NO: 1004509 - RNA, 20 nt, Homo sapiens
gcaauuuuucaagagcuccu

SEQ ID NO: 1004510 - RNA, 14 nt, Homo sapiens
gcacacagggcagu

SEQ ID NO: 1004511 - RNA, 12 nt, Homo sapiens
gcacacauauac

SEQ ID NO: 1004512 - RNA, 21 nt, Homo sapiens
gcacaggaguguccucuuccc

SEQ ID NO: 1004513 - RNA, 21 nt, Homo sapiens
gcacaggcgcaucccaggccu

SEQ ID NO: 1004514 - RNA, 16 nt, Homo sapiens
gcaccaccaagccaag

SEQ ID NO: 1004515 - RNA, 12 nt, Homo sapiens
gcaccagcaaaa

SEQ ID NO: 1004516 - RNA, 13 nt, Homo sapiens
gcaccaugcugcu

SEQ ID NO: 1004517 - RNA, 22 nt, Homo sapiens
gcccugggaccgcuacaccacu

SEQ ID NO: 1004518 - RNA, 15 nt, Homo sapiens
gcccuucacugucac

SEQ ID NO: 1004519 - RNA, 19 nt, Homo sapiens
gcccuugaguccccauuga

SEQ ID NO: 1004520 - RNA, 20 nt, Homo sapiens
gccgauaucaacacuuguau

SEQ ID NO: 1004521 - RNA, 16 nt, Homo sapiens
gccgccggcugugcag

SEQ ID NO: 1004522 - RNA, 13 nt, Homo sapiens
gccggcugugcag

SEQ ID NO: 1004523 - RNA, 19 nt, Homo sapiens
guguccugagccccaggga

SEQ ID NO: 1004524 - RNA, 9 nt, Homo sapiens
gugugagug

SEQ ID NO: 1004525 - RNA, 12 nt, Homo sapiens
gugugauuugcu

SEQ ID NO: 1004526 - RNA, 18 nt, Homo sapiens
gugugccaagaguucgau

SEQ ID NO: 1004527 - RNA, 20 nt, Homo sapiens
gugugcugggaucuacuuuc

SEQ ID NO: 1004528 - RNA, 20 nt, Homo sapiens
gugugguacagagaagccag

SEQ ID NO: 1004529 - RNA, 15 nt, Homo sapiens
guguguaugcacaug

SEQ ID NO: 1004530 - RNA, 19 nt, Homo sapiens
guguguccaaaacugccuc

SEQ ID NO: 1004531 - RNA, 17 nt, Homo sapiens
guguguugauacuguug

SEQ ID NO: 1004532 - RNA, 18 nt, Homo sapiens
guguucacaacagugaaa

SEQ ID NO: 1004533 - RNA, 16 nt, Homo sapiens
guguuccccacuguau

SEQ ID NO: 1004534 - RNA, 23 nt, Homo sapiens
guguucuccugcugcucccucag

SEQ ID NO: 1004535 - RNA, 17 nt, Homo sapiens
guguuuccacagccugc

SEQ ID NO: 1004536 - RNA, 13 nt, Homo sapiens
guguuucuugccu

SEQ ID NO: 1004537 - RNA, 15 nt, Homo sapiens
guguuuuuaaggaaa

SEQ ID NO: 1004538 - RNA, 17 nt, Homo sapiens
guuaauaaaccuuugca

SEQ ID NO: 1004539 - RNA, 20 nt, Homo sapiens
guuaauuuuuccaacuacua

SEQ ID NO: 1004540 - RNA, 12 nt, Homo sapiens
guuacacagggu

SEQ ID NO: 1004541 - RNA, 21 nt, Homo sapiens
guuacugcuugaccaaagagc

SEQ ID NO: 1004542 - RNA, 22 nt, Homo sapiens
guuagagcaggacugaugucuc

SEQ ID NO: 1004543 - RNA, 12 nt, Homo sapiens
guucaaagccag

SEQ ID NO: 1004544 - RNA, 16 nt, Homo sapiens
guucauugcacuuuga

SEQ ID NO: 1004545 - RNA, 20 nt, Homo sapiens
guuccaaauucaguuucaua

SEQ ID NO: 1004546 - RNA, 21 nt, Homo sapiens
guuccacagacggaaggguaa

SEQ ID NO: 1004547 - RNA, 13 nt, Homo sapiens
guuccccacugac

SEQ ID NO: 1004548 - RNA, 20 nt, Homo sapiens
guuccccacugacagccucc

SEQ ID NO: 1004549 - RNA, 13 nt, Homo sapiens
guuccccagagaa

SEQ ID NO: 1004550 - RNA, 14 nt, Homo sapiens
guucccccugugca

SEQ ID NO: 1004551 - RNA, 21 nt, Homo sapiens
guuccccuaguucuacaugaa

SEQ ID NO: 1004552 - RNA, 15 nt, Homo sapiens
guuccccuucaguac

SEQ ID NO: 1004553 - RNA, 15 nt, Homo sapiens
guuccuuucuuuucc

SEQ ID NO: 1004554 - RNA, 19 nt, Homo sapiens
guucgauguuagcguuuac

SEQ ID NO: 1004555 - RNA, 17 nt, Homo sapiens
guucuaaaguucuaaga

SEQ ID NO: 1004556 - RNA, 20 nt, Homo sapiens
guucucagguguugccaaau

SEQ ID NO: 1004557 - RNA, 12 nt, Homo sapiens
guucuccagugu

SEQ ID NO: 1004558 - RNA, 18 nt, Homo sapiens
guucuguuaacugaauac

SEQ ID NO: 1004559 - RNA, 12 nt, Homo sapiens
guucuugcucca

SEQ ID NO: 1004560 - RNA, 17 nt, Homo sapiens
guucuuuaaaauguaaa

SEQ ID NO: 1004561 - RNA, 22 nt, Homo sapiens
guucuuuaaaauguaaagccau

SEQ ID NO: 1004562 - RNA, 23 nt, Homo sapiens
guucuuuggaaaguacacucugc

SEQ ID NO: 1004563 - RNA, 14 nt, Homo sapiens
guucuuugggccag

SEQ ID NO: 1004564 - RNA, 16 nt, Homo sapiens
guucuuugggccagac

SEQ ID NO: 1004565 - RNA, 15 nt, Homo sapiens
guugacuuuacccau

SEQ ID NO: 1004566 - RNA, 18 nt, Homo sapiens
guugauuacagugcagug

SEQ ID NO: 1004567 - RNA, 10 nt, Homo sapiens
guugcagcug

SEQ ID NO: 1004568 - RNA, 18 nt, Homo sapiens
guuggccugcacuggugu

SEQ ID NO: 1004569 - RNA, 13 nt, Homo sapiens
guuguuguuguug

SEQ ID NO: 1004570 - RNA, 22 nt, Homo sapiens
guuuaaaaaggcaguuugcaaa

SEQ ID NO: 1004571 - RNA, 15 nt, Homo sapiens
guuuauacacugugu

SEQ ID NO: 1004572 - RNA, 19 nt, Homo sapiens
guuucaccauguuagccag

SEQ ID NO: 1004573 - RNA, 18 nt, Homo sapiens
guuucagcacuagccaaa

SEQ ID NO: 1004574 - RNA, 20 nt, Homo sapiens
guuucauuuagucaugugac

SEQ ID NO: 1004575 - RNA, 16 nt, Homo sapiens
guuuccacagccugca

SEQ ID NO: 1004576 - RNA, 16 nt, Homo sapiens
guuucccuuucacugg

SEQ ID NO: 1004577 - RNA, 19 nt, Homo sapiens
guuuccuagcugugugaau

SEQ ID NO: 1004578 - RNA, 12 nt, Homo sapiens
guuuccugaaac

SEQ ID NO: 1004579 - RNA, 17 nt, Homo sapiens
guuucuaggcaccucag

SEQ ID NO: 1004580 - RNA, 14 nt, Homo sapiens
guuucuugccucau

SEQ ID NO: 1004581 - RNA, 24 nt, Homo sapiens
guuucuugccugaacuccugccau

SEQ ID NO: 1004582 - RNA, 18 nt, Homo sapiens
guuucuugugcacuggca

SEQ ID NO: 1004583 - RNA, 15 nt, Homo sapiens
guuugacauuugucu

SEQ ID NO: 1004584 - RNA, 17 nt, Homo sapiens
guuugauuauucagugu

SEQ ID NO: 1004585 - RNA, 21 nt, Homo sapiens
guuuggacccaguucagugag

SEQ ID NO: 1004586 - RNA, 17 nt, Homo sapiens
guuuggagagagcagac

SEQ ID NO: 1004587 - RNA, 15 nt, Homo sapiens
guuuggccucucuau

SEQ ID NO: 1004588 - RNA, 13 nt, Homo sapiens
guuuggcuuucag

SEQ ID NO: 1004589 - RNA, 16 nt, Homo sapiens
guuuguaguugaauau

SEQ ID NO: 1004590 - RNA, 22 nt, Homo sapiens
guuugucacacgauaaagggau

SEQ ID NO: 1004591 - RNA, 19 nt, Homo sapiens
guuuguguguugucucuug

SEQ ID NO: 1004592 - RNA, 15 nt, Homo sapiens
guuuuaaacauuaau

SEQ ID NO: 1004593 - RNA, 12 nt, Homo sapiens
guuuucauuugu

SEQ ID NO: 1004594 - RNA, 23 nt, Homo sapiens
guuuuguagagauggggucucac

SEQ ID NO: 1004595 - RNA, 13 nt, Homo sapiens
guuuuuacuguga

SEQ ID NO: 1004596 - RNA, 15 nt, Homo sapiens
guuuuuggcaccuua

SEQ ID NO: 1004597 - RNA, 22 nt, Homo sapiens
guuuuugggggguuuucuugcc

SEQ ID NO: 1004598 - RNA, 16 nt, Homo sapiens
guuuuuucacugccug

SEQ ID NO: 1004599 - RNA, 12 nt, Homo sapiens
uaaaaaacaguc

SEQ ID NO: 1004600 - RNA, 14 nt, Homo sapiens
uaaaaagcuuccau

SEQ ID NO: 1004601 - RNA, 17 nt, Homo sapiens
uaaaaaggcaguuugca

SEQ ID NO: 1004602 - RNA, 16 nt, Homo sapiens
uaaaaaugucaucuca

SEQ ID NO: 1004603 - RNA, 23 nt, Homo sapiens
uaaaaauugugaucagaccauaa

SEQ ID NO: 1004604 - RNA, 20 nt, Homo sapiens
uaaaacagaagccugaugcu

SEQ ID NO: 1004605 - RNA, 21 nt, Homo sapiens
uaaaacagguagaauuaucua

SEQ ID NO: 1004606 - RNA, 22 nt, Homo sapiens
uaaaaguuuuuuauuaugcauu

SEQ ID NO: 1004607 - RNA, 24 nt, Homo sapiens
uaaaauacuuuuacucugccuaca

SEQ ID NO: 1004608 - RNA, 12 nt, Homo sapiens
uaaaaucucaaa

SEQ ID NO: 1004609 - RNA, 17 nt, Homo sapiens
uaaaaugacaagcacua

SEQ ID NO: 1004610 - RNA, 21 nt, Homo sapiens
uaaaaugugauguucuaaggc

SEQ ID NO: 1004611 - RNA, 12 nt, Homo sapiens
uaaacagaggau

SEQ ID NO: 1004612 - RNA, 14 nt, Homo sapiens
uaaacuguacagug

SEQ ID NO: 1004613 - RNA, 15 nt, Homo sapiens
uaaacuguacagugu

SEQ ID NO: 1004614 - RNA, 14 nt, Homo sapiens
uaaagcaaauuuau

SEQ ID NO: 1004615 - RNA, 18 nt, Homo sapiens
uaaagcaauaugcauuua

SEQ ID NO: 1004616 - RNA, 16 nt, Homo sapiens
uaaagccaaacauaua

SEQ ID NO: 1004617 - RNA, 20 nt, Homo sapiens
uaaagugacuaauggcauga

SEQ ID NO: 1004618 - RNA, 15 nt, Homo sapiens
uaaagugcuaagguu

SEQ ID NO: 1004619 - RNA, 18 nt, Homo sapiens
uaaagugcugcacucaaa

SEQ ID NO: 1004620 - RNA, 15 nt, Homo sapiens
uaaaguugauaaaga

SEQ ID NO: 1004621 - RNA, 16 nt, Homo sapiens
uaaauaaaauuuguug

SEQ ID NO: 1004622 - RNA, 21 nt, Homo sapiens
uaaauaacuggaaaacagaac

SEQ ID NO: 1004623 - RNA, 18 nt, Homo sapiens
uaaauaagauucuaacgg

SEQ ID NO: 1004624 - RNA, 23 nt, Homo sapiens
aaaguuuuauaacuuguguuauu

SEQ ID NO: 1004625 - RNA, 17 nt, Homo sapiens
aaauaaaaggaagccaa

SEQ ID NO: 1004626 - RNA, 17 nt, Homo sapiens
aaauaagacuuccacuc

SEQ ID NO: 1004627 - RNA, 15 nt, Homo sapiens
aaauaagagcucagg

SEQ ID NO: 1004628 - RNA, 18 nt, Homo sapiens
aaauacagacuggaugua

SEQ ID NO: 1004629 - RNA, 14 nt, Homo sapiens
aaauacuacugugu

SEQ ID NO: 1004630 - RNA, 20 nt, Homo sapiens
aaauacuuagagcagugaag

SEQ ID NO: 1004631 - RNA, 19 nt, Homo sapiens
aaauacuucuugaagccga

SEQ ID NO: 1004632 - RNA, 17 nt, Homo sapiens
aaauagcaaaagaagaa

SEQ ID NO: 1004633 - RNA, 20 nt, Homo sapiens
aaauaggcggggcuugccuu

SEQ ID NO: 1004634 - RNA, 23 nt, Homo sapiens
aaauaucccuccuguugggagag

SEQ ID NO: 1004635 - RNA, 19 nt, Homo sapiens
aaauauccuuuaauugauc

SEQ ID NO: 1004636 - RNA, 17 nt, Homo sapiens
aaauaugaagacauaaa

SEQ ID NO: 1004637 - RNA, 19 nt, Homo sapiens
aaauauuaaggagaauuca

SEQ ID NO: 1004638 - RNA, 13 nt, Homo sapiens
aaauauuaugaga

SEQ ID NO: 1004639 - RNA, 16 nt, Homo sapiens
aaauauuuagauguaa

SEQ ID NO: 1004640 - RNA, 13 nt, Homo sapiens
aaaucaacuugcu

SEQ ID NO: 1004641 - RNA, 20 nt, Homo sapiens
aaaucaauaaagaccacuuu

SEQ ID NO: 1004642 - RNA, 22 nt, Homo sapiens
aaaucagaagucaucuugcuac

SEQ ID NO: 1004643 - RNA, 14 nt, Homo sapiens
aaauccaaguagau

SEQ ID NO: 1004644 - RNA, 21 nt, Homo sapiens
aaauccuuagaucuggcaugu

SEQ ID NO: 1004645 - RNA, 14 nt, Homo sapiens
aaaucgugccuugu

SEQ ID NO: 1004646 - RNA, 16 nt, Homo sapiens
aaaucuaagugauaua

SEQ ID NO: 1004647 - RNA, 16 nt, Homo sapiens
aaaucuauagaacuga

SEQ ID NO: 1004648 - RNA, 18 nt, Homo sapiens
aaaucuauagaacugaau

SEQ ID NO: 1004649 - RNA, 19 nt, Homo sapiens
aaaugaaggaaaagcaugu

SEQ ID NO: 1004650 - RNA, 22 nt, Homo sapiens
aaaugaauggaggaacuuucca

SEQ ID NO: 1004651 - RNA, 22 nt, Homo sapiens
aaaugacaaccugaauuaucua

SEQ ID NO: 1004652 - RNA, 13 nt, Homo sapiens
aaaugagugcuua

SEQ ID NO: 1004653 - RNA, 14 nt, Homo sapiens
aaaugccaagcacu

SEQ ID NO: 1004654 - RNA, 13 nt, Homo sapiens
aaauggggccaga

SEQ ID NO: 1004655 - RNA, 15 nt, Homo sapiens
aaauggguuuauuca

SEQ ID NO: 1004656 - RNA, 21 nt, Homo sapiens
aaaugguucagaauuaaacuu

SEQ ID NO: 1004657 - RNA, 16 nt, Homo sapiens
aaauguaaagacaaaa

SEQ ID NO: 1004658 - RNA, 20 nt, Homo sapiens
aaauguaguauggccugugu

SEQ ID NO: 1004659 - RNA, 13 nt, Homo sapiens
aaaugucaucuca

SEQ ID NO: 1004660 - RNA, 22 nt, Homo sapiens
aaaugugcacacauauacaugu

SEQ ID NO: 1004661 - RNA, 21 nt, Homo sapiens
uauguauugugcaauguguau

SEQ ID NO: 1004662 - RNA, 14 nt, Homo sapiens
uaugugcaaguuua

SEQ ID NO: 1004663 - RNA, 17 nt, Homo sapiens
uaugugcgugcaugugu

SEQ ID NO: 1004664 - RNA, 19 nt, Homo sapiens
uauguggguuuuacacuaa

SEQ ID NO: 1004665 - RNA, 13 nt, Homo sapiens
uauguuuggcugc

SEQ ID NO: 1004666 - RNA, 17 nt, Homo sapiens
uauguuuggcugcuaga

SEQ ID NO: 1004667 - RNA, 16 nt, Homo sapiens
uauuaacaauuaggca

SEQ ID NO: 1004668 - RNA, 17 nt, Homo sapiens
uauuaauuucuucacac

SEQ ID NO: 1004669 - RNA, 21 nt, Homo sapiens
uauuacguaugucugguucuc

SEQ ID NO: 1004670 - RNA, 20 nt, Homo sapiens
uauuauaccaaaauguugcu

SEQ ID NO: 1004671 - RNA, 13 nt, Homo sapiens
uauuauauggaaa

SEQ ID NO: 1004672 - RNA, 17 nt, Homo sapiens
uauuauucuucauaaca

SEQ ID NO: 1004673 - RNA, 18 nt, Homo sapiens
uauuauucuucauaacaa

SEQ ID NO: 1004674 - RNA, 13 nt, Homo sapiens
uauuccaugacug

SEQ ID NO: 1004675 - RNA, 21 nt, Homo sapiens
uauucccaaaaauuacuuugg

SEQ ID NO: 1004676 - RNA, 13 nt, Homo sapiens
uauucuacuaugc

SEQ ID NO: 1004677 - RNA, 17 nt, Homo sapiens
uauugcugcaaacacuu

SEQ ID NO: 1004678 - RNA, 21 nt, Homo sapiens
uauugucgguuaccucugcau

SEQ ID NO: 1004679 - RNA, 18 nt, Homo sapiens
uauuuaaagccuccucau

SEQ ID NO: 1004680 - RNA, 20 nt, Homo sapiens
uauuuaaauuguuuuggacg

SEQ ID NO: 1004681 - RNA, 17 nt, Homo sapiens
uauuucuuccuaccaag

SEQ ID NO: 1004682 - RNA, 21 nt, Homo sapiens
uauuuguaauuaaaagcaaau

SEQ ID NO: 1004683 - RNA, 20 nt, Homo sapiens
uauuuguuuggugaauuugu

SEQ ID NO: 1004684 - RNA, 14 nt, Homo sapiens
uauuuuuuuuacug

SEQ ID NO: 1004685 - RNA, 20 nt, Homo sapiens
ucaaaacagagggcugcauu

SEQ ID NO: 1004686 - RNA, 18 nt, Homo sapiens
ucaaaaucucuccacuuu

SEQ ID NO: 1004687 - RNA, 14 nt, Homo sapiens
ucaaagaaagugua

SEQ ID NO: 1004688 - RNA, 22 nt, Homo sapiens
ucaaagaaaguguauugguuua

SEQ ID NO: 1004689 - RNA, 23 nt, Homo sapiens
ucaaagaggcugaggcuggcaca

SEQ ID NO: 1004690 - RNA, 10 nt, Homo sapiens
ucaaagccag

SEQ ID NO: 1004691 - RNA, 14 nt, Homo sapiens
ucaaauagcauaag

SEQ ID NO: 1004692 - RNA, 15 nt, Homo sapiens
ucaaaucguccagcg

SEQ ID NO: 1004693 - RNA, 12 nt, Homo sapiens
ucaaaugccuga

SEQ ID NO: 1004694 - RNA, 19 nt, Homo sapiens
ucaacacuuguaucuggcc

SEQ ID NO: 1004695 - RNA, 16 nt, Homo sapiens
ucaaccucuacagggu

SEQ ID NO: 1004696 - RNA, 18 nt, Homo sapiens
ucaaccugggcaaagccu

SEQ ID NO: 1004697 - RNA, 21 nt, Homo sapiens
ucaacuuaccaggcaccaaaa

SEQ ID NO: 1004698 - RNA, 17 nt, Homo sapiens
ucaacuuauuaacaauu

SEQ ID NO: 1004699 - RNA, 14 nt, Homo sapiens
ucaagaauagcauu

SEQ ID NO: 1004700 - RNA, 19 nt, Homo sapiens
ucaagacaagccuggccua

SEQ ID NO: 1004701 - RNA, 19 nt, Homo sapiens
ucaagauuuuuuuugucag

SEQ ID NO: 1004702 - RNA, 14 nt, Homo sapiens
ucaaggcacucuag

SEQ ID NO: 1004703 - RNA, 21 nt, Homo sapiens
ucaaggcccauaucugugaaa

SEQ ID NO: 1004704 - RNA, 17 nt, Homo sapiens
ucaagguucuaacccua

SEQ ID NO: 1004705 - RNA, 15 nt, Homo sapiens
ucaaguaauacaaac

SEQ ID NO: 1004706 - RNA, 15 nt, Homo sapiens
ucaauacagauauau

SEQ ID NO: 1004707 - RNA, 22 nt, Homo sapiens
ucaauacauagugcugcugugu

SEQ ID NO: 1004708 - RNA, 16 nt, Homo sapiens
ucaaucaacuuuacug

SEQ ID NO: 1004709 - RNA, 22 nt, Homo sapiens
ucaaugacaugaauuuuagcuu

SEQ ID NO: 1004710 - RNA, 22 nt, Homo sapiens
ucaaugagcauguuuagacuuu

SEQ ID NO: 1004711 - RNA, 12 nt, Homo sapiens
ucaaugccagua

SEQ ID NO: 1004712 - RNA, 20 nt, Homo sapiens
ucaauuccaccugcaaucaa

SEQ ID NO: 1004713 - RNA, 21 nt, Homo sapiens
ucacaaucaucaucauucuca

SEQ ID NO: 1004714 - RNA, 15 nt, Homo sapiens
ucacaaugagauuga

SEQ ID NO: 1004715 - RNA, 17 nt, Homo sapiens
ucacacgauaaagggau

SEQ ID NO: 1004716 - RNA, 23 nt, Homo sapiens
ucacagcccagcccgcccacugg

SEQ ID NO: 1004717 - RNA, 16 nt, Homo sapiens
ucacagcuccucccac

SEQ ID NO: 1004718 - RNA, 16 nt, Homo sapiens
ucacagugaacacuca

SEQ ID NO: 1004719 - RNA, 14 nt, Homo sapiens
ucacaucacacaaa

SEQ ID NO: 1004720 - RNA, 20 nt, Homo sapiens
ucacaugggcagaaaaaugg

SEQ ID NO: 1004721 - RNA, 17 nt, Homo sapiens
ucacaugucaguaccuu

SEQ ID NO: 1004722 - RNA, 17 nt, Homo sapiens
ucaccaacuccuaguuc

SEQ ID NO: 1004723 - RNA, 19 nt, Homo sapiens
ucacccaggcuggagugca

SEQ ID NO: 1004724 - RNA, 18 nt, Homo sapiens
ucaccucagauggcagcu

SEQ ID NO: 1004725 - RNA, 14 nt, Homo sapiens
ucaccucuugccuu

SEQ ID NO: 1004726 - RNA, 21 nt, Homo sapiens
ucaccuggacuuaagcaucug

SEQ ID NO: 1004727 - RNA, 21 nt, Homo sapiens
ucaccuugaaagcaguagcau

SEQ ID NO: 1004728 - RNA, 12 nt, Homo sapiens
ucaccuugcuca

SEQ ID NO: 1004729 - RNA, 19 nt, Homo sapiens
ucaccuuggcaccagacac

SEQ ID NO: 1004730 - RNA, 20 nt, Homo sapiens
ucacggcugcgcacuguguc

SEQ ID NO: 1004731 - RNA, 20 nt, Homo sapiens
ucacuaaaacacacaggugc

SEQ ID NO: 1004732 - RNA, 19 nt, Homo sapiens
ucacuaauucauuaaucug

SEQ ID NO: 1004733 - RNA, 22 nt, Homo sapiens
ucacuaauucauuaaucugccu

SEQ ID NO: 1004734 - RNA, 14 nt, Homo sapiens
agaagcaaaccgcc

SEQ ID NO: 1004735 - RNA, 21 nt, Homo sapiens
agaagcaguggccuuauugca

SEQ ID NO: 1004736 - RNA, 23 nt, Homo sapiens
agaagcuaaauccuuuacuguua

SEQ ID NO: 1004737 - RNA, 15 nt, Homo sapiens
agaagggcacuguaa

SEQ ID NO: 1004738 - RNA, 14 nt, Homo sapiens
agaaguaccagacu

SEQ ID NO: 1004739 - RNA, 22 nt, Homo sapiens
agaaguuccuagugauggcuua

SEQ ID NO: 1004740 - RNA, 15 nt, Homo sapiens
agaauaaagucuuug

SEQ ID NO: 1004741 - RNA, 18 nt, Homo sapiens
agaauaaggaacaacguu

SEQ ID NO: 1004742 - RNA, 19 nt, Homo sapiens
agaauaccccucaacucau

SEQ ID NO: 1004743 - RNA, 14 nt, Homo sapiens
agaaucaacauuuc

SEQ ID NO: 1004744 - RNA, 22 nt, Homo sapiens
agaaucccagcccccugaccac

SEQ ID NO: 1004745 - RNA, 11 nt, Homo sapiens
agaauggagcu

SEQ ID NO: 1004746 - RNA, 15 nt, Homo sapiens
agaauuauaacugua

SEQ ID NO: 1004747 - RNA, 17 nt, Homo sapiens
agaauucagacaucuga

SEQ ID NO: 1004748 - RNA, 18 nt, Homo sapiens
agaauuugagugcucuga

SEQ ID NO: 1004749 - RNA, 19 nt, Homo sapiens
agacaaacuuugcaucuca

SEQ ID NO: 1004750 - RNA, 16 nt, Homo sapiens
agacaaguauggcucc

SEQ ID NO: 1004751 - RNA, 19 nt, Homo sapiens
agacacccaggacuuauuu

SEQ ID NO: 1004752 - RNA, 16 nt, Homo sapiens
agacagaaaacauguu

SEQ ID NO: 1004753 - RNA, 21 nt, Homo sapiens
agacagacuagaaguuccuag

SEQ ID NO: 1004754 - RNA, 18 nt, Homo sapiens
agacagagcccugugagg

SEQ ID NO: 1004755 - RNA, 23 nt, Homo sapiens
agacaggcaaauaaaagugaccu

SEQ ID NO: 1004756 - RNA, 16 nt, Homo sapiens
agacaggcucuuagca

SEQ ID NO: 1004757 - RNA, 13 nt, Homo sapiens
agacauacauuuc

SEQ ID NO: 1004758 - RNA, 21 nt, Homo sapiens
agacaugauuuccuugaaugu

SEQ ID NO: 1004759 - RNA, 17 nt, Homo sapiens
agacaugugacauuuau

SEQ ID NO: 1004760 - RNA, 13 nt, Homo sapiens
agacauuccacca

SEQ ID NO: 1004761 - RNA, 15 nt, Homo sapiens
agaccacuguuauca

SEQ ID NO: 1004762 - RNA, 16 nt, Homo sapiens
agacccccagcacuug

SEQ ID NO: 1004763 - RNA, 20 nt, Homo sapiens
agaccccucucccagcuauu

SEQ ID NO: 1004764 - RNA, 18 nt, Homo sapiens
agaccccuguucaugccg

SEQ ID NO: 1004765 - RNA, 21 nt, Homo sapiens
agaccgugaccagugcugcug

SEQ ID NO: 1004766 - RNA, 16 nt, Homo sapiens
agaccuccaccuccuc

SEQ ID NO: 1004767 - RNA, 16 nt, Homo sapiens
agaccucuacugccuu

SEQ ID NO: 1004768 - RNA, 20 nt, Homo sapiens
agaccuguguuacuaaaaaa

SEQ ID NO: 1004769 - RNA, 22 nt, Homo sapiens
agaccuuccagaaauacuacug

SEQ ID NO: 1004770 - RNA, 13 nt, Homo sapiens
agacuaaggccau

SEQ ID NO: 1004771 - RNA, 19 nt, Homo sapiens
agacuacagcuggggugca

SEQ ID NO: 1004772 - RNA, 17 nt, Homo sapiens
agacucaaauguucuaa

SEQ ID NO: 1004773 - RNA, 16 nt, Homo sapiens
agacuccuagcugucc

SEQ ID NO: 1004774 - RNA, 15 nt, Homo sapiens
agacucuagagucca

SEQ ID NO: 1004775 - RNA, 14 nt, Homo sapiens
agacucugguguuc

SEQ ID NO: 1004776 - RNA, 18 nt, Homo sapiens
agacucuuuaugcuugca

SEQ ID NO: 1004777 - RNA, 16 nt, Homo sapiens
agacugggcugaggga

SEQ ID NO: 1004778 - RNA, 19 nt, Homo sapiens
agacuuaagcccagugcac

SEQ ID NO: 1004779 - RNA, 17 nt, Homo sapiens
agacuuugcuaaagaca

SEQ ID NO: 1004780 - RNA, 12 nt, Homo sapiens
agagaaagggag

SEQ ID NO: 1004781 - RNA, 15 nt, Homo sapiens
agagaaccucagauc

SEQ ID NO: 1004782 - RNA, 14 nt, Homo sapiens
agagaagcauucuc

SEQ ID NO: 1004783 - RNA, 12 nt, Homo sapiens
agagaagccagc

SEQ ID NO: 1004784 - RNA, 21 nt, Homo sapiens
agagaagccuucaagcucuga

SEQ ID NO: 1004785 - RNA, 12 nt, Homo sapiens
agagaccucaaa

SEQ ID NO: 1004786 - RNA, 19 nt, Homo sapiens
agagagguuugcaguccca

SEQ ID NO: 1004787 - RNA, 19 nt, Homo sapiens
agagaucagcgacccugag

SEQ ID NO: 1004788 - RNA, 20 nt, Homo sapiens
agagauggggucucacagug

SEQ ID NO: 1004789 - RNA, 17 nt, Homo sapiens
agagcaggaaugggaag

SEQ ID NO: 1004790 - RNA, 13 nt, Homo sapiens
agagcauaggguc

SEQ ID NO: 1004791 - RNA, 18 nt, Homo sapiens
agagccggguguccccaa

SEQ ID NO: 1004792 - RNA, 18 nt, Homo sapiens
agagccugcaggaucuca

SEQ ID NO: 1004793 - RNA, 13 nt, Homo sapiens
agaggaaauucuu

SEQ ID NO: 1004794 - RNA, 24 nt, Homo sapiens
agaggcagcagagcauucagacuc

SEQ ID NO: 1004795 - RNA, 14 nt, Homo sapiens
agaggcagugacag

SEQ ID NO: 1004796 - RNA, 17 nt, Homo sapiens
agaggcugccccucuca

SEQ ID NO: 1004797 - RNA, 21 nt, Homo sapiens
agaggcugccccucucaccaa

SEQ ID NO: 1004798 - RNA, 16 nt, Homo sapiens
agaggcuuucuccagg

SEQ ID NO: 1004799 - RNA, 20 nt, Homo sapiens
agaggggccugccaccugga

SEQ ID NO: 1004800 - RNA, 18 nt, Homo sapiens
agaguagaauugcauuga

SEQ ID NO: 1004801 - RNA, 17 nt, Homo sapiens
agagugaauucccucac

SEQ ID NO: 1004802 - RNA, 14 nt, Homo sapiens
agagugacucacua

SEQ ID NO: 1004803 - RNA, 19 nt, Homo sapiens
agagugcuccuguauugaa

SEQ ID NO: 1004804 - RNA, 13 nt, Homo sapiens
agagugucuuucc

SEQ ID NO: 1004805 - RNA, 20 nt, Homo sapiens
agcacagggggaagaagaag

SEQ ID NO: 1004806 - RNA, 22 nt, Homo sapiens
agcacauauggaauuuugcaaa

SEQ ID NO: 1004807 - RNA, 20 nt, Homo sapiens
agcaccaaaucaaaaucucu

SEQ ID NO: 1004808 - RNA, 15 nt, Homo sapiens
agcacugccaccagu

SEQ ID NO: 1004809 - RNA, 15 nt, Homo sapiens
agcacugccaggagg

SEQ ID NO: 1004810 - RNA, 20 nt, Homo sapiens
agcacugccaggagggacaa

SEQ ID NO: 1004811 - RNA, 17 nt, Homo sapiens
agcacuguuuauacacu

SEQ ID NO: 1004812 - RNA, 14 nt, Homo sapiens
agcacuuccauggg

SEQ ID NO: 1004813 - RNA, 13 nt, Homo sapiens
agcagagcauuca

SEQ ID NO: 1004814 - RNA, 21 nt, Homo sapiens
agcagaguguucccugacucc

SEQ ID NO: 1004815 - RNA, 16 nt, Homo sapiens
agcagcaacuuguccu

SEQ ID NO: 1004816 - RNA, 14 nt, Homo sapiens
agcagcacuuauaa

SEQ ID NO: 1004817 - RNA, 18 nt, Homo sapiens
agcagggauuaaccucug

SEQ ID NO: 1004818 - RNA, 17 nt, Homo sapiens
agcaggugcugacuuca

SEQ ID NO: 1004819 - RNA, 22 nt, Homo sapiens
agcaggugcugacuucaucucc

SEQ ID NO: 1004820 - RNA, 19 nt, Homo sapiens
agcagguuaccacucuggc

SEQ ID NO: 1004821 - RNA, 20 nt, Homo sapiens
agcagguucccaagcucaga

SEQ ID NO: 1004822 - RNA, 17 nt, Homo sapiens
agcagguuucaaggaag

SEQ ID NO: 1004823 - RNA, 23 nt, Homo sapiens
agcagguuucaaggaaguagaaa

SEQ ID NO: 1004824 - RNA, 22 nt, Homo sapiens
agcagucacugacaguuaauaa

SEQ ID NO: 1004825 - RNA, 15 nt, Homo sapiens
agcagucgugccugu

SEQ ID NO: 1004826 - RNA, 20 nt, Homo sapiens
agcagugaaugauucagugu

SEQ ID NO: 1004827 - RNA, 18 nt, Homo sapiens
agcauacgguaugauauu

SEQ ID NO: 1004828 - RNA, 17 nt, Homo sapiens
agcauagggucuggaac

SEQ ID NO: 1004829 - RNA, 16 nt, Homo sapiens
agcaucuggcucuaau

SEQ ID NO: 1004830 - RNA, 20 nt, Homo sapiens
agcaugaaaguggacaagga

SEQ ID NO: 1004831 - RNA, 14 nt, Homo sapiens
agcauggaacacuu

SEQ ID NO: 1004832 - RNA, 15 nt, Homo sapiens
agcauguacuccccu

SEQ ID NO: 1004833 - RNA, 21 nt, Homo sapiens
agcauuguaaaauuauuucau

SEQ ID NO: 1004834 - RNA, 17 nt, Homo sapiens
agcauuuagacccugca

SEQ ID NO: 1004835 - RNA, 22 nt, Homo sapiens
agcauuugacccuugcugugaa

SEQ ID NO: 1004836 - RNA, 12 nt, Homo sapiens
agccaagcaaaa

SEQ ID NO: 1004837 - RNA, 17 nt, Homo sapiens
agccaagggauggacau

SEQ ID NO: 1004838 - RNA, 20 nt, Homo sapiens
agccaagggauggacaucuu

SEQ ID NO: 1004839 - RNA, 18 nt, Homo sapiens
agccaauucagacaggca

SEQ ID NO: 1004840 - RNA, 16 nt, Homo sapiens
agccacacuucucagg

SEQ ID NO: 1004841 - RNA, 16 nt, Homo sapiens
agccaccaguucucau

SEQ ID NO: 1004842 - RNA, 22 nt, Homo sapiens
agccacccugaggagucugagg

SEQ ID NO: 1004843 - RNA, 17 nt, Homo sapiens
agccacgaggugcaaca

SEQ ID NO: 1004844 - RNA, 14 nt, Homo sapiens
agccacugccuuca

SEQ ID NO: 1004845 - RNA, 14 nt, Homo sapiens
agccagaacuugac

SEQ ID NO: 1004846 - RNA, 18 nt, Homo sapiens
agccaggccccaagccca

SEQ ID NO: 1004847 - RNA, 22 nt, Homo sapiens
agccaguuuggguaaaauacuu

SEQ ID NO: 1004848 - RNA, 21 nt, Homo sapiens
agccaugucuucucccuggaa

SEQ ID NO: 1004849 - RNA, 16 nt, Homo sapiens
agcccaggaagucuca

SEQ ID NO: 1004850 - RNA, 23 nt, Homo sapiens
agcccaggaagucucaucugggg

SEQ ID NO: 1004851 - RNA, 14 nt, Homo sapiens
agcccagugcacug

SEQ ID NO: 1004852 - RNA, 19 nt, Homo sapiens
agcccauccugaccagcug

SEQ ID NO: 1004853 - RNA, 20 nt, Homo sapiens
agcccccaccccgagucaca

SEQ ID NO: 1004854 - RNA, 17 nt, Homo sapiens
agcccccuccuggugcc

SEQ ID NO: 1004855 - RNA, 14 nt, Homo sapiens
agcccgcccacugg

SEQ ID NO: 1004856 - RNA, 19 nt, Homo sapiens
agcccgucuccucuucccu

SEQ ID NO: 1004857 - RNA, 19 nt, Homo sapiens
agcccugcaccaugcugcu

SEQ ID NO: 1004858 - RNA, 21 nt, Homo sapiens
agcccugucagcaugaauuug

SEQ ID NO: 1004859 - RNA, 14 nt, Homo sapiens
agccggcacagggu

SEQ ID NO: 1004860 - RNA, 18 nt, Homo sapiens
agccggggcgaguggcac

SEQ ID NO: 1004861 - RNA, 21 nt, Homo sapiens
agccuauguaugccauggagg

SEQ ID NO: 1004862 - RNA, 13 nt, Homo sapiens
agccucaacuuac

SEQ ID NO: 1004863 - RNA, 16 nt, Homo sapiens
agccucaagaugaagg

SEQ ID NO: 1004864 - RNA, 19 nt, Homo sapiens
agccucgcaacccgugcca

SEQ ID NO: 1004865 - RNA, 22 nt, Homo sapiens
agccucggcccuagcauugcac

SEQ ID NO: 1004866 - RNA, 22 nt, Homo sapiens
agccuguaaacuuuaucacuua

SEQ ID NO: 1004867 - RNA, 16 nt, Homo sapiens
agccugugcaaugcau

SEQ ID NO: 1004868 - RNA, 21 nt, Homo sapiens
agccuguucauggcagaugua

SEQ ID NO: 1004869 - RNA, 17 nt, Homo sapiens
agccuuaauuugcacag

SEQ ID NO: 1004870 - RNA, 20 nt, Homo sapiens
agccuuaauuugcacagugu

SEQ ID NO: 1004871 - RNA, 22 nt, Homo sapiens
agccuuccccuaccccuugucg

SEQ ID NO: 1004872 - RNA, 18 nt, Homo sapiens
agcgaggaggcuccagag

SEQ ID NO: 1004873 - RNA, 19 nt, Homo sapiens
agcgauucucuugccucaa

SEQ ID NO: 1004874 - RNA, 14 nt, Homo sapiens
agcggcaucaggcu

SEQ ID NO: 1004875 - RNA, 18 nt, Homo sapiens
cauaaaauagagugcauu

SEQ ID NO: 1004876 - RNA, 18 nt, Homo sapiens
cauaagggagauuguaua

SEQ ID NO: 1004877 - RNA, 16 nt, Homo sapiens
cauaauguuacauuau

SEQ ID NO: 1004878 - RNA, 18 nt, Homo sapiens
cauaauguuacauuauua

SEQ ID NO: 1004879 - RNA, 21 nt, Homo sapiens
cauaauguuucuggauuucau

SEQ ID NO: 1004880 - RNA, 22 nt, Homo sapiens
cauacgguaugauauugcagcu

SEQ ID NO: 1004881 - RNA, 23 nt, Homo sapiens
cauagucuuuggagaaaugcuua

SEQ ID NO: 1004882 - RNA, 23 nt, Homo sapiens
cauauauuugaaguggagccaua

SEQ ID NO: 1004883 - RNA, 20 nt, Homo sapiens
cauaugaucugucuguggca

SEQ ID NO: 1004884 - RNA, 17 nt, Homo sapiens
cauauguaccauguaca

SEQ ID NO: 1004885 - RNA, 22 nt, Homo sapiens
cauauguguguguggguaugug

SEQ ID NO: 1004886 - RNA, 23 nt, Homo sapiens
cauauguguguguggguaugugu

SEQ ID NO: 1004887 - RNA, 19 nt, Homo sapiens
cauauuuguaaaaugacaa

SEQ ID NO: 1004888 - RNA, 19 nt, Homo sapiens
cauauuuuuuuuacuguca

SEQ ID NO: 1004889 - RNA, 20 nt, Homo sapiens
caucaaaaaagauagaucua

SEQ ID NO: 1004890 - RNA, 13 nt, Homo sapiens
caucaagcuccug

SEQ ID NO: 1004891 - RNA, 16 nt, Homo sapiens
caucacagaaugugau

SEQ ID NO: 1004892 - RNA, 16 nt, Homo sapiens
caucacguuagcuguc

SEQ ID NO: 1004893 - RNA, 10 nt, Homo sapiens
caucagaaag

SEQ ID NO: 1004894 - RNA, 17 nt, Homo sapiens
caucagagugacaucca

SEQ ID NO: 1004895 - RNA, 14 nt, Homo sapiens
caucaggcuuucuu

SEQ ID NO: 1004896 - RNA, 19 nt, Homo sapiens
caucaucuccugccuuccu

SEQ ID NO: 1004897 - RNA, 12 nt, Homo sapiens
caucauggccag

SEQ ID NO: 1004898 - RNA, 22 nt, Homo sapiens
cauccaaacuaaaaggaaguca

SEQ ID NO: 1004899 - RNA, 16 nt, Homo sapiens
cauccaagcaaacuga

SEQ ID NO: 1004900 - RNA, 21 nt, Homo sapiens
cauccacauacccugaccugg

SEQ ID NO: 1004901 - RNA, 18 nt, Homo sapiens
cauccacuucaccaucca

SEQ ID NO: 1004902 - RNA, 16 nt, Homo sapiens
cauccauaacugaaca

SEQ ID NO: 1004903 - RNA, 12 nt, Homo sapiens
caucccaaagga

SEQ ID NO: 1004904 - RNA, 23 nt, Homo sapiens
accaugcugcuggggaagacagu

SEQ ID NO: 1004905 - RNA, 15 nt, Homo sapiens
accauggaguggcag

SEQ ID NO: 1004906 - RNA, 13 nt, Homo sapiens
accauguacauga

SEQ ID NO: 1004907 - RNA, 18 nt, Homo sapiens
accaugucuuucucucuc

SEQ ID NO: 1004908 - RNA, 21 nt, Homo sapiens
accauuaacuccuccugagcu

SEQ ID NO: 1004909 - RNA, 23 nt, Homo sapiens
accauuuaauggggaggacaaaa

SEQ ID NO: 1004910 - RNA, 20 nt, Homo sapiens
acccaacgcuccaaagucau

SEQ ID NO: 1004911 - RNA, 14 nt, Homo sapiens
acccacaugcucca

SEQ ID NO: 1004912 - RNA, 19 nt, Homo sapiens
acccaccugcuagugugaa

SEQ ID NO: 1004913 - RNA, 17 nt, Homo sapiens
acccacuguggacucca

SEQ ID NO: 1004914 - RNA, 18 nt, Homo sapiens
acccacuucugcacuugc

SEQ ID NO: 1004915 - RNA, 22 nt, Homo sapiens
acccacuuuaaaauaucuacau

SEQ ID NO: 1004916 - RNA, 20 nt, Homo sapiens
acccaggacuuccauuugcu

SEQ ID NO: 1004917 - RNA, 20 nt, Homo sapiens
acccaggcuggagugcagug

SEQ ID NO: 1004918 - RNA, 20 nt, Homo sapiens
acccagucuucuacacagau

SEQ ID NO: 1004919 - RNA, 13 nt, Homo sapiens
acccauauguccu

SEQ ID NO: 1004920 - RNA, 14 nt, Homo sapiens
accccaaccugcuc

SEQ ID NO: 1004921 - RNA, 15 nt, Homo sapiens
accccaauccuccca

SEQ ID NO: 1004922 - RNA, 21 nt, Homo sapiens
accccaggcaaggaugucuga

SEQ ID NO: 1004923 - RNA, 18 nt, Homo sapiens
accccaucaccuacucac

SEQ ID NO: 1004924 - RNA, 14 nt, Homo sapiens
acccccagcacuug

SEQ ID NO: 1004925 - RNA, 20 nt, Homo sapiens
accccugagauccggcaaca

SEQ ID NO: 1004926 - RNA, 16 nt, Homo sapiens
acccggagagugcucc

SEQ ID NO: 1004927 - RNA, 20 nt, Homo sapiens
acccggcugcagaggccaga

SEQ ID NO: 1004928 - RNA, 22 nt, Homo sapiens
acccgugucuagaggcagguag

SEQ ID NO: 1004929 - RNA, 16 nt, Homo sapiens
acccuaaacauccaua

SEQ ID NO: 1004930 - RNA, 17 nt, Homo sapiens
acccucauuucucaucu

SEQ ID NO: 1004931 - RNA, 20 nt, Homo sapiens
acccucggggauguguccug

SEQ ID NO: 1004932 - RNA, 22 nt, Homo sapiens
acccucuggagaaggugggcac

SEQ ID NO: 1004933 - RNA, 19 nt, Homo sapiens
acccugaaggggccaugau

SEQ ID NO: 1004934 - RNA, 13 nt, Homo sapiens
acccugaccagcu

SEQ ID NO: 1004935 - RNA, 23 nt, Homo sapiens
acccugagccggccccaggcucg

SEQ ID NO: 1004936 - RNA, 16 nt, Homo sapiens
acccuggagggccagg

SEQ ID NO: 1004937 - RNA, 16 nt, Homo sapiens
acccugggauucagga

SEQ ID NO: 1004938 - RNA, 22 nt, Homo sapiens
acccuucauuuaacaaguaaga

SEQ ID NO: 1004939 - RNA, 23 nt, Homo sapiens
acccuuccacuuccaucugggag

SEQ ID NO: 1004940 - RNA, 14 nt, Homo sapiens
acccuuugcuguga

SEQ ID NO: 1004941 - RNA, 21 nt, Homo sapiens
accggccugccaggaggaccc

SEQ ID NO: 1004942 - RNA, 17 nt, Homo sapiens
accguggcccuuccugg

SEQ ID NO: 1004943 - RNA, 17 nt, Homo sapiens
accuacccuccacaggc

SEQ ID NO: 1004944 - RNA, 13 nt, Homo sapiens
accuaggauuuca

SEQ ID NO: 1004945 - RNA, 19 nt, Homo sapiens
accucagauggcagcuuuu

SEQ ID NO: 1004946 - RNA, 20 nt, Homo sapiens
accucaguucccucuugcuc

SEQ ID NO: 1004947 - RNA, 12 nt, Homo sapiens
accucaguuuua

SEQ ID NO: 1004948 - RNA, 22 nt, Homo sapiens
accuccuuucaucacacugggu

SEQ ID NO: 1004949 - RNA, 16 nt, Homo sapiens
accucuaacagcacca

SEQ ID NO: 1004950 - RNA, 13 nt, Homo sapiens
accucuacagggu

SEQ ID NO: 1004951 - RNA, 22 nt, Homo sapiens
accucuccuucaugacagccuc

SEQ ID NO: 1004952 - RNA, 14 nt, Homo sapiens
accucugcacuacu

SEQ ID NO: 1004953 - RNA, 18 nt, Homo sapiens
accugaaauaaaauucau

SEQ ID NO: 1004954 - RNA, 23 nt, Homo sapiens
accugacaggugaggucuguucc

SEQ ID NO: 1004955 - RNA, 14 nt, Homo sapiens
accugacucuugca

SEQ ID NO: 1004956 - RNA, 17 nt, Homo sapiens
accugcagcccauggug

SEQ ID NO: 1004957 - RNA, 23 nt, Homo sapiens
accugcugagaaaacaugccucu

SEQ ID NO: 1004958 - RNA, 19 nt, Homo sapiens
accuggcagcucuggacag

SEQ ID NO: 1004959 - RNA, 15 nt, Homo sapiens
accugggcaaagccu

SEQ ID NO: 1004960 - RNA, 16 nt, Homo sapiens
accugggcccuggggc

SEQ ID NO: 1004961 - RNA, 21 nt, Homo sapiens
accugugcacguuggaacuuu

SEQ ID NO: 1004962 - RNA, 19 nt, Homo sapiens
accuguuagcagacaggcc

SEQ ID NO: 1004963 - RNA, 12 nt, Homo sapiens
accuucauccau

SEQ ID NO: 1004964 - RNA, 20 nt, Homo sapiens
accuugcucagccaucccgu

SEQ ID NO: 1004965 - RNA, 17 nt, Homo sapiens
accuugcuccuccuucu

SEQ ID NO: 1004966 - RNA, 21 nt, Homo sapiens
accuuggaauucgcuuucuaa

SEQ ID NO: 1004967 - RNA, 13 nt, Homo sapiens
accuuggugcuua

SEQ ID NO: 1004968 - RNA, 18 nt, Homo sapiens
acgacaagugcugaacag

SEQ ID NO: 1004969 - RNA, 11 nt, Homo sapiens
acgacacugca

SEQ ID NO: 1004970 - RNA, 13 nt, Homo sapiens
acgaggugcaaca

SEQ ID NO: 1004971 - RNA, 16 nt, Homo sapiens
acgcuggcaacacaga

SEQ ID NO: 1004972 - RNA, 14 nt, Homo sapiens
acggagcacugcac

SEQ ID NO: 1004973 - RNA, 13 nt, Homo sapiens
cuccucauucaca

SEQ ID NO: 1004974 - RNA, 14 nt, Homo sapiens
cuccucauucacau

SEQ ID NO: 1004975 - RNA, 12 nt, Homo sapiens
cuccuccaggga

SEQ ID NO: 1004976 - RNA, 14 nt, Homo sapiens
cuccucucaucccc

SEQ ID NO: 1004977 - RNA, 21 nt, Homo sapiens
cuccucuccuagccccuguca

SEQ ID NO: 1004978 - RNA, 13 nt, Homo sapiens
cuccugacacugc

SEQ ID NO: 1004979 - RNA, 15 nt, Homo sapiens
cuccugcugcucccu

SEQ ID NO: 1004980 - RNA, 11 nt, Homo sapiens
cuccuggugcc

SEQ ID NO: 1004981 - RNA, 15 nt, Homo sapiens
cuccuucccaaguga

SEQ ID NO: 1004982 - RNA, 23 nt, Homo sapiens
cuccuugguucuugaggggacca

SEQ ID NO: 1004983 - RNA, 14 nt, Homo sapiens
cucgaaacacagaa

SEQ ID NO: 1004984 - RNA, 15 nt, Homo sapiens
cucgaaacacagaaa

SEQ ID NO: 1004985 - RNA, 21 nt, Homo sapiens
cucgcacaccucugcaccuuu

SEQ ID NO: 1004986 - RNA, 15 nt, Homo sapiens
cucgcuagcaguggc

SEQ ID NO: 1004987 - RNA, 22 nt, Homo sapiens
cucggagaaacgggugagcuga

SEQ ID NO: 1004988 - RNA, 17 nt, Homo sapiens
cucggggauguguccug

SEQ ID NO: 1004989 - RNA, 15 nt, Homo sapiens
cucguccccaaguga

SEQ ID NO: 1004990 - RNA, 16 nt, Homo sapiens
cucuacuaaugccucu

SEQ ID NO: 1004991 - RNA, 20 nt, Homo sapiens
cucuacuuccccauggcccu

SEQ ID NO: 1004992 - RNA, 22 nt, Homo sapiens
cucuagucaaugacaugaauuu

SEQ ID NO: 1004993 - RNA, 13 nt, Homo sapiens
cucuauuaucuca

SEQ ID NO: 1004994 - RNA, 23 nt, Homo sapiens
cucuauucgccacacaguauuuu

SEQ ID NO: 1004995 - RNA, 17 nt, Homo sapiens
cucucacuauaccagua

SEQ ID NO: 1004996 - RNA, 18 nt, Homo sapiens
cucuccauucugcuccuu

SEQ ID NO: 1004997 - RNA, 17 nt, Homo sapiens
cucucccaacucuugca

SEQ ID NO: 1004998 - RNA, 14 nt, Homo sapiens
cucuccuucuuagc

SEQ ID NO: 1004999 - RNA, 22 nt, Homo sapiens
cucucgcacaccucugcaccuu

SEQ ID NO: 1005000 - RNA, 14 nt, Homo sapiens
cucucuucucucca

SEQ ID NO: 1005001 - RNA, 15 nt, Homo sapiens
cucucuucucuccag

SEQ ID NO: 1005002 - RNA, 23 nt, Homo sapiens
cucucuugcaggaaggacuauga

SEQ ID NO: 1005003 - RNA, 14 nt, Homo sapiens
cucugaaaccagug

SEQ ID NO: 1005004 - RNA, 14 nt, Homo sapiens
cucugaagccacaa

SEQ ID NO: 1005005 - RNA, 18 nt, Homo sapiens
cucugacucagggcuccu

SEQ ID NO: 1005006 - RNA, 15 nt, Homo sapiens
cucugagcugugcag

SEQ ID NO: 1005007 - RNA, 22 nt, Homo sapiens
cucugcagccucagagacauca

SEQ ID NO: 1005008 - RNA, 15 nt, Homo sapiens
cucugcauucuagua

SEQ ID NO: 1005009 - RNA, 21 nt, Homo sapiens
cucugccaaaggaugugauau

SEQ ID NO: 1005010 - RNA, 23 nt, Homo sapiens
cucuggcugcucccugacagcac

SEQ ID NO: 1005011 - RNA, 15 nt, Homo sapiens
cucugggaagugugg

SEQ ID NO: 1005012 - RNA, 20 nt, Homo sapiens
cucugggcuggaugagcucc

SEQ ID NO: 1005013 - RNA, 18 nt, Homo sapiens
cucugguuagguuaggac

SEQ ID NO: 1005014 - RNA, 19 nt, Homo sapiens
cucuguuucccuuucacug

SEQ ID NO: 1005015 - RNA, 18 nt, Homo sapiens
cucuuagggacagucaaa

SEQ ID NO: 1005016 - RNA, 22 nt, Homo sapiens
cucuuccaguuugcuuugcccu

SEQ ID NO: 1005017 - RNA, 16 nt, Homo sapiens
cucuuccuaaguauau

SEQ ID NO: 1005018 - RNA, 20 nt, Homo sapiens
cucuucuuuagaacagggaa

SEQ ID NO: 1005019 - RNA, 14 nt, Homo sapiens
cucuugaccaggcu

SEQ ID NO: 1005020 - RNA, 22 nt, Homo sapiens
cucuugcacagucacugcucuu

SEQ ID NO: 1005021 - RNA, 18 nt, Homo sapiens
cucuugccugccacugug

SEQ ID NO: 1005022 - RNA, 21 nt, Homo sapiens
cucuugggaacugaacucacu

SEQ ID NO: 1005023 - RNA, 18 nt, Homo sapiens
cucuuuccaugacaucaa

SEQ ID NO: 1005024 - RNA, 24 nt, Homo sapiens
cucuuucuucgcugaagugugacu

SEQ ID NO: 1005025 - RNA, 19 nt, Homo sapiens
cugaaaacacugugcacau

SEQ ID NO: 1005026 - RNA, 20 nt, Homo sapiens
cugaacagcugguguagcua

SEQ ID NO: 1005027 - RNA, 15 nt, Homo sapiens
cugaauggcaaugaa

SEQ ID NO: 1005028 - RNA, 20 nt, Homo sapiens
cugaauucuuuuucauuuga

SEQ ID NO: 1005029 - RNA, 13 nt, Homo sapiens
cugaauugcacau

SEQ ID NO: 1005030 - RNA, 22 nt, Homo sapiens
cugacacaagaauggucuuucu

SEQ ID NO: 1005031 - RNA, 15 nt, Homo sapiens
cugacagaaugagac

SEQ ID NO: 1005032 - RNA, 19 nt, Homo sapiens
cugacaugcaucaucucau

SEQ ID NO: 1005033 - RNA, 23 nt, Homo sapiens
cugaccaaacagccaacuagccc

SEQ ID NO: 1005034 - RNA, 17 nt, Homo sapiens
cugaccaagauacuuaa

SEQ ID NO: 1005035 - RNA, 23 nt, Homo sapiens
cugaccugugcacaccccacucc

SEQ ID NO: 1005036 - RNA, 20 nt, Homo sapiens
cugacggaguccuguguuug

SEQ ID NO: 1005037 - RNA, 13 nt, Homo sapiens
cugacucuugcag

SEQ ID NO: 1005038 - RNA, 23 nt, Homo sapiens
cugacugggaccaggcaccaggc

SEQ ID NO: 1005039 - RNA, 12 nt, Homo sapiens
cugacuguaaau

SEQ ID NO: 1005040 - RNA, 16 nt, Homo sapiens
cugagaaucagacuga

SEQ ID NO: 1005041 - RNA, 15 nt, Homo sapiens
cugagagaguagcag

SEQ ID NO: 1005042 - RNA, 18 nt, Homo sapiens
cugagcacuguuuauaca

SEQ ID NO: 1005043 - RNA, 18 nt, Homo sapiens
cugagcaguccuuggccu

SEQ ID NO: 1005044 - RNA, 20 nt, Homo sapiens
cugagccuccacagcagugg

SEQ ID NO: 1005045 - RNA, 20 nt, Homo sapiens
cugaggagucugagguccug

SEQ ID NO: 1005046 - RNA, 18 nt, Homo sapiens
cugaggauguaaagauca

SEQ ID NO: 1005047 - RNA, 20 nt, Homo sapiens
cugaggccacacucagcaca

SEQ ID NO: 1005048 - RNA, 22 nt, Homo sapiens
cugaggccacacucagcacaag

SEQ ID NO: 1005049 - RNA, 17 nt, Homo sapiens
cugagguuugcacuucc

SEQ ID NO: 1005050 - RNA, 22 nt, Homo sapiens
cugagucaggacuugaacccag

SEQ ID NO: 1005051 - RNA, 14 nt, Homo sapiens
cugagucgugaccu

SEQ ID NO: 1005052 - RNA, 13 nt, Homo sapiens
cugauaaacacaa

SEQ ID NO: 1005053 - RNA, 19 nt, Homo sapiens
cugauacuuugacaguguu

SEQ ID NO: 1005054 - RNA, 20 nt, Homo sapiens
cugcaacuuaaugcucugau

SEQ ID NO: 1005055 - RNA, 22 nt, Homo sapiens
cugcacagugacuucugagauc

SEQ ID NO: 1005056 - RNA, 23 nt, Homo sapiens
cugcacaucuguaaaucuacaca

SEQ ID NO: 1005057 - RNA, 15 nt, Homo sapiens
cugcaccuuugcacg

SEQ ID NO: 1005058 - RNA, 16 nt, Homo sapiens
cugcaccuuugcacgu

SEQ ID NO: 1005059 - RNA, 15 nt, Homo sapiens
cugcacugaugcugc

SEQ ID NO: 1005060 - RNA, 20 nt, Homo sapiens
cugcagccucagagacauca

SEQ ID NO: 1005061 - RNA, 21 nt, Homo sapiens
cugcauaaaauagagugcauu

SEQ ID NO: 1005062 - RNA, 14 nt, Homo sapiens
cugcaugcccagag

SEQ ID NO: 1005063 - RNA, 14 nt, Homo sapiens
cugcauguacugua

SEQ ID NO: 1005064 - RNA, 22 nt, Homo sapiens
cugcauucuucugagcacuguu

SEQ ID NO: 1005065 - RNA, 22 nt, Homo sapiens
cugcauuuauagcauacgguau

SEQ ID NO: 1005066 - RNA, 22 nt, Homo sapiens
cugccacugaggggggauccag

SEQ ID NO: 1005067 - RNA, 19 nt, Homo sapiens
cugccagcaggggugugau

SEQ ID NO: 1005068 - RNA, 16 nt, Homo sapiens
cugcccccaauccaug

SEQ ID NO: 1005069 - RNA, 21 nt, Homo sapiens
cugccuagaaacaacacugua

SEQ ID NO: 1005070 - RNA, 21 nt, Homo sapiens
cugccucggccucccaaagug

SEQ ID NO: 1005071 - RNA, 18 nt, Homo sapiens
cugccuuaucuugcaccc

SEQ ID NO: 1005072 - RNA, 19 nt, Homo sapiens
cugccuuggacaacuuuuc

SEQ ID NO: 1005073 - RNA, 21 nt, Homo sapiens
cugccuuuccauccauggcca

SEQ ID NO: 1005074 - RNA, 18 nt, Homo sapiens
cugcggaccccucgucau

SEQ ID NO: 1005075 - RNA, 14 nt, Homo sapiens
cugcuaccaaaaca

SEQ ID NO: 1005076 - RNA, 22 nt, Homo sapiens
cugcuccuggaucucccugaga

SEQ ID NO: 1005077 - RNA, 15 nt, Homo sapiens
cugcugcucccucag

SEQ ID NO: 1005078 - RNA, 13 nt, Homo sapiens
cugcugggcucag

SEQ ID NO: 1005079 - RNA, 17 nt, Homo sapiens
cugcuuugggaagccgu

SEQ ID NO: 1005080 - RNA, 20 nt, Homo sapiens
cuggaaugaguugaggccac

SEQ ID NO: 1005081 - RNA, 13 nt, Homo sapiens
cuggagaggacaa

SEQ ID NO: 1005082 - RNA, 15 nt, Homo sapiens
cuggaggagcccagg

SEQ ID NO: 1005083 - RNA, 22 nt, Homo sapiens
cuggagggccaggggaguggag

SEQ ID NO: 1005084 - RNA, 21 nt, Homo sapiens
cuggaguuucauguacaagau

SEQ ID NO: 1005085 - RNA, 18 nt, Homo sapiens
cuggauggggcaggccac

SEQ ID NO: 1005086 - RNA, 19 nt, Homo sapiens
cuggcaagccugucuucag

SEQ ID NO: 1005087 - RNA, 15 nt, Homo sapiens
cuggccagugcccug

SEQ ID NO: 1005088 - RNA, 18 nt, Homo sapiens
cuggccauggccugcaaa

SEQ ID NO: 1005089 - RNA, 19 nt, Homo sapiens
cuggcccccggguguaaau

SEQ ID NO: 1005090 - RNA, 21 nt, Homo sapiens
cuggcccccucccuggaugac

SEQ ID NO: 1005091 - RNA, 16 nt, Homo sapiens
cuggcccuugcuuacc

SEQ ID NO: 1005092 - RNA, 15 nt, Homo sapiens
cuggccgcugugcca

SEQ ID NO: 1005093 - RNA, 18 nt, Homo sapiens
cugggaaggggggccaua

SEQ ID NO: 1005094 - RNA, 13 nt, Homo sapiens
cugggagccccaa

SEQ ID NO: 1005095 - RNA, 23 nt, Homo sapiens
cugggauuacagguguaagccac

SEQ ID NO: 1005096 - RNA, 14 nt, Homo sapiens
cugggcacagucag

SEQ ID NO: 1005097 - RNA, 16 nt, Homo sapiens
cugggccauguccaaa

SEQ ID NO: 1005098 - RNA, 17 nt, Homo sapiens
cugggccugcugcugag

SEQ ID NO: 1005099 - RNA, 16 nt, Homo sapiens
cuggggaagacagugg

SEQ ID NO: 1005100 - RNA, 15 nt, Homo sapiens
cuggggagcucagga

SEQ ID NO: 1005101 - RNA, 17 nt, Homo sapiens
cuggggcagaaacacuc

SEQ ID NO: 1005102 - RNA, 23 nt, Homo sapiens
cugggggccucuucugcuuucuc

SEQ ID NO: 1005103 - RNA, 15 nt, Homo sapiens
cugggggcugcaguu

SEQ ID NO: 1005104 - RNA, 17 nt, Homo sapiens
cuggggugggcaguuuu

SEQ ID NO: 1005105 - RNA, 22 nt, Homo sapiens
cuggguggcucacucagcacuu

SEQ ID NO: 1005106 - RNA, 15 nt, Homo sapiens
cugguaauagcugua

SEQ ID NO: 1005107 - RNA, 18 nt, Homo sapiens
cugguacaguaugggggu

SEQ ID NO: 1005108 - RNA, 16 nt, Homo sapiens
cugguagaccacugcc

SEQ ID NO: 1005109 - RNA, 16 nt, Homo sapiens
cuggucaguacccacu

SEQ ID NO: 1005110 - RNA, 19 nt, Homo sapiens
cugguccagggcuagugac

SEQ ID NO: 1005111 - RNA, 15 nt, Homo sapiens
cuggucucaaacucc

SEQ ID NO: 1005112 - RNA, 22 nt, Homo sapiens
cuggugauggauuaacauauag

SEQ ID NO: 1005113 - RNA, 16 nt, Homo sapiens
cuggugcccagcacau

SEQ ID NO: 1005114 - RNA, 15 nt, Homo sapiens
cugguggcacaggag

SEQ ID NO: 1005115 - RNA, 12 nt, Homo sapiens
cugguguucuau

SEQ ID NO: 1005116 - RNA, 13 nt, Homo sapiens
cugguuagguaga

SEQ ID NO: 1005117 - RNA, 21 nt, Homo sapiens
cugguucccggagaagugugc

SEQ ID NO: 1005118 - RNA, 16 nt, Homo sapiens
cuguaaaacagguuau

SEQ ID NO: 1005119 - RNA, 20 nt, Homo sapiens
cuguaaacuuuaucacuuaa

SEQ ID NO: 1005120 - RNA, 21 nt, Homo sapiens
cuguaaacuuuaucacuuaaa

SEQ ID NO: 1005121 - RNA, 20 nt, Homo sapiens
cuguaacuccccuccugucc

SEQ ID NO: 1005122 - RNA, 18 nt, Homo sapiens
cuguaacuugauccauuu

SEQ ID NO: 1005123 - RNA, 20 nt, Homo sapiens
cuguacuguucugugucuuu

SEQ ID NO: 1005124 - RNA, 18 nt, Homo sapiens
cuguagauucagguaaua

SEQ ID NO: 1005125 - RNA, 17 nt, Homo sapiens
cuguagugcuacagggu

SEQ ID NO: 1005126 - RNA, 17 nt, Homo sapiens
cuguaguucuaagacuc

SEQ ID NO: 1005127 - RNA, 22 nt, Homo sapiens
cugucacaaccaagaauguuau

SEQ ID NO: 1005128 - RNA, 13 nt, Homo sapiens
cugucaccugaaa

SEQ ID NO: 1005129 - RNA, 12 nt, Homo sapiens
cugucaccuugc

SEQ ID NO: 1005130 - RNA, 15 nt, Homo sapiens
cugucaccuugcuca

SEQ ID NO: 1005131 - RNA, 19 nt, Homo sapiens
cugucacguagaacuugga

SEQ ID NO: 1005132 - RNA, 18 nt, Homo sapiens
cugucaggguugucuacc

SEQ ID NO: 1005133 - RNA, 15 nt, Homo sapiens
cuguccccaccucca

SEQ ID NO: 1005134 - RNA, 16 nt, Homo sapiens
cuguccguucacaugu

SEQ ID NO: 1005135 - RNA, 22 nt, Homo sapiens
cuguccguucacauguguggua

SEQ ID NO: 1005136 - RNA, 20 nt, Homo sapiens
cuguccucagccuugccaga

SEQ ID NO: 1005137 - RNA, 22 nt, Homo sapiens
cuguccucagccuugccagaga

SEQ ID NO: 1005138 - RNA, 18 nt, Homo sapiens
cugucuggcaaugccaca

SEQ ID NO: 1005139 - RNA, 18 nt, Homo sapiens
cugucuuaaggcaucuga

SEQ ID NO: 1005140 - RNA, 20 nt, Homo sapiens
cugucuuaaggcaucugaca

SEQ ID NO: 1005141 - RNA, 21 nt, Homo sapiens
cugugaaaugcuggcauuugc

SEQ ID NO: 1005142 - RNA, 22 nt, Homo sapiens
cugugaaaugcuggcauuugca

SEQ ID NO: 1005143 - RNA, 16 nt, Homo sapiens
cugugaauuaagccca

SEQ ID NO: 1005144 - RNA, 10 nt, Homo sapiens
cugugacacu

SEQ ID NO: 1005145 - RNA, 15 nt, Homo sapiens
cugugaccugcugag

SEQ ID NO: 1005146 - RNA, 19 nt, Homo sapiens
cugugaccugcugagcucu

SEQ ID NO: 1005147 - RNA, 19 nt, Homo sapiens
cugugcacaaaacccagac

SEQ ID NO: 1005148 - RNA, 17 nt, Homo sapiens
cugugccccagcagugc

SEQ ID NO: 1005149 - RNA, 22 nt, Homo sapiens
cugugcccccaggguccuggga

SEQ ID NO: 1005150 - RNA, 20 nt, Homo sapiens
cugugcccggggaaaggcaa

SEQ ID NO: 1005151 - RNA, 15 nt, Homo sapiens
cugugcuauggugcu

SEQ ID NO: 1005152 - RNA, 23 nt, Homo sapiens
cuguggugugucccccucugucc

SEQ ID NO: 1005153 - RNA, 16 nt, Homo sapiens
cuguguguccaaaacu

SEQ ID NO: 1005154 - RNA, 15 nt, Homo sapiens
cugugugugugaaug

SEQ ID NO: 1005155 - RNA, 18 nt, Homo sapiens
cuguuauggggacuuuau

SEQ ID NO: 1005156 - RNA, 16 nt, Homo sapiens
cuguucaaagcugccu

SEQ ID NO: 1005157 - RNA, 17 nt, Homo sapiens
cuguucagagcacucau

SEQ ID NO: 1005158 - RNA, 21 nt, Homo sapiens
cuguucuaagugcuggcaauu

SEQ ID NO: 1005159 - RNA, 17 nt, Homo sapiens
cuguucuugcuccaaag

SEQ ID NO: 1005160 - RNA, 17 nt, Homo sapiens
cuguuggcaaggugaca

SEQ ID NO: 1005161 - RNA, 14 nt, Homo sapiens
cuguuugcugugga

SEQ ID NO: 1005162 - RNA, 22 nt, Homo sapiens
cuuaaaauaagcagguggaucu

SEQ ID NO: 1005163 - RNA, 19 nt, Homo sapiens
cuuaaaauguaagauuaua

SEQ ID NO: 1005164 - RNA, 14 nt, Homo sapiens
cuuaaacacuugca

SEQ ID NO: 1005165 - RNA, 13 nt, Homo sapiens
cuuaaacucuguu

SEQ ID NO: 1005166 - RNA, 16 nt, Homo sapiens
cuuaaacucuguuaca

SEQ ID NO: 1005167 - RNA, 17 nt, Homo sapiens
cuuaaacuugcaucacu

SEQ ID NO: 1005168 - RNA, 16 nt, Homo sapiens
cuuaauacuaccuuga

SEQ ID NO: 1005169 - RNA, 13 nt, Homo sapiens
cuuaauugccacc

SEQ ID NO: 1005170 - RNA, 16 nt, Homo sapiens
cuuacaucauguguug

SEQ ID NO: 1005171 - RNA, 21 nt, Homo sapiens
cuuacauuuacaaacugaaga

SEQ ID NO: 1005172 - RNA, 13 nt, Homo sapiens
cuuaccauauguu

SEQ ID NO: 1005173 - RNA, 23 nt, Homo sapiens
cuuacugcuugguccuugauuua

SEQ ID NO: 1005174 - RNA, 13 nt, Homo sapiens
cuuacuggugcua

SEQ ID NO: 1005175 - RNA, 18 nt, Homo sapiens
cuuacuuaaacccagcuc

SEQ ID NO: 1005176 - RNA, 18 nt, Homo sapiens
cuuagaaauucagcauuu

SEQ ID NO: 1005177 - RNA, 16 nt, Homo sapiens
cuuagcuuuagaaaca

SEQ ID NO: 1005178 - RNA, 15 nt, Homo sapiens
uaaauacagucuucc

SEQ ID NO: 1005179 - RNA, 19 nt, Homo sapiens
uaaauacuauuauuugcua

SEQ ID NO: 1005180 - RNA, 15 nt, Homo sapiens
uaaauauaucuaccc

SEQ ID NO: 1005181 - RNA, 16 nt, Homo sapiens
ugcuuuucccauugcc

SEQ ID NO: 1005182 - RNA, 22 nt, Homo sapiens
uggaaaaaaaauaagauaucaa

SEQ ID NO: 1005183 - RNA, 17 nt, Homo sapiens
uggaaagaaguugggga

SEQ ID NO: 1005184 - RNA, 12 nt, Homo sapiens
uggaacacggcc

SEQ ID NO: 1005185 - RNA, 21 nt, Homo sapiens
uggaacagcauuacccuccuc

SEQ ID NO: 1005186 - RNA, 23 nt, Homo sapiens
uggaaccaacacuaacauauaau

SEQ ID NO: 1005187 - RNA, 15 nt, Homo sapiens
uggaacccagacuca

SEQ ID NO: 1005188 - RNA, 17 nt, Homo sapiens
uggaacuacauuacugu

SEQ ID NO: 1005189 - RNA, 18 nt, Homo sapiens
uggaacugcugccacuga

SEQ ID NO: 1005190 - RNA, 21 nt, Homo sapiens
uggaacuuuuauuacuggggu

SEQ ID NO: 1005191 - RNA, 18 nt, Homo sapiens
uggaagcuaauuugcauu

SEQ ID NO: 1005192 - RNA, 12 nt, Homo sapiens
uggaagggucaa

SEQ ID NO: 1005193 - RNA, 21 nt, Homo sapiens
uggaauauuguccauugucca

SEQ ID NO: 1005194 - RNA, 21 nt, Homo sapiens
uggaauccuuucagcaagacu

SEQ ID NO: 1005195 - RNA, 20 nt, Homo sapiens
uggaauuugccugcugggau

SEQ ID NO: 1005196 - RNA, 14 nt, Homo sapiens
uggaauuuugcaaa

SEQ ID NO: 1005197 - RNA, 18 nt, Homo sapiens
uggacaauggaccggaga

SEQ ID NO: 1005198 - RNA, 19 nt, Homo sapiens
uggaccucugacagcagca

SEQ ID NO: 1005199 - RNA, 20 nt, Homo sapiens
uggacucgccuguaaucuca

SEQ ID NO: 1005200 - RNA, 23 nt, Homo sapiens
uggagaccgugaccagugcugcu

SEQ ID NO: 1005201 - RNA, 12 nt, Homo sapiens
uggagagccacc

SEQ ID NO: 1005202 - RNA, 15 nt, Homo sapiens
uggagaguuugccug

SEQ ID NO: 1005203 - RNA, 16 nt, Homo sapiens
uggagcuccagccuga

SEQ ID NO: 1005204 - RNA, 16 nt, Homo sapiens
uggaggaacuuuccaa

SEQ ID NO: 1005205 - RNA, 13 nt, Homo sapiens
uggaggaccugag

SEQ ID NO: 1005206 - RNA, 18 nt, Homo sapiens
uggaggacggucagucca

SEQ ID NO: 1005207 - RNA, 21 nt, Homo sapiens
uggaggcacugaagugcuuag

SEQ ID NO: 1005208 - RNA, 18 nt, Homo sapiens
uggaggccccaacccugu

SEQ ID NO: 1005209 - RNA, 12 nt, Homo sapiens
uggaggcugcuc

SEQ ID NO: 1005210 - RNA, 16 nt, Homo sapiens
uggaguauuggggucu

SEQ ID NO: 1005211 - RNA, 17 nt, Homo sapiens
uggauaccauuauaugu

SEQ ID NO: 1005212 - RNA, 13 nt, Homo sapiens
uggauccugugug

SEQ ID NO: 1005213 - RNA, 15 nt, Homo sapiens
uggaucucaagagcc

SEQ ID NO: 1005214 - RNA, 21 nt, Homo sapiens
uggaugacauuaaagaagggu

SEQ ID NO: 1005215 - RNA, 15 nt, Homo sapiens
uggaugcagcucuug

SEQ ID NO: 1005216 - RNA, 16 nt, Homo sapiens
uggaugggggaacuca

SEQ ID NO: 1005217 - RNA, 23 nt, Homo sapiens
uggaugggggaacucagauccag

SEQ ID NO: 1005218 - RNA, 15 nt, Homo sapiens
uggauuaacauauag

SEQ ID NO: 1005219 - RNA, 16 nt, Homo sapiens
uggauuaacauauagc

SEQ ID NO: 1005220 - RNA, 18 nt, Homo sapiens
uggauuccccaucucagg

SEQ ID NO: 1005221 - RNA, 20 nt, Homo sapiens
uggauucuuuaaacgcucua

SEQ ID NO: 1005222 - RNA, 22 nt, Homo sapiens
uggauuuaaaagccugcucaau

SEQ ID NO: 1005223 - RNA, 18 nt, Homo sapiens
uggauuuuucuuuaacug

SEQ ID NO: 1005224 - RNA, 22 nt, Homo sapiens
uggcaagucaccugcagcccau

SEQ ID NO: 1005225 - RNA, 15 nt, Homo sapiens
uggcaaugaaacaaa

SEQ ID NO: 1005226 - RNA, 22 nt, Homo sapiens
uggcaaugccacagcccuguca

SEQ ID NO: 1005227 - RNA, 16 nt, Homo sapiens
uggcaccgaagcccag

SEQ ID NO: 1005228 - RNA, 15 nt, Homo sapiens
uggcacucagucucu

SEQ ID NO: 1005229 - RNA, 12 nt, Homo sapiens
uggcacuuugaa

SEQ ID NO: 1005230 - RNA, 19 nt, Homo sapiens
uggcagaguuacaguucug

SEQ ID NO: 1005231 - RNA, 15 nt, Homo sapiens
uggcauaaccugucu

SEQ ID NO: 1005232 - RNA, 17 nt, Homo sapiens
uggcaugagaaauacaa

SEQ ID NO: 1005233 - RNA, 23 nt, Homo sapiens
uggcauuuuauaggcauaccucc

SEQ ID NO: 1005234 - RNA, 22 nt, Homo sapiens
uggccaagaagcaguggccuua

SEQ ID NO: 1005235 - RNA, 16 nt, Homo sapiens
uggccaaguuccucua

SEQ ID NO: 1005236 - RNA, 15 nt, Homo sapiens
uggccaccaguauga

SEQ ID NO: 1005237 - RNA, 21 nt, Homo sapiens
uggccaccaguaugacaguau

SEQ ID NO: 1005238 - RNA, 15 nt, Homo sapiens
uggccagugcccuga

SEQ ID NO: 1005239 - RNA, 19 nt, Homo sapiens
uggccauggagaaagcuga

SEQ ID NO: 1005240 - RNA, 13 nt, Homo sapiens
uggcccaccccac

SEQ ID NO: 1005241 - RNA, 13 nt, Homo sapiens
uggcccagccuuu

SEQ ID NO: 1005242 - RNA, 19 nt, Homo sapiens
uggcccuugcuuaccucuc

SEQ ID NO: 1005243 - RNA, 15 nt, Homo sapiens
uggccucaugucaaa

SEQ ID NO: 1005244 - RNA, 14 nt, Homo sapiens
uggccucccgccaa

SEQ ID NO: 1005245 - RNA, 23 nt, Homo sapiens
uggccuggccauacuguguccca

SEQ ID NO: 1005246 - RNA, 22 nt, Homo sapiens
uggccuggucccuguuuuccca

SEQ ID NO: 1005247 - RNA, 15 nt, Homo sapiens
uggccuucauaucau

SEQ ID NO: 1005248 - RNA, 22 nt, Homo sapiens
uggcguuacugcuugaccaaag

SEQ ID NO: 1005249 - RNA, 20 nt, Homo sapiens
uggcguuuggacccaguuca

SEQ ID NO: 1005250 - RNA, 17 nt, Homo sapiens
uggcucacucagcacuu

SEQ ID NO: 1005251 - RNA, 15 nt, Homo sapiens
uggcucccaggggcu

SEQ ID NO: 1005252 - RNA, 18 nt, Homo sapiens
uggcugguguuaacagaa

SEQ ID NO: 1005253 - RNA, 22 nt, Homo sapiens
uggcuguggcaggccagcugug

SEQ ID NO: 1005254 - RNA, 22 nt, Homo sapiens
uggcuugggacuaaaugcccug

SEQ ID NO: 1005255 - RNA, 23 nt, Homo sapiens
ugggaagacuccuagcuguccuu

SEQ ID NO: 1005256 - RNA, 16 nt, Homo sapiens
ugggaagggcagggaa

SEQ ID NO: 1005257 - RNA, 12 nt, Homo sapiens
ugggaagugaag

SEQ ID NO: 1005258 - RNA, 18 nt, Homo sapiens
ugggacgggaugguucug

SEQ ID NO: 1005259 - RNA, 22 nt, Homo sapiens
ugggaggccccacccuucuccc

SEQ ID NO: 1005260 - RNA, 15 nt, Homo sapiens
ugggagucacacagu

SEQ ID NO: 1005261 - RNA, 15 nt, Homo sapiens
ugggaguuguaguua

SEQ ID NO: 1005262 - RNA, 16 nt, Homo sapiens
ugggauuugcugugua

SEQ ID NO: 1005263 - RNA, 14 nt, Homo sapiens
ugggcaacacagug

SEQ ID NO: 1005264 - RNA, 15 nt, Homo sapiens
ugggcacgugugcug

SEQ ID NO: 1005265 - RNA, 18 nt, Homo sapiens
ugggcauucuuguuucaa

SEQ ID NO: 1005266 - RNA, 19 nt, Homo sapiens
ugggccagacaugccacaa

SEQ ID NO: 1005267 - RNA, 14 nt, Homo sapiens
ugggccauguccaa

SEQ ID NO: 1005268 - RNA, 17 nt, Homo sapiens
ugggccauguccaaaga

SEQ ID NO: 1005269 - RNA, 18 nt, Homo sapiens
ugggccauguccaaagag

SEQ ID NO: 1005270 - RNA, 16 nt, Homo sapiens
ugggcccuuugagugc

SEQ ID NO: 1005271 - RNA, 22 nt, Homo sapiens
ugggcgcuguuuucucagcucc

SEQ ID NO: 1005272 - RNA, 15 nt, Homo sapiens
ugggcucagggacca

SEQ ID NO: 1005273 - RNA, 22 nt, Homo sapiens
ugggcuccggaggacucaccac

SEQ ID NO: 1005274 - RNA, 17 nt, Homo sapiens
uggggaaaaaacugugc

SEQ ID NO: 1005275 - RNA, 17 nt, Homo sapiens
uggggagcccgucucag

SEQ ID NO: 1005276 - RNA, 22 nt, Homo sapiens
uggggaucccacucuucuugca

SEQ ID NO: 1005277 - RNA, 21 nt, Homo sapiens
uggggccaaacccaccugcua

SEQ ID NO: 1005278 - RNA, 14 nt, Homo sapiens
uggggccagaucca

SEQ ID NO: 1005279 - RNA, 22 nt, Homo sapiens
uggggccucuccuacuaugcaa

SEQ ID NO: 1005280 - RNA, 22 nt, Homo sapiens
uggggcuggccucccaaaugag

SEQ ID NO: 1005281 - RNA, 20 nt, Homo sapiens
ugggggaaagcaaagcacag

SEQ ID NO: 1005282 - RNA, 20 nt, Homo sapiens
ugggggaccaaugaggugag

SEQ ID NO: 1005283 - RNA, 17 nt, Homo sapiens
ugggggguuuucuugcc

SEQ ID NO: 1005284 - RNA, 21 nt, Homo sapiens
ugaaaagcuagaauugagugu

SEQ ID NO: 1005285 - RNA, 17 nt, Homo sapiens
ugaaaauguccaggaaa

SEQ ID NO: 1005286 - RNA, 16 nt, Homo sapiens
ugaaaccuguacauau

SEQ ID NO: 1005287 - RNA, 23 nt, Homo sapiens
ugaaagucacggcugcgcacugu

SEQ ID NO: 1005288 - RNA, 13 nt, Homo sapiens
ugaaaguggacaa

SEQ ID NO: 1005289 - RNA, 15 nt, Homo sapiens
ugaaauaagcuauuu

SEQ ID NO: 1005290 - RNA, 18 nt, Homo sapiens
ugaaauaauacauugcag

SEQ ID NO: 1005291 - RNA, 19 nt, Homo sapiens
ugaaauaauguacaucugg

SEQ ID NO: 1005292 - RNA, 19 nt, Homo sapiens
ugaaaugcuggcauuugca

SEQ ID NO: 1005293 - RNA, 16 nt, Homo sapiens
ugaaauugcuuugcug

SEQ ID NO: 1005294 - RNA, 20 nt, Homo sapiens
ugaacacucuuuugcuuuau

SEQ ID NO: 1005295 - RNA, 21 nt, Homo sapiens
ugaacaucccuuuuucaauga

SEQ ID NO: 1005296 - RNA, 16 nt, Homo sapiens
ugaaccauuaaccaga

SEQ ID NO: 1005297 - RNA, 23 nt, Homo sapiens
ugaaccuauuucuuaaacacuug

SEQ ID NO: 1005298 - RNA, 13 nt, Homo sapiens
ugaacuccugcca

SEQ ID NO: 1005299 - RNA, 21 nt, Homo sapiens
ugaacucugguggcacaggag

SEQ ID NO: 1005300 - RNA, 22 nt, Homo sapiens
ugaacuuuuuuuuuuuaagagu

SEQ ID NO: 1005301 - RNA, 23 nt, Homo sapiens
ugaagaacugcaggcccuggccu

SEQ ID NO: 1005302 - RNA, 11 nt, Homo sapiens
ugaagacauaa

SEQ ID NO: 1005303 - RNA, 18 nt, Homo sapiens
ugaagaccagccugggca

SEQ ID NO: 1005304 - RNA, 15 nt, Homo sapiens
ugaagcagguuccca

SEQ ID NO: 1005305 - RNA, 15 nt, Homo sapiens
ugaagccaaagggac

SEQ ID NO: 1005306 - RNA, 14 nt, Homo sapiens
ugaagccacugccu

SEQ ID NO: 1005307 - RNA, 17 nt, Homo sapiens
ugaagccacugccuuca

SEQ ID NO: 1005308 - RNA, 18 nt, Homo sapiens
ugaagccuauguaugcca

SEQ ID NO: 1005309 - RNA, 16 nt, Homo sapiens
ugaagggccacuggga

SEQ ID NO: 1005310 - RNA, 16 nt, Homo sapiens
ugaagugcuguggcug

SEQ ID NO: 1005311 - RNA, 19 nt, Homo sapiens
ugaagugcuuaguguacuu

SEQ ID NO: 1005312 - RNA, 15 nt, Homo sapiens
ugaaugcaaaccaua

SEQ ID NO: 1005313 - RNA, 16 nt, Homo sapiens
ugaauggccuucauau

SEQ ID NO: 1005314 - RNA, 12 nt, Homo sapiens
ugaauugcacau

SEQ ID NO: 1005315 - RNA, 19 nt, Homo sapiens
ugacaaccugaauuaucua

SEQ ID NO: 1005316 - RNA, 19 nt, Homo sapiens
ugacaacuucuaauugcca

SEQ ID NO: 1005317 - RNA, 20 nt, Homo sapiens
ugacaauuacucagguuuga

SEQ ID NO: 1005318 - RNA, 19 nt, Homo sapiens
ugacagacaggcucuuagc

SEQ ID NO: 1005319 - RNA, 14 nt, Homo sapiens
ugacauuauaugca

SEQ ID NO: 1005320 - RNA, 17 nt, Homo sapiens
ugacauuauaugcacua

SEQ ID NO: 1005321 - RNA, 15 nt, Homo sapiens
ugaccacagcacagc

SEQ ID NO: 1005322 - RNA, 15 nt, Homo sapiens
ugaccacucagagac

SEQ ID NO: 1005323 - RNA, 15 nt, Homo sapiens
ugaccagugcugcug

SEQ ID NO: 1005324 - RNA, 14 nt, Homo sapiens
ugaccuaaauuauu

SEQ ID NO: 1005325 - RNA, 20 nt, Homo sapiens
ugaccucaagugaucugccc

SEQ ID NO: 1005326 - RNA, 21 nt, Homo sapiens
ugaccugcugaccugugcaca

SEQ ID NO: 1005327 - RNA, 18 nt, Homo sapiens
ugaccuggaaucagugaa

SEQ ID NO: 1005328 - RNA, 19 nt, Homo sapiens
ugaccuggaaucagugaag

SEQ ID NO: 1005329 - RNA, 20 nt, Homo sapiens
ugaccuggcccccucagugu

SEQ ID NO: 1005330 - RNA, 17 nt, Homo sapiens
ugaccuuaaaugcaacc

SEQ ID NO: 1005331 - RNA, 22 nt, Homo sapiens
ugacgacaagugcugaacagug

SEQ ID NO: 1005332 - RNA, 17 nt, Homo sapiens
ugacuaacuagacacca

SEQ ID NO: 1005333 - RNA, 17 nt, Homo sapiens
ugacuauggcuaccaaa

SEQ ID NO: 1005334 - RNA, 21 nt, Homo sapiens
ugacucacaccugaacugaac

SEQ ID NO: 1005335 - RNA, 21 nt, Homo sapiens
ugacuuugggaaagagggacc

SEQ ID NO: 1005336 - RNA, 18 nt, Homo sapiens
ugagaaauuuaaacuaua

SEQ ID NO: 1005337 - RNA, 12 nt, Homo sapiens
ugagacagacua

SEQ ID NO: 1005338 - RNA, 12 nt, Homo sapiens
ugagaccaaacg

SEQ ID NO: 1005339 - RNA, 19 nt, Homo sapiens
ugagauacuuuacuaauaa

SEQ ID NO: 1005340 - RNA, 14 nt, Homo sapiens
ugagaucccgacaa

SEQ ID NO: 1005341 - RNA, 15 nt, Homo sapiens
ugagaugggcuuccc

SEQ ID NO: 1005342 - RNA, 21 nt, Homo sapiens
ugagauucagaugucauuuag

SEQ ID NO: 1005343 - RNA, 16 nt, Homo sapiens
ugagauugcaccacug

SEQ ID NO: 1005344 - RNA, 19 nt, Homo sapiens
ugagcaacucuugauuauc

SEQ ID NO: 1005345 - RNA, 15 nt, Homo sapiens
ugagcaagacauacu

SEQ ID NO: 1005346 - RNA, 15 nt, Homo sapiens
ugagcacuguuuaua

SEQ ID NO: 1005347 - RNA, 17 nt, Homo sapiens
ugcgcgcgugcaugugu

SEQ ID NO: 1005348 - RNA, 13 nt, Homo sapiens
ugcggaagcccag

SEQ ID NO: 1005349 - RNA, 16 nt, Homo sapiens
ugcgguagaugggagg

SEQ ID NO: 1005350 - RNA, 18 nt, Homo sapiens
ugcgugcgagcacacaca

SEQ ID NO: 1005351 - RNA, 12 nt, Homo sapiens
ugcuaaagacau

SEQ ID NO: 1005352 - RNA, 17 nt, Homo sapiens
ugcuaagguucuaaggc

SEQ ID NO: 1005353 - RNA, 21 nt, Homo sapiens
ugcuacagcaauuucuaauuu

SEQ ID NO: 1005354 - RNA, 18 nt, Homo sapiens
ugcuaccacagcaacuau

SEQ ID NO: 1005355 - RNA, 20 nt, Homo sapiens
ugcuaccacagcaacuauau

SEQ ID NO: 1005356 - RNA, 19 nt, Homo sapiens
ugcuacuggggaaacuggc

SEQ ID NO: 1005357 - RNA, 20 nt, Homo sapiens
ugcuaguggccgaaccagaa

SEQ ID NO: 1005358 - RNA, 22 nt, Homo sapiens
ugcucacgucaaaugcauacaa

SEQ ID NO: 1005359 - RNA, 17 nt, Homo sapiens
ugcucagguacuuguaa

SEQ ID NO: 1005360 - RNA, 21 nt, Homo sapiens
ugcucauuuuuucuucuccua

SEQ ID NO: 1005361 - RNA, 16 nt, Homo sapiens
ugcuccaagauucuag

SEQ ID NO: 1005362 - RNA, 16 nt, Homo sapiens
ugcucggggugcacag

SEQ ID NO: 1005363 - RNA, 22 nt, Homo sapiens
ugcucuccucuucuacucacuu

SEQ ID NO: 1005364 - RNA, 18 nt, Homo sapiens
ugcucugagaauuguuga

SEQ ID NO: 1005365 - RNA, 23 nt, Homo sapiens
ugcucugagaauuguugagauac

SEQ ID NO: 1005366 - RNA, 21 nt, Homo sapiens
ugcucugguuguuucuguucc

SEQ ID NO: 1005367 - RNA, 19 nt, Homo sapiens
ugcucuuacuacagcuuca

SEQ ID NO: 1005368 - RNA, 16 nt, Homo sapiens
ugcucuucagccauag

SEQ ID NO: 1005369 - RNA, 16 nt, Homo sapiens
ugcucuugagucuuug

SEQ ID NO: 1005370 - RNA, 16 nt, Homo sapiens
ugcucuuucucugcca

SEQ ID NO: 1005371 - RNA, 21 nt, Homo sapiens
ugcugaaaauguccuugugau

SEQ ID NO: 1005372 - RNA, 18 nt, Homo sapiens
ugcugaaacucagugcaa

SEQ ID NO: 1005373 - RNA, 19 nt, Homo sapiens
ugcugaaacucagugcaaa

SEQ ID NO: 1005374 - RNA, 18 nt, Homo sapiens
ugcugacgggacccacau

SEQ ID NO: 1005375 - RNA, 13 nt, Homo sapiens
ugcugccacugag

SEQ ID NO: 1005376 - RNA, 17 nt, Homo sapiens
ugcugcccauguuucaa

SEQ ID NO: 1005377 - RNA, 18 nt, Homo sapiens
ugcugcugcccccaccuc

SEQ ID NO: 1005378 - RNA, 13 nt, Homo sapiens
ugcuggcauuugc

SEQ ID NO: 1005379 - RNA, 22 nt, Homo sapiens
ugcuggcauuugcaccuaccuc

SEQ ID NO: 1005380 - RNA, 23 nt, Homo sapiens
ugcuggguccauaucacacacau

SEQ ID NO: 1005381 - RNA, 23 nt, Homo sapiens
ugcuguagaaaaaaaaauucaca

SEQ ID NO: 1005382 - RNA, 16 nt, Homo sapiens
ugcuuaccugaucuca

SEQ ID NO: 1005383 - RNA, 17 nt, Homo sapiens
ugcuuaugaaaccugua

SEQ ID NO: 1005384 - RNA, 16 nt, Homo sapiens
ugcuucagugcugcuc

SEQ ID NO: 1005385 - RNA, 12 nt, Homo sapiens
ugcuuccuccca

SEQ ID NO: 1005386 - RNA, 14 nt, Homo sapiens
ugcuugaccaaaga

SEQ ID NO: 1005387 - RNA, 18 nt, Homo sapiens
ugcuuggagcugagcaaa

SEQ ID NO: 1005388 - RNA, 16 nt, Homo sapiens
ugcuugggaagacucc

SEQ ID NO: 1005389 - RNA, 17 nt, Homo sapiens
cuucacaguacccaaac

SEQ ID NO: 1005390 - RNA, 19 nt, Homo sapiens
cuucacucuucaaaugccu

SEQ ID NO: 1005391 - RNA, 17 nt, Homo sapiens
cuucagguucucaugau

SEQ ID NO: 1005392 - RNA, 14 nt, Homo sapiens
cuucagugcugcuc

SEQ ID NO: 1005393 - RNA, 21 nt, Homo sapiens
cuucauccucugagugugacc

SEQ ID NO: 1005394 - RNA, 22 nt, Homo sapiens
cuucaucgaaucuacuaauucc

SEQ ID NO: 1005395 - RNA, 14 nt, Homo sapiens
cuucauucugcaag

SEQ ID NO: 1005396 - RNA, 14 nt, Homo sapiens
cuuccagaaaacaa

SEQ ID NO: 1005397 - RNA, 9 nt, Homo sapiens
cuucccaaa

SEQ ID NO: 1005398 - RNA, 14 nt, Homo sapiens
cuuccggcucccuu

SEQ ID NO: 1005399 - RNA, 21 nt, Homo sapiens
cuuccuagaggugugcuauac

SEQ ID NO: 1005400 - RNA, 15 nt, Homo sapiens
cuuccucagccagcc

SEQ ID NO: 1005401 - RNA, 20 nt, Homo sapiens
cuuccugaguggugccaaac

SEQ ID NO: 1005402 - RNA, 19 nt, Homo sapiens
cuuccugccagcaggggug

SEQ ID NO: 1005403 - RNA, 23 nt, Homo sapiens
cuuccugguagaccacugccaua

SEQ ID NO: 1005404 - RNA, 22 nt, Homo sapiens
cuuccuguguguccaaaacugc

SEQ ID NO: 1005405 - RNA, 18 nt, Homo sapiens
cuucgcugaagugugacu

SEQ ID NO: 1005406 - RNA, 21 nt, Homo sapiens
cuucuaaacccaauccaaaug

SEQ ID NO: 1005407 - RNA, 21 nt, Homo sapiens
cuucuaggucacuucucacaa

SEQ ID NO: 1005408 - RNA, 21 nt, Homo sapiens
cuucuauuuggggcuugauga

SEQ ID NO: 1005409 - RNA, 19 nt, Homo sapiens
cuucucccacucuccuagg

SEQ ID NO: 1005410 - RNA, 19 nt, Homo sapiens
cuucuccccugcacuguaa

SEQ ID NO: 1005411 - RNA, 16 nt, Homo sapiens
cuucucugcacuuaua

SEQ ID NO: 1005412 - RNA, 15 nt, Homo sapiens
cuucucuuugccuca

SEQ ID NO: 1005413 - RNA, 18 nt, Homo sapiens
cuucugagcacuguuuau

SEQ ID NO: 1005414 - RNA, 16 nt, Homo sapiens
cuucugauaaacacaa

SEQ ID NO: 1005415 - RNA, 17 nt, Homo sapiens
cuucugggaacccugcc

SEQ ID NO: 1005416 - RNA, 23 nt, Homo sapiens
cuucuggggcaggcugggccaug

SEQ ID NO: 1005417 - RNA, 18 nt, Homo sapiens
cuugaaaaaaaacagugg

SEQ ID NO: 1005418 - RNA, 19 nt, Homo sapiens
cuugaagggccagagccag

SEQ ID NO: 1005419 - RNA, 16 nt, Homo sapiens
cuugaauguggcuuga

SEQ ID NO: 1005420 - RNA, 12 nt, Homo sapiens
cuugagcccaaa

SEQ ID NO: 1005421 - RNA, 18 nt, Homo sapiens
cuugaggaaaacaagcau

SEQ ID NO: 1005422 - RNA, 21 nt, Homo sapiens
cuugaggggaagcuagucuuu

SEQ ID NO: 1005423 - RNA, 22 nt, Homo sapiens
cuugagggggaaggauucugcu

SEQ ID NO: 1005424 - RNA, 16 nt, Homo sapiens
cuugauagaaaugcca

SEQ ID NO: 1005425 - RNA, 21 nt, Homo sapiens
cuugauuuaucacacaaagca

SEQ ID NO: 1005426 - RNA, 20 nt, Homo sapiens
cuugcaccccaaagcuuucc

SEQ ID NO: 1005427 - RNA, 19 nt, Homo sapiens
cuugcauucccuuaugaug

SEQ ID NO: 1005428 - RNA, 20 nt, Homo sapiens
cuugccuaaauacaagggcu

SEQ ID NO: 1005429 - RNA, 18 nt, Homo sapiens
cuugccugccacugugug

SEQ ID NO: 1005430 - RNA, 15 nt, Homo sapiens
cuugcuauucugucc

SEQ ID NO: 1005431 - RNA, 18 nt, Homo sapiens
cuugcucagguacuugua

SEQ ID NO: 1005432 - RNA, 15 nt, Homo sapiens
cuugcuuaccucuca

SEQ ID NO: 1005433 - RNA, 14 nt, Homo sapiens
cuugcuuccugucu

SEQ ID NO: 1005434 - RNA, 16 nt, Homo sapiens
cuugcuugcaauaggu

SEQ ID NO: 1005435 - RNA, 16 nt, Homo sapiens
cuuggaacauuggaau

SEQ ID NO: 1005436 - RNA, 15 nt, Homo sapiens
cuuggaacuugccug

SEQ ID NO: 1005437 - RNA, 22 nt, Homo sapiens
cuuggagaaaauggguuuauuc

SEQ ID NO: 1005438 - RNA, 17 nt, Homo sapiens
cuuggauucuuuccauu

SEQ ID NO: 1005439 - RNA, 16 nt, Homo sapiens
cuuggcaccagacacc

SEQ ID NO: 1005440 - RNA, 22 nt, Homo sapiens
cuuggcagccuugugaugucau

SEQ ID NO: 1005441 - RNA, 19 nt, Homo sapiens
cuuggccucucucuagggu

SEQ ID NO: 1005442 - RNA, 21 nt, Homo sapiens
cuuggcuggugugguacagag

SEQ ID NO: 1005443 - RNA, 22 nt, Homo sapiens
cuuggcuggugugguacagaga

SEQ ID NO: 1005444 - RNA, 21 nt, Homo sapiens
cuugggaaaggugguguuucu

SEQ ID NO: 1005445 - RNA, 14 nt, Homo sapiens
cuugggcucugaug

SEQ ID NO: 1005446 - RNA, 17 nt, Homo sapiens
cuuggggaaauggggcu

SEQ ID NO: 1005447 - RNA, 23 nt, Homo sapiens
cuugguaauuguacuaaagccaa

SEQ ID NO: 1005448 - RNA, 20 nt, Homo sapiens
cuuguaaauagaaccagccc

SEQ ID NO: 1005449 - RNA, 23 nt, Homo sapiens
cuuguaacuaaaauaauuuugua

SEQ ID NO: 1005450 - RNA, 18 nt, Homo sapiens
cuuguaauucuaaaugaa

SEQ ID NO: 1005451 - RNA, 23 nt, Homo sapiens
cuuguccuagcacagauggccag

SEQ ID NO: 1005452 - RNA, 20 nt, Homo sapiens
cuugugaugucauacagaga

SEQ ID NO: 1005453 - RNA, 16 nt, Homo sapiens
cuugugcccaggguuu

SEQ ID NO: 1005454 - RNA, 14 nt, Homo sapiens
cuuguguguaugca

SEQ ID NO: 1005455 - RNA, 17 nt, Homo sapiens
cuuguguuauauagcca

SEQ ID NO: 1005456 - RNA, 23 nt, Homo sapiens
cuuguuccccacugacagccucc

SEQ ID NO: 1005457 - RNA, 22 nt, Homo sapiens
cuuguucugucaccaauguacc

SEQ ID NO: 1005458 - RNA, 20 nt, Homo sapiens
cuuuaaagcguuugcacaga

SEQ ID NO: 1005459 - RNA, 19 nt, Homo sapiens
cuuuaacaacauguuucca

SEQ ID NO: 1005460 - RNA, 19 nt, Homo sapiens
cuuuaacugacaagccauc

SEQ ID NO: 1005461 - RNA, 20 nt, Homo sapiens
cuuuaaugauaugcuuguaa

SEQ ID NO: 1005462 - RNA, 21 nt, Homo sapiens
cuuuacuaauaaacuguguag

SEQ ID NO: 1005463 - RNA, 15 nt, Homo sapiens
cuuuacuccguaaca

SEQ ID NO: 1005464 - RNA, 23 nt, Homo sapiens
cuuuagucagggcaugcuuuauu

SEQ ID NO: 1005465 - RNA, 15 nt, Homo sapiens
cuuuaugcagagcca

SEQ ID NO: 1005466 - RNA, 21 nt, Homo sapiens
cuuuaugcagagccacagcug

SEQ ID NO: 1005467 - RNA, 16 nt, Homo sapiens
cuuucaaccucaguga

SEQ ID NO: 1005468 - RNA, 20 nt, Homo sapiens
cuuucaagcagucgugccug

SEQ ID NO: 1005469 - RNA, 15 nt, Homo sapiens
cuuucagcuccugac

SEQ ID NO: 1005470 - RNA, 20 nt, Homo sapiens
cuuucccuaauacaggguug

SEQ ID NO: 1005471 - RNA, 22 nt, Homo sapiens
cuuucuaaaggaaaucaaauga

SEQ ID NO: 1005472 - RNA, 13 nt, Homo sapiens
cuuucuccuccaa

SEQ ID NO: 1005473 - RNA, 18 nt, Homo sapiens
cuuucucugccagugaca

SEQ ID NO: 1005474 - RNA, 16 nt, Homo sapiens
aaaaagccacaaugaa

SEQ ID NO: 1005475 - RNA, 21 nt, Homo sapiens
aaaaagugaaaacaauguaag

SEQ ID NO: 1005476 - RNA, 15 nt, Homo sapiens
aaaaauaaauugcuc

SEQ ID NO: 1005477 - RNA, 19 nt, Homo sapiens
aaaaauagacuuaaaucuc

SEQ ID NO: 1005478 - RNA, 21 nt, Homo sapiens
ccagaaaacaaaacugcauuu

SEQ ID NO: 1005479 - RNA, 15 nt, Homo sapiens
ccagacaaaaagcua

SEQ ID NO: 1005480 - RNA, 11 nt, Homo sapiens
ccagacaggga

SEQ ID NO: 1005481 - RNA, 17 nt, Homo sapiens
ccagacucuugccuguu

SEQ ID NO: 1005482 - RNA, 18 nt, Homo sapiens
ccagagcaggaaugggaa

SEQ ID NO: 1005483 - RNA, 17 nt, Homo sapiens
ccagagcccacuccauc

SEQ ID NO: 1005484 - RNA, 14 nt, Homo sapiens
ccagagcccagcuc

SEQ ID NO: 1005485 - RNA, 17 nt, Homo sapiens
ccagagcccagcuccaa

SEQ ID NO: 1005486 - RNA, 21 nt, Homo sapiens
ccagaggagccaccaguucuc

SEQ ID NO: 1005487 - RNA, 18 nt, Homo sapiens
ccagaggcccuggcuccu

SEQ ID NO: 1005488 - RNA, 15 nt, Homo sapiens
ccagagggcacucug

SEQ ID NO: 1005489 - RNA, 20 nt, Homo sapiens
ccagaggggcucaggucaca

SEQ ID NO: 1005490 - RNA, 19 nt, Homo sapiens
ccagaugagaagucugcua

SEQ ID NO: 1005491 - RNA, 18 nt, Homo sapiens
ccagauugacgacaagug

SEQ ID NO: 1005492 - RNA, 22 nt, Homo sapiens
ccagauuggauauggacucuuu

SEQ ID NO: 1005493 - RNA, 17 nt, Homo sapiens
ccagcacacagggcagu

SEQ ID NO: 1005494 - RNA, 15 nt, Homo sapiens
ccagcacaugugcug

SEQ ID NO: 1005495 - RNA, 12 nt, Homo sapiens
ccagcacuucca

SEQ ID NO: 1005496 - RNA, 17 nt, Homo sapiens
ccagccaagcucugcag

SEQ ID NO: 1005497 - RNA, 20 nt, Homo sapiens
ccagccaucaaaaugcuuuu

SEQ ID NO: 1005498 - RNA, 20 nt, Homo sapiens
ccagccucgcccauccccuu

SEQ ID NO: 1005499 - RNA, 17 nt, Homo sapiens
ccagcggcccugucauc

SEQ ID NO: 1005500 - RNA, 13 nt, Homo sapiens
ccagcuagugacc

SEQ ID NO: 1005501 - RNA, 13 nt, Homo sapiens
aguagcugagcuc

SEQ ID NO: 1005502 - RNA, 16 nt, Homo sapiens
aguagucccugcacag

SEQ ID NO: 1005503 - RNA, 18 nt, Homo sapiens
aguagucccugcacagug

SEQ ID NO: 1005504 - RNA, 22 nt, Homo sapiens
aguaguucacauacaaaucauc

SEQ ID NO: 1005505 - RNA, 19 nt, Homo sapiens
aguauacuagggagccauu

SEQ ID NO: 1005506 - RNA, 16 nt, Homo sapiens
aguauauuaauaucau

SEQ ID NO: 1005507 - RNA, 19 nt, Homo sapiens
aguaucacaucacacaaaa

SEQ ID NO: 1005508 - RNA, 14 nt, Homo sapiens
aguaugggaucuga

SEQ ID NO: 1005509 - RNA, 16 nt, Homo sapiens
aguauuuagaagccaa

SEQ ID NO: 1005510 - RNA, 20 nt, Homo sapiens
aguauuuagaagccaacuau

SEQ ID NO: 1005511 - RNA, 15 nt, Homo sapiens
aguauuuuucuugac

SEQ ID NO: 1005512 - RNA, 15 nt, Homo sapiens
uguuuauacacugug

SEQ ID NO: 1005513 - RNA, 20 nt, Homo sapiens
uguuuauccuuucauauagu

SEQ ID NO: 1005514 - RNA, 20 nt, Homo sapiens
uguuucaaggcacucuagau

SEQ ID NO: 1005515 - RNA, 14 nt, Homo sapiens
uguuuuugaucaaa

SEQ ID NO: 1005516 - RNA, 20 nt, Homo sapiens
uguuuuuguucaaagccagc

SEQ ID NO: 1005517 - RNA, 22 nt, Homo sapiens
uguuuuuugccacagcuuuugc

SEQ ID NO: 1005518 - RNA, 19 nt, Homo sapiens
uuaaaaaagauaaacacaa

SEQ ID NO: 1005519 - RNA, 21 nt, Homo sapiens
uuaaaaagccaguuuggguaa

SEQ ID NO: 1005520 - RNA, 15 nt, Homo sapiens
uuaaaacuucaguuu

SEQ ID NO: 1005521 - RNA, 15 nt, Homo sapiens
uuaaaaucagcuauu

SEQ ID NO: 1005522 - RNA, 13 nt, Homo sapiens
uuaaaaucuguca

SEQ ID NO: 1005523 - RNA, 15 nt, Homo sapiens
uuaaaaugacaagca

SEQ ID NO: 1005524 - RNA, 14 nt, Homo sapiens
uuaaacaccuccuc

SEQ ID NO: 1005525 - RNA, 23 nt, Homo sapiens
uuaaaccaauugcugcuacuuau

SEQ ID NO: 1005526 - RNA, 16 nt, Homo sapiens
uuaaacuuuuaauuca

SEQ ID NO: 1005527 - RNA, 17 nt, Homo sapiens
uuaaagaaggguugagc

SEQ ID NO: 1005528 - RNA, 16 nt, Homo sapiens
uuaaaguauucuucuc

SEQ ID NO: 1005529 - RNA, 17 nt, Homo sapiens
uuaaauacagucuucca

SEQ ID NO: 1005530 - RNA, 17 nt, Homo sapiens
uuaaauauauuguacuc

SEQ ID NO: 1005531 - RNA, 12 nt, Homo sapiens
uuaaaucaauaa

SEQ ID NO: 1005532 - RNA, 23 nt, Homo sapiens
uuaaaucaauaaagaccacuuua

SEQ ID NO: 1005533 - RNA, 21 nt, Homo sapiens
uuaaauuucuccaguggauuc

SEQ ID NO: 1005534 - RNA, 15 nt, Homo sapiens
uuaacacucaugaag

SEQ ID NO: 1005535 - RNA, 13 nt, Homo sapiens
uuaacucccauua

SEQ ID NO: 1005536 - RNA, 17 nt, Homo sapiens
uuaagaaauuucacaua

SEQ ID NO: 1005537 - RNA, 22 nt, Homo sapiens
uuaagaauugaguaauggugua

SEQ ID NO: 1005538 - RNA, 19 nt, Homo sapiens
uuaagaccuacuguucuaa

SEQ ID NO: 1005539 - RNA, 17 nt, Homo sapiens
uuaaguacaugugccag

SEQ ID NO: 1005540 - RNA, 19 nt, Homo sapiens
uuaauacucaaaugaguaa

SEQ ID NO: 1005541 - RNA, 19 nt, Homo sapiens
uuaauaucccuacauguau

SEQ ID NO: 1005542 - RNA, 14 nt, Homo sapiens
uuaauccuaccuca

SEQ ID NO: 1005543 - RNA, 21 nt, Homo sapiens
uuaaucuuaguguaugauuac

SEQ ID NO: 1005544 - RNA, 18 nt, Homo sapiens
uuaaugaagaaaguggaa

SEQ ID NO: 1005545 - RNA, 17 nt, Homo sapiens
uuaaugagucagucaau

SEQ ID NO: 1005546 - RNA, 16 nt, Homo sapiens
uuaauuugcacagugu

SEQ ID NO: 1005547 - RNA, 15 nt, Homo sapiens
uuacaaaaguauuau

SEQ ID NO: 1005548 - RNA, 12 nt, Homo sapiens
uuacaagccuaa

SEQ ID NO: 1005549 - RNA, 19 nt, Homo sapiens
uuacaaucagccacauucu

SEQ ID NO: 1005550 - RNA, 22 nt, Homo sapiens
uuacacuuuuuggaagugaaaa

SEQ ID NO: 1005551 - RNA, 19 nt, Homo sapiens
uuacuacagcuucagugau

SEQ ID NO: 1005552 - RNA, 17 nt, Homo sapiens
uuacucagguuugagaa

SEQ ID NO: 1005553 - RNA, 19 nt, Homo sapiens
uuacucccaggcacugucu

SEQ ID NO: 1005554 - RNA, 12 nt, Homo sapiens
uuagaaauucag

SEQ ID NO: 1005555 - RNA, 19 nt, Homo sapiens
uuagacaucuuugcuuaug

SEQ ID NO: 1005556 - RNA, 17 nt, Homo sapiens
uuagaccuguguuacua

SEQ ID NO: 1005557 - RNA, 12 nt, Homo sapiens
uuagaguuuacu

SEQ ID NO: 1005558 - RNA, 19 nt, Homo sapiens
uuagauuugugugcaucag

SEQ ID NO: 1005559 - RNA, 20 nt, Homo sapiens
uuagcuaguuuuauucuugg

SEQ ID NO: 1005560 - RNA, 16 nt, Homo sapiens
uuaggaaggccuucag

SEQ ID NO: 1005561 - RNA, 17 nt, Homo sapiens
cuuguuuacaugcuuau

SEQ ID NO: 1005562 - RNA, 13 nt, Homo sapiens
cuuguuuuggaca

SEQ ID NO: 1005563 - RNA, 18 nt, Homo sapiens
cuuuaaaauguaaagcca

SEQ ID NO: 1005564 - RNA, 18 nt, Homo sapiens
cuuuaauaaaauuugcuu

SEQ ID NO: 1005565 - RNA, 20 nt, Homo sapiens
cuuuacacaauagaauuaua

SEQ ID NO: 1005566 - RNA, 19 nt, Homo sapiens
cuuuacuaauaaacugugu

SEQ ID NO: 1005567 - RNA, 14 nt, Homo sapiens
cuuuagaacaggga

SEQ ID NO: 1005568 - RNA, 16 nt, Homo sapiens
cuuuagaacagggaaa

SEQ ID NO: 1005569 - RNA, 18 nt, Homo sapiens
cuuuagugucugagcuuc

SEQ ID NO: 1005570 - RNA, 19 nt, Homo sapiens
cuuuaugaucuggcccuug

SEQ ID NO: 1005571 - RNA, 15 nt, Homo sapiens
cuuuauuuugagaug

SEQ ID NO: 1005572 - RNA, 14 nt, Homo sapiens
cuuucauauaguua

SEQ ID NO: 1005573 - RNA, 18 nt, Homo sapiens
cuuucauuugcuuuggaa

SEQ ID NO: 1005574 - RNA, 16 nt, Homo sapiens
cuuuccaaacaccacu

SEQ ID NO: 1005575 - RNA, 18 nt, Homo sapiens
cuuuccauaaauccuuga

SEQ ID NO: 1005576 - RNA, 14 nt, Homo sapiens
cuuuccccagugac

SEQ ID NO: 1005577 - RNA, 22 nt, Homo sapiens
cuuuccccagugacaccucagc

SEQ ID NO: 1005578 - RNA, 18 nt, Homo sapiens
cuuucccucauccaugcu

SEQ ID NO: 1005579 - RNA, 16 nt, Homo sapiens
cuuuccucgccugaca

SEQ ID NO: 1005580 - RNA, 22 nt, Homo sapiens
cuuucuaggagggagacacugg

SEQ ID NO: 1005581 - RNA, 15 nt, Homo sapiens
cuuucugaauugcac

SEQ ID NO: 1005582 - RNA, 15 nt, Homo sapiens
cuuucuguucuccag

SEQ ID NO: 1005583 - RNA, 22 nt, Homo sapiens
cuuucuuccgaucuguaccuga

SEQ ID NO: 1005584 - RNA, 17 nt, Homo sapiens
cuuugaauaaaugucac

SEQ ID NO: 1005585 - RNA, 20 nt, Homo sapiens
cuuugaccuaaauuauuuac

SEQ ID NO: 1005586 - RNA, 16 nt, Homo sapiens
cuuugagugacugggu

SEQ ID NO: 1005587 - RNA, 20 nt, Homo sapiens
cuuugcagagaaccucagau

SEQ ID NO: 1005588 - RNA, 14 nt, Homo sapiens
cuuugcagcacagc

SEQ ID NO: 1005589 - RNA, 14 nt, Homo sapiens
cuuugcauggauuu

SEQ ID NO: 1005590 - RNA, 18 nt, Homo sapiens
cuuugcuaaagacaugaa

SEQ ID NO: 1005591 - RNA, 19 nt, Homo sapiens
cuuugcugaaugucauuuu

SEQ ID NO: 1005592 - RNA, 10 nt, Homo sapiens
cuuugcugca

SEQ ID NO: 1005593 - RNA, 18 nt, Homo sapiens
cuuuggaagauggcauaa

SEQ ID NO: 1005594 - RNA, 19 nt, Homo sapiens
cuuugggccagacaugcca

SEQ ID NO: 1005595 - RNA, 17 nt, Homo sapiens
cuuugucccggggcucc

SEQ ID NO: 1005596 - RNA, 12 nt, Homo sapiens
cuuugugcccua

SEQ ID NO: 1005597 - RNA, 14 nt, Homo sapiens
cuuugugugcucuc

SEQ ID NO: 1005598 - RNA, 23 nt, Homo sapiens
cuuuguugcuuccguucauggaa

SEQ ID NO: 1005599 - RNA, 17 nt, Homo sapiens
cuuuguuggagucaaaa

SEQ ID NO: 1005600 - RNA, 18 nt, Homo sapiens
cuuuuacaacugccucga

SEQ ID NO: 1005601 - RNA, 13 nt, Homo sapiens
cuuuuacauucug

SEQ ID NO: 1005602 - RNA, 19 nt, Homo sapiens
cuuuuauacucagcuuucu

SEQ ID NO: 1005603 - RNA, 19 nt, Homo sapiens
cuuuuauuaaugcacuuuc

SEQ ID NO: 1005604 - RNA, 17 nt, Homo sapiens
cuuuuauugacacagaa

SEQ ID NO: 1005605 - RNA, 23 nt, Homo sapiens
cuuuucggccccauguaucucag

SEQ ID NO: 1005606 - RNA, 18 nt, Homo sapiens
cuuuucugaccaaagaga

SEQ ID NO: 1005607 - RNA, 17 nt, Homo sapiens
cuuuugcaacuuaauac

SEQ ID NO: 1005608 - RNA, 20 nt, Homo sapiens
cuuuugccgaccccaagagu

SEQ ID NO: 1005609 - RNA, 23 nt, Homo sapiens
cuuuugugaauuaggcuguaacu

SEQ ID NO: 1005610 - RNA, 18 nt, Homo sapiens
cuuuuugaggcaaaagaa

SEQ ID NO: 1005611 - RNA, 15 nt, Homo sapiens
cuuuuuggagagugc

SEQ ID NO: 1005612 - RNA, 20 nt, Homo sapiens
gaaaaaagcaccaaagggaa

SEQ ID NO: 1005613 - RNA, 18 nt, Homo sapiens
gaaaaaucauccaagaca

SEQ ID NO: 1005614 - RNA, 15 nt, Homo sapiens
gaaaacaaacccagg

SEQ ID NO: 1005615 - RNA, 16 nt, Homo sapiens
gaaaacagaacacuua

SEQ ID NO: 1005616 - RNA, 17 nt, Homo sapiens
gaaaaggcugcugugaa

SEQ ID NO: 1005617 - RNA, 14 nt, Homo sapiens
gaaaaguugcuauu

SEQ ID NO: 1005618 - RNA, 15 nt, Homo sapiens
gaaaauaaaugucac

SEQ ID NO: 1005619 - RNA, 16 nt, Homo sapiens
gaaaauugaaugcaaa

SEQ ID NO: 1005620 - RNA, 22 nt, Homo sapiens
gaaacaacaauuucuacuuuga

SEQ ID NO: 1005621 - RNA, 23 nt, Homo sapiens
gaaacaacaauuucuacuuugaa

SEQ ID NO: 1005622 - RNA, 22 nt, Homo sapiens
gaaacaauggcuaagauaccaa

SEQ ID NO: 1005623 - RNA, 17 nt, Homo sapiens
gaaacacagaaaccuuu

SEQ ID NO: 1005624 - RNA, 17 nt, Homo sapiens
gaaacccuugcugcuuu

SEQ ID NO: 1005625 - RNA, 23 nt, Homo sapiens
gaaacuccagaugccacaaugga

SEQ ID NO: 1005626 - RNA, 14 nt, Homo sapiens
gaaacuuucaaaag

SEQ ID NO: 1005627 - RNA, 20 nt, Homo sapiens
gaaagaagacaaacuuugca

SEQ ID NO: 1005628 - RNA, 23 nt, Homo sapiens
gaaagaccaggccaaugucaggg

SEQ ID NO: 1005629 - RNA, 15 nt, Homo sapiens
gaaagauaauucacu

SEQ ID NO: 1005630 - RNA, 18 nt, Homo sapiens
gaaagauaauucacugua

SEQ ID NO: 1005631 - RNA, 14 nt, Homo sapiens
gaaagaucaaagac

SEQ ID NO: 1005632 - RNA, 19 nt, Homo sapiens
gaaagccugggugacauuu

SEQ ID NO: 1005633 - RNA, 15 nt, Homo sapiens
ugaguugcuuuucag

SEQ ID NO: 1005634 - RNA, 23 nt, Homo sapiens
ugauaagaucuuuuauuuugcca

SEQ ID NO: 1005635 - RNA, 12 nt, Homo sapiens
ugauacuguugc

SEQ ID NO: 1005636 - RNA, 12 nt, Homo sapiens
ugauacuuugac

SEQ ID NO: 1005637 - RNA, 14 nt, Homo sapiens
ugauagaaaugcca

SEQ ID NO: 1005638 - RNA, 14 nt, Homo sapiens
ugauauagaaguau

SEQ ID NO: 1005639 - RNA, 15 nt, Homo sapiens
ugauauucuaucugu

SEQ ID NO: 1005640 - RNA, 15 nt, Homo sapiens
ugaucaaaaacuauu

SEQ ID NO: 1005641 - RNA, 17 nt, Homo sapiens
ugaucaauuauaguuuc

SEQ ID NO: 1005642 - RNA, 15 nt, Homo sapiens
ugaucaggcacagug

SEQ ID NO: 1005643 - RNA, 18 nt, Homo sapiens
ugaugacccuuuucauga

SEQ ID NO: 1005644 - RNA, 14 nt, Homo sapiens
ugaugagcacgguu

SEQ ID NO: 1005645 - RNA, 17 nt, Homo sapiens
ugauggcaacagaucug

SEQ ID NO: 1005646 - RNA, 15 nt, Homo sapiens
ugaugucuuuguuaa

SEQ ID NO: 1005647 - RNA, 22 nt, Homo sapiens
ugauguucauggguauaguuca

SEQ ID NO: 1005648 - RNA, 15 nt, Homo sapiens
ugauuagacagaaca

SEQ ID NO: 1005649 - RNA, 21 nt, Homo sapiens
ugauuauccauauugagucaa

SEQ ID NO: 1005650 - RNA, 23 nt, Homo sapiens
ugauuauccauauugagucaaau

SEQ ID NO: 1005651 - RNA, 13 nt, Homo sapiens
ugauuuacauuuc

SEQ ID NO: 1005652 - RNA, 21 nt, Homo sapiens
ugauuuuaaccaauguagcac

SEQ ID NO: 1005653 - RNA, 14 nt, Homo sapiens
ugauuuuguaaaag

SEQ ID NO: 1005654 - RNA, 16 nt, Homo sapiens
ugcaaaaggacucuca

SEQ ID NO: 1005655 - RNA, 20 nt, Homo sapiens
ugcaaacucuuuggucguuu

SEQ ID NO: 1005656 - RNA, 14 nt, Homo sapiens
ugcaaauacuguau

SEQ ID NO: 1005657 - RNA, 19 nt, Homo sapiens
ugcaaauacuguauauuca

SEQ ID NO: 1005658 - RNA, 10 nt, Homo sapiens
ugcaaaucag

SEQ ID NO: 1005659 - RNA, 15 nt, Homo sapiens
ugcaacagacuugaa

SEQ ID NO: 1005660 - RNA, 13 nt, Homo sapiens
ugcaaccaggaac

SEQ ID NO: 1005661 - RNA, 21 nt, Homo sapiens
ugcaaccucuuggccugauca

SEQ ID NO: 1005662 - RNA, 15 nt, Homo sapiens
ugcaagcacaucugc

SEQ ID NO: 1005663 - RNA, 22 nt, Homo sapiens
ugcaagguacucuggugaguca

SEQ ID NO: 1005664 - RNA, 18 nt, Homo sapiens
ugcaauaggugugcguca

SEQ ID NO: 1005665 - RNA, 14 nt, Homo sapiens
ugcacaagaaugga

SEQ ID NO: 1005666 - RNA, 17 nt, Homo sapiens
ugcacaagcacuaucac

SEQ ID NO: 1005667 - RNA, 15 nt, Homo sapiens
ugcacacauauacau

SEQ ID NO: 1005668 - RNA, 19 nt, Homo sapiens
ugcacacauauacauguag

SEQ ID NO: 1005669 - RNA, 17 nt, Homo sapiens
ugcacagucacugcucu

SEQ ID NO: 1005670 - RNA, 19 nt, Homo sapiens
ugcacagucacugcucuuc

SEQ ID NO: 1005671 - RNA, 16 nt, Homo sapiens
ugcacagugacuucug

SEQ ID NO: 1005672 - RNA, 23 nt, Homo sapiens
ugcacaugugagcaugucacuuc

SEQ ID NO: 1005673 - RNA, 16 nt, Homo sapiens
ugcaccaagcaggaaa

SEQ ID NO: 1005674 - RNA, 14 nt, Homo sapiens
ugcaccacugcacu

SEQ ID NO: 1005675 - RNA, 23 nt, Homo sapiens
ugcaccaugucaaggguucaaga

SEQ ID NO: 1005676 - RNA, 22 nt, Homo sapiens
ugcaccugggagaaagacuuug

SEQ ID NO: 1005677 - RNA, 15 nt, Homo sapiens
ugcaccugugcauuu

SEQ ID NO: 1005678 - RNA, 19 nt, Homo sapiens
ugcacgaccgccccaguuc

SEQ ID NO: 1005679 - RNA, 18 nt, Homo sapiens
ugcacguguguauugcaa

SEQ ID NO: 1005680 - RNA, 15 nt, Homo sapiens
ugcacuucaaauuca

SEQ ID NO: 1005681 - RNA, 20 nt, Homo sapiens
ugcacuucaaauucaaauaa

SEQ ID NO: 1005682 - RNA, 23 nt, Homo sapiens
ugcagacaggaaucuuaaggugu

SEQ ID NO: 1005683 - RNA, 20 nt, Homo sapiens
cugagcacuguuuauacacu

SEQ ID NO: 1005684 - RNA, 14 nt, Homo sapiens
cugagcccaaggca

SEQ ID NO: 1005685 - RNA, 15 nt, Homo sapiens
cugaggccacacuca

SEQ ID NO: 1005686 - RNA, 14 nt, Homo sapiens
cugagggcccgugu

SEQ ID NO: 1005687 - RNA, 15 nt, Homo sapiens
cugagguccugagca

SEQ ID NO: 1005688 - RNA, 19 nt, Homo sapiens
cugagguuugccagcauuu

SEQ ID NO: 1005689 - RNA, 16 nt, Homo sapiens
cugagucagagccaug

SEQ ID NO: 1005690 - RNA, 18 nt, Homo sapiens
cugaguggcaggggacag

SEQ ID NO: 1005691 - RNA, 17 nt, Homo sapiens
cugaguguuuaauuuca

SEQ ID NO: 1005692 - RNA, 16 nt, Homo sapiens
cugaguugcuuuucag

SEQ ID NO: 1005693 - RNA, 15 nt, Homo sapiens
cugaugagcacgguu

SEQ ID NO: 1005694 - RNA, 22 nt, Homo sapiens
cugauuuaggagaagccaggaa

SEQ ID NO: 1005695 - RNA, 23 nt, Homo sapiens
cugcaaaccuuaaaccugcaaaa

SEQ ID NO: 1005696 - RNA, 20 nt, Homo sapiens
cugcaaagaucuguccucag

SEQ ID NO: 1005697 - RNA, 14 nt, Homo sapiens
cugcaaauacugua

SEQ ID NO: 1005698 - RNA, 15 nt, Homo sapiens
cugcaauuggcaccg

SEQ ID NO: 1005699 - RNA, 15 nt, Homo sapiens
cugcaccaugcugcu

SEQ ID NO: 1005700 - RNA, 21 nt, Homo sapiens
cugcaccuuuuugcaugauau

SEQ ID NO: 1005701 - RNA, 14 nt, Homo sapiens
cugcacuguaaaau

SEQ ID NO: 1005702 - RNA, 14 nt, Homo sapiens
cugcaggaucucac

SEQ ID NO: 1005703 - RNA, 23 nt, Homo sapiens
cugcagggccucugucaauugua

SEQ ID NO: 1005704 - RNA, 20 nt, Homo sapiens
cugcaugcccagagacccag

SEQ ID NO: 1005705 - RNA, 17 nt, Homo sapiens
cugcauggcauccucca

SEQ ID NO: 1005706 - RNA, 21 nt, Homo sapiens
cugcauucuucugagcacugu

SEQ ID NO: 1005707 - RNA, 15 nt, Homo sapiens
cugccacccuugacg

SEQ ID NO: 1005708 - RNA, 16 nt, Homo sapiens
cugccagcugcacuga

SEQ ID NO: 1005709 - RNA, 16 nt, Homo sapiens
cugccauguuuaguga

SEQ ID NO: 1005710 - RNA, 19 nt, Homo sapiens
cugcccaaagcagcacuua

SEQ ID NO: 1005711 - RNA, 20 nt, Homo sapiens
cugcccaacccuucccucac

SEQ ID NO: 1005712 - RNA, 13 nt, Homo sapiens
cugcccacuccca

SEQ ID NO: 1005713 - RNA, 15 nt, Homo sapiens
cugccccucucacca

SEQ ID NO: 1005714 - RNA, 18 nt, Homo sapiens
cugcccugguggcccucu

SEQ ID NO: 1005715 - RNA, 20 nt, Homo sapiens
cugccgcagggguccgggau

SEQ ID NO: 1005716 - RNA, 13 nt, Homo sapiens
cugccguccccua

SEQ ID NO: 1005717 - RNA, 16 nt, Homo sapiens
cugccugcccugguga

SEQ ID NO: 1005718 - RNA, 22 nt, Homo sapiens
cugcucagcccugcaccaugcu

SEQ ID NO: 1005719 - RNA, 20 nt, Homo sapiens
cugcucuuggcuggacccag

SEQ ID NO: 1005720 - RNA, 19 nt, Homo sapiens
cugcuggggaagacagugg

SEQ ID NO: 1005721 - RNA, 11 nt, Homo sapiens
cugcugugaac

SEQ ID NO: 1005722 - RNA, 20 nt, Homo sapiens
cugcuucucccaggcaaggc

SEQ ID NO: 1005723 - RNA, 16 nt, Homo sapiens
cugcuugaccaaagag

SEQ ID NO: 1005724 - RNA, 22 nt, Homo sapiens
cugcuugaggaaaacaagcauu

SEQ ID NO: 1005725 - RNA, 18 nt, Homo sapiens
cugcuuuuugcuucuuga

SEQ ID NO: 1005726 - RNA, 12 nt, Homo sapiens
cuggaacccaga

SEQ ID NO: 1005727 - RNA, 14 nt, Homo sapiens
cuggaaugaguuga

SEQ ID NO: 1005728 - RNA, 20 nt, Homo sapiens
cuggaauguaaucaauguuu

SEQ ID NO: 1005729 - RNA, 23 nt, Homo sapiens
cuggaggcccaguucacccugau

SEQ ID NO: 1005730 - RNA, 21 nt, Homo sapiens
cuggagggaggcugggcgggu

SEQ ID NO: 1005731 - RNA, 20 nt, Homo sapiens
cuggagugcaguggcgcgau

SEQ ID NO: 1005732 - RNA, 22 nt, Homo sapiens
cuggaguugaucuggaacccag

SEQ ID NO: 1005733 - RNA, 14 nt, Homo sapiens
cuggaugacauuaa

SEQ ID NO: 1005734 - RNA, 15 nt, Homo sapiens
cuggaugacauuaaa

SEQ ID NO: 1005735 - RNA, 22 nt, Homo sapiens
cuggaugacauuaaagaagggu

SEQ ID NO: 1005736 - RNA, 12 nt, Homo sapiens
cuggauggggca

SEQ ID NO: 1005737 - RNA, 15 nt, Homo sapiens
cuggauuauucuggg

SEQ ID NO: 1005738 - RNA, 15 nt, Homo sapiens
cuggcaacacagagg

SEQ ID NO: 1005739 - RNA, 22 nt, Homo sapiens
cuggccagugcccugaucccag

SEQ ID NO: 1005740 - RNA, 17 nt, Homo sapiens
cuggcuccuugugccag

SEQ ID NO: 1005741 - RNA, 22 nt, Homo sapiens
cuggcucuugaggcauuuccag

SEQ ID NO: 1005742 - RNA, 16 nt, Homo sapiens
cuggcucuuugcugug

SEQ ID NO: 1005743 - RNA, 22 nt, Homo sapiens
cugggaaaugagaugaccacuu

SEQ ID NO: 1005744 - RNA, 20 nt, Homo sapiens
cugggaggagagacacuggu

SEQ ID NO: 1005745 - RNA, 13 nt, Homo sapiens
cugggaggggcaa

SEQ ID NO: 1005746 - RNA, 18 nt, Homo sapiens
cugggagucacacagugu

SEQ ID NO: 1005747 - RNA, 10 nt, Homo sapiens
cugggccaug

SEQ ID NO: 1005748 - RNA, 13 nt, Homo sapiens
cugggccaugucc

SEQ ID NO: 1005749 - RNA, 15 nt, Homo sapiens
cugggccauguccaa

SEQ ID NO: 1005750 - RNA, 18 nt, Homo sapiens
cugggccauguccaaaga

SEQ ID NO: 1005751 - RNA, 20 nt, Homo sapiens
cugggccauucuccacagca

SEQ ID NO: 1005752 - RNA, 16 nt, Homo sapiens
cugggccgcugccacg

SEQ ID NO: 1005753 - RNA, 13 nt, Homo sapiens
cugggcugggaaa

SEQ ID NO: 1005754 - RNA, 19 nt, Homo sapiens
cuggggccuguacugccug

SEQ ID NO: 1005755 - RNA, 14 nt, Homo sapiens
cuggggcucagagc

SEQ ID NO: 1005756 - RNA, 23 nt, Homo sapiens
cugggucucgcuuuguugcccag

SEQ ID NO: 1005757 - RNA, 13 nt, Homo sapiens
ugcagagccacag

SEQ ID NO: 1005758 - RNA, 15 nt, Homo sapiens
ugcagcaagcaauaa

SEQ ID NO: 1005759 - RNA, 19 nt, Homo sapiens
ugcagccucagagacauca

SEQ ID NO: 1005760 - RNA, 17 nt, Homo sapiens
ugcaggaaggagcugcc

SEQ ID NO: 1005761 - RNA, 16 nt, Homo sapiens
ugcaggaucucaccag

SEQ ID NO: 1005762 - RNA, 17 nt, Homo sapiens
ugcaguggugugaucuc

SEQ ID NO: 1005763 - RNA, 21 nt, Homo sapiens
ugcaguuguaggcauguagcu

SEQ ID NO: 1005764 - RNA, 22 nt, Homo sapiens
ugcauaaaugcgauccacagaa

SEQ ID NO: 1005765 - RNA, 22 nt, Homo sapiens
ugcauaauguuucuggauuuca

SEQ ID NO: 1005766 - RNA, 17 nt, Homo sapiens
ugcauagcaagugaaag

SEQ ID NO: 1005767 - RNA, 13 nt, Homo sapiens
ugcaucucuaaua

SEQ ID NO: 1005768 - RNA, 23 nt, Homo sapiens
ugcaucuguuuauucuauaguua

SEQ ID NO: 1005769 - RNA, 20 nt, Homo sapiens
ugcauggauuucuuugaaaa

SEQ ID NO: 1005770 - RNA, 14 nt, Homo sapiens
ugcauuauaucaaa

SEQ ID NO: 1005771 - RNA, 20 nt, Homo sapiens
ugcauucuucugagcacugu

SEQ ID NO: 1005772 - RNA, 21 nt, Homo sapiens
ugcauucuucugagcacuguu

SEQ ID NO: 1005773 - RNA, 23 nt, Homo sapiens
ugcauuuaaauacagucuuccau

SEQ ID NO: 1005774 - RNA, 19 nt, Homo sapiens
ugccaaaggaugugauaua

SEQ ID NO: 1005775 - RNA, 15 nt, Homo sapiens
ugccaauagugucau

SEQ ID NO: 1005776 - RNA, 17 nt, Homo sapiens
ugccaauagugucaucc

SEQ ID NO: 1005777 - RNA, 20 nt, Homo sapiens
ugccaccauggccagccaac

SEQ ID NO: 1005778 - RNA, 15 nt, Homo sapiens
ugccacuggggaaaa

SEQ ID NO: 1005779 - RNA, 19 nt, Homo sapiens
ugccacuggggaaaacucc

SEQ ID NO: 1005780 - RNA, 22 nt, Homo sapiens
ugccagaggcugaugucaagca

SEQ ID NO: 1005781 - RNA, 21 nt, Homo sapiens
ugccagcauuuagacccugca

SEQ ID NO: 1005782 - RNA, 18 nt, Homo sapiens
ugccauacuuuccuguau

SEQ ID NO: 1005783 - RNA, 13 nt, Homo sapiens
ugcccacaggccg

SEQ ID NO: 1005784 - RNA, 15 nt, Homo sapiens
ugcccaggcacugca

SEQ ID NO: 1005785 - RNA, 15 nt, Homo sapiens
ugccccacuuguccu

SEQ ID NO: 1005786 - RNA, 18 nt, Homo sapiens
ugccccagcagugccuug

SEQ ID NO: 1005787 - RNA, 18 nt, Homo sapiens
ugccccaggccugaaaga

SEQ ID NO: 1005788 - RNA, 21 nt, Homo sapiens
ugcccccaccccauucccgca

SEQ ID NO: 1005789 - RNA, 19 nt, Homo sapiens
ugcccccuccaguccccca

SEQ ID NO: 1005790 - RNA, 15 nt, Homo sapiens
ugccccucucucagu

SEQ ID NO: 1005791 - RNA, 14 nt, Homo sapiens
ugccccuugacaac

SEQ ID NO: 1005792 - RNA, 13 nt, Homo sapiens
ugcccucauggcc

SEQ ID NO: 1005793 - RNA, 16 nt, Homo sapiens
ugcccucgugguggaa

SEQ ID NO: 1005794 - RNA, 17 nt, Homo sapiens
ugccuauugcuagagcu

SEQ ID NO: 1005795 - RNA, 21 nt, Homo sapiens
ugccucaacccaaggggauuu

SEQ ID NO: 1005796 - RNA, 15 nt, Homo sapiens
ugccucaaccuccca

SEQ ID NO: 1005797 - RNA, 23 nt, Homo sapiens
ugccucaccacggaccaaaggga

SEQ ID NO: 1005798 - RNA, 23 nt, Homo sapiens
ugccucacuucagguauaccuca

SEQ ID NO: 1005799 - RNA, 21 nt, Homo sapiens
ugccucaugccuguaauccca

SEQ ID NO: 1005800 - RNA, 21 nt, Homo sapiens
ugccucccccuaaauuaauga

SEQ ID NO: 1005801 - RNA, 23 nt, Homo sapiens
ugccucugaggccagccuggccu

SEQ ID NO: 1005802 - RNA, 12 nt, Homo sapiens
ugccugugccag

SEQ ID NO: 1005803 - RNA, 16 nt, Homo sapiens
ugccugugccagguga

SEQ ID NO: 1005804 - RNA, 17 nt, Homo sapiens
ugccugugccaggugag

SEQ ID NO: 1005805 - RNA, 18 nt, Homo sapiens
ugccugugcuacaauuca

SEQ ID NO: 1005806 - RNA, 11 nt, Homo sapiens
ugccuguguac

SEQ ID NO: 1005807 - RNA, 18 nt, Homo sapiens
ugccuguucuaugccuuu

SEQ ID NO: 1005808 - RNA, 15 nt, Homo sapiens
ugccuucaccuccuc

SEQ ID NO: 1005809 - RNA, 17 nt, Homo sapiens
ugggauguucagcacug

SEQ ID NO: 1005810 - RNA, 16 nt, Homo sapiens
ugggauuaggcccuca

SEQ ID NO: 1005811 - RNA, 16 nt, Homo sapiens
ugggcaacacagugag

SEQ ID NO: 1005812 - RNA, 14 nt, Homo sapiens
ugggcagagcccaa

SEQ ID NO: 1005813 - RNA, 18 nt, Homo sapiens
ugggcagggugacccuga

SEQ ID NO: 1005814 - RNA, 20 nt, Homo sapiens
ugggccagaaguaccagacu

SEQ ID NO: 1005815 - RNA, 16 nt, Homo sapiens
ugggccagacaugcca

SEQ ID NO: 1005816 - RNA, 15 nt, Homo sapiens
ugggccccaggggaa

SEQ ID NO: 1005817 - RNA, 14 nt, Homo sapiens
ugggcucugaugaa

SEQ ID NO: 1005818 - RNA, 16 nt, Homo sapiens
ugggcugggaaaaacu

SEQ ID NO: 1005819 - RNA, 13 nt, Homo sapiens
ugggcuucaucca

SEQ ID NO: 1005820 - RNA, 14 nt, Homo sapiens
ugggcuuccagaaa

SEQ ID NO: 1005821 - RNA, 14 nt, Homo sapiens
ugggcuugauucug

SEQ ID NO: 1005822 - RNA, 12 nt, Homo sapiens
uggggaagacag

SEQ ID NO: 1005823 - RNA, 13 nt, Homo sapiens
uggggaagacagu

SEQ ID NO: 1005824 - RNA, 21 nt, Homo sapiens
uggggagaccucuacugccuu

SEQ ID NO: 1005825 - RNA, 16 nt, Homo sapiens
uggggauuuucacuga

SEQ ID NO: 1005826 - RNA, 16 nt, Homo sapiens
uggggcaccuugcucc

SEQ ID NO: 1005827 - RNA, 19 nt, Homo sapiens
uggggcaggccaccuggcu

SEQ ID NO: 1005828 - RNA, 19 nt, Homo sapiens
uggggcaggcugggccaug

SEQ ID NO: 1005829 - RNA, 11 nt, Homo sapiens
uggggccugua

SEQ ID NO: 1005830 - RNA, 21 nt, Homo sapiens
ugggggaaagcaaagcacaga

SEQ ID NO: 1005831 - RNA, 15 nt, Homo sapiens
ugggggagaagcaag

SEQ ID NO: 1005832 - RNA, 17 nt, Homo sapiens
ugggggugggggguccc

SEQ ID NO: 1005833 - RNA, 18 nt, Homo sapiens
ugggguaguuguguuuca

SEQ ID NO: 1005834 - RNA, 17 nt, Homo sapiens
ugggguauaggucucau

SEQ ID NO: 1005835 - RNA, 18 nt, Homo sapiens
uggggugcaccuguccaa

SEQ ID NO: 1005836 - RNA, 15 nt, Homo sapiens
uggguacuucuugaa

SEQ ID NO: 1005837 - RNA, 22 nt, Homo sapiens
ugggucugggagucacacagug

SEQ ID NO: 1005838 - RNA, 13 nt, Homo sapiens
ugggugacauuug

SEQ ID NO: 1005839 - RNA, 16 nt, Homo sapiens
uggguggaaaggugug

SEQ ID NO: 1005840 - RNA, 22 nt, Homo sapiens
uggguugcagacaggaaucuua

SEQ ID NO: 1005841 - RNA, 14 nt, Homo sapiens
ugguaauagcugua

SEQ ID NO: 1005842 - RNA, 21 nt, Homo sapiens
ugguaauuguacuaaagccaa

SEQ ID NO: 1005843 - RNA, 12 nt, Homo sapiens
ugguacagagaa

SEQ ID NO: 1005844 - RNA, 22 nt, Homo sapiens
ugguauaaacguccuacuguau

SEQ ID NO: 1005845 - RNA, 21 nt, Homo sapiens
uggucauuggccgacaucaca

SEQ ID NO: 1005846 - RNA, 22 nt, Homo sapiens
uggucuacccgugucuagaggc

SEQ ID NO: 1005847 - RNA, 17 nt, Homo sapiens
uggucugcccucugcau

SEQ ID NO: 1005848 - RNA, 18 nt, Homo sapiens
uggucuguuugcauuuga

SEQ ID NO: 1005849 - RNA, 21 nt, Homo sapiens
uggucuucaagacgacagcuc

SEQ ID NO: 1005850 - RNA, 19 nt, Homo sapiens
uggucuuucugaauugcac

SEQ ID NO: 1005851 - RNA, 21 nt, Homo sapiens
uggucuuucugaauugcacau

SEQ ID NO: 1005852 - RNA, 22 nt, Homo sapiens
uggugcccagcacaugugcugc

SEQ ID NO: 1005853 - RNA, 18 nt, Homo sapiens
uggugcgucuaagaugag

SEQ ID NO: 1005854 - RNA, 15 nt, Homo sapiens
ugguggagggccaca

SEQ ID NO: 1005855 - RNA, 17 nt, Homo sapiens
ugguguagcuacagaga

SEQ ID NO: 1005856 - RNA, 18 nt, Homo sapiens
ugguguagcuacagagaa

SEQ ID NO: 1005857 - RNA, 19 nt, Homo sapiens
ugguucccccacugaucac

SEQ ID NO: 1005858 - RNA, 14 nt, Homo sapiens
ugguuccuucccaa

SEQ ID NO: 1005859 - RNA, 12 nt, Homo sapiens
ugguuuuuacug

SEQ ID NO: 1005860 - RNA, 17 nt, Homo sapiens
uguaaaaugacaaucau

SEQ ID NO: 1005861 - RNA, 14 nt, Homo sapiens
agcacucauuccuu

SEQ ID NO: 1005862 - RNA, 15 nt, Homo sapiens
agcacugcaccugcc

SEQ ID NO: 1005863 - RNA, 21 nt, Homo sapiens
agcacugccaggagggacaaa

SEQ ID NO: 1005864 - RNA, 20 nt, Homo sapiens
agcagacaggccccgugagg

SEQ ID NO: 1005865 - RNA, 15 nt, Homo sapiens
agcagaggucuccca

SEQ ID NO: 1005866 - RNA, 13 nt, Homo sapiens
agcagccacgagg

SEQ ID NO: 1005867 - RNA, 13 nt, Homo sapiens
agcaguagcauca

SEQ ID NO: 1005868 - RNA, 14 nt, Homo sapiens
agcagucacuugau

SEQ ID NO: 1005869 - RNA, 13 nt, Homo sapiens
agcagugccuugu

SEQ ID NO: 1005870 - RNA, 20 nt, Homo sapiens
agcaguuaguuccuucauga

SEQ ID NO: 1005871 - RNA, 18 nt, Homo sapiens
agcauaaguuucugggac

SEQ ID NO: 1005872 - RNA, 21 nt, Homo sapiens
agcauacgguaugauauugca

SEQ ID NO: 1005873 - RNA, 18 nt, Homo sapiens
agcauaggaaggcucuau

SEQ ID NO: 1005874 - RNA, 15 nt, Homo sapiens
agcaucccucagccu

SEQ ID NO: 1005875 - RNA, 20 nt, Homo sapiens
agcaugaauuuguaaugucu

SEQ ID NO: 1005876 - RNA, 18 nt, Homo sapiens
agcaugcaauacauacca

SEQ ID NO: 1005877 - RNA, 18 nt, Homo sapiens
agcauggaggaggaggga

SEQ ID NO: 1005878 - RNA, 23 nt, Homo sapiens
agcauuacccuccucucucccca

SEQ ID NO: 1005879 - RNA, 22 nt, Homo sapiens
agccaaagggacuggcagucug

SEQ ID NO: 1005880 - RNA, 15 nt, Homo sapiens
agccaagcucugcag

SEQ ID NO: 1005881 - RNA, 22 nt, Homo sapiens
agccacccugaguugcuuuuca

SEQ ID NO: 1005882 - RNA, 13 nt, Homo sapiens
agccagaacuuga

SEQ ID NO: 1005883 - RNA, 15 nt, Homo sapiens
agccagcaucugggc

SEQ ID NO: 1005884 - RNA, 14 nt, Homo sapiens
agccagcccugccu

SEQ ID NO: 1005885 - RNA, 19 nt, Homo sapiens
agccaggagaagcucagcu

SEQ ID NO: 1005886 - RNA, 13 nt, Homo sapiens
agccauaugaaug

SEQ ID NO: 1005887 - RNA, 14 nt, Homo sapiens
agccaucaccucag

SEQ ID NO: 1005888 - RNA, 22 nt, Homo sapiens
agcccaaggcacugagaccucc

SEQ ID NO: 1005889 - RNA, 14 nt, Homo sapiens
agcccaaguucaug

SEQ ID NO: 1005890 - RNA, 11 nt, Homo sapiens
agcccagagac

SEQ ID NO: 1005891 - RNA, 22 nt, Homo sapiens
agcccagggcuccugcacuuac

SEQ ID NO: 1005892 - RNA, 17 nt, Homo sapiens
agcccagugcacugaaa

SEQ ID NO: 1005893 - RNA, 23 nt, Homo sapiens
agcccauaugcuaccaccagcug

SEQ ID NO: 1005894 - RNA, 22 nt, Homo sapiens
agcccccagcuaagaaccugga

SEQ ID NO: 1005895 - RNA, 17 nt, Homo sapiens
agccccugggguggcca

SEQ ID NO: 1005896 - RNA, 14 nt, Homo sapiens
agccccuguagaac

SEQ ID NO: 1005897 - RNA, 13 nt, Homo sapiens
agcccgucucagu

SEQ ID NO: 1005898 - RNA, 19 nt, Homo sapiens
agcccuccucugcacuccc

SEQ ID NO: 1005899 - RNA, 16 nt, Homo sapiens
agcccugcaccaugcu

SEQ ID NO: 1005900 - RNA, 17 nt, Homo sapiens
agcccugucagcaugaa

SEQ ID NO: 1005901 - RNA, 20 nt, Homo sapiens
agccgacaccuuuuuucaac

SEQ ID NO: 1005902 - RNA, 20 nt, Homo sapiens
agccuaaaagugggcuugau

SEQ ID NO: 1005903 - RNA, 23 nt, Homo sapiens
agccucuagagcagacuacagcu

SEQ ID NO: 1005904 - RNA, 13 nt, Homo sapiens
agccuggccagac

SEQ ID NO: 1005905 - RNA, 16 nt, Homo sapiens
agccuggccuccugcc

SEQ ID NO: 1005906 - RNA, 17 nt, Homo sapiens
agccuggguuaaguauu

SEQ ID NO: 1005907 - RNA, 18 nt, Homo sapiens
agccugucagauccagga

SEQ ID NO: 1005908 - RNA, 17 nt, Homo sapiens
agccuguccugucauca

SEQ ID NO: 1005909 - RNA, 20 nt, Homo sapiens
agccugugaacccaggacaa

SEQ ID NO: 1005910 - RNA, 22 nt, Homo sapiens
agccuuaggaaggccuucagga

SEQ ID NO: 1005911 - RNA, 15 nt, Homo sapiens
agccuuccacccagg

SEQ ID NO: 1005912 - RNA, 22 nt, Homo sapiens
agcgaccgcccccuccucuagc

SEQ ID NO: 1005913 - RNA, 18 nt, Homo sapiens
agcgaguggagucugcca

SEQ ID NO: 1005914 - RNA, 18 nt, Homo sapiens
agcuaaacggauuccaaa

SEQ ID NO: 1005915 - RNA, 12 nt, Homo sapiens
agcuaauuugca

SEQ ID NO: 1005916 - RNA, 13 nt, Homo sapiens
agcuacaggacau

SEQ ID NO: 1005917 - RNA, 16 nt, Homo sapiens
agcuacaggacauuuu

SEQ ID NO: 1005918 - RNA, 22 nt, Homo sapiens
agcuaccugcucagcccugcac

SEQ ID NO: 1005919 - RNA, 14 nt, Homo sapiens
agcuacugacuaug

SEQ ID NO: 1005920 - RNA, 21 nt, Homo sapiens
agcuacugccgucagugcugu

SEQ ID NO: 1005921 - RNA, 14 nt, Homo sapiens
agcuagaauaccac

SEQ ID NO: 1005922 - RNA, 15 nt, Homo sapiens
agcuaggugcuauuu

SEQ ID NO: 1005923 - RNA, 17 nt, Homo sapiens
agcuaggugcuauuugu

SEQ ID NO: 1005924 - RNA, 19 nt, Homo sapiens
agcuagguggaaaagccug

SEQ ID NO: 1005925 - RNA, 23 nt, Homo sapiens
agcuauuugauguaauacuucuu

SEQ ID NO: 1005926 - RNA, 17 nt, Homo sapiens
agcuccaauuucaagag

SEQ ID NO: 1005927 - RNA, 21 nt, Homo sapiens
agcuccacccuggccgagucc

SEQ ID NO: 1005928 - RNA, 18 nt, Homo sapiens
agcuccagccugacauca

SEQ ID NO: 1005929 - RNA, 16 nt, Homo sapiens
agcuccaguguccuga

SEQ ID NO: 1005930 - RNA, 21 nt, Homo sapiens
agcuccucccacaaugcugaa

SEQ ID NO: 1005931 - RNA, 15 nt, Homo sapiens
agcuccugacacugc

SEQ ID NO: 1005932 - RNA, 20 nt, Homo sapiens
agcucgggcccucugugaga

SEQ ID NO: 1005933 - RNA, 23 nt, Homo sapiens
agcucugaaaccaguguuaggga

SEQ ID NO: 1005934 - RNA, 16 nt, Homo sapiens
agcucugcagucccag

SEQ ID NO: 1005935 - RNA, 21 nt, Homo sapiens
agcucugcuccccuaaagccu

SEQ ID NO: 1005936 - RNA, 22 nt, Homo sapiens
agcucuggggugggcaguuuuu

SEQ ID NO: 1005937 - RNA, 20 nt, Homo sapiens
agcugagauugcaccacugc

SEQ ID NO: 1005938 - RNA, 14 nt, Homo sapiens
agcugcaauaggaa

SEQ ID NO: 1005939 - RNA, 17 nt, Homo sapiens
agcuggacccugaccag

SEQ ID NO: 1005940 - RNA, 20 nt, Homo sapiens
agcugggucaggcagggugc

SEQ ID NO: 1005941 - RNA, 18 nt, Homo sapiens
agcugguguagcuacaga

SEQ ID NO: 1005942 - RNA, 18 nt, Homo sapiens
agcuuagacuaaggccau

SEQ ID NO: 1005943 - RNA, 14 nt, Homo sapiens
agcuugcaacaaaa

SEQ ID NO: 1005944 - RNA, 18 nt, Homo sapiens
agcuuggacuugcauucc

SEQ ID NO: 1005945 - RNA, 16 nt, Homo sapiens
agcuuucugaacagcu

SEQ ID NO: 1005946 - RNA, 22 nt, Homo sapiens
agcuuuugugggggacuguaag

SEQ ID NO: 1005947 - RNA, 17 nt, Homo sapiens
aggaaaaacaaacucua

SEQ ID NO: 1005948 - RNA, 16 nt, Homo sapiens
aggaaacuccugugac

SEQ ID NO: 1005949 - RNA, 15 nt, Homo sapiens
aggaauagcauguca

SEQ ID NO: 1005950 - RNA, 17 nt, Homo sapiens
aggaauggcugcaccuu

SEQ ID NO: 1005951 - RNA, 12 nt, Homo sapiens
aggacaagcaug

SEQ ID NO: 1005952 - RNA, 14 nt, Homo sapiens
aggaccaagcaucu

SEQ ID NO: 1005953 - RNA, 11 nt, Homo sapiens
aggacccugaa

SEQ ID NO: 1005954 - RNA, 16 nt, Homo sapiens
aggacgcacugagcaa

SEQ ID NO: 1005955 - RNA, 16 nt, Homo sapiens
aggacucaccacugcc

SEQ ID NO: 1005956 - RNA, 16 nt, Homo sapiens
aggacuuccauuugcu

SEQ ID NO: 1005957 - RNA, 21 nt, Homo sapiens
aggacuuccauuugcuuuguc

SEQ ID NO: 1005958 - RNA, 16 nt, Homo sapiens
aggacuugaacccagg

SEQ ID NO: 1005959 - RNA, 22 nt, Homo sapiens
aggagaccuacccuccacaggc

SEQ ID NO: 1005960 - RNA, 15 nt, Homo sapiens
aggagagacacuggu

SEQ ID NO: 1005961 - RNA, 17 nt, Homo sapiens
aggagauucugccuuug

SEQ ID NO: 1005962 - RNA, 15 nt, Homo sapiens
aggagcagaaaaccc

SEQ ID NO: 1005963 - RNA, 15 nt, Homo sapiens
aggagcuccaguguc

SEQ ID NO: 1005964 - RNA, 18 nt, Homo sapiens
aggagcugauacuuugac

SEQ ID NO: 1005965 - RNA, 19 nt, Homo sapiens
augaauacuuugcagcaca

SEQ ID NO: 1005966 - RNA, 14 nt, Homo sapiens
augaaucugcacau

SEQ ID NO: 1005967 - RNA, 23 nt, Homo sapiens
augaauguuuacacucuuuguaa

SEQ ID NO: 1005968 - RNA, 13 nt, Homo sapiens
augacugcacaug

SEQ ID NO: 1005969 - RNA, 19 nt, Homo sapiens
augacuugggcacccccag

SEQ ID NO: 1005970 - RNA, 16 nt, Homo sapiens
augagaccacuguuau

SEQ ID NO: 1005971 - RNA, 20 nt, Homo sapiens
augagagaaggaggggagca

SEQ ID NO: 1005972 - RNA, 11 nt, Homo sapiens
augagccauga

SEQ ID NO: 1005973 - RNA, 18 nt, Homo sapiens
augaggaccuccuacccc

SEQ ID NO: 1005974 - RNA, 19 nt, Homo sapiens
augaggaccuccuaccccc

SEQ ID NO: 1005975 - RNA, 20 nt, Homo sapiens
augaguaauacaucaaagag

SEQ ID NO: 1005976 - RNA, 21 nt, Homo sapiens
augaguaauacaucaaagagu

SEQ ID NO: 1005977 - RNA, 20 nt, Homo sapiens
augaguugaggccacugugu

SEQ ID NO: 1005978 - RNA, 18 nt, Homo sapiens
augauacuucgacacugu

SEQ ID NO: 1005979 - RNA, 22 nt, Homo sapiens
augauacuuggaugcagcucuu

SEQ ID NO: 1005980 - RNA, 19 nt, Homo sapiens
augauagcaaauggccuca

SEQ ID NO: 1005981 - RNA, 22 nt, Homo sapiens
augaucaucacaaucaucauca

SEQ ID NO: 1005982 - RNA, 20 nt, Homo sapiens
augaucccuguguugucucu

SEQ ID NO: 1005983 - RNA, 16 nt, Homo sapiens
augaugagaagcagaa

SEQ ID NO: 1005984 - RNA, 21 nt, Homo sapiens
augauuuuaaguuucucugca

SEQ ID NO: 1005985 - RNA, 15 nt, Homo sapiens
augcaaagaugaacc

SEQ ID NO: 1005986 - RNA, 15 nt, Homo sapiens
augcaauacauacca

SEQ ID NO: 1005987 - RNA, 13 nt, Homo sapiens
augcaaugaacac

SEQ ID NO: 1005988 - RNA, 16 nt, Homo sapiens
augcaauuuuucaaga

SEQ ID NO: 1005989 - RNA, 14 nt, Homo sapiens
augcaccaugucaa

SEQ ID NO: 1005990 - RNA, 22 nt, Homo sapiens
augcacuguucccccugugcag

SEQ ID NO: 1005991 - RNA, 14 nt, Homo sapiens
augcagagccacag

SEQ ID NO: 1005992 - RNA, 23 nt, Homo sapiens
augcagcuguggcagaguuacag

SEQ ID NO: 1005993 - RNA, 16 nt, Homo sapiens
augcauaaaugcgauc

SEQ ID NO: 1005994 - RNA, 16 nt, Homo sapiens
augcauggugccccag

SEQ ID NO: 1005995 - RNA, 17 nt, Homo sapiens
augcauuauaucaaauc

SEQ ID NO: 1005996 - RNA, 21 nt, Homo sapiens
augccagccaagcucugcagu

SEQ ID NO: 1005997 - RNA, 14 nt, Homo sapiens
augcccagacaaaa

SEQ ID NO: 1005998 - RNA, 15 nt, Homo sapiens
augccuagaguuuac

SEQ ID NO: 1005999 - RNA, 22 nt, Homo sapiens
augcgucugucguugugcuuuu

SEQ ID NO: 1006000 - RNA, 14 nt, Homo sapiens
augcucagggucaa

SEQ ID NO: 1006001 - RNA, 14 nt, Homo sapiens
augcugacauucac

SEQ ID NO: 1006002 - RNA, 15 nt, Homo sapiens
augcuggcauuugca

SEQ ID NO: 1006003 - RNA, 14 nt, Homo sapiens
augcuuuccugcac

SEQ ID NO: 1006004 - RNA, 15 nt, Homo sapiens
auggaacagcauuac

SEQ ID NO: 1006005 - RNA, 11 nt, Homo sapiens
auggacaugcu

SEQ ID NO: 1006006 - RNA, 23 nt, Homo sapiens
auggacaugcuucagugcugcuc

SEQ ID NO: 1006007 - RNA, 21 nt, Homo sapiens
auggaggggagggaucuccug

SEQ ID NO: 1006008 - RNA, 17 nt, Homo sapiens
auggauaucccuaccuu

SEQ ID NO: 1006009 - RNA, 20 nt, Homo sapiens
auggcaaaggaagguggaug

SEQ ID NO: 1006010 - RNA, 23 nt, Homo sapiens
auggcaacagaucuggaaccuca

SEQ ID NO: 1006011 - RNA, 18 nt, Homo sapiens
auggcagggggcugcugc

SEQ ID NO: 1006012 - RNA, 20 nt, Homo sapiens
auggcagggggcugcugcug

SEQ ID NO: 1006013 - RNA, 17 nt, Homo sapiens
auggccucauguggcug

SEQ ID NO: 1006014 - RNA, 16 nt, Homo sapiens
auggcuaccaaaaaga

SEQ ID NO: 1006015 - RNA, 18 nt, Homo sapiens
auggcuuuuagcauuuau

SEQ ID NO: 1006016 - RNA, 16 nt, Homo sapiens
augggcagaaaaaugg

SEQ ID NO: 1006017 - RNA, 13 nt, Homo sapiens
auggggaggacaa

SEQ ID NO: 1006018 - RNA, 15 nt, Homo sapiens
auggucacacacuga

SEQ ID NO: 1006019 - RNA, 13 nt, Homo sapiens
auggugagcucug

SEQ ID NO: 1006020 - RNA, 17 nt, Homo sapiens
auggugagcucugggaa

SEQ ID NO: 1006021 - RNA, 19 nt, Homo sapiens
augguguagaacacuaauu

SEQ ID NO: 1006022 - RNA, 23 nt, Homo sapiens
augguguagaacacuaauucaua

SEQ ID NO: 1006023 - RNA, 13 nt, Homo sapiens
auguaaagccaug

SEQ ID NO: 1006024 - RNA, 13 nt, Homo sapiens
auguaaaugguau

SEQ ID NO: 1006025 - RNA, 23 nt, Homo sapiens
auguaacauguaggaaguaggaa

SEQ ID NO: 1006026 - RNA, 22 nt, Homo sapiens
auguaagauuauagauucuaaa

SEQ ID NO: 1006027 - RNA, 19 nt, Homo sapiens
auguacaucuggccuugaa

SEQ ID NO: 1006028 - RNA, 21 nt, Homo sapiens
auguacaugaagaagcuaaau

SEQ ID NO: 1006029 - RNA, 17 nt, Homo sapiens
auguacauuucucaggc

SEQ ID NO: 1006030 - RNA, 22 nt, Homo sapiens
auguaccaccaacuacuaccug

SEQ ID NO: 1006031 - RNA, 14 nt, Homo sapiens
auguacuucucacc

SEQ ID NO: 1006032 - RNA, 17 nt, Homo sapiens
auguauauaaagcuuuu

SEQ ID NO: 1006033 - RNA, 19 nt, Homo sapiens
auguaucucaguaccccau

SEQ ID NO: 1006034 - RNA, 10 nt, Homo sapiens
augucacuuu

SEQ ID NO: 1006035 - RNA, 15 nt, Homo sapiens
augucagugcugaug

SEQ ID NO: 1006036 - RNA, 15 nt, Homo sapiens
augucauacagagaa

SEQ ID NO: 1006037 - RNA, 20 nt, Homo sapiens
augucauuuugguacuuugg

SEQ ID NO: 1006038 - RNA, 22 nt, Homo sapiens
augucuggggcagaaacacuca

SEQ ID NO: 1006039 - RNA, 16 nt, Homo sapiens
augucuuuaaugcaau

SEQ ID NO: 1006040 - RNA, 22 nt, Homo sapiens
augucuuuguuaagacugcuga

SEQ ID NO: 1006041 - RNA, 20 nt, Homo sapiens
augugaaccauuaaccagau

SEQ ID NO: 1006042 - RNA, 12 nt, Homo sapiens
augugaagccaa

SEQ ID NO: 1006043 - RNA, 15 nt, Homo sapiens
augugagcaugucac

SEQ ID NO: 1006044 - RNA, 15 nt, Homo sapiens
augugauguucuaag

SEQ ID NO: 1006045 - RNA, 21 nt, Homo sapiens
auguggacuggugcaaguuga

SEQ ID NO: 1006046 - RNA, 22 nt, Homo sapiens
auguggcaaggaaaaacagguc

SEQ ID NO: 1006047 - RNA, 18 nt, Homo sapiens
auguguguauauggacaa

SEQ ID NO: 1006048 - RNA, 14 nt, Homo sapiens
auguguguugauac

SEQ ID NO: 1006049 - RNA, 18 nt, Homo sapiens
auguguguugauacuguu

SEQ ID NO: 1006050 - RNA, 22 nt, Homo sapiens
auguguguugauacuguugcac

SEQ ID NO: 1006051 - RNA, 22 nt, Homo sapiens
auguuaaaaaaauaagaagaau

SEQ ID NO: 1006052 - RNA, 20 nt, Homo sapiens
auguuaggccuaagaggcuu

SEQ ID NO: 1006053 - RNA, 16 nt, Homo sapiens
auguuaguuaccuuau

SEQ ID NO: 1006054 - RNA, 20 nt, Homo sapiens
auguuauacaauacagauca

SEQ ID NO: 1006055 - RNA, 21 nt, Homo sapiens
auguuaucuucucaaguucua

SEQ ID NO: 1006056 - RNA, 14 nt, Homo sapiens
auguucagcacugu

SEQ ID NO: 1006057 - RNA, 18 nt, Homo sapiens
auguugggaaacuuggcu

SEQ ID NO: 1006058 - RNA, 17 nt, Homo sapiens
auguuuauuaagcauca

SEQ ID NO: 1006059 - RNA, 19 nt, Homo sapiens
auguuuauuuuucuugucu

SEQ ID NO: 1006060 - RNA, 14 nt, Homo sapiens
auguuuccucucaa

SEQ ID NO: 1006061 - RNA, 22 nt, Homo sapiens
auguuuucucuggaguauucua

SEQ ID NO: 1006062 - RNA, 17 nt, Homo sapiens
auuaaaagcaaaucauu

SEQ ID NO: 1006063 - RNA, 16 nt, Homo sapiens
auuaaaauguaugcau

SEQ ID NO: 1006064 - RNA, 15 nt, Homo sapiens
auuaaaguacaacca

SEQ ID NO: 1006065 - RNA, 15 nt, Homo sapiens
auuaaaugacacuca

SEQ ID NO: 1006066 - RNA, 17 nt, Homo sapiens
auuaaauucacaaacuu

SEQ ID NO: 1006067 - RNA, 22 nt, Homo sapiens
auuaacuccuccugagcucuga

SEQ ID NO: 1006068 - RNA, 19 nt, Homo sapiens
auuaagacuuuauguaguu

SEQ ID NO: 1006069 - RNA, 15 nt, Homo sapiens
caguuacauaauuca

SEQ ID NO: 1006070 - RNA, 14 nt, Homo sapiens
caguucagugaggu

SEQ ID NO: 1006071 - RNA, 22 nt, Homo sapiens
caguuuaaaagcacgacagugg

SEQ ID NO: 1006072 - RNA, 18 nt, Homo sapiens
caguuucuaggcaccuca

SEQ ID NO: 1006073 - RNA, 15 nt, Homo sapiens
cauaaccugucucac

SEQ ID NO: 1006074 - RNA, 16 nt, Homo sapiens
cauaaggcuucaaaau

SEQ ID NO: 1006075 - RNA, 21 nt, Homo sapiens
cauaauguuacauuauuauca

SEQ ID NO: 1006076 - RNA, 17 nt, Homo sapiens
cauaauugcauugacuu

SEQ ID NO: 1006077 - RNA, 20 nt, Homo sapiens
cauaauugugauuagacaga

SEQ ID NO: 1006078 - RNA, 14 nt, Homo sapiens
cauacaaguuucau

SEQ ID NO: 1006079 - RNA, 12 nt, Homo sapiens
cauacagaauua

SEQ ID NO: 1006080 - RNA, 19 nt, Homo sapiens
cauacgagagcagaggucu

SEQ ID NO: 1006081 - RNA, 16 nt, Homo sapiens
cauacuuaaugcauau

SEQ ID NO: 1006082 - RNA, 17 nt, Homo sapiens
cauacuugaagggccag

SEQ ID NO: 1006083 - RNA, 15 nt, Homo sapiens
cauauaauuauaugu

SEQ ID NO: 1006084 - RNA, 21 nt, Homo sapiens
cauauagauuguccuuuugca

SEQ ID NO: 1006085 - RNA, 22 nt, Homo sapiens
cauauagauuguccuuuugcaa

SEQ ID NO: 1006086 - RNA, 18 nt, Homo sapiens
cauaugcuaccaccagcu

SEQ ID NO: 1006087 - RNA, 15 nt, Homo sapiens
cauauuuaccucagc

SEQ ID NO: 1006088 - RNA, 22 nt, Homo sapiens
cauauuuguuuaugguaaaaaa

SEQ ID NO: 1006089 - RNA, 20 nt, Homo sapiens
cauauuuuuuuuacugucag

SEQ ID NO: 1006090 - RNA, 16 nt, Homo sapiens
caucaaguugugccaa

SEQ ID NO: 1006091 - RNA, 19 nt, Homo sapiens
caucaauauucagcaaaau

SEQ ID NO: 1006092 - RNA, 11 nt, Homo sapiens
caucaguccau

SEQ ID NO: 1006093 - RNA, 18 nt, Homo sapiens
caucaucaaaaacuuugg

SEQ ID NO: 1006094 - RNA, 17 nt, Homo sapiens
caucaucuccugccuuc

SEQ ID NO: 1006095 - RNA, 19 nt, Homo sapiens
caucauuauuuauguauug

SEQ ID NO: 1006096 - RNA, 21 nt, Homo sapiens
caucauucauuuuuguuguug

SEQ ID NO: 1006097 - RNA, 17 nt, Homo sapiens
cauccaauggacugcau

SEQ ID NO: 1006098 - RNA, 14 nt, Homo sapiens
cauccacacaugaa

SEQ ID NO: 1006099 - RNA, 15 nt, Homo sapiens
cauccauaacugaac

SEQ ID NO: 1006100 - RNA, 16 nt, Homo sapiens
cauccauaauugugau

SEQ ID NO: 1006101 - RNA, 16 nt, Homo sapiens
cauccaucaucaugug

SEQ ID NO: 1006102 - RNA, 21 nt, Homo sapiens
caucccugggccugcugcuga

SEQ ID NO: 1006103 - RNA, 14 nt, Homo sapiens
cauccucacaguga

SEQ ID NO: 1006104 - RNA, 17 nt, Homo sapiens
caucggaaaaauaauca

SEQ ID NO: 1006105 - RNA, 13 nt, Homo sapiens
caucucuauuuag

SEQ ID NO: 1006106 - RNA, 14 nt, Homo sapiens
caucucuuguauau

SEQ ID NO: 1006107 - RNA, 18 nt, Homo sapiens
caucugcuccuguucaca

SEQ ID NO: 1006108 - RNA, 14 nt, Homo sapiens
caucuugcuaccag

SEQ ID NO: 1006109 - RNA, 14 nt, Homo sapiens
caucuugucauuuu

SEQ ID NO: 1006110 - RNA, 13 nt, Homo sapiens
caucuuugcuuau

SEQ ID NO: 1006111 - RNA, 22 nt, Homo sapiens
caugaaucugcacaucuguaaa

SEQ ID NO: 1006112 - RNA, 15 nt, Homo sapiens
caugaggaccaggug

SEQ ID NO: 1006113 - RNA, 18 nt, Homo sapiens
caugaucaucacaaucau

SEQ ID NO: 1006114 - RNA, 22 nt, Homo sapiens
caugaucccuguguugucucua

SEQ ID NO: 1006115 - RNA, 16 nt, Homo sapiens
caugauuucauuucaa

SEQ ID NO: 1006116 - RNA, 15 nt, Homo sapiens
caugauuucuucuua

SEQ ID NO: 1006117 - RNA, 16 nt, Homo sapiens
caugcaauacauacca

SEQ ID NO: 1006118 - RNA, 16 nt, Homo sapiens
caugcauaaaugcgau

SEQ ID NO: 1006119 - RNA, 18 nt, Homo sapiens
caugcgaugacacuugua

SEQ ID NO: 1006120 - RNA, 18 nt, Homo sapiens
caugcuuauuccaugacu

SEQ ID NO: 1006121 - RNA, 18 nt, Homo sapiens
caugcuucagugcugcuc

SEQ ID NO: 1006122 - RNA, 13 nt, Homo sapiens
caugcuuguugca

SEQ ID NO: 1006123 - RNA, 20 nt, Homo sapiens
caugcuuguugcaauugccu

SEQ ID NO: 1006124 - RNA, 21 nt, Homo sapiens
cauggaacagcauuacccucc

SEQ ID NO: 1006125 - RNA, 17 nt, Homo sapiens
cauggaauaguuuugua

SEQ ID NO: 1006126 - RNA, 21 nt, Homo sapiens
cauggcagaaggcaaacccau

SEQ ID NO: 1006127 - RNA, 19 nt, Homo sapiens
cauggucugcccucugcau

SEQ ID NO: 1006128 - RNA, 22 nt, Homo sapiens
cauggugccccaggaccagcuc

SEQ ID NO: 1006129 - RNA, 17 nt, Homo sapiens
caugguggguccauggg

SEQ ID NO: 1006130 - RNA, 17 nt, Homo sapiens
caugguuucagcacuag

SEQ ID NO: 1006131 - RNA, 16 nt, Homo sapiens
cauguaaacugugcac

SEQ ID NO: 1006132 - RNA, 17 nt, Homo sapiens
cauguaaacugugcacc

SEQ ID NO: 1006133 - RNA, 22 nt, Homo sapiens
cauguaacgcaaguucccaguu

SEQ ID NO: 1006134 - RNA, 16 nt, Homo sapiens
cauguacauacccugg

SEQ ID NO: 1006135 - RNA, 12 nt, Homo sapiens
cauguacaugaa

SEQ ID NO: 1006136 - RNA, 14 nt, Homo sapiens
cauguauugcacau

SEQ ID NO: 1006137 - RNA, 17 nt, Homo sapiens
caugucaaggguucaag

SEQ ID NO: 1006138 - RNA, 21 nt, Homo sapiens
caugugacauuuauauauuga

SEQ ID NO: 1006139 - RNA, 16 nt, Homo sapiens
caugugagcaugucac

SEQ ID NO: 1006140 - RNA, 19 nt, Homo sapiens
caugugcaaaugugcuggu

SEQ ID NO: 1006141 - RNA, 19 nt, Homo sapiens
caugugcgcgcgugcaugu

SEQ ID NO: 1006142 - RNA, 15 nt, Homo sapiens
cauguggacuggugc

SEQ ID NO: 1006143 - RNA, 23 nt, Homo sapiens
cauguggacuggugcaaguugag

SEQ ID NO: 1006144 - RNA, 21 nt, Homo sapiens
cauguguagguauugaaaaag

SEQ ID NO: 1006145 - RNA, 15 nt, Homo sapiens
cauguuguaagcacu

SEQ ID NO: 1006146 - RNA, 17 nt, Homo sapiens
cauguuguaagcacuga

SEQ ID NO: 1006147 - RNA, 16 nt, Homo sapiens
cauguuuccucucaau

SEQ ID NO: 1006148 - RNA, 18 nt, Homo sapiens
cauuaaaucuugaacuuu

SEQ ID NO: 1006149 - RNA, 14 nt, Homo sapiens
cauuauaugcacua

SEQ ID NO: 1006150 - RNA, 18 nt, Homo sapiens
cauuaucauaugaacuug

SEQ ID NO: 1006151 - RNA, 18 nt, Homo sapiens
cauuaucgagcagcauuu

SEQ ID NO: 1006152 - RNA, 22 nt, Homo sapiens
cauucccgcagugggagcaaac

SEQ ID NO: 1006153 - RNA, 18 nt, Homo sapiens
cauuccucaugaauguaa

SEQ ID NO: 1006154 - RNA, 14 nt, Homo sapiens
cauuccuucccacc

SEQ ID NO: 1006155 - RNA, 21 nt, Homo sapiens
cauucuauuccauguuugcac

SEQ ID NO: 1006156 - RNA, 18 nt, Homo sapiens
cauucugcaagcacaucu

SEQ ID NO: 1006157 - RNA, 16 nt, Homo sapiens
cauugaacacaaacug

SEQ ID NO: 1006158 - RNA, 17 nt, Homo sapiens
cauuggaauaaggcaug

SEQ ID NO: 1006159 - RNA, 16 nt, Homo sapiens
cauuggccgacaucac

SEQ ID NO: 1006160 - RNA, 17 nt, Homo sapiens
cauuggccgacaucaca

SEQ ID NO: 1006161 - RNA, 20 nt, Homo sapiens
cauuguaaacaaacugugua

SEQ ID NO: 1006162 - RNA, 14 nt, Homo sapiens
cauuguagccucaa

SEQ ID NO: 1006163 - RNA, 19 nt, Homo sapiens
cauuuaaaacauuaaaaua

SEQ ID NO: 1006164 - RNA, 15 nt, Homo sapiens
cauuuaauagacuua

SEQ ID NO: 1006165 - RNA, 16 nt, Homo sapiens
cauuuagucaugugac

SEQ ID NO: 1006166 - RNA, 13 nt, Homo sapiens
cauuuauagcaua

SEQ ID NO: 1006167 - RNA, 15 nt, Homo sapiens
cauuuauauauugaa

SEQ ID NO: 1006168 - RNA, 17 nt, Homo sapiens
cauuucagaaaugcugu

SEQ ID NO: 1006169 - RNA, 22 nt, Homo sapiens
cauuucuauuucuccuccaugg

SEQ ID NO: 1006170 - RNA, 19 nt, Homo sapiens
cauuucucauaccuucccc

SEQ ID NO: 1006171 - RNA, 23 nt, Homo sapiens
cauuucucaucaguaguucacau

SEQ ID NO: 1006172 - RNA, 16 nt, Homo sapiens
cauuugcaccuaccuc

SEQ ID NO: 1006173 - RNA, 22 nt, Homo sapiens
ccuucaugaucaucacaaucau

SEQ ID NO: 1006174 - RNA, 17 nt, Homo sapiens
ccuuccagcuccuguaa

SEQ ID NO: 1006175 - RNA, 14 nt, Homo sapiens
ccuucccaaagcaa

SEQ ID NO: 1006176 - RNA, 16 nt, Homo sapiens
ccuucccaauccagug

SEQ ID NO: 1006177 - RNA, 17 nt, Homo sapiens
ccuucccaauccagugg

SEQ ID NO: 1006178 - RNA, 16 nt, Homo sapiens
ccuuccgcuuggagcu

SEQ ID NO: 1006179 - RNA, 23 nt, Homo sapiens
ccuuccugauuguuuacagucau

SEQ ID NO: 1006180 - RNA, 17 nt, Homo sapiens
ccuucgcuucuugccuc

SEQ ID NO: 1006181 - RNA, 22 nt, Homo sapiens
ccuucuaggucacuucucacaa

SEQ ID NO: 1006182 - RNA, 20 nt, Homo sapiens
ccuucuauuuggggcuugau

SEQ ID NO: 1006183 - RNA, 11 nt, Homo sapiens
ccuucucucuc

SEQ ID NO: 1006184 - RNA, 23 nt, Homo sapiens
ccuucugcucagcucugggccau

SEQ ID NO: 1006185 - RNA, 17 nt, Homo sapiens
ccuucuggcaagccugu

SEQ ID NO: 1006186 - RNA, 17 nt, Homo sapiens
ccuucuucuccaucucc

SEQ ID NO: 1006187 - RNA, 24 nt, Homo sapiens
ccuugaugauugacaacacccauu

SEQ ID NO: 1006188 - RNA, 23 nt, Homo sapiens
ccuugcggcuccucagggacuca

SEQ ID NO: 1006189 - RNA, 17 nt, Homo sapiens
ccuuggcaccagacacc

SEQ ID NO: 1006190 - RNA, 16 nt, Homo sapiens
ccuuggcagcccugau

SEQ ID NO: 1006191 - RNA, 16 nt, Homo sapiens
ccuuggccucugcuaa

SEQ ID NO: 1006192 - RNA, 19 nt, Homo sapiens
ccuuguaauucuaaaugaa

SEQ ID NO: 1006193 - RNA, 12 nt, Homo sapiens
ccuugugccuug

SEQ ID NO: 1006194 - RNA, 16 nt, Homo sapiens
ccuuuacugugcuuau

SEQ ID NO: 1006195 - RNA, 17 nt, Homo sapiens
ccuuucaucacacuggg

SEQ ID NO: 1006196 - RNA, 19 nt, Homo sapiens
ccuuucauggucugcugag

SEQ ID NO: 1006197 - RNA, 11 nt, Homo sapiens
ccuuugcugca

SEQ ID NO: 1006198 - RNA, 21 nt, Homo sapiens
ccuuuggggugaacuaccuug

SEQ ID NO: 1006199 - RNA, 17 nt, Homo sapiens
ccuuuguuggagucaaa

SEQ ID NO: 1006200 - RNA, 13 nt, Homo sapiens
ccuuuucuguucu

SEQ ID NO: 1006201 - RNA, 13 nt, Homo sapiens
ccuuuuucaauga

SEQ ID NO: 1006202 - RNA, 17 nt, Homo sapiens
ccuuuuuguuucaauga

SEQ ID NO: 1006203 - RNA, 17 nt, Homo sapiens
ccuuuuuuauuccauaa

SEQ ID NO: 1006204 - RNA, 18 nt, Homo sapiens
ccuuuuuuccccagacuu

SEQ ID NO: 1006205 - RNA, 23 nt, Homo sapiens
ccuuuuuugaucaggcacagugg

SEQ ID NO: 1006206 - RNA, 13 nt, Homo sapiens
cgaaacacacaaa

SEQ ID NO: 1006207 - RNA, 14 nt, Homo sapiens
cgaaacacacaaac

SEQ ID NO: 1006208 - RNA, 19 nt, Homo sapiens
cgaaacacacaaaccagcc

SEQ ID NO: 1006209 - RNA, 13 nt, Homo sapiens
cgaaugugucuuu

SEQ ID NO: 1006210 - RNA, 20 nt, Homo sapiens
cgacaagugcugaacagugg

SEQ ID NO: 1006211 - RNA, 18 nt, Homo sapiens
cgacuccacgcuguccuu

SEQ ID NO: 1006212 - RNA, 18 nt, Homo sapiens
cgacuuucugccuggagu

SEQ ID NO: 1006213 - RNA, 16 nt, Homo sapiens
cgagaaaaacacacag

SEQ ID NO: 1006214 - RNA, 18 nt, Homo sapiens
cgagaagggcugcuuccc

SEQ ID NO: 1006215 - RNA, 17 nt, Homo sapiens
cgagaggugggccaguc

SEQ ID NO: 1006216 - RNA, 23 nt, Homo sapiens
cgaggcccuuggcgggcacgggu

SEQ ID NO: 1006217 - RNA, 21 nt, Homo sapiens
cgaggcugagaaucagacuga

SEQ ID NO: 1006218 - RNA, 12 nt, Homo sapiens
cgauaaagggau

SEQ ID NO: 1006219 - RNA, 13 nt, Homo sapiens
cgaugacaguguu

SEQ ID NO: 1006220 - RNA, 23 nt, Homo sapiens
cgauucucuugccucaaccuccc

SEQ ID NO: 1006221 - RNA, 20 nt, Homo sapiens
cgcccaggcuggagugcagu

SEQ ID NO: 1006222 - RNA, 11 nt, Homo sapiens
cgccuuggccu

SEQ ID NO: 1006223 - RNA, 19 nt, Homo sapiens
cgcuuggagcuauuuucca

SEQ ID NO: 1006224 - RNA, 21 nt, Homo sapiens
cggacaagacccccagcacuu

SEQ ID NO: 1006225 - RNA, 20 nt, Homo sapiens
cggagaaacgggugagcuga

SEQ ID NO: 1006226 - RNA, 18 nt, Homo sapiens
cggccccucccccugaga

SEQ ID NO: 1006227 - RNA, 19 nt, Homo sapiens
cggcucacugcaaccucca

SEQ ID NO: 1006228 - RNA, 16 nt, Homo sapiens
cggcucgauuucucca

SEQ ID NO: 1006229 - RNA, 17 nt, Homo sapiens
cgggcugugcccgggga

SEQ ID NO: 1006230 - RNA, 15 nt, Homo sapiens
cggggauguguccug

SEQ ID NO: 1006231 - RNA, 22 nt, Homo sapiens
cggggugagggggggcucccug

SEQ ID NO: 1006232 - RNA, 23 nt, Homo sapiens
cgggugagcugagcuuggcguuu

SEQ ID NO: 1006233 - RNA, 23 nt, Homo sapiens
cguaacagauuuuguuggcauag

SEQ ID NO: 1006234 - RNA, 17 nt, Homo sapiens
cgucaucaucacauuca

SEQ ID NO: 1006235 - RNA, 12 nt, Homo sapiens
cguccuggucaa

SEQ ID NO: 1006236 - RNA, 21 nt, Homo sapiens
cgucuucuccaacaccaccuc

SEQ ID NO: 1006237 - RNA, 17 nt, Homo sapiens
cgugacacaaacacaca

SEQ ID NO: 1006238 - RNA, 14 nt, Homo sapiens
cgugaccagcagua

SEQ ID NO: 1006239 - RNA, 14 nt, Homo sapiens
cgugaccagugcug

SEQ ID NO: 1006240 - RNA, 19 nt, Homo sapiens
cgugaccugcuaggccaga

SEQ ID NO: 1006241 - RNA, 16 nt, Homo sapiens
cgugaguggucuucaa

SEQ ID NO: 1006242 - RNA, 16 nt, Homo sapiens
cgugaugccaggacca

SEQ ID NO: 1006243 - RNA, 20 nt, Homo sapiens
cguggcugcugugggaaaug

SEQ ID NO: 1006244 - RNA, 18 nt, Homo sapiens
cguggugaccuuucacga

SEQ ID NO: 1006245 - RNA, 15 nt, Homo sapiens
cguucugugcacaaa

SEQ ID NO: 1006246 - RNA, 22 nt, Homo sapiens
cguuguuuugguuguacuuugg

SEQ ID NO: 1006247 - RNA, 14 nt, Homo sapiens
cguuuuuuucauuc

SEQ ID NO: 1006248 - RNA, 17 nt, Homo sapiens
cuaaaaaugcaucacau

SEQ ID NO: 1006249 - RNA, 15 nt, Homo sapiens
cuaaaacaaugaaua

SEQ ID NO: 1006250 - RNA, 17 nt, Homo sapiens
cuaaaaggaaaucucac

SEQ ID NO: 1006251 - RNA, 12 nt, Homo sapiens
cuaaacauccau

SEQ ID NO: 1006252 - RNA, 16 nt, Homo sapiens
cuaaacggauuccaaa

SEQ ID NO: 1006253 - RNA, 16 nt, Homo sapiens
cuaaacucagaggcag

SEQ ID NO: 1006254 - RNA, 15 nt, Homo sapiens
cuaaagcaauaugca

SEQ ID NO: 1006255 - RNA, 12 nt, Homo sapiens
cuaaagccucaa

SEQ ID NO: 1006256 - RNA, 19 nt, Homo sapiens
cuaaagccucaaaacaaag

SEQ ID NO: 1006257 - RNA, 20 nt, Homo sapiens
cuaaagguccacaggucuag

SEQ ID NO: 1006258 - RNA, 18 nt, Homo sapiens
cuaaaugaauguuuacac

SEQ ID NO: 1006259 - RNA, 15 nt, Homo sapiens
cuaaaugcacaguca

SEQ ID NO: 1006260 - RNA, 12 nt, Homo sapiens
cuaaauguauuc

SEQ ID NO: 1006261 - RNA, 19 nt, Homo sapiens
cuaacagcaccaaaucaaa

SEQ ID NO: 1006262 - RNA, 17 nt, Homo sapiens
cuaacuagcauuguaaa

SEQ ID NO: 1006263 - RNA, 21 nt, Homo sapiens
cuaacuaugcauggugcccca

SEQ ID NO: 1006264 - RNA, 21 nt, Homo sapiens
cuaagaaacauuuauauugau

SEQ ID NO: 1006265 - RNA, 15 nt, Homo sapiens
cuaagcagaccacug

SEQ ID NO: 1006266 - RNA, 20 nt, Homo sapiens
cuaaggcucuaugagucuag

SEQ ID NO: 1006267 - RNA, 22 nt, Homo sapiens
cuaagggccacaucccacugcc

SEQ ID NO: 1006268 - RNA, 22 nt, Homo sapiens
cuaagguuuagauaaauauuga

SEQ ID NO: 1006269 - RNA, 14 nt, Homo sapiens
cuaauuauguagcu

SEQ ID NO: 1006270 - RNA, 19 nt, Homo sapiens
cuaauuuguaggaaaaagc

SEQ ID NO: 1006271 - RNA, 20 nt, Homo sapiens
cuaauuuguaggaaaaagca

SEQ ID NO: 1006272 - RNA, 17 nt, Homo sapiens
cuacaaacuucaaagag

SEQ ID NO: 1006273 - RNA, 19 nt, Homo sapiens
cuacacacccugcauauca

SEQ ID NO: 1006274 - RNA, 18 nt, Homo sapiens
cuacacacggugccuuua

SEQ ID NO: 1006275 - RNA, 19 nt, Homo sapiens
cuacacucaccugcacuaa

SEQ ID NO: 1006276 - RNA, 19 nt, Homo sapiens
cuacagggacacuaucacu

SEQ ID NO: 1006277 - RNA, 18 nt, Homo sapiens
guagguugcacacuuugg

SEQ ID NO: 1006278 - RNA, 21 nt, Homo sapiens
guagugucacucaaggcggug

SEQ ID NO: 1006279 - RNA, 14 nt, Homo sapiens
guauaagcaucugc

SEQ ID NO: 1006280 - RNA, 20 nt, Homo sapiens
guauauuucucuuugucaga

SEQ ID NO: 1006281 - RNA, 18 nt, Homo sapiens
guaucaaauacauuuaaa

SEQ ID NO: 1006282 - RNA, 17 nt, Homo sapiens
guaucaugcccugugca

SEQ ID NO: 1006283 - RNA, 17 nt, Homo sapiens
guaucucaguaccccau

SEQ ID NO: 1006284 - RNA, 13 nt, Homo sapiens
guaugggaucuga

SEQ ID NO: 1006285 - RNA, 19 nt, Homo sapiens
guauguaaaagaaaaucca

SEQ ID NO: 1006286 - RNA, 16 nt, Homo sapiens
guaugugcgugcaugu

SEQ ID NO: 1006287 - RNA, 17 nt, Homo sapiens
guauuaaaauguaugca

SEQ ID NO: 1006288 - RNA, 11 nt, Homo sapiens
guauuauaugu

SEQ ID NO: 1006289 - RNA, 18 nt, Homo sapiens
guauuuuuucacuuguac

SEQ ID NO: 1006290 - RNA, 18 nt, Homo sapiens
gucaaaaccaagucacuu

SEQ ID NO: 1006291 - RNA, 19 nt, Homo sapiens
gucaaccugccugacauuu

SEQ ID NO: 1006292 - RNA, 12 nt, Homo sapiens
gucacacacuga

SEQ ID NO: 1006293 - RNA, 19 nt, Homo sapiens
gucaccaggugaccagugg

SEQ ID NO: 1006294 - RNA, 11 nt, Homo sapiens
gucaccuugcu

SEQ ID NO: 1006295 - RNA, 19 nt, Homo sapiens
gucacguuaccauuuacau

SEQ ID NO: 1006296 - RNA, 14 nt, Homo sapiens
gucacuugaucucc

SEQ ID NO: 1006297 - RNA, 15 nt, Homo sapiens
gucagcacaucucaa

SEQ ID NO: 1006298 - RNA, 13 nt, Homo sapiens
gucagccacuguu

SEQ ID NO: 1006299 - RNA, 15 nt, Homo sapiens
gucagccgguccaug

SEQ ID NO: 1006300 - RNA, 19 nt, Homo sapiens
gucaggaaaacuguuccaa

SEQ ID NO: 1006301 - RNA, 17 nt, Homo sapiens
gucaguucuaaccuccu

SEQ ID NO: 1006302 - RNA, 18 nt, Homo sapiens
gucauauauaucacccag

SEQ ID NO: 1006303 - RNA, 13 nt, Homo sapiens
gucaucugugcac

SEQ ID NO: 1006304 - RNA, 20 nt, Homo sapiens
gucauuggccgacaucacag

SEQ ID NO: 1006305 - RNA, 17 nt, Homo sapiens
guccauuguccaauccu

SEQ ID NO: 1006306 - RNA, 18 nt, Homo sapiens
gucccacaucccugggcc

SEQ ID NO: 1006307 - RNA, 18 nt, Homo sapiens
gucccggggccagcacuu

SEQ ID NO: 1006308 - RNA, 20 nt, Homo sapiens
gucccggggccagcacuucc

SEQ ID NO: 1006309 - RNA, 20 nt, Homo sapiens
gucccggggcuccacugaac

SEQ ID NO: 1006310 - RNA, 12 nt, Homo sapiens
gucccuugcccc

SEQ ID NO: 1006311 - RNA, 16 nt, Homo sapiens
guccgguguucuaaga

SEQ ID NO: 1006312 - RNA, 20 nt, Homo sapiens
guccuaucuccagcggcccu

SEQ ID NO: 1006313 - RNA, 21 nt, Homo sapiens
guccucagccuugccagagau

SEQ ID NO: 1006314 - RNA, 12 nt, Homo sapiens
guccuccuccag

SEQ ID NO: 1006315 - RNA, 15 nt, Homo sapiens
guccuguacauugug

SEQ ID NO: 1006316 - RNA, 20 nt, Homo sapiens
guccuuagccuggaccucug

SEQ ID NO: 1006317 - RNA, 22 nt, Homo sapiens
guccuugauuuaucacacaaag

SEQ ID NO: 1006318 - RNA, 19 nt, Homo sapiens
guccuuguuguuucuugcc

SEQ ID NO: 1006319 - RNA, 23 nt, Homo sapiens
guccuuucccuucaguacccucu

SEQ ID NO: 1006320 - RNA, 21 nt, Homo sapiens
guccuuuugacacugcucuaa

SEQ ID NO: 1006321 - RNA, 21 nt, Homo sapiens
gucuacuugcucagguacuug

SEQ ID NO: 1006322 - RNA, 14 nt, Homo sapiens
gucuagauucucug

SEQ ID NO: 1006323 - RNA, 17 nt, Homo sapiens
gucucacaguguugccc

SEQ ID NO: 1006324 - RNA, 23 nt, Homo sapiens
gucucaccuggacuuaagcaucu

SEQ ID NO: 1006325 - RNA, 18 nt, Homo sapiens
gucucuaguuccacgccu

SEQ ID NO: 1006326 - RNA, 16 nt, Homo sapiens
gucucuguacaugugu

SEQ ID NO: 1006327 - RNA, 21 nt, Homo sapiens
gucugaaaagugaagacagaa

SEQ ID NO: 1006328 - RNA, 12 nt, Homo sapiens
gucugagguccu

SEQ ID NO: 1006329 - RNA, 17 nt, Homo sapiens
gucugccccgcccucau

SEQ ID NO: 1006330 - RNA, 14 nt, Homo sapiens
gucugcuguagaaa

SEQ ID NO: 1006331 - RNA, 22 nt, Homo sapiens
gucuggauaacuuccacagggu

SEQ ID NO: 1006332 - RNA, 16 nt, Homo sapiens
gucugggagucacaca

SEQ ID NO: 1006333 - RNA, 21 nt, Homo sapiens
gucuuaaacuaaaugugcaau

SEQ ID NO: 1006334 - RNA, 16 nt, Homo sapiens
gucuucuuacuuggaa

SEQ ID NO: 1006335 - RNA, 18 nt, Homo sapiens
gucuuggaacauuggaau

SEQ ID NO: 1006336 - RNA, 17 nt, Homo sapiens
gucuuguguauuugucu

SEQ ID NO: 1006337 - RNA, 15 nt, Homo sapiens
gucuuuacagaauca

SEQ ID NO: 1006338 - RNA, 19 nt, Homo sapiens
gugaacaaagcagccacga

SEQ ID NO: 1006339 - RNA, 11 nt, Homo sapiens
gugaagccaug

SEQ ID NO: 1006340 - RNA, 15 nt, Homo sapiens
gugaauaaaccauca

SEQ ID NO: 1006341 - RNA, 21 nt, Homo sapiens
gugaauuaggcuguaacuacu

SEQ ID NO: 1006342 - RNA, 16 nt, Homo sapiens
gugacauuuccaugca

SEQ ID NO: 1006343 - RNA, 17 nt, Homo sapiens
gugacauuuccaugcau

SEQ ID NO: 1006344 - RNA, 16 nt, Homo sapiens
gugaccagugcugcug

SEQ ID NO: 1006345 - RNA, 20 nt, Homo sapiens
gugagcauggaacacuucga

SEQ ID NO: 1006346 - RNA, 18 nt, Homo sapiens
gugaugucauacagagaa

SEQ ID NO: 1006347 - RNA, 20 nt, Homo sapiens
gugauucaccucuucuuucc

SEQ ID NO: 1006348 - RNA, 20 nt, Homo sapiens
gugcaguuguaggcauguag

SEQ ID NO: 1006349 - RNA, 16 nt, Homo sapiens
gugccaaauuauucuc

SEQ ID NO: 1006350 - RNA, 14 nt, Homo sapiens
gugccaccucagac

SEQ ID NO: 1006351 - RNA, 21 nt, Homo sapiens
gugccuccucccucccucucc

SEQ ID NO: 1006352 - RNA, 17 nt, Homo sapiens
gugccuucccagacacu

SEQ ID NO: 1006353 - RNA, 15 nt, Homo sapiens
gugcuacagggucca

SEQ ID NO: 1006354 - RNA, 16 nt, Homo sapiens
gugcugggcauuuuua

SEQ ID NO: 1006355 - RNA, 18 nt, Homo sapiens
guggaaaacuuaugcuga

SEQ ID NO: 1006356 - RNA, 21 nt, Homo sapiens
guggacaugcgugaccagcag

SEQ ID NO: 1006357 - RNA, 15 nt, Homo sapiens
guggaggccacuguu

SEQ ID NO: 1006358 - RNA, 23 nt, Homo sapiens
guggauuauguguguuuugcuaa

SEQ ID NO: 1006359 - RNA, 15 nt, Homo sapiens
guggcgcuuucugca

SEQ ID NO: 1006360 - RNA, 12 nt, Homo sapiens
gugggggguccc

SEQ ID NO: 1006361 - RNA, 20 nt, Homo sapiens
guggguacccccaggaccag

SEQ ID NO: 1006362 - RNA, 15 nt, Homo sapiens
guggguuccacagac

SEQ ID NO: 1006363 - RNA, 16 nt, Homo sapiens
gugguggaagcaagac

SEQ ID NO: 1006364 - RNA, 18 nt, Homo sapiens
gugguuuucuuuugccau

SEQ ID NO: 1006365 - RNA, 19 nt, Homo sapiens
guguaaauauguacauuuc

SEQ ID NO: 1006366 - RNA, 15 nt, Homo sapiens
guguagcuacagaga

SEQ ID NO: 1006367 - RNA, 16 nt, Homo sapiens
guguauauggacaaaa

SEQ ID NO: 1006368 - RNA, 13 nt, Homo sapiens
guguauccaugca

SEQ ID NO: 1006369 - RNA, 17 nt, Homo sapiens
gugucuggcaguuuaua

SEQ ID NO: 1006370 - RNA, 20 nt, Homo sapiens
gugucuguccuuuaugaucc

SEQ ID NO: 1006371 - RNA, 15 nt, Homo sapiens
gugucuuaauuauua

SEQ ID NO: 1006372 - RNA, 18 nt, Homo sapiens
gugucuuucacagcuccu

SEQ ID NO: 1006373 - RNA, 21 nt, Homo sapiens
gugugaacucaccaaacacaa

SEQ ID NO: 1006374 - RNA, 19 nt, Homo sapiens
guguggggauuuucacuga

SEQ ID NO: 1006375 - RNA, 14 nt, Homo sapiens
guguguauugcaau

SEQ ID NO: 1006376 - RNA, 18 nt, Homo sapiens
guguguuuggaagacuau

SEQ ID NO: 1006377 - RNA, 16 nt, Homo sapiens
guguuucuugccucau

SEQ ID NO: 1006378 - RNA, 16 nt, Homo sapiens
guguuuuuaacauguc

SEQ ID NO: 1006379 - RNA, 20 nt, Homo sapiens
guuaaacuuauaacccacuu

SEQ ID NO: 1006380 - RNA, 20 nt, Homo sapiens
guuaacuuuucuaacagaaa

SEQ ID NO: 1006381 - RNA, 18 nt, Homo sapiens
ucagaagucaucuugcua

SEQ ID NO: 1006382 - RNA, 20 nt, Homo sapiens
ucagaaguuaguuuguauau

SEQ ID NO: 1006383 - RNA, 13 nt, Homo sapiens
ucagaauagccac

SEQ ID NO: 1006384 - RNA, 13 nt, Homo sapiens
ucagacaggcaaa

SEQ ID NO: 1006385 - RNA, 17 nt, Homo sapiens
ucagacucuaagaaaga

SEQ ID NO: 1006386 - RNA, 13 nt, Homo sapiens
ucagagacaucag

SEQ ID NO: 1006387 - RNA, 17 nt, Homo sapiens
ucagagcacucauuccu

SEQ ID NO: 1006388 - RNA, 18 nt, Homo sapiens
ucagagccgggguggggu

SEQ ID NO: 1006389 - RNA, 17 nt, Homo sapiens
ucagaggcgcacuguga

SEQ ID NO: 1006390 - RNA, 23 nt, Homo sapiens
ucagagugacuacacacaguacg

SEQ ID NO: 1006391 - RNA, 22 nt, Homo sapiens
ucagauaagguaaaaugccaug

SEQ ID NO: 1006392 - RNA, 23 nt, Homo sapiens
ucagauaagguaaaaugccauga

SEQ ID NO: 1006393 - RNA, 21 nt, Homo sapiens
ucagauccuccucauucacau

SEQ ID NO: 1006394 - RNA, 13 nt, Homo sapiens
ucagcauggcauc

SEQ ID NO: 1006395 - RNA, 20 nt, Homo sapiens
ucagccaauccgauugccuu

SEQ ID NO: 1006396 - RNA, 21 nt, Homo sapiens
ucagccaauccgauugccuua

SEQ ID NO: 1006397 - RNA, 14 nt, Homo sapiens
ucagccacauucua

SEQ ID NO: 1006398 - RNA, 22 nt, Homo sapiens
ucagccacuugccugugcuaca

SEQ ID NO: 1006399 - RNA, 20 nt, Homo sapiens
ucagcccugcaccaugcugc

SEQ ID NO: 1006400 - RNA, 16 nt, Homo sapiens
ucagccuggccagaca

SEQ ID NO: 1006401 - RNA, 17 nt, Homo sapiens
ucagccuuaagaaccau

SEQ ID NO: 1006402 - RNA, 21 nt, Homo sapiens
ucagccuugccagagauccaa

SEQ ID NO: 1006403 - RNA, 13 nt, Homo sapiens
ucagcucugggcc

SEQ ID NO: 1006404 - RNA, 20 nt, Homo sapiens
ucaggaaaacuguuccaauc

SEQ ID NO: 1006405 - RNA, 20 nt, Homo sapiens
ucaggaaacgagacuuucca

SEQ ID NO: 1006406 - RNA, 14 nt, Homo sapiens
ucaggacagaugcc

SEQ ID NO: 1006407 - RNA, 18 nt, Homo sapiens
ucaggacagaugccacac

SEQ ID NO: 1006408 - RNA, 16 nt, Homo sapiens
ucaggcagggugcagu

SEQ ID NO: 1006409 - RNA, 23 nt, Homo sapiens
ucaggcgauccaccugucucagc

SEQ ID NO: 1006410 - RNA, 17 nt, Homo sapiens
ucagguaauacaaacua

SEQ ID NO: 1006411 - RNA, 17 nt, Homo sapiens
ucagguggcccuacugg

SEQ ID NO: 1006412 - RNA, 19 nt, Homo sapiens
ucagguggcccuacuggga

SEQ ID NO: 1006413 - RNA, 22 nt, Homo sapiens
ucagguuugaggguuugcagaa

SEQ ID NO: 1006414 - RNA, 14 nt, Homo sapiens
ucaguaccccaugg

SEQ ID NO: 1006415 - RNA, 15 nt, Homo sapiens
ucaguaguucacaua

SEQ ID NO: 1006416 - RNA, 22 nt, Homo sapiens
ucagucacagccaccccugaga

SEQ ID NO: 1006417 - RNA, 15 nt, Homo sapiens
ucaguccaugucucg

SEQ ID NO: 1006418 - RNA, 16 nt, Homo sapiens
ucagugaaguugcugc

SEQ ID NO: 1006419 - RNA, 18 nt, Homo sapiens
ucagugaaguugcugcuu

SEQ ID NO: 1006420 - RNA, 12 nt, Homo sapiens
ucagugcugcuc

SEQ ID NO: 1006421 - RNA, 15 nt, Homo sapiens
ucaguguuaaaugug

SEQ ID NO: 1006422 - RNA, 11 nt, Homo sapiens
ucauacagaga

SEQ ID NO: 1006423 - RNA, 12 nt, Homo sapiens
ucauacagagaa

SEQ ID NO: 1006424 - RNA, 12 nt, Homo sapiens
ucauacuguaac

SEQ ID NO: 1006425 - RNA, 18 nt, Homo sapiens
ucauagcaauacuuggag

SEQ ID NO: 1006426 - RNA, 20 nt, Homo sapiens
ucauagcaccuaacaacauu

SEQ ID NO: 1006427 - RNA, 15 nt, Homo sapiens
ucauauuguucaaua

SEQ ID NO: 1006428 - RNA, 20 nt, Homo sapiens
ucauauuuuaaacagaggau

SEQ ID NO: 1006429 - RNA, 17 nt, Homo sapiens
ucaucaaaaacuuugga

SEQ ID NO: 1006430 - RNA, 18 nt, Homo sapiens
ucaucaauggggccaguc

SEQ ID NO: 1006431 - RNA, 18 nt, Homo sapiens
ucaucaggugcauagcaa

SEQ ID NO: 1006432 - RNA, 22 nt, Homo sapiens
ucaucaguccauugcucuugag

SEQ ID NO: 1006433 - RNA, 17 nt, Homo sapiens
ucauccagcucacucau

SEQ ID NO: 1006434 - RNA, 18 nt, Homo sapiens
ucauccauccuugccaau

SEQ ID NO: 1006435 - RNA, 21 nt, Homo sapiens
ucaucccgagcaccuccacau

SEQ ID NO: 1006436 - RNA, 16 nt, Homo sapiens
ucaucccuccaucuca

SEQ ID NO: 1006437 - RNA, 18 nt, Homo sapiens
ucaucucccaccuagcag

SEQ ID NO: 1006438 - RNA, 16 nt, Homo sapiens
ucaucuuggaacugca

SEQ ID NO: 1006439 - RNA, 14 nt, Homo sapiens
ucaugaggagauuc

SEQ ID NO: 1006440 - RNA, 14 nt, Homo sapiens
ucaugaucaucaca

SEQ ID NO: 1006441 - RNA, 16 nt, Homo sapiens
ucaugauuucauuuca

SEQ ID NO: 1006442 - RNA, 13 nt, Homo sapiens
ucaugcccugugc

SEQ ID NO: 1006443 - RNA, 18 nt, Homo sapiens
ucaugccgacgcuugcac

SEQ ID NO: 1006444 - RNA, 21 nt, Homo sapiens
ucauguugaagccacugccuu

SEQ ID NO: 1006445 - RNA, 13 nt, Homo sapiens
ucauucauggcua

SEQ ID NO: 1006446 - RNA, 18 nt, Homo sapiens
ucauucgcuacuaugauu

SEQ ID NO: 1006447 - RNA, 13 nt, Homo sapiens
ucauucuacugaa

SEQ ID NO: 1006448 - RNA, 21 nt, Homo sapiens
ucauucucugucucauccauc

SEQ ID NO: 1006449 - RNA, 22 nt, Homo sapiens
ucauucuuuuauacucagcuuu

SEQ ID NO: 1006450 - RNA, 19 nt, Homo sapiens
ucauuggaaauuuagcauu

SEQ ID NO: 1006451 - RNA, 15 nt, Homo sapiens
ucauuuaauccuccc

SEQ ID NO: 1006452 - RNA, 12 nt, Homo sapiens
uccaaagaggcu

SEQ ID NO: 1006453 - RNA, 15 nt, Homo sapiens
uccaaagaggcugcc

SEQ ID NO: 1006454 - RNA, 22 nt, Homo sapiens
uccaaagaggcugccccucuca

SEQ ID NO: 1006455 - RNA, 23 nt, Homo sapiens
uccaaagaguagaauugcauuga

SEQ ID NO: 1006456 - RNA, 17 nt, Homo sapiens
uccaaauucaguuucau

SEQ ID NO: 1006457 - RNA, 16 nt, Homo sapiens
uccaacacaucucccu

SEQ ID NO: 1006458 - RNA, 17 nt, Homo sapiens
uccaacaccaagcacag

SEQ ID NO: 1006459 - RNA, 17 nt, Homo sapiens
uccaaccugcaaagauc

SEQ ID NO: 1006460 - RNA, 19 nt, Homo sapiens
uccaagugguccacaagcu

SEQ ID NO: 1006461 - RNA, 12 nt, Homo sapiens
uccaauacucag

SEQ ID NO: 1006462 - RNA, 12 nt, Homo sapiens
uccaaucagaac

SEQ ID NO: 1006463 - RNA, 21 nt, Homo sapiens
uccaaugagcuuucugaacag

SEQ ID NO: 1006464 - RNA, 12 nt, Homo sapiens
uccacagaggac

SEQ ID NO: 1006465 - RNA, 20 nt, Homo sapiens
uccacucuacuaaugccucu

SEQ ID NO: 1006466 - RNA, 19 nt, Homo sapiens
uccagaaaacaaaacugca

SEQ ID NO: 1006467 - RNA, 20 nt, Homo sapiens
uccagaaaacaaaacugcau

SEQ ID NO: 1006468 - RNA, 16 nt, Homo sapiens
uccagaaaaugaacac

SEQ ID NO: 1006469 - RNA, 17 nt, Homo sapiens
uccaggaaaguggccaa

SEQ ID NO: 1006470 - RNA, 16 nt, Homo sapiens
uccaggagaaggccaa

SEQ ID NO: 1006471 - RNA, 19 nt, Homo sapiens
uccaucccccguggccauu

SEQ ID NO: 1006472 - RNA, 16 nt, Homo sapiens
uccaugggaccacaac

SEQ ID NO: 1006473 - RNA, 15 nt, Homo sapiens
uccauuugcuuuguc

SEQ ID NO: 1006474 - RNA, 15 nt, Homo sapiens
ucccaaagcaucccu

SEQ ID NO: 1006475 - RNA, 19 nt, Homo sapiens
ucccaaagugcugagauua

SEQ ID NO: 1006476 - RNA, 19 nt, Homo sapiens
ucccaaaugagccaugaga

SEQ ID NO: 1006477 - RNA, 14 nt, Homo sapiens
ucccaacucuugca

SEQ ID NO: 1006478 - RNA, 22 nt, Homo sapiens
ucccaagagcaucaugccucug

SEQ ID NO: 1006479 - RNA, 20 nt, Homo sapiens
ucccaaguagcugggauuac

SEQ ID NO: 1006480 - RNA, 15 nt, Homo sapiens
ucccaaucggccuua

SEQ ID NO: 1006481 - RNA, 22 nt, Homo sapiens
ucccaauuucagacucccauuc

SEQ ID NO: 1006482 - RNA, 22 nt, Homo sapiens
ucccaccccaaccugcucuccu

SEQ ID NO: 1006483 - RNA, 23 nt, Homo sapiens
ucccacccccacccccagcucaa

SEQ ID NO: 1006484 - RNA, 14 nt, Homo sapiens
ucccacgaggaauc

SEQ ID NO: 1006485 - RNA, 15 nt, Homo sapiens
ugcuggcauuugcac

SEQ ID NO: 1006486 - RNA, 14 nt, Homo sapiens
ugcuggggaagaca

SEQ ID NO: 1006487 - RNA, 18 nt, Homo sapiens
ugcuggggaagacagugg

SEQ ID NO: 1006488 - RNA, 18 nt, Homo sapiens
ugcuggguccauaucaca

SEQ ID NO: 1006489 - RNA, 23 nt, Homo sapiens
ugcuggucccggggccagcacuu

SEQ ID NO: 1006490 - RNA, 16 nt, Homo sapiens
ugcugucacaaccaag

SEQ ID NO: 1006491 - RNA, 17 nt, Homo sapiens
ugcugucacaaccaaga

SEQ ID NO: 1006492 - RNA, 22 nt, Homo sapiens
ugcugugaggcuguccuguaca

SEQ ID NO: 1006493 - RNA, 22 nt, Homo sapiens
ugcugugcguggaaugcccuuc

SEQ ID NO: 1006494 - RNA, 16 nt, Homo sapiens
ugcuguuuuaaacauu

SEQ ID NO: 1006495 - RNA, 19 nt, Homo sapiens
ugcuuaccucucagccuua

SEQ ID NO: 1006496 - RNA, 14 nt, Homo sapiens
ugcuuaugcucuua

SEQ ID NO: 1006497 - RNA, 14 nt, Homo sapiens
ugcuucccgaguga

SEQ ID NO: 1006498 - RNA, 20 nt, Homo sapiens
ugcuucucccaggcaaggcu

SEQ ID NO: 1006499 - RNA, 19 nt, Homo sapiens
ugcuugacaugguuuccaa

SEQ ID NO: 1006500 - RNA, 14 nt, Homo sapiens
ugcuuguuauuaga

SEQ ID NO: 1006501 - RNA, 23 nt, Homo sapiens
ugcuuugggcuugggccuaggcu

SEQ ID NO: 1006502 - RNA, 23 nt, Homo sapiens
ugcuuuugcccauuuugaaucac

SEQ ID NO: 1006503 - RNA, 19 nt, Homo sapiens
uggaaaagcaacauucaua

SEQ ID NO: 1006504 - RNA, 19 nt, Homo sapiens
uggaaagcggcuagguuuu

SEQ ID NO: 1006505 - RNA, 20 nt, Homo sapiens
uggaaccucagccuggccag

SEQ ID NO: 1006506 - RNA, 15 nt, Homo sapiens
uggaagauggcauaa

SEQ ID NO: 1006507 - RNA, 17 nt, Homo sapiens
uggaaguuuagcucuga

SEQ ID NO: 1006508 - RNA, 23 nt, Homo sapiens
uggaaucagugaagccaaaggga

SEQ ID NO: 1006509 - RNA, 16 nt, Homo sapiens
uggacaaagaaccuuc

SEQ ID NO: 1006510 - RNA, 19 nt, Homo sapiens
uggacaagccauuauacca

SEQ ID NO: 1006511 - RNA, 20 nt, Homo sapiens
uggacaaggagugugaccac

SEQ ID NO: 1006512 - RNA, 16 nt, Homo sapiens
uggacagccugaguca

SEQ ID NO: 1006513 - RNA, 14 nt, Homo sapiens
uggacaucuuguca

SEQ ID NO: 1006514 - RNA, 15 nt, Homo sapiens
uggacaucuugucau

SEQ ID NO: 1006515 - RNA, 17 nt, Homo sapiens
uggacaugcgugaccag

SEQ ID NO: 1006516 - RNA, 17 nt, Homo sapiens
uggaccauggaguggca

SEQ ID NO: 1006517 - RNA, 14 nt, Homo sapiens
uggacccugaccag

SEQ ID NO: 1006518 - RNA, 14 nt, Homo sapiens
uggacugguuuuca

SEQ ID NO: 1006519 - RNA, 22 nt, Homo sapiens
uggacugguuuucacauuagaa

SEQ ID NO: 1006520 - RNA, 22 nt, Homo sapiens
uggagaaaauggguuuauucac

SEQ ID NO: 1006521 - RNA, 17 nt, Homo sapiens
uggagaagucucagcua

SEQ ID NO: 1006522 - RNA, 17 nt, Homo sapiens
uggagacugucuggccc

SEQ ID NO: 1006523 - RNA, 20 nt, Homo sapiens
uggagaggaaaagcaucaga

SEQ ID NO: 1006524 - RNA, 19 nt, Homo sapiens
uggagagggaaugugaaau

SEQ ID NO: 1006525 - RNA, 14 nt, Homo sapiens
uggagcugggcuaa

SEQ ID NO: 1006526 - RNA, 14 nt, Homo sapiens
uggaggccacuguu

SEQ ID NO: 1006527 - RNA, 22 nt, Homo sapiens
uggaggcccaguucacccugau

SEQ ID NO: 1006528 - RNA, 22 nt, Homo sapiens
uggagguggaaaagcaacauuc

SEQ ID NO: 1006529 - RNA, 23 nt, Homo sapiens
uggagguggaaaagcaacauuca

SEQ ID NO: 1006530 - RNA, 23 nt, Homo sapiens
uggaguacuuagcuaguuuuauu

SEQ ID NO: 1006531 - RNA, 16 nt, Homo sapiens
uggagugcagugccac

SEQ ID NO: 1006532 - RNA, 15 nt, Homo sapiens
uggauaaauugcaca

SEQ ID NO: 1006533 - RNA, 21 nt, Homo sapiens
uggauaucccuaccuugaaag

SEQ ID NO: 1006534 - RNA, 21 nt, Homo sapiens
uggaucacucaccauucccag

SEQ ID NO: 1006535 - RNA, 14 nt, Homo sapiens
uggaugagcuccca

SEQ ID NO: 1006536 - RNA, 20 nt, Homo sapiens
uggaugcuggguccauauca

SEQ ID NO: 1006537 - RNA, 22 nt, Homo sapiens
uggauugcacguggccucuuga

SEQ ID NO: 1006538 - RNA, 23 nt, Homo sapiens
uggcaacagaucuggaaccucag

SEQ ID NO: 1006539 - RNA, 21 nt, Homo sapiens
uggcacuuggggcaccuugcu

SEQ ID NO: 1006540 - RNA, 18 nt, Homo sapiens
uggcagcauugacucugu

SEQ ID NO: 1006541 - RNA, 22 nt, Homo sapiens
uggcauccaagacucuuuauga

SEQ ID NO: 1006542 - RNA, 17 nt, Homo sapiens
uggccacagccagggga

SEQ ID NO: 1006543 - RNA, 19 nt, Homo sapiens
uggcccccggguguaaaua

SEQ ID NO: 1006544 - RNA, 20 nt, Homo sapiens
uggcccccucaguguuguca

SEQ ID NO: 1006545 - RNA, 24 nt, Homo sapiens
uggcccccucccuggaugacauua

SEQ ID NO: 1006546 - RNA, 14 nt, Homo sapiens
uggcccuacuggga

SEQ ID NO: 1006547 - RNA, 17 nt, Homo sapiens
uggcccuugcuuaccuc

SEQ ID NO: 1006548 - RNA, 22 nt, Homo sapiens
uggccuccccugccaccaggcc

SEQ ID NO: 1006549 - RNA, 17 nt, Homo sapiens
uggccuugaaaccaccu

SEQ ID NO: 1006550 - RNA, 18 nt, Homo sapiens
uggcguaaguacagagaa

SEQ ID NO: 1006551 - RNA, 23 nt, Homo sapiens
uggcguuacugcuugaccaaaga

SEQ ID NO: 1006552 - RNA, 15 nt, Homo sapiens
uggcuaagauaccaa

SEQ ID NO: 1006553 - RNA, 12 nt, Homo sapiens
uggcuaauugca

SEQ ID NO: 1006554 - RNA, 18 nt, Homo sapiens
uggcuacacacaaaccag

SEQ ID NO: 1006555 - RNA, 19 nt, Homo sapiens
uggcuacacacaaaccagu

SEQ ID NO: 1006556 - RNA, 18 nt, Homo sapiens
uggcucacucagcacuug

SEQ ID NO: 1006557 - RNA, 13 nt, Homo sapiens
uggcucuacuucc

SEQ ID NO: 1006558 - RNA, 16 nt, Homo sapiens
uggcuggcuuguuuga

SEQ ID NO: 1006559 - RNA, 22 nt, Homo sapiens
uggcuggcuuguuugauuucaa

SEQ ID NO: 1006560 - RNA, 20 nt, Homo sapiens
uggcuggugugguacagaga

SEQ ID NO: 1006561 - RNA, 23 nt, Homo sapiens
ugggaaccccuuucccaccccaa

SEQ ID NO: 1006562 - RNA, 16 nt, Homo sapiens
ugggaagccgugcucg

SEQ ID NO: 1006563 - RNA, 15 nt, Homo sapiens
ugggaaugucucuuu

SEQ ID NO: 1006564 - RNA, 16 nt, Homo sapiens
ugggacagcaaccugu

SEQ ID NO: 1006565 - RNA, 14 nt, Homo sapiens
ugggacagcuugua

SEQ ID NO: 1006566 - RNA, 13 nt, Homo sapiens
ugggaccuaggga

SEQ ID NO: 1006567 - RNA, 23 nt, Homo sapiens
ugggacuacaggcgugagccacc

SEQ ID NO: 1006568 - RNA, 23 nt, Homo sapiens
ugggauuacaggcgugagccacc

SEQ ID NO: 1006569 - RNA, 17 nt, Homo sapiens
ugggauuugcccacgua

SEQ ID NO: 1006570 - RNA, 21 nt, Homo sapiens
ugggcaugagggguuccuccc

SEQ ID NO: 1006571 - RNA, 19 nt, Homo sapiens
ugggccugcugcugagaac

SEQ ID NO: 1006572 - RNA, 18 nt, Homo sapiens
ugggcuccuccagggugu

SEQ ID NO: 1006573 - RNA, 21 nt, Homo sapiens
ugggcugguaucucagaaagu

SEQ ID NO: 1006574 - RNA, 15 nt, Homo sapiens
uggggaagacagugg

SEQ ID NO: 1006575 - RNA, 13 nt, Homo sapiens
uggggacggugua

SEQ ID NO: 1006576 - RNA, 20 nt, Homo sapiens
uggggcagaaacacucaagu

SEQ ID NO: 1006577 - RNA, 13 nt, Homo sapiens
uggggccagucag

SEQ ID NO: 1006578 - RNA, 20 nt, Homo sapiens
uggggggaguaaagaauuau

SEQ ID NO: 1006579 - RNA, 20 nt, Homo sapiens
uggggggaugaggaccuccu

SEQ ID NO: 1006580 - RNA, 20 nt, Homo sapiens
ugggggguuuucuugccuug

SEQ ID NO: 1006581 - RNA, 17 nt, Homo sapiens
ugggguggccaccagua

SEQ ID NO: 1006582 - RNA, 16 nt, Homo sapiens
uggguggcucacucag

SEQ ID NO: 1006583 - RNA, 16 nt, Homo sapiens
ugggugggaguguuga

SEQ ID NO: 1006584 - RNA, 15 nt, Homo sapiens
uggguuuuuuaguug

SEQ ID NO: 1006585 - RNA, 19 nt, Homo sapiens
ugguaacugcuuucuguuc

SEQ ID NO: 1006586 - RNA, 19 nt, Homo sapiens
ugguacagagaagccagcu

SEQ ID NO: 1006587 - RNA, 20 nt, Homo sapiens
ugguacuccacauauuucag

SEQ ID NO: 1006588 - RNA, 16 nt, Homo sapiens
ucuucucaaguucuaa

SEQ ID NO: 1006589 - RNA, 23 nt, Homo sapiens
ucuucucaaguucuaagauucua

SEQ ID NO: 1006590 - RNA, 20 nt, Homo sapiens
ucuucuccuaaaacuuuaaa

SEQ ID NO: 1006591 - RNA, 21 nt, Homo sapiens
ucuugaaauuaagaaggcaaa

SEQ ID NO: 1006592 - RNA, 17 nt, Homo sapiens
ucuugaugcaugcacug

SEQ ID NO: 1006593 - RNA, 14 nt, Homo sapiens
ucuugcuaccagua

SEQ ID NO: 1006594 - RNA, 15 nt, Homo sapiens
ucuuggggaagauac

SEQ ID NO: 1006595 - RNA, 20 nt, Homo sapiens
ucuuguguuggcuguggcag

SEQ ID NO: 1006596 - RNA, 17 nt, Homo sapiens
ucuuguuccccacugac

SEQ ID NO: 1006597 - RNA, 14 nt, Homo sapiens
ucuuuagugucuga

SEQ ID NO: 1006598 - RNA, 12 nt, Homo sapiens
ucuuuaugaucu

SEQ ID NO: 1006599 - RNA, 13 nt, Homo sapiens
ucuuuaugaucug

SEQ ID NO: 1006600 - RNA, 14 nt, Homo sapiens
ucuuuccuggcacu

SEQ ID NO: 1006601 - RNA, 23 nt, Homo sapiens
ucuuuccuggcacuaacguugag

SEQ ID NO: 1006602 - RNA, 20 nt, Homo sapiens
ucuuucucugccagugacag

SEQ ID NO: 1006603 - RNA, 20 nt, Homo sapiens
ucuuugaacccuugcuugca

SEQ ID NO: 1006604 - RNA, 21 nt, Homo sapiens
ucuuuguaagaguggaaccaa

SEQ ID NO: 1006605 - RNA, 16 nt, Homo sapiens
ucuuuuacauucugca

SEQ ID NO: 1006606 - RNA, 21 nt, Homo sapiens
ucuuuucuggaauguaaucaa

SEQ ID NO: 1006607 - RNA, 18 nt, Homo sapiens
ucuuuucuucuauggggu

SEQ ID NO: 1006608 - RNA, 21 nt, Homo sapiens
ugaaaaaguuuggaagcacug

SEQ ID NO: 1006609 - RNA, 15 nt, Homo sapiens
ugaaaaaucauccaa

SEQ ID NO: 1006610 - RNA, 17 nt, Homo sapiens
ugaaaauaagaauuauu

SEQ ID NO: 1006611 - RNA, 14 nt, Homo sapiens
ugaaaauauagcua

SEQ ID NO: 1006612 - RNA, 19 nt, Homo sapiens
ugaaaauguccauuuacac

SEQ ID NO: 1006613 - RNA, 13 nt, Homo sapiens
ugaaaccuguaca

SEQ ID NO: 1006614 - RNA, 20 nt, Homo sapiens
ugaaacgucuaggaaaucua

SEQ ID NO: 1006615 - RNA, 16 nt, Homo sapiens
ugaaacguuuaugcuu

SEQ ID NO: 1006616 - RNA, 16 nt, Homo sapiens
ugaaagcaaguguuca

SEQ ID NO: 1006617 - RNA, 23 nt, Homo sapiens
ugaaaggagaugucuuggaacau

SEQ ID NO: 1006618 - RNA, 20 nt, Homo sapiens
ugaaaguaccaggugaacaa

SEQ ID NO: 1006619 - RNA, 15 nt, Homo sapiens
ugaaauucucaucag

SEQ ID NO: 1006620 - RNA, 12 nt, Homo sapiens
ugaaauugaacc

SEQ ID NO: 1006621 - RNA, 15 nt, Homo sapiens
ugaaauuuggcaaag

SEQ ID NO: 1006622 - RNA, 21 nt, Homo sapiens
ugaacacucuuuugcuuuauu

SEQ ID NO: 1006623 - RNA, 19 nt, Homo sapiens
ugaacagcugguguagcua

SEQ ID NO: 1006624 - RNA, 22 nt, Homo sapiens
ugaacccgaggcugagaaucag

SEQ ID NO: 1006625 - RNA, 19 nt, Homo sapiens
ugaacucuucacucuucaa

SEQ ID NO: 1006626 - RNA, 13 nt, Homo sapiens
ugaagacuaugaa

SEQ ID NO: 1006627 - RNA, 16 nt, Homo sapiens
ugaagagccacugcca

SEQ ID NO: 1006628 - RNA, 19 nt, Homo sapiens
ugaagaugggcuucaucca

SEQ ID NO: 1006629 - RNA, 19 nt, Homo sapiens
ugaagccaauucagacagg

SEQ ID NO: 1006630 - RNA, 13 nt, Homo sapiens
ugaagccacagca

SEQ ID NO: 1006631 - RNA, 21 nt, Homo sapiens
ugaaggccucuuguugagugc

SEQ ID NO: 1006632 - RNA, 12 nt, Homo sapiens
ugaaggccuuca

SEQ ID NO: 1006633 - RNA, 24 nt, Homo sapiens
ugaaggggaaccccggggugccca

SEQ ID NO: 1006634 - RNA, 14 nt, Homo sapiens
ugaaggggccauga

SEQ ID NO: 1006635 - RNA, 21 nt, Homo sapiens
ugaaguagaggacuaaccaug

SEQ ID NO: 1006636 - RNA, 23 nt, Homo sapiens
ugaagugaccuggaaucagugaa

SEQ ID NO: 1006637 - RNA, 17 nt, Homo sapiens
ugaauauugccauuaug

SEQ ID NO: 1006638 - RNA, 21 nt, Homo sapiens
ugaaucauuguauguggucau

SEQ ID NO: 1006639 - RNA, 16 nt, Homo sapiens
ugaaugagagguuccu

SEQ ID NO: 1006640 - RNA, 19 nt, Homo sapiens
ugaaugccuaugguggauc

SEQ ID NO: 1006641 - RNA, 22 nt, Homo sapiens
ugaaugucauugaaaaacuaaa

SEQ ID NO: 1006642 - RNA, 15 nt, Homo sapiens
ugaauuaagcccaau

SEQ ID NO: 1006643 - RNA, 16 nt, Homo sapiens
ugaauuuagugagcau

SEQ ID NO: 1006644 - RNA, 13 nt, Homo sapiens
ugaauuucacugu

SEQ ID NO: 1006645 - RNA, 18 nt, Homo sapiens
ugaauuuccucaucccuc

SEQ ID NO: 1006646 - RNA, 12 nt, Homo sapiens
ugacaagcacua

SEQ ID NO: 1006647 - RNA, 15 nt, Homo sapiens
ugacaaucaugugug

SEQ ID NO: 1006648 - RNA, 19 nt, Homo sapiens
ugacaauuuuuuccacuua

SEQ ID NO: 1006649 - RNA, 20 nt, Homo sapiens
ugacacucccuugggcuccc

SEQ ID NO: 1006650 - RNA, 17 nt, Homo sapiens
ugacaugcaucaucuca

SEQ ID NO: 1006651 - RNA, 21 nt, Homo sapiens
ugacauggagaccgugaccag

SEQ ID NO: 1006652 - RNA, 17 nt, Homo sapiens
ugacauugcguuugacc

SEQ ID NO: 1006653 - RNA, 20 nt, Homo sapiens
ugaccaagauacuuaagugc

SEQ ID NO: 1006654 - RNA, 17 nt, Homo sapiens
ugaccacagcacagcca

SEQ ID NO: 1006655 - RNA, 18 nt, Homo sapiens
ugaccacagcacagccaa

SEQ ID NO: 1006656 - RNA, 21 nt, Homo sapiens
ugaccacugaagcaccacagg

SEQ ID NO: 1006657 - RNA, 17 nt, Homo sapiens
ugaccaguugcagucac

SEQ ID NO: 1006658 - RNA, 20 nt, Homo sapiens
ugaccccaucaccuacucac

SEQ ID NO: 1006659 - RNA, 23 nt, Homo sapiens
ugaccuaaauuauuuacugcaaa

SEQ ID NO: 1006660 - RNA, 24 nt, Homo sapiens
ugacgccaggguaugaagaguguu

SEQ ID NO: 1006661 - RNA, 20 nt, Homo sapiens
ugacgucaucaucacauuca

SEQ ID NO: 1006662 - RNA, 21 nt, Homo sapiens
ugacuauucuugauguaaaau

SEQ ID NO: 1006663 - RNA, 16 nt, Homo sapiens
ugacucaagaagugaa

SEQ ID NO: 1006664 - RNA, 17 nt, Homo sapiens
ugacugggaccaggcac

SEQ ID NO: 1006665 - RNA, 17 nt, Homo sapiens
ugacuugugucccauga

SEQ ID NO: 1006666 - RNA, 18 nt, Homo sapiens
ugacuuuccccaccagau

SEQ ID NO: 1006667 - RNA, 19 nt, Homo sapiens
ugacuuuccccaccagaug

SEQ ID NO: 1006668 - RNA, 13 nt, Homo sapiens
ugagaaagcucaa

SEQ ID NO: 1006669 - RNA, 13 nt, Homo sapiens
ugagaacuggaca

SEQ ID NO: 1006670 - RNA, 15 nt, Homo sapiens
ugagaaucagacuga

SEQ ID NO: 1006671 - RNA, 17 nt, Homo sapiens
ugagaccacuguuauca

SEQ ID NO: 1006672 - RNA, 18 nt, Homo sapiens
ugagaccugaaggguuga

SEQ ID NO: 1006673 - RNA, 22 nt, Homo sapiens
ugagagcauugggauaucuccu

SEQ ID NO: 1006674 - RNA, 14 nt, Homo sapiens
ugagauacauacag

SEQ ID NO: 1006675 - RNA, 12 nt, Homo sapiens
aaaaaacagugg

SEQ ID NO: 1006676 - RNA, 21 nt, Homo sapiens
aaaaacagguauauacuuuga

SEQ ID NO: 1006677 - RNA, 17 nt, Homo sapiens
aaaaagaagcaaccuca

SEQ ID NO: 1006678 - RNA, 15 nt, Homo sapiens
aaaaagcaccaaagg

SEQ ID NO: 1006679 - RNA, 17 nt, Homo sapiens
aaaaagccaguuugggu

SEQ ID NO: 1006680 - RNA, 14 nt, Homo sapiens
aaaaaguauugcau

SEQ ID NO: 1006681 - RNA, 17 nt, Homo sapiens
aaaaagugaaauaaugu

SEQ ID NO: 1006682 - RNA, 15 nt, Homo sapiens
aaaaauagacacucc

SEQ ID NO: 1006683 - RNA, 12 nt, Homo sapiens
aaaaaugguacu

SEQ ID NO: 1006684 - RNA, 17 nt, Homo sapiens
aaaacaaaggccuaauu

SEQ ID NO: 1006685 - RNA, 13 nt, Homo sapiens
aaaacacugugca

SEQ ID NO: 1006686 - RNA, 14 nt, Homo sapiens
aaaacacugugcac

SEQ ID NO: 1006687 - RNA, 15 nt, Homo sapiens
aaaacacugugcaca

SEQ ID NO: 1006688 - RNA, 19 nt, Homo sapiens
aaaacagguauauacuuug

SEQ ID NO: 1006689 - RNA, 15 nt, Homo sapiens
aaaacaggucuucau

SEQ ID NO: 1006690 - RNA, 16 nt, Homo sapiens
aaaacuauuugggaua

SEQ ID NO: 1006691 - RNA, 16 nt, Homo sapiens
aaaacugcauuucacu

SEQ ID NO: 1006692 - RNA, 21 nt, Homo sapiens
aaaacuuuggaguccccucac

SEQ ID NO: 1006693 - RNA, 14 nt, Homo sapiens
aaaagcaaguucgu

SEQ ID NO: 1006694 - RNA, 13 nt, Homo sapiens
aaaagcaccaaag

SEQ ID NO: 1006695 - RNA, 20 nt, Homo sapiens
aaaaggacucucaggaccaa

SEQ ID NO: 1006696 - RNA, 14 nt, Homo sapiens
aaaaguggcauuuc

SEQ ID NO: 1006697 - RNA, 19 nt, Homo sapiens
aaaaguuccaagagucuaa

SEQ ID NO: 1006698 - RNA, 22 nt, Homo sapiens
aaaauaaauauaucuaccccag

SEQ ID NO: 1006699 - RNA, 13 nt, Homo sapiens
aaaauacaugaca

SEQ ID NO: 1006700 - RNA, 19 nt, Homo sapiens
aaaauacuuuuacucugcc

SEQ ID NO: 1006701 - RNA, 12 nt, Homo sapiens
aaaauaugccuu

SEQ ID NO: 1006702 - RNA, 11 nt, Homo sapiens
aaaaugaagga

SEQ ID NO: 1006703 - RNA, 13 nt, Homo sapiens
aaaauguaugcau

SEQ ID NO: 1006704 - RNA, 14 nt, Homo sapiens
aaaaugucaucuca

SEQ ID NO: 1006705 - RNA, 22 nt, Homo sapiens
aaaauguccuugugaugugcac

SEQ ID NO: 1006706 - RNA, 17 nt, Homo sapiens
aaaauugugaucagacc

SEQ ID NO: 1006707 - RNA, 15 nt, Homo sapiens
aaaauuucaccugca

SEQ ID NO: 1006708 - RNA, 11 nt, Homo sapiens
aaacaaaauac

SEQ ID NO: 1006709 - RNA, 13 nt, Homo sapiens
aaacaaacccagg

SEQ ID NO: 1006710 - RNA, 15 nt, Homo sapiens
aaacaaacucauuca

SEQ ID NO: 1006711 - RNA, 14 nt, Homo sapiens
aaacaccuccucau

SEQ ID NO: 1006712 - RNA, 13 nt, Homo sapiens
aaacacuugcaac

SEQ ID NO: 1006713 - RNA, 14 nt, Homo sapiens
aaacagaagccuga

SEQ ID NO: 1006714 - RNA, 15 nt, Homo sapiens
aaacagaccccuguu

SEQ ID NO: 1006715 - RNA, 19 nt, Homo sapiens
aaacagauggcacuuugaa

SEQ ID NO: 1006716 - RNA, 18 nt, Homo sapiens
aaacagguauauacuuug

SEQ ID NO: 1006717 - RNA, 21 nt, Homo sapiens
aaacagguuauaacaguguuu

SEQ ID NO: 1006718 - RNA, 20 nt, Homo sapiens
aaacagugcaaggaagggca

SEQ ID NO: 1006719 - RNA, 13 nt, Homo sapiens
aaacccaauccaa

SEQ ID NO: 1006720 - RNA, 19 nt, Homo sapiens
aaacccauucccucuccag

SEQ ID NO: 1006721 - RNA, 16 nt, Homo sapiens
aaacccuuauacucac

SEQ ID NO: 1006722 - RNA, 18 nt, Homo sapiens
aaaccuuggccucugcua

SEQ ID NO: 1006723 - RNA, 13 nt, Homo sapiens
aaaccuuugcaaa

SEQ ID NO: 1006724 - RNA, 13 nt, Homo sapiens
aaacgagacuuuc

SEQ ID NO: 1006725 - RNA, 22 nt, Homo sapiens
aaacgucgauucgcaccgucca

SEQ ID NO: 1006726 - RNA, 14 nt, Homo sapiens
aaacgucuaggaaa

SEQ ID NO: 1006727 - RNA, 20 nt, Homo sapiens
aaacgucuucuaaacuuccc

SEQ ID NO: 1006728 - RNA, 17 nt, Homo sapiens
aaacuaaacucuuacca

SEQ ID NO: 1006729 - RNA, 18 nt, Homo sapiens
aaacuauguaacauguag

SEQ ID NO: 1006730 - RNA, 15 nt, Homo sapiens
aaacuauuugggaua

SEQ ID NO: 1006731 - RNA, 13 nt, Homo sapiens
aaacucagugcaa

SEQ ID NO: 1006732 - RNA, 16 nt, Homo sapiens
aaacuccagaugccac

SEQ ID NO: 1006733 - RNA, 11 nt, Homo sapiens
aaacucuguca

SEQ ID NO: 1006734 - RNA, 19 nt, Homo sapiens
aaacuguuccaaucaugaa

SEQ ID NO: 1006735 - RNA, 13 nt, Homo sapiens
aaacuucaaagag

SEQ ID NO: 1006736 - RNA, 18 nt, Homo sapiens
aaacuuuggaaccagacu

SEQ ID NO: 1006737 - RNA, 13 nt, Homo sapiens
aaagaaccacuug

SEQ ID NO: 1006738 - RNA, 17 nt, Homo sapiens
aaagaacguggucagag

SEQ ID NO: 1006739 - RNA, 21 nt, Homo sapiens
aaagagaagcaaaaucuacca

SEQ ID NO: 1006740 - RNA, 23 nt, Homo sapiens
aaccucaguaauuuagaaaucau

SEQ ID NO: 1006741 - RNA, 14 nt, Homo sapiens
aaccuccuaagcaa

SEQ ID NO: 1006742 - RNA, 13 nt, Homo sapiens
aaccugcucuccu

SEQ ID NO: 1006743 - RNA, 15 nt, Homo sapiens
aacguugacaaguuu

SEQ ID NO: 1006744 - RNA, 17 nt, Homo sapiens
aacuaaaaggaagucau

SEQ ID NO: 1006745 - RNA, 17 nt, Homo sapiens
aacuaagaaauaugcac

SEQ ID NO: 1006746 - RNA, 14 nt, Homo sapiens
aacuacuguguuau

SEQ ID NO: 1006747 - RNA, 15 nt, Homo sapiens
aacuaggaaaaucac

SEQ ID NO: 1006748 - RNA, 21 nt, Homo sapiens
aacuaggaaaaucacuugcca

SEQ ID NO: 1006749 - RNA, 16 nt, Homo sapiens
aacuauguaacaugua

SEQ ID NO: 1006750 - RNA, 19 nt, Homo sapiens
aacuauuuucaaagacuua

SEQ ID NO: 1006751 - RNA, 23 nt, Homo sapiens
aacucaaauggggccagauccag

SEQ ID NO: 1006752 - RNA, 17 nt, Homo sapiens
aacucaguuucuaggca

SEQ ID NO: 1006753 - RNA, 15 nt, Homo sapiens
aacucauuugcucua

SEQ ID NO: 1006754 - RNA, 15 nt, Homo sapiens
aacucuaugaacuua

SEQ ID NO: 1006755 - RNA, 22 nt, Homo sapiens
aacugcauucuucugagcacug

SEQ ID NO: 1006756 - RNA, 21 nt, Homo sapiens
aacugcccaaagcagcacuua

SEQ ID NO: 1006757 - RNA, 17 nt, Homo sapiens
aacuguacagugucuuu

SEQ ID NO: 1006758 - RNA, 17 nt, Homo sapiens
aacugucaccugaaaua

SEQ ID NO: 1006759 - RNA, 14 nt, Homo sapiens
aacuugacccccuu

SEQ ID NO: 1006760 - RNA, 12 nt, Homo sapiens
aacuuggcugca

SEQ ID NO: 1006761 - RNA, 17 nt, Homo sapiens
aacuuuguaguaugaua

SEQ ID NO: 1006762 - RNA, 13 nt, Homo sapiens
aagaaacauuuau

SEQ ID NO: 1006763 - RNA, 14 nt, Homo sapiens
aagaaagaucaaag

SEQ ID NO: 1006764 - RNA, 12 nt, Homo sapiens
aagaaaguguau

SEQ ID NO: 1006765 - RNA, 17 nt, Homo sapiens
aagaaauacagacugga

SEQ ID NO: 1006766 - RNA, 12 nt, Homo sapiens
aagaacauguga

SEQ ID NO: 1006767 - RNA, 11 nt, Homo sapiens
aagaaccacuu

SEQ ID NO: 1006768 - RNA, 16 nt, Homo sapiens
aagaacugaagcucuu

SEQ ID NO: 1006769 - RNA, 11 nt, Homo sapiens
aagaaggguug

SEQ ID NO: 1006770 - RNA, 17 nt, Homo sapiens
aagaauagcugcuuccg

SEQ ID NO: 1006771 - RNA, 14 nt, Homo sapiens
aagaauagcuuuaa

SEQ ID NO: 1006772 - RNA, 15 nt, Homo sapiens
aagacaaacuuugca

SEQ ID NO: 1006773 - RNA, 13 nt, Homo sapiens
aagacccauuccu

SEQ ID NO: 1006774 - RNA, 14 nt, Homo sapiens
uacuuaaugcauau

SEQ ID NO: 1006775 - RNA, 16 nt, Homo sapiens
uacuucaagaucugaa

SEQ ID NO: 1006776 - RNA, 23 nt, Homo sapiens
uacuucucacuaauuuguaggaa

SEQ ID NO: 1006777 - RNA, 16 nt, Homo sapiens
uacuuuuacucugccu

SEQ ID NO: 1006778 - RNA, 17 nt, Homo sapiens
uacuuuugauccugggg

SEQ ID NO: 1006779 - RNA, 20 nt, Homo sapiens
ucuaccucaggcagcucaag

SEQ ID NO: 1006780 - RNA, 20 nt, Homo sapiens
ucuacuacaaacuucaaaga

SEQ ID NO: 1006781 - RNA, 15 nt, Homo sapiens
ucuacugaaugucau

SEQ ID NO: 1006782 - RNA, 19 nt, Homo sapiens
ucuacugaaugucauugaa

SEQ ID NO: 1006783 - RNA, 19 nt, Homo sapiens
ucuacugcaauguaaauag

SEQ ID NO: 1006784 - RNA, 19 nt, Homo sapiens
ucuacuuccccauggcccu

SEQ ID NO: 1006785 - RNA, 13 nt, Homo sapiens
ucuagaacuugac

SEQ ID NO: 1006786 - RNA, 19 nt, Homo sapiens
ucuagacuauuaggugcaa

SEQ ID NO: 1006787 - RNA, 18 nt, Homo sapiens
ucuagaguucagaguccu

SEQ ID NO: 1006788 - RNA, 15 nt, Homo sapiens
ucuagcugugggggu

SEQ ID NO: 1006789 - RNA, 12 nt, Homo sapiens
ucuaggauuuua

SEQ ID NO: 1006790 - RNA, 16 nt, Homo sapiens
ucuaggucacuucuca

SEQ ID NO: 1006791 - RNA, 20 nt, Homo sapiens
ucuagguccccauacuccua

SEQ ID NO: 1006792 - RNA, 14 nt, Homo sapiens
ucuauaaggccaua

SEQ ID NO: 1006793 - RNA, 14 nt, Homo sapiens
ucuauaauuuaccu

SEQ ID NO: 1006794 - RNA, 13 nt, Homo sapiens
ucuaugccuuuag

SEQ ID NO: 1006795 - RNA, 16 nt, Homo sapiens
ucucaaacuacuggca

SEQ ID NO: 1006796 - RNA, 20 nt, Homo sapiens
ucucacccucaucacuagga

SEQ ID NO: 1006797 - RNA, 15 nt, Homo sapiens
ucucacuauaccagu

SEQ ID NO: 1006798 - RNA, 21 nt, Homo sapiens
ucucagaaagugccugacaca

SEQ ID NO: 1006799 - RNA, 15 nt, Homo sapiens
ucucagguguugcca

SEQ ID NO: 1006800 - RNA, 19 nt, Homo sapiens
ucucaguaugaauuauuca

SEQ ID NO: 1006801 - RNA, 15 nt, Homo sapiens
ucucaguucuugagg

SEQ ID NO: 1006802 - RNA, 21 nt, Homo sapiens
ucucauaccuuccccacaucu

SEQ ID NO: 1006803 - RNA, 16 nt, Homo sapiens
ucucaucaguccauug

SEQ ID NO: 1006804 - RNA, 21 nt, Homo sapiens
ucucaugccaguaacaggcuc

SEQ ID NO: 1006805 - RNA, 18 nt, Homo sapiens
ucuccaacaccaccucuc

SEQ ID NO: 1006806 - RNA, 18 nt, Homo sapiens
ucuccccagcccagagac

SEQ ID NO: 1006807 - RNA, 18 nt, Homo sapiens
ucucccuugggcucugau

SEQ ID NO: 1006808 - RNA, 21 nt, Homo sapiens
ucucccuugggcucugaugaa

SEQ ID NO: 1006809 - RNA, 18 nt, Homo sapiens
ucuccuacuaugcaauuu

SEQ ID NO: 1006810 - RNA, 18 nt, Homo sapiens
ucuccuccaacccaaccu

SEQ ID NO: 1006811 - RNA, 15 nt, Homo sapiens
ucuccuggcuuccca

SEQ ID NO: 1006812 - RNA, 18 nt, Homo sapiens
ucucgcuuuguugcccag

SEQ ID NO: 1006813 - RNA, 13 nt, Homo sapiens
ucucggccuucac

SEQ ID NO: 1006814 - RNA, 20 nt, Homo sapiens
ucucggcucacugcaaccuc

SEQ ID NO: 1006815 - RNA, 14 nt, Homo sapiens
ucucuacagucucg

SEQ ID NO: 1006816 - RNA, 18 nt, Homo sapiens
ucucucaacaccaugauu

SEQ ID NO: 1006817 - RNA, 14 nt, Homo sapiens
ucucucuguuuauc

SEQ ID NO: 1006818 - RNA, 16 nt, Homo sapiens
ucucucuucucuccag

SEQ ID NO: 1006819 - RNA, 14 nt, Homo sapiens
ucucugagcaguga

SEQ ID NO: 1006820 - RNA, 12 nt, Homo sapiens
ucucugccagug

SEQ ID NO: 1006821 - RNA, 12 nt, Homo sapiens
ucucugcucugc

SEQ ID NO: 1006822 - RNA, 14 nt, Homo sapiens
ucucuguugucgua

SEQ ID NO: 1006823 - RNA, 18 nt, Homo sapiens
ucucuugccucaaccucc

SEQ ID NO: 1006824 - RNA, 18 nt, Homo sapiens
ucugaaacucacacaacu

SEQ ID NO: 1006825 - RNA, 16 nt, Homo sapiens
ucugaacagcuggugu

SEQ ID NO: 1006826 - RNA, 21 nt, Homo sapiens
ucugaauaaaguguaacaauu

SEQ ID NO: 1006827 - RNA, 21 nt, Homo sapiens
ucugacuuucuuuuuugauau

SEQ ID NO: 1006828 - RNA, 19 nt, Homo sapiens
ucugagacuccagaccuga

SEQ ID NO: 1006829 - RNA, 13 nt, Homo sapiens
ucugagcacuguu

SEQ ID NO: 1006830 - RNA, 14 nt, Homo sapiens
ucugagcugugcag

SEQ ID NO: 1006831 - RNA, 21 nt, Homo sapiens
ucugcaggcuucagccaucca

SEQ ID NO: 1006832 - RNA, 22 nt, Homo sapiens
ucugcauggaacagcauuaccc

SEQ ID NO: 1006833 - RNA, 14 nt, Homo sapiens
ucugcucaucauuc

SEQ ID NO: 1006834 - RNA, 19 nt, Homo sapiens
ucugcuccagacagggaau

SEQ ID NO: 1006835 - RNA, 23 nt, Homo sapiens
ucugcucuuucucugccagugac

SEQ ID NO: 1006836 - RNA, 12 nt, Homo sapiens
ucugcuguagaa

SEQ ID NO: 1006837 - RNA, 13 nt, Homo sapiens
ucugcuuugcucu

SEQ ID NO: 1006838 - RNA, 17 nt, Homo sapiens
ucugcuuuucccauugc

SEQ ID NO: 1006839 - RNA, 15 nt, Homo sapiens
ucuggaccucugggu

SEQ ID NO: 1006840 - RNA, 20 nt, Homo sapiens
ucuggaggacggucagucca

SEQ ID NO: 1006841 - RNA, 21 nt, Homo sapiens
ucuggaggacggucaguccau

SEQ ID NO: 1006842 - RNA, 22 nt, Homo sapiens
ucuggauaacaagacuuugacu

SEQ ID NO: 1006843 - RNA, 14 nt, Homo sapiens
ucuggcucuugagg

SEQ ID NO: 1006844 - RNA, 19 nt, Homo sapiens
ucuggcucuugaggcauuu

SEQ ID NO: 1006845 - RNA, 19 nt, Homo sapiens
ucugggaaucaacagcaua

SEQ ID NO: 1006846 - RNA, 13 nt, Homo sapiens
ucuguaacuguca

SEQ ID NO: 1006847 - RNA, 13 nt, Homo sapiens
ucuguagggauuu

SEQ ID NO: 1006848 - RNA, 19 nt, Homo sapiens
ucuguagguugcacacuuu

SEQ ID NO: 1006849 - RNA, 17 nt, Homo sapiens
ucuguagugcuacaggg

SEQ ID NO: 1006850 - RNA, 14 nt, Homo sapiens
ucugucagcugcaa

SEQ ID NO: 1006851 - RNA, 22 nt, Homo sapiens
ucuguggcaaaaguuuaaucag

SEQ ID NO: 1006852 - RNA, 18 nt, Homo sapiens
ucugugugugauuugcua

SEQ ID NO: 1006853 - RNA, 15 nt, Homo sapiens
ucuguguuaggggua

SEQ ID NO: 1006854 - RNA, 17 nt, Homo sapiens
ucuguucaaagcugccu

SEQ ID NO: 1006855 - RNA, 12 nt, Homo sapiens
ucuguugauuga

SEQ ID NO: 1006856 - RNA, 22 nt, Homo sapiens
ucuguuggcaggcuggccaguc

SEQ ID NO: 1006857 - RNA, 21 nt, Homo sapiens
ucuguugucguaaagauuugg

SEQ ID NO: 1006858 - RNA, 14 nt, Homo sapiens
ucuguuuacugcaa

SEQ ID NO: 1006859 - RNA, 21 nt, Homo sapiens
ucuguuuccuggucagcaugu

SEQ ID NO: 1006860 - RNA, 22 nt, Homo sapiens
ucuguuucuuaagggcacacac

SEQ ID NO: 1006861 - RNA, 22 nt, Homo sapiens
ucuguuugcuguggaacuacau

SEQ ID NO: 1006862 - RNA, 17 nt, Homo sapiens
ucuguuuugaaggcaaa

SEQ ID NO: 1006863 - RNA, 14 nt, Homo sapiens
ucuguuuuuagacc

SEQ ID NO: 1006864 - RNA, 21 nt, Homo sapiens
ucuguuuuuucagucugugaa

SEQ ID NO: 1006865 - RNA, 16 nt, Homo sapiens
ucuuaacuucuugcuu

SEQ ID NO: 1006866 - RNA, 18 nt, Homo sapiens
ucuuaauugccaccucua

SEQ ID NO: 1006867 - RNA, 22 nt, Homo sapiens
gcuggucccggggccagcacuu

SEQ ID NO: 1006868 - RNA, 23 nt, Homo sapiens
gcuggucccggggccagcacuuc

SEQ ID NO: 1006869 - RNA, 23 nt, Homo sapiens
gcuguauagcugcuuccagugua

SEQ ID NO: 1006870 - RNA, 13 nt, Homo sapiens
gcugucaggauug

SEQ ID NO: 1006871 - RNA, 16 nt, Homo sapiens
gcugucaucugugcac

SEQ ID NO: 1006872 - RNA, 21 nt, Homo sapiens
gcugucuggguggcucacuca

SEQ ID NO: 1006873 - RNA, 18 nt, Homo sapiens
gcuguggcagaguuacag

SEQ ID NO: 1006874 - RNA, 13 nt, Homo sapiens
gcuguuccagugg

SEQ ID NO: 1006875 - RNA, 13 nt, Homo sapiens
gcuguuuuagaca

SEQ ID NO: 1006876 - RNA, 13 nt, Homo sapiens
gcuuaaaauaagc

SEQ ID NO: 1006877 - RNA, 13 nt, Homo sapiens
gcuuaccccuuca

SEQ ID NO: 1006878 - RNA, 18 nt, Homo sapiens
gcuuaccuacauacgugu

SEQ ID NO: 1006879 - RNA, 15 nt, Homo sapiens
gcuuaccugaucuca

SEQ ID NO: 1006880 - RNA, 14 nt, Homo sapiens
gcuuagauuucaua

SEQ ID NO: 1006881 - RNA, 16 nt, Homo sapiens
gcuuagugcacaagca

SEQ ID NO: 1006882 - RNA, 18 nt, Homo sapiens
gcuuauaucuggccucug

SEQ ID NO: 1006883 - RNA, 23 nt, Homo sapiens
gcuuaugaaaccuguacauaugu

SEQ ID NO: 1006884 - RNA, 15 nt, Homo sapiens
gcuuccaugauucua

SEQ ID NO: 1006885 - RNA, 18 nt, Homo sapiens
gcuucuauaauuuugccu

SEQ ID NO: 1006886 - RNA, 19 nt, Homo sapiens
gcuuguuuacaugcuuauu

SEQ ID NO: 1006887 - RNA, 18 nt, Homo sapiens
gcuuuagaaacagugcaa

SEQ ID NO: 1006888 - RNA, 20 nt, Homo sapiens
gcuuuagaaacagugcaaca

SEQ ID NO: 1006889 - RNA, 20 nt, Homo sapiens
gcuuuauuccagaaugcugu

SEQ ID NO: 1006890 - RNA, 20 nt, Homo sapiens
gcuuucauguaaacugugca

SEQ ID NO: 1006891 - RNA, 20 nt, Homo sapiens
gcuuuggugagaaccugggu

SEQ ID NO: 1006892 - RNA, 13 nt, Homo sapiens
gcuuugguuuaaa

SEQ ID NO: 1006893 - RNA, 14 nt, Homo sapiens
gcuuuguugcccag

SEQ ID NO: 1006894 - RNA, 22 nt, Homo sapiens
ggaaaacaggaacccaccaaac

SEQ ID NO: 1006895 - RNA, 16 nt, Homo sapiens
ggaaaagcauguuaug

SEQ ID NO: 1006896 - RNA, 22 nt, Homo sapiens
ggaaaauaauacugcugagaua

SEQ ID NO: 1006897 - RNA, 21 nt, Homo sapiens
ggaaagggagacgcccuuuca

SEQ ID NO: 1006898 - RNA, 17 nt, Homo sapiens
ggaaaggugguguuucu

SEQ ID NO: 1006899 - RNA, 14 nt, Homo sapiens
ggaaagugggacag

SEQ ID NO: 1006900 - RNA, 15 nt, Homo sapiens
ggaaauuaagacuuu

SEQ ID NO: 1006901 - RNA, 16 nt, Homo sapiens
ggaacaaaagcgaaac

SEQ ID NO: 1006902 - RNA, 14 nt, Homo sapiens
ggaacagugugcaa

SEQ ID NO: 1006903 - RNA, 15 nt, Homo sapiens
ggaacccaccaaacc

SEQ ID NO: 1006904 - RNA, 16 nt, Homo sapiens
ggaacccagacucaga

SEQ ID NO: 1006905 - RNA, 18 nt, Homo sapiens
ggaacccagacucagaca

SEQ ID NO: 1006906 - RNA, 20 nt, Homo sapiens
ggaaccucagccuggccaga

SEQ ID NO: 1006907 - RNA, 18 nt, Homo sapiens
ggaacuggaggcagggaa

SEQ ID NO: 1006908 - RNA, 22 nt, Homo sapiens
ggaagacgccuuucuccuccaa

SEQ ID NO: 1006909 - RNA, 17 nt, Homo sapiens
ggaagagggugauugcu

SEQ ID NO: 1006910 - RNA, 15 nt, Homo sapiens
ggaagguuaucagug

SEQ ID NO: 1006911 - RNA, 12 nt, Homo sapiens
ggaaucagagag

SEQ ID NO: 1006912 - RNA, 22 nt, Homo sapiens
ggacaaaaccccccagauauca

SEQ ID NO: 1006913 - RNA, 15 nt, Homo sapiens
ggacaaaccuugaaa

SEQ ID NO: 1006914 - RNA, 21 nt, Homo sapiens
ggacaagacccccagcacuug

SEQ ID NO: 1006915 - RNA, 16 nt, Homo sapiens
ggacagcaacuaucag

SEQ ID NO: 1006916 - RNA, 17 nt, Homo sapiens
ggacaggacuaacacuc

SEQ ID NO: 1006917 - RNA, 16 nt, Homo sapiens
ggaccaggagugggug

SEQ ID NO: 1006918 - RNA, 14 nt, Homo sapiens
ggaccucaguuuua

SEQ ID NO: 1006919 - RNA, 15 nt, Homo sapiens
ggaccugagaccuga

SEQ ID NO: 1006920 - RNA, 22 nt, Homo sapiens
ggacucugcagccucagagaca

SEQ ID NO: 1006921 - RNA, 15 nt, Homo sapiens
ggacuuccauuugcu

SEQ ID NO: 1006922 - RNA, 19 nt, Homo sapiens
ggagaaagcugacuuggcu

SEQ ID NO: 1006923 - RNA, 18 nt, Homo sapiens
ggagaagaaagaggugac

SEQ ID NO: 1006924 - RNA, 18 nt, Homo sapiens
ggagacugugugugcccu

SEQ ID NO: 1006925 - RNA, 15 nt, Homo sapiens
ggagauguccugaau

SEQ ID NO: 1006926 - RNA, 16 nt, Homo sapiens
ggaggaccugagccug

SEQ ID NO: 1006927 - RNA, 16 nt, Homo sapiens
ggaggagggaggcgcu

SEQ ID NO: 1006928 - RNA, 20 nt, Homo sapiens
ggaggcgcugcugguguucu

SEQ ID NO: 1006929 - RNA, 21 nt, Homo sapiens
ggaggcuccagagggcacucu

SEQ ID NO: 1006930 - RNA, 17 nt, Homo sapiens
ggagggaagggagccaa

SEQ ID NO: 1006931 - RNA, 13 nt, Homo sapiens
ggagggacaagug

SEQ ID NO: 1006932 - RNA, 21 nt, Homo sapiens
ggagggcugucaucugugcac

SEQ ID NO: 1006933 - RNA, 20 nt, Homo sapiens
ggagggugguucaacaaaga

SEQ ID NO: 1006934 - RNA, 22 nt, Homo sapiens
ggaguaacaauacaaauggauu

SEQ ID NO: 1006935 - RNA, 14 nt, Homo sapiens
ggagucacacagug

SEQ ID NO: 1006936 - RNA, 20 nt, Homo sapiens
ggagucacucuuaugcugua

SEQ ID NO: 1006937 - RNA, 17 nt, Homo sapiens
ggauaaccuugugccuu

SEQ ID NO: 1006938 - RNA, 16 nt, Homo sapiens
ggauagagacuggaac

SEQ ID NO: 1006939 - RNA, 17 nt, Homo sapiens
ggauauuuuuuacuuua

SEQ ID NO: 1006940 - RNA, 11 nt, Homo sapiens
ggaugacauua

SEQ ID NO: 1006941 - RNA, 21 nt, Homo sapiens
ggaugagggaaaagaaaaaga

SEQ ID NO: 1006942 - RNA, 19 nt, Homo sapiens
ggauguugaacuggucauu

SEQ ID NO: 1006943 - RNA, 23 nt, Homo sapiens
ggauuccccaucucaggccagag

SEQ ID NO: 1006944 - RNA, 14 nt, Homo sapiens
ggauuuuucuuuaa

SEQ ID NO: 1006945 - RNA, 14 nt, Homo sapiens
ggcaaggaugucug

SEQ ID NO: 1006946 - RNA, 12 nt, Homo sapiens
ggcaccagacac

SEQ ID NO: 1006947 - RNA, 16 nt, Homo sapiens
ggcacugagaccucca

SEQ ID NO: 1006948 - RNA, 22 nt, Homo sapiens
ggcagagccaccugacucuugc

SEQ ID NO: 1006949 - RNA, 22 nt, Homo sapiens
ggcagccacacuucucaggaca

SEQ ID NO: 1006950 - RNA, 15 nt, Homo sapiens
ggcagggaacauggg

SEQ ID NO: 1006951 - RNA, 12 nt, Homo sapiens
gccucaaccucc

SEQ ID NO: 1006952 - RNA, 13 nt, Homo sapiens
gccucaaugccag

SEQ ID NO: 1006953 - RNA, 20 nt, Homo sapiens
gccuccaccuccuaggcuca

SEQ ID NO: 1006954 - RNA, 22 nt, Homo sapiens
gccuccagccgccggcugugca

SEQ ID NO: 1006955 - RNA, 21 nt, Homo sapiens
gccuccaugggccccagggga

SEQ ID NO: 1006956 - RNA, 19 nt, Homo sapiens
gccucccacccccaucucu

SEQ ID NO: 1006957 - RNA, 16 nt, Homo sapiens
gccucccauccagggc

SEQ ID NO: 1006958 - RNA, 18 nt, Homo sapiens
gccucccuuguggcagca

SEQ ID NO: 1006959 - RNA, 20 nt, Homo sapiens
gccuccuccagaauggagcu

SEQ ID NO: 1006960 - RNA, 20 nt, Homo sapiens
gccuccugugacuggcagca

SEQ ID NO: 1006961 - RNA, 21 nt, Homo sapiens
gccucugaucguaggaauuga

SEQ ID NO: 1006962 - RNA, 10 nt, Homo sapiens
gccucugugc

SEQ ID NO: 1006963 - RNA, 19 nt, Homo sapiens
gccucuuguugagugccag

SEQ ID NO: 1006964 - RNA, 16 nt, Homo sapiens
gccugacaaccacugg

SEQ ID NO: 1006965 - RNA, 20 nt, Homo sapiens
gccugagcaacucuugauua

SEQ ID NO: 1006966 - RNA, 17 nt, Homo sapiens
gccugagguuugccagc

SEQ ID NO: 1006967 - RNA, 22 nt, Homo sapiens
gccugaucagcgccgcaccagc

SEQ ID NO: 1006968 - RNA, 14 nt, Homo sapiens
gccugaugcugaca

SEQ ID NO: 1006969 - RNA, 20 nt, Homo sapiens
gccugcagggccucugucaa

SEQ ID NO: 1006970 - RNA, 13 nt, Homo sapiens
gccugcugcugag

SEQ ID NO: 1006971 - RNA, 22 nt, Homo sapiens
gccugcuuggggggugaugagg

SEQ ID NO: 1006972 - RNA, 15 nt, Homo sapiens
gccuggacuuuccug

SEQ ID NO: 1006973 - RNA, 17 nt, Homo sapiens
gccuggacuuuccugca

SEQ ID NO: 1006974 - RNA, 21 nt, Homo sapiens
gccuggagaaggugacagucc

SEQ ID NO: 1006975 - RNA, 16 nt, Homo sapiens
gccuggccagugcccu

SEQ ID NO: 1006976 - RNA, 23 nt, Homo sapiens
gccuguaaacuuuaucacuuaaa

SEQ ID NO: 1006977 - RNA, 21 nt, Homo sapiens
gccugucuuaauuuucuuuca

SEQ ID NO: 1006978 - RNA, 14 nt, Homo sapiens
gccugucuucagag

SEQ ID NO: 1006979 - RNA, 13 nt, Homo sapiens
gccugugccaggu

SEQ ID NO: 1006980 - RNA, 15 nt, Homo sapiens
gccugugccagguga

SEQ ID NO: 1006981 - RNA, 17 nt, Homo sapiens
gccuguucauggcagau

SEQ ID NO: 1006982 - RNA, 18 nt, Homo sapiens
gccuuagucucaguuugu

SEQ ID NO: 1006983 - RNA, 18 nt, Homo sapiens
gccuuccagaaaacaaaa

SEQ ID NO: 1006984 - RNA, 17 nt, Homo sapiens
gccuuuauuuccacugu

SEQ ID NO: 1006985 - RNA, 16 nt, Homo sapiens
gccuuugccaggugac

SEQ ID NO: 1006986 - RNA, 13 nt, Homo sapiens
gccuuuuuguaua

SEQ ID NO: 1006987 - RNA, 17 nt, Homo sapiens
gcgaaaaaaucagugaa

SEQ ID NO: 1006988 - RNA, 17 nt, Homo sapiens
gcgaccuccuuucauca

SEQ ID NO: 1006989 - RNA, 15 nt, Homo sapiens
gcgaugacacuugua

SEQ ID NO: 1006990 - RNA, 22 nt, Homo sapiens
gcgcaguguggaggccacuguu

SEQ ID NO: 1006991 - RNA, 20 nt, Homo sapiens
gcgcgugaguggucuucaaa

SEQ ID NO: 1006992 - RNA, 22 nt, Homo sapiens
gcggaccccucgucaucaggug

SEQ ID NO: 1006993 - RNA, 19 nt, Homo sapiens
gcggccuccuucugagcuc

SEQ ID NO: 1006994 - RNA, 16 nt, Homo sapiens
gcgugaccagcaguac

SEQ ID NO: 1006995 - RNA, 21 nt, Homo sapiens
gcguuuguaaugagagcacuu

SEQ ID NO: 1006996 - RNA, 21 nt, Homo sapiens
gcuaaggggaucggacaugaa

SEQ ID NO: 1006997 - RNA, 14 nt, Homo sapiens
gcuaccaguauuua

SEQ ID NO: 1006998 - RNA, 22 nt, Homo sapiens
gcuacugacuauggcuaccaaa

SEQ ID NO: 1006999 - RNA, 20 nt, Homo sapiens
gcuacugccgucagugcugu

SEQ ID NO: 1007000 - RNA, 15 nt, Homo sapiens
gcuagagugacucac

SEQ ID NO: 1007001 - RNA, 13 nt, Homo sapiens
gcuaggagcaaag

SEQ ID NO: 1007002 - RNA, 22 nt, Homo sapiens
gcuaggcaugguggacucgccu

SEQ ID NO: 1007003 - RNA, 19 nt, Homo sapiens
gcuauuucuucuacugcua

SEQ ID NO: 1007004 - RNA, 20 nt, Homo sapiens
gcuauuucuucuacugcuau

SEQ ID NO: 1007005 - RNA, 22 nt, Homo sapiens
gcucaacucucuuauugccuca

SEQ ID NO: 1007006 - RNA, 13 nt, Homo sapiens
gcucacucagcca

SEQ ID NO: 1007007 - RNA, 16 nt, Homo sapiens
gcucacugcaaccucc

SEQ ID NO: 1007008 - RNA, 17 nt, Homo sapiens
gcucacugcaaccucca

SEQ ID NO: 1007009 - RNA, 17 nt, Homo sapiens
gcucagauuguaauaug

SEQ ID NO: 1007010 - RNA, 13 nt, Homo sapiens
gcucagcccugag

SEQ ID NO: 1007011 - RNA, 19 nt, Homo sapiens
gcucaggacagaugccaca

SEQ ID NO: 1007012 - RNA, 16 nt, Homo sapiens
gcucaggaugagggaa

SEQ ID NO: 1007013 - RNA, 13 nt, Homo sapiens
gcucagggaccau

SEQ ID NO: 1007014 - RNA, 22 nt, Homo sapiens
gcucauuuuuucuucuccuaaa

SEQ ID NO: 1007015 - RNA, 16 nt, Homo sapiens
gcuccaaccugcaaag

SEQ ID NO: 1007016 - RNA, 11 nt, Homo sapiens
gcuccacugaa

SEQ ID NO: 1007017 - RNA, 21 nt, Homo sapiens
gcuccagccugacaucaaaaa

SEQ ID NO: 1007018 - RNA, 16 nt, Homo sapiens
gcuccaguguccugag

SEQ ID NO: 1007019 - RNA, 19 nt, Homo sapiens
gcuccaguguccugagcuc

SEQ ID NO: 1007020 - RNA, 14 nt, Homo sapiens
gcuccuccacgccu

SEQ ID NO: 1007021 - RNA, 21 nt, Homo sapiens
gcuccucuccccagcccagag

SEQ ID NO: 1007022 - RNA, 19 nt, Homo sapiens
gcuccuguccccugcuaca

SEQ ID NO: 1007023 - RNA, 18 nt, Homo sapiens
gcuccuguucacaccaga

SEQ ID NO: 1007024 - RNA, 19 nt, Homo sapiens
gcuccuguucacaccagag

SEQ ID NO: 1007025 - RNA, 22 nt, Homo sapiens
gcucgccccagcaggugcugac

SEQ ID NO: 1007026 - RNA, 15 nt, Homo sapiens
gcucggggugcacag

SEQ ID NO: 1007027 - RNA, 21 nt, Homo sapiens
gcucuaaacaagucccuuuau

SEQ ID NO: 1007028 - RNA, 20 nt, Homo sapiens
gcucuaacaaugacauuuau

SEQ ID NO: 1007029 - RNA, 20 nt, Homo sapiens
gcucuaauucacagugcucu

SEQ ID NO: 1007030 - RNA, 21 nt, Homo sapiens
gcucugagagucuagauucuc

SEQ ID NO: 1007031 - RNA, 17 nt, Homo sapiens
gcugaaaaaucauccaa

SEQ ID NO: 1007032 - RNA, 14 nt, Homo sapiens
gcugaagcagguuc

SEQ ID NO: 1007033 - RNA, 15 nt, Homo sapiens
gcugaaugucauuuu

SEQ ID NO: 1007034 - RNA, 17 nt, Homo sapiens
ucuccccagcccagaga

SEQ ID NO: 1007035 - RNA, 18 nt, Homo sapiens
ucuccccuaggcgcuguu

SEQ ID NO: 1007036 - RNA, 18 nt, Homo sapiens
ucuccccuccucuugccu

SEQ ID NO: 1007037 - RNA, 20 nt, Homo sapiens
ucuccccugaccugugagcc

SEQ ID NO: 1007038 - RNA, 23 nt, Homo sapiens
ucucccggcaacaucucugggaa

SEQ ID NO: 1007039 - RNA, 19 nt, Homo sapiens
ucucccuccccugccauuu

SEQ ID NO: 1007040 - RNA, 13 nt, Homo sapiens
ucucccugagaug

SEQ ID NO: 1007041 - RNA, 22 nt, Homo sapiens
ucuccuaaaacuuuaaaacuug

SEQ ID NO: 1007042 - RNA, 23 nt, Homo sapiens
ucuccugcgcccuucauugccac

SEQ ID NO: 1007043 - RNA, 22 nt, Homo sapiens
ucucuaggguacauggugcugg

SEQ ID NO: 1007044 - RNA, 11 nt, Homo sapiens
ucucuaguucc

SEQ ID NO: 1007045 - RNA, 14 nt, Homo sapiens
ucucucagggccag

SEQ ID NO: 1007046 - RNA, 13 nt, Homo sapiens
ucucucaggugaa

SEQ ID NO: 1007047 - RNA, 17 nt, Homo sapiens
ucucuccacuuucagcu

SEQ ID NO: 1007048 - RNA, 15 nt, Homo sapiens
ucucucuugcaggaa

SEQ ID NO: 1007049 - RNA, 15 nt, Homo sapiens
ucucugagcagugaa

SEQ ID NO: 1007050 - RNA, 13 nt, Homo sapiens
ucucugaggacaa

SEQ ID NO: 1007051 - RNA, 14 nt, Homo sapiens
ucucuggaguauuc

SEQ ID NO: 1007052 - RNA, 17 nt, Homo sapiens
ucucugggcuggaugag

SEQ ID NO: 1007053 - RNA, 13 nt, Homo sapiens
ucucugugccauc

SEQ ID NO: 1007054 - RNA, 14 nt, Homo sapiens
ucucugugccuucg

SEQ ID NO: 1007055 - RNA, 17 nt, Homo sapiens
ucucuugccucaaccuc

SEQ ID NO: 1007056 - RNA, 13 nt, Homo sapiens
ucucuuugcccag

SEQ ID NO: 1007057 - RNA, 23 nt, Homo sapiens
ucugaagcccucccagguguuaa

SEQ ID NO: 1007058 - RNA, 12 nt, Homo sapiens
ucugacccagug

SEQ ID NO: 1007059 - RNA, 23 nt, Homo sapiens
ucugagaccacuugggcgcuguu

SEQ ID NO: 1007060 - RNA, 19 nt, Homo sapiens
ucugagagaugacagggaa

SEQ ID NO: 1007061 - RNA, 19 nt, Homo sapiens
ucugagcagugaaugauuc

SEQ ID NO: 1007062 - RNA, 23 nt, Homo sapiens
ucugagcagugaaugauucagug

SEQ ID NO: 1007063 - RNA, 22 nt, Homo sapiens
ucugaggcgccccaacccgugg

SEQ ID NO: 1007064 - RNA, 17 nt, Homo sapiens
ucugaggugcacuggga

SEQ ID NO: 1007065 - RNA, 22 nt, Homo sapiens
ucugauaaacacaaucugcuag

SEQ ID NO: 1007066 - RNA, 15 nt, Homo sapiens
ucugaugcaucagaa

SEQ ID NO: 1007067 - RNA, 23 nt, Homo sapiens
ucugcaagugaggugugucacaa

SEQ ID NO: 1007068 - RNA, 11 nt, Homo sapiens
ucugcauuuac

SEQ ID NO: 1007069 - RNA, 13 nt, Homo sapiens
ucugccacccagg

SEQ ID NO: 1007070 - RNA, 16 nt, Homo sapiens
ucugccccgcccucau

SEQ ID NO: 1007071 - RNA, 13 nt, Homo sapiens
ucugcgugacaau

SEQ ID NO: 1007072 - RNA, 18 nt, Homo sapiens
ucugcucaucauucucug

SEQ ID NO: 1007073 - RNA, 18 nt, Homo sapiens
ucugcucugaugcaucag

SEQ ID NO: 1007074 - RNA, 16 nt, Homo sapiens
ucugcugggugugacc

SEQ ID NO: 1007075 - RNA, 19 nt, Homo sapiens
ucugcuuuucccauugcca

SEQ ID NO: 1007076 - RNA, 12 nt, Homo sapiens
ucuggauuucau

SEQ ID NO: 1007077 - RNA, 20 nt, Homo sapiens
ucuggauuucauacuguaac

SEQ ID NO: 1007078 - RNA, 19 nt, Homo sapiens
ucuggcaagccugucuuca

SEQ ID NO: 1007079 - RNA, 15 nt, Homo sapiens
ucugggggcugagga

SEQ ID NO: 1007080 - RNA, 19 nt, Homo sapiens
ucugguaggaauagcaugu

SEQ ID NO: 1007081 - RNA, 23 nt, Homo sapiens
ucuggugauggauuaacauauag

SEQ ID NO: 1007082 - RNA, 21 nt, Homo sapiens
ucuguaaauaaugugcacuga

SEQ ID NO: 1007083 - RNA, 14 nt, Homo sapiens
ucuguaacugucac

SEQ ID NO: 1007084 - RNA, 16 nt, Homo sapiens
ucuguaaugguacuga

SEQ ID NO: 1007085 - RNA, 17 nt, Homo sapiens
ucuguaggaaacccaac

SEQ ID NO: 1007086 - RNA, 14 nt, Homo sapiens
ucuguagugucacu

SEQ ID NO: 1007087 - RNA, 15 nt, Homo sapiens
ucugucuguggcaaa

SEQ ID NO: 1007088 - RNA, 15 nt, Homo sapiens
ucugugcacugccca

SEQ ID NO: 1007089 - RNA, 16 nt, Homo sapiens
ucuguggagguggaaa

SEQ ID NO: 1007090 - RNA, 17 nt, Homo sapiens
ucuguggcacucagaua

SEQ ID NO: 1007091 - RNA, 19 nt, Homo sapiens
ucuguucuguuucaaggca

SEQ ID NO: 1007092 - RNA, 22 nt, Homo sapiens
ucuuaaacuaaaugugcaauag

SEQ ID NO: 1007093 - RNA, 22 nt, Homo sapiens
ucuuaauacuaaggaaccaaca

SEQ ID NO: 1007094 - RNA, 12 nt, Homo sapiens
ucuuaauugcca

SEQ ID NO: 1007095 - RNA, 21 nt, Homo sapiens
ucuuagcagcuuccagauuga

SEQ ID NO: 1007096 - RNA, 20 nt, Homo sapiens
ucuuagugugccaagaguuc

SEQ ID NO: 1007097 - RNA, 19 nt, Homo sapiens
ucuucacaccuacccuccu

SEQ ID NO: 1007098 - RNA, 14 nt, Homo sapiens
ucuucaccauuugg

SEQ ID NO: 1007099 - RNA, 13 nt, Homo sapiens
ucuucagagacag

SEQ ID NO: 1007100 - RNA, 20 nt, Homo sapiens
ugagccaccaugcccggcua

SEQ ID NO: 1007101 - RNA, 22 nt, Homo sapiens
ugagcccagcugggucaggcag

SEQ ID NO: 1007102 - RNA, 20 nt, Homo sapiens
ugagccccuggaggcacuga

SEQ ID NO: 1007103 - RNA, 18 nt, Homo sapiens
ugagcuauugcuguucuc

SEQ ID NO: 1007104 - RNA, 18 nt, Homo sapiens
ugagcugggagcccggca

SEQ ID NO: 1007105 - RNA, 14 nt, Homo sapiens
ugagcuggggaccu

SEQ ID NO: 1007106 - RNA, 15 nt, Homo sapiens
ugaggaacccuuaca

SEQ ID NO: 1007107 - RNA, 15 nt, Homo sapiens
ugaggacuucuugcu

SEQ ID NO: 1007108 - RNA, 18 nt, Homo sapiens
ugaggcaauuagacacuu

SEQ ID NO: 1007109 - RNA, 20 nt, Homo sapiens
ugaggcauuuccagacuuga

SEQ ID NO: 1007110 - RNA, 18 nt, Homo sapiens
ugaggcuugguuccuucc

SEQ ID NO: 1007111 - RNA, 15 nt, Homo sapiens
ugagggcaguucuga

SEQ ID NO: 1007112 - RNA, 21 nt, Homo sapiens
ugagguccugaucagcuucaa

SEQ ID NO: 1007113 - RNA, 16 nt, Homo sapiens
ugaguaaaaugaagga

SEQ ID NO: 1007114 - RNA, 15 nt, Homo sapiens
ugaguaacauuugcu

SEQ ID NO: 1007115 - RNA, 18 nt, Homo sapiens
ugaguaauacaucaaaga

SEQ ID NO: 1007116 - RNA, 18 nt, Homo sapiens
ugaguacuccacacugca

SEQ ID NO: 1007117 - RNA, 20 nt, Homo sapiens
ugagucuuugguucuaagga

SEQ ID NO: 1007118 - RNA, 13 nt, Homo sapiens
ugaguggugccaa

SEQ ID NO: 1007119 - RNA, 15 nt, Homo sapiens
ugaguggugccaaac

SEQ ID NO: 1007120 - RNA, 19 nt, Homo sapiens
ugaguuucuggcucuugag

SEQ ID NO: 1007121 - RNA, 14 nt, Homo sapiens
ugaguuuucagugg

SEQ ID NO: 1007122 - RNA, 15 nt, Homo sapiens
ugauaauagauucuc

SEQ ID NO: 1007123 - RNA, 22 nt, Homo sapiens
ugauacauccaaagcagacagc

SEQ ID NO: 1007124 - RNA, 19 nt, Homo sapiens
ugauacauuuuuguacuaa

SEQ ID NO: 1007125 - RNA, 22 nt, Homo sapiens
ugauaccaccuuuacugugcuu

SEQ ID NO: 1007126 - RNA, 17 nt, Homo sapiens
ugauacuuugacagugu

SEQ ID NO: 1007127 - RNA, 21 nt, Homo sapiens
ugauauauaaaugugauugca

SEQ ID NO: 1007128 - RNA, 12 nt, Homo sapiens
ugauaugcacaa

SEQ ID NO: 1007129 - RNA, 13 nt, Homo sapiens
ugauauugcagcu

SEQ ID NO: 1007130 - RNA, 20 nt, Homo sapiens
ugaucagcgccgcaccagcc

SEQ ID NO: 1007131 - RNA, 21 nt, Homo sapiens
ugaucauguguggaaguuauu

SEQ ID NO: 1007132 - RNA, 15 nt, Homo sapiens
ugauccugggggacc

SEQ ID NO: 1007133 - RNA, 19 nt, Homo sapiens
ugauggauaucccuaccuu

SEQ ID NO: 1007134 - RNA, 18 nt, Homo sapiens
ugauggauuaacauauag

SEQ ID NO: 1007135 - RNA, 21 nt, Homo sapiens
ugauguauuucaagucucuca

SEQ ID NO: 1007136 - RNA, 22 nt, Homo sapiens
ugaugucaagcaccacacccca

SEQ ID NO: 1007137 - RNA, 23 nt, Homo sapiens
ugauuagaaagaccaggccaaug

SEQ ID NO: 1007138 - RNA, 17 nt, Homo sapiens
ugauugcuuaccuacau

SEQ ID NO: 1007139 - RNA, 16 nt, Homo sapiens
ugauuuaucacacaaa

SEQ ID NO: 1007140 - RNA, 16 nt, Homo sapiens
ccaucuugagugguca

SEQ ID NO: 1007141 - RNA, 23 nt, Homo sapiens
ccaugaacaucuuuagugucuga

SEQ ID NO: 1007142 - RNA, 17 nt, Homo sapiens
ccaugauggcaacagau

SEQ ID NO: 1007143 - RNA, 15 nt, Homo sapiens
ccaugggaccacaac

SEQ ID NO: 1007144 - RNA, 19 nt, Homo sapiens
ccauggugagcucugggaa

SEQ ID NO: 1007145 - RNA, 16 nt, Homo sapiens
ccauggugugaucguc

SEQ ID NO: 1007146 - RNA, 13 nt, Homo sapiens
ccauguccaaaga

SEQ ID NO: 1007147 - RNA, 14 nt, Homo sapiens
ccauguccaaagag

SEQ ID NO: 1007148 - RNA, 13 nt, Homo sapiens
ccauguuucacaa

SEQ ID NO: 1007149 - RNA, 23 nt, Homo sapiens
ccauguuucacaaggucuuuaaa

SEQ ID NO: 1007150 - RNA, 21 nt, Homo sapiens
ccauuuggcaaugccaucauc

SEQ ID NO: 1007151 - RNA, 20 nt, Homo sapiens
cccaaauccuuagaucuggc

SEQ ID NO: 1007152 - RNA, 15 nt, Homo sapiens
cccaacccaaugggc

SEQ ID NO: 1007153 - RNA, 18 nt, Homo sapiens
cccaacuccuuccagcua

SEQ ID NO: 1007154 - RNA, 16 nt, Homo sapiens
cccaauucacaucuaa

SEQ ID NO: 1007155 - RNA, 12 nt, Homo sapiens
cccacaguguca

SEQ ID NO: 1007156 - RNA, 19 nt, Homo sapiens
cccacccucuggagaaggu

SEQ ID NO: 1007157 - RNA, 16 nt, Homo sapiens
cccacuccaucuggua

SEQ ID NO: 1007158 - RNA, 16 nt, Homo sapiens
cccagacaaaaagcua

SEQ ID NO: 1007159 - RNA, 13 nt, Homo sapiens
cccagacacuggc

SEQ ID NO: 1007160 - RNA, 23 nt, Homo sapiens
cccagacacuggcguuacugcuu

SEQ ID NO: 1007161 - RNA, 18 nt, Homo sapiens
cccagacuagauguagua

SEQ ID NO: 1007162 - RNA, 15 nt, Homo sapiens
cccagagcaccugcu

SEQ ID NO: 1007163 - RNA, 11 nt, Homo sapiens
cccagcacuug

SEQ ID NO: 1007164 - RNA, 20 nt, Homo sapiens
cccagcacuuugggaggcca

SEQ ID NO: 1007165 - RNA, 20 nt, Homo sapiens
cccagccaaacccugucuga

SEQ ID NO: 1007166 - RNA, 19 nt, Homo sapiens
cccagccagggcucaaucu

SEQ ID NO: 1007167 - RNA, 15 nt, Homo sapiens
cccagcccagagaca

SEQ ID NO: 1007168 - RNA, 22 nt, Homo sapiens
cccagcccgucuccucuucccu

SEQ ID NO: 1007169 - RNA, 20 nt, Homo sapiens
acggagcacugcaccugccu

SEQ ID NO: 1007170 - RNA, 20 nt, Homo sapiens
acggagccacuccucugacu

SEQ ID NO: 1007171 - RNA, 22 nt, Homo sapiens
acggagccacuccucugacuca

SEQ ID NO: 1007172 - RNA, 17 nt, Homo sapiens
acggccacacagcugcc

SEQ ID NO: 1007173 - RNA, 19 nt, Homo sapiens
acgggaauucagacaagcu

SEQ ID NO: 1007174 - RNA, 16 nt, Homo sapiens
acggucaguccauguc

SEQ ID NO: 1007175 - RNA, 19 nt, Homo sapiens
acguaaaguacuuguaguu

SEQ ID NO: 1007176 - RNA, 19 nt, Homo sapiens
acguauuuaugucccugac

SEQ ID NO: 1007177 - RNA, 12 nt, Homo sapiens
acguggccucuu

SEQ ID NO: 1007178 - RNA, 14 nt, Homo sapiens
acguggcucagcca

SEQ ID NO: 1007179 - RNA, 16 nt, Homo sapiens
acguggcucagccagc

SEQ ID NO: 1007180 - RNA, 21 nt, Homo sapiens
acguguguauugcaaugggaa

SEQ ID NO: 1007181 - RNA, 23 nt, Homo sapiens
acguuguuuugguuguacuuugg

SEQ ID NO: 1007182 - RNA, 16 nt, Homo sapiens
acguuuaacauacaau

SEQ ID NO: 1007183 - RNA, 17 nt, Homo sapiens
acguuuuggucacauau

SEQ ID NO: 1007184 - RNA, 16 nt, Homo sapiens
acuaaaaaaaugcaaa

SEQ ID NO: 1007185 - RNA, 19 nt, Homo sapiens
acuaacuaugcauggugcc

SEQ ID NO: 1007186 - RNA, 18 nt, Homo sapiens
acuaauagaaaaguaugu

SEQ ID NO: 1007187 - RNA, 22 nt, Homo sapiens
acuaauggcaugagaaauacaa

SEQ ID NO: 1007188 - RNA, 19 nt, Homo sapiens
acuaauuauaccaguuuuu

SEQ ID NO: 1007189 - RNA, 19 nt, Homo sapiens
acuaauuuauaacuauuau

SEQ ID NO: 1007190 - RNA, 15 nt, Homo sapiens
acuacaaacuucaaa

SEQ ID NO: 1007191 - RNA, 23 nt, Homo sapiens
acuaccuugguucccccacugau

SEQ ID NO: 1007192 - RNA, 17 nt, Homo sapiens
acuagaagcaacuagga

SEQ ID NO: 1007193 - RNA, 19 nt, Homo sapiens
acuagagucugaacagcug

SEQ ID NO: 1007194 - RNA, 17 nt, Homo sapiens
acuagccaaaccucacc

SEQ ID NO: 1007195 - RNA, 15 nt, Homo sapiens
acuagggaucccuca

SEQ ID NO: 1007196 - RNA, 11 nt, Homo sapiens
acuagggccaa

SEQ ID NO: 1007197 - RNA, 14 nt, Homo sapiens
acuaugauuauuaa

SEQ ID NO: 1007198 - RNA, 22 nt, Homo sapiens
acuaugcauggugccccaggac

SEQ ID NO: 1007199 - RNA, 22 nt, Homo sapiens
acuauuguuacauuauguggaa

SEQ ID NO: 1007200 - RNA, 21 nt, Homo sapiens
acuauuuaaagccuccucauc

SEQ ID NO: 1007201 - RNA, 21 nt, Homo sapiens
acucaaaaauccuaacauuca

SEQ ID NO: 1007202 - RNA, 19 nt, Homo sapiens
ccagcuccaaccugcaaag

SEQ ID NO: 1007203 - RNA, 15 nt, Homo sapiens
ccagcucccuucuuc

SEQ ID NO: 1007204 - RNA, 17 nt, Homo sapiens
ccagcugggucaggcag

SEQ ID NO: 1007205 - RNA, 14 nt, Homo sapiens
ccagcuucagguga

SEQ ID NO: 1007206 - RNA, 14 nt, Homo sapiens
ccaggaaaggccca

SEQ ID NO: 1007207 - RNA, 23 nt, Homo sapiens
ccaggaagcuuuggugagaaccu

SEQ ID NO: 1007208 - RNA, 13 nt, Homo sapiens
ccaggacccugaa

SEQ ID NO: 1007209 - RNA, 17 nt, Homo sapiens
ccaggagcuccaguguc

SEQ ID NO: 1007210 - RNA, 14 nt, Homo sapiens
ccaggccaauguca

SEQ ID NO: 1007211 - RNA, 21 nt, Homo sapiens
ccaggccaccuccccagcauu

SEQ ID NO: 1007212 - RNA, 20 nt, Homo sapiens
ccaggcucucgcacaccucu

SEQ ID NO: 1007213 - RNA, 21 nt, Homo sapiens
ccaggcugagguccugaucag

SEQ ID NO: 1007214 - RNA, 22 nt, Homo sapiens
ccaggcugccuggucacugccc

SEQ ID NO: 1007215 - RNA, 18 nt, Homo sapiens
ccaggcuggagugcagug

SEQ ID NO: 1007216 - RNA, 20 nt, Homo sapiens
ccaggcuggagugcaguggu

SEQ ID NO: 1007217 - RNA, 15 nt, Homo sapiens
ccaggcugggaacuc

SEQ ID NO: 1007218 - RNA, 16 nt, Homo sapiens
ccagggagagcccagg

SEQ ID NO: 1007219 - RNA, 23 nt, Homo sapiens
ccagguuuuacacuugcaucucu

SEQ ID NO: 1007220 - RNA, 16 nt, Homo sapiens
ccagucauucugggaa

SEQ ID NO: 1007221 - RNA, 15 nt, Homo sapiens
ccagucccagagcag

SEQ ID NO: 1007222 - RNA, 16 nt, Homo sapiens
ccaguuugcuuugccc

SEQ ID NO: 1007223 - RNA, 22 nt, Homo sapiens
ccauaagggucccccacucuaa

SEQ ID NO: 1007224 - RNA, 13 nt, Homo sapiens
ccauaaugcauuc

SEQ ID NO: 1007225 - RNA, 16 nt, Homo sapiens
ccauaucugugaaaug

SEQ ID NO: 1007226 - RNA, 16 nt, Homo sapiens
ccaucaaguugugcca

SEQ ID NO: 1007227 - RNA, 14 nt, Homo sapiens
ccaucaccuacuca

SEQ ID NO: 1007228 - RNA, 18 nt, Homo sapiens
ccaucgucucggccuuca

SEQ ID NO: 1007229 - RNA, 13 nt, Homo sapiens
ccaugaacacaga

SEQ ID NO: 1007230 - RNA, 19 nt, Homo sapiens
ccaugaaccaagaccauug

SEQ ID NO: 1007231 - RNA, 22 nt, Homo sapiens
ccaugacaacuucuaauugcca

SEQ ID NO: 1007232 - RNA, 13 nt, Homo sapiens
ccauggugagcuc

SEQ ID NO: 1007233 - RNA, 14 nt, Homo sapiens
ccauggugagcucu

SEQ ID NO: 1007234 - RNA, 12 nt, Homo sapiens
ccauuacugcau

SEQ ID NO: 1007235 - RNA, 16 nt, Homo sapiens
ccauuauaaugaauuu

SEQ ID NO: 1007236 - RNA, 18 nt, Homo sapiens
ccauucccagauguacca

SEQ ID NO: 1007237 - RNA, 23 nt, Homo sapiens
ccauuucugaggugcacugggag

SEQ ID NO: 1007238 - RNA, 16 nt, Homo sapiens
cccaaaguuguuguaa

SEQ ID NO: 1007239 - RNA, 21 nt, Homo sapiens
cccaaccuucuugucauugaa

SEQ ID NO: 1007240 - RNA, 15 nt, Homo sapiens
cccaacucuugcaca

SEQ ID NO: 1007241 - RNA, 12 nt, Homo sapiens
cccaagcaguug

SEQ ID NO: 1007242 - RNA, 21 nt, Homo sapiens
cccacagucccaucugcuuca

SEQ ID NO: 1007243 - RNA, 22 nt, Homo sapiens
cccacucccaggaccaagauug

SEQ ID NO: 1007244 - RNA, 17 nt, Homo sapiens
cccacuggggugugugg

SEQ ID NO: 1007245 - RNA, 20 nt, Homo sapiens
cccacuuguccuuagccugg

SEQ ID NO: 1007246 - RNA, 21 nt, Homo sapiens
cccagaccuguuagcagacag

SEQ ID NO: 1007247 - RNA, 19 nt, Homo sapiens
cccagagcaccugcugucu

SEQ ID NO: 1007248 - RNA, 12 nt, Homo sapiens
cccagagcagga

SEQ ID NO: 1007249 - RNA, 22 nt, Homo sapiens
cccagaggagccaccaguucuc

SEQ ID NO: 1007250 - RNA, 22 nt, Homo sapiens
cccagagugcugggauuacaau

SEQ ID NO: 1007251 - RNA, 11 nt, Homo sapiens
cccagcacugc

SEQ ID NO: 1007252 - RNA, 16 nt, Homo sapiens
cccagccagggcucaa

SEQ ID NO: 1007253 - RNA, 19 nt, Homo sapiens
cccagccccacuccucugc

SEQ ID NO: 1007254 - RNA, 16 nt, Homo sapiens
cccagcccugcagcaa

SEQ ID NO: 1007255 - RNA, 19 nt, Homo sapiens
cccagcuccugacacugcu

SEQ ID NO: 1007256 - RNA, 22 nt, Homo sapiens
cccagcuccugacacugcugga

SEQ ID NO: 1007257 - RNA, 13 nt, Homo sapiens
cccaggaccagcu

SEQ ID NO: 1007258 - RNA, 14 nt, Homo sapiens
cccaggaccagcuc

SEQ ID NO: 1007259 - RNA, 14 nt, Homo sapiens
cccaggacccugaa

SEQ ID NO: 1007260 - RNA, 18 nt, Homo sapiens
cccaggacccugaagggg

SEQ ID NO: 1007261 - RNA, 14 nt, Homo sapiens
cccaggcacugggc

SEQ ID NO: 1007262 - RNA, 12 nt, Homo sapiens
cccaggccagga

SEQ ID NO: 1007263 - RNA, 19 nt, Homo sapiens
cccaggccaggacucugca

SEQ ID NO: 1007264 - RNA, 15 nt, Homo sapiens
cccaggcugggaacu

SEQ ID NO: 1007265 - RNA, 16 nt, Homo sapiens
cccagggagagggggc

SEQ ID NO: 1007266 - RNA, 15 nt, Homo sapiens
cccaggguuuugccc

SEQ ID NO: 1007267 - RNA, 18 nt, Homo sapiens
cccaguccaccugaggaa

SEQ ID NO: 1007268 - RNA, 20 nt, Homo sapiens
cccagugcccccacugacca

SEQ ID NO: 1007269 - RNA, 22 nt, Homo sapiens
cccagugcccccacugaccaga

SEQ ID NO: 1007270 - RNA, 22 nt, Homo sapiens
cccaguucacccugauuuagga

SEQ ID NO: 1007271 - RNA, 14 nt, Homo sapiens
cccauaucugugaa

SEQ ID NO: 1007272 - RNA, 15 nt, Homo sapiens
cccaucaccuacuca

SEQ ID NO: 1007273 - RNA, 22 nt, Homo sapiens
cccaucccacacccuggaggau

SEQ ID NO: 1007274 - RNA, 14 nt, Homo sapiens
cccaucguugcccc

SEQ ID NO: 1007275 - RNA, 14 nt, Homo sapiens
cccaugcacuguga

SEQ ID NO: 1007276 - RNA, 17 nt, Homo sapiens
cccaugcacugugaagg

SEQ ID NO: 1007277 - RNA, 16 nt, Homo sapiens
ccccaacaugcacuga

SEQ ID NO: 1007278 - RNA, 12 nt, Homo sapiens
ccccacugacca

SEQ ID NO: 1007279 - RNA, 13 nt, Homo sapiens
ccccagaccucca

SEQ ID NO: 1007280 - RNA, 14 nt, Homo sapiens
ccccagcccagaga

SEQ ID NO: 1007281 - RNA, 19 nt, Homo sapiens
ccccagcccagagacauac

SEQ ID NO: 1007282 - RNA, 20 nt, Homo sapiens
ccccaggcaaggaugucuga

SEQ ID NO: 1007283 - RNA, 15 nt, Homo sapiens
ccccaggcauugcca

SEQ ID NO: 1007284 - RNA, 21 nt, Homo sapiens
ccccaggggcugucccggagg

SEQ ID NO: 1007285 - RNA, 13 nt, Homo sapiens
ccccaugcacugu

SEQ ID NO: 1007286 - RNA, 16 nt, Homo sapiens
cccccacugaccagaa

SEQ ID NO: 1007287 - RNA, 12 nt, Homo sapiens
cccccagcacuu

SEQ ID NO: 1007288 - RNA, 14 nt, Homo sapiens
cccccagcuaagaa

SEQ ID NO: 1007289 - RNA, 12 nt, Homo sapiens
cccccugugcag

SEQ ID NO: 1007290 - RNA, 12 nt, Homo sapiens
cccccuugaggg

SEQ ID NO: 1007291 - RNA, 15 nt, Homo sapiens
ccccgugacugcaau

SEQ ID NO: 1007292 - RNA, 16 nt, Homo sapiens
ccccuccggccugggc

SEQ ID NO: 1007293 - RNA, 19 nt, Homo sapiens
ccccucggccccagcacau

SEQ ID NO: 1007294 - RNA, 24 nt, Homo sapiens
ccccugacgugcagccacacacag

SEQ ID NO: 1007295 - RNA, 22 nt, Homo sapiens
ccccugagcccaaggcacugag

SEQ ID NO: 1007296 - RNA, 15 nt, Homo sapiens
ccccuuuagaucucu

SEQ ID NO: 1007297 - RNA, 19 nt, Homo sapiens
cccggagguugggugggcc

SEQ ID NO: 1007298 - RNA, 17 nt, Homo sapiens
cccggggccagcacuuc

SEQ ID NO: 1007299 - RNA, 21 nt, Homo sapiens
cccggggcggcaggaaggggg

SEQ ID NO: 1007300 - RNA, 17 nt, Homo sapiens
cccuaaaucuugacuac

SEQ ID NO: 1007301 - RNA, 21 nt, Homo sapiens
cccucaccuguagcagccagu

SEQ ID NO: 1007302 - RNA, 12 nt, Homo sapiens
cccucacuggcu

SEQ ID NO: 1007303 - RNA, 19 nt, Homo sapiens
cccucagggcaaagccagg

SEQ ID NO: 1007304 - RNA, 16 nt, Homo sapiens
cccuccaaguggucca

SEQ ID NO: 1007305 - RNA, 22 nt, Homo sapiens
cccuccaagugguccacaagcu

SEQ ID NO: 1007306 - RNA, 21 nt, Homo sapiens
cuucuggacugguuuucacau

SEQ ID NO: 1007307 - RNA, 11 nt, Homo sapiens
cuucuugccuc

SEQ ID NO: 1007308 - RNA, 18 nt, Homo sapiens
cuucuuuuggacaaaccu

SEQ ID NO: 1007309 - RNA, 17 nt, Homo sapiens
cuugaaaaagacauuca

SEQ ID NO: 1007310 - RNA, 21 nt, Homo sapiens
cuugaagaggaaacucuguca

SEQ ID NO: 1007311 - RNA, 18 nt, Homo sapiens
cuugaagggccagagcca

SEQ ID NO: 1007312 - RNA, 16 nt, Homo sapiens
cuugaaggugcugacg

SEQ ID NO: 1007313 - RNA, 18 nt, Homo sapiens
cuugacccccuugagggu

SEQ ID NO: 1007314 - RNA, 21 nt, Homo sapiens
cuugauagaaaugccaagcac

SEQ ID NO: 1007315 - RNA, 17 nt, Homo sapiens
cuugccaaauuuagauu

SEQ ID NO: 1007316 - RNA, 12 nt, Homo sapiens
cuugccagagau

SEQ ID NO: 1007317 - RNA, 15 nt, Homo sapiens
cuugcccuaagcaga

SEQ ID NO: 1007318 - RNA, 11 nt, Homo sapiens
cuugccucuuc

SEQ ID NO: 1007319 - RNA, 21 nt, Homo sapiens
cuuggcaccagacacccagga

SEQ ID NO: 1007320 - RNA, 16 nt, Homo sapiens
cuuggcagccuuguga

SEQ ID NO: 1007321 - RNA, 14 nt, Homo sapiens
cuuggcugacauga

SEQ ID NO: 1007322 - RNA, 23 nt, Homo sapiens
cuuggcuggugugguacagagaa

SEQ ID NO: 1007323 - RNA, 22 nt, Homo sapiens
cuuggcuuacugcagccuuugc

SEQ ID NO: 1007324 - RNA, 18 nt, Homo sapiens
cuugggaagacuccuagc

SEQ ID NO: 1007325 - RNA, 23 nt, Homo sapiens
cuuggggagaccucuacugccuu

SEQ ID NO: 1007326 - RNA, 21 nt, Homo sapiens
cuuggggggugaugagggcag

SEQ ID NO: 1007327 - RNA, 21 nt, Homo sapiens
cuuggguuagaccuacagggg

SEQ ID NO: 1007328 - RNA, 15 nt, Homo sapiens
cuugguaauuguacu

SEQ ID NO: 1007329 - RNA, 18 nt, Homo sapiens
cuuggucccacaggccac

SEQ ID NO: 1007330 - RNA, 17 nt, Homo sapiens
cuuguaggggaggggcu

SEQ ID NO: 1007331 - RNA, 14 nt, Homo sapiens
cuugucauguguau

SEQ ID NO: 1007332 - RNA, 23 nt, Homo sapiens
cuuguccgcugggugguacccuc

SEQ ID NO: 1007333 - RNA, 18 nt, Homo sapiens
cuugucucuugccugcca

SEQ ID NO: 1007334 - RNA, 12 nt, Homo sapiens
cuugugaugugc

SEQ ID NO: 1007335 - RNA, 19 nt, Homo sapiens
cuuguguuauuuaaugagu

SEQ ID NO: 1007336 - RNA, 16 nt, Homo sapiens
cuuguuguuucuugcc

SEQ ID NO: 1007337 - RNA, 13 nt, Homo sapiens
gaaucagacugac

SEQ ID NO: 1007338 - RNA, 17 nt, Homo sapiens
gaaucagacugacaguu

SEQ ID NO: 1007339 - RNA, 19 nt, Homo sapiens
gaaucagacugacaguuua

SEQ ID NO: 1007340 - RNA, 20 nt, Homo sapiens
gaaucaggaauauuuuccaa

SEQ ID NO: 1007341 - RNA, 16 nt, Homo sapiens
gaauccccaacaugca

SEQ ID NO: 1007342 - RNA, 19 nt, Homo sapiens
gaaucuuaagguguagcca

SEQ ID NO: 1007343 - RNA, 17 nt, Homo sapiens
gaaugcaaaccauagca

SEQ ID NO: 1007344 - RNA, 13 nt, Homo sapiens
gaauggucuuucu

SEQ ID NO: 1007345 - RNA, 18 nt, Homo sapiens
gaauguuaugugcaaguu

SEQ ID NO: 1007346 - RNA, 15 nt, Homo sapiens
gaauuaaaguacuuu

SEQ ID NO: 1007347 - RNA, 16 nt, Homo sapiens
gaauuauaacuguaaa

SEQ ID NO: 1007348 - RNA, 15 nt, Homo sapiens
gaauuauuacagugu

SEQ ID NO: 1007349 - RNA, 12 nt, Homo sapiens
gaauucccucac

SEQ ID NO: 1007350 - RNA, 18 nt, Homo sapiens
gaauucuaacaagucaua

SEQ ID NO: 1007351 - RNA, 14 nt, Homo sapiens
gaauucuaagugaa

SEQ ID NO: 1007352 - RNA, 12 nt, Homo sapiens
gaauuugagugc

SEQ ID NO: 1007353 - RNA, 14 nt, Homo sapiens
gaauuuggggcuuc

SEQ ID NO: 1007354 - RNA, 16 nt, Homo sapiens
gaauuuucaucuagga

SEQ ID NO: 1007355 - RNA, 19 nt, Homo sapiens
gaauuuucucuaacuucaa

SEQ ID NO: 1007356 - RNA, 21 nt, Homo sapiens
gacaaggagugugaccacuga

SEQ ID NO: 1007357 - RNA, 15 nt, Homo sapiens
gacaaguauggcucc

SEQ ID NO: 1007358 - RNA, 18 nt, Homo sapiens
gacaaguggacucagggc

SEQ ID NO: 1007359 - RNA, 20 nt, Homo sapiens
gacacauguauuuggugauu

SEQ ID NO: 1007360 - RNA, 15 nt, Homo sapiens
gacaccuaacucuuc

SEQ ID NO: 1007361 - RNA, 19 nt, Homo sapiens
gacacuccccgaagucuuu

SEQ ID NO: 1007362 - RNA, 23 nt, Homo sapiens
gacacugguggggauaggccagc

SEQ ID NO: 1007363 - RNA, 15 nt, Homo sapiens
gacagaaccacaggg

SEQ ID NO: 1007364 - RNA, 19 nt, Homo sapiens
gacagaaugagaccaaacg

SEQ ID NO: 1007365 - RNA, 17 nt, Homo sapiens
gacagacaggcucuuag

SEQ ID NO: 1007366 - RNA, 17 nt, Homo sapiens
gacagagagaggcauuu

SEQ ID NO: 1007367 - RNA, 17 nt, Homo sapiens
gacagaugccuccuucc

SEQ ID NO: 1007368 - RNA, 14 nt, Homo sapiens
gacagccugaguca

SEQ ID NO: 1007369 - RNA, 16 nt, Homo sapiens
gacaggacuaacacuc

SEQ ID NO: 1007370 - RNA, 13 nt, Homo sapiens
gacaggauguguu

SEQ ID NO: 1007371 - RNA, 17 nt, Homo sapiens
gacaggugaggucuguu

SEQ ID NO: 1007372 - RNA, 14 nt, Homo sapiens
gacauacauuucuc

SEQ ID NO: 1007373 - RNA, 15 nt, Homo sapiens
gacauacuuaaugca

SEQ ID NO: 1007374 - RNA, 15 nt, Homo sapiens
gacaucaagacuuug

SEQ ID NO: 1007375 - RNA, 19 nt, Homo sapiens
gacaugaaaggacccugug

SEQ ID NO: 1007376 - RNA, 19 nt, Homo sapiens
gacaugcuucagugcugcu

SEQ ID NO: 1007377 - RNA, 14 nt, Homo sapiens
gacaugugacauuu

SEQ ID NO: 1007378 - RNA, 15 nt, Homo sapiens
gacauguggggccag

SEQ ID NO: 1007379 - RNA, 21 nt, Homo sapiens
gacauuugggagacaugugac

SEQ ID NO: 1007380 - RNA, 19 nt, Homo sapiens
gaccaaugucuugaugcau

SEQ ID NO: 1007381 - RNA, 13 nt, Homo sapiens
gaccacaacuauu

SEQ ID NO: 1007382 - RNA, 12 nt, Homo sapiens
gaccaccagggc

SEQ ID NO: 1007383 - RNA, 17 nt, Homo sapiens
gaccacuguuaucaaaa

SEQ ID NO: 1007384 - RNA, 14 nt, Homo sapiens
gaccaggcaccagg

SEQ ID NO: 1007385 - RNA, 21 nt, Homo sapiens
gaccaugcucaucugcugguc

SEQ ID NO: 1007386 - RNA, 12 nt, Homo sapiens
gacccaggaaag

SEQ ID NO: 1007387 - RNA, 16 nt, Homo sapiens
gacccauuccuuccca

SEQ ID NO: 1007388 - RNA, 21 nt, Homo sapiens
gaccccaagaguuuugggagu

SEQ ID NO: 1007389 - RNA, 23 nt, Homo sapiens
gacccccagcacuuggggguuca

SEQ ID NO: 1007390 - RNA, 18 nt, Homo sapiens
gaccgcccccuccucuag

SEQ ID NO: 1007391 - RNA, 19 nt, Homo sapiens
gaccgcccccugucucuca

SEQ ID NO: 1007392 - RNA, 23 nt, Homo sapiens
gaccgcccccugucucucagggc

SEQ ID NO: 1007393 - RNA, 13 nt, Homo sapiens
gaccuacuguucu

SEQ ID NO: 1007394 - RNA, 15 nt, Homo sapiens
gaccuaggauuucau

SEQ ID NO: 1007395 - RNA, 19 nt, Homo sapiens
gaccuccagcuuuccugua

SEQ ID NO: 1007396 - RNA, 17 nt, Homo sapiens
gaccugaggcugugguc

SEQ ID NO: 1007397 - RNA, 17 nt, Homo sapiens
gaccuggaaucagugaa

SEQ ID NO: 1007398 - RNA, 16 nt, Homo sapiens
gaccuggcagcucugg

SEQ ID NO: 1007399 - RNA, 20 nt, Homo sapiens
gaccuggcccccucaguguu

SEQ ID NO: 1007400 - RNA, 22 nt, Homo sapiens
gaccuuuuuuaggaagcaagcu

SEQ ID NO: 1007401 - RNA, 14 nt, Homo sapiens
gacgacaagugcug

SEQ ID NO: 1007402 - RNA, 17 nt, Homo sapiens
gacgacaagugcugaac

SEQ ID NO: 1007403 - RNA, 17 nt, Homo sapiens
gacgcaucucaaaacag

SEQ ID NO: 1007404 - RNA, 22 nt, Homo sapiens
gacuacaggcgugagccaccau

SEQ ID NO: 1007405 - RNA, 17 nt, Homo sapiens
gacuauggcuaccaaaa

SEQ ID NO: 1007406 - RNA, 14 nt, Homo sapiens
gacuauucuaauga

SEQ ID NO: 1007407 - RNA, 13 nt, Homo sapiens
gacuccaugccuc

SEQ ID NO: 1007408 - RNA, 17 nt, Homo sapiens
gacucuuuaugcuugca

SEQ ID NO: 1007409 - RNA, 18 nt, Homo sapiens
ggagggaagggagccaag

SEQ ID NO: 1007410 - RNA, 19 nt, Homo sapiens
ggaggugaccaaaucagug

SEQ ID NO: 1007411 - RNA, 19 nt, Homo sapiens
ggagucacucuuaugcugu

SEQ ID NO: 1007412 - RNA, 18 nt, Homo sapiens
ggauaaccuugugccuug

SEQ ID NO: 1007413 - RNA, 23 nt, Homo sapiens
ggauaauauccagccucccacaa

SEQ ID NO: 1007414 - RNA, 15 nt, Homo sapiens
ggauacgacacaugc

SEQ ID NO: 1007415 - RNA, 20 nt, Homo sapiens
ggauaucuguguauaugccc

SEQ ID NO: 1007416 - RNA, 14 nt, Homo sapiens
ggaucagaauauca

SEQ ID NO: 1007417 - RNA, 21 nt, Homo sapiens
ggauccuguguggagagggaa

SEQ ID NO: 1007418 - RNA, 23 nt, Homo sapiens
ggauggaacacggccacaucaaa

SEQ ID NO: 1007419 - RNA, 15 nt, Homo sapiens
ggauguaaagaucaa

SEQ ID NO: 1007420 - RNA, 22 nt, Homo sapiens
ggauguugaagugagcugagau

SEQ ID NO: 1007421 - RNA, 17 nt, Homo sapiens
ggauuaacccacuagcu

SEQ ID NO: 1007422 - RNA, 17 nt, Homo sapiens
ggauuaaccucugcacu

SEQ ID NO: 1007423 - RNA, 13 nt, Homo sapiens
ggauucuaaggaa

SEQ ID NO: 1007424 - RNA, 16 nt, Homo sapiens
ggauuucauacuguaa

SEQ ID NO: 1007425 - RNA, 19 nt, Homo sapiens
ggauuugcccacguaccca

SEQ ID NO: 1007426 - RNA, 21 nt, Homo sapiens
ggauuugcccacguacccagg

SEQ ID NO: 1007427 - RNA, 15 nt, Homo sapiens
ggauuuuucuguaac

SEQ ID NO: 1007428 - RNA, 17 nt, Homo sapiens
ggcaaaaacaaaacucu

SEQ ID NO: 1007429 - RNA, 12 nt, Homo sapiens
ggcaacaucaac

SEQ ID NO: 1007430 - RNA, 22 nt, Homo sapiens
ggcaagucaccugcagcccaug

SEQ ID NO: 1007431 - RNA, 12 nt, Homo sapiens
ggcacacagcua

SEQ ID NO: 1007432 - RNA, 20 nt, Homo sapiens
ggcacagggucugcucuuuc

SEQ ID NO: 1007433 - RNA, 9 nt, Homo sapiens
ggcacauug

SEQ ID NO: 1007434 - RNA, 19 nt, Homo sapiens
ggcaccagacacccaggac

SEQ ID NO: 1007435 - RNA, 16 nt, Homo sapiens
ggcaccuaauccaggc

SEQ ID NO: 1007436 - RNA, 23 nt, Homo sapiens
ggcacugagaccuccacccacug

SEQ ID NO: 1007437 - RNA, 21 nt, Homo sapiens
ggcagaaacacucaaguugau

SEQ ID NO: 1007438 - RNA, 20 nt, Homo sapiens
ggcagacucuuuaugcuugc

SEQ ID NO: 1007439 - RNA, 12 nt, Homo sapiens
ggcagauccagg

SEQ ID NO: 1007440 - RNA, 23 nt, Homo sapiens
ggcagcagagcauucagacucca

SEQ ID NO: 1007441 - RNA, 16 nt, Homo sapiens
ggcagccauagugcau

SEQ ID NO: 1007442 - RNA, 22 nt, Homo sapiens
ggcagccucugggggguggcca

SEQ ID NO: 1007443 - RNA, 16 nt, Homo sapiens
ggcaggcucccaggga

SEQ ID NO: 1007444 - RNA, 20 nt, Homo sapiens
ggcaggcugggccaugucca

SEQ ID NO: 1007445 - RNA, 21 nt, Homo sapiens
ggcagggaauggggacggugu

SEQ ID NO: 1007446 - RNA, 13 nt, Homo sapiens
ggcaugcuuuauu

SEQ ID NO: 1007447 - RNA, 21 nt, Homo sapiens
ggccaaagagucuccaguuua

SEQ ID NO: 1007448 - RNA, 15 nt, Homo sapiens
ggccaagcugaggug

SEQ ID NO: 1007449 - RNA, 12 nt, Homo sapiens
ggccagcacuuc

SEQ ID NO: 1007450 - RNA, 14 nt, Homo sapiens
ggccagcagcaccu

SEQ ID NO: 1007451 - RNA, 15 nt, Homo sapiens
ggccagcagcaccug

SEQ ID NO: 1007452 - RNA, 14 nt, Homo sapiens
ggccauguccaaag

SEQ ID NO: 1007453 - RNA, 16 nt, Homo sapiens
ggccauguccaaagag

SEQ ID NO: 1007454 - RNA, 18 nt, Homo sapiens
ggccgugacgucugggug

SEQ ID NO: 1007455 - RNA, 23 nt, Homo sapiens
ggccuaaccgagaucaguauuua

SEQ ID NO: 1007456 - RNA, 22 nt, Homo sapiens
ggccuccugccucuacugggaa

SEQ ID NO: 1007457 - RNA, 15 nt, Homo sapiens
ggccuccugugacug

SEQ ID NO: 1007458 - RNA, 20 nt, Homo sapiens
ggccucucccuccuccagga

SEQ ID NO: 1007459 - RNA, 21 nt, Homo sapiens
ggccucucccuccuccaggaa

SEQ ID NO: 1007460 - RNA, 18 nt, Homo sapiens
ggccucuucugcuuucuc

SEQ ID NO: 1007461 - RNA, 17 nt, Homo sapiens
ggccugcaaacugggaa

SEQ ID NO: 1007462 - RNA, 19 nt, Homo sapiens
ggccuggggugacccggca

SEQ ID NO: 1007463 - RNA, 22 nt, Homo sapiens
ggcgcgaucucggcucacugca

SEQ ID NO: 1007464 - RNA, 11 nt, Homo sapiens
ggcgcuuucug

SEQ ID NO: 1007465 - RNA, 23 nt, Homo sapiens
ggcuaauuuaacaagaacuuuaa

SEQ ID NO: 1007466 - RNA, 19 nt, Homo sapiens
ggcuauuuaaaacuuguaa

SEQ ID NO: 1007467 - RNA, 20 nt, Homo sapiens
ggcucaauugaaagugggca

SEQ ID NO: 1007468 - RNA, 20 nt, Homo sapiens
ggcucagauuguaauaugua

SEQ ID NO: 1007469 - RNA, 13 nt, Homo sapiens
ggcucagccagca

SEQ ID NO: 1007470 - RNA, 20 nt, Homo sapiens
ggcuccagaugcagggcagu

SEQ ID NO: 1007471 - RNA, 16 nt, Homo sapiens
ggcuccgugugggaga

SEQ ID NO: 1007472 - RNA, 17 nt, Homo sapiens
ggcuccuucccaucgcu

SEQ ID NO: 1007473 - RNA, 21 nt, Homo sapiens
ggcucuaacaaugacauuuau

SEQ ID NO: 1007474 - RNA, 18 nt, Homo sapiens
guaaucccagcacuuugg

SEQ ID NO: 1007475 - RNA, 22 nt, Homo sapiens
guaaugaaacaaagaguucaag

SEQ ID NO: 1007476 - RNA, 21 nt, Homo sapiens
guaauuguacuaaagccaaac

SEQ ID NO: 1007477 - RNA, 20 nt, Homo sapiens
guaauuuuaguagagacagg

SEQ ID NO: 1007478 - RNA, 18 nt, Homo sapiens
guaauuuuguaucuugau

SEQ ID NO: 1007479 - RNA, 14 nt, Homo sapiens
guacagagcacauu

SEQ ID NO: 1007480 - RNA, 12 nt, Homo sapiens
guacaucuggcc

SEQ ID NO: 1007481 - RNA, 18 nt, Homo sapiens
guaccagaugcagcucaa

SEQ ID NO: 1007482 - RNA, 11 nt, Homo sapiens
guaccaguuaa

SEQ ID NO: 1007483 - RNA, 14 nt, Homo sapiens
guacccaccgggcc

SEQ ID NO: 1007484 - RNA, 16 nt, Homo sapiens
guaccgcgucuacccu

SEQ ID NO: 1007485 - RNA, 20 nt, Homo sapiens
guacuaacuagcauuguaaa

SEQ ID NO: 1007486 - RNA, 17 nt, Homo sapiens
guacugacuuugcuugc

SEQ ID NO: 1007487 - RNA, 12 nt, Homo sapiens
guacuucuugaa

SEQ ID NO: 1007488 - RNA, 20 nt, Homo sapiens
guacuuguaguuccacuuau

SEQ ID NO: 1007489 - RNA, 22 nt, Homo sapiens
guagaaaauuuguuauuuugca

SEQ ID NO: 1007490 - RNA, 13 nt, Homo sapiens
guagaacuuggau

SEQ ID NO: 1007491 - RNA, 17 nt, Homo sapiens
guagaagccacuauuac

SEQ ID NO: 1007492 - RNA, 16 nt, Homo sapiens
guagaagucucuucca

SEQ ID NO: 1007493 - RNA, 15 nt, Homo sapiens
guagaauugcauuga

SEQ ID NO: 1007494 - RNA, 12 nt, Homo sapiens
guagaugggagg

SEQ ID NO: 1007495 - RNA, 13 nt, Homo sapiens
guaggacauacca

SEQ ID NO: 1007496 - RNA, 21 nt, Homo sapiens
guaggaccaagcaucuugggg

SEQ ID NO: 1007497 - RNA, 22 nt, Homo sapiens
guauaaagaauugugguuuaua

SEQ ID NO: 1007498 - RNA, 17 nt, Homo sapiens
guauacccucuguuucc

SEQ ID NO: 1007499 - RNA, 15 nt, Homo sapiens
guaucaaaugugaca

SEQ ID NO: 1007500 - RNA, 15 nt, Homo sapiens
guaucaggacccaga

SEQ ID NO: 1007501 - RNA, 18 nt, Homo sapiens
guaucaugcccugugcaa

SEQ ID NO: 1007502 - RNA, 19 nt, Homo sapiens
guauccccccaucuugcuu

SEQ ID NO: 1007503 - RNA, 20 nt, Homo sapiens
guauguauuauuuacauuua

SEQ ID NO: 1007504 - RNA, 14 nt, Homo sapiens
guauuaaaagcuaa

SEQ ID NO: 1007505 - RNA, 22 nt, Homo sapiens
guauucccaaaaauuacuuugg

SEQ ID NO: 1007506 - RNA, 20 nt, Homo sapiens
guauuugaaauaagaauuca

SEQ ID NO: 1007507 - RNA, 21 nt, Homo sapiens
guauuuggaaauaaagucaga

SEQ ID NO: 1007508 - RNA, 17 nt, Homo sapiens
gucaagaauagcauugu

SEQ ID NO: 1007509 - RNA, 16 nt, Homo sapiens
gucaccacgacuggcc

SEQ ID NO: 1007510 - RNA, 13 nt, Homo sapiens
gucaccugcagcc

SEQ ID NO: 1007511 - RNA, 16 nt, Homo sapiens
gucacugacaguuaau

SEQ ID NO: 1007512 - RNA, 18 nt, Homo sapiens
gucagcauguacuccccu

SEQ ID NO: 1007513 - RNA, 13 nt, Homo sapiens
ugccuuuugcaac

SEQ ID NO: 1007514 - RNA, 15 nt, Homo sapiens
ugcgagagaaaggga

SEQ ID NO: 1007515 - RNA, 16 nt, Homo sapiens
ugcgagagaaagggag

SEQ ID NO: 1007516 - RNA, 17 nt, Homo sapiens
ugcgagugguuucuugu

SEQ ID NO: 1007517 - RNA, 17 nt, Homo sapiens
ugcggcuccucagggac

SEQ ID NO: 1007518 - RNA, 18 nt, Homo sapiens
ugcgggugaacaaagcag

SEQ ID NO: 1007519 - RNA, 20 nt, Homo sapiens
ugcuaaaggaaaaaaccauc

SEQ ID NO: 1007520 - RNA, 19 nt, Homo sapiens
ugcuaacggugcucagggg

SEQ ID NO: 1007521 - RNA, 23 nt, Homo sapiens
ugcuaugguuuucuccaagagcu

SEQ ID NO: 1007522 - RNA, 20 nt, Homo sapiens
ugcucagcccugcaccaugc

SEQ ID NO: 1007523 - RNA, 22 nt, Homo sapiens
ugcucagcccugcaccaugcug

SEQ ID NO: 1007524 - RNA, 15 nt, Homo sapiens
ugcuccaagauucua

SEQ ID NO: 1007525 - RNA, 15 nt, Homo sapiens
ugcuccagacaggga

SEQ ID NO: 1007526 - RNA, 20 nt, Homo sapiens
ugcuccagauuagagccugu

SEQ ID NO: 1007527 - RNA, 13 nt, Homo sapiens
ugcucccucagac

SEQ ID NO: 1007528 - RNA, 20 nt, Homo sapiens
ugcuccgaggacccaggaaa

SEQ ID NO: 1007529 - RNA, 21 nt, Homo sapiens
ugcuccgaggacccaggaaag

SEQ ID NO: 1007530 - RNA, 19 nt, Homo sapiens
ugcuccuugggcccuuuga

SEQ ID NO: 1007531 - RNA, 23 nt, Homo sapiens
ugcucugguuguuucuguuccaa

SEQ ID NO: 1007532 - RNA, 14 nt, Homo sapiens
ugcucuugagucuu

SEQ ID NO: 1007533 - RNA, 19 nt, Homo sapiens
ugcucuugagucuuugcag

SEQ ID NO: 1007534 - RNA, 20 nt, Homo sapiens
ugcucuugagucuuugcaga

SEQ ID NO: 1007535 - RNA, 13 nt, Homo sapiens
ugcugaacagugg

SEQ ID NO: 1007536 - RNA, 15 nt, Homo sapiens
ugcugaaugucauuu

SEQ ID NO: 1007537 - RNA, 15 nt, Homo sapiens
ugcugagaaccuggc

SEQ ID NO: 1007538 - RNA, 15 nt, Homo sapiens
ugcugagcauguacu

SEQ ID NO: 1007539 - RNA, 22 nt, Homo sapiens
ugcugauguauuucaagucucu

SEQ ID NO: 1007540 - RNA, 15 nt, Homo sapiens
ugcugcaaacacuua

SEQ ID NO: 1007541 - RNA, 19 nt, Homo sapiens
ugcugccagcuucagguga

SEQ ID NO: 1007542 - RNA, 14 nt, Homo sapiens
ugcugccaugugga

SEQ ID NO: 1007543 - RNA, 18 nt, Homo sapiens
ugcugccgcgcagugugg

SEQ ID NO: 1007544 - RNA, 14 nt, Homo sapiens
ugcuggcauuugca

SEQ ID NO: 1007545 - RNA, 16 nt, Homo sapiens
ugcuguacccaguuuc

SEQ ID NO: 1007546 - RNA, 19 nt, Homo sapiens
ugcuguacccaguuucuaa

SEQ ID NO: 1007547 - RNA, 23 nt, Homo sapiens
ugcugucugggugcuacugggga

SEQ ID NO: 1007548 - RNA, 13 nt, Homo sapiens
ugcugugcuaugg

SEQ ID NO: 1007549 - RNA, 20 nt, Homo sapiens
ugcuuaccucucagccuuag

SEQ ID NO: 1007550 - RNA, 18 nt, Homo sapiens
ugcuuaguguacuuggag

SEQ ID NO: 1007551 - RNA, 13 nt, Homo sapiens
ugcuuccagugua

SEQ ID NO: 1007552 - RNA, 14 nt, Homo sapiens
ugcuuccugucuua

SEQ ID NO: 1007553 - RNA, 21 nt, Homo sapiens
ugcuuuaauauaaaugcaaau

SEQ ID NO: 1007554 - RNA, 13 nt, Homo sapiens
ugcuuucuguucc

SEQ ID NO: 1007555 - RNA, 15 nt, Homo sapiens
ugcuuucuguuccaa

SEQ ID NO: 1007556 - RNA, 18 nt, Homo sapiens
uggaaaacagaacacuua

SEQ ID NO: 1007557 - RNA, 21 nt, Homo sapiens
uggaaagaaguuggggacaca

SEQ ID NO: 1007558 - RNA, 14 nt, Homo sapiens
uggaaauaaaguca

SEQ ID NO: 1007559 - RNA, 21 nt, Homo sapiens
uggaaauaaagucagauggaa

SEQ ID NO: 1007560 - RNA, 15 nt, Homo sapiens
uggaacacggccaca

SEQ ID NO: 1007561 - RNA, 21 nt, Homo sapiens
uggaacacuagacaagccaga

SEQ ID NO: 1007562 - RNA, 18 nt, Homo sapiens
uggaacauuggaauguuc

SEQ ID NO: 1007563 - RNA, 12 nt, Homo sapiens
uggaacuggagg

SEQ ID NO: 1007564 - RNA, 20 nt, Homo sapiens
uguaaagaaaaaagcaccaa

SEQ ID NO: 1007565 - RNA, 20 nt, Homo sapiens
uguaaagacaaaaaacuaua

SEQ ID NO: 1007566 - RNA, 23 nt, Homo sapiens
uguaaaucugccacaaaaacagg

SEQ ID NO: 1007567 - RNA, 15 nt, Homo sapiens
uguaaaugugacauu

SEQ ID NO: 1007568 - RNA, 19 nt, Homo sapiens
uguaacucaaaggguggaa

SEQ ID NO: 1007569 - RNA, 14 nt, Homo sapiens
uguaacugccaggc

SEQ ID NO: 1007570 - RNA, 14 nt, Homo sapiens
uguaagagugauuu

SEQ ID NO: 1007571 - RNA, 15 nt, Homo sapiens
uguaaggcucuagau

SEQ ID NO: 1007572 - RNA, 18 nt, Homo sapiens
uguacaguauguucaaag

SEQ ID NO: 1007573 - RNA, 21 nt, Homo sapiens
uguacaguauguucaaaguca

SEQ ID NO: 1007574 - RNA, 15 nt, Homo sapiens
uguaccugugcacgu

SEQ ID NO: 1007575 - RNA, 13 nt, Homo sapiens
uguacuauuuaac

SEQ ID NO: 1007576 - RNA, 15 nt, Homo sapiens
uguagauucagguaa

SEQ ID NO: 1007577 - RNA, 19 nt, Homo sapiens
uguagcuggggcuuugaug

SEQ ID NO: 1007578 - RNA, 15 nt, Homo sapiens
uguagugcuacaggg

SEQ ID NO: 1007579 - RNA, 23 nt, Homo sapiens
uguaguuccacuuauagccucug

SEQ ID NO: 1007580 - RNA, 14 nt, Homo sapiens
uguaguugaauauu

SEQ ID NO: 1007581 - RNA, 13 nt, Homo sapiens
uguauccaugcac

SEQ ID NO: 1007582 - RNA, 13 nt, Homo sapiens
uguauguggguuu

SEQ ID NO: 1007583 - RNA, 14 nt, Homo sapiens
uguauuuguuccca

SEQ ID NO: 1007584 - RNA, 18 nt, Homo sapiens
ugucaaugaguaauucau

SEQ ID NO: 1007585 - RNA, 19 nt, Homo sapiens
ugucacacgauaaagggau

SEQ ID NO: 1007586 - RNA, 17 nt, Homo sapiens
ugucaccuugcucagcc

SEQ ID NO: 1007587 - RNA, 16 nt, Homo sapiens
ugucagucacagccac

SEQ ID NO: 1007588 - RNA, 14 nt, Homo sapiens
ugucauacagagaa

SEQ ID NO: 1007589 - RNA, 15 nt, Homo sapiens
ugucauccucacagu

SEQ ID NO: 1007590 - RNA, 19 nt, Homo sapiens
ugucauuucucauccacau

SEQ ID NO: 1007591 - RNA, 16 nt, Homo sapiens
ugucauuuuuaucuau

SEQ ID NO: 1007592 - RNA, 21 nt, Homo sapiens
ugucauuuuuuuucuuugaau

SEQ ID NO: 1007593 - RNA, 11 nt, Homo sapiens
uguccaaagag

SEQ ID NO: 1007594 - RNA, 17 nt, Homo sapiens
uguccaggcacugagau

SEQ ID NO: 1007595 - RNA, 19 nt, Homo sapiens
ugucccccuuuagaucucu

SEQ ID NO: 1007596 - RNA, 12 nt, Homo sapiens
uguccuacagaa

SEQ ID NO: 1007597 - RNA, 21 nt, Homo sapiens
uguccuagcacagauggccag

SEQ ID NO: 1007598 - RNA, 18 nt, Homo sapiens
uguccucuuccaccacag

SEQ ID NO: 1007599 - RNA, 17 nt, Homo sapiens
uguccugcccccaagga

SEQ ID NO: 1007600 - RNA, 21 nt, Homo sapiens
uguccuguacauugugggaug

SEQ ID NO: 1007601 - RNA, 18 nt, Homo sapiens
uguccuugugaugugcac

SEQ ID NO: 1007602 - RNA, 19 nt, Homo sapiens
ugucgccaggcuagagugc

SEQ ID NO: 1007603 - RNA, 15 nt, Homo sapiens
ugucuaagauucuag

SEQ ID NO: 1007604 - RNA, 18 nt, Homo sapiens
ugucuacacacccugcau

SEQ ID NO: 1007605 - RNA, 14 nt, Homo sapiens
ugucugacaaccuc

SEQ ID NO: 1007606 - RNA, 13 nt, Homo sapiens
ugucuucagagaa

SEQ ID NO: 1007607 - RNA, 16 nt, Homo sapiens
ugucuuuaaugcaaua

SEQ ID NO: 1007608 - RNA, 16 nt, Homo sapiens
ugugaacccaggacaa

SEQ ID NO: 1007609 - RNA, 16 nt, Homo sapiens
ugugaagcaaacucua

SEQ ID NO: 1007610 - RNA, 16 nt, Homo sapiens
ugugaagcaaggagcu

SEQ ID NO: 1007611 - RNA, 18 nt, Homo sapiens
ugugaagccuuccccuua

SEQ ID NO: 1007612 - RNA, 17 nt, Homo sapiens
ugugaauuaggcuguaa

SEQ ID NO: 1007613 - RNA, 19 nt, Homo sapiens
ugugaauuaggcuguaacu

SEQ ID NO: 1007614 - RNA, 19 nt, Homo sapiens
ugugacauugauuugcucu

SEQ ID NO: 1007615 - RNA, 22 nt, Homo sapiens
cccagcagugccuugugcaaug

SEQ ID NO: 1007616 - RNA, 14 nt, Homo sapiens
cccagcccaaguga

SEQ ID NO: 1007617 - RNA, 23 nt, Homo sapiens
cccaggagaagaaagaggugacc

SEQ ID NO: 1007618 - RNA, 15 nt, Homo sapiens
cccaggcacugcaaa

SEQ ID NO: 1007619 - RNA, 21 nt, Homo sapiens
cccaggcccugcucuuccuca

SEQ ID NO: 1007620 - RNA, 14 nt, Homo sapiens
cccaggcuggagug

SEQ ID NO: 1007621 - RNA, 19 nt, Homo sapiens
cccaggcuggagugcagug

SEQ ID NO: 1007622 - RNA, 23 nt, Homo sapiens
cccaggcuggagugcagugccac

SEQ ID NO: 1007623 - RNA, 17 nt, Homo sapiens
cccagggcagccaggga

SEQ ID NO: 1007624 - RNA, 19 nt, Homo sapiens
cccagggcuccugcacuua

SEQ ID NO: 1007625 - RNA, 17 nt, Homo sapiens
cccagugcccccacuga

SEQ ID NO: 1007626 - RNA, 14 nt, Homo sapiens
cccaguuagcacca

SEQ ID NO: 1007627 - RNA, 23 nt, Homo sapiens
cccauaucugugaaaugcuggca

SEQ ID NO: 1007628 - RNA, 22 nt, Homo sapiens
cccaucgucucggccuucacaa

SEQ ID NO: 1007629 - RNA, 15 nt, Homo sapiens
cccaucuccuuucau

SEQ ID NO: 1007630 - RNA, 14 nt, Homo sapiens
cccaugaacacaga

SEQ ID NO: 1007631 - RNA, 19 nt, Homo sapiens
cccaugaccccaaagccaa

SEQ ID NO: 1007632 - RNA, 20 nt, Homo sapiens
cccauuuuugcuuagcucaa

SEQ ID NO: 1007633 - RNA, 14 nt, Homo sapiens
ccccaagugaccua

SEQ ID NO: 1007634 - RNA, 19 nt, Homo sapiens
ccccacccuggagggccag

SEQ ID NO: 1007635 - RNA, 13 nt, Homo sapiens
ccccaccuccagu

SEQ ID NO: 1007636 - RNA, 11 nt, Homo sapiens
ccccacugaca

SEQ ID NO: 1007637 - RNA, 12 nt, Homo sapiens
ccccagcacuug

SEQ ID NO: 1007638 - RNA, 17 nt, Homo sapiens
ccccagccagggcucaa

SEQ ID NO: 1007639 - RNA, 15 nt, Homo sapiens
ccccagcgauucccu

SEQ ID NO: 1007640 - RNA, 12 nt, Homo sapiens
ccccagcucaau

SEQ ID NO: 1007641 - RNA, 22 nt, Homo sapiens
cccccaguccuguccuaucacu

SEQ ID NO: 1007642 - RNA, 14 nt, Homo sapiens
cccccugucucuca

SEQ ID NO: 1007643 - RNA, 16 nt, Homo sapiens
ccccgacuucauccca

SEQ ID NO: 1007644 - RNA, 18 nt, Homo sapiens
ccccucacucuguuuccu

SEQ ID NO: 1007645 - RNA, 21 nt, Homo sapiens
ccccucccuggaugacauuaa

SEQ ID NO: 1007646 - RNA, 13 nt, Homo sapiens
ccccucucaccaa

SEQ ID NO: 1007647 - RNA, 21 nt, Homo sapiens
ccccucucccuugggcucuga

SEQ ID NO: 1007648 - RNA, 22 nt, Homo sapiens
ccccugaaguauuuuuuaaucc

SEQ ID NO: 1007649 - RNA, 23 nt, Homo sapiens
ccccugagcccaaggcacugaga

SEQ ID NO: 1007650 - RNA, 13 nt, Homo sapiens
ccccuuucccacc

SEQ ID NO: 1007651 - RNA, 17 nt, Homo sapiens
cccgacuggggcagggu

SEQ ID NO: 1007652 - RNA, 18 nt, Homo sapiens
cccgaggaggugucucag

SEQ ID NO: 1007653 - RNA, 15 nt, Homo sapiens
cccgagugagcaugg

SEQ ID NO: 1007654 - RNA, 23 nt, Homo sapiens
cccguggccauuacugcauaaaa

SEQ ID NO: 1007655 - RNA, 23 nt, Homo sapiens
cccguuucauuuagucaugugac

SEQ ID NO: 1007656 - RNA, 21 nt, Homo sapiens
cccuacugaagcccuugugaa

SEQ ID NO: 1007657 - RNA, 11 nt, Homo sapiens
cccuacuggga

SEQ ID NO: 1007658 - RNA, 17 nt, Homo sapiens
cccuauuaaccuagaga

SEQ ID NO: 1007659 - RNA, 17 nt, Homo sapiens
cccucaccccuccaagc

SEQ ID NO: 1007660 - RNA, 18 nt, Homo sapiens
cccucccuggaugacauu

SEQ ID NO: 1007661 - RNA, 20 nt, Homo sapiens
cccucccuggaugacauuaa

SEQ ID NO: 1007662 - RNA, 20 nt, Homo sapiens
cccucccuguuccccagaga

SEQ ID NO: 1007663 - RNA, 17 nt, Homo sapiens
cccuccuaaccuagaga

SEQ ID NO: 1007664 - RNA, 18 nt, Homo sapiens
cccuccuggcucuugaua

SEQ ID NO: 1007665 - RNA, 24 nt, Homo sapiens
cccuccugugucccuuguaaauag

SEQ ID NO: 1007666 - RNA, 15 nt, Homo sapiens
cccucugucuuguga

SEQ ID NO: 1007667 - RNA, 15 nt, Homo sapiens
cccugaccacucaga

SEQ ID NO: 1007668 - RNA, 22 nt, Homo sapiens
cccugaccugugagcccagcug

SEQ ID NO: 1007669 - RNA, 18 nt, Homo sapiens
cccugacgugcagccaca

SEQ ID NO: 1007670 - RNA, 18 nt, Homo sapiens
cccugcaccaugcugcug

SEQ ID NO: 1007671 - RNA, 19 nt, Homo sapiens
cccugcgggugaacaaagc

SEQ ID NO: 1007672 - RNA, 19 nt, Homo sapiens
cccuggccuccccugccac

SEQ ID NO: 1007673 - RNA, 13 nt, Homo sapiens
cccuggcuccuug

SEQ ID NO: 1007674 - RNA, 20 nt, Homo sapiens
cccuggggagucugggcaca

SEQ ID NO: 1007675 - RNA, 21 nt, Homo sapiens
cccuggugggccaacaaagaa

SEQ ID NO: 1007676 - RNA, 17 nt, Homo sapiens
cccuguaccugugcacg

SEQ ID NO: 1007677 - RNA, 18 nt, Homo sapiens
cccugugucugcuguaga

SEQ ID NO: 1007678 - RNA, 21 nt, Homo sapiens
cccuuaaaggggagaccucag

SEQ ID NO: 1007679 - RNA, 20 nt, Homo sapiens
cccuucaguacccucucagc

SEQ ID NO: 1007680 - RNA, 13 nt, Homo sapiens
cccuucuucccua

SEQ ID NO: 1007681 - RNA, 10 nt, Homo sapiens
cccuugccug

SEQ ID NO: 1007682 - RNA, 16 nt, Homo sapiens
cccuuuccccagugac

SEQ ID NO: 1007683 - RNA, 13 nt, Homo sapiens
ccgaaaucagaag

SEQ ID NO: 1007684 - RNA, 19 nt, Homo sapiens
ccgaggcugagaaucagac

SEQ ID NO: 1007685 - RNA, 19 nt, Homo sapiens
ccgcaagaaagcaugacuu

SEQ ID NO: 1007686 - RNA, 19 nt, Homo sapiens
ccgcgcaucagacugugaa

SEQ ID NO: 1007687 - RNA, 22 nt, Homo sapiens
ccgcucuguagugcuacagggu

SEQ ID NO: 1007688 - RNA, 14 nt, Homo sapiens
cuacagaugaguca

SEQ ID NO: 1007689 - RNA, 21 nt, Homo sapiens
cuacaggcgugagccaccaug

SEQ ID NO: 1007690 - RNA, 17 nt, Homo sapiens
cuacaguuuuaacugug

SEQ ID NO: 1007691 - RNA, 17 nt, Homo sapiens
cuacauacguguuccua

SEQ ID NO: 1007692 - RNA, 15 nt, Homo sapiens
cuacauguauugcac

SEQ ID NO: 1007693 - RNA, 9 nt, Homo sapiens
cuaccccag

SEQ ID NO: 1007694 - RNA, 22 nt, Homo sapiens
cuaccuugguucccccacugau

SEQ ID NO: 1007695 - RNA, 14 nt, Homo sapiens
cuacuagagucuga

SEQ ID NO: 1007696 - RNA, 12 nt, Homo sapiens
cuacuguucuaa

SEQ ID NO: 1007697 - RNA, 18 nt, Homo sapiens
cuagaaagagaaacaguu

SEQ ID NO: 1007698 - RNA, 22 nt, Homo sapiens
cuagaaagcugcacuggugcua

SEQ ID NO: 1007699 - RNA, 18 nt, Homo sapiens
cuagagaucuggcugugg

SEQ ID NO: 1007700 - RNA, 19 nt, Homo sapiens
cuagagcaagcaggaauca

SEQ ID NO: 1007701 - RNA, 20 nt, Homo sapiens
cuagagugcgguggcgcgau

SEQ ID NO: 1007702 - RNA, 19 nt, Homo sapiens
cuagaugauggaugccaau

SEQ ID NO: 1007703 - RNA, 17 nt, Homo sapiens
cuagauuuaacucaguu

SEQ ID NO: 1007704 - RNA, 14 nt, Homo sapiens
cuagccaaaccuca

SEQ ID NO: 1007705 - RNA, 15 nt, Homo sapiens
cuagccucagggguc

SEQ ID NO: 1007706 - RNA, 14 nt, Homo sapiens
cuagccuugcuugu

SEQ ID NO: 1007707 - RNA, 22 nt, Homo sapiens
cuagccuuggccucuuuccuca

SEQ ID NO: 1007708 - RNA, 19 nt, Homo sapiens
cuaggaaaaucacuugcca

SEQ ID NO: 1007709 - RNA, 16 nt, Homo sapiens
cuaggaaauccauuca

SEQ ID NO: 1007710 - RNA, 19 nt, Homo sapiens
cuaggaucagaauaucaca

SEQ ID NO: 1007711 - RNA, 14 nt, Homo sapiens
cuagggagccauuu

SEQ ID NO: 1007712 - RNA, 16 nt, Homo sapiens
cuagggagccauuuga

SEQ ID NO: 1007713 - RNA, 14 nt, Homo sapiens
cuagggaucccuca

SEQ ID NO: 1007714 - RNA, 15 nt, Homo sapiens
cuagggaucccucau

SEQ ID NO: 1007715 - RNA, 17 nt, Homo sapiens
cuagguaggggcccacu

SEQ ID NO: 1007716 - RNA, 17 nt, Homo sapiens
cuagguuuuauucauac

SEQ ID NO: 1007717 - RNA, 17 nt, Homo sapiens
cuaguacuaugucaaag

SEQ ID NO: 1007718 - RNA, 16 nt, Homo sapiens
cuagucaaugacauga

SEQ ID NO: 1007719 - RNA, 18 nt, Homo sapiens
cuagucacgcaugcagug

SEQ ID NO: 1007720 - RNA, 18 nt, Homo sapiens
cuauaaggccauaaaaca

SEQ ID NO: 1007721 - RNA, 21 nt, Homo sapiens
cuauaauuuugccuuuaacag

SEQ ID NO: 1007722 - RNA, 18 nt, Homo sapiens
cuauauugcuuaccugau

SEQ ID NO: 1007723 - RNA, 14 nt, Homo sapiens
cuauccaaucaauc

SEQ ID NO: 1007724 - RNA, 14 nt, Homo sapiens
cuaucucuacugaa

SEQ ID NO: 1007725 - RNA, 20 nt, Homo sapiens
cuaucuguguggugaugaau

SEQ ID NO: 1007726 - RNA, 12 nt, Homo sapiens
cuaugagucuag

SEQ ID NO: 1007727 - RNA, 14 nt, Homo sapiens
cuauguaacaugua

SEQ ID NO: 1007728 - RNA, 18 nt, Homo sapiens
cuauguagcaauauauca

SEQ ID NO: 1007729 - RNA, 22 nt, Homo sapiens
cuauguuuuuguucaaagccag

SEQ ID NO: 1007730 - RNA, 23 nt, Homo sapiens
cuauuaaaaagguuuacagaauu

SEQ ID NO: 1007731 - RNA, 12 nt, Homo sapiens
cuauuaucucaa

SEQ ID NO: 1007732 - RNA, 13 nt, Homo sapiens
cuauucugucccu

SEQ ID NO: 1007733 - RNA, 17 nt, Homo sapiens
cuauucuugauguaaaa

SEQ ID NO: 1007734 - RNA, 17 nt, Homo sapiens
cuauuucuccaaagccu

SEQ ID NO: 1007735 - RNA, 20 nt, Homo sapiens
cuauuuguaaaucugccaca

SEQ ID NO: 1007736 - RNA, 21 nt, Homo sapiens
cucaaaauuuaacaguuaccu

SEQ ID NO: 1007737 - RNA, 22 nt, Homo sapiens
cucaaacuccugaccucaggca

SEQ ID NO: 1007738 - RNA, 23 nt, Homo sapiens
cucaaacuccugaccucaggcaa

SEQ ID NO: 1007739 - RNA, 20 nt, Homo sapiens
cucaaauggggccagaucca

SEQ ID NO: 1007740 - RNA, 20 nt, Homo sapiens
cucaaccccuccccuccauc

SEQ ID NO: 1007741 - RNA, 19 nt, Homo sapiens
cucaagguuuuagguucua

SEQ ID NO: 1007742 - RNA, 23 nt, Homo sapiens
cucaauaaaguuccccugugaca

SEQ ID NO: 1007743 - RNA, 13 nt, Homo sapiens
cucaauaauuucc

SEQ ID NO: 1007744 - RNA, 19 nt, Homo sapiens
cucaaucccugaggacuga

SEQ ID NO: 1007745 - RNA, 14 nt, Homo sapiens
cucaaugccaguaa

SEQ ID NO: 1007746 - RNA, 19 nt, Homo sapiens
cucacagagugcauuguga

SEQ ID NO: 1007747 - RNA, 21 nt, Homo sapiens
cucacagagugcauugugagg

SEQ ID NO: 1007748 - RNA, 14 nt, Homo sapiens
cucaccaaacacaa

SEQ ID NO: 1007749 - RNA, 16 nt, Homo sapiens
cucaccccuccaagcu

SEQ ID NO: 1007750 - RNA, 20 nt, Homo sapiens
cucacucccucccuuucuau

SEQ ID NO: 1007751 - RNA, 18 nt, Homo sapiens
cucacugcaaccuccacc

SEQ ID NO: 1007752 - RNA, 23 nt, Homo sapiens
cucacugcugcaaauacuguaua

SEQ ID NO: 1007753 - RNA, 17 nt, Homo sapiens
cucagccccuuucccuu

SEQ ID NO: 1007754 - RNA, 21 nt, Homo sapiens
cucagccuugccagagaucca

SEQ ID NO: 1007755 - RNA, 22 nt, Homo sapiens
cucagcuaagcucacguccuga

SEQ ID NO: 1007756 - RNA, 23 nt, Homo sapiens
cucaggaaacgagacuuuccauu

SEQ ID NO: 1007757 - RNA, 16 nt, Homo sapiens
cucaggcaaucugccc

SEQ ID NO: 1007758 - RNA, 20 nt, Homo sapiens
cucagggcagcgccaggcug

SEQ ID NO: 1007759 - RNA, 15 nt, Homo sapiens
cucagguguugccaa

SEQ ID NO: 1007760 - RNA, 19 nt, Homo sapiens
cucagugaaguugcugcuu

SEQ ID NO: 1007761 - RNA, 17 nt, Homo sapiens
cucaguucccucuugcu

SEQ ID NO: 1007762 - RNA, 22 nt, Homo sapiens
cucaguuuccucaccagaaaaa

SEQ ID NO: 1007763 - RNA, 18 nt, Homo sapiens
cucaguuugugugucuua

SEQ ID NO: 1007764 - RNA, 19 nt, Homo sapiens
cucaguuugugugucuuaa

SEQ ID NO: 1007765 - RNA, 17 nt, Homo sapiens
cucaucccgagcaccuc

SEQ ID NO: 1007766 - RNA, 23 nt, Homo sapiens
cucauggguggcacucagucucu

SEQ ID NO: 1007767 - RNA, 14 nt, Homo sapiens
cuccaaagucauaa

SEQ ID NO: 1007768 - RNA, 13 nt, Homo sapiens
cuccaagcagcuu

SEQ ID NO: 1007769 - RNA, 14 nt, Homo sapiens
cuccaaugccuacu

SEQ ID NO: 1007770 - RNA, 17 nt, Homo sapiens
cuccaccuccuccagac

SEQ ID NO: 1007771 - RNA, 15 nt, Homo sapiens
cuccaccuccugggu

SEQ ID NO: 1007772 - RNA, 14 nt, Homo sapiens
cuccaggauuuccu

SEQ ID NO: 1007773 - RNA, 22 nt, Homo sapiens
cuccaggcaggucugaagcuca

SEQ ID NO: 1007774 - RNA, 19 nt, Homo sapiens
cuccaguguccugagcuca

SEQ ID NO: 1007775 - RNA, 19 nt, Homo sapiens
cuccauguagaagccacua

SEQ ID NO: 1007776 - RNA, 18 nt, Homo sapiens
cucccaacucuugcacag

SEQ ID NO: 1007777 - RNA, 21 nt, Homo sapiens
cucccacagucccaucugcuu

SEQ ID NO: 1007778 - RNA, 21 nt, Homo sapiens
cucccacucuccuaggcauuc

SEQ ID NO: 1007779 - RNA, 22 nt, Homo sapiens
cucccagaggagccaccaguuc

SEQ ID NO: 1007780 - RNA, 15 nt, Homo sapiens
cucccagcauaggau

SEQ ID NO: 1007781 - RNA, 20 nt, Homo sapiens
cuccccacuuguccgcuggg

SEQ ID NO: 1007782 - RNA, 21 nt, Homo sapiens
cuccccagaugugacuacuga

SEQ ID NO: 1007783 - RNA, 15 nt, Homo sapiens
cuccccugcacugua

SEQ ID NO: 1007784 - RNA, 24 nt, Homo sapiens
cucccucuuucuucccaugacccc

SEQ ID NO: 1007785 - RNA, 16 nt, Homo sapiens
cucccuggaugacauu

SEQ ID NO: 1007786 - RNA, 18 nt, Homo sapiens
cucccuugggcacgugug

SEQ ID NO: 1007787 - RNA, 20 nt, Homo sapiens
cuccgagaggugggccaguc

SEQ ID NO: 1007788 - RNA, 17 nt, Homo sapiens
cuccuaaaguacuggga

SEQ ID NO: 1007789 - RNA, 19 nt, Homo sapiens
cuccucaggcacacagcua

SEQ ID NO: 1007790 - RNA, 21 nt, Homo sapiens
cuccucaggcacacagcuacu

SEQ ID NO: 1007791 - RNA, 12 nt, Homo sapiens
ccuguugggaga

SEQ ID NO: 1007792 - RNA, 15 nt, Homo sapiens
ccuguugucaagaau

SEQ ID NO: 1007793 - RNA, 17 nt, Homo sapiens
ccuuaaaccugcaaaau

SEQ ID NO: 1007794 - RNA, 19 nt, Homo sapiens
ccuuagaaaacaaguauug

SEQ ID NO: 1007795 - RNA, 23 nt, Homo sapiens
ccuuagauguucuaagucuuucc

SEQ ID NO: 1007796 - RNA, 19 nt, Homo sapiens
ccuuagccuaggccuaguc

SEQ ID NO: 1007797 - RNA, 21 nt, Homo sapiens
ccuucaguaaaugugauucac

SEQ ID NO: 1007798 - RNA, 12 nt, Homo sapiens
ccuuccacugag

SEQ ID NO: 1007799 - RNA, 17 nt, Homo sapiens
ccuuccacuuccaucug

SEQ ID NO: 1007800 - RNA, 18 nt, Homo sapiens
ccuuccagcuagugaccc

SEQ ID NO: 1007801 - RNA, 16 nt, Homo sapiens
ccuucccuccaagaag

SEQ ID NO: 1007802 - RNA, 15 nt, Homo sapiens
ccuucuaggucacuu

SEQ ID NO: 1007803 - RNA, 18 nt, Homo sapiens
ccuucuauuuggggcuug

SEQ ID NO: 1007804 - RNA, 19 nt, Homo sapiens
ccuucuccauccacauggg

SEQ ID NO: 1007805 - RNA, 18 nt, Homo sapiens
ccuucucccucgacauuu

SEQ ID NO: 1007806 - RNA, 21 nt, Homo sapiens
ccuucugguguuggacaagcu

SEQ ID NO: 1007807 - RNA, 13 nt, Homo sapiens
ccuucuucaggga

SEQ ID NO: 1007808 - RNA, 23 nt, Homo sapiens
ccuucuuuugggggucaacaguu

SEQ ID NO: 1007809 - RNA, 19 nt, Homo sapiens
ccuugauuuaucacacaaa

SEQ ID NO: 1007810 - RNA, 18 nt, Homo sapiens
ccuugccaauagugucau

SEQ ID NO: 1007811 - RNA, 21 nt, Homo sapiens
ccuuggguuagaccuacaggg

SEQ ID NO: 1007812 - RNA, 19 nt, Homo sapiens
ccuugguucccccacugau

SEQ ID NO: 1007813 - RNA, 14 nt, Homo sapiens
ccuugugaugucau

SEQ ID NO: 1007814 - RNA, 22 nt, Homo sapiens
ccuuguggcugagaacuggaca

SEQ ID NO: 1007815 - RNA, 19 nt, Homo sapiens
ccuuuaugcagagccacag

SEQ ID NO: 1007816 - RNA, 17 nt, Homo sapiens
ccuuucacuaaaacaca

SEQ ID NO: 1007817 - RNA, 16 nt, Homo sapiens
ccuuucuucaccaaau

SEQ ID NO: 1007818 - RNA, 16 nt, Homo sapiens
ccuuugugagucaaua

SEQ ID NO: 1007819 - RNA, 14 nt, Homo sapiens
ccuuuugauauuaa

SEQ ID NO: 1007820 - RNA, 11 nt, Homo sapiens
ccuuuugcaac

SEQ ID NO: 1007821 - RNA, 20 nt, Homo sapiens
ccuuuuuuccccagacuugu

SEQ ID NO: 1007822 - RNA, 16 nt, Homo sapiens
ccuuuuuugcaugugc

SEQ ID NO: 1007823 - RNA, 17 nt, Homo sapiens
cgaaacacacaaaccag

SEQ ID NO: 1007824 - RNA, 16 nt, Homo sapiens
cgaacaauucauauau

SEQ ID NO: 1007825 - RNA, 21 nt, Homo sapiens
cgaacaauucauauauuugaa

SEQ ID NO: 1007826 - RNA, 22 nt, Homo sapiens
cgaacuauuuucaaagacuuaa

SEQ ID NO: 1007827 - RNA, 17 nt, Homo sapiens
cgacuggggcagggugu

SEQ ID NO: 1007828 - RNA, 14 nt, Homo sapiens
cgacuucaucccaa

SEQ ID NO: 1007829 - RNA, 16 nt, Homo sapiens
cgaggacccaggaaag

SEQ ID NO: 1007830 - RNA, 10 nt, Homo sapiens
cgaguacuuc

SEQ ID NO: 1007831 - RNA, 14 nt, Homo sapiens
cgauaaagggauuu

SEQ ID NO: 1007832 - RNA, 13 nt, Homo sapiens
cgcaccugccuca

SEQ ID NO: 1007833 - RNA, 13 nt, Homo sapiens
cgcauuuccugag

SEQ ID NO: 1007834 - RNA, 22 nt, Homo sapiens
cgccuguggacagccugaguca

SEQ ID NO: 1007835 - RNA, 15 nt, Homo sapiens
cgcuagcauuuccca

SEQ ID NO: 1007836 - RNA, 17 nt, Homo sapiens
cgcuagccaagaaccua

SEQ ID NO: 1007837 - RNA, 17 nt, Homo sapiens
cgcuccaaugccuacug

SEQ ID NO: 1007838 - RNA, 22 nt, Homo sapiens
cgcugagcgaggagaugcuccu

SEQ ID NO: 1007839 - RNA, 21 nt, Homo sapiens
cgcugcugucacaaccaagaa

SEQ ID NO: 1007840 - RNA, 14 nt, Homo sapiens
cgcugggugguacc

SEQ ID NO: 1007841 - RNA, 21 nt, Homo sapiens
cggaaggagggagcucugaug

SEQ ID NO: 1007842 - RNA, 13 nt, Homo sapiens
cggagcacugcac

SEQ ID NO: 1007843 - RNA, 23 nt, Homo sapiens
cggauuugcucaggccugggaau

SEQ ID NO: 1007844 - RNA, 17 nt, Homo sapiens
cggcaacaucaacccga

SEQ ID NO: 1007845 - RNA, 18 nt, Homo sapiens
cggccucucaguucuuga

SEQ ID NO: 1007846 - RNA, 14 nt, Homo sapiens
cggcucacugcaac

SEQ ID NO: 1007847 - RNA, 14 nt, Homo sapiens
cggcuccucaggga

SEQ ID NO: 1007848 - RNA, 18 nt, Homo sapiens
cggggccagcacuuccau

SEQ ID NO: 1007849 - RNA, 20 nt, Homo sapiens
cgggugguccgggaagugag

SEQ ID NO: 1007850 - RNA, 14 nt, Homo sapiens
cggugcucaggggg

SEQ ID NO: 1007851 - RNA, 22 nt, Homo sapiens
cggugcuugauagaaaugccaa

SEQ ID NO: 1007852 - RNA, 14 nt, Homo sapiens
cgguuaccucugca

SEQ ID NO: 1007853 - RNA, 13 nt, Homo sapiens
cguccuacuguau

SEQ ID NO: 1007854 - RNA, 23 nt, Homo sapiens
cgucuuccugaguggugccaaac

SEQ ID NO: 1007855 - RNA, 16 nt, Homo sapiens
cguggauugcacgugg

SEQ ID NO: 1007856 - RNA, 22 nt, Homo sapiens
cguuucuccaccuagacuguaa

SEQ ID NO: 1007857 - RNA, 16 nt, Homo sapiens
cguuucugguggucug

SEQ ID NO: 1007858 - RNA, 14 nt, Homo sapiens
cuaaaaaaaugcaa

SEQ ID NO: 1007859 - RNA, 18 nt, Homo sapiens
cuaaaagugggcuugauu

SEQ ID NO: 1007860 - RNA, 18 nt, Homo sapiens
cuaaaauucacuuagggu

SEQ ID NO: 1007861 - RNA, 22 nt, Homo sapiens
cuaaaauuguaucaaaugugac

SEQ ID NO: 1007862 - RNA, 18 nt, Homo sapiens
cuaaagucuguugauuaa

SEQ ID NO: 1007863 - RNA, 12 nt, Homo sapiens
cuaaaguucuaa

SEQ ID NO: 1007864 - RNA, 16 nt, Homo sapiens
cuaaauaccucaauca

SEQ ID NO: 1007865 - RNA, 18 nt, Homo sapiens
cuaaauccuuuacuguua

SEQ ID NO: 1007866 - RNA, 21 nt, Homo sapiens
cuaaaugcacagucaugugcc

SEQ ID NO: 1007867 - RNA, 16 nt, Homo sapiens
cuaacaaugacauuua

SEQ ID NO: 1007868 - RNA, 22 nt, Homo sapiens
cuaacaaugacauuuauaucac

SEQ ID NO: 1007869 - RNA, 15 nt, Homo sapiens
cuaacaggccaaaga

SEQ ID NO: 1007870 - RNA, 15 nt, Homo sapiens
cuaacaguggacaaa

SEQ ID NO: 1007871 - RNA, 19 nt, Homo sapiens
cuaacauaggugaacgugu

SEQ ID NO: 1007872 - RNA, 12 nt, Homo sapiens
cuaaccaagaga

SEQ ID NO: 1007873 - RNA, 15 nt, Homo sapiens
cuaaccauguguuau

SEQ ID NO: 1007874 - RNA, 18 nt, Homo sapiens
cuaacccucacaagcaug

SEQ ID NO: 1007875 - RNA, 22 nt, Homo sapiens
cuaacccuuugugugcucucca

SEQ ID NO: 1007876 - RNA, 15 nt, Homo sapiens
cuaacuagcauugua

SEQ ID NO: 1007877 - RNA, 17 nt, Homo sapiens
cuaacuucaaggcccau

SEQ ID NO: 1007878 - RNA, 16 nt, Homo sapiens
cuaagagaacaaugug

SEQ ID NO: 1007879 - RNA, 22 nt, Homo sapiens
cuaagaggcugcccuccugugc

SEQ ID NO: 1007880 - RNA, 20 nt, Homo sapiens
cuaaggcucugagagucuag

SEQ ID NO: 1007881 - RNA, 18 nt, Homo sapiens
cuaagguuuagauaaaua

SEQ ID NO: 1007882 - RNA, 18 nt, Homo sapiens
cuaaguauauuaauauca

SEQ ID NO: 1007883 - RNA, 14 nt, Homo sapiens
cuaauaaacugugu

SEQ ID NO: 1007884 - RNA, 16 nt, Homo sapiens
cuaauaacaugugaaa

SEQ ID NO: 1007885 - RNA, 23 nt, Homo sapiens
cuaauccaccccaauccucccag

SEQ ID NO: 1007886 - RNA, 22 nt, Homo sapiens
cuaaugauuuagugaucaaauu

SEQ ID NO: 1007887 - RNA, 15 nt, Homo sapiens
cuaauguugacuuua

SEQ ID NO: 1007888 - RNA, 22 nt, Homo sapiens
cuaauuauguagcucuuuguca

SEQ ID NO: 1007889 - RNA, 16 nt, Homo sapiens
cuaauuuuuaagaauu

SEQ ID NO: 1007890 - RNA, 14 nt, Homo sapiens
cuacacacaguacg

SEQ ID NO: 1007891 - RNA, 16 nt, Homo sapiens
cuacacguaaguauaa

SEQ ID NO: 1007892 - RNA, 14 nt, Homo sapiens
cuacagagaagccu

SEQ ID NO: 1007893 - RNA, 16 nt, Homo sapiens
cuacagagaagccuuc

SEQ ID NO: 1007894 - RNA, 23 nt, Homo sapiens
gaauguagcccuuccaacaccug

SEQ ID NO: 1007895 - RNA, 12 nt, Homo sapiens
gaaugugucuuu

SEQ ID NO: 1007896 - RNA, 14 nt, Homo sapiens
gaauucuuggggcu

SEQ ID NO: 1007897 - RNA, 16 nt, Homo sapiens
gaauuuaaacaaugca

SEQ ID NO: 1007898 - RNA, 23 nt, Homo sapiens
gaauuuccucaucccuccaucuc

SEQ ID NO: 1007899 - RNA, 15 nt, Homo sapiens
gaauuuuauaaucug

SEQ ID NO: 1007900 - RNA, 16 nt, Homo sapiens
gaauuuuuaaacaagu

SEQ ID NO: 1007901 - RNA, 18 nt, Homo sapiens
gacaaaggagccugugaa

SEQ ID NO: 1007902 - RNA, 19 nt, Homo sapiens
gacaacacguuacuagcag

SEQ ID NO: 1007903 - RNA, 18 nt, Homo sapiens
gacaacauuucuauagcc

SEQ ID NO: 1007904 - RNA, 16 nt, Homo sapiens
gacaacugcucccacc

SEQ ID NO: 1007905 - RNA, 19 nt, Homo sapiens
gacaagacccccagcacuu

SEQ ID NO: 1007906 - RNA, 20 nt, Homo sapiens
gacaagacccccagcacuug

SEQ ID NO: 1007907 - RNA, 21 nt, Homo sapiens
gagcuagaacccucuguuccu

SEQ ID NO: 1007908 - RNA, 16 nt, Homo sapiens
gagcuggggaucccuc

SEQ ID NO: 1007909 - RNA, 15 nt, Homo sapiens
gaggaaauucuuucc

SEQ ID NO: 1007910 - RNA, 17 nt, Homo sapiens
gaggaagacaggcaaau

SEQ ID NO: 1007911 - RNA, 13 nt, Homo sapiens
gaggacucaccac

SEQ ID NO: 1007912 - RNA, 16 nt, Homo sapiens
gaggacucaccacugc

SEQ ID NO: 1007913 - RNA, 20 nt, Homo sapiens
gaggagcccacgacacugca

SEQ ID NO: 1007914 - RNA, 13 nt, Homo sapiens
gaggaguaacaau

SEQ ID NO: 1007915 - RNA, 14 nt, Homo sapiens
gaggcaaugggagc

SEQ ID NO: 1007916 - RNA, 20 nt, Homo sapiens
gaggcaggagaaucacuuga

SEQ ID NO: 1007917 - RNA, 10 nt, Homo sapiens
gaggcauuuc

SEQ ID NO: 1007918 - RNA, 14 nt, Homo sapiens
gcaccaugcugcug

SEQ ID NO: 1007919 - RNA, 19 nt, Homo sapiens
gcacccuaguucuaccuca

SEQ ID NO: 1007920 - RNA, 12 nt, Homo sapiens
gcaccuaccuca

SEQ ID NO: 1007921 - RNA, 13 nt, Homo sapiens
gcaccuaccucac

SEQ ID NO: 1007922 - RNA, 11 nt, Homo sapiens
gcaccuggcau

SEQ ID NO: 1007923 - RNA, 17 nt, Homo sapiens
gcaccuguaaugugcga

SEQ ID NO: 1007924 - RNA, 21 nt, Homo sapiens
gcacuacauucauuuagcuaa

SEQ ID NO: 1007925 - RNA, 20 nt, Homo sapiens
gcacugaugcugccccucau

SEQ ID NO: 1007926 - RNA, 22 nt, Homo sapiens
gcacuggggagcccgucucagu

SEQ ID NO: 1007927 - RNA, 20 nt, Homo sapiens
gcacuguucccccugugcag

SEQ ID NO: 1007928 - RNA, 23 nt, Homo sapiens
gcacuuauaagaaagaucaaaga

SEQ ID NO: 1007929 - RNA, 13 nt, Homo sapiens
gcagaccacugau

SEQ ID NO: 1007930 - RNA, 17 nt, Homo sapiens
gcagagcauucagacuc

SEQ ID NO: 1007931 - RNA, 21 nt, Homo sapiens
gcagagccacagcugugcaug

SEQ ID NO: 1007932 - RNA, 12 nt, Homo sapiens
gcagagcuggug

SEQ ID NO: 1007933 - RNA, 20 nt, Homo sapiens
gcagaggcccaggcugccgu

SEQ ID NO: 1007934 - RNA, 19 nt, Homo sapiens
gcagcaccguucugugcac

SEQ ID NO: 1007935 - RNA, 20 nt, Homo sapiens
gcagcaccguucugugcaca

SEQ ID NO: 1007936 - RNA, 19 nt, Homo sapiens
gcagccacgaggugcaaca

SEQ ID NO: 1007937 - RNA, 20 nt, Homo sapiens
gcagcuuagacuaaggccau

SEQ ID NO: 1007938 - RNA, 18 nt, Homo sapiens
gcaggaaaugaaaauguc

SEQ ID NO: 1007939 - RNA, 22 nt, Homo sapiens
gcaggaaggagcugccuggacc

SEQ ID NO: 1007940 - RNA, 18 nt, Homo sapiens
gcaggaguagcugagcuc

SEQ ID NO: 1007941 - RNA, 19 nt, Homo sapiens
gcaggaucucaccaggcag

SEQ ID NO: 1007942 - RNA, 14 nt, Homo sapiens
gcaggcugggccau

SEQ ID NO: 1007943 - RNA, 15 nt, Homo sapiens
gcaggcugggccaug

SEQ ID NO: 1007944 - RNA, 23 nt, Homo sapiens
gcaggcugggccauguccaaaga

SEQ ID NO: 1007945 - RNA, 16 nt, Homo sapiens
gcagucacucuaguca

SEQ ID NO: 1007946 - RNA, 16 nt, Homo sapiens
gcagugccuugugcaa

SEQ ID NO: 1007947 - RNA, 20 nt, Homo sapiens
gcaguguggaggccacuguu

SEQ ID NO: 1007948 - RNA, 22 nt, Homo sapiens
gcaguucgcagccacccugagg

SEQ ID NO: 1007949 - RNA, 22 nt, Homo sapiens
gcaguugaaacaagaagccaca

SEQ ID NO: 1007950 - RNA, 13 nt, Homo sapiens
gcauaaccugucu

SEQ ID NO: 1007951 - RNA, 16 nt, Homo sapiens
gcauaaguuucuggga

SEQ ID NO: 1007952 - RNA, 21 nt, Homo sapiens
gcauaaguuucugggaccuca

SEQ ID NO: 1007953 - RNA, 20 nt, Homo sapiens
gcauacgguaugauauugca

SEQ ID NO: 1007954 - RNA, 16 nt, Homo sapiens
gcauacuuucccucau

SEQ ID NO: 1007955 - RNA, 21 nt, Homo sapiens
gcauagggucuggaacaccag

SEQ ID NO: 1007956 - RNA, 19 nt, Homo sapiens
gcauaggugauccauguaa

SEQ ID NO: 1007957 - RNA, 13 nt, Homo sapiens
gcauaugaguaag

SEQ ID NO: 1007958 - RNA, 16 nt, Homo sapiens
gcaucacagaauguga

SEQ ID NO: 1007959 - RNA, 12 nt, Homo sapiens
gcaucacuuaac

SEQ ID NO: 1007960 - RNA, 22 nt, Homo sapiens
gcaucacuuaacggaccaaagc

SEQ ID NO: 1007961 - RNA, 22 nt, Homo sapiens
gcauccucuuuuuccaacuugg

SEQ ID NO: 1007962 - RNA, 19 nt, Homo sapiens
gcaugcccagagacccagc

SEQ ID NO: 1007963 - RNA, 16 nt, Homo sapiens
gcauggaacacuucga

SEQ ID NO: 1007964 - RNA, 13 nt, Homo sapiens
gcauuaaauucac

SEQ ID NO: 1007965 - RNA, 19 nt, Homo sapiens
gcauucuucugagcacugu

SEQ ID NO: 1007966 - RNA, 12 nt, Homo sapiens
gcauugcacuug

SEQ ID NO: 1007967 - RNA, 20 nt, Homo sapiens
gcauuuagacccugcauuua

SEQ ID NO: 1007968 - RNA, 21 nt, Homo sapiens
gcauuuuauaggcauaccucc

SEQ ID NO: 1007969 - RNA, 14 nt, Homo sapiens
gccaaaaauagcua

SEQ ID NO: 1007970 - RNA, 14 nt, Homo sapiens
gccaagacugcugu

SEQ ID NO: 1007971 - RNA, 19 nt, Homo sapiens
gccaagggaaccugugucc

SEQ ID NO: 1007972 - RNA, 14 nt, Homo sapiens
gccaauagugucau

SEQ ID NO: 1007973 - RNA, 13 nt, Homo sapiens
gccaauauaacua

SEQ ID NO: 1007974 - RNA, 11 nt, Homo sapiens
gccacauggga

SEQ ID NO: 1007975 - RNA, 23 nt, Homo sapiens
gccaccucccuauacugcuugga

SEQ ID NO: 1007976 - RNA, 12 nt, Homo sapiens
gccaccuggacc

SEQ ID NO: 1007977 - RNA, 16 nt, Homo sapiens
gccacgaggugcaaca

SEQ ID NO: 1007978 - RNA, 16 nt, Homo sapiens
gccacuauuacuggga

SEQ ID NO: 1007979 - RNA, 21 nt, Homo sapiens
gccacucuuagcuaaaucccu

SEQ ID NO: 1007980 - RNA, 15 nt, Homo sapiens
gccagacaugccaca

SEQ ID NO: 1007981 - RNA, 14 nt, Homo sapiens
gccagccucuagag

SEQ ID NO: 1007982 - RNA, 14 nt, Homo sapiens
gccagcuacuuccu

SEQ ID NO: 1007983 - RNA, 21 nt, Homo sapiens
gccagcucuaaacaagucccu

SEQ ID NO: 1007984 - RNA, 22 nt, Homo sapiens
gccagugcaagaccgagauuga

SEQ ID NO: 1007985 - RNA, 20 nt, Homo sapiens
gccauauuuguaaaaugaca

SEQ ID NO: 1007986 - RNA, 18 nt, Homo sapiens
gccaucaaaaugcuuuuu

SEQ ID NO: 1007987 - RNA, 12 nt, Homo sapiens
gccaucaccuca

SEQ ID NO: 1007988 - RNA, 14 nt, Homo sapiens
gccauguccaaaga

SEQ ID NO: 1007989 - RNA, 21 nt, Homo sapiens
gccauuacugcauaaaauaga

SEQ ID NO: 1007990 - RNA, 13 nt, Homo sapiens
gccauuuguacug

SEQ ID NO: 1007991 - RNA, 12 nt, Homo sapiens
gcccaaggcacu

SEQ ID NO: 1007992 - RNA, 19 nt, Homo sapiens
gcccacuguccugggccug

SEQ ID NO: 1007993 - RNA, 22 nt, Homo sapiens
gcccacuucaccguacuaacca

SEQ ID NO: 1007994 - RNA, 17 nt, Homo sapiens
gcccagagcccagcucc

SEQ ID NO: 1007995 - RNA, 16 nt, Homo sapiens
gcccagcgcagugccu

SEQ ID NO: 1007996 - RNA, 19 nt, Homo sapiens
gcccaggcuggagugcagu

SEQ ID NO: 1007997 - RNA, 14 nt, Homo sapiens
gcccauaucuguga

SEQ ID NO: 1007998 - RNA, 18 nt, Homo sapiens
gcccauccccaggcaccu

SEQ ID NO: 1007999 - RNA, 13 nt, Homo sapiens
gcccauggcauuu

SEQ ID NO: 1008000 - RNA, 20 nt, Homo sapiens
gccccaacuccuuccagcua

SEQ ID NO: 1008001 - RNA, 14 nt, Homo sapiens
gccccacuccuucc

SEQ ID NO: 1008002 - RNA, 17 nt, Homo sapiens
gccccagcagugccuug

SEQ ID NO: 1008003 - RNA, 18 nt, Homo sapiens
gccccagccagggcucaa

SEQ ID NO: 1008004 - RNA, 19 nt, Homo sapiens
gccccaggcauugccaagg

SEQ ID NO: 1008005 - RNA, 21 nt, Homo sapiens
gcccccaccgugggcagggag

SEQ ID NO: 1008006 - RNA, 13 nt, Homo sapiens
gcccccagccugu

SEQ ID NO: 1008007 - RNA, 20 nt, Homo sapiens
gcccccugcaggaaggagcu

SEQ ID NO: 1008008 - RNA, 15 nt, Homo sapiens
gccccuccuaguucu

SEQ ID NO: 1008009 - RNA, 17 nt, Homo sapiens
gccccucugaccugcac

SEQ ID NO: 1008010 - RNA, 22 nt, Homo sapiens
gccccugggguggccaccagua

SEQ ID NO: 1008011 - RNA, 23 nt, Homo sapiens
gcccguguaaauauguacauuuc

SEQ ID NO: 1008012 - RNA, 13 nt, Homo sapiens
gcccuccaggcuu

SEQ ID NO: 1008013 - RNA, 17 nt, Homo sapiens
ggcuggccgcugugcca

SEQ ID NO: 1008014 - RNA, 15 nt, Homo sapiens
gcuguuugacaccuc

SEQ ID NO: 1008015 - RNA, 16 nt, Homo sapiens
gcuuaguuuguguguu

SEQ ID NO: 1008016 - RNA, 17 nt, Homo sapiens
gcuuauuuaagaucaca

SEQ ID NO: 1008017 - RNA, 22 nt, Homo sapiens
ucagcuccugaccaguugcagu

SEQ ID NO: 1008018 - RNA, 12 nt, Homo sapiens
ucagcucugagg

SEQ ID NO: 1008019 - RNA, 21 nt, Homo sapiens
ucagcucugaggauguauacc

SEQ ID NO: 1008020 - RNA, 17 nt, Homo sapiens
ucagcugagguuugcac

SEQ ID NO: 1008021 - RNA, 19 nt, Homo sapiens
ucagcugcaagguacucug

SEQ ID NO: 1008022 - RNA, 19 nt, Homo sapiens
ucagcuuugggguuccuuu

SEQ ID NO: 1008023 - RNA, 18 nt, Homo sapiens
ucaggaaggggugugcug

SEQ ID NO: 1008024 - RNA, 22 nt, Homo sapiens
ucaggauccaagcuaagcacug

SEQ ID NO: 1008025 - RNA, 13 nt, Homo sapiens
ucaggcacacagc

SEQ ID NO: 1008026 - RNA, 15 nt, Homo sapiens
ucaggcacacagcua

SEQ ID NO: 1008027 - RNA, 17 nt, Homo sapiens
ucaggcacacagcuacu

SEQ ID NO: 1008028 - RNA, 17 nt, Homo sapiens
ucaggcagggugcagua

SEQ ID NO: 1008029 - RNA, 13 nt, Homo sapiens
ucaggcccaggca

SEQ ID NO: 1008030 - RNA, 18 nt, Homo sapiens
ucaggccccacuccuucc

SEQ ID NO: 1008031 - RNA, 16 nt, Homo sapiens
ucaggguaccuggggc

SEQ ID NO: 1008032 - RNA, 12 nt, Homo sapiens
ucagggucuaag

SEQ ID NO: 1008033 - RNA, 20 nt, Homo sapiens
ucagguggcccuacugggag

SEQ ID NO: 1008034 - RNA, 16 nt, Homo sapiens
ucagguguugccaaau

SEQ ID NO: 1008035 - RNA, 15 nt, Homo sapiens
ucagguguuuuuacc

SEQ ID NO: 1008036 - RNA, 16 nt, Homo sapiens
ucaguaaaugugauuc

SEQ ID NO: 1008037 - RNA, 21 nt, Homo sapiens
ucagugaagaauacuucucau

SEQ ID NO: 1008038 - RNA, 19 nt, Homo sapiens
ucagugaagccaaagggac

SEQ ID NO: 1008039 - RNA, 23 nt, Homo sapiens
ucagugaguaauuuuggauuuug

SEQ ID NO: 1008040 - RNA, 21 nt, Homo sapiens
ucagugcucccucacauguca

SEQ ID NO: 1008041 - RNA, 23 nt, Homo sapiens
ucagugggaaacaaacugucuaa

SEQ ID NO: 1008042 - RNA, 17 nt, Homo sapiens
ucagugguggucuucaa

SEQ ID NO: 1008043 - RNA, 19 nt, Homo sapiens
ucagugguggucuucaaga

SEQ ID NO: 1008044 - RNA, 17 nt, Homo sapiens
ucaguguaccauuugcc

SEQ ID NO: 1008045 - RNA, 24 nt, Homo sapiens
ucauaccguguaccucaguucccu

SEQ ID NO: 1008046 - RNA, 17 nt, Homo sapiens
ucauagcaauacuugga

SEQ ID NO: 1008047 - RNA, 14 nt, Homo sapiens
ucauaguaacuucu

SEQ ID NO: 1008048 - RNA, 14 nt, Homo sapiens
ucaucaaguaauac

SEQ ID NO: 1008049 - RNA, 15 nt, Homo sapiens
ucaucaggugcauag

SEQ ID NO: 1008050 - RNA, 13 nt, Homo sapiens
ucauccaccccau

SEQ ID NO: 1008051 - RNA, 22 nt, Homo sapiens
ucauccacucuacuaaugccuc

SEQ ID NO: 1008052 - RNA, 14 nt, Homo sapiens
ucauccagcucacu

SEQ ID NO: 1008053 - RNA, 16 nt, Homo sapiens
ucauccauguccaacc

SEQ ID NO: 1008054 - RNA, 13 nt, Homo sapiens
ucaucugugcacu

SEQ ID NO: 1008055 - RNA, 12 nt, Homo sapiens
ucaucuugccac

SEQ ID NO: 1008056 - RNA, 20 nt, Homo sapiens
ucaugaggagauucugccuu

SEQ ID NO: 1008057 - RNA, 23 nt, Homo sapiens
ucaugccaccauggccagccaac

SEQ ID NO: 1008058 - RNA, 14 nt, Homo sapiens
ucaugccucugagg

SEQ ID NO: 1008059 - RNA, 19 nt, Homo sapiens
ucaugcgaugacacuugua

SEQ ID NO: 1008060 - RNA, 22 nt, Homo sapiens
ucaugcgaugacacuuguacaa

SEQ ID NO: 1008061 - RNA, 16 nt, Homo sapiens
ucaugcggacccucac

SEQ ID NO: 1008062 - RNA, 20 nt, Homo sapiens
ucauggaugggggaacucag

SEQ ID NO: 1008063 - RNA, 17 nt, Homo sapiens
ucaugguguccagacag

SEQ ID NO: 1008064 - RNA, 12 nt, Homo sapiens
ucauucugggaa

SEQ ID NO: 1008065 - RNA, 14 nt, Homo sapiens
ucauugcacuuuga

SEQ ID NO: 1008066 - RNA, 15 nt, Homo sapiens
ucauugcacuuugau

SEQ ID NO: 1008067 - RNA, 22 nt, Homo sapiens
ucauuguaaacaaacuguguaa

SEQ ID NO: 1008068 - RNA, 18 nt, Homo sapiens
ucauuguaaucacuguug

SEQ ID NO: 1008069 - RNA, 17 nt, Homo sapiens
ucauuuagucaugugac

SEQ ID NO: 1008070 - RNA, 14 nt, Homo sapiens
ucauuugcucuaau

SEQ ID NO: 1008071 - RNA, 15 nt, Homo sapiens
uccaaacucuucccu

SEQ ID NO: 1008072 - RNA, 12 nt, Homo sapiens
uccaaugagcuu

SEQ ID NO: 1008073 - RNA, 13 nt, Homo sapiens
uccaaugagcuuu

SEQ ID NO: 1008074 - RNA, 22 nt, Homo sapiens
uccaaugucuggagaccaccag

SEQ ID NO: 1008075 - RNA, 16 nt, Homo sapiens
uccaauuaguuuccuu

SEQ ID NO: 1008076 - RNA, 13 nt, Homo sapiens
uccaauuucaaga

SEQ ID NO: 1008077 - RNA, 16 nt, Homo sapiens
uccacacagugcucaa

SEQ ID NO: 1008078 - RNA, 23 nt, Homo sapiens
uccacggagccacuccucugacu

SEQ ID NO: 1008079 - RNA, 19 nt, Homo sapiens
uccacuucuuguuccccac

SEQ ID NO: 1008080 - RNA, 23 nt, Homo sapiens
uccacuucuuguuccccacugac

SEQ ID NO: 1008081 - RNA, 19 nt, Homo sapiens
uccagaaauacuacugugu

SEQ ID NO: 1008082 - RNA, 17 nt, Homo sapiens
uccagacagagcccugu

SEQ ID NO: 1008083 - RNA, 16 nt, Homo sapiens
uccagcggcccuguca

SEQ ID NO: 1008084 - RNA, 14 nt, Homo sapiens
uccagggacagcaa

SEQ ID NO: 1008085 - RNA, 19 nt, Homo sapiens
uccagggcccccaucucau

SEQ ID NO: 1008086 - RNA, 18 nt, Homo sapiens
uccagggucccucugugu

SEQ ID NO: 1008087 - RNA, 14 nt, Homo sapiens
ucgcuucuugccuc

SEQ ID NO: 1008088 - RNA, 22 nt, Homo sapiens
ucggaggccauccugccagggg

SEQ ID NO: 1008089 - RNA, 19 nt, Homo sapiens
ucggauuugccauagccuu

SEQ ID NO: 1008090 - RNA, 15 nt, Homo sapiens
ucgggagcaaaccaa

SEQ ID NO: 1008091 - RNA, 21 nt, Homo sapiens
ucgguauccccccaucuugcu

SEQ ID NO: 1008092 - RNA, 18 nt, Homo sapiens
ucgucaucaggugcauag

SEQ ID NO: 1008093 - RNA, 14 nt, Homo sapiens
ucguuaaaaacaga

SEQ ID NO: 1008094 - RNA, 15 nt, Homo sapiens
ucguucuucugggaa

SEQ ID NO: 1008095 - RNA, 17 nt, Homo sapiens
ucguuuuuuucauucca

SEQ ID NO: 1008096 - RNA, 18 nt, Homo sapiens
ucuaaagauggaguuucu

SEQ ID NO: 1008097 - RNA, 13 nt, Homo sapiens
ucuaacagcacca

SEQ ID NO: 1008098 - RNA, 12 nt, Homo sapiens
ucuaagaaagaa

SEQ ID NO: 1008099 - RNA, 15 nt, Homo sapiens
ucuaagaaagaaauu

SEQ ID NO: 1008100 - RNA, 20 nt, Homo sapiens
ucuaagagaacaaugugcua

SEQ ID NO: 1008101 - RNA, 12 nt, Homo sapiens
ucuaagugauau

SEQ ID NO: 1008102 - RNA, 18 nt, Homo sapiens
ucuaauucggauuugcca

SEQ ID NO: 1008103 - RNA, 17 nt, Homo sapiens
ucuaccaggucaaaaua

SEQ ID NO: 1008104 - RNA, 21 nt, Homo sapiens
ucuacuaacaaucagcuccuu

SEQ ID NO: 1008105 - RNA, 21 nt, Homo sapiens
ucuacuacaaacuucaaagag

SEQ ID NO: 1008106 - RNA, 18 nt, Homo sapiens
ucuacugccuuggacaac

SEQ ID NO: 1008107 - RNA, 20 nt, Homo sapiens
ucuagacauggagguucuaa

SEQ ID NO: 1008108 - RNA, 21 nt, Homo sapiens
ucuagguccccauacuccuau

SEQ ID NO: 1008109 - RNA, 14 nt, Homo sapiens
ucuaguucauugaa

SEQ ID NO: 1008110 - RNA, 17 nt, Homo sapiens
ucuaguucauugaauca

SEQ ID NO: 1008111 - RNA, 19 nt, Homo sapiens
ucuauacucagguaccucu

SEQ ID NO: 1008112 - RNA, 20 nt, Homo sapiens
ucuaugaacuuagaguuuac

SEQ ID NO: 1008113 - RNA, 18 nt, Homo sapiens
ucuauuuggggcuugaug

SEQ ID NO: 1008114 - RNA, 19 nt, Homo sapiens
ucucaauaauuuccuccac

SEQ ID NO: 1008115 - RNA, 18 nt, Homo sapiens
ucucacaguguugcccag

SEQ ID NO: 1008116 - RNA, 14 nt, Homo sapiens
ucucaggaccaaag

SEQ ID NO: 1008117 - RNA, 16 nt, Homo sapiens
ucucagguguugccaa

SEQ ID NO: 1008118 - RNA, 14 nt, Homo sapiens
ucucaucaguccau

SEQ ID NO: 1008119 - RNA, 13 nt, Homo sapiens
ucucauccaucau

SEQ ID NO: 1008120 - RNA, 23 nt, Homo sapiens
ucucauugucuguguagaguguu

SEQ ID NO: 1008121 - RNA, 15 nt, Homo sapiens
ucuccacuuucagcu

SEQ ID NO: 1008122 - RNA, 14 nt, Homo sapiens
ucuccaguggauuc

SEQ ID NO: 1008123 - RNA, 15 nt, Homo sapiens
uuuugugaagccaug

SEQ ID NO: 1008124 - RNA, 13 nt, Homo sapiens
uuuugugauugcc

SEQ ID NO: 1008125 - RNA, 16 nt, Homo sapiens
uuuuguugacauuagu

SEQ ID NO: 1008126 - RNA, 15 nt, Homo sapiens
uuuuuacugcucuga

SEQ ID NO: 1008127 - RNA, 20 nt, Homo sapiens
uuuuuauaaaaaugagugcu

SEQ ID NO: 1008128 - RNA, 18 nt, Homo sapiens
uuuuuauuaugcauuaua

SEQ ID NO: 1008129 - RNA, 13 nt, Homo sapiens
uuuuucaagagcu

SEQ ID NO: 1008130 - RNA, 22 nt, Homo sapiens
uuuuucaagagcuccuugaccc

SEQ ID NO: 1008131 - RNA, 18 nt, Homo sapiens
uuuuucccuaucacugaa

SEQ ID NO: 1008132 - RNA, 23 nt, Homo sapiens
uuuuugguaauauguuacaauua

SEQ ID NO: 1008133 - RNA, 19 nt, Homo sapiens
uuuuuguuaucagucaaua

SEQ ID NO: 1008134 - RNA, 18 nt, Homo sapiens
uuuuuguucaaagccagc

SEQ ID NO: 1008135 - RNA, 14 nt, Homo sapiens
uucuucagagacag

SEQ ID NO: 1008136 - RNA, 15 nt, Homo sapiens
uucuucuacugcuau

SEQ ID NO: 1008137 - RNA, 13 nt, Homo sapiens
uucuucugggaac

SEQ ID NO: 1008138 - RNA, 15 nt, Homo sapiens
uucuugaggggacca

SEQ ID NO: 1008139 - RNA, 19 nt, Homo sapiens
uucuugaguugucuuuugc

SEQ ID NO: 1008140 - RNA, 21 nt, Homo sapiens
uugaaaaagggaagccauucc

SEQ ID NO: 1008141 - RNA, 15 nt, Homo sapiens
uugaaaacugugcaa

SEQ ID NO: 1008142 - RNA, 15 nt, Homo sapiens
uugaaaaugggcuca

SEQ ID NO: 1008143 - RNA, 17 nt, Homo sapiens
uugaaaauguccaggaa

SEQ ID NO: 1008144 - RNA, 22 nt, Homo sapiens
uugaaacccguggcgcuuucug

SEQ ID NO: 1008145 - RNA, 18 nt, Homo sapiens
uugaaauugaaccuuugu

SEQ ID NO: 1008146 - RNA, 14 nt, Homo sapiens
uugaauacuuugaa

SEQ ID NO: 1008147 - RNA, 17 nt, Homo sapiens
uugaaucacaugaauua

SEQ ID NO: 1008148 - RNA, 14 nt, Homo sapiens
uugaauuucacugu

SEQ ID NO: 1008149 - RNA, 11 nt, Homo sapiens
uugacaccugc

SEQ ID NO: 1008150 - RNA, 15 nt, Homo sapiens
uugacacugcucuaa

SEQ ID NO: 1008151 - RNA, 14 nt, Homo sapiens
uugagaaucccaaa

SEQ ID NO: 1008152 - RNA, 20 nt, Homo sapiens
uugagcaucacagaauguga

SEQ ID NO: 1008153 - RNA, 18 nt, Homo sapiens
uugaggagugucccgccu

SEQ ID NO: 1008154 - RNA, 21 nt, Homo sapiens
uugaggccacccgcacaaaau

SEQ ID NO: 1008155 - RNA, 12 nt, Homo sapiens
uugauacuguug

SEQ ID NO: 1008156 - RNA, 14 nt, Homo sapiens
uugaugcaugcacu

SEQ ID NO: 1008157 - RNA, 20 nt, Homo sapiens
uugauuugcucuuacuacag

SEQ ID NO: 1008158 - RNA, 13 nt, Homo sapiens
uugcaaagauuua

SEQ ID NO: 1008159 - RNA, 14 nt, Homo sapiens
uugcaaccucgcug

SEQ ID NO: 1008160 - RNA, 20 nt, Homo sapiens
uugcagcuuauauucaucca

SEQ ID NO: 1008161 - RNA, 23 nt, Homo sapiens
uugcaucucaguaugaauuauuc

SEQ ID NO: 1008162 - RNA, 21 nt, Homo sapiens
uugcauggauuucuuugaaaa

SEQ ID NO: 1008163 - RNA, 11 nt, Homo sapiens
uugccagguga

SEQ ID NO: 1008164 - RNA, 12 nt, Homo sapiens
uugccaggugac

SEQ ID NO: 1008165 - RNA, 20 nt, Homo sapiens
uugccuuuugcaaccaggaa

SEQ ID NO: 1008166 - RNA, 23 nt, Homo sapiens
uugcgagagauguguguugauac

SEQ ID NO: 1008167 - RNA, 16 nt, Homo sapiens
uugcuggucuagucac

SEQ ID NO: 1008168 - RNA, 13 nt, Homo sapiens
uugcugugaauua

SEQ ID NO: 1008169 - RNA, 17 nt, Homo sapiens
uugcugugcguggaaug

SEQ ID NO: 1008170 - RNA, 14 nt, Homo sapiens
uuggaaagcagucc

SEQ ID NO: 1008171 - RNA, 21 nt, Homo sapiens
uuggaacuuuuauuacugggg

SEQ ID NO: 1008172 - RNA, 15 nt, Homo sapiens
uuggagaaaaugggu

SEQ ID NO: 1008173 - RNA, 19 nt, Homo sapiens
uuggcagcccugaugacug

SEQ ID NO: 1008174 - RNA, 18 nt, Homo sapiens
uuggcaggcuggccaguc

SEQ ID NO: 1008175 - RNA, 21 nt, Homo sapiens
uugggaacggacugguaugua

SEQ ID NO: 1008176 - RNA, 17 nt, Homo sapiens
uugggagacaugugaca

SEQ ID NO: 1008177 - RNA, 22 nt, Homo sapiens
uugggcagagcuggcucugagc

SEQ ID NO: 1008178 - RNA, 16 nt, Homo sapiens
uugggccagacaugcc

SEQ ID NO: 1008179 - RNA, 15 nt, Homo sapiens
uugggccugcuccag

SEQ ID NO: 1008180 - RNA, 10 nt, Homo sapiens
uugggcuccg

SEQ ID NO: 1008181 - RNA, 20 nt, Homo sapiens
uugggcuccgugugggagac

SEQ ID NO: 1008182 - RNA, 15 nt, Homo sapiens
uugggcucugaugaa

SEQ ID NO: 1008183 - RNA, 14 nt, Homo sapiens
uuggucacauauca

SEQ ID NO: 1008184 - RNA, 16 nt, Homo sapiens
uuggucccacaggcca

SEQ ID NO: 1008185 - RNA, 13 nt, Homo sapiens
uugguuacuucau

SEQ ID NO: 1008186 - RNA, 14 nt, Homo sapiens
uuguaacucuauga

SEQ ID NO: 1008187 - RNA, 15 nt, Homo sapiens
ugucccgccuugugg

SEQ ID NO: 1008188 - RNA, 16 nt, Homo sapiens
ugucccucacuguuga

SEQ ID NO: 1008189 - RNA, 15 nt, Homo sapiens
ugucccugacuguaa

SEQ ID NO: 1008190 - RNA, 15 nt, Homo sapiens
ugucccuuguaaaua

SEQ ID NO: 1008191 - RNA, 20 nt, Homo sapiens
uguccuagcacagauggcca

SEQ ID NO: 1008192 - RNA, 15 nt, Homo sapiens
ugucguugugcuuuu

SEQ ID NO: 1008193 - RNA, 21 nt, Homo sapiens
ugucucgaugcaaugaacacu

SEQ ID NO: 1008194 - RNA, 23 nt, Homo sapiens
ugucugaacuugcauugugauug

SEQ ID NO: 1008195 - RNA, 18 nt, Homo sapiens
ugucugcuaucauuauuc

SEQ ID NO: 1008196 - RNA, 19 nt, Homo sapiens
ugucuggcaaugccacagc

SEQ ID NO: 1008197 - RNA, 19 nt, Homo sapiens
ugucugggugcuacugggg

SEQ ID NO: 1008198 - RNA, 16 nt, Homo sapiens
ugucuguccuuuauga

SEQ ID NO: 1008199 - RNA, 17 nt, Homo sapiens
ugucuuaaggcaucuga

SEQ ID NO: 1008200 - RNA, 19 nt, Homo sapiens
ugucuuaauuuucuuucac

SEQ ID NO: 1008201 - RNA, 14 nt, Homo sapiens
ugucuucuacagau

SEQ ID NO: 1008202 - RNA, 18 nt, Homo sapiens
ugucuuguguuuccacag

SEQ ID NO: 1008203 - RNA, 13 nt, Homo sapiens
ugucuuuugccau

SEQ ID NO: 1008204 - RNA, 18 nt, Homo sapiens
ugugaauagaacucugaa

SEQ ID NO: 1008205 - RNA, 22 nt, Homo sapiens
ugugacauuauaugcacuagca

SEQ ID NO: 1008206 - RNA, 12 nt, Homo sapiens
ugugacuacuga

SEQ ID NO: 1008207 - RNA, 16 nt, Homo sapiens
ugugaggcugggucca

SEQ ID NO: 1008208 - RNA, 20 nt, Homo sapiens
ugugauguaccaguuugucc

SEQ ID NO: 1008209 - RNA, 19 nt, Homo sapiens
ugugcacguaaaguacuug

SEQ ID NO: 1008210 - RNA, 21 nt, Homo sapiens
ugugcaguguugacaguucau

SEQ ID NO: 1008211 - RNA, 14 nt, Homo sapiens
ugugcaugcucagc

SEQ ID NO: 1008212 - RNA, 17 nt, Homo sapiens
ugugcccaggguuuugc

SEQ ID NO: 1008213 - RNA, 20 nt, Homo sapiens
ugugccccagcagugccuug

SEQ ID NO: 1008214 - RNA, 14 nt, Homo sapiens
ugugcuacaauuca

SEQ ID NO: 1008215 - RNA, 18 nt, Homo sapiens
ugugcucagagaccccuc

SEQ ID NO: 1008216 - RNA, 13 nt, Homo sapiens
uguggcagagcca

SEQ ID NO: 1008217 - RNA, 18 nt, Homo sapiens
uguggggugggcacauug

SEQ ID NO: 1008218 - RNA, 21 nt, Homo sapiens
ugugguuuucuuuugccauga

SEQ ID NO: 1008219 - RNA, 16 nt, Homo sapiens
uguguaauuagugcca

SEQ ID NO: 1008220 - RNA, 16 nt, Homo sapiens
uguguacugcaguugg

SEQ ID NO: 1008221 - RNA, 21 nt, Homo sapiens
uguguauuuacgcuuugauuc

SEQ ID NO: 1008222 - RNA, 11 nt, Homo sapiens
uguguccaaaa

SEQ ID NO: 1008223 - RNA, 18 nt, Homo sapiens
ugugucccccucugucca

SEQ ID NO: 1008224 - RNA, 15 nt, Homo sapiens
uguguguaugcacau

SEQ ID NO: 1008225 - RNA, 17 nt, Homo sapiens
uguguugauacuguugc

SEQ ID NO: 1008226 - RNA, 20 nt, Homo sapiens
uguuaucagucauaacuaaa

SEQ ID NO: 1008227 - RNA, 22 nt, Homo sapiens
uguuauuuaaugagucagucaa

SEQ ID NO: 1008228 - RNA, 19 nt, Homo sapiens
uguucacaacagugaaaag

SEQ ID NO: 1008229 - RNA, 18 nt, Homo sapiens
uguucccauuuuugcuua

SEQ ID NO: 1008230 - RNA, 14 nt, Homo sapiens
uguuccccacugga

SEQ ID NO: 1008231 - RNA, 19 nt, Homo sapiens
uguucucaacuucaaaagu

SEQ ID NO: 1008232 - RNA, 18 nt, Homo sapiens
uguucucagaaucccuua

SEQ ID NO: 1008233 - RNA, 20 nt, Homo sapiens
uguucuuuaagaguuuaaaa

SEQ ID NO: 1008234 - RNA, 16 nt, Homo sapiens
aagauuaaaaagcaca

SEQ ID NO: 1008235 - RNA, 21 nt, Homo sapiens
aagauuauagauucuaaagau

SEQ ID NO: 1008236 - RNA, 23 nt, Homo sapiens
aagauucugaccuuaaaugcaac

SEQ ID NO: 1008237 - RNA, 18 nt, Homo sapiens
aagauuuuuuuugucaga

SEQ ID NO: 1008238 - RNA, 12 nt, Homo sapiens
aaucuaagugau

SEQ ID NO: 1008239 - RNA, 15 nt, Homo sapiens
aaucuauagaacuga

SEQ ID NO: 1008240 - RNA, 18 nt, Homo sapiens
aaucucaccccaucccac

SEQ ID NO: 1008241 - RNA, 13 nt, Homo sapiens
aaucucacuacac

SEQ ID NO: 1008242 - RNA, 13 nt, Homo sapiens
agucacacagugu

SEQ ID NO: 1008243 - RNA, 13 nt, Homo sapiens
agucacagccacc

SEQ ID NO: 1008244 - RNA, 22 nt, Homo sapiens
agucacucuuaugcuguaccca

SEQ ID NO: 1008245 - RNA, 20 nt, Homo sapiens
agucaggacuugaacccagg

SEQ ID NO: 1008246 - RNA, 21 nt, Homo sapiens
agucaggacuugaacccaggu

SEQ ID NO: 1008247 - RNA, 18 nt, Homo sapiens
agucauccagucuauuca

SEQ ID NO: 1008248 - RNA, 23 nt, Homo sapiens
agucaucuugcuaccaguauuua

SEQ ID NO: 1008249 - RNA, 17 nt, Homo sapiens
aguccacacuuugucca

SEQ ID NO: 1008250 - RNA, 20 nt, Homo sapiens
aguccuaucugggcuuccug

SEQ ID NO: 1008251 - RNA, 18 nt, Homo sapiens
agucguggggugugcugg

SEQ ID NO: 1008252 - RNA, 19 nt, Homo sapiens
agucucagugaagacuaug

SEQ ID NO: 1008253 - RNA, 13 nt, Homo sapiens
agucugaacagcu

SEQ ID NO: 1008254 - RNA, 15 nt, Homo sapiens
agucugccacccagg

SEQ ID NO: 1008255 - RNA, 17 nt, Homo sapiens
agucuuuuucaguuccu

SEQ ID NO: 1008256 - RNA, 16 nt, Homo sapiens
agugacuaauggcaug

SEQ ID NO: 1008257 - RNA, 13 nt, Homo sapiens
agugagacagacu

SEQ ID NO: 1008258 - RNA, 23 nt, Homo sapiens
agugagagcacgccuguacuaga

SEQ ID NO: 1008259 - RNA, 22 nt, Homo sapiens
agugagcauaggugauccaugu

SEQ ID NO: 1008260 - RNA, 16 nt, Homo sapiens
agugagggcucacuca

SEQ ID NO: 1008261 - RNA, 19 nt, Homo sapiens
agugaucugcccaccucag

SEQ ID NO: 1008262 - RNA, 12 nt, Homo sapiens
agugauggagcu

SEQ ID NO: 1008263 - RNA, 21 nt, Homo sapiens
agugauggcuuaugauagcaa

SEQ ID NO: 1008264 - RNA, 17 nt, Homo sapiens
agugauugauagagugu

SEQ ID NO: 1008265 - RNA, 20 nt, Homo sapiens
agugcacaggcgcaucccag

SEQ ID NO: 1008266 - RNA, 16 nt, Homo sapiens
agugcaguggugcaau

SEQ ID NO: 1008267 - RNA, 20 nt, Homo sapiens
agugcaguggugugaucuca

SEQ ID NO: 1008268 - RNA, 21 nt, Homo sapiens
agugccuuaaacucuguuaca

SEQ ID NO: 1008269 - RNA, 21 nt, Homo sapiens
agugccuucaacacagcuugu

SEQ ID NO: 1008270 - RNA, 13 nt, Homo sapiens
agugcuacagggu

SEQ ID NO: 1008271 - RNA, 11 nt, Homo sapiens
aguggacaaau

SEQ ID NO: 1008272 - RNA, 19 nt, Homo sapiens
aguggcagcccagccagcg

SEQ ID NO: 1008273 - RNA, 17 nt, Homo sapiens
aguggcccauggcauuu

SEQ ID NO: 1008274 - RNA, 12 nt, Homo sapiens
aguggucuucaa

SEQ ID NO: 1008275 - RNA, 15 nt, Homo sapiens
agugguggucuucaa

SEQ ID NO: 1008276 - RNA, 17 nt, Homo sapiens
aguguaugacugcacau

SEQ ID NO: 1008277 - RNA, 18 nt, Homo sapiens
aguguaugacugcacaug

SEQ ID NO: 1008278 - RNA, 17 nt, Homo sapiens
aguguaugauuacuggc

SEQ ID NO: 1008279 - RNA, 16 nt, Homo sapiens
aguguggcugaggcca

SEQ ID NO: 1008280 - RNA, 17 nt, Homo sapiens
aguguuaucagucauaa

SEQ ID NO: 1008281 - RNA, 18 nt, Homo sapiens
aguguucacaacagugaa

SEQ ID NO: 1008282 - RNA, 20 nt, Homo sapiens
aguguuccccgauaccaugc

SEQ ID NO: 1008283 - RNA, 23 nt, Homo sapiens
aguguuccccuuccacugagggc

SEQ ID NO: 1008284 - RNA, 16 nt, Homo sapiens
aguguugagcaucugu

SEQ ID NO: 1008285 - RNA, 16 nt, Homo sapiens
aguuaauccacuguga

SEQ ID NO: 1008286 - RNA, 23 nt, Homo sapiens
aguuacaguucugugguuucaug

SEQ ID NO: 1008287 - RNA, 22 nt, Homo sapiens
aguuaccuuauaguuacugugu

SEQ ID NO: 1008288 - RNA, 17 nt, Homo sapiens
aguuaguuuguauauau

SEQ ID NO: 1008289 - RNA, 13 nt, Homo sapiens
aguuauaaccaac

SEQ ID NO: 1008290 - RNA, 18 nt, Homo sapiens
aguucauauguaccaugu

SEQ ID NO: 1008291 - RNA, 13 nt, Homo sapiens
aguuccacuuaua

SEQ ID NO: 1008292 - RNA, 16 nt, Homo sapiens
aguucuaagauucuaa

SEQ ID NO: 1008293 - RNA, 23 nt, Homo sapiens
aguucuagaaaaacaggcacuug

SEQ ID NO: 1008294 - RNA, 13 nt, Homo sapiens
aguucuaggcacu

SEQ ID NO: 1008295 - RNA, 14 nt, Homo sapiens
aguucugggcccag

SEQ ID NO: 1008296 - RNA, 21 nt, Homo sapiens
aguucuugagggccuccccac

SEQ ID NO: 1008297 - RNA, 16 nt, Homo sapiens
aguucuuugggccaga

SEQ ID NO: 1008298 - RNA, 19 nt, Homo sapiens
aguucuuugggccagacau

SEQ ID NO: 1008299 - RNA, 19 nt, Homo sapiens
aguugaucuggaacccaga

SEQ ID NO: 1008300 - RNA, 11 nt, Homo sapiens
aguugcagcug

SEQ ID NO: 1008301 - RNA, 16 nt, Homo sapiens
aguuggagcuccagcc

SEQ ID NO: 1008302 - RNA, 17 nt, Homo sapiens
aguugucuuuccuggca

SEQ ID NO: 1008303 - RNA, 16 nt, Homo sapiens
aguugucuuuugccau

SEQ ID NO: 1008304 - RNA, 22 nt, Homo sapiens
aguuguuuuaauaacuuaucua

SEQ ID NO: 1008305 - RNA, 20 nt, Homo sapiens
aguuuaaaacagaagccuga

SEQ ID NO: 1008306 - RNA, 13 nt, Homo sapiens
aguuuaaugauua

SEQ ID NO: 1008307 - RNA, 17 nt, Homo sapiens
aguuuaauuaugccuuu

SEQ ID NO: 1008308 - RNA, 21 nt, Homo sapiens
aguuuaauuuuugaaaacugg

SEQ ID NO: 1008309 - RNA, 14 nt, Homo sapiens
aguuuagauuuuaa

SEQ ID NO: 1008310 - RNA, 19 nt, Homo sapiens
aguuuauacuucucuauua

SEQ ID NO: 1008311 - RNA, 16 nt, Homo sapiens
aguuuaucaguaaaua

SEQ ID NO: 1008312 - RNA, 18 nt, Homo sapiens
aguuuccucuacugcaaa

SEQ ID NO: 1008313 - RNA, 13 nt, Homo sapiens
aguuugcaaaaaa

SEQ ID NO: 1008314 - RNA, 13 nt, Homo sapiens
auaaaacuuuccu

SEQ ID NO: 1008315 - RNA, 15 nt, Homo sapiens
auaaaaggaagccaa

SEQ ID NO: 1008316 - RNA, 21 nt, Homo sapiens
auaaaauguuuaaucucugcu

SEQ ID NO: 1008317 - RNA, 14 nt, Homo sapiens
auaaacccaguugc

SEQ ID NO: 1008318 - RNA, 21 nt, Homo sapiens
auaaagcaguauuuuucuuga

SEQ ID NO: 1008319 - RNA, 18 nt, Homo sapiens
auaaaggcaguuuucuaa

SEQ ID NO: 1008320 - RNA, 19 nt, Homo sapiens
auaaaguuccccugugaca

SEQ ID NO: 1008321 - RNA, 17 nt, Homo sapiens
auaaaucucuccuauaa

SEQ ID NO: 1008322 - RNA, 17 nt, Homo sapiens
auaaauguacauuaauu

SEQ ID NO: 1008323 - RNA, 23 nt, Homo sapiens
auaaauguaccagagagaguugu

SEQ ID NO: 1008324 - RNA, 14 nt, Homo sapiens
auaaauugcucaaa

SEQ ID NO: 1008325 - RNA, 19 nt, Homo sapiens
auaaccagccauuggcuau

SEQ ID NO: 1008326 - RNA, 18 nt, Homo sapiens
auaaccucucugugccau

SEQ ID NO: 1008327 - RNA, 22 nt, Homo sapiens
auaacuggaaaacagaacacuu

SEQ ID NO: 1008328 - RNA, 16 nt, Homo sapiens
auaacuuccacagggu

SEQ ID NO: 1008329 - RNA, 21 nt, Homo sapiens
auaagacuacugaaucugcua

SEQ ID NO: 1008330 - RNA, 13 nt, Homo sapiens
auaagacuuccac

SEQ ID NO: 1008331 - RNA, 19 nt, Homo sapiens
auaagagaaucaacauuuc

SEQ ID NO: 1008332 - RNA, 23 nt, Homo sapiens
auaauacauugcagcaagcaaua

SEQ ID NO: 1008333 - RNA, 18 nt, Homo sapiens
auacucucaccauuugga

SEQ ID NO: 1008334 - RNA, 19 nt, Homo sapiens
auacuggccuggacuguuu

SEQ ID NO: 1008335 - RNA, 22 nt, Homo sapiens
auacuucuuguguguaugcaca

SEQ ID NO: 1008336 - RNA, 20 nt, Homo sapiens
auacuuggaugcagcucuug

SEQ ID NO: 1008337 - RNA, 22 nt, Homo sapiens
auacuuugcagcacagcugaga

SEQ ID NO: 1008338 - RNA, 15 nt, Homo sapiens
auagaacacaguuug

SEQ ID NO: 1008339 - RNA, 17 nt, Homo sapiens
auagaacugaaugagaa

SEQ ID NO: 1008340 - RNA, 21 nt, Homo sapiens
auagaacugaaugagaaccaa

SEQ ID NO: 1008341 - RNA, 18 nt, Homo sapiens
auagaauaaaggcaguuu

SEQ ID NO: 1008342 - RNA, 18 nt, Homo sapiens
auagagucucacuguguc

SEQ ID NO: 1008343 - RNA, 15 nt, Homo sapiens
auagagugcauuuga

SEQ ID NO: 1008344 - RNA, 23 nt, Homo sapiens
auagaugcuggcccagggcccag

SEQ ID NO: 1008345 - RNA, 14 nt, Homo sapiens
auagcaagugaaag

SEQ ID NO: 1008346 - RNA, 18 nt, Homo sapiens
auagcaguugaaacaaga

SEQ ID NO: 1008347 - RNA, 19 nt, Homo sapiens
auagcaugcaucuguuuau

SEQ ID NO: 1008348 - RNA, 18 nt, Homo sapiens
auagccuggguuaaguau

SEQ ID NO: 1008349 - RNA, 20 nt, Homo sapiens
auagccuuuguuuucuaaua

SEQ ID NO: 1008350 - RNA, 13 nt, Homo sapiens
auagcuucaggag

SEQ ID NO: 1008351 - RNA, 19 nt, Homo sapiens
auagggacuuggggcuugg

SEQ ID NO: 1008352 - RNA, 18 nt, Homo sapiens
auaggguauauuuuccua

SEQ ID NO: 1008353 - RNA, 18 nt, Homo sapiens
auagucuuaacuggucuc

SEQ ID NO: 1008354 - RNA, 21 nt, Homo sapiens
auauaaaugugauugcagcuu

SEQ ID NO: 1008355 - RNA, 14 nt, Homo sapiens
auauaacuaucucu

SEQ ID NO: 1008356 - RNA, 19 nt, Homo sapiens
auauaauuauauguuguaa

SEQ ID NO: 1008357 - RNA, 13 nt, Homo sapiens
auauaauugccaa

SEQ ID NO: 1008358 - RNA, 20 nt, Homo sapiens
auauauauuuuugugcacau

SEQ ID NO: 1008359 - RNA, 15 nt, Homo sapiens
auauaucuaccccag

SEQ ID NO: 1008360 - RNA, 20 nt, Homo sapiens
auauauuuaaaaauaaguca

SEQ ID NO: 1008361 - RNA, 19 nt, Homo sapiens
auauauuuaaaagugucaa

SEQ ID NO: 1008362 - RNA, 13 nt, Homo sapiens
auaucacaaucuc

SEQ ID NO: 1008363 - RNA, 22 nt, Homo sapiens
auaucacacacauugcugugaa

SEQ ID NO: 1008364 - RNA, 21 nt, Homo sapiens
auaucccuacauguauugcac

SEQ ID NO: 1008365 - RNA, 20 nt, Homo sapiens
auaucuuuaugggcucuguu

SEQ ID NO: 1008366 - RNA, 20 nt, Homo sapiens
auaugauauauaaaugugau

SEQ ID NO: 1008367 - RNA, 20 nt, Homo sapiens
auaugaugaucuggauccac

SEQ ID NO: 1008368 - RNA, 21 nt, Homo sapiens
auaugcacaauagcaguugaa

SEQ ID NO: 1008369 - RNA, 15 nt, Homo sapiens
auauggaauuuugca

SEQ ID NO: 1008370 - RNA, 18 nt, Homo sapiens
auauggggaaaaaacugu

SEQ ID NO: 1008371 - RNA, 11 nt, Homo sapiens
auauguuacaa

SEQ ID NO: 1008372 - RNA, 14 nt, Homo sapiens
auauucuacuaugc

SEQ ID NO: 1008373 - RNA, 16 nt, Homo sapiens
auauucuacuaugcau

SEQ ID NO: 1008374 - RNA, 20 nt, Homo sapiens
auauugcagcuuauauucau

SEQ ID NO: 1008375 - RNA, 22 nt, Homo sapiens
auauuuaaauguaaagacaaaa

SEQ ID NO: 1008376 - RNA, 14 nt, Homo sapiens
auauuuuagcauuu

SEQ ID NO: 1008377 - RNA, 15 nt, Homo sapiens
auauuuuguuuacaa

SEQ ID NO: 1008378 - RNA, 15 nt, Homo sapiens
auauuuuugugcaca

SEQ ID NO: 1008379 - RNA, 16 nt, Homo sapiens
aucaaagcaucuugca

SEQ ID NO: 1008380 - RNA, 16 nt, Homo sapiens
aucaacgaguacuuca

SEQ ID NO: 1008381 - RNA, 12 nt, Homo sapiens
aucaagcuccug

SEQ ID NO: 1008382 - RNA, 20 nt, Homo sapiens
aucaauaaagaccacuuuac

SEQ ID NO: 1008383 - RNA, 21 nt, Homo sapiens
aucacacacauugcugugaac

SEQ ID NO: 1008384 - RNA, 23 nt, Homo sapiens
aucacucuaauucggauuugcca

SEQ ID NO: 1008385 - RNA, 12 nt, Homo sapiens
aucagaauauca

SEQ ID NO: 1008386 - RNA, 15 nt, Homo sapiens
aucagaauaucacag

SEQ ID NO: 1008387 - RNA, 16 nt, Homo sapiens
aucagaauaucacaga

SEQ ID NO: 1008388 - RNA, 15 nt, Homo sapiens
aucagagacuaugua

SEQ ID NO: 1008389 - RNA, 18 nt, Homo sapiens
aucagaugcuuuccugca

SEQ ID NO: 1008390 - RNA, 22 nt, Homo sapiens
aucagaugcuuuccugcacauu

SEQ ID NO: 1008391 - RNA, 15 nt, Homo sapiens
aucagccacauucua

SEQ ID NO: 1008392 - RNA, 18 nt, Homo sapiens
aucaguaaauaacuggaa

SEQ ID NO: 1008393 - RNA, 20 nt, Homo sapiens
aucagugaagccaaagggac

SEQ ID NO: 1008394 - RNA, 17 nt, Homo sapiens
aucauagcucacugcag

SEQ ID NO: 1008395 - RNA, 19 nt, Homo sapiens
aucaucaaaaacuuuggag

SEQ ID NO: 1008396 - RNA, 19 nt, Homo sapiens
aucaucaaguaauacaaac

SEQ ID NO: 1008397 - RNA, 14 nt, Homo sapiens
aucaucauggccag

SEQ ID NO: 1008398 - RNA, 16 nt, Homo sapiens
aucaucauggccagcu

SEQ ID NO: 1008399 - RNA, 13 nt, Homo sapiens
aucaucauucuca

SEQ ID NO: 1008400 - RNA, 13 nt, Homo sapiens
aucauccaagaca

SEQ ID NO: 1008401 - RNA, 17 nt, Homo sapiens
aucauggccagcuggag

SEQ ID NO: 1008402 - RNA, 17 nt, Homo sapiens
auccaaucaaucuugca

SEQ ID NO: 1008403 - RNA, 19 nt, Homo sapiens
auccaccccguugcucaag

SEQ ID NO: 1008404 - RNA, 16 nt, Homo sapiens
auccaggcagauccag

SEQ ID NO: 1008405 - RNA, 23 nt, Homo sapiens
auccaguuuugucaaugcaguug

SEQ ID NO: 1008406 - RNA, 12 nt, Homo sapiens
auccauggccag

SEQ ID NO: 1008407 - RNA, 16 nt, Homo sapiens
auccauggccagcagc

SEQ ID NO: 1008408 - RNA, 20 nt, Homo sapiens
auccauggccagcagcaccu

SEQ ID NO: 1008409 - RNA, 16 nt, Homo sapiens
auccauguaacugccu

SEQ ID NO: 1008410 - RNA, 20 nt, Homo sapiens
aucccaaguagaaucucagu

SEQ ID NO: 1008411 - RNA, 17 nt, Homo sapiens
aucccacucuucuugca

SEQ ID NO: 1008412 - RNA, 22 nt, Homo sapiens
aucccaucgucucggccuucac

SEQ ID NO: 1008413 - RNA, 18 nt, Homo sapiens
auccccagcgauucccuc

SEQ ID NO: 1008414 - RNA, 16 nt, Homo sapiens
auccccaggcaccuca

SEQ ID NO: 1008415 - RNA, 22 nt, Homo sapiens
aucccgucuucuccaacaccac

SEQ ID NO: 1008416 - RNA, 20 nt, Homo sapiens
aucccuacauguauugcaca

SEQ ID NO: 1008417 - RNA, 17 nt, Homo sapiens
aucccuuaacaguugua

SEQ ID NO: 1008418 - RNA, 12 nt, Homo sapiens
auccuauggcag

SEQ ID NO: 1008419 - RNA, 14 nt, Homo sapiens
auccuauggcagag

SEQ ID NO: 1008420 - RNA, 14 nt, Homo sapiens
auccucacagugaa

SEQ ID NO: 1008421 - RNA, 15 nt, Homo sapiens
auccugggggaccaa

SEQ ID NO: 1008422 - RNA, 16 nt, Homo sapiens
auccuuccacuaucau

SEQ ID NO: 1008423 - RNA, 13 nt, Homo sapiens
caauacagauaua

SEQ ID NO: 1008424 - RNA, 14 nt, Homo sapiens
caauacauaccacg

SEQ ID NO: 1008425 - RNA, 21 nt, Homo sapiens
caauagugaaaugccacaccu

SEQ ID NO: 1008426 - RNA, 17 nt, Homo sapiens
caaucagccacauucua

SEQ ID NO: 1008427 - RNA, 19 nt, Homo sapiens
caaucaucaucauucucau

SEQ ID NO: 1008428 - RNA, 15 nt, Homo sapiens
caaucauuucuauua

SEQ ID NO: 1008429 - RNA, 18 nt, Homo sapiens
caauccagcuauguuaua

SEQ ID NO: 1008430 - RNA, 21 nt, Homo sapiens
caauccuaugcaugguuucag

SEQ ID NO: 1008431 - RNA, 19 nt, Homo sapiens
caaucucuguuuguaugug

SEQ ID NO: 1008432 - RNA, 18 nt, Homo sapiens
caaugagauugaauuuca

SEQ ID NO: 1008433 - RNA, 20 nt, Homo sapiens
caaugauccuguauucagac

SEQ ID NO: 1008434 - RNA, 23 nt, Homo sapiens
caaugccacagcccugucagcau

SEQ ID NO: 1008435 - RNA, 11 nt, Homo sapiens
caaugccagua

SEQ ID NO: 1008436 - RNA, 19 nt, Homo sapiens
caauguaaauaguauaaag

SEQ ID NO: 1008437 - RNA, 14 nt, Homo sapiens
caauuaauuaucuu

SEQ ID NO: 1008438 - RNA, 22 nt, Homo sapiens
caauucauauauuugaagugga

SEQ ID NO: 1008439 - RNA, 17 nt, Homo sapiens
cugaacuccugccauag

SEQ ID NO: 1008440 - RNA, 20 nt, Homo sapiens
cugaacuccugccauagucu

SEQ ID NO: 1008441 - RNA, 13 nt, Homo sapiens
cugaagcagguuc

SEQ ID NO: 1008442 - RNA, 13 nt, Homo sapiens
cugaagcuuuuua

SEQ ID NO: 1008443 - RNA, 19 nt, Homo sapiens
cugaaggagccccauuccu

SEQ ID NO: 1008444 - RNA, 14 nt, Homo sapiens
cugaaggggaaccc

SEQ ID NO: 1008445 - RNA, 12 nt, Homo sapiens
cugaagugcuua

SEQ ID NO: 1008446 - RNA, 23 nt, Homo sapiens
cugaauagcagaagguugcaccu

SEQ ID NO: 1008447 - RNA, 12 nt, Homo sapiens
cugaauauugcc

SEQ ID NO: 1008448 - RNA, 18 nt, Homo sapiens
cugaauuaucuauuucau

SEQ ID NO: 1008449 - RNA, 18 nt, Homo sapiens
cugacacaagaauggucu

SEQ ID NO: 1008450 - RNA, 14 nt, Homo sapiens
cugacaguuuacag

SEQ ID NO: 1008451 - RNA, 19 nt, Homo sapiens
cugaccaaagagaagcaaa

SEQ ID NO: 1008452 - RNA, 19 nt, Homo sapiens
cugaccacagcacagccaa

SEQ ID NO: 1008453 - RNA, 17 nt, Homo sapiens
cugacccagugccccca

SEQ ID NO: 1008454 - RNA, 15 nt, Homo sapiens
cugaccuuaaaugca

SEQ ID NO: 1008455 - RNA, 19 nt, Homo sapiens
cugaccuuuaaaaggccau

SEQ ID NO: 1008456 - RNA, 18 nt, Homo sapiens
cugacuauucuugaugua

SEQ ID NO: 1008457 - RNA, 22 nt, Homo sapiens
cugacuauucuugauguaaaau

SEQ ID NO: 1008458 - RNA, 18 nt, Homo sapiens
cugagaaucagacugaca

SEQ ID NO: 1008459 - RNA, 14 nt, Homo sapiens
cugagaauuguuga

SEQ ID NO: 1008460 - RNA, 18 nt, Homo sapiens
cugagacuccagaccuga

SEQ ID NO: 1008461 - RNA, 13 nt, Homo sapiens
cugagagaugaca

SEQ ID NO: 1008462 - RNA, 14 nt, Homo sapiens
cugagauacauaca

SEQ ID NO: 1008463 - RNA, 20 nt, Homo sapiens
cugagauacauacagaauua

SEQ ID NO: 1008464 - RNA, 18 nt, Homo sapiens
cugagaucuguugauuga

SEQ ID NO: 1008465 - RNA, 19 nt, Homo sapiens
cugagcaaaucaccacaaa

SEQ ID NO: 1008466 - RNA, 20 nt, Homo sapiens
cugagcaaaucaccacaaac

SEQ ID NO: 1008467 - RNA, 21 nt, Homo sapiens
gagagucuggauaacuuccac

SEQ ID NO: 1008468 - RNA, 22 nt, Homo sapiens
gagagugggggugggggguccc

SEQ ID NO: 1008469 - RNA, 15 nt, Homo sapiens
gagauauuaaugccc

SEQ ID NO: 1008470 - RNA, 17 nt, Homo sapiens
gagauuaccuccugaga

SEQ ID NO: 1008471 - RNA, 20 nt, Homo sapiens
gagauugaauuucacugucu

SEQ ID NO: 1008472 - RNA, 17 nt, Homo sapiens
gagcaaaucgugccuug

SEQ ID NO: 1008473 - RNA, 17 nt, Homo sapiens
gagcagaggucucccaa

SEQ ID NO: 1008474 - RNA, 18 nt, Homo sapiens
gagcagggauuaaccucu

SEQ ID NO: 1008475 - RNA, 17 nt, Homo sapiens
gagcaguccugccucag

SEQ ID NO: 1008476 - RNA, 13 nt, Homo sapiens
gagcaucaugccu

SEQ ID NO: 1008477 - RNA, 17 nt, Homo sapiens
gagcauuucucaucagu

SEQ ID NO: 1008478 - RNA, 13 nt, Homo sapiens
gagccaccaugcc

SEQ ID NO: 1008479 - RNA, 16 nt, Homo sapiens
gagcccacgacacugc

SEQ ID NO: 1008480 - RNA, 23 nt, Homo sapiens
gagcccugugaggcuggguccaa

SEQ ID NO: 1008481 - RNA, 23 nt, Homo sapiens
gagcuacugccgucagugcugug

SEQ ID NO: 1008482 - RNA, 16 nt, Homo sapiens
gagcucacaaggcagc

SEQ ID NO: 1008483 - RNA, 15 nt, Homo sapiens
gagcugaguaaaaug

SEQ ID NO: 1008484 - RNA, 23 nt, Homo sapiens
gagcuuggcguuuggacccaguu

SEQ ID NO: 1008485 - RNA, 18 nt, Homo sapiens
gaggacucaccacugccc

SEQ ID NO: 1008486 - RNA, 16 nt, Homo sapiens
gaggagccaccaguuc

SEQ ID NO: 1008487 - RNA, 16 nt, Homo sapiens
gaggagggaggccagg

SEQ ID NO: 1008488 - RNA, 21 nt, Homo sapiens
gaggagggucggugccuucaa

SEQ ID NO: 1008489 - RNA, 22 nt, Homo sapiens
gaggcagaccauccaccaggcc

SEQ ID NO: 1008490 - RNA, 22 nt, Homo sapiens
gaggcaggggcuuccuggugcu

SEQ ID NO: 1008491 - RNA, 13 nt, Homo sapiens
gaggcagugacag

SEQ ID NO: 1008492 - RNA, 17 nt, Homo sapiens
gaggccacccgcacaaa

SEQ ID NO: 1008493 - RNA, 14 nt, Homo sapiens
gaggccauggacuc

SEQ ID NO: 1008494 - RNA, 17 nt, Homo sapiens
gaggccuggacuuuccu

SEQ ID NO: 1008495 - RNA, 22 nt, Homo sapiens
gaggccuggacuuuccugcaac

SEQ ID NO: 1008496 - RNA, 13 nt, Homo sapiens
gaggccuuggaaa

SEQ ID NO: 1008497 - RNA, 14 nt, Homo sapiens
gaggcuacagcaga

SEQ ID NO: 1008498 - RNA, 20 nt, Homo sapiens
gaggcugccccucucaccaa

SEQ ID NO: 1008499 - RNA, 19 nt, Homo sapiens
gaggcuugguuccuuccca

SEQ ID NO: 1008500 - RNA, 23 nt, Homo sapiens
gaggcuuucuccaggaggauuag

SEQ ID NO: 1008501 - RNA, 14 nt, Homo sapiens
gagggcagggacca

SEQ ID NO: 1008502 - RNA, 17 nt, Homo sapiens
gagggccacaugggagg

SEQ ID NO: 1008503 - RNA, 18 nt, Homo sapiens
gaggggucaaguuauuaa

SEQ ID NO: 1008504 - RNA, 17 nt, Homo sapiens
gaggucaggccccacuc

SEQ ID NO: 1008505 - RNA, 14 nt, Homo sapiens
gaggucuaaucuag

SEQ ID NO: 1008506 - RNA, 15 nt, Homo sapiens
gaggucucccaaacg

SEQ ID NO: 1008507 - RNA, 19 nt, Homo sapiens
gagguguuggcugcacgug

SEQ ID NO: 1008508 - RNA, 19 nt, Homo sapiens
gaguaacauuugcuguuuu

SEQ ID NO: 1008509 - RNA, 16 nt, Homo sapiens
gaguaauucauuauua

SEQ ID NO: 1008510 - RNA, 14 nt, Homo sapiens
gaguagaauugcau

SEQ ID NO: 1008511 - RNA, 16 nt, Homo sapiens
gagucugccacccagg

SEQ ID NO: 1008512 - RNA, 16 nt, Homo sapiens
gagugaauucccucac

SEQ ID NO: 1008513 - RNA, 20 nt, Homo sapiens
gagugacuacacacaguacg

SEQ ID NO: 1008514 - RNA, 13 nt, Homo sapiens
gagugacucacua

SEQ ID NO: 1008515 - RNA, 14 nt, Homo sapiens
gagugcagugccac

SEQ ID NO: 1008516 - RNA, 24 nt, Homo sapiens
gagugccuucaacacagcuugucu

SEQ ID NO: 1008517 - RNA, 15 nt, Homo sapiens
gaguugguuacuuca

SEQ ID NO: 1008518 - RNA, 15 nt, Homo sapiens
gaguuuagggaacaa

SEQ ID NO: 1008519 - RNA, 17 nt, Homo sapiens
gauaacaagacuuugac

SEQ ID NO: 1008520 - RNA, 20 nt, Homo sapiens
gauaaguaaguuugauuuca

SEQ ID NO: 1008521 - RNA, 15 nt, Homo sapiens
gauacagaacucuuu

SEQ ID NO: 1008522 - RNA, 19 nt, Homo sapiens
gauacugcgacuuucugcc

SEQ ID NO: 1008523 - RNA, 18 nt, Homo sapiens
gauacuguugcacgugug

SEQ ID NO: 1008524 - RNA, 19 nt, Homo sapiens
gauacuucgacacuguucu

SEQ ID NO: 1008525 - RNA, 22 nt, Homo sapiens
gauauauaaguguacauaugug

SEQ ID NO: 1008526 - RNA, 11 nt, Homo sapiens
gauaucuugga

SEQ ID NO: 1008527 - RNA, 20 nt, Homo sapiens
gauaucuuggacaaaucaca

SEQ ID NO: 1008528 - RNA, 12 nt, Homo sapiens
gauauggcuuuu

SEQ ID NO: 1008529 - RNA, 14 nt, Homo sapiens
gaucagaauaucac

SEQ ID NO: 1008530 - RNA, 19 nt, Homo sapiens
gaucaucuuggaacugcau

SEQ ID NO: 1008531 - RNA, 20 nt, Homo sapiens
gauccaagcagccugagcaa

SEQ ID NO: 1008532 - RNA, 23 nt, Homo sapiens
gauccaguuuugucaaugcaguu

SEQ ID NO: 1008533 - RNA, 21 nt, Homo sapiens
gauccgucuuuggccuccucc

SEQ ID NO: 1008534 - RNA, 15 nt, Homo sapiens
gaucgggagcaaacc

SEQ ID NO: 1008535 - RNA, 20 nt, Homo sapiens
gaucugauaaggaucuagga

SEQ ID NO: 1008536 - RNA, 15 nt, Homo sapiens
gaucuuugacucuuu

SEQ ID NO: 1008537 - RNA, 18 nt, Homo sapiens
gaugaaaaauugcugacu

SEQ ID NO: 1008538 - RNA, 18 nt, Homo sapiens
gaugacacuuguacaauu

SEQ ID NO: 1008539 - RNA, 17 nt, Homo sapiens
gaugacauuaaagaagg

SEQ ID NO: 1008540 - RNA, 15 nt, Homo sapiens
gaugacccuuuucau

SEQ ID NO: 1008541 - RNA, 18 nt, Homo sapiens
gaugaccucguacucagg

SEQ ID NO: 1008542 - RNA, 22 nt, Homo sapiens
gaugacuuucuuuuuguagcug

SEQ ID NO: 1008543 - RNA, 18 nt, Homo sapiens
gaugagcaagacauacuu

SEQ ID NO: 1008544 - RNA, 14 nt, Homo sapiens
gaugauacauccaa

SEQ ID NO: 1008545 - RNA, 23 nt, Homo sapiens
gaugauuuuguaaaaguggcauu

SEQ ID NO: 1008546 - RNA, 16 nt, Homo sapiens
gaugcagcucuuggga

SEQ ID NO: 1008547 - RNA, 20 nt, Homo sapiens
gaugcagcucuugggaccgu

SEQ ID NO: 1008548 - RNA, 21 nt, Homo sapiens
gaugcuucuauaauuuugccu

SEQ ID NO: 1008549 - RNA, 16 nt, Homo sapiens
gauggacaucuuguca

SEQ ID NO: 1008550 - RNA, 24 nt, Homo sapiens
gauggauuaacauauagccuuugu

SEQ ID NO: 1008551 - RNA, 14 nt, Homo sapiens
gauggcagcuuuua

SEQ ID NO: 1008552 - RNA, 19 nt, Homo sapiens
gauuacaggcgugagccac

SEQ ID NO: 1008553 - RNA, 14 nt, Homo sapiens
gauuauacaggaga

SEQ ID NO: 1008554 - RNA, 14 nt, Homo sapiens
gauucaguguuaaa

SEQ ID NO: 1008555 - RNA, 15 nt, Homo sapiens
gauuccccaucucag

SEQ ID NO: 1008556 - RNA, 18 nt, Homo sapiens
gauuccggugccuccuga

SEQ ID NO: 1008557 - RNA, 23 nt, Homo sapiens
gauucuaaaaugugauguucuaa

SEQ ID NO: 1008558 - RNA, 18 nt, Homo sapiens
gauucucugugucuaaga

SEQ ID NO: 1008559 - RNA, 15 nt, Homo sapiens
gauucucuugccuca

SEQ ID NO: 1008560 - RNA, 16 nt, Homo sapiens
gauucucuugccucaa

SEQ ID NO: 1008561 - RNA, 17 nt, Homo sapiens
gauucugccuuugccag

SEQ ID NO: 1008562 - RNA, 17 nt, Homo sapiens
gauucuuucccaauuca

SEQ ID NO: 1008563 - RNA, 16 nt, Homo sapiens
gauugaauuucacugu

SEQ ID NO: 1008564 - RNA, 23 nt, Homo sapiens
gauugccucugaagccuauguau

SEQ ID NO: 1008565 - RNA, 17 nt, Homo sapiens
gauuguuuacagucauu

SEQ ID NO: 1008566 - RNA, 22 nt, Homo sapiens
gauuuauuuaagggggaaaaag

SEQ ID NO: 1008567 - RNA, 15 nt, Homo sapiens
gauuucaugauuuca

SEQ ID NO: 1008568 - RNA, 13 nt, Homo sapiens
gauuuccuugaau

SEQ ID NO: 1008569 - RNA, 18 nt, Homo sapiens
gauuugcccacguaccca

SEQ ID NO: 1008570 - RNA, 17 nt, Homo sapiens
aucugggcuuccuggag

SEQ ID NO: 1008571 - RNA, 22 nt, Homo sapiens
aucugucccccuuuagaucucu

SEQ ID NO: 1008572 - RNA, 14 nt, Homo sapiens
aucuguuuuagaca

SEQ ID NO: 1008573 - RNA, 15 nt, Homo sapiens
aucuuauaguucuag

SEQ ID NO: 1008574 - RNA, 22 nt, Homo sapiens
aucuucuaaacccaauccaaau

SEQ ID NO: 1008575 - RNA, 15 nt, Homo sapiens
aucuugcuaccagua

SEQ ID NO: 1008576 - RNA, 19 nt, Homo sapiens
aucuugcuaccaguauuua

SEQ ID NO: 1008577 - RNA, 18 nt, Homo sapiens
aucuuggacaaaucacau

SEQ ID NO: 1008578 - RNA, 15 nt, Homo sapiens
augaaacaaacugga

SEQ ID NO: 1008579 - RNA, 21 nt, Homo sapiens
augaaaccuguacauaugugu

SEQ ID NO: 1008580 - RNA, 14 nt, Homo sapiens
augaaaguggacaa

SEQ ID NO: 1008581 - RNA, 16 nt, Homo sapiens
augaaaguggacaagg

SEQ ID NO: 1008582 - RNA, 13 nt, Homo sapiens
augaacacuuaau

SEQ ID NO: 1008583 - RNA, 17 nt, Homo sapiens
augaagaugggcuucau

SEQ ID NO: 1008584 - RNA, 13 nt, Homo sapiens
augacaugaauuu

SEQ ID NO: 1008585 - RNA, 17 nt, Homo sapiens
augagaacaaacagauc

SEQ ID NO: 1008586 - RNA, 13 nt, Homo sapiens
augagaagcagaa

SEQ ID NO: 1008587 - RNA, 18 nt, Homo sapiens
augagagaaggaggggag

SEQ ID NO: 1008588 - RNA, 18 nt, Homo sapiens
augagagggaugaggcaa

SEQ ID NO: 1008589 - RNA, 18 nt, Homo sapiens
augagaugauacauccaa

SEQ ID NO: 1008590 - RNA, 20 nt, Homo sapiens
augagcacguuuuuguaaaa

SEQ ID NO: 1008591 - RNA, 13 nt, Homo sapiens
augaggaccuccu

SEQ ID NO: 1008592 - RNA, 23 nt, Homo sapiens
augaggcaacccgugcucagcug

SEQ ID NO: 1008593 - RNA, 17 nt, Homo sapiens
augaguaauacaucaaa

SEQ ID NO: 1008594 - RNA, 19 nt, Homo sapiens
augauacuuggaugcagcu

SEQ ID NO: 1008595 - RNA, 20 nt, Homo sapiens
augauagcaaauggccucau

SEQ ID NO: 1008596 - RNA, 17 nt, Homo sapiens
augaucuggauccacca

SEQ ID NO: 1008597 - RNA, 20 nt, Homo sapiens
augauuaaauaagauucuaa

SEQ ID NO: 1008598 - RNA, 21 nt, Homo sapiens
augauuuuguaaaaguggcau

SEQ ID NO: 1008599 - RNA, 21 nt, Homo sapiens
augcaaauaacaaaugccaaa

SEQ ID NO: 1008600 - RNA, 16 nt, Homo sapiens
augcaaugaacacuua

SEQ ID NO: 1008601 - RNA, 17 nt, Homo sapiens
augcaauuuuucaagag

SEQ ID NO: 1008602 - RNA, 17 nt, Homo sapiens
augcacaagaauggauc

SEQ ID NO: 1008603 - RNA, 12 nt, Homo sapiens
augcacugugaa

SEQ ID NO: 1008604 - RNA, 16 nt, Homo sapiens
augcagcuuauacgaa

SEQ ID NO: 1008605 - RNA, 23 nt, Homo sapiens
augcaugguuucagcacuagcca

SEQ ID NO: 1008606 - RNA, 16 nt, Homo sapiens
augcauuuggguccag

SEQ ID NO: 1008607 - RNA, 23 nt, Homo sapiens
augccacaaggacuuccugucca

SEQ ID NO: 1008608 - RNA, 13 nt, Homo sapiens
augccacauucaa

SEQ ID NO: 1008609 - RNA, 21 nt, Homo sapiens
augccagcuacuuccuccucc

SEQ ID NO: 1008610 - RNA, 11 nt, Homo sapiens
augccaggacc

SEQ ID NO: 1008611 - RNA, 19 nt, Homo sapiens
augcccugugcaaccucuu

SEQ ID NO: 1008612 - RNA, 15 nt, Homo sapiens
augccucgaccugcc

SEQ ID NO: 1008613 - RNA, 13 nt, Homo sapiens
augccuuuaguca

SEQ ID NO: 1008614 - RNA, 22 nt, Homo sapiens
augccuuuucccaaaauguuga

SEQ ID NO: 1008615 - RNA, 12 nt, Homo sapiens
augcuccaagau

SEQ ID NO: 1008616 - RNA, 16 nt, Homo sapiens
augcuccagauuagag

SEQ ID NO: 1008617 - RNA, 22 nt, Homo sapiens
augcugaaaaaucauccaagac

SEQ ID NO: 1008618 - RNA, 23 nt, Homo sapiens
augcuggcauuugcaccuaccuc

SEQ ID NO: 1008619 - RNA, 16 nt, Homo sapiens
augcuucagugcugcu

SEQ ID NO: 1008620 - RNA, 20 nt, Homo sapiens
auggaacagcauuacccucc

SEQ ID NO: 1008621 - RNA, 19 nt, Homo sapiens
auggaaugugauguucaug

SEQ ID NO: 1008622 - RNA, 16 nt, Homo sapiens
auggaauugauuugca

SEQ ID NO: 1008623 - RNA, 16 nt, Homo sapiens
auggagucuugcucug

SEQ ID NO: 1008624 - RNA, 15 nt, Homo sapiens
auggaugcguggaua

SEQ ID NO: 1008625 - RNA, 20 nt, Homo sapiens
auggauuuuucuuuaacugc

SEQ ID NO: 1008626 - RNA, 13 nt, Homo sapiens
auggccagccaac

SEQ ID NO: 1008627 - RNA, 17 nt, Homo sapiens
auggcuccuccauaucu

SEQ ID NO: 1008628 - RNA, 17 nt, Homo sapiens
augggaacaaggcaaug

SEQ ID NO: 1008629 - RNA, 22 nt, Homo sapiens
augggaacaaggcaauggucua

SEQ ID NO: 1008630 - RNA, 18 nt, Homo sapiens
augggagcugaggccaca

SEQ ID NO: 1008631 - RNA, 19 nt, Homo sapiens
augggcagagcccaaggga

SEQ ID NO: 1008632 - RNA, 16 nt, Homo sapiens
auggggacgguguaug

SEQ ID NO: 1008633 - RNA, 16 nt, Homo sapiens
auggggcaggccaccu

SEQ ID NO: 1008634 - RNA, 13 nt, Homo sapiens
auggggccagauc

SEQ ID NO: 1008635 - RNA, 17 nt, Homo sapiens
augggggaacucagauc

SEQ ID NO: 1008636 - RNA, 16 nt, Homo sapiens
augguacaaaccaaau

SEQ ID NO: 1008637 - RNA, 12 nt, Homo sapiens
auggugagcucu

SEQ ID NO: 1008638 - RNA, 16 nt, Homo sapiens
auggugccccaggacc

SEQ ID NO: 1008639 - RNA, 19 nt, Homo sapiens
augguggacucgccuguaa

SEQ ID NO: 1008640 - RNA, 23 nt, Homo sapiens
augguggagggccacaugggagg

SEQ ID NO: 1008641 - RNA, 21 nt, Homo sapiens
augguuuucuccaagagcuac

SEQ ID NO: 1008642 - RNA, 14 nt, Homo sapiens
augguuuuguggau

SEQ ID NO: 1008643 - RNA, 20 nt, Homo sapiens
auguaaagaaaaaagcacca

SEQ ID NO: 1008644 - RNA, 12 nt, Homo sapiens
auguaaagccau

SEQ ID NO: 1008645 - RNA, 18 nt, Homo sapiens
auguaacgcaaguuccca

SEQ ID NO: 1008646 - RNA, 12 nt, Homo sapiens
auguacauuucu

SEQ ID NO: 1008647 - RNA, 19 nt, Homo sapiens
auguagacuuuugcuuuau

SEQ ID NO: 1008648 - RNA, 20 nt, Homo sapiens
auguaguuuuuauauguugu

SEQ ID NO: 1008649 - RNA, 13 nt, Homo sapiens
augucaagcacca

SEQ ID NO: 1008650 - RNA, 19 nt, Homo sapiens
augucacuucccugcuuaa

SEQ ID NO: 1008651 - RNA, 12 nt, Homo sapiens
auguccaaagag

SEQ ID NO: 1008652 - RNA, 16 nt, Homo sapiens
auguccuuucauuugu

SEQ ID NO: 1008653 - RNA, 19 nt, Homo sapiens
augugacauuauaugcacu

SEQ ID NO: 1008654 - RNA, 15 nt, Homo sapiens
augugcaaguuuauc

SEQ ID NO: 1008655 - RNA, 21 nt, Homo sapiens
augugcccaguuaaucuugcu

SEQ ID NO: 1008656 - RNA, 19 nt, Homo sapiens
augugcgugcauguguaua

SEQ ID NO: 1008657 - RNA, 21 nt, Homo sapiens
auguggaugugacaguggcgu

SEQ ID NO: 1008658 - RNA, 15 nt, Homo sapiens
auguggguuuuacac

SEQ ID NO: 1008659 - RNA, 18 nt, Homo sapiens
auuuguuucuuucucuga

SEQ ID NO: 1008660 - RNA, 16 nt, Homo sapiens
auuuuaaacagaggau

SEQ ID NO: 1008661 - RNA, 21 nt, Homo sapiens
auuuuaaguuucucugcagaa

SEQ ID NO: 1008662 - RNA, 17 nt, Homo sapiens
auuuuagugaacuugaa

SEQ ID NO: 1008663 - RNA, 16 nt, Homo sapiens
auuuucaaagacuuaa

SEQ ID NO: 1008664 - RNA, 15 nt, Homo sapiens
auuuuccaggcuucu

SEQ ID NO: 1008665 - RNA, 15 nt, Homo sapiens
auuuuccuguuguca

SEQ ID NO: 1008666 - RNA, 19 nt, Homo sapiens
auuuugaaaacugugcaau

SEQ ID NO: 1008667 - RNA, 22 nt, Homo sapiens
auuuugaaauaaacagguaaua

SEQ ID NO: 1008668 - RNA, 17 nt, Homo sapiens
auuuugcauaguaccaa

SEQ ID NO: 1008669 - RNA, 13 nt, Homo sapiens
auuuuguaacuuu

SEQ ID NO: 1008670 - RNA, 18 nt, Homo sapiens
auuuuguaauaauaaaga

SEQ ID NO: 1008671 - RNA, 21 nt, Homo sapiens
auuuuguaauaauaaagaaua

SEQ ID NO: 1008672 - RNA, 17 nt, Homo sapiens
auuuuguguaagaaaua

SEQ ID NO: 1008673 - RNA, 19 nt, Homo sapiens
auuuuguuauugacuaaca

SEQ ID NO: 1008674 - RNA, 23 nt, Homo sapiens
gugggagcaaacugcaugcccag

SEQ ID NO: 1008675 - RNA, 13 nt, Homo sapiens
guggguuuuacac

SEQ ID NO: 1008676 - RNA, 16 nt, Homo sapiens
gugguguuucuguaag

SEQ ID NO: 1008677 - RNA, 23 nt, Homo sapiens
guguaccucaguucccucuugcu

SEQ ID NO: 1008678 - RNA, 14 nt, Homo sapiens
guguauauggacaa

SEQ ID NO: 1008679 - RNA, 22 nt, Homo sapiens
guguauccaugcaccuaccuua

SEQ ID NO: 1008680 - RNA, 22 nt, Homo sapiens
guguaugguuuuugagauauua

SEQ ID NO: 1008681 - RNA, 14 nt, Homo sapiens
guguauugcaaugg

SEQ ID NO: 1008682 - RNA, 15 nt, Homo sapiens
gugucaccugugcuu

SEQ ID NO: 1008683 - RNA, 19 nt, Homo sapiens
gugucacucagcaguggga

SEQ ID NO: 1008684 - RNA, 11 nt, Homo sapiens
gugugggagac

SEQ ID NO: 1008685 - RNA, 12 nt, Homo sapiens
guguguccaaaa

SEQ ID NO: 1008686 - RNA, 14 nt, Homo sapiens
guguuaaaugugau

SEQ ID NO: 1008687 - RNA, 13 nt, Homo sapiens
guguuaccauccc

SEQ ID NO: 1008688 - RNA, 18 nt, Homo sapiens
guguuuugcuaaaggaaa

SEQ ID NO: 1008689 - RNA, 17 nt, Homo sapiens
guguuuuuaacauguca

SEQ ID NO: 1008690 - RNA, 20 nt, Homo sapiens
guuaauaaaccuuugcaaac

SEQ ID NO: 1008691 - RNA, 14 nt, Homo sapiens
guuaauguacaaaa

SEQ ID NO: 1008692 - RNA, 22 nt, Homo sapiens
guuaauuuuuccuauauugcau

SEQ ID NO: 1008693 - RNA, 16 nt, Homo sapiens
guuaccucugcaugga

SEQ ID NO: 1008694 - RNA, 14 nt, Homo sapiens
guuaguuccuucau

SEQ ID NO: 1008695 - RNA, 17 nt, Homo sapiens
guuaucagugcuucccg

SEQ ID NO: 1008696 - RNA, 19 nt, Homo sapiens
guuaugugcaaguuuauca

SEQ ID NO: 1008697 - RNA, 15 nt, Homo sapiens
guuauuuucauucaa

SEQ ID NO: 1008698 - RNA, 24 nt, Homo sapiens
guucagcacugucccuugccucaa

SEQ ID NO: 1008699 - RNA, 20 nt, Homo sapiens
guucagugagguucuugggu

SEQ ID NO: 1008700 - RNA, 20 nt, Homo sapiens
guucccauuuuugcuuagcu

SEQ ID NO: 1008701 - RNA, 14 nt, Homo sapiens
guucccccacugau

SEQ ID NO: 1008702 - RNA, 15 nt, Homo sapiens
guucccccuguuuca

SEQ ID NO: 1008703 - RNA, 22 nt, Homo sapiens
guucccugacuccuccaaggaa

SEQ ID NO: 1008704 - RNA, 16 nt, Homo sapiens
guuccuuccaguguca

SEQ ID NO: 1008705 - RNA, 13 nt, Homo sapiens
guucgcuuaucaa

SEQ ID NO: 1008706 - RNA, 21 nt, Homo sapiens
guucuaccucaggcagcucaa

SEQ ID NO: 1008707 - RNA, 18 nt, Homo sapiens
guucucaauuccaacagu

SEQ ID NO: 1008708 - RNA, 21 nt, Homo sapiens
guucuccugcugcucccucag

SEQ ID NO: 1008709 - RNA, 18 nt, Homo sapiens
guucucggggcucaggag

SEQ ID NO: 1008710 - RNA, 11 nt, Homo sapiens
guucugcagcc

SEQ ID NO: 1008711 - RNA, 12 nt, Homo sapiens
guucugugcaca

SEQ ID NO: 1008712 - RNA, 14 nt, Homo sapiens
guucugugcacaaa

SEQ ID NO: 1008713 - RNA, 16 nt, Homo sapiens
guugaagccacugccu

SEQ ID NO: 1008714 - RNA, 12 nt, Homo sapiens
guugcuuuucag

SEQ ID NO: 1008715 - RNA, 13 nt, Homo sapiens
guuguuucuugcc

SEQ ID NO: 1008716 - RNA, 20 nt, Homo sapiens
guuuaaaaagaaaaaaugca

SEQ ID NO: 1008717 - RNA, 20 nt, Homo sapiens
guuuacagacgcugcuguca

SEQ ID NO: 1008718 - RNA, 13 nt, Homo sapiens
guuuagcucugag

SEQ ID NO: 1008719 - RNA, 18 nt, Homo sapiens
guuuauuaagcaucagaa

SEQ ID NO: 1008720 - RNA, 18 nt, Homo sapiens
guuucacagaaaauaagg

SEQ ID NO: 1008721 - RNA, 18 nt, Homo sapiens
guuucacagccuauaacc

SEQ ID NO: 1008722 - RNA, 13 nt, Homo sapiens
guuucagcacuag

SEQ ID NO: 1008723 - RNA, 20 nt, Homo sapiens
guuucccuuagagauuuugu

SEQ ID NO: 1008724 - RNA, 13 nt, Homo sapiens
guuuccuggucag

SEQ ID NO: 1008725 - RNA, 13 nt, Homo sapiens
guuucucccccau

SEQ ID NO: 1008726 - RNA, 17 nt, Homo sapiens
guuucugguggucuguu

SEQ ID NO: 1008727 - RNA, 22 nt, Homo sapiens
guuugacccaggggucagccuu

SEQ ID NO: 1008728 - RNA, 15 nt, Homo sapiens
guuuggaagcacuga

SEQ ID NO: 1008729 - RNA, 21 nt, Homo sapiens
guuuuacacuaaaaaaaugca

SEQ ID NO: 1008730 - RNA, 18 nt, Homo sapiens
guuuucagcccaucuccu

SEQ ID NO: 1008731 - RNA, 14 nt, Homo sapiens
guuuucuucauuca

SEQ ID NO: 1008732 - RNA, 16 nt, Homo sapiens
guuuuuaaaacccagu

SEQ ID NO: 1008733 - RNA, 21 nt, Homo sapiens
guuuuucuaaaggaguuuaug

SEQ ID NO: 1008734 - RNA, 13 nt, Homo sapiens
uaaaaauagacac

SEQ ID NO: 1008735 - RNA, 23 nt, Homo sapiens
uaaaaauggcaggggguggaauu

SEQ ID NO: 1008736 - RNA, 19 nt, Homo sapiens
uaaccagacacauacucau

SEQ ID NO: 1008737 - RNA, 21 nt, Homo sapiens
uaacccucacaagcaugaagu

SEQ ID NO: 1008738 - RNA, 22 nt, Homo sapiens
uaacccuuugugugcucuccau

SEQ ID NO: 1008739 - RNA, 14 nt, Homo sapiens
uaaccucugcacua

SEQ ID NO: 1008740 - RNA, 15 nt, Homo sapiens
uaaccuugugccuug

SEQ ID NO: 1008741 - RNA, 22 nt, Homo sapiens
uaacuggguaaugaaacaaaga

SEQ ID NO: 1008742 - RNA, 20 nt, Homo sapiens
uaacuucaaggcccauaucu

SEQ ID NO: 1008743 - RNA, 14 nt, Homo sapiens
uaagaaaacuaaga

SEQ ID NO: 1008744 - RNA, 16 nt, Homo sapiens
uaagaaagaucaaaga

SEQ ID NO: 1008745 - RNA, 18 nt, Homo sapiens
uaagagaaucaacauuuc

SEQ ID NO: 1008746 - RNA, 21 nt, Homo sapiens
uaagaugugauauucuaagac

SEQ ID NO: 1008747 - RNA, 16 nt, Homo sapiens
uaaggagaaaucuaua

SEQ ID NO: 1008748 - RNA, 12 nt, Homo sapiens
uaagggcacuga

SEQ ID NO: 1008749 - RNA, 13 nt, Homo sapiens
uaagggccagaaa

SEQ ID NO: 1008750 - RNA, 18 nt, Homo sapiens
uaagguaaaaugccauga

SEQ ID NO: 1008751 - RNA, 21 nt, Homo sapiens
uaagguuguuccccuaguucu

SEQ ID NO: 1008752 - RNA, 14 nt, Homo sapiens
uaaguuucugggac

SEQ ID NO: 1008753 - RNA, 15 nt, Homo sapiens
uaaguuugauuucau

SEQ ID NO: 1008754 - RNA, 15 nt, Homo sapiens
uaauacaaacuaauu

SEQ ID NO: 1008755 - RNA, 14 nt, Homo sapiens
uaauacaaacuaua

SEQ ID NO: 1008756 - RNA, 14 nt, Homo sapiens
uaauacaucaaaga

SEQ ID NO: 1008757 - RNA, 16 nt, Homo sapiens
uaauauauauuaucuu

SEQ ID NO: 1008758 - RNA, 18 nt, Homo sapiens
uaauaucccuacauguau

SEQ ID NO: 1008759 - RNA, 14 nt, Homo sapiens
uaaucaucaaguaa

SEQ ID NO: 1008760 - RNA, 15 nt, Homo sapiens
uaaugaaaacauuaa

SEQ ID NO: 1008761 - RNA, 14 nt, Homo sapiens
uaaugcaauauacu

SEQ ID NO: 1008762 - RNA, 14 nt, Homo sapiens
uaaugccucuucau

SEQ ID NO: 1008763 - RNA, 15 nt, Homo sapiens
uaauggggaggacaa

SEQ ID NO: 1008764 - RNA, 16 nt, Homo sapiens
uaauuaguaacaugug

SEQ ID NO: 1008765 - RNA, 21 nt, Homo sapiens
uaauuauuuauguauggugca

SEQ ID NO: 1008766 - RNA, 13 nt, Homo sapiens
uaauucuuucaau

SEQ ID NO: 1008767 - RNA, 15 nt, Homo sapiens
uaauuguguggauuc

SEQ ID NO: 1008768 - RNA, 15 nt, Homo sapiens
uaauuuuggauuuug

SEQ ID NO: 1008769 - RNA, 19 nt, Homo sapiens
uaauuuuuccuauauugca

SEQ ID NO: 1008770 - RNA, 16 nt, Homo sapiens
uaauuuuuuucuuaaa

SEQ ID NO: 1008771 - RNA, 23 nt, Homo sapiens
uacaaaucauccauccuugccaa

SEQ ID NO: 1008772 - RNA, 21 nt, Homo sapiens
uacaaauguuaaaauguguug

SEQ ID NO: 1008773 - RNA, 21 nt, Homo sapiens
uacaaccaauggaaugugaug

SEQ ID NO: 1008774 - RNA, 21 nt, Homo sapiens
uacaauaaaacuuugcugcca

SEQ ID NO: 1008775 - RNA, 11 nt, Homo sapiens
uacaauuguga

SEQ ID NO: 1008776 - RNA, 13 nt, Homo sapiens
uacaauugugagc

SEQ ID NO: 1008777 - RNA, 16 nt, Homo sapiens
uacaauuugacauaca

SEQ ID NO: 1008778 - RNA, 13 nt, Homo sapiens
uacaccacucugg

SEQ ID NO: 1008779 - RNA, 18 nt, Homo sapiens
uacacuaaaaaaaugcaa

SEQ ID NO: 1008780 - RNA, 23 nt, Homo sapiens
uacagagaagccaucaccucaga

SEQ ID NO: 1008781 - RNA, 17 nt, Homo sapiens
uacagauauuugucaug

SEQ ID NO: 1008782 - RNA, 22 nt, Homo sapiens
uacagaucaucuuggaacugca

SEQ ID NO: 1008783 - RNA, 13 nt, Homo sapiens
uacagaugggcaa

SEQ ID NO: 1008784 - RNA, 19 nt, Homo sapiens
uacagcuguauugucugaa

SEQ ID NO: 1008785 - RNA, 19 nt, Homo sapiens
uacauagggauaugcguau

SEQ ID NO: 1008786 - RNA, 13 nt, Homo sapiens
uacauaugugcug

SEQ ID NO: 1008787 - RNA, 13 nt, Homo sapiens
uacauccaaagca

SEQ ID NO: 1008788 - RNA, 17 nt, Homo sapiens
uacaugcauugagcucu

SEQ ID NO: 1008789 - RNA, 21 nt, Homo sapiens
uacaugcauugagcucucuca

SEQ ID NO: 1008790 - RNA, 20 nt, Homo sapiens
uacaugcuuauuccaugacu

SEQ ID NO: 1008791 - RNA, 13 nt, Homo sapiens
uacauggugcugg

SEQ ID NO: 1008792 - RNA, 21 nt, Homo sapiens
uacauuccaacucguauagca

SEQ ID NO: 1008793 - RNA, 19 nt, Homo sapiens
uacauugugggauguucag

SEQ ID NO: 1008794 - RNA, 15 nt, Homo sapiens
uacauuuucagugag

SEQ ID NO: 1008795 - RNA, 20 nt, Homo sapiens
uaccaccuuuacugugcuua

SEQ ID NO: 1008796 - RNA, 15 nt, Homo sapiens
uaccagaugcuuucc

SEQ ID NO: 1008797 - RNA, 15 nt, Homo sapiens
uagcaccauuaacuc

SEQ ID NO: 1008798 - RNA, 14 nt, Homo sapiens
uagcagacaguguu

SEQ ID NO: 1008799 - RNA, 23 nt, Homo sapiens
uagccagccggggcgaguggcac

SEQ ID NO: 1008800 - RNA, 23 nt, Homo sapiens
uagcucucccaacucuugcacag

SEQ ID NO: 1008801 - RNA, 12 nt, Homo sapiens
uagcucugagaa

SEQ ID NO: 1008802 - RNA, 23 nt, Homo sapiens
uagcugguucacacugaccaaga

SEQ ID NO: 1008803 - RNA, 21 nt, Homo sapiens
uaggaugcuugggaagacucc

SEQ ID NO: 1008804 - RNA, 20 nt, Homo sapiens
uaggccaagguguccuacag

SEQ ID NO: 1008805 - RNA, 11 nt, Homo sapiens
uaggcucuguc

SEQ ID NO: 1008806 - RNA, 19 nt, Homo sapiens
uagggacugaccagcagcu

SEQ ID NO: 1008807 - RNA, 24 nt, Homo sapiens
uagggauuuuuggcuacacacaaa

SEQ ID NO: 1008808 - RNA, 16 nt, Homo sapiens
uagggccgacgcugug

SEQ ID NO: 1008809 - RNA, 23 nt, Homo sapiens
uaggggccccucucagcccucac

SEQ ID NO: 1008810 - RNA, 23 nt, Homo sapiens
uagggggagccccuucugcucag

SEQ ID NO: 1008811 - RNA, 19 nt, Homo sapiens
uagguccccauacuccuau

SEQ ID NO: 1008812 - RNA, 18 nt, Homo sapiens
uagucaggaauggcugca

SEQ ID NO: 1008813 - RNA, 19 nt, Homo sapiens
uagucagggcaugcuuuau

SEQ ID NO: 1008814 - RNA, 20 nt, Homo sapiens
uagucagggcaugcuuuauu

SEQ ID NO: 1008815 - RNA, 12 nt, Homo sapiens
uagucucaguga

SEQ ID NO: 1008816 - RNA, 13 nt, Homo sapiens
uagugcuacaggg

SEQ ID NO: 1008817 - RNA, 14 nt, Homo sapiens
uaguguacuuggag

SEQ ID NO: 1008818 - RNA, 18 nt, Homo sapiens
uaguguauccauaaugca

SEQ ID NO: 1008819 - RNA, 22 nt, Homo sapiens
uaguucacauacaaaucaucca

SEQ ID NO: 1008820 - RNA, 14 nt, Homo sapiens
uaguucaugucugc

SEQ ID NO: 1008821 - RNA, 21 nt, Homo sapiens
uaguucugggcccagcgcagu

SEQ ID NO: 1008822 - RNA, 15 nt, Homo sapiens
uauaaaaagcuucca

SEQ ID NO: 1008823 - RNA, 23 nt, Homo sapiens
uauaaacuauaaccucuccuuca

SEQ ID NO: 1008824 - RNA, 23 nt, Homo sapiens
uauaaagauacagaacucuuuca

SEQ ID NO: 1008825 - RNA, 22 nt, Homo sapiens
uauaaaugaauuugcauaccag

SEQ ID NO: 1008826 - RNA, 11 nt, Homo sapiens
uauaacagugu

SEQ ID NO: 1008827 - RNA, 21 nt, Homo sapiens
uauaaccagacacauacucau

SEQ ID NO: 1008828 - RNA, 18 nt, Homo sapiens
uauaagaaagaucaaaga

SEQ ID NO: 1008829 - RNA, 21 nt, Homo sapiens
uauaagcaagaaggcaaaaau

SEQ ID NO: 1008830 - RNA, 15 nt, Homo sapiens
uauaagcugccauau

SEQ ID NO: 1008831 - RNA, 21 nt, Homo sapiens
uauaaucaucaaguaauacaa

SEQ ID NO: 1008832 - RNA, 20 nt, Homo sapiens
uauaauucuuucaauacaga

SEQ ID NO: 1008833 - RNA, 12 nt, Homo sapiens
uauacacugugu

SEQ ID NO: 1008834 - RNA, 20 nt, Homo sapiens
uauaccuguguuucuugccu

SEQ ID NO: 1008835 - RNA, 20 nt, Homo sapiens
uauacuagggagccauuuga

SEQ ID NO: 1008836 - RNA, 15 nt, Homo sapiens
uauacuguaggcaca

SEQ ID NO: 1008837 - RNA, 21 nt, Homo sapiens
uauacuugggaauauaaagga

SEQ ID NO: 1008838 - RNA, 23 nt, Homo sapiens
uauacuuucccuacccucuagag

SEQ ID NO: 1008839 - RNA, 17 nt, Homo sapiens
uauagccaauauaacua

SEQ ID NO: 1008840 - RNA, 18 nt, Homo sapiens
uauauaaaugugauugca

SEQ ID NO: 1008841 - RNA, 12 nt, Homo sapiens
uauauaaccaau

SEQ ID NO: 1008842 - RNA, 14 nt, Homo sapiens
uauauaauugccaa

SEQ ID NO: 1008843 - RNA, 13 nt, Homo sapiens
uauauacuuugaa

SEQ ID NO: 1008844 - RNA, 14 nt, Homo sapiens
uauauguacaugag

SEQ ID NO: 1008845 - RNA, 13 nt, Homo sapiens
uauauuaauauca

SEQ ID NO: 1008846 - RNA, 15 nt, Homo sapiens
uauauuuuugugcac

SEQ ID NO: 1008847 - RNA, 15 nt, Homo sapiens
uaucaaauaacucaa

SEQ ID NO: 1008848 - RNA, 14 nt, Homo sapiens
uaucaacagcauuu

SEQ ID NO: 1008849 - RNA, 13 nt, Homo sapiens
uaucaacuuccua

SEQ ID NO: 1008850 - RNA, 15 nt, Homo sapiens
uaucacaucacacaa

SEQ ID NO: 1008851 - RNA, 17 nt, Homo sapiens
uaucaccgugggcuccc

SEQ ID NO: 1008852 - RNA, 21 nt, Homo sapiens
uaucagugcuucccgagugag

SEQ ID NO: 1008853 - RNA, 14 nt, Homo sapiens
uaucauaugaacuu

SEQ ID NO: 1008854 - RNA, 17 nt, Homo sapiens
uaucaugcccugugcaa

SEQ ID NO: 1008855 - RNA, 13 nt, Homo sapiens
uauccaugcaccu

SEQ ID NO: 1008856 - RNA, 16 nt, Homo sapiens
ucacggccacacagcu

SEQ ID NO: 1008857 - RNA, 13 nt, Homo sapiens
ucacggccaggca

SEQ ID NO: 1008858 - RNA, 14 nt, Homo sapiens
ucacggcugcgcac

SEQ ID NO: 1008859 - RNA, 17 nt, Homo sapiens
ucacggcugcgcacugu

SEQ ID NO: 1008860 - RNA, 19 nt, Homo sapiens
ucacggcugcgcacugugu

SEQ ID NO: 1008861 - RNA, 21 nt, Homo sapiens
ucacuaggcccccacuugccu

SEQ ID NO: 1008862 - RNA, 18 nt, Homo sapiens
ucacugaguuuuccaugg

SEQ ID NO: 1008863 - RNA, 14 nt, Homo sapiens
ucacugcaaccucc

SEQ ID NO: 1008864 - RNA, 16 nt, Homo sapiens
ucacugcagccuccac

SEQ ID NO: 1008865 - RNA, 14 nt, Homo sapiens
ucacugcucuucag

SEQ ID NO: 1008866 - RNA, 21 nt, Homo sapiens
ucacugcugcaaauacuguau

SEQ ID NO: 1008867 - RNA, 22 nt, Homo sapiens
ucacugcugcaaauacuguaua

SEQ ID NO: 1008868 - RNA, 22 nt, Homo sapiens
ucacugucuuuaauucuguauc

SEQ ID NO: 1008869 - RNA, 12 nt, Homo sapiens
ucacuugaucuc

SEQ ID NO: 1008870 - RNA, 21 nt, Homo sapiens
ucacuuuuugaggcaaaagaa

SEQ ID NO: 1008871 - RNA, 18 nt, Homo sapiens
ucagaaaugcugucauaa

SEQ ID NO: 1008872 - RNA, 16 nt, Homo sapiens
ucagaccuggcugcuu

SEQ ID NO: 1008873 - RNA, 14 nt, Homo sapiens
ucagagaccuucca

SEQ ID NO: 1008874 - RNA, 22 nt, Homo sapiens
ucagaguucuuuuugaaguauu

SEQ ID NO: 1008875 - RNA, 18 nt, Homo sapiens
ucagauaccgacuggggc

SEQ ID NO: 1008876 - RNA, 17 nt, Homo sapiens
ucagauggcagcuuuua

SEQ ID NO: 1008877 - RNA, 22 nt, Homo sapiens
ucagcaagacuucucuuugccu

SEQ ID NO: 1008878 - RNA, 15 nt, Homo sapiens
ucagcacuagccaaa

SEQ ID NO: 1008879 - RNA, 21 nt, Homo sapiens
ucagcacugucccuugccuca

SEQ ID NO: 1008880 - RNA, 23 nt, Homo sapiens
ucagcauuuucuucucugcacuu

SEQ ID NO: 1008881 - RNA, 22 nt, Homo sapiens
ucagcccugcaccaugcugcug

SEQ ID NO: 1008882 - RNA, 15 nt, Homo sapiens
ucagccuuagcucuc

SEQ ID NO: 1008883 - RNA, 18 nt, Homo sapiens
ucagcgcugucaggauug

SEQ ID NO: 1008884 - RNA, 21 nt, Homo sapiens
ucaggauugcgagagaugugu

SEQ ID NO: 1008885 - RNA, 21 nt, Homo sapiens
ucaggguaccuggggccaaac

SEQ ID NO: 1008886 - RNA, 13 nt, Homo sapiens
ucagguaauacaa

SEQ ID NO: 1008887 - RNA, 20 nt, Homo sapiens
ucagguauaccucacuuuac

SEQ ID NO: 1008888 - RNA, 12 nt, Homo sapiens
ucagguucucau

SEQ ID NO: 1008889 - RNA, 20 nt, Homo sapiens
ucaguaaagaacguggucag

SEQ ID NO: 1008890 - RNA, 16 nt, Homo sapiens
ucaguaaauaacugga

SEQ ID NO: 1008891 - RNA, 18 nt, Homo sapiens
ucaguaaauaacuggaaa

SEQ ID NO: 1008892 - RNA, 12 nt, Homo sapiens
ucaguaccccau

SEQ ID NO: 1008893 - RNA, 18 nt, Homo sapiens
ucaguaguucacauacaa

SEQ ID NO: 1008894 - RNA, 22 nt, Homo sapiens
ucaguccauugcucuugagucu

SEQ ID NO: 1008895 - RNA, 17 nt, Homo sapiens
ucagucgcuagcauuuc

SEQ ID NO: 1008896 - RNA, 13 nt, Homo sapiens
ucagucucugagc

SEQ ID NO: 1008897 - RNA, 13 nt, Homo sapiens
ucagucugugaaa

SEQ ID NO: 1008898 - RNA, 16 nt, Homo sapiens
ucagugaagacuauga

SEQ ID NO: 1008899 - RNA, 23 nt, Homo sapiens
ucaguguaccgcgucuacccugg

SEQ ID NO: 1008900 - RNA, 22 nt, Homo sapiens
ucaguguagaaccuaauucaau

SEQ ID NO: 1008901 - RNA, 16 nt, Homo sapiens
ucccaaauuugauuga

SEQ ID NO: 1008902 - RNA, 17 nt, Homo sapiens
ucccaacucuugcacag

SEQ ID NO: 1008903 - RNA, 20 nt, Homo sapiens
ucccaagagcaucaugccuc

SEQ ID NO: 1008904 - RNA, 18 nt, Homo sapiens
ucccaaguagaaucucag

SEQ ID NO: 1008905 - RNA, 13 nt, Homo sapiens
ucccacaggacau

SEQ ID NO: 1008906 - RNA, 19 nt, Homo sapiens
ucccacaggcaccagcaaa

SEQ ID NO: 1008907 - RNA, 18 nt, Homo sapiens
ucccacaugggcccaggc

SEQ ID NO: 1008908 - RNA, 18 nt, Homo sapiens
ucccacccccaucucucc

SEQ ID NO: 1008909 - RNA, 23 nt, Homo sapiens
ucccagacggucaggaaaacugu

SEQ ID NO: 1008910 - RNA, 21 nt, Homo sapiens
ucccagaggagccaccaguuc

SEQ ID NO: 1008911 - RNA, 19 nt, Homo sapiens
ucccagcuauuccuacucu

SEQ ID NO: 1008912 - RNA, 14 nt, Homo sapiens
ucccaggacccuga

SEQ ID NO: 1008913 - RNA, 22 nt, Homo sapiens
ucccagguguuaacauuccaag

SEQ ID NO: 1008914 - RNA, 16 nt, Homo sapiens
ucccaugaccccaaag

SEQ ID NO: 1008915 - RNA, 12 nt, Homo sapiens
ucccauugccau

SEQ ID NO: 1008916 - RNA, 13 nt, Homo sapiens
ucccauugccaug

SEQ ID NO: 1008917 - RNA, 20 nt, Homo sapiens
ucccauuuuugcuuagcuca

SEQ ID NO: 1008918 - RNA, 15 nt, Homo sapiens
uccccaacaugcacu

SEQ ID NO: 1008919 - RNA, 13 nt, Homo sapiens
uccccaaggcacu

SEQ ID NO: 1008920 - RNA, 14 nt, Homo sapiens
uccccaaggcacuu

SEQ ID NO: 1008921 - RNA, 20 nt, Homo sapiens
uccccaccagaugcugaaaa

SEQ ID NO: 1008922 - RNA, 16 nt, Homo sapiens
uccccagaugugacua

SEQ ID NO: 1008923 - RNA, 16 nt, Homo sapiens
uccccagcccagagac

SEQ ID NO: 1008924 - RNA, 21 nt, Homo sapiens
uccccaguucauugcacuuug

SEQ ID NO: 1008925 - RNA, 17 nt, Homo sapiens
ucccccucucccaguug

SEQ ID NO: 1008926 - RNA, 18 nt, Homo sapiens
ucccccuuugugcacauu

SEQ ID NO: 1008927 - RNA, 22 nt, Homo sapiens
uccccuaggcgcuguucuugcu

SEQ ID NO: 1008928 - RNA, 16 nt, Homo sapiens
uccccuccucuugccu

SEQ ID NO: 1008929 - RNA, 16 nt, Homo sapiens
uccccugcacuguaaa

SEQ ID NO: 1008930 - RNA, 18 nt, Homo sapiens
uccccugcacuguaaaau

SEQ ID NO: 1008931 - RNA, 24 nt, Homo sapiens
uccccugcuacaccuauuauccca

SEQ ID NO: 1008932 - RNA, 20 nt, Homo sapiens
uccccuggggagucugggca

SEQ ID NO: 1008933 - RNA, 16 nt, Homo sapiens
uccccuggugguggaa

SEQ ID NO: 1008934 - RNA, 15 nt, Homo sapiens
uccccuucccuccaa

SEQ ID NO: 1008935 - RNA, 16 nt, Homo sapiens
ucccuauuaaccuaga

SEQ ID NO: 1008936 - RNA, 23 nt, Homo sapiens
ucccucaccuuggcaccagacac

SEQ ID NO: 1008937 - RNA, 15 nt, Homo sapiens
ucccucaucaaggac

SEQ ID NO: 1008938 - RNA, 16 nt, Homo sapiens
ucccuccccugccauu

SEQ ID NO: 1008939 - RNA, 17 nt, Homo sapiens
ucccucucaacacccag

SEQ ID NO: 1008940 - RNA, 16 nt, Homo sapiens
ucccucuuucuuccca

SEQ ID NO: 1008941 - RNA, 14 nt, Homo sapiens
ucccugacuguaaa

SEQ ID NO: 1008942 - RNA, 16 nt, Homo sapiens
ucccugacuguaaaug

SEQ ID NO: 1008943 - RNA, 23 nt, Homo sapiens
ucccuggcccccucccuggauga

SEQ ID NO: 1008944 - RNA, 15 nt, Homo sapiens
ucccuggugcuuaug

SEQ ID NO: 1008945 - RNA, 14 nt, Homo sapiens
ucccuguggucuac

SEQ ID NO: 1008946 - RNA, 18 nt, Homo sapiens
ucccuguguugucucuag

SEQ ID NO: 1008947 - RNA, 23 nt, Homo sapiens
uucugcaggcuucagccauccac

SEQ ID NO: 1008948 - RNA, 17 nt, Homo sapiens
uucugcauauguugaau

SEQ ID NO: 1008949 - RNA, 14 nt, Homo sapiens
uucuggauaccauu

SEQ ID NO: 1008950 - RNA, 15 nt, Homo sapiens
uucuguacucaaaug

SEQ ID NO: 1008951 - RNA, 13 nt, Homo sapiens
uucugugacaaaa

SEQ ID NO: 1008952 - RNA, 17 nt, Homo sapiens
uucuuagucacaaaaua

SEQ ID NO: 1008953 - RNA, 16 nt, Homo sapiens
uucuuuuauacugaca

SEQ ID NO: 1008954 - RNA, 15 nt, Homo sapiens
uucuuuucuuuacaa

SEQ ID NO: 1008955 - RNA, 20 nt, Homo sapiens
uugaaaaaaaacaguggauc

SEQ ID NO: 1008956 - RNA, 16 nt, Homo sapiens
uugaaaccccaucucu

SEQ ID NO: 1008957 - RNA, 16 nt, Homo sapiens
uugaaauaagaauuca

SEQ ID NO: 1008958 - RNA, 14 nt, Homo sapiens
uugaacguuuucua

SEQ ID NO: 1008959 - RNA, 20 nt, Homo sapiens
uugaaggugcugacggccag

SEQ ID NO: 1008960 - RNA, 15 nt, Homo sapiens
uugaaguagcucuuu

SEQ ID NO: 1008961 - RNA, 19 nt, Homo sapiens
uugacaguucauauguacc

SEQ ID NO: 1008962 - RNA, 22 nt, Homo sapiens
uugacuagaugauggaugccaa

SEQ ID NO: 1008963 - RNA, 12 nt, Homo sapiens
uugagauauuaa

SEQ ID NO: 1008964 - RNA, 22 nt, Homo sapiens
uugagcaguggcugguccaggg

SEQ ID NO: 1008965 - RNA, 16 nt, Homo sapiens
uugaggcaaaagaagg

SEQ ID NO: 1008966 - RNA, 19 nt, Homo sapiens
uugaggcauuuccagacuu

SEQ ID NO: 1008967 - RNA, 13 nt, Homo sapiens
uugauacuguugc

SEQ ID NO: 1008968 - RNA, 17 nt, Homo sapiens
uugauagaaccauugca

SEQ ID NO: 1008969 - RNA, 19 nt, Homo sapiens
uugauccauuucuaauuau

SEQ ID NO: 1008970 - RNA, 17 nt, Homo sapiens
uugauccugggggacca

SEQ ID NO: 1008971 - RNA, 21 nt, Homo sapiens
uugaucuggaacccagacuca

SEQ ID NO: 1008972 - RNA, 22 nt, Homo sapiens
uugauuuuuauaaauacugcaa

SEQ ID NO: 1008973 - RNA, 15 nt, Homo sapiens
uugcaaaaacuacaa

SEQ ID NO: 1008974 - RNA, 13 nt, Homo sapiens
uugcaaggcauuu

SEQ ID NO: 1008975 - RNA, 18 nt, Homo sapiens
uugcagaaaauucugugc

SEQ ID NO: 1008976 - RNA, 17 nt, Homo sapiens
uugcaguucccacauua

SEQ ID NO: 1008977 - RNA, 20 nt, Homo sapiens
uugcaucucaguaugaauua

SEQ ID NO: 1008978 - RNA, 19 nt, Homo sapiens
uugccauuaaacuuaccug

SEQ ID NO: 1008979 - RNA, 20 nt, Homo sapiens
uugcccaggcuggucucaaa

SEQ ID NO: 1008980 - RNA, 15 nt, Homo sapiens
uugccucaaccuccc

SEQ ID NO: 1008981 - RNA, 19 nt, Homo sapiens
uugccucaaugccaguaac

SEQ ID NO: 1008982 - RNA, 17 nt, Homo sapiens
uugccugugccagguga

SEQ ID NO: 1008983 - RNA, 19 nt, Homo sapiens
uugcguuuguauauccaaa

SEQ ID NO: 1008984 - RNA, 14 nt, Homo sapiens
uugcuaaagacaug

SEQ ID NO: 1008985 - RNA, 23 nt, Homo sapiens
uugcuggggcucgugcccugcau

SEQ ID NO: 1008986 - RNA, 13 nt, Homo sapiens
uuggaaccagacu

SEQ ID NO: 1008987 - RNA, 22 nt, Homo sapiens
uuggaacuugccugccuuucca

SEQ ID NO: 1008988 - RNA, 14 nt, Homo sapiens
uuggaagauggcau

SEQ ID NO: 1008989 - RNA, 17 nt, Homo sapiens
uuggagcucauucuguc

SEQ ID NO: 1008990 - RNA, 22 nt, Homo sapiens
uuggagcucauucugucucuuu

SEQ ID NO: 1008991 - RNA, 17 nt, Homo sapiens
uuggagguuaaggcaua

SEQ ID NO: 1008992 - RNA, 15 nt, Homo sapiens
uuggauucuuuccau

SEQ ID NO: 1008993 - RNA, 13 nt, Homo sapiens
uuggcaaugccau

SEQ ID NO: 1008994 - RNA, 18 nt, Homo sapiens
uuggcaccgaagcccaga

SEQ ID NO: 1008995 - RNA, 20 nt, Homo sapiens
uuggccuguagaguugcuga

SEQ ID NO: 1008996 - RNA, 18 nt, Homo sapiens
uuggcguaggcuacagag

SEQ ID NO: 1008997 - RNA, 17 nt, Homo sapiens
uuggcguuuggacccag

SEQ ID NO: 1008998 - RNA, 16 nt, Homo sapiens
uugggagacaugugac

SEQ ID NO: 1008999 - RNA, 12 nt, Homo sapiens
uugggaguugua

SEQ ID NO: 1009000 - RNA, 15 nt, Homo sapiens
uugggcccuuugagu

SEQ ID NO: 1009001 - RNA, 12 nt, Homo sapiens
uugggcucugau

SEQ ID NO: 1009002 - RNA, 14 nt, Homo sapiens
uugggcuugcuauu

SEQ ID NO: 1009003 - RNA, 20 nt, Homo sapiens
uuucauacuguaacauucag

SEQ ID NO: 1009004 - RNA, 19 nt, Homo sapiens
uuucauccauaacugaaca

SEQ ID NO: 1009005 - RNA, 16 nt, Homo sapiens
uuucaucucuauuuag

SEQ ID NO: 1009006 - RNA, 23 nt, Homo sapiens
uuucaucuucaguugucucugau

SEQ ID NO: 1009007 - RNA, 21 nt, Homo sapiens
uuucaugauaaugaacagaac

SEQ ID NO: 1009008 - RNA, 15 nt, Homo sapiens
uuuccaacuacuaau

SEQ ID NO: 1009009 - RNA, 13 nt, Homo sapiens
uuucccauugcca

SEQ ID NO: 1009010 - RNA, 22 nt, Homo sapiens
uuucccuuccugggucuaccac

SEQ ID NO: 1009011 - RNA, 22 nt, Homo sapiens
uuuccucagccuuaagaaccau

SEQ ID NO: 1009012 - RNA, 22 nt, Homo sapiens
uuuccucuccacacagugcuca

SEQ ID NO: 1009013 - RNA, 12 nt, Homo sapiens
uuuccucugcau

SEQ ID NO: 1009014 - RNA, 12 nt, Homo sapiens
uuuccugccucc

SEQ ID NO: 1009015 - RNA, 15 nt, Homo sapiens
uuucuauagccaaaa

SEQ ID NO: 1009016 - RNA, 20 nt, Homo sapiens
uuucuauuaaaagacucauc

SEQ ID NO: 1009017 - RNA, 20 nt, Homo sapiens
uuucucccucuuucuuccca

SEQ ID NO: 1009018 - RNA, 20 nt, Homo sapiens
uuucuccucacuguauccag

SEQ ID NO: 1009019 - RNA, 18 nt, Homo sapiens
uuucucuuucccuggucc

SEQ ID NO: 1009020 - RNA, 16 nt, Homo sapiens
uuucugaauugcacau

SEQ ID NO: 1009021 - RNA, 21 nt, Homo sapiens
uuucugggagacagaaaacau

SEQ ID NO: 1009022 - RNA, 21 nt, Homo sapiens
uuucugucguuaaaaacagau

SEQ ID NO: 1009023 - RNA, 12 nt, Homo sapiens
uuucuugccuca

SEQ ID NO: 1009024 - RNA, 16 nt, Homo sapiens
uuugaaaaagcgaaaa

SEQ ID NO: 1009025 - RNA, 23 nt, Homo sapiens
uuugaaaaugggcucaaccagaa

SEQ ID NO: 1009026 - RNA, 22 nt, Homo sapiens
uuugaagcuacuguguguguga

SEQ ID NO: 1009027 - RNA, 20 nt, Homo sapiens
uuugaaggcaaaauugcaaa

SEQ ID NO: 1009028 - RNA, 14 nt, Homo sapiens
uuugacaaccauga

SEQ ID NO: 1009029 - RNA, 15 nt, Homo sapiens
uuugaggcaaaagaa

SEQ ID NO: 1009030 - RNA, 18 nt, Homo sapiens
uuugauacuaagcauuga

SEQ ID NO: 1009031 - RNA, 14 nt, Homo sapiens
uuugauagaaccau

SEQ ID NO: 1009032 - RNA, 19 nt, Homo sapiens
uuugaugaggcccuccaca

SEQ ID NO: 1009033 - RNA, 14 nt, Homo sapiens
uuugcugguuucau

SEQ ID NO: 1009034 - RNA, 18 nt, Homo sapiens
uuugcuguggaacuacau

SEQ ID NO: 1009035 - RNA, 17 nt, Homo sapiens
uuugcuuuuugugauau

SEQ ID NO: 1009036 - RNA, 22 nt, Homo sapiens
uuuggaaguuuagcucugagaa

SEQ ID NO: 1009037 - RNA, 16 nt, Homo sapiens
uuuggaggaagauaca

SEQ ID NO: 1009038 - RNA, 13 nt, Homo sapiens
uuugggccagaca

SEQ ID NO: 1009039 - RNA, 15 nt, Homo sapiens
uuuggggcaggagua

SEQ ID NO: 1009040 - RNA, 18 nt, Homo sapiens
uuuggggggaguaaagaa

SEQ ID NO: 1009041 - RNA, 17 nt, Homo sapiens
uuuguccccacuuacag

SEQ ID NO: 1009042 - RNA, 17 nt, Homo sapiens
uuuguuaagacugcuga

SEQ ID NO: 1009043 - RNA, 11 nt, Homo sapiens
uuuguugacau

SEQ ID NO: 1009044 - RNA, 13 nt, Homo sapiens
uuuguuucaauga

SEQ ID NO: 1009045 - RNA, 16 nt, Homo sapiens
uuuguuuuuacaaaau

SEQ ID NO: 1009046 - RNA, 20 nt, Homo sapiens
uuuuaaguuucucugcagaa

SEQ ID NO: 1009047 - RNA, 21 nt, Homo sapiens
uuuuaauuuaaacaccuccuc

SEQ ID NO: 1009048 - RNA, 15 nt, Homo sapiens
uuuuacacuugcauc

SEQ ID NO: 1009049 - RNA, 17 nt, Homo sapiens
uuuuacugcucugagaa

SEQ ID NO: 1009050 - RNA, 18 nt, Homo sapiens
uuuuagggagaacgggaa

SEQ ID NO: 1009051 - RNA, 19 nt, Homo sapiens
uuuuauaaaaaugagugcu

SEQ ID NO: 1009052 - RNA, 14 nt, Homo sapiens
uuuuauugccuuga

SEQ ID NO: 1009053 - RNA, 21 nt, Homo sapiens
uuuucacugccugaccuuuaa

SEQ ID NO: 1009054 - RNA, 12 nt, Homo sapiens
uuuucacuugua

SEQ ID NO: 1009055 - RNA, 14 nt, Homo sapiens
uuuuccaacuacua

SEQ ID NO: 1009056 - RNA, 15 nt, Homo sapiens
uuuucugauaaaaga

SEQ ID NO: 1009057 - RNA, 18 nt, Homo sapiens
uuuugaaaaagcgaaaaa

SEQ ID NO: 1009058 - RNA, 14 nt, Homo sapiens
uuuugaaggcaaaa

SEQ ID NO: 1009059 - RNA, 22 nt, Homo sapiens
uuuugagauggagucuugcucu

SEQ ID NO: 1009060 - RNA, 12 nt, Homo sapiens
aaaaaaccacau

SEQ ID NO: 1009061 - RNA, 11 nt, Homo sapiens
aaaaaauuacu

SEQ ID NO: 1009062 - RNA, 23 nt, Homo sapiens
aaaaaccaucaaguugugccaaa

SEQ ID NO: 1009063 - RNA, 21 nt, Homo sapiens
aaaaauaagauaucaacugcc

SEQ ID NO: 1009064 - RNA, 15 nt, Homo sapiens
aaaaaucagugaaua

SEQ ID NO: 1009065 - RNA, 15 nt, Homo sapiens
aaaaaugucaucuca

SEQ ID NO: 1009066 - RNA, 16 nt, Homo sapiens
aaaacaagcauucaca

SEQ ID NO: 1009067 - RNA, 11 nt, Homo sapiens
aaaacugccuc

SEQ ID NO: 1009068 - RNA, 18 nt, Homo sapiens
aaaacuggcuacugcucu

SEQ ID NO: 1009069 - RNA, 15 nt, Homo sapiens
aaaacugugccuugu

SEQ ID NO: 1009070 - RNA, 18 nt, Homo sapiens
aaaacuuuggaaccagac

SEQ ID NO: 1009071 - RNA, 18 nt, Homo sapiens
aaaauagagccugaggga

SEQ ID NO: 1009072 - RNA, 13 nt, Homo sapiens
aaaauagcaaaag

SEQ ID NO: 1009073 - RNA, 16 nt, Homo sapiens
aaaauccuaacauuca

SEQ ID NO: 1009074 - RNA, 13 nt, Homo sapiens
aaaaugagugcuu

SEQ ID NO: 1009075 - RNA, 16 nt, Homo sapiens
aaaauguaaagccaug

SEQ ID NO: 1009076 - RNA, 18 nt, Homo sapiens
aaaaugugcacacauaua

SEQ ID NO: 1009077 - RNA, 15 nt, Homo sapiens
aaaauuagacuguga

SEQ ID NO: 1009078 - RNA, 23 nt, Homo sapiens
aaaauuauuuaaaccgcuaaaag

SEQ ID NO: 1009079 - RNA, 18 nt, Homo sapiens
aaaauuauuugcauaaca

SEQ ID NO: 1009080 - RNA, 14 nt, Homo sapiens
aaaauucacaugau

SEQ ID NO: 1009081 - RNA, 15 nt, Homo sapiens
aaaauuccacucaaa

SEQ ID NO: 1009082 - RNA, 21 nt, Homo sapiens
aaaauuuuuuuuguaacugga

SEQ ID NO: 1009083 - RNA, 15 nt, Homo sapiens
aaacaaccaugucau

SEQ ID NO: 1009084 - RNA, 12 nt, Homo sapiens
aaacaacucuuu

SEQ ID NO: 1009085 - RNA, 18 nt, Homo sapiens
aaacaaugaaaacucuuu

SEQ ID NO: 1009086 - RNA, 10 nt, Homo sapiens
aaacagccac

SEQ ID NO: 1009087 - RNA, 16 nt, Homo sapiens
aaacaucauuacuaua

SEQ ID NO: 1009088 - RNA, 16 nt, Homo sapiens
aaaccaauugcugcua

SEQ ID NO: 1009089 - RNA, 23 nt, Homo sapiens
aaaccacgccucuugaccaggcu

SEQ ID NO: 1009090 - RNA, 17 nt, Homo sapiens
aaacccccaaaccagau

SEQ ID NO: 1009091 - RNA, 16 nt, Homo sapiens
aaacguccuacuguau

SEQ ID NO: 1009092 - RNA, 21 nt, Homo sapiens
aaacuaauuuaguaauagccu

SEQ ID NO: 1009093 - RNA, 12 nt, Homo sapiens
aaacucuucccu

SEQ ID NO: 1009094 - RNA, 14 nt, Homo sapiens
aaacuguacagugu

SEQ ID NO: 1009095 - RNA, 12 nt, Homo sapiens
aaacugugcacc

SEQ ID NO: 1009096 - RNA, 17 nt, Homo sapiens
aaacuuauuuacaaaua

SEQ ID NO: 1009097 - RNA, 22 nt, Homo sapiens
aaacuuccaauuucuagccaua

SEQ ID NO: 1009098 - RNA, 23 nt, Homo sapiens
aaacuuggcucgaaucucugugc

SEQ ID NO: 1009099 - RNA, 15 nt, Homo sapiens
aaacuuuaucacuua

SEQ ID NO: 1009100 - RNA, 23 nt, Homo sapiens
aaacuuuuuuucuguaccaguua

SEQ ID NO: 1009101 - RNA, 23 nt, Homo sapiens
aaagaaggcauuugcaggguccu

SEQ ID NO: 1009102 - RNA, 14 nt, Homo sapiens
aaagaaguaaaagc

SEQ ID NO: 1009103 - RNA, 19 nt, Homo sapiens
aaagaauaugaaacauaga

SEQ ID NO: 1009104 - RNA, 14 nt, Homo sapiens
aaagagacagugau

SEQ ID NO: 1009105 - RNA, 15 nt, Homo sapiens
aaagaggaaccagga

SEQ ID NO: 1009106 - RNA, 21 nt, Homo sapiens
aaagaguuugaugaggcccuc

SEQ ID NO: 1009107 - RNA, 19 nt, Homo sapiens
aaagauugauuuguguguu

SEQ ID NO: 1009108 - RNA, 21 nt, Homo sapiens
aagcccaaguucaugcagcug

SEQ ID NO: 1009109 - RNA, 15 nt, Homo sapiens
aagcccagugcacug

SEQ ID NO: 1009110 - RNA, 19 nt, Homo sapiens
aagcccauuuguguacaca

SEQ ID NO: 1009111 - RNA, 18 nt, Homo sapiens
aagccuauguaugccaug

SEQ ID NO: 1009112 - RNA, 18 nt, Homo sapiens
aagccuggccuacauggu

SEQ ID NO: 1009113 - RNA, 16 nt, Homo sapiens
aagccugggugacauu

SEQ ID NO: 1009114 - RNA, 21 nt, Homo sapiens
aagccuuccccuuauccuccc

SEQ ID NO: 1009115 - RNA, 14 nt, Homo sapiens
aagcuaggucgugg

SEQ ID NO: 1009116 - RNA, 21 nt, Homo sapiens
aagcucagaggcgcacuguga

SEQ ID NO: 1009117 - RNA, 14 nt, Homo sapiens
aagcucugcagucc

SEQ ID NO: 1009118 - RNA, 16 nt, Homo sapiens
aagcugacucaaaaau

SEQ ID NO: 1009119 - RNA, 14 nt, Homo sapiens
aagcugccauauau

SEQ ID NO: 1009120 - RNA, 23 nt, Homo sapiens
aagcuuauuuaagaucacaguga

SEQ ID NO: 1009121 - RNA, 22 nt, Homo sapiens
aagcuuucauguaaacugugca

SEQ ID NO: 1009122 - RNA, 15 nt, Homo sapiens
aaggaaaaaaccauc

SEQ ID NO: 1009123 - RNA, 18 nt, Homo sapiens
aaggaaaaaaccauccag

SEQ ID NO: 1009124 - RNA, 13 nt, Homo sapiens
aaggaacauaccc

SEQ ID NO: 1009125 - RNA, 12 nt, Homo sapiens
aaggaacuucca

SEQ ID NO: 1009126 - RNA, 11 nt, Homo sapiens
aaggacucuca

SEQ ID NO: 1009127 - RNA, 18 nt, Homo sapiens
aaggagaggcaacaucca

SEQ ID NO: 1009128 - RNA, 16 nt, Homo sapiens
aaggagccccauuccu

SEQ ID NO: 1009129 - RNA, 15 nt, Homo sapiens
aaggagcugauacuu

SEQ ID NO: 1009130 - RNA, 22 nt, Homo sapiens
aaggaggucaggccccacuccu

SEQ ID NO: 1009131 - RNA, 23 nt, Homo sapiens
aaggcaauuccugauggaaaaug

SEQ ID NO: 1009132 - RNA, 18 nt, Homo sapiens
aaggcccauaucugugaa

SEQ ID NO: 1009133 - RNA, 13 nt, Homo sapiens
aaggccucugugg

SEQ ID NO: 1009134 - RNA, 22 nt, Homo sapiens
aaggcucccggaauuccgucac

SEQ ID NO: 1009135 - RNA, 20 nt, Homo sapiens
aagggaauucggugugcacc

SEQ ID NO: 1009136 - RNA, 20 nt, Homo sapiens
aagggauggacaucuuguca

SEQ ID NO: 1009137 - RNA, 20 nt, Homo sapiens
aagggccacaucccacugcc

SEQ ID NO: 1009138 - RNA, 16 nt, Homo sapiens
aagggccgacuaagag

SEQ ID NO: 1009139 - RNA, 13 nt, Homo sapiens
aagggcugcuucc

SEQ ID NO: 1009140 - RNA, 17 nt, Homo sapiens
aaggggacccuccgcuc

SEQ ID NO: 1009141 - RNA, 21 nt, Homo sapiens
aagggguuggauugcaauauc

SEQ ID NO: 1009142 - RNA, 19 nt, Homo sapiens
aaggguucaagauuguucc

SEQ ID NO: 1009143 - RNA, 16 nt, Homo sapiens
aagguaaaaugccaug

SEQ ID NO: 1009144 - RNA, 20 nt, Homo sapiens
aagguccucugucagucaca

SEQ ID NO: 1009145 - RNA, 13 nt, Homo sapiens
aagguuaucagug

SEQ ID NO: 1009146 - RNA, 16 nt, Homo sapiens
aaguaauacaaacuaa

SEQ ID NO: 1009147 - RNA, 12 nt, Homo sapiens
aaguagugugaa

SEQ ID NO: 1009148 - RNA, 13 nt, Homo sapiens
aaguauaaaugaa

SEQ ID NO: 1009149 - RNA, 20 nt, Homo sapiens
aaguccuaguuguucagcau

SEQ ID NO: 1009150 - RNA, 15 nt, Homo sapiens
aagucugcuacccuc

SEQ ID NO: 1009151 - RNA, 16 nt, Homo sapiens
aagucuguuuacugca

SEQ ID NO: 1009152 - RNA, 15 nt, Homo sapiens
aagugagggcucacu

SEQ ID NO: 1009153 - RNA, 20 nt, Homo sapiens
aagugaucugcccaccucag

SEQ ID NO: 1009154 - RNA, 15 nt, Homo sapiens
aagugcugcacucaa

SEQ ID NO: 1009155 - RNA, 21 nt, Homo sapiens
aagugcugccgcgcagugugg

SEQ ID NO: 1009156 - RNA, 15 nt, Homo sapiens
aagugucaacucuuu

SEQ ID NO: 1009157 - RNA, 19 nt, Homo sapiens
aaguugauuagaaagacca

SEQ ID NO: 1009158 - RNA, 11 nt, Homo sapiens
aaguugcagcu

SEQ ID NO: 1009159 - RNA, 15 nt, Homo sapiens
aaguugcuauuugaa

SEQ ID NO: 1009160 - RNA, 16 nt, Homo sapiens
aaguuuagcucugaga

SEQ ID NO: 1009161 - RNA, 20 nt, Homo sapiens
aaguuuuuuauuaugcauua

SEQ ID NO: 1009162 - RNA, 20 nt, Homo sapiens
aauaaaggaugugauugugg

SEQ ID NO: 1009163 - RNA, 18 nt, Homo sapiens
aauaaaguucuguacuca

SEQ ID NO: 1009164 - RNA, 15 nt, Homo sapiens
aauaaauauccuuua

SEQ ID NO: 1009165 - RNA, 17 nt, Homo sapiens
aauaaaucugacccagu

SEQ ID NO: 1009166 - RNA, 21 nt, Homo sapiens
aauaaauggcuguaaaaucuc

SEQ ID NO: 1009167 - RNA, 16 nt, Homo sapiens
aauaaauugcucaaau

SEQ ID NO: 1009168 - RNA, 13 nt, Homo sapiens
aauaaccaauccu

SEQ ID NO: 1009169 - RNA, 19 nt, Homo sapiens
aauaacucaacuaacucca

SEQ ID NO: 1009170 - RNA, 17 nt, Homo sapiens
aauaacuccucccaggg

SEQ ID NO: 1009171 - RNA, 19 nt, Homo sapiens
aauaauguccuuucauuug

SEQ ID NO: 1009172 - RNA, 14 nt, Homo sapiens
aauaaugugcacug

SEQ ID NO: 1009173 - RNA, 17 nt, Homo sapiens
aauacaaugauccugua

SEQ ID NO: 1009174 - RNA, 20 nt, Homo sapiens
aauacagucuuccauuugca

SEQ ID NO: 1009175 - RNA, 21 nt, Homo sapiens
aauacagucuuccauuugcaa

SEQ ID NO: 1009176 - RNA, 14 nt, Homo sapiens
aauacaucaaagag

SEQ ID NO: 1009177 - RNA, 21 nt, Homo sapiens
aauacugcugagauacauaca

SEQ ID NO: 1009178 - RNA, 18 nt, Homo sapiens
aauacuuuuuacaauuaa

SEQ ID NO: 1009179 - RNA, 19 nt, Homo sapiens
aauagcagccuuucucucu

SEQ ID NO: 1009180 - RNA, 17 nt, Homo sapiens
aauagcuaaauaccuca

SEQ ID NO: 1009181 - RNA, 18 nt, Homo sapiens
aauagcuguaaacuucca

SEQ ID NO: 1009182 - RNA, 15 nt, Homo sapiens
aauagugucauccuc

SEQ ID NO: 1009183 - RNA, 21 nt, Homo sapiens
aauauagcuaauaacauguga

SEQ ID NO: 1009184 - RNA, 19 nt, Homo sapiens
aauaucacagaaaagcaug

SEQ ID NO: 1009185 - RNA, 16 nt, Homo sapiens
aauauccuuuaauuga

SEQ ID NO: 1009186 - RNA, 16 nt, Homo sapiens
aauaugaguaauacau

SEQ ID NO: 1009187 - RNA, 19 nt, Homo sapiens
aauaugcacaauagcaguu

SEQ ID NO: 1009188 - RNA, 15 nt, Homo sapiens
aauaugggggccuuu

SEQ ID NO: 1009189 - RNA, 16 nt, Homo sapiens
aauauguaaaugguau

SEQ ID NO: 1009190 - RNA, 15 nt, Homo sapiens
aaucaaaaucucucc

SEQ ID NO: 1009191 - RNA, 19 nt, Homo sapiens
aaucaaaaucucuccacuu

SEQ ID NO: 1009192 - RNA, 18 nt, Homo sapiens
aaucaaccaaacaaagaa

SEQ ID NO: 1009193 - RNA, 12 nt, Homo sapiens
aaucaacuuuac

SEQ ID NO: 1009194 - RNA, 22 nt, Homo sapiens
aaucaaguauuugggaagugaa

SEQ ID NO: 1009195 - RNA, 16 nt, Homo sapiens
aaucaauaaagaccac

SEQ ID NO: 1009196 - RNA, 21 nt, Homo sapiens
aaucaauaaagaccacuuuac

SEQ ID NO: 1009197 - RNA, 17 nt, Homo sapiens
aaucagaacuguuggca

SEQ ID NO: 1009198 - RNA, 19 nt, Homo sapiens
aaucaggaauauuuuccaa

SEQ ID NO: 1009199 - RNA, 16 nt, Homo sapiens
aaucaucaaguaauac

SEQ ID NO: 1009200 - RNA, 18 nt, Homo sapiens
aaucaucaaguaauacaa

SEQ ID NO: 1009201 - RNA, 21 nt, Homo sapiens
aaucaugugaaauuuaggcag

SEQ ID NO: 1009202 - RNA, 17 nt, Homo sapiens
aaucauuauuacuuuug

SEQ ID NO: 1009203 - RNA, 20 nt, Homo sapiens
aauccaaauggcgucuggaa

SEQ ID NO: 1009204 - RNA, 19 nt, Homo sapiens
aauccaauggguuuuuccc

SEQ ID NO: 1009205 - RNA, 12 nt, Homo sapiens
aauccaugaacc

SEQ ID NO: 1009206 - RNA, 19 nt, Homo sapiens
aaucccagcccccugacca

SEQ ID NO: 1009207 - RNA, 20 nt, Homo sapiens
aaucccuccccgugacugca

SEQ ID NO: 1009208 - RNA, 17 nt, Homo sapiens
aauccucccuuccuccc

SEQ ID NO: 1009209 - RNA, 17 nt, Homo sapiens
aauccuuccacuaucau

SEQ ID NO: 1009210 - RNA, 14 nt, Homo sapiens
aaucuacuaauucc

SEQ ID NO: 1009211 - RNA, 15 nt, Homo sapiens
aaucuacuaauucca

SEQ ID NO: 1009212 - RNA, 17 nt, Homo sapiens
cuacauaugaucugucu

SEQ ID NO: 1009213 - RNA, 16 nt, Homo sapiens
cuacauguauugcaca

SEQ ID NO: 1009214 - RNA, 18 nt, Homo sapiens
cuaccucaggcagcucaa

SEQ ID NO: 1009215 - RNA, 20 nt, Homo sapiens
cuaccuugaaagaagaaaag

SEQ ID NO: 1009216 - RNA, 21 nt, Homo sapiens
cuacucugugccagagccugg

SEQ ID NO: 1009217 - RNA, 20 nt, Homo sapiens
cuacugacggaguccugugu

SEQ ID NO: 1009218 - RNA, 20 nt, Homo sapiens
cuacugaguagggggagcaa

SEQ ID NO: 1009219 - RNA, 21 nt, Homo sapiens
cuacuggggaaacuggccaug

SEQ ID NO: 1009220 - RNA, 22 nt, Homo sapiens
cuacuucuccccuccucuugcc

SEQ ID NO: 1009221 - RNA, 23 nt, Homo sapiens
cuacuucuccccuccucuugccu

SEQ ID NO: 1009222 - RNA, 17 nt, Homo sapiens
cuacuugcucagguacu

SEQ ID NO: 1009223 - RNA, 16 nt, Homo sapiens
cuacuuucccucuggg

SEQ ID NO: 1009224 - RNA, 19 nt, Homo sapiens
cuagaacaugguuaccaug

SEQ ID NO: 1009225 - RNA, 18 nt, Homo sapiens
cuagacauggagguucua

SEQ ID NO: 1009226 - RNA, 15 nt, Homo sapiens
cuagagcacugccac

SEQ ID NO: 1009227 - RNA, 13 nt, Homo sapiens
cuagagugacuca

SEQ ID NO: 1009228 - RNA, 18 nt, Homo sapiens
cuagauucaaagguucua

SEQ ID NO: 1009229 - RNA, 13 nt, Homo sapiens
cuagcauugcacu

SEQ ID NO: 1009230 - RNA, 23 nt, Homo sapiens
cuagcauuguaaaauuauuucau

SEQ ID NO: 1009231 - RNA, 14 nt, Homo sapiens
cuagccucaggggu

SEQ ID NO: 1009232 - RNA, 14 nt, Homo sapiens
cuagcugugggggu

SEQ ID NO: 1009233 - RNA, 18 nt, Homo sapiens
cuaggaaauccauucaca

SEQ ID NO: 1009234 - RNA, 18 nt, Homo sapiens
cuaggaagagcaggacuc

SEQ ID NO: 1009235 - RNA, 16 nt, Homo sapiens
cuaggauuuuaaggga

SEQ ID NO: 1009236 - RNA, 22 nt, Homo sapiens
cuaggcaccucagaccaaucau

SEQ ID NO: 1009237 - RNA, 16 nt, Homo sapiens
cuaggccugggcagug

SEQ ID NO: 1009238 - RNA, 16 nt, Homo sapiens
cuaggucacuucucac

SEQ ID NO: 1009239 - RNA, 16 nt, Homo sapiens
cuagguggaaaagccu

SEQ ID NO: 1009240 - RNA, 20 nt, Homo sapiens
cuagguucuaaaaauuguga

SEQ ID NO: 1009241 - RNA, 23 nt, Homo sapiens
cuagguucuaaaaauugugauca

SEQ ID NO: 1009242 - RNA, 15 nt, Homo sapiens
cuagguuucaaagau

SEQ ID NO: 1009243 - RNA, 20 nt, Homo sapiens
cuaguacuaugucaaagcaa

SEQ ID NO: 1009244 - RNA, 17 nt, Homo sapiens
cuaguauggggugggag

SEQ ID NO: 1009245 - RNA, 18 nt, Homo sapiens
cuaguggccgaaccagaa

SEQ ID NO: 1009246 - RNA, 13 nt, Homo sapiens
cuaguucuaccuc

SEQ ID NO: 1009247 - RNA, 17 nt, Homo sapiens
cuaguuuuuauacaugu

SEQ ID NO: 1009248 - RNA, 21 nt, Homo sapiens
cuauaauuuaccuaagauuac

SEQ ID NO: 1009249 - RNA, 13 nt, Homo sapiens
cuauaguucuaga

SEQ ID NO: 1009250 - RNA, 22 nt, Homo sapiens
cuauccaaucaaucuugcaugu

SEQ ID NO: 1009251 - RNA, 18 nt, Homo sapiens
cuauccucucuuccucuu

SEQ ID NO: 1009252 - RNA, 14 nt, Homo sapiens
cuaucuacuacaaa

SEQ ID NO: 1009253 - RNA, 21 nt, Homo sapiens
cuaucuacuacaaacuucaaa

SEQ ID NO: 1009254 - RNA, 12 nt, Homo sapiens
cuaucucuacug

SEQ ID NO: 1009255 - RNA, 15 nt, Homo sapiens
cuaugacuugggcac

SEQ ID NO: 1009256 - RNA, 14 nt, Homo sapiens
cuauguuauauuga

SEQ ID NO: 1009257 - RNA, 23 nt, Homo sapiens
cuauuaggugcaauuucaagguu

SEQ ID NO: 1009258 - RNA, 19 nt, Homo sapiens
cuauuucacuggagcacaa

SEQ ID NO: 1009259 - RNA, 22 nt, Homo sapiens
cuauuucauguuuuugaucaaa

SEQ ID NO: 1009260 - RNA, 16 nt, Homo sapiens
cuauuucuccaaagcc

SEQ ID NO: 1009261 - RNA, 19 nt, Homo sapiens
cuauuucuucuacugcuau

SEQ ID NO: 1009262 - RNA, 18 nt, Homo sapiens
cuauuuuaaagacaaugu

SEQ ID NO: 1009263 - RNA, 15 nt, Homo sapiens
cucaaacaaugacaa

SEQ ID NO: 1009264 - RNA, 20 nt, Homo sapiens
cucaaauaaaaagugcuuuu

SEQ ID NO: 1009265 - RNA, 19 nt, Homo sapiens
cucaacaggccucagggcu

SEQ ID NO: 1009266 - RNA, 17 nt, Homo sapiens
cucaaccucuacagggu

SEQ ID NO: 1009267 - RNA, 14 nt, Homo sapiens
cucaacuaacucca

SEQ ID NO: 1009268 - RNA, 16 nt, Homo sapiens
cucaagaugaaggcaa

SEQ ID NO: 1009269 - RNA, 19 nt, Homo sapiens
cucaaggacuuugcagccg

SEQ ID NO: 1009270 - RNA, 14 nt, Homo sapiens
cucaagguuuuagg

SEQ ID NO: 1009271 - RNA, 12 nt, Homo sapiens
cucaaguucuaa

SEQ ID NO: 1009272 - RNA, 19 nt, Homo sapiens
cucaaguucuaagauucua

SEQ ID NO: 1009273 - RNA, 19 nt, Homo sapiens
cucaauaaaugauucuuag

SEQ ID NO: 1009274 - RNA, 15 nt, Homo sapiens
cucaaugccaguaac

SEQ ID NO: 1009275 - RNA, 18 nt, Homo sapiens
cucacacucgacaugaaa

SEQ ID NO: 1009276 - RNA, 14 nt, Homo sapiens
cucacagagugcau

SEQ ID NO: 1009277 - RNA, 18 nt, Homo sapiens
cucacaucagagugacau

SEQ ID NO: 1009278 - RNA, 17 nt, Homo sapiens
cucacccagucuucuac

SEQ ID NO: 1009279 - RNA, 20 nt, Homo sapiens
cucacccgccccacucccuc

SEQ ID NO: 1009280 - RNA, 22 nt, Homo sapiens
cucacuaggcccccacuugccu

SEQ ID NO: 1009281 - RNA, 14 nt, Homo sapiens
cucacucagcacuu

SEQ ID NO: 1009282 - RNA, 21 nt, Homo sapiens
cucacugcugcaaauacugua

SEQ ID NO: 1009283 - RNA, 17 nt, Homo sapiens
cucacuguugaauuuuc

SEQ ID NO: 1009284 - RNA, 21 nt, Homo sapiens
cucacuucagguauaccucac

SEQ ID NO: 1009285 - RNA, 18 nt, Homo sapiens
cucacuugugcaguguug

SEQ ID NO: 1009286 - RNA, 12 nt, Homo sapiens
cucagaccugaa

SEQ ID NO: 1009287 - RNA, 16 nt, Homo sapiens
cucagaggcgcacugu

SEQ ID NO: 1009288 - RNA, 21 nt, Homo sapiens
cucagccacuugccugugcua

SEQ ID NO: 1009289 - RNA, 21 nt, Homo sapiens
cucagccuuggcagcccugau

SEQ ID NO: 1009290 - RNA, 16 nt, Homo sapiens
cucagcuaagcucacg

SEQ ID NO: 1009291 - RNA, 17 nt, Homo sapiens
cucagcucccacaagcc

SEQ ID NO: 1009292 - RNA, 13 nt, Homo sapiens
cucaggacagaug

SEQ ID NO: 1009293 - RNA, 17 nt, Homo sapiens
cucagguguugccaaau

SEQ ID NO: 1009294 - RNA, 23 nt, Homo sapiens
cucagucuuaaaaaaauaugccu

SEQ ID NO: 1009295 - RNA, 15 nt, Homo sapiens
cucaguuucuaggca

SEQ ID NO: 1009296 - RNA, 13 nt, Homo sapiens
cucaucacuagga

SEQ ID NO: 1009297 - RNA, 18 nt, Homo sapiens
cucaucaguaguucacau

SEQ ID NO: 1009298 - RNA, 23 nt, Homo sapiens
cucauguugaagccacugccuuc

SEQ ID NO: 1009299 - RNA, 21 nt, Homo sapiens
cucauuggacccuuccauggu

SEQ ID NO: 1009300 - RNA, 21 nt, Homo sapiens
cucauuuaaaagcauaaggcc

SEQ ID NO: 1009301 - RNA, 14 nt, Homo sapiens
cuccaaaaugugcc

SEQ ID NO: 1009302 - RNA, 13 nt, Homo sapiens
cuccaacaccaag

SEQ ID NO: 1009303 - RNA, 15 nt, Homo sapiens
cuccacacagugcuc

SEQ ID NO: 1009304 - RNA, 23 nt, Homo sapiens
cuccacacagugcucaaggccag

SEQ ID NO: 1009305 - RNA, 16 nt, Homo sapiens
cuccacaggcacaggu

SEQ ID NO: 1009306 - RNA, 13 nt, Homo sapiens
cuccacauauuuc

SEQ ID NO: 1009307 - RNA, 16 nt, Homo sapiens
cuccacccacugugga

SEQ ID NO: 1009308 - RNA, 20 nt, Homo sapiens
cuccaccgucuuucuuuuau

SEQ ID NO: 1009309 - RNA, 17 nt, Homo sapiens
cuccaccuagacuguaa

SEQ ID NO: 1009310 - RNA, 20 nt, Homo sapiens
cuccagauaguguagcugag

SEQ ID NO: 1009311 - RNA, 22 nt, Homo sapiens
cuccagccccuguagaacucaa

SEQ ID NO: 1009312 - RNA, 18 nt, Homo sapiens
cuccaggcccaaggcucc

SEQ ID NO: 1009313 - RNA, 22 nt, Homo sapiens
cuccagguggcucugaggugcc

SEQ ID NO: 1009314 - RNA, 10 nt, Homo sapiens
cuccaucucc

SEQ ID NO: 1009315 - RNA, 21 nt, Homo sapiens
cuccauguagaagccacuauu

SEQ ID NO: 1009316 - RNA, 15 nt, Homo sapiens
cuguacagugucuuu

SEQ ID NO: 1009317 - RNA, 14 nt, Homo sapiens
cuguacaugcauug

SEQ ID NO: 1009318 - RNA, 22 nt, Homo sapiens
cuguagaaaaaaaaauucacau

SEQ ID NO: 1009319 - RNA, 15 nt, Homo sapiens
cuguagaguugcuga

SEQ ID NO: 1009320 - RNA, 21 nt, Homo sapiens
cuguagauucagguaauacaa

SEQ ID NO: 1009321 - RNA, 19 nt, Homo sapiens
cuguaggcacacuuugcac

SEQ ID NO: 1009322 - RNA, 12 nt, Homo sapiens
cugucaccaccc

SEQ ID NO: 1009323 - RNA, 12 nt, Homo sapiens
cuguccagcucc

SEQ ID NO: 1009324 - RNA, 15 nt, Homo sapiens
cuguccucagccuug

SEQ ID NO: 1009325 - RNA, 17 nt, Homo sapiens
cuguccuuuaugauccc

SEQ ID NO: 1009326 - RNA, 16 nt, Homo sapiens
cugucuacuugcucag

SEQ ID NO: 1009327 - RNA, 16 nt, Homo sapiens
cugucucgaugcaaug

SEQ ID NO: 1009328 - RNA, 19 nt, Homo sapiens
cugucuucagagaacccac

SEQ ID NO: 1009329 - RNA, 14 nt, Homo sapiens
cugucuuuaauucu

SEQ ID NO: 1009330 - RNA, 13 nt, Homo sapiens
cugugacuuugcc

SEQ ID NO: 1009331 - RNA, 23 nt, Homo sapiens
cugugagccgauuguccuaucuc

SEQ ID NO: 1009332 - RNA, 18 nt, Homo sapiens
cugugauacgaugcuuca

SEQ ID NO: 1009333 - RNA, 22 nt, Homo sapiens
cugugcaaccucuuggccugau

SEQ ID NO: 1009334 - RNA, 18 nt, Homo sapiens
cugugcacugcccaugga

SEQ ID NO: 1009335 - RNA, 21 nt, Homo sapiens
cugugcagguucccacuuaaa

SEQ ID NO: 1009336 - RNA, 19 nt, Homo sapiens
cugugcuauggugcucugu

SEQ ID NO: 1009337 - RNA, 21 nt, Homo sapiens
cuguggaacuacauuacugua

SEQ ID NO: 1009338 - RNA, 14 nt, Homo sapiens
cuguggcagaguua

SEQ ID NO: 1009339 - RNA, 16 nt, Homo sapiens
cugugggggugagggu

SEQ ID NO: 1009340 - RNA, 16 nt, Homo sapiens
cuguguagcugugacc

SEQ ID NO: 1009341 - RNA, 13 nt, Homo sapiens
cuguguuaggggu

SEQ ID NO: 1009342 - RNA, 13 nt, Homo sapiens
cuguguuaugcaa

SEQ ID NO: 1009343 - RNA, 17 nt, Homo sapiens
cuguguuucuugccuca

SEQ ID NO: 1009344 - RNA, 15 nt, Homo sapiens
cuguuccccagagaa

SEQ ID NO: 1009345 - RNA, 19 nt, Homo sapiens
cuguuuauuaaaguacaac

SEQ ID NO: 1009346 - RNA, 21 nt, Homo sapiens
cuguuuauuaaaguacaacca

SEQ ID NO: 1009347 - RNA, 16 nt, Homo sapiens
cuguuuccuagcugug

SEQ ID NO: 1009348 - RNA, 21 nt, Homo sapiens
cuguuucuuaagggcacacac

SEQ ID NO: 1009349 - RNA, 20 nt, Homo sapiens
cuguuugcccccauucacuu

SEQ ID NO: 1009350 - RNA, 15 nt, Homo sapiens
cuguuuucucucggc

SEQ ID NO: 1009351 - RNA, 19 nt, Homo sapiens
cuguuuucuuuugguaaag

SEQ ID NO: 1009352 - RNA, 20 nt, Homo sapiens
cuuaaaggggagaccucaga

SEQ ID NO: 1009353 - RNA, 16 nt, Homo sapiens
cuuaacggaccaaagc

SEQ ID NO: 1009354 - RNA, 19 nt, Homo sapiens
cuuaacggaccaaagcaag

SEQ ID NO: 1009355 - RNA, 21 nt, Homo sapiens
cuuaagcccagugcacugaaa

SEQ ID NO: 1009356 - RNA, 21 nt, Homo sapiens
cuuaauacuaaggaaccaaca

SEQ ID NO: 1009357 - RNA, 20 nt, Homo sapiens
cuuacauuuacaaacugaag

SEQ ID NO: 1009358 - RNA, 20 nt, Homo sapiens
cuuacucccaggcacugucu

SEQ ID NO: 1009359 - RNA, 16 nt, Homo sapiens
cuuacucuaagaucuu

SEQ ID NO: 1009360 - RNA, 20 nt, Homo sapiens
cuuacucuaagaucuuagau

SEQ ID NO: 1009361 - RNA, 18 nt, Homo sapiens
cuuagaaaacaaguauug

SEQ ID NO: 1009362 - RNA, 20 nt, Homo sapiens
cuuaggaaggccuucaggag

SEQ ID NO: 1009363 - RNA, 15 nt, Homo sapiens
cuuaucaacuaauga

SEQ ID NO: 1009364 - RNA, 21 nt, Homo sapiens
cuuauccuccaccgucuuucu

SEQ ID NO: 1009365 - RNA, 18 nt, Homo sapiens
cuuaugcuguacccaguu

SEQ ID NO: 1009366 - RNA, 13 nt, Homo sapiens
cuucaaauucaaa

SEQ ID NO: 1009367 - RNA, 20 nt, Homo sapiens
cuucacaccuacccuccuuu

SEQ ID NO: 1009368 - RNA, 16 nt, Homo sapiens
cuucagagagcagugc

SEQ ID NO: 1009369 - RNA, 21 nt, Homo sapiens
cuucaguaaaugugauucacc

SEQ ID NO: 1009370 - RNA, 22 nt, Homo sapiens
cuucauccucugagugugacca

SEQ ID NO: 1009371 - RNA, 21 nt, Homo sapiens
cuucaugaucaucacaaucau

SEQ ID NO: 1009372 - RNA, 14 nt, Homo sapiens
cuucauguguccca

SEQ ID NO: 1009373 - RNA, 14 nt, Homo sapiens
cuuccacugagggc

SEQ ID NO: 1009374 - RNA, 23 nt, Homo sapiens
cuuccagguguuacuguaauucc

SEQ ID NO: 1009375 - RNA, 18 nt, Homo sapiens
cuuccauuugcaagggaa

SEQ ID NO: 1009376 - RNA, 12 nt, Homo sapiens
cuuccauuugcu

SEQ ID NO: 1009377 - RNA, 12 nt, Homo sapiens
cuucccaaagca

SEQ ID NO: 1009378 - RNA, 22 nt, Homo sapiens
cuucccccaagauugagcucuc

SEQ ID NO: 1009379 - RNA, 11 nt, Homo sapiens
cuucccugugc

SEQ ID NO: 1009380 - RNA, 21 nt, Homo sapiens
cuuccuaaauauuaugagaug

SEQ ID NO: 1009381 - RNA, 17 nt, Homo sapiens
cuuccugaguggugcca

SEQ ID NO: 1009382 - RNA, 15 nt, Homo sapiens
cuuccugcuugccaa

SEQ ID NO: 1009383 - RNA, 19 nt, Homo sapiens
cuuccugguagaccacugc

SEQ ID NO: 1009384 - RNA, 22 nt, Homo sapiens
cuucgggcugugcccggggaaa

SEQ ID NO: 1009385 - RNA, 19 nt, Homo sapiens
cuucuaaacccaauccaaa

SEQ ID NO: 1009386 - RNA, 16 nt, Homo sapiens
cuucuacugcuaucua

SEQ ID NO: 1009387 - RNA, 19 nt, Homo sapiens
cuucuauaauuuugccuuu

SEQ ID NO: 1009388 - RNA, 15 nt, Homo sapiens
cuucuauggggucua

SEQ ID NO: 1009389 - RNA, 15 nt, Homo sapiens
cuucuauuuggggcu

SEQ ID NO: 1009390 - RNA, 20 nt, Homo sapiens
cuucucaaauuagcugcaau

SEQ ID NO: 1009391 - RNA, 20 nt, Homo sapiens
cuucucaggacacaggccug

SEQ ID NO: 1009392 - RNA, 12 nt, Homo sapiens
cuucucauuucu

SEQ ID NO: 1009393 - RNA, 13 nt, Homo sapiens
cuucuccaucucc

SEQ ID NO: 1009394 - RNA, 24 nt, Homo sapiens
cuucucccaggcaaggcuguggac

SEQ ID NO: 1009395 - RNA, 19 nt, Homo sapiens
cuucucuccagcugacuaa

SEQ ID NO: 1009396 - RNA, 21 nt, Homo sapiens
cuucugagaucuguugauuga

SEQ ID NO: 1009397 - RNA, 14 nt, Homo sapiens
cuucugagcacugu

SEQ ID NO: 1009398 - RNA, 12 nt, Homo sapiens
cuucugcuaaaa

SEQ ID NO: 1009399 - RNA, 23 nt, Homo sapiens
cuucugcuuucucgggaauuuuc

SEQ ID NO: 1009400 - RNA, 14 nt, Homo sapiens
cuucuggccaggaa

SEQ ID NO: 1009401 - RNA, 15 nt, Homo sapiens
cuucuuacuggugcu

SEQ ID NO: 1009402 - RNA, 16 nt, Homo sapiens
cuucuuacuggugcua

SEQ ID NO: 1009403 - RNA, 22 nt, Homo sapiens
cuucuuauggaauugauuugca

SEQ ID NO: 1009404 - RNA, 20 nt, Homo sapiens
cuucuugccucugugcugug

SEQ ID NO: 1009405 - RNA, 13 nt, Homo sapiens
cuucuuguucccc

SEQ ID NO: 1009406 - RNA, 21 nt, Homo sapiens
cuugaaauucucaucagucca

SEQ ID NO: 1009407 - RNA, 20 nt, Homo sapiens
cuugagccaguaauuggucc

SEQ ID NO: 1009408 - RNA, 12 nt, Homo sapiens
cuugaugauuga

SEQ ID NO: 1009409 - RNA, 17 nt, Homo sapiens
cuugauguuggaucuca

SEQ ID NO: 1009410 - RNA, 17 nt, Homo sapiens
cuugauucugcaguaaa

SEQ ID NO: 1009411 - RNA, 14 nt, Homo sapiens
cuugcauuaugcaa

SEQ ID NO: 1009412 - RNA, 17 nt, Homo sapiens
cuugccugaacuccugc

SEQ ID NO: 1009413 - RNA, 17 nt, Homo sapiens
cuugcuaccaguauuua

SEQ ID NO: 1009414 - RNA, 18 nt, Homo sapiens
cuugcuauucugucccua

SEQ ID NO: 1009415 - RNA, 15 nt, Homo sapiens
cuugcuggucuaguc

SEQ ID NO: 1009416 - RNA, 14 nt, Homo sapiens
cuuggaacugcauu

SEQ ID NO: 1009417 - RNA, 16 nt, Homo sapiens
cuuggacuugcauucc

SEQ ID NO: 1009418 - RNA, 20 nt, Homo sapiens
cuuggcaccagacacccagg

SEQ ID NO: 1009419 - RNA, 15 nt, Homo sapiens
cuuggcagcccugau

SEQ ID NO: 1009420 - RNA, 21 nt, Homo sapiens
gauuuguuuuuaaacuguaca

SEQ ID NO: 1009421 - RNA, 20 nt, Homo sapiens
gauuuuacaugaaguauuuu

SEQ ID NO: 1009422 - RNA, 16 nt, Homo sapiens
gauuuuucucuucauu

SEQ ID NO: 1009423 - RNA, 13 nt, Homo sapiens
gcaaaaucuacca

SEQ ID NO: 1009424 - RNA, 22 nt, Homo sapiens
gcaaacaguguucugugacaaa

SEQ ID NO: 1009425 - RNA, 21 nt, Homo sapiens
gcaaacugcaugcccagagac

SEQ ID NO: 1009426 - RNA, 16 nt, Homo sapiens
gcaaagcccccagagc

SEQ ID NO: 1009427 - RNA, 19 nt, Homo sapiens
gcaaauaacaaaugccaaa

SEQ ID NO: 1009428 - RNA, 15 nt, Homo sapiens
gcaaaucgugccuug

SEQ ID NO: 1009429 - RNA, 15 nt, Homo sapiens
gcaaaugcaaaaacu

SEQ ID NO: 1009430 - RNA, 17 nt, Homo sapiens
gcaaaugucaugcugcc

SEQ ID NO: 1009431 - RNA, 23 nt, Homo sapiens
gcaaaugugcuggucacccuuca

SEQ ID NO: 1009432 - RNA, 14 nt, Homo sapiens
gcaacacagugaga

SEQ ID NO: 1009433 - RNA, 18 nt, Homo sapiens
gcaacauucauagucuuu

SEQ ID NO: 1009434 - RNA, 23 nt, Homo sapiens
gcaacuaggaaaaucacuugcca

SEQ ID NO: 1009435 - RNA, 14 nt, Homo sapiens
gcaacuuaauacuc

SEQ ID NO: 1009436 - RNA, 22 nt, Homo sapiens
gcaagacuucucuuugccucaa

SEQ ID NO: 1009437 - RNA, 16 nt, Homo sapiens
gcaaggaaacuaugua

SEQ ID NO: 1009438 - RNA, 23 nt, Homo sapiens
gcaaggaaacuauguaacaugua

SEQ ID NO: 1009439 - RNA, 23 nt, Homo sapiens
gcaaggcuguggaccauggagug

SEQ ID NO: 1009440 - RNA, 21 nt, Homo sapiens
gcaauaaaucugacccagugc

SEQ ID NO: 1009441 - RNA, 18 nt, Homo sapiens
gcaaugagggagcaugua

SEQ ID NO: 1009442 - RNA, 11 nt, Homo sapiens
gcacacuuugc

SEQ ID NO: 1009443 - RNA, 23 nt, Homo sapiens
gcacaggacaugcgguagccagc

SEQ ID NO: 1009444 - RNA, 16 nt, Homo sapiens
gcacaggagcuaccug

SEQ ID NO: 1009445 - RNA, 20 nt, Homo sapiens
gcacauuccccuugccuaaa

SEQ ID NO: 1009446 - RNA, 13 nt, Homo sapiens
gcaccauucugac

SEQ ID NO: 1009447 - RNA, 17 nt, Homo sapiens
gcaccccaaagcuuucc

SEQ ID NO: 1009448 - RNA, 16 nt, Homo sapiens
gcacccccugcagcuu

SEQ ID NO: 1009449 - RNA, 19 nt, Homo sapiens
gcaccuacacucaccugca

SEQ ID NO: 1009450 - RNA, 21 nt, Homo sapiens
gcaccuaccuuagaaaacaag

SEQ ID NO: 1009451 - RNA, 21 nt, Homo sapiens
gcaccucacaggccccaggaa

SEQ ID NO: 1009452 - RNA, 22 nt, Homo sapiens
gcacguggccucuugagcagug

SEQ ID NO: 1009453 - RNA, 13 nt, Homo sapiens
gcacgugugcugg

SEQ ID NO: 1009454 - RNA, 14 nt, Homo sapiens
gcacugacugggac

SEQ ID NO: 1009455 - RNA, 13 nt, Homo sapiens
gcacugaugcugc

SEQ ID NO: 1009456 - RNA, 14 nt, Homo sapiens
gcacuggcaccaag

SEQ ID NO: 1009457 - RNA, 19 nt, Homo sapiens
gcacugugacccccagcuc

SEQ ID NO: 1009458 - RNA, 20 nt, Homo sapiens
gcagaaccggagagccagcu

SEQ ID NO: 1009459 - RNA, 14 nt, Homo sapiens
gcagaccacugaua

SEQ ID NO: 1009460 - RNA, 21 nt, Homo sapiens
gcagaccacugauaaaaccau

SEQ ID NO: 1009461 - RNA, 20 nt, Homo sapiens
gcagagccacagcugugcau

SEQ ID NO: 1009462 - RNA, 22 nt, Homo sapiens
gcagagcuagguggaaaagccu

SEQ ID NO: 1009463 - RNA, 14 nt, Homo sapiens
gcagaggccagagg

SEQ ID NO: 1009464 - RNA, 21 nt, Homo sapiens
gcagcaaggaaagcucacgaa

SEQ ID NO: 1009465 - RNA, 17 nt, Homo sapiens
gcagcauuuuauuuacc

SEQ ID NO: 1009466 - RNA, 21 nt, Homo sapiens
gcagccuaacacggugcucau

SEQ ID NO: 1009467 - RNA, 19 nt, Homo sapiens
gcagccugagcaacucuug

SEQ ID NO: 1009468 - RNA, 22 nt, Homo sapiens
gcagccuugugaugucauacag

SEQ ID NO: 1009469 - RNA, 12 nt, Homo sapiens
gcaggagaauca

SEQ ID NO: 1009470 - RNA, 14 nt, Homo sapiens
gcaggaguagcuga

SEQ ID NO: 1009471 - RNA, 15 nt, Homo sapiens
gcaggaguagcugag

SEQ ID NO: 1009472 - RNA, 18 nt, Homo sapiens
gcaggcugggccaugucc

SEQ ID NO: 1009473 - RNA, 19 nt, Homo sapiens
gcaggcugggccaugucca

SEQ ID NO: 1009474 - RNA, 16 nt, Homo sapiens
gcagggaacaugggga

SEQ ID NO: 1009475 - RNA, 16 nt, Homo sapiens
gcaggggccuggagau

SEQ ID NO: 1009476 - RNA, 17 nt, Homo sapiens
gcagucgugccuguguc

SEQ ID NO: 1009477 - RNA, 12 nt, Homo sapiens
gcagugccuugu

SEQ ID NO: 1009478 - RNA, 14 nt, Homo sapiens
gcaguggugcaauc

SEQ ID NO: 1009479 - RNA, 23 nt, Homo sapiens
gcaguucugaguguuuaauuuca

SEQ ID NO: 1009480 - RNA, 19 nt, Homo sapiens
gcauaagaaaacuaagaaa

SEQ ID NO: 1009481 - RNA, 13 nt, Homo sapiens
gcaucuugcauua

SEQ ID NO: 1009482 - RNA, 14 nt, Homo sapiens
gcauggaacagcau

SEQ ID NO: 1009483 - RNA, 21 nt, Homo sapiens
gcaugucacuucccugcuuaa

SEQ ID NO: 1009484 - RNA, 13 nt, Homo sapiens
gcauucagacucc

SEQ ID NO: 1009485 - RNA, 20 nt, Homo sapiens
gcauuccagccccucugguc

SEQ ID NO: 1009486 - RNA, 20 nt, Homo sapiens
gccaacaaagaacacuaacu

SEQ ID NO: 1009487 - RNA, 14 nt, Homo sapiens
gccaagaagcagug

SEQ ID NO: 1009488 - RNA, 16 nt, Homo sapiens
gccaagggauggacau

SEQ ID NO: 1009489 - RNA, 23 nt, Homo sapiens
gccaagggauggacaucuuguca

SEQ ID NO: 1009490 - RNA, 19 nt, Homo sapiens
gccaagggccgacuaagag

SEQ ID NO: 1009491 - RNA, 17 nt, Homo sapiens
gccaauauaacuaucuc

SEQ ID NO: 1009492 - RNA, 21 nt, Homo sapiens
gccacagaccuaggauuucau

SEQ ID NO: 1009493 - RNA, 16 nt, Homo sapiens
gccaccgcccagagac

SEQ ID NO: 1009494 - RNA, 13 nt, Homo sapiens
gccagaacuugac

SEQ ID NO: 1009495 - RNA, 15 nt, Homo sapiens
gccagcacucgcuag

SEQ ID NO: 1009496 - RNA, 14 nt, Homo sapiens
gccagcagcaccug

SEQ ID NO: 1009497 - RNA, 15 nt, Homo sapiens
gccagcagcaccugc

SEQ ID NO: 1009498 - RNA, 14 nt, Homo sapiens
gccagcuucaggug

SEQ ID NO: 1009499 - RNA, 12 nt, Homo sapiens
gccagugacaga

SEQ ID NO: 1009500 - RNA, 13 nt, Homo sapiens
gccaucaccucag

SEQ ID NO: 1009501 - RNA, 23 nt, Homo sapiens
gccaucaccucagauggcagcuu

SEQ ID NO: 1009502 - RNA, 15 nt, Homo sapiens
gccauguggacuggu

SEQ ID NO: 1009503 - RNA, 22 nt, Homo sapiens
gccauuuuggguuuugggucuu

SEQ ID NO: 1009504 - RNA, 17 nt, Homo sapiens
gcccacccccggcagca

SEQ ID NO: 1009505 - RNA, 15 nt, Homo sapiens
gcccacgacacugca

SEQ ID NO: 1009506 - RNA, 16 nt, Homo sapiens
gcccacguacccaggu

SEQ ID NO: 1009507 - RNA, 15 nt, Homo sapiens
gcccagagacacagc

SEQ ID NO: 1009508 - RNA, 14 nt, Homo sapiens
gcccagagcccagc

SEQ ID NO: 1009509 - RNA, 15 nt, Homo sapiens
gcccagagcccagcu

SEQ ID NO: 1009510 - RNA, 19 nt, Homo sapiens
gcccagcgguucacacagg

SEQ ID NO: 1009511 - RNA, 16 nt, Homo sapiens
gcccagcuaaagcaau

SEQ ID NO: 1009512 - RNA, 20 nt, Homo sapiens
gcccaggcuggagugcagug

SEQ ID NO: 1009513 - RNA, 13 nt, Homo sapiens
gcccagugcacug

SEQ ID NO: 1009514 - RNA, 18 nt, Homo sapiens
gcccauaucugugaaaug

SEQ ID NO: 1009515 - RNA, 20 nt, Homo sapiens
gcccaugcuggagugcagug

SEQ ID NO: 1009516 - RNA, 15 nt, Homo sapiens
gcccauggagauuga

SEQ ID NO: 1009517 - RNA, 20 nt, Homo sapiens
gcccauggugagcucuggga

SEQ ID NO: 1009518 - RNA, 15 nt, Homo sapiens
gccccaucccaugcu

SEQ ID NO: 1009519 - RNA, 19 nt, Homo sapiens
gccccaugaccuccagcuu

SEQ ID NO: 1009520 - RNA, 17 nt, Homo sapiens
gcccccucacaguauug

SEQ ID NO: 1009521 - RNA, 21 nt, Homo sapiens
gcccccucccuggaugacauu

SEQ ID NO: 1009522 - RNA, 23 nt, Homo sapiens
gcccccucccuggaugacauuaa

SEQ ID NO: 1009523 - RNA, 16 nt, Homo sapiens
gcccccuccucuagcu

SEQ ID NO: 1009524 - RNA, 21 nt, Homo sapiens
uuuguagcuggggcuuugaug

SEQ ID NO: 1009525 - RNA, 17 nt, Homo sapiens
uuuguauaaaaguguga

SEQ ID NO: 1009526 - RNA, 16 nt, Homo sapiens
uuuguuauccuguaua

SEQ ID NO: 1009527 - RNA, 12 nt, Homo sapiens
uuuguugcccag

SEQ ID NO: 1009528 - RNA, 15 nt, Homo sapiens
uuuuaacauuccuca

SEQ ID NO: 1009529 - RNA, 16 nt, Homo sapiens
uuuuacucugccuaca

SEQ ID NO: 1009530 - RNA, 10 nt, Homo sapiens
uuuucacuga

SEQ ID NO: 1009531 - RNA, 12 nt, Homo sapiens
uuuucauuccau

SEQ ID NO: 1009532 - RNA, 12 nt, Homo sapiens
uuuucauuugag

SEQ ID NO: 1009533 - RNA, 23 nt, Homo sapiens
uuuucuauuucacuggagcacaa

SEQ ID NO: 1009534 - RNA, 17 nt, Homo sapiens
uuuugaaauuaaccucu

SEQ ID NO: 1009535 - RNA, 13 nt, Homo sapiens
uuuugaaggcaaa

SEQ ID NO: 1009536 - RNA, 22 nt, Homo sapiens
uuuugucagaggcuccaaauag

SEQ ID NO: 1009537 - RNA, 17 nt, Homo sapiens
uuuuguucucaacuuca

SEQ ID NO: 1009538 - RNA, 19 nt, Homo sapiens
uuuuguucucaacuucaaa

SEQ ID NO: 1009539 - RNA, 13 nt, Homo sapiens
uuuuugaggcaaa

SEQ ID NO: 1009540 - RNA, 21 nt, Homo sapiens
uuuuuggcuacacacaaacca

SEQ ID NO: 1009541 - RNA, 14 nt, Homo sapiens
uuuuuguaacugga

SEQ ID NO: 1009542 - RNA, 13 nt, Homo sapiens
uuuuuucccccac

SEQ ID NO: 1009543 - RNA, 15 nt, Homo sapiens
acugcacaauaacuc

SEQ ID NO: 1009544 - RNA, 23 nt, Homo sapiens
acugcagggaaaauuauuugcau

SEQ ID NO: 1009545 - RNA, 15 nt, Homo sapiens
acugcccauggacag

SEQ ID NO: 1009546 - RNA, 19 nt, Homo sapiens
acugcccauggacaggcug

SEQ ID NO: 1009547 - RNA, 22 nt, Homo sapiens
acugcccccugcugccaugugg

SEQ ID NO: 1009548 - RNA, 22 nt, Homo sapiens
acugccuagaaacaacacugua

SEQ ID NO: 1009549 - RNA, 19 nt, Homo sapiens
acugccucgaaacacagaa

SEQ ID NO: 1009550 - RNA, 21 nt, Homo sapiens
acugccuucgcuucuugccuc

SEQ ID NO: 1009551 - RNA, 18 nt, Homo sapiens
acugcuauauaauucucu

SEQ ID NO: 1009552 - RNA, 22 nt, Homo sapiens
acugcucugagaauuguugaga

SEQ ID NO: 1009553 - RNA, 18 nt, Homo sapiens
acugcugagauacauaca

SEQ ID NO: 1009554 - RNA, 14 nt, Homo sapiens
acuggaaagcuuuu

SEQ ID NO: 1009555 - RNA, 19 nt, Homo sapiens
acuggcauacuauguggau

SEQ ID NO: 1009556 - RNA, 22 nt, Homo sapiens
acuggccagggccacgcuccag

SEQ ID NO: 1009557 - RNA, 17 nt, Homo sapiens
acuggucuccuugcuuc

SEQ ID NO: 1009558 - RNA, 19 nt, Homo sapiens
acuguaggcacacuuugca

SEQ ID NO: 1009559 - RNA, 12 nt, Homo sapiens
acugucaggguu

SEQ ID NO: 1009560 - RNA, 15 nt, Homo sapiens
acugucuccuaccuc

SEQ ID NO: 1009561 - RNA, 21 nt, Homo sapiens
acugugcagguucccacuuaa

SEQ ID NO: 1009562 - RNA, 19 nt, Homo sapiens
acuguguaagggccagaaa

SEQ ID NO: 1009563 - RNA, 23 nt, Homo sapiens
acugugucauucuguuagauacu

SEQ ID NO: 1009564 - RNA, 20 nt, Homo sapiens
acuguuagucauuugcugag

SEQ ID NO: 1009565 - RNA, 12 nt, Homo sapiens
acuguugcacgu

SEQ ID NO: 1009566 - RNA, 19 nt, Homo sapiens
acuguuggcaaggugacau

SEQ ID NO: 1009567 - RNA, 20 nt, Homo sapiens
acuguuuauacacuguguaa

SEQ ID NO: 1009568 - RNA, 18 nt, Homo sapiens
acuuaacggaccaaagca

SEQ ID NO: 1009569 - RNA, 15 nt, Homo sapiens
acuuacaucaugugu

SEQ ID NO: 1009570 - RNA, 17 nt, Homo sapiens
acuuauguuauacaaua

SEQ ID NO: 1009571 - RNA, 11 nt, Homo sapiens
acuucaaagag

SEQ ID NO: 1009572 - RNA, 17 nt, Homo sapiens
acuucauauuguugcau

SEQ ID NO: 1009573 - RNA, 14 nt, Homo sapiens
acuuccauuugcuu

SEQ ID NO: 1009574 - RNA, 20 nt, Homo sapiens
acuucugacagccucaguga

SEQ ID NO: 1009575 - RNA, 15 nt, Homo sapiens
acuucuuguguguau

SEQ ID NO: 1009576 - RNA, 20 nt, Homo sapiens
acuucuuguguguaugcaca

SEQ ID NO: 1009577 - RNA, 21 nt, Homo sapiens
acuugaaagaaauggugaaug

SEQ ID NO: 1009578 - RNA, 14 nt, Homo sapiens
acuugaacccaggu

SEQ ID NO: 1009579 - RNA, 12 nt, Homo sapiens
acuugagcaugu

SEQ ID NO: 1009580 - RNA, 16 nt, Homo sapiens
acuugccugugcuaca

SEQ ID NO: 1009581 - RNA, 22 nt, Homo sapiens
acuugccugugcuacaauucau

SEQ ID NO: 1009582 - RNA, 19 nt, Homo sapiens
acuugcuuaucaacuuccu

SEQ ID NO: 1009583 - RNA, 23 nt, Homo sapiens
acuuggcucgaaucucugugccu

SEQ ID NO: 1009584 - RNA, 17 nt, Homo sapiens
acuuggggcaccuugcu

SEQ ID NO: 1009585 - RNA, 21 nt, Homo sapiens
acuugucagugggaaacaaac

SEQ ID NO: 1009586 - RNA, 15 nt, Homo sapiens
acuuuaaauacuauu

SEQ ID NO: 1009587 - RNA, 14 nt, Homo sapiens
acuuuaucacuuaa

SEQ ID NO: 1009588 - RNA, 22 nt, Homo sapiens
acuuuauguaguuuuuauaugu

SEQ ID NO: 1009589 - RNA, 17 nt, Homo sapiens
acuuucauuccuucaga

SEQ ID NO: 1009590 - RNA, 15 nt, Homo sapiens
acuuucccucaucca

SEQ ID NO: 1009591 - RNA, 11 nt, Homo sapiens
acuuuccugca

SEQ ID NO: 1009592 - RNA, 13 nt, Homo sapiens
acuuugaccuaaa

SEQ ID NO: 1009593 - RNA, 23 nt, Homo sapiens
acuuuggaaccagacucuugccu

SEQ ID NO: 1009594 - RNA, 21 nt, Homo sapiens
acuuuggaguccccucaccuc

SEQ ID NO: 1009595 - RNA, 16 nt, Homo sapiens
acuuugggaggccaag

SEQ ID NO: 1009596 - RNA, 14 nt, Homo sapiens
acuuuguacauuug

SEQ ID NO: 1009597 - RNA, 15 nt, Homo sapiens
agaaaacaauuccuu

SEQ ID NO: 1009598 - RNA, 17 nt, Homo sapiens
agaaaauaagagcucag

SEQ ID NO: 1009599 - RNA, 16 nt, Homo sapiens
agaaagcaaaccugua

SEQ ID NO: 1009600 - RNA, 10 nt, Homo sapiens
agaaagccug

SEQ ID NO: 1009601 - RNA, 21 nt, Homo sapiens
agaaagggcggugaacucugg

SEQ ID NO: 1009602 - RNA, 17 nt, Homo sapiens
agaaauaaagcaucuca

SEQ ID NO: 1009603 - RNA, 19 nt, Homo sapiens
agaaauaaagcaucucauu

SEQ ID NO: 1009604 - RNA, 14 nt, Homo sapiens
agaaauagcuuaug

SEQ ID NO: 1009605 - RNA, 17 nt, Homo sapiens
agaaauugaauacuuug

SEQ ID NO: 1009606 - RNA, 15 nt, Homo sapiens
agaacugaagcucuu

SEQ ID NO: 1009607 - RNA, 14 nt, Homo sapiens
agaacuugaccccc

SEQ ID NO: 1009608 - RNA, 17 nt, Homo sapiens
agaagaagcuaccucag

SEQ ID NO: 1009609 - RNA, 15 nt, Homo sapiens
agaagacaaacuuug

SEQ ID NO: 1009610 - RNA, 16 nt, Homo sapiens
agaagccaacuaugau

SEQ ID NO: 1009611 - RNA, 19 nt, Homo sapiens
agaagccagcuuguuuaca

SEQ ID NO: 1009612 - RNA, 15 nt, Homo sapiens
agaagccaucaccuc

SEQ ID NO: 1009613 - RNA, 23 nt, Homo sapiens
agaagccugaugcugacauucac

SEQ ID NO: 1009614 - RNA, 13 nt, Homo sapiens
agaagcucagcug

SEQ ID NO: 1009615 - RNA, 16 nt, Homo sapiens
agaaggaggggagcag

SEQ ID NO: 1009616 - RNA, 22 nt, Homo sapiens
agaagggggucucuucuuccag

SEQ ID NO: 1009617 - RNA, 14 nt, Homo sapiens
agaagucucuucca

SEQ ID NO: 1009618 - RNA, 20 nt, Homo sapiens
agaagucucuuccaguuugc

SEQ ID NO: 1009619 - RNA, 16 nt, Homo sapiens
agaagugcaucuggag

SEQ ID NO: 1009620 - RNA, 23 nt, Homo sapiens
agaaguguggggauuuucacuga

SEQ ID NO: 1009621 - RNA, 13 nt, Homo sapiens
agaaguuugcacu

SEQ ID NO: 1009622 - RNA, 17 nt, Homo sapiens
agaauaaaggcaguuuu

SEQ ID NO: 1009623 - RNA, 13 nt, Homo sapiens
agaaucaaaugca

SEQ ID NO: 1009624 - RNA, 14 nt, Homo sapiens
agaaucacuugaac

SEQ ID NO: 1009625 - RNA, 24 nt, Homo sapiens
agaaugcacaagaauggaucacaa

SEQ ID NO: 1009626 - RNA, 12 nt, Homo sapiens
agaauggagcug

SEQ ID NO: 1009627 - RNA, 22 nt, Homo sapiens
agaaugucaaugaguaauucau

SEQ ID NO: 1009628 - RNA, 16 nt, Homo sapiens
agaauguuaugugcaa

SEQ ID NO: 1009629 - RNA, 21 nt, Homo sapiens
agaauuauuuugugaugcaaa

SEQ ID NO: 1009630 - RNA, 16 nt, Homo sapiens
agaauuuggggcuucc

SEQ ID NO: 1009631 - RNA, 12 nt, Homo sapiens
agaauuugugcc

SEQ ID NO: 1009632 - RNA, 13 nt, Homo sapiens
agacaaaaagcua

SEQ ID NO: 1009633 - RNA, 21 nt, Homo sapiens
agacaaauagucggauuagaa

SEQ ID NO: 1009634 - RNA, 16 nt, Homo sapiens
agacaagcugcauuuc

SEQ ID NO: 1009635 - RNA, 21 nt, Homo sapiens
agacaaguauggcuccuccau

SEQ ID NO: 1009636 - RNA, 16 nt, Homo sapiens
agacaccaaaguucua

SEQ ID NO: 1009637 - RNA, 22 nt, Homo sapiens
agacaggcaaauguacuucuca

SEQ ID NO: 1009638 - RNA, 19 nt, Homo sapiens
agacaggccccgugaggca

SEQ ID NO: 1009639 - RNA, 16 nt, Homo sapiens
agacaguuauugcaag

SEQ ID NO: 1009640 - RNA, 22 nt, Homo sapiens
agacauaaaggaaaagacacau

SEQ ID NO: 1009641 - RNA, 15 nt, Homo sapiens
agacauacauuucuc

SEQ ID NO: 1009642 - RNA, 16 nt, Homo sapiens
agacauacauuucuca

SEQ ID NO: 1009643 - RNA, 21 nt, Homo sapiens
agacauacuugaagggccaga

SEQ ID NO: 1009644 - RNA, 19 nt, Homo sapiens
agacaucuuugcuuaugaa

SEQ ID NO: 1009645 - RNA, 17 nt, Homo sapiens
agacaugauuuccuuga

SEQ ID NO: 1009646 - RNA, 17 nt, Homo sapiens
agacauggagguucuaa

SEQ ID NO: 1009647 - RNA, 19 nt, Homo sapiens
aguauuuaggauaaccuug

SEQ ID NO: 1009648 - RNA, 23 nt, Homo sapiens
aguauuuauugcaggaugguguc

SEQ ID NO: 1009649 - RNA, 23 nt, Homo sapiens
aguauuuuuuaauccuaccucaa

SEQ ID NO: 1009650 - RNA, 16 nt, Homo sapiens
agucaaaacacuugua

SEQ ID NO: 1009651 - RNA, 17 nt, Homo sapiens
agucaaagagcacugga

SEQ ID NO: 1009652 - RNA, 22 nt, Homo sapiens
agucacggcugcgcacuguguc

SEQ ID NO: 1009653 - RNA, 16 nt, Homo sapiens
agucacugcucuucag

SEQ ID NO: 1009654 - RNA, 20 nt, Homo sapiens
agucacugcucuucagccau

SEQ ID NO: 1009655 - RNA, 20 nt, Homo sapiens
agucacuggucuguuugcau

SEQ ID NO: 1009656 - RNA, 19 nt, Homo sapiens
agucauaauugcauugacu

SEQ ID NO: 1009657 - RNA, 13 nt, Homo sapiens
agucaugugccua

SEQ ID NO: 1009658 - RNA, 14 nt, Homo sapiens
agucauucugggaa

SEQ ID NO: 1009659 - RNA, 21 nt, Homo sapiens
agucauuugcugagcauguac

SEQ ID NO: 1009660 - RNA, 22 nt, Homo sapiens
aguccaagguuuaaagagucua

SEQ ID NO: 1009661 - RNA, 20 nt, Homo sapiens
aguccccucaccuccucuaa

SEQ ID NO: 1009662 - RNA, 18 nt, Homo sapiens
aguccuggaugauacuaa

SEQ ID NO: 1009663 - RNA, 15 nt, Homo sapiens
agucgaacaauucau

SEQ ID NO: 1009664 - RNA, 15 nt, Homo sapiens
agucuguuuacugca

SEQ ID NO: 1009665 - RNA, 15 nt, Homo sapiens
agugaaguugcugcu

SEQ ID NO: 1009666 - RNA, 22 nt, Homo sapiens
agugacuugugucccaugaucc

SEQ ID NO: 1009667 - RNA, 13 nt, Homo sapiens
agugcgguuuacu

SEQ ID NO: 1009668 - RNA, 14 nt, Homo sapiens
agugcuacaggguc

SEQ ID NO: 1009669 - RNA, 15 nt, Homo sapiens
agugcugaacagugg

SEQ ID NO: 1009670 - RNA, 17 nt, Homo sapiens
agugcugggauuacaau

SEQ ID NO: 1009671 - RNA, 13 nt, Homo sapiens
agugcugugcugu

SEQ ID NO: 1009672 - RNA, 17 nt, Homo sapiens
agugcuuaguguacuug

SEQ ID NO: 1009673 - RNA, 18 nt, Homo sapiens
aguggaaauuaagacuuu

SEQ ID NO: 1009674 - RNA, 16 nt, Homo sapiens
aguggagagagcuccu

SEQ ID NO: 1009675 - RNA, 13 nt, Homo sapiens
aguggagaggaaa

SEQ ID NO: 1009676 - RNA, 19 nt, Homo sapiens
aguggcaggggacaggagu

SEQ ID NO: 1009677 - RNA, 18 nt, Homo sapiens
aguggcauuuccugguca

SEQ ID NO: 1009678 - RNA, 19 nt, Homo sapiens
aguggcccauggcauuuua

SEQ ID NO: 1009679 - RNA, 23 nt, Homo sapiens
agugggguggugucagacccugg

SEQ ID NO: 1009680 - RNA, 13 nt, Homo sapiens
aguggugccaaac

SEQ ID NO: 1009681 - RNA, 22 nt, Homo sapiens
aguguaccgcgucuacccuggg

SEQ ID NO: 1009682 - RNA, 20 nt, Homo sapiens
agugucauccucacagugaa

SEQ ID NO: 1009683 - RNA, 20 nt, Homo sapiens
aguguggggauuuucacuga

SEQ ID NO: 1009684 - RNA, 22 nt, Homo sapiens
aguguuaucagucauaacuaaa

SEQ ID NO: 1009685 - RNA, 20 nt, Homo sapiens
aguguuccccuuccacugag

SEQ ID NO: 1009686 - RNA, 19 nt, Homo sapiens
aguuaacagacaacacguu

SEQ ID NO: 1009687 - RNA, 12 nt, Homo sapiens
aguuacugugua

SEQ ID NO: 1009688 - RNA, 15 nt, Homo sapiens
aguuaguuccacuga

SEQ ID NO: 1009689 - RNA, 15 nt, Homo sapiens
aguuaugacaagcuu

SEQ ID NO: 1009690 - RNA, 17 nt, Homo sapiens
aguucacauacaaauca

SEQ ID NO: 1009691 - RNA, 15 nt, Homo sapiens
aguuccaagagucua

SEQ ID NO: 1009692 - RNA, 14 nt, Homo sapiens
aguucccucuugcu

SEQ ID NO: 1009693 - RNA, 24 nt, Homo sapiens
aguucucccuguacaguguuacca

SEQ ID NO: 1009694 - RNA, 20 nt, Homo sapiens
aguucuucaucccacuccaa

SEQ ID NO: 1009695 - RNA, 22 nt, Homo sapiens
aguucuuuaaaauguaaagcca

SEQ ID NO: 1009696 - RNA, 17 nt, Homo sapiens
aguucuuugggccagac

SEQ ID NO: 1009697 - RNA, 13 nt, Homo sapiens
aguugaaacaaga

SEQ ID NO: 1009698 - RNA, 16 nt, Homo sapiens
aguugaagaccagccu

SEQ ID NO: 1009699 - RNA, 17 nt, Homo sapiens
aguugaggccacugugu

SEQ ID NO: 1009700 - RNA, 13 nt, Homo sapiens
aguugaucuggaa

SEQ ID NO: 1009701 - RNA, 19 nt, Homo sapiens
aguugcagucacucuaguc

SEQ ID NO: 1009702 - RNA, 22 nt, Homo sapiens
aguugccaucugcgugacaaua

SEQ ID NO: 1009703 - RNA, 17 nt, Homo sapiens
aguugcuuuucagcuga

SEQ ID NO: 1009704 - RNA, 14 nt, Homo sapiens
aguuguuagauuaa

SEQ ID NO: 1009705 - RNA, 16 nt, Homo sapiens
aguuuacaaucagcca

SEQ ID NO: 1009706 - RNA, 14 nt, Homo sapiens
aguuuagcucugag

SEQ ID NO: 1009707 - RNA, 17 nt, Homo sapiens
aguuucuaagauucuaa

SEQ ID NO: 1009708 - RNA, 15 nt, Homo sapiens
aguuugaaauaagcu

SEQ ID NO: 1009709 - RNA, 13 nt, Homo sapiens
aguuugauuucau

SEQ ID NO: 1009710 - RNA, 16 nt, Homo sapiens
aguuuggagagagcag

SEQ ID NO: 1009711 - RNA, 16 nt, Homo sapiens
aguuuggguaaaauac

SEQ ID NO: 1009712 - RNA, 16 nt, Homo sapiens
aguuuguauauauuau

SEQ ID NO: 1009713 - RNA, 14 nt, Homo sapiens
aguuuuaacugugg

SEQ ID NO: 1009714 - RNA, 13 nt, Homo sapiens
auaaaaaacaguc

SEQ ID NO: 1009715 - RNA, 23 nt, Homo sapiens
auaaaaaaugguucagaauuaaa

SEQ ID NO: 1009716 - RNA, 18 nt, Homo sapiens
auaaaaguguucauuguu

SEQ ID NO: 1009717 - RNA, 17 nt, Homo sapiens
auaaagagacagugaua

SEQ ID NO: 1009718 - RNA, 14 nt, Homo sapiens
auaaaggaugugau

SEQ ID NO: 1009719 - RNA, 18 nt, Homo sapiens
auaaaucugacccagugc

SEQ ID NO: 1009720 - RNA, 20 nt, Homo sapiens
auaaaugucuuuaaugcaau

SEQ ID NO: 1009721 - RNA, 16 nt, Homo sapiens
auaaccuugugccuug

SEQ ID NO: 1009722 - RNA, 22 nt, Homo sapiens
auaacuguaaaugugacauuga

SEQ ID NO: 1009723 - RNA, 20 nt, Homo sapiens
auaagaguuggcuggucaac

SEQ ID NO: 1009724 - RNA, 19 nt, Homo sapiens
auaaguuauugcaguuuau

SEQ ID NO: 1009725 - RNA, 21 nt, Homo sapiens
auaaguuuuauguuaaaucaa

SEQ ID NO: 1009726 - RNA, 17 nt, Homo sapiens
auaaucaaaagcuauuu

SEQ ID NO: 1009727 - RNA, 21 nt, Homo sapiens
auaaucaaucauuucuauuaa

SEQ ID NO: 1009728 - RNA, 20 nt, Homo sapiens
auaaucaucaaguaauacaa

SEQ ID NO: 1009729 - RNA, 20 nt, Homo sapiens
auaaugguuuuuaacaccuu

SEQ ID NO: 1009730 - RNA, 14 nt, Homo sapiens
auaauuucuaaugu

SEQ ID NO: 1009731 - RNA, 12 nt, Homo sapiens
auaauuuugccu

SEQ ID NO: 1009732 - RNA, 14 nt, Homo sapiens
auacaaaucaucca

SEQ ID NO: 1009733 - RNA, 22 nt, Homo sapiens
auaccagguuuuacacuugcau

SEQ ID NO: 1009734 - RNA, 14 nt, Homo sapiens
auaccuccuauggg

SEQ ID NO: 1009735 - RNA, 15 nt, Homo sapiens
auaccuuccccacau

SEQ ID NO: 1009736 - RNA, 14 nt, Homo sapiens
auacgguaugauau

SEQ ID NO: 1009737 - RNA, 14 nt, Homo sapiens
auacuacuguguaa

SEQ ID NO: 1009738 - RNA, 15 nt, Homo sapiens
auacuauuauuugcu

SEQ ID NO: 1009739 - RNA, 15 nt, Homo sapiens
auacucuagaugaag

SEQ ID NO: 1009740 - RNA, 19 nt, Homo sapiens
auacuguaacauucaggaa

SEQ ID NO: 1009741 - RNA, 16 nt, Homo sapiens
auacuguugcacgugu

SEQ ID NO: 1009742 - RNA, 18 nt, Homo sapiens
auacuguugcacgugugu

SEQ ID NO: 1009743 - RNA, 15 nt, Homo sapiens
auacuuaaugcauau

SEQ ID NO: 1009744 - RNA, 19 nt, Homo sapiens
auacuuuuacucugccuac

SEQ ID NO: 1009745 - RNA, 13 nt, Homo sapiens
auacuuuuuacaa

SEQ ID NO: 1009746 - RNA, 14 nt, Homo sapiens
auagaaaugccaag

SEQ ID NO: 1009747 - RNA, 10 nt, Homo sapiens
auagaauuau

SEQ ID NO: 1009748 - RNA, 13 nt, Homo sapiens
auagagccugagg

SEQ ID NO: 1009749 - RNA, 23 nt, Homo sapiens
auagcaguugaaacaagaagcca

SEQ ID NO: 1009750 - RNA, 13 nt, Homo sapiens
auagccucugucu

SEQ ID NO: 1009751 - RNA, 23 nt, Homo sapiens
caaaaccccccagauaucaucua

SEQ ID NO: 1009752 - RNA, 15 nt, Homo sapiens
caaaaccgccagcuc

SEQ ID NO: 1009753 - RNA, 14 nt, Homo sapiens
caaaacuacaaauc

SEQ ID NO: 1009754 - RNA, 14 nt, Homo sapiens
caaaacuacaugag

SEQ ID NO: 1009755 - RNA, 15 nt, Homo sapiens
caaaacuacaugaga

SEQ ID NO: 1009756 - RNA, 23 nt, Homo sapiens
caaaagcgaaacacacaaaccag

SEQ ID NO: 1009757 - RNA, 14 nt, Homo sapiens
caaaagcuuacaaa

SEQ ID NO: 1009758 - RNA, 14 nt, Homo sapiens
caaaauccaaggca

SEQ ID NO: 1009759 - RNA, 19 nt, Homo sapiens
caaaaucuugaucaguuaa

SEQ ID NO: 1009760 - RNA, 18 nt, Homo sapiens
caaaauguaugucugguu

SEQ ID NO: 1009761 - RNA, 13 nt, Homo sapiens
caaaauucaccca

SEQ ID NO: 1009762 - RNA, 12 nt, Homo sapiens
caaacaaugaaa

SEQ ID NO: 1009763 - RNA, 21 nt, Homo sapiens
caaacaccacuuuacuugugu

SEQ ID NO: 1009764 - RNA, 24 nt, Homo sapiens
caaaccacgccucuugaccaggcu

SEQ ID NO: 1009765 - RNA, 21 nt, Homo sapiens
caaacuacuggcaauuuguaa

SEQ ID NO: 1009766 - RNA, 16 nt, Homo sapiens
caaacuccugaccuca

SEQ ID NO: 1009767 - RNA, 21 nt, Homo sapiens
caaacuccugaccucaggcaa

SEQ ID NO: 1009768 - RNA, 21 nt, Homo sapiens
caaacugcuuuuuccaacuca

SEQ ID NO: 1009769 - RNA, 20 nt, Homo sapiens
caaacugggaaccccuuucc

SEQ ID NO: 1009770 - RNA, 23 nt, Homo sapiens
caaacugggaaccccuuucccac

SEQ ID NO: 1009771 - RNA, 23 nt, Homo sapiens
caaagaaaaaauuccacaaugaa

SEQ ID NO: 1009772 - RNA, 14 nt, Homo sapiens
caaagaaaguguau

SEQ ID NO: 1009773 - RNA, 13 nt, Homo sapiens
caaagaaggcauu

SEQ ID NO: 1009774 - RNA, 17 nt, Homo sapiens
caaagaggcugccccuc

SEQ ID NO: 1009775 - RNA, 20 nt, Homo sapiens
caaagaggcugccccucuca

SEQ ID NO: 1009776 - RNA, 23 nt, Homo sapiens
caaagcaaggaaacuauguaaca

SEQ ID NO: 1009777 - RNA, 11 nt, Homo sapiens
caaagcacaga

SEQ ID NO: 1009778 - RNA, 18 nt, Homo sapiens
caaagcacgaaauguuau

SEQ ID NO: 1009779 - RNA, 14 nt, Homo sapiens
caaagcugccuguc

SEQ ID NO: 1009780 - RNA, 17 nt, Homo sapiens
caaagcuuucauguaaa

SEQ ID NO: 1009781 - RNA, 21 nt, Homo sapiens
caaaggcucccuguguucuca

SEQ ID NO: 1009782 - RNA, 11 nt, Homo sapiens
caaagugcugg

SEQ ID NO: 1009783 - RNA, 15 nt, Homo sapiens
caaaucaaaaucucu

SEQ ID NO: 1009784 - RNA, 14 nt, Homo sapiens
caaaucaccacaaa

SEQ ID NO: 1009785 - RNA, 21 nt, Homo sapiens
caaaucauccauccuugccaa

SEQ ID NO: 1009786 - RNA, 16 nt, Homo sapiens
caaaucuaccacugua

SEQ ID NO: 1009787 - RNA, 17 nt, Homo sapiens
caaaucuggaagccaaa

SEQ ID NO: 1009788 - RNA, 14 nt, Homo sapiens
caaaugagccauga

SEQ ID NO: 1009789 - RNA, 22 nt, Homo sapiens
caaauggcccugggucccagga

SEQ ID NO: 1009790 - RNA, 19 nt, Homo sapiens
caaauggggccagauccag

SEQ ID NO: 1009791 - RNA, 13 nt, Homo sapiens
caaaugugacauu

SEQ ID NO: 1009792 - RNA, 20 nt, Homo sapiens
caaaugugcuggucacccuu

SEQ ID NO: 1009793 - RNA, 15 nt, Homo sapiens
caaauuaaggcauaa

SEQ ID NO: 1009794 - RNA, 19 nt, Homo sapiens
caaauuauucuccuauguu

SEQ ID NO: 1009795 - RNA, 15 nt, Homo sapiens
caacaaaagaagccc

SEQ ID NO: 1009796 - RNA, 20 nt, Homo sapiens
caacacaucucccuuuucca

SEQ ID NO: 1009797 - RNA, 22 nt, Homo sapiens
caacaccaugauuccuuuaaca

SEQ ID NO: 1009798 - RNA, 16 nt, Homo sapiens
caacaggaacuuggag

SEQ ID NO: 1009799 - RNA, 12 nt, Homo sapiens
caacaguuuucc

SEQ ID NO: 1009800 - RNA, 17 nt, Homo sapiens
caacaucacagcccagc

SEQ ID NO: 1009801 - RNA, 22 nt, Homo sapiens
caacaugaugagguaguaccuu

SEQ ID NO: 1009802 - RNA, 10 nt, Homo sapiens
caacauucau

SEQ ID NO: 1009803 - RNA, 22 nt, Homo sapiens
caaccaagaauguuaugugcaa

SEQ ID NO: 1009804 - RNA, 21 nt, Homo sapiens
caacccccgacuucaucccaa

SEQ ID NO: 1009805 - RNA, 22 nt, Homo sapiens
caacccgucuggcccaccaggg

SEQ ID NO: 1009806 - RNA, 15 nt, Homo sapiens
caacccuucauuuaa

SEQ ID NO: 1009807 - RNA, 14 nt, Homo sapiens
caacgaguacuuca

SEQ ID NO: 1009808 - RNA, 18 nt, Homo sapiens
caacgcuauuccagcugu

SEQ ID NO: 1009809 - RNA, 14 nt, Homo sapiens
caacggaugaaugu

SEQ ID NO: 1009810 - RNA, 22 nt, Homo sapiens
caacuacuguguuaugcaaaag

SEQ ID NO: 1009811 - RNA, 13 nt, Homo sapiens
caacuaugauuau

SEQ ID NO: 1009812 - RNA, 15 nt, Homo sapiens
caacuccuaguucua

SEQ ID NO: 1009813 - RNA, 22 nt, Homo sapiens
caacucuguaaauauguaugua

SEQ ID NO: 1009814 - RNA, 15 nt, Homo sapiens
caacuuaaugcucug

SEQ ID NO: 1009815 - RNA, 19 nt, Homo sapiens
caacuuccuaaauauuaug

SEQ ID NO: 1009816 - RNA, 13 nt, Homo sapiens
caacuuuacugua

SEQ ID NO: 1009817 - RNA, 21 nt, Homo sapiens
caagaagugaagaaugcacaa

SEQ ID NO: 1009818 - RNA, 18 nt, Homo sapiens
caagaauguuaugugcaa

SEQ ID NO: 1009819 - RNA, 15 nt, Homo sapiens
caagacaaaaagcca

SEQ ID NO: 1009820 - RNA, 17 nt, Homo sapiens
caagacaagccuggccu

SEQ ID NO: 1009821 - RNA, 17 nt, Homo sapiens
caagacccccagcacuu

SEQ ID NO: 1009822 - RNA, 20 nt, Homo sapiens
caagagcaucaugccucuga

SEQ ID NO: 1009823 - RNA, 19 nt, Homo sapiens
caagagugaauucccucac

SEQ ID NO: 1009824 - RNA, 14 nt, Homo sapiens
caagaucugaauuu

SEQ ID NO: 1009825 - RNA, 20 nt, Homo sapiens
caagauucuagaugauuaaa

SEQ ID NO: 1009826 - RNA, 16 nt, Homo sapiens
caagcaauaaacacaa

SEQ ID NO: 1009827 - RNA, 12 nt, Homo sapiens
caagcaccucca

SEQ ID NO: 1009828 - RNA, 16 nt, Homo sapiens
caagcaugaagugcug

SEQ ID NO: 1009829 - RNA, 21 nt, Homo sapiens
caagcauucagaagaaaaaga

SEQ ID NO: 1009830 - RNA, 22 nt, Homo sapiens
caagcuaaaauuagaugaacuc

SEQ ID NO: 1009831 - RNA, 14 nt, Homo sapiens
caagcuaggugcua

SEQ ID NO: 1009832 - RNA, 12 nt, Homo sapiens
caagcucugcag

SEQ ID NO: 1009833 - RNA, 12 nt, Homo sapiens
caagcugccucc

SEQ ID NO: 1009834 - RNA, 17 nt, Homo sapiens
caagcuucuguccugcc

SEQ ID NO: 1009835 - RNA, 20 nt, Homo sapiens
caaggaaaaacaggucuuca

SEQ ID NO: 1009836 - RNA, 16 nt, Homo sapiens
caaggaaguagaaaca

SEQ ID NO: 1009837 - RNA, 15 nt, Homo sapiens
caaggcacucuagau

SEQ ID NO: 1009838 - RNA, 15 nt, Homo sapiens
caaggccuucccugu

SEQ ID NO: 1009839 - RNA, 16 nt, Homo sapiens
caagggacccaugagu

SEQ ID NO: 1009840 - RNA, 21 nt, Homo sapiens
caagggcuuuguuuugcacac

SEQ ID NO: 1009841 - RNA, 21 nt, Homo sapiens
caagguccucugucagucaca

SEQ ID NO: 1009842 - RNA, 18 nt, Homo sapiens
caaguaagaauguuaaaa

SEQ ID NO: 1009843 - RNA, 12 nt, Homo sapiens
caaguaauacaa

SEQ ID NO: 1009844 - RNA, 13 nt, Homo sapiens
caagucaccugca

SEQ ID NO: 1009845 - RNA, 15 nt, Homo sapiens
caaguucuaagauuc

SEQ ID NO: 1009846 - RNA, 13 nt, Homo sapiens
caauacagaucau

SEQ ID NO: 1009847 - RNA, 17 nt, Homo sapiens
caauagugucauccuca

SEQ ID NO: 1009848 - RNA, 12 nt, Homo sapiens
caauaugcauuu

SEQ ID NO: 1009849 - RNA, 20 nt, Homo sapiens
caaucaacuuuacuguaaua

SEQ ID NO: 1009850 - RNA, 21 nt, Homo sapiens
caaucaucaacuaccauucua

SEQ ID NO: 1009851 - RNA, 16 nt, Homo sapiens
caaucauguguguuaa

SEQ ID NO: 1009852 - RNA, 23 nt, Homo sapiens
caaucauguguguuaacccagug

SEQ ID NO: 1009853 - RNA, 22 nt, Homo sapiens
caaucccugaggacugauuuca

SEQ ID NO: 1009854 - RNA, 20 nt, Homo sapiens
caaucuguccguucacaugu

SEQ ID NO: 1009855 - RNA, 14 nt, Homo sapiens
ccauggaguggcag

SEQ ID NO: 1009856 - RNA, 16 nt, Homo sapiens
ccauguacaugaagaa

SEQ ID NO: 1009857 - RNA, 10 nt, Homo sapiens
ccauguccaa

SEQ ID NO: 1009858 - RNA, 23 nt, Homo sapiens
ccaugucuuucucucucacuccc

SEQ ID NO: 1009859 - RNA, 14 nt, Homo sapiens
ccaugugcccaguu

SEQ ID NO: 1009860 - RNA, 13 nt, Homo sapiens
ccauugcucuuga

SEQ ID NO: 1009861 - RNA, 11 nt, Homo sapiens
ccauuuacacg

SEQ ID NO: 1009862 - RNA, 15 nt, Homo sapiens
ccauuugggugggag

SEQ ID NO: 1009863 - RNA, 20 nt, Homo sapiens
ccauuuguguacacagucag

SEQ ID NO: 1009864 - RNA, 23 nt, Homo sapiens
cccaaauccuuagaucuggcaug

SEQ ID NO: 1009865 - RNA, 14 nt, Homo sapiens
cccaacaugcacug

SEQ ID NO: 1009866 - RNA, 16 nt, Homo sapiens
cccaaccuucuuguca

SEQ ID NO: 1009867 - RNA, 16 nt, Homo sapiens
cccaacucuugcacag

SEQ ID NO: 1009868 - RNA, 18 nt, Homo sapiens
cccaagauugagcucucu

SEQ ID NO: 1009869 - RNA, 19 nt, Homo sapiens
cccacaugcuccagauuag

SEQ ID NO: 1009870 - RNA, 17 nt, Homo sapiens
cccaccaguuauuccuu

SEQ ID NO: 1009871 - RNA, 21 nt, Homo sapiens
cccacuagaagcaacuaggaa

SEQ ID NO: 1009872 - RNA, 15 nt, Homo sapiens
cccacuucugcacuu

SEQ ID NO: 1009873 - RNA, 17 nt, Homo sapiens
cccacuucugcacuugc

SEQ ID NO: 1009874 - RNA, 22 nt, Homo sapiens
cccagagacauacuugaagggc

SEQ ID NO: 1009875 - RNA, 21 nt, Homo sapiens
cccagcaggugcugacuucau

SEQ ID NO: 1009876 - RNA, 14 nt, Homo sapiens
cccagccaccgaag

SEQ ID NO: 1009877 - RNA, 23 nt, Homo sapiens
cccagcccagggcuccugcacuu

SEQ ID NO: 1009878 - RNA, 15 nt, Homo sapiens
cccagccucccugaa

SEQ ID NO: 1009879 - RNA, 13 nt, Homo sapiens
cccagcgcagugc

SEQ ID NO: 1009880 - RNA, 13 nt, Homo sapiens
cccagcggcauca

SEQ ID NO: 1009881 - RNA, 18 nt, Homo sapiens
cccagcuaagaaccugga

SEQ ID NO: 1009882 - RNA, 21 nt, Homo sapiens
cccagcuccggccuguccucc

SEQ ID NO: 1009883 - RNA, 18 nt, Homo sapiens
cccagcugccuagauuca

SEQ ID NO: 1009884 - RNA, 23 nt, Homo sapiens
cccaggacccugaaggggccaug

SEQ ID NO: 1009885 - RNA, 15 nt, Homo sapiens
cccaggaccuggcug

SEQ ID NO: 1009886 - RNA, 21 nt, Homo sapiens
cccaggaggugugauuccuga

SEQ ID NO: 1009887 - RNA, 19 nt, Homo sapiens
cccaggccaaaggggaccu

SEQ ID NO: 1009888 - RNA, 17 nt, Homo sapiens
cccagguacauccauga

SEQ ID NO: 1009889 - RNA, 19 nt, Homo sapiens
cccaguucauugcacuuug

SEQ ID NO: 1009890 - RNA, 21 nt, Homo sapiens
cccaguucauugcacuuugau

SEQ ID NO: 1009891 - RNA, 17 nt, Homo sapiens
cccauaucugugaaaug

SEQ ID NO: 1009892 - RNA, 20 nt, Homo sapiens
cccaucgucucggccuucac

SEQ ID NO: 1009893 - RNA, 14 nt, Homo sapiens
cccaucugcuucag

SEQ ID NO: 1009894 - RNA, 23 nt, Homo sapiens
cccauguguagguauugaaaaag

SEQ ID NO: 1009895 - RNA, 14 nt, Homo sapiens
cccauuccugaaga

SEQ ID NO: 1009896 - RNA, 22 nt, Homo sapiens
cccauuuuuccuuuugccgacc

SEQ ID NO: 1009897 - RNA, 22 nt, Homo sapiens
ccccaaaccuggcaagucaccu

SEQ ID NO: 1009898 - RNA, 17 nt, Homo sapiens
ccccaacaugcacugau

SEQ ID NO: 1009899 - RNA, 20 nt, Homo sapiens
ccccaacuacccccagcugu

SEQ ID NO: 1009900 - RNA, 22 nt, Homo sapiens
ccccaacuacuguguuaugcaa

SEQ ID NO: 1009901 - RNA, 23 nt, Homo sapiens
ccccaaggaggcagccuggacca

SEQ ID NO: 1009902 - RNA, 20 nt, Homo sapiens
ccccacccuggccuagacca

SEQ ID NO: 1009903 - RNA, 12 nt, Homo sapiens
ccccaccuccag

SEQ ID NO: 1009904 - RNA, 18 nt, Homo sapiens
ccccacucccucacaagu

SEQ ID NO: 1009905 - RNA, 11 nt, Homo sapiens
ccccagcacuu

SEQ ID NO: 1009906 - RNA, 15 nt, Homo sapiens
ccccaggaccagaag

SEQ ID NO: 1009907 - RNA, 17 nt, Homo sapiens
ccccaggaccagaagcu

SEQ ID NO: 1009908 - RNA, 15 nt, Homo sapiens
ccccaugcacuguga

SEQ ID NO: 1009909 - RNA, 23 nt, Homo sapiens
ccccauguaucucaguaccccau

SEQ ID NO: 1009910 - RNA, 15 nt, Homo sapiens
ccccauuccugggaa

SEQ ID NO: 1009911 - RNA, 13 nt, Homo sapiens
cccccaaaccaga

SEQ ID NO: 1009912 - RNA, 16 nt, Homo sapiens
cccccaaccauuuccu

SEQ ID NO: 1009913 - RNA, 14 nt, Homo sapiens
cccccaaggaggca

SEQ ID NO: 1009914 - RNA, 12 nt, Homo sapiens
cccccagauauc

SEQ ID NO: 1009915 - RNA, 18 nt, Homo sapiens
cccccauucacuuuguca

SEQ ID NO: 1009916 - RNA, 17 nt, Homo sapiens
cccccggguguaaauag

SEQ ID NO: 1009917 - RNA, 13 nt, Homo sapiens
cccccucccugga

SEQ ID NO: 1009918 - RNA, 14 nt, Homo sapiens
ccccgacuucaucc

SEQ ID NO: 1009919 - RNA, 17 nt, Homo sapiens
ccccggggugcccacag

SEQ ID NO: 1009920 - RNA, 14 nt, Homo sapiens
ccccugcacaguug

SEQ ID NO: 1009921 - RNA, 23 nt, Homo sapiens
ccccuucuccccugcacuguaaa

SEQ ID NO: 1009922 - RNA, 11 nt, Homo sapiens
ccccuugccug

SEQ ID NO: 1009923 - RNA, 14 nt, Homo sapiens
ccccuuguccuuuc

SEQ ID NO: 1009924 - RNA, 19 nt, Homo sapiens
cccgauggggaacaguguu

SEQ ID NO: 1009925 - RNA, 16 nt, Homo sapiens
cccggggccagcacuu

SEQ ID NO: 1009926 - RNA, 18 nt, Homo sapiens
cccuaagcagaccacuga

SEQ ID NO: 1009927 - RNA, 17 nt, Homo sapiens
cccuagcauugcacuug

SEQ ID NO: 1009928 - RNA, 19 nt, Homo sapiens
cccuagccuugcuuguuaa

SEQ ID NO: 1009929 - RNA, 21 nt, Homo sapiens
cccucaccuuggcaccagaca

SEQ ID NO: 1009930 - RNA, 15 nt, Homo sapiens
cccucacuguugaau

SEQ ID NO: 1009931 - RNA, 18 nt, Homo sapiens
cccucauucuacugaaaa

SEQ ID NO: 1009932 - RNA, 15 nt, Homo sapiens
cccuccccugccauu

SEQ ID NO: 1009933 - RNA, 21 nt, Homo sapiens
cccucgucaucaggugcauag

SEQ ID NO: 1009934 - RNA, 14 nt, Homo sapiens
cccucuucauggau

SEQ ID NO: 1009935 - RNA, 16 nt, Homo sapiens
cccucuucauggaugg

SEQ ID NO: 1009936 - RNA, 21 nt, Homo sapiens
cccugacugggaguugaucgc

SEQ ID NO: 1009937 - RNA, 15 nt, Homo sapiens
cccugcucauccacu

SEQ ID NO: 1009938 - RNA, 20 nt, Homo sapiens
cccuggccucccccacuuuc

SEQ ID NO: 1009939 - RNA, 20 nt, Homo sapiens
cccugggguggccaccagua

SEQ ID NO: 1009940 - RNA, 20 nt, Homo sapiens
cccugucagcaugaauuugu

SEQ ID NO: 1009941 - RNA, 20 nt, Homo sapiens
cccuucccucaccuuggcac

SEQ ID NO: 1009942 - RNA, 15 nt, Homo sapiens
cccuucugcucagcu

SEQ ID NO: 1009943 - RNA, 14 nt, Homo sapiens
cccuuuagaucucu

SEQ ID NO: 1009944 - RNA, 21 nt, Homo sapiens
cccuuuccuccucaggcacac

SEQ ID NO: 1009945 - RNA, 19 nt, Homo sapiens
cccuuuuucuccagcuggg

SEQ ID NO: 1009946 - RNA, 19 nt, Homo sapiens
ccgagaaaacaaacccagg

SEQ ID NO: 1009947 - RNA, 19 nt, Homo sapiens
ccgauauacucuagaugaa

SEQ ID NO: 1009948 - RNA, 19 nt, Homo sapiens
ccgcaaaagacaagucuuu

SEQ ID NO: 1009949 - RNA, 17 nt, Homo sapiens
ccgcaggugcugguccc

SEQ ID NO: 1009950 - RNA, 13 nt, Homo sapiens
ccgcucuguagug

SEQ ID NO: 1009951 - RNA, 13 nt, Homo sapiens
ccgcugugccagg

SEQ ID NO: 1009952 - RNA, 17 nt, Homo sapiens
ccgcugugccaggcgag

SEQ ID NO: 1009953 - RNA, 22 nt, Homo sapiens
ccggcucccuucuacagccuca

SEQ ID NO: 1009954 - RNA, 20 nt, Homo sapiens
ccgggaagagggugauugcu

SEQ ID NO: 1009955 - RNA, 21 nt, Homo sapiens
ccggggauucuguacaugcau

SEQ ID NO: 1009956 - RNA, 16 nt, Homo sapiens
ccggggcgaguggcac

SEQ ID NO: 1009957 - RNA, 11 nt, Homo sapiens
ccgucuucucc

SEQ ID NO: 1009958 - RNA, 17 nt, Homo sapiens
ccgugaccagugcugcu

SEQ ID NO: 1009959 - RNA, 19 nt, Homo sapiens
ggcuccucugcuucucacg

SEQ ID NO: 1009960 - RNA, 21 nt, Homo sapiens
ggcucugccaguccuguccuu

SEQ ID NO: 1009961 - RNA, 18 nt, Homo sapiens
ggcugacaugaagcuguu

SEQ ID NO: 1009962 - RNA, 15 nt, Homo sapiens
ggcugaccaugcuca

SEQ ID NO: 1009963 - RNA, 14 nt, Homo sapiens
ggcugcgcacugug

SEQ ID NO: 1009964 - RNA, 18 nt, Homo sapiens
ggcugcucggggugcaca

SEQ ID NO: 1009965 - RNA, 23 nt, Homo sapiens
ggcuggagugcaguggugcaauc

SEQ ID NO: 1009966 - RNA, 19 nt, Homo sapiens
ggcuggaguggaguggcgu

SEQ ID NO: 1009967 - RNA, 20 nt, Homo sapiens
ggcuggugugguacagagaa

SEQ ID NO: 1009968 - RNA, 21 nt, Homo sapiens
ggcuugaauaaggaaaugaca

SEQ ID NO: 1009969 - RNA, 18 nt, Homo sapiens
ggcuugagucaccaugcc

SEQ ID NO: 1009970 - RNA, 19 nt, Homo sapiens
ggcuugggccuaggcugca

SEQ ID NO: 1009971 - RNA, 18 nt, Homo sapiens
gggaaaggaaucagagag

SEQ ID NO: 1009972 - RNA, 17 nt, Homo sapiens
gggaacucagauccagg

SEQ ID NO: 1009973 - RNA, 23 nt, Homo sapiens
gggaagagagccugcaggaucuc

SEQ ID NO: 1009974 - RNA, 13 nt, Homo sapiens
gggaaggcuuccu

SEQ ID NO: 1009975 - RNA, 21 nt, Homo sapiens
gggaagugagggcucacucag

SEQ ID NO: 1009976 - RNA, 16 nt, Homo sapiens
gggacaaaggagccug

SEQ ID NO: 1009977 - RNA, 21 nt, Homo sapiens
gggacaaaggagccugugaac

SEQ ID NO: 1009978 - RNA, 13 nt, Homo sapiens
gggaccaaugagg

SEQ ID NO: 1009979 - RNA, 19 nt, Homo sapiens
gggagcaaaucgugccuug

SEQ ID NO: 1009980 - RNA, 14 nt, Homo sapiens
gggagccaagggau

SEQ ID NO: 1009981 - RNA, 16 nt, Homo sapiens
gggagccaagggaugg

SEQ ID NO: 1009982 - RNA, 13 nt, Homo sapiens
gggaggagggugg

SEQ ID NO: 1009983 - RNA, 12 nt, Homo sapiens
gggagucugggc

SEQ ID NO: 1009984 - RNA, 23 nt, Homo sapiens
gggauaaguaaguuugauuucau

SEQ ID NO: 1009985 - RNA, 13 nt, Homo sapiens
gggauguguccug

SEQ ID NO: 1009986 - RNA, 20 nt, Homo sapiens
gggauucuguacaugcauug

SEQ ID NO: 1009987 - RNA, 17 nt, Homo sapiens
gggcagcgccaggcuga

SEQ ID NO: 1009988 - RNA, 21 nt, Homo sapiens
gggcaggcugggccaugucca

SEQ ID NO: 1009989 - RNA, 14 nt, Homo sapiens
gggcagucauuauc

SEQ ID NO: 1009990 - RNA, 14 nt, Homo sapiens
gggccacaucccac

SEQ ID NO: 1009991 - RNA, 12 nt, Homo sapiens
gggccagagcca

SEQ ID NO: 1009992 - RNA, 21 nt, Homo sapiens
gggccagagccagggggguga

SEQ ID NO: 1009993 - RNA, 17 nt, Homo sapiens
gggccauguccaaagag

SEQ ID NO: 1009994 - RNA, 21 nt, Homo sapiens
gggccccacccucggggaugu

SEQ ID NO: 1009995 - RNA, 13 nt, Homo sapiens
gggccugggacaa

SEQ ID NO: 1009996 - RNA, 17 nt, Homo sapiens
gggcgcaagucaaagag

SEQ ID NO: 1009997 - RNA, 23 nt, Homo sapiens
gggcuauuuuuucccccacaaac

SEQ ID NO: 1009998 - RNA, 22 nt, Homo sapiens
gggcucacucagccacccugag

SEQ ID NO: 1009999 - RNA, 18 nt, Homo sapiens
gggcucagggagcugaga

SEQ ID NO: 1010000 - RNA, 14 nt, Homo sapiens
gggcucgugcccug

SEQ ID NO: 1010001 - RNA, 14 nt, Homo sapiens
gggcugagcuggga

SEQ ID NO: 1010002 - RNA, 20 nt, Homo sapiens
gggcugucaucugugcacug

SEQ ID NO: 1010003 - RNA, 18 nt, Homo sapiens
ggggaagagagccugcag

SEQ ID NO: 1010004 - RNA, 16 nt, Homo sapiens
ggggauuuuuaugucu

SEQ ID NO: 1010005 - RNA, 23 nt, Homo sapiens
ggggcugucccggaggcgguggg

SEQ ID NO: 1010006 - RNA, 14 nt, Homo sapiens
gggggucaccaggu

SEQ ID NO: 1010007 - RNA, 13 nt, Homo sapiens
gggguagccugag

SEQ ID NO: 1010008 - RNA, 18 nt, Homo sapiens
gggguauaaaacuuuccu

SEQ ID NO: 1010009 - RNA, 22 nt, Homo sapiens
ggguacuucuugaaggugcuga

SEQ ID NO: 1010010 - RNA, 20 nt, Homo sapiens
gggucucgcuuuguugccca

SEQ ID NO: 1010011 - RNA, 21 nt, Homo sapiens
gggucucgcuuuguugcccag

SEQ ID NO: 1010012 - RNA, 19 nt, Homo sapiens
gggugguccgggaagugag

SEQ ID NO: 1010013 - RNA, 14 nt, Homo sapiens
gguaugauauugca

SEQ ID NO: 1010014 - RNA, 13 nt, Homo sapiens
ggucaggccuuug

SEQ ID NO: 1010015 - RNA, 16 nt, Homo sapiens
ggucauuguaaucacu

SEQ ID NO: 1010016 - RNA, 18 nt, Homo sapiens
gguccuccuccagggaca

SEQ ID NO: 1010017 - RNA, 20 nt, Homo sapiens
gguccucugagacuccagac

SEQ ID NO: 1010018 - RNA, 21 nt, Homo sapiens
ggucguggagagcuaggagca

SEQ ID NO: 1010019 - RNA, 16 nt, Homo sapiens
ggucugcucuuucucu

SEQ ID NO: 1010020 - RNA, 12 nt, Homo sapiens
ggucuucaagac

SEQ ID NO: 1010021 - RNA, 20 nt, Homo sapiens
ggucuuucugaauugcacau

SEQ ID NO: 1010022 - RNA, 16 nt, Homo sapiens
ggucuuuugguuauga

SEQ ID NO: 1010023 - RNA, 20 nt, Homo sapiens
ggugaacaaagcagccacga

SEQ ID NO: 1010024 - RNA, 20 nt, Homo sapiens
ggugaaccuuaguaccuaaa

SEQ ID NO: 1010025 - RNA, 17 nt, Homo sapiens
ggugaccccagggcaca

SEQ ID NO: 1010026 - RNA, 13 nt, Homo sapiens
ggugcacugggag

SEQ ID NO: 1010027 - RNA, 21 nt, Homo sapiens
ggugcagggauguggguucca

SEQ ID NO: 1010028 - RNA, 13 nt, Homo sapiens
ggugcccacaggc

SEQ ID NO: 1010029 - RNA, 19 nt, Homo sapiens
gguggggagacauaaccac

SEQ ID NO: 1010030 - RNA, 11 nt, Homo sapiens
ggugggguccu

SEQ ID NO: 1010031 - RNA, 20 nt, Homo sapiens
gguggguacuugggugagga

SEQ ID NO: 1010032 - RNA, 13 nt, Homo sapiens
gguguaccaccca

SEQ ID NO: 1010033 - RNA, 17 nt, Homo sapiens
gguguaccacccauccc

SEQ ID NO: 1010034 - RNA, 23 nt, Homo sapiens
gguguuggacaagcuucugagac

SEQ ID NO: 1010035 - RNA, 14 nt, Homo sapiens
gguugaucuugcaa

SEQ ID NO: 1010036 - RNA, 15 nt, Homo sapiens
gguuguuucuguucc

SEQ ID NO: 1010037 - RNA, 17 nt, Homo sapiens
gguuuauaugcacuuuc

SEQ ID NO: 1010038 - RNA, 23 nt, Homo sapiens
gguuugucacacgauaaagggau

SEQ ID NO: 1010039 - RNA, 21 nt, Homo sapiens
guaaagaaaaaagcaccaaag

SEQ ID NO: 1010040 - RNA, 13 nt, Homo sapiens
guaaagaauuauu

SEQ ID NO: 1010041 - RNA, 20 nt, Homo sapiens
guaacaauuguguagccuuu

SEQ ID NO: 1010042 - RNA, 22 nt, Homo sapiens
guaacagauuuuguuggcauag

SEQ ID NO: 1010043 - RNA, 17 nt, Homo sapiens
guaacugucaccugaaa

SEQ ID NO: 1010044 - RNA, 14 nt, Homo sapiens
guaagacaggccag

SEQ ID NO: 1010045 - RNA, 14 nt, Homo sapiens
guaaggcucuagau

SEQ ID NO: 1010046 - RNA, 13 nt, Homo sapiens
guaauauguuaca

SEQ ID NO: 1010047 - RNA, 15 nt, Homo sapiens
guaauccucaagaaa

SEQ ID NO: 1010048 - RNA, 19 nt, Homo sapiens
guaaugucuugagcucuau

SEQ ID NO: 1010049 - RNA, 21 nt, Homo sapiens
guacaaaagaagggcugguau

SEQ ID NO: 1010050 - RNA, 11 nt, Homo sapiens
guacaugagaa

SEQ ID NO: 1010051 - RNA, 17 nt, Homo sapiens
guacaugguguuugugg

SEQ ID NO: 1010052 - RNA, 16 nt, Homo sapiens
guacauguguguacau

SEQ ID NO: 1010053 - RNA, 14 nt, Homo sapiens
guacauuucucagg

SEQ ID NO: 1010054 - RNA, 15 nt, Homo sapiens
guacgaugacagugu

SEQ ID NO: 1010055 - RNA, 17 nt, Homo sapiens
guacuaugucaaagcaa

SEQ ID NO: 1010056 - RNA, 19 nt, Homo sapiens
guacucuuuagaucuccca

SEQ ID NO: 1010057 - RNA, 18 nt, Homo sapiens
guagacuuuugcuuuaug

SEQ ID NO: 1010058 - RNA, 17 nt, Homo sapiens
guagagagcaagggaag

SEQ ID NO: 1010059 - RNA, 22 nt, Homo sapiens
guagagggaguugucaagucuc

SEQ ID NO: 1010060 - RNA, 21 nt, Homo sapiens
guagcagagaaaggauugauu

SEQ ID NO: 1010061 - RNA, 15 nt, Homo sapiens
guaggcuacagagaa

SEQ ID NO: 1010062 - RNA, 20 nt, Homo sapiens
guaggcuacagagaagccuu

SEQ ID NO: 1010063 - RNA, 18 nt, Homo sapiens
guuaaggguuaguuuaca

SEQ ID NO: 1010064 - RNA, 21 nt, Homo sapiens
guuaccugaaaacacugugca

SEQ ID NO: 1010065 - RNA, 22 nt, Homo sapiens
guuaccugaaaacacugugcac

SEQ ID NO: 1010066 - RNA, 16 nt, Homo sapiens
guuagaccuacagggg

SEQ ID NO: 1010067 - RNA, 22 nt, Homo sapiens
guuagcaccauuaacuccuccu

SEQ ID NO: 1010068 - RNA, 15 nt, Homo sapiens
guuagugauggagcu

SEQ ID NO: 1010069 - RNA, 19 nt, Homo sapiens
guuauacuuauuuguauau

SEQ ID NO: 1010070 - RNA, 14 nt, Homo sapiens
guuauagcuucagg

SEQ ID NO: 1010071 - RNA, 23 nt, Homo sapiens
guuauugguguaagguacuuuca

SEQ ID NO: 1010072 - RNA, 18 nt, Homo sapiens
guuauuuaaugagucagu

SEQ ID NO: 1010073 - RNA, 20 nt, Homo sapiens
guucacaaacuucauuucag

SEQ ID NO: 1010074 - RNA, 22 nt, Homo sapiens
guucacaccagagaaccaggcu

SEQ ID NO: 1010075 - RNA, 16 nt, Homo sapiens
guuccacagaggacac

SEQ ID NO: 1010076 - RNA, 15 nt, Homo sapiens
guucccacuuaaaaa

SEQ ID NO: 1010077 - RNA, 14 nt, Homo sapiens
guuccccacugaca

SEQ ID NO: 1010078 - RNA, 17 nt, Homo sapiens
guucccuauccaaucaa

SEQ ID NO: 1010079 - RNA, 16 nt, Homo sapiens
guucccucuugcucag

SEQ ID NO: 1010080 - RNA, 15 nt, Homo sapiens
guucuuugggccaga

SEQ ID NO: 1010081 - RNA, 17 nt, Homo sapiens
guugaagccacugccuu

SEQ ID NO: 1010082 - RNA, 12 nt, Homo sapiens
guugagugccag

SEQ ID NO: 1010083 - RNA, 22 nt, Homo sapiens
guugaucuggaacccagacuca

SEQ ID NO: 1010084 - RNA, 19 nt, Homo sapiens
guugcagucacucuaguca

SEQ ID NO: 1010085 - RNA, 18 nt, Homo sapiens
guuguaaccugcugugau

SEQ ID NO: 1010086 - RNA, 12 nt, Homo sapiens
guugugccaaau

SEQ ID NO: 1010087 - RNA, 15 nt, Homo sapiens
guuuaaaacagaagc

SEQ ID NO: 1010088 - RNA, 13 nt, Homo sapiens
guuuaaagucuca

SEQ ID NO: 1010089 - RNA, 22 nt, Homo sapiens
guuuaaagucucaguuucuugc

SEQ ID NO: 1010090 - RNA, 13 nt, Homo sapiens
guuuacagaauuu

SEQ ID NO: 1010091 - RNA, 22 nt, Homo sapiens
guuuaucaguaaauaacuggaa

SEQ ID NO: 1010092 - RNA, 23 nt, Homo sapiens
guuuccuuuguuggagucaaaaa

SEQ ID NO: 1010093 - RNA, 21 nt, Homo sapiens
guuucguaacacagcauugua

SEQ ID NO: 1010094 - RNA, 14 nt, Homo sapiens
guuucuggcucuug

SEQ ID NO: 1010095 - RNA, 13 nt, Homo sapiens
guuucuugccuca

SEQ ID NO: 1010096 - RNA, 21 nt, Homo sapiens
guuugaagucuuguguauuug

SEQ ID NO: 1010097 - RNA, 18 nt, Homo sapiens
guuugaugaggcccucca

SEQ ID NO: 1010098 - RNA, 15 nt, Homo sapiens
guuuuaaacuugccu

SEQ ID NO: 1010099 - RNA, 17 nt, Homo sapiens
guuuuaacuguggauau

SEQ ID NO: 1010100 - RNA, 20 nt, Homo sapiens
guuuuacauuguugagcuau

SEQ ID NO: 1010101 - RNA, 22 nt, Homo sapiens
guuuuauuuucaaaaccagguc

SEQ ID NO: 1010102 - RNA, 20 nt, Homo sapiens
guuuugaaggcaaaauugca

SEQ ID NO: 1010103 - RNA, 18 nt, Homo sapiens
guuuuggagaguuugccu

SEQ ID NO: 1010104 - RNA, 15 nt, Homo sapiens
guuuuguauucucug

SEQ ID NO: 1010105 - RNA, 14 nt, Homo sapiens
guuuugugccuuug

SEQ ID NO: 1010106 - RNA, 15 nt, Homo sapiens
guuuuuaacauguca

SEQ ID NO: 1010107 - RNA, 22 nt, Homo sapiens
guuuuucuauuaaaagacucau

SEQ ID NO: 1010108 - RNA, 16 nt, Homo sapiens
guuuuuuauuaugcau

SEQ ID NO: 1010109 - RNA, 19 nt, Homo sapiens
guuuuuuauuaugcauuau

SEQ ID NO: 1010110 - RNA, 19 nt, Homo sapiens
guuuuuucagucugugaaa

SEQ ID NO: 1010111 - RNA, 20 nt, Homo sapiens
uaaaaagguuuacagaauuu

SEQ ID NO: 1010112 - RNA, 14 nt, Homo sapiens
uaaaaauacacaaa

SEQ ID NO: 1010113 - RNA, 15 nt, Homo sapiens
uaaaaaugagugcuu

SEQ ID NO: 1010114 - RNA, 17 nt, Homo sapiens
uaaaaaugagugcuuaa

SEQ ID NO: 1010115 - RNA, 22 nt, Homo sapiens
uaaaacagguuauaacaguguu

SEQ ID NO: 1010116 - RNA, 15 nt, Homo sapiens
uaaaacauguacaaa

SEQ ID NO: 1010117 - RNA, 16 nt, Homo sapiens
uaaaacuucaguuuca

SEQ ID NO: 1010118 - RNA, 13 nt, Homo sapiens
uaaaaguggcauu

SEQ ID NO: 1010119 - RNA, 17 nt, Homo sapiens
uaaaagugggcuugauu

SEQ ID NO: 1010120 - RNA, 21 nt, Homo sapiens
uaaaaguuuuuuauuaugcau

SEQ ID NO: 1010121 - RNA, 21 nt, Homo sapiens
uaaaauacuuuuacucugccu

SEQ ID NO: 1010122 - RNA, 14 nt, Homo sapiens
uaaaauaucuacau

SEQ ID NO: 1010123 - RNA, 21 nt, Homo sapiens
uaaaaucuuauaguucuaggc

SEQ ID NO: 1010124 - RNA, 20 nt, Homo sapiens
uaaaaugaaggaaaagcaug

SEQ ID NO: 1010125 - RNA, 21 nt, Homo sapiens
uaaaaugauuguaguaaucug

SEQ ID NO: 1010126 - RNA, 19 nt, Homo sapiens
uaaaaugccaugaugccuc

SEQ ID NO: 1010127 - RNA, 14 nt, Homo sapiens
uaaaauguaugcau

SEQ ID NO: 1010128 - RNA, 13 nt, Homo sapiens
uaaaauuauuuca

SEQ ID NO: 1010129 - RNA, 14 nt, Homo sapiens
uaaacaauauaguc

SEQ ID NO: 1010130 - RNA, 15 nt, Homo sapiens
uaaacaccuccucau

SEQ ID NO: 1010131 - RNA, 17 nt, Homo sapiens
uaaacagauggcacuuu

SEQ ID NO: 1010132 - RNA, 20 nt, Homo sapiens
uaaacagauggcacuuugaa

SEQ ID NO: 1010133 - RNA, 21 nt, Homo sapiens
uaaaccaucucccuggugcuu

SEQ ID NO: 1010134 - RNA, 22 nt, Homo sapiens
uaaacccagcucccuucuuccc

SEQ ID NO: 1010135 - RNA, 16 nt, Homo sapiens
uaaacuauaaccucuc

SEQ ID NO: 1010136 - RNA, 15 nt, Homo sapiens
uaaacucuguugcaa

SEQ ID NO: 1010137 - RNA, 22 nt, Homo sapiens
uaaacucuguugcaagugcaau

SEQ ID NO: 1010138 - RNA, 20 nt, Homo sapiens
uaaacugauggauaucccua

SEQ ID NO: 1010139 - RNA, 23 nt, Homo sapiens
uaaacuggaauccuuucacccgc

SEQ ID NO: 1010140 - RNA, 18 nt, Homo sapiens
uaaacuuauuuacaaaua

SEQ ID NO: 1010141 - RNA, 13 nt, Homo sapiens
uaaacuugcauca

SEQ ID NO: 1010142 - RNA, 15 nt, Homo sapiens
uaaagaaaaaagcac

SEQ ID NO: 1010143 - RNA, 17 nt, Homo sapiens
uaaagaaaaaagcacca

SEQ ID NO: 1010144 - RNA, 12 nt, Homo sapiens
uaaagaauacac

SEQ ID NO: 1010145 - RNA, 20 nt, Homo sapiens
uaaagaauguucuauuucug

SEQ ID NO: 1010146 - RNA, 21 nt, Homo sapiens
uaaagauggaguuucuaaggu

SEQ ID NO: 1010147 - RNA, 12 nt, Homo sapiens
uaaagcaaauuu

SEQ ID NO: 1010148 - RNA, 17 nt, Homo sapiens
uaaaggggagaccucag

SEQ ID NO: 1010149 - RNA, 22 nt, Homo sapiens
uaaagguccacaggucuagacu

SEQ ID NO: 1010150 - RNA, 16 nt, Homo sapiens
uaaaguacaaccauag

SEQ ID NO: 1010151 - RNA, 18 nt, Homo sapiens
uaaaguaguccugugaau

SEQ ID NO: 1010152 - RNA, 21 nt, Homo sapiens
uaaauaaccggggauucugua

SEQ ID NO: 1010153 - RNA, 21 nt, Homo sapiens
uaaauaggcggggcuugccuu

SEQ ID NO: 1010154 - RNA, 21 nt, Homo sapiens
uaaaugauucuuagugacuuu

SEQ ID NO: 1010155 - RNA, 17 nt, Homo sapiens
uaaauuauuggcaugaa

SEQ ID NO: 1010156 - RNA, 16 nt, Homo sapiens
uaaauuauuuacugca

SEQ ID NO: 1010157 - RNA, 21 nt, Homo sapiens
uaaauuuuaaguacuuugcug

SEQ ID NO: 1010158 - RNA, 17 nt, Homo sapiens
uaaauuuuuuguugaca

SEQ ID NO: 1010159 - RNA, 18 nt, Homo sapiens
uaacaauuguguagccuu

SEQ ID NO: 1010160 - RNA, 18 nt, Homo sapiens
uaacacucagaagccugg

SEQ ID NO: 1010161 - RNA, 15 nt, Homo sapiens
uaacacucaugaagc

SEQ ID NO: 1010162 - RNA, 23 nt, Homo sapiens
uaacagaaagccugggugacauu

SEQ ID NO: 1010163 - RNA, 16 nt, Homo sapiens
uaacaguggacaaagu

SEQ ID NO: 1010164 - RNA, 17 nt, Homo sapiens
uaacauuaucuaguuca

SEQ ID NO: 1010165 - RNA, 19 nt, Homo sapiens
uaaccaacuuuucuauuaa

SEQ ID NO: 1010166 - RNA, 13 nt, Homo sapiens
ucccagacacugg

SEQ ID NO: 1010167 - RNA, 18 nt, Homo sapiens
ucccagacggucaggaaa

SEQ ID NO: 1010168 - RNA, 19 nt, Homo sapiens
ucccagcauaggauucauu

SEQ ID NO: 1010169 - RNA, 17 nt, Homo sapiens
ucccagcccccugacca

SEQ ID NO: 1010170 - RNA, 15 nt, Homo sapiens
ucccaggaccacagg

SEQ ID NO: 1010171 - RNA, 18 nt, Homo sapiens
ucccaggacccugaaggg

SEQ ID NO: 1010172 - RNA, 21 nt, Homo sapiens
ucccaggccaggcuuuguugc

SEQ ID NO: 1010173 - RNA, 19 nt, Homo sapiens
ucccaggccccaugaccuc

SEQ ID NO: 1010174 - RNA, 21 nt, Homo sapiens
ucccaggguuauagacagucg

SEQ ID NO: 1010175 - RNA, 18 nt, Homo sapiens
ucccaggguuuuaacuuu

SEQ ID NO: 1010176 - RNA, 18 nt, Homo sapiens
ucccaguguggcugaggc

SEQ ID NO: 1010177 - RNA, 16 nt, Homo sapiens
ucccauagccaggaaa

SEQ ID NO: 1010178 - RNA, 23 nt, Homo sapiens
ucccauuaccauguaauggcagu

SEQ ID NO: 1010179 - RNA, 14 nt, Homo sapiens
uccccacaucccau

SEQ ID NO: 1010180 - RNA, 23 nt, Homo sapiens
uccccacgagggcuggcuggccu

SEQ ID NO: 1010181 - RNA, 20 nt, Homo sapiens
uccccacuuacagaucuauc

SEQ ID NO: 1010182 - RNA, 12 nt, Homo sapiens
ucccccccaugc

SEQ ID NO: 1010183 - RNA, 19 nt, Homo sapiens
ucccccuuugugcacauuu

SEQ ID NO: 1010184 - RNA, 22 nt, Homo sapiens
uccccgagugccuagguuuugg

SEQ ID NO: 1010185 - RNA, 22 nt, Homo sapiens
uccccucagggauacgacacau

SEQ ID NO: 1010186 - RNA, 22 nt, Homo sapiens
uccccuccugugucccuuguaa

SEQ ID NO: 1010187 - RNA, 22 nt, Homo sapiens
uccccuggggagucugggcaca

SEQ ID NO: 1010188 - RNA, 15 nt, Homo sapiens
uccccuuccacugag

SEQ ID NO: 1010189 - RNA, 23 nt, Homo sapiens
uccccuucucugugcaguagcau

SEQ ID NO: 1010190 - RNA, 16 nt, Homo sapiens
ucccgaggcuacagca

SEQ ID NO: 1010191 - RNA, 17 nt, Homo sapiens
ucccggggccagcacuu

SEQ ID NO: 1010192 - RNA, 18 nt, Homo sapiens
ucccggggcuccacugaa

SEQ ID NO: 1010193 - RNA, 13 nt, Homo sapiens
ucccuacauguau

SEQ ID NO: 1010194 - RNA, 18 nt, Homo sapiens
ucccucacuguugaauuu

SEQ ID NO: 1010195 - RNA, 20 nt, Homo sapiens
ucccucaggucccuugguca

SEQ ID NO: 1010196 - RNA, 15 nt, Homo sapiens
ucccucaucuguccc

SEQ ID NO: 1010197 - RNA, 23 nt, Homo sapiens
ucccucccagaggagccaccagu

SEQ ID NO: 1010198 - RNA, 17 nt, Homo sapiens
ucccucccccccaugca

SEQ ID NO: 1010199 - RNA, 22 nt, Homo sapiens
ucccucccccccaugcacugug

SEQ ID NO: 1010200 - RNA, 16 nt, Homo sapiens
ucccuccccuugccug

SEQ ID NO: 1010201 - RNA, 15 nt, Homo sapiens
ucccuccuaaccuag

SEQ ID NO: 1010202 - RNA, 18 nt, Homo sapiens
ucccucgacauuuucucc

SEQ ID NO: 1010203 - RNA, 18 nt, Homo sapiens
ucccucucguaagauuuc

SEQ ID NO: 1010204 - RNA, 19 nt, Homo sapiens
ucccucucguaagauuucc

SEQ ID NO: 1010205 - RNA, 22 nt, Homo sapiens
ucccucuuuggcuccccuguac

SEQ ID NO: 1010206 - RNA, 15 nt, Homo sapiens
ucccugacuguaaau

SEQ ID NO: 1010207 - RNA, 16 nt, Homo sapiens
ucccuggaucagaaca

SEQ ID NO: 1010208 - RNA, 23 nt, Homo sapiens
ucccuggaugacauuaaagaagg

SEQ ID NO: 1010209 - RNA, 14 nt, Homo sapiens
ucccuucuucccua

SEQ ID NO: 1010210 - RNA, 23 nt, Homo sapiens
ucccuugggcacgugugcuggga

SEQ ID NO: 1010211 - RNA, 18 nt, Homo sapiens
ucccuugggcucugauga

SEQ ID NO: 1010212 - RNA, 20 nt, Homo sapiens
ucccuugggcucugaugaaa

SEQ ID NO: 1010213 - RNA, 19 nt, Homo sapiens
ucccuuuaugcagagccac

SEQ ID NO: 1010214 - RNA, 19 nt, Homo sapiens
uccgagaggugggccaguc

SEQ ID NO: 1010215 - RNA, 18 nt, Homo sapiens
uccgauuccccuguagca

SEQ ID NO: 1010216 - RNA, 22 nt, Homo sapiens
uccgcccccggauuugcucagg

SEQ ID NO: 1010217 - RNA, 14 nt, Homo sapiens
uccggcggggaccc

SEQ ID NO: 1010218 - RNA, 14 nt, Homo sapiens
uccuaaauuuuccu

SEQ ID NO: 1010219 - RNA, 22 nt, Homo sapiens
uccuaguuguucagcauggcau

SEQ ID NO: 1010220 - RNA, 13 nt, Homo sapiens
uccucacagugaa

SEQ ID NO: 1010221 - RNA, 20 nt, Homo sapiens
uccucauagcaauacuugga

SEQ ID NO: 1010222 - RNA, 19 nt, Homo sapiens
uccucaucccuccaucuca

SEQ ID NO: 1010223 - RNA, 16 nt, Homo sapiens
uccuccaacaccaagc

SEQ ID NO: 1010224 - RNA, 15 nt, Homo sapiens
uccuccacaaauuau

SEQ ID NO: 1010225 - RNA, 17 nt, Homo sapiens
uccuccaccgucuuucu

SEQ ID NO: 1010226 - RNA, 16 nt, Homo sapiens
uccuccacgccugucc

SEQ ID NO: 1010227 - RNA, 18 nt, Homo sapiens
uccuccagaauggagcug

SEQ ID NO: 1010228 - RNA, 23 nt, Homo sapiens
uccuccagggacagcaacuauca

SEQ ID NO: 1010229 - RNA, 14 nt, Homo sapiens
uccuccaugggaga

SEQ ID NO: 1010230 - RNA, 14 nt, Homo sapiens
uccucccuugggaa

SEQ ID NO: 1010231 - RNA, 19 nt, Homo sapiens
uccuccuccagggacagca

SEQ ID NO: 1010232 - RNA, 19 nt, Homo sapiens
uccucuagcugugggggug

SEQ ID NO: 1010233 - RNA, 13 nt, Homo sapiens
uccucucaucccc

SEQ ID NO: 1010234 - RNA, 16 nt, Homo sapiens
uccucucccucaucaa

SEQ ID NO: 1010235 - RNA, 15 nt, Homo sapiens
uccucucuuccucuu

SEQ ID NO: 1010236 - RNA, 15 nt, Homo sapiens
uccucugcauuuaca

SEQ ID NO: 1010237 - RNA, 17 nt, Homo sapiens
uccucugcauuuacaca

SEQ ID NO: 1010238 - RNA, 16 nt, Homo sapiens
uccucugugaccaaug

SEQ ID NO: 1010239 - RNA, 16 nt, Homo sapiens
uccucuuucaaccuca

SEQ ID NO: 1010240 - RNA, 12 nt, Homo sapiens
uccugacacugc

SEQ ID NO: 1010241 - RNA, 23 nt, Homo sapiens
uccugaggcuuuggauuugacau

SEQ ID NO: 1010242 - RNA, 23 nt, Homo sapiens
uccugauacuuucuguucuccag

SEQ ID NO: 1010243 - RNA, 13 nt, Homo sapiens
uccugcaacucaa

SEQ ID NO: 1010244 - RNA, 16 nt, Homo sapiens
uccugcaacucaagga

SEQ ID NO: 1010245 - RNA, 19 nt, Homo sapiens
uccugcccccaaggaggca

SEQ ID NO: 1010246 - RNA, 15 nt, Homo sapiens
uccugccucuacugg

SEQ ID NO: 1010247 - RNA, 21 nt, Homo sapiens
uccugccuugaaaaagacauu

SEQ ID NO: 1010248 - RNA, 16 nt, Homo sapiens
uccugggccugcagaa

SEQ ID NO: 1010249 - RNA, 14 nt, Homo sapiens
uccugggucuacca

SEQ ID NO: 1010250 - RNA, 18 nt, Homo sapiens
uccuggugccaccucaga

SEQ ID NO: 1010251 - RNA, 22 nt, Homo sapiens
uccuguacauugugggauguuc

SEQ ID NO: 1010252 - RNA, 17 nt, Homo sapiens
uccuguccuaucacucu

SEQ ID NO: 1010253 - RNA, 16 nt, Homo sapiens
uccuguccuuuaccaa

SEQ ID NO: 1010254 - RNA, 21 nt, Homo sapiens
uccugugucccuuguaaauag

SEQ ID NO: 1010255 - RNA, 12 nt, Homo sapiens
uccuuacauuuu

SEQ ID NO: 1010256 - RNA, 12 nt, Homo sapiens
uccuuccagugu

SEQ ID NO: 1010257 - RNA, 20 nt, Homo sapiens
uccuugccuaaggugucuga

SEQ ID NO: 1010258 - RNA, 22 nt, Homo sapiens
uccuuuccauaaauccuugaug

SEQ ID NO: 1010259 - RNA, 13 nt, Homo sapiens
uccuuuugcaaag

SEQ ID NO: 1010260 - RNA, 18 nt, Homo sapiens
uccuuuuuugcaugugca

SEQ ID NO: 1010261 - RNA, 23 nt, Homo sapiens
ucgaacuauuuucaaagacuuaa

SEQ ID NO: 1010262 - RNA, 17 nt, Homo sapiens
ucgaaucucugugccuu

SEQ ID NO: 1010263 - RNA, 16 nt, Homo sapiens
ucgauuuaugccucag

SEQ ID NO: 1010264 - RNA, 16 nt, Homo sapiens
ucgcuccccacucugc

SEQ ID NO: 1010265 - RNA, 13 nt, Homo sapiens
ucgcuucuugccu

SEQ ID NO: 1010266 - RNA, 23 nt, Homo sapiens
ucggacaagacccccagcacuug

SEQ ID NO: 1010267 - RNA, 23 nt, Homo sapiens
ucggacaugaaaggacccuguga

SEQ ID NO: 1010268 - RNA, 20 nt, Homo sapiens
ucggagaaacgggugagcug

SEQ ID NO: 1010269 - RNA, 17 nt, Homo sapiens
ugguagaccacugccau

SEQ ID NO: 1010270 - RNA, 21 nt, Homo sapiens
ugguauaaacguccuacugua

SEQ ID NO: 1010271 - RNA, 20 nt, Homo sapiens
uggucccggggccagcacuu

SEQ ID NO: 1010272 - RNA, 21 nt, Homo sapiens
uggucccggggccagcacuuc

SEQ ID NO: 1010273 - RNA, 14 nt, Homo sapiens
ugguccgaucuuug

SEQ ID NO: 1010274 - RNA, 20 nt, Homo sapiens
uggucugcugaguaacaggu

SEQ ID NO: 1010275 - RNA, 21 nt, Homo sapiens
uggucuuccucgauaaaggga

SEQ ID NO: 1010276 - RNA, 16 nt, Homo sapiens
uggugaccuuucacga

SEQ ID NO: 1010277 - RNA, 20 nt, Homo sapiens
uggugagcucugggaagugu

SEQ ID NO: 1010278 - RNA, 16 nt, Homo sapiens
uggugcuuaugcucuu

SEQ ID NO: 1010279 - RNA, 23 nt, Homo sapiens
ugguggacucgccuguaaucuca

SEQ ID NO: 1010280 - RNA, 13 nt, Homo sapiens
ugguguccagaca

SEQ ID NO: 1010281 - RNA, 15 nt, Homo sapiens
ugguuccuucccaau

SEQ ID NO: 1010282 - RNA, 12 nt, Homo sapiens
ugguucuuucau

SEQ ID NO: 1010283 - RNA, 14 nt, Homo sapiens
ugguuucagcacua

SEQ ID NO: 1010284 - RNA, 21 nt, Homo sapiens
ugguuuuuugcauacugcuau

SEQ ID NO: 1010285 - RNA, 15 nt, Homo sapiens
uguaaaauuauuuca

SEQ ID NO: 1010286 - RNA, 13 nt, Homo sapiens
uguaaacuuuauc

SEQ ID NO: 1010287 - RNA, 17 nt, Homo sapiens
uguaaacuuuaucacuu

SEQ ID NO: 1010288 - RNA, 22 nt, Homo sapiens
uguaaagaaaaaagcaccaaag

SEQ ID NO: 1010289 - RNA, 23 nt, Homo sapiens
uguaaagauguucuggauaccau

SEQ ID NO: 1010290 - RNA, 17 nt, Homo sapiens
uguaacgcaaguuccca

SEQ ID NO: 1010291 - RNA, 18 nt, Homo sapiens
uguaaguugggcuugcua

SEQ ID NO: 1010292 - RNA, 14 nt, Homo sapiens
uguaaucauauaau

SEQ ID NO: 1010293 - RNA, 17 nt, Homo sapiens
uguaaugucuugagcuc

SEQ ID NO: 1010294 - RNA, 14 nt, Homo sapiens
uguacacagucagc

SEQ ID NO: 1010295 - RNA, 14 nt, Homo sapiens
uguaccaggcucuc

SEQ ID NO: 1010296 - RNA, 13 nt, Homo sapiens
uguaccaguuugu

SEQ ID NO: 1010297 - RNA, 13 nt, Homo sapiens
uguaccauguaca

SEQ ID NO: 1010298 - RNA, 14 nt, Homo sapiens
uguaccauuugccu

SEQ ID NO: 1010299 - RNA, 14 nt, Homo sapiens
uguaccugugcacg

SEQ ID NO: 1010300 - RNA, 23 nt, Homo sapiens
uguacuguucugugucuuucaca

SEQ ID NO: 1010301 - RNA, 18 nt, Homo sapiens
uguacuugccuuauuaga

SEQ ID NO: 1010302 - RNA, 19 nt, Homo sapiens
uguagacuuuugcuuuaug

SEQ ID NO: 1010303 - RNA, 20 nt, Homo sapiens
uguagauucagguaauacaa

SEQ ID NO: 1010304 - RNA, 15 nt, Homo sapiens
uguagcaauauauca

SEQ ID NO: 1010305 - RNA, 12 nt, Homo sapiens
uguaggccucag

SEQ ID NO: 1010306 - RNA, 14 nt, Homo sapiens
uguauaaaauguac

SEQ ID NO: 1010307 - RNA, 16 nt, Homo sapiens
uguauacuguaggcac

SEQ ID NO: 1010308 - RNA, 19 nt, Homo sapiens
uguauauucaggacuugaa

SEQ ID NO: 1010309 - RNA, 16 nt, Homo sapiens
uguaucaaaugugaca

SEQ ID NO: 1010310 - RNA, 22 nt, Homo sapiens
uguauuuucuuacacuguguca

SEQ ID NO: 1010311 - RNA, 16 nt, Homo sapiens
ugucaaugcaguuguc

SEQ ID NO: 1010312 - RNA, 13 nt, Homo sapiens
ugucacaaccaag

SEQ ID NO: 1010313 - RNA, 13 nt, Homo sapiens
ugucagauccagg

SEQ ID NO: 1010314 - RNA, 14 nt, Homo sapiens
ugucaggcacuggg

SEQ ID NO: 1010315 - RNA, 22 nt, Homo sapiens
ugucagggaguguucccuaucc

SEQ ID NO: 1010316 - RNA, 21 nt, Homo sapiens
ugucauccucaaagaaagugu

SEQ ID NO: 1010317 - RNA, 14 nt, Homo sapiens
uguccauuuacacg

SEQ ID NO: 1010318 - RNA, 21 nt, Homo sapiens
uguccccuuuccccagugaca

SEQ ID NO: 1010319 - RNA, 22 nt, Homo sapiens
ugucccuugccucaaugccagu

SEQ ID NO: 1010320 - RNA, 18 nt, Homo sapiens
uguccucagccuugccag

SEQ ID NO: 1010321 - RNA, 13 nt, Homo sapiens
uguccuccaacac

SEQ ID NO: 1010322 - RNA, 16 nt, Homo sapiens
uguccucuuucagcuc

SEQ ID NO: 1010323 - RNA, 22 nt, Homo sapiens
uguccugcccccaaggaggcag

SEQ ID NO: 1010324 - RNA, 13 nt, Homo sapiens
uguccugggguau

SEQ ID NO: 1010325 - RNA, 15 nt, Homo sapiens
uguccuuuaugaucc

SEQ ID NO: 1010326 - RNA, 15 nt, Homo sapiens
uguccuuuugcaaag

SEQ ID NO: 1010327 - RNA, 17 nt, Homo sapiens
ugucgauuuaugccuca

SEQ ID NO: 1010328 - RNA, 20 nt, Homo sapiens
ugucgcccaggcuggagugc

SEQ ID NO: 1010329 - RNA, 14 nt, Homo sapiens
ugucucagccuccc

SEQ ID NO: 1010330 - RNA, 14 nt, Homo sapiens
ugucuccuaccucu

SEQ ID NO: 1010331 - RNA, 16 nt, Homo sapiens
ugucugacaaccucuu

SEQ ID NO: 1010332 - RNA, 14 nt, Homo sapiens
ugucugcuguagaa

SEQ ID NO: 1010333 - RNA, 14 nt, Homo sapiens
ugugaaauuuacau

SEQ ID NO: 1010334 - RNA, 17 nt, Homo sapiens
ugugaacucaccaaaca

SEQ ID NO: 1010335 - RNA, 21 nt, Homo sapiens
ugugaccaaugucuugaugca

SEQ ID NO: 1010336 - RNA, 23 nt, Homo sapiens
ugugaccacaacaugaggccacu

SEQ ID NO: 1010337 - RNA, 19 nt, Homo sapiens
ugugagguucgcuuaucaa

SEQ ID NO: 1010338 - RNA, 18 nt, Homo sapiens
ugugauacgaugcuucaa

SEQ ID NO: 1010339 - RNA, 19 nt, Homo sapiens
ugugccaucauaagaauag

SEQ ID NO: 1010340 - RNA, 12 nt, Homo sapiens
ugugcccgggga

SEQ ID NO: 1010341 - RNA, 16 nt, Homo sapiens
uguggacuccaugccu

SEQ ID NO: 1010342 - RNA, 18 nt, Homo sapiens
uguggcuggaagauccug

SEQ ID NO: 1010343 - RNA, 22 nt, Homo sapiens
ugugggagaccggccugccagg

SEQ ID NO: 1010344 - RNA, 15 nt, Homo sapiens
uguguaacugcccaa

SEQ ID NO: 1010345 - RNA, 19 nt, Homo sapiens
uguguaagaaauacagacu

SEQ ID NO: 1010346 - RNA, 23 nt, Homo sapiens
uguguauccaugcaccuaccuua

SEQ ID NO: 1010347 - RNA, 21 nt, Homo sapiens
uguguccugacacugcaauug

SEQ ID NO: 1010348 - RNA, 16 nt, Homo sapiens
ugugucuaagauucua

SEQ ID NO: 1010349 - RNA, 22 nt, Homo sapiens
ugugugacuuacagaaacugca

SEQ ID NO: 1010350 - RNA, 13 nt, Homo sapiens
uguuaaaucaaua

SEQ ID NO: 1010351 - RNA, 23 nt, Homo sapiens
uguuaccugaaaacacugugcac

SEQ ID NO: 1010352 - RNA, 17 nt, Homo sapiens
uguuauauaauuuagac

SEQ ID NO: 1010353 - RNA, 16 nt, Homo sapiens
uguuaucaccuagcug

SEQ ID NO: 1010354 - RNA, 14 nt, Homo sapiens
uguuaucagucaua

SEQ ID NO: 1010355 - RNA, 14 nt, Homo sapiens
uguuccccacugac

SEQ ID NO: 1010356 - RNA, 18 nt, Homo sapiens
uguuccccuuccacugag

SEQ ID NO: 1010357 - RNA, 22 nt, Homo sapiens
uguucuaagucuuuccauugga

SEQ ID NO: 1010358 - RNA, 14 nt, Homo sapiens
uguucuauugcuga

SEQ ID NO: 1010359 - RNA, 18 nt, Homo sapiens
uguugaagccacugccuu

SEQ ID NO: 1010360 - RNA, 17 nt, Homo sapiens
uguugacauuagucuca

SEQ ID NO: 1010361 - RNA, 18 nt, Homo sapiens
uguugacauucugaaugc

SEQ ID NO: 1010362 - RNA, 16 nt, Homo sapiens
uguugagcaucugucc

SEQ ID NO: 1010363 - RNA, 13 nt, Homo sapiens
uguugagugccag

SEQ ID NO: 1010364 - RNA, 11 nt, Homo sapiens
uguugccaaau

SEQ ID NO: 1010365 - RNA, 18 nt, Homo sapiens
uguuguaagcaacaggcu

SEQ ID NO: 1010366 - RNA, 15 nt, Homo sapiens
uguuguaagcacuga

SEQ ID NO: 1010367 - RNA, 18 nt, Homo sapiens
uguuguagguuucaggga

SEQ ID NO: 1010368 - RNA, 14 nt, Homo sapiens
uguugucaccagau

SEQ ID NO: 1010369 - RNA, 23 nt, Homo sapiens
uguuuauuucaggcauuggauau

SEQ ID NO: 1010370 - RNA, 20 nt, Homo sapiens
uguuucaauugcaucuccca

SEQ ID NO: 1010371 - RNA, 23 nt, Homo sapiens
uguuucacaguuugaaauaagcu

SEQ ID NO: 1010372 - RNA, 15 nt, Homo sapiens
uguuuuucuaaagga

SEQ ID NO: 1010373 - RNA, 23 nt, Homo sapiens
aaaaccguaugagggaacugugu

SEQ ID NO: 1010374 - RNA, 23 nt, Homo sapiens
aaaacuucaacguaagacugugu

SEQ ID NO: 1010375 - RNA, 13 nt, Homo sapiens
aaaagacugacca

SEQ ID NO: 1010376 - RNA, 14 nt, Homo sapiens
aaaagacugaccaa

SEQ ID NO: 1010377 - RNA, 16 nt, Homo sapiens
aaaagggaacugaaca

SEQ ID NO: 1010378 - RNA, 10 nt, Homo sapiens
aaaagugaug

SEQ ID NO: 1010379 - RNA, 22 nt, Homo sapiens
aaaauaugacacucuagucaaa

SEQ ID NO: 1010380 - RNA, 13 nt, Homo sapiens
aaaaugugacuca

SEQ ID NO: 1010381 - RNA, 21 nt, Homo sapiens
aaaauuaagaaauucacuucc

SEQ ID NO: 1010382 - RNA, 14 nt, Homo sapiens
aaacaaucuuguca

SEQ ID NO: 1010383 - RNA, 13 nt, Homo sapiens
aaacaucauuuca

SEQ ID NO: 1010384 - RNA, 18 nt, Homo sapiens
aaaccugaugcuggggac

SEQ ID NO: 1010385 - RNA, 14 nt, Homo sapiens
aaagaacuuggaaa

SEQ ID NO: 1010386 - RNA, 9 nt, Homo sapiens
aaagacaga

SEQ ID NO: 1010387 - RNA, 21 nt, Homo sapiens
aaagcccuuaaaaauaugugu

SEQ ID NO: 1010388 - RNA, 21 nt, Homo sapiens
aaagcuagaaaguguaugugu

SEQ ID NO: 1010389 - RNA, 20 nt, Homo sapiens
aaagcuggagucugucaaug

SEQ ID NO: 1010390 - RNA, 21 nt, Homo sapiens
aaaucuuuuuuguucaaagau

SEQ ID NO: 1010391 - RNA, 13 nt, Homo sapiens
aaaugaaagugag

SEQ ID NO: 1010392 - RNA, 20 nt, Homo sapiens
aaaugagaagucucacugau

SEQ ID NO: 1010393 - RNA, 23 nt, Homo sapiens
aaauuuucuuuuuauacuauuaa

SEQ ID NO: 1010394 - RNA, 23 nt, Homo sapiens
aacaguaguugcaauguuuuaga

SEQ ID NO: 1010395 - RNA, 15 nt, Homo sapiens
aacauugcaauagaa

SEQ ID NO: 1010396 - RNA, 19 nt, Homo sapiens
aaccaaauauuccagagac

SEQ ID NO: 1010397 - RNA, 18 nt, Homo sapiens
aaccucgagguuucucaa

SEQ ID NO: 1010398 - RNA, 15 nt, Homo sapiens
aacugaacauuccag

SEQ ID NO: 1010399 - RNA, 21 nt, Homo sapiens
aacuucaacguaagacugugu

SEQ ID NO: 1010400 - RNA, 12 nt, Homo sapiens
aacuucugccuc

SEQ ID NO: 1010401 - RNA, 22 nt, Homo sapiens
aagaaaaguuuuguaaauuucu

SEQ ID NO: 1010402 - RNA, 21 nt, Homo sapiens
aagaauuuuuauauccacuaa

SEQ ID NO: 1010403 - RNA, 22 nt, Homo sapiens
aagaugaaugagcaaaaccaaa

SEQ ID NO: 1010404 - RNA, 16 nt, Homo sapiens
aagcagguucuuguua

SEQ ID NO: 1010405 - RNA, 17 nt, Homo sapiens
aagcuggagucugucaa

SEQ ID NO: 1010406 - RNA, 16 nt, Homo sapiens
aagguugagggcaaug

SEQ ID NO: 1010407 - RNA, 12 nt, Homo sapiens
aaguaagccaug

SEQ ID NO: 1010408 - RNA, 16 nt, Homo sapiens
aaguccacaguggaac

SEQ ID NO: 1010409 - RNA, 17 nt, Homo sapiens
aauaaccauugucauaa

SEQ ID NO: 1010410 - RNA, 13 nt, Homo sapiens
aauagccauaaag

SEQ ID NO: 1010411 - RNA, 22 nt, Homo sapiens
aaucaguguuuccaaucugucc

SEQ ID NO: 1010412 - RNA, 23 nt, Homo sapiens
aaucaguguuuccaaucuguccu

SEQ ID NO: 1010413 - RNA, 16 nt, Homo sapiens
aaucucuccauucccg

SEQ ID NO: 1010414 - RNA, 12 nt, Homo sapiens
aaugaaagugag

SEQ ID NO: 1010415 - RNA, 15 nt, Homo sapiens
aaugugacucaagac

SEQ ID NO: 1010416 - RNA, 21 nt, Homo sapiens
aauguuuuagaaugagacuua

SEQ ID NO: 1010417 - RNA, 19 nt, Homo sapiens
aauucugaauuaagcacag

SEQ ID NO: 1010418 - RNA, 18 nt, Homo sapiens
aauugggaauaugcacaa

SEQ ID NO: 1010419 - RNA, 15 nt, Homo sapiens
acaauauacuuguau

SEQ ID NO: 1010420 - RNA, 14 nt, Homo sapiens
acaaucugaaacag

SEQ ID NO: 1010421 - RNA, 15 nt, Homo sapiens
acaaucuugucauac

SEQ ID NO: 1010422 - RNA, 19 nt, Homo sapiens
acacagucuuggcucacug

SEQ ID NO: 1010423 - RNA, 14 nt, Homo sapiens
acagcaucagcuca

SEQ ID NO: 1010424 - RNA, 22 nt, Homo sapiens
acagucuuguauuaaguuguua

SEQ ID NO: 1010425 - RNA, 14 nt, Homo sapiens
acauuuuguauauu

SEQ ID NO: 1010426 - RNA, 20 nt, Homo sapiens
accaaauacuuuaauguaua

SEQ ID NO: 1010427 - RNA, 23 nt, Homo sapiens
accagagaagggcuuggacucaa

SEQ ID NO: 1010428 - RNA, 13 nt, Homo sapiens
accaggucucaua

SEQ ID NO: 1010429 - RNA, 11 nt, Homo sapiens
acccucccacu

SEQ ID NO: 1010430 - RNA, 14 nt, Homo sapiens
accguacacugugu

SEQ ID NO: 1010431 - RNA, 21 nt, Homo sapiens
accuaaauaugagcccagaaa

SEQ ID NO: 1010432 - RNA, 13 nt, Homo sapiens
accuacaguguac

SEQ ID NO: 1010433 - RNA, 18 nt, Homo sapiens
acgugauuuugcuguaga

SEQ ID NO: 1010434 - RNA, 18 nt, Homo sapiens
acugccaaagaacuugga

SEQ ID NO: 1010435 - RNA, 21 nt, Homo sapiens
acuguuuugguuuugcucaca

SEQ ID NO: 1010436 - RNA, 12 nt, Homo sapiens
agaaagugaucc

SEQ ID NO: 1010437 - RNA, 15 nt, Homo sapiens
agaaagugauccaua

SEQ ID NO: 1010438 - RNA, 15 nt, Homo sapiens
agaaauccaauugga

SEQ ID NO: 1010439 - RNA, 19 nt, Homo sapiens
agaaguaaauauagcucag

SEQ ID NO: 1010440 - RNA, 22 nt, Homo sapiens
agacagcacagccaaccuagcu

SEQ ID NO: 1010441 - RNA, 22 nt, Homo sapiens
agagagaaaaguaacuguuuug

SEQ ID NO: 1010442 - RNA, 22 nt, Homo sapiens
agauacacaaucugaaacagcu

SEQ ID NO: 1010443 - RNA, 19 nt, Homo sapiens
agaugaaacaucauuucaa

SEQ ID NO: 1010444 - RNA, 22 nt, Homo sapiens
agauucuaauggcuuuauugca

SEQ ID NO: 1010445 - RNA, 17 nt, Homo sapiens
agauuucagauuuguga

SEQ ID NO: 1010446 - RNA, 19 nt, Homo sapiens
agcaccuacaguguacagu

SEQ ID NO: 1010447 - RNA, 21 nt, Homo sapiens
agccaaccuagcuagcaacau

SEQ ID NO: 1010448 - RNA, 23 nt, Homo sapiens
agccaccgcgcccagccucaucu

SEQ ID NO: 1010449 - RNA, 15 nt, Homo sapiens
agccauguaucucag

SEQ ID NO: 1010450 - RNA, 17 nt, Homo sapiens
agccccagccuaggaaa

SEQ ID NO: 1010451 - RNA, 15 nt, Homo sapiens
agcgauuaauaacag

SEQ ID NO: 1010452 - RNA, 18 nt, Homo sapiens
agcuggagucugucaaug

SEQ ID NO: 1010453 - RNA, 20 nt, Homo sapiens
agcuguuuaugcauagauaa

SEQ ID NO: 1010454 - RNA, 16 nt, Homo sapiens
agcuguuuuguugaca

SEQ ID NO: 1010455 - RNA, 21 nt, Homo sapiens
aggacacuagaagauuuugaa

SEQ ID NO: 1010456 - RNA, 19 nt, Homo sapiens
aggauuugggcucuuggaa

SEQ ID NO: 1010457 - RNA, 19 nt, Homo sapiens
aggcugugccaucagcucc

SEQ ID NO: 1010458 - RNA, 13 nt, Homo sapiens
agguugagggcaa

SEQ ID NO: 1010459 - RNA, 13 nt, Homo sapiens
agucuucuuccau

SEQ ID NO: 1010460 - RNA, 23 nt, Homo sapiens
agucuuguuguuuucccaaagag

SEQ ID NO: 1010461 - RNA, 19 nt, Homo sapiens
agugauucuccugccucag

SEQ ID NO: 1010462 - RNA, 20 nt, Homo sapiens
agugcaguuuuuuucuuguc

SEQ ID NO: 1010463 - RNA, 11 nt, Homo sapiens
aguugcacaaa

SEQ ID NO: 1010464 - RNA, 15 nt, Homo sapiens
aguuguuaauaaaag

SEQ ID NO: 1010465 - RNA, 15 nt, Homo sapiens
auaaagacaggguuu

SEQ ID NO: 1010466 - RNA, 21 nt, Homo sapiens
auagagguucuuuauugcuca

SEQ ID NO: 1010467 - RNA, 18 nt, Homo sapiens
auaggaggccaacccaaa

SEQ ID NO: 1010468 - RNA, 17 nt, Homo sapiens
auaugacacucuaguca

SEQ ID NO: 1010469 - RNA, 18 nt, Homo sapiens
auauguauaucacauucc

SEQ ID NO: 1010470 - RNA, 20 nt, Homo sapiens
aucugcuagggaauaucaau

SEQ ID NO: 1010471 - RNA, 15 nt, Homo sapiens
aucuguccuguuaca

SEQ ID NO: 1010472 - RNA, 13 nt, Homo sapiens
augaaacaucauu

SEQ ID NO: 1010473 - RNA, 15 nt, Homo sapiens
augaauaguuuccaa

SEQ ID NO: 1010474 - RNA, 21 nt, Homo sapiens
augacacucuagucaaagccu

SEQ ID NO: 1010475 - RNA, 16 nt, Homo sapiens
augagggaacugugua

SEQ ID NO: 1010476 - RNA, 16 nt, Homo sapiens
auggcaggacagcucc

SEQ ID NO: 1010477 - RNA, 12 nt, Homo sapiens
auguaucucagg

SEQ ID NO: 1010478 - RNA, 19 nt, Homo sapiens
augugacucaagacuucca

SEQ ID NO: 1010479 - RNA, 19 nt, Homo sapiens
auuaucuaaaaucugcuag

SEQ ID NO: 1010480 - RNA, 20 nt, Homo sapiens
auuccacaaccugguuugcc

SEQ ID NO: 1010481 - RNA, 15 nt, Homo sapiens
auucuccugccucag

SEQ ID NO: 1010482 - RNA, 21 nt, Homo sapiens
auucucuagucaguuggcuaa

SEQ ID NO: 1010483 - RNA, 17 nt, Homo sapiens
auuugucaacaaaguca

SEQ ID NO: 1010484 - RNA, 17 nt, Homo sapiens
auuuucuuuuuauacua

SEQ ID NO: 1010485 - RNA, 22 nt, Homo sapiens
cuccuuggcuucuuuacuuagu

SEQ ID NO: 1010486 - RNA, 18 nt, Homo sapiens
cucuaacaguaguugcaa

SEQ ID NO: 1010487 - RNA, 21 nt, Homo sapiens
cucugauguagcuuauacaaa

SEQ ID NO: 1010488 - RNA, 19 nt, Homo sapiens
cucuggccuccaaguccac

SEQ ID NO: 1010489 - RNA, 19 nt, Homo sapiens
cugaguagcuggauuacag

SEQ ID NO: 1010490 - RNA, 21 nt, Homo sapiens
cugaugcuggggacacagcau

SEQ ID NO: 1010491 - RNA, 16 nt, Homo sapiens
cugcuucugauaugca

SEQ ID NO: 1010492 - RNA, 15 nt, Homo sapiens
cuggagucugucaau

SEQ ID NO: 1010493 - RNA, 17 nt, Homo sapiens
cuggccuccaaguccac

SEQ ID NO: 1010494 - RNA, 19 nt, Homo sapiens
cugggacuaaguguaccag

SEQ ID NO: 1010495 - RNA, 20 nt, Homo sapiens
cugucaauguccuacugaga

SEQ ID NO: 1010496 - RNA, 22 nt, Homo sapiens
cugucaauguccuacugagaca

SEQ ID NO: 1010497 - RNA, 14 nt, Homo sapiens
cuuaaaauagccau

SEQ ID NO: 1010498 - RNA, 15 nt, Homo sapiens
cuuacuuaguguuau

SEQ ID NO: 1010499 - RNA, 14 nt, Homo sapiens
cuuagaaagucuga

SEQ ID NO: 1010500 - RNA, 17 nt, Homo sapiens
cuuagccaagcaguuuc

SEQ ID NO: 1010501 - RNA, 14 nt, Homo sapiens
cuuccaucaccucc

SEQ ID NO: 1010502 - RNA, 19 nt, Homo sapiens
cuuccuggaggugacacuu

SEQ ID NO: 1010503 - RNA, 13 nt, Homo sapiens
cuucuccuuagaa

SEQ ID NO: 1010504 - RNA, 16 nt, Homo sapiens
cuucuuuuugcuucaa

SEQ ID NO: 1010505 - RNA, 17 nt, Homo sapiens
cuucuuuuuguucuuca

SEQ ID NO: 1010506 - RNA, 17 nt, Homo sapiens
cuuggguucaagugauu

SEQ ID NO: 1010507 - RNA, 16 nt, Homo sapiens
cuugguaaaauaauca

SEQ ID NO: 1010508 - RNA, 24 nt, Homo sapiens
cuugguaaaauaaucaguguuucc

SEQ ID NO: 1010509 - RNA, 21 nt, Homo sapiens
cuuguuagugcacagcacaaa

SEQ ID NO: 1010510 - RNA, 22 nt, Homo sapiens
cuuguuagugcacagcacaaau

SEQ ID NO: 1010511 - RNA, 20 nt, Homo sapiens
cuuguuguuuucccaaagag

SEQ ID NO: 1010512 - RNA, 19 nt, Homo sapiens
cuuuaauuuuuuacuauuu

SEQ ID NO: 1010513 - RNA, 21 nt, Homo sapiens
cuuuguaaagaaaguggcuug

SEQ ID NO: 1010514 - RNA, 11 nt, Homo sapiens
gaaaacagaaa

SEQ ID NO: 1010515 - RNA, 22 nt, Homo sapiens
gaaaagaaucggcaauguuuca

SEQ ID NO: 1010516 - RNA, 23 nt, Homo sapiens
gaaaagaaucggcaauguuucaa

SEQ ID NO: 1010517 - RNA, 17 nt, Homo sapiens
gaaaagggaacugaaca

SEQ ID NO: 1010518 - RNA, 15 nt, Homo sapiens
gaaaaguaacuguuu

SEQ ID NO: 1010519 - RNA, 18 nt, Homo sapiens
gaaccaggccagagcaaa

SEQ ID NO: 1010520 - RNA, 17 nt, Homo sapiens
gaacuccuuggcuucuu

SEQ ID NO: 1010521 - RNA, 12 nt, Homo sapiens
gaaucucucuuc

SEQ ID NO: 1010522 - RNA, 15 nt, Homo sapiens
gaauguaaugguggc

SEQ ID NO: 1010523 - RNA, 13 nt, Homo sapiens
gaauuaagcacag

SEQ ID NO: 1010524 - RNA, 16 nt, Homo sapiens
gacacagcaucagcuc

SEQ ID NO: 1010525 - RNA, 21 nt, Homo sapiens
gacagcacagccaaccuagcu

SEQ ID NO: 1010526 - RNA, 21 nt, Homo sapiens
gaccaauauuguacaguuuuu

SEQ ID NO: 1010527 - RNA, 15 nt, Homo sapiens
gaccauuagcauuug

SEQ ID NO: 1010528 - RNA, 17 nt, Homo sapiens
gacgugauuuugcugua

SEQ ID NO: 1010529 - RNA, 19 nt, Homo sapiens
gacuaaguguaccagagaa

SEQ ID NO: 1010530 - RNA, 15 nt, Homo sapiens
gacucaucauuucca

SEQ ID NO: 1010531 - RNA, 13 nt, Homo sapiens
gacucuaacagua

SEQ ID NO: 1010532 - RNA, 17 nt, Homo sapiens
gacucuuggcacagcau

SEQ ID NO: 1010533 - RNA, 12 nt, Homo sapiens
gaguagcuggau

SEQ ID NO: 1010534 - RNA, 21 nt, Homo sapiens
gaguucauggauauguuauac

SEQ ID NO: 1010535 - RNA, 21 nt, Homo sapiens
gauacacaaucugaaacagcu

SEQ ID NO: 1010536 - RNA, 13 nt, Homo sapiens
gauaugcuguauu

SEQ ID NO: 1010537 - RNA, 17 nt, Homo sapiens
gauuugggcucuuggaa

SEQ ID NO: 1010538 - RNA, 13 nt, Homo sapiens
gcaaaaccaaaua

SEQ ID NO: 1010539 - RNA, 17 nt, Homo sapiens
gcaauggacaaggaagg

SEQ ID NO: 1010540 - RNA, 20 nt, Homo sapiens
gcagaugguggagcugaaua

SEQ ID NO: 1010541 - RNA, 16 nt, Homo sapiens
gcauuugucaacaaag

SEQ ID NO: 1010542 - RNA, 12 nt, Homo sapiens
gccaagcaguuu

SEQ ID NO: 1010543 - RNA, 20 nt, Homo sapiens
gccacucuguaauugcaaaa

SEQ ID NO: 1010544 - RNA, 16 nt, Homo sapiens
gccacuguuaagccau

SEQ ID NO: 1010545 - RNA, 18 nt, Homo sapiens
gccagagcaaacagaaaa

SEQ ID NO: 1010546 - RNA, 22 nt, Homo sapiens
gcccagacccuucuccuuagaa

SEQ ID NO: 1010547 - RNA, 20 nt, Homo sapiens
gcccaggcuggagugcaaug

SEQ ID NO: 1010548 - RNA, 22 nt, Homo sapiens
gccggggaaggaggccguccau

SEQ ID NO: 1010549 - RNA, 20 nt, Homo sapiens
gccuccaaguccacagugga

SEQ ID NO: 1010550 - RNA, 23 nt, Homo sapiens
gccuuccuggaggugacacuuga

SEQ ID NO: 1010551 - RNA, 22 nt, Homo sapiens
gcgcaguuggucuuuaaccacu

SEQ ID NO: 1010552 - RNA, 18 nt, Homo sapiens
gcgcccagccucaucucu

SEQ ID NO: 1010553 - RNA, 16 nt, Homo sapiens
gcuaguaaaagccauc

SEQ ID NO: 1010554 - RNA, 20 nt, Homo sapiens
gcuuagcuaauauugcaaug

SEQ ID NO: 1010555 - RNA, 19 nt, Homo sapiens
gcuucuuaaaauagccaua

SEQ ID NO: 1010556 - RNA, 13 nt, Homo sapiens
gcuucuuuacuua

SEQ ID NO: 1010557 - RNA, 21 nt, Homo sapiens
ggaauccuggggaacauagaa

SEQ ID NO: 1010558 - RNA, 20 nt, Homo sapiens
ggacuaaguguaccagagaa

SEQ ID NO: 1010559 - RNA, 11 nt, Homo sapiens
ggcucaucucu

SEQ ID NO: 1010560 - RNA, 20 nt, Homo sapiens
ggcuggagugcaaugacaca

SEQ ID NO: 1010561 - RNA, 13 nt, Homo sapiens
gggagacacugau

SEQ ID NO: 1010562 - RNA, 13 nt, Homo sapiens
ggguaaauucucu

SEQ ID NO: 1010563 - RNA, 21 nt, Homo sapiens
gguaaaauaaucaguguuucc

SEQ ID NO: 1010564 - RNA, 15 nt, Homo sapiens
gguccaaggucucca

SEQ ID NO: 1010565 - RNA, 22 nt, Homo sapiens
guaaaauaaucaguguuuccaa

SEQ ID NO: 1010566 - RNA, 20 nt, Homo sapiens
guagaaagugauccauacuu

SEQ ID NO: 1010567 - RNA, 21 nt, Homo sapiens
guauaaauauguauuuuguca

SEQ ID NO: 1010568 - RNA, 20 nt, Homo sapiens
guauauucaaccaaauacuu

SEQ ID NO: 1010569 - RNA, 18 nt, Homo sapiens
cagaaagcuagaaagugu

SEQ ID NO: 1010570 - RNA, 21 nt, Homo sapiens
cagagaagggcuuggacucaa

SEQ ID NO: 1010571 - RNA, 20 nt, Homo sapiens
cagagcagagaggcugaaua

SEQ ID NO: 1010572 - RNA, 15 nt, Homo sapiens
cagagccucaaauga

SEQ ID NO: 1010573 - RNA, 13 nt, Homo sapiens
cagccucaucucu

SEQ ID NO: 1010574 - RNA, 13 nt, Homo sapiens
cagcuguuuaugc

SEQ ID NO: 1010575 - RNA, 20 nt, Homo sapiens
cagcuguuuaugcauagaua

SEQ ID NO: 1010576 - RNA, 23 nt, Homo sapiens
caggcgugaccugccaggcacac

SEQ ID NO: 1010577 - RNA, 16 nt, Homo sapiens
caggcuggagugcaau

SEQ ID NO: 1010578 - RNA, 18 nt, Homo sapiens
cagggagugggcuaagca

SEQ ID NO: 1010579 - RNA, 21 nt, Homo sapiens
cagguucugacucuuggcaca

SEQ ID NO: 1010580 - RNA, 14 nt, Homo sapiens
caguguacagucuu

SEQ ID NO: 1010581 - RNA, 12 nt, Homo sapiens
caguguuuccaa

SEQ ID NO: 1010582 - RNA, 23 nt, Homo sapiens
caguugcagcuguuuuguugaca

SEQ ID NO: 1010583 - RNA, 20 nt, Homo sapiens
cauaaaaguuggcucaggag

SEQ ID NO: 1010584 - RNA, 19 nt, Homo sapiens
cauaaugcauguggcacuu

SEQ ID NO: 1010585 - RNA, 18 nt, Homo sapiens
cauauugaugugugucua

SEQ ID NO: 1010586 - RNA, 19 nt, Homo sapiens
cauggauauguuauacuga

SEQ ID NO: 1010587 - RNA, 23 nt, Homo sapiens
cauggauauguuauacugaacca

SEQ ID NO: 1010588 - RNA, 13 nt, Homo sapiens
cauuuacauugcc

SEQ ID NO: 1010589 - RNA, 14 nt, Homo sapiens
cauuugucaacaaa

SEQ ID NO: 1010590 - RNA, 13 nt, Homo sapiens
cauuuguuuucac

SEQ ID NO: 1010591 - RNA, 18 nt, Homo sapiens
ccaaagaaacauugccuu

SEQ ID NO: 1010592 - RNA, 11 nt, Homo sapiens
ccaaggucucc

SEQ ID NO: 1010593 - RNA, 18 nt, Homo sapiens
ccacccucccacugccaa

SEQ ID NO: 1010594 - RNA, 11 nt, Homo sapiens
ccacucagguc

SEQ ID NO: 1010595 - RNA, 15 nt, Homo sapiens
ccacugccaaagaac

SEQ ID NO: 1010596 - RNA, 21 nt, Homo sapiens
ccacugccaaagaacuuggaa

SEQ ID NO: 1010597 - RNA, 23 nt, Homo sapiens
ccacuguuaagccauguguucca

SEQ ID NO: 1010598 - RNA, 17 nt, Homo sapiens
ccagagccucaaaugag

SEQ ID NO: 1010599 - RNA, 18 nt, Homo sapiens
ccagagcguguagugaau

SEQ ID NO: 1010600 - RNA, 14 nt, Homo sapiens
ccagccucaucucu

SEQ ID NO: 1010601 - RNA, 13 nt, Homo sapiens
ccaggggagaccc

SEQ ID NO: 1010602 - RNA, 21 nt, Homo sapiens
ccauaaaggggagggacucau

SEQ ID NO: 1010603 - RNA, 15 nt, Homo sapiens
cccacccaacuaauu

SEQ ID NO: 1010604 - RNA, 20 nt, Homo sapiens
cccaggcuggagugcaauga

SEQ ID NO: 1010605 - RNA, 22 nt, Homo sapiens
cccucccacugccaaagaacuu

SEQ ID NO: 1010606 - RNA, 16 nt, Homo sapiens
cccuucuuuucugacu

SEQ ID NO: 1010607 - RNA, 18 nt, Homo sapiens
ccgacugccaucuuggac

SEQ ID NO: 1010608 - RNA, 19 nt, Homo sapiens
ccucaucuccuaaaaggca

SEQ ID NO: 1010609 - RNA, 21 nt, Homo sapiens
ccugaugcuggggacacagca

SEQ ID NO: 1010610 - RNA, 15 nt, Homo sapiens
ccugccaggcacacu

SEQ ID NO: 1010611 - RNA, 15 nt, Homo sapiens
ccuuagaaguggaag

SEQ ID NO: 1010612 - RNA, 22 nt, Homo sapiens
cgaauauaucaguaauuucaga

SEQ ID NO: 1010613 - RNA, 18 nt, Homo sapiens
cgugaccugccaggcaca

SEQ ID NO: 1010614 - RNA, 17 nt, Homo sapiens
cuaaguguaccagagaa

SEQ ID NO: 1010615 - RNA, 17 nt, Homo sapiens
cuagaguucauggauau

SEQ ID NO: 1010616 - RNA, 19 nt, Homo sapiens
cuagcaacauuuguuuuag

SEQ ID NO: 1010617 - RNA, 15 nt, Homo sapiens
cuaguaaaagccauc

SEQ ID NO: 1010618 - RNA, 15 nt, Homo sapiens
cuagucaguuggcua

SEQ ID NO: 1010619 - RNA, 23 nt, Homo sapiens
cuagugcaguuuuuuucuugucu

SEQ ID NO: 1010620 - RNA, 17 nt, Homo sapiens
cucaaagaaauuuccac

SEQ ID NO: 1010621 - RNA, 10 nt, Homo sapiens
cucacaaaag

SEQ ID NO: 1010622 - RNA, 17 nt, Homo sapiens
cuccccuucacucccac

SEQ ID NO: 1010623 - RNA, 20 nt, Homo sapiens
cuccugaccucaaguaaucc

SEQ ID NO: 1010624 - RNA, 13 nt, Homo sapiens
aaaaacauucuua

SEQ ID NO: 1010625 - RNA, 15 nt, Homo sapiens
aaaacaaucuuguca

SEQ ID NO: 1010626 - RNA, 15 nt, Homo sapiens
aaaaguuuuguaaau

SEQ ID NO: 1010627 - RNA, 20 nt, Homo sapiens
aaaauaaucaguguuuccaa

SEQ ID NO: 1010628 - RNA, 14 nt, Homo sapiens
aaacaucauuucaa

SEQ ID NO: 1010629 - RNA, 22 nt, Homo sapiens
aaacccaguaguggugacugug

SEQ ID NO: 1010630 - RNA, 18 nt, Homo sapiens
aaagacaggguuucacca

SEQ ID NO: 1010631 - RNA, 22 nt, Homo sapiens
aaagccaaucucaaucccucaa

SEQ ID NO: 1010632 - RNA, 16 nt, Homo sapiens
aaagggagaagaggga

SEQ ID NO: 1010633 - RNA, 18 nt, Homo sapiens
aaagucuacuuuaccuaa

SEQ ID NO: 1010634 - RNA, 16 nt, Homo sapiens
aaaugcugguuuuuca

SEQ ID NO: 1010635 - RNA, 23 nt, Homo sapiens
aaaugcugguuuuucaguuuuca

SEQ ID NO: 1010636 - RNA, 18 nt, Homo sapiens
aacaggaauucugaauua

SEQ ID NO: 1010637 - RNA, 20 nt, Homo sapiens
aaccaaauacuuuaauguau

SEQ ID NO: 1010638 - RNA, 22 nt, Homo sapiens
aaccguaugagggaacugugua

SEQ ID NO: 1010639 - RNA, 19 nt, Homo sapiens
aacugaaugccacucugua

SEQ ID NO: 1010640 - RNA, 15 nt, Homo sapiens
aagaauguuuaugaa

SEQ ID NO: 1010641 - RNA, 16 nt, Homo sapiens
aagaauguuuaugaau

SEQ ID NO: 1010642 - RNA, 23 nt, Homo sapiens
aagacgucacccuccauucugca

SEQ ID NO: 1010643 - RNA, 20 nt, Homo sapiens
aagauggcacuuauaaccaa

SEQ ID NO: 1010644 - RNA, 21 nt, Homo sapiens
aagauuucagauuugugacca

SEQ ID NO: 1010645 - RNA, 22 nt, Homo sapiens
aagccuugguaaaauaaucagu

SEQ ID NO: 1010646 - RNA, 18 nt, Homo sapiens
aaggacacuagaagauuu

SEQ ID NO: 1010647 - RNA, 22 nt, Homo sapiens
aaguaagccauguaucucagga

SEQ ID NO: 1010648 - RNA, 18 nt, Homo sapiens
aaguaauccaccugccuc

SEQ ID NO: 1010649 - RNA, 14 nt, Homo sapiens
aauagugauuucca

SEQ ID NO: 1010650 - RNA, 13 nt, Homo sapiens
aauauaucaguaa

SEQ ID NO: 1010651 - RNA, 24 nt, Homo sapiens
aaucccucaaaacaaucuugucau

SEQ ID NO: 1010652 - RNA, 14 nt, Homo sapiens
aaugagacuuacuu

SEQ ID NO: 1010653 - RNA, 23 nt, Homo sapiens
aaugagcaaaaccaaauauucca

SEQ ID NO: 1010654 - RNA, 16 nt, Homo sapiens
aaugccacucuguaau

SEQ ID NO: 1010655 - RNA, 21 nt, Homo sapiens
aaugcugguuuuucaguuuuc

SEQ ID NO: 1010656 - RNA, 21 nt, Homo sapiens
aauuuuauguuuaguugcaca

SEQ ID NO: 1010657 - RNA, 23 nt, Homo sapiens
aauuuuauguuuaguugcacaaa

SEQ ID NO: 1010658 - RNA, 16 nt, Homo sapiens
acaagaacacugaaaa

SEQ ID NO: 1010659 - RNA, 12 nt, Homo sapiens
acaaucuuguca

SEQ ID NO: 1010660 - RNA, 18 nt, Homo sapiens
acacaaucugaaacagcu

SEQ ID NO: 1010661 - RNA, 12 nt, Homo sapiens
acacagcaucag

SEQ ID NO: 1010662 - RNA, 15 nt, Homo sapiens
acacagcaucagcuc

SEQ ID NO: 1010663 - RNA, 22 nt, Homo sapiens
acagcauggagucacagccacu

SEQ ID NO: 1010664 - RNA, 15 nt, Homo sapiens
acaguaguugcaaug

SEQ ID NO: 1010665 - RNA, 19 nt, Homo sapiens
acauuuguuguucuguuaa

SEQ ID NO: 1010666 - RNA, 22 nt, Homo sapiens
acauuuguuuuagucugaacaa

SEQ ID NO: 1010667 - RNA, 19 nt, Homo sapiens
accaaauacuuuaauguau

SEQ ID NO: 1010668 - RNA, 13 nt, Homo sapiens
accaauauuguac

SEQ ID NO: 1010669 - RNA, 20 nt, Homo sapiens
accaauauuguacaguuuuu

SEQ ID NO: 1010670 - RNA, 19 nt, Homo sapiens
accgcaggauuugggcucu

SEQ ID NO: 1010671 - RNA, 18 nt, Homo sapiens
accuaaauaugagcccag

SEQ ID NO: 1010672 - RNA, 19 nt, Homo sapiens
accuguggccaaguucuua

SEQ ID NO: 1010673 - RNA, 21 nt, Homo sapiens
accuucaguugucucugaugu

SEQ ID NO: 1010674 - RNA, 14 nt, Homo sapiens
acuaagaagcagau

SEQ ID NO: 1010675 - RNA, 16 nt, Homo sapiens
acuauugcuugcacaa

SEQ ID NO: 1010676 - RNA, 18 nt, Homo sapiens
acugaauuuugucuuuau

SEQ ID NO: 1010677 - RNA, 12 nt, Homo sapiens
acugugggcucc

SEQ ID NO: 1010678 - RNA, 16 nt, Homo sapiens
acuuacuuaguguuau

SEQ ID NO: 1010679 - RNA, 14 nt, Homo sapiens
acuuauuuauauaa

SEQ ID NO: 1010680 - RNA, 22 nt, Homo sapiens
agaagauggcacuuauaaccaa

SEQ ID NO: 1010681 - RNA, 11 nt, Homo sapiens
agaaguggaag

SEQ ID NO: 1010682 - RNA, 19 nt, Homo sapiens
agacgugauuuugcuguag

SEQ ID NO: 1010683 - RNA, 13 nt, Homo sapiens
agagcuuuaccua

SEQ ID NO: 1010684 - RNA, 15 nt, Homo sapiens
agccagguucugacu

SEQ ID NO: 1010685 - RNA, 14 nt, Homo sapiens
agccaguuacauaa

SEQ ID NO: 1010686 - RNA, 19 nt, Homo sapiens
agccaugggagacacugau

SEQ ID NO: 1010687 - RNA, 18 nt, Homo sapiens
agcccuuaggaagaauuu

SEQ ID NO: 1010688 - RNA, 22 nt, Homo sapiens
agccuaggaaagccaguuacau

SEQ ID NO: 1010689 - RNA, 14 nt, Homo sapiens
agccucaucucuuu

SEQ ID NO: 1010690 - RNA, 21 nt, Homo sapiens
agcuagcaacauuuguuuuag

SEQ ID NO: 1010691 - RNA, 18 nt, Homo sapiens
agcucagguagcacuuua

SEQ ID NO: 1010692 - RNA, 15 nt, Homo sapiens
agcugccuguacaca

SEQ ID NO: 1010693 - RNA, 14 nt, Homo sapiens
agcuggagucuguc

SEQ ID NO: 1010694 - RNA, 17 nt, Homo sapiens
agcuggauuacaggcau

SEQ ID NO: 1010695 - RNA, 20 nt, Homo sapiens
agcuuacaagccagcuggag

SEQ ID NO: 1010696 - RNA, 13 nt, Homo sapiens
aggacuguagaaa

SEQ ID NO: 1010697 - RNA, 15 nt, Homo sapiens
agggagaagagggaa

SEQ ID NO: 1010698 - RNA, 18 nt, Homo sapiens
agggcaauggacaaggaa

SEQ ID NO: 1010699 - RNA, 14 nt, Homo sapiens
aggguaaauucucu

SEQ ID NO: 1010700 - RNA, 16 nt, Homo sapiens
aguagcuggauuacag

SEQ ID NO: 1010701 - RNA, 16 nt, Homo sapiens
agucugauuguagcua

SEQ ID NO: 1010702 - RNA, 17 nt, Homo sapiens
agucuuagagcuuuacc

SEQ ID NO: 1010703 - RNA, 19 nt, Homo sapiens
agucuuagagcuuuaccua

SEQ ID NO: 1010704 - RNA, 16 nt, Homo sapiens
agucuuguauuaaguu

SEQ ID NO: 1010705 - RNA, 24 nt, Homo sapiens
agugagacuuugaggguguauauu

SEQ ID NO: 1010706 - RNA, 17 nt, Homo sapiens
agugagcuccuaagcca

SEQ ID NO: 1010707 - RNA, 15 nt, Homo sapiens
aguucauggauaugu

SEQ ID NO: 1010708 - RNA, 15 nt, Homo sapiens
aguuccgacugccau

SEQ ID NO: 1010709 - RNA, 22 nt, Homo sapiens
aguuccgacugccaucuuggac

SEQ ID NO: 1010710 - RNA, 11 nt, Homo sapiens
aguugcuguau

SEQ ID NO: 1010711 - RNA, 19 nt, Homo sapiens
aguuuacauuuuguauauu

SEQ ID NO: 1010712 - RNA, 20 nt, Homo sapiens
aguuuccaaauuauggcaaa

SEQ ID NO: 1010713 - RNA, 11 nt, Homo sapiens
auaguuuccaa

SEQ ID NO: 1010714 - RNA, 13 nt, Homo sapiens
auauacuuauaga

SEQ ID NO: 1010715 - RNA, 23 nt, Homo sapiens
auauacuuauagaauucagucaa

SEQ ID NO: 1010716 - RNA, 11 nt, Homo sapiens
auaugcacaaa

SEQ ID NO: 1010717 - RNA, 18 nt, Homo sapiens
aucacauucccauuugcu

SEQ ID NO: 1010718 - RNA, 14 nt, Homo sapiens
aucaguguuuccaa

SEQ ID NO: 1010719 - RNA, 17 nt, Homo sapiens
aucccgucgacguagaa

SEQ ID NO: 1010720 - RNA, 15 nt, Homo sapiens
aucuaaaaucugcua

SEQ ID NO: 1010721 - RNA, 21 nt, Homo sapiens
aucugccuccccuucacuccc

SEQ ID NO: 1010722 - RNA, 18 nt, Homo sapiens
augcuggggacacagcau

SEQ ID NO: 1010723 - RNA, 15 nt, Homo sapiens
augggagacacugau

SEQ ID NO: 1010724 - RNA, 18 nt, Homo sapiens
auguaagaucguucucug

SEQ ID NO: 1010725 - RNA, 17 nt, Homo sapiens
auguagaaagugaucca

SEQ ID NO: 1010726 - RNA, 13 nt, Homo sapiens
auguguuccaagg

SEQ ID NO: 1010727 - RNA, 17 nt, Homo sapiens
auucagggagugggcua

SEQ ID NO: 1010728 - RNA, 16 nt, Homo sapiens
auuuuaauguuuccuu

SEQ ID NO: 1010729 - RNA, 17 nt, Homo sapiens
caaacuccugaccucaa

SEQ ID NO: 1010730 - RNA, 19 nt, Homo sapiens
caaagugcugggauuacag

SEQ ID NO: 1010731 - RNA, 16 nt, Homo sapiens
caaauauuccagagac

SEQ ID NO: 1010732 - RNA, 13 nt, Homo sapiens
caacuguggcuua

SEQ ID NO: 1010733 - RNA, 21 nt, Homo sapiens
caaguucuuaguugcuguaug

SEQ ID NO: 1010734 - RNA, 19 nt, Homo sapiens
caauauauacuuauagaau

SEQ ID NO: 1010735 - RNA, 16 nt, Homo sapiens
caauauuguacaguuu

SEQ ID NO: 1010736 - RNA, 23 nt, Homo sapiens
caaucaguagccagcaucugccu

SEQ ID NO: 1010737 - RNA, 13 nt, Homo sapiens
caaucguaaaauu

SEQ ID NO: 1010738 - RNA, 19 nt, Homo sapiens
caaucucaaucccucaaaa

SEQ ID NO: 1010739 - RNA, 21 nt, Homo sapiens
caaucugaaacagcuucaugg

SEQ ID NO: 1010740 - RNA, 19 nt, Homo sapiens
caauguuucaaacaaaaag

SEQ ID NO: 1010741 - RNA, 17 nt, Homo sapiens
cacaaaagucuacuuua

SEQ ID NO: 1010742 - RNA, 19 nt, Homo sapiens
cacagcaucagcucaagac

SEQ ID NO: 1010743 - RNA, 16 nt, Homo sapiens
cacagccaaccuagcu

SEQ ID NO: 1010744 - RNA, 17 nt, Homo sapiens
cacauuuuucagauaua

SEQ ID NO: 1010745 - RNA, 19 nt, Homo sapiens
caccaacuauagaauguau

SEQ ID NO: 1010746 - RNA, 21 nt, Homo sapiens
cacugccaaagaacuuggaaa

SEQ ID NO: 1010747 - RNA, 19 nt, Homo sapiens
cacuguguuuuuuuguaua

SEQ ID NO: 1010748 - RNA, 13 nt, Homo sapiens
cagagacugggac

SEQ ID NO: 1010749 - RNA, 13 nt, Homo sapiens
cagagcaaacaga

SEQ ID NO: 1010750 - RNA, 20 nt, Homo sapiens
cagagucucgcucuguugcc

SEQ ID NO: 1010751 - RNA, 15 nt, Homo sapiens
cagcauggagucaca

SEQ ID NO: 1010752 - RNA, 17 nt, Homo sapiens
caguaguggugacugug

SEQ ID NO: 1010753 - RNA, 19 nt, Homo sapiens
caguaguggugacuguggg

SEQ ID NO: 1010754 - RNA, 14 nt, Homo sapiens
caguaguugcaaug

SEQ ID NO: 1010755 - RNA, 23 nt, Homo sapiens
cagucaaagauacacaaucugaa

SEQ ID NO: 1010756 - RNA, 22 nt, Homo sapiens
cagucuucuuccaugucuauua

SEQ ID NO: 1010757 - RNA, 14 nt, Homo sapiens
caguggaacuaaga

SEQ ID NO: 1010758 - RNA, 16 nt, Homo sapiens
cauaaaaguuggcuca

SEQ ID NO: 1010759 - RNA, 17 nt, Homo sapiens
cauacuagaguucaugg

SEQ ID NO: 1010760 - RNA, 13 nt, Homo sapiens
caucauuuccauu

SEQ ID NO: 1010761 - RNA, 18 nt, Homo sapiens
caucccgucgacguagaa

SEQ ID NO: 1010762 - RNA, 21 nt, Homo sapiens
cauucccguggaacguuuuuc

SEQ ID NO: 1010763 - RNA, 15 nt, Homo sapiens
ccaaagacauguuua

SEQ ID NO: 1010764 - RNA, 19 nt, Homo sapiens
ccaaagcccaaagugguau

SEQ ID NO: 1010765 - RNA, 20 nt, Homo sapiens
ccacagugacuccacucuga

SEQ ID NO: 1010766 - RNA, 14 nt, Homo sapiens
ccacaguggaacca

SEQ ID NO: 1010767 - RNA, 18 nt, Homo sapiens
ccaggcuggagugcaaug

SEQ ID NO: 1010768 - RNA, 23 nt, Homo sapiens
ccaguaguggugacugugggcuc

SEQ ID NO: 1010769 - RNA, 12 nt, Homo sapiens
ccaguuacauaa

SEQ ID NO: 1010770 - RNA, 22 nt, Homo sapiens
ccauaggaggccaacccaaaau

SEQ ID NO: 1010771 - RNA, 15 nt, Homo sapiens
ccauaugaauaacau

SEQ ID NO: 1010772 - RNA, 22 nt, Homo sapiens
cccgccacccucccacugccaa

SEQ ID NO: 1010773 - RNA, 21 nt, Homo sapiens
ccgccacccucccacugccaa

SEQ ID NO: 1010774 - RNA, 21 nt, Homo sapiens
ccuaaaaggcagaguacaaag

SEQ ID NO: 1010775 - RNA, 22 nt, Homo sapiens
ccucaaaugagaaaaugucuuu

SEQ ID NO: 1010776 - RNA, 13 nt, Homo sapiens
ccuccaaguccac

SEQ ID NO: 1010777 - RNA, 21 nt, Homo sapiens
ccuccaaguccacaguggaac

SEQ ID NO: 1010778 - RNA, 18 nt, Homo sapiens
ccucccacugccaaagaa

SEQ ID NO: 1010779 - RNA, 14 nt, Homo sapiens
ccuggggcuucuga

SEQ ID NO: 1010780 - RNA, 18 nt, Homo sapiens
ccuucuuuuuguucuuca

SEQ ID NO: 1010781 - RNA, 21 nt, Homo sapiens
ccuuggcuaguaaaagccauc

SEQ ID NO: 1010782 - RNA, 15 nt, Homo sapiens
ccuuugccugguaca

SEQ ID NO: 1010783 - RNA, 15 nt, Homo sapiens
cgacaacuugcacgu

SEQ ID NO: 1010784 - RNA, 23 nt, Homo sapiens
cgugaccugccaggcacacugag

SEQ ID NO: 1010785 - RNA, 19 nt, Homo sapiens
cgugauuuugcuguagaag

SEQ ID NO: 1010786 - RNA, 19 nt, Homo sapiens
cgugguaggacuguagaaa

SEQ ID NO: 1010787 - RNA, 13 nt, Homo sapiens
cuaaauaugagcc

SEQ ID NO: 1010788 - RNA, 17 nt, Homo sapiens
cuaagcacgggccauau

SEQ ID NO: 1010789 - RNA, 22 nt, Homo sapiens
cuagaguucauggauauguuau

SEQ ID NO: 1010790 - RNA, 20 nt, Homo sapiens
cuccccuguucauucugcau

SEQ ID NO: 1010791 - RNA, 15 nt, Homo sapiens
cuccuuagaagugga

SEQ ID NO: 1010792 - RNA, 19 nt, Homo sapiens
cucgagguuucucaaagaa

SEQ ID NO: 1010793 - RNA, 19 nt, Homo sapiens
cucgugguaggacuguaga

SEQ ID NO: 1010794 - RNA, 19 nt, Homo sapiens
cucuugaaaucuguuaaaa

SEQ ID NO: 1010795 - RNA, 20 nt, Homo sapiens
cugaacaauauauacuuaua

SEQ ID NO: 1010796 - RNA, 22 nt, Homo sapiens
cugagucccuuagccaagcagu

SEQ ID NO: 1010797 - RNA, 20 nt, Homo sapiens
cuggauuacaggcaugugcc

SEQ ID NO: 1010798 - RNA, 19 nt, Homo sapiens
cuggcaguggaacuaagaa

SEQ ID NO: 1010799 - RNA, 14 nt, Homo sapiens
cuggccuccaaguc

SEQ ID NO: 1010800 - RNA, 22 nt, Homo sapiens
cugggauuacagggaugagcca

SEQ ID NO: 1010801 - RNA, 16 nt, Homo sapiens
cugugccaucagcucc

SEQ ID NO: 1010802 - RNA, 22 nt, Homo sapiens
cuguuuugguuuugcucacaaa

SEQ ID NO: 1010803 - RNA, 23 nt, Homo sapiens
cuuagagcuuuaccuaaauauga

SEQ ID NO: 1010804 - RNA, 19 nt, Homo sapiens
cuuaugcaaauaaccauug

SEQ ID NO: 1010805 - RNA, 17 nt, Homo sapiens
cuucagucuuuuccaug

SEQ ID NO: 1010806 - RNA, 17 nt, Homo sapiens
cuucuaaguaaauacaa

SEQ ID NO: 1010807 - RNA, 13 nt, Homo sapiens
cuugcacaaacca

SEQ ID NO: 1010808 - RNA, 22 nt, Homo sapiens
cuuuaguuuuugugaaguuuaa

SEQ ID NO: 1010809 - RNA, 20 nt, Homo sapiens
cuuuuuccuggcucaucucu

SEQ ID NO: 1010810 - RNA, 23 nt, Homo sapiens
cuuuuuuuuuuuuuaaagacaga

SEQ ID NO: 1010811 - RNA, 22 nt, Homo sapiens
gaaaaagaagguugagggcaau

SEQ ID NO: 1010812 - RNA, 10 nt, Homo sapiens
gaaaagcagg

SEQ ID NO: 1010813 - RNA, 13 nt, Homo sapiens
gaaacagcuucau

SEQ ID NO: 1010814 - RNA, 14 nt, Homo sapiens
gaaacaucauuuca

SEQ ID NO: 1010815 - RNA, 22 nt, Homo sapiens
gaaauagugauuuccacaguga

SEQ ID NO: 1010816 - RNA, 15 nt, Homo sapiens
gaaauggggaacuac

SEQ ID NO: 1010817 - RNA, 12 nt, Homo sapiens
gaaccaggccag

SEQ ID NO: 1010818 - RNA, 16 nt, Homo sapiens
gaaguuuaauugacuu

SEQ ID NO: 1010819 - RNA, 20 nt, Homo sapiens
gaaguuuguuuaaaugacag

SEQ ID NO: 1010820 - RNA, 22 nt, Homo sapiens
gaauaacauggugugcuucuua

SEQ ID NO: 1010821 - RNA, 13 nt, Homo sapiens
gaauaugcacaaa

SEQ ID NO: 1010822 - RNA, 17 nt, Homo sapiens
gaaugagcaaaaccaaa

SEQ ID NO: 1010823 - RNA, 21 nt, Homo sapiens
gaauucagucaaagauacaca

SEQ ID NO: 1010824 - RNA, 17 nt, Homo sapiens
gaauuucuguucuucca

SEQ ID NO: 1010825 - RNA, 14 nt, Homo sapiens
gacagaagcguaua

SEQ ID NO: 1010826 - RNA, 12 nt, Homo sapiens
gaccaggucuca

SEQ ID NO: 1010827 - RNA, 20 nt, Homo sapiens
gacgugauuuugcuguagaa

SEQ ID NO: 1010828 - RNA, 12 nt, Homo sapiens
gacucaagcaag

SEQ ID NO: 1010829 - RNA, 20 nt, Homo sapiens
gacucuaacaguaguugcaa

SEQ ID NO: 1010830 - RNA, 19 nt, Homo sapiens
gacuuugaggguguauauu

SEQ ID NO: 1010831 - RNA, 23 nt, Homo sapiens
gagacagcacagccaaccuagcu

SEQ ID NO: 1010832 - RNA, 16 nt, Homo sapiens
gagggaaaacagaaaa

SEQ ID NO: 1010833 - RNA, 21 nt, Homo sapiens
gaguuauuuuuauuuauuuaa

SEQ ID NO: 1010834 - RNA, 20 nt, Homo sapiens
gaguucauggauauguuaua

SEQ ID NO: 1010835 - RNA, 18 nt, Homo sapiens
gauaaucucuccauuccc

SEQ ID NO: 1010836 - RNA, 16 nt, Homo sapiens
gauucuccugccucag

SEQ ID NO: 1010837 - RNA, 20 nt, Homo sapiens
gauuuugaaauuuuuauuaa

SEQ ID NO: 1010838 - RNA, 16 nt, Homo sapiens
gauuuugcuguagaag

SEQ ID NO: 1010839 - RNA, 22 nt, Homo sapiens
gcaaaaccaaauauuccagaga

SEQ ID NO: 1010840 - RNA, 23 nt, Homo sapiens
gcaaaaccaaauauuccagagac

SEQ ID NO: 1010841 - RNA, 22 nt, Homo sapiens
gcacaaaccaauuaaacccagu

SEQ ID NO: 1010842 - RNA, 20 nt, Homo sapiens
gcacucagaaaauggcacuu

SEQ ID NO: 1010843 - RNA, 18 nt, Homo sapiens
gcaguuuuuuucuugucu

SEQ ID NO: 1010844 - RNA, 13 nt, Homo sapiens
gcauucucuaguc

SEQ ID NO: 1010845 - RNA, 19 nt, Homo sapiens
gcauuugucaacaaaguca

SEQ ID NO: 1010846 - RNA, 18 nt, Homo sapiens
gccacccucccacugcca

SEQ ID NO: 1010847 - RNA, 19 nt, Homo sapiens
gccacccucccacugccaa

SEQ ID NO: 1010848 - RNA, 14 nt, Homo sapiens
gccagcaucugccu

SEQ ID NO: 1010849 - RNA, 15 nt, Homo sapiens
gccaguuacauaaaa

SEQ ID NO: 1010850 - RNA, 22 nt, Homo sapiens
gccauaaaggggagggacucau

SEQ ID NO: 1010851 - RNA, 13 nt, Homo sapiens
gccauaugaauaa

SEQ ID NO: 1010852 - RNA, 18 nt, Homo sapiens
gcccaggcuggagugcaa

SEQ ID NO: 1010853 - RNA, 14 nt, Homo sapiens
gcuaauauugcaau

SEQ ID NO: 1010854 - RNA, 16 nt, Homo sapiens
gcuccauucaaaguga

SEQ ID NO: 1010855 - RNA, 14 nt, Homo sapiens
gcuccuaagccaug

SEQ ID NO: 1010856 - RNA, 22 nt, Homo sapiens
gcuggauuacaggcaugugcca

SEQ ID NO: 1010857 - RNA, 14 nt, Homo sapiens
gcuguagaagaugg

SEQ ID NO: 1010858 - RNA, 13 nt, Homo sapiens
ggaaccagcccag

SEQ ID NO: 1010859 - RNA, 19 nt, Homo sapiens
ggacuaaguguaccagaga

SEQ ID NO: 1010860 - RNA, 18 nt, Homo sapiens
ggacucaagcaagauuuc

SEQ ID NO: 1010861 - RNA, 12 nt, Homo sapiens
ggagacacugau

SEQ ID NO: 1010862 - RNA, 17 nt, Homo sapiens
ggcacacugagccagca

SEQ ID NO: 1010863 - RNA, 17 nt, Homo sapiens
ggcaggaccuguggcca

SEQ ID NO: 1010864 - RNA, 22 nt, Homo sapiens
ggcuaagcacgggccauaugaa

SEQ ID NO: 1010865 - RNA, 17 nt, Homo sapiens
ggcucucccagccaggu

SEQ ID NO: 1010866 - RNA, 22 nt, Homo sapiens
ggcugucagauauaaguaacuu

SEQ ID NO: 1010867 - RNA, 17 nt, Homo sapiens
ggcugugccaucagcuc

SEQ ID NO: 1010868 - RNA, 14 nt, Homo sapiens
ggguucaagugauu

SEQ ID NO: 1010869 - RNA, 18 nt, Homo sapiens
ggguuucaccauguuggc

SEQ ID NO: 1010870 - RNA, 21 nt, Homo sapiens
ggucagaguuccgacugccau

SEQ ID NO: 1010871 - RNA, 12 nt, Homo sapiens
guaaaagccauc

SEQ ID NO: 1010872 - RNA, 22 nt, Homo sapiens
guaacuguuuugguuuugcuca

SEQ ID NO: 1010873 - RNA, 17 nt, Homo sapiens
guacaaaguaagccaug

SEQ ID NO: 1010874 - RNA, 15 nt, Homo sapiens
guagaaagugaucca

SEQ ID NO: 1010875 - RNA, 21 nt, Homo sapiens
guagagagagaaaaguaacug

SEQ ID NO: 1010876 - RNA, 15 nt, Homo sapiens
guauuaaguuguuaa

SEQ ID NO: 1010877 - RNA, 20 nt, Homo sapiens
gucaacaaagucacccacuu

SEQ ID NO: 1010878 - RNA, 23 nt, Homo sapiens
gucaauguccuacugagacagca

SEQ ID NO: 1010879 - RNA, 13 nt, Homo sapiens
guccaaggucucc

SEQ ID NO: 1010880 - RNA, 13 nt, Homo sapiens
gucuauuagcucc

SEQ ID NO: 1010881 - RNA, 23 nt, Homo sapiens
gucucaguuuacauuuuguauau

SEQ ID NO: 1010882 - RNA, 19 nt, Homo sapiens
gucugaacaauauauacuu

SEQ ID NO: 1010883 - RNA, 18 nt, Homo sapiens
gucugauuguagcuauga

SEQ ID NO: 1010884 - RNA, 14 nt, Homo sapiens
gucuuuaaccacuu

SEQ ID NO: 1010885 - RNA, 13 nt, Homo sapiens
gugccaucagcuc

SEQ ID NO: 1010886 - RNA, 22 nt, Homo sapiens
gugcuucuuaaaauagccauaa

SEQ ID NO: 1010887 - RNA, 22 nt, Homo sapiens
gugggcuaagcacgggccauau

SEQ ID NO: 1010888 - RNA, 20 nt, Homo sapiens
guuaaaaguuguguuuugaa

SEQ ID NO: 1010889 - RNA, 17 nt, Homo sapiens
guucuaaggcugugcca

SEQ ID NO: 1010890 - RNA, 13 nt, Homo sapiens
guuggcucaggag

SEQ ID NO: 1010891 - RNA, 19 nt, Homo sapiens
guuguuaauaaaaguacau

SEQ ID NO: 1010892 - RNA, 14 nt, Homo sapiens
guuuaguugcacaa

SEQ ID NO: 1010893 - RNA, 22 nt, Homo sapiens
guuuaugcauagauaaucucuc

SEQ ID NO: 1010894 - RNA, 19 nt, Homo sapiens
guuucaccauguuggccag

SEQ ID NO: 1010895 - RNA, 15 nt, Homo sapiens
guuuccaaucugucc

SEQ ID NO: 1010896 - RNA, 12 nt, Homo sapiens
uaaaaguuggcu

SEQ ID NO: 1010897 - RNA, 14 nt, Homo sapiens
uaaaauagccauaa

SEQ ID NO: 1010898 - RNA, 21 nt, Homo sapiens
uaaauguagaaagugauccau

SEQ ID NO: 1010899 - RNA, 15 nt, Homo sapiens
uaacauggugugcuu

SEQ ID NO: 1010900 - RNA, 14 nt, Homo sapiens
uaaccauugucaua

SEQ ID NO: 1010901 - RNA, 17 nt, Homo sapiens
uaagaagugacucuugc

SEQ ID NO: 1010902 - RNA, 12 nt, Homo sapiens
uaagaugaaaca

SEQ ID NO: 1010903 - RNA, 20 nt, Homo sapiens
uaagaugaaacaucauuuca

SEQ ID NO: 1010904 - RNA, 21 nt, Homo sapiens
uaagcacgggccauaugaaua

SEQ ID NO: 1010905 - RNA, 19 nt, Homo sapiens
uaaguuacacauuuuucag

SEQ ID NO: 1010906 - RNA, 16 nt, Homo sapiens
uaaucaguguuuccaa

SEQ ID NO: 1010907 - RNA, 16 nt, Homo sapiens
uaaugguuauauguau

SEQ ID NO: 1010908 - RNA, 16 nt, Homo sapiens
uacagucuuguauuaa

SEQ ID NO: 1010909 - RNA, 22 nt, Homo sapiens
uaccuuuuauuuuaauguuucc

SEQ ID NO: 1010910 - RNA, 13 nt, Homo sapiens
uacuaaucuuucu

SEQ ID NO: 1010911 - RNA, 16 nt, Homo sapiens
uacuauuuuuacuaau

SEQ ID NO: 1010912 - RNA, 22 nt, Homo sapiens
uacugcuggcaguggaacuaag

SEQ ID NO: 1010913 - RNA, 14 nt, Homo sapiens
uacuuaguucaagc

SEQ ID NO: 1010914 - RNA, 22 nt, Homo sapiens
uagaaccucgagguuucucaaa

SEQ ID NO: 1010915 - RNA, 14 nt, Homo sapiens
uagaagauggcacu

SEQ ID NO: 1010916 - RNA, 14 nt, Homo sapiens
uagaaugagacuua

SEQ ID NO: 1010917 - RNA, 22 nt, Homo sapiens
uagagaccaguuuucucuggaa

SEQ ID NO: 1010918 - RNA, 14 nt, Homo sapiens
uagcuccacaaagc

SEQ ID NO: 1010919 - RNA, 16 nt, Homo sapiens
uagcuuauacaaaaca

SEQ ID NO: 1010920 - RNA, 17 nt, Homo sapiens
uagcuuauacaaaacau

SEQ ID NO: 1010921 - RNA, 22 nt, Homo sapiens
uaggaagaauuuuuauauccac

SEQ ID NO: 1010922 - RNA, 22 nt, Homo sapiens
uagucucuggcaagaugcuuua

SEQ ID NO: 1010923 - RNA, 22 nt, Homo sapiens
uagucugaacaauauauacuua

SEQ ID NO: 1010924 - RNA, 23 nt, Homo sapiens
uagugauuuccacagugacucca

SEQ ID NO: 1010925 - RNA, 16 nt, Homo sapiens
uaugaauaguuuccaa

SEQ ID NO: 1010926 - RNA, 20 nt, Homo sapiens
ucaaaaaaaaaaaaauguga

SEQ ID NO: 1010927 - RNA, 14 nt, Homo sapiens
ucaaaaacauucuu

SEQ ID NO: 1010928 - RNA, 19 nt, Homo sapiens
ucaaaacaaucuugucaua

SEQ ID NO: 1010929 - RNA, 13 nt, Homo sapiens
ucaaagugagcuc

SEQ ID NO: 1010930 - RNA, 22 nt, Homo sapiens
ucaaagugagcuccuaagccau

SEQ ID NO: 1010931 - RNA, 21 nt, Homo sapiens
ucaagacgucacccuccauuc

SEQ ID NO: 1010932 - RNA, 22 nt, Homo sapiens
ucaagacgucacccuccauucu

SEQ ID NO: 1010933 - RNA, 13 nt, Homo sapiens
ucaaguaauccac

SEQ ID NO: 1010934 - RNA, 21 nt, Homo sapiens
ucaaguaauccaccugccucg

SEQ ID NO: 1010935 - RNA, 19 nt, Homo sapiens
ucaagugauucuccugccu

SEQ ID NO: 1010936 - RNA, 16 nt, Homo sapiens
ucaauguccuacugag

SEQ ID NO: 1010937 - RNA, 18 nt, Homo sapiens
ucacagccacuugggaua

SEQ ID NO: 1010938 - RNA, 16 nt, Homo sapiens
ucacguaaagcuagaa

SEQ ID NO: 1010939 - RNA, 18 nt, Homo sapiens
ucacugcaacuucugccu

SEQ ID NO: 1010940 - RNA, 23 nt, Homo sapiens
ucagauauaaaagacugaccaau

SEQ ID NO: 1010941 - RNA, 16 nt, Homo sapiens
ucagcaccuacagugu

SEQ ID NO: 1010942 - RNA, 22 nt, Homo sapiens
ucagcaccuacaguguacaguc

SEQ ID NO: 1010943 - RNA, 16 nt, Homo sapiens
ucagggagugggcuaa

SEQ ID NO: 1010944 - RNA, 13 nt, Homo sapiens
ucaucauuuccau

SEQ ID NO: 1010945 - RNA, 22 nt, Homo sapiens
ucauucugcauucucuagucag

SEQ ID NO: 1010946 - RNA, 14 nt, Homo sapiens
uccaaagacauguu

SEQ ID NO: 1010947 - RNA, 15 nt, Homo sapiens
uccacagugacucca

SEQ ID NO: 1010948 - RNA, 13 nt, Homo sapiens
ucccucaaaacaa

SEQ ID NO: 1010949 - RNA, 15 nt, Homo sapiens
uccuccccuguucau

SEQ ID NO: 1010950 - RNA, 18 nt, Homo sapiens
uccuggggaacauagaac

SEQ ID NO: 1010951 - RNA, 16 nt, Homo sapiens
uccuuagaaguggaag

SEQ ID NO: 1010952 - RNA, 19 nt, Homo sapiens
ucgugguaggacuguagaa

SEQ ID NO: 1010953 - RNA, 15 nt, Homo sapiens
ucguucucugccuca

SEQ ID NO: 1010954 - RNA, 15 nt, Homo sapiens
ucuaaaaacauuugu

SEQ ID NO: 1010955 - RNA, 20 nt, Homo sapiens
ucuaaagauggaaaaaccac

SEQ ID NO: 1010956 - RNA, 22 nt, Homo sapiens
ucuaaggcugugccaucagcuc

SEQ ID NO: 1010957 - RNA, 14 nt, Homo sapiens
ucuaauggcuuuau

SEQ ID NO: 1010958 - RNA, 20 nt, Homo sapiens
ucucaaacuccugaccucaa

SEQ ID NO: 1010959 - RNA, 13 nt, Homo sapiens
ucugaaacagcuu

SEQ ID NO: 1010960 - RNA, 21 nt, Homo sapiens
ucugaacaauauauacuuaua

SEQ ID NO: 1010961 - RNA, 21 nt, Homo sapiens
ucugaggcuucuggggcuuca

SEQ ID NO: 1010962 - RNA, 20 nt, Homo sapiens
ucugccuccccuucacuccc

SEQ ID NO: 1010963 - RNA, 21 nt, Homo sapiens
ucugccuccccuucacuccca

SEQ ID NO: 1010964 - RNA, 17 nt, Homo sapiens
ucuggccuccaagucca

SEQ ID NO: 1010965 - RNA, 13 nt, Homo sapiens
ucuuaagacguga

SEQ ID NO: 1010966 - RNA, 13 nt, Homo sapiens
ucuuccaucaccu

SEQ ID NO: 1010967 - RNA, 18 nt, Homo sapiens
ucuuggguucaagugauu

SEQ ID NO: 1010968 - RNA, 14 nt, Homo sapiens
ugaaacaucauuuc

SEQ ID NO: 1010969 - RNA, 20 nt, Homo sapiens
ugaaagcuggagucugucaa

SEQ ID NO: 1010970 - RNA, 13 nt, Homo sapiens
ugacacagucuug

SEQ ID NO: 1010971 - RNA, 19 nt, Homo sapiens
ugaccaauauuguacaguu

SEQ ID NO: 1010972 - RNA, 16 nt, Homo sapiens
ugaccugccaggcaca

SEQ ID NO: 1010973 - RNA, 21 nt, Homo sapiens
ugaggaauuucuguucuucca

SEQ ID NO: 1010974 - RNA, 20 nt, Homo sapiens
ugaguagcuggauuacaggc

SEQ ID NO: 1010975 - RNA, 21 nt, Homo sapiens
ugaugcuggggacacagcauc

SEQ ID NO: 1010976 - RNA, 14 nt, Homo sapiens
ugcaauguuuuaga

SEQ ID NO: 1010977 - RNA, 14 nt, Homo sapiens
ugccaaagaacuug

SEQ ID NO: 1010978 - RNA, 21 nt, Homo sapiens
ugccacucuguaauugcaaaa

SEQ ID NO: 1010979 - RNA, 20 nt, Homo sapiens
ugcuggcaguggaacuaaga

SEQ ID NO: 1010980 - RNA, 21 nt, Homo sapiens
ugcuguagaagauggcacuua

SEQ ID NO: 1010981 - RNA, 21 nt, Homo sapiens
uggauuacaggcaugugccac

SEQ ID NO: 1010982 - RNA, 22 nt, Homo sapiens
uggauuugucuuuggugaacau

SEQ ID NO: 1010983 - RNA, 15 nt, Homo sapiens
uggggacacagcauc

SEQ ID NO: 1010984 - RNA, 21 nt, Homo sapiens
uggggacacagcaucagcuca

SEQ ID NO: 1010985 - RNA, 23 nt, Homo sapiens
ugggucagaguuccgacugccau

SEQ ID NO: 1010986 - RNA, 21 nt, Homo sapiens
uguaaauuucucuacugucuc

SEQ ID NO: 1010987 - RNA, 12 nt, Homo sapiens
uguaauugcaaa

SEQ ID NO: 1010988 - RNA, 16 nt, Homo sapiens
uguacagucuuguauu

SEQ ID NO: 1010989 - RNA, 22 nt, Homo sapiens
uguacaguuuuuauugcuuguu

SEQ ID NO: 1010990 - RNA, 12 nt, Homo sapiens
uguagaaaguga

SEQ ID NO: 1010991 - RNA, 22 nt, Homo sapiens
uguagagagagaaaaguaacug

SEQ ID NO: 1010992 - RNA, 13 nt, Homo sapiens
uguaucucaggaa

SEQ ID NO: 1010993 - RNA, 22 nt, Homo sapiens
ugucaauguccuacugagacag

SEQ ID NO: 1010994 - RNA, 11 nt, Homo sapiens
uguccaaagac

SEQ ID NO: 1010995 - RNA, 18 nt, Homo sapiens
ugugaaguuuaauugacu

SEQ ID NO: 1010996 - RNA, 14 nt, Homo sapiens
ugugccaucagcuc

SEQ ID NO: 1010997 - RNA, 20 nt, Homo sapiens
uguuaauaaaaguacauguu

SEQ ID NO: 1010998 - RNA, 20 nt, Homo sapiens
uguucugguuacuguucuaa

SEQ ID NO: 1010999 - RNA, 18 nt, Homo sapiens
uguuguuuucccaaagag

SEQ ID NO: 1011000 - RNA, 22 nt, Homo sapiens
uuaaauguagaaagugauccau

SEQ ID NO: 1011001 - RNA, 18 nt, Homo sapiens
uuaagaaauucacuuccc

SEQ ID NO: 1011002 - RNA, 23 nt, Homo sapiens
uuacuguucuaaggcugugccau

SEQ ID NO: 1011003 - RNA, 16 nt, Homo sapiens
uuagagcuuuaccuaa

SEQ ID NO: 1011004 - RNA, 19 nt, Homo sapiens
uuauacaauauacuuguau

SEQ ID NO: 1011005 - RNA, 22 nt, Homo sapiens
uuaucauuaaaaggaaagcaga

SEQ ID NO: 1011006 - RNA, 15 nt, Homo sapiens
uuaugaauaguuucc

SEQ ID NO: 1011007 - RNA, 20 nt, Homo sapiens
uuauuaaauguagaaaguga

SEQ ID NO: 1011008 - RNA, 21 nt, Homo sapiens
uuauuaaauguagaaagugau

SEQ ID NO: 1011009 - RNA, 17 nt, Homo sapiens
uucaacguaagacugug

SEQ ID NO: 1011010 - RNA, 13 nt, Homo sapiens
uucagaaucucuc

SEQ ID NO: 1011011 - RNA, 12 nt, Homo sapiens
uucucugccuca

SEQ ID NO: 1011012 - RNA, 15 nt, Homo sapiens
uucugaaaaaguauc

SEQ ID NO: 1011013 - RNA, 18 nt, Homo sapiens
uucugcauucucuaguca

SEQ ID NO: 1011014 - RNA, 20 nt, Homo sapiens
uugaaguauauucaaccaaa

SEQ ID NO: 1011015 - RNA, 15 nt, Homo sapiens
uugcaauguggcuug

SEQ ID NO: 1011016 - RNA, 18 nt, Homo sapiens
uugcacaaauugggccaa

SEQ ID NO: 1011017 - RNA, 21 nt, Homo sapiens
uuggacucaagcaagauuuca

SEQ ID NO: 1011018 - RNA, 19 nt, Homo sapiens
uuggauacgacaacuugca

SEQ ID NO: 1011019 - RNA, 11 nt, Homo sapiens
uuuaaagacag

SEQ ID NO: 1011020 - RNA, 17 nt, Homo sapiens
uuuccaaauuauggcaa

SEQ ID NO: 1011021 - RNA, 19 nt, Homo sapiens
uuucuuucaaagaagccag

SEQ ID NO: 1011022 - RNA, 15 nt, Homo sapiens
uuugaggguguauau

SEQ ID NO: 1011023 - RNA, 11 nt, Homo sapiens
uuugcuguaga

SEQ ID NO: 1011024 - RNA, 12 nt, Homo sapiens
uuugcuguagaa

SEQ ID NO: 1011025 - RNA, 18 nt, Homo sapiens
uuuuccuggcucaucucu

SEQ ID NO: 1011026 - RNA, 19 nt, Homo sapiens
uuuucuucuuuuugcuuca

SEQ ID NO: 1011027 - RNA, 13 nt, Homo sapiens
gucacagccacuu

SEQ ID NO: 1011028 - RNA, 14 nt, Homo sapiens
guccacaguggaac

SEQ ID NO: 1011029 - RNA, 21 nt, Homo sapiens
guccaucccgucgacguagaa

SEQ ID NO: 1011030 - RNA, 21 nt, Homo sapiens
gucucaaacuccugaccucaa

SEQ ID NO: 1011031 - RNA, 14 nt, Homo sapiens
gucugaacaauaua

SEQ ID NO: 1011032 - RNA, 20 nt, Homo sapiens
gucugucaauguccuacuga

SEQ ID NO: 1011033 - RNA, 12 nt, Homo sapiens
gucuuggcucac

SEQ ID NO: 1011034 - RNA, 19 nt, Homo sapiens
gucuuuggugaacauugca

SEQ ID NO: 1011035 - RNA, 23 nt, Homo sapiens
gugagacuuugaggguguauauu

SEQ ID NO: 1011036 - RNA, 22 nt, Homo sapiens
gugccucugggacuggacaauu

SEQ ID NO: 1011037 - RNA, 19 nt, Homo sapiens
gugcugggauuacagggau

SEQ ID NO: 1011038 - RNA, 23 nt, Homo sapiens
guggacucuaacaguaguugcaa

SEQ ID NO: 1011039 - RNA, 16 nt, Homo sapiens
guggauuggauuuguc

SEQ ID NO: 1011040 - RNA, 12 nt, Homo sapiens
guucauucugca

SEQ ID NO: 1011041 - RNA, 18 nt, Homo sapiens
guugagggcaauggacaa

SEQ ID NO: 1011042 - RNA, 23 nt, Homo sapiens
guugauuucagcaccuacagugu

SEQ ID NO: 1011043 - RNA, 15 nt, Homo sapiens
guugcuguaugucuc

SEQ ID NO: 1011044 - RNA, 17 nt, Homo sapiens
guuguuuucccaaagag

SEQ ID NO: 1011045 - RNA, 19 nt, Homo sapiens
guuuauacccguuucacau

SEQ ID NO: 1011046 - RNA, 20 nt, Homo sapiens
guuuaugcauagauaaucuc

SEQ ID NO: 1011047 - RNA, 14 nt, Homo sapiens
guuuucccaaagag

SEQ ID NO: 1011048 - RNA, 11 nt, Homo sapiens
uaaaagccauc

SEQ ID NO: 1011049 - RNA, 23 nt, Homo sapiens
uaaaaguacauguuaaacuuacu

SEQ ID NO: 1011050 - RNA, 18 nt, Homo sapiens
uaaaccguacacuguguu

SEQ ID NO: 1011051 - RNA, 20 nt, Homo sapiens
uaaauuucucuacugucuca

SEQ ID NO: 1011052 - RNA, 22 nt, Homo sapiens
uaaccaaagcccaaagugguau

SEQ ID NO: 1011053 - RNA, 21 nt, Homo sapiens
uaagaagcagauaaugguguu

SEQ ID NO: 1011054 - RNA, 12 nt, Homo sapiens
uaagacugugua

SEQ ID NO: 1011055 - RNA, 16 nt, Homo sapiens
uaagccauguguucca

SEQ ID NO: 1011056 - RNA, 18 nt, Homo sapiens
uaaugcauguggcacuua

SEQ ID NO: 1011057 - RNA, 20 nt, Homo sapiens
uacacauuuuucagauauaa

SEQ ID NO: 1011058 - RNA, 14 nt, Homo sapiens
uacgacaacuugca

SEQ ID NO: 1011059 - RNA, 21 nt, Homo sapiens
uacuauuuuuacuaaucuuuc

SEQ ID NO: 1011060 - RNA, 14 nt, Homo sapiens
uacuguccaaagac

SEQ ID NO: 1011061 - RNA, 15 nt, Homo sapiens
uacuuuaauguauaa

SEQ ID NO: 1011062 - RNA, 22 nt, Homo sapiens
uacuuuuuccuggcucaucucu

SEQ ID NO: 1011063 - RNA, 18 nt, Homo sapiens
uagaaugagacuuacuuc

SEQ ID NO: 1011064 - RNA, 16 nt, Homo sapiens
uagaucugaacuccuu

SEQ ID NO: 1011065 - RNA, 18 nt, Homo sapiens
uagcauuugucaacaaag

SEQ ID NO: 1011066 - RNA, 14 nt, Homo sapiens
uaguaaaagccauc

SEQ ID NO: 1011067 - RNA, 23 nt, Homo sapiens
uaguaaaagccaucuauguauau

SEQ ID NO: 1011068 - RNA, 19 nt, Homo sapiens
uagugcacagcacaaauua

SEQ ID NO: 1011069 - RNA, 14 nt, Homo sapiens
uaguggugacugug

SEQ ID NO: 1011070 - RNA, 20 nt, Homo sapiens
uauacccguuucacaugcuu

SEQ ID NO: 1011071 - RNA, 16 nt, Homo sapiens
uauagaaaugcugguu

SEQ ID NO: 1011072 - RNA, 17 nt, Homo sapiens
uaugacacucuagucaa

SEQ ID NO: 1011073 - RNA, 13 nt, Homo sapiens
uaugcacaaacuu

SEQ ID NO: 1011074 - RNA, 17 nt, Homo sapiens
uauugaacuuaugcaaa

SEQ ID NO: 1011075 - RNA, 13 nt, Homo sapiens
ucaaaaacauucu

SEQ ID NO: 1011076 - RNA, 16 nt, Homo sapiens
ucaaacaaaaagucau

SEQ ID NO: 1011077 - RNA, 16 nt, Homo sapiens
acugaaccaggccaga

SEQ ID NO: 1011078 - RNA, 16 nt, Homo sapiens
acugaauuuugucuuu

SEQ ID NO: 1011079 - RNA, 21 nt, Homo sapiens
acugcauaugaaaggacacua

SEQ ID NO: 1011080 - RNA, 21 nt, Homo sapiens
acugccaucuuggacuuguca

SEQ ID NO: 1011081 - RNA, 18 nt, Homo sapiens
acuuuugaaaacaaaaua

SEQ ID NO: 1011082 - RNA, 17 nt, Homo sapiens
acuuuuuccuggcucau

SEQ ID NO: 1011083 - RNA, 13 nt, Homo sapiens
agaaagugaucca

SEQ ID NO: 1011084 - RNA, 19 nt, Homo sapiens
agaaccucgagguuucuca

SEQ ID NO: 1011085 - RNA, 11 nt, Homo sapiens
agaagaugaau

SEQ ID NO: 1011086 - RNA, 15 nt, Homo sapiens
agagggaaaacagaa

SEQ ID NO: 1011087 - RNA, 19 nt, Homo sapiens
agaucguucucugccucac

SEQ ID NO: 1011088 - RNA, 14 nt, Homo sapiens
agaugaaacaucau

SEQ ID NO: 1011089 - RNA, 13 nt, Homo sapiens
agcaaaaccaaau

SEQ ID NO: 1011090 - RNA, 20 nt, Homo sapiens
agcaacauuuguuuuagucu

SEQ ID NO: 1011091 - RNA, 12 nt, Homo sapiens
agcaucagcuca

SEQ ID NO: 1011092 - RNA, 12 nt, Homo sapiens
agccucaucucu

SEQ ID NO: 1011093 - RNA, 17 nt, Homo sapiens
aggagugccacuucaug

SEQ ID NO: 1011094 - RNA, 15 nt, Homo sapiens
aggcuucuggggcuu

SEQ ID NO: 1011095 - RNA, 19 nt, Homo sapiens
agggaacugaacauuccag

SEQ ID NO: 1011096 - RNA, 16 nt, Homo sapiens
aggucagucuucuucc

SEQ ID NO: 1011097 - RNA, 17 nt, Homo sapiens
agguugagggcaaugga

SEQ ID NO: 1011098 - RNA, 17 nt, Homo sapiens
agguuucucaaagaaau

SEQ ID NO: 1011099 - RNA, 13 nt, Homo sapiens
aguaaaagccauc

SEQ ID NO: 1011100 - RNA, 21 nt, Homo sapiens
aguagcuggauuacaggcaug

SEQ ID NO: 1011101 - RNA, 21 nt, Homo sapiens
aguauauucaaccaaauacuu

SEQ ID NO: 1011102 - RNA, 21 nt, Homo sapiens
agugcaguuuuuuucuugucu

SEQ ID NO: 1011103 - RNA, 15 nt, Homo sapiens
aguguaccagagaag

SEQ ID NO: 1011104 - RNA, 16 nt, Homo sapiens
aguugcaauguuuuag

SEQ ID NO: 1011105 - RNA, 13 nt, Homo sapiens
aguugcuguaugu

SEQ ID NO: 1011106 - RNA, 15 nt, Homo sapiens
aguugggugauaugu

SEQ ID NO: 1011107 - RNA, 19 nt, Homo sapiens
aguuuauacccguuucaca

SEQ ID NO: 1011108 - RNA, 16 nt, Homo sapiens
auaaaaguuggcucag

SEQ ID NO: 1011109 - RNA, 20 nt, Homo sapiens
auaaaggggagggacucauc

SEQ ID NO: 1011110 - RNA, 21 nt, Homo sapiens
auaacuuuuuuuuaaguuaca

SEQ ID NO: 1011111 - RNA, 20 nt, Homo sapiens
auacuagaguucauggauau

SEQ ID NO: 1011112 - RNA, 20 nt, Homo sapiens
auacuuauagaauucaguca

SEQ ID NO: 1011113 - RNA, 14 nt, Homo sapiens
auagaauucaguca

SEQ ID NO: 1011114 - RNA, 18 nt, Homo sapiens
auaugacacucuagucaa

SEQ ID NO: 1011115 - RNA, 14 nt, Homo sapiens
aucaguagccagca

SEQ ID NO: 1011116 - RNA, 16 nt, Homo sapiens
auccacuaaaaucaaa

SEQ ID NO: 1011117 - RNA, 16 nt, Homo sapiens
augacacucuagucaa

SEQ ID NO: 1011118 - RNA, 18 nt, Homo sapiens
augagaaaaugucuuuau

SEQ ID NO: 1011119 - RNA, 15 nt, Homo sapiens
augagcaaaaccaaa

SEQ ID NO: 1011120 - RNA, 22 nt, Homo sapiens
augaggaauuucuguucuucca

SEQ ID NO: 1011121 - RNA, 17 nt, Homo sapiens
augagggaacuguguag

SEQ ID NO: 1011122 - RNA, 16 nt, Homo sapiens
augcaguuuuccuuaa

SEQ ID NO: 1011123 - RNA, 20 nt, Homo sapiens
augcuggggacacagcauca

SEQ ID NO: 1011124 - RNA, 17 nt, Homo sapiens
augguggccuggggcuu

SEQ ID NO: 1011125 - RNA, 21 nt, Homo sapiens
augucuuuauuaaauguagaa

SEQ ID NO: 1011126 - RNA, 18 nt, Homo sapiens
auuaagaaauucacuucc

SEQ ID NO: 1011127 - RNA, 18 nt, Homo sapiens
auuagcuccacaaagcca

SEQ ID NO: 1011128 - RNA, 11 nt, Homo sapiens
auucaaaguga

SEQ ID NO: 1011129 - RNA, 13 nt, Homo sapiens
auucugcacucag

SEQ ID NO: 1011130 - RNA, 18 nt, Homo sapiens
auugcaauagaaauccaa

SEQ ID NO: 1011131 - RNA, 20 nt, Homo sapiens
auugcagcgauuaauaacag

SEQ ID NO: 1011132 - RNA, 19 nt, Homo sapiens
auugcuugcacaaaccaau

SEQ ID NO: 1011133 - RNA, 14 nt, Homo sapiens
auugggccaaagaa

SEQ ID NO: 1011134 - RNA, 17 nt, Homo sapiens
auuucucuacugucuca

SEQ ID NO: 1011135 - RNA, 13 nt, Homo sapiens
auuugucaacaaa

SEQ ID NO: 1011136 - RNA, 21 nt, Homo sapiens
auuugucaacaaagucaccca

SEQ ID NO: 1011137 - RNA, 18 nt, Homo sapiens
auuuuucagauauaaaag

SEQ ID NO: 1011138 - RNA, 22 nt, Homo sapiens
caaaaacauucuuacauuuuac

SEQ ID NO: 1011139 - RNA, 12 nt, Homo sapiens
caaaacauuugu

SEQ ID NO: 1011140 - RNA, 13 nt, Homo sapiens
caaagaaauuucc

SEQ ID NO: 1011141 - RNA, 22 nt, Homo sapiens
caaagauacacaaucugaaaca

SEQ ID NO: 1011142 - RNA, 13 nt, Homo sapiens
caaaguaagccau

SEQ ID NO: 1011143 - RNA, 14 nt, Homo sapiens
caauauacuuguau

SEQ ID NO: 1011144 - RNA, 22 nt, Homo sapiens
caauauacuuguauagcaguuu

SEQ ID NO: 1011145 - RNA, 19 nt, Homo sapiens
caaucaguagccagcaucu

SEQ ID NO: 1011146 - RNA, 15 nt, Homo sapiens
caaucugaaacagcu

SEQ ID NO: 1011147 - RNA, 18 nt, Homo sapiens
caaucugaaacagcuuca

SEQ ID NO: 1011148 - RNA, 21 nt, Homo sapiens
caaucuguccuguuacaaaag

SEQ ID NO: 1011149 - RNA, 15 nt, Homo sapiens
caaugacacagucuu

SEQ ID NO: 1011150 - RNA, 14 nt, Homo sapiens
caaugucuaaaaac

SEQ ID NO: 1011151 - RNA, 15 nt, Homo sapiens
cacagcaucagcuca

SEQ ID NO: 1011152 - RNA, 23 nt, Homo sapiens
cacagccaaccuagcuagcaaca

SEQ ID NO: 1011153 - RNA, 15 nt, Homo sapiens
cacagucuuggcuca

SEQ ID NO: 1011154 - RNA, 12 nt, Homo sapiens
cacugccaaaga

SEQ ID NO: 1011155 - RNA, 14 nt, Homo sapiens
cacuguuaagccau

SEQ ID NO: 1011156 - RNA, 19 nt, Homo sapiens
cacuuagguccaaggucuc

SEQ ID NO: 1011157 - RNA, 13 nt, Homo sapiens
cacuuuucaaugu

SEQ ID NO: 1011158 - RNA, 19 nt, Homo sapiens
guguacagucuuguauuaa

SEQ ID NO: 1011159 - RNA, 13 nt, Homo sapiens
guguaccagagaa

SEQ ID NO: 1011160 - RNA, 22 nt, Homo sapiens
guguuuuuaauaaagacagggu

SEQ ID NO: 1011161 - RNA, 20 nt, Homo sapiens
guuaaaauaaaauuguacau

SEQ ID NO: 1011162 - RNA, 22 nt, Homo sapiens
guucauggauauguuauacuga

SEQ ID NO: 1011163 - RNA, 18 nt, Homo sapiens
guuuuacuguccaaagac

SEQ ID NO: 1011164 - RNA, 21 nt, Homo sapiens
guuuuacuguccaaagacaug

SEQ ID NO: 1011165 - RNA, 23 nt, Homo sapiens
uaaaaguuggcucaggagucuua

SEQ ID NO: 1011166 - RNA, 20 nt, Homo sapiens
uaaacuuacuuaguguuaug

SEQ ID NO: 1011167 - RNA, 19 nt, Homo sapiens
uaaagaaaaguuuuguaaa

SEQ ID NO: 1011168 - RNA, 10 nt, Homo sapiens
uaaagacaga

SEQ ID NO: 1011169 - RNA, 13 nt, Homo sapiens
uaaauguagaaag

SEQ ID NO: 1011170 - RNA, 16 nt, Homo sapiens
uaacgagaaauagaaa

SEQ ID NO: 1011171 - RNA, 15 nt, Homo sapiens
uaagaaauucacuuc

SEQ ID NO: 1011172 - RNA, 16 nt, Homo sapiens
uaauaaaaguacaugu

SEQ ID NO: 1011173 - RNA, 15 nt, Homo sapiens
uaauaaagacagggu

SEQ ID NO: 1011174 - RNA, 16 nt, Homo sapiens
uacaaaguaagccaug

SEQ ID NO: 1011175 - RNA, 19 nt, Homo sapiens
uacaaaguaagccauguau

SEQ ID NO: 1011176 - RNA, 16 nt, Homo sapiens
uacaauauacuuguau

SEQ ID NO: 1011177 - RNA, 20 nt, Homo sapiens
uacacaaucugaaacagcuu

SEQ ID NO: 1011178 - RNA, 18 nt, Homo sapiens
uacuuauagaauucaguc

SEQ ID NO: 1011179 - RNA, 14 nt, Homo sapiens
uacuucucugcuau

SEQ ID NO: 1011180 - RNA, 15 nt, Homo sapiens
uagaaagaagaugaa

SEQ ID NO: 1011181 - RNA, 16 nt, Homo sapiens
uagaaauccaauugga

SEQ ID NO: 1011182 - RNA, 17 nt, Homo sapiens
uagcauuugucaacaaa

SEQ ID NO: 1011183 - RNA, 17 nt, Homo sapiens
uagugaaucacguaaag

SEQ ID NO: 1011184 - RNA, 22 nt, Homo sapiens
uagugaaucacguaaagcuaga

SEQ ID NO: 1011185 - RNA, 12 nt, Homo sapiens
uaguugcuguau

SEQ ID NO: 1011186 - RNA, 14 nt, Homo sapiens
uauacaauauacuu

SEQ ID NO: 1011187 - RNA, 19 nt, Homo sapiens
uauauguauaucacauucc

SEQ ID NO: 1011188 - RNA, 16 nt, Homo sapiens
uauugaacuuaugcaa

SEQ ID NO: 1011189 - RNA, 15 nt, Homo sapiens
ucaaaaacauucuua

SEQ ID NO: 1011190 - RNA, 17 nt, Homo sapiens
ucaaaacaaucuuguca

SEQ ID NO: 1011191 - RNA, 22 nt, Homo sapiens
ucaaacaaaaagucauaaaagu

SEQ ID NO: 1011192 - RNA, 14 nt, Homo sapiens
ucaacaaagucacc

SEQ ID NO: 1011193 - RNA, 16 nt, Homo sapiens
ucaacaaagucaccca

SEQ ID NO: 1011194 - RNA, 22 nt, Homo sapiens
ucaagugauucuccugccucag

SEQ ID NO: 1011195 - RNA, 19 nt, Homo sapiens
ucagaguuccgacugccau

SEQ ID NO: 1011196 - RNA, 21 nt, Homo sapiens
ucauggauauguuauacugaa

SEQ ID NO: 1011197 - RNA, 21 nt, Homo sapiens
ucaugggguggacucuaacag

SEQ ID NO: 1011198 - RNA, 16 nt, Homo sapiens
ucauuguaaaaagccc

SEQ ID NO: 1011199 - RNA, 13 nt, Homo sapiens
uccacaaagccaa

SEQ ID NO: 1011200 - RNA, 13 nt, Homo sapiens
uccacaguggaac

SEQ ID NO: 1011201 - RNA, 18 nt, Homo sapiens
uccagagacugggacuaa

SEQ ID NO: 1011202 - RNA, 10 nt, Homo sapiens
ucccaaagag

SEQ ID NO: 1011203 - RNA, 14 nt, Homo sapiens
uccccuucacuccc

SEQ ID NO: 1011204 - RNA, 18 nt, Homo sapiens
uccugaccucaaguaauc

SEQ ID NO: 1011205 - RNA, 16 nt, Homo sapiens
uccuggggaacauaga

SEQ ID NO: 1011206 - RNA, 15 nt, Homo sapiens
ucuaaaaucugcuag

SEQ ID NO: 1011207 - RNA, 20 nt, Homo sapiens
ucuaagccuucugguuuuau

SEQ ID NO: 1011208 - RNA, 21 nt, Homo sapiens
ucuaaggcugugccaucagcu

SEQ ID NO: 1011209 - RNA, 14 nt, Homo sapiens
ucuaaguaaauaca

SEQ ID NO: 1011210 - RNA, 21 nt, Homo sapiens
ucucccagccagguucugacu

SEQ ID NO: 1011211 - RNA, 14 nt, Homo sapiens
ucucugcuaucuag

SEQ ID NO: 1011212 - RNA, 22 nt, Homo sapiens
ucugauaugcaguuuuccuuaa

SEQ ID NO: 1011213 - RNA, 16 nt, Homo sapiens
ucugcauucucuaguc

SEQ ID NO: 1011214 - RNA, 17 nt, Homo sapiens
ucuuaaaauagccauaa

SEQ ID NO: 1011215 - RNA, 14 nt, Homo sapiens
ucuuaguugcugua

SEQ ID NO: 1011216 - RNA, 12 nt, Homo sapiens
ugaaacaucauu

SEQ ID NO: 1011217 - RNA, 12 nt, Homo sapiens
ugaacauuccag

SEQ ID NO: 1011218 - RNA, 14 nt, Homo sapiens
ugaauaguuuccaa

SEQ ID NO: 1011219 - RNA, 15 nt, Homo sapiens
ugaaugccacucugu

SEQ ID NO: 1011220 - RNA, 22 nt, Homo sapiens
ugacucaagacuuccagagccu

SEQ ID NO: 1011221 - RNA, 14 nt, Homo sapiens
ugacucuuggcaca

SEQ ID NO: 1011222 - RNA, 22 nt, Homo sapiens
ugagacuuugaggguguauauu

SEQ ID NO: 1011223 - RNA, 12 nt, Homo sapiens
ugaggguguaua

SEQ ID NO: 1011224 - RNA, 13 nt, Homo sapiens
ugcaauguuuuag

SEQ ID NO: 1011225 - RNA, 14 nt, Homo sapiens
ugcacguauuuuaa

SEQ ID NO: 1011226 - RNA, 20 nt, Homo sapiens
ugcaguuuuuuucuugucua

SEQ ID NO: 1011227 - RNA, 15 nt, Homo sapiens
ugcauguggcacuua

SEQ ID NO: 1011228 - RNA, 21 nt, Homo sapiens
ugcccaggcuggagugcaaug

SEQ ID NO: 1011229 - RNA, 14 nt, Homo sapiens
ugcuguaugucucg

SEQ ID NO: 1011230 - RNA, 19 nt, Homo sapiens
ugcuucaaaaacauucuua

SEQ ID NO: 1011231 - RNA, 23 nt, Homo sapiens
ugcuucuuugaaacuuguaugaa

SEQ ID NO: 1011232 - RNA, 18 nt, Homo sapiens
uggccaggcuggucucaa

SEQ ID NO: 1011233 - RNA, 18 nt, Homo sapiens
uggcuaguaaaagccauc

SEQ ID NO: 1011234 - RNA, 13 nt, Homo sapiens
uggcucaucucuu

SEQ ID NO: 1011235 - RNA, 22 nt, Homo sapiens
uggcuucuuuacuuaguucaag

SEQ ID NO: 1011236 - RNA, 17 nt, Homo sapiens
ugggagacacugaugua

SEQ ID NO: 1011237 - RNA, 15 nt, Homo sapiens
ugggauuacagggau

SEQ ID NO: 1011238 - RNA, 12 nt, Homo sapiens
ugggccaaagaa

SEQ ID NO: 1011239 - RNA, 22 nt, Homo sapiens
uggggacacagcaucagcucaa

SEQ ID NO: 1011240 - RNA, 18 nt, Homo sapiens
ugguuguauuaaagcagg

SEQ ID NO: 1011241 - RNA, 21 nt, Homo sapiens
ugguuuugcucacaaaagucu

SEQ ID NO: 1011242 - RNA, 18 nt, Homo sapiens
ugguuuuucaguuuucag

SEQ ID NO: 1011243 - RNA, 14 nt, Homo sapiens
uguagaaagugauc

SEQ ID NO: 1011244 - RNA, 23 nt, Homo sapiens
ugucucgugguaggacuguagaa

SEQ ID NO: 1011245 - RNA, 10 nt, Homo sapiens
ugucuuuauu

SEQ ID NO: 1011246 - RNA, 20 nt, Homo sapiens
ugucuuuggugaacauugca

SEQ ID NO: 1011247 - RNA, 14 nt, Homo sapiens
uguguuuuuaauaa

SEQ ID NO: 1011248 - RNA, 20 nt, Homo sapiens
uguguuuuuaauaaagacag

SEQ ID NO: 1011249 - RNA, 14 nt, Homo sapiens
uguuaacugaaugc

SEQ ID NO: 1011250 - RNA, 23 nt, Homo sapiens
uguuaagccauguguuccaaggc

SEQ ID NO: 1011251 - RNA, 18 nt, Homo sapiens
uguugacauucugaaugc

SEQ ID NO: 1011252 - RNA, 15 nt, Homo sapiens
uguuuauagugcucu

SEQ ID NO: 1011253 - RNA, 17 nt, Homo sapiens
uguuucaaacaaaaagu

SEQ ID NO: 1011254 - RNA, 20 nt, Homo sapiens
uguuucaaacaaaaagucau

SEQ ID NO: 1011255 - RNA, 22 nt, Homo sapiens
uuaaaaaauggacucuugaaau

SEQ ID NO: 1011256 - RNA, 23 nt, Homo sapiens
uuaaaaggaaagcagauggugga

SEQ ID NO: 1011257 - RNA, 16 nt, Homo sapiens
uuaauaaagacagggu

SEQ ID NO: 1011258 - RNA, 20 nt, Homo sapiens
uuaauaggguaaauucucua

SEQ ID NO: 1011259 - RNA, 16 nt, Homo sapiens
uuacauuuuguauauu

SEQ ID NO: 1011260 - RNA, 19 nt, Homo sapiens
uuacuuuuuccuggcucau

SEQ ID NO: 1011261 - RNA, 23 nt, Homo sapiens
uuacuuuuuccuggcucaucucu

SEQ ID NO: 1011262 - RNA, 17 nt, Homo sapiens
uuagugcacagcacaaa

SEQ ID NO: 1011263 - RNA, 12 nt, Homo sapiens
uucacucccacc

SEQ ID NO: 1011264 - RNA, 22 nt, Homo sapiens
uucagucaaagauacacaaucu

SEQ ID NO: 1011265 - RNA, 16 nt, Homo sapiens
uucccauuaaagaagu

SEQ ID NO: 1011266 - RNA, 23 nt, Homo sapiens
uucuaaagauggaaaaaccaccc

SEQ ID NO: 1011267 - RNA, 17 nt, Homo sapiens
uucuuccaugucuauua

SEQ ID NO: 1011268 - RNA, 15 nt, Homo sapiens
uucuuucaaagaagc

SEQ ID NO: 1011269 - RNA, 20 nt, Homo sapiens
uugcccaggcuggagugcaa

SEQ ID NO: 1011270 - RNA, 21 nt, Homo sapiens
uugcccaggcuggagugcaau

SEQ ID NO: 1011271 - RNA, 11 nt, Homo sapiens
uugcuguagaa

SEQ ID NO: 1011272 - RNA, 14 nt, Homo sapiens
uuggaaaaucaaga

SEQ ID NO: 1011273 - RNA, 15 nt, Homo sapiens
uuggugaacauugca

SEQ ID NO: 1011274 - RNA, 17 nt, Homo sapiens
uugguuuugcucacaaa

SEQ ID NO: 1011275 - RNA, 13 nt, Homo sapiens
uugucaacaaagu

SEQ ID NO: 1011276 - RNA, 18 nt, Homo sapiens
uugugcauaaaaacaaga

SEQ ID NO: 1011277 - RNA, 18 nt, Homo sapiens
uuguuauucuguaguuuc

SEQ ID NO: 1011278 - RNA, 16 nt, Homo sapiens
uuguuuguggucuaua

SEQ ID NO: 1011279 - RNA, 11 nt, Homo sapiens
uuuaaccaaga

SEQ ID NO: 1011280 - RNA, 15 nt, Homo sapiens
uuuaauagcgucaua

SEQ ID NO: 1011281 - RNA, 14 nt, Homo sapiens
uuuauugcuuguug

SEQ ID NO: 1011282 - RNA, 14 nt, Homo sapiens
uuugaggguguaua

SEQ ID NO: 1011283 - RNA, 14 nt, Homo sapiens
uuugucaacaaagu

SEQ ID NO: 1011284 - RNA, 17 nt, Homo sapiens
ucaaacuccugaccuca

SEQ ID NO: 1011285 - RNA, 22 nt, Homo sapiens
ucaaagaaauuuccacucaggu

SEQ ID NO: 1011286 - RNA, 16 nt, Homo sapiens
ucaaagccuugguaaa

SEQ ID NO: 1011287 - RNA, 23 nt, Homo sapiens
ucaaaugagaaaaugucuuuauu

SEQ ID NO: 1011288 - RNA, 17 nt, Homo sapiens
ucaaucccucaaaacaa

SEQ ID NO: 1011289 - RNA, 17 nt, Homo sapiens
ucagucuuuuccaugaa

SEQ ID NO: 1011290 - RNA, 20 nt, Homo sapiens
ucagucuuuuccaugaacuu

SEQ ID NO: 1011291 - RNA, 18 nt, Homo sapiens
ucauaaaagucacuuuau

SEQ ID NO: 1011292 - RNA, 20 nt, Homo sapiens
ucauacuugaaaauaugaca

SEQ ID NO: 1011293 - RNA, 10 nt, Homo sapiens
ucauauugau

SEQ ID NO: 1011294 - RNA, 20 nt, Homo sapiens
ucauauugaugugugucuag

SEQ ID NO: 1011295 - RNA, 14 nt, Homo sapiens
ucaucucuuuauuc

SEQ ID NO: 1011296 - RNA, 17 nt, Homo sapiens
ucaugagugcaacugug

SEQ ID NO: 1011297 - RNA, 15 nt, Homo sapiens
ucauggauauguuau

SEQ ID NO: 1011298 - RNA, 13 nt, Homo sapiens
uccacagugacuc

SEQ ID NO: 1011299 - RNA, 19 nt, Homo sapiens
uccuaagccaugggagaca

SEQ ID NO: 1011300 - RNA, 22 nt, Homo sapiens
uccuaagccaugggagacacug

SEQ ID NO: 1011301 - RNA, 18 nt, Homo sapiens
uccuccccuguucauucu

SEQ ID NO: 1011302 - RNA, 23 nt, Homo sapiens
uccugaccucaaguaauccaccu

SEQ ID NO: 1011303 - RNA, 19 nt, Homo sapiens
uccugaguagcuggauuac

SEQ ID NO: 1011304 - RNA, 19 nt, Homo sapiens
uccuggaggugacacuuga

SEQ ID NO: 1011305 - RNA, 20 nt, Homo sapiens
uccuuggcuucuuuacuuag

SEQ ID NO: 1011306 - RNA, 22 nt, Homo sapiens
ucuaaagauggaaaaaccaccc

SEQ ID NO: 1011307 - RNA, 20 nt, Homo sapiens
ucuacugucucaguuuacau

SEQ ID NO: 1011308 - RNA, 17 nt, Homo sapiens
ucuccuuagaaguggaa

SEQ ID NO: 1011309 - RNA, 18 nt, Homo sapiens
ucucgugguaggacugua

SEQ ID NO: 1011310 - RNA, 14 nt, Homo sapiens
ucucucuucuuuuc

SEQ ID NO: 1011311 - RNA, 20 nt, Homo sapiens
ucugaaaaaguauccugcuu

SEQ ID NO: 1011312 - RNA, 20 nt, Homo sapiens
ucugacucuuggcacagcau

SEQ ID NO: 1011313 - RNA, 15 nt, Homo sapiens
ucuguucuuccauca

SEQ ID NO: 1011314 - RNA, 23 nt, Homo sapiens
ucuuaagacgugauuuugcugua

SEQ ID NO: 1011315 - RNA, 22 nt, Homo sapiens
ucuuuguaaagaaaguggcuug

SEQ ID NO: 1011316 - RNA, 14 nt, Homo sapiens
ucuuuuccaugaac

SEQ ID NO: 1011317 - RNA, 23 nt, Homo sapiens
ugaaaagaaucggcaauguuuca

SEQ ID NO: 1011318 - RNA, 18 nt, Homo sapiens
ugaaaauaugacacucua

SEQ ID NO: 1011319 - RNA, 17 nt, Homo sapiens
ugaaagugagacuuuga

SEQ ID NO: 1011320 - RNA, 13 nt, Homo sapiens
ugaacauugcaau

SEQ ID NO: 1011321 - RNA, 19 nt, Homo sapiens
ugaacauugcaauagaaau

SEQ ID NO: 1011322 - RNA, 17 nt, Homo sapiens
ugaauuuugucuuuaug

SEQ ID NO: 1011323 - RNA, 20 nt, Homo sapiens
ugacacucuagucaaagccu

SEQ ID NO: 1011324 - RNA, 21 nt, Homo sapiens
ugaccugccaggcacacugag

SEQ ID NO: 1011325 - RNA, 14 nt, Homo sapiens
ugagaaaaugucuu

SEQ ID NO: 1011326 - RNA, 21 nt, Homo sapiens
ugagacuuacuucucugcuau

SEQ ID NO: 1011327 - RNA, 22 nt, Homo sapiens
ugaguagcuggauuacaggcau

SEQ ID NO: 1011328 - RNA, 16 nt, Homo sapiens
ugagucccagagccaa

SEQ ID NO: 1011329 - RNA, 22 nt, Homo sapiens
ugauuucagcaccuacagugua

SEQ ID NO: 1011330 - RNA, 19 nt, Homo sapiens
ugcaguuuuuuucuugucu

SEQ ID NO: 1011331 - RNA, 16 nt, Homo sapiens
ugcauucucuagucag

SEQ ID NO: 1011332 - RNA, 13 nt, Homo sapiens
ugcucacaaaagu

SEQ ID NO: 1011333 - RNA, 19 nt, Homo sapiens
ugcuucuuaaaauagccau

SEQ ID NO: 1011334 - RNA, 17 nt, Homo sapiens
ugcuugcacaaaccaau

SEQ ID NO: 1011335 - RNA, 20 nt, Homo sapiens
uggacucaagcaagauuuca

SEQ ID NO: 1011336 - RNA, 13 nt, Homo sapiens
uggagucugucaa

SEQ ID NO: 1011337 - RNA, 15 nt, Homo sapiens
uggauuugucuuugg

SEQ ID NO: 1011338 - RNA, 16 nt, Homo sapiens
uggccuggggcuucug

SEQ ID NO: 1011339 - RNA, 14 nt, Homo sapiens
uggcucaucucuuu

SEQ ID NO: 1011340 - RNA, 13 nt, Homo sapiens
ugggauuacaggg

SEQ ID NO: 1011341 - RNA, 23 nt, Homo sapiens
uguaagaucguucucugccucac

SEQ ID NO: 1011342 - RNA, 14 nt, Homo sapiens
uguacagucuugua

SEQ ID NO: 1011343 - RNA, 23 nt, Homo sapiens
uguauauuuucugugcagccacu

SEQ ID NO: 1011344 - RNA, 15 nt, Homo sapiens
uguccuguuacaaaa

SEQ ID NO: 1011345 - RNA, 21 nt, Homo sapiens
ugugcuucuuaaaauagccau

SEQ ID NO: 1011346 - RNA, 15 nt, Homo sapiens
ugugggcuccauuca

SEQ ID NO: 1011347 - RNA, 13 nt, Homo sapiens
uguguuucuuuag

SEQ ID NO: 1011348 - RNA, 21 nt, Homo sapiens
uguguuuuuaauaaagacagg

SEQ ID NO: 1011349 - RNA, 21 nt, Homo sapiens
uguuuaugaauaguuuccaaa

SEQ ID NO: 1011350 - RNA, 22 nt, Homo sapiens
uguuuccuuuaauuuuuuacua

SEQ ID NO: 1011351 - RNA, 15 nt, Homo sapiens
uuaaaaauaugugua

SEQ ID NO: 1011352 - RNA, 17 nt, Homo sapiens
uuaaaccguacacugug

SEQ ID NO: 1011353 - RNA, 21 nt, Homo sapiens
uuaaagcagggauaugcugua

SEQ ID NO: 1011354 - RNA, 21 nt, Homo sapiens
uuaaauguagaaagugaucca

SEQ ID NO: 1011355 - RNA, 12 nt, Homo sapiens
uuaacugaaugc

SEQ ID NO: 1011356 - RNA, 18 nt, Homo sapiens
uuaagccauguguuccaa

SEQ ID NO: 1011357 - RNA, 22 nt, Homo sapiens
uuaaguuacacauuuuucagau

SEQ ID NO: 1011358 - RNA, 22 nt, Homo sapiens
uuaccuuuuauuuuaauguuuc

SEQ ID NO: 1011359 - RNA, 13 nt, Homo sapiens
uuacuaaucuuuc

SEQ ID NO: 1011360 - RNA, 15 nt, Homo sapiens
uuacuguccaaagac

SEQ ID NO: 1011361 - RNA, 17 nt, Homo sapiens
uuaugaauaguuuccaa

SEQ ID NO: 1011362 - RNA, 23 nt, Homo sapiens
uucagauauaaaagacugaccaa

SEQ ID NO: 1011363 - RNA, 15 nt, Homo sapiens
uucaguuuucaggag

SEQ ID NO: 1011364 - RNA, 23 nt, Homo sapiens
uucauggauauguuauacugaac

SEQ ID NO: 1011365 - RNA, 23 nt, Homo sapiens
uuccaaucuguccuguuacaaaa

SEQ ID NO: 1011366 - RNA, 13 nt, Homo sapiens
uucuccugccuca

SEQ ID NO: 1011367 - RNA, 14 nt, Homo sapiens
uucuggggcuucag

SEQ ID NO: 1011368 - RNA, 18 nt, Homo sapiens
uucuuucaaagaagccag

SEQ ID NO: 1011369 - RNA, 13 nt, Homo sapiens
uucuuuucugacu

SEQ ID NO: 1011370 - RNA, 13 nt, Homo sapiens
uugaaacuuguau

SEQ ID NO: 1011371 - RNA, 19 nt, Homo sapiens
uuggcuaguaaaagccauc

SEQ ID NO: 1011372 - RNA, 22 nt, Homo sapiens
uugucaacaaagucacccacuu

SEQ ID NO: 1011373 - RNA, 13 nt, Homo sapiens
caaaaccaaauau

SEQ ID NO: 1011374 - RNA, 15 nt, Homo sapiens
caaauauuccagaga

SEQ ID NO: 1011375 - RNA, 15 nt, Homo sapiens
caacaaagucaccca

SEQ ID NO: 1011376 - RNA, 17 nt, Homo sapiens
caacaaagucacccacu

SEQ ID NO: 1011377 - RNA, 18 nt, Homo sapiens
caaggucuccagagggug

SEQ ID NO: 1011378 - RNA, 20 nt, Homo sapiens
caaguucuuaguugcuguau

SEQ ID NO: 1011379 - RNA, 14 nt, Homo sapiens
caauagauauuuac

SEQ ID NO: 1011380 - RNA, 22 nt, Homo sapiens
caauauauacuuauagaauuca

SEQ ID NO: 1011381 - RNA, 22 nt, Homo sapiens
caaucaauucauaucuauuuau

SEQ ID NO: 1011382 - RNA, 14 nt, Homo sapiens
caauguuuuagaau

SEQ ID NO: 1011383 - RNA, 15 nt, Homo sapiens
cacaaauuaguugua

SEQ ID NO: 1011384 - RNA, 16 nt, Homo sapiens
cacccuccauucugca

SEQ ID NO: 1011385 - RNA, 13 nt, Homo sapiens
cacucagaaaaug

SEQ ID NO: 1011386 - RNA, 23 nt, Homo sapiens
cacuguuaagccauguguuccaa

SEQ ID NO: 1011387 - RNA, 21 nt, Homo sapiens
cacuucccacuauugcuugca

SEQ ID NO: 1011388 - RNA, 13 nt, Homo sapiens
cagaaaaagaagg

SEQ ID NO: 1011389 - RNA, 15 nt, Homo sapiens
cagcaccuacagugu

SEQ ID NO: 1011390 - RNA, 16 nt, Homo sapiens
cagcauggagucacag

SEQ ID NO: 1011391 - RNA, 14 nt, Homo sapiens
cagcuccuggacca

SEQ ID NO: 1011392 - RNA, 17 nt, Homo sapiens
caggacagcuccuggac

SEQ ID NO: 1011393 - RNA, 13 nt, Homo sapiens
caggcacacugag

SEQ ID NO: 1011394 - RNA, 22 nt, Homo sapiens
caggcaugugccacccacccaa

SEQ ID NO: 1011395 - RNA, 17 nt, Homo sapiens
caggcuggagugcaaug

SEQ ID NO: 1011396 - RNA, 21 nt, Homo sapiens
caggguuucaccauguuggcc

SEQ ID NO: 1011397 - RNA, 17 nt, Homo sapiens
cagguucugacucuugg

SEQ ID NO: 1011398 - RNA, 13 nt, Homo sapiens
caguaguugcaau

SEQ ID NO: 1011399 - RNA, 18 nt, Homo sapiens
cagugacuccacucugag

SEQ ID NO: 1011400 - RNA, 13 nt, Homo sapiens
caguguacagucu

SEQ ID NO: 1011401 - RNA, 16 nt, Homo sapiens
cauaacaggagugcca

SEQ ID NO: 1011402 - RNA, 14 nt, Homo sapiens
cauaugaauaacau

SEQ ID NO: 1011403 - RNA, 14 nt, Homo sapiens
caucauuucaaucg

SEQ ID NO: 1011404 - RNA, 22 nt, Homo sapiens
caucugccuccccuucacuccc

SEQ ID NO: 1011405 - RNA, 17 nt, Homo sapiens
cauggagucacagccac

SEQ ID NO: 1011406 - RNA, 19 nt, Homo sapiens
caugggagacacugaugua

SEQ ID NO: 1011407 - RNA, 15 nt, Homo sapiens
cauucugcacucaga

SEQ ID NO: 1011408 - RNA, 21 nt, Homo sapiens
ccaaguucuuaguugcuguau

SEQ ID NO: 1011409 - RNA, 23 nt, Homo sapiens
ccacccccaaauuuucuuuuuau

SEQ ID NO: 1011410 - RNA, 14 nt, Homo sapiens
ccagagacugggac

SEQ ID NO: 1011411 - RNA, 16 nt, Homo sapiens
ccaggcuggagugcaa

SEQ ID NO: 1011412 - RNA, 20 nt, Homo sapiens
ccaggcuggagugcaaugac

SEQ ID NO: 1011413 - RNA, 22 nt, Homo sapiens
ccauacuagaguucauggauau

SEQ ID NO: 1011414 - RNA, 15 nt, Homo sapiens
cccagccucaucucu

SEQ ID NO: 1011415 - RNA, 16 nt, Homo sapiens
cccuccauucugcacu

SEQ ID NO: 1011416 - RNA, 19 nt, Homo sapiens
cccucuaggaggugaugau

SEQ ID NO: 1011417 - RNA, 19 nt, Homo sapiens
cccuguucauucugcauuc

SEQ ID NO: 1011418 - RNA, 13 nt, Homo sapiens
ccuacugagacag

SEQ ID NO: 1011419 - RNA, 23 nt, Homo sapiens
ccuaggaaagccaguuacauaaa

SEQ ID NO: 1011420 - RNA, 16 nt, Homo sapiens
ccuggaccaggucuca

SEQ ID NO: 1011421 - RNA, 14 nt, Homo sapiens
ccuggcucaucucu

SEQ ID NO: 1011422 - RNA, 19 nt, Homo sapiens
ccuuggcuaguaaaagcca

SEQ ID NO: 1011423 - RNA, 16 nt, Homo sapiens
cgugauuuugcuguag

SEQ ID NO: 1011424 - RNA, 17 nt, Homo sapiens
cuaaaaguuaauagggu

SEQ ID NO: 1011425 - RNA, 15 nt, Homo sapiens
cuagaguucauggau

SEQ ID NO: 1011426 - RNA, 21 nt, Homo sapiens
cuaugauuguccguaggccca

SEQ ID NO: 1011427 - RNA, 14 nt, Homo sapiens
cucaucauuuccau

SEQ ID NO: 1011428 - RNA, 19 nt, Homo sapiens
cuccacaaagccaaucuca

SEQ ID NO: 1011429 - RNA, 17 nt, Homo sapiens
cuccuggaccaggucuc

SEQ ID NO: 1011430 - RNA, 19 nt, Homo sapiens
cucugagucccagagccaa

SEQ ID NO: 1011431 - RNA, 15 nt, Homo sapiens
cucuguaauugcaaa

SEQ ID NO: 1011432 - RNA, 13 nt, Homo sapiens
cucuuggguucaa

SEQ ID NO: 1011433 - RNA, 15 nt, Homo sapiens
cuggaccaggucuca

SEQ ID NO: 1011434 - RNA, 17 nt, Homo sapiens
cugguggggcugccagg

SEQ ID NO: 1011435 - RNA, 15 nt, Homo sapiens
cuguggccaaguucu

SEQ ID NO: 1011436 - RNA, 20 nt, Homo sapiens
cuguucuaaggcugugccau

SEQ ID NO: 1011437 - RNA, 22 nt, Homo sapiens
cuuaaaagaaagagaaguuuuc

SEQ ID NO: 1011438 - RNA, 18 nt, Homo sapiens
cuuagguccaaggucucc

SEQ ID NO: 1011439 - RNA, 13 nt, Homo sapiens
cuuaguugcugua

SEQ ID NO: 1011440 - RNA, 17 nt, Homo sapiens
cuucugaaaaaguaucc

SEQ ID NO: 1011441 - RNA, 17 nt, Homo sapiens
cuucuuuuugcuucaaa

SEQ ID NO: 1011442 - RNA, 18 nt, Homo sapiens
cuugacuuuugaaaacaa

SEQ ID NO: 1011443 - RNA, 23 nt, Homo sapiens
cuuggaauccuggggaacauaga

SEQ ID NO: 1011444 - RNA, 16 nt, Homo sapiens
cuuguauagcaguuuc

SEQ ID NO: 1011445 - RNA, 13 nt, Homo sapiens
cuuuauugcucau

SEQ ID NO: 1011446 - RNA, 23 nt, Homo sapiens
cuuuggugaacauugcaauagaa

SEQ ID NO: 1011447 - RNA, 20 nt, Homo sapiens
gaaaagaaucggcaauguuu

SEQ ID NO: 1011448 - RNA, 13 nt, Homo sapiens
gaaaaguuuugua

SEQ ID NO: 1011449 - RNA, 22 nt, Homo sapiens
gaaaauugggaauaugcacaaa

SEQ ID NO: 1011450 - RNA, 21 nt, Homo sapiens
gaaauucacuuccccucuagg

SEQ ID NO: 1011451 - RNA, 15 nt, Homo sapiens
gaacugaacauucca

SEQ ID NO: 1011452 - RNA, 13 nt, Homo sapiens
gaacuuaugcaaa

SEQ ID NO: 1011453 - RNA, 23 nt, Homo sapiens
gaagggcuuggacucaagcaaga

SEQ ID NO: 1011454 - RNA, 13 nt, Homo sapiens
gaauaguuuccaa

SEQ ID NO: 1011455 - RNA, 15 nt, Homo sapiens
gaaugagacuuacuu

SEQ ID NO: 1011456 - RNA, 18 nt, Homo sapiens
gaauuuggguaugaacag

SEQ ID NO: 1011457 - RNA, 21 nt, Homo sapiens
gaauuuuuauauccacuaaaa

SEQ ID NO: 1011458 - RNA, 21 nt, Homo sapiens
gacgucacccuccauucugca

SEQ ID NO: 1011459 - RNA, 18 nt, Homo sapiens
gacgugauuuugcuguag

SEQ ID NO: 1011460 - RNA, 19 nt, Homo sapiens
gacgugauuuugcuguaga

SEQ ID NO: 1011461 - RNA, 21 nt, Homo sapiens
gacucaagacuuccagagccu

SEQ ID NO: 1011462 - RNA, 19 nt, Homo sapiens
gagaucuauauauguauaa

SEQ ID NO: 1011463 - RNA, 16 nt, Homo sapiens
gaguuccgacugccau

SEQ ID NO: 1011464 - RNA, 15 nt, Homo sapiens
gauauaaaagacuga

SEQ ID NO: 1011465 - RNA, 18 nt, Homo sapiens
gaugaaacaucauuucaa

SEQ ID NO: 1011466 - RNA, 14 nt, Homo sapiens
gauuuccacaguga

SEQ ID NO: 1011467 - RNA, 18 nt, Homo sapiens
gcaaacagaaaaagaagg

SEQ ID NO: 1011468 - RNA, 15 nt, Homo sapiens
gcaccuacaguguac

SEQ ID NO: 1011469 - RNA, 16 nt, Homo sapiens
gcagagaggcugaaua

SEQ ID NO: 1011470 - RNA, 21 nt, Homo sapiens
gcagaguacaaaguaagccau

SEQ ID NO: 1011471 - RNA, 22 nt, Homo sapiens
gcagcgauuaauaacaggcaaa

SEQ ID NO: 1011472 - RNA, 15 nt, Homo sapiens
gcaggacagcuccug

SEQ ID NO: 1011473 - RNA, 22 nt, Homo sapiens
gcaggauuugggcucuuggaau

SEQ ID NO: 1011474 - RNA, 13 nt, Homo sapiens
gcaguggaacuaa

SEQ ID NO: 1011475 - RNA, 16 nt, Homo sapiens
gcaguggaacuaagaa

SEQ ID NO: 1011476 - RNA, 18 nt, Homo sapiens
gccaaucaguagccagca

SEQ ID NO: 1011477 - RNA, 16 nt, Homo sapiens
gccagagcaaacagaa

SEQ ID NO: 1011478 - RNA, 20 nt, Homo sapiens
gccagguucugacucuuggc

SEQ ID NO: 1011479 - RNA, 16 nt, Homo sapiens
gcccagccucaucucu

SEQ ID NO: 1011480 - RNA, 19 nt, Homo sapiens
gcccaggcuggagugcaau

SEQ ID NO: 1011481 - RNA, 22 nt, Homo sapiens
gccuaggaaagccaguuacaua

SEQ ID NO: 1011482 - RNA, 15 nt, Homo sapiens
gcuagggaauaucaa

SEQ ID NO: 1011483 - RNA, 17 nt, Homo sapiens
gcuccauucaaagugag

SEQ ID NO: 1011484 - RNA, 12 nt, Homo sapiens
gcuggagugcaa

SEQ ID NO: 1011485 - RNA, 14 nt, Homo sapiens
gcuucugauaugca

SEQ ID NO: 1011486 - RNA, 16 nt, Homo sapiens
ggaaagccaguuacau

SEQ ID NO: 1011487 - RNA, 11 nt, Homo sapiens
ggaacugugua

SEQ ID NO: 1011488 - RNA, 15 nt, Homo sapiens
ggaccaggucucaua

SEQ ID NO: 1011489 - RNA, 18 nt, Homo sapiens
ggagccccugcucuggug

SEQ ID NO: 1011490 - RNA, 18 nt, Homo sapiens
ggauacgacaacuugcac

SEQ ID NO: 1011491 - RNA, 13 nt, Homo sapiens
ggauuacaggcau

SEQ ID NO: 1011492 - RNA, 20 nt, Homo sapiens
ggcacagcauggagucacag

SEQ ID NO: 1011493 - RNA, 21 nt, Homo sapiens
ggcuucagucuuuuccaugaa

SEQ ID NO: 1011494 - RNA, 22 nt, Homo sapiens
gggaaggaggccguccaucccg

SEQ ID NO: 1011495 - RNA, 20 nt, Homo sapiens
gggacuaaguguaccagaga

SEQ ID NO: 1011496 - RNA, 16 nt, Homo sapiens
ggggacacagcaucag

SEQ ID NO: 1011497 - RNA, 12 nt, Homo sapiens
gguauuuagcca

SEQ ID NO: 1011498 - RNA, 19 nt, Homo sapiens
guaaauauagcucagguag

SEQ ID NO: 1011499 - RNA, 21 nt, Homo sapiens
guaaauuucucuacugucuca

SEQ ID NO: 1011500 - RNA, 19 nt, Homo sapiens
guagaaaagggaacugaac

SEQ ID NO: 1011501 - RNA, 12 nt, Homo sapiens
guagaaagugau

SEQ ID NO: 1011502 - RNA, 20 nt, Homo sapiens
gucaaagauacacaaucuga

SEQ ID NO: 1011503 - RNA, 17 nt, Homo sapiens
gucaaagccuugguaaa

SEQ ID NO: 1011504 - RNA, 18 nt, Homo sapiens
gucacagccacuugggau

SEQ ID NO: 1011505 - RNA, 16 nt, Homo sapiens
gucagucuucuuccau

SEQ ID NO: 1011506 - RNA, 16 nt, Homo sapiens
gucuaaaaacauuugu

SEQ ID NO: 1011507 - RNA, 23 nt, Homo sapiens
gucucgugguaggacuguagaaa

SEQ ID NO: 1011508 - RNA, 22 nt, Homo sapiens
gugaccugccaggcacacugag

SEQ ID NO: 1011509 - RNA, 16 nt, Homo sapiens
gugccaucagcuccuu

SEQ ID NO: 1011510 - RNA, 12 nt, Homo sapiens
uuuaaagacaga

SEQ ID NO: 1011511 - RNA, 16 nt, Homo sapiens
uuuaauguuuccuuua

SEQ ID NO: 1011512 - RNA, 17 nt, Homo sapiens
uuuaauguuuccuuuaa

SEQ ID NO: 1011513 - RNA, 16 nt, Homo sapiens
uuucauaucacacugu

SEQ ID NO: 1011514 - RNA, 20 nt, Homo sapiens
uuucuugucuauaaagcauu

SEQ ID NO: 1011515 - RNA, 19 nt, Homo sapiens
uuugcuucaaaaacauucu

SEQ ID NO: 1011516 - RNA, 12 nt, Homo sapiens
uuugucuuuaug

SEQ ID NO: 1011517 - RNA, 12 nt, Homo sapiens
uuuuauauccac

SEQ ID NO: 1011518 - RNA, 15 nt, Homo sapiens
uuuucaaugucuaaa

SEQ ID NO: 1011519 - RNA, 13 nt, Homo sapiens
uuuugcuguagaa

SEQ ID NO: 1011520 - RNA, 21 nt, Homo sapiens
aaaaagcccuuaaaaauaugu

SEQ ID NO: 1011521 - RNA, 17 nt, Homo sapiens
aaaaaugugacucaaga

SEQ ID NO: 1011522 - RNA, 19 nt, Homo sapiens
aaaauggcacuugggggac

SEQ ID NO: 1011523 - RNA, 16 nt, Homo sapiens
aaacagaaaaccugau

SEQ ID NO: 1011524 - RNA, 9 nt, Homo sapiens
aaagugaug

SEQ ID NO: 1011525 - RNA, 16 nt, Homo sapiens
aaauauaguucacaau

SEQ ID NO: 1011526 - RNA, 21 nt, Homo sapiens
aaauuaagaaauucacuuccc

SEQ ID NO: 1011527 - RNA, 21 nt, Homo sapiens
aacaaucuugucauacuugaa

SEQ ID NO: 1011528 - RNA, 14 nt, Homo sapiens
aacaucauuucaau

SEQ ID NO: 1011529 - RNA, 21 nt, Homo sapiens
aaccguaugagggaacugugu

SEQ ID NO: 1011530 - RNA, 14 nt, Homo sapiens
aaccuagcuagcaa

SEQ ID NO: 1011531 - RNA, 23 nt, Homo sapiens
aacuuggaaauagugauuuccac

SEQ ID NO: 1011532 - RNA, 17 nt, Homo sapiens
aagaucguucucugccu

SEQ ID NO: 1011533 - RNA, 15 nt, Homo sapiens
aagccauguaucuca

SEQ ID NO: 1011534 - RNA, 15 nt, Homo sapiens
aaggcagaguacaaa

SEQ ID NO: 1011535 - RNA, 21 nt, Homo sapiens
aagggauggaagaaguaaaua

SEQ ID NO: 1011536 - RNA, 16 nt, Homo sapiens
aaguuuaauugacuua

SEQ ID NO: 1011537 - RNA, 14 nt, Homo sapiens
aauaaaauuguaca

SEQ ID NO: 1011538 - RNA, 12 nt, Homo sapiens
aauaaagacagg

SEQ ID NO: 1011539 - RNA, 22 nt, Homo sapiens
aauauuccagagacugggacua

SEQ ID NO: 1011540 - RNA, 15 nt, Homo sapiens
aaucaguguuuccaa

SEQ ID NO: 1011541 - RNA, 23 nt, Homo sapiens
aaucccucaaaacaaucuuguca

SEQ ID NO: 1011542 - RNA, 20 nt, Homo sapiens
aaucuuucugcagaaacaga

SEQ ID NO: 1011543 - RNA, 15 nt, Homo sapiens
aauguagaaagugau

SEQ ID NO: 1011544 - RNA, 18 nt, Homo sapiens
aauguagaaagugaucca

SEQ ID NO: 1011545 - RNA, 15 nt, Homo sapiens
aauguauuugcuaua

SEQ ID NO: 1011546 - RNA, 18 nt, Homo sapiens
aauguccuacugagacag

SEQ ID NO: 1011547 - RNA, 23 nt, Homo sapiens
aaugucuuuauuaaauguagaaa

SEQ ID NO: 1011548 - RNA, 21 nt, Homo sapiens
aauguggcuugaauguaggua

SEQ ID NO: 1011549 - RNA, 18 nt, Homo sapiens
aauucagggagugggcua

SEQ ID NO: 1011550 - RNA, 15 nt, Homo sapiens
aauugggccaaagaa

SEQ ID NO: 1011551 - RNA, 23 nt, Homo sapiens
aauugggccaaagaaacauugcc

SEQ ID NO: 1011552 - RNA, 18 nt, Homo sapiens
aauuucucuacugucuca

SEQ ID NO: 1011553 - RNA, 16 nt, Homo sapiens
aauuuugucuuuauga

SEQ ID NO: 1011554 - RNA, 15 nt, Homo sapiens
acaaagccaaucuca

SEQ ID NO: 1011555 - RNA, 16 nt, Homo sapiens
acaauauacuuguaua

SEQ ID NO: 1011556 - RNA, 22 nt, Homo sapiens
acacaaucugaaacagcuucau

SEQ ID NO: 1011557 - RNA, 14 nt, Homo sapiens
acagccacuuggga

SEQ ID NO: 1011558 - RNA, 20 nt, Homo sapiens
acagugacuccacucugagu

SEQ ID NO: 1011559 - RNA, 18 nt, Homo sapiens
accaacuauagaauguau

SEQ ID NO: 1011560 - RNA, 18 nt, Homo sapiens
accauuagcauuugucaa

SEQ ID NO: 1011561 - RNA, 16 nt, Homo sapiens
acccucccacugccaa

SEQ ID NO: 1011562 - RNA, 23 nt, Homo sapiens
acccuucuccuuagaaguggaag

SEQ ID NO: 1011563 - RNA, 17 nt, Homo sapiens
acccuucuuuucugacu

SEQ ID NO: 1011564 - RNA, 17 nt, Homo sapiens
accuaacgagaaauaga

SEQ ID NO: 1011565 - RNA, 11 nt, Homo sapiens
accucaucucc

SEQ ID NO: 1011566 - RNA, 16 nt, Homo sapiens
acguaagacuguguaa

SEQ ID NO: 1011567 - RNA, 15 nt, Homo sapiens
acucaucauuuccau

SEQ ID NO: 1011568 - RNA, 14 nt, Homo sapiens
acugaacauuccag

SEQ ID NO: 1011569 - RNA, 14 nt, Homo sapiens
aaaaaugugacuca

SEQ ID NO: 1011570 - RNA, 14 nt, Homo sapiens
aaaaggcagaguac

SEQ ID NO: 1011571 - RNA, 18 nt, Homo sapiens
aaaaguauccugcuucug

SEQ ID NO: 1011572 - RNA, 21 nt, Homo sapiens
aaaaguuuuguaaauuucucu

SEQ ID NO: 1011573 - RNA, 20 nt, Homo sapiens
aaaaucaaacaauucaggga

SEQ ID NO: 1011574 - RNA, 12 nt, Homo sapiens
aaaaugugacuc

SEQ ID NO: 1011575 - RNA, 22 nt, Homo sapiens
aaacauuuguuuguggucuaua

SEQ ID NO: 1011576 - RNA, 16 nt, Homo sapiens
aaaccaaauauuccag

SEQ ID NO: 1011577 - RNA, 10 nt, Homo sapiens
aaacuuguau

SEQ ID NO: 1011578 - RNA, 13 nt, Homo sapiens
aaagaaauuucca

SEQ ID NO: 1011579 - RNA, 13 nt, Homo sapiens
aaaguaagccaug

SEQ ID NO: 1011580 - RNA, 16 nt, Homo sapiens
aaagugauccauacuu

SEQ ID NO: 1011581 - RNA, 17 nt, Homo sapiens
aaauaaucaguguuucc

SEQ ID NO: 1011582 - RNA, 21 nt, Homo sapiens
aaaugugacucaagacuucca

SEQ ID NO: 1011583 - RNA, 14 nt, Homo sapiens
aaauucacuucccc

SEQ ID NO: 1011584 - RNA, 15 nt, Homo sapiens
aaauuucucuacugu

SEQ ID NO: 1011585 - RNA, 19 nt, Homo sapiens
aaauuucucuacugucuca

SEQ ID NO: 1011586 - RNA, 16 nt, Homo sapiens
aacaaagucacccacu

SEQ ID NO: 1011587 - RNA, 22 nt, Homo sapiens
aacauuuguuuuagucugaaca

SEQ ID NO: 1011588 - RNA, 15 nt, Homo sapiens
aaccguacacugugu

SEQ ID NO: 1011589 - RNA, 17 nt, Homo sapiens
aaccguacacuguguuu

SEQ ID NO: 1011590 - RNA, 16 nt, Homo sapiens
aacguaagacugugua

SEQ ID NO: 1011591 - RNA, 16 nt, Homo sapiens
aacuuacuuaguguua

SEQ ID NO: 1011592 - RNA, 22 nt, Homo sapiens
aacuuggaaauagugauuucca

SEQ ID NO: 1011593 - RNA, 14 nt, Homo sapiens
aagaaacauugccu

SEQ ID NO: 1011594 - RNA, 20 nt, Homo sapiens
aagaaucggcaauguuucaa

SEQ ID NO: 1011595 - RNA, 23 nt, Homo sapiens
aagaauuuuuauauccacuaaaa

SEQ ID NO: 1011596 - RNA, 23 nt, Homo sapiens
aagacgugauuuugcuguagaag

SEQ ID NO: 1011597 - RNA, 11 nt, Homo sapiens
aagacugacca

SEQ ID NO: 1011598 - RNA, 18 nt, Homo sapiens
aagagaaguuuucuugac

SEQ ID NO: 1011599 - RNA, 20 nt, Homo sapiens
aagaugaaacaucauuucaa

SEQ ID NO: 1011600 - RNA, 13 nt, Homo sapiens
aagcauucuucaa

SEQ ID NO: 1011601 - RNA, 15 nt, Homo sapiens
aagccauguguucca

SEQ ID NO: 1011602 - RNA, 19 nt, Homo sapiens
aagccauguguuccaaggc

SEQ ID NO: 1011603 - RNA, 13 nt, Homo sapiens
aagccuugguaaa

SEQ ID NO: 1011604 - RNA, 20 nt, Homo sapiens
aaggcugugccaucagcucc

SEQ ID NO: 1011605 - RNA, 19 nt, Homo sapiens
aagggcuuggacucaagca

SEQ ID NO: 1011606 - RNA, 20 nt, Homo sapiens
aaguaaauauagcucaggua

SEQ ID NO: 1011607 - RNA, 18 nt, Homo sapiens
aaguacauguuaaacuua

SEQ ID NO: 1011608 - RNA, 20 nt, Homo sapiens
aagugagcuccuaagccaug

SEQ ID NO: 1011609 - RNA, 18 nt, Homo sapiens
aaguucuuaguugcugua

SEQ ID NO: 1011610 - RNA, 16 nt, Homo sapiens
aauaaauucaucagau

SEQ ID NO: 1011611 - RNA, 15 nt, Homo sapiens
aauaaccauugucau

SEQ ID NO: 1011612 - RNA, 23 nt, Homo sapiens
aauaagcaggcgugaccugccag

SEQ ID NO: 1011613 - RNA, 15 nt, Homo sapiens
aauagugauuuccac

SEQ ID NO: 1011614 - RNA, 19 nt, Homo sapiens
aauagugauuuccacagug

SEQ ID NO: 1011615 - RNA, 21 nt, Homo sapiens
aauaguuguuauucuguaguu

SEQ ID NO: 1011616 - RNA, 15 nt, Homo sapiens
aauauagcucaggua

SEQ ID NO: 1011617 - RNA, 18 nt, Homo sapiens
aauaugacacucuaguca

SEQ ID NO: 1011618 - RNA, 15 nt, Homo sapiens
aaugacacagucuug

SEQ ID NO: 1011619 - RNA, 20 nt, Homo sapiens
aaugacacagucuuggcuca

SEQ ID NO: 1011620 - RNA, 22 nt, Homo sapiens
aaugccacucuguaauugcaaa

SEQ ID NO: 1011621 - RNA, 23 nt, Homo sapiens
aauguaagaucguucucugccuc

SEQ ID NO: 1011622 - RNA, 12 nt, Homo sapiens
aaugucuuuauu

SEQ ID NO: 1011623 - RNA, 21 nt, Homo sapiens
aauguguucggugauuucaga

SEQ ID NO: 1011624 - RNA, 22 nt, Homo sapiens
aauguuuaugaauaguuuccaa

SEQ ID NO: 1011625 - RNA, 14 nt, Homo sapiens
aauucaucagauaa

SEQ ID NO: 1011626 - RNA, 16 nt, Homo sapiens
aauugcuucaagcauu

SEQ ID NO: 1011627 - RNA, 14 nt, Homo sapiens
acaaaguaagccau

SEQ ID NO: 1011628 - RNA, 15 nt, Homo sapiens
acaaaguaagccaug

SEQ ID NO: 1011629 - RNA, 19 nt, Homo sapiens
acaaaguaagccauguauc

SEQ ID NO: 1011630 - RNA, 18 nt, Homo sapiens
acaaauugggccaaagaa

SEQ ID NO: 1011631 - RNA, 19 nt, Homo sapiens
acaaucuugucauacuuga

SEQ ID NO: 1011632 - RNA, 15 nt, Homo sapiens
acacaaucugaaaca

SEQ ID NO: 1011633 - RNA, 16 nt, Homo sapiens
acacaaucugaaacag

SEQ ID NO: 1011634 - RNA, 14 nt, Homo sapiens
acacagcaucagcu

SEQ ID NO: 1011635 - RNA, 16 nt, Homo sapiens
acacagcaucagcuca

SEQ ID NO: 1011636 - RNA, 15 nt, Homo sapiens
acagcaucagcucaa

SEQ ID NO: 1011637 - RNA, 17 nt, Homo sapiens
acauaaaaguuggcuca

SEQ ID NO: 1011638 - RNA, 18 nt, Homo sapiens
acauuuguuuguggucua

SEQ ID NO: 1011639 - RNA, 23 nt, Homo sapiens
acauuuuacuuuuuccuggcuca

SEQ ID NO: 1011640 - RNA, 16 nt, Homo sapiens
accaauauuguacagu

SEQ ID NO: 1011641 - RNA, 22 nt, Homo sapiens
accagagaagggcuuggacuca

SEQ ID NO: 1011642 - RNA, 19 nt, Homo sapiens
accaggucucauaaugcau

SEQ ID NO: 1011643 - RNA, 16 nt, Homo sapiens
acccuucuccuuagaa

SEQ ID NO: 1011644 - RNA, 21 nt, Homo sapiens
accgcgcccagccucaucucu

SEQ ID NO: 1011645 - RNA, 20 nt, Homo sapiens
accguaugagggaacugugu

SEQ ID NO: 1011646 - RNA, 17 nt, Homo sapiens
accuaaauaugagccca

SEQ ID NO: 1011647 - RNA, 14 nt, Homo sapiens
accuacaguguaca

SEQ ID NO: 1011648 - RNA, 21 nt, Homo sapiens
accucgagguuucucaaagaa

SEQ ID NO: 1011649 - RNA, 19 nt, Homo sapiens
accugccaggcacacugag

SEQ ID NO: 1011650 - RNA, 14 nt, Homo sapiens
acguaagacugugu

SEQ ID NO: 1011651 - RNA, 20 nt, Homo sapiens
acucuaacaguaguugcaau

SEQ ID NO: 1011652 - RNA, 12 nt, Homo sapiens
acugagccagca

SEQ ID NO: 1011653 - RNA, 16 nt, Homo sapiens
acugcaacuucugccu

SEQ ID NO: 1011654 - RNA, 12 nt, Homo sapiens
acugccaaagaa

SEQ ID NO: 1011655 - RNA, 23 nt, Homo sapiens
acugggacuaaguguaccagaga

SEQ ID NO: 1011656 - RNA, 19 nt, Homo sapiens
acugggcgcaguuggucuu

SEQ ID NO: 1011657 - RNA, 13 nt, Homo sapiens
acuguccaaagac

SEQ ID NO: 1011658 - RNA, 17 nt, Homo sapiens
acuuacuucucugcuau

SEQ ID NO: 1011659 - RNA, 12 nt, Homo sapiens
acuuaguucaag

SEQ ID NO: 1011660 - RNA, 22 nt, Homo sapiens
acuuauagaauucagucaaaga

SEQ ID NO: 1011661 - RNA, 21 nt, Homo sapiens
acuuuuuccuggcucaucucu

SEQ ID NO: 1011662 - RNA, 17 nt, Homo sapiens
agaaaguggcuugaaau

SEQ ID NO: 1011663 - RNA, 13 nt, Homo sapiens
agaagaugaauga

SEQ ID NO: 1011664 - RNA, 18 nt, Homo sapiens
agaagguugagggcaaug

SEQ ID NO: 1011665 - RNA, 23 nt, Homo sapiens
agaagguugagggcaauggacaa

SEQ ID NO: 1011666 - RNA, 14 nt, Homo sapiens
agaauaaauacugu

SEQ ID NO: 1011667 - RNA, 23 nt, Homo sapiens
agaauauuauuggaaaauucucu

SEQ ID NO: 1011668 - RNA, 21 nt, Homo sapiens
agacgugauuuugcuguagaa

SEQ ID NO: 1011669 - RNA, 19 nt, Homo sapiens
agauaaccucaagucacau

SEQ ID NO: 1011670 - RNA, 19 nt, Homo sapiens
agauaaucucuccauuccc

SEQ ID NO: 1011671 - RNA, 17 nt, Homo sapiens
agaugcauccuuucaua

SEQ ID NO: 1011672 - RNA, 22 nt, Homo sapiens
agcaaaaccaaauauuccagag

SEQ ID NO: 1011673 - RNA, 13 nt, Homo sapiens
agcagauaauggu

SEQ ID NO: 1011674 - RNA, 22 nt, Homo sapiens
agcagaugguggagcugaauau

SEQ ID NO: 1011675 - RNA, 13 nt, Homo sapiens
agccucaucucuu

SEQ ID NO: 1011676 - RNA, 16 nt, Homo sapiens
agcuagcaacauuugu

SEQ ID NO: 1011677 - RNA, 22 nt, Homo sapiens
agcuggagucugucaauguccu

SEQ ID NO: 1011678 - RNA, 12 nt, Homo sapiens
aggacuguagaa

SEQ ID NO: 1011679 - RNA, 12 nt, Homo sapiens
aggccagagcaa

SEQ ID NO: 1011680 - RNA, 16 nt, Homo sapiens
aggcuggagugcaaug

SEQ ID NO: 1011681 - RNA, 17 nt, Homo sapiens
agggagugggcuaagca

SEQ ID NO: 1011682 - RNA, 19 nt, Homo sapiens
agggcuuggacucaagcaa

SEQ ID NO: 1011683 - RNA, 21 nt, Homo sapiens
aggucuccagagggugaaagc

SEQ ID NO: 1011684 - RNA, 11 nt, Homo sapiens
aguaagccaug

SEQ ID NO: 1011685 - RNA, 19 nt, Homo sapiens
aguauccugcuucugauau

SEQ ID NO: 1011686 - RNA, 15 nt, Homo sapiens
agucugaacaauaua

SEQ ID NO: 1011687 - RNA, 17 nt, Homo sapiens
agucugucaauguccua

SEQ ID NO: 1011688 - RNA, 16 nt, Homo sapiens
agugauucuccugccu

SEQ ID NO: 1011689 - RNA, 12 nt, Homo sapiens
agugauuuccac

SEQ ID NO: 1011690 - RNA, 11 nt, Homo sapiens
auaaagacagg

SEQ ID NO: 1011691 - RNA, 21 nt, Homo sapiens
auaacauggugugcuucuuaa

SEQ ID NO: 1011692 - RNA, 15 nt, Homo sapiens
auacuagaguucaug

SEQ ID NO: 1011693 - RNA, 18 nt, Homo sapiens
auacugaaccaggccaga

SEQ ID NO: 1011694 - RNA, 23 nt, Homo sapiens
auacuguuuuacuguccaaagac

SEQ ID NO: 1011695 - RNA, 15 nt, Homo sapiens
auagaauucagucaa

SEQ ID NO: 1011696 - RNA, 22 nt, Homo sapiens
auauacuuauagaauucaguca

SEQ ID NO: 1011697 - RNA, 14 nt, Homo sapiens
auaucacauuccca

SEQ ID NO: 1011698 - RNA, 22 nt, Homo sapiens
aucccucaaaacaaucuuguca

SEQ ID NO: 1011699 - RNA, 17 nt, Homo sapiens
auccuggggaacauaga

SEQ ID NO: 1011700 - RNA, 17 nt, Homo sapiens
aucguucucugccucac

SEQ ID NO: 1011701 - RNA, 18 nt, Homo sapiens
aucugaaacagcuucaug

SEQ ID NO: 1011702 - RNA, 13 nt, Homo sapiens
aucugaacuccuu

SEQ ID NO: 1011703 - RNA, 22 nt, Homo sapiens
augaaucaaucaauucauaucu

SEQ ID NO: 1011704 - RNA, 12 nt, Homo sapiens
augacacagucu

SEQ ID NO: 1011705 - RNA, 14 nt, Homo sapiens
auguaucucaggaa

SEQ ID NO: 1011706 - RNA, 21 nt, Homo sapiens
auguccuacugagacagcaca

SEQ ID NO: 1011707 - RNA, 22 nt, Homo sapiens
auuaaauguagaaagugaucca

SEQ ID NO: 1011708 - RNA, 15 nt, Homo sapiens
auucucuagucaguu

SEQ ID NO: 1011709 - RNA, 15 nt, Homo sapiens
auucuguaguuucac

SEQ ID NO: 1011710 - RNA, 17 nt, Homo sapiens
auucuuacauuuuacuu

SEQ ID NO: 1011711 - RNA, 15 nt, Homo sapiens
auugaacuuaugcaa

SEQ ID NO: 1011712 - RNA, 12 nt, Homo sapiens
auugcuugcaca

SEQ ID NO: 1011713 - RNA, 19 nt, Homo sapiens
auuggaccagucagcacag

SEQ ID NO: 1011714 - RNA, 14 nt, Homo sapiens
auuguagcuaugau

SEQ ID NO: 1011715 - RNA, 13 nt, Homo sapiens
auuuacauugccu

SEQ ID NO: 1011716 - RNA, 14 nt, Homo sapiens
auuucuguucuucc

SEQ ID NO: 1011717 - RNA, 20 nt, Homo sapiens
auuugcuuagaaagucugau

SEQ ID NO: 1011718 - RNA, 21 nt, Homo sapiens
auuuuacuuuuuccuggcuca

SEQ ID NO: 1011719 - RNA, 19 nt, Homo sapiens
auuuuauguuuaguugcac

SEQ ID NO: 1011720 - RNA, 11 nt, Homo sapiens
caaaaccaaau

SEQ ID NO: 1011721 - RNA, 19 nt, Homo sapiens
caaaaccaaauauuccaga

SEQ ID NO: 1011722 - RNA, 22 nt, Homo sapiens
caaaaccaaauauuccagagac

SEQ ID NO: 1011723 - RNA, 22 nt, Homo sapiens
caaagaacuuggaaauagugau

SEQ ID NO: 1011724 - RNA, 13 nt, Homo sapiens
caaagaagccagc

SEQ ID NO: 1011725 - RNA, 14 nt, Homo sapiens
caaaguaagccaug

SEQ ID NO: 1011726 - RNA, 17 nt, Homo sapiens
caaauugggccaaagaa

SEQ ID NO: 1011727 - RNA, 16 nt, Homo sapiens
caacauuuguuuuagu

SEQ ID NO: 1011728 - RNA, 14 nt, Homo sapiens
caauagaaauccaa

SEQ ID NO: 1011729 - RNA, 13 nt, Homo sapiens
caaucccucaaaa

SEQ ID NO: 1011730 - RNA, 17 nt, Homo sapiens
caaucuguccuguuaca

SEQ ID NO: 1011731 - RNA, 14 nt, Homo sapiens
cacaaucugaaaca

SEQ ID NO: 1011732 - RNA, 21 nt, Homo sapiens
cacaaucugaaacagcuucau

SEQ ID NO: 1011733 - RNA, 13 nt, Homo sapiens
cacacuguuaaaa

SEQ ID NO: 1011734 - RNA, 22 nt, Homo sapiens
cacagcacaaauuaguuguaua

SEQ ID NO: 1011735 - RNA, 11 nt, Homo sapiens
cacaugcuuuu

SEQ ID NO: 1011736 - RNA, 17 nt, Homo sapiens
cacccucccacugccaa

SEQ ID NO: 1011737 - RNA, 22 nt, Homo sapiens
caccgcgcccagccucaucucu

SEQ ID NO: 1011738 - RNA, 18 nt, Homo sapiens
cacucuguaauugcaaaa

SEQ ID NO: 1011739 - RNA, 13 nt, Homo sapiens
cacugauguauga

SEQ ID NO: 1011740 - RNA, 21 nt, Homo sapiens
cagaaucucucuucuuuucaa

SEQ ID NO: 1011741 - RNA, 21 nt, Homo sapiens
cagagucucgcucuguugccc

SEQ ID NO: 1011742 - RNA, 18 nt, Homo sapiens
cagaguuccgacugccau

SEQ ID NO: 1011743 - RNA, 15 nt, Homo sapiens
cagauuauuauugaa

SEQ ID NO: 1011744 - RNA, 13 nt, Homo sapiens
cagcaucagcuca

SEQ ID NO: 1011745 - RNA, 16 nt, Homo sapiens
cagccagguucugacu

SEQ ID NO: 1011746 - RNA, 20 nt, Homo sapiens
cagccuccugaguagcugga

SEQ ID NO: 1011747 - RNA, 15 nt, Homo sapiens
caggcgugaccugcc

SEQ ID NO: 1011748 - RNA, 20 nt, Homo sapiens
caggcuggagugcaaugaca

SEQ ID NO: 1011749 - RNA, 20 nt, Homo sapiens
caggguuucaccauguuggc

SEQ ID NO: 1011750 - RNA, 19 nt, Homo sapiens
cagucuuggcucacugcaa

SEQ ID NO: 1011751 - RNA, 23 nt, Homo sapiens
caguuggcuaagaagugacucuu

SEQ ID NO: 1011752 - RNA, 21 nt, Homo sapiens
caugucuauuagcuccacaaa

SEQ ID NO: 1011753 - RNA, 24 nt, Homo sapiens
cauguuggccaggcuggucucaaa

SEQ ID NO: 1011754 - RNA, 23 nt, Homo sapiens
cauucugcacucagaaaauggca

SEQ ID NO: 1011755 - RNA, 19 nt, Homo sapiens
cauugcaauagaaauccaa

SEQ ID NO: 1011756 - RNA, 19 nt, Homo sapiens
cauuuaagcugccuguaca

SEQ ID NO: 1011757 - RNA, 22 nt, Homo sapiens
cauuugucaacaaagucaccca

SEQ ID NO: 1011758 - RNA, 18 nt, Homo sapiens
cauuuguuuuagucugaa

SEQ ID NO: 1011759 - RNA, 14 nt, Homo sapiens
ccaaagugguauag

SEQ ID NO: 1011760 - RNA, 17 nt, Homo sapiens
ccaaauauuccagagac

SEQ ID NO: 1011761 - RNA, 14 nt, Homo sapiens
ccaaauuauggcaa

SEQ ID NO: 1011762 - RNA, 15 nt, Homo sapiens
ccaaauuauggcaaa

SEQ ID NO: 1011763 - RNA, 19 nt, Homo sapiens
ccaagcaguuucuuucaaa

SEQ ID NO: 1011764 - RNA, 18 nt, Homo sapiens
ccaaguccacaguggaac

SEQ ID NO: 1011765 - RNA, 19 nt, Homo sapiens
ccacuauugcuugcacaaa

SEQ ID NO: 1011766 - RNA, 14 nt, Homo sapiens
ccacugccaaagaa

SEQ ID NO: 1011767 - RNA, 15 nt, Homo sapiens
ccagagcaaacagaa

SEQ ID NO: 1011768 - RNA, 17 nt, Homo sapiens
ccaggcuggagugcaau

SEQ ID NO: 1011769 - RNA, 21 nt, Homo sapiens
ccauuagcauuugucaacaaa

SEQ ID NO: 1011770 - RNA, 22 nt, Homo sapiens
ccauuagcauuugucaacaaag

SEQ ID NO: 1011771 - RNA, 22 nt, Homo sapiens
ccauuugcuuagaaagucugau

SEQ ID NO: 1011772 - RNA, 21 nt, Homo sapiens
cccacugccaaagaacuugga

SEQ ID NO: 1011773 - RNA, 19 nt, Homo sapiens
cccaggcuggagugcaaug

SEQ ID NO: 1011774 - RNA, 15 nt, Homo sapiens
cccgucgacguagaa

SEQ ID NO: 1011775 - RNA, 23 nt, Homo sapiens
ccuaagccaugggagacacugau

SEQ ID NO: 1011776 - RNA, 22 nt, Homo sapiens
uaugauuguccguaggcccaua

SEQ ID NO: 1011777 - RNA, 12 nt, Homo sapiens
uauuccagagac

SEQ ID NO: 1011778 - RNA, 12 nt, Homo sapiens
uauuuuuacuaa

SEQ ID NO: 1011779 - RNA, 21 nt, Homo sapiens
ucaagugauucuccugccuca

SEQ ID NO: 1011780 - RNA, 17 nt, Homo sapiens
ucaauguccuacugaga

SEQ ID NO: 1011781 - RNA, 18 nt, Homo sapiens
ucagaaaauggcacuugg

SEQ ID NO: 1011782 - RNA, 16 nt, Homo sapiens
ucaggcagaucucagc

SEQ ID NO: 1011783 - RNA, 17 nt, Homo sapiens
uccacagugacuccacu

SEQ ID NO: 1011784 - RNA, 21 nt, Homo sapiens
uccacucaggucuguuuuccg

SEQ ID NO: 1011785 - RNA, 19 nt, Homo sapiens
uccauuuacccuucuuuuc

SEQ ID NO: 1011786 - RNA, 12 nt, Homo sapiens
ucccacugccaa

SEQ ID NO: 1011787 - RNA, 12 nt, Homo sapiens
uccccucuagga

SEQ ID NO: 1011788 - RNA, 22 nt, Homo sapiens
ucccucaaaacaaucuugucau

SEQ ID NO: 1011789 - RNA, 22 nt, Homo sapiens
ucccuucuuuuuguucuucauc

SEQ ID NO: 1011790 - RNA, 15 nt, Homo sapiens
uccugcuucugauau

SEQ ID NO: 1011791 - RNA, 23 nt, Homo sapiens
uccuggggaacauagaacucaug

SEQ ID NO: 1011792 - RNA, 15 nt, Homo sapiens
uccuguuacaaaaga

SEQ ID NO: 1011793 - RNA, 17 nt, Homo sapiens
ucggcucuggccuccaa

SEQ ID NO: 1011794 - RNA, 18 nt, Homo sapiens
ucugcauucucuagucag

SEQ ID NO: 1011795 - RNA, 12 nt, Homo sapiens
ucugcuagggaa

SEQ ID NO: 1011796 - RNA, 22 nt, Homo sapiens
ucuuuaaccacuuuucaauguc

SEQ ID NO: 1011797 - RNA, 14 nt, Homo sapiens
ucuuuggugaacau

SEQ ID NO: 1011798 - RNA, 13 nt, Homo sapiens
ucuuuuugcuuca

SEQ ID NO: 1011799 - RNA, 11 nt, Homo sapiens
ugaacauucca

SEQ ID NO: 1011800 - RNA, 16 nt, Homo sapiens
ugaaguuuaauugacu

SEQ ID NO: 1011801 - RNA, 18 nt, Homo sapiens
ugaaguuuaauugacuua

SEQ ID NO: 1011802 - RNA, 14 nt, Homo sapiens
ugaauaugccacuu

SEQ ID NO: 1011803 - RNA, 16 nt, Homo sapiens
ugaaugccacucugua

SEQ ID NO: 1011804 - RNA, 16 nt, Homo sapiens
ugagacagcacagcca

SEQ ID NO: 1011805 - RNA, 14 nt, Homo sapiens
ugagcaaaaccaaa

SEQ ID NO: 1011806 - RNA, 21 nt, Homo sapiens
ugagcaaaaccaaauauucca

SEQ ID NO: 1011807 - RNA, 19 nt, Homo sapiens
ugagucccagagccaauca

SEQ ID NO: 1011808 - RNA, 23 nt, Homo sapiens
ugauagagguucuuuauugcuca

SEQ ID NO: 1011809 - RNA, 20 nt, Homo sapiens
ugauauguugguagauucua

SEQ ID NO: 1011810 - RNA, 13 nt, Homo sapiens
ugauuguagcuau

SEQ ID NO: 1011811 - RNA, 16 nt, Homo sapiens
ugcaaugacacagucu

SEQ ID NO: 1011812 - RNA, 18 nt, Homo sapiens
ugcaaugacacagucuug

SEQ ID NO: 1011813 - RNA, 15 nt, Homo sapiens
ugcacaaaccaauua

SEQ ID NO: 1011814 - RNA, 21 nt, Homo sapiens
ugcacaaauugggccaaagaa

SEQ ID NO: 1011815 - RNA, 15 nt, Homo sapiens
ugcagccacuguuaa

SEQ ID NO: 1011816 - RNA, 20 nt, Homo sapiens
ugcagccacuguuaagccau

SEQ ID NO: 1011817 - RNA, 16 nt, Homo sapiens
ugccaggcacacugag

SEQ ID NO: 1011818 - RNA, 19 nt, Homo sapiens
ugccaucuuggacuuguca

SEQ ID NO: 1011819 - RNA, 20 nt, Homo sapiens
ugcccaggcuggagugcaau

SEQ ID NO: 1011820 - RNA, 18 nt, Homo sapiens
uggaaauagugauuucca

SEQ ID NO: 1011821 - RNA, 19 nt, Homo sapiens
uggaaauagugauuuccac

SEQ ID NO: 1011822 - RNA, 13 nt, Homo sapiens
uggaaccagccca

SEQ ID NO: 1011823 - RNA, 17 nt, Homo sapiens
uggcacuuauaaccaaa

SEQ ID NO: 1011824 - RNA, 16 nt, Homo sapiens
uggcaggacagcuccu

SEQ ID NO: 1011825 - RNA, 21 nt, Homo sapiens
uggcaguggaacuaagaaagc

SEQ ID NO: 1011826 - RNA, 12 nt, Homo sapiens
uggcucaucucu

SEQ ID NO: 1011827 - RNA, 15 nt, Homo sapiens
uggcuucuuuacuua

SEQ ID NO: 1011828 - RNA, 14 nt, Homo sapiens
ugggagacacugau

SEQ ID NO: 1011829 - RNA, 14 nt, Homo sapiens
ugggauuacaggga

SEQ ID NO: 1011830 - RNA, 20 nt, Homo sapiens
uggggacacagcaucagcuc

SEQ ID NO: 1011831 - RNA, 15 nt, Homo sapiens
ugguuauauguauau

SEQ ID NO: 1011832 - RNA, 12 nt, Homo sapiens
uguaccagagaa

SEQ ID NO: 1011833 - RNA, 18 nt, Homo sapiens
uguagaagauggcacuua

SEQ ID NO: 1011834 - RNA, 19 nt, Homo sapiens
uguauuuaaaugaaaguga

SEQ ID NO: 1011835 - RNA, 21 nt, Homo sapiens
uguauuuaaaugaaagugaga

SEQ ID NO: 1011836 - RNA, 21 nt, Homo sapiens
ugugaccauuagcauuuguca

SEQ ID NO: 1011837 - RNA, 19 nt, Homo sapiens
uguuaagccauguguucca

SEQ ID NO: 1011838 - RNA, 16 nt, Homo sapiens
uguuauacugaaccag

SEQ ID NO: 1011839 - RNA, 22 nt, Homo sapiens
uguuucaaacaaaaagucauaa

SEQ ID NO: 1011840 - RNA, 19 nt, Homo sapiens
uguuuuuaauaaagacagg

SEQ ID NO: 1011841 - RNA, 16 nt, Homo sapiens
uuaaaauagccauaaa

SEQ ID NO: 1011842 - RNA, 18 nt, Homo sapiens
uuaaaccguacacugugu

SEQ ID NO: 1011843 - RNA, 14 nt, Homo sapiens
uuaaacuuacuuag

SEQ ID NO: 1011844 - RNA, 15 nt, Homo sapiens
uuaaaugaaagugag

SEQ ID NO: 1011845 - RNA, 19 nt, Homo sapiens
uuaaauguagaaagugauc

SEQ ID NO: 1011846 - RNA, 12 nt, Homo sapiens
uuaagaaauuca

SEQ ID NO: 1011847 - RNA, 14 nt, Homo sapiens
uuaauaaaaguaca

SEQ ID NO: 1011848 - RNA, 12 nt, Homo sapiens
uuacauugccuu

SEQ ID NO: 1011849 - RNA, 21 nt, Homo sapiens
uuauauguauaucacauuccc

SEQ ID NO: 1011850 - RNA, 14 nt, Homo sapiens
uuauggcaaauuca

SEQ ID NO: 1011851 - RNA, 23 nt, Homo sapiens
uuauucuguaguuucacucucau

SEQ ID NO: 1011852 - RNA, 11 nt, Homo sapiens
uucaagugauu

SEQ ID NO: 1011853 - RNA, 23 nt, Homo sapiens
uucagucaaagauacacaaucug

SEQ ID NO: 1011854 - RNA, 16 nt, Homo sapiens
uuccuccccuguucau

SEQ ID NO: 1011855 - RNA, 13 nt, Homo sapiens
uucuucuuuuugc

SEQ ID NO: 1011856 - RNA, 16 nt, Homo sapiens
uugacauucugaaugc

SEQ ID NO: 1011857 - RNA, 15 nt, Homo sapiens
uugagggcaauggac

SEQ ID NO: 1011858 - RNA, 18 nt, Homo sapiens
uugcaauguggcuugaau

SEQ ID NO: 1011859 - RNA, 22 nt, Homo sapiens
uugcacaaauugggccaaagaa

SEQ ID NO: 1011860 - RNA, 14 nt, Homo sapiens
uugcucacaaaagu

SEQ ID NO: 1011861 - RNA, 19 nt, Homo sapiens
uugcuugcacaaaccaauu

SEQ ID NO: 1011862 - RNA, 20 nt, Homo sapiens
uuguauuuaaaugaaaguga

SEQ ID NO: 1011863 - RNA, 17 nt, Homo sapiens
uuuaaaugaaagugaga

SEQ ID NO: 1011864 - RNA, 18 nt, Homo sapiens
uuuaaaugaaagugagac

SEQ ID NO: 1011865 - RNA, 16 nt, Homo sapiens
uuuacuguccaaagac

SEQ ID NO: 1011866 - RNA, 23 nt, Homo sapiens
uuuauacucaggcagaucucagc

SEQ ID NO: 1011867 - RNA, 12 nt, Homo sapiens
uuucccaaagag

SEQ ID NO: 1011868 - RNA, 15 nt, Homo sapiens
uuuuccuguucuuaa

SEQ ID NO: 1011869 - RNA, 14 nt, Homo sapiens
uuuucuugucuaua

SEQ ID NO: 1011870 - RNA, 20 nt, Homo sapiens
uuuuuacuaaucuuucugca

SEQ ID NO: 1011871 - RNA, 19 nt, Homo sapiens
ccucaaaacaaucuuguca

SEQ ID NO: 1011872 - RNA, 22 nt, Homo sapiens
ccugaccucaaguaauccaccu

SEQ ID NO: 1011873 - RNA, 18 nt, Homo sapiens
ccugccaggcacacugag

SEQ ID NO: 1011874 - RNA, 18 nt, Homo sapiens
cgauuaauaacaggcaaa

SEQ ID NO: 1011875 - RNA, 20 nt, Homo sapiens
cgccacccucccacugccaa

SEQ ID NO: 1011876 - RNA, 16 nt, Homo sapiens
cuaaauaugagcccag

SEQ ID NO: 1011877 - RNA, 15 nt, Homo sapiens
cuaacaguaguugca

SEQ ID NO: 1011878 - RNA, 16 nt, Homo sapiens
cuaacaguaguugcaa

SEQ ID NO: 1011879 - RNA, 21 nt, Homo sapiens
cuaagaagcagauaauggugu

SEQ ID NO: 1011880 - RNA, 20 nt, Homo sapiens
cuaagcacgggccauaugaa

SEQ ID NO: 1011881 - RNA, 13 nt, Homo sapiens
cuaaguaaauaca

SEQ ID NO: 1011882 - RNA, 16 nt, Homo sapiens
cuaaguguaccagaga

SEQ ID NO: 1011883 - RNA, 14 nt, Homo sapiens
cuagucaguuggcu

SEQ ID NO: 1011884 - RNA, 20 nt, Homo sapiens
cuauaaaaugagaagucuca

SEQ ID NO: 1011885 - RNA, 18 nt, Homo sapiens
cuauaagaugaaacauca

SEQ ID NO: 1011886 - RNA, 20 nt, Homo sapiens
cuauaagaugaaacaucauu

SEQ ID NO: 1011887 - RNA, 16 nt, Homo sapiens
cuauuagcuccacaaa

SEQ ID NO: 1011888 - RNA, 18 nt, Homo sapiens
cuauuuuuuguaaugugu

SEQ ID NO: 1011889 - RNA, 16 nt, Homo sapiens
cucaaagaaauuucca

SEQ ID NO: 1011890 - RNA, 18 nt, Homo sapiens
cucaaagaaauuuccacu

SEQ ID NO: 1011891 - RNA, 15 nt, Homo sapiens
cucaggcagaucuca

SEQ ID NO: 1011892 - RNA, 18 nt, Homo sapiens
cucccagccagguucuga

SEQ ID NO: 1011893 - RNA, 19 nt, Homo sapiens
cuccugaguagcuggauua

SEQ ID NO: 1011894 - RNA, 20 nt, Homo sapiens
cucgugguaggacuguagaa

SEQ ID NO: 1011895 - RNA, 20 nt, Homo sapiens
cucuuggguucaagugauuc

SEQ ID NO: 1011896 - RNA, 15 nt, Homo sapiens
cugaccaauauugua

SEQ ID NO: 1011897 - RNA, 20 nt, Homo sapiens
cugaccaauauuguacaguu

SEQ ID NO: 1011898 - RNA, 21 nt, Homo sapiens
cugaccaauauuguacaguuu

SEQ ID NO: 1011899 - RNA, 17 nt, Homo sapiens
cugauguagcuuauaca

SEQ ID NO: 1011900 - RNA, 19 nt, Homo sapiens
cugauguagcuuauacaaa

SEQ ID NO: 1011901 - RNA, 17 nt, Homo sapiens
cugcuagggaauaucaa

SEQ ID NO: 1011902 - RNA, 16 nt, Homo sapiens
cuggcaagaugcuuua

SEQ ID NO: 1011903 - RNA, 13 nt, Homo sapiens
cuggcucaucucu

SEQ ID NO: 1011904 - RNA, 22 nt, Homo sapiens
cuguagaaaagggaacugaaca

SEQ ID NO: 1011905 - RNA, 17 nt, Homo sapiens
cuguaugucucguggua

SEQ ID NO: 1011906 - RNA, 12 nt, Homo sapiens
cuguccaaagac

SEQ ID NO: 1011907 - RNA, 16 nt, Homo sapiens
cuuaaaauagccauaa

SEQ ID NO: 1011908 - RNA, 22 nt, Homo sapiens
cuuaagacgugauuuugcugua

SEQ ID NO: 1011909 - RNA, 18 nt, Homo sapiens
cuuagagcuuuaccuaaa

SEQ ID NO: 1011910 - RNA, 23 nt, Homo sapiens
cuuccuccccuguucauucugca

SEQ ID NO: 1011911 - RNA, 23 nt, Homo sapiens
cuucucugcuaucuagaucugaa

SEQ ID NO: 1011912 - RNA, 18 nt, Homo sapiens
cuucuuuacuuaguucaa

SEQ ID NO: 1011913 - RNA, 19 nt, Homo sapiens
cuuuaccuaaauaugagcc

SEQ ID NO: 1011914 - RNA, 15 nt, Homo sapiens
cuuuauacucaggca

SEQ ID NO: 1011915 - RNA, 18 nt, Homo sapiens
cuuucccuuaaauaacac

SEQ ID NO: 1011916 - RNA, 15 nt, Homo sapiens
cuuuuuauacuauua

SEQ ID NO: 1011917 - RNA, 18 nt, Homo sapiens
cuuuuuuuuaaguuacac

SEQ ID NO: 1011918 - RNA, 10 nt, Homo sapiens
gaaaacagaa

SEQ ID NO: 1011919 - RNA, 23 nt, Homo sapiens
gaaaugcugguuuuucaguuuuc

SEQ ID NO: 1011920 - RNA, 20 nt, Homo sapiens
gaacguuuuuccuguucuua

SEQ ID NO: 1011921 - RNA, 16 nt, Homo sapiens
gaacugaacauuccag

SEQ ID NO: 1011922 - RNA, 16 nt, Homo sapiens
gaaguuuucuugacuu

SEQ ID NO: 1011923 - RNA, 19 nt, Homo sapiens
gaaugagcaaaaccaaaua

SEQ ID NO: 1011924 - RNA, 20 nt, Homo sapiens
gacagcuccuggaccaggcc

SEQ ID NO: 1011925 - RNA, 19 nt, Homo sapiens
gaccugccaggcacacuga

SEQ ID NO: 1011926 - RNA, 20 nt, Homo sapiens
gaccugccaggcacacugag

SEQ ID NO: 1011927 - RNA, 16 nt, Homo sapiens
gacucaucauuuccau

SEQ ID NO: 1011928 - RNA, 22 nt, Homo sapiens
gacucuauuaaaaucuucaaua

SEQ ID NO: 1011929 - RNA, 12 nt, Homo sapiens
gagcaaacagaa

SEQ ID NO: 1011930 - RNA, 13 nt, Homo sapiens
gagcaaacagaaa

SEQ ID NO: 1011931 - RNA, 15 nt, Homo sapiens
gagcuccuaagccau

SEQ ID NO: 1011932 - RNA, 15 nt, Homo sapiens
gagggaacuguguag

SEQ ID NO: 1011933 - RNA, 19 nt, Homo sapiens
gaguacaaaguaagccaug

SEQ ID NO: 1011934 - RNA, 15 nt, Homo sapiens
gagugggcuaagcac

SEQ ID NO: 1011935 - RNA, 13 nt, Homo sapiens
gauacgacaacuu

SEQ ID NO: 1011936 - RNA, 21 nt, Homo sapiens
gauaggguuucuaaugguuau

SEQ ID NO: 1011937 - RNA, 23 nt, Homo sapiens
gauauguuauacugaaccaggcc

SEQ ID NO: 1011938 - RNA, 18 nt, Homo sapiens
gaucguucucugccucac

SEQ ID NO: 1011939 - RNA, 17 nt, Homo sapiens
gaugcuggggacacagc

SEQ ID NO: 1011940 - RNA, 15 nt, Homo sapiens
gauucuccugccuca

SEQ ID NO: 1011941 - RNA, 12 nt, Homo sapiens
gcaaaaccaaau

SEQ ID NO: 1011942 - RNA, 16 nt, Homo sapiens
gcaauagaaauccaau

SEQ ID NO: 1011943 - RNA, 20 nt, Homo sapiens
gcacaaauugggccaaagaa

SEQ ID NO: 1011944 - RNA, 16 nt, Homo sapiens
gcagaguacaaaguaa

SEQ ID NO: 1011945 - RNA, 15 nt, Homo sapiens
gccccagccuaggaa

SEQ ID NO: 1011946 - RNA, 11 nt, Homo sapiens
gccucaucucu

SEQ ID NO: 1011947 - RNA, 15 nt, Homo sapiens
gcuaguaaaagccau

SEQ ID NO: 1011948 - RNA, 13 nt, Homo sapiens
gcugggauuacag

SEQ ID NO: 1011949 - RNA, 19 nt, Homo sapiens
gcuucuuugaaacuuguau

SEQ ID NO: 1011950 - RNA, 12 nt, Homo sapiens
ggaaaauucucu

SEQ ID NO: 1011951 - RNA, 18 nt, Homo sapiens
ggaaauagugauuuccac

SEQ ID NO: 1011952 - RNA, 18 nt, Homo sapiens
ggaacuaagaaagcccuu

SEQ ID NO: 1011953 - RNA, 19 nt, Homo sapiens
ggaauuucuguucuuccau

SEQ ID NO: 1011954 - RNA, 24 nt, Homo sapiens
ggacagcuccuggaccaggcccau

SEQ ID NO: 1011955 - RNA, 22 nt, Homo sapiens
ggagaaauaugguacucauuaa

SEQ ID NO: 1011956 - RNA, 22 nt, Homo sapiens
ggagucuuagagcuuuaccuaa

SEQ ID NO: 1011957 - RNA, 13 nt, Homo sapiens
ggauuacagggau

SEQ ID NO: 1011958 - RNA, 23 nt, Homo sapiens
ggcagaguacaaaguaagccaug

SEQ ID NO: 1011959 - RNA, 13 nt, Homo sapiens
ggcaggacagcuc

SEQ ID NO: 1011960 - RNA, 22 nt, Homo sapiens
ggcuaagaagugacucuugcaa

SEQ ID NO: 1011961 - RNA, 17 nt, Homo sapiens
ggcuaguaaaagccauc

SEQ ID NO: 1011962 - RNA, 15 nt, Homo sapiens
ggcuggagugcaaug

SEQ ID NO: 1011963 - RNA, 21 nt, Homo sapiens
ggggacacagcaucagcucaa

SEQ ID NO: 1011964 - RNA, 22 nt, Homo sapiens
gguacaguauggggguuguaaa

SEQ ID NO: 1011965 - RNA, 13 nt, Homo sapiens
gguuauauguaua

SEQ ID NO: 1011966 - RNA, 13 nt, Homo sapiens
gguucaagugauu

SEQ ID NO: 1011967 - RNA, 13 nt, Homo sapiens
guaagacugugua

SEQ ID NO: 1011968 - RNA, 22 nt, Homo sapiens
guaagaucguucucugccucac

SEQ ID NO: 1011969 - RNA, 12 nt, Homo sapiens
guacacuguguu

SEQ ID NO: 1011970 - RNA, 17 nt, Homo sapiens
guacauguuaaacuuac

SEQ ID NO: 1011971 - RNA, 15 nt, Homo sapiens
guaggugguuuugaa

SEQ ID NO: 1011972 - RNA, 21 nt, Homo sapiens
guauaguuaaccacuaccgaa

SEQ ID NO: 1011973 - RNA, 17 nt, Homo sapiens
gucaauguccuacugag

SEQ ID NO: 1011974 - RNA, 20 nt, Homo sapiens
gucagaguuccgacugccau

SEQ ID NO: 1011975 - RNA, 14 nt, Homo sapiens
gucauaacuagaac

SEQ ID NO: 1011976 - RNA, 23 nt, Homo sapiens
gucucauaaugcauguggcacuu

SEQ ID NO: 1011977 - RNA, 20 nt, Homo sapiens
gucugaacaauauauacuua

SEQ ID NO: 1011978 - RNA, 22 nt, Homo sapiens
gucuuggcucacugcaacuucu

SEQ ID NO: 1011979 - RNA, 13 nt, Homo sapiens
gucuuguguuucu

SEQ ID NO: 1011980 - RNA, 21 nt, Homo sapiens
gucuuuggugaacauugcaau

SEQ ID NO: 1011981 - RNA, 15 nt, Homo sapiens
gugagaggacucuga

SEQ ID NO: 1011982 - RNA, 13 nt, Homo sapiens
gugauauguuggu

SEQ ID NO: 1011983 - RNA, 23 nt, Homo sapiens
guucauggauauguuauacugaa

SEQ ID NO: 1011984 - RNA, 14 nt, Homo sapiens
guuccgacugccau

SEQ ID NO: 1011985 - RNA, 13 nt, Homo sapiens
guucucugccuca

SEQ ID NO: 1011986 - RNA, 17 nt, Homo sapiens
guucugguuacuguucu

SEQ ID NO: 1011987 - RNA, 21 nt, Homo sapiens
guuguuaauaaaaguacaugu

SEQ ID NO: 1011988 - RNA, 18 nt, Homo sapiens
guuuacauuuuguauauu

SEQ ID NO: 1011989 - RNA, 22 nt, Homo sapiens
guuucauauugaugugugucua

SEQ ID NO: 1011990 - RNA, 23 nt, Homo sapiens
uaaaaaaaaaaaaaaaagugaug

SEQ ID NO: 1011991 - RNA, 21 nt, Homo sapiens
uaaaauaaucaguguuuccaa

SEQ ID NO: 1011992 - RNA, 16 nt, Homo sapiens
uaaaccguacacugug

SEQ ID NO: 1011993 - RNA, 17 nt, Homo sapiens
uaaaccguacacugugu

SEQ ID NO: 1011994 - RNA, 17 nt, Homo sapiens
uaaauauagcucaggua

SEQ ID NO: 1011995 - RNA, 22 nt, Homo sapiens
uaaauuucucuacugucucagu

SEQ ID NO: 1011996 - RNA, 17 nt, Homo sapiens
uaacaggagugccacuu

SEQ ID NO: 1011997 - RNA, 21 nt, Homo sapiens
uaagaucguucucugccucac

SEQ ID NO: 1011998 - RNA, 22 nt, Homo sapiens
uaagcugccuguacacaacuca

SEQ ID NO: 1011999 - RNA, 13 nt, Homo sapiens
uaauaaagacagg

SEQ ID NO: 1012000 - RNA, 20 nt, Homo sapiens
uacaguuuuuauugcuuguu

SEQ ID NO: 1012001 - RNA, 20 nt, Homo sapiens
uacccguuucacaugcuuuu

SEQ ID NO: 1012002 - RNA, 16 nt, Homo sapiens
uagaaaagggaacuga

SEQ ID NO: 1012003 - RNA, 14 nt, Homo sapiens
uagaauucagucaa

SEQ ID NO: 1012004 - RNA, 20 nt, Homo sapiens
uagauaaucucuccauuccc

SEQ ID NO: 1012005 - RNA, 19 nt, Homo sapiens
uagcggggaggggguuauc

SEQ ID NO: 1012006 - RNA, 19 nt, Homo sapiens
uagugauuuccacagugac

SEQ ID NO: 1012007 - RNA, 21 nt, Homo sapiens
uaguggugacugugggcucca

SEQ ID NO: 1012008 - RNA, 16 nt, Homo sapiens
uauaaaagacugacca

SEQ ID NO: 1012009 - RNA, 15 nt, Homo sapiens
uaucuaaaaucugcu

SEQ ID NO: 1012010 - RNA, 12 nt, Homo sapiens
aaaaaaaauccc

SEQ ID NO: 1012011 - RNA, 22 nt, Homo sapiens
aaaaaaaccaaaacugugcaga

SEQ ID NO: 1012012 - RNA, 12 nt, Homo sapiens
aaaaaaagccaa

SEQ ID NO: 1012013 - RNA, 21 nt, Homo sapiens
aaaaaaauuuuauagugucuu

SEQ ID NO: 1012014 - RNA, 17 nt, Homo sapiens
aagaaacccagacugaa

SEQ ID NO: 1012015 - RNA, 22 nt, Homo sapiens
aagaaacgucuauguguacaga

SEQ ID NO: 1012016 - RNA, 14 nt, Homo sapiens
aagaaauacuguac

SEQ ID NO: 1012017 - RNA, 16 nt, Homo sapiens
aagaaauuaugucagc

SEQ ID NO: 1012018 - RNA, 14 nt, Homo sapiens
aagaaauuuuugcc

SEQ ID NO: 1012019 - RNA, 17 nt, Homo sapiens
aagaacaguccauugaa

SEQ ID NO: 1012020 - RNA, 16 nt, Homo sapiens
aagaacaucuuuaugg

SEQ ID NO: 1012021 - RNA, 18 nt, Homo sapiens
aagaacucugggcugcua

SEQ ID NO: 1012022 - RNA, 16 nt, Homo sapiens
aagaacugaagcucuu

SEQ ID NO: 1012023 - RNA, 20 nt, Homo sapiens
aagaacugacuagugagaug

SEQ ID NO: 1012024 - RNA, 17 nt, Homo sapiens
aagaacugcuuucuuuc

SEQ ID NO: 1012025 - RNA, 20 nt, Homo sapiens
aagaagaaacgucuaugugu

SEQ ID NO: 1012026 - RNA, 22 nt, Homo sapiens
aagaagaggagaaaaaaacuuc

SEQ ID NO: 1012027 - RNA, 14 nt, Homo sapiens
aagaagauggauug

SEQ ID NO: 1012028 - RNA, 22 nt, Homo sapiens
aagaagcccaggaaaggcucca

SEQ ID NO: 1012029 - RNA, 13 nt, Homo sapiens
aagaagcuugaau

SEQ ID NO: 1012030 - RNA, 18 nt, Homo sapiens
aagaagcuuucaguauua

SEQ ID NO: 1012031 - RNA, 14 nt, Homo sapiens
aagaagugccaguu

SEQ ID NO: 1012032 - RNA, 21 nt, Homo sapiens
aagaauaaaauugcacuuuua

SEQ ID NO: 1012033 - RNA, 13 nt, Homo sapiens
aagaauacagaaa

SEQ ID NO: 1012034 - RNA, 13 nt, Homo sapiens
aagaaucuaauag

SEQ ID NO: 1012035 - RNA, 17 nt, Homo sapiens
aagaaugaauaauaauu

SEQ ID NO: 1012036 - RNA, 16 nt, Homo sapiens
aagaaugacuaugcaa

SEQ ID NO: 1012037 - RNA, 12 nt, Homo sapiens
aagaaugcucuu

SEQ ID NO: 1012038 - RNA, 18 nt, Homo sapiens
aagaauguguuuaaacuu

SEQ ID NO: 1012039 - RNA, 19 nt, Homo sapiens
aagaauuuuguauuuucau

SEQ ID NO: 1012040 - RNA, 17 nt, Homo sapiens
aagacaccagagcagau

SEQ ID NO: 1012041 - RNA, 16 nt, Homo sapiens
aagacagagcugggau

SEQ ID NO: 1012042 - RNA, 21 nt, Homo sapiens
aagacauaaacccaguugcca

SEQ ID NO: 1012043 - RNA, 13 nt, Homo sapiens
aagacaugaacca

SEQ ID NO: 1012044 - RNA, 14 nt, Homo sapiens
aagaccaaagcaga

SEQ ID NO: 1012045 - RNA, 13 nt, Homo sapiens
aagaccagacugu

SEQ ID NO: 1012046 - RNA, 11 nt, Homo sapiens
aagaccagcuu

SEQ ID NO: 1012047 - RNA, 19 nt, Homo sapiens
aagaccagcuuugcaguga

SEQ ID NO: 1012048 - RNA, 21 nt, Homo sapiens
aagaccagcuuugcagugaca

SEQ ID NO: 1012049 - RNA, 22 nt, Homo sapiens
aagaccauaacagccaacaggu

SEQ ID NO: 1012050 - RNA, 22 nt, Homo sapiens
aagaccucgagcagaugaugcc

SEQ ID NO: 1012051 - RNA, 22 nt, Homo sapiens
aagaccugcugagggaccagcc

SEQ ID NO: 1012052 - RNA, 21 nt, Homo sapiens
aagacuaaucgaaugaacaaa

SEQ ID NO: 1012053 - RNA, 23 nt, Homo sapiens
aagacuauaaaaaaaugcauuua

SEQ ID NO: 1012054 - RNA, 14 nt, Homo sapiens
aagacuauucaaac

SEQ ID NO: 1012055 - RNA, 20 nt, Homo sapiens
aagacuauucaaacagucuc

SEQ ID NO: 1012056 - RNA, 18 nt, Homo sapiens
aagacuauucccuucuaa

SEQ ID NO: 1012057 - RNA, 23 nt, Homo sapiens
aagacugagcucaaggugggaac

SEQ ID NO: 1012058 - RNA, 18 nt, Homo sapiens
aagacugucagcuuccaa

SEQ ID NO: 1012059 - RNA, 19 nt, Homo sapiens
aagacugucagcuuccaaa

SEQ ID NO: 1012060 - RNA, 22 nt, Homo sapiens
aagacuguggcugcuagcacuu

SEQ ID NO: 1012061 - RNA, 15 nt, Homo sapiens
aagacuuaacugguu

SEQ ID NO: 1012062 - RNA, 17 nt, Homo sapiens
aagacuuaucaacauuu

SEQ ID NO: 1012063 - RNA, 16 nt, Homo sapiens
aagagaaccauaucaa

SEQ ID NO: 1012064 - RNA, 16 nt, Homo sapiens
aagagaaccgagcaaa

SEQ ID NO: 1012065 - RNA, 18 nt, Homo sapiens
aagagaaccgagcaaaga

SEQ ID NO: 1012066 - RNA, 21 nt, Homo sapiens
aagagacaugcugacuuucau

SEQ ID NO: 1012067 - RNA, 22 nt, Homo sapiens
aagagagcaacauuuuacccac

SEQ ID NO: 1012068 - RNA, 21 nt, Homo sapiens
aagagaggaaugccuguguga

SEQ ID NO: 1012069 - RNA, 23 nt, Homo sapiens
agcuccuucuguccuacucugug

SEQ ID NO: 1012070 - RNA, 14 nt, Homo sapiens
agcuccuugacucc

SEQ ID NO: 1012071 - RNA, 20 nt, Homo sapiens
agcucgggcccucugugaga

SEQ ID NO: 1012072 - RNA, 15 nt, Homo sapiens
agcucuccccucaga

SEQ ID NO: 1012073 - RNA, 23 nt, Homo sapiens
agcucuccccucagagugcaagc

SEQ ID NO: 1012074 - RNA, 20 nt, Homo sapiens
agcucugaaaccaguguuag

SEQ ID NO: 1012075 - RNA, 15 nt, Homo sapiens
agcucuggaccagcc

SEQ ID NO: 1012076 - RNA, 19 nt, Homo sapiens
agcucuggugacaccagcc

SEQ ID NO: 1012077 - RNA, 19 nt, Homo sapiens
agcucuguuuuacaauaaa

SEQ ID NO: 1012078 - RNA, 20 nt, Homo sapiens
agcucuuacacuacauuaga

SEQ ID NO: 1012079 - RNA, 13 nt, Homo sapiens
agcugaaccuggg

SEQ ID NO: 1012080 - RNA, 19 nt, Homo sapiens
agcugaagugcauccaaag

SEQ ID NO: 1012081 - RNA, 19 nt, Homo sapiens
agcugaagugccuugugaa

SEQ ID NO: 1012082 - RNA, 17 nt, Homo sapiens
agcugaauuauuggaca

SEQ ID NO: 1012083 - RNA, 15 nt, Homo sapiens
agcugagagacuuuu

SEQ ID NO: 1012084 - RNA, 15 nt, Homo sapiens
agcugagauuccugg

SEQ ID NO: 1012085 - RNA, 22 nt, Homo sapiens
agcugagauugugccacuucac

SEQ ID NO: 1012086 - RNA, 23 nt, Homo sapiens
agcugauugggcaccugaccaca

SEQ ID NO: 1012087 - RNA, 14 nt, Homo sapiens
agcugcaccugcca

SEQ ID NO: 1012088 - RNA, 20 nt, Homo sapiens
agcugcaugggugccugcug

SEQ ID NO: 1012089 - RNA, 17 nt, Homo sapiens
agcugccugcuuuucac

SEQ ID NO: 1012090 - RNA, 20 nt, Homo sapiens
agcugccugcuuuucacugc

SEQ ID NO: 1012091 - RNA, 21 nt, Homo sapiens
agcugccugcuuuucacugcu

SEQ ID NO: 1012092 - RNA, 18 nt, Homo sapiens
agcuggaaaaaguguccu

SEQ ID NO: 1012093 - RNA, 17 nt, Homo sapiens
agcuggaaaagggucuu

SEQ ID NO: 1012094 - RNA, 22 nt, Homo sapiens
agcuggagccaacagauguguc

SEQ ID NO: 1012095 - RNA, 23 nt, Homo sapiens
agcuggaggacuagaaccuggag

SEQ ID NO: 1012096 - RNA, 19 nt, Homo sapiens
agcuggagggaccuugucu

SEQ ID NO: 1012097 - RNA, 20 nt, Homo sapiens
agcuggagggaccuugucuc

SEQ ID NO: 1012098 - RNA, 13 nt, Homo sapiens
agcuggauuuccu

SEQ ID NO: 1012099 - RNA, 23 nt, Homo sapiens
agcuggauuuccuaggcugacua

SEQ ID NO: 1012100 - RNA, 23 nt, Homo sapiens
agcuggcgaacccugggccaucc

SEQ ID NO: 1012101 - RNA, 22 nt, Homo sapiens
agcuggcgucaugcaaagucau

SEQ ID NO: 1012102 - RNA, 23 nt, Homo sapiens
agcugggaccacacagacagggu

SEQ ID NO: 1012103 - RNA, 17 nt, Homo sapiens
agcugggacuacagggg

SEQ ID NO: 1012104 - RNA, 14 nt, Homo sapiens
agcugggagcacag

SEQ ID NO: 1012105 - RNA, 22 nt, Homo sapiens
agcugggauaaucacauuauca

SEQ ID NO: 1012106 - RNA, 16 nt, Homo sapiens
agcugggcagaccccu

SEQ ID NO: 1012107 - RNA, 19 nt, Homo sapiens
agcuggggaugucucucau

SEQ ID NO: 1012108 - RNA, 21 nt, Homo sapiens
agcuggguuggaaaacaguau

SEQ ID NO: 1012109 - RNA, 14 nt, Homo sapiens
agcugguaaacuau

SEQ ID NO: 1012110 - RNA, 18 nt, Homo sapiens
agcugguaaacuauuugu

SEQ ID NO: 1012111 - RNA, 16 nt, Homo sapiens
agcuggugguaucuga

SEQ ID NO: 1012112 - RNA, 20 nt, Homo sapiens
agcuggugguaucugaguug

SEQ ID NO: 1012113 - RNA, 20 nt, Homo sapiens
agcuggugguuucacggugc

SEQ ID NO: 1012114 - RNA, 17 nt, Homo sapiens
agcugucaggcugauua

SEQ ID NO: 1012115 - RNA, 18 nt, Homo sapiens
agcugucaggcugauuau

SEQ ID NO: 1012116 - RNA, 20 nt, Homo sapiens
agcuguccccugacccagag

SEQ ID NO: 1012117 - RNA, 12 nt, Homo sapiens
agcugucugcuc

SEQ ID NO: 1012118 - RNA, 15 nt, Homo sapiens
agcugugacuucucc

SEQ ID NO: 1012119 - RNA, 19 nt, Homo sapiens
agcugugacuucuccaggu

SEQ ID NO: 1012120 - RNA, 13 nt, Homo sapiens
agcuguucagcug

SEQ ID NO: 1012121 - RNA, 21 nt, Homo sapiens
agcuguuucaccaucagucaa

SEQ ID NO: 1012122 - RNA, 14 nt, Homo sapiens
agcuguuuccauag

SEQ ID NO: 1012123 - RNA, 21 nt, Homo sapiens
agcuuaauggcucaugaccug

SEQ ID NO: 1012124 - RNA, 20 nt, Homo sapiens
agcuuacaagccagcuggag

SEQ ID NO: 1012125 - RNA, 13 nt, Homo sapiens
agcuuagaccuca

SEQ ID NO: 1012126 - RNA, 22 nt, Homo sapiens
agcuuauaaaaucaaacagaga

SEQ ID NO: 1012127 - RNA, 23 nt, Homo sapiens
agcuucaccuuuuugucuuggcu

SEQ ID NO: 1012128 - RNA, 21 nt, Homo sapiens
agcuucauauaccagcaauau

SEQ ID NO: 1012129 - RNA, 17 nt, Homo sapiens
agcuuccgccgucucaa

SEQ ID NO: 1012130 - RNA, 22 nt, Homo sapiens
agcuuggaaacuggaugagguc

SEQ ID NO: 1012131 - RNA, 16 nt, Homo sapiens
agcuuuaaacucaggg

SEQ ID NO: 1012132 - RNA, 21 nt, Homo sapiens
agcuuuaaacucagggacaga

SEQ ID NO: 1012133 - RNA, 14 nt, Homo sapiens
agcuuuauucuuca

SEQ ID NO: 1012134 - RNA, 22 nt, Homo sapiens
agcuuucccugccucucaucaa

SEQ ID NO: 1012135 - RNA, 19 nt, Homo sapiens
agcuuuccucaucaggcca

SEQ ID NO: 1012136 - RNA, 20 nt, Homo sapiens
agcuuugaugauaaacacug

SEQ ID NO: 1012137 - RNA, 12 nt, Homo sapiens
agcuuugcucuu

SEQ ID NO: 1012138 - RNA, 21 nt, Homo sapiens
agcuuugcuuccgacaccucu

SEQ ID NO: 1012139 - RNA, 15 nt, Homo sapiens
agcuuuggaccuaau

SEQ ID NO: 1012140 - RNA, 19 nt, Homo sapiens
agcuuuggaccuaauccaa

SEQ ID NO: 1012141 - RNA, 16 nt, Homo sapiens
agcuuugugacuguau

SEQ ID NO: 1012142 - RNA, 19 nt, Homo sapiens
agcuuuuccugauguucca

SEQ ID NO: 1012143 - RNA, 15 nt, Homo sapiens
aggaaaaaaaugacu

SEQ ID NO: 1012144 - RNA, 17 nt, Homo sapiens
aggaaaaucugcacugu

SEQ ID NO: 1012145 - RNA, 17 nt, Homo sapiens
aggaaacaacagcuuua

SEQ ID NO: 1012146 - RNA, 13 nt, Homo sapiens
aggaaacaguuaa

SEQ ID NO: 1012147 - RNA, 14 nt, Homo sapiens
aggaaaccacagcu

SEQ ID NO: 1012148 - RNA, 15 nt, Homo sapiens
aggaaaccacagcug

SEQ ID NO: 1012149 - RNA, 13 nt, Homo sapiens
aggaaagcaauaa

SEQ ID NO: 1012150 - RNA, 14 nt, Homo sapiens
aggaaaggcuccag

SEQ ID NO: 1012151 - RNA, 18 nt, Homo sapiens
aggaaagggauaguccaa

SEQ ID NO: 1012152 - RNA, 15 nt, Homo sapiens
aggaaauaaaguaua

SEQ ID NO: 1012153 - RNA, 22 nt, Homo sapiens
aggaaauaccaguucugggcaa

SEQ ID NO: 1012154 - RNA, 18 nt, Homo sapiens
aggaaauauauaugugug

SEQ ID NO: 1012155 - RNA, 21 nt, Homo sapiens
aggaaaugaaugaucuuggcu

SEQ ID NO: 1012156 - RNA, 19 nt, Homo sapiens
aggaaauggcuuugugauu

SEQ ID NO: 1012157 - RNA, 22 nt, Homo sapiens
aggaacugggccaacucaccug

SEQ ID NO: 1012158 - RNA, 22 nt, Homo sapiens
aggaagaccaagacacagauca

SEQ ID NO: 1012159 - RNA, 18 nt, Homo sapiens
aggaagcaccccaugcca

SEQ ID NO: 1012160 - RNA, 12 nt, Homo sapiens
aggaagcucagg

SEQ ID NO: 1012161 - RNA, 21 nt, Homo sapiens
aggaaggaaagaaagaaggaa

SEQ ID NO: 1012162 - RNA, 14 nt, Homo sapiens
aggaaggaugagca

SEQ ID NO: 1012163 - RNA, 20 nt, Homo sapiens
aggaaggcucuucuccccag

SEQ ID NO: 1012164 - RNA, 21 nt, Homo sapiens
aggaagguagaaauaucugaa

SEQ ID NO: 1012165 - RNA, 18 nt, Homo sapiens
aggaaguaugguuuuauu

SEQ ID NO: 1012166 - RNA, 18 nt, Homo sapiens
agcauuucuagcagugau

SEQ ID NO: 1012167 - RNA, 15 nt, Homo sapiens
agccaaacucugcca

SEQ ID NO: 1012168 - RNA, 24 nt, Homo sapiens
agccaaagccaauaacacacagcu

SEQ ID NO: 1012169 - RNA, 23 nt, Homo sapiens
agccaaauaaaaucuauacauac

SEQ ID NO: 1012170 - RNA, 15 nt, Homo sapiens
agccaaaugcauggu

SEQ ID NO: 1012171 - RNA, 13 nt, Homo sapiens
agccaaauguaau

SEQ ID NO: 1012172 - RNA, 17 nt, Homo sapiens
agccaacacccugucua

SEQ ID NO: 1012173 - RNA, 15 nt, Homo sapiens
agccaaccccugugg

SEQ ID NO: 1012174 - RNA, 14 nt, Homo sapiens
agccaacuuuugca

SEQ ID NO: 1012175 - RNA, 23 nt, Homo sapiens
agccaacuuuugcauguuuugua

SEQ ID NO: 1012176 - RNA, 19 nt, Homo sapiens
agccaagaucacgccauug

SEQ ID NO: 1012177 - RNA, 18 nt, Homo sapiens
agccaagaucccaucucu

SEQ ID NO: 1012178 - RNA, 20 nt, Homo sapiens
agccaagaucgcaccacugc

SEQ ID NO: 1012179 - RNA, 13 nt, Homo sapiens
agccaagcacagu

SEQ ID NO: 1012180 - RNA, 11 nt, Homo sapiens
agccaagggau

SEQ ID NO: 1012181 - RNA, 18 nt, Homo sapiens
agccaaguuuauauacaa

SEQ ID NO: 1012182 - RNA, 15 nt, Homo sapiens
agccacaaccaaaaa

SEQ ID NO: 1012183 - RNA, 19 nt, Homo sapiens
agccacacaaacguuuacu

SEQ ID NO: 1012184 - RNA, 22 nt, Homo sapiens
agccacacucugggcuccagag

SEQ ID NO: 1012185 - RNA, 15 nt, Homo sapiens
agccacagaagccag

SEQ ID NO: 1012186 - RNA, 24 nt, Homo sapiens
agccacaguuuccucaucugucca

SEQ ID NO: 1012187 - RNA, 19 nt, Homo sapiens
agccacaucccuuugaaac

SEQ ID NO: 1012188 - RNA, 15 nt, Homo sapiens
agccaccacauuuag

SEQ ID NO: 1012189 - RNA, 18 nt, Homo sapiens
agccacccuguguugaca

SEQ ID NO: 1012190 - RNA, 23 nt, Homo sapiens
agccaccgcgccuggccaggcug

SEQ ID NO: 1012191 - RNA, 16 nt, Homo sapiens
agccaccucucccuca

SEQ ID NO: 1012192 - RNA, 14 nt, Homo sapiens
agccacuucacuuu

SEQ ID NO: 1012193 - RNA, 23 nt, Homo sapiens
agccagaaaaacguguugccuug

SEQ ID NO: 1012194 - RNA, 14 nt, Homo sapiens
agccagaagcugag

SEQ ID NO: 1012195 - RNA, 11 nt, Homo sapiens
agccagacucu

SEQ ID NO: 1012196 - RNA, 16 nt, Homo sapiens
agccagcaaugauguc

SEQ ID NO: 1012197 - RNA, 14 nt, Homo sapiens
agccagcacuugua

SEQ ID NO: 1012198 - RNA, 18 nt, Homo sapiens
agccagcagccagcucuc

SEQ ID NO: 1012199 - RNA, 22 nt, Homo sapiens
agccagcauccccaacugcgac

SEQ ID NO: 1012200 - RNA, 13 nt, Homo sapiens
agccagccaugca

SEQ ID NO: 1012201 - RNA, 16 nt, Homo sapiens
agccagccuugcuccu

SEQ ID NO: 1012202 - RNA, 17 nt, Homo sapiens
agccagcucauuucacu

SEQ ID NO: 1012203 - RNA, 14 nt, Homo sapiens
agccagggucucac

SEQ ID NO: 1012204 - RNA, 10 nt, Homo sapiens
agccagugac

SEQ ID NO: 1012205 - RNA, 21 nt, Homo sapiens
agccagugcggcagguucaca

SEQ ID NO: 1012206 - RNA, 17 nt, Homo sapiens
agccaguuguugccaac

SEQ ID NO: 1012207 - RNA, 22 nt, Homo sapiens
agccauaguggagagaacugaa

SEQ ID NO: 1012208 - RNA, 13 nt, Homo sapiens
agccauaugaaug

SEQ ID NO: 1012209 - RNA, 23 nt, Homo sapiens
agccaucaccuugauaaugggau

SEQ ID NO: 1012210 - RNA, 20 nt, Homo sapiens
agccauggacucuacacugu

SEQ ID NO: 1012211 - RNA, 13 nt, Homo sapiens
agcccaccccuca

SEQ ID NO: 1012212 - RNA, 15 nt, Homo sapiens
agcccaccccugugc

SEQ ID NO: 1012213 - RNA, 16 nt, Homo sapiens
agcccacuguuaauau

SEQ ID NO: 1012214 - RNA, 16 nt, Homo sapiens
agcccauccagucucc

SEQ ID NO: 1012215 - RNA, 16 nt, Homo sapiens
agcccauggcacucua

SEQ ID NO: 1012216 - RNA, 23 nt, Homo sapiens
agcccauggcuuuagcuaccuca

SEQ ID NO: 1012217 - RNA, 12 nt, Homo sapiens
agccccaaaagg

SEQ ID NO: 1012218 - RNA, 15 nt, Homo sapiens
agccccagugccaag

SEQ ID NO: 1012219 - RNA, 20 nt, Homo sapiens
agcccccccaacacugugcc

SEQ ID NO: 1012220 - RNA, 19 nt, Homo sapiens
agccccucuggacacagcc

SEQ ID NO: 1012221 - RNA, 20 nt, Homo sapiens
agccccuguauggcacuggc

SEQ ID NO: 1012222 - RNA, 16 nt, Homo sapiens
agcccuaagacguccc

SEQ ID NO: 1012223 - RNA, 13 nt, Homo sapiens
agcccuaccuaaa

SEQ ID NO: 1012224 - RNA, 18 nt, Homo sapiens
agcccuccaaaagcacuu

SEQ ID NO: 1012225 - RNA, 18 nt, Homo sapiens
agcccuccacgccggcuc

SEQ ID NO: 1012226 - RNA, 15 nt, Homo sapiens
agcccugaggugaaa

SEQ ID NO: 1012227 - RNA, 14 nt, Homo sapiens
agcccuuuacuuga

SEQ ID NO: 1012228 - RNA, 15 nt, Homo sapiens
agcccuuuacuugac

SEQ ID NO: 1012229 - RNA, 12 nt, Homo sapiens
agccgaccucag

SEQ ID NO: 1012230 - RNA, 16 nt, Homo sapiens
agccgcugcacaucac

SEQ ID NO: 1012231 - RNA, 13 nt, Homo sapiens
agccgcugugagc

SEQ ID NO: 1012232 - RNA, 21 nt, Homo sapiens
agccuacuuucacacuaagaa

SEQ ID NO: 1012233 - RNA, 19 nt, Homo sapiens
agccuagcccuucucucau

SEQ ID NO: 1012234 - RNA, 16 nt, Homo sapiens
agccuagccgaccuca

SEQ ID NO: 1012235 - RNA, 18 nt, Homo sapiens
agccuagccgaccucagc

SEQ ID NO: 1012236 - RNA, 21 nt, Homo sapiens
agccuaggggucagggaccaa

SEQ ID NO: 1012237 - RNA, 22 nt, Homo sapiens
agccuaugaggggguuuggcac

SEQ ID NO: 1012238 - RNA, 12 nt, Homo sapiens
agccucacuuau

SEQ ID NO: 1012239 - RNA, 14 nt, Homo sapiens
agccucaucucuuu

SEQ ID NO: 1012240 - RNA, 22 nt, Homo sapiens
agccuccccagcucaccccugg

SEQ ID NO: 1012241 - RNA, 18 nt, Homo sapiens
agccucccgaguagcugg

SEQ ID NO: 1012242 - RNA, 15 nt, Homo sapiens
agccuccucucucaa

SEQ ID NO: 1012243 - RNA, 19 nt, Homo sapiens
agccuccuuuugcuugaaa

SEQ ID NO: 1012244 - RNA, 16 nt, Homo sapiens
agccucugaaaaccaa

SEQ ID NO: 1012245 - RNA, 14 nt, Homo sapiens
agccucugaauaug

SEQ ID NO: 1012246 - RNA, 16 nt, Homo sapiens
agccucuggcauuaga

SEQ ID NO: 1012247 - RNA, 13 nt, Homo sapiens
agccucuggcuag

SEQ ID NO: 1012248 - RNA, 19 nt, Homo sapiens
agccugaauuuuguugcug

SEQ ID NO: 1012249 - RNA, 14 nt, Homo sapiens
agccugaguuugcu

SEQ ID NO: 1012250 - RNA, 15 nt, Homo sapiens
agccugcagaaucca

SEQ ID NO: 1012251 - RNA, 18 nt, Homo sapiens
agccugcagaauccagcu

SEQ ID NO: 1012252 - RNA, 23 nt, Homo sapiens
agccugcaguuauuaacacuaac

SEQ ID NO: 1012253 - RNA, 16 nt, Homo sapiens
agccugccucuuccag

SEQ ID NO: 1012254 - RNA, 18 nt, Homo sapiens
agccugccucuuccagga

SEQ ID NO: 1012255 - RNA, 17 nt, Homo sapiens
agccugcuccagcuguu

SEQ ID NO: 1012256 - RNA, 14 nt, Homo sapiens
agccuggaacauca

SEQ ID NO: 1012257 - RNA, 18 nt, Homo sapiens
agccuggagacucgugga

SEQ ID NO: 1012258 - RNA, 16 nt, Homo sapiens
agccugucucuuccau

SEQ ID NO: 1012259 - RNA, 23 nt, Homo sapiens
agccuguggcaucuuugccuugg

SEQ ID NO: 1012260 - RNA, 22 nt, Homo sapiens
agccuguuggacccgcucugga

SEQ ID NO: 1012261 - RNA, 19 nt, Homo sapiens
agccuuauuuaugauguau

SEQ ID NO: 1012262 - RNA, 18 nt, Homo sapiens
agaucauauacgugaaaa

SEQ ID NO: 1012263 - RNA, 14 nt, Homo sapiens
agaucccccagacu

SEQ ID NO: 1012264 - RNA, 19 nt, Homo sapiens
agauccccccacaaagugg

SEQ ID NO: 1012265 - RNA, 16 nt, Homo sapiens
agauccccguguuacu

SEQ ID NO: 1012266 - RNA, 17 nt, Homo sapiens
agauccuuaaugcagag

SEQ ID NO: 1012267 - RNA, 19 nt, Homo sapiens
agaucgcaucauugcacuc

SEQ ID NO: 1012268 - RNA, 17 nt, Homo sapiens
agaucgcgccacugcac

SEQ ID NO: 1012269 - RNA, 19 nt, Homo sapiens
agaucgcgccacugcacuc

SEQ ID NO: 1012270 - RNA, 14 nt, Homo sapiens
agaucuauguacug

SEQ ID NO: 1012271 - RNA, 18 nt, Homo sapiens
agaucuauguacuguaau

SEQ ID NO: 1012272 - RNA, 16 nt, Homo sapiens
agaucuccuggcaaag

SEQ ID NO: 1012273 - RNA, 22 nt, Homo sapiens
agaucuggucccuugcagcuag

SEQ ID NO: 1012274 - RNA, 17 nt, Homo sapiens
agaugaagacaacagca

SEQ ID NO: 1012275 - RNA, 19 nt, Homo sapiens
agaugaaucauugauugaa

SEQ ID NO: 1012276 - RNA, 20 nt, Homo sapiens
agaugaauguagcagauccc

SEQ ID NO: 1012277 - RNA, 14 nt, Homo sapiens
agaugaucaucucc

SEQ ID NO: 1012278 - RNA, 16 nt, Homo sapiens
agaugcaaugugcuac

SEQ ID NO: 1012279 - RNA, 20 nt, Homo sapiens
agaugcagaaaauugccuaa

SEQ ID NO: 1012280 - RNA, 14 nt, Homo sapiens
agaugcagcauuuu

SEQ ID NO: 1012281 - RNA, 18 nt, Homo sapiens
agaugccccagagcuguu

SEQ ID NO: 1012282 - RNA, 17 nt, Homo sapiens
agaugcucuaucuugcu

SEQ ID NO: 1012283 - RNA, 17 nt, Homo sapiens
agaugcuuuccugcaca

SEQ ID NO: 1012284 - RNA, 22 nt, Homo sapiens
agaugcuuuucugucucugccu

SEQ ID NO: 1012285 - RNA, 21 nt, Homo sapiens
agauggaaaagggagauucag

SEQ ID NO: 1012286 - RNA, 18 nt, Homo sapiens
agauggaauaaagcccuu

SEQ ID NO: 1012287 - RNA, 12 nt, Homo sapiens
agauggaguucu

SEQ ID NO: 1012288 - RNA, 20 nt, Homo sapiens
agauggaguucuugugccau

SEQ ID NO: 1012289 - RNA, 15 nt, Homo sapiens
agauggauugauaau

SEQ ID NO: 1012290 - RNA, 15 nt, Homo sapiens
agauggcaauuucac

SEQ ID NO: 1012291 - RNA, 21 nt, Homo sapiens
agaugggguuucacuguguug

SEQ ID NO: 1012292 - RNA, 22 nt, Homo sapiens
agauguaagaaauguucuugca

SEQ ID NO: 1012293 - RNA, 12 nt, Homo sapiens
agauguacuugu

SEQ ID NO: 1012294 - RNA, 21 nt, Homo sapiens
agauguagauaaacucagaaa

SEQ ID NO: 1012295 - RNA, 21 nt, Homo sapiens
agaugucugcagcccucagca

SEQ ID NO: 1012296 - RNA, 19 nt, Homo sapiens
agaugucuucguacaguuc

SEQ ID NO: 1012297 - RNA, 21 nt, Homo sapiens
agaugucuucguacaguucuu

SEQ ID NO: 1012298 - RNA, 19 nt, Homo sapiens
agaugucuucugccuguua

SEQ ID NO: 1012299 - RNA, 21 nt, Homo sapiens
agaugucuucugccuguuaua

SEQ ID NO: 1012300 - RNA, 19 nt, Homo sapiens
agaugugaacacaucagcu

SEQ ID NO: 1012301 - RNA, 22 nt, Homo sapiens
agaugugggcagugaugucacu

SEQ ID NO: 1012302 - RNA, 21 nt, Homo sapiens
agauguugaaaaaaauugucu

SEQ ID NO: 1012303 - RNA, 19 nt, Homo sapiens
agauguuugaggcuuucag

SEQ ID NO: 1012304 - RNA, 16 nt, Homo sapiens
agauuaaacaaacaaa

SEQ ID NO: 1012305 - RNA, 22 nt, Homo sapiens
agauuccaggcgaugugcaagu

SEQ ID NO: 1012306 - RNA, 22 nt, Homo sapiens
agauucuaauggcuuuauugca

SEQ ID NO: 1012307 - RNA, 13 nt, Homo sapiens
agauucuaccaca

SEQ ID NO: 1012308 - RNA, 22 nt, Homo sapiens
agauucuggcuagugucuauca

SEQ ID NO: 1012309 - RNA, 20 nt, Homo sapiens
agauugcaccauugcgcucu

SEQ ID NO: 1012310 - RNA, 23 nt, Homo sapiens
agauugugccacuucacuccagc

SEQ ID NO: 1012311 - RNA, 16 nt, Homo sapiens
agauuguuaaaauaac

SEQ ID NO: 1012312 - RNA, 17 nt, Homo sapiens
agauuuaaagcacaugc

SEQ ID NO: 1012313 - RNA, 15 nt, Homo sapiens
agauuuaaauccuuu

SEQ ID NO: 1012314 - RNA, 17 nt, Homo sapiens
agauuucagauuuguga

SEQ ID NO: 1012315 - RNA, 15 nt, Homo sapiens
agauuuccuaacucu

SEQ ID NO: 1012316 - RNA, 16 nt, Homo sapiens
agauuuuaugcugcug

SEQ ID NO: 1012317 - RNA, 22 nt, Homo sapiens
agauuuugaaugcuuccugaca

SEQ ID NO: 1012318 - RNA, 18 nt, Homo sapiens
agcaaaacuccaucucaa

SEQ ID NO: 1012319 - RNA, 18 nt, Homo sapiens
agcaaacacuuacagaau

SEQ ID NO: 1012320 - RNA, 18 nt, Homo sapiens
agcaaagggagcacuggg

SEQ ID NO: 1012321 - RNA, 17 nt, Homo sapiens
agcaaauaaagaccuga

SEQ ID NO: 1012322 - RNA, 14 nt, Homo sapiens
agcaaaucuaugag

SEQ ID NO: 1012323 - RNA, 12 nt, Homo sapiens
agcaaaugacaa

SEQ ID NO: 1012324 - RNA, 15 nt, Homo sapiens
agcaaauguggcucc

SEQ ID NO: 1012325 - RNA, 16 nt, Homo sapiens
agcaaauguggcuccu

SEQ ID NO: 1012326 - RNA, 23 nt, Homo sapiens
agcaacagacuucucaauaauca

SEQ ID NO: 1012327 - RNA, 18 nt, Homo sapiens
agcaacccaaauguucau

SEQ ID NO: 1012328 - RNA, 14 nt, Homo sapiens
agcaagcuauucaa

SEQ ID NO: 1012329 - RNA, 19 nt, Homo sapiens
agcaagucacuggccagug

SEQ ID NO: 1012330 - RNA, 21 nt, Homo sapiens
agcaagugaauuuuucucuaa

SEQ ID NO: 1012331 - RNA, 19 nt, Homo sapiens
agcaaguuucaucagucaa

SEQ ID NO: 1012332 - RNA, 19 nt, Homo sapiens
agcaaugacaucucagggg

SEQ ID NO: 1012333 - RNA, 17 nt, Homo sapiens
agcaauuccucugaaca

SEQ ID NO: 1012334 - RNA, 18 nt, Homo sapiens
agcaauucuccugccuca

SEQ ID NO: 1012335 - RNA, 20 nt, Homo sapiens
agcaauugacugucacuguu

SEQ ID NO: 1012336 - RNA, 22 nt, Homo sapiens
agcacaagcaggugaacuggga

SEQ ID NO: 1012337 - RNA, 14 nt, Homo sapiens
agcacaccuaucuu

SEQ ID NO: 1012338 - RNA, 12 nt, Homo sapiens
agcacacgucau

SEQ ID NO: 1012339 - RNA, 20 nt, Homo sapiens
agcacacuuggcccaagugg

SEQ ID NO: 1012340 - RNA, 17 nt, Homo sapiens
agcacagcacccauggg

SEQ ID NO: 1012341 - RNA, 20 nt, Homo sapiens
agcacagcagccccugcaca

SEQ ID NO: 1012342 - RNA, 18 nt, Homo sapiens
agcacaggcacugcagga

SEQ ID NO: 1012343 - RNA, 15 nt, Homo sapiens
agcacagugccugca

SEQ ID NO: 1012344 - RNA, 14 nt, Homo sapiens
agcaccaggggaug

SEQ ID NO: 1012345 - RNA, 21 nt, Homo sapiens
agcaccaucucuuuaccuccu

SEQ ID NO: 1012346 - RNA, 14 nt, Homo sapiens
agcacccaagccag

SEQ ID NO: 1012347 - RNA, 14 nt, Homo sapiens
agcaccccaugcca

SEQ ID NO: 1012348 - RNA, 20 nt, Homo sapiens
agcacccucuccagaugcag

SEQ ID NO: 1012349 - RNA, 21 nt, Homo sapiens
agcaccugcgggagcugcacu

SEQ ID NO: 1012350 - RNA, 22 nt, Homo sapiens
agcacggacucuuacugcuaac

SEQ ID NO: 1012351 - RNA, 20 nt, Homo sapiens
agcacguggagcucuuggcu

SEQ ID NO: 1012352 - RNA, 24 nt, Homo sapiens
agcacgugucucagacugcaugua

SEQ ID NO: 1012353 - RNA, 16 nt, Homo sapiens
acaggaggacaauuca

SEQ ID NO: 1012354 - RNA, 20 nt, Homo sapiens
acaggaugaaggcaaugcca

SEQ ID NO: 1012355 - RNA, 20 nt, Homo sapiens
acaggcacccaccaccaugc

SEQ ID NO: 1012356 - RNA, 13 nt, Homo sapiens
acaggcaccugcc

SEQ ID NO: 1012357 - RNA, 14 nt, Homo sapiens
acaggcccaagaga

SEQ ID NO: 1012358 - RNA, 20 nt, Homo sapiens
acagggcgagacuccgucuc

SEQ ID NO: 1012359 - RNA, 13 nt, Homo sapiens
acagggcucgccu

SEQ ID NO: 1012360 - RNA, 18 nt, Homo sapiens
acagggcugacauugugg

SEQ ID NO: 1012361 - RNA, 16 nt, Homo sapiens
acaggucacacgaggg

SEQ ID NO: 1012362 - RNA, 15 nt, Homo sapiens
acaggugugagucac

SEQ ID NO: 1012363 - RNA, 19 nt, Homo sapiens
acagguguuuauacagcuc

SEQ ID NO: 1012364 - RNA, 15 nt, Homo sapiens
acagguuacaacaga

SEQ ID NO: 1012365 - RNA, 13 nt, Homo sapiens
acaguaaaucuca

SEQ ID NO: 1012366 - RNA, 23 nt, Homo sapiens
acaguaaauggcuuauccagcug

SEQ ID NO: 1012367 - RNA, 21 nt, Homo sapiens
acaguacaggcagcacagaga

SEQ ID NO: 1012368 - RNA, 17 nt, Homo sapiens
acaguauacgcuccauc

SEQ ID NO: 1012369 - RNA, 14 nt, Homo sapiens
acagucacauucca

SEQ ID NO: 1012370 - RNA, 15 nt, Homo sapiens
acaguccugggagaa

SEQ ID NO: 1012371 - RNA, 22 nt, Homo sapiens
acaguccugggagaaccucagg

SEQ ID NO: 1012372 - RNA, 13 nt, Homo sapiens
acagucucaggaa

SEQ ID NO: 1012373 - RNA, 20 nt, Homo sapiens
acagucucaggaaaucaaau

SEQ ID NO: 1012374 - RNA, 18 nt, Homo sapiens
acagugaaaauguaagcu

SEQ ID NO: 1012375 - RNA, 22 nt, Homo sapiens
acagugaaaauguaagcuguuu

SEQ ID NO: 1012376 - RNA, 23 nt, Homo sapiens
acagugaaaauguaagcuguuua

SEQ ID NO: 1012377 - RNA, 18 nt, Homo sapiens
acagugaaggcuguccuu

SEQ ID NO: 1012378 - RNA, 19 nt, Homo sapiens
acagugagacucugucuca

SEQ ID NO: 1012379 - RNA, 21 nt, Homo sapiens
acagugagucgaggacaggga

SEQ ID NO: 1012380 - RNA, 22 nt, Homo sapiens
acagugcauuugccuugucacc

SEQ ID NO: 1012381 - RNA, 14 nt, Homo sapiens
acagugcccagggc

SEQ ID NO: 1012382 - RNA, 19 nt, Homo sapiens
acaguguugaaaauguuca

SEQ ID NO: 1012383 - RNA, 14 nt, Homo sapiens
acaguguugcccag

SEQ ID NO: 1012384 - RNA, 14 nt, Homo sapiens
acaguuacagagug

SEQ ID NO: 1012385 - RNA, 17 nt, Homo sapiens
acaguuagguagcuuua

SEQ ID NO: 1012386 - RNA, 21 nt, Homo sapiens
acaguucauguuugcuucaua

SEQ ID NO: 1012387 - RNA, 23 nt, Homo sapiens
acaguuuauuuuuauacuuucag

SEQ ID NO: 1012388 - RNA, 13 nt, Homo sapiens
acaguuugagacu

SEQ ID NO: 1012389 - RNA, 16 nt, Homo sapiens
acaguuugcuguacua

SEQ ID NO: 1012390 - RNA, 15 nt, Homo sapiens
acauaaaauagauuu

SEQ ID NO: 1012391 - RNA, 12 nt, Homo sapiens
acauaagacaga

SEQ ID NO: 1012392 - RNA, 17 nt, Homo sapiens
acauaaggaaacugggu

SEQ ID NO: 1012393 - RNA, 16 nt, Homo sapiens
acauaaguuaugguuu

SEQ ID NO: 1012394 - RNA, 15 nt, Homo sapiens
acauaaucuguacaa

SEQ ID NO: 1012395 - RNA, 21 nt, Homo sapiens
acauaaucuguacaaugaacc

SEQ ID NO: 1012396 - RNA, 15 nt, Homo sapiens
acauacaggauuuga

SEQ ID NO: 1012397 - RNA, 22 nt, Homo sapiens
acauacaggccauacuuuacaa

SEQ ID NO: 1012398 - RNA, 15 nt, Homo sapiens
acauacauccaacau

SEQ ID NO: 1012399 - RNA, 18 nt, Homo sapiens
acauacgcaccacaucuc

SEQ ID NO: 1012400 - RNA, 11 nt, Homo sapiens
acauacugcug

SEQ ID NO: 1012401 - RNA, 14 nt, Homo sapiens
acauacuucagcuc

SEQ ID NO: 1012402 - RNA, 13 nt, Homo sapiens
acauagagaucua

SEQ ID NO: 1012403 - RNA, 12 nt, Homo sapiens
acauagcacaga

SEQ ID NO: 1012404 - RNA, 14 nt, Homo sapiens
acauagcugugcua

SEQ ID NO: 1012405 - RNA, 23 nt, Homo sapiens
acauagugaaaccccaucucuac

SEQ ID NO: 1012406 - RNA, 13 nt, Homo sapiens
acauaucugucau

SEQ ID NO: 1012407 - RNA, 12 nt, Homo sapiens
acauaugcaccu

SEQ ID NO: 1012408 - RNA, 16 nt, Homo sapiens
acauauggacucugca

SEQ ID NO: 1012409 - RNA, 15 nt, Homo sapiens
acauauugagcacuu

SEQ ID NO: 1012410 - RNA, 21 nt, Homo sapiens
acauauuuguggaauaaugua

SEQ ID NO: 1012411 - RNA, 15 nt, Homo sapiens
acaucaacagauaaa

SEQ ID NO: 1012412 - RNA, 12 nt, Homo sapiens
acaucaagcaca

SEQ ID NO: 1012413 - RNA, 12 nt, Homo sapiens
acaucaaugaug

SEQ ID NO: 1012414 - RNA, 20 nt, Homo sapiens
acaucacuuguacaaaauaa

SEQ ID NO: 1012415 - RNA, 14 nt, Homo sapiens
acaucagcagagaa

SEQ ID NO: 1012416 - RNA, 15 nt, Homo sapiens
acaucaggaguucaa

SEQ ID NO: 1012417 - RNA, 16 nt, Homo sapiens
acaucaguuacucuga

SEQ ID NO: 1012418 - RNA, 19 nt, Homo sapiens
acauccacaugauaccucu

SEQ ID NO: 1012419 - RNA, 17 nt, Homo sapiens
acauccccuucugcaau

SEQ ID NO: 1012420 - RNA, 20 nt, Homo sapiens
acauccccuuuguguagaaa

SEQ ID NO: 1012421 - RNA, 22 nt, Homo sapiens
acaucucagacccuuuagccaa

SEQ ID NO: 1012422 - RNA, 23 nt, Homo sapiens
acaucucuuccuccgaggccagu

SEQ ID NO: 1012423 - RNA, 15 nt, Homo sapiens
acaucugcauuuuca

SEQ ID NO: 1012424 - RNA, 23 nt, Homo sapiens
acaucuucugccuuagucucagu

SEQ ID NO: 1012425 - RNA, 18 nt, Homo sapiens
acaucuugcucugcugac

SEQ ID NO: 1012426 - RNA, 13 nt, Homo sapiens
acaucuuucacau

SEQ ID NO: 1012427 - RNA, 13 nt, Homo sapiens
acaucuuuuacau

SEQ ID NO: 1012428 - RNA, 17 nt, Homo sapiens
acaucuuuuacauucug

SEQ ID NO: 1012429 - RNA, 18 nt, Homo sapiens
accccaaacuguugauua

SEQ ID NO: 1012430 - RNA, 15 nt, Homo sapiens
accccaacagcaccc

SEQ ID NO: 1012431 - RNA, 19 nt, Homo sapiens
accccaauuuacuugccau

SEQ ID NO: 1012432 - RNA, 16 nt, Homo sapiens
accccagcucaugccc

SEQ ID NO: 1012433 - RNA, 11 nt, Homo sapiens
accccagcugg

SEQ ID NO: 1012434 - RNA, 22 nt, Homo sapiens
accccaggacgcccucacugca

SEQ ID NO: 1012435 - RNA, 23 nt, Homo sapiens
accccagugguauccugugacau

SEQ ID NO: 1012436 - RNA, 15 nt, Homo sapiens
accccaucucuacua

SEQ ID NO: 1012437 - RNA, 14 nt, Homo sapiens
accccaugccaaag

SEQ ID NO: 1012438 - RNA, 11 nt, Homo sapiens
accccaugcug

SEQ ID NO: 1012439 - RNA, 16 nt, Homo sapiens
accccaugcuguugau

SEQ ID NO: 1012440 - RNA, 21 nt, Homo sapiens
acccccagcaacccuccuauc

SEQ ID NO: 1012441 - RNA, 12 nt, Homo sapiens
acccccaugaug

SEQ ID NO: 1012442 - RNA, 20 nt, Homo sapiens
accccgagccuggcuccaaa

SEQ ID NO: 1012443 - RNA, 20 nt, Homo sapiens
accccuccaggaaugaucuc

SEQ ID NO: 1012444 - RNA, 22 nt, Homo sapiens
accccugcucaguaaagcacuu

SEQ ID NO: 1012445 - RNA, 22 nt, Homo sapiens
accccugcuccccugagcugaa

SEQ ID NO: 1012446 - RNA, 13 nt, Homo sapiens
accccugucucua

SEQ ID NO: 1012447 - RNA, 23 nt, Homo sapiens
accccugucucuagccacuuugg

SEQ ID NO: 1012448 - RNA, 14 nt, Homo sapiens
accccuuagccucc

SEQ ID NO: 1012449 - RNA, 21 nt, Homo sapiens
accccuugcucucaacccagg

SEQ ID NO: 1012450 - RNA, 14 nt, Homo sapiens
acccgaugcugcuu

SEQ ID NO: 1012451 - RNA, 16 nt, Homo sapiens
acccuaaaucuugacu

SEQ ID NO: 1012452 - RNA, 21 nt, Homo sapiens
acccuaagccuccuuuugcuu

SEQ ID NO: 1012453 - RNA, 13 nt, Homo sapiens
acccuagucccuu

SEQ ID NO: 1012454 - RNA, 20 nt, Homo sapiens
acccuaugugggugggacca

SEQ ID NO: 1012455 - RNA, 21 nt, Homo sapiens
acccuauuuagaaauggauuu

SEQ ID NO: 1012456 - RNA, 22 nt, Homo sapiens
acccuccuuucaccacaugugc

SEQ ID NO: 1012457 - RNA, 18 nt, Homo sapiens
acccucuccccacugcuc

SEQ ID NO: 1012458 - RNA, 18 nt, Homo sapiens
acccugcaauaaacugcu

SEQ ID NO: 1012459 - RNA, 18 nt, Homo sapiens
acccugcuacacauacag

SEQ ID NO: 1012460 - RNA, 16 nt, Homo sapiens
acccugcuucaaauau

SEQ ID NO: 1012461 - RNA, 16 nt, Homo sapiens
acccuggagaguucaa

SEQ ID NO: 1012462 - RNA, 16 nt, Homo sapiens
acccugggaccacaga

SEQ ID NO: 1012463 - RNA, 22 nt, Homo sapiens
acccuuaggccagcaccaucuc

SEQ ID NO: 1012464 - RNA, 10 nt, Homo sapiens
acccuuccag

SEQ ID NO: 1012465 - RNA, 19 nt, Homo sapiens
acccuuccccacugcacac

SEQ ID NO: 1012466 - RNA, 18 nt, Homo sapiens
acccuucccuugagcccu

SEQ ID NO: 1012467 - RNA, 20 nt, Homo sapiens
acccuuuagacuguagccug

SEQ ID NO: 1012468 - RNA, 18 nt, Homo sapiens
accgagagagauggaaua

SEQ ID NO: 1012469 - RNA, 20 nt, Homo sapiens
accgagcgcuuucuggaaaa

SEQ ID NO: 1012470 - RNA, 16 nt, Homo sapiens
accgaguggcugucau

SEQ ID NO: 1012471 - RNA, 21 nt, Homo sapiens
accgcgcccagccucaucucu

SEQ ID NO: 1012472 - RNA, 18 nt, Homo sapiens
accggauggcggacaccu

SEQ ID NO: 1012473 - RNA, 16 nt, Homo sapiens
accggccggucacugc

SEQ ID NO: 1012474 - RNA, 21 nt, Homo sapiens
accguggccccaaauuugcua

SEQ ID NO: 1012475 - RNA, 17 nt, Homo sapiens
accgugggcucccugac

SEQ ID NO: 1012476 - RNA, 21 nt, Homo sapiens
accuaauguuuaugagccaga

SEQ ID NO: 1012477 - RNA, 14 nt, Homo sapiens
accuacaguguaca

SEQ ID NO: 1012478 - RNA, 12 nt, Homo sapiens
accuacugcuga

SEQ ID NO: 1012479 - RNA, 13 nt, Homo sapiens
accuacugcugag

SEQ ID NO: 1012480 - RNA, 21 nt, Homo sapiens
accuacuuugacuuuuugcau

SEQ ID NO: 1012481 - RNA, 23 nt, Homo sapiens
accuagaagggcuagaaccugga

SEQ ID NO: 1012482 - RNA, 11 nt, Homo sapiens
accuagcuuua

SEQ ID NO: 1012483 - RNA, 15 nt, Homo sapiens
accuaggggucuugu

SEQ ID NO: 1012484 - RNA, 17 nt, Homo sapiens
accuaguagucauuuca

SEQ ID NO: 1012485 - RNA, 12 nt, Homo sapiens
accuauguaaca

SEQ ID NO: 1012486 - RNA, 15 nt, Homo sapiens
accucacgcaccucc

SEQ ID NO: 1012487 - RNA, 17 nt, Homo sapiens
accucacgcaccuccca

SEQ ID NO: 1012488 - RNA, 16 nt, Homo sapiens
accucacuaugcugcu

SEQ ID NO: 1012489 - RNA, 22 nt, Homo sapiens
accucacuuuaggcagcuguaa

SEQ ID NO: 1012490 - RNA, 16 nt, Homo sapiens
accucagacuuaccag

SEQ ID NO: 1012491 - RNA, 22 nt, Homo sapiens
accucagaguauggagcucaga

SEQ ID NO: 1012492 - RNA, 16 nt, Homo sapiens
accucaggcagcucaa

SEQ ID NO: 1012493 - RNA, 23 nt, Homo sapiens
accucagguugcugguugcugug

SEQ ID NO: 1012494 - RNA, 22 nt, Homo sapiens
accucauagcuaauuuuugcaa

SEQ ID NO: 1012495 - RNA, 15 nt, Homo sapiens
accucaucucuacua

SEQ ID NO: 1012496 - RNA, 22 nt, Homo sapiens
accucauggggguauuguauaa

SEQ ID NO: 1012497 - RNA, 15 nt, Homo sapiens
accuccacauaccug

SEQ ID NO: 1012498 - RNA, 14 nt, Homo sapiens
accuccacugcugc

SEQ ID NO: 1012499 - RNA, 23 nt, Homo sapiens
accucccacugcccccuccacug

SEQ ID NO: 1012500 - RNA, 17 nt, Homo sapiens
accucccauccuaauca

SEQ ID NO: 1012501 - RNA, 15 nt, Homo sapiens
accuccccaacagca

SEQ ID NO: 1012502 - RNA, 22 nt, Homo sapiens
accucccccugaacacugugac

SEQ ID NO: 1012503 - RNA, 19 nt, Homo sapiens
accuccccugaggcucagg

SEQ ID NO: 1012504 - RNA, 16 nt, Homo sapiens
accuccuccucuggac

SEQ ID NO: 1012505 - RNA, 16 nt, Homo sapiens
acaauaguaauucuca

SEQ ID NO: 1012506 - RNA, 16 nt, Homo sapiens
acaaucaaagcacuug

SEQ ID NO: 1012507 - RNA, 19 nt, Homo sapiens
acaaucaucaucauucuca

SEQ ID NO: 1012508 - RNA, 15 nt, Homo sapiens
acaauccaucucuca

SEQ ID NO: 1012509 - RNA, 16 nt, Homo sapiens
acaauccaucucucaa

SEQ ID NO: 1012510 - RNA, 12 nt, Homo sapiens
acaaucuaaaag

SEQ ID NO: 1012511 - RNA, 16 nt, Homo sapiens
acaaugaaaugcucuc

SEQ ID NO: 1012512 - RNA, 19 nt, Homo sapiens
acaaugaacccccaugaug

SEQ ID NO: 1012513 - RNA, 20 nt, Homo sapiens
acaaugaacccccaugaugu

SEQ ID NO: 1012514 - RNA, 18 nt, Homo sapiens
acaaugacuuuauugcau

SEQ ID NO: 1012515 - RNA, 15 nt, Homo sapiens
acaaugcuuugcccc

SEQ ID NO: 1012516 - RNA, 14 nt, Homo sapiens
acaauggaaacuga

SEQ ID NO: 1012517 - RNA, 18 nt, Homo sapiens
acaauggcuaauucccag

SEQ ID NO: 1012518 - RNA, 13 nt, Homo sapiens
acaauuagccagg

SEQ ID NO: 1012519 - RNA, 14 nt, Homo sapiens
acaauuccaaacau

SEQ ID NO: 1012520 - RNA, 19 nt, Homo sapiens
acaauuccuccucuggcca

SEQ ID NO: 1012521 - RNA, 16 nt, Homo sapiens
acaauugaacuuaaau

SEQ ID NO: 1012522 - RNA, 15 nt, Homo sapiens
acacaaauuuguaaa

SEQ ID NO: 1012523 - RNA, 17 nt, Homo sapiens
acacaauucuucuucca

SEQ ID NO: 1012524 - RNA, 14 nt, Homo sapiens
acacacaauuacua

SEQ ID NO: 1012525 - RNA, 14 nt, Homo sapiens
acacacacacucac

SEQ ID NO: 1012526 - RNA, 13 nt, Homo sapiens
acacacacucacu

SEQ ID NO: 1012527 - RNA, 15 nt, Homo sapiens
acacaccaucuuucc

SEQ ID NO: 1012528 - RNA, 16 nt, Homo sapiens
acacaccugaacacau

SEQ ID NO: 1012529 - RNA, 20 nt, Homo sapiens
acacacuguugucaaaaagu

SEQ ID NO: 1012530 - RNA, 15 nt, Homo sapiens
acacagacugcgauu

SEQ ID NO: 1012531 - RNA, 19 nt, Homo sapiens
acacagagcaggacugcac

SEQ ID NO: 1012532 - RNA, 15 nt, Homo sapiens
acacagaucacagcu

SEQ ID NO: 1012533 - RNA, 22 nt, Homo sapiens
acacagcaagggugaugggaaa

SEQ ID NO: 1012534 - RNA, 15 nt, Homo sapiens
acacagcgagacucc

SEQ ID NO: 1012535 - RNA, 22 nt, Homo sapiens
acacagcgagacuccgucucaa

SEQ ID NO: 1012536 - RNA, 14 nt, Homo sapiens
acacagcucccaua

SEQ ID NO: 1012537 - RNA, 15 nt, Homo sapiens
acacaggaugaaggc

SEQ ID NO: 1012538 - RNA, 18 nt, Homo sapiens
acacaggcaaaauccuug

SEQ ID NO: 1012539 - RNA, 15 nt, Homo sapiens
acacaguuacagagu

SEQ ID NO: 1012540 - RNA, 22 nt, Homo sapiens
acacaugauccugcaauuccac

SEQ ID NO: 1012541 - RNA, 14 nt, Homo sapiens
acacauuaagccuu

SEQ ID NO: 1012542 - RNA, 16 nt, Homo sapiens
acacauuaagccuucc

SEQ ID NO: 1012543 - RNA, 16 nt, Homo sapiens
acacauuguacauggu

SEQ ID NO: 1012544 - RNA, 18 nt, Homo sapiens
acacauuuuucuuaggga

SEQ ID NO: 1012545 - RNA, 20 nt, Homo sapiens
acacauuuuuuaaaugcacc

SEQ ID NO: 1012546 - RNA, 16 nt, Homo sapiens
acaccacaaaucugaa

SEQ ID NO: 1012547 - RNA, 17 nt, Homo sapiens
acaccaggagagcuucu

SEQ ID NO: 1012548 - RNA, 13 nt, Homo sapiens
acaccaggcugug

SEQ ID NO: 1012549 - RNA, 17 nt, Homo sapiens
acaccagggaugguacu

SEQ ID NO: 1012550 - RNA, 11 nt, Homo sapiens
acaccaucucc

SEQ ID NO: 1012551 - RNA, 20 nt, Homo sapiens
acacccagcucagcauuucc

SEQ ID NO: 1012552 - RNA, 17 nt, Homo sapiens
acacccaugaaucaaag

SEQ ID NO: 1012553 - RNA, 23 nt, Homo sapiens
acacccuauauuuugcauaguac

SEQ ID NO: 1012554 - RNA, 11 nt, Homo sapiens
acacccuguga

SEQ ID NO: 1012555 - RNA, 15 nt, Homo sapiens
acaccggccuugcau

SEQ ID NO: 1012556 - RNA, 21 nt, Homo sapiens
acaccuccacaguucaguggc

SEQ ID NO: 1012557 - RNA, 15 nt, Homo sapiens
acaccugaccaauca

SEQ ID NO: 1012558 - RNA, 19 nt, Homo sapiens
acaccuugacagggcacac

SEQ ID NO: 1012559 - RNA, 14 nt, Homo sapiens
acacgcgaaaguau

SEQ ID NO: 1012560 - RNA, 14 nt, Homo sapiens
acacgcgugcacac

SEQ ID NO: 1012561 - RNA, 14 nt, Homo sapiens
acacggaggcaucu

SEQ ID NO: 1012562 - RNA, 20 nt, Homo sapiens
acacggaggucucuguaaaa

SEQ ID NO: 1012563 - RNA, 15 nt, Homo sapiens
acacggggcaguggc

SEQ ID NO: 1012564 - RNA, 18 nt, Homo sapiens
acacggggcuugcaacuu

SEQ ID NO: 1012565 - RNA, 15 nt, Homo sapiens
acacuaaaaggugac

SEQ ID NO: 1012566 - RNA, 12 nt, Homo sapiens
acacuaccacau

SEQ ID NO: 1012567 - RNA, 21 nt, Homo sapiens
acacuaguuuugugccagccg

SEQ ID NO: 1012568 - RNA, 20 nt, Homo sapiens
acacucaagaagcaggcuac

SEQ ID NO: 1012569 - RNA, 21 nt, Homo sapiens
acacucauccccucacuugcc

SEQ ID NO: 1012570 - RNA, 15 nt, Homo sapiens
acacuccagugccag

SEQ ID NO: 1012571 - RNA, 22 nt, Homo sapiens
acacuccagugccagcaaugac

SEQ ID NO: 1012572 - RNA, 18 nt, Homo sapiens
acacucuacuacauguga

SEQ ID NO: 1012573 - RNA, 19 nt, Homo sapiens
acacucuccaaacagucac

SEQ ID NO: 1012574 - RNA, 17 nt, Homo sapiens
acacugaaguuaacaga

SEQ ID NO: 1012575 - RNA, 21 nt, Homo sapiens
acacugaggcccaauggccuu

SEQ ID NO: 1012576 - RNA, 15 nt, Homo sapiens
acacugcaggcauca

SEQ ID NO: 1012577 - RNA, 12 nt, Homo sapiens
acacugcugcuc

SEQ ID NO: 1012578 - RNA, 19 nt, Homo sapiens
acacugcugcuccagugca

SEQ ID NO: 1012579 - RNA, 20 nt, Homo sapiens
acacugcugcuccagugcag

SEQ ID NO: 1012580 - RNA, 21 nt, Homo sapiens
acacugcugcuccagugcagg

SEQ ID NO: 1012581 - RNA, 16 nt, Homo sapiens
acacuggugugaccug

SEQ ID NO: 1012582 - RNA, 23 nt, Homo sapiens
acacuggugugaccugagggcag

SEQ ID NO: 1012583 - RNA, 18 nt, Homo sapiens
aauguauugagcauguga

SEQ ID NO: 1012584 - RNA, 20 nt, Homo sapiens
aaugucaaugaguaauucau

SEQ ID NO: 1012585 - RNA, 17 nt, Homo sapiens
aaugucaguauguggaa

SEQ ID NO: 1012586 - RNA, 12 nt, Homo sapiens
aaugucauucac

SEQ ID NO: 1012587 - RNA, 18 nt, Homo sapiens
aaugucuggucuguccac

SEQ ID NO: 1012588 - RNA, 16 nt, Homo sapiens
aaugucuguuaacuua

SEQ ID NO: 1012589 - RNA, 20 nt, Homo sapiens
aaugucuucuguauucacuu

SEQ ID NO: 1012590 - RNA, 21 nt, Homo sapiens
aaugucuuuugaauauuccca

SEQ ID NO: 1012591 - RNA, 18 nt, Homo sapiens
aaugucuuuuuaagcuua

SEQ ID NO: 1012592 - RNA, 19 nt, Homo sapiens
aaugucuuuuuaagcuuau

SEQ ID NO: 1012593 - RNA, 11 nt, Homo sapiens
aaugugcaaua

SEQ ID NO: 1012594 - RNA, 12 nt, Homo sapiens
aauguguacaaa

SEQ ID NO: 1012595 - RNA, 18 nt, Homo sapiens
aauguuacauuauuauca

SEQ ID NO: 1012596 - RNA, 19 nt, Homo sapiens
aauguuacugaucaugcau

SEQ ID NO: 1012597 - RNA, 19 nt, Homo sapiens
aauguuauucaauggaauc

SEQ ID NO: 1012598 - RNA, 21 nt, Homo sapiens
aauguuauuuuuuaauuauua

SEQ ID NO: 1012599 - RNA, 16 nt, Homo sapiens
aauguucaucaaugaa

SEQ ID NO: 1012600 - RNA, 13 nt, Homo sapiens
aauguuguucucu

SEQ ID NO: 1012601 - RNA, 22 nt, Homo sapiens
aauguuguuuuaggaauacaua

SEQ ID NO: 1012602 - RNA, 19 nt, Homo sapiens
aauguuuaagauaaacaga

SEQ ID NO: 1012603 - RNA, 14 nt, Homo sapiens
aauguuuacacucu

SEQ ID NO: 1012604 - RNA, 20 nt, Homo sapiens
aauguuuagcaaauacauau

SEQ ID NO: 1012605 - RNA, 16 nt, Homo sapiens
aauuaaaacaugcaca

SEQ ID NO: 1012606 - RNA, 17 nt, Homo sapiens
aauuaaaggaacagagu

SEQ ID NO: 1012607 - RNA, 17 nt, Homo sapiens
aauuaaccuggugcugg

SEQ ID NO: 1012608 - RNA, 18 nt, Homo sapiens
aauuaauauucauauuau

SEQ ID NO: 1012609 - RNA, 19 nt, Homo sapiens
aauuaaugacagagccagu

SEQ ID NO: 1012610 - RNA, 16 nt, Homo sapiens
aauuaauuuacuagaa

SEQ ID NO: 1012611 - RNA, 23 nt, Homo sapiens
aauuacuuugugaauagaacucu

SEQ ID NO: 1012612 - RNA, 24 nt, Homo sapiens
aauuaggaaagaaaaaaaguagga

SEQ ID NO: 1012613 - RNA, 19 nt, Homo sapiens
aauuagguuuuguacaauu

SEQ ID NO: 1012614 - RNA, 13 nt, Homo sapiens
aauuaguauuuau

SEQ ID NO: 1012615 - RNA, 14 nt, Homo sapiens
aauuaguggcacuu

SEQ ID NO: 1012616 - RNA, 17 nt, Homo sapiens
aauuaguggcacuugcu

SEQ ID NO: 1012617 - RNA, 21 nt, Homo sapiens
aauuaguuccucauuagcauu

SEQ ID NO: 1012618 - RNA, 18 nt, Homo sapiens
aauuaucgggaacagugu

SEQ ID NO: 1012619 - RNA, 12 nt, Homo sapiens
aauuaugccaua

SEQ ID NO: 1012620 - RNA, 15 nt, Homo sapiens
aauuaugcuuucuau

SEQ ID NO: 1012621 - RNA, 16 nt, Homo sapiens
aauuaugucugcugaa

SEQ ID NO: 1012622 - RNA, 20 nt, Homo sapiens
aauuauguuauuugcucuaa

SEQ ID NO: 1012623 - RNA, 16 nt, Homo sapiens
aauuauuuugacaaau

SEQ ID NO: 1012624 - RNA, 12 nt, Homo sapiens
aauucaaccacu

SEQ ID NO: 1012625 - RNA, 20 nt, Homo sapiens
aauucacccccuuuccugga

SEQ ID NO: 1012626 - RNA, 17 nt, Homo sapiens
aauucaucucucuuuaa

SEQ ID NO: 1012627 - RNA, 18 nt, Homo sapiens
aauuccaaacacauacag

SEQ ID NO: 1012628 - RNA, 23 nt, Homo sapiens
aauuccaguggaacagucuuccc

SEQ ID NO: 1012629 - RNA, 15 nt, Homo sapiens
aauucccuucaucug

SEQ ID NO: 1012630 - RNA, 13 nt, Homo sapiens
aauuccgcauuua

SEQ ID NO: 1012631 - RNA, 12 nt, Homo sapiens
aauuccuaguca

SEQ ID NO: 1012632 - RNA, 15 nt, Homo sapiens
aauucgagaagcaau

SEQ ID NO: 1012633 - RNA, 13 nt, Homo sapiens
aauucuacuuuga

SEQ ID NO: 1012634 - RNA, 20 nt, Homo sapiens
aauucuagcuuugagcuuaa

SEQ ID NO: 1012635 - RNA, 21 nt, Homo sapiens
aauucuauuacgugcaauacu

SEQ ID NO: 1012636 - RNA, 17 nt, Homo sapiens
aauucuauucugaucuu

SEQ ID NO: 1012637 - RNA, 16 nt, Homo sapiens
aauucucagaaucuca

SEQ ID NO: 1012638 - RNA, 22 nt, Homo sapiens
aauucucagucaguaauugcca

SEQ ID NO: 1012639 - RNA, 16 nt, Homo sapiens
aauucucaugugaucc

SEQ ID NO: 1012640 - RNA, 23 nt, Homo sapiens
aauucucaugugauccuuuuaug

SEQ ID NO: 1012641 - RNA, 17 nt, Homo sapiens
aauucucauuugucaca

SEQ ID NO: 1012642 - RNA, 16 nt, Homo sapiens
aauucuccugccucag

SEQ ID NO: 1012643 - RNA, 19 nt, Homo sapiens
aauucuccugccucagccu

SEQ ID NO: 1012644 - RNA, 24 nt, Homo sapiens
aauucucucaccucuaacaucaga

SEQ ID NO: 1012645 - RNA, 15 nt, Homo sapiens
aauucugaacuuuau

SEQ ID NO: 1012646 - RNA, 13 nt, Homo sapiens
aauucugcugucu

SEQ ID NO: 1012647 - RNA, 15 nt, Homo sapiens
aauucuuucaguggc

SEQ ID NO: 1012648 - RNA, 14 nt, Homo sapiens
aauugaacuaacaa

SEQ ID NO: 1012649 - RNA, 16 nt, Homo sapiens
aauugacccacaagaa

SEQ ID NO: 1012650 - RNA, 21 nt, Homo sapiens
aauugaccuuuugacuuaaag

SEQ ID NO: 1012651 - RNA, 16 nt, Homo sapiens
aauugauguuacugua

SEQ ID NO: 1012652 - RNA, 13 nt, Homo sapiens
aauugauuauucu

SEQ ID NO: 1012653 - RNA, 20 nt, Homo sapiens
aauugcacuuuuaaaccucu

SEQ ID NO: 1012654 - RNA, 13 nt, Homo sapiens
aauuggacaauaa

SEQ ID NO: 1012655 - RNA, 18 nt, Homo sapiens
aauuguaucaaaugugac

SEQ ID NO: 1012656 - RNA, 20 nt, Homo sapiens
aauugucuguuuguuuucuc

SEQ ID NO: 1012657 - RNA, 21 nt, Homo sapiens
aauugucuuuguucugugauu

SEQ ID NO: 1012658 - RNA, 17 nt, Homo sapiens
aauugugaucagaccau

SEQ ID NO: 1012659 - RNA, 19 nt, Homo sapiens
aauugugaucagaccauaa

SEQ ID NO: 1012660 - RNA, 12 nt, Homo sapiens
aauugugugaug

SEQ ID NO: 1012661 - RNA, 22 nt, Homo sapiens
aauuuaaaagacacuguuuaca

SEQ ID NO: 1012662 - RNA, 19 nt, Homo sapiens
aauuuaaaggguguacuua

SEQ ID NO: 1012663 - RNA, 20 nt, Homo sapiens
aauuuaucuugucucugggc

SEQ ID NO: 1012664 - RNA, 23 nt, Homo sapiens
aauuucacauuaauauuugcuga

SEQ ID NO: 1012665 - RNA, 15 nt, Homo sapiens
aauuucacugaugua

SEQ ID NO: 1012666 - RNA, 17 nt, Homo sapiens
aauuucuaaaaaacaga

SEQ ID NO: 1012667 - RNA, 14 nt, Homo sapiens
aauuucuacuuuga

SEQ ID NO: 1012668 - RNA, 14 nt, Homo sapiens
aauuugaaauuuag

SEQ ID NO: 1012669 - RNA, 16 nt, Homo sapiens
aauuugagauacaaac

SEQ ID NO: 1012670 - RNA, 21 nt, Homo sapiens
aauuugauguuuacaggugga

SEQ ID NO: 1012671 - RNA, 18 nt, Homo sapiens
aauuuggccugcacuaau

SEQ ID NO: 1012672 - RNA, 19 nt, Homo sapiens
aauuuguaauugcuuacau

SEQ ID NO: 1012673 - RNA, 12 nt, Homo sapiens
aauuuguacaua

SEQ ID NO: 1012674 - RNA, 14 nt, Homo sapiens
aauuuguguucuca

SEQ ID NO: 1012675 - RNA, 13 nt, Homo sapiens
aauuuuaauugaa

SEQ ID NO: 1012676 - RNA, 17 nt, Homo sapiens
aauuuuauaacagaauu

SEQ ID NO: 1012677 - RNA, 17 nt, Homo sapiens
aauuuuauuuacauucu

SEQ ID NO: 1012678 - RNA, 15 nt, Homo sapiens
aauuuucaguauaau

SEQ ID NO: 1012679 - RNA, 21 nt, Homo sapiens
aauuuucuagauuuucuacuu

SEQ ID NO: 1012680 - RNA, 21 nt, Homo sapiens
aauuuugccauaaagucaaau

SEQ ID NO: 1012681 - RNA, 23 nt, Homo sapiens
aauuuuguguguaccugugacua

SEQ ID NO: 1012682 - RNA, 21 nt, Homo sapiens
aauuuuucucuaacucagaaa

SEQ ID NO: 1012683 - RNA, 16 nt, Homo sapiens
acaaaaaaaccucuau

SEQ ID NO: 1012684 - RNA, 13 nt, Homo sapiens
acaaaaacacagc

SEQ ID NO: 1012685 - RNA, 17 nt, Homo sapiens
acaaaaacauggccuuu

SEQ ID NO: 1012686 - RNA, 16 nt, Homo sapiens
acaaaaagcuucccca

SEQ ID NO: 1012687 - RNA, 22 nt, Homo sapiens
acaaaaaugaaagcaugucuca

SEQ ID NO: 1012688 - RNA, 21 nt, Homo sapiens
acaaaaauguaaugaucauaa

SEQ ID NO: 1012689 - RNA, 13 nt, Homo sapiens
acaaaaauuagcu

SEQ ID NO: 1012690 - RNA, 11 nt, Homo sapiens
acaaaacagaa

SEQ ID NO: 1012691 - RNA, 20 nt, Homo sapiens
acaaaauaaccaauccugga

SEQ ID NO: 1012692 - RNA, 20 nt, Homo sapiens
acaaaauaaugcacuuccuu

SEQ ID NO: 1012693 - RNA, 16 nt, Homo sapiens
acaaacagcucaguuc

SEQ ID NO: 1012694 - RNA, 16 nt, Homo sapiens
acaaaccgagugcaau

SEQ ID NO: 1012695 - RNA, 20 nt, Homo sapiens
acaaacguauguaaauguau

SEQ ID NO: 1012696 - RNA, 22 nt, Homo sapiens
acaaacguauguaaauguauau

SEQ ID NO: 1012697 - RNA, 16 nt, Homo sapiens
acaaacuacauguaau

SEQ ID NO: 1012698 - RNA, 19 nt, Homo sapiens
acaaacucucccuucacuc

SEQ ID NO: 1012699 - RNA, 22 nt, Homo sapiens
acaaacuucccugacucuucaa

SEQ ID NO: 1012700 - RNA, 12 nt, Homo sapiens
acaaaugcaggg

SEQ ID NO: 1012701 - RNA, 18 nt, Homo sapiens
acaaaugccacacaucac

SEQ ID NO: 1012702 - RNA, 16 nt, Homo sapiens
acaaauuauguuacau

SEQ ID NO: 1012703 - RNA, 14 nt, Homo sapiens
acaaauugaacucu

SEQ ID NO: 1012704 - RNA, 17 nt, Homo sapiens
acaaauugcuugaaaga

SEQ ID NO: 1012705 - RNA, 14 nt, Homo sapiens
acaacaaaaagcuu

SEQ ID NO: 1012706 - RNA, 17 nt, Homo sapiens
acaacaaccuggucaca

SEQ ID NO: 1012707 - RNA, 14 nt, Homo sapiens
acaacagaagucau

SEQ ID NO: 1012708 - RNA, 12 nt, Homo sapiens
acaacagauuug

SEQ ID NO: 1012709 - RNA, 23 nt, Homo sapiens
acaacagcaaaacuccaucucaa

SEQ ID NO: 1012710 - RNA, 17 nt, Homo sapiens
acaacaucaagccugug

SEQ ID NO: 1012711 - RNA, 17 nt, Homo sapiens
acaacauguauaauauu

SEQ ID NO: 1012712 - RNA, 14 nt, Homo sapiens
acaacauuuacuua

SEQ ID NO: 1012713 - RNA, 19 nt, Homo sapiens
acaacauuuacuuaacaga

SEQ ID NO: 1012714 - RNA, 20 nt, Homo sapiens
acaaccaaaaaauucuacaa

SEQ ID NO: 1012715 - RNA, 21 nt, Homo sapiens
acaaccaugagaccacuguua

SEQ ID NO: 1012716 - RNA, 16 nt, Homo sapiens
acaacuaugauuugga

SEQ ID NO: 1012717 - RNA, 17 nt, Homo sapiens
acaacucagucccuaaa

SEQ ID NO: 1012718 - RNA, 12 nt, Homo sapiens
acaacugugguc

SEQ ID NO: 1012719 - RNA, 13 nt, Homo sapiens
acaacuucuuugu

SEQ ID NO: 1012720 - RNA, 22 nt, Homo sapiens
acaagaauuucuugguaagaag

SEQ ID NO: 1012721 - RNA, 17 nt, Homo sapiens
acaagagaagcugaugg

SEQ ID NO: 1012722 - RNA, 22 nt, Homo sapiens
acaagagcuuugguaaucucug

SEQ ID NO: 1012723 - RNA, 17 nt, Homo sapiens
acaagccaacuuguaaa

SEQ ID NO: 1012724 - RNA, 17 nt, Homo sapiens
acaagcuggaagcacau

SEQ ID NO: 1012725 - RNA, 17 nt, Homo sapiens
acaagcuuguccaugua

SEQ ID NO: 1012726 - RNA, 16 nt, Homo sapiens
acaaggaugacaagaa

SEQ ID NO: 1012727 - RNA, 17 nt, Homo sapiens
acaaggcuccacaagcg

SEQ ID NO: 1012728 - RNA, 11 nt, Homo sapiens
acaaguccagc

SEQ ID NO: 1012729 - RNA, 17 nt, Homo sapiens
acaagucgaugaacuau

SEQ ID NO: 1012730 - RNA, 18 nt, Homo sapiens
acaagugggugaaugugg

SEQ ID NO: 1012731 - RNA, 16 nt, Homo sapiens
acaauaaaacauuaau

SEQ ID NO: 1012732 - RNA, 16 nt, Homo sapiens
aaggucccuuguuucc

SEQ ID NO: 1012733 - RNA, 17 nt, Homo sapiens
aaggucccuuguuucca

SEQ ID NO: 1012734 - RNA, 22 nt, Homo sapiens
aagguccugcuauuacuaagga

SEQ ID NO: 1012735 - RNA, 22 nt, Homo sapiens
aaggucuucagauuucuugcau

SEQ ID NO: 1012736 - RNA, 16 nt, Homo sapiens
aaggugaaagugcagu

SEQ ID NO: 1012737 - RNA, 18 nt, Homo sapiens
aaggugacccaaugauuc

SEQ ID NO: 1012738 - RNA, 24 nt, Homo sapiens
aaggugugcucugaucauccacug

SEQ ID NO: 1012739 - RNA, 16 nt, Homo sapiens
aagguuccaacuggaa

SEQ ID NO: 1012740 - RNA, 11 nt, Homo sapiens
aagguucucuc

SEQ ID NO: 1012741 - RNA, 13 nt, Homo sapiens
aagguugugauga

SEQ ID NO: 1012742 - RNA, 15 nt, Homo sapiens
aaguaaaaccacagc

SEQ ID NO: 1012743 - RNA, 20 nt, Homo sapiens
aaguaaaacuugcugccuga

SEQ ID NO: 1012744 - RNA, 15 nt, Homo sapiens
aaguaaauauuucag

SEQ ID NO: 1012745 - RNA, 11 nt, Homo sapiens
aaguaagcaac

SEQ ID NO: 1012746 - RNA, 23 nt, Homo sapiens
aaguaauuaucgggaacaguguu

SEQ ID NO: 1012747 - RNA, 20 nt, Homo sapiens
aaguaauucugcugucucag

SEQ ID NO: 1012748 - RNA, 13 nt, Homo sapiens
aaguacauguauu

SEQ ID NO: 1012749 - RNA, 15 nt, Homo sapiens
aaguaccacucaggc

SEQ ID NO: 1012750 - RNA, 15 nt, Homo sapiens
aaguacuguaacugu

SEQ ID NO: 1012751 - RNA, 19 nt, Homo sapiens
aaguagaaaggggcccagu

SEQ ID NO: 1012752 - RNA, 16 nt, Homo sapiens
aaguagaauccuaaau

SEQ ID NO: 1012753 - RNA, 23 nt, Homo sapiens
aaguauaacugaguuaaauuaua

SEQ ID NO: 1012754 - RNA, 15 nt, Homo sapiens
aaguaucaugcauuc

SEQ ID NO: 1012755 - RNA, 12 nt, Homo sapiens
aaguauccuuca

SEQ ID NO: 1012756 - RNA, 19 nt, Homo sapiens
aaguauccuucagccugaa

SEQ ID NO: 1012757 - RNA, 18 nt, Homo sapiens
aaguauuauuuauuugaa

SEQ ID NO: 1012758 - RNA, 16 nt, Homo sapiens
aagucaaaugugugcu

SEQ ID NO: 1012759 - RNA, 12 nt, Homo sapiens
aagucacacagu

SEQ ID NO: 1012760 - RNA, 18 nt, Homo sapiens
aagucaccggagcuuuca

SEQ ID NO: 1012761 - RNA, 13 nt, Homo sapiens
aagucacucugag

SEQ ID NO: 1012762 - RNA, 21 nt, Homo sapiens
aagucagaggauggccagugu

SEQ ID NO: 1012763 - RNA, 22 nt, Homo sapiens
aagucaggacaucagucugauu

SEQ ID NO: 1012764 - RNA, 16 nt, Homo sapiens
aagucagguccaauuu

SEQ ID NO: 1012765 - RNA, 21 nt, Homo sapiens
aagucaucauaauucagcucu

SEQ ID NO: 1012766 - RNA, 17 nt, Homo sapiens
aaguccaauuccaaagc

SEQ ID NO: 1012767 - RNA, 23 nt, Homo sapiens
aaguccagaaacuguucccaccu

SEQ ID NO: 1012768 - RNA, 21 nt, Homo sapiens
aaguccagauuuacacuggga

SEQ ID NO: 1012769 - RNA, 22 nt, Homo sapiens
aaguccccgaguuuccccagac

SEQ ID NO: 1012770 - RNA, 20 nt, Homo sapiens
aagucccugacucucuguga

SEQ ID NO: 1012771 - RNA, 14 nt, Homo sapiens
aagucccuuuguga

SEQ ID NO: 1012772 - RNA, 19 nt, Homo sapiens
aaguccuucaccucacuga

SEQ ID NO: 1012773 - RNA, 16 nt, Homo sapiens
aagucgucuuaacuca

SEQ ID NO: 1012774 - RNA, 14 nt, Homo sapiens
aagucuuccauaga

SEQ ID NO: 1012775 - RNA, 18 nt, Homo sapiens
aagucuuugaagugacuu

SEQ ID NO: 1012776 - RNA, 13 nt, Homo sapiens
aagugaaacugcu

SEQ ID NO: 1012777 - RNA, 23 nt, Homo sapiens
aagugaagaaaagugaaugcuca

SEQ ID NO: 1012778 - RNA, 17 nt, Homo sapiens
aagugaagacaaugacu

SEQ ID NO: 1012779 - RNA, 18 nt, Homo sapiens
aagugaagagauccuucu

SEQ ID NO: 1012780 - RNA, 14 nt, Homo sapiens
aagugacucucaca

SEQ ID NO: 1012781 - RNA, 22 nt, Homo sapiens
aagugagacccugucucaaaaa

SEQ ID NO: 1012782 - RNA, 20 nt, Homo sapiens
aagugagcuccuaagccaug

SEQ ID NO: 1012783 - RNA, 21 nt, Homo sapiens
aagugaggcauugcacaggga

SEQ ID NO: 1012784 - RNA, 20 nt, Homo sapiens
aagugauccucccaccucag

SEQ ID NO: 1012785 - RNA, 18 nt, Homo sapiens
aagugcagucugauccag

SEQ ID NO: 1012786 - RNA, 16 nt, Homo sapiens
aagugcauccaaaggu

SEQ ID NO: 1012787 - RNA, 17 nt, Homo sapiens
aagugcauuaaacugaa

SEQ ID NO: 1012788 - RNA, 14 nt, Homo sapiens
aagugccugcaaaa

SEQ ID NO: 1012789 - RNA, 21 nt, Homo sapiens
aagugcugggauuacaggugu

SEQ ID NO: 1012790 - RNA, 14 nt, Homo sapiens
aaguggccaugcca

SEQ ID NO: 1012791 - RNA, 21 nt, Homo sapiens
aaguggugagaacuacucagg

SEQ ID NO: 1012792 - RNA, 14 nt, Homo sapiens
aaguguaauagauu

SEQ ID NO: 1012793 - RNA, 21 nt, Homo sapiens
aagugucugugugcaagugug

SEQ ID NO: 1012794 - RNA, 12 nt, Homo sapiens
aagugugugauc

SEQ ID NO: 1012795 - RNA, 11 nt, Homo sapiens
aaguguugcau

SEQ ID NO: 1012796 - RNA, 16 nt, Homo sapiens
aaguguuucuguuauu

SEQ ID NO: 1012797 - RNA, 15 nt, Homo sapiens
aaguuaacuuccaau

SEQ ID NO: 1012798 - RNA, 22 nt, Homo sapiens
aaguuagggaauggcacagccc

SEQ ID NO: 1012799 - RNA, 21 nt, Homo sapiens
aaguuagggaugacugugauu

SEQ ID NO: 1012800 - RNA, 17 nt, Homo sapiens
aaguucaacuuccagaa

SEQ ID NO: 1012801 - RNA, 17 nt, Homo sapiens
aaguucagcaugaagga

SEQ ID NO: 1012802 - RNA, 18 nt, Homo sapiens
aaguuccaguguucucuc

SEQ ID NO: 1012803 - RNA, 22 nt, Homo sapiens
aaguuccaguguucucucuuau

SEQ ID NO: 1012804 - RNA, 19 nt, Homo sapiens
aaguugaaugggcacagca

SEQ ID NO: 1012805 - RNA, 14 nt, Homo sapiens
aaguugaugcaauc

SEQ ID NO: 1012806 - RNA, 21 nt, Homo sapiens
aaguuggguuuucuccauuca

SEQ ID NO: 1012807 - RNA, 20 nt, Homo sapiens
aaguuguggugcugacaaag

SEQ ID NO: 1012808 - RNA, 16 nt, Homo sapiens
aaguuuaauugacuua

SEQ ID NO: 1012809 - RNA, 14 nt, Homo sapiens
aaguuuaucuuuca

SEQ ID NO: 1012810 - RNA, 15 nt, Homo sapiens
aaguuucaaugugau

SEQ ID NO: 1012811 - RNA, 13 nt, Homo sapiens
aaguuucacccaa

SEQ ID NO: 1012812 - RNA, 16 nt, Homo sapiens
aaguuucacugacuua

SEQ ID NO: 1012813 - RNA, 15 nt, Homo sapiens
aaguuucucagcucc

SEQ ID NO: 1012814 - RNA, 18 nt, Homo sapiens
aaguuucugcagcagaug

SEQ ID NO: 1012815 - RNA, 21 nt, Homo sapiens
aaguuuuguggaggagcucag

SEQ ID NO: 1012816 - RNA, 23 nt, Homo sapiens
aaguuuuuauggcuuuugugcau

SEQ ID NO: 1012817 - RNA, 12 nt, Homo sapiens
aauaaaaaagcc

SEQ ID NO: 1012818 - RNA, 15 nt, Homo sapiens
aagagaggaguucaa

SEQ ID NO: 1012819 - RNA, 19 nt, Homo sapiens
aagagaggaguucaaugau

SEQ ID NO: 1012820 - RNA, 13 nt, Homo sapiens
aagagauuccuga

SEQ ID NO: 1012821 - RNA, 23 nt, Homo sapiens
aagagauuccugagccaguguca

SEQ ID NO: 1012822 - RNA, 22 nt, Homo sapiens
aagagauuuuucaugauuuuga

SEQ ID NO: 1012823 - RNA, 21 nt, Homo sapiens
aagaggaaggccucuguggca

SEQ ID NO: 1012824 - RNA, 12 nt, Homo sapiens
aagaggagaaaa

SEQ ID NO: 1012825 - RNA, 22 nt, Homo sapiens
aagaggagaaaaaaacuucuuu

SEQ ID NO: 1012826 - RNA, 17 nt, Homo sapiens
aagagggaacuuagcag

SEQ ID NO: 1012827 - RNA, 17 nt, Homo sapiens
aagagggagaagggaug

SEQ ID NO: 1012828 - RNA, 21 nt, Homo sapiens
aagagguuuuaaaaaaauccc

SEQ ID NO: 1012829 - RNA, 15 nt, Homo sapiens
aagaguagcauuuca

SEQ ID NO: 1012830 - RNA, 15 nt, Homo sapiens
aagagugagagggca

SEQ ID NO: 1012831 - RNA, 23 nt, Homo sapiens
aagauaccuaaaagagauuucaa

SEQ ID NO: 1012832 - RNA, 23 nt, Homo sapiens
aagauacugaggaaugucuuuca

SEQ ID NO: 1012833 - RNA, 13 nt, Homo sapiens
aagauaucuugaa

SEQ ID NO: 1012834 - RNA, 18 nt, Homo sapiens
aagauaucuugaaaugaa

SEQ ID NO: 1012835 - RNA, 16 nt, Homo sapiens
aagauauuuuucauga

SEQ ID NO: 1012836 - RNA, 14 nt, Homo sapiens
aagauccuacccca

SEQ ID NO: 1012837 - RNA, 13 nt, Homo sapiens
aagaugaauacaa

SEQ ID NO: 1012838 - RNA, 22 nt, Homo sapiens
aagaugaaugagcaaaaccaaa

SEQ ID NO: 1012839 - RNA, 17 nt, Homo sapiens
aagaugaccuuugucuc

SEQ ID NO: 1012840 - RNA, 14 nt, Homo sapiens
aagaugaugcuauu

SEQ ID NO: 1012841 - RNA, 18 nt, Homo sapiens
aagauggcugacuuugcu

SEQ ID NO: 1012842 - RNA, 20 nt, Homo sapiens
aagaugggagcccaguuuca

SEQ ID NO: 1012843 - RNA, 22 nt, Homo sapiens
aagaugugggcagugaugucac

SEQ ID NO: 1012844 - RNA, 22 nt, Homo sapiens
aagauguguugcuauccugaaa

SEQ ID NO: 1012845 - RNA, 18 nt, Homo sapiens
aagauguuucaaaaaauc

SEQ ID NO: 1012846 - RNA, 19 nt, Homo sapiens
aagauucacaccugacucu

SEQ ID NO: 1012847 - RNA, 15 nt, Homo sapiens
aagauucauccauuu

SEQ ID NO: 1012848 - RNA, 17 nt, Homo sapiens
aagauucuccugugcua

SEQ ID NO: 1012849 - RNA, 13 nt, Homo sapiens
aagauugauacuu

SEQ ID NO: 1012850 - RNA, 21 nt, Homo sapiens
aagauugcgccauugcacucc

SEQ ID NO: 1012851 - RNA, 15 nt, Homo sapiens
aagcaaacacauuaa

SEQ ID NO: 1012852 - RNA, 13 nt, Homo sapiens
aagcaaacacuua

SEQ ID NO: 1012853 - RNA, 13 nt, Homo sapiens
aagcaacaucuag

SEQ ID NO: 1012854 - RNA, 20 nt, Homo sapiens
aagcaacaucuagcaaaugu

SEQ ID NO: 1012855 - RNA, 14 nt, Homo sapiens
aagcaacuguuaug

SEQ ID NO: 1012856 - RNA, 20 nt, Homo sapiens
aagcaagacuguugcucaaa

SEQ ID NO: 1012857 - RNA, 21 nt, Homo sapiens
aagcaaguuucaucagucaau

SEQ ID NO: 1012858 - RNA, 13 nt, Homo sapiens
aagcaaucugccc

SEQ ID NO: 1012859 - RNA, 19 nt, Homo sapiens
aagcaaucugcccauucau

SEQ ID NO: 1012860 - RNA, 11 nt, Homo sapiens
aagcacacuca

SEQ ID NO: 1012861 - RNA, 13 nt, Homo sapiens
aagcacaguuuga

SEQ ID NO: 1012862 - RNA, 12 nt, Homo sapiens
aagcaccaggac

SEQ ID NO: 1012863 - RNA, 11 nt, Homo sapiens
aagcacugccu

SEQ ID NO: 1012864 - RNA, 18 nt, Homo sapiens
aagcacuuggacucuugc

SEQ ID NO: 1012865 - RNA, 16 nt, Homo sapiens
aagcacuuugugcugu

SEQ ID NO: 1012866 - RNA, 22 nt, Homo sapiens
aagcagaaauacauauuuccaa

SEQ ID NO: 1012867 - RNA, 16 nt, Homo sapiens
aagcagaacagugauu

SEQ ID NO: 1012868 - RNA, 15 nt, Homo sapiens
aagcagaccacugau

SEQ ID NO: 1012869 - RNA, 20 nt, Homo sapiens
aagcagacccaccucccagc

SEQ ID NO: 1012870 - RNA, 21 nt, Homo sapiens
aagcagaugcaaagaggcaag

SEQ ID NO: 1012871 - RNA, 16 nt, Homo sapiens
aagcaggaagcucaga

SEQ ID NO: 1012872 - RNA, 19 nt, Homo sapiens
aagcaggacuaaaugucua

SEQ ID NO: 1012873 - RNA, 15 nt, Homo sapiens
aagcaggagaaucac

SEQ ID NO: 1012874 - RNA, 18 nt, Homo sapiens
aagcaggagaaucacuug

SEQ ID NO: 1012875 - RNA, 22 nt, Homo sapiens
aagcagggacuugaacccauau

SEQ ID NO: 1012876 - RNA, 17 nt, Homo sapiens
aagcaggugaacuggga

SEQ ID NO: 1012877 - RNA, 23 nt, Homo sapiens
aagcaugucucaauaguaaaaga

SEQ ID NO: 1012878 - RNA, 17 nt, Homo sapiens
aagcaugugagacuggu

SEQ ID NO: 1012879 - RNA, 19 nt, Homo sapiens
aagcauucacaacuuguuu

SEQ ID NO: 1012880 - RNA, 11 nt, Homo sapiens
aagcauuguaa

SEQ ID NO: 1012881 - RNA, 14 nt, Homo sapiens
aagcauuuacuuug

SEQ ID NO: 1012882 - RNA, 18 nt, Homo sapiens
aagcauuucuagcaguga

SEQ ID NO: 1012883 - RNA, 17 nt, Homo sapiens
aagccaaacucugccag

SEQ ID NO: 1012884 - RNA, 18 nt, Homo sapiens
aagccacauggcugggau

SEQ ID NO: 1012885 - RNA, 14 nt, Homo sapiens
aagccacgaaugaa

SEQ ID NO: 1012886 - RNA, 17 nt, Homo sapiens
aagccagaagcugagca

SEQ ID NO: 1012887 - RNA, 14 nt, Homo sapiens
aagccagacaucaa

SEQ ID NO: 1012888 - RNA, 20 nt, Homo sapiens
aagccagccaugcauuguua

SEQ ID NO: 1012889 - RNA, 23 nt, Homo sapiens
aagccauaguggagagaacugaa

SEQ ID NO: 1012890 - RNA, 15 nt, Homo sapiens
aagcccaauauuaua

SEQ ID NO: 1012891 - RNA, 15 nt, Homo sapiens
aagccccacuugaag

SEQ ID NO: 1012892 - RNA, 14 nt, Homo sapiens
aagccccugcccau

SEQ ID NO: 1012893 - RNA, 18 nt, Homo sapiens
aagcccuccccaucccau

SEQ ID NO: 1012894 - RNA, 13 nt, Homo sapiens
aagcccuugaacc

SEQ ID NO: 1012895 - RNA, 15 nt, Homo sapiens
aagccgugauuuuca

SEQ ID NO: 1012896 - RNA, 15 nt, Homo sapiens
aagccuaccaaugua

SEQ ID NO: 1012897 - RNA, 14 nt, Homo sapiens
aagccucaugucca

SEQ ID NO: 1012898 - RNA, 18 nt, Homo sapiens
aagccucuccagcaauaa

SEQ ID NO: 1012899 - RNA, 18 nt, Homo sapiens
aagccuggccuacauggu

SEQ ID NO: 1012900 - RNA, 16 nt, Homo sapiens
aagcgaugaaacugga

SEQ ID NO: 1012901 - RNA, 16 nt, Homo sapiens
aagcguucagugaugu

SEQ ID NO: 1012902 - RNA, 22 nt, Homo sapiens
aagcuaaaauuagaugaacuca

SEQ ID NO: 1012903 - RNA, 14 nt, Homo sapiens
aagcuaaauuccac

SEQ ID NO: 1012904 - RNA, 22 nt, Homo sapiens
aagcuauggugagaugcagcug

SEQ ID NO: 1012905 - RNA, 21 nt, Homo sapiens
aagcucaccuguugcuuacaa

SEQ ID NO: 1012906 - RNA, 18 nt, Homo sapiens
aagcucacuaagaagcuu

SEQ ID NO: 1012907 - RNA, 14 nt, Homo sapiens
aagcuccaccacuu

SEQ ID NO: 1012908 - RNA, 16 nt, Homo sapiens
aagcuccacugucacc

SEQ ID NO: 1012909 - RNA, 16 nt, Homo sapiens
aagcucccaagggaug

SEQ ID NO: 1012910 - RNA, 14 nt, Homo sapiens
aagcucugaaguca

SEQ ID NO: 1012911 - RNA, 23 nt, Homo sapiens
aagcucuggcugaacccugugcu

SEQ ID NO: 1012912 - RNA, 22 nt, Homo sapiens
aagcucuggugacaccagccuu

SEQ ID NO: 1012913 - RNA, 14 nt, Homo sapiens
aagcucuuguggua

SEQ ID NO: 1012914 - RNA, 14 nt, Homo sapiens
aagcugcucaggga

SEQ ID NO: 1012915 - RNA, 13 nt, Homo sapiens
aagcugcuuuaaa

SEQ ID NO: 1012916 - RNA, 16 nt, Homo sapiens
aagcugggagcacagg

SEQ ID NO: 1012917 - RNA, 22 nt, Homo sapiens
aagcugggagcacaggcacugc

SEQ ID NO: 1012918 - RNA, 22 nt, Homo sapiens
aagcuggugccccacugaauuu

SEQ ID NO: 1012919 - RNA, 14 nt, Homo sapiens
aagcugucagggac

SEQ ID NO: 1012920 - RNA, 21 nt, Homo sapiens
aagcugugagacagugggaaa

SEQ ID NO: 1012921 - RNA, 17 nt, Homo sapiens
aagcuguuguacauuua

SEQ ID NO: 1012922 - RNA, 16 nt, Homo sapiens
aagcuuaagugggcag

SEQ ID NO: 1012923 - RNA, 21 nt, Homo sapiens
aaggaaacuggguuccugcaa

SEQ ID NO: 1012924 - RNA, 22 nt, Homo sapiens
aaggaaacuugaaucaaagcag

SEQ ID NO: 1012925 - RNA, 21 nt, Homo sapiens
aaggaacauuccuuagucuca

SEQ ID NO: 1012926 - RNA, 22 nt, Homo sapiens
aaggaacucuggcuuccaggua

SEQ ID NO: 1012927 - RNA, 23 nt, Homo sapiens
aaggaagaaauuccaggaaaauc

SEQ ID NO: 1012928 - RNA, 20 nt, Homo sapiens
aaggacaccuuuuaacucac

SEQ ID NO: 1012929 - RNA, 21 nt, Homo sapiens
aaggacggccuucaacugaaa

SEQ ID NO: 1012930 - RNA, 22 nt, Homo sapiens
aaggacugccgaccgaggcugg

SEQ ID NO: 1012931 - RNA, 13 nt, Homo sapiens
aaggacugugaca

SEQ ID NO: 1012932 - RNA, 17 nt, Homo sapiens
aaggacuugacuugcaa

SEQ ID NO: 1012933 - RNA, 20 nt, Homo sapiens
aaggagacacaacaacuccu

SEQ ID NO: 1012934 - RNA, 14 nt, Homo sapiens
aaggagagcauagg

SEQ ID NO: 1012935 - RNA, 13 nt, Homo sapiens
aaggagauuuaca

SEQ ID NO: 1012936 - RNA, 21 nt, Homo sapiens
aaggaggcuuaggacuuucca

SEQ ID NO: 1012937 - RNA, 21 nt, Homo sapiens
aaggaguaaucuguguacaaa

SEQ ID NO: 1012938 - RNA, 17 nt, Homo sapiens
aaggaguccuugcauca

SEQ ID NO: 1012939 - RNA, 13 nt, Homo sapiens
aaggauggaccac

SEQ ID NO: 1012940 - RNA, 17 nt, Homo sapiens
aaggaugggaaggaggg

SEQ ID NO: 1012941 - RNA, 15 nt, Homo sapiens
aaggauucuguaugc

SEQ ID NO: 1012942 - RNA, 19 nt, Homo sapiens
aaggauuuuaugcuuuaaa

SEQ ID NO: 1012943 - RNA, 19 nt, Homo sapiens
aaggcaaugccauccucaa

SEQ ID NO: 1012944 - RNA, 13 nt, Homo sapiens
aaggcacagugaa

SEQ ID NO: 1012945 - RNA, 23 nt, Homo sapiens
aaggcaccuauaaaacaggucaa

SEQ ID NO: 1012946 - RNA, 21 nt, Homo sapiens
aaggccaagaaucaagcuaga

SEQ ID NO: 1012947 - RNA, 18 nt, Homo sapiens
aaggcggcuacaugccuc

SEQ ID NO: 1012948 - RNA, 24 nt, Homo sapiens
aaggcgugagucugcaucuuaggg

SEQ ID NO: 1012949 - RNA, 13 nt, Homo sapiens
aaggcuguugcau

SEQ ID NO: 1012950 - RNA, 17 nt, Homo sapiens
aaggcuuggcacacagc

SEQ ID NO: 1012951 - RNA, 13 nt, Homo sapiens
aagggaaacuauu

SEQ ID NO: 1012952 - RNA, 13 nt, Homo sapiens
aagggaacuucca

SEQ ID NO: 1012953 - RNA, 18 nt, Homo sapiens
aagggacaccaagccuug

SEQ ID NO: 1012954 - RNA, 19 nt, Homo sapiens
aagggacaccaagccuugg

SEQ ID NO: 1012955 - RNA, 17 nt, Homo sapiens
aagggauaguccaaaga

SEQ ID NO: 1012956 - RNA, 18 nt, Homo sapiens
aagggauaguccaaagac

SEQ ID NO: 1012957 - RNA, 18 nt, Homo sapiens
aagggauccguacauuca

SEQ ID NO: 1012958 - RNA, 14 nt, Homo sapiens
aagggcaucaucua

SEQ ID NO: 1012959 - RNA, 15 nt, Homo sapiens
aaggggcaggccaga

SEQ ID NO: 1012960 - RNA, 18 nt, Homo sapiens
aaggggcccaaauucuuu

SEQ ID NO: 1012961 - RNA, 14 nt, Homo sapiens
aaggggugggccac

SEQ ID NO: 1012962 - RNA, 15 nt, Homo sapiens
aaggguaucugguga

SEQ ID NO: 1012963 - RNA, 20 nt, Homo sapiens
aaggguucagagacucaggg
